United States Patent 7,655,785 (BIOINFORMATICALLY DETECTABLE GROUP OF NOVEL REGULATORY OLIGONUCLEOTIDES AND USES THEREOF) - sequence listing, part 48

SEQ ID NO: 1988214 - RNA, 19 nt, Homo sapiens
agaaauaagaauaaacuuu

SEQ ID NO: 1988215 - RNA, 15 nt, Homo sapiens
gaaucagaccugguu

SEQ ID NO: 1988216 - RNA, 20 nt, Homo sapiens
ggcuguugacgcaccugugg

SEQ ID NO: 1988217 - RNA, 16 nt, Homo sapiens
gccugggggcagugac

SEQ ID NO: 1988218 - RNA, 20 nt, Homo sapiens
ucccacccccagcagcucac

SEQ ID NO: 1988219 - RNA, 19 nt, Homo sapiens
ugucuguggcaaaaguuua

SEQ ID NO: 1988220 - RNA, 19 nt, Homo sapiens
gcacuauucuuuguauuac

SEQ ID NO: 1988221 - RNA, 15 nt, Homo sapiens
gagaaauacuuucag

SEQ ID NO: 1988222 - RNA, 17 nt, Homo sapiens
ucaggcaccugaaguga

SEQ ID NO: 1988223 - RNA, 14 nt, Homo sapiens
gugaccagggguga

SEQ ID NO: 1988224 - RNA, 21 nt, Homo sapiens
gacacucaaaacgcuacugag

SEQ ID NO: 1988225 - RNA, 13 nt, Homo sapiens
ucuuaauucccaa

SEQ ID NO: 1988226 - RNA, 16 nt, Homo sapiens
guccuggucaguuuuc

SEQ ID NO: 1988227 - RNA, 13 nt, Homo sapiens
ucuuccugaggaa

SEQ ID NO: 1988228 - RNA, 16 nt, Homo sapiens
augucuauaacuccuu

SEQ ID NO: 1988229 - RNA, 16 nt, Homo sapiens
gaaucccuuucucacu

SEQ ID NO: 1988230 - RNA, 13 nt, Homo sapiens
acuaccaguaucu

SEQ ID NO: 1988231 - RNA, 22 nt, Homo sapiens
aauauuagugauucugauuuca

SEQ ID NO: 1988232 - RNA, 21 nt, Homo sapiens
uguguagccuucuccccaaca

SEQ ID NO: 1988233 - RNA, 23 nt, Homo sapiens
caggaaccucagggcugugugua

SEQ ID NO: 1988234 - RNA, 23 nt, Homo sapiens
gacuuuuuguacugaaaacaauu

SEQ ID NO: 1988235 - RNA, 19 nt, Homo sapiens
ccagcccuugagucuguca

SEQ ID NO: 1988236 - RNA, 16 nt, Homo sapiens
gccuugacaacagacu

SEQ ID NO: 1988237 - RNA, 14 nt, Homo sapiens
gcuggagcuuccaa

SEQ ID NO: 1988238 - RNA, 15 nt, Homo sapiens
aguaaaaucuugccu

SEQ ID NO: 1988239 - RNA, 16 nt, Homo sapiens
cuacucccucuuccaa

SEQ ID NO: 1988240 - RNA, 21 nt, Homo sapiens
ugauuucccuucuucugucau

SEQ ID NO: 1988241 - RNA, 15 nt, Homo sapiens
ucuucuuugcuucuc

SEQ ID NO: 1988242 - RNA, 13 nt, Homo sapiens
agguuaugccaaa

SEQ ID NO: 1988243 - RNA, 22 nt, Homo sapiens
cuacuuuuuuuuaguucaauac

SEQ ID NO: 1988244 - RNA, 14 nt, Homo sapiens
ucagaggagcucua

SEQ ID NO: 1988245 - RNA, 18 nt, Homo sapiens
agaaaccacagucuuccc

SEQ ID NO: 1988246 - RNA, 13 nt, Homo sapiens
gugcagaacaaau

SEQ ID NO: 1988247 - RNA, 20 nt, Homo sapiens
ucaaggacgaauuugcacag

SEQ ID NO: 1988248 - RNA, 22 nt, Homo sapiens
gcgcaguguggaggccacuguu

SEQ ID NO: 1988249 - RNA, 17 nt, Homo sapiens
ucguuuaaaaacaaagg

SEQ ID NO: 1988250 - RNA, 20 nt, Homo sapiens
uaaaaaacuccugucuugcu

SEQ ID NO: 1988251 - RNA, 23 nt, Homo sapiens
agagaucuaaucccuucaaggaa

SEQ ID NO: 1988252 - RNA, 15 nt, Homo sapiens
gucugucacaggcug

SEQ ID NO: 1988253 - RNA, 17 nt, Homo sapiens
caaaugauuuccacaaa

SEQ ID NO: 1988254 - RNA, 15 nt, Homo sapiens
acuuaaaaaacugca

SEQ ID NO: 1988255 - RNA, 17 nt, Homo sapiens
caagcagucaguuugca

SEQ ID NO: 1988256 - RNA, 24 nt, Homo sapiens
cauccuuggaaauuggaagagcac

SEQ ID NO: 1988257 - RNA, 13 nt, Homo sapiens
aagacugucuuaa

SEQ ID NO: 1988258 - RNA, 18 nt, Homo sapiens
gucaguagugccugugau

SEQ ID NO: 1988259 - RNA, 14 nt, Homo sapiens
gugugaaaauucag

SEQ ID NO: 1988260 - RNA, 16 nt, Homo sapiens
caaccagaacuuucug

SEQ ID NO: 1988261 - RNA, 21 nt, Homo sapiens
gucuaccugcuggacagccuc

SEQ ID NO: 1988262 - RNA, 16 nt, Homo sapiens
uucuuuuucacacuga

SEQ ID NO: 1988263 - RNA, 22 nt, Homo sapiens
ggcaggcggaucaugaggucag

SEQ ID NO: 1988264 - RNA, 13 nt, Homo sapiens
aaguugaagcaca

SEQ ID NO: 1988265 - RNA, 18 nt, Homo sapiens
caauccugucauauaaua

SEQ ID NO: 1988266 - RNA, 18 nt, Homo sapiens
guuuccaaguuuauugcc

SEQ ID NO: 1988267 - RNA, 18 nt, Homo sapiens
cuauuuguucagaucuca

SEQ ID NO: 1988268 - RNA, 18 nt, Homo sapiens
auuuaucaacuguugaua

SEQ ID NO: 1988269 - RNA, 19 nt, Homo sapiens
ccugccucccuuucuggga

SEQ ID NO: 1988270 - RNA, 13 nt, Homo sapiens
ggcuccugugcua

SEQ ID NO: 1988271 - RNA, 20 nt, Homo sapiens
uacaauuucuuuugguucau

SEQ ID NO: 1988272 - RNA, 13 nt, Homo sapiens
aaucuuuuacugu

SEQ ID NO: 1988273 - RNA, 17 nt, Homo sapiens
cagcccucagacuguca

SEQ ID NO: 1988274 - RNA, 22 nt, Homo sapiens
cuuugaucccugacaucuggaa

SEQ ID NO: 1988275 - RNA, 18 nt, Homo sapiens
ucaacaucccuuaccucc

SEQ ID NO: 1988276 - RNA, 21 nt, Homo sapiens
aaugugucuugcugucauuua

SEQ ID NO: 1988277 - RNA, 16 nt, Homo sapiens
acagcacccuauauac

SEQ ID NO: 1988278 - RNA, 14 nt, Homo sapiens
ucuuacuugcccuu

SEQ ID NO: 1988279 - RNA, 17 nt, Homo sapiens
ccucuccuggaucaaaa

SEQ ID NO: 1988280 - RNA, 24 nt, Homo sapiens
ggggcugggcagcguacucaucau

SEQ ID NO: 1988281 - RNA, 14 nt, Homo sapiens
uggagggaauuuga

SEQ ID NO: 1988282 - RNA, 17 nt, Homo sapiens
cagacuuucuacaccug

SEQ ID NO: 1988283 - RNA, 23 nt, Homo sapiens
auguuaugcauuuuuuaccacaa

SEQ ID NO: 1988284 - RNA, 14 nt, Homo sapiens
acuuauaccaaagg

SEQ ID NO: 1988285 - RNA, 15 nt, Homo sapiens
guuuugcaagugcug

SEQ ID NO: 1988286 - RNA, 14 nt, Homo sapiens
gggaagcucagggg

SEQ ID NO: 1988287 - RNA, 16 nt, Homo sapiens
gcaucaucagccuauu

SEQ ID NO: 1988288 - RNA, 15 nt, Homo sapiens
ggcauuuugugaggc

SEQ ID NO: 1988289 - RNA, 17 nt, Homo sapiens
cuggacuuuugcagcuu

SEQ ID NO: 1988290 - RNA, 21 nt, Homo sapiens
accauaagugacaccaauaaa

SEQ ID NO: 1988291 - RNA, 17 nt, Homo sapiens
agaaaucuuuauucuua

SEQ ID NO: 1988292 - RNA, 15 nt, Homo sapiens
agaaagugacaugca

SEQ ID NO: 1988293 - RNA, 21 nt, Homo sapiens
aauuauaucacuucacuguuc

SEQ ID NO: 1988294 - RNA, 21 nt, Homo sapiens
uucccaacacuucagacugca

SEQ ID NO: 1988295 - RNA, 18 nt, Homo sapiens
gggagauuaaaaccagag

SEQ ID NO: 1988296 - RNA, 13 nt, Homo sapiens
caugcacugaugu

SEQ ID NO: 1988297 - RNA, 23 nt, Homo sapiens
cuuguauuuaauacacaaugcau

SEQ ID NO: 1988298 - RNA, 16 nt, Homo sapiens
aaguaggaaugcauuu

SEQ ID NO: 1988299 - RNA, 14 nt, Homo sapiens
aggcauucuggagu

SEQ ID NO: 1988300 - RNA, 16 nt, Homo sapiens
acccacugaaucugag

SEQ ID NO: 1988301 - RNA, 20 nt, Homo sapiens
cccccagccuggccagacaa

SEQ ID NO: 1988302 - RNA, 17 nt, Homo sapiens
uaaaugugguacaagca

SEQ ID NO: 1988303 - RNA, 22 nt, Homo sapiens
gcauguguaaaucugaaaaacu

SEQ ID NO: 1988304 - RNA, 19 nt, Homo sapiens
ugacuuugaacacaucucu

SEQ ID NO: 1988305 - RNA, 18 nt, Homo sapiens
uggccaggaaguagcaca

SEQ ID NO: 1988306 - RNA, 19 nt, Homo sapiens
uacaaaucaaagauuuguc

SEQ ID NO: 1988307 - RNA, 17 nt, Homo sapiens
auuuuagagcaucucau

SEQ ID NO: 1988308 - RNA, 17 nt, Homo sapiens
ccaaggaaucaugucag

SEQ ID NO: 1988309 - RNA, 12 nt, Homo sapiens
cuccuugauaaa

SEQ ID NO: 1988310 - RNA, 14 nt, Homo sapiens
ugauaaaccaaaau

SEQ ID NO: 1988311 - RNA, 20 nt, Homo sapiens
cuugaaagucaugaacacau

SEQ ID NO: 1988312 - RNA, 15 nt, Homo sapiens
agccaauuagcucua

SEQ ID NO: 1988313 - RNA, 14 nt, Homo sapiens
ucuuugucuaaaca

SEQ ID NO: 1988314 - RNA, 21 nt, Homo sapiens
cugaaaccucuguucucauga

SEQ ID NO: 1988315 - RNA, 20 nt, Homo sapiens
agccaagaucgcgccacugc

SEQ ID NO: 1988316 - RNA, 21 nt, Homo sapiens
ugauucucuugagauaagguu

SEQ ID NO: 1988317 - RNA, 19 nt, Homo sapiens
ucacccagguuggagugca

SEQ ID NO: 1988318 - RNA, 19 nt, Homo sapiens
uuacccaggcuggagugca

SEQ ID NO: 1988319 - RNA, 16 nt, Homo sapiens
ugaaaagacuccaaag

SEQ ID NO: 1988320 - RNA, 22 nt, Homo sapiens
guucucuacucccucuugucag

SEQ ID NO: 1988321 - RNA, 23 nt, Homo sapiens
ccaugaaaauagccaaccagcag

SEQ ID NO: 1988322 - RNA, 18 nt, Homo sapiens
ucccucaucugccagaaa

SEQ ID NO: 1988323 - RNA, 12 nt, Homo sapiens
cacuaccuuuau

SEQ ID NO: 1988324 - RNA, 20 nt, Homo sapiens
guguuauuauuuugcacugu

SEQ ID NO: 1988325 - RNA, 16 nt, Homo sapiens
auuuauauucaaggau

SEQ ID NO: 1988326 - RNA, 13 nt, Homo sapiens
ugcuugauuccag

SEQ ID NO: 1988327 - RNA, 19 nt, Homo sapiens
accuugaguugaguauuac

SEQ ID NO: 1988328 - RNA, 17 nt, Homo sapiens
agcugaauuauuggaca

SEQ ID NO: 1988329 - RNA, 21 nt, Homo sapiens
ccucuuuuguuguccuugccc

SEQ ID NO: 1988330 - RNA, 22 nt, Homo sapiens
acgauuauaguaccacugcaca

SEQ ID NO: 1988331 - RNA, 13 nt, Homo sapiens
ugaaguugcugag

SEQ ID NO: 1988332 - RNA, 16 nt, Homo sapiens
aauaguucaguagaau

SEQ ID NO: 1988333 - RNA, 21 nt, Homo sapiens
cagaguguguuuuugcacugu

SEQ ID NO: 1988334 - RNA, 22 nt, Homo sapiens
ccucucccucccuaacagugaa

SEQ ID NO: 1988335 - RNA, 12 nt, Homo sapiens
aguagcuccuug

SEQ ID NO: 1988336 - RNA, 23 nt, Homo sapiens
uagcaaaauuuggggaaauccau

SEQ ID NO: 1988337 - RNA, 15 nt, Homo sapiens
aagcagugucuguca

SEQ ID NO: 1988338 - RNA, 23 nt, Homo sapiens
cucauuugaaugcuuaauucaau

SEQ ID NO: 1988339 - RNA, 16 nt, Homo sapiens
ccaaauaagaagggau

SEQ ID NO: 1988340 - RNA, 14 nt, Homo sapiens
gcacgcccaugugu

SEQ ID NO: 1988341 - RNA, 14 nt, Homo sapiens
acuauggaaaauca

SEQ ID NO: 1988342 - RNA, 18 nt, Homo sapiens
aauugcuuuuaucagugu

SEQ ID NO: 1988343 - RNA, 13 nt, Homo sapiens
uaaagccaagaau

SEQ ID NO: 1988344 - RNA, 19 nt, Homo sapiens
uuuagauguuuaccuucag

SEQ ID NO: 1988345 - RNA, 17 nt, Homo sapiens
guugccuaagcauugcc

SEQ ID NO: 1988346 - RNA, 21 nt, Homo sapiens
agcuuugagcuuaagaauuuu

SEQ ID NO: 1988347 - RNA, 22 nt, Homo sapiens
aaugaaaccugugucucugaga

SEQ ID NO: 1988348 - RNA, 16 nt, Homo sapiens
agagccagcaggucaa

SEQ ID NO: 1988349 - RNA, 20 nt, Homo sapiens
caccaugaugugaagaguuu

SEQ ID NO: 1988350 - RNA, 19 nt, Homo sapiens
gcccuuuuauacuaggacu

SEQ ID NO: 1988351 - RNA, 16 nt, Homo sapiens
ucauugcuaaccacug

SEQ ID NO: 1988352 - RNA, 14 nt, Homo sapiens
uaagaauguucaua

SEQ ID NO: 1988353 - RNA, 15 nt, Homo sapiens
aagcaacagcuggac

SEQ ID NO: 1988354 - RNA, 18 nt, Homo sapiens
ucaaagagauggugcuaa

SEQ ID NO: 1988355 - RNA, 18 nt, Homo sapiens
uccuggggcagcacuccc

SEQ ID NO: 1988356 - RNA, 19 nt, Homo sapiens
cgggcgucaggggugcaca

SEQ ID NO: 1988357 - RNA, 15 nt, Homo sapiens
ccucucugagucaaa

SEQ ID NO: 1988358 - RNA, 21 nt, Homo sapiens
cugcacccacgugcauucaca

SEQ ID NO: 1988359 - RNA, 17 nt, Homo sapiens
guuaauuucauuccaaa

SEQ ID NO: 1988360 - RNA, 21 nt, Homo sapiens
gaaagucaggcuagcugugcu

SEQ ID NO: 1988361 - RNA, 18 nt, Homo sapiens
auuucuuuuauguuaacu

SEQ ID NO: 1988362 - RNA, 17 nt, Homo sapiens
guuuuuaaaaaucuguu

SEQ ID NO: 1988363 - RNA, 15 nt, Homo sapiens
uugaaaacaacaaaa

SEQ ID NO: 1988364 - RNA, 14 nt, Homo sapiens
uguucucuguccag

SEQ ID NO: 1988365 - RNA, 15 nt, Homo sapiens
gacucgcuagcacuc

SEQ ID NO: 1988366 - RNA, 22 nt, Homo sapiens
cugggcccucucugcucugcgu

SEQ ID NO: 1988367 - RNA, 21 nt, Homo sapiens
ccuuugaaguagacucauucu

SEQ ID NO: 1988368 - RNA, 13 nt, Homo sapiens
aacaauugguaaa

SEQ ID NO: 1988369 - RNA, 15 nt, Homo sapiens
aaggaaaaagcagag

SEQ ID NO: 1988370 - RNA, 17 nt, Homo sapiens
caugauuagauugcaaa

SEQ ID NO: 1988371 - RNA, 19 nt, Homo sapiens
caggacuccaucucuuaaa

SEQ ID NO: 1988372 - RNA, 18 nt, Homo sapiens
auguauuuuucacaaagg

SEQ ID NO: 1988373 - RNA, 23 nt, Homo sapiens
aggcaugagcuacuaugcccaac

SEQ ID NO: 1988374 - RNA, 18 nt, Homo sapiens
caccaacaacgcuuguga

SEQ ID NO: 1988375 - RNA, 22 nt, Homo sapiens
agggacugguccaggcaugggu

SEQ ID NO: 1988376 - RNA, 17 nt, Homo sapiens
auucauuguggucauag

SEQ ID NO: 1988377 - RNA, 14 nt, Homo sapiens
uccaaagcuuuauu

SEQ ID NO: 1988378 - RNA, 19 nt, Homo sapiens
cccacaugccaauuucagc

SEQ ID NO: 1988379 - RNA, 12 nt, Homo sapiens
cacaaucugaca

SEQ ID NO: 1988380 - RNA, 12 nt, Homo sapiens
cuauaucuguau

SEQ ID NO: 1988381 - RNA, 13 nt, Homo sapiens
ggacuuguaggga

SEQ ID NO: 1988382 - RNA, 17 nt, Homo sapiens
augagcuagugucuuau

SEQ ID NO: 1988383 - RNA, 14 nt, Homo sapiens
ccuucucaacuggg

SEQ ID NO: 1988384 - RNA, 14 nt, Homo sapiens
uuguauaggccauc

SEQ ID NO: 1988385 - RNA, 21 nt, Homo sapiens
gacuaaucuuugcugaagcug

SEQ ID NO: 1988386 - RNA, 15 nt, Homo sapiens
aacucacacauuccc

SEQ ID NO: 1988387 - RNA, 15 nt, Homo sapiens
ccuuccaaaccucaa

SEQ ID NO: 1988388 - RNA, 12 nt, Homo sapiens
cugugugcugac

SEQ ID NO: 1988389 - RNA, 19 nt, Homo sapiens
cuuaaugguauccuacuga

SEQ ID NO: 1988390 - RNA, 18 nt, Homo sapiens
aagaucucgguuugccaa

SEQ ID NO: 1988391 - RNA, 13 nt, Homo sapiens
agggaacagugcc

SEQ ID NO: 1988392 - RNA, 19 nt, Homo sapiens
cacaucugugucucuggaa

SEQ ID NO: 1988393 - RNA, 16 nt, Homo sapiens
acucaggcagugcagu

SEQ ID NO: 1988394 - RNA, 13 nt, Homo sapiens
ccucagugccuuc

SEQ ID NO: 1988395 - RNA, 16 nt, Homo sapiens
acugaugaaaucugcu

SEQ ID NO: 1988396 - RNA, 15 nt, Homo sapiens
cugcacuauuugccg

SEQ ID NO: 1988397 - RNA, 21 nt, Homo sapiens
cgccugucaauaaauguugaa

SEQ ID NO: 1988398 - RNA, 21 nt, Homo sapiens
gcagcuggggagcagcugaga

SEQ ID NO: 1988399 - RNA, 21 nt, Homo sapiens
gaaaaucaaugcuuuaucuga

SEQ ID NO: 1988400 - RNA, 20 nt, Homo sapiens
ugcaguuccugaguaccuuc

SEQ ID NO: 1988401 - RNA, 17 nt, Homo sapiens
auuacccuucuuuccau

SEQ ID NO: 1988402 - RNA, 19 nt, Homo sapiens
ucugccacuugcacugugc

SEQ ID NO: 1988403 - RNA, 21 nt, Homo sapiens
gaauggagggaaugcucagaa

SEQ ID NO: 1988404 - RNA, 19 nt, Homo sapiens
uucacuuaaguuaguucca

SEQ ID NO: 1988405 - RNA, 17 nt, Homo sapiens
ugauuuugaaaccauga

SEQ ID NO: 1988406 - RNA, 12 nt, Homo sapiens
auaaucuggugu

SEQ ID NO: 1988407 - RNA, 15 nt, Homo sapiens
accuaguuugcacua

SEQ ID NO: 1988408 - RNA, 19 nt, Homo sapiens
gcggugugugugccauguc

SEQ ID NO: 1988409 - RNA, 16 nt, Homo sapiens
auuucuuaacauauua

SEQ ID NO: 1988410 - RNA, 13 nt, Homo sapiens
acuggagugaaug

SEQ ID NO: 1988411 - RNA, 14 nt, Homo sapiens
ccuccaucagccag

SEQ ID NO: 1988412 - RNA, 22 nt, Homo sapiens
uacacucgucccccuccugccu

SEQ ID NO: 1988413 - RNA, 16 nt, Homo sapiens
auuccacuccacucag

SEQ ID NO: 1988414 - RNA, 17 nt, Homo sapiens
aauaaaucugacccagu

SEQ ID NO: 1988415 - RNA, 17 nt, Homo sapiens
uguaaguugaccuucuc

SEQ ID NO: 1988416 - RNA, 18 nt, Homo sapiens
uagaggaggcaacacuga

SEQ ID NO: 1988417 - RNA, 22 nt, Homo sapiens
cucgcaaacguuucuugaacaa

SEQ ID NO: 1988418 - RNA, 22 nt, Homo sapiens
cugucucuacuaaaaauacaau

SEQ ID NO: 1988419 - RNA, 22 nt, Homo sapiens
gggaagcgaugaauuuggagac

SEQ ID NO: 1988420 - RNA, 21 nt, Homo sapiens
uaagacauuuguuaggccauu

SEQ ID NO: 1988421 - RNA, 17 nt, Homo sapiens
ugaaugucuuacuguga

SEQ ID NO: 1988422 - RNA, 16 nt, Homo sapiens
caaggcauccaugaaa

SEQ ID NO: 1988423 - RNA, 15 nt, Homo sapiens
uauuccuuuucccag

SEQ ID NO: 1988424 - RNA, 13 nt, Homo sapiens
cuggcgugcagug

SEQ ID NO: 1988425 - RNA, 13 nt, Homo sapiens
cugggaacagccg

SEQ ID NO: 1988426 - RNA, 14 nt, Homo sapiens
uacauuuaggcauu

SEQ ID NO: 1988427 - RNA, 14 nt, Homo sapiens
cuccuuucuugcac

SEQ ID NO: 1988428 - RNA, 22 nt, Homo sapiens
ugcgggcucccuggcaggaugc

SEQ ID NO: 1988429 - RNA, 18 nt, Homo sapiens
uauauacuuugccacugc

SEQ ID NO: 1988430 - RNA, 19 nt, Homo sapiens
gcagguugaucaccugagg

SEQ ID NO: 1988431 - RNA, 10 nt, Homo sapiens
aacuauuuau

SEQ ID NO: 1988432 - RNA, 15 nt, Homo sapiens
gcuguucugcacuga

SEQ ID NO: 1988433 - RNA, 23 nt, Homo sapiens
ccugucuuagccucccaaagugc

SEQ ID NO: 1988434 - RNA, 22 nt, Homo sapiens
caaagcaacaguccacacuuug

SEQ ID NO: 1988435 - RNA, 14 nt, Homo sapiens
ccugcugauaccac

SEQ ID NO: 1988436 - RNA, 11 nt, Homo sapiens
cuuuugugcau

SEQ ID NO: 1988437 - RNA, 19 nt, Homo sapiens
cccaacuagacauuaccaa

SEQ ID NO: 1988438 - RNA, 12 nt, Homo sapiens
cuuuuacauucu

SEQ ID NO: 1988439 - RNA, 12 nt, Homo sapiens
cacauacauaua

SEQ ID NO: 1988440 - RNA, 18 nt, Homo sapiens
aaauuuggccucuggccu

SEQ ID NO: 1988441 - RNA, 15 nt, Homo sapiens
ucccugcugugccau

SEQ ID NO: 1988442 - RNA, 23 nt, Homo sapiens
ugaauagccaggccugaccucaa

SEQ ID NO: 1988443 - RNA, 17 nt, Homo sapiens
gaaacccuugagcucaa

SEQ ID NO: 1988444 - RNA, 22 nt, Homo sapiens
cuguaaauguauucauucuuaa

SEQ ID NO: 1988445 - RNA, 16 nt, Homo sapiens
cugugucccacaggga

SEQ ID NO: 1988446 - RNA, 13 nt, Homo sapiens
aagaaacauguga

SEQ ID NO: 1988447 - RNA, 16 nt, Homo sapiens
auuucugaacuguuac

SEQ ID NO: 1988448 - RNA, 19 nt, Homo sapiens
cuauauaaaaaacauaaua

SEQ ID NO: 1988449 - RNA, 13 nt, Homo sapiens
ugcggaauuccac

SEQ ID NO: 1988450 - RNA, 16 nt, Homo sapiens
cuguccccacacugac

SEQ ID NO: 1988451 - RNA, 12 nt, Homo sapiens
uauauguagauu

SEQ ID NO: 1988452 - RNA, 16 nt, Homo sapiens
agccaucacaugaucu

SEQ ID NO: 1988453 - RNA, 22 nt, Homo sapiens
uguguaauaaauauguuucaca

SEQ ID NO: 1988454 - RNA, 14 nt, Homo sapiens
guuaugacagccau

SEQ ID NO: 1988455 - RNA, 21 nt, Homo sapiens
uuaacaauuaauuuucuauga

SEQ ID NO: 1988456 - RNA, 10 nt, Homo sapiens
gaaggccauu

SEQ ID NO: 1988457 - RNA, 23 nt, Homo sapiens
ggguuggcaccuucccccucccc

SEQ ID NO: 1988458 - RNA, 20 nt, Homo sapiens
cagagaaggccuuacagaaa

SEQ ID NO: 1988459 - RNA, 16 nt, Homo sapiens
aaucgaauacaaauca

SEQ ID NO: 1988460 - RNA, 19 nt, Homo sapiens
cuucuuuuauaacuagucc

SEQ ID NO: 1988461 - RNA, 21 nt, Homo sapiens
agcacacacacacaguccuca

SEQ ID NO: 1988462 - RNA, 21 nt, Homo sapiens
ccucuuggaccucugcucuga

SEQ ID NO: 1988463 - RNA, 19 nt, Homo sapiens
aagucaggugucaucauca

SEQ ID NO: 1988464 - RNA, 15 nt, Homo sapiens
agguaguacugggaa

SEQ ID NO: 1988465 - RNA, 13 nt, Homo sapiens
auucacuacaggu

SEQ ID NO: 1988466 - RNA, 17 nt, Homo sapiens
agguucaggaagaccac

SEQ ID NO: 1988467 - RNA, 17 nt, Homo sapiens
ggaacugguucaagaga

SEQ ID NO: 1988468 - RNA, 17 nt, Homo sapiens
ccugucuccucugucag

SEQ ID NO: 1988469 - RNA, 16 nt, Homo sapiens
agggacucccacaaca

SEQ ID NO: 1988470 - RNA, 17 nt, Homo sapiens
guuaggccauucuugca

SEQ ID NO: 1988471 - RNA, 23 nt, Homo sapiens
aaaauuagagugcauuacuuuga

SEQ ID NO: 1988472 - RNA, 20 nt, Homo sapiens
caucccuggcugaccugcug

SEQ ID NO: 1988473 - RNA, 19 nt, Homo sapiens
ugaugagaauuguauguca

SEQ ID NO: 1988474 - RNA, 20 nt, Homo sapiens
gaucaucgaggagcuagaac

SEQ ID NO: 1988475 - RNA, 11 nt, Homo sapiens
agaucaugaca

SEQ ID NO: 1988476 - RNA, 18 nt, Homo sapiens
acaguugguucaucccuu

SEQ ID NO: 1988477 - RNA, 15 nt, Homo sapiens
aaagcaggugcaaca

SEQ ID NO: 1988478 - RNA, 11 nt, Homo sapiens
ugaagcacugu

SEQ ID NO: 1988479 - RNA, 21 nt, Homo sapiens
gaaaucucaaaacuguacugu

SEQ ID NO: 1988480 - RNA, 20 nt, Homo sapiens
ggauuacagguguaagccac

SEQ ID NO: 1988481 - RNA, 13 nt, Homo sapiens
gcaguauguugcc

SEQ ID NO: 1988482 - RNA, 12 nt, Homo sapiens
cggagcugccag

SEQ ID NO: 1988483 - RNA, 16 nt, Homo sapiens
cacaguugagugaaau

SEQ ID NO: 1988484 - RNA, 14 nt, Homo sapiens
uguucuuaauugca

SEQ ID NO: 1988485 - RNA, 14 nt, Homo sapiens
uauugaucuuugcc

SEQ ID NO: 1988486 - RNA, 17 nt, Homo sapiens
agauaguguaacuugcu

SEQ ID NO: 1988487 - RNA, 21 nt, Homo sapiens
uaauauauuuuuugaacuuug

SEQ ID NO: 1988488 - RNA, 21 nt, Homo sapiens
aggauaugaguacauacucaa

SEQ ID NO: 1988489 - RNA, 12 nt, Homo sapiens
cuacuggcugua

SEQ ID NO: 1988490 - RNA, 23 nt, Homo sapiens
cccgccccagggcccacuagcau

SEQ ID NO: 1988491 - RNA, 17 nt, Homo sapiens
uuguaagucccaugaau

SEQ ID NO: 1988492 - RNA, 21 nt, Homo sapiens
acucagguggcccuacuggga

SEQ ID NO: 1988493 - RNA, 23 nt, Homo sapiens
accaacuuauaaagcauugcaac

SEQ ID NO: 1988494 - RNA, 10 nt, Homo sapiens
gugaccuucu

SEQ ID NO: 1988495 - RNA, 16 nt, Homo sapiens
uucacaauuugaaaag

SEQ ID NO: 1988496 - RNA, 16 nt, Homo sapiens
caguaugucacucugg

SEQ ID NO: 1988497 - RNA, 23 nt, Homo sapiens
acauauucuuuaaauuucaucuc

SEQ ID NO: 1988498 - RNA, 21 nt, Homo sapiens
ucuccagccugggaggcacag

SEQ ID NO: 1988499 - RNA, 14 nt, Homo sapiens
aguguuaccuguua

SEQ ID NO: 1988500 - RNA, 17 nt, Homo sapiens
agcaaaucgugccuugu

SEQ ID NO: 1988501 - RNA, 19 nt, Homo sapiens
uggcaauaaggaucuuccc

SEQ ID NO: 1988502 - RNA, 22 nt, Homo sapiens
gccuguaaucccaacacuuuug

SEQ ID NO: 1988503 - RNA, 18 nt, Homo sapiens
cgguggcggcagggccag

SEQ ID NO: 1988504 - RNA, 17 nt, Homo sapiens
cuccuuuugaccaaaua

SEQ ID NO: 1988505 - RNA, 18 nt, Homo sapiens
aacccccagccccuccau

SEQ ID NO: 1988506 - RNA, 17 nt, Homo sapiens
caacuaacguacauuca

SEQ ID NO: 1988507 - RNA, 18 nt, Homo sapiens
uaacaaauugaguuuaga

SEQ ID NO: 1988508 - RNA, 17 nt, Homo sapiens
gcaaaugcauggcaaau

SEQ ID NO: 1988509 - RNA, 23 nt, Homo sapiens
guggagacccugccacagccaga

SEQ ID NO: 1988510 - RNA, 17 nt, Homo sapiens
gauauuaauaauuccaa

SEQ ID NO: 1988511 - RNA, 17 nt, Homo sapiens
ggaaaggugcucaaaga

SEQ ID NO: 1988512 - RNA, 17 nt, Homo sapiens
agcaugugugacuuuca

SEQ ID NO: 1988513 - RNA, 16 nt, Homo sapiens
caauaaggcagugcag

SEQ ID NO: 1988514 - RNA, 21 nt, Homo sapiens
agcagauggacagcgaugagg

SEQ ID NO: 1988515 - RNA, 20 nt, Homo sapiens
cccaaagcucagacuugcca

SEQ ID NO: 1988516 - RNA, 21 nt, Homo sapiens
ccucagcagccucacugcauc

SEQ ID NO: 1988517 - RNA, 16 nt, Homo sapiens
gccaauaaaugaacug

SEQ ID NO: 1988518 - RNA, 16 nt, Homo sapiens
caccucagaguggagu

SEQ ID NO: 1988519 - RNA, 18 nt, Homo sapiens
agacaggguuucgccaug

SEQ ID NO: 1988520 - RNA, 12 nt, Homo sapiens
ucagaucucaug

SEQ ID NO: 1988521 - RNA, 14 nt, Homo sapiens
ccugcucuccgcac

SEQ ID NO: 1988522 - RNA, 18 nt, Homo sapiens
uugagaguugcuggugua

SEQ ID NO: 1988523 - RNA, 19 nt, Homo sapiens
aaaaauuuugugacauucc

SEQ ID NO: 1988524 - RNA, 16 nt, Homo sapiens
gauucucgcuuaaaaa

SEQ ID NO: 1988525 - RNA, 17 nt, Homo sapiens
gucaaggaaagggcagu

SEQ ID NO: 1988526 - RNA, 21 nt, Homo sapiens
uguaaugauacugauuaugaa

SEQ ID NO: 1988527 - RNA, 14 nt, Homo sapiens
gcuuuaugcccuug

SEQ ID NO: 1988528 - RNA, 18 nt, Homo sapiens
acucuagggaaaaaccag

SEQ ID NO: 1988529 - RNA, 16 nt, Homo sapiens
cccaagggcuccagac

SEQ ID NO: 1988530 - RNA, 16 nt, Homo sapiens
ggauguucugggacac

SEQ ID NO: 1988531 - RNA, 20 nt, Homo sapiens
aagccagacagcaacgggga

SEQ ID NO: 1988532 - RNA, 15 nt, Homo sapiens
acaaauuuaacuuuu

SEQ ID NO: 1988533 - RNA, 14 nt, Homo sapiens
cuaaauaggagaua

SEQ ID NO: 1988534 - RNA, 18 nt, Homo sapiens
uccaaaggaaauccaaaa

SEQ ID NO: 1988535 - RNA, 22 nt, Homo sapiens
ccaucaauaccuguacuaugau

SEQ ID NO: 1988536 - RNA, 22 nt, Homo sapiens
aauauuguguugugcagcauua

SEQ ID NO: 1988537 - RNA, 20 nt, Homo sapiens
gcuuccaacaaggacagccc

SEQ ID NO: 1988538 - RNA, 17 nt, Homo sapiens
caauuuaaaauuauuca

SEQ ID NO: 1988539 - RNA, 17 nt, Homo sapiens
cccuggggcaggggugc

SEQ ID NO: 1988540 - RNA, 21 nt, Homo sapiens
aaugaaguguuuuacaaugau

SEQ ID NO: 1988541 - RNA, 15 nt, Homo sapiens
agcaucauugaucuu

SEQ ID NO: 1988542 - RNA, 18 nt, Homo sapiens
cuuacccucccaccacuc

SEQ ID NO: 1988543 - RNA, 20 nt, Homo sapiens
ggccuccucuucuaugcuuu

SEQ ID NO: 1988544 - RNA, 20 nt, Homo sapiens
gcaggugacauuugcucuga

SEQ ID NO: 1988545 - RNA, 17 nt, Homo sapiens
caucccacugacuguau

SEQ ID NO: 1988546 - RNA, 20 nt, Homo sapiens
agcuggaaauaaaccuggag

SEQ ID NO: 1988547 - RNA, 12 nt, Homo sapiens
uacucugaaauu

SEQ ID NO: 1988548 - RNA, 22 nt, Homo sapiens
ucucccucccuuggggccuaug

SEQ ID NO: 1988549 - RNA, 14 nt, Homo sapiens
caacagaaguauca

SEQ ID NO: 1988550 - RNA, 14 nt, Homo sapiens
ucuaggugcuuuaa

SEQ ID NO: 1988551 - RNA, 13 nt, Homo sapiens
uguuuauuacuua

SEQ ID NO: 1988552 - RNA, 14 nt, Homo sapiens
ugagcgaggacauu

SEQ ID NO: 1988553 - RNA, 18 nt, Homo sapiens
cugagaccaguguaucag

SEQ ID NO: 1988554 - RNA, 15 nt, Homo sapiens
guauauuugucauga

SEQ ID NO: 1988555 - RNA, 19 nt, Homo sapiens
ugcacauuuuguacaaaga

SEQ ID NO: 1988556 - RNA, 21 nt, Homo sapiens
ugaaaacgucuuccuucuuua

SEQ ID NO: 1988557 - RNA, 17 nt, Homo sapiens
accugcuuagcugccuu

SEQ ID NO: 1988558 - RNA, 22 nt, Homo sapiens
agugacuugugucccaugaucc

SEQ ID NO: 1988559 - RNA, 15 nt, Homo sapiens
aaaggagacauauca

SEQ ID NO: 1988560 - RNA, 18 nt, Homo sapiens
aacuaugaggaugugcug

SEQ ID NO: 1988561 - RNA, 14 nt, Homo sapiens
ugucuguacuucau

SEQ ID NO: 1988562 - RNA, 19 nt, Homo sapiens
aaguuggguucacuugcca

SEQ ID NO: 1988563 - RNA, 22 nt, Homo sapiens
guagauacaggggcaaaaguca

SEQ ID NO: 1988564 - RNA, 19 nt, Homo sapiens
aaucauaaaacuugaugug

SEQ ID NO: 1988565 - RNA, 18 nt, Homo sapiens
ccccucaguguugucacc

SEQ ID NO: 1988566 - RNA, 19 nt, Homo sapiens
aaaguuuagccccugaaag

SEQ ID NO: 1988567 - RNA, 16 nt, Homo sapiens
augauggugacaugau

SEQ ID NO: 1988568 - RNA, 13 nt, Homo sapiens
guggaggggcccu

SEQ ID NO: 1988569 - RNA, 13 nt, Homo sapiens
aaauuuucaagca

SEQ ID NO: 1988570 - RNA, 17 nt, Homo sapiens
augcagaguugacauga

SEQ ID NO: 1988571 - RNA, 18 nt, Homo sapiens
gagccugcccucacuccc

SEQ ID NO: 1988572 - RNA, 16 nt, Homo sapiens
uaauagacacugggga

SEQ ID NO: 1988573 - RNA, 23 nt, Homo sapiens
agcaacuuguguuacaaaaauac

SEQ ID NO: 1988574 - RNA, 19 nt, Homo sapiens
cuggaggcugagcugcauc

SEQ ID NO: 1988575 - RNA, 21 nt, Homo sapiens
aauaauaaaguagcaaaacaa

SEQ ID NO: 1988576 - RNA, 15 nt, Homo sapiens
aauaagaucuagucu

SEQ ID NO: 1988577 - RNA, 18 nt, Homo sapiens
uuaucuggaaaauuccag

SEQ ID NO: 1988578 - RNA, 15 nt, Homo sapiens
cuucaucccaaagga

SEQ ID NO: 1988579 - RNA, 21 nt, Homo sapiens
agaccaaguuaucaucucacc

SEQ ID NO: 1988580 - RNA, 16 nt, Homo sapiens
caccuacuaugugcug

SEQ ID NO: 1988581 - RNA, 22 nt, Homo sapiens
aaagaguugcaguaaaguucca

SEQ ID NO: 1988582 - RNA, 17 nt, Homo sapiens
uccuguuuacacucggg

SEQ ID NO: 1988583 - RNA, 14 nt, Homo sapiens
cuuucuaaauugca

SEQ ID NO: 1988584 - RNA, 12 nt, Homo sapiens
uucaagucuucu

SEQ ID NO: 1988585 - RNA, 11 nt, Homo sapiens
cuuucucucag

SEQ ID NO: 1988586 - RNA, 23 nt, Homo sapiens
caaacauccuacaagacacagug

SEQ ID NO: 1988587 - RNA, 13 nt, Homo sapiens
gcccaucugucca

SEQ ID NO: 1988588 - RNA, 20 nt, Homo sapiens
agaaagcugcacuggugcua

SEQ ID NO: 1988589 - RNA, 16 nt, Homo sapiens
cugauaggacccauau

SEQ ID NO: 1988590 - RNA, 16 nt, Homo sapiens
acugaaucucaccugc

SEQ ID NO: 1988591 - RNA, 19 nt, Homo sapiens
auuccugaaauaaugcaag

SEQ ID NO: 1988592 - RNA, 21 nt, Homo sapiens
caugcagccagccaucaaaua

SEQ ID NO: 1988593 - RNA, 18 nt, Homo sapiens
aggaugucacagggccaa

SEQ ID NO: 1988594 - RNA, 12 nt, Homo sapiens
ucugcacucuaa

SEQ ID NO: 1988595 - RNA, 13 nt, Homo sapiens
ucauauguucuca

SEQ ID NO: 1988596 - RNA, 17 nt, Homo sapiens
gcccauuuccauggugc

SEQ ID NO: 1988597 - RNA, 12 nt, Homo sapiens
acuuuaaaacca

SEQ ID NO: 1988598 - RNA, 16 nt, Homo sapiens
acauccuucuguggcu

SEQ ID NO: 1988599 - RNA, 15 nt, Homo sapiens
aaugguuucaaguua

SEQ ID NO: 1988600 - RNA, 13 nt, Homo sapiens
guccagugcaacc

SEQ ID NO: 1988601 - RNA, 21 nt, Homo sapiens
cuugcacaggccacuugcuca

SEQ ID NO: 1988602 - RNA, 20 nt, Homo sapiens
aacuccaugaccaggccacc

SEQ ID NO: 1988603 - RNA, 15 nt, Homo sapiens
aauaaauuaugcaau

SEQ ID NO: 1988604 - RNA, 17 nt, Homo sapiens
uauuuuauuuagacaag

SEQ ID NO: 1988605 - RNA, 13 nt, Homo sapiens
aaguugaggggag

SEQ ID NO: 1988606 - RNA, 21 nt, Homo sapiens
cuguuuuuuuaagaaagugca

SEQ ID NO: 1988607 - RNA, 14 nt, Homo sapiens
acacaccuugccca

SEQ ID NO: 1988608 - RNA, 16 nt, Homo sapiens
ugccugucacuacugg

SEQ ID NO: 1988609 - RNA, 16 nt, Homo sapiens
aauugcuguuccuuaa

SEQ ID NO: 1988610 - RNA, 22 nt, Homo sapiens
ugaaauggauugguaagauguc

SEQ ID NO: 1988611 - RNA, 11 nt, Homo sapiens
gccacacuggg

SEQ ID NO: 1988612 - RNA, 17 nt, Homo sapiens
cauuacuuuuucauaua

SEQ ID NO: 1988613 - RNA, 13 nt, Homo sapiens
acucuuugguccu

SEQ ID NO: 1988614 - RNA, 14 nt, Homo sapiens
ucuaacuuggggaa

SEQ ID NO: 1988615 - RNA, 19 nt, Homo sapiens
uggggcagucucugcccaa

SEQ ID NO: 1988616 - RNA, 16 nt, Homo sapiens
guaaauacuugcaguu

SEQ ID NO: 1988617 - RNA, 18 nt, Homo sapiens
agggagaaguuugggaaa

SEQ ID NO: 1988618 - RNA, 23 nt, Homo sapiens
cuguuggcguggggccuuuguca

SEQ ID NO: 1988619 - RNA, 15 nt, Homo sapiens
uaaaagcacacuccc

SEQ ID NO: 1988620 - RNA, 13 nt, Homo sapiens
uacaccacucugg

SEQ ID NO: 1988621 - RNA, 22 nt, Homo sapiens
cacugagacuugaaucaaguca

SEQ ID NO: 1988622 - RNA, 21 nt, Homo sapiens
agcucugcuugccgaaacugg

SEQ ID NO: 1988623 - RNA, 16 nt, Homo sapiens
uacuauuuuuacuaau

SEQ ID NO: 1988624 - RNA, 16 nt, Homo sapiens
acaauaauucuaugag

SEQ ID NO: 1988625 - RNA, 19 nt, Homo sapiens
gcaaauaacaaaugccaaa

SEQ ID NO: 1988626 - RNA, 14 nt, Homo sapiens
ugggggauuucaaa

SEQ ID NO: 1988627 - RNA, 20 nt, Homo sapiens
aaugaaguauuucauguaau

SEQ ID NO: 1988628 - RNA, 18 nt, Homo sapiens
ugagauaaccacaaccag

SEQ ID NO: 1988629 - RNA, 22 nt, Homo sapiens
uggcuacugggaaauuacuuau

SEQ ID NO: 1988630 - RNA, 16 nt, Homo sapiens
uaauauaaauguugcu

SEQ ID NO: 1988631 - RNA, 19 nt, Homo sapiens
cagagaacugccuuaaaaa

SEQ ID NO: 1988632 - RNA, 22 nt, Homo sapiens
ugucuagaauccugcuuuacag

SEQ ID NO: 1988633 - RNA, 14 nt, Homo sapiens
gaaaguugcaguuu

SEQ ID NO: 1988634 - RNA, 21 nt, Homo sapiens
auggacuaagaugaaaugcac

SEQ ID NO: 1988635 - RNA, 16 nt, Homo sapiens
gaagauagaugcacuu

SEQ ID NO: 1988636 - RNA, 11 nt, Homo sapiens
uacccucucag

SEQ ID NO: 1988637 - RNA, 18 nt, Homo sapiens
cgagagagaggugccaca

SEQ ID NO: 1988638 - RNA, 22 nt, Homo sapiens
acacccccaccuccugcaauaa

SEQ ID NO: 1988639 - RNA, 13 nt, Homo sapiens
agaggacugugau

SEQ ID NO: 1988640 - RNA, 22 nt, Homo sapiens
uaaaauguguuuuaucacuuca

SEQ ID NO: 1988641 - RNA, 16 nt, Homo sapiens
cucagauagaccugug

SEQ ID NO: 1988642 - RNA, 21 nt, Homo sapiens
uuuucuuccuauuuccuugua

SEQ ID NO: 1988643 - RNA, 13 nt, Homo sapiens
ugauuugguggau

SEQ ID NO: 1988644 - RNA, 13 nt, Homo sapiens
aaauuuggaagau

SEQ ID NO: 1988645 - RNA, 18 nt, Homo sapiens
ugggcugaucuuugcccc

SEQ ID NO: 1988646 - RNA, 17 nt, Homo sapiens
uccguuccacauccaca

SEQ ID NO: 1988647 - RNA, 20 nt, Homo sapiens
gaaaauuuaagacaaguuca

SEQ ID NO: 1988648 - RNA, 13 nt, Homo sapiens
gacuggcucaaga

SEQ ID NO: 1988649 - RNA, 11 nt, Homo sapiens
accagcucucu

SEQ ID NO: 1988650 - RNA, 12 nt, Homo sapiens
cuuucucuguag

SEQ ID NO: 1988651 - RNA, 14 nt, Homo sapiens
uaucaagccaaaga

SEQ ID NO: 1988652 - RNA, 23 nt, Homo sapiens
aggguggcuggguccaggggaug

SEQ ID NO: 1988653 - RNA, 14 nt, Homo sapiens
ugccacacaguggg

SEQ ID NO: 1988654 - RNA, 22 nt, Homo sapiens
augcuaguuugaccucauuugu

SEQ ID NO: 1988655 - RNA, 14 nt, Homo sapiens
uccacugucuuuaa

SEQ ID NO: 1988656 - RNA, 14 nt, Homo sapiens
cuuaauguuccuca

SEQ ID NO: 1988657 - RNA, 23 nt, Homo sapiens
auccauaggcgcaggugcacagg

SEQ ID NO: 1988658 - RNA, 19 nt, Homo sapiens
acuuccugugacuucagcu

SEQ ID NO: 1988659 - RNA, 22 nt, Homo sapiens
caagugcaguagugcaguucac

SEQ ID NO: 1988660 - RNA, 21 nt, Homo sapiens
aagaccagcuuugcagugaca

SEQ ID NO: 1988661 - RNA, 15 nt, Homo sapiens
aagcaaauaaaugcc

SEQ ID NO: 1988662 - RNA, 21 nt, Homo sapiens
gaagaauugauguaugccucu

SEQ ID NO: 1988663 - RNA, 14 nt, Homo sapiens
acacuggugccaug

SEQ ID NO: 1988664 - RNA, 18 nt, Homo sapiens
gggccuggggccugagag

SEQ ID NO: 1988665 - RNA, 19 nt, Homo sapiens
ucauuucugcagauggaaa

SEQ ID NO: 1988666 - RNA, 21 nt, Homo sapiens
uucaaacaauaucauaucauc

SEQ ID NO: 1988667 - RNA, 22 nt, Homo sapiens
acagccaccguuucuuccugcc

SEQ ID NO: 1988668 - RNA, 22 nt, Homo sapiens
ugggcagcggcuucaagagcca

SEQ ID NO: 1988669 - RNA, 14 nt, Homo sapiens
aaagaucguuuaaa

SEQ ID NO: 1988670 - RNA, 18 nt, Homo sapiens
ugcgugcgagcacacaca

SEQ ID NO: 1988671 - RNA, 21 nt, Homo sapiens
ccagguaugggccagcaguuu

SEQ ID NO: 1988672 - RNA, 22 nt, Homo sapiens
uaaaugguaguaaucacaguug

SEQ ID NO: 1988673 - RNA, 20 nt, Homo sapiens
uuggaauuaugucugcugaa

SEQ ID NO: 1988674 - RNA, 15 nt, Homo sapiens
uugauuuuaaugaau

SEQ ID NO: 1988675 - RNA, 23 nt, Homo sapiens
gaccuuuuuuuuuuuaauggcaa

SEQ ID NO: 1988676 - RNA, 24 nt, Homo sapiens
cucccuccaccuaccacucacaug

SEQ ID NO: 1988677 - RNA, 20 nt, Homo sapiens
aggaacaauaaaaugucuuc

SEQ ID NO: 1988678 - RNA, 15 nt, Homo sapiens
cuucuccccauucug

SEQ ID NO: 1988679 - RNA, 17 nt, Homo sapiens
auugaaaucaagcuuau

SEQ ID NO: 1988680 - RNA, 13 nt, Homo sapiens
aaccaccuuucca

SEQ ID NO: 1988681 - RNA, 15 nt, Homo sapiens
cuaccaaauagugau

SEQ ID NO: 1988682 - RNA, 15 nt, Homo sapiens
cauuauuacuuuucc

SEQ ID NO: 1988683 - RNA, 18 nt, Homo sapiens
gaggccuccggacuccuc

SEQ ID NO: 1988684 - RNA, 19 nt, Homo sapiens
cucuccuuccuuacccaaa

SEQ ID NO: 1988685 - RNA, 16 nt, Homo sapiens
ugugcacaagugugca

SEQ ID NO: 1988686 - RNA, 16 nt, Homo sapiens
gaacaagcauuaguuu

SEQ ID NO: 1988687 - RNA, 18 nt, Homo sapiens
auucuuccccgaaucaca

SEQ ID NO: 1988688 - RNA, 20 nt, Homo sapiens
acuacuccgugaaggcuucu

SEQ ID NO: 1988689 - RNA, 16 nt, Homo sapiens
agagcagccuggccaa

SEQ ID NO: 1988690 - RNA, 15 nt, Homo sapiens
uacauuucucaggcu

SEQ ID NO: 1988691 - RNA, 17 nt, Homo sapiens
acuuuauuuaaaugcau

SEQ ID NO: 1988692 - RNA, 15 nt, Homo sapiens
ccagaaugcugaacu

SEQ ID NO: 1988693 - RNA, 20 nt, Homo sapiens
gcucugcgccgagccucaga

SEQ ID NO: 1988694 - RNA, 18 nt, Homo sapiens
cuccaauccccacuccuc

SEQ ID NO: 1988695 - RNA, 15 nt, Homo sapiens
gguuuagcugcagga

SEQ ID NO: 1988696 - RNA, 20 nt, Homo sapiens
uacucuaucagagaaaaaca

SEQ ID NO: 1988697 - RNA, 18 nt, Homo sapiens
aaucuuagugaaugggaa

SEQ ID NO: 1988698 - RNA, 15 nt, Homo sapiens
cauguauuaccugaa

SEQ ID NO: 1988699 - RNA, 15 nt, Homo sapiens
cuuuggucauuucuc

SEQ ID NO: 1988700 - RNA, 17 nt, Homo sapiens
auuucuugaaaagccuu

SEQ ID NO: 1988701 - RNA, 21 nt, Homo sapiens
gcagagaagcuguaggacugu

SEQ ID NO: 1988702 - RNA, 20 nt, Homo sapiens
aauuuuguuuaaaacucaga

SEQ ID NO: 1988703 - RNA, 16 nt, Homo sapiens
auacaagaagcacuga

SEQ ID NO: 1988704 - RNA, 21 nt, Homo sapiens
caaacauuucuaacucuauua

SEQ ID NO: 1988705 - RNA, 16 nt, Homo sapiens
caaauauugaucugua

SEQ ID NO: 1988706 - RNA, 16 nt, Homo sapiens
ucaacaaccaugccag

SEQ ID NO: 1988707 - RNA, 12 nt, Homo sapiens
aaagcugugaaa

SEQ ID NO: 1988708 - RNA, 14 nt, Homo sapiens
ccaacuccagugaa

SEQ ID NO: 1988709 - RNA, 15 nt, Homo sapiens
gucccacacugugca

SEQ ID NO: 1988710 - RNA, 17 nt, Homo sapiens
ccuguguccagcagcug

SEQ ID NO: 1988711 - RNA, 16 nt, Homo sapiens
uuccaaauaagugcau

SEQ ID NO: 1988712 - RNA, 20 nt, Homo sapiens
uccucaugagggcuggaugc

SEQ ID NO: 1988713 - RNA, 18 nt, Homo sapiens
cugaucagagguguacac

SEQ ID NO: 1988714 - RNA, 14 nt, Homo sapiens
uacacacacaaaga

SEQ ID NO: 1988715 - RNA, 17 nt, Homo sapiens
augggcucagggccagg

SEQ ID NO: 1988716 - RNA, 19 nt, Homo sapiens
ucuucaaaggugacuucag

SEQ ID NO: 1988717 - RNA, 17 nt, Homo sapiens
acgucuggacugcuauu

SEQ ID NO: 1988718 - RNA, 14 nt, Homo sapiens
caaaccuucaggaa

SEQ ID NO: 1988719 - RNA, 14 nt, Homo sapiens
gugcuugagucucc

SEQ ID NO: 1988720 - RNA, 21 nt, Homo sapiens
gaaaucuugcuucagaccauc

SEQ ID NO: 1988721 - RNA, 16 nt, Homo sapiens
cuguuagcaagugugu

SEQ ID NO: 1988722 - RNA, 16 nt, Homo sapiens
gcaugaacacacaugg

SEQ ID NO: 1988723 - RNA, 14 nt, Homo sapiens
ugaugucuaccuca

SEQ ID NO: 1988724 - RNA, 23 nt, Homo sapiens
ugagaaaaugccucaauucacau

SEQ ID NO: 1988725 - RNA, 20 nt, Homo sapiens
cugugcuucgacuacugcuc

SEQ ID NO: 1988726 - RNA, 16 nt, Homo sapiens
uuccagacagucacaa

SEQ ID NO: 1988727 - RNA, 14 nt, Homo sapiens
uggugauauccucu

SEQ ID NO: 1988728 - RNA, 19 nt, Homo sapiens
uccagcccaacccacuguc

SEQ ID NO: 1988729 - RNA, 14 nt, Homo sapiens
gaguaauuguuauu

SEQ ID NO: 1988730 - RNA, 23 nt, Homo sapiens
cuauuuggggcuugcaugccaaa

SEQ ID NO: 1988731 - RNA, 18 nt, Homo sapiens
aaugauaauagcucacag

SEQ ID NO: 1988732 - RNA, 16 nt, Homo sapiens
aucagucuauccacag

SEQ ID NO: 1988733 - RNA, 15 nt, Homo sapiens
uucacagagacacgu

SEQ ID NO: 1988734 - RNA, 11 nt, Homo sapiens
guauucauuca

SEQ ID NO: 1988735 - RNA, 15 nt, Homo sapiens
ucugauuuacauuca

SEQ ID NO: 1988736 - RNA, 15 nt, Homo sapiens
uuugucuuauauaua

SEQ ID NO: 1988737 - RNA, 23 nt, Homo sapiens
ccagaauucugggcaagucaccc

SEQ ID NO: 1988738 - RNA, 20 nt, Homo sapiens
caaaagggguuaauguuacu

SEQ ID NO: 1988739 - RNA, 19 nt, Homo sapiens
gcuuuagccauaccagggu

SEQ ID NO: 1988740 - RNA, 23 nt, Homo sapiens
uaauugggcaggugaaaagggua

SEQ ID NO: 1988741 - RNA, 15 nt, Homo sapiens
ucccccaaccccagc

SEQ ID NO: 1988742 - RNA, 18 nt, Homo sapiens
ugcaaacucaguuccaaa

SEQ ID NO: 1988743 - RNA, 23 nt, Homo sapiens
gcaagaggaaugaggcucuguaa

SEQ ID NO: 1988744 - RNA, 21 nt, Homo sapiens
ggaauugcuggaggaaccaga

SEQ ID NO: 1988745 - RNA, 22 nt, Homo sapiens
acaauguauacuucagugcuca

SEQ ID NO: 1988746 - RNA, 17 nt, Homo sapiens
auuuggggacagauuca

SEQ ID NO: 1988747 - RNA, 14 nt, Homo sapiens
aguacugcaaaaug

SEQ ID NO: 1988748 - RNA, 16 nt, Homo sapiens
caggcucauaugcguc

SEQ ID NO: 1988749 - RNA, 17 nt, Homo sapiens
aaacacaaauagaacau

SEQ ID NO: 1988750 - RNA, 17 nt, Homo sapiens
gaacacccuugguggcu

SEQ ID NO: 1988751 - RNA, 13 nt, Homo sapiens
aacccuugcacua

SEQ ID NO: 1988752 - RNA, 12 nt, Homo sapiens
auaccagcaaua

SEQ ID NO: 1988753 - RNA, 15 nt, Homo sapiens
gacaacucaaugaaa

SEQ ID NO: 1988754 - RNA, 23 nt, Homo sapiens
caucguugcaaccacugcaauau

SEQ ID NO: 1988755 - RNA, 12 nt, Homo sapiens
auaaaaaccaaa

SEQ ID NO: 1988756 - RNA, 18 nt, Homo sapiens
ucaaaauugagugguuua

SEQ ID NO: 1988757 - RNA, 16 nt, Homo sapiens
gugacagcugagcacc

SEQ ID NO: 1988758 - RNA, 18 nt, Homo sapiens
caauauugguguacugua

SEQ ID NO: 1988759 - RNA, 14 nt, Homo sapiens
uaaagucugaauca

SEQ ID NO: 1988760 - RNA, 17 nt, Homo sapiens
auuugaguuuauaucuc

SEQ ID NO: 1988761 - RNA, 14 nt, Homo sapiens
uaagaaagcacuau

SEQ ID NO: 1988762 - RNA, 18 nt, Homo sapiens
auggacaaacagugcacu

SEQ ID NO: 1988763 - RNA, 16 nt, Homo sapiens
aagaccaaaauuacua

SEQ ID NO: 1988764 - RNA, 12 nt, Homo sapiens
auacuaucucuu

SEQ ID NO: 1988765 - RNA, 15 nt, Homo sapiens
acaauccaucucuca

SEQ ID NO: 1988766 - RNA, 13 nt, Homo sapiens
cugaugggaacca

SEQ ID NO: 1988767 - RNA, 13 nt, Homo sapiens
ggauuauuaacua

SEQ ID NO: 1988768 - RNA, 17 nt, Homo sapiens
cucucuagaaccuucua

SEQ ID NO: 1988769 - RNA, 18 nt, Homo sapiens
gucaaagaagucauucuu

SEQ ID NO: 1988770 - RNA, 13 nt, Homo sapiens
ccaggucagggag

SEQ ID NO: 1988771 - RNA, 22 nt, Homo sapiens
acuugacugggugagacccaaa

SEQ ID NO: 1988772 - RNA, 17 nt, Homo sapiens
caguguuuucaccucau

SEQ ID NO: 1988773 - RNA, 19 nt, Homo sapiens
gugccuccugugugucugc

SEQ ID NO: 1988774 - RNA, 14 nt, Homo sapiens
acaacuuguuuucc

SEQ ID NO: 1988775 - RNA, 13 nt, Homo sapiens
agguuaaggcaua

SEQ ID NO: 1988776 - RNA, 13 nt, Homo sapiens
cccucuauuuauu

SEQ ID NO: 1988777 - RNA, 19 nt, Homo sapiens
gcauuuaaauuugauuucc

SEQ ID NO: 1988778 - RNA, 15 nt, Homo sapiens
gagcuccacugccau

SEQ ID NO: 1988779 - RNA, 20 nt, Homo sapiens
uuuaccaauuccaauuucaa

SEQ ID NO: 1988780 - RNA, 16 nt, Homo sapiens
uuuggucauagcauuc

SEQ ID NO: 1988781 - RNA, 16 nt, Homo sapiens
cugcacuccauggcca

SEQ ID NO: 1988782 - RNA, 16 nt, Homo sapiens
cucucugcaaggcccu

SEQ ID NO: 1988783 - RNA, 21 nt, Homo sapiens
aaccaaagucuaaacugagcu

SEQ ID NO: 1988784 - RNA, 16 nt, Homo sapiens
gucuucucucucugcu

SEQ ID NO: 1988785 - RNA, 17 nt, Homo sapiens
aagaaaagcaguuugca

SEQ ID NO: 1988786 - RNA, 13 nt, Homo sapiens
acuguccaaagac

SEQ ID NO: 1988787 - RNA, 22 nt, Homo sapiens
acuucgcucuugaggagcucaa

SEQ ID NO: 1988788 - RNA, 16 nt, Homo sapiens
aauuuagaaagcuuaa

SEQ ID NO: 1988789 - RNA, 18 nt, Homo sapiens
ccaccauuuaauuucaug

SEQ ID NO: 1988790 - RNA, 13 nt, Homo sapiens
uuggaccacagca

SEQ ID NO: 1988791 - RNA, 19 nt, Homo sapiens
aaacugcucuguaggucau

SEQ ID NO: 1988792 - RNA, 22 nt, Homo sapiens
cgacggcggcggcccucaaaag

SEQ ID NO: 1988793 - RNA, 13 nt, Homo sapiens
ugaauucaccgug

SEQ ID NO: 1988794 - RNA, 20 nt, Homo sapiens
aaccccuccucccucagacu

SEQ ID NO: 1988795 - RNA, 18 nt, Homo sapiens
cuuucaagguaacuguac

SEQ ID NO: 1988796 - RNA, 21 nt, Homo sapiens
cugccuaugcacugaagagcu

SEQ ID NO: 1988797 - RNA, 19 nt, Homo sapiens
agguugccucaacagcagg

SEQ ID NO: 1988798 - RNA, 17 nt, Homo sapiens
ugccucuugcagggucu

SEQ ID NO: 1988799 - RNA, 22 nt, Homo sapiens
aaggccgagaccccaucuucca

SEQ ID NO: 1988800 - RNA, 23 nt, Homo sapiens
aucugcaaaggaaucacuuuaga

SEQ ID NO: 1988801 - RNA, 20 nt, Homo sapiens
ugcaaaggagaagcacagcu

SEQ ID NO: 1988802 - RNA, 17 nt, Homo sapiens
ucccuuuguugcacacu

SEQ ID NO: 1988803 - RNA, 15 nt, Homo sapiens
agcugucaccucuca

SEQ ID NO: 1988804 - RNA, 17 nt, Homo sapiens
uaauauuuuccuaguag

SEQ ID NO: 1988805 - RNA, 14 nt, Homo sapiens
caccaccuggagug

SEQ ID NO: 1988806 - RNA, 22 nt, Homo sapiens
ugcaaaauacaugaagcuucau

SEQ ID NO: 1988807 - RNA, 23 nt, Homo sapiens
agucauguagccccagucagaag

SEQ ID NO: 1988808 - RNA, 16 nt, Homo sapiens
auguucacuuccaaga

SEQ ID NO: 1988809 - RNA, 15 nt, Homo sapiens
cuccauguaguuacu

SEQ ID NO: 1988810 - RNA, 19 nt, Homo sapiens
cuuggaggccagccaguga

SEQ ID NO: 1988811 - RNA, 14 nt, Homo sapiens
aacaaguguaucuc

SEQ ID NO: 1988812 - RNA, 24 nt, Homo sapiens
cuugaccagcagaucccagcucac

SEQ ID NO: 1988813 - RNA, 17 nt, Homo sapiens
ccaagcugcucauuuca

SEQ ID NO: 1988814 - RNA, 16 nt, Homo sapiens
aaaucaaugaagcaag

SEQ ID NO: 1988815 - RNA, 16 nt, Homo sapiens
ugaaucaugaaguaaa

SEQ ID NO: 1988816 - RNA, 18 nt, Homo sapiens
uuauguguugaugacuca

SEQ ID NO: 1988817 - RNA, 19 nt, Homo sapiens
caguagagcaaaucuauga

SEQ ID NO: 1988818 - RNA, 20 nt, Homo sapiens
uggauccgugacagcacuuu

SEQ ID NO: 1988819 - RNA, 22 nt, Homo sapiens
agguucugugcaaaacuaccac

SEQ ID NO: 1988820 - RNA, 17 nt, Homo sapiens
caugccucuaaucucag

SEQ ID NO: 1988821 - RNA, 18 nt, Homo sapiens
gaaaguauagauggccaa

SEQ ID NO: 1988822 - RNA, 18 nt, Homo sapiens
uuguuccaaaagagucca

SEQ ID NO: 1988823 - RNA, 16 nt, Homo sapiens
aaaauuagacugugau

SEQ ID NO: 1988824 - RNA, 18 nt, Homo sapiens
gucagucuucacuugcac

SEQ ID NO: 1988825 - RNA, 23 nt, Homo sapiens
uguaucuuuaggucuuugccuuc

SEQ ID NO: 1988826 - RNA, 21 nt, Homo sapiens
aauauauuuuuugaacuuugu

SEQ ID NO: 1988827 - RNA, 14 nt, Homo sapiens
auguguaugcgugc

SEQ ID NO: 1988828 - RNA, 13 nt, Homo sapiens
uaaaacucugcca

SEQ ID NO: 1988829 - RNA, 17 nt, Homo sapiens
ggcuaaaucccaagugu

SEQ ID NO: 1988830 - RNA, 21 nt, Homo sapiens
uauaaaaaccaugcugguaua

SEQ ID NO: 1988831 - RNA, 23 nt, Homo sapiens
cauuaaaggaaaaauagcagaga

SEQ ID NO: 1988832 - RNA, 23 nt, Homo sapiens
uugaauauuuuauauuguuauau

SEQ ID NO: 1988833 - RNA, 24 nt, Homo sapiens
agcugccuuuuuuaacacuagaaa

SEQ ID NO: 1988834 - RNA, 23 nt, Homo sapiens
caaacacaaguggguagugucau

SEQ ID NO: 1988835 - RNA, 17 nt, Homo sapiens
uuucacuuugugauuau

SEQ ID NO: 1988836 - RNA, 23 nt, Homo sapiens
agccccuccaaaggucugauguc

SEQ ID NO: 1988837 - RNA, 17 nt, Homo sapiens
uuauguagguaagacug

SEQ ID NO: 1988838 - RNA, 16 nt, Homo sapiens
acuaaaaauacaaaaa

SEQ ID NO: 1988839 - RNA, 12 nt, Homo sapiens
uuauauaauuca

SEQ ID NO: 1988840 - RNA, 15 nt, Homo sapiens
uagaaugaaccaaua

SEQ ID NO: 1988841 - RNA, 15 nt, Homo sapiens
auuuuagcuacuaua

SEQ ID NO: 1988842 - RNA, 16 nt, Homo sapiens
gagaaguuaucagaca

SEQ ID NO: 1988843 - RNA, 18 nt, Homo sapiens
gaugagggaaaagaaaaa

SEQ ID NO: 1988844 - RNA, 14 nt, Homo sapiens
agccacucaaagga

SEQ ID NO: 1988845 - RNA, 16 nt, Homo sapiens
ugcucuaaugccaagu

SEQ ID NO: 1988846 - RNA, 18 nt, Homo sapiens
ugaggacagaccacagag

SEQ ID NO: 1988847 - RNA, 23 nt, Homo sapiens
aucacccuuuccggcacacugcc

SEQ ID NO: 1988848 - RNA, 21 nt, Homo sapiens
auauuuaauaggauaaauuaa

SEQ ID NO: 1988849 - RNA, 20 nt, Homo sapiens
uauguuuauuauuugcacag

SEQ ID NO: 1988850 - RNA, 23 nt, Homo sapiens
uauuaagugacugaccaugcacu

SEQ ID NO: 1988851 - RNA, 17 nt, Homo sapiens
uaaugaccaguuguuau

SEQ ID NO: 1988852 - RNA, 16 nt, Homo sapiens
uguaauccuagcacuu

SEQ ID NO: 1988853 - RNA, 19 nt, Homo sapiens
aagcugguccuguccagac

SEQ ID NO: 1988854 - RNA, 16 nt, Homo sapiens
ccugaauaaaccaaga

SEQ ID NO: 1988855 - RNA, 18 nt, Homo sapiens
acagccacacugugggac

SEQ ID NO: 1988856 - RNA, 15 nt, Homo sapiens
ucccuaggaaacuca

SEQ ID NO: 1988857 - RNA, 21 nt, Homo sapiens
ugucaucugcuccuguucaca

SEQ ID NO: 1988858 - RNA, 14 nt, Homo sapiens
aacuucaucugucu

SEQ ID NO: 1988859 - RNA, 14 nt, Homo sapiens
aaccucaucugccu

SEQ ID NO: 1988860 - RNA, 14 nt, Homo sapiens
caggccuccagcgg

SEQ ID NO: 1988861 - RNA, 17 nt, Homo sapiens
acuucuaaacacaaaua

SEQ ID NO: 1988862 - RNA, 18 nt, Homo sapiens
uaaagucuacacugccuu

SEQ ID NO: 1988863 - RNA, 16 nt, Homo sapiens
aagcagaaaaucuacc

SEQ ID NO: 1988864 - RNA, 20 nt, Homo sapiens
ucucauacugucugggauua

SEQ ID NO: 1988865 - RNA, 17 nt, Homo sapiens
ugucauuuugcacugua

SEQ ID NO: 1988866 - RNA, 21 nt, Homo sapiens
gaauacaguuuugaguagagu

SEQ ID NO: 1988867 - RNA, 18 nt, Homo sapiens
acuucaagacaucaccau

SEQ ID NO: 1988868 - RNA, 18 nt, Homo sapiens
uacauuucuuagacuaca

SEQ ID NO: 1988869 - RNA, 15 nt, Homo sapiens
cuuuggagcaaagaa

SEQ ID NO: 1988870 - RNA, 18 nt, Homo sapiens
uucuauauugcaguguga

SEQ ID NO: 1988871 - RNA, 21 nt, Homo sapiens
uccuauguuucacugugcaaa

SEQ ID NO: 1988872 - RNA, 21 nt, Homo sapiens
uaacaggcauugcacuaaaag

SEQ ID NO: 1988873 - RNA, 20 nt, Homo sapiens
ggcacugcccuuuucaggaa

SEQ ID NO: 1988874 - RNA, 13 nt, Homo sapiens
caucugucugucu

SEQ ID NO: 1988875 - RNA, 18 nt, Homo sapiens
uaacuauuuuuuuaguua

SEQ ID NO: 1988876 - RNA, 19 nt, Homo sapiens
aggcaagcuugaggccaag

SEQ ID NO: 1988877 - RNA, 15 nt, Homo sapiens
acuaaaaaguaccag

SEQ ID NO: 1988878 - RNA, 12 nt, Homo sapiens
agaaauggccaa

SEQ ID NO: 1988879 - RNA, 19 nt, Homo sapiens
uauuaacaugcuuaugaca

SEQ ID NO: 1988880 - RNA, 23 nt, Homo sapiens
uccuaaaguacuggagugaaaua

SEQ ID NO: 1988881 - RNA, 15 nt, Homo sapiens
agccccucuucccuu

SEQ ID NO: 1988882 - RNA, 18 nt, Homo sapiens
ugugguuugguuggggcu

SEQ ID NO: 1988883 - RNA, 16 nt, Homo sapiens
acauauaggagcaaua

SEQ ID NO: 1988884 - RNA, 23 nt, Homo sapiens
acagacaccuuuucuauuuaccu

SEQ ID NO: 1988885 - RNA, 16 nt, Homo sapiens
uggaaaaaugauuuaa

SEQ ID NO: 1988886 - RNA, 14 nt, Homo sapiens
uccuugcugcauug

SEQ ID NO: 1988887 - RNA, 14 nt, Homo sapiens
ucccaccugcacac

SEQ ID NO: 1988888 - RNA, 14 nt, Homo sapiens
uucaaacuguaaaa

SEQ ID NO: 1988889 - RNA, 16 nt, Homo sapiens
uacauucugcucugcc

SEQ ID NO: 1988890 - RNA, 22 nt, Homo sapiens
uuuaauagagaacuucuagugu

SEQ ID NO: 1988891 - RNA, 17 nt, Homo sapiens
uacuugcuccauucaua

SEQ ID NO: 1988892 - RNA, 20 nt, Homo sapiens
ugccggucgcccuuugcugc

SEQ ID NO: 1988893 - RNA, 22 nt, Homo sapiens
acugcucaagaacuacgggcug

SEQ ID NO: 1988894 - RNA, 17 nt, Homo sapiens
augaaaaaaaugaucua

SEQ ID NO: 1988895 - RNA, 14 nt, Homo sapiens
agaggccauggcag

SEQ ID NO: 1988896 - RNA, 15 nt, Homo sapiens
agaguauacaagugu

SEQ ID NO: 1988897 - RNA, 15 nt, Homo sapiens
aguguauacaugugu

SEQ ID NO: 1988898 - RNA, 15 nt, Homo sapiens
agcgcgcacacgcac

SEQ ID NO: 1988899 - RNA, 21 nt, Homo sapiens
guuagaaaauggacacugugc

SEQ ID NO: 1988900 - RNA, 18 nt, Homo sapiens
gacagcugcugugcauua

SEQ ID NO: 1988901 - RNA, 17 nt, Homo sapiens
gaagaaccaaauaccuc

SEQ ID NO: 1988902 - RNA, 15 nt, Homo sapiens
ucaccaagcaggcaa

SEQ ID NO: 1988903 - RNA, 19 nt, Homo sapiens
gguguuuauaagcagguaa

SEQ ID NO: 1988904 - RNA, 22 nt, Homo sapiens
gaacuuuuuuagaaaugcaaaa

SEQ ID NO: 1988905 - RNA, 21 nt, Homo sapiens
aacaauuccuuacauuuacca

SEQ ID NO: 1988906 - RNA, 17 nt, Homo sapiens
gaacuaaacucauuuau

SEQ ID NO: 1988907 - RNA, 22 nt, Homo sapiens
aaaccuccuucucuucuggaca

SEQ ID NO: 1988908 - RNA, 12 nt, Homo sapiens
cugccaguguuu

SEQ ID NO: 1988909 - RNA, 13 nt, Homo sapiens
aauaugaaagccu

SEQ ID NO: 1988910 - RNA, 16 nt, Homo sapiens
ucagagaccugaagug

SEQ ID NO: 1988911 - RNA, 18 nt, Homo sapiens
ggaacccaagauguggcc

SEQ ID NO: 1988912 - RNA, 17 nt, Homo sapiens
gggcuucuccugaaauc

SEQ ID NO: 1988913 - RNA, 23 nt, Homo sapiens
ccugcccccugcaggaaggagcu

SEQ ID NO: 1988914 - RNA, 12 nt, Homo sapiens
auaagcagagag

SEQ ID NO: 1988915 - RNA, 20 nt, Homo sapiens
cuucccaagcagcugggauu

SEQ ID NO: 1988916 - RNA, 20 nt, Homo sapiens
gccuuaaacacacauugcag

SEQ ID NO: 1988917 - RNA, 20 nt, Homo sapiens
cuacaccguggugagcauac

SEQ ID NO: 1988918 - RNA, 16 nt, Homo sapiens
caaagagcaauauucc

SEQ ID NO: 1988919 - RNA, 20 nt, Homo sapiens
ccacaagcugcacugugaac

SEQ ID NO: 1988920 - RNA, 17 nt, Homo sapiens
aaauauuuaccuugaaa

SEQ ID NO: 1988921 - RNA, 21 nt, Homo sapiens
acagcauuuguguguuacaau

SEQ ID NO: 1988922 - RNA, 17 nt, Homo sapiens
acacauggaaacccaua

SEQ ID NO: 1988923 - RNA, 23 nt, Homo sapiens
gaaaaguuagucaauccugucau

SEQ ID NO: 1988924 - RNA, 17 nt, Homo sapiens
agucaaagcaggauuau

SEQ ID NO: 1988925 - RNA, 19 nt, Homo sapiens
ugcccaaaagaggugucau

SEQ ID NO: 1988926 - RNA, 23 nt, Homo sapiens
cuaugcauuuucuucacagugca

SEQ ID NO: 1988927 - RNA, 22 nt, Homo sapiens
ucugggagcaucgaagcucugu

SEQ ID NO: 1988928 - RNA, 23 nt, Homo sapiens
caucucuaacauaugauacugau

SEQ ID NO: 1988929 - RNA, 15 nt, Homo sapiens
agcccagggugcugg

SEQ ID NO: 1988930 - RNA, 10 nt, Homo sapiens
uucacugagc

SEQ ID NO: 1988931 - RNA, 15 nt, Homo sapiens
ugccgcucucucuga

SEQ ID NO: 1988932 - RNA, 20 nt, Homo sapiens
gaucacagcugcaggccacg

SEQ ID NO: 1988933 - RNA, 15 nt, Homo sapiens
aagugagagagacaa

SEQ ID NO: 1988934 - RNA, 19 nt, Homo sapiens
ucuuccuugaccugcauug

SEQ ID NO: 1988935 - RNA, 18 nt, Homo sapiens
caggcgaggccuggagua

SEQ ID NO: 1988936 - RNA, 15 nt, Homo sapiens
cuugacucauggcag

SEQ ID NO: 1988937 - RNA, 16 nt, Homo sapiens
aaacuucuacugagca

SEQ ID NO: 1988938 - RNA, 23 nt, Homo sapiens
uguaacguuuucuuucacacaca

SEQ ID NO: 1988939 - RNA, 22 nt, Homo sapiens
aaccuggccuuauaucauuuca

SEQ ID NO: 1988940 - RNA, 16 nt, Homo sapiens
gcaauaaaguuauuca

SEQ ID NO: 1988941 - RNA, 19 nt, Homo sapiens
uucccugaacacucauccc

SEQ ID NO: 1988942 - RNA, 15 nt, Homo sapiens
ggcacccccaugcug

SEQ ID NO: 1988943 - RNA, 21 nt, Homo sapiens
caucugacaugcaucaucuca

SEQ ID NO: 1988944 - RNA, 15 nt, Homo sapiens
caguuaauacuuaac

SEQ ID NO: 1988945 - RNA, 16 nt, Homo sapiens
agaaaauuguugugcu

SEQ ID NO: 1988946 - RNA, 15 nt, Homo sapiens
accacaugugcacau

SEQ ID NO: 1988947 - RNA, 17 nt, Homo sapiens
uugcccuggagccucag

SEQ ID NO: 1988948 - RNA, 14 nt, Homo sapiens
ccugccacauccag

SEQ ID NO: 1988949 - RNA, 13 nt, Homo sapiens
agggagacagaga

SEQ ID NO: 1988950 - RNA, 22 nt, Homo sapiens
cugauguuuugguguauuguca

SEQ ID NO: 1988951 - RNA, 22 nt, Homo sapiens
acuugcagauacauucaugagg

SEQ ID NO: 1988952 - RNA, 23 nt, Homo sapiens
aacacagugaaacuccaucucaa

SEQ ID NO: 1988953 - RNA, 21 nt, Homo sapiens
aucugaaagugguacuugauc

SEQ ID NO: 1988954 - RNA, 15 nt, Homo sapiens
caucaccagacuuug

SEQ ID NO: 1988955 - RNA, 12 nt, Homo sapiens
aaacucuuccac

SEQ ID NO: 1988956 - RNA, 20 nt, Homo sapiens
accaaaucucaguagcugau

SEQ ID NO: 1988957 - RNA, 16 nt, Homo sapiens
gccucgaaacacagaa

SEQ ID NO: 1988958 - RNA, 20 nt, Homo sapiens
guuuauuuuuauacuuucag

SEQ ID NO: 1988959 - RNA, 13 nt, Homo sapiens
uguuuacagcaau

SEQ ID NO: 1988960 - RNA, 20 nt, Homo sapiens
caucuggcccaagugaagca

SEQ ID NO: 1988961 - RNA, 14 nt, Homo sapiens
acauagucuguucc

SEQ ID NO: 1988962 - RNA, 17 nt, Homo sapiens
ucuauugaccaccaguu

SEQ ID NO: 1988963 - RNA, 14 nt, Homo sapiens
gugaaauggccaaa

SEQ ID NO: 1988964 - RNA, 16 nt, Homo sapiens
uauucucaaccagaga

SEQ ID NO: 1988965 - RNA, 21 nt, Homo sapiens
guccacgggaagccuccguca

SEQ ID NO: 1988966 - RNA, 21 nt, Homo sapiens
uguacaaaaugaauugccuuu

SEQ ID NO: 1988967 - RNA, 15 nt, Homo sapiens
ccacggccacugcag

SEQ ID NO: 1988968 - RNA, 15 nt, Homo sapiens
ucccuuacuguuuca

SEQ ID NO: 1988969 - RNA, 15 nt, Homo sapiens
uuggugauucugaau

SEQ ID NO: 1988970 - RNA, 14 nt, Homo sapiens
guggaccaugggga

SEQ ID NO: 1988971 - RNA, 13 nt, Homo sapiens
uaccaaucuguga

SEQ ID NO: 1988972 - RNA, 16 nt, Homo sapiens
aucucagagcauuuca

SEQ ID NO: 1988973 - RNA, 16 nt, Homo sapiens
aaggcagucauaucaa

SEQ ID NO: 1988974 - RNA, 20 nt, Homo sapiens
cagagucguuggagacugaa

SEQ ID NO: 1988975 - RNA, 21 nt, Homo sapiens
ccuggcccucgccagcugcca

SEQ ID NO: 1988976 - RNA, 20 nt, Homo sapiens
guagcaacccugugauacua

SEQ ID NO: 1988977 - RNA, 21 nt, Homo sapiens
cucaaggauccagacucucau

SEQ ID NO: 1988978 - RNA, 21 nt, Homo sapiens
gccuccacuccuuccaucucu

SEQ ID NO: 1988979 - RNA, 14 nt, Homo sapiens
uaugaauauuacuc

SEQ ID NO: 1988980 - RNA, 22 nt, Homo sapiens
cuaggauaacuggcacccagag

SEQ ID NO: 1988981 - RNA, 11 nt, Homo sapiens
gcaaggugcau

SEQ ID NO: 1988982 - RNA, 13 nt, Homo sapiens
accagccucacaa

SEQ ID NO: 1988983 - RNA, 14 nt, Homo sapiens
ccaagcugcauggc

SEQ ID NO: 1988984 - RNA, 15 nt, Homo sapiens
cccauuaaucuugau

SEQ ID NO: 1988985 - RNA, 20 nt, Homo sapiens
aaaguuuacauuguccugua

SEQ ID NO: 1988986 - RNA, 21 nt, Homo sapiens
cauuugucaguauuuuugccg

SEQ ID NO: 1988987 - RNA, 15 nt, Homo sapiens
gcuguuuccaguggu

SEQ ID NO: 1988988 - RNA, 16 nt, Homo sapiens
aggcacauaccacugc

SEQ ID NO: 1988989 - RNA, 12 nt, Homo sapiens
gacuugaugaau

SEQ ID NO: 1988990 - RNA, 19 nt, Homo sapiens
ugcaggaccucgugccacc

SEQ ID NO: 1988991 - RNA, 13 nt, Homo sapiens
uaaucgugcuauu

SEQ ID NO: 1988992 - RNA, 13 nt, Homo sapiens
aaaaaaauggagu

SEQ ID NO: 1988993 - RNA, 19 nt, Homo sapiens
caauucucgauucuuugaa

SEQ ID NO: 1988994 - RNA, 22 nt, Homo sapiens
gcuagacaguucuuuguuugga

SEQ ID NO: 1988995 - RNA, 22 nt, Homo sapiens
ccacauaccuggcccaaccaga

SEQ ID NO: 1988996 - RNA, 16 nt, Homo sapiens
cuacacugauacacuu

SEQ ID NO: 1988997 - RNA, 21 nt, Homo sapiens
auugggagcaugggaggggag

SEQ ID NO: 1988998 - RNA, 19 nt, Homo sapiens
agcaaggcuuugguuucca

SEQ ID NO: 1988999 - RNA, 17 nt, Homo sapiens
gcaccuccgcuugccag

SEQ ID NO: 1989000 - RNA, 14 nt, Homo sapiens
ucggugggacccug

SEQ ID NO: 1989001 - RNA, 18 nt, Homo sapiens
acaggccauacuuuacaa

SEQ ID NO: 1989002 - RNA, 17 nt, Homo sapiens
gagguuucacuugcaca

SEQ ID NO: 1989003 - RNA, 14 nt, Homo sapiens
aucauucuuuacau

SEQ ID NO: 1989004 - RNA, 19 nt, Homo sapiens
cuuagaauggagggcaaca

SEQ ID NO: 1989005 - RNA, 21 nt, Homo sapiens
ggaagccauuuuccagugacu

SEQ ID NO: 1989006 - RNA, 14 nt, Homo sapiens
ccggaggccagcua

SEQ ID NO: 1989007 - RNA, 23 nt, Homo sapiens
uagguagaggaauaaaaugaaau

SEQ ID NO: 1989008 - RNA, 21 nt, Homo sapiens
agaggaaugaggcucuguaac

SEQ ID NO: 1989009 - RNA, 20 nt, Homo sapiens
cauucaggauucuguuccuu

SEQ ID NO: 1989010 - RNA, 19 nt, Homo sapiens
guggccaccgugucccuug

SEQ ID NO: 1989011 - RNA, 19 nt, Homo sapiens
uaauucagcacugauuuca

SEQ ID NO: 1989012 - RNA, 21 nt, Homo sapiens
ggaagaacuacagcucuuaaa

SEQ ID NO: 1989013 - RNA, 17 nt, Homo sapiens
caaaacaaaaaaaccuc

SEQ ID NO: 1989014 - RNA, 14 nt, Homo sapiens
auuauagagacaau

SEQ ID NO: 1989015 - RNA, 22 nt, Homo sapiens
ucuucuaaaggcuuuugcccua

SEQ ID NO: 1989016 - RNA, 13 nt, Homo sapiens
uguaaagcuuaaa

SEQ ID NO: 1989017 - RNA, 19 nt, Homo sapiens
cuaaaagcauguauaguua

SEQ ID NO: 1989018 - RNA, 20 nt, Homo sapiens
gccccagaaccccaacuccc

SEQ ID NO: 1989019 - RNA, 20 nt, Homo sapiens
gaagucuucucugccuguaa

SEQ ID NO: 1989020 - RNA, 16 nt, Homo sapiens
acaaauuuuaacuucu

SEQ ID NO: 1989021 - RNA, 22 nt, Homo sapiens
cagccucgcuuugagguaccca

SEQ ID NO: 1989022 - RNA, 13 nt, Homo sapiens
ccuagcacuuuau

SEQ ID NO: 1989023 - RNA, 21 nt, Homo sapiens
auacacgguauuuauagagag

SEQ ID NO: 1989024 - RNA, 21 nt, Homo sapiens
aguauuauuaauacuaugcaa

SEQ ID NO: 1989025 - RNA, 14 nt, Homo sapiens
cagcagugaaugcu

SEQ ID NO: 1989026 - RNA, 19 nt, Homo sapiens
aaugugauuugucuucccu

SEQ ID NO: 1989027 - RNA, 16 nt, Homo sapiens
auauacaguaacuuua

SEQ ID NO: 1989028 - RNA, 20 nt, Homo sapiens
cuaucagccugucucuucca

SEQ ID NO: 1989029 - RNA, 15 nt, Homo sapiens
aaaaaauuauucugc

SEQ ID NO: 1989030 - RNA, 17 nt, Homo sapiens
cugagggcccuguggag

SEQ ID NO: 1989031 - RNA, 20 nt, Homo sapiens
acaugacccaggccuggcca

SEQ ID NO: 1989032 - RNA, 19 nt, Homo sapiens
augcagaaauuauugggcu

SEQ ID NO: 1989033 - RNA, 22 nt, Homo sapiens
uucaguacacccaguugccaaa

SEQ ID NO: 1989034 - RNA, 15 nt, Homo sapiens
gugauagagugcagu

SEQ ID NO: 1989035 - RNA, 12 nt, Homo sapiens
accuauugcugu

SEQ ID NO: 1989036 - RNA, 12 nt, Homo sapiens
acgaauugcuca

SEQ ID NO: 1989037 - RNA, 18 nt, Homo sapiens
uuuguacaauuacuaaau

SEQ ID NO: 1989038 - RNA, 18 nt, Homo sapiens
guuauuauuuugcacugu

SEQ ID NO: 1989039 - RNA, 21 nt, Homo sapiens
ccuuucucagccacaaaauaa

SEQ ID NO: 1989040 - RNA, 18 nt, Homo sapiens
uaagggacauuucuauaa

SEQ ID NO: 1989041 - RNA, 23 nt, Homo sapiens
gccugcuuuggccuuuccuugua

SEQ ID NO: 1989042 - RNA, 14 nt, Homo sapiens
ccccuggagccuca

SEQ ID NO: 1989043 - RNA, 21 nt, Homo sapiens
cuucuaaacccaauccaaaug

SEQ ID NO: 1989044 - RNA, 19 nt, Homo sapiens
caaaaaaaucuaacaguaa

SEQ ID NO: 1989045 - RNA, 16 nt, Homo sapiens
gagcccuuuugcuaua

SEQ ID NO: 1989046 - RNA, 20 nt, Homo sapiens
augauaacaacccaaggcaa

SEQ ID NO: 1989047 - RNA, 18 nt, Homo sapiens
uacaaucuuucaccaagu

SEQ ID NO: 1989048 - RNA, 16 nt, Homo sapiens
gacucuuguacuugau

SEQ ID NO: 1989049 - RNA, 20 nt, Homo sapiens
uggcaacaaacacauuguga

SEQ ID NO: 1989050 - RNA, 13 nt, Homo sapiens
gagccuuugcaca

SEQ ID NO: 1989051 - RNA, 20 nt, Homo sapiens
guaagauguccuccuugaua

SEQ ID NO: 1989052 - RNA, 12 nt, Homo sapiens
ugagccuggcag

SEQ ID NO: 1989053 - RNA, 14 nt, Homo sapiens
ggacacacaggcag

SEQ ID NO: 1989054 - RNA, 19 nt, Homo sapiens
ggcuggaguacaauggcgu

SEQ ID NO: 1989055 - RNA, 20 nt, Homo sapiens
cauuucuguaaauaccauug

SEQ ID NO: 1989056 - RNA, 16 nt, Homo sapiens
ugggcacuucaucuga

SEQ ID NO: 1989057 - RNA, 20 nt, Homo sapiens
guccauugccacggccauga

SEQ ID NO: 1989058 - RNA, 14 nt, Homo sapiens
ccagccacacuuga

SEQ ID NO: 1989059 - RNA, 16 nt, Homo sapiens
ucaguuuucacugucg

SEQ ID NO: 1989060 - RNA, 23 nt, Homo sapiens
ucacugauucucuacaugcucuu

SEQ ID NO: 1989061 - RNA, 20 nt, Homo sapiens
caaaaagaacuaaauaugca

SEQ ID NO: 1989062 - RNA, 17 nt, Homo sapiens
guaaaucuaaacauaaa

SEQ ID NO: 1989063 - RNA, 19 nt, Homo sapiens
uuaguggacccugaaaugu

SEQ ID NO: 1989064 - RNA, 20 nt, Homo sapiens
aggcauguuugauacacauu

SEQ ID NO: 1989065 - RNA, 18 nt, Homo sapiens
gagaguauauuauguauu

SEQ ID NO: 1989066 - RNA, 20 nt, Homo sapiens
cucacccaggucuccagcaa

SEQ ID NO: 1989067 - RNA, 22 nt, Homo sapiens
uaaacucaagacaaugcaccua

SEQ ID NO: 1989068 - RNA, 18 nt, Homo sapiens
ugucagaaacucgaugaa

SEQ ID NO: 1989069 - RNA, 18 nt, Homo sapiens
agagaagcuuucagggga

SEQ ID NO: 1989070 - RNA, 18 nt, Homo sapiens
aggacugaagaccagcug

SEQ ID NO: 1989071 - RNA, 21 nt, Homo sapiens
cuaaugaguggucggaccgug

SEQ ID NO: 1989072 - RNA, 19 nt, Homo sapiens
uggguauuucuuggcaugc

SEQ ID NO: 1989073 - RNA, 13 nt, Homo sapiens
uuuauugcacaaa

SEQ ID NO: 1989074 - RNA, 18 nt, Homo sapiens
uuuuggaauaaacugucu

SEQ ID NO: 1989075 - RNA, 17 nt, Homo sapiens
gaugauauaauuuaacu

SEQ ID NO: 1989076 - RNA, 17 nt, Homo sapiens
uauuuaauuaaaucuca

SEQ ID NO: 1989077 - RNA, 19 nt, Homo sapiens
cucuggcuuugucucuagc

SEQ ID NO: 1989078 - RNA, 17 nt, Homo sapiens
caaauacggauccugca

SEQ ID NO: 1989079 - RNA, 23 nt, Homo sapiens
ugcauaucacuugauaugugcac

SEQ ID NO: 1989080 - RNA, 18 nt, Homo sapiens
uccagcuaacauacuaua

SEQ ID NO: 1989081 - RNA, 21 nt, Homo sapiens
gaaacucaguaugcugccccu

SEQ ID NO: 1989082 - RNA, 21 nt, Homo sapiens
aaagcaauucagaaaggaugc

SEQ ID NO: 1989083 - RNA, 15 nt, Homo sapiens
agaauuuaagacuug

SEQ ID NO: 1989084 - RNA, 16 nt, Homo sapiens
guuucagccacacuga

SEQ ID NO: 1989085 - RNA, 14 nt, Homo sapiens
acugaagaccagcu

SEQ ID NO: 1989086 - RNA, 17 nt, Homo sapiens
uuuaaaugaaagugaga

SEQ ID NO: 1989087 - RNA, 18 nt, Homo sapiens
agacuggcggggggccca

SEQ ID NO: 1989088 - RNA, 22 nt, Homo sapiens
uugaucaugaauaacugauuag

SEQ ID NO: 1989089 - RNA, 22 nt, Homo sapiens
uacacacucugagucucugaau

SEQ ID NO: 1989090 - RNA, 19 nt, Homo sapiens
ugucuggauucccaggaug

SEQ ID NO: 1989091 - RNA, 21 nt, Homo sapiens
uggcucaugccuguaaucuca

SEQ ID NO: 1989092 - RNA, 22 nt, Homo sapiens
ucggaggccauccugccagggg

SEQ ID NO: 1989093 - RNA, 21 nt, Homo sapiens
uacugaugguuacauauacua

SEQ ID NO: 1989094 - RNA, 15 nt, Homo sapiens
uguguguguguacaa

SEQ ID NO: 1989095 - RNA, 23 nt, Homo sapiens
gacagugacuggugccaguguca

SEQ ID NO: 1989096 - RNA, 15 nt, Homo sapiens
guuuauguagucagu

SEQ ID NO: 1989097 - RNA, 14 nt, Homo sapiens
cuagucaguuggcu

SEQ ID NO: 1989098 - RNA, 20 nt, Homo sapiens
cuaucuuggcucacugcaaa

SEQ ID NO: 1989099 - RNA, 18 nt, Homo sapiens
uguuucuggggacaccag

SEQ ID NO: 1989100 - RNA, 22 nt, Homo sapiens
uaugugucccgaauccacaguc

SEQ ID NO: 1989101 - RNA, 19 nt, Homo sapiens
auauccucucagcucucuu

SEQ ID NO: 1989102 - RNA, 14 nt, Homo sapiens
aaaagucacuuacu

SEQ ID NO: 1989103 - RNA, 18 nt, Homo sapiens
acacauguauccuuucac

SEQ ID NO: 1989104 - RNA, 16 nt, Homo sapiens
ugaaagugacagagac

SEQ ID NO: 1989105 - RNA, 17 nt, Homo sapiens
uguaggucacucuccag

SEQ ID NO: 1989106 - RNA, 19 nt, Homo sapiens
uuuaauugugaauuagacu

SEQ ID NO: 1989107 - RNA, 22 nt, Homo sapiens
uggacacucaaacacaucauaa

SEQ ID NO: 1989108 - RNA, 20 nt, Homo sapiens
agagccugugcuaaagaagc

SEQ ID NO: 1989109 - RNA, 22 nt, Homo sapiens
ccuacauuuuaaugcaccugaa

SEQ ID NO: 1989110 - RNA, 17 nt, Homo sapiens
aacccuuaaaaaugcac

SEQ ID NO: 1989111 - RNA, 14 nt, Homo sapiens
aagauacauuucau

SEQ ID NO: 1989112 - RNA, 20 nt, Homo sapiens
accaugaccccuucucucuc

SEQ ID NO: 1989113 - RNA, 15 nt, Homo sapiens
caagccccacccucc

SEQ ID NO: 1989114 - RNA, 22 nt, Homo sapiens
aaggacugccgaccgaggcugg

SEQ ID NO: 1989115 - RNA, 21 nt, Homo sapiens
ucugaggaaggugcuugccug

SEQ ID NO: 1989116 - RNA, 13 nt, Homo sapiens
uucaaacauauau

SEQ ID NO: 1989117 - RNA, 16 nt, Homo sapiens
ucugaagagcuagucu

SEQ ID NO: 1989118 - RNA, 18 nt, Homo sapiens
ggcagucugggcacuuuu

SEQ ID NO: 1989119 - RNA, 20 nt, Homo sapiens
ugcuucagaguuugugugua

SEQ ID NO: 1989120 - RNA, 22 nt, Homo sapiens
acuacaaagauauuucagagag

SEQ ID NO: 1989121 - RNA, 13 nt, Homo sapiens
cugcauuccagcc

SEQ ID NO: 1989122 - RNA, 14 nt, Homo sapiens
uuagcuaccugcua

SEQ ID NO: 1989123 - RNA, 21 nt, Homo sapiens
cuggcaguaaccuagugaauu

SEQ ID NO: 1989124 - RNA, 13 nt, Homo sapiens
uaaagaauuacuu

SEQ ID NO: 1989125 - RNA, 16 nt, Homo sapiens
ggcugggcugagccaa

SEQ ID NO: 1989126 - RNA, 18 nt, Homo sapiens
uacuuugccaacuugcca

SEQ ID NO: 1989127 - RNA, 16 nt, Homo sapiens
uaauugcugccaggau

SEQ ID NO: 1989128 - RNA, 16 nt, Homo sapiens
caugaagauucuuucc

SEQ ID NO: 1989129 - RNA, 19 nt, Homo sapiens
aguugcagucacucuaguc

SEQ ID NO: 1989130 - RNA, 15 nt, Homo sapiens
auacaucuucauuaa

SEQ ID NO: 1989131 - RNA, 14 nt, Homo sapiens
gcccacuggccgcu

SEQ ID NO: 1989132 - RNA, 15 nt, Homo sapiens
caggaaggaggugca

SEQ ID NO: 1989133 - RNA, 23 nt, Homo sapiens
cacagcugagagacuuuuaauca

SEQ ID NO: 1989134 - RNA, 18 nt, Homo sapiens
guuuuacaaugucauaua

SEQ ID NO: 1989135 - RNA, 16 nt, Homo sapiens
gccgaagcccaccacu

SEQ ID NO: 1989136 - RNA, 20 nt, Homo sapiens
ccagaacaauggcuauucau

SEQ ID NO: 1989137 - RNA, 22 nt, Homo sapiens
gacagagccaggagaagcucag

SEQ ID NO: 1989138 - RNA, 18 nt, Homo sapiens
aaugauuuacucaauauc

SEQ ID NO: 1989139 - RNA, 14 nt, Homo sapiens
cugauuaguauuca

SEQ ID NO: 1989140 - RNA, 21 nt, Homo sapiens
acugaagccugcguuggucca

SEQ ID NO: 1989141 - RNA, 16 nt, Homo sapiens
gcaguugagacaagaa

SEQ ID NO: 1989142 - RNA, 13 nt, Homo sapiens
cucuagcuucuac

SEQ ID NO: 1989143 - RNA, 23 nt, Homo sapiens
ucuuaacauuucuaacucugaug

SEQ ID NO: 1989144 - RNA, 18 nt, Homo sapiens
ugcauuuuguguacagua

SEQ ID NO: 1989145 - RNA, 16 nt, Homo sapiens
aaugcagcagggaugc

SEQ ID NO: 1989146 - RNA, 21 nt, Homo sapiens
ugcauccaggacugugccagc

SEQ ID NO: 1989147 - RNA, 15 nt, Homo sapiens
cuggcaucucacuuu

SEQ ID NO: 1989148 - RNA, 20 nt, Homo sapiens
uuaaagaaaaaaaaagucag

SEQ ID NO: 1989149 - RNA, 19 nt, Homo sapiens
aagcagaaauaaaguuuaa

SEQ ID NO: 1989150 - RNA, 22 nt, Homo sapiens
uacuaccuguccccuaugccac

SEQ ID NO: 1989151 - RNA, 18 nt, Homo sapiens
guauccuuucaguguuau

SEQ ID NO: 1989152 - RNA, 19 nt, Homo sapiens
accgaggugcuauccugcc

SEQ ID NO: 1989153 - RNA, 18 nt, Homo sapiens
uacuacuagaucacuugu

SEQ ID NO: 1989154 - RNA, 18 nt, Homo sapiens
uaagagaaucaacauuuc

SEQ ID NO: 1989155 - RNA, 16 nt, Homo sapiens
ucaccugagaccucca

SEQ ID NO: 1989156 - RNA, 12 nt, Homo sapiens
aacucuguacaa

SEQ ID NO: 1989157 - RNA, 16 nt, Homo sapiens
aagucuccuguaucau

SEQ ID NO: 1989158 - RNA, 23 nt, Homo sapiens
ggcuuuggacuccuuguuugccu

SEQ ID NO: 1989159 - RNA, 18 nt, Homo sapiens
acauauuacuggaaguaa

SEQ ID NO: 1989160 - RNA, 23 nt, Homo sapiens
gaaaaauaguucuaaacuaucaa

SEQ ID NO: 1989161 - RNA, 23 nt, Homo sapiens
cuggaugugcccacagggaccaa

SEQ ID NO: 1989162 - RNA, 18 nt, Homo sapiens
ccagugucaggguccagg

SEQ ID NO: 1989163 - RNA, 14 nt, Homo sapiens
cggagcuauacaua

SEQ ID NO: 1989164 - RNA, 19 nt, Homo sapiens
aucguccaccccagugugc

SEQ ID NO: 1989165 - RNA, 17 nt, Homo sapiens
caagcccugcagucaca

SEQ ID NO: 1989166 - RNA, 23 nt, Homo sapiens
uugaauuguuacaucaugcugga

SEQ ID NO: 1989167 - RNA, 21 nt, Homo sapiens
cagggucucacucugucgccc

SEQ ID NO: 1989168 - RNA, 23 nt, Homo sapiens
gacauucacucagagaagaccac

SEQ ID NO: 1989169 - RNA, 20 nt, Homo sapiens
caucagggccuuucuccucc

SEQ ID NO: 1989170 - RNA, 23 nt, Homo sapiens
gcaccuuagggagggacugggau

SEQ ID NO: 1989171 - RNA, 16 nt, Homo sapiens
caucacugggucugcu

SEQ ID NO: 1989172 - RNA, 22 nt, Homo sapiens
ugcauccccuuggcccaucugu

SEQ ID NO: 1989173 - RNA, 17 nt, Homo sapiens
acuaccucccacugagg

SEQ ID NO: 1989174 - RNA, 13 nt, Homo sapiens
aagacuccaaaga

SEQ ID NO: 1989175 - RNA, 18 nt, Homo sapiens
gacaaucacugccaaccc

SEQ ID NO: 1989176 - RNA, 16 nt, Homo sapiens
uguggcccaggccaga

SEQ ID NO: 1989177 - RNA, 17 nt, Homo sapiens
uccccaauccaggccaa

SEQ ID NO: 1989178 - RNA, 16 nt, Homo sapiens
uuuaagggauguugca

SEQ ID NO: 1989179 - RNA, 14 nt, Homo sapiens
ucucccacucugcc

SEQ ID NO: 1989180 - RNA, 14 nt, Homo sapiens
gauauugcuacuau

SEQ ID NO: 1989181 - RNA, 14 nt, Homo sapiens
augcuuauaggugg

SEQ ID NO: 1989182 - RNA, 20 nt, Homo sapiens
gaauagacuaucuagaacuu

SEQ ID NO: 1989183 - RNA, 20 nt, Homo sapiens
cauucuccagggguuuacag

SEQ ID NO: 1989184 - RNA, 20 nt, Homo sapiens
aagguuauguucauuuuuca

SEQ ID NO: 1989185 - RNA, 20 nt, Homo sapiens
cugcauuuagcuguauucau

SEQ ID NO: 1989186 - RNA, 20 nt, Homo sapiens
augugccuugauugauuaga

SEQ ID NO: 1989187 - RNA, 15 nt, Homo sapiens
auuucuuuucugcau

SEQ ID NO: 1989188 - RNA, 14 nt, Homo sapiens
agaccauaauguua

SEQ ID NO: 1989189 - RNA, 15 nt, Homo sapiens
gaaacguuugcccca

SEQ ID NO: 1989190 - RNA, 23 nt, Homo sapiens
accuguggccaguacucgggaca

SEQ ID NO: 1989191 - RNA, 15 nt, Homo sapiens
caugagucagucuga

SEQ ID NO: 1989192 - RNA, 22 nt, Homo sapiens
uuuaggcaaauaagcacuccuu

SEQ ID NO: 1989193 - RNA, 20 nt, Homo sapiens
ucugucauccauauuugcua

SEQ ID NO: 1989194 - RNA, 16 nt, Homo sapiens
uccccagggcugucau

SEQ ID NO: 1989195 - RNA, 16 nt, Homo sapiens
acccgaguaacuuucu

SEQ ID NO: 1989196 - RNA, 17 nt, Homo sapiens
cuccaacagccagugug

SEQ ID NO: 1989197 - RNA, 15 nt, Homo sapiens
cauccagcaugugug

SEQ ID NO: 1989198 - RNA, 13 nt, Homo sapiens
acuguucaugaau

SEQ ID NO: 1989199 - RNA, 19 nt, Homo sapiens
ucaacuucuggcuccucaa

SEQ ID NO: 1989200 - RNA, 14 nt, Homo sapiens
ucuguagcuauaau

SEQ ID NO: 1989201 - RNA, 15 nt, Homo sapiens
ugauaauagauucuc

SEQ ID NO: 1989202 - RNA, 17 nt, Homo sapiens
ggacaugauacugaugc

SEQ ID NO: 1989203 - RNA, 20 nt, Homo sapiens
uuuaaaaaacuuucuacuca

SEQ ID NO: 1989204 - RNA, 13 nt, Homo sapiens
uaaaucuaucuau

SEQ ID NO: 1989205 - RNA, 21 nt, Homo sapiens
gaggugcccacuccgccagcc

SEQ ID NO: 1989206 - RNA, 17 nt, Homo sapiens
cccauucucugccugua

SEQ ID NO: 1989207 - RNA, 15 nt, Homo sapiens
gaacuuuuaaacugc

SEQ ID NO: 1989208 - RNA, 14 nt, Homo sapiens
cugcuggucuucaa

SEQ ID NO: 1989209 - RNA, 14 nt, Homo sapiens
cuuaaaaaaaccau

SEQ ID NO: 1989210 - RNA, 12 nt, Homo sapiens
cacagugcagua

SEQ ID NO: 1989211 - RNA, 12 nt, Homo sapiens
agcagugccaua

SEQ ID NO: 1989212 - RNA, 19 nt, Homo sapiens
acggaccaugcgacacugg

SEQ ID NO: 1989213 - RNA, 23 nt, Homo sapiens
agcaucucuucuucccugucagc

SEQ ID NO: 1989214 - RNA, 20 nt, Homo sapiens
aaaaggucuguuaaugucau

SEQ ID NO: 1989215 - RNA, 21 nt, Homo sapiens
ucccagagggauugcugugaa

SEQ ID NO: 1989216 - RNA, 17 nt, Homo sapiens
caaguugacaaaugcca

SEQ ID NO: 1989217 - RNA, 22 nt, Homo sapiens
agggcugggcagguccugggga

SEQ ID NO: 1989218 - RNA, 21 nt, Homo sapiens
aagcaucucauuuugaguaga

SEQ ID NO: 1989219 - RNA, 20 nt, Homo sapiens
uaaaagcuacuauguacugc

SEQ ID NO: 1989220 - RNA, 14 nt, Homo sapiens
ccaucugugcagua

SEQ ID NO: 1989221 - RNA, 17 nt, Homo sapiens
acaugguuguaauaugc

SEQ ID NO: 1989222 - RNA, 13 nt, Homo sapiens
uagcagucacuga

SEQ ID NO: 1989223 - RNA, 17 nt, Homo sapiens
ggucaauggugcaaagg

SEQ ID NO: 1989224 - RNA, 13 nt, Homo sapiens
ugcccagaucaac

SEQ ID NO: 1989225 - RNA, 18 nt, Homo sapiens
cccauuuuggaaccuaau

SEQ ID NO: 1989226 - RNA, 23 nt, Homo sapiens
cagacagcuauuucgcacuguau

SEQ ID NO: 1989227 - RNA, 17 nt, Homo sapiens
aagaauuuaaaauaaca

SEQ ID NO: 1989228 - RNA, 15 nt, Homo sapiens
accccugcuaaggag

SEQ ID NO: 1989229 - RNA, 12 nt, Homo sapiens
uggccccaguga

SEQ ID NO: 1989230 - RNA, 15 nt, Homo sapiens
ccucccaggaaccaa

SEQ ID NO: 1989231 - RNA, 12 nt, Homo sapiens
cucguaccagcc

SEQ ID NO: 1989232 - RNA, 20 nt, Homo sapiens
cauauguuuuuguaaguuua

SEQ ID NO: 1989233 - RNA, 20 nt, Homo sapiens
uaaaggcuuaggacuucaaa

SEQ ID NO: 1989234 - RNA, 11 nt, Homo sapiens
aagagaauuau

SEQ ID NO: 1989235 - RNA, 23 nt, Homo sapiens
cuccaaucgauguuuagugugau

SEQ ID NO: 1989236 - RNA, 10 nt, Homo sapiens
auaggacaaa

SEQ ID NO: 1989237 - RNA, 17 nt, Homo sapiens
ccugucccccugagauc

SEQ ID NO: 1989238 - RNA, 17 nt, Homo sapiens
ucccucccucccagauc

SEQ ID NO: 1989239 - RNA, 14 nt, Homo sapiens
aacagauacauuca

SEQ ID NO: 1989240 - RNA, 15 nt, Homo sapiens
uuacacaucuuccac

SEQ ID NO: 1989241 - RNA, 20 nt, Homo sapiens
cuuccaacguggcccagaga

SEQ ID NO: 1989242 - RNA, 16 nt, Homo sapiens
cagucugcaucaucau

SEQ ID NO: 1989243 - RNA, 20 nt, Homo sapiens
gcacauugccuguucugcuu

SEQ ID NO: 1989244 - RNA, 15 nt, Homo sapiens
caaaucugauuucau

SEQ ID NO: 1989245 - RNA, 22 nt, Homo sapiens
ucccagcucuagccucuggacu

SEQ ID NO: 1989246 - RNA, 13 nt, Homo sapiens
gucccuccaggga

SEQ ID NO: 1989247 - RNA, 15 nt, Homo sapiens
agagaguauggugcu

SEQ ID NO: 1989248 - RNA, 14 nt, Homo sapiens
gguuccuccucucc

SEQ ID NO: 1989249 - RNA, 20 nt, Homo sapiens
cacaaccuccuccuccaguu

SEQ ID NO: 1989250 - RNA, 18 nt, Homo sapiens
ugaccucuugaucugccc

SEQ ID NO: 1989251 - RNA, 16 nt, Homo sapiens
aggugcgugugucucu

SEQ ID NO: 1989252 - RNA, 17 nt, Homo sapiens
ggggagagcuggcagug

SEQ ID NO: 1989253 - RNA, 19 nt, Homo sapiens
cuguccaccugugcugcug

SEQ ID NO: 1989254 - RNA, 20 nt, Homo sapiens
auagauccccccacugagcu

SEQ ID NO: 1989255 - RNA, 14 nt, Homo sapiens
accaaaugauuuca

SEQ ID NO: 1989256 - RNA, 13 nt, Homo sapiens
cccaagugccuca

SEQ ID NO: 1989257 - RNA, 13 nt, Homo sapiens
cccaugugccucu

SEQ ID NO: 1989258 - RNA, 21 nt, Homo sapiens
augagggugggggugauacua

SEQ ID NO: 1989259 - RNA, 13 nt, Homo sapiens
uuggacacacugg

SEQ ID NO: 1989260 - RNA, 13 nt, Homo sapiens
caggaggcugcaa

SEQ ID NO: 1989261 - RNA, 12 nt, Homo sapiens
cauaaaucacaa

SEQ ID NO: 1989262 - RNA, 20 nt, Homo sapiens
gaacagaccggagaggacag

SEQ ID NO: 1989263 - RNA, 13 nt, Homo sapiens
agaaucuuuucaa

SEQ ID NO: 1989264 - RNA, 24 nt, Homo sapiens
auucucauuaaaagaauaucuggc

SEQ ID NO: 1989265 - RNA, 14 nt, Homo sapiens
acccagcacccaca

SEQ ID NO: 1989266 - RNA, 15 nt, Homo sapiens
cacacccauguguac

SEQ ID NO: 1989267 - RNA, 13 nt, Homo sapiens
aucuuucuaggag

SEQ ID NO: 1989268 - RNA, 15 nt, Homo sapiens
cacugccaccuugug

SEQ ID NO: 1989269 - RNA, 22 nt, Homo sapiens
cagaacagugguggcaacauuc

SEQ ID NO: 1989270 - RNA, 12 nt, Homo sapiens
aaaaacaaguuu

SEQ ID NO: 1989271 - RNA, 12 nt, Homo sapiens
agagaaccauga

SEQ ID NO: 1989272 - RNA, 16 nt, Homo sapiens
ucccgggccucagggu

SEQ ID NO: 1989273 - RNA, 20 nt, Homo sapiens
acauacuauauaagccagug

SEQ ID NO: 1989274 - RNA, 13 nt, Homo sapiens
gcacacauuuaac

SEQ ID NO: 1989275 - RNA, 14 nt, Homo sapiens
accaaaaacauuug

SEQ ID NO: 1989276 - RNA, 17 nt, Homo sapiens
cauccacauuguuuuaa

SEQ ID NO: 1989277 - RNA, 18 nt, Homo sapiens
ugcggaaaugugucuugu

SEQ ID NO: 1989278 - RNA, 15 nt, Homo sapiens
caacuccucuccucc

SEQ ID NO: 1989279 - RNA, 17 nt, Homo sapiens
cacaggagcguguccua

SEQ ID NO: 1989280 - RNA, 19 nt, Homo sapiens
ucuuugauuuguaccauuc

SEQ ID NO: 1989281 - RNA, 21 nt, Homo sapiens
caaaugcuccuccuccaugcu

SEQ ID NO: 1989282 - RNA, 13 nt, Homo sapiens
aaaguggagugua

SEQ ID NO: 1989283 - RNA, 17 nt, Homo sapiens
aaugccaccggaacccc

SEQ ID NO: 1989284 - RNA, 18 nt, Homo sapiens
cagguuguugucaucuga

SEQ ID NO: 1989285 - RNA, 21 nt, Homo sapiens
uuugcacccuguagauguucu

SEQ ID NO: 1989286 - RNA, 21 nt, Homo sapiens
accguggccccaaauuugcua

SEQ ID NO: 1989287 - RNA, 15 nt, Homo sapiens
gguugggcagccaga

SEQ ID NO: 1989288 - RNA, 20 nt, Homo sapiens
uuauuuacugacauauaucu

SEQ ID NO: 1989289 - RNA, 20 nt, Homo sapiens
gcccaccuggaaucccacaa

SEQ ID NO: 1989290 - RNA, 15 nt, Homo sapiens
cagcugauugggcac

SEQ ID NO: 1989291 - RNA, 20 nt, Homo sapiens
uucuccacuuucuagccaga

SEQ ID NO: 1989292 - RNA, 12 nt, Homo sapiens
uacugacugaga

SEQ ID NO: 1989293 - RNA, 16 nt, Homo sapiens
uuugcugcagacucau

SEQ ID NO: 1989294 - RNA, 22 nt, Homo sapiens
ugcuauucccuggggcugcugu

SEQ ID NO: 1989295 - RNA, 16 nt, Homo sapiens
uuauuuagcuggccau

SEQ ID NO: 1989296 - RNA, 12 nt, Homo sapiens
gcccaacaguaa

SEQ ID NO: 1989297 - RNA, 14 nt, Homo sapiens
cuaccaauguagac

SEQ ID NO: 1989298 - RNA, 14 nt, Homo sapiens
uuacaucugccuua

SEQ ID NO: 1989299 - RNA, 22 nt, Homo sapiens
cagauuuagguuacuuuagugu

SEQ ID NO: 1989300 - RNA, 21 nt, Homo sapiens
gucacagggccaacuugaggg

SEQ ID NO: 1989301 - RNA, 22 nt, Homo sapiens
cuugaaucaggaggagauuaac

SEQ ID NO: 1989302 - RNA, 15 nt, Homo sapiens
cacuguaaaugcagc

SEQ ID NO: 1989303 - RNA, 22 nt, Homo sapiens
uuaagagagucuauuuacggaa

SEQ ID NO: 1989304 - RNA, 23 nt, Homo sapiens
aaguaacaaugcaugcuuuggaa

SEQ ID NO: 1989305 - RNA, 15 nt, Homo sapiens
uaugccucauacaca

SEQ ID NO: 1989306 - RNA, 23 nt, Homo sapiens
cagccauuguggaagacagugug

SEQ ID NO: 1989307 - RNA, 12 nt, Homo sapiens
uagaaaugcuac

SEQ ID NO: 1989308 - RNA, 12 nt, Homo sapiens
ccauguguuuca

SEQ ID NO: 1989309 - RNA, 19 nt, Homo sapiens
guaccucucucugcuccuc

SEQ ID NO: 1989310 - RNA, 23 nt, Homo sapiens
cacuuuuaaaggaaugugaaauu

SEQ ID NO: 1989311 - RNA, 22 nt, Homo sapiens
aaggguguucgguugcgugcau

SEQ ID NO: 1989312 - RNA, 17 nt, Homo sapiens
ucucagauuuccacaga

SEQ ID NO: 1989313 - RNA, 14 nt, Homo sapiens
acucuuggccucaa

SEQ ID NO: 1989314 - RNA, 20 nt, Homo sapiens
ccccaugcucugaugcagug

SEQ ID NO: 1989315 - RNA, 13 nt, Homo sapiens
aaaagucagucuu

SEQ ID NO: 1989316 - RNA, 17 nt, Homo sapiens
ugucaucagccugugua

SEQ ID NO: 1989317 - RNA, 16 nt, Homo sapiens
cagaaagcucaucuca

SEQ ID NO: 1989318 - RNA, 13 nt, Homo sapiens
uccauauauauuc

SEQ ID NO: 1989319 - RNA, 13 nt, Homo sapiens
cucacacauuuac

SEQ ID NO: 1989320 - RNA, 13 nt, Homo sapiens
cacaaacauauaa

SEQ ID NO: 1989321 - RNA, 18 nt, Homo sapiens
ccuuaucugaaaggccag

SEQ ID NO: 1989322 - RNA, 18 nt, Homo sapiens
uguucuguuacaaaaugu

SEQ ID NO: 1989323 - RNA, 16 nt, Homo sapiens
uuuagaaaugcaaaau

SEQ ID NO: 1989324 - RNA, 17 nt, Homo sapiens
guuagugaacuagguag

SEQ ID NO: 1989325 - RNA, 20 nt, Homo sapiens
caaggucagcucccaucuca

SEQ ID NO: 1989326 - RNA, 19 nt, Homo sapiens
aguuuuuuuccuucaagaa

SEQ ID NO: 1989327 - RNA, 15 nt, Homo sapiens
uucuuugcugcugcu

SEQ ID NO: 1989328 - RNA, 23 nt, Homo sapiens
aaaauucccuaaagacuaacuug

SEQ ID NO: 1989329 - RNA, 14 nt, Homo sapiens
uauucauccuaaaa

SEQ ID NO: 1989330 - RNA, 13 nt, Homo sapiens
cucacuccuagga

SEQ ID NO: 1989331 - RNA, 21 nt, Homo sapiens
ucucaccugccgugcguacug

SEQ ID NO: 1989332 - RNA, 14 nt, Homo sapiens
ugauuuacauucaa

SEQ ID NO: 1989333 - RNA, 15 nt, Homo sapiens
gaggaaccuacugcc

SEQ ID NO: 1989334 - RNA, 16 nt, Homo sapiens
ucaccauugcugucaa

SEQ ID NO: 1989335 - RNA, 15 nt, Homo sapiens
caauaaucucuauuu

SEQ ID NO: 1989336 - RNA, 13 nt, Homo sapiens
uaguaacaagaaa

SEQ ID NO: 1989337 - RNA, 23 nt, Homo sapiens
aagggggugaccucuugccucga

SEQ ID NO: 1989338 - RNA, 14 nt, Homo sapiens
uauauaaaccugga

SEQ ID NO: 1989339 - RNA, 17 nt, Homo sapiens
gcaucuuucucuuccca

SEQ ID NO: 1989340 - RNA, 20 nt, Homo sapiens
auucaauccucaggucucca

SEQ ID NO: 1989341 - RNA, 22 nt, Homo sapiens
ccugugucagaaacccuggucu

SEQ ID NO: 1989342 - RNA, 18 nt, Homo sapiens
agaccauuucacagaaaa

SEQ ID NO: 1989343 - RNA, 20 nt, Homo sapiens
uauagcuaggugacauauac

SEQ ID NO: 1989344 - RNA, 22 nt, Homo sapiens
agaaucuuugcaugcagaggag

SEQ ID NO: 1989345 - RNA, 19 nt, Homo sapiens
auguauugugucuuuugca

SEQ ID NO: 1989346 - RNA, 21 nt, Homo sapiens
ucacaaccuccaacaacacuu

SEQ ID NO: 1989347 - RNA, 19 nt, Homo sapiens
caccugcacaaacauagac

SEQ ID NO: 1989348 - RNA, 23 nt, Homo sapiens
uuaaaagcaaguuucagugaagg

SEQ ID NO: 1989349 - RNA, 20 nt, Homo sapiens
aaagacacaggcauggcuaa

SEQ ID NO: 1989350 - RNA, 13 nt, Homo sapiens
ucugucucccuuc

SEQ ID NO: 1989351 - RNA, 23 nt, Homo sapiens
ucaaaugucauuucauacaaauu

SEQ ID NO: 1989352 - RNA, 14 nt, Homo sapiens
uugaccuugugaca

SEQ ID NO: 1989353 - RNA, 23 nt, Homo sapiens
agcuuccauguuuaauguuaucc

SEQ ID NO: 1989354 - RNA, 17 nt, Homo sapiens
cuggucagaugauauaa

SEQ ID NO: 1989355 - RNA, 17 nt, Homo sapiens
uccaaccccuuuccacg

SEQ ID NO: 1989356 - RNA, 18 nt, Homo sapiens
cagaggcugcagaaggcc

SEQ ID NO: 1989357 - RNA, 18 nt, Homo sapiens
aaagaacugaaagcacua

SEQ ID NO: 1989358 - RNA, 18 nt, Homo sapiens
aacaaugccaucacugga

SEQ ID NO: 1989359 - RNA, 13 nt, Homo sapiens
aaugauacuuacu

SEQ ID NO: 1989360 - RNA, 14 nt, Homo sapiens
caccagucaccucg

SEQ ID NO: 1989361 - RNA, 14 nt, Homo sapiens
ccauccucaaacac

SEQ ID NO: 1989362 - RNA, 20 nt, Homo sapiens
aauauacgaaaagccagcuu

SEQ ID NO: 1989363 - RNA, 21 nt, Homo sapiens
ugggcugucagcccaugugca

SEQ ID NO: 1989364 - RNA, 15 nt, Homo sapiens
ugucagaaguugaua

SEQ ID NO: 1989365 - RNA, 23 nt, Homo sapiens
aaaaccuacacacguaccuucau

SEQ ID NO: 1989366 - RNA, 17 nt, Homo sapiens
auuuuguagccucucuu

SEQ ID NO: 1989367 - RNA, 21 nt, Homo sapiens
aacuaaagcuggagagaccug

SEQ ID NO: 1989368 - RNA, 13 nt, Homo sapiens
gaagugcucuuuc

SEQ ID NO: 1989369 - RNA, 18 nt, Homo sapiens
ucuucugcacaucuacuu

SEQ ID NO: 1989370 - RNA, 16 nt, Homo sapiens
cacuuucugaaauuca

SEQ ID NO: 1989371 - RNA, 17 nt, Homo sapiens
gcugaggcccagugcau

SEQ ID NO: 1989372 - RNA, 20 nt, Homo sapiens
ugccucacugugucccaaaa

SEQ ID NO: 1989373 - RNA, 20 nt, Homo sapiens
uuucguuugcauugucuuua

SEQ ID NO: 1989374 - RNA, 22 nt, Homo sapiens
acuucauauaacugagaugaau

SEQ ID NO: 1989375 - RNA, 16 nt, Homo sapiens
cgaaaugguaccaagg

SEQ ID NO: 1989376 - RNA, 20 nt, Homo sapiens
agcuacauagcagacuuucc

SEQ ID NO: 1989377 - RNA, 18 nt, Homo sapiens
cuuugugaaaacuacuga

SEQ ID NO: 1989378 - RNA, 20 nt, Homo sapiens
ugcaaaggaaauaccaguuc

SEQ ID NO: 1989379 - RNA, 22 nt, Homo sapiens
cagucccugacuaacagccuca

SEQ ID NO: 1989380 - RNA, 11 nt, Homo sapiens
ccccaauccaa

SEQ ID NO: 1989381 - RNA, 20 nt, Homo sapiens
uugaaacagauucaggccag

SEQ ID NO: 1989382 - RNA, 14 nt, Homo sapiens
gcccacuucccucc

SEQ ID NO: 1989383 - RNA, 17 nt, Homo sapiens
cuugaguuccucugcag

SEQ ID NO: 1989384 - RNA, 21 nt, Homo sapiens
caugcaguugcagugaauuca

SEQ ID NO: 1989385 - RNA, 15 nt, Homo sapiens
uauuuuaaccugcau

SEQ ID NO: 1989386 - RNA, 14 nt, Homo sapiens
acggcucacugcag

SEQ ID NO: 1989387 - RNA, 12 nt, Homo sapiens
ccuaugcuuuca

SEQ ID NO: 1989388 - RNA, 13 nt, Homo sapiens
cccagcaagauga

SEQ ID NO: 1989389 - RNA, 15 nt, Homo sapiens
auugguaugaugcug

SEQ ID NO: 1989390 - RNA, 20 nt, Homo sapiens
uaugugagugaaaguacuuc

SEQ ID NO: 1989391 - RNA, 17 nt, Homo sapiens
cucccucuuucuagccu

SEQ ID NO: 1989392 - RNA, 23 nt, Homo sapiens
acauaggaaaaugccaugaaaau

SEQ ID NO: 1989393 - RNA, 19 nt, Homo sapiens
cgacucccccaaccaagga

SEQ ID NO: 1989394 - RNA, 16 nt, Homo sapiens
gaaguuuucuugacuu

SEQ ID NO: 1989395 - RNA, 18 nt, Homo sapiens
auuucauaccuaucaucu

SEQ ID NO: 1989396 - RNA, 23 nt, Homo sapiens
uagaacauucacuuuuguuaaca

SEQ ID NO: 1989397 - RNA, 20 nt, Homo sapiens
aaagacugauuuugcuuuuu

SEQ ID NO: 1989398 - RNA, 19 nt, Homo sapiens
gucacagaggaucugcuug

SEQ ID NO: 1989399 - RNA, 15 nt, Homo sapiens
gguagaaaaccucac

SEQ ID NO: 1989400 - RNA, 14 nt, Homo sapiens
uauaguaaaugccu

SEQ ID NO: 1989401 - RNA, 22 nt, Homo sapiens
ucuuauuuaaauuuucagaaag

SEQ ID NO: 1989402 - RNA, 12 nt, Homo sapiens
aguccagucucu

SEQ ID NO: 1989403 - RNA, 15 nt, Homo sapiens
uaagagaucccuuaa

SEQ ID NO: 1989404 - RNA, 15 nt, Homo sapiens
uaauggaugcucauu

SEQ ID NO: 1989405 - RNA, 15 nt, Homo sapiens
acaaagucucacugu

SEQ ID NO: 1989406 - RNA, 16 nt, Homo sapiens
uuuuugucaagacaag

SEQ ID NO: 1989407 - RNA, 23 nt, Homo sapiens
uaaauaucccagagaacaaucac

SEQ ID NO: 1989408 - RNA, 17 nt, Homo sapiens
cccugucauccagcuca

SEQ ID NO: 1989409 - RNA, 15 nt, Homo sapiens
ugggcaucccagcuu

SEQ ID NO: 1989410 - RNA, 13 nt, Homo sapiens
cuugucauaaaau

SEQ ID NO: 1989411 - RNA, 13 nt, Homo sapiens
cuugccauaaaac

SEQ ID NO: 1989412 - RNA, 14 nt, Homo sapiens
aagcugucuuagag

SEQ ID NO: 1989413 - RNA, 12 nt, Homo sapiens
gaggguuuccac

SEQ ID NO: 1989414 - RNA, 18 nt, Homo sapiens
uagagaggggacuggggg

SEQ ID NO: 1989415 - RNA, 16 nt, Homo sapiens
cacuguuuuuuuccca

SEQ ID NO: 1989416 - RNA, 13 nt, Homo sapiens
caauuccaugaau

SEQ ID NO: 1989417 - RNA, 15 nt, Homo sapiens
auuucacacagugaa

SEQ ID NO: 1989418 - RNA, 20 nt, Homo sapiens
auggggguggggaggcaaga

SEQ ID NO: 1989419 - RNA, 23 nt, Homo sapiens
cagcaaauguguguagauuucau

SEQ ID NO: 1989420 - RNA, 15 nt, Homo sapiens
ugacagguugcugaa

SEQ ID NO: 1989421 - RNA, 17 nt, Homo sapiens
ccugaaucagaggcaga

SEQ ID NO: 1989422 - RNA, 17 nt, Homo sapiens
gcgucaccugugcaggg

SEQ ID NO: 1989423 - RNA, 18 nt, Homo sapiens
acgcuuccagaccaccug

SEQ ID NO: 1989424 - RNA, 18 nt, Homo sapiens
gaugaguaaaacuggugg

SEQ ID NO: 1989425 - RNA, 18 nt, Homo sapiens
cuggaauagaaacagugg

SEQ ID NO: 1989426 - RNA, 19 nt, Homo sapiens
aguguaacgaugcacuuug

SEQ ID NO: 1989427 - RNA, 13 nt, Homo sapiens
uucggagcucuuc

SEQ ID NO: 1989428 - RNA, 15 nt, Homo sapiens
ccaccugcucaccaa

SEQ ID NO: 1989429 - RNA, 15 nt, Homo sapiens
cacugugcuacugaa

SEQ ID NO: 1989430 - RNA, 20 nt, Homo sapiens
gaaggcaucugaugccuuca

SEQ ID NO: 1989431 - RNA, 23 nt, Homo sapiens
aaaugaagacaccagaguguaug

SEQ ID NO: 1989432 - RNA, 21 nt, Homo sapiens
gccuuguguauauuuguauau

SEQ ID NO: 1989433 - RNA, 18 nt, Homo sapiens
gugugucgcgcacacagc

SEQ ID NO: 1989434 - RNA, 20 nt, Homo sapiens
cauaauuagaguuuguguau

SEQ ID NO: 1989435 - RNA, 18 nt, Homo sapiens
caauauguaacaugucua

SEQ ID NO: 1989436 - RNA, 17 nt, Homo sapiens
aaagacucaaaaagcug

SEQ ID NO: 1989437 - RNA, 18 nt, Homo sapiens
ucaauaaaaccacuguac

SEQ ID NO: 1989438 - RNA, 18 nt, Homo sapiens
ggaguacaccccaacagc

SEQ ID NO: 1989439 - RNA, 20 nt, Homo sapiens
augaagcaaugcuucauccc

SEQ ID NO: 1989440 - RNA, 12 nt, Homo sapiens
agggugcucagu

SEQ ID NO: 1989441 - RNA, 13 nt, Homo sapiens
uccacccaugaug

SEQ ID NO: 1989442 - RNA, 16 nt, Homo sapiens
cuugaagacacugaaa

SEQ ID NO: 1989443 - RNA, 14 nt, Homo sapiens
aguuccaccaucaa

SEQ ID NO: 1989444 - RNA, 22 nt, Homo sapiens
ugccucccccucgacucccggu

SEQ ID NO: 1989445 - RNA, 15 nt, Homo sapiens
ucuaccuguacacau

SEQ ID NO: 1989446 - RNA, 14 nt, Homo sapiens
uacaggugaggcaa

SEQ ID NO: 1989447 - RNA, 16 nt, Homo sapiens
gcgcccccaccccaga

SEQ ID NO: 1989448 - RNA, 22 nt, Homo sapiens
acccauuuucgcuauaaauaaa

SEQ ID NO: 1989449 - RNA, 14 nt, Homo sapiens
aggcccccaucucc

SEQ ID NO: 1989450 - RNA, 17 nt, Homo sapiens
aacucuagagagccuua

SEQ ID NO: 1989451 - RNA, 21 nt, Homo sapiens
ggaaucucuuggaugcagcuu

SEQ ID NO: 1989452 - RNA, 14 nt, Homo sapiens
aaggccacauguca

SEQ ID NO: 1989453 - RNA, 12 nt, Homo sapiens
acuuuuuuacac

SEQ ID NO: 1989454 - RNA, 15 nt, Homo sapiens
aggcugaggcacaag

SEQ ID NO: 1989455 - RNA, 15 nt, Homo sapiens
cccuacacugugaag

SEQ ID NO: 1989456 - RNA, 23 nt, Homo sapiens
uuugacaaauugaagauggaugu

SEQ ID NO: 1989457 - RNA, 16 nt, Homo sapiens
agugcuccugugugcu

SEQ ID NO: 1989458 - RNA, 16 nt, Homo sapiens
uaucugcuuccauuaa

SEQ ID NO: 1989459 - RNA, 10 nt, Homo sapiens
augacuaugc

SEQ ID NO: 1989460 - RNA, 16 nt, Homo sapiens
cuuauuccaugacugc

SEQ ID NO: 1989461 - RNA, 17 nt, Homo sapiens
ugguaacuguagucauc

SEQ ID NO: 1989462 - RNA, 19 nt, Homo sapiens
guagcugggacuacaggug

SEQ ID NO: 1989463 - RNA, 18 nt, Homo sapiens
auacugaaaaaaugcuga

SEQ ID NO: 1989464 - RNA, 18 nt, Homo sapiens
guaaaucuaaacauaaaa

SEQ ID NO: 1989465 - RNA, 16 nt, Homo sapiens
gcgccgggggaccugg

SEQ ID NO: 1989466 - RNA, 22 nt, Homo sapiens
aagcuccuguccucccaucccc

SEQ ID NO: 1989467 - RNA, 15 nt, Homo sapiens
aagaguaacagucau

SEQ ID NO: 1989468 - RNA, 16 nt, Homo sapiens
gaauaaugaauggacu

SEQ ID NO: 1989469 - RNA, 17 nt, Homo sapiens
auuuuguaucaccucuu

SEQ ID NO: 1989470 - RNA, 18 nt, Homo sapiens
aauaauacauacuaauga

SEQ ID NO: 1989471 - RNA, 18 nt, Homo sapiens
ggcaccuguguuccagcc

SEQ ID NO: 1989472 - RNA, 20 nt, Homo sapiens
cuuuuaaaaaauacucugcu

SEQ ID NO: 1989473 - RNA, 24 nt, Homo sapiens
uccaccuuaaauuaaacaauuuau

SEQ ID NO: 1989474 - RNA, 16 nt, Homo sapiens
auggaagacagcagga

SEQ ID NO: 1989475 - RNA, 15 nt, Homo sapiens
ccugcuugcacacuu

SEQ ID NO: 1989476 - RNA, 13 nt, Homo sapiens
aagcauaacuuau

SEQ ID NO: 1989477 - RNA, 13 nt, Homo sapiens
augcuuaacauaa

SEQ ID NO: 1989478 - RNA, 14 nt, Homo sapiens
gauagaaugucaau

SEQ ID NO: 1989479 - RNA, 14 nt, Homo sapiens
cucugccugcauuc

SEQ ID NO: 1989480 - RNA, 19 nt, Homo sapiens
accucagauggcagcuuuu

SEQ ID NO: 1989481 - RNA, 21 nt, Homo sapiens
uaaccaaguuuauucaguaaa

SEQ ID NO: 1989482 - RNA, 15 nt, Homo sapiens
gacaggaauacuuaa

SEQ ID NO: 1989483 - RNA, 16 nt, Homo sapiens
agagagaggcauuuag

SEQ ID NO: 1989484 - RNA, 17 nt, Homo sapiens
auauuccaccaggauau

SEQ ID NO: 1989485 - RNA, 13 nt, Homo sapiens
cacuagagaccaa

SEQ ID NO: 1989486 - RNA, 14 nt, Homo sapiens
uuuucagagcuuau

SEQ ID NO: 1989487 - RNA, 20 nt, Homo sapiens
acaaguguacagaagaauuu

SEQ ID NO: 1989488 - RNA, 15 nt, Homo sapiens
uuaaggggaagaaug

SEQ ID NO: 1989489 - RNA, 18 nt, Homo sapiens
cuccaggggggacaauau

SEQ ID NO: 1989490 - RNA, 17 nt, Homo sapiens
ugucaguuauucuugca

SEQ ID NO: 1989491 - RNA, 15 nt, Homo sapiens
gacaggaauuuagaa

SEQ ID NO: 1989492 - RNA, 17 nt, Homo sapiens
augguagaaaaugcacc

SEQ ID NO: 1989493 - RNA, 17 nt, Homo sapiens
cugaggguaucugacaa

SEQ ID NO: 1989494 - RNA, 21 nt, Homo sapiens
cuccaguuagaaugcaccaug

SEQ ID NO: 1989495 - RNA, 16 nt, Homo sapiens
aauguauuuuucuaca

SEQ ID NO: 1989496 - RNA, 16 nt, Homo sapiens
auuuguagcaauuuaa

SEQ ID NO: 1989497 - RNA, 15 nt, Homo sapiens
cuaacccccagugcc

SEQ ID NO: 1989498 - RNA, 18 nt, Homo sapiens
gcagaaggccuugccuug

SEQ ID NO: 1989499 - RNA, 16 nt, Homo sapiens
agccuggugacaggca

SEQ ID NO: 1989500 - RNA, 18 nt, Homo sapiens
cuuagguuguagcagaaa

SEQ ID NO: 1989501 - RNA, 21 nt, Homo sapiens
caauccaggugggagagacac

SEQ ID NO: 1989502 - RNA, 20 nt, Homo sapiens
aggacaaauugcgcccauuu

SEQ ID NO: 1989503 - RNA, 14 nt, Homo sapiens
gcugccacucuaca

SEQ ID NO: 1989504 - RNA, 20 nt, Homo sapiens
gcuuuaugcaaauacaauca

SEQ ID NO: 1989505 - RNA, 19 nt, Homo sapiens
uuuacaauuuaaugcacua

SEQ ID NO: 1989506 - RNA, 21 nt, Homo sapiens
aaugccuaaauauaauuaucc

SEQ ID NO: 1989507 - RNA, 19 nt, Homo sapiens
uuauuuuguuuauugcacu

SEQ ID NO: 1989508 - RNA, 24 nt, Homo sapiens
acuguuacagcuuucugugcagag

SEQ ID NO: 1989509 - RNA, 20 nt, Homo sapiens
acuuugcuugagaauccucu

SEQ ID NO: 1989510 - RNA, 13 nt, Homo sapiens
cuuuccccaaaga

SEQ ID NO: 1989511 - RNA, 23 nt, Homo sapiens
agucuguauggcaugacaacuac

SEQ ID NO: 1989512 - RNA, 19 nt, Homo sapiens
guuugauaccugcacuguc

SEQ ID NO: 1989513 - RNA, 23 nt, Homo sapiens
aaugacacuaaacuccaugauau

SEQ ID NO: 1989514 - RNA, 15 nt, Homo sapiens
auuaaaaaaauggaa

SEQ ID NO: 1989515 - RNA, 16 nt, Homo sapiens
agugcaaggaccaaag

SEQ ID NO: 1989516 - RNA, 14 nt, Homo sapiens
aauaaaucgaucca

SEQ ID NO: 1989517 - RNA, 19 nt, Homo sapiens
aggcauaagaaaacuaaga

SEQ ID NO: 1989518 - RNA, 22 nt, Homo sapiens
cuguuuugggaaacacuuugag

SEQ ID NO: 1989519 - RNA, 21 nt, Homo sapiens
acuugcuuuaugccuucuuau

SEQ ID NO: 1989520 - RNA, 16 nt, Homo sapiens
caauauuaacauaaga

SEQ ID NO: 1989521 - RNA, 14 nt, Homo sapiens
uucuaggauagcua

SEQ ID NO: 1989522 - RNA, 17 nt, Homo sapiens
aguaaauagcauucucu

SEQ ID NO: 1989523 - RNA, 23 nt, Homo sapiens
gccugaggugugugccacucaga

SEQ ID NO: 1989524 - RNA, 21 nt, Homo sapiens
uggaccuuuucccuugcugua

SEQ ID NO: 1989525 - RNA, 15 nt, Homo sapiens
ccuuccuguguaugc

SEQ ID NO: 1989526 - RNA, 12 nt, Homo sapiens
caugaagcacaa

SEQ ID NO: 1989527 - RNA, 24 nt, Homo sapiens
agcuuggccagaagggggccauga

SEQ ID NO: 1989528 - RNA, 22 nt, Homo sapiens
uucccagccccuccucccucag

SEQ ID NO: 1989529 - RNA, 15 nt, Homo sapiens
ccaagauucaaagag

SEQ ID NO: 1989530 - RNA, 22 nt, Homo sapiens
cucaggcuggcuugagugaauu

SEQ ID NO: 1989531 - RNA, 14 nt, Homo sapiens
ccaugcccuggacc

SEQ ID NO: 1989532 - RNA, 15 nt, Homo sapiens
ucuuuaaugcaauau

SEQ ID NO: 1989533 - RNA, 13 nt, Homo sapiens
ucucaccuacgaa

SEQ ID NO: 1989534 - RNA, 14 nt, Homo sapiens
gacuugcaaaaagg

SEQ ID NO: 1989535 - RNA, 16 nt, Homo sapiens
aucaguaccucucaag

SEQ ID NO: 1989536 - RNA, 14 nt, Homo sapiens
gcaccaacuaagaa

SEQ ID NO: 1989537 - RNA, 14 nt, Homo sapiens
gcgagucacugccu

SEQ ID NO: 1989538 - RNA, 14 nt, Homo sapiens
cagggcucaaucuc

SEQ ID NO: 1989539 - RNA, 18 nt, Homo sapiens
gagaauggcauggcagga

SEQ ID NO: 1989540 - RNA, 14 nt, Homo sapiens
uggagccugccaag

SEQ ID NO: 1989541 - RNA, 17 nt, Homo sapiens
aaauauuugacuugcau

SEQ ID NO: 1989542 - RNA, 22 nt, Homo sapiens
uucuauguugguuucaguggcu

SEQ ID NO: 1989543 - RNA, 12 nt, Homo sapiens
caucaaaccuca

SEQ ID NO: 1989544 - RNA, 16 nt, Homo sapiens
acguagaucgaagcca

SEQ ID NO: 1989545 - RNA, 17 nt, Homo sapiens
cuugcucacaucuuggc

SEQ ID NO: 1989546 - RNA, 21 nt, Homo sapiens
auaccuaugucaacaguauaa

SEQ ID NO: 1989547 - RNA, 20 nt, Homo sapiens
agcagugaaugauucagugu

SEQ ID NO: 1989548 - RNA, 22 nt, Homo sapiens
ucugguaauaaaugugacucag

SEQ ID NO: 1989549 - RNA, 21 nt, Homo sapiens
aaguuuaaaguugcacaugau

SEQ ID NO: 1989550 - RNA, 22 nt, Homo sapiens
uagacugacccugaucagucua

SEQ ID NO: 1989551 - RNA, 18 nt, Homo sapiens
agcccccagccugucaga

SEQ ID NO: 1989552 - RNA, 13 nt, Homo sapiens
ggcccaguccucu

SEQ ID NO: 1989553 - RNA, 17 nt, Homo sapiens
auucugauaaugcucac

SEQ ID NO: 1989554 - RNA, 19 nt, Homo sapiens
uuuaauagcuauggaauca

SEQ ID NO: 1989555 - RNA, 17 nt, Homo sapiens
guaaaacacuuauuccc

SEQ ID NO: 1989556 - RNA, 17 nt, Homo sapiens
ucugcaccccacuucag

SEQ ID NO: 1989557 - RNA, 20 nt, Homo sapiens
ucauuauuuaaccuaguuca

SEQ ID NO: 1989558 - RNA, 16 nt, Homo sapiens
uugccagcugcugcug

SEQ ID NO: 1989559 - RNA, 20 nt, Homo sapiens
auagagaaaggucuaugcag

SEQ ID NO: 1989560 - RNA, 14 nt, Homo sapiens
aagugagacugaca

SEQ ID NO: 1989561 - RNA, 12 nt, Homo sapiens
uucaguuugcag

SEQ ID NO: 1989562 - RNA, 18 nt, Homo sapiens
aaaguaagggaagcagaa

SEQ ID NO: 1989563 - RNA, 18 nt, Homo sapiens
uuauuaaaggaacacaua

SEQ ID NO: 1989564 - RNA, 17 nt, Homo sapiens
agacaaaggcccagaaa

SEQ ID NO: 1989565 - RNA, 11 nt, Homo sapiens
guucucagacu

SEQ ID NO: 1989566 - RNA, 19 nt, Homo sapiens
augcucaaacgcaacuguu

SEQ ID NO: 1989567 - RNA, 21 nt, Homo sapiens
ucaccccaaguagucugcuca

SEQ ID NO: 1989568 - RNA, 22 nt, Homo sapiens
uacaugaggggaaaacauguau

SEQ ID NO: 1989569 - RNA, 13 nt, Homo sapiens
uggggccauaaac

SEQ ID NO: 1989570 - RNA, 18 nt, Homo sapiens
uggaagggccuucuccac

SEQ ID NO: 1989571 - RNA, 15 nt, Homo sapiens
aggaaggaggaccca

SEQ ID NO: 1989572 - RNA, 17 nt, Homo sapiens
caaguauuauuuuacaa

SEQ ID NO: 1989573 - RNA, 20 nt, Homo sapiens
acccagagaaccugcuuuac

SEQ ID NO: 1989574 - RNA, 20 nt, Homo sapiens
ugagccaugaucgagccacu

SEQ ID NO: 1989575 - RNA, 16 nt, Homo sapiens
uauuuccauauggcaa

SEQ ID NO: 1989576 - RNA, 14 nt, Homo sapiens
aguuagucaauccu

SEQ ID NO: 1989577 - RNA, 22 nt, Homo sapiens
ccaauucacuuuagagugacua

SEQ ID NO: 1989578 - RNA, 18 nt, Homo sapiens
guagccggagaagggccu

SEQ ID NO: 1989579 - RNA, 23 nt, Homo sapiens
aaauuauuuuaggcaaaguccau

SEQ ID NO: 1989580 - RNA, 22 nt, Homo sapiens
guacucaguaaggcagugcagu

SEQ ID NO: 1989581 - RNA, 23 nt, Homo sapiens
uguggaagacacuugcugaguga

SEQ ID NO: 1989582 - RNA, 17 nt, Homo sapiens
gagugaauuugaccuag

SEQ ID NO: 1989583 - RNA, 19 nt, Homo sapiens
augaaaacugaaucaagaa

SEQ ID NO: 1989584 - RNA, 14 nt, Homo sapiens
aggggagugcucug

SEQ ID NO: 1989585 - RNA, 12 nt, Homo sapiens
cagucugaguca

SEQ ID NO: 1989586 - RNA, 20 nt, Homo sapiens
cucuaucauguugaagucaa

SEQ ID NO: 1989587 - RNA, 18 nt, Homo sapiens
aggaaagcaccgcagcau

SEQ ID NO: 1989588 - RNA, 18 nt, Homo sapiens
auggcaggggcaaagggc

SEQ ID NO: 1989589 - RNA, 15 nt, Homo sapiens
aucaacaaaccacaa

SEQ ID NO: 1989590 - RNA, 15 nt, Homo sapiens
aguaauuuacaaacc

SEQ ID NO: 1989591 - RNA, 15 nt, Homo sapiens
cagaaccagagcuca

SEQ ID NO: 1989592 - RNA, 16 nt, Homo sapiens
ucccccaggagcagcu

SEQ ID NO: 1989593 - RNA, 18 nt, Homo sapiens
cucuuuucccacucccuu

SEQ ID NO: 1989594 - RNA, 21 nt, Homo sapiens
gcaaauagccuuccugaccuc

SEQ ID NO: 1989595 - RNA, 11 nt, Homo sapiens
uucacugcuga

SEQ ID NO: 1989596 - RNA, 17 nt, Homo sapiens
auuucaugucacuaaac

SEQ ID NO: 1989597 - RNA, 15 nt, Homo sapiens
acccgaguaccucca

SEQ ID NO: 1989598 - RNA, 12 nt, Homo sapiens
cugucagagccg

SEQ ID NO: 1989599 - RNA, 12 nt, Homo sapiens
cuggcagagccu

SEQ ID NO: 1989600 - RNA, 23 nt, Homo sapiens
auccacacccucuccuugucaca

SEQ ID NO: 1989601 - RNA, 14 nt, Homo sapiens
uuuggaauauucca

SEQ ID NO: 1989602 - RNA, 15 nt, Homo sapiens
ugaauuugaaucuca

SEQ ID NO: 1989603 - RNA, 14 nt, Homo sapiens
aauacccuagaaga

SEQ ID NO: 1989604 - RNA, 17 nt, Homo sapiens
cuucugaagugcugcuc

SEQ ID NO: 1989605 - RNA, 21 nt, Homo sapiens
uccaagacagccauacuucca

SEQ ID NO: 1989606 - RNA, 19 nt, Homo sapiens
auguuuagugaaacauuug

SEQ ID NO: 1989607 - RNA, 21 nt, Homo sapiens
uggcuuaauguuuauuccuga

SEQ ID NO: 1989608 - RNA, 19 nt, Homo sapiens
gacacucuccuugcaguuc

SEQ ID NO: 1989609 - RNA, 22 nt, Homo sapiens
uaaaacaaaauuugacuaauuu

SEQ ID NO: 1989610 - RNA, 22 nt, Homo sapiens
cugcuuaacccauggauccuga

SEQ ID NO: 1989611 - RNA, 14 nt, Homo sapiens
cggcgccaccaucc

SEQ ID NO: 1989612 - RNA, 19 nt, Homo sapiens
uggccuucugaacuccaua

SEQ ID NO: 1989613 - RNA, 22 nt, Homo sapiens
uaucuugaagacuuuucuuuca

SEQ ID NO: 1989614 - RNA, 18 nt, Homo sapiens
ugacugucacauaaugcu

SEQ ID NO: 1989615 - RNA, 12 nt, Homo sapiens
cuuccaugagaa

SEQ ID NO: 1989616 - RNA, 16 nt, Homo sapiens
uucagacaagacagag

SEQ ID NO: 1989617 - RNA, 17 nt, Homo sapiens
uagcuaccuucucuacc

SEQ ID NO: 1989618 - RNA, 22 nt, Homo sapiens
agugggagggagguaacgggug

SEQ ID NO: 1989619 - RNA, 21 nt, Homo sapiens
ucuguucuuugguguaaucuc

SEQ ID NO: 1989620 - RNA, 17 nt, Homo sapiens
gauugguaagaugucuu

SEQ ID NO: 1989621 - RNA, 15 nt, Homo sapiens
uccuguuuuugcaaa

SEQ ID NO: 1989622 - RNA, 20 nt, Homo sapiens
cuguacuaacaaagccaaau

SEQ ID NO: 1989623 - RNA, 18 nt, Homo sapiens
aucagaauuuguguugaa

SEQ ID NO: 1989624 - RNA, 21 nt, Homo sapiens
uggaucuguugggaaccagag

SEQ ID NO: 1989625 - RNA, 22 nt, Homo sapiens
uagcugacggcuggguguuuca

SEQ ID NO: 1989626 - RNA, 20 nt, Homo sapiens
cugaccuggaaagaaaaagc

SEQ ID NO: 1989627 - RNA, 19 nt, Homo sapiens
cacuagaggaaaccaguuu

SEQ ID NO: 1989628 - RNA, 22 nt, Homo sapiens
uuuauguguuaugaacauccaa

SEQ ID NO: 1989629 - RNA, 22 nt, Homo sapiens
uauuccuaaauaaauggauaag

SEQ ID NO: 1989630 - RNA, 17 nt, Homo sapiens
cguuccuggcauuugcu

SEQ ID NO: 1989631 - RNA, 20 nt, Homo sapiens
uggagauuucauuuugucag

SEQ ID NO: 1989632 - RNA, 22 nt, Homo sapiens
acccaucacgugugauugacau

SEQ ID NO: 1989633 - RNA, 13 nt, Homo sapiens
ccugcugagcucu

SEQ ID NO: 1989634 - RNA, 15 nt, Homo sapiens
aggcuguuccuugaa

SEQ ID NO: 1989635 - RNA, 13 nt, Homo sapiens
aaggcuugccaag

SEQ ID NO: 1989636 - RNA, 15 nt, Homo sapiens
gaaaagaaaugcacu

SEQ ID NO: 1989637 - RNA, 17 nt, Homo sapiens
acuauggagugcucaca

SEQ ID NO: 1989638 - RNA, 21 nt, Homo sapiens
uugugcuucacaguagagcca

SEQ ID NO: 1989639 - RNA, 21 nt, Homo sapiens
ccuugcugcauugauccagga

SEQ ID NO: 1989640 - RNA, 14 nt, Homo sapiens
ggucauucuuuauu

SEQ ID NO: 1989641 - RNA, 21 nt, Homo sapiens
gccagagcuccaugcauggaa

SEQ ID NO: 1989642 - RNA, 12 nt, Homo sapiens
ccaacaaaaaga

SEQ ID NO: 1989643 - RNA, 20 nt, Homo sapiens
cuguguauaucucuguaauc

SEQ ID NO: 1989644 - RNA, 17 nt, Homo sapiens
guagugcaccaucucac

SEQ ID NO: 1989645 - RNA, 19 nt, Homo sapiens
acagagagcuugcugugac

SEQ ID NO: 1989646 - RNA, 13 nt, Homo sapiens
aaauuaauccuca

SEQ ID NO: 1989647 - RNA, 17 nt, Homo sapiens
cuguguucauucuuacc

SEQ ID NO: 1989648 - RNA, 20 nt, Homo sapiens
gcucuccgccccccggccug

SEQ ID NO: 1989649 - RNA, 16 nt, Homo sapiens
gccucaacauacuguu

SEQ ID NO: 1989650 - RNA, 10 nt, Homo sapiens
cccagugcac

SEQ ID NO: 1989651 - RNA, 22 nt, Homo sapiens
aagaccauacauaauaaccaaa

SEQ ID NO: 1989652 - RNA, 22 nt, Homo sapiens
aaaucuguucaaggaaucauug

SEQ ID NO: 1989653 - RNA, 18 nt, Homo sapiens
ugccucagccucccgagu

SEQ ID NO: 1989654 - RNA, 12 nt, Homo sapiens
ucacccaucuca

SEQ ID NO: 1989655 - RNA, 12 nt, Homo sapiens
uucaccauccac

SEQ ID NO: 1989656 - RNA, 22 nt, Homo sapiens
gcuauacagcugggaacagcag

SEQ ID NO: 1989657 - RNA, 14 nt, Homo sapiens
agacaggacugcag

SEQ ID NO: 1989658 - RNA, 12 nt, Homo sapiens
ugggauucccac

SEQ ID NO: 1989659 - RNA, 11 nt, Homo sapiens
auucacaucuc

SEQ ID NO: 1989660 - RNA, 15 nt, Homo sapiens
auugaagaugcugcc

SEQ ID NO: 1989661 - RNA, 14 nt, Homo sapiens
aucugagaagacaa

SEQ ID NO: 1989662 - RNA, 13 nt, Homo sapiens
acuccuacugagu

SEQ ID NO: 1989663 - RNA, 24 nt, Homo sapiens
ggccagggaaagcccgugucaaug

SEQ ID NO: 1989664 - RNA, 14 nt, Homo sapiens
caaauauaucugcu

SEQ ID NO: 1989665 - RNA, 18 nt, Homo sapiens
auaacauuugcugaauau

SEQ ID NO: 1989666 - RNA, 20 nt, Homo sapiens
aucuacauuuguuuguauuc

SEQ ID NO: 1989667 - RNA, 19 nt, Homo sapiens
cgugcaggcacacucagcg

SEQ ID NO: 1989668 - RNA, 20 nt, Homo sapiens
aaaugggguggaauagggaa

SEQ ID NO: 1989669 - RNA, 19 nt, Homo sapiens
augccucacuuucuucuag

SEQ ID NO: 1989670 - RNA, 21 nt, Homo sapiens
caggccuugagggcgucuucu

SEQ ID NO: 1989671 - RNA, 18 nt, Homo sapiens
acugagucuggcaaacau

SEQ ID NO: 1989672 - RNA, 22 nt, Homo sapiens
aauauuacaauccuugaccuca

SEQ ID NO: 1989673 - RNA, 14 nt, Homo sapiens
cuuuucucaggacc

SEQ ID NO: 1989674 - RNA, 19 nt, Homo sapiens
uaccagugacgcugcugac

SEQ ID NO: 1989675 - RNA, 18 nt, Homo sapiens
ccuccugucuaauuugca

SEQ ID NO: 1989676 - RNA, 15 nt, Homo sapiens
ccaaugggacaguua

SEQ ID NO: 1989677 - RNA, 17 nt, Homo sapiens
gagcacaggagcugcca

SEQ ID NO: 1989678 - RNA, 16 nt, Homo sapiens
cauagcuggacaucca

SEQ ID NO: 1989679 - RNA, 17 nt, Homo sapiens
aaccacaauauccagca

SEQ ID NO: 1989680 - RNA, 15 nt, Homo sapiens
cauuucaaaucugua

SEQ ID NO: 1989681 - RNA, 15 nt, Homo sapiens
caacacaccuugccc

SEQ ID NO: 1989682 - RNA, 13 nt, Homo sapiens
aaguaacuuuuca

SEQ ID NO: 1989683 - RNA, 14 nt, Homo sapiens
ucuuuugaguggua

SEQ ID NO: 1989684 - RNA, 15 nt, Homo sapiens
agaacaagguaaaaa

SEQ ID NO: 1989685 - RNA, 15 nt, Homo sapiens
augcacaggggccca

SEQ ID NO: 1989686 - RNA, 22 nt, Homo sapiens
cagacaugguggcaugcaccug

SEQ ID NO: 1989687 - RNA, 16 nt, Homo sapiens
aaaccucuaacccagg

SEQ ID NO: 1989688 - RNA, 17 nt, Homo sapiens
ucccugacgucugccac

SEQ ID NO: 1989689 - RNA, 13 nt, Homo sapiens
gugucugcacagg

SEQ ID NO: 1989690 - RNA, 13 nt, Homo sapiens
gcaucugcauggg

SEQ ID NO: 1989691 - RNA, 17 nt, Homo sapiens
uguccugcccuguggaa

SEQ ID NO: 1989692 - RNA, 17 nt, Homo sapiens
ugcuuaugaaaccugua

SEQ ID NO: 1989693 - RNA, 16 nt, Homo sapiens
uuggaauaaaacuguc

SEQ ID NO: 1989694 - RNA, 19 nt, Homo sapiens
ucuuagccucccaaagugc

SEQ ID NO: 1989695 - RNA, 14 nt, Homo sapiens
caacagccugagaa

SEQ ID NO: 1989696 - RNA, 13 nt, Homo sapiens
cuaggucugacca

SEQ ID NO: 1989697 - RNA, 18 nt, Homo sapiens
aaaauuuguuuugacgga

SEQ ID NO: 1989698 - RNA, 16 nt, Homo sapiens
uuguccccuccaaauc

SEQ ID NO: 1989699 - RNA, 15 nt, Homo sapiens
aucaaauuuugccag

SEQ ID NO: 1989700 - RNA, 24 nt, Homo sapiens
aacauggugaaaccucaucucuac

SEQ ID NO: 1989701 - RNA, 14 nt, Homo sapiens
aucucuucuggccg

SEQ ID NO: 1989702 - RNA, 17 nt, Homo sapiens
cgcagaccaccagcauc

SEQ ID NO: 1989703 - RNA, 17 nt, Homo sapiens
aauucaugaaauuaucc

SEQ ID NO: 1989704 - RNA, 16 nt, Homo sapiens
ucagcuuucaaagcau

SEQ ID NO: 1989705 - RNA, 20 nt, Homo sapiens
agucuauuugagacuccuca

SEQ ID NO: 1989706 - RNA, 21 nt, Homo sapiens
gaucauuuuuaacugauucuu

SEQ ID NO: 1989707 - RNA, 21 nt, Homo sapiens
aguccaacucuuccaccucug

SEQ ID NO: 1989708 - RNA, 17 nt, Homo sapiens
cccaguaaaaauccacu

SEQ ID NO: 1989709 - RNA, 16 nt, Homo sapiens
uccuuuuacugcagau

SEQ ID NO: 1989710 - RNA, 21 nt, Homo sapiens
ucauuugcauccuaucgaucu

SEQ ID NO: 1989711 - RNA, 18 nt, Homo sapiens
auucuguuggccagugug

SEQ ID NO: 1989712 - RNA, 17 nt, Homo sapiens
acuuaguauuuuaccua

SEQ ID NO: 1989713 - RNA, 15 nt, Homo sapiens
accuccuuagcccug

SEQ ID NO: 1989714 - RNA, 13 nt, Homo sapiens
cuucugucuguca

SEQ ID NO: 1989715 - RNA, 13 nt, Homo sapiens
ugcauguccucaa

SEQ ID NO: 1989716 - RNA, 18 nt, Homo sapiens
ugucuacguuaccaggca

SEQ ID NO: 1989717 - RNA, 22 nt, Homo sapiens
aggaugucaugucugcuuguca

SEQ ID NO: 1989718 - RNA, 15 nt, Homo sapiens
uucaugcauuacuua

SEQ ID NO: 1989719 - RNA, 19 nt, Homo sapiens
guuguccugcccuguggaa

SEQ ID NO: 1989720 - RNA, 15 nt, Homo sapiens
gcccuagacuggcug

SEQ ID NO: 1989721 - RNA, 14 nt, Homo sapiens
uaugaugagccaua

SEQ ID NO: 1989722 - RNA, 18 nt, Homo sapiens
auccauuauaaacaauca

SEQ ID NO: 1989723 - RNA, 22 nt, Homo sapiens
cauuccuccagugcauacugua

SEQ ID NO: 1989724 - RNA, 23 nt, Homo sapiens
ucauagggauggcagugauucug

SEQ ID NO: 1989725 - RNA, 18 nt, Homo sapiens
uuuacacacuguacacau

SEQ ID NO: 1989726 - RNA, 16 nt, Homo sapiens
acccggagagugcucc

SEQ ID NO: 1989727 - RNA, 22 nt, Homo sapiens
auagcaguuuguaaaaguguaa

SEQ ID NO: 1989728 - RNA, 16 nt, Homo sapiens
ccuguuuccauggguc

SEQ ID NO: 1989729 - RNA, 17 nt, Homo sapiens
agagauuaacugggauu

SEQ ID NO: 1989730 - RNA, 19 nt, Homo sapiens
cuaaccucgggugauccac

SEQ ID NO: 1989731 - RNA, 16 nt, Homo sapiens
cuauuuugcaaacaaa

SEQ ID NO: 1989732 - RNA, 19 nt, Homo sapiens
gaggaaucuuuuacugugg

SEQ ID NO: 1989733 - RNA, 17 nt, Homo sapiens
auccauauugagucaaa

SEQ ID NO: 1989734 - RNA, 16 nt, Homo sapiens
uccagaucacugccac

SEQ ID NO: 1989735 - RNA, 18 nt, Homo sapiens
cuggucucaaacuccuga

SEQ ID NO: 1989736 - RNA, 17 nt, Homo sapiens
auuugcacgguuuguga

SEQ ID NO: 1989737 - RNA, 15 nt, Homo sapiens
caagcagcaaaaucc

SEQ ID NO: 1989738 - RNA, 16 nt, Homo sapiens
cuuccuauaauuuuag

SEQ ID NO: 1989739 - RNA, 20 nt, Homo sapiens
uauuucuccuuggauggcac

SEQ ID NO: 1989740 - RNA, 18 nt, Homo sapiens
ugcauaauaugcauauau

SEQ ID NO: 1989741 - RNA, 15 nt, Homo sapiens
uuucuccauucagga

SEQ ID NO: 1989742 - RNA, 20 nt, Homo sapiens
ucaccuaaacccucugugaa

SEQ ID NO: 1989743 - RNA, 17 nt, Homo sapiens
gaaaggaaacuuugaac

SEQ ID NO: 1989744 - RNA, 12 nt, Homo sapiens
ucuaaaugccca

SEQ ID NO: 1989745 - RNA, 16 nt, Homo sapiens
caauaaaaaaaaaccu

SEQ ID NO: 1989746 - RNA, 13 nt, Homo sapiens
cuggccucaggug

SEQ ID NO: 1989747 - RNA, 16 nt, Homo sapiens
ccaugugucuuuacac

SEQ ID NO: 1989748 - RNA, 17 nt, Homo sapiens
cagaccauccaccaggc

SEQ ID NO: 1989749 - RNA, 20 nt, Homo sapiens
cugaccuguaggucaggacc

SEQ ID NO: 1989750 - RNA, 23 nt, Homo sapiens
gaagaaaugaaaggugacaaaag

SEQ ID NO: 1989751 - RNA, 19 nt, Homo sapiens
aucgggaauacuagggaga

SEQ ID NO: 1989752 - RNA, 13 nt, Homo sapiens
uuccuucccacau

SEQ ID NO: 1989753 - RNA, 21 nt, Homo sapiens
guaaaauuagaggauugcacu

SEQ ID NO: 1989754 - RNA, 17 nt, Homo sapiens
guauucuuaaaaugcaa

SEQ ID NO: 1989755 - RNA, 21 nt, Homo sapiens
aggcuggagugcaguggugcu

SEQ ID NO: 1989756 - RNA, 22 nt, Homo sapiens
gucacgaacuugaaaguuuucu

SEQ ID NO: 1989757 - RNA, 23 nt, Homo sapiens
gaaggauuguuucuggugacugc

SEQ ID NO: 1989758 - RNA, 13 nt, Homo sapiens
uuuacuauuuuag

SEQ ID NO: 1989759 - RNA, 11 nt, Homo sapiens
cagagaaccau

SEQ ID NO: 1989760 - RNA, 15 nt, Homo sapiens
auuuaugaugcacuu

SEQ ID NO: 1989761 - RNA, 16 nt, Homo sapiens
gcugccaaaaagaaca

SEQ ID NO: 1989762 - RNA, 17 nt, Homo sapiens
aggauccaagcuaagca

SEQ ID NO: 1989763 - RNA, 16 nt, Homo sapiens
ggaggcugcggccuag

SEQ ID NO: 1989764 - RNA, 15 nt, Homo sapiens
gaugccuaacagaga

SEQ ID NO: 1989765 - RNA, 14 nt, Homo sapiens
aaaccucuccucau

SEQ ID NO: 1989766 - RNA, 14 nt, Homo sapiens
acacaacucaucca

SEQ ID NO: 1989767 - RNA, 18 nt, Homo sapiens
ucccuucuuggugcuuac

SEQ ID NO: 1989768 - RNA, 13 nt, Homo sapiens
ucagaauuauuaa

SEQ ID NO: 1989769 - RNA, 15 nt, Homo sapiens
ugaagacugcacagg

SEQ ID NO: 1989770 - RNA, 19 nt, Homo sapiens
caggccaaaccguacugua

SEQ ID NO: 1989771 - RNA, 19 nt, Homo sapiens
aagaccugacaccuuucau

SEQ ID NO: 1989772 - RNA, 22 nt, Homo sapiens
agaaaucuuguuggcaaaucag

SEQ ID NO: 1989773 - RNA, 22 nt, Homo sapiens
acccuaacacaguauaucccaa

SEQ ID NO: 1989774 - RNA, 14 nt, Homo sapiens
caauaggacaaaac

SEQ ID NO: 1989775 - RNA, 11 nt, Homo sapiens
cucacuccugc

SEQ ID NO: 1989776 - RNA, 18 nt, Homo sapiens
agaccugaaggaccuccc

SEQ ID NO: 1989777 - RNA, 15 nt, Homo sapiens
aaugcaccaaucagc

SEQ ID NO: 1989778 - RNA, 23 nt, Homo sapiens
uacagauggagcaaauguccuaa

SEQ ID NO: 1989779 - RNA, 18 nt, Homo sapiens
aacuggggauauaauacu

SEQ ID NO: 1989780 - RNA, 12 nt, Homo sapiens
agccagcagggu

SEQ ID NO: 1989781 - RNA, 19 nt, Homo sapiens
ucaaauucuucugaacuca

SEQ ID NO: 1989782 - RNA, 22 nt, Homo sapiens
caaaaaaaaaaaaacaaaagaa

SEQ ID NO: 1989783 - RNA, 18 nt, Homo sapiens
gcaaucagcuaccauuca

SEQ ID NO: 1989784 - RNA, 14 nt, Homo sapiens
caacaguuaucaca

SEQ ID NO: 1989785 - RNA, 14 nt, Homo sapiens
gcucuuuagcauug

SEQ ID NO: 1989786 - RNA, 20 nt, Homo sapiens
gcgccugcugccugcugaga

SEQ ID NO: 1989787 - RNA, 13 nt, Homo sapiens
cagcucagagaug

SEQ ID NO: 1989788 - RNA, 17 nt, Homo sapiens
aucucagagacaggugg

SEQ ID NO: 1989789 - RNA, 12 nt, Homo sapiens
aucuuguuucau

SEQ ID NO: 1989790 - RNA, 13 nt, Homo sapiens
uccuggccucaga

SEQ ID NO: 1989791 - RNA, 22 nt, Homo sapiens
auauauuaauaaucuuggcaau

SEQ ID NO: 1989792 - RNA, 20 nt, Homo sapiens
caguuaugugaaugaucucu

SEQ ID NO: 1989793 - RNA, 19 nt, Homo sapiens
gcagagcuuccacaagaca

SEQ ID NO: 1989794 - RNA, 15 nt, Homo sapiens
caguaaaucagugca

SEQ ID NO: 1989795 - RNA, 22 nt, Homo sapiens
cuucagaaaaggaguggccaca

SEQ ID NO: 1989796 - RNA, 14 nt, Homo sapiens
cuggaguuggcaau

SEQ ID NO: 1989797 - RNA, 17 nt, Homo sapiens
guugugccccuuuccaa

SEQ ID NO: 1989798 - RNA, 21 nt, Homo sapiens
gucauguuucugcaguauucu

SEQ ID NO: 1989799 - RNA, 22 nt, Homo sapiens
ucauccacucuacuaaugccuc

SEQ ID NO: 1989800 - RNA, 17 nt, Homo sapiens
uugugauuacguguaug

SEQ ID NO: 1989801 - RNA, 16 nt, Homo sapiens
agaagcccgaggucau

SEQ ID NO: 1989802 - RNA, 16 nt, Homo sapiens
uaaaccugcaggguca

SEQ ID NO: 1989803 - RNA, 12 nt, Homo sapiens
cuucacauucau

SEQ ID NO: 1989804 - RNA, 12 nt, Homo sapiens
ccuuacauuuac

SEQ ID NO: 1989805 - RNA, 14 nt, Homo sapiens
ucugacuccagugg

SEQ ID NO: 1989806 - RNA, 18 nt, Homo sapiens
ugcccacuucacugcucg

SEQ ID NO: 1989807 - RNA, 15 nt, Homo sapiens
acgccacucauuuca

SEQ ID NO: 1989808 - RNA, 21 nt, Homo sapiens
gcagcagugagcuucuauuaa

SEQ ID NO: 1989809 - RNA, 19 nt, Homo sapiens
cagccugcugcucucagga

SEQ ID NO: 1989810 - RNA, 12 nt, Homo sapiens
agagaagcugcu

SEQ ID NO: 1989811 - RNA, 22 nt, Homo sapiens
auuaacaaagugucacuccaua

SEQ ID NO: 1989812 - RNA, 23 nt, Homo sapiens
caccuguuugaaaccaagcuuuc

SEQ ID NO: 1989813 - RNA, 18 nt, Homo sapiens
cuucaauguaguuuucca

SEQ ID NO: 1989814 - RNA, 15 nt, Homo sapiens
cuacugucucacuga

SEQ ID NO: 1989815 - RNA, 15 nt, Homo sapiens
ccucccucuuuccca

SEQ ID NO: 1989816 - RNA, 22 nt, Homo sapiens
ucccaacugcaagucacaaagg

SEQ ID NO: 1989817 - RNA, 20 nt, Homo sapiens
ccguaauucuuauuccauau

SEQ ID NO: 1989818 - RNA, 19 nt, Homo sapiens
uuaagaacaaacucugaaa

SEQ ID NO: 1989819 - RNA, 15 nt, Homo sapiens
accacuaacuccuga

SEQ ID NO: 1989820 - RNA, 14 nt, Homo sapiens
uugaggaccucauc

SEQ ID NO: 1989821 - RNA, 18 nt, Homo sapiens
gacaugucuagccacuga

SEQ ID NO: 1989822 - RNA, 22 nt, Homo sapiens
aaaggcuuccccaccacacuuu

SEQ ID NO: 1989823 - RNA, 17 nt, Homo sapiens
aaggcauuuauugccau

SEQ ID NO: 1989824 - RNA, 23 nt, Homo sapiens
acaauuaacauacaucauuccac

SEQ ID NO: 1989825 - RNA, 20 nt, Homo sapiens
aauuuauuucucccuguaaa

SEQ ID NO: 1989826 - RNA, 23 nt, Homo sapiens
gggucugcuccugggaauggggu

SEQ ID NO: 1989827 - RNA, 22 nt, Homo sapiens
uaugagauguagcaaauuccaa

SEQ ID NO: 1989828 - RNA, 15 nt, Homo sapiens
aagaaguucauuccu

SEQ ID NO: 1989829 - RNA, 13 nt, Homo sapiens
accugcaggccaa

SEQ ID NO: 1989830 - RNA, 17 nt, Homo sapiens
aaacuacaguuguaaua

SEQ ID NO: 1989831 - RNA, 19 nt, Homo sapiens
accuuaauuuaacuuucca

SEQ ID NO: 1989832 - RNA, 16 nt, Homo sapiens
uucuccucggacugug

SEQ ID NO: 1989833 - RNA, 12 nt, Homo sapiens
uacaucuuuauu

SEQ ID NO: 1989834 - RNA, 13 nt, Homo sapiens
gauauucauucuu

SEQ ID NO: 1989835 - RNA, 16 nt, Homo sapiens
aauggcgcgaucucag

SEQ ID NO: 1989836 - RNA, 17 nt, Homo sapiens
auaauuguuucauucau

SEQ ID NO: 1989837 - RNA, 13 nt, Homo sapiens
ugagcgcuguguu

SEQ ID NO: 1989838 - RNA, 23 nt, Homo sapiens
uuacuuuucuguuuaguuuuaca

SEQ ID NO: 1989839 - RNA, 18 nt, Homo sapiens
uuaauggguacaauguac

SEQ ID NO: 1989840 - RNA, 11 nt, Homo sapiens
cuugugcacug

SEQ ID NO: 1989841 - RNA, 20 nt, Homo sapiens
uguuguuuuaggaauacaua

SEQ ID NO: 1989842 - RNA, 14 nt, Homo sapiens
cuccuccagccaug

SEQ ID NO: 1989843 - RNA, 18 nt, Homo sapiens
ugguguagcgugcaucag

SEQ ID NO: 1989844 - RNA, 23 nt, Homo sapiens
cccacugggguuggaagugcaga

SEQ ID NO: 1989845 - RNA, 13 nt, Homo sapiens
accacuguuugau

SEQ ID NO: 1989846 - RNA, 16 nt, Homo sapiens
auaacauccaacuaac

SEQ ID NO: 1989847 - RNA, 21 nt, Homo sapiens
ugagcauggggcgcucccacu

SEQ ID NO: 1989848 - RNA, 12 nt, Homo sapiens
guccagugcaac

SEQ ID NO: 1989849 - RNA, 17 nt, Homo sapiens
gugggaagaauuggaag

SEQ ID NO: 1989850 - RNA, 23 nt, Homo sapiens
caucugaccuuaguuugcugcca

SEQ ID NO: 1989851 - RNA, 18 nt, Homo sapiens
ugguaaaacucacuguga

SEQ ID NO: 1989852 - RNA, 23 nt, Homo sapiens
cauuuuuuucacuggaguuacau

SEQ ID NO: 1989853 - RNA, 20 nt, Homo sapiens
aacguucuauaaaugaaugu

SEQ ID NO: 1989854 - RNA, 14 nt, Homo sapiens
ucauuaugccacuu

SEQ ID NO: 1989855 - RNA, 14 nt, Homo sapiens
ucacuuugccauua

SEQ ID NO: 1989856 - RNA, 13 nt, Homo sapiens
agccucagucucc

SEQ ID NO: 1989857 - RNA, 16 nt, Homo sapiens
caccuucaaaauguuc

SEQ ID NO: 1989858 - RNA, 19 nt, Homo sapiens
acagaacuguguacuguau

SEQ ID NO: 1989859 - RNA, 19 nt, Homo sapiens
ggcagacaccaggccaggc

SEQ ID NO: 1989860 - RNA, 18 nt, Homo sapiens
uauucacugguuuuacac

SEQ ID NO: 1989861 - RNA, 18 nt, Homo sapiens
cauuucuugguuccaaua

SEQ ID NO: 1989862 - RNA, 20 nt, Homo sapiens
ccaucaaacauaauucucuc

SEQ ID NO: 1989863 - RNA, 17 nt, Homo sapiens
gaauauaagaaaucuuu

SEQ ID NO: 1989864 - RNA, 16 nt, Homo sapiens
ucucgaauacuuugaa

SEQ ID NO: 1989865 - RNA, 16 nt, Homo sapiens
cuugcuggacggggac

SEQ ID NO: 1989866 - RNA, 22 nt, Homo sapiens
cauaugagaaggaacuuuguca

SEQ ID NO: 1989867 - RNA, 15 nt, Homo sapiens
acuucuuguguguau

SEQ ID NO: 1989868 - RNA, 15 nt, Homo sapiens
uggcuacacagggau

SEQ ID NO: 1989869 - RNA, 15 nt, Homo sapiens
guggaugaugcugcc

SEQ ID NO: 1989870 - RNA, 13 nt, Homo sapiens
acgauuagcuuuu

SEQ ID NO: 1989871 - RNA, 17 nt, Homo sapiens
ucucuccagcugacuaa

SEQ ID NO: 1989872 - RNA, 17 nt, Homo sapiens
gcucaguaacugugcau

SEQ ID NO: 1989873 - RNA, 19 nt, Homo sapiens
agguuggagcccagggcau

SEQ ID NO: 1989874 - RNA, 21 nt, Homo sapiens
uguguacacaucuauucucaa

SEQ ID NO: 1989875 - RNA, 20 nt, Homo sapiens
uuacacuuuuuggaagugaa

SEQ ID NO: 1989876 - RNA, 16 nt, Homo sapiens
cugaugucauaucauu

SEQ ID NO: 1989877 - RNA, 17 nt, Homo sapiens
agacccaggucuuccag

SEQ ID NO: 1989878 - RNA, 21 nt, Homo sapiens
cgggcuuggcggcucuagccc

SEQ ID NO: 1989879 - RNA, 22 nt, Homo sapiens
cagcuuauugugugcgcugccu

SEQ ID NO: 1989880 - RNA, 12 nt, Homo sapiens
aagaccaaagac

SEQ ID NO: 1989881 - RNA, 13 nt, Homo sapiens
gaggacacaucuc

SEQ ID NO: 1989882 - RNA, 17 nt, Homo sapiens
guaacucuuucugagga

SEQ ID NO: 1989883 - RNA, 12 nt, Homo sapiens
ugcacaaugcau

SEQ ID NO: 1989884 - RNA, 16 nt, Homo sapiens
auaaaaaagcaaaaac

SEQ ID NO: 1989885 - RNA, 18 nt, Homo sapiens
ucauaacugguagcuaua

SEQ ID NO: 1989886 - RNA, 21 nt, Homo sapiens
aggccaagaguuaaagaccag

SEQ ID NO: 1989887 - RNA, 12 nt, Homo sapiens
aagagggaacaa

SEQ ID NO: 1989888 - RNA, 20 nt, Homo sapiens
uauguauacacacauauaca

SEQ ID NO: 1989889 - RNA, 18 nt, Homo sapiens
gaauauaauaugucuuca

SEQ ID NO: 1989890 - RNA, 22 nt, Homo sapiens
gagacaccaccacccuugccau

SEQ ID NO: 1989891 - RNA, 15 nt, Homo sapiens
agccaccaagaggga

SEQ ID NO: 1989892 - RNA, 22 nt, Homo sapiens
ggccccgccugcucuuuccucc

SEQ ID NO: 1989893 - RNA, 20 nt, Homo sapiens
ugcaguauggccaugggcug

SEQ ID NO: 1989894 - RNA, 19 nt, Homo sapiens
uaacuuccucuauuucaca

SEQ ID NO: 1989895 - RNA, 13 nt, Homo sapiens
cacugccuguaua

SEQ ID NO: 1989896 - RNA, 18 nt, Homo sapiens
ucucaugccagugccuua

SEQ ID NO: 1989897 - RNA, 15 nt, Homo sapiens
uccagagaccaaaua

SEQ ID NO: 1989898 - RNA, 17 nt, Homo sapiens
auucuaggcagcaccuu

SEQ ID NO: 1989899 - RNA, 17 nt, Homo sapiens
uuacaggauauuccaaa

SEQ ID NO: 1989900 - RNA, 14 nt, Homo sapiens
aagugccugcaaaa

SEQ ID NO: 1989901 - RNA, 13 nt, Homo sapiens
acggagcaucuca

SEQ ID NO: 1989902 - RNA, 21 nt, Homo sapiens
cuaaucuaugcauguauguag

SEQ ID NO: 1989903 - RNA, 20 nt, Homo sapiens
cuugcuuguuacauaccugg

SEQ ID NO: 1989904 - RNA, 12 nt, Homo sapiens
auaaaacaugag

SEQ ID NO: 1989905 - RNA, 12 nt, Homo sapiens
cggcugccuagc

SEQ ID NO: 1989906 - RNA, 13 nt, Homo sapiens
gaauugauucaug

SEQ ID NO: 1989907 - RNA, 16 nt, Homo sapiens
uuuauacucacugagu

SEQ ID NO: 1989908 - RNA, 20 nt, Homo sapiens
acaaugaccaaggacugcua

SEQ ID NO: 1989909 - RNA, 23 nt, Homo sapiens
auuuaagaagccaagggggaccu

SEQ ID NO: 1989910 - RNA, 18 nt, Homo sapiens
auauuuaauugugucaua

SEQ ID NO: 1989911 - RNA, 20 nt, Homo sapiens
cccaucuaccacaucuucau

SEQ ID NO: 1989912 - RNA, 21 nt, Homo sapiens
cuuaagagauuggaucaagua

SEQ ID NO: 1989913 - RNA, 20 nt, Homo sapiens
uacuuuuuuuuaguucaaua

SEQ ID NO: 1989914 - RNA, 15 nt, Homo sapiens
gcuugacauaccuac

SEQ ID NO: 1989915 - RNA, 14 nt, Homo sapiens
cuuaaaauugugag

SEQ ID NO: 1989916 - RNA, 11 nt, Homo sapiens
uacaauucuuu

SEQ ID NO: 1989917 - RNA, 21 nt, Homo sapiens
uugcaaagguuccaacuguau

SEQ ID NO: 1989918 - RNA, 16 nt, Homo sapiens
uuuaucacuacaagcu

SEQ ID NO: 1989919 - RNA, 23 nt, Homo sapiens
uccauggccuuucuaauaaacug

SEQ ID NO: 1989920 - RNA, 16 nt, Homo sapiens
ucccuagguaggcacc

SEQ ID NO: 1989921 - RNA, 14 nt, Homo sapiens
guuagccuggugac

SEQ ID NO: 1989922 - RNA, 19 nt, Homo sapiens
caugccagacccacugaaa

SEQ ID NO: 1989923 - RNA, 15 nt, Homo sapiens
auauuuucacaugac

SEQ ID NO: 1989924 - RNA, 18 nt, Homo sapiens
acccuggaacuggagaaa

SEQ ID NO: 1989925 - RNA, 19 nt, Homo sapiens
aaagucauaaaauguaucu

SEQ ID NO: 1989926 - RNA, 18 nt, Homo sapiens
ucuguguacauguacaga

SEQ ID NO: 1989927 - RNA, 16 nt, Homo sapiens
ccccaaagcaauguga

SEQ ID NO: 1989928 - RNA, 11 nt, Homo sapiens
cgcaccugcuu

SEQ ID NO: 1989929 - RNA, 22 nt, Homo sapiens
agccauucuuacucgggcgacc

SEQ ID NO: 1989930 - RNA, 14 nt, Homo sapiens
auucuuaacagugg

SEQ ID NO: 1989931 - RNA, 19 nt, Homo sapiens
cuaaaagaaaaucuauuau

SEQ ID NO: 1989932 - RNA, 20 nt, Homo sapiens
ccacaagagccccaaagauc

SEQ ID NO: 1989933 - RNA, 21 nt, Homo sapiens
uucucaagcgcuauccacaga

SEQ ID NO: 1989934 - RNA, 22 nt, Homo sapiens
caugccucugaggccagccugg

SEQ ID NO: 1989935 - RNA, 17 nt, Homo sapiens
auuugaugcuuuucucu

SEQ ID NO: 1989936 - RNA, 14 nt, Homo sapiens
ccaucuccauugca

SEQ ID NO: 1989937 - RNA, 19 nt, Homo sapiens
uccuguguaccucacuguc

SEQ ID NO: 1989938 - RNA, 17 nt, Homo sapiens
acucuccaaacagucac

SEQ ID NO: 1989939 - RNA, 13 nt, Homo sapiens
gcaauuaacugau

SEQ ID NO: 1989940 - RNA, 13 nt, Homo sapiens
gugcucauuucau

SEQ ID NO: 1989941 - RNA, 13 nt, Homo sapiens
uuccucaugugau

SEQ ID NO: 1989942 - RNA, 13 nt, Homo sapiens
acccauagacagc

SEQ ID NO: 1989943 - RNA, 21 nt, Homo sapiens
guguccccgcugcugugcaac

SEQ ID NO: 1989944 - RNA, 19 nt, Homo sapiens
aucaaguccuuugugaaua

SEQ ID NO: 1989945 - RNA, 17 nt, Homo sapiens
ccccaacaugcacugau

SEQ ID NO: 1989946 - RNA, 15 nt, Homo sapiens
ucuuagcuggucuaa

SEQ ID NO: 1989947 - RNA, 11 nt, Homo sapiens
ucugagcccag

SEQ ID NO: 1989948 - RNA, 23 nt, Homo sapiens
gaaacagagguggcugcugugcu

SEQ ID NO: 1989949 - RNA, 18 nt, Homo sapiens
cuuauaacuucugaagua

SEQ ID NO: 1989950 - RNA, 14 nt, Homo sapiens
guguucacccgugg

SEQ ID NO: 1989951 - RNA, 16 nt, Homo sapiens
gucccucgagcucugu

SEQ ID NO: 1989952 - RNA, 20 nt, Homo sapiens
agccauguaccaguguacug

SEQ ID NO: 1989953 - RNA, 22 nt, Homo sapiens
uaaccagcaacauugacccaga

SEQ ID NO: 1989954 - RNA, 19 nt, Homo sapiens
gaaacauucuuuuccacuu

SEQ ID NO: 1989955 - RNA, 22 nt, Homo sapiens
aauuccugguuugaagaaauaa

SEQ ID NO: 1989956 - RNA, 17 nt, Homo sapiens
aaaagaaaggguucugu

SEQ ID NO: 1989957 - RNA, 14 nt, Homo sapiens
gaaaaauguugcuc

SEQ ID NO: 1989958 - RNA, 18 nt, Homo sapiens
uuaaucuaggaaugacuc

SEQ ID NO: 1989959 - RNA, 15 nt, Homo sapiens
aauauugauuccuca

SEQ ID NO: 1989960 - RNA, 12 nt, Homo sapiens
uccguccauccc

SEQ ID NO: 1989961 - RNA, 23 nt, Homo sapiens
cuaaugggaugccuuuuacuuug

SEQ ID NO: 1989962 - RNA, 17 nt, Homo sapiens
cucuucucaaagcuggg

SEQ ID NO: 1989963 - RNA, 20 nt, Homo sapiens
ucacaccaccccccaugcca

SEQ ID NO: 1989964 - RNA, 14 nt, Homo sapiens
agaauuaaaacuga

SEQ ID NO: 1989965 - RNA, 23 nt, Homo sapiens
uagaauggggcuuccaugguggu

SEQ ID NO: 1989966 - RNA, 16 nt, Homo sapiens
aagcugagugacugua

SEQ ID NO: 1989967 - RNA, 16 nt, Homo sapiens
ugggggugaaagggaa

SEQ ID NO: 1989968 - RNA, 19 nt, Homo sapiens
uggagacugacaaccucau

SEQ ID NO: 1989969 - RNA, 12 nt, Homo sapiens
aaugacacuuuc

SEQ ID NO: 1989970 - RNA, 15 nt, Homo sapiens
uucaaagagucauau

SEQ ID NO: 1989971 - RNA, 16 nt, Homo sapiens
auaauaaugccuaccu

SEQ ID NO: 1989972 - RNA, 17 nt, Homo sapiens
cuuaaggggguguaaug

SEQ ID NO: 1989973 - RNA, 21 nt, Homo sapiens
ugcuuacaaagaaagcacuuc

SEQ ID NO: 1989974 - RNA, 15 nt, Homo sapiens
agaccuggauucaaa

SEQ ID NO: 1989975 - RNA, 14 nt, Homo sapiens
ugucuggccagaaa

SEQ ID NO: 1989976 - RNA, 18 nt, Homo sapiens
gaagcaacugugaauuca

SEQ ID NO: 1989977 - RNA, 21 nt, Homo sapiens
ccuccugucaguggagcaguu

SEQ ID NO: 1989978 - RNA, 15 nt, Homo sapiens
cuacagaaagcacaa

SEQ ID NO: 1989979 - RNA, 19 nt, Homo sapiens
uauugacuuuauguuguau

SEQ ID NO: 1989980 - RNA, 15 nt, Homo sapiens
gugcugugucugcac

SEQ ID NO: 1989981 - RNA, 20 nt, Homo sapiens
augcuauguucugucuuccc

SEQ ID NO: 1989982 - RNA, 17 nt, Homo sapiens
aaaagcaauccauguga

SEQ ID NO: 1989983 - RNA, 19 nt, Homo sapiens
gauugauagaguguuauca

SEQ ID NO: 1989984 - RNA, 17 nt, Homo sapiens
auauguguauauauaca

SEQ ID NO: 1989985 - RNA, 16 nt, Homo sapiens
gagaccaccagggcau

SEQ ID NO: 1989986 - RNA, 23 nt, Homo sapiens
ugcacuguccugcuccacagugu

SEQ ID NO: 1989987 - RNA, 21 nt, Homo sapiens
uuuuaaagacccaacuugcca

SEQ ID NO: 1989988 - RNA, 20 nt, Homo sapiens
auuaaaaucacugucaauau

SEQ ID NO: 1989989 - RNA, 21 nt, Homo sapiens
gccacuccuggggucacucag

SEQ ID NO: 1989990 - RNA, 14 nt, Homo sapiens
auucauucugagcc

SEQ ID NO: 1989991 - RNA, 14 nt, Homo sapiens
gaauuuuguauauu

SEQ ID NO: 1989992 - RNA, 16 nt, Homo sapiens
acaaaugaugccaugg

SEQ ID NO: 1989993 - RNA, 20 nt, Homo sapiens
uuaauguuuuuuaaacuagu

SEQ ID NO: 1989994 - RNA, 23 nt, Homo sapiens
cuguaguuuuuuuggugcuauaa

SEQ ID NO: 1989995 - RNA, 20 nt, Homo sapiens
uaauuacuuaaugugaugcu

SEQ ID NO: 1989996 - RNA, 21 nt, Homo sapiens
gaucagcuuucaaagcauuua

SEQ ID NO: 1989997 - RNA, 14 nt, Homo sapiens
aagggcaggaccaa

SEQ ID NO: 1989998 - RNA, 23 nt, Homo sapiens
cuugggacccuagcuauaugcau

SEQ ID NO: 1989999 - RNA, 18 nt, Homo sapiens
cauguguagccugugcau

SEQ ID NO: 1990000 - RNA, 19 nt, Homo sapiens
cgggcacagugguggugcc

SEQ ID NO: 1990001 - RNA, 20 nt, Homo sapiens
auaguauucaggugagcaau

SEQ ID NO: 1990002 - RNA, 18 nt, Homo sapiens
aucuugaauagucucauc

SEQ ID NO: 1990003 - RNA, 21 nt, Homo sapiens
auaaggacucacacaaauuaa

SEQ ID NO: 1990004 - RNA, 18 nt, Homo sapiens
acuuagcuugcacaugaa

SEQ ID NO: 1990005 - RNA, 13 nt, Homo sapiens
uugaaagacauca

SEQ ID NO: 1990006 - RNA, 18 nt, Homo sapiens
cucgguggcccagguggu

SEQ ID NO: 1990007 - RNA, 14 nt, Homo sapiens
ucauggaccaaagg

SEQ ID NO: 1990008 - RNA, 21 nt, Homo sapiens
acuagccagacaaaauuugag

SEQ ID NO: 1990009 - RNA, 14 nt, Homo sapiens
aaaaauuuacuuga

SEQ ID NO: 1990010 - RNA, 14 nt, Homo sapiens
cauaauuuccauga

SEQ ID NO: 1990011 - RNA, 23 nt, Homo sapiens
caacccgagaaaacaaacccagg

SEQ ID NO: 1990012 - RNA, 18 nt, Homo sapiens
caccauuuuccugccuca

SEQ ID NO: 1990013 - RNA, 21 nt, Homo sapiens
aaacaguugcacagcaucuca

SEQ ID NO: 1990014 - RNA, 15 nt, Homo sapiens
gaaguuuuaggugcu

SEQ ID NO: 1990015 - RNA, 18 nt, Homo sapiens
ugcucaggcccuggccag

SEQ ID NO: 1990016 - RNA, 21 nt, Homo sapiens
cucaauggaagaggccaggac

SEQ ID NO: 1990017 - RNA, 18 nt, Homo sapiens
uucccuggacugccggaa

SEQ ID NO: 1990018 - RNA, 20 nt, Homo sapiens
uaucacuuuggucuccauuu

SEQ ID NO: 1990019 - RNA, 18 nt, Homo sapiens
gaaauagaaagaagccau

SEQ ID NO: 1990020 - RNA, 16 nt, Homo sapiens
uacuugccaucaguga

SEQ ID NO: 1990021 - RNA, 21 nt, Homo sapiens
gcuuuccaaaccuuaucucca

SEQ ID NO: 1990022 - RNA, 19 nt, Homo sapiens
ugcugggggccgcccugua

SEQ ID NO: 1990023 - RNA, 13 nt, Homo sapiens
guagggcgcugca

SEQ ID NO: 1990024 - RNA, 23 nt, Homo sapiens
agugucaggcgccgcacuuccuu

SEQ ID NO: 1990025 - RNA, 15 nt, Homo sapiens
auuaacuuacuucca

SEQ ID NO: 1990026 - RNA, 19 nt, Homo sapiens
gguagagacuuugacucuc

SEQ ID NO: 1990027 - RNA, 13 nt, Homo sapiens
acuccagcccauu

SEQ ID NO: 1990028 - RNA, 13 nt, Homo sapiens
guauaaaacauua

SEQ ID NO: 1990029 - RNA, 18 nt, Homo sapiens
aggagcagaccagcacuu

SEQ ID NO: 1990030 - RNA, 13 nt, Homo sapiens
agggccccggggc

SEQ ID NO: 1990031 - RNA, 12 nt, Homo sapiens
acagugacugua

SEQ ID NO: 1990032 - RNA, 15 nt, Homo sapiens
aguuguuuugcauaa

SEQ ID NO: 1990033 - RNA, 20 nt, Homo sapiens
ggccaaccaaagacacuguc

SEQ ID NO: 1990034 - RNA, 19 nt, Homo sapiens
aggguggcacccaccacuc

SEQ ID NO: 1990035 - RNA, 14 nt, Homo sapiens
agaaugcauucccu

SEQ ID NO: 1990036 - RNA, 17 nt, Homo sapiens
ucagauuuccauugugu

SEQ ID NO: 1990037 - RNA, 21 nt, Homo sapiens
caauacccuuuuaaguuuaaa

SEQ ID NO: 1990038 - RNA, 18 nt, Homo sapiens
guuuccccaauuccucug

SEQ ID NO: 1990039 - RNA, 22 nt, Homo sapiens
cuuaauguuucuuagagccaag

SEQ ID NO: 1990040 - RNA, 13 nt, Homo sapiens
aguuccugcacuc

SEQ ID NO: 1990041 - RNA, 14 nt, Homo sapiens
auacaguguacaug

SEQ ID NO: 1990042 - RNA, 14 nt, Homo sapiens
uggcugcugugcua

SEQ ID NO: 1990043 - RNA, 13 nt, Homo sapiens
aaagaccuugaaa

SEQ ID NO: 1990044 - RNA, 19 nt, Homo sapiens
uuucagaauauuuucaaaa

SEQ ID NO: 1990045 - RNA, 12 nt, Homo sapiens
ggguuuugcucu

SEQ ID NO: 1990046 - RNA, 14 nt, Homo sapiens
agcacucuacugca

SEQ ID NO: 1990047 - RNA, 20 nt, Homo sapiens
aaugcuauacuggauacucu

SEQ ID NO: 1990048 - RNA, 20 nt, Homo sapiens
cugaauucuuuccccaaaga

SEQ ID NO: 1990049 - RNA, 12 nt, Homo sapiens
cacauccagcuu

SEQ ID NO: 1990050 - RNA, 17 nt, Homo sapiens
guaggagagagugcugc

SEQ ID NO: 1990051 - RNA, 16 nt, Homo sapiens
ucuuuuacaauccuaa

SEQ ID NO: 1990052 - RNA, 12 nt, Homo sapiens
uuaauacaccuu

SEQ ID NO: 1990053 - RNA, 15 nt, Homo sapiens
ccucaauauuuacua

SEQ ID NO: 1990054 - RNA, 17 nt, Homo sapiens
ggagccccacugcccuu

SEQ ID NO: 1990055 - RNA, 17 nt, Homo sapiens
aggggaagccagugaca

SEQ ID NO: 1990056 - RNA, 16 nt, Homo sapiens
caaaacccacagaaga

SEQ ID NO: 1990057 - RNA, 22 nt, Homo sapiens
acaauaaaaugucuucucccac

SEQ ID NO: 1990058 - RNA, 18 nt, Homo sapiens
cccaguaacugcaccaac

SEQ ID NO: 1990059 - RNA, 18 nt, Homo sapiens
uccauuuaaaaaugaucu

SEQ ID NO: 1990060 - RNA, 15 nt, Homo sapiens
uuccuccuacuuaca

SEQ ID NO: 1990061 - RNA, 13 nt, Homo sapiens
ugagauaaaugca

SEQ ID NO: 1990062 - RNA, 19 nt, Homo sapiens
ucuucaaagcaaagcucuu

SEQ ID NO: 1990063 - RNA, 17 nt, Homo sapiens
aguugaagggaggugaa

SEQ ID NO: 1990064 - RNA, 23 nt, Homo sapiens
ccauccaaacacugaggcagccu

SEQ ID NO: 1990065 - RNA, 14 nt, Homo sapiens
agauauugauuacu

SEQ ID NO: 1990066 - RNA, 16 nt, Homo sapiens
agcaccuguaauccca

SEQ ID NO: 1990067 - RNA, 11 nt, Homo sapiens
aggggccucag

SEQ ID NO: 1990068 - RNA, 21 nt, Homo sapiens
uucgcgcccgccccugcagca

SEQ ID NO: 1990069 - RNA, 20 nt, Homo sapiens
aaccgcuugccauauuccga

SEQ ID NO: 1990070 - RNA, 22 nt, Homo sapiens
agucagacuuuguguucauuuc

SEQ ID NO: 1990071 - RNA, 19 nt, Homo sapiens
cucuuacaucaguagcauu

SEQ ID NO: 1990072 - RNA, 20 nt, Homo sapiens
gcugugaucggccuggggaa

SEQ ID NO: 1990073 - RNA, 15 nt, Homo sapiens
acuaaggagcaugau

SEQ ID NO: 1990074 - RNA, 19 nt, Homo sapiens
ccgggaaggaccugcggua

SEQ ID NO: 1990075 - RNA, 13 nt, Homo sapiens
cucugcauauucu

SEQ ID NO: 1990076 - RNA, 19 nt, Homo sapiens
cuugguguuucuuuuucca

SEQ ID NO: 1990077 - RNA, 17 nt, Homo sapiens
uugacaggaauacuuaa

SEQ ID NO: 1990078 - RNA, 21 nt, Homo sapiens
uuuuaggaacucacucuuuag

SEQ ID NO: 1990079 - RNA, 15 nt, Homo sapiens
acugagguccacaga

SEQ ID NO: 1990080 - RNA, 23 nt, Homo sapiens
gcccugugggcccccaaauggaa

SEQ ID NO: 1990081 - RNA, 15 nt, Homo sapiens
aaagucuugugacua

SEQ ID NO: 1990082 - RNA, 18 nt, Homo sapiens
cuucccaguagcucuugc

SEQ ID NO: 1990083 - RNA, 20 nt, Homo sapiens
cccugggaugccucaccaca

SEQ ID NO: 1990084 - RNA, 23 nt, Homo sapiens
acucucugccagcuccacagggu

SEQ ID NO: 1990085 - RNA, 22 nt, Homo sapiens
agagagccccugacaauccuga

SEQ ID NO: 1990086 - RNA, 23 nt, Homo sapiens
agagcaaucuugcugugaaacag

SEQ ID NO: 1990087 - RNA, 22 nt, Homo sapiens
cacagucaccacuccaugacau

SEQ ID NO: 1990088 - RNA, 22 nt, Homo sapiens
augugauaaaaccccaucucua

SEQ ID NO: 1990089 - RNA, 14 nt, Homo sapiens
uacagaaaugacug

SEQ ID NO: 1990090 - RNA, 22 nt, Homo sapiens
cagccccuccccagacucucag

SEQ ID NO: 1990091 - RNA, 14 nt, Homo sapiens
ggcuucaccaucaa

SEQ ID NO: 1990092 - RNA, 14 nt, Homo sapiens
gacuuaaugugauu

SEQ ID NO: 1990093 - RNA, 15 nt, Homo sapiens
ugaaaaggacaaaua

SEQ ID NO: 1990094 - RNA, 13 nt, Homo sapiens
uaccaauuuccca

SEQ ID NO: 1990095 - RNA, 13 nt, Homo sapiens
uaaauauuucaau

SEQ ID NO: 1990096 - RNA, 17 nt, Homo sapiens
aaucuuauuacugagag

SEQ ID NO: 1990097 - RNA, 11 nt, Homo sapiens
gcucuugcccu

SEQ ID NO: 1990098 - RNA, 14 nt, Homo sapiens
auuuuacacaaaua

SEQ ID NO: 1990099 - RNA, 14 nt, Homo sapiens
cugcugaccuccac

SEQ ID NO: 1990100 - RNA, 15 nt, Homo sapiens
ucuugcacuauucca

SEQ ID NO: 1990101 - RNA, 18 nt, Homo sapiens
uuaaagacguucccuuuu

SEQ ID NO: 1990102 - RNA, 14 nt, Homo sapiens
uugagucugucaca

SEQ ID NO: 1990103 - RNA, 16 nt, Homo sapiens
auuaacaugcaauaac

SEQ ID NO: 1990104 - RNA, 20 nt, Homo sapiens
agcaggguggggucugggag

SEQ ID NO: 1990105 - RNA, 21 nt, Homo sapiens
cggcugcggcagcucugguaa

SEQ ID NO: 1990106 - RNA, 15 nt, Homo sapiens
gucauagggauuguc

SEQ ID NO: 1990107 - RNA, 15 nt, Homo sapiens
cauaaauuguacugu

SEQ ID NO: 1990108 - RNA, 13 nt, Homo sapiens
gauccucuacugu

SEQ ID NO: 1990109 - RNA, 14 nt, Homo sapiens
ugugucaacugaga

SEQ ID NO: 1990110 - RNA, 17 nt, Homo sapiens
cugagaaggcaaaagaa

SEQ ID NO: 1990111 - RNA, 14 nt, Homo sapiens
gauccaauaugacu

SEQ ID NO: 1990112 - RNA, 16 nt, Homo sapiens
uggggaagguggagca

SEQ ID NO: 1990113 - RNA, 12 nt, Homo sapiens
caaagacuguac

SEQ ID NO: 1990114 - RNA, 22 nt, Homo sapiens
gcccuugacaaagucaagccac

SEQ ID NO: 1990115 - RNA, 23 nt, Homo sapiens
caccuggcagggcucacacuccu

SEQ ID NO: 1990116 - RNA, 11 nt, Homo sapiens
gaacagggaag

SEQ ID NO: 1990117 - RNA, 19 nt, Homo sapiens
agagugagacuccgucuca

SEQ ID NO: 1990118 - RNA, 18 nt, Homo sapiens
uucccuguguagcucuca

SEQ ID NO: 1990119 - RNA, 12 nt, Homo sapiens
gcccccaugcug

SEQ ID NO: 1990120 - RNA, 13 nt, Homo sapiens
uuucuugcaugag

SEQ ID NO: 1990121 - RNA, 12 nt, Homo sapiens
gaauacuuggaa

SEQ ID NO: 1990122 - RNA, 13 nt, Homo sapiens
ucaauaguauuaa

SEQ ID NO: 1990123 - RNA, 14 nt, Homo sapiens
auuggucauuguga

SEQ ID NO: 1990124 - RNA, 18 nt, Homo sapiens
gccugacgaacuccuuga

SEQ ID NO: 1990125 - RNA, 19 nt, Homo sapiens
accggccuuugcaccucca

SEQ ID NO: 1990126 - RNA, 14 nt, Homo sapiens
auuucugguucuga

SEQ ID NO: 1990127 - RNA, 22 nt, Homo sapiens
aacaccuucuuggcuucuggga

SEQ ID NO: 1990128 - RNA, 21 nt, Homo sapiens
accucuagguccccauacucc

SEQ ID NO: 1990129 - RNA, 19 nt, Homo sapiens
uuccaucagacugaacuua

SEQ ID NO: 1990130 - RNA, 18 nt, Homo sapiens
cccagaugaucccaguca

SEQ ID NO: 1990131 - RNA, 22 nt, Homo sapiens
gcuucagguuagugacauuuaa

SEQ ID NO: 1990132 - RNA, 17 nt, Homo sapiens
ccaguacauaaggaguu

SEQ ID NO: 1990133 - RNA, 15 nt, Homo sapiens
aauaaagcuuacaua

SEQ ID NO: 1990134 - RNA, 14 nt, Homo sapiens
cuaacuuauccauc

SEQ ID NO: 1990135 - RNA, 12 nt, Homo sapiens
gucagcucucuc

SEQ ID NO: 1990136 - RNA, 14 nt, Homo sapiens
aagguuugaugcca

SEQ ID NO: 1990137 - RNA, 23 nt, Homo sapiens
uaugucaccucaggaccauguga

SEQ ID NO: 1990138 - RNA, 14 nt, Homo sapiens
ccugaccacccucc

SEQ ID NO: 1990139 - RNA, 17 nt, Homo sapiens
aggucggagugccugga

SEQ ID NO: 1990140 - RNA, 14 nt, Homo sapiens
uagcaaacuuugua

SEQ ID NO: 1990141 - RNA, 21 nt, Homo sapiens
auguguggguguguguuacau

SEQ ID NO: 1990142 - RNA, 13 nt, Homo sapiens
cagagagugaaua

SEQ ID NO: 1990143 - RNA, 18 nt, Homo sapiens
cugaugccccugacauca

SEQ ID NO: 1990144 - RNA, 21 nt, Homo sapiens
uauaugccucauacacauaau

SEQ ID NO: 1990145 - RNA, 16 nt, Homo sapiens
agucuuaacuuuucac

SEQ ID NO: 1990146 - RNA, 13 nt, Homo sapiens
uggaaccagccca

SEQ ID NO: 1990147 - RNA, 18 nt, Homo sapiens
agaaaggguucuguaaaa

SEQ ID NO: 1990148 - RNA, 20 nt, Homo sapiens
cugagagccgggaaggggaa

SEQ ID NO: 1990149 - RNA, 13 nt, Homo sapiens
gugcucauuuaag

SEQ ID NO: 1990150 - RNA, 22 nt, Homo sapiens
uucaugccaaguaucuuuccag

SEQ ID NO: 1990151 - RNA, 14 nt, Homo sapiens
uggaagugcuaauu

SEQ ID NO: 1990152 - RNA, 17 nt, Homo sapiens
gucaucaggugcauagc

SEQ ID NO: 1990153 - RNA, 17 nt, Homo sapiens
cuccuuccuugaacccu

SEQ ID NO: 1990154 - RNA, 14 nt, Homo sapiens
acccuugacuguua

SEQ ID NO: 1990155 - RNA, 16 nt, Homo sapiens
gauguaaauauuucaa

SEQ ID NO: 1990156 - RNA, 15 nt, Homo sapiens
aggucagaaguucaa

SEQ ID NO: 1990157 - RNA, 22 nt, Homo sapiens
uacuucugggaaccguaauuga

SEQ ID NO: 1990158 - RNA, 15 nt, Homo sapiens
uuggggugcuuccuu

SEQ ID NO: 1990159 - RNA, 15 nt, Homo sapiens
cggccggguguggug

SEQ ID NO: 1990160 - RNA, 14 nt, Homo sapiens
ggcaugcaccagug

SEQ ID NO: 1990161 - RNA, 15 nt, Homo sapiens
uaugcaaguguuccu

SEQ ID NO: 1990162 - RNA, 16 nt, Homo sapiens
ccacuauugugcuguc

SEQ ID NO: 1990163 - RNA, 19 nt, Homo sapiens
gugucauggacuguugcca

SEQ ID NO: 1990164 - RNA, 15 nt, Homo sapiens
acacacggaugcaca

SEQ ID NO: 1990165 - RNA, 17 nt, Homo sapiens
gccauccucacccagca

SEQ ID NO: 1990166 - RNA, 11 nt, Homo sapiens
gaaaagccuaa

SEQ ID NO: 1990167 - RNA, 15 nt, Homo sapiens
cagugcauguggaaa

SEQ ID NO: 1990168 - RNA, 14 nt, Homo sapiens
cucccagugccuuc

SEQ ID NO: 1990169 - RNA, 16 nt, Homo sapiens
uacaucugugugguau

SEQ ID NO: 1990170 - RNA, 16 nt, Homo sapiens
auugcuaucagcaaug

SEQ ID NO: 1990171 - RNA, 19 nt, Homo sapiens
accuauccacacaacauau

SEQ ID NO: 1990172 - RNA, 20 nt, Homo sapiens
caccaaguaaauuuguauaa

SEQ ID NO: 1990173 - RNA, 13 nt, Homo sapiens
ggguccuguccau

SEQ ID NO: 1990174 - RNA, 14 nt, Homo sapiens
ugaaagguaaucug

SEQ ID NO: 1990175 - RNA, 21 nt, Homo sapiens
agccugaaugucuuacuguga

SEQ ID NO: 1990176 - RNA, 21 nt, Homo sapiens
gccaggccaaaucacccuuag

SEQ ID NO: 1990177 - RNA, 17 nt, Homo sapiens
acuuucuuuuuugauau

SEQ ID NO: 1990178 - RNA, 14 nt, Homo sapiens
agaaaaccaaacaa

SEQ ID NO: 1990179 - RNA, 16 nt, Homo sapiens
acugauuucaaaucau

SEQ ID NO: 1990180 - RNA, 22 nt, Homo sapiens
gguucuuuccaugcagacuccu

SEQ ID NO: 1990181 - RNA, 14 nt, Homo sapiens
agacauguuucaag

SEQ ID NO: 1990182 - RNA, 20 nt, Homo sapiens
uacagcuuucugugcagaga

SEQ ID NO: 1990183 - RNA, 22 nt, Homo sapiens
aaaggacaucagcaaacaggau

SEQ ID NO: 1990184 - RNA, 13 nt, Homo sapiens
cuagcuauaacaa

SEQ ID NO: 1990185 - RNA, 10 nt, Homo sapiens
caacacuuaa

SEQ ID NO: 1990186 - RNA, 23 nt, Homo sapiens
auggauggggguuaccuagcccu

SEQ ID NO: 1990187 - RNA, 21 nt, Homo sapiens
acccauuucuacuuuuugcac

SEQ ID NO: 1990188 - RNA, 13 nt, Homo sapiens
acuugauaaucuu

SEQ ID NO: 1990189 - RNA, 12 nt, Homo sapiens
uuccacugccuc

SEQ ID NO: 1990190 - RNA, 20 nt, Homo sapiens
uaagcucaauuuaauuuugc

SEQ ID NO: 1990191 - RNA, 15 nt, Homo sapiens
gccuguaacacuccu

SEQ ID NO: 1990192 - RNA, 18 nt, Homo sapiens
gguugcagugaaccuaga

SEQ ID NO: 1990193 - RNA, 16 nt, Homo sapiens
uaaaugucucacugag

SEQ ID NO: 1990194 - RNA, 14 nt, Homo sapiens
cuucgaguccagga

SEQ ID NO: 1990195 - RNA, 21 nt, Homo sapiens
gcuuucccgcccagccucacu

SEQ ID NO: 1990196 - RNA, 12 nt, Homo sapiens
ugucauguguau

SEQ ID NO: 1990197 - RNA, 17 nt, Homo sapiens
gaucauuucuaggcaaa

SEQ ID NO: 1990198 - RNA, 17 nt, Homo sapiens
agaucaaguugagacag

SEQ ID NO: 1990199 - RNA, 10 nt, Homo sapiens
auaacccaua

SEQ ID NO: 1990200 - RNA, 17 nt, Homo sapiens
accuuaagauuuugcac

SEQ ID NO: 1990201 - RNA, 18 nt, Homo sapiens
uuguuuuaugcuacugaa

SEQ ID NO: 1990202 - RNA, 17 nt, Homo sapiens
ugcgcucucuuugcaac

SEQ ID NO: 1990203 - RNA, 23 nt, Homo sapiens
uuccacugauggaaacaaagugg

SEQ ID NO: 1990204 - RNA, 21 nt, Homo sapiens
gacccaaccccuagcugggcc

SEQ ID NO: 1990205 - RNA, 17 nt, Homo sapiens
ggaauguguccaagaca

SEQ ID NO: 1990206 - RNA, 23 nt, Homo sapiens
caagaguucuaaauacaggaaau

SEQ ID NO: 1990207 - RNA, 20 nt, Homo sapiens
agccucccugaagaccaaaa

SEQ ID NO: 1990208 - RNA, 13 nt, Homo sapiens
aauugauagucaa

SEQ ID NO: 1990209 - RNA, 23 nt, Homo sapiens
ugcggaggaaggaggacccagga

SEQ ID NO: 1990210 - RNA, 23 nt, Homo sapiens
ucuaaagcuuuggacaaguccuu

SEQ ID NO: 1990211 - RNA, 15 nt, Homo sapiens
ccaaccaaaccaauu

SEQ ID NO: 1990212 - RNA, 19 nt, Homo sapiens
uggaaaucagacuuuuaca

SEQ ID NO: 1990213 - RNA, 18 nt, Homo sapiens
agcgccucccuugucuca

SEQ ID NO: 1990214 - RNA, 16 nt, Homo sapiens
acuuccucaugaaucu

SEQ ID NO: 1990215 - RNA, 19 nt, Homo sapiens
uauucugccuuccaguuug

SEQ ID NO: 1990216 - RNA, 15 nt, Homo sapiens
ugggcguuuguaaau

SEQ ID NO: 1990217 - RNA, 13 nt, Homo sapiens
aucauaugugauc

SEQ ID NO: 1990218 - RNA, 23 nt, Homo sapiens
aguuuaugaugcaaaucugccaa

SEQ ID NO: 1990219 - RNA, 20 nt, Homo sapiens
ugacaaguagggcacaaaau

SEQ ID NO: 1990220 - RNA, 22 nt, Homo sapiens
gccaagaugacacaacugcacu

SEQ ID NO: 1990221 - RNA, 22 nt, Homo sapiens
agccccacccugccucacccac

SEQ ID NO: 1990222 - RNA, 14 nt, Homo sapiens
ccauucaucuucau

SEQ ID NO: 1990223 - RNA, 17 nt, Homo sapiens
aauuaugcugcauuugg

SEQ ID NO: 1990224 - RNA, 18 nt, Homo sapiens
caugauacuaucugugcc

SEQ ID NO: 1990225 - RNA, 22 nt, Homo sapiens
aucuacuccuuguaaagacugu

SEQ ID NO: 1990226 - RNA, 15 nt, Homo sapiens
agccuccagcugccc

SEQ ID NO: 1990227 - RNA, 22 nt, Homo sapiens
gcacugauaucaucgauuagaa

SEQ ID NO: 1990228 - RNA, 21 nt, Homo sapiens
ggagcaagggcacaaacugca

SEQ ID NO: 1990229 - RNA, 13 nt, Homo sapiens
cacugcauacaau

SEQ ID NO: 1990230 - RNA, 23 nt, Homo sapiens
ucuagcuauuauuuucuuuaaag

SEQ ID NO: 1990231 - RNA, 20 nt, Homo sapiens
gcuucauauaccagcaauau

SEQ ID NO: 1990232 - RNA, 22 nt, Homo sapiens
uguacauauauauucuacauau

SEQ ID NO: 1990233 - RNA, 14 nt, Homo sapiens
uccaccaugaacuu

SEQ ID NO: 1990234 - RNA, 17 nt, Homo sapiens
cauuugugugugugcaa

SEQ ID NO: 1990235 - RNA, 13 nt, Homo sapiens
uacagacuccaaa

SEQ ID NO: 1990236 - RNA, 20 nt, Homo sapiens
aauaucaucugucauuauau

SEQ ID NO: 1990237 - RNA, 14 nt, Homo sapiens
auaaaguccugaca

SEQ ID NO: 1990238 - RNA, 19 nt, Homo sapiens
auccaccaccuugccaaug

SEQ ID NO: 1990239 - RNA, 18 nt, Homo sapiens
uccuagguccucugaggc

SEQ ID NO: 1990240 - RNA, 12 nt, Homo sapiens
auuuucuagaua

SEQ ID NO: 1990241 - RNA, 18 nt, Homo sapiens
ggccacucuugaccugga

SEQ ID NO: 1990242 - RNA, 23 nt, Homo sapiens
aaagguauuaaauugauguugcu

SEQ ID NO: 1990243 - RNA, 17 nt, Homo sapiens
caggcuggagugcagua

SEQ ID NO: 1990244 - RNA, 15 nt, Homo sapiens
ggaggacccuggaaa

SEQ ID NO: 1990245 - RNA, 14 nt, Homo sapiens
agaaauuaguuuca

SEQ ID NO: 1990246 - RNA, 22 nt, Homo sapiens
uuugacagacauccuugcaguu

SEQ ID NO: 1990247 - RNA, 14 nt, Homo sapiens
acagcauaugcaaa

SEQ ID NO: 1990248 - RNA, 16 nt, Homo sapiens
agcuuaagccacugcc

SEQ ID NO: 1990249 - RNA, 21 nt, Homo sapiens
uguauggguuaaaucaaagau

SEQ ID NO: 1990250 - RNA, 19 nt, Homo sapiens
cggcuccucggacucugcu

SEQ ID NO: 1990251 - RNA, 16 nt, Homo sapiens
gguacccacugggaca

SEQ ID NO: 1990252 - RNA, 19 nt, Homo sapiens
cccaagggacagcaaguga

SEQ ID NO: 1990253 - RNA, 14 nt, Homo sapiens
ugcugucauaacau

SEQ ID NO: 1990254 - RNA, 20 nt, Homo sapiens
gauguacgcugcgugccaug

SEQ ID NO: 1990255 - RNA, 15 nt, Homo sapiens
gagcacagggcuguu

SEQ ID NO: 1990256 - RNA, 18 nt, Homo sapiens
agucuuugauucaccaaa

SEQ ID NO: 1990257 - RNA, 13 nt, Homo sapiens
accaggccagcuc

SEQ ID NO: 1990258 - RNA, 15 nt, Homo sapiens
aauaaaauacauacu

SEQ ID NO: 1990259 - RNA, 17 nt, Homo sapiens
ccaggugagagcccuuu

SEQ ID NO: 1990260 - RNA, 17 nt, Homo sapiens
ccucuccuuugugacuu

SEQ ID NO: 1990261 - RNA, 19 nt, Homo sapiens
augaaugugcauuucuuga

SEQ ID NO: 1990262 - RNA, 17 nt, Homo sapiens
caucucaaagaaggcau

SEQ ID NO: 1990263 - RNA, 13 nt, Homo sapiens
ccacccuuuggag

SEQ ID NO: 1990264 - RNA, 23 nt, Homo sapiens
agagcacacugcacacaugcaca

SEQ ID NO: 1990265 - RNA, 21 nt, Homo sapiens
cuccaguccugccaccacccu

SEQ ID NO: 1990266 - RNA, 14 nt, Homo sapiens
uacugcccaaauag

SEQ ID NO: 1990267 - RNA, 23 nt, Homo sapiens
aacaugaagcacacacacaaaaa

SEQ ID NO: 1990268 - RNA, 22 nt, Homo sapiens
gccuggaugcccccuguggaug

SEQ ID NO: 1990269 - RNA, 17 nt, Homo sapiens
acauuuaguaaaugcug

SEQ ID NO: 1990270 - RNA, 23 nt, Homo sapiens
gcgguguggaccgaggaacaacu

SEQ ID NO: 1990271 - RNA, 19 nt, Homo sapiens
aacugaauaaauaccucuu

SEQ ID NO: 1990272 - RNA, 21 nt, Homo sapiens
ccuuuauugauaucuccauga

SEQ ID NO: 1990273 - RNA, 19 nt, Homo sapiens
ugugccugcugggcacugg

SEQ ID NO: 1990274 - RNA, 17 nt, Homo sapiens
acuuuugcaugaaaaua

SEQ ID NO: 1990275 - RNA, 18 nt, Homo sapiens
ucacccucauaccaucug

SEQ ID NO: 1990276 - RNA, 13 nt, Homo sapiens
uucuaggcauaca

SEQ ID NO: 1990277 - RNA, 15 nt, Homo sapiens
auuccaugugaaaau

SEQ ID NO: 1990278 - RNA, 17 nt, Homo sapiens
gucucuucauaauacuu

SEQ ID NO: 1990279 - RNA, 12 nt, Homo sapiens
ucuucucaaagc

SEQ ID NO: 1990280 - RNA, 15 nt, Homo sapiens
ucauuuguaaucuag

SEQ ID NO: 1990281 - RNA, 15 nt, Homo sapiens
ccacacaaaauguca

SEQ ID NO: 1990282 - RNA, 15 nt, Homo sapiens
uacacguaaaugcag

SEQ ID NO: 1990283 - RNA, 18 nt, Homo sapiens
aaaggagaacuauccaaa

SEQ ID NO: 1990284 - RNA, 12 nt, Homo sapiens
aucccucuccag

SEQ ID NO: 1990285 - RNA, 15 nt, Homo sapiens
gacgcagccugagaa

SEQ ID NO: 1990286 - RNA, 20 nt, Homo sapiens
cugaaauaaagcacauucca

SEQ ID NO: 1990287 - RNA, 16 nt, Homo sapiens
gccugcuucuuuccag

SEQ ID NO: 1990288 - RNA, 17 nt, Homo sapiens
ccaaaaagaccagacua

SEQ ID NO: 1990289 - RNA, 15 nt, Homo sapiens
ccuggguguguguga

SEQ ID NO: 1990290 - RNA, 20 nt, Homo sapiens
uggcaggggauccagcucaa

SEQ ID NO: 1990291 - RNA, 20 nt, Homo sapiens
aauacuauauuuauacugua

SEQ ID NO: 1990292 - RNA, 19 nt, Homo sapiens
ggcugguauuuaucugcaa

SEQ ID NO: 1990293 - RNA, 14 nt, Homo sapiens
auuguguguucuca

SEQ ID NO: 1990294 - RNA, 13 nt, Homo sapiens
gacaccuccuucu

SEQ ID NO: 1990295 - RNA, 23 nt, Homo sapiens
aauguguuuucuguagacucuaa

SEQ ID NO: 1990296 - RNA, 18 nt, Homo sapiens
cuaaguaagaacacugag

SEQ ID NO: 1990297 - RNA, 14 nt, Homo sapiens
aagcaucacacuug

SEQ ID NO: 1990298 - RNA, 13 nt, Homo sapiens
caccaaaguucua

SEQ ID NO: 1990299 - RNA, 12 nt, Homo sapiens
ccacaucccucu

SEQ ID NO: 1990300 - RNA, 20 nt, Homo sapiens
cuuuugaggggcugacuuca

SEQ ID NO: 1990301 - RNA, 19 nt, Homo sapiens
agcccugcagcccaccaga

SEQ ID NO: 1990302 - RNA, 11 nt, Homo sapiens
gggcugugcau

SEQ ID NO: 1990303 - RNA, 22 nt, Homo sapiens
ugcuccucucgcacaaugcaug

SEQ ID NO: 1990304 - RNA, 21 nt, Homo sapiens
cagggcccucccagcccauug

SEQ ID NO: 1990305 - RNA, 14 nt, Homo sapiens
cccuacccaccgau

SEQ ID NO: 1990306 - RNA, 22 nt, Homo sapiens
guaauuuuuggggaaaaaagca

SEQ ID NO: 1990307 - RNA, 17 nt, Homo sapiens
ccaaacuggugcaugac

SEQ ID NO: 1990308 - RNA, 19 nt, Homo sapiens
ucaccuggccugguugugu

SEQ ID NO: 1990309 - RNA, 19 nt, Homo sapiens
agcggcuguuuacugcuuu

SEQ ID NO: 1990310 - RNA, 18 nt, Homo sapiens
uacccuccucugcuggga

SEQ ID NO: 1990311 - RNA, 13 nt, Homo sapiens
auugcacucauca

SEQ ID NO: 1990312 - RNA, 16 nt, Homo sapiens
cagugccuggcaaggc

SEQ ID NO: 1990313 - RNA, 17 nt, Homo sapiens
ggagaaggcagugauua

SEQ ID NO: 1990314 - RNA, 16 nt, Homo sapiens
uuaccuugugcuaauc

SEQ ID NO: 1990315 - RNA, 17 nt, Homo sapiens
gcgggucaacauuucca

SEQ ID NO: 1990316 - RNA, 15 nt, Homo sapiens
cuggauuauucuggg

SEQ ID NO: 1990317 - RNA, 14 nt, Homo sapiens
cuccugggugccag

SEQ ID NO: 1990318 - RNA, 22 nt, Homo sapiens
cugacagaaagcagauaccuca

SEQ ID NO: 1990319 - RNA, 22 nt, Homo sapiens
cagcugcagucaacaguucaaa

SEQ ID NO: 1990320 - RNA, 13 nt, Homo sapiens
ggcaaaugaauuu

SEQ ID NO: 1990321 - RNA, 22 nt, Homo sapiens
ucuccccgcuaaggaagauauc

SEQ ID NO: 1990322 - RNA, 22 nt, Homo sapiens
ggacugagccuggcccauagaa

SEQ ID NO: 1990323 - RNA, 14 nt, Homo sapiens
ucucggacucccua

SEQ ID NO: 1990324 - RNA, 17 nt, Homo sapiens
uugugugcucauguaug

SEQ ID NO: 1990325 - RNA, 21 nt, Homo sapiens
cuugggccucaucugcuccua

SEQ ID NO: 1990326 - RNA, 12 nt, Homo sapiens
auaacacuguga

SEQ ID NO: 1990327 - RNA, 23 nt, Homo sapiens
ucuauuuuguuagauuuugccuu

SEQ ID NO: 1990328 - RNA, 12 nt, Homo sapiens
agaucacgccac

SEQ ID NO: 1990329 - RNA, 23 nt, Homo sapiens
gacccagccagaacuugugcccu

SEQ ID NO: 1990330 - RNA, 14 nt, Homo sapiens
ccaagagcuacucc

SEQ ID NO: 1990331 - RNA, 19 nt, Homo sapiens
ugacaucccuuccuggaaa

SEQ ID NO: 1990332 - RNA, 23 nt, Homo sapiens
aguccucagugaaaggauuccgc

SEQ ID NO: 1990333 - RNA, 22 nt, Homo sapiens
ccuguuuuuccuuuuguuuaca

SEQ ID NO: 1990334 - RNA, 14 nt, Homo sapiens
auaacugaaccaaa

SEQ ID NO: 1990335 - RNA, 21 nt, Homo sapiens
ugccauaguuugaauucaugc

SEQ ID NO: 1990336 - RNA, 23 nt, Homo sapiens
cagaggcuaauucagugucacau

SEQ ID NO: 1990337 - RNA, 17 nt, Homo sapiens
uaaugucaacaccagaa

SEQ ID NO: 1990338 - RNA, 23 nt, Homo sapiens
ccgggccugcacagauaccucau

SEQ ID NO: 1990339 - RNA, 20 nt, Homo sapiens
agcucaggucccaggccagc

SEQ ID NO: 1990340 - RNA, 19 nt, Homo sapiens
uuccuugacuucuuugaga

SEQ ID NO: 1990341 - RNA, 20 nt, Homo sapiens
cacuuaaaaaauguccauga

SEQ ID NO: 1990342 - RNA, 22 nt, Homo sapiens
uuaucagcaaaaaaguccaauu

SEQ ID NO: 1990343 - RNA, 23 nt, Homo sapiens
gcuguggggaccacacugauccu

SEQ ID NO: 1990344 - RNA, 12 nt, Homo sapiens
gauauaccaaau

SEQ ID NO: 1990345 - RNA, 23 nt, Homo sapiens
uaaaugucauuucacuacuggug

SEQ ID NO: 1990346 - RNA, 21 nt, Homo sapiens
gguaucaaaauuacauauacu

SEQ ID NO: 1990347 - RNA, 23 nt, Homo sapiens
ucucccuacuuagacccagucau

SEQ ID NO: 1990348 - RNA, 17 nt, Homo sapiens
uuagaaacacugcaaau

SEQ ID NO: 1990349 - RNA, 19 nt, Homo sapiens
aaaugcuagguuaauucca

SEQ ID NO: 1990350 - RNA, 18 nt, Homo sapiens
uguggacugggaagcauu

SEQ ID NO: 1990351 - RNA, 13 nt, Homo sapiens
augaaauacucuu

SEQ ID NO: 1990352 - RNA, 19 nt, Homo sapiens
aaaucagcacauuccuccu

SEQ ID NO: 1990353 - RNA, 21 nt, Homo sapiens
acagugagacccccaucucua

SEQ ID NO: 1990354 - RNA, 22 nt, Homo sapiens
cugcucaagagaagcacaugaa

SEQ ID NO: 1990355 - RNA, 16 nt, Homo sapiens
guauguugaagccuuu

SEQ ID NO: 1990356 - RNA, 23 nt, Homo sapiens
aggcuggcacuccccugaccuca

SEQ ID NO: 1990357 - RNA, 16 nt, Homo sapiens
ccuagucuagcauucu

SEQ ID NO: 1990358 - RNA, 14 nt, Homo sapiens
aauauaucuugucu

SEQ ID NO: 1990359 - RNA, 22 nt, Homo sapiens
aaaggcauaagacccuaagccu

SEQ ID NO: 1990360 - RNA, 12 nt, Homo sapiens
cccuguagggug

SEQ ID NO: 1990361 - RNA, 16 nt, Homo sapiens
aacaccaagugucugc

SEQ ID NO: 1990362 - RNA, 11 nt, Homo sapiens
uucaaacacuc

SEQ ID NO: 1990363 - RNA, 17 nt, Homo sapiens
ucuguggaccacugcau

SEQ ID NO: 1990364 - RNA, 22 nt, Homo sapiens
cauauguuucugcuagcuauau

SEQ ID NO: 1990365 - RNA, 16 nt, Homo sapiens
aaagaagccucagcuc

SEQ ID NO: 1990366 - RNA, 19 nt, Homo sapiens
ggaaugcuuuccaucucca

SEQ ID NO: 1990367 - RNA, 23 nt, Homo sapiens
agugucaccccucacugugacug

SEQ ID NO: 1990368 - RNA, 17 nt, Homo sapiens
ucugcauuucauauuau

SEQ ID NO: 1990369 - RNA, 20 nt, Homo sapiens
ugggggugccgcucucucug

SEQ ID NO: 1990370 - RNA, 19 nt, Homo sapiens
uauccaguuuaaucuucac

SEQ ID NO: 1990371 - RNA, 16 nt, Homo sapiens
aauucacauaggcaau

SEQ ID NO: 1990372 - RNA, 21 nt, Homo sapiens
ugcaagguuccacagaguaag

SEQ ID NO: 1990373 - RNA, 15 nt, Homo sapiens
accaccuaauaucaa

SEQ ID NO: 1990374 - RNA, 13 nt, Homo sapiens
caaugaaauggau

SEQ ID NO: 1990375 - RNA, 22 nt, Homo sapiens
uaaaaagggcagggcaucuccu

SEQ ID NO: 1990376 - RNA, 16 nt, Homo sapiens
auagguugagcaauuu

SEQ ID NO: 1990377 - RNA, 12 nt, Homo sapiens
aagcaucugcca

SEQ ID NO: 1990378 - RNA, 18 nt, Homo sapiens
gcacagacugucuugaac

SEQ ID NO: 1990379 - RNA, 16 nt, Homo sapiens
ugauuguuauguguau

SEQ ID NO: 1990380 - RNA, 18 nt, Homo sapiens
agcuugggcuucuuccuc

SEQ ID NO: 1990381 - RNA, 13 nt, Homo sapiens
aucaggauuucau

SEQ ID NO: 1990382 - RNA, 20 nt, Homo sapiens
ggaaugcaccuccccaaagc

SEQ ID NO: 1990383 - RNA, 17 nt, Homo sapiens
uucauauuugucuuuga

SEQ ID NO: 1990384 - RNA, 23 nt, Homo sapiens
aaauucccuuuaugcacccaaga

SEQ ID NO: 1990385 - RNA, 21 nt, Homo sapiens
cagaggccugcugccagugca

SEQ ID NO: 1990386 - RNA, 16 nt, Homo sapiens
aauguuaacaugcgca

SEQ ID NO: 1990387 - RNA, 15 nt, Homo sapiens
aaggaaucauuguuc

SEQ ID NO: 1990388 - RNA, 13 nt, Homo sapiens
ccugggacaucag

SEQ ID NO: 1990389 - RNA, 13 nt, Homo sapiens
cucaugacacugu

SEQ ID NO: 1990390 - RNA, 16 nt, Homo sapiens
aggaugggauguauuu

SEQ ID NO: 1990391 - RNA, 19 nt, Homo sapiens
augugacugugacuuucaa

SEQ ID NO: 1990392 - RNA, 21 nt, Homo sapiens
ucagauuaaugacuggcuaca

SEQ ID NO: 1990393 - RNA, 20 nt, Homo sapiens
ucauauugaugugugucuag

SEQ ID NO: 1990394 - RNA, 17 nt, Homo sapiens
ggcuuuguauacuuuua

SEQ ID NO: 1990395 - RNA, 17 nt, Homo sapiens
guuugugagaaacaucu

SEQ ID NO: 1990396 - RNA, 20 nt, Homo sapiens
ucaguccacuucugcucugg

SEQ ID NO: 1990397 - RNA, 19 nt, Homo sapiens
acuuacaggcuaaaauuag

SEQ ID NO: 1990398 - RNA, 13 nt, Homo sapiens
uuuacaugugauu

SEQ ID NO: 1990399 - RNA, 16 nt, Homo sapiens
gaaagccccugccccu

SEQ ID NO: 1990400 - RNA, 14 nt, Homo sapiens
augcucaucugagc

SEQ ID NO: 1990401 - RNA, 14 nt, Homo sapiens
gguaggucggcacu

SEQ ID NO: 1990402 - RNA, 20 nt, Homo sapiens
gucuuggcuuucauguuauu

SEQ ID NO: 1990403 - RNA, 22 nt, Homo sapiens
acaagacaggacccugggacca

SEQ ID NO: 1990404 - RNA, 18 nt, Homo sapiens
auaaccccaggcauccca

SEQ ID NO: 1990405 - RNA, 12 nt, Homo sapiens
guauauaaucca

SEQ ID NO: 1990406 - RNA, 14 nt, Homo sapiens
ggguuuacucucaa

SEQ ID NO: 1990407 - RNA, 14 nt, Homo sapiens
ugcagugaauucau

SEQ ID NO: 1990408 - RNA, 15 nt, Homo sapiens
aucuuuuuccacuuu

SEQ ID NO: 1990409 - RNA, 23 nt, Homo sapiens
aggcuggucucaaacuccugagc

SEQ ID NO: 1990410 - RNA, 14 nt, Homo sapiens
ugucugucccaaag

SEQ ID NO: 1990411 - RNA, 23 nt, Homo sapiens
cuaauuaaaaaguuaaucuucau

SEQ ID NO: 1990412 - RNA, 22 nt, Homo sapiens
gcuccugccccuuucaggccua

SEQ ID NO: 1990413 - RNA, 13 nt, Homo sapiens
gaugaaauacuua

SEQ ID NO: 1990414 - RNA, 17 nt, Homo sapiens
gcugguuuuucauuucc

SEQ ID NO: 1990415 - RNA, 19 nt, Homo sapiens
guaauauaguuauugcaca

SEQ ID NO: 1990416 - RNA, 23 nt, Homo sapiens
agauaacuuccuucacaucuccc

SEQ ID NO: 1990417 - RNA, 14 nt, Homo sapiens
ucugcuaaauauca

SEQ ID NO: 1990418 - RNA, 17 nt, Homo sapiens
cucucuuauaauuccag

SEQ ID NO: 1990419 - RNA, 16 nt, Homo sapiens
uugaacaguuggauag

SEQ ID NO: 1990420 - RNA, 13 nt, Homo sapiens
ggguggcggugga

SEQ ID NO: 1990421 - RNA, 15 nt, Homo sapiens
uacuguucuugcugc

SEQ ID NO: 1990422 - RNA, 22 nt, Homo sapiens
uacuuugcaauccaaauaaaga

SEQ ID NO: 1990423 - RNA, 14 nt, Homo sapiens
agucucaggaccua

SEQ ID NO: 1990424 - RNA, 15 nt, Homo sapiens
cagucccacacugug

SEQ ID NO: 1990425 - RNA, 22 nt, Homo sapiens
ugugugaaauguauuaucacca

SEQ ID NO: 1990426 - RNA, 14 nt, Homo sapiens
auaauaacuacuuc

SEQ ID NO: 1990427 - RNA, 17 nt, Homo sapiens
uccacacggucuucaca

SEQ ID NO: 1990428 - RNA, 18 nt, Homo sapiens
ccugacgaacuccuugau

SEQ ID NO: 1990429 - RNA, 23 nt, Homo sapiens
guaagaacauguuacgugugcaa

SEQ ID NO: 1990430 - RNA, 18 nt, Homo sapiens
caagcaaugggcaaugga

SEQ ID NO: 1990431 - RNA, 11 nt, Homo sapiens
agugcauuuag

SEQ ID NO: 1990432 - RNA, 14 nt, Homo sapiens
gugccuggccaugu

SEQ ID NO: 1990433 - RNA, 19 nt, Homo sapiens
cuaucugacuucauacauc

SEQ ID NO: 1990434 - RNA, 15 nt, Homo sapiens
cuugggcaggucaca

SEQ ID NO: 1990435 - RNA, 18 nt, Homo sapiens
gcauagaguucagacuuu

SEQ ID NO: 1990436 - RNA, 16 nt, Homo sapiens
ucaauucagugcugua

SEQ ID NO: 1990437 - RNA, 19 nt, Homo sapiens
acuggcacuguggcacugc

SEQ ID NO: 1990438 - RNA, 19 nt, Homo sapiens
uggcaguguggcagugacc

SEQ ID NO: 1990439 - RNA, 20 nt, Homo sapiens
aauauacuuuuuuuguuaua

SEQ ID NO: 1990440 - RNA, 12 nt, Homo sapiens
uucaaaugaaac

SEQ ID NO: 1990441 - RNA, 13 nt, Homo sapiens
cuagcaaagcuua

SEQ ID NO: 1990442 - RNA, 22 nt, Homo sapiens
cagcuguaacccucacccacag

SEQ ID NO: 1990443 - RNA, 14 nt, Homo sapiens
cuaccucaaaacac

SEQ ID NO: 1990444 - RNA, 14 nt, Homo sapiens
aagacccacugaau

SEQ ID NO: 1990445 - RNA, 11 nt, Homo sapiens
ugaagccacag

SEQ ID NO: 1990446 - RNA, 23 nt, Homo sapiens
uaugcugugaauuuuacaaaaau

SEQ ID NO: 1990447 - RNA, 18 nt, Homo sapiens
uaaauuacccaguuuaga

SEQ ID NO: 1990448 - RNA, 19 nt, Homo sapiens
aaccaaagcuuuauuucaa

SEQ ID NO: 1990449 - RNA, 14 nt, Homo sapiens
aacuguaagcucaa

SEQ ID NO: 1990450 - RNA, 14 nt, Homo sapiens
gcuuguaaaaccaa

SEQ ID NO: 1990451 - RNA, 19 nt, Homo sapiens
guucauuucacacagugaa

SEQ ID NO: 1990452 - RNA, 20 nt, Homo sapiens
ccaagggcuccagggccagg

SEQ ID NO: 1990453 - RNA, 13 nt, Homo sapiens
caucuagccagag

SEQ ID NO: 1990454 - RNA, 22 nt, Homo sapiens
caaauauuaucuuuguucuccu

SEQ ID NO: 1990455 - RNA, 21 nt, Homo sapiens
agcggacuggugaggagcaca

SEQ ID NO: 1990456 - RNA, 18 nt, Homo sapiens
agaggcugccccucucac

SEQ ID NO: 1990457 - RNA, 19 nt, Homo sapiens
cuaaccuggauaacuguaa

SEQ ID NO: 1990458 - RNA, 19 nt, Homo sapiens
uuugaauacaggcauagag

SEQ ID NO: 1990459 - RNA, 15 nt, Homo sapiens
cuaccuaccaagaua

SEQ ID NO: 1990460 - RNA, 15 nt, Homo sapiens
cacucuuuauagugc

SEQ ID NO: 1990461 - RNA, 20 nt, Homo sapiens
caaagcgagaucccaucucu

SEQ ID NO: 1990462 - RNA, 16 nt, Homo sapiens
ugcauagcuugcacaa

SEQ ID NO: 1990463 - RNA, 17 nt, Homo sapiens
aggagucugaugcucaa

SEQ ID NO: 1990464 - RNA, 21 nt, Homo sapiens
gucccuugcuguuuucaucuc

SEQ ID NO: 1990465 - RNA, 15 nt, Homo sapiens
agggaucacugccaa

SEQ ID NO: 1990466 - RNA, 18 nt, Homo sapiens
uaaaaugugucuugcugu

SEQ ID NO: 1990467 - RNA, 16 nt, Homo sapiens
caucaaaaaaggcagu

SEQ ID NO: 1990468 - RNA, 13 nt, Homo sapiens
aguugcaccauuc

SEQ ID NO: 1990469 - RNA, 15 nt, Homo sapiens
gaacaguccauugaa

SEQ ID NO: 1990470 - RNA, 22 nt, Homo sapiens
accucaaaauauuuuuuuuaac

SEQ ID NO: 1990471 - RNA, 12 nt, Homo sapiens
gaauaaugcugu

SEQ ID NO: 1990472 - RNA, 19 nt, Homo sapiens
gcuaggguggucagaggaa

SEQ ID NO: 1990473 - RNA, 13 nt, Homo sapiens
cauggaugcacac

SEQ ID NO: 1990474 - RNA, 17 nt, Homo sapiens
gcaaauggccaaugaga

SEQ ID NO: 1990475 - RNA, 14 nt, Homo sapiens
aaaucaguuucuca

SEQ ID NO: 1990476 - RNA, 22 nt, Homo sapiens
uguagaaaaacccaaacugaga

SEQ ID NO: 1990477 - RNA, 23 nt, Homo sapiens
acacccuauauuuugcauaguac

SEQ ID NO: 1990478 - RNA, 17 nt, Homo sapiens
agggggcugcucugcaa

SEQ ID NO: 1990479 - RNA, 19 nt, Homo sapiens
ucuuggaaaaaaaccacag

SEQ ID NO: 1990480 - RNA, 16 nt, Homo sapiens
aaaacccaaacuucca

SEQ ID NO: 1990481 - RNA, 13 nt, Homo sapiens
aagaacacccucu

SEQ ID NO: 1990482 - RNA, 22 nt, Homo sapiens
uuugcuacaaauagugcuaaua

SEQ ID NO: 1990483 - RNA, 13 nt, Homo sapiens
agacucaaacuca

SEQ ID NO: 1990484 - RNA, 23 nt, Homo sapiens
gaugggguaaucuauaacacauc

SEQ ID NO: 1990485 - RNA, 13 nt, Homo sapiens
agcaugcacaaag

SEQ ID NO: 1990486 - RNA, 21 nt, Homo sapiens
cuucaagacgacagcucugua

SEQ ID NO: 1990487 - RNA, 20 nt, Homo sapiens
cccugugccagaccucaaaa

SEQ ID NO: 1990488 - RNA, 20 nt, Homo sapiens
gcuuuccccauuccuaccca

SEQ ID NO: 1990489 - RNA, 18 nt, Homo sapiens
ucaucacaauuagggaau

SEQ ID NO: 1990490 - RNA, 21 nt, Homo sapiens
gagaucguaccuauugcacuc

SEQ ID NO: 1990491 - RNA, 15 nt, Homo sapiens
aaaucaauaaauucc

SEQ ID NO: 1990492 - RNA, 21 nt, Homo sapiens
agagaugggguuucaccauau

SEQ ID NO: 1990493 - RNA, 19 nt, Homo sapiens
caggacgauuucacugaca

SEQ ID NO: 1990494 - RNA, 15 nt, Homo sapiens
ugacaguaacaaaau

SEQ ID NO: 1990495 - RNA, 13 nt, Homo sapiens
ucuaccauuugaa

SEQ ID NO: 1990496 - RNA, 12 nt, Homo sapiens
accccaguuuuu

SEQ ID NO: 1990497 - RNA, 12 nt, Homo sapiens
aucucaguucuc

SEQ ID NO: 1990498 - RNA, 16 nt, Homo sapiens
augaaggugugcuaca

SEQ ID NO: 1990499 - RNA, 17 nt, Homo sapiens
cucucaggaucaaugac

SEQ ID NO: 1990500 - RNA, 16 nt, Homo sapiens
uacacguaaaugcaga

SEQ ID NO: 1990501 - RNA, 21 nt, Homo sapiens
cauacuuaucucucugugcug

SEQ ID NO: 1990502 - RNA, 12 nt, Homo sapiens
uuacugcuugac

SEQ ID NO: 1990503 - RNA, 19 nt, Homo sapiens
cuggccuccaggcccgucu

SEQ ID NO: 1990504 - RNA, 18 nt, Homo sapiens
cuagaaguuacugaaugc

SEQ ID NO: 1990505 - RNA, 21 nt, Homo sapiens
ucugccccagcuggagcauug

SEQ ID NO: 1990506 - RNA, 15 nt, Homo sapiens
aacaccucacuuuug

SEQ ID NO: 1990507 - RNA, 18 nt, Homo sapiens
acauaaugaaaauccaug

SEQ ID NO: 1990508 - RNA, 20 nt, Homo sapiens
aauagauuugggucauuuag

SEQ ID NO: 1990509 - RNA, 22 nt, Homo sapiens
ucugugucccacccaugcagac

SEQ ID NO: 1990510 - RNA, 13 nt, Homo sapiens
ugaugccaugaag

SEQ ID NO: 1990511 - RNA, 13 nt, Homo sapiens
uccuuccauccau

SEQ ID NO: 1990512 - RNA, 14 nt, Homo sapiens
cacuccagcuccuu

SEQ ID NO: 1990513 - RNA, 18 nt, Homo sapiens
auguuuauguacuguaaa

SEQ ID NO: 1990514 - RNA, 12 nt, Homo sapiens
acagcacuggcu

SEQ ID NO: 1990515 - RNA, 13 nt, Homo sapiens
aguaaacacaggg

SEQ ID NO: 1990516 - RNA, 13 nt, Homo sapiens
aagcuacuugaag

SEQ ID NO: 1990517 - RNA, 15 nt, Homo sapiens
agagcuuuuugcaug

SEQ ID NO: 1990518 - RNA, 21 nt, Homo sapiens
uaaucaagaaaaacaucuuug

SEQ ID NO: 1990519 - RNA, 15 nt, Homo sapiens
cauuaaucagauuag

SEQ ID NO: 1990520 - RNA, 17 nt, Homo sapiens
ucugaguuuacguggag

SEQ ID NO: 1990521 - RNA, 13 nt, Homo sapiens
cgccgugcuguaa

SEQ ID NO: 1990522 - RNA, 19 nt, Homo sapiens
auaauucuauacuguugau

SEQ ID NO: 1990523 - RNA, 18 nt, Homo sapiens
auauauaaagucagugac

SEQ ID NO: 1990524 - RNA, 14 nt, Homo sapiens
gaagguacaaacac

SEQ ID NO: 1990525 - RNA, 16 nt, Homo sapiens
uacuaguuagcauaca

SEQ ID NO: 1990526 - RNA, 13 nt, Homo sapiens
ucaaugugcagug

SEQ ID NO: 1990527 - RNA, 13 nt, Homo sapiens
gcccacaucccag

SEQ ID NO: 1990528 - RNA, 22 nt, Homo sapiens
cacucugguuguuuaugcaaga

SEQ ID NO: 1990529 - RNA, 19 nt, Homo sapiens
caggugcaacagacuugaa

SEQ ID NO: 1990530 - RNA, 14 nt, Homo sapiens
agguacaaguggcu

SEQ ID NO: 1990531 - RNA, 21 nt, Homo sapiens
ccucgcuuggacggcugggca

SEQ ID NO: 1990532 - RNA, 23 nt, Homo sapiens
aaaaugugccauuuugcauuuuc

SEQ ID NO: 1990533 - RNA, 13 nt, Homo sapiens
uaacuauguuuua

SEQ ID NO: 1990534 - RNA, 21 nt, Homo sapiens
guuucuuuuuucggcuaaaaa

SEQ ID NO: 1990535 - RNA, 14 nt, Homo sapiens
uugcuucaauuuca

SEQ ID NO: 1990536 - RNA, 21 nt, Homo sapiens
ucacccagacuggagugcagu

SEQ ID NO: 1990537 - RNA, 18 nt, Homo sapiens
gggagauggaucaaucaa

SEQ ID NO: 1990538 - RNA, 12 nt, Homo sapiens
acugcugugagc

SEQ ID NO: 1990539 - RNA, 12 nt, Homo sapiens
aaggcugugcuc

SEQ ID NO: 1990540 - RNA, 21 nt, Homo sapiens
cuacuccccuuaaucuaaucu

SEQ ID NO: 1990541 - RNA, 13 nt, Homo sapiens
ccugaaucuauca

SEQ ID NO: 1990542 - RNA, 12 nt, Homo sapiens
agucacacagug

SEQ ID NO: 1990543 - RNA, 12 nt, Homo sapiens
uggcacacuggg

SEQ ID NO: 1990544 - RNA, 19 nt, Homo sapiens
aagugcuucuccagccuca

SEQ ID NO: 1990545 - RNA, 15 nt, Homo sapiens
guugaggcugucaca

SEQ ID NO: 1990546 - RNA, 15 nt, Homo sapiens
caacuggaaacccuu

SEQ ID NO: 1990547 - RNA, 21 nt, Homo sapiens
uucuaaaucauaaucauccuu

SEQ ID NO: 1990548 - RNA, 19 nt, Homo sapiens
uuacagaagugaaagugag

SEQ ID NO: 1990549 - RNA, 19 nt, Homo sapiens
uaaaacaagcacuaaacaa

SEQ ID NO: 1990550 - RNA, 12 nt, Homo sapiens
agccugguggcc

SEQ ID NO: 1990551 - RNA, 12 nt, Homo sapiens
uuacacuuucuc

SEQ ID NO: 1990552 - RNA, 11 nt, Homo sapiens
acuaaucauga

SEQ ID NO: 1990553 - RNA, 18 nt, Homo sapiens
ugaaggcaaccuggaagg

SEQ ID NO: 1990554 - RNA, 18 nt, Homo sapiens
ccucuccacacagugcuc

SEQ ID NO: 1990555 - RNA, 14 nt, Homo sapiens
caucuauuuuacca

SEQ ID NO: 1990556 - RNA, 14 nt, Homo sapiens
caacuauuuuucca

SEQ ID NO: 1990557 - RNA, 21 nt, Homo sapiens
agcccaggagcuccccucccc

SEQ ID NO: 1990558 - RNA, 19 nt, Homo sapiens
accugugcucuaagugaau

SEQ ID NO: 1990559 - RNA, 17 nt, Homo sapiens
ccuguaaaggucaacaa

SEQ ID NO: 1990560 - RNA, 23 nt, Homo sapiens
accacuuuucaguucaguggcau

SEQ ID NO: 1990561 - RNA, 19 nt, Homo sapiens
ugacucagcuaaugucaca

SEQ ID NO: 1990562 - RNA, 12 nt, Homo sapiens
ucucaauucuuu

SEQ ID NO: 1990563 - RNA, 19 nt, Homo sapiens
agccaucaccuaggacuga

SEQ ID NO: 1990564 - RNA, 20 nt, Homo sapiens
cacaaaugguagcauacuuu

SEQ ID NO: 1990565 - RNA, 19 nt, Homo sapiens
ucccagcccuauggaugug

SEQ ID NO: 1990566 - RNA, 17 nt, Homo sapiens
augacccacccaguguc

SEQ ID NO: 1990567 - RNA, 17 nt, Homo sapiens
agcucuauuaugaaugu

SEQ ID NO: 1990568 - RNA, 17 nt, Homo sapiens
agcccaggacacugccu

SEQ ID NO: 1990569 - RNA, 22 nt, Homo sapiens
uaccuggcuacaauuacuuuga

SEQ ID NO: 1990570 - RNA, 20 nt, Homo sapiens
ccuguaaagucugaguaaga

SEQ ID NO: 1990571 - RNA, 11 nt, Homo sapiens
uaaaguucuag

SEQ ID NO: 1990572 - RNA, 21 nt, Homo sapiens
ugguggcaucacagaccccag

SEQ ID NO: 1990573 - RNA, 23 nt, Homo sapiens
aagauaucagcauauggcacuaa

SEQ ID NO: 1990574 - RNA, 21 nt, Homo sapiens
cuuggggggugaugagggcag

SEQ ID NO: 1990575 - RNA, 14 nt, Homo sapiens
aaagaagaguuuac

SEQ ID NO: 1990576 - RNA, 20 nt, Homo sapiens
guacuuagaaauacacguau

SEQ ID NO: 1990577 - RNA, 18 nt, Homo sapiens
uucacuguaagacucauu

SEQ ID NO: 1990578 - RNA, 17 nt, Homo sapiens
ugcuugucccuguggaa

SEQ ID NO: 1990579 - RNA, 15 nt, Homo sapiens
ccuggccucaucuca

SEQ ID NO: 1990580 - RNA, 15 nt, Homo sapiens
ucauaccuaaguacu

SEQ ID NO: 1990581 - RNA, 17 nt, Homo sapiens
uauuauaacucauuugu

SEQ ID NO: 1990582 - RNA, 15 nt, Homo sapiens
uuacuaauugucuac

SEQ ID NO: 1990583 - RNA, 22 nt, Homo sapiens
aucugucccccuuuagaucucu

SEQ ID NO: 1990584 - RNA, 14 nt, Homo sapiens
cauccguaucuuuu

SEQ ID NO: 1990585 - RNA, 15 nt, Homo sapiens
caggccacauggcua

SEQ ID NO: 1990586 - RNA, 12 nt, Homo sapiens
gcguccugguca

SEQ ID NO: 1990587 - RNA, 23 nt, Homo sapiens
auaauaacaacaacuuaaugugc

SEQ ID NO: 1990588 - RNA, 20 nt, Homo sapiens
gacaucuggggcuuugaccc

SEQ ID NO: 1990589 - RNA, 20 nt, Homo sapiens
auucuggcuagugucuauca

SEQ ID NO: 1990590 - RNA, 17 nt, Homo sapiens
gcuuggaaauuccuugc

SEQ ID NO: 1990591 - RNA, 17 nt, Homo sapiens
caccuucaccuucaucc

SEQ ID NO: 1990592 - RNA, 22 nt, Homo sapiens
guaugagacagaaacuaauccu

SEQ ID NO: 1990593 - RNA, 19 nt, Homo sapiens
caagcacagugccugcaug

SEQ ID NO: 1990594 - RNA, 17 nt, Homo sapiens
ucucccaggccucugcc

SEQ ID NO: 1990595 - RNA, 18 nt, Homo sapiens
gggccuuucuguguccua

SEQ ID NO: 1990596 - RNA, 21 nt, Homo sapiens
ucuagugaaugaaucucaaga

SEQ ID NO: 1990597 - RNA, 24 nt, Homo sapiens
ucuuaauauaaauucacuuucauu

SEQ ID NO: 1990598 - RNA, 19 nt, Homo sapiens
ugaaguccuggcuucaggc

SEQ ID NO: 1990599 - RNA, 13 nt, Homo sapiens
aaucucacuacac

SEQ ID NO: 1990600 - RNA, 15 nt, Homo sapiens
ugggcaccagcucau

SEQ ID NO: 1990601 - RNA, 13 nt, Homo sapiens
gcuaacacacagc

SEQ ID NO: 1990602 - RNA, 22 nt, Homo sapiens
ggcacccgcccagccgggcugg

SEQ ID NO: 1990603 - RNA, 14 nt, Homo sapiens
gaaugcacagugaa

SEQ ID NO: 1990604 - RNA, 15 nt, Homo sapiens
cguagacagguguua

SEQ ID NO: 1990605 - RNA, 21 nt, Homo sapiens
cacagauuuuugguaguuucu

SEQ ID NO: 1990606 - RNA, 19 nt, Homo sapiens
caucuauuuggaacccaag

SEQ ID NO: 1990607 - RNA, 14 nt, Homo sapiens
cuguaaucaggcaa

SEQ ID NO: 1990608 - RNA, 21 nt, Homo sapiens
gaagggcuuggccagcgcugu

SEQ ID NO: 1990609 - RNA, 18 nt, Homo sapiens
ccuaucauagauuuacaa

SEQ ID NO: 1990610 - RNA, 18 nt, Homo sapiens
ugccuuuuccuauguaaa

SEQ ID NO: 1990611 - RNA, 22 nt, Homo sapiens
acuauaaaaaagaaagaauuaa

SEQ ID NO: 1990612 - RNA, 14 nt, Homo sapiens
ccauaugugggugu

SEQ ID NO: 1990613 - RNA, 16 nt, Homo sapiens
ucuguauucauacagc

SEQ ID NO: 1990614 - RNA, 22 nt, Homo sapiens
ggaaacacagucacuugggagc

SEQ ID NO: 1990615 - RNA, 20 nt, Homo sapiens
uauuaaggccuuuuccacac

SEQ ID NO: 1990616 - RNA, 20 nt, Homo sapiens
ccacagugacuccacucuga

SEQ ID NO: 1990617 - RNA, 18 nt, Homo sapiens
acaggcacacaggucuca

SEQ ID NO: 1990618 - RNA, 22 nt, Homo sapiens
uucucuaaaauaacuaguacaa

SEQ ID NO: 1990619 - RNA, 12 nt, Homo sapiens
cuccucuucaaa

SEQ ID NO: 1990620 - RNA, 18 nt, Homo sapiens
guaaucccaacuacucag

SEQ ID NO: 1990621 - RNA, 17 nt, Homo sapiens
ccuagaugccaaagggg

SEQ ID NO: 1990622 - RNA, 18 nt, Homo sapiens
aaugucagugugacugau

SEQ ID NO: 1990623 - RNA, 14 nt, Homo sapiens
auaauauacuaugc

SEQ ID NO: 1990624 - RNA, 13 nt, Homo sapiens
ccccagagcauuu

SEQ ID NO: 1990625 - RNA, 17 nt, Homo sapiens
uucaucuacuacagggu

SEQ ID NO: 1990626 - RNA, 22 nt, Homo sapiens
aaauuacacaguuaaugccaca

SEQ ID NO: 1990627 - RNA, 15 nt, Homo sapiens
ucccaaucuuucuau

SEQ ID NO: 1990628 - RNA, 17 nt, Homo sapiens
aucccagcuacucgaga

SEQ ID NO: 1990629 - RNA, 21 nt, Homo sapiens
auuuaguagaaaggucaucca

SEQ ID NO: 1990630 - RNA, 13 nt, Homo sapiens
caccaagccucug

SEQ ID NO: 1990631 - RNA, 17 nt, Homo sapiens
agacuucugcuuuccac

SEQ ID NO: 1990632 - RNA, 17 nt, Homo sapiens
acuggggcaagcuccuc

SEQ ID NO: 1990633 - RNA, 15 nt, Homo sapiens
acccuugaaaauaua

SEQ ID NO: 1990634 - RNA, 15 nt, Homo sapiens
aaccauaaacauuug

SEQ ID NO: 1990635 - RNA, 23 nt, Homo sapiens
acacucaaaacgcuacugaguca

SEQ ID NO: 1990636 - RNA, 15 nt, Homo sapiens
aaugcuauuugugua

SEQ ID NO: 1990637 - RNA, 17 nt, Homo sapiens
uacugggugucauuuca

SEQ ID NO: 1990638 - RNA, 14 nt, Homo sapiens
uaguuguacuauga

SEQ ID NO: 1990639 - RNA, 19 nt, Homo sapiens
cuccucagagcgccaggaa

SEQ ID NO: 1990640 - RNA, 22 nt, Homo sapiens
aauagacuaucuagaacuugag

SEQ ID NO: 1990641 - RNA, 20 nt, Homo sapiens
gugagacuguggcucaaaaa

SEQ ID NO: 1990642 - RNA, 17 nt, Homo sapiens
acaacucguguucacuc

SEQ ID NO: 1990643 - RNA, 18 nt, Homo sapiens
uguugauaauuucaggga

SEQ ID NO: 1990644 - RNA, 23 nt, Homo sapiens
cucucuuuugguuugugggucca

SEQ ID NO: 1990645 - RNA, 12 nt, Homo sapiens
uaaaaugcauaa

SEQ ID NO: 1990646 - RNA, 20 nt, Homo sapiens
aguaagaaaacaucacugaa

SEQ ID NO: 1990647 - RNA, 23 nt, Homo sapiens
ucaaugccucacgagauuugcca

SEQ ID NO: 1990648 - RNA, 17 nt, Homo sapiens
aauuguuagcuauuuau

SEQ ID NO: 1990649 - RNA, 13 nt, Homo sapiens
aauaguauuccaa

SEQ ID NO: 1990650 - RNA, 19 nt, Homo sapiens
uguaaaaaaaccaccaaaa

SEQ ID NO: 1990651 - RNA, 12 nt, Homo sapiens
auucaucucugg

SEQ ID NO: 1990652 - RNA, 20 nt, Homo sapiens
uaagauuuucugggauaaca

SEQ ID NO: 1990653 - RNA, 17 nt, Homo sapiens
acagagcugaagaacuu

SEQ ID NO: 1990654 - RNA, 21 nt, Homo sapiens
uauaguuuauugacaauaauu

SEQ ID NO: 1990655 - RNA, 11 nt, Homo sapiens
ucucucugauc

SEQ ID NO: 1990656 - RNA, 11 nt, Homo sapiens
gaguggcugca

SEQ ID NO: 1990657 - RNA, 12 nt, Homo sapiens
uggacuggccau

SEQ ID NO: 1990658 - RNA, 20 nt, Homo sapiens
gaucacuuguccucuugcca

SEQ ID NO: 1990659 - RNA, 13 nt, Homo sapiens
uccagcagcugcc

SEQ ID NO: 1990660 - RNA, 17 nt, Homo sapiens
gugggccguguggcaca

SEQ ID NO: 1990661 - RNA, 21 nt, Homo sapiens
ccuucacuuuucugaguucuu

SEQ ID NO: 1990662 - RNA, 14 nt, Homo sapiens
gguucccccaggac

SEQ ID NO: 1990663 - RNA, 13 nt, Homo sapiens
agucagcagucau

SEQ ID NO: 1990664 - RNA, 18 nt, Homo sapiens
aacgagccuggaagcacu

SEQ ID NO: 1990665 - RNA, 17 nt, Homo sapiens
ucauguguggaaauggg

SEQ ID NO: 1990666 - RNA, 18 nt, Homo sapiens
cugcauguuccuggacac

SEQ ID NO: 1990667 - RNA, 15 nt, Homo sapiens
gcaugugugauuuca

SEQ ID NO: 1990668 - RNA, 19 nt, Homo sapiens
accuuuauagcucaucacu

SEQ ID NO: 1990669 - RNA, 20 nt, Homo sapiens
gcugagguuuagaugugcaa

SEQ ID NO: 1990670 - RNA, 18 nt, Homo sapiens
caaagaaugggcuugaaa

SEQ ID NO: 1990671 - RNA, 11 nt, Homo sapiens
uccuggaccaa

SEQ ID NO: 1990672 - RNA, 14 nt, Homo sapiens
gaucaggaauucua

SEQ ID NO: 1990673 - RNA, 20 nt, Homo sapiens
ucuugucauuauucucugaa

SEQ ID NO: 1990674 - RNA, 17 nt, Homo sapiens
uugacuugaaaugcucu

SEQ ID NO: 1990675 - RNA, 23 nt, Homo sapiens
gccugaugauggaagggccuucu

SEQ ID NO: 1990676 - RNA, 19 nt, Homo sapiens
auacauaacuaaauuugau

SEQ ID NO: 1990677 - RNA, 15 nt, Homo sapiens
aauauuccuuugcau

SEQ ID NO: 1990678 - RNA, 11 nt, Homo sapiens
cugggugaccc

SEQ ID NO: 1990679 - RNA, 18 nt, Homo sapiens
gcuacaggagcauaccac

SEQ ID NO: 1990680 - RNA, 15 nt, Homo sapiens
aaauacuucuugaag

SEQ ID NO: 1990681 - RNA, 23 nt, Homo sapiens
gagggauaagccagcugcagcug

SEQ ID NO: 1990682 - RNA, 16 nt, Homo sapiens
agcacacuuuacacaa

SEQ ID NO: 1990683 - RNA, 20 nt, Homo sapiens
aaguauauaaugcuugcacc

SEQ ID NO: 1990684 - RNA, 22 nt, Homo sapiens
acuggauccaaacccaucuucc

SEQ ID NO: 1990685 - RNA, 14 nt, Homo sapiens
gagccauauaggca

SEQ ID NO: 1990686 - RNA, 14 nt, Homo sapiens
cagcuucucuacag

SEQ ID NO: 1990687 - RNA, 21 nt, Homo sapiens
cuguggguuugguccuugaac

SEQ ID NO: 1990688 - RNA, 15 nt, Homo sapiens
acccagcaacuccaa

SEQ ID NO: 1990689 - RNA, 12 nt, Homo sapiens
gcuuaugucaua

SEQ ID NO: 1990690 - RNA, 13 nt, Homo sapiens
caaaagcaugaaa

SEQ ID NO: 1990691 - RNA, 14 nt, Homo sapiens
gaccccugccaguu

SEQ ID NO: 1990692 - RNA, 18 nt, Homo sapiens
gcacgguggcucaggccu

SEQ ID NO: 1990693 - RNA, 21 nt, Homo sapiens
gaacuaaagugcugcacucaa

SEQ ID NO: 1990694 - RNA, 22 nt, Homo sapiens
agcacaauccuauuacucuucc

SEQ ID NO: 1990695 - RNA, 16 nt, Homo sapiens
gauuucuguuguuauu

SEQ ID NO: 1990696 - RNA, 23 nt, Homo sapiens
aguguuugcccuuuggccaguga

SEQ ID NO: 1990697 - RNA, 12 nt, Homo sapiens
ugucugcaaugg

SEQ ID NO: 1990698 - RNA, 22 nt, Homo sapiens
aauuuggguugacuccugagca

SEQ ID NO: 1990699 - RNA, 15 nt, Homo sapiens
aaaauacugccagau

SEQ ID NO: 1990700 - RNA, 18 nt, Homo sapiens
auaagguuaagauaucau

SEQ ID NO: 1990701 - RNA, 10 nt, Homo sapiens
gacuggccag

SEQ ID NO: 1990702 - RNA, 13 nt, Homo sapiens
cgaguaucuguaa

SEQ ID NO: 1990703 - RNA, 16 nt, Homo sapiens
cccacacacacuauaa

SEQ ID NO: 1990704 - RNA, 16 nt, Homo sapiens
ugaugccaggugcaau

SEQ ID NO: 1990705 - RNA, 14 nt, Homo sapiens
aauauagccugccu

SEQ ID NO: 1990706 - RNA, 20 nt, Homo sapiens
cacuugaugggccacacaag

SEQ ID NO: 1990707 - RNA, 19 nt, Homo sapiens
acagcggcuccacuaaaga

SEQ ID NO: 1990708 - RNA, 13 nt, Homo sapiens
uuuguuuaguacu

SEQ ID NO: 1990709 - RNA, 21 nt, Homo sapiens
aucucgcacuacaucugauau

SEQ ID NO: 1990710 - RNA, 21 nt, Homo sapiens
uaacagcaauuguucagggaa

SEQ ID NO: 1990711 - RNA, 20 nt, Homo sapiens
cuuugcuccagauaacucuc

SEQ ID NO: 1990712 - RNA, 14 nt, Homo sapiens
caauauaaucugaa

SEQ ID NO: 1990713 - RNA, 15 nt, Homo sapiens
caugcccacagauca

SEQ ID NO: 1990714 - RNA, 16 nt, Homo sapiens
augauagaacuguacu

SEQ ID NO: 1990715 - RNA, 13 nt, Homo sapiens
aucauuccccgac

SEQ ID NO: 1990716 - RNA, 13 nt, Homo sapiens
uauaaauaucaca

SEQ ID NO: 1990717 - RNA, 17 nt, Homo sapiens
uccugggcagcugccuc

SEQ ID NO: 1990718 - RNA, 18 nt, Homo sapiens
auaugguugauaguuuac

SEQ ID NO: 1990719 - RNA, 16 nt, Homo sapiens
ucugcuuucuguucau

SEQ ID NO: 1990720 - RNA, 20 nt, Homo sapiens
aucucuguuauguacuguac

SEQ ID NO: 1990721 - RNA, 16 nt, Homo sapiens
ucuguguuuaauauua

SEQ ID NO: 1990722 - RNA, 21 nt, Homo sapiens
cugaugauaauuuaucuacau

SEQ ID NO: 1990723 - RNA, 22 nt, Homo sapiens
ccucucacacucaggccagacu

SEQ ID NO: 1990724 - RNA, 16 nt, Homo sapiens
gauagaauuauuucac

SEQ ID NO: 1990725 - RNA, 21 nt, Homo sapiens
uaaaagaauaaaauugcacuu

SEQ ID NO: 1990726 - RNA, 13 nt, Homo sapiens
gccacacccaggu

SEQ ID NO: 1990727 - RNA, 17 nt, Homo sapiens
cgggucucaacuuuaag

SEQ ID NO: 1990728 - RNA, 12 nt, Homo sapiens
uuccuaugcaaa

SEQ ID NO: 1990729 - RNA, 16 nt, Homo sapiens
agcagauccaccugca

SEQ ID NO: 1990730 - RNA, 20 nt, Homo sapiens
aacucucugguuuacuucaa

SEQ ID NO: 1990731 - RNA, 14 nt, Homo sapiens
aucucuuuucccac

SEQ ID NO: 1990732 - RNA, 21 nt, Homo sapiens
agagagccuagaacaucccug

SEQ ID NO: 1990733 - RNA, 13 nt, Homo sapiens
aaguccuuuguga

SEQ ID NO: 1990734 - RNA, 13 nt, Homo sapiens
gccaaaaagugaa

SEQ ID NO: 1990735 - RNA, 17 nt, Homo sapiens
ccuccccagacucucag

SEQ ID NO: 1990736 - RNA, 17 nt, Homo sapiens
uauuaaagaacgcugca

SEQ ID NO: 1990737 - RNA, 22 nt, Homo sapiens
cccagacaauggcccaggucuc

SEQ ID NO: 1990738 - RNA, 16 nt, Homo sapiens
uacugauaauuuugcu

SEQ ID NO: 1990739 - RNA, 15 nt, Homo sapiens
caguaaaaacuugua

SEQ ID NO: 1990740 - RNA, 13 nt, Homo sapiens
gcacccucaggga

SEQ ID NO: 1990741 - RNA, 22 nt, Homo sapiens
cauguuauguuucuacacauug

SEQ ID NO: 1990742 - RNA, 13 nt, Homo sapiens
aaaacaagcugau

SEQ ID NO: 1990743 - RNA, 14 nt, Homo sapiens
aagggcagcauaua

SEQ ID NO: 1990744 - RNA, 14 nt, Homo sapiens
acucccccacccau

SEQ ID NO: 1990745 - RNA, 19 nt, Homo sapiens
aacaguggaaacuaugugu

SEQ ID NO: 1990746 - RNA, 19 nt, Homo sapiens
ucugcccugagcccuccac

SEQ ID NO: 1990747 - RNA, 19 nt, Homo sapiens
guggacugcagucggcaug

SEQ ID NO: 1990748 - RNA, 15 nt, Homo sapiens
cugcuggaggguaau

SEQ ID NO: 1990749 - RNA, 16 nt, Homo sapiens
ggugcaguaaccauuu

SEQ ID NO: 1990750 - RNA, 21 nt, Homo sapiens
acucugggguuuuuacuguua

SEQ ID NO: 1990751 - RNA, 22 nt, Homo sapiens
cacacagauuuuuauguuuucu

SEQ ID NO: 1990752 - RNA, 22 nt, Homo sapiens
gaagccuguccucaccgucucg

SEQ ID NO: 1990753 - RNA, 21 nt, Homo sapiens
ucaaauagagcuguucaacau

SEQ ID NO: 1990754 - RNA, 18 nt, Homo sapiens
agacuguuccuguuugcu

SEQ ID NO: 1990755 - RNA, 16 nt, Homo sapiens
gacuugaaauacuacu

SEQ ID NO: 1990756 - RNA, 22 nt, Homo sapiens
uguaaauaucccagagaacaau

SEQ ID NO: 1990757 - RNA, 20 nt, Homo sapiens
uuguuuccccacaaaacaaa

SEQ ID NO: 1990758 - RNA, 15 nt, Homo sapiens
guugacaacugugac

SEQ ID NO: 1990759 - RNA, 19 nt, Homo sapiens
accagguuugcaccuaagu

SEQ ID NO: 1990760 - RNA, 15 nt, Homo sapiens
cucaagaaaucaaaa

SEQ ID NO: 1990761 - RNA, 15 nt, Homo sapiens
gcccgcagcccagac

SEQ ID NO: 1990762 - RNA, 14 nt, Homo sapiens
auaucaugcuccau

SEQ ID NO: 1990763 - RNA, 23 nt, Homo sapiens
augcuguucucuucuucauucua

SEQ ID NO: 1990764 - RNA, 16 nt, Homo sapiens
auccacggagcugaag

SEQ ID NO: 1990765 - RNA, 12 nt, Homo sapiens
augaaaaccuga

SEQ ID NO: 1990766 - RNA, 12 nt, Homo sapiens
acagaaacccag

SEQ ID NO: 1990767 - RNA, 12 nt, Homo sapiens
auacaaaccuac

SEQ ID NO: 1990768 - RNA, 16 nt, Homo sapiens
uuggcucacacugaga

SEQ ID NO: 1990769 - RNA, 15 nt, Homo sapiens
ucucgggcacaggcc

SEQ ID NO: 1990770 - RNA, 15 nt, Homo sapiens
guauuggaaauggau

SEQ ID NO: 1990771 - RNA, 18 nt, Homo sapiens
uuguauuuagugacaaaa

SEQ ID NO: 1990772 - RNA, 20 nt, Homo sapiens
uaaauuucaguaguggugau

SEQ ID NO: 1990773 - RNA, 21 nt, Homo sapiens
ucuugcaauucaauacagauc

SEQ ID NO: 1990774 - RNA, 20 nt, Homo sapiens
cauguaucuuuugaacuggc

SEQ ID NO: 1990775 - RNA, 17 nt, Homo sapiens
cuacucgaguuacagac

SEQ ID NO: 1990776 - RNA, 16 nt, Homo sapiens
aucuucacauucugaa

SEQ ID NO: 1990777 - RNA, 14 nt, Homo sapiens
ccaacucauccacg

SEQ ID NO: 1990778 - RNA, 23 nt, Homo sapiens
acuucaugcaggugaaacccagu

SEQ ID NO: 1990779 - RNA, 16 nt, Homo sapiens
uaguucugacuuugaa

SEQ ID NO: 1990780 - RNA, 16 nt, Homo sapiens
aaguuucacugacuua

SEQ ID NO: 1990781 - RNA, 17 nt, Homo sapiens
cuugaacaaagucucug

SEQ ID NO: 1990782 - RNA, 17 nt, Homo sapiens
caguauauguugcaaaa

SEQ ID NO: 1990783 - RNA, 17 nt, Homo sapiens
acaaagcacaguuugaa

SEQ ID NO: 1990784 - RNA, 20 nt, Homo sapiens
augcagugcugcuuugccaa

SEQ ID NO: 1990785 - RNA, 16 nt, Homo sapiens
ucaucucaagcuugcu

SEQ ID NO: 1990786 - RNA, 23 nt, Homo sapiens
cucaauuuugucuguacucaugu

SEQ ID NO: 1990787 - RNA, 19 nt, Homo sapiens
ggugggauccacacugaga

SEQ ID NO: 1990788 - RNA, 20 nt, Homo sapiens
caaaagcucagggcccugug

SEQ ID NO: 1990789 - RNA, 20 nt, Homo sapiens
uccaaggaaacuuugccaaa

SEQ ID NO: 1990790 - RNA, 15 nt, Homo sapiens
aacccauacaaugua

SEQ ID NO: 1990791 - RNA, 15 nt, Homo sapiens
cuuugcacauuuuga

SEQ ID NO: 1990792 - RNA, 11 nt, Homo sapiens
gggaagacagu

SEQ ID NO: 1990793 - RNA, 17 nt, Homo sapiens
gugaaguuuugcaaaua

SEQ ID NO: 1990794 - RNA, 22 nt, Homo sapiens
aaaggcauccauagugcacuag

SEQ ID NO: 1990795 - RNA, 21 nt, Homo sapiens
aacaaagagagcucaucauca

SEQ ID NO: 1990796 - RNA, 22 nt, Homo sapiens
ggaugcacagcucaaguauuua

SEQ ID NO: 1990797 - RNA, 22 nt, Homo sapiens
uccccuuuuauuaauacauuca

SEQ ID NO: 1990798 - RNA, 16 nt, Homo sapiens
caauaaaacaaucucu

SEQ ID NO: 1990799 - RNA, 20 nt, Homo sapiens
ucagcaguucagcuccuucc

SEQ ID NO: 1990800 - RNA, 19 nt, Homo sapiens
uuuaauguaauagggaaaa

SEQ ID NO: 1990801 - RNA, 19 nt, Homo sapiens
ggcuaaccuguuacacugg

SEQ ID NO: 1990802 - RNA, 14 nt, Homo sapiens
uauuauugugacaa

SEQ ID NO: 1990803 - RNA, 16 nt, Homo sapiens
ccaggccaagacucaa

SEQ ID NO: 1990804 - RNA, 18 nt, Homo sapiens
gccaggagaccugcucuc

SEQ ID NO: 1990805 - RNA, 21 nt, Homo sapiens
uccaccucugauuacauguau

SEQ ID NO: 1990806 - RNA, 22 nt, Homo sapiens
auaguauuuaacgaagccuaga

SEQ ID NO: 1990807 - RNA, 17 nt, Homo sapiens
cucccuugcccuagaua

SEQ ID NO: 1990808 - RNA, 17 nt, Homo sapiens
uuuccgucuuuguauca

SEQ ID NO: 1990809 - RNA, 23 nt, Homo sapiens
cacaaggggaaggguacugaaaa

SEQ ID NO: 1990810 - RNA, 12 nt, Homo sapiens
agcauacagagu

SEQ ID NO: 1990811 - RNA, 17 nt, Homo sapiens
agaaauagaacacugcc

SEQ ID NO: 1990812 - RNA, 15 nt, Homo sapiens
ugcucauaugaugua

SEQ ID NO: 1990813 - RNA, 15 nt, Homo sapiens
aacuguaaaaaucau

SEQ ID NO: 1990814 - RNA, 15 nt, Homo sapiens
aguggcuggucucac

SEQ ID NO: 1990815 - RNA, 19 nt, Homo sapiens
ugcccucucccauggugcc

SEQ ID NO: 1990816 - RNA, 18 nt, Homo sapiens
auuguggauuaaugucaa

SEQ ID NO: 1990817 - RNA, 20 nt, Homo sapiens
uaugucaauuuguauaucau

SEQ ID NO: 1990818 - RNA, 16 nt, Homo sapiens
cuucaauguaguuuuc

SEQ ID NO: 1990819 - RNA, 22 nt, Homo sapiens
gcuaccaaguuucauaccaaau

SEQ ID NO: 1990820 - RNA, 13 nt, Homo sapiens
uggcuccuaucug

SEQ ID NO: 1990821 - RNA, 17 nt, Homo sapiens
cggcaggcccugcagug

SEQ ID NO: 1990822 - RNA, 21 nt, Homo sapiens
augacuauucaguggcuaacu

SEQ ID NO: 1990823 - RNA, 14 nt, Homo sapiens
uugucuuguucacc

SEQ ID NO: 1990824 - RNA, 21 nt, Homo sapiens
agccuggauccucaguucuca

SEQ ID NO: 1990825 - RNA, 23 nt, Homo sapiens
cauagaaaaauucagcaaaccau

SEQ ID NO: 1990826 - RNA, 20 nt, Homo sapiens
gaacguuuuuccuguucuua

SEQ ID NO: 1990827 - RNA, 13 nt, Homo sapiens
ucaugcugucagu

SEQ ID NO: 1990828 - RNA, 11 nt, Homo sapiens
aaccuuucaaa

SEQ ID NO: 1990829 - RNA, 14 nt, Homo sapiens
gugcccaaccucac

SEQ ID NO: 1990830 - RNA, 16 nt, Homo sapiens
aauccaauaucauguc

SEQ ID NO: 1990831 - RNA, 19 nt, Homo sapiens
auuacagaaacugaugcca

SEQ ID NO: 1990832 - RNA, 14 nt, Homo sapiens
ccugagauccugca

SEQ ID NO: 1990833 - RNA, 22 nt, Homo sapiens
agaagggcucagagaggacaaa

SEQ ID NO: 1990834 - RNA, 18 nt, Homo sapiens
agccaggaguaagacaag

SEQ ID NO: 1990835 - RNA, 14 nt, Homo sapiens
ucuaccugcuggac

SEQ ID NO: 1990836 - RNA, 21 nt, Homo sapiens
gaagaucuuugugaggugagc

SEQ ID NO: 1990837 - RNA, 20 nt, Homo sapiens
agccccaucuaccacaucuu

SEQ ID NO: 1990838 - RNA, 20 nt, Homo sapiens
uuuaaaagcaaaacugcaaa

SEQ ID NO: 1990839 - RNA, 17 nt, Homo sapiens
aauacaaucagcccagu

SEQ ID NO: 1990840 - RNA, 20 nt, Homo sapiens
ggccuccccagccaggcugc

SEQ ID NO: 1990841 - RNA, 14 nt, Homo sapiens
aaucuuaguguuca

SEQ ID NO: 1990842 - RNA, 14 nt, Homo sapiens
aggaggggagcaag

SEQ ID NO: 1990843 - RNA, 13 nt, Homo sapiens
gccauuggccuua

SEQ ID NO: 1990844 - RNA, 24 nt, Homo sapiens
caggcuggagugcagugaugcaau

SEQ ID NO: 1990845 - RNA, 14 nt, Homo sapiens
ugcugccauccuca

SEQ ID NO: 1990846 - RNA, 19 nt, Homo sapiens
acuuuguauuaauguguua

SEQ ID NO: 1990847 - RNA, 15 nt, Homo sapiens
ggacugugaggccau

SEQ ID NO: 1990848 - RNA, 16 nt, Homo sapiens
cauuacaauugcaguu

SEQ ID NO: 1990849 - RNA, 18 nt, Homo sapiens
aucuuugauucuccuuca

SEQ ID NO: 1990850 - RNA, 13 nt, Homo sapiens
aguuuagugcauc

SEQ ID NO: 1990851 - RNA, 13 nt, Homo sapiens
ucugaaccauuac

SEQ ID NO: 1990852 - RNA, 17 nt, Homo sapiens
gugauuuucauugcugg

SEQ ID NO: 1990853 - RNA, 18 nt, Homo sapiens
cauagcugucacaguaua

SEQ ID NO: 1990854 - RNA, 11 nt, Homo sapiens
gccauagcaac

SEQ ID NO: 1990855 - RNA, 20 nt, Homo sapiens
uuuaacaagugacaggguug

SEQ ID NO: 1990856 - RNA, 18 nt, Homo sapiens
aggaucaagucacucauc

SEQ ID NO: 1990857 - RNA, 17 nt, Homo sapiens
auaucucaccacaguga

SEQ ID NO: 1990858 - RNA, 22 nt, Homo sapiens
acugcacaugauuucacaaaua

SEQ ID NO: 1990859 - RNA, 16 nt, Homo sapiens
uucucucucucuuuga

SEQ ID NO: 1990860 - RNA, 16 nt, Homo sapiens
ccuggaaugggucucu

SEQ ID NO: 1990861 - RNA, 14 nt, Homo sapiens
cauauucucauggc

SEQ ID NO: 1990862 - RNA, 20 nt, Homo sapiens
aguauuuacaguauugagcu

SEQ ID NO: 1990863 - RNA, 13 nt, Homo sapiens
aaagguccuguaa

SEQ ID NO: 1990864 - RNA, 16 nt, Homo sapiens
ccagucucuccagcau

SEQ ID NO: 1990865 - RNA, 22 nt, Homo sapiens
acucagccuuaagaaagcuaua

SEQ ID NO: 1990866 - RNA, 19 nt, Homo sapiens
ccccaaaucuacugagcca

SEQ ID NO: 1990867 - RNA, 19 nt, Homo sapiens
aaggucaaacuaauucuca

SEQ ID NO: 1990868 - RNA, 14 nt, Homo sapiens
agugcacuacugua

SEQ ID NO: 1990869 - RNA, 22 nt, Homo sapiens
gaauucuagaggauguaucuca

SEQ ID NO: 1990870 - RNA, 20 nt, Homo sapiens
uggcgaccgggcaagcuuuc

SEQ ID NO: 1990871 - RNA, 14 nt, Homo sapiens
uaaacccuuaccaa

SEQ ID NO: 1990872 - RNA, 16 nt, Homo sapiens
uuugaggggcugacuu

SEQ ID NO: 1990873 - RNA, 22 nt, Homo sapiens
ugauuagagggaugagacagac

SEQ ID NO: 1990874 - RNA, 17 nt, Homo sapiens
acaaauggacuauacau

SEQ ID NO: 1990875 - RNA, 14 nt, Homo sapiens
uaaaacaaguacau

SEQ ID NO: 1990876 - RNA, 17 nt, Homo sapiens
gaugcacuuauucaaua

SEQ ID NO: 1990877 - RNA, 23 nt, Homo sapiens
ccucucugagucaaauccagugg

SEQ ID NO: 1990878 - RNA, 21 nt, Homo sapiens
gggcaaagccccucacacugc

SEQ ID NO: 1990879 - RNA, 20 nt, Homo sapiens
gacaacauuuuucauagaua

SEQ ID NO: 1990880 - RNA, 18 nt, Homo sapiens
ugggagagcaacaaguag

SEQ ID NO: 1990881 - RNA, 21 nt, Homo sapiens
cagaugguagacgagcugucu

SEQ ID NO: 1990882 - RNA, 16 nt, Homo sapiens
agcaaauguugggaaa

SEQ ID NO: 1990883 - RNA, 12 nt, Homo sapiens
aggaagcucagg

SEQ ID NO: 1990884 - RNA, 14 nt, Homo sapiens
ggauccugcacucu

SEQ ID NO: 1990885 - RNA, 13 nt, Homo sapiens
gccaggcacuuug

SEQ ID NO: 1990886 - RNA, 12 nt, Homo sapiens
uaagcugugauu

SEQ ID NO: 1990887 - RNA, 20 nt, Homo sapiens
gucacccugugggugucucc

SEQ ID NO: 1990888 - RNA, 17 nt, Homo sapiens
acuccccgggccucggg

SEQ ID NO: 1990889 - RNA, 18 nt, Homo sapiens
ugaagguuuauacuaauu

SEQ ID NO: 1990890 - RNA, 12 nt, Homo sapiens
ccccgacuuccu

SEQ ID NO: 1990891 - RNA, 20 nt, Homo sapiens
aggacuccagaugaggacaa

SEQ ID NO: 1990892 - RNA, 20 nt, Homo sapiens
agagguuucagcauucccaa

SEQ ID NO: 1990893 - RNA, 14 nt, Homo sapiens
aauuucacagauaa

SEQ ID NO: 1990894 - RNA, 15 nt, Homo sapiens
augucacagauuccu

SEQ ID NO: 1990895 - RNA, 16 nt, Homo sapiens
uggaaauuauguggaa

SEQ ID NO: 1990896 - RNA, 15 nt, Homo sapiens
uugguugcauccagg

SEQ ID NO: 1990897 - RNA, 18 nt, Homo sapiens
augguguaauaagacaua

SEQ ID NO: 1990898 - RNA, 19 nt, Homo sapiens
gaucuguugggaaccagag

SEQ ID NO: 1990899 - RNA, 23 nt, Homo sapiens
agcucuucgguuucugagcauaa

SEQ ID NO: 1990900 - RNA, 13 nt, Homo sapiens
ccccagaccucca

SEQ ID NO: 1990901 - RNA, 15 nt, Homo sapiens
ugaugcagucuuaga

SEQ ID NO: 1990902 - RNA, 20 nt, Homo sapiens
gaaauccauuccauuuugug

SEQ ID NO: 1990903 - RNA, 17 nt, Homo sapiens
guuuccaaugaugggau

SEQ ID NO: 1990904 - RNA, 20 nt, Homo sapiens
ccaauucuuugaauuuccca

SEQ ID NO: 1990905 - RNA, 19 nt, Homo sapiens
guuacuccauuacugugau

SEQ ID NO: 1990906 - RNA, 16 nt, Homo sapiens
ccauaguucacugacu

SEQ ID NO: 1990907 - RNA, 21 nt, Homo sapiens
gucugaacgucuccuagccaa

SEQ ID NO: 1990908 - RNA, 21 nt, Homo sapiens
caaaauaagaugaaucacuua

SEQ ID NO: 1990909 - RNA, 18 nt, Homo sapiens
uacccaucuugaaaaaca

SEQ ID NO: 1990910 - RNA, 11 nt, Homo sapiens
ucaaugagaug

SEQ ID NO: 1990911 - RNA, 17 nt, Homo sapiens
uuccgacaccacuggga

SEQ ID NO: 1990912 - RNA, 15 nt, Homo sapiens
cuuuccagagaccag

SEQ ID NO: 1990913 - RNA, 17 nt, Homo sapiens
auuguuuugccacuuag

SEQ ID NO: 1990914 - RNA, 22 nt, Homo sapiens
ucauguggcucagugccuuccu

SEQ ID NO: 1990915 - RNA, 14 nt, Homo sapiens
ucuucuggugagug

SEQ ID NO: 1990916 - RNA, 22 nt, Homo sapiens
ccaaauucucccuggaccccau

SEQ ID NO: 1990917 - RNA, 16 nt, Homo sapiens
ugccggccgcccagac

SEQ ID NO: 1990918 - RNA, 18 nt, Homo sapiens
gaaauggacugacuguaa

SEQ ID NO: 1990919 - RNA, 22 nt, Homo sapiens
acaagacuuuaccauacacgca

SEQ ID NO: 1990920 - RNA, 16 nt, Homo sapiens
uggagcuagaauuuga

SEQ ID NO: 1990921 - RNA, 16 nt, Homo sapiens
aguuguguuuguugcu

SEQ ID NO: 1990922 - RNA, 14 nt, Homo sapiens
ugacuguacaguua

SEQ ID NO: 1990923 - RNA, 17 nt, Homo sapiens
guaagaaggcaauauua

SEQ ID NO: 1990924 - RNA, 12 nt, Homo sapiens
ucugacacugaa

SEQ ID NO: 1990925 - RNA, 22 nt, Homo sapiens
gcucuugcucagugaagaggaa

SEQ ID NO: 1990926 - RNA, 15 nt, Homo sapiens
uuauauacaucucaa

SEQ ID NO: 1990927 - RNA, 15 nt, Homo sapiens
accagcaacuugaac

SEQ ID NO: 1990928 - RNA, 19 nt, Homo sapiens
ggaacugcuugugcacugg

SEQ ID NO: 1990929 - RNA, 20 nt, Homo sapiens
uuucccauaagacaaugaca

SEQ ID NO: 1990930 - RNA, 15 nt, Homo sapiens
uacagauuaucacau

SEQ ID NO: 1990931 - RNA, 20 nt, Homo sapiens
cccugcucaguaaagcacuu

SEQ ID NO: 1990932 - RNA, 18 nt, Homo sapiens
gcuuccuucauuuccucc

SEQ ID NO: 1990933 - RNA, 19 nt, Homo sapiens
caccacaccacugccccaa

SEQ ID NO: 1990934 - RNA, 15 nt, Homo sapiens
uccaggagacauaua

SEQ ID NO: 1990935 - RNA, 15 nt, Homo sapiens
ucgacucuuugcaac

SEQ ID NO: 1990936 - RNA, 17 nt, Homo sapiens
agucucauagcuuugga

SEQ ID NO: 1990937 - RNA, 21 nt, Homo sapiens
aacauuccuguugaugggaaa

SEQ ID NO: 1990938 - RNA, 21 nt, Homo sapiens
caaaaacaagcaaaaccaaag

SEQ ID NO: 1990939 - RNA, 21 nt, Homo sapiens
cuaacgcaaaaauagcucuug

SEQ ID NO: 1990940 - RNA, 12 nt, Homo sapiens
aaaaauuagcau

SEQ ID NO: 1990941 - RNA, 17 nt, Homo sapiens
cugccucaugcucucua

SEQ ID NO: 1990942 - RNA, 15 nt, Homo sapiens
cuaaguucuuagaua

SEQ ID NO: 1990943 - RNA, 15 nt, Homo sapiens
uauagaaccaugaau

SEQ ID NO: 1990944 - RNA, 23 nt, Homo sapiens
auuuuggaucuaucaccugucau

SEQ ID NO: 1990945 - RNA, 16 nt, Homo sapiens
cauaucccuuccucuc

SEQ ID NO: 1990946 - RNA, 14 nt, Homo sapiens
aaagaaacacucaa

SEQ ID NO: 1990947 - RNA, 17 nt, Homo sapiens
cagugggacccacaguc

SEQ ID NO: 1990948 - RNA, 21 nt, Homo sapiens
agcccacacaugaaccauccu

SEQ ID NO: 1990949 - RNA, 21 nt, Homo sapiens
ucuuauccaacaucaacaucu

SEQ ID NO: 1990950 - RNA, 19 nt, Homo sapiens
aguugauguaacauuguag

SEQ ID NO: 1990951 - RNA, 16 nt, Homo sapiens
aauugcauuucugcuc

SEQ ID NO: 1990952 - RNA, 13 nt, Homo sapiens
aauauuacucuca

SEQ ID NO: 1990953 - RNA, 19 nt, Homo sapiens
uaacuguccaguccaguga

SEQ ID NO: 1990954 - RNA, 17 nt, Homo sapiens
ugaaagucaugcacaua

SEQ ID NO: 1990955 - RNA, 18 nt, Homo sapiens
uaagcauuuaggaaugaa

SEQ ID NO: 1990956 - RNA, 22 nt, Homo sapiens
uuugaacaacucgaaucacuca

SEQ ID NO: 1990957 - RNA, 17 nt, Homo sapiens
caagagaaucugaucaa

SEQ ID NO: 1990958 - RNA, 18 nt, Homo sapiens
auacuaauagccuaaaag

SEQ ID NO: 1990959 - RNA, 21 nt, Homo sapiens
aacaacuauuuuucacauaau

SEQ ID NO: 1990960 - RNA, 14 nt, Homo sapiens
ccaaaugcuuuaaa

SEQ ID NO: 1990961 - RNA, 23 nt, Homo sapiens
ucauggccauagcuuuuauucau

SEQ ID NO: 1990962 - RNA, 18 nt, Homo sapiens
ccuaagacacaaaugcau

SEQ ID NO: 1990963 - RNA, 22 nt, Homo sapiens
aacagagugcaacccagucaca

SEQ ID NO: 1990964 - RNA, 21 nt, Homo sapiens
ucaauuuaccuacucuaugua

SEQ ID NO: 1990965 - RNA, 15 nt, Homo sapiens
cuaaaucacuuugag

SEQ ID NO: 1990966 - RNA, 16 nt, Homo sapiens
ucccaaaaagcuuuau

SEQ ID NO: 1990967 - RNA, 18 nt, Homo sapiens
ucuaccaagcugucacag

SEQ ID NO: 1990968 - RNA, 18 nt, Homo sapiens
cuguuaccaauauaguuu

SEQ ID NO: 1990969 - RNA, 18 nt, Homo sapiens
caauuuuugucucagaag

SEQ ID NO: 1990970 - RNA, 21 nt, Homo sapiens
gcaucuaaguuauaagacucu

SEQ ID NO: 1990971 - RNA, 22 nt, Homo sapiens
ugaaaaugcuguauuagucaca

SEQ ID NO: 1990972 - RNA, 12 nt, Homo sapiens
acacuuuugcuu

SEQ ID NO: 1990973 - RNA, 15 nt, Homo sapiens
ggaaccagcaaugag

SEQ ID NO: 1990974 - RNA, 22 nt, Homo sapiens
ggggugccaggugccaucaucu

SEQ ID NO: 1990975 - RNA, 20 nt, Homo sapiens
gaaccuguccuugcacacuc

SEQ ID NO: 1990976 - RNA, 20 nt, Homo sapiens
ccugacacaggggacacuga

SEQ ID NO: 1990977 - RNA, 15 nt, Homo sapiens
acagccuuugcccaa

SEQ ID NO: 1990978 - RNA, 13 nt, Homo sapiens
acccaugaagcug

SEQ ID NO: 1990979 - RNA, 15 nt, Homo sapiens
augaacucuuaauca

SEQ ID NO: 1990980 - RNA, 21 nt, Homo sapiens
ccuggggguuuaagcucugcc

SEQ ID NO: 1990981 - RNA, 16 nt, Homo sapiens
ugucaacaugaacaaa

SEQ ID NO: 1990982 - RNA, 20 nt, Homo sapiens
ucauacagugguauugcuag

SEQ ID NO: 1990983 - RNA, 20 nt, Homo sapiens
gccucccugacgucugccac

SEQ ID NO: 1990984 - RNA, 15 nt, Homo sapiens
cacauguggggacag

SEQ ID NO: 1990985 - RNA, 13 nt, Homo sapiens
caaaugacaguuu

SEQ ID NO: 1990986 - RNA, 17 nt, Homo sapiens
gcccucgagcacugaag

SEQ ID NO: 1990987 - RNA, 18 nt, Homo sapiens
uuuauagaggcuagcuuc

SEQ ID NO: 1990988 - RNA, 17 nt, Homo sapiens
augucaaauaucucaga

SEQ ID NO: 1990989 - RNA, 23 nt, Homo sapiens
agcuuauuuguauuuuuccucuu

SEQ ID NO: 1990990 - RNA, 19 nt, Homo sapiens
uagcgacugucaacagcgu

SEQ ID NO: 1990991 - RNA, 18 nt, Homo sapiens
cuuuugugguccuguaaa

SEQ ID NO: 1990992 - RNA, 22 nt, Homo sapiens
aaaaauuggcuaguugaaucua

SEQ ID NO: 1990993 - RNA, 13 nt, Homo sapiens
auaugaaugaaua

SEQ ID NO: 1990994 - RNA, 18 nt, Homo sapiens
aauaucugagaaguguau

SEQ ID NO: 1990995 - RNA, 16 nt, Homo sapiens
cacggaugcacagaga

SEQ ID NO: 1990996 - RNA, 15 nt, Homo sapiens
gcugugguguguucc

SEQ ID NO: 1990997 - RNA, 19 nt, Homo sapiens
caaauuuagaaagcuuaag

SEQ ID NO: 1990998 - RNA, 21 nt, Homo sapiens
accacauucuguccccaaaau

SEQ ID NO: 1990999 - RNA, 13 nt, Homo sapiens
guuaacuguguau

SEQ ID NO: 1991000 - RNA, 15 nt, Homo sapiens
aacaugaaaugcccu

SEQ ID NO: 1991001 - RNA, 18 nt, Homo sapiens
uaacuaugagccaggcau

SEQ ID NO: 1991002 - RNA, 22 nt, Homo sapiens
acaguuguccagaucacugaau

SEQ ID NO: 1991003 - RNA, 12 nt, Homo sapiens
accuuuuuacac

SEQ ID NO: 1991004 - RNA, 17 nt, Homo sapiens
uguccgcuauccaccaa

SEQ ID NO: 1991005 - RNA, 22 nt, Homo sapiens
aaauagaugugucuuaacauaa

SEQ ID NO: 1991006 - RNA, 16 nt, Homo sapiens
gauuacaaaagcaauu

SEQ ID NO: 1991007 - RNA, 18 nt, Homo sapiens
guacaguggugagaucac

SEQ ID NO: 1991008 - RNA, 15 nt, Homo sapiens
aacaauguauacaau

SEQ ID NO: 1991009 - RNA, 17 nt, Homo sapiens
gagaagcuuucagggga

SEQ ID NO: 1991010 - RNA, 17 nt, Homo sapiens
ucuuccuguguaccucu

SEQ ID NO: 1991011 - RNA, 19 nt, Homo sapiens
accaacuaugcguaaauca

SEQ ID NO: 1991012 - RNA, 21 nt, Homo sapiens
ugaagcucuugaagacacuga

SEQ ID NO: 1991013 - RNA, 15 nt, Homo sapiens
acauuaaauguccau

SEQ ID NO: 1991014 - RNA, 16 nt, Homo sapiens
uucagggcacugcugc

SEQ ID NO: 1991015 - RNA, 19 nt, Homo sapiens
cccuuccuaccucugguga

SEQ ID NO: 1991016 - RNA, 14 nt, Homo sapiens
uguaucguauugag

SEQ ID NO: 1991017 - RNA, 19 nt, Homo sapiens
uaguugcccucuaccugac

SEQ ID NO: 1991018 - RNA, 23 nt, Homo sapiens
aaaauguuuaaauucucuuucac

SEQ ID NO: 1991019 - RNA, 20 nt, Homo sapiens
ggguucaugaugcagucucc

SEQ ID NO: 1991020 - RNA, 22 nt, Homo sapiens
uggcucaugccuguaaucucag

SEQ ID NO: 1991021 - RNA, 12 nt, Homo sapiens
agcacaucucuc

SEQ ID NO: 1991022 - RNA, 13 nt, Homo sapiens
uacaggacuguaa

SEQ ID NO: 1991023 - RNA, 16 nt, Homo sapiens
aggagccgaccgggaa

SEQ ID NO: 1991024 - RNA, 15 nt, Homo sapiens
caucaacaacacagc

SEQ ID NO: 1991025 - RNA, 20 nt, Homo sapiens
ucguuugugaacgcugugau

SEQ ID NO: 1991026 - RNA, 22 nt, Homo sapiens
aaagcugccugugccaugccca

SEQ ID NO: 1991027 - RNA, 13 nt, Homo sapiens
gcucuaucuuccu

SEQ ID NO: 1991028 - RNA, 16 nt, Homo sapiens
gugcugggacagcuag

SEQ ID NO: 1991029 - RNA, 16 nt, Homo sapiens
cuugcugugcuucaaa

SEQ ID NO: 1991030 - RNA, 15 nt, Homo sapiens
auucuuugaccuguu

SEQ ID NO: 1991031 - RNA, 19 nt, Homo sapiens
cagccuccuuaaauguuuu

SEQ ID NO: 1991032 - RNA, 19 nt, Homo sapiens
aauauuuuuaugugcaaua

SEQ ID NO: 1991033 - RNA, 21 nt, Homo sapiens
acaugugcucucgggugcccu

SEQ ID NO: 1991034 - RNA, 12 nt, Homo sapiens
aagauugcuaua

SEQ ID NO: 1991035 - RNA, 12 nt, Homo sapiens
aaguuugcuauu

SEQ ID NO: 1991036 - RNA, 23 nt, Homo sapiens
uaaaauuagaaucugaguauaaa

SEQ ID NO: 1991037 - RNA, 17 nt, Homo sapiens
accacccgaaaugccac

SEQ ID NO: 1991038 - RNA, 16 nt, Homo sapiens
acaugaauuuuagcuu

SEQ ID NO: 1991039 - RNA, 17 nt, Homo sapiens
ucuauguccggcuuuaa

SEQ ID NO: 1991040 - RNA, 16 nt, Homo sapiens
caaugcuuugaucccu

SEQ ID NO: 1991041 - RNA, 16 nt, Homo sapiens
cacagauaugcacaca

SEQ ID NO: 1991042 - RNA, 14 nt, Homo sapiens
acaggccauuguga

SEQ ID NO: 1991043 - RNA, 13 nt, Homo sapiens
uuaaaggacauaa

SEQ ID NO: 1991044 - RNA, 19 nt, Homo sapiens
gaagaucauauacgugaaa

SEQ ID NO: 1991045 - RNA, 14 nt, Homo sapiens
auccugcagucaau

SEQ ID NO: 1991046 - RNA, 14 nt, Homo sapiens
aaaaguauuuccaa

SEQ ID NO: 1991047 - RNA, 14 nt, Homo sapiens
uuggugaacacaca

SEQ ID NO: 1991048 - RNA, 15 nt, Homo sapiens
aaagaaaaaugccug

SEQ ID NO: 1991049 - RNA, 23 nt, Homo sapiens
uguaaguaccccugauaagcaaa

SEQ ID NO: 1991050 - RNA, 13 nt, Homo sapiens
uaauuugccacag

SEQ ID NO: 1991051 - RNA, 21 nt, Homo sapiens
agcuguuucaccaucagucaa

SEQ ID NO: 1991052 - RNA, 15 nt, Homo sapiens
cacacacaccgaugu

SEQ ID NO: 1991053 - RNA, 14 nt, Homo sapiens
uaauuaacaucaaa

SEQ ID NO: 1991054 - RNA, 22 nt, Homo sapiens
cagcuugggaauccugcuaaag

SEQ ID NO: 1991055 - RNA, 18 nt, Homo sapiens
gugcagagagaucaucac

SEQ ID NO: 1991056 - RNA, 19 nt, Homo sapiens
ucuggaaaacucaggauuc

SEQ ID NO: 1991057 - RNA, 16 nt, Homo sapiens
aaagccacccuaccau

SEQ ID NO: 1991058 - RNA, 12 nt, Homo sapiens
gugacucucuug

SEQ ID NO: 1991059 - RNA, 14 nt, Homo sapiens
cuuuccuagauggc

SEQ ID NO: 1991060 - RNA, 14 nt, Homo sapiens
uuguaccauauaga

SEQ ID NO: 1991061 - RNA, 16 nt, Homo sapiens
caauacaaaaagccaa

SEQ ID NO: 1991062 - RNA, 16 nt, Homo sapiens
ucuacaaggaaauggg

SEQ ID NO: 1991063 - RNA, 20 nt, Homo sapiens
uaaagaauguuuuggaauaa

SEQ ID NO: 1991064 - RNA, 14 nt, Homo sapiens
uuucagaaauucca

SEQ ID NO: 1991065 - RNA, 17 nt, Homo sapiens
auuuuguaagaaguuuc

SEQ ID NO: 1991066 - RNA, 18 nt, Homo sapiens
aacauuuggaagccccau

SEQ ID NO: 1991067 - RNA, 19 nt, Homo sapiens
auuauguuuucaacacuuu

SEQ ID NO: 1991068 - RNA, 13 nt, Homo sapiens
ccucaaaugucag

SEQ ID NO: 1991069 - RNA, 16 nt, Homo sapiens
ccagggaguccagggu

SEQ ID NO: 1991070 - RNA, 14 nt, Homo sapiens
agacuugguuucaa

SEQ ID NO: 1991071 - RNA, 17 nt, Homo sapiens
uuuagcuguauucauau

SEQ ID NO: 1991072 - RNA, 23 nt, Homo sapiens
ugaacauuuuacaguagaacuca

SEQ ID NO: 1991073 - RNA, 18 nt, Homo sapiens
ucaugccagcagcacguc

SEQ ID NO: 1991074 - RNA, 16 nt, Homo sapiens
auugagccaguggugc

SEQ ID NO: 1991075 - RNA, 16 nt, Homo sapiens
caagccagcccggccg

SEQ ID NO: 1991076 - RNA, 14 nt, Homo sapiens
ccuccucagugaca

SEQ ID NO: 1991077 - RNA, 21 nt, Homo sapiens
ucucauaucaacuuagucaau

SEQ ID NO: 1991078 - RNA, 22 nt, Homo sapiens
uuaaguggacucucugacaaag

SEQ ID NO: 1991079 - RNA, 19 nt, Homo sapiens
auccacugauauccaugau

SEQ ID NO: 1991080 - RNA, 14 nt, Homo sapiens
uugcccggcuguga

SEQ ID NO: 1991081 - RNA, 18 nt, Homo sapiens
cccaugugacuguggcau

SEQ ID NO: 1991082 - RNA, 13 nt, Homo sapiens
cccacaaacugcc

SEQ ID NO: 1991083 - RNA, 20 nt, Homo sapiens
ucugccuauuuauuggggug

SEQ ID NO: 1991084 - RNA, 19 nt, Homo sapiens
auuucuggagggcaauuug

SEQ ID NO: 1991085 - RNA, 22 nt, Homo sapiens
ccauaaacgguuccuggugacu

SEQ ID NO: 1991086 - RNA, 19 nt, Homo sapiens
auagauccccccacugagc

SEQ ID NO: 1991087 - RNA, 12 nt, Homo sapiens
uaaaacacagcu

SEQ ID NO: 1991088 - RNA, 14 nt, Homo sapiens
aaaaagugucucaa

SEQ ID NO: 1991089 - RNA, 17 nt, Homo sapiens
ucauucaguucuaggcc

SEQ ID NO: 1991090 - RNA, 17 nt, Homo sapiens
uauaucauucuaaagau

SEQ ID NO: 1991091 - RNA, 15 nt, Homo sapiens
augacuguugcauag

SEQ ID NO: 1991092 - RNA, 16 nt, Homo sapiens
cugcccuucgcugcca

SEQ ID NO: 1991093 - RNA, 20 nt, Homo sapiens
gucucgauauccugaucucg

SEQ ID NO: 1991094 - RNA, 19 nt, Homo sapiens
aaauucucagucaugcacu

SEQ ID NO: 1991095 - RNA, 12 nt, Homo sapiens
ccccagucccag

SEQ ID NO: 1991096 - RNA, 13 nt, Homo sapiens
agggcugcuuccc

SEQ ID NO: 1991097 - RNA, 18 nt, Homo sapiens
agccccgccccguuguga

SEQ ID NO: 1991098 - RNA, 18 nt, Homo sapiens
ccucuccuggugcuccaa

SEQ ID NO: 1991099 - RNA, 12 nt, Homo sapiens
cuuaagagccag

SEQ ID NO: 1991100 - RNA, 18 nt, Homo sapiens
acuggaggccaggaaucu

SEQ ID NO: 1991101 - RNA, 22 nt, Homo sapiens
aauacaauauggacauguaaaa

SEQ ID NO: 1991102 - RNA, 14 nt, Homo sapiens
ccagaggugcuucu

SEQ ID NO: 1991103 - RNA, 17 nt, Homo sapiens
uauaacuagacaucugc

SEQ ID NO: 1991104 - RNA, 19 nt, Homo sapiens
ccuccaucaugaagaagcu

SEQ ID NO: 1991105 - RNA, 15 nt, Homo sapiens
cucauuucaggagca

SEQ ID NO: 1991106 - RNA, 22 nt, Homo sapiens
cccugguggagaaagcacugac

SEQ ID NO: 1991107 - RNA, 17 nt, Homo sapiens
ucuaauagcgaggcucu

SEQ ID NO: 1991108 - RNA, 22 nt, Homo sapiens
uccagaggaugucuuucuccuc

SEQ ID NO: 1991109 - RNA, 17 nt, Homo sapiens
agguauauagaacacaa

SEQ ID NO: 1991110 - RNA, 12 nt, Homo sapiens
uagaucuuucaa

SEQ ID NO: 1991111 - RNA, 15 nt, Homo sapiens
agccguccauggcac

SEQ ID NO: 1991112 - RNA, 23 nt, Homo sapiens
agccaaguucacaccacugccau

SEQ ID NO: 1991113 - RNA, 20 nt, Homo sapiens
ccuuuucuuguaaacauugc

SEQ ID NO: 1991114 - RNA, 14 nt, Homo sapiens
cuuggaaggugaca

SEQ ID NO: 1991115 - RNA, 13 nt, Homo sapiens
cccucaccucccu

SEQ ID NO: 1991116 - RNA, 12 nt, Homo sapiens
agguuaccucac

SEQ ID NO: 1991117 - RNA, 16 nt, Homo sapiens
uucuccagaacccauu

SEQ ID NO: 1991118 - RNA, 17 nt, Homo sapiens
cugguaauuuguaucug

SEQ ID NO: 1991119 - RNA, 17 nt, Homo sapiens
uccaucuuucacuaucu

SEQ ID NO: 1991120 - RNA, 18 nt, Homo sapiens
aggggugauaacucagga

SEQ ID NO: 1991121 - RNA, 20 nt, Homo sapiens
uauuucuaugaaaaugggau

SEQ ID NO: 1991122 - RNA, 16 nt, Homo sapiens
agauggcuggcuggug

SEQ ID NO: 1991123 - RNA, 14 nt, Homo sapiens
uuaaguaccaaugg

SEQ ID NO: 1991124 - RNA, 15 nt, Homo sapiens
uaaaauaccacugua

SEQ ID NO: 1991125 - RNA, 22 nt, Homo sapiens
acuaauggcaugagaaauacaa

SEQ ID NO: 1991126 - RNA, 17 nt, Homo sapiens
gacccugucuucugggc

SEQ ID NO: 1991127 - RNA, 20 nt, Homo sapiens
aucagugcuccuguaaguca

SEQ ID NO: 1991128 - RNA, 21 nt, Homo sapiens
aaacuucaguuucacagaaaa

SEQ ID NO: 1991129 - RNA, 13 nt, Homo sapiens
cagauacuccucc

SEQ ID NO: 1991130 - RNA, 23 nt, Homo sapiens
uuacagugagccaagauugcacc

SEQ ID NO: 1991131 - RNA, 18 nt, Homo sapiens
ucccucagaucccaguuc

SEQ ID NO: 1991132 - RNA, 15 nt, Homo sapiens
ccuugaucagugaca

SEQ ID NO: 1991133 - RNA, 18 nt, Homo sapiens
ggaugcugugccucccaa

SEQ ID NO: 1991134 - RNA, 16 nt, Homo sapiens
ugaaaacucuuugcug

SEQ ID NO: 1991135 - RNA, 13 nt, Homo sapiens
cucuuacaaaagc

SEQ ID NO: 1991136 - RNA, 18 nt, Homo sapiens
cagcauuuucauucauuu

SEQ ID NO: 1991137 - RNA, 15 nt, Homo sapiens
caggaauauuuucca

SEQ ID NO: 1991138 - RNA, 12 nt, Homo sapiens
cucagcacuuuc

SEQ ID NO: 1991139 - RNA, 13 nt, Homo sapiens
agcuauacuguau

SEQ ID NO: 1991140 - RNA, 23 nt, Homo sapiens
cuucaguuuuucacuucuaccua

SEQ ID NO: 1991141 - RNA, 21 nt, Homo sapiens
cacuguaacgccuguuacaca

SEQ ID NO: 1991142 - RNA, 17 nt, Homo sapiens
ugguuuccauuuacuaa

SEQ ID NO: 1991143 - RNA, 19 nt, Homo sapiens
gugacuucuccaggucuca

SEQ ID NO: 1991144 - RNA, 14 nt, Homo sapiens
acuuuccaaaucca

SEQ ID NO: 1991145 - RNA, 15 nt, Homo sapiens
aaacuuggcucucaa

SEQ ID NO: 1991146 - RNA, 20 nt, Homo sapiens
aucccugcccagccuguggu

SEQ ID NO: 1991147 - RNA, 17 nt, Homo sapiens
cccucgcucagagggau

SEQ ID NO: 1991148 - RNA, 18 nt, Homo sapiens
acuuuagguagaugaacu

SEQ ID NO: 1991149 - RNA, 14 nt, Homo sapiens
gauuagugcaauaa

SEQ ID NO: 1991150 - RNA, 15 nt, Homo sapiens
gcaaaggaagacuug

SEQ ID NO: 1991151 - RNA, 22 nt, Homo sapiens
acagaaauuaagauguugucuu

SEQ ID NO: 1991152 - RNA, 21 nt, Homo sapiens
ugugaaaauuacaguccaaaa

SEQ ID NO: 1991153 - RNA, 20 nt, Homo sapiens
cuuccgggaaaacagcuauu

SEQ ID NO: 1991154 - RNA, 14 nt, Homo sapiens
uuaggcagugcagu

SEQ ID NO: 1991155 - RNA, 22 nt, Homo sapiens
aaugacagauucugacauuuau

SEQ ID NO: 1991156 - RNA, 12 nt, Homo sapiens
uaucaucucaau

SEQ ID NO: 1991157 - RNA, 16 nt, Homo sapiens
gcacauaugugccaau

SEQ ID NO: 1991158 - RNA, 18 nt, Homo sapiens
uucuggagucuccagugg

SEQ ID NO: 1991159 - RNA, 15 nt, Homo sapiens
uuaauucugaugcua

SEQ ID NO: 1991160 - RNA, 18 nt, Homo sapiens
cugaagcguuuuucucaa

SEQ ID NO: 1991161 - RNA, 19 nt, Homo sapiens
aggugggccuugcuaccuc

SEQ ID NO: 1991162 - RNA, 15 nt, Homo sapiens
uccuucauucaaccc

SEQ ID NO: 1991163 - RNA, 20 nt, Homo sapiens
aguacaucuugugcaugcaa

SEQ ID NO: 1991164 - RNA, 13 nt, Homo sapiens
ucaccugccaaca

SEQ ID NO: 1991165 - RNA, 22 nt, Homo sapiens
uuggaggaccuuaaaugcuacu

SEQ ID NO: 1991166 - RNA, 15 nt, Homo sapiens
gcaccccacuucaga

SEQ ID NO: 1991167 - RNA, 13 nt, Homo sapiens
uuaguaaucugua

SEQ ID NO: 1991168 - RNA, 14 nt, Homo sapiens
auccaauccucagg

SEQ ID NO: 1991169 - RNA, 21 nt, Homo sapiens
ggcccuguccuggcaucagua

SEQ ID NO: 1991170 - RNA, 12 nt, Homo sapiens
gaggucaugcca

SEQ ID NO: 1991171 - RNA, 18 nt, Homo sapiens
gauaacuggccagccaua

SEQ ID NO: 1991172 - RNA, 18 nt, Homo sapiens
aaaauuagugaguauaaa

SEQ ID NO: 1991173 - RNA, 16 nt, Homo sapiens
cccagguggcagacuc

SEQ ID NO: 1991174 - RNA, 17 nt, Homo sapiens
uuucaaucaaaacucag

SEQ ID NO: 1991175 - RNA, 15 nt, Homo sapiens
auuccuucuuacucu

SEQ ID NO: 1991176 - RNA, 17 nt, Homo sapiens
acaguuaauuaugugca

SEQ ID NO: 1991177 - RNA, 16 nt, Homo sapiens
ccaauacugagugccu

SEQ ID NO: 1991178 - RNA, 12 nt, Homo sapiens
gcacauuaacug

SEQ ID NO: 1991179 - RNA, 21 nt, Homo sapiens
ucuguuguguuugucaaaaag

SEQ ID NO: 1991180 - RNA, 14 nt, Homo sapiens
gggugggcacagua

SEQ ID NO: 1991181 - RNA, 15 nt, Homo sapiens
aguaaguacaaauau

SEQ ID NO: 1991182 - RNA, 22 nt, Homo sapiens
ugaauaucugccccaguaguca

SEQ ID NO: 1991183 - RNA, 12 nt, Homo sapiens
gucaggcacguc

SEQ ID NO: 1991184 - RNA, 17 nt, Homo sapiens
agguaggaucaucccac

SEQ ID NO: 1991185 - RNA, 13 nt, Homo sapiens
cuccauuccugag

SEQ ID NO: 1991186 - RNA, 20 nt, Homo sapiens
gagcauugcuauuuaucuca

SEQ ID NO: 1991187 - RNA, 22 nt, Homo sapiens
agcauuucuagcagugaugaaa

SEQ ID NO: 1991188 - RNA, 15 nt, Homo sapiens
gggacccucccagug

SEQ ID NO: 1991189 - RNA, 13 nt, Homo sapiens
gguccucucugag

SEQ ID NO: 1991190 - RNA, 17 nt, Homo sapiens
auucuacguaucugcua

SEQ ID NO: 1991191 - RNA, 20 nt, Homo sapiens
cugcuauugcagcaauuaaa

SEQ ID NO: 1991192 - RNA, 21 nt, Homo sapiens
cugggcagaaggaagacuuca

SEQ ID NO: 1991193 - RNA, 14 nt, Homo sapiens
ugcacaaacuccau

SEQ ID NO: 1991194 - RNA, 12 nt, Homo sapiens
ugcaauguauua

SEQ ID NO: 1991195 - RNA, 15 nt, Homo sapiens
aagaucuacaugaau

SEQ ID NO: 1991196 - RNA, 23 nt, Homo sapiens
uaaaauggcaguuugaagucaaa

SEQ ID NO: 1991197 - RNA, 13 nt, Homo sapiens
aaaaucacuugau

SEQ ID NO: 1991198 - RNA, 12 nt, Homo sapiens
gcuuauauucau

SEQ ID NO: 1991199 - RNA, 14 nt, Homo sapiens
acccacccagcacc

SEQ ID NO: 1991200 - RNA, 14 nt, Homo sapiens
gcaugccuauguac

SEQ ID NO: 1991201 - RNA, 17 nt, Homo sapiens
ucucaguaucaguauuu

SEQ ID NO: 1991202 - RNA, 16 nt, Homo sapiens
cugucaggauucaguu

SEQ ID NO: 1991203 - RNA, 15 nt, Homo sapiens
auauacaauauaaca

SEQ ID NO: 1991204 - RNA, 23 nt, Homo sapiens
gcacaggacaugcgguagccagc

SEQ ID NO: 1991205 - RNA, 23 nt, Homo sapiens
augaugagccauauuaauugccu

SEQ ID NO: 1991206 - RNA, 23 nt, Homo sapiens
agaaucggcuuugcagugcacuu

SEQ ID NO: 1991207 - RNA, 23 nt, Homo sapiens
cugccccaaggccccagggacag

SEQ ID NO: 1991208 - RNA, 17 nt, Homo sapiens
aauauuagggaguaaaa

SEQ ID NO: 1991209 - RNA, 16 nt, Homo sapiens
cuugggaccgugccca

SEQ ID NO: 1991210 - RNA, 21 nt, Homo sapiens
aaacugggucuucagcuuuau

SEQ ID NO: 1991211 - RNA, 17 nt, Homo sapiens
aauauuacaaauucuaa

SEQ ID NO: 1991212 - RNA, 22 nt, Homo sapiens
acugguauguguggaugaugcu

SEQ ID NO: 1991213 - RNA, 15 nt, Homo sapiens
uuuucauuacacuaa

SEQ ID NO: 1991214 - RNA, 23 nt, Homo sapiens
cauacauugauucaugucucacg

SEQ ID NO: 1991215 - RNA, 19 nt, Homo sapiens
aagcaaucugcccauucau

SEQ ID NO: 1991216 - RNA, 18 nt, Homo sapiens
gcucaccagccccagugc

SEQ ID NO: 1991217 - RNA, 12 nt, Homo sapiens
aaggaaggcagu

SEQ ID NO: 1991218 - RNA, 20 nt, Homo sapiens
ccaggaacguuucugaacaa

SEQ ID NO: 1991219 - RNA, 20 nt, Homo sapiens
aaaacuacuguuaacacugc

SEQ ID NO: 1991220 - RNA, 23 nt, Homo sapiens
aucaccccucugccccugcagcu

SEQ ID NO: 1991221 - RNA, 22 nt, Homo sapiens
caacagguggcaggaccaggac

SEQ ID NO: 1991222 - RNA, 17 nt, Homo sapiens
uaauguauacacaugga

SEQ ID NO: 1991223 - RNA, 17 nt, Homo sapiens
gucugccuggaggccag

SEQ ID NO: 1991224 - RNA, 14 nt, Homo sapiens
uacaguacagugag

SEQ ID NO: 1991225 - RNA, 23 nt, Homo sapiens
agaauggggugagcagccaccau

SEQ ID NO: 1991226 - RNA, 23 nt, Homo sapiens
gcuuccauccugucaccaugacu

SEQ ID NO: 1991227 - RNA, 19 nt, Homo sapiens
uugcacaacucuacuguug

SEQ ID NO: 1991228 - RNA, 15 nt, Homo sapiens
ucuugcaacucugua

SEQ ID NO: 1991229 - RNA, 14 nt, Homo sapiens
uagugcucacauug

SEQ ID NO: 1991230 - RNA, 20 nt, Homo sapiens
gccuuguuuggauuggcacu

SEQ ID NO: 1991231 - RNA, 20 nt, Homo sapiens
ggaaaaguugaugguauuca

SEQ ID NO: 1991232 - RNA, 23 nt, Homo sapiens
cauugaugcugcuggcuaagcau

SEQ ID NO: 1991233 - RNA, 14 nt, Homo sapiens
gugugcuucacaca

SEQ ID NO: 1991234 - RNA, 17 nt, Homo sapiens
aggugagggaugccaua

SEQ ID NO: 1991235 - RNA, 13 nt, Homo sapiens
cuuuauugcucau

SEQ ID NO: 1991236 - RNA, 13 nt, Homo sapiens
cucuuuugcuuaa

SEQ ID NO: 1991237 - RNA, 21 nt, Homo sapiens
uuacaucccagacacauucac

SEQ ID NO: 1991238 - RNA, 15 nt, Homo sapiens
cacagggaacaggaa

SEQ ID NO: 1991239 - RNA, 22 nt, Homo sapiens
uaauucggaagggaaaacaguc

SEQ ID NO: 1991240 - RNA, 19 nt, Homo sapiens
cucuuuggugcacaaguaa

SEQ ID NO: 1991241 - RNA, 22 nt, Homo sapiens
gauuugaauuguuuuaagccaa

SEQ ID NO: 1991242 - RNA, 15 nt, Homo sapiens
aucuuauauaguuua

SEQ ID NO: 1991243 - RNA, 18 nt, Homo sapiens
cagauuaaauuuaauuaa

SEQ ID NO: 1991244 - RNA, 14 nt, Homo sapiens
uauagccucugucu

SEQ ID NO: 1991245 - RNA, 19 nt, Homo sapiens
acaugaaaggacccuguga

SEQ ID NO: 1991246 - RNA, 13 nt, Homo sapiens
uacggcuaccugg

SEQ ID NO: 1991247 - RNA, 16 nt, Homo sapiens
aguaaauacauuauug

SEQ ID NO: 1991248 - RNA, 13 nt, Homo sapiens
ugcgcacaccgcc

SEQ ID NO: 1991249 - RNA, 15 nt, Homo sapiens
acaggccgagugaag

SEQ ID NO: 1991250 - RNA, 17 nt, Homo sapiens
ugcagcucuacagguga

SEQ ID NO: 1991251 - RNA, 19 nt, Homo sapiens
auccuauuaaaacacagcu

SEQ ID NO: 1991252 - RNA, 18 nt, Homo sapiens
cuguguuguguccugaca

SEQ ID NO: 1991253 - RNA, 13 nt, Homo sapiens
aggaacaaagaca

SEQ ID NO: 1991254 - RNA, 12 nt, Homo sapiens
uucuagcuauaa

SEQ ID NO: 1991255 - RNA, 13 nt, Homo sapiens
cuaccucuguccc

SEQ ID NO: 1991256 - RNA, 23 nt, Homo sapiens
aguucuuuuauaacuuuuaaaca

SEQ ID NO: 1991257 - RNA, 19 nt, Homo sapiens
ucugcuuccaguuggaguu

SEQ ID NO: 1991258 - RNA, 22 nt, Homo sapiens
acaggaugcccacauacugucu

SEQ ID NO: 1991259 - RNA, 19 nt, Homo sapiens
guuucaccauguuggccag

SEQ ID NO: 1991260 - RNA, 22 nt, Homo sapiens
ugggaauauuugaaucuugucu

SEQ ID NO: 1991261 - RNA, 16 nt, Homo sapiens
auggcuuaagcaauaa

SEQ ID NO: 1991262 - RNA, 18 nt, Homo sapiens
auuugagagacugccaua

SEQ ID NO: 1991263 - RNA, 18 nt, Homo sapiens
aucccauuccugggcuag

SEQ ID NO: 1991264 - RNA, 17 nt, Homo sapiens
aagucuuugguacaagu

SEQ ID NO: 1991265 - RNA, 15 nt, Homo sapiens
ugcacuuauucaaua

SEQ ID NO: 1991266 - RNA, 23 nt, Homo sapiens
uggacuaaauauuuaagugcagu

SEQ ID NO: 1991267 - RNA, 16 nt, Homo sapiens
agagaauguguguaga

SEQ ID NO: 1991268 - RNA, 18 nt, Homo sapiens
ucauccauagacacagua

SEQ ID NO: 1991269 - RNA, 21 nt, Homo sapiens
cgacaaguaguucaugaguau

SEQ ID NO: 1991270 - RNA, 16 nt, Homo sapiens
gcaaaguggaauuaaa

SEQ ID NO: 1991271 - RNA, 18 nt, Homo sapiens
guucucagguucacucau

SEQ ID NO: 1991272 - RNA, 14 nt, Homo sapiens
agaagaagaaggag

SEQ ID NO: 1991273 - RNA, 18 nt, Homo sapiens
agcugaaaagagcuuugu

SEQ ID NO: 1991274 - RNA, 17 nt, Homo sapiens
aguuaaaacagcuauuu

SEQ ID NO: 1991275 - RNA, 19 nt, Homo sapiens
gagacuuucugcugggauc

SEQ ID NO: 1991276 - RNA, 19 nt, Homo sapiens
acucuuagagaugauucag

SEQ ID NO: 1991277 - RNA, 14 nt, Homo sapiens
uauauaaucaauca

SEQ ID NO: 1991278 - RNA, 10 nt, Homo sapiens
uauguaaaac

SEQ ID NO: 1991279 - RNA, 19 nt, Homo sapiens
aaggcagcugguauauuca

SEQ ID NO: 1991280 - RNA, 15 nt, Homo sapiens
ucauaguugggguca

SEQ ID NO: 1991281 - RNA, 14 nt, Homo sapiens
ccuugccaugucuu

SEQ ID NO: 1991282 - RNA, 16 nt, Homo sapiens
cuguuggccaguguga

SEQ ID NO: 1991283 - RNA, 16 nt, Homo sapiens
auauuaaggaaaaaag

SEQ ID NO: 1991284 - RNA, 14 nt, Homo sapiens
uuucuacucaaaag

SEQ ID NO: 1991285 - RNA, 21 nt, Homo sapiens
ccagcccccacccaugccagc

SEQ ID NO: 1991286 - RNA, 17 nt, Homo sapiens
cuauuuguuuacaugca

SEQ ID NO: 1991287 - RNA, 18 nt, Homo sapiens
gaagacacuaauuccuua

SEQ ID NO: 1991288 - RNA, 18 nt, Homo sapiens
uagagggcgagggaugau

SEQ ID NO: 1991289 - RNA, 18 nt, Homo sapiens
uggaucugucauuaucaa

SEQ ID NO: 1991290 - RNA, 16 nt, Homo sapiens
aauggacugacuguaa

SEQ ID NO: 1991291 - RNA, 13 nt, Homo sapiens
ggguacacggugg

SEQ ID NO: 1991292 - RNA, 19 nt, Homo sapiens
ccuauguacuuaauccuuu

SEQ ID NO: 1991293 - RNA, 19 nt, Homo sapiens
agccuagaagagcuucuga

SEQ ID NO: 1991294 - RNA, 23 nt, Homo sapiens
cuggcccucgacacucaccauga

SEQ ID NO: 1991295 - RNA, 20 nt, Homo sapiens
aggccucagggaccaaggag

SEQ ID NO: 1991296 - RNA, 17 nt, Homo sapiens
gcuuuucucaugguauu

SEQ ID NO: 1991297 - RNA, 22 nt, Homo sapiens
uaaacauuuuuagagaaguaaa

SEQ ID NO: 1991298 - RNA, 19 nt, Homo sapiens
aguuuccgugcguggcacu

SEQ ID NO: 1991299 - RNA, 14 nt, Homo sapiens
ucagcucuuugaca

SEQ ID NO: 1991300 - RNA, 12 nt, Homo sapiens
cacaaagccuua

SEQ ID NO: 1991301 - RNA, 12 nt, Homo sapiens
aaauacaaagca

SEQ ID NO: 1991302 - RNA, 11 nt, Homo sapiens
ccgaugcacac

SEQ ID NO: 1991303 - RNA, 17 nt, Homo sapiens
ucauaaggauucaggga

SEQ ID NO: 1991304 - RNA, 23 nt, Homo sapiens
gcggucggggacuuuaccugcug

SEQ ID NO: 1991305 - RNA, 16 nt, Homo sapiens
accuuuuuauuugcau

SEQ ID NO: 1991306 - RNA, 20 nt, Homo sapiens
acagcacuuuccuguugcac

SEQ ID NO: 1991307 - RNA, 17 nt, Homo sapiens
auacccacacagucaca

SEQ ID NO: 1991308 - RNA, 14 nt, Homo sapiens
uguacuuuuuggca

SEQ ID NO: 1991309 - RNA, 15 nt, Homo sapiens
ugucugugugcugag

SEQ ID NO: 1991310 - RNA, 16 nt, Homo sapiens
acaggccgcacaucuc

SEQ ID NO: 1991311 - RNA, 22 nt, Homo sapiens
aaggcugaggcaggaggaucau

SEQ ID NO: 1991312 - RNA, 15 nt, Homo sapiens
agccucugaccccuc

SEQ ID NO: 1991313 - RNA, 15 nt, Homo sapiens
ugcugagcauguacu

SEQ ID NO: 1991314 - RNA, 15 nt, Homo sapiens
acccccaguccucac

SEQ ID NO: 1991315 - RNA, 19 nt, Homo sapiens
agccucccuuugccagcca

SEQ ID NO: 1991316 - RNA, 12 nt, Homo sapiens
uccccagucucu

SEQ ID NO: 1991317 - RNA, 22 nt, Homo sapiens
ccuugagaggcaugacagcugu

SEQ ID NO: 1991318 - RNA, 15 nt, Homo sapiens
ccagagcagugccaa

SEQ ID NO: 1991319 - RNA, 18 nt, Homo sapiens
ggccuuauaucauuucau

SEQ ID NO: 1991320 - RNA, 23 nt, Homo sapiens
auuuuagcacaaagaugugcaaa

SEQ ID NO: 1991321 - RNA, 18 nt, Homo sapiens
cugauuuccuucugcuau

SEQ ID NO: 1991322 - RNA, 19 nt, Homo sapiens
uguauauucaggacuugaa

SEQ ID NO: 1991323 - RNA, 21 nt, Homo sapiens
gggcauuccuugggacucagg

SEQ ID NO: 1991324 - RNA, 13 nt, Homo sapiens
aaaacauauccaa

SEQ ID NO: 1991325 - RNA, 14 nt, Homo sapiens
uauaucgaucucuu

SEQ ID NO: 1991326 - RNA, 13 nt, Homo sapiens
uaccaaguauugu

SEQ ID NO: 1991327 - RNA, 12 nt, Homo sapiens
cccagucagaag

SEQ ID NO: 1991328 - RNA, 13 nt, Homo sapiens
agaacaacauauc

SEQ ID NO: 1991329 - RNA, 15 nt, Homo sapiens
aaaagcccccaguua

SEQ ID NO: 1991330 - RNA, 20 nt, Homo sapiens
aucuuguuaaauugcuuauu

SEQ ID NO: 1991331 - RNA, 23 nt, Homo sapiens
accccugcccugggauguccaca

SEQ ID NO: 1991332 - RNA, 12 nt, Homo sapiens
uugcaaaguaau

SEQ ID NO: 1991333 - RNA, 15 nt, Homo sapiens
auacuggacucagga

SEQ ID NO: 1991334 - RNA, 12 nt, Homo sapiens
aacaagugcucu

SEQ ID NO: 1991335 - RNA, 23 nt, Homo sapiens
ggggcccuccaugcgcagaugag

SEQ ID NO: 1991336 - RNA, 15 nt, Homo sapiens
gcccuucugaugaga

SEQ ID NO: 1991337 - RNA, 16 nt, Homo sapiens
uccagacccccagcaa

SEQ ID NO: 1991338 - RNA, 11 nt, Homo sapiens
ccuuccagggc

SEQ ID NO: 1991339 - RNA, 14 nt, Homo sapiens
gcucagacaugaaa

SEQ ID NO: 1991340 - RNA, 14 nt, Homo sapiens
gcuucaaccuugag

SEQ ID NO: 1991341 - RNA, 17 nt, Homo sapiens
cgucugugauugccauu

SEQ ID NO: 1991342 - RNA, 14 nt, Homo sapiens
cauauggucaucca

SEQ ID NO: 1991343 - RNA, 14 nt, Homo sapiens
ggcaugguggccca

SEQ ID NO: 1991344 - RNA, 17 nt, Homo sapiens
aauucauugugauuuau

SEQ ID NO: 1991345 - RNA, 17 nt, Homo sapiens
cuuggccaaggugguga

SEQ ID NO: 1991346 - RNA, 19 nt, Homo sapiens
uguguguucauuguaaaca

SEQ ID NO: 1991347 - RNA, 21 nt, Homo sapiens
ccuuguuuggggcaggaguag

SEQ ID NO: 1991348 - RNA, 17 nt, Homo sapiens
ucuacuguacacaaucu

SEQ ID NO: 1991349 - RNA, 18 nt, Homo sapiens
uaggaaaugaaugaucuu

SEQ ID NO: 1991350 - RNA, 22 nt, Homo sapiens
auaauaugucaccuggcacauu

SEQ ID NO: 1991351 - RNA, 14 nt, Homo sapiens
cauuaaauaaugca

SEQ ID NO: 1991352 - RNA, 15 nt, Homo sapiens
ugacuugccaaagaa

SEQ ID NO: 1991353 - RNA, 14 nt, Homo sapiens
ccucuccacccucc

SEQ ID NO: 1991354 - RNA, 15 nt, Homo sapiens
auaaacuccuacuaa

SEQ ID NO: 1991355 - RNA, 14 nt, Homo sapiens
ugugcagauaucac

SEQ ID NO: 1991356 - RNA, 15 nt, Homo sapiens
aacucaacuguauaa

SEQ ID NO: 1991357 - RNA, 23 nt, Homo sapiens
agcugugguuuucuuuugccaug

SEQ ID NO: 1991358 - RNA, 21 nt, Homo sapiens
ggcugggaagaagcugcacuu

SEQ ID NO: 1991359 - RNA, 22 nt, Homo sapiens
cagcugaacaguguuggcuuuc

SEQ ID NO: 1991360 - RNA, 15 nt, Homo sapiens
gacccaggaaugcca

SEQ ID NO: 1991361 - RNA, 15 nt, Homo sapiens
ugucucucacugcau

SEQ ID NO: 1991362 - RNA, 23 nt, Homo sapiens
ugaaucucaccugcuggggaccu

SEQ ID NO: 1991363 - RNA, 22 nt, Homo sapiens
gucucuagaagugccaucucaa

SEQ ID NO: 1991364 - RNA, 14 nt, Homo sapiens
aggagccuuuccag

SEQ ID NO: 1991365 - RNA, 14 nt, Homo sapiens
ucaggcugcuggaa

SEQ ID NO: 1991366 - RNA, 13 nt, Homo sapiens
ucaaaacauccca

SEQ ID NO: 1991367 - RNA, 17 nt, Homo sapiens
augcucuggacuugccu

SEQ ID NO: 1991368 - RNA, 14 nt, Homo sapiens
cagcucacugcaag

SEQ ID NO: 1991369 - RNA, 17 nt, Homo sapiens
caguaugguaacuuugc

SEQ ID NO: 1991370 - RNA, 12 nt, Homo sapiens
caaacauuuacc

SEQ ID NO: 1991371 - RNA, 14 nt, Homo sapiens
aacagguguuccuc

SEQ ID NO: 1991372 - RNA, 15 nt, Homo sapiens
uggguguuuucaaau

SEQ ID NO: 1991373 - RNA, 15 nt, Homo sapiens
cuuggccaguuuucu

SEQ ID NO: 1991374 - RNA, 18 nt, Homo sapiens
ucauguuaugcagugaac

SEQ ID NO: 1991375 - RNA, 20 nt, Homo sapiens
gccagcauuuccucagucuc

SEQ ID NO: 1991376 - RNA, 18 nt, Homo sapiens
ugaaaacauagcaucuca

SEQ ID NO: 1991377 - RNA, 15 nt, Homo sapiens
cccuucacugccuuu

SEQ ID NO: 1991378 - RNA, 19 nt, Homo sapiens
acugaacuuuucaaaauaa

SEQ ID NO: 1991379 - RNA, 17 nt, Homo sapiens
caauuccucugaacaaa

SEQ ID NO: 1991380 - RNA, 20 nt, Homo sapiens
gcguguaccucacuuuacau

SEQ ID NO: 1991381 - RNA, 13 nt, Homo sapiens
uccacaauucauu

SEQ ID NO: 1991382 - RNA, 13 nt, Homo sapiens
uuuaagauuccca

SEQ ID NO: 1991383 - RNA, 14 nt, Homo sapiens
gagcugugggagag

SEQ ID NO: 1991384 - RNA, 15 nt, Homo sapiens
gaaucugagugaauu

SEQ ID NO: 1991385 - RNA, 18 nt, Homo sapiens
gcccuugccucucuggac

SEQ ID NO: 1991386 - RNA, 20 nt, Homo sapiens
aggugcuggaggugggagca

SEQ ID NO: 1991387 - RNA, 12 nt, Homo sapiens
gagacucuaggg

SEQ ID NO: 1991388 - RNA, 17 nt, Homo sapiens
cccaggcuaauacagga

SEQ ID NO: 1991389 - RNA, 21 nt, Homo sapiens
cucugacguugaucccagaga

SEQ ID NO: 1991390 - RNA, 22 nt, Homo sapiens
uuugcucauugcuguaccacau

SEQ ID NO: 1991391 - RNA, 22 nt, Homo sapiens
uccuuaccagcagagcaccuua

SEQ ID NO: 1991392 - RNA, 16 nt, Homo sapiens
acuuaaauaucaauca

SEQ ID NO: 1991393 - RNA, 18 nt, Homo sapiens
aagaagagacucuuugca

SEQ ID NO: 1991394 - RNA, 16 nt, Homo sapiens
cauuugccacuuagua

SEQ ID NO: 1991395 - RNA, 13 nt, Homo sapiens
augcacacacaga

SEQ ID NO: 1991396 - RNA, 17 nt, Homo sapiens
aguccagucaaguuccc

SEQ ID NO: 1991397 - RNA, 15 nt, Homo sapiens
ugaggugaccacuua

SEQ ID NO: 1991398 - RNA, 11 nt, Homo sapiens
gugcaaaggga

SEQ ID NO: 1991399 - RNA, 17 nt, Homo sapiens
cuauaccugagccucaa

SEQ ID NO: 1991400 - RNA, 14 nt, Homo sapiens
agaaacuucccaag

SEQ ID NO: 1991401 - RNA, 13 nt, Homo sapiens
cccuucuucccua

SEQ ID NO: 1991402 - RNA, 13 nt, Homo sapiens
gcccucuugccca

SEQ ID NO: 1991403 - RNA, 22 nt, Homo sapiens
auuugguggacgagaaggugcu

SEQ ID NO: 1991404 - RNA, 21 nt, Homo sapiens
acuuuauaaauucauaacugg

SEQ ID NO: 1991405 - RNA, 18 nt, Homo sapiens
gccugugccugccuggga

SEQ ID NO: 1991406 - RNA, 19 nt, Homo sapiens
cugaguccagagcuugugc

SEQ ID NO: 1991407 - RNA, 13 nt, Homo sapiens
ucuauuucuauga

SEQ ID NO: 1991408 - RNA, 21 nt, Homo sapiens
uaccuauuuuguauguguaua

SEQ ID NO: 1991409 - RNA, 21 nt, Homo sapiens
gccagaauggcuguccuuguc

SEQ ID NO: 1991410 - RNA, 14 nt, Homo sapiens
gcauaugcagccaa

SEQ ID NO: 1991411 - RNA, 21 nt, Homo sapiens
cucauuccgagggugaaacaa

SEQ ID NO: 1991412 - RNA, 22 nt, Homo sapiens
acauccaucccuccauucaucc

SEQ ID NO: 1991413 - RNA, 14 nt, Homo sapiens
cacaucuggcucaa

SEQ ID NO: 1991414 - RNA, 14 nt, Homo sapiens
cuuugauaugacug

SEQ ID NO: 1991415 - RNA, 17 nt, Homo sapiens
ugaaaaacagaaagcau

SEQ ID NO: 1991416 - RNA, 23 nt, Homo sapiens
acauggcccccagaggcuuccag

SEQ ID NO: 1991417 - RNA, 14 nt, Homo sapiens
agccuccaacacaa

SEQ ID NO: 1991418 - RNA, 16 nt, Homo sapiens
acaauauacuuguaua

SEQ ID NO: 1991419 - RNA, 16 nt, Homo sapiens
cuaaccucacugccuc

SEQ ID NO: 1991420 - RNA, 22 nt, Homo sapiens
gagccaacugauuuuguaugua

SEQ ID NO: 1991421 - RNA, 21 nt, Homo sapiens
aaagccacuuucaaucuucaa

SEQ ID NO: 1991422 - RNA, 14 nt, Homo sapiens
cugucuuugcauaa

SEQ ID NO: 1991423 - RNA, 19 nt, Homo sapiens
gccccugcccacgcccuug

SEQ ID NO: 1991424 - RNA, 23 nt, Homo sapiens
ggagccucgguggccaugcuucu

SEQ ID NO: 1991425 - RNA, 16 nt, Homo sapiens
ugcagaugcuuugccc

SEQ ID NO: 1991426 - RNA, 15 nt, Homo sapiens
uugaacugguuguga

SEQ ID NO: 1991427 - RNA, 20 nt, Homo sapiens
caaaagcgaaacacacaaac

SEQ ID NO: 1991428 - RNA, 19 nt, Homo sapiens
cauguauuagccagucauu

SEQ ID NO: 1991429 - RNA, 19 nt, Homo sapiens
cagguauuuuuuuaaauca

SEQ ID NO: 1991430 - RNA, 12 nt, Homo sapiens
agaaccuacugu

SEQ ID NO: 1991431 - RNA, 23 nt, Homo sapiens
gcugucucaucacauaaaaggcu

SEQ ID NO: 1991432 - RNA, 14 nt, Homo sapiens
acucucacuaugcu

SEQ ID NO: 1991433 - RNA, 13 nt, Homo sapiens
ucaagacauuucu

SEQ ID NO: 1991434 - RNA, 17 nt, Homo sapiens
ugaucaccaagcaggaa

SEQ ID NO: 1991435 - RNA, 16 nt, Homo sapiens
aucaucaucauucuca

SEQ ID NO: 1991436 - RNA, 16 nt, Homo sapiens
uugucaaaaaguggau

SEQ ID NO: 1991437 - RNA, 12 nt, Homo sapiens
acacugugacuu

SEQ ID NO: 1991438 - RNA, 12 nt, Homo sapiens
auauugugauuc

SEQ ID NO: 1991439 - RNA, 12 nt, Homo sapiens
gcuuuguggcac

SEQ ID NO: 1991440 - RNA, 16 nt, Homo sapiens
ucaaugcuagcacaau

SEQ ID NO: 1991441 - RNA, 15 nt, Homo sapiens
uauugccugcuuuga

SEQ ID NO: 1991442 - RNA, 16 nt, Homo sapiens
ccccacuguccuguga

SEQ ID NO: 1991443 - RNA, 16 nt, Homo sapiens
uuccacuucuaugcaa

SEQ ID NO: 1991444 - RNA, 19 nt, Homo sapiens
uugaauuucugccaggcau

SEQ ID NO: 1991445 - RNA, 13 nt, Homo sapiens
aaaaggggcuccu

SEQ ID NO: 1991446 - RNA, 16 nt, Homo sapiens
acugggacguguauuu

SEQ ID NO: 1991447 - RNA, 18 nt, Homo sapiens
acugauuuuacaaauuaa

SEQ ID NO: 1991448 - RNA, 21 nt, Homo sapiens
aggaagaugaauccuagcuuc

SEQ ID NO: 1991449 - RNA, 13 nt, Homo sapiens
gaauccacacuuc

SEQ ID NO: 1991450 - RNA, 11 nt, Homo sapiens
aauguccuccg

SEQ ID NO: 1991451 - RNA, 11 nt, Homo sapiens
acuguccucag

SEQ ID NO: 1991452 - RNA, 22 nt, Homo sapiens
guagaaaauuuguuauuuugca

SEQ ID NO: 1991453 - RNA, 17 nt, Homo sapiens
gaggaaauccuaccuuu

SEQ ID NO: 1991454 - RNA, 17 nt, Homo sapiens
auuucuguuagcaauau

SEQ ID NO: 1991455 - RNA, 13 nt, Homo sapiens
agccagauucaaa

SEQ ID NO: 1991456 - RNA, 19 nt, Homo sapiens
aggaaaguuugccaggagg

SEQ ID NO: 1991457 - RNA, 15 nt, Homo sapiens
ucaaggaagucuuca

SEQ ID NO: 1991458 - RNA, 22 nt, Homo sapiens
ucuaaaagcguuggauguagca

SEQ ID NO: 1991459 - RNA, 23 nt, Homo sapiens
agucuuccaguuuaaugaacuac

SEQ ID NO: 1991460 - RNA, 20 nt, Homo sapiens
ucaggaaacgagacuuucca

SEQ ID NO: 1991461 - RNA, 20 nt, Homo sapiens
ccuggaguaacacaaaguga

SEQ ID NO: 1991462 - RNA, 18 nt, Homo sapiens
caaagaucaccagccaug

SEQ ID NO: 1991463 - RNA, 18 nt, Homo sapiens
cagguuggagugcagugg

SEQ ID NO: 1991464 - RNA, 22 nt, Homo sapiens
aaagucccagaucaagccugcc

SEQ ID NO: 1991465 - RNA, 20 nt, Homo sapiens
cauuagagggacagccaaaa

SEQ ID NO: 1991466 - RNA, 20 nt, Homo sapiens
cucucucuagaaugagcaag

SEQ ID NO: 1991467 - RNA, 20 nt, Homo sapiens
guuccuuccucugagccuug

SEQ ID NO: 1991468 - RNA, 11 nt, Homo sapiens
cucauuugcau

SEQ ID NO: 1991469 - RNA, 12 nt, Homo sapiens
uaauuugcacug

SEQ ID NO: 1991470 - RNA, 20 nt, Homo sapiens
uucugccugccuuccagcca

SEQ ID NO: 1991471 - RNA, 11 nt, Homo sapiens
gguuugcaguu

SEQ ID NO: 1991472 - RNA, 22 nt, Homo sapiens
uuuaauaaacacugacauuucc

SEQ ID NO: 1991473 - RNA, 13 nt, Homo sapiens
auugugcugccau

SEQ ID NO: 1991474 - RNA, 11 nt, Homo sapiens
uuggcauuucg

SEQ ID NO: 1991475 - RNA, 11 nt, Homo sapiens
uuugcauuucu

SEQ ID NO: 1991476 - RNA, 16 nt, Homo sapiens
uaaguuagacucuucc

SEQ ID NO: 1991477 - RNA, 14 nt, Homo sapiens
cuucuccuguucca

SEQ ID NO: 1991478 - RNA, 18 nt, Homo sapiens
aaggugggauucaugucg

SEQ ID NO: 1991479 - RNA, 13 nt, Homo sapiens
ugaaaagccaaau

SEQ ID NO: 1991480 - RNA, 18 nt, Homo sapiens
gacagucucccccaaaca

SEQ ID NO: 1991481 - RNA, 18 nt, Homo sapiens
ccauuuuccuaaccacaa

SEQ ID NO: 1991482 - RNA, 18 nt, Homo sapiens
cagagcgagaccgucuca

SEQ ID NO: 1991483 - RNA, 21 nt, Homo sapiens
uaucagugcuucccgagugag

SEQ ID NO: 1991484 - RNA, 16 nt, Homo sapiens
gauaaugauaguguuu

SEQ ID NO: 1991485 - RNA, 21 nt, Homo sapiens
uuccaaaccugacagauguca

SEQ ID NO: 1991486 - RNA, 21 nt, Homo sapiens
ggagaguaugguccucagauc

SEQ ID NO: 1991487 - RNA, 22 nt, Homo sapiens
uuuuuaaguuauuuuuacauuc

SEQ ID NO: 1991488 - RNA, 16 nt, Homo sapiens
guuaauaccagcuuaa

SEQ ID NO: 1991489 - RNA, 19 nt, Homo sapiens
ucugaaaauauaaccagcc

SEQ ID NO: 1991490 - RNA, 18 nt, Homo sapiens
auuagaggucuccaaaau

SEQ ID NO: 1991491 - RNA, 21 nt, Homo sapiens
uccauuccuaggucacuugaa

SEQ ID NO: 1991492 - RNA, 21 nt, Homo sapiens
auagaauuauuucacaaauaa

SEQ ID NO: 1991493 - RNA, 19 nt, Homo sapiens
aaugccccacauuuuacua

SEQ ID NO: 1991494 - RNA, 16 nt, Homo sapiens
guggcacucagucucu

SEQ ID NO: 1991495 - RNA, 21 nt, Homo sapiens
uaauuaaauccaacuuucaca

SEQ ID NO: 1991496 - RNA, 14 nt, Homo sapiens
uuacuuugugcaau

SEQ ID NO: 1991497 - RNA, 22 nt, Homo sapiens
uuccuauuguaaucgugugcca

SEQ ID NO: 1991498 - RNA, 18 nt, Homo sapiens
agaacacauaauucagga

SEQ ID NO: 1991499 - RNA, 22 nt, Homo sapiens
auauacauagucuuuguuuaca

SEQ ID NO: 1991500 - RNA, 17 nt, Homo sapiens
agcugggguggggaccu

SEQ ID NO: 1991501 - RNA, 22 nt, Homo sapiens
aaucauuccuuagauaccuuga

SEQ ID NO: 1991502 - RNA, 22 nt, Homo sapiens
uaacaaaaauaaaaacucuuau

SEQ ID NO: 1991503 - RNA, 20 nt, Homo sapiens
uccccuaacccuacaugcau

SEQ ID NO: 1991504 - RNA, 13 nt, Homo sapiens
cauuucuuugugc

SEQ ID NO: 1991505 - RNA, 17 nt, Homo sapiens
ucuuccaaaggcagcgu

SEQ ID NO: 1991506 - RNA, 20 nt, Homo sapiens
agagccagccagcauggcca

SEQ ID NO: 1991507 - RNA, 19 nt, Homo sapiens
acccguuuuauucuauucc

SEQ ID NO: 1991508 - RNA, 20 nt, Homo sapiens
cuuaauggacgaagcaacaa

SEQ ID NO: 1991509 - RNA, 17 nt, Homo sapiens
gcucugaauaguuaaaa

SEQ ID NO: 1991510 - RNA, 14 nt, Homo sapiens
acucaaucauuucu

SEQ ID NO: 1991511 - RNA, 14 nt, Homo sapiens
auuucuucacucaa

SEQ ID NO: 1991512 - RNA, 17 nt, Homo sapiens
uugguuagugacugaug

SEQ ID NO: 1991513 - RNA, 15 nt, Homo sapiens
agcauugggugcaaa

SEQ ID NO: 1991514 - RNA, 16 nt, Homo sapiens
caucuacaaucaggag

SEQ ID NO: 1991515 - RNA, 17 nt, Homo sapiens
guauguguaagaucuga

SEQ ID NO: 1991516 - RNA, 18 nt, Homo sapiens
uuuguuucuuucauauga

SEQ ID NO: 1991517 - RNA, 23 nt, Homo sapiens
auuagccaagugugguagagugu

SEQ ID NO: 1991518 - RNA, 23 nt, Homo sapiens
aggauaacuggcacccagagaaa

SEQ ID NO: 1991519 - RNA, 23 nt, Homo sapiens
aggaggcgcagcccgaagcccag

SEQ ID NO: 1991520 - RNA, 17 nt, Homo sapiens
ccccauaaaaugauccu

SEQ ID NO: 1991521 - RNA, 18 nt, Homo sapiens
acugugugccuucugcca

SEQ ID NO: 1991522 - RNA, 20 nt, Homo sapiens
agggccugcagugauucagc

SEQ ID NO: 1991523 - RNA, 14 nt, Homo sapiens
caacuuccuuugac

SEQ ID NO: 1991524 - RNA, 19 nt, Homo sapiens
acgacagaagguugccagg

SEQ ID NO: 1991525 - RNA, 22 nt, Homo sapiens
uggauuuaaaagccugcucaau

SEQ ID NO: 1991526 - RNA, 13 nt, Homo sapiens
cucugguggcaca

SEQ ID NO: 1991527 - RNA, 22 nt, Homo sapiens
ucuauacuuaaucucacauuca

SEQ ID NO: 1991528 - RNA, 15 nt, Homo sapiens
cuaaagaacauaccu

SEQ ID NO: 1991529 - RNA, 19 nt, Homo sapiens
ccauuggacagauuucagu

SEQ ID NO: 1991530 - RNA, 15 nt, Homo sapiens
uguaaggccuuucaa

SEQ ID NO: 1991531 - RNA, 18 nt, Homo sapiens
uccacagaaauacaugaa

SEQ ID NO: 1991532 - RNA, 18 nt, Homo sapiens
aaagaggggaagagacuu

SEQ ID NO: 1991533 - RNA, 19 nt, Homo sapiens
cuucauuucauccuguugg

SEQ ID NO: 1991534 - RNA, 22 nt, Homo sapiens
uauguacaggacauguacugag

SEQ ID NO: 1991535 - RNA, 19 nt, Homo sapiens
augauucaaauugcugcuu

SEQ ID NO: 1991536 - RNA, 22 nt, Homo sapiens
gucuccaagaauguuuugcuag

SEQ ID NO: 1991537 - RNA, 13 nt, Homo sapiens
cuuuauauaccuu

SEQ ID NO: 1991538 - RNA, 19 nt, Homo sapiens
ugaagcauaauuuguuuaa

SEQ ID NO: 1991539 - RNA, 12 nt, Homo sapiens
agccucagcuca

SEQ ID NO: 1991540 - RNA, 18 nt, Homo sapiens
caaccugauuacagaaua

SEQ ID NO: 1991541 - RNA, 18 nt, Homo sapiens
uacauaaaguacauaaca

SEQ ID NO: 1991542 - RNA, 15 nt, Homo sapiens
gaauaaccugcacag

SEQ ID NO: 1991543 - RNA, 23 nt, Homo sapiens
ccuuguucgccuccccacccucc

SEQ ID NO: 1991544 - RNA, 14 nt, Homo sapiens
aagucuacacugcc

SEQ ID NO: 1991545 - RNA, 16 nt, Homo sapiens
aguauuguccauauca

SEQ ID NO: 1991546 - RNA, 14 nt, Homo sapiens
ugcauuguauuuag

SEQ ID NO: 1991547 - RNA, 17 nt, Homo sapiens
acaucuuaguugaugcu

SEQ ID NO: 1991548 - RNA, 13 nt, Homo sapiens
uaaacacugaugg

SEQ ID NO: 1991549 - RNA, 15 nt, Homo sapiens
caguucucuguggaa

SEQ ID NO: 1991550 - RNA, 18 nt, Homo sapiens
gcuccccgugagcacugc

SEQ ID NO: 1991551 - RNA, 16 nt, Homo sapiens
aauuaaaacaugcaca

SEQ ID NO: 1991552 - RNA, 21 nt, Homo sapiens
agaauccagcuacgaauauag

SEQ ID NO: 1991553 - RNA, 16 nt, Homo sapiens
ucauucugcuacuuca

SEQ ID NO: 1991554 - RNA, 15 nt, Homo sapiens
gcaaugaaaccaaag

SEQ ID NO: 1991555 - RNA, 16 nt, Homo sapiens
caggaauuacacugug

SEQ ID NO: 1991556 - RNA, 13 nt, Homo sapiens
caaucaaccaaag

SEQ ID NO: 1991557 - RNA, 13 nt, Homo sapiens
gcuuugauauuuc

SEQ ID NO: 1991558 - RNA, 20 nt, Homo sapiens
ucuaaucuauaugauaugca

SEQ ID NO: 1991559 - RNA, 12 nt, Homo sapiens
cuugaccaaagc

SEQ ID NO: 1991560 - RNA, 20 nt, Homo sapiens
caugugugacugcgcacuga

SEQ ID NO: 1991561 - RNA, 16 nt, Homo sapiens
accucucccugacccu

SEQ ID NO: 1991562 - RNA, 20 nt, Homo sapiens
cgugcucccgaugcugcuau

SEQ ID NO: 1991563 - RNA, 18 nt, Homo sapiens
ucacuggggaugguggca

SEQ ID NO: 1991564 - RNA, 11 nt, Homo sapiens
cucagugcagg

SEQ ID NO: 1991565 - RNA, 17 nt, Homo sapiens
uucacuguccauuccaa

SEQ ID NO: 1991566 - RNA, 22 nt, Homo sapiens
cucugacaguccacaggggcca

SEQ ID NO: 1991567 - RNA, 17 nt, Homo sapiens
cccaaguagcugagauu

SEQ ID NO: 1991568 - RNA, 20 nt, Homo sapiens
ggaauuuccucccaauucau

SEQ ID NO: 1991569 - RNA, 14 nt, Homo sapiens
uggguccaggggau

SEQ ID NO: 1991570 - RNA, 15 nt, Homo sapiens
acuggaguucacuuu

SEQ ID NO: 1991571 - RNA, 19 nt, Homo sapiens
cuugcuaccucagucagua

SEQ ID NO: 1991572 - RNA, 20 nt, Homo sapiens
cacagcgagacuccgucuca

SEQ ID NO: 1991573 - RNA, 23 nt, Homo sapiens
ugucuuacagagaaaagacauaa

SEQ ID NO: 1991574 - RNA, 17 nt, Homo sapiens
cucaacauuacauuuga

SEQ ID NO: 1991575 - RNA, 15 nt, Homo sapiens
gcaccuguaauccca

SEQ ID NO: 1991576 - RNA, 19 nt, Homo sapiens
ucucugucagugugaaaau

SEQ ID NO: 1991577 - RNA, 20 nt, Homo sapiens
cuuaagggguaucauguaug

SEQ ID NO: 1991578 - RNA, 19 nt, Homo sapiens
guuuauugucaaaguggug

SEQ ID NO: 1991579 - RNA, 16 nt, Homo sapiens
uuuuugaaaagcuaau

SEQ ID NO: 1991580 - RNA, 16 nt, Homo sapiens
auugaaaccauugugg

SEQ ID NO: 1991581 - RNA, 15 nt, Homo sapiens
auaucauacuuccau

SEQ ID NO: 1991582 - RNA, 15 nt, Homo sapiens
ugguggaucugucca

SEQ ID NO: 1991583 - RNA, 16 nt, Homo sapiens
ucaaaacacccaaaaa

SEQ ID NO: 1991584 - RNA, 14 nt, Homo sapiens
ucucgaacaguauu

SEQ ID NO: 1991585 - RNA, 14 nt, Homo sapiens
cucuaaagaccaaa

SEQ ID NO: 1991586 - RNA, 14 nt, Homo sapiens
ccagaggcuuuaaa

SEQ ID NO: 1991587 - RNA, 12 nt, Homo sapiens
uuucauagcaaa

SEQ ID NO: 1991588 - RNA, 16 nt, Homo sapiens
agacccacuggacuca

SEQ ID NO: 1991589 - RNA, 20 nt, Homo sapiens
caaugugacauguugcucuu

SEQ ID NO: 1991590 - RNA, 15 nt, Homo sapiens
aggcuggcuuguccc

SEQ ID NO: 1991591 - RNA, 18 nt, Homo sapiens
cuucaggcagcugaaauu

SEQ ID NO: 1991592 - RNA, 14 nt, Homo sapiens
cugggggccagcuc

SEQ ID NO: 1991593 - RNA, 17 nt, Homo sapiens
uccaauuccugaucacc

SEQ ID NO: 1991594 - RNA, 13 nt, Homo sapiens
ccaggaacugccu

SEQ ID NO: 1991595 - RNA, 23 nt, Homo sapiens
aguuuuagcuguagaucaagcua

SEQ ID NO: 1991596 - RNA, 23 nt, Homo sapiens
acccaggucugcugcccaggaac

SEQ ID NO: 1991597 - RNA, 17 nt, Homo sapiens
augggaaaagagucucu

SEQ ID NO: 1991598 - RNA, 13 nt, Homo sapiens
cacagcacccagg

SEQ ID NO: 1991599 - RNA, 20 nt, Homo sapiens
uuugcaacaauaaaguacuu

SEQ ID NO: 1991600 - RNA, 22 nt, Homo sapiens
aaugacaucauguuagucuuug

SEQ ID NO: 1991601 - RNA, 16 nt, Homo sapiens
uccaggucuugacuca

SEQ ID NO: 1991602 - RNA, 21 nt, Homo sapiens
cuccuugcccucaagcaauau

SEQ ID NO: 1991603 - RNA, 12 nt, Homo sapiens
ugaaaaccuguc

SEQ ID NO: 1991604 - RNA, 19 nt, Homo sapiens
gaucuuucuuuccaaaaca

SEQ ID NO: 1991605 - RNA, 17 nt, Homo sapiens
ggaggcagccggccaag

SEQ ID NO: 1991606 - RNA, 17 nt, Homo sapiens
ccaucggggggugggag

SEQ ID NO: 1991607 - RNA, 15 nt, Homo sapiens
uaaauacagucuucc

SEQ ID NO: 1991608 - RNA, 20 nt, Homo sapiens
caugguguggccaucacuca

SEQ ID NO: 1991609 - RNA, 14 nt, Homo sapiens
cucaggacugcuga

SEQ ID NO: 1991610 - RNA, 14 nt, Homo sapiens
cuuuagacuguaaa

SEQ ID NO: 1991611 - RNA, 20 nt, Homo sapiens
auggacucgcuagugauuaa

SEQ ID NO: 1991612 - RNA, 22 nt, Homo sapiens
ugagcuggauggguacagcuua

SEQ ID NO: 1991613 - RNA, 15 nt, Homo sapiens
ggcaacccaccaucu

SEQ ID NO: 1991614 - RNA, 16 nt, Homo sapiens
uucauuagacacuuaa

SEQ ID NO: 1991615 - RNA, 13 nt, Homo sapiens
cccuggcaggcag

SEQ ID NO: 1991616 - RNA, 16 nt, Homo sapiens
ggcggcccugaccaau

SEQ ID NO: 1991617 - RNA, 21 nt, Homo sapiens
cucuggaagccucuauugcca

SEQ ID NO: 1991618 - RNA, 17 nt, Homo sapiens
gauaaguugugauuuga

SEQ ID NO: 1991619 - RNA, 18 nt, Homo sapiens
aucccucugucaggguca

SEQ ID NO: 1991620 - RNA, 16 nt, Homo sapiens
agacaggcccaagaga

SEQ ID NO: 1991621 - RNA, 13 nt, Homo sapiens
uuauggacaggau

SEQ ID NO: 1991622 - RNA, 18 nt, Homo sapiens
cgaaccccccacucccug

SEQ ID NO: 1991623 - RNA, 18 nt, Homo sapiens
acuccuucaauauuucua

SEQ ID NO: 1991624 - RNA, 13 nt, Homo sapiens
uccuguuacuuaa

SEQ ID NO: 1991625 - RNA, 14 nt, Homo sapiens
acaggaggggccca

SEQ ID NO: 1991626 - RNA, 12 nt, Homo sapiens
gcugcaaccucc

SEQ ID NO: 1991627 - RNA, 22 nt, Homo sapiens
aggaccucagcuugcacaaaga

SEQ ID NO: 1991628 - RNA, 15 nt, Homo sapiens
ugauuguuugacaca

SEQ ID NO: 1991629 - RNA, 21 nt, Homo sapiens
ugaggacugaauuacucucca

SEQ ID NO: 1991630 - RNA, 18 nt, Homo sapiens
aucccuuaacaguuguau

SEQ ID NO: 1991631 - RNA, 16 nt, Homo sapiens
uggggcgacugugaaa

SEQ ID NO: 1991632 - RNA, 18 nt, Homo sapiens
aucuggaggcucccaugg

SEQ ID NO: 1991633 - RNA, 19 nt, Homo sapiens
aaacagguuuuuaguuugu

SEQ ID NO: 1991634 - RNA, 16 nt, Homo sapiens
ugcacucuaaacugca

SEQ ID NO: 1991635 - RNA, 14 nt, Homo sapiens
uuccuccuuauccu

SEQ ID NO: 1991636 - RNA, 18 nt, Homo sapiens
aaacuaaaugacuuucaa

SEQ ID NO: 1991637 - RNA, 20 nt, Homo sapiens
accuaacugugaacaaucag

SEQ ID NO: 1991638 - RNA, 21 nt, Homo sapiens
gaaucagugaagccaaaggga

SEQ ID NO: 1991639 - RNA, 22 nt, Homo sapiens
caaucuuaaugucucuucauaa

SEQ ID NO: 1991640 - RNA, 20 nt, Homo sapiens
ugacccacucacacuuggag

SEQ ID NO: 1991641 - RNA, 11 nt, Homo sapiens
aucugagcucc

SEQ ID NO: 1991642 - RNA, 17 nt, Homo sapiens
guauuauaauaagcaaa

SEQ ID NO: 1991643 - RNA, 17 nt, Homo sapiens
ugccuaugaaauuucaa

SEQ ID NO: 1991644 - RNA, 19 nt, Homo sapiens
cugccuucugucucuugca

SEQ ID NO: 1991645 - RNA, 14 nt, Homo sapiens
aaguguuccuucau

SEQ ID NO: 1991646 - RNA, 14 nt, Homo sapiens
agacuucaucccuc

SEQ ID NO: 1991647 - RNA, 15 nt, Homo sapiens
gccuggccaccagcc

SEQ ID NO: 1991648 - RNA, 16 nt, Homo sapiens
caaugggagccucaua

SEQ ID NO: 1991649 - RNA, 13 nt, Homo sapiens
uugguaagagaca

SEQ ID NO: 1991650 - RNA, 20 nt, Homo sapiens
ccgguugcagucacugugau

SEQ ID NO: 1991651 - RNA, 17 nt, Homo sapiens
gccuugggggugugaug

SEQ ID NO: 1991652 - RNA, 21 nt, Homo sapiens
uccuggaaccaggcuugccug

SEQ ID NO: 1991653 - RNA, 13 nt, Homo sapiens
cacucugccaucc

SEQ ID NO: 1991654 - RNA, 13 nt, Homo sapiens
caguacaugggaa

SEQ ID NO: 1991655 - RNA, 16 nt, Homo sapiens
cucacaugugacaaag

SEQ ID NO: 1991656 - RNA, 23 nt, Homo sapiens
gagaaacgaaaaccacaaaaaga

SEQ ID NO: 1991657 - RNA, 14 nt, Homo sapiens
guguguguguauau

SEQ ID NO: 1991658 - RNA, 14 nt, Homo sapiens
gcgcgcgugcacac

SEQ ID NO: 1991659 - RNA, 15 nt, Homo sapiens
uaaaagaauuacaua

SEQ ID NO: 1991660 - RNA, 17 nt, Homo sapiens
ugccagaggcuggacca

SEQ ID NO: 1991661 - RNA, 22 nt, Homo sapiens
aguagguuuacauucaucucau

SEQ ID NO: 1991662 - RNA, 19 nt, Homo sapiens
ccugugagccggagcucau

SEQ ID NO: 1991663 - RNA, 19 nt, Homo sapiens
gccaauggacaagcagugu

SEQ ID NO: 1991664 - RNA, 16 nt, Homo sapiens
auuauacguacauaca

SEQ ID NO: 1991665 - RNA, 20 nt, Homo sapiens
aggucuguuuaaaguggcaa

SEQ ID NO: 1991666 - RNA, 18 nt, Homo sapiens
agcugacauauacugggu

SEQ ID NO: 1991667 - RNA, 14 nt, Homo sapiens
acuguacauuguga

SEQ ID NO: 1991668 - RNA, 22 nt, Homo sapiens
auuucucucagauuuccacaga

SEQ ID NO: 1991669 - RNA, 14 nt, Homo sapiens
auacuuucagucaa

SEQ ID NO: 1991670 - RNA, 18 nt, Homo sapiens
aaauuuuucuaguauaua

SEQ ID NO: 1991671 - RNA, 19 nt, Homo sapiens
guuaguggauaaccacagg

SEQ ID NO: 1991672 - RNA, 18 nt, Homo sapiens
cgggagccugacccucau

SEQ ID NO: 1991673 - RNA, 14 nt, Homo sapiens
aaaguguguauuua

SEQ ID NO: 1991674 - RNA, 14 nt, Homo sapiens
gacccuggagcuag

SEQ ID NO: 1991675 - RNA, 14 nt, Homo sapiens
agacagggucucau

SEQ ID NO: 1991676 - RNA, 14 nt, Homo sapiens
agugauggucagag

SEQ ID NO: 1991677 - RNA, 15 nt, Homo sapiens
aagaaaauuaguaau

SEQ ID NO: 1991678 - RNA, 19 nt, Homo sapiens
gcaggaagcucagacuggu

SEQ ID NO: 1991679 - RNA, 13 nt, Homo sapiens
caauucuucuucc

SEQ ID NO: 1991680 - RNA, 18 nt, Homo sapiens
ccugggagccagggugag

SEQ ID NO: 1991681 - RNA, 21 nt, Homo sapiens
cauagagggagaggaagcaca

SEQ ID NO: 1991682 - RNA, 14 nt, Homo sapiens
cuuaauucugaugc

SEQ ID NO: 1991683 - RNA, 13 nt, Homo sapiens
cugccuugccaug

SEQ ID NO: 1991684 - RNA, 13 nt, Homo sapiens
ccauguugcugcc

SEQ ID NO: 1991685 - RNA, 22 nt, Homo sapiens
agcauugccauaccauucccau

SEQ ID NO: 1991686 - RNA, 22 nt, Homo sapiens
uuuauuucugguaacucacuca

SEQ ID NO: 1991687 - RNA, 22 nt, Homo sapiens
aucagggacuugaaugcacuuu

SEQ ID NO: 1991688 - RNA, 16 nt, Homo sapiens
acagccuugcaaccca

SEQ ID NO: 1991689 - RNA, 16 nt, Homo sapiens
augauugugcacauac

SEQ ID NO: 1991690 - RNA, 18 nt, Homo sapiens
ucuccuccaacccaaccu

SEQ ID NO: 1991691 - RNA, 19 nt, Homo sapiens
aguuuauacuucucuauua

SEQ ID NO: 1991692 - RNA, 18 nt, Homo sapiens
ccucugccuuugugcucu

SEQ ID NO: 1991693 - RNA, 15 nt, Homo sapiens
gccugcuggggaccu

SEQ ID NO: 1991694 - RNA, 15 nt, Homo sapiens
acuuucaaacauaua

SEQ ID NO: 1991695 - RNA, 18 nt, Homo sapiens
agaaguugacaggcagug

SEQ ID NO: 1991696 - RNA, 23 nt, Homo sapiens
ucaccccggcaggcccugcagug

SEQ ID NO: 1991697 - RNA, 18 nt, Homo sapiens
ugcuauacacaagcaaug

SEQ ID NO: 1991698 - RNA, 22 nt, Homo sapiens
ggacugggugcauaucuuccca

SEQ ID NO: 1991699 - RNA, 12 nt, Homo sapiens
acagaauggauu

SEQ ID NO: 1991700 - RNA, 15 nt, Homo sapiens
ggugugaaagucaga

SEQ ID NO: 1991701 - RNA, 13 nt, Homo sapiens
aguuaauucucac

SEQ ID NO: 1991702 - RNA, 15 nt, Homo sapiens
ggauuacuuuggcca

SEQ ID NO: 1991703 - RNA, 16 nt, Homo sapiens
gacacuguugcaaagg

SEQ ID NO: 1991704 - RNA, 21 nt, Homo sapiens
uuaaauguagaaagugaucca

SEQ ID NO: 1991705 - RNA, 15 nt, Homo sapiens
cauauuuucaugcug

SEQ ID NO: 1991706 - RNA, 18 nt, Homo sapiens
ggugacguagaauugagu

SEQ ID NO: 1991707 - RNA, 18 nt, Homo sapiens
ucugcucccauccaagaa

SEQ ID NO: 1991708 - RNA, 18 nt, Homo sapiens
cuucaaaucaaucuguaa

SEQ ID NO: 1991709 - RNA, 12 nt, Homo sapiens
cgugcccugcuc

SEQ ID NO: 1991710 - RNA, 11 nt, Homo sapiens
agaacacaaga

SEQ ID NO: 1991711 - RNA, 14 nt, Homo sapiens
gagauacugcaugu

SEQ ID NO: 1991712 - RNA, 19 nt, Homo sapiens
uuuaaggcaggacagagaa

SEQ ID NO: 1991713 - RNA, 15 nt, Homo sapiens
aaaaaggucuuuaaa

SEQ ID NO: 1991714 - RNA, 21 nt, Homo sapiens
cgguaagcacuuaaugaauga

SEQ ID NO: 1991715 - RNA, 18 nt, Homo sapiens
uugucugccauugaucca

SEQ ID NO: 1991716 - RNA, 19 nt, Homo sapiens
cugguccccuccucaguga

SEQ ID NO: 1991717 - RNA, 21 nt, Homo sapiens
gagugggguuuucuugaacau

SEQ ID NO: 1991718 - RNA, 23 nt, Homo sapiens
caagguaacuguacugggccaug

SEQ ID NO: 1991719 - RNA, 14 nt, Homo sapiens
agggaaaaauggga

SEQ ID NO: 1991720 - RNA, 14 nt, Homo sapiens
aagugcuccugaaa

SEQ ID NO: 1991721 - RNA, 19 nt, Homo sapiens
ccauguccuccuagaguuu

SEQ ID NO: 1991722 - RNA, 22 nt, Homo sapiens
ugugguuaaugccauggacaga

SEQ ID NO: 1991723 - RNA, 11 nt, Homo sapiens
acuagaucucc

SEQ ID NO: 1991724 - RNA, 15 nt, Homo sapiens
aacccucacacugcu

SEQ ID NO: 1991725 - RNA, 18 nt, Homo sapiens
gucaauaaauuugcaaau

SEQ ID NO: 1991726 - RNA, 13 nt, Homo sapiens
acagugauaagua

SEQ ID NO: 1991727 - RNA, 21 nt, Homo sapiens
ccuccuaggcucccugaggua

SEQ ID NO: 1991728 - RNA, 15 nt, Homo sapiens
gcuccaacuccauac

SEQ ID NO: 1991729 - RNA, 20 nt, Homo sapiens
acagcgagacuccgucucaa

SEQ ID NO: 1991730 - RNA, 17 nt, Homo sapiens
augucaaacgccuugaa

SEQ ID NO: 1991731 - RNA, 18 nt, Homo sapiens
auuaggcagacucuuuau

SEQ ID NO: 1991732 - RNA, 18 nt, Homo sapiens
ucccuaacuguucccuua

SEQ ID NO: 1991733 - RNA, 20 nt, Homo sapiens
cggaaugaaccacaucuugc

SEQ ID NO: 1991734 - RNA, 23 nt, Homo sapiens
uuuguaaaaagcuucauucucac

SEQ ID NO: 1991735 - RNA, 23 nt, Homo sapiens
aaacagcuccucuauauuuccac

SEQ ID NO: 1991736 - RNA, 14 nt, Homo sapiens
cccccagcuucugc

SEQ ID NO: 1991737 - RNA, 21 nt, Homo sapiens
aucacaaacugaaugacuuga

SEQ ID NO: 1991738 - RNA, 14 nt, Homo sapiens
uuaauuuagcuuag

SEQ ID NO: 1991739 - RNA, 13 nt, Homo sapiens
aggcugugcugcc

SEQ ID NO: 1991740 - RNA, 14 nt, Homo sapiens
aaagacuccaaaga

SEQ ID NO: 1991741 - RNA, 18 nt, Homo sapiens
auucuggaccucuggguu

SEQ ID NO: 1991742 - RNA, 18 nt, Homo sapiens
aauauaugucuauauaca

SEQ ID NO: 1991743 - RNA, 21 nt, Homo sapiens
gauauccaguaagcacauguu

SEQ ID NO: 1991744 - RNA, 20 nt, Homo sapiens
caaaugccuucuguuuucca

SEQ ID NO: 1991745 - RNA, 14 nt, Homo sapiens
ucuuaacaaacucu

SEQ ID NO: 1991746 - RNA, 24 nt, Homo sapiens
agcaacagauggauagucugucca

SEQ ID NO: 1991747 - RNA, 16 nt, Homo sapiens
aucucacaagcacuuu

SEQ ID NO: 1991748 - RNA, 19 nt, Homo sapiens
aggccccaguuauugugaa

SEQ ID NO: 1991749 - RNA, 22 nt, Homo sapiens
aacaggugucagagcugaaauu

SEQ ID NO: 1991750 - RNA, 23 nt, Homo sapiens
ugggcaaagagauuaaaaugaca

SEQ ID NO: 1991751 - RNA, 12 nt, Homo sapiens
aguuuacaauau

SEQ ID NO: 1991752 - RNA, 20 nt, Homo sapiens
cagaagcaggguacccuuug

SEQ ID NO: 1991753 - RNA, 22 nt, Homo sapiens
guugaaaaccacagucagugga

SEQ ID NO: 1991754 - RNA, 14 nt, Homo sapiens
gcaacaaacaauau

SEQ ID NO: 1991755 - RNA, 14 nt, Homo sapiens
cuaugugcuccuaa

SEQ ID NO: 1991756 - RNA, 18 nt, Homo sapiens
aagguuucacuguucaug

SEQ ID NO: 1991757 - RNA, 20 nt, Homo sapiens
cauauuuuccuuuagaucaa

SEQ ID NO: 1991758 - RNA, 18 nt, Homo sapiens
gaaauaaagcguccucuc

SEQ ID NO: 1991759 - RNA, 16 nt, Homo sapiens
ggacucuuaaggcauu

SEQ ID NO: 1991760 - RNA, 19 nt, Homo sapiens
acugaugcgaaaacuugaa

SEQ ID NO: 1991761 - RNA, 18 nt, Homo sapiens
cuccuccugcucugccca

SEQ ID NO: 1991762 - RNA, 22 nt, Homo sapiens
cagaugguuuuauaaucugauu

SEQ ID NO: 1991763 - RNA, 18 nt, Homo sapiens
agcaccuccagccugaac

SEQ ID NO: 1991764 - RNA, 18 nt, Homo sapiens
aucuucggggugugauga

SEQ ID NO: 1991765 - RNA, 22 nt, Homo sapiens
ugaguuuuguuucacuuugaca

SEQ ID NO: 1991766 - RNA, 14 nt, Homo sapiens
aguugugcaugccc

SEQ ID NO: 1991767 - RNA, 14 nt, Homo sapiens
uugugagucuucac

SEQ ID NO: 1991768 - RNA, 15 nt, Homo sapiens
aagaggaagugcacu

SEQ ID NO: 1991769 - RNA, 13 nt, Homo sapiens
agcccacauccca

SEQ ID NO: 1991770 - RNA, 17 nt, Homo sapiens
cauuaggaagauaucau

SEQ ID NO: 1991771 - RNA, 18 nt, Homo sapiens
caccgaccaacuccagac

SEQ ID NO: 1991772 - RNA, 13 nt, Homo sapiens
ccucaugcccagc

SEQ ID NO: 1991773 - RNA, 22 nt, Homo sapiens
ggcugccgcauuccugcacuca

SEQ ID NO: 1991774 - RNA, 15 nt, Homo sapiens
uccacucuccuugcu

SEQ ID NO: 1991775 - RNA, 15 nt, Homo sapiens
cagauucuucagcuu

SEQ ID NO: 1991776 - RNA, 14 nt, Homo sapiens
aggcugggccgcaa

SEQ ID NO: 1991777 - RNA, 17 nt, Homo sapiens
ccacucaguuguuccua

SEQ ID NO: 1991778 - RNA, 10 nt, Homo sapiens
cuucuuuaaa

SEQ ID NO: 1991779 - RNA, 16 nt, Homo sapiens
cucacucuguugcuca

SEQ ID NO: 1991780 - RNA, 20 nt, Homo sapiens
uaucagucuuucuugagcag

SEQ ID NO: 1991781 - RNA, 23 nt, Homo sapiens
agccaucaaauagugaauggucu

SEQ ID NO: 1991782 - RNA, 14 nt, Homo sapiens
auuugcauggauuu

SEQ ID NO: 1991783 - RNA, 14 nt, Homo sapiens
auauucaugguugu

SEQ ID NO: 1991784 - RNA, 20 nt, Homo sapiens
gccuucauaagccuaccaau

SEQ ID NO: 1991785 - RNA, 21 nt, Homo sapiens
aaaauggcaaagaauucaaac

SEQ ID NO: 1991786 - RNA, 21 nt, Homo sapiens
agugucuuuuuuuucuucacc

SEQ ID NO: 1991787 - RNA, 16 nt, Homo sapiens
ggaaugguucucucaa

SEQ ID NO: 1991788 - RNA, 17 nt, Homo sapiens
guuuguuauaucaggga

SEQ ID NO: 1991789 - RNA, 15 nt, Homo sapiens
ugugcucuacuguua

SEQ ID NO: 1991790 - RNA, 14 nt, Homo sapiens
gacaacgaugaauu

SEQ ID NO: 1991791 - RNA, 20 nt, Homo sapiens
uguguguccacacauacaua

SEQ ID NO: 1991792 - RNA, 14 nt, Homo sapiens
cucaagguuuuagg

SEQ ID NO: 1991793 - RNA, 19 nt, Homo sapiens
cugacaauaaaggaacuaa

SEQ ID NO: 1991794 - RNA, 14 nt, Homo sapiens
uuuuuguacuugga

SEQ ID NO: 1991795 - RNA, 18 nt, Homo sapiens
acuuuuaaguuuccuucc

SEQ ID NO: 1991796 - RNA, 19 nt, Homo sapiens
acucaugaggcugaggcag

SEQ ID NO: 1991797 - RNA, 21 nt, Homo sapiens
gcacaguucaugguuuccucc

SEQ ID NO: 1991798 - RNA, 18 nt, Homo sapiens
caugugacacauaugcac

SEQ ID NO: 1991799 - RNA, 16 nt, Homo sapiens
ucuggucccagcaucc

SEQ ID NO: 1991800 - RNA, 18 nt, Homo sapiens
uauaaauacguauuacaa

SEQ ID NO: 1991801 - RNA, 19 nt, Homo sapiens
uaaguuacacauuuuucag

SEQ ID NO: 1991802 - RNA, 16 nt, Homo sapiens
ccaaugcacacaguag

SEQ ID NO: 1991803 - RNA, 14 nt, Homo sapiens
augaaccagaguuu

SEQ ID NO: 1991804 - RNA, 15 nt, Homo sapiens
uaacucuagaauuug

SEQ ID NO: 1991805 - RNA, 21 nt, Homo sapiens
cauuuacaacucauuccagau

SEQ ID NO: 1991806 - RNA, 20 nt, Homo sapiens
uugcuuuaaaguaccuguag

SEQ ID NO: 1991807 - RNA, 16 nt, Homo sapiens
gaggaagaaaaccagc

SEQ ID NO: 1991808 - RNA, 22 nt, Homo sapiens
cagaagggugugggccaccaga

SEQ ID NO: 1991809 - RNA, 23 nt, Homo sapiens
auucugauucuuuuuuaugcaga

SEQ ID NO: 1991810 - RNA, 20 nt, Homo sapiens
guauuguuuuccagugucac

SEQ ID NO: 1991811 - RNA, 15 nt, Homo sapiens
auuuguagcaauuua

SEQ ID NO: 1991812 - RNA, 16 nt, Homo sapiens
auauuuaaguauucaa

SEQ ID NO: 1991813 - RNA, 11 nt, Homo sapiens
aauguuugcau

SEQ ID NO: 1991814 - RNA, 17 nt, Homo sapiens
agcuagaacuucucuaa

SEQ ID NO: 1991815 - RNA, 21 nt, Homo sapiens
uaaacuguacagaauuuccac

SEQ ID NO: 1991816 - RNA, 16 nt, Homo sapiens
ccgggcugcugcugau

SEQ ID NO: 1991817 - RNA, 22 nt, Homo sapiens
aguuuaaggaauaugggagaaa

SEQ ID NO: 1991818 - RNA, 16 nt, Homo sapiens
guuccagauggggccu

SEQ ID NO: 1991819 - RNA, 18 nt, Homo sapiens
acgcacgauaucuaguga

SEQ ID NO: 1991820 - RNA, 11 nt, Homo sapiens
gcugcacagua

SEQ ID NO: 1991821 - RNA, 17 nt, Homo sapiens
ucagaguaauccaagca

SEQ ID NO: 1991822 - RNA, 23 nt, Homo sapiens
acuuccagugcaacacugaagcu

SEQ ID NO: 1991823 - RNA, 20 nt, Homo sapiens
uucucaggaggugucuccua

SEQ ID NO: 1991824 - RNA, 17 nt, Homo sapiens
caaucagugcuccugua

SEQ ID NO: 1991825 - RNA, 17 nt, Homo sapiens
cauucuggacaccaggg

SEQ ID NO: 1991826 - RNA, 23 nt, Homo sapiens
uuuugugaucuguaacaggguag

SEQ ID NO: 1991827 - RNA, 16 nt, Homo sapiens
agccgacaacagagac

SEQ ID NO: 1991828 - RNA, 16 nt, Homo sapiens
aacccccugacauuau

SEQ ID NO: 1991829 - RNA, 16 nt, Homo sapiens
caugcucuuaaaacuu

SEQ ID NO: 1991830 - RNA, 14 nt, Homo sapiens
uaagauuuaauugu

SEQ ID NO: 1991831 - RNA, 23 nt, Homo sapiens
gaaagguacuucaaauccuugaa

SEQ ID NO: 1991832 - RNA, 21 nt, Homo sapiens
uacagcaacaggaaucucaga

SEQ ID NO: 1991833 - RNA, 15 nt, Homo sapiens
aaugaggacauguuu

SEQ ID NO: 1991834 - RNA, 15 nt, Homo sapiens
uuuuccaacaggggc

SEQ ID NO: 1991835 - RNA, 14 nt, Homo sapiens
agcugccugggaag

SEQ ID NO: 1991836 - RNA, 18 nt, Homo sapiens
gcaccccuccuccuugcu

SEQ ID NO: 1991837 - RNA, 18 nt, Homo sapiens
gaugaggggccacugacc

SEQ ID NO: 1991838 - RNA, 14 nt, Homo sapiens
ugguguauuugcca

SEQ ID NO: 1991839 - RNA, 14 nt, Homo sapiens
cuucauccagauga

SEQ ID NO: 1991840 - RNA, 14 nt, Homo sapiens
ugccauaugccuug

SEQ ID NO: 1991841 - RNA, 15 nt, Homo sapiens
uucuggucuguugcu

SEQ ID NO: 1991842 - RNA, 23 nt, Homo sapiens
auuugcacuucaccuuuugacca

SEQ ID NO: 1991843 - RNA, 18 nt, Homo sapiens
ucaaaguguaagcacuuc

SEQ ID NO: 1991844 - RNA, 13 nt, Homo sapiens
ccacuuacauaua

SEQ ID NO: 1991845 - RNA, 16 nt, Homo sapiens
acuaugacacugagca

SEQ ID NO: 1991846 - RNA, 20 nt, Homo sapiens
ccugaagcccagcgacacag

SEQ ID NO: 1991847 - RNA, 20 nt, Homo sapiens
cuccccuagggggagaagaa

SEQ ID NO: 1991848 - RNA, 21 nt, Homo sapiens
caucaauuuuuauacauauca

SEQ ID NO: 1991849 - RNA, 21 nt, Homo sapiens
guuguauuguggaacacugaa

SEQ ID NO: 1991850 - RNA, 15 nt, Homo sapiens
cccugcuacuccacu

SEQ ID NO: 1991851 - RNA, 16 nt, Homo sapiens
gaggugcaacaagguc

SEQ ID NO: 1991852 - RNA, 12 nt, Homo sapiens
ucagguggugcc

SEQ ID NO: 1991853 - RNA, 20 nt, Homo sapiens
gauucgugacaacaugcgac

SEQ ID NO: 1991854 - RNA, 18 nt, Homo sapiens
cuaaaugccccauauuaa

SEQ ID NO: 1991855 - RNA, 12 nt, Homo sapiens
aacuaacuacug

SEQ ID NO: 1991856 - RNA, 17 nt, Homo sapiens
cacaagcagagugcaca

SEQ ID NO: 1991857 - RNA, 12 nt, Homo sapiens
uggccuugccuc

SEQ ID NO: 1991858 - RNA, 14 nt, Homo sapiens
gguagaaaggcagu

SEQ ID NO: 1991859 - RNA, 20 nt, Homo sapiens
acauuuaugaguaacuauua

SEQ ID NO: 1991860 - RNA, 20 nt, Homo sapiens
ucagcugggucacauccauc

SEQ ID NO: 1991861 - RNA, 16 nt, Homo sapiens
uagccuuuuuguauaa

SEQ ID NO: 1991862 - RNA, 16 nt, Homo sapiens
augacugacuugucua

SEQ ID NO: 1991863 - RNA, 19 nt, Homo sapiens
uaaacuauaaaacaaaaau

SEQ ID NO: 1991864 - RNA, 16 nt, Homo sapiens
caccugccauuugcac

SEQ ID NO: 1991865 - RNA, 16 nt, Homo sapiens
accaguuaacguauua

SEQ ID NO: 1991866 - RNA, 19 nt, Homo sapiens
ugcccaggcuagagugcag

SEQ ID NO: 1991867 - RNA, 19 nt, Homo sapiens
ugcccaggcuggagugcaa

SEQ ID NO: 1991868 - RNA, 21 nt, Homo sapiens
aagagauaggaaccagcagga

SEQ ID NO: 1991869 - RNA, 23 nt, Homo sapiens
ucucuuaaaaaaaaaauuacuuc

SEQ ID NO: 1991870 - RNA, 14 nt, Homo sapiens
gucacuaccuggcu

SEQ ID NO: 1991871 - RNA, 17 nt, Homo sapiens
ccaggccagagggcagu

SEQ ID NO: 1991872 - RNA, 22 nt, Homo sapiens
agccugaaguggaaugacugaa

SEQ ID NO: 1991873 - RNA, 18 nt, Homo sapiens
auucuguggauucuauau

SEQ ID NO: 1991874 - RNA, 16 nt, Homo sapiens
cugucuugucauucca

SEQ ID NO: 1991875 - RNA, 22 nt, Homo sapiens
cuuaagucccaguauaccucau

SEQ ID NO: 1991876 - RNA, 15 nt, Homo sapiens
cugcaguaaaacaca

SEQ ID NO: 1991877 - RNA, 22 nt, Homo sapiens
caguuguaccauucaccgugcc

SEQ ID NO: 1991878 - RNA, 13 nt, Homo sapiens
ggcaggaggccau

SEQ ID NO: 1991879 - RNA, 17 nt, Homo sapiens
accucagcuuggcacuc

SEQ ID NO: 1991880 - RNA, 20 nt, Homo sapiens
gacucuuucugagugccuuc

SEQ ID NO: 1991881 - RNA, 20 nt, Homo sapiens
uuguaaauaaagcccuggga

SEQ ID NO: 1991882 - RNA, 18 nt, Homo sapiens
ucugucucugcuauggaa

SEQ ID NO: 1991883 - RNA, 21 nt, Homo sapiens
gcaggaggcuagcaaagcuua

SEQ ID NO: 1991884 - RNA, 20 nt, Homo sapiens
cgauucccaagcucccuucc

SEQ ID NO: 1991885 - RNA, 14 nt, Homo sapiens
uaaaaaaugagcuu

SEQ ID NO: 1991886 - RNA, 13 nt, Homo sapiens
ccccucucaccaa

SEQ ID NO: 1991887 - RNA, 16 nt, Homo sapiens
cugucuccucuucaaa

SEQ ID NO: 1991888 - RNA, 20 nt, Homo sapiens
ucauggcuuagaaaucuuua

SEQ ID NO: 1991889 - RNA, 22 nt, Homo sapiens
auuaagugacuauagaaugcaa

SEQ ID NO: 1991890 - RNA, 13 nt, Homo sapiens
guccaauauuugg

SEQ ID NO: 1991891 - RNA, 22 nt, Homo sapiens
uauacugccuuguguucaguga

SEQ ID NO: 1991892 - RNA, 20 nt, Homo sapiens
gccauccccgaaagagguga

SEQ ID NO: 1991893 - RNA, 22 nt, Homo sapiens
gccacaguuuccucaucugucc

SEQ ID NO: 1991894 - RNA, 14 nt, Homo sapiens
ugcuggcugugaca

SEQ ID NO: 1991895 - RNA, 22 nt, Homo sapiens
gcuggccaaagagccuuuccaa

SEQ ID NO: 1991896 - RNA, 14 nt, Homo sapiens
acuguuuaaauucc

SEQ ID NO: 1991897 - RNA, 14 nt, Homo sapiens
gcugcuuagauuuc

SEQ ID NO: 1991898 - RNA, 21 nt, Homo sapiens
uaugacaauuucaaaaugcau

SEQ ID NO: 1991899 - RNA, 12 nt, Homo sapiens
acccggugcucc

SEQ ID NO: 1991900 - RNA, 15 nt, Homo sapiens
acugaaacauucaca

SEQ ID NO: 1991901 - RNA, 17 nt, Homo sapiens
aaugggaagaccaaaau

SEQ ID NO: 1991902 - RNA, 21 nt, Homo sapiens
uuuccacgcaguucuuuccau

SEQ ID NO: 1991903 - RNA, 23 nt, Homo sapiens
cacggaagggcucuuucacagcu

SEQ ID NO: 1991904 - RNA, 13 nt, Homo sapiens
uuauguacucuac

SEQ ID NO: 1991905 - RNA, 20 nt, Homo sapiens
auacuaaugcccuaucuuag

SEQ ID NO: 1991906 - RNA, 19 nt, Homo sapiens
aggacaugggacuugcgug

SEQ ID NO: 1991907 - RNA, 22 nt, Homo sapiens
uucuuuuccugucccucuucca

SEQ ID NO: 1991908 - RNA, 13 nt, Homo sapiens
gaugagggggcca

SEQ ID NO: 1991909 - RNA, 15 nt, Homo sapiens
aaaguaaauugccuu

SEQ ID NO: 1991910 - RNA, 22 nt, Homo sapiens
cacugaaaaaaaaaaaaauccc

SEQ ID NO: 1991911 - RNA, 16 nt, Homo sapiens
aagggugggugcucag

SEQ ID NO: 1991912 - RNA, 13 nt, Homo sapiens
ucaguugcacuuc

SEQ ID NO: 1991913 - RNA, 16 nt, Homo sapiens
ucuagaacagccagac

SEQ ID NO: 1991914 - RNA, 22 nt, Homo sapiens
auaguggguacaucaaguccau

SEQ ID NO: 1991915 - RNA, 14 nt, Homo sapiens
aguauucaaucaag

SEQ ID NO: 1991916 - RNA, 22 nt, Homo sapiens
cuaaguaaaaauauuaacugac

SEQ ID NO: 1991917 - RNA, 22 nt, Homo sapiens
auucacuuuugcuauuccaauc

SEQ ID NO: 1991918 - RNA, 22 nt, Homo sapiens
aacuuuuauaaacuuuaccuuu

SEQ ID NO: 1991919 - RNA, 20 nt, Homo sapiens
augucuccccaguuccacag

SEQ ID NO: 1991920 - RNA, 12 nt, Homo sapiens
guacagacacuc

SEQ ID NO: 1991921 - RNA, 20 nt, Homo sapiens
uaagaaucuuuguuagauau

SEQ ID NO: 1991922 - RNA, 21 nt, Homo sapiens
uuuccauaaacacccaugaau

SEQ ID NO: 1991923 - RNA, 21 nt, Homo sapiens
ccuccaagauuucagaagcca

SEQ ID NO: 1991924 - RNA, 18 nt, Homo sapiens
cauugcccgaaaccagag

SEQ ID NO: 1991925 - RNA, 15 nt, Homo sapiens
cucaugccuguaauc

SEQ ID NO: 1991926 - RNA, 15 nt, Homo sapiens
uucaugcuugccauc

SEQ ID NO: 1991927 - RNA, 13 nt, Homo sapiens
gucagaaguugau

SEQ ID NO: 1991928 - RNA, 13 nt, Homo sapiens
gugagaaguucau

SEQ ID NO: 1991929 - RNA, 20 nt, Homo sapiens
aaagauuaggugagguuuau

SEQ ID NO: 1991930 - RNA, 19 nt, Homo sapiens
uguaugcaguauucuugca

SEQ ID NO: 1991931 - RNA, 18 nt, Homo sapiens
cgcuggguccucugcagu

SEQ ID NO: 1991932 - RNA, 16 nt, Homo sapiens
uaacuucuacauucaa

SEQ ID NO: 1991933 - RNA, 17 nt, Homo sapiens
ggcacuggaugcaugaa

SEQ ID NO: 1991934 - RNA, 16 nt, Homo sapiens
cugcacuuauacccau

SEQ ID NO: 1991935 - RNA, 21 nt, Homo sapiens
gcugcaaacccaugaagcugg

SEQ ID NO: 1991936 - RNA, 17 nt, Homo sapiens
cuccugaaggucugggu

SEQ ID NO: 1991937 - RNA, 16 nt, Homo sapiens
ucaggcuuuggauguu

SEQ ID NO: 1991938 - RNA, 19 nt, Homo sapiens
guaauauuaauuuccacua

SEQ ID NO: 1991939 - RNA, 16 nt, Homo sapiens
ccaucuugagugguca

SEQ ID NO: 1991940 - RNA, 12 nt, Homo sapiens
cuguccagagag

SEQ ID NO: 1991941 - RNA, 20 nt, Homo sapiens
gcuccaccagcagcauggca

SEQ ID NO: 1991942 - RNA, 19 nt, Homo sapiens
cucugccagccacauccaa

SEQ ID NO: 1991943 - RNA, 15 nt, Homo sapiens
gccugaaacuuugag

SEQ ID NO: 1991944 - RNA, 20 nt, Homo sapiens
uggccuuucacuucugccuu

SEQ ID NO: 1991945 - RNA, 21 nt, Homo sapiens
ugugaacacauaaggacgugu

SEQ ID NO: 1991946 - RNA, 21 nt, Homo sapiens
ucuggggaccccaaccucaga

SEQ ID NO: 1991947 - RNA, 20 nt, Homo sapiens
gccaugcucaggagccacca

SEQ ID NO: 1991948 - RNA, 17 nt, Homo sapiens
auaaaggaugggaccaa

SEQ ID NO: 1991949 - RNA, 14 nt, Homo sapiens
agaugccccagccu

SEQ ID NO: 1991950 - RNA, 19 nt, Homo sapiens
ugagcuccccaaaaaccuc

SEQ ID NO: 1991951 - RNA, 20 nt, Homo sapiens
auaaaacuaggggguguaua

SEQ ID NO: 1991952 - RNA, 15 nt, Homo sapiens
guuauauucagugug

SEQ ID NO: 1991953 - RNA, 13 nt, Homo sapiens
uagcugacuugca

SEQ ID NO: 1991954 - RNA, 13 nt, Homo sapiens
uaccugacuucca

SEQ ID NO: 1991955 - RNA, 13 nt, Homo sapiens
aaaaagacauaau

SEQ ID NO: 1991956 - RNA, 16 nt, Homo sapiens
cccgucgugcagucag

SEQ ID NO: 1991957 - RNA, 23 nt, Homo sapiens
uugugcaaguugacaaaugccaa

SEQ ID NO: 1991958 - RNA, 22 nt, Homo sapiens
cucacuguguggccucagagaa

SEQ ID NO: 1991959 - RNA, 12 nt, Homo sapiens
guuuuuaaucuc

SEQ ID NO: 1991960 - RNA, 18 nt, Homo sapiens
uuauaugaacauagacua

SEQ ID NO: 1991961 - RNA, 15 nt, Homo sapiens
aauaauucucuauua

SEQ ID NO: 1991962 - RNA, 16 nt, Homo sapiens
uagucaguaauuuauc

SEQ ID NO: 1991963 - RNA, 22 nt, Homo sapiens
agugucccccuuguggaaccaa

SEQ ID NO: 1991964 - RNA, 17 nt, Homo sapiens
uuuaacagaaacuuuca

SEQ ID NO: 1991965 - RNA, 13 nt, Homo sapiens
uggagugcucaau

SEQ ID NO: 1991966 - RNA, 18 nt, Homo sapiens
gccuggcaacaucuuacu

SEQ ID NO: 1991967 - RNA, 13 nt, Homo sapiens
acuacacugagga

SEQ ID NO: 1991968 - RNA, 11 nt, Homo sapiens
accauccacag

SEQ ID NO: 1991969 - RNA, 17 nt, Homo sapiens
auucccauuuugcaaaa

SEQ ID NO: 1991970 - RNA, 17 nt, Homo sapiens
ucaguacagcacuccug

SEQ ID NO: 1991971 - RNA, 12 nt, Homo sapiens
uuggagaacuca

SEQ ID NO: 1991972 - RNA, 16 nt, Homo sapiens
uggaggccuaccucuc

SEQ ID NO: 1991973 - RNA, 20 nt, Homo sapiens
cauaugauuguccgugauaa

SEQ ID NO: 1991974 - RNA, 15 nt, Homo sapiens
ucucuugucacaugg

SEQ ID NO: 1991975 - RNA, 19 nt, Homo sapiens
uacaggaaauuucuuagga

SEQ ID NO: 1991976 - RNA, 14 nt, Homo sapiens
cacugcccugucuc

SEQ ID NO: 1991977 - RNA, 22 nt, Homo sapiens
uuugcaagccugcaugcauuca

SEQ ID NO: 1991978 - RNA, 14 nt, Homo sapiens
cagaugcuuugccc

SEQ ID NO: 1991979 - RNA, 19 nt, Homo sapiens
cagaaagccaggguccuga

SEQ ID NO: 1991980 - RNA, 18 nt, Homo sapiens
cuauccccaaacuccuuu

SEQ ID NO: 1991981 - RNA, 13 nt, Homo sapiens
aaauuaacucacu

SEQ ID NO: 1991982 - RNA, 13 nt, Homo sapiens
uaucuaacacuuu

SEQ ID NO: 1991983 - RNA, 18 nt, Homo sapiens
ugguuaagagaucccuua

SEQ ID NO: 1991984 - RNA, 17 nt, Homo sapiens
agcccugcucauuccuc

SEQ ID NO: 1991985 - RNA, 17 nt, Homo sapiens
uuaccuuaaaaaguaau

SEQ ID NO: 1991986 - RNA, 16 nt, Homo sapiens
cuuccacagagacauc

SEQ ID NO: 1991987 - RNA, 15 nt, Homo sapiens
gagcaagaccucguc

SEQ ID NO: 1991988 - RNA, 22 nt, Homo sapiens
gguuauuucagcccccaucacc

SEQ ID NO: 1991989 - RNA, 23 nt, Homo sapiens
accaauaaagugacccuguucuc

SEQ ID NO: 1991990 - RNA, 16 nt, Homo sapiens
auuuuuuaacauauug

SEQ ID NO: 1991991 - RNA, 14 nt, Homo sapiens
acugaaagcacuag

SEQ ID NO: 1991992 - RNA, 18 nt, Homo sapiens
gucuuggaacauuggaau

SEQ ID NO: 1991993 - RNA, 20 nt, Homo sapiens
gaucccaucucuccauauac

SEQ ID NO: 1991994 - RNA, 11 nt, Homo sapiens
aaagcccuccc

SEQ ID NO: 1991995 - RNA, 23 nt, Homo sapiens
uugcccaacuacuaucucagaga

SEQ ID NO: 1991996 - RNA, 22 nt, Homo sapiens
uaauuacuuuccagcagguguu

SEQ ID NO: 1991997 - RNA, 22 nt, Homo sapiens
gaaacggucacgagacccagag

SEQ ID NO: 1991998 - RNA, 13 nt, Homo sapiens
uuauauacaauuu

SEQ ID NO: 1991999 - RNA, 11 nt, Homo sapiens
uccccuggcaa

SEQ ID NO: 1992000 - RNA, 17 nt, Homo sapiens
gccagcaauaauugaca

SEQ ID NO: 1992001 - RNA, 13 nt, Homo sapiens
aggcacaacaguu

SEQ ID NO: 1992002 - RNA, 14 nt, Homo sapiens
ccacuacugcagca

SEQ ID NO: 1992003 - RNA, 14 nt, Homo sapiens
guuccccucuuguc

SEQ ID NO: 1992004 - RNA, 13 nt, Homo sapiens
accagacugcaau

SEQ ID NO: 1992005 - RNA, 13 nt, Homo sapiens
accucaaccugug

SEQ ID NO: 1992006 - RNA, 20 nt, Homo sapiens
cuuuguugccuuaucuugaa

SEQ ID NO: 1992007 - RNA, 13 nt, Homo sapiens
caauaguauuucu

SEQ ID NO: 1992008 - RNA, 15 nt, Homo sapiens
aggcccuacuaccca

SEQ ID NO: 1992009 - RNA, 23 nt, Homo sapiens
guaaguuauugaugagagggaaa

SEQ ID NO: 1992010 - RNA, 15 nt, Homo sapiens
cuuuagacuucccac

SEQ ID NO: 1992011 - RNA, 14 nt, Homo sapiens
ucaaaaccuacaca

SEQ ID NO: 1992012 - RNA, 15 nt, Homo sapiens
agaauauaggucucu

SEQ ID NO: 1992013 - RNA, 20 nt, Homo sapiens
aauuucggauuuuuuccaaa

SEQ ID NO: 1992014 - RNA, 14 nt, Homo sapiens
uuugcuguaccaca

SEQ ID NO: 1992015 - RNA, 21 nt, Homo sapiens
aucuccuaacaaaagaacuaa

SEQ ID NO: 1992016 - RNA, 15 nt, Homo sapiens
aaguaaagcuagaca

SEQ ID NO: 1992017 - RNA, 13 nt, Homo sapiens
aagucauagaaau

SEQ ID NO: 1992018 - RNA, 16 nt, Homo sapiens
gcaauagugaaugaau

SEQ ID NO: 1992019 - RNA, 23 nt, Homo sapiens
aggguugcuucugagugguguuu

SEQ ID NO: 1992020 - RNA, 12 nt, Homo sapiens
gcagugcccuuu

SEQ ID NO: 1992021 - RNA, 19 nt, Homo sapiens
aaaagcaugaaacauuuca

SEQ ID NO: 1992022 - RNA, 18 nt, Homo sapiens
aacaaaccucacugagag

SEQ ID NO: 1992023 - RNA, 18 nt, Homo sapiens
ugaucaguaugaaaaugu

SEQ ID NO: 1992024 - RNA, 16 nt, Homo sapiens
ucacucaccauuccca

SEQ ID NO: 1992025 - RNA, 19 nt, Homo sapiens
uucuaagaaauaucuguga

SEQ ID NO: 1992026 - RNA, 21 nt, Homo sapiens
accuucaucagaccacucccu

SEQ ID NO: 1992027 - RNA, 18 nt, Homo sapiens
cuccucauuuuuacgggu

SEQ ID NO: 1992028 - RNA, 17 nt, Homo sapiens
auuuuuaccagucucac

SEQ ID NO: 1992029 - RNA, 16 nt, Homo sapiens
aaugauagacaauuga

SEQ ID NO: 1992030 - RNA, 17 nt, Homo sapiens
acgaacauguuagucaa

SEQ ID NO: 1992031 - RNA, 22 nt, Homo sapiens
uugugcucaaaauaaaaagccu

SEQ ID NO: 1992032 - RNA, 14 nt, Homo sapiens
caccucugccuugg

SEQ ID NO: 1992033 - RNA, 23 nt, Homo sapiens
uccacuucuuguuccccacugac

SEQ ID NO: 1992034 - RNA, 21 nt, Homo sapiens
auauaaaaaagccacuggaau

SEQ ID NO: 1992035 - RNA, 22 nt, Homo sapiens
uccucaagauccugucuugcug

SEQ ID NO: 1992036 - RNA, 17 nt, Homo sapiens
augguaggggcuuaaaa

SEQ ID NO: 1992037 - RNA, 14 nt, Homo sapiens
ucucuccucucuga

SEQ ID NO: 1992038 - RNA, 20 nt, Homo sapiens
uuugauaccauggcacugac

SEQ ID NO: 1992039 - RNA, 17 nt, Homo sapiens
guauaaagggacuugaa

SEQ ID NO: 1992040 - RNA, 13 nt, Homo sapiens
uaggugacauaua

SEQ ID NO: 1992041 - RNA, 14 nt, Homo sapiens
gaagaaagcaacaa

SEQ ID NO: 1992042 - RNA, 19 nt, Homo sapiens
cgcugauuccuaaggccca

SEQ ID NO: 1992043 - RNA, 20 nt, Homo sapiens
uuuuguacaauaaccugcua

SEQ ID NO: 1992044 - RNA, 13 nt, Homo sapiens
uuaugggcacugg

SEQ ID NO: 1992045 - RNA, 20 nt, Homo sapiens
guaccuguacuaaaccaccu

SEQ ID NO: 1992046 - RNA, 20 nt, Homo sapiens
agccaccccaugcuggccuu

SEQ ID NO: 1992047 - RNA, 23 nt, Homo sapiens
aaaguaauagggcuucugccuaa

SEQ ID NO: 1992048 - RNA, 23 nt, Homo sapiens
gugggugaaggccuggcuggaag

SEQ ID NO: 1992049 - RNA, 15 nt, Homo sapiens
uaauuggucauguga

SEQ ID NO: 1992050 - RNA, 14 nt, Homo sapiens
gcagcucuggaggg

SEQ ID NO: 1992051 - RNA, 17 nt, Homo sapiens
ucuguuugucugaacaa

SEQ ID NO: 1992052 - RNA, 12 nt, Homo sapiens
gagaaugaccug

SEQ ID NO: 1992053 - RNA, 16 nt, Homo sapiens
ccuggcgcuuccagcu

SEQ ID NO: 1992054 - RNA, 14 nt, Homo sapiens
cuuucaccuuucua

SEQ ID NO: 1992055 - RNA, 17 nt, Homo sapiens
uccuuguuguuugcuuu

SEQ ID NO: 1992056 - RNA, 11 nt, Homo sapiens
uccucugccag

SEQ ID NO: 1992057 - RNA, 18 nt, Homo sapiens
gucugaauaacacuggau

SEQ ID NO: 1992058 - RNA, 16 nt, Homo sapiens
guuaggcagugcagua

SEQ ID NO: 1992059 - RNA, 20 nt, Homo sapiens
auuucccuucauacuccuuu

SEQ ID NO: 1992060 - RNA, 14 nt, Homo sapiens
gcuaugucuuccca

SEQ ID NO: 1992061 - RNA, 13 nt, Homo sapiens
gaaaaagaacaaa

SEQ ID NO: 1992062 - RNA, 12 nt, Homo sapiens
agccccugaauu

SEQ ID NO: 1992063 - RNA, 16 nt, Homo sapiens
auuguucaacuuuuca

SEQ ID NO: 1992064 - RNA, 17 nt, Homo sapiens
uaaauaaccauugcagg

SEQ ID NO: 1992065 - RNA, 14 nt, Homo sapiens
agauuuaacauaua

SEQ ID NO: 1992066 - RNA, 20 nt, Homo sapiens
gagaccccuuguugcacugc

SEQ ID NO: 1992067 - RNA, 18 nt, Homo sapiens
aacccagacccugagucc

SEQ ID NO: 1992068 - RNA, 14 nt, Homo sapiens
aaagcuucagggaa

SEQ ID NO: 1992069 - RNA, 14 nt, Homo sapiens
gcagcagagccauc

SEQ ID NO: 1992070 - RNA, 18 nt, Homo sapiens
auucuuauguugaauaug

SEQ ID NO: 1992071 - RNA, 20 nt, Homo sapiens
uacaugaugauuucagaaac

SEQ ID NO: 1992072 - RNA, 23 nt, Homo sapiens
agcuauuugggcacaacacauca

SEQ ID NO: 1992073 - RNA, 19 nt, Homo sapiens
aaugcuguaugucauuaaa

SEQ ID NO: 1992074 - RNA, 15 nt, Homo sapiens
uuuugccacuggaac

SEQ ID NO: 1992075 - RNA, 15 nt, Homo sapiens
uaggaaaacauugca

SEQ ID NO: 1992076 - RNA, 15 nt, Homo sapiens
uuaggcuggaaaugg

SEQ ID NO: 1992077 - RNA, 21 nt, Homo sapiens
gccuuccaggcagacacagcu

SEQ ID NO: 1992078 - RNA, 12 nt, Homo sapiens
ccagcucuucca

SEQ ID NO: 1992079 - RNA, 17 nt, Homo sapiens
augaggaauauuugcaa

SEQ ID NO: 1992080 - RNA, 23 nt, Homo sapiens
caggagcaaauguuucugcagua

SEQ ID NO: 1992081 - RNA, 15 nt, Homo sapiens
cugauauuaaguaau

SEQ ID NO: 1992082 - RNA, 18 nt, Homo sapiens
ccaggcaacuugggaacu

SEQ ID NO: 1992083 - RNA, 22 nt, Homo sapiens
caguauucucagagcauguguc

SEQ ID NO: 1992084 - RNA, 18 nt, Homo sapiens
aauaacccugaaucagag

SEQ ID NO: 1992085 - RNA, 16 nt, Homo sapiens
aguauauuauuauuaa

SEQ ID NO: 1992086 - RNA, 13 nt, Homo sapiens
uuucucaccagcc

SEQ ID NO: 1992087 - RNA, 13 nt, Homo sapiens
aggcaaucugccc

SEQ ID NO: 1992088 - RNA, 14 nt, Homo sapiens
agcauguaccccag

SEQ ID NO: 1992089 - RNA, 19 nt, Homo sapiens
gacauugaccuauuuccag

SEQ ID NO: 1992090 - RNA, 15 nt, Homo sapiens
ucucucccugcuuug

SEQ ID NO: 1992091 - RNA, 15 nt, Homo sapiens
ucugcccuccugcca

SEQ ID NO: 1992092 - RNA, 20 nt, Homo sapiens
uggagggggcuggggucaca

SEQ ID NO: 1992093 - RNA, 13 nt, Homo sapiens
guacuguacuaau

SEQ ID NO: 1992094 - RNA, 23 nt, Homo sapiens
ucgggggaugaggauauggcagg

SEQ ID NO: 1992095 - RNA, 17 nt, Homo sapiens
aggccagugggacccca

SEQ ID NO: 1992096 - RNA, 22 nt, Homo sapiens
cagaggcagcgaguuguggaaa

SEQ ID NO: 1992097 - RNA, 13 nt, Homo sapiens
cguccuuccucuc

SEQ ID NO: 1992098 - RNA, 22 nt, Homo sapiens
auaucaucaaugugacauuuac

SEQ ID NO: 1992099 - RNA, 14 nt, Homo sapiens
agcuaacagugaag

SEQ ID NO: 1992100 - RNA, 23 nt, Homo sapiens
acaggcugauaccuuugugaagu

SEQ ID NO: 1992101 - RNA, 17 nt, Homo sapiens
guaaacugauguacuga

SEQ ID NO: 1992102 - RNA, 13 nt, Homo sapiens
uaaaauagaaaca

SEQ ID NO: 1992103 - RNA, 13 nt, Homo sapiens
ucaccuagacaac

SEQ ID NO: 1992104 - RNA, 16 nt, Homo sapiens
gcuggugccccacuga

SEQ ID NO: 1992105 - RNA, 12 nt, Homo sapiens
aacaaaauuaca

SEQ ID NO: 1992106 - RNA, 13 nt, Homo sapiens
aggaaaacaauaa

SEQ ID NO: 1992107 - RNA, 13 nt, Homo sapiens
aagugaacaguug

SEQ ID NO: 1992108 - RNA, 17 nt, Homo sapiens
agguuagcugcucccca

SEQ ID NO: 1992109 - RNA, 21 nt, Homo sapiens
uauccacaauuauuggcaaag

SEQ ID NO: 1992110 - RNA, 17 nt, Homo sapiens
ggccgcggcccagaccc

SEQ ID NO: 1992111 - RNA, 15 nt, Homo sapiens
auuuuucaaggcauu

SEQ ID NO: 1992112 - RNA, 24 nt, Homo sapiens
aucaguugcaauaauacuucucaa

SEQ ID NO: 1992113 - RNA, 15 nt, Homo sapiens
cagcucccuucucug

SEQ ID NO: 1992114 - RNA, 15 nt, Homo sapiens
uucuaaugugugaau

SEQ ID NO: 1992115 - RNA, 15 nt, Homo sapiens
uuuguuggugcuuug

SEQ ID NO: 1992116 - RNA, 13 nt, Homo sapiens
ugcuaccugugag

SEQ ID NO: 1992117 - RNA, 21 nt, Homo sapiens
ggcaagccugucuucagagaa

SEQ ID NO: 1992118 - RNA, 21 nt, Homo sapiens
auuccuucuacauguaaugac

SEQ ID NO: 1992119 - RNA, 22 nt, Homo sapiens
ccuggugggaaaaugcacacau

SEQ ID NO: 1992120 - RNA, 15 nt, Homo sapiens
accuuaguggcuuuu

SEQ ID NO: 1992121 - RNA, 20 nt, Homo sapiens
ucccugggggagaccuauga

SEQ ID NO: 1992122 - RNA, 16 nt, Homo sapiens
gucaccccaacucugu

SEQ ID NO: 1992123 - RNA, 22 nt, Homo sapiens
gggccugcacccuuccacagcu

SEQ ID NO: 1992124 - RNA, 17 nt, Homo sapiens
acauggaauagcaccug

SEQ ID NO: 1992125 - RNA, 17 nt, Homo sapiens
ccaucuagcaagcacuu

SEQ ID NO: 1992126 - RNA, 15 nt, Homo sapiens
ugacucaggacaucc

SEQ ID NO: 1992127 - RNA, 18 nt, Homo sapiens
uccucauauacuugaaua

SEQ ID NO: 1992128 - RNA, 15 nt, Homo sapiens
agaucacaucacugc

SEQ ID NO: 1992129 - RNA, 15 nt, Homo sapiens
ccuuaggagcaaaau

SEQ ID NO: 1992130 - RNA, 22 nt, Homo sapiens
ccuugugaauuugcugcuauuu

SEQ ID NO: 1992131 - RNA, 21 nt, Homo sapiens
agcccaagacaccaugacaaa

SEQ ID NO: 1992132 - RNA, 16 nt, Homo sapiens
agaggucucucuggaa

SEQ ID NO: 1992133 - RNA, 13 nt, Homo sapiens
aaaauuguuacaa

SEQ ID NO: 1992134 - RNA, 16 nt, Homo sapiens
caaaaagaaucugcau

SEQ ID NO: 1992135 - RNA, 16 nt, Homo sapiens
aucugcaacaaaaagu

SEQ ID NO: 1992136 - RNA, 17 nt, Homo sapiens
accuccaaaacuccugc

SEQ ID NO: 1992137 - RNA, 14 nt, Homo sapiens
gggccccucagagc

SEQ ID NO: 1992138 - RNA, 22 nt, Homo sapiens
ugggcacucccuugguggcaag

SEQ ID NO: 1992139 - RNA, 19 nt, Homo sapiens
caaucccucuccacucuuc

SEQ ID NO: 1992140 - RNA, 13 nt, Homo sapiens
gggucaacaucuu

SEQ ID NO: 1992141 - RNA, 17 nt, Homo sapiens
gccaggggcugguggga

SEQ ID NO: 1992142 - RNA, 21 nt, Homo sapiens
gaagucacucacacuggccac

SEQ ID NO: 1992143 - RNA, 16 nt, Homo sapiens
gaaauaguaccuucaa

SEQ ID NO: 1992144 - RNA, 20 nt, Homo sapiens
cuuuugccacaucccuauag

SEQ ID NO: 1992145 - RNA, 13 nt, Homo sapiens
acaaugcuuucca

SEQ ID NO: 1992146 - RNA, 20 nt, Homo sapiens
ugcccuucagcauccucagu

SEQ ID NO: 1992147 - RNA, 14 nt, Homo sapiens
auuguccaugccua

SEQ ID NO: 1992148 - RNA, 16 nt, Homo sapiens
gcgauguggacgucac

SEQ ID NO: 1992149 - RNA, 10 nt, Homo sapiens
ggcugaugau

SEQ ID NO: 1992150 - RNA, 14 nt, Homo sapiens
gauucuuaccaaga

SEQ ID NO: 1992151 - RNA, 13 nt, Homo sapiens
uccaugugcauau

SEQ ID NO: 1992152 - RNA, 13 nt, Homo sapiens
uaaauuauaucaa

SEQ ID NO: 1992153 - RNA, 14 nt, Homo sapiens
caguggcuaccuac

SEQ ID NO: 1992154 - RNA, 13 nt, Homo sapiens
aggaggacaggga

SEQ ID NO: 1992155 - RNA, 16 nt, Homo sapiens
gggaacagggcccagg

SEQ ID NO: 1992156 - RNA, 19 nt, Homo sapiens
ggggaucugggcaaggugg

SEQ ID NO: 1992157 - RNA, 23 nt, Homo sapiens
acaaaacugaccuugacuacuca

SEQ ID NO: 1992158 - RNA, 22 nt, Homo sapiens
cccaguguggacucuggacugg

SEQ ID NO: 1992159 - RNA, 16 nt, Homo sapiens
gcagaggcaacacugg

SEQ ID NO: 1992160 - RNA, 18 nt, Homo sapiens
auaccauggcacugacaa

SEQ ID NO: 1992161 - RNA, 19 nt, Homo sapiens
ucuuaagaaaaugaugcug

SEQ ID NO: 1992162 - RNA, 15 nt, Homo sapiens
gguggggacagggau

SEQ ID NO: 1992163 - RNA, 18 nt, Homo sapiens
gcuggaguccuguucuca

SEQ ID NO: 1992164 - RNA, 17 nt, Homo sapiens
acauuaaucaccaaagu

SEQ ID NO: 1992165 - RNA, 19 nt, Homo sapiens
agaguacagauaugaacac

SEQ ID NO: 1992166 - RNA, 21 nt, Homo sapiens
ggacucugcaucccagcaccu

SEQ ID NO: 1992167 - RNA, 14 nt, Homo sapiens
agccacuaccuucu

SEQ ID NO: 1992168 - RNA, 16 nt, Homo sapiens
gacacagacuggcaau

SEQ ID NO: 1992169 - RNA, 16 nt, Homo sapiens
uaggacauugauuuga

SEQ ID NO: 1992170 - RNA, 21 nt, Homo sapiens
cugucaccaugacuuccucac

SEQ ID NO: 1992171 - RNA, 20 nt, Homo sapiens
gaugcauguaguagccuuuc

SEQ ID NO: 1992172 - RNA, 16 nt, Homo sapiens
gaaauucaaagcauaa

SEQ ID NO: 1992173 - RNA, 14 nt, Homo sapiens
uagggaacugggga

SEQ ID NO: 1992174 - RNA, 21 nt, Homo sapiens
acuuuucuuuccucagaucau

SEQ ID NO: 1992175 - RNA, 17 nt, Homo sapiens
ccuucgcuucuugccuc

SEQ ID NO: 1992176 - RNA, 20 nt, Homo sapiens
uauuccaaaugccauccaga

SEQ ID NO: 1992177 - RNA, 12 nt, Homo sapiens
guccaggccagg

SEQ ID NO: 1992178 - RNA, 15 nt, Homo sapiens
cuucucauuaccagu

SEQ ID NO: 1992179 - RNA, 15 nt, Homo sapiens
accuagccacuuaau

SEQ ID NO: 1992180 - RNA, 12 nt, Homo sapiens
guugaaagccaa

SEQ ID NO: 1992181 - RNA, 18 nt, Homo sapiens
ucugcuccucuccaggca

SEQ ID NO: 1992182 - RNA, 10 nt, Homo sapiens
gacagaauuc

SEQ ID NO: 1992183 - RNA, 15 nt, Homo sapiens
auguauaucaggguu

SEQ ID NO: 1992184 - RNA, 18 nt, Homo sapiens
agaccuuuucucucccau

SEQ ID NO: 1992185 - RNA, 15 nt, Homo sapiens
gaccagccuugacac

SEQ ID NO: 1992186 - RNA, 19 nt, Homo sapiens
uucccuguacuuuucccau

SEQ ID NO: 1992187 - RNA, 21 nt, Homo sapiens
guuucaauugaaggugcuguu

SEQ ID NO: 1992188 - RNA, 18 nt, Homo sapiens
ggcccaauucugccacuu

SEQ ID NO: 1992189 - RNA, 11 nt, Homo sapiens
ucagggccacg

SEQ ID NO: 1992190 - RNA, 15 nt, Homo sapiens
ucaauuccugugauu

SEQ ID NO: 1992191 - RNA, 20 nt, Homo sapiens
aucagcccaggucccagugc

SEQ ID NO: 1992192 - RNA, 13 nt, Homo sapiens
ugaucucagcuca

SEQ ID NO: 1992193 - RNA, 16 nt, Homo sapiens
guggauaucuguguau

SEQ ID NO: 1992194 - RNA, 21 nt, Homo sapiens
ugauauuauggcaagugauau

SEQ ID NO: 1992195 - RNA, 19 nt, Homo sapiens
aaaaugggaugauauggag

SEQ ID NO: 1992196 - RNA, 14 nt, Homo sapiens
accaucugugacua

SEQ ID NO: 1992197 - RNA, 16 nt, Homo sapiens
cagucccacacugugc

SEQ ID NO: 1992198 - RNA, 19 nt, Homo sapiens
uaauucuguuacuuugcua

SEQ ID NO: 1992199 - RNA, 16 nt, Homo sapiens
uaacagagaguaagca

SEQ ID NO: 1992200 - RNA, 20 nt, Homo sapiens
ucuguuuuucuucugaaaua

SEQ ID NO: 1992201 - RNA, 14 nt, Homo sapiens
agacugaacauguu

SEQ ID NO: 1992202 - RNA, 15 nt, Homo sapiens
caaugcagcauguug

SEQ ID NO: 1992203 - RNA, 20 nt, Homo sapiens
augucugguguuugucaugg

SEQ ID NO: 1992204 - RNA, 16 nt, Homo sapiens
ucuagguucugagcuc

SEQ ID NO: 1992205 - RNA, 20 nt, Homo sapiens
gaaauaccaguucugggcaa

SEQ ID NO: 1992206 - RNA, 23 nt, Homo sapiens
uuaucauucauucuuagcucuua

SEQ ID NO: 1992207 - RNA, 16 nt, Homo sapiens
auacaacuucauauaa

SEQ ID NO: 1992208 - RNA, 16 nt, Homo sapiens
ccacgagggugccgug

SEQ ID NO: 1992209 - RNA, 14 nt, Homo sapiens
gacuguccccuuga

SEQ ID NO: 1992210 - RNA, 13 nt, Homo sapiens
caaccaaauggag

SEQ ID NO: 1992211 - RNA, 19 nt, Homo sapiens
aucccacccccaaugcaca

SEQ ID NO: 1992212 - RNA, 18 nt, Homo sapiens
caagcuauccuugcaccu

SEQ ID NO: 1992213 - RNA, 16 nt, Homo sapiens
gagaggugucugccac

SEQ ID NO: 1992214 - RNA, 17 nt, Homo sapiens
ugugcacaagugugcac

SEQ ID NO: 1992215 - RNA, 21 nt, Homo sapiens
cccgcuaaggugaaaaggggu

SEQ ID NO: 1992216 - RNA, 19 nt, Homo sapiens
uaauaaaacaucuuuccag

SEQ ID NO: 1992217 - RNA, 21 nt, Homo sapiens
gcuccaccuugugacccaggg

SEQ ID NO: 1992218 - RNA, 14 nt, Homo sapiens
cccuuagugaauua

SEQ ID NO: 1992219 - RNA, 22 nt, Homo sapiens
ugcauucauucauccucuuaua

SEQ ID NO: 1992220 - RNA, 22 nt, Homo sapiens
caacucaagugucaccuccuuc

SEQ ID NO: 1992221 - RNA, 23 nt, Homo sapiens
uuaacuuguaaaugaaaaaauuc

SEQ ID NO: 1992222 - RNA, 15 nt, Homo sapiens
ccguggccuggcauc

SEQ ID NO: 1992223 - RNA, 12 nt, Homo sapiens
guuaaguucaaa

SEQ ID NO: 1992224 - RNA, 12 nt, Homo sapiens
guugaguucaag

SEQ ID NO: 1992225 - RNA, 21 nt, Homo sapiens
gucacaaaggagugagugaaa

SEQ ID NO: 1992226 - RNA, 23 nt, Homo sapiens
cauauuuguauaguugcuugccu

SEQ ID NO: 1992227 - RNA, 20 nt, Homo sapiens
gccccuaggaaggugaaucu

SEQ ID NO: 1992228 - RNA, 20 nt, Homo sapiens
auugcacuuggccucaugcu

SEQ ID NO: 1992229 - RNA, 15 nt, Homo sapiens
cucauugaaauguca

SEQ ID NO: 1992230 - RNA, 16 nt, Homo sapiens
uauuuuuucaguauua

SEQ ID NO: 1992231 - RNA, 14 nt, Homo sapiens
gcucaagacggggu

SEQ ID NO: 1992232 - RNA, 21 nt, Homo sapiens
gggcuucagcugccagugucc

SEQ ID NO: 1992233 - RNA, 11 nt, Homo sapiens
agaaguggaag

SEQ ID NO: 1992234 - RNA, 19 nt, Homo sapiens
uuuaaguuauagcuucuua

SEQ ID NO: 1992235 - RNA, 22 nt, Homo sapiens
gccaaguaacaaugcaugcuuu

SEQ ID NO: 1992236 - RNA, 22 nt, Homo sapiens
acuucagugcaagagacuuugu

SEQ ID NO: 1992237 - RNA, 12 nt, Homo sapiens
gcuaagacugau

SEQ ID NO: 1992238 - RNA, 17 nt, Homo sapiens
aucugccaaugccauga

SEQ ID NO: 1992239 - RNA, 19 nt, Homo sapiens
uaggaagauggagguuuac

SEQ ID NO: 1992240 - RNA, 15 nt, Homo sapiens
gugcugggcacugcu

SEQ ID NO: 1992241 - RNA, 13 nt, Homo sapiens
agucacauucgaa

SEQ ID NO: 1992242 - RNA, 21 nt, Homo sapiens
ucaguucacuguucaguuuag

SEQ ID NO: 1992243 - RNA, 18 nt, Homo sapiens
ucguuuucauaacuugcu

SEQ ID NO: 1992244 - RNA, 21 nt, Homo sapiens
cacagcugcagagacagagag

SEQ ID NO: 1992245 - RNA, 18 nt, Homo sapiens
aaaaggccuguggcccag

SEQ ID NO: 1992246 - RNA, 23 nt, Homo sapiens
gccuggguugggggcacucagcc

SEQ ID NO: 1992247 - RNA, 17 nt, Homo sapiens
uuaauuaguugauugcu

SEQ ID NO: 1992248 - RNA, 20 nt, Homo sapiens
acuuccugcccucucuguac

SEQ ID NO: 1992249 - RNA, 13 nt, Homo sapiens
uucauugacugau

SEQ ID NO: 1992250 - RNA, 22 nt, Homo sapiens
uagcuauuuuuuuccuaagaca

SEQ ID NO: 1992251 - RNA, 14 nt, Homo sapiens
acuugucucuucau

SEQ ID NO: 1992252 - RNA, 20 nt, Homo sapiens
caaaccugugcugaccaaag

SEQ ID NO: 1992253 - RNA, 13 nt, Homo sapiens
cacucacugccaa

SEQ ID NO: 1992254 - RNA, 18 nt, Homo sapiens
cagcagcuggugccccac

SEQ ID NO: 1992255 - RNA, 15 nt, Homo sapiens
uacuuuguuaggauu

SEQ ID NO: 1992256 - RNA, 14 nt, Homo sapiens
uugauccugaguua

SEQ ID NO: 1992257 - RNA, 13 nt, Homo sapiens
uaaaagacacagg

SEQ ID NO: 1992258 - RNA, 13 nt, Homo sapiens
auccagacucuca

SEQ ID NO: 1992259 - RNA, 20 nt, Homo sapiens
uguugcccaggcuggagugc

SEQ ID NO: 1992260 - RNA, 21 nt, Homo sapiens
accgucuucucccuauucccu

SEQ ID NO: 1992261 - RNA, 22 nt, Homo sapiens
cuacaagucaucauaauucagc

SEQ ID NO: 1992262 - RNA, 11 nt, Homo sapiens
gcaacugccug

SEQ ID NO: 1992263 - RNA, 16 nt, Homo sapiens
ugucucucucuguccu

SEQ ID NO: 1992264 - RNA, 17 nt, Homo sapiens
ggguucacuugggcucu

SEQ ID NO: 1992265 - RNA, 21 nt, Homo sapiens
aaacagauaacaccaaaccaa

SEQ ID NO: 1992266 - RNA, 16 nt, Homo sapiens
guggaaaaacugagac

SEQ ID NO: 1992267 - RNA, 16 nt, Homo sapiens
ccacccggacaggugg

SEQ ID NO: 1992268 - RNA, 19 nt, Homo sapiens
gcagaacauacuguucuca

SEQ ID NO: 1992269 - RNA, 14 nt, Homo sapiens
ucagaaaccaaagu

SEQ ID NO: 1992270 - RNA, 11 nt, Homo sapiens
acaaagacagg

SEQ ID NO: 1992271 - RNA, 11 nt, Homo sapiens
aggaagacaca

SEQ ID NO: 1992272 - RNA, 14 nt, Homo sapiens
accuacuuacaugc

SEQ ID NO: 1992273 - RNA, 15 nt, Homo sapiens
ugcacuccagccuag

SEQ ID NO: 1992274 - RNA, 14 nt, Homo sapiens
gcgaaucaucucaa

SEQ ID NO: 1992275 - RNA, 14 nt, Homo sapiens
gugacucauuucca

SEQ ID NO: 1992276 - RNA, 13 nt, Homo sapiens
cauuuugaugaua

SEQ ID NO: 1992277 - RNA, 19 nt, Homo sapiens
aauuuaggaaaugucuuga

SEQ ID NO: 1992278 - RNA, 21 nt, Homo sapiens
acaggaugaugacuauggaaa

SEQ ID NO: 1992279 - RNA, 18 nt, Homo sapiens
gauaguacuaagcauuuc

SEQ ID NO: 1992280 - RNA, 21 nt, Homo sapiens
caauuaacauacaucauucca

SEQ ID NO: 1992281 - RNA, 18 nt, Homo sapiens
ccaauucauuaugucaau

SEQ ID NO: 1992282 - RNA, 12 nt, Homo sapiens
ugccucauuuua

SEQ ID NO: 1992283 - RNA, 16 nt, Homo sapiens
uucagcagagcugaaa

SEQ ID NO: 1992284 - RNA, 23 nt, Homo sapiens
gccugggcaacgagugaaacucc

SEQ ID NO: 1992285 - RNA, 18 nt, Homo sapiens
caagacggagaugcaugg

SEQ ID NO: 1992286 - RNA, 15 nt, Homo sapiens
uuguaucuugccuaa

SEQ ID NO: 1992287 - RNA, 14 nt, Homo sapiens
guuaauguacaaaa

SEQ ID NO: 1992288 - RNA, 19 nt, Homo sapiens
ccucccaaagugcagggau

SEQ ID NO: 1992289 - RNA, 14 nt, Homo sapiens
aaugauagaacuuu

SEQ ID NO: 1992290 - RNA, 22 nt, Homo sapiens
uaagaaagaacauuuugccuga

SEQ ID NO: 1992291 - RNA, 21 nt, Homo sapiens
gacugugccagcacaaagugg

SEQ ID NO: 1992292 - RNA, 19 nt, Homo sapiens
ccaugggauguuaagcaaa

SEQ ID NO: 1992293 - RNA, 16 nt, Homo sapiens
gcccuuccucuucccc

SEQ ID NO: 1992294 - RNA, 12 nt, Homo sapiens
ugcgauggugcu

SEQ ID NO: 1992295 - RNA, 17 nt, Homo sapiens
uauuuuguaaugcugca

SEQ ID NO: 1992296 - RNA, 14 nt, Homo sapiens
agaucuuugcacca

SEQ ID NO: 1992297 - RNA, 13 nt, Homo sapiens
uuagcuugcacau

SEQ ID NO: 1992298 - RNA, 23 nt, Homo sapiens
aacguaauuguacaagcaguuaa

SEQ ID NO: 1992299 - RNA, 18 nt, Homo sapiens
auccagaguucugugaca

SEQ ID NO: 1992300 - RNA, 19 nt, Homo sapiens
guccuaagccuguuagcau

SEQ ID NO: 1992301 - RNA, 19 nt, Homo sapiens
uaagcauggucccuuguca

SEQ ID NO: 1992302 - RNA, 23 nt, Homo sapiens
aggacuaaauaaugaucuuccaa

SEQ ID NO: 1992303 - RNA, 17 nt, Homo sapiens
cccuuuaacucaugagg

SEQ ID NO: 1992304 - RNA, 17 nt, Homo sapiens
ccuaauuauaagaauuu

SEQ ID NO: 1992305 - RNA, 17 nt, Homo sapiens
aaaugcaagccaucucu

SEQ ID NO: 1992306 - RNA, 21 nt, Homo sapiens
uuagaaugggaucacgaggaa

SEQ ID NO: 1992307 - RNA, 11 nt, Homo sapiens
cgaacaccagg

SEQ ID NO: 1992308 - RNA, 22 nt, Homo sapiens
aaguuugacacaaacucacaca

SEQ ID NO: 1992309 - RNA, 17 nt, Homo sapiens
uauucauaccuguugua

SEQ ID NO: 1992310 - RNA, 18 nt, Homo sapiens
uggaagcuguguccuugc

SEQ ID NO: 1992311 - RNA, 21 nt, Homo sapiens
uuauacaucacagcagugcau

SEQ ID NO: 1992312 - RNA, 22 nt, Homo sapiens
auuuaguagaaaggucauccaa

SEQ ID NO: 1992313 - RNA, 16 nt, Homo sapiens
cccuuuccccagugac

SEQ ID NO: 1992314 - RNA, 19 nt, Homo sapiens
uauuuccaguuuuuugcca

SEQ ID NO: 1992315 - RNA, 12 nt, Homo sapiens
aaagaaauaccu

SEQ ID NO: 1992316 - RNA, 22 nt, Homo sapiens
ugguaauccuuuaaacauacaa

SEQ ID NO: 1992317 - RNA, 14 nt, Homo sapiens
cuccaccagucauu

SEQ ID NO: 1992318 - RNA, 15 nt, Homo sapiens
gaacaucccugagaa

SEQ ID NO: 1992319 - RNA, 16 nt, Homo sapiens
ugcaggccaaaccgua

SEQ ID NO: 1992320 - RNA, 22 nt, Homo sapiens
cugagacuucaggugcauucca

SEQ ID NO: 1992321 - RNA, 21 nt, Homo sapiens
agaacaugguuaccaugucuu

SEQ ID NO: 1992322 - RNA, 19 nt, Homo sapiens
aaagauauuuguacuuuga

SEQ ID NO: 1992323 - RNA, 18 nt, Homo sapiens
cugugccagacauugcuc

SEQ ID NO: 1992324 - RNA, 15 nt, Homo sapiens
uuaaaugcuacugaa

SEQ ID NO: 1992325 - RNA, 21 nt, Homo sapiens
cagccugcagacucacugugg

SEQ ID NO: 1992326 - RNA, 23 nt, Homo sapiens
cauaauaaggggaagacuuuaaa

SEQ ID NO: 1992327 - RNA, 23 nt, Homo sapiens
cucacucuucaaggaggcccacu

SEQ ID NO: 1992328 - RNA, 17 nt, Homo sapiens
aucuguacaaaggggaa

SEQ ID NO: 1992329 - RNA, 20 nt, Homo sapiens
aauacuugcaugaaugauuu

SEQ ID NO: 1992330 - RNA, 23 nt, Homo sapiens
ugagggccaacgcuugacacaaa

SEQ ID NO: 1992331 - RNA, 23 nt, Homo sapiens
ugagacucuaggguccaguggau

SEQ ID NO: 1992332 - RNA, 21 nt, Homo sapiens
accaugaacacguuuuuucac

SEQ ID NO: 1992333 - RNA, 18 nt, Homo sapiens
cucccuccagauauacuu

SEQ ID NO: 1992334 - RNA, 13 nt, Homo sapiens
agacuuguuguga

SEQ ID NO: 1992335 - RNA, 13 nt, Homo sapiens
acacauguucugu

SEQ ID NO: 1992336 - RNA, 12 nt, Homo sapiens
ccuacuguaaua

SEQ ID NO: 1992337 - RNA, 13 nt, Homo sapiens
cugugccagagau

SEQ ID NO: 1992338 - RNA, 21 nt, Homo sapiens
cuuuuacagaaugcauuaaaa

SEQ ID NO: 1992339 - RNA, 21 nt, Homo sapiens
gucaacaucuuuuacauucug

SEQ ID NO: 1992340 - RNA, 18 nt, Homo sapiens
aaauccgggucaagugaa

SEQ ID NO: 1992341 - RNA, 17 nt, Homo sapiens
gauacuugaacacugug

SEQ ID NO: 1992342 - RNA, 16 nt, Homo sapiens
uguaagagaaauggaa

SEQ ID NO: 1992343 - RNA, 14 nt, Homo sapiens
ccuggcaguugaau

SEQ ID NO: 1992344 - RNA, 15 nt, Homo sapiens
cauacaacauauacu

SEQ ID NO: 1992345 - RNA, 15 nt, Homo sapiens
gacagaaauaugauu

SEQ ID NO: 1992346 - RNA, 21 nt, Homo sapiens
aacaauauguuugcaaacuug

SEQ ID NO: 1992347 - RNA, 21 nt, Homo sapiens
uaaugacucuuucugaaggaa

SEQ ID NO: 1992348 - RNA, 10 nt, Homo sapiens
uguguuccaa

SEQ ID NO: 1992349 - RNA, 15 nt, Homo sapiens
cccucccacggugcc

SEQ ID NO: 1992350 - RNA, 21 nt, Homo sapiens
aauacuugaacucuguucccc

SEQ ID NO: 1992351 - RNA, 18 nt, Homo sapiens
cagcuuccuguuacugag

SEQ ID NO: 1992352 - RNA, 16 nt, Homo sapiens
uccugcuuaaugucag

SEQ ID NO: 1992353 - RNA, 16 nt, Homo sapiens
aauguuuguccuguau

SEQ ID NO: 1992354 - RNA, 13 nt, Homo sapiens
uuuaauuuacacu

SEQ ID NO: 1992355 - RNA, 12 nt, Homo sapiens
ggcagaacuccc

SEQ ID NO: 1992356 - RNA, 22 nt, Homo sapiens
ccuuagauuagcucuggaccag

SEQ ID NO: 1992357 - RNA, 22 nt, Homo sapiens
cacauccaaccccccaccugcc

SEQ ID NO: 1992358 - RNA, 15 nt, Homo sapiens
uuccaauaaagcagc

SEQ ID NO: 1992359 - RNA, 14 nt, Homo sapiens
guccucccaagcug

SEQ ID NO: 1992360 - RNA, 12 nt, Homo sapiens
ggaacugugcaa

SEQ ID NO: 1992361 - RNA, 16 nt, Homo sapiens
cccgugucuagaggca

SEQ ID NO: 1992362 - RNA, 17 nt, Homo sapiens
aggcacccaccacaucu

SEQ ID NO: 1992363 - RNA, 22 nt, Homo sapiens
ggaccagcuggccugggguccc

SEQ ID NO: 1992364 - RNA, 23 nt, Homo sapiens
cagucaagggcaagcuggaguua

SEQ ID NO: 1992365 - RNA, 21 nt, Homo sapiens
cggggugagcccccagagcug

SEQ ID NO: 1992366 - RNA, 16 nt, Homo sapiens
aauuuuguaugccaau

SEQ ID NO: 1992367 - RNA, 12 nt, Homo sapiens
caucaacacagu

SEQ ID NO: 1992368 - RNA, 13 nt, Homo sapiens
uguuuagcuauuu

SEQ ID NO: 1992369 - RNA, 22 nt, Homo sapiens
gcuguuuguuucauauauacag

SEQ ID NO: 1992370 - RNA, 18 nt, Homo sapiens
aacugucuuuuaaugugu

SEQ ID NO: 1992371 - RNA, 23 nt, Homo sapiens
aucagugacagaguucacuauaa

SEQ ID NO: 1992372 - RNA, 22 nt, Homo sapiens
ugauuucuuauuauuauauguu

SEQ ID NO: 1992373 - RNA, 21 nt, Homo sapiens
aaacacacaaacuauuacuua

SEQ ID NO: 1992374 - RNA, 19 nt, Homo sapiens
uaaaugagacgagacaugu

SEQ ID NO: 1992375 - RNA, 19 nt, Homo sapiens
cuaaggggccccuccuugu

SEQ ID NO: 1992376 - RNA, 20 nt, Homo sapiens
uaauuccuguuacuuuacag

SEQ ID NO: 1992377 - RNA, 20 nt, Homo sapiens
agagaccugccagauuauca

SEQ ID NO: 1992378 - RNA, 22 nt, Homo sapiens
aaucagugagaagaauagcuua

SEQ ID NO: 1992379 - RNA, 16 nt, Homo sapiens
cuguaagcucuuugaa

SEQ ID NO: 1992380 - RNA, 17 nt, Homo sapiens
ucucuauuucuggauga

SEQ ID NO: 1992381 - RNA, 15 nt, Homo sapiens
ucccaggaacugggc

SEQ ID NO: 1992382 - RNA, 18 nt, Homo sapiens
gugcccaccgcccuccuc

SEQ ID NO: 1992383 - RNA, 12 nt, Homo sapiens
ugcuaccaaaaa

SEQ ID NO: 1992384 - RNA, 20 nt, Homo sapiens
agcuuugaaaaaacaccaug

SEQ ID NO: 1992385 - RNA, 13 nt, Homo sapiens
ucauaaaugucac

SEQ ID NO: 1992386 - RNA, 15 nt, Homo sapiens
uccacucacuccagc

SEQ ID NO: 1992387 - RNA, 14 nt, Homo sapiens
uauuguuacuggua

SEQ ID NO: 1992388 - RNA, 16 nt, Homo sapiens
ucuacagaauaaucca

SEQ ID NO: 1992389 - RNA, 23 nt, Homo sapiens
uccucucuaagugggcauugcca

SEQ ID NO: 1992390 - RNA, 22 nt, Homo sapiens
aaaacugggacguguauuucca

SEQ ID NO: 1992391 - RNA, 22 nt, Homo sapiens
cagggccacguuaccacagacc

SEQ ID NO: 1992392 - RNA, 21 nt, Homo sapiens
auuccaugccgcagacaugaa

SEQ ID NO: 1992393 - RNA, 23 nt, Homo sapiens
uacccauagaaaacuugacaugu

SEQ ID NO: 1992394 - RNA, 14 nt, Homo sapiens
ggauaaacaucaca

SEQ ID NO: 1992395 - RNA, 19 nt, Homo sapiens
caguugauucugaaucuga

SEQ ID NO: 1992396 - RNA, 15 nt, Homo sapiens
ccugccaguguuuag

SEQ ID NO: 1992397 - RNA, 20 nt, Homo sapiens
aggagccggacacuucucag

SEQ ID NO: 1992398 - RNA, 21 nt, Homo sapiens
cacuuuuuuccugucaauaua

SEQ ID NO: 1992399 - RNA, 17 nt, Homo sapiens
ucuugaauagacuucca

SEQ ID NO: 1992400 - RNA, 23 nt, Homo sapiens
ucucacuuaauuuucccaaugau

SEQ ID NO: 1992401 - RNA, 21 nt, Homo sapiens
caguccuguccuuuaccaaag

SEQ ID NO: 1992402 - RNA, 22 nt, Homo sapiens
aaaaacaaugugcugcugcuuc

SEQ ID NO: 1992403 - RNA, 14 nt, Homo sapiens
ucccuuguuuacuc

SEQ ID NO: 1992404 - RNA, 23 nt, Homo sapiens
uaugcuggaguauuuucuaauaa

SEQ ID NO: 1992405 - RNA, 17 nt, Homo sapiens
uuucugaaugucuguga

SEQ ID NO: 1992406 - RNA, 15 nt, Homo sapiens
cuuucuaccaaauga

SEQ ID NO: 1992407 - RNA, 21 nt, Homo sapiens
ucccuuuugcuagagcugaca

SEQ ID NO: 1992408 - RNA, 18 nt, Homo sapiens
ucucuugccucaaccucc

SEQ ID NO: 1992409 - RNA, 19 nt, Homo sapiens
cuuuugguaucuacuucua

SEQ ID NO: 1992410 - RNA, 18 nt, Homo sapiens
ucuggcaggcuacucugc

SEQ ID NO: 1992411 - RNA, 15 nt, Homo sapiens
cagagcauacaacag

SEQ ID NO: 1992412 - RNA, 23 nt, Homo sapiens
guccaugaaaucuuuaugugaua

SEQ ID NO: 1992413 - RNA, 20 nt, Homo sapiens
acccuuucauucagccuuua

SEQ ID NO: 1992414 - RNA, 18 nt, Homo sapiens
uuuugggaagaauccagu

SEQ ID NO: 1992415 - RNA, 16 nt, Homo sapiens
guucaaaacauuccaa

SEQ ID NO: 1992416 - RNA, 14 nt, Homo sapiens
auucuuguuauacc

SEQ ID NO: 1992417 - RNA, 21 nt, Homo sapiens
cagacagaucuggaaugugaa

SEQ ID NO: 1992418 - RNA, 20 nt, Homo sapiens
acgaauuucugugcccuccu

SEQ ID NO: 1992419 - RNA, 18 nt, Homo sapiens
aaacaaucuuagacauuu

SEQ ID NO: 1992420 - RNA, 17 nt, Homo sapiens
gaacagguguuccuccu

SEQ ID NO: 1992421 - RNA, 23 nt, Homo sapiens
uuacuaagcuuugccagcugcug

SEQ ID NO: 1992422 - RNA, 20 nt, Homo sapiens
agcccuggugcuacuugcuu

SEQ ID NO: 1992423 - RNA, 20 nt, Homo sapiens
caagauuuaccaauucaccc

SEQ ID NO: 1992424 - RNA, 22 nt, Homo sapiens
uuaaaaauggcucaaguagaaa

SEQ ID NO: 1992425 - RNA, 15 nt, Homo sapiens
auugauuaaugaacu

SEQ ID NO: 1992426 - RNA, 10 nt, Homo sapiens
cugucuuccc

SEQ ID NO: 1992427 - RNA, 18 nt, Homo sapiens
cugaucuagcacuccuca

SEQ ID NO: 1992428 - RNA, 15 nt, Homo sapiens
uguucuuaacacuuc

SEQ ID NO: 1992429 - RNA, 21 nt, Homo sapiens
uagaaaaauuagaugacugaa

SEQ ID NO: 1992430 - RNA, 23 nt, Homo sapiens
ccaauacaugguguauagcacca

SEQ ID NO: 1992431 - RNA, 14 nt, Homo sapiens
accuguucaagaag

SEQ ID NO: 1992432 - RNA, 20 nt, Homo sapiens
gccauugagugcagcagugu

SEQ ID NO: 1992433 - RNA, 16 nt, Homo sapiens
aagccugaaguggaau

SEQ ID NO: 1992434 - RNA, 19 nt, Homo sapiens
ccacguugccucuacuuua

SEQ ID NO: 1992435 - RNA, 13 nt, Homo sapiens
caauaucuugcca

SEQ ID NO: 1992436 - RNA, 15 nt, Homo sapiens
uuuuacugacgcuca

SEQ ID NO: 1992437 - RNA, 13 nt, Homo sapiens
agaagauuuugcc

SEQ ID NO: 1992438 - RNA, 19 nt, Homo sapiens
cagacauacauuuaugcac

SEQ ID NO: 1992439 - RNA, 21 nt, Homo sapiens
cagaugagcaaggacauugcc

SEQ ID NO: 1992440 - RNA, 22 nt, Homo sapiens
auggacuccuggacuacuuuca

SEQ ID NO: 1992441 - RNA, 20 nt, Homo sapiens
gagacaccaaacugccaaaa

SEQ ID NO: 1992442 - RNA, 14 nt, Homo sapiens
acccauaccacagc

SEQ ID NO: 1992443 - RNA, 22 nt, Homo sapiens
uccauuuuucccaggacaggaa

SEQ ID NO: 1992444 - RNA, 23 nt, Homo sapiens
caaaauaaauuggaaaugugaau

SEQ ID NO: 1992445 - RNA, 19 nt, Homo sapiens
ucccgggcacugucaugcc

SEQ ID NO: 1992446 - RNA, 16 nt, Homo sapiens
cuggccaaaaugcaga

SEQ ID NO: 1992447 - RNA, 13 nt, Homo sapiens
gcugugugcaguc

SEQ ID NO: 1992448 - RNA, 17 nt, Homo sapiens
cagucucugaauacaca

SEQ ID NO: 1992449 - RNA, 12 nt, Homo sapiens
uaccucacuuuu

SEQ ID NO: 1992450 - RNA, 14 nt, Homo sapiens
uaaagcauccuccu

SEQ ID NO: 1992451 - RNA, 21 nt, Homo sapiens
cuguaggaagguacuguauga

SEQ ID NO: 1992452 - RNA, 20 nt, Homo sapiens
ucuaaaauaacuaguacaaa

SEQ ID NO: 1992453 - RNA, 23 nt, Homo sapiens
gaauauauggggggagugagcuc

SEQ ID NO: 1992454 - RNA, 15 nt, Homo sapiens
uuucuuccaccacuc

SEQ ID NO: 1992455 - RNA, 19 nt, Homo sapiens
cuucaauuaaaauuacaaa

SEQ ID NO: 1992456 - RNA, 20 nt, Homo sapiens
gacauagaauuaacacauga

SEQ ID NO: 1992457 - RNA, 22 nt, Homo sapiens
caccuaacucaugccauuccag

SEQ ID NO: 1992458 - RNA, 18 nt, Homo sapiens
aguaaaauucuacuguau

SEQ ID NO: 1992459 - RNA, 15 nt, Homo sapiens
caucucaucaugucu

SEQ ID NO: 1992460 - RNA, 12 nt, Homo sapiens
aauauacuguaa

SEQ ID NO: 1992461 - RNA, 13 nt, Homo sapiens
aaaaacauggccu

SEQ ID NO: 1992462 - RNA, 13 nt, Homo sapiens
guggaggauucau

SEQ ID NO: 1992463 - RNA, 16 nt, Homo sapiens
agcccugggaccgcua

SEQ ID NO: 1992464 - RNA, 14 nt, Homo sapiens
gguaggugugacau

SEQ ID NO: 1992465 - RNA, 13 nt, Homo sapiens
guagcggcccuga

SEQ ID NO: 1992466 - RNA, 15 nt, Homo sapiens
guaaggccuuucaau

SEQ ID NO: 1992467 - RNA, 18 nt, Homo sapiens
ggccaggcuuacugagcu

SEQ ID NO: 1992468 - RNA, 22 nt, Homo sapiens
auccaguuuugucaaugcaguu

SEQ ID NO: 1992469 - RNA, 16 nt, Homo sapiens
ccucuuaccaacaucu

SEQ ID NO: 1992470 - RNA, 23 nt, Homo sapiens
accuggagcaucauaauggacuc

SEQ ID NO: 1992471 - RNA, 14 nt, Homo sapiens
aacaugcacauuca

SEQ ID NO: 1992472 - RNA, 13 nt, Homo sapiens
caaagccagugaa

SEQ ID NO: 1992473 - RNA, 15 nt, Homo sapiens
ggaaauuauuggaaa

SEQ ID NO: 1992474 - RNA, 20 nt, Homo sapiens
acaagacacagaauaguuua

SEQ ID NO: 1992475 - RNA, 13 nt, Homo sapiens
uuccccacucccg

SEQ ID NO: 1992476 - RNA, 14 nt, Homo sapiens
cugcacaguuuucu

SEQ ID NO: 1992477 - RNA, 20 nt, Homo sapiens
ucgugguuuuuacauucaau

SEQ ID NO: 1992478 - RNA, 11 nt, Homo sapiens
acacacacagg

SEQ ID NO: 1992479 - RNA, 14 nt, Homo sapiens
uccagacccggcug

SEQ ID NO: 1992480 - RNA, 20 nt, Homo sapiens
gcccaggcuggaguguagug

SEQ ID NO: 1992481 - RNA, 21 nt, Homo sapiens
ggcucagccuugcacacccac

SEQ ID NO: 1992482 - RNA, 17 nt, Homo sapiens
ccugcuuuuggggcucu

SEQ ID NO: 1992483 - RNA, 15 nt, Homo sapiens
gccccuaacuccugc

SEQ ID NO: 1992484 - RNA, 14 nt, Homo sapiens
cacauucgucacag

SEQ ID NO: 1992485 - RNA, 18 nt, Homo sapiens
uggagaggagaguggcag

SEQ ID NO: 1992486 - RNA, 14 nt, Homo sapiens
ucugcacagauucu

SEQ ID NO: 1992487 - RNA, 22 nt, Homo sapiens
cuuauucuugagcacaaaauga

SEQ ID NO: 1992488 - RNA, 18 nt, Homo sapiens
cuucagauacuugugaac

SEQ ID NO: 1992489 - RNA, 23 nt, Homo sapiens
aaccagcucuuuggugccagcug

SEQ ID NO: 1992490 - RNA, 19 nt, Homo sapiens
gaaucgcuugaaccuggga

SEQ ID NO: 1992491 - RNA, 12 nt, Homo sapiens
acugcugcacaa

SEQ ID NO: 1992492 - RNA, 18 nt, Homo sapiens
cuguaacccucacccaca

SEQ ID NO: 1992493 - RNA, 21 nt, Homo sapiens
aguggugcccuggaacacucc

SEQ ID NO: 1992494 - RNA, 16 nt, Homo sapiens
uaaauuaaaagcccua

SEQ ID NO: 1992495 - RNA, 16 nt, Homo sapiens
aaaaccaauagcuuua

SEQ ID NO: 1992496 - RNA, 16 nt, Homo sapiens
gcugggacuacaggug

SEQ ID NO: 1992497 - RNA, 13 nt, Homo sapiens
gaugauacaucca

SEQ ID NO: 1992498 - RNA, 22 nt, Homo sapiens
gaaauaguaccuucaauacuua

SEQ ID NO: 1992499 - RNA, 21 nt, Homo sapiens
auaugguagcaacacugugaa

SEQ ID NO: 1992500 - RNA, 16 nt, Homo sapiens
cugcauguacuguaua

SEQ ID NO: 1992501 - RNA, 17 nt, Homo sapiens
uccaucccuccauucau

SEQ ID NO: 1992502 - RNA, 15 nt, Homo sapiens
acacuguuucaucuc

SEQ ID NO: 1992503 - RNA, 16 nt, Homo sapiens
ugaacacaggcagcuu

SEQ ID NO: 1992504 - RNA, 14 nt, Homo sapiens
uaucagaaguguua

SEQ ID NO: 1992505 - RNA, 19 nt, Homo sapiens
cugagugagaagauaaaaa

SEQ ID NO: 1992506 - RNA, 22 nt, Homo sapiens
aaacucaaccuaacacauuaaa

SEQ ID NO: 1992507 - RNA, 20 nt, Homo sapiens
gaauaacuguguuuccuacc

SEQ ID NO: 1992508 - RNA, 18 nt, Homo sapiens
uacacacuuuuuaagaaa

SEQ ID NO: 1992509 - RNA, 17 nt, Homo sapiens
caaagcuugucaaagau

SEQ ID NO: 1992510 - RNA, 14 nt, Homo sapiens
ggaucuaguccagc

SEQ ID NO: 1992511 - RNA, 15 nt, Homo sapiens
ugcauuuggugguuu

SEQ ID NO: 1992512 - RNA, 15 nt, Homo sapiens
ccugaggaccaccuc

SEQ ID NO: 1992513 - RNA, 23 nt, Homo sapiens
uccuaaucauacaccagaagaca

SEQ ID NO: 1992514 - RNA, 16 nt, Homo sapiens
uguaccauucucaggu

SEQ ID NO: 1992515 - RNA, 24 nt, Homo sapiens
aaaaucacaacacagagcugcuau

SEQ ID NO: 1992516 - RNA, 18 nt, Homo sapiens
acauguacacgugcacag

SEQ ID NO: 1992517 - RNA, 18 nt, Homo sapiens
acgcacacacacauacag

SEQ ID NO: 1992518 - RNA, 21 nt, Homo sapiens
cccggcucccccugcuucuca

SEQ ID NO: 1992519 - RNA, 22 nt, Homo sapiens
aggaagcuugguccacuugcuu

SEQ ID NO: 1992520 - RNA, 22 nt, Homo sapiens
ggggagagauggcacaccagau

SEQ ID NO: 1992521 - RNA, 17 nt, Homo sapiens
agauucagguaauacaa

SEQ ID NO: 1992522 - RNA, 20 nt, Homo sapiens
gcuuuugacccaaaugcaaa

SEQ ID NO: 1992523 - RNA, 13 nt, Homo sapiens
ccuauugcugcua

SEQ ID NO: 1992524 - RNA, 19 nt, Homo sapiens
cugcuaguuuauauagaaa

SEQ ID NO: 1992525 - RNA, 14 nt, Homo sapiens
cucagacauccaca

SEQ ID NO: 1992526 - RNA, 23 nt, Homo sapiens
uggaccacaggaggugugauaga

SEQ ID NO: 1992527 - RNA, 21 nt, Homo sapiens
aguaugugaguguguccaagu

SEQ ID NO: 1992528 - RNA, 13 nt, Homo sapiens
aaccaugaacuca

SEQ ID NO: 1992529 - RNA, 11 nt, Homo sapiens
aagcaucaucc

SEQ ID NO: 1992530 - RNA, 14 nt, Homo sapiens
aaguucaucuugca

SEQ ID NO: 1992531 - RNA, 23 nt, Homo sapiens
agugauguuagcagacccagcuu

SEQ ID NO: 1992532 - RNA, 15 nt, Homo sapiens
uagcuaacaaaagau

SEQ ID NO: 1992533 - RNA, 17 nt, Homo sapiens
cgugagcagcuuuggaa

SEQ ID NO: 1992534 - RNA, 18 nt, Homo sapiens
cagccucucaaguagcug

SEQ ID NO: 1992535 - RNA, 13 nt, Homo sapiens
acucagcacauuc

SEQ ID NO: 1992536 - RNA, 16 nt, Homo sapiens
ucaaguagcugggacu

SEQ ID NO: 1992537 - RNA, 19 nt, Homo sapiens
agccagccaacccuuucau

SEQ ID NO: 1992538 - RNA, 21 nt, Homo sapiens
uucuucaucccuuuccaguua

SEQ ID NO: 1992539 - RNA, 17 nt, Homo sapiens
gaacauguguguguguu

SEQ ID NO: 1992540 - RNA, 12 nt, Homo sapiens
ccagccugcuuu

SEQ ID NO: 1992541 - RNA, 22 nt, Homo sapiens
cugccaugccuccccaaauugg

SEQ ID NO: 1992542 - RNA, 15 nt, Homo sapiens
ccagcuccucacuca

SEQ ID NO: 1992543 - RNA, 19 nt, Homo sapiens
guugguuaguagacacuaa

SEQ ID NO: 1992544 - RNA, 18 nt, Homo sapiens
aagucuguccauuaucua

SEQ ID NO: 1992545 - RNA, 17 nt, Homo sapiens
uuguggguccaugcuaa

SEQ ID NO: 1992546 - RNA, 19 nt, Homo sapiens
uguccuguccuuucuugca

SEQ ID NO: 1992547 - RNA, 21 nt, Homo sapiens
ucaauaguguccuaugcaaua

SEQ ID NO: 1992548 - RNA, 23 nt, Homo sapiens
aagugccacgugaacuaugcaau

SEQ ID NO: 1992549 - RNA, 18 nt, Homo sapiens
aaauuuaaugacaguuuu

SEQ ID NO: 1992550 - RNA, 21 nt, Homo sapiens
auucucaugugauccuuuuau

SEQ ID NO: 1992551 - RNA, 13 nt, Homo sapiens
gcaaagcacagag

SEQ ID NO: 1992552 - RNA, 22 nt, Homo sapiens
ucuaaaguguuggucuuucuaa

SEQ ID NO: 1992553 - RNA, 15 nt, Homo sapiens
auuagaggauugcac

SEQ ID NO: 1992554 - RNA, 17 nt, Homo sapiens
cuauucuguaucauuga

SEQ ID NO: 1992555 - RNA, 20 nt, Homo sapiens
uaccaccagcuguguccaaa

SEQ ID NO: 1992556 - RNA, 21 nt, Homo sapiens
agcaaagugaagacacuggcu

SEQ ID NO: 1992557 - RNA, 19 nt, Homo sapiens
guauuuauuacaacucuau

SEQ ID NO: 1992558 - RNA, 16 nt, Homo sapiens
agguucccgacaccag

SEQ ID NO: 1992559 - RNA, 16 nt, Homo sapiens
auuccagcauuugcca

SEQ ID NO: 1992560 - RNA, 18 nt, Homo sapiens
ucuacuaauuuccugcug

SEQ ID NO: 1992561 - RNA, 18 nt, Homo sapiens
gccucagaggccuuggga

SEQ ID NO: 1992562 - RNA, 14 nt, Homo sapiens
gagucuggggacca

SEQ ID NO: 1992563 - RNA, 16 nt, Homo sapiens
aagcacagccucagaa

SEQ ID NO: 1992564 - RNA, 23 nt, Homo sapiens
cugcuuuuaaagauauggcugcu

SEQ ID NO: 1992565 - RNA, 21 nt, Homo sapiens
auacuccacuccaagugcccc

SEQ ID NO: 1992566 - RNA, 23 nt, Homo sapiens
uccugugcggugucaccaugagc

SEQ ID NO: 1992567 - RNA, 16 nt, Homo sapiens
guucugccacuuaggg

SEQ ID NO: 1992568 - RNA, 15 nt, Homo sapiens
uugucuguucacuuu

SEQ ID NO: 1992569 - RNA, 14 nt, Homo sapiens
caguugcugugaac

SEQ ID NO: 1992570 - RNA, 16 nt, Homo sapiens
cgggccacagggcggu

SEQ ID NO: 1992571 - RNA, 14 nt, Homo sapiens
aaguaagacuuuua

SEQ ID NO: 1992572 - RNA, 21 nt, Homo sapiens
cauguggugggacuuucauau

SEQ ID NO: 1992573 - RNA, 18 nt, Homo sapiens
uaugccagggcgcacuuu

SEQ ID NO: 1992574 - RNA, 22 nt, Homo sapiens
guuagacucaagggggugacag

SEQ ID NO: 1992575 - RNA, 17 nt, Homo sapiens
aacugucaccugaaaua

SEQ ID NO: 1992576 - RNA, 14 nt, Homo sapiens
acaccugucugugc

SEQ ID NO: 1992577 - RNA, 20 nt, Homo sapiens
aagugauccucccaccucag

SEQ ID NO: 1992578 - RNA, 12 nt, Homo sapiens
acauguuugcag

SEQ ID NO: 1992579 - RNA, 14 nt, Homo sapiens
ggaagagugcaaaa

SEQ ID NO: 1992580 - RNA, 21 nt, Homo sapiens
ccucaggcccaauucugccac

SEQ ID NO: 1992581 - RNA, 20 nt, Homo sapiens
ccauuuugguuuuccuuaac

SEQ ID NO: 1992582 - RNA, 18 nt, Homo sapiens
cagcucuccccuucucug

SEQ ID NO: 1992583 - RNA, 17 nt, Homo sapiens
acauaaugcgugcauac

SEQ ID NO: 1992584 - RNA, 17 nt, Homo sapiens
aguucuggucagaugau

SEQ ID NO: 1992585 - RNA, 20 nt, Homo sapiens
cuuguuuuauuuugugcuau

SEQ ID NO: 1992586 - RNA, 24 nt, Homo sapiens
cagucucugcugaucacaugugcc

SEQ ID NO: 1992587 - RNA, 17 nt, Homo sapiens
aacaaugauuaaucagc

SEQ ID NO: 1992588 - RNA, 17 nt, Homo sapiens
acguggagauagugcca

SEQ ID NO: 1992589 - RNA, 21 nt, Homo sapiens
aggcuucuuccccccaaaacu

SEQ ID NO: 1992590 - RNA, 13 nt, Homo sapiens
gucccucuuccau

SEQ ID NO: 1992591 - RNA, 14 nt, Homo sapiens
cccuccacguucac

SEQ ID NO: 1992592 - RNA, 21 nt, Homo sapiens
uaguuuuuggacuauguaaac

SEQ ID NO: 1992593 - RNA, 21 nt, Homo sapiens
cagagaccuugccacacugaa

SEQ ID NO: 1992594 - RNA, 12 nt, Homo sapiens
cuuguugcacug

SEQ ID NO: 1992595 - RNA, 12 nt, Homo sapiens
cuacuugcacac

SEQ ID NO: 1992596 - RNA, 13 nt, Homo sapiens
uagauauugcuac

SEQ ID NO: 1992597 - RNA, 13 nt, Homo sapiens
gaccccuuccucc

SEQ ID NO: 1992598 - RNA, 20 nt, Homo sapiens
ucagagucucugauacacag

SEQ ID NO: 1992599 - RNA, 16 nt, Homo sapiens
cauggccuaugcacau

SEQ ID NO: 1992600 - RNA, 17 nt, Homo sapiens
augauucuaguacauaa

SEQ ID NO: 1992601 - RNA, 15 nt, Homo sapiens
augagggcgcaagaa

SEQ ID NO: 1992602 - RNA, 17 nt, Homo sapiens
ccuucaguuuauuucca

SEQ ID NO: 1992603 - RNA, 17 nt, Homo sapiens
cgcuggguccucugcag

SEQ ID NO: 1992604 - RNA, 21 nt, Homo sapiens
uaaggcaugcucccagcauuu

SEQ ID NO: 1992605 - RNA, 13 nt, Homo sapiens
cauccaucugugg

SEQ ID NO: 1992606 - RNA, 22 nt, Homo sapiens
uggcagaaaucccaguucaugu

SEQ ID NO: 1992607 - RNA, 19 nt, Homo sapiens
acuucuuuauucacaguau

SEQ ID NO: 1992608 - RNA, 19 nt, Homo sapiens
auccaaagcgaucauguca

SEQ ID NO: 1992609 - RNA, 15 nt, Homo sapiens
acugcaaacacaccu

SEQ ID NO: 1992610 - RNA, 17 nt, Homo sapiens
gcccgggagccuaggac

SEQ ID NO: 1992611 - RNA, 19 nt, Homo sapiens
acaaaagugaaccaucuca

SEQ ID NO: 1992612 - RNA, 14 nt, Homo sapiens
ugucagagcccagg

SEQ ID NO: 1992613 - RNA, 18 nt, Homo sapiens
aggcaccuuaguggcuuu

SEQ ID NO: 1992614 - RNA, 23 nt, Homo sapiens
agccuccccacguggcaccuccu

SEQ ID NO: 1992615 - RNA, 23 nt, Homo sapiens
ccguuuucauuguucacuucuaa

SEQ ID NO: 1992616 - RNA, 14 nt, Homo sapiens
ccugaccugucuca

SEQ ID NO: 1992617 - RNA, 17 nt, Homo sapiens
accuuaaaugcugagau

SEQ ID NO: 1992618 - RNA, 14 nt, Homo sapiens
ucccuaaaaacaca

SEQ ID NO: 1992619 - RNA, 15 nt, Homo sapiens
gguccuuuagucugu

SEQ ID NO: 1992620 - RNA, 19 nt, Homo sapiens
uacuguauggaaacacuga

SEQ ID NO: 1992621 - RNA, 19 nt, Homo sapiens
guguucaagugcgugacug

SEQ ID NO: 1992622 - RNA, 16 nt, Homo sapiens
agaagugccaguugau

SEQ ID NO: 1992623 - RNA, 16 nt, Homo sapiens
cccaugaguccuugaa

SEQ ID NO: 1992624 - RNA, 18 nt, Homo sapiens
cagacucaauaaaaucau

SEQ ID NO: 1992625 - RNA, 13 nt, Homo sapiens
cucuucaucccau

SEQ ID NO: 1992626 - RNA, 20 nt, Homo sapiens
aaaugaacuccauugcuuaa

SEQ ID NO: 1992627 - RNA, 21 nt, Homo sapiens
uaccugcccccaauccaugaa

SEQ ID NO: 1992628 - RNA, 21 nt, Homo sapiens
aucuccucucucuuuccucca

SEQ ID NO: 1992629 - RNA, 13 nt, Homo sapiens
ugagaagaaugaa

SEQ ID NO: 1992630 - RNA, 14 nt, Homo sapiens
uuggacugucuaua

SEQ ID NO: 1992631 - RNA, 12 nt, Homo sapiens
auauacuaugaa

SEQ ID NO: 1992632 - RNA, 14 nt, Homo sapiens
ucacucgaacccgg

SEQ ID NO: 1992633 - RNA, 23 nt, Homo sapiens
agaauucugcuaccucacugggg

SEQ ID NO: 1992634 - RNA, 20 nt, Homo sapiens
ccauacucaugcaugcaaau

SEQ ID NO: 1992635 - RNA, 12 nt, Homo sapiens
auuaggucuuaa

SEQ ID NO: 1992636 - RNA, 18 nt, Homo sapiens
gucauggacuguugccac

SEQ ID NO: 1992637 - RNA, 22 nt, Homo sapiens
ugcaagccccugcuccagaaga

SEQ ID NO: 1992638 - RNA, 23 nt, Homo sapiens
ccguuguguggguuuacucugug

SEQ ID NO: 1992639 - RNA, 17 nt, Homo sapiens
auuguaaaguagcugua

SEQ ID NO: 1992640 - RNA, 17 nt, Homo sapiens
aggaaaggcacauuaca

SEQ ID NO: 1992641 - RNA, 21 nt, Homo sapiens
ccaugagacucgguccaagag

SEQ ID NO: 1992642 - RNA, 20 nt, Homo sapiens
uuuguuggaaaguaucauga

SEQ ID NO: 1992643 - RNA, 18 nt, Homo sapiens
ugaauauaaauguacuac

SEQ ID NO: 1992644 - RNA, 13 nt, Homo sapiens
agcucacagucua

SEQ ID NO: 1992645 - RNA, 15 nt, Homo sapiens
uaauuuaagugacac

SEQ ID NO: 1992646 - RNA, 17 nt, Homo sapiens
uaaacacuccacagugu

SEQ ID NO: 1992647 - RNA, 12 nt, Homo sapiens
cauacaaauacu

SEQ ID NO: 1992648 - RNA, 17 nt, Homo sapiens
gccaaguaucuuuccag

SEQ ID NO: 1992649 - RNA, 14 nt, Homo sapiens
aaaauagaauccaa

SEQ ID NO: 1992650 - RNA, 20 nt, Homo sapiens
aaggaccucucucaaugcca

SEQ ID NO: 1992651 - RNA, 22 nt, Homo sapiens
auuaccagcauuuacuaugcca

SEQ ID NO: 1992652 - RNA, 19 nt, Homo sapiens
caaagugaaagacauuuca

SEQ ID NO: 1992653 - RNA, 17 nt, Homo sapiens
uggguuccagacagagu

SEQ ID NO: 1992654 - RNA, 17 nt, Homo sapiens
aguaccaccaagggauc

SEQ ID NO: 1992655 - RNA, 13 nt, Homo sapiens
uaauaaagcuuua

SEQ ID NO: 1992656 - RNA, 13 nt, Homo sapiens
aaaacgucuugcu

SEQ ID NO: 1992657 - RNA, 14 nt, Homo sapiens
aaaugaccaagaca

SEQ ID NO: 1992658 - RNA, 19 nt, Homo sapiens
gaaaguguuuaacuuguca

SEQ ID NO: 1992659 - RNA, 24 nt, Homo sapiens
cuggccaugccuggagacauauca

SEQ ID NO: 1992660 - RNA, 23 nt, Homo sapiens
gaguuggggccauugcuuaccuu

SEQ ID NO: 1992661 - RNA, 13 nt, Homo sapiens
agugguacaggaa

SEQ ID NO: 1992662 - RNA, 16 nt, Homo sapiens
uccuauuacuuuucau

SEQ ID NO: 1992663 - RNA, 19 nt, Homo sapiens
gugcuugccugggaccagu

SEQ ID NO: 1992664 - RNA, 21 nt, Homo sapiens
auucccugcccaaacccuuaa

SEQ ID NO: 1992665 - RNA, 21 nt, Homo sapiens
accccacccacuucugcacuu

SEQ ID NO: 1992666 - RNA, 16 nt, Homo sapiens
uagacacuuacuugau

SEQ ID NO: 1992667 - RNA, 19 nt, Homo sapiens
gccugggggcuuuugccac

SEQ ID NO: 1992668 - RNA, 19 nt, Homo sapiens
ucauguguaauaugcacaa

SEQ ID NO: 1992669 - RNA, 16 nt, Homo sapiens
ugucccugaaaccuag

SEQ ID NO: 1992670 - RNA, 15 nt, Homo sapiens
gggcugcgagcauuu

SEQ ID NO: 1992671 - RNA, 13 nt, Homo sapiens
uguauauaagcaa

SEQ ID NO: 1992672 - RNA, 13 nt, Homo sapiens
uauuuauaaacua

SEQ ID NO: 1992673 - RNA, 22 nt, Homo sapiens
cagcaaaccaaugcuauuguga

SEQ ID NO: 1992674 - RNA, 14 nt, Homo sapiens
aauggaaucauaua

SEQ ID NO: 1992675 - RNA, 22 nt, Homo sapiens
ugucuuucuccucuggagagua

SEQ ID NO: 1992676 - RNA, 18 nt, Homo sapiens
aucaccaaggagccaaac

SEQ ID NO: 1992677 - RNA, 18 nt, Homo sapiens
ugacccugugccuguguu

SEQ ID NO: 1992678 - RNA, 17 nt, Homo sapiens
uuugagauguauuucaa

SEQ ID NO: 1992679 - RNA, 17 nt, Homo sapiens
agccccugggguggcca

SEQ ID NO: 1992680 - RNA, 18 nt, Homo sapiens
acaugaaaaaauacucaa

SEQ ID NO: 1992681 - RNA, 14 nt, Homo sapiens
cuacguucucuuua

SEQ ID NO: 1992682 - RNA, 19 nt, Homo sapiens
accuauuucugaugauguc

SEQ ID NO: 1992683 - RNA, 16 nt, Homo sapiens
auugagcgccauaagc

SEQ ID NO: 1992684 - RNA, 18 nt, Homo sapiens
uucaaaccacaauaucca

SEQ ID NO: 1992685 - RNA, 19 nt, Homo sapiens
agauugaagccuuugccag

SEQ ID NO: 1992686 - RNA, 20 nt, Homo sapiens
cgauaacuuugugauguuuc

SEQ ID NO: 1992687 - RNA, 14 nt, Homo sapiens
uauacauauagaua

SEQ ID NO: 1992688 - RNA, 12 nt, Homo sapiens
auagguguuacc

SEQ ID NO: 1992689 - RNA, 23 nt, Homo sapiens
gcagagaagggcauaaaacagcu

SEQ ID NO: 1992690 - RNA, 15 nt, Homo sapiens
aaagaugacuugaaa

SEQ ID NO: 1992691 - RNA, 20 nt, Homo sapiens
augagcccuauauauucaaa

SEQ ID NO: 1992692 - RNA, 14 nt, Homo sapiens
aaguccagcucucc

SEQ ID NO: 1992693 - RNA, 11 nt, Homo sapiens
uccaccuuucu

SEQ ID NO: 1992694 - RNA, 18 nt, Homo sapiens
cccugaauuuugcuuccu

SEQ ID NO: 1992695 - RNA, 18 nt, Homo sapiens
ccacauucacuacugcaa

SEQ ID NO: 1992696 - RNA, 21 nt, Homo sapiens
uccacaggcaacgcagaccaa

SEQ ID NO: 1992697 - RNA, 21 nt, Homo sapiens
ggcccguggcuuggcaucugu

SEQ ID NO: 1992698 - RNA, 15 nt, Homo sapiens
gcugagaguggggcu

SEQ ID NO: 1992699 - RNA, 17 nt, Homo sapiens
cucccugaaguaagcaa

SEQ ID NO: 1992700 - RNA, 17 nt, Homo sapiens
cuacuuuaacaccaggu

SEQ ID NO: 1992701 - RNA, 14 nt, Homo sapiens
gagcagcugggauu

SEQ ID NO: 1992702 - RNA, 14 nt, Homo sapiens
auaacagaaagaac

SEQ ID NO: 1992703 - RNA, 14 nt, Homo sapiens
aaacacgugucuau

SEQ ID NO: 1992704 - RNA, 15 nt, Homo sapiens
uagaaaccugaauga

SEQ ID NO: 1992705 - RNA, 15 nt, Homo sapiens
caggacuuucccuga

SEQ ID NO: 1992706 - RNA, 13 nt, Homo sapiens
accaugcaguggg

SEQ ID NO: 1992707 - RNA, 15 nt, Homo sapiens
uugaauauuacugga

SEQ ID NO: 1992708 - RNA, 20 nt, Homo sapiens
ccucucuaucggggucacuu

SEQ ID NO: 1992709 - RNA, 17 nt, Homo sapiens
aggagaagcuaauauga

SEQ ID NO: 1992710 - RNA, 20 nt, Homo sapiens
auugauuuuuaaacagcagg

SEQ ID NO: 1992711 - RNA, 18 nt, Homo sapiens
auuacugccuuacuguac

SEQ ID NO: 1992712 - RNA, 18 nt, Homo sapiens
agcaaccucccaacccag

SEQ ID NO: 1992713 - RNA, 17 nt, Homo sapiens
auuuuccagauaacuua

SEQ ID NO: 1992714 - RNA, 16 nt, Homo sapiens
ugaauggccuucauau

SEQ ID NO: 1992715 - RNA, 12 nt, Homo sapiens
uagaauugcauu

SEQ ID NO: 1992716 - RNA, 20 nt, Homo sapiens
gugcaugcgccuacucgcuu

SEQ ID NO: 1992717 - RNA, 16 nt, Homo sapiens
aauacauguaccuaua

SEQ ID NO: 1992718 - RNA, 21 nt, Homo sapiens
cagcucauuucacuuuacacg

SEQ ID NO: 1992719 - RNA, 16 nt, Homo sapiens
gcagacaaaaagaaca

SEQ ID NO: 1992720 - RNA, 13 nt, Homo sapiens
gagacaucacuug

SEQ ID NO: 1992721 - RNA, 18 nt, Homo sapiens
acuaaacaacuaccuccu

SEQ ID NO: 1992722 - RNA, 16 nt, Homo sapiens
cccacccugcacuuuc

SEQ ID NO: 1992723 - RNA, 15 nt, Homo sapiens
aauccuaagcaaaaa

SEQ ID NO: 1992724 - RNA, 21 nt, Homo sapiens
ccagcauccuccucuguucua

SEQ ID NO: 1992725 - RNA, 15 nt, Homo sapiens
auaagcucagugaua

SEQ ID NO: 1992726 - RNA, 16 nt, Homo sapiens
auggaagugucugcca

SEQ ID NO: 1992727 - RNA, 18 nt, Homo sapiens
auccuuccuaaacccaau

SEQ ID NO: 1992728 - RNA, 23 nt, Homo sapiens
uguuaacaccuaccucacagggu

SEQ ID NO: 1992729 - RNA, 15 nt, Homo sapiens
cuagcaagcacuuga

SEQ ID NO: 1992730 - RNA, 14 nt, Homo sapiens
gagagcccagucuc

SEQ ID NO: 1992731 - RNA, 15 nt, Homo sapiens
ugaaaccucaucucu

SEQ ID NO: 1992732 - RNA, 20 nt, Homo sapiens
uacuaauucuuacacugccu

SEQ ID NO: 1992733 - RNA, 14 nt, Homo sapiens
ugggagaagagaga

SEQ ID NO: 1992734 - RNA, 14 nt, Homo sapiens
gauaggaaugugaa

SEQ ID NO: 1992735 - RNA, 12 nt, Homo sapiens
uuuuaaugggau

SEQ ID NO: 1992736 - RNA, 17 nt, Homo sapiens
cauggggguaauaagag

SEQ ID NO: 1992737 - RNA, 20 nt, Homo sapiens
cuguagaacuuauucucugu

SEQ ID NO: 1992738 - RNA, 13 nt, Homo sapiens
ucccagagcugca

SEQ ID NO: 1992739 - RNA, 19 nt, Homo sapiens
uuccaucuaguaccagagg

SEQ ID NO: 1992740 - RNA, 20 nt, Homo sapiens
uaguuugggguguauacuuc

SEQ ID NO: 1992741 - RNA, 22 nt, Homo sapiens
uuguuggcguaggcuacagaga

SEQ ID NO: 1992742 - RNA, 21 nt, Homo sapiens
cuccuugucaauacugagcca

SEQ ID NO: 1992743 - RNA, 20 nt, Homo sapiens
uuaauauuacucagcacaga

SEQ ID NO: 1992744 - RNA, 14 nt, Homo sapiens
cuuauuccucagug

SEQ ID NO: 1992745 - RNA, 18 nt, Homo sapiens
ccaaauauaaaaacagac

SEQ ID NO: 1992746 - RNA, 13 nt, Homo sapiens
guggcugcugcug

SEQ ID NO: 1992747 - RNA, 20 nt, Homo sapiens
aacuugcacgacgccugcca

SEQ ID NO: 1992748 - RNA, 16 nt, Homo sapiens
ucacaguugagcugcu

SEQ ID NO: 1992749 - RNA, 18 nt, Homo sapiens
acgaguggaccauuauca

SEQ ID NO: 1992750 - RNA, 22 nt, Homo sapiens
ggaaagaaaaaaggaaguggaa

SEQ ID NO: 1992751 - RNA, 17 nt, Homo sapiens
aagguacugguacuaua

SEQ ID NO: 1992752 - RNA, 18 nt, Homo sapiens
aauacuauacagccauaa

SEQ ID NO: 1992753 - RNA, 14 nt, Homo sapiens
gguccaccuccuga

SEQ ID NO: 1992754 - RNA, 16 nt, Homo sapiens
cuuuucuuaauacuga

SEQ ID NO: 1992755 - RNA, 16 nt, Homo sapiens
agauaacagugugcuc

SEQ ID NO: 1992756 - RNA, 19 nt, Homo sapiens
uauaaguguucaguguuga

SEQ ID NO: 1992757 - RNA, 15 nt, Homo sapiens
auuuagucugcauug

SEQ ID NO: 1992758 - RNA, 19 nt, Homo sapiens
gcgcacagagggaagccau

SEQ ID NO: 1992759 - RNA, 20 nt, Homo sapiens
acguauccauuauucuucuc

SEQ ID NO: 1992760 - RNA, 18 nt, Homo sapiens
gugcuggcauuacaggug

SEQ ID NO: 1992761 - RNA, 13 nt, Homo sapiens
acagccagugugu

SEQ ID NO: 1992762 - RNA, 16 nt, Homo sapiens
cuacaaugcucauguc

SEQ ID NO: 1992763 - RNA, 16 nt, Homo sapiens
auuguuugaaacaaag

SEQ ID NO: 1992764 - RNA, 21 nt, Homo sapiens
agagugcccagaacuggacuc

SEQ ID NO: 1992765 - RNA, 20 nt, Homo sapiens
agaagugcaacugcuacuga

SEQ ID NO: 1992766 - RNA, 14 nt, Homo sapiens
caaaaugacuuuga

SEQ ID NO: 1992767 - RNA, 19 nt, Homo sapiens
acccagaaggcagagguug

SEQ ID NO: 1992768 - RNA, 23 nt, Homo sapiens
guuguucucuucuuuaaagggau

SEQ ID NO: 1992769 - RNA, 19 nt, Homo sapiens
gccuuccaaaaccugcuuc

SEQ ID NO: 1992770 - RNA, 16 nt, Homo sapiens
ugggccagaauuucaa

SEQ ID NO: 1992771 - RNA, 17 nt, Homo sapiens
ccaaaucuuguuuacaa

SEQ ID NO: 1992772 - RNA, 19 nt, Homo sapiens
augguuuuacucaugugca

SEQ ID NO: 1992773 - RNA, 18 nt, Homo sapiens
aacucaccauuucaucca

SEQ ID NO: 1992774 - RNA, 18 nt, Homo sapiens
cuccccccaaucccucaa

SEQ ID NO: 1992775 - RNA, 11 nt, Homo sapiens
uaaaugcuuug

SEQ ID NO: 1992776 - RNA, 13 nt, Homo sapiens
ugguggggguucu

SEQ ID NO: 1992777 - RNA, 18 nt, Homo sapiens
guaaugauauagccagaa

SEQ ID NO: 1992778 - RNA, 12 nt, Homo sapiens
cucuuggcaguc

SEQ ID NO: 1992779 - RNA, 21 nt, Homo sapiens
cauacaaauacuauccaaaua

SEQ ID NO: 1992780 - RNA, 15 nt, Homo sapiens
gguuuucauuugcca

SEQ ID NO: 1992781 - RNA, 13 nt, Homo sapiens
uagcauacgguau

SEQ ID NO: 1992782 - RNA, 23 nt, Homo sapiens
ucuuacaacaggcuuaugaauau

SEQ ID NO: 1992783 - RNA, 17 nt, Homo sapiens
acacccaugaaucaaag

SEQ ID NO: 1992784 - RNA, 14 nt, Homo sapiens
ucgcaagacccuua

SEQ ID NO: 1992785 - RNA, 23 nt, Homo sapiens
uugccauccugauggaccugccc

SEQ ID NO: 1992786 - RNA, 19 nt, Homo sapiens
gacaauuucaaaaugcaug

SEQ ID NO: 1992787 - RNA, 21 nt, Homo sapiens
cucccugagccugcauucugc

SEQ ID NO: 1992788 - RNA, 14 nt, Homo sapiens
aaauaucuggucuc

SEQ ID NO: 1992789 - RNA, 18 nt, Homo sapiens
aagacagugcagugcuca

SEQ ID NO: 1992790 - RNA, 15 nt, Homo sapiens
gcaaaugcaaaaacu

SEQ ID NO: 1992791 - RNA, 14 nt, Homo sapiens
caauagagacugua

SEQ ID NO: 1992792 - RNA, 19 nt, Homo sapiens
guuuuuauuuugucucuga

SEQ ID NO: 1992793 - RNA, 19 nt, Homo sapiens
guuuggaaguguuaacuau

SEQ ID NO: 1992794 - RNA, 15 nt, Homo sapiens
uuccgccacuccagu

SEQ ID NO: 1992795 - RNA, 11 nt, Homo sapiens
guuacuauuau

SEQ ID NO: 1992796 - RNA, 11 nt, Homo sapiens
uuaacuaugaa

SEQ ID NO: 1992797 - RNA, 13 nt, Homo sapiens
uaguuacugucag

SEQ ID NO: 1992798 - RNA, 21 nt, Homo sapiens
ucaggaagccuccugcugagu

SEQ ID NO: 1992799 - RNA, 13 nt, Homo sapiens
ugcauguguauau

SEQ ID NO: 1992800 - RNA, 22 nt, Homo sapiens
aaacagaagauuacaaaagcaa

SEQ ID NO: 1992801 - RNA, 21 nt, Homo sapiens
uuugcaugaugucuaccucag

SEQ ID NO: 1992802 - RNA, 22 nt, Homo sapiens
aaaaucaauacaauccuuugaa

SEQ ID NO: 1992803 - RNA, 20 nt, Homo sapiens
gcuauggggagaaaagacau

SEQ ID NO: 1992804 - RNA, 20 nt, Homo sapiens
ugcucucccgguucuuccag

SEQ ID NO: 1992805 - RNA, 21 nt, Homo sapiens
cagaaagcaucccucacccau

SEQ ID NO: 1992806 - RNA, 23 nt, Homo sapiens
accauuuuccuuuggacuguuca

SEQ ID NO: 1992807 - RNA, 12 nt, Homo sapiens
guugccuggaca

SEQ ID NO: 1992808 - RNA, 17 nt, Homo sapiens
aaagaauuaccaagaga

SEQ ID NO: 1992809 - RNA, 14 nt, Homo sapiens
uuauugucuaggcc

SEQ ID NO: 1992810 - RNA, 18 nt, Homo sapiens
aaguguauuagauguggu

SEQ ID NO: 1992811 - RNA, 17 nt, Homo sapiens
gugagacuccgucucaa

SEQ ID NO: 1992812 - RNA, 13 nt, Homo sapiens
ccagugaaccaaa

SEQ ID NO: 1992813 - RNA, 21 nt, Homo sapiens
auuccccuguagcagucacug

SEQ ID NO: 1992814 - RNA, 22 nt, Homo sapiens
uuuacugggucuaaagggcuau

SEQ ID NO: 1992815 - RNA, 21 nt, Homo sapiens
uccagcugacccugguucucu

SEQ ID NO: 1992816 - RNA, 18 nt, Homo sapiens
uguggcuggaagauccug

SEQ ID NO: 1992817 - RNA, 20 nt, Homo sapiens
uuauuuuugguuuccaaaga

SEQ ID NO: 1992818 - RNA, 23 nt, Homo sapiens
acauuucugauucugauugcuau

SEQ ID NO: 1992819 - RNA, 23 nt, Homo sapiens
uacaauacggcuaaucuuucauu

SEQ ID NO: 1992820 - RNA, 16 nt, Homo sapiens
acagugcuauuugcau

SEQ ID NO: 1992821 - RNA, 16 nt, Homo sapiens
gcccacacuugggagc

SEQ ID NO: 1992822 - RNA, 23 nt, Homo sapiens
uguaaacaguucugcacucuugu

SEQ ID NO: 1992823 - RNA, 23 nt, Homo sapiens
ggucaauaaccugagggaaucaa

SEQ ID NO: 1992824 - RNA, 19 nt, Homo sapiens
acagaucuugagcaaggca

SEQ ID NO: 1992825 - RNA, 16 nt, Homo sapiens
cuugcauguacuugaa

SEQ ID NO: 1992826 - RNA, 15 nt, Homo sapiens
acuauauaugacugg

SEQ ID NO: 1992827 - RNA, 20 nt, Homo sapiens
agcuacuugaaggacacaag

SEQ ID NO: 1992828 - RNA, 14 nt, Homo sapiens
uagauuuucacuua

SEQ ID NO: 1992829 - RNA, 19 nt, Homo sapiens
augcugugauugugccuac

SEQ ID NO: 1992830 - RNA, 17 nt, Homo sapiens
ggugcguuuggccaaaa

SEQ ID NO: 1992831 - RNA, 18 nt, Homo sapiens
cuaggaagacauuuuucc

SEQ ID NO: 1992832 - RNA, 13 nt, Homo sapiens
guccauauuuaca

SEQ ID NO: 1992833 - RNA, 15 nt, Homo sapiens
ggcuggagugcagug

SEQ ID NO: 1992834 - RNA, 15 nt, Homo sapiens
ggcuagagugcaaug

SEQ ID NO: 1992835 - RNA, 16 nt, Homo sapiens
caacggcuuagacuuc

SEQ ID NO: 1992836 - RNA, 20 nt, Homo sapiens
agagcuggaccugagcuauu

SEQ ID NO: 1992837 - RNA, 16 nt, Homo sapiens
uuugaagacuacauga

SEQ ID NO: 1992838 - RNA, 14 nt, Homo sapiens
uucucaauuccaac

SEQ ID NO: 1992839 - RNA, 13 nt, Homo sapiens
accagagcugcca

SEQ ID NO: 1992840 - RNA, 21 nt, Homo sapiens
aguggauuggcuuugugcuug

SEQ ID NO: 1992841 - RNA, 19 nt, Homo sapiens
cucuugaaaaaugcauguu

SEQ ID NO: 1992842 - RNA, 14 nt, Homo sapiens
cuuagccugugcug

SEQ ID NO: 1992843 - RNA, 14 nt, Homo sapiens
acuuccucugccau

SEQ ID NO: 1992844 - RNA, 20 nt, Homo sapiens
uacaucccuuaccugggaaa

SEQ ID NO: 1992845 - RNA, 16 nt, Homo sapiens
agccuugugaugucau

SEQ ID NO: 1992846 - RNA, 13 nt, Homo sapiens
aagccucuugucu

SEQ ID NO: 1992847 - RNA, 20 nt, Homo sapiens
ucugggauuaagggcaaauc

SEQ ID NO: 1992848 - RNA, 13 nt, Homo sapiens
acaccuaagagaa

SEQ ID NO: 1992849 - RNA, 22 nt, Homo sapiens
gggaacagcaaaccaaugcuau

SEQ ID NO: 1992850 - RNA, 17 nt, Homo sapiens
aaaaaugucuuucaugu

SEQ ID NO: 1992851 - RNA, 23 nt, Homo sapiens
aaugguuaguggucucuacugug

SEQ ID NO: 1992852 - RNA, 17 nt, Homo sapiens
uuaacccucacacugcu

SEQ ID NO: 1992853 - RNA, 14 nt, Homo sapiens
ucuaggauggggca

SEQ ID NO: 1992854 - RNA, 16 nt, Homo sapiens
guuuuaaguguuugcu

SEQ ID NO: 1992855 - RNA, 12 nt, Homo sapiens
accagugaaagg

SEQ ID NO: 1992856 - RNA, 18 nt, Homo sapiens
aucaaaaggaggaauuuc

SEQ ID NO: 1992857 - RNA, 11 nt, Homo sapiens
ccaucaucucu

SEQ ID NO: 1992858 - RNA, 11 nt, Homo sapiens
ucuucauccca

SEQ ID NO: 1992859 - RNA, 21 nt, Homo sapiens
gagauugcaccauugcgcucu

SEQ ID NO: 1992860 - RNA, 21 nt, Homo sapiens
gagauugcgccacugcacucc

SEQ ID NO: 1992861 - RNA, 13 nt, Homo sapiens
uugugauugugga

SEQ ID NO: 1992862 - RNA, 22 nt, Homo sapiens
aacacugcaagaagucuugaga

SEQ ID NO: 1992863 - RNA, 23 nt, Homo sapiens
auauuccccuuccuguguccaug

SEQ ID NO: 1992864 - RNA, 15 nt, Homo sapiens
aagauuauauaucau

SEQ ID NO: 1992865 - RNA, 18 nt, Homo sapiens
aacuccuauaaagugccu

SEQ ID NO: 1992866 - RNA, 21 nt, Homo sapiens
caggggucgucaccaccucuc

SEQ ID NO: 1992867 - RNA, 21 nt, Homo sapiens
ggcacgucgcccgcugagcug

SEQ ID NO: 1992868 - RNA, 22 nt, Homo sapiens
caauaauauauccacaucuaag

SEQ ID NO: 1992869 - RNA, 19 nt, Homo sapiens
cucccucuguccaccagcc

SEQ ID NO: 1992870 - RNA, 14 nt, Homo sapiens
cugugcaccaggca

SEQ ID NO: 1992871 - RNA, 20 nt, Homo sapiens
uuuguaaauuaauacuucau

SEQ ID NO: 1992872 - RNA, 20 nt, Homo sapiens
ugccuugcaauuagcauucu

SEQ ID NO: 1992873 - RNA, 16 nt, Homo sapiens
aaagcaucccugugag

SEQ ID NO: 1992874 - RNA, 22 nt, Homo sapiens
uuagaaacagaaauagacuuaa

SEQ ID NO: 1992875 - RNA, 14 nt, Homo sapiens
ucuaagacaaaugc

SEQ ID NO: 1992876 - RNA, 18 nt, Homo sapiens
ugagauguaacucaugaa

SEQ ID NO: 1992877 - RNA, 12 nt, Homo sapiens
gcaguguucuca

SEQ ID NO: 1992878 - RNA, 19 nt, Homo sapiens
gaacuccaguacucaccca

SEQ ID NO: 1992879 - RNA, 14 nt, Homo sapiens
agaauucucuugcu

SEQ ID NO: 1992880 - RNA, 13 nt, Homo sapiens
aauuuucuuccaa

SEQ ID NO: 1992881 - RNA, 16 nt, Homo sapiens
gagaggggcuguccau

SEQ ID NO: 1992882 - RNA, 20 nt, Homo sapiens
gugacuuccucgaggucaua

SEQ ID NO: 1992883 - RNA, 20 nt, Homo sapiens
acauuuuucauagauaccau

SEQ ID NO: 1992884 - RNA, 16 nt, Homo sapiens
ucucugugcaaggaug

SEQ ID NO: 1992885 - RNA, 18 nt, Homo sapiens
ucaugguccccauggcau

SEQ ID NO: 1992886 - RNA, 16 nt, Homo sapiens
aaagguugcagugagu

SEQ ID NO: 1992887 - RNA, 12 nt, Homo sapiens
cagcaguuucca

SEQ ID NO: 1992888 - RNA, 15 nt, Homo sapiens
gaaaaauuucuggca

SEQ ID NO: 1992889 - RNA, 21 nt, Homo sapiens
agaccuggagcggcuauucca

SEQ ID NO: 1992890 - RNA, 21 nt, Homo sapiens
ugcaucacggauggugcaugg

SEQ ID NO: 1992891 - RNA, 17 nt, Homo sapiens
uggcucacuacagccuc

SEQ ID NO: 1992892 - RNA, 14 nt, Homo sapiens
acaauacaacucac

SEQ ID NO: 1992893 - RNA, 23 nt, Homo sapiens
aaguucuccuuuugaacuuguca

SEQ ID NO: 1992894 - RNA, 16 nt, Homo sapiens
agagcucacagcugga

SEQ ID NO: 1992895 - RNA, 13 nt, Homo sapiens
aggcaaaguggaa

SEQ ID NO: 1992896 - RNA, 14 nt, Homo sapiens
uccaggaaggcagc

SEQ ID NO: 1992897 - RNA, 14 nt, Homo sapiens
auucaauuugauuc

SEQ ID NO: 1992898 - RNA, 17 nt, Homo sapiens
uugcguggacucugcac

SEQ ID NO: 1992899 - RNA, 17 nt, Homo sapiens
cugcagucagugcuaau

SEQ ID NO: 1992900 - RNA, 19 nt, Homo sapiens
ccagugcuuuauguuguug

SEQ ID NO: 1992901 - RNA, 19 nt, Homo sapiens
aagccuugaaaaagaacaa

SEQ ID NO: 1992902 - RNA, 19 nt, Homo sapiens
ccaagaugucaaaacaaga

SEQ ID NO: 1992903 - RNA, 18 nt, Homo sapiens
caaaaguguugacugugu

SEQ ID NO: 1992904 - RNA, 21 nt, Homo sapiens
uucagaaauuccaacuccuga

SEQ ID NO: 1992905 - RNA, 22 nt, Homo sapiens
augcgucugucguugugcuuuu

SEQ ID NO: 1992906 - RNA, 19 nt, Homo sapiens
aucuauggaaaugugagaa

SEQ ID NO: 1992907 - RNA, 14 nt, Homo sapiens
gaaaaaucuaaaau

SEQ ID NO: 1992908 - RNA, 23 nt, Homo sapiens
acagaaauugguaccuugcacac

SEQ ID NO: 1992909 - RNA, 19 nt, Homo sapiens
cacauuuuacuacaguaaa

SEQ ID NO: 1992910 - RNA, 13 nt, Homo sapiens
cugccccuagaca

SEQ ID NO: 1992911 - RNA, 18 nt, Homo sapiens
aaccuacccuguccuaga

SEQ ID NO: 1992912 - RNA, 20 nt, Homo sapiens
gcagaagccccaacugugau

SEQ ID NO: 1992913 - RNA, 22 nt, Homo sapiens
gacuccacgcuguccuuuggga

SEQ ID NO: 1992914 - RNA, 14 nt, Homo sapiens
cgcccucugaaauu

SEQ ID NO: 1992915 - RNA, 16 nt, Homo sapiens
ugauaaacaguugaau

SEQ ID NO: 1992916 - RNA, 13 nt, Homo sapiens
guacagguauauu

SEQ ID NO: 1992917 - RNA, 12 nt, Homo sapiens
ucggcacagugc

SEQ ID NO: 1992918 - RNA, 19 nt, Homo sapiens
ccuuguuucaaaauucuca

SEQ ID NO: 1992919 - RNA, 19 nt, Homo sapiens
caaaaugcuuuugugucua

SEQ ID NO: 1992920 - RNA, 14 nt, Homo sapiens
cugcaggaaucaaa

SEQ ID NO: 1992921 - RNA, 14 nt, Homo sapiens
uaucaaaugguuau

SEQ ID NO: 1992922 - RNA, 16 nt, Homo sapiens
gcaugcagugcccuca

SEQ ID NO: 1992923 - RNA, 19 nt, Homo sapiens
accacugacuauaccaacu

SEQ ID NO: 1992924 - RNA, 23 nt, Homo sapiens
cuuaaugucagucuacaggccuu

SEQ ID NO: 1992925 - RNA, 19 nt, Homo sapiens
ugggcacaguggacucagc

SEQ ID NO: 1992926 - RNA, 15 nt, Homo sapiens
auugcuagauaaaag

SEQ ID NO: 1992927 - RNA, 22 nt, Homo sapiens
cugagucaacuccuuucucauc

SEQ ID NO: 1992928 - RNA, 13 nt, Homo sapiens
cggcucacugaaa

SEQ ID NO: 1992929 - RNA, 13 nt, Homo sapiens
ccugacgcagcac

SEQ ID NO: 1992930 - RNA, 17 nt, Homo sapiens
auuagagaagcugaaag

SEQ ID NO: 1992931 - RNA, 14 nt, Homo sapiens
cuguauuagcagca

SEQ ID NO: 1992932 - RNA, 15 nt, Homo sapiens
cccuccacccaucca

SEQ ID NO: 1992933 - RNA, 21 nt, Homo sapiens
auucccagcccaucccuguga

SEQ ID NO: 1992934 - RNA, 17 nt, Homo sapiens
cacccagagccagugug

SEQ ID NO: 1992935 - RNA, 16 nt, Homo sapiens
agagaaggcugugagc

SEQ ID NO: 1992936 - RNA, 15 nt, Homo sapiens
aaugggaaaucagug

SEQ ID NO: 1992937 - RNA, 19 nt, Homo sapiens
cuugugaacaccuccuagc

SEQ ID NO: 1992938 - RNA, 21 nt, Homo sapiens
ggcagugcaggacaacaucag

SEQ ID NO: 1992939 - RNA, 22 nt, Homo sapiens
aaaguauuauucaaaccaauuu

SEQ ID NO: 1992940 - RNA, 15 nt, Homo sapiens
cucccaaugugccga

SEQ ID NO: 1992941 - RNA, 14 nt, Homo sapiens
uuauauaauuuugc

SEQ ID NO: 1992942 - RNA, 20 nt, Homo sapiens
ggcucaagaauaaaauauga

SEQ ID NO: 1992943 - RNA, 16 nt, Homo sapiens
aaugcauugcuaaaau

SEQ ID NO: 1992944 - RNA, 21 nt, Homo sapiens
ucauaacucugugaucuugcu

SEQ ID NO: 1992945 - RNA, 20 nt, Homo sapiens
gaagcaauuuguugcugcuu

SEQ ID NO: 1992946 - RNA, 16 nt, Homo sapiens
uaauaauagauuguga

SEQ ID NO: 1992947 - RNA, 20 nt, Homo sapiens
agaggcagcuucaagugccu

SEQ ID NO: 1992948 - RNA, 15 nt, Homo sapiens
auaaacugguguucu

SEQ ID NO: 1992949 - RNA, 17 nt, Homo sapiens
gaccaaaaugacaauga

SEQ ID NO: 1992950 - RNA, 21 nt, Homo sapiens
acucauagauguuaugcaaaa

SEQ ID NO: 1992951 - RNA, 15 nt, Homo sapiens
cucacucccaaggga

SEQ ID NO: 1992952 - RNA, 17 nt, Homo sapiens
cagaaaugccacucacc

SEQ ID NO: 1992953 - RNA, 17 nt, Homo sapiens
augauggagaagugugg

SEQ ID NO: 1992954 - RNA, 23 nt, Homo sapiens
uauugguuuugguuuugacucac

SEQ ID NO: 1992955 - RNA, 13 nt, Homo sapiens
aagaaucaccuca

SEQ ID NO: 1992956 - RNA, 14 nt, Homo sapiens
ugucccucuuccau

SEQ ID NO: 1992957 - RNA, 22 nt, Homo sapiens
ggccagaggaucaccagugcau

SEQ ID NO: 1992958 - RNA, 22 nt, Homo sapiens
aggagcaaagcagcaauuacau

SEQ ID NO: 1992959 - RNA, 17 nt, Homo sapiens
aaguaggaaaugaauga

SEQ ID NO: 1992960 - RNA, 17 nt, Homo sapiens
ucaguaaguaucuggag

SEQ ID NO: 1992961 - RNA, 17 nt, Homo sapiens
uugauccucacugagaa

SEQ ID NO: 1992962 - RNA, 15 nt, Homo sapiens
auuuuuauacaccau

SEQ ID NO: 1992963 - RNA, 22 nt, Homo sapiens
ccuuuugcccacugucugcuac

SEQ ID NO: 1992964 - RNA, 19 nt, Homo sapiens
ggucuuuaauccacucccc

SEQ ID NO: 1992965 - RNA, 17 nt, Homo sapiens
auuugugugugugcaag

SEQ ID NO: 1992966 - RNA, 15 nt, Homo sapiens
uuaacuuaacauucu

SEQ ID NO: 1992967 - RNA, 23 nt, Homo sapiens
agccuuuaucuaccaacuuucaa

SEQ ID NO: 1992968 - RNA, 17 nt, Homo sapiens
ugccacucacacagcca

SEQ ID NO: 1992969 - RNA, 23 nt, Homo sapiens
cugaggccuggggaugugaacaa

SEQ ID NO: 1992970 - RNA, 20 nt, Homo sapiens
gaaagcacaagacuggccca

SEQ ID NO: 1992971 - RNA, 11 nt, Homo sapiens
uuaauguaucu

SEQ ID NO: 1992972 - RNA, 14 nt, Homo sapiens
caaauacuaucucu

SEQ ID NO: 1992973 - RNA, 16 nt, Homo sapiens
uaugucaaagcuuuga

SEQ ID NO: 1992974 - RNA, 12 nt, Homo sapiens
ucccagauccag

SEQ ID NO: 1992975 - RNA, 12 nt, Homo sapiens
uaagacauucac

SEQ ID NO: 1992976 - RNA, 15 nt, Homo sapiens
uguagcucuguccac

SEQ ID NO: 1992977 - RNA, 15 nt, Homo sapiens
ugacauuuugcauga

SEQ ID NO: 1992978 - RNA, 19 nt, Homo sapiens
gccaccaacauacucccau

SEQ ID NO: 1992979 - RNA, 14 nt, Homo sapiens
caaagaacaucugc

SEQ ID NO: 1992980 - RNA, 14 nt, Homo sapiens
cucugaacaaaagc

SEQ ID NO: 1992981 - RNA, 19 nt, Homo sapiens
ucacaaaugucauugucua

SEQ ID NO: 1992982 - RNA, 11 nt, Homo sapiens
gaguccaggga

SEQ ID NO: 1992983 - RNA, 21 nt, Homo sapiens
aucuuaaucauuauccuucua

SEQ ID NO: 1992984 - RNA, 14 nt, Homo sapiens
agccaaaccacuga

SEQ ID NO: 1992985 - RNA, 19 nt, Homo sapiens
ugcaggggggcaguaacuc

SEQ ID NO: 1992986 - RNA, 15 nt, Homo sapiens
caucuccaaauauca

SEQ ID NO: 1992987 - RNA, 18 nt, Homo sapiens
gcccugggucuugccaug

SEQ ID NO: 1992988 - RNA, 18 nt, Homo sapiens
cauacucaugcaugcaaa

SEQ ID NO: 1992989 - RNA, 16 nt, Homo sapiens
agggaggcccauguga

SEQ ID NO: 1992990 - RNA, 20 nt, Homo sapiens
uuuugguuuaaaaaguuuca

SEQ ID NO: 1992991 - RNA, 19 nt, Homo sapiens
ucccucaggccgaaggagg

SEQ ID NO: 1992992 - RNA, 20 nt, Homo sapiens
gaacuaauuucaagauuuua

SEQ ID NO: 1992993 - RNA, 20 nt, Homo sapiens
ccucggagagcagcagcacc

SEQ ID NO: 1992994 - RNA, 15 nt, Homo sapiens
cuccaagguggcaua

SEQ ID NO: 1992995 - RNA, 22 nt, Homo sapiens
acuuuagacuucccacuguucu

SEQ ID NO: 1992996 - RNA, 20 nt, Homo sapiens
uggcuggugugguacagaga

SEQ ID NO: 1992997 - RNA, 19 nt, Homo sapiens
gaggccgcuuagugcugcu

SEQ ID NO: 1992998 - RNA, 18 nt, Homo sapiens
ugaaagccuaguccagaa

SEQ ID NO: 1992999 - RNA, 23 nt, Homo sapiens
agccugcacggugaauggcuuug

SEQ ID NO: 1993000 - RNA, 22 nt, Homo sapiens
caacaaaugggucccucagucu

SEQ ID NO: 1993001 - RNA, 19 nt, Homo sapiens
gccuccuggaaaaaacaaa

SEQ ID NO: 1993002 - RNA, 18 nt, Homo sapiens
uuugauccugggggacca

SEQ ID NO: 1993003 - RNA, 18 nt, Homo sapiens
aagauauaagacuuaaua

SEQ ID NO: 1993004 - RNA, 13 nt, Homo sapiens
uaguuaugugauu

SEQ ID NO: 1993005 - RNA, 15 nt, Homo sapiens
cuacaggcauuuaac

SEQ ID NO: 1993006 - RNA, 17 nt, Homo sapiens
cucgaacuugaagcaca

SEQ ID NO: 1993007 - RNA, 23 nt, Homo sapiens
gcccuuuuaguucuuagagcacu

SEQ ID NO: 1993008 - RNA, 13 nt, Homo sapiens
uauggccaugccc

SEQ ID NO: 1993009 - RNA, 20 nt, Homo sapiens
ggcuacguuuugguucuaug

SEQ ID NO: 1993010 - RNA, 16 nt, Homo sapiens
uuaaaaguccacuuuu

SEQ ID NO: 1993011 - RNA, 14 nt, Homo sapiens
auagaggcuagcuu

SEQ ID NO: 1993012 - RNA, 19 nt, Homo sapiens
uuuacucuguuaccacauu

SEQ ID NO: 1993013 - RNA, 15 nt, Homo sapiens
cacccugggcagcua

SEQ ID NO: 1993014 - RNA, 17 nt, Homo sapiens
cccggggcuggugggcc

SEQ ID NO: 1993015 - RNA, 12 nt, Homo sapiens
ucuuugcugcug

SEQ ID NO: 1993016 - RNA, 15 nt, Homo sapiens
uaugccuguugaucu

SEQ ID NO: 1993017 - RNA, 15 nt, Homo sapiens
aauguaggaugacag

SEQ ID NO: 1993018 - RNA, 14 nt, Homo sapiens
accacuguguaugu

SEQ ID NO: 1993019 - RNA, 13 nt, Homo sapiens
acaugugugacug

SEQ ID NO: 1993020 - RNA, 13 nt, Homo sapiens
caaugcagaauuu

SEQ ID NO: 1993021 - RNA, 22 nt, Homo sapiens
ccucauugcauuuauugcaguu

SEQ ID NO: 1993022 - RNA, 18 nt, Homo sapiens
ucccuggccucccgccac

SEQ ID NO: 1993023 - RNA, 16 nt, Homo sapiens
aaagugguuucagcaa

SEQ ID NO: 1993024 - RNA, 15 nt, Homo sapiens
cagaaaugccacuca

SEQ ID NO: 1993025 - RNA, 14 nt, Homo sapiens
caacuccacugucu

SEQ ID NO: 1993026 - RNA, 18 nt, Homo sapiens
ugucuuuuuucuaaagua

SEQ ID NO: 1993027 - RNA, 22 nt, Homo sapiens
auggcaugagggccacauucca

SEQ ID NO: 1993028 - RNA, 18 nt, Homo sapiens
cacaaagaguaguuaaaa

SEQ ID NO: 1993029 - RNA, 14 nt, Homo sapiens
cggacaaguuuuaa

SEQ ID NO: 1993030 - RNA, 16 nt, Homo sapiens
agaauggugaucacuc

SEQ ID NO: 1993031 - RNA, 20 nt, Homo sapiens
uuaccaaaugaaaugccaaa

SEQ ID NO: 1993032 - RNA, 14 nt, Homo sapiens
uuugagagagcagc

SEQ ID NO: 1993033 - RNA, 15 nt, Homo sapiens
aacugcuugugcacu

SEQ ID NO: 1993034 - RNA, 13 nt, Homo sapiens
uaucuguugccuu

SEQ ID NO: 1993035 - RNA, 10 nt, Homo sapiens
agucuugucu

SEQ ID NO: 1993036 - RNA, 17 nt, Homo sapiens
gauguuuggaaaccaca

SEQ ID NO: 1993037 - RNA, 22 nt, Homo sapiens
ugcaacucacugauucucuaca

SEQ ID NO: 1993038 - RNA, 20 nt, Homo sapiens
ucuucaugguguccauuuua

SEQ ID NO: 1993039 - RNA, 24 nt, Homo sapiens
aacauauuuauauauguaucuaaa

SEQ ID NO: 1993040 - RNA, 21 nt, Homo sapiens
aagaaagcuauauaugaauaa

SEQ ID NO: 1993041 - RNA, 13 nt, Homo sapiens
uguggcagagcca

SEQ ID NO: 1993042 - RNA, 17 nt, Homo sapiens
caguaacgcgucuuccu

SEQ ID NO: 1993043 - RNA, 20 nt, Homo sapiens
acaugccucugccaaaggau

SEQ ID NO: 1993044 - RNA, 19 nt, Homo sapiens
aaccguuugugauugccau

SEQ ID NO: 1993045 - RNA, 23 nt, Homo sapiens
aagaaaaagggcugccgggccag

SEQ ID NO: 1993046 - RNA, 19 nt, Homo sapiens
ggggccuuggucccagaca

SEQ ID NO: 1993047 - RNA, 21 nt, Homo sapiens
ccaagaagauaaucuccaaag

SEQ ID NO: 1993048 - RNA, 19 nt, Homo sapiens
gagcuuaauuuucugugga

SEQ ID NO: 1993049 - RNA, 15 nt, Homo sapiens
ucuugcaacuuguua

SEQ ID NO: 1993050 - RNA, 17 nt, Homo sapiens
ucugucaaucacagucu

SEQ ID NO: 1993051 - RNA, 14 nt, Homo sapiens
cucaaguucuugga

SEQ ID NO: 1993052 - RNA, 19 nt, Homo sapiens
gugcguguuuccugugcaa

SEQ ID NO: 1993053 - RNA, 10 nt, Homo sapiens
ggaucuucau

SEQ ID NO: 1993054 - RNA, 23 nt, Homo sapiens
auaaacugagaggucacaaagaa

SEQ ID NO: 1993055 - RNA, 19 nt, Homo sapiens
augguaguuuuacaguguu

SEQ ID NO: 1993056 - RNA, 18 nt, Homo sapiens
gacuuggauucuuuccau

SEQ ID NO: 1993057 - RNA, 21 nt, Homo sapiens
agacuggcaauaaacuccuac

SEQ ID NO: 1993058 - RNA, 14 nt, Homo sapiens
ugagacugguugca

SEQ ID NO: 1993059 - RNA, 22 nt, Homo sapiens
ggacuccauuucuuucuuccau

SEQ ID NO: 1993060 - RNA, 19 nt, Homo sapiens
agguaauagggacuuagca

SEQ ID NO: 1993061 - RNA, 16 nt, Homo sapiens
uccacuugccuuguga

SEQ ID NO: 1993062 - RNA, 22 nt, Homo sapiens
gccucacuggggcagacaauaa

SEQ ID NO: 1993063 - RNA, 14 nt, Homo sapiens
ggcucugaugcaga

SEQ ID NO: 1993064 - RNA, 21 nt, Homo sapiens
gaaaagcacuuuacagaugag

SEQ ID NO: 1993065 - RNA, 19 nt, Homo sapiens
guuuauuaaaauacuguuu

SEQ ID NO: 1993066 - RNA, 13 nt, Homo sapiens
ugaucuuacucac

SEQ ID NO: 1993067 - RNA, 18 nt, Homo sapiens
ucugauuuccuaauguca

SEQ ID NO: 1993068 - RNA, 14 nt, Homo sapiens
uagccgaccucagc

SEQ ID NO: 1993069 - RNA, 12 nt, Homo sapiens
aauacacauuuc

SEQ ID NO: 1993070 - RNA, 19 nt, Homo sapiens
uuucugaaccauuacugua

SEQ ID NO: 1993071 - RNA, 18 nt, Homo sapiens
gaagcccuucagugcccu

SEQ ID NO: 1993072 - RNA, 16 nt, Homo sapiens
gacauuggacuuccuc

SEQ ID NO: 1993073 - RNA, 22 nt, Homo sapiens
ggcauuucacaaacucuguaca

SEQ ID NO: 1993074 - RNA, 11 nt, Homo sapiens
cugcuccuaga

SEQ ID NO: 1993075 - RNA, 16 nt, Homo sapiens
caaaucagccaugugc

SEQ ID NO: 1993076 - RNA, 22 nt, Homo sapiens
uuccucuaugaaaauuauaucu

SEQ ID NO: 1993077 - RNA, 21 nt, Homo sapiens
auguaacuuaauuauaagcua

SEQ ID NO: 1993078 - RNA, 14 nt, Homo sapiens
uuuugaaaggcaca

SEQ ID NO: 1993079 - RNA, 17 nt, Homo sapiens
ucauuccugccugucuc

SEQ ID NO: 1993080 - RNA, 21 nt, Homo sapiens
cacauucgcaccccuacuuca

SEQ ID NO: 1993081 - RNA, 21 nt, Homo sapiens
cuggggacagguccucagugu

SEQ ID NO: 1993082 - RNA, 17 nt, Homo sapiens
aagcucuauuaagauuu

SEQ ID NO: 1993083 - RNA, 21 nt, Homo sapiens
uuccgcaccaauaaagccuuc

SEQ ID NO: 1993084 - RNA, 14 nt, Homo sapiens
uguugcuauuuccu

SEQ ID NO: 1993085 - RNA, 18 nt, Homo sapiens
aauauucuguuuccauag

SEQ ID NO: 1993086 - RNA, 15 nt, Homo sapiens
uucuucuagugcuuu

SEQ ID NO: 1993087 - RNA, 19 nt, Homo sapiens
agugaauaaaaggauauca

SEQ ID NO: 1993088 - RNA, 17 nt, Homo sapiens
cucugucgugagugucu

SEQ ID NO: 1993089 - RNA, 18 nt, Homo sapiens
cacucuuguugugcucuu

SEQ ID NO: 1993090 - RNA, 18 nt, Homo sapiens
cucuguugcuguccucca

SEQ ID NO: 1993091 - RNA, 18 nt, Homo sapiens
aacuucuuuuaaaccuca

SEQ ID NO: 1993092 - RNA, 15 nt, Homo sapiens
cucccucuagccuuu

SEQ ID NO: 1993093 - RNA, 16 nt, Homo sapiens
uggggauuaucuguca

SEQ ID NO: 1993094 - RNA, 23 nt, Homo sapiens
aguaaaggcugcugcuacaaugu

SEQ ID NO: 1993095 - RNA, 17 nt, Homo sapiens
uaagagguuaugccaaa

SEQ ID NO: 1993096 - RNA, 19 nt, Homo sapiens
augaugugugaaaacuggu

SEQ ID NO: 1993097 - RNA, 14 nt, Homo sapiens
ugacucuuggcaca

SEQ ID NO: 1993098 - RNA, 17 nt, Homo sapiens
uaucaaucccaaccauc

SEQ ID NO: 1993099 - RNA, 13 nt, Homo sapiens
aguccuuauguua

SEQ ID NO: 1993100 - RNA, 14 nt, Homo sapiens
gcugggaucugcga

SEQ ID NO: 1993101 - RNA, 13 nt, Homo sapiens
aguuuaccauccu

SEQ ID NO: 1993102 - RNA, 17 nt, Homo sapiens
gugucugccaaacacau

SEQ ID NO: 1993103 - RNA, 20 nt, Homo sapiens
aaaucaucauuaaugacuuu

SEQ ID NO: 1993104 - RNA, 19 nt, Homo sapiens
cucacaagaagaccagacu

SEQ ID NO: 1993105 - RNA, 20 nt, Homo sapiens
aacaugaugugaaaacccau

SEQ ID NO: 1993106 - RNA, 19 nt, Homo sapiens
cuccugucccuugaccuua

SEQ ID NO: 1993107 - RNA, 16 nt, Homo sapiens
ggaaaggcaggugggc

SEQ ID NO: 1993108 - RNA, 18 nt, Homo sapiens
cugcacagugacuucuga

SEQ ID NO: 1993109 - RNA, 19 nt, Homo sapiens
agaugcuggugagguugug

SEQ ID NO: 1993110 - RNA, 21 nt, Homo sapiens
auuuacaugaauugcauuuua

SEQ ID NO: 1993111 - RNA, 19 nt, Homo sapiens
cuugaauaaauuugcccaa

SEQ ID NO: 1993112 - RNA, 18 nt, Homo sapiens
aauggacuauacauacua

SEQ ID NO: 1993113 - RNA, 21 nt, Homo sapiens
uuugcuuccucccaacaagca

SEQ ID NO: 1993114 - RNA, 21 nt, Homo sapiens
ccaucuaaugcuuguuuauga

SEQ ID NO: 1993115 - RNA, 16 nt, Homo sapiens
aauuuuuaagugucag

SEQ ID NO: 1993116 - RNA, 23 nt, Homo sapiens
gagccccuccuuccuucaagcca

SEQ ID NO: 1993117 - RNA, 13 nt, Homo sapiens
ccauagauggguc

SEQ ID NO: 1993118 - RNA, 14 nt, Homo sapiens
auaaaacucuccuu

SEQ ID NO: 1993119 - RNA, 16 nt, Homo sapiens
ccaucauggcagugau

SEQ ID NO: 1993120 - RNA, 23 nt, Homo sapiens
aggaaccucucgccaugaucaga

SEQ ID NO: 1993121 - RNA, 20 nt, Homo sapiens
acaguacucacuuuuuccaa

SEQ ID NO: 1993122 - RNA, 13 nt, Homo sapiens
auacagaccucca

SEQ ID NO: 1993123 - RNA, 20 nt, Homo sapiens
gaagauccuagugaccaaau

SEQ ID NO: 1993124 - RNA, 12 nt, Homo sapiens
gcucaaguauuu

SEQ ID NO: 1993125 - RNA, 20 nt, Homo sapiens
agagcugggacucaguucuu

SEQ ID NO: 1993126 - RNA, 21 nt, Homo sapiens
ggugacagugccuucucuauu

SEQ ID NO: 1993127 - RNA, 21 nt, Homo sapiens
ugaaggcaaaaacuguacugu

SEQ ID NO: 1993128 - RNA, 21 nt, Homo sapiens
cauccuccuuuagaguugcau

SEQ ID NO: 1993129 - RNA, 15 nt, Homo sapiens
agucaugggaacgca

SEQ ID NO: 1993130 - RNA, 22 nt, Homo sapiens
agagcucacuauggucaaaaag

SEQ ID NO: 1993131 - RNA, 17 nt, Homo sapiens
auuguuaucuuuaccuc

SEQ ID NO: 1993132 - RNA, 17 nt, Homo sapiens
auaaccacugcuuccau

SEQ ID NO: 1993133 - RNA, 22 nt, Homo sapiens
ucuuggugccuuuugugugaug

SEQ ID NO: 1993134 - RNA, 17 nt, Homo sapiens
ucaaagcccacauacug

SEQ ID NO: 1993135 - RNA, 11 nt, Homo sapiens
gcuauaugcau

SEQ ID NO: 1993136 - RNA, 11 nt, Homo sapiens
gaaauaugcca

SEQ ID NO: 1993137 - RNA, 23 nt, Homo sapiens
caccugguuccggaauccugucc

SEQ ID NO: 1993138 - RNA, 16 nt, Homo sapiens
ugggaacaggcugugu

SEQ ID NO: 1993139 - RNA, 15 nt, Homo sapiens
accugacugccccag

SEQ ID NO: 1993140 - RNA, 19 nt, Homo sapiens
auguacuuaagaguggcau

SEQ ID NO: 1993141 - RNA, 23 nt, Homo sapiens
uggugucuuuuauauuugaauua

SEQ ID NO: 1993142 - RNA, 16 nt, Homo sapiens
uuaacauaagcuauuu

SEQ ID NO: 1993143 - RNA, 20 nt, Homo sapiens
uuuaacucaguuucuaggca

SEQ ID NO: 1993144 - RNA, 18 nt, Homo sapiens
ugaauauuagcauugcca

SEQ ID NO: 1993145 - RNA, 18 nt, Homo sapiens
uccagcuguucuuaguga

SEQ ID NO: 1993146 - RNA, 19 nt, Homo sapiens
ugaugguggacuaagcaau

SEQ ID NO: 1993147 - RNA, 15 nt, Homo sapiens
uuuaagcaugugaug

SEQ ID NO: 1993148 - RNA, 15 nt, Homo sapiens
caacuccaacaucca

SEQ ID NO: 1993149 - RNA, 18 nt, Homo sapiens
agugagacuccgucucaa

SEQ ID NO: 1993150 - RNA, 14 nt, Homo sapiens
ucagccaccaucug

SEQ ID NO: 1993151 - RNA, 23 nt, Homo sapiens
aaagagccuuggccuuaaggaaa

SEQ ID NO: 1993152 - RNA, 14 nt, Homo sapiens
uaugugauguuaac

SEQ ID NO: 1993153 - RNA, 22 nt, Homo sapiens
aguuacauauguauacaugugc

SEQ ID NO: 1993154 - RNA, 18 nt, Homo sapiens
auccuggagggguguugu

SEQ ID NO: 1993155 - RNA, 17 nt, Homo sapiens
uuggucauagcauucac

SEQ ID NO: 1993156 - RNA, 19 nt, Homo sapiens
cuugucuccccuguucccc

SEQ ID NO: 1993157 - RNA, 19 nt, Homo sapiens
ugaggcagguggaucacug

SEQ ID NO: 1993158 - RNA, 15 nt, Homo sapiens
uuauucugaugauag

SEQ ID NO: 1993159 - RNA, 18 nt, Homo sapiens
gucccagccgcacuggga

SEQ ID NO: 1993160 - RNA, 16 nt, Homo sapiens
auggacuuucuugcaa

SEQ ID NO: 1993161 - RNA, 23 nt, Homo sapiens
agccugaccuuucugagugacau

SEQ ID NO: 1993162 - RNA, 20 nt, Homo sapiens
gaccaguugggagcacugga

SEQ ID NO: 1993163 - RNA, 19 nt, Homo sapiens
auauaccuggcuuuuacuu

SEQ ID NO: 1993164 - RNA, 16 nt, Homo sapiens
cagcucccacaagccu

SEQ ID NO: 1993165 - RNA, 18 nt, Homo sapiens
aaaccauaugaacauaua

SEQ ID NO: 1993166 - RNA, 18 nt, Homo sapiens
cagauucccagcuuccag

SEQ ID NO: 1993167 - RNA, 22 nt, Homo sapiens
cacagcaaggaaauguccugca

SEQ ID NO: 1993168 - RNA, 18 nt, Homo sapiens
ccaugaaagacuucucua

SEQ ID NO: 1993169 - RNA, 15 nt, Homo sapiens
acuucagucuugccu

SEQ ID NO: 1993170 - RNA, 17 nt, Homo sapiens
cagauggcaagugcacc

SEQ ID NO: 1993171 - RNA, 17 nt, Homo sapiens
uggacagauggaccaaa

SEQ ID NO: 1993172 - RNA, 18 nt, Homo sapiens
gaucacuuuaugucucac

SEQ ID NO: 1993173 - RNA, 16 nt, Homo sapiens
ucauccccuuacccuu

SEQ ID NO: 1993174 - RNA, 18 nt, Homo sapiens
cauucaugcaacuugauu

SEQ ID NO: 1993175 - RNA, 14 nt, Homo sapiens
uguuuuauuuuggu

SEQ ID NO: 1993176 - RNA, 14 nt, Homo sapiens
uguuuaauuuugga

SEQ ID NO: 1993177 - RNA, 18 nt, Homo sapiens
uuauagcuaucaacauua

SEQ ID NO: 1993178 - RNA, 12 nt, Homo sapiens
auuccagugcag

SEQ ID NO: 1993179 - RNA, 16 nt, Homo sapiens
gaaauaugaaugcccc

SEQ ID NO: 1993180 - RNA, 18 nt, Homo sapiens
cuacugcucuguguuuac

SEQ ID NO: 1993181 - RNA, 21 nt, Homo sapiens
auuuuggaaaaaugucacuga

SEQ ID NO: 1993182 - RNA, 14 nt, Homo sapiens
acucuucuguaaau

SEQ ID NO: 1993183 - RNA, 14 nt, Homo sapiens
cauagacugcaaaa

SEQ ID NO: 1993184 - RNA, 17 nt, Homo sapiens
ccaggccagcgcugcaa

SEQ ID NO: 1993185 - RNA, 20 nt, Homo sapiens
uccuuucuucguacauaguc

SEQ ID NO: 1993186 - RNA, 18 nt, Homo sapiens
aaguaguaaugauucuca

SEQ ID NO: 1993187 - RNA, 18 nt, Homo sapiens
ggauggacaucuugucau

SEQ ID NO: 1993188 - RNA, 20 nt, Homo sapiens
agagggggaggggugguacu

SEQ ID NO: 1993189 - RNA, 17 nt, Homo sapiens
accagacucuguugcaa

SEQ ID NO: 1993190 - RNA, 15 nt, Homo sapiens
cauuugaacuauauu

SEQ ID NO: 1993191 - RNA, 18 nt, Homo sapiens
cuagccaucucaagcaag

SEQ ID NO: 1993192 - RNA, 18 nt, Homo sapiens
gcaguuucugcuauugug

SEQ ID NO: 1993193 - RNA, 23 nt, Homo sapiens
agugaauacauuaacggugcuaa

SEQ ID NO: 1993194 - RNA, 21 nt, Homo sapiens
aagucuguuuuaugacuucau

SEQ ID NO: 1993195 - RNA, 19 nt, Homo sapiens
auaguaccuucaauacuua

SEQ ID NO: 1993196 - RNA, 13 nt, Homo sapiens
aagaauuccacca

SEQ ID NO: 1993197 - RNA, 14 nt, Homo sapiens
caguggacucuucc

SEQ ID NO: 1993198 - RNA, 21 nt, Homo sapiens
auggagcuugacuucaugcca

SEQ ID NO: 1993199 - RNA, 19 nt, Homo sapiens
acaaaaaaugcagaacuua

SEQ ID NO: 1993200 - RNA, 17 nt, Homo sapiens
caugcccgccagugcac

SEQ ID NO: 1993201 - RNA, 18 nt, Homo sapiens
ucuauaaaugaaugugcu

SEQ ID NO: 1993202 - RNA, 19 nt, Homo sapiens
ucagaacauguuaagauaa

SEQ ID NO: 1993203 - RNA, 15 nt, Homo sapiens
agcccagugcugcca

SEQ ID NO: 1993204 - RNA, 21 nt, Homo sapiens
aucaucaacaagauuuccuug

SEQ ID NO: 1993205 - RNA, 21 nt, Homo sapiens
cauaaagauauucuuuagugg

SEQ ID NO: 1993206 - RNA, 16 nt, Homo sapiens
cuuuauuaaauacaaa

SEQ ID NO: 1993207 - RNA, 17 nt, Homo sapiens
ucacuguuccagucucc

SEQ ID NO: 1993208 - RNA, 12 nt, Homo sapiens
cuauucaugucu

SEQ ID NO: 1993209 - RNA, 17 nt, Homo sapiens
aacauccaagucuuucu

SEQ ID NO: 1993210 - RNA, 19 nt, Homo sapiens
ucauaagacuuugggauag

SEQ ID NO: 1993211 - RNA, 13 nt, Homo sapiens
cacagauuaucaa

SEQ ID NO: 1993212 - RNA, 20 nt, Homo sapiens
uacuccugguucagugccac

SEQ ID NO: 1993213 - RNA, 16 nt, Homo sapiens
cauggcaauugcacuc

SEQ ID NO: 1993214 - RNA, 20 nt, Homo sapiens
uacaauaauucuaugagaua

SEQ ID NO: 1993215 - RNA, 21 nt, Homo sapiens
aaguugauuuuaagaauccaa

SEQ ID NO: 1993216 - RNA, 17 nt, Homo sapiens
auuaugauugcauugua

SEQ ID NO: 1993217 - RNA, 13 nt, Homo sapiens
acaagaacaauga

SEQ ID NO: 1993218 - RNA, 14 nt, Homo sapiens
acugacaaagacau

SEQ ID NO: 1993219 - RNA, 23 nt, Homo sapiens
cuuucuguuacugauguucaaua

SEQ ID NO: 1993220 - RNA, 14 nt, Homo sapiens
gacgccuggcugcu

SEQ ID NO: 1993221 - RNA, 21 nt, Homo sapiens
ucacuccaaaccuuacucuga

SEQ ID NO: 1993222 - RNA, 22 nt, Homo sapiens
uccaaugauacccaacaguuua

SEQ ID NO: 1993223 - RNA, 20 nt, Homo sapiens
aaguuuauguucuuacuuug

SEQ ID NO: 1993224 - RNA, 14 nt, Homo sapiens
agccuuagaaguca

SEQ ID NO: 1993225 - RNA, 13 nt, Homo sapiens
aaaaaaacagacu

SEQ ID NO: 1993226 - RNA, 15 nt, Homo sapiens
aucuucacugccaag

SEQ ID NO: 1993227 - RNA, 17 nt, Homo sapiens
ugccugguccagugggg

SEQ ID NO: 1993228 - RNA, 16 nt, Homo sapiens
gucacccuucugggca

SEQ ID NO: 1993229 - RNA, 19 nt, Homo sapiens
ggcgcuguuccacagugac

SEQ ID NO: 1993230 - RNA, 15 nt, Homo sapiens
ucugaaaacaaugcu

SEQ ID NO: 1993231 - RNA, 14 nt, Homo sapiens
gcuagagugcagug

SEQ ID NO: 1993232 - RNA, 16 nt, Homo sapiens
auugcugauaugcaag

SEQ ID NO: 1993233 - RNA, 19 nt, Homo sapiens
ugagggcagcuuugcaaaa

SEQ ID NO: 1993234 - RNA, 14 nt, Homo sapiens
aacauuucucucca

SEQ ID NO: 1993235 - RNA, 22 nt, Homo sapiens
cagauggcaggaugggcacugc

SEQ ID NO: 1993236 - RNA, 14 nt, Homo sapiens
cuguagcuccuuag

SEQ ID NO: 1993237 - RNA, 14 nt, Homo sapiens
ccuaaacucugaaa

SEQ ID NO: 1993238 - RNA, 16 nt, Homo sapiens
auccuguuuuugcaaa

SEQ ID NO: 1993239 - RNA, 17 nt, Homo sapiens
uuuuguucauacauauu

SEQ ID NO: 1993240 - RNA, 15 nt, Homo sapiens
aauccuuuuccuuau

SEQ ID NO: 1993241 - RNA, 20 nt, Homo sapiens
uguggccuucggacaacuca

SEQ ID NO: 1993242 - RNA, 19 nt, Homo sapiens
auugaccuugaccauuaau

SEQ ID NO: 1993243 - RNA, 14 nt, Homo sapiens
acuaaaaacaaacc

SEQ ID NO: 1993244 - RNA, 18 nt, Homo sapiens
ucucccagggaugcucuu

SEQ ID NO: 1993245 - RNA, 17 nt, Homo sapiens
agaauugaaacugagua

SEQ ID NO: 1993246 - RNA, 17 nt, Homo sapiens
uaaauagaugcugugua

SEQ ID NO: 1993247 - RNA, 13 nt, Homo sapiens
uggucuuugcucc

SEQ ID NO: 1993248 - RNA, 20 nt, Homo sapiens
cuuuccucagugacugugug

SEQ ID NO: 1993249 - RNA, 21 nt, Homo sapiens
guuuguuucaagaaccuggaa

SEQ ID NO: 1993250 - RNA, 16 nt, Homo sapiens
ucuaagacaaaugcag

SEQ ID NO: 1993251 - RNA, 16 nt, Homo sapiens
uauaagacacaugcag

SEQ ID NO: 1993252 - RNA, 19 nt, Homo sapiens
uuuacuuggagaagagauu

SEQ ID NO: 1993253 - RNA, 20 nt, Homo sapiens
agccucguuucugcuuucag

SEQ ID NO: 1993254 - RNA, 20 nt, Homo sapiens
uuguaaagauuucuguucag

SEQ ID NO: 1993255 - RNA, 16 nt, Homo sapiens
aacauuugcaccacuu

SEQ ID NO: 1993256 - RNA, 15 nt, Homo sapiens
auuucuucuacugcu

SEQ ID NO: 1993257 - RNA, 20 nt, Homo sapiens
gacugagguauaaagacaag

SEQ ID NO: 1993258 - RNA, 23 nt, Homo sapiens
gaaaacugacaucagauuucuua

SEQ ID NO: 1993259 - RNA, 16 nt, Homo sapiens
ugcccuggaaaggggg

SEQ ID NO: 1993260 - RNA, 19 nt, Homo sapiens
acugcauuccacagguggg

SEQ ID NO: 1993261 - RNA, 19 nt, Homo sapiens
guguuaaagugaaucucaa

SEQ ID NO: 1993262 - RNA, 22 nt, Homo sapiens
cagccccuccuccucgggcaca

SEQ ID NO: 1993263 - RNA, 20 nt, Homo sapiens
acugcacacugccuggccca

SEQ ID NO: 1993264 - RNA, 17 nt, Homo sapiens
uggggagacaccucaga

SEQ ID NO: 1993265 - RNA, 21 nt, Homo sapiens
acugcuuugagaaaucucauc

SEQ ID NO: 1993266 - RNA, 16 nt, Homo sapiens
ugugcuugucaucugc

SEQ ID NO: 1993267 - RNA, 16 nt, Homo sapiens
cuauauuuacagugaa

SEQ ID NO: 1993268 - RNA, 16 nt, Homo sapiens
gccuggacaacauagu

SEQ ID NO: 1993269 - RNA, 22 nt, Homo sapiens
guggagccaacacuugaacuca

SEQ ID NO: 1993270 - RNA, 15 nt, Homo sapiens
gaguauguugucaua

SEQ ID NO: 1993271 - RNA, 17 nt, Homo sapiens
acaccugccucugaccc

SEQ ID NO: 1993272 - RNA, 12 nt, Homo sapiens
aucauugaucuu

SEQ ID NO: 1993273 - RNA, 15 nt, Homo sapiens
ugcugauguggcaac

SEQ ID NO: 1993274 - RNA, 14 nt, Homo sapiens
ccugcagauguucu

SEQ ID NO: 1993275 - RNA, 14 nt, Homo sapiens
uguucagaaaagca

SEQ ID NO: 1993276 - RNA, 23 nt, Homo sapiens
gcauaaagucagggguucccuuu

SEQ ID NO: 1993277 - RNA, 13 nt, Homo sapiens
acaaggugacaaa

SEQ ID NO: 1993278 - RNA, 13 nt, Homo sapiens
cacaagugcacag

SEQ ID NO: 1993279 - RNA, 17 nt, Homo sapiens
cuuucugacaucagcac

SEQ ID NO: 1993280 - RNA, 12 nt, Homo sapiens
ugcuaaguauuu

SEQ ID NO: 1993281 - RNA, 15 nt, Homo sapiens
caggaggggucucau

SEQ ID NO: 1993282 - RNA, 23 nt, Homo sapiens
ucagcucuuuggaucagucuuug

SEQ ID NO: 1993283 - RNA, 23 nt, Homo sapiens
cuguaaaaucuuucuuucuuaga

SEQ ID NO: 1993284 - RNA, 18 nt, Homo sapiens
aaacuauuuaugaauauu

SEQ ID NO: 1993285 - RNA, 18 nt, Homo sapiens
ggccagcugggaucugac

SEQ ID NO: 1993286 - RNA, 20 nt, Homo sapiens
caguucagaaucacuucuga

SEQ ID NO: 1993287 - RNA, 22 nt, Homo sapiens
aaacucagaaggcuuugggaua

SEQ ID NO: 1993288 - RNA, 18 nt, Homo sapiens
caugugcgcgcgugcaug

SEQ ID NO: 1993289 - RNA, 23 nt, Homo sapiens
ccaggcccuacuacccauuguuc

SEQ ID NO: 1993290 - RNA, 21 nt, Homo sapiens
uaggccacaugcgguggcuca

SEQ ID NO: 1993291 - RNA, 18 nt, Homo sapiens
accacuacaugcagccca

SEQ ID NO: 1993292 - RNA, 14 nt, Homo sapiens
agguccuccucucu

SEQ ID NO: 1993293 - RNA, 23 nt, Homo sapiens
aauuugcuaaauacaacacugau

SEQ ID NO: 1993294 - RNA, 20 nt, Homo sapiens
gaauagcaugguuuuggcca

SEQ ID NO: 1993295 - RNA, 13 nt, Homo sapiens
acccucacauggg

SEQ ID NO: 1993296 - RNA, 16 nt, Homo sapiens
guuuaacauacaauca

SEQ ID NO: 1993297 - RNA, 22 nt, Homo sapiens
ccucaguccuuuauuguccauu

SEQ ID NO: 1993298 - RNA, 23 nt, Homo sapiens
caaaaccaaugagcauuacuuuc

SEQ ID NO: 1993299 - RNA, 14 nt, Homo sapiens
ccucaucucaucuc

SEQ ID NO: 1993300 - RNA, 17 nt, Homo sapiens
agccaagcuggcacaaa

SEQ ID NO: 1993301 - RNA, 14 nt, Homo sapiens
gaaccaauaaugua

SEQ ID NO: 1993302 - RNA, 16 nt, Homo sapiens
caacaugugugacugc

SEQ ID NO: 1993303 - RNA, 13 nt, Homo sapiens
gauugcugugaaa

SEQ ID NO: 1993304 - RNA, 22 nt, Homo sapiens
gaaaaccucauuuaccauaaaa

SEQ ID NO: 1993305 - RNA, 16 nt, Homo sapiens
cugcaugcccagagac

SEQ ID NO: 1993306 - RNA, 24 nt, Homo sapiens
gaaccuaacaugcuggugaauauu

SEQ ID NO: 1993307 - RNA, 16 nt, Homo sapiens
cacaagcaaugcaaga

SEQ ID NO: 1993308 - RNA, 14 nt, Homo sapiens
caauuaacaauaag

SEQ ID NO: 1993309 - RNA, 18 nt, Homo sapiens
aucgcacacuggggcccc

SEQ ID NO: 1993310 - RNA, 15 nt, Homo sapiens
gcaaauaaaccacuu

SEQ ID NO: 1993311 - RNA, 12 nt, Homo sapiens
acgccuuccucu

SEQ ID NO: 1993312 - RNA, 17 nt, Homo sapiens
auccccuaacacaaguu

SEQ ID NO: 1993313 - RNA, 15 nt, Homo sapiens
aucacuaaugcucaa

SEQ ID NO: 1993314 - RNA, 17 nt, Homo sapiens
agccguugcuaaugcca

SEQ ID NO: 1993315 - RNA, 19 nt, Homo sapiens
uugacucuaaaugcaguuu

SEQ ID NO: 1993316 - RNA, 18 nt, Homo sapiens
cauucuauuguggcaagg

SEQ ID NO: 1993317 - RNA, 16 nt, Homo sapiens
cauacaaauuuuccca

SEQ ID NO: 1993318 - RNA, 13 nt, Homo sapiens
ucauacuuaucua

SEQ ID NO: 1993319 - RNA, 22 nt, Homo sapiens
agcuuuuagccuggcugucacc

SEQ ID NO: 1993320 - RNA, 16 nt, Homo sapiens
uucacucuccauuaga

SEQ ID NO: 1993321 - RNA, 22 nt, Homo sapiens
augggagugaucucaccaacuc

SEQ ID NO: 1993322 - RNA, 15 nt, Homo sapiens
gguguggcacuggga

SEQ ID NO: 1993323 - RNA, 14 nt, Homo sapiens
ggauuucuuguauu

SEQ ID NO: 1993324 - RNA, 15 nt, Homo sapiens
gccaccagcggcccu

SEQ ID NO: 1993325 - RNA, 13 nt, Homo sapiens
aagagucauguca

SEQ ID NO: 1993326 - RNA, 16 nt, Homo sapiens
ucaggacagaugccac

SEQ ID NO: 1993327 - RNA, 21 nt, Homo sapiens
aagucuuuuuuucugcuucuu

SEQ ID NO: 1993328 - RNA, 15 nt, Homo sapiens
gcaagaagcuguuac

SEQ ID NO: 1993329 - RNA, 21 nt, Homo sapiens
uuuuugaucaagaaugcaaua

SEQ ID NO: 1993330 - RNA, 15 nt, Homo sapiens
aaaaauauugcugaa

SEQ ID NO: 1993331 - RNA, 13 nt, Homo sapiens
aauugacaugugc

SEQ ID NO: 1993332 - RNA, 21 nt, Homo sapiens
acaaauucggauguaugaucu

SEQ ID NO: 1993333 - RNA, 18 nt, Homo sapiens
cuuagggauaacacuguc

SEQ ID NO: 1993334 - RNA, 18 nt, Homo sapiens
ucaagacagccuaaugaa

SEQ ID NO: 1993335 - RNA, 20 nt, Homo sapiens
cacauuacauuuagucuucc

SEQ ID NO: 1993336 - RNA, 21 nt, Homo sapiens
ggucacccaacucaaggacag

SEQ ID NO: 1993337 - RNA, 23 nt, Homo sapiens
cuggguggaaggcagaccugaau

SEQ ID NO: 1993338 - RNA, 22 nt, Homo sapiens
gauucuuuucaucaaaaagccu

SEQ ID NO: 1993339 - RNA, 15 nt, Homo sapiens
guucacucagcacuu

SEQ ID NO: 1993340 - RNA, 15 nt, Homo sapiens
cacaaaugucuaguu

SEQ ID NO: 1993341 - RNA, 13 nt, Homo sapiens
uucuccuacuuag

SEQ ID NO: 1993342 - RNA, 22 nt, Homo sapiens
cuuagcuuuucugcaauucaac

SEQ ID NO: 1993343 - RNA, 16 nt, Homo sapiens
aaaugcugguuuuuca

SEQ ID NO: 1993344 - RNA, 21 nt, Homo sapiens
cuugaccccgacgccacagcc

SEQ ID NO: 1993345 - RNA, 22 nt, Homo sapiens
aacuccugauuuuguaguuaau

SEQ ID NO: 1993346 - RNA, 19 nt, Homo sapiens
uucauuuccuuguccugcu

SEQ ID NO: 1993347 - RNA, 15 nt, Homo sapiens
aucaauggugcaaaa

SEQ ID NO: 1993348 - RNA, 14 nt, Homo sapiens
agcagcaauaugcu

SEQ ID NO: 1993349 - RNA, 18 nt, Homo sapiens
ucgaggaagcaccucuca

SEQ ID NO: 1993350 - RNA, 19 nt, Homo sapiens
aaaagcaucuaugugagac

SEQ ID NO: 1993351 - RNA, 20 nt, Homo sapiens
ucugagcuagugauuugccu

SEQ ID NO: 1993352 - RNA, 23 nt, Homo sapiens
guugcuauuguaaggucuuugua

SEQ ID NO: 1993353 - RNA, 18 nt, Homo sapiens
ccaagaacuauaaacuua

SEQ ID NO: 1993354 - RNA, 15 nt, Homo sapiens
ugcccgccugcccac

SEQ ID NO: 1993355 - RNA, 13 nt, Homo sapiens
uugacacucugca

SEQ ID NO: 1993356 - RNA, 17 nt, Homo sapiens
uaaauauuuagucugca

SEQ ID NO: 1993357 - RNA, 17 nt, Homo sapiens
aagacagauacuccucc

SEQ ID NO: 1993358 - RNA, 12 nt, Homo sapiens
ugacacacagcu

SEQ ID NO: 1993359 - RNA, 12 nt, Homo sapiens
acacacacuccu

SEQ ID NO: 1993360 - RNA, 18 nt, Homo sapiens
ucauaaggauucagggaa

SEQ ID NO: 1993361 - RNA, 12 nt, Homo sapiens
aauuaaaaccuc

SEQ ID NO: 1993362 - RNA, 15 nt, Homo sapiens
gaauguaugugcaca

SEQ ID NO: 1993363 - RNA, 18 nt, Homo sapiens
gugguugucuuauugcac

SEQ ID NO: 1993364 - RNA, 17 nt, Homo sapiens
cuauggagaauuuaucc

SEQ ID NO: 1993365 - RNA, 14 nt, Homo sapiens
ucugccgcuaccuc

SEQ ID NO: 1993366 - RNA, 20 nt, Homo sapiens
cuguccucagccuugccaga

SEQ ID NO: 1993367 - RNA, 20 nt, Homo sapiens
uuaaacugauuacguuuaca

SEQ ID NO: 1993368 - RNA, 12 nt, Homo sapiens
ggccuccacucc

SEQ ID NO: 1993369 - RNA, 15 nt, Homo sapiens
aaguuacaacuuccu

SEQ ID NO: 1993370 - RNA, 22 nt, Homo sapiens
cacaaauuauucagauguacac

SEQ ID NO: 1993371 - RNA, 14 nt, Homo sapiens
cgcaugaaccugga

SEQ ID NO: 1993372 - RNA, 17 nt, Homo sapiens
caggcucaggcugccca

SEQ ID NO: 1993373 - RNA, 15 nt, Homo sapiens
aguaacugaaccauu

SEQ ID NO: 1993374 - RNA, 17 nt, Homo sapiens
ccucaccaaggugacac

SEQ ID NO: 1993375 - RNA, 13 nt, Homo sapiens
auucugcuuccac

SEQ ID NO: 1993376 - RNA, 18 nt, Homo sapiens
acagccaacaaacauaga

SEQ ID NO: 1993377 - RNA, 12 nt, Homo sapiens
aaaguuguugca

SEQ ID NO: 1993378 - RNA, 23 nt, Homo sapiens
ucuaacaauggaagauuugccca

SEQ ID NO: 1993379 - RNA, 22 nt, Homo sapiens
gcaauccucccacuucagccuc

SEQ ID NO: 1993380 - RNA, 14 nt, Homo sapiens
caggcagugugagu

SEQ ID NO: 1993381 - RNA, 20 nt, Homo sapiens
uuccacaucauguuacuuga

SEQ ID NO: 1993382 - RNA, 17 nt, Homo sapiens
gcuaaugaacucuuuca

SEQ ID NO: 1993383 - RNA, 14 nt, Homo sapiens
ggaccaucagugac

SEQ ID NO: 1993384 - RNA, 19 nt, Homo sapiens
ccuagccucgcucuuggca

SEQ ID NO: 1993385 - RNA, 14 nt, Homo sapiens
caucuuugucaaac

SEQ ID NO: 1993386 - RNA, 15 nt, Homo sapiens
ggcaguaacauuggg

SEQ ID NO: 1993387 - RNA, 18 nt, Homo sapiens
cauccagaugugugcaau

SEQ ID NO: 1993388 - RNA, 18 nt, Homo sapiens
caagguacaauucuuuaa

SEQ ID NO: 1993389 - RNA, 16 nt, Homo sapiens
acugagccucuuuuca

SEQ ID NO: 1993390 - RNA, 15 nt, Homo sapiens
caauaacacugucuc

SEQ ID NO: 1993391 - RNA, 14 nt, Homo sapiens
uauccuugucugaa

SEQ ID NO: 1993392 - RNA, 14 nt, Homo sapiens
gugcuucugcucau

SEQ ID NO: 1993393 - RNA, 22 nt, Homo sapiens
agaaaugccacucaccaaccca

SEQ ID NO: 1993394 - RNA, 22 nt, Homo sapiens
cuauaauguugucauuucaaga

SEQ ID NO: 1993395 - RNA, 14 nt, Homo sapiens
gccccuuucaggag

SEQ ID NO: 1993396 - RNA, 19 nt, Homo sapiens
auagaaauguauuuugaaa

SEQ ID NO: 1993397 - RNA, 18 nt, Homo sapiens
ucuguaaucaaacugcaa

SEQ ID NO: 1993398 - RNA, 15 nt, Homo sapiens
ugaauuccaguauuu

SEQ ID NO: 1993399 - RNA, 22 nt, Homo sapiens
aauugucaauaccccuguuaag

SEQ ID NO: 1993400 - RNA, 18 nt, Homo sapiens
augguaugugggugaccc

SEQ ID NO: 1993401 - RNA, 15 nt, Homo sapiens
uugguuguacuuugg

SEQ ID NO: 1993402 - RNA, 22 nt, Homo sapiens
ugacugauagcuuacacugagg

SEQ ID NO: 1993403 - RNA, 20 nt, Homo sapiens
uggagccagcagggcuguga

SEQ ID NO: 1993404 - RNA, 20 nt, Homo sapiens
gaaucuugucccagccucag

SEQ ID NO: 1993405 - RNA, 13 nt, Homo sapiens
gagccaguucagu

SEQ ID NO: 1993406 - RNA, 22 nt, Homo sapiens
uacauugugcccuugauuuuua

SEQ ID NO: 1993407 - RNA, 13 nt, Homo sapiens
gcagauccagagg

SEQ ID NO: 1993408 - RNA, 21 nt, Homo sapiens
agugaugugugagcuaugcaa

SEQ ID NO: 1993409 - RNA, 16 nt, Homo sapiens
uucuccucugauuuca

SEQ ID NO: 1993410 - RNA, 16 nt, Homo sapiens
ugaaauauaaucagaa

SEQ ID NO: 1993411 - RNA, 21 nt, Homo sapiens
ucacacugaaucagcugcuga

SEQ ID NO: 1993412 - RNA, 16 nt, Homo sapiens
acaaugccaucacugg

SEQ ID NO: 1993413 - RNA, 22 nt, Homo sapiens
acauuugaagacccuugugcau

SEQ ID NO: 1993414 - RNA, 15 nt, Homo sapiens
aguaacacaaacauc

SEQ ID NO: 1993415 - RNA, 20 nt, Homo sapiens
gacagccaggagcucuccau

SEQ ID NO: 1993416 - RNA, 16 nt, Homo sapiens
aguucugaaaacuguu

SEQ ID NO: 1993417 - RNA, 14 nt, Homo sapiens
ggaugcacauuucu

SEQ ID NO: 1993418 - RNA, 22 nt, Homo sapiens
cauuguguucucuauugcugcu

SEQ ID NO: 1993419 - RNA, 13 nt, Homo sapiens
acugcagcugcug

SEQ ID NO: 1993420 - RNA, 17 nt, Homo sapiens
augucccaccucucuga

SEQ ID NO: 1993421 - RNA, 21 nt, Homo sapiens
gucacacauuucuauuuugca

SEQ ID NO: 1993422 - RNA, 24 nt, Homo sapiens
uaagugaaaaucuuacaacaggcu

SEQ ID NO: 1993423 - RNA, 22 nt, Homo sapiens
agauggacucaggauccaguga

SEQ ID NO: 1993424 - RNA, 17 nt, Homo sapiens
uggugguuggggugguu

SEQ ID NO: 1993425 - RNA, 16 nt, Homo sapiens
ccaaagacguguccga

SEQ ID NO: 1993426 - RNA, 15 nt, Homo sapiens
cuaacauacugcauu

SEQ ID NO: 1993427 - RNA, 12 nt, Homo sapiens
uguggacacugc

SEQ ID NO: 1993428 - RNA, 17 nt, Homo sapiens
acaaauauaaaauuaaa

SEQ ID NO: 1993429 - RNA, 19 nt, Homo sapiens
guaauuccuguuacuuuac

SEQ ID NO: 1993430 - RNA, 13 nt, Homo sapiens
agacugcuacagg

SEQ ID NO: 1993431 - RNA, 15 nt, Homo sapiens
augaagcuucaugca

SEQ ID NO: 1993432 - RNA, 23 nt, Homo sapiens
agacgggcaaaauaaagugacag

SEQ ID NO: 1993433 - RNA, 17 nt, Homo sapiens
cugacuuuuaaugucau

SEQ ID NO: 1993434 - RNA, 19 nt, Homo sapiens
ugaggcaggugacagugag

SEQ ID NO: 1993435 - RNA, 19 nt, Homo sapiens
cugggcugcagagacugga

SEQ ID NO: 1993436 - RNA, 21 nt, Homo sapiens
auguuucaggagagaguugaa

SEQ ID NO: 1993437 - RNA, 19 nt, Homo sapiens
caagacuugauacugcaau

SEQ ID NO: 1993438 - RNA, 11 nt, Homo sapiens
agaccagugac

SEQ ID NO: 1993439 - RNA, 15 nt, Homo sapiens
acacaccucauguga

SEQ ID NO: 1993440 - RNA, 21 nt, Homo sapiens
aaugugcagcucccauuuggc

SEQ ID NO: 1993441 - RNA, 15 nt, Homo sapiens
cccuuccccugggaa

SEQ ID NO: 1993442 - RNA, 18 nt, Homo sapiens
aggcugggugcagucacg

SEQ ID NO: 1993443 - RNA, 21 nt, Homo sapiens
uccuucacucugacaguauua

SEQ ID NO: 1993444 - RNA, 23 nt, Homo sapiens
auuucuguucuuacaaaugugaa

SEQ ID NO: 1993445 - RNA, 15 nt, Homo sapiens
cuuggaucugccaug

SEQ ID NO: 1993446 - RNA, 17 nt, Homo sapiens
cuucuggugagugcaag

SEQ ID NO: 1993447 - RNA, 19 nt, Homo sapiens
uuccaucccuaagaauucc

SEQ ID NO: 1993448 - RNA, 21 nt, Homo sapiens
acauaaguguugguagcacuu

SEQ ID NO: 1993449 - RNA, 18 nt, Homo sapiens
auccuucaacucugugag

SEQ ID NO: 1993450 - RNA, 23 nt, Homo sapiens
ucuuuccaucuaucacugcauua

SEQ ID NO: 1993451 - RNA, 21 nt, Homo sapiens
aacucuuguauugcuccauuu

SEQ ID NO: 1993452 - RNA, 20 nt, Homo sapiens
ugaggcaaauuaacuguaug

SEQ ID NO: 1993453 - RNA, 22 nt, Homo sapiens
cuaaguuauuguuaauuaugua

SEQ ID NO: 1993454 - RNA, 12 nt, Homo sapiens
ugagcuggugcc

SEQ ID NO: 1993455 - RNA, 22 nt, Homo sapiens
guucuaagaaacccucugucau

SEQ ID NO: 1993456 - RNA, 16 nt, Homo sapiens
uauaaagaagaacuug

SEQ ID NO: 1993457 - RNA, 13 nt, Homo sapiens
uccugggugccag

SEQ ID NO: 1993458 - RNA, 13 nt, Homo sapiens
ugaaggguggaug

SEQ ID NO: 1993459 - RNA, 20 nt, Homo sapiens
caucucauuuuuaagaacaa

SEQ ID NO: 1993460 - RNA, 16 nt, Homo sapiens
gcacccccugcagcuu

SEQ ID NO: 1993461 - RNA, 14 nt, Homo sapiens
cagaaaaaugucau

SEQ ID NO: 1993462 - RNA, 17 nt, Homo sapiens
uuagcaugaaagguaau

SEQ ID NO: 1993463 - RNA, 14 nt, Homo sapiens
gcggaccggggacc

SEQ ID NO: 1993464 - RNA, 17 nt, Homo sapiens
ccaggaguuugagacca

SEQ ID NO: 1993465 - RNA, 13 nt, Homo sapiens
auuauuagucugu

SEQ ID NO: 1993466 - RNA, 20 nt, Homo sapiens
ggaggcggagguuccaguga

SEQ ID NO: 1993467 - RNA, 19 nt, Homo sapiens
auaguaagccccugugacc

SEQ ID NO: 1993468 - RNA, 22 nt, Homo sapiens
gucuuaauauauauauccagau

SEQ ID NO: 1993469 - RNA, 19 nt, Homo sapiens
gaguccaugaaaauaccau

SEQ ID NO: 1993470 - RNA, 13 nt, Homo sapiens
aauagaaaacugu

SEQ ID NO: 1993471 - RNA, 14 nt, Homo sapiens
ugagaccucaaauc

SEQ ID NO: 1993472 - RNA, 14 nt, Homo sapiens
uuccacuuugcaua

SEQ ID NO: 1993473 - RNA, 23 nt, Homo sapiens
uccugagcucagcguggaggggu

SEQ ID NO: 1993474 - RNA, 13 nt, Homo sapiens
aaggaucacuuga

SEQ ID NO: 1993475 - RNA, 13 nt, Homo sapiens
ccucuguucucuc

SEQ ID NO: 1993476 - RNA, 17 nt, Homo sapiens
ugugacuuuuauaugcu

SEQ ID NO: 1993477 - RNA, 13 nt, Homo sapiens
aauguucacuggu

SEQ ID NO: 1993478 - RNA, 20 nt, Homo sapiens
cacguuggugcgugagaucc

SEQ ID NO: 1993479 - RNA, 13 nt, Homo sapiens
cuugaaaccaaag

SEQ ID NO: 1993480 - RNA, 21 nt, Homo sapiens
agcccgaggcaccaguguccu

SEQ ID NO: 1993481 - RNA, 21 nt, Homo sapiens
ucucuaaauaaaagaagucaa

SEQ ID NO: 1993482 - RNA, 14 nt, Homo sapiens
ccaagcuggcacaa

SEQ ID NO: 1993483 - RNA, 15 nt, Homo sapiens
aaucagccacauucu

SEQ ID NO: 1993484 - RNA, 20 nt, Homo sapiens
ccccugggcgagacacagcu

SEQ ID NO: 1993485 - RNA, 18 nt, Homo sapiens
gccccaggggcacugugu

SEQ ID NO: 1993486 - RNA, 15 nt, Homo sapiens
cagacaccacagccu

SEQ ID NO: 1993487 - RNA, 12 nt, Homo sapiens
ugaagugucaca

SEQ ID NO: 1993488 - RNA, 22 nt, Homo sapiens
agugggggcggggaagggugca

SEQ ID NO: 1993489 - RNA, 20 nt, Homo sapiens
uggcagagggcagagcacau

SEQ ID NO: 1993490 - RNA, 19 nt, Homo sapiens
uaaucuugaaggaacacaa

SEQ ID NO: 1993491 - RNA, 22 nt, Homo sapiens
ggugauauauaaucauauccag

SEQ ID NO: 1993492 - RNA, 17 nt, Homo sapiens
ugccaaucugcauuucu

SEQ ID NO: 1993493 - RNA, 23 nt, Homo sapiens
cuccgugucucgcgcgacugaga

SEQ ID NO: 1993494 - RNA, 17 nt, Homo sapiens
ucugggggaguggaaua

SEQ ID NO: 1993495 - RNA, 19 nt, Homo sapiens
ccaccagcccgcaacucuc

SEQ ID NO: 1993496 - RNA, 15 nt, Homo sapiens
ucucauuugugugga

SEQ ID NO: 1993497 - RNA, 18 nt, Homo sapiens
aacauauauauacuauua

SEQ ID NO: 1993498 - RNA, 23 nt, Homo sapiens
ugacaaccgcaacaacaaaaaca

SEQ ID NO: 1993499 - RNA, 11 nt, Homo sapiens
agcuuucccag

SEQ ID NO: 1993500 - RNA, 12 nt, Homo sapiens
gaaagcuuugaa

SEQ ID NO: 1993501 - RNA, 17 nt, Homo sapiens
agugccuuauucucaca

SEQ ID NO: 1993502 - RNA, 20 nt, Homo sapiens
cagauggggucugugacugg

SEQ ID NO: 1993503 - RNA, 17 nt, Homo sapiens
cauucaagcuucauaua

SEQ ID NO: 1993504 - RNA, 21 nt, Homo sapiens
cauuguuuuugucauguagcu

SEQ ID NO: 1993505 - RNA, 15 nt, Homo sapiens
auuauucuucuuuau

SEQ ID NO: 1993506 - RNA, 18 nt, Homo sapiens
agaguugugauacagagu

SEQ ID NO: 1993507 - RNA, 19 nt, Homo sapiens
aucuguguuaaucugagua

SEQ ID NO: 1993508 - RNA, 17 nt, Homo sapiens
aacaugggagcguuccu

SEQ ID NO: 1993509 - RNA, 20 nt, Homo sapiens
aguuagaauuauaucacuuc

SEQ ID NO: 1993510 - RNA, 16 nt, Homo sapiens
cuuuugcuaaugcaau

SEQ ID NO: 1993511 - RNA, 12 nt, Homo sapiens
cuccugcaaaau

SEQ ID NO: 1993512 - RNA, 14 nt, Homo sapiens
ucggcuccugaugg

SEQ ID NO: 1993513 - RNA, 15 nt, Homo sapiens
ugguucucaucuuuc

SEQ ID NO: 1993514 - RNA, 12 nt, Homo sapiens
uuagcaaugcug

SEQ ID NO: 1993515 - RNA, 13 nt, Homo sapiens
cucugagggugau

SEQ ID NO: 1993516 - RNA, 15 nt, Homo sapiens
cagaagucuugucuc

SEQ ID NO: 1993517 - RNA, 17 nt, Homo sapiens
cgaguuguuggcugcuc

SEQ ID NO: 1993518 - RNA, 15 nt, Homo sapiens
agagagccaagcccu

SEQ ID NO: 1993519 - RNA, 18 nt, Homo sapiens
aagauccuccugcugcag

SEQ ID NO: 1993520 - RNA, 15 nt, Homo sapiens
ugggcucgcacugcc

SEQ ID NO: 1993521 - RNA, 13 nt, Homo sapiens
cucuuagggugag

SEQ ID NO: 1993522 - RNA, 23 nt, Homo sapiens
acuagagacgcaccuugcugcag

SEQ ID NO: 1993523 - RNA, 18 nt, Homo sapiens
ccgggaacaaaaugaugu

SEQ ID NO: 1993524 - RNA, 12 nt, Homo sapiens
cagccuuucuaa

SEQ ID NO: 1993525 - RNA, 18 nt, Homo sapiens
ugcucuagauucauaaau

SEQ ID NO: 1993526 - RNA, 21 nt, Homo sapiens
cucaaggguggcaggucacug

SEQ ID NO: 1993527 - RNA, 14 nt, Homo sapiens
acagggcaugccug

SEQ ID NO: 1993528 - RNA, 14 nt, Homo sapiens
gauucaagucugca

SEQ ID NO: 1993529 - RNA, 12 nt, Homo sapiens
aaauacaucacu

SEQ ID NO: 1993530 - RNA, 15 nt, Homo sapiens
cacucccgaggaugu

SEQ ID NO: 1993531 - RNA, 19 nt, Homo sapiens
caccugugagauccgugaa

SEQ ID NO: 1993532 - RNA, 19 nt, Homo sapiens
cccacuccgccagccacag

SEQ ID NO: 1993533 - RNA, 20 nt, Homo sapiens
auuaacauacaucauuccac

SEQ ID NO: 1993534 - RNA, 16 nt, Homo sapiens
uuucuugaagauaaaa

SEQ ID NO: 1993535 - RNA, 17 nt, Homo sapiens
caagugccuuauucuca

SEQ ID NO: 1993536 - RNA, 12 nt, Homo sapiens
uaaacucucuuc

SEQ ID NO: 1993537 - RNA, 23 nt, Homo sapiens
gaaauuuauaucagauucuuggc

SEQ ID NO: 1993538 - RNA, 21 nt, Homo sapiens
guuuuuuuaagucacuuugua

SEQ ID NO: 1993539 - RNA, 20 nt, Homo sapiens
cuggccagagccaagaaaca

SEQ ID NO: 1993540 - RNA, 18 nt, Homo sapiens
ugguaaucugaggcaauc

SEQ ID NO: 1993541 - RNA, 15 nt, Homo sapiens
gcagaucaucuccaa

SEQ ID NO: 1993542 - RNA, 18 nt, Homo sapiens
aaucuagaagcuuaagaa

SEQ ID NO: 1993543 - RNA, 20 nt, Homo sapiens
auucuuuuuucuauucaaua

SEQ ID NO: 1993544 - RNA, 19 nt, Homo sapiens
cugauauucaaauggacaa

SEQ ID NO: 1993545 - RNA, 18 nt, Homo sapiens
agaggaucuccuguccau

SEQ ID NO: 1993546 - RNA, 22 nt, Homo sapiens
aucucugagaccacagaggcuc

SEQ ID NO: 1993547 - RNA, 14 nt, Homo sapiens
ccauggaugcaugc

SEQ ID NO: 1993548 - RNA, 14 nt, Homo sapiens
gaguugcggcagaa

SEQ ID NO: 1993549 - RNA, 15 nt, Homo sapiens
aaguuaucauggugu

SEQ ID NO: 1993550 - RNA, 23 nt, Homo sapiens
uacuuauuauuccagaucugcag

SEQ ID NO: 1993551 - RNA, 21 nt, Homo sapiens
agaaauuuggcauugaucuua

SEQ ID NO: 1993552 - RNA, 21 nt, Homo sapiens
acagacaaggugccuguuaua

SEQ ID NO: 1993553 - RNA, 23 nt, Homo sapiens
cagcuggguuggaaaacaguauu

SEQ ID NO: 1993554 - RNA, 17 nt, Homo sapiens
agcuggaacuacaagga

SEQ ID NO: 1993555 - RNA, 13 nt, Homo sapiens
guggcauccagag

SEQ ID NO: 1993556 - RNA, 16 nt, Homo sapiens
ugccuccagugcaguc

SEQ ID NO: 1993557 - RNA, 23 nt, Homo sapiens
agggaaugagaguuccuucucac

SEQ ID NO: 1993558 - RNA, 19 nt, Homo sapiens
aguugagagguuggagcag

SEQ ID NO: 1993559 - RNA, 17 nt, Homo sapiens
auggacauucaugcuca

SEQ ID NO: 1993560 - RNA, 12 nt, Homo sapiens
aucaaaugucag

SEQ ID NO: 1993561 - RNA, 22 nt, Homo sapiens
uagaaaaauagcugugaacaga

SEQ ID NO: 1993562 - RNA, 23 nt, Homo sapiens
uuguucaucagacuccugugcaa

SEQ ID NO: 1993563 - RNA, 17 nt, Homo sapiens
cauagaagaaaauccau

SEQ ID NO: 1993564 - RNA, 16 nt, Homo sapiens
ucuucccaaacccagu

SEQ ID NO: 1993565 - RNA, 13 nt, Homo sapiens
caucauuacccuu

SEQ ID NO: 1993566 - RNA, 14 nt, Homo sapiens
aacagccugaauca

SEQ ID NO: 1993567 - RNA, 21 nt, Homo sapiens
aguaaugccucugucuagcau

SEQ ID NO: 1993568 - RNA, 12 nt, Homo sapiens
ugcuaauguugc

SEQ ID NO: 1993569 - RNA, 22 nt, Homo sapiens
auuaaucacaaauuucacuuau

SEQ ID NO: 1993570 - RNA, 15 nt, Homo sapiens
ucccccuaaggcagc

SEQ ID NO: 1993571 - RNA, 16 nt, Homo sapiens
cugaaguaaacagcug

SEQ ID NO: 1993572 - RNA, 14 nt, Homo sapiens
aggguugacaaaua

SEQ ID NO: 1993573 - RNA, 12 nt, Homo sapiens
agacgugugaga

SEQ ID NO: 1993574 - RNA, 17 nt, Homo sapiens
caaaugucaguucauaa

SEQ ID NO: 1993575 - RNA, 12 nt, Homo sapiens
cugaacugaugg

SEQ ID NO: 1993576 - RNA, 20 nt, Homo sapiens
cgcuugcucgcuugcuggaa

SEQ ID NO: 1993577 - RNA, 15 nt, Homo sapiens
ucagagcccagcuca

SEQ ID NO: 1993578 - RNA, 13 nt, Homo sapiens
ccuaacuucuuau

SEQ ID NO: 1993579 - RNA, 12 nt, Homo sapiens
gacaacacuuca

SEQ ID NO: 1993580 - RNA, 19 nt, Homo sapiens
accuuaaauuaaacaauuu

SEQ ID NO: 1993581 - RNA, 23 nt, Homo sapiens
uuuuccaguccccagaagcagag

SEQ ID NO: 1993582 - RNA, 17 nt, Homo sapiens
auacugcugcuugucaa

SEQ ID NO: 1993583 - RNA, 13 nt, Homo sapiens
auacacuuacacu

SEQ ID NO: 1993584 - RNA, 22 nt, Homo sapiens
cugggucuuucugacaucagca

SEQ ID NO: 1993585 - RNA, 14 nt, Homo sapiens
cucagagcugcuga

SEQ ID NO: 1993586 - RNA, 18 nt, Homo sapiens
aagccugugccaccugca

SEQ ID NO: 1993587 - RNA, 15 nt, Homo sapiens
aggcaggaguggcgu

SEQ ID NO: 1993588 - RNA, 16 nt, Homo sapiens
aaggccuggucuggga

SEQ ID NO: 1993589 - RNA, 16 nt, Homo sapiens
gaaguccuccagacaa

SEQ ID NO: 1993590 - RNA, 15 nt, Homo sapiens
uccccacaccucccu

SEQ ID NO: 1993591 - RNA, 13 nt, Homo sapiens
agggacagcgggu

SEQ ID NO: 1993592 - RNA, 22 nt, Homo sapiens
cuuucuuacauuagcaguuugc

SEQ ID NO: 1993593 - RNA, 21 nt, Homo sapiens
accgagcgggugcaagcacuc

SEQ ID NO: 1993594 - RNA, 10 nt, Homo sapiens
uaacagaauu

SEQ ID NO: 1993595 - RNA, 21 nt, Homo sapiens
uccagagcccaaggucaggga

SEQ ID NO: 1993596 - RNA, 15 nt, Homo sapiens
aggagaaacacaucu

SEQ ID NO: 1993597 - RNA, 21 nt, Homo sapiens
uaacucuugcucacucccuaa

SEQ ID NO: 1993598 - RNA, 20 nt, Homo sapiens
gcaacaugccagccacugug

SEQ ID NO: 1993599 - RNA, 21 nt, Homo sapiens
uaauggagaauuaaaacuuug

SEQ ID NO: 1993600 - RNA, 23 nt, Homo sapiens
cccuccacgugauuuccagugag

SEQ ID NO: 1993601 - RNA, 19 nt, Homo sapiens
agacuuacucuaagaucuu

SEQ ID NO: 1993602 - RNA, 20 nt, Homo sapiens
agagcacgggcguuauguaa

SEQ ID NO: 1993603 - RNA, 22 nt, Homo sapiens
ucucugggcuucgggcuaugca

SEQ ID NO: 1993604 - RNA, 18 nt, Homo sapiens
aauucuucuguccugaga

SEQ ID NO: 1993605 - RNA, 13 nt, Homo sapiens
acauccaaugcau

SEQ ID NO: 1993606 - RNA, 15 nt, Homo sapiens
gaggcggauuucccu

SEQ ID NO: 1993607 - RNA, 22 nt, Homo sapiens
cugugaccugcugagcucugag

SEQ ID NO: 1993608 - RNA, 20 nt, Homo sapiens
uaaagugcuuuagguaugaa

SEQ ID NO: 1993609 - RNA, 15 nt, Homo sapiens
cuuaucaacauuugg

SEQ ID NO: 1993610 - RNA, 13 nt, Homo sapiens
cuuaggucuuccu

SEQ ID NO: 1993611 - RNA, 20 nt, Homo sapiens
cuacuaccuagggcacuuua

SEQ ID NO: 1993612 - RNA, 21 nt, Homo sapiens
gauaaguagggcuaagccagu

SEQ ID NO: 1993613 - RNA, 17 nt, Homo sapiens
guguguugauacuguug

SEQ ID NO: 1993614 - RNA, 15 nt, Homo sapiens
caguaacagugcagu

SEQ ID NO: 1993615 - RNA, 12 nt, Homo sapiens
accagucccaug

SEQ ID NO: 1993616 - RNA, 22 nt, Homo sapiens
ucugacuccacucaaagagggu

SEQ ID NO: 1993617 - RNA, 17 nt, Homo sapiens
uauaaagacaacaaaag

SEQ ID NO: 1993618 - RNA, 14 nt, Homo sapiens
cacauuaaaagaca

SEQ ID NO: 1993619 - RNA, 17 nt, Homo sapiens
cauaaagguaacaaagg

SEQ ID NO: 1993620 - RNA, 22 nt, Homo sapiens
gaggaaaaaaagcaugcauucu

SEQ ID NO: 1993621 - RNA, 16 nt, Homo sapiens
uuuguaaaacauuagu

SEQ ID NO: 1993622 - RNA, 18 nt, Homo sapiens
ugacaagagcgaaacucc

SEQ ID NO: 1993623 - RNA, 21 nt, Homo sapiens
guucagauuuuacugucuaug

SEQ ID NO: 1993624 - RNA, 22 nt, Homo sapiens
acccuccuggggcucucagugu

SEQ ID NO: 1993625 - RNA, 22 nt, Homo sapiens
gccaaagaccaaauuccuuggc

SEQ ID NO: 1993626 - RNA, 23 nt, Homo sapiens
ggccuugagcaagucccaucuca

SEQ ID NO: 1993627 - RNA, 13 nt, Homo sapiens
ugaccucagcaaa

SEQ ID NO: 1993628 - RNA, 19 nt, Homo sapiens
gauaggaagugccccaggg

SEQ ID NO: 1993629 - RNA, 20 nt, Homo sapiens
augcacuuaaagaaguauuu

SEQ ID NO: 1993630 - RNA, 23 nt, Homo sapiens
uaaacaguagcagccugcguuaa

SEQ ID NO: 1993631 - RNA, 18 nt, Homo sapiens
auuugaaaugaauuccuc

SEQ ID NO: 1993632 - RNA, 18 nt, Homo sapiens
cuugaguaaaucuaaaga

SEQ ID NO: 1993633 - RNA, 13 nt, Homo sapiens
gcaugagugcuga

SEQ ID NO: 1993634 - RNA, 12 nt, Homo sapiens
gcugucugugaa

SEQ ID NO: 1993635 - RNA, 15 nt, Homo sapiens
gucacuguaugugaa

SEQ ID NO: 1993636 - RNA, 19 nt, Homo sapiens
gcacauugcauaguaguuu

SEQ ID NO: 1993637 - RNA, 23 nt, Homo sapiens
cgagagaaagggagugcaugugc

SEQ ID NO: 1993638 - RNA, 19 nt, Homo sapiens
uuaauugugauauuugaca

SEQ ID NO: 1993639 - RNA, 19 nt, Homo sapiens
uacuuuucaggcacuuuag

SEQ ID NO: 1993640 - RNA, 12 nt, Homo sapiens
agcacacgucau

SEQ ID NO: 1993641 - RNA, 16 nt, Homo sapiens
auucugauguuucuca

SEQ ID NO: 1993642 - RNA, 14 nt, Homo sapiens
auucucuagacaaa

SEQ ID NO: 1993643 - RNA, 21 nt, Homo sapiens
augccagcuacuuccuccucc

SEQ ID NO: 1993644 - RNA, 15 nt, Homo sapiens
cuuagggaugauuaa

SEQ ID NO: 1993645 - RNA, 19 nt, Homo sapiens
agugagacuagacauagua

SEQ ID NO: 1993646 - RNA, 18 nt, Homo sapiens
cacuggggcagaugucuc

SEQ ID NO: 1993647 - RNA, 19 nt, Homo sapiens
ucccaggaaagaagcauuu

SEQ ID NO: 1993648 - RNA, 14 nt, Homo sapiens
ucuaacaagucaua

SEQ ID NO: 1993649 - RNA, 18 nt, Homo sapiens
ccugaaccguuacaaaag

SEQ ID NO: 1993650 - RNA, 19 nt, Homo sapiens
ggccagcauacuccgugag

SEQ ID NO: 1993651 - RNA, 17 nt, Homo sapiens
cuuugaacaugcugaaa

SEQ ID NO: 1993652 - RNA, 18 nt, Homo sapiens
aaacaggcaccacugcuu

SEQ ID NO: 1993653 - RNA, 14 nt, Homo sapiens
aguuacucucaggc

SEQ ID NO: 1993654 - RNA, 23 nt, Homo sapiens
ugcaucuuuguuacuuccuuaug

SEQ ID NO: 1993655 - RNA, 22 nt, Homo sapiens
cuagaaccaagcuucagagccu

SEQ ID NO: 1993656 - RNA, 13 nt, Homo sapiens
cuaggugcccuug

SEQ ID NO: 1993657 - RNA, 14 nt, Homo sapiens
gcagccccugagag

SEQ ID NO: 1993658 - RNA, 22 nt, Homo sapiens
cauaguaccgaauuuaguucau

SEQ ID NO: 1993659 - RNA, 19 nt, Homo sapiens
cacucacaggcuacaguug

SEQ ID NO: 1993660 - RNA, 16 nt, Homo sapiens
ccuaaaucacuuugag

SEQ ID NO: 1993661 - RNA, 16 nt, Homo sapiens
gugucuucccugccug

SEQ ID NO: 1993662 - RNA, 20 nt, Homo sapiens
uuccugcaguguuuugcaua

SEQ ID NO: 1993663 - RNA, 15 nt, Homo sapiens
uccacccccaagaaa

SEQ ID NO: 1993664 - RNA, 21 nt, Homo sapiens
cugaauauacagaaguuccau

SEQ ID NO: 1993665 - RNA, 20 nt, Homo sapiens
cguggagcaugcaacacauc

SEQ ID NO: 1993666 - RNA, 19 nt, Homo sapiens
ugguuacauaucaaaacau

SEQ ID NO: 1993667 - RNA, 18 nt, Homo sapiens
ucccagucccagccucug

SEQ ID NO: 1993668 - RNA, 20 nt, Homo sapiens
uugguaagugcagcuugaau

SEQ ID NO: 1993669 - RNA, 20 nt, Homo sapiens
ccacuggcuuuugccuguaa

SEQ ID NO: 1993670 - RNA, 13 nt, Homo sapiens
gcuguggggcccu

SEQ ID NO: 1993671 - RNA, 24 nt, Homo sapiens
ccuggucaggcccuggugcgaaug

SEQ ID NO: 1993672 - RNA, 16 nt, Homo sapiens
auguuuaauaauaugu

SEQ ID NO: 1993673 - RNA, 14 nt, Homo sapiens
auucaagagccagc

SEQ ID NO: 1993674 - RNA, 18 nt, Homo sapiens
aagccagucuuguucaca

SEQ ID NO: 1993675 - RNA, 19 nt, Homo sapiens
uacuguaagaaacaaggaa

SEQ ID NO: 1993676 - RNA, 15 nt, Homo sapiens
uuaagaaagcacuua

SEQ ID NO: 1993677 - RNA, 19 nt, Homo sapiens
gcugaccaacgcacaacag

SEQ ID NO: 1993678 - RNA, 21 nt, Homo sapiens
aucuuuuagcuagaauccaca

SEQ ID NO: 1993679 - RNA, 23 nt, Homo sapiens
guccagccgccauugccaccagg

SEQ ID NO: 1993680 - RNA, 17 nt, Homo sapiens
auaacccuuucuguggu

SEQ ID NO: 1993681 - RNA, 18 nt, Homo sapiens
ucacuguguuagccagga

SEQ ID NO: 1993682 - RNA, 19 nt, Homo sapiens
gaaguccccucuacuuuaa

SEQ ID NO: 1993683 - RNA, 15 nt, Homo sapiens
accgucccucaguga

SEQ ID NO: 1993684 - RNA, 18 nt, Homo sapiens
gccucaaccucccuggcu

SEQ ID NO: 1993685 - RNA, 22 nt, Homo sapiens
agcuauuuauguucaucuucaa

SEQ ID NO: 1993686 - RNA, 14 nt, Homo sapiens
auucccugucccca

SEQ ID NO: 1993687 - RNA, 12 nt, Homo sapiens
aggagcucagau

SEQ ID NO: 1993688 - RNA, 17 nt, Homo sapiens
augcaauuuuucaagag

SEQ ID NO: 1993689 - RNA, 15 nt, Homo sapiens
uagcauacuguguau

SEQ ID NO: 1993690 - RNA, 15 nt, Homo sapiens
gccuuaaaagccauc

SEQ ID NO: 1993691 - RNA, 19 nt, Homo sapiens
gugucagcaucuuugcccu

SEQ ID NO: 1993692 - RNA, 22 nt, Homo sapiens
agccuauaucuucaucugugaa

SEQ ID NO: 1993693 - RNA, 19 nt, Homo sapiens
acccuuggccuuuacagaa

SEQ ID NO: 1993694 - RNA, 20 nt, Homo sapiens
uuagcauuauuggaugucaa

SEQ ID NO: 1993695 - RNA, 11 nt, Homo sapiens
cucuggaccaa

SEQ ID NO: 1993696 - RNA, 18 nt, Homo sapiens
ggaauggccugugccaua

SEQ ID NO: 1993697 - RNA, 21 nt, Homo sapiens
uauacagcauugacucagaua

SEQ ID NO: 1993698 - RNA, 21 nt, Homo sapiens
cacauagguuagauucucauu

SEQ ID NO: 1993699 - RNA, 15 nt, Homo sapiens
aagaagguuuguguu

SEQ ID NO: 1993700 - RNA, 20 nt, Homo sapiens
auucacuuuauuguagaaaa

SEQ ID NO: 1993701 - RNA, 23 nt, Homo sapiens
ucaaaucauguuuuuucugcaau

SEQ ID NO: 1993702 - RNA, 21 nt, Homo sapiens
cuuucaaaggauaugcagaaa

SEQ ID NO: 1993703 - RNA, 16 nt, Homo sapiens
cuggauuauaaggaaa

SEQ ID NO: 1993704 - RNA, 13 nt, Homo sapiens
cagacagauucca

SEQ ID NO: 1993705 - RNA, 23 nt, Homo sapiens
aauguugcaacacauucauuugg

SEQ ID NO: 1993706 - RNA, 23 nt, Homo sapiens
ugguaaacaguuuggaaaagugg

SEQ ID NO: 1993707 - RNA, 22 nt, Homo sapiens
cccugagauacuucccaaagcc

SEQ ID NO: 1993708 - RNA, 14 nt, Homo sapiens
agaaauaaccacug

SEQ ID NO: 1993709 - RNA, 20 nt, Homo sapiens
cauggcagaagucaacgccu

SEQ ID NO: 1993710 - RNA, 19 nt, Homo sapiens
aucugguauaugucauuau

SEQ ID NO: 1993711 - RNA, 22 nt, Homo sapiens
cucuccaccccauuuuacagag

SEQ ID NO: 1993712 - RNA, 18 nt, Homo sapiens
ucaccuguuugaaaccaa

SEQ ID NO: 1993713 - RNA, 22 nt, Homo sapiens
ugaaagggaccuucgugcaacu

SEQ ID NO: 1993714 - RNA, 15 nt, Homo sapiens
aaguguucauugcac

SEQ ID NO: 1993715 - RNA, 15 nt, Homo sapiens
gaauaaauuugccca

SEQ ID NO: 1993716 - RNA, 15 nt, Homo sapiens
acauccgacaccucc

SEQ ID NO: 1993717 - RNA, 13 nt, Homo sapiens
agaaaagcccauu

SEQ ID NO: 1993718 - RNA, 22 nt, Homo sapiens
uaugacagugaagcagcacugu

SEQ ID NO: 1993719 - RNA, 22 nt, Homo sapiens
aucugcagcguugcuuggugca

SEQ ID NO: 1993720 - RNA, 16 nt, Homo sapiens
gagaguggcuccuccc

SEQ ID NO: 1993721 - RNA, 20 nt, Homo sapiens
caagaacagaaaacaagaag

SEQ ID NO: 1993722 - RNA, 21 nt, Homo sapiens
augcuuuccauauugugauaa

SEQ ID NO: 1993723 - RNA, 20 nt, Homo sapiens
cagcacacgaguuccagacc

SEQ ID NO: 1993724 - RNA, 19 nt, Homo sapiens
cuuuguuaccauacugucu

SEQ ID NO: 1993725 - RNA, 14 nt, Homo sapiens
uaaugugacuugga

SEQ ID NO: 1993726 - RNA, 19 nt, Homo sapiens
agaugaaauuccauuugua

SEQ ID NO: 1993727 - RNA, 22 nt, Homo sapiens
guacucacauauaacaugcaaa

SEQ ID NO: 1993728 - RNA, 16 nt, Homo sapiens
ugaaagaggccaaaca

SEQ ID NO: 1993729 - RNA, 12 nt, Homo sapiens
ccucucccaguu

SEQ ID NO: 1993730 - RNA, 16 nt, Homo sapiens
ggaguggaucuauuua

SEQ ID NO: 1993731 - RNA, 14 nt, Homo sapiens
uggaucaaguauua

SEQ ID NO: 1993732 - RNA, 14 nt, Homo sapiens
aauuuccugauaca

SEQ ID NO: 1993733 - RNA, 17 nt, Homo sapiens
gagaauauguaauacuu

SEQ ID NO: 1993734 - RNA, 18 nt, Homo sapiens
agaacaagcaaugaugac

SEQ ID NO: 1993735 - RNA, 18 nt, Homo sapiens
aaaaacucuuauggccaa

SEQ ID NO: 1993736 - RNA, 14 nt, Homo sapiens
ugugacacauaugc

SEQ ID NO: 1993737 - RNA, 14 nt, Homo sapiens
aaaagcaugcauau

SEQ ID NO: 1993738 - RNA, 16 nt, Homo sapiens
ugcaacuacuauucaa

SEQ ID NO: 1993739 - RNA, 17 nt, Homo sapiens
ccaaggugcacauuuuc

SEQ ID NO: 1993740 - RNA, 18 nt, Homo sapiens
ugcugggauuacaggcau

SEQ ID NO: 1993741 - RNA, 21 nt, Homo sapiens
caauagguuuguaaaaugcac

SEQ ID NO: 1993742 - RNA, 19 nt, Homo sapiens
cagcaaaagaaacuaucaa

SEQ ID NO: 1993743 - RNA, 18 nt, Homo sapiens
auccccugugcccugcac

SEQ ID NO: 1993744 - RNA, 21 nt, Homo sapiens
uucuaggcacuguaguucuaa

SEQ ID NO: 1993745 - RNA, 11 nt, Homo sapiens
aagaagacugg

SEQ ID NO: 1993746 - RNA, 15 nt, Homo sapiens
uuuccugcggcauca

SEQ ID NO: 1993747 - RNA, 20 nt, Homo sapiens
acaaacaugcaguacuuuug

SEQ ID NO: 1993748 - RNA, 14 nt, Homo sapiens
acacugagauccag

SEQ ID NO: 1993749 - RNA, 18 nt, Homo sapiens
aaaaugcgagacucugau

SEQ ID NO: 1993750 - RNA, 18 nt, Homo sapiens
gcuuucacauuguacuua

SEQ ID NO: 1993751 - RNA, 14 nt, Homo sapiens
aagggcuggcugca

SEQ ID NO: 1993752 - RNA, 18 nt, Homo sapiens
aguuguaauaagucuucc

SEQ ID NO: 1993753 - RNA, 18 nt, Homo sapiens
uagcaccuuaucuaugau

SEQ ID NO: 1993754 - RNA, 19 nt, Homo sapiens
aggaauguguucaccaucc

SEQ ID NO: 1993755 - RNA, 14 nt, Homo sapiens
uuguucauugcuag

SEQ ID NO: 1993756 - RNA, 14 nt, Homo sapiens
gcccugcccgggga

SEQ ID NO: 1993757 - RNA, 14 nt, Homo sapiens
acuaaccaaugccu

SEQ ID NO: 1993758 - RNA, 14 nt, Homo sapiens
acccugccauggaa

SEQ ID NO: 1993759 - RNA, 23 nt, Homo sapiens
cacucuggaaaugcaaauagaau

SEQ ID NO: 1993760 - RNA, 20 nt, Homo sapiens
uuaaucacaggaucccacga

SEQ ID NO: 1993761 - RNA, 20 nt, Homo sapiens
gcccuaaaaauccagacucu

SEQ ID NO: 1993762 - RNA, 21 nt, Homo sapiens
augaaacaaucuuccaaagaa

SEQ ID NO: 1993763 - RNA, 15 nt, Homo sapiens
auaaagcauuuugca

SEQ ID NO: 1993764 - RNA, 21 nt, Homo sapiens
auauuauuauuaauuuugcca

SEQ ID NO: 1993765 - RNA, 16 nt, Homo sapiens
agacaccugccuuaac

SEQ ID NO: 1993766 - RNA, 15 nt, Homo sapiens
cuacaguuguaauaa

SEQ ID NO: 1993767 - RNA, 20 nt, Homo sapiens
ccgccaccgugcccggcuaa

SEQ ID NO: 1993768 - RNA, 15 nt, Homo sapiens
aaauguacacuuuuu

SEQ ID NO: 1993769 - RNA, 15 nt, Homo sapiens
cugggacuucugggu

SEQ ID NO: 1993770 - RNA, 17 nt, Homo sapiens
ccugcucccuagccaga

SEQ ID NO: 1993771 - RNA, 15 nt, Homo sapiens
auuucaaauaacugc

SEQ ID NO: 1993772 - RNA, 17 nt, Homo sapiens
ucccucauucugcauua

SEQ ID NO: 1993773 - RNA, 13 nt, Homo sapiens
ugugaauugccag

SEQ ID NO: 1993774 - RNA, 14 nt, Homo sapiens
agcucagccagugg

SEQ ID NO: 1993775 - RNA, 21 nt, Homo sapiens
guacugguuuauguggacaag

SEQ ID NO: 1993776 - RNA, 17 nt, Homo sapiens
cgccuagguuguguuga

SEQ ID NO: 1993777 - RNA, 16 nt, Homo sapiens
gugaaacaggucuuug

SEQ ID NO: 1993778 - RNA, 23 nt, Homo sapiens
ggucagagagaccucauccugcu

SEQ ID NO: 1993779 - RNA, 22 nt, Homo sapiens
ugaagugcuacagaaagcacaa

SEQ ID NO: 1993780 - RNA, 22 nt, Homo sapiens
augcugaaaaauauagccuuua

SEQ ID NO: 1993781 - RNA, 13 nt, Homo sapiens
gcugauauuuaaa

SEQ ID NO: 1993782 - RNA, 20 nt, Homo sapiens
uucccaaggcagcuggauug

SEQ ID NO: 1993783 - RNA, 15 nt, Homo sapiens
aacauuuuucacuua

SEQ ID NO: 1993784 - RNA, 21 nt, Homo sapiens
ccaagccuacuuuugccauug

SEQ ID NO: 1993785 - RNA, 20 nt, Homo sapiens
cauugcucccagugccaaac

SEQ ID NO: 1993786 - RNA, 17 nt, Homo sapiens
ucuuuugccaaugucau

SEQ ID NO: 1993787 - RNA, 17 nt, Homo sapiens
ccuuaaggucuccaaac

SEQ ID NO: 1993788 - RNA, 15 nt, Homo sapiens
aucccagacuacuuc

SEQ ID NO: 1993789 - RNA, 20 nt, Homo sapiens
uccuuucuuuuaaugaugcc

SEQ ID NO: 1993790 - RNA, 19 nt, Homo sapiens
aaaaguacauguugauacu

SEQ ID NO: 1993791 - RNA, 12 nt, Homo sapiens
uuaaaucacuug

SEQ ID NO: 1993792 - RNA, 13 nt, Homo sapiens
cagcccagggugg

SEQ ID NO: 1993793 - RNA, 15 nt, Homo sapiens
gauucagucuugccu

SEQ ID NO: 1993794 - RNA, 16 nt, Homo sapiens
cccagccuacauucac

SEQ ID NO: 1993795 - RNA, 14 nt, Homo sapiens
uacaagcaaugccu

SEQ ID NO: 1993796 - RNA, 12 nt, Homo sapiens
auguugcuuaga

SEQ ID NO: 1993797 - RNA, 22 nt, Homo sapiens
cuucugacccaaagcaaaacau

SEQ ID NO: 1993798 - RNA, 22 nt, Homo sapiens
cagcagaugcuguugugaagcu

SEQ ID NO: 1993799 - RNA, 20 nt, Homo sapiens
cauucuguuuaucaagccau

SEQ ID NO: 1993800 - RNA, 15 nt, Homo sapiens
gaggcaauggcuccu

SEQ ID NO: 1993801 - RNA, 20 nt, Homo sapiens
ugccuuuuaccugagacuuu

SEQ ID NO: 1993802 - RNA, 22 nt, Homo sapiens
acuagccaggaaguacuuccac

SEQ ID NO: 1993803 - RNA, 18 nt, Homo sapiens
uggaauaguuuuguaucg

SEQ ID NO: 1993804 - RNA, 13 nt, Homo sapiens
cuuucaguauuag

SEQ ID NO: 1993805 - RNA, 19 nt, Homo sapiens
auaaaccauggccaauuca

SEQ ID NO: 1993806 - RNA, 23 nt, Homo sapiens
ucuucagggggccaggugcacag

SEQ ID NO: 1993807 - RNA, 17 nt, Homo sapiens
ucugggacuccugucua

SEQ ID NO: 1993808 - RNA, 15 nt, Homo sapiens
uccuuggauguaguc

SEQ ID NO: 1993809 - RNA, 23 nt, Homo sapiens
uugauguuaacugagcuacuaga

SEQ ID NO: 1993810 - RNA, 13 nt, Homo sapiens
uuggcaccagaca

SEQ ID NO: 1993811 - RNA, 23 nt, Homo sapiens
gagccucccccucagaugaucuc

SEQ ID NO: 1993812 - RNA, 16 nt, Homo sapiens
uccagccugggggaca

SEQ ID NO: 1993813 - RNA, 14 nt, Homo sapiens
aauagcuccucuac

SEQ ID NO: 1993814 - RNA, 13 nt, Homo sapiens
uucucaucauuau

SEQ ID NO: 1993815 - RNA, 15 nt, Homo sapiens
uuuaacagcugauaa

SEQ ID NO: 1993816 - RNA, 12 nt, Homo sapiens
ucuccucagguc

SEQ ID NO: 1993817 - RNA, 15 nt, Homo sapiens
cuuggcuugauggaa

SEQ ID NO: 1993818 - RNA, 18 nt, Homo sapiens
cuaagggugggugcucag

SEQ ID NO: 1993819 - RNA, 22 nt, Homo sapiens
aaaauauuucuaagcuuauuuc

SEQ ID NO: 1993820 - RNA, 13 nt, Homo sapiens
agcacuagaauau

SEQ ID NO: 1993821 - RNA, 18 nt, Homo sapiens
accuaaacuuacauuuaa

SEQ ID NO: 1993822 - RNA, 12 nt, Homo sapiens
ggauuacaggug

SEQ ID NO: 1993823 - RNA, 21 nt, Homo sapiens
guuucacuguacugcauguga

SEQ ID NO: 1993824 - RNA, 12 nt, Homo sapiens
uuuguacauuau

SEQ ID NO: 1993825 - RNA, 15 nt, Homo sapiens
aagcucccagcugac

SEQ ID NO: 1993826 - RNA, 22 nt, Homo sapiens
cucugcagacugcuaguguucu

SEQ ID NO: 1993827 - RNA, 14 nt, Homo sapiens
gggagucugaaaug

SEQ ID NO: 1993828 - RNA, 15 nt, Homo sapiens
acacuugcugaguga

SEQ ID NO: 1993829 - RNA, 14 nt, Homo sapiens
uggauuggccucca

SEQ ID NO: 1993830 - RNA, 12 nt, Homo sapiens
uucugagcaaac

SEQ ID NO: 1993831 - RNA, 14 nt, Homo sapiens
ugauaaacauuaaa

SEQ ID NO: 1993832 - RNA, 20 nt, Homo sapiens
cuagauaugaagaaucugcu

SEQ ID NO: 1993833 - RNA, 23 nt, Homo sapiens
cuggagcccgaggcaccaguguc

SEQ ID NO: 1993834 - RNA, 13 nt, Homo sapiens
cucacuacugaac

SEQ ID NO: 1993835 - RNA, 20 nt, Homo sapiens
cugcuaugacaaaaccuuua

SEQ ID NO: 1993836 - RNA, 21 nt, Homo sapiens
cacugugggggcugguccuga

SEQ ID NO: 1993837 - RNA, 11 nt, Homo sapiens
agguucaagac

SEQ ID NO: 1993838 - RNA, 15 nt, Homo sapiens
gaacugaaggcucag

SEQ ID NO: 1993839 - RNA, 14 nt, Homo sapiens
ucagagcuugaaca

SEQ ID NO: 1993840 - RNA, 17 nt, Homo sapiens
acaacauguauguggau

SEQ ID NO: 1993841 - RNA, 17 nt, Homo sapiens
cugaacccugccucuug

SEQ ID NO: 1993842 - RNA, 15 nt, Homo sapiens
gcgcaugugccaguu

SEQ ID NO: 1993843 - RNA, 11 nt, Homo sapiens
gucccuaccuc

SEQ ID NO: 1993844 - RNA, 22 nt, Homo sapiens
cuccacaucugccuuaaaacca

SEQ ID NO: 1993845 - RNA, 11 nt, Homo sapiens
gccccuacccc

SEQ ID NO: 1993846 - RNA, 12 nt, Homo sapiens
uauguagcaaug

SEQ ID NO: 1993847 - RNA, 15 nt, Homo sapiens
gccuuuaucucugag

SEQ ID NO: 1993848 - RNA, 14 nt, Homo sapiens
aagacauaucucua

SEQ ID NO: 1993849 - RNA, 18 nt, Homo sapiens
aguguucacaaacuguga

SEQ ID NO: 1993850 - RNA, 13 nt, Homo sapiens
uguaaaugcauau

SEQ ID NO: 1993851 - RNA, 14 nt, Homo sapiens
aaauaaaaacccaa

SEQ ID NO: 1993852 - RNA, 19 nt, Homo sapiens
guaauuuauauuccauuua

SEQ ID NO: 1993853 - RNA, 13 nt, Homo sapiens
caccuaugugcca

SEQ ID NO: 1993854 - RNA, 15 nt, Homo sapiens
cugagagacagaauu

SEQ ID NO: 1993855 - RNA, 23 nt, Homo sapiens
auuaaguaaaagucuguaaauau

SEQ ID NO: 1993856 - RNA, 18 nt, Homo sapiens
agugacugcaagcauuuu

SEQ ID NO: 1993857 - RNA, 21 nt, Homo sapiens
aggaggccguugauucacuuc

SEQ ID NO: 1993858 - RNA, 18 nt, Homo sapiens
aaaauuggagaacugcug

SEQ ID NO: 1993859 - RNA, 15 nt, Homo sapiens
auauuguuauauaca

SEQ ID NO: 1993860 - RNA, 15 nt, Homo sapiens
ucacacacacagcug

SEQ ID NO: 1993861 - RNA, 17 nt, Homo sapiens
uaaagacaaagcauucu

SEQ ID NO: 1993862 - RNA, 15 nt, Homo sapiens
ugggccuccaugccc

SEQ ID NO: 1993863 - RNA, 19 nt, Homo sapiens
accugucuucaacagcucc

SEQ ID NO: 1993864 - RNA, 17 nt, Homo sapiens
gaacugugcaucaacca

SEQ ID NO: 1993865 - RNA, 23 nt, Homo sapiens
caauccauuuggcagaacugcug

SEQ ID NO: 1993866 - RNA, 16 nt, Homo sapiens
aucccuccuccagcca

SEQ ID NO: 1993867 - RNA, 15 nt, Homo sapiens
aagacucauugcuua

SEQ ID NO: 1993868 - RNA, 22 nt, Homo sapiens
agcuucucugcaguaaaacaca

SEQ ID NO: 1993869 - RNA, 16 nt, Homo sapiens
ggauuucauacuguaa

SEQ ID NO: 1993870 - RNA, 15 nt, Homo sapiens
agcccacacauggga

SEQ ID NO: 1993871 - RNA, 14 nt, Homo sapiens
agacaguucaagaa

SEQ ID NO: 1993872 - RNA, 19 nt, Homo sapiens
gacuggggucauuguguaa

SEQ ID NO: 1993873 - RNA, 20 nt, Homo sapiens
ugcccuagcccagacucuga

SEQ ID NO: 1993874 - RNA, 14 nt, Homo sapiens
uaucuuaacacuga

SEQ ID NO: 1993875 - RNA, 17 nt, Homo sapiens
gguaaaaacugcagugu

SEQ ID NO: 1993876 - RNA, 22 nt, Homo sapiens
uauuuagacacuacaacauaug

SEQ ID NO: 1993877 - RNA, 19 nt, Homo sapiens
ggucauagauguuuccuug

SEQ ID NO: 1993878 - RNA, 17 nt, Homo sapiens
ucacuuuuacuacccca

SEQ ID NO: 1993879 - RNA, 12 nt, Homo sapiens
uuguaugccuuu

SEQ ID NO: 1993880 - RNA, 12 nt, Homo sapiens
uagaaugccaua

SEQ ID NO: 1993881 - RNA, 17 nt, Homo sapiens
ugggaacuaauuucaag

SEQ ID NO: 1993882 - RNA, 16 nt, Homo sapiens
gcccuguuggcagcuc

SEQ ID NO: 1993883 - RNA, 19 nt, Homo sapiens
auacauggguagcuucuga

SEQ ID NO: 1993884 - RNA, 15 nt, Homo sapiens
uacuccaagacagag

SEQ ID NO: 1993885 - RNA, 21 nt, Homo sapiens
ucaguuacaguggcaguauug

SEQ ID NO: 1993886 - RNA, 14 nt, Homo sapiens
augaaaagcaauac

SEQ ID NO: 1993887 - RNA, 13 nt, Homo sapiens
aagaauuaacaga

SEQ ID NO: 1993888 - RNA, 17 nt, Homo sapiens
gaucacuuuaugucuca

SEQ ID NO: 1993889 - RNA, 19 nt, Homo sapiens
caguucugccuuaucuaaa

SEQ ID NO: 1993890 - RNA, 17 nt, Homo sapiens
gcuccaagcaguuugaa

SEQ ID NO: 1993891 - RNA, 18 nt, Homo sapiens
gcuauugaagaugcugcc

SEQ ID NO: 1993892 - RNA, 11 nt, Homo sapiens
cugcacaggga

SEQ ID NO: 1993893 - RNA, 18 nt, Homo sapiens
agaaaauguguaauucaa

SEQ ID NO: 1993894 - RNA, 15 nt, Homo sapiens
aaaauguauuuuucc

SEQ ID NO: 1993895 - RNA, 18 nt, Homo sapiens
agaguaaacuauucuaua

SEQ ID NO: 1993896 - RNA, 21 nt, Homo sapiens
aaaacggugcauccacgcaca

SEQ ID NO: 1993897 - RNA, 12 nt, Homo sapiens
aaaucaaagcag

SEQ ID NO: 1993898 - RNA, 21 nt, Homo sapiens
guaaggaguuuuuuugucaga

SEQ ID NO: 1993899 - RNA, 16 nt, Homo sapiens
uugagagcaacgucac

SEQ ID NO: 1993900 - RNA, 20 nt, Homo sapiens
cagaaguuaaaccaugugac

SEQ ID NO: 1993901 - RNA, 13 nt, Homo sapiens
acccagcaggcag

SEQ ID NO: 1993902 - RNA, 13 nt, Homo sapiens
cuacugcugugag

SEQ ID NO: 1993903 - RNA, 14 nt, Homo sapiens
aucaacucuaauag

SEQ ID NO: 1993904 - RNA, 19 nt, Homo sapiens
uaaaagcauuuuguaauaa

SEQ ID NO: 1993905 - RNA, 20 nt, Homo sapiens
caccacacugaccacacugu

SEQ ID NO: 1993906 - RNA, 20 nt, Homo sapiens
gaggucuccacugaggaugu

SEQ ID NO: 1993907 - RNA, 19 nt, Homo sapiens
gccgucgaguugaccuucu

SEQ ID NO: 1993908 - RNA, 19 nt, Homo sapiens
guguuacccaguaacucau

SEQ ID NO: 1993909 - RNA, 21 nt, Homo sapiens
gauggacuggccccugaccca

SEQ ID NO: 1993910 - RNA, 16 nt, Homo sapiens
cuguaaggcauuuuca

SEQ ID NO: 1993911 - RNA, 14 nt, Homo sapiens
cugaaguuagaaau

SEQ ID NO: 1993912 - RNA, 22 nt, Homo sapiens
caaccugaugccccuuccccaa

SEQ ID NO: 1993913 - RNA, 14 nt, Homo sapiens
uauaauaugucacc

SEQ ID NO: 1993914 - RNA, 22 nt, Homo sapiens
caacucuccccugaccugugag

SEQ ID NO: 1993915 - RNA, 15 nt, Homo sapiens
aagugcucaguauug

SEQ ID NO: 1993916 - RNA, 21 nt, Homo sapiens
gggaggccccagggggucuca

SEQ ID NO: 1993917 - RNA, 17 nt, Homo sapiens
cugccauccaugugcua

SEQ ID NO: 1993918 - RNA, 20 nt, Homo sapiens
cauguuaacuuuauuacaau

SEQ ID NO: 1993919 - RNA, 19 nt, Homo sapiens
agaaguacuuuauugcaac

SEQ ID NO: 1993920 - RNA, 14 nt, Homo sapiens
gggugacaucccag

SEQ ID NO: 1993921 - RNA, 15 nt, Homo sapiens
acuuggcaaggucau

SEQ ID NO: 1993922 - RNA, 23 nt, Homo sapiens
uuugcauuugcucuuucaucucu

SEQ ID NO: 1993923 - RNA, 17 nt, Homo sapiens
ccuagccuaauuuacca

SEQ ID NO: 1993924 - RNA, 23 nt, Homo sapiens
uccuccagggacagcaacuauca

SEQ ID NO: 1993925 - RNA, 22 nt, Homo sapiens
aguaaggcaauccuaagcaaaa

SEQ ID NO: 1993926 - RNA, 17 nt, Homo sapiens
aauucuuagaauaucua

SEQ ID NO: 1993927 - RNA, 12 nt, Homo sapiens
cucauuuacaac

SEQ ID NO: 1993928 - RNA, 22 nt, Homo sapiens
accaugaagaugccauugacaa

SEQ ID NO: 1993929 - RNA, 17 nt, Homo sapiens
uguagucucgaccuccc

SEQ ID NO: 1993930 - RNA, 15 nt, Homo sapiens
cugaggacucaaggg

SEQ ID NO: 1993931 - RNA, 16 nt, Homo sapiens
aggugccuggccaugu

SEQ ID NO: 1993932 - RNA, 20 nt, Homo sapiens
ccagucucuuguacagcguu

SEQ ID NO: 1993933 - RNA, 13 nt, Homo sapiens
gaaguaaccuuau

SEQ ID NO: 1993934 - RNA, 21 nt, Homo sapiens
ugcuguggguauucaccaccc

SEQ ID NO: 1993935 - RNA, 20 nt, Homo sapiens
aggguacuuuaagacauacu

SEQ ID NO: 1993936 - RNA, 18 nt, Homo sapiens
ucccgucuucuccaacac

SEQ ID NO: 1993937 - RNA, 17 nt, Homo sapiens
uacacacucagugacau

SEQ ID NO: 1993938 - RNA, 18 nt, Homo sapiens
acugacgaagaagcaacu

SEQ ID NO: 1993939 - RNA, 21 nt, Homo sapiens
augacaacccugugguuucca

SEQ ID NO: 1993940 - RNA, 16 nt, Homo sapiens
aauaauggaagccaaa

SEQ ID NO: 1993941 - RNA, 15 nt, Homo sapiens
gauguuucuugccuu

SEQ ID NO: 1993942 - RNA, 22 nt, Homo sapiens
acauuuaauacagcagugucau

SEQ ID NO: 1993943 - RNA, 16 nt, Homo sapiens
ucagugcucgagacac

SEQ ID NO: 1993944 - RNA, 11 nt, Homo sapiens
aaaucaaagau

SEQ ID NO: 1993945 - RNA, 22 nt, Homo sapiens
aacacuauccaaugaaugauca

SEQ ID NO: 1993946 - RNA, 14 nt, Homo sapiens
gccgaggaggcauu

SEQ ID NO: 1993947 - RNA, 15 nt, Homo sapiens
ggcugaccaggcccu

SEQ ID NO: 1993948 - RNA, 13 nt, Homo sapiens
cugaucuuacucu

SEQ ID NO: 1993949 - RNA, 16 nt, Homo sapiens
uuggacuugcauuccc

SEQ ID NO: 1993950 - RNA, 14 nt, Homo sapiens
ugagcaaaaccaaa

SEQ ID NO: 1993951 - RNA, 19 nt, Homo sapiens
cuucagggccaguccuccu

SEQ ID NO: 1993952 - RNA, 23 nt, Homo sapiens
cuaaggggcagcuccugaccaaa

SEQ ID NO: 1993953 - RNA, 14 nt, Homo sapiens
augcaaaugcucaa

SEQ ID NO: 1993954 - RNA, 18 nt, Homo sapiens
aaugucuauuuccaagaa

SEQ ID NO: 1993955 - RNA, 17 nt, Homo sapiens
aaugcccuucuccuuau

SEQ ID NO: 1993956 - RNA, 22 nt, Homo sapiens
acaucuaccuaaaggacuauua

SEQ ID NO: 1993957 - RNA, 20 nt, Homo sapiens
aagcccccacuucucuccag

SEQ ID NO: 1993958 - RNA, 22 nt, Homo sapiens
cugguccugggagccacuggga

SEQ ID NO: 1993959 - RNA, 17 nt, Homo sapiens
uguuuccaucaagggua

SEQ ID NO: 1993960 - RNA, 19 nt, Homo sapiens
cuaaauauccaaagacugu

SEQ ID NO: 1993961 - RNA, 14 nt, Homo sapiens
aaggugccacuuua

SEQ ID NO: 1993962 - RNA, 14 nt, Homo sapiens
gucuguguggugcc

SEQ ID NO: 1993963 - RNA, 14 nt, Homo sapiens
aggugccucagacu

SEQ ID NO: 1993964 - RNA, 15 nt, Homo sapiens
ugccuguagucucag

SEQ ID NO: 1993965 - RNA, 22 nt, Homo sapiens
uggagacacaacuauuuuucca

SEQ ID NO: 1993966 - RNA, 23 nt, Homo sapiens
caggugagaauuuucauugucaa

SEQ ID NO: 1993967 - RNA, 16 nt, Homo sapiens
gaaccauuucacccag

SEQ ID NO: 1993968 - RNA, 21 nt, Homo sapiens
aaucuuccgauggaugaaucu

SEQ ID NO: 1993969 - RNA, 16 nt, Homo sapiens
cccucucucaguguca

SEQ ID NO: 1993970 - RNA, 12 nt, Homo sapiens
ccuggacugagc

SEQ ID NO: 1993971 - RNA, 20 nt, Homo sapiens
ucggcauucacacacagccu

SEQ ID NO: 1993972 - RNA, 23 nt, Homo sapiens
aauuggcuacuaguuuaagcaaa

SEQ ID NO: 1993973 - RNA, 19 nt, Homo sapiens
gcuggagugcaguggcgca

SEQ ID NO: 1993974 - RNA, 19 nt, Homo sapiens
agaauugguggugagauau

SEQ ID NO: 1993975 - RNA, 15 nt, Homo sapiens
gggucugcaggugag

SEQ ID NO: 1993976 - RNA, 19 nt, Homo sapiens
aguguugcucagcuccuac

SEQ ID NO: 1993977 - RNA, 23 nt, Homo sapiens
aaacugcuuuauacacugucacg

SEQ ID NO: 1993978 - RNA, 20 nt, Homo sapiens
gcuacuaccuagggcacuuu

SEQ ID NO: 1993979 - RNA, 15 nt, Homo sapiens
aguguauguauacac

SEQ ID NO: 1993980 - RNA, 20 nt, Homo sapiens
aauguugauuucuaguuauu

SEQ ID NO: 1993981 - RNA, 23 nt, Homo sapiens
uauuaaauugggaaaacuccauc

SEQ ID NO: 1993982 - RNA, 18 nt, Homo sapiens
acgaaaguggaaauggag

SEQ ID NO: 1993983 - RNA, 15 nt, Homo sapiens
uguguguugauacug

SEQ ID NO: 1993984 - RNA, 13 nt, Homo sapiens
acagggcauucaa

SEQ ID NO: 1993985 - RNA, 16 nt, Homo sapiens
auccugcuagcuguag

SEQ ID NO: 1993986 - RNA, 17 nt, Homo sapiens
uaauaauuaugugccau

SEQ ID NO: 1993987 - RNA, 13 nt, Homo sapiens
aguucuaauuccc

SEQ ID NO: 1993988 - RNA, 14 nt, Homo sapiens
uauuuuuauacuga

SEQ ID NO: 1993989 - RNA, 18 nt, Homo sapiens
cuugaggcugcaaucaca

SEQ ID NO: 1993990 - RNA, 20 nt, Homo sapiens
uacuaaauuacaaaugcaau

SEQ ID NO: 1993991 - RNA, 18 nt, Homo sapiens
aacugacccuuccuucau

SEQ ID NO: 1993992 - RNA, 23 nt, Homo sapiens
caaaccuucugacuuugccaaaa

SEQ ID NO: 1993993 - RNA, 16 nt, Homo sapiens
aaagugcugggaugac

SEQ ID NO: 1993994 - RNA, 13 nt, Homo sapiens
ugcaauuguggac

SEQ ID NO: 1993995 - RNA, 23 nt, Homo sapiens
ccauguuggcuagacuagucuca

SEQ ID NO: 1993996 - RNA, 16 nt, Homo sapiens
ccacagccaccuccac

SEQ ID NO: 1993997 - RNA, 16 nt, Homo sapiens
caauaauuaccaauau

SEQ ID NO: 1993998 - RNA, 18 nt, Homo sapiens
agcgugagcugugggaga

SEQ ID NO: 1993999 - RNA, 17 nt, Homo sapiens
gaggccuggacuuuccu

SEQ ID NO: 1994000 - RNA, 16 nt, Homo sapiens
cauugggcuacuguag

SEQ ID NO: 1994001 - RNA, 23 nt, Homo sapiens
cagaaauugaccugauuuccauu

SEQ ID NO: 1994002 - RNA, 13 nt, Homo sapiens
auguuuuuacuga

SEQ ID NO: 1994003 - RNA, 17 nt, Homo sapiens
aagcaaacccaguguca

SEQ ID NO: 1994004 - RNA, 11 nt, Homo sapiens
uaaacugugua

SEQ ID NO: 1994005 - RNA, 13 nt, Homo sapiens
cacacacauggaa

SEQ ID NO: 1994006 - RNA, 21 nt, Homo sapiens
agccagaguuggauaagccaa

SEQ ID NO: 1994007 - RNA, 21 nt, Homo sapiens
cauuaaauggaauaauaugau

SEQ ID NO: 1994008 - RNA, 16 nt, Homo sapiens
auuuuacaagggcaua

SEQ ID NO: 1994009 - RNA, 20 nt, Homo sapiens
ucacauacccacacauucca

SEQ ID NO: 1994010 - RNA, 16 nt, Homo sapiens
gcgcagcugcauuugg

SEQ ID NO: 1994011 - RNA, 22 nt, Homo sapiens
cugcauucuuuuaaaguuuuau

SEQ ID NO: 1994012 - RNA, 18 nt, Homo sapiens
uuaaaaaaaaacauucaa

SEQ ID NO: 1994013 - RNA, 17 nt, Homo sapiens
cuguuuagguacugaag

SEQ ID NO: 1994014 - RNA, 15 nt, Homo sapiens
cauaucaaaacaucc

SEQ ID NO: 1994015 - RNA, 15 nt, Homo sapiens
acccuccaccucuca

SEQ ID NO: 1994016 - RNA, 14 nt, Homo sapiens
uuauuaacuuuaau

SEQ ID NO: 1994017 - RNA, 20 nt, Homo sapiens
auuuuuuuuacugugcauac

SEQ ID NO: 1994018 - RNA, 13 nt, Homo sapiens
gaagaagcaguuu

SEQ ID NO: 1994019 - RNA, 20 nt, Homo sapiens
ugccauuccacagccccuuc

SEQ ID NO: 1994020 - RNA, 23 nt, Homo sapiens
aggccuggccagaugcaccagcc

SEQ ID NO: 1994021 - RNA, 15 nt, Homo sapiens
cucccaaagugcagg

SEQ ID NO: 1994022 - RNA, 17 nt, Homo sapiens
uguccaacaacuccagg

SEQ ID NO: 1994023 - RNA, 23 nt, Homo sapiens
uaguggcaaaaaagaacaguguu

SEQ ID NO: 1994024 - RNA, 21 nt, Homo sapiens
ccugcuaccaaggcccagcua

SEQ ID NO: 1994025 - RNA, 17 nt, Homo sapiens
ccaagugugugugcaau

SEQ ID NO: 1994026 - RNA, 17 nt, Homo sapiens
gcaacagacaagugacu

SEQ ID NO: 1994027 - RNA, 20 nt, Homo sapiens
guauggaaaaaccauuugaa

SEQ ID NO: 1994028 - RNA, 11 nt, Homo sapiens
caaauguucuc

SEQ ID NO: 1994029 - RNA, 19 nt, Homo sapiens
uuauacaaaccuaccaaaa

SEQ ID NO: 1994030 - RNA, 20 nt, Homo sapiens
guggugacaggcccagugga

SEQ ID NO: 1994031 - RNA, 19 nt, Homo sapiens
cuucaucuucacugcaauu

SEQ ID NO: 1994032 - RNA, 22 nt, Homo sapiens
acaguuaccucugccucagaaa

SEQ ID NO: 1994033 - RNA, 16 nt, Homo sapiens
auagaauuuccaauau

SEQ ID NO: 1994034 - RNA, 21 nt, Homo sapiens
ucagucuguucacugcauuca

SEQ ID NO: 1994035 - RNA, 20 nt, Homo sapiens
auuaaagucuacacugccuu

SEQ ID NO: 1994036 - RNA, 13 nt, Homo sapiens
caaacucuucagu

SEQ ID NO: 1994037 - RNA, 14 nt, Homo sapiens
cauuacuacuguac

SEQ ID NO: 1994038 - RNA, 13 nt, Homo sapiens
guuuuccaaagag

SEQ ID NO: 1994039 - RNA, 21 nt, Homo sapiens
auucugggcuccuggaaccaa

SEQ ID NO: 1994040 - RNA, 24 nt, Homo sapiens
uccucuguaccuagaauagucuca

SEQ ID NO: 1994041 - RNA, 14 nt, Homo sapiens
gcuucucuccucag

SEQ ID NO: 1994042 - RNA, 14 nt, Homo sapiens
cuggaauacaugaa

SEQ ID NO: 1994043 - RNA, 17 nt, Homo sapiens
gaaagcauggcugagaa

SEQ ID NO: 1994044 - RNA, 14 nt, Homo sapiens
aacacagcugauga

SEQ ID NO: 1994045 - RNA, 20 nt, Homo sapiens
cagcucugaggacugcacca

SEQ ID NO: 1994046 - RNA, 13 nt, Homo sapiens
ucaaaaaguucca

SEQ ID NO: 1994047 - RNA, 17 nt, Homo sapiens
aggccucaccauuccaa

SEQ ID NO: 1994048 - RNA, 15 nt, Homo sapiens
cuuccucugcagaau

SEQ ID NO: 1994049 - RNA, 20 nt, Homo sapiens
augaaccugcccugcuccca

SEQ ID NO: 1994050 - RNA, 23 nt, Homo sapiens
aguauucugaucaguugccaaag

SEQ ID NO: 1994051 - RNA, 17 nt, Homo sapiens
ccucaggguucccuuga

SEQ ID NO: 1994052 - RNA, 23 nt, Homo sapiens
agauuuucauguucuugcaguca

SEQ ID NO: 1994053 - RNA, 16 nt, Homo sapiens
aagaauuaugcaucug

SEQ ID NO: 1994054 - RNA, 14 nt, Homo sapiens
aagggucacaauac

SEQ ID NO: 1994055 - RNA, 21 nt, Homo sapiens
gucugagguccugagcacugc

SEQ ID NO: 1994056 - RNA, 17 nt, Homo sapiens
uguauuuugugaugaau

SEQ ID NO: 1994057 - RNA, 21 nt, Homo sapiens
ccuuguccccaacguuccaca

SEQ ID NO: 1994058 - RNA, 22 nt, Homo sapiens
cuggaguugaucuggaacccag

SEQ ID NO: 1994059 - RNA, 19 nt, Homo sapiens
gguguacacuaacauuucc

SEQ ID NO: 1994060 - RNA, 22 nt, Homo sapiens
aucagaggucuauuuuuaccua

SEQ ID NO: 1994061 - RNA, 21 nt, Homo sapiens
gugaacauugguucuuucauu

SEQ ID NO: 1994062 - RNA, 14 nt, Homo sapiens
gaaaaacaaaaagg

SEQ ID NO: 1994063 - RNA, 23 nt, Homo sapiens
ucuuaucuuuuggcuucugcaga

SEQ ID NO: 1994064 - RNA, 16 nt, Homo sapiens
uggagucugugucugc

SEQ ID NO: 1994065 - RNA, 22 nt, Homo sapiens
agcucauagugaacacagcaga

SEQ ID NO: 1994066 - RNA, 15 nt, Homo sapiens
uuuugcacaaggaaa

SEQ ID NO: 1994067 - RNA, 14 nt, Homo sapiens
uucuuaaccaucuu

SEQ ID NO: 1994068 - RNA, 22 nt, Homo sapiens
caugagugauucuugacauuca

SEQ ID NO: 1994069 - RNA, 19 nt, Homo sapiens
cagcauuuuagaaacuaca

SEQ ID NO: 1994070 - RNA, 18 nt, Homo sapiens
agcuaaacggauuccaaa

SEQ ID NO: 1994071 - RNA, 14 nt, Homo sapiens
gaauugaugaugca

SEQ ID NO: 1994072 - RNA, 17 nt, Homo sapiens
gguucaaaccugugaag

SEQ ID NO: 1994073 - RNA, 15 nt, Homo sapiens
aacuuagauguuaaa

SEQ ID NO: 1994074 - RNA, 22 nt, Homo sapiens
accaguaucgcucauagaucag

SEQ ID NO: 1994075 - RNA, 14 nt, Homo sapiens
aauugaacuacuug

SEQ ID NO: 1994076 - RNA, 23 nt, Homo sapiens
ucuacuuuguugcuauggcuuua

SEQ ID NO: 1994077 - RNA, 22 nt, Homo sapiens
ugcacaguuugcaaucuuaugu

SEQ ID NO: 1994078 - RNA, 14 nt, Homo sapiens
cugaguggaucucc

SEQ ID NO: 1994079 - RNA, 14 nt, Homo sapiens
cuauacuaccaaaa

SEQ ID NO: 1994080 - RNA, 14 nt, Homo sapiens
gcugagaccagggu

SEQ ID NO: 1994081 - RNA, 14 nt, Homo sapiens
uauuuaacaacugg

SEQ ID NO: 1994082 - RNA, 19 nt, Homo sapiens
uuuaggaccaauaccuccu

SEQ ID NO: 1994083 - RNA, 14 nt, Homo sapiens
ccugucucuacuaa

SEQ ID NO: 1994084 - RNA, 18 nt, Homo sapiens
uuccaaaugccauccaga

SEQ ID NO: 1994085 - RNA, 20 nt, Homo sapiens
cucaaauaaaaagugcuuuu

SEQ ID NO: 1994086 - RNA, 16 nt, Homo sapiens
auaauuauaauguugc

SEQ ID NO: 1994087 - RNA, 16 nt, Homo sapiens
cugcuccucccauucc

SEQ ID NO: 1994088 - RNA, 15 nt, Homo sapiens
uacuguauuguuaca

SEQ ID NO: 1994089 - RNA, 16 nt, Homo sapiens
ggaagggggcugugug

SEQ ID NO: 1994090 - RNA, 12 nt, Homo sapiens
gucaaaccaaga

SEQ ID NO: 1994091 - RNA, 19 nt, Homo sapiens
uaacauaaacuuguacuua

SEQ ID NO: 1994092 - RNA, 13 nt, Homo sapiens
ucaggugugacuc

SEQ ID NO: 1994093 - RNA, 16 nt, Homo sapiens
uguguagcucugucca

SEQ ID NO: 1994094 - RNA, 18 nt, Homo sapiens
ugagcgacuuaaaaugau

SEQ ID NO: 1994095 - RNA, 18 nt, Homo sapiens
guuuuaucuccugugauc

SEQ ID NO: 1994096 - RNA, 14 nt, Homo sapiens
aaugacauguguca

SEQ ID NO: 1994097 - RNA, 14 nt, Homo sapiens
agcauguacuguac

SEQ ID NO: 1994098 - RNA, 17 nt, Homo sapiens
ccagaggccaacacugu

SEQ ID NO: 1994099 - RNA, 22 nt, Homo sapiens
cuguugaauuauguuuugacac

SEQ ID NO: 1994100 - RNA, 23 nt, Homo sapiens
gaaaagcugaugaggcuggugac

SEQ ID NO: 1994101 - RNA, 21 nt, Homo sapiens
aauaugguguacauucuuccu

SEQ ID NO: 1994102 - RNA, 13 nt, Homo sapiens
acuaagccuuuga

SEQ ID NO: 1994103 - RNA, 15 nt, Homo sapiens
guuauacaaccauca

SEQ ID NO: 1994104 - RNA, 14 nt, Homo sapiens
agcugggagacccu

SEQ ID NO: 1994105 - RNA, 17 nt, Homo sapiens
cugauggguucaugucu

SEQ ID NO: 1994106 - RNA, 21 nt, Homo sapiens
ccgcaaauauccuccacuuuc

SEQ ID NO: 1994107 - RNA, 13 nt, Homo sapiens
uuggcuucagggg

SEQ ID NO: 1994108 - RNA, 19 nt, Homo sapiens
ggagaagggacaaaaggua

SEQ ID NO: 1994109 - RNA, 21 nt, Homo sapiens
caccccuuuccuccccauaca

SEQ ID NO: 1994110 - RNA, 14 nt, Homo sapiens
acaccauaugcaag

SEQ ID NO: 1994111 - RNA, 24 nt, Homo sapiens
ucuacaaaaaaccaggaugcccac

SEQ ID NO: 1994112 - RNA, 18 nt, Homo sapiens
uuuguaaauuauugauga

SEQ ID NO: 1994113 - RNA, 15 nt, Homo sapiens
uauauuacuagcaua

SEQ ID NO: 1994114 - RNA, 14 nt, Homo sapiens
augaaucauauuca

SEQ ID NO: 1994115 - RNA, 21 nt, Homo sapiens
gagcccccaccugccugacca

SEQ ID NO: 1994116 - RNA, 20 nt, Homo sapiens
uuccuaauaagugaagggaa

SEQ ID NO: 1994117 - RNA, 16 nt, Homo sapiens
ucuugugaacugucuu

SEQ ID NO: 1994118 - RNA, 12 nt, Homo sapiens
aagaaucacuug

SEQ ID NO: 1994119 - RNA, 16 nt, Homo sapiens
uacuugaaaaaguaaa

SEQ ID NO: 1994120 - RNA, 21 nt, Homo sapiens
aauuaucuaaaguaugaagca

SEQ ID NO: 1994121 - RNA, 14 nt, Homo sapiens
aauggccagugaga

SEQ ID NO: 1994122 - RNA, 10 nt, Homo sapiens
cucucuccag

SEQ ID NO: 1994123 - RNA, 11 nt, Homo sapiens
ugaagugaauu

SEQ ID NO: 1994124 - RNA, 17 nt, Homo sapiens
ccaagacuccugcaaaa

SEQ ID NO: 1994125 - RNA, 20 nt, Homo sapiens
ugugaugucuuuucuuggca

SEQ ID NO: 1994126 - RNA, 18 nt, Homo sapiens
cccugguuuucagucuug

SEQ ID NO: 1994127 - RNA, 17 nt, Homo sapiens
augccaagacaugauua

SEQ ID NO: 1994128 - RNA, 21 nt, Homo sapiens
uaaacagcucuaacacggcca

SEQ ID NO: 1994129 - RNA, 20 nt, Homo sapiens
uuugugauucaaaauguacu

SEQ ID NO: 1994130 - RNA, 22 nt, Homo sapiens
cauauuggcaguuggaggacac

SEQ ID NO: 1994131 - RNA, 21 nt, Homo sapiens
cauaacaccgucccagggcuc

SEQ ID NO: 1994132 - RNA, 22 nt, Homo sapiens
agcuguauaaacagaacuccac

SEQ ID NO: 1994133 - RNA, 21 nt, Homo sapiens
uaaauacuugcaguugugaua

SEQ ID NO: 1994134 - RNA, 16 nt, Homo sapiens
acaaaccaagccaugc

SEQ ID NO: 1994135 - RNA, 23 nt, Homo sapiens
agugggguggugucagacccugg

SEQ ID NO: 1994136 - RNA, 22 nt, Homo sapiens
cucuggcucucaugggguccaa

SEQ ID NO: 1994137 - RNA, 14 nt, Homo sapiens
aaagugacccugcu

SEQ ID NO: 1994138 - RNA, 17 nt, Homo sapiens
uucucacacuagccuua

SEQ ID NO: 1994139 - RNA, 22 nt, Homo sapiens
cuguauaggaaugagauuaauu

SEQ ID NO: 1994140 - RNA, 19 nt, Homo sapiens
caggaugcccacauacugu

SEQ ID NO: 1994141 - RNA, 17 nt, Homo sapiens
auucagaaagcauuuau

SEQ ID NO: 1994142 - RNA, 14 nt, Homo sapiens
aacuaguaauacug

SEQ ID NO: 1994143 - RNA, 22 nt, Homo sapiens
cagaaagggccuugaauccugg

SEQ ID NO: 1994144 - RNA, 21 nt, Homo sapiens
auaugauggggcaugugccau

SEQ ID NO: 1994145 - RNA, 20 nt, Homo sapiens
uggaagccaggacugugaua

SEQ ID NO: 1994146 - RNA, 19 nt, Homo sapiens
ucuguaaguuucugugacc

SEQ ID NO: 1994147 - RNA, 20 nt, Homo sapiens
ccuaauacugucauccucaa

SEQ ID NO: 1994148 - RNA, 14 nt, Homo sapiens
uacuugaaccuggg

SEQ ID NO: 1994149 - RNA, 19 nt, Homo sapiens
agccucacuuggucugcca

SEQ ID NO: 1994150 - RNA, 18 nt, Homo sapiens
auaccucaaaaggcccua

SEQ ID NO: 1994151 - RNA, 13 nt, Homo sapiens
ccaaagccaguga

SEQ ID NO: 1994152 - RNA, 21 nt, Homo sapiens
acacugguuugagcuuaguga

SEQ ID NO: 1994153 - RNA, 17 nt, Homo sapiens
uagcaagacacaucccu

SEQ ID NO: 1994154 - RNA, 17 nt, Homo sapiens
cuucaauuuauuacuga

SEQ ID NO: 1994155 - RNA, 23 nt, Homo sapiens
aggacaaguuacaccuccacuca

SEQ ID NO: 1994156 - RNA, 18 nt, Homo sapiens
acuuaguaguuuuuacaa

SEQ ID NO: 1994157 - RNA, 23 nt, Homo sapiens
uccuagugggccauuaaaaacua

SEQ ID NO: 1994158 - RNA, 17 nt, Homo sapiens
gaauaaacgugcucccc

SEQ ID NO: 1994159 - RNA, 22 nt, Homo sapiens
auuuugugcaguuaauacuuaa

SEQ ID NO: 1994160 - RNA, 21 nt, Homo sapiens
gcucuauacuguggccugcag

SEQ ID NO: 1994161 - RNA, 15 nt, Homo sapiens
auucauguggaauau

SEQ ID NO: 1994162 - RNA, 15 nt, Homo sapiens
agacaacuucccaaa

SEQ ID NO: 1994163 - RNA, 16 nt, Homo sapiens
cccuccacaccagugg

SEQ ID NO: 1994164 - RNA, 14 nt, Homo sapiens
auaaguacuacaua

SEQ ID NO: 1994165 - RNA, 21 nt, Homo sapiens
gcuuaaaaaaauuacugugaa

SEQ ID NO: 1994166 - RNA, 12 nt, Homo sapiens
agaggcuuccaa

SEQ ID NO: 1994167 - RNA, 17 nt, Homo sapiens
acaugcuuuagccauac

SEQ ID NO: 1994168 - RNA, 14 nt, Homo sapiens
aacuguacauuuca

SEQ ID NO: 1994169 - RNA, 13 nt, Homo sapiens
ucuggugccauuu

SEQ ID NO: 1994170 - RNA, 21 nt, Homo sapiens
agucuggcaaacaugugcaac

SEQ ID NO: 1994171 - RNA, 15 nt, Homo sapiens
agugguugcauucua

SEQ ID NO: 1994172 - RNA, 15 nt, Homo sapiens
ccaucaccgcugggu

SEQ ID NO: 1994173 - RNA, 21 nt, Homo sapiens
aaaaccuugaaaccuuugaca

SEQ ID NO: 1994174 - RNA, 19 nt, Homo sapiens
cuggggccuguacugccug

SEQ ID NO: 1994175 - RNA, 13 nt, Homo sapiens
cacacacaugcac

SEQ ID NO: 1994176 - RNA, 22 nt, Homo sapiens
gcucuccaagcacuagccuucc

SEQ ID NO: 1994177 - RNA, 20 nt, Homo sapiens
gaaaauuauuuuguucauac

SEQ ID NO: 1994178 - RNA, 19 nt, Homo sapiens
agcucccaggacgcaggga

SEQ ID NO: 1994179 - RNA, 17 nt, Homo sapiens
ccuucuguccugguguc

SEQ ID NO: 1994180 - RNA, 13 nt, Homo sapiens
augagcuuccuuc

SEQ ID NO: 1994181 - RNA, 18 nt, Homo sapiens
caauaaacagucacugga

SEQ ID NO: 1994182 - RNA, 14 nt, Homo sapiens
agaagggcugagcc

SEQ ID NO: 1994183 - RNA, 14 nt, Homo sapiens
ccugugacagcagc

SEQ ID NO: 1994184 - RNA, 21 nt, Homo sapiens
gaacuaaguuuuuuacuucca

SEQ ID NO: 1994185 - RNA, 15 nt, Homo sapiens
uguaaacacauguuc

SEQ ID NO: 1994186 - RNA, 13 nt, Homo sapiens
cuguuucaagcca

SEQ ID NO: 1994187 - RNA, 17 nt, Homo sapiens
uaucaaggaagucuuca

SEQ ID NO: 1994188 - RNA, 22 nt, Homo sapiens
ccacaaacuguaauacaaugau

SEQ ID NO: 1994189 - RNA, 16 nt, Homo sapiens
gugguaugucugccau

SEQ ID NO: 1994190 - RNA, 23 nt, Homo sapiens
agcccuggcaaaugccugacuca

SEQ ID NO: 1994191 - RNA, 14 nt, Homo sapiens
ugggcagguaguuu

SEQ ID NO: 1994192 - RNA, 20 nt, Homo sapiens
acuucugacagccucaguga

SEQ ID NO: 1994193 - RNA, 14 nt, Homo sapiens
cucagccugaucag

SEQ ID NO: 1994194 - RNA, 21 nt, Homo sapiens
ucagccuccccccgcugggga

SEQ ID NO: 1994195 - RNA, 20 nt, Homo sapiens
cuauuucauuuuuugcauca

SEQ ID NO: 1994196 - RNA, 20 nt, Homo sapiens
cuugguaagaugacucugag

SEQ ID NO: 1994197 - RNA, 13 nt, Homo sapiens
auggccacuguga

SEQ ID NO: 1994198 - RNA, 17 nt, Homo sapiens
cagaguuuacauucuaa

SEQ ID NO: 1994199 - RNA, 13 nt, Homo sapiens
cguuuuaugauuu

SEQ ID NO: 1994200 - RNA, 16 nt, Homo sapiens
aguguuuucaccucau

SEQ ID NO: 1994201 - RNA, 13 nt, Homo sapiens
auugcacaaguuc

SEQ ID NO: 1994202 - RNA, 12 nt, Homo sapiens
gucagcauguac

SEQ ID NO: 1994203 - RNA, 20 nt, Homo sapiens
ucucaugagcuguguucaca

SEQ ID NO: 1994204 - RNA, 13 nt, Homo sapiens
gcaaucaaaggca

SEQ ID NO: 1994205 - RNA, 14 nt, Homo sapiens
ggacaagacacuga

SEQ ID NO: 1994206 - RNA, 21 nt, Homo sapiens
guucuccagucauuauguuaa

SEQ ID NO: 1994207 - RNA, 20 nt, Homo sapiens
ugcauucucuauagagccaa

SEQ ID NO: 1994208 - RNA, 12 nt, Homo sapiens
aaaaaaauggaa

SEQ ID NO: 1994209 - RNA, 20 nt, Homo sapiens
cagggcagaggagagcagcu

SEQ ID NO: 1994210 - RNA, 19 nt, Homo sapiens
gagaaugugagaagccagc

SEQ ID NO: 1994211 - RNA, 22 nt, Homo sapiens
accucgggaaacuuagaucauc

SEQ ID NO: 1994212 - RNA, 17 nt, Homo sapiens
caugagaccuugcuaag

SEQ ID NO: 1994213 - RNA, 14 nt, Homo sapiens
aaagcagauacuug

SEQ ID NO: 1994214 - RNA, 15 nt, Homo sapiens
gaaaaggccauuaaa

SEQ ID NO: 1994215 - RNA, 17 nt, Homo sapiens
augccugguaccagagg

SEQ ID NO: 1994216 - RNA, 16 nt, Homo sapiens
gacagucagcauuucu

SEQ ID NO: 1994217 - RNA, 20 nt, Homo sapiens
ugauuagccucgucuuucag

SEQ ID NO: 1994218 - RNA, 12 nt, Homo sapiens
augcaugaacaa

SEQ ID NO: 1994219 - RNA, 15 nt, Homo sapiens
augcuuuuagcucaa

SEQ ID NO: 1994220 - RNA, 11 nt, Homo sapiens
ucugggcuccu

SEQ ID NO: 1994221 - RNA, 16 nt, Homo sapiens
acaagagugaauuuga

SEQ ID NO: 1994222 - RNA, 20 nt, Homo sapiens
acuguuagucauuugcugag

SEQ ID NO: 1994223 - RNA, 15 nt, Homo sapiens
uacaggauauuccaa

SEQ ID NO: 1994224 - RNA, 21 nt, Homo sapiens
gacccucacaggagcaucucc

SEQ ID NO: 1994225 - RNA, 17 nt, Homo sapiens
gccguggacuggcucau

SEQ ID NO: 1994226 - RNA, 15 nt, Homo sapiens
agcccccagguugcc

SEQ ID NO: 1994227 - RNA, 14 nt, Homo sapiens
aaaacaaagccuua

SEQ ID NO: 1994228 - RNA, 17 nt, Homo sapiens
ccugagagucagggugg

SEQ ID NO: 1994229 - RNA, 17 nt, Homo sapiens
agccgauaucagaauuu

SEQ ID NO: 1994230 - RNA, 21 nt, Homo sapiens
auuuuaagaauuucacaagcu

SEQ ID NO: 1994231 - RNA, 18 nt, Homo sapiens
auauaaggaaagcaauaa

SEQ ID NO: 1994232 - RNA, 13 nt, Homo sapiens
guugaaaagccau

SEQ ID NO: 1994233 - RNA, 13 nt, Homo sapiens
auugaaaaaccau

SEQ ID NO: 1994234 - RNA, 18 nt, Homo sapiens
gccuuacuuaaacccagc

SEQ ID NO: 1994235 - RNA, 23 nt, Homo sapiens
accccaggacgccacucauuuca

SEQ ID NO: 1994236 - RNA, 13 nt, Homo sapiens
agccacuugacua

SEQ ID NO: 1994237 - RNA, 12 nt, Homo sapiens
gugcaauauucu

SEQ ID NO: 1994238 - RNA, 20 nt, Homo sapiens
cucauguugaagccacugcc

SEQ ID NO: 1994239 - RNA, 14 nt, Homo sapiens
gccaggcucugccu

SEQ ID NO: 1994240 - RNA, 14 nt, Homo sapiens
cggccccaucagag

SEQ ID NO: 1994241 - RNA, 23 nt, Homo sapiens
acucuuuaugauaacaacacugu

SEQ ID NO: 1994242 - RNA, 17 nt, Homo sapiens
agggagagggaaauaca

SEQ ID NO: 1994243 - RNA, 13 nt, Homo sapiens
aacugcauuuccu

SEQ ID NO: 1994244 - RNA, 19 nt, Homo sapiens
gacuuugccaaaaagcaua

SEQ ID NO: 1994245 - RNA, 15 nt, Homo sapiens
ugaguuaaauuauac

SEQ ID NO: 1994246 - RNA, 15 nt, Homo sapiens
acagaauucacuugu

SEQ ID NO: 1994247 - RNA, 14 nt, Homo sapiens
guauuuugaugaag

SEQ ID NO: 1994248 - RNA, 15 nt, Homo sapiens
acuggacaacacuga

SEQ ID NO: 1994249 - RNA, 17 nt, Homo sapiens
auuugacugugcaugac

SEQ ID NO: 1994250 - RNA, 17 nt, Homo sapiens
gccacucaccaacccag

SEQ ID NO: 1994251 - RNA, 23 nt, Homo sapiens
aacccuuuggauuaugcccauga

SEQ ID NO: 1994252 - RNA, 14 nt, Homo sapiens
uauccagccuccca

SEQ ID NO: 1994253 - RNA, 19 nt, Homo sapiens
agaaauuaacacccaaaag

SEQ ID NO: 1994254 - RNA, 21 nt, Homo sapiens
ccucuacuguugcacagccag

SEQ ID NO: 1994255 - RNA, 15 nt, Homo sapiens
ucacccuucugggca

SEQ ID NO: 1994256 - RNA, 15 nt, Homo sapiens
ugcuguaaacuugua

SEQ ID NO: 1994257 - RNA, 20 nt, Homo sapiens
gcuaugucucuagcagugag

SEQ ID NO: 1994258 - RNA, 14 nt, Homo sapiens
uaaaauaaaccaga

SEQ ID NO: 1994259 - RNA, 23 nt, Homo sapiens
aauuguuaguaaacauagguaua

SEQ ID NO: 1994260 - RNA, 12 nt, Homo sapiens
cacaauggguau

SEQ ID NO: 1994261 - RNA, 16 nt, Homo sapiens
ugagcagaagcuggag

SEQ ID NO: 1994262 - RNA, 19 nt, Homo sapiens
uucagagccaagccuuaaa

SEQ ID NO: 1994263 - RNA, 20 nt, Homo sapiens
cacauguguaagacacugug

SEQ ID NO: 1994264 - RNA, 22 nt, Homo sapiens
uccaaaagcacuuacggauucu

SEQ ID NO: 1994265 - RNA, 10 nt, Homo sapiens
uccuccucag

SEQ ID NO: 1994266 - RNA, 18 nt, Homo sapiens
aggacaaccauuccagac

SEQ ID NO: 1994267 - RNA, 15 nt, Homo sapiens
auguaaaugcaucug

SEQ ID NO: 1994268 - RNA, 20 nt, Homo sapiens
auaagauugacuuugaaucu

SEQ ID NO: 1994269 - RNA, 21 nt, Homo sapiens
gggaaggagggagcugcucag

SEQ ID NO: 1994270 - RNA, 20 nt, Homo sapiens
cccuuguaaugccacucaua

SEQ ID NO: 1994271 - RNA, 22 nt, Homo sapiens
gcaaucaugugcuucauagaaa

SEQ ID NO: 1994272 - RNA, 16 nt, Homo sapiens
uuuaugaauuauagua

SEQ ID NO: 1994273 - RNA, 16 nt, Homo sapiens
gcuuaaaugcaauauu

SEQ ID NO: 1994274 - RNA, 15 nt, Homo sapiens
gcaacuguaugaaaa

SEQ ID NO: 1994275 - RNA, 19 nt, Homo sapiens
ugauucaauaaaaugcacu

SEQ ID NO: 1994276 - RNA, 12 nt, Homo sapiens
accuucaaagcu

SEQ ID NO: 1994277 - RNA, 20 nt, Homo sapiens
gguuuuguuuuuuuucagcc

SEQ ID NO: 1994278 - RNA, 21 nt, Homo sapiens
cugcugagcgugaugaucuag

SEQ ID NO: 1994279 - RNA, 15 nt, Homo sapiens
gaugaguugagcucu

SEQ ID NO: 1994280 - RNA, 12 nt, Homo sapiens
agccaaccucau

SEQ ID NO: 1994281 - RNA, 21 nt, Homo sapiens
acuccaaaaggcccuuuucag

SEQ ID NO: 1994282 - RNA, 18 nt, Homo sapiens
agaagccuguuugguggu

SEQ ID NO: 1994283 - RNA, 17 nt, Homo sapiens
cuuucuuuggugccuuu

SEQ ID NO: 1994284 - RNA, 17 nt, Homo sapiens
augcauaccacaagaca

SEQ ID NO: 1994285 - RNA, 19 nt, Homo sapiens
uccauguggacugugccau

SEQ ID NO: 1994286 - RNA, 13 nt, Homo sapiens
augauaaaagcac

SEQ ID NO: 1994287 - RNA, 13 nt, Homo sapiens
gauaauaugagaa

SEQ ID NO: 1994288 - RNA, 23 nt, Homo sapiens
cagugugaucccaagugccaguc

SEQ ID NO: 1994289 - RNA, 10 nt, Homo sapiens
gaauggugcu

SEQ ID NO: 1994290 - RNA, 23 nt, Homo sapiens
aaaacuaacucagguguauuuau

SEQ ID NO: 1994291 - RNA, 13 nt, Homo sapiens
aguaaaugcgugc

SEQ ID NO: 1994292 - RNA, 16 nt, Homo sapiens
cugcagggacagagca

SEQ ID NO: 1994293 - RNA, 15 nt, Homo sapiens
cuuagaccuauggca

SEQ ID NO: 1994294 - RNA, 22 nt, Homo sapiens
cuuguaccuuccacaagacuca

SEQ ID NO: 1994295 - RNA, 16 nt, Homo sapiens
ugauaccuucaaugaa

SEQ ID NO: 1994296 - RNA, 18 nt, Homo sapiens
uuguagcuguuacugcaa

SEQ ID NO: 1994297 - RNA, 12 nt, Homo sapiens
ugaagcuggaag

SEQ ID NO: 1994298 - RNA, 14 nt, Homo sapiens
caugcucaaugaaa

SEQ ID NO: 1994299 - RNA, 19 nt, Homo sapiens
uauuaccuuuacauauuau

SEQ ID NO: 1994300 - RNA, 16 nt, Homo sapiens
auuaugugacuugcaa

SEQ ID NO: 1994301 - RNA, 21 nt, Homo sapiens
gccuccgccucaguaagacga

SEQ ID NO: 1994302 - RNA, 15 nt, Homo sapiens
ugaagcuggcugugc

SEQ ID NO: 1994303 - RNA, 15 nt, Homo sapiens
gcagcuucagugaca

SEQ ID NO: 1994304 - RNA, 14 nt, Homo sapiens
ucuguuuuuagacc

SEQ ID NO: 1994305 - RNA, 16 nt, Homo sapiens
gguguucaaacacaac

SEQ ID NO: 1994306 - RNA, 15 nt, Homo sapiens
cuaugaauauggaaa

SEQ ID NO: 1994307 - RNA, 13 nt, Homo sapiens
cuuccaccuggaa

SEQ ID NO: 1994308 - RNA, 21 nt, Homo sapiens
cuggacuggguuuugucucug

SEQ ID NO: 1994309 - RNA, 20 nt, Homo sapiens
aagucaggacaucagucuga

SEQ ID NO: 1994310 - RNA, 20 nt, Homo sapiens
cagaucgcaccacugcacuc

SEQ ID NO: 1994311 - RNA, 15 nt, Homo sapiens
uuucacauugaucau

SEQ ID NO: 1994312 - RNA, 11 nt, Homo sapiens
ggagacucagc

SEQ ID NO: 1994313 - RNA, 20 nt, Homo sapiens
gaggucuggcugcuugcccc

SEQ ID NO: 1994314 - RNA, 20 nt, Homo sapiens
uaacuccagucuccugacau

SEQ ID NO: 1994315 - RNA, 17 nt, Homo sapiens
caagaaauaaccaugaa

SEQ ID NO: 1994316 - RNA, 14 nt, Homo sapiens
auuccuucacacag

SEQ ID NO: 1994317 - RNA, 13 nt, Homo sapiens
gguguuaauugaa

SEQ ID NO: 1994318 - RNA, 18 nt, Homo sapiens
uaaaggcccccacuucuc

SEQ ID NO: 1994319 - RNA, 12 nt, Homo sapiens
auucagcugccc

SEQ ID NO: 1994320 - RNA, 15 nt, Homo sapiens
aaauaauuauuuucc

SEQ ID NO: 1994321 - RNA, 16 nt, Homo sapiens
ggugcaaagacucuga

SEQ ID NO: 1994322 - RNA, 22 nt, Homo sapiens
uggauuuuguccauucaucuca

SEQ ID NO: 1994323 - RNA, 13 nt, Homo sapiens
uaccccucuucca

SEQ ID NO: 1994324 - RNA, 14 nt, Homo sapiens
gaaugcccagugag

SEQ ID NO: 1994325 - RNA, 20 nt, Homo sapiens
augagcauuagcuacuuuuc

SEQ ID NO: 1994326 - RNA, 15 nt, Homo sapiens
ccaaaccguacugua

SEQ ID NO: 1994327 - RNA, 19 nt, Homo sapiens
cucaugccuuaaucccagc

SEQ ID NO: 1994328 - RNA, 23 nt, Homo sapiens
cccccaucuccuuaaagagugug

SEQ ID NO: 1994329 - RNA, 12 nt, Homo sapiens
ugugugcucagc

SEQ ID NO: 1994330 - RNA, 15 nt, Homo sapiens
caggcuacaggugcc

SEQ ID NO: 1994331 - RNA, 12 nt, Homo sapiens
cugggugacaaa

SEQ ID NO: 1994332 - RNA, 19 nt, Homo sapiens
auggccaauaacuuuucac

SEQ ID NO: 1994333 - RNA, 17 nt, Homo sapiens
uagagaucuuaugucaa

SEQ ID NO: 1994334 - RNA, 21 nt, Homo sapiens
aagucccagggagcucugcau

SEQ ID NO: 1994335 - RNA, 18 nt, Homo sapiens
auccaccgccacacuggc

SEQ ID NO: 1994336 - RNA, 22 nt, Homo sapiens
ucaagugauccacccaccucag

SEQ ID NO: 1994337 - RNA, 22 nt, Homo sapiens
uuaguuuugguuauuucuaaac

SEQ ID NO: 1994338 - RNA, 14 nt, Homo sapiens
uuauaaaccuucag

SEQ ID NO: 1994339 - RNA, 22 nt, Homo sapiens
acccuggaugauaggaauugac

SEQ ID NO: 1994340 - RNA, 23 nt, Homo sapiens
uuaaaaauaaaaaacauauacaa

SEQ ID NO: 1994341 - RNA, 14 nt, Homo sapiens
accacagacacucc

SEQ ID NO: 1994342 - RNA, 12 nt, Homo sapiens
aaugcacugugu

SEQ ID NO: 1994343 - RNA, 17 nt, Homo sapiens
acaaacauguaagcaua

SEQ ID NO: 1994344 - RNA, 17 nt, Homo sapiens
gcagagguguaggggug

SEQ ID NO: 1994345 - RNA, 17 nt, Homo sapiens
uggacuuuccuguuguc

SEQ ID NO: 1994346 - RNA, 18 nt, Homo sapiens
cccaaaaaagaaugugcu

SEQ ID NO: 1994347 - RNA, 17 nt, Homo sapiens
uaggaagugaacccaua

SEQ ID NO: 1994348 - RNA, 19 nt, Homo sapiens
acaucaccuuuuugacuuu

SEQ ID NO: 1994349 - RNA, 11 nt, Homo sapiens
uucugagauca

SEQ ID NO: 1994350 - RNA, 19 nt, Homo sapiens
gcagcuuacuuaguaggcu

SEQ ID NO: 1994351 - RNA, 15 nt, Homo sapiens
ccagugcuaccucuc

SEQ ID NO: 1994352 - RNA, 15 nt, Homo sapiens
auguuauucucucac

SEQ ID NO: 1994353 - RNA, 23 nt, Homo sapiens
cuuauguaugacuuugugccauc

SEQ ID NO: 1994354 - RNA, 16 nt, Homo sapiens
guacagauacugugag

SEQ ID NO: 1994355 - RNA, 20 nt, Homo sapiens
gucauuccaaauaugagaug

SEQ ID NO: 1994356 - RNA, 20 nt, Homo sapiens
gaaaggugugcuagaacaag

SEQ ID NO: 1994357 - RNA, 16 nt, Homo sapiens
gugaagcaacauuucu

SEQ ID NO: 1994358 - RNA, 17 nt, Homo sapiens
uaugggaggaacaaaga

SEQ ID NO: 1994359 - RNA, 11 nt, Homo sapiens
ugaaugugccc

SEQ ID NO: 1994360 - RNA, 21 nt, Homo sapiens
gagagcucuuugugaauguga

SEQ ID NO: 1994361 - RNA, 19 nt, Homo sapiens
uuaaugaaggugugcuaca

SEQ ID NO: 1994362 - RNA, 21 nt, Homo sapiens
ugucauuccucuccuagcccu

SEQ ID NO: 1994363 - RNA, 22 nt, Homo sapiens
ugaucacacaguguuagugcug

SEQ ID NO: 1994364 - RNA, 13 nt, Homo sapiens
auuucaucuacua

SEQ ID NO: 1994365 - RNA, 17 nt, Homo sapiens
uaaguauaaacaaaagu

SEQ ID NO: 1994366 - RNA, 13 nt, Homo sapiens
cugguggugcugc

SEQ ID NO: 1994367 - RNA, 14 nt, Homo sapiens
aggcuguggcauca

SEQ ID NO: 1994368 - RNA, 18 nt, Homo sapiens
ucauuguaaacauuaguu

SEQ ID NO: 1994369 - RNA, 15 nt, Homo sapiens
uggggacacagcauc

SEQ ID NO: 1994370 - RNA, 16 nt, Homo sapiens
aaaaaugcaugauaau

SEQ ID NO: 1994371 - RNA, 23 nt, Homo sapiens
ucugaguugagcacuggucacau

SEQ ID NO: 1994372 - RNA, 18 nt, Homo sapiens
ggacuguuagaauagaac

SEQ ID NO: 1994373 - RNA, 19 nt, Homo sapiens
ggccuuccucucuccagau

SEQ ID NO: 1994374 - RNA, 13 nt, Homo sapiens
acuccaguaaaaa

SEQ ID NO: 1994375 - RNA, 19 nt, Homo sapiens
uugcugccacucuacaggu

SEQ ID NO: 1994376 - RNA, 15 nt, Homo sapiens
ccagcuauacuguau

SEQ ID NO: 1994377 - RNA, 16 nt, Homo sapiens
aggagaaucacuggaa

SEQ ID NO: 1994378 - RNA, 19 nt, Homo sapiens
ggggcagggaaaacacaga

SEQ ID NO: 1994379 - RNA, 16 nt, Homo sapiens
gcuuuggaggauuuca

SEQ ID NO: 1994380 - RNA, 23 nt, Homo sapiens
acaucaugcuggaaccugcaaaa

SEQ ID NO: 1994381 - RNA, 23 nt, Homo sapiens
acugcuuuggucucuucuuucau

SEQ ID NO: 1994382 - RNA, 20 nt, Homo sapiens
uauuuuucuuuaaagccagu

SEQ ID NO: 1994383 - RNA, 12 nt, Homo sapiens
uuagaaaucagu

SEQ ID NO: 1994384 - RNA, 20 nt, Homo sapiens
gagcacacccgugugcacac

SEQ ID NO: 1994385 - RNA, 13 nt, Homo sapiens
auugauguugcug

SEQ ID NO: 1994386 - RNA, 21 nt, Homo sapiens
gcugaguagcucugccuuugc

SEQ ID NO: 1994387 - RNA, 13 nt, Homo sapiens
cuguuagagucca

SEQ ID NO: 1994388 - RNA, 15 nt, Homo sapiens
gguauggccaugccc

SEQ ID NO: 1994389 - RNA, 13 nt, Homo sapiens
gcagcuuguagcc

SEQ ID NO: 1994390 - RNA, 15 nt, Homo sapiens
aaauuggagcaggga

SEQ ID NO: 1994391 - RNA, 22 nt, Homo sapiens
aggaaagaaucucuugagacau

SEQ ID NO: 1994392 - RNA, 13 nt, Homo sapiens
accccucugggaa

SEQ ID NO: 1994393 - RNA, 20 nt, Homo sapiens
gcaaauguguguagauuuca

SEQ ID NO: 1994394 - RNA, 14 nt, Homo sapiens
guccugcucucuuc

SEQ ID NO: 1994395 - RNA, 13 nt, Homo sapiens
gaaauuaccaaaa

SEQ ID NO: 1994396 - RNA, 20 nt, Homo sapiens
gcuguuaauauaguuuagga

SEQ ID NO: 1994397 - RNA, 21 nt, Homo sapiens
cuuucaauaucuuuauugcau

SEQ ID NO: 1994398 - RNA, 22 nt, Homo sapiens
auauauucuuacaagaguguaa

SEQ ID NO: 1994399 - RNA, 14 nt, Homo sapiens
ccaggcaugcacaa

SEQ ID NO: 1994400 - RNA, 14 nt, Homo sapiens
uguauguacauacc

SEQ ID NO: 1994401 - RNA, 19 nt, Homo sapiens
ucauauguccccacuggca

SEQ ID NO: 1994402 - RNA, 17 nt, Homo sapiens
cagaguagccaugagga

SEQ ID NO: 1994403 - RNA, 14 nt, Homo sapiens
gagucugugcucuu

SEQ ID NO: 1994404 - RNA, 14 nt, Homo sapiens
caacacugcugcuc

SEQ ID NO: 1994405 - RNA, 15 nt, Homo sapiens
ggagcugucuuguca

SEQ ID NO: 1994406 - RNA, 20 nt, Homo sapiens
auauaaaauguuuaaucucu

SEQ ID NO: 1994407 - RNA, 17 nt, Homo sapiens
cuggcccuccacuccuc

SEQ ID NO: 1994408 - RNA, 23 nt, Homo sapiens
guccuugaacccaggccaugugg

SEQ ID NO: 1994409 - RNA, 22 nt, Homo sapiens
aucuaaaauauuuucuacaucu

SEQ ID NO: 1994410 - RNA, 15 nt, Homo sapiens
uagcucacaggacuu

SEQ ID NO: 1994411 - RNA, 19 nt, Homo sapiens
cagcagccucccugucacu

SEQ ID NO: 1994412 - RNA, 21 nt, Homo sapiens
cuuggcucacugcaaccucua

SEQ ID NO: 1994413 - RNA, 17 nt, Homo sapiens
cacugcccgaaaagcau

SEQ ID NO: 1994414 - RNA, 18 nt, Homo sapiens
ccuucaaucaacaucucu

SEQ ID NO: 1994415 - RNA, 18 nt, Homo sapiens
ccucccugacgucugcca

SEQ ID NO: 1994416 - RNA, 21 nt, Homo sapiens
cccugcaaagcccagcuugaa

SEQ ID NO: 1994417 - RNA, 16 nt, Homo sapiens
ccacaggcagcauuua

SEQ ID NO: 1994418 - RNA, 14 nt, Homo sapiens
ucgauuagacugga

SEQ ID NO: 1994419 - RNA, 17 nt, Homo sapiens
cccagcugucuguguca

SEQ ID NO: 1994420 - RNA, 16 nt, Homo sapiens
cuggcccuuaagccaa

SEQ ID NO: 1994421 - RNA, 14 nt, Homo sapiens
cccccgcuccagau

SEQ ID NO: 1994422 - RNA, 22 nt, Homo sapiens
ccuggauaacuguaaaagggcu

SEQ ID NO: 1994423 - RNA, 18 nt, Homo sapiens
uaaaauggaugccuugaa

SEQ ID NO: 1994424 - RNA, 15 nt, Homo sapiens
ccuccuagcagacau

SEQ ID NO: 1994425 - RNA, 15 nt, Homo sapiens
ggacaagucuuucuc

SEQ ID NO: 1994426 - RNA, 18 nt, Homo sapiens
cccaggguggagugcagu

SEQ ID NO: 1994427 - RNA, 19 nt, Homo sapiens
ugaaugcuuaccugugaga

SEQ ID NO: 1994428 - RNA, 21 nt, Homo sapiens
ugauacuuacugaacugugug

SEQ ID NO: 1994429 - RNA, 17 nt, Homo sapiens
cauagcuacuauaugca

SEQ ID NO: 1994430 - RNA, 21 nt, Homo sapiens
caguaagaauuauuuacugaa

SEQ ID NO: 1994431 - RNA, 14 nt, Homo sapiens
gggccaagcccagg

SEQ ID NO: 1994432 - RNA, 18 nt, Homo sapiens
aggcagccacuccuagcc

SEQ ID NO: 1994433 - RNA, 23 nt, Homo sapiens
cacuuuuggaaggugacuuuuca

SEQ ID NO: 1994434 - RNA, 17 nt, Homo sapiens
ccauggccuugggcucu

SEQ ID NO: 1994435 - RNA, 23 nt, Homo sapiens
gagcuuggccagaagggggccau

SEQ ID NO: 1994436 - RNA, 10 nt, Homo sapiens
ccagaggcag

SEQ ID NO: 1994437 - RNA, 22 nt, Homo sapiens
acauguuuuucuucucccucag

SEQ ID NO: 1994438 - RNA, 13 nt, Homo sapiens
gcuugugaacugc

SEQ ID NO: 1994439 - RNA, 12 nt, Homo sapiens
uaauggguuuau

SEQ ID NO: 1994440 - RNA, 19 nt, Homo sapiens
cugacaaagaugaccugcu

SEQ ID NO: 1994441 - RNA, 18 nt, Homo sapiens
ggaacagaagacagcugc

SEQ ID NO: 1994442 - RNA, 17 nt, Homo sapiens
uaacaauuauguuuuca

SEQ ID NO: 1994443 - RNA, 20 nt, Homo sapiens
cagacccccacucucauucc

SEQ ID NO: 1994444 - RNA, 14 nt, Homo sapiens
cuuaugccauauaa

SEQ ID NO: 1994445 - RNA, 16 nt, Homo sapiens
auuaaaauaucccaag

SEQ ID NO: 1994446 - RNA, 13 nt, Homo sapiens
acagaaaugacug

SEQ ID NO: 1994447 - RNA, 15 nt, Homo sapiens
agugaggaaaaacuc

SEQ ID NO: 1994448 - RNA, 15 nt, Homo sapiens
gaccacccaaccuca

SEQ ID NO: 1994449 - RNA, 21 nt, Homo sapiens
ucuguuuauaaugaagaacac

SEQ ID NO: 1994450 - RNA, 14 nt, Homo sapiens
accauggcacugac

SEQ ID NO: 1994451 - RNA, 23 nt, Homo sapiens
aaagcccucccuaccuaccaaga

SEQ ID NO: 1994452 - RNA, 12 nt, Homo sapiens
gcacauauuuga

SEQ ID NO: 1994453 - RNA, 13 nt, Homo sapiens
ccuccugaugucu

SEQ ID NO: 1994454 - RNA, 18 nt, Homo sapiens
uagugucuauuaucacau

SEQ ID NO: 1994455 - RNA, 14 nt, Homo sapiens
gacuuggaaauggg

SEQ ID NO: 1994456 - RNA, 19 nt, Homo sapiens
accaaacccagguucauga

SEQ ID NO: 1994457 - RNA, 20 nt, Homo sapiens
auugaauuggauacaaggau

SEQ ID NO: 1994458 - RNA, 21 nt, Homo sapiens
ucaaaugagccccuucauccg

SEQ ID NO: 1994459 - RNA, 20 nt, Homo sapiens
cuugcaaaaucaguuuuccu

SEQ ID NO: 1994460 - RNA, 19 nt, Homo sapiens
ccaggaacaauaaaauguc

SEQ ID NO: 1994461 - RNA, 16 nt, Homo sapiens
accuuuuucuggucau

SEQ ID NO: 1994462 - RNA, 21 nt, Homo sapiens
acgggucugccaugcucugga

SEQ ID NO: 1994463 - RNA, 18 nt, Homo sapiens
ugccagcgucgguuaaaa

SEQ ID NO: 1994464 - RNA, 23 nt, Homo sapiens
auuaaugcuauacuggaaaugua

SEQ ID NO: 1994465 - RNA, 16 nt, Homo sapiens
aaauguauagcugcuu

SEQ ID NO: 1994466 - RNA, 11 nt, Homo sapiens
aguuuugcccc

SEQ ID NO: 1994467 - RNA, 19 nt, Homo sapiens
auugcagcaguagccuuaa

SEQ ID NO: 1994468 - RNA, 21 nt, Homo sapiens
aacugaaaguuuaacuauuua

SEQ ID NO: 1994469 - RNA, 16 nt, Homo sapiens
aucucugaggccucag

SEQ ID NO: 1994470 - RNA, 17 nt, Homo sapiens
auaccaguacucaguau

SEQ ID NO: 1994471 - RNA, 12 nt, Homo sapiens
uucaaaauucaa

SEQ ID NO: 1994472 - RNA, 17 nt, Homo sapiens
augguccuccauuucaa

SEQ ID NO: 1994473 - RNA, 18 nt, Homo sapiens
aacaagugcucuuuccac

SEQ ID NO: 1994474 - RNA, 20 nt, Homo sapiens
uccagcuugggcaacagggc

SEQ ID NO: 1994475 - RNA, 18 nt, Homo sapiens
caccucugugccaccucu

SEQ ID NO: 1994476 - RNA, 19 nt, Homo sapiens
ugacuacauagucaagucc

SEQ ID NO: 1994477 - RNA, 18 nt, Homo sapiens
gcaaaugccaacuguugg

SEQ ID NO: 1994478 - RNA, 23 nt, Homo sapiens
guggaguaauuuaugccuuaguc

SEQ ID NO: 1994479 - RNA, 17 nt, Homo sapiens
ccaagauaaaaccagag

SEQ ID NO: 1994480 - RNA, 20 nt, Homo sapiens
acugccacacucuccaucac

SEQ ID NO: 1994481 - RNA, 20 nt, Homo sapiens
gcugaccacagcacagccaa

SEQ ID NO: 1994482 - RNA, 17 nt, Homo sapiens
auccauaacuuuagucu

SEQ ID NO: 1994483 - RNA, 22 nt, Homo sapiens
uaacuucaauguaguuuuccau

SEQ ID NO: 1994484 - RNA, 14 nt, Homo sapiens
aggccgugccuugu

SEQ ID NO: 1994485 - RNA, 21 nt, Homo sapiens
ggagccuguguaacagcuccu

SEQ ID NO: 1994486 - RNA, 19 nt, Homo sapiens
cuaaaguuagaaaguugau

SEQ ID NO: 1994487 - RNA, 21 nt, Homo sapiens
accuguccggcccagugccag

SEQ ID NO: 1994488 - RNA, 16 nt, Homo sapiens
uguagacaaaguacau

SEQ ID NO: 1994489 - RNA, 22 nt, Homo sapiens
uggcuggacuguagaaggugag

SEQ ID NO: 1994490 - RNA, 12 nt, Homo sapiens
ucagcuccuucc

SEQ ID NO: 1994491 - RNA, 17 nt, Homo sapiens
cagagagucaaugucau

SEQ ID NO: 1994492 - RNA, 22 nt, Homo sapiens
cugcugaccaauugugcugcca

SEQ ID NO: 1994493 - RNA, 19 nt, Homo sapiens
acuucaagaucugaauuug

SEQ ID NO: 1994494 - RNA, 22 nt, Homo sapiens
ucuaauugaauuuucaagcauc

SEQ ID NO: 1994495 - RNA, 22 nt, Homo sapiens
aaaauaugaaaaaaagaaauga

SEQ ID NO: 1994496 - RNA, 12 nt, Homo sapiens
gaaauacuuuau

SEQ ID NO: 1994497 - RNA, 12 nt, Homo sapiens
uauuuacuguua

SEQ ID NO: 1994498 - RNA, 17 nt, Homo sapiens
acuuucuuuaacauauc

SEQ ID NO: 1994499 - RNA, 13 nt, Homo sapiens
gccuuugcuuaag

SEQ ID NO: 1994500 - RNA, 21 nt, Homo sapiens
aaaaucucccagugacaacau

SEQ ID NO: 1994501 - RNA, 19 nt, Homo sapiens
uccccaacucuucuccaag

SEQ ID NO: 1994502 - RNA, 20 nt, Homo sapiens
aguagagacgggguuucacc

SEQ ID NO: 1994503 - RNA, 20 nt, Homo sapiens
auagcaacuccccuacauca

SEQ ID NO: 1994504 - RNA, 21 nt, Homo sapiens
auaccuuggcugauguugcag

SEQ ID NO: 1994505 - RNA, 18 nt, Homo sapiens
aaacucuccucugcugcu

SEQ ID NO: 1994506 - RNA, 14 nt, Homo sapiens
ccucuguauacuga

SEQ ID NO: 1994507 - RNA, 14 nt, Homo sapiens
gcuccuaggugaug

SEQ ID NO: 1994508 - RNA, 22 nt, Homo sapiens
auugagaaagauguuccaguga

SEQ ID NO: 1994509 - RNA, 21 nt, Homo sapiens
uccugcaucguggcacuccuc

SEQ ID NO: 1994510 - RNA, 23 nt, Homo sapiens
gaaaaccauucuggacacuguca

SEQ ID NO: 1994511 - RNA, 23 nt, Homo sapiens
auuccagaacaaaucauuauguu

SEQ ID NO: 1994512 - RNA, 22 nt, Homo sapiens
cauuuaaauaucugaacauuua

SEQ ID NO: 1994513 - RNA, 16 nt, Homo sapiens
cgcaugauggagcuga

SEQ ID NO: 1994514 - RNA, 18 nt, Homo sapiens
agcuugucaaugauuuca

SEQ ID NO: 1994515 - RNA, 14 nt, Homo sapiens
ucuuggcacaaucu

SEQ ID NO: 1994516 - RNA, 20 nt, Homo sapiens
caaauuuuagaacuuuaccu

SEQ ID NO: 1994517 - RNA, 16 nt, Homo sapiens
agaauucacaccuuag

SEQ ID NO: 1994518 - RNA, 18 nt, Homo sapiens
agaaacuguuugauuaua

SEQ ID NO: 1994519 - RNA, 16 nt, Homo sapiens
ggguuaauucauuugg

SEQ ID NO: 1994520 - RNA, 23 nt, Homo sapiens
uguccuccagggcgagcacuuuc

SEQ ID NO: 1994521 - RNA, 17 nt, Homo sapiens
ccugucauggcucugaa

SEQ ID NO: 1994522 - RNA, 12 nt, Homo sapiens
cauuuccaaaag

SEQ ID NO: 1994523 - RNA, 18 nt, Homo sapiens
cuuuaugcagagccacag

SEQ ID NO: 1994524 - RNA, 14 nt, Homo sapiens
gaaaaagcauguac

SEQ ID NO: 1994525 - RNA, 21 nt, Homo sapiens
gacacagcagcuucaccagag

SEQ ID NO: 1994526 - RNA, 22 nt, Homo sapiens
uguaacucacaugccuucuaaa

SEQ ID NO: 1994527 - RNA, 19 nt, Homo sapiens
ugacucgucugacugugug

SEQ ID NO: 1994528 - RNA, 16 nt, Homo sapiens
aaaugagacuuucuaa

SEQ ID NO: 1994529 - RNA, 20 nt, Homo sapiens
gcccacuuugccuuccagga

SEQ ID NO: 1994530 - RNA, 19 nt, Homo sapiens
gaggcggguggaucacuug

SEQ ID NO: 1994531 - RNA, 12 nt, Homo sapiens
aagagacugauc

SEQ ID NO: 1994532 - RNA, 23 nt, Homo sapiens
cuuucuuaaugugugugccaaug

SEQ ID NO: 1994533 - RNA, 17 nt, Homo sapiens
auagugaugaugaucuc

SEQ ID NO: 1994534 - RNA, 15 nt, Homo sapiens
uuugcuuacaaagua

SEQ ID NO: 1994535 - RNA, 21 nt, Homo sapiens
augggacugaugucaucuuga

SEQ ID NO: 1994536 - RNA, 14 nt, Homo sapiens
caaaauauuucuca

SEQ ID NO: 1994537 - RNA, 17 nt, Homo sapiens
acuguugccaccaugua

SEQ ID NO: 1994538 - RNA, 13 nt, Homo sapiens
aaagcugcucagg

SEQ ID NO: 1994539 - RNA, 23 nt, Homo sapiens
agccaccaugccuggcccggaua

SEQ ID NO: 1994540 - RNA, 21 nt, Homo sapiens
aacuaugcaauaauccacccc

SEQ ID NO: 1994541 - RNA, 18 nt, Homo sapiens
ccauauuuguguucaguu

SEQ ID NO: 1994542 - RNA, 21 nt, Homo sapiens
auaucaacccucucuacaggu

SEQ ID NO: 1994543 - RNA, 22 nt, Homo sapiens
uaaacaguuugaaaagacaaau

SEQ ID NO: 1994544 - RNA, 18 nt, Homo sapiens
ccccacuggagcguguac

SEQ ID NO: 1994545 - RNA, 23 nt, Homo sapiens
ugaggaucggagggcgcuauguc

SEQ ID NO: 1994546 - RNA, 16 nt, Homo sapiens
guaauuccagccacuc

SEQ ID NO: 1994547 - RNA, 22 nt, Homo sapiens
uaccaaggggaauuacugaaaa

SEQ ID NO: 1994548 - RNA, 17 nt, Homo sapiens
aauucgaaaacaaccgu

SEQ ID NO: 1994549 - RNA, 16 nt, Homo sapiens
cuuagguuuugcuugg

SEQ ID NO: 1994550 - RNA, 16 nt, Homo sapiens
cugcucauaugaugua

SEQ ID NO: 1994551 - RNA, 20 nt, Homo sapiens
aggugugagccacagcacuc

SEQ ID NO: 1994552 - RNA, 22 nt, Homo sapiens
gccacggagggaggcaccaugc

SEQ ID NO: 1994553 - RNA, 19 nt, Homo sapiens
cagaaucugauaccaaaga

SEQ ID NO: 1994554 - RNA, 18 nt, Homo sapiens
cauaggaagaaaauguca

SEQ ID NO: 1994555 - RNA, 12 nt, Homo sapiens
gucccuuaccug

SEQ ID NO: 1994556 - RNA, 19 nt, Homo sapiens
aaagguaaucugaaacaca

SEQ ID NO: 1994557 - RNA, 17 nt, Homo sapiens
cgcuagccaagaaccua

SEQ ID NO: 1994558 - RNA, 14 nt, Homo sapiens
uccaaaaucaggcu

SEQ ID NO: 1994559 - RNA, 11 nt, Homo sapiens
cacgaugcauu

SEQ ID NO: 1994560 - RNA, 12 nt, Homo sapiens
guucaagccaug

SEQ ID NO: 1994561 - RNA, 15 nt, Homo sapiens
agccugcauucugca

SEQ ID NO: 1994562 - RNA, 13 nt, Homo sapiens
aaagcucuagaca

SEQ ID NO: 1994563 - RNA, 17 nt, Homo sapiens
uucaaaucaaaccucag

SEQ ID NO: 1994564 - RNA, 19 nt, Homo sapiens
uguauuaauccccaucauu

SEQ ID NO: 1994565 - RNA, 17 nt, Homo sapiens
aggaggcugcccugagg

SEQ ID NO: 1994566 - RNA, 14 nt, Homo sapiens
agagagagaacuuu

SEQ ID NO: 1994567 - RNA, 22 nt, Homo sapiens
caugcuggggcccuaccagcag

SEQ ID NO: 1994568 - RNA, 13 nt, Homo sapiens
aaugagcauugau

SEQ ID NO: 1994569 - RNA, 15 nt, Homo sapiens
augaaugucaugcac

SEQ ID NO: 1994570 - RNA, 20 nt, Homo sapiens
cauuuacacauauccacaaa

SEQ ID NO: 1994571 - RNA, 23 nt, Homo sapiens
ccgcauuccaggcuccucccucc

SEQ ID NO: 1994572 - RNA, 16 nt, Homo sapiens
ccucaucucugccuga

SEQ ID NO: 1994573 - RNA, 23 nt, Homo sapiens
cuucagagaaaucugcauucuau

SEQ ID NO: 1994574 - RNA, 17 nt, Homo sapiens
aucuuuacguacuguaa

SEQ ID NO: 1994575 - RNA, 11 nt, Homo sapiens
gacccaagacc

SEQ ID NO: 1994576 - RNA, 18 nt, Homo sapiens
uuacacggagugugcuaa

SEQ ID NO: 1994577 - RNA, 16 nt, Homo sapiens
auauguauauauguau

SEQ ID NO: 1994578 - RNA, 16 nt, Homo sapiens
cucugucucucugucu

SEQ ID NO: 1994579 - RNA, 16 nt, Homo sapiens
ccaaagaaccaaagaa

SEQ ID NO: 1994580 - RNA, 16 nt, Homo sapiens
acauacauacauacau

SEQ ID NO: 1994581 - RNA, 16 nt, Homo sapiens
uacauacauacauaca

SEQ ID NO: 1994582 - RNA, 16 nt, Homo sapiens
ucucugucucucuguc

SEQ ID NO: 1994583 - RNA, 16 nt, Homo sapiens
agugcaguagugcagu

SEQ ID NO: 1994584 - RNA, 16 nt, Homo sapiens
uaaauguguaaaugug

SEQ ID NO: 1994585 - RNA, 16 nt, Homo sapiens
gucucucugucucucu

SEQ ID NO: 1994586 - RNA, 18 nt, Homo sapiens
gaucagccccgccuguca

SEQ ID NO: 1994587 - RNA, 19 nt, Homo sapiens
ccaguacaccccaccucuu

SEQ ID NO: 1994588 - RNA, 15 nt, Homo sapiens
uuguuaauucuuccu

SEQ ID NO: 1994589 - RNA, 17 nt, Homo sapiens
gaagauuuaugaugcac

SEQ ID NO: 1994590 - RNA, 21 nt, Homo sapiens
gggaugggccccgccuuccug

SEQ ID NO: 1994591 - RNA, 21 nt, Homo sapiens
gaggggucagcucuggccaca

SEQ ID NO: 1994592 - RNA, 17 nt, Homo sapiens
cuuucaacucauugcau

SEQ ID NO: 1994593 - RNA, 23 nt, Homo sapiens
aggaauuuucuugaaacugugaa

SEQ ID NO: 1994594 - RNA, 18 nt, Homo sapiens
auuucugcuaaauaucac

SEQ ID NO: 1994595 - RNA, 21 nt, Homo sapiens
cagagaaaauaaaagcacuua

SEQ ID NO: 1994596 - RNA, 22 nt, Homo sapiens
ugagcaauguauaaccccaaag

SEQ ID NO: 1994597 - RNA, 14 nt, Homo sapiens
aaauaagcuuuauu

SEQ ID NO: 1994598 - RNA, 16 nt, Homo sapiens
guauuuaaagcauuuu

SEQ ID NO: 1994599 - RNA, 20 nt, Homo sapiens
acuggaaauaaccugugaau

SEQ ID NO: 1994600 - RNA, 12 nt, Homo sapiens
agcucuccuuag

SEQ ID NO: 1994601 - RNA, 13 nt, Homo sapiens
agccugucucucc

SEQ ID NO: 1994602 - RNA, 24 nt, Homo sapiens
augagcauccucucucacauggaa

SEQ ID NO: 1994603 - RNA, 16 nt, Homo sapiens
ucacgcccccaggaau

SEQ ID NO: 1994604 - RNA, 23 nt, Homo sapiens
aacgacaaagccaaacucugcca

SEQ ID NO: 1994605 - RNA, 23 nt, Homo sapiens
gauuauucuuugaaaacagauga

SEQ ID NO: 1994606 - RNA, 23 nt, Homo sapiens
caaaaauacucuaauucuaacca

SEQ ID NO: 1994607 - RNA, 18 nt, Homo sapiens
agagcagccucaucccag

SEQ ID NO: 1994608 - RNA, 12 nt, Homo sapiens
cacuucucucag

SEQ ID NO: 1994609 - RNA, 12 nt, Homo sapiens
uagaacugagaa

SEQ ID NO: 1994610 - RNA, 20 nt, Homo sapiens
cuacugcucuccuccaccuc

SEQ ID NO: 1994611 - RNA, 18 nt, Homo sapiens
cagggcagcagaucugua

SEQ ID NO: 1994612 - RNA, 14 nt, Homo sapiens
uguucuauugcuga

SEQ ID NO: 1994613 - RNA, 13 nt, Homo sapiens
gccucucugacau

SEQ ID NO: 1994614 - RNA, 14 nt, Homo sapiens
aauauggacucagc

SEQ ID NO: 1994615 - RNA, 16 nt, Homo sapiens
gaaauaauaauaucca

SEQ ID NO: 1994616 - RNA, 14 nt, Homo sapiens
cacuagucagaaaa

SEQ ID NO: 1994617 - RNA, 16 nt, Homo sapiens
uggcccucgacacuca

SEQ ID NO: 1994618 - RNA, 22 nt, Homo sapiens
cuuuccagggcauaaaacucaa

SEQ ID NO: 1994619 - RNA, 15 nt, Homo sapiens
ccaguguuaguggga

SEQ ID NO: 1994620 - RNA, 23 nt, Homo sapiens
gcccugucugaaggacacuuccu

SEQ ID NO: 1994621 - RNA, 17 nt, Homo sapiens
ugcuaaguaauuuagaa

SEQ ID NO: 1994622 - RNA, 16 nt, Homo sapiens
uacuauggaaagcagc

SEQ ID NO: 1994623 - RNA, 23 nt, Homo sapiens
ugacaauaugauuuuaaauuuga

SEQ ID NO: 1994624 - RNA, 20 nt, Homo sapiens
cucccgaguagcugggauua

SEQ ID NO: 1994625 - RNA, 18 nt, Homo sapiens
caggggucagcaggagga

SEQ ID NO: 1994626 - RNA, 12 nt, Homo sapiens
cucuuagcacac

SEQ ID NO: 1994627 - RNA, 19 nt, Homo sapiens
uugucacuuuuuaugcuau

SEQ ID NO: 1994628 - RNA, 19 nt, Homo sapiens
aaucccaaauucacuuuau

SEQ ID NO: 1994629 - RNA, 17 nt, Homo sapiens
ugggggguuuucuugcc

SEQ ID NO: 1994630 - RNA, 13 nt, Homo sapiens
ccugcacacucca

SEQ ID NO: 1994631 - RNA, 20 nt, Homo sapiens
cagacacgauugagaacuga

SEQ ID NO: 1994632 - RNA, 18 nt, Homo sapiens
gcugcuagaucuuuauua

SEQ ID NO: 1994633 - RNA, 15 nt, Homo sapiens
uaguccccaucagca

SEQ ID NO: 1994634 - RNA, 21 nt, Homo sapiens
ucuccccucagcucggcucag

SEQ ID NO: 1994635 - RNA, 23 nt, Homo sapiens
aaaggcuuaggacuucaaaaggu

SEQ ID NO: 1994636 - RNA, 13 nt, Homo sapiens
ucuuacaugcauu

SEQ ID NO: 1994637 - RNA, 13 nt, Homo sapiens
guaaucauuuuaa

SEQ ID NO: 1994638 - RNA, 21 nt, Homo sapiens
cccuuuccuccucaggcacac

SEQ ID NO: 1994639 - RNA, 17 nt, Homo sapiens
guuccugacaucacagc

SEQ ID NO: 1994640 - RNA, 13 nt, Homo sapiens
aaagaauguuacu

SEQ ID NO: 1994641 - RNA, 20 nt, Homo sapiens
uuuacaguuagaaacaccag

SEQ ID NO: 1994642 - RNA, 12 nt, Homo sapiens
guggcauugggu

SEQ ID NO: 1994643 - RNA, 12 nt, Homo sapiens
agugcauuauuu

SEQ ID NO: 1994644 - RNA, 15 nt, Homo sapiens
ucaugcaaucuuccu

SEQ ID NO: 1994645 - RNA, 15 nt, Homo sapiens
gcacguaagcuccuu

SEQ ID NO: 1994646 - RNA, 20 nt, Homo sapiens
gccccuguauggcacuggca

SEQ ID NO: 1994647 - RNA, 15 nt, Homo sapiens
uuccucacaccacaa

SEQ ID NO: 1994648 - RNA, 20 nt, Homo sapiens
aucugugucaaaagccagau

SEQ ID NO: 1994649 - RNA, 16 nt, Homo sapiens
auuacugcaugcacuu

SEQ ID NO: 1994650 - RNA, 19 nt, Homo sapiens
cuguucauuguaagcacuu

SEQ ID NO: 1994651 - RNA, 15 nt, Homo sapiens
cuuucacacuggauc

SEQ ID NO: 1994652 - RNA, 13 nt, Homo sapiens
uccgugcguccuc

SEQ ID NO: 1994653 - RNA, 22 nt, Homo sapiens
gcacauuagccuaugugcaugc

SEQ ID NO: 1994654 - RNA, 17 nt, Homo sapiens
gcauagaaauggaagaa

SEQ ID NO: 1994655 - RNA, 15 nt, Homo sapiens
aauagcaaaagugau

SEQ ID NO: 1994656 - RNA, 17 nt, Homo sapiens
caguucuuggugcucug

SEQ ID NO: 1994657 - RNA, 20 nt, Homo sapiens
uuuauggcagacauugugcu

SEQ ID NO: 1994658 - RNA, 17 nt, Homo sapiens
uuucagucaucaucuca

SEQ ID NO: 1994659 - RNA, 13 nt, Homo sapiens
cagcaucuucuca

SEQ ID NO: 1994660 - RNA, 12 nt, Homo sapiens
uauuaacagaua

SEQ ID NO: 1994661 - RNA, 21 nt, Homo sapiens
ucuuugacauuuggugguacu

SEQ ID NO: 1994662 - RNA, 18 nt, Homo sapiens
gcagcccaacagcacuuu

SEQ ID NO: 1994663 - RNA, 19 nt, Homo sapiens
ucguugggccgcucugauu

SEQ ID NO: 1994664 - RNA, 20 nt, Homo sapiens
ccuuucuucucuccagugca

SEQ ID NO: 1994665 - RNA, 15 nt, Homo sapiens
cucagucaugcauaa

SEQ ID NO: 1994666 - RNA, 19 nt, Homo sapiens
gguauuauucuguuuugca

SEQ ID NO: 1994667 - RNA, 16 nt, Homo sapiens
uuguagcacugagggu

SEQ ID NO: 1994668 - RNA, 21 nt, Homo sapiens
uaucaugcuuugaaaaaucac

SEQ ID NO: 1994669 - RNA, 17 nt, Homo sapiens
aauuggaacaaagugaa

SEQ ID NO: 1994670 - RNA, 17 nt, Homo sapiens
ucucuugccucaaccuc

SEQ ID NO: 1994671 - RNA, 15 nt, Homo sapiens
accaugccaggcuaa

SEQ ID NO: 1994672 - RNA, 15 nt, Homo sapiens
ccuggagcagaagca

SEQ ID NO: 1994673 - RNA, 14 nt, Homo sapiens
ccagaaaccuucca

SEQ ID NO: 1994674 - RNA, 18 nt, Homo sapiens
acuucagagcacacuuau

SEQ ID NO: 1994675 - RNA, 13 nt, Homo sapiens
cacuaaugcuuua

SEQ ID NO: 1994676 - RNA, 18 nt, Homo sapiens
ugauacuuguuccagaug

SEQ ID NO: 1994677 - RNA, 21 nt, Homo sapiens
ccaaauuuuagauuuaccuug

SEQ ID NO: 1994678 - RNA, 16 nt, Homo sapiens
auacauuagugccaua

SEQ ID NO: 1994679 - RNA, 20 nt, Homo sapiens
auacugguguuaacagucac

SEQ ID NO: 1994680 - RNA, 17 nt, Homo sapiens
aaauguuacuucucuca

SEQ ID NO: 1994681 - RNA, 12 nt, Homo sapiens
cucaugagcuga

SEQ ID NO: 1994682 - RNA, 11 nt, Homo sapiens
auuuacugugg

SEQ ID NO: 1994683 - RNA, 18 nt, Homo sapiens
cuaccccucaaacugcac

SEQ ID NO: 1994684 - RNA, 17 nt, Homo sapiens
accaucucuuuaccucc

SEQ ID NO: 1994685 - RNA, 22 nt, Homo sapiens
uagguuaguagcccuucagucu

SEQ ID NO: 1994686 - RNA, 20 nt, Homo sapiens
ucaucucugguuuucuugcc

SEQ ID NO: 1994687 - RNA, 11 nt, Homo sapiens
uuuauggugua

SEQ ID NO: 1994688 - RNA, 15 nt, Homo sapiens
uaauuuugccauccu

SEQ ID NO: 1994689 - RNA, 17 nt, Homo sapiens
aaacuauuuuauguuca

SEQ ID NO: 1994690 - RNA, 22 nt, Homo sapiens
cugacuauucuugauguaaaau

SEQ ID NO: 1994691 - RNA, 21 nt, Homo sapiens
aaguaggaacucuuaagcaau

SEQ ID NO: 1994692 - RNA, 21 nt, Homo sapiens
agaggcuggaaaagggcucag

SEQ ID NO: 1994693 - RNA, 16 nt, Homo sapiens
cugugugauugacagc

SEQ ID NO: 1994694 - RNA, 13 nt, Homo sapiens
aaacaaacccagg

SEQ ID NO: 1994695 - RNA, 14 nt, Homo sapiens
gacaagcacuuugg

SEQ ID NO: 1994696 - RNA, 14 nt, Homo sapiens
guuuaucacacagu

SEQ ID NO: 1994697 - RNA, 13 nt, Homo sapiens
uaaacucagggac

SEQ ID NO: 1994698 - RNA, 20 nt, Homo sapiens
auggcaaaagguugacucau

SEQ ID NO: 1994699 - RNA, 14 nt, Homo sapiens
uucaacaaugacua

SEQ ID NO: 1994700 - RNA, 20 nt, Homo sapiens
cacaugcuggugcauauacg

SEQ ID NO: 1994701 - RNA, 14 nt, Homo sapiens
uagacuacauuuag

SEQ ID NO: 1994702 - RNA, 16 nt, Homo sapiens
ucauaccucugaccaa

SEQ ID NO: 1994703 - RNA, 20 nt, Homo sapiens
acacucaucccccaucagau

SEQ ID NO: 1994704 - RNA, 14 nt, Homo sapiens
guguuacauacaca

SEQ ID NO: 1994705 - RNA, 14 nt, Homo sapiens
uaacucacucaguu

SEQ ID NO: 1994706 - RNA, 19 nt, Homo sapiens
aguagauagaaagcaauaa

SEQ ID NO: 1994707 - RNA, 19 nt, Homo sapiens
uacaucauuuuaacagcug

SEQ ID NO: 1994708 - RNA, 12 nt, Homo sapiens
uuuaauagcaaa

SEQ ID NO: 1994709 - RNA, 17 nt, Homo sapiens
guuccaugaagaccaca

SEQ ID NO: 1994710 - RNA, 20 nt, Homo sapiens
aguguuuuuuagauacagag

SEQ ID NO: 1994711 - RNA, 20 nt, Homo sapiens
uuccagcagaggugauucuu

SEQ ID NO: 1994712 - RNA, 15 nt, Homo sapiens
uauugcuguuaauau

SEQ ID NO: 1994713 - RNA, 19 nt, Homo sapiens
cacucugcaucagcacugc

SEQ ID NO: 1994714 - RNA, 14 nt, Homo sapiens
agaccccuuggcca

SEQ ID NO: 1994715 - RNA, 15 nt, Homo sapiens
uuggaagugauuuca

SEQ ID NO: 1994716 - RNA, 20 nt, Homo sapiens
cugugacuuaagaagccuua

SEQ ID NO: 1994717 - RNA, 19 nt, Homo sapiens
uacuugagccggacaccaa

SEQ ID NO: 1994718 - RNA, 14 nt, Homo sapiens
agucuuggcucacu

SEQ ID NO: 1994719 - RNA, 21 nt, Homo sapiens
ccuacggagggaccagguguc

SEQ ID NO: 1994720 - RNA, 18 nt, Homo sapiens
auaccacugcacuccagc

SEQ ID NO: 1994721 - RNA, 19 nt, Homo sapiens
ccuuuuuuuaaaauucacc

SEQ ID NO: 1994722 - RNA, 15 nt, Homo sapiens
agcccgacagugcca

SEQ ID NO: 1994723 - RNA, 16 nt, Homo sapiens
aggccgcaagaggcau

SEQ ID NO: 1994724 - RNA, 10 nt, Homo sapiens
aguguaagaa

SEQ ID NO: 1994725 - RNA, 17 nt, Homo sapiens
cucccaaguccagugug

SEQ ID NO: 1994726 - RNA, 16 nt, Homo sapiens
uuacauguaauuugau

SEQ ID NO: 1994727 - RNA, 14 nt, Homo sapiens
caauaaauuugcaa

SEQ ID NO: 1994728 - RNA, 15 nt, Homo sapiens
cccaaguaugccuua

SEQ ID NO: 1994729 - RNA, 13 nt, Homo sapiens
ccccugaguguga

SEQ ID NO: 1994730 - RNA, 12 nt, Homo sapiens
gauauaccuaau

SEQ ID NO: 1994731 - RNA, 13 nt, Homo sapiens
caaaggagccuug

SEQ ID NO: 1994732 - RNA, 23 nt, Homo sapiens
accuggcauggugcuuucagguc

SEQ ID NO: 1994733 - RNA, 20 nt, Homo sapiens
agucagcggagaggacccca

SEQ ID NO: 1994734 - RNA, 16 nt, Homo sapiens
gaugagggaagcaaua

SEQ ID NO: 1994735 - RNA, 14 nt, Homo sapiens
aagcuggugaaagc

SEQ ID NO: 1994736 - RNA, 21 nt, Homo sapiens
aaaucuagaauuuagugauac

SEQ ID NO: 1994737 - RNA, 19 nt, Homo sapiens
agugcugugcugugcuaug

SEQ ID NO: 1994738 - RNA, 21 nt, Homo sapiens
ccacgucccgggcacugucau

SEQ ID NO: 1994739 - RNA, 18 nt, Homo sapiens
guccaacucuuccaccuc

SEQ ID NO: 1994740 - RNA, 13 nt, Homo sapiens
gcccgccaccuug

SEQ ID NO: 1994741 - RNA, 16 nt, Homo sapiens
agccagggcccgggaa

SEQ ID NO: 1994742 - RNA, 12 nt, Homo sapiens
cucccuagccag

SEQ ID NO: 1994743 - RNA, 16 nt, Homo sapiens
agggacagaagcagga

SEQ ID NO: 1994744 - RNA, 15 nt, Homo sapiens
uaaucugaggcaauc

SEQ ID NO: 1994745 - RNA, 14 nt, Homo sapiens
gugucauaccacaa

SEQ ID NO: 1994746 - RNA, 13 nt, Homo sapiens
gaacuagaaccug

SEQ ID NO: 1994747 - RNA, 21 nt, Homo sapiens
uuauaaacuuuagaguagcau

SEQ ID NO: 1994748 - RNA, 14 nt, Homo sapiens
aauagccauaugca

SEQ ID NO: 1994749 - RNA, 13 nt, Homo sapiens
gauacuguugauc

SEQ ID NO: 1994750 - RNA, 17 nt, Homo sapiens
uggagcauggacagugu

SEQ ID NO: 1994751 - RNA, 20 nt, Homo sapiens
cacaagcagagugcacagcu

SEQ ID NO: 1994752 - RNA, 16 nt, Homo sapiens
ccuaaaaaacacuggc

SEQ ID NO: 1994753 - RNA, 19 nt, Homo sapiens
cacaccccaacacuuccag

SEQ ID NO: 1994754 - RNA, 21 nt, Homo sapiens
gugguaucugugaacauguua

SEQ ID NO: 1994755 - RNA, 23 nt, Homo sapiens
gcaaacagagugaaaugccauuu

SEQ ID NO: 1994756 - RNA, 16 nt, Homo sapiens
gacccuuuucucagga

SEQ ID NO: 1994757 - RNA, 19 nt, Homo sapiens
guaaaauuaugagugauua

SEQ ID NO: 1994758 - RNA, 21 nt, Homo sapiens
guuugacuuauugcuguuuca

SEQ ID NO: 1994759 - RNA, 20 nt, Homo sapiens
auaaauauacucaaguuuca

SEQ ID NO: 1994760 - RNA, 19 nt, Homo sapiens
ccucuguccccuucucuca

SEQ ID NO: 1994761 - RNA, 21 nt, Homo sapiens
ucaauggaguaugucugaugg

SEQ ID NO: 1994762 - RNA, 17 nt, Homo sapiens
uaucuucuuuugaacaa

SEQ ID NO: 1994763 - RNA, 21 nt, Homo sapiens
ucccaacuccucccuauccua

SEQ ID NO: 1994764 - RNA, 22 nt, Homo sapiens
auauuguuccuuaucaccugcc

SEQ ID NO: 1994765 - RNA, 20 nt, Homo sapiens
ucccagagggauugcuguga

SEQ ID NO: 1994766 - RNA, 16 nt, Homo sapiens
auacuuugucugaaaa

SEQ ID NO: 1994767 - RNA, 16 nt, Homo sapiens
cuccugaacagaagau

SEQ ID NO: 1994768 - RNA, 18 nt, Homo sapiens
gcuuaaaguuauguuauu

SEQ ID NO: 1994769 - RNA, 14 nt, Homo sapiens
auguuuaguaauca

SEQ ID NO: 1994770 - RNA, 17 nt, Homo sapiens
auuggcaggugugggcu

SEQ ID NO: 1994771 - RNA, 15 nt, Homo sapiens
aagguccaggcuugc

SEQ ID NO: 1994772 - RNA, 11 nt, Homo sapiens
gcacagauuau

SEQ ID NO: 1994773 - RNA, 14 nt, Homo sapiens
auuuauucauucag

SEQ ID NO: 1994774 - RNA, 19 nt, Homo sapiens
agugucuaauucccuguua

SEQ ID NO: 1994775 - RNA, 18 nt, Homo sapiens
ccaaagguuggcagugau

SEQ ID NO: 1994776 - RNA, 17 nt, Homo sapiens
aguuaauuuugaguaau

SEQ ID NO: 1994777 - RNA, 10 nt, Homo sapiens
ggaagcaaag

SEQ ID NO: 1994778 - RNA, 10 nt, Homo sapiens
aaaagcaaga

SEQ ID NO: 1994779 - RNA, 14 nt, Homo sapiens
gccuuucuccucca

SEQ ID NO: 1994780 - RNA, 14 nt, Homo sapiens
cuuuuucuguccca

SEQ ID NO: 1994781 - RNA, 23 nt, Homo sapiens
agguccaccgagccccugacccc

SEQ ID NO: 1994782 - RNA, 21 nt, Homo sapiens
auaucugggauucuacuuuaa

SEQ ID NO: 1994783 - RNA, 16 nt, Homo sapiens
uacucacuuuuuccaa

SEQ ID NO: 1994784 - RNA, 15 nt, Homo sapiens
gguuuauuugcagua

SEQ ID NO: 1994785 - RNA, 14 nt, Homo sapiens
acagggcagcagug

SEQ ID NO: 1994786 - RNA, 22 nt, Homo sapiens
acuauauuguuugcuaagcauu

SEQ ID NO: 1994787 - RNA, 22 nt, Homo sapiens
ugcauucuuauucaucagggag

SEQ ID NO: 1994788 - RNA, 14 nt, Homo sapiens
cgucaccaccaccg

SEQ ID NO: 1994789 - RNA, 14 nt, Homo sapiens
ucaucccauguuag

SEQ ID NO: 1994790 - RNA, 12 nt, Homo sapiens
cuggcacacucc

SEQ ID NO: 1994791 - RNA, 23 nt, Homo sapiens
gaaaacugccuuuuaucugccca

SEQ ID NO: 1994792 - RNA, 23 nt, Homo sapiens
uauagcguucccaacaacaucca

SEQ ID NO: 1994793 - RNA, 22 nt, Homo sapiens
uuaacagauaacagugugcuca

SEQ ID NO: 1994794 - RNA, 22 nt, Homo sapiens
caucagcccucauguuucauug

SEQ ID NO: 1994795 - RNA, 21 nt, Homo sapiens
aacuguaaaguucaauuguga

SEQ ID NO: 1994796 - RNA, 15 nt, Homo sapiens
cacacaacuguccau

SEQ ID NO: 1994797 - RNA, 17 nt, Homo sapiens
cccugggucaccuagcu

SEQ ID NO: 1994798 - RNA, 12 nt, Homo sapiens
acagaugcacac

SEQ ID NO: 1994799 - RNA, 13 nt, Homo sapiens
ugccacagccaag

SEQ ID NO: 1994800 - RNA, 20 nt, Homo sapiens
agcaaucucggcucauugaa

SEQ ID NO: 1994801 - RNA, 14 nt, Homo sapiens
cuguagucucagga

SEQ ID NO: 1994802 - RNA, 19 nt, Homo sapiens
uuuaggaaaagugaaucuu

SEQ ID NO: 1994803 - RNA, 23 nt, Homo sapiens
ugaaaaggauauuaucuaccugu

SEQ ID NO: 1994804 - RNA, 15 nt, Homo sapiens
ucgauugauaugcuu

SEQ ID NO: 1994805 - RNA, 22 nt, Homo sapiens
ugccaagaccauuucacagaaa

SEQ ID NO: 1994806 - RNA, 20 nt, Homo sapiens
ccccaggaggcagcucagga

SEQ ID NO: 1994807 - RNA, 22 nt, Homo sapiens
aaugugcugaagcaaagugccc

SEQ ID NO: 1994808 - RNA, 22 nt, Homo sapiens
ggacaaauugagacagugcaca

SEQ ID NO: 1994809 - RNA, 19 nt, Homo sapiens
ucugcuugcucuuguccua

SEQ ID NO: 1994810 - RNA, 23 nt, Homo sapiens
ucaaucuguccguucacaugugu

SEQ ID NO: 1994811 - RNA, 18 nt, Homo sapiens
cuucauggaacucagcug

SEQ ID NO: 1994812 - RNA, 17 nt, Homo sapiens
cagcuucacccugaggu

SEQ ID NO: 1994813 - RNA, 16 nt, Homo sapiens
cuaaauguguacacaa

SEQ ID NO: 1994814 - RNA, 18 nt, Homo sapiens
acaaacaagaggacugug

SEQ ID NO: 1994815 - RNA, 14 nt, Homo sapiens
ccaguucugaaggu

SEQ ID NO: 1994816 - RNA, 13 nt, Homo sapiens
uuaauauacuaga

SEQ ID NO: 1994817 - RNA, 20 nt, Homo sapiens
ggcucaagcgauccucccac

SEQ ID NO: 1994818 - RNA, 12 nt, Homo sapiens
cuccauucccug

SEQ ID NO: 1994819 - RNA, 14 nt, Homo sapiens
ugaccccagcagcu

SEQ ID NO: 1994820 - RNA, 13 nt, Homo sapiens
guccccaccucag

SEQ ID NO: 1994821 - RNA, 23 nt, Homo sapiens
auuccugugcggacagcccuucc

SEQ ID NO: 1994822 - RNA, 13 nt, Homo sapiens
aucuaugcaauuu

SEQ ID NO: 1994823 - RNA, 18 nt, Homo sapiens
guccauuguggagccaaa

SEQ ID NO: 1994824 - RNA, 20 nt, Homo sapiens
auucucccauaaacacugaa

SEQ ID NO: 1994825 - RNA, 16 nt, Homo sapiens
cauugguccaagauuc

SEQ ID NO: 1994826 - RNA, 14 nt, Homo sapiens
ucuguaagagaauu

SEQ ID NO: 1994827 - RNA, 23 nt, Homo sapiens
cucuuccuugcuuucucuucuaa

SEQ ID NO: 1994828 - RNA, 9 nt, Homo sapiens
ugcccuccc

SEQ ID NO: 1994829 - RNA, 22 nt, Homo sapiens
aaaugucuaguuucuaguguca

SEQ ID NO: 1994830 - RNA, 17 nt, Homo sapiens
ccugaaaugacauuuca

SEQ ID NO: 1994831 - RNA, 19 nt, Homo sapiens
ugauugaaaauaguaaaug

SEQ ID NO: 1994832 - RNA, 22 nt, Homo sapiens
ccacaaucuuaaggggcagcuu

SEQ ID NO: 1994833 - RNA, 21 nt, Homo sapiens
aucuuuaacagcuuacacuga

SEQ ID NO: 1994834 - RNA, 13 nt, Homo sapiens
agcacacugaguu

SEQ ID NO: 1994835 - RNA, 18 nt, Homo sapiens
caauaacuacuguguucc

SEQ ID NO: 1994836 - RNA, 19 nt, Homo sapiens
gcucaacuuagagugaagg

SEQ ID NO: 1994837 - RNA, 19 nt, Homo sapiens
ugcaaacucaguuccaaag

SEQ ID NO: 1994838 - RNA, 15 nt, Homo sapiens
ugaugcccaggucac

SEQ ID NO: 1994839 - RNA, 15 nt, Homo sapiens
caaauccaugugucc

SEQ ID NO: 1994840 - RNA, 21 nt, Homo sapiens
uguuuauuauaaacaaaaagc

SEQ ID NO: 1994841 - RNA, 22 nt, Homo sapiens
cugcaucauaagcugauuugau

SEQ ID NO: 1994842 - RNA, 15 nt, Homo sapiens
acauucccagcaccu

SEQ ID NO: 1994843 - RNA, 16 nt, Homo sapiens
ucccuuggguucugau

SEQ ID NO: 1994844 - RNA, 20 nt, Homo sapiens
accaggagagagggcaaagg

SEQ ID NO: 1994845 - RNA, 14 nt, Homo sapiens
ugcugaacaucaca

SEQ ID NO: 1994846 - RNA, 24 nt, Homo sapiens
gaaguugaaugggcacagcaacuc

SEQ ID NO: 1994847 - RNA, 21 nt, Homo sapiens
aacucuggggcucaagcaguu

SEQ ID NO: 1994848 - RNA, 19 nt, Homo sapiens
uagauuuggacaaacaaga

SEQ ID NO: 1994849 - RNA, 19 nt, Homo sapiens
cauuuacacauauccacaa

SEQ ID NO: 1994850 - RNA, 22 nt, Homo sapiens
auguugcccuggcaccuguggc

SEQ ID NO: 1994851 - RNA, 22 nt, Homo sapiens
uccaaggcaguucuguguccuc

SEQ ID NO: 1994852 - RNA, 16 nt, Homo sapiens
cuaucuauauucauuu

SEQ ID NO: 1994853 - RNA, 15 nt, Homo sapiens
accuccaugucaucc

SEQ ID NO: 1994854 - RNA, 19 nt, Homo sapiens
auuuaaagaccugacagcu

SEQ ID NO: 1994855 - RNA, 21 nt, Homo sapiens
auccaccugcagcccuuuuag

SEQ ID NO: 1994856 - RNA, 15 nt, Homo sapiens
accccagcugaccug

SEQ ID NO: 1994857 - RNA, 15 nt, Homo sapiens
accugaccugauguc

SEQ ID NO: 1994858 - RNA, 22 nt, Homo sapiens
aacacuaauaauaguacuauua

SEQ ID NO: 1994859 - RNA, 13 nt, Homo sapiens
uuuuucuauauuc

SEQ ID NO: 1994860 - RNA, 13 nt, Homo sapiens
gggacuacaggca

SEQ ID NO: 1994861 - RNA, 16 nt, Homo sapiens
uuauuggauauuugau

SEQ ID NO: 1994862 - RNA, 16 nt, Homo sapiens
uuucugagugccuucu

SEQ ID NO: 1994863 - RNA, 11 nt, Homo sapiens
gcgcugcagua

SEQ ID NO: 1994864 - RNA, 20 nt, Homo sapiens
aaacacccuuuccaaagcaa

SEQ ID NO: 1994865 - RNA, 17 nt, Homo sapiens
caaaugaggauaucauc

SEQ ID NO: 1994866 - RNA, 13 nt, Homo sapiens
gaugcuaacugga

SEQ ID NO: 1994867 - RNA, 21 nt, Homo sapiens
ucaccaggggcaggcacagca

SEQ ID NO: 1994868 - RNA, 11 nt, Homo sapiens
cacagcugucu

SEQ ID NO: 1994869 - RNA, 18 nt, Homo sapiens
cauaaauaaaaguacagu

SEQ ID NO: 1994870 - RNA, 17 nt, Homo sapiens
uguguacucuuaggcua

SEQ ID NO: 1994871 - RNA, 16 nt, Homo sapiens
gagacagcccugccua

SEQ ID NO: 1994872 - RNA, 19 nt, Homo sapiens
uaagaaugguuuguaaaau

SEQ ID NO: 1994873 - RNA, 17 nt, Homo sapiens
ucauaccaguuguucau

SEQ ID NO: 1994874 - RNA, 16 nt, Homo sapiens
gucucacagaggcagu

SEQ ID NO: 1994875 - RNA, 16 nt, Homo sapiens
gagguggagucuugcu

SEQ ID NO: 1994876 - RNA, 16 nt, Homo sapiens
uguacaccaauauuca

SEQ ID NO: 1994877 - RNA, 13 nt, Homo sapiens
uccuuuugacaua

SEQ ID NO: 1994878 - RNA, 13 nt, Homo sapiens
uccauuugacaaa

SEQ ID NO: 1994879 - RNA, 13 nt, Homo sapiens
uucuagcuacaau

SEQ ID NO: 1994880 - RNA, 16 nt, Homo sapiens
agcaaaaaguauugaa

SEQ ID NO: 1994881 - RNA, 16 nt, Homo sapiens
ucuagauuaagauaug

SEQ ID NO: 1994882 - RNA, 14 nt, Homo sapiens
agaagguaacucuu

SEQ ID NO: 1994883 - RNA, 21 nt, Homo sapiens
agcagcucuuccccuuuccug

SEQ ID NO: 1994884 - RNA, 15 nt, Homo sapiens
auaugauuuagcaag

SEQ ID NO: 1994885 - RNA, 21 nt, Homo sapiens
uggcugacaguaacagcaucu

SEQ ID NO: 1994886 - RNA, 15 nt, Homo sapiens
cuagucuauucauua

SEQ ID NO: 1994887 - RNA, 10 nt, Homo sapiens
uuuucacuga

SEQ ID NO: 1994888 - RNA, 20 nt, Homo sapiens
gagucauuauguagcugucg

SEQ ID NO: 1994889 - RNA, 22 nt, Homo sapiens
ggacagaauuggauacauacac

SEQ ID NO: 1994890 - RNA, 15 nt, Homo sapiens
cccugaccacucaga

SEQ ID NO: 1994891 - RNA, 19 nt, Homo sapiens
guagagguauguuugugaa

SEQ ID NO: 1994892 - RNA, 12 nt, Homo sapiens
aauuguuugacc

SEQ ID NO: 1994893 - RNA, 17 nt, Homo sapiens
cuuccaugauacuuuaa

SEQ ID NO: 1994894 - RNA, 23 nt, Homo sapiens
ugccacccaggcuggagugcagu

SEQ ID NO: 1994895 - RNA, 19 nt, Homo sapiens
auggacaugcuaccugaaa

SEQ ID NO: 1994896 - RNA, 20 nt, Homo sapiens
ccauacauaauauaugacuu

SEQ ID NO: 1994897 - RNA, 13 nt, Homo sapiens
cagcucugagauc

SEQ ID NO: 1994898 - RNA, 23 nt, Homo sapiens
uaagccaacaaccacagugccac

SEQ ID NO: 1994899 - RNA, 14 nt, Homo sapiens
ucuucaauagcuaa

SEQ ID NO: 1994900 - RNA, 19 nt, Homo sapiens
uccacauaacccugucacc

SEQ ID NO: 1994901 - RNA, 13 nt, Homo sapiens
ucuggacauuuca

SEQ ID NO: 1994902 - RNA, 23 nt, Homo sapiens
uccuggcaaucaauacagcuuca

SEQ ID NO: 1994903 - RNA, 23 nt, Homo sapiens
cauucaguuaauucaaugugaac

SEQ ID NO: 1994904 - RNA, 17 nt, Homo sapiens
caacaccuuaauaugcu

SEQ ID NO: 1994905 - RNA, 14 nt, Homo sapiens
gcauacagccuuug

SEQ ID NO: 1994906 - RNA, 13 nt, Homo sapiens
agacaccacagac

SEQ ID NO: 1994907 - RNA, 14 nt, Homo sapiens
gcccagucauaugu

SEQ ID NO: 1994908 - RNA, 12 nt, Homo sapiens
acuuuucacuua

SEQ ID NO: 1994909 - RNA, 15 nt, Homo sapiens
auguaggacuguaua

SEQ ID NO: 1994910 - RNA, 16 nt, Homo sapiens
aucuaaugugaaguag

SEQ ID NO: 1994911 - RNA, 19 nt, Homo sapiens
gauuggcuauaacaugucu

SEQ ID NO: 1994912 - RNA, 14 nt, Homo sapiens
auugacaacacagc

SEQ ID NO: 1994913 - RNA, 13 nt, Homo sapiens
uccuaaucauaca

SEQ ID NO: 1994914 - RNA, 12 nt, Homo sapiens
cuaauacuacug

SEQ ID NO: 1994915 - RNA, 11 nt, Homo sapiens
agaauccaaag

SEQ ID NO: 1994916 - RNA, 18 nt, Homo sapiens
agauucuucgcacagugu

SEQ ID NO: 1994917 - RNA, 14 nt, Homo sapiens
aggaccccugagua

SEQ ID NO: 1994918 - RNA, 19 nt, Homo sapiens
cauggcaccuuuugcacau

SEQ ID NO: 1994919 - RNA, 18 nt, Homo sapiens
uacuuuacagacaggaaa

SEQ ID NO: 1994920 - RNA, 21 nt, Homo sapiens
gcaaguaugugagugugucca

SEQ ID NO: 1994921 - RNA, 20 nt, Homo sapiens
auugcaugaauucacaaaca

SEQ ID NO: 1994922 - RNA, 14 nt, Homo sapiens
agcccggacugacc

SEQ ID NO: 1994923 - RNA, 21 nt, Homo sapiens
uaaagccaacacccugucuaa

SEQ ID NO: 1994924 - RNA, 14 nt, Homo sapiens
ggucucuuucuuuu

SEQ ID NO: 1994925 - RNA, 19 nt, Homo sapiens
caguuuauggauaugcugc

SEQ ID NO: 1994926 - RNA, 15 nt, Homo sapiens
acggaugaguuauua

SEQ ID NO: 1994927 - RNA, 13 nt, Homo sapiens
caccugggucuuu

SEQ ID NO: 1994928 - RNA, 19 nt, Homo sapiens
ugaggaggagacagccuca

SEQ ID NO: 1994929 - RNA, 21 nt, Homo sapiens
uaucuacccaagggcagaaag

SEQ ID NO: 1994930 - RNA, 18 nt, Homo sapiens
ggucacuaaccaagccag

SEQ ID NO: 1994931 - RNA, 14 nt, Homo sapiens
cacuugaugccacc

SEQ ID NO: 1994932 - RNA, 18 nt, Homo sapiens
acauucaagagagcucgu

SEQ ID NO: 1994933 - RNA, 14 nt, Homo sapiens
caaauaaaaauccu

SEQ ID NO: 1994934 - RNA, 23 nt, Homo sapiens
uaaagagagagagagagaauucc

SEQ ID NO: 1994935 - RNA, 18 nt, Homo sapiens
acccaguggcagggcaca

SEQ ID NO: 1994936 - RNA, 12 nt, Homo sapiens
guguuccagugu

SEQ ID NO: 1994937 - RNA, 15 nt, Homo sapiens
ccaauuaauguagcu

SEQ ID NO: 1994938 - RNA, 18 nt, Homo sapiens
gcugggucaccagaaaua

SEQ ID NO: 1994939 - RNA, 19 nt, Homo sapiens
aggguguugcagagaggga

SEQ ID NO: 1994940 - RNA, 14 nt, Homo sapiens
uaccccuuacaaau

SEQ ID NO: 1994941 - RNA, 18 nt, Homo sapiens
auucagccucgucucuuu

SEQ ID NO: 1994942 - RNA, 15 nt, Homo sapiens
gguaguggggaccaa

SEQ ID NO: 1994943 - RNA, 12 nt, Homo sapiens
uaaaacuagcaa

SEQ ID NO: 1994944 - RNA, 20 nt, Homo sapiens
ccuguaaucccagcuacucg

SEQ ID NO: 1994945 - RNA, 19 nt, Homo sapiens
ugacgcagcacaagcucag

SEQ ID NO: 1994946 - RNA, 14 nt, Homo sapiens
caauaaaacugcua

SEQ ID NO: 1994947 - RNA, 23 nt, Homo sapiens
acaugaacguuuucucuucaccg

SEQ ID NO: 1994948 - RNA, 14 nt, Homo sapiens
gagcacagccauag

SEQ ID NO: 1994949 - RNA, 21 nt, Homo sapiens
uaggaguucucugaugcagaa

SEQ ID NO: 1994950 - RNA, 21 nt, Homo sapiens
agagacuaauagagacacaga

SEQ ID NO: 1994951 - RNA, 20 nt, Homo sapiens
ugaggucaucccggggccau

SEQ ID NO: 1994952 - RNA, 20 nt, Homo sapiens
uaauguacacauugcauuuu

SEQ ID NO: 1994953 - RNA, 17 nt, Homo sapiens
cucuacuaaaaauacaa

SEQ ID NO: 1994954 - RNA, 21 nt, Homo sapiens
gaauuaguugcauugguuuga

SEQ ID NO: 1994955 - RNA, 15 nt, Homo sapiens
ggagauguccugaau

SEQ ID NO: 1994956 - RNA, 14 nt, Homo sapiens
uggugucuucaggg

SEQ ID NO: 1994957 - RNA, 22 nt, Homo sapiens
uuauugguguaagguacuuuca

SEQ ID NO: 1994958 - RNA, 15 nt, Homo sapiens
uaaaaaauggagcuc

SEQ ID NO: 1994959 - RNA, 19 nt, Homo sapiens
aguucuuaguugcuggcuc

SEQ ID NO: 1994960 - RNA, 14 nt, Homo sapiens
gcucccaacagagg

SEQ ID NO: 1994961 - RNA, 21 nt, Homo sapiens
gcaacccacguguaacuguca

SEQ ID NO: 1994962 - RNA, 14 nt, Homo sapiens
cuggaaaugcugac

SEQ ID NO: 1994963 - RNA, 14 nt, Homo sapiens
uccaugucaggcca

SEQ ID NO: 1994964 - RNA, 21 nt, Homo sapiens
aauuauaagcauacaacugga

SEQ ID NO: 1994965 - RNA, 12 nt, Homo sapiens
guuuuuugccag

SEQ ID NO: 1994966 - RNA, 21 nt, Homo sapiens
acaagguagacauggauuuga

SEQ ID NO: 1994967 - RNA, 20 nt, Homo sapiens
agcuacuauguacugccuua

SEQ ID NO: 1994968 - RNA, 17 nt, Homo sapiens
cuuggagagcaaaggcc

SEQ ID NO: 1994969 - RNA, 16 nt, Homo sapiens
uauccuaguuccauuc

SEQ ID NO: 1994970 - RNA, 20 nt, Homo sapiens
uugaauacucugaaaccgaa

SEQ ID NO: 1994971 - RNA, 19 nt, Homo sapiens
auuuguaacuuuguugcau

SEQ ID NO: 1994972 - RNA, 12 nt, Homo sapiens
ccuccugcugag

SEQ ID NO: 1994973 - RNA, 20 nt, Homo sapiens
ccaauuucaaaaugucucaa

SEQ ID NO: 1994974 - RNA, 19 nt, Homo sapiens
gugacacaacucauccaga

SEQ ID NO: 1994975 - RNA, 18 nt, Homo sapiens
agauggaauaaagcccuu

SEQ ID NO: 1994976 - RNA, 12 nt, Homo sapiens
accugcucuccg

SEQ ID NO: 1994977 - RNA, 23 nt, Homo sapiens
uuagcuuucccugugccacuuug

SEQ ID NO: 1994978 - RNA, 18 nt, Homo sapiens
cuuauuuugcauuccaga

SEQ ID NO: 1994979 - RNA, 17 nt, Homo sapiens
uucaguccacaguacau

SEQ ID NO: 1994980 - RNA, 13 nt, Homo sapiens
aaggaaauacuuu

SEQ ID NO: 1994981 - RNA, 17 nt, Homo sapiens
cgacguuugacuagcca

SEQ ID NO: 1994982 - RNA, 17 nt, Homo sapiens
ucaauauuaaaugacuu

SEQ ID NO: 1994983 - RNA, 18 nt, Homo sapiens
uaauccaguuuagaaagu

SEQ ID NO: 1994984 - RNA, 17 nt, Homo sapiens
uaacaugggcaaaggga

SEQ ID NO: 1994985 - RNA, 18 nt, Homo sapiens
uccaucagaaaaccaaag

SEQ ID NO: 1994986 - RNA, 18 nt, Homo sapiens
ugcacaaggaaauaaagc

SEQ ID NO: 1994987 - RNA, 22 nt, Homo sapiens
cucggugucuaugcaaggccgc

SEQ ID NO: 1994988 - RNA, 17 nt, Homo sapiens
cuugaaaccaguauuua

SEQ ID NO: 1994989 - RNA, 11 nt, Homo sapiens
cugcugagcug

SEQ ID NO: 1994990 - RNA, 18 nt, Homo sapiens
uucccagaaucaaagcaa

SEQ ID NO: 1994991 - RNA, 14 nt, Homo sapiens
uaaagugaacuuug

SEQ ID NO: 1994992 - RNA, 23 nt, Homo sapiens
uaauacugguauuuuuacuuaau

SEQ ID NO: 1994993 - RNA, 17 nt, Homo sapiens
gaagaguuauaaaguau

SEQ ID NO: 1994994 - RNA, 18 nt, Homo sapiens
uacagauguaaaugccac

SEQ ID NO: 1994995 - RNA, 22 nt, Homo sapiens
ucaugcuggaaccugcaaaaaa

SEQ ID NO: 1994996 - RNA, 17 nt, Homo sapiens
aggcagagccagugugc

SEQ ID NO: 1994997 - RNA, 21 nt, Homo sapiens
uggaugcuggguccauaucac

SEQ ID NO: 1994998 - RNA, 14 nt, Homo sapiens
acccuucucaggga

SEQ ID NO: 1994999 - RNA, 18 nt, Homo sapiens
agaauauaauacuguauu

SEQ ID NO: 1995000 - RNA, 22 nt, Homo sapiens
gaacugccaggcccggccaaaa

SEQ ID NO: 1995001 - RNA, 22 nt, Homo sapiens
uuaagagggaacuuagcagaga

SEQ ID NO: 1995002 - RNA, 21 nt, Homo sapiens
agcaggcagcgccaagugcgu

SEQ ID NO: 1995003 - RNA, 17 nt, Homo sapiens
agaaaacaaguauauaa

SEQ ID NO: 1995004 - RNA, 16 nt, Homo sapiens
aauaauuuccuacaca

SEQ ID NO: 1995005 - RNA, 16 nt, Homo sapiens
ccuuaauuaauucuca

SEQ ID NO: 1995006 - RNA, 23 nt, Homo sapiens
acuaugaaugggcaaaacugaau

SEQ ID NO: 1995007 - RNA, 17 nt, Homo sapiens
acacuaucaacacugca

SEQ ID NO: 1995008 - RNA, 17 nt, Homo sapiens
gagaaaagccucuccag

SEQ ID NO: 1995009 - RNA, 15 nt, Homo sapiens
uagccaaugucuccu

SEQ ID NO: 1995010 - RNA, 16 nt, Homo sapiens
gacucucugccugcuu

SEQ ID NO: 1995011 - RNA, 16 nt, Homo sapiens
ugaaaagaagccucag

SEQ ID NO: 1995012 - RNA, 20 nt, Homo sapiens
cuguccccacagcuucucua

SEQ ID NO: 1995013 - RNA, 15 nt, Homo sapiens
aagccuauucacuug

SEQ ID NO: 1995014 - RNA, 22 nt, Homo sapiens
ucacuaggcccccacuugccuc

SEQ ID NO: 1995015 - RNA, 15 nt, Homo sapiens
aauuuucagcauuaa

SEQ ID NO: 1995016 - RNA, 21 nt, Homo sapiens
cacauaauuuugugcaugaaa

SEQ ID NO: 1995017 - RNA, 14 nt, Homo sapiens
gguuuuuccagcua

SEQ ID NO: 1995018 - RNA, 15 nt, Homo sapiens
aaucugggaccaaaa

SEQ ID NO: 1995019 - RNA, 22 nt, Homo sapiens
uuguggcaucagauaaugccac

SEQ ID NO: 1995020 - RNA, 14 nt, Homo sapiens
ugaagggcuuuauu

SEQ ID NO: 1995021 - RNA, 18 nt, Homo sapiens
aaugacaugcacugaccc

SEQ ID NO: 1995022 - RNA, 14 nt, Homo sapiens
gccacuuucugcca

SEQ ID NO: 1995023 - RNA, 22 nt, Homo sapiens
augcuuauuguacuuguuauca

SEQ ID NO: 1995024 - RNA, 19 nt, Homo sapiens
aggcacgugccugucucau

SEQ ID NO: 1995025 - RNA, 19 nt, Homo sapiens
uuuaaaaauaucugaauau

SEQ ID NO: 1995026 - RNA, 20 nt, Homo sapiens
ccuguacccauucuguucca

SEQ ID NO: 1995027 - RNA, 21 nt, Homo sapiens
ugaacacuugaagccaucuaa

SEQ ID NO: 1995028 - RNA, 14 nt, Homo sapiens
augguguguuaaag

SEQ ID NO: 1995029 - RNA, 20 nt, Homo sapiens
gcuaguauucgcuguguuca

SEQ ID NO: 1995030 - RNA, 15 nt, Homo sapiens
aguaaauaacuggaa

SEQ ID NO: 1995031 - RNA, 18 nt, Homo sapiens
cuccucaaacccagucuc

SEQ ID NO: 1995032 - RNA, 17 nt, Homo sapiens
acuaaacauguauguaa

SEQ ID NO: 1995033 - RNA, 16 nt, Homo sapiens
ucccugacacccuggg

SEQ ID NO: 1995034 - RNA, 16 nt, Homo sapiens
agcucagugccacaaa

SEQ ID NO: 1995035 - RNA, 18 nt, Homo sapiens
ugggaacucgaacuugaa

SEQ ID NO: 1995036 - RNA, 18 nt, Homo sapiens
ucccccucccaguacuag

SEQ ID NO: 1995037 - RNA, 15 nt, Homo sapiens
aaaaucacacuguaa

SEQ ID NO: 1995038 - RNA, 17 nt, Homo sapiens
cgcucucagcugaccau

SEQ ID NO: 1995039 - RNA, 13 nt, Homo sapiens
ggcacaauuccug

SEQ ID NO: 1995040 - RNA, 16 nt, Homo sapiens
cacucugaagauccca

SEQ ID NO: 1995041 - RNA, 15 nt, Homo sapiens
agcccauaaagcaag

SEQ ID NO: 1995042 - RNA, 21 nt, Homo sapiens
aaagcuggugucugauuuugg

SEQ ID NO: 1995043 - RNA, 22 nt, Homo sapiens
cauguuauuaaacguaugcaug

SEQ ID NO: 1995044 - RNA, 17 nt, Homo sapiens
accccaguggauucuca

SEQ ID NO: 1995045 - RNA, 19 nt, Homo sapiens
uuagggaaggacaaaggcc

SEQ ID NO: 1995046 - RNA, 16 nt, Homo sapiens
acauggcugacuuugc

SEQ ID NO: 1995047 - RNA, 16 nt, Homo sapiens
ucagguguugccaaau

SEQ ID NO: 1995048 - RNA, 16 nt, Homo sapiens
ucagcaccugggaccc

SEQ ID NO: 1995049 - RNA, 15 nt, Homo sapiens
gcaaguuuaaucaau

SEQ ID NO: 1995050 - RNA, 22 nt, Homo sapiens
gaacuucuccuacuguagcaac

SEQ ID NO: 1995051 - RNA, 16 nt, Homo sapiens
uagaauggggcuucca

SEQ ID NO: 1995052 - RNA, 15 nt, Homo sapiens
uaucaccucauggcc

SEQ ID NO: 1995053 - RNA, 19 nt, Homo sapiens
augugaaaauaaagcagaa

SEQ ID NO: 1995054 - RNA, 13 nt, Homo sapiens
uggaacucuugcu

SEQ ID NO: 1995055 - RNA, 19 nt, Homo sapiens
uguuaacuguuaguauuaa

SEQ ID NO: 1995056 - RNA, 17 nt, Homo sapiens
cugccagccccaugcca

SEQ ID NO: 1995057 - RNA, 22 nt, Homo sapiens
accccuuguuuagcauauaauc

SEQ ID NO: 1995058 - RNA, 18 nt, Homo sapiens
cugucagcccacagcagc

SEQ ID NO: 1995059 - RNA, 21 nt, Homo sapiens
ugaagaaacuacuaaucucaa

SEQ ID NO: 1995060 - RNA, 23 nt, Homo sapiens
aguaaaaauaaauaaaacagcag

SEQ ID NO: 1995061 - RNA, 19 nt, Homo sapiens
gaucccccgccccauccuc

SEQ ID NO: 1995062 - RNA, 13 nt, Homo sapiens
aucaaaagacuuu

SEQ ID NO: 1995063 - RNA, 18 nt, Homo sapiens
cuugcuggaacacagggg

SEQ ID NO: 1995064 - RNA, 17 nt, Homo sapiens
ugagcguccaggugauc

SEQ ID NO: 1995065 - RNA, 20 nt, Homo sapiens
uccacuggagaauugaaaag

SEQ ID NO: 1995066 - RNA, 20 nt, Homo sapiens
auuugaaaacaaacuucucg

SEQ ID NO: 1995067 - RNA, 15 nt, Homo sapiens
acaaaauugcagaua

SEQ ID NO: 1995068 - RNA, 13 nt, Homo sapiens
augcauaacaaac

SEQ ID NO: 1995069 - RNA, 20 nt, Homo sapiens
cuucauagauuaugcuuuaa

SEQ ID NO: 1995070 - RNA, 12 nt, Homo sapiens
uuuccuuugcua

SEQ ID NO: 1995071 - RNA, 18 nt, Homo sapiens
uugcaugaaauuuugccu

SEQ ID NO: 1995072 - RNA, 13 nt, Homo sapiens
ugccaucaugccu

SEQ ID NO: 1995073 - RNA, 13 nt, Homo sapiens
aaugagacuugcc

SEQ ID NO: 1995074 - RNA, 13 nt, Homo sapiens
caaugaccaaaca

SEQ ID NO: 1995075 - RNA, 20 nt, Homo sapiens
ucugagagaccugugugaac

SEQ ID NO: 1995076 - RNA, 18 nt, Homo sapiens
cuacaugaaauaaugcac

SEQ ID NO: 1995077 - RNA, 17 nt, Homo sapiens
caaaccugaccacagaa

SEQ ID NO: 1995078 - RNA, 18 nt, Homo sapiens
aacuccuacuaaaucccu

SEQ ID NO: 1995079 - RNA, 22 nt, Homo sapiens
uaaaugcucuaacuggacauga

SEQ ID NO: 1995080 - RNA, 16 nt, Homo sapiens
cagagaccaguauucc

SEQ ID NO: 1995081 - RNA, 22 nt, Homo sapiens
gugggacccugccagacugaag

SEQ ID NO: 1995082 - RNA, 15 nt, Homo sapiens
ugaguggucaggcau

SEQ ID NO: 1995083 - RNA, 22 nt, Homo sapiens
uguacuuuauuuguauuugcca

SEQ ID NO: 1995084 - RNA, 20 nt, Homo sapiens
auguguccuuucaaggggaa

SEQ ID NO: 1995085 - RNA, 15 nt, Homo sapiens
caaccuacucugcaa

SEQ ID NO: 1995086 - RNA, 23 nt, Homo sapiens
uuuugauuaagugguuacuuugu

SEQ ID NO: 1995087 - RNA, 23 nt, Homo sapiens
cccuaaagaaugcaaccuaguca

SEQ ID NO: 1995088 - RNA, 21 nt, Homo sapiens
augcagccuucaccauggauc

SEQ ID NO: 1995089 - RNA, 17 nt, Homo sapiens
cauaauaagcuaaagag

SEQ ID NO: 1995090 - RNA, 21 nt, Homo sapiens
gcuguuuggauuauuccucua

SEQ ID NO: 1995091 - RNA, 16 nt, Homo sapiens
cacuccugcuguaaau

SEQ ID NO: 1995092 - RNA, 15 nt, Homo sapiens
accccacucuaccuc

SEQ ID NO: 1995093 - RNA, 20 nt, Homo sapiens
aacuacagaaagagcgucau

SEQ ID NO: 1995094 - RNA, 21 nt, Homo sapiens
uuaacagcgugucaacuuuca

SEQ ID NO: 1995095 - RNA, 14 nt, Homo sapiens
aucacucauuuauu

SEQ ID NO: 1995096 - RNA, 20 nt, Homo sapiens
auugcgaccauuucucagca

SEQ ID NO: 1995097 - RNA, 23 nt, Homo sapiens
cugacccgguugcagucacugug

SEQ ID NO: 1995098 - RNA, 23 nt, Homo sapiens
aucaaacaugcauggaugggucc

SEQ ID NO: 1995099 - RNA, 21 nt, Homo sapiens
cugccagguuuaaacaucacu

SEQ ID NO: 1995100 - RNA, 22 nt, Homo sapiens
ccaggcugccuggucacugccc

SEQ ID NO: 1995101 - RNA, 14 nt, Homo sapiens
gcaggaaacuaacu

SEQ ID NO: 1995102 - RNA, 19 nt, Homo sapiens
cagcuucccgaguaccagu

SEQ ID NO: 1995103 - RNA, 14 nt, Homo sapiens
ucagaaaagcuauu

SEQ ID NO: 1995104 - RNA, 21 nt, Homo sapiens
ccugaguuuuacccagacuca

SEQ ID NO: 1995105 - RNA, 16 nt, Homo sapiens
cugccaagauacuuga

SEQ ID NO: 1995106 - RNA, 18 nt, Homo sapiens
ccauucacagccaggaga

SEQ ID NO: 1995107 - RNA, 17 nt, Homo sapiens
aacaagacccccaggaa

SEQ ID NO: 1995108 - RNA, 17 nt, Homo sapiens
cuuucugcccuucuccc

SEQ ID NO: 1995109 - RNA, 17 nt, Homo sapiens
ucucuagugucuuuugc

SEQ ID NO: 1995110 - RNA, 18 nt, Homo sapiens
uguaaccuaccuuaucau

SEQ ID NO: 1995111 - RNA, 21 nt, Homo sapiens
uagucuugacgaauauugcuu

SEQ ID NO: 1995112 - RNA, 15 nt, Homo sapiens
cuaacaggccaaaga

SEQ ID NO: 1995113 - RNA, 21 nt, Homo sapiens
cuugucagugcucggcuguaa

SEQ ID NO: 1995114 - RNA, 15 nt, Homo sapiens
aaaacauuaccaucc

SEQ ID NO: 1995115 - RNA, 13 nt, Homo sapiens
cauucaguuauca

SEQ ID NO: 1995116 - RNA, 18 nt, Homo sapiens
caucaguauugaagcauu

SEQ ID NO: 1995117 - RNA, 21 nt, Homo sapiens
uuuccacauaaagguauuuag

SEQ ID NO: 1995118 - RNA, 21 nt, Homo sapiens
uaaaacaagagaccacuuccu

SEQ ID NO: 1995119 - RNA, 19 nt, Homo sapiens
aaguguuucguaagacaaa

SEQ ID NO: 1995120 - RNA, 15 nt, Homo sapiens
caugugcuugugccu

SEQ ID NO: 1995121 - RNA, 12 nt, Homo sapiens
guacaguacuca

SEQ ID NO: 1995122 - RNA, 14 nt, Homo sapiens
agcgggcacagggc

SEQ ID NO: 1995123 - RNA, 20 nt, Homo sapiens
acagcuuuggggugucuuuu

SEQ ID NO: 1995124 - RNA, 16 nt, Homo sapiens
cuugaaauaccaguga

SEQ ID NO: 1995125 - RNA, 23 nt, Homo sapiens
ucauuguuaauauaacugucuua

SEQ ID NO: 1995126 - RNA, 21 nt, Homo sapiens
gacugacccugaucagucuaa

SEQ ID NO: 1995127 - RNA, 20 nt, Homo sapiens
aacauagacucacucuucca

SEQ ID NO: 1995128 - RNA, 14 nt, Homo sapiens
cauucugauccuca

SEQ ID NO: 1995129 - RNA, 15 nt, Homo sapiens
acugagagaagguga

SEQ ID NO: 1995130 - RNA, 18 nt, Homo sapiens
gugcuuucuccauuuauu

SEQ ID NO: 1995131 - RNA, 24 nt, Homo sapiens
aacucuccuuugcucucuggccac

SEQ ID NO: 1995132 - RNA, 14 nt, Homo sapiens
gccaccaguguccu

SEQ ID NO: 1995133 - RNA, 16 nt, Homo sapiens
ugaccgcagguugcuu

SEQ ID NO: 1995134 - RNA, 20 nt, Homo sapiens
augccuuacgaaccaugccu

SEQ ID NO: 1995135 - RNA, 14 nt, Homo sapiens
ucuaccugcaagau

SEQ ID NO: 1995136 - RNA, 14 nt, Homo sapiens
acggugcugugagg

SEQ ID NO: 1995137 - RNA, 15 nt, Homo sapiens
aaaaccuuuuacugg

SEQ ID NO: 1995138 - RNA, 13 nt, Homo sapiens
aacaguaucuuug

SEQ ID NO: 1995139 - RNA, 13 nt, Homo sapiens
aauaauaucucua

SEQ ID NO: 1995140 - RNA, 15 nt, Homo sapiens
auaucacaguauuau

SEQ ID NO: 1995141 - RNA, 20 nt, Homo sapiens
ucaagcuaccuucaugucac

SEQ ID NO: 1995142 - RNA, 16 nt, Homo sapiens
agacucgcuagcacuc

SEQ ID NO: 1995143 - RNA, 20 nt, Homo sapiens
acauagccucaccaagguga

SEQ ID NO: 1995144 - RNA, 19 nt, Homo sapiens
ucaaguagacuacuguuca

SEQ ID NO: 1995145 - RNA, 22 nt, Homo sapiens
uggcuguguuuucaaugcacaa

SEQ ID NO: 1995146 - RNA, 22 nt, Homo sapiens
gaauuuuaugucauauaucaaa

SEQ ID NO: 1995147 - RNA, 21 nt, Homo sapiens
cugggugauggaaacugccaa

SEQ ID NO: 1995148 - RNA, 20 nt, Homo sapiens
gccaugaagaggaugcugug

SEQ ID NO: 1995149 - RNA, 16 nt, Homo sapiens
ugaguauugaaugaua

SEQ ID NO: 1995150 - RNA, 20 nt, Homo sapiens
uccaugauuauuaguugacc

SEQ ID NO: 1995151 - RNA, 17 nt, Homo sapiens
aagcucaugcauuucaa

SEQ ID NO: 1995152 - RNA, 22 nt, Homo sapiens
ugcugacugggucagccuuccg

SEQ ID NO: 1995153 - RNA, 15 nt, Homo sapiens
gagcaaaauaaugca

SEQ ID NO: 1995154 - RNA, 18 nt, Homo sapiens
auuccuuuccacuccaac

SEQ ID NO: 1995155 - RNA, 17 nt, Homo sapiens
auugcuggagacuacaa

SEQ ID NO: 1995156 - RNA, 21 nt, Homo sapiens
cuuuacuaauaaacuguguag

SEQ ID NO: 1995157 - RNA, 22 nt, Homo sapiens
caauuucacauggacuuuggaa

SEQ ID NO: 1995158 - RNA, 14 nt, Homo sapiens
aacuuagcacuacu

SEQ ID NO: 1995159 - RNA, 19 nt, Homo sapiens
ccuugggaaggaaggcagu

SEQ ID NO: 1995160 - RNA, 17 nt, Homo sapiens
guacuggaaaagcccuu

SEQ ID NO: 1995161 - RNA, 12 nt, Homo sapiens
auaugugcuugu

SEQ ID NO: 1995162 - RNA, 17 nt, Homo sapiens
agggguagaaguggcau

SEQ ID NO: 1995163 - RNA, 15 nt, Homo sapiens
cucacauaucuguca

SEQ ID NO: 1995164 - RNA, 16 nt, Homo sapiens
cacucagcacucugga

SEQ ID NO: 1995165 - RNA, 12 nt, Homo sapiens
agccuaacacgg

SEQ ID NO: 1995166 - RNA, 14 nt, Homo sapiens
cauaugcuguggac

SEQ ID NO: 1995167 - RNA, 19 nt, Homo sapiens
ucauauuauuuuagugugu

SEQ ID NO: 1995168 - RNA, 13 nt, Homo sapiens
cuggugcuccugc

SEQ ID NO: 1995169 - RNA, 15 nt, Homo sapiens
uaucaacauguuauu

SEQ ID NO: 1995170 - RNA, 22 nt, Homo sapiens
gacuauguuccaauaaaacuuu

SEQ ID NO: 1995171 - RNA, 23 nt, Homo sapiens
auagucacauggccuaugcacau

SEQ ID NO: 1995172 - RNA, 11 nt, Homo sapiens
aucccaugagc

SEQ ID NO: 1995173 - RNA, 18 nt, Homo sapiens
aacuuaacgugaucauca

SEQ ID NO: 1995174 - RNA, 19 nt, Homo sapiens
aaucaaaagggccaaagaa

SEQ ID NO: 1995175 - RNA, 18 nt, Homo sapiens
cagauuuucggaacacau

SEQ ID NO: 1995176 - RNA, 21 nt, Homo sapiens
aguuuucaaagaucccgugaa

SEQ ID NO: 1995177 - RNA, 13 nt, Homo sapiens
uguaugccuauuc

SEQ ID NO: 1995178 - RNA, 12 nt, Homo sapiens
ucacugucaggg

SEQ ID NO: 1995179 - RNA, 16 nt, Homo sapiens
ucaugugccuugaaca

SEQ ID NO: 1995180 - RNA, 16 nt, Homo sapiens
uccacaucuuuacuca

SEQ ID NO: 1995181 - RNA, 16 nt, Homo sapiens
augcagaaguuacuaa

SEQ ID NO: 1995182 - RNA, 13 nt, Homo sapiens
uucuucaaccuca

SEQ ID NO: 1995183 - RNA, 22 nt, Homo sapiens
cagcaucucagaguccagucaa

SEQ ID NO: 1995184 - RNA, 23 nt, Homo sapiens
agauuuuucugugaaagcucuca

SEQ ID NO: 1995185 - RNA, 11 nt, Homo sapiens
uuugcauuugc

SEQ ID NO: 1995186 - RNA, 17 nt, Homo sapiens
cauucaauuagugguca

SEQ ID NO: 1995187 - RNA, 17 nt, Homo sapiens
aaggaguagaauaccaa

SEQ ID NO: 1995188 - RNA, 16 nt, Homo sapiens
uaaauuggcuaaucag

SEQ ID NO: 1995189 - RNA, 19 nt, Homo sapiens
augacuuaaggugaaguga

SEQ ID NO: 1995190 - RNA, 22 nt, Homo sapiens
uuggugaauuucacaagcuauu

SEQ ID NO: 1995191 - RNA, 21 nt, Homo sapiens
gcaccaggagugccuucauac

SEQ ID NO: 1995192 - RNA, 19 nt, Homo sapiens
auuggccacacacugaguu

SEQ ID NO: 1995193 - RNA, 17 nt, Homo sapiens
agaaguuaacuacagug

SEQ ID NO: 1995194 - RNA, 22 nt, Homo sapiens
gccaaagcuggcuuuuugucaa

SEQ ID NO: 1995195 - RNA, 16 nt, Homo sapiens
gguaauuccaagugaa

SEQ ID NO: 1995196 - RNA, 19 nt, Homo sapiens
uagcaucuucucauuccca

SEQ ID NO: 1995197 - RNA, 15 nt, Homo sapiens
agaccauagugacca

SEQ ID NO: 1995198 - RNA, 12 nt, Homo sapiens
uuaguugagggg

SEQ ID NO: 1995199 - RNA, 20 nt, Homo sapiens
ucugauuaguugacaguauu

SEQ ID NO: 1995200 - RNA, 13 nt, Homo sapiens
uaaugauacugau

SEQ ID NO: 1995201 - RNA, 12 nt, Homo sapiens
uaccagcagcug

SEQ ID NO: 1995202 - RNA, 20 nt, Homo sapiens
agggugagacuccaucucaa

SEQ ID NO: 1995203 - RNA, 12 nt, Homo sapiens
aggaagaaggcc

SEQ ID NO: 1995204 - RNA, 16 nt, Homo sapiens
caagagcuuccagagc

SEQ ID NO: 1995205 - RNA, 14 nt, Homo sapiens
ugcaauuugcacaa

SEQ ID NO: 1995206 - RNA, 17 nt, Homo sapiens
ggccaccgccagagcuc

SEQ ID NO: 1995207 - RNA, 22 nt, Homo sapiens
caaugggaccgugccccaccuc

SEQ ID NO: 1995208 - RNA, 20 nt, Homo sapiens
cuuggagggauaagccagcu

SEQ ID NO: 1995209 - RNA, 20 nt, Homo sapiens
uccucaaagauucugcauuu

SEQ ID NO: 1995210 - RNA, 14 nt, Homo sapiens
acucugcacugaau

SEQ ID NO: 1995211 - RNA, 19 nt, Homo sapiens
cuggaacagaaaaagauca

SEQ ID NO: 1995212 - RNA, 19 nt, Homo sapiens
aaggaaagaaaacaucuuu

SEQ ID NO: 1995213 - RNA, 20 nt, Homo sapiens
ugccaguuuaaucauugccu

SEQ ID NO: 1995214 - RNA, 21 nt, Homo sapiens
ccuuauguagguugccagcua

SEQ ID NO: 1995215 - RNA, 20 nt, Homo sapiens
accuccauuaaauuugguac

SEQ ID NO: 1995216 - RNA, 20 nt, Homo sapiens
gugcuuuuaaaaaaaaauac

SEQ ID NO: 1995217 - RNA, 20 nt, Homo sapiens
uaaauuuuuuauaaaagugu

SEQ ID NO: 1995218 - RNA, 21 nt, Homo sapiens
uguguccuucuacuccagcau

SEQ ID NO: 1995219 - RNA, 24 nt, Homo sapiens
cucauucagggauagcacugagca

SEQ ID NO: 1995220 - RNA, 16 nt, Homo sapiens
ugccauuccgaccuuc

SEQ ID NO: 1995221 - RNA, 16 nt, Homo sapiens
caaccuacucugcaaa

SEQ ID NO: 1995222 - RNA, 16 nt, Homo sapiens
aggucccugugagcac

SEQ ID NO: 1995223 - RNA, 21 nt, Homo sapiens
ugaaacacucaguuguucaau

SEQ ID NO: 1995224 - RNA, 14 nt, Homo sapiens
ugaucaaggugcuc

SEQ ID NO: 1995225 - RNA, 17 nt, Homo sapiens
gugcgugcauguguaua

SEQ ID NO: 1995226 - RNA, 17 nt, Homo sapiens
aaauauacaaacaugug

SEQ ID NO: 1995227 - RNA, 22 nt, Homo sapiens
agccagcaggucaaaaaggcca

SEQ ID NO: 1995228 - RNA, 19 nt, Homo sapiens
uaguuugcuaagaguuuuc

SEQ ID NO: 1995229 - RNA, 19 nt, Homo sapiens
uuauuugugauguacugua

SEQ ID NO: 1995230 - RNA, 18 nt, Homo sapiens
cggagagagaauguauuu

SEQ ID NO: 1995231 - RNA, 18 nt, Homo sapiens
ugcacuguaaauaucccu

SEQ ID NO: 1995232 - RNA, 20 nt, Homo sapiens
aagcucccacacccaccucu

SEQ ID NO: 1995233 - RNA, 17 nt, Homo sapiens
gagucacaguugacaaa

SEQ ID NO: 1995234 - RNA, 12 nt, Homo sapiens
aguccugucagc

SEQ ID NO: 1995235 - RNA, 13 nt, Homo sapiens
uucugcugaagga

SEQ ID NO: 1995236 - RNA, 11 nt, Homo sapiens
cugcacagugg

SEQ ID NO: 1995237 - RNA, 17 nt, Homo sapiens
uagcagccacacuuccu

SEQ ID NO: 1995238 - RNA, 20 nt, Homo sapiens
uccagugucugucauuucag

SEQ ID NO: 1995239 - RNA, 23 nt, Homo sapiens
ccauaauguucugcuaaauuuca

SEQ ID NO: 1995240 - RNA, 16 nt, Homo sapiens
auguuuaccaguguag

SEQ ID NO: 1995241 - RNA, 15 nt, Homo sapiens
cagaugauacuucca

SEQ ID NO: 1995242 - RNA, 15 nt, Homo sapiens
ucaguaguucacaua

SEQ ID NO: 1995243 - RNA, 18 nt, Homo sapiens
cucugccuuugugcucug

SEQ ID NO: 1995244 - RNA, 14 nt, Homo sapiens
agcaauacagggag

SEQ ID NO: 1995245 - RNA, 19 nt, Homo sapiens
ugaagaaaugaaaggugac

SEQ ID NO: 1995246 - RNA, 20 nt, Homo sapiens
ccauuauuucuaccauuaaa

SEQ ID NO: 1995247 - RNA, 23 nt, Homo sapiens
uccaagucuaggaacucccucag

SEQ ID NO: 1995248 - RNA, 23 nt, Homo sapiens
gaaacaccguguuuucugacaca

SEQ ID NO: 1995249 - RNA, 15 nt, Homo sapiens
guaaucagauuuauu

SEQ ID NO: 1995250 - RNA, 18 nt, Homo sapiens
ugaauccuggccuggaau

SEQ ID NO: 1995251 - RNA, 18 nt, Homo sapiens
caauguggcaguccugug

SEQ ID NO: 1995252 - RNA, 17 nt, Homo sapiens
caacagauuuacauccc

SEQ ID NO: 1995253 - RNA, 20 nt, Homo sapiens
aagaaggccagcaacauugg

SEQ ID NO: 1995254 - RNA, 15 nt, Homo sapiens
agccugggccugggu

SEQ ID NO: 1995255 - RNA, 14 nt, Homo sapiens
ucaacaauuucaau

SEQ ID NO: 1995256 - RNA, 22 nt, Homo sapiens
auaaauuuuaaaauugguauau

SEQ ID NO: 1995257 - RNA, 14 nt, Homo sapiens
aagcccagcuccag

SEQ ID NO: 1995258 - RNA, 20 nt, Homo sapiens
cagcccauuccucccauuca

SEQ ID NO: 1995259 - RNA, 18 nt, Homo sapiens
ucuuguguaauacuucau

SEQ ID NO: 1995260 - RNA, 11 nt, Homo sapiens
cccaccaucua

SEQ ID NO: 1995261 - RNA, 13 nt, Homo sapiens
ccugauaagcaaa

SEQ ID NO: 1995262 - RNA, 16 nt, Homo sapiens
cuaguugucacuuucc

SEQ ID NO: 1995263 - RNA, 22 nt, Homo sapiens
cgcugggauccgggaucaaagu

SEQ ID NO: 1995264 - RNA, 14 nt, Homo sapiens
ggagugcugcagcu

SEQ ID NO: 1995265 - RNA, 11 nt, Homo sapiens
ccaagacauuc

SEQ ID NO: 1995266 - RNA, 14 nt, Homo sapiens
cauuaggcaaagua

SEQ ID NO: 1995267 - RNA, 15 nt, Homo sapiens
ucucuuuaaucuccu

SEQ ID NO: 1995268 - RNA, 14 nt, Homo sapiens
uuuggaaagccauu

SEQ ID NO: 1995269 - RNA, 16 nt, Homo sapiens
accucagcacugugga

SEQ ID NO: 1995270 - RNA, 14 nt, Homo sapiens
aauugugauuagac

SEQ ID NO: 1995271 - RNA, 21 nt, Homo sapiens
gucagggagaggucaccagcu

SEQ ID NO: 1995272 - RNA, 22 nt, Homo sapiens
uaauuauaagcuaugucacuac

SEQ ID NO: 1995273 - RNA, 20 nt, Homo sapiens
uccuccagaagccucuggcu

SEQ ID NO: 1995274 - RNA, 14 nt, Homo sapiens
ccaggagccuugag

SEQ ID NO: 1995275 - RNA, 18 nt, Homo sapiens
ccuagacagcuuuucuca

SEQ ID NO: 1995276 - RNA, 16 nt, Homo sapiens
augggcaagcaaggag

SEQ ID NO: 1995277 - RNA, 21 nt, Homo sapiens
uggcccaagugguuugugcua

SEQ ID NO: 1995278 - RNA, 17 nt, Homo sapiens
cuagcugcaagugacau

SEQ ID NO: 1995279 - RNA, 14 nt, Homo sapiens
gcuugguagcacuu

SEQ ID NO: 1995280 - RNA, 22 nt, Homo sapiens
agcuauguugacaugaggcagu

SEQ ID NO: 1995281 - RNA, 20 nt, Homo sapiens
agaagccacgcuguccucuc

SEQ ID NO: 1995282 - RNA, 10 nt, Homo sapiens
acagggguga

SEQ ID NO: 1995283 - RNA, 23 nt, Homo sapiens
acagagugagacuccaucucaaa

SEQ ID NO: 1995284 - RNA, 23 nt, Homo sapiens
gggucccugauaacaaccuggag

SEQ ID NO: 1995285 - RNA, 23 nt, Homo sapiens
agccugcuuguugggaaaagccc

SEQ ID NO: 1995286 - RNA, 13 nt, Homo sapiens
caaacacaauucu

SEQ ID NO: 1995287 - RNA, 22 nt, Homo sapiens
agucccuucucucuuccuugcu

SEQ ID NO: 1995288 - RNA, 21 nt, Homo sapiens
uacuuuuaguagagacagugu

SEQ ID NO: 1995289 - RNA, 19 nt, Homo sapiens
uuauuuuuguuagcaaaga

SEQ ID NO: 1995290 - RNA, 13 nt, Homo sapiens
ccaggaugugcua

SEQ ID NO: 1995291 - RNA, 18 nt, Homo sapiens
uccccaaacccacccaua

SEQ ID NO: 1995292 - RNA, 15 nt, Homo sapiens
uccagggacaaagag

SEQ ID NO: 1995293 - RNA, 14 nt, Homo sapiens
gauccugcuccagc

SEQ ID NO: 1995294 - RNA, 18 nt, Homo sapiens
gaccaacgcacaacagga

SEQ ID NO: 1995295 - RNA, 17 nt, Homo sapiens
ggauucuuauggacaau

SEQ ID NO: 1995296 - RNA, 19 nt, Homo sapiens
acauucaccaacaacaguc

SEQ ID NO: 1995297 - RNA, 19 nt, Homo sapiens
gcaugagcuggcaaccagc

SEQ ID NO: 1995298 - RNA, 12 nt, Homo sapiens
ggagcucauucu

SEQ ID NO: 1995299 - RNA, 19 nt, Homo sapiens
agaaucgcuugaacccagg

SEQ ID NO: 1995300 - RNA, 15 nt, Homo sapiens
gaaauaacacuguga

SEQ ID NO: 1995301 - RNA, 16 nt, Homo sapiens
uguuuuccacugugcu

SEQ ID NO: 1995302 - RNA, 17 nt, Homo sapiens
caaauugaugugcccua

SEQ ID NO: 1995303 - RNA, 19 nt, Homo sapiens
uuggcagcccugaugacug

SEQ ID NO: 1995304 - RNA, 21 nt, Homo sapiens
aguguggccuggauccauccu

SEQ ID NO: 1995305 - RNA, 15 nt, Homo sapiens
uacuuuucacacugu

SEQ ID NO: 1995306 - RNA, 21 nt, Homo sapiens
auguuguguuuuuaacauguc

SEQ ID NO: 1995307 - RNA, 15 nt, Homo sapiens
cauuaucauguguaa

SEQ ID NO: 1995308 - RNA, 15 nt, Homo sapiens
augcaaauacaauca

SEQ ID NO: 1995309 - RNA, 20 nt, Homo sapiens
ccuuggcugcucacugucca

SEQ ID NO: 1995310 - RNA, 19 nt, Homo sapiens
ggcuugccucaaguuccau

SEQ ID NO: 1995311 - RNA, 13 nt, Homo sapiens
caucucuauuuag

SEQ ID NO: 1995312 - RNA, 13 nt, Homo sapiens
cucagagauauac

SEQ ID NO: 1995313 - RNA, 18 nt, Homo sapiens
cucagaaugaaaauucau

SEQ ID NO: 1995314 - RNA, 22 nt, Homo sapiens
ugguagagagguuuuucuuggg

SEQ ID NO: 1995315 - RNA, 16 nt, Homo sapiens
accuaguagaguguaa

SEQ ID NO: 1995316 - RNA, 21 nt, Homo sapiens
auuggcucccaucuuuuguua

SEQ ID NO: 1995317 - RNA, 19 nt, Homo sapiens
gaugauaauggaaagcagc

SEQ ID NO: 1995318 - RNA, 11 nt, Homo sapiens
ccuacauuccc

SEQ ID NO: 1995319 - RNA, 19 nt, Homo sapiens
cauguggugggacagggac

SEQ ID NO: 1995320 - RNA, 13 nt, Homo sapiens
caagugugugcau

SEQ ID NO: 1995321 - RNA, 19 nt, Homo sapiens
gugccuauggguugucaau

SEQ ID NO: 1995322 - RNA, 19 nt, Homo sapiens
agcuuguccaaggucucau

SEQ ID NO: 1995323 - RNA, 12 nt, Homo sapiens
uuugaaggcaaa

SEQ ID NO: 1995324 - RNA, 18 nt, Homo sapiens
accacugguacuuccuuu

SEQ ID NO: 1995325 - RNA, 16 nt, Homo sapiens
agagccuaacaucucc

SEQ ID NO: 1995326 - RNA, 17 nt, Homo sapiens
ccuugcuuugagacucc

SEQ ID NO: 1995327 - RNA, 15 nt, Homo sapiens
cucacaggugucucc

SEQ ID NO: 1995328 - RNA, 17 nt, Homo sapiens
auaacaaagcacauaac

SEQ ID NO: 1995329 - RNA, 13 nt, Homo sapiens
cuccugcuggaug

SEQ ID NO: 1995330 - RNA, 18 nt, Homo sapiens
guugcuggcaguacuguu

SEQ ID NO: 1995331 - RNA, 20 nt, Homo sapiens
uuggcaccgcuucucagcca

SEQ ID NO: 1995332 - RNA, 19 nt, Homo sapiens
ucccuccgagcuugggaua

SEQ ID NO: 1995333 - RNA, 16 nt, Homo sapiens
gacaacugugacugua

SEQ ID NO: 1995334 - RNA, 16 nt, Homo sapiens
cugcuuaaacaaagca

SEQ ID NO: 1995335 - RNA, 14 nt, Homo sapiens
aaacaucuauucuc

SEQ ID NO: 1995336 - RNA, 14 nt, Homo sapiens
aagcucuucauuuc

SEQ ID NO: 1995337 - RNA, 21 nt, Homo sapiens
gaaacagaggaccagcacacu

SEQ ID NO: 1995338 - RNA, 18 nt, Homo sapiens
caggcaacgcacaaaaca

SEQ ID NO: 1995339 - RNA, 15 nt, Homo sapiens
uuaagcuuuggggaa

SEQ ID NO: 1995340 - RNA, 22 nt, Homo sapiens
uucagauggaggugccauauca

SEQ ID NO: 1995341 - RNA, 16 nt, Homo sapiens
uaaaguacccugugcu

SEQ ID NO: 1995342 - RNA, 18 nt, Homo sapiens
guagcuccgcgugucuca

SEQ ID NO: 1995343 - RNA, 22 nt, Homo sapiens
gccccucuuccaaaggcagcgu

SEQ ID NO: 1995344 - RNA, 17 nt, Homo sapiens
ucaacaccagaaagccu

SEQ ID NO: 1995345 - RNA, 12 nt, Homo sapiens
agguugccauug

SEQ ID NO: 1995346 - RNA, 17 nt, Homo sapiens
uuauuccuccugcucau

SEQ ID NO: 1995347 - RNA, 16 nt, Homo sapiens
cuguuugaagaaaaua

SEQ ID NO: 1995348 - RNA, 12 nt, Homo sapiens
cugugcacuguu

SEQ ID NO: 1995349 - RNA, 16 nt, Homo sapiens
ccucucuuaaaugcaa

SEQ ID NO: 1995350 - RNA, 16 nt, Homo sapiens
guaagaacacugagau

SEQ ID NO: 1995351 - RNA, 14 nt, Homo sapiens
ccagcuuauaguca

SEQ ID NO: 1995352 - RNA, 14 nt, Homo sapiens
cuaccugacugcca

SEQ ID NO: 1995353 - RNA, 13 nt, Homo sapiens
cagaguuguucug

SEQ ID NO: 1995354 - RNA, 15 nt, Homo sapiens
aaauucuuuaguacu

SEQ ID NO: 1995355 - RNA, 15 nt, Homo sapiens
auguacauuuauuca

SEQ ID NO: 1995356 - RNA, 19 nt, Homo sapiens
cugugugugugugugcaua

SEQ ID NO: 1995357 - RNA, 17 nt, Homo sapiens
cugcacccaacuacuga

SEQ ID NO: 1995358 - RNA, 19 nt, Homo sapiens
caaugugaaaccaucacag

SEQ ID NO: 1995359 - RNA, 21 nt, Homo sapiens
uggccuacagucaucugccac

SEQ ID NO: 1995360 - RNA, 19 nt, Homo sapiens
cgagguguugccagugcua

SEQ ID NO: 1995361 - RNA, 15 nt, Homo sapiens
ggacagugaggucac

SEQ ID NO: 1995362 - RNA, 17 nt, Homo sapiens
ugcccagugauggcauu

SEQ ID NO: 1995363 - RNA, 16 nt, Homo sapiens
acccgcucuggaccaa

SEQ ID NO: 1995364 - RNA, 15 nt, Homo sapiens
ugggucagcuugaau

SEQ ID NO: 1995365 - RNA, 15 nt, Homo sapiens
ugccccagcuuuauc

SEQ ID NO: 1995366 - RNA, 19 nt, Homo sapiens
cugugugugcaaaggugag

SEQ ID NO: 1995367 - RNA, 16 nt, Homo sapiens
cuuucugacaaaaagu

SEQ ID NO: 1995368 - RNA, 20 nt, Homo sapiens
ggcacacaaugcuauugaaa

SEQ ID NO: 1995369 - RNA, 12 nt, Homo sapiens
cagguguggaac

SEQ ID NO: 1995370 - RNA, 21 nt, Homo sapiens
gggcccaugggagggagcuga

SEQ ID NO: 1995371 - RNA, 23 nt, Homo sapiens
acuaucuuuuuuuuauuccacau

SEQ ID NO: 1995372 - RNA, 21 nt, Homo sapiens
gggaagacaacuaggauacuu

SEQ ID NO: 1995373 - RNA, 20 nt, Homo sapiens
uguucccuuuuaaaucugcu

SEQ ID NO: 1995374 - RNA, 22 nt, Homo sapiens
agauagcuucaccccaauccca

SEQ ID NO: 1995375 - RNA, 16 nt, Homo sapiens
uggaaacaacauauua

SEQ ID NO: 1995376 - RNA, 16 nt, Homo sapiens
aagcagucauaccugc

SEQ ID NO: 1995377 - RNA, 14 nt, Homo sapiens
ucuuugcaccaaag

SEQ ID NO: 1995378 - RNA, 18 nt, Homo sapiens
cacaaaaaggcauaugca

SEQ ID NO: 1995379 - RNA, 23 nt, Homo sapiens
acucacaacacuuaacagggaac

SEQ ID NO: 1995380 - RNA, 21 nt, Homo sapiens
caaaagauacggcccaugcaa

SEQ ID NO: 1995381 - RNA, 23 nt, Homo sapiens
gcaucaauauacauaauacauga

SEQ ID NO: 1995382 - RNA, 13 nt, Homo sapiens
ugcaggcuguguu

SEQ ID NO: 1995383 - RNA, 16 nt, Homo sapiens
ccugacucaggcauca

SEQ ID NO: 1995384 - RNA, 17 nt, Homo sapiens
gaaaugccacugggaca

SEQ ID NO: 1995385 - RNA, 18 nt, Homo sapiens
guaacacuaaaacuuucu

SEQ ID NO: 1995386 - RNA, 14 nt, Homo sapiens
agacugaagaaagu

SEQ ID NO: 1995387 - RNA, 16 nt, Homo sapiens
ugucgcuggguccucu

SEQ ID NO: 1995388 - RNA, 22 nt, Homo sapiens
guggaauaauacauacuaauga

SEQ ID NO: 1995389 - RNA, 17 nt, Homo sapiens
gcugcccuggguccugc

SEQ ID NO: 1995390 - RNA, 15 nt, Homo sapiens
ggaugcagagucagc

SEQ ID NO: 1995391 - RNA, 14 nt, Homo sapiens
aauugugucugcag

SEQ ID NO: 1995392 - RNA, 13 nt, Homo sapiens
uaauauaguccaa

SEQ ID NO: 1995393 - RNA, 15 nt, Homo sapiens
cucccuggcauguca

SEQ ID NO: 1995394 - RNA, 18 nt, Homo sapiens
gaaccaaaccaaaucaua

SEQ ID NO: 1995395 - RNA, 19 nt, Homo sapiens
ucaacaacaccagaacugu

SEQ ID NO: 1995396 - RNA, 20 nt, Homo sapiens
gcaauauucuguaacuauug

SEQ ID NO: 1995397 - RNA, 15 nt, Homo sapiens
gcccugaggaauaaa

SEQ ID NO: 1995398 - RNA, 23 nt, Homo sapiens
aucuccugucuacaguuuaauaa

SEQ ID NO: 1995399 - RNA, 13 nt, Homo sapiens
gacuuucuugcaa

SEQ ID NO: 1995400 - RNA, 15 nt, Homo sapiens
cauguggaaaacuca

SEQ ID NO: 1995401 - RNA, 15 nt, Homo sapiens
uguguccacagaguu

SEQ ID NO: 1995402 - RNA, 18 nt, Homo sapiens
aucagcggccccuugacu

SEQ ID NO: 1995403 - RNA, 12 nt, Homo sapiens
caucugucacau

SEQ ID NO: 1995404 - RNA, 19 nt, Homo sapiens
ccauaccacccaaugcuga

SEQ ID NO: 1995405 - RNA, 17 nt, Homo sapiens
cacuuauacccaugaac

SEQ ID NO: 1995406 - RNA, 22 nt, Homo sapiens
agcuuggauggagacuccauga

SEQ ID NO: 1995407 - RNA, 14 nt, Homo sapiens
ugaucagacauuca

SEQ ID NO: 1995408 - RNA, 20 nt, Homo sapiens
cugggacccuuggcuaugaa

SEQ ID NO: 1995409 - RNA, 18 nt, Homo sapiens
uucugucuuuauaaucua

SEQ ID NO: 1995410 - RNA, 21 nt, Homo sapiens
ucaucuugcccccucaucuca

SEQ ID NO: 1995411 - RNA, 20 nt, Homo sapiens
gucauacuacauacaagcau

SEQ ID NO: 1995412 - RNA, 17 nt, Homo sapiens
cuccugcugccuaauaa

SEQ ID NO: 1995413 - RNA, 17 nt, Homo sapiens
aguaaaguuagauuaaa

SEQ ID NO: 1995414 - RNA, 13 nt, Homo sapiens
uguaaaacuguua

SEQ ID NO: 1995415 - RNA, 13 nt, Homo sapiens
uauauaacuauuu

SEQ ID NO: 1995416 - RNA, 17 nt, Homo sapiens
ucuguguaaucucugau

SEQ ID NO: 1995417 - RNA, 17 nt, Homo sapiens
gguauugaucuguguua

SEQ ID NO: 1995418 - RNA, 14 nt, Homo sapiens
aguaguuaaccaaa

SEQ ID NO: 1995419 - RNA, 21 nt, Homo sapiens
ugcuuuucugcggcuguguag

SEQ ID NO: 1995420 - RNA, 19 nt, Homo sapiens
acaguacuguucccaacuc

SEQ ID NO: 1995421 - RNA, 20 nt, Homo sapiens
augucauugaugaacugcca

SEQ ID NO: 1995422 - RNA, 21 nt, Homo sapiens
gaacuauuaauuccaugugau

SEQ ID NO: 1995423 - RNA, 20 nt, Homo sapiens
guuuuaaagcuugcucacau

SEQ ID NO: 1995424 - RNA, 15 nt, Homo sapiens
auaggagaggaugag

SEQ ID NO: 1995425 - RNA, 19 nt, Homo sapiens
gggaaucuaagugggagac

SEQ ID NO: 1995426 - RNA, 18 nt, Homo sapiens
ccacaacugacacaggaa

SEQ ID NO: 1995427 - RNA, 20 nt, Homo sapiens
aaguuugcugugcuuuggaa

SEQ ID NO: 1995428 - RNA, 16 nt, Homo sapiens
aaauauauguauuuaa

SEQ ID NO: 1995429 - RNA, 16 nt, Homo sapiens
cugaaaugcaguauca

SEQ ID NO: 1995430 - RNA, 22 nt, Homo sapiens
ucuggauuuuauucaucauaua

SEQ ID NO: 1995431 - RNA, 21 nt, Homo sapiens
aauuacaguaaucccauuucc

SEQ ID NO: 1995432 - RNA, 22 nt, Homo sapiens
agaauauggaaacagagcaaaa

SEQ ID NO: 1995433 - RNA, 17 nt, Homo sapiens
auaauuggacucuguca

SEQ ID NO: 1995434 - RNA, 22 nt, Homo sapiens
auauagcucuacacaacaugua

SEQ ID NO: 1995435 - RNA, 22 nt, Homo sapiens
auguaucuaguguguccuguga

SEQ ID NO: 1995436 - RNA, 15 nt, Homo sapiens
gucccagcggcacca

SEQ ID NO: 1995437 - RNA, 19 nt, Homo sapiens
caucuaaaacucauacaau

SEQ ID NO: 1995438 - RNA, 15 nt, Homo sapiens
aacguuucacugcaa

SEQ ID NO: 1995439 - RNA, 16 nt, Homo sapiens
agucucaggaaaucaa

SEQ ID NO: 1995440 - RNA, 15 nt, Homo sapiens
gacuucagacuuuca

SEQ ID NO: 1995441 - RNA, 15 nt, Homo sapiens
gauaaacgaccaaac

SEQ ID NO: 1995442 - RNA, 18 nt, Homo sapiens
auacacguaaaugcagaa

SEQ ID NO: 1995443 - RNA, 15 nt, Homo sapiens
gccccaugccugucc

SEQ ID NO: 1995444 - RNA, 18 nt, Homo sapiens
uaauaccccaacagauga

SEQ ID NO: 1995445 - RNA, 12 nt, Homo sapiens
cuccacugccuc

SEQ ID NO: 1995446 - RNA, 21 nt, Homo sapiens
ugggacagucaccucauggaa

SEQ ID NO: 1995447 - RNA, 19 nt, Homo sapiens
cagaagacucuccacugac

SEQ ID NO: 1995448 - RNA, 21 nt, Homo sapiens
uagucuugaaaugaaagggaa

SEQ ID NO: 1995449 - RNA, 16 nt, Homo sapiens
gacucacuuguucuca

SEQ ID NO: 1995450 - RNA, 16 nt, Homo sapiens
acaaagcuacuugaag

SEQ ID NO: 1995451 - RNA, 22 nt, Homo sapiens
gacugaguacguugugcauuug

SEQ ID NO: 1995452 - RNA, 20 nt, Homo sapiens
aggcagcccaggaagucuca

SEQ ID NO: 1995453 - RNA, 19 nt, Homo sapiens
ccaccagugaaaauugaug

SEQ ID NO: 1995454 - RNA, 19 nt, Homo sapiens
guaacucuuaaagcaaaua

SEQ ID NO: 1995455 - RNA, 22 nt, Homo sapiens
ucuuuuaaaauauccuguaacu

SEQ ID NO: 1995456 - RNA, 13 nt, Homo sapiens
uaaaucauaaagu

SEQ ID NO: 1995457 - RNA, 11 nt, Homo sapiens
uguauuuacuu

SEQ ID NO: 1995458 - RNA, 17 nt, Homo sapiens
ucagugauaacuccuaa

SEQ ID NO: 1995459 - RNA, 21 nt, Homo sapiens
agucuuuuuugcuucuccuac

SEQ ID NO: 1995460 - RNA, 16 nt, Homo sapiens
cuuauuuuuguucaua

SEQ ID NO: 1995461 - RNA, 21 nt, Homo sapiens
cagguaccaucuuguauacac

SEQ ID NO: 1995462 - RNA, 18 nt, Homo sapiens
augcaggggccacaucca

SEQ ID NO: 1995463 - RNA, 20 nt, Homo sapiens
uuauauauuuuucugagauu

SEQ ID NO: 1995464 - RNA, 16 nt, Homo sapiens
ggggguucuguuuuca

SEQ ID NO: 1995465 - RNA, 21 nt, Homo sapiens
agcuaggaugguucugugacc

SEQ ID NO: 1995466 - RNA, 17 nt, Homo sapiens
guguggcuuaaacauuu

SEQ ID NO: 1995467 - RNA, 13 nt, Homo sapiens
gucggacuaugua

SEQ ID NO: 1995468 - RNA, 15 nt, Homo sapiens
ugacauguggggcca

SEQ ID NO: 1995469 - RNA, 12 nt, Homo sapiens
aucauugcauuu

SEQ ID NO: 1995470 - RNA, 15 nt, Homo sapiens
aaugcuuucucaugc

SEQ ID NO: 1995471 - RNA, 12 nt, Homo sapiens
ugaacauuugcu

SEQ ID NO: 1995472 - RNA, 15 nt, Homo sapiens
cagccagggcucaau

SEQ ID NO: 1995473 - RNA, 17 nt, Homo sapiens
caaaaggaacuaugaaa

SEQ ID NO: 1995474 - RNA, 21 nt, Homo sapiens
augaguaacauuugcuguuuu

SEQ ID NO: 1995475 - RNA, 18 nt, Homo sapiens
gucacuauggacuuaccc

SEQ ID NO: 1995476 - RNA, 16 nt, Homo sapiens
aucccagcaccugccu

SEQ ID NO: 1995477 - RNA, 21 nt, Homo sapiens
ccugaaagcuguuggauuuca

SEQ ID NO: 1995478 - RNA, 13 nt, Homo sapiens
gccagaacuugac

SEQ ID NO: 1995479 - RNA, 19 nt, Homo sapiens
aaagcagcucaaaggcaca

SEQ ID NO: 1995480 - RNA, 23 nt, Homo sapiens
ccaaaccacugacauuccuccau

SEQ ID NO: 1995481 - RNA, 21 nt, Homo sapiens
uuggugcacagacaagcccuu

SEQ ID NO: 1995482 - RNA, 20 nt, Homo sapiens
ucuuguccaaguuguuucau

SEQ ID NO: 1995483 - RNA, 21 nt, Homo sapiens
gcuccgugcuuguuugcucac

SEQ ID NO: 1995484 - RNA, 17 nt, Homo sapiens
ccuugagcucuucugag

SEQ ID NO: 1995485 - RNA, 12 nt, Homo sapiens
gcaccugggauu

SEQ ID NO: 1995486 - RNA, 15 nt, Homo sapiens
acugauguauagcuu

SEQ ID NO: 1995487 - RNA, 22 nt, Homo sapiens
augcaugucugccuaugcacug

SEQ ID NO: 1995488 - RNA, 21 nt, Homo sapiens
agucaucacauuucuaugcca

SEQ ID NO: 1995489 - RNA, 14 nt, Homo sapiens
ccuacaaaugacag

SEQ ID NO: 1995490 - RNA, 20 nt, Homo sapiens
ucagccucccaaagugcagg

SEQ ID NO: 1995491 - RNA, 16 nt, Homo sapiens
ccacugucuccacuca

SEQ ID NO: 1995492 - RNA, 20 nt, Homo sapiens
uugaaacugcuugagcauca

SEQ ID NO: 1995493 - RNA, 19 nt, Homo sapiens
augauagauuugaccuccu

SEQ ID NO: 1995494 - RNA, 20 nt, Homo sapiens
guuauuuuguacguguuauu

SEQ ID NO: 1995495 - RNA, 19 nt, Homo sapiens
ccaggcuggagugcaaugc

SEQ ID NO: 1995496 - RNA, 12 nt, Homo sapiens
cauuguaacaug

SEQ ID NO: 1995497 - RNA, 23 nt, Homo sapiens
uccuugcauguuguagcagugau

SEQ ID NO: 1995498 - RNA, 20 nt, Homo sapiens
aaguuauaaccaacuuuucu

SEQ ID NO: 1995499 - RNA, 22 nt, Homo sapiens
uccccgagugccuagguuuugg

SEQ ID NO: 1995500 - RNA, 14 nt, Homo sapiens
ccuccucacacucc

SEQ ID NO: 1995501 - RNA, 14 nt, Homo sapiens
ccaucaacuguauu

SEQ ID NO: 1995502 - RNA, 16 nt, Homo sapiens
acuugcuggcugugaa

SEQ ID NO: 1995503 - RNA, 20 nt, Homo sapiens
guccucaccccuguccucac

SEQ ID NO: 1995504 - RNA, 17 nt, Homo sapiens
aacaugcccacagauca

SEQ ID NO: 1995505 - RNA, 21 nt, Homo sapiens
cacaaaucagaccuggcugcu

SEQ ID NO: 1995506 - RNA, 20 nt, Homo sapiens
ugcauagcagaccacacaga

SEQ ID NO: 1995507 - RNA, 12 nt, Homo sapiens
caucauuucagc

SEQ ID NO: 1995508 - RNA, 16 nt, Homo sapiens
ugauuuugcuuuccaa

SEQ ID NO: 1995509 - RNA, 19 nt, Homo sapiens
aucuccaacaguugacagg

SEQ ID NO: 1995510 - RNA, 20 nt, Homo sapiens
aaauauuuuguaaugcugca

SEQ ID NO: 1995511 - RNA, 19 nt, Homo sapiens
uucuauccuuuugccugca

SEQ ID NO: 1995512 - RNA, 15 nt, Homo sapiens
uggcggguggcugca

SEQ ID NO: 1995513 - RNA, 14 nt, Homo sapiens
gauggguggcacca

SEQ ID NO: 1995514 - RNA, 15 nt, Homo sapiens
uaaaauaagcuauau

SEQ ID NO: 1995515 - RNA, 14 nt, Homo sapiens
cuaaagccaguggc

SEQ ID NO: 1995516 - RNA, 21 nt, Homo sapiens
aagaaaacuuguguucaaucu

SEQ ID NO: 1995517 - RNA, 19 nt, Homo sapiens
uugaagaaugaaaggcaau

SEQ ID NO: 1995518 - RNA, 15 nt, Homo sapiens
cccguacuagguugg

SEQ ID NO: 1995519 - RNA, 18 nt, Homo sapiens
acuguuuauacacugugu

SEQ ID NO: 1995520 - RNA, 18 nt, Homo sapiens
uccauuuacagcccucag

SEQ ID NO: 1995521 - RNA, 13 nt, Homo sapiens
ucccuaccccagg

SEQ ID NO: 1995522 - RNA, 19 nt, Homo sapiens
agccuagcccuucucucau

SEQ ID NO: 1995523 - RNA, 23 nt, Homo sapiens
uuucacauagguuagauucucau

SEQ ID NO: 1995524 - RNA, 13 nt, Homo sapiens
gagcuguuaacuu

SEQ ID NO: 1995525 - RNA, 23 nt, Homo sapiens
gcguggugcucuuugcugcacua

SEQ ID NO: 1995526 - RNA, 22 nt, Homo sapiens
ugagauuuuucauguaucuuau

SEQ ID NO: 1995527 - RNA, 17 nt, Homo sapiens
gaauggagcucaggucc

SEQ ID NO: 1995528 - RNA, 18 nt, Homo sapiens
caaaauaaucuauauuaa

SEQ ID NO: 1995529 - RNA, 18 nt, Homo sapiens
uacauugaaaacaacaaa

SEQ ID NO: 1995530 - RNA, 18 nt, Homo sapiens
uucauucaguacaagaga

SEQ ID NO: 1995531 - RNA, 21 nt, Homo sapiens
uagaagcuguaguagcccuuu

SEQ ID NO: 1995532 - RNA, 21 nt, Homo sapiens
gugagcacuaaggugugcucu

SEQ ID NO: 1995533 - RNA, 13 nt, Homo sapiens
aaaagugggccag

SEQ ID NO: 1995534 - RNA, 13 nt, Homo sapiens
gcaaauggaacaa

SEQ ID NO: 1995535 - RNA, 23 nt, Homo sapiens
ucccguguuguaccugacuucca

SEQ ID NO: 1995536 - RNA, 14 nt, Homo sapiens
uguccacacaagac

SEQ ID NO: 1995537 - RNA, 18 nt, Homo sapiens
uuuugccaaggcaaaaaa

SEQ ID NO: 1995538 - RNA, 12 nt, Homo sapiens
guugugcaugga

SEQ ID NO: 1995539 - RNA, 21 nt, Homo sapiens
aucuucucacauagguguugu

SEQ ID NO: 1995540 - RNA, 16 nt, Homo sapiens
gauacugcuuuucacc

SEQ ID NO: 1995541 - RNA, 10 nt, Homo sapiens
aucucaaagu

SEQ ID NO: 1995542 - RNA, 22 nt, Homo sapiens
acccucauuggccugcccuuca

SEQ ID NO: 1995543 - RNA, 16 nt, Homo sapiens
aguguuuuugugaauu

SEQ ID NO: 1995544 - RNA, 17 nt, Homo sapiens
cucugcuccagacucac

SEQ ID NO: 1995545 - RNA, 11 nt, Homo sapiens
agccaggugug

SEQ ID NO: 1995546 - RNA, 13 nt, Homo sapiens
ccuucucaucucc

SEQ ID NO: 1995547 - RNA, 21 nt, Homo sapiens
aggaggccuccacuccggauc

SEQ ID NO: 1995548 - RNA, 14 nt, Homo sapiens
ccauucuacugugu

SEQ ID NO: 1995549 - RNA, 23 nt, Homo sapiens
cuucgcugccaggacaccugccc

SEQ ID NO: 1995550 - RNA, 19 nt, Homo sapiens
ccugauauaucaaacugaa

SEQ ID NO: 1995551 - RNA, 15 nt, Homo sapiens
uguuuuauaguauua

SEQ ID NO: 1995552 - RNA, 20 nt, Homo sapiens
aauguggccgaggacuuuga

SEQ ID NO: 1995553 - RNA, 12 nt, Homo sapiens
gcuucuguggug

SEQ ID NO: 1995554 - RNA, 17 nt, Homo sapiens
uuacugagcaguaggua

SEQ ID NO: 1995555 - RNA, 17 nt, Homo sapiens
ucuuugaaaacagauga

SEQ ID NO: 1995556 - RNA, 14 nt, Homo sapiens
ccacgugcagcacc

SEQ ID NO: 1995557 - RNA, 23 nt, Homo sapiens
cucuuaaguaauugguuaguuaa

SEQ ID NO: 1995558 - RNA, 17 nt, Homo sapiens
acuccagagacagggaa

SEQ ID NO: 1995559 - RNA, 13 nt, Homo sapiens
ccgggaagggugg

SEQ ID NO: 1995560 - RNA, 22 nt, Homo sapiens
guaggucagaagaagaugcugu

SEQ ID NO: 1995561 - RNA, 21 nt, Homo sapiens
uguggauuuuuaaaacagaua

SEQ ID NO: 1995562 - RNA, 15 nt, Homo sapiens
augcucuaacuggac

SEQ ID NO: 1995563 - RNA, 16 nt, Homo sapiens
cuggguggaagugugu

SEQ ID NO: 1995564 - RNA, 22 nt, Homo sapiens
uauaauuuugauagugggacca

SEQ ID NO: 1995565 - RNA, 19 nt, Homo sapiens
auacuguuuccuaugacau

SEQ ID NO: 1995566 - RNA, 14 nt, Homo sapiens
gcagagagaagccu

SEQ ID NO: 1995567 - RNA, 13 nt, Homo sapiens
uaagaauuucaca

SEQ ID NO: 1995568 - RNA, 14 nt, Homo sapiens
aucauccuuuccag

SEQ ID NO: 1995569 - RNA, 16 nt, Homo sapiens
cccagggacacuccaa

SEQ ID NO: 1995570 - RNA, 14 nt, Homo sapiens
aagccgccguuuuc

SEQ ID NO: 1995571 - RNA, 23 nt, Homo sapiens
uggcaacagaucuggaaccucag

SEQ ID NO: 1995572 - RNA, 16 nt, Homo sapiens
uaagcaaaaaacugca

SEQ ID NO: 1995573 - RNA, 12 nt, Homo sapiens
aaggaucacuug

SEQ ID NO: 1995574 - RNA, 16 nt, Homo sapiens
cagcucuuacuuuuaa

SEQ ID NO: 1995575 - RNA, 18 nt, Homo sapiens
uaaaauguauuuuucaca

SEQ ID NO: 1995576 - RNA, 20 nt, Homo sapiens
ucugaaaaauuuguaguuua

SEQ ID NO: 1995577 - RNA, 14 nt, Homo sapiens
cuauggcucugcaa

SEQ ID NO: 1995578 - RNA, 14 nt, Homo sapiens
uuaggcagucuucu

SEQ ID NO: 1995579 - RNA, 16 nt, Homo sapiens
uauagccaccccaaga

SEQ ID NO: 1995580 - RNA, 17 nt, Homo sapiens
cauuuuugagcaacucc

SEQ ID NO: 1995581 - RNA, 14 nt, Homo sapiens
uugcagauuaaaga

SEQ ID NO: 1995582 - RNA, 23 nt, Homo sapiens
gcuggagagguuaaggugcaaua

SEQ ID NO: 1995583 - RNA, 16 nt, Homo sapiens
aaggagaagcuaauau

SEQ ID NO: 1995584 - RNA, 13 nt, Homo sapiens
gucucgcuacauu

SEQ ID NO: 1995585 - RNA, 13 nt, Homo sapiens
ccgagugcacugc

SEQ ID NO: 1995586 - RNA, 17 nt, Homo sapiens
acaauuaugaacaucca

SEQ ID NO: 1995587 - RNA, 18 nt, Homo sapiens
accagugaaagaagccac

SEQ ID NO: 1995588 - RNA, 16 nt, Homo sapiens
gcuucuuauaguaaca

SEQ ID NO: 1995589 - RNA, 22 nt, Homo sapiens
ugcuaauaaaguuaaauugcac

SEQ ID NO: 1995590 - RNA, 16 nt, Homo sapiens
acagauugucuuauua

SEQ ID NO: 1995591 - RNA, 20 nt, Homo sapiens
guguuuuacugucagauuaa

SEQ ID NO: 1995592 - RNA, 21 nt, Homo sapiens
ucucguuccagaaauuguggg

SEQ ID NO: 1995593 - RNA, 14 nt, Homo sapiens
cuaugaucucaggu

SEQ ID NO: 1995594 - RNA, 15 nt, Homo sapiens
cauauaaucuuacaa

SEQ ID NO: 1995595 - RNA, 23 nt, Homo sapiens
cucacuauucaaguauuaggggu

SEQ ID NO: 1995596 - RNA, 22 nt, Homo sapiens
aggcagguacagguagugggcu

SEQ ID NO: 1995597 - RNA, 14 nt, Homo sapiens
guaguuagcuuaag

SEQ ID NO: 1995598 - RNA, 19 nt, Homo sapiens
cacugucagucccacugca

SEQ ID NO: 1995599 - RNA, 12 nt, Homo sapiens
cguuuuccucau

SEQ ID NO: 1995600 - RNA, 14 nt, Homo sapiens
guuuccccucagaa

SEQ ID NO: 1995601 - RNA, 13 nt, Homo sapiens
agagaccucaggg

SEQ ID NO: 1995602 - RNA, 19 nt, Homo sapiens
acuucugccccagcuuuau

SEQ ID NO: 1995603 - RNA, 13 nt, Homo sapiens
uaauuucuucaca

SEQ ID NO: 1995604 - RNA, 20 nt, Homo sapiens
agaaccccccgcaaugugcu

SEQ ID NO: 1995605 - RNA, 23 nt, Homo sapiens
auuuugaaaaaaaauuucaaaaa

SEQ ID NO: 1995606 - RNA, 21 nt, Homo sapiens
gcuuugguuccuucucugggu

SEQ ID NO: 1995607 - RNA, 20 nt, Homo sapiens
uauuuuuuaaaacacuaaaa

SEQ ID NO: 1995608 - RNA, 15 nt, Homo sapiens
ccagugcacugaaag

SEQ ID NO: 1995609 - RNA, 18 nt, Homo sapiens
ccuucaagguggcagcug

SEQ ID NO: 1995610 - RNA, 16 nt, Homo sapiens
uccagugaguccaggc

SEQ ID NO: 1995611 - RNA, 17 nt, Homo sapiens
ccaauagcaaggcugug

SEQ ID NO: 1995612 - RNA, 16 nt, Homo sapiens
gcucuguggagggcau

SEQ ID NO: 1995613 - RNA, 15 nt, Homo sapiens
gccuggauuccagca

SEQ ID NO: 1995614 - RNA, 19 nt, Homo sapiens
aggaagccccaagccaugg

SEQ ID NO: 1995615 - RNA, 19 nt, Homo sapiens
acuuucccacgucacuuga

SEQ ID NO: 1995616 - RNA, 18 nt, Homo sapiens
uaaauuauaucugugaau

SEQ ID NO: 1995617 - RNA, 14 nt, Homo sapiens
cugcccaauaugca

SEQ ID NO: 1995618 - RNA, 22 nt, Homo sapiens
acaggacgaggcagaaaagcac

SEQ ID NO: 1995619 - RNA, 22 nt, Homo sapiens
accccgaauugacaacccaaac

SEQ ID NO: 1995620 - RNA, 18 nt, Homo sapiens
cuugauuguauccuugcc

SEQ ID NO: 1995621 - RNA, 14 nt, Homo sapiens
uggagcugcucaac

SEQ ID NO: 1995622 - RNA, 14 nt, Homo sapiens
gggucugucagggu

SEQ ID NO: 1995623 - RNA, 15 nt, Homo sapiens
uccucagacaacagc

SEQ ID NO: 1995624 - RNA, 23 nt, Homo sapiens
aauaaaauuuaacucacacugcc

SEQ ID NO: 1995625 - RNA, 21 nt, Homo sapiens
gugcaaugauagucacuucua

SEQ ID NO: 1995626 - RNA, 16 nt, Homo sapiens
aaaaucuccaucucaa

SEQ ID NO: 1995627 - RNA, 19 nt, Homo sapiens
caggggcgugggauugaau

SEQ ID NO: 1995628 - RNA, 20 nt, Homo sapiens
cagucagcccuuauggccaa

SEQ ID NO: 1995629 - RNA, 22 nt, Homo sapiens
ggagccaguccgugcaggcaca

SEQ ID NO: 1995630 - RNA, 21 nt, Homo sapiens
gcagcugacuuuucugaccca

SEQ ID NO: 1995631 - RNA, 16 nt, Homo sapiens
cggugcagagugcaga

SEQ ID NO: 1995632 - RNA, 20 nt, Homo sapiens
ugccugggaguuuuguauuc

SEQ ID NO: 1995633 - RNA, 21 nt, Homo sapiens
gugaaaccccauuucuacuaa

SEQ ID NO: 1995634 - RNA, 12 nt, Homo sapiens
agccuggugggc

SEQ ID NO: 1995635 - RNA, 16 nt, Homo sapiens
cuuccccuucccugac

SEQ ID NO: 1995636 - RNA, 20 nt, Homo sapiens
agugaaagaguagugcauuu

SEQ ID NO: 1995637 - RNA, 13 nt, Homo sapiens
uacgcacauaccu

SEQ ID NO: 1995638 - RNA, 17 nt, Homo sapiens
agacugcuacagugcau

SEQ ID NO: 1995639 - RNA, 14 nt, Homo sapiens
auuagagagucuca

SEQ ID NO: 1995640 - RNA, 17 nt, Homo sapiens
gagauggcugcugcuca

SEQ ID NO: 1995641 - RNA, 11 nt, Homo sapiens
cagggacccac

SEQ ID NO: 1995642 - RNA, 17 nt, Homo sapiens
aagaugggugauuauga

SEQ ID NO: 1995643 - RNA, 19 nt, Homo sapiens
gcucaaugacucucuggug

SEQ ID NO: 1995644 - RNA, 14 nt, Homo sapiens
aacucaaaugagcc

SEQ ID NO: 1995645 - RNA, 17 nt, Homo sapiens
aauucaaugaaauggau

SEQ ID NO: 1995646 - RNA, 15 nt, Homo sapiens
caugugcaaaugugc

SEQ ID NO: 1995647 - RNA, 16 nt, Homo sapiens
augugaaugaauacac

SEQ ID NO: 1995648 - RNA, 19 nt, Homo sapiens
gacaauguuguccuccugu

SEQ ID NO: 1995649 - RNA, 16 nt, Homo sapiens
ucuguguugaagcacu

SEQ ID NO: 1995650 - RNA, 20 nt, Homo sapiens
uuaaaaaccuauuuugaaag

SEQ ID NO: 1995651 - RNA, 12 nt, Homo sapiens
gaccuugcacaa

SEQ ID NO: 1995652 - RNA, 12 nt, Homo sapiens
caaucccauucc

SEQ ID NO: 1995653 - RNA, 22 nt, Homo sapiens
ggcccccaugcaaggugcccac

SEQ ID NO: 1995654 - RNA, 15 nt, Homo sapiens
ccucccucccagcgc

SEQ ID NO: 1995655 - RNA, 18 nt, Homo sapiens
gaaauuuaaucaguguga

SEQ ID NO: 1995656 - RNA, 17 nt, Homo sapiens
cuccaugguggggccaa

SEQ ID NO: 1995657 - RNA, 18 nt, Homo sapiens
auauucaagccuguuguc

SEQ ID NO: 1995658 - RNA, 19 nt, Homo sapiens
aaggacuagauacuacuuu

SEQ ID NO: 1995659 - RNA, 20 nt, Homo sapiens
ggugggauuccacucgugug

SEQ ID NO: 1995660 - RNA, 13 nt, Homo sapiens
aagacaaaccaag

SEQ ID NO: 1995661 - RNA, 22 nt, Homo sapiens
gcaggauccgcugccaccacgu

SEQ ID NO: 1995662 - RNA, 16 nt, Homo sapiens
cuauucugauuacaca

SEQ ID NO: 1995663 - RNA, 23 nt, Homo sapiens
uuggucucugcccugccuacuuu

SEQ ID NO: 1995664 - RNA, 19 nt, Homo sapiens
acagauuuuagacuuaccu

SEQ ID NO: 1995665 - RNA, 23 nt, Homo sapiens
gagucaucuaccugagucccaaa

SEQ ID NO: 1995666 - RNA, 18 nt, Homo sapiens
uauugaaagcucaugaug

SEQ ID NO: 1995667 - RNA, 16 nt, Homo sapiens
uguuaaucauccauca

SEQ ID NO: 1995668 - RNA, 16 nt, Homo sapiens
gcacaaagcccauagc

SEQ ID NO: 1995669 - RNA, 19 nt, Homo sapiens
aacugccaggcugccuccu

SEQ ID NO: 1995670 - RNA, 18 nt, Homo sapiens
aacuuucuguccuaauca

SEQ ID NO: 1995671 - RNA, 22 nt, Homo sapiens
aagugcacaacauuacagggaa

SEQ ID NO: 1995672 - RNA, 22 nt, Homo sapiens
ccuuaaaccucuucuauugcua

SEQ ID NO: 1995673 - RNA, 18 nt, Homo sapiens
acaccacaaaucugaaug

SEQ ID NO: 1995674 - RNA, 15 nt, Homo sapiens
caaggucauuucuuc

SEQ ID NO: 1995675 - RNA, 17 nt, Homo sapiens
auuucucuaacccuauc

SEQ ID NO: 1995676 - RNA, 20 nt, Homo sapiens
gcuuucuucucugccuccuc

SEQ ID NO: 1995677 - RNA, 18 nt, Homo sapiens
auucaagguuuguucaac

SEQ ID NO: 1995678 - RNA, 21 nt, Homo sapiens
agcugaccuggagaugcugcc

SEQ ID NO: 1995679 - RNA, 20 nt, Homo sapiens
uguuucaaacaaaaagucau

SEQ ID NO: 1995680 - RNA, 16 nt, Homo sapiens
cuauguuaucagucuc

SEQ ID NO: 1995681 - RNA, 11 nt, Homo sapiens
accacaauuca

SEQ ID NO: 1995682 - RNA, 24 nt, Homo sapiens
gaaugucaagguucccucccacuc

SEQ ID NO: 1995683 - RNA, 13 nt, Homo sapiens
cucucaucacuga

SEQ ID NO: 1995684 - RNA, 19 nt, Homo sapiens
cugcagguugaagccaugu

SEQ ID NO: 1995685 - RNA, 13 nt, Homo sapiens
aauauccauauag

SEQ ID NO: 1995686 - RNA, 21 nt, Homo sapiens
ugaggauggagcaacccaaua

SEQ ID NO: 1995687 - RNA, 20 nt, Homo sapiens
ccucugacuaguagauuucu

SEQ ID NO: 1995688 - RNA, 17 nt, Homo sapiens
ugggcccugcacagaua

SEQ ID NO: 1995689 - RNA, 15 nt, Homo sapiens
ugaacuucucucaga

SEQ ID NO: 1995690 - RNA, 20 nt, Homo sapiens
cuuuccuggcugaucagagc

SEQ ID NO: 1995691 - RNA, 23 nt, Homo sapiens
ccaauucuaaauccgacuugaau

SEQ ID NO: 1995692 - RNA, 14 nt, Homo sapiens
ugcuuggguguaac

SEQ ID NO: 1995693 - RNA, 19 nt, Homo sapiens
guuuauuguauacugccuu

SEQ ID NO: 1995694 - RNA, 15 nt, Homo sapiens
ugaaauucucaucag

SEQ ID NO: 1995695 - RNA, 18 nt, Homo sapiens
cagcauccucaguuccug

SEQ ID NO: 1995696 - RNA, 19 nt, Homo sapiens
caaaucacaucucaccucc

SEQ ID NO: 1995697 - RNA, 22 nt, Homo sapiens
gcucuagagaaaagucuacccc

SEQ ID NO: 1995698 - RNA, 19 nt, Homo sapiens
uaugggaacaaguguacag

SEQ ID NO: 1995699 - RNA, 18 nt, Homo sapiens
cucugcagaacagugaaa

SEQ ID NO: 1995700 - RNA, 15 nt, Homo sapiens
cugccacaaugugau

SEQ ID NO: 1995701 - RNA, 15 nt, Homo sapiens
uuucacuguauucaa

SEQ ID NO: 1995702 - RNA, 14 nt, Homo sapiens
ugguuuaaagcaaa

SEQ ID NO: 1995703 - RNA, 12 nt, Homo sapiens
auggcucagaug

SEQ ID NO: 1995704 - RNA, 23 nt, Homo sapiens
uuaugaaaagauaacuucaugaa

SEQ ID NO: 1995705 - RNA, 16 nt, Homo sapiens
uuuuccucuucuagau

SEQ ID NO: 1995706 - RNA, 19 nt, Homo sapiens
uacccaggaccaagccaca

SEQ ID NO: 1995707 - RNA, 22 nt, Homo sapiens
gguacaguauggggguuguaaa

SEQ ID NO: 1995708 - RNA, 20 nt, Homo sapiens
aguaacuuaaccagcacauu

SEQ ID NO: 1995709 - RNA, 21 nt, Homo sapiens
gggcugaccugccucucacac

SEQ ID NO: 1995710 - RNA, 12 nt, Homo sapiens
agaccuggccaa

SEQ ID NO: 1995711 - RNA, 17 nt, Homo sapiens
aggccagccugucccug

SEQ ID NO: 1995712 - RNA, 22 nt, Homo sapiens
agaauucugagauccagcacaa

SEQ ID NO: 1995713 - RNA, 23 nt, Homo sapiens
gcacauugucaccccaagccaua

SEQ ID NO: 1995714 - RNA, 18 nt, Homo sapiens
auucccccaucuagccau

SEQ ID NO: 1995715 - RNA, 22 nt, Homo sapiens
ccacuggcccagggccaccucu

SEQ ID NO: 1995716 - RNA, 13 nt, Homo sapiens
ugccacgcuuuuu

SEQ ID NO: 1995717 - RNA, 15 nt, Homo sapiens
auggacugcacaaaa

SEQ ID NO: 1995718 - RNA, 15 nt, Homo sapiens
aucugaucugaguga

SEQ ID NO: 1995719 - RNA, 15 nt, Homo sapiens
gauggcccauucuac

SEQ ID NO: 1995720 - RNA, 18 nt, Homo sapiens
augagauaggcacaugca

SEQ ID NO: 1995721 - RNA, 15 nt, Homo sapiens
uugacugccuaugcc

SEQ ID NO: 1995722 - RNA, 22 nt, Homo sapiens
acuuagagcacuagaagcacag

SEQ ID NO: 1995723 - RNA, 19 nt, Homo sapiens
caacaacacaauaacacua

SEQ ID NO: 1995724 - RNA, 17 nt, Homo sapiens
ggcaucuaauucuuauu

SEQ ID NO: 1995725 - RNA, 17 nt, Homo sapiens
ugccccugcacuccagc

SEQ ID NO: 1995726 - RNA, 16 nt, Homo sapiens
uacacucuugauucua

SEQ ID NO: 1995727 - RNA, 13 nt, Homo sapiens
ggccugauggugc

SEQ ID NO: 1995728 - RNA, 21 nt, Homo sapiens
aaagugagaugggaagggcuu

SEQ ID NO: 1995729 - RNA, 20 nt, Homo sapiens
gaaacuuugcagaugugauu

SEQ ID NO: 1995730 - RNA, 15 nt, Homo sapiens
gacaguguuuugcca

SEQ ID NO: 1995731 - RNA, 11 nt, Homo sapiens
cuguguauaca

SEQ ID NO: 1995732 - RNA, 17 nt, Homo sapiens
uauuauacgcuggcaac

SEQ ID NO: 1995733 - RNA, 13 nt, Homo sapiens
ucucauccaucac

SEQ ID NO: 1995734 - RNA, 17 nt, Homo sapiens
uguggcugucaggacac

SEQ ID NO: 1995735 - RNA, 13 nt, Homo sapiens
auuuguagcacug

SEQ ID NO: 1995736 - RNA, 18 nt, Homo sapiens
auugcccccagggcacuu

SEQ ID NO: 1995737 - RNA, 15 nt, Homo sapiens
uacuuacauaucuga

SEQ ID NO: 1995738 - RNA, 16 nt, Homo sapiens
ucaguaguucacuuua

SEQ ID NO: 1995739 - RNA, 16 nt, Homo sapiens
ucugcauauuucugua

SEQ ID NO: 1995740 - RNA, 21 nt, Homo sapiens
aaggagaacugugcucuccca

SEQ ID NO: 1995741 - RNA, 14 nt, Homo sapiens
aaauuuaccacaga

SEQ ID NO: 1995742 - RNA, 16 nt, Homo sapiens
aguggcgcgaucucag

SEQ ID NO: 1995743 - RNA, 16 nt, Homo sapiens
cauuuaugaugcaguu

SEQ ID NO: 1995744 - RNA, 16 nt, Homo sapiens
ccauaauaaaauauca

SEQ ID NO: 1995745 - RNA, 16 nt, Homo sapiens
augacacaacugcacu

SEQ ID NO: 1995746 - RNA, 16 nt, Homo sapiens
ucugcacuuugacaca

SEQ ID NO: 1995747 - RNA, 14 nt, Homo sapiens
uuuugguggugaua

SEQ ID NO: 1995748 - RNA, 19 nt, Homo sapiens
uuaaugcacagugcauuau

SEQ ID NO: 1995749 - RNA, 20 nt, Homo sapiens
guuaaauagaguauaugcac

SEQ ID NO: 1995750 - RNA, 19 nt, Homo sapiens
uggcauagcccauguuaag

SEQ ID NO: 1995751 - RNA, 14 nt, Homo sapiens
guacagaguggaau

SEQ ID NO: 1995752 - RNA, 13 nt, Homo sapiens
cuaaaucagagac

SEQ ID NO: 1995753 - RNA, 16 nt, Homo sapiens
uggaugcagcuucaag

SEQ ID NO: 1995754 - RNA, 16 nt, Homo sapiens
gcaaccucuuugcuca

SEQ ID NO: 1995755 - RNA, 19 nt, Homo sapiens
ucaagaacaggacauagca

SEQ ID NO: 1995756 - RNA, 16 nt, Homo sapiens
gacuuaacauagccaa

SEQ ID NO: 1995757 - RNA, 23 nt, Homo sapiens
caccucacuagcuccccaauccc

SEQ ID NO: 1995758 - RNA, 16 nt, Homo sapiens
cucucaagcuagccag

SEQ ID NO: 1995759 - RNA, 22 nt, Homo sapiens
auauguaauuucaaaauacauu

SEQ ID NO: 1995760 - RNA, 24 nt, Homo sapiens
acuagcauaugaguuucauagcua

SEQ ID NO: 1995761 - RNA, 20 nt, Homo sapiens
uuguuuuacaucuuuuggga

SEQ ID NO: 1995762 - RNA, 15 nt, Homo sapiens
uucauccccugugaa

SEQ ID NO: 1995763 - RNA, 17 nt, Homo sapiens
ccagauccucugcugac

SEQ ID NO: 1995764 - RNA, 20 nt, Homo sapiens
gucccuacuagagaccucuc

SEQ ID NO: 1995765 - RNA, 20 nt, Homo sapiens
auauacauacuuacaugugu

SEQ ID NO: 1995766 - RNA, 18 nt, Homo sapiens
aguauguuuuacacugua

SEQ ID NO: 1995767 - RNA, 19 nt, Homo sapiens
cuucugacuuuuagaaaca

SEQ ID NO: 1995768 - RNA, 19 nt, Homo sapiens
uccuuucaccccauccaca

SEQ ID NO: 1995769 - RNA, 15 nt, Homo sapiens
uugggagcaggauuu

SEQ ID NO: 1995770 - RNA, 15 nt, Homo sapiens
accucugauuacaau

SEQ ID NO: 1995771 - RNA, 17 nt, Homo sapiens
aaaaugcaccaaucagc

SEQ ID NO: 1995772 - RNA, 17 nt, Homo sapiens
cuuugccuucauucugc

SEQ ID NO: 1995773 - RNA, 18 nt, Homo sapiens
gaaaccuguuaugccaaa

SEQ ID NO: 1995774 - RNA, 21 nt, Homo sapiens
aaucuuccuuuguugcacaaa

SEQ ID NO: 1995775 - RNA, 18 nt, Homo sapiens
uuucucauaucaacuuag

SEQ ID NO: 1995776 - RNA, 14 nt, Homo sapiens
cuagccagugcuca

SEQ ID NO: 1995777 - RNA, 12 nt, Homo sapiens
cucaacaagcaa

SEQ ID NO: 1995778 - RNA, 13 nt, Homo sapiens
caggaguuugugg

SEQ ID NO: 1995779 - RNA, 18 nt, Homo sapiens
aaauuaccaaacaaagca

SEQ ID NO: 1995780 - RNA, 15 nt, Homo sapiens
cccaccccacuccag

SEQ ID NO: 1995781 - RNA, 11 nt, Homo sapiens
cccuuccccag

SEQ ID NO: 1995782 - RNA, 21 nt, Homo sapiens
uggggaaggcgacugagccau

SEQ ID NO: 1995783 - RNA, 18 nt, Homo sapiens
ugaaaucaguaaacacug

SEQ ID NO: 1995784 - RNA, 22 nt, Homo sapiens
gccgaccacagggccuugaauc

SEQ ID NO: 1995785 - RNA, 22 nt, Homo sapiens
ggcaaaucauuuggacaaucug

SEQ ID NO: 1995786 - RNA, 13 nt, Homo sapiens
ggcaggggcccac

SEQ ID NO: 1995787 - RNA, 18 nt, Homo sapiens
uuagucauaccauccauc

SEQ ID NO: 1995788 - RNA, 15 nt, Homo sapiens
uccaguucaugagaa

SEQ ID NO: 1995789 - RNA, 16 nt, Homo sapiens
uagcacagacccugcc

SEQ ID NO: 1995790 - RNA, 23 nt, Homo sapiens
ggaggcagcgugggcucugccaa

SEQ ID NO: 1995791 - RNA, 14 nt, Homo sapiens
uggagcagccagag

SEQ ID NO: 1995792 - RNA, 17 nt, Homo sapiens
aauuaaccuggugcugg

SEQ ID NO: 1995793 - RNA, 19 nt, Homo sapiens
gugacaauuaaaagugucu

SEQ ID NO: 1995794 - RNA, 16 nt, Homo sapiens
aauucuugcuaugaaa

SEQ ID NO: 1995795 - RNA, 16 nt, Homo sapiens
caacuuagagauugca

SEQ ID NO: 1995796 - RNA, 17 nt, Homo sapiens
ugcugcaccccaugugg

SEQ ID NO: 1995797 - RNA, 19 nt, Homo sapiens
aaugaaauaauacuucagc

SEQ ID NO: 1995798 - RNA, 22 nt, Homo sapiens
aaaaguggcauuuccuggucag

SEQ ID NO: 1995799 - RNA, 15 nt, Homo sapiens
uagguagacuuugcu

SEQ ID NO: 1995800 - RNA, 22 nt, Homo sapiens
acacaguggauggacggacaag

SEQ ID NO: 1995801 - RNA, 16 nt, Homo sapiens
aggugugcccuguaca

SEQ ID NO: 1995802 - RNA, 18 nt, Homo sapiens
gaaaauguuuaccagugu

SEQ ID NO: 1995803 - RNA, 19 nt, Homo sapiens
aaggaugucacagggccaa

SEQ ID NO: 1995804 - RNA, 12 nt, Homo sapiens
ugcaauuccacu

SEQ ID NO: 1995805 - RNA, 12 nt, Homo sapiens
ugaacacaggca

SEQ ID NO: 1995806 - RNA, 23 nt, Homo sapiens
aaccuuagaaagacuacauguua

SEQ ID NO: 1995807 - RNA, 23 nt, Homo sapiens
ugcagugguaugaucacggcuca

SEQ ID NO: 1995808 - RNA, 21 nt, Homo sapiens
auagacuguacuuauuuucca

SEQ ID NO: 1995809 - RNA, 11 nt, Homo sapiens
cugggccaaaa

SEQ ID NO: 1995810 - RNA, 13 nt, Homo sapiens
auuaaaugcaaaa

SEQ ID NO: 1995811 - RNA, 13 nt, Homo sapiens
aauguccauucuu

SEQ ID NO: 1995812 - RNA, 13 nt, Homo sapiens
uucuaccaaauga

SEQ ID NO: 1995813 - RNA, 20 nt, Homo sapiens
ggcgagugugggcauagcau

SEQ ID NO: 1995814 - RNA, 15 nt, Homo sapiens
accucgggugaucca

SEQ ID NO: 1995815 - RNA, 20 nt, Homo sapiens
uuucuugugagaaaagaaua

SEQ ID NO: 1995816 - RNA, 12 nt, Homo sapiens
uaaaauucacua

SEQ ID NO: 1995817 - RNA, 13 nt, Homo sapiens
caagaccaaagag

SEQ ID NO: 1995818 - RNA, 16 nt, Homo sapiens
aauucaccgugaaaua

SEQ ID NO: 1995819 - RNA, 17 nt, Homo sapiens
cuuggcaguguggacau

SEQ ID NO: 1995820 - RNA, 15 nt, Homo sapiens
uggggcugggguccu

SEQ ID NO: 1995821 - RNA, 17 nt, Homo sapiens
cacagaaaugagaucag

SEQ ID NO: 1995822 - RNA, 16 nt, Homo sapiens
caucuccagugugcca

SEQ ID NO: 1995823 - RNA, 21 nt, Homo sapiens
ugagacaggaggauugccuga

SEQ ID NO: 1995824 - RNA, 22 nt, Homo sapiens
guaguugcaaagagacauuuca

SEQ ID NO: 1995825 - RNA, 19 nt, Homo sapiens
aucuuggccuuacuguaua

SEQ ID NO: 1995826 - RNA, 16 nt, Homo sapiens
ggcuuugggacaccug

SEQ ID NO: 1995827 - RNA, 12 nt, Homo sapiens
aguuauaaccaa

SEQ ID NO: 1995828 - RNA, 17 nt, Homo sapiens
ugccagauuuugggauu

SEQ ID NO: 1995829 - RNA, 21 nt, Homo sapiens
guaagcucaagcuuuugcuca

SEQ ID NO: 1995830 - RNA, 20 nt, Homo sapiens
ucacacggcuugugggcacu

SEQ ID NO: 1995831 - RNA, 18 nt, Homo sapiens
gaaaauugcacuauugca

SEQ ID NO: 1995832 - RNA, 18 nt, Homo sapiens
gaaagggaaacugggaaa

SEQ ID NO: 1995833 - RNA, 14 nt, Homo sapiens
ugacaucacuugua

SEQ ID NO: 1995834 - RNA, 20 nt, Homo sapiens
uaggaaccugcacacgagca

SEQ ID NO: 1995835 - RNA, 18 nt, Homo sapiens
cacagcuauuuagaagca

SEQ ID NO: 1995836 - RNA, 18 nt, Homo sapiens
uauuuucccaugccaguu

SEQ ID NO: 1995837 - RNA, 21 nt, Homo sapiens
agucugauuaaagguggugcc

SEQ ID NO: 1995838 - RNA, 21 nt, Homo sapiens
ugauuccuauaaaucuaauga

SEQ ID NO: 1995839 - RNA, 15 nt, Homo sapiens
aaaaucacuauaucu

SEQ ID NO: 1995840 - RNA, 14 nt, Homo sapiens
aguuuacaguauuu

SEQ ID NO: 1995841 - RNA, 17 nt, Homo sapiens
acaggcaacauuacaaa

SEQ ID NO: 1995842 - RNA, 14 nt, Homo sapiens
uaugauugugcaca

SEQ ID NO: 1995843 - RNA, 20 nt, Homo sapiens
acccaggcuagagugcaaug

SEQ ID NO: 1995844 - RNA, 20 nt, Homo sapiens
acccaggcuggagugcagug

SEQ ID NO: 1995845 - RNA, 15 nt, Homo sapiens
caucacaugaccaca

SEQ ID NO: 1995846 - RNA, 16 nt, Homo sapiens
uucuagugaaacugca

SEQ ID NO: 1995847 - RNA, 17 nt, Homo sapiens
acuccagagggccuucc

SEQ ID NO: 1995848 - RNA, 16 nt, Homo sapiens
aaauauccugcucaca

SEQ ID NO: 1995849 - RNA, 19 nt, Homo sapiens
auaaggaucagaacagcag

SEQ ID NO: 1995850 - RNA, 17 nt, Homo sapiens
uuccuccccacacucca

SEQ ID NO: 1995851 - RNA, 17 nt, Homo sapiens
ucaaaagcugguggugu

SEQ ID NO: 1995852 - RNA, 15 nt, Homo sapiens
guccagcucugacau

SEQ ID NO: 1995853 - RNA, 17 nt, Homo sapiens
aaguuuacaacuugauu

SEQ ID NO: 1995854 - RNA, 19 nt, Homo sapiens
guagucccagcuacucagg

SEQ ID NO: 1995855 - RNA, 16 nt, Homo sapiens
auuaauuuccacuaaa

SEQ ID NO: 1995856 - RNA, 13 nt, Homo sapiens
agaacgucucuca

SEQ ID NO: 1995857 - RNA, 16 nt, Homo sapiens
agacauugacaagcac

SEQ ID NO: 1995858 - RNA, 20 nt, Homo sapiens
cggccuuccacccugacugc

SEQ ID NO: 1995859 - RNA, 22 nt, Homo sapiens
auugcaacucuuuuaagugccu

SEQ ID NO: 1995860 - RNA, 13 nt, Homo sapiens
gggaaccaaacac

SEQ ID NO: 1995861 - RNA, 19 nt, Homo sapiens
agcccagcaaaugaucagc

SEQ ID NO: 1995862 - RNA, 21 nt, Homo sapiens
aguugcugggauuacaggugu

SEQ ID NO: 1995863 - RNA, 21 nt, Homo sapiens
uuguagugguauagaguacug

SEQ ID NO: 1995864 - RNA, 15 nt, Homo sapiens
gaugguaaaccagau

SEQ ID NO: 1995865 - RNA, 14 nt, Homo sapiens
caggaacuugcaca

SEQ ID NO: 1995866 - RNA, 17 nt, Homo sapiens
cuguccagcagucacuu

SEQ ID NO: 1995867 - RNA, 20 nt, Homo sapiens
auaggaucugaggacaagga

SEQ ID NO: 1995868 - RNA, 21 nt, Homo sapiens
cuuacuucccuaaugaaguua

SEQ ID NO: 1995869 - RNA, 15 nt, Homo sapiens
uuugcuagcagaaau

SEQ ID NO: 1995870 - RNA, 18 nt, Homo sapiens
uguuauuuuaucugcuau

SEQ ID NO: 1995871 - RNA, 13 nt, Homo sapiens
cauuucccugugc

SEQ ID NO: 1995872 - RNA, 18 nt, Homo sapiens
guauuaaucaacauugua

SEQ ID NO: 1995873 - RNA, 15 nt, Homo sapiens
uccucucuuccucuu

SEQ ID NO: 1995874 - RNA, 16 nt, Homo sapiens
uagaauuaacacauga

SEQ ID NO: 1995875 - RNA, 16 nt, Homo sapiens
ggaaaguucagccaga

SEQ ID NO: 1995876 - RNA, 22 nt, Homo sapiens
cucccacaaugcugaugaaaac

SEQ ID NO: 1995877 - RNA, 15 nt, Homo sapiens
uaucuccucuugggc

SEQ ID NO: 1995878 - RNA, 18 nt, Homo sapiens
ucuguagugagauagcau

SEQ ID NO: 1995879 - RNA, 20 nt, Homo sapiens
agaauauuuuagccacucaa

SEQ ID NO: 1995880 - RNA, 13 nt, Homo sapiens
ccauuggugcaca

SEQ ID NO: 1995881 - RNA, 20 nt, Homo sapiens
gcuaauguuuaaaagcaaaa

SEQ ID NO: 1995882 - RNA, 17 nt, Homo sapiens
cacugagccauccucag

SEQ ID NO: 1995883 - RNA, 17 nt, Homo sapiens
aaguccucugcuccagc

SEQ ID NO: 1995884 - RNA, 19 nt, Homo sapiens
ggccacaaaacaccaaaga

SEQ ID NO: 1995885 - RNA, 20 nt, Homo sapiens
aguccccccgaccagauccu

SEQ ID NO: 1995886 - RNA, 22 nt, Homo sapiens
gcagacgugagugugacuuuuu

SEQ ID NO: 1995887 - RNA, 19 nt, Homo sapiens
ccugaguuugggauugugg

SEQ ID NO: 1995888 - RNA, 20 nt, Homo sapiens
cauccauuaccuccauccau

SEQ ID NO: 1995889 - RNA, 18 nt, Homo sapiens
aauaaggaaacgaugaaa

SEQ ID NO: 1995890 - RNA, 19 nt, Homo sapiens
ucaugacuccuacuuuuca

SEQ ID NO: 1995891 - RNA, 20 nt, Homo sapiens
cgguuuguauuuagugucuu

SEQ ID NO: 1995892 - RNA, 15 nt, Homo sapiens
uagauguauuuucaa

SEQ ID NO: 1995893 - RNA, 18 nt, Homo sapiens
acgugggagucugugcau

SEQ ID NO: 1995894 - RNA, 17 nt, Homo sapiens
aaagggaugaugggauu

SEQ ID NO: 1995895 - RNA, 17 nt, Homo sapiens
uuauccuuguuuccuua

SEQ ID NO: 1995896 - RNA, 20 nt, Homo sapiens
uaugugacauuuuacauuaa

SEQ ID NO: 1995897 - RNA, 17 nt, Homo sapiens
ugucuggccacacugga

SEQ ID NO: 1995898 - RNA, 18 nt, Homo sapiens
caggucuuucaaaaagca

SEQ ID NO: 1995899 - RNA, 23 nt, Homo sapiens
uccagaacaaauuguuuacauaa

SEQ ID NO: 1995900 - RNA, 19 nt, Homo sapiens
aaagagauuagaacauuua

SEQ ID NO: 1995901 - RNA, 14 nt, Homo sapiens
ugucaccaacugaa

SEQ ID NO: 1995902 - RNA, 11 nt, Homo sapiens
aaaguguuauu

SEQ ID NO: 1995903 - RNA, 19 nt, Homo sapiens
ccugcucucccuaaccccu

SEQ ID NO: 1995904 - RNA, 20 nt, Homo sapiens
ggugucaggcagguuugcca

SEQ ID NO: 1995905 - RNA, 20 nt, Homo sapiens
ugguggggugugcaugccac

SEQ ID NO: 1995906 - RNA, 23 nt, Homo sapiens
cagagguuuuguuagguuacaga

SEQ ID NO: 1995907 - RNA, 18 nt, Homo sapiens
agaaaugguuguauuaga

SEQ ID NO: 1995908 - RNA, 15 nt, Homo sapiens
uuuccuugucucuca

SEQ ID NO: 1995909 - RNA, 20 nt, Homo sapiens
cauuagugccauagaguuua

SEQ ID NO: 1995910 - RNA, 21 nt, Homo sapiens
caggguuucaccauguuggcc

SEQ ID NO: 1995911 - RNA, 17 nt, Homo sapiens
acagagucuggcucugu

SEQ ID NO: 1995912 - RNA, 11 nt, Homo sapiens
acauugcccaa

SEQ ID NO: 1995913 - RNA, 17 nt, Homo sapiens
gcugaacugacaaugaa

SEQ ID NO: 1995914 - RNA, 14 nt, Homo sapiens
uguguugaaugaag

SEQ ID NO: 1995915 - RNA, 15 nt, Homo sapiens
ggcucuccaagggaa

SEQ ID NO: 1995916 - RNA, 16 nt, Homo sapiens
ccacacauuaguacuu

SEQ ID NO: 1995917 - RNA, 15 nt, Homo sapiens
ugggggcaaugggag

SEQ ID NO: 1995918 - RNA, 21 nt, Homo sapiens
gugauugacacacagcacucu

SEQ ID NO: 1995919 - RNA, 21 nt, Homo sapiens
cucuguagcucaaucugcaaa

SEQ ID NO: 1995920 - RNA, 14 nt, Homo sapiens
ugaagaccuaaagu

SEQ ID NO: 1995921 - RNA, 15 nt, Homo sapiens
uuaugaaaaagaaga

SEQ ID NO: 1995922 - RNA, 16 nt, Homo sapiens
ugaugaguugagcucu

SEQ ID NO: 1995923 - RNA, 22 nt, Homo sapiens
aucaacauguuuuugauauuug

SEQ ID NO: 1995924 - RNA, 20 nt, Homo sapiens
caacauggcgaaaccccucu

SEQ ID NO: 1995925 - RNA, 13 nt, Homo sapiens
acuuuuaucacug

SEQ ID NO: 1995926 - RNA, 18 nt, Homo sapiens
augcauggaaauucccuu

SEQ ID NO: 1995927 - RNA, 17 nt, Homo sapiens
cagcuauaccucauuca

SEQ ID NO: 1995928 - RNA, 21 nt, Homo sapiens
acaggaggaagacaggcaaau

SEQ ID NO: 1995929 - RNA, 21 nt, Homo sapiens
cuuugcugucaaaacuacuga

SEQ ID NO: 1995930 - RNA, 14 nt, Homo sapiens
ucugcucacuuuaa

SEQ ID NO: 1995931 - RNA, 13 nt, Homo sapiens
uucuuuucugacu

SEQ ID NO: 1995932 - RNA, 21 nt, Homo sapiens
gauucagccaaaugcagggag

SEQ ID NO: 1995933 - RNA, 19 nt, Homo sapiens
agggacacguuaggaaugu

SEQ ID NO: 1995934 - RNA, 22 nt, Homo sapiens
uacaaaagcagcuuuuaguuca

SEQ ID NO: 1995935 - RNA, 18 nt, Homo sapiens
gcaaagcaaaaggcugag

SEQ ID NO: 1995936 - RNA, 14 nt, Homo sapiens
cuuaaagcacugau

SEQ ID NO: 1995937 - RNA, 23 nt, Homo sapiens
gacauacucucugccuggugguc

SEQ ID NO: 1995938 - RNA, 12 nt, Homo sapiens
aagaaaaugagc

SEQ ID NO: 1995939 - RNA, 19 nt, Homo sapiens
gugcaauggcacgaucuca

SEQ ID NO: 1995940 - RNA, 12 nt, Homo sapiens
auucuucuaauu

SEQ ID NO: 1995941 - RNA, 17 nt, Homo sapiens
gcugauguagugaccaa

SEQ ID NO: 1995942 - RNA, 19 nt, Homo sapiens
caaaucuaccacuguauga

SEQ ID NO: 1995943 - RNA, 12 nt, Homo sapiens
guuucacagugu

SEQ ID NO: 1995944 - RNA, 13 nt, Homo sapiens
uacauuuaugcac

SEQ ID NO: 1995945 - RNA, 18 nt, Homo sapiens
uucaaaguggaugcaauu

SEQ ID NO: 1995946 - RNA, 13 nt, Homo sapiens
agccagucaaaac

SEQ ID NO: 1995947 - RNA, 12 nt, Homo sapiens
uuccucucuuaa

SEQ ID NO: 1995948 - RNA, 22 nt, Homo sapiens
guacaaugauguaaauauuuca

SEQ ID NO: 1995949 - RNA, 18 nt, Homo sapiens
acuugaaaaaauguucua

SEQ ID NO: 1995950 - RNA, 12 nt, Homo sapiens
aaccucaaacaa

SEQ ID NO: 1995951 - RNA, 21 nt, Homo sapiens
auugauguuuuacgugcaaac

SEQ ID NO: 1995952 - RNA, 14 nt, Homo sapiens
uaauggaaugaagg

SEQ ID NO: 1995953 - RNA, 15 nt, Homo sapiens
uguggccccaacaca

SEQ ID NO: 1995954 - RNA, 14 nt, Homo sapiens
agauguagcaacau

SEQ ID NO: 1995955 - RNA, 19 nt, Homo sapiens
ggaaggauguuuagcagug

SEQ ID NO: 1995956 - RNA, 13 nt, Homo sapiens
aauccccaugcuu

SEQ ID NO: 1995957 - RNA, 20 nt, Homo sapiens
ucagcuagacauugcaauuu

SEQ ID NO: 1995958 - RNA, 12 nt, Homo sapiens
uuagaaagggaa

SEQ ID NO: 1995959 - RNA, 15 nt, Homo sapiens
uaaauucuaagccau

SEQ ID NO: 1995960 - RNA, 20 nt, Homo sapiens
gauacuaagcacaaagccca

SEQ ID NO: 1995961 - RNA, 13 nt, Homo sapiens
aauucugaugcua

SEQ ID NO: 1995962 - RNA, 18 nt, Homo sapiens
aguccgcaaguucaggga

SEQ ID NO: 1995963 - RNA, 21 nt, Homo sapiens
cuucagcucuucuugacauca

SEQ ID NO: 1995964 - RNA, 24 nt, Homo sapiens
caaguguguaugugcgugugugca

SEQ ID NO: 1995965 - RNA, 17 nt, Homo sapiens
uccuuucagaacacuca

SEQ ID NO: 1995966 - RNA, 22 nt, Homo sapiens
augaucuguggagaauguacac

SEQ ID NO: 1995967 - RNA, 14 nt, Homo sapiens
ccucgccacgggga

SEQ ID NO: 1995968 - RNA, 15 nt, Homo sapiens
ugguaaauacuguga

SEQ ID NO: 1995969 - RNA, 21 nt, Homo sapiens
agccgcgggcgcucgcucagg

SEQ ID NO: 1995970 - RNA, 14 nt, Homo sapiens
ccgcagccuggcau

SEQ ID NO: 1995971 - RNA, 17 nt, Homo sapiens
ucaguuucuaggcaccu

SEQ ID NO: 1995972 - RNA, 23 nt, Homo sapiens
ugcggccaguauuagacuggaag

SEQ ID NO: 1995973 - RNA, 17 nt, Homo sapiens
ugccaaugaccaaacag

SEQ ID NO: 1995974 - RNA, 15 nt, Homo sapiens
aucccuuguucucag

SEQ ID NO: 1995975 - RNA, 13 nt, Homo sapiens
gcaaaaguucuca

SEQ ID NO: 1995976 - RNA, 12 nt, Homo sapiens
gaauucauguga

SEQ ID NO: 1995977 - RNA, 15 nt, Homo sapiens
ugcaauuuuucaaga

SEQ ID NO: 1995978 - RNA, 18 nt, Homo sapiens
aauucuuuuucacacuga

SEQ ID NO: 1995979 - RNA, 20 nt, Homo sapiens
acaauggcuggguuugggca

SEQ ID NO: 1995980 - RNA, 16 nt, Homo sapiens
ucagugaccuguuuua

SEQ ID NO: 1995981 - RNA, 17 nt, Homo sapiens
auucaaagaaguacuuu

SEQ ID NO: 1995982 - RNA, 23 nt, Homo sapiens
aauacauuaacaagcucuuacuu

SEQ ID NO: 1995983 - RNA, 16 nt, Homo sapiens
acugggugucauuuca

SEQ ID NO: 1995984 - RNA, 18 nt, Homo sapiens
cuagaacccugagacaua

SEQ ID NO: 1995985 - RNA, 18 nt, Homo sapiens
aaguuuaugcauacagua

SEQ ID NO: 1995986 - RNA, 18 nt, Homo sapiens
uucuuacagacugcaugu

SEQ ID NO: 1995987 - RNA, 14 nt, Homo sapiens
agagagcugagacc

SEQ ID NO: 1995988 - RNA, 22 nt, Homo sapiens
auauaagaaugagccuguccaa

SEQ ID NO: 1995989 - RNA, 21 nt, Homo sapiens
caggaguuuuaaguccagcuu

SEQ ID NO: 1995990 - RNA, 11 nt, Homo sapiens
aaucacaaaaa

SEQ ID NO: 1995991 - RNA, 21 nt, Homo sapiens
uccccucgugugacucucuug

SEQ ID NO: 1995992 - RNA, 13 nt, Homo sapiens
auauuaugagaug

SEQ ID NO: 1995993 - RNA, 18 nt, Homo sapiens
uugcuaagaaugucuauu

SEQ ID NO: 1995994 - RNA, 14 nt, Homo sapiens
aucacucuaaaaaa

SEQ ID NO: 1995995 - RNA, 16 nt, Homo sapiens
caauuuguauaucaug

SEQ ID NO: 1995996 - RNA, 15 nt, Homo sapiens
gccccagcaccaacc

SEQ ID NO: 1995997 - RNA, 14 nt, Homo sapiens
ucgaggggcucuca

SEQ ID NO: 1995998 - RNA, 19 nt, Homo sapiens
cuucuaugcccagcugugc

SEQ ID NO: 1995999 - RNA, 11 nt, Homo sapiens
agauucacaua

SEQ ID NO: 1996000 - RNA, 18 nt, Homo sapiens
ccaggcuaauacaggaaa

SEQ ID NO: 1996001 - RNA, 14 nt, Homo sapiens
aaaaauaacaucug

SEQ ID NO: 1996002 - RNA, 12 nt, Homo sapiens
agaaagcaaaag

SEQ ID NO: 1996003 - RNA, 15 nt, Homo sapiens
gcuaacuaaugccau

SEQ ID NO: 1996004 - RNA, 15 nt, Homo sapiens
acuccucacagcauc

SEQ ID NO: 1996005 - RNA, 16 nt, Homo sapiens
uguccuccaccaugca

SEQ ID NO: 1996006 - RNA, 13 nt, Homo sapiens
ugauugcuuuuau

SEQ ID NO: 1996007 - RNA, 12 nt, Homo sapiens
auacugcaugcu

SEQ ID NO: 1996008 - RNA, 13 nt, Homo sapiens
auuuugacacugg

SEQ ID NO: 1996009 - RNA, 14 nt, Homo sapiens
auauccaagacuua

SEQ ID NO: 1996010 - RNA, 13 nt, Homo sapiens
guuuaacugaaag

SEQ ID NO: 1996011 - RNA, 13 nt, Homo sapiens
uaaugacuuuuaa

SEQ ID NO: 1996012 - RNA, 21 nt, Homo sapiens
gagcccugaggaccucucagc

SEQ ID NO: 1996013 - RNA, 20 nt, Homo sapiens
ccaguuggcagacagccguu

SEQ ID NO: 1996014 - RNA, 21 nt, Homo sapiens
cuaaaguguauuuuuuuacua

SEQ ID NO: 1996015 - RNA, 23 nt, Homo sapiens
uguaacucaacuaacaaaaucaa

SEQ ID NO: 1996016 - RNA, 21 nt, Homo sapiens
uuugccaucggaacugccuua

SEQ ID NO: 1996017 - RNA, 17 nt, Homo sapiens
cuucugaugaaucuugc

SEQ ID NO: 1996018 - RNA, 21 nt, Homo sapiens
cuucuauuuggggcuugauga

SEQ ID NO: 1996019 - RNA, 15 nt, Homo sapiens
cugccccuuccccau

SEQ ID NO: 1996020 - RNA, 23 nt, Homo sapiens
gcaucugggauucccaccaaggu

SEQ ID NO: 1996021 - RNA, 23 nt, Homo sapiens
caaggaaauaaagcguccucuca

SEQ ID NO: 1996022 - RNA, 14 nt, Homo sapiens
auaaagaccuucca

SEQ ID NO: 1996023 - RNA, 16 nt, Homo sapiens
cccaguggaacaguca

SEQ ID NO: 1996024 - RNA, 23 nt, Homo sapiens
cauggaacucauuccugccuguc

SEQ ID NO: 1996025 - RNA, 14 nt, Homo sapiens
ccagccugccaggc

SEQ ID NO: 1996026 - RNA, 14 nt, Homo sapiens
cacagaugcacaca

SEQ ID NO: 1996027 - RNA, 14 nt, Homo sapiens
ccaagaugccaaca

SEQ ID NO: 1996028 - RNA, 13 nt, Homo sapiens
gaaucuacagaac

SEQ ID NO: 1996029 - RNA, 22 nt, Homo sapiens
aaaaugauacuguguucccuca

SEQ ID NO: 1996030 - RNA, 23 nt, Homo sapiens
acuuugagcugagugcugaaaua

SEQ ID NO: 1996031 - RNA, 22 nt, Homo sapiens
uaagcugccuguacacaacuca

SEQ ID NO: 1996032 - RNA, 22 nt, Homo sapiens
ucaauaaacagcaggugauaca

SEQ ID NO: 1996033 - RNA, 21 nt, Homo sapiens
uauucuaaucaguaguucacu

SEQ ID NO: 1996034 - RNA, 12 nt, Homo sapiens
agggacucccac

SEQ ID NO: 1996035 - RNA, 17 nt, Homo sapiens
uacaaauauauuguuaa

SEQ ID NO: 1996036 - RNA, 19 nt, Homo sapiens
cauuuuacucuuaugauca

SEQ ID NO: 1996037 - RNA, 14 nt, Homo sapiens
ccacaggugccugg

SEQ ID NO: 1996038 - RNA, 14 nt, Homo sapiens
ccuuccagugcagg

SEQ ID NO: 1996039 - RNA, 21 nt, Homo sapiens
caacuuaaaagucaguaucau

SEQ ID NO: 1996040 - RNA, 15 nt, Homo sapiens
guaccucaucugcac

SEQ ID NO: 1996041 - RNA, 20 nt, Homo sapiens
gcuggagugcaguggugcca

SEQ ID NO: 1996042 - RNA, 17 nt, Homo sapiens
aauaucauaaagcauuu

SEQ ID NO: 1996043 - RNA, 17 nt, Homo sapiens
ccuuugauuuuugccca

SEQ ID NO: 1996044 - RNA, 20 nt, Homo sapiens
ugauaguguuuuguacuugu

SEQ ID NO: 1996045 - RNA, 23 nt, Homo sapiens
ugaagaauauuuaagaaaagcac

SEQ ID NO: 1996046 - RNA, 17 nt, Homo sapiens
aaguauaacaacuuuga

SEQ ID NO: 1996047 - RNA, 17 nt, Homo sapiens
ugggcagggucucugcu

SEQ ID NO: 1996048 - RNA, 15 nt, Homo sapiens
cucaaugugcuguug

SEQ ID NO: 1996049 - RNA, 19 nt, Homo sapiens
gauauggacucucuaagga

SEQ ID NO: 1996050 - RNA, 22 nt, Homo sapiens
auauacucuucgauguacuugu

SEQ ID NO: 1996051 - RNA, 23 nt, Homo sapiens
ucacugcaguagugcaccaucuc

SEQ ID NO: 1996052 - RNA, 13 nt, Homo sapiens
ucaagaaaagcau

SEQ ID NO: 1996053 - RNA, 18 nt, Homo sapiens
gcaagacuucucuuugcc

SEQ ID NO: 1996054 - RNA, 18 nt, Homo sapiens
aucuauaguagacacacu

SEQ ID NO: 1996055 - RNA, 22 nt, Homo sapiens
agcuugagcuccccuggagcca

SEQ ID NO: 1996056 - RNA, 20 nt, Homo sapiens
cauugcacugaucuuacucu

SEQ ID NO: 1996057 - RNA, 18 nt, Homo sapiens
cuuggcuucgugaaugua

SEQ ID NO: 1996058 - RNA, 22 nt, Homo sapiens
caggccacugcaaacccugcug

SEQ ID NO: 1996059 - RNA, 16 nt, Homo sapiens
uucacagaugugugau

SEQ ID NO: 1996060 - RNA, 19 nt, Homo sapiens
guuugcaguguuaagauaa

SEQ ID NO: 1996061 - RNA, 14 nt, Homo sapiens
ggcccugucugugu

SEQ ID NO: 1996062 - RNA, 13 nt, Homo sapiens
uuacuguucaugg

SEQ ID NO: 1996063 - RNA, 14 nt, Homo sapiens
aggaauccuuacug

SEQ ID NO: 1996064 - RNA, 21 nt, Homo sapiens
cuagggcccaggaucaaguca

SEQ ID NO: 1996065 - RNA, 19 nt, Homo sapiens
cagccagggccugcgaggg

SEQ ID NO: 1996066 - RNA, 20 nt, Homo sapiens
acugccaugccucaagaaca

SEQ ID NO: 1996067 - RNA, 17 nt, Homo sapiens
aaagugguucuggauau

SEQ ID NO: 1996068 - RNA, 14 nt, Homo sapiens
cgugcacucaguca

SEQ ID NO: 1996069 - RNA, 18 nt, Homo sapiens
gaaaccaacaagaaccac

SEQ ID NO: 1996070 - RNA, 21 nt, Homo sapiens
aaaugguuuuuaaacaaccaa

SEQ ID NO: 1996071 - RNA, 19 nt, Homo sapiens
augaucuaauaaacuuuau

SEQ ID NO: 1996072 - RNA, 17 nt, Homo sapiens
cuaaacauguauguaaa

SEQ ID NO: 1996073 - RNA, 19 nt, Homo sapiens
cggccaggcuggagugcag

SEQ ID NO: 1996074 - RNA, 13 nt, Homo sapiens
acuggugggccau

SEQ ID NO: 1996075 - RNA, 22 nt, Homo sapiens
ucuucauuuuuuaaugugcucu

SEQ ID NO: 1996076 - RNA, 14 nt, Homo sapiens
auaacuuauuugcc

SEQ ID NO: 1996077 - RNA, 21 nt, Homo sapiens
agauaggcacaugcaucuucu

SEQ ID NO: 1996078 - RNA, 13 nt, Homo sapiens
aaguggcaccuaa

SEQ ID NO: 1996079 - RNA, 21 nt, Homo sapiens
agugaccccugccuacuuccu

SEQ ID NO: 1996080 - RNA, 14 nt, Homo sapiens
uuuacugacugcuu

SEQ ID NO: 1996081 - RNA, 17 nt, Homo sapiens
caaaguaaacaaaagau

SEQ ID NO: 1996082 - RNA, 23 nt, Homo sapiens
auacuguuuuacuguccaaagac

SEQ ID NO: 1996083 - RNA, 12 nt, Homo sapiens
caggugaacaaa

SEQ ID NO: 1996084 - RNA, 15 nt, Homo sapiens
aggagcccacagugc

SEQ ID NO: 1996085 - RNA, 18 nt, Homo sapiens
acauagaugucccuuucu

SEQ ID NO: 1996086 - RNA, 20 nt, Homo sapiens
gagccuguccuuccaugccc

SEQ ID NO: 1996087 - RNA, 17 nt, Homo sapiens
aagaugguuaagucaau

SEQ ID NO: 1996088 - RNA, 13 nt, Homo sapiens
caguguugccaga

SEQ ID NO: 1996089 - RNA, 16 nt, Homo sapiens
guaucccugcucugcu

SEQ ID NO: 1996090 - RNA, 22 nt, Homo sapiens
agggaacggcgaugaacaaaug

SEQ ID NO: 1996091 - RNA, 18 nt, Homo sapiens
cuguucgaguagcucagc

SEQ ID NO: 1996092 - RNA, 21 nt, Homo sapiens
caaaaauggauauuauuagaa

SEQ ID NO: 1996093 - RNA, 14 nt, Homo sapiens
ugauugaagucuuc

SEQ ID NO: 1996094 - RNA, 20 nt, Homo sapiens
ccccagagcucuaaccaaag

SEQ ID NO: 1996095 - RNA, 19 nt, Homo sapiens
caugggaauauucaaauau

SEQ ID NO: 1996096 - RNA, 18 nt, Homo sapiens
cuccuguuagcuguuauu

SEQ ID NO: 1996097 - RNA, 18 nt, Homo sapiens
uucagggagaaacuccaa

SEQ ID NO: 1996098 - RNA, 14 nt, Homo sapiens
cuuucacacuucca

SEQ ID NO: 1996099 - RNA, 14 nt, Homo sapiens
agcucacaagccca

SEQ ID NO: 1996100 - RNA, 14 nt, Homo sapiens
uaauaacauaacaa

SEQ ID NO: 1996101 - RNA, 16 nt, Homo sapiens
gcccagcgcucgccac

SEQ ID NO: 1996102 - RNA, 16 nt, Homo sapiens
ggacuuuucgaccaau

SEQ ID NO: 1996103 - RNA, 16 nt, Homo sapiens
uuuguuuuuuaaucuu

SEQ ID NO: 1996104 - RNA, 23 nt, Homo sapiens
ucucuauaaguguucaguguuga

SEQ ID NO: 1996105 - RNA, 21 nt, Homo sapiens
ggcuuagaaaguccaauucca

SEQ ID NO: 1996106 - RNA, 22 nt, Homo sapiens
gccccuuacuaugaucucagga

SEQ ID NO: 1996107 - RNA, 16 nt, Homo sapiens
ccagcauccugauuaa

SEQ ID NO: 1996108 - RNA, 16 nt, Homo sapiens
cuuuauuaaauauuca

SEQ ID NO: 1996109 - RNA, 23 nt, Homo sapiens
caccucaaccuucggaguagcug

SEQ ID NO: 1996110 - RNA, 17 nt, Homo sapiens
auuuuauacugcacuuu

SEQ ID NO: 1996111 - RNA, 13 nt, Homo sapiens
acagcaaaaccau

SEQ ID NO: 1996112 - RNA, 17 nt, Homo sapiens
ucuugcucugucaccca

SEQ ID NO: 1996113 - RNA, 19 nt, Homo sapiens
ugcauuacgauaaacauua

SEQ ID NO: 1996114 - RNA, 18 nt, Homo sapiens
aguacaccccaacagcac

SEQ ID NO: 1996115 - RNA, 15 nt, Homo sapiens
ucacuaagagcuuua

SEQ ID NO: 1996116 - RNA, 22 nt, Homo sapiens
uggcuuuuuguacuguaguuca

SEQ ID NO: 1996117 - RNA, 15 nt, Homo sapiens
ugggagcuuauugcu

SEQ ID NO: 1996118 - RNA, 18 nt, Homo sapiens
ucuucuuuuccuuuaucc

SEQ ID NO: 1996119 - RNA, 19 nt, Homo sapiens
guaggaaccgaucugcuau

SEQ ID NO: 1996120 - RNA, 17 nt, Homo sapiens
gcacaguacccggugac

SEQ ID NO: 1996121 - RNA, 21 nt, Homo sapiens
aaaaccaacagguuuaucuga

SEQ ID NO: 1996122 - RNA, 14 nt, Homo sapiens
uuccuuccugagaa

SEQ ID NO: 1996123 - RNA, 13 nt, Homo sapiens
aacagauugccau

SEQ ID NO: 1996124 - RNA, 19 nt, Homo sapiens
cuuucuuauuuuguaauaa

SEQ ID NO: 1996125 - RNA, 16 nt, Homo sapiens
gaugacgccucuggac

SEQ ID NO: 1996126 - RNA, 14 nt, Homo sapiens
aauauuuauugaag

SEQ ID NO: 1996127 - RNA, 16 nt, Homo sapiens
uggcucccaggguccu

SEQ ID NO: 1996128 - RNA, 21 nt, Homo sapiens
cugggauccuaagggcucacc

SEQ ID NO: 1996129 - RNA, 14 nt, Homo sapiens
caaacagaucacua

SEQ ID NO: 1996130 - RNA, 18 nt, Homo sapiens
auugcuuaccugaucuca

SEQ ID NO: 1996131 - RNA, 12 nt, Homo sapiens
aggagaugucau

SEQ ID NO: 1996132 - RNA, 14 nt, Homo sapiens
ucugcagcaaugaa

SEQ ID NO: 1996133 - RNA, 16 nt, Homo sapiens
cuaaaagguaugcaau

SEQ ID NO: 1996134 - RNA, 12 nt, Homo sapiens
guaaagccaugc

SEQ ID NO: 1996135 - RNA, 12 nt, Homo sapiens
gggaagccagac

SEQ ID NO: 1996136 - RNA, 19 nt, Homo sapiens
aauagugauuuccacagug

SEQ ID NO: 1996137 - RNA, 23 nt, Homo sapiens
ugauuuauggucagaauuucccu

SEQ ID NO: 1996138 - RNA, 16 nt, Homo sapiens
ugacacugacauuuca

SEQ ID NO: 1996139 - RNA, 13 nt, Homo sapiens
uguccugccuuga

SEQ ID NO: 1996140 - RNA, 12 nt, Homo sapiens
aaggauccagac

SEQ ID NO: 1996141 - RNA, 23 nt, Homo sapiens
cccuacuuugcuuccgccacuca

SEQ ID NO: 1996142 - RNA, 21 nt, Homo sapiens
gaccaggaagcucggugagug

SEQ ID NO: 1996143 - RNA, 19 nt, Homo sapiens
agcccaacuagaagccuag

SEQ ID NO: 1996144 - RNA, 16 nt, Homo sapiens
agggcagggcucugau

SEQ ID NO: 1996145 - RNA, 16 nt, Homo sapiens
aggccagugcugugag

SEQ ID NO: 1996146 - RNA, 12 nt, Homo sapiens
acuuucauguca

SEQ ID NO: 1996147 - RNA, 13 nt, Homo sapiens
acuuaaagugcaa

SEQ ID NO: 1996148 - RNA, 22 nt, Homo sapiens
cgaggagugacugccaaaaagg

SEQ ID NO: 1996149 - RNA, 15 nt, Homo sapiens
uacacccaccagagu

SEQ ID NO: 1996150 - RNA, 16 nt, Homo sapiens
caauuuuuugcuaaac

SEQ ID NO: 1996151 - RNA, 23 nt, Homo sapiens
uacgcgccauuagggcuuuuugc

SEQ ID NO: 1996152 - RNA, 21 nt, Homo sapiens
cugucuggaggggagcucugu

SEQ ID NO: 1996153 - RNA, 22 nt, Homo sapiens
uuugauccgcagcaggggccag

SEQ ID NO: 1996154 - RNA, 16 nt, Homo sapiens
ccccagcccacaggug

SEQ ID NO: 1996155 - RNA, 20 nt, Homo sapiens
ugguaaccagccacaguaca

SEQ ID NO: 1996156 - RNA, 19 nt, Homo sapiens
aaugaagacccaguguaaa

SEQ ID NO: 1996157 - RNA, 13 nt, Homo sapiens
aacuccaggguua

SEQ ID NO: 1996158 - RNA, 16 nt, Homo sapiens
uaugggaucugauaag

SEQ ID NO: 1996159 - RNA, 22 nt, Homo sapiens
agccuuggauacuccauggggu

SEQ ID NO: 1996160 - RNA, 16 nt, Homo sapiens
ccuuuaguggcuucau

SEQ ID NO: 1996161 - RNA, 19 nt, Homo sapiens
aaaguagguauacaaaaga

SEQ ID NO: 1996162 - RNA, 18 nt, Homo sapiens
cagcccuguccccugaaa

SEQ ID NO: 1996163 - RNA, 23 nt, Homo sapiens
agcuucuaauaaauuauacaaau

SEQ ID NO: 1996164 - RNA, 18 nt, Homo sapiens
cuacugaaauuuacacaa

SEQ ID NO: 1996165 - RNA, 19 nt, Homo sapiens
gaucaguguuguugcucua

SEQ ID NO: 1996166 - RNA, 16 nt, Homo sapiens
ccguggucccugagga

SEQ ID NO: 1996167 - RNA, 14 nt, Homo sapiens
caguguuaagguaa

SEQ ID NO: 1996168 - RNA, 20 nt, Homo sapiens
aaucagagcuccaguuugca

SEQ ID NO: 1996169 - RNA, 19 nt, Homo sapiens
augauaaaaaaguguccua

SEQ ID NO: 1996170 - RNA, 23 nt, Homo sapiens
auugguugccucugccuuuguga

SEQ ID NO: 1996171 - RNA, 14 nt, Homo sapiens
ucuaggugcuuucc

SEQ ID NO: 1996172 - RNA, 13 nt, Homo sapiens
ugcuucaaauuca

SEQ ID NO: 1996173 - RNA, 17 nt, Homo sapiens
agcauugggcugggcuc

SEQ ID NO: 1996174 - RNA, 15 nt, Homo sapiens
aucugggcuggcaga

SEQ ID NO: 1996175 - RNA, 17 nt, Homo sapiens
aggcgggaggaucacuu

SEQ ID NO: 1996176 - RNA, 15 nt, Homo sapiens
agaaauaaacauaag

SEQ ID NO: 1996177 - RNA, 18 nt, Homo sapiens
ucaccuuuauauauguac

SEQ ID NO: 1996178 - RNA, 14 nt, Homo sapiens
gcuguuccugagaa

SEQ ID NO: 1996179 - RNA, 20 nt, Homo sapiens
cuccugcuuccuccagggaa

SEQ ID NO: 1996180 - RNA, 20 nt, Homo sapiens
ccucuuuauuuuuugauuga

SEQ ID NO: 1996181 - RNA, 22 nt, Homo sapiens
auuccuuuggaaaaccaaacua

SEQ ID NO: 1996182 - RNA, 15 nt, Homo sapiens
caaacguguagccaa

SEQ ID NO: 1996183 - RNA, 20 nt, Homo sapiens
gccaggauccucuccuuuga

SEQ ID NO: 1996184 - RNA, 21 nt, Homo sapiens
aacuuuuccuuucauacgucu

SEQ ID NO: 1996185 - RNA, 18 nt, Homo sapiens
agacauaaguaaaugagc

SEQ ID NO: 1996186 - RNA, 23 nt, Homo sapiens
gucuccucuuggccucagcagcu

SEQ ID NO: 1996187 - RNA, 18 nt, Homo sapiens
ggaacuugauguugagau

SEQ ID NO: 1996188 - RNA, 19 nt, Homo sapiens
uaaacauauucaaggagca

SEQ ID NO: 1996189 - RNA, 20 nt, Homo sapiens
gaaaacauagcaucucagga

SEQ ID NO: 1996190 - RNA, 17 nt, Homo sapiens
cucuuuccuccucauga

SEQ ID NO: 1996191 - RNA, 21 nt, Homo sapiens
ugcaguguucuacaccuugcu

SEQ ID NO: 1996192 - RNA, 13 nt, Homo sapiens
ugaacacaguguc

SEQ ID NO: 1996193 - RNA, 16 nt, Homo sapiens
uaguaccucugcuauu

SEQ ID NO: 1996194 - RNA, 18 nt, Homo sapiens
acucucuaguuuuaucuu

SEQ ID NO: 1996195 - RNA, 18 nt, Homo sapiens
gaguugggacaauugcuu

SEQ ID NO: 1996196 - RNA, 15 nt, Homo sapiens
cucgucucucugcaa

SEQ ID NO: 1996197 - RNA, 13 nt, Homo sapiens
caaccuuccagcu

SEQ ID NO: 1996198 - RNA, 23 nt, Homo sapiens
aguccuacagauggacugaaaaa

SEQ ID NO: 1996199 - RNA, 16 nt, Homo sapiens
cgcccgaccaggauca

SEQ ID NO: 1996200 - RNA, 23 nt, Homo sapiens
cuuaacacacuggccauucuuau

SEQ ID NO: 1996201 - RNA, 12 nt, Homo sapiens
aaaacacugugg

SEQ ID NO: 1996202 - RNA, 16 nt, Homo sapiens
ucucacccacuaggau

SEQ ID NO: 1996203 - RNA, 21 nt, Homo sapiens
cacugagucuuucuuagauua

SEQ ID NO: 1996204 - RNA, 14 nt, Homo sapiens
uuacagugauccac

SEQ ID NO: 1996205 - RNA, 12 nt, Homo sapiens
ccugaugacaau

SEQ ID NO: 1996206 - RNA, 21 nt, Homo sapiens
cuuguuaaugucauugcuaaa

SEQ ID NO: 1996207 - RNA, 17 nt, Homo sapiens
agccuagccgaccucag

SEQ ID NO: 1996208 - RNA, 14 nt, Homo sapiens
auaauucaagucag

SEQ ID NO: 1996209 - RNA, 19 nt, Homo sapiens
ugcacaaaauagcacaucc

SEQ ID NO: 1996210 - RNA, 15 nt, Homo sapiens
ucccuggauguggau

SEQ ID NO: 1996211 - RNA, 17 nt, Homo sapiens
uuuucaaagcaguauag

SEQ ID NO: 1996212 - RNA, 14 nt, Homo sapiens
ccuaccugcucccc

SEQ ID NO: 1996213 - RNA, 13 nt, Homo sapiens
uccuccccagaaa

SEQ ID NO: 1996214 - RNA, 16 nt, Homo sapiens
cuuuucuggccaaaag

SEQ ID NO: 1996215 - RNA, 15 nt, Homo sapiens
ugugcacccagaaga

SEQ ID NO: 1996216 - RNA, 18 nt, Homo sapiens
gugcuggaauuacaggcg

SEQ ID NO: 1996217 - RNA, 15 nt, Homo sapiens
uaaaguugguauuaa

SEQ ID NO: 1996218 - RNA, 23 nt, Homo sapiens
augucaguucugauauggaagca

SEQ ID NO: 1996219 - RNA, 14 nt, Homo sapiens
cugcucuccuggga

SEQ ID NO: 1996220 - RNA, 14 nt, Homo sapiens
ucucucucucugga

SEQ ID NO: 1996221 - RNA, 20 nt, Homo sapiens
cugaggccccaggugggaac

SEQ ID NO: 1996222 - RNA, 14 nt, Homo sapiens
uggggaagaaggga

SEQ ID NO: 1996223 - RNA, 12 nt, Homo sapiens
caguucagauaa

SEQ ID NO: 1996224 - RNA, 12 nt, Homo sapiens
cugaacucagaa

SEQ ID NO: 1996225 - RNA, 22 nt, Homo sapiens
cacauagauuaauggcacugau

SEQ ID NO: 1996226 - RNA, 14 nt, Homo sapiens
gaaaacagaccuaa

SEQ ID NO: 1996227 - RNA, 13 nt, Homo sapiens
uggucacugucag

SEQ ID NO: 1996228 - RNA, 17 nt, Homo sapiens
caaagaaaagacauuga

SEQ ID NO: 1996229 - RNA, 18 nt, Homo sapiens
cauuuuggcaucugcaaa

SEQ ID NO: 1996230 - RNA, 20 nt, Homo sapiens
uuuccugagagcagcacagg

SEQ ID NO: 1996231 - RNA, 19 nt, Homo sapiens
caggccaaagugccgguga

SEQ ID NO: 1996232 - RNA, 13 nt, Homo sapiens
gagguugcaguga

SEQ ID NO: 1996233 - RNA, 15 nt, Homo sapiens
auaaacccaucugua

SEQ ID NO: 1996234 - RNA, 14 nt, Homo sapiens
agagagaaccaagc

SEQ ID NO: 1996235 - RNA, 22 nt, Homo sapiens
ugacuagaacaacuugaagauu

SEQ ID NO: 1996236 - RNA, 17 nt, Homo sapiens
aaugaccgagcccugga

SEQ ID NO: 1996237 - RNA, 14 nt, Homo sapiens
uuaaaaugagcauu

SEQ ID NO: 1996238 - RNA, 17 nt, Homo sapiens
uccccaauaauugcaga

SEQ ID NO: 1996239 - RNA, 21 nt, Homo sapiens
cacugaugaacuagugaugua

SEQ ID NO: 1996240 - RNA, 14 nt, Homo sapiens
gaucagaaagugac

SEQ ID NO: 1996241 - RNA, 19 nt, Homo sapiens
uuaaaagacugcagcugcu

SEQ ID NO: 1996242 - RNA, 21 nt, Homo sapiens
aagaugucuuaaccucaggga

SEQ ID NO: 1996243 - RNA, 16 nt, Homo sapiens
guuucuuccacagugc

SEQ ID NO: 1996244 - RNA, 17 nt, Homo sapiens
guuuucauccuggccuc

SEQ ID NO: 1996245 - RNA, 20 nt, Homo sapiens
aaauacaguauucuguacca

SEQ ID NO: 1996246 - RNA, 21 nt, Homo sapiens
uagcuuagcuaugucagccaa

SEQ ID NO: 1996247 - RNA, 14 nt, Homo sapiens
uccuuucccaccca

SEQ ID NO: 1996248 - RNA, 19 nt, Homo sapiens
aauuuccucaucccuccau

SEQ ID NO: 1996249 - RNA, 15 nt, Homo sapiens
aaacacacaaaaagu

SEQ ID NO: 1996250 - RNA, 18 nt, Homo sapiens
uucaaacauuauucucaa

SEQ ID NO: 1996251 - RNA, 16 nt, Homo sapiens
ucucaaggcaguuaau

SEQ ID NO: 1996252 - RNA, 16 nt, Homo sapiens
uaauaggcaucuccag

SEQ ID NO: 1996253 - RNA, 20 nt, Homo sapiens
uggaaccucagccuggccag

SEQ ID NO: 1996254 - RNA, 17 nt, Homo sapiens
agaaauaucuucacuug

SEQ ID NO: 1996255 - RNA, 19 nt, Homo sapiens
agagcaagacccugucuca

SEQ ID NO: 1996256 - RNA, 17 nt, Homo sapiens
gggagggggaagcaaag

SEQ ID NO: 1996257 - RNA, 16 nt, Homo sapiens
auuuguuugcaauuuu

SEQ ID NO: 1996258 - RNA, 16 nt, Homo sapiens
ugugcauggaacuaaa

SEQ ID NO: 1996259 - RNA, 12 nt, Homo sapiens
uggcaccagcag

SEQ ID NO: 1996260 - RNA, 21 nt, Homo sapiens
cuugggaaaggugguguuucu

SEQ ID NO: 1996261 - RNA, 17 nt, Homo sapiens
cuuaauuccuuucucau

SEQ ID NO: 1996262 - RNA, 15 nt, Homo sapiens
auaguguauuuugca

SEQ ID NO: 1996263 - RNA, 19 nt, Homo sapiens
aaaacaaaaaaagcaucuc

SEQ ID NO: 1996264 - RNA, 22 nt, Homo sapiens
gggacgcccccaccagcucaaa

SEQ ID NO: 1996265 - RNA, 12 nt, Homo sapiens
caccgagaagag

SEQ ID NO: 1996266 - RNA, 16 nt, Homo sapiens
cacauauaaauguacu

SEQ ID NO: 1996267 - RNA, 18 nt, Homo sapiens
aagugccugacacacuaa

SEQ ID NO: 1996268 - RNA, 18 nt, Homo sapiens
aaaagauuuucagaaaau

SEQ ID NO: 1996269 - RNA, 21 nt, Homo sapiens
cuugauccacuucucucagga

SEQ ID NO: 1996270 - RNA, 15 nt, Homo sapiens
uaaucaauacuuuga

SEQ ID NO: 1996271 - RNA, 15 nt, Homo sapiens
uugcuaaaauauuau

SEQ ID NO: 1996272 - RNA, 15 nt, Homo sapiens
ugaugaagaccaaag

SEQ ID NO: 1996273 - RNA, 18 nt, Homo sapiens
agggguugagagcaugcc

SEQ ID NO: 1996274 - RNA, 19 nt, Homo sapiens
ccaguuuuguuuggaccaa

SEQ ID NO: 1996275 - RNA, 16 nt, Homo sapiens
ugaaaaggaacuugcc

SEQ ID NO: 1996276 - RNA, 14 nt, Homo sapiens
ggaggaagcacaga

SEQ ID NO: 1996277 - RNA, 16 nt, Homo sapiens
auucagcacacacaaa

SEQ ID NO: 1996278 - RNA, 19 nt, Homo sapiens
acuccaucucaaaacaaaa

SEQ ID NO: 1996279 - RNA, 22 nt, Homo sapiens
gaaucuguuaccagaggacaaa

SEQ ID NO: 1996280 - RNA, 18 nt, Homo sapiens
gaaucaaggaaagccagg

SEQ ID NO: 1996281 - RNA, 16 nt, Homo sapiens
aggccagugccauuuc

SEQ ID NO: 1996282 - RNA, 18 nt, Homo sapiens
auguaugacuuugugcca

SEQ ID NO: 1996283 - RNA, 19 nt, Homo sapiens
cgcaucaaaagacaauucu

SEQ ID NO: 1996284 - RNA, 22 nt, Homo sapiens
uuagucauucaauaaauuguaa

SEQ ID NO: 1996285 - RNA, 14 nt, Homo sapiens
agaaaaauaugcau

SEQ ID NO: 1996286 - RNA, 16 nt, Homo sapiens
cuagggcagggaaacc

SEQ ID NO: 1996287 - RNA, 16 nt, Homo sapiens
aucuucauaucuauca

SEQ ID NO: 1996288 - RNA, 20 nt, Homo sapiens
uaugagaacugguucuugcc

SEQ ID NO: 1996289 - RNA, 17 nt, Homo sapiens
aaauugaacuucaggga

SEQ ID NO: 1996290 - RNA, 23 nt, Homo sapiens
gauuucaccccacagacacuuac

SEQ ID NO: 1996291 - RNA, 18 nt, Homo sapiens
aacagguuucuaagcaua

SEQ ID NO: 1996292 - RNA, 18 nt, Homo sapiens
gccugaggaaguuuugca

SEQ ID NO: 1996293 - RNA, 15 nt, Homo sapiens
aacugcauugcugau

SEQ ID NO: 1996294 - RNA, 12 nt, Homo sapiens
ugggagagccag

SEQ ID NO: 1996295 - RNA, 23 nt, Homo sapiens
ccuuccggaagaaaaagagccau

SEQ ID NO: 1996296 - RNA, 16 nt, Homo sapiens
aaugcucauuugccaa

SEQ ID NO: 1996297 - RNA, 19 nt, Homo sapiens
cugguccagggcuagugac

SEQ ID NO: 1996298 - RNA, 22 nt, Homo sapiens
acuacaacuuuuguuuucugau

SEQ ID NO: 1996299 - RNA, 12 nt, Homo sapiens
ucuuaguaccag

SEQ ID NO: 1996300 - RNA, 20 nt, Homo sapiens
cuggauucuuggcccgcaca

SEQ ID NO: 1996301 - RNA, 20 nt, Homo sapiens
uucucaaucagugcagugau

SEQ ID NO: 1996302 - RNA, 13 nt, Homo sapiens
cugucuuccucaa

SEQ ID NO: 1996303 - RNA, 19 nt, Homo sapiens
aucaaguuguugacuguga

SEQ ID NO: 1996304 - RNA, 18 nt, Homo sapiens
agaaccgagcaaagauca

SEQ ID NO: 1996305 - RNA, 19 nt, Homo sapiens
accagugacucaucuucuc

SEQ ID NO: 1996306 - RNA, 14 nt, Homo sapiens
ccugcaggcagcuu

SEQ ID NO: 1996307 - RNA, 16 nt, Homo sapiens
gcaccaugcaaauguc

SEQ ID NO: 1996308 - RNA, 22 nt, Homo sapiens
gaaaaaggccaguggaaauuca

SEQ ID NO: 1996309 - RNA, 14 nt, Homo sapiens
gcuguaacuacuuu

SEQ ID NO: 1996310 - RNA, 22 nt, Homo sapiens
gcugaguguuucacaccuuauc

SEQ ID NO: 1996311 - RNA, 19 nt, Homo sapiens
cagccaaaggggagccaga

SEQ ID NO: 1996312 - RNA, 11 nt, Homo sapiens
gagacucugaa

SEQ ID NO: 1996313 - RNA, 21 nt, Homo sapiens
auauucacugggccaauucaa

SEQ ID NO: 1996314 - RNA, 16 nt, Homo sapiens
gauaaguuuuguuuca

SEQ ID NO: 1996315 - RNA, 14 nt, Homo sapiens
cauguaugugcgaa

SEQ ID NO: 1996316 - RNA, 23 nt, Homo sapiens
auguucaccuuuuccuugcugau

SEQ ID NO: 1996317 - RNA, 21 nt, Homo sapiens
guacagaauagaauacauuga

SEQ ID NO: 1996318 - RNA, 16 nt, Homo sapiens
cccuggucaccagagg

SEQ ID NO: 1996319 - RNA, 19 nt, Homo sapiens
guugaaaggagaauuugaa

SEQ ID NO: 1996320 - RNA, 23 nt, Homo sapiens
gcacagccucuuagaugcaguuc

SEQ ID NO: 1996321 - RNA, 16 nt, Homo sapiens
uugcuuugcugaccaa

SEQ ID NO: 1996322 - RNA, 20 nt, Homo sapiens
uugccagagaaacugaggua

SEQ ID NO: 1996323 - RNA, 21 nt, Homo sapiens
gcuauuuauguucaucuucaa

SEQ ID NO: 1996324 - RNA, 14 nt, Homo sapiens
cugggaguguuccc

SEQ ID NO: 1996325 - RNA, 12 nt, Homo sapiens
agguaggggaag

SEQ ID NO: 1996326 - RNA, 18 nt, Homo sapiens
caaucaauacccuuguga

SEQ ID NO: 1996327 - RNA, 23 nt, Homo sapiens
cgcccugucuaaaguguauuuuc

SEQ ID NO: 1996328 - RNA, 18 nt, Homo sapiens
uaaguccaugaauguuca

SEQ ID NO: 1996329 - RNA, 21 nt, Homo sapiens
uagcaguccccagugauuugc

SEQ ID NO: 1996330 - RNA, 18 nt, Homo sapiens
ucucccuccccaaauggc

SEQ ID NO: 1996331 - RNA, 19 nt, Homo sapiens
uauuaauacauucacccag

SEQ ID NO: 1996332 - RNA, 20 nt, Homo sapiens
gugucaacuaaaugagauua

SEQ ID NO: 1996333 - RNA, 19 nt, Homo sapiens
uguauguuaugaacaugca

SEQ ID NO: 1996334 - RNA, 22 nt, Homo sapiens
ucaguauuacaaauauauagca

SEQ ID NO: 1996335 - RNA, 20 nt, Homo sapiens
aaaggaaacccagcucacag

SEQ ID NO: 1996336 - RNA, 15 nt, Homo sapiens
aaacuuuaucacuua

SEQ ID NO: 1996337 - RNA, 20 nt, Homo sapiens
ucguagguauuagugcuagu

SEQ ID NO: 1996338 - RNA, 15 nt, Homo sapiens
ugcuuguacuaagcc

SEQ ID NO: 1996339 - RNA, 18 nt, Homo sapiens
caaacgggauacaggaga

SEQ ID NO: 1996340 - RNA, 21 nt, Homo sapiens
aauaaagcugcugagaaucua

SEQ ID NO: 1996341 - RNA, 16 nt, Homo sapiens
gccacugggaaggcac

SEQ ID NO: 1996342 - RNA, 16 nt, Homo sapiens
ccacaacccuguugcu

SEQ ID NO: 1996343 - RNA, 16 nt, Homo sapiens
uaagcaaaaugccaaa

SEQ ID NO: 1996344 - RNA, 16 nt, Homo sapiens
ugcucagaauugcaca

SEQ ID NO: 1996345 - RNA, 15 nt, Homo sapiens
uauuuaucugcaagg

SEQ ID NO: 1996346 - RNA, 12 nt, Homo sapiens
ccacacucagca

SEQ ID NO: 1996347 - RNA, 20 nt, Homo sapiens
caauugugagaauuacuguu

SEQ ID NO: 1996348 - RNA, 20 nt, Homo sapiens
ugcccuccaauccuuuccac

SEQ ID NO: 1996349 - RNA, 16 nt, Homo sapiens
aagaauuuaccagaaa

SEQ ID NO: 1996350 - RNA, 19 nt, Homo sapiens
cuagucaacaguacccugg

SEQ ID NO: 1996351 - RNA, 13 nt, Homo sapiens
ccuacccccugaa

SEQ ID NO: 1996352 - RNA, 23 nt, Homo sapiens
cgaggaaaggauuuuaccaaagc

SEQ ID NO: 1996353 - RNA, 20 nt, Homo sapiens
cauagaguucccaugaacua

SEQ ID NO: 1996354 - RNA, 15 nt, Homo sapiens
ugacaauggcagcua

SEQ ID NO: 1996355 - RNA, 22 nt, Homo sapiens
aacuaaaaauauuaaagccuca

SEQ ID NO: 1996356 - RNA, 18 nt, Homo sapiens
uaugcauagcuuugcacu

SEQ ID NO: 1996357 - RNA, 14 nt, Homo sapiens
cugggcacuccucc

SEQ ID NO: 1996358 - RNA, 15 nt, Homo sapiens
cuuuugcaacaagac

SEQ ID NO: 1996359 - RNA, 22 nt, Homo sapiens
acauaccucucucuauauauac

SEQ ID NO: 1996360 - RNA, 14 nt, Homo sapiens
uucuucauugcagu

SEQ ID NO: 1996361 - RNA, 21 nt, Homo sapiens
cuaaaauuguauagaccuaaa

SEQ ID NO: 1996362 - RNA, 20 nt, Homo sapiens
uuacaugaguucaaauacuu

SEQ ID NO: 1996363 - RNA, 20 nt, Homo sapiens
agcuugcugucacuucuuca

SEQ ID NO: 1996364 - RNA, 21 nt, Homo sapiens
acguguguauugcaaugggaa

SEQ ID NO: 1996365 - RNA, 13 nt, Homo sapiens
cucaccauuucau

SEQ ID NO: 1996366 - RNA, 15 nt, Homo sapiens
aggcugguuugcaag

SEQ ID NO: 1996367 - RNA, 22 nt, Homo sapiens
agcgacaggaauagaugugguc

SEQ ID NO: 1996368 - RNA, 17 nt, Homo sapiens
uuaaaacaaagggaaaa

SEQ ID NO: 1996369 - RNA, 19 nt, Homo sapiens
ggacugggugccacggugg

SEQ ID NO: 1996370 - RNA, 23 nt, Homo sapiens
gaagcauggcauauagugcccuu

SEQ ID NO: 1996371 - RNA, 14 nt, Homo sapiens
aagaaaacuuccau

SEQ ID NO: 1996372 - RNA, 14 nt, Homo sapiens
caaaaugaacucca

SEQ ID NO: 1996373 - RNA, 18 nt, Homo sapiens
acgugcucucugcuggau

SEQ ID NO: 1996374 - RNA, 22 nt, Homo sapiens
ggcgcccuuggcuucugugaug

SEQ ID NO: 1996375 - RNA, 15 nt, Homo sapiens
ugacccuccuguugc

SEQ ID NO: 1996376 - RNA, 24 nt, Homo sapiens
ggaaaaucuucacuuucuuaagca

SEQ ID NO: 1996377 - RNA, 15 nt, Homo sapiens
uccaaugccacagac

SEQ ID NO: 1996378 - RNA, 15 nt, Homo sapiens
ucugaggacacagau

SEQ ID NO: 1996379 - RNA, 21 nt, Homo sapiens
aaggacuuuauagaucagcca

SEQ ID NO: 1996380 - RNA, 16 nt, Homo sapiens
cuauuuccuaaaauca

SEQ ID NO: 1996381 - RNA, 23 nt, Homo sapiens
gaucuaacuguuguuacuggaag

SEQ ID NO: 1996382 - RNA, 13 nt, Homo sapiens
gcauacaguuugc

SEQ ID NO: 1996383 - RNA, 21 nt, Homo sapiens
auuccugguuugacucaguuc

SEQ ID NO: 1996384 - RNA, 11 nt, Homo sapiens
gacauuuugcc

SEQ ID NO: 1996385 - RNA, 11 nt, Homo sapiens
gaaauuuugca

SEQ ID NO: 1996386 - RNA, 17 nt, Homo sapiens
gcuccuccuuaugacuc

SEQ ID NO: 1996387 - RNA, 18 nt, Homo sapiens
ggaggcugucuucucagg

SEQ ID NO: 1996388 - RNA, 18 nt, Homo sapiens
auagucucugcccucaua

SEQ ID NO: 1996389 - RNA, 22 nt, Homo sapiens
ugacagucauaaauacugucaa

SEQ ID NO: 1996390 - RNA, 15 nt, Homo sapiens
agcagucgccugccu

SEQ ID NO: 1996391 - RNA, 12 nt, Homo sapiens
uccacucccacu

SEQ ID NO: 1996392 - RNA, 23 nt, Homo sapiens
gguuaccaguaacggaacaguau

SEQ ID NO: 1996393 - RNA, 19 nt, Homo sapiens
ucucaguaugaauuauuca

SEQ ID NO: 1996394 - RNA, 20 nt, Homo sapiens
uugugaccuucucuauauca

SEQ ID NO: 1996395 - RNA, 22 nt, Homo sapiens
uaaaaugcuccuagaagucuua

SEQ ID NO: 1996396 - RNA, 18 nt, Homo sapiens
agacgccuuccaggucag

SEQ ID NO: 1996397 - RNA, 18 nt, Homo sapiens
uuggagauuaaucuacca

SEQ ID NO: 1996398 - RNA, 17 nt, Homo sapiens
aagaccucccugugaga

SEQ ID NO: 1996399 - RNA, 21 nt, Homo sapiens
cacugaggauguaaagaucaa

SEQ ID NO: 1996400 - RNA, 12 nt, Homo sapiens
caaaacuuucca

SEQ ID NO: 1996401 - RNA, 14 nt, Homo sapiens
gcaacacagugaga

SEQ ID NO: 1996402 - RNA, 18 nt, Homo sapiens
uaauccaguaaaauaaua

SEQ ID NO: 1996403 - RNA, 21 nt, Homo sapiens
gccccccagaaagcugccaga

SEQ ID NO: 1996404 - RNA, 22 nt, Homo sapiens
gauagaauaaagccuugugauc

SEQ ID NO: 1996405 - RNA, 12 nt, Homo sapiens
ucccagucucau

SEQ ID NO: 1996406 - RNA, 12 nt, Homo sapiens
uuacagucuucu

SEQ ID NO: 1996407 - RNA, 22 nt, Homo sapiens
ccgcaaugugacuuaaugccac

SEQ ID NO: 1996408 - RNA, 20 nt, Homo sapiens
acccuaauaaguccacaucu

SEQ ID NO: 1996409 - RNA, 12 nt, Homo sapiens
uucugagcauuu

SEQ ID NO: 1996410 - RNA, 12 nt, Homo sapiens
accagagcucua

SEQ ID NO: 1996411 - RNA, 19 nt, Homo sapiens
ugggcuuggggacagaaau

SEQ ID NO: 1996412 - RNA, 19 nt, Homo sapiens
ggaaugcagaggucuccaa

SEQ ID NO: 1996413 - RNA, 16 nt, Homo sapiens
uaauacuaaagugucu

SEQ ID NO: 1996414 - RNA, 17 nt, Homo sapiens
aguguuguggacacugc

SEQ ID NO: 1996415 - RNA, 17 nt, Homo sapiens
aagggggcuauucccug

SEQ ID NO: 1996416 - RNA, 23 nt, Homo sapiens
auguauauaagccaguucacuua

SEQ ID NO: 1996417 - RNA, 21 nt, Homo sapiens
auccuucugagcuccaccucu

SEQ ID NO: 1996418 - RNA, 21 nt, Homo sapiens
uguguuuauauggaagaaagu

SEQ ID NO: 1996419 - RNA, 21 nt, Homo sapiens
auuccuguccuucacauuuac

SEQ ID NO: 1996420 - RNA, 19 nt, Homo sapiens
ucuuaaacacaaauuucau

SEQ ID NO: 1996421 - RNA, 16 nt, Homo sapiens
ugcaguugacagcagg

SEQ ID NO: 1996422 - RNA, 23 nt, Homo sapiens
aucugauuuguaacccacugaga

SEQ ID NO: 1996423 - RNA, 21 nt, Homo sapiens
aagcuguaagauaauguugcu

SEQ ID NO: 1996424 - RNA, 21 nt, Homo sapiens
ccucagccuggggcucucuga

SEQ ID NO: 1996425 - RNA, 12 nt, Homo sapiens
cuagcaguacua

SEQ ID NO: 1996426 - RNA, 18 nt, Homo sapiens
auauucuuuaauacuuca

SEQ ID NO: 1996427 - RNA, 22 nt, Homo sapiens
guguauuuugagauaaugucaa

SEQ ID NO: 1996428 - RNA, 13 nt, Homo sapiens
cccaacaugacug

SEQ ID NO: 1996429 - RNA, 18 nt, Homo sapiens
ggaacacugcacucuuaa

SEQ ID NO: 1996430 - RNA, 15 nt, Homo sapiens
uuccaaauuacugau

SEQ ID NO: 1996431 - RNA, 23 nt, Homo sapiens
ggaagauagaauucaauuugaac

SEQ ID NO: 1996432 - RNA, 19 nt, Homo sapiens
caggguggguguccaugug

SEQ ID NO: 1996433 - RNA, 19 nt, Homo sapiens
cagaacagcuucagguuau

SEQ ID NO: 1996434 - RNA, 14 nt, Homo sapiens
uuguuaugucuaga

SEQ ID NO: 1996435 - RNA, 19 nt, Homo sapiens
accacacgcccccacaggc

SEQ ID NO: 1996436 - RNA, 23 nt, Homo sapiens
cucacuuuacuuucaaguaauau

SEQ ID NO: 1996437 - RNA, 18 nt, Homo sapiens
ggagcaagggcacaaacu

SEQ ID NO: 1996438 - RNA, 15 nt, Homo sapiens
auacauuagcagcua

SEQ ID NO: 1996439 - RNA, 21 nt, Homo sapiens
cuucaucgcaguggacugugu

SEQ ID NO: 1996440 - RNA, 15 nt, Homo sapiens
uauuauacaauguua

SEQ ID NO: 1996441 - RNA, 15 nt, Homo sapiens
ucaguuucacauauu

SEQ ID NO: 1996442 - RNA, 22 nt, Homo sapiens
ugcuacuaauuauauaguauac

SEQ ID NO: 1996443 - RNA, 15 nt, Homo sapiens
ucucguucuccuucc

SEQ ID NO: 1996444 - RNA, 20 nt, Homo sapiens
aaacaaaaauauuuugauca

SEQ ID NO: 1996445 - RNA, 12 nt, Homo sapiens
cauuuguagcaa

SEQ ID NO: 1996446 - RNA, 23 nt, Homo sapiens
ucaagaggcgagaugagcccaca

SEQ ID NO: 1996447 - RNA, 14 nt, Homo sapiens
aaaacuaccacaug

SEQ ID NO: 1996448 - RNA, 22 nt, Homo sapiens
aauucuaaaaaugguuaucauu

SEQ ID NO: 1996449 - RNA, 19 nt, Homo sapiens
ccaugagggagaugccaug

SEQ ID NO: 1996450 - RNA, 19 nt, Homo sapiens
ggccuguaaucuaccagug

SEQ ID NO: 1996451 - RNA, 19 nt, Homo sapiens
ugccugggccugugcagca

SEQ ID NO: 1996452 - RNA, 13 nt, Homo sapiens
gaagaaacacuuu

SEQ ID NO: 1996453 - RNA, 13 nt, Homo sapiens
gcuuaaacaaagu

SEQ ID NO: 1996454 - RNA, 17 nt, Homo sapiens
gggagguuccucgcagg

SEQ ID NO: 1996455 - RNA, 17 nt, Homo sapiens
uuaagaaauuucacaua

SEQ ID NO: 1996456 - RNA, 21 nt, Homo sapiens
ucauuuaagggaguuacaucu

SEQ ID NO: 1996457 - RNA, 21 nt, Homo sapiens
acagccccaaacaagcgccac

SEQ ID NO: 1996458 - RNA, 13 nt, Homo sapiens
gccaaaauuauua

SEQ ID NO: 1996459 - RNA, 10 nt, Homo sapiens
uuccacagau

SEQ ID NO: 1996460 - RNA, 15 nt, Homo sapiens
uuucauccuugacua

SEQ ID NO: 1996461 - RNA, 18 nt, Homo sapiens
uaugugcagucuugcuua

SEQ ID NO: 1996462 - RNA, 13 nt, Homo sapiens
agccucuggcuag

SEQ ID NO: 1996463 - RNA, 14 nt, Homo sapiens
uacugggaagacaa

SEQ ID NO: 1996464 - RNA, 22 nt, Homo sapiens
aauuuauuuauuaagauggauu

SEQ ID NO: 1996465 - RNA, 18 nt, Homo sapiens
auaauaaucaugaucaca

SEQ ID NO: 1996466 - RNA, 21 nt, Homo sapiens
auaacacuguacugcaauaag

SEQ ID NO: 1996467 - RNA, 23 nt, Homo sapiens
cauuggcuauuuaaaacuuguaa

SEQ ID NO: 1996468 - RNA, 13 nt, Homo sapiens
ucagcucugggcc

SEQ ID NO: 1996469 - RNA, 16 nt, Homo sapiens
uguugcaaugacacau

SEQ ID NO: 1996470 - RNA, 18 nt, Homo sapiens
ccacucaggccacagugg

SEQ ID NO: 1996471 - RNA, 21 nt, Homo sapiens
gagcauuugguacacacuuga

SEQ ID NO: 1996472 - RNA, 17 nt, Homo sapiens
ugugauucacaguguga

SEQ ID NO: 1996473 - RNA, 16 nt, Homo sapiens
aacaauuaacugagca

SEQ ID NO: 1996474 - RNA, 13 nt, Homo sapiens
agagccuugacaa

SEQ ID NO: 1996475 - RNA, 23 nt, Homo sapiens
cuguuacuugaaauaccagugaa

SEQ ID NO: 1996476 - RNA, 14 nt, Homo sapiens
uauuaaagugccau

SEQ ID NO: 1996477 - RNA, 20 nt, Homo sapiens
cuugucaauaaaauccauac

SEQ ID NO: 1996478 - RNA, 13 nt, Homo sapiens
aacugcuugugca

SEQ ID NO: 1996479 - RNA, 23 nt, Homo sapiens
cccaacagcacuuagguuuuccu

SEQ ID NO: 1996480 - RNA, 16 nt, Homo sapiens
cuucucaaaccuccaa

SEQ ID NO: 1996481 - RNA, 22 nt, Homo sapiens
aaacauacccuuuaucucugua

SEQ ID NO: 1996482 - RNA, 15 nt, Homo sapiens
agcaggcaaaagacu

SEQ ID NO: 1996483 - RNA, 11 nt, Homo sapiens
gucccagagag

SEQ ID NO: 1996484 - RNA, 17 nt, Homo sapiens
uucccagagucaucuga

SEQ ID NO: 1996485 - RNA, 19 nt, Homo sapiens
uuaauauuguauugcugcu

SEQ ID NO: 1996486 - RNA, 20 nt, Homo sapiens
cugguucucaucuuucuuga

SEQ ID NO: 1996487 - RNA, 14 nt, Homo sapiens
acuaugcuuuagaa

SEQ ID NO: 1996488 - RNA, 14 nt, Homo sapiens
uuaaagcuacugua

SEQ ID NO: 1996489 - RNA, 21 nt, Homo sapiens
ccuuuuacagcucuuggcauu

SEQ ID NO: 1996490 - RNA, 15 nt, Homo sapiens
gcccccaugcaaggu

SEQ ID NO: 1996491 - RNA, 14 nt, Homo sapiens
gucagacauggcca

SEQ ID NO: 1996492 - RNA, 19 nt, Homo sapiens
gaagcauauuuugcugguu

SEQ ID NO: 1996493 - RNA, 12 nt, Homo sapiens
accagauuuacu

SEQ ID NO: 1996494 - RNA, 12 nt, Homo sapiens
aacugauuucca

SEQ ID NO: 1996495 - RNA, 12 nt, Homo sapiens
uucuugcuccaa

SEQ ID NO: 1996496 - RNA, 19 nt, Homo sapiens
gcccuggaugcccaggaau

SEQ ID NO: 1996497 - RNA, 20 nt, Homo sapiens
auuauguaaauaacucuaac

SEQ ID NO: 1996498 - RNA, 20 nt, Homo sapiens
ccagaaaauaaagauaguua

SEQ ID NO: 1996499 - RNA, 14 nt, Homo sapiens
cccugacugaauca

SEQ ID NO: 1996500 - RNA, 19 nt, Homo sapiens
ggucaguaaauaacaggca

SEQ ID NO: 1996501 - RNA, 21 nt, Homo sapiens
ccagcacccaccugguacuga

SEQ ID NO: 1996502 - RNA, 18 nt, Homo sapiens
acaugacaacuuugccag

SEQ ID NO: 1996503 - RNA, 15 nt, Homo sapiens
uuguuuuugccaaag

SEQ ID NO: 1996504 - RNA, 17 nt, Homo sapiens
caaaagugauguuauag

SEQ ID NO: 1996505 - RNA, 15 nt, Homo sapiens
guccuagacaaacca

SEQ ID NO: 1996506 - RNA, 14 nt, Homo sapiens
agggcauugcucag

SEQ ID NO: 1996507 - RNA, 22 nt, Homo sapiens
gguuuccuuuuggaacauuucu

SEQ ID NO: 1996508 - RNA, 15 nt, Homo sapiens
aaacaggcgcuguuu

SEQ ID NO: 1996509 - RNA, 19 nt, Homo sapiens
caggagguggucugggacu

SEQ ID NO: 1996510 - RNA, 20 nt, Homo sapiens
gcuguaccuggugcccugug

SEQ ID NO: 1996511 - RNA, 13 nt, Homo sapiens
acagaaagcacaa

SEQ ID NO: 1996512 - RNA, 14 nt, Homo sapiens
guuccgacugccau

SEQ ID NO: 1996513 - RNA, 18 nt, Homo sapiens
ugcuguauccauccaugg

SEQ ID NO: 1996514 - RNA, 16 nt, Homo sapiens
uugccucuugcaaugc

SEQ ID NO: 1996515 - RNA, 21 nt, Homo sapiens
uucuagaacaguaaaagccuu

SEQ ID NO: 1996516 - RNA, 18 nt, Homo sapiens
ugaauccucaugaggcuu

SEQ ID NO: 1996517 - RNA, 16 nt, Homo sapiens
aauggaggcaacgcca

SEQ ID NO: 1996518 - RNA, 20 nt, Homo sapiens
ugccaguguguuacucaucu

SEQ ID NO: 1996519 - RNA, 21 nt, Homo sapiens
caucgcaguguucaaggccau

SEQ ID NO: 1996520 - RNA, 13 nt, Homo sapiens
ggcuuugugcugc

SEQ ID NO: 1996521 - RNA, 19 nt, Homo sapiens
aauggagauaugcauucaa

SEQ ID NO: 1996522 - RNA, 13 nt, Homo sapiens
uauauuauggaag

SEQ ID NO: 1996523 - RNA, 16 nt, Homo sapiens
gaugggcacaugagga

SEQ ID NO: 1996524 - RNA, 14 nt, Homo sapiens
uccuccguggcaca

SEQ ID NO: 1996525 - RNA, 22 nt, Homo sapiens
gauuaaguaaugauaacuggaa

SEQ ID NO: 1996526 - RNA, 15 nt, Homo sapiens
agauggccacugcuc

SEQ ID NO: 1996527 - RNA, 20 nt, Homo sapiens
ugaaccguuugugauugcca

SEQ ID NO: 1996528 - RNA, 15 nt, Homo sapiens
ugggagccugaggca

SEQ ID NO: 1996529 - RNA, 15 nt, Homo sapiens
cagaggcccaaaaca

SEQ ID NO: 1996530 - RNA, 15 nt, Homo sapiens
cugugcccaucaucu

SEQ ID NO: 1996531 - RNA, 19 nt, Homo sapiens
ucaaugccuggagacagau

SEQ ID NO: 1996532 - RNA, 18 nt, Homo sapiens
cccaaaaaagucaagaac

SEQ ID NO: 1996533 - RNA, 18 nt, Homo sapiens
aaaccauucaccaagagc

SEQ ID NO: 1996534 - RNA, 17 nt, Homo sapiens
uuugcucaacagaacau

SEQ ID NO: 1996535 - RNA, 14 nt, Homo sapiens
cacaaccuggauuu

SEQ ID NO: 1996536 - RNA, 14 nt, Homo sapiens
ugucuucaauguca

SEQ ID NO: 1996537 - RNA, 22 nt, Homo sapiens
uuagagcacaggaagugacaac

SEQ ID NO: 1996538 - RNA, 22 nt, Homo sapiens
ccaaauuugaguugcacccuuc

SEQ ID NO: 1996539 - RNA, 21 nt, Homo sapiens
aauagaaaagucuccaccccu

SEQ ID NO: 1996540 - RNA, 15 nt, Homo sapiens
uaugucaguccaaua

SEQ ID NO: 1996541 - RNA, 15 nt, Homo sapiens
cuggucaguugccaa

SEQ ID NO: 1996542 - RNA, 13 nt, Homo sapiens
uucuuuucacugu

SEQ ID NO: 1996543 - RNA, 13 nt, Homo sapiens
guggcugcaguua

SEQ ID NO: 1996544 - RNA, 20 nt, Homo sapiens
auauuuagcugcuaacaaga

SEQ ID NO: 1996545 - RNA, 14 nt, Homo sapiens
cuaagaaaaggcaa

SEQ ID NO: 1996546 - RNA, 15 nt, Homo sapiens
aaaagacacugcaga

SEQ ID NO: 1996547 - RNA, 19 nt, Homo sapiens
cugaguacguugugcauuu

SEQ ID NO: 1996548 - RNA, 13 nt, Homo sapiens
acacaacuuugca

SEQ ID NO: 1996549 - RNA, 23 nt, Homo sapiens
ucuccuccagcccagacccagug

SEQ ID NO: 1996550 - RNA, 23 nt, Homo sapiens
agacaguaugagucaaugugcag

SEQ ID NO: 1996551 - RNA, 18 nt, Homo sapiens
gcagugcccaucuuccag

SEQ ID NO: 1996552 - RNA, 16 nt, Homo sapiens
aggagaauagcagaga

SEQ ID NO: 1996553 - RNA, 18 nt, Homo sapiens
caugucccacccucccua

SEQ ID NO: 1996554 - RNA, 22 nt, Homo sapiens
uccccucagggauacgacacau

SEQ ID NO: 1996555 - RNA, 19 nt, Homo sapiens
uugccugcagggccauggc

SEQ ID NO: 1996556 - RNA, 14 nt, Homo sapiens
uuacauucaucuca

SEQ ID NO: 1996557 - RNA, 22 nt, Homo sapiens
auuccugcccaaacagcuguau

SEQ ID NO: 1996558 - RNA, 16 nt, Homo sapiens
acagucacuggaaaga

SEQ ID NO: 1996559 - RNA, 16 nt, Homo sapiens
aguauauaauauguca

SEQ ID NO: 1996560 - RNA, 13 nt, Homo sapiens
uuuugcacuguaa

SEQ ID NO: 1996561 - RNA, 18 nt, Homo sapiens
uauugauguuuccagaaa

SEQ ID NO: 1996562 - RNA, 19 nt, Homo sapiens
agcgugauuccugcugccu

SEQ ID NO: 1996563 - RNA, 22 nt, Homo sapiens
aucaccucuuaugcacaccucc

SEQ ID NO: 1996564 - RNA, 21 nt, Homo sapiens
agcauuugauauacaugcuca

SEQ ID NO: 1996565 - RNA, 22 nt, Homo sapiens
auggguaucuaauaaauacuua

SEQ ID NO: 1996566 - RNA, 13 nt, Homo sapiens
gcuucuccaaaua

SEQ ID NO: 1996567 - RNA, 16 nt, Homo sapiens
uuggaccugcaguugg

SEQ ID NO: 1996568 - RNA, 15 nt, Homo sapiens
uguggccugccaguc

SEQ ID NO: 1996569 - RNA, 17 nt, Homo sapiens
auuuuucuauaaagauc

SEQ ID NO: 1996570 - RNA, 13 nt, Homo sapiens
ucuuugaauuuag

SEQ ID NO: 1996571 - RNA, 17 nt, Homo sapiens
ucucugucuacuccuua

SEQ ID NO: 1996572 - RNA, 20 nt, Homo sapiens
guacuggagaaaauggacgu

SEQ ID NO: 1996573 - RNA, 16 nt, Homo sapiens
aagguuccaacuggaa

SEQ ID NO: 1996574 - RNA, 19 nt, Homo sapiens
ucucaucccacgcacucca

SEQ ID NO: 1996575 - RNA, 17 nt, Homo sapiens
ccuugcugcugcugcac

SEQ ID NO: 1996576 - RNA, 15 nt, Homo sapiens
auuccucagcugcca

SEQ ID NO: 1996577 - RNA, 18 nt, Homo sapiens
ucugcccuuuccuaggcc

SEQ ID NO: 1996578 - RNA, 19 nt, Homo sapiens
ugucuuuccagaaggucac

SEQ ID NO: 1996579 - RNA, 19 nt, Homo sapiens
cuuagggcagaagugaaug

SEQ ID NO: 1996580 - RNA, 18 nt, Homo sapiens
uaauauuuuaaauugcuu

SEQ ID NO: 1996581 - RNA, 16 nt, Homo sapiens
ccgugcaguacaggca

SEQ ID NO: 1996582 - RNA, 21 nt, Homo sapiens
agaauaaccaacacccugagg

SEQ ID NO: 1996583 - RNA, 17 nt, Homo sapiens
auuaccagcauuuacua

SEQ ID NO: 1996584 - RNA, 13 nt, Homo sapiens
cacugauuugaua

SEQ ID NO: 1996585 - RNA, 13 nt, Homo sapiens
caaagauuugcaa

SEQ ID NO: 1996586 - RNA, 17 nt, Homo sapiens
gcugugccagcugcuuc

SEQ ID NO: 1996587 - RNA, 22 nt, Homo sapiens
agccauucugccucagccuccc

SEQ ID NO: 1996588 - RNA, 17 nt, Homo sapiens
acaguuuacuuugccaa

SEQ ID NO: 1996589 - RNA, 21 nt, Homo sapiens
ggauuaccaaaacacugccug

SEQ ID NO: 1996590 - RNA, 13 nt, Homo sapiens
acugaaauggacu

SEQ ID NO: 1996591 - RNA, 13 nt, Homo sapiens
ucugagcaguugu

SEQ ID NO: 1996592 - RNA, 14 nt, Homo sapiens
uucuuugcauucca

SEQ ID NO: 1996593 - RNA, 21 nt, Homo sapiens
ucuugugguaacuugcugcuu

SEQ ID NO: 1996594 - RNA, 22 nt, Homo sapiens
aguccccaucccauuuucaucc

SEQ ID NO: 1996595 - RNA, 19 nt, Homo sapiens
ggaagagagagacccucac

SEQ ID NO: 1996596 - RNA, 17 nt, Homo sapiens
auuucuuguaggcauca

SEQ ID NO: 1996597 - RNA, 16 nt, Homo sapiens
caacuguauaccgugu

SEQ ID NO: 1996598 - RNA, 13 nt, Homo sapiens
augguaauacaca

SEQ ID NO: 1996599 - RNA, 20 nt, Homo sapiens
cucaauccauccauguacuu

SEQ ID NO: 1996600 - RNA, 23 nt, Homo sapiens
gggcucuucugagcagaaauggc

SEQ ID NO: 1996601 - RNA, 12 nt, Homo sapiens
uggccauucuuu

SEQ ID NO: 1996602 - RNA, 22 nt, Homo sapiens
ucuuaacaaucaaaucugguau

SEQ ID NO: 1996603 - RNA, 19 nt, Homo sapiens
cacacgucauguuucuuca

SEQ ID NO: 1996604 - RNA, 18 nt, Homo sapiens
gcuucauacagaaggcaa

SEQ ID NO: 1996605 - RNA, 17 nt, Homo sapiens
ucugaauuuuaaaacau

SEQ ID NO: 1996606 - RNA, 19 nt, Homo sapiens
gagcccaaaaacaagcaaa

SEQ ID NO: 1996607 - RNA, 20 nt, Homo sapiens
cgacugagaaccgugacauc

SEQ ID NO: 1996608 - RNA, 20 nt, Homo sapiens
uucaaccugguggcaccaga

SEQ ID NO: 1996609 - RNA, 14 nt, Homo sapiens
acagcugcuccuag

SEQ ID NO: 1996610 - RNA, 17 nt, Homo sapiens
aggguagaagaggcaag

SEQ ID NO: 1996611 - RNA, 23 nt, Homo sapiens
gaacauaaagccuuggauguaua

SEQ ID NO: 1996612 - RNA, 12 nt, Homo sapiens
cacacugaaccg

SEQ ID NO: 1996613 - RNA, 21 nt, Homo sapiens
aagaauggggaucacagagac

SEQ ID NO: 1996614 - RNA, 17 nt, Homo sapiens
gugcagaguguuuaccu

SEQ ID NO: 1996615 - RNA, 16 nt, Homo sapiens
acaaaauggacauggu

SEQ ID NO: 1996616 - RNA, 17 nt, Homo sapiens
caggauagucuaaggga

SEQ ID NO: 1996617 - RNA, 14 nt, Homo sapiens
aagcacacuuuucc

SEQ ID NO: 1996618 - RNA, 13 nt, Homo sapiens
gaaaugucuaugu

SEQ ID NO: 1996619 - RNA, 22 nt, Homo sapiens
ccccaugcauacguacauuccu

SEQ ID NO: 1996620 - RNA, 21 nt, Homo sapiens
caucuuuccaauccagaggaa

SEQ ID NO: 1996621 - RNA, 12 nt, Homo sapiens
cccucacaggag

SEQ ID NO: 1996622 - RNA, 14 nt, Homo sapiens
cugaggaguggagu

SEQ ID NO: 1996623 - RNA, 19 nt, Homo sapiens
uccaucaaaccuuugccaa

SEQ ID NO: 1996624 - RNA, 16 nt, Homo sapiens
guauuuuuaaaggcau

SEQ ID NO: 1996625 - RNA, 14 nt, Homo sapiens
aucgccauuccagg

SEQ ID NO: 1996626 - RNA, 21 nt, Homo sapiens
cuguuaauacacaguacuuua

SEQ ID NO: 1996627 - RNA, 22 nt, Homo sapiens
cauccagugugagauacugugu

SEQ ID NO: 1996628 - RNA, 20 nt, Homo sapiens
aaucuuuguuacucuguaaa

SEQ ID NO: 1996629 - RNA, 13 nt, Homo sapiens
uccuggucuuuga

SEQ ID NO: 1996630 - RNA, 17 nt, Homo sapiens
uaaaaacaaagugcuaa

SEQ ID NO: 1996631 - RNA, 21 nt, Homo sapiens
gugcaguggcuccgaucucug

SEQ ID NO: 1996632 - RNA, 16 nt, Homo sapiens
cagggacagaucugau

SEQ ID NO: 1996633 - RNA, 17 nt, Homo sapiens
caguaacugugacugau

SEQ ID NO: 1996634 - RNA, 15 nt, Homo sapiens
agagagagagagaaa

SEQ ID NO: 1996635 - RNA, 15 nt, Homo sapiens
aaggggagaagggaa

SEQ ID NO: 1996636 - RNA, 14 nt, Homo sapiens
ucagggcucagagu

SEQ ID NO: 1996637 - RNA, 18 nt, Homo sapiens
augucuccaucuugaugc

SEQ ID NO: 1996638 - RNA, 17 nt, Homo sapiens
acaugucuacaugccau

SEQ ID NO: 1996639 - RNA, 16 nt, Homo sapiens
cccuuccugggcacac

SEQ ID NO: 1996640 - RNA, 16 nt, Homo sapiens
augaauauuacaugua

SEQ ID NO: 1996641 - RNA, 18 nt, Homo sapiens
aacaauucaguggucuua

SEQ ID NO: 1996642 - RNA, 13 nt, Homo sapiens
ugcauaugaaauc

SEQ ID NO: 1996643 - RNA, 20 nt, Homo sapiens
aaguuguugcuauacauguu

SEQ ID NO: 1996644 - RNA, 21 nt, Homo sapiens
ucauauuucuaccugagugaa

SEQ ID NO: 1996645 - RNA, 21 nt, Homo sapiens
ccagaugaacugacugaagga

SEQ ID NO: 1996646 - RNA, 22 nt, Homo sapiens
uguccaaacucagugcuguuuc

SEQ ID NO: 1996647 - RNA, 14 nt, Homo sapiens
auauauuuuaucuc

SEQ ID NO: 1996648 - RNA, 15 nt, Homo sapiens
cugccauggggccau

SEQ ID NO: 1996649 - RNA, 20 nt, Homo sapiens
auuuaugccucuguauuuaa

SEQ ID NO: 1996650 - RNA, 15 nt, Homo sapiens
aaccaaagugcagga

SEQ ID NO: 1996651 - RNA, 23 nt, Homo sapiens
caacacgagcaggcuacugucag

SEQ ID NO: 1996652 - RNA, 23 nt, Homo sapiens
uaagaccccacuggagucucucu

SEQ ID NO: 1996653 - RNA, 21 nt, Homo sapiens
aaugccaaauagaaaaccacu

SEQ ID NO: 1996654 - RNA, 19 nt, Homo sapiens
auguauggaugaaagcaau

SEQ ID NO: 1996655 - RNA, 21 nt, Homo sapiens
gcauggcaagucacaugcgua

SEQ ID NO: 1996656 - RNA, 13 nt, Homo sapiens
agauucuaaugau

SEQ ID NO: 1996657 - RNA, 14 nt, Homo sapiens
cuuggacuuuauga

SEQ ID NO: 1996658 - RNA, 14 nt, Homo sapiens
uuuuaacucuagaa

SEQ ID NO: 1996659 - RNA, 12 nt, Homo sapiens
cugccagcaucu

SEQ ID NO: 1996660 - RNA, 13 nt, Homo sapiens
agccucuugcccg

SEQ ID NO: 1996661 - RNA, 15 nt, Homo sapiens
cuuugcaucucagua

SEQ ID NO: 1996662 - RNA, 17 nt, Homo sapiens
ccaagaguuucuucuca

SEQ ID NO: 1996663 - RNA, 20 nt, Homo sapiens
acuucauuaauuucaaucaa

SEQ ID NO: 1996664 - RNA, 16 nt, Homo sapiens
cuaaacuuacauuuaa

SEQ ID NO: 1996665 - RNA, 23 nt, Homo sapiens
cuaggcagaucacguugcaaugg

SEQ ID NO: 1996666 - RNA, 23 nt, Homo sapiens
aauauuuugcuaaaaaagcauau

SEQ ID NO: 1996667 - RNA, 21 nt, Homo sapiens
cacacccccaagccacaggga

SEQ ID NO: 1996668 - RNA, 19 nt, Homo sapiens
cugaaaagaugguaucaua

SEQ ID NO: 1996669 - RNA, 18 nt, Homo sapiens
caggagaaucaauaaaaa

SEQ ID NO: 1996670 - RNA, 15 nt, Homo sapiens
agccuggccagacaa

SEQ ID NO: 1996671 - RNA, 20 nt, Homo sapiens
gauggcagauucccacugcc

SEQ ID NO: 1996672 - RNA, 15 nt, Homo sapiens
cuagucaguuggcua

SEQ ID NO: 1996673 - RNA, 12 nt, Homo sapiens
uucugucuuccc

SEQ ID NO: 1996674 - RNA, 19 nt, Homo sapiens
ucccuggaaauaacugagc

SEQ ID NO: 1996675 - RNA, 16 nt, Homo sapiens
ggaucacaaggucacu

SEQ ID NO: 1996676 - RNA, 14 nt, Homo sapiens
aagaugauugacuc

SEQ ID NO: 1996677 - RNA, 13 nt, Homo sapiens
cacccaggcacuu

SEQ ID NO: 1996678 - RNA, 17 nt, Homo sapiens
auuugguacaaaaccac

SEQ ID NO: 1996679 - RNA, 18 nt, Homo sapiens
cauuuuaaaaaauggaac

SEQ ID NO: 1996680 - RNA, 11 nt, Homo sapiens
aaccucagcua

SEQ ID NO: 1996681 - RNA, 17 nt, Homo sapiens
aaguguaacagauauca

SEQ ID NO: 1996682 - RNA, 17 nt, Homo sapiens
ucagcaggaaugcucug

SEQ ID NO: 1996683 - RNA, 15 nt, Homo sapiens
gcuaauucuuugcaa

SEQ ID NO: 1996684 - RNA, 13 nt, Homo sapiens
aaaggcacaguga

SEQ ID NO: 1996685 - RNA, 23 nt, Homo sapiens
cagccccguguagccccgggcug

SEQ ID NO: 1996686 - RNA, 20 nt, Homo sapiens
cuccuguaagcaacacuuua

SEQ ID NO: 1996687 - RNA, 22 nt, Homo sapiens
uuuuauaaagucuaagcaagau

SEQ ID NO: 1996688 - RNA, 16 nt, Homo sapiens
aguguguaugccaaga

SEQ ID NO: 1996689 - RNA, 17 nt, Homo sapiens
uccaguuuagcccuucc

SEQ ID NO: 1996690 - RNA, 20 nt, Homo sapiens
caaccaggcuacaguugaua

SEQ ID NO: 1996691 - RNA, 17 nt, Homo sapiens
caauuagaacuccugac

SEQ ID NO: 1996692 - RNA, 12 nt, Homo sapiens
ucucuucuaaug

SEQ ID NO: 1996693 - RNA, 19 nt, Homo sapiens
ugcaugaaaaacauuccac

SEQ ID NO: 1996694 - RNA, 13 nt, Homo sapiens
uaguuaauggauu

SEQ ID NO: 1996695 - RNA, 22 nt, Homo sapiens
agcuccgaugcccgcccgggga

SEQ ID NO: 1996696 - RNA, 16 nt, Homo sapiens
gcaagcauugaauaau

SEQ ID NO: 1996697 - RNA, 17 nt, Homo sapiens
acuuuuugguacaggua

SEQ ID NO: 1996698 - RNA, 16 nt, Homo sapiens
auguauuuuucuugcu

SEQ ID NO: 1996699 - RNA, 18 nt, Homo sapiens
uuuccaggcugcauuugu

SEQ ID NO: 1996700 - RNA, 23 nt, Homo sapiens
gagccuauaucuucaucugugaa

SEQ ID NO: 1996701 - RNA, 23 nt, Homo sapiens
gccuacagauaauuuauuuugua

SEQ ID NO: 1996702 - RNA, 23 nt, Homo sapiens
caggcauuugaggcugucgugag

SEQ ID NO: 1996703 - RNA, 20 nt, Homo sapiens
cagagagaaucaacagauca

SEQ ID NO: 1996704 - RNA, 15 nt, Homo sapiens
ccauagagacuuugu

SEQ ID NO: 1996705 - RNA, 15 nt, Homo sapiens
ccugaaagacaguau

SEQ ID NO: 1996706 - RNA, 23 nt, Homo sapiens
gaggaagcauccaaagauugcaa

SEQ ID NO: 1996707 - RNA, 14 nt, Homo sapiens
cacacaguggcacu

SEQ ID NO: 1996708 - RNA, 21 nt, Homo sapiens
uuuuugaaaucagcauacuca

SEQ ID NO: 1996709 - RNA, 22 nt, Homo sapiens
caggacuuccaucugugccaua

SEQ ID NO: 1996710 - RNA, 13 nt, Homo sapiens
auaaaaacacuua

SEQ ID NO: 1996711 - RNA, 18 nt, Homo sapiens
ccuggguuuaagcaaugc

SEQ ID NO: 1996712 - RNA, 21 nt, Homo sapiens
cccccuccaggccaguuugaa

SEQ ID NO: 1996713 - RNA, 22 nt, Homo sapiens
auagauuuucauguucuugcag

SEQ ID NO: 1996714 - RNA, 23 nt, Homo sapiens
augccacccaguugugacaauua

SEQ ID NO: 1996715 - RNA, 20 nt, Homo sapiens
uugcaaagcuuccuuggaag

SEQ ID NO: 1996716 - RNA, 18 nt, Homo sapiens
cuuuuaugauacuugaaa

SEQ ID NO: 1996717 - RNA, 15 nt, Homo sapiens
aacucauuugcucua

SEQ ID NO: 1996718 - RNA, 23 nt, Homo sapiens
cuaauaaauauuuagucugcauu

SEQ ID NO: 1996719 - RNA, 14 nt, Homo sapiens
aucaacaugcuuua

SEQ ID NO: 1996720 - RNA, 23 nt, Homo sapiens
accucgcuguugucacaucucag

SEQ ID NO: 1996721 - RNA, 22 nt, Homo sapiens
agcugcuucucccacuuggcca

SEQ ID NO: 1996722 - RNA, 15 nt, Homo sapiens
cugcaggucacugaa

SEQ ID NO: 1996723 - RNA, 23 nt, Homo sapiens
auagcacacuuuuccacauucca

SEQ ID NO: 1996724 - RNA, 17 nt, Homo sapiens
gaauaaaaacuuuugag

SEQ ID NO: 1996725 - RNA, 19 nt, Homo sapiens
cuagacuacucaauauuaa

SEQ ID NO: 1996726 - RNA, 12 nt, Homo sapiens
ugaaaagucaaa

SEQ ID NO: 1996727 - RNA, 18 nt, Homo sapiens
cagaacuuucuaguugcc

SEQ ID NO: 1996728 - RNA, 22 nt, Homo sapiens
ccuuucuccuccccaccuguag

SEQ ID NO: 1996729 - RNA, 21 nt, Homo sapiens
acaacguucuuaguuuacuua

SEQ ID NO: 1996730 - RNA, 14 nt, Homo sapiens
gcaggaguggugca

SEQ ID NO: 1996731 - RNA, 12 nt, Homo sapiens
gugagugcaagg

SEQ ID NO: 1996732 - RNA, 17 nt, Homo sapiens
gagccccccacugcaga

SEQ ID NO: 1996733 - RNA, 12 nt, Homo sapiens
ucagugaaggac

SEQ ID NO: 1996734 - RNA, 14 nt, Homo sapiens
cuccagccaucuca

SEQ ID NO: 1996735 - RNA, 19 nt, Homo sapiens
uccaucauucauccaggac

SEQ ID NO: 1996736 - RNA, 17 nt, Homo sapiens
cuucuguuuccaucugc

SEQ ID NO: 1996737 - RNA, 22 nt, Homo sapiens
uagugggccaccccuaaucacu

SEQ ID NO: 1996738 - RNA, 16 nt, Homo sapiens
ugggcuccacauugca

SEQ ID NO: 1996739 - RNA, 14 nt, Homo sapiens
cucugccuucuuag

SEQ ID NO: 1996740 - RNA, 20 nt, Homo sapiens
uccuaaacucucuagcuuaa

SEQ ID NO: 1996741 - RNA, 15 nt, Homo sapiens
agaucugaaguagug

SEQ ID NO: 1996742 - RNA, 20 nt, Homo sapiens
uccccuccucagugacauca

SEQ ID NO: 1996743 - RNA, 12 nt, Homo sapiens
ccccucuggaau

SEQ ID NO: 1996744 - RNA, 14 nt, Homo sapiens
ggguuuuauaucca

SEQ ID NO: 1996745 - RNA, 17 nt, Homo sapiens
uaacagaaauacaucau

SEQ ID NO: 1996746 - RNA, 14 nt, Homo sapiens
cucucuuuaacccu

SEQ ID NO: 1996747 - RNA, 15 nt, Homo sapiens
gcccaggccaucacc

SEQ ID NO: 1996748 - RNA, 21 nt, Homo sapiens
accgcggcgccuccgcccaaa

SEQ ID NO: 1996749 - RNA, 21 nt, Homo sapiens
uuauggaauaucaucugucau

SEQ ID NO: 1996750 - RNA, 15 nt, Homo sapiens
acaucuuaaauucau

SEQ ID NO: 1996751 - RNA, 19 nt, Homo sapiens
agugaggcucagauuaaau

SEQ ID NO: 1996752 - RNA, 14 nt, Homo sapiens
cuaacucuugcuca

SEQ ID NO: 1996753 - RNA, 12 nt, Homo sapiens
uaguacacacuu

SEQ ID NO: 1996754 - RNA, 17 nt, Homo sapiens
cuuuccuguagucccau

SEQ ID NO: 1996755 - RNA, 16 nt, Homo sapiens
cugcacauaaguuaug

SEQ ID NO: 1996756 - RNA, 13 nt, Homo sapiens
gcacuagaucucc

SEQ ID NO: 1996757 - RNA, 13 nt, Homo sapiens
caucacuugccaa

SEQ ID NO: 1996758 - RNA, 13 nt, Homo sapiens
gaagcacugcugu

SEQ ID NO: 1996759 - RNA, 18 nt, Homo sapiens
auaugcauugucugcaau

SEQ ID NO: 1996760 - RNA, 18 nt, Homo sapiens
gcugggucaaggcaaagc

SEQ ID NO: 1996761 - RNA, 16 nt, Homo sapiens
uuaccauacugucucu

SEQ ID NO: 1996762 - RNA, 16 nt, Homo sapiens
agaaugcaauacugua

SEQ ID NO: 1996763 - RNA, 22 nt, Homo sapiens
agcuccaguuuccaaguuccug

SEQ ID NO: 1996764 - RNA, 22 nt, Homo sapiens
ugacccugaaaggaacacuggc

SEQ ID NO: 1996765 - RNA, 15 nt, Homo sapiens
ucugcauccagagau

SEQ ID NO: 1996766 - RNA, 18 nt, Homo sapiens
uacagcucuuggcauuuu

SEQ ID NO: 1996767 - RNA, 15 nt, Homo sapiens
cugaaauuaacucag

SEQ ID NO: 1996768 - RNA, 20 nt, Homo sapiens
aggcagcugccucugcuccc

SEQ ID NO: 1996769 - RNA, 16 nt, Homo sapiens
caggaagaugaaagag

SEQ ID NO: 1996770 - RNA, 16 nt, Homo sapiens
ggccuagaccuggugc

SEQ ID NO: 1996771 - RNA, 13 nt, Homo sapiens
ucuccuuuuccua

SEQ ID NO: 1996772 - RNA, 15 nt, Homo sapiens
cuuucaaguguccug

SEQ ID NO: 1996773 - RNA, 13 nt, Homo sapiens
caaggaggugaca

SEQ ID NO: 1996774 - RNA, 23 nt, Homo sapiens
uuguguaaauacaguggaucuca

SEQ ID NO: 1996775 - RNA, 21 nt, Homo sapiens
ccuagucaccaagaacuccac

SEQ ID NO: 1996776 - RNA, 16 nt, Homo sapiens
auacuagauugaucua

SEQ ID NO: 1996777 - RNA, 13 nt, Homo sapiens
ucaucucuuucua

SEQ ID NO: 1996778 - RNA, 22 nt, Homo sapiens
accugcgccuggcucugucacc

SEQ ID NO: 1996779 - RNA, 15 nt, Homo sapiens
cuuuuguaccaaaua

SEQ ID NO: 1996780 - RNA, 16 nt, Homo sapiens
gauugcauaugcaucc

SEQ ID NO: 1996781 - RNA, 14 nt, Homo sapiens
uuauauaaggcauu

SEQ ID NO: 1996782 - RNA, 15 nt, Homo sapiens
auguuagucaaggac

SEQ ID NO: 1996783 - RNA, 15 nt, Homo sapiens
gcuaguaaaagccau

SEQ ID NO: 1996784 - RNA, 22 nt, Homo sapiens
accuaaagaauaugaauggauu

SEQ ID NO: 1996785 - RNA, 15 nt, Homo sapiens
ccuagguuguguuga

SEQ ID NO: 1996786 - RNA, 12 nt, Homo sapiens
gagccuggagaa

SEQ ID NO: 1996787 - RNA, 21 nt, Homo sapiens
cauuaaauauuugacaucuac

SEQ ID NO: 1996788 - RNA, 18 nt, Homo sapiens
cauauuugcacugaagca

SEQ ID NO: 1996789 - RNA, 21 nt, Homo sapiens
ugucucugcagcucuacaggu

SEQ ID NO: 1996790 - RNA, 16 nt, Homo sapiens
uagaguaucacuccca

SEQ ID NO: 1996791 - RNA, 14 nt, Homo sapiens
aaaugagccuuaag

SEQ ID NO: 1996792 - RNA, 17 nt, Homo sapiens
agggaacauagacucac

SEQ ID NO: 1996793 - RNA, 14 nt, Homo sapiens
acagcagcagcuca

SEQ ID NO: 1996794 - RNA, 17 nt, Homo sapiens
uucaaccuuaccaaaaa

SEQ ID NO: 1996795 - RNA, 13 nt, Homo sapiens
ugcuagggaccuc

SEQ ID NO: 1996796 - RNA, 15 nt, Homo sapiens
cuuccuucacuuugc

SEQ ID NO: 1996797 - RNA, 16 nt, Homo sapiens
agaaauccagcuucau

SEQ ID NO: 1996798 - RNA, 16 nt, Homo sapiens
caacuugagggcccag

SEQ ID NO: 1996799 - RNA, 21 nt, Homo sapiens
uuccccagcgucccagucucu

SEQ ID NO: 1996800 - RNA, 20 nt, Homo sapiens
aaauuaagagauacauuccc

SEQ ID NO: 1996801 - RNA, 15 nt, Homo sapiens
gccucucuuucacac

SEQ ID NO: 1996802 - RNA, 15 nt, Homo sapiens
uuuaauaugcuuaaa

SEQ ID NO: 1996803 - RNA, 14 nt, Homo sapiens
cagcgaacaugccu

SEQ ID NO: 1996804 - RNA, 13 nt, Homo sapiens
uguuguagacuua

SEQ ID NO: 1996805 - RNA, 21 nt, Homo sapiens
uauauaaaugugauugcagcu

SEQ ID NO: 1996806 - RNA, 19 nt, Homo sapiens
aucugcauuucuacauguu

SEQ ID NO: 1996807 - RNA, 15 nt, Homo sapiens
ggcuucaagagccag

SEQ ID NO: 1996808 - RNA, 22 nt, Homo sapiens
gucuuuuuuuucuucaccucac

SEQ ID NO: 1996809 - RNA, 20 nt, Homo sapiens
caacagugagagacuccaua

SEQ ID NO: 1996810 - RNA, 11 nt, Homo sapiens
cccugcugcuu

SEQ ID NO: 1996811 - RNA, 18 nt, Homo sapiens
uauuuauguaacaaaguu

SEQ ID NO: 1996812 - RNA, 21 nt, Homo sapiens
acaugaacauauguccaucca

SEQ ID NO: 1996813 - RNA, 13 nt, Homo sapiens
acucccugcuuag

SEQ ID NO: 1996814 - RNA, 17 nt, Homo sapiens
cagaguccagugcucug

SEQ ID NO: 1996815 - RNA, 20 nt, Homo sapiens
agcccucaggccagugccag

SEQ ID NO: 1996816 - RNA, 23 nt, Homo sapiens
ccuucuucccgccccaccuccca

SEQ ID NO: 1996817 - RNA, 18 nt, Homo sapiens
aaauucuuaaaucugccu

SEQ ID NO: 1996818 - RNA, 23 nt, Homo sapiens
aucuguugauauuaaagaaucaa

SEQ ID NO: 1996819 - RNA, 21 nt, Homo sapiens
ugaugcagcauuugauaauga

SEQ ID NO: 1996820 - RNA, 21 nt, Homo sapiens
gagcuggauuugggagcucug

SEQ ID NO: 1996821 - RNA, 22 nt, Homo sapiens
acuaaagggugugggucaggga

SEQ ID NO: 1996822 - RNA, 13 nt, Homo sapiens
agagaccaaaaau

SEQ ID NO: 1996823 - RNA, 15 nt, Homo sapiens
ucagucaauucugau

SEQ ID NO: 1996824 - RNA, 17 nt, Homo sapiens
cuuggugcccucgccuc

SEQ ID NO: 1996825 - RNA, 20 nt, Homo sapiens
uccuauuucuccaaagccuu

SEQ ID NO: 1996826 - RNA, 20 nt, Homo sapiens
aggcagcauugcacagugaa

SEQ ID NO: 1996827 - RNA, 14 nt, Homo sapiens
aaagggacaguuug

SEQ ID NO: 1996828 - RNA, 15 nt, Homo sapiens
aaaaugaagauacac

SEQ ID NO: 1996829 - RNA, 16 nt, Homo sapiens
ggagaggaacaagcuu

SEQ ID NO: 1996830 - RNA, 15 nt, Homo sapiens
agauguagucuuacu

SEQ ID NO: 1996831 - RNA, 20 nt, Homo sapiens
acugcugagguuuuauacuc

SEQ ID NO: 1996832 - RNA, 15 nt, Homo sapiens
cuuccuuccucuugc

SEQ ID NO: 1996833 - RNA, 12 nt, Homo sapiens
cuugagucagaa

SEQ ID NO: 1996834 - RNA, 15 nt, Homo sapiens
gacugggcacugggg

SEQ ID NO: 1996835 - RNA, 17 nt, Homo sapiens
gaagaagaaaacacuag

SEQ ID NO: 1996836 - RNA, 10 nt, Homo sapiens
accaguuuuc

SEQ ID NO: 1996837 - RNA, 14 nt, Homo sapiens
guauuccuuuucau

SEQ ID NO: 1996838 - RNA, 20 nt, Homo sapiens
agcagacaccauucauucca

SEQ ID NO: 1996839 - RNA, 20 nt, Homo sapiens
aaccauuccaacuucaauuu

SEQ ID NO: 1996840 - RNA, 18 nt, Homo sapiens
uauccagaugaacugaga

SEQ ID NO: 1996841 - RNA, 17 nt, Homo sapiens
cuaaggcucuauuuccu

SEQ ID NO: 1996842 - RNA, 22 nt, Homo sapiens
cccuuuuuuggcugcugaaggc

SEQ ID NO: 1996843 - RNA, 20 nt, Homo sapiens
cuuauaaauauccugcucac

SEQ ID NO: 1996844 - RNA, 14 nt, Homo sapiens
gacagaaagcaagg

SEQ ID NO: 1996845 - RNA, 12 nt, Homo sapiens
aaauucuuucag

SEQ ID NO: 1996846 - RNA, 19 nt, Homo sapiens
uuuuguccauaaaucucag

SEQ ID NO: 1996847 - RNA, 17 nt, Homo sapiens
agggcagagacaaucac

SEQ ID NO: 1996848 - RNA, 13 nt, Homo sapiens
gccuaaagugcug

SEQ ID NO: 1996849 - RNA, 13 nt, Homo sapiens
cagcagacugacc

SEQ ID NO: 1996850 - RNA, 11 nt, Homo sapiens
cuguaauacua

SEQ ID NO: 1996851 - RNA, 20 nt, Homo sapiens
uaaaauucuacuguauggaa

SEQ ID NO: 1996852 - RNA, 21 nt, Homo sapiens
aaccugcagggacuccaugcu

SEQ ID NO: 1996853 - RNA, 15 nt, Homo sapiens
uugguaauagauuua

SEQ ID NO: 1996854 - RNA, 14 nt, Homo sapiens
gacacaaaugcaug

SEQ ID NO: 1996855 - RNA, 21 nt, Homo sapiens
gaaucacaucuuuuaagacaa

SEQ ID NO: 1996856 - RNA, 20 nt, Homo sapiens
auuuucuguggaucauuucc

SEQ ID NO: 1996857 - RNA, 22 nt, Homo sapiens
ugaccuugcugauggugacauu

SEQ ID NO: 1996858 - RNA, 14 nt, Homo sapiens
uggacgaacagggg

SEQ ID NO: 1996859 - RNA, 21 nt, Homo sapiens
aaucuagagaaggcauuucau

SEQ ID NO: 1996860 - RNA, 23 nt, Homo sapiens
caguacaaauguuuuucauccau

SEQ ID NO: 1996861 - RNA, 19 nt, Homo sapiens
cacaagcagccuacuaaca

SEQ ID NO: 1996862 - RNA, 22 nt, Homo sapiens
augagaauaauucuuuccaugc

SEQ ID NO: 1996863 - RNA, 15 nt, Homo sapiens
ucaauaaaagaauuc

SEQ ID NO: 1996864 - RNA, 21 nt, Homo sapiens
aacgagcauaguccaaaaagc

SEQ ID NO: 1996865 - RNA, 16 nt, Homo sapiens
ugagaggaagccugag

SEQ ID NO: 1996866 - RNA, 13 nt, Homo sapiens
acuucagcccagc

SEQ ID NO: 1996867 - RNA, 20 nt, Homo sapiens
uauaaacauguccccuuccc

SEQ ID NO: 1996868 - RNA, 13 nt, Homo sapiens
agucuuucuugaa

SEQ ID NO: 1996869 - RNA, 14 nt, Homo sapiens
ucuguguuaggggu

SEQ ID NO: 1996870 - RNA, 15 nt, Homo sapiens
uauuggacagucuca

SEQ ID NO: 1996871 - RNA, 18 nt, Homo sapiens
cuggcccagggccugaaa

SEQ ID NO: 1996872 - RNA, 19 nt, Homo sapiens
uuaaaaaaaauuugcucau

SEQ ID NO: 1996873 - RNA, 23 nt, Homo sapiens
ggaccaaagggggagucccucgu

SEQ ID NO: 1996874 - RNA, 11 nt, Homo sapiens
ucugacugcug

SEQ ID NO: 1996875 - RNA, 14 nt, Homo sapiens
cuuaacagacucaa

SEQ ID NO: 1996876 - RNA, 21 nt, Homo sapiens
agggucaagggcuggggcuga

SEQ ID NO: 1996877 - RNA, 15 nt, Homo sapiens
agcuccacucagggc

SEQ ID NO: 1996878 - RNA, 15 nt, Homo sapiens
ugagggccaccucca

SEQ ID NO: 1996879 - RNA, 22 nt, Homo sapiens
uuuaucacuugccgugucaucc

SEQ ID NO: 1996880 - RNA, 21 nt, Homo sapiens
uacagacacucccacuuggca

SEQ ID NO: 1996881 - RNA, 17 nt, Homo sapiens
auaacaaggagauuucu

SEQ ID NO: 1996882 - RNA, 10 nt, Homo sapiens
cucagugcag

SEQ ID NO: 1996883 - RNA, 18 nt, Homo sapiens
agccuuuggucuccugga

SEQ ID NO: 1996884 - RNA, 15 nt, Homo sapiens
cugcagagugggcuc

SEQ ID NO: 1996885 - RNA, 12 nt, Homo sapiens
agcacuccucau

SEQ ID NO: 1996886 - RNA, 17 nt, Homo sapiens
uuuccaaaaaaguguua

SEQ ID NO: 1996887 - RNA, 19 nt, Homo sapiens
gguuucacuauguugccua

SEQ ID NO: 1996888 - RNA, 21 nt, Homo sapiens
aggguccugggccuccugaca

SEQ ID NO: 1996889 - RNA, 13 nt, Homo sapiens
aaacacugauggu

SEQ ID NO: 1996890 - RNA, 17 nt, Homo sapiens
cuggccugaaaccagug

SEQ ID NO: 1996891 - RNA, 18 nt, Homo sapiens
ccuuagcuaaaugcaauu

SEQ ID NO: 1996892 - RNA, 16 nt, Homo sapiens
acaugaauacuaucca

SEQ ID NO: 1996893 - RNA, 22 nt, Homo sapiens
gaagguucugguaaccuguggu

SEQ ID NO: 1996894 - RNA, 18 nt, Homo sapiens
cgagcgcuaccucuccag

SEQ ID NO: 1996895 - RNA, 15 nt, Homo sapiens
auuguuuaacccugg

SEQ ID NO: 1996896 - RNA, 13 nt, Homo sapiens
acaggagcacugc

SEQ ID NO: 1996897 - RNA, 13 nt, Homo sapiens
auuuccauauucu

SEQ ID NO: 1996898 - RNA, 22 nt, Homo sapiens
cucacagcaaggauggagcuga

SEQ ID NO: 1996899 - RNA, 17 nt, Homo sapiens
aacaggggccaaacugg

SEQ ID NO: 1996900 - RNA, 22 nt, Homo sapiens
aaguacaaccugaauacccuuu

SEQ ID NO: 1996901 - RNA, 15 nt, Homo sapiens
uaugucucagugccc

SEQ ID NO: 1996902 - RNA, 19 nt, Homo sapiens
uccuugauaucauucagca

SEQ ID NO: 1996903 - RNA, 13 nt, Homo sapiens
aagcucaucucag

SEQ ID NO: 1996904 - RNA, 20 nt, Homo sapiens
agcacugccauuagacugaa

SEQ ID NO: 1996905 - RNA, 17 nt, Homo sapiens
gcaccucaugcagaggg

SEQ ID NO: 1996906 - RNA, 14 nt, Homo sapiens
caugcuacugccaa

SEQ ID NO: 1996907 - RNA, 21 nt, Homo sapiens
ccaagcuauguggcugcugcu

SEQ ID NO: 1996908 - RNA, 14 nt, Homo sapiens
uauaucuaugucua

SEQ ID NO: 1996909 - RNA, 18 nt, Homo sapiens
caacccgcuggagcccac

SEQ ID NO: 1996910 - RNA, 15 nt, Homo sapiens
gcucuacauucugcu

SEQ ID NO: 1996911 - RNA, 19 nt, Homo sapiens
ucgcugaugcagacacaga

SEQ ID NO: 1996912 - RNA, 22 nt, Homo sapiens
agaguuauuuuguguccuuuaa

SEQ ID NO: 1996913 - RNA, 21 nt, Homo sapiens
aaacuaauuguauuuagugac

SEQ ID NO: 1996914 - RNA, 15 nt, Homo sapiens
ccaagcgaccaagga

SEQ ID NO: 1996915 - RNA, 18 nt, Homo sapiens
gaauggaagcuucagggc

SEQ ID NO: 1996916 - RNA, 19 nt, Homo sapiens
gaaggaacucuggcuucca

SEQ ID NO: 1996917 - RNA, 17 nt, Homo sapiens
acgaaucguacuucuuu

SEQ ID NO: 1996918 - RNA, 23 nt, Homo sapiens
gccaccgugggggaacugacgcu

SEQ ID NO: 1996919 - RNA, 23 nt, Homo sapiens
aaaauguagacugaaaagccaug

SEQ ID NO: 1996920 - RNA, 20 nt, Homo sapiens
ucuaguuucuugugggcuaa

SEQ ID NO: 1996921 - RNA, 17 nt, Homo sapiens
aauccccacccugggcu

SEQ ID NO: 1996922 - RNA, 19 nt, Homo sapiens
caauucagauugucuugca

SEQ ID NO: 1996923 - RNA, 17 nt, Homo sapiens
uuaaauuuaauaccaga

SEQ ID NO: 1996924 - RNA, 19 nt, Homo sapiens
uauuguugcaauaucuaca

SEQ ID NO: 1996925 - RNA, 18 nt, Homo sapiens
aaauuucaguccagaaga

SEQ ID NO: 1996926 - RNA, 14 nt, Homo sapiens
gugagccacagugc

SEQ ID NO: 1996927 - RNA, 19 nt, Homo sapiens
uauuaacugccaaaacaag

SEQ ID NO: 1996928 - RNA, 21 nt, Homo sapiens
ggaaaagcauuuuucaauaua

SEQ ID NO: 1996929 - RNA, 18 nt, Homo sapiens
uuguuugaauuccuccuc

SEQ ID NO: 1996930 - RNA, 23 nt, Homo sapiens
agacuguugcucaaaucuauuca

SEQ ID NO: 1996931 - RNA, 19 nt, Homo sapiens
ucaccaggggaggagccug

SEQ ID NO: 1996932 - RNA, 13 nt, Homo sapiens
gccaacaguggcu

SEQ ID NO: 1996933 - RNA, 19 nt, Homo sapiens
gagcucuaagcccauucag

SEQ ID NO: 1996934 - RNA, 18 nt, Homo sapiens
uugagguaggagaauugc

SEQ ID NO: 1996935 - RNA, 15 nt, Homo sapiens
caugauuuuacucau

SEQ ID NO: 1996936 - RNA, 23 nt, Homo sapiens
uugacagagagagauacucuggg

SEQ ID NO: 1996937 - RNA, 22 nt, Homo sapiens
acaacaccuccuccugcugcuc

SEQ ID NO: 1996938 - RNA, 19 nt, Homo sapiens
ugaaauaauguacaucugg

SEQ ID NO: 1996939 - RNA, 14 nt, Homo sapiens
ugguucaugccugu

SEQ ID NO: 1996940 - RNA, 22 nt, Homo sapiens
auguucucaauacccacugcca

SEQ ID NO: 1996941 - RNA, 19 nt, Homo sapiens
uggucccacuucacagcug

SEQ ID NO: 1996942 - RNA, 21 nt, Homo sapiens
gugaaaaaguuaaacauugaa

SEQ ID NO: 1996943 - RNA, 16 nt, Homo sapiens
augcuggaaauaugaa

SEQ ID NO: 1996944 - RNA, 15 nt, Homo sapiens
ccugcccaccuguca

SEQ ID NO: 1996945 - RNA, 15 nt, Homo sapiens
cauacacacauauaa

SEQ ID NO: 1996946 - RNA, 19 nt, Homo sapiens
auccccaagugccugcuuu

SEQ ID NO: 1996947 - RNA, 18 nt, Homo sapiens
caauuggaauaaucacuu

SEQ ID NO: 1996948 - RNA, 20 nt, Homo sapiens
uguuuaaauagccuaaauga

SEQ ID NO: 1996949 - RNA, 12 nt, Homo sapiens
acugcagucacc

SEQ ID NO: 1996950 - RNA, 18 nt, Homo sapiens
cugguuccggcucugcac

SEQ ID NO: 1996951 - RNA, 16 nt, Homo sapiens
ggaaacuugucacuug

SEQ ID NO: 1996952 - RNA, 12 nt, Homo sapiens
gauuuguuuaaa

SEQ ID NO: 1996953 - RNA, 17 nt, Homo sapiens
ugagaauuguaugucau

SEQ ID NO: 1996954 - RNA, 13 nt, Homo sapiens
uaagggccagaaa

SEQ ID NO: 1996955 - RNA, 15 nt, Homo sapiens
aggauuagacaguaa

SEQ ID NO: 1996956 - RNA, 22 nt, Homo sapiens
ggaagccgccuagugcagagag

SEQ ID NO: 1996957 - RNA, 16 nt, Homo sapiens
ugugacaucacagggc

SEQ ID NO: 1996958 - RNA, 19 nt, Homo sapiens
guuuucguagguugacuau

SEQ ID NO: 1996959 - RNA, 22 nt, Homo sapiens
aacuaugugcuaucacauguga

SEQ ID NO: 1996960 - RNA, 22 nt, Homo sapiens
uaucaucggaguugacagugaa

SEQ ID NO: 1996961 - RNA, 18 nt, Homo sapiens
ucucaagcaggggauccu

SEQ ID NO: 1996962 - RNA, 15 nt, Homo sapiens
cuaugccagugcuca

SEQ ID NO: 1996963 - RNA, 15 nt, Homo sapiens
ccuggcgcugugcua

SEQ ID NO: 1996964 - RNA, 15 nt, Homo sapiens
cucuaguucuuaaca

SEQ ID NO: 1996965 - RNA, 21 nt, Homo sapiens
gaaaacauuccagaugcauga

SEQ ID NO: 1996966 - RNA, 19 nt, Homo sapiens
caguagucaccuaugucug

SEQ ID NO: 1996967 - RNA, 14 nt, Homo sapiens
aguuucuuuucaca

SEQ ID NO: 1996968 - RNA, 16 nt, Homo sapiens
uccauuucuacuguau

SEQ ID NO: 1996969 - RNA, 13 nt, Homo sapiens
ggaguaaaauuca

SEQ ID NO: 1996970 - RNA, 16 nt, Homo sapiens
cgaucuggauuuuaaa

SEQ ID NO: 1996971 - RNA, 20 nt, Homo sapiens
cuucaucugaaacccacaga

SEQ ID NO: 1996972 - RNA, 21 nt, Homo sapiens
agacguggcgugagagggacg

SEQ ID NO: 1996973 - RNA, 15 nt, Homo sapiens
uuuucagaccccagc

SEQ ID NO: 1996974 - RNA, 20 nt, Homo sapiens
uagaauuugagcaucaguga

SEQ ID NO: 1996975 - RNA, 22 nt, Homo sapiens
ggacuagccagaauucuacccu

SEQ ID NO: 1996976 - RNA, 20 nt, Homo sapiens
auauauguguuuuucacauu

SEQ ID NO: 1996977 - RNA, 17 nt, Homo sapiens
ccugggcaauuccgcau

SEQ ID NO: 1996978 - RNA, 16 nt, Homo sapiens
acagugagaaaccaua

SEQ ID NO: 1996979 - RNA, 20 nt, Homo sapiens
gcucucaguuacaagugcag

SEQ ID NO: 1996980 - RNA, 14 nt, Homo sapiens
aggccaacucacug

SEQ ID NO: 1996981 - RNA, 14 nt, Homo sapiens
ugggcaacacagug

SEQ ID NO: 1996982 - RNA, 16 nt, Homo sapiens
gguucguuuaccaaau

SEQ ID NO: 1996983 - RNA, 18 nt, Homo sapiens
gcugagacaggccccuga

SEQ ID NO: 1996984 - RNA, 16 nt, Homo sapiens
auacauuuacagcaau

SEQ ID NO: 1996985 - RNA, 13 nt, Homo sapiens
cuuguucuacuga

SEQ ID NO: 1996986 - RNA, 13 nt, Homo sapiens
cuuuaucuacuuu

SEQ ID NO: 1996987 - RNA, 16 nt, Homo sapiens
uuuaauggaaaccaag

SEQ ID NO: 1996988 - RNA, 15 nt, Homo sapiens
gaaugcagggacaaa

SEQ ID NO: 1996989 - RNA, 13 nt, Homo sapiens
gacaaaaugacuu

SEQ ID NO: 1996990 - RNA, 22 nt, Homo sapiens
agaaugucaaugaguaauucau

SEQ ID NO: 1996991 - RNA, 14 nt, Homo sapiens
uuccuucucugggu

SEQ ID NO: 1996992 - RNA, 21 nt, Homo sapiens
guaacacuguugagugcuuac

SEQ ID NO: 1996993 - RNA, 16 nt, Homo sapiens
gaaaccgccucuggag

SEQ ID NO: 1996994 - RNA, 19 nt, Homo sapiens
guaacuugcaccucugacc

SEQ ID NO: 1996995 - RNA, 18 nt, Homo sapiens
ccaacgaggugaucuagc

SEQ ID NO: 1996996 - RNA, 14 nt, Homo sapiens
cuuccgugcugaac

SEQ ID NO: 1996997 - RNA, 17 nt, Homo sapiens
ucacacuaugugcaaaa

SEQ ID NO: 1996998 - RNA, 22 nt, Homo sapiens
gaaaagccuccgccugcugugu

SEQ ID NO: 1996999 - RNA, 17 nt, Homo sapiens
ccugcuaacggugcuca

SEQ ID NO: 1997000 - RNA, 23 nt, Homo sapiens
uucaguuccucuuugcauggaau

SEQ ID NO: 1997001 - RNA, 13 nt, Homo sapiens
agaguacacccca

SEQ ID NO: 1997002 - RNA, 16 nt, Homo sapiens
augaucaaggugaaau

SEQ ID NO: 1997003 - RNA, 21 nt, Homo sapiens
aagagugagacuccgucucaa

SEQ ID NO: 1997004 - RNA, 13 nt, Homo sapiens
aagaaagauccac

SEQ ID NO: 1997005 - RNA, 15 nt, Homo sapiens
ugaaaugcuggcauu

SEQ ID NO: 1997006 - RNA, 22 nt, Homo sapiens
aaauaguguaagaacuguacau

SEQ ID NO: 1997007 - RNA, 16 nt, Homo sapiens
ucggaguaucugaaag

SEQ ID NO: 1997008 - RNA, 14 nt, Homo sapiens
gcuuccugcugaau

SEQ ID NO: 1997009 - RNA, 13 nt, Homo sapiens
gucuguuugcauu

SEQ ID NO: 1997010 - RNA, 19 nt, Homo sapiens
gacaaaccucuaacccagg

SEQ ID NO: 1997011 - RNA, 18 nt, Homo sapiens
uauuuuuucccuccugac

SEQ ID NO: 1997012 - RNA, 22 nt, Homo sapiens
aaaccccuuuucaguuugaacu

SEQ ID NO: 1997013 - RNA, 12 nt, Homo sapiens
gaggacaauuca

SEQ ID NO: 1997014 - RNA, 15 nt, Homo sapiens
uucaaaggcauuucu

SEQ ID NO: 1997015 - RNA, 17 nt, Homo sapiens
aacuagagacucuguga

SEQ ID NO: 1997016 - RNA, 21 nt, Homo sapiens
ugaauagcgaaucaucucaaa

SEQ ID NO: 1997017 - RNA, 13 nt, Homo sapiens
aguguuacauauu

SEQ ID NO: 1997018 - RNA, 14 nt, Homo sapiens
cugacgaaagaguc

SEQ ID NO: 1997019 - RNA, 21 nt, Homo sapiens
uaguuuuuaaaaaggccuuug

SEQ ID NO: 1997020 - RNA, 18 nt, Homo sapiens
ucucccuugggcucugau

SEQ ID NO: 1997021 - RNA, 17 nt, Homo sapiens
uguugccaccauaccuc

SEQ ID NO: 1997022 - RNA, 16 nt, Homo sapiens
cauuaccgucugugau

SEQ ID NO: 1997023 - RNA, 19 nt, Homo sapiens
gcacaugaacauaugucca

SEQ ID NO: 1997024 - RNA, 23 nt, Homo sapiens
cuguaguugcguggacucugcac

SEQ ID NO: 1997025 - RNA, 21 nt, Homo sapiens
ucugcauuccccgcugcccaa

SEQ ID NO: 1997026 - RNA, 20 nt, Homo sapiens
gaaguuucguaugcacuccc

SEQ ID NO: 1997027 - RNA, 20 nt, Homo sapiens
cauuccugauaugauuuaaa

SEQ ID NO: 1997028 - RNA, 14 nt, Homo sapiens
ggagucugcaguga

SEQ ID NO: 1997029 - RNA, 14 nt, Homo sapiens
guauuaauaccaaa

SEQ ID NO: 1997030 - RNA, 17 nt, Homo sapiens
uugaaagcaagucauuc

SEQ ID NO: 1997031 - RNA, 17 nt, Homo sapiens
uguucacugcuccuugc

SEQ ID NO: 1997032 - RNA, 22 nt, Homo sapiens
ccaccuaccugccggacacaga

SEQ ID NO: 1997033 - RNA, 15 nt, Homo sapiens
cagauuuaugaauuu

SEQ ID NO: 1997034 - RNA, 14 nt, Homo sapiens
agcacaucugggag

SEQ ID NO: 1997035 - RNA, 15 nt, Homo sapiens
aaucuucugucuugu

SEQ ID NO: 1997036 - RNA, 11 nt, Homo sapiens
augugaagggu

SEQ ID NO: 1997037 - RNA, 18 nt, Homo sapiens
aggaaaagauucaaagcu

SEQ ID NO: 1997038 - RNA, 16 nt, Homo sapiens
cuucuaccaacuggaa

SEQ ID NO: 1997039 - RNA, 21 nt, Homo sapiens
uuaauaaaagaacaugcuuga

SEQ ID NO: 1997040 - RNA, 13 nt, Homo sapiens
cacccagcaauag

SEQ ID NO: 1997041 - RNA, 22 nt, Homo sapiens
ucagagagccuuuuucuaggcc

SEQ ID NO: 1997042 - RNA, 17 nt, Homo sapiens
agaaauacagucuucca

SEQ ID NO: 1997043 - RNA, 19 nt, Homo sapiens
guuaaauauacacuagcuu

SEQ ID NO: 1997044 - RNA, 15 nt, Homo sapiens
uaaggcuguacauag

SEQ ID NO: 1997045 - RNA, 23 nt, Homo sapiens
ccaguuacgacugaagucagugu

SEQ ID NO: 1997046 - RNA, 17 nt, Homo sapiens
gccacaaauaacaucuc

SEQ ID NO: 1997047 - RNA, 13 nt, Homo sapiens
ugguuugagacac

SEQ ID NO: 1997048 - RNA, 13 nt, Homo sapiens
cucuggcugccaa

SEQ ID NO: 1997049 - RNA, 16 nt, Homo sapiens
uucuccaggaugucaa

SEQ ID NO: 1997050 - RNA, 18 nt, Homo sapiens
ccgaaaaggauaugcagu

SEQ ID NO: 1997051 - RNA, 21 nt, Homo sapiens
ucaucuccgggguggccacag

SEQ ID NO: 1997052 - RNA, 17 nt, Homo sapiens
uucuuauuaaugucauu

SEQ ID NO: 1997053 - RNA, 15 nt, Homo sapiens
agcccugaacgugag

SEQ ID NO: 1997054 - RNA, 19 nt, Homo sapiens
uguaaaguugguuggauaa

SEQ ID NO: 1997055 - RNA, 21 nt, Homo sapiens
cuccacgugguugccgucucu

SEQ ID NO: 1997056 - RNA, 12 nt, Homo sapiens
augaugaugaua

SEQ ID NO: 1997057 - RNA, 19 nt, Homo sapiens
cacguaaggucucauuuga

SEQ ID NO: 1997058 - RNA, 21 nt, Homo sapiens
gcaggggggcaguaacucccc

SEQ ID NO: 1997059 - RNA, 16 nt, Homo sapiens
uugcuggaaaccaagu

SEQ ID NO: 1997060 - RNA, 21 nt, Homo sapiens
acgauguucuguacaacuuaa

SEQ ID NO: 1997061 - RNA, 16 nt, Homo sapiens
guuuggaagaccagaa

SEQ ID NO: 1997062 - RNA, 12 nt, Homo sapiens
guucuacaugag

SEQ ID NO: 1997063 - RNA, 19 nt, Homo sapiens
cacccaugaaccuacuacc

SEQ ID NO: 1997064 - RNA, 20 nt, Homo sapiens
cugggaggcaucaguugcua

SEQ ID NO: 1997065 - RNA, 16 nt, Homo sapiens
ccaaaguacagaauuu

SEQ ID NO: 1997066 - RNA, 22 nt, Homo sapiens
uaaaaauauaaauuguacauuu

SEQ ID NO: 1997067 - RNA, 21 nt, Homo sapiens
uugucaccucugugaccccuc

SEQ ID NO: 1997068 - RNA, 17 nt, Homo sapiens
gcucuuucccucaugua

SEQ ID NO: 1997069 - RNA, 19 nt, Homo sapiens
auagauuugaaacauuuau

SEQ ID NO: 1997070 - RNA, 21 nt, Homo sapiens
guaaguggaggaaauguugga

SEQ ID NO: 1997071 - RNA, 17 nt, Homo sapiens
uaaaaaaaccaccaaaa

SEQ ID NO: 1997072 - RNA, 17 nt, Homo sapiens
uaaacugaacacaugac

SEQ ID NO: 1997073 - RNA, 20 nt, Homo sapiens
aggaacugguccaggccagg

SEQ ID NO: 1997074 - RNA, 18 nt, Homo sapiens
ccuaguuucccugaagga

SEQ ID NO: 1997075 - RNA, 13 nt, Homo sapiens
caguuagccucug

SEQ ID NO: 1997076 - RNA, 16 nt, Homo sapiens
uuagagcagaauucau

SEQ ID NO: 1997077 - RNA, 17 nt, Homo sapiens
uguaaaucacuuguaaa

SEQ ID NO: 1997078 - RNA, 17 nt, Homo sapiens
aaaguuccugucauucc

SEQ ID NO: 1997079 - RNA, 22 nt, Homo sapiens
agagcuggcgcucagcagcccu

SEQ ID NO: 1997080 - RNA, 14 nt, Homo sapiens
ugagguuguucaaa

SEQ ID NO: 1997081 - RNA, 22 nt, Homo sapiens
uuaaaaaaacaaucccaaguaa

SEQ ID NO: 1997082 - RNA, 18 nt, Homo sapiens
ucuccuacuaugcaauuu

SEQ ID NO: 1997083 - RNA, 18 nt, Homo sapiens
aucugccucuauucaauu

SEQ ID NO: 1997084 - RNA, 17 nt, Homo sapiens
agagcguuacuguagac

SEQ ID NO: 1997085 - RNA, 19 nt, Homo sapiens
ccucacaaaugcugugguu

SEQ ID NO: 1997086 - RNA, 15 nt, Homo sapiens
gauccagaacugcac

SEQ ID NO: 1997087 - RNA, 17 nt, Homo sapiens
acuacagguaugugcca

SEQ ID NO: 1997088 - RNA, 18 nt, Homo sapiens
caaccauuugaaaccccu

SEQ ID NO: 1997089 - RNA, 21 nt, Homo sapiens
agaaucugcagcuaacuuauu

SEQ ID NO: 1997090 - RNA, 18 nt, Homo sapiens
ucagcuucugcugggcug

SEQ ID NO: 1997091 - RNA, 16 nt, Homo sapiens
ucaccauaaaaaggaa

SEQ ID NO: 1997092 - RNA, 17 nt, Homo sapiens
uuauuuccuaugaugua

SEQ ID NO: 1997093 - RNA, 16 nt, Homo sapiens
ugcugauugaagacac

SEQ ID NO: 1997094 - RNA, 17 nt, Homo sapiens
caagaaaauaaaacuaa

SEQ ID NO: 1997095 - RNA, 11 nt, Homo sapiens
aaaaacugcag

SEQ ID NO: 1997096 - RNA, 19 nt, Homo sapiens
aagaaauuaugucagcuua

SEQ ID NO: 1997097 - RNA, 23 nt, Homo sapiens
gccaggauggcgugugugccgug

SEQ ID NO: 1997098 - RNA, 14 nt, Homo sapiens
uuuauaucaugcaa

SEQ ID NO: 1997099 - RNA, 15 nt, Homo sapiens
ugaccucccagugac

SEQ ID NO: 1997100 - RNA, 18 nt, Homo sapiens
ucuugaaaaacacuauuu

SEQ ID NO: 1997101 - RNA, 18 nt, Homo sapiens
ggauuacuauugcaaaag

SEQ ID NO: 1997102 - RNA, 20 nt, Homo sapiens
acaccucaagguguucucug

SEQ ID NO: 1997103 - RNA, 11 nt, Homo sapiens
uauucucugaa

SEQ ID NO: 1997104 - RNA, 15 nt, Homo sapiens
gcccuccgaccucuc

SEQ ID NO: 1997105 - RNA, 23 nt, Homo sapiens
ggccagccuccggcggggaccca

SEQ ID NO: 1997106 - RNA, 21 nt, Homo sapiens
acccaacagagaccagcuucu

SEQ ID NO: 1997107 - RNA, 20 nt, Homo sapiens
aggagugggaaaacacugcc

SEQ ID NO: 1997108 - RNA, 14 nt, Homo sapiens
uauuucaucucuuu

SEQ ID NO: 1997109 - RNA, 20 nt, Homo sapiens
uaugauccagcagauuauuc

SEQ ID NO: 1997110 - RNA, 21 nt, Homo sapiens
uguguacauauauauucuaca

SEQ ID NO: 1997111 - RNA, 21 nt, Homo sapiens
gugcuccucggcagaugcugu

SEQ ID NO: 1997112 - RNA, 20 nt, Homo sapiens
gagagcgagacccugucuca

SEQ ID NO: 1997113 - RNA, 22 nt, Homo sapiens
aagcuauggugagaugcagcug

SEQ ID NO: 1997114 - RNA, 21 nt, Homo sapiens
cagagaaaauaauuaauuuca

SEQ ID NO: 1997115 - RNA, 23 nt, Homo sapiens
aaccagcccuugagucugucaca

SEQ ID NO: 1997116 - RNA, 17 nt, Homo sapiens
uucguguuugauuccau

SEQ ID NO: 1997117 - RNA, 16 nt, Homo sapiens
accugauuuaccucuu

SEQ ID NO: 1997118 - RNA, 23 nt, Homo sapiens
ccuacauugugcugcaccugguc

SEQ ID NO: 1997119 - RNA, 23 nt, Homo sapiens
auauugauuucugccuuccuugc

SEQ ID NO: 1997120 - RNA, 13 nt, Homo sapiens
cugagagugaagu

SEQ ID NO: 1997121 - RNA, 19 nt, Homo sapiens
uuauacuaaauaugugacu

SEQ ID NO: 1997122 - RNA, 21 nt, Homo sapiens
gacaagcugcaaaucagccau

SEQ ID NO: 1997123 - RNA, 19 nt, Homo sapiens
uggagacccugccacagcc

SEQ ID NO: 1997124 - RNA, 20 nt, Homo sapiens
auggcagucacugaauucca

SEQ ID NO: 1997125 - RNA, 17 nt, Homo sapiens
cuagcugaguaugcuga

SEQ ID NO: 1997126 - RNA, 14 nt, Homo sapiens
caaugaaaugcucu

SEQ ID NO: 1997127 - RNA, 19 nt, Homo sapiens
uuguaaacauuucuuucaa

SEQ ID NO: 1997128 - RNA, 17 nt, Homo sapiens
gaaauaccagugaacca

SEQ ID NO: 1997129 - RNA, 22 nt, Homo sapiens
uucaggcaccugaagugagaac

SEQ ID NO: 1997130 - RNA, 15 nt, Homo sapiens
uauuuagacaaaguu

SEQ ID NO: 1997131 - RNA, 19 nt, Homo sapiens
agugcugagauuacaggug

SEQ ID NO: 1997132 - RNA, 17 nt, Homo sapiens
agcuaacuccagucucc

SEQ ID NO: 1997133 - RNA, 15 nt, Homo sapiens
agugcuuucuucucc

SEQ ID NO: 1997134 - RNA, 17 nt, Homo sapiens
uaucuauauucauuuca

SEQ ID NO: 1997135 - RNA, 12 nt, Homo sapiens
cucagaccagcu

SEQ ID NO: 1997136 - RNA, 15 nt, Homo sapiens
uuuugugaagccaug

SEQ ID NO: 1997137 - RNA, 15 nt, Homo sapiens
gacagccaagcaccu

SEQ ID NO: 1997138 - RNA, 13 nt, Homo sapiens
agaaaugauucac

SEQ ID NO: 1997139 - RNA, 16 nt, Homo sapiens
ucucagcuaacauucc

SEQ ID NO: 1997140 - RNA, 17 nt, Homo sapiens
auaacagauaaguccau

SEQ ID NO: 1997141 - RNA, 18 nt, Homo sapiens
gauuuaaagcaucaucug

SEQ ID NO: 1997142 - RNA, 13 nt, Homo sapiens
aaccuuacucuga

SEQ ID NO: 1997143 - RNA, 21 nt, Homo sapiens
cugaaugucuuacugugauca

SEQ ID NO: 1997144 - RNA, 20 nt, Homo sapiens
acaucugcacaacugggcac

SEQ ID NO: 1997145 - RNA, 13 nt, Homo sapiens
cacgcucgcugcc

SEQ ID NO: 1997146 - RNA, 14 nt, Homo sapiens
cucaggagacuugu

SEQ ID NO: 1997147 - RNA, 22 nt, Homo sapiens
cugcuuuugauuuuagccaugc

SEQ ID NO: 1997148 - RNA, 18 nt, Homo sapiens
cccucaucuuucuuccaa

SEQ ID NO: 1997149 - RNA, 21 nt, Homo sapiens
ucuauuuuaguugguuuguau

SEQ ID NO: 1997150 - RNA, 22 nt, Homo sapiens
aauaacuaugccagcaaccuug

SEQ ID NO: 1997151 - RNA, 21 nt, Homo sapiens
cucgccccaccuccaccugug

SEQ ID NO: 1997152 - RNA, 16 nt, Homo sapiens
uagccccucacuucca

SEQ ID NO: 1997153 - RNA, 18 nt, Homo sapiens
ugucagcccccaucugac

SEQ ID NO: 1997154 - RNA, 20 nt, Homo sapiens
cuacauuuaaaaauacuucu

SEQ ID NO: 1997155 - RNA, 21 nt, Homo sapiens
uccuuacuguuuacaguuuag

SEQ ID NO: 1997156 - RNA, 21 nt, Homo sapiens
aucaccucuggcuuugucucu

SEQ ID NO: 1997157 - RNA, 18 nt, Homo sapiens
uaguacauggagcucagg

SEQ ID NO: 1997158 - RNA, 21 nt, Homo sapiens
ccagcuacuugggagguugaa

SEQ ID NO: 1997159 - RNA, 19 nt, Homo sapiens
aucuaaaaugugugccaga

SEQ ID NO: 1997160 - RNA, 22 nt, Homo sapiens
gcguuuuuuaaauguauacuau

SEQ ID NO: 1997161 - RNA, 13 nt, Homo sapiens
gugaggcagggga

SEQ ID NO: 1997162 - RNA, 21 nt, Homo sapiens
uguuuuaaacacaugccuuaa

SEQ ID NO: 1997163 - RNA, 18 nt, Homo sapiens
aauugucaaagacuguau

SEQ ID NO: 1997164 - RNA, 20 nt, Homo sapiens
uaggugacagagugagacuc

SEQ ID NO: 1997165 - RNA, 16 nt, Homo sapiens
agccugugcuaaagaa

SEQ ID NO: 1997166 - RNA, 15 nt, Homo sapiens
auuugauauauguau

SEQ ID NO: 1997167 - RNA, 18 nt, Homo sapiens
aagagugguaucuugcag

SEQ ID NO: 1997168 - RNA, 18 nt, Homo sapiens
uccauuuacuugaucauu

SEQ ID NO: 1997169 - RNA, 18 nt, Homo sapiens
cauucucuucccagugaa

SEQ ID NO: 1997170 - RNA, 14 nt, Homo sapiens
uugcuaaagacaug

SEQ ID NO: 1997171 - RNA, 16 nt, Homo sapiens
uguaguguuuugugga

SEQ ID NO: 1997172 - RNA, 21 nt, Homo sapiens
gacaguggcaggggcuggaga

SEQ ID NO: 1997173 - RNA, 16 nt, Homo sapiens
uggcuuucccuuccag

SEQ ID NO: 1997174 - RNA, 13 nt, Homo sapiens
gauguauucugug

SEQ ID NO: 1997175 - RNA, 22 nt, Homo sapiens
cacuaaagagugaaugccauuu

SEQ ID NO: 1997176 - RNA, 22 nt, Homo sapiens
acuuuuucagaguugcuuuaaa

SEQ ID NO: 1997177 - RNA, 19 nt, Homo sapiens
cagaauauugcuuugguca

SEQ ID NO: 1997178 - RNA, 16 nt, Homo sapiens
guuucuaacucagggg

SEQ ID NO: 1997179 - RNA, 13 nt, Homo sapiens
aggacacagaucu

SEQ ID NO: 1997180 - RNA, 16 nt, Homo sapiens
cucguuccggucccca

SEQ ID NO: 1997181 - RNA, 12 nt, Homo sapiens
caacgccagaau

SEQ ID NO: 1997182 - RNA, 21 nt, Homo sapiens
ugacccuugucccauguggcu

SEQ ID NO: 1997183 - RNA, 14 nt, Homo sapiens
auccaaauuucuca

SEQ ID NO: 1997184 - RNA, 10 nt, Homo sapiens
aacugcauuu

SEQ ID NO: 1997185 - RNA, 23 nt, Homo sapiens
accucugccuuacaaaauacagg

SEQ ID NO: 1997186 - RNA, 21 nt, Homo sapiens
cuucgugaugacauaucacau

SEQ ID NO: 1997187 - RNA, 15 nt, Homo sapiens
augcaucacaugaug

SEQ ID NO: 1997188 - RNA, 16 nt, Homo sapiens
agaagaaagcaaaaaa

SEQ ID NO: 1997189 - RNA, 13 nt, Homo sapiens
aacaaaaagucau

SEQ ID NO: 1997190 - RNA, 14 nt, Homo sapiens
uuacauaucaccuc

SEQ ID NO: 1997191 - RNA, 14 nt, Homo sapiens
gagggcuguaggaa

SEQ ID NO: 1997192 - RNA, 21 nt, Homo sapiens
augcauagcuuugcacuucaa

SEQ ID NO: 1997193 - RNA, 14 nt, Homo sapiens
guuuaaaacaccuu

SEQ ID NO: 1997194 - RNA, 21 nt, Homo sapiens
caaauguaaauuuacugagcg

SEQ ID NO: 1997195 - RNA, 22 nt, Homo sapiens
aaauggugguuguuucuuccaa

SEQ ID NO: 1997196 - RNA, 19 nt, Homo sapiens
aggaaggucucaugccuga

SEQ ID NO: 1997197 - RNA, 22 nt, Homo sapiens
aucacugaaauaaaagcuauau

SEQ ID NO: 1997198 - RNA, 19 nt, Homo sapiens
cugaagggugacaucccag

SEQ ID NO: 1997199 - RNA, 12 nt, Homo sapiens
auucaaaauacu

SEQ ID NO: 1997200 - RNA, 20 nt, Homo sapiens
uugauguggaaaauuggcag

SEQ ID NO: 1997201 - RNA, 21 nt, Homo sapiens
gaggucugguccgagucucag

SEQ ID NO: 1997202 - RNA, 12 nt, Homo sapiens
uguuuacucauu

SEQ ID NO: 1997203 - RNA, 14 nt, Homo sapiens
cuccuacuuugaaa

SEQ ID NO: 1997204 - RNA, 15 nt, Homo sapiens
uuacauaauugccaa

SEQ ID NO: 1997205 - RNA, 19 nt, Homo sapiens
ggcuggcaccauggugacu

SEQ ID NO: 1997206 - RNA, 20 nt, Homo sapiens
aucauuggcccucauuccaa

SEQ ID NO: 1997207 - RNA, 22 nt, Homo sapiens
cagauguuuuacgucugggaga

SEQ ID NO: 1997208 - RNA, 23 nt, Homo sapiens
uuucagagugacuacacacagua

SEQ ID NO: 1997209 - RNA, 15 nt, Homo sapiens
agagaaguccagcuc

SEQ ID NO: 1997210 - RNA, 15 nt, Homo sapiens
agacgcagauuucag

SEQ ID NO: 1997211 - RNA, 20 nt, Homo sapiens
ucucucggcuccccaugugu

SEQ ID NO: 1997212 - RNA, 17 nt, Homo sapiens
caucauuucacuuguca

SEQ ID NO: 1997213 - RNA, 16 nt, Homo sapiens
cagcucccuucucugu

SEQ ID NO: 1997214 - RNA, 17 nt, Homo sapiens
uccucuaaugaagaauu

SEQ ID NO: 1997215 - RNA, 22 nt, Homo sapiens
aagacacaccucuggaucccug

SEQ ID NO: 1997216 - RNA, 20 nt, Homo sapiens
agaaacgagauuugccaaaa

SEQ ID NO: 1997217 - RNA, 16 nt, Homo sapiens
gcacucucugccauuc

SEQ ID NO: 1997218 - RNA, 19 nt, Homo sapiens
uuucaaguugcagucagaa

SEQ ID NO: 1997219 - RNA, 16 nt, Homo sapiens
ggcaugcagcuaccca

SEQ ID NO: 1997220 - RNA, 19 nt, Homo sapiens
ucaccuuaacucagccaga

SEQ ID NO: 1997221 - RNA, 23 nt, Homo sapiens
guuuuaccuccaggaaacaugaa

SEQ ID NO: 1997222 - RNA, 20 nt, Homo sapiens
aguugcuuccaguccugagc

SEQ ID NO: 1997223 - RNA, 21 nt, Homo sapiens
uucuccugauccucuugccac

SEQ ID NO: 1997224 - RNA, 18 nt, Homo sapiens
ugccucucugcuccagag

SEQ ID NO: 1997225 - RNA, 19 nt, Homo sapiens
gccuaaaaaguaucauuac

SEQ ID NO: 1997226 - RNA, 17 nt, Homo sapiens
ucucugcauccauuuga

SEQ ID NO: 1997227 - RNA, 19 nt, Homo sapiens
cacguggccgcugcuguga

SEQ ID NO: 1997228 - RNA, 14 nt, Homo sapiens
auucaaaguguuau

SEQ ID NO: 1997229 - RNA, 19 nt, Homo sapiens
cagggaacaagcccaaagc

SEQ ID NO: 1997230 - RNA, 15 nt, Homo sapiens
gaguaaauacaggua

SEQ ID NO: 1997231 - RNA, 22 nt, Homo sapiens
cagagcccugugucuguauaca

SEQ ID NO: 1997232 - RNA, 12 nt, Homo sapiens
cuuucagauuau

SEQ ID NO: 1997233 - RNA, 18 nt, Homo sapiens
cucaccaaaugagaagaa

SEQ ID NO: 1997234 - RNA, 23 nt, Homo sapiens
gauguaaaaaugaaaagccaaau

SEQ ID NO: 1997235 - RNA, 14 nt, Homo sapiens
gcccacagugucag

SEQ ID NO: 1997236 - RNA, 12 nt, Homo sapiens
cucuaaggaauu

SEQ ID NO: 1997237 - RNA, 22 nt, Homo sapiens
acauguguagccugugcaugua

SEQ ID NO: 1997238 - RNA, 14 nt, Homo sapiens
cucaggccagucac

SEQ ID NO: 1997239 - RNA, 19 nt, Homo sapiens
ccagauugugccacugcuc

SEQ ID NO: 1997240 - RNA, 17 nt, Homo sapiens
cugcccugcucccacag

SEQ ID NO: 1997241 - RNA, 12 nt, Homo sapiens
acuuccaugaua

SEQ ID NO: 1997242 - RNA, 12 nt, Homo sapiens
acauccaugaaa

SEQ ID NO: 1997243 - RNA, 14 nt, Homo sapiens
aggcccaccuggaa

SEQ ID NO: 1997244 - RNA, 16 nt, Homo sapiens
uucucuuugguguaca

SEQ ID NO: 1997245 - RNA, 16 nt, Homo sapiens
ucuggccaaauaugca

SEQ ID NO: 1997246 - RNA, 19 nt, Homo sapiens
ggaacucuggaguucauca

SEQ ID NO: 1997247 - RNA, 17 nt, Homo sapiens
gcauacccacacaaaua

SEQ ID NO: 1997248 - RNA, 19 nt, Homo sapiens
agcuuaaauuuuauaucau

SEQ ID NO: 1997249 - RNA, 18 nt, Homo sapiens
auauucuaaaaguaauaa

SEQ ID NO: 1997250 - RNA, 14 nt, Homo sapiens
uuaaacaccuccuc

SEQ ID NO: 1997251 - RNA, 12 nt, Homo sapiens
caguaucugauc

SEQ ID NO: 1997252 - RNA, 13 nt, Homo sapiens
ugaauauguagua

SEQ ID NO: 1997253 - RNA, 14 nt, Homo sapiens
gagcugcagggugg

SEQ ID NO: 1997254 - RNA, 11 nt, Homo sapiens
uaucugugaua

SEQ ID NO: 1997255 - RNA, 17 nt, Homo sapiens
caaaagcagcacaagga

SEQ ID NO: 1997256 - RNA, 20 nt, Homo sapiens
cugaguuuuccauggcagga

SEQ ID NO: 1997257 - RNA, 21 nt, Homo sapiens
auccacugggcacaacugcaa

SEQ ID NO: 1997258 - RNA, 14 nt, Homo sapiens
uuauguuagcauug

SEQ ID NO: 1997259 - RNA, 21 nt, Homo sapiens
guagccucgauguccuccucu

SEQ ID NO: 1997260 - RNA, 13 nt, Homo sapiens
auugcuuuuauua

SEQ ID NO: 1997261 - RNA, 16 nt, Homo sapiens
gagcuuucaaacacuc

SEQ ID NO: 1997262 - RNA, 18 nt, Homo sapiens
caggaccccuguccagga

SEQ ID NO: 1997263 - RNA, 20 nt, Homo sapiens
ugauccagaaagaaaacuug

SEQ ID NO: 1997264 - RNA, 22 nt, Homo sapiens
acaacauuuuugguguauuuga

SEQ ID NO: 1997265 - RNA, 20 nt, Homo sapiens
uuaucaucccaacagccaag

SEQ ID NO: 1997266 - RNA, 12 nt, Homo sapiens
uuaauaagugaa

SEQ ID NO: 1997267 - RNA, 21 nt, Homo sapiens
acaaaauggucauccaaacuc

SEQ ID NO: 1997268 - RNA, 21 nt, Homo sapiens
cagcaugaccugugaccagca

SEQ ID NO: 1997269 - RNA, 13 nt, Homo sapiens
guggagagugcac

SEQ ID NO: 1997270 - RNA, 21 nt, Homo sapiens
cucucaaaugugaccauguga

SEQ ID NO: 1997271 - RNA, 16 nt, Homo sapiens
gcggagguuccaguga

SEQ ID NO: 1997272 - RNA, 16 nt, Homo sapiens
cacuguccaguauucu

SEQ ID NO: 1997273 - RNA, 23 nt, Homo sapiens
uugaagaauuuguuuuagguaga

SEQ ID NO: 1997274 - RNA, 18 nt, Homo sapiens
gagaguugagacuugcca

SEQ ID NO: 1997275 - RNA, 16 nt, Homo sapiens
ggaugaccauaugcac

SEQ ID NO: 1997276 - RNA, 20 nt, Homo sapiens
aguucuggugaauguucaau

SEQ ID NO: 1997277 - RNA, 20 nt, Homo sapiens
gaagaccaagacacagauca

SEQ ID NO: 1997278 - RNA, 15 nt, Homo sapiens
cuucaaaauauugag

SEQ ID NO: 1997279 - RNA, 18 nt, Homo sapiens
aagacauuguguguauua

SEQ ID NO: 1997280 - RNA, 19 nt, Homo sapiens
aaguugucuuacacuucuc

SEQ ID NO: 1997281 - RNA, 21 nt, Homo sapiens
uuacaaacuuuguuugucaca

SEQ ID NO: 1997282 - RNA, 12 nt, Homo sapiens
gaauauucccaa

SEQ ID NO: 1997283 - RNA, 17 nt, Homo sapiens
ugcagucacuuugacag

SEQ ID NO: 1997284 - RNA, 13 nt, Homo sapiens
ucucuuucuuauu

SEQ ID NO: 1997285 - RNA, 22 nt, Homo sapiens
gcucagaaaauaucccuccugu

SEQ ID NO: 1997286 - RNA, 14 nt, Homo sapiens
ugauaucugaucaa

SEQ ID NO: 1997287 - RNA, 15 nt, Homo sapiens
caagaaguugcuuga

SEQ ID NO: 1997288 - RNA, 20 nt, Homo sapiens
agcucccgaggaagcacagc

SEQ ID NO: 1997289 - RNA, 13 nt, Homo sapiens
gaugcgacuguaa

SEQ ID NO: 1997290 - RNA, 16 nt, Homo sapiens
uuuuauuuacauucuu

SEQ ID NO: 1997291 - RNA, 20 nt, Homo sapiens
cucuguaguuuaugaugcaa

SEQ ID NO: 1997292 - RNA, 13 nt, Homo sapiens
uaacuucaaauau

SEQ ID NO: 1997293 - RNA, 23 nt, Homo sapiens
agggacaaccaccaggugucaaa

SEQ ID NO: 1997294 - RNA, 22 nt, Homo sapiens
cacaacuugagaagacauuuau

SEQ ID NO: 1997295 - RNA, 13 nt, Homo sapiens
guuggugcugcuc

SEQ ID NO: 1997296 - RNA, 23 nt, Homo sapiens
ucaguaaggcagugcaguacuca

SEQ ID NO: 1997297 - RNA, 21 nt, Homo sapiens
acuuucugaaauaacauggcc

SEQ ID NO: 1997298 - RNA, 16 nt, Homo sapiens
cagcugggcaaagcca

SEQ ID NO: 1997299 - RNA, 22 nt, Homo sapiens
auuuuagucagauuuugcccaa

SEQ ID NO: 1997300 - RNA, 15 nt, Homo sapiens
gggacagagccaugc

SEQ ID NO: 1997301 - RNA, 14 nt, Homo sapiens
gaaagaaaaccauu

SEQ ID NO: 1997302 - RNA, 16 nt, Homo sapiens
ggcaacaaagugagac

SEQ ID NO: 1997303 - RNA, 16 nt, Homo sapiens
gcugggccaccagcca

SEQ ID NO: 1997304 - RNA, 21 nt, Homo sapiens
cauaaagagcacguuuuccau

SEQ ID NO: 1997305 - RNA, 22 nt, Homo sapiens
uugaauggcaugcuaguagcag

SEQ ID NO: 1997306 - RNA, 21 nt, Homo sapiens
cugcaguagugcaccaucuca

SEQ ID NO: 1997307 - RNA, 15 nt, Homo sapiens
uaagguaaaaugcca

SEQ ID NO: 1997308 - RNA, 23 nt, Homo sapiens
ccccuuucuccagcccugacuaa

SEQ ID NO: 1997309 - RNA, 13 nt, Homo sapiens
gggagcaucucca

SEQ ID NO: 1997310 - RNA, 21 nt, Homo sapiens
uagaauagccuguggccuuug

SEQ ID NO: 1997311 - RNA, 18 nt, Homo sapiens
gagggauuuuaaaguaaa

SEQ ID NO: 1997312 - RNA, 14 nt, Homo sapiens
ccugaggucaugca

SEQ ID NO: 1997313 - RNA, 12 nt, Homo sapiens
aaaaucugucca

SEQ ID NO: 1997314 - RNA, 14 nt, Homo sapiens
gcacgcccuccuca

SEQ ID NO: 1997315 - RNA, 12 nt, Homo sapiens
aaaaugccuuug

SEQ ID NO: 1997316 - RNA, 15 nt, Homo sapiens
gaaaaagacacagac

SEQ ID NO: 1997317 - RNA, 14 nt, Homo sapiens
gaaaaaugaggaau

SEQ ID NO: 1997318 - RNA, 21 nt, Homo sapiens
cccuucuuugcacuuuugaaa

SEQ ID NO: 1997319 - RNA, 17 nt, Homo sapiens
aggccagagugcugcca

SEQ ID NO: 1997320 - RNA, 19 nt, Homo sapiens
auugcugugaauuagcuca

SEQ ID NO: 1997321 - RNA, 20 nt, Homo sapiens
auccaugcaccuaccuuaga

SEQ ID NO: 1997322 - RNA, 21 nt, Homo sapiens
augugccgauccuugucaaaa

SEQ ID NO: 1997323 - RNA, 18 nt, Homo sapiens
uuaauuagauuuucuugc

SEQ ID NO: 1997324 - RNA, 20 nt, Homo sapiens
ugagccaaagagaaugccau

SEQ ID NO: 1997325 - RNA, 17 nt, Homo sapiens
uaaucccaacacugugg

SEQ ID NO: 1997326 - RNA, 19 nt, Homo sapiens
ccaauggugauccucuauu

SEQ ID NO: 1997327 - RNA, 17 nt, Homo sapiens
uuaaauuguaucuaauc

SEQ ID NO: 1997328 - RNA, 17 nt, Homo sapiens
cacugcagaaacccuga

SEQ ID NO: 1997329 - RNA, 15 nt, Homo sapiens
acuccaucucaaaaa

SEQ ID NO: 1997330 - RNA, 18 nt, Homo sapiens
ucugaguccuuugcuaau

SEQ ID NO: 1997331 - RNA, 20 nt, Homo sapiens
uucaccuuccagugucucgg

SEQ ID NO: 1997332 - RNA, 12 nt, Homo sapiens
uauuacugcugc

SEQ ID NO: 1997333 - RNA, 19 nt, Homo sapiens
cacccagggucccagccug

SEQ ID NO: 1997334 - RNA, 17 nt, Homo sapiens
ucagcgcgguccugacu

SEQ ID NO: 1997335 - RNA, 17 nt, Homo sapiens
auuuuuucuugcauuga

SEQ ID NO: 1997336 - RNA, 17 nt, Homo sapiens
acccagaaauccauuug

SEQ ID NO: 1997337 - RNA, 16 nt, Homo sapiens
ccugaaauaauuugag

SEQ ID NO: 1997338 - RNA, 19 nt, Homo sapiens
ucaucacucaucugccaag

SEQ ID NO: 1997339 - RNA, 17 nt, Homo sapiens
aggccacggaccaaugg

SEQ ID NO: 1997340 - RNA, 16 nt, Homo sapiens
gugaagacuugccuuu

SEQ ID NO: 1997341 - RNA, 13 nt, Homo sapiens
uaacauaacaaca

SEQ ID NO: 1997342 - RNA, 19 nt, Homo sapiens
uugacaguucauauguacc

SEQ ID NO: 1997343 - RNA, 18 nt, Homo sapiens
auugcuagagguggcaug

SEQ ID NO: 1997344 - RNA, 22 nt, Homo sapiens
aacaacaugggagcguuccuaa

SEQ ID NO: 1997345 - RNA, 15 nt, Homo sapiens
gacucugacuuugag

SEQ ID NO: 1997346 - RNA, 16 nt, Homo sapiens
auguguguacaugugc

SEQ ID NO: 1997347 - RNA, 21 nt, Homo sapiens
ucuacacgcuguauuguguau

SEQ ID NO: 1997348 - RNA, 19 nt, Homo sapiens
uaagugcuuuguaauggga

SEQ ID NO: 1997349 - RNA, 15 nt, Homo sapiens
uugcaccucugcuga

SEQ ID NO: 1997350 - RNA, 16 nt, Homo sapiens
uaaccaguauuuuugc

SEQ ID NO: 1997351 - RNA, 18 nt, Homo sapiens
augaacccauccaaugga

SEQ ID NO: 1997352 - RNA, 23 nt, Homo sapiens
uccguguuuguuuaguacuuuua

SEQ ID NO: 1997353 - RNA, 22 nt, Homo sapiens
acuucacgggcaaucaugagca

SEQ ID NO: 1997354 - RNA, 14 nt, Homo sapiens
acuuccccacaggc

SEQ ID NO: 1997355 - RNA, 21 nt, Homo sapiens
gauaaaucaguuaugucaauu

SEQ ID NO: 1997356 - RNA, 16 nt, Homo sapiens
cacccuggaggauuuc

SEQ ID NO: 1997357 - RNA, 14 nt, Homo sapiens
ucuucccuucccug

SEQ ID NO: 1997358 - RNA, 23 nt, Homo sapiens
ggcugugcuagcaacacccaaag

SEQ ID NO: 1997359 - RNA, 21 nt, Homo sapiens
agaaccaagcuucagagccua

SEQ ID NO: 1997360 - RNA, 16 nt, Homo sapiens
cucuacucuuacuucc

SEQ ID NO: 1997361 - RNA, 19 nt, Homo sapiens
acugcagcaugcccagugc

SEQ ID NO: 1997362 - RNA, 16 nt, Homo sapiens
acaaguuucuagcucu

SEQ ID NO: 1997363 - RNA, 17 nt, Homo sapiens
cagugagccgagaucau

SEQ ID NO: 1997364 - RNA, 21 nt, Homo sapiens
cccaagauuauucaauuuaua

SEQ ID NO: 1997365 - RNA, 15 nt, Homo sapiens
augcacacacauaua

SEQ ID NO: 1997366 - RNA, 15 nt, Homo sapiens
ccaucccccugccuc

SEQ ID NO: 1997367 - RNA, 14 nt, Homo sapiens
caagcggcccugug

SEQ ID NO: 1997368 - RNA, 13 nt, Homo sapiens
auguauagcuuua

SEQ ID NO: 1997369 - RNA, 14 nt, Homo sapiens
gauacuucucuuuu

SEQ ID NO: 1997370 - RNA, 22 nt, Homo sapiens
auugaaugaugugauacaaauu

SEQ ID NO: 1997371 - RNA, 19 nt, Homo sapiens
gacagccucuucagccccu

SEQ ID NO: 1997372 - RNA, 20 nt, Homo sapiens
cugcucccacacuugugcca

SEQ ID NO: 1997373 - RNA, 20 nt, Homo sapiens
acagaggccgggguccaggc

SEQ ID NO: 1997374 - RNA, 14 nt, Homo sapiens
agcuggugagauca

SEQ ID NO: 1997375 - RNA, 12 nt, Homo sapiens
ugcaacacccuc

SEQ ID NO: 1997376 - RNA, 12 nt, Homo sapiens
ccucacacugca

SEQ ID NO: 1997377 - RNA, 15 nt, Homo sapiens
guauuaauaucucca

SEQ ID NO: 1997378 - RNA, 15 nt, Homo sapiens
ucaguaaccaugcaa

SEQ ID NO: 1997379 - RNA, 14 nt, Homo sapiens
uccccuggacauau

SEQ ID NO: 1997380 - RNA, 23 nt, Homo sapiens
accaagcguuucccagucuuagc

SEQ ID NO: 1997381 - RNA, 15 nt, Homo sapiens
uuaaauaacagggac

SEQ ID NO: 1997382 - RNA, 15 nt, Homo sapiens
ucuguggcuuaccuu

SEQ ID NO: 1997383 - RNA, 23 nt, Homo sapiens
ucuaaaucaccagagaccaaaca

SEQ ID NO: 1997384 - RNA, 21 nt, Homo sapiens
acaggcgccuaccaccaugcc

SEQ ID NO: 1997385 - RNA, 17 nt, Homo sapiens
guuacagauuaucacau

SEQ ID NO: 1997386 - RNA, 13 nt, Homo sapiens
aaaaucauuaaca

SEQ ID NO: 1997387 - RNA, 22 nt, Homo sapiens
auuggaucaggaacccuuacag

SEQ ID NO: 1997388 - RNA, 17 nt, Homo sapiens
cuaacagcaaauaacag

SEQ ID NO: 1997389 - RNA, 11 nt, Homo sapiens
cuuuaccuucu

SEQ ID NO: 1997390 - RNA, 20 nt, Homo sapiens
auuuauggaaaauacucuga

SEQ ID NO: 1997391 - RNA, 20 nt, Homo sapiens
ugauggccaggccucaggga

SEQ ID NO: 1997392 - RNA, 18 nt, Homo sapiens
cuagucugugccucagug

SEQ ID NO: 1997393 - RNA, 14 nt, Homo sapiens
agggcugagccaug

SEQ ID NO: 1997394 - RNA, 23 nt, Homo sapiens
agugcaguggcgugaucuuggcu

SEQ ID NO: 1997395 - RNA, 19 nt, Homo sapiens
gcaccaucucacugcagua

SEQ ID NO: 1997396 - RNA, 14 nt, Homo sapiens
agaaguacuccuau

SEQ ID NO: 1997397 - RNA, 17 nt, Homo sapiens
gaaacagggcaccccag

SEQ ID NO: 1997398 - RNA, 17 nt, Homo sapiens
gcaguuuccucaucugu

SEQ ID NO: 1997399 - RNA, 18 nt, Homo sapiens
guagcguaacaaacaaaa

SEQ ID NO: 1997400 - RNA, 19 nt, Homo sapiens
uccccaaagcuuuaucugu

SEQ ID NO: 1997401 - RNA, 22 nt, Homo sapiens
ccauuuagaggauguggcugua

SEQ ID NO: 1997402 - RNA, 15 nt, Homo sapiens
accugacugcaauga

SEQ ID NO: 1997403 - RNA, 14 nt, Homo sapiens
uguaaguuuaccua

SEQ ID NO: 1997404 - RNA, 16 nt, Homo sapiens
uguaaccugcugugau

SEQ ID NO: 1997405 - RNA, 19 nt, Homo sapiens
ccaaguuaucaucucacca

SEQ ID NO: 1997406 - RNA, 18 nt, Homo sapiens
ccucgcaucauugcagau

SEQ ID NO: 1997407 - RNA, 11 nt, Homo sapiens
agccacuucau

SEQ ID NO: 1997408 - RNA, 14 nt, Homo sapiens
ugauacaaauguua

SEQ ID NO: 1997409 - RNA, 15 nt, Homo sapiens
cuugcacggcugcuc

SEQ ID NO: 1997410 - RNA, 18 nt, Homo sapiens
ugaaacuggggcuugcaa

SEQ ID NO: 1997411 - RNA, 20 nt, Homo sapiens
uaaacaagucaauucugugu

SEQ ID NO: 1997412 - RNA, 20 nt, Homo sapiens
ugugaauuauucugauucuu

SEQ ID NO: 1997413 - RNA, 15 nt, Homo sapiens
cacuggagugaauga

SEQ ID NO: 1997414 - RNA, 15 nt, Homo sapiens
cacaguggccaaaga

SEQ ID NO: 1997415 - RNA, 15 nt, Homo sapiens
ucaaggaguacaaug

SEQ ID NO: 1997416 - RNA, 14 nt, Homo sapiens
gcaacuggcucaaa

SEQ ID NO: 1997417 - RNA, 11 nt, Homo sapiens
uugaaagaaga

SEQ ID NO: 1997418 - RNA, 16 nt, Homo sapiens
cguagugucaguacua

SEQ ID NO: 1997419 - RNA, 15 nt, Homo sapiens
uccagcgaagggaag

SEQ ID NO: 1997420 - RNA, 13 nt, Homo sapiens
ugcacggcagcuu

SEQ ID NO: 1997421 - RNA, 22 nt, Homo sapiens
agucuuaaaaaaauaugccuuu

SEQ ID NO: 1997422 - RNA, 16 nt, Homo sapiens
gccucaaguuccaugc

SEQ ID NO: 1997423 - RNA, 22 nt, Homo sapiens
ucacaaccucaccaaacuagua

SEQ ID NO: 1997424 - RNA, 13 nt, Homo sapiens
auuaaggucauua

SEQ ID NO: 1997425 - RNA, 15 nt, Homo sapiens
cauugugaggguuaa

SEQ ID NO: 1997426 - RNA, 15 nt, Homo sapiens
cggcgccuccgccca

SEQ ID NO: 1997427 - RNA, 13 nt, Homo sapiens
ugucagugucuua

SEQ ID NO: 1997428 - RNA, 17 nt, Homo sapiens
ggcugaaaagugcuuug

SEQ ID NO: 1997429 - RNA, 21 nt, Homo sapiens
cucagcaccacucaagaccaa

SEQ ID NO: 1997430 - RNA, 18 nt, Homo sapiens
ccagccugggcaacaaag

SEQ ID NO: 1997431 - RNA, 15 nt, Homo sapiens
gggaagggacuggga

SEQ ID NO: 1997432 - RNA, 14 nt, Homo sapiens
agagaaauacuuuc

SEQ ID NO: 1997433 - RNA, 17 nt, Homo sapiens
uauuguuccaagacauu

SEQ ID NO: 1997434 - RNA, 22 nt, Homo sapiens
ucuuguauggcucucaagugaa

SEQ ID NO: 1997435 - RNA, 19 nt, Homo sapiens
uaagcacaaccauguucuu

SEQ ID NO: 1997436 - RNA, 17 nt, Homo sapiens
caacuaccuagacugga

SEQ ID NO: 1997437 - RNA, 19 nt, Homo sapiens
caguccugccucagccucc

SEQ ID NO: 1997438 - RNA, 15 nt, Homo sapiens
agcgccagcucugcc

SEQ ID NO: 1997439 - RNA, 19 nt, Homo sapiens
aaucacuuuugaagcaaua

SEQ ID NO: 1997440 - RNA, 15 nt, Homo sapiens
uugcuuacuggugag

SEQ ID NO: 1997441 - RNA, 21 nt, Homo sapiens
aggucucgucccagcccuccc

SEQ ID NO: 1997442 - RNA, 15 nt, Homo sapiens
agagggacugacacc

SEQ ID NO: 1997443 - RNA, 21 nt, Homo sapiens
cucagcagcugguaaucuugc

SEQ ID NO: 1997444 - RNA, 18 nt, Homo sapiens
ccaucacgugugauugac

SEQ ID NO: 1997445 - RNA, 23 nt, Homo sapiens
gcaaaggaaauugucaucugcca

SEQ ID NO: 1997446 - RNA, 11 nt, Homo sapiens
gacucuuccac

SEQ ID NO: 1997447 - RNA, 22 nt, Homo sapiens
aaaauuagagcaagaacauuca

SEQ ID NO: 1997448 - RNA, 23 nt, Homo sapiens
ggacuaacccaaugccugugaag

SEQ ID NO: 1997449 - RNA, 16 nt, Homo sapiens
ugauauuccauaguau

SEQ ID NO: 1997450 - RNA, 12 nt, Homo sapiens
ggucaaacuccc

SEQ ID NO: 1997451 - RNA, 22 nt, Homo sapiens
uugauaaaaaauuuauuauguc

SEQ ID NO: 1997452 - RNA, 16 nt, Homo sapiens
acuuacuuacccucac

SEQ ID NO: 1997453 - RNA, 23 nt, Homo sapiens
aguuuacaugggccucugaugga

SEQ ID NO: 1997454 - RNA, 13 nt, Homo sapiens
ucucaucccaguc

SEQ ID NO: 1997455 - RNA, 16 nt, Homo sapiens
gcaaaugcauggcaaa

SEQ ID NO: 1997456 - RNA, 20 nt, Homo sapiens
uuuuuucuaaaacuaaauag

SEQ ID NO: 1997457 - RNA, 19 nt, Homo sapiens
aaaucucuuccacaugggu

SEQ ID NO: 1997458 - RNA, 14 nt, Homo sapiens
cuguuggauucaga

SEQ ID NO: 1997459 - RNA, 15 nt, Homo sapiens
ggcuugugugcacau

SEQ ID NO: 1997460 - RNA, 12 nt, Homo sapiens
uuuuuacauaua

SEQ ID NO: 1997461 - RNA, 12 nt, Homo sapiens
uauuuacauuua

SEQ ID NO: 1997462 - RNA, 17 nt, Homo sapiens
cuugugagggacugaga

SEQ ID NO: 1997463 - RNA, 17 nt, Homo sapiens
auguggaaggucaucaa

SEQ ID NO: 1997464 - RNA, 14 nt, Homo sapiens
caaggcacaaguca

SEQ ID NO: 1997465 - RNA, 18 nt, Homo sapiens
uguauuaaagacagaggc

SEQ ID NO: 1997466 - RNA, 16 nt, Homo sapiens
acucuuccaucagaga

SEQ ID NO: 1997467 - RNA, 21 nt, Homo sapiens
agcacaaccacuguagcaaaa

SEQ ID NO: 1997468 - RNA, 15 nt, Homo sapiens
ccaaguaugccuuaa

SEQ ID NO: 1997469 - RNA, 15 nt, Homo sapiens
ccauuugugccagag

SEQ ID NO: 1997470 - RNA, 16 nt, Homo sapiens
auaaauaaucaucccu

SEQ ID NO: 1997471 - RNA, 18 nt, Homo sapiens
gaaacccccaguguaaua

SEQ ID NO: 1997472 - RNA, 14 nt, Homo sapiens
ccuuuuuaauguca

SEQ ID NO: 1997473 - RNA, 18 nt, Homo sapiens
ucuucccuaccucaggca

SEQ ID NO: 1997474 - RNA, 23 nt, Homo sapiens
caaucacaaaggcugacauucac

SEQ ID NO: 1997475 - RNA, 21 nt, Homo sapiens
ggcagcugucucaaaccucca

SEQ ID NO: 1997476 - RNA, 19 nt, Homo sapiens
ccucuaagacuuuguauau

SEQ ID NO: 1997477 - RNA, 15 nt, Homo sapiens
aagaaacaccacuua

SEQ ID NO: 1997478 - RNA, 17 nt, Homo sapiens
ucgggacuucaaaauca

SEQ ID NO: 1997479 - RNA, 13 nt, Homo sapiens
aaaauauugcuuc

SEQ ID NO: 1997480 - RNA, 22 nt, Homo sapiens
uuguucugacuuuuuguuucuu

SEQ ID NO: 1997481 - RNA, 14 nt, Homo sapiens
auuguaccaaagcu

SEQ ID NO: 1997482 - RNA, 20 nt, Homo sapiens
acaggagucugucucugcua

SEQ ID NO: 1997483 - RNA, 17 nt, Homo sapiens
ugaagagcuaauuuacu

SEQ ID NO: 1997484 - RNA, 19 nt, Homo sapiens
uuuaccccaccuuccuggg

SEQ ID NO: 1997485 - RNA, 23 nt, Homo sapiens
aacauuccagccacuggcugcua

SEQ ID NO: 1997486 - RNA, 24 nt, Homo sapiens
uggacagcggcagugggccugcug

SEQ ID NO: 1997487 - RNA, 20 nt, Homo sapiens
gagucuugguuccucuacua

SEQ ID NO: 1997488 - RNA, 16 nt, Homo sapiens
cagaagaacaaagagc

SEQ ID NO: 1997489 - RNA, 20 nt, Homo sapiens
uuuauauauggacagcuuua

SEQ ID NO: 1997490 - RNA, 20 nt, Homo sapiens
auaccuggcccugugccuug

SEQ ID NO: 1997491 - RNA, 15 nt, Homo sapiens
agcaggaagcucaga

SEQ ID NO: 1997492 - RNA, 15 nt, Homo sapiens
auaguauaugcauuu

SEQ ID NO: 1997493 - RNA, 16 nt, Homo sapiens
ucauuucuacuuugac

SEQ ID NO: 1997494 - RNA, 20 nt, Homo sapiens
cagccauucuucaggucgua

SEQ ID NO: 1997495 - RNA, 13 nt, Homo sapiens
uugacuccaagaa

SEQ ID NO: 1997496 - RNA, 18 nt, Homo sapiens
cccagacuuuacaugaca

SEQ ID NO: 1997497 - RNA, 20 nt, Homo sapiens
uacucuuucuaaugcugaua

SEQ ID NO: 1997498 - RNA, 19 nt, Homo sapiens
ccacuagguuucaccuccc

SEQ ID NO: 1997499 - RNA, 13 nt, Homo sapiens
ucauuacauauag

SEQ ID NO: 1997500 - RNA, 18 nt, Homo sapiens
cuccucucucuacuugaa

SEQ ID NO: 1997501 - RNA, 16 nt, Homo sapiens
ugccugugaacugaac

SEQ ID NO: 1997502 - RNA, 19 nt, Homo sapiens
ugcaguagagagcaaagau

SEQ ID NO: 1997503 - RNA, 14 nt, Homo sapiens
guucccaggugaua

SEQ ID NO: 1997504 - RNA, 20 nt, Homo sapiens
aggagccucauccagccuca

SEQ ID NO: 1997505 - RNA, 18 nt, Homo sapiens
gccaaaggucccucccca

SEQ ID NO: 1997506 - RNA, 20 nt, Homo sapiens
ugaacaaagacuacuaauga

SEQ ID NO: 1997507 - RNA, 20 nt, Homo sapiens
gugagcaauccugcaagaac

SEQ ID NO: 1997508 - RNA, 19 nt, Homo sapiens
auaagaaaaccaccccuua

SEQ ID NO: 1997509 - RNA, 17 nt, Homo sapiens
caggugcccauuagcaa

SEQ ID NO: 1997510 - RNA, 13 nt, Homo sapiens
cuucccguucuua

SEQ ID NO: 1997511 - RNA, 20 nt, Homo sapiens
cucauccucuuuuaauggca

SEQ ID NO: 1997512 - RNA, 20 nt, Homo sapiens
gguacacuguuuccauguua

SEQ ID NO: 1997513 - RNA, 13 nt, Homo sapiens
uguucaacaucua

SEQ ID NO: 1997514 - RNA, 22 nt, Homo sapiens
aggcugagcuggcauuggucug

SEQ ID NO: 1997515 - RNA, 16 nt, Homo sapiens
acccagacagcucccu

SEQ ID NO: 1997516 - RNA, 17 nt, Homo sapiens
agucaucaucagggccu

SEQ ID NO: 1997517 - RNA, 14 nt, Homo sapiens
gaacaucacauucc

SEQ ID NO: 1997518 - RNA, 18 nt, Homo sapiens
ugaaauuugagagacaaa

SEQ ID NO: 1997519 - RNA, 14 nt, Homo sapiens
cgucgucaccaaau

SEQ ID NO: 1997520 - RNA, 22 nt, Homo sapiens
auauucuuuaaacaaauaugaa

SEQ ID NO: 1997521 - RNA, 16 nt, Homo sapiens
uuccuuugaacuuuga

SEQ ID NO: 1997522 - RNA, 14 nt, Homo sapiens
aggcuggaugcugg

SEQ ID NO: 1997523 - RNA, 17 nt, Homo sapiens
aacagcucuguugaauc

SEQ ID NO: 1997524 - RNA, 22 nt, Homo sapiens
ugcaaauaggcagaauggaauc

SEQ ID NO: 1997525 - RNA, 17 nt, Homo sapiens
cuccacuuucuagccag

SEQ ID NO: 1997526 - RNA, 12 nt, Homo sapiens
cccugugcucca

SEQ ID NO: 1997527 - RNA, 14 nt, Homo sapiens
ccuuuuuugccaga

SEQ ID NO: 1997528 - RNA, 15 nt, Homo sapiens
uaaaagcuguucuca

SEQ ID NO: 1997529 - RNA, 20 nt, Homo sapiens
ucagcauguuuccagcacua

SEQ ID NO: 1997530 - RNA, 13 nt, Homo sapiens
agccucucuucac

SEQ ID NO: 1997531 - RNA, 17 nt, Homo sapiens
ucucacugaugcccuuu

SEQ ID NO: 1997532 - RNA, 16 nt, Homo sapiens
ucaacugccucucuuu

SEQ ID NO: 1997533 - RNA, 18 nt, Homo sapiens
cacauguuacugcuucau

SEQ ID NO: 1997534 - RNA, 22 nt, Homo sapiens
ucugugaaauucucagaguguu

SEQ ID NO: 1997535 - RNA, 12 nt, Homo sapiens
gcuucuucuuca

SEQ ID NO: 1997536 - RNA, 17 nt, Homo sapiens
cgggaagaaggggacaa

SEQ ID NO: 1997537 - RNA, 16 nt, Homo sapiens
cauaauguuacauuau

SEQ ID NO: 1997538 - RNA, 23 nt, Homo sapiens
ggugcagguugggaaugaggcuu

SEQ ID NO: 1997539 - RNA, 21 nt, Homo sapiens
accugggguuuugacuugcca

SEQ ID NO: 1997540 - RNA, 16 nt, Homo sapiens
uucuagauuaccauga

SEQ ID NO: 1997541 - RNA, 23 nt, Homo sapiens
aaccucccccgacgcucucucuc

SEQ ID NO: 1997542 - RNA, 18 nt, Homo sapiens
gacaccccugcucuaccc

SEQ ID NO: 1997543 - RNA, 22 nt, Homo sapiens
aagcauguggaugacacaaucc

SEQ ID NO: 1997544 - RNA, 19 nt, Homo sapiens
caaccuccccugguccugc

SEQ ID NO: 1997545 - RNA, 23 nt, Homo sapiens
cuucccauuguggcuccuaucug

SEQ ID NO: 1997546 - RNA, 18 nt, Homo sapiens
gcucuacccugcagcuug

SEQ ID NO: 1997547 - RNA, 15 nt, Homo sapiens
uacaccacugcacuu

SEQ ID NO: 1997548 - RNA, 17 nt, Homo sapiens
cuucugagcgagcacac

SEQ ID NO: 1997549 - RNA, 23 nt, Homo sapiens
uagagaagaucuaauaccauccu

SEQ ID NO: 1997550 - RNA, 21 nt, Homo sapiens
agaauucaaguggguauucug

SEQ ID NO: 1997551 - RNA, 18 nt, Homo sapiens
caaaucuacugucaauuu

SEQ ID NO: 1997552 - RNA, 23 nt, Homo sapiens
cuucugagcacagcugcauuaaa

SEQ ID NO: 1997553 - RNA, 19 nt, Homo sapiens
caugacauucuuagcugua

SEQ ID NO: 1997554 - RNA, 19 nt, Homo sapiens
ggggaugacaugcacucag

SEQ ID NO: 1997555 - RNA, 19 nt, Homo sapiens
gccucugucaggccuucag

SEQ ID NO: 1997556 - RNA, 17 nt, Homo sapiens
acuguuucauucacugu

SEQ ID NO: 1997557 - RNA, 21 nt, Homo sapiens
augcuccagcaacacagccug

SEQ ID NO: 1997558 - RNA, 18 nt, Homo sapiens
acuauggcccugggagag

SEQ ID NO: 1997559 - RNA, 23 nt, Homo sapiens
ucuuucuccucuuugagacccca

SEQ ID NO: 1997560 - RNA, 20 nt, Homo sapiens
uauugugaaucgauucccaa

SEQ ID NO: 1997561 - RNA, 15 nt, Homo sapiens
cuaauuccacacccu

SEQ ID NO: 1997562 - RNA, 14 nt, Homo sapiens
uguuauuugcacac

SEQ ID NO: 1997563 - RNA, 16 nt, Homo sapiens
uuguugcaggcugugg

SEQ ID NO: 1997564 - RNA, 14 nt, Homo sapiens
gcccucaguuuuca

SEQ ID NO: 1997565 - RNA, 17 nt, Homo sapiens
gaaaaccugaggccaaa

SEQ ID NO: 1997566 - RNA, 16 nt, Homo sapiens
ugcagcugagauucca

SEQ ID NO: 1997567 - RNA, 18 nt, Homo sapiens
acacuuuuccacauucca

SEQ ID NO: 1997568 - RNA, 18 nt, Homo sapiens
acuuuuguuauuaugcuc

SEQ ID NO: 1997569 - RNA, 18 nt, Homo sapiens
aaucauauaaucuuacaa

SEQ ID NO: 1997570 - RNA, 21 nt, Homo sapiens
aggauauugggucagugucca

SEQ ID NO: 1997571 - RNA, 20 nt, Homo sapiens
ccuccuagcuggagugccau

SEQ ID NO: 1997572 - RNA, 22 nt, Homo sapiens
agcaacugaauaaauaccucuu

SEQ ID NO: 1997573 - RNA, 17 nt, Homo sapiens
cucagguguugccaaau

SEQ ID NO: 1997574 - RNA, 20 nt, Homo sapiens
aagucaaagcuuugcccuuu

SEQ ID NO: 1997575 - RNA, 16 nt, Homo sapiens
gcaggauuuguuguuc

SEQ ID NO: 1997576 - RNA, 23 nt, Homo sapiens
cugggacaguuuaucaugaagcc

SEQ ID NO: 1997577 - RNA, 14 nt, Homo sapiens
uucugauugucuua

SEQ ID NO: 1997578 - RNA, 16 nt, Homo sapiens
ugcaaaucagccaugu

SEQ ID NO: 1997579 - RNA, 13 nt, Homo sapiens
cacaagcacaaag

SEQ ID NO: 1997580 - RNA, 13 nt, Homo sapiens
uaaugcaccugaa

SEQ ID NO: 1997581 - RNA, 20 nt, Homo sapiens
gcaucuuccccaacgaaaag

SEQ ID NO: 1997582 - RNA, 23 nt, Homo sapiens
caaguucaaagaacccuagcaca

SEQ ID NO: 1997583 - RNA, 20 nt, Homo sapiens
ucuguguaccacugggauag

SEQ ID NO: 1997584 - RNA, 13 nt, Homo sapiens
gacccagccugaa

SEQ ID NO: 1997585 - RNA, 16 nt, Homo sapiens
uuagcuacaaaugccu

SEQ ID NO: 1997586 - RNA, 16 nt, Homo sapiens
aaacuucuuucacuca

SEQ ID NO: 1997587 - RNA, 11 nt, Homo sapiens
uucuguaaaac

SEQ ID NO: 1997588 - RNA, 14 nt, Homo sapiens
uucuucacugguga

SEQ ID NO: 1997589 - RNA, 17 nt, Homo sapiens
cuggucaauaaaccacu

SEQ ID NO: 1997590 - RNA, 22 nt, Homo sapiens
caauugucaccgguuaacugug

SEQ ID NO: 1997591 - RNA, 15 nt, Homo sapiens
uaugguagcuuuuac

SEQ ID NO: 1997592 - RNA, 15 nt, Homo sapiens
auuguacugcacaaa

SEQ ID NO: 1997593 - RNA, 23 nt, Homo sapiens
ccaccagaugcugaaaauguccu

SEQ ID NO: 1997594 - RNA, 23 nt, Homo sapiens
uuggagucccaggggcagccaca

SEQ ID NO: 1997595 - RNA, 12 nt, Homo sapiens
augauacaaaga

SEQ ID NO: 1997596 - RNA, 14 nt, Homo sapiens
cuggaaaacugcca

SEQ ID NO: 1997597 - RNA, 15 nt, Homo sapiens
uguauugucugccca

SEQ ID NO: 1997598 - RNA, 19 nt, Homo sapiens
aacuucaucacacacugag

SEQ ID NO: 1997599 - RNA, 15 nt, Homo sapiens
aggcucuccaggugg

SEQ ID NO: 1997600 - RNA, 17 nt, Homo sapiens
cuugaugugccugugaa

SEQ ID NO: 1997601 - RNA, 18 nt, Homo sapiens
uggugauuccgcagugag

SEQ ID NO: 1997602 - RNA, 14 nt, Homo sapiens
caguugggacucag

SEQ ID NO: 1997603 - RNA, 15 nt, Homo sapiens
guuggacagacacug

SEQ ID NO: 1997604 - RNA, 22 nt, Homo sapiens
ccaaguuauacacgggacaguu

SEQ ID NO: 1997605 - RNA, 15 nt, Homo sapiens
agcuuuuuugccaca

SEQ ID NO: 1997606 - RNA, 13 nt, Homo sapiens
augccuguugauc

SEQ ID NO: 1997607 - RNA, 13 nt, Homo sapiens
ccugugugucugc

SEQ ID NO: 1997608 - RNA, 14 nt, Homo sapiens
ggucauacaugcau

SEQ ID NO: 1997609 - RNA, 18 nt, Homo sapiens
gaaaacacuaguaccuuc

SEQ ID NO: 1997610 - RNA, 13 nt, Homo sapiens
aaagugcauucaa

SEQ ID NO: 1997611 - RNA, 12 nt, Homo sapiens
gucgcaucucag

SEQ ID NO: 1997612 - RNA, 12 nt, Homo sapiens
gucccaucucac

SEQ ID NO: 1997613 - RNA, 19 nt, Homo sapiens
uccaggaacacaugcacac

SEQ ID NO: 1997614 - RNA, 14 nt, Homo sapiens
cccauuuguucaua

SEQ ID NO: 1997615 - RNA, 19 nt, Homo sapiens
ccuauauguaguauaaaga

SEQ ID NO: 1997616 - RNA, 15 nt, Homo sapiens
uagguccaccugcua

SEQ ID NO: 1997617 - RNA, 16 nt, Homo sapiens
acgaggauuucccuga

SEQ ID NO: 1997618 - RNA, 17 nt, Homo sapiens
ugugaacaagucccugu

SEQ ID NO: 1997619 - RNA, 17 nt, Homo sapiens
ccuccaugccugaccaa

SEQ ID NO: 1997620 - RNA, 22 nt, Homo sapiens
uuauauaauaaaguauuccacc

SEQ ID NO: 1997621 - RNA, 17 nt, Homo sapiens
cugccacauacaccaca

SEQ ID NO: 1997622 - RNA, 18 nt, Homo sapiens
ucacuugcuggcugugaa

SEQ ID NO: 1997623 - RNA, 22 nt, Homo sapiens
acacgccuaaggucacagcuag

SEQ ID NO: 1997624 - RNA, 17 nt, Homo sapiens
uuuaagugggcuccuga

SEQ ID NO: 1997625 - RNA, 17 nt, Homo sapiens
ucaagagcacacagaga

SEQ ID NO: 1997626 - RNA, 15 nt, Homo sapiens
cucuccaguguuucu

SEQ ID NO: 1997627 - RNA, 14 nt, Homo sapiens
aagucccaucucac

SEQ ID NO: 1997628 - RNA, 18 nt, Homo sapiens
cucagcagcaaaugccac

SEQ ID NO: 1997629 - RNA, 21 nt, Homo sapiens
uagaauugaauuuacauauag

SEQ ID NO: 1997630 - RNA, 21 nt, Homo sapiens
cuauuauuuacuccuuaccaa

SEQ ID NO: 1997631 - RNA, 20 nt, Homo sapiens
auuguuauacacagcuuuau

SEQ ID NO: 1997632 - RNA, 11 nt, Homo sapiens
caaccuuucau

SEQ ID NO: 1997633 - RNA, 17 nt, Homo sapiens
ccgaggcccucaaucca

SEQ ID NO: 1997634 - RNA, 22 nt, Homo sapiens
cccacaagaacucccuucuccc

SEQ ID NO: 1997635 - RNA, 19 nt, Homo sapiens
aaggagacaaaacuagaga

SEQ ID NO: 1997636 - RNA, 15 nt, Homo sapiens
uguaaacugugcacc

SEQ ID NO: 1997637 - RNA, 22 nt, Homo sapiens
auugguuuuccaaucauuugac

SEQ ID NO: 1997638 - RNA, 21 nt, Homo sapiens
acaccagccgaggccacagaa

SEQ ID NO: 1997639 - RNA, 12 nt, Homo sapiens
ugaaacacugga

SEQ ID NO: 1997640 - RNA, 15 nt, Homo sapiens
auggcacugacaaug

SEQ ID NO: 1997641 - RNA, 16 nt, Homo sapiens
agugauguacgagcug

SEQ ID NO: 1997642 - RNA, 22 nt, Homo sapiens
ugcaaaaugcccagggauuuaa

SEQ ID NO: 1997643 - RNA, 15 nt, Homo sapiens
aaucugaguuuuaca

SEQ ID NO: 1997644 - RNA, 17 nt, Homo sapiens
caagggacaaguauuaa

SEQ ID NO: 1997645 - RNA, 20 nt, Homo sapiens
gauaucgccacugcacucca

SEQ ID NO: 1997646 - RNA, 21 nt, Homo sapiens
gucagaaaaaggaaaccacag

SEQ ID NO: 1997647 - RNA, 16 nt, Homo sapiens
uaaggcuuuuucuucc

SEQ ID NO: 1997648 - RNA, 16 nt, Homo sapiens
ggacacuguccaugaa

SEQ ID NO: 1997649 - RNA, 17 nt, Homo sapiens
auugcuuaaaagacauu

SEQ ID NO: 1997650 - RNA, 19 nt, Homo sapiens
ugcaguagugcaccaucuc

SEQ ID NO: 1997651 - RNA, 14 nt, Homo sapiens
uuccaucugcaucu

SEQ ID NO: 1997652 - RNA, 22 nt, Homo sapiens
uuuguauauaggcuucucacgg

SEQ ID NO: 1997653 - RNA, 13 nt, Homo sapiens
uacauccaaagca

SEQ ID NO: 1997654 - RNA, 13 nt, Homo sapiens
uucauccaaugca

SEQ ID NO: 1997655 - RNA, 15 nt, Homo sapiens
acacugucuugaaga

SEQ ID NO: 1997656 - RNA, 23 nt, Homo sapiens
gcaaaaaaaaacuuaaagcaaaa

SEQ ID NO: 1997657 - RNA, 17 nt, Homo sapiens
acacuuucaaagagaaa

SEQ ID NO: 1997658 - RNA, 22 nt, Homo sapiens
cuuccucggcagucacuuccac

SEQ ID NO: 1997659 - RNA, 21 nt, Homo sapiens
acucuuccgaaaaauccucuu

SEQ ID NO: 1997660 - RNA, 20 nt, Homo sapiens
ugcuccaguaaaaucuugcc

SEQ ID NO: 1997661 - RNA, 22 nt, Homo sapiens
uauuaaauguaacuuauuuaau

SEQ ID NO: 1997662 - RNA, 17 nt, Homo sapiens
uuuuaauauugauguca

SEQ ID NO: 1997663 - RNA, 19 nt, Homo sapiens
uuguucugcccuccagaga

SEQ ID NO: 1997664 - RNA, 19 nt, Homo sapiens
ucagcccuagcccucagcc

SEQ ID NO: 1997665 - RNA, 20 nt, Homo sapiens
ugcuggcaguggaacuaaga

SEQ ID NO: 1997666 - RNA, 15 nt, Homo sapiens
cuguauaccccguga

SEQ ID NO: 1997667 - RNA, 20 nt, Homo sapiens
aggccagcccggaccucugg

SEQ ID NO: 1997668 - RNA, 19 nt, Homo sapiens
cuccagaccagaccccaaa

SEQ ID NO: 1997669 - RNA, 15 nt, Homo sapiens
cuccaguuuccccau

SEQ ID NO: 1997670 - RNA, 21 nt, Homo sapiens
cagcaguguccccugccccag

SEQ ID NO: 1997671 - RNA, 15 nt, Homo sapiens
acaaacuucaaagag

SEQ ID NO: 1997672 - RNA, 18 nt, Homo sapiens
uaacacaagccacagaag

SEQ ID NO: 1997673 - RNA, 13 nt, Homo sapiens
ggaugccacccag

SEQ ID NO: 1997674 - RNA, 16 nt, Homo sapiens
uaacucuaacugaugu

SEQ ID NO: 1997675 - RNA, 22 nt, Homo sapiens
cuggcggagggaugcagguggg

SEQ ID NO: 1997676 - RNA, 15 nt, Homo sapiens
ucauucaucacucca

SEQ ID NO: 1997677 - RNA, 14 nt, Homo sapiens
agugacccugcucu

SEQ ID NO: 1997678 - RNA, 18 nt, Homo sapiens
accagcccagcccgucuc

SEQ ID NO: 1997679 - RNA, 15 nt, Homo sapiens
agguggccucugccu

SEQ ID NO: 1997680 - RNA, 16 nt, Homo sapiens
gccucccgaaugaagc

SEQ ID NO: 1997681 - RNA, 20 nt, Homo sapiens
gauuagguguucaggccagu

SEQ ID NO: 1997682 - RNA, 14 nt, Homo sapiens
caagucaaauacca

SEQ ID NO: 1997683 - RNA, 22 nt, Homo sapiens
aggacaauucacuucauugacc

SEQ ID NO: 1997684 - RNA, 20 nt, Homo sapiens
ggaagauacugacuagucau

SEQ ID NO: 1997685 - RNA, 20 nt, Homo sapiens
agacauacagcugccuaccu

SEQ ID NO: 1997686 - RNA, 17 nt, Homo sapiens
cuuuucuuucuacagac

SEQ ID NO: 1997687 - RNA, 22 nt, Homo sapiens
acaaagcggcucuaaaccucag

SEQ ID NO: 1997688 - RNA, 22 nt, Homo sapiens
acuccagccugggugacagagc

SEQ ID NO: 1997689 - RNA, 20 nt, Homo sapiens
agucuggcuaggggccgagu

SEQ ID NO: 1997690 - RNA, 14 nt, Homo sapiens
agaugaacauuuca

SEQ ID NO: 1997691 - RNA, 17 nt, Homo sapiens
cagaaccagucuuucaa

SEQ ID NO: 1997692 - RNA, 23 nt, Homo sapiens
cuuuuuaauuggcccuguacagu

SEQ ID NO: 1997693 - RNA, 20 nt, Homo sapiens
gccucggccucccaaagugu

SEQ ID NO: 1997694 - RNA, 23 nt, Homo sapiens
gagauauguugaauuaacauaau

SEQ ID NO: 1997695 - RNA, 15 nt, Homo sapiens
caaaaaguagacuug

SEQ ID NO: 1997696 - RNA, 23 nt, Homo sapiens
uuguggcccagauaaggcuuuag

SEQ ID NO: 1997697 - RNA, 15 nt, Homo sapiens
acuacaaauggauga

SEQ ID NO: 1997698 - RNA, 23 nt, Homo sapiens
acuuaauguuuguaagacuuaca

SEQ ID NO: 1997699 - RNA, 20 nt, Homo sapiens
caccuuggcuuguuauugcc

SEQ ID NO: 1997700 - RNA, 17 nt, Homo sapiens
cccagccugguuugcaa

SEQ ID NO: 1997701 - RNA, 11 nt, Homo sapiens
aagcacugugc

SEQ ID NO: 1997702 - RNA, 11 nt, Homo sapiens
aaccacugugg

SEQ ID NO: 1997703 - RNA, 21 nt, Homo sapiens
acuauaagcagaagcacauau

SEQ ID NO: 1997704 - RNA, 17 nt, Homo sapiens
acgggcaaucaugagca

SEQ ID NO: 1997705 - RNA, 22 nt, Homo sapiens
cacaucaagcgaugaaacugga

SEQ ID NO: 1997706 - RNA, 18 nt, Homo sapiens
auuuaaaauaccacugua

SEQ ID NO: 1997707 - RNA, 17 nt, Homo sapiens
auaaccauaugauacua

SEQ ID NO: 1997708 - RNA, 23 nt, Homo sapiens
aaaaugagcccuguccugccuaa

SEQ ID NO: 1997709 - RNA, 22 nt, Homo sapiens
uuuuauacugcacaguggcaca

SEQ ID NO: 1997710 - RNA, 22 nt, Homo sapiens
accagggccgaggaggugccug

SEQ ID NO: 1997711 - RNA, 21 nt, Homo sapiens
auuuccacuauuuucaaagaa

SEQ ID NO: 1997712 - RNA, 20 nt, Homo sapiens
agccguuacuacacacaaag

SEQ ID NO: 1997713 - RNA, 17 nt, Homo sapiens
aacacauggcuuccuaa

SEQ ID NO: 1997714 - RNA, 16 nt, Homo sapiens
gcagcgaaaacugcca

SEQ ID NO: 1997715 - RNA, 14 nt, Homo sapiens
caagggaugucuca

SEQ ID NO: 1997716 - RNA, 18 nt, Homo sapiens
aaugucacaguaaugcaa

SEQ ID NO: 1997717 - RNA, 19 nt, Homo sapiens
uaaacaucuccccucucac

SEQ ID NO: 1997718 - RNA, 12 nt, Homo sapiens
aauauguuacaa

SEQ ID NO: 1997719 - RNA, 17 nt, Homo sapiens
auuuuuccugcauguuc

SEQ ID NO: 1997720 - RNA, 12 nt, Homo sapiens
auaaauggauau

SEQ ID NO: 1997721 - RNA, 16 nt, Homo sapiens
ugggcaauauagcaag

SEQ ID NO: 1997722 - RNA, 23 nt, Homo sapiens
agagcaccuuugcacaggaugcu

SEQ ID NO: 1997723 - RNA, 20 nt, Homo sapiens
aauaagaagggggagugaaa

SEQ ID NO: 1997724 - RNA, 14 nt, Homo sapiens
ugacacaauuggaa

SEQ ID NO: 1997725 - RNA, 23 nt, Homo sapiens
ccacugcugcccugggcagugag

SEQ ID NO: 1997726 - RNA, 12 nt, Homo sapiens
aaaacaauuuca

SEQ ID NO: 1997727 - RNA, 14 nt, Homo sapiens
auugcuuuacuguc

SEQ ID NO: 1997728 - RNA, 13 nt, Homo sapiens
ucuuuaccugggg

SEQ ID NO: 1997729 - RNA, 16 nt, Homo sapiens
aauauguguaucucaa

SEQ ID NO: 1997730 - RNA, 13 nt, Homo sapiens
uuggucacugcua

SEQ ID NO: 1997731 - RNA, 18 nt, Homo sapiens
cucagagaccagcacuca

SEQ ID NO: 1997732 - RNA, 18 nt, Homo sapiens
uacauugcuggucuugua

SEQ ID NO: 1997733 - RNA, 22 nt, Homo sapiens
aauuggggcacuuaauggucac

SEQ ID NO: 1997734 - RNA, 24 nt, Homo sapiens
accucacuuuuaauuagugaugca

SEQ ID NO: 1997735 - RNA, 23 nt, Homo sapiens
aaauagcaucugcucuucucuua

SEQ ID NO: 1997736 - RNA, 21 nt, Homo sapiens
caaucagaugacaacaaagau

SEQ ID NO: 1997737 - RNA, 17 nt, Homo sapiens
ucucaucucuguauucc

SEQ ID NO: 1997738 - RNA, 17 nt, Homo sapiens
augagcugacaucucag

SEQ ID NO: 1997739 - RNA, 20 nt, Homo sapiens
gauggcgccaccgcacucca

SEQ ID NO: 1997740 - RNA, 19 nt, Homo sapiens
cucaccaucggcaggcagu

SEQ ID NO: 1997741 - RNA, 20 nt, Homo sapiens
gaaaugccuuuguacuuuag

SEQ ID NO: 1997742 - RNA, 18 nt, Homo sapiens
uagaggggcaacugauga

SEQ ID NO: 1997743 - RNA, 13 nt, Homo sapiens
ccgcuugccauau

SEQ ID NO: 1997744 - RNA, 22 nt, Homo sapiens
cagaauauucuuuuuauauucu

SEQ ID NO: 1997745 - RNA, 18 nt, Homo sapiens
agaugucuuggaacauug

SEQ ID NO: 1997746 - RNA, 20 nt, Homo sapiens
ggauuaaaagccucauccac

SEQ ID NO: 1997747 - RNA, 14 nt, Homo sapiens
uaaauuacagucau

SEQ ID NO: 1997748 - RNA, 19 nt, Homo sapiens
acuggagguugaagccaag

SEQ ID NO: 1997749 - RNA, 21 nt, Homo sapiens
uuaaggaaacucuuaucucag

SEQ ID NO: 1997750 - RNA, 14 nt, Homo sapiens
uguaaacuaguacu

SEQ ID NO: 1997751 - RNA, 14 nt, Homo sapiens
uucugugucauuaa

SEQ ID NO: 1997752 - RNA, 16 nt, Homo sapiens
cugcaacuguauuuca

SEQ ID NO: 1997753 - RNA, 19 nt, Homo sapiens
auaacuuuauugcauauag

SEQ ID NO: 1997754 - RNA, 14 nt, Homo sapiens
agaacuuuccagga

SEQ ID NO: 1997755 - RNA, 17 nt, Homo sapiens
ucuacugagacaugacu

SEQ ID NO: 1997756 - RNA, 12 nt, Homo sapiens
ggauuccauuua

SEQ ID NO: 1997757 - RNA, 20 nt, Homo sapiens
uguuguguauagaugcaaga

SEQ ID NO: 1997758 - RNA, 15 nt, Homo sapiens
cucuguucauuuccu

SEQ ID NO: 1997759 - RNA, 22 nt, Homo sapiens
uggcaaaagccacauuacaagc

SEQ ID NO: 1997760 - RNA, 21 nt, Homo sapiens
auaaucuuuggguaacuucaa

SEQ ID NO: 1997761 - RNA, 17 nt, Homo sapiens
ccaacaugguccuagca

SEQ ID NO: 1997762 - RNA, 18 nt, Homo sapiens
auuuguuuuaugcuacug

SEQ ID NO: 1997763 - RNA, 17 nt, Homo sapiens
caguagucaccucuggg

SEQ ID NO: 1997764 - RNA, 18 nt, Homo sapiens
gcuucaaguggggagaag

SEQ ID NO: 1997765 - RNA, 14 nt, Homo sapiens
aggaguuacuggau

SEQ ID NO: 1997766 - RNA, 19 nt, Homo sapiens
cagaaauacauauuuccaa

SEQ ID NO: 1997767 - RNA, 20 nt, Homo sapiens
uacagguuuuaaaagccuug

SEQ ID NO: 1997768 - RNA, 17 nt, Homo sapiens
cagaggaaugaugggcu

SEQ ID NO: 1997769 - RNA, 13 nt, Homo sapiens
agaagucuugucu

SEQ ID NO: 1997770 - RNA, 13 nt, Homo sapiens
acaauucuucucg

SEQ ID NO: 1997771 - RNA, 12 nt, Homo sapiens
guaugugcauua

SEQ ID NO: 1997772 - RNA, 17 nt, Homo sapiens
uguaaucucagcacuuu

SEQ ID NO: 1997773 - RNA, 21 nt, Homo sapiens
aucaucugucauuauauucua

SEQ ID NO: 1997774 - RNA, 17 nt, Homo sapiens
cguguuuggagcucuau

SEQ ID NO: 1997775 - RNA, 17 nt, Homo sapiens
auuaagcaaauguuaaa

SEQ ID NO: 1997776 - RNA, 11 nt, Homo sapiens
ucauaaccaaa

SEQ ID NO: 1997777 - RNA, 14 nt, Homo sapiens
ccccugcacaguug

SEQ ID NO: 1997778 - RNA, 14 nt, Homo sapiens
gagcaacagccuaa

SEQ ID NO: 1997779 - RNA, 14 nt, Homo sapiens
gcgccccagacucc

SEQ ID NO: 1997780 - RNA, 12 nt, Homo sapiens
gcaaccucugua

SEQ ID NO: 1997781 - RNA, 23 nt, Homo sapiens
aaagcaggccuuugcagauauga

SEQ ID NO: 1997782 - RNA, 15 nt, Homo sapiens
ucagggcggaacucu

SEQ ID NO: 1997783 - RNA, 21 nt, Homo sapiens
aucaaaccaggugcaauuauu

SEQ ID NO: 1997784 - RNA, 16 nt, Homo sapiens
guuaggugugccaaac

SEQ ID NO: 1997785 - RNA, 19 nt, Homo sapiens
guucuuauugaaaacaaca

SEQ ID NO: 1997786 - RNA, 23 nt, Homo sapiens
ugcuaugguuuucuccaagagcu

SEQ ID NO: 1997787 - RNA, 15 nt, Homo sapiens
agcacaaaguuuacu

SEQ ID NO: 1997788 - RNA, 21 nt, Homo sapiens
gccugaaguuugugggggcca

SEQ ID NO: 1997789 - RNA, 20 nt, Homo sapiens
accuuugcacgaacaccaag

SEQ ID NO: 1997790 - RNA, 17 nt, Homo sapiens
ccugcaccacucucuuc

SEQ ID NO: 1997791 - RNA, 17 nt, Homo sapiens
uuaaugacaaggugaua

SEQ ID NO: 1997792 - RNA, 14 nt, Homo sapiens
ucagaaaagacacu

SEQ ID NO: 1997793 - RNA, 21 nt, Homo sapiens
cucuuaauaagcccacauaua

SEQ ID NO: 1997794 - RNA, 18 nt, Homo sapiens
gauuccauuuuacuucca

SEQ ID NO: 1997795 - RNA, 22 nt, Homo sapiens
aacacuuuacaauguucauccc

SEQ ID NO: 1997796 - RNA, 19 nt, Homo sapiens
gggugagacuccaucucaa

SEQ ID NO: 1997797 - RNA, 14 nt, Homo sapiens
aaaaauaugugaau

SEQ ID NO: 1997798 - RNA, 14 nt, Homo sapiens
ucagacucaucuac

SEQ ID NO: 1997799 - RNA, 21 nt, Homo sapiens
aaccuuccauaaaaaaacaau

SEQ ID NO: 1997800 - RNA, 15 nt, Homo sapiens
cagagugaauuucag

SEQ ID NO: 1997801 - RNA, 16 nt, Homo sapiens
acaaaugccacacauc

SEQ ID NO: 1997802 - RNA, 16 nt, Homo sapiens
auuuuuaaaaugucaa

SEQ ID NO: 1997803 - RNA, 13 nt, Homo sapiens
uggccugcuggau

SEQ ID NO: 1997804 - RNA, 16 nt, Homo sapiens
uggacacgcugcgcaa

SEQ ID NO: 1997805 - RNA, 12 nt, Homo sapiens
uuggcuuucaua

SEQ ID NO: 1997806 - RNA, 15 nt, Homo sapiens
cugggcagcuacaag

SEQ ID NO: 1997807 - RNA, 23 nt, Homo sapiens
aaaguaaggugcuuggaguuuac

SEQ ID NO: 1997808 - RNA, 15 nt, Homo sapiens
cagucuggagaaggu

SEQ ID NO: 1997809 - RNA, 22 nt, Homo sapiens
ccuggccaugcugucccugcac

SEQ ID NO: 1997810 - RNA, 18 nt, Homo sapiens
acuuuaucuaauaccucu

SEQ ID NO: 1997811 - RNA, 14 nt, Homo sapiens
uauugaacuguaaa

SEQ ID NO: 1997812 - RNA, 16 nt, Homo sapiens
gguagcuagaugccac

SEQ ID NO: 1997813 - RNA, 22 nt, Homo sapiens
ccaaagccaauaacacacagcu

SEQ ID NO: 1997814 - RNA, 15 nt, Homo sapiens
cucuaucaugcaaaa

SEQ ID NO: 1997815 - RNA, 19 nt, Homo sapiens
ucacaccacugcacucuag

SEQ ID NO: 1997816 - RNA, 19 nt, Homo sapiens
auguacucaaguaccacca

SEQ ID NO: 1997817 - RNA, 18 nt, Homo sapiens
ggauaucaaaggacaaag

SEQ ID NO: 1997818 - RNA, 20 nt, Homo sapiens
gggaaaaagaaugaugcuau

SEQ ID NO: 1997819 - RNA, 13 nt, Homo sapiens
uuggccucuugua

SEQ ID NO: 1997820 - RNA, 17 nt, Homo sapiens
ugcaguguggaguucac

SEQ ID NO: 1997821 - RNA, 16 nt, Homo sapiens
ucaguuuccccauuug

SEQ ID NO: 1997822 - RNA, 22 nt, Homo sapiens
uaagauacuggacuccucuucc

SEQ ID NO: 1997823 - RNA, 21 nt, Homo sapiens
aguccagaaccccugucacac

SEQ ID NO: 1997824 - RNA, 14 nt, Homo sapiens
aaagaugaaagcug

SEQ ID NO: 1997825 - RNA, 15 nt, Homo sapiens
acucauuuaaauuaa

SEQ ID NO: 1997826 - RNA, 10 nt, Homo sapiens
uuugccuucc

SEQ ID NO: 1997827 - RNA, 13 nt, Homo sapiens
cacuggucuguag

SEQ ID NO: 1997828 - RNA, 13 nt, Homo sapiens
cauaugucugcuu

SEQ ID NO: 1997829 - RNA, 13 nt, Homo sapiens
gccgacaaugccc

SEQ ID NO: 1997830 - RNA, 22 nt, Homo sapiens
agaaaaguagaaaggagguuag

SEQ ID NO: 1997831 - RNA, 22 nt, Homo sapiens
ucaucagcugugugcauuucag

SEQ ID NO: 1997832 - RNA, 14 nt, Homo sapiens
agucccccaaaggg

SEQ ID NO: 1997833 - RNA, 14 nt, Homo sapiens
acccauuugccagg

SEQ ID NO: 1997834 - RNA, 15 nt, Homo sapiens
cuccauguugcuuca

SEQ ID NO: 1997835 - RNA, 11 nt, Homo sapiens
accccaucuca

SEQ ID NO: 1997836 - RNA, 11 nt, Homo sapiens
acaccaucucc

SEQ ID NO: 1997837 - RNA, 19 nt, Homo sapiens
gcuuauggcaucucauuga

SEQ ID NO: 1997838 - RNA, 12 nt, Homo sapiens
acagaacaaagu

SEQ ID NO: 1997839 - RNA, 16 nt, Homo sapiens
caucaguuauaucuug

SEQ ID NO: 1997840 - RNA, 22 nt, Homo sapiens
ggcaccggcugcccacagggaa

SEQ ID NO: 1997841 - RNA, 17 nt, Homo sapiens
uggugacaccagccuuu

SEQ ID NO: 1997842 - RNA, 21 nt, Homo sapiens
acuaaaccauugugcauucua

SEQ ID NO: 1997843 - RNA, 19 nt, Homo sapiens
acaguaguuuauuugaacu

SEQ ID NO: 1997844 - RNA, 13 nt, Homo sapiens
gaaggaugaauga

SEQ ID NO: 1997845 - RNA, 19 nt, Homo sapiens
caauccaagagucugauga

SEQ ID NO: 1997846 - RNA, 20 nt, Homo sapiens
ggaaacuggaugaggucaua

SEQ ID NO: 1997847 - RNA, 15 nt, Homo sapiens
gugcaggccaccagu

SEQ ID NO: 1997848 - RNA, 21 nt, Homo sapiens
cacaguacaauguuucagaag

SEQ ID NO: 1997849 - RNA, 22 nt, Homo sapiens
cccaggcuucacccugaauggu

SEQ ID NO: 1997850 - RNA, 19 nt, Homo sapiens
ccagcagugucacucugua

SEQ ID NO: 1997851 - RNA, 18 nt, Homo sapiens
cuaccagagcgugcacuu

SEQ ID NO: 1997852 - RNA, 16 nt, Homo sapiens
accaacaaacaaugcc

SEQ ID NO: 1997853 - RNA, 15 nt, Homo sapiens
ucccaacucacccca

SEQ ID NO: 1997854 - RNA, 21 nt, Homo sapiens
aacaauguuguccaacaauaa

SEQ ID NO: 1997855 - RNA, 13 nt, Homo sapiens
gcuccagggagug

SEQ ID NO: 1997856 - RNA, 19 nt, Homo sapiens
uaaggaagaauaaaaaaga

SEQ ID NO: 1997857 - RNA, 20 nt, Homo sapiens
cucauuugagauaaagucaa

SEQ ID NO: 1997858 - RNA, 16 nt, Homo sapiens
acagcaucauuuugca

SEQ ID NO: 1997859 - RNA, 12 nt, Homo sapiens
auucaugacaac

SEQ ID NO: 1997860 - RNA, 14 nt, Homo sapiens
cuuuauuuauuucu

SEQ ID NO: 1997861 - RNA, 15 nt, Homo sapiens
auucaaucauuuugg

SEQ ID NO: 1997862 - RNA, 18 nt, Homo sapiens
gaaucucgcaguguuucu

SEQ ID NO: 1997863 - RNA, 16 nt, Homo sapiens
ccucaucaacacagug

SEQ ID NO: 1997864 - RNA, 11 nt, Homo sapiens
acaagugacag

SEQ ID NO: 1997865 - RNA, 13 nt, Homo sapiens
ccauaggcccaca

SEQ ID NO: 1997866 - RNA, 21 nt, Homo sapiens
aacgcuucgggaaaauauuca

SEQ ID NO: 1997867 - RNA, 15 nt, Homo sapiens
aucauagcugacuca

SEQ ID NO: 1997868 - RNA, 15 nt, Homo sapiens
aagagugggcuuucc

SEQ ID NO: 1997869 - RNA, 16 nt, Homo sapiens
cgagggauuacuuugg

SEQ ID NO: 1997870 - RNA, 19 nt, Homo sapiens
ugggauggugacuccugaa

SEQ ID NO: 1997871 - RNA, 18 nt, Homo sapiens
uuccuucccuucuccauc

SEQ ID NO: 1997872 - RNA, 21 nt, Homo sapiens
gcgugcucccgaugcugcuau

SEQ ID NO: 1997873 - RNA, 13 nt, Homo sapiens
augcagguggugu

SEQ ID NO: 1997874 - RNA, 15 nt, Homo sapiens
auuccuucauucacu

SEQ ID NO: 1997875 - RNA, 17 nt, Homo sapiens
ccgcgaguuuuccccac

SEQ ID NO: 1997876 - RNA, 13 nt, Homo sapiens
uucccuuugccac

SEQ ID NO: 1997877 - RNA, 16 nt, Homo sapiens
uguuagaaguagcaau

SEQ ID NO: 1997878 - RNA, 23 nt, Homo sapiens
caugguggugauguccaaaagau

SEQ ID NO: 1997879 - RNA, 22 nt, Homo sapiens
auccuggaaaauucuauggaau

SEQ ID NO: 1997880 - RNA, 23 nt, Homo sapiens
acauuuaccaagagagcacauga

SEQ ID NO: 1997881 - RNA, 14 nt, Homo sapiens
acaccaaccgacag

SEQ ID NO: 1997882 - RNA, 21 nt, Homo sapiens
cuaagauccuccugaccucaa

SEQ ID NO: 1997883 - RNA, 23 nt, Homo sapiens
cugacagaaggaacacugcuuga

SEQ ID NO: 1997884 - RNA, 13 nt, Homo sapiens
ugccgcuaccucc

SEQ ID NO: 1997885 - RNA, 15 nt, Homo sapiens
cugaugcugccccuc

SEQ ID NO: 1997886 - RNA, 15 nt, Homo sapiens
augacaggcuguuca

SEQ ID NO: 1997887 - RNA, 19 nt, Homo sapiens
ucaagugggaucugucaca

SEQ ID NO: 1997888 - RNA, 19 nt, Homo sapiens
aggaaggaaaacuauguau

SEQ ID NO: 1997889 - RNA, 14 nt, Homo sapiens
aagauguacuugug

SEQ ID NO: 1997890 - RNA, 13 nt, Homo sapiens
acacgaugcauuu

SEQ ID NO: 1997891 - RNA, 22 nt, Homo sapiens
auuccauguccauacuaugaca

SEQ ID NO: 1997892 - RNA, 17 nt, Homo sapiens
uuguaacuuaugaaccu

SEQ ID NO: 1997893 - RNA, 14 nt, Homo sapiens
ccaagggagggaag

SEQ ID NO: 1997894 - RNA, 20 nt, Homo sapiens
acaacagagaugccaugaua

SEQ ID NO: 1997895 - RNA, 15 nt, Homo sapiens
uagacaauuugcaca

SEQ ID NO: 1997896 - RNA, 20 nt, Homo sapiens
ugcagucaucagaaauucca

SEQ ID NO: 1997897 - RNA, 23 nt, Homo sapiens
agaaaucauaguuuaaacugcau

SEQ ID NO: 1997898 - RNA, 23 nt, Homo sapiens
ggccaugccuggagacauaucac

SEQ ID NO: 1997899 - RNA, 13 nt, Homo sapiens
aaaucaacuugcu

SEQ ID NO: 1997900 - RNA, 18 nt, Homo sapiens
gggacguugcugagccag

SEQ ID NO: 1997901 - RNA, 16 nt, Homo sapiens
accacacaggagaagc

SEQ ID NO: 1997902 - RNA, 13 nt, Homo sapiens
aacuucagggauc

SEQ ID NO: 1997903 - RNA, 22 nt, Homo sapiens
caggauacuggcacagagguag

SEQ ID NO: 1997904 - RNA, 23 nt, Homo sapiens
agacauuguuuugccaacauugc

SEQ ID NO: 1997905 - RNA, 19 nt, Homo sapiens
auagcaacagagcacuuga

SEQ ID NO: 1997906 - RNA, 15 nt, Homo sapiens
acuucuggaagucau

SEQ ID NO: 1997907 - RNA, 18 nt, Homo sapiens
accaggauuacuagucaa

SEQ ID NO: 1997908 - RNA, 12 nt, Homo sapiens
cagcagagccau

SEQ ID NO: 1997909 - RNA, 16 nt, Homo sapiens
cuacaugaugacucaa

SEQ ID NO: 1997910 - RNA, 18 nt, Homo sapiens
gcaguaaaagaugaaguu

SEQ ID NO: 1997911 - RNA, 19 nt, Homo sapiens
gccacauucaccaaccaaa

SEQ ID NO: 1997912 - RNA, 16 nt, Homo sapiens
ucacucacacuggcca

SEQ ID NO: 1997913 - RNA, 16 nt, Homo sapiens
gucccccaaacauguu

SEQ ID NO: 1997914 - RNA, 14 nt, Homo sapiens
acgguggucuuuga

SEQ ID NO: 1997915 - RNA, 21 nt, Homo sapiens
uaucaaaucagucagugcaaa

SEQ ID NO: 1997916 - RNA, 18 nt, Homo sapiens
caaggaaauuugcaaaua

SEQ ID NO: 1997917 - RNA, 17 nt, Homo sapiens
auccucacuuugcugcc

SEQ ID NO: 1997918 - RNA, 14 nt, Homo sapiens
cucuucaagcuuuu

SEQ ID NO: 1997919 - RNA, 19 nt, Homo sapiens
uguggccaacugcaaaaaa

SEQ ID NO: 1997920 - RNA, 17 nt, Homo sapiens
ugucagccccucuuccc

SEQ ID NO: 1997921 - RNA, 13 nt, Homo sapiens
agugcaacccagu

SEQ ID NO: 1997922 - RNA, 17 nt, Homo sapiens
uucaaugaaccacaaaa

SEQ ID NO: 1997923 - RNA, 14 nt, Homo sapiens
aaagaaagcacuuc

SEQ ID NO: 1997924 - RNA, 15 nt, Homo sapiens
gcaggucugcaaggg

SEQ ID NO: 1997925 - RNA, 10 nt, Homo sapiens
ucucuguccu

SEQ ID NO: 1997926 - RNA, 16 nt, Homo sapiens
cucuuagcccucacca

SEQ ID NO: 1997927 - RNA, 21 nt, Homo sapiens
caaacuuggugaaacuacauc

SEQ ID NO: 1997928 - RNA, 17 nt, Homo sapiens
cuaaaaaggucuguuaa

SEQ ID NO: 1997929 - RNA, 17 nt, Homo sapiens
cuuccuacccucucuaa

SEQ ID NO: 1997930 - RNA, 23 nt, Homo sapiens
ugcccaggagaaaagaagacauu

SEQ ID NO: 1997931 - RNA, 20 nt, Homo sapiens
cugccucagccaguggcaca

SEQ ID NO: 1997932 - RNA, 12 nt, Homo sapiens
uucagaagugcc

SEQ ID NO: 1997933 - RNA, 19 nt, Homo sapiens
aaaugcucuugucccuguc

SEQ ID NO: 1997934 - RNA, 11 nt, Homo sapiens
uuuuaugcugg

SEQ ID NO: 1997935 - RNA, 22 nt, Homo sapiens
gacuugcaaagcuucacuucau

SEQ ID NO: 1997936 - RNA, 20 nt, Homo sapiens
cagaacaagaccccgucuca

SEQ ID NO: 1997937 - RNA, 19 nt, Homo sapiens
caguaaaugaacaaaaaca

SEQ ID NO: 1997938 - RNA, 20 nt, Homo sapiens
gacaggaagcccaaggcagu

SEQ ID NO: 1997939 - RNA, 12 nt, Homo sapiens
acaaauacacau

SEQ ID NO: 1997940 - RNA, 15 nt, Homo sapiens
cuggagggggcagaa

SEQ ID NO: 1997941 - RNA, 13 nt, Homo sapiens
uaugagggccacg

SEQ ID NO: 1997942 - RNA, 15 nt, Homo sapiens
uucuuaggaacagac

SEQ ID NO: 1997943 - RNA, 19 nt, Homo sapiens
uccacagcuauauccugau

SEQ ID NO: 1997944 - RNA, 19 nt, Homo sapiens
caguguuuuccuuugcacc

SEQ ID NO: 1997945 - RNA, 22 nt, Homo sapiens
aaacacauacaggaagguagaa

SEQ ID NO: 1997946 - RNA, 18 nt, Homo sapiens
gcacuuuucaaacaauca

SEQ ID NO: 1997947 - RNA, 21 nt, Homo sapiens
caauguugcauuuaugaugca

SEQ ID NO: 1997948 - RNA, 21 nt, Homo sapiens
ggauuaagaaaccuugcucuc

SEQ ID NO: 1997949 - RNA, 15 nt, Homo sapiens
uuaacaucacuacaa

SEQ ID NO: 1997950 - RNA, 19 nt, Homo sapiens
uaaaauauuuaugagaaag

SEQ ID NO: 1997951 - RNA, 12 nt, Homo sapiens
aauaaacauuaa

SEQ ID NO: 1997952 - RNA, 23 nt, Homo sapiens
ggaagauucccucuuccugccaa

SEQ ID NO: 1997953 - RNA, 11 nt, Homo sapiens
uuauguacugc

SEQ ID NO: 1997954 - RNA, 12 nt, Homo sapiens
auuucagacucc

SEQ ID NO: 1997955 - RNA, 19 nt, Homo sapiens
uacaaauaaauccaagacu

SEQ ID NO: 1997956 - RNA, 13 nt, Homo sapiens
gaggugaaggcag

SEQ ID NO: 1997957 - RNA, 21 nt, Homo sapiens
ugagauccggcagcacaagcu

SEQ ID NO: 1997958 - RNA, 15 nt, Homo sapiens
uagaugaacaucucu

SEQ ID NO: 1997959 - RNA, 15 nt, Homo sapiens
uaucuguacagauca

SEQ ID NO: 1997960 - RNA, 16 nt, Homo sapiens
cauuguuuggagacau

SEQ ID NO: 1997961 - RNA, 12 nt, Homo sapiens
uaguugcuguau

SEQ ID NO: 1997962 - RNA, 16 nt, Homo sapiens
uucccccgcuaauuca

SEQ ID NO: 1997963 - RNA, 14 nt, Homo sapiens
uaacuuugcccuuc

SEQ ID NO: 1997964 - RNA, 14 nt, Homo sapiens
gaccaggccaccau

SEQ ID NO: 1997965 - RNA, 21 nt, Homo sapiens
aauuugcuggaacacaaagac

SEQ ID NO: 1997966 - RNA, 16 nt, Homo sapiens
cacauacuugcagcuc

SEQ ID NO: 1997967 - RNA, 15 nt, Homo sapiens
acuaauagagacaca

SEQ ID NO: 1997968 - RNA, 22 nt, Homo sapiens
accucuucuggagauggaagcu

SEQ ID NO: 1997969 - RNA, 16 nt, Homo sapiens
uuuugucaacauugug

SEQ ID NO: 1997970 - RNA, 17 nt, Homo sapiens
aguaacauucauguucu

SEQ ID NO: 1997971 - RNA, 21 nt, Homo sapiens
aucaaggugaaggaucugucc

SEQ ID NO: 1997972 - RNA, 22 nt, Homo sapiens
caggcugugggucugcaccucu

SEQ ID NO: 1997973 - RNA, 18 nt, Homo sapiens
acacaaggcuccaagacc

SEQ ID NO: 1997974 - RNA, 22 nt, Homo sapiens
acugagucacucacauugagag

SEQ ID NO: 1997975 - RNA, 11 nt, Homo sapiens
aaacauucucu

SEQ ID NO: 1997976 - RNA, 16 nt, Homo sapiens
acuuugcugcauuuua

SEQ ID NO: 1997977 - RNA, 14 nt, Homo sapiens
ugagcuucaguaua

SEQ ID NO: 1997978 - RNA, 14 nt, Homo sapiens
cucuaauaugauua

SEQ ID NO: 1997979 - RNA, 15 nt, Homo sapiens
aagggcucagagcug

SEQ ID NO: 1997980 - RNA, 14 nt, Homo sapiens
gugaaauaagccag

SEQ ID NO: 1997981 - RNA, 15 nt, Homo sapiens
gcauuuuaagcauaa

SEQ ID NO: 1997982 - RNA, 22 nt, Homo sapiens
uagguguaagagaaauggaaau

SEQ ID NO: 1997983 - RNA, 20 nt, Homo sapiens
accacaacccuguugcuaca

SEQ ID NO: 1997984 - RNA, 22 nt, Homo sapiens
ucgcacugcccacaugggaccu

SEQ ID NO: 1997985 - RNA, 18 nt, Homo sapiens
ucugugcccggugccauc

SEQ ID NO: 1997986 - RNA, 20 nt, Homo sapiens
ggcuggagugcaauggcaca

SEQ ID NO: 1997987 - RNA, 20 nt, Homo sapiens
cucauuaaaauugugaugcu

SEQ ID NO: 1997988 - RNA, 15 nt, Homo sapiens
ugacucaucuucuca

SEQ ID NO: 1997989 - RNA, 14 nt, Homo sapiens
uaagcuacugccau

SEQ ID NO: 1997990 - RNA, 15 nt, Homo sapiens
cuuuaaauugauaaa

SEQ ID NO: 1997991 - RNA, 15 nt, Homo sapiens
uuaauauuucugagg

SEQ ID NO: 1997992 - RNA, 14 nt, Homo sapiens
guuuccguucacau

SEQ ID NO: 1997993 - RNA, 21 nt, Homo sapiens
ugcaccuacccacaugcacuc

SEQ ID NO: 1997994 - RNA, 23 nt, Homo sapiens
agaucaccaccccuuacaauucc

SEQ ID NO: 1997995 - RNA, 15 nt, Homo sapiens
acucaaucuacaggc

SEQ ID NO: 1997996 - RNA, 16 nt, Homo sapiens
aaggacuaugaaaagc

SEQ ID NO: 1997997 - RNA, 16 nt, Homo sapiens
uagagaacucuuucau

SEQ ID NO: 1997998 - RNA, 17 nt, Homo sapiens
accuuguuuugccaugu

SEQ ID NO: 1997999 - RNA, 13 nt, Homo sapiens
ugguguauuguca

SEQ ID NO: 1998000 - RNA, 18 nt, Homo sapiens
uuaacaaauugaguuuag

SEQ ID NO: 1998001 - RNA, 14 nt, Homo sapiens
guuuugagcauucu

SEQ ID NO: 1998002 - RNA, 12 nt, Homo sapiens
auccugugcaau

SEQ ID NO: 1998003 - RNA, 17 nt, Homo sapiens
ucugggacccacuccga

SEQ ID NO: 1998004 - RNA, 21 nt, Homo sapiens
caagcugaaaccccaucucca

SEQ ID NO: 1998005 - RNA, 15 nt, Homo sapiens
gaauaaaagugcaca

SEQ ID NO: 1998006 - RNA, 14 nt, Homo sapiens
acaaauguaaauag

SEQ ID NO: 1998007 - RNA, 16 nt, Homo sapiens
gcuacuauguacugcc

SEQ ID NO: 1998008 - RNA, 16 nt, Homo sapiens
gacauuaaaccuggau

SEQ ID NO: 1998009 - RNA, 18 nt, Homo sapiens
gaauaaagcuuauucuuu

SEQ ID NO: 1998010 - RNA, 18 nt, Homo sapiens
gcacccauuucaaugugu

SEQ ID NO: 1998011 - RNA, 22 nt, Homo sapiens
cauuccagccacuggcugcuaa

SEQ ID NO: 1998012 - RNA, 21 nt, Homo sapiens
ucuagcacuuccuugccaguc

SEQ ID NO: 1998013 - RNA, 19 nt, Homo sapiens
gaacucaccagugaguuag

SEQ ID NO: 1998014 - RNA, 15 nt, Homo sapiens
cuugucacuugccag

SEQ ID NO: 1998015 - RNA, 22 nt, Homo sapiens
acaaucaugaacagcucugaga

SEQ ID NO: 1998016 - RNA, 20 nt, Homo sapiens
uacagcacacacuuccauau

SEQ ID NO: 1998017 - RNA, 15 nt, Homo sapiens
gaguugcuuugccag

SEQ ID NO: 1998018 - RNA, 18 nt, Homo sapiens
guaaaggcuauacuuguc

SEQ ID NO: 1998019 - RNA, 21 nt, Homo sapiens
uucugagcaucugcaguacag

SEQ ID NO: 1998020 - RNA, 16 nt, Homo sapiens
gugucuguugcuugua

SEQ ID NO: 1998021 - RNA, 18 nt, Homo sapiens
gccugcccaacgugguga

SEQ ID NO: 1998022 - RNA, 19 nt, Homo sapiens
uacaugcccaucccagugu

SEQ ID NO: 1998023 - RNA, 17 nt, Homo sapiens
ugcccacugaacaugcu

SEQ ID NO: 1998024 - RNA, 17 nt, Homo sapiens
caguaacuccccaacuc

SEQ ID NO: 1998025 - RNA, 11 nt, Homo sapiens
ccuacuuuuca

SEQ ID NO: 1998026 - RNA, 14 nt, Homo sapiens
caacaaugacuuaa

SEQ ID NO: 1998027 - RNA, 21 nt, Homo sapiens
aaauaguauacauugucuuga

SEQ ID NO: 1998028 - RNA, 16 nt, Homo sapiens
gcugaacugacaauga

SEQ ID NO: 1998029 - RNA, 13 nt, Homo sapiens
ccauuuccugaga

SEQ ID NO: 1998030 - RNA, 20 nt, Homo sapiens
gccauauucuguaguauuuu

SEQ ID NO: 1998031 - RNA, 15 nt, Homo sapiens
gagggaggugguccu

SEQ ID NO: 1998032 - RNA, 17 nt, Homo sapiens
agggcaaaaagaccaag

SEQ ID NO: 1998033 - RNA, 21 nt, Homo sapiens
ugacaccgucccucagugaua

SEQ ID NO: 1998034 - RNA, 20 nt, Homo sapiens
guauauuaugguguaaugca

SEQ ID NO: 1998035 - RNA, 12 nt, Homo sapiens
agaaaacaucua

SEQ ID NO: 1998036 - RNA, 16 nt, Homo sapiens
cuaaugauuauagaua

SEQ ID NO: 1998037 - RNA, 13 nt, Homo sapiens
gcacaggugacaa

SEQ ID NO: 1998038 - RNA, 17 nt, Homo sapiens
ugagcagaacaccugag

SEQ ID NO: 1998039 - RNA, 15 nt, Homo sapiens
auaaaagcugcauau

SEQ ID NO: 1998040 - RNA, 20 nt, Homo sapiens
uaaaaaaaaaaaccaaaacu

SEQ ID NO: 1998041 - RNA, 17 nt, Homo sapiens
ccaucgcaggaugacag

SEQ ID NO: 1998042 - RNA, 17 nt, Homo sapiens
ccgaggcugggacacug

SEQ ID NO: 1998043 - RNA, 14 nt, Homo sapiens
caggagaagggaua

SEQ ID NO: 1998044 - RNA, 21 nt, Homo sapiens
agcaccugaagugaccuggaa

SEQ ID NO: 1998045 - RNA, 19 nt, Homo sapiens
gcaaagggcgggccuguuu

SEQ ID NO: 1998046 - RNA, 14 nt, Homo sapiens
ccuccugcuuccuc

SEQ ID NO: 1998047 - RNA, 17 nt, Homo sapiens
gccucuggaugcuguga

SEQ ID NO: 1998048 - RNA, 16 nt, Homo sapiens
ggagaggucaccagcu

SEQ ID NO: 1998049 - RNA, 14 nt, Homo sapiens
gugccuuuaucugu

SEQ ID NO: 1998050 - RNA, 15 nt, Homo sapiens
caagccugugcaaug

SEQ ID NO: 1998051 - RNA, 18 nt, Homo sapiens
agucagguuugaguagag

SEQ ID NO: 1998052 - RNA, 14 nt, Homo sapiens
gaaaccucugccuu

SEQ ID NO: 1998053 - RNA, 22 nt, Homo sapiens
gaguauuuuuguauuaaaaaca

SEQ ID NO: 1998054 - RNA, 17 nt, Homo sapiens
gaccacagcacagccaa

SEQ ID NO: 1998055 - RNA, 12 nt, Homo sapiens
aaauguuuauaa

SEQ ID NO: 1998056 - RNA, 19 nt, Homo sapiens
acugagcccucucacucca

SEQ ID NO: 1998057 - RNA, 22 nt, Homo sapiens
caucccagucugauauucaccu

SEQ ID NO: 1998058 - RNA, 23 nt, Homo sapiens
aaaugugcagaugcuaacuggac

SEQ ID NO: 1998059 - RNA, 23 nt, Homo sapiens
auguggcauucucucugcucagu

SEQ ID NO: 1998060 - RNA, 12 nt, Homo sapiens
uaaauuacaguc

SEQ ID NO: 1998061 - RNA, 13 nt, Homo sapiens
cugcacuccauga

SEQ ID NO: 1998062 - RNA, 17 nt, Homo sapiens
cuacuguuaacacugcu

SEQ ID NO: 1998063 - RNA, 15 nt, Homo sapiens
cauuucacucucaaa

SEQ ID NO: 1998064 - RNA, 19 nt, Homo sapiens
uuucucaccugucaucuca

SEQ ID NO: 1998065 - RNA, 17 nt, Homo sapiens
cguuugugauugccauu

SEQ ID NO: 1998066 - RNA, 13 nt, Homo sapiens
uuaaaugguaaua

SEQ ID NO: 1998067 - RNA, 23 nt, Homo sapiens
uggaugggggaacucagauccag

SEQ ID NO: 1998068 - RNA, 13 nt, Homo sapiens
gcagugugcagug

SEQ ID NO: 1998069 - RNA, 21 nt, Homo sapiens
ugggcaauauucucuguacau

SEQ ID NO: 1998070 - RNA, 23 nt, Homo sapiens
cccauuagaagcacacagaauua

SEQ ID NO: 1998071 - RNA, 15 nt, Homo sapiens
ucacuacugcauuua

SEQ ID NO: 1998072 - RNA, 16 nt, Homo sapiens
aauaaucaugaucaca

SEQ ID NO: 1998073 - RNA, 17 nt, Homo sapiens
gccagucucauugucac

SEQ ID NO: 1998074 - RNA, 23 nt, Homo sapiens
accaacuuuaccucuucuucucc

SEQ ID NO: 1998075 - RNA, 22 nt, Homo sapiens
gucucugaacuaggugaucuca

SEQ ID NO: 1998076 - RNA, 22 nt, Homo sapiens
gaaagugaucacgacaaucaca

SEQ ID NO: 1998077 - RNA, 20 nt, Homo sapiens
aucugcucaccagaucucag

SEQ ID NO: 1998078 - RNA, 23 nt, Homo sapiens
cuuuuaagccagguuacauucua

SEQ ID NO: 1998079 - RNA, 14 nt, Homo sapiens
gcugucaugcccag

SEQ ID NO: 1998080 - RNA, 12 nt, Homo sapiens
gcacagccagaa

SEQ ID NO: 1998081 - RNA, 17 nt, Homo sapiens
gcuaacaguugccacau

SEQ ID NO: 1998082 - RNA, 14 nt, Homo sapiens
uauuauguuaugaa

SEQ ID NO: 1998083 - RNA, 13 nt, Homo sapiens
cagaaugugcaaa

SEQ ID NO: 1998084 - RNA, 23 nt, Homo sapiens
acaaaaaggaaaugaauauucaa

SEQ ID NO: 1998085 - RNA, 14 nt, Homo sapiens
aguaucucuugcug

SEQ ID NO: 1998086 - RNA, 16 nt, Homo sapiens
uccaacacugcugcuc

SEQ ID NO: 1998087 - RNA, 14 nt, Homo sapiens
aagcacacaugcau

SEQ ID NO: 1998088 - RNA, 15 nt, Homo sapiens
ucauuccuaacacag

SEQ ID NO: 1998089 - RNA, 22 nt, Homo sapiens
gcucugucuacccagugcucca

SEQ ID NO: 1998090 - RNA, 19 nt, Homo sapiens
ugugguuuauaaucuugca

SEQ ID NO: 1998091 - RNA, 21 nt, Homo sapiens
acagauguacauuaaauacca

SEQ ID NO: 1998092 - RNA, 19 nt, Homo sapiens
cuccucucccagugacaac

SEQ ID NO: 1998093 - RNA, 21 nt, Homo sapiens
agcacuuggcccuucuaccua

SEQ ID NO: 1998094 - RNA, 16 nt, Homo sapiens
gucuugucuuuuucca

SEQ ID NO: 1998095 - RNA, 19 nt, Homo sapiens
augaaggcucauuuacuug

SEQ ID NO: 1998096 - RNA, 18 nt, Homo sapiens
gaucucugagaccacaga

SEQ ID NO: 1998097 - RNA, 12 nt, Homo sapiens
guauaacaaaga

SEQ ID NO: 1998098 - RNA, 18 nt, Homo sapiens
ggcaccugguaugugcca

SEQ ID NO: 1998099 - RNA, 15 nt, Homo sapiens
cugcgcuuccaaaag

SEQ ID NO: 1998100 - RNA, 15 nt, Homo sapiens
ccugagagggaaccc

SEQ ID NO: 1998101 - RNA, 16 nt, Homo sapiens
uccuuuguaauugaca

SEQ ID NO: 1998102 - RNA, 11 nt, Homo sapiens
auccuaaagau

SEQ ID NO: 1998103 - RNA, 20 nt, Homo sapiens
uacagaauuuuucuucauua

SEQ ID NO: 1998104 - RNA, 16 nt, Homo sapiens
auuuuuauaaccuggc

SEQ ID NO: 1998105 - RNA, 15 nt, Homo sapiens
uugaguaauucuagc

SEQ ID NO: 1998106 - RNA, 14 nt, Homo sapiens
ccaaaucucuucca

SEQ ID NO: 1998107 - RNA, 14 nt, Homo sapiens
aauuaaaacuuugu

SEQ ID NO: 1998108 - RNA, 14 nt, Homo sapiens
uucccauucuugca

SEQ ID NO: 1998109 - RNA, 20 nt, Homo sapiens
uccacagucccccacccacc

SEQ ID NO: 1998110 - RNA, 19 nt, Homo sapiens
uuauaauuugcauaccauu

SEQ ID NO: 1998111 - RNA, 16 nt, Homo sapiens
aguuugcccauucucu

SEQ ID NO: 1998112 - RNA, 15 nt, Homo sapiens
gcagcaaaugccacu

SEQ ID NO: 1998113 - RNA, 15 nt, Homo sapiens
cuuuggcaauucuuc

SEQ ID NO: 1998114 - RNA, 23 nt, Homo sapiens
ggagcucuucaggccucccucuc

SEQ ID NO: 1998115 - RNA, 12 nt, Homo sapiens
uauuauugaacu

SEQ ID NO: 1998116 - RNA, 21 nt, Homo sapiens
ugcuccacucgcacuuaucaa

SEQ ID NO: 1998117 - RNA, 21 nt, Homo sapiens
ccugaacagcccucucucuca

SEQ ID NO: 1998118 - RNA, 22 nt, Homo sapiens
gccccugucgucaggaccuccu

SEQ ID NO: 1998119 - RNA, 12 nt, Homo sapiens
caggucagggac

SEQ ID NO: 1998120 - RNA, 16 nt, Homo sapiens
uugauaauuuagacau

SEQ ID NO: 1998121 - RNA, 17 nt, Homo sapiens
ugcucaguuggugcugc

SEQ ID NO: 1998122 - RNA, 19 nt, Homo sapiens
agcacuuuguuucauauuc

SEQ ID NO: 1998123 - RNA, 13 nt, Homo sapiens
uucucaucacuca

SEQ ID NO: 1998124 - RNA, 22 nt, Homo sapiens
uacauaaagacugugcugagaa

SEQ ID NO: 1998125 - RNA, 21 nt, Homo sapiens
cccuaacuuucuuaucccaug

SEQ ID NO: 1998126 - RNA, 22 nt, Homo sapiens
uuuuacagagaggauacauuua

SEQ ID NO: 1998127 - RNA, 22 nt, Homo sapiens
aaggauguuuugucccauuucc

SEQ ID NO: 1998128 - RNA, 19 nt, Homo sapiens
uuagucuuaauguacacau

SEQ ID NO: 1998129 - RNA, 15 nt, Homo sapiens
cuccuuuccaauaga

SEQ ID NO: 1998130 - RNA, 13 nt, Homo sapiens
gagauacuuugca

SEQ ID NO: 1998131 - RNA, 17 nt, Homo sapiens
auguccaucagaugaca

SEQ ID NO: 1998132 - RNA, 13 nt, Homo sapiens
acaauucagugac

SEQ ID NO: 1998133 - RNA, 22 nt, Homo sapiens
gguucccaagaguauccuaccc

SEQ ID NO: 1998134 - RNA, 19 nt, Homo sapiens
gguauuuuccugugccuuu

SEQ ID NO: 1998135 - RNA, 14 nt, Homo sapiens
cugcuuuaucuuuu

SEQ ID NO: 1998136 - RNA, 16 nt, Homo sapiens
uugacccuagccagag

SEQ ID NO: 1998137 - RNA, 16 nt, Homo sapiens
ugcacuguuugcccca

SEQ ID NO: 1998138 - RNA, 15 nt, Homo sapiens
uggagccauccuccu

SEQ ID NO: 1998139 - RNA, 16 nt, Homo sapiens
ggauaggaaaaaaaga

SEQ ID NO: 1998140 - RNA, 21 nt, Homo sapiens
aagaacauugauuucauugaa

SEQ ID NO: 1998141 - RNA, 16 nt, Homo sapiens
uaaaucuaaacauaaa

SEQ ID NO: 1998142 - RNA, 17 nt, Homo sapiens
gcgacgugaggguccug

SEQ ID NO: 1998143 - RNA, 18 nt, Homo sapiens
ccaaacuguacaguuucu

SEQ ID NO: 1998144 - RNA, 13 nt, Homo sapiens
agauaugugccaa

SEQ ID NO: 1998145 - RNA, 13 nt, Homo sapiens
cuuuauguacugc

SEQ ID NO: 1998146 - RNA, 19 nt, Homo sapiens
agauacuuugucagcaaua

SEQ ID NO: 1998147 - RNA, 13 nt, Homo sapiens
aaccaaguucaaa

SEQ ID NO: 1998148 - RNA, 13 nt, Homo sapiens
aaccuaguucaau

SEQ ID NO: 1998149 - RNA, 14 nt, Homo sapiens
cuucuuuuacucau

SEQ ID NO: 1998150 - RNA, 22 nt, Homo sapiens
gaaaauccugacaaaagggaca

SEQ ID NO: 1998151 - RNA, 15 nt, Homo sapiens
cgcuguccugagaug

SEQ ID NO: 1998152 - RNA, 19 nt, Homo sapiens
ggucccaggcagagaauca

SEQ ID NO: 1998153 - RNA, 16 nt, Homo sapiens
ugugguggcucaugcc

SEQ ID NO: 1998154 - RNA, 21 nt, Homo sapiens
auuguuuuguggauaauugaa

SEQ ID NO: 1998155 - RNA, 20 nt, Homo sapiens
auguauaaaaauuaucaaaa

SEQ ID NO: 1998156 - RNA, 19 nt, Homo sapiens
gcuuuauacguguagcuau

SEQ ID NO: 1998157 - RNA, 16 nt, Homo sapiens
aauuucuuccuuccac

SEQ ID NO: 1998158 - RNA, 22 nt, Homo sapiens
cuaauauuuuguucugcaaauu

SEQ ID NO: 1998159 - RNA, 21 nt, Homo sapiens
guaaauuucucuacugucuca

SEQ ID NO: 1998160 - RNA, 15 nt, Homo sapiens
cacuggcugccucca

SEQ ID NO: 1998161 - RNA, 16 nt, Homo sapiens
auucuaaaccaaucaa

SEQ ID NO: 1998162 - RNA, 18 nt, Homo sapiens
acuuucuuaucacuuaua

SEQ ID NO: 1998163 - RNA, 19 nt, Homo sapiens
uacacgagguaugaggucu

SEQ ID NO: 1998164 - RNA, 16 nt, Homo sapiens
auucauuauuccucag

SEQ ID NO: 1998165 - RNA, 21 nt, Homo sapiens
gucguaccucgguucacuguu

SEQ ID NO: 1998166 - RNA, 14 nt, Homo sapiens
uggucucuucacca

SEQ ID NO: 1998167 - RNA, 16 nt, Homo sapiens
agggauaauuggugca

SEQ ID NO: 1998168 - RNA, 16 nt, Homo sapiens
acuagcuaaaccagaa

SEQ ID NO: 1998169 - RNA, 22 nt, Homo sapiens
aaauucaggugaaaauguucau

SEQ ID NO: 1998170 - RNA, 16 nt, Homo sapiens
agugcauuugugcuag

SEQ ID NO: 1998171 - RNA, 20 nt, Homo sapiens
uggaccuagcuugaggcaau

SEQ ID NO: 1998172 - RNA, 12 nt, Homo sapiens
uuucugggaccc

SEQ ID NO: 1998173 - RNA, 20 nt, Homo sapiens
agccuguugcggaucuucau

SEQ ID NO: 1998174 - RNA, 16 nt, Homo sapiens
cuacuguacacggacc

SEQ ID NO: 1998175 - RNA, 21 nt, Homo sapiens
caggccugggaugcagugaug

SEQ ID NO: 1998176 - RNA, 20 nt, Homo sapiens
agugcugcucucccaucucc

SEQ ID NO: 1998177 - RNA, 21 nt, Homo sapiens
agucuuguuuuuuauucagau

SEQ ID NO: 1998178 - RNA, 17 nt, Homo sapiens
cuaaagcaguccuccag

SEQ ID NO: 1998179 - RNA, 16 nt, Homo sapiens
ccucccaaaaugcugg

SEQ ID NO: 1998180 - RNA, 20 nt, Homo sapiens
uugcaggauggugucucuuc

SEQ ID NO: 1998181 - RNA, 22 nt, Homo sapiens
aagcaagugaacucaucccuug

SEQ ID NO: 1998182 - RNA, 20 nt, Homo sapiens
uacuuccagcaaaauccaaa

SEQ ID NO: 1998183 - RNA, 12 nt, Homo sapiens
uggggguguuca

SEQ ID NO: 1998184 - RNA, 19 nt, Homo sapiens
uggucaauccgaaguauga

SEQ ID NO: 1998185 - RNA, 13 nt, Homo sapiens
ugugugugcagaa

SEQ ID NO: 1998186 - RNA, 14 nt, Homo sapiens
cuugaacacugugu

SEQ ID NO: 1998187 - RNA, 22 nt, Homo sapiens
cccuggcucugaccgaaacagc

SEQ ID NO: 1998188 - RNA, 15 nt, Homo sapiens
aaugggagaagagag

SEQ ID NO: 1998189 - RNA, 19 nt, Homo sapiens
uguaccagggcucuguauu

SEQ ID NO: 1998190 - RNA, 17 nt, Homo sapiens
gaagacccaguguaaag

SEQ ID NO: 1998191 - RNA, 19 nt, Homo sapiens
guacauuucugauucugau

SEQ ID NO: 1998192 - RNA, 16 nt, Homo sapiens
ggagacaaggugcuaa

SEQ ID NO: 1998193 - RNA, 16 nt, Homo sapiens
ggcugaggcuggcaca

SEQ ID NO: 1998194 - RNA, 19 nt, Homo sapiens
ugcccagagaaucagggca

SEQ ID NO: 1998195 - RNA, 17 nt, Homo sapiens
caucaaccuaggagcag

SEQ ID NO: 1998196 - RNA, 17 nt, Homo sapiens
guugugucuugcuauac

SEQ ID NO: 1998197 - RNA, 17 nt, Homo sapiens
aaggugauugauuguau

SEQ ID NO: 1998198 - RNA, 20 nt, Homo sapiens
cgauugucugggcaaugaaa

SEQ ID NO: 1998199 - RNA, 12 nt, Homo sapiens
accuugaugaaa

SEQ ID NO: 1998200 - RNA, 17 nt, Homo sapiens
uagaauucacaaugcau

SEQ ID NO: 1998201 - RNA, 20 nt, Homo sapiens
aagcaucugagcuaacuuau

SEQ ID NO: 1998202 - RNA, 11 nt, Homo sapiens
uggcauuugcu

SEQ ID NO: 1998203 - RNA, 21 nt, Homo sapiens
caguugcccuagcccagacuc

SEQ ID NO: 1998204 - RNA, 21 nt, Homo sapiens
accccuuccagaucacugcca

SEQ ID NO: 1998205 - RNA, 21 nt, Homo sapiens
acugucuguaccuaaagcaau

SEQ ID NO: 1998206 - RNA, 16 nt, Homo sapiens
ugaaggaaucauucca

SEQ ID NO: 1998207 - RNA, 16 nt, Homo sapiens
agccacccugccaugg

SEQ ID NO: 1998208 - RNA, 16 nt, Homo sapiens
aagaucaaacuuccau

SEQ ID NO: 1998209 - RNA, 18 nt, Homo sapiens
cugaugccccagggauuc

SEQ ID NO: 1998210 - RNA, 23 nt, Homo sapiens
guuucugccuucuccaugcugag

SEQ ID NO: 1998211 - RNA, 23 nt, Homo sapiens
cccggggcgggcugaugucuucu

SEQ ID NO: 1998212 - RNA, 21 nt, Homo sapiens
uggccguuugcuuaaugccag

SEQ ID NO: 1998213 - RNA, 16 nt, Homo sapiens
auaagccagugagacc

SEQ ID NO: 1998214 - RNA, 18 nt, Homo sapiens
ucuguucucccugggaag

SEQ ID NO: 1998215 - RNA, 15 nt, Homo sapiens
auccauguacuuucc

SEQ ID NO: 1998216 - RNA, 19 nt, Homo sapiens
uggaguauuuucuaauaau

SEQ ID NO: 1998217 - RNA, 14 nt, Homo sapiens
ccaaauaauuccac

SEQ ID NO: 1998218 - RNA, 19 nt, Homo sapiens
gaacaagcccaacaguaau

SEQ ID NO: 1998219 - RNA, 21 nt, Homo sapiens
ugcucccuccucuccuaccca

SEQ ID NO: 1998220 - RNA, 12 nt, Homo sapiens
ccuggcaguuua

SEQ ID NO: 1998221 - RNA, 16 nt, Homo sapiens
ccuccagaagcugcuc

SEQ ID NO: 1998222 - RNA, 13 nt, Homo sapiens
ccagggcagugag

SEQ ID NO: 1998223 - RNA, 22 nt, Homo sapiens
acaacuuuuaaccaaacaauua

SEQ ID NO: 1998224 - RNA, 23 nt, Homo sapiens
uugcuuggugcacagauugcuga

SEQ ID NO: 1998225 - RNA, 18 nt, Homo sapiens
ucugcucugaugcaucag

SEQ ID NO: 1998226 - RNA, 12 nt, Homo sapiens
uaucuaccccag

SEQ ID NO: 1998227 - RNA, 12 nt, Homo sapiens
cauguaccucac

SEQ ID NO: 1998228 - RNA, 22 nt, Homo sapiens
cuaggcuaggguggggagagac

SEQ ID NO: 1998229 - RNA, 23 nt, Homo sapiens
acacugccuuaccuucacuuaaa

SEQ ID NO: 1998230 - RNA, 21 nt, Homo sapiens
ucucuuacaaaagcuuugaau

SEQ ID NO: 1998231 - RNA, 12 nt, Homo sapiens
auccauggccag

SEQ ID NO: 1998232 - RNA, 19 nt, Homo sapiens
ggugaccacccaccaccug

SEQ ID NO: 1998233 - RNA, 16 nt, Homo sapiens
ggacacccagggucua

SEQ ID NO: 1998234 - RNA, 15 nt, Homo sapiens
ugcaacuacuaucca

SEQ ID NO: 1998235 - RNA, 13 nt, Homo sapiens
ugauccgccuacc

SEQ ID NO: 1998236 - RNA, 22 nt, Homo sapiens
aacugcaggagcaguuugccac

SEQ ID NO: 1998237 - RNA, 19 nt, Homo sapiens
agaauuuaagacuugugcu

SEQ ID NO: 1998238 - RNA, 16 nt, Homo sapiens
guucccccaguaccuc

SEQ ID NO: 1998239 - RNA, 22 nt, Homo sapiens
uugugaaaaugaauaucaugca

SEQ ID NO: 1998240 - RNA, 21 nt, Homo sapiens
aagccacgaaugaaugaauua

SEQ ID NO: 1998241 - RNA, 20 nt, Homo sapiens
acuucuuuauucacaguauc

SEQ ID NO: 1998242 - RNA, 20 nt, Homo sapiens
guagcugggauuacaggcgu

SEQ ID NO: 1998243 - RNA, 23 nt, Homo sapiens
aguguuuggguauauucauuuca

SEQ ID NO: 1998244 - RNA, 22 nt, Homo sapiens
gaguuugguuaaucaguguuga

SEQ ID NO: 1998245 - RNA, 19 nt, Homo sapiens
cucuuuggaggaagcccau

SEQ ID NO: 1998246 - RNA, 21 nt, Homo sapiens
accuccuacgucaaacaugaa

SEQ ID NO: 1998247 - RNA, 19 nt, Homo sapiens
caccuagaacacuaacuca

SEQ ID NO: 1998248 - RNA, 16 nt, Homo sapiens
uuccucagaucaucca

SEQ ID NO: 1998249 - RNA, 12 nt, Homo sapiens
uccuguauauuc

SEQ ID NO: 1998250 - RNA, 17 nt, Homo sapiens
ugcgcauucucauggag

SEQ ID NO: 1998251 - RNA, 19 nt, Homo sapiens
cauucuugggaggacacuu

SEQ ID NO: 1998252 - RNA, 14 nt, Homo sapiens
gaaagcagugcagu

SEQ ID NO: 1998253 - RNA, 21 nt, Homo sapiens
aagaauguuauccaacuauua

SEQ ID NO: 1998254 - RNA, 23 nt, Homo sapiens
ugguacauacacaccagggaaua

SEQ ID NO: 1998255 - RNA, 17 nt, Homo sapiens
ugcuggccggagcaaac

SEQ ID NO: 1998256 - RNA, 12 nt, Homo sapiens
ccauuacuguaa

SEQ ID NO: 1998257 - RNA, 13 nt, Homo sapiens
aagauauaugaau

SEQ ID NO: 1998258 - RNA, 21 nt, Homo sapiens
ugaaaaggauauuaucuaccu

SEQ ID NO: 1998259 - RNA, 14 nt, Homo sapiens
agcuggacuacggc

SEQ ID NO: 1998260 - RNA, 16 nt, Homo sapiens
ugacguggagcugcuc

SEQ ID NO: 1998261 - RNA, 18 nt, Homo sapiens
aucuugggauaguuccca

SEQ ID NO: 1998262 - RNA, 13 nt, Homo sapiens
uauuauacugaca

SEQ ID NO: 1998263 - RNA, 12 nt, Homo sapiens
aacaaaccaaua

SEQ ID NO: 1998264 - RNA, 15 nt, Homo sapiens
ccugagaagccagug

SEQ ID NO: 1998265 - RNA, 14 nt, Homo sapiens
gugugugcucagca

SEQ ID NO: 1998266 - RNA, 18 nt, Homo sapiens
uugccuucucuguucccu

SEQ ID NO: 1998267 - RNA, 17 nt, Homo sapiens
guaccacacauauugca

SEQ ID NO: 1998268 - RNA, 16 nt, Homo sapiens
gucccuccuguuguga

SEQ ID NO: 1998269 - RNA, 15 nt, Homo sapiens
acgugauacauuugg

SEQ ID NO: 1998270 - RNA, 13 nt, Homo sapiens
uucauucugcauu

SEQ ID NO: 1998271 - RNA, 16 nt, Homo sapiens
uacauaaaaaagggac

SEQ ID NO: 1998272 - RNA, 22 nt, Homo sapiens
auguucacuuuugacaaaggca

SEQ ID NO: 1998273 - RNA, 22 nt, Homo sapiens
cuacaagccacgaaugaaugaa

SEQ ID NO: 1998274 - RNA, 14 nt, Homo sapiens
agaccugauccugg

SEQ ID NO: 1998275 - RNA, 18 nt, Homo sapiens
uaugaaagaaaaauggau

SEQ ID NO: 1998276 - RNA, 12 nt, Homo sapiens
aacauguacaaa

SEQ ID NO: 1998277 - RNA, 13 nt, Homo sapiens
gcucuugcucaag

SEQ ID NO: 1998278 - RNA, 11 nt, Homo sapiens
gagggggaccc

SEQ ID NO: 1998279 - RNA, 15 nt, Homo sapiens
ucaaccaauguagaa

SEQ ID NO: 1998280 - RNA, 17 nt, Homo sapiens
caacucaugaacaaaau

SEQ ID NO: 1998281 - RNA, 18 nt, Homo sapiens
auuuaaaucguacuacag

SEQ ID NO: 1998282 - RNA, 18 nt, Homo sapiens
auucugggaaucaugucc

SEQ ID NO: 1998283 - RNA, 18 nt, Homo sapiens
uaaucauuuuaaauucca

SEQ ID NO: 1998284 - RNA, 15 nt, Homo sapiens
ugaacacaucagcuu

SEQ ID NO: 1998285 - RNA, 21 nt, Homo sapiens
ucugcgcaccaaggaauggag

SEQ ID NO: 1998286 - RNA, 14 nt, Homo sapiens
gcaauuugccaguu

SEQ ID NO: 1998287 - RNA, 18 nt, Homo sapiens
cuggugaauaacuaugcc

SEQ ID NO: 1998288 - RNA, 22 nt, Homo sapiens
augaucuguuuuucaccacuuc

SEQ ID NO: 1998289 - RNA, 22 nt, Homo sapiens
auguguauugaagaaaagcacu

SEQ ID NO: 1998290 - RNA, 18 nt, Homo sapiens
gugccuggccaaagggau

SEQ ID NO: 1998291 - RNA, 18 nt, Homo sapiens
acagaagcaaaaauucac

SEQ ID NO: 1998292 - RNA, 18 nt, Homo sapiens
cuuauuuacuuguagaaa

SEQ ID NO: 1998293 - RNA, 12 nt, Homo sapiens
uucucagugucc

SEQ ID NO: 1998294 - RNA, 16 nt, Homo sapiens
uuaggccacauugaca

SEQ ID NO: 1998295 - RNA, 19 nt, Homo sapiens
guccugggugcugucaugc

SEQ ID NO: 1998296 - RNA, 12 nt, Homo sapiens
ugccaucuucag

SEQ ID NO: 1998297 - RNA, 13 nt, Homo sapiens
gucccccuuccau

SEQ ID NO: 1998298 - RNA, 22 nt, Homo sapiens
uggaguagcaucccccuggggc

SEQ ID NO: 1998299 - RNA, 14 nt, Homo sapiens
cuuacacauuccau

SEQ ID NO: 1998300 - RNA, 13 nt, Homo sapiens
uggccaagccugg

SEQ ID NO: 1998301 - RNA, 17 nt, Homo sapiens
augcuuuagccauacac

SEQ ID NO: 1998302 - RNA, 17 nt, Homo sapiens
gucuuaaagcauuucag

SEQ ID NO: 1998303 - RNA, 23 nt, Homo sapiens
aguucccuccugcagccugaccc

SEQ ID NO: 1998304 - RNA, 21 nt, Homo sapiens
ccuccgagacccaggagacaa

SEQ ID NO: 1998305 - RNA, 22 nt, Homo sapiens
ccugggaugaggggugcugggu

SEQ ID NO: 1998306 - RNA, 21 nt, Homo sapiens
aaaaacaaauauauauaugua

SEQ ID NO: 1998307 - RNA, 15 nt, Homo sapiens
caagcaacauaaaac

SEQ ID NO: 1998308 - RNA, 14 nt, Homo sapiens
ccagaaccuggaca

SEQ ID NO: 1998309 - RNA, 14 nt, Homo sapiens
agcagcagugccau

SEQ ID NO: 1998310 - RNA, 18 nt, Homo sapiens
aguaaucuguaagcauaa

SEQ ID NO: 1998311 - RNA, 20 nt, Homo sapiens
aucuguacucauguccuuca

SEQ ID NO: 1998312 - RNA, 13 nt, Homo sapiens
cccagaucugucc

SEQ ID NO: 1998313 - RNA, 14 nt, Homo sapiens
accaaaguuugcaa

SEQ ID NO: 1998314 - RNA, 17 nt, Homo sapiens
ugucaaugauuucaaaa

SEQ ID NO: 1998315 - RNA, 12 nt, Homo sapiens
aucauaaauacu

SEQ ID NO: 1998316 - RNA, 13 nt, Homo sapiens
aguucgaccagcc

SEQ ID NO: 1998317 - RNA, 21 nt, Homo sapiens
gaagggaaaugacuucuccag

SEQ ID NO: 1998318 - RNA, 22 nt, Homo sapiens
caagauaggaagaaaauuuccu

SEQ ID NO: 1998319 - RNA, 22 nt, Homo sapiens
aagcccucucagaucaccccag

SEQ ID NO: 1998320 - RNA, 22 nt, Homo sapiens
uaaucccaagaucugugcagcc

SEQ ID NO: 1998321 - RNA, 22 nt, Homo sapiens
cuuaaugaucuuuccauuggaa

SEQ ID NO: 1998322 - RNA, 15 nt, Homo sapiens
uccuccuugucuuaa

SEQ ID NO: 1998323 - RNA, 15 nt, Homo sapiens
augauaagugacaaa

SEQ ID NO: 1998324 - RNA, 23 nt, Homo sapiens
ugaaggaggugagggaugugaau

SEQ ID NO: 1998325 - RNA, 14 nt, Homo sapiens
ugcuuuugcauuuc

SEQ ID NO: 1998326 - RNA, 19 nt, Homo sapiens
aacauaccuaagaaguaca

SEQ ID NO: 1998327 - RNA, 19 nt, Homo sapiens
gugaauuauugacacugaa

SEQ ID NO: 1998328 - RNA, 22 nt, Homo sapiens
uguaaaauagugaauaaaguca

SEQ ID NO: 1998329 - RNA, 16 nt, Homo sapiens
guaagugagaacaaau

SEQ ID NO: 1998330 - RNA, 15 nt, Homo sapiens
gcccaauacagccau

SEQ ID NO: 1998331 - RNA, 19 nt, Homo sapiens
ucacucgcaggaccaaggg

SEQ ID NO: 1998332 - RNA, 10 nt, Homo sapiens
ugccaaaaaa

SEQ ID NO: 1998333 - RNA, 23 nt, Homo sapiens
uccuguucuuccuauuucuuuca

SEQ ID NO: 1998334 - RNA, 19 nt, Homo sapiens
gaugaauuccuauggcucu

SEQ ID NO: 1998335 - RNA, 21 nt, Homo sapiens
agaguugggaugcggggcaga

SEQ ID NO: 1998336 - RNA, 22 nt, Homo sapiens
acuguguucccacgggugccau

SEQ ID NO: 1998337 - RNA, 18 nt, Homo sapiens
auugaugauaagauuuac

SEQ ID NO: 1998338 - RNA, 23 nt, Homo sapiens
ucucuucaccccuacacugugaa

SEQ ID NO: 1998339 - RNA, 14 nt, Homo sapiens
cuugucucuggugu

SEQ ID NO: 1998340 - RNA, 13 nt, Homo sapiens
acugcugcugcug

SEQ ID NO: 1998341 - RNA, 24 nt, Homo sapiens
gacaugaucgcuuucuacacugua

SEQ ID NO: 1998342 - RNA, 20 nt, Homo sapiens
accaaauuacaaguauucag

SEQ ID NO: 1998343 - RNA, 21 nt, Homo sapiens
acaucucguauaauauucaca

SEQ ID NO: 1998344 - RNA, 15 nt, Homo sapiens
ucaaaaauacucuug

SEQ ID NO: 1998345 - RNA, 13 nt, Homo sapiens
ucaaauagcaaua

SEQ ID NO: 1998346 - RNA, 21 nt, Homo sapiens
acaugucauguagguugucua

SEQ ID NO: 1998347 - RNA, 15 nt, Homo sapiens
auggugucugugaca

SEQ ID NO: 1998348 - RNA, 21 nt, Homo sapiens
acagccuauaaccagacacau

SEQ ID NO: 1998349 - RNA, 22 nt, Homo sapiens
auccaggcccggugaggccaag

SEQ ID NO: 1998350 - RNA, 21 nt, Homo sapiens
gucuuaacauuucuaacucug

SEQ ID NO: 1998351 - RNA, 21 nt, Homo sapiens
acuggcuggccagucuggguc

SEQ ID NO: 1998352 - RNA, 16 nt, Homo sapiens
agcccagcaucacuga

SEQ ID NO: 1998353 - RNA, 15 nt, Homo sapiens
gcacagcugccgcgu

SEQ ID NO: 1998354 - RNA, 14 nt, Homo sapiens
cuagguuuaacuca

SEQ ID NO: 1998355 - RNA, 23 nt, Homo sapiens
agccugcggggugcccucucacu

SEQ ID NO: 1998356 - RNA, 21 nt, Homo sapiens
aucuccaauccacacauauug

SEQ ID NO: 1998357 - RNA, 23 nt, Homo sapiens
gugcuuguucuguccucuugccu

SEQ ID NO: 1998358 - RNA, 16 nt, Homo sapiens
cugcaucaagauguga

SEQ ID NO: 1998359 - RNA, 23 nt, Homo sapiens
cugucagaaaaagcuagcacuaa

SEQ ID NO: 1998360 - RNA, 21 nt, Homo sapiens
cuucuugggcugagugcagcc

SEQ ID NO: 1998361 - RNA, 17 nt, Homo sapiens
cccuauggagaauuuau

SEQ ID NO: 1998362 - RNA, 14 nt, Homo sapiens
gaugaguacccaaa

SEQ ID NO: 1998363 - RNA, 16 nt, Homo sapiens
gaaccaaccaaugaaa

SEQ ID NO: 1998364 - RNA, 20 nt, Homo sapiens
agagaaccuuuagaauaucu

SEQ ID NO: 1998365 - RNA, 23 nt, Homo sapiens
uggaucuggggugggaguaacag

SEQ ID NO: 1998366 - RNA, 17 nt, Homo sapiens
aaaguauauuuaacuca

SEQ ID NO: 1998367 - RNA, 19 nt, Homo sapiens
ucacaccgcgucuggugac

SEQ ID NO: 1998368 - RNA, 14 nt, Homo sapiens
gcauuaaccugucu

SEQ ID NO: 1998369 - RNA, 15 nt, Homo sapiens
agugucaaccagaca

SEQ ID NO: 1998370 - RNA, 12 nt, Homo sapiens
aaagacauguug

SEQ ID NO: 1998371 - RNA, 19 nt, Homo sapiens
aacccuguauggcacuuau

SEQ ID NO: 1998372 - RNA, 14 nt, Homo sapiens
cccuauucugccau

SEQ ID NO: 1998373 - RNA, 22 nt, Homo sapiens
uaugauuaaaaauaucaaauua

SEQ ID NO: 1998374 - RNA, 19 nt, Homo sapiens
ccucucucccggagguugg

SEQ ID NO: 1998375 - RNA, 15 nt, Homo sapiens
uauuaaauaaucucu

SEQ ID NO: 1998376 - RNA, 14 nt, Homo sapiens
uaauuucauucaaa

SEQ ID NO: 1998377 - RNA, 17 nt, Homo sapiens
ggcacagucauucacau

SEQ ID NO: 1998378 - RNA, 20 nt, Homo sapiens
caggcccaccuaccuucaaa

SEQ ID NO: 1998379 - RNA, 16 nt, Homo sapiens
augccauaugccuugg

SEQ ID NO: 1998380 - RNA, 19 nt, Homo sapiens
aucacaacgggccagcucu

SEQ ID NO: 1998381 - RNA, 22 nt, Homo sapiens
agccccuccccccaggcucagg

SEQ ID NO: 1998382 - RNA, 14 nt, Homo sapiens
gcauugcuuuccac

SEQ ID NO: 1998383 - RNA, 17 nt, Homo sapiens
auauaggggcaauguca

SEQ ID NO: 1998384 - RNA, 21 nt, Homo sapiens
ugaagaucggcuuucauguaa

SEQ ID NO: 1998385 - RNA, 16 nt, Homo sapiens
ucuacacugccuuacc

SEQ ID NO: 1998386 - RNA, 12 nt, Homo sapiens
ccaagcucugcu

SEQ ID NO: 1998387 - RNA, 15 nt, Homo sapiens
uguuuuuaauccagu

SEQ ID NO: 1998388 - RNA, 20 nt, Homo sapiens
ugacaaccgaguggcuguca

SEQ ID NO: 1998389 - RNA, 18 nt, Homo sapiens
uucccuaaaaucagggaa

SEQ ID NO: 1998390 - RNA, 15 nt, Homo sapiens
ccucuccuccagugu

SEQ ID NO: 1998391 - RNA, 19 nt, Homo sapiens
cgcgcuugcuggccagucc

SEQ ID NO: 1998392 - RNA, 14 nt, Homo sapiens
guuugcucuuuuaa

SEQ ID NO: 1998393 - RNA, 15 nt, Homo sapiens
aacugaacauuccag

SEQ ID NO: 1998394 - RNA, 18 nt, Homo sapiens
aauucucuucgcugugau

SEQ ID NO: 1998395 - RNA, 16 nt, Homo sapiens
ugccucagaagugcau

SEQ ID NO: 1998396 - RNA, 16 nt, Homo sapiens
agcucaucccucucac

SEQ ID NO: 1998397 - RNA, 19 nt, Homo sapiens
uaugcagauuauuugccca

SEQ ID NO: 1998398 - RNA, 15 nt, Homo sapiens
gacagcuuucuggga

SEQ ID NO: 1998399 - RNA, 17 nt, Homo sapiens
caaagcuuucauguaaa

SEQ ID NO: 1998400 - RNA, 16 nt, Homo sapiens
agccuuugcccuguca

SEQ ID NO: 1998401 - RNA, 18 nt, Homo sapiens
aauacuuugugucuuuug

SEQ ID NO: 1998402 - RNA, 21 nt, Homo sapiens
auagagaacgggaguggccau

SEQ ID NO: 1998403 - RNA, 21 nt, Homo sapiens
uuauaccuguacacacacaga

SEQ ID NO: 1998404 - RNA, 23 nt, Homo sapiens
aauacugguuauccugugcuaca

SEQ ID NO: 1998405 - RNA, 15 nt, Homo sapiens
agaacaaacucugaa

SEQ ID NO: 1998406 - RNA, 20 nt, Homo sapiens
ucauauuuauacuuugcaau

SEQ ID NO: 1998407 - RNA, 22 nt, Homo sapiens
aacuacugaacuguuaccuagg

SEQ ID NO: 1998408 - RNA, 23 nt, Homo sapiens
ucugucagugggccucaugguaa

SEQ ID NO: 1998409 - RNA, 20 nt, Homo sapiens
auaaaaugugugaugaauca

SEQ ID NO: 1998410 - RNA, 17 nt, Homo sapiens
aaugcugcgcuuaccuu

SEQ ID NO: 1998411 - RNA, 15 nt, Homo sapiens
uuaaagaacugcuua

SEQ ID NO: 1998412 - RNA, 15 nt, Homo sapiens
gagcauggacagugu

SEQ ID NO: 1998413 - RNA, 15 nt, Homo sapiens
ugucuugccagccag

SEQ ID NO: 1998414 - RNA, 10 nt, Homo sapiens
uuucuaagug

SEQ ID NO: 1998415 - RNA, 15 nt, Homo sapiens
cuuugacaaauugaa

SEQ ID NO: 1998416 - RNA, 21 nt, Homo sapiens
augccagagacggaagccuuu

SEQ ID NO: 1998417 - RNA, 13 nt, Homo sapiens
gcagaaagggaaa

SEQ ID NO: 1998418 - RNA, 13 nt, Homo sapiens
cggggaagccgag

SEQ ID NO: 1998419 - RNA, 19 nt, Homo sapiens
gguuccugagcucacugaa

SEQ ID NO: 1998420 - RNA, 13 nt, Homo sapiens
uuccaucaucucu

SEQ ID NO: 1998421 - RNA, 15 nt, Homo sapiens
cucccucccagagaa

SEQ ID NO: 1998422 - RNA, 20 nt, Homo sapiens
cagagacaauaaaacauucc

SEQ ID NO: 1998423 - RNA, 14 nt, Homo sapiens
uuaacauuccucau

SEQ ID NO: 1998424 - RNA, 16 nt, Homo sapiens
gaaggagaucagggca

SEQ ID NO: 1998425 - RNA, 15 nt, Homo sapiens
uguguugaaugaaga

SEQ ID NO: 1998426 - RNA, 19 nt, Homo sapiens
cuggagcccgagggccuga

SEQ ID NO: 1998427 - RNA, 15 nt, Homo sapiens
acuugcagguacuuu

SEQ ID NO: 1998428 - RNA, 21 nt, Homo sapiens
gagaguccagcuaacacacuu

SEQ ID NO: 1998429 - RNA, 17 nt, Homo sapiens
uggaugcagcacgccaa

SEQ ID NO: 1998430 - RNA, 15 nt, Homo sapiens
cagagcuggaccuga

SEQ ID NO: 1998431 - RNA, 23 nt, Homo sapiens
cauuuguuuugccaauuugcaca

SEQ ID NO: 1998432 - RNA, 14 nt, Homo sapiens
uuuucagaugugaa

SEQ ID NO: 1998433 - RNA, 17 nt, Homo sapiens
gaagccuauguaugcca

SEQ ID NO: 1998434 - RNA, 17 nt, Homo sapiens
cuucuuuccuuuccauu

SEQ ID NO: 1998435 - RNA, 15 nt, Homo sapiens
gugauuccauuuuac

SEQ ID NO: 1998436 - RNA, 19 nt, Homo sapiens
caaacuugugugauuauua

SEQ ID NO: 1998437 - RNA, 18 nt, Homo sapiens
agcaauggggaauacaag

SEQ ID NO: 1998438 - RNA, 23 nt, Homo sapiens
cauuuguuuaaauucacaucuca

SEQ ID NO: 1998439 - RNA, 21 nt, Homo sapiens
ucacccaggcuggagugcagu

SEQ ID NO: 1998440 - RNA, 21 nt, Homo sapiens
ucacccaggcuagagugcaau

SEQ ID NO: 1998441 - RNA, 11 nt, Homo sapiens
agaaucaucuu

SEQ ID NO: 1998442 - RNA, 21 nt, Homo sapiens
acucacugcaaccuucgccuc

SEQ ID NO: 1998443 - RNA, 15 nt, Homo sapiens
cauaaucucauucaa

SEQ ID NO: 1998444 - RNA, 15 nt, Homo sapiens
cccuaucucccacaa

SEQ ID NO: 1998445 - RNA, 13 nt, Homo sapiens
aguuugggggcag

SEQ ID NO: 1998446 - RNA, 13 nt, Homo sapiens
gggucgucugccc

SEQ ID NO: 1998447 - RNA, 22 nt, Homo sapiens
uguacuauccccaaacuccuuu

SEQ ID NO: 1998448 - RNA, 16 nt, Homo sapiens
cauaaaaacaacuuua

SEQ ID NO: 1998449 - RNA, 17 nt, Homo sapiens
aagcaucacacaguggc

SEQ ID NO: 1998450 - RNA, 23 nt, Homo sapiens
agcauguacaguguucuguuuaa

SEQ ID NO: 1998451 - RNA, 21 nt, Homo sapiens
acaacaugucaaagcugcaug

SEQ ID NO: 1998452 - RNA, 14 nt, Homo sapiens
cggucaugaugucu

SEQ ID NO: 1998453 - RNA, 18 nt, Homo sapiens
uuccuaaagccaucaugc

SEQ ID NO: 1998454 - RNA, 19 nt, Homo sapiens
agccgacucuuugauaugc

SEQ ID NO: 1998455 - RNA, 15 nt, Homo sapiens
cuccgcaggcccacu

SEQ ID NO: 1998456 - RNA, 15 nt, Homo sapiens
aaugaaaugccaaag

SEQ ID NO: 1998457 - RNA, 16 nt, Homo sapiens
cuucuuugcugcugcu

SEQ ID NO: 1998458 - RNA, 17 nt, Homo sapiens
gugggacccuucagcca

SEQ ID NO: 1998459 - RNA, 14 nt, Homo sapiens
caguccugguucag

SEQ ID NO: 1998460 - RNA, 18 nt, Homo sapiens
gguuggugcacagugauu

SEQ ID NO: 1998461 - RNA, 20 nt, Homo sapiens
aucaauuuuuauacauauca

SEQ ID NO: 1998462 - RNA, 18 nt, Homo sapiens
ggagacagugguagagag

SEQ ID NO: 1998463 - RNA, 20 nt, Homo sapiens
cucuccaggggucuugcaaa

SEQ ID NO: 1998464 - RNA, 21 nt, Homo sapiens
gaucuguuuuuaaaaaucaua

SEQ ID NO: 1998465 - RNA, 22 nt, Homo sapiens
ugcucaacaauuuauccauuca

SEQ ID NO: 1998466 - RNA, 21 nt, Homo sapiens
ucuggcuggguuuucaggggc

SEQ ID NO: 1998467 - RNA, 19 nt, Homo sapiens
gccuaacaugauuauuuga

SEQ ID NO: 1998468 - RNA, 23 nt, Homo sapiens
auacuauauugcuguaugguaua

SEQ ID NO: 1998469 - RNA, 14 nt, Homo sapiens
cugauugacugugc

SEQ ID NO: 1998470 - RNA, 17 nt, Homo sapiens
caugugcaaaugugcug

SEQ ID NO: 1998471 - RNA, 14 nt, Homo sapiens
cauuuggucucagg

SEQ ID NO: 1998472 - RNA, 13 nt, Homo sapiens
auuucuugugaug

SEQ ID NO: 1998473 - RNA, 15 nt, Homo sapiens
aauguuaaaugcaau

SEQ ID NO: 1998474 - RNA, 16 nt, Homo sapiens
aauacuaucucuguau

SEQ ID NO: 1998475 - RNA, 21 nt, Homo sapiens
cagauagcccaggagcaacag

SEQ ID NO: 1998476 - RNA, 16 nt, Homo sapiens
gugcaugcaugcccuc

SEQ ID NO: 1998477 - RNA, 13 nt, Homo sapiens
uccaucccaggcu

SEQ ID NO: 1998478 - RNA, 14 nt, Homo sapiens
acuccugacuucag

SEQ ID NO: 1998479 - RNA, 22 nt, Homo sapiens
uuauguaaagauaaauauucua

SEQ ID NO: 1998480 - RNA, 14 nt, Homo sapiens
ugguggcuacccaa

SEQ ID NO: 1998481 - RNA, 13 nt, Homo sapiens
gugauuucuugcu

SEQ ID NO: 1998482 - RNA, 14 nt, Homo sapiens
ccuccuuuucccaa

SEQ ID NO: 1998483 - RNA, 14 nt, Homo sapiens
ugaauugaggacua

SEQ ID NO: 1998484 - RNA, 19 nt, Homo sapiens
caaacuccagguuccugaa

SEQ ID NO: 1998485 - RNA, 17 nt, Homo sapiens
aauacuuauuauguaag

SEQ ID NO: 1998486 - RNA, 21 nt, Homo sapiens
uucaaauaauccauuccaaaa

SEQ ID NO: 1998487 - RNA, 20 nt, Homo sapiens
gcggugacucaugccuguaa

SEQ ID NO: 1998488 - RNA, 15 nt, Homo sapiens
uauuuuucuuuccaa

SEQ ID NO: 1998489 - RNA, 19 nt, Homo sapiens
caagaauauuguauguuaa

SEQ ID NO: 1998490 - RNA, 12 nt, Homo sapiens
gcauaguacuca

SEQ ID NO: 1998491 - RNA, 15 nt, Homo sapiens
cuuauccacaaagua

SEQ ID NO: 1998492 - RNA, 13 nt, Homo sapiens
gaaauuucacuuc

SEQ ID NO: 1998493 - RNA, 19 nt, Homo sapiens
gaucacuuuguuaaaaaua

SEQ ID NO: 1998494 - RNA, 15 nt, Homo sapiens
ugaggggcucucuca

SEQ ID NO: 1998495 - RNA, 13 nt, Homo sapiens
accuccaggggcu

SEQ ID NO: 1998496 - RNA, 17 nt, Homo sapiens
caucuaacaaagucaag

SEQ ID NO: 1998497 - RNA, 21 nt, Homo sapiens
gcucaacggcuccaucaccag

SEQ ID NO: 1998498 - RNA, 18 nt, Homo sapiens
ugcuuauccuuccacgga

SEQ ID NO: 1998499 - RNA, 11 nt, Homo sapiens
ugcugccaggc

SEQ ID NO: 1998500 - RNA, 17 nt, Homo sapiens
caggugauaauggaucc

SEQ ID NO: 1998501 - RNA, 13 nt, Homo sapiens
ugucucuguuauc

SEQ ID NO: 1998502 - RNA, 17 nt, Homo sapiens
uuccauuaugaggaaac

SEQ ID NO: 1998503 - RNA, 18 nt, Homo sapiens
gcuuuuugccaucuguga

SEQ ID NO: 1998504 - RNA, 17 nt, Homo sapiens
aucguggagacagggca

SEQ ID NO: 1998505 - RNA, 17 nt, Homo sapiens
ccagugaccaaaccuca

SEQ ID NO: 1998506 - RNA, 15 nt, Homo sapiens
uaaaccuucagauua

SEQ ID NO: 1998507 - RNA, 21 nt, Homo sapiens
acagccccggaaugcuuccag

SEQ ID NO: 1998508 - RNA, 12 nt, Homo sapiens
caggcaugggca

SEQ ID NO: 1998509 - RNA, 21 nt, Homo sapiens
gcagagcggguaaagugcaau

SEQ ID NO: 1998510 - RNA, 19 nt, Homo sapiens
ccaaguaguccaccuucau

SEQ ID NO: 1998511 - RNA, 21 nt, Homo sapiens
ucaaaacgacucuaaacacac

SEQ ID NO: 1998512 - RNA, 14 nt, Homo sapiens
augcagacauguau

SEQ ID NO: 1998513 - RNA, 14 nt, Homo sapiens
uuuuauacuuucag

SEQ ID NO: 1998514 - RNA, 15 nt, Homo sapiens
gacaguauccacaau

SEQ ID NO: 1998515 - RNA, 15 nt, Homo sapiens
gucugucuacugugg

SEQ ID NO: 1998516 - RNA, 12 nt, Homo sapiens
ucaucuugccuc

SEQ ID NO: 1998517 - RNA, 16 nt, Homo sapiens
ucuaccuggucucucc

SEQ ID NO: 1998518 - RNA, 13 nt, Homo sapiens
cccucucugccag

SEQ ID NO: 1998519 - RNA, 13 nt, Homo sapiens
ucauccaaggaac

SEQ ID NO: 1998520 - RNA, 17 nt, Homo sapiens
uccaaaugcugugcaaa

SEQ ID NO: 1998521 - RNA, 14 nt, Homo sapiens
ucaaaccaggauuu

SEQ ID NO: 1998522 - RNA, 19 nt, Homo sapiens
caggguggcugugguccua

SEQ ID NO: 1998523 - RNA, 16 nt, Homo sapiens
ugcugcuacaaugucc

SEQ ID NO: 1998524 - RNA, 17 nt, Homo sapiens
cacaaauuauacuuuau

SEQ ID NO: 1998525 - RNA, 15 nt, Homo sapiens
gauggugcuggguaa

SEQ ID NO: 1998526 - RNA, 23 nt, Homo sapiens
uuucccuucagucuucuucacuu

SEQ ID NO: 1998527 - RNA, 18 nt, Homo sapiens
ugugauggauggacacaa

SEQ ID NO: 1998528 - RNA, 15 nt, Homo sapiens
aaguacuguuuugaa

SEQ ID NO: 1998529 - RNA, 14 nt, Homo sapiens
ucugugcaacaaac

SEQ ID NO: 1998530 - RNA, 11 nt, Homo sapiens
uguucuugggg

SEQ ID NO: 1998531 - RNA, 12 nt, Homo sapiens
ucaaugggaccu

SEQ ID NO: 1998532 - RNA, 18 nt, Homo sapiens
ucuaaggcaggaauuuga

SEQ ID NO: 1998533 - RNA, 15 nt, Homo sapiens
uaauuuguaagaaua

SEQ ID NO: 1998534 - RNA, 15 nt, Homo sapiens
agcuggagccuggga

SEQ ID NO: 1998535 - RNA, 18 nt, Homo sapiens
ccuggaaucuacaagcca

SEQ ID NO: 1998536 - RNA, 20 nt, Homo sapiens
ugagaacuucucuucccaua

SEQ ID NO: 1998537 - RNA, 15 nt, Homo sapiens
acccuggaaauggac

SEQ ID NO: 1998538 - RNA, 15 nt, Homo sapiens
agaaaugucaugugg

SEQ ID NO: 1998539 - RNA, 14 nt, Homo sapiens
aaccaauguagcac

SEQ ID NO: 1998540 - RNA, 18 nt, Homo sapiens
ggccucagggcgcucaga

SEQ ID NO: 1998541 - RNA, 16 nt, Homo sapiens
aaacagucaucuagaa

SEQ ID NO: 1998542 - RNA, 12 nt, Homo sapiens
acuccacauccu

SEQ ID NO: 1998543 - RNA, 14 nt, Homo sapiens
ggagacgggggcag

SEQ ID NO: 1998544 - RNA, 19 nt, Homo sapiens
ucuauauaugaagugaaaa

SEQ ID NO: 1998545 - RNA, 18 nt, Homo sapiens
cuaaaagucagcuuuacu

SEQ ID NO: 1998546 - RNA, 18 nt, Homo sapiens
cagcagugucuguaccuc

SEQ ID NO: 1998547 - RNA, 13 nt, Homo sapiens
agcacaaacuguc

SEQ ID NO: 1998548 - RNA, 23 nt, Homo sapiens
gccaugggaugucaacagccaua

SEQ ID NO: 1998549 - RNA, 16 nt, Homo sapiens
guccacuuuacucaaa

SEQ ID NO: 1998550 - RNA, 21 nt, Homo sapiens
cucuggucgccgcacuucuga

SEQ ID NO: 1998551 - RNA, 17 nt, Homo sapiens
cuuuuaagucuuccacc

SEQ ID NO: 1998552 - RNA, 19 nt, Homo sapiens
ucgacuuccccggccacaa

SEQ ID NO: 1998553 - RNA, 16 nt, Homo sapiens
cgugaggcagggacaa

SEQ ID NO: 1998554 - RNA, 13 nt, Homo sapiens
gccauccaggguc

SEQ ID NO: 1998555 - RNA, 21 nt, Homo sapiens
ucugccccucccugcuucaau

SEQ ID NO: 1998556 - RNA, 20 nt, Homo sapiens
aggggauggagugagcccau

SEQ ID NO: 1998557 - RNA, 17 nt, Homo sapiens
gaucuuguuaaugcauu

SEQ ID NO: 1998558 - RNA, 20 nt, Homo sapiens
gaagaagaugguaccaccag

SEQ ID NO: 1998559 - RNA, 19 nt, Homo sapiens
ugcuauacuggauacucug

SEQ ID NO: 1998560 - RNA, 19 nt, Homo sapiens
auaccagcuuuuucucuca

SEQ ID NO: 1998561 - RNA, 23 nt, Homo sapiens
aaguuucuucuuuaggcauuaaa

SEQ ID NO: 1998562 - RNA, 14 nt, Homo sapiens
ucaaaaugcuuuuu

SEQ ID NO: 1998563 - RNA, 23 nt, Homo sapiens
uucauuuggcauuccccacuuga

SEQ ID NO: 1998564 - RNA, 14 nt, Homo sapiens
uaaaauuccaugga

SEQ ID NO: 1998565 - RNA, 22 nt, Homo sapiens
ugcacuguuuauguuacaguga

SEQ ID NO: 1998566 - RNA, 18 nt, Homo sapiens
cuauaaugguuggaacua

SEQ ID NO: 1998567 - RNA, 16 nt, Homo sapiens
ugaaaccuuucuacuu

SEQ ID NO: 1998568 - RNA, 22 nt, Homo sapiens
aauugcuucuguguagucaaua

SEQ ID NO: 1998569 - RNA, 19 nt, Homo sapiens
aaguacuguaauaauaccu

SEQ ID NO: 1998570 - RNA, 20 nt, Homo sapiens
ugggccucagccuccaggca

SEQ ID NO: 1998571 - RNA, 15 nt, Homo sapiens
aaucgcagccagcuu

SEQ ID NO: 1998572 - RNA, 15 nt, Homo sapiens
ggcaaugacugugag

SEQ ID NO: 1998573 - RNA, 20 nt, Homo sapiens
uauuccugacccucccuacc

SEQ ID NO: 1998574 - RNA, 23 nt, Homo sapiens
ucaacguuuuuggacacugugcu

SEQ ID NO: 1998575 - RNA, 13 nt, Homo sapiens
gagacugggucuc

SEQ ID NO: 1998576 - RNA, 15 nt, Homo sapiens
gcaucuccccaaaaa

SEQ ID NO: 1998577 - RNA, 18 nt, Homo sapiens
augagaacaaagcuguua

SEQ ID NO: 1998578 - RNA, 13 nt, Homo sapiens
agagcaagggcuu

SEQ ID NO: 1998579 - RNA, 19 nt, Homo sapiens
auauuaagacaauagcacu

SEQ ID NO: 1998580 - RNA, 19 nt, Homo sapiens
acauuuguuccugggacug

SEQ ID NO: 1998581 - RNA, 18 nt, Homo sapiens
gauccaaacccaucuucc

SEQ ID NO: 1998582 - RNA, 20 nt, Homo sapiens
aauucacccccuuuccugga

SEQ ID NO: 1998583 - RNA, 20 nt, Homo sapiens
acugcaaucaugugcuucau

SEQ ID NO: 1998584 - RNA, 12 nt, Homo sapiens
cugcaguuauuu

SEQ ID NO: 1998585 - RNA, 21 nt, Homo sapiens
uuuucuaauuaaagaugguuu

SEQ ID NO: 1998586 - RNA, 19 nt, Homo sapiens
gccagcaccugcccagugg

SEQ ID NO: 1998587 - RNA, 20 nt, Homo sapiens
ucauuuauuuacaugugauu

SEQ ID NO: 1998588 - RNA, 20 nt, Homo sapiens
ucugauuuauguuuugauca

SEQ ID NO: 1998589 - RNA, 21 nt, Homo sapiens
cgugagcaugcacacugagaa

SEQ ID NO: 1998590 - RNA, 18 nt, Homo sapiens
gauauaguagccaugaca

SEQ ID NO: 1998591 - RNA, 18 nt, Homo sapiens
caggagaauagcugagaa

SEQ ID NO: 1998592 - RNA, 15 nt, Homo sapiens
ugccaguaggcucaa

SEQ ID NO: 1998593 - RNA, 22 nt, Homo sapiens
ccuggcauggugcagggagaca

SEQ ID NO: 1998594 - RNA, 22 nt, Homo sapiens
gcaccaaaaaacuaaagcaguu

SEQ ID NO: 1998595 - RNA, 14 nt, Homo sapiens
guccacaguggaac

SEQ ID NO: 1998596 - RNA, 13 nt, Homo sapiens
gccaagugugccc

SEQ ID NO: 1998597 - RNA, 19 nt, Homo sapiens
acagagcucuccagcucca

SEQ ID NO: 1998598 - RNA, 15 nt, Homo sapiens
cugguaaauugccau

SEQ ID NO: 1998599 - RNA, 14 nt, Homo sapiens
agccaaauuuccag

SEQ ID NO: 1998600 - RNA, 19 nt, Homo sapiens
uggaagccucuauugccau

SEQ ID NO: 1998601 - RNA, 13 nt, Homo sapiens
guggcccuguccu

SEQ ID NO: 1998602 - RNA, 22 nt, Homo sapiens
gguaagguuuucaagguggcaa

SEQ ID NO: 1998603 - RNA, 17 nt, Homo sapiens
cacagcuuuucuugaua

SEQ ID NO: 1998604 - RNA, 12 nt, Homo sapiens
uuguuuuccacu

SEQ ID NO: 1998605 - RNA, 19 nt, Homo sapiens
gccuugcaauuagcauucu

SEQ ID NO: 1998606 - RNA, 19 nt, Homo sapiens
aacaucauuauuggcaguu

SEQ ID NO: 1998607 - RNA, 22 nt, Homo sapiens
acaaagccacuuucaaucuuca

SEQ ID NO: 1998608 - RNA, 20 nt, Homo sapiens
gcuuaacgcacuaacccagc

SEQ ID NO: 1998609 - RNA, 17 nt, Homo sapiens
uaaacauauuggaaugu

SEQ ID NO: 1998610 - RNA, 13 nt, Homo sapiens
guucuacacugau

SEQ ID NO: 1998611 - RNA, 20 nt, Homo sapiens
accaagcugguggcucugug

SEQ ID NO: 1998612 - RNA, 21 nt, Homo sapiens
acacaauaggucuuucucuca

SEQ ID NO: 1998613 - RNA, 11 nt, Homo sapiens
uuuucccaaag

SEQ ID NO: 1998614 - RNA, 23 nt, Homo sapiens
ugacuggcagggcuuugggcagu

SEQ ID NO: 1998615 - RNA, 19 nt, Homo sapiens
ccuggagaaaggauggcag

SEQ ID NO: 1998616 - RNA, 22 nt, Homo sapiens
agccucccaaguagcugagacu

SEQ ID NO: 1998617 - RNA, 14 nt, Homo sapiens
gaauucauguuggu

SEQ ID NO: 1998618 - RNA, 14 nt, Homo sapiens
acaguuugcuuauu

SEQ ID NO: 1998619 - RNA, 16 nt, Homo sapiens
cucugauuuacauuca

SEQ ID NO: 1998620 - RNA, 20 nt, Homo sapiens
aaaggaagcuccacugucac

SEQ ID NO: 1998621 - RNA, 18 nt, Homo sapiens
accagaguggaaauucau

SEQ ID NO: 1998622 - RNA, 20 nt, Homo sapiens
caacaaauuucauugcacuu

SEQ ID NO: 1998623 - RNA, 21 nt, Homo sapiens
agucuucuaccaaauguguaa

SEQ ID NO: 1998624 - RNA, 20 nt, Homo sapiens
agggcgagacucugucucaa

SEQ ID NO: 1998625 - RNA, 16 nt, Homo sapiens
gcacuuuaaacauuua

SEQ ID NO: 1998626 - RNA, 14 nt, Homo sapiens
cagaccugcuuccu

SEQ ID NO: 1998627 - RNA, 17 nt, Homo sapiens
uccaucagcuguaagaa

SEQ ID NO: 1998628 - RNA, 12 nt, Homo sapiens
agacguggugcu

SEQ ID NO: 1998629 - RNA, 18 nt, Homo sapiens
ccuuggucccaagccuga

SEQ ID NO: 1998630 - RNA, 20 nt, Homo sapiens
acauuuuauucuucuaauua

SEQ ID NO: 1998631 - RNA, 17 nt, Homo sapiens
cuccauccuugcaucac

SEQ ID NO: 1998632 - RNA, 17 nt, Homo sapiens
cauuuugcauuccugca

SEQ ID NO: 1998633 - RNA, 16 nt, Homo sapiens
gugacaugugcagugc

SEQ ID NO: 1998634 - RNA, 15 nt, Homo sapiens
gaaaaaucaggcaga

SEQ ID NO: 1998635 - RNA, 16 nt, Homo sapiens
cugagaauguggaaua

SEQ ID NO: 1998636 - RNA, 17 nt, Homo sapiens
aauggucucuaccuaau

SEQ ID NO: 1998637 - RNA, 17 nt, Homo sapiens
ccucaugaucauucuca

SEQ ID NO: 1998638 - RNA, 17 nt, Homo sapiens
cagauaaaccugugacu

SEQ ID NO: 1998639 - RNA, 18 nt, Homo sapiens
ugcaaucaugugcuucau

SEQ ID NO: 1998640 - RNA, 14 nt, Homo sapiens
ccauugugcauucu

SEQ ID NO: 1998641 - RNA, 19 nt, Homo sapiens
ugcaguacauuaauauuca

SEQ ID NO: 1998642 - RNA, 19 nt, Homo sapiens
ucgagaacacaaaaugaca

SEQ ID NO: 1998643 - RNA, 16 nt, Homo sapiens
ugagaauuguauguca

SEQ ID NO: 1998644 - RNA, 20 nt, Homo sapiens
acuaauagcuugaacccuuu

SEQ ID NO: 1998645 - RNA, 16 nt, Homo sapiens
accacgguuucagcuu

SEQ ID NO: 1998646 - RNA, 22 nt, Homo sapiens
auuaaugacaaaggcacugagg

SEQ ID NO: 1998647 - RNA, 21 nt, Homo sapiens
gggaaccauugagcuuggcaa

SEQ ID NO: 1998648 - RNA, 14 nt, Homo sapiens
guuucuuuuugcca

SEQ ID NO: 1998649 - RNA, 22 nt, Homo sapiens
caguagucccugcacagugacu

SEQ ID NO: 1998650 - RNA, 17 nt, Homo sapiens
caccccuuuucgucacg

SEQ ID NO: 1998651 - RNA, 18 nt, Homo sapiens
cacugcaugucagagcac

SEQ ID NO: 1998652 - RNA, 22 nt, Homo sapiens
aaaauagggaaguaacaguaac

SEQ ID NO: 1998653 - RNA, 22 nt, Homo sapiens
caaguccucagugguuggcaau

SEQ ID NO: 1998654 - RNA, 22 nt, Homo sapiens
agcccacagaggcauauccugc

SEQ ID NO: 1998655 - RNA, 20 nt, Homo sapiens
cuccccugggcccaucucaa

SEQ ID NO: 1998656 - RNA, 17 nt, Homo sapiens
accaguggccuuacccc

SEQ ID NO: 1998657 - RNA, 23 nt, Homo sapiens
auucagacagagacuuuaaucac

SEQ ID NO: 1998658 - RNA, 19 nt, Homo sapiens
ugaguaucacuuuaacuca

SEQ ID NO: 1998659 - RNA, 22 nt, Homo sapiens
uauauuuuuuucaacugccaau

SEQ ID NO: 1998660 - RNA, 15 nt, Homo sapiens
ugcucuuuguggcag

SEQ ID NO: 1998661 - RNA, 18 nt, Homo sapiens
ucuggaagaucugcaaac

SEQ ID NO: 1998662 - RNA, 16 nt, Homo sapiens
agguguuacuagaagg

SEQ ID NO: 1998663 - RNA, 19 nt, Homo sapiens
ccucauuccuucccagaga

SEQ ID NO: 1998664 - RNA, 21 nt, Homo sapiens
aacagcaaaacuccaucucaa

SEQ ID NO: 1998665 - RNA, 22 nt, Homo sapiens
acagccguggggggaagcacau

SEQ ID NO: 1998666 - RNA, 13 nt, Homo sapiens
aauguuaagcaga

SEQ ID NO: 1998667 - RNA, 13 nt, Homo sapiens
uccaagcccguuc

SEQ ID NO: 1998668 - RNA, 19 nt, Homo sapiens
gccauggacucuacacugu

SEQ ID NO: 1998669 - RNA, 15 nt, Homo sapiens
ccugacugccaagcc

SEQ ID NO: 1998670 - RNA, 13 nt, Homo sapiens
aauguauaaagau

SEQ ID NO: 1998671 - RNA, 18 nt, Homo sapiens
gaggaaauuagcauuccu

SEQ ID NO: 1998672 - RNA, 14 nt, Homo sapiens
acaaacguuguccu

SEQ ID NO: 1998673 - RNA, 18 nt, Homo sapiens
gccaggggcaggcagcua

SEQ ID NO: 1998674 - RNA, 20 nt, Homo sapiens
aguccuaucugggcuuccug

SEQ ID NO: 1998675 - RNA, 16 nt, Homo sapiens
aagagggucugcauuu

SEQ ID NO: 1998676 - RNA, 12 nt, Homo sapiens
gcguucaaagag

SEQ ID NO: 1998677 - RNA, 10 nt, Homo sapiens
agagcucuua

SEQ ID NO: 1998678 - RNA, 13 nt, Homo sapiens
aauuauguagcuc

SEQ ID NO: 1998679 - RNA, 17 nt, Homo sapiens
ugaacucagaccacuug

SEQ ID NO: 1998680 - RNA, 21 nt, Homo sapiens
uuggugagaaaucguugcugc

SEQ ID NO: 1998681 - RNA, 17 nt, Homo sapiens
augacagccagagccug

SEQ ID NO: 1998682 - RNA, 22 nt, Homo sapiens
gccaugugugagucacuucuac

SEQ ID NO: 1998683 - RNA, 17 nt, Homo sapiens
gaggccucauccagggc

SEQ ID NO: 1998684 - RNA, 17 nt, Homo sapiens
gacuggcgugcugagaa

SEQ ID NO: 1998685 - RNA, 23 nt, Homo sapiens
aguuuaucuuggccuuacuguau

SEQ ID NO: 1998686 - RNA, 17 nt, Homo sapiens
caugcugaaaacuacac

SEQ ID NO: 1998687 - RNA, 18 nt, Homo sapiens
ggcccaagcaugccccac

SEQ ID NO: 1998688 - RNA, 10 nt, Homo sapiens
ccauguccaa

SEQ ID NO: 1998689 - RNA, 21 nt, Homo sapiens
cugcugaauguaguauuuggc

SEQ ID NO: 1998690 - RNA, 20 nt, Homo sapiens
acccacaaauaaaugacaag

SEQ ID NO: 1998691 - RNA, 18 nt, Homo sapiens
gguucugaguucugguga

SEQ ID NO: 1998692 - RNA, 17 nt, Homo sapiens
aauccagacucuuucga

SEQ ID NO: 1998693 - RNA, 18 nt, Homo sapiens
cccuacccccaguaaaau

SEQ ID NO: 1998694 - RNA, 21 nt, Homo sapiens
cugccuguuggcaggcccacu

SEQ ID NO: 1998695 - RNA, 15 nt, Homo sapiens
acuucugucuucaca

SEQ ID NO: 1998696 - RNA, 14 nt, Homo sapiens
ccuaaaauacuuau

SEQ ID NO: 1998697 - RNA, 16 nt, Homo sapiens
agauccuauagcucuu

SEQ ID NO: 1998698 - RNA, 15 nt, Homo sapiens
auggcuuuugugcau

SEQ ID NO: 1998699 - RNA, 12 nt, Homo sapiens
caucaucuaugg

SEQ ID NO: 1998700 - RNA, 17 nt, Homo sapiens
ggccuucccauggccau

SEQ ID NO: 1998701 - RNA, 21 nt, Homo sapiens
gcugauuucaaaugcagucca

SEQ ID NO: 1998702 - RNA, 20 nt, Homo sapiens
ccauggcagacucaccaccu

SEQ ID NO: 1998703 - RNA, 17 nt, Homo sapiens
caggcguacacaugcac

SEQ ID NO: 1998704 - RNA, 21 nt, Homo sapiens
uauucucuuugugaggacaaa

SEQ ID NO: 1998705 - RNA, 21 nt, Homo sapiens
uaacaaauguuuucauuuaca

SEQ ID NO: 1998706 - RNA, 15 nt, Homo sapiens
cgagaggcaggucaa

SEQ ID NO: 1998707 - RNA, 13 nt, Homo sapiens
uccugcacugucc

SEQ ID NO: 1998708 - RNA, 18 nt, Homo sapiens
aaaaugugugaugaauca

SEQ ID NO: 1998709 - RNA, 23 nt, Homo sapiens
aaaauccuggaagacaacccagg

SEQ ID NO: 1998710 - RNA, 14 nt, Homo sapiens
cugccugcagagca

SEQ ID NO: 1998711 - RNA, 20 nt, Homo sapiens
ucuggaccaugcugagacau

SEQ ID NO: 1998712 - RNA, 22 nt, Homo sapiens
ucuuuacaagauggguccagga

SEQ ID NO: 1998713 - RNA, 16 nt, Homo sapiens
aaucucaugauuccau

SEQ ID NO: 1998714 - RNA, 23 nt, Homo sapiens
ugagacuuaaaacauggugccua

SEQ ID NO: 1998715 - RNA, 20 nt, Homo sapiens
uaauucccaaucccauuccu

SEQ ID NO: 1998716 - RNA, 19 nt, Homo sapiens
aauuuaccugguacuaaac

SEQ ID NO: 1998717 - RNA, 21 nt, Homo sapiens
gacacgugauggaccaaagcc

SEQ ID NO: 1998718 - RNA, 21 nt, Homo sapiens
cacuccaguggcagacaaaca

SEQ ID NO: 1998719 - RNA, 17 nt, Homo sapiens
aagggcugaguguccag

SEQ ID NO: 1998720 - RNA, 14 nt, Homo sapiens
uguccaaacccacu

SEQ ID NO: 1998721 - RNA, 14 nt, Homo sapiens
uggaaauaaagcuu

SEQ ID NO: 1998722 - RNA, 17 nt, Homo sapiens
cugauaagcuuccuaga

SEQ ID NO: 1998723 - RNA, 18 nt, Homo sapiens
aaugcaucacauauucau

SEQ ID NO: 1998724 - RNA, 12 nt, Homo sapiens
gucccuugcccc

SEQ ID NO: 1998725 - RNA, 17 nt, Homo sapiens
cuaauaaaucuguggau

SEQ ID NO: 1998726 - RNA, 21 nt, Homo sapiens
auaacguuagagaaacugaaa

SEQ ID NO: 1998727 - RNA, 18 nt, Homo sapiens
gucccagaagaugaaaaa

SEQ ID NO: 1998728 - RNA, 19 nt, Homo sapiens
gugccuauggguuguuaau

SEQ ID NO: 1998729 - RNA, 23 nt, Homo sapiens
acuaucaagagaguaaacagaca

SEQ ID NO: 1998730 - RNA, 13 nt, Homo sapiens
guucucuauacuc

SEQ ID NO: 1998731 - RNA, 21 nt, Homo sapiens
uagggucaggcggggugcugu

SEQ ID NO: 1998732 - RNA, 23 nt, Homo sapiens
aggauauaguuaucaaucucuag

SEQ ID NO: 1998733 - RNA, 22 nt, Homo sapiens
aaauuuaggaccaauaccuccu

SEQ ID NO: 1998734 - RNA, 23 nt, Homo sapiens
uuguuuuauccacaacuuuucaa

SEQ ID NO: 1998735 - RNA, 19 nt, Homo sapiens
cucuagaagugccaucuca

SEQ ID NO: 1998736 - RNA, 21 nt, Homo sapiens
ccaauccuuaaauaugugaaa

SEQ ID NO: 1998737 - RNA, 17 nt, Homo sapiens
auucuuaaaaugcaaua

SEQ ID NO: 1998738 - RNA, 17 nt, Homo sapiens
agucuauguucaaagac

SEQ ID NO: 1998739 - RNA, 18 nt, Homo sapiens
cugugcccucagauuccg

SEQ ID NO: 1998740 - RNA, 16 nt, Homo sapiens
gacuguggccuguuaa

SEQ ID NO: 1998741 - RNA, 14 nt, Homo sapiens
auaagaccacuaca

SEQ ID NO: 1998742 - RNA, 14 nt, Homo sapiens
cccugaagugccag

SEQ ID NO: 1998743 - RNA, 16 nt, Homo sapiens
agugcaauugcacaaa

SEQ ID NO: 1998744 - RNA, 19 nt, Homo sapiens
guggcuuguaucaacacug

SEQ ID NO: 1998745 - RNA, 23 nt, Homo sapiens
gugagcuauaauguuucccucaa

SEQ ID NO: 1998746 - RNA, 14 nt, Homo sapiens
ucucaauaguaaaa

SEQ ID NO: 1998747 - RNA, 19 nt, Homo sapiens
uuuggcaagcucuaucacc

SEQ ID NO: 1998748 - RNA, 13 nt, Homo sapiens
aagaaccaaaaaa

SEQ ID NO: 1998749 - RNA, 16 nt, Homo sapiens
aaauuguuuuuacuga

SEQ ID NO: 1998750 - RNA, 22 nt, Homo sapiens
gacacagcuuuaucaccagaga

SEQ ID NO: 1998751 - RNA, 21 nt, Homo sapiens
uauucauuggcagcucaaaga

SEQ ID NO: 1998752 - RNA, 23 nt, Homo sapiens
caaggaagccucggcagaugugg

SEQ ID NO: 1998753 - RNA, 23 nt, Homo sapiens
ugacacucaagucccccaagacc

SEQ ID NO: 1998754 - RNA, 17 nt, Homo sapiens
ggccucuggacuggccu

SEQ ID NO: 1998755 - RNA, 15 nt, Homo sapiens
ggcucaaccacacac

SEQ ID NO: 1998756 - RNA, 18 nt, Homo sapiens
uugcuucuccagugguga

SEQ ID NO: 1998757 - RNA, 15 nt, Homo sapiens
ugcccucucugccag

SEQ ID NO: 1998758 - RNA, 22 nt, Homo sapiens
caaacuaacaggaacaaaauga

SEQ ID NO: 1998759 - RNA, 13 nt, Homo sapiens
agauagcugccac

SEQ ID NO: 1998760 - RNA, 12 nt, Homo sapiens
ggaacucuggag

SEQ ID NO: 1998761 - RNA, 23 nt, Homo sapiens
ucuuuucugcaucaucuguagau

SEQ ID NO: 1998762 - RNA, 18 nt, Homo sapiens
ggacuguggugacuuugg

SEQ ID NO: 1998763 - RNA, 16 nt, Homo sapiens
uggugauuccugggaa

SEQ ID NO: 1998764 - RNA, 13 nt, Homo sapiens
agccaccuagucc

SEQ ID NO: 1998765 - RNA, 15 nt, Homo sapiens
uuggagcucuaucca

SEQ ID NO: 1998766 - RNA, 19 nt, Homo sapiens
cacgacugcccggcagggu

SEQ ID NO: 1998767 - RNA, 19 nt, Homo sapiens
ccuggucccuuggagacaa

SEQ ID NO: 1998768 - RNA, 19 nt, Homo sapiens
agaggcuucuccaaaggga

SEQ ID NO: 1998769 - RNA, 22 nt, Homo sapiens
guggguccaggggccccuccag

SEQ ID NO: 1998770 - RNA, 14 nt, Homo sapiens
gcgucuggcacacu

SEQ ID NO: 1998771 - RNA, 20 nt, Homo sapiens
cuggccacauucaccaacca

SEQ ID NO: 1998772 - RNA, 12 nt, Homo sapiens
gggccccucucc

SEQ ID NO: 1998773 - RNA, 23 nt, Homo sapiens
guucugugcauauaguguuguau

SEQ ID NO: 1998774 - RNA, 16 nt, Homo sapiens
cuguccucauucuucu

SEQ ID NO: 1998775 - RNA, 21 nt, Homo sapiens
aacuaaaguuagaaaguugau

SEQ ID NO: 1998776 - RNA, 17 nt, Homo sapiens
gauaaaugauagacaau

SEQ ID NO: 1998777 - RNA, 18 nt, Homo sapiens
gacuuucuccaaaggcac

SEQ ID NO: 1998778 - RNA, 16 nt, Homo sapiens
cuucaguuguuuuccc

SEQ ID NO: 1998779 - RNA, 18 nt, Homo sapiens
uccaguuucccaccaccu

SEQ ID NO: 1998780 - RNA, 18 nt, Homo sapiens
aaaaccugugugccauuu

SEQ ID NO: 1998781 - RNA, 15 nt, Homo sapiens
auagagccacguaug

SEQ ID NO: 1998782 - RNA, 17 nt, Homo sapiens
ugcucccagcucuaaaa

SEQ ID NO: 1998783 - RNA, 18 nt, Homo sapiens
gacaucagauccugggca

SEQ ID NO: 1998784 - RNA, 16 nt, Homo sapiens
aagcuuccauaguggu

SEQ ID NO: 1998785 - RNA, 22 nt, Homo sapiens
uuuauucccaaguaugccuuaa

SEQ ID NO: 1998786 - RNA, 18 nt, Homo sapiens
cauguuuagauuccagga

SEQ ID NO: 1998787 - RNA, 15 nt, Homo sapiens
guauaacugaguuaa

SEQ ID NO: 1998788 - RNA, 20 nt, Homo sapiens
guaccuacagagcagccagg

SEQ ID NO: 1998789 - RNA, 19 nt, Homo sapiens
aggggccgcccuuggcucc

SEQ ID NO: 1998790 - RNA, 16 nt, Homo sapiens
cccucuucauggaugg

SEQ ID NO: 1998791 - RNA, 18 nt, Homo sapiens
aggcuaaaugagauacac

SEQ ID NO: 1998792 - RNA, 15 nt, Homo sapiens
gcaagcagugcccuc

SEQ ID NO: 1998793 - RNA, 19 nt, Homo sapiens
aguaauucuagacauaacu

SEQ ID NO: 1998794 - RNA, 14 nt, Homo sapiens
uucaagcuauuuaa

SEQ ID NO: 1998795 - RNA, 22 nt, Homo sapiens
augcccuguugguuucacagau

SEQ ID NO: 1998796 - RNA, 18 nt, Homo sapiens
auggcuuguucucuggaa

SEQ ID NO: 1998797 - RNA, 18 nt, Homo sapiens
cauaaucccagcacuuug

SEQ ID NO: 1998798 - RNA, 14 nt, Homo sapiens
uuggaugucuguag

SEQ ID NO: 1998799 - RNA, 22 nt, Homo sapiens
ucacuccccaaggaagagccaa

SEQ ID NO: 1998800 - RNA, 17 nt, Homo sapiens
uaugaaugugaagccuu

SEQ ID NO: 1998801 - RNA, 22 nt, Homo sapiens
acaggaucuuuggucuacucua

SEQ ID NO: 1998802 - RNA, 15 nt, Homo sapiens
caaucgucucagccu

SEQ ID NO: 1998803 - RNA, 17 nt, Homo sapiens
guuuuuaauguucacau

SEQ ID NO: 1998804 - RNA, 17 nt, Homo sapiens
cagacucacauccugac

SEQ ID NO: 1998805 - RNA, 17 nt, Homo sapiens
uugauagauuucuacac

SEQ ID NO: 1998806 - RNA, 20 nt, Homo sapiens
gcuaguguuguauuucuaua

SEQ ID NO: 1998807 - RNA, 14 nt, Homo sapiens
aagugguacuugau

SEQ ID NO: 1998808 - RNA, 16 nt, Homo sapiens
gcuuaaauugucagau

SEQ ID NO: 1998809 - RNA, 21 nt, Homo sapiens
agcuggaacacaauaaugugu

SEQ ID NO: 1998810 - RNA, 16 nt, Homo sapiens
guggccuagcacuggu

SEQ ID NO: 1998811 - RNA, 15 nt, Homo sapiens
uggccugaaaccagu

SEQ ID NO: 1998812 - RNA, 13 nt, Homo sapiens
ccugaacuugccu

SEQ ID NO: 1998813 - RNA, 21 nt, Homo sapiens
ugucagcuuccccaggagcuc

SEQ ID NO: 1998814 - RNA, 22 nt, Homo sapiens
uguccccgccgggcagugucac

SEQ ID NO: 1998815 - RNA, 19 nt, Homo sapiens
acccugagcagaauacugg

SEQ ID NO: 1998816 - RNA, 20 nt, Homo sapiens
cagaguaaauagcauucucu

SEQ ID NO: 1998817 - RNA, 16 nt, Homo sapiens
ggugggggugcucucu

SEQ ID NO: 1998818 - RNA, 20 nt, Homo sapiens
auagcaaagaggcuguuaua

SEQ ID NO: 1998819 - RNA, 22 nt, Homo sapiens
uugauucacaaugaaaugcucu

SEQ ID NO: 1998820 - RNA, 14 nt, Homo sapiens
acaucagcagagaa

SEQ ID NO: 1998821 - RNA, 15 nt, Homo sapiens
gacucgucucaaaaa

SEQ ID NO: 1998822 - RNA, 18 nt, Homo sapiens
aaauuccuguugucugac

SEQ ID NO: 1998823 - RNA, 20 nt, Homo sapiens
agccucucugcacacuaaua

SEQ ID NO: 1998824 - RNA, 18 nt, Homo sapiens
cccacccgggagugaugg

SEQ ID NO: 1998825 - RNA, 16 nt, Homo sapiens
guaaccacaacuuuca

SEQ ID NO: 1998826 - RNA, 18 nt, Homo sapiens
uuuauugaagggucuguu

SEQ ID NO: 1998827 - RNA, 15 nt, Homo sapiens
auggcucagaugcca

SEQ ID NO: 1998828 - RNA, 20 nt, Homo sapiens
uccuaugcuucgagccaugg

SEQ ID NO: 1998829 - RNA, 18 nt, Homo sapiens
agcaaaacuuuacuuuca

SEQ ID NO: 1998830 - RNA, 19 nt, Homo sapiens
auuugauuuuuacugagga

SEQ ID NO: 1998831 - RNA, 20 nt, Homo sapiens
cauucuccucaugcuuagaa

SEQ ID NO: 1998832 - RNA, 20 nt, Homo sapiens
aauucauaaagaaaugcaag

SEQ ID NO: 1998833 - RNA, 18 nt, Homo sapiens
uaguguccaaauucucac

SEQ ID NO: 1998834 - RNA, 13 nt, Homo sapiens
gggguagccugag

SEQ ID NO: 1998835 - RNA, 16 nt, Homo sapiens
auguacacacacagau

SEQ ID NO: 1998836 - RNA, 20 nt, Homo sapiens
cagcaccuguggcugacgaa

SEQ ID NO: 1998837 - RNA, 17 nt, Homo sapiens
cucaacauuaccaaaau

SEQ ID NO: 1998838 - RNA, 17 nt, Homo sapiens
gacuuugggaccugcuu

SEQ ID NO: 1998839 - RNA, 11 nt, Homo sapiens
cagaauacugg

SEQ ID NO: 1998840 - RNA, 21 nt, Homo sapiens
gccgcuucagacacgcacuuc

SEQ ID NO: 1998841 - RNA, 13 nt, Homo sapiens
uucuuccuucauu

SEQ ID NO: 1998842 - RNA, 21 nt, Homo sapiens
agaguacgugaaaugcucaag

SEQ ID NO: 1998843 - RNA, 11 nt, Homo sapiens
ucugagcagug

SEQ ID NO: 1998844 - RNA, 21 nt, Homo sapiens
agccugugagggcugggaugg

SEQ ID NO: 1998845 - RNA, 17 nt, Homo sapiens
ugauauguguaauauca

SEQ ID NO: 1998846 - RNA, 15 nt, Homo sapiens
uaauuguacaauaaa

SEQ ID NO: 1998847 - RNA, 20 nt, Homo sapiens
ggacugaugccccagggauu

SEQ ID NO: 1998848 - RNA, 14 nt, Homo sapiens
ucaagaauagcauu

SEQ ID NO: 1998849 - RNA, 19 nt, Homo sapiens
cugcaucugauaaaguuga

SEQ ID NO: 1998850 - RNA, 20 nt, Homo sapiens
auaaacuuaaagcuacugua

SEQ ID NO: 1998851 - RNA, 19 nt, Homo sapiens
ugaccaaggacugcuacac

SEQ ID NO: 1998852 - RNA, 19 nt, Homo sapiens
cgcaucguggugugucaau

SEQ ID NO: 1998853 - RNA, 16 nt, Homo sapiens
uauauacaaguagauc

SEQ ID NO: 1998854 - RNA, 23 nt, Homo sapiens
uagaauaauauugugucauagaa

SEQ ID NO: 1998855 - RNA, 12 nt, Homo sapiens
uuuuacaccagu

SEQ ID NO: 1998856 - RNA, 12 nt, Homo sapiens
aauaaacauaau

SEQ ID NO: 1998857 - RNA, 12 nt, Homo sapiens
agaaaacauguu

SEQ ID NO: 1998858 - RNA, 12 nt, Homo sapiens
uuucacacuguc

SEQ ID NO: 1998859 - RNA, 16 nt, Homo sapiens
caagaggcuggaaaag

SEQ ID NO: 1998860 - RNA, 17 nt, Homo sapiens
auuacaacuagaucaag

SEQ ID NO: 1998861 - RNA, 20 nt, Homo sapiens
caaaggaaaacaccuuuauu

SEQ ID NO: 1998862 - RNA, 17 nt, Homo sapiens
uuaaaauauccugugua

SEQ ID NO: 1998863 - RNA, 20 nt, Homo sapiens
cgaaaauucauuucacauua

SEQ ID NO: 1998864 - RNA, 20 nt, Homo sapiens
ccauuucuuaccaugcauuu

SEQ ID NO: 1998865 - RNA, 22 nt, Homo sapiens
ucagcaauccaugagauagcua

SEQ ID NO: 1998866 - RNA, 17 nt, Homo sapiens
guuuguaaaggcauucu

SEQ ID NO: 1998867 - RNA, 18 nt, Homo sapiens
aacuguugccagagaugg

SEQ ID NO: 1998868 - RNA, 22 nt, Homo sapiens
aacagcauuacccuccucucuc

SEQ ID NO: 1998869 - RNA, 17 nt, Homo sapiens
acuaaaggugcacugcu

SEQ ID NO: 1998870 - RNA, 20 nt, Homo sapiens
uuuucuauaaguuguaccaa

SEQ ID NO: 1998871 - RNA, 17 nt, Homo sapiens
uuuccccaaccacagag

SEQ ID NO: 1998872 - RNA, 15 nt, Homo sapiens
agaccucccagagag

SEQ ID NO: 1998873 - RNA, 15 nt, Homo sapiens
ucucugggagacuuu

SEQ ID NO: 1998874 - RNA, 16 nt, Homo sapiens
agcccaaggucaggga

SEQ ID NO: 1998875 - RNA, 15 nt, Homo sapiens
caugaauacuaucca

SEQ ID NO: 1998876 - RNA, 16 nt, Homo sapiens
cuucuaagaaaagccu

SEQ ID NO: 1998877 - RNA, 20 nt, Homo sapiens
aggcgggcagaucacgaguu

SEQ ID NO: 1998878 - RNA, 20 nt, Homo sapiens
ccccuaugugacagcucuau

SEQ ID NO: 1998879 - RNA, 12 nt, Homo sapiens
cuaaaguagacu

SEQ ID NO: 1998880 - RNA, 15 nt, Homo sapiens
acuguauugaauauu

SEQ ID NO: 1998881 - RNA, 13 nt, Homo sapiens
ccagugcagccac

SEQ ID NO: 1998882 - RNA, 18 nt, Homo sapiens
agggaauuccugcuauga

SEQ ID NO: 1998883 - RNA, 17 nt, Homo sapiens
guaauugaaacauuuac

SEQ ID NO: 1998884 - RNA, 20 nt, Homo sapiens
gcaaagauagagaaugcccu

SEQ ID NO: 1998885 - RNA, 20 nt, Homo sapiens
cugcagcccaccagacguca

SEQ ID NO: 1998886 - RNA, 17 nt, Homo sapiens
aauugacaguugcagaa

SEQ ID NO: 1998887 - RNA, 17 nt, Homo sapiens
aggccagcuucgugcug

SEQ ID NO: 1998888 - RNA, 14 nt, Homo sapiens
aggaaguggcucag

SEQ ID NO: 1998889 - RNA, 18 nt, Homo sapiens
ucaauaaaccacaagcau

SEQ ID NO: 1998890 - RNA, 22 nt, Homo sapiens
cuauuuaaaaaaaaagucagag

SEQ ID NO: 1998891 - RNA, 13 nt, Homo sapiens
caggcccaaagcc

SEQ ID NO: 1998892 - RNA, 20 nt, Homo sapiens
cugacuugguucugaagcca

SEQ ID NO: 1998893 - RNA, 20 nt, Homo sapiens
cuuccccuccccgcuccuaa

SEQ ID NO: 1998894 - RNA, 24 nt, Homo sapiens
gcaggauuucuucacaccucuccu

SEQ ID NO: 1998895 - RNA, 20 nt, Homo sapiens
gaaucagauuuuaacagcuc

SEQ ID NO: 1998896 - RNA, 21 nt, Homo sapiens
gagcugggaccaguaccuggg

SEQ ID NO: 1998897 - RNA, 20 nt, Homo sapiens
caaaugcuguagaaugcuug

SEQ ID NO: 1998898 - RNA, 20 nt, Homo sapiens
uaaagauggggaaacugagg

SEQ ID NO: 1998899 - RNA, 14 nt, Homo sapiens
ggucagaggggagc

SEQ ID NO: 1998900 - RNA, 19 nt, Homo sapiens
ucugcuguggucugaagug

SEQ ID NO: 1998901 - RNA, 19 nt, Homo sapiens
augacuuuauccugagucc

SEQ ID NO: 1998902 - RNA, 15 nt, Homo sapiens
gggacccugcucaca

SEQ ID NO: 1998903 - RNA, 18 nt, Homo sapiens
uacauacaaacaaugcaa

SEQ ID NO: 1998904 - RNA, 13 nt, Homo sapiens
acguugugcauuu

SEQ ID NO: 1998905 - RNA, 17 nt, Homo sapiens
uggagaccgaggccaga

SEQ ID NO: 1998906 - RNA, 22 nt, Homo sapiens
gguuucaaacuccugaccucag

SEQ ID NO: 1998907 - RNA, 22 nt, Homo sapiens
uaauauuuuguauuauugcugu

SEQ ID NO: 1998908 - RNA, 17 nt, Homo sapiens
aauuaauauuuaugucu

SEQ ID NO: 1998909 - RNA, 19 nt, Homo sapiens
uggcaccugggaagccugg

SEQ ID NO: 1998910 - RNA, 15 nt, Homo sapiens
aaaauuguagcuuuu

SEQ ID NO: 1998911 - RNA, 12 nt, Homo sapiens
acacuacuguau

SEQ ID NO: 1998912 - RNA, 13 nt, Homo sapiens
ccugggucgggac

SEQ ID NO: 1998913 - RNA, 16 nt, Homo sapiens
ccuggcugggacuggg

SEQ ID NO: 1998914 - RNA, 16 nt, Homo sapiens
ggguuggaagugcaga

SEQ ID NO: 1998915 - RNA, 22 nt, Homo sapiens
auuggacuuccuugguuuggac

SEQ ID NO: 1998916 - RNA, 22 nt, Homo sapiens
accugaccucuugcugccagcu

SEQ ID NO: 1998917 - RNA, 11 nt, Homo sapiens
caaguggcucc

SEQ ID NO: 1998918 - RNA, 21 nt, Homo sapiens
caccugcgugguccauuccau

SEQ ID NO: 1998919 - RNA, 18 nt, Homo sapiens
uagccaaacccuugucag

SEQ ID NO: 1998920 - RNA, 11 nt, Homo sapiens
aacacuuugag

SEQ ID NO: 1998921 - RNA, 20 nt, Homo sapiens
uacaauauuaauuauaauaa

SEQ ID NO: 1998922 - RNA, 12 nt, Homo sapiens
ucucagugcagg

SEQ ID NO: 1998923 - RNA, 19 nt, Homo sapiens
ccugcgggcaccuacaagg

SEQ ID NO: 1998924 - RNA, 14 nt, Homo sapiens
ccgauaaccacagg

SEQ ID NO: 1998925 - RNA, 21 nt, Homo sapiens
gcaaucuucucagaaggcaaa

SEQ ID NO: 1998926 - RNA, 12 nt, Homo sapiens
ucuaaugugcau

SEQ ID NO: 1998927 - RNA, 13 nt, Homo sapiens
uucccaaacugau

SEQ ID NO: 1998928 - RNA, 15 nt, Homo sapiens
ggcaaagaaggauua

SEQ ID NO: 1998929 - RNA, 15 nt, Homo sapiens
gggcuugaagccaaa

SEQ ID NO: 1998930 - RNA, 22 nt, Homo sapiens
cuggaggaaccgaaaggccaaa

SEQ ID NO: 1998931 - RNA, 18 nt, Homo sapiens
uaaaaaaaagaagugugc

SEQ ID NO: 1998932 - RNA, 15 nt, Homo sapiens
cacacucacuggcau

SEQ ID NO: 1998933 - RNA, 16 nt, Homo sapiens
cagaagaaguuaucaa

SEQ ID NO: 1998934 - RNA, 13 nt, Homo sapiens
ucccaaaugccuu

SEQ ID NO: 1998935 - RNA, 23 nt, Homo sapiens
uuagcagucauagggcugauaau

SEQ ID NO: 1998936 - RNA, 15 nt, Homo sapiens
cucugacacacagcu

SEQ ID NO: 1998937 - RNA, 13 nt, Homo sapiens
gccuagcuuucau

SEQ ID NO: 1998938 - RNA, 21 nt, Homo sapiens
cuggccccucagggucccugg

SEQ ID NO: 1998939 - RNA, 16 nt, Homo sapiens
ggaucagcccugccag

SEQ ID NO: 1998940 - RNA, 16 nt, Homo sapiens
auaaacugauuuaucu

SEQ ID NO: 1998941 - RNA, 18 nt, Homo sapiens
gauggcuggaacacugua

SEQ ID NO: 1998942 - RNA, 15 nt, Homo sapiens
aagaacaucaguuca

SEQ ID NO: 1998943 - RNA, 15 nt, Homo sapiens
ggccauguccaaaga

SEQ ID NO: 1998944 - RNA, 17 nt, Homo sapiens
uagucccaaacuggaaa

SEQ ID NO: 1998945 - RNA, 11 nt, Homo sapiens
gacagcaaaca

SEQ ID NO: 1998946 - RNA, 14 nt, Homo sapiens
ucucaggagccauc

SEQ ID NO: 1998947 - RNA, 21 nt, Homo sapiens
auguauuaauaaauagagcaa

SEQ ID NO: 1998948 - RNA, 16 nt, Homo sapiens
aaauuuucuaugcuua

SEQ ID NO: 1998949 - RNA, 18 nt, Homo sapiens
acccagagauuagccucc

SEQ ID NO: 1998950 - RNA, 15 nt, Homo sapiens
auggccacaccuggg

SEQ ID NO: 1998951 - RNA, 19 nt, Homo sapiens
cuucuccugaccuacuucc

SEQ ID NO: 1998952 - RNA, 21 nt, Homo sapiens
cggaaacuaguguacauuucu

SEQ ID NO: 1998953 - RNA, 18 nt, Homo sapiens
cuaguuccucuucuuaag

SEQ ID NO: 1998954 - RNA, 14 nt, Homo sapiens
cuccuugcccuggg

SEQ ID NO: 1998955 - RNA, 21 nt, Homo sapiens
aauuccuagaaguugagagag

SEQ ID NO: 1998956 - RNA, 19 nt, Homo sapiens
ccuagauaugaagaaucug

SEQ ID NO: 1998957 - RNA, 15 nt, Homo sapiens
uucaccugugacaaa

SEQ ID NO: 1998958 - RNA, 16 nt, Homo sapiens
guggcugucgguggga

SEQ ID NO: 1998959 - RNA, 13 nt, Homo sapiens
ucugacagucuca

SEQ ID NO: 1998960 - RNA, 13 nt, Homo sapiens
ugugucagugucu

SEQ ID NO: 1998961 - RNA, 16 nt, Homo sapiens
uuucacacagugaaac

SEQ ID NO: 1998962 - RNA, 22 nt, Homo sapiens
ccaggauggcgugugugccgug

SEQ ID NO: 1998963 - RNA, 22 nt, Homo sapiens
gucaguugccaaauaucuugau

SEQ ID NO: 1998964 - RNA, 20 nt, Homo sapiens
uuaauucucauuuguucuca

SEQ ID NO: 1998965 - RNA, 23 nt, Homo sapiens
ucuacauguuuuagacagagaca

SEQ ID NO: 1998966 - RNA, 13 nt, Homo sapiens
gaguagcucugcc

SEQ ID NO: 1998967 - RNA, 19 nt, Homo sapiens
acggcucacugcagccuca

SEQ ID NO: 1998968 - RNA, 18 nt, Homo sapiens
gaggagcuggaggggugg

SEQ ID NO: 1998969 - RNA, 22 nt, Homo sapiens
gaacauaguagauugacaucua

SEQ ID NO: 1998970 - RNA, 20 nt, Homo sapiens
cagccuccugagcagcuggg

SEQ ID NO: 1998971 - RNA, 20 nt, Homo sapiens
gagugccuucauacacugua

SEQ ID NO: 1998972 - RNA, 13 nt, Homo sapiens
acugauacaucca

SEQ ID NO: 1998973 - RNA, 14 nt, Homo sapiens
cucucuucuggaau

SEQ ID NO: 1998974 - RNA, 15 nt, Homo sapiens
uugugagucuucacu

SEQ ID NO: 1998975 - RNA, 19 nt, Homo sapiens
cagcauaccaguucuugca

SEQ ID NO: 1998976 - RNA, 18 nt, Homo sapiens
ccaaaaguguugacugug

SEQ ID NO: 1998977 - RNA, 14 nt, Homo sapiens
acacacacauauac

SEQ ID NO: 1998978 - RNA, 14 nt, Homo sapiens
aucccaacaccuca

SEQ ID NO: 1998979 - RNA, 20 nt, Homo sapiens
ucccacugggagcacuuugu

SEQ ID NO: 1998980 - RNA, 21 nt, Homo sapiens
cuguugaugaaagggacagau

SEQ ID NO: 1998981 - RNA, 16 nt, Homo sapiens
guacacagacuauuga

SEQ ID NO: 1998982 - RNA, 19 nt, Homo sapiens
uaagugaaauaagccagac

SEQ ID NO: 1998983 - RNA, 23 nt, Homo sapiens
aguacacuguuucaaacuuuacu

SEQ ID NO: 1998984 - RNA, 19 nt, Homo sapiens
caugguaucuugagucuug

SEQ ID NO: 1998985 - RNA, 19 nt, Homo sapiens
cagaugcauauagacacac

SEQ ID NO: 1998986 - RNA, 19 nt, Homo sapiens
aagcugaaaggaugauccu

SEQ ID NO: 1998987 - RNA, 20 nt, Homo sapiens
auuuuuccacuauuaaucuu

SEQ ID NO: 1998988 - RNA, 15 nt, Homo sapiens
accccaggaucccag

SEQ ID NO: 1998989 - RNA, 17 nt, Homo sapiens
uccacccugagccugac

SEQ ID NO: 1998990 - RNA, 14 nt, Homo sapiens
auuuucaaguaauu

SEQ ID NO: 1998991 - RNA, 15 nt, Homo sapiens
cugcccuuggcacca

SEQ ID NO: 1998992 - RNA, 23 nt, Homo sapiens
gaccuccuuuuuugaggucaggg

SEQ ID NO: 1998993 - RNA, 18 nt, Homo sapiens
caaagaagguuaccaaga

SEQ ID NO: 1998994 - RNA, 17 nt, Homo sapiens
cuuuggacaacugacaa

SEQ ID NO: 1998995 - RNA, 18 nt, Homo sapiens
uaaaaugugaaguaauag

SEQ ID NO: 1998996 - RNA, 14 nt, Homo sapiens
cugggaaaugagau

SEQ ID NO: 1998997 - RNA, 21 nt, Homo sapiens
agcauuuuacaagaucuugca

SEQ ID NO: 1998998 - RNA, 15 nt, Homo sapiens
ccuugagaagccaac

SEQ ID NO: 1998999 - RNA, 17 nt, Homo sapiens
ggcaacgacgguuucaa

SEQ ID NO: 1999000 - RNA, 14 nt, Homo sapiens
augagaaaagggaa

SEQ ID NO: 1999001 - RNA, 16 nt, Homo sapiens
gugacgugcacuguga

SEQ ID NO: 1999002 - RNA, 18 nt, Homo sapiens
uacuggaguuagaucucu

SEQ ID NO: 1999003 - RNA, 13 nt, Homo sapiens
cuuuuauguagca

SEQ ID NO: 1999004 - RNA, 17 nt, Homo sapiens
ucaauuuggacuggugu

SEQ ID NO: 1999005 - RNA, 14 nt, Homo sapiens
gggugcagcuguca

SEQ ID NO: 1999006 - RNA, 20 nt, Homo sapiens
ucuaauuauuuacucaaaga

SEQ ID NO: 1999007 - RNA, 14 nt, Homo sapiens
cuuggcucugccag

SEQ ID NO: 1999008 - RNA, 23 nt, Homo sapiens
agcccucucccucaguccuuuau

SEQ ID NO: 1999009 - RNA, 22 nt, Homo sapiens
aaggcagaggaauuuggcugcu

SEQ ID NO: 1999010 - RNA, 22 nt, Homo sapiens
agacauagcauccaaguggcau

SEQ ID NO: 1999011 - RNA, 14 nt, Homo sapiens
acaccguucauuca

SEQ ID NO: 1999012 - RNA, 19 nt, Homo sapiens
cugggagacugggacaccu

SEQ ID NO: 1999013 - RNA, 15 nt, Homo sapiens
ugucaacacaaagac

SEQ ID NO: 1999014 - RNA, 13 nt, Homo sapiens
aacuccaucucaa

SEQ ID NO: 1999015 - RNA, 19 nt, Homo sapiens
cacagacacuacauaucua

SEQ ID NO: 1999016 - RNA, 17 nt, Homo sapiens
aacaacauccacuguua

SEQ ID NO: 1999017 - RNA, 22 nt, Homo sapiens
aacaguaaaagccuuauucuaa

SEQ ID NO: 1999018 - RNA, 16 nt, Homo sapiens
aauuucaagucuuccu

SEQ ID NO: 1999019 - RNA, 18 nt, Homo sapiens
uuuuaguauuugcccggg

SEQ ID NO: 1999020 - RNA, 16 nt, Homo sapiens
uagacacacauauaca

SEQ ID NO: 1999021 - RNA, 16 nt, Homo sapiens
gaccuucuauccucug

SEQ ID NO: 1999022 - RNA, 24 nt, Homo sapiens
auuguucagacauuccauggugau

SEQ ID NO: 1999023 - RNA, 16 nt, Homo sapiens
acaaacaaugccauca

SEQ ID NO: 1999024 - RNA, 21 nt, Homo sapiens
gacauuuuuucagucauauaa

SEQ ID NO: 1999025 - RNA, 16 nt, Homo sapiens
aauuggccucagugua

SEQ ID NO: 1999026 - RNA, 21 nt, Homo sapiens
ugauguauaaaacuugauaaa

SEQ ID NO: 1999027 - RNA, 15 nt, Homo sapiens
cacugacaaugggca

SEQ ID NO: 1999028 - RNA, 16 nt, Homo sapiens
gguucagaaaugcugc

SEQ ID NO: 1999029 - RNA, 11 nt, Homo sapiens
cagacugucuc

SEQ ID NO: 1999030 - RNA, 11 nt, Homo sapiens
gucacugugag

SEQ ID NO: 1999031 - RNA, 14 nt, Homo sapiens
gcagaagacaguau

SEQ ID NO: 1999032 - RNA, 23 nt, Homo sapiens
ucaagucuucccugaucaaguca

SEQ ID NO: 1999033 - RNA, 15 nt, Homo sapiens
aaaacaaaauaccac

SEQ ID NO: 1999034 - RNA, 17 nt, Homo sapiens
cccuugguucucauaac

SEQ ID NO: 1999035 - RNA, 16 nt, Homo sapiens
uucugucaaaugcagu

SEQ ID NO: 1999036 - RNA, 21 nt, Homo sapiens
ccuggccuuugaggcaaaggc

SEQ ID NO: 1999037 - RNA, 22 nt, Homo sapiens
cucauuucuggaaagugcaauu

SEQ ID NO: 1999038 - RNA, 13 nt, Homo sapiens
guaaagguuucaa

SEQ ID NO: 1999039 - RNA, 13 nt, Homo sapiens
uucaagguguaaa

SEQ ID NO: 1999040 - RNA, 19 nt, Homo sapiens
caaucaguauaauucugua

SEQ ID NO: 1999041 - RNA, 17 nt, Homo sapiens
gaugcacguggggccca

SEQ ID NO: 1999042 - RNA, 23 nt, Homo sapiens
cagccaccuagucccccaaaggg

SEQ ID NO: 1999043 - RNA, 15 nt, Homo sapiens
gaaggagacacagau

SEQ ID NO: 1999044 - RNA, 13 nt, Homo sapiens
cugauaguuuuau

SEQ ID NO: 1999045 - RNA, 16 nt, Homo sapiens
cagccaugaccaguuc

SEQ ID NO: 1999046 - RNA, 23 nt, Homo sapiens
cugcccagucccccaaccccagc

SEQ ID NO: 1999047 - RNA, 15 nt, Homo sapiens
gcuuuucugucccuu

SEQ ID NO: 1999048 - RNA, 21 nt, Homo sapiens
uuguaaucgauuugucuguca

SEQ ID NO: 1999049 - RNA, 15 nt, Homo sapiens
caccagcgcuugaag

SEQ ID NO: 1999050 - RNA, 20 nt, Homo sapiens
ucuaagcauauucaaaaggg

SEQ ID NO: 1999051 - RNA, 21 nt, Homo sapiens
ccaguuaguuagaauuggaaa

SEQ ID NO: 1999052 - RNA, 16 nt, Homo sapiens
uuacaucacuuuguga

SEQ ID NO: 1999053 - RNA, 17 nt, Homo sapiens
agagccacagcugugca

SEQ ID NO: 1999054 - RNA, 13 nt, Homo sapiens
ucaugcccugugc

SEQ ID NO: 1999055 - RNA, 12 nt, Homo sapiens
agauuaucccac

SEQ ID NO: 1999056 - RNA, 21 nt, Homo sapiens
caacuaaagaauagugccuca

SEQ ID NO: 1999057 - RNA, 22 nt, Homo sapiens
accaaugguccuagaacuuugu

SEQ ID NO: 1999058 - RNA, 14 nt, Homo sapiens
aagacuuguaauau

SEQ ID NO: 1999059 - RNA, 17 nt, Homo sapiens
augucugcagcccucag

SEQ ID NO: 1999060 - RNA, 16 nt, Homo sapiens
caauuucauccauguc

SEQ ID NO: 1999061 - RNA, 14 nt, Homo sapiens
agaccacaccaagg

SEQ ID NO: 1999062 - RNA, 19 nt, Homo sapiens
gcuuuaaaacuuauccucc

SEQ ID NO: 1999063 - RNA, 23 nt, Homo sapiens
caacagaaaccagaaaagcaaua

SEQ ID NO: 1999064 - RNA, 22 nt, Homo sapiens
ccugaagguguuuuucauucac

SEQ ID NO: 1999065 - RNA, 13 nt, Homo sapiens
aggaaccaccugu

SEQ ID NO: 1999066 - RNA, 17 nt, Homo sapiens
aaaacaguguguaaaca

SEQ ID NO: 1999067 - RNA, 19 nt, Homo sapiens
cuuugccuuuccauaauca

SEQ ID NO: 1999068 - RNA, 18 nt, Homo sapiens
gaauaugcuagugaugua

SEQ ID NO: 1999069 - RNA, 16 nt, Homo sapiens
uuuugagggcuaaaaa

SEQ ID NO: 1999070 - RNA, 21 nt, Homo sapiens
aucuaaauauuuccauauucu

SEQ ID NO: 1999071 - RNA, 17 nt, Homo sapiens
gguuagccuuugcccug

SEQ ID NO: 1999072 - RNA, 23 nt, Homo sapiens
gcacccacacccuacagcagauc

SEQ ID NO: 1999073 - RNA, 14 nt, Homo sapiens
ccaguggaugccac

SEQ ID NO: 1999074 - RNA, 19 nt, Homo sapiens
aagucgagggacuuuaugu

SEQ ID NO: 1999075 - RNA, 14 nt, Homo sapiens
aggugacacuccag

SEQ ID NO: 1999076 - RNA, 17 nt, Homo sapiens
cugugagcacauaagca

SEQ ID NO: 1999077 - RNA, 20 nt, Homo sapiens
guaaaugcuagguuaauucc

SEQ ID NO: 1999078 - RNA, 23 nt, Homo sapiens
aacugcugagagacagagcuauu

SEQ ID NO: 1999079 - RNA, 14 nt, Homo sapiens
gcgcgugcacacac

SEQ ID NO: 1999080 - RNA, 16 nt, Homo sapiens
gaaaauucgaaccagg

SEQ ID NO: 1999081 - RNA, 20 nt, Homo sapiens
agcaguucaauaaacuauac

SEQ ID NO: 1999082 - RNA, 16 nt, Homo sapiens
uauagaccaugcacag

SEQ ID NO: 1999083 - RNA, 20 nt, Homo sapiens
agauguuuuauuuugccagu

SEQ ID NO: 1999084 - RNA, 12 nt, Homo sapiens
cagaauguugaa

SEQ ID NO: 1999085 - RNA, 20 nt, Homo sapiens
uggccaacagaacacuugcu

SEQ ID NO: 1999086 - RNA, 23 nt, Homo sapiens
auuccaggaggaguuagccaaac

SEQ ID NO: 1999087 - RNA, 22 nt, Homo sapiens
cuugaucacuuuugcacauucc

SEQ ID NO: 1999088 - RNA, 17 nt, Homo sapiens
gcuuuccguaaaugcaa

SEQ ID NO: 1999089 - RNA, 16 nt, Homo sapiens
ggaugcggcuuucucu

SEQ ID NO: 1999090 - RNA, 14 nt, Homo sapiens
ccccaccaugcagc

SEQ ID NO: 1999091 - RNA, 14 nt, Homo sapiens
cuucugggggugua

SEQ ID NO: 1999092 - RNA, 21 nt, Homo sapiens
aggcugcuuagauuucuagca

SEQ ID NO: 1999093 - RNA, 21 nt, Homo sapiens
ugguauuuuuauagccauaaa

SEQ ID NO: 1999094 - RNA, 14 nt, Homo sapiens
cuugucugugcauc

SEQ ID NO: 1999095 - RNA, 21 nt, Homo sapiens
uucuggacauucucuuugaua

SEQ ID NO: 1999096 - RNA, 13 nt, Homo sapiens
aggaaagugauuu

SEQ ID NO: 1999097 - RNA, 21 nt, Homo sapiens
acaaaucucaaaguguacaaa

SEQ ID NO: 1999098 - RNA, 21 nt, Homo sapiens
uuuuaaaaaaaucccauuuaa

SEQ ID NO: 1999099 - RNA, 22 nt, Homo sapiens
uuucaacaagugcuaccuuuga

SEQ ID NO: 1999100 - RNA, 18 nt, Homo sapiens
caggucaaguuuuuuaua

SEQ ID NO: 1999101 - RNA, 19 nt, Homo sapiens
gaaaucaggcaguucccug

SEQ ID NO: 1999102 - RNA, 18 nt, Homo sapiens
cggaguacagacgucuca

SEQ ID NO: 1999103 - RNA, 16 nt, Homo sapiens
accugcugaagggcag

SEQ ID NO: 1999104 - RNA, 23 nt, Homo sapiens
cuuggagggcccagcccaaguga

SEQ ID NO: 1999105 - RNA, 19 nt, Homo sapiens
gcucucuggagguacugag

SEQ ID NO: 1999106 - RNA, 17 nt, Homo sapiens
uggacucugcacauguc

SEQ ID NO: 1999107 - RNA, 18 nt, Homo sapiens
auuuaucaugguccugaa

SEQ ID NO: 1999108 - RNA, 14 nt, Homo sapiens
auacuucacacuga

SEQ ID NO: 1999109 - RNA, 23 nt, Homo sapiens
ccuuaggaauacuguuuuaucuc

SEQ ID NO: 1999110 - RNA, 20 nt, Homo sapiens
uggucgagaccuguucacgg

SEQ ID NO: 1999111 - RNA, 21 nt, Homo sapiens
cauuuaggaaagcagugcagu

SEQ ID NO: 1999112 - RNA, 12 nt, Homo sapiens
cuugucagugug

SEQ ID NO: 1999113 - RNA, 20 nt, Homo sapiens
cauuugaguugcccaucuug

SEQ ID NO: 1999114 - RNA, 21 nt, Homo sapiens
cugggagcuucucugcugcuu

SEQ ID NO: 1999115 - RNA, 13 nt, Homo sapiens
acacagcuaacaa

SEQ ID NO: 1999116 - RNA, 14 nt, Homo sapiens
ucuucccaguauua

SEQ ID NO: 1999117 - RNA, 17 nt, Homo sapiens
uguuggaaaaugugucu

SEQ ID NO: 1999118 - RNA, 18 nt, Homo sapiens
gggccuguucucuuggcu

SEQ ID NO: 1999119 - RNA, 16 nt, Homo sapiens
aaugaagaauggccau

SEQ ID NO: 1999120 - RNA, 15 nt, Homo sapiens
gacuuugaagaccag

SEQ ID NO: 1999121 - RNA, 13 nt, Homo sapiens
aucaucaaaaaga

SEQ ID NO: 1999122 - RNA, 11 nt, Homo sapiens
ugguucagugg

SEQ ID NO: 1999123 - RNA, 18 nt, Homo sapiens
caugccccacucugcuga

SEQ ID NO: 1999124 - RNA, 16 nt, Homo sapiens
auacaggacauucuca

SEQ ID NO: 1999125 - RNA, 23 nt, Homo sapiens
cucaguaacacagugcaguacuc

SEQ ID NO: 1999126 - RNA, 18 nt, Homo sapiens
guccugcugucccuguca

SEQ ID NO: 1999127 - RNA, 14 nt, Homo sapiens
cagggaaaugugua

SEQ ID NO: 1999128 - RNA, 23 nt, Homo sapiens
auucauagugauagagugcagug

SEQ ID NO: 1999129 - RNA, 18 nt, Homo sapiens
gcugaggccuaugcagac

SEQ ID NO: 1999130 - RNA, 23 nt, Homo sapiens
gcucccacauucugaugagcaac

SEQ ID NO: 1999131 - RNA, 20 nt, Homo sapiens
caagaaucucccagucuggu

SEQ ID NO: 1999132 - RNA, 17 nt, Homo sapiens
gugacuucacagugaag

SEQ ID NO: 1999133 - RNA, 18 nt, Homo sapiens
ucaccucacacuccucca

SEQ ID NO: 1999134 - RNA, 16 nt, Homo sapiens
cucacuaccuccucag

SEQ ID NO: 1999135 - RNA, 18 nt, Homo sapiens
uccacauccccaccuucc

SEQ ID NO: 1999136 - RNA, 17 nt, Homo sapiens
auucugcuucucaucua

SEQ ID NO: 1999137 - RNA, 18 nt, Homo sapiens
cugaacacaucgugauga

SEQ ID NO: 1999138 - RNA, 14 nt, Homo sapiens
aauguuaugcaggc

SEQ ID NO: 1999139 - RNA, 22 nt, Homo sapiens
aauuuguugaacccugccacau

SEQ ID NO: 1999140 - RNA, 18 nt, Homo sapiens
acagaugaaccaaguguc

SEQ ID NO: 1999141 - RNA, 16 nt, Homo sapiens
ugggacccaguggcag

SEQ ID NO: 1999142 - RNA, 15 nt, Homo sapiens
cuucuguugaucuca

SEQ ID NO: 1999143 - RNA, 17 nt, Homo sapiens
caucccuagccauucug

SEQ ID NO: 1999144 - RNA, 17 nt, Homo sapiens
cacagcuucuccaagca

SEQ ID NO: 1999145 - RNA, 12 nt, Homo sapiens
ucccuagccauu

SEQ ID NO: 1999146 - RNA, 22 nt, Homo sapiens
cucgugggucccagagaccuca

SEQ ID NO: 1999147 - RNA, 23 nt, Homo sapiens
uccccaaaacacugucugcauau

SEQ ID NO: 1999148 - RNA, 22 nt, Homo sapiens
acuuguuuuugaguuuucuuau

SEQ ID NO: 1999149 - RNA, 19 nt, Homo sapiens
cugguuugaaagauuauga

SEQ ID NO: 1999150 - RNA, 19 nt, Homo sapiens
cauauauacuugcaagaua

SEQ ID NO: 1999151 - RNA, 15 nt, Homo sapiens
agggagcgaggucag

SEQ ID NO: 1999152 - RNA, 14 nt, Homo sapiens
uacuuaaguuuuag

SEQ ID NO: 1999153 - RNA, 19 nt, Homo sapiens
aaccugcacguugugcaca

SEQ ID NO: 1999154 - RNA, 18 nt, Homo sapiens
uucucugcuugccuagcc

SEQ ID NO: 1999155 - RNA, 17 nt, Homo sapiens
gagccuggggcauccca

SEQ ID NO: 1999156 - RNA, 12 nt, Homo sapiens
acaacucagucc

SEQ ID NO: 1999157 - RNA, 20 nt, Homo sapiens
uuacauguuugguaccaaga

SEQ ID NO: 1999158 - RNA, 14 nt, Homo sapiens
caaugauuccagac

SEQ ID NO: 1999159 - RNA, 14 nt, Homo sapiens
guucgagacuccau

SEQ ID NO: 1999160 - RNA, 12 nt, Homo sapiens
uguuuuguggau

SEQ ID NO: 1999161 - RNA, 19 nt, Homo sapiens
ccagcucagggcucuuucc

SEQ ID NO: 1999162 - RNA, 19 nt, Homo sapiens
uaggguccauaugagggaa

SEQ ID NO: 1999163 - RNA, 22 nt, Homo sapiens
aucugccuaguuuugaugaauu

SEQ ID NO: 1999164 - RNA, 18 nt, Homo sapiens
uacaaucaugaacagcuc

SEQ ID NO: 1999165 - RNA, 18 nt, Homo sapiens
cccauuuuauaccaaagg

SEQ ID NO: 1999166 - RNA, 16 nt, Homo sapiens
cagauggaguaccaug

SEQ ID NO: 1999167 - RNA, 20 nt, Homo sapiens
agcucucccaacucuugcac

SEQ ID NO: 1999168 - RNA, 22 nt, Homo sapiens
uacaucugucuuucaucuccca

SEQ ID NO: 1999169 - RNA, 23 nt, Homo sapiens
gcacgccaacauggcacauguau

SEQ ID NO: 1999170 - RNA, 16 nt, Homo sapiens
ugcuacucuaguauuc

SEQ ID NO: 1999171 - RNA, 18 nt, Homo sapiens
guauaaauugguuccuga

SEQ ID NO: 1999172 - RNA, 18 nt, Homo sapiens
uaaaacacaugauaccag

SEQ ID NO: 1999173 - RNA, 18 nt, Homo sapiens
gagagagguacccaaggu

SEQ ID NO: 1999174 - RNA, 20 nt, Homo sapiens
cagggcuggcuccucugccc

SEQ ID NO: 1999175 - RNA, 17 nt, Homo sapiens
aaucuuaaacaauguau

SEQ ID NO: 1999176 - RNA, 19 nt, Homo sapiens
cugccuggagagcuccuau

SEQ ID NO: 1999177 - RNA, 19 nt, Homo sapiens
gauaacuauuuacauauaa

SEQ ID NO: 1999178 - RNA, 14 nt, Homo sapiens
guccuuugugaaua

SEQ ID NO: 1999179 - RNA, 15 nt, Homo sapiens
ucuauucucaaagcu

SEQ ID NO: 1999180 - RNA, 21 nt, Homo sapiens
aggauuccaaaaacauuuuau

SEQ ID NO: 1999181 - RNA, 23 nt, Homo sapiens
guggugggggucagguggacucu

SEQ ID NO: 1999182 - RNA, 11 nt, Homo sapiens
gagcugagacc

SEQ ID NO: 1999183 - RNA, 17 nt, Homo sapiens
aaaaccagcgugugacu

SEQ ID NO: 1999184 - RNA, 15 nt, Homo sapiens
ggcuugggcaauaaa

SEQ ID NO: 1999185 - RNA, 16 nt, Homo sapiens
cuuaugccagcgugac

SEQ ID NO: 1999186 - RNA, 19 nt, Homo sapiens
agcuaauguaggacuguau

SEQ ID NO: 1999187 - RNA, 14 nt, Homo sapiens
cuccaguguacaua

SEQ ID NO: 1999188 - RNA, 19 nt, Homo sapiens
ccuguuccccaaggacucu

SEQ ID NO: 1999189 - RNA, 13 nt, Homo sapiens
aagcuaucugugc

SEQ ID NO: 1999190 - RNA, 11 nt, Homo sapiens
ugaaaagccau

SEQ ID NO: 1999191 - RNA, 21 nt, Homo sapiens
aucacuaagaaagaaaggaaa

SEQ ID NO: 1999192 - RNA, 14 nt, Homo sapiens
ccaacuugagaugu

SEQ ID NO: 1999193 - RNA, 12 nt, Homo sapiens
agcacuugucca

SEQ ID NO: 1999194 - RNA, 23 nt, Homo sapiens
uccuccagggaacccaacaguca

SEQ ID NO: 1999195 - RNA, 17 nt, Homo sapiens
ccuaacauacugcauuu

SEQ ID NO: 1999196 - RNA, 16 nt, Homo sapiens
agagcugggugucaag

SEQ ID NO: 1999197 - RNA, 17 nt, Homo sapiens
cuuuuaaugaacaaaug

SEQ ID NO: 1999198 - RNA, 12 nt, Homo sapiens
cagggucucacu

SEQ ID NO: 1999199 - RNA, 21 nt, Homo sapiens
ucaaaguccaacuacagccaa

SEQ ID NO: 1999200 - RNA, 15 nt, Homo sapiens
uuuaagguacaugga

SEQ ID NO: 1999201 - RNA, 17 nt, Homo sapiens
ugaguccuguucuuccu

SEQ ID NO: 1999202 - RNA, 19 nt, Homo sapiens
uuagaagcagaucauuucc

SEQ ID NO: 1999203 - RNA, 12 nt, Homo sapiens
uuuuauucugaa

SEQ ID NO: 1999204 - RNA, 16 nt, Homo sapiens
uuaguugcaugauuag

SEQ ID NO: 1999205 - RNA, 22 nt, Homo sapiens
ccuggggcuggguguguuucag

SEQ ID NO: 1999206 - RNA, 23 nt, Homo sapiens
aguuacggagggaggacaucaua

SEQ ID NO: 1999207 - RNA, 16 nt, Homo sapiens
uccaaccucacuuccc

SEQ ID NO: 1999208 - RNA, 19 nt, Homo sapiens
uuguuacuguccacccuca

SEQ ID NO: 1999209 - RNA, 20 nt, Homo sapiens
gcugaaucccguagccaguc

SEQ ID NO: 1999210 - RNA, 13 nt, Homo sapiens
gguguuuugccau

SEQ ID NO: 1999211 - RNA, 14 nt, Homo sapiens
ggaagaaagcuaau

SEQ ID NO: 1999212 - RNA, 15 nt, Homo sapiens
aggaagaauggugug

SEQ ID NO: 1999213 - RNA, 23 nt, Homo sapiens
uaaauuaggcauaucucugccau

SEQ ID NO: 1999214 - RNA, 20 nt, Homo sapiens
augagaaucagaucauuuca

SEQ ID NO: 1999215 - RNA, 17 nt, Homo sapiens
gacagggucggccugua

SEQ ID NO: 1999216 - RNA, 21 nt, Homo sapiens
gccugcagagcaggaccuggg

SEQ ID NO: 1999217 - RNA, 14 nt, Homo sapiens
agaggucaccagcu

SEQ ID NO: 1999218 - RNA, 14 nt, Homo sapiens
gaagaaaacaugac

SEQ ID NO: 1999219 - RNA, 17 nt, Homo sapiens
acgugacuguggcacac

SEQ ID NO: 1999220 - RNA, 15 nt, Homo sapiens
cagcuggcucugcag

SEQ ID NO: 1999221 - RNA, 15 nt, Homo sapiens
cuaacauauguauua

SEQ ID NO: 1999222 - RNA, 22 nt, Homo sapiens
aagaucaggccaaccccaaaga

SEQ ID NO: 1999223 - RNA, 20 nt, Homo sapiens
aucauguccccaaaccugca

SEQ ID NO: 1999224 - RNA, 22 nt, Homo sapiens
cauuucucuccucacacacaga

SEQ ID NO: 1999225 - RNA, 22 nt, Homo sapiens
uccgacaugccuugaaaccaga

SEQ ID NO: 1999226 - RNA, 22 nt, Homo sapiens
cacgugucuuccacuuugcaua

SEQ ID NO: 1999227 - RNA, 17 nt, Homo sapiens
acagccguuuguucuac

SEQ ID NO: 1999228 - RNA, 15 nt, Homo sapiens
cgaguaacugagauu

SEQ ID NO: 1999229 - RNA, 15 nt, Homo sapiens
uuguuauccuguaua

SEQ ID NO: 1999230 - RNA, 13 nt, Homo sapiens
uagcauugccaau

SEQ ID NO: 1999231 - RNA, 17 nt, Homo sapiens
ucaccuuccuaguucuu

SEQ ID NO: 1999232 - RNA, 17 nt, Homo sapiens
acagaaguccauggagu

SEQ ID NO: 1999233 - RNA, 17 nt, Homo sapiens
uuaaaaaugaaagccaa

SEQ ID NO: 1999234 - RNA, 14 nt, Homo sapiens
cacccacucugcac

SEQ ID NO: 1999235 - RNA, 19 nt, Homo sapiens
ugcuccaaauuuucaauaa

SEQ ID NO: 1999236 - RNA, 22 nt, Homo sapiens
acuaugcuguuaacagcuguca

SEQ ID NO: 1999237 - RNA, 19 nt, Homo sapiens
aaggaaucuuuaagcagag

SEQ ID NO: 1999238 - RNA, 23 nt, Homo sapiens
aacuguggacaaaaguuuaucuu

SEQ ID NO: 1999239 - RNA, 18 nt, Homo sapiens
aagucccuuuaugcagag

SEQ ID NO: 1999240 - RNA, 17 nt, Homo sapiens
uaaaauaaaaugcagac

SEQ ID NO: 1999241 - RNA, 15 nt, Homo sapiens
aguucaauacaguga

SEQ ID NO: 1999242 - RNA, 15 nt, Homo sapiens
guauguccuuuucug

SEQ ID NO: 1999243 - RNA, 18 nt, Homo sapiens
uucauuuaaaaugauuag

SEQ ID NO: 1999244 - RNA, 22 nt, Homo sapiens
acucuguaaaacgcaccaauca

SEQ ID NO: 1999245 - RNA, 19 nt, Homo sapiens
ggugggaaaaucacuugaa

SEQ ID NO: 1999246 - RNA, 23 nt, Homo sapiens
uagcuguccuuuuuccucuccac

SEQ ID NO: 1999247 - RNA, 18 nt, Homo sapiens
gccagcccaacugugaga

SEQ ID NO: 1999248 - RNA, 19 nt, Homo sapiens
auauuguauuacuagaaga

SEQ ID NO: 1999249 - RNA, 16 nt, Homo sapiens
cauguaccuuguguac

SEQ ID NO: 1999250 - RNA, 14 nt, Homo sapiens
cuuggugggagaaa

SEQ ID NO: 1999251 - RNA, 15 nt, Homo sapiens
caccucucuaccuaa

SEQ ID NO: 1999252 - RNA, 22 nt, Homo sapiens
uccuguguccaugugaucucau

SEQ ID NO: 1999253 - RNA, 17 nt, Homo sapiens
uuacauacuauucuuac

SEQ ID NO: 1999254 - RNA, 20 nt, Homo sapiens
ggacccccagcuuugcccaa

SEQ ID NO: 1999255 - RNA, 21 nt, Homo sapiens
cuuguugucuauuaucuguag

SEQ ID NO: 1999256 - RNA, 12 nt, Homo sapiens
ugagcugugaug

SEQ ID NO: 1999257 - RNA, 22 nt, Homo sapiens
agucuggucagagccacagggu

SEQ ID NO: 1999258 - RNA, 17 nt, Homo sapiens
cagaggcugcaggacuu

SEQ ID NO: 1999259 - RNA, 16 nt, Homo sapiens
ggcuccagccaucuca

SEQ ID NO: 1999260 - RNA, 16 nt, Homo sapiens
ugagccaucacuagaa

SEQ ID NO: 1999261 - RNA, 14 nt, Homo sapiens
cuuugaaaacucau

SEQ ID NO: 1999262 - RNA, 14 nt, Homo sapiens
gccccuuuccaaaa

SEQ ID NO: 1999263 - RNA, 14 nt, Homo sapiens
aauucucuuucaaa

SEQ ID NO: 1999264 - RNA, 15 nt, Homo sapiens
ccuaacauauaugua

SEQ ID NO: 1999265 - RNA, 17 nt, Homo sapiens
auggguccuugaugcca

SEQ ID NO: 1999266 - RNA, 17 nt, Homo sapiens
ggaccaggacugcagcu

SEQ ID NO: 1999267 - RNA, 17 nt, Homo sapiens
aaguuugggcugaagaa

SEQ ID NO: 1999268 - RNA, 22 nt, Homo sapiens
uccccacaaacccccaccagca

SEQ ID NO: 1999269 - RNA, 17 nt, Homo sapiens
uaauaguacuauuacua

SEQ ID NO: 1999270 - RNA, 12 nt, Homo sapiens
caggugcaaaag

SEQ ID NO: 1999271 - RNA, 19 nt, Homo sapiens
agcaucuucccaaaaccau

SEQ ID NO: 1999272 - RNA, 14 nt, Homo sapiens
agaugcuaguucau

SEQ ID NO: 1999273 - RNA, 17 nt, Homo sapiens
augugagcuguaaaaau

SEQ ID NO: 1999274 - RNA, 20 nt, Homo sapiens
auaaguuaauuuugcauuuu

SEQ ID NO: 1999275 - RNA, 14 nt, Homo sapiens
agugugcugcuauu

SEQ ID NO: 1999276 - RNA, 14 nt, Homo sapiens
guuuauaaugccau

SEQ ID NO: 1999277 - RNA, 17 nt, Homo sapiens
accagagugauguccuc

SEQ ID NO: 1999278 - RNA, 18 nt, Homo sapiens
cgggaaggaggcaacugc

SEQ ID NO: 1999279 - RNA, 16 nt, Homo sapiens
aaucgagucuaccucu

SEQ ID NO: 1999280 - RNA, 16 nt, Homo sapiens
caucuugaucugcuca

SEQ ID NO: 1999281 - RNA, 16 nt, Homo sapiens
ucuuaguucucacugu

SEQ ID NO: 1999282 - RNA, 22 nt, Homo sapiens
ugcaaauauaucugcuauucuc

SEQ ID NO: 1999283 - RNA, 13 nt, Homo sapiens
caauaaauuauuc

SEQ ID NO: 1999284 - RNA, 20 nt, Homo sapiens
cagcucaaugaccuggagca

SEQ ID NO: 1999285 - RNA, 16 nt, Homo sapiens
caugaaaucugaggaa

SEQ ID NO: 1999286 - RNA, 18 nt, Homo sapiens
caggggucucccugagcc

SEQ ID NO: 1999287 - RNA, 15 nt, Homo sapiens
ccugggggccagcug

SEQ ID NO: 1999288 - RNA, 11 nt, Homo sapiens
aucacuggguc

SEQ ID NO: 1999289 - RNA, 14 nt, Homo sapiens
ucguugaggccaag

SEQ ID NO: 1999290 - RNA, 21 nt, Homo sapiens
auagcugcaaguguaucuccu

SEQ ID NO: 1999291 - RNA, 15 nt, Homo sapiens
gccuguggugcuuga

SEQ ID NO: 1999292 - RNA, 21 nt, Homo sapiens
ucguuuaaaaacaaaggaaua

SEQ ID NO: 1999293 - RNA, 21 nt, Homo sapiens
ccagcaggagccagccaaggc

SEQ ID NO: 1999294 - RNA, 15 nt, Homo sapiens
aauuaaaccaaugaa

SEQ ID NO: 1999295 - RNA, 20 nt, Homo sapiens
agagagaugagcacuucuaa

SEQ ID NO: 1999296 - RNA, 21 nt, Homo sapiens
ccucaggauuucauugacuga

SEQ ID NO: 1999297 - RNA, 19 nt, Homo sapiens
ugucccaccccuaccucua

SEQ ID NO: 1999298 - RNA, 22 nt, Homo sapiens
agccagcaagagggaacaaaac

SEQ ID NO: 1999299 - RNA, 15 nt, Homo sapiens
ucuaugcuuuggaau

SEQ ID NO: 1999300 - RNA, 22 nt, Homo sapiens
auugaaaugggaacaauaucaa

SEQ ID NO: 1999301 - RNA, 21 nt, Homo sapiens
aacauguuagaagcaaugaau

SEQ ID NO: 1999302 - RNA, 12 nt, Homo sapiens
cugaauucacuc

SEQ ID NO: 1999303 - RNA, 15 nt, Homo sapiens
aaagucccccuucaa

SEQ ID NO: 1999304 - RNA, 18 nt, Homo sapiens
ucuacagauggcauaccu

SEQ ID NO: 1999305 - RNA, 16 nt, Homo sapiens
gaauaagaauggagca

SEQ ID NO: 1999306 - RNA, 18 nt, Homo sapiens
caaaaggccucuuguaaa

SEQ ID NO: 1999307 - RNA, 14 nt, Homo sapiens
aauccuucuaaucu

SEQ ID NO: 1999308 - RNA, 14 nt, Homo sapiens
aaugucaccaccuu

SEQ ID NO: 1999309 - RNA, 16 nt, Homo sapiens
ggcucagucucaggag

SEQ ID NO: 1999310 - RNA, 14 nt, Homo sapiens
ugaaaacacacuca

SEQ ID NO: 1999311 - RNA, 18 nt, Homo sapiens
caagaaaauggccaguga

SEQ ID NO: 1999312 - RNA, 22 nt, Homo sapiens
cucaaagcauaaaauggaauaa

SEQ ID NO: 1999313 - RNA, 19 nt, Homo sapiens
ccaggagggaccacccucc

SEQ ID NO: 1999314 - RNA, 12 nt, Homo sapiens
agccuccagugc

SEQ ID NO: 1999315 - RNA, 16 nt, Homo sapiens
aucacccugaauucau

SEQ ID NO: 1999316 - RNA, 21 nt, Homo sapiens
aauccacagcuauauccugau

SEQ ID NO: 1999317 - RNA, 13 nt, Homo sapiens
uuuucugccaaga

SEQ ID NO: 1999318 - RNA, 14 nt, Homo sapiens
uguuuauugcaaua

SEQ ID NO: 1999319 - RNA, 14 nt, Homo sapiens
ugauuuuugcuauu

SEQ ID NO: 1999320 - RNA, 18 nt, Homo sapiens
uaaaauaaaacucucagu

SEQ ID NO: 1999321 - RNA, 20 nt, Homo sapiens
cagguggacacacaaggugc

SEQ ID NO: 1999322 - RNA, 19 nt, Homo sapiens
uuaguucagccauugugga

SEQ ID NO: 1999323 - RNA, 13 nt, Homo sapiens
ugaaaggugcuga

SEQ ID NO: 1999324 - RNA, 16 nt, Homo sapiens
cuuugcaggcccagca

SEQ ID NO: 1999325 - RNA, 16 nt, Homo sapiens
caaaucuucacugagc

SEQ ID NO: 1999326 - RNA, 19 nt, Homo sapiens
cauucucaccaacuuguag

SEQ ID NO: 1999327 - RNA, 17 nt, Homo sapiens
uccuauguuucacugug

SEQ ID NO: 1999328 - RNA, 20 nt, Homo sapiens
cauuuugucaguuuuaucuu

SEQ ID NO: 1999329 - RNA, 24 nt, Homo sapiens
auuagaagacaacaggcauagcaa

SEQ ID NO: 1999330 - RNA, 16 nt, Homo sapiens
agagaguacacugugu

SEQ ID NO: 1999331 - RNA, 14 nt, Homo sapiens
cuacuagagucuga

SEQ ID NO: 1999332 - RNA, 20 nt, Homo sapiens
cgcaucccagacuugcugaa

SEQ ID NO: 1999333 - RNA, 22 nt, Homo sapiens
caaaggaaauugucaucugcca

SEQ ID NO: 1999334 - RNA, 22 nt, Homo sapiens
ucacuuuuuuugaggacauuga

SEQ ID NO: 1999335 - RNA, 20 nt, Homo sapiens
cauuaaagugcacugugucc

SEQ ID NO: 1999336 - RNA, 21 nt, Homo sapiens
gggcagagcacagcgggguga

SEQ ID NO: 1999337 - RNA, 16 nt, Homo sapiens
ucccuucuccaucucu

SEQ ID NO: 1999338 - RNA, 13 nt, Homo sapiens
uccaggugagaac

SEQ ID NO: 1999339 - RNA, 20 nt, Homo sapiens
ucaguaugggaaccccaaau

SEQ ID NO: 1999340 - RNA, 13 nt, Homo sapiens
accauggaacauu

SEQ ID NO: 1999341 - RNA, 17 nt, Homo sapiens
aacugaggcucaggcca

SEQ ID NO: 1999342 - RNA, 21 nt, Homo sapiens
ggcuucaaagugugugugugc

SEQ ID NO: 1999343 - RNA, 15 nt, Homo sapiens
uaccaagcugugacc

SEQ ID NO: 1999344 - RNA, 20 nt, Homo sapiens
acuuucauuauagcagagag

SEQ ID NO: 1999345 - RNA, 16 nt, Homo sapiens
ugauucccuccugcua

SEQ ID NO: 1999346 - RNA, 12 nt, Homo sapiens
ugguuaaaguau

SEQ ID NO: 1999347 - RNA, 22 nt, Homo sapiens
cuggagauggaaaaucacacca

SEQ ID NO: 1999348 - RNA, 18 nt, Homo sapiens
caauguuuuuaaaaaucu

SEQ ID NO: 1999349 - RNA, 15 nt, Homo sapiens
guuguggggccucag

SEQ ID NO: 1999350 - RNA, 17 nt, Homo sapiens
auccaacucucugagag

SEQ ID NO: 1999351 - RNA, 23 nt, Homo sapiens
cuuugucccggggcuccacugaa

SEQ ID NO: 1999352 - RNA, 13 nt, Homo sapiens
ggagcugcaaauu

SEQ ID NO: 1999353 - RNA, 23 nt, Homo sapiens
aggcguggugggauuugcuccug

SEQ ID NO: 1999354 - RNA, 22 nt, Homo sapiens
gugccgcucuuggggacauggg

SEQ ID NO: 1999355 - RNA, 16 nt, Homo sapiens
aucaucauggccagcu

SEQ ID NO: 1999356 - RNA, 14 nt, Homo sapiens
cuuacuaaaugcag

SEQ ID NO: 1999357 - RNA, 16 nt, Homo sapiens
ucacaaaugauauuaa

SEQ ID NO: 1999358 - RNA, 16 nt, Homo sapiens
gaaaaaauucucuuaa

SEQ ID NO: 1999359 - RNA, 12 nt, Homo sapiens
gccucaguucua

SEQ ID NO: 1999360 - RNA, 12 nt, Homo sapiens
uuuacagugucu

SEQ ID NO: 1999361 - RNA, 14 nt, Homo sapiens
aauaucaguauucu

SEQ ID NO: 1999362 - RNA, 14 nt, Homo sapiens
uccuccagaccauu

SEQ ID NO: 1999363 - RNA, 18 nt, Homo sapiens
acugcccuccagggccag

SEQ ID NO: 1999364 - RNA, 23 nt, Homo sapiens
uaagugaggaugaaaaaauaaca

SEQ ID NO: 1999365 - RNA, 13 nt, Homo sapiens
cccagcacuuugg

SEQ ID NO: 1999366 - RNA, 13 nt, Homo sapiens
cucagcacucugg

SEQ ID NO: 1999367 - RNA, 19 nt, Homo sapiens
accuggagaguacauuugc

SEQ ID NO: 1999368 - RNA, 16 nt, Homo sapiens
aaaguggaaguaugua

SEQ ID NO: 1999369 - RNA, 22 nt, Homo sapiens
aaaaaaaccaaaacugugcaga

SEQ ID NO: 1999370 - RNA, 14 nt, Homo sapiens
gagucucuguauaa

SEQ ID NO: 1999371 - RNA, 14 nt, Homo sapiens
aaaccucuaugcaa

SEQ ID NO: 1999372 - RNA, 20 nt, Homo sapiens
acucaucaccccucuucccc

SEQ ID NO: 1999373 - RNA, 19 nt, Homo sapiens
aagaucacgccacuggacu

SEQ ID NO: 1999374 - RNA, 20 nt, Homo sapiens
agugucaaauaaacacugug

SEQ ID NO: 1999375 - RNA, 23 nt, Homo sapiens
cugaaaaauggagcaguaaugca

SEQ ID NO: 1999376 - RNA, 15 nt, Homo sapiens
uacugauucacugca

SEQ ID NO: 1999377 - RNA, 23 nt, Homo sapiens
gcugcuggaggaaaacugagacu

SEQ ID NO: 1999378 - RNA, 22 nt, Homo sapiens
uccaaggguuuucaccuuagca

SEQ ID NO: 1999379 - RNA, 13 nt, Homo sapiens
aagugcaugucac

SEQ ID NO: 1999380 - RNA, 12 nt, Homo sapiens
uugauucuugcc

SEQ ID NO: 1999381 - RNA, 16 nt, Homo sapiens
agcccagcuugugugc

SEQ ID NO: 1999382 - RNA, 16 nt, Homo sapiens
cccaucucccugcuuu

SEQ ID NO: 1999383 - RNA, 14 nt, Homo sapiens
agcuaaauggcaac

SEQ ID NO: 1999384 - RNA, 20 nt, Homo sapiens
aaauccaacuuucacaguga

SEQ ID NO: 1999385 - RNA, 16 nt, Homo sapiens
agcuugaaaacucacu

SEQ ID NO: 1999386 - RNA, 17 nt, Homo sapiens
cagccuaggcagaggcu

SEQ ID NO: 1999387 - RNA, 18 nt, Homo sapiens
auuugucccaagugccaa

SEQ ID NO: 1999388 - RNA, 15 nt, Homo sapiens
cgccuccccaaguca

SEQ ID NO: 1999389 - RNA, 23 nt, Homo sapiens
agaggccagcacauuaucuucau

SEQ ID NO: 1999390 - RNA, 17 nt, Homo sapiens
cuugacgacaagaccac

SEQ ID NO: 1999391 - RNA, 23 nt, Homo sapiens
uacuggauuguguuugugccaua

SEQ ID NO: 1999392 - RNA, 13 nt, Homo sapiens
cagggccaguccu

SEQ ID NO: 1999393 - RNA, 20 nt, Homo sapiens
aaacucucugguuuacuuca

SEQ ID NO: 1999394 - RNA, 17 nt, Homo sapiens
agccuaauugucacauc

SEQ ID NO: 1999395 - RNA, 14 nt, Homo sapiens
auacuggaaaccua

SEQ ID NO: 1999396 - RNA, 14 nt, Homo sapiens
aguggaguugacuc

SEQ ID NO: 1999397 - RNA, 15 nt, Homo sapiens
ucaacaguaucugug

SEQ ID NO: 1999398 - RNA, 15 nt, Homo sapiens
uccugucugcccuag

SEQ ID NO: 1999399 - RNA, 19 nt, Homo sapiens
cuguuuccauagggugaca

SEQ ID NO: 1999400 - RNA, 20 nt, Homo sapiens
guuguuugguuagugacuga

SEQ ID NO: 1999401 - RNA, 15 nt, Homo sapiens
auggagugccuguac

SEQ ID NO: 1999402 - RNA, 17 nt, Homo sapiens
auaccuuuagauuucag

SEQ ID NO: 1999403 - RNA, 16 nt, Homo sapiens
uucuuaaaaauaugcu

SEQ ID NO: 1999404 - RNA, 21 nt, Homo sapiens
aaauaaaaauuacuguguuag

SEQ ID NO: 1999405 - RNA, 18 nt, Homo sapiens
aguuucugauaccacugc

SEQ ID NO: 1999406 - RNA, 16 nt, Homo sapiens
ccgccaaaggcccaaa

SEQ ID NO: 1999407 - RNA, 18 nt, Homo sapiens
gccccagggguggaacaa

SEQ ID NO: 1999408 - RNA, 15 nt, Homo sapiens
ggcaagcacuaccag

SEQ ID NO: 1999409 - RNA, 18 nt, Homo sapiens
uaaaaguugaaaaaccac

SEQ ID NO: 1999410 - RNA, 21 nt, Homo sapiens
uucaacuuugaauaaagaaua

SEQ ID NO: 1999411 - RNA, 19 nt, Homo sapiens
uaucaaaugaauaaauccu

SEQ ID NO: 1999412 - RNA, 15 nt, Homo sapiens
cucuuugcccaaaau

SEQ ID NO: 1999413 - RNA, 18 nt, Homo sapiens
agggcauagcgacagugu

SEQ ID NO: 1999414 - RNA, 21 nt, Homo sapiens
caucuauuuccucugugcaaa

SEQ ID NO: 1999415 - RNA, 13 nt, Homo sapiens
acuucuagcugua

SEQ ID NO: 1999416 - RNA, 23 nt, Homo sapiens
ucacuaaagaaaaacuaauguca

SEQ ID NO: 1999417 - RNA, 13 nt, Homo sapiens
ugggccccaucau

SEQ ID NO: 1999418 - RNA, 12 nt, Homo sapiens
caguggggcucu

SEQ ID NO: 1999419 - RNA, 16 nt, Homo sapiens
ugaagguucccaagga

SEQ ID NO: 1999420 - RNA, 15 nt, Homo sapiens
ugaguguguaugugu

SEQ ID NO: 1999421 - RNA, 19 nt, Homo sapiens
aagauauagaaacucucau

SEQ ID NO: 1999422 - RNA, 16 nt, Homo sapiens
cauaauugcaagggaa

SEQ ID NO: 1999423 - RNA, 22 nt, Homo sapiens
uauguaaauguguuagcacuga

SEQ ID NO: 1999424 - RNA, 17 nt, Homo sapiens
uuuucaguuuuaccucu

SEQ ID NO: 1999425 - RNA, 17 nt, Homo sapiens
aaaauaaguugacuuuc

SEQ ID NO: 1999426 - RNA, 22 nt, Homo sapiens
ucucuaacagcucaggaucucu

SEQ ID NO: 1999427 - RNA, 13 nt, Homo sapiens
guaauaaauauga

SEQ ID NO: 1999428 - RNA, 22 nt, Homo sapiens
gaaagucaagucuaccugccuu

SEQ ID NO: 1999429 - RNA, 16 nt, Homo sapiens
guaacauccaagccag

SEQ ID NO: 1999430 - RNA, 16 nt, Homo sapiens
augaaauuuacaguga

SEQ ID NO: 1999431 - RNA, 18 nt, Homo sapiens
ggaguucugcucauucua

SEQ ID NO: 1999432 - RNA, 18 nt, Homo sapiens
cugcuuuugaggacaguu

SEQ ID NO: 1999433 - RNA, 22 nt, Homo sapiens
gguccccacugccugcuggaaa

SEQ ID NO: 1999434 - RNA, 22 nt, Homo sapiens
auaauguacucacauauaacau

SEQ ID NO: 1999435 - RNA, 16 nt, Homo sapiens
gcuuggaguucucuau

SEQ ID NO: 1999436 - RNA, 21 nt, Homo sapiens
cugccugguccucacacucac

SEQ ID NO: 1999437 - RNA, 13 nt, Homo sapiens
uaaaccuagggag

SEQ ID NO: 1999438 - RNA, 13 nt, Homo sapiens
guggucacuggaa

SEQ ID NO: 1999439 - RNA, 23 nt, Homo sapiens
acugccucccauccuucccucau

SEQ ID NO: 1999440 - RNA, 17 nt, Homo sapiens
uaaggucauuacucuca

SEQ ID NO: 1999441 - RNA, 16 nt, Homo sapiens
uucccacuuucauuca

SEQ ID NO: 1999442 - RNA, 17 nt, Homo sapiens
uuucagauaaacaacaa

SEQ ID NO: 1999443 - RNA, 16 nt, Homo sapiens
cacugcgggacagagg

SEQ ID NO: 1999444 - RNA, 21 nt, Homo sapiens
gguuccaguaaucugagcagu

SEQ ID NO: 1999445 - RNA, 16 nt, Homo sapiens
uacuguaauaauaccu

SEQ ID NO: 1999446 - RNA, 23 nt, Homo sapiens
cuggucuccucccaaaauacuac

SEQ ID NO: 1999447 - RNA, 20 nt, Homo sapiens
caagacuuggcaacagaagc

SEQ ID NO: 1999448 - RNA, 19 nt, Homo sapiens
uaucaaacuacugccauuu

SEQ ID NO: 1999449 - RNA, 19 nt, Homo sapiens
uauauuguuuucaguguac

SEQ ID NO: 1999450 - RNA, 19 nt, Homo sapiens
guaugcacaauuccaugac

SEQ ID NO: 1999451 - RNA, 16 nt, Homo sapiens
caugcuggcagaggca

SEQ ID NO: 1999452 - RNA, 14 nt, Homo sapiens
gggccccacccggg

SEQ ID NO: 1999453 - RNA, 13 nt, Homo sapiens
gggcccauggggu

SEQ ID NO: 1999454 - RNA, 12 nt, Homo sapiens
aaugccacaaaa

SEQ ID NO: 1999455 - RNA, 14 nt, Homo sapiens
uggauguagucagu

SEQ ID NO: 1999456 - RNA, 18 nt, Homo sapiens
ucccgggggcacugccug

SEQ ID NO: 1999457 - RNA, 16 nt, Homo sapiens
agacaccuucugugcu

SEQ ID NO: 1999458 - RNA, 13 nt, Homo sapiens
agccaaugugaac

SEQ ID NO: 1999459 - RNA, 13 nt, Homo sapiens
agcaaaugugacc

SEQ ID NO: 1999460 - RNA, 14 nt, Homo sapiens
aucgucauuuugca

SEQ ID NO: 1999461 - RNA, 21 nt, Homo sapiens
agacauuucucuaacuccugc

SEQ ID NO: 1999462 - RNA, 19 nt, Homo sapiens
cauggcagauuugcaacua

SEQ ID NO: 1999463 - RNA, 18 nt, Homo sapiens
uucagacaagaaugugca

SEQ ID NO: 1999464 - RNA, 16 nt, Homo sapiens
aacacuucugcuuuca

SEQ ID NO: 1999465 - RNA, 16 nt, Homo sapiens
agacugaaaaacuguu

SEQ ID NO: 1999466 - RNA, 18 nt, Homo sapiens
ggaagauaccagcuuuuu

SEQ ID NO: 1999467 - RNA, 19 nt, Homo sapiens
gaaauucucaucaguccau

SEQ ID NO: 1999468 - RNA, 15 nt, Homo sapiens
uguauuugaacacuu

SEQ ID NO: 1999469 - RNA, 13 nt, Homo sapiens
ucucugcagucaa

SEQ ID NO: 1999470 - RNA, 16 nt, Homo sapiens
caauggcacgaucuca

SEQ ID NO: 1999471 - RNA, 14 nt, Homo sapiens
aauguuauucuguu

SEQ ID NO: 1999472 - RNA, 16 nt, Homo sapiens
cauggguucaccagcc

SEQ ID NO: 1999473 - RNA, 15 nt, Homo sapiens
accgcccuugccgaa

SEQ ID NO: 1999474 - RNA, 14 nt, Homo sapiens
uuuuaaguugucaa

SEQ ID NO: 1999475 - RNA, 19 nt, Homo sapiens
ccucccugggccaccuccu

SEQ ID NO: 1999476 - RNA, 23 nt, Homo sapiens
cucagugagauauuugguaccau

SEQ ID NO: 1999477 - RNA, 20 nt, Homo sapiens
aaaguuaaacuuuaucucac

SEQ ID NO: 1999478 - RNA, 21 nt, Homo sapiens
cuucugcaaaguggcagggac

SEQ ID NO: 1999479 - RNA, 22 nt, Homo sapiens
auuuuuuugugggaaauccaca

SEQ ID NO: 1999480 - RNA, 17 nt, Homo sapiens
aauaaugaauacauuuc

SEQ ID NO: 1999481 - RNA, 18 nt, Homo sapiens
aaaugcuguuaguaaauu

SEQ ID NO: 1999482 - RNA, 20 nt, Homo sapiens
auaucuugaagaauauuguu

SEQ ID NO: 1999483 - RNA, 23 nt, Homo sapiens
cccagugggccuguggcauucau

SEQ ID NO: 1999484 - RNA, 16 nt, Homo sapiens
cagagaugaucuugcc

SEQ ID NO: 1999485 - RNA, 11 nt, Homo sapiens
aaauguacaau

SEQ ID NO: 1999486 - RNA, 11 nt, Homo sapiens
gaauucuuccg

SEQ ID NO: 1999487 - RNA, 20 nt, Homo sapiens
uguuuucaggacaacacuuc

SEQ ID NO: 1999488 - RNA, 17 nt, Homo sapiens
auacaagagacauauaa

SEQ ID NO: 1999489 - RNA, 12 nt, Homo sapiens
auugaaaaccaa

SEQ ID NO: 1999490 - RNA, 19 nt, Homo sapiens
gaaaaaguucugcagauaa

SEQ ID NO: 1999491 - RNA, 14 nt, Homo sapiens
ccuggucaggcucu

SEQ ID NO: 1999492 - RNA, 19 nt, Homo sapiens
agacucuguaauugaauau

SEQ ID NO: 1999493 - RNA, 17 nt, Homo sapiens
augguggaucuuugcua

SEQ ID NO: 1999494 - RNA, 13 nt, Homo sapiens
gugggcacacuga

SEQ ID NO: 1999495 - RNA, 23 nt, Homo sapiens
cugguggcugggcccagcagggg

SEQ ID NO: 1999496 - RNA, 19 nt, Homo sapiens
uccuucacucccugucaua

SEQ ID NO: 1999497 - RNA, 18 nt, Homo sapiens
cuuuagaaauauccuuuu

SEQ ID NO: 1999498 - RNA, 22 nt, Homo sapiens
auauauaggcaguugcaugcua

SEQ ID NO: 1999499 - RNA, 12 nt, Homo sapiens
agugcuaccucu

SEQ ID NO: 1999500 - RNA, 19 nt, Homo sapiens
agccuccugaguagcugag

SEQ ID NO: 1999501 - RNA, 14 nt, Homo sapiens
uguauccauuauca

SEQ ID NO: 1999502 - RNA, 13 nt, Homo sapiens
cuaggaauggagg

SEQ ID NO: 1999503 - RNA, 20 nt, Homo sapiens
ucccaauuagcuuggccuac

SEQ ID NO: 1999504 - RNA, 21 nt, Homo sapiens
agcagacaucaagcucaaggc

SEQ ID NO: 1999505 - RNA, 23 nt, Homo sapiens
cacagcagcaccuccuccaugca

SEQ ID NO: 1999506 - RNA, 13 nt, Homo sapiens
ugacuugagccac

SEQ ID NO: 1999507 - RNA, 19 nt, Homo sapiens
uccuguuagcauaauguga

SEQ ID NO: 1999508 - RNA, 21 nt, Homo sapiens
uccaugaacaucauggacuga

SEQ ID NO: 1999509 - RNA, 16 nt, Homo sapiens
aggacuaggcauguca

SEQ ID NO: 1999510 - RNA, 21 nt, Homo sapiens
cucucuggaccugaccagacu

SEQ ID NO: 1999511 - RNA, 19 nt, Homo sapiens
cuacaauaaacugguauga

SEQ ID NO: 1999512 - RNA, 20 nt, Homo sapiens
uuggaacuauuuacaaggau

SEQ ID NO: 1999513 - RNA, 20 nt, Homo sapiens
uugcuacccagaaauccauc

SEQ ID NO: 1999514 - RNA, 22 nt, Homo sapiens
caggauaacagcaauuguucag

SEQ ID NO: 1999515 - RNA, 19 nt, Homo sapiens
aguucacaggaggccagug

SEQ ID NO: 1999516 - RNA, 16 nt, Homo sapiens
cucccuaggagaccaa

SEQ ID NO: 1999517 - RNA, 23 nt, Homo sapiens
uggaaaugaaacugcugugaaug

SEQ ID NO: 1999518 - RNA, 13 nt, Homo sapiens
uaauucauggcau

SEQ ID NO: 1999519 - RNA, 16 nt, Homo sapiens
gagauuucaugccugg

SEQ ID NO: 1999520 - RNA, 19 nt, Homo sapiens
auguaccauaaugcuaaau

SEQ ID NO: 1999521 - RNA, 21 nt, Homo sapiens
ggaugguggcuuuaggggaag

SEQ ID NO: 1999522 - RNA, 14 nt, Homo sapiens
augcuuucuacuca

SEQ ID NO: 1999523 - RNA, 18 nt, Homo sapiens
auaugcagccaaccaaga

SEQ ID NO: 1999524 - RNA, 14 nt, Homo sapiens
ccagauuggcucac

SEQ ID NO: 1999525 - RNA, 14 nt, Homo sapiens
gaaguuugcaucuc

SEQ ID NO: 1999526 - RNA, 14 nt, Homo sapiens
uguuugcuggguau

SEQ ID NO: 1999527 - RNA, 15 nt, Homo sapiens
uucauggacacuuug

SEQ ID NO: 1999528 - RNA, 19 nt, Homo sapiens
uauccaaucugugaugaca

SEQ ID NO: 1999529 - RNA, 20 nt, Homo sapiens
caugguggugugugccugua

SEQ ID NO: 1999530 - RNA, 14 nt, Homo sapiens
uguuucuaugucca

SEQ ID NO: 1999531 - RNA, 16 nt, Homo sapiens
caggagcuugauccag

SEQ ID NO: 1999532 - RNA, 20 nt, Homo sapiens
ucccagcagcggcaccaagg

SEQ ID NO: 1999533 - RNA, 23 nt, Homo sapiens
ucuuuaauaaauugcuuacugau

SEQ ID NO: 1999534 - RNA, 18 nt, Homo sapiens
uaccuggggccaaaccca

SEQ ID NO: 1999535 - RNA, 19 nt, Homo sapiens
aaugucuaucaacuuuaau

SEQ ID NO: 1999536 - RNA, 20 nt, Homo sapiens
agaugauuaaacagacuuua

SEQ ID NO: 1999537 - RNA, 19 nt, Homo sapiens
cuaaacaagaaucagucua

SEQ ID NO: 1999538 - RNA, 19 nt, Homo sapiens
agaaaacaagugggacaua

SEQ ID NO: 1999539 - RNA, 20 nt, Homo sapiens
agccaggcccagccgacccc

SEQ ID NO: 1999540 - RNA, 21 nt, Homo sapiens
agugcagucacccuguggcaa

SEQ ID NO: 1999541 - RNA, 19 nt, Homo sapiens
cagccaucguccugggacu

SEQ ID NO: 1999542 - RNA, 19 nt, Homo sapiens
gaucucccugccgccucaa

SEQ ID NO: 1999543 - RNA, 22 nt, Homo sapiens
aucaaguccuaguuguucagca

SEQ ID NO: 1999544 - RNA, 18 nt, Homo sapiens
aguguucacaacagugaa

SEQ ID NO: 1999545 - RNA, 16 nt, Homo sapiens
aaagcaaugugguagu

SEQ ID NO: 1999546 - RNA, 14 nt, Homo sapiens
ucauuuacuguggc

SEQ ID NO: 1999547 - RNA, 21 nt, Homo sapiens
gcucccuuuuaaaaggagcac

SEQ ID NO: 1999548 - RNA, 16 nt, Homo sapiens
gcuaggggacuugggg

SEQ ID NO: 1999549 - RNA, 21 nt, Homo sapiens
uccuagaagaaccaaauaccu

SEQ ID NO: 1999550 - RNA, 22 nt, Homo sapiens
cuggccagugcccugaucccag

SEQ ID NO: 1999551 - RNA, 13 nt, Homo sapiens
cacacuucuugaa

SEQ ID NO: 1999552 - RNA, 16 nt, Homo sapiens
accaagaugccaucug

SEQ ID NO: 1999553 - RNA, 14 nt, Homo sapiens
aaaauucacuucua

SEQ ID NO: 1999554 - RNA, 15 nt, Homo sapiens
aaucacugcauuuca

SEQ ID NO: 1999555 - RNA, 16 nt, Homo sapiens
agccaauauaaugggc

SEQ ID NO: 1999556 - RNA, 20 nt, Homo sapiens
ucuuacauugccaagucaga

SEQ ID NO: 1999557 - RNA, 22 nt, Homo sapiens
gaacucugacaacagacuucug

SEQ ID NO: 1999558 - RNA, 19 nt, Homo sapiens
gcugggccauguccaaaga

SEQ ID NO: 1999559 - RNA, 19 nt, Homo sapiens
auauuagccaguaccagcu

SEQ ID NO: 1999560 - RNA, 11 nt, Homo sapiens
auuucuacugu

SEQ ID NO: 1999561 - RNA, 16 nt, Homo sapiens
agcauccacuggaaaa

SEQ ID NO: 1999562 - RNA, 20 nt, Homo sapiens
agaccaagacuuuugucuga

SEQ ID NO: 1999563 - RNA, 15 nt, Homo sapiens
auucaagccugugaa

SEQ ID NO: 1999564 - RNA, 23 nt, Homo sapiens
cugagcuggaaggggccacgugg

SEQ ID NO: 1999565 - RNA, 14 nt, Homo sapiens
cucaguuugcauau

SEQ ID NO: 1999566 - RNA, 14 nt, Homo sapiens
caaagauacaugua

SEQ ID NO: 1999567 - RNA, 23 nt, Homo sapiens
cagccccuagaaacccaagcucc

SEQ ID NO: 1999568 - RNA, 23 nt, Homo sapiens
ccaugcaauuuuauuaaaugcau

SEQ ID NO: 1999569 - RNA, 12 nt, Homo sapiens
cauuacugccaa

SEQ ID NO: 1999570 - RNA, 13 nt, Homo sapiens
accugauuuacua

SEQ ID NO: 1999571 - RNA, 17 nt, Homo sapiens
uagaagugaguguaauc

SEQ ID NO: 1999572 - RNA, 15 nt, Homo sapiens
uguucagggcuguga

SEQ ID NO: 1999573 - RNA, 15 nt, Homo sapiens
acuucccuuaagagu

SEQ ID NO: 1999574 - RNA, 19 nt, Homo sapiens
acuuaaaugguaauaagca

SEQ ID NO: 1999575 - RNA, 20 nt, Homo sapiens
agccccuggaugcagccuca

SEQ ID NO: 1999576 - RNA, 11 nt, Homo sapiens
cagggccucug

SEQ ID NO: 1999577 - RNA, 14 nt, Homo sapiens
cuuacuauuacaua

SEQ ID NO: 1999578 - RNA, 20 nt, Homo sapiens
agcacggugacucuguccag

SEQ ID NO: 1999579 - RNA, 18 nt, Homo sapiens
cuuuaaucuguuguuuga

SEQ ID NO: 1999580 - RNA, 18 nt, Homo sapiens
uuaaaguuuuauaugcau

SEQ ID NO: 1999581 - RNA, 15 nt, Homo sapiens
uauaagacuacuaua

SEQ ID NO: 1999582 - RNA, 13 nt, Homo sapiens
gcuuuaauuucau

SEQ ID NO: 1999583 - RNA, 12 nt, Homo sapiens
ugucccugugga

SEQ ID NO: 1999584 - RNA, 18 nt, Homo sapiens
uuuguaauauuuuccaua

SEQ ID NO: 1999585 - RNA, 17 nt, Homo sapiens
uuucuacacguugccca

SEQ ID NO: 1999586 - RNA, 22 nt, Homo sapiens
aacaauugcuuuugaggcucag

SEQ ID NO: 1999587 - RNA, 19 nt, Homo sapiens
cagagaaauacuuucaggc

SEQ ID NO: 1999588 - RNA, 19 nt, Homo sapiens
ucucugacugcuuuggaua

SEQ ID NO: 1999589 - RNA, 15 nt, Homo sapiens
ucaccucucaccucc

SEQ ID NO: 1999590 - RNA, 15 nt, Homo sapiens
uaacucacugccuag

SEQ ID NO: 1999591 - RNA, 18 nt, Homo sapiens
guucacucggcacuacuu

SEQ ID NO: 1999592 - RNA, 17 nt, Homo sapiens
acaccacgguagugccu

SEQ ID NO: 1999593 - RNA, 14 nt, Homo sapiens
cuacauaguuauuc

SEQ ID NO: 1999594 - RNA, 14 nt, Homo sapiens
cagcucaguaguau

SEQ ID NO: 1999595 - RNA, 16 nt, Homo sapiens
gauaccugcacugucc

SEQ ID NO: 1999596 - RNA, 20 nt, Homo sapiens
uaucaacccucucuacaggu

SEQ ID NO: 1999597 - RNA, 18 nt, Homo sapiens
accccucgccccagccuc

SEQ ID NO: 1999598 - RNA, 24 nt, Homo sapiens
uaaaaggaaauguaaaagcacaug

SEQ ID NO: 1999599 - RNA, 19 nt, Homo sapiens
cuggagggggagcaccagc

SEQ ID NO: 1999600 - RNA, 13 nt, Homo sapiens
gagaggccucauc

SEQ ID NO: 1999601 - RNA, 18 nt, Homo sapiens
ucagccaggugaacugga

SEQ ID NO: 1999602 - RNA, 20 nt, Homo sapiens
aaguuuuuuauuaugcauua

SEQ ID NO: 1999603 - RNA, 17 nt, Homo sapiens
uccuuuuacuaccauuu

SEQ ID NO: 1999604 - RNA, 23 nt, Homo sapiens
ggcaguaugugauggacugggga

SEQ ID NO: 1999605 - RNA, 23 nt, Homo sapiens
cuaaaggaugagauuuuucaugu

SEQ ID NO: 1999606 - RNA, 17 nt, Homo sapiens
cauguaguaguacuuga

SEQ ID NO: 1999607 - RNA, 16 nt, Homo sapiens
aagugcuuucuucucc

SEQ ID NO: 1999608 - RNA, 18 nt, Homo sapiens
cucgcugugccaccaccc

SEQ ID NO: 1999609 - RNA, 18 nt, Homo sapiens
caggagagugugugggca

SEQ ID NO: 1999610 - RNA, 19 nt, Homo sapiens
ccuagcaacauaucucugc

SEQ ID NO: 1999611 - RNA, 15 nt, Homo sapiens
ucucuuucugcauaa

SEQ ID NO: 1999612 - RNA, 23 nt, Homo sapiens
ucuuugccuuagcuuugcaguga

SEQ ID NO: 1999613 - RNA, 20 nt, Homo sapiens
gauguuucaccaaggaaaua

SEQ ID NO: 1999614 - RNA, 15 nt, Homo sapiens
accagcuuugcagug

SEQ ID NO: 1999615 - RNA, 12 nt, Homo sapiens
uugcuuaaacau

SEQ ID NO: 1999616 - RNA, 13 nt, Homo sapiens
uaucucagccaua

SEQ ID NO: 1999617 - RNA, 19 nt, Homo sapiens
uucuccuguguaucuuuga

SEQ ID NO: 1999618 - RNA, 21 nt, Homo sapiens
uuguucaaaaugcagauuccu

SEQ ID NO: 1999619 - RNA, 23 nt, Homo sapiens
ucaaccauccccuccguggcauc

SEQ ID NO: 1999620 - RNA, 21 nt, Homo sapiens
augcacccaucagcacucugu

SEQ ID NO: 1999621 - RNA, 22 nt, Homo sapiens
acaacuggacucauuaucacag

SEQ ID NO: 1999622 - RNA, 21 nt, Homo sapiens
ccaacacugcucacagccuuu

SEQ ID NO: 1999623 - RNA, 21 nt, Homo sapiens
aguauggcaauaucuacagcu

SEQ ID NO: 1999624 - RNA, 20 nt, Homo sapiens
ucuggauaccauuauauguu

SEQ ID NO: 1999625 - RNA, 15 nt, Homo sapiens
cauucacaccagcua

SEQ ID NO: 1999626 - RNA, 15 nt, Homo sapiens
caagcaaaccuucuc

SEQ ID NO: 1999627 - RNA, 13 nt, Homo sapiens
aaaaaucugccac

SEQ ID NO: 1999628 - RNA, 17 nt, Homo sapiens
agcacagcugcauuaaa

SEQ ID NO: 1999629 - RNA, 14 nt, Homo sapiens
uucuuaguucauau

SEQ ID NO: 1999630 - RNA, 20 nt, Homo sapiens
cuuaacuuguuugguaguua

SEQ ID NO: 1999631 - RNA, 22 nt, Homo sapiens
aauguucuuaaccuuugauucu

SEQ ID NO: 1999632 - RNA, 20 nt, Homo sapiens
guuucacuuuuguugcccag

SEQ ID NO: 1999633 - RNA, 18 nt, Homo sapiens
aucucagggaacugaccc

SEQ ID NO: 1999634 - RNA, 18 nt, Homo sapiens
aggcugcccugaacaaaa

SEQ ID NO: 1999635 - RNA, 19 nt, Homo sapiens
gcacaguuuguggcuuaua

SEQ ID NO: 1999636 - RNA, 16 nt, Homo sapiens
ucuugcucuguucaca

SEQ ID NO: 1999637 - RNA, 19 nt, Homo sapiens
ucuggcagagucagcugcu

SEQ ID NO: 1999638 - RNA, 19 nt, Homo sapiens
agaaaggaacugcaauaau

SEQ ID NO: 1999639 - RNA, 24 nt, Homo sapiens
agcgaagaugauuucaguucauca

SEQ ID NO: 1999640 - RNA, 14 nt, Homo sapiens
cuauauauacaaug

SEQ ID NO: 1999641 - RNA, 18 nt, Homo sapiens
agagaagugggugggcac

SEQ ID NO: 1999642 - RNA, 19 nt, Homo sapiens
uugcaaugcaugauacuau

SEQ ID NO: 1999643 - RNA, 23 nt, Homo sapiens
auggaugaauaaauguuauagcu

SEQ ID NO: 1999644 - RNA, 19 nt, Homo sapiens
gugagcguguccacagagu

SEQ ID NO: 1999645 - RNA, 18 nt, Homo sapiens
gcuucucugacuucugcc

SEQ ID NO: 1999646 - RNA, 15 nt, Homo sapiens
aaguuacucugccuu

SEQ ID NO: 1999647 - RNA, 17 nt, Homo sapiens
cuugaaugaugccauga

SEQ ID NO: 1999648 - RNA, 22 nt, Homo sapiens
uaaagucaaggacgaauuugca

SEQ ID NO: 1999649 - RNA, 12 nt, Homo sapiens
cucugucaguca

SEQ ID NO: 1999650 - RNA, 16 nt, Homo sapiens
aguuuuguauucaaua

SEQ ID NO: 1999651 - RNA, 23 nt, Homo sapiens
gaugccaucccgucgacucucca

SEQ ID NO: 1999652 - RNA, 12 nt, Homo sapiens
agauauuacuuu

SEQ ID NO: 1999653 - RNA, 16 nt, Homo sapiens
ccaaaauguacuuaaa

SEQ ID NO: 1999654 - RNA, 14 nt, Homo sapiens
aaagcuuuauuuca

SEQ ID NO: 1999655 - RNA, 19 nt, Homo sapiens
cuuuuauccacuuaccuag

SEQ ID NO: 1999656 - RNA, 13 nt, Homo sapiens
aaagaagccacag

SEQ ID NO: 1999657 - RNA, 16 nt, Homo sapiens
ccuccugaauuaacua

SEQ ID NO: 1999658 - RNA, 21 nt, Homo sapiens
aggggaggggugaaauccaua

SEQ ID NO: 1999659 - RNA, 20 nt, Homo sapiens
ucugccguuuucccacuuuc

SEQ ID NO: 1999660 - RNA, 15 nt, Homo sapiens
caguugcauaucuua

SEQ ID NO: 1999661 - RNA, 15 nt, Homo sapiens
guacuacucuaggga

SEQ ID NO: 1999662 - RNA, 18 nt, Homo sapiens
aagauguuuuauuuugcc

SEQ ID NO: 1999663 - RNA, 13 nt, Homo sapiens
aaauaauagccau

SEQ ID NO: 1999664 - RNA, 22 nt, Homo sapiens
caccaaguaccaguauaagcau

SEQ ID NO: 1999665 - RNA, 22 nt, Homo sapiens
gccaaguuuuaaauauuaucua

SEQ ID NO: 1999666 - RNA, 23 nt, Homo sapiens
aagcugaagaaaaugaagcccua

SEQ ID NO: 1999667 - RNA, 21 nt, Homo sapiens
guccccacccuccacucagcu

SEQ ID NO: 1999668 - RNA, 18 nt, Homo sapiens
ucuguuaugcugugacac

SEQ ID NO: 1999669 - RNA, 18 nt, Homo sapiens
aauauuacucuaugauga

SEQ ID NO: 1999670 - RNA, 15 nt, Homo sapiens
ccaauugcugccaau

SEQ ID NO: 1999671 - RNA, 22 nt, Homo sapiens
cuccugugugauugacagcuuu

SEQ ID NO: 1999672 - RNA, 12 nt, Homo sapiens
accucaucuuuc

SEQ ID NO: 1999673 - RNA, 22 nt, Homo sapiens
auucguccuuagaauacuguau

SEQ ID NO: 1999674 - RNA, 21 nt, Homo sapiens
aucaaagacauggaauuaccu

SEQ ID NO: 1999675 - RNA, 14 nt, Homo sapiens
aacugaaagcacua

SEQ ID NO: 1999676 - RNA, 14 nt, Homo sapiens
caaucuuugacaau

SEQ ID NO: 1999677 - RNA, 14 nt, Homo sapiens
ccccaggcccuuca

SEQ ID NO: 1999678 - RNA, 14 nt, Homo sapiens
uuggaccuaaacau

SEQ ID NO: 1999679 - RNA, 18 nt, Homo sapiens
augagccgugaacugugc

SEQ ID NO: 1999680 - RNA, 20 nt, Homo sapiens
auauaacugucuuaguacac

SEQ ID NO: 1999681 - RNA, 21 nt, Homo sapiens
gcgagaagaaaggaagagaaa

SEQ ID NO: 1999682 - RNA, 14 nt, Homo sapiens
ucaucuccugaccc

SEQ ID NO: 1999683 - RNA, 13 nt, Homo sapiens
cugcaccaugcug

SEQ ID NO: 1999684 - RNA, 22 nt, Homo sapiens
gguggacuucaguguguguauu

SEQ ID NO: 1999685 - RNA, 19 nt, Homo sapiens
cacugauuguccauuuaca

SEQ ID NO: 1999686 - RNA, 16 nt, Homo sapiens
uccaccgucagcugua

SEQ ID NO: 1999687 - RNA, 19 nt, Homo sapiens
ccgaagagugaagggcagu

SEQ ID NO: 1999688 - RNA, 16 nt, Homo sapiens
gcacagccucagaaua

SEQ ID NO: 1999689 - RNA, 16 nt, Homo sapiens
ucuauccaaaguguca

SEQ ID NO: 1999690 - RNA, 11 nt, Homo sapiens
ugagggucccc

SEQ ID NO: 1999691 - RNA, 14 nt, Homo sapiens
gacauagcacuugc

SEQ ID NO: 1999692 - RNA, 21 nt, Homo sapiens
uccuggauuccucacuuugaa

SEQ ID NO: 1999693 - RNA, 17 nt, Homo sapiens
cauaacuguucucauuu

SEQ ID NO: 1999694 - RNA, 17 nt, Homo sapiens
aguguucaguguugaca

SEQ ID NO: 1999695 - RNA, 14 nt, Homo sapiens
ggaacauagacuca

SEQ ID NO: 1999696 - RNA, 12 nt, Homo sapiens
cccccaccacac

SEQ ID NO: 1999697 - RNA, 12 nt, Homo sapiens
aguguacaugga

SEQ ID NO: 1999698 - RNA, 21 nt, Homo sapiens
cuaccccgagggcgccaugca

SEQ ID NO: 1999699 - RNA, 16 nt, Homo sapiens
ucucuacccaguagau

SEQ ID NO: 1999700 - RNA, 18 nt, Homo sapiens
uccuucuggugucugcuu

SEQ ID NO: 1999701 - RNA, 22 nt, Homo sapiens
uucuuuuuuuuuuuugagacag

SEQ ID NO: 1999702 - RNA, 13 nt, Homo sapiens
uauucgugcagca

SEQ ID NO: 1999703 - RNA, 18 nt, Homo sapiens
uacagaaaagacucugac

SEQ ID NO: 1999704 - RNA, 19 nt, Homo sapiens
aagugaggagugccagcuc

SEQ ID NO: 1999705 - RNA, 12 nt, Homo sapiens
gggcauguuucu

SEQ ID NO: 1999706 - RNA, 21 nt, Homo sapiens
cuaagucaccuaaguacuuaa

SEQ ID NO: 1999707 - RNA, 13 nt, Homo sapiens
auaucuaaaaacu

SEQ ID NO: 1999708 - RNA, 19 nt, Homo sapiens
auucucucugcucagugau

SEQ ID NO: 1999709 - RNA, 12 nt, Homo sapiens
guaugccaagug

SEQ ID NO: 1999710 - RNA, 18 nt, Homo sapiens
cagagcacuuuaaaaaca

SEQ ID NO: 1999711 - RNA, 22 nt, Homo sapiens
auugccccuggcuuugccucuu

SEQ ID NO: 1999712 - RNA, 19 nt, Homo sapiens
caaggaaccauaugugcua

SEQ ID NO: 1999713 - RNA, 17 nt, Homo sapiens
cuugucaugugacaggu

SEQ ID NO: 1999714 - RNA, 22 nt, Homo sapiens
caguauaagcaucugccaucug

SEQ ID NO: 1999715 - RNA, 20 nt, Homo sapiens
ccucugguuccacucagcuu

SEQ ID NO: 1999716 - RNA, 16 nt, Homo sapiens
caucuucacauucuga

SEQ ID NO: 1999717 - RNA, 13 nt, Homo sapiens
aacugucauguaa

SEQ ID NO: 1999718 - RNA, 17 nt, Homo sapiens
ccaggccgccugccaua

SEQ ID NO: 1999719 - RNA, 23 nt, Homo sapiens
cuuaauuaugguaccucugucua

SEQ ID NO: 1999720 - RNA, 13 nt, Homo sapiens
ucaaauacaucuu

SEQ ID NO: 1999721 - RNA, 15 nt, Homo sapiens
uucagagaacccacu

SEQ ID NO: 1999722 - RNA, 14 nt, Homo sapiens
uccaagugguccac

SEQ ID NO: 1999723 - RNA, 18 nt, Homo sapiens
gaagcaggagaaucacuu

SEQ ID NO: 1999724 - RNA, 18 nt, Homo sapiens
cucuuaucaaguguuaca

SEQ ID NO: 1999725 - RNA, 18 nt, Homo sapiens
uuucucauuuagcauuga

SEQ ID NO: 1999726 - RNA, 16 nt, Homo sapiens
gacugagcagacuggu

SEQ ID NO: 1999727 - RNA, 19 nt, Homo sapiens
augugaauacucuucccac

SEQ ID NO: 1999728 - RNA, 22 nt, Homo sapiens
aaaaugcagcagggaugcccug

SEQ ID NO: 1999729 - RNA, 18 nt, Homo sapiens
gcacagggggaggccaua

SEQ ID NO: 1999730 - RNA, 22 nt, Homo sapiens
acacaaaacguuaagugaugaa

SEQ ID NO: 1999731 - RNA, 14 nt, Homo sapiens
cggaaggcaaagag

SEQ ID NO: 1999732 - RNA, 17 nt, Homo sapiens
aagcaguacacuuggau

SEQ ID NO: 1999733 - RNA, 18 nt, Homo sapiens
aguauauaauaugucacc

SEQ ID NO: 1999734 - RNA, 21 nt, Homo sapiens
aauacagauaaguguucuuca

SEQ ID NO: 1999735 - RNA, 23 nt, Homo sapiens
aagccucagcuacccacuauccu

SEQ ID NO: 1999736 - RNA, 15 nt, Homo sapiens
uauuuacugugcuaa

SEQ ID NO: 1999737 - RNA, 19 nt, Homo sapiens
uguuacacagcccaagagg

SEQ ID NO: 1999738 - RNA, 18 nt, Homo sapiens
auuuuuguggaagcacuu

SEQ ID NO: 1999739 - RNA, 18 nt, Homo sapiens
caggacauuaaggaccaa

SEQ ID NO: 1999740 - RNA, 19 nt, Homo sapiens
uaauuaaagugaggagaaa

SEQ ID NO: 1999741 - RNA, 16 nt, Homo sapiens
agauuuaaagcacaug

SEQ ID NO: 1999742 - RNA, 19 nt, Homo sapiens
cuuuuuuccaccugccaau

SEQ ID NO: 1999743 - RNA, 16 nt, Homo sapiens
ugaaacguuuaugcuu

SEQ ID NO: 1999744 - RNA, 18 nt, Homo sapiens
gagguagagguugcacug

SEQ ID NO: 1999745 - RNA, 17 nt, Homo sapiens
uucucuuucuuuuacug

SEQ ID NO: 1999746 - RNA, 20 nt, Homo sapiens
aauuuugguuuaugacucuu

SEQ ID NO: 1999747 - RNA, 19 nt, Homo sapiens
cucuuucccucccuuccuc

SEQ ID NO: 1999748 - RNA, 16 nt, Homo sapiens
acugcaagcucugccu

SEQ ID NO: 1999749 - RNA, 15 nt, Homo sapiens
cucagccgugcacuc

SEQ ID NO: 1999750 - RNA, 19 nt, Homo sapiens
cauaauagaauuuccuaau

SEQ ID NO: 1999751 - RNA, 19 nt, Homo sapiens
cugugucauuaaccaucuu

SEQ ID NO: 1999752 - RNA, 20 nt, Homo sapiens
cuggagugcgguggugugau

SEQ ID NO: 1999753 - RNA, 21 nt, Homo sapiens
gucuuguagcuagaacuucuc

SEQ ID NO: 1999754 - RNA, 17 nt, Homo sapiens
ccuuugcuucaaauuca

SEQ ID NO: 1999755 - RNA, 18 nt, Homo sapiens
gaaguugcugcugugaau

SEQ ID NO: 1999756 - RNA, 17 nt, Homo sapiens
cugcauucuuucuguau

SEQ ID NO: 1999757 - RNA, 23 nt, Homo sapiens
ccagcagagggcgccaccaccac

SEQ ID NO: 1999758 - RNA, 12 nt, Homo sapiens
cagaaggggugg

SEQ ID NO: 1999759 - RNA, 21 nt, Homo sapiens
auaguaccaguaggggcuuau

SEQ ID NO: 1999760 - RNA, 16 nt, Homo sapiens
cugccacccuggggag

SEQ ID NO: 1999761 - RNA, 19 nt, Homo sapiens
uuuacugucuguaagagaa

SEQ ID NO: 1999762 - RNA, 14 nt, Homo sapiens
aaguauuacaacca

SEQ ID NO: 1999763 - RNA, 14 nt, Homo sapiens
cuguaauaauaccu

SEQ ID NO: 1999764 - RNA, 19 nt, Homo sapiens
guugcuucacucuauccaa

SEQ ID NO: 1999765 - RNA, 20 nt, Homo sapiens
uuuauccuaguuccauucuu

SEQ ID NO: 1999766 - RNA, 16 nt, Homo sapiens
ucauuccucacaauga

SEQ ID NO: 1999767 - RNA, 17 nt, Homo sapiens
auagccuuuaauuccuu

SEQ ID NO: 1999768 - RNA, 19 nt, Homo sapiens
uauaugaugaaauucuuau

SEQ ID NO: 1999769 - RNA, 18 nt, Homo sapiens
auccauccauuguguucu

SEQ ID NO: 1999770 - RNA, 22 nt, Homo sapiens
uuaucuagagaauaaucauaua

SEQ ID NO: 1999771 - RNA, 16 nt, Homo sapiens
ugcuuguacauaaugc

SEQ ID NO: 1999772 - RNA, 18 nt, Homo sapiens
uacccagggcugccgcau

SEQ ID NO: 1999773 - RNA, 16 nt, Homo sapiens
gcagagagcacaguga

SEQ ID NO: 1999774 - RNA, 23 nt, Homo sapiens
gcaugcccuaagagugucacuga

SEQ ID NO: 1999775 - RNA, 11 nt, Homo sapiens
caaauucccug

SEQ ID NO: 1999776 - RNA, 21 nt, Homo sapiens
acccucuuuuaccaacuuccu

SEQ ID NO: 1999777 - RNA, 21 nt, Homo sapiens
cuguucaguuuagcauuaaaa

SEQ ID NO: 1999778 - RNA, 18 nt, Homo sapiens
augaacacagcugcugaa

SEQ ID NO: 1999779 - RNA, 23 nt, Homo sapiens
uggugaaaccccaucucuaugaa

SEQ ID NO: 1999780 - RNA, 19 nt, Homo sapiens
gcauauuuuuaaacaaaga

SEQ ID NO: 1999781 - RNA, 18 nt, Homo sapiens
caguccaacaaaccacac

SEQ ID NO: 1999782 - RNA, 15 nt, Homo sapiens
aagaucacauaccag

SEQ ID NO: 1999783 - RNA, 19 nt, Homo sapiens
ggaaacccaccucucugga

SEQ ID NO: 1999784 - RNA, 17 nt, Homo sapiens
aaggggaaggaagagag

SEQ ID NO: 1999785 - RNA, 19 nt, Homo sapiens
gcugaacagugcucugccu

SEQ ID NO: 1999786 - RNA, 17 nt, Homo sapiens
cccauuggucugcaugu

SEQ ID NO: 1999787 - RNA, 20 nt, Homo sapiens
uuguuguucugccuguccua

SEQ ID NO: 1999788 - RNA, 19 nt, Homo sapiens
uccucccaaaauacuacac

SEQ ID NO: 1999789 - RNA, 17 nt, Homo sapiens
uaagagcagaacagauc

SEQ ID NO: 1999790 - RNA, 18 nt, Homo sapiens
cuguugugaaucaccaaa

SEQ ID NO: 1999791 - RNA, 18 nt, Homo sapiens
uguacaaugguuuauucc

SEQ ID NO: 1999792 - RNA, 18 nt, Homo sapiens
gauuaguaaaagugcuuu

SEQ ID NO: 1999793 - RNA, 14 nt, Homo sapiens
ccaggcuuuguaca

SEQ ID NO: 1999794 - RNA, 20 nt, Homo sapiens
ccugaggaggccgcuuagug

SEQ ID NO: 1999795 - RNA, 21 nt, Homo sapiens
agacugggacuauggcuuauu

SEQ ID NO: 1999796 - RNA, 21 nt, Homo sapiens
aaaaauggacaaaauccauga

SEQ ID NO: 1999797 - RNA, 20 nt, Homo sapiens
ccaaggaacaaaaaaaccac

SEQ ID NO: 1999798 - RNA, 15 nt, Homo sapiens
cgugguagaagccag

SEQ ID NO: 1999799 - RNA, 19 nt, Homo sapiens
ccuaaugucuguaucacuc

SEQ ID NO: 1999800 - RNA, 17 nt, Homo sapiens
aaauccuaagacacaaa

SEQ ID NO: 1999801 - RNA, 19 nt, Homo sapiens
ucagaaccaagaugccaac

SEQ ID NO: 1999802 - RNA, 13 nt, Homo sapiens
uucaccauucaaa

SEQ ID NO: 1999803 - RNA, 15 nt, Homo sapiens
acaugaacccaaaaa

SEQ ID NO: 1999804 - RNA, 19 nt, Homo sapiens
auccugccuugcugugaaa

SEQ ID NO: 1999805 - RNA, 18 nt, Homo sapiens
gcugcauuugugucaucu

SEQ ID NO: 1999806 - RNA, 20 nt, Homo sapiens
caguuagagucuucaucugu

SEQ ID NO: 1999807 - RNA, 11 nt, Homo sapiens
aaaggcaguuc

SEQ ID NO: 1999808 - RNA, 20 nt, Homo sapiens
ccucuaguaagaugcacuga

SEQ ID NO: 1999809 - RNA, 17 nt, Homo sapiens
ucuggcuguguggccaa

SEQ ID NO: 1999810 - RNA, 19 nt, Homo sapiens
gccuugggagccacugcca

SEQ ID NO: 1999811 - RNA, 13 nt, Homo sapiens
gaagcaacuaaau

SEQ ID NO: 1999812 - RNA, 11 nt, Homo sapiens
aaucauuuccc

SEQ ID NO: 1999813 - RNA, 11 nt, Homo sapiens
acucauuucac

SEQ ID NO: 1999814 - RNA, 18 nt, Homo sapiens
gauguuuccaaugcugaa

SEQ ID NO: 1999815 - RNA, 19 nt, Homo sapiens
aaagauuuaacaaauacau

SEQ ID NO: 1999816 - RNA, 17 nt, Homo sapiens
aagguauaccugggaag

SEQ ID NO: 1999817 - RNA, 17 nt, Homo sapiens
uauuucuuaagaauuca

SEQ ID NO: 1999818 - RNA, 21 nt, Homo sapiens
ugguaccuuucuagccuuaga

SEQ ID NO: 1999819 - RNA, 20 nt, Homo sapiens
caaaguuuuaaaccuguuaa

SEQ ID NO: 1999820 - RNA, 13 nt, Homo sapiens
auuuaacuuucca

SEQ ID NO: 1999821 - RNA, 21 nt, Homo sapiens
aagaauuuuuuugucuuucaa

SEQ ID NO: 1999822 - RNA, 23 nt, Homo sapiens
aaacuugugccuccaauguggua

SEQ ID NO: 1999823 - RNA, 21 nt, Homo sapiens
ugagacaggaggucagcacaa

SEQ ID NO: 1999824 - RNA, 23 nt, Homo sapiens
agaaguccccaggucaugcugcu

SEQ ID NO: 1999825 - RNA, 12 nt, Homo sapiens
agacagacccca

SEQ ID NO: 1999826 - RNA, 16 nt, Homo sapiens
gaauaucagucacugu

SEQ ID NO: 1999827 - RNA, 18 nt, Homo sapiens
gccucuccuacuaugcaa

SEQ ID NO: 1999828 - RNA, 17 nt, Homo sapiens
cuuucugcacacaaaua

SEQ ID NO: 1999829 - RNA, 18 nt, Homo sapiens
gcacugagaagcaaucaa

SEQ ID NO: 1999830 - RNA, 15 nt, Homo sapiens
cagguuggugggggc

SEQ ID NO: 1999831 - RNA, 21 nt, Homo sapiens
cauggcuuagagaggcuugaa

SEQ ID NO: 1999832 - RNA, 13 nt, Homo sapiens
cacuaacauuucc

SEQ ID NO: 1999833 - RNA, 18 nt, Homo sapiens
ccucaaaccagucacuuu

SEQ ID NO: 1999834 - RNA, 21 nt, Homo sapiens
acauccuaugaaauacuuuau

SEQ ID NO: 1999835 - RNA, 17 nt, Homo sapiens
aaauaaagcuacugaau

SEQ ID NO: 1999836 - RNA, 16 nt, Homo sapiens
agugcaagagacuuug

SEQ ID NO: 1999837 - RNA, 15 nt, Homo sapiens
aauauuccagaagaa

SEQ ID NO: 1999838 - RNA, 14 nt, Homo sapiens
aauauuuaagugaa

SEQ ID NO: 1999839 - RNA, 21 nt, Homo sapiens
ucagagaaggugcaggugaca

SEQ ID NO: 1999840 - RNA, 13 nt, Homo sapiens
aggcugcccugag

SEQ ID NO: 1999841 - RNA, 16 nt, Homo sapiens
cugucuggugccccua

SEQ ID NO: 1999842 - RNA, 18 nt, Homo sapiens
cacaguuguaccauucac

SEQ ID NO: 1999843 - RNA, 13 nt, Homo sapiens
aucccaaacaaaa

SEQ ID NO: 1999844 - RNA, 14 nt, Homo sapiens
guaacaacuguggu

SEQ ID NO: 1999845 - RNA, 23 nt, Homo sapiens
gcccuuacuccugguucagugcc

SEQ ID NO: 1999846 - RNA, 13 nt, Homo sapiens
uuugguuugaccc

SEQ ID NO: 1999847 - RNA, 16 nt, Homo sapiens
caagucuacuucacua

SEQ ID NO: 1999848 - RNA, 17 nt, Homo sapiens
aauauuagauugcugaa

SEQ ID NO: 1999849 - RNA, 18 nt, Homo sapiens
aaauacagacuggaugua

SEQ ID NO: 1999850 - RNA, 19 nt, Homo sapiens
cuccuggaggcccugguca

SEQ ID NO: 1999851 - RNA, 18 nt, Homo sapiens
auggcugggccuuuccag

SEQ ID NO: 1999852 - RNA, 20 nt, Homo sapiens
gauccuggucugcaccucua

SEQ ID NO: 1999853 - RNA, 16 nt, Homo sapiens
gagacuauggagccug

SEQ ID NO: 1999854 - RNA, 14 nt, Homo sapiens
gcuccacuaggacu

SEQ ID NO: 1999855 - RNA, 14 nt, Homo sapiens
guguugacugcugc

SEQ ID NO: 1999856 - RNA, 17 nt, Homo sapiens
ugucugugugcaagugu

SEQ ID NO: 1999857 - RNA, 13 nt, Homo sapiens
uuuuugaggcaaa

SEQ ID NO: 1999858 - RNA, 16 nt, Homo sapiens
uuggaaaacacuuuca

SEQ ID NO: 1999859 - RNA, 21 nt, Homo sapiens
acacugggcuucuagaaccag

SEQ ID NO: 1999860 - RNA, 21 nt, Homo sapiens
acucauggccuugucuaacuu

SEQ ID NO: 1999861 - RNA, 17 nt, Homo sapiens
ccaagguuucccaguga

SEQ ID NO: 1999862 - RNA, 16 nt, Homo sapiens
gcugcaggaaucaaaa

SEQ ID NO: 1999863 - RNA, 23 nt, Homo sapiens
uaagacaaacuccugaaaugcca

SEQ ID NO: 1999864 - RNA, 22 nt, Homo sapiens
cugauagcgucucugcacguga

SEQ ID NO: 1999865 - RNA, 21 nt, Homo sapiens
aauacaugaaaugucuggucu

SEQ ID NO: 1999866 - RNA, 12 nt, Homo sapiens
cagaagugcccc

SEQ ID NO: 1999867 - RNA, 16 nt, Homo sapiens
caaggcacaaaccuua

SEQ ID NO: 1999868 - RNA, 15 nt, Homo sapiens
cacccacgcauauac

SEQ ID NO: 1999869 - RNA, 18 nt, Homo sapiens
uucccauccauaaggugc

SEQ ID NO: 1999870 - RNA, 22 nt, Homo sapiens
agugaagcugggagaaccaaaa

SEQ ID NO: 1999871 - RNA, 15 nt, Homo sapiens
gcugacuacuugaua

SEQ ID NO: 1999872 - RNA, 18 nt, Homo sapiens
uaugugggugcuccucuu

SEQ ID NO: 1999873 - RNA, 22 nt, Homo sapiens
gacucuguaacaucacuaucca

SEQ ID NO: 1999874 - RNA, 13 nt, Homo sapiens
cucuuuugagcua

SEQ ID NO: 1999875 - RNA, 17 nt, Homo sapiens
ugcugcguucuuucaau

SEQ ID NO: 1999876 - RNA, 20 nt, Homo sapiens
cguugcccaagguugcacag

SEQ ID NO: 1999877 - RNA, 12 nt, Homo sapiens
ccagcuacuuga

SEQ ID NO: 1999878 - RNA, 23 nt, Homo sapiens
ucaaauuuugaugccaagaaagu

SEQ ID NO: 1999879 - RNA, 21 nt, Homo sapiens
ucucggcccugcccagcuuug

SEQ ID NO: 1999880 - RNA, 11 nt, Homo sapiens
guuauucuguu

SEQ ID NO: 1999881 - RNA, 21 nt, Homo sapiens
aggagggucaggaaggaugag

SEQ ID NO: 1999882 - RNA, 21 nt, Homo sapiens
aacugagauuacaggcaccca

SEQ ID NO: 1999883 - RNA, 18 nt, Homo sapiens
auuugggagacaugugac

SEQ ID NO: 1999884 - RNA, 17 nt, Homo sapiens
cucaggcugcccagcgg

SEQ ID NO: 1999885 - RNA, 20 nt, Homo sapiens
caugagugcgugcucaguuc

SEQ ID NO: 1999886 - RNA, 14 nt, Homo sapiens
uaaagcuuuugcau

SEQ ID NO: 1999887 - RNA, 23 nt, Homo sapiens
cuguaauuccagcacuuugggag

SEQ ID NO: 1999888 - RNA, 22 nt, Homo sapiens
agccaggccugggggcagccuc

SEQ ID NO: 1999889 - RNA, 13 nt, Homo sapiens
ccccaacugcucc

SEQ ID NO: 1999890 - RNA, 22 nt, Homo sapiens
uagcaacugcuggggagacaaa

SEQ ID NO: 1999891 - RNA, 19 nt, Homo sapiens
ugcuguacccaguuucuaa

SEQ ID NO: 1999892 - RNA, 21 nt, Homo sapiens
uuaugucuggggcagaaacac

SEQ ID NO: 1999893 - RNA, 13 nt, Homo sapiens
uuguuucuacuca

SEQ ID NO: 1999894 - RNA, 20 nt, Homo sapiens
aaucuuauuuuggcauucuu

SEQ ID NO: 1999895 - RNA, 12 nt, Homo sapiens
agcacagugauc

SEQ ID NO: 1999896 - RNA, 21 nt, Homo sapiens
auuuuggugaccaauacuacu

SEQ ID NO: 1999897 - RNA, 19 nt, Homo sapiens
auauuaauuuuccaaugca

SEQ ID NO: 1999898 - RNA, 14 nt, Homo sapiens
ggaagcuccacugu

SEQ ID NO: 1999899 - RNA, 13 nt, Homo sapiens
cucaaucuccuga

SEQ ID NO: 1999900 - RNA, 16 nt, Homo sapiens
ccugguucccaccauu

SEQ ID NO: 1999901 - RNA, 12 nt, Homo sapiens
gccuucucaggg

SEQ ID NO: 1999902 - RNA, 13 nt, Homo sapiens
cuauuaauauuca

SEQ ID NO: 1999903 - RNA, 15 nt, Homo sapiens
uuacucugucuccca

SEQ ID NO: 1999904 - RNA, 16 nt, Homo sapiens
gaugauacacuaugaa

SEQ ID NO: 1999905 - RNA, 22 nt, Homo sapiens
ucccucuuuggcuccccuguac

SEQ ID NO: 1999906 - RNA, 15 nt, Homo sapiens
augaaauacucaggg

SEQ ID NO: 1999907 - RNA, 17 nt, Homo sapiens
ugggagacucuuugaaa

SEQ ID NO: 1999908 - RNA, 14 nt, Homo sapiens
uccugggaacacau

SEQ ID NO: 1999909 - RNA, 18 nt, Homo sapiens
aucuucaggugaacacuu

SEQ ID NO: 1999910 - RNA, 23 nt, Homo sapiens
ccagcuuuuguagauggcacuuu

SEQ ID NO: 1999911 - RNA, 14 nt, Homo sapiens
cucaugaagcauac

SEQ ID NO: 1999912 - RNA, 12 nt, Homo sapiens
aaucagcacucu

SEQ ID NO: 1999913 - RNA, 19 nt, Homo sapiens
acacagcucucuccacaac

SEQ ID NO: 1999914 - RNA, 17 nt, Homo sapiens
auuauucuuuguuuccu

SEQ ID NO: 1999915 - RNA, 17 nt, Homo sapiens
gaaagcccugugcuuug

SEQ ID NO: 1999916 - RNA, 21 nt, Homo sapiens
uacacuaaaaccacaugugca

SEQ ID NO: 1999917 - RNA, 22 nt, Homo sapiens
uucuucccgcacaaauuccaca

SEQ ID NO: 1999918 - RNA, 15 nt, Homo sapiens
auauuaacauauucu

SEQ ID NO: 1999919 - RNA, 14 nt, Homo sapiens
auuuaggauacucu

SEQ ID NO: 1999920 - RNA, 13 nt, Homo sapiens
cucacaccacuaa

SEQ ID NO: 1999921 - RNA, 15 nt, Homo sapiens
aaaacuccugucuug

SEQ ID NO: 1999922 - RNA, 20 nt, Homo sapiens
agcuucuagaaggugcuuag

SEQ ID NO: 1999923 - RNA, 12 nt, Homo sapiens
uuagcagugucu

SEQ ID NO: 1999924 - RNA, 21 nt, Homo sapiens
ccuagccuuagaagucacaca

SEQ ID NO: 1999925 - RNA, 16 nt, Homo sapiens
uuaaauuguaaaugaa

SEQ ID NO: 1999926 - RNA, 17 nt, Homo sapiens
cuauguuuucuacucca

SEQ ID NO: 1999927 - RNA, 14 nt, Homo sapiens
ugaucugagcaaaa

SEQ ID NO: 1999928 - RNA, 15 nt, Homo sapiens
ugacaccugccauac

SEQ ID NO: 1999929 - RNA, 18 nt, Homo sapiens
aaugguugggacaauggc

SEQ ID NO: 1999930 - RNA, 16 nt, Homo sapiens
cacagaugcuguguaa

SEQ ID NO: 1999931 - RNA, 14 nt, Homo sapiens
gcuugggccugagu

SEQ ID NO: 1999932 - RNA, 16 nt, Homo sapiens
agcuauuuaucuguag

SEQ ID NO: 1999933 - RNA, 16 nt, Homo sapiens
uuccagaggacagcuc

SEQ ID NO: 1999934 - RNA, 16 nt, Homo sapiens
agacagacacguguga

SEQ ID NO: 1999935 - RNA, 16 nt, Homo sapiens
uguugaggguccucag

SEQ ID NO: 1999936 - RNA, 14 nt, Homo sapiens
ucucuucuuuaaag

SEQ ID NO: 1999937 - RNA, 16 nt, Homo sapiens
acacccugguucccac

SEQ ID NO: 1999938 - RNA, 15 nt, Homo sapiens
auguuugcugaguga

SEQ ID NO: 1999939 - RNA, 14 nt, Homo sapiens
aguucaguuuacua

SEQ ID NO: 1999940 - RNA, 15 nt, Homo sapiens
uugaccaaauaaagu

SEQ ID NO: 1999941 - RNA, 20 nt, Homo sapiens
ccaaggagggugagugcaag

SEQ ID NO: 1999942 - RNA, 12 nt, Homo sapiens
uucuaccuugaa

SEQ ID NO: 1999943 - RNA, 11 nt, Homo sapiens
gcucccagugc

SEQ ID NO: 1999944 - RNA, 18 nt, Homo sapiens
ucuagcuaguaauauauu

SEQ ID NO: 1999945 - RNA, 23 nt, Homo sapiens
auccauugucaugaaauuacccu

SEQ ID NO: 1999946 - RNA, 21 nt, Homo sapiens
agagcaucuggaacaacagau

SEQ ID NO: 1999947 - RNA, 17 nt, Homo sapiens
agccucccaaguagcug

SEQ ID NO: 1999948 - RNA, 17 nt, Homo sapiens
agcuucccaagcagcug

SEQ ID NO: 1999949 - RNA, 16 nt, Homo sapiens
uucucccuugauucca

SEQ ID NO: 1999950 - RNA, 21 nt, Homo sapiens
acgggggccgcguggugccau

SEQ ID NO: 1999951 - RNA, 15 nt, Homo sapiens
acugcacucuagccu

SEQ ID NO: 1999952 - RNA, 14 nt, Homo sapiens
aaccauucauugca

SEQ ID NO: 1999953 - RNA, 16 nt, Homo sapiens
guugcugccagccagu

SEQ ID NO: 1999954 - RNA, 16 nt, Homo sapiens
ggcuacugacuacccu

SEQ ID NO: 1999955 - RNA, 17 nt, Homo sapiens
gucguuuuccaaagagc

SEQ ID NO: 1999956 - RNA, 22 nt, Homo sapiens
cauuagcagaagcaugcacaaa

SEQ ID NO: 1999957 - RNA, 16 nt, Homo sapiens
auuuuacucacucacu

SEQ ID NO: 1999958 - RNA, 19 nt, Homo sapiens
acugagcaggcuguggggu

SEQ ID NO: 1999959 - RNA, 16 nt, Homo sapiens
gucuauauguuuauuu

SEQ ID NO: 1999960 - RNA, 16 nt, Homo sapiens
acuugcauaccugcuu

SEQ ID NO: 1999961 - RNA, 19 nt, Homo sapiens
acugcaaagcucggugcuc

SEQ ID NO: 1999962 - RNA, 16 nt, Homo sapiens
agagaacaacauggga

SEQ ID NO: 1999963 - RNA, 19 nt, Homo sapiens
ucgccaaggcucacaugcu

SEQ ID NO: 1999964 - RNA, 13 nt, Homo sapiens
cacacgaaaagac

SEQ ID NO: 1999965 - RNA, 12 nt, Homo sapiens
caugcucuccaa

SEQ ID NO: 1999966 - RNA, 20 nt, Homo sapiens
aggucucacgggcaugggca

SEQ ID NO: 1999967 - RNA, 18 nt, Homo sapiens
cagguggugggccauggc

SEQ ID NO: 1999968 - RNA, 21 nt, Homo sapiens
ccugaaacaacuuggaaagau

SEQ ID NO: 1999969 - RNA, 17 nt, Homo sapiens
cugucuuuccacucugg

SEQ ID NO: 1999970 - RNA, 19 nt, Homo sapiens
guagaagccacgguguucu

SEQ ID NO: 1999971 - RNA, 18 nt, Homo sapiens
agaggaggccagccucac

SEQ ID NO: 1999972 - RNA, 17 nt, Homo sapiens
gaaagcuuuuacugugu

SEQ ID NO: 1999973 - RNA, 17 nt, Homo sapiens
cuuaggcacuuuuuaac

SEQ ID NO: 1999974 - RNA, 17 nt, Homo sapiens
cuaaggaaauauuucaa

SEQ ID NO: 1999975 - RNA, 12 nt, Homo sapiens
uacagaaacuga

SEQ ID NO: 1999976 - RNA, 19 nt, Homo sapiens
aaacauucacacagggcuc

SEQ ID NO: 1999977 - RNA, 15 nt, Homo sapiens
cacuuguagauuuga

SEQ ID NO: 1999978 - RNA, 23 nt, Homo sapiens
augauucaaaaagucacaguuaa

SEQ ID NO: 1999979 - RNA, 16 nt, Homo sapiens
uugaguaaugugacua

SEQ ID NO: 1999980 - RNA, 16 nt, Homo sapiens
cugauguucuuccagu

SEQ ID NO: 1999981 - RNA, 15 nt, Homo sapiens
cugggaaaagcccaa

SEQ ID NO: 1999982 - RNA, 13 nt, Homo sapiens
gccuuacacugaa

SEQ ID NO: 1999983 - RNA, 21 nt, Homo sapiens
cguaucaccugagguugggag

SEQ ID NO: 1999984 - RNA, 16 nt, Homo sapiens
uuugaauuaaacucga

SEQ ID NO: 1999985 - RNA, 12 nt, Homo sapiens
auuuggaaucaa

SEQ ID NO: 1999986 - RNA, 15 nt, Homo sapiens
cuuguaaagacugua

SEQ ID NO: 1999987 - RNA, 15 nt, Homo sapiens
gcuauucuccaugua

SEQ ID NO: 1999988 - RNA, 12 nt, Homo sapiens
ugcucuuuccac

SEQ ID NO: 1999989 - RNA, 18 nt, Homo sapiens
ucaguaacugugcaucug

SEQ ID NO: 1999990 - RNA, 18 nt, Homo sapiens
auuacaggcgcacaccac

SEQ ID NO: 1999991 - RNA, 19 nt, Homo sapiens
guagcucucacaugcacag

SEQ ID NO: 1999992 - RNA, 16 nt, Homo sapiens
aggcacagaaacuccu

SEQ ID NO: 1999993 - RNA, 21 nt, Homo sapiens
cguccaucacuggcucucuaa

SEQ ID NO: 1999994 - RNA, 18 nt, Homo sapiens
caggagaguguauaugaa

SEQ ID NO: 1999995 - RNA, 13 nt, Homo sapiens
ggauuaccauuca

SEQ ID NO: 1999996 - RNA, 15 nt, Homo sapiens
cugaugggaaaacug

SEQ ID NO: 1999997 - RNA, 19 nt, Homo sapiens
agucugucugucugaugau

SEQ ID NO: 1999998 - RNA, 21 nt, Homo sapiens
ucucuccaggggucuugcaaa

SEQ ID NO: 1999999 - RNA, 14 nt, Homo sapiens
aacaaacaugcagu

SEQ ID NO: 2000000 - RNA, 14 nt, Homo sapiens
uuccuuaugacuca

SEQ ID NO: 2000001 - RNA, 16 nt, Homo sapiens
agaaugugugugcaga

SEQ ID NO: 2000002 - RNA, 22 nt, Homo sapiens
cuguucuguggaaaguguaaag

SEQ ID NO: 2000003 - RNA, 21 nt, Homo sapiens
acuggagacuuggaagaguug

SEQ ID NO: 2000004 - RNA, 15 nt, Homo sapiens
uggaacagcccugca

SEQ ID NO: 2000005 - RNA, 15 nt, Homo sapiens
aucuuaaagcauucc

SEQ ID NO: 2000006 - RNA, 11 nt, Homo sapiens
aaaagugcaac

SEQ ID NO: 2000007 - RNA, 19 nt, Homo sapiens
caguuugugcucuacuguu

SEQ ID NO: 2000008 - RNA, 15 nt, Homo sapiens
ugugcucuuuuauaa

SEQ ID NO: 2000009 - RNA, 20 nt, Homo sapiens
uuuggggggagagacacaga

SEQ ID NO: 2000010 - RNA, 22 nt, Homo sapiens
cguauuuuuucuaaugugcauu

SEQ ID NO: 2000011 - RNA, 19 nt, Homo sapiens
ugaccuguaguguaccauu

SEQ ID NO: 2000012 - RNA, 19 nt, Homo sapiens
aagcccuuacuuuccuaau

SEQ ID NO: 2000013 - RNA, 21 nt, Homo sapiens
uugcugcauugauccaggaga

SEQ ID NO: 2000014 - RNA, 14 nt, Homo sapiens
agagagagcaagau

SEQ ID NO: 2000015 - RNA, 21 nt, Homo sapiens
gugaccauguuuccucucaau

SEQ ID NO: 2000016 - RNA, 23 nt, Homo sapiens
accccggugugccuguggaggaa

SEQ ID NO: 2000017 - RNA, 11 nt, Homo sapiens
cgcaaccucca

SEQ ID NO: 2000018 - RNA, 17 nt, Homo sapiens
cuuuagaaauuaauacc

SEQ ID NO: 2000019 - RNA, 15 nt, Homo sapiens
gaguggagcccucag

SEQ ID NO: 2000020 - RNA, 17 nt, Homo sapiens
agccauugauucuucag

SEQ ID NO: 2000021 - RNA, 20 nt, Homo sapiens
uuacccccugggagccccaa

SEQ ID NO: 2000022 - RNA, 15 nt, Homo sapiens
agccccaucagcucc

SEQ ID NO: 2000023 - RNA, 18 nt, Homo sapiens
accacugcacccagcuaa

SEQ ID NO: 2000024 - RNA, 19 nt, Homo sapiens
uuguuugugaaacaaaaaa

SEQ ID NO: 2000025 - RNA, 23 nt, Homo sapiens
cagucauagcaagcuuuugcuca

SEQ ID NO: 2000026 - RNA, 18 nt, Homo sapiens
cacuuaaacaauguccuc

SEQ ID NO: 2000027 - RNA, 14 nt, Homo sapiens
uaaacuacauuaua

SEQ ID NO: 2000028 - RNA, 16 nt, Homo sapiens
ccauuuacacuuuuga

SEQ ID NO: 2000029 - RNA, 22 nt, Homo sapiens
agcagagcauuuuuuaugauau

SEQ ID NO: 2000030 - RNA, 21 nt, Homo sapiens
gaagagguaagggugacaaau

SEQ ID NO: 2000031 - RNA, 13 nt, Homo sapiens
cacauuuccacua

SEQ ID NO: 2000032 - RNA, 17 nt, Homo sapiens
uucucaugggguggggu

SEQ ID NO: 2000033 - RNA, 20 nt, Homo sapiens
acccuccugccccacacucc

SEQ ID NO: 2000034 - RNA, 12 nt, Homo sapiens
cuggcaguacug

SEQ ID NO: 2000035 - RNA, 14 nt, Homo sapiens
cuuuccugggucug

SEQ ID NO: 2000036 - RNA, 21 nt, Homo sapiens
aaaaagucaccaaauagugug

SEQ ID NO: 2000037 - RNA, 18 nt, Homo sapiens
gcuuaauaaacaugucac

SEQ ID NO: 2000038 - RNA, 14 nt, Homo sapiens
uuguuaagaguauc

SEQ ID NO: 2000039 - RNA, 23 nt, Homo sapiens
uccaaagcuuguucuucuugagc

SEQ ID NO: 2000040 - RNA, 18 nt, Homo sapiens
cauuaaacagaagguaau

SEQ ID NO: 2000041 - RNA, 14 nt, Homo sapiens
ggaaggacuaugac

SEQ ID NO: 2000042 - RNA, 16 nt, Homo sapiens
aggucacucuccagca

SEQ ID NO: 2000043 - RNA, 17 nt, Homo sapiens
ugucaauaugagauauu

SEQ ID NO: 2000044 - RNA, 19 nt, Homo sapiens
ucaggaagggaaagccaga

SEQ ID NO: 2000045 - RNA, 15 nt, Homo sapiens
uggccuucugggaac

SEQ ID NO: 2000046 - RNA, 11 nt, Homo sapiens
aaaacugccug

SEQ ID NO: 2000047 - RNA, 19 nt, Homo sapiens
uuaccaaagcaucaauaca

SEQ ID NO: 2000048 - RNA, 14 nt, Homo sapiens
ugcaucuacuugcc

SEQ ID NO: 2000049 - RNA, 24 nt, Homo sapiens
caugggguuugguugugcugauag

SEQ ID NO: 2000050 - RNA, 16 nt, Homo sapiens
guggcacccaccacuc

SEQ ID NO: 2000051 - RNA, 18 nt, Homo sapiens
ggaaaggccacccuagaa

SEQ ID NO: 2000052 - RNA, 14 nt, Homo sapiens
aaaucguccuccca

SEQ ID NO: 2000053 - RNA, 16 nt, Homo sapiens
uuaaggggguguaaug

SEQ ID NO: 2000054 - RNA, 22 nt, Homo sapiens
uaagaacagaucaggaauucua

SEQ ID NO: 2000055 - RNA, 10 nt, Homo sapiens
acagauuugg

SEQ ID NO: 2000056 - RNA, 20 nt, Homo sapiens
uagaagggcuagaaccugga

SEQ ID NO: 2000057 - RNA, 20 nt, Homo sapiens
ccuggggcuugaauuugcau

SEQ ID NO: 2000058 - RNA, 21 nt, Homo sapiens
uaugugaccagacugcacagg

SEQ ID NO: 2000059 - RNA, 23 nt, Homo sapiens
ucuagcacacuuuuuuaaaugaa

SEQ ID NO: 2000060 - RNA, 16 nt, Homo sapiens
gcagguacuacauuua

SEQ ID NO: 2000061 - RNA, 19 nt, Homo sapiens
acuccuucccuaauagcuu

SEQ ID NO: 2000062 - RNA, 14 nt, Homo sapiens
ccuacucugcaaac

SEQ ID NO: 2000063 - RNA, 20 nt, Homo sapiens
guuugcucccauuacucaaa

SEQ ID NO: 2000064 - RNA, 18 nt, Homo sapiens
accauaaauuaauuugac

SEQ ID NO: 2000065 - RNA, 20 nt, Homo sapiens
cuucuagacacuccuugaaa

SEQ ID NO: 2000066 - RNA, 23 nt, Homo sapiens
ccaaacugggucuucagcuuuau

SEQ ID NO: 2000067 - RNA, 17 nt, Homo sapiens
acugacugcaagcccca

SEQ ID NO: 2000068 - RNA, 22 nt, Homo sapiens
aauagagucacagcuuucccag

SEQ ID NO: 2000069 - RNA, 23 nt, Homo sapiens
uauauuggucauugccuugccaa

SEQ ID NO: 2000070 - RNA, 16 nt, Homo sapiens
accauaacagugccag

SEQ ID NO: 2000071 - RNA, 23 nt, Homo sapiens
caauaggagggauguuccagugg

SEQ ID NO: 2000072 - RNA, 22 nt, Homo sapiens
ccuguuuuaauucaacccagcc

SEQ ID NO: 2000073 - RNA, 19 nt, Homo sapiens
acuaaauuuucuaauuaaa

SEQ ID NO: 2000074 - RNA, 17 nt, Homo sapiens
uccagaacaauaagcag

SEQ ID NO: 2000075 - RNA, 23 nt, Homo sapiens
uguuucacaguuugaaauaagcu

SEQ ID NO: 2000076 - RNA, 16 nt, Homo sapiens
acucaugugauuuacc

SEQ ID NO: 2000077 - RNA, 12 nt, Homo sapiens
aacuucuuguca

SEQ ID NO: 2000078 - RNA, 16 nt, Homo sapiens
uggggccuguggaaug

SEQ ID NO: 2000079 - RNA, 18 nt, Homo sapiens
gaggacucgcuuguaaau

SEQ ID NO: 2000080 - RNA, 17 nt, Homo sapiens
ugccuuguccucagggc

SEQ ID NO: 2000081 - RNA, 22 nt, Homo sapiens
gcucuuaggugcuucuucacuu

SEQ ID NO: 2000082 - RNA, 20 nt, Homo sapiens
ucauauguccccacuggcau

SEQ ID NO: 2000083 - RNA, 20 nt, Homo sapiens
uuccugcagguaaacaguuc

SEQ ID NO: 2000084 - RNA, 22 nt, Homo sapiens
uacaaggcccagaagccugauc

SEQ ID NO: 2000085 - RNA, 13 nt, Homo sapiens
gaacugggcacca

SEQ ID NO: 2000086 - RNA, 20 nt, Homo sapiens
auaaauauguguugguacag

SEQ ID NO: 2000087 - RNA, 18 nt, Homo sapiens
uuuguuauuuuuccccaa

SEQ ID NO: 2000088 - RNA, 20 nt, Homo sapiens
uugcagagaaccucagauca

SEQ ID NO: 2000089 - RNA, 20 nt, Homo sapiens
ggccaccccagagugggaga

SEQ ID NO: 2000090 - RNA, 21 nt, Homo sapiens
cucaauuuugucuguacucau

SEQ ID NO: 2000091 - RNA, 14 nt, Homo sapiens
cagagcuguuauaa

SEQ ID NO: 2000092 - RNA, 17 nt, Homo sapiens
uccaguucauaaacaac

SEQ ID NO: 2000093 - RNA, 13 nt, Homo sapiens
gauuugccugugc

SEQ ID NO: 2000094 - RNA, 21 nt, Homo sapiens
cccuaauaaguccacaucuuc

SEQ ID NO: 2000095 - RNA, 11 nt, Homo sapiens
uaaaaccaaag

SEQ ID NO: 2000096 - RNA, 23 nt, Homo sapiens
acaagucuuuaguguucaaauac

SEQ ID NO: 2000097 - RNA, 17 nt, Homo sapiens
aacaugaaaugcuucca

SEQ ID NO: 2000098 - RNA, 18 nt, Homo sapiens
ccuaaaaauucccuuccu

SEQ ID NO: 2000099 - RNA, 22 nt, Homo sapiens
cuggagaguaucugagaaccaa

SEQ ID NO: 2000100 - RNA, 20 nt, Homo sapiens
agaagccccugggggcuccc

SEQ ID NO: 2000101 - RNA, 21 nt, Homo sapiens
acaagcagcuggugcuccaag

SEQ ID NO: 2000102 - RNA, 23 nt, Homo sapiens
cuggacaaacagccucacuccuc

SEQ ID NO: 2000103 - RNA, 19 nt, Homo sapiens
cauauggucccugggccac

SEQ ID NO: 2000104 - RNA, 24 nt, Homo sapiens
ugaaauguauuuuaaaauuucacu

SEQ ID NO: 2000105 - RNA, 17 nt, Homo sapiens
cuguagaugacuacuug

SEQ ID NO: 2000106 - RNA, 19 nt, Homo sapiens
uuucucuggacacugggga

SEQ ID NO: 2000107 - RNA, 18 nt, Homo sapiens
cugcuguauuugaggaaa

SEQ ID NO: 2000108 - RNA, 21 nt, Homo sapiens
acuuggggucaccacccuccc

SEQ ID NO: 2000109 - RNA, 12 nt, Homo sapiens
uuuuauugauaa

SEQ ID NO: 2000110 - RNA, 23 nt, Homo sapiens
aaaauagaauauagcaucuuuca

SEQ ID NO: 2000111 - RNA, 16 nt, Homo sapiens
cagcaucuguccucau

SEQ ID NO: 2000112 - RNA, 15 nt, Homo sapiens
auaaacacuggugcc

SEQ ID NO: 2000113 - RNA, 11 nt, Homo sapiens
aaaagugcaca

SEQ ID NO: 2000114 - RNA, 11 nt, Homo sapiens
acuagugcaau

SEQ ID NO: 2000115 - RNA, 11 nt, Homo sapiens
ccaagugccaa

SEQ ID NO: 2000116 - RNA, 16 nt, Homo sapiens
gcccaugggcacugcu

SEQ ID NO: 2000117 - RNA, 14 nt, Homo sapiens
uacaguggcuguca

SEQ ID NO: 2000118 - RNA, 20 nt, Homo sapiens
aauuccuuucagaguuuuac

SEQ ID NO: 2000119 - RNA, 22 nt, Homo sapiens
auggggaaguaggaauguggaa

SEQ ID NO: 2000120 - RNA, 17 nt, Homo sapiens
gccccaucauugcaccu

SEQ ID NO: 2000121 - RNA, 18 nt, Homo sapiens
ugcucgccuuagcacuac

SEQ ID NO: 2000122 - RNA, 17 nt, Homo sapiens
aaaacuguguugccaca

SEQ ID NO: 2000123 - RNA, 14 nt, Homo sapiens
aauuuuuuccugcu

SEQ ID NO: 2000124 - RNA, 22 nt, Homo sapiens
cauccaaucuaaccacaucaau

SEQ ID NO: 2000125 - RNA, 19 nt, Homo sapiens
aagaaugacgaugccuuca

SEQ ID NO: 2000126 - RNA, 18 nt, Homo sapiens
ucuccaccuuguuacaca

SEQ ID NO: 2000127 - RNA, 18 nt, Homo sapiens
uuguaugauccuaaugaa

SEQ ID NO: 2000128 - RNA, 22 nt, Homo sapiens
guccgacaacaccguguccaaa

SEQ ID NO: 2000129 - RNA, 14 nt, Homo sapiens
ugcgucaggcagug

SEQ ID NO: 2000130 - RNA, 15 nt, Homo sapiens
cugaucagugugaua

SEQ ID NO: 2000131 - RNA, 14 nt, Homo sapiens
guucaauccagaga

SEQ ID NO: 2000132 - RNA, 16 nt, Homo sapiens
caaaugacccaaagac

SEQ ID NO: 2000133 - RNA, 20 nt, Homo sapiens
aagauggccuaggaucuuca

SEQ ID NO: 2000134 - RNA, 21 nt, Homo sapiens
aaaauuuaaaguaucuugcac

SEQ ID NO: 2000135 - RNA, 15 nt, Homo sapiens
ccauauuaaaaucug

SEQ ID NO: 2000136 - RNA, 21 nt, Homo sapiens
auuggccggcuucccaugccu

SEQ ID NO: 2000137 - RNA, 22 nt, Homo sapiens
agaaagcuggacugaccaaaga

SEQ ID NO: 2000138 - RNA, 13 nt, Homo sapiens
aggccucagggac

SEQ ID NO: 2000139 - RNA, 21 nt, Homo sapiens
uaugugacgacugcaaagcca

SEQ ID NO: 2000140 - RNA, 17 nt, Homo sapiens
uccgaugguaucugggu

SEQ ID NO: 2000141 - RNA, 15 nt, Homo sapiens
ugauucugcagguaa

SEQ ID NO: 2000142 - RNA, 17 nt, Homo sapiens
uaacucagacauuccaa

SEQ ID NO: 2000143 - RNA, 19 nt, Homo sapiens
cuuuuaguuacaugaauua

SEQ ID NO: 2000144 - RNA, 18 nt, Homo sapiens
cucagacaugaaauguac

SEQ ID NO: 2000145 - RNA, 20 nt, Homo sapiens
auaauguggguuauccuccu

SEQ ID NO: 2000146 - RNA, 12 nt, Homo sapiens
ggauuguguuaa

SEQ ID NO: 2000147 - RNA, 21 nt, Homo sapiens
gacugggugagacccaaagcg

SEQ ID NO: 2000148 - RNA, 18 nt, Homo sapiens
caccccucccugcuugca

SEQ ID NO: 2000149 - RNA, 21 nt, Homo sapiens
ccauacgcggaggaguuuucu

SEQ ID NO: 2000150 - RNA, 14 nt, Homo sapiens
ugacugcaccagcg

SEQ ID NO: 2000151 - RNA, 22 nt, Homo sapiens
auagggagacccccaucuuuac

SEQ ID NO: 2000152 - RNA, 11 nt, Homo sapiens
caaaguucucu

SEQ ID NO: 2000153 - RNA, 18 nt, Homo sapiens
ucaaaggagcaagaacuu

SEQ ID NO: 2000154 - RNA, 22 nt, Homo sapiens
uguaaauuauuucauacaaaac

SEQ ID NO: 2000155 - RNA, 14 nt, Homo sapiens
uauucaauacacag

SEQ ID NO: 2000156 - RNA, 13 nt, Homo sapiens
gggaggagccuug

SEQ ID NO: 2000157 - RNA, 12 nt, Homo sapiens
uggaaugccaaa

SEQ ID NO: 2000158 - RNA, 21 nt, Homo sapiens
cacugcugcccccagaaaaag

SEQ ID NO: 2000159 - RNA, 14 nt, Homo sapiens
ccccaacugugauc

SEQ ID NO: 2000160 - RNA, 11 nt, Homo sapiens
cuuguucuguc

SEQ ID NO: 2000161 - RNA, 17 nt, Homo sapiens
aaaucugugaccuguca

SEQ ID NO: 2000162 - RNA, 17 nt, Homo sapiens
gccugucuccuuugcag

SEQ ID NO: 2000163 - RNA, 14 nt, Homo sapiens
aaaugaauuucucu

SEQ ID NO: 2000164 - RNA, 17 nt, Homo sapiens
ccagaaaucuaaucucu

SEQ ID NO: 2000165 - RNA, 12 nt, Homo sapiens
gcuggugccuga

SEQ ID NO: 2000166 - RNA, 20 nt, Homo sapiens
auaagaguugagauuuugca

SEQ ID NO: 2000167 - RNA, 22 nt, Homo sapiens
uagacugugucugaaucauguc

SEQ ID NO: 2000168 - RNA, 11 nt, Homo sapiens
aaagaagggau

SEQ ID NO: 2000169 - RNA, 16 nt, Homo sapiens
cgggcuuaccagguga

SEQ ID NO: 2000170 - RNA, 19 nt, Homo sapiens
acugaacaaaaccuacgca

SEQ ID NO: 2000171 - RNA, 20 nt, Homo sapiens
cuuuccucuggcccagugaa

SEQ ID NO: 2000172 - RNA, 21 nt, Homo sapiens
auucaggagaguguauaugaa

SEQ ID NO: 2000173 - RNA, 20 nt, Homo sapiens
gagcccuaaaaauccagacu

SEQ ID NO: 2000174 - RNA, 14 nt, Homo sapiens
ugaaagaaccagag

SEQ ID NO: 2000175 - RNA, 19 nt, Homo sapiens
cauauuaaaaauauacaag

SEQ ID NO: 2000176 - RNA, 17 nt, Homo sapiens
uuugauaccugcacugu

SEQ ID NO: 2000177 - RNA, 15 nt, Homo sapiens
cuuguauguuuagag

SEQ ID NO: 2000178 - RNA, 16 nt, Homo sapiens
caacagauuauuaccu

SEQ ID NO: 2000179 - RNA, 14 nt, Homo sapiens
caucagcaagacuu

SEQ ID NO: 2000180 - RNA, 14 nt, Homo sapiens
guuguguagucaag

SEQ ID NO: 2000181 - RNA, 22 nt, Homo sapiens
uacaaaaguuuaaaaagcucac

SEQ ID NO: 2000182 - RNA, 22 nt, Homo sapiens
aaaauaugacacucuagucaaa

SEQ ID NO: 2000183 - RNA, 16 nt, Homo sapiens
ggugaugggugaugga

SEQ ID NO: 2000184 - RNA, 13 nt, Homo sapiens
auuucugucaaau

SEQ ID NO: 2000185 - RNA, 21 nt, Homo sapiens
aguugauucauauugcaucau

SEQ ID NO: 2000186 - RNA, 18 nt, Homo sapiens
aaacuaccaaauuaguga

SEQ ID NO: 2000187 - RNA, 12 nt, Homo sapiens
gccgccaugcuu

SEQ ID NO: 2000188 - RNA, 22 nt, Homo sapiens
acugaagcuucaaaaagccacu

SEQ ID NO: 2000189 - RNA, 16 nt, Homo sapiens
ggcacugucaugccca

SEQ ID NO: 2000190 - RNA, 19 nt, Homo sapiens
acucccggccugucauuca

SEQ ID NO: 2000191 - RNA, 22 nt, Homo sapiens
agguuuccgggggaugaaugau

SEQ ID NO: 2000192 - RNA, 21 nt, Homo sapiens
uccauauauuggcacugcuaa

SEQ ID NO: 2000193 - RNA, 18 nt, Homo sapiens
aaaccuccacugcugcuc

SEQ ID NO: 2000194 - RNA, 23 nt, Homo sapiens
uuaucaaaaucuuucagcacuca

SEQ ID NO: 2000195 - RNA, 19 nt, Homo sapiens
cuuggcaugccuuccagca

SEQ ID NO: 2000196 - RNA, 21 nt, Homo sapiens
cucuggcuacgacuugggacg

SEQ ID NO: 2000197 - RNA, 16 nt, Homo sapiens
auaaagccacuuuccu

SEQ ID NO: 2000198 - RNA, 13 nt, Homo sapiens
uuguacugugacc

SEQ ID NO: 2000199 - RNA, 13 nt, Homo sapiens
acaagauuguaaa

SEQ ID NO: 2000200 - RNA, 14 nt, Homo sapiens
aggaccaagcaucu

SEQ ID NO: 2000201 - RNA, 23 nt, Homo sapiens
gaucauuaucagccugugccacg

SEQ ID NO: 2000202 - RNA, 16 nt, Homo sapiens
acaguucuacagaaaa

SEQ ID NO: 2000203 - RNA, 13 nt, Homo sapiens
ucccucuguguca

SEQ ID NO: 2000204 - RNA, 13 nt, Homo sapiens
agucacugacccu

SEQ ID NO: 2000205 - RNA, 13 nt, Homo sapiens
ucuuacugugcuu

SEQ ID NO: 2000206 - RNA, 21 nt, Homo sapiens
gaacaaaaagaaaucuugucu

SEQ ID NO: 2000207 - RNA, 16 nt, Homo sapiens
gcucagucagugcacu

SEQ ID NO: 2000208 - RNA, 19 nt, Homo sapiens
auuuaccacagacuauuaa

SEQ ID NO: 2000209 - RNA, 22 nt, Homo sapiens
uucccuguagugaccuguaaaa

SEQ ID NO: 2000210 - RNA, 18 nt, Homo sapiens
ucagcaucugaccaucug

SEQ ID NO: 2000211 - RNA, 12 nt, Homo sapiens
gaaugauggacu

SEQ ID NO: 2000212 - RNA, 22 nt, Homo sapiens
ucuucccacacagaauauacau

SEQ ID NO: 2000213 - RNA, 22 nt, Homo sapiens
gacuaccucugugccuugccac

SEQ ID NO: 2000214 - RNA, 22 nt, Homo sapiens
cccagccggcaggccuggacuu

SEQ ID NO: 2000215 - RNA, 17 nt, Homo sapiens
uugaaacguuaugauga

SEQ ID NO: 2000216 - RNA, 15 nt, Homo sapiens
gcgcuuggcaucaca

SEQ ID NO: 2000217 - RNA, 19 nt, Homo sapiens
aucaucagcauaccuuuau

SEQ ID NO: 2000218 - RNA, 20 nt, Homo sapiens
caaauauuuagcaucuuccu

SEQ ID NO: 2000219 - RNA, 21 nt, Homo sapiens
accugaaugaccugcagucag

SEQ ID NO: 2000220 - RNA, 17 nt, Homo sapiens
uagagugauuuugaaau

SEQ ID NO: 2000221 - RNA, 16 nt, Homo sapiens
auaguuucccauaaca

SEQ ID NO: 2000222 - RNA, 15 nt, Homo sapiens
gacucucacacugaa

SEQ ID NO: 2000223 - RNA, 14 nt, Homo sapiens
aaugaccaggccaa

SEQ ID NO: 2000224 - RNA, 17 nt, Homo sapiens
uaguaaagcuugcacau

SEQ ID NO: 2000225 - RNA, 23 nt, Homo sapiens
gaguuguucaaauguuccuuuua

SEQ ID NO: 2000226 - RNA, 19 nt, Homo sapiens
aaauuauuacuaaugaugc

SEQ ID NO: 2000227 - RNA, 17 nt, Homo sapiens
ggcgaguucagcaaaga

SEQ ID NO: 2000228 - RNA, 18 nt, Homo sapiens
cacaggucccacugcccu

SEQ ID NO: 2000229 - RNA, 20 nt, Homo sapiens
ccaaaggaaggcacccuuga

SEQ ID NO: 2000230 - RNA, 15 nt, Homo sapiens
agcaaauuaguaauu

SEQ ID NO: 2000231 - RNA, 19 nt, Homo sapiens
ggaaccguaggacccaagc

SEQ ID NO: 2000232 - RNA, 21 nt, Homo sapiens
cuccaagaggcugaggacuuu

SEQ ID NO: 2000233 - RNA, 23 nt, Homo sapiens
aacggcuccaucaccagcccggg

SEQ ID NO: 2000234 - RNA, 20 nt, Homo sapiens
cauucaggugaccuccugca

SEQ ID NO: 2000235 - RNA, 23 nt, Homo sapiens
ccaaucugcaggcucuaucuuug

SEQ ID NO: 2000236 - RNA, 19 nt, Homo sapiens
cacccuggccaccccaucu

SEQ ID NO: 2000237 - RNA, 13 nt, Homo sapiens
uuucucuuugaga

SEQ ID NO: 2000238 - RNA, 14 nt, Homo sapiens
cucauccuuugcca

SEQ ID NO: 2000239 - RNA, 14 nt, Homo sapiens
ccagauagcucaau

SEQ ID NO: 2000240 - RNA, 20 nt, Homo sapiens
gaugucucugcaaaccaaca

SEQ ID NO: 2000241 - RNA, 14 nt, Homo sapiens
agcuucaaacugca

SEQ ID NO: 2000242 - RNA, 15 nt, Homo sapiens
acuuggcaucauuca

SEQ ID NO: 2000243 - RNA, 18 nt, Homo sapiens
caacaugucacacuggcu

SEQ ID NO: 2000244 - RNA, 18 nt, Homo sapiens
ucaucaggugcauagcaa

SEQ ID NO: 2000245 - RNA, 20 nt, Homo sapiens
gaaaaacaaaaaggaaauga

SEQ ID NO: 2000246 - RNA, 21 nt, Homo sapiens
aacaacguucuuaguuuacuu

SEQ ID NO: 2000247 - RNA, 16 nt, Homo sapiens
caaacauuguuuuauu

SEQ ID NO: 2000248 - RNA, 21 nt, Homo sapiens
ugcaguucauccgcacuguaa

SEQ ID NO: 2000249 - RNA, 21 nt, Homo sapiens
uuaaauauuuuggcauuguac

SEQ ID NO: 2000250 - RNA, 12 nt, Homo sapiens
ucuggacacugu

SEQ ID NO: 2000251 - RNA, 15 nt, Homo sapiens
gugugugccacaccc

SEQ ID NO: 2000252 - RNA, 18 nt, Homo sapiens
ucaugcccgccagugcac

SEQ ID NO: 2000253 - RNA, 19 nt, Homo sapiens
cacacggaagcaagcagau

SEQ ID NO: 2000254 - RNA, 12 nt, Homo sapiens
cccgaaaccuca

SEQ ID NO: 2000255 - RNA, 13 nt, Homo sapiens
gaccagacacagg

SEQ ID NO: 2000256 - RNA, 21 nt, Homo sapiens
uaaguuuugaaauaagaaagu

SEQ ID NO: 2000257 - RNA, 15 nt, Homo sapiens
gacaggaaaaacccg

SEQ ID NO: 2000258 - RNA, 15 nt, Homo sapiens
acauaacaugcuuua

SEQ ID NO: 2000259 - RNA, 12 nt, Homo sapiens
aaggugaaucug

SEQ ID NO: 2000260 - RNA, 12 nt, Homo sapiens
ucucugaaaagc

SEQ ID NO: 2000261 - RNA, 14 nt, Homo sapiens
agacacugugcuau

SEQ ID NO: 2000262 - RNA, 17 nt, Homo sapiens
auauuuaagcaacaucu

SEQ ID NO: 2000263 - RNA, 14 nt, Homo sapiens
aauauuuugcauau

SEQ ID NO: 2000264 - RNA, 18 nt, Homo sapiens
uaaaaaauuaguugggca

SEQ ID NO: 2000265 - RNA, 14 nt, Homo sapiens
uguacuacaguaua

SEQ ID NO: 2000266 - RNA, 21 nt, Homo sapiens
uuuaaacacggggcuugcaac

SEQ ID NO: 2000267 - RNA, 18 nt, Homo sapiens
cucuaagcacauuccaaa

SEQ ID NO: 2000268 - RNA, 17 nt, Homo sapiens
auaaacagagcuuucaa

SEQ ID NO: 2000269 - RNA, 21 nt, Homo sapiens
auucaucuuuccuuugcucug

SEQ ID NO: 2000270 - RNA, 13 nt, Homo sapiens
accaguugccguu

SEQ ID NO: 2000271 - RNA, 18 nt, Homo sapiens
auagaaacaugacacuga

SEQ ID NO: 2000272 - RNA, 13 nt, Homo sapiens
gagcugcucugcu

SEQ ID NO: 2000273 - RNA, 13 nt, Homo sapiens
guguggcucagug

SEQ ID NO: 2000274 - RNA, 13 nt, Homo sapiens
gagaggcucugag

SEQ ID NO: 2000275 - RNA, 16 nt, Homo sapiens
aaugcuacugaaacuu

SEQ ID NO: 2000276 - RNA, 19 nt, Homo sapiens
uuauauuuuaugaacauug

SEQ ID NO: 2000277 - RNA, 16 nt, Homo sapiens
cguuuggccaaaaaga

SEQ ID NO: 2000278 - RNA, 19 nt, Homo sapiens
gcaaaacagacaucaugcu

SEQ ID NO: 2000279 - RNA, 15 nt, Homo sapiens
aaggagaacugugcu

SEQ ID NO: 2000280 - RNA, 23 nt, Homo sapiens
ccugguccccccaaaucuacuga

SEQ ID NO: 2000281 - RNA, 19 nt, Homo sapiens
guuucaaaaauaaauuugc

SEQ ID NO: 2000282 - RNA, 15 nt, Homo sapiens
ugcguaaaguaauau

SEQ ID NO: 2000283 - RNA, 19 nt, Homo sapiens
aaugccgcugucucugagg

SEQ ID NO: 2000284 - RNA, 17 nt, Homo sapiens
cagauacacugugauaa

SEQ ID NO: 2000285 - RNA, 17 nt, Homo sapiens
uccaugccugcucucga

SEQ ID NO: 2000286 - RNA, 16 nt, Homo sapiens
cgugugcgugcaugug

SEQ ID NO: 2000287 - RNA, 13 nt, Homo sapiens
gaugggauuucau

SEQ ID NO: 2000288 - RNA, 18 nt, Homo sapiens
aauuucuuucuaaaacac

SEQ ID NO: 2000289 - RNA, 19 nt, Homo sapiens
cuuauuuauguaacaaagu

SEQ ID NO: 2000290 - RNA, 15 nt, Homo sapiens
aaaggaacaguugca

SEQ ID NO: 2000291 - RNA, 22 nt, Homo sapiens
uggacguacugguuuaaccucc

SEQ ID NO: 2000292 - RNA, 22 nt, Homo sapiens
caugcauaaaaauuaaauggau

SEQ ID NO: 2000293 - RNA, 21 nt, Homo sapiens
ugaagcugacagcacuacaaa

SEQ ID NO: 2000294 - RNA, 19 nt, Homo sapiens
ucugccaaaggaugugaua

SEQ ID NO: 2000295 - RNA, 17 nt, Homo sapiens
gugugcaagugugugca

SEQ ID NO: 2000296 - RNA, 20 nt, Homo sapiens
uaacuuauugcauaacagca

SEQ ID NO: 2000297 - RNA, 18 nt, Homo sapiens
gaggccuaccugcucccc

SEQ ID NO: 2000298 - RNA, 16 nt, Homo sapiens
auauuuaaauaaagga

SEQ ID NO: 2000299 - RNA, 23 nt, Homo sapiens
cuaagggcaggcccaaauuauca

SEQ ID NO: 2000300 - RNA, 22 nt, Homo sapiens
aaauauacuuuuacaaguaaca

SEQ ID NO: 2000301 - RNA, 15 nt, Homo sapiens
ucaccacgugcagua

SEQ ID NO: 2000302 - RNA, 23 nt, Homo sapiens
cuccugucuucagagcaaaagac

SEQ ID NO: 2000303 - RNA, 17 nt, Homo sapiens
aaagguuuacagaauuu

SEQ ID NO: 2000304 - RNA, 13 nt, Homo sapiens
uugugaauugccu

SEQ ID NO: 2000305 - RNA, 19 nt, Homo sapiens
uuaagcuuuaaaugacagu

SEQ ID NO: 2000306 - RNA, 16 nt, Homo sapiens
guuguaccacugcuaa

SEQ ID NO: 2000307 - RNA, 19 nt, Homo sapiens
cuagagaaggacccggagg

SEQ ID NO: 2000308 - RNA, 22 nt, Homo sapiens
uccuuuuuuuuuuauccuaguc

SEQ ID NO: 2000309 - RNA, 16 nt, Homo sapiens
guuacagguggggcau

SEQ ID NO: 2000310 - RNA, 18 nt, Homo sapiens
cuccaacucccucuggga

SEQ ID NO: 2000311 - RNA, 16 nt, Homo sapiens
aggcccaaugcugcuu

SEQ ID NO: 2000312 - RNA, 16 nt, Homo sapiens
accaaagaaauuauaa

SEQ ID NO: 2000313 - RNA, 14 nt, Homo sapiens
cccagggcucugca

SEQ ID NO: 2000314 - RNA, 14 nt, Homo sapiens
aaugacuucauuuc

SEQ ID NO: 2000315 - RNA, 21 nt, Homo sapiens
auauuuauuuauguguucaca

SEQ ID NO: 2000316 - RNA, 15 nt, Homo sapiens
uggacgugcucagac

SEQ ID NO: 2000317 - RNA, 15 nt, Homo sapiens
uuccaaccggcuuug

SEQ ID NO: 2000318 - RNA, 17 nt, Homo sapiens
uggcaggggggcugugg

SEQ ID NO: 2000319 - RNA, 19 nt, Homo sapiens
ugugcacguaaaguacuug

SEQ ID NO: 2000320 - RNA, 20 nt, Homo sapiens
aaagccucaaaucuuccuua

SEQ ID NO: 2000321 - RNA, 22 nt, Homo sapiens
uuuuacuugaaucagauggugu

SEQ ID NO: 2000322 - RNA, 20 nt, Homo sapiens
cgcagcugcugccacucugc

SEQ ID NO: 2000323 - RNA, 14 nt, Homo sapiens
agggaauccagcuc

SEQ ID NO: 2000324 - RNA, 19 nt, Homo sapiens
cugcgcaggccaugcaugg

SEQ ID NO: 2000325 - RNA, 21 nt, Homo sapiens
gccugggaggggcaauccuca

SEQ ID NO: 2000326 - RNA, 19 nt, Homo sapiens
gacauggguagcaauucua

SEQ ID NO: 2000327 - RNA, 20 nt, Homo sapiens
uugccaaacagccacacugu

SEQ ID NO: 2000328 - RNA, 23 nt, Homo sapiens
uccccuuuacuaucauucucagu

SEQ ID NO: 2000329 - RNA, 21 nt, Homo sapiens
cugguaauggguaagguucua

SEQ ID NO: 2000330 - RNA, 22 nt, Homo sapiens
uuuccucuuaaugucucaaaau

SEQ ID NO: 2000331 - RNA, 17 nt, Homo sapiens
caaugaauccccaauaa

SEQ ID NO: 2000332 - RNA, 23 nt, Homo sapiens
auccuuacagcuaucuguagaau

SEQ ID NO: 2000333 - RNA, 17 nt, Homo sapiens
gacaacauuaugaucua

SEQ ID NO: 2000334 - RNA, 14 nt, Homo sapiens
aacuuagaaaggga

SEQ ID NO: 2000335 - RNA, 21 nt, Homo sapiens
aguggcccccacucacaggga

SEQ ID NO: 2000336 - RNA, 19 nt, Homo sapiens
ccaucaacaagucuugaaa

SEQ ID NO: 2000337 - RNA, 17 nt, Homo sapiens
uuccccaagaaggugag

SEQ ID NO: 2000338 - RNA, 13 nt, Homo sapiens
auuucccacuucc

SEQ ID NO: 2000339 - RNA, 24 nt, Homo sapiens
cagcugacuuuucuguccgagcuu

SEQ ID NO: 2000340 - RNA, 17 nt, Homo sapiens
auaaauccaucacuaua

SEQ ID NO: 2000341 - RNA, 13 nt, Homo sapiens
ggaaccccuccug

SEQ ID NO: 2000342 - RNA, 13 nt, Homo sapiens
auuuucaucaaaa

SEQ ID NO: 2000343 - RNA, 13 nt, Homo sapiens
ccaugugaucuca

SEQ ID NO: 2000344 - RNA, 20 nt, Homo sapiens
cacagaggaagaaaccugga

SEQ ID NO: 2000345 - RNA, 17 nt, Homo sapiens
aucacagcucacugcag

SEQ ID NO: 2000346 - RNA, 16 nt, Homo sapiens
uugcaaagaccaccuc

SEQ ID NO: 2000347 - RNA, 23 nt, Homo sapiens
agaucauguaaggaagggacuga

SEQ ID NO: 2000348 - RNA, 18 nt, Homo sapiens
agggauguuccaguggau

SEQ ID NO: 2000349 - RNA, 16 nt, Homo sapiens
uccaggaucuuugacu

SEQ ID NO: 2000350 - RNA, 20 nt, Homo sapiens
uuaacaacauguuuccagca

SEQ ID NO: 2000351 - RNA, 13 nt, Homo sapiens
caucucagacugu

SEQ ID NO: 2000352 - RNA, 19 nt, Homo sapiens
aucaauagaaggauguaca

SEQ ID NO: 2000353 - RNA, 14 nt, Homo sapiens
aacuuagcauuuag

SEQ ID NO: 2000354 - RNA, 20 nt, Homo sapiens
ggcagccucuccgacucugc

SEQ ID NO: 2000355 - RNA, 18 nt, Homo sapiens
uugugauuuuugaacaau

SEQ ID NO: 2000356 - RNA, 17 nt, Homo sapiens
agaauagaaccaaccca

SEQ ID NO: 2000357 - RNA, 18 nt, Homo sapiens
aacccccgacuucauccc

SEQ ID NO: 2000358 - RNA, 14 nt, Homo sapiens
aacugagucacuca

SEQ ID NO: 2000359 - RNA, 18 nt, Homo sapiens
auacccaccucuguggau

SEQ ID NO: 2000360 - RNA, 17 nt, Homo sapiens
cagaauugacaguugaa

SEQ ID NO: 2000361 - RNA, 17 nt, Homo sapiens
cugaugacaaacccagg

SEQ ID NO: 2000362 - RNA, 14 nt, Homo sapiens
aguguggugugugg

SEQ ID NO: 2000363 - RNA, 23 nt, Homo sapiens
gguuuccgaaggguuuugcuaca

SEQ ID NO: 2000364 - RNA, 15 nt, Homo sapiens
acgugaacuaagauu

SEQ ID NO: 2000365 - RNA, 15 nt, Homo sapiens
aaaauaguagaacaa

SEQ ID NO: 2000366 - RNA, 18 nt, Homo sapiens
acuuggaccucagccaac

SEQ ID NO: 2000367 - RNA, 20 nt, Homo sapiens
gccaaacccaugaggcaaug

SEQ ID NO: 2000368 - RNA, 15 nt, Homo sapiens
uuuuugagaaacagc

SEQ ID NO: 2000369 - RNA, 17 nt, Homo sapiens
gucccuaaaaacacaga

SEQ ID NO: 2000370 - RNA, 17 nt, Homo sapiens
cagaggcuccacaggcu

SEQ ID NO: 2000371 - RNA, 16 nt, Homo sapiens
aggaggucagcacaag

SEQ ID NO: 2000372 - RNA, 18 nt, Homo sapiens
uaauaaauauuuuugcca

SEQ ID NO: 2000373 - RNA, 18 nt, Homo sapiens
caucuacucauugucuca

SEQ ID NO: 2000374 - RNA, 15 nt, Homo sapiens
uuucuuuaaagccag

SEQ ID NO: 2000375 - RNA, 11 nt, Homo sapiens
uaacauuugcc

SEQ ID NO: 2000376 - RNA, 13 nt, Homo sapiens
cccgccccagaga

SEQ ID NO: 2000377 - RNA, 13 nt, Homo sapiens
ccaaccccagcaa

SEQ ID NO: 2000378 - RNA, 22 nt, Homo sapiens
uucuuuaacccucacugggacu

SEQ ID NO: 2000379 - RNA, 21 nt, Homo sapiens
aauucuauugaguggcagugu

SEQ ID NO: 2000380 - RNA, 14 nt, Homo sapiens
aguauaacaacuuu

SEQ ID NO: 2000381 - RNA, 14 nt, Homo sapiens
auuaagaagcaaua

SEQ ID NO: 2000382 - RNA, 16 nt, Homo sapiens
aaucauuuugccucuu

SEQ ID NO: 2000383 - RNA, 17 nt, Homo sapiens
ggaucaugguguaauaa

SEQ ID NO: 2000384 - RNA, 15 nt, Homo sapiens
ucaagaugugacaug

SEQ ID NO: 2000385 - RNA, 23 nt, Homo sapiens
gcaguggcuccgaucucugcuca

SEQ ID NO: 2000386 - RNA, 20 nt, Homo sapiens
agaggcugaggcuggcacag

SEQ ID NO: 2000387 - RNA, 21 nt, Homo sapiens
cucugcugcagcggccacacu

SEQ ID NO: 2000388 - RNA, 14 nt, Homo sapiens
agguagccauccca

SEQ ID NO: 2000389 - RNA, 19 nt, Homo sapiens
ccaacccuaucuccugaca

SEQ ID NO: 2000390 - RNA, 23 nt, Homo sapiens
acugagucuuuuggaggcuccaa

SEQ ID NO: 2000391 - RNA, 20 nt, Homo sapiens
ccucaauccuccauuugcug

SEQ ID NO: 2000392 - RNA, 19 nt, Homo sapiens
caucccucgggugugcuau

SEQ ID NO: 2000393 - RNA, 23 nt, Homo sapiens
agcccacauuggauucaucagca

SEQ ID NO: 2000394 - RNA, 13 nt, Homo sapiens
aagccucagcuca

SEQ ID NO: 2000395 - RNA, 16 nt, Homo sapiens
uaaauucaaaccuaag

SEQ ID NO: 2000396 - RNA, 17 nt, Homo sapiens
guccagggcuagugacu

SEQ ID NO: 2000397 - RNA, 19 nt, Homo sapiens
uacagauguaaaugccaca

SEQ ID NO: 2000398 - RNA, 21 nt, Homo sapiens
auaauuuaaaauccauuuuag

SEQ ID NO: 2000399 - RNA, 16 nt, Homo sapiens
uccagggcaaggccau

SEQ ID NO: 2000400 - RNA, 20 nt, Homo sapiens
aauucagaucaaaaugccuu

SEQ ID NO: 2000401 - RNA, 16 nt, Homo sapiens
auguugagcagcaucu

SEQ ID NO: 2000402 - RNA, 20 nt, Homo sapiens
cacauucuuaaauauuucca

SEQ ID NO: 2000403 - RNA, 21 nt, Homo sapiens
ucuuucuuaaugaaccuuaga

SEQ ID NO: 2000404 - RNA, 17 nt, Homo sapiens
uucacagucuggugcuu

SEQ ID NO: 2000405 - RNA, 21 nt, Homo sapiens
caugauguuuuaagcugcuaa

SEQ ID NO: 2000406 - RNA, 16 nt, Homo sapiens
caggccucaccauucc

SEQ ID NO: 2000407 - RNA, 22 nt, Homo sapiens
uaauuuuaguauuaacucugua

SEQ ID NO: 2000408 - RNA, 16 nt, Homo sapiens
aagcagucuugcucug

SEQ ID NO: 2000409 - RNA, 17 nt, Homo sapiens
cuagagccgaggggaga

SEQ ID NO: 2000410 - RNA, 18 nt, Homo sapiens
caaauaaguuacccucaa

SEQ ID NO: 2000411 - RNA, 19 nt, Homo sapiens
auaagaaaaaauucuuuca

SEQ ID NO: 2000412 - RNA, 18 nt, Homo sapiens
aauacuuuugcugaugcu

SEQ ID NO: 2000413 - RNA, 22 nt, Homo sapiens
auuuucaagaaagcauugccag

SEQ ID NO: 2000414 - RNA, 17 nt, Homo sapiens
gcccaugggcagaagau

SEQ ID NO: 2000415 - RNA, 22 nt, Homo sapiens
uauuuugcaauaguuaccucaa

SEQ ID NO: 2000416 - RNA, 16 nt, Homo sapiens
cacauuggcagugugu

SEQ ID NO: 2000417 - RNA, 18 nt, Homo sapiens
caggacugugccugaaca

SEQ ID NO: 2000418 - RNA, 13 nt, Homo sapiens
ucaaauacauaca

SEQ ID NO: 2000419 - RNA, 21 nt, Homo sapiens
aucuggaccccaucugugaau

SEQ ID NO: 2000420 - RNA, 21 nt, Homo sapiens
aaagaguaugagucuucugua

SEQ ID NO: 2000421 - RNA, 19 nt, Homo sapiens
ugauaugagucacugccuu

SEQ ID NO: 2000422 - RNA, 20 nt, Homo sapiens
uccagccuggggaacagagc

SEQ ID NO: 2000423 - RNA, 21 nt, Homo sapiens
cagaacuuuccagggauccag

SEQ ID NO: 2000424 - RNA, 23 nt, Homo sapiens
gcucuaauguacaauaaagcaau

SEQ ID NO: 2000425 - RNA, 14 nt, Homo sapiens
uugugguuaaucug

SEQ ID NO: 2000426 - RNA, 15 nt, Homo sapiens
uccuagcaaccugcc

SEQ ID NO: 2000427 - RNA, 21 nt, Homo sapiens
aggaucuuuguuccucugagc

SEQ ID NO: 2000428 - RNA, 15 nt, Homo sapiens
uucagaggugcuaaa

SEQ ID NO: 2000429 - RNA, 19 nt, Homo sapiens
aaaacauggaacagugugg

SEQ ID NO: 2000430 - RNA, 16 nt, Homo sapiens
gaguggguuucacaag

SEQ ID NO: 2000431 - RNA, 15 nt, Homo sapiens
acuguauaaacaaaa

SEQ ID NO: 2000432 - RNA, 18 nt, Homo sapiens
uuuaaauguguacaaugu

SEQ ID NO: 2000433 - RNA, 23 nt, Homo sapiens
ccacugugcuuucagaagugccc

SEQ ID NO: 2000434 - RNA, 16 nt, Homo sapiens
uaaacugaacacauga

SEQ ID NO: 2000435 - RNA, 17 nt, Homo sapiens
gcucagccccagaccug

SEQ ID NO: 2000436 - RNA, 21 nt, Homo sapiens
gggcccagcugggcucugcca

SEQ ID NO: 2000437 - RNA, 16 nt, Homo sapiens
gaggacagauuaauag

SEQ ID NO: 2000438 - RNA, 22 nt, Homo sapiens
auaaacacugccuauauaugua

SEQ ID NO: 2000439 - RNA, 15 nt, Homo sapiens
agccagcucaaauca

SEQ ID NO: 2000440 - RNA, 15 nt, Homo sapiens
uucuauauuuucaca

SEQ ID NO: 2000441 - RNA, 19 nt, Homo sapiens
gcaguagugcaccaucuca

SEQ ID NO: 2000442 - RNA, 21 nt, Homo sapiens
acaauaaacgguacuugucau

SEQ ID NO: 2000443 - RNA, 15 nt, Homo sapiens
gaggcucagccacac

SEQ ID NO: 2000444 - RNA, 15 nt, Homo sapiens
uacugggugaugcac

SEQ ID NO: 2000445 - RNA, 19 nt, Homo sapiens
caugcagauucagugcaau

SEQ ID NO: 2000446 - RNA, 14 nt, Homo sapiens
auuuuucuuaacaa

SEQ ID NO: 2000447 - RNA, 17 nt, Homo sapiens
cccaucagcuccagcug

SEQ ID NO: 2000448 - RNA, 12 nt, Homo sapiens
agcuggaacccg

SEQ ID NO: 2000449 - RNA, 15 nt, Homo sapiens
acauguauugcacau

SEQ ID NO: 2000450 - RNA, 14 nt, Homo sapiens
agaaaaagagccau

SEQ ID NO: 2000451 - RNA, 17 nt, Homo sapiens
gaaacaauaaaaccugg

SEQ ID NO: 2000452 - RNA, 20 nt, Homo sapiens
caaaaauagcucuugcuuug

SEQ ID NO: 2000453 - RNA, 13 nt, Homo sapiens
aauaaauaagaau

SEQ ID NO: 2000454 - RNA, 19 nt, Homo sapiens
cucauuuaaaacaggcaaa

SEQ ID NO: 2000455 - RNA, 17 nt, Homo sapiens
guauuuucuccacuuca

SEQ ID NO: 2000456 - RNA, 14 nt, Homo sapiens
accaaagacugaaa

SEQ ID NO: 2000457 - RNA, 22 nt, Homo sapiens
cgggcccaggcccuagacccuc

SEQ ID NO: 2000458 - RNA, 22 nt, Homo sapiens
guuauuguggaaagaugaaugc

SEQ ID NO: 2000459 - RNA, 20 nt, Homo sapiens
ccucuccuucccacaaaaga

SEQ ID NO: 2000460 - RNA, 14 nt, Homo sapiens
cacaggcugcuaau

SEQ ID NO: 2000461 - RNA, 17 nt, Homo sapiens
auccucuguauuuguca

SEQ ID NO: 2000462 - RNA, 19 nt, Homo sapiens
ucaggacaagggcucagag

SEQ ID NO: 2000463 - RNA, 12 nt, Homo sapiens
aucuucuggguu

SEQ ID NO: 2000464 - RNA, 17 nt, Homo sapiens
cuggaacauucugucau

SEQ ID NO: 2000465 - RNA, 21 nt, Homo sapiens
ugugugcauggaacaaauaau

SEQ ID NO: 2000466 - RNA, 23 nt, Homo sapiens
gccaugauucuuaagagaauuga

SEQ ID NO: 2000467 - RNA, 20 nt, Homo sapiens
uguguguugccacaggacac

SEQ ID NO: 2000468 - RNA, 17 nt, Homo sapiens
aauagcuguaaacuucc

SEQ ID NO: 2000469 - RNA, 18 nt, Homo sapiens
cuucagucucuauaccaa

SEQ ID NO: 2000470 - RNA, 23 nt, Homo sapiens
ugguucauauuuauacuuugcaa

SEQ ID NO: 2000471 - RNA, 22 nt, Homo sapiens
uuaaaugccccccucccaacag

SEQ ID NO: 2000472 - RNA, 13 nt, Homo sapiens
aagucuacuucac

SEQ ID NO: 2000473 - RNA, 22 nt, Homo sapiens
ccagcgugaggagcgaucucag

SEQ ID NO: 2000474 - RNA, 19 nt, Homo sapiens
cuccaugguggggccaaga

SEQ ID NO: 2000475 - RNA, 15 nt, Homo sapiens
aauugugaacagcca

SEQ ID NO: 2000476 - RNA, 22 nt, Homo sapiens
auaaggaucuucccacuuugcc

SEQ ID NO: 2000477 - RNA, 22 nt, Homo sapiens
ugggucagggggagucuuugca

SEQ ID NO: 2000478 - RNA, 16 nt, Homo sapiens
gucugcucaaugccau

SEQ ID NO: 2000479 - RNA, 21 nt, Homo sapiens
cuauuuuacuuuucugccaaa

SEQ ID NO: 2000480 - RNA, 18 nt, Homo sapiens
gguuguacguuuugcaca

SEQ ID NO: 2000481 - RNA, 17 nt, Homo sapiens
agagacaguaucucuag

SEQ ID NO: 2000482 - RNA, 15 nt, Homo sapiens
ucgggauuaguacac

SEQ ID NO: 2000483 - RNA, 23 nt, Homo sapiens
agccacuggcugcuaacaaguca

SEQ ID NO: 2000484 - RNA, 17 nt, Homo sapiens
ucagagcagaggcagca

SEQ ID NO: 2000485 - RNA, 15 nt, Homo sapiens
gaaucuagagcaaag

SEQ ID NO: 2000486 - RNA, 21 nt, Homo sapiens
acugcaccugggcagcuccuc

SEQ ID NO: 2000487 - RNA, 21 nt, Homo sapiens
cuuucuguagguuucucucuu

SEQ ID NO: 2000488 - RNA, 21 nt, Homo sapiens
uguccugcuggcuuccagcuu

SEQ ID NO: 2000489 - RNA, 18 nt, Homo sapiens
ccucaacuccaggauuua

SEQ ID NO: 2000490 - RNA, 14 nt, Homo sapiens
guuucaugaaauga

SEQ ID NO: 2000491 - RNA, 15 nt, Homo sapiens
uuguagcagaaggca

SEQ ID NO: 2000492 - RNA, 15 nt, Homo sapiens
ccuacucuuugccaa

SEQ ID NO: 2000493 - RNA, 17 nt, Homo sapiens
uggugcaagugugcaug

SEQ ID NO: 2000494 - RNA, 19 nt, Homo sapiens
agacuacuaaugacuuugu

SEQ ID NO: 2000495 - RNA, 14 nt, Homo sapiens
agaaaaucuaccaa

SEQ ID NO: 2000496 - RNA, 23 nt, Homo sapiens
auagugacuaugaacuucucuca

SEQ ID NO: 2000497 - RNA, 15 nt, Homo sapiens
cgcucuguugcccag

SEQ ID NO: 2000498 - RNA, 20 nt, Homo sapiens
ucauuccauguccauaugca

SEQ ID NO: 2000499 - RNA, 16 nt, Homo sapiens
ucuacuucugcccuug

SEQ ID NO: 2000500 - RNA, 15 nt, Homo sapiens
agacccagcccagac

SEQ ID NO: 2000501 - RNA, 16 nt, Homo sapiens
cuugaccaauaaccua

SEQ ID NO: 2000502 - RNA, 19 nt, Homo sapiens
gcccagcgguucacacagg

SEQ ID NO: 2000503 - RNA, 14 nt, Homo sapiens
caaacauacccauc

SEQ ID NO: 2000504 - RNA, 16 nt, Homo sapiens
gucaaugaauuuugcu

SEQ ID NO: 2000505 - RNA, 15 nt, Homo sapiens
uaacacacauaaagg

SEQ ID NO: 2000506 - RNA, 23 nt, Homo sapiens
cagaacaaaagauaaaacuaauu

SEQ ID NO: 2000507 - RNA, 22 nt, Homo sapiens
uucaucaugucaguuccaauga

SEQ ID NO: 2000508 - RNA, 22 nt, Homo sapiens
augcuguuaugaguggcuuuaa

SEQ ID NO: 2000509 - RNA, 20 nt, Homo sapiens
acauucccuugauggucuca

SEQ ID NO: 2000510 - RNA, 15 nt, Homo sapiens
auacugccuuugcag

SEQ ID NO: 2000511 - RNA, 20 nt, Homo sapiens
aaucccuguacucugaccca

SEQ ID NO: 2000512 - RNA, 13 nt, Homo sapiens
ugcugucuguccu

SEQ ID NO: 2000513 - RNA, 18 nt, Homo sapiens
acauuuucaauacugucc

SEQ ID NO: 2000514 - RNA, 16 nt, Homo sapiens
uaauuuaacacccuuu

SEQ ID NO: 2000515 - RNA, 17 nt, Homo sapiens
agucccugucaccucuu

SEQ ID NO: 2000516 - RNA, 23 nt, Homo sapiens
agcacaggugggcuucccagugg

SEQ ID NO: 2000517 - RNA, 13 nt, Homo sapiens
ugacacagucaau

SEQ ID NO: 2000518 - RNA, 20 nt, Homo sapiens
gcucuuuccuggcuacucca

SEQ ID NO: 2000519 - RNA, 22 nt, Homo sapiens
cucuacuugcaagccucaaaga

SEQ ID NO: 2000520 - RNA, 15 nt, Homo sapiens
aauaugcauaaucag

SEQ ID NO: 2000521 - RNA, 12 nt, Homo sapiens
ucuauaggucau

SEQ ID NO: 2000522 - RNA, 15 nt, Homo sapiens
uuuucaucacuggga

SEQ ID NO: 2000523 - RNA, 18 nt, Homo sapiens
acacuguauauaaacaua

SEQ ID NO: 2000524 - RNA, 18 nt, Homo sapiens
caguaaaaauaaaauacu

SEQ ID NO: 2000525 - RNA, 17 nt, Homo sapiens
agcuuaccugacacaag

SEQ ID NO: 2000526 - RNA, 13 nt, Homo sapiens
ccaaacacauuaa

SEQ ID NO: 2000527 - RNA, 15 nt, Homo sapiens
aagaaccaguguuua

SEQ ID NO: 2000528 - RNA, 16 nt, Homo sapiens
uggagaaggaguuuca

SEQ ID NO: 2000529 - RNA, 23 nt, Homo sapiens
agggcccugugccaggccaaaga

SEQ ID NO: 2000530 - RNA, 18 nt, Homo sapiens
uauaaucaauaagcuaga

SEQ ID NO: 2000531 - RNA, 15 nt, Homo sapiens
cugcaagcuuuucaa

SEQ ID NO: 2000532 - RNA, 12 nt, Homo sapiens
acucuugcucac

SEQ ID NO: 2000533 - RNA, 13 nt, Homo sapiens
ucagcaguauucu

SEQ ID NO: 2000534 - RNA, 21 nt, Homo sapiens
cuuaccagggucuuugcagau

SEQ ID NO: 2000535 - RNA, 13 nt, Homo sapiens
auacuuuacaaag

SEQ ID NO: 2000536 - RNA, 13 nt, Homo sapiens
aaacuuuacuaag

SEQ ID NO: 2000537 - RNA, 17 nt, Homo sapiens
ugauucggccucuccac

SEQ ID NO: 2000538 - RNA, 20 nt, Homo sapiens
ccucugacugaugcuuucag

SEQ ID NO: 2000539 - RNA, 22 nt, Homo sapiens
cauuaacuggugaauggaguca

SEQ ID NO: 2000540 - RNA, 17 nt, Homo sapiens
uggcuaucuacaaugug

SEQ ID NO: 2000541 - RNA, 22 nt, Homo sapiens
aaauuuuauuuuuauuacuuuu

SEQ ID NO: 2000542 - RNA, 14 nt, Homo sapiens
agacugaaagaaua

SEQ ID NO: 2000543 - RNA, 19 nt, Homo sapiens
auuauuuuuuauacuguau

SEQ ID NO: 2000544 - RNA, 23 nt, Homo sapiens
auuaauaacagguuuaaauagcu

SEQ ID NO: 2000545 - RNA, 17 nt, Homo sapiens
cgugaaaaggacaaaua

SEQ ID NO: 2000546 - RNA, 20 nt, Homo sapiens
uacuuuugcuuucuaccuga

SEQ ID NO: 2000547 - RNA, 14 nt, Homo sapiens
cuaaauauuuccau

SEQ ID NO: 2000548 - RNA, 19 nt, Homo sapiens
gcuggcaccagaugauguc

SEQ ID NO: 2000549 - RNA, 23 nt, Homo sapiens
cugucccuccaggcccaucucaa

SEQ ID NO: 2000550 - RNA, 14 nt, Homo sapiens
ucaacuuccaaagg

SEQ ID NO: 2000551 - RNA, 17 nt, Homo sapiens
uguagaauaaaugaaga

SEQ ID NO: 2000552 - RNA, 19 nt, Homo sapiens
guccaaacccacucaugac

SEQ ID NO: 2000553 - RNA, 14 nt, Homo sapiens
cuugugugcccuga

SEQ ID NO: 2000554 - RNA, 15 nt, Homo sapiens
aguguuuuuuauuca

SEQ ID NO: 2000555 - RNA, 15 nt, Homo sapiens
gaauugacucaaaaa

SEQ ID NO: 2000556 - RNA, 17 nt, Homo sapiens
ugcucuggcuugcccca

SEQ ID NO: 2000557 - RNA, 18 nt, Homo sapiens
ccacagccgcagcuguaa

SEQ ID NO: 2000558 - RNA, 14 nt, Homo sapiens
ccuuguuuugccau

SEQ ID NO: 2000559 - RNA, 13 nt, Homo sapiens
cuauugaauugga

SEQ ID NO: 2000560 - RNA, 14 nt, Homo sapiens
cagaagucuuucag

SEQ ID NO: 2000561 - RNA, 15 nt, Homo sapiens
gaauucaauuugaac

SEQ ID NO: 2000562 - RNA, 10 nt, Homo sapiens
cucuguccag

SEQ ID NO: 2000563 - RNA, 22 nt, Homo sapiens
aaacaaaccauuuuuuuucucu

SEQ ID NO: 2000564 - RNA, 21 nt, Homo sapiens
ucuuuagaaacacaagaguau

SEQ ID NO: 2000565 - RNA, 13 nt, Homo sapiens
acacauacagagc

SEQ ID NO: 2000566 - RNA, 22 nt, Homo sapiens
gacaguugauuuccaacaugag

SEQ ID NO: 2000567 - RNA, 15 nt, Homo sapiens
aaggaucucucagga

SEQ ID NO: 2000568 - RNA, 21 nt, Homo sapiens
uucaaaacaaaaugaaacaaa

SEQ ID NO: 2000569 - RNA, 23 nt, Homo sapiens
uccagcaggagggacagucucac

SEQ ID NO: 2000570 - RNA, 16 nt, Homo sapiens
cuuucaccuuugugua

SEQ ID NO: 2000571 - RNA, 23 nt, Homo sapiens
aauuuucucucacugaugcccuu

SEQ ID NO: 2000572 - RNA, 20 nt, Homo sapiens
gcacccuggauuugcauaca

SEQ ID NO: 2000573 - RNA, 22 nt, Homo sapiens
cuccacauccaccccacuggau

SEQ ID NO: 2000574 - RNA, 23 nt, Homo sapiens
cuucuugucagacauaaagccau

SEQ ID NO: 2000575 - RNA, 17 nt, Homo sapiens
acaggacucugcagaua

SEQ ID NO: 2000576 - RNA, 20 nt, Homo sapiens
ccacugaucucuacuaccac

SEQ ID NO: 2000577 - RNA, 16 nt, Homo sapiens
ugaaguauauauauca

SEQ ID NO: 2000578 - RNA, 23 nt, Homo sapiens
caaugugauauguguaauaucau

SEQ ID NO: 2000579 - RNA, 18 nt, Homo sapiens
uacaaacuuuguuuguca

SEQ ID NO: 2000580 - RNA, 21 nt, Homo sapiens
accacucuucuuuaagccaua

SEQ ID NO: 2000581 - RNA, 22 nt, Homo sapiens
uaacuguuuuguauaugcugca

SEQ ID NO: 2000582 - RNA, 15 nt, Homo sapiens
auaguauaccauaca

SEQ ID NO: 2000583 - RNA, 21 nt, Homo sapiens
gaaguccuguaugucugucau

SEQ ID NO: 2000584 - RNA, 13 nt, Homo sapiens
ggaagggucccuu

SEQ ID NO: 2000585 - RNA, 22 nt, Homo sapiens
uaccccgacuaucccugcacau

SEQ ID NO: 2000586 - RNA, 14 nt, Homo sapiens
ccacauuccaugac

SEQ ID NO: 2000587 - RNA, 23 nt, Homo sapiens
uaacacauuaucgggagcagugu

SEQ ID NO: 2000588 - RNA, 20 nt, Homo sapiens
uaaccaucacugguugcacu

SEQ ID NO: 2000589 - RNA, 22 nt, Homo sapiens
gaacauuaacaaaagcaauugu

SEQ ID NO: 2000590 - RNA, 11 nt, Homo sapiens
gaaaaccuaaa

SEQ ID NO: 2000591 - RNA, 22 nt, Homo sapiens
gagaagaaaacaucuauucucu

SEQ ID NO: 2000592 - RNA, 15 nt, Homo sapiens
augaaaaccuacaua

SEQ ID NO: 2000593 - RNA, 17 nt, Homo sapiens
ccaggauggacuccauc

SEQ ID NO: 2000594 - RNA, 17 nt, Homo sapiens
uugaauguggucucagg

SEQ ID NO: 2000595 - RNA, 20 nt, Homo sapiens
ggcugaggccucucauucca

SEQ ID NO: 2000596 - RNA, 11 nt, Homo sapiens
aggaaacugcu

SEQ ID NO: 2000597 - RNA, 23 nt, Homo sapiens
ugaacaaauuuacagagacagaa

SEQ ID NO: 2000598 - RNA, 16 nt, Homo sapiens
gacuagaggcagggag

SEQ ID NO: 2000599 - RNA, 18 nt, Homo sapiens
acuugaauucaaagcaug

SEQ ID NO: 2000600 - RNA, 18 nt, Homo sapiens
cuuuugggaauggacuca

SEQ ID NO: 2000601 - RNA, 19 nt, Homo sapiens
accuagguuaacaacccug

SEQ ID NO: 2000602 - RNA, 19 nt, Homo sapiens
aggagaguacauggcauug

SEQ ID NO: 2000603 - RNA, 20 nt, Homo sapiens
cuuaaucuagagcuaugcac

SEQ ID NO: 2000604 - RNA, 17 nt, Homo sapiens
cagagaugaaacuaugg

SEQ ID NO: 2000605 - RNA, 16 nt, Homo sapiens
ccaguaaaaauccacu

SEQ ID NO: 2000606 - RNA, 21 nt, Homo sapiens
guuaauuuuuugguacaaaaa

SEQ ID NO: 2000607 - RNA, 23 nt, Homo sapiens
uauuuacaaaugaaguauuucau

SEQ ID NO: 2000608 - RNA, 24 nt, Homo sapiens
uaggaaucccagaggugggauccu

SEQ ID NO: 2000609 - RNA, 22 nt, Homo sapiens
gguguaaacuuguacauggaau

SEQ ID NO: 2000610 - RNA, 13 nt, Homo sapiens
cccgucuggugcc

SEQ ID NO: 2000611 - RNA, 19 nt, Homo sapiens
auucagugaugugccuaaa

SEQ ID NO: 2000612 - RNA, 20 nt, Homo sapiens
acaugucuacaugccaugac

SEQ ID NO: 2000613 - RNA, 20 nt, Homo sapiens
uuaaaucaugcaaccuuucc

SEQ ID NO: 2000614 - RNA, 13 nt, Homo sapiens
ccaucugagcugg

SEQ ID NO: 2000615 - RNA, 16 nt, Homo sapiens
uuuaagugcuucacau

SEQ ID NO: 2000616 - RNA, 12 nt, Homo sapiens
caagauagcucc

SEQ ID NO: 2000617 - RNA, 17 nt, Homo sapiens
gcuuaaaagaaacuaua

SEQ ID NO: 2000618 - RNA, 23 nt, Homo sapiens
gcacucagcuauaccucauucac

SEQ ID NO: 2000619 - RNA, 12 nt, Homo sapiens
gcuggacagggg

SEQ ID NO: 2000620 - RNA, 15 nt, Homo sapiens
aggagccucacuggg

SEQ ID NO: 2000621 - RNA, 15 nt, Homo sapiens
uguuacuauuccuuu

SEQ ID NO: 2000622 - RNA, 13 nt, Homo sapiens
ggcugggugguga

SEQ ID NO: 2000623 - RNA, 23 nt, Homo sapiens
agaucuuucaggacucuaccuca

SEQ ID NO: 2000624 - RNA, 20 nt, Homo sapiens
caauuguuauguguuuagaa

SEQ ID NO: 2000625 - RNA, 12 nt, Homo sapiens
uaagaagacauu

SEQ ID NO: 2000626 - RNA, 14 nt, Homo sapiens
uccucggacaccaa

SEQ ID NO: 2000627 - RNA, 16 nt, Homo sapiens
uauauuuaauggcaau

SEQ ID NO: 2000628 - RNA, 20 nt, Homo sapiens
uucaguccaacaaaccacac

SEQ ID NO: 2000629 - RNA, 22 nt, Homo sapiens
gacuggcccuguccuggcauca

SEQ ID NO: 2000630 - RNA, 17 nt, Homo sapiens
agagcugaagguugugg

SEQ ID NO: 2000631 - RNA, 13 nt, Homo sapiens
cuuugcucccuga

SEQ ID NO: 2000632 - RNA, 22 nt, Homo sapiens
aucagugcacacggaugcacag

SEQ ID NO: 2000633 - RNA, 19 nt, Homo sapiens
gcagauccaccugcacaaa

SEQ ID NO: 2000634 - RNA, 17 nt, Homo sapiens
cacccaccaccugaagc

SEQ ID NO: 2000635 - RNA, 17 nt, Homo sapiens
caugcugagucaugucu

SEQ ID NO: 2000636 - RNA, 16 nt, Homo sapiens
ucccugauggacccuc

SEQ ID NO: 2000637 - RNA, 22 nt, Homo sapiens
agaagaacagcuguuccugugu

SEQ ID NO: 2000638 - RNA, 20 nt, Homo sapiens
gacuuugauacuaccagggu

SEQ ID NO: 2000639 - RNA, 15 nt, Homo sapiens
cgaggaccacuuugg

SEQ ID NO: 2000640 - RNA, 15 nt, Homo sapiens
aggauuuggacugca

SEQ ID NO: 2000641 - RNA, 18 nt, Homo sapiens
auucaggcuucucaggug

SEQ ID NO: 2000642 - RNA, 15 nt, Homo sapiens
acccuccacucagcu

SEQ ID NO: 2000643 - RNA, 15 nt, Homo sapiens
gggcaacugcaguga

SEQ ID NO: 2000644 - RNA, 13 nt, Homo sapiens
gaagcugcuccgu

SEQ ID NO: 2000645 - RNA, 19 nt, Homo sapiens
auuucuccaagaaagccaa

SEQ ID NO: 2000646 - RNA, 16 nt, Homo sapiens
cagagucccugccugg

SEQ ID NO: 2000647 - RNA, 12 nt, Homo sapiens
ucuuaguuauug

SEQ ID NO: 2000648 - RNA, 19 nt, Homo sapiens
cauaucagcucugcauaag

SEQ ID NO: 2000649 - RNA, 19 nt, Homo sapiens
cuggaaugagcagcuuuag

SEQ ID NO: 2000650 - RNA, 20 nt, Homo sapiens
uuccuggcuccuucacugaa

SEQ ID NO: 2000651 - RNA, 18 nt, Homo sapiens
uugguuuaugacuuuguc

SEQ ID NO: 2000652 - RNA, 18 nt, Homo sapiens
aagagucgggacuugaaa

SEQ ID NO: 2000653 - RNA, 19 nt, Homo sapiens
ucccccgcaaagacaucaa

SEQ ID NO: 2000654 - RNA, 19 nt, Homo sapiens
agugaacaaucagcggcau

SEQ ID NO: 2000655 - RNA, 22 nt, Homo sapiens
gucuucuccuccaugaacauca

SEQ ID NO: 2000656 - RNA, 16 nt, Homo sapiens
gaugacguccucucaa

SEQ ID NO: 2000657 - RNA, 15 nt, Homo sapiens
cugugcucuccuaga

SEQ ID NO: 2000658 - RNA, 19 nt, Homo sapiens
aauuaaaaaguuaaucuuc

SEQ ID NO: 2000659 - RNA, 17 nt, Homo sapiens
ucuuuugguuucugcuu

SEQ ID NO: 2000660 - RNA, 13 nt, Homo sapiens
aguggaauuguga

SEQ ID NO: 2000661 - RNA, 17 nt, Homo sapiens
agcuguugaucuuucac

SEQ ID NO: 2000662 - RNA, 17 nt, Homo sapiens
uaagggagcugagccag

SEQ ID NO: 2000663 - RNA, 19 nt, Homo sapiens
caguguaacgaugcacuuu

SEQ ID NO: 2000664 - RNA, 14 nt, Homo sapiens
uugggacaucaagc

SEQ ID NO: 2000665 - RNA, 22 nt, Homo sapiens
gaucuaguucucaaucacugcu

SEQ ID NO: 2000666 - RNA, 21 nt, Homo sapiens
gaagguagagcccacugcuca

SEQ ID NO: 2000667 - RNA, 17 nt, Homo sapiens
ccaagaauucuccaaaa

SEQ ID NO: 2000668 - RNA, 21 nt, Homo sapiens
cuaaagucaggccauucaguc

SEQ ID NO: 2000669 - RNA, 19 nt, Homo sapiens
ggcaucgaccacaccagcc

SEQ ID NO: 2000670 - RNA, 20 nt, Homo sapiens
ccaguuggagcagaugccuc

SEQ ID NO: 2000671 - RNA, 21 nt, Homo sapiens
gcccuaggcuacccuugccaa

SEQ ID NO: 2000672 - RNA, 14 nt, Homo sapiens
auacaggacacuaa

SEQ ID NO: 2000673 - RNA, 20 nt, Homo sapiens
ucuucacggaaagugccugc

SEQ ID NO: 2000674 - RNA, 17 nt, Homo sapiens
ucuccaaaggcacugac

SEQ ID NO: 2000675 - RNA, 21 nt, Homo sapiens
ucuaucaaauacuaguauuaa

SEQ ID NO: 2000676 - RNA, 19 nt, Homo sapiens
ucauguuuuuucugcaaug

SEQ ID NO: 2000677 - RNA, 16 nt, Homo sapiens
accaucccugauggca

SEQ ID NO: 2000678 - RNA, 21 nt, Homo sapiens
auuacaagaucuuuccaaaua

SEQ ID NO: 2000679 - RNA, 11 nt, Homo sapiens
uuuaacaucug

SEQ ID NO: 2000680 - RNA, 23 nt, Homo sapiens
aucaugaacuagugucuaaauac

SEQ ID NO: 2000681 - RNA, 22 nt, Homo sapiens
gaacacacugagacuugaauca

SEQ ID NO: 2000682 - RNA, 12 nt, Homo sapiens
cuuuggccagug

SEQ ID NO: 2000683 - RNA, 15 nt, Homo sapiens
auugagcaguuagcu

SEQ ID NO: 2000684 - RNA, 18 nt, Homo sapiens
uugcacaauccaugaaca

SEQ ID NO: 2000685 - RNA, 22 nt, Homo sapiens
agcuggagguggaaaauggugc

SEQ ID NO: 2000686 - RNA, 18 nt, Homo sapiens
cuaauaucuuaaugaaua

SEQ ID NO: 2000687 - RNA, 13 nt, Homo sapiens
gcacuaacccagc

SEQ ID NO: 2000688 - RNA, 20 nt, Homo sapiens
cuuaggaagaaaucacuuaa

SEQ ID NO: 2000689 - RNA, 19 nt, Homo sapiens
uaacugauuaccugccaau

SEQ ID NO: 2000690 - RNA, 15 nt, Homo sapiens
ccauuacgugcauuu

SEQ ID NO: 2000691 - RNA, 22 nt, Homo sapiens
cauaccagaccacucugcuuca

SEQ ID NO: 2000692 - RNA, 15 nt, Homo sapiens
aguuuauaugcuucu

SEQ ID NO: 2000693 - RNA, 17 nt, Homo sapiens
ugugguaaaugccacac

SEQ ID NO: 2000694 - RNA, 18 nt, Homo sapiens
uuguuaauuguaauugca

SEQ ID NO: 2000695 - RNA, 17 nt, Homo sapiens
ucugugaaauucucaga

SEQ ID NO: 2000696 - RNA, 17 nt, Homo sapiens
gcagugaaguacucagu

SEQ ID NO: 2000697 - RNA, 20 nt, Homo sapiens
aggacgugcagacaggcugg

SEQ ID NO: 2000698 - RNA, 15 nt, Homo sapiens
cagugccauuccacu

SEQ ID NO: 2000699 - RNA, 21 nt, Homo sapiens
auaaaauguugaaaagucaaa

SEQ ID NO: 2000700 - RNA, 23 nt, Homo sapiens
ccagugaggucggggauuuugag

SEQ ID NO: 2000701 - RNA, 16 nt, Homo sapiens
guuucauuguguguua

SEQ ID NO: 2000702 - RNA, 17 nt, Homo sapiens
guuguuaauguacaaaa

SEQ ID NO: 2000703 - RNA, 14 nt, Homo sapiens
gcuugggcauugaa

SEQ ID NO: 2000704 - RNA, 17 nt, Homo sapiens
uugugucaaaacugguu

SEQ ID NO: 2000705 - RNA, 17 nt, Homo sapiens
cuuugccucugaaacuu

SEQ ID NO: 2000706 - RNA, 14 nt, Homo sapiens
uggcuuugugcuua

SEQ ID NO: 2000707 - RNA, 18 nt, Homo sapiens
uacacacaguuacugacu

SEQ ID NO: 2000708 - RNA, 21 nt, Homo sapiens
agcaaguuugacacaaacuca

SEQ ID NO: 2000709 - RNA, 14 nt, Homo sapiens
cucgagucugaggc

SEQ ID NO: 2000710 - RNA, 23 nt, Homo sapiens
aaagcaagacagauuaccaaaga

SEQ ID NO: 2000711 - RNA, 23 nt, Homo sapiens
ugaacugcuuuuaaaagugcaca

SEQ ID NO: 2000712 - RNA, 15 nt, Homo sapiens
cacccaucacgugug

SEQ ID NO: 2000713 - RNA, 14 nt, Homo sapiens
ucccugccacuggg

SEQ ID NO: 2000714 - RNA, 17 nt, Homo sapiens
guuuucauggugaaaau

SEQ ID NO: 2000715 - RNA, 16 nt, Homo sapiens
agagcgauaauacacu

SEQ ID NO: 2000716 - RNA, 14 nt, Homo sapiens
ugacccuccccaaa

SEQ ID NO: 2000717 - RNA, 22 nt, Homo sapiens
gagggccaaaauauuuggaaug

SEQ ID NO: 2000718 - RNA, 16 nt, Homo sapiens
ccuuugaucaguauaa

SEQ ID NO: 2000719 - RNA, 15 nt, Homo sapiens
guuguauaaccaaua

SEQ ID NO: 2000720 - RNA, 18 nt, Homo sapiens
aauaauaacaaucacaaa

SEQ ID NO: 2000721 - RNA, 19 nt, Homo sapiens
gaaagaguaaaaccaaagg

SEQ ID NO: 2000722 - RNA, 23 nt, Homo sapiens
caauucccaccuaugagugagaa

SEQ ID NO: 2000723 - RNA, 16 nt, Homo sapiens
ccucugggcagcuccu

SEQ ID NO: 2000724 - RNA, 13 nt, Homo sapiens
augauagucauca

SEQ ID NO: 2000725 - RNA, 12 nt, Homo sapiens
guucacugugag

SEQ ID NO: 2000726 - RNA, 22 nt, Homo sapiens
ccacuaauuguguacauaugua

SEQ ID NO: 2000727 - RNA, 16 nt, Homo sapiens
aaccagagaagcugcu

SEQ ID NO: 2000728 - RNA, 15 nt, Homo sapiens
cagaggaugucacaa

SEQ ID NO: 2000729 - RNA, 21 nt, Homo sapiens
uguauaauuuucuacaaccua

SEQ ID NO: 2000730 - RNA, 18 nt, Homo sapiens
uaguaucacaaaaccacc

SEQ ID NO: 2000731 - RNA, 15 nt, Homo sapiens
uacaaauuuugcacu

SEQ ID NO: 2000732 - RNA, 18 nt, Homo sapiens
aagccacaagucuuccag

SEQ ID NO: 2000733 - RNA, 13 nt, Homo sapiens
gucaccugugcac

SEQ ID NO: 2000734 - RNA, 15 nt, Homo sapiens
uuuccugacaauaaa

SEQ ID NO: 2000735 - RNA, 13 nt, Homo sapiens
gcaaugcauaucu

SEQ ID NO: 2000736 - RNA, 21 nt, Homo sapiens
cugaguagcuaggacuauggg

SEQ ID NO: 2000737 - RNA, 15 nt, Homo sapiens
cccugugggagucca

SEQ ID NO: 2000738 - RNA, 15 nt, Homo sapiens
auucucacagguuca

SEQ ID NO: 2000739 - RNA, 19 nt, Homo sapiens
ucccaggggacaugaguaa

SEQ ID NO: 2000740 - RNA, 10 nt, Homo sapiens
cugcauuuca

SEQ ID NO: 2000741 - RNA, 21 nt, Homo sapiens
cugguaacaguucauguuugc

SEQ ID NO: 2000742 - RNA, 13 nt, Homo sapiens
uuuucugcuguaa

SEQ ID NO: 2000743 - RNA, 17 nt, Homo sapiens
auuugcuugcaaucuaa

SEQ ID NO: 2000744 - RNA, 18 nt, Homo sapiens
ccugggaggaaauuugaa

SEQ ID NO: 2000745 - RNA, 15 nt, Homo sapiens
ugguuugugugauca

SEQ ID NO: 2000746 - RNA, 13 nt, Homo sapiens
ugugcauaaugcu

SEQ ID NO: 2000747 - RNA, 13 nt, Homo sapiens
acuaacauuguga

SEQ ID NO: 2000748 - RNA, 22 nt, Homo sapiens
cuccuagacucacuuguucuca

SEQ ID NO: 2000749 - RNA, 22 nt, Homo sapiens
agccugcacuuugaugucaugu

SEQ ID NO: 2000750 - RNA, 20 nt, Homo sapiens
ccugcuaauaauuugccauu

SEQ ID NO: 2000751 - RNA, 18 nt, Homo sapiens
ugccauucccacuaagcu

SEQ ID NO: 2000752 - RNA, 20 nt, Homo sapiens
agauaacuuaaauaauuuaa

SEQ ID NO: 2000753 - RNA, 18 nt, Homo sapiens
uuauucaaaaugauguau

SEQ ID NO: 2000754 - RNA, 20 nt, Homo sapiens
gcuccacccuggccgagucc

SEQ ID NO: 2000755 - RNA, 21 nt, Homo sapiens
ccuucugguuacaauuuacag

SEQ ID NO: 2000756 - RNA, 18 nt, Homo sapiens
uggcucagagggggacug

SEQ ID NO: 2000757 - RNA, 22 nt, Homo sapiens
caccaauuuggaaggcauugaa

SEQ ID NO: 2000758 - RNA, 14 nt, Homo sapiens
gugcaguggcucaa

SEQ ID NO: 2000759 - RNA, 23 nt, Homo sapiens
agucucaggacagaaccacugag

SEQ ID NO: 2000760 - RNA, 18 nt, Homo sapiens
cauuugccaauuuccaug

SEQ ID NO: 2000761 - RNA, 15 nt, Homo sapiens
acacauuugcccaau

SEQ ID NO: 2000762 - RNA, 13 nt, Homo sapiens
ugcucaaagggaa

SEQ ID NO: 2000763 - RNA, 17 nt, Homo sapiens
aaaaacagagguggaua

SEQ ID NO: 2000764 - RNA, 23 nt, Homo sapiens
uuuauaaagucuaagcaagaugu

SEQ ID NO: 2000765 - RNA, 21 nt, Homo sapiens
auguugaagggaaguucagca

SEQ ID NO: 2000766 - RNA, 21 nt, Homo sapiens
augaucaucugaaucccgggc

SEQ ID NO: 2000767 - RNA, 14 nt, Homo sapiens
cauggaggccagug

SEQ ID NO: 2000768 - RNA, 19 nt, Homo sapiens
augucgaugcacaguaucu

SEQ ID NO: 2000769 - RNA, 19 nt, Homo sapiens
ucagcaauacagacuacuu

SEQ ID NO: 2000770 - RNA, 11 nt, Homo sapiens
aucagccagga

SEQ ID NO: 2000771 - RNA, 18 nt, Homo sapiens
ucuuauuuugcauuccag

SEQ ID NO: 2000772 - RNA, 22 nt, Homo sapiens
ccacugccuucgcuucuugccu

SEQ ID NO: 2000773 - RNA, 18 nt, Homo sapiens
uugaugaguuaacuguga

SEQ ID NO: 2000774 - RNA, 21 nt, Homo sapiens
cuuaaaaauauauuuccucau

SEQ ID NO: 2000775 - RNA, 17 nt, Homo sapiens
aaagugcagcccuuccu

SEQ ID NO: 2000776 - RNA, 24 nt, Homo sapiens
ccucuuauuguuccucuuacgcuc

SEQ ID NO: 2000777 - RNA, 18 nt, Homo sapiens
uauuuuuuacaauggcca

SEQ ID NO: 2000778 - RNA, 16 nt, Homo sapiens
accuuaguauacugcc

SEQ ID NO: 2000779 - RNA, 15 nt, Homo sapiens
cccagggcagcuuug

SEQ ID NO: 2000780 - RNA, 14 nt, Homo sapiens
caaucucaucccaa

SEQ ID NO: 2000781 - RNA, 19 nt, Homo sapiens
caccugcugcgcuugguag

SEQ ID NO: 2000782 - RNA, 22 nt, Homo sapiens
accaaggcgggcggaucacuua

SEQ ID NO: 2000783 - RNA, 22 nt, Homo sapiens
uaaaacuuuaaucccacuugcc

SEQ ID NO: 2000784 - RNA, 15 nt, Homo sapiens
aacuaaaauguucua

SEQ ID NO: 2000785 - RNA, 15 nt, Homo sapiens
gugccugcccaggga

SEQ ID NO: 2000786 - RNA, 21 nt, Homo sapiens
cucccaguccauuuccaaaug

SEQ ID NO: 2000787 - RNA, 16 nt, Homo sapiens
uucagccucucccacc

SEQ ID NO: 2000788 - RNA, 20 nt, Homo sapiens
ugcaauaauacaacuaucau

SEQ ID NO: 2000789 - RNA, 20 nt, Homo sapiens
aucuauuaaaauugccauuu

SEQ ID NO: 2000790 - RNA, 20 nt, Homo sapiens
aaccaauacuccacugcuca

SEQ ID NO: 2000791 - RNA, 13 nt, Homo sapiens
ucauucauuucau

SEQ ID NO: 2000792 - RNA, 21 nt, Homo sapiens
uuauaaauuuuauaacagaau

SEQ ID NO: 2000793 - RNA, 15 nt, Homo sapiens
aacaaaacaacauuu

SEQ ID NO: 2000794 - RNA, 14 nt, Homo sapiens
ugggaauugcacag

SEQ ID NO: 2000795 - RNA, 15 nt, Homo sapiens
aagccccaacgggaa

SEQ ID NO: 2000796 - RNA, 18 nt, Homo sapiens
gaauccaugaagaauucc

SEQ ID NO: 2000797 - RNA, 16 nt, Homo sapiens
caagagccauguagaa

SEQ ID NO: 2000798 - RNA, 21 nt, Homo sapiens
auccuuuuuuccuuuccugau

SEQ ID NO: 2000799 - RNA, 21 nt, Homo sapiens
agcagcaccguucugugcaca

SEQ ID NO: 2000800 - RNA, 18 nt, Homo sapiens
ucccuauacuuaggcaua

SEQ ID NO: 2000801 - RNA, 15 nt, Homo sapiens
gaaaaucuauuccug

SEQ ID NO: 2000802 - RNA, 21 nt, Homo sapiens
gcaacagggccaugugcugcc

SEQ ID NO: 2000803 - RNA, 23 nt, Homo sapiens
acccaugaaggcuggaaggcagc

SEQ ID NO: 2000804 - RNA, 14 nt, Homo sapiens
uucuuguugcugca

SEQ ID NO: 2000805 - RNA, 21 nt, Homo sapiens
aauuauuauuuaaacaucagc

SEQ ID NO: 2000806 - RNA, 15 nt, Homo sapiens
gcuucuaccuggaaa

SEQ ID NO: 2000807 - RNA, 23 nt, Homo sapiens
ucccauccuggggcagcacuccc

SEQ ID NO: 2000808 - RNA, 18 nt, Homo sapiens
agggaaugggucugcaca

SEQ ID NO: 2000809 - RNA, 23 nt, Homo sapiens
cuccagggaauccaagccuccac

SEQ ID NO: 2000810 - RNA, 13 nt, Homo sapiens
ucggggugcuccu

SEQ ID NO: 2000811 - RNA, 15 nt, Homo sapiens
gaaauauaaugcaaa

SEQ ID NO: 2000812 - RNA, 20 nt, Homo sapiens
acaugcauguucuccucuau

SEQ ID NO: 2000813 - RNA, 20 nt, Homo sapiens
caccgccgugggguguauug

SEQ ID NO: 2000814 - RNA, 16 nt, Homo sapiens
acaggguccucagcuc

SEQ ID NO: 2000815 - RNA, 18 nt, Homo sapiens
gcuacaaaaaacugcagu

SEQ ID NO: 2000816 - RNA, 15 nt, Homo sapiens
ugggccagagcucaa

SEQ ID NO: 2000817 - RNA, 18 nt, Homo sapiens
aaucuguguaaacacagg

SEQ ID NO: 2000818 - RNA, 17 nt, Homo sapiens
cuguuuucguaccuucc

SEQ ID NO: 2000819 - RNA, 14 nt, Homo sapiens
ccccugccuuugaa

SEQ ID NO: 2000820 - RNA, 22 nt, Homo sapiens
auccagaaacuuguucuuccaa

SEQ ID NO: 2000821 - RNA, 18 nt, Homo sapiens
caggggccacacuaugcc

SEQ ID NO: 2000822 - RNA, 17 nt, Homo sapiens
gcaggcugagugcacug

SEQ ID NO: 2000823 - RNA, 22 nt, Homo sapiens
accaccaugcacuguaaauauc

SEQ ID NO: 2000824 - RNA, 13 nt, Homo sapiens
uuguugucucccu

SEQ ID NO: 2000825 - RNA, 21 nt, Homo sapiens
ucccacucuagggcaguggag

SEQ ID NO: 2000826 - RNA, 20 nt, Homo sapiens
aaagaccccucccacuccug

SEQ ID NO: 2000827 - RNA, 21 nt, Homo sapiens
auauguuuauguaacuaucaa

SEQ ID NO: 2000828 - RNA, 15 nt, Homo sapiens
uaguuuacaaacaag

SEQ ID NO: 2000829 - RNA, 16 nt, Homo sapiens
ucuuaucauauuucaa

SEQ ID NO: 2000830 - RNA, 15 nt, Homo sapiens
guuaccaccaugcuc

SEQ ID NO: 2000831 - RNA, 17 nt, Homo sapiens
auucauacauuaucuca

SEQ ID NO: 2000832 - RNA, 19 nt, Homo sapiens
uaagaguucuugcccuuca

SEQ ID NO: 2000833 - RNA, 22 nt, Homo sapiens
acccaccaaggucucacacucc

SEQ ID NO: 2000834 - RNA, 15 nt, Homo sapiens
ccagcaucaauucca

SEQ ID NO: 2000835 - RNA, 19 nt, Homo sapiens
ccuggauguguggggcaug

SEQ ID NO: 2000836 - RNA, 22 nt, Homo sapiens
guagcugugucauguauauacc

SEQ ID NO: 2000837 - RNA, 21 nt, Homo sapiens
uucccucuuggugugauugca

SEQ ID NO: 2000838 - RNA, 22 nt, Homo sapiens
ccagcaaaauggaagcaaagac

SEQ ID NO: 2000839 - RNA, 16 nt, Homo sapiens
ugaauauuccuggacu

SEQ ID NO: 2000840 - RNA, 18 nt, Homo sapiens
ccuccggcuggaccuggg

SEQ ID NO: 2000841 - RNA, 22 nt, Homo sapiens
auauuuccaagaaauauuccuu

SEQ ID NO: 2000842 - RNA, 21 nt, Homo sapiens
auuuugauggugucugugaca

SEQ ID NO: 2000843 - RNA, 15 nt, Homo sapiens
ggggacagaggcccu

SEQ ID NO: 2000844 - RNA, 19 nt, Homo sapiens
auugcugagauguuuagua

SEQ ID NO: 2000845 - RNA, 21 nt, Homo sapiens
uguuaugcaucauuucaggag

SEQ ID NO: 2000846 - RNA, 18 nt, Homo sapiens
caauccaggcuguucuca

SEQ ID NO: 2000847 - RNA, 19 nt, Homo sapiens
auaugugauuuacauuuca

SEQ ID NO: 2000848 - RNA, 11 nt, Homo sapiens
agggaauuuaa

SEQ ID NO: 2000849 - RNA, 14 nt, Homo sapiens
agauuauguauuaa

SEQ ID NO: 2000850 - RNA, 18 nt, Homo sapiens
uuuccacuuugacuacaa

SEQ ID NO: 2000851 - RNA, 18 nt, Homo sapiens
augcgaggaccacuuugg

SEQ ID NO: 2000852 - RNA, 16 nt, Homo sapiens
aagugguuuuuauuuc

SEQ ID NO: 2000853 - RNA, 14 nt, Homo sapiens
gugguagcucugag

SEQ ID NO: 2000854 - RNA, 18 nt, Homo sapiens
gcaguguuuucaccucau

SEQ ID NO: 2000855 - RNA, 18 nt, Homo sapiens
guugagccccaaguccug

SEQ ID NO: 2000856 - RNA, 24 nt, Homo sapiens
ccaaacaaaaauguuaagcaucua

SEQ ID NO: 2000857 - RNA, 16 nt, Homo sapiens
uaaaauuacagacaaa

SEQ ID NO: 2000858 - RNA, 14 nt, Homo sapiens
auuccacaccccug

SEQ ID NO: 2000859 - RNA, 14 nt, Homo sapiens
cuucugcaacccca

SEQ ID NO: 2000860 - RNA, 19 nt, Homo sapiens
cacacagaaugcaaccaag

SEQ ID NO: 2000861 - RNA, 19 nt, Homo sapiens
agcugugcgcaauugcuca

SEQ ID NO: 2000862 - RNA, 14 nt, Homo sapiens
aauauuuuuguaca

SEQ ID NO: 2000863 - RNA, 14 nt, Homo sapiens
cuacagcagaucca

SEQ ID NO: 2000864 - RNA, 19 nt, Homo sapiens
uucagcucacuuccuccag

SEQ ID NO: 2000865 - RNA, 13 nt, Homo sapiens
uggccuguagucc

SEQ ID NO: 2000866 - RNA, 22 nt, Homo sapiens
aaagaccuuuuccaugcacccu

SEQ ID NO: 2000867 - RNA, 19 nt, Homo sapiens
acccugucuaaaaaacaua

SEQ ID NO: 2000868 - RNA, 20 nt, Homo sapiens
aacugaaaauacuuaggaag

SEQ ID NO: 2000869 - RNA, 14 nt, Homo sapiens
cagccuuacaauac

SEQ ID NO: 2000870 - RNA, 15 nt, Homo sapiens
gaacuccagagucag

SEQ ID NO: 2000871 - RNA, 16 nt, Homo sapiens
uucuccuuuugaccaa

SEQ ID NO: 2000872 - RNA, 17 nt, Homo sapiens
cugagauugugccacug

SEQ ID NO: 2000873 - RNA, 17 nt, Homo sapiens
ccaagauugcaccacug

SEQ ID NO: 2000874 - RNA, 21 nt, Homo sapiens
ugaacuuuuuaagaugaggca

SEQ ID NO: 2000875 - RNA, 17 nt, Homo sapiens
agaaauagugcacucca

SEQ ID NO: 2000876 - RNA, 23 nt, Homo sapiens
aacccaggucuugacaccagcug

SEQ ID NO: 2000877 - RNA, 17 nt, Homo sapiens
ugugcuaauaacagugc

SEQ ID NO: 2000878 - RNA, 21 nt, Homo sapiens
gcagaggcguacuacccagcu

SEQ ID NO: 2000879 - RNA, 12 nt, Homo sapiens
aauuagcaauug

SEQ ID NO: 2000880 - RNA, 20 nt, Homo sapiens
ugacaagcugacuuggcacu

SEQ ID NO: 2000881 - RNA, 14 nt, Homo sapiens
gguugucaugugau

SEQ ID NO: 2000882 - RNA, 13 nt, Homo sapiens
cauuucccaaaau

SEQ ID NO: 2000883 - RNA, 23 nt, Homo sapiens
gagugcggcguggagacuggcag

SEQ ID NO: 2000884 - RNA, 19 nt, Homo sapiens
aggauggcuugaggccaga

SEQ ID NO: 2000885 - RNA, 14 nt, Homo sapiens
ccugucugugcaga

SEQ ID NO: 2000886 - RNA, 14 nt, Homo sapiens
gaagaaggacauuu

SEQ ID NO: 2000887 - RNA, 22 nt, Homo sapiens
gcuucucuucuuuauugcacua

SEQ ID NO: 2000888 - RNA, 15 nt, Homo sapiens
guccccccugugguc

SEQ ID NO: 2000889 - RNA, 11 nt, Homo sapiens
cagcaguccaa

SEQ ID NO: 2000890 - RNA, 13 nt, Homo sapiens
cgcacgcacacac

SEQ ID NO: 2000891 - RNA, 13 nt, Homo sapiens
uaaaagcaugaaa

SEQ ID NO: 2000892 - RNA, 13 nt, Homo sapiens
agaaggcaaaaag

SEQ ID NO: 2000893 - RNA, 13 nt, Homo sapiens
agccagcaaacca

SEQ ID NO: 2000894 - RNA, 22 nt, Homo sapiens
ugccucagccaggcccugagau

SEQ ID NO: 2000895 - RNA, 14 nt, Homo sapiens
aacauguaauccau

SEQ ID NO: 2000896 - RNA, 13 nt, Homo sapiens
uccaggagcugca

SEQ ID NO: 2000897 - RNA, 14 nt, Homo sapiens
uauguacaugagaa

SEQ ID NO: 2000898 - RNA, 14 nt, Homo sapiens
ugaauucauauaau

SEQ ID NO: 2000899 - RNA, 23 nt, Homo sapiens
uggaggcggaauugcucucccag

SEQ ID NO: 2000900 - RNA, 15 nt, Homo sapiens
augauacagagggau

SEQ ID NO: 2000901 - RNA, 13 nt, Homo sapiens
gcugaucaaugaa

SEQ ID NO: 2000902 - RNA, 14 nt, Homo sapiens
uucccuaaguccaa

SEQ ID NO: 2000903 - RNA, 18 nt, Homo sapiens
uaauuaaaagcaaaucau

SEQ ID NO: 2000904 - RNA, 18 nt, Homo sapiens
aacuuguauuaaagacag

SEQ ID NO: 2000905 - RNA, 15 nt, Homo sapiens
auaaaauaaugacau

SEQ ID NO: 2000906 - RNA, 14 nt, Homo sapiens
auccucacagugaa

SEQ ID NO: 2000907 - RNA, 17 nt, Homo sapiens
gcaccccaaagcuuucc

SEQ ID NO: 2000908 - RNA, 21 nt, Homo sapiens
ugacacauagaaaacaaucaa

SEQ ID NO: 2000909 - RNA, 23 nt, Homo sapiens
aaaaugauacuguguucccucau

SEQ ID NO: 2000910 - RNA, 20 nt, Homo sapiens
aaugguuugugucaaaacug

SEQ ID NO: 2000911 - RNA, 16 nt, Homo sapiens
cgcaggccagcaacuc

SEQ ID NO: 2000912 - RNA, 12 nt, Homo sapiens
aaagaaaagaga

SEQ ID NO: 2000913 - RNA, 23 nt, Homo sapiens
acguuuucaucucuagggaccag

SEQ ID NO: 2000914 - RNA, 21 nt, Homo sapiens
acucaccagccccacugccag

SEQ ID NO: 2000915 - RNA, 15 nt, Homo sapiens
caaguuccagugcag

SEQ ID NO: 2000916 - RNA, 22 nt, Homo sapiens
gucacgcuuucaugaauucugu

SEQ ID NO: 2000917 - RNA, 13 nt, Homo sapiens
ugaguaaaaucua

SEQ ID NO: 2000918 - RNA, 23 nt, Homo sapiens
uggaaguugcauggcaucaccuc

SEQ ID NO: 2000919 - RNA, 20 nt, Homo sapiens
uucugaaaaccuaccagcca

SEQ ID NO: 2000920 - RNA, 19 nt, Homo sapiens
uaaagcuuucaacauguac

SEQ ID NO: 2000921 - RNA, 14 nt, Homo sapiens
accacccucaggug

SEQ ID NO: 2000922 - RNA, 17 nt, Homo sapiens
gccuaaagcccauugcu

SEQ ID NO: 2000923 - RNA, 19 nt, Homo sapiens
agugauuuuuauccaaucu

SEQ ID NO: 2000924 - RNA, 22 nt, Homo sapiens
uucugggaugcaauacuaggaa

SEQ ID NO: 2000925 - RNA, 19 nt, Homo sapiens
ugaaaacccucugaacuca

SEQ ID NO: 2000926 - RNA, 16 nt, Homo sapiens
gcagagcaacugagga

SEQ ID NO: 2000927 - RNA, 12 nt, Homo sapiens
accuuccucauc

SEQ ID NO: 2000928 - RNA, 21 nt, Homo sapiens
ugcugaaugggacccuguuga

SEQ ID NO: 2000929 - RNA, 14 nt, Homo sapiens
aaaaccuauuccac

SEQ ID NO: 2000930 - RNA, 12 nt, Homo sapiens
ugaccccagugu

SEQ ID NO: 2000931 - RNA, 18 nt, Homo sapiens
ugaggccuagacucuguc

SEQ ID NO: 2000932 - RNA, 14 nt, Homo sapiens
aaaguugcugugaa

SEQ ID NO: 2000933 - RNA, 15 nt, Homo sapiens
guguuuauugucaaa

SEQ ID NO: 2000934 - RNA, 23 nt, Homo sapiens
caauagucucucugcaagacaga

SEQ ID NO: 2000935 - RNA, 14 nt, Homo sapiens
uggacagcugcuug

SEQ ID NO: 2000936 - RNA, 14 nt, Homo sapiens
gcaccagugugaca

SEQ ID NO: 2000937 - RNA, 14 nt, Homo sapiens
ucccaaagugccuu

SEQ ID NO: 2000938 - RNA, 15 nt, Homo sapiens
cugggguggggauca

SEQ ID NO: 2000939 - RNA, 17 nt, Homo sapiens
gggcgagucacugccuc

SEQ ID NO: 2000940 - RNA, 16 nt, Homo sapiens
aguauaaaacaccuaa

SEQ ID NO: 2000941 - RNA, 23 nt, Homo sapiens
gcagcccaugcccaccugcccau

SEQ ID NO: 2000942 - RNA, 22 nt, Homo sapiens
ccaccuguagucccagcacuuu

SEQ ID NO: 2000943 - RNA, 18 nt, Homo sapiens
aaacacgaaacuuguuau

SEQ ID NO: 2000944 - RNA, 23 nt, Homo sapiens
acacuaguucagaggaagcacau

SEQ ID NO: 2000945 - RNA, 15 nt, Homo sapiens
cagauaaacaacaaa

SEQ ID NO: 2000946 - RNA, 15 nt, Homo sapiens
auaauaaaaugcaaa

SEQ ID NO: 2000947 - RNA, 13 nt, Homo sapiens
auuucaagauuuu

SEQ ID NO: 2000948 - RNA, 16 nt, Homo sapiens
uugaucaaauauuuca

SEQ ID NO: 2000949 - RNA, 22 nt, Homo sapiens
guaacaggcuugaaucaaagaa

SEQ ID NO: 2000950 - RNA, 17 nt, Homo sapiens
cccaugcacugugaagg

SEQ ID NO: 2000951 - RNA, 16 nt, Homo sapiens
cgguguguaacacugu

SEQ ID NO: 2000952 - RNA, 16 nt, Homo sapiens
ugaccuuccaaagacu

SEQ ID NO: 2000953 - RNA, 12 nt, Homo sapiens
ucacacaaggaa

SEQ ID NO: 2000954 - RNA, 18 nt, Homo sapiens
cgacuuucugccuggagu

SEQ ID NO: 2000955 - RNA, 23 nt, Homo sapiens
aaccagccgaccggcccugcccc

SEQ ID NO: 2000956 - RNA, 16 nt, Homo sapiens
aggaauuaaugugauu

SEQ ID NO: 2000957 - RNA, 18 nt, Homo sapiens
agggugggaccaaugucc

SEQ ID NO: 2000958 - RNA, 20 nt, Homo sapiens
ucaaaacgacucuaaacaca

SEQ ID NO: 2000959 - RNA, 17 nt, Homo sapiens
uucuuauuuuuguacuu

SEQ ID NO: 2000960 - RNA, 17 nt, Homo sapiens
ggaguccaggcugcuag

SEQ ID NO: 2000961 - RNA, 14 nt, Homo sapiens
ggugagcaucaucu

SEQ ID NO: 2000962 - RNA, 18 nt, Homo sapiens
ucucuacugaaaguacaa

SEQ ID NO: 2000963 - RNA, 14 nt, Homo sapiens
ccuaugucauuuca

SEQ ID NO: 2000964 - RNA, 23 nt, Homo sapiens
ggaaugggcacagcacagccagg

SEQ ID NO: 2000965 - RNA, 16 nt, Homo sapiens
uccuaagcucaucuau

SEQ ID NO: 2000966 - RNA, 13 nt, Homo sapiens
guuagcugucaca

SEQ ID NO: 2000967 - RNA, 20 nt, Homo sapiens
agccuaaccccauuccugug

SEQ ID NO: 2000968 - RNA, 14 nt, Homo sapiens
guagcacacugagu

SEQ ID NO: 2000969 - RNA, 18 nt, Homo sapiens
gaucaguggugucuguga

SEQ ID NO: 2000970 - RNA, 14 nt, Homo sapiens
aauaagacaacaga

SEQ ID NO: 2000971 - RNA, 17 nt, Homo sapiens
uucagugagaaucugcu

SEQ ID NO: 2000972 - RNA, 15 nt, Homo sapiens
ugguuccuaagccug

SEQ ID NO: 2000973 - RNA, 21 nt, Homo sapiens
agaagucacucacuauugcaa

SEQ ID NO: 2000974 - RNA, 13 nt, Homo sapiens
ugcuauguucugg

SEQ ID NO: 2000975 - RNA, 22 nt, Homo sapiens
cuuucucugccagugacagaca

SEQ ID NO: 2000976 - RNA, 15 nt, Homo sapiens
agcccccuguccuuc

SEQ ID NO: 2000977 - RNA, 21 nt, Homo sapiens
uguacaccagagccucaguga

SEQ ID NO: 2000978 - RNA, 12 nt, Homo sapiens
agaaacaugaca

SEQ ID NO: 2000979 - RNA, 18 nt, Homo sapiens
ccacagagaauaagcuga

SEQ ID NO: 2000980 - RNA, 12 nt, Homo sapiens
aagggccauuua

SEQ ID NO: 2000981 - RNA, 13 nt, Homo sapiens
auacacauauagu

SEQ ID NO: 2000982 - RNA, 17 nt, Homo sapiens
acucaagugccauucau

SEQ ID NO: 2000983 - RNA, 19 nt, Homo sapiens
augugcgugcauguguaua

SEQ ID NO: 2000984 - RNA, 19 nt, Homo sapiens
cagacccugccacucucac

SEQ ID NO: 2000985 - RNA, 20 nt, Homo sapiens
cuguggaugaugguugcaaa

SEQ ID NO: 2000986 - RNA, 10 nt, Homo sapiens
gcucaugccc

SEQ ID NO: 2000987 - RNA, 14 nt, Homo sapiens
uggaaagcugauga

SEQ ID NO: 2000988 - RNA, 21 nt, Homo sapiens
acccgagaaaacaaacccagg

SEQ ID NO: 2000989 - RNA, 18 nt, Homo sapiens
aggaacaaauaaacucau

SEQ ID NO: 2000990 - RNA, 14 nt, Homo sapiens
acaaaaaauuagcu

SEQ ID NO: 2000991 - RNA, 14 nt, Homo sapiens
gcccaaaccuggga

SEQ ID NO: 2000992 - RNA, 23 nt, Homo sapiens
guggaaaguguucauugcacaau

SEQ ID NO: 2000993 - RNA, 13 nt, Homo sapiens
ggaggaggugucu

SEQ ID NO: 2000994 - RNA, 13 nt, Homo sapiens
gaugacuauucag

SEQ ID NO: 2000995 - RNA, 21 nt, Homo sapiens
ucagcauguuuccagcacuau

SEQ ID NO: 2000996 - RNA, 14 nt, Homo sapiens
auagaauucaguca

SEQ ID NO: 2000997 - RNA, 14 nt, Homo sapiens
cugcucugcuauau

SEQ ID NO: 2000998 - RNA, 12 nt, Homo sapiens
auaaaucacuug

SEQ ID NO: 2000999 - RNA, 16 nt, Homo sapiens
cugagaaaacuaaguc

SEQ ID NO: 2001000 - RNA, 17 nt, Homo sapiens
acacugagauauucagc

SEQ ID NO: 2001001 - RNA, 21 nt, Homo sapiens
cuguccugccucucugcucca

SEQ ID NO: 2001002 - RNA, 20 nt, Homo sapiens
gugaagauuggggacacuca

SEQ ID NO: 2001003 - RNA, 21 nt, Homo sapiens
auuaugcuugagaugucuuaa

SEQ ID NO: 2001004 - RNA, 19 nt, Homo sapiens
gauccaccgccacacuggc

SEQ ID NO: 2001005 - RNA, 13 nt, Homo sapiens
ggaagucaucuca

SEQ ID NO: 2001006 - RNA, 21 nt, Homo sapiens
acaaugucuuguuucagucca

SEQ ID NO: 2001007 - RNA, 15 nt, Homo sapiens
uccaaaugagccaua

SEQ ID NO: 2001008 - RNA, 13 nt, Homo sapiens
gacauggaccucc

SEQ ID NO: 2001009 - RNA, 15 nt, Homo sapiens
ucuggaagacaugau

SEQ ID NO: 2001010 - RNA, 15 nt, Homo sapiens
gauguagucaguuag

SEQ ID NO: 2001011 - RNA, 17 nt, Homo sapiens
caacagcugugugugcc

SEQ ID NO: 2001012 - RNA, 21 nt, Homo sapiens
gaauauaaagccucaaaucuu

SEQ ID NO: 2001013 - RNA, 14 nt, Homo sapiens
gacauuuaagacag

SEQ ID NO: 2001014 - RNA, 18 nt, Homo sapiens
gaccaaagccaccaagac

SEQ ID NO: 2001015 - RNA, 20 nt, Homo sapiens
ggggacagaaaugccacuca

SEQ ID NO: 2001016 - RNA, 22 nt, Homo sapiens
uagacaguacucuuaacuccua

SEQ ID NO: 2001017 - RNA, 14 nt, Homo sapiens
ugggggaguggaau

SEQ ID NO: 2001018 - RNA, 23 nt, Homo sapiens
aaaaacagagccuccuagaugua

SEQ ID NO: 2001019 - RNA, 15 nt, Homo sapiens
caugccauugcacuc

SEQ ID NO: 2001020 - RNA, 13 nt, Homo sapiens
aauauaggggcaa

SEQ ID NO: 2001021 - RNA, 16 nt, Homo sapiens
cguuuuuggacacugu

SEQ ID NO: 2001022 - RNA, 20 nt, Homo sapiens
agcccagaaaaccuccagua

SEQ ID NO: 2001023 - RNA, 13 nt, Homo sapiens
cuggagugcaaug

SEQ ID NO: 2001024 - RNA, 13 nt, Homo sapiens
cuagagugcagug

SEQ ID NO: 2001025 - RNA, 18 nt, Homo sapiens
gccaauggagacugucuc

SEQ ID NO: 2001026 - RNA, 23 nt, Homo sapiens
ugaugaggccucuuggaccucug

SEQ ID NO: 2001027 - RNA, 17 nt, Homo sapiens
gggcugaagccacacag

SEQ ID NO: 2001028 - RNA, 19 nt, Homo sapiens
acaucaaagccuggccuaa

SEQ ID NO: 2001029 - RNA, 23 nt, Homo sapiens
ggcuccugaagggugcucagucu

SEQ ID NO: 2001030 - RNA, 19 nt, Homo sapiens
cgccccggacaguggcacc

SEQ ID NO: 2001031 - RNA, 16 nt, Homo sapiens
cacccacaccauaagc

SEQ ID NO: 2001032 - RNA, 23 nt, Homo sapiens
gaaaaauauggccuugauggugu

SEQ ID NO: 2001033 - RNA, 18 nt, Homo sapiens
ucauguuuaauuugcauc

SEQ ID NO: 2001034 - RNA, 20 nt, Homo sapiens
ucuaauuaauuguaaucuga

SEQ ID NO: 2001035 - RNA, 23 nt, Homo sapiens
uccccaggucucuccacugcucu

SEQ ID NO: 2001036 - RNA, 15 nt, Homo sapiens
gcuugaaguaaccuu

SEQ ID NO: 2001037 - RNA, 16 nt, Homo sapiens
uguuuggaaaagacag

SEQ ID NO: 2001038 - RNA, 11 nt, Homo sapiens
cucuuccucac

SEQ ID NO: 2001039 - RNA, 11 nt, Homo sapiens
gaauuccugua

SEQ ID NO: 2001040 - RNA, 18 nt, Homo sapiens
cuacuaauccucucugca

SEQ ID NO: 2001041 - RNA, 21 nt, Homo sapiens
uuacaggcaugggccaccacg

SEQ ID NO: 2001042 - RNA, 19 nt, Homo sapiens
ucauucgugguugauuuca

SEQ ID NO: 2001043 - RNA, 19 nt, Homo sapiens
uguucgguugcgugcaugu

SEQ ID NO: 2001044 - RNA, 11 nt, Homo sapiens
uuacucagagc

SEQ ID NO: 2001045 - RNA, 19 nt, Homo sapiens
cuguuauuuuaucugcuau

SEQ ID NO: 2001046 - RNA, 16 nt, Homo sapiens
gcaucucccugcaguu

SEQ ID NO: 2001047 - RNA, 16 nt, Homo sapiens
aauuaugucaaaugga

SEQ ID NO: 2001048 - RNA, 19 nt, Homo sapiens
aucccuuucucucuugucc

SEQ ID NO: 2001049 - RNA, 23 nt, Homo sapiens
uaaguaaccucuacaggcauuua

SEQ ID NO: 2001050 - RNA, 21 nt, Homo sapiens
aaugcauuauaggaucauuug

SEQ ID NO: 2001051 - RNA, 19 nt, Homo sapiens
acuccucuccuucaaagaa

SEQ ID NO: 2001052 - RNA, 17 nt, Homo sapiens
ucuuuguccauuauuca

SEQ ID NO: 2001053 - RNA, 22 nt, Homo sapiens
agagcuucuguugcugccucau

SEQ ID NO: 2001054 - RNA, 22 nt, Homo sapiens
uggcuccaggccaaagugccgg

SEQ ID NO: 2001055 - RNA, 19 nt, Homo sapiens
acucagggccccagcacua

SEQ ID NO: 2001056 - RNA, 19 nt, Homo sapiens
auucuuuguauuaccaaag

SEQ ID NO: 2001057 - RNA, 14 nt, Homo sapiens
uauuugugggguac

SEQ ID NO: 2001058 - RNA, 19 nt, Homo sapiens
ugcccccuccaguccccca

SEQ ID NO: 2001059 - RNA, 14 nt, Homo sapiens
ccuuucuggcuuug

SEQ ID NO: 2001060 - RNA, 15 nt, Homo sapiens
agaucauuuugaaau

SEQ ID NO: 2001061 - RNA, 20 nt, Homo sapiens
ucaagcauggaacaaagcau

SEQ ID NO: 2001062 - RNA, 20 nt, Homo sapiens
cacacagggugcaugugagg

SEQ ID NO: 2001063 - RNA, 16 nt, Homo sapiens
caggacagaaagaucu

SEQ ID NO: 2001064 - RNA, 23 nt, Homo sapiens
aaaguauuaauucucuuuccauc

SEQ ID NO: 2001065 - RNA, 20 nt, Homo sapiens
aggaacguugccacaccaau

SEQ ID NO: 2001066 - RNA, 22 nt, Homo sapiens
ccuggaagacaacccaggcagu

SEQ ID NO: 2001067 - RNA, 18 nt, Homo sapiens
uguuuccuaggaggaaaa

SEQ ID NO: 2001068 - RNA, 15 nt, Homo sapiens
ucugucauuuacaca

SEQ ID NO: 2001069 - RNA, 22 nt, Homo sapiens
auacuggguucuuaguugacaa

SEQ ID NO: 2001070 - RNA, 22 nt, Homo sapiens
gacaaugcugagguuaugaaca

SEQ ID NO: 2001071 - RNA, 21 nt, Homo sapiens
gccucaaggguagaaaccugc

SEQ ID NO: 2001072 - RNA, 18 nt, Homo sapiens
gaagcaauugaaaaggaa

SEQ ID NO: 2001073 - RNA, 21 nt, Homo sapiens
aaggacugagggcagugcccu

SEQ ID NO: 2001074 - RNA, 20 nt, Homo sapiens
agguauuucuccaguuggga

SEQ ID NO: 2001075 - RNA, 23 nt, Homo sapiens
auguugcccacauuaagcacugu

SEQ ID NO: 2001076 - RNA, 20 nt, Homo sapiens
aauaaacuagauuacauuca

SEQ ID NO: 2001077 - RNA, 21 nt, Homo sapiens
cugaccacgugcuacccccau

SEQ ID NO: 2001078 - RNA, 19 nt, Homo sapiens
uuaagcauuuucuacacag

SEQ ID NO: 2001079 - RNA, 20 nt, Homo sapiens
uaugacaauguugcauuuau

SEQ ID NO: 2001080 - RNA, 15 nt, Homo sapiens
aucaguaaacacugu

SEQ ID NO: 2001081 - RNA, 15 nt, Homo sapiens
guggaaaaugcaaug

SEQ ID NO: 2001082 - RNA, 17 nt, Homo sapiens
ccugauauaacacuuuc

SEQ ID NO: 2001083 - RNA, 22 nt, Homo sapiens
ucccaugggcuaggagccagug

SEQ ID NO: 2001084 - RNA, 15 nt, Homo sapiens
ucugggagaaaauca

SEQ ID NO: 2001085 - RNA, 20 nt, Homo sapiens
gggucuugcuauauugccca

SEQ ID NO: 2001086 - RNA, 13 nt, Homo sapiens
acacacagcacuc

SEQ ID NO: 2001087 - RNA, 14 nt, Homo sapiens
caccaccaugccag

SEQ ID NO: 2001088 - RNA, 20 nt, Homo sapiens
gaaucuucagcauguucuca

SEQ ID NO: 2001089 - RNA, 22 nt, Homo sapiens
guuuucagcugcucagaauuca

SEQ ID NO: 2001090 - RNA, 19 nt, Homo sapiens
uaaucccagcuacucagga

SEQ ID NO: 2001091 - RNA, 20 nt, Homo sapiens
ccaaagggggacagugauuu

SEQ ID NO: 2001092 - RNA, 15 nt, Homo sapiens
gguauagacaauaaa

SEQ ID NO: 2001093 - RNA, 15 nt, Homo sapiens
aguuucaucagucaa

SEQ ID NO: 2001094 - RNA, 14 nt, Homo sapiens
gaaagcauugccag

SEQ ID NO: 2001095 - RNA, 23 nt, Homo sapiens
uccuuucccugggguacuacucu

SEQ ID NO: 2001096 - RNA, 15 nt, Homo sapiens
cuaaucccagcacuu

SEQ ID NO: 2001097 - RNA, 21 nt, Homo sapiens
cgcaaggaucacuugagccca

SEQ ID NO: 2001098 - RNA, 22 nt, Homo sapiens
gggcccucuuucccugcgagac

SEQ ID NO: 2001099 - RNA, 14 nt, Homo sapiens
aaauauaucugcua

SEQ ID NO: 2001100 - RNA, 22 nt, Homo sapiens
uuuccagcuccuaguagcuuuc

SEQ ID NO: 2001101 - RNA, 15 nt, Homo sapiens
guaacccaaaccuca

SEQ ID NO: 2001102 - RNA, 21 nt, Homo sapiens
gauuucuuccagaaggcaaaa

SEQ ID NO: 2001103 - RNA, 16 nt, Homo sapiens
gauguguccucaggga

SEQ ID NO: 2001104 - RNA, 22 nt, Homo sapiens
gccugugcgugccauccagagu

SEQ ID NO: 2001105 - RNA, 20 nt, Homo sapiens
agcucuaucccaaccucucc

SEQ ID NO: 2001106 - RNA, 16 nt, Homo sapiens
aauaaguugacuuuca

SEQ ID NO: 2001107 - RNA, 17 nt, Homo sapiens
gaaagcagucuguucug

SEQ ID NO: 2001108 - RNA, 18 nt, Homo sapiens
cuccugauggagugugca

SEQ ID NO: 2001109 - RNA, 20 nt, Homo sapiens
uuaucaaugaaaauuucacu

SEQ ID NO: 2001110 - RNA, 23 nt, Homo sapiens
auauuuuaagaauuucacaagcu

SEQ ID NO: 2001111 - RNA, 23 nt, Homo sapiens
uccaaaauagucauguuucugca

SEQ ID NO: 2001112 - RNA, 16 nt, Homo sapiens
ccuugugcguggguga

SEQ ID NO: 2001113 - RNA, 13 nt, Homo sapiens
gauccacauuguu

SEQ ID NO: 2001114 - RNA, 16 nt, Homo sapiens
gucaggagggugcagu

SEQ ID NO: 2001115 - RNA, 15 nt, Homo sapiens
gaaaguguaaugugc

SEQ ID NO: 2001116 - RNA, 23 nt, Homo sapiens
uccauaaaugacacuacuugaua

SEQ ID NO: 2001117 - RNA, 23 nt, Homo sapiens
ucuggcuguguugucagcacugu

SEQ ID NO: 2001118 - RNA, 20 nt, Homo sapiens
auuagacaugaaaucugagg

SEQ ID NO: 2001119 - RNA, 21 nt, Homo sapiens
auaauuaaaaaaaaaacuuca

SEQ ID NO: 2001120 - RNA, 23 nt, Homo sapiens
cagagcggaaggagggagcucug

SEQ ID NO: 2001121 - RNA, 19 nt, Homo sapiens
agcugcacugaucacccaa

SEQ ID NO: 2001122 - RNA, 17 nt, Homo sapiens
ucaagaaaaaaagggag

SEQ ID NO: 2001123 - RNA, 14 nt, Homo sapiens
uccaguaucuucac

SEQ ID NO: 2001124 - RNA, 23 nt, Homo sapiens
cacaaucccuggggcugugcauu

SEQ ID NO: 2001125 - RNA, 20 nt, Homo sapiens
ugaaauaaaauuacacagua

SEQ ID NO: 2001126 - RNA, 18 nt, Homo sapiens
gggcacugaggaccagcc

SEQ ID NO: 2001127 - RNA, 17 nt, Homo sapiens
gcagccagcaucugggc

SEQ ID NO: 2001128 - RNA, 18 nt, Homo sapiens
aauuugcaaaguacugua

SEQ ID NO: 2001129 - RNA, 15 nt, Homo sapiens
cggcucagugcaacc

SEQ ID NO: 2001130 - RNA, 20 nt, Homo sapiens
caaucuucucagaaggcaaa

SEQ ID NO: 2001131 - RNA, 17 nt, Homo sapiens
aauggauucucuauuca

SEQ ID NO: 2001132 - RNA, 18 nt, Homo sapiens
guauuuuuucacuuguac

SEQ ID NO: 2001133 - RNA, 20 nt, Homo sapiens
gucagaguuccgacugccau

SEQ ID NO: 2001134 - RNA, 16 nt, Homo sapiens
cuugcucucuguucuc

SEQ ID NO: 2001135 - RNA, 23 nt, Homo sapiens
agcuuuggcuuuuuccaucucaa

SEQ ID NO: 2001136 - RNA, 14 nt, Homo sapiens
cuaaguguaaaaaa

SEQ ID NO: 2001137 - RNA, 14 nt, Homo sapiens
aaucgugucuucaa

SEQ ID NO: 2001138 - RNA, 19 nt, Homo sapiens
ucugcaguccuacucaagc

SEQ ID NO: 2001139 - RNA, 23 nt, Homo sapiens
auuauuuuuuuaaagaaaacuug

SEQ ID NO: 2001140 - RNA, 22 nt, Homo sapiens
gggcacccccaaauucaaagaa

SEQ ID NO: 2001141 - RNA, 23 nt, Homo sapiens
auaaacaacauugagauuaugau

SEQ ID NO: 2001142 - RNA, 13 nt, Homo sapiens
aucuggacacugg

SEQ ID NO: 2001143 - RNA, 13 nt, Homo sapiens
ccugagaccucua

SEQ ID NO: 2001144 - RNA, 18 nt, Homo sapiens
cauucucaguauccacug

SEQ ID NO: 2001145 - RNA, 14 nt, Homo sapiens
ugcacuccagccug

SEQ ID NO: 2001146 - RNA, 17 nt, Homo sapiens
auucacaagacccaaaa

SEQ ID NO: 2001147 - RNA, 20 nt, Homo sapiens
cugcuucucccaggcaaggc

SEQ ID NO: 2001148 - RNA, 21 nt, Homo sapiens
uucagucucuauaccaauaaa

SEQ ID NO: 2001149 - RNA, 22 nt, Homo sapiens
aagaaaccccuguccccaguca

SEQ ID NO: 2001150 - RNA, 21 nt, Homo sapiens
gcuuuguguaucucauuuaau

SEQ ID NO: 2001151 - RNA, 20 nt, Homo sapiens
aaugugaaguucaucuugca

SEQ ID NO: 2001152 - RNA, 22 nt, Homo sapiens
agagugacauccaggaggaaua

SEQ ID NO: 2001153 - RNA, 22 nt, Homo sapiens
cucaguuguuugcuucuugcca

SEQ ID NO: 2001154 - RNA, 21 nt, Homo sapiens
uuaaagaaacaucuacaggau

SEQ ID NO: 2001155 - RNA, 14 nt, Homo sapiens
aggaggaugugcug

SEQ ID NO: 2001156 - RNA, 16 nt, Homo sapiens
gucaaacuuucaccuc

SEQ ID NO: 2001157 - RNA, 16 nt, Homo sapiens
auuuuaucauagccua

SEQ ID NO: 2001158 - RNA, 19 nt, Homo sapiens
uguuuacagaggacaguau

SEQ ID NO: 2001159 - RNA, 14 nt, Homo sapiens
gcauaucacuugau

SEQ ID NO: 2001160 - RNA, 18 nt, Homo sapiens
gccccuugagccaggugg

SEQ ID NO: 2001161 - RNA, 16 nt, Homo sapiens
agaaaaaagugcaacu

SEQ ID NO: 2001162 - RNA, 19 nt, Homo sapiens
aacgugcaacuacuauuca

SEQ ID NO: 2001163 - RNA, 15 nt, Homo sapiens
cucccaaaacagccu

SEQ ID NO: 2001164 - RNA, 19 nt, Homo sapiens
uuagugaaugacuuuucuc

SEQ ID NO: 2001165 - RNA, 13 nt, Homo sapiens
uguuaaugcauca

SEQ ID NO: 2001166 - RNA, 11 nt, Homo sapiens
gaaauaccuca

SEQ ID NO: 2001167 - RNA, 20 nt, Homo sapiens
agcacaggauuaggacugaa

SEQ ID NO: 2001168 - RNA, 14 nt, Homo sapiens
gcuuguuuguucua

SEQ ID NO: 2001169 - RNA, 16 nt, Homo sapiens
augaucuagccuccau

SEQ ID NO: 2001170 - RNA, 20 nt, Homo sapiens
cccuccuccagaccauucag

SEQ ID NO: 2001171 - RNA, 11 nt, Homo sapiens
augaaaacacc

SEQ ID NO: 2001172 - RNA, 17 nt, Homo sapiens
aaccaagauggcgacaa

SEQ ID NO: 2001173 - RNA, 15 nt, Homo sapiens
ugucugugugcaagu

SEQ ID NO: 2001174 - RNA, 17 nt, Homo sapiens
uccagcugccccgggga

SEQ ID NO: 2001175 - RNA, 16 nt, Homo sapiens
agcuggagugcugcuu

SEQ ID NO: 2001176 - RNA, 16 nt, Homo sapiens
ccuccucacuggccau

SEQ ID NO: 2001177 - RNA, 22 nt, Homo sapiens
ugucaccuacgugccacuccug

SEQ ID NO: 2001178 - RNA, 12 nt, Homo sapiens
acuccaugagaa

SEQ ID NO: 2001179 - RNA, 22 nt, Homo sapiens
ucauuaccgucugugauugcca

SEQ ID NO: 2001180 - RNA, 22 nt, Homo sapiens
ucuggaaaucagacuuuuacaa

SEQ ID NO: 2001181 - RNA, 15 nt, Homo sapiens
aagcagcgagugcau

SEQ ID NO: 2001182 - RNA, 18 nt, Homo sapiens
uucugaaacuucauaaau

SEQ ID NO: 2001183 - RNA, 18 nt, Homo sapiens
aauugaauuuacauauag

SEQ ID NO: 2001184 - RNA, 16 nt, Homo sapiens
auuguacacgcugaug

SEQ ID NO: 2001185 - RNA, 13 nt, Homo sapiens
gacuccaugccuc

SEQ ID NO: 2001186 - RNA, 15 nt, Homo sapiens
cuuacccgaaagcau

SEQ ID NO: 2001187 - RNA, 21 nt, Homo sapiens
uggccuggggaagcugugaaa

SEQ ID NO: 2001188 - RNA, 21 nt, Homo sapiens
gcuccuguggcugucuuguca

SEQ ID NO: 2001189 - RNA, 20 nt, Homo sapiens
cuaagcaacuaggccuucag

SEQ ID NO: 2001190 - RNA, 15 nt, Homo sapiens
cucacauuagaucua

SEQ ID NO: 2001191 - RNA, 21 nt, Homo sapiens
uugaagacagagcuacacagg

SEQ ID NO: 2001192 - RNA, 19 nt, Homo sapiens
ugauccuuccuacuuugcu

SEQ ID NO: 2001193 - RNA, 15 nt, Homo sapiens
acucccgccuuugac

SEQ ID NO: 2001194 - RNA, 12 nt, Homo sapiens
agcgacagugag

SEQ ID NO: 2001195 - RNA, 15 nt, Homo sapiens
acuaagauguauuaa

SEQ ID NO: 2001196 - RNA, 14 nt, Homo sapiens
aaaugucacuauau

SEQ ID NO: 2001197 - RNA, 13 nt, Homo sapiens
auuacaagcccug

SEQ ID NO: 2001198 - RNA, 16 nt, Homo sapiens
ugaguaaaaugaagga

SEQ ID NO: 2001199 - RNA, 16 nt, Homo sapiens
auucuauuccuaucug

SEQ ID NO: 2001200 - RNA, 19 nt, Homo sapiens
uuaagguaugguacaagca

SEQ ID NO: 2001201 - RNA, 16 nt, Homo sapiens
ugaugcaggugcaaau

SEQ ID NO: 2001202 - RNA, 20 nt, Homo sapiens
uggcuuuucaccccagagga

SEQ ID NO: 2001203 - RNA, 18 nt, Homo sapiens
agcagcucuugaaguaua

SEQ ID NO: 2001204 - RNA, 23 nt, Homo sapiens
gcccacugaggaaugaugaagcu

SEQ ID NO: 2001205 - RNA, 23 nt, Homo sapiens
cagcccauggagauugaccugga

SEQ ID NO: 2001206 - RNA, 23 nt, Homo sapiens
cugaagaucaagccaguucuccu

SEQ ID NO: 2001207 - RNA, 13 nt, Homo sapiens
aucugaauuggaa

SEQ ID NO: 2001208 - RNA, 13 nt, Homo sapiens
uuguuaaugcuuu

SEQ ID NO: 2001209 - RNA, 17 nt, Homo sapiens
acuuaacagauugccau

SEQ ID NO: 2001210 - RNA, 15 nt, Homo sapiens
cauccucaaagcccc

SEQ ID NO: 2001211 - RNA, 19 nt, Homo sapiens
ccuaaggccuuagggguca

SEQ ID NO: 2001212 - RNA, 19 nt, Homo sapiens
gugcaauggcgcgaucuca

SEQ ID NO: 2001213 - RNA, 20 nt, Homo sapiens
gaccucccuggcuugaguga

SEQ ID NO: 2001214 - RNA, 19 nt, Homo sapiens
ccuggagggcacuuccucc

SEQ ID NO: 2001215 - RNA, 15 nt, Homo sapiens
aggagauggccucau

SEQ ID NO: 2001216 - RNA, 15 nt, Homo sapiens
accugcuggggaccu

SEQ ID NO: 2001217 - RNA, 15 nt, Homo sapiens
aaaaauuagugagua

SEQ ID NO: 2001218 - RNA, 19 nt, Homo sapiens
aucuuaguucuguauauaa

SEQ ID NO: 2001219 - RNA, 14 nt, Homo sapiens
cauggguccagggc

SEQ ID NO: 2001220 - RNA, 22 nt, Homo sapiens
guuacucuaagguaaaaccauc

SEQ ID NO: 2001221 - RNA, 21 nt, Homo sapiens
uuaaguuguugauguuuuaac

SEQ ID NO: 2001222 - RNA, 23 nt, Homo sapiens
ccauaauuuuuauuauuaaucuc

SEQ ID NO: 2001223 - RNA, 14 nt, Homo sapiens
guauguguguauau

SEQ ID NO: 2001224 - RNA, 13 nt, Homo sapiens
uuaaguucacuuu

SEQ ID NO: 2001225 - RNA, 21 nt, Homo sapiens
caaguguguugggaauugcau

SEQ ID NO: 2001226 - RNA, 19 nt, Homo sapiens
agaucaugucucacuucac

SEQ ID NO: 2001227 - RNA, 22 nt, Homo sapiens
ggcgccaggggcgggggaccua

SEQ ID NO: 2001228 - RNA, 23 nt, Homo sapiens
auauaaauuaucugaauauuaga

SEQ ID NO: 2001229 - RNA, 13 nt, Homo sapiens
ugcuuugcaggaa

SEQ ID NO: 2001230 - RNA, 16 nt, Homo sapiens
gagcauucauaauuaa

SEQ ID NO: 2001231 - RNA, 14 nt, Homo sapiens
ucaaaaacauucuu

SEQ ID NO: 2001232 - RNA, 16 nt, Homo sapiens
ugauccuuccuacuuu

SEQ ID NO: 2001233 - RNA, 22 nt, Homo sapiens
uacuugcuuuggaaaacccaga

SEQ ID NO: 2001234 - RNA, 23 nt, Homo sapiens
aacaggaaugucuggagugguaa

SEQ ID NO: 2001235 - RNA, 17 nt, Homo sapiens
acaguggugagaucaca

SEQ ID NO: 2001236 - RNA, 22 nt, Homo sapiens
ugcccagcccuggcccaggugc

SEQ ID NO: 2001237 - RNA, 14 nt, Homo sapiens
gcaggaguagcuga

SEQ ID NO: 2001238 - RNA, 14 nt, Homo sapiens
ugggacugcuaaau

SEQ ID NO: 2001239 - RNA, 14 nt, Homo sapiens
uugcaucagugauc

SEQ ID NO: 2001240 - RNA, 15 nt, Homo sapiens
uuaccuuguggaugc

SEQ ID NO: 2001241 - RNA, 17 nt, Homo sapiens
cucucugucuucuugga

SEQ ID NO: 2001242 - RNA, 17 nt, Homo sapiens
uagucucuugauucaua

SEQ ID NO: 2001243 - RNA, 14 nt, Homo sapiens
gcauuuuucuggga

SEQ ID NO: 2001244 - RNA, 10 nt, Homo sapiens
aaaagcaagg

SEQ ID NO: 2001245 - RNA, 13 nt, Homo sapiens
aaauaguuugcaa

SEQ ID NO: 2001246 - RNA, 21 nt, Homo sapiens
uccaucacugccgucccaaau

SEQ ID NO: 2001247 - RNA, 18 nt, Homo sapiens
uaagugggcauuuugaca

SEQ ID NO: 2001248 - RNA, 14 nt, Homo sapiens
cucucaggccagcu

SEQ ID NO: 2001249 - RNA, 13 nt, Homo sapiens
acucuucacggaa

SEQ ID NO: 2001250 - RNA, 14 nt, Homo sapiens
uuggccucaagcaa

SEQ ID NO: 2001251 - RNA, 16 nt, Homo sapiens
cacaggugcacgccac

SEQ ID NO: 2001252 - RNA, 16 nt, Homo sapiens
cuggccaccugaggug

SEQ ID NO: 2001253 - RNA, 14 nt, Homo sapiens
agaagucacuguca

SEQ ID NO: 2001254 - RNA, 23 nt, Homo sapiens
guguacaaauacauguguauauu

SEQ ID NO: 2001255 - RNA, 16 nt, Homo sapiens
ucuugccaaccuguaa

SEQ ID NO: 2001256 - RNA, 19 nt, Homo sapiens
ucuuuuuccuucuacuccu

SEQ ID NO: 2001257 - RNA, 14 nt, Homo sapiens
uuauaauuuuacuc

SEQ ID NO: 2001258 - RNA, 14 nt, Homo sapiens
gagaucacuacuca

SEQ ID NO: 2001259 - RNA, 15 nt, Homo sapiens
gccauggcucauggg

SEQ ID NO: 2001260 - RNA, 17 nt, Homo sapiens
cuaugccuucacuacaa

SEQ ID NO: 2001261 - RNA, 21 nt, Homo sapiens
uugaggcagagucucauucug

SEQ ID NO: 2001262 - RNA, 19 nt, Homo sapiens
aaaugaugaagaccaaaga

SEQ ID NO: 2001263 - RNA, 22 nt, Homo sapiens
caguacccacucuggagcauuu

SEQ ID NO: 2001264 - RNA, 14 nt, Homo sapiens
cuggaagaagugag

SEQ ID NO: 2001265 - RNA, 15 nt, Homo sapiens
cugcugggaccugcu

SEQ ID NO: 2001266 - RNA, 12 nt, Homo sapiens
ucccuguuauaa

SEQ ID NO: 2001267 - RNA, 12 nt, Homo sapiens
uuccuguuacaa

SEQ ID NO: 2001268 - RNA, 16 nt, Homo sapiens
gaacucgaagcccuuc

SEQ ID NO: 2001269 - RNA, 15 nt, Homo sapiens
ccaaaacuaguucaa

SEQ ID NO: 2001270 - RNA, 19 nt, Homo sapiens
aggacuacauuuugcucug

SEQ ID NO: 2001271 - RNA, 16 nt, Homo sapiens
aagccuuaagcaaauu

SEQ ID NO: 2001272 - RNA, 21 nt, Homo sapiens
gcaaaccaagagauugcuaau

SEQ ID NO: 2001273 - RNA, 16 nt, Homo sapiens
aauuuugucuuuauga

SEQ ID NO: 2001274 - RNA, 12 nt, Homo sapiens
cuaccucuagua

SEQ ID NO: 2001275 - RNA, 16 nt, Homo sapiens
auuucuuggcauugga

SEQ ID NO: 2001276 - RNA, 18 nt, Homo sapiens
cguggucuccuugcacuu

SEQ ID NO: 2001277 - RNA, 18 nt, Homo sapiens
uuucauuaaagaauguuu

SEQ ID NO: 2001278 - RNA, 16 nt, Homo sapiens
cauuuauuuuuaguua

SEQ ID NO: 2001279 - RNA, 17 nt, Homo sapiens
cuccagucuguucucac

SEQ ID NO: 2001280 - RNA, 20 nt, Homo sapiens
gcuagggagacgccauguga

SEQ ID NO: 2001281 - RNA, 21 nt, Homo sapiens
acuguguaaccagcagucaca

SEQ ID NO: 2001282 - RNA, 13 nt, Homo sapiens
uuaccucacacgc

SEQ ID NO: 2001283 - RNA, 17 nt, Homo sapiens
cuccuauaaucugucaa

SEQ ID NO: 2001284 - RNA, 18 nt, Homo sapiens
uagaucucugaagccaca

SEQ ID NO: 2001285 - RNA, 13 nt, Homo sapiens
ucuaugccaggcu

SEQ ID NO: 2001286 - RNA, 19 nt, Homo sapiens
gcugugggccaaaaucaug

SEQ ID NO: 2001287 - RNA, 19 nt, Homo sapiens
uacaugcagcccaugccca

SEQ ID NO: 2001288 - RNA, 22 nt, Homo sapiens
cuuaguaucucaucaacaaaga

SEQ ID NO: 2001289 - RNA, 15 nt, Homo sapiens
uuaaauggcuuuaug

SEQ ID NO: 2001290 - RNA, 18 nt, Homo sapiens
guccagcucccuugcuaa

SEQ ID NO: 2001291 - RNA, 13 nt, Homo sapiens
uugccuucuccac

SEQ ID NO: 2001292 - RNA, 16 nt, Homo sapiens
acacagucacuuggga

SEQ ID NO: 2001293 - RNA, 15 nt, Homo sapiens
acugggacacuuuua

SEQ ID NO: 2001294 - RNA, 14 nt, Homo sapiens
augcccuauuguaa

SEQ ID NO: 2001295 - RNA, 16 nt, Homo sapiens
cugguccugaucccag

SEQ ID NO: 2001296 - RNA, 15 nt, Homo sapiens
caaaaacuguacugu

SEQ ID NO: 2001297 - RNA, 17 nt, Homo sapiens
cuuuuagaggcuaugaa

SEQ ID NO: 2001298 - RNA, 24 nt, Homo sapiens
cacuucauugaccaagaugaucac

SEQ ID NO: 2001299 - RNA, 16 nt, Homo sapiens
gccagaaaaggcauuu

SEQ ID NO: 2001300 - RNA, 16 nt, Homo sapiens
aguugaagaccagccu

SEQ ID NO: 2001301 - RNA, 21 nt, Homo sapiens
ucagccuagagaccauguuga

SEQ ID NO: 2001302 - RNA, 23 nt, Homo sapiens
gccaggccagagggagugacaga

SEQ ID NO: 2001303 - RNA, 16 nt, Homo sapiens
accacagacgggcaca

SEQ ID NO: 2001304 - RNA, 22 nt, Homo sapiens
uaaacauuugccaaaaauucau

SEQ ID NO: 2001305 - RNA, 19 nt, Homo sapiens
ggccuuucucuggcuuccu

SEQ ID NO: 2001306 - RNA, 18 nt, Homo sapiens
uucugggaugucaucacc

SEQ ID NO: 2001307 - RNA, 20 nt, Homo sapiens
gcuuuaguccuagaggaccu

SEQ ID NO: 2001308 - RNA, 20 nt, Homo sapiens
agaauaaaguuccugucauu

SEQ ID NO: 2001309 - RNA, 15 nt, Homo sapiens
ucccuccucaggggc

SEQ ID NO: 2001310 - RNA, 16 nt, Homo sapiens
gaccucaccuagaaau

SEQ ID NO: 2001311 - RNA, 16 nt, Homo sapiens
ugccuagacuguuacu

SEQ ID NO: 2001312 - RNA, 14 nt, Homo sapiens
caugcacacgggaa

SEQ ID NO: 2001313 - RNA, 22 nt, Homo sapiens
ugcaacugaaugacuaaucaga

SEQ ID NO: 2001314 - RNA, 23 nt, Homo sapiens
uccacaucuuuuuccaagcagug

SEQ ID NO: 2001315 - RNA, 22 nt, Homo sapiens
uauuuccaucagcccaucucaa

SEQ ID NO: 2001316 - RNA, 22 nt, Homo sapiens
uaucauguguuucuguguagua

SEQ ID NO: 2001317 - RNA, 15 nt, Homo sapiens
gaaguaugguguguu

SEQ ID NO: 2001318 - RNA, 19 nt, Homo sapiens
uuccauaguuaaagaagac

SEQ ID NO: 2001319 - RNA, 16 nt, Homo sapiens
aucccucuccucugcc

SEQ ID NO: 2001320 - RNA, 14 nt, Homo sapiens
aagauuccauuucu

SEQ ID NO: 2001321 - RNA, 17 nt, Homo sapiens
acuugagggaccaauau

SEQ ID NO: 2001322 - RNA, 15 nt, Homo sapiens
agaaccgugaacugg

SEQ ID NO: 2001323 - RNA, 14 nt, Homo sapiens
cuucuuccagauuu

SEQ ID NO: 2001324 - RNA, 19 nt, Homo sapiens
gaucacuugaggccaguga

SEQ ID NO: 2001325 - RNA, 15 nt, Homo sapiens
ucagagcaggcucag

SEQ ID NO: 2001326 - RNA, 21 nt, Homo sapiens
aaacacacgagcaaacccaga

SEQ ID NO: 2001327 - RNA, 22 nt, Homo sapiens
uguaaccugggaaagccaugac

SEQ ID NO: 2001328 - RNA, 15 nt, Homo sapiens
agaaucaaauacuca

SEQ ID NO: 2001329 - RNA, 14 nt, Homo sapiens
aaacguggaucucc

SEQ ID NO: 2001330 - RNA, 22 nt, Homo sapiens
gcucagaaauguugguuacaug

SEQ ID NO: 2001331 - RNA, 11 nt, Homo sapiens
aucacaacauu

SEQ ID NO: 2001332 - RNA, 12 nt, Homo sapiens
cuacaagaauaa

SEQ ID NO: 2001333 - RNA, 15 nt, Homo sapiens
uuaccuucacuuaaa

SEQ ID NO: 2001334 - RNA, 22 nt, Homo sapiens
auuauuguuccccuaaguggau

SEQ ID NO: 2001335 - RNA, 13 nt, Homo sapiens
auaccaccuuuac

SEQ ID NO: 2001336 - RNA, 20 nt, Homo sapiens
ugaaaucuuugcagcaauga

SEQ ID NO: 2001337 - RNA, 15 nt, Homo sapiens
ucucgccaagccauc

SEQ ID NO: 2001338 - RNA, 18 nt, Homo sapiens
cugggccgguuaguguau

SEQ ID NO: 2001339 - RNA, 15 nt, Homo sapiens
accaccagucaauaa

SEQ ID NO: 2001340 - RNA, 16 nt, Homo sapiens
caccauguaacaacca

SEQ ID NO: 2001341 - RNA, 18 nt, Homo sapiens
uuuguccuucguauagca

SEQ ID NO: 2001342 - RNA, 22 nt, Homo sapiens
uggggacagagcagaacuuuca

SEQ ID NO: 2001343 - RNA, 20 nt, Homo sapiens
uauauuugugugugugauau

SEQ ID NO: 2001344 - RNA, 18 nt, Homo sapiens
uuuagaagauucuauguu

SEQ ID NO: 2001345 - RNA, 21 nt, Homo sapiens
auaaguccacaucuucucagu

SEQ ID NO: 2001346 - RNA, 14 nt, Homo sapiens
acuacuaaggccuu

SEQ ID NO: 2001347 - RNA, 22 nt, Homo sapiens
aaaguuuuuauggaaggguaaa

SEQ ID NO: 2001348 - RNA, 19 nt, Homo sapiens
agcuaucuuagguggagcu

SEQ ID NO: 2001349 - RNA, 19 nt, Homo sapiens
gcacaggggcccauggacu

SEQ ID NO: 2001350 - RNA, 18 nt, Homo sapiens
agucugaaucucccaagg

SEQ ID NO: 2001351 - RNA, 16 nt, Homo sapiens
uaacuuggaguuucau

SEQ ID NO: 2001352 - RNA, 21 nt, Homo sapiens
cacacccauguaaccacugca

SEQ ID NO: 2001353 - RNA, 18 nt, Homo sapiens
ucccuuccuuguagccuu

SEQ ID NO: 2001354 - RNA, 15 nt, Homo sapiens
aaaggccgggugaca

SEQ ID NO: 2001355 - RNA, 16 nt, Homo sapiens
auguuuuauuuugcca

SEQ ID NO: 2001356 - RNA, 14 nt, Homo sapiens
cauauguaaucucu

SEQ ID NO: 2001357 - RNA, 19 nt, Homo sapiens
ucucuacccauccccugau

SEQ ID NO: 2001358 - RNA, 13 nt, Homo sapiens
caagagaauagcu

SEQ ID NO: 2001359 - RNA, 17 nt, Homo sapiens
ggagcucagggcuggau

SEQ ID NO: 2001360 - RNA, 14 nt, Homo sapiens
gguugccacccaag

SEQ ID NO: 2001361 - RNA, 13 nt, Homo sapiens
uuucaaagcuaaa

SEQ ID NO: 2001362 - RNA, 18 nt, Homo sapiens
uaaaaaaauuuuaauucc

SEQ ID NO: 2001363 - RNA, 18 nt, Homo sapiens
uaucauaauucagcacuu

SEQ ID NO: 2001364 - RNA, 15 nt, Homo sapiens
aucaauauacauaau

SEQ ID NO: 2001365 - RNA, 22 nt, Homo sapiens
cuggcaucucccacacaagacc

SEQ ID NO: 2001366 - RNA, 18 nt, Homo sapiens
ugcauaaaugugguacaa

SEQ ID NO: 2001367 - RNA, 20 nt, Homo sapiens
agaaaugcauaaaagacaag

SEQ ID NO: 2001368 - RNA, 12 nt, Homo sapiens
aaagacugaguc

SEQ ID NO: 2001369 - RNA, 23 nt, Homo sapiens
cccaguaaaaucaaaugugcauc

SEQ ID NO: 2001370 - RNA, 21 nt, Homo sapiens
ucacaagucuaaacaaugaau

SEQ ID NO: 2001371 - RNA, 13 nt, Homo sapiens
ccaccaccugucc

SEQ ID NO: 2001372 - RNA, 22 nt, Homo sapiens
uuccuguuauguuuaacuugau

SEQ ID NO: 2001373 - RNA, 15 nt, Homo sapiens
agaugagcagucaca

SEQ ID NO: 2001374 - RNA, 18 nt, Homo sapiens
uguggaugcuccagggca

SEQ ID NO: 2001375 - RNA, 13 nt, Homo sapiens
caaaaugugaaaa

SEQ ID NO: 2001376 - RNA, 19 nt, Homo sapiens
cauuuaaaaaagauaucua

SEQ ID NO: 2001377 - RNA, 19 nt, Homo sapiens
guuccauuugaaccaguga

SEQ ID NO: 2001378 - RNA, 22 nt, Homo sapiens
ggcagggccuuugucugucuca

SEQ ID NO: 2001379 - RNA, 14 nt, Homo sapiens
caacccucacugug

SEQ ID NO: 2001380 - RNA, 22 nt, Homo sapiens
aggaauccacauugccagugac

SEQ ID NO: 2001381 - RNA, 17 nt, Homo sapiens
aagcugccugcuuuuca

SEQ ID NO: 2001382 - RNA, 18 nt, Homo sapiens
gggccucaggagcaggaa

SEQ ID NO: 2001383 - RNA, 23 nt, Homo sapiens
gaccuccccagccccuagcccag

SEQ ID NO: 2001384 - RNA, 19 nt, Homo sapiens
ggaagggggguugcagugg

SEQ ID NO: 2001385 - RNA, 15 nt, Homo sapiens
ccuuaauaaauaugu

SEQ ID NO: 2001386 - RNA, 21 nt, Homo sapiens
cagcagguucucuccugugag

SEQ ID NO: 2001387 - RNA, 20 nt, Homo sapiens
ccuaccugagcaacaagaau

SEQ ID NO: 2001388 - RNA, 18 nt, Homo sapiens
uaaagcaaucuguugaaa

SEQ ID NO: 2001389 - RNA, 14 nt, Homo sapiens
aaugacagauacaa

SEQ ID NO: 2001390 - RNA, 12 nt, Homo sapiens
gaguagcuggau

SEQ ID NO: 2001391 - RNA, 15 nt, Homo sapiens
ggcagaugucucccc

SEQ ID NO: 2001392 - RNA, 16 nt, Homo sapiens
aaaaugggacuucuuu

SEQ ID NO: 2001393 - RNA, 17 nt, Homo sapiens
aagauagcuucacccca

SEQ ID NO: 2001394 - RNA, 15 nt, Homo sapiens
aauagucuuugccag

SEQ ID NO: 2001395 - RNA, 22 nt, Homo sapiens
ucugucaagcuuacuacaguga

SEQ ID NO: 2001396 - RNA, 17 nt, Homo sapiens
ucacuacauugugcaau

SEQ ID NO: 2001397 - RNA, 22 nt, Homo sapiens
ggccacugcucccuaagccagc

SEQ ID NO: 2001398 - RNA, 19 nt, Homo sapiens
uaauaccuuuaaauaucau

SEQ ID NO: 2001399 - RNA, 14 nt, Homo sapiens
aaaacacauugccu

SEQ ID NO: 2001400 - RNA, 18 nt, Homo sapiens
ucaggaguuggagaccag

SEQ ID NO: 2001401 - RNA, 12 nt, Homo sapiens
cccuugccuuau

SEQ ID NO: 2001402 - RNA, 13 nt, Homo sapiens
ccaaaaaccucac

SEQ ID NO: 2001403 - RNA, 19 nt, Homo sapiens
agccacccuuggucucaug

SEQ ID NO: 2001404 - RNA, 22 nt, Homo sapiens
agggcagauucuucccucugag

SEQ ID NO: 2001405 - RNA, 19 nt, Homo sapiens
uucauguccaccacugacu

SEQ ID NO: 2001406 - RNA, 22 nt, Homo sapiens
cauauauaaauuauuacuuuaa

SEQ ID NO: 2001407 - RNA, 20 nt, Homo sapiens
augccguauaggaugucaga

SEQ ID NO: 2001408 - RNA, 15 nt, Homo sapiens
auccugucauauaau

SEQ ID NO: 2001409 - RNA, 15 nt, Homo sapiens
auuaacauggccauu

SEQ ID NO: 2001410 - RNA, 15 nt, Homo sapiens
gagucucaggacaga

SEQ ID NO: 2001411 - RNA, 12 nt, Homo sapiens
auuaaaauaaga

SEQ ID NO: 2001412 - RNA, 19 nt, Homo sapiens
gcagaugccacccuagcca

SEQ ID NO: 2001413 - RNA, 15 nt, Homo sapiens
ggcuucuggucauga

SEQ ID NO: 2001414 - RNA, 18 nt, Homo sapiens
ggacagguggaggcgagc

SEQ ID NO: 2001415 - RNA, 15 nt, Homo sapiens
uucuccaauguccaa

SEQ ID NO: 2001416 - RNA, 19 nt, Homo sapiens
cauugugacuguguuugca

SEQ ID NO: 2001417 - RNA, 15 nt, Homo sapiens
acuuauucucaagaa

SEQ ID NO: 2001418 - RNA, 23 nt, Homo sapiens
auuuaaaaaugcaugauaaugag

SEQ ID NO: 2001419 - RNA, 13 nt, Homo sapiens
aguggacagcagc

SEQ ID NO: 2001420 - RNA, 17 nt, Homo sapiens
acauuucuaagccuuug

SEQ ID NO: 2001421 - RNA, 23 nt, Homo sapiens
aaugguuggguugauuguauguu

SEQ ID NO: 2001422 - RNA, 13 nt, Homo sapiens
cacuuuaccucuu

SEQ ID NO: 2001423 - RNA, 20 nt, Homo sapiens
caucacuauucagaagacac

SEQ ID NO: 2001424 - RNA, 18 nt, Homo sapiens
uucaaucuuugcuguaua

SEQ ID NO: 2001425 - RNA, 18 nt, Homo sapiens
ugcccuuggcaccaccag

SEQ ID NO: 2001426 - RNA, 15 nt, Homo sapiens
auuaaaucuuccuca

SEQ ID NO: 2001427 - RNA, 14 nt, Homo sapiens
cagcuacucaggag

SEQ ID NO: 2001428 - RNA, 22 nt, Homo sapiens
agcagaaaccaagucuacuuca

SEQ ID NO: 2001429 - RNA, 16 nt, Homo sapiens
ccacccuccuugagac

SEQ ID NO: 2001430 - RNA, 21 nt, Homo sapiens
acagaucuuuacucuugagaa

SEQ ID NO: 2001431 - RNA, 19 nt, Homo sapiens
gcccaggacacugccuuug

SEQ ID NO: 2001432 - RNA, 17 nt, Homo sapiens
ucuggaguuugagacca

SEQ ID NO: 2001433 - RNA, 18 nt, Homo sapiens
guauucucuucacagugc

SEQ ID NO: 2001434 - RNA, 23 nt, Homo sapiens
acacagggaacaggaaaugggaa

SEQ ID NO: 2001435 - RNA, 13 nt, Homo sapiens
guuuauccucuug

SEQ ID NO: 2001436 - RNA, 17 nt, Homo sapiens
auucagcucugcaagaa

SEQ ID NO: 2001437 - RNA, 17 nt, Homo sapiens
cuuguagaguggugcug

SEQ ID NO: 2001438 - RNA, 14 nt, Homo sapiens
cacgcgguacaaag

SEQ ID NO: 2001439 - RNA, 18 nt, Homo sapiens
ugacaagcaagggcugug

SEQ ID NO: 2001440 - RNA, 16 nt, Homo sapiens
acaugccugguggaag

SEQ ID NO: 2001441 - RNA, 20 nt, Homo sapiens
cagagccucccaaggagaac

SEQ ID NO: 2001442 - RNA, 21 nt, Homo sapiens
aauuucuagccugcacuuuga

SEQ ID NO: 2001443 - RNA, 17 nt, Homo sapiens
gcuacugaaccagccac

SEQ ID NO: 2001444 - RNA, 16 nt, Homo sapiens
aacaaaagauucccuu

SEQ ID NO: 2001445 - RNA, 16 nt, Homo sapiens
agaucgaagccaaagc

SEQ ID NO: 2001446 - RNA, 17 nt, Homo sapiens
cccuccccaaaugcuuu

SEQ ID NO: 2001447 - RNA, 19 nt, Homo sapiens
auauucaaugaacuuccau

SEQ ID NO: 2001448 - RNA, 20 nt, Homo sapiens
aucacaggaaaauguaucca

SEQ ID NO: 2001449 - RNA, 20 nt, Homo sapiens
ccuggacuccggaggacuga

SEQ ID NO: 2001450 - RNA, 22 nt, Homo sapiens
agcuccacacccucucccagga

SEQ ID NO: 2001451 - RNA, 23 nt, Homo sapiens
gcaggcacacacgccuucaugcc

SEQ ID NO: 2001452 - RNA, 15 nt, Homo sapiens
ccagacucagcucca

SEQ ID NO: 2001453 - RNA, 19 nt, Homo sapiens
ugcaagacagcacaggcaa

SEQ ID NO: 2001454 - RNA, 14 nt, Homo sapiens
caaaaugucucagu

SEQ ID NO: 2001455 - RNA, 14 nt, Homo sapiens
aagccagggacuaa

SEQ ID NO: 2001456 - RNA, 14 nt, Homo sapiens
aggucccaucaauu

SEQ ID NO: 2001457 - RNA, 16 nt, Homo sapiens
ggugugcacaccaaag

SEQ ID NO: 2001458 - RNA, 22 nt, Homo sapiens
uucaaggccccugacagcuguc

SEQ ID NO: 2001459 - RNA, 18 nt, Homo sapiens
aaccaucgcgugcaauga

SEQ ID NO: 2001460 - RNA, 16 nt, Homo sapiens
uacuuuuacucugccu

SEQ ID NO: 2001461 - RNA, 16 nt, Homo sapiens
ucuugcgauccuuaau

SEQ ID NO: 2001462 - RNA, 23 nt, Homo sapiens
cuuuucuuugaaggaugacuaca

SEQ ID NO: 2001463 - RNA, 12 nt, Homo sapiens
gucuacacugug

SEQ ID NO: 2001464 - RNA, 19 nt, Homo sapiens
caggacagucagcucucuc

SEQ ID NO: 2001465 - RNA, 18 nt, Homo sapiens
caucacaucuuauuuauu

SEQ ID NO: 2001466 - RNA, 15 nt, Homo sapiens
gaaaauggugccugg

SEQ ID NO: 2001467 - RNA, 12 nt, Homo sapiens
cauccaucacag

SEQ ID NO: 2001468 - RNA, 18 nt, Homo sapiens
ugucacaaagggacuuug

SEQ ID NO: 2001469 - RNA, 15 nt, Homo sapiens
ugucugucaccacau

SEQ ID NO: 2001470 - RNA, 15 nt, Homo sapiens
accucugacuugcua

SEQ ID NO: 2001471 - RNA, 15 nt, Homo sapiens
ggccuagaccuggug

SEQ ID NO: 2001472 - RNA, 22 nt, Homo sapiens
ccuguguuggggggcaaggugg

SEQ ID NO: 2001473 - RNA, 20 nt, Homo sapiens
uguugcaaugcaugauacua

SEQ ID NO: 2001474 - RNA, 17 nt, Homo sapiens
gaugugagccaccgugc

SEQ ID NO: 2001475 - RNA, 17 nt, Homo sapiens
ggaaaaauaauucuauu

SEQ ID NO: 2001476 - RNA, 16 nt, Homo sapiens
aguguagaagcauucc

SEQ ID NO: 2001477 - RNA, 17 nt, Homo sapiens
aggaaaauaaacugaca

SEQ ID NO: 2001478 - RNA, 16 nt, Homo sapiens
ucugaacagcuggugu

SEQ ID NO: 2001479 - RNA, 16 nt, Homo sapiens
cauucagaccagugaa

SEQ ID NO: 2001480 - RNA, 21 nt, Homo sapiens
uagauucagcucccacacaca

SEQ ID NO: 2001481 - RNA, 17 nt, Homo sapiens
cucagcucaaccacagu

SEQ ID NO: 2001482 - RNA, 17 nt, Homo sapiens
auaguugauauguaaca

SEQ ID NO: 2001483 - RNA, 14 nt, Homo sapiens
acgucacaaagacc

SEQ ID NO: 2001484 - RNA, 20 nt, Homo sapiens
guuuguuacugucauuccca

SEQ ID NO: 2001485 - RNA, 14 nt, Homo sapiens
aagaaacauugccu

SEQ ID NO: 2001486 - RNA, 16 nt, Homo sapiens
acagagaaaagacaua

SEQ ID NO: 2001487 - RNA, 19 nt, Homo sapiens
caagacccaaguagcugcu

SEQ ID NO: 2001488 - RNA, 17 nt, Homo sapiens
ucugucauccagaaaau

SEQ ID NO: 2001489 - RNA, 16 nt, Homo sapiens
ugggcagagcagagac

SEQ ID NO: 2001490 - RNA, 17 nt, Homo sapiens
aguuucacaaaguuugu

SEQ ID NO: 2001491 - RNA, 19 nt, Homo sapiens
guaacaaauaaagugcagu

SEQ ID NO: 2001492 - RNA, 16 nt, Homo sapiens
gucugagcuucaguau

SEQ ID NO: 2001493 - RNA, 16 nt, Homo sapiens
auugguggcaucacag

SEQ ID NO: 2001494 - RNA, 13 nt, Homo sapiens
ccggaggaaccga

SEQ ID NO: 2001495 - RNA, 16 nt, Homo sapiens
uggcugggaguggcau

SEQ ID NO: 2001496 - RNA, 14 nt, Homo sapiens
guauuuuggcagag

SEQ ID NO: 2001497 - RNA, 21 nt, Homo sapiens
uccaaccaggaguaccuggac

SEQ ID NO: 2001498 - RNA, 18 nt, Homo sapiens
cagucuggcgucuccaga

SEQ ID NO: 2001499 - RNA, 18 nt, Homo sapiens
uacaccaguuuagcccug

SEQ ID NO: 2001500 - RNA, 18 nt, Homo sapiens
cuuuaugucucacaggga

SEQ ID NO: 2001501 - RNA, 16 nt, Homo sapiens
aggacuuuauagauca

SEQ ID NO: 2001502 - RNA, 14 nt, Homo sapiens
caggcagcauuuag

SEQ ID NO: 2001503 - RNA, 23 nt, Homo sapiens
cugcaggcaugcugaacaagggg

SEQ ID NO: 2001504 - RNA, 13 nt, Homo sapiens
ccauggccacaau

SEQ ID NO: 2001505 - RNA, 13 nt, Homo sapiens
cuccugauggcca

SEQ ID NO: 2001506 - RNA, 16 nt, Homo sapiens
ucccggcccauguuga

SEQ ID NO: 2001507 - RNA, 21 nt, Homo sapiens
uguaaauaucccagagaacaa

SEQ ID NO: 2001508 - RNA, 18 nt, Homo sapiens
uguuagcugcucacuuaa

SEQ ID NO: 2001509 - RNA, 16 nt, Homo sapiens
caccuuaaaauuagca

SEQ ID NO: 2001510 - RNA, 23 nt, Homo sapiens
cugaaccagagcuggaacacaau

SEQ ID NO: 2001511 - RNA, 18 nt, Homo sapiens
uguacucuuuagaucucc

SEQ ID NO: 2001512 - RNA, 22 nt, Homo sapiens
aaucuggagaaaugcuuauaaa

SEQ ID NO: 2001513 - RNA, 18 nt, Homo sapiens
uacaucccuuaccuggga

SEQ ID NO: 2001514 - RNA, 21 nt, Homo sapiens
aacaugugguuaaugccaugg

SEQ ID NO: 2001515 - RNA, 18 nt, Homo sapiens
ucagcaaaacuuuccaac

SEQ ID NO: 2001516 - RNA, 10 nt, Homo sapiens
ccaucuucca

SEQ ID NO: 2001517 - RNA, 18 nt, Homo sapiens
agccacgcagugccugga

SEQ ID NO: 2001518 - RNA, 14 nt, Homo sapiens
cacaaguggguacc

SEQ ID NO: 2001519 - RNA, 14 nt, Homo sapiens
cauuccugggcuag

SEQ ID NO: 2001520 - RNA, 15 nt, Homo sapiens
uaauguugugguuug

SEQ ID NO: 2001521 - RNA, 23 nt, Homo sapiens
cauuguguguuagcagcagugag

SEQ ID NO: 2001522 - RNA, 22 nt, Homo sapiens
gaccuggccccaggcugucacc

SEQ ID NO: 2001523 - RNA, 23 nt, Homo sapiens
uggauugugaagauuucauggac

SEQ ID NO: 2001524 - RNA, 14 nt, Homo sapiens
gcagucuuugcuca

SEQ ID NO: 2001525 - RNA, 17 nt, Homo sapiens
gguucucuccaccaggu

SEQ ID NO: 2001526 - RNA, 12 nt, Homo sapiens
cucuacccagua

SEQ ID NO: 2001527 - RNA, 14 nt, Homo sapiens
agaagugauuuagu

SEQ ID NO: 2001528 - RNA, 13 nt, Homo sapiens
aaacauuuugaca

SEQ ID NO: 2001529 - RNA, 18 nt, Homo sapiens
gugucccccauaaaagau

SEQ ID NO: 2001530 - RNA, 18 nt, Homo sapiens
gcuaauucucagcagaaa

SEQ ID NO: 2001531 - RNA, 14 nt, Homo sapiens
aucugcgugcacuu

SEQ ID NO: 2001532 - RNA, 19 nt, Homo sapiens
ccccacuggacaacacuga

SEQ ID NO: 2001533 - RNA, 15 nt, Homo sapiens
ggcucgggacuucaa

SEQ ID NO: 2001534 - RNA, 15 nt, Homo sapiens
accaaggggguaaaa

SEQ ID NO: 2001535 - RNA, 19 nt, Homo sapiens
auuccuauauaguuuauug

SEQ ID NO: 2001536 - RNA, 14 nt, Homo sapiens
ggccccagcucuga

SEQ ID NO: 2001537 - RNA, 12 nt, Homo sapiens
aauuacagacaa

SEQ ID NO: 2001538 - RNA, 11 nt, Homo sapiens
ugaagauuuca

SEQ ID NO: 2001539 - RNA, 11 nt, Homo sapiens
ugcagauuucc

SEQ ID NO: 2001540 - RNA, 13 nt, Homo sapiens
aacaaauaugcaa

SEQ ID NO: 2001541 - RNA, 16 nt, Homo sapiens
gaaggauauauuuggc

SEQ ID NO: 2001542 - RNA, 15 nt, Homo sapiens
uagucugcuuuggua

SEQ ID NO: 2001543 - RNA, 15 nt, Homo sapiens
ucuagucugcuuugg

SEQ ID NO: 2001544 - RNA, 23 nt, Homo sapiens
gucuuaguacauccucacuuuua

SEQ ID NO: 2001545 - RNA, 12 nt, Homo sapiens
gacuacaaccaa

SEQ ID NO: 2001546 - RNA, 23 nt, Homo sapiens
gaucccccagacuuuacaugaca

SEQ ID NO: 2001547 - RNA, 13 nt, Homo sapiens
agcauaaugcucc

SEQ ID NO: 2001548 - RNA, 14 nt, Homo sapiens
ccaugaaucucugc

SEQ ID NO: 2001549 - RNA, 14 nt, Homo sapiens
ucaaacauuucaaa

SEQ ID NO: 2001550 - RNA, 22 nt, Homo sapiens
aaaaccagaacaguaugaauuu

SEQ ID NO: 2001551 - RNA, 21 nt, Homo sapiens
aaggaacguauaucacauaau

SEQ ID NO: 2001552 - RNA, 20 nt, Homo sapiens
gccaugaaggguuuugcuau

SEQ ID NO: 2001553 - RNA, 20 nt, Homo sapiens
auaaagaggaucguagugug

SEQ ID NO: 2001554 - RNA, 14 nt, Homo sapiens
uuguaccaguguga

SEQ ID NO: 2001555 - RNA, 22 nt, Homo sapiens
ucagagaacucccccaccugug

SEQ ID NO: 2001556 - RNA, 12 nt, Homo sapiens
aggccauuccag

SEQ ID NO: 2001557 - RNA, 16 nt, Homo sapiens
ucuuaguggaagacaa

SEQ ID NO: 2001558 - RNA, 23 nt, Homo sapiens
cagaacaaaugaucuguuuucau

SEQ ID NO: 2001559 - RNA, 14 nt, Homo sapiens
ugacuggcacccaa

SEQ ID NO: 2001560 - RNA, 18 nt, Homo sapiens
guaaaauaucuaccugcc

SEQ ID NO: 2001561 - RNA, 18 nt, Homo sapiens
aggcugcgacugaugaag

SEQ ID NO: 2001562 - RNA, 22 nt, Homo sapiens
guaggcauucugagcaggggaa

SEQ ID NO: 2001563 - RNA, 13 nt, Homo sapiens
auggccacuacuu

SEQ ID NO: 2001564 - RNA, 19 nt, Homo sapiens
uucagcgagacccuugcau

SEQ ID NO: 2001565 - RNA, 19 nt, Homo sapiens
augccuucaaaaugcugcu

SEQ ID NO: 2001566 - RNA, 18 nt, Homo sapiens
uguuauuuguacaguuca

SEQ ID NO: 2001567 - RNA, 15 nt, Homo sapiens
aaguuccacuucuug

SEQ ID NO: 2001568 - RNA, 19 nt, Homo sapiens
accuugagaagacauagau

SEQ ID NO: 2001569 - RNA, 19 nt, Homo sapiens
gaaacaucucaacaaccug

SEQ ID NO: 2001570 - RNA, 21 nt, Homo sapiens
cacacuguagcauuacagugg

SEQ ID NO: 2001571 - RNA, 12 nt, Homo sapiens
uccuaugugauu

SEQ ID NO: 2001572 - RNA, 22 nt, Homo sapiens
uguuuggaagaccagaauguga

SEQ ID NO: 2001573 - RNA, 20 nt, Homo sapiens
uugagcugccugcucugcag

SEQ ID NO: 2001574 - RNA, 16 nt, Homo sapiens
ucaaggcaaugggcua

SEQ ID NO: 2001575 - RNA, 14 nt, Homo sapiens
guaaagaagggaag

SEQ ID NO: 2001576 - RNA, 14 nt, Homo sapiens
gaaaaccacaguca

SEQ ID NO: 2001577 - RNA, 21 nt, Homo sapiens
augcagcagcuuuugacuguu

SEQ ID NO: 2001578 - RNA, 19 nt, Homo sapiens
uucucugguaauauugacu

SEQ ID NO: 2001579 - RNA, 16 nt, Homo sapiens
agccaagaaacacugc

SEQ ID NO: 2001580 - RNA, 17 nt, Homo sapiens
gaggcauagucaccuag

SEQ ID NO: 2001581 - RNA, 14 nt, Homo sapiens
cagcuaagcaauag

SEQ ID NO: 2001582 - RNA, 22 nt, Homo sapiens
cuggaaaacagaaaccauucua

SEQ ID NO: 2001583 - RNA, 15 nt, Homo sapiens
ucccauuacuuugau

SEQ ID NO: 2001584 - RNA, 22 nt, Homo sapiens
accagccugcacuacucccuca

SEQ ID NO: 2001585 - RNA, 16 nt, Homo sapiens
cuuuucccaccagcuc

SEQ ID NO: 2001586 - RNA, 22 nt, Homo sapiens
uagaaguucuaguguuuucaau

SEQ ID NO: 2001587 - RNA, 13 nt, Homo sapiens
aacuucuugucag

SEQ ID NO: 2001588 - RNA, 23 nt, Homo sapiens
uauaugaguaaguuacuacuuac

SEQ ID NO: 2001589 - RNA, 18 nt, Homo sapiens
agugacaacaucgcaaua

SEQ ID NO: 2001590 - RNA, 20 nt, Homo sapiens
auugaaccgccguccuucaa

SEQ ID NO: 2001591 - RNA, 16 nt, Homo sapiens
acuauaaaagcuuucu

SEQ ID NO: 2001592 - RNA, 20 nt, Homo sapiens
uaccuuuugugguucucaau

SEQ ID NO: 2001593 - RNA, 15 nt, Homo sapiens
uccuuaucugucaca

SEQ ID NO: 2001594 - RNA, 16 nt, Homo sapiens
guuucuucucuacacc

SEQ ID NO: 2001595 - RNA, 22 nt, Homo sapiens
agagccaugguguguuuguaau

SEQ ID NO: 2001596 - RNA, 18 nt, Homo sapiens
uuggcuuuaugcaaauac

SEQ ID NO: 2001597 - RNA, 23 nt, Homo sapiens
cagaaaauguugagaaucccaaa

SEQ ID NO: 2001598 - RNA, 20 nt, Homo sapiens
caacagcuaggaaauaucau

SEQ ID NO: 2001599 - RNA, 17 nt, Homo sapiens
uaaguucauucaugcca

SEQ ID NO: 2001600 - RNA, 19 nt, Homo sapiens
aaaguccagauaccaagca

SEQ ID NO: 2001601 - RNA, 18 nt, Homo sapiens
cuauguagcaauauauca

SEQ ID NO: 2001602 - RNA, 22 nt, Homo sapiens
acugggacagcccaggaaacaa

SEQ ID NO: 2001603 - RNA, 16 nt, Homo sapiens
uagcugggauuugaac

SEQ ID NO: 2001604 - RNA, 21 nt, Homo sapiens
cgaaaaaaaaauguucauucu

SEQ ID NO: 2001605 - RNA, 14 nt, Homo sapiens
uguuuagaacacac

SEQ ID NO: 2001606 - RNA, 21 nt, Homo sapiens
aggcaggagaaucacuugaac

SEQ ID NO: 2001607 - RNA, 13 nt, Homo sapiens
ggugucugugaag

SEQ ID NO: 2001608 - RNA, 14 nt, Homo sapiens
gccagccucuagag

SEQ ID NO: 2001609 - RNA, 14 nt, Homo sapiens
caacaagaaugcau

SEQ ID NO: 2001610 - RNA, 14 nt, Homo sapiens
aaauuugacuguua

SEQ ID NO: 2001611 - RNA, 14 nt, Homo sapiens
gcaauuuagcucuc

SEQ ID NO: 2001612 - RNA, 18 nt, Homo sapiens
cuucacuucugacucuuc

SEQ ID NO: 2001613 - RNA, 18 nt, Homo sapiens
gagcuuucuccugagcuc

SEQ ID NO: 2001614 - RNA, 19 nt, Homo sapiens
cacugacaaugggcacuga

SEQ ID NO: 2001615 - RNA, 23 nt, Homo sapiens
aaguuagccagguaugguggcau

SEQ ID NO: 2001616 - RNA, 16 nt, Homo sapiens
uccugggccugcagaa

SEQ ID NO: 2001617 - RNA, 22 nt, Homo sapiens
acucccguguaggaaccugcac

SEQ ID NO: 2001618 - RNA, 22 nt, Homo sapiens
gcuuuguuugggccacugccag

SEQ ID NO: 2001619 - RNA, 14 nt, Homo sapiens
cagcaguaccaucu

SEQ ID NO: 2001620 - RNA, 14 nt, Homo sapiens
ugcagaguacauga

SEQ ID NO: 2001621 - RNA, 18 nt, Homo sapiens
aaccauuucagccaaacu

SEQ ID NO: 2001622 - RNA, 17 nt, Homo sapiens
aauacgucgugcucgag

SEQ ID NO: 2001623 - RNA, 16 nt, Homo sapiens
ggaauuaagcaaaauc

SEQ ID NO: 2001624 - RNA, 23 nt, Homo sapiens
ccagggaggggucccugcaaaac

SEQ ID NO: 2001625 - RNA, 18 nt, Homo sapiens
guccaccaugcucucuca

SEQ ID NO: 2001626 - RNA, 17 nt, Homo sapiens
ccagagccagaaagggu

SEQ ID NO: 2001627 - RNA, 21 nt, Homo sapiens
gauuccaccaacagccggcug

SEQ ID NO: 2001628 - RNA, 22 nt, Homo sapiens
gcaugcuggggcccuaccagca

SEQ ID NO: 2001629 - RNA, 19 nt, Homo sapiens
aacagaaguugaagcacaa

SEQ ID NO: 2001630 - RNA, 20 nt, Homo sapiens
ugucugcaccuuagaaaaaa

SEQ ID NO: 2001631 - RNA, 21 nt, Homo sapiens
uacauuuauauuaauugagau

SEQ ID NO: 2001632 - RNA, 20 nt, Homo sapiens
cccauuaaagagccaguuua

SEQ ID NO: 2001633 - RNA, 14 nt, Homo sapiens
uucagaaagggcag

SEQ ID NO: 2001634 - RNA, 22 nt, Homo sapiens
uuugguuaagaauaaauuaaaa

SEQ ID NO: 2001635 - RNA, 15 nt, Homo sapiens
aaauuacaugcauga

SEQ ID NO: 2001636 - RNA, 23 nt, Homo sapiens
cucuguccuggaggcacugggaa

SEQ ID NO: 2001637 - RNA, 17 nt, Homo sapiens
ucuuguuuuauauaccu

SEQ ID NO: 2001638 - RNA, 22 nt, Homo sapiens
aagggaguaaguagagguggcu

SEQ ID NO: 2001639 - RNA, 16 nt, Homo sapiens
uuguuccccacuggag

SEQ ID NO: 2001640 - RNA, 17 nt, Homo sapiens
aagaaacagagugcuaa

SEQ ID NO: 2001641 - RNA, 14 nt, Homo sapiens
agccagucccucag

SEQ ID NO: 2001642 - RNA, 15 nt, Homo sapiens
uacauacagugauau

SEQ ID NO: 2001643 - RNA, 23 nt, Homo sapiens
gggguaagggauuucuuagggga

SEQ ID NO: 2001644 - RNA, 16 nt, Homo sapiens
uaccucccucauuuaa

SEQ ID NO: 2001645 - RNA, 22 nt, Homo sapiens
cauuuuccaaaucuuaauucaa

SEQ ID NO: 2001646 - RNA, 20 nt, Homo sapiens
guaauugcagauaacuuuga

SEQ ID NO: 2001647 - RNA, 23 nt, Homo sapiens
cuggagcuggcgucugucuucaa

SEQ ID NO: 2001648 - RNA, 15 nt, Homo sapiens
agccagcagccagcu

SEQ ID NO: 2001649 - RNA, 17 nt, Homo sapiens
uaaaagaaaaaugcugu

SEQ ID NO: 2001650 - RNA, 15 nt, Homo sapiens
agugggaucccagac

SEQ ID NO: 2001651 - RNA, 15 nt, Homo sapiens
agcaucagcacagcu

SEQ ID NO: 2001652 - RNA, 15 nt, Homo sapiens
agcagaagcacauau

SEQ ID NO: 2001653 - RNA, 15 nt, Homo sapiens
cugccccaugugucc

SEQ ID NO: 2001654 - RNA, 13 nt, Homo sapiens
gcugauggcagcu

SEQ ID NO: 2001655 - RNA, 14 nt, Homo sapiens
caugccaagcauuu

SEQ ID NO: 2001656 - RNA, 16 nt, Homo sapiens
uauuuuuaaacaaaga

SEQ ID NO: 2001657 - RNA, 19 nt, Homo sapiens
gaacaguuuuacaauagac

SEQ ID NO: 2001658 - RNA, 16 nt, Homo sapiens
ugugugggcugcagau

SEQ ID NO: 2001659 - RNA, 23 nt, Homo sapiens
cauucccauguugucaauaacag

SEQ ID NO: 2001660 - RNA, 20 nt, Homo sapiens
caaccuccccgcagagcucc

SEQ ID NO: 2001661 - RNA, 17 nt, Homo sapiens
cuggaggccaaggugug

SEQ ID NO: 2001662 - RNA, 19 nt, Homo sapiens
ccaguccagauauuucaca

SEQ ID NO: 2001663 - RNA, 20 nt, Homo sapiens
gagauggcgcuauugcacuc

SEQ ID NO: 2001664 - RNA, 16 nt, Homo sapiens
cuugucgggcacagau

SEQ ID NO: 2001665 - RNA, 17 nt, Homo sapiens
accaggucucccgggaa

SEQ ID NO: 2001666 - RNA, 15 nt, Homo sapiens
gcauggccgcgucac

SEQ ID NO: 2001667 - RNA, 19 nt, Homo sapiens
uuucaagagugagcuauca

SEQ ID NO: 2001668 - RNA, 19 nt, Homo sapiens
acuuuaugccggaugugcu

SEQ ID NO: 2001669 - RNA, 19 nt, Homo sapiens
uugacacuauucacuaaaa

SEQ ID NO: 2001670 - RNA, 20 nt, Homo sapiens
aagugaggagugccagcuca

SEQ ID NO: 2001671 - RNA, 14 nt, Homo sapiens
ggagggagggacaa

SEQ ID NO: 2001672 - RNA, 15 nt, Homo sapiens
uuuuguauuauugcu

SEQ ID NO: 2001673 - RNA, 22 nt, Homo sapiens
aaaugugcacacauauacaugu

SEQ ID NO: 2001674 - RNA, 21 nt, Homo sapiens
ugccaacaauccuagugcuuu

SEQ ID NO: 2001675 - RNA, 16 nt, Homo sapiens
uugcagcaagcaauaa

SEQ ID NO: 2001676 - RNA, 14 nt, Homo sapiens
agucaaaguaguua

SEQ ID NO: 2001677 - RNA, 23 nt, Homo sapiens
cugaaauuuuaaugaagugcaau

SEQ ID NO: 2001678 - RNA, 20 nt, Homo sapiens
uauguugucauaacauuuaa

SEQ ID NO: 2001679 - RNA, 13 nt, Homo sapiens
caucuuuucaagg

SEQ ID NO: 2001680 - RNA, 20 nt, Homo sapiens
acucccgaggauguguccua

SEQ ID NO: 2001681 - RNA, 18 nt, Homo sapiens
caucagggacaggaugac

SEQ ID NO: 2001682 - RNA, 15 nt, Homo sapiens
gccccugaaagccau

SEQ ID NO: 2001683 - RNA, 16 nt, Homo sapiens
ggccucccuuugggga

SEQ ID NO: 2001684 - RNA, 22 nt, Homo sapiens
ggaaugucagcaggaccccauc

SEQ ID NO: 2001685 - RNA, 15 nt, Homo sapiens
aggccaggcguggug

SEQ ID NO: 2001686 - RNA, 20 nt, Homo sapiens
gccccgcccccaccccuaca

SEQ ID NO: 2001687 - RNA, 20 nt, Homo sapiens
ugaagcguuuuucucaaagg

SEQ ID NO: 2001688 - RNA, 14 nt, Homo sapiens
gcacucagacugua

SEQ ID NO: 2001689 - RNA, 12 nt, Homo sapiens
ggauugugcuuu

SEQ ID NO: 2001690 - RNA, 14 nt, Homo sapiens
ugcucugcugugag

SEQ ID NO: 2001691 - RNA, 22 nt, Homo sapiens
gacuggauuuuugcucugcccc

SEQ ID NO: 2001692 - RNA, 20 nt, Homo sapiens
cugcuauuuuacugucuuaa

SEQ ID NO: 2001693 - RNA, 16 nt, Homo sapiens
ggccuggagcaggccu

SEQ ID NO: 2001694 - RNA, 23 nt, Homo sapiens
aacccauuccaguacaguauucu

SEQ ID NO: 2001695 - RNA, 19 nt, Homo sapiens
caucuaaauauuaugccuu

SEQ ID NO: 2001696 - RNA, 16 nt, Homo sapiens
auaguaggacugcuga

SEQ ID NO: 2001697 - RNA, 17 nt, Homo sapiens
caaauagcccacacgug

SEQ ID NO: 2001698 - RNA, 12 nt, Homo sapiens
auggcugaagaa

SEQ ID NO: 2001699 - RNA, 18 nt, Homo sapiens
guccugggauuacaggug

SEQ ID NO: 2001700 - RNA, 14 nt, Homo sapiens
gaaaaaaaguuucu

SEQ ID NO: 2001701 - RNA, 22 nt, Homo sapiens
cacgccugguucuguacaugug

SEQ ID NO: 2001702 - RNA, 18 nt, Homo sapiens
agagcacuagaagcacag

SEQ ID NO: 2001703 - RNA, 23 nt, Homo sapiens
guacuaucgucaggaaaccaaau

SEQ ID NO: 2001704 - RNA, 22 nt, Homo sapiens
cauugcuuuugggagacuggaa

SEQ ID NO: 2001705 - RNA, 22 nt, Homo sapiens
cugauuuguauuaaaauuguaa

SEQ ID NO: 2001706 - RNA, 24 nt, Homo sapiens
ucugcacgcuuugggguguggaug

SEQ ID NO: 2001707 - RNA, 17 nt, Homo sapiens
ugcccccuccuguguaa

SEQ ID NO: 2001708 - RNA, 23 nt, Homo sapiens
ggcaaccaauaaaagccagaugc

SEQ ID NO: 2001709 - RNA, 15 nt, Homo sapiens
agcagacuccagccc

SEQ ID NO: 2001710 - RNA, 23 nt, Homo sapiens
caauguaagagccuaacuccauc

SEQ ID NO: 2001711 - RNA, 16 nt, Homo sapiens
cuuccccgaaucacac

SEQ ID NO: 2001712 - RNA, 16 nt, Homo sapiens
ugggaacagugugcaa

SEQ ID NO: 2001713 - RNA, 19 nt, Homo sapiens
cccagacugaugagcacau

SEQ ID NO: 2001714 - RNA, 14 nt, Homo sapiens
acauggaaggugau

SEQ ID NO: 2001715 - RNA, 15 nt, Homo sapiens
acagccuccuaggcu

SEQ ID NO: 2001716 - RNA, 16 nt, Homo sapiens
aaccucaaagugacua

SEQ ID NO: 2001717 - RNA, 15 nt, Homo sapiens
ccuggugcauugcug

SEQ ID NO: 2001718 - RNA, 22 nt, Homo sapiens
uggauauuaaaaaucuguaaau

SEQ ID NO: 2001719 - RNA, 16 nt, Homo sapiens
cccccagagguggaua

SEQ ID NO: 2001720 - RNA, 12 nt, Homo sapiens
guuuucaaugug

SEQ ID NO: 2001721 - RNA, 13 nt, Homo sapiens
caucaggugggaa

SEQ ID NO: 2001722 - RNA, 16 nt, Homo sapiens
gagucagucaugucac

SEQ ID NO: 2001723 - RNA, 15 nt, Homo sapiens
uuugaaagcuguaua

SEQ ID NO: 2001724 - RNA, 16 nt, Homo sapiens
ugucauuaaccaucuu

SEQ ID NO: 2001725 - RNA, 20 nt, Homo sapiens
aaccaacaauaaauauguau

SEQ ID NO: 2001726 - RNA, 19 nt, Homo sapiens
agccuccaggauaccagca

SEQ ID NO: 2001727 - RNA, 14 nt, Homo sapiens
cucuauuguuaccu

SEQ ID NO: 2001728 - RNA, 20 nt, Homo sapiens
gcagaucuaccccuuacuua

SEQ ID NO: 2001729 - RNA, 17 nt, Homo sapiens
gguccauucugcaccuc

SEQ ID NO: 2001730 - RNA, 22 nt, Homo sapiens
cuguacccccgacgugcucccc

SEQ ID NO: 2001731 - RNA, 14 nt, Homo sapiens
uuaaauauuuccau

SEQ ID NO: 2001732 - RNA, 17 nt, Homo sapiens
ccaggcuggagugcagu

SEQ ID NO: 2001733 - RNA, 17 nt, Homo sapiens
ccaggcuagagugcaau

SEQ ID NO: 2001734 - RNA, 20 nt, Homo sapiens
uaaagaaauaauacccugcc

SEQ ID NO: 2001735 - RNA, 11 nt, Homo sapiens
ucaugugaaau

SEQ ID NO: 2001736 - RNA, 17 nt, Homo sapiens
ucccuauuaaccuagag

SEQ ID NO: 2001737 - RNA, 22 nt, Homo sapiens
acagaugacaaugggagccuca

SEQ ID NO: 2001738 - RNA, 21 nt, Homo sapiens
uuguacuuuguuuuuccaugu

SEQ ID NO: 2001739 - RNA, 13 nt, Homo sapiens
guaucuugauguu

SEQ ID NO: 2001740 - RNA, 13 nt, Homo sapiens
ugaagcacuuaag

SEQ ID NO: 2001741 - RNA, 13 nt, Homo sapiens
uuccucacugccu

SEQ ID NO: 2001742 - RNA, 15 nt, Homo sapiens
gaccaugcagccgca

SEQ ID NO: 2001743 - RNA, 19 nt, Homo sapiens
cuuaucccugcccauuuca

SEQ ID NO: 2001744 - RNA, 17 nt, Homo sapiens
ugaucauugcaguauca

SEQ ID NO: 2001745 - RNA, 13 nt, Homo sapiens
caacacaucacuu

SEQ ID NO: 2001746 - RNA, 14 nt, Homo sapiens
guuucuguuugaau

SEQ ID NO: 2001747 - RNA, 19 nt, Homo sapiens
uuauuauuuuggggucucu

SEQ ID NO: 2001748 - RNA, 18 nt, Homo sapiens
gagaaguucccauuauua

SEQ ID NO: 2001749 - RNA, 22 nt, Homo sapiens
aggaaccaaccaacaaacaaug

SEQ ID NO: 2001750 - RNA, 13 nt, Homo sapiens
ggaagcccugggu

SEQ ID NO: 2001751 - RNA, 20 nt, Homo sapiens
ugaagaagaugagccuugca

SEQ ID NO: 2001752 - RNA, 22 nt, Homo sapiens
cagaaaagcaauacuguuucca

SEQ ID NO: 2001753 - RNA, 21 nt, Homo sapiens
ugcaagccugucugagacuca

SEQ ID NO: 2001754 - RNA, 17 nt, Homo sapiens
gccucuccaguuugcac

SEQ ID NO: 2001755 - RNA, 16 nt, Homo sapiens
acaauucugcagaaaa

SEQ ID NO: 2001756 - RNA, 18 nt, Homo sapiens
agagccucuggcaucucu

SEQ ID NO: 2001757 - RNA, 16 nt, Homo sapiens
ucaagaagaaaguguu

SEQ ID NO: 2001758 - RNA, 15 nt, Homo sapiens
acugugcuacugaaa

SEQ ID NO: 2001759 - RNA, 21 nt, Homo sapiens
gccuguaaucucagcacuuug

SEQ ID NO: 2001760 - RNA, 11 nt, Homo sapiens
ccucacaucuu

SEQ ID NO: 2001761 - RNA, 12 nt, Homo sapiens
aggagggagcau

SEQ ID NO: 2001762 - RNA, 13 nt, Homo sapiens
cugcugccaucca

SEQ ID NO: 2001763 - RNA, 18 nt, Homo sapiens
ucauaaaggauauuucaa

SEQ ID NO: 2001764 - RNA, 22 nt, Homo sapiens
ggcucuggacaggcacuaucug

SEQ ID NO: 2001765 - RNA, 21 nt, Homo sapiens
uguggcauaaauuacagucau

SEQ ID NO: 2001766 - RNA, 15 nt, Homo sapiens
ccuggccucauacag

SEQ ID NO: 2001767 - RNA, 19 nt, Homo sapiens
ggaaccuugcuguccugau

SEQ ID NO: 2001768 - RNA, 17 nt, Homo sapiens
auaauguauacauuaca

SEQ ID NO: 2001769 - RNA, 22 nt, Homo sapiens
ccaccacugggcaaacagaaga

SEQ ID NO: 2001770 - RNA, 18 nt, Homo sapiens
uuauauuaaaacacuuag

SEQ ID NO: 2001771 - RNA, 15 nt, Homo sapiens
ggcauggagccagug

SEQ ID NO: 2001772 - RNA, 22 nt, Homo sapiens
aguuccggccugggcaccagca

SEQ ID NO: 2001773 - RNA, 16 nt, Homo sapiens
guccucacugcugauu

SEQ ID NO: 2001774 - RNA, 23 nt, Homo sapiens
acauguuauccacaagcaaugga

SEQ ID NO: 2001775 - RNA, 15 nt, Homo sapiens
uaagguauugugcau

SEQ ID NO: 2001776 - RNA, 21 nt, Homo sapiens
ccccaccugggacccuugaga

SEQ ID NO: 2001777 - RNA, 23 nt, Homo sapiens
aauguuaguauuuuaauccugua

SEQ ID NO: 2001778 - RNA, 17 nt, Homo sapiens
aaauucuggacacauua

SEQ ID NO: 2001779 - RNA, 19 nt, Homo sapiens
ccucaggcugccaggaugg

SEQ ID NO: 2001780 - RNA, 13 nt, Homo sapiens
ucacuguggucau

SEQ ID NO: 2001781 - RNA, 16 nt, Homo sapiens
ugugcucuaagugaau

SEQ ID NO: 2001782 - RNA, 19 nt, Homo sapiens
gucaaaauuugcugccaaa

SEQ ID NO: 2001783 - RNA, 14 nt, Homo sapiens
auauaccauuucaa

SEQ ID NO: 2001784 - RNA, 11 nt, Homo sapiens
ucuaugaagcc

SEQ ID NO: 2001785 - RNA, 11 nt, Homo sapiens
gccaugaaucu

SEQ ID NO: 2001786 - RNA, 19 nt, Homo sapiens
aggaacagagacucuggaa

SEQ ID NO: 2001787 - RNA, 22 nt, Homo sapiens
ccugccccaauucaauccugcc

SEQ ID NO: 2001788 - RNA, 21 nt, Homo sapiens
acugcauugguuuuccaugac

SEQ ID NO: 2001789 - RNA, 17 nt, Homo sapiens
aaauugggaaaacucca

SEQ ID NO: 2001790 - RNA, 22 nt, Homo sapiens
aacucauucucuucuugcuaua

SEQ ID NO: 2001791 - RNA, 15 nt, Homo sapiens
uccagggacacuuuu

SEQ ID NO: 2001792 - RNA, 16 nt, Homo sapiens
gaugauggcucauuua

SEQ ID NO: 2001793 - RNA, 19 nt, Homo sapiens
ugcaguggugcaaucuugg

SEQ ID NO: 2001794 - RNA, 23 nt, Homo sapiens
uauuuuuaaccugccaacauacu

SEQ ID NO: 2001795 - RNA, 20 nt, Homo sapiens
acuucccucaggccuaugca

SEQ ID NO: 2001796 - RNA, 22 nt, Homo sapiens
gccaaacauuaaaauuagcacu

SEQ ID NO: 2001797 - RNA, 16 nt, Homo sapiens
agucuccccacuccac

SEQ ID NO: 2001798 - RNA, 20 nt, Homo sapiens
guaaaaaaggagacaguuua

SEQ ID NO: 2001799 - RNA, 19 nt, Homo sapiens
agaaacccggcuuccugug

SEQ ID NO: 2001800 - RNA, 13 nt, Homo sapiens
ugaauaacaguag

SEQ ID NO: 2001801 - RNA, 16 nt, Homo sapiens
aggaaacuccugugac

SEQ ID NO: 2001802 - RNA, 18 nt, Homo sapiens
aucuucaggacacucacu

SEQ ID NO: 2001803 - RNA, 17 nt, Homo sapiens
aaaugucuaagguagua

SEQ ID NO: 2001804 - RNA, 16 nt, Homo sapiens
guuuuuaaguacucac

SEQ ID NO: 2001805 - RNA, 19 nt, Homo sapiens
acacugugcccagcccgga

SEQ ID NO: 2001806 - RNA, 18 nt, Homo sapiens
guuuaaucccagcacuuu

SEQ ID NO: 2001807 - RNA, 11 nt, Homo sapiens
ugaacauacac

SEQ ID NO: 2001808 - RNA, 17 nt, Homo sapiens
ccauguuggucaggcug

SEQ ID NO: 2001809 - RNA, 12 nt, Homo sapiens
ucugaccucagc

SEQ ID NO: 2001810 - RNA, 21 nt, Homo sapiens
caacgacccuggacagugacg

SEQ ID NO: 2001811 - RNA, 18 nt, Homo sapiens
uuuguuaaguucaccgua

SEQ ID NO: 2001812 - RNA, 15 nt, Homo sapiens
uaaagucaaaugcca

SEQ ID NO: 2001813 - RNA, 13 nt, Homo sapiens
gaguuaaggcaaa

SEQ ID NO: 2001814 - RNA, 17 nt, Homo sapiens
ggacuugacuugcaauu

SEQ ID NO: 2001815 - RNA, 18 nt, Homo sapiens
aauggugauauccucuca

SEQ ID NO: 2001816 - RNA, 17 nt, Homo sapiens
uuuagcaagguguuucu

SEQ ID NO: 2001817 - RNA, 15 nt, Homo sapiens
agaucacugccacac

SEQ ID NO: 2001818 - RNA, 14 nt, Homo sapiens
ggcacucccaucca

SEQ ID NO: 2001819 - RNA, 19 nt, Homo sapiens
agagcaagacucugucuca

SEQ ID NO: 2001820 - RNA, 12 nt, Homo sapiens
cucagccuaaga

SEQ ID NO: 2001821 - RNA, 19 nt, Homo sapiens
agagugagacuccaucuca

SEQ ID NO: 2001822 - RNA, 17 nt, Homo sapiens
auuuuuucaugaaagau

SEQ ID NO: 2001823 - RNA, 21 nt, Homo sapiens
auugccaaauugacauguugu

SEQ ID NO: 2001824 - RNA, 13 nt, Homo sapiens
caauguaucuuua

SEQ ID NO: 2001825 - RNA, 17 nt, Homo sapiens
ggcuccacgcccugggg

SEQ ID NO: 2001826 - RNA, 16 nt, Homo sapiens
gacaaaccgagugcaa

SEQ ID NO: 2001827 - RNA, 21 nt, Homo sapiens
auacuuuuucuuugaauuuag

SEQ ID NO: 2001828 - RNA, 13 nt, Homo sapiens
agccucacuccuc

SEQ ID NO: 2001829 - RNA, 15 nt, Homo sapiens
gugagagaaagccac

SEQ ID NO: 2001830 - RNA, 15 nt, Homo sapiens
auuauucaaaaacau

SEQ ID NO: 2001831 - RNA, 12 nt, Homo sapiens
ucaucuggcugc

SEQ ID NO: 2001832 - RNA, 22 nt, Homo sapiens
guccccagccugcucccuagcc

SEQ ID NO: 2001833 - RNA, 19 nt, Homo sapiens
cugccccacggcccuguca

SEQ ID NO: 2001834 - RNA, 21 nt, Homo sapiens
aaaacagucaucuagaauuca

SEQ ID NO: 2001835 - RNA, 14 nt, Homo sapiens
aaaacucucaguca

SEQ ID NO: 2001836 - RNA, 16 nt, Homo sapiens
cuugccucauuuugcu

SEQ ID NO: 2001837 - RNA, 19 nt, Homo sapiens
uauuuaaucuuaaucuguu

SEQ ID NO: 2001838 - RNA, 21 nt, Homo sapiens
ucugagcccccacugcuucua

SEQ ID NO: 2001839 - RNA, 22 nt, Homo sapiens
ucuuaaauuuugugauauggag

SEQ ID NO: 2001840 - RNA, 19 nt, Homo sapiens
aauagcauaucacagagag

SEQ ID NO: 2001841 - RNA, 18 nt, Homo sapiens
ucuccuguaagccaaaga

SEQ ID NO: 2001842 - RNA, 22 nt, Homo sapiens
uugauaggccuaguacaaucuu

SEQ ID NO: 2001843 - RNA, 16 nt, Homo sapiens
cauuuagcacauacua

SEQ ID NO: 2001844 - RNA, 23 nt, Homo sapiens
uacuggaaaaaaauacaaaaagc

SEQ ID NO: 2001845 - RNA, 19 nt, Homo sapiens
gccacauggcgcaugaagg

SEQ ID NO: 2001846 - RNA, 20 nt, Homo sapiens
aggacauugcggacagccac

SEQ ID NO: 2001847 - RNA, 17 nt, Homo sapiens
gagauauucuuauuuca

SEQ ID NO: 2001848 - RNA, 15 nt, Homo sapiens
cuguuuaagcuacua

SEQ ID NO: 2001849 - RNA, 22 nt, Homo sapiens
cagcaccugauucucacagcaa

SEQ ID NO: 2001850 - RNA, 16 nt, Homo sapiens
uguuccugacuuuaua

SEQ ID NO: 2001851 - RNA, 17 nt, Homo sapiens
aucaauugaccuuguga

SEQ ID NO: 2001852 - RNA, 17 nt, Homo sapiens
aaucaaaauaauacuuc

SEQ ID NO: 2001853 - RNA, 17 nt, Homo sapiens
ucauggcucacugcagc

SEQ ID NO: 2001854 - RNA, 15 nt, Homo sapiens
guuaacugagugccu

SEQ ID NO: 2001855 - RNA, 13 nt, Homo sapiens
augcagcuaccca

SEQ ID NO: 2001856 - RNA, 17 nt, Homo sapiens
cuguggccucucaguca

SEQ ID NO: 2001857 - RNA, 20 nt, Homo sapiens
uaaucugucaaaacacugug

SEQ ID NO: 2001858 - RNA, 23 nt, Homo sapiens
caaguagauuggcugggcaaaag

SEQ ID NO: 2001859 - RNA, 19 nt, Homo sapiens
cucaguagcugauucugaa

SEQ ID NO: 2001860 - RNA, 16 nt, Homo sapiens
cuuuaguuccuacuuu

SEQ ID NO: 2001861 - RNA, 15 nt, Homo sapiens
gaaacuauacauuua

SEQ ID NO: 2001862 - RNA, 20 nt, Homo sapiens
uuauguguuaugaacaucca

SEQ ID NO: 2001863 - RNA, 15 nt, Homo sapiens
caaugccaaucuuca

SEQ ID NO: 2001864 - RNA, 17 nt, Homo sapiens
acugguacucaagccag

SEQ ID NO: 2001865 - RNA, 19 nt, Homo sapiens
gaauuuauuuaaguucaca

SEQ ID NO: 2001866 - RNA, 19 nt, Homo sapiens
guauugucaccaggauuac

SEQ ID NO: 2001867 - RNA, 15 nt, Homo sapiens
ccauucagccucguc

SEQ ID NO: 2001868 - RNA, 14 nt, Homo sapiens
guucuuuccaugaa

SEQ ID NO: 2001869 - RNA, 18 nt, Homo sapiens
gccuccuguggucucagg

SEQ ID NO: 2001870 - RNA, 14 nt, Homo sapiens
aaaugucaucaggu

SEQ ID NO: 2001871 - RNA, 18 nt, Homo sapiens
gagccuuauaaacagaua

SEQ ID NO: 2001872 - RNA, 14 nt, Homo sapiens
cccgcuagcauuag

SEQ ID NO: 2001873 - RNA, 20 nt, Homo sapiens
acucuggggcuuguccugug

SEQ ID NO: 2001874 - RNA, 12 nt, Homo sapiens
acaacucuuugu

SEQ ID NO: 2001875 - RNA, 20 nt, Homo sapiens
ucuucuuuuuuuuaguuuac

SEQ ID NO: 2001876 - RNA, 22 nt, Homo sapiens
ucauuguuuaggggugaaggag

SEQ ID NO: 2001877 - RNA, 16 nt, Homo sapiens
gccaccgcccagagac

SEQ ID NO: 2001878 - RNA, 21 nt, Homo sapiens
cuuugaguugacuucugacaa

SEQ ID NO: 2001879 - RNA, 11 nt, Homo sapiens
ucuagccuuuu

SEQ ID NO: 2001880 - RNA, 19 nt, Homo sapiens
acagcccccacuccagucc

SEQ ID NO: 2001881 - RNA, 23 nt, Homo sapiens
uaucaguuacaguggcaguauug

SEQ ID NO: 2001882 - RNA, 18 nt, Homo sapiens
gauuuuuuagaucuuccu

SEQ ID NO: 2001883 - RNA, 20 nt, Homo sapiens
gcagcccucuccacccagag

SEQ ID NO: 2001884 - RNA, 21 nt, Homo sapiens
auuuucucuaaaauuucaaca

SEQ ID NO: 2001885 - RNA, 21 nt, Homo sapiens
uugcuaucggggaagccagac

SEQ ID NO: 2001886 - RNA, 14 nt, Homo sapiens
acucuuaagccauc

SEQ ID NO: 2001887 - RNA, 20 nt, Homo sapiens
uuuuaguagagacaggguuu

SEQ ID NO: 2001888 - RNA, 18 nt, Homo sapiens
cuuuucaaaacugcuaaa

SEQ ID NO: 2001889 - RNA, 14 nt, Homo sapiens
accuccacugcugc

SEQ ID NO: 2001890 - RNA, 13 nt, Homo sapiens
ucuagaauuccag

SEQ ID NO: 2001891 - RNA, 15 nt, Homo sapiens
aucauucccuucgac

SEQ ID NO: 2001892 - RNA, 21 nt, Homo sapiens
cuuuucuguccgagcuuugaa

SEQ ID NO: 2001893 - RNA, 16 nt, Homo sapiens
cacugcaacccaugag

SEQ ID NO: 2001894 - RNA, 16 nt, Homo sapiens
gucuccucucucugua

SEQ ID NO: 2001895 - RNA, 18 nt, Homo sapiens
gcuggguuugggcagugg

SEQ ID NO: 2001896 - RNA, 14 nt, Homo sapiens
ccgggcuccaggga

SEQ ID NO: 2001897 - RNA, 13 nt, Homo sapiens
acuccagugguga

SEQ ID NO: 2001898 - RNA, 17 nt, Homo sapiens
cugacagaaaugcaauc

SEQ ID NO: 2001899 - RNA, 21 nt, Homo sapiens
auguauuugauguauucugug

SEQ ID NO: 2001900 - RNA, 18 nt, Homo sapiens
uuuagcccaucucuccag

SEQ ID NO: 2001901 - RNA, 15 nt, Homo sapiens
uaucauacuguucaa

SEQ ID NO: 2001902 - RNA, 14 nt, Homo sapiens
aacuuaugacuaaa

SEQ ID NO: 2001903 - RNA, 16 nt, Homo sapiens
ccugacucacacuuac

SEQ ID NO: 2001904 - RNA, 13 nt, Homo sapiens
auuacaggcacau

SEQ ID NO: 2001905 - RNA, 20 nt, Homo sapiens
gcagacuagcuaauuagcuc

SEQ ID NO: 2001906 - RNA, 20 nt, Homo sapiens
auugcccauuguuuuucuga

SEQ ID NO: 2001907 - RNA, 14 nt, Homo sapiens
agaugguucuagca

SEQ ID NO: 2001908 - RNA, 23 nt, Homo sapiens
uccaaacaauuuagccagaaugu

SEQ ID NO: 2001909 - RNA, 21 nt, Homo sapiens
uauucuuuaguguuaaaauac

SEQ ID NO: 2001910 - RNA, 21 nt, Homo sapiens
ucacuucuaggguaugggaaa

SEQ ID NO: 2001911 - RNA, 22 nt, Homo sapiens
gcuguugauauuaaaaacaaac

SEQ ID NO: 2001912 - RNA, 18 nt, Homo sapiens
uucagacuccaaacagac

SEQ ID NO: 2001913 - RNA, 13 nt, Homo sapiens
cggcaaaagccca

SEQ ID NO: 2001914 - RNA, 17 nt, Homo sapiens
gagggagagucucccag

SEQ ID NO: 2001915 - RNA, 17 nt, Homo sapiens
auuccagugccaggcca

SEQ ID NO: 2001916 - RNA, 14 nt, Homo sapiens
gaggaauccucaga

SEQ ID NO: 2001917 - RNA, 20 nt, Homo sapiens
auuuggguucugccugccag

SEQ ID NO: 2001918 - RNA, 18 nt, Homo sapiens
gcuguggcagaguuacag

SEQ ID NO: 2001919 - RNA, 18 nt, Homo sapiens
ggaaacacuaggugccug

SEQ ID NO: 2001920 - RNA, 21 nt, Homo sapiens
cuuagggugcugagugccuga

SEQ ID NO: 2001921 - RNA, 15 nt, Homo sapiens
ccacuaugcacagau

SEQ ID NO: 2001922 - RNA, 16 nt, Homo sapiens
ccuccugggcccucuc

SEQ ID NO: 2001923 - RNA, 14 nt, Homo sapiens
acugagaaagccaa

SEQ ID NO: 2001924 - RNA, 15 nt, Homo sapiens
cacagcaaaccucuc

SEQ ID NO: 2001925 - RNA, 21 nt, Homo sapiens
guagugauuaacugugaauaa

SEQ ID NO: 2001926 - RNA, 18 nt, Homo sapiens
uacaaagaccuaccuaga

SEQ ID NO: 2001927 - RNA, 15 nt, Homo sapiens
cucccauccaagaaa

SEQ ID NO: 2001928 - RNA, 14 nt, Homo sapiens
caaaccaaagacca

SEQ ID NO: 2001929 - RNA, 19 nt, Homo sapiens
uaaaccuagaguuuuauca

SEQ ID NO: 2001930 - RNA, 15 nt, Homo sapiens
cagcccuugugaugu

SEQ ID NO: 2001931 - RNA, 19 nt, Homo sapiens
aacucuugauaacaccaag

SEQ ID NO: 2001932 - RNA, 13 nt, Homo sapiens
aaaaaauagagag

SEQ ID NO: 2001933 - RNA, 21 nt, Homo sapiens
uacugcuguuguugaaauuga

SEQ ID NO: 2001934 - RNA, 20 nt, Homo sapiens
ccaacguggggcagcacaga

SEQ ID NO: 2001935 - RNA, 14 nt, Homo sapiens
ugauaacucaggaa

SEQ ID NO: 2001936 - RNA, 19 nt, Homo sapiens
cuggggcugagggcauuaa

SEQ ID NO: 2001937 - RNA, 19 nt, Homo sapiens
gacucggagacuauggccu

SEQ ID NO: 2001938 - RNA, 16 nt, Homo sapiens
caugcaucacuauuca

SEQ ID NO: 2001939 - RNA, 15 nt, Homo sapiens
auuuaagcaaaggcu

SEQ ID NO: 2001940 - RNA, 16 nt, Homo sapiens
auuugcagcugcgaug

SEQ ID NO: 2001941 - RNA, 13 nt, Homo sapiens
cuggaucaguaaa

SEQ ID NO: 2001942 - RNA, 21 nt, Homo sapiens
uggcaugauggacaaaggccu

SEQ ID NO: 2001943 - RNA, 14 nt, Homo sapiens
uauugacaucucuu

SEQ ID NO: 2001944 - RNA, 20 nt, Homo sapiens
ugaaaaccguaaagugccuu

SEQ ID NO: 2001945 - RNA, 12 nt, Homo sapiens
cucaacuccucc

SEQ ID NO: 2001946 - RNA, 14 nt, Homo sapiens
gcuagggaccucgc

SEQ ID NO: 2001947 - RNA, 23 nt, Homo sapiens
ggcagugacagaacuaagaugau

SEQ ID NO: 2001948 - RNA, 20 nt, Homo sapiens
caucuaaauugaucauucau

SEQ ID NO: 2001949 - RNA, 17 nt, Homo sapiens
aaaucuaauaauuauuc

SEQ ID NO: 2001950 - RNA, 14 nt, Homo sapiens
gcugacacugugac

SEQ ID NO: 2001951 - RNA, 21 nt, Homo sapiens
ugaaucaucauaucuacuaua

SEQ ID NO: 2001952 - RNA, 14 nt, Homo sapiens
agaggacgugggac

SEQ ID NO: 2001953 - RNA, 13 nt, Homo sapiens
ugagcucaggcau

SEQ ID NO: 2001954 - RNA, 19 nt, Homo sapiens
guguggcccuggacacagc

SEQ ID NO: 2001955 - RNA, 21 nt, Homo sapiens
gucuacuugcucagguacuug

SEQ ID NO: 2001956 - RNA, 13 nt, Homo sapiens
uauacugcaaaag

SEQ ID NO: 2001957 - RNA, 13 nt, Homo sapiens
ucaugugcacuuc

SEQ ID NO: 2001958 - RNA, 12 nt, Homo sapiens
cauguuuccauc

SEQ ID NO: 2001959 - RNA, 13 nt, Homo sapiens
cuucccuuugauu

SEQ ID NO: 2001960 - RNA, 18 nt, Homo sapiens
guuaaagacagucauaua

SEQ ID NO: 2001961 - RNA, 13 nt, Homo sapiens
ucuugugcccuua

SEQ ID NO: 2001962 - RNA, 23 nt, Homo sapiens
gagacggggucucccuguguuac

SEQ ID NO: 2001963 - RNA, 21 nt, Homo sapiens
aaucccaagugucucuugacu

SEQ ID NO: 2001964 - RNA, 16 nt, Homo sapiens
acagaacuaagaugau

SEQ ID NO: 2001965 - RNA, 13 nt, Homo sapiens
cacccgugagaaa

SEQ ID NO: 2001966 - RNA, 22 nt, Homo sapiens
gcuccugauggugucauucugc

SEQ ID NO: 2001967 - RNA, 16 nt, Homo sapiens
agaggaaaagguguag

SEQ ID NO: 2001968 - RNA, 22 nt, Homo sapiens
gaugugcagccccuuccuggug

SEQ ID NO: 2001969 - RNA, 20 nt, Homo sapiens
agaaagggauugcugaggca

SEQ ID NO: 2001970 - RNA, 12 nt, Homo sapiens
uacucagcacug

SEQ ID NO: 2001971 - RNA, 13 nt, Homo sapiens
cagaguuugccuu

SEQ ID NO: 2001972 - RNA, 13 nt, Homo sapiens
cuuuugaccaaau

SEQ ID NO: 2001973 - RNA, 22 nt, Homo sapiens
augcucuguagccuaaacucca

SEQ ID NO: 2001974 - RNA, 18 nt, Homo sapiens
cugugagccggagcucau

SEQ ID NO: 2001975 - RNA, 14 nt, Homo sapiens
uccauuugggauau

SEQ ID NO: 2001976 - RNA, 18 nt, Homo sapiens
ugcccauccugacugaaa

SEQ ID NO: 2001977 - RNA, 23 nt, Homo sapiens
gugccuagacuguuacuuuggca

SEQ ID NO: 2001978 - RNA, 16 nt, Homo sapiens
aauaaaagaaucauuu

SEQ ID NO: 2001979 - RNA, 17 nt, Homo sapiens
auuccacuccacucagg

SEQ ID NO: 2001980 - RNA, 22 nt, Homo sapiens
guggguacuauucugauuacac

SEQ ID NO: 2001981 - RNA, 12 nt, Homo sapiens
ucuuuaccuccu

SEQ ID NO: 2001982 - RNA, 17 nt, Homo sapiens
ucuucuacacagcaaua

SEQ ID NO: 2001983 - RNA, 18 nt, Homo sapiens
uguaaagaauuuagcugu

SEQ ID NO: 2001984 - RNA, 16 nt, Homo sapiens
auauuucaaaugauua

SEQ ID NO: 2001985 - RNA, 19 nt, Homo sapiens
accuauucccaaaugccuu

SEQ ID NO: 2001986 - RNA, 13 nt, Homo sapiens
aguguugacauag

SEQ ID NO: 2001987 - RNA, 15 nt, Homo sapiens
ucccaguuaagugaa

SEQ ID NO: 2001988 - RNA, 15 nt, Homo sapiens
guuauaaaagcaaua

SEQ ID NO: 2001989 - RNA, 19 nt, Homo sapiens
ggaugaacucaaugcauga

SEQ ID NO: 2001990 - RNA, 13 nt, Homo sapiens
accugccucuucc

SEQ ID NO: 2001991 - RNA, 18 nt, Homo sapiens
gugcuacgaccaggguga

SEQ ID NO: 2001992 - RNA, 16 nt, Homo sapiens
cuuuguggcacugggg

SEQ ID NO: 2001993 - RNA, 20 nt, Homo sapiens
cagggagacguacguaucag

SEQ ID NO: 2001994 - RNA, 18 nt, Homo sapiens
cagaggcagcuaaggggc

SEQ ID NO: 2001995 - RNA, 20 nt, Homo sapiens
uaaauauauauauauuucuc

SEQ ID NO: 2001996 - RNA, 14 nt, Homo sapiens
uguguaugggggaa

SEQ ID NO: 2001997 - RNA, 22 nt, Homo sapiens
acuggcacgcgacgaggacgca

SEQ ID NO: 2001998 - RNA, 22 nt, Homo sapiens
auccuuuccacccuauucccua

SEQ ID NO: 2001999 - RNA, 19 nt, Homo sapiens
uacugcugagucagacugu

SEQ ID NO: 2002000 - RNA, 17 nt, Homo sapiens
gaccaucacccagauga

SEQ ID NO: 2002001 - RNA, 11 nt, Homo sapiens
caaacugaaga

SEQ ID NO: 2002002 - RNA, 11 nt, Homo sapiens
agcacugacac

SEQ ID NO: 2002003 - RNA, 15 nt, Homo sapiens
gccaaccccaaagaa

SEQ ID NO: 2002004 - RNA, 18 nt, Homo sapiens
aucaguaaucacuuuuca

SEQ ID NO: 2002005 - RNA, 11 nt, Homo sapiens
cugacccaggg

SEQ ID NO: 2002006 - RNA, 21 nt, Homo sapiens
uccuaagucugucauccucug

SEQ ID NO: 2002007 - RNA, 19 nt, Homo sapiens
gaagccuguggugugcgga

SEQ ID NO: 2002008 - RNA, 16 nt, Homo sapiens
aacugcaguuugauca

SEQ ID NO: 2002009 - RNA, 21 nt, Homo sapiens
cucagccacuugccugugcua

SEQ ID NO: 2002010 - RNA, 19 nt, Homo sapiens
aauaaagcauucuuuaaca

SEQ ID NO: 2002011 - RNA, 14 nt, Homo sapiens
cuuuuaacaugcau

SEQ ID NO: 2002012 - RNA, 19 nt, Homo sapiens
auguggcccucuggaucca

SEQ ID NO: 2002013 - RNA, 16 nt, Homo sapiens
gcccgggagcucagga

SEQ ID NO: 2002014 - RNA, 14 nt, Homo sapiens
uccgagccauguga

SEQ ID NO: 2002015 - RNA, 13 nt, Homo sapiens
agagaagcugaug

SEQ ID NO: 2002016 - RNA, 22 nt, Homo sapiens
uucucucugccugugagccagu

SEQ ID NO: 2002017 - RNA, 19 nt, Homo sapiens
cuuucuagguucaaaagaa

SEQ ID NO: 2002018 - RNA, 15 nt, Homo sapiens
cucacucggcuucca

SEQ ID NO: 2002019 - RNA, 12 nt, Homo sapiens
cacucuuugcca

SEQ ID NO: 2002020 - RNA, 21 nt, Homo sapiens
aaaugugucuuguauuaucau

SEQ ID NO: 2002021 - RNA, 13 nt, Homo sapiens
guuaauggucaca

SEQ ID NO: 2002022 - RNA, 21 nt, Homo sapiens
cucuauuuagcaacagaauua

SEQ ID NO: 2002023 - RNA, 12 nt, Homo sapiens
cucuauugccau

SEQ ID NO: 2002024 - RNA, 15 nt, Homo sapiens
agccgcagaccugga

SEQ ID NO: 2002025 - RNA, 13 nt, Homo sapiens
auucagaacuuua

SEQ ID NO: 2002026 - RNA, 20 nt, Homo sapiens
ccauaguuauuuacuugaaa

SEQ ID NO: 2002027 - RNA, 21 nt, Homo sapiens
accaaagaauuguaggcagug

SEQ ID NO: 2002028 - RNA, 19 nt, Homo sapiens
auuguaucaaaugugacau

SEQ ID NO: 2002029 - RNA, 13 nt, Homo sapiens
cuaccagucuauu

SEQ ID NO: 2002030 - RNA, 11 nt, Homo sapiens
aauccaugcuu

SEQ ID NO: 2002031 - RNA, 13 nt, Homo sapiens
aucuucauuugaa

SEQ ID NO: 2002032 - RNA, 22 nt, Homo sapiens
acccuguuuuaccguugcuaag

SEQ ID NO: 2002033 - RNA, 13 nt, Homo sapiens
caccaaguacagc

SEQ ID NO: 2002034 - RNA, 18 nt, Homo sapiens
aggaucuggagaaccuca

SEQ ID NO: 2002035 - RNA, 11 nt, Homo sapiens
aucuguugccu

SEQ ID NO: 2002036 - RNA, 17 nt, Homo sapiens
ugaagcagaaauguacu

SEQ ID NO: 2002037 - RNA, 23 nt, Homo sapiens
ggcacccacaaauaaaugacaag

SEQ ID NO: 2002038 - RNA, 13 nt, Homo sapiens
aaggaaggaugaa

SEQ ID NO: 2002039 - RNA, 21 nt, Homo sapiens
accaccccaacaaaccaucca

SEQ ID NO: 2002040 - RNA, 19 nt, Homo sapiens
gucugauuggcucacccaa

SEQ ID NO: 2002041 - RNA, 17 nt, Homo sapiens
ucagcaugcauccuuug

SEQ ID NO: 2002042 - RNA, 23 nt, Homo sapiens
aguuuuuuuaauguguuugcaau

SEQ ID NO: 2002043 - RNA, 14 nt, Homo sapiens
auccaauugcugcu

SEQ ID NO: 2002044 - RNA, 16 nt, Homo sapiens
agugagugccaugcuu

SEQ ID NO: 2002045 - RNA, 18 nt, Homo sapiens
aucaccucccaguacaac

SEQ ID NO: 2002046 - RNA, 15 nt, Homo sapiens
cccugccauuuacca

SEQ ID NO: 2002047 - RNA, 11 nt, Homo sapiens
aggggcccaag

SEQ ID NO: 2002048 - RNA, 15 nt, Homo sapiens
cuuccagugcucaga

SEQ ID NO: 2002049 - RNA, 19 nt, Homo sapiens
agaaaucagcuuuguuaaa

SEQ ID NO: 2002050 - RNA, 15 nt, Homo sapiens
ucuaguacugugaau

SEQ ID NO: 2002051 - RNA, 13 nt, Homo sapiens
gggagcugagggg

SEQ ID NO: 2002052 - RNA, 17 nt, Homo sapiens
aacauuccaaugcauug

SEQ ID NO: 2002053 - RNA, 18 nt, Homo sapiens
cuaugaaagcuaugaaug

SEQ ID NO: 2002054 - RNA, 19 nt, Homo sapiens
cugaguagcugggacuaca

SEQ ID NO: 2002055 - RNA, 22 nt, Homo sapiens
aagccucuaguguaccaagugc

SEQ ID NO: 2002056 - RNA, 22 nt, Homo sapiens
cuagcacaugcccuaaugucug

SEQ ID NO: 2002057 - RNA, 21 nt, Homo sapiens
uacaugcauugagcucucuca

SEQ ID NO: 2002058 - RNA, 14 nt, Homo sapiens
gaggagccagagaa

SEQ ID NO: 2002059 - RNA, 14 nt, Homo sapiens
ggacuaccaagcug

SEQ ID NO: 2002060 - RNA, 19 nt, Homo sapiens
gaauuaaaacuuuaaggaa

SEQ ID NO: 2002061 - RNA, 18 nt, Homo sapiens
guuuugugugguauucaa

SEQ ID NO: 2002062 - RNA, 11 nt, Homo sapiens
ugcucuugccu

SEQ ID NO: 2002063 - RNA, 12 nt, Homo sapiens
ccaaaccaaaau

SEQ ID NO: 2002064 - RNA, 18 nt, Homo sapiens
ccacugcguuguccacaa

SEQ ID NO: 2002065 - RNA, 17 nt, Homo sapiens
acccauucagagacugu

SEQ ID NO: 2002066 - RNA, 22 nt, Homo sapiens
cauugacuuaggggaguucagu

SEQ ID NO: 2002067 - RNA, 15 nt, Homo sapiens
cacagugguggugcc

SEQ ID NO: 2002068 - RNA, 17 nt, Homo sapiens
ugacgcagccugagaau

SEQ ID NO: 2002069 - RNA, 14 nt, Homo sapiens
guauccuacuacuu

SEQ ID NO: 2002070 - RNA, 23 nt, Homo sapiens
aauuuuaagcuguacacuuucaa

SEQ ID NO: 2002071 - RNA, 18 nt, Homo sapiens
uaaacuuauuuacaaaua

SEQ ID NO: 2002072 - RNA, 24 nt, Homo sapiens
cgaucaagagaaucaacagaugau

SEQ ID NO: 2002073 - RNA, 16 nt, Homo sapiens
aaaacuuaugaccucu

SEQ ID NO: 2002074 - RNA, 15 nt, Homo sapiens
uuuguccucucugug

SEQ ID NO: 2002075 - RNA, 23 nt, Homo sapiens
uugugaacaccuccuagccacau

SEQ ID NO: 2002076 - RNA, 14 nt, Homo sapiens
uucaccagagcauu

SEQ ID NO: 2002077 - RNA, 20 nt, Homo sapiens
aucugaaaauaaagugucau

SEQ ID NO: 2002078 - RNA, 13 nt, Homo sapiens
gcauguagacugu

SEQ ID NO: 2002079 - RNA, 20 nt, Homo sapiens
auaaugucauuaaacaugac

SEQ ID NO: 2002080 - RNA, 23 nt, Homo sapiens
gacaaauccuugaauguucucuu

SEQ ID NO: 2002081 - RNA, 14 nt, Homo sapiens
cagcgucaacaucg

SEQ ID NO: 2002082 - RNA, 16 nt, Homo sapiens
cagguauaaguucuau

SEQ ID NO: 2002083 - RNA, 16 nt, Homo sapiens
agacaagacauugugu

SEQ ID NO: 2002084 - RNA, 13 nt, Homo sapiens
cugggaggggcaa

SEQ ID NO: 2002085 - RNA, 14 nt, Homo sapiens
gcucaaugccauug

SEQ ID NO: 2002086 - RNA, 18 nt, Homo sapiens
ucacucuguugccauuaa

SEQ ID NO: 2002087 - RNA, 16 nt, Homo sapiens
ccucugggaaggugac

SEQ ID NO: 2002088 - RNA, 12 nt, Homo sapiens
accaaugcacac

SEQ ID NO: 2002089 - RNA, 15 nt, Homo sapiens
uacuuaucuuaugcc

SEQ ID NO: 2002090 - RNA, 18 nt, Homo sapiens
caauaaugaaugagcagu

SEQ ID NO: 2002091 - RNA, 22 nt, Homo sapiens
aagcaaaugcuacauauaugca

SEQ ID NO: 2002092 - RNA, 13 nt, Homo sapiens
gauauugcagcuu

SEQ ID NO: 2002093 - RNA, 21 nt, Homo sapiens
ucaggauugaggaugaacuca

SEQ ID NO: 2002094 - RNA, 18 nt, Homo sapiens
gaaguggagaggguguca

SEQ ID NO: 2002095 - RNA, 13 nt, Homo sapiens
acaggcacggguc

SEQ ID NO: 2002096 - RNA, 13 nt, Homo sapiens
aagacaagcauuu

SEQ ID NO: 2002097 - RNA, 17 nt, Homo sapiens
ccaguggaacagucuuc

SEQ ID NO: 2002098 - RNA, 22 nt, Homo sapiens
ucgaauacuggggauuaccauu

SEQ ID NO: 2002099 - RNA, 16 nt, Homo sapiens
gcaaugagacuacaac

SEQ ID NO: 2002100 - RNA, 16 nt, Homo sapiens
ucuucuacaaccagag

SEQ ID NO: 2002101 - RNA, 21 nt, Homo sapiens
gucaugacggggacagaguga

SEQ ID NO: 2002102 - RNA, 24 nt, Homo sapiens
acuuccuugcaggagugacucaag

SEQ ID NO: 2002103 - RNA, 20 nt, Homo sapiens
augugauuguugaaguacaa

SEQ ID NO: 2002104 - RNA, 18 nt, Homo sapiens
auaaagcuuuuccugcau

SEQ ID NO: 2002105 - RNA, 18 nt, Homo sapiens
cauuguuguucugcucaa

SEQ ID NO: 2002106 - RNA, 12 nt, Homo sapiens
gaggucacugga

SEQ ID NO: 2002107 - RNA, 18 nt, Homo sapiens
uaccagcggggacaccaa

SEQ ID NO: 2002108 - RNA, 20 nt, Homo sapiens
ugaacaaaaaaaacaaaaag

SEQ ID NO: 2002109 - RNA, 14 nt, Homo sapiens
uuccaccugccaca

SEQ ID NO: 2002110 - RNA, 22 nt, Homo sapiens
augccaacuuaaguauuuacag

SEQ ID NO: 2002111 - RNA, 19 nt, Homo sapiens
caggaacccaccaaaccaa

SEQ ID NO: 2002112 - RNA, 20 nt, Homo sapiens
acagcuggggacaacugcgg

SEQ ID NO: 2002113 - RNA, 17 nt, Homo sapiens
cuaguucuuaugagcua

SEQ ID NO: 2002114 - RNA, 21 nt, Homo sapiens
acaaugccuuugaugaacugu

SEQ ID NO: 2002115 - RNA, 19 nt, Homo sapiens
agcugaauccuuccauuuc

SEQ ID NO: 2002116 - RNA, 17 nt, Homo sapiens
acaacagcccugucuca

SEQ ID NO: 2002117 - RNA, 20 nt, Homo sapiens
uacuguucuauacgagugac

SEQ ID NO: 2002118 - RNA, 21 nt, Homo sapiens
cugggauguuuugagggucuu

SEQ ID NO: 2002119 - RNA, 21 nt, Homo sapiens
ugugaccaucccaacaccuca

SEQ ID NO: 2002120 - RNA, 14 nt, Homo sapiens
ucugguuuugcuau

SEQ ID NO: 2002121 - RNA, 16 nt, Homo sapiens
uaacuuaacauugcau

SEQ ID NO: 2002122 - RNA, 19 nt, Homo sapiens
gccuuuaguucuccacugg

SEQ ID NO: 2002123 - RNA, 15 nt, Homo sapiens
aguaaaugaacaaaa

SEQ ID NO: 2002124 - RNA, 15 nt, Homo sapiens
ugcgugaguaugugu

SEQ ID NO: 2002125 - RNA, 16 nt, Homo sapiens
ucuggagucacaucag

SEQ ID NO: 2002126 - RNA, 18 nt, Homo sapiens
agguggagguugcaguga

SEQ ID NO: 2002127 - RNA, 19 nt, Homo sapiens
gcauuucuuuucuggccaa

SEQ ID NO: 2002128 - RNA, 18 nt, Homo sapiens
gaacuguuggcugcuccc

SEQ ID NO: 2002129 - RNA, 20 nt, Homo sapiens
gagaguccagugaguccagg

SEQ ID NO: 2002130 - RNA, 22 nt, Homo sapiens
cuuaguaaaaagcccuauguga

SEQ ID NO: 2002131 - RNA, 13 nt, Homo sapiens
aauauucaguggu

SEQ ID NO: 2002132 - RNA, 23 nt, Homo sapiens
cucacaggacaugcuuugugcca

SEQ ID NO: 2002133 - RNA, 22 nt, Homo sapiens
agaugcaaguggcugaggccaa

SEQ ID NO: 2002134 - RNA, 15 nt, Homo sapiens
guggucagcagaaac

SEQ ID NO: 2002135 - RNA, 15 nt, Homo sapiens
uccugacacuuuaau

SEQ ID NO: 2002136 - RNA, 17 nt, Homo sapiens
ccuuuaguaccugaaaa

SEQ ID NO: 2002137 - RNA, 12 nt, Homo sapiens
gaaaaacaacca

SEQ ID NO: 2002138 - RNA, 14 nt, Homo sapiens
uaauaaaauaucau

SEQ ID NO: 2002139 - RNA, 18 nt, Homo sapiens
uagaaaauuguccuccuu

SEQ ID NO: 2002140 - RNA, 16 nt, Homo sapiens
cuuccucagcuguaga

SEQ ID NO: 2002141 - RNA, 11 nt, Homo sapiens
cagccggagau

SEQ ID NO: 2002142 - RNA, 14 nt, Homo sapiens
guguggcugaugau

SEQ ID NO: 2002143 - RNA, 17 nt, Homo sapiens
agccagcugcuuuuugu

SEQ ID NO: 2002144 - RNA, 23 nt, Homo sapiens
uugaaaaaaagggcacucugaua

SEQ ID NO: 2002145 - RNA, 20 nt, Homo sapiens
acugcagugaacacaugcca

SEQ ID NO: 2002146 - RNA, 12 nt, Homo sapiens
acuuggccaguu

SEQ ID NO: 2002147 - RNA, 21 nt, Homo sapiens
uuuugucugcuuaguaucuca

SEQ ID NO: 2002148 - RNA, 21 nt, Homo sapiens
aagaccacacuugguguuacc

SEQ ID NO: 2002149 - RNA, 19 nt, Homo sapiens
ugaaauauuuugaauacac

SEQ ID NO: 2002150 - RNA, 15 nt, Homo sapiens
cuuuauccacuuuuc

SEQ ID NO: 2002151 - RNA, 16 nt, Homo sapiens
caguuucagcucacuu

SEQ ID NO: 2002152 - RNA, 21 nt, Homo sapiens
gcaaugaucagacuugauuua

SEQ ID NO: 2002153 - RNA, 21 nt, Homo sapiens
guuaugagaaauuagucacuu

SEQ ID NO: 2002154 - RNA, 13 nt, Homo sapiens
ggcuguucugcac

SEQ ID NO: 2002155 - RNA, 19 nt, Homo sapiens
uuaaacccauacaauguau

SEQ ID NO: 2002156 - RNA, 21 nt, Homo sapiens
aacuaaagugcugcacucaaa

SEQ ID NO: 2002157 - RNA, 14 nt, Homo sapiens
agguagauaccaaa

SEQ ID NO: 2002158 - RNA, 23 nt, Homo sapiens
ugcaugaugagucugaaggcauu

SEQ ID NO: 2002159 - RNA, 15 nt, Homo sapiens
gacagaacgagacuc

SEQ ID NO: 2002160 - RNA, 23 nt, Homo sapiens
ccaaauaaacucuaaacauuaau

SEQ ID NO: 2002161 - RNA, 14 nt, Homo sapiens
acauaccuucaugu

SEQ ID NO: 2002162 - RNA, 17 nt, Homo sapiens
uugaaacuaacuguugg

SEQ ID NO: 2002163 - RNA, 17 nt, Homo sapiens
uguucuuagguuuacug

SEQ ID NO: 2002164 - RNA, 17 nt, Homo sapiens
uuccccucagagcucuu

SEQ ID NO: 2002165 - RNA, 18 nt, Homo sapiens
guucuuacuacuugccac

SEQ ID NO: 2002166 - RNA, 20 nt, Homo sapiens
acugcuucccuuacuuugcu

SEQ ID NO: 2002167 - RNA, 21 nt, Homo sapiens
caccccucaaaaaaagccuuu

SEQ ID NO: 2002168 - RNA, 23 nt, Homo sapiens
agucgugccuguuugcuuagcau

SEQ ID NO: 2002169 - RNA, 19 nt, Homo sapiens
aaauuucaaaagacauguu

SEQ ID NO: 2002170 - RNA, 20 nt, Homo sapiens
cuagaagcacauguguauuu

SEQ ID NO: 2002171 - RNA, 16 nt, Homo sapiens
aaugcacucagacugu

SEQ ID NO: 2002172 - RNA, 15 nt, Homo sapiens
ucaucccacacugua

SEQ ID NO: 2002173 - RNA, 13 nt, Homo sapiens
gcaugauggugca

SEQ ID NO: 2002174 - RNA, 15 nt, Homo sapiens
acaucuggucuucca

SEQ ID NO: 2002175 - RNA, 15 nt, Homo sapiens
uaaaauggaauaaca

SEQ ID NO: 2002176 - RNA, 19 nt, Homo sapiens
auaaaguucagauguuuca

SEQ ID NO: 2002177 - RNA, 18 nt, Homo sapiens
ugguuucaauaaaccuaa

SEQ ID NO: 2002178 - RNA, 19 nt, Homo sapiens
ucuugcugcuagaacuuuu

SEQ ID NO: 2002179 - RNA, 17 nt, Homo sapiens
ggugauggggcugagca

SEQ ID NO: 2002180 - RNA, 21 nt, Homo sapiens
uggagagaccagccuuucuuc

SEQ ID NO: 2002181 - RNA, 11 nt, Homo sapiens
caucuaagaca

SEQ ID NO: 2002182 - RNA, 14 nt, Homo sapiens
ggcugcuuugccuc

SEQ ID NO: 2002183 - RNA, 15 nt, Homo sapiens
aauuagaaacauaaa

SEQ ID NO: 2002184 - RNA, 20 nt, Homo sapiens
ccuauuuggggcuugcaugc

SEQ ID NO: 2002185 - RNA, 20 nt, Homo sapiens
aagcucuugaagacacugaa

SEQ ID NO: 2002186 - RNA, 16 nt, Homo sapiens
agaugucuaagacagg

SEQ ID NO: 2002187 - RNA, 13 nt, Homo sapiens
uggcacacaccug

SEQ ID NO: 2002188 - RNA, 18 nt, Homo sapiens
ccuucucugcagcucuga

SEQ ID NO: 2002189 - RNA, 13 nt, Homo sapiens
cugcaggugcugc

SEQ ID NO: 2002190 - RNA, 21 nt, Homo sapiens
uguguacagaaacaacugcca

SEQ ID NO: 2002191 - RNA, 20 nt, Homo sapiens
ugggagagucucacuuugga

SEQ ID NO: 2002192 - RNA, 22 nt, Homo sapiens
ccaggugggcgggcagcacagc

SEQ ID NO: 2002193 - RNA, 14 nt, Homo sapiens
aaaguacuaauaga

SEQ ID NO: 2002194 - RNA, 13 nt, Homo sapiens
caacuuuaaguaa

SEQ ID NO: 2002195 - RNA, 13 nt, Homo sapiens
auccuaagacaca

SEQ ID NO: 2002196 - RNA, 14 nt, Homo sapiens
ccugugcucaaaaa

SEQ ID NO: 2002197 - RNA, 23 nt, Homo sapiens
aacaggagaauuuuacuguguuu

SEQ ID NO: 2002198 - RNA, 12 nt, Homo sapiens
ccacacccaaag

SEQ ID NO: 2002199 - RNA, 15 nt, Homo sapiens
aauuccaugcacucu

SEQ ID NO: 2002200 - RNA, 21 nt, Homo sapiens
ugcaaaaaaaaacuuugacaa

SEQ ID NO: 2002201 - RNA, 12 nt, Homo sapiens
acacacauacau

SEQ ID NO: 2002202 - RNA, 21 nt, Homo sapiens
ugcacauccauucccaagaaa

SEQ ID NO: 2002203 - RNA, 15 nt, Homo sapiens
cuguccacaugaccu

SEQ ID NO: 2002204 - RNA, 17 nt, Homo sapiens
cacaaagaccaaaauga

SEQ ID NO: 2002205 - RNA, 16 nt, Homo sapiens
uggauguaauucucau

SEQ ID NO: 2002206 - RNA, 22 nt, Homo sapiens
accaaagccaccagacugacaa

SEQ ID NO: 2002207 - RNA, 16 nt, Homo sapiens
uacuuacauaucugac

SEQ ID NO: 2002208 - RNA, 18 nt, Homo sapiens
ucaggagcagcacucuua

SEQ ID NO: 2002209 - RNA, 15 nt, Homo sapiens
uuucccuugaacugu

SEQ ID NO: 2002210 - RNA, 15 nt, Homo sapiens
auuuuacuacaguaa

SEQ ID NO: 2002211 - RNA, 24 nt, Homo sapiens
caaaaucuaccaggucaaaauagu

SEQ ID NO: 2002212 - RNA, 19 nt, Homo sapiens
gccgagccugcacuggggc

SEQ ID NO: 2002213 - RNA, 18 nt, Homo sapiens
ccagccucuuaucacugg

SEQ ID NO: 2002214 - RNA, 22 nt, Homo sapiens
auggggauggcuggggcucucu

SEQ ID NO: 2002215 - RNA, 21 nt, Homo sapiens
acauugugaacagaaguuuaa

SEQ ID NO: 2002216 - RNA, 15 nt, Homo sapiens
auacaaaacuguuca

SEQ ID NO: 2002217 - RNA, 17 nt, Homo sapiens
agugauugcagcuuuau

SEQ ID NO: 2002218 - RNA, 21 nt, Homo sapiens
cguuuugaaauaaaaagagua

SEQ ID NO: 2002219 - RNA, 17 nt, Homo sapiens
caagucaccaugcugaa

SEQ ID NO: 2002220 - RNA, 19 nt, Homo sapiens
cuccucucuagaaccuccu

SEQ ID NO: 2002221 - RNA, 16 nt, Homo sapiens
uccuuccauuggcaga

SEQ ID NO: 2002222 - RNA, 22 nt, Homo sapiens
ucaccauugcugucaaguuccu

SEQ ID NO: 2002223 - RNA, 21 nt, Homo sapiens
augaauauauuuaagcaacau

SEQ ID NO: 2002224 - RNA, 20 nt, Homo sapiens
uggugcuaaagauuguuaaa

SEQ ID NO: 2002225 - RNA, 15 nt, Homo sapiens
aauugaucauucaua

SEQ ID NO: 2002226 - RNA, 19 nt, Homo sapiens
uucccaauaucaugugauu

SEQ ID NO: 2002227 - RNA, 21 nt, Homo sapiens
aaaccuccaaauguccuuaaa

SEQ ID NO: 2002228 - RNA, 18 nt, Homo sapiens
accagccuggcccacccc

SEQ ID NO: 2002229 - RNA, 19 nt, Homo sapiens
agucccuccccaaaugcuu

SEQ ID NO: 2002230 - RNA, 22 nt, Homo sapiens
auacuuuuaaagccuauucacu

SEQ ID NO: 2002231 - RNA, 14 nt, Homo sapiens
gcacauuacauuua

SEQ ID NO: 2002232 - RNA, 14 nt, Homo sapiens
cagccuaccagaga

SEQ ID NO: 2002233 - RNA, 20 nt, Homo sapiens
ccaccuugaccguaggggaa

SEQ ID NO: 2002234 - RNA, 15 nt, Homo sapiens
gccuugccaugucuu

SEQ ID NO: 2002235 - RNA, 22 nt, Homo sapiens
aaaaucuauauuugucuuccga

SEQ ID NO: 2002236 - RNA, 22 nt, Homo sapiens
gccacaaaugugucccagugaa

SEQ ID NO: 2002237 - RNA, 12 nt, Homo sapiens
augcagacacac

SEQ ID NO: 2002238 - RNA, 21 nt, Homo sapiens
gaaggaccugcucccacaggg

SEQ ID NO: 2002239 - RNA, 20 nt, Homo sapiens
ucauaugaaaaaaaugcauu

SEQ ID NO: 2002240 - RNA, 16 nt, Homo sapiens
aaaugaaauccaguga

SEQ ID NO: 2002241 - RNA, 20 nt, Homo sapiens
aauuaucacaauguacuaua

SEQ ID NO: 2002242 - RNA, 18 nt, Homo sapiens
augugcauuucugugaug

SEQ ID NO: 2002243 - RNA, 18 nt, Homo sapiens
uaccauaagugacaccaa

SEQ ID NO: 2002244 - RNA, 20 nt, Homo sapiens
aaugaccaggccaagacuca

SEQ ID NO: 2002245 - RNA, 17 nt, Homo sapiens
gucuguccuugaaggac

SEQ ID NO: 2002246 - RNA, 15 nt, Homo sapiens
uggugcacuucuuac

SEQ ID NO: 2002247 - RNA, 16 nt, Homo sapiens
cuccuuggccacagac

SEQ ID NO: 2002248 - RNA, 22 nt, Homo sapiens
ugcacaccagugucgugucugc

SEQ ID NO: 2002249 - RNA, 17 nt, Homo sapiens
cccuaggauacccagau

SEQ ID NO: 2002250 - RNA, 20 nt, Homo sapiens
aagcccgauccacauugcau

SEQ ID NO: 2002251 - RNA, 15 nt, Homo sapiens
aaaccuuucaauuca

SEQ ID NO: 2002252 - RNA, 22 nt, Homo sapiens
gcgguccugggauggggcaugu

SEQ ID NO: 2002253 - RNA, 18 nt, Homo sapiens
aauauuagaagccugcag

SEQ ID NO: 2002254 - RNA, 21 nt, Homo sapiens
aagaacauuauucaucucucc

SEQ ID NO: 2002255 - RNA, 14 nt, Homo sapiens
aaagaauucuucca

SEQ ID NO: 2002256 - RNA, 19 nt, Homo sapiens
cucucuccaucuaccuucc

SEQ ID NO: 2002257 - RNA, 17 nt, Homo sapiens
uuaaacuucaccuacaa

SEQ ID NO: 2002258 - RNA, 14 nt, Homo sapiens
acaaaaauuugcca

SEQ ID NO: 2002259 - RNA, 15 nt, Homo sapiens
caccccaacucuccc

SEQ ID NO: 2002260 - RNA, 13 nt, Homo sapiens
ugcuccaccagca

SEQ ID NO: 2002261 - RNA, 20 nt, Homo sapiens
uauauaauuuccucacugcc

SEQ ID NO: 2002262 - RNA, 16 nt, Homo sapiens
gagcucccucgcugua

SEQ ID NO: 2002263 - RNA, 18 nt, Homo sapiens
ccugaagcccucugucua

SEQ ID NO: 2002264 - RNA, 24 nt, Homo sapiens
ugucucugacaaugcguggcacau

SEQ ID NO: 2002265 - RNA, 18 nt, Homo sapiens
aaugauuucaagguuugu

SEQ ID NO: 2002266 - RNA, 20 nt, Homo sapiens
gcauggcugagcugcccaca

SEQ ID NO: 2002267 - RNA, 12 nt, Homo sapiens
acuaaacauaca

SEQ ID NO: 2002268 - RNA, 14 nt, Homo sapiens
cauugcacaaggca

SEQ ID NO: 2002269 - RNA, 18 nt, Homo sapiens
cuggaccccaucugugaa

SEQ ID NO: 2002270 - RNA, 12 nt, Homo sapiens
ccagaaaugucu

SEQ ID NO: 2002271 - RNA, 12 nt, Homo sapiens
cauacccaugca

SEQ ID NO: 2002272 - RNA, 22 nt, Homo sapiens
cacuuuaaauaugaaagccuag

SEQ ID NO: 2002273 - RNA, 15 nt, Homo sapiens
uuauguacuguaaac

SEQ ID NO: 2002274 - RNA, 13 nt, Homo sapiens
augacuucuccag

SEQ ID NO: 2002275 - RNA, 20 nt, Homo sapiens
uccucagccuccucaucugg

SEQ ID NO: 2002276 - RNA, 15 nt, Homo sapiens
uauaaaccccucaga

SEQ ID NO: 2002277 - RNA, 23 nt, Homo sapiens
acuugagggacgacuuucuuuaa

SEQ ID NO: 2002278 - RNA, 18 nt, Homo sapiens
auuucaugaauacauugu

SEQ ID NO: 2002279 - RNA, 15 nt, Homo sapiens
cucuuauuugguaua

SEQ ID NO: 2002280 - RNA, 13 nt, Homo sapiens
ugaguacagaauu

SEQ ID NO: 2002281 - RNA, 13 nt, Homo sapiens
ugagucugucaca

SEQ ID NO: 2002282 - RNA, 19 nt, Homo sapiens
uaccacucuguaauugcaa

SEQ ID NO: 2002283 - RNA, 21 nt, Homo sapiens
auaccauguauucacacuuua

SEQ ID NO: 2002284 - RNA, 21 nt, Homo sapiens
gagaccccaggaacaauaaaa

SEQ ID NO: 2002285 - RNA, 13 nt, Homo sapiens
aagaauagucaua

SEQ ID NO: 2002286 - RNA, 22 nt, Homo sapiens
uggaacuguccuucccucaaag

SEQ ID NO: 2002287 - RNA, 19 nt, Homo sapiens
cauagaaauguagguccuc

SEQ ID NO: 2002288 - RNA, 13 nt, Homo sapiens
augcuucuuggcu

SEQ ID NO: 2002289 - RNA, 16 nt, Homo sapiens
aacuuuugugcucccc

SEQ ID NO: 2002290 - RNA, 18 nt, Homo sapiens
augggaauuuuaacuuuu

SEQ ID NO: 2002291 - RNA, 14 nt, Homo sapiens
gugaaaaaggaaua

SEQ ID NO: 2002292 - RNA, 14 nt, Homo sapiens
auaauaaaaggaaa

SEQ ID NO: 2002293 - RNA, 21 nt, Homo sapiens
uuuaauagaaagauacaaccu

SEQ ID NO: 2002294 - RNA, 19 nt, Homo sapiens
agucauuaugagaggcaau

SEQ ID NO: 2002295 - RNA, 13 nt, Homo sapiens
gcuucuugugaaa

SEQ ID NO: 2002296 - RNA, 18 nt, Homo sapiens
guagauaacugcauuuug

SEQ ID NO: 2002297 - RNA, 16 nt, Homo sapiens
cuccaagucacaaaga

SEQ ID NO: 2002298 - RNA, 14 nt, Homo sapiens
cuuuacugugcuua

SEQ ID NO: 2002299 - RNA, 22 nt, Homo sapiens
ggcuuccucccagacuugccuu

SEQ ID NO: 2002300 - RNA, 21 nt, Homo sapiens
ccgagugcucugaugcaauag

SEQ ID NO: 2002301 - RNA, 20 nt, Homo sapiens
aaguaauugccuacaauaaa

SEQ ID NO: 2002302 - RNA, 15 nt, Homo sapiens
ggaaagguaguguau

SEQ ID NO: 2002303 - RNA, 23 nt, Homo sapiens
ccauguggcugaagacauuccaa

SEQ ID NO: 2002304 - RNA, 19 nt, Homo sapiens
cucagcucuuggcuccacu

SEQ ID NO: 2002305 - RNA, 16 nt, Homo sapiens
caagaucaaacuucca

SEQ ID NO: 2002306 - RNA, 18 nt, Homo sapiens
caaaagcuuuuugaugua

SEQ ID NO: 2002307 - RNA, 23 nt, Homo sapiens
ucccuaagaauucccagauaguc

SEQ ID NO: 2002308 - RNA, 23 nt, Homo sapiens
uggccauuacccccagcuuugag

SEQ ID NO: 2002309 - RNA, 18 nt, Homo sapiens
gagccaugucaugugcca

SEQ ID NO: 2002310 - RNA, 14 nt, Homo sapiens
guuauucuucaaac

SEQ ID NO: 2002311 - RNA, 14 nt, Homo sapiens
cuguauucacuuau

SEQ ID NO: 2002312 - RNA, 12 nt, Homo sapiens
ugugccuggaaa

SEQ ID NO: 2002313 - RNA, 17 nt, Homo sapiens
gaaagagagaagccagc

SEQ ID NO: 2002314 - RNA, 23 nt, Homo sapiens
augucuguuuaagaaaaguauuu

SEQ ID NO: 2002315 - RNA, 13 nt, Homo sapiens
ucccugccagugu

SEQ ID NO: 2002316 - RNA, 19 nt, Homo sapiens
uuucucccccuuuccaaaa

SEQ ID NO: 2002317 - RNA, 20 nt, Homo sapiens
gcagaaucuguuaccagagg

SEQ ID NO: 2002318 - RNA, 21 nt, Homo sapiens
cagcucuguaucugccaugug

SEQ ID NO: 2002319 - RNA, 18 nt, Homo sapiens
auucguacauaauacuga

SEQ ID NO: 2002320 - RNA, 13 nt, Homo sapiens
gucauuguauuca

SEQ ID NO: 2002321 - RNA, 13 nt, Homo sapiens
aacauugugauca

SEQ ID NO: 2002322 - RNA, 13 nt, Homo sapiens
agggauuacuuau

SEQ ID NO: 2002323 - RNA, 14 nt, Homo sapiens
aaaaugacuguaga

SEQ ID NO: 2002324 - RNA, 22 nt, Homo sapiens
ccucuaauaugccuaaucugua

SEQ ID NO: 2002325 - RNA, 14 nt, Homo sapiens
ugaagucacauuag

SEQ ID NO: 2002326 - RNA, 17 nt, Homo sapiens
ucucauuuggacuugcu

SEQ ID NO: 2002327 - RNA, 15 nt, Homo sapiens
cauucaaaaugucca

SEQ ID NO: 2002328 - RNA, 17 nt, Homo sapiens
aaaacaaggaugaauua

SEQ ID NO: 2002329 - RNA, 15 nt, Homo sapiens
acacucuugguagaa

SEQ ID NO: 2002330 - RNA, 14 nt, Homo sapiens
ccucauuuaccaua

SEQ ID NO: 2002331 - RNA, 14 nt, Homo sapiens
aaucuuuucacaaa

SEQ ID NO: 2002332 - RNA, 16 nt, Homo sapiens
aacuuucuuacacuga

SEQ ID NO: 2002333 - RNA, 22 nt, Homo sapiens
caguguggggaagcccauuccu

SEQ ID NO: 2002334 - RNA, 17 nt, Homo sapiens
caaguagcuggaauuac

SEQ ID NO: 2002335 - RNA, 17 nt, Homo sapiens
uccaagugugugugcaa

SEQ ID NO: 2002336 - RNA, 19 nt, Homo sapiens
ugcaaauaaauuaugcaau

SEQ ID NO: 2002337 - RNA, 21 nt, Homo sapiens
auuucucccuuguccaaaguc

SEQ ID NO: 2002338 - RNA, 20 nt, Homo sapiens
guaaggauaugagccuuugc

SEQ ID NO: 2002339 - RNA, 16 nt, Homo sapiens
aucacagccucugaaa

SEQ ID NO: 2002340 - RNA, 21 nt, Homo sapiens
augaucuguggagaauguaca

SEQ ID NO: 2002341 - RNA, 18 nt, Homo sapiens
auuucauuucaggugcau

SEQ ID NO: 2002342 - RNA, 19 nt, Homo sapiens
auucuauuacgugcaauac

SEQ ID NO: 2002343 - RNA, 15 nt, Homo sapiens
gaguaaaccuugaag

SEQ ID NO: 2002344 - RNA, 22 nt, Homo sapiens
gugagacaguccagccuggaga

SEQ ID NO: 2002345 - RNA, 15 nt, Homo sapiens
gaaugagccaaagaa

SEQ ID NO: 2002346 - RNA, 15 nt, Homo sapiens
gacagaaccacugag

SEQ ID NO: 2002347 - RNA, 15 nt, Homo sapiens
aggaauagcauguca

SEQ ID NO: 2002348 - RNA, 16 nt, Homo sapiens
ucauuccauguccaua

SEQ ID NO: 2002349 - RNA, 24 nt, Homo sapiens
caguugucccgauuguaacucaaa

SEQ ID NO: 2002350 - RNA, 15 nt, Homo sapiens
uuaguugagauuuca

SEQ ID NO: 2002351 - RNA, 19 nt, Homo sapiens
cuuaucuuggaaucaugca

SEQ ID NO: 2002352 - RNA, 19 nt, Homo sapiens
ucacugcuuguuaugcauc

SEQ ID NO: 2002353 - RNA, 21 nt, Homo sapiens
aacuucaauguaguuuuccau

SEQ ID NO: 2002354 - RNA, 21 nt, Homo sapiens
uggccaggcugcacacauucu

SEQ ID NO: 2002355 - RNA, 15 nt, Homo sapiens
aaguuggguuaggag

SEQ ID NO: 2002356 - RNA, 18 nt, Homo sapiens
cauagucuugaugacauu

SEQ ID NO: 2002357 - RNA, 22 nt, Homo sapiens
ugcauaccuucgggguacaagu

SEQ ID NO: 2002358 - RNA, 19 nt, Homo sapiens
cauauuuuguauuguucua

SEQ ID NO: 2002359 - RNA, 18 nt, Homo sapiens
auaccagugaaccaaaga

SEQ ID NO: 2002360 - RNA, 20 nt, Homo sapiens
uggaucaguccuuugaucag

SEQ ID NO: 2002361 - RNA, 18 nt, Homo sapiens
gcuggaagucuaccugcu

SEQ ID NO: 2002362 - RNA, 18 nt, Homo sapiens
uacgcucagcucauccau

SEQ ID NO: 2002363 - RNA, 13 nt, Homo sapiens
uaaaguuugcuaa

SEQ ID NO: 2002364 - RNA, 11 nt, Homo sapiens
gccaggccagg

SEQ ID NO: 2002365 - RNA, 13 nt, Homo sapiens
aucagcacuccuc

SEQ ID NO: 2002366 - RNA, 18 nt, Homo sapiens
cuucccaaguagcugaga

SEQ ID NO: 2002367 - RNA, 16 nt, Homo sapiens
uggggcuccuaccugg

SEQ ID NO: 2002368 - RNA, 18 nt, Homo sapiens
cagagcccaagugccauc

SEQ ID NO: 2002369 - RNA, 21 nt, Homo sapiens
acuaggugccugcccagggag

SEQ ID NO: 2002370 - RNA, 12 nt, Homo sapiens
acuccacacucu

SEQ ID NO: 2002371 - RNA, 19 nt, Homo sapiens
uuugagggacgaucuuuga

SEQ ID NO: 2002372 - RNA, 17 nt, Homo sapiens
acauaauuaagcuguau

SEQ ID NO: 2002373 - RNA, 17 nt, Homo sapiens
uucaggagacuuuacaa

SEQ ID NO: 2002374 - RNA, 9 nt, Homo sapiens
ggcacauug

SEQ ID NO: 2002375 - RNA, 18 nt, Homo sapiens
auuuaaaaaagauaucua

SEQ ID NO: 2002376 - RNA, 21 nt, Homo sapiens
aggaagaagugguacuagugu

SEQ ID NO: 2002377 - RNA, 15 nt, Homo sapiens
aguuucuaacuuaca

SEQ ID NO: 2002378 - RNA, 15 nt, Homo sapiens
ugucauaaucucuuu

SEQ ID NO: 2002379 - RNA, 16 nt, Homo sapiens
acuuguuuucugggaa

SEQ ID NO: 2002380 - RNA, 15 nt, Homo sapiens
uuuccacugccaaaa

SEQ ID NO: 2002381 - RNA, 16 nt, Homo sapiens
ccagaaauaaagggac

SEQ ID NO: 2002382 - RNA, 22 nt, Homo sapiens
aguuaagaauggaagaaaacgg

SEQ ID NO: 2002383 - RNA, 22 nt, Homo sapiens
agccuugggauagcaaacucca

SEQ ID NO: 2002384 - RNA, 23 nt, Homo sapiens
cuguuuucuggaagugugcaggu

SEQ ID NO: 2002385 - RNA, 16 nt, Homo sapiens
uagaugacauggugaa

SEQ ID NO: 2002386 - RNA, 16 nt, Homo sapiens
aaugucaauuuaucac

SEQ ID NO: 2002387 - RNA, 13 nt, Homo sapiens
ucuauugggauau

SEQ ID NO: 2002388 - RNA, 15 nt, Homo sapiens
acccucucacuuugg

SEQ ID NO: 2002389 - RNA, 14 nt, Homo sapiens
caggacuccacugg

SEQ ID NO: 2002390 - RNA, 20 nt, Homo sapiens
ucccaaaaagaugcuuuaau

SEQ ID NO: 2002391 - RNA, 14 nt, Homo sapiens
accagaggugacag

SEQ ID NO: 2002392 - RNA, 14 nt, Homo sapiens
aagcucaugcauuu

SEQ ID NO: 2002393 - RNA, 23 nt, Homo sapiens
ucauugugagauugcaguucugu

SEQ ID NO: 2002394 - RNA, 23 nt, Homo sapiens
acaauuuuuuuuauuaguauugu

SEQ ID NO: 2002395 - RNA, 16 nt, Homo sapiens
uuaaaauaaugaacac

SEQ ID NO: 2002396 - RNA, 12 nt, Homo sapiens
cgcucucaagac

SEQ ID NO: 2002397 - RNA, 15 nt, Homo sapiens
uggcucccagggugg

SEQ ID NO: 2002398 - RNA, 23 nt, Homo sapiens
uauaaaauaguaugaaaauggaa

SEQ ID NO: 2002399 - RNA, 13 nt, Homo sapiens
cccaaagcacuuu

SEQ ID NO: 2002400 - RNA, 22 nt, Homo sapiens
aucucccugcuuuggucuugcc

SEQ ID NO: 2002401 - RNA, 18 nt, Homo sapiens
uuaugccccugcacugaa

SEQ ID NO: 2002402 - RNA, 18 nt, Homo sapiens
gccacguggccgcugccc

SEQ ID NO: 2002403 - RNA, 21 nt, Homo sapiens
aaggcuuggcacacugccagu

SEQ ID NO: 2002404 - RNA, 14 nt, Homo sapiens
caaucuugcuguga

SEQ ID NO: 2002405 - RNA, 20 nt, Homo sapiens
auauauuuauauacuuuuuc

SEQ ID NO: 2002406 - RNA, 18 nt, Homo sapiens
gauccaccugcacaaaca

SEQ ID NO: 2002407 - RNA, 22 nt, Homo sapiens
aacucuuccuggaaugcauuca

SEQ ID NO: 2002408 - RNA, 22 nt, Homo sapiens
acacagauggucacacagagau

SEQ ID NO: 2002409 - RNA, 22 nt, Homo sapiens
ccaaggaaacccccaguguaau

SEQ ID NO: 2002410 - RNA, 14 nt, Homo sapiens
cucagacugccaaa

SEQ ID NO: 2002411 - RNA, 15 nt, Homo sapiens
auccagacagucgcu

SEQ ID NO: 2002412 - RNA, 21 nt, Homo sapiens
uuccagguuccauccaccacc

SEQ ID NO: 2002413 - RNA, 14 nt, Homo sapiens
aaauauguccuggg

SEQ ID NO: 2002414 - RNA, 13 nt, Homo sapiens
guauucucagagc

SEQ ID NO: 2002415 - RNA, 19 nt, Homo sapiens
ccucccuaccuaccaagau

SEQ ID NO: 2002416 - RNA, 14 nt, Homo sapiens
aggggcucaguggc

SEQ ID NO: 2002417 - RNA, 12 nt, Homo sapiens
gguacacagugg

SEQ ID NO: 2002418 - RNA, 20 nt, Homo sapiens
cccugaguugggcagccagg

SEQ ID NO: 2002419 - RNA, 16 nt, Homo sapiens
gaaagggcuggcugca

SEQ ID NO: 2002420 - RNA, 20 nt, Homo sapiens
cacagcccccacggacaaaa

SEQ ID NO: 2002421 - RNA, 22 nt, Homo sapiens
augugcuacccacaacaccuca

SEQ ID NO: 2002422 - RNA, 15 nt, Homo sapiens
cacccugggagacag

SEQ ID NO: 2002423 - RNA, 14 nt, Homo sapiens
uugcuuauugcuua

SEQ ID NO: 2002424 - RNA, 21 nt, Homo sapiens
uguuguggguuuuuucacaua

SEQ ID NO: 2002425 - RNA, 17 nt, Homo sapiens
uccacccccuccuguca

SEQ ID NO: 2002426 - RNA, 20 nt, Homo sapiens
auucaaauuuuaucuccaga

SEQ ID NO: 2002427 - RNA, 20 nt, Homo sapiens
uguucucaugcauuucaugg

SEQ ID NO: 2002428 - RNA, 22 nt, Homo sapiens
auaaaagguuguguacaacucc

SEQ ID NO: 2002429 - RNA, 23 nt, Homo sapiens
ucuggugauggauuaacauauag

SEQ ID NO: 2002430 - RNA, 15 nt, Homo sapiens
gucugucucugcuau

SEQ ID NO: 2002431 - RNA, 15 nt, Homo sapiens
uacauggagcucagg

SEQ ID NO: 2002432 - RNA, 20 nt, Homo sapiens
guacuuguaguuccacuuau

SEQ ID NO: 2002433 - RNA, 14 nt, Homo sapiens
gcugaaaaugcaaa

SEQ ID NO: 2002434 - RNA, 12 nt, Homo sapiens
gccucuggaaaa

SEQ ID NO: 2002435 - RNA, 16 nt, Homo sapiens
acugucauaaucucuu

SEQ ID NO: 2002436 - RNA, 22 nt, Homo sapiens
ucauacugucugggauuaaggg

SEQ ID NO: 2002437 - RNA, 21 nt, Homo sapiens
uugccauauuaaaucuuccuc

SEQ ID NO: 2002438 - RNA, 15 nt, Homo sapiens
accugcugcugcuau

SEQ ID NO: 2002439 - RNA, 14 nt, Homo sapiens
guuaugacuaugua

SEQ ID NO: 2002440 - RNA, 20 nt, Homo sapiens
uggucagaacagagccuuug

SEQ ID NO: 2002441 - RNA, 20 nt, Homo sapiens
ccagguuuuuggucugaccc

SEQ ID NO: 2002442 - RNA, 21 nt, Homo sapiens
aaaugugauuguugaaguaca

SEQ ID NO: 2002443 - RNA, 14 nt, Homo sapiens
ggcaucuccaggaa

SEQ ID NO: 2002444 - RNA, 14 nt, Homo sapiens
cauguacagcauua

SEQ ID NO: 2002445 - RNA, 21 nt, Homo sapiens
gggaagcugggggaagggugg

SEQ ID NO: 2002446 - RNA, 14 nt, Homo sapiens
ugcucuuuuacuaa

SEQ ID NO: 2002447 - RNA, 15 nt, Homo sapiens
uugguugggggcucc

SEQ ID NO: 2002448 - RNA, 15 nt, Homo sapiens
guggcccguggccug

SEQ ID NO: 2002449 - RNA, 11 nt, Homo sapiens
caauacuguag

SEQ ID NO: 2002450 - RNA, 20 nt, Homo sapiens
ugcaaaggggugcaugggaa

SEQ ID NO: 2002451 - RNA, 18 nt, Homo sapiens
uaauucaacauauaccuu

SEQ ID NO: 2002452 - RNA, 21 nt, Homo sapiens
aauaugucagugcugauguag

SEQ ID NO: 2002453 - RNA, 15 nt, Homo sapiens
cacacuucccauuua

SEQ ID NO: 2002454 - RNA, 16 nt, Homo sapiens
uaaaauccuaagacac

SEQ ID NO: 2002455 - RNA, 18 nt, Homo sapiens
uuaaaguacuuucuuaua

SEQ ID NO: 2002456 - RNA, 20 nt, Homo sapiens
aacuugccuuucaguauuga

SEQ ID NO: 2002457 - RNA, 20 nt, Homo sapiens
cacccugaggugagcaucau

SEQ ID NO: 2002458 - RNA, 23 nt, Homo sapiens
uguuuaccauagaaagaugacaa

SEQ ID NO: 2002459 - RNA, 20 nt, Homo sapiens
ucugccuucuuccaggauca

SEQ ID NO: 2002460 - RNA, 18 nt, Homo sapiens
ccuucggcuccgggcaaa

SEQ ID NO: 2002461 - RNA, 12 nt, Homo sapiens
ggaaagccaaac

SEQ ID NO: 2002462 - RNA, 19 nt, Homo sapiens
cuaguaaguaauuaugcac

SEQ ID NO: 2002463 - RNA, 22 nt, Homo sapiens
ggacaucagcuggucaaacaaa

SEQ ID NO: 2002464 - RNA, 16 nt, Homo sapiens
aggagcaaaguuaaaa

SEQ ID NO: 2002465 - RNA, 14 nt, Homo sapiens
cauucuaaaccaaa

SEQ ID NO: 2002466 - RNA, 14 nt, Homo sapiens
uccaccaccaccug

SEQ ID NO: 2002467 - RNA, 15 nt, Homo sapiens
uaaaaacaagaugga

SEQ ID NO: 2002468 - RNA, 16 nt, Homo sapiens
accugauguccauuca

SEQ ID NO: 2002469 - RNA, 19 nt, Homo sapiens
acaaccuuuuuauuuucac

SEQ ID NO: 2002470 - RNA, 19 nt, Homo sapiens
acuuaaacuuuuaucacug

SEQ ID NO: 2002471 - RNA, 18 nt, Homo sapiens
aaacuaggcaauguacuc

SEQ ID NO: 2002472 - RNA, 11 nt, Homo sapiens
uagacugcaaa

SEQ ID NO: 2002473 - RNA, 12 nt, Homo sapiens
ucugaaaugccu

SEQ ID NO: 2002474 - RNA, 20 nt, Homo sapiens
agccccagagggucaggguu

SEQ ID NO: 2002475 - RNA, 15 nt, Homo sapiens
gcuuugcaaacauca

SEQ ID NO: 2002476 - RNA, 20 nt, Homo sapiens
acucaggcgccuggcacauu

SEQ ID NO: 2002477 - RNA, 14 nt, Homo sapiens
gugcauucuggcca

SEQ ID NO: 2002478 - RNA, 14 nt, Homo sapiens
ggucaagcccagga

SEQ ID NO: 2002479 - RNA, 17 nt, Homo sapiens
agauucuucacugguga

SEQ ID NO: 2002480 - RNA, 12 nt, Homo sapiens
gcuagaugggca

SEQ ID NO: 2002481 - RNA, 14 nt, Homo sapiens
cucaacuaacucca

SEQ ID NO: 2002482 - RNA, 15 nt, Homo sapiens
uuuaagaaugacagg

SEQ ID NO: 2002483 - RNA, 13 nt, Homo sapiens
ugacaacaugcua

SEQ ID NO: 2002484 - RNA, 14 nt, Homo sapiens
agcacuucucacca

SEQ ID NO: 2002485 - RNA, 20 nt, Homo sapiens
augugggagcugaaccacag

SEQ ID NO: 2002486 - RNA, 16 nt, Homo sapiens
aauucauaaucacucu

SEQ ID NO: 2002487 - RNA, 16 nt, Homo sapiens
ggcggcugugcaucag

SEQ ID NO: 2002488 - RNA, 17 nt, Homo sapiens
ucacuuuuaaugaacaa

SEQ ID NO: 2002489 - RNA, 15 nt, Homo sapiens
uucuuuuaccacuga

SEQ ID NO: 2002490 - RNA, 19 nt, Homo sapiens
aacgugaaauucuauugaa

SEQ ID NO: 2002491 - RNA, 18 nt, Homo sapiens
aauagcuguaaacuucca

SEQ ID NO: 2002492 - RNA, 22 nt, Homo sapiens
gggcugcccgcucccagugucu

SEQ ID NO: 2002493 - RNA, 19 nt, Homo sapiens
uggccacaauccuccccac

SEQ ID NO: 2002494 - RNA, 17 nt, Homo sapiens
uuuucucuaaugcuuga

SEQ ID NO: 2002495 - RNA, 20 nt, Homo sapiens
acauuucuaacuaaggacag

SEQ ID NO: 2002496 - RNA, 18 nt, Homo sapiens
ccaggagcuacucaggaa

SEQ ID NO: 2002497 - RNA, 23 nt, Homo sapiens
gcucagaggcccaggaaucggag

SEQ ID NO: 2002498 - RNA, 21 nt, Homo sapiens
aguuucugugugaacucucag

SEQ ID NO: 2002499 - RNA, 19 nt, Homo sapiens
ccaagcaagacugaggggu

SEQ ID NO: 2002500 - RNA, 21 nt, Homo sapiens
aauguugcauuuaugaugcag

SEQ ID NO: 2002501 - RNA, 19 nt, Homo sapiens
augucaaauaaagcaaagu

SEQ ID NO: 2002502 - RNA, 23 nt, Homo sapiens
gcuccaguauaaauuacaugcau

SEQ ID NO: 2002503 - RNA, 17 nt, Homo sapiens
cagagacggucaugcaa

SEQ ID NO: 2002504 - RNA, 19 nt, Homo sapiens
uugcuagugaaacugccca

SEQ ID NO: 2002505 - RNA, 23 nt, Homo sapiens
auugcuuauguaugccuauucag

SEQ ID NO: 2002506 - RNA, 12 nt, Homo sapiens
uggaaaucuguu

SEQ ID NO: 2002507 - RNA, 14 nt, Homo sapiens
agauuagucucuuc

SEQ ID NO: 2002508 - RNA, 14 nt, Homo sapiens
uacaaccagcccaa

SEQ ID NO: 2002509 - RNA, 17 nt, Homo sapiens
acuuuggcuuacauuug

SEQ ID NO: 2002510 - RNA, 22 nt, Homo sapiens
gcacauuggcagugugucacac

SEQ ID NO: 2002511 - RNA, 12 nt, Homo sapiens
acugcacccuca

SEQ ID NO: 2002512 - RNA, 20 nt, Homo sapiens
cugccugcgccagaagagcu

SEQ ID NO: 2002513 - RNA, 17 nt, Homo sapiens
aagaauucuguacuucc

SEQ ID NO: 2002514 - RNA, 15 nt, Homo sapiens
agcucugccuguuag

SEQ ID NO: 2002515 - RNA, 22 nt, Homo sapiens
uccagcccugggacagggcaaa

SEQ ID NO: 2002516 - RNA, 22 nt, Homo sapiens
uaucccagaaaaaguaacucau

SEQ ID NO: 2002517 - RNA, 15 nt, Homo sapiens
aggcaggaggaucac

SEQ ID NO: 2002518 - RNA, 15 nt, Homo sapiens
aagcaggagaaucac

SEQ ID NO: 2002519 - RNA, 14 nt, Homo sapiens
agggacaucuccau

SEQ ID NO: 2002520 - RNA, 11 nt, Homo sapiens
gagaacugugc

SEQ ID NO: 2002521 - RNA, 18 nt, Homo sapiens
ccuggguaacagagugag

SEQ ID NO: 2002522 - RNA, 20 nt, Homo sapiens
gucugcuuaguaucucauca

SEQ ID NO: 2002523 - RNA, 15 nt, Homo sapiens
cuggaucuaucugua

SEQ ID NO: 2002524 - RNA, 20 nt, Homo sapiens
caugugcuggacacugucca

SEQ ID NO: 2002525 - RNA, 23 nt, Homo sapiens
cucuucaggcaccugaagugaga

SEQ ID NO: 2002526 - RNA, 14 nt, Homo sapiens
agccuggaagccau

SEQ ID NO: 2002527 - RNA, 19 nt, Homo sapiens
caguuguccuuaaauuugu

SEQ ID NO: 2002528 - RNA, 16 nt, Homo sapiens
caccagcuccacuggc

SEQ ID NO: 2002529 - RNA, 18 nt, Homo sapiens
gaaacacacaggccauuu

SEQ ID NO: 2002530 - RNA, 21 nt, Homo sapiens
accuguaccuccaaaagugac

SEQ ID NO: 2002531 - RNA, 18 nt, Homo sapiens
cuugcuuuuugcugugua

SEQ ID NO: 2002532 - RNA, 17 nt, Homo sapiens
caucuagcaagcacuug

SEQ ID NO: 2002533 - RNA, 16 nt, Homo sapiens
uugaggcaguuccagg

SEQ ID NO: 2002534 - RNA, 20 nt, Homo sapiens
auagcuuuagccgugucacg

SEQ ID NO: 2002535 - RNA, 19 nt, Homo sapiens
cuuuaaaauguaaagccau

SEQ ID NO: 2002536 - RNA, 16 nt, Homo sapiens
ccggcucuguggguga

SEQ ID NO: 2002537 - RNA, 14 nt, Homo sapiens
cucguuaacacaug

SEQ ID NO: 2002538 - RNA, 19 nt, Homo sapiens
ccuacacccagaccccagg

SEQ ID NO: 2002539 - RNA, 17 nt, Homo sapiens
aguuuucauaguaucca

SEQ ID NO: 2002540 - RNA, 21 nt, Homo sapiens
gcuuuaauaagcgagaccuaa

SEQ ID NO: 2002541 - RNA, 15 nt, Homo sapiens
uuaacaacaauaaca

SEQ ID NO: 2002542 - RNA, 11 nt, Homo sapiens
cugcccugugg

SEQ ID NO: 2002543 - RNA, 23 nt, Homo sapiens
ugaggaauuaaggguuaccccac

SEQ ID NO: 2002544 - RNA, 18 nt, Homo sapiens
acccuguugcuuuucaca

SEQ ID NO: 2002545 - RNA, 16 nt, Homo sapiens
ggcugguugugcugca

SEQ ID NO: 2002546 - RNA, 18 nt, Homo sapiens
aucugcuuaggugccagg

SEQ ID NO: 2002547 - RNA, 11 nt, Homo sapiens
aauuauucccc

SEQ ID NO: 2002548 - RNA, 21 nt, Homo sapiens
acacuguauuguaaguggaaa

SEQ ID NO: 2002549 - RNA, 17 nt, Homo sapiens
gccugauagaagugcau

SEQ ID NO: 2002550 - RNA, 19 nt, Homo sapiens
uccugaggggcaucugccc

SEQ ID NO: 2002551 - RNA, 19 nt, Homo sapiens
ucauucugcaaugagccau

SEQ ID NO: 2002552 - RNA, 21 nt, Homo sapiens
acagagcaagaccccaucuca

SEQ ID NO: 2002553 - RNA, 13 nt, Homo sapiens
auagaaccaugaa

SEQ ID NO: 2002554 - RNA, 15 nt, Homo sapiens
gauguggacaugcac

SEQ ID NO: 2002555 - RNA, 18 nt, Homo sapiens
aaaaaucccuuguucuca

SEQ ID NO: 2002556 - RNA, 18 nt, Homo sapiens
aauguuuuaaaaauucau

SEQ ID NO: 2002557 - RNA, 16 nt, Homo sapiens
ugcgcagggcucuuug

SEQ ID NO: 2002558 - RNA, 13 nt, Homo sapiens
aaauacuugcucc

SEQ ID NO: 2002559 - RNA, 15 nt, Homo sapiens
accacauagacuuua

SEQ ID NO: 2002560 - RNA, 19 nt, Homo sapiens
cuugaguugccugaugcuc

SEQ ID NO: 2002561 - RNA, 21 nt, Homo sapiens
acagacuauggccauggcuca

SEQ ID NO: 2002562 - RNA, 23 nt, Homo sapiens
uguaagaaaauaucacuugucaa

SEQ ID NO: 2002563 - RNA, 20 nt, Homo sapiens
cucuuguguuuuuugcucac

SEQ ID NO: 2002564 - RNA, 20 nt, Homo sapiens
ggaaccucagccuggccaga

SEQ ID NO: 2002565 - RNA, 18 nt, Homo sapiens
uaauaaagcauucuuuaa

SEQ ID NO: 2002566 - RNA, 14 nt, Homo sapiens
cugcagucucuaua

SEQ ID NO: 2002567 - RNA, 19 nt, Homo sapiens
caggaaaugggcuuuucag

SEQ ID NO: 2002568 - RNA, 17 nt, Homo sapiens
cagcuaaaucauuugag

SEQ ID NO: 2002569 - RNA, 18 nt, Homo sapiens
agccucaagucacuccca

SEQ ID NO: 2002570 - RNA, 14 nt, Homo sapiens
uaaagaaguuugau

SEQ ID NO: 2002571 - RNA, 20 nt, Homo sapiens
gacuaccagcuaacuccagu

SEQ ID NO: 2002572 - RNA, 19 nt, Homo sapiens
caguuuuuaaaaugcugcu

SEQ ID NO: 2002573 - RNA, 18 nt, Homo sapiens
guucucaugaacuacccc

SEQ ID NO: 2002574 - RNA, 12 nt, Homo sapiens
auucugaacaau

SEQ ID NO: 2002575 - RNA, 16 nt, Homo sapiens
uggaggccucuggccc

SEQ ID NO: 2002576 - RNA, 13 nt, Homo sapiens
guggucaagcacu

SEQ ID NO: 2002577 - RNA, 15 nt, Homo sapiens
gccacugccaagcuu

SEQ ID NO: 2002578 - RNA, 21 nt, Homo sapiens
aaucguaguuaacguauauug

SEQ ID NO: 2002579 - RNA, 16 nt, Homo sapiens
ugucccagaaaaagca

SEQ ID NO: 2002580 - RNA, 17 nt, Homo sapiens
uaaagccagccaugcau

SEQ ID NO: 2002581 - RNA, 16 nt, Homo sapiens
ugagacuccgucacaa

SEQ ID NO: 2002582 - RNA, 13 nt, Homo sapiens
aagugugugcaug

SEQ ID NO: 2002583 - RNA, 23 nt, Homo sapiens
caccacagcuuauggcaucucau

SEQ ID NO: 2002584 - RNA, 17 nt, Homo sapiens
uaucggggaagccagac

SEQ ID NO: 2002585 - RNA, 21 nt, Homo sapiens
aaggcaccugcccccacagcu

SEQ ID NO: 2002586 - RNA, 12 nt, Homo sapiens
augucuagcuca

SEQ ID NO: 2002587 - RNA, 22 nt, Homo sapiens
aaauauccuguacauauuuaca

SEQ ID NO: 2002588 - RNA, 20 nt, Homo sapiens
cuugaaugcuuaaaugauca

SEQ ID NO: 2002589 - RNA, 21 nt, Homo sapiens
cccaagguaaacaguuugaaa

SEQ ID NO: 2002590 - RNA, 22 nt, Homo sapiens
ucuuauuaaaaaucuaacaaau

SEQ ID NO: 2002591 - RNA, 23 nt, Homo sapiens
ugacaacaaggcccuuuaacuug

SEQ ID NO: 2002592 - RNA, 17 nt, Homo sapiens
gcggguaggacggagau

SEQ ID NO: 2002593 - RNA, 19 nt, Homo sapiens
aaaguaaucauauaucaaa

SEQ ID NO: 2002594 - RNA, 22 nt, Homo sapiens
aaauauguucuuuaguuugcug

SEQ ID NO: 2002595 - RNA, 17 nt, Homo sapiens
ucaaauacacauuugcu

SEQ ID NO: 2002596 - RNA, 20 nt, Homo sapiens
uucccccgagcucuuggccu

SEQ ID NO: 2002597 - RNA, 23 nt, Homo sapiens
gcccugaggagggcccugaggaa

SEQ ID NO: 2002598 - RNA, 12 nt, Homo sapiens
uuucccauuuca

SEQ ID NO: 2002599 - RNA, 18 nt, Homo sapiens
acauaaaacaaaagcauu

SEQ ID NO: 2002600 - RNA, 18 nt, Homo sapiens
cuuggcuggggaggacca

SEQ ID NO: 2002601 - RNA, 15 nt, Homo sapiens
uuuuucuugugcuga

SEQ ID NO: 2002602 - RNA, 17 nt, Homo sapiens
aagacucugaccagaga

SEQ ID NO: 2002603 - RNA, 16 nt, Homo sapiens
uugcuauuuauauuca

SEQ ID NO: 2002604 - RNA, 13 nt, Homo sapiens
gggcacacgcugc

SEQ ID NO: 2002605 - RNA, 13 nt, Homo sapiens
ccaaugauucaua

SEQ ID NO: 2002606 - RNA, 21 nt, Homo sapiens
auuggaauaaaauugauucau

SEQ ID NO: 2002607 - RNA, 21 nt, Homo sapiens
agcccuggcccccacagcgcu

SEQ ID NO: 2002608 - RNA, 17 nt, Homo sapiens
cucacacuacagaucag

SEQ ID NO: 2002609 - RNA, 14 nt, Homo sapiens
caacagccaaaaca

SEQ ID NO: 2002610 - RNA, 14 nt, Homo sapiens
cagccaccaagaag

SEQ ID NO: 2002611 - RNA, 15 nt, Homo sapiens
agacacccucugggg

SEQ ID NO: 2002612 - RNA, 19 nt, Homo sapiens
aucacgcuuuccugaaucc

SEQ ID NO: 2002613 - RNA, 21 nt, Homo sapiens
cuacuccucugcagugccuug

SEQ ID NO: 2002614 - RNA, 16 nt, Homo sapiens
caaugucugcugagga

SEQ ID NO: 2002615 - RNA, 19 nt, Homo sapiens
cacagugugugacuuacag

SEQ ID NO: 2002616 - RNA, 19 nt, Homo sapiens
aguguuccaagucucugug

SEQ ID NO: 2002617 - RNA, 17 nt, Homo sapiens
auuacuauaagaacuuu

SEQ ID NO: 2002618 - RNA, 22 nt, Homo sapiens
auucagcaguuucugacaauua

SEQ ID NO: 2002619 - RNA, 19 nt, Homo sapiens
uagcacuuugaaauaccuc

SEQ ID NO: 2002620 - RNA, 20 nt, Homo sapiens
gaggcaggagaauugcugga

SEQ ID NO: 2002621 - RNA, 15 nt, Homo sapiens
caagaggcuaacuca

SEQ ID NO: 2002622 - RNA, 18 nt, Homo sapiens
aaguauguuuuuacauua

SEQ ID NO: 2002623 - RNA, 24 nt, Homo sapiens
ugugaccuccuuauguauucucaa

SEQ ID NO: 2002624 - RNA, 15 nt, Homo sapiens
agccguguguucaaa

SEQ ID NO: 2002625 - RNA, 19 nt, Homo sapiens
agcugcagccccuugcucu

SEQ ID NO: 2002626 - RNA, 22 nt, Homo sapiens
cugagaaauuauuagauugcca

SEQ ID NO: 2002627 - RNA, 17 nt, Homo sapiens
cucggggaugcauagau

SEQ ID NO: 2002628 - RNA, 16 nt, Homo sapiens
uugaauuaagaagaaa

SEQ ID NO: 2002629 - RNA, 15 nt, Homo sapiens
cuguuuauugccauu

SEQ ID NO: 2002630 - RNA, 20 nt, Homo sapiens
cuuucaggagggaaaaccca

SEQ ID NO: 2002631 - RNA, 22 nt, Homo sapiens
cuacagagcuucccugacucau

SEQ ID NO: 2002632 - RNA, 16 nt, Homo sapiens
ccuguccccucagcuc

SEQ ID NO: 2002633 - RNA, 13 nt, Homo sapiens
cucacugccucau

SEQ ID NO: 2002634 - RNA, 12 nt, Homo sapiens
cugaugguugcu

SEQ ID NO: 2002635 - RNA, 20 nt, Homo sapiens
agcuguccccugacccagag

SEQ ID NO: 2002636 - RNA, 21 nt, Homo sapiens
accuacuccagcucccaacuu

SEQ ID NO: 2002637 - RNA, 12 nt, Homo sapiens
ucgaaagcaaug

SEQ ID NO: 2002638 - RNA, 18 nt, Homo sapiens
ggaucugucugugcacau

SEQ ID NO: 2002639 - RNA, 20 nt, Homo sapiens
ucugcacccagccaaacaca

SEQ ID NO: 2002640 - RNA, 17 nt, Homo sapiens
cauuucaggggucguca

SEQ ID NO: 2002641 - RNA, 23 nt, Homo sapiens
cuggaccuuuucccuugcuguac

SEQ ID NO: 2002642 - RNA, 14 nt, Homo sapiens
gauagcaaacucca

SEQ ID NO: 2002643 - RNA, 19 nt, Homo sapiens
augcacuuggccugacuca

SEQ ID NO: 2002644 - RNA, 17 nt, Homo sapiens
cagggcgcuccggcaga

SEQ ID NO: 2002645 - RNA, 13 nt, Homo sapiens
cuauauugguuua

SEQ ID NO: 2002646 - RNA, 16 nt, Homo sapiens
uaauguaauacuguag

SEQ ID NO: 2002647 - RNA, 20 nt, Homo sapiens
uuucuuaaauauuaugugaa

SEQ ID NO: 2002648 - RNA, 13 nt, Homo sapiens
ugaauguuuccaa

SEQ ID NO: 2002649 - RNA, 23 nt, Homo sapiens
uaugaugauuugcuuaaauaucc

SEQ ID NO: 2002650 - RNA, 23 nt, Homo sapiens
ugcuaaacuuggcuguaugucaa

SEQ ID NO: 2002651 - RNA, 16 nt, Homo sapiens
aagauccugucuugcu

SEQ ID NO: 2002652 - RNA, 18 nt, Homo sapiens
guuuacuauugcuaucuu

SEQ ID NO: 2002653 - RNA, 15 nt, Homo sapiens
agcauaggaacaaua

SEQ ID NO: 2002654 - RNA, 17 nt, Homo sapiens
uuguaaacagaagcaac

SEQ ID NO: 2002655 - RNA, 15 nt, Homo sapiens
guauacaaugcacuu

SEQ ID NO: 2002656 - RNA, 14 nt, Homo sapiens
auauuuuagaugca

SEQ ID NO: 2002657 - RNA, 19 nt, Homo sapiens
gagugagacccugucucaa

SEQ ID NO: 2002658 - RNA, 22 nt, Homo sapiens
cagccugcgggccuaacauguu

SEQ ID NO: 2002659 - RNA, 18 nt, Homo sapiens
cacuagagaaacuugaau

SEQ ID NO: 2002660 - RNA, 18 nt, Homo sapiens
uuauugagauuguccuca

SEQ ID NO: 2002661 - RNA, 13 nt, Homo sapiens
gaaaggugcagga

SEQ ID NO: 2002662 - RNA, 13 nt, Homo sapiens
acaugaaugcaca

SEQ ID NO: 2002663 - RNA, 13 nt, Homo sapiens
acacaaaugcaug

SEQ ID NO: 2002664 - RNA, 19 nt, Homo sapiens
gauacaaauguuagucccu

SEQ ID NO: 2002665 - RNA, 15 nt, Homo sapiens
gucacgcggcagcuu

SEQ ID NO: 2002666 - RNA, 13 nt, Homo sapiens
ccucucagguggg

SEQ ID NO: 2002667 - RNA, 12 nt, Homo sapiens
caaucuguaaac

SEQ ID NO: 2002668 - RNA, 22 nt, Homo sapiens
acuguacacagaauuguuccag

SEQ ID NO: 2002669 - RNA, 14 nt, Homo sapiens
uaagucuacauuaa

SEQ ID NO: 2002670 - RNA, 14 nt, Homo sapiens
cuaugggugagcau

SEQ ID NO: 2002671 - RNA, 15 nt, Homo sapiens
cuucuaggauuuauu

SEQ ID NO: 2002672 - RNA, 14 nt, Homo sapiens
cacucaaaauaugu

SEQ ID NO: 2002673 - RNA, 17 nt, Homo sapiens
ucucugaggacaagaga

SEQ ID NO: 2002674 - RNA, 18 nt, Homo sapiens
uauguauccaguacauuu

SEQ ID NO: 2002675 - RNA, 12 nt, Homo sapiens
ucagagcaguga

SEQ ID NO: 2002676 - RNA, 21 nt, Homo sapiens
uguacuacagcuauauuugau

SEQ ID NO: 2002677 - RNA, 12 nt, Homo sapiens
aguugcacuugg

SEQ ID NO: 2002678 - RNA, 18 nt, Homo sapiens
agcccucaacuauucugu

SEQ ID NO: 2002679 - RNA, 23 nt, Homo sapiens
uauuugacauucuucacugucug

SEQ ID NO: 2002680 - RNA, 15 nt, Homo sapiens
cccaaccagaacuuu

SEQ ID NO: 2002681 - RNA, 22 nt, Homo sapiens
caguugucaucaaacauaauga

SEQ ID NO: 2002682 - RNA, 18 nt, Homo sapiens
uuaauaaguauaucuuaa

SEQ ID NO: 2002683 - RNA, 13 nt, Homo sapiens
ucuaugauguugc

SEQ ID NO: 2002684 - RNA, 16 nt, Homo sapiens
uaauauguauuuguug

SEQ ID NO: 2002685 - RNA, 18 nt, Homo sapiens
acucuucauggugacacu

SEQ ID NO: 2002686 - RNA, 18 nt, Homo sapiens
guaaccuuauacuacuaa

SEQ ID NO: 2002687 - RNA, 15 nt, Homo sapiens
uaaagaaauugcaau

SEQ ID NO: 2002688 - RNA, 19 nt, Homo sapiens
gagaugcuggacuugccua

SEQ ID NO: 2002689 - RNA, 21 nt, Homo sapiens
cuguaggacuguuugugacug

SEQ ID NO: 2002690 - RNA, 12 nt, Homo sapiens
auugcaaagggu

SEQ ID NO: 2002691 - RNA, 20 nt, Homo sapiens
gacacccccagcugacuguu

SEQ ID NO: 2002692 - RNA, 13 nt, Homo sapiens
auauaacugccuu

SEQ ID NO: 2002693 - RNA, 15 nt, Homo sapiens
caguaucucuucagu

SEQ ID NO: 2002694 - RNA, 14 nt, Homo sapiens
gagucucacuuugg

SEQ ID NO: 2002695 - RNA, 19 nt, Homo sapiens
guauucuccuuugcacugu

SEQ ID NO: 2002696 - RNA, 19 nt, Homo sapiens
ggagggaccaggugucuag

SEQ ID NO: 2002697 - RNA, 15 nt, Homo sapiens
acccuuugugaaagu

SEQ ID NO: 2002698 - RNA, 15 nt, Homo sapiens
ucaaugagagccaua

SEQ ID NO: 2002699 - RNA, 22 nt, Homo sapiens
uuaggaugugaucacuuucagg

SEQ ID NO: 2002700 - RNA, 14 nt, Homo sapiens
agaaauccauuuga

SEQ ID NO: 2002701 - RNA, 15 nt, Homo sapiens
ugggccauguccaaa

SEQ ID NO: 2002702 - RNA, 22 nt, Homo sapiens
cccacugcuugcacugaugucc

SEQ ID NO: 2002703 - RNA, 13 nt, Homo sapiens
uaacuggcaccca

SEQ ID NO: 2002704 - RNA, 16 nt, Homo sapiens
cccccacuacaaguga

SEQ ID NO: 2002705 - RNA, 14 nt, Homo sapiens
uccccagacucagc

SEQ ID NO: 2002706 - RNA, 14 nt, Homo sapiens
cagguaaguggcag

SEQ ID NO: 2002707 - RNA, 20 nt, Homo sapiens
uuauagugaauacugcuaca

SEQ ID NO: 2002708 - RNA, 14 nt, Homo sapiens
caagacuuccucau

SEQ ID NO: 2002709 - RNA, 14 nt, Homo sapiens
uaugacuuucacau

SEQ ID NO: 2002710 - RNA, 15 nt, Homo sapiens
gcuuguuugccugaa

SEQ ID NO: 2002711 - RNA, 18 nt, Homo sapiens
aacuccuuguuaauccag

SEQ ID NO: 2002712 - RNA, 17 nt, Homo sapiens
uaacaagcucccaggua

SEQ ID NO: 2002713 - RNA, 19 nt, Homo sapiens
uccuucaacugcucugcau

SEQ ID NO: 2002714 - RNA, 22 nt, Homo sapiens
aauaaagcuuucagguguuaca

SEQ ID NO: 2002715 - RNA, 14 nt, Homo sapiens
gaaaggaaagaaga

SEQ ID NO: 2002716 - RNA, 14 nt, Homo sapiens
aucuuagcaugccu

SEQ ID NO: 2002717 - RNA, 14 nt, Homo sapiens
gaaaggaacauuuu

SEQ ID NO: 2002718 - RNA, 18 nt, Homo sapiens
aacaguuguauguuugcu

SEQ ID NO: 2002719 - RNA, 16 nt, Homo sapiens
gcuagguaucauucaa

SEQ ID NO: 2002720 - RNA, 16 nt, Homo sapiens
uaaagcuugauuugau

SEQ ID NO: 2002721 - RNA, 14 nt, Homo sapiens
cuuggagugccaca

SEQ ID NO: 2002722 - RNA, 17 nt, Homo sapiens
acaguaacugccaucaa

SEQ ID NO: 2002723 - RNA, 18 nt, Homo sapiens
aacagcucaaagaguaaa

SEQ ID NO: 2002724 - RNA, 18 nt, Homo sapiens
cuagaaccuggagggcua

SEQ ID NO: 2002725 - RNA, 23 nt, Homo sapiens
gcccugaccuuggcugacugggg

SEQ ID NO: 2002726 - RNA, 23 nt, Homo sapiens
aagaggcccugucuguaccuaac

SEQ ID NO: 2002727 - RNA, 9 nt, Homo sapiens
cacugccaa

SEQ ID NO: 2002728 - RNA, 14 nt, Homo sapiens
uaugcaagggacug

SEQ ID NO: 2002729 - RNA, 13 nt, Homo sapiens
ccauagcugguua

SEQ ID NO: 2002730 - RNA, 15 nt, Homo sapiens
gauagggaacacuca

SEQ ID NO: 2002731 - RNA, 15 nt, Homo sapiens
aauguucaaugccac

SEQ ID NO: 2002732 - RNA, 16 nt, Homo sapiens
ugccuaaaaguuuuga

SEQ ID NO: 2002733 - RNA, 21 nt, Homo sapiens
acccaguaaaaauccacuauu

SEQ ID NO: 2002734 - RNA, 23 nt, Homo sapiens
gcaggcuucuuccccccaaaacu

SEQ ID NO: 2002735 - RNA, 17 nt, Homo sapiens
caaaauauccaauucau

SEQ ID NO: 2002736 - RNA, 12 nt, Homo sapiens
aucagacuguag

SEQ ID NO: 2002737 - RNA, 16 nt, Homo sapiens
ggagaaucacuugaac

SEQ ID NO: 2002738 - RNA, 15 nt, Homo sapiens
gauuaacacacugaa

SEQ ID NO: 2002739 - RNA, 14 nt, Homo sapiens
uaauaucacuuaaa

SEQ ID NO: 2002740 - RNA, 22 nt, Homo sapiens
guugaaaccaccgugaaccaga

SEQ ID NO: 2002741 - RNA, 18 nt, Homo sapiens
gcgucccagucucuggca

SEQ ID NO: 2002742 - RNA, 17 nt, Homo sapiens
acaguuuacaaaugaca

SEQ ID NO: 2002743 - RNA, 15 nt, Homo sapiens
aguuccaagagucua

SEQ ID NO: 2002744 - RNA, 14 nt, Homo sapiens
gcccacucaggggu

SEQ ID NO: 2002745 - RNA, 17 nt, Homo sapiens
uacacaucuauucucaa

SEQ ID NO: 2002746 - RNA, 23 nt, Homo sapiens
ucaccggccuugugacauucacu

SEQ ID NO: 2002747 - RNA, 15 nt, Homo sapiens
agcagauacugucuu

SEQ ID NO: 2002748 - RNA, 18 nt, Homo sapiens
uuucccauuaaagagcca

SEQ ID NO: 2002749 - RNA, 18 nt, Homo sapiens
ggcagggaccuaaaggga

SEQ ID NO: 2002750 - RNA, 14 nt, Homo sapiens
gucacucacaucca

SEQ ID NO: 2002751 - RNA, 20 nt, Homo sapiens
uacauaccaccaccaagaaa

SEQ ID NO: 2002752 - RNA, 16 nt, Homo sapiens
ugcccuugcuccagcc

SEQ ID NO: 2002753 - RNA, 16 nt, Homo sapiens
aaggucccuuguuucc

SEQ ID NO: 2002754 - RNA, 16 nt, Homo sapiens
uguacgcuuugcucaa

SEQ ID NO: 2002755 - RNA, 15 nt, Homo sapiens
agaggagccagacag

SEQ ID NO: 2002756 - RNA, 18 nt, Homo sapiens
gugcugggauuacaggug

SEQ ID NO: 2002757 - RNA, 15 nt, Homo sapiens
agauaaacuauacac

SEQ ID NO: 2002758 - RNA, 14 nt, Homo sapiens
cgucuccucuccag

SEQ ID NO: 2002759 - RNA, 15 nt, Homo sapiens
aauagacacugggga

SEQ ID NO: 2002760 - RNA, 21 nt, Homo sapiens
gcuaaaaucauccuauuacuu

SEQ ID NO: 2002761 - RNA, 15 nt, Homo sapiens
agccuguugcugaag

SEQ ID NO: 2002762 - RNA, 14 nt, Homo sapiens
agggaucuugcaaa

SEQ ID NO: 2002763 - RNA, 20 nt, Homo sapiens
cagaauauuaaauauuauaa

SEQ ID NO: 2002764 - RNA, 23 nt, Homo sapiens
agcagagcugauggagaaggaag

SEQ ID NO: 2002765 - RNA, 16 nt, Homo sapiens
aggaaaaggaauuccu

SEQ ID NO: 2002766 - RNA, 23 nt, Homo sapiens
agaagugcagaauuggggcacuu

SEQ ID NO: 2002767 - RNA, 13 nt, Homo sapiens
acaaaauguucac

SEQ ID NO: 2002768 - RNA, 16 nt, Homo sapiens
acaaauaaaaaauuca

SEQ ID NO: 2002769 - RNA, 19 nt, Homo sapiens
auuagccaguaccagcuuu

SEQ ID NO: 2002770 - RNA, 17 nt, Homo sapiens
uccacaccuccaaugcu

SEQ ID NO: 2002771 - RNA, 14 nt, Homo sapiens
ccagcucagugcca

SEQ ID NO: 2002772 - RNA, 21 nt, Homo sapiens
aacaugaccaaaaaccaaaag

SEQ ID NO: 2002773 - RNA, 20 nt, Homo sapiens
ucauaaaaauaaccaaaaaa

SEQ ID NO: 2002774 - RNA, 22 nt, Homo sapiens
cacacauccacgcacaugcgac

SEQ ID NO: 2002775 - RNA, 21 nt, Homo sapiens
acaaguagguuuacauuacug

SEQ ID NO: 2002776 - RNA, 15 nt, Homo sapiens
accuuccccugagga

SEQ ID NO: 2002777 - RNA, 22 nt, Homo sapiens
auggagcugaggaggugccuug

SEQ ID NO: 2002778 - RNA, 23 nt, Homo sapiens
ucuuuacaagcaggcacuguauu

SEQ ID NO: 2002779 - RNA, 15 nt, Homo sapiens
caguaccaucuacau

SEQ ID NO: 2002780 - RNA, 19 nt, Homo sapiens
caaaugcacucaucacaaa

SEQ ID NO: 2002781 - RNA, 20 nt, Homo sapiens
uaaugaaaucagaagcagua

SEQ ID NO: 2002782 - RNA, 18 nt, Homo sapiens
acccaggcuuuagcauua

SEQ ID NO: 2002783 - RNA, 20 nt, Homo sapiens
gaggacauaccacugccaug

SEQ ID NO: 2002784 - RNA, 15 nt, Homo sapiens
gcuuuguggcacugg

SEQ ID NO: 2002785 - RNA, 14 nt, Homo sapiens
uaagaaugcuuugc

SEQ ID NO: 2002786 - RNA, 20 nt, Homo sapiens
aaagagccugaagaccuuca

SEQ ID NO: 2002787 - RNA, 18 nt, Homo sapiens
uccuacucaacaaaagga

SEQ ID NO: 2002788 - RNA, 18 nt, Homo sapiens
gaaaccuacaagauuucc

SEQ ID NO: 2002789 - RNA, 17 nt, Homo sapiens
aggaaaggaaacuuuga

SEQ ID NO: 2002790 - RNA, 20 nt, Homo sapiens
gaccuuggagagacacagcg

SEQ ID NO: 2002791 - RNA, 9 nt, Homo sapiens
gcagcacuu

SEQ ID NO: 2002792 - RNA, 15 nt, Homo sapiens
aucccaagaaugcaa

SEQ ID NO: 2002793 - RNA, 19 nt, Homo sapiens
auuaugauuagcuuuguca

SEQ ID NO: 2002794 - RNA, 13 nt, Homo sapiens
cccagacagccug

SEQ ID NO: 2002795 - RNA, 20 nt, Homo sapiens
aauccucaaaucagucuucc

SEQ ID NO: 2002796 - RNA, 15 nt, Homo sapiens
cagugacucaucuuc

SEQ ID NO: 2002797 - RNA, 21 nt, Homo sapiens
ugaaacauggcuguguuugca

SEQ ID NO: 2002798 - RNA, 13 nt, Homo sapiens
augaaaagcagaa

SEQ ID NO: 2002799 - RNA, 13 nt, Homo sapiens
ccuuagacagucc

SEQ ID NO: 2002800 - RNA, 22 nt, Homo sapiens
gauuuccccuuuugcauucucc

SEQ ID NO: 2002801 - RNA, 23 nt, Homo sapiens
ccacauaaaagaagaaacuauuu

SEQ ID NO: 2002802 - RNA, 14 nt, Homo sapiens
gaagagaugcucua

SEQ ID NO: 2002803 - RNA, 15 nt, Homo sapiens
uggaggccaaggugg

SEQ ID NO: 2002804 - RNA, 22 nt, Homo sapiens
uguugacuggccaaaaauaucu

SEQ ID NO: 2002805 - RNA, 19 nt, Homo sapiens
cuuaaacccuuuagugcuu

SEQ ID NO: 2002806 - RNA, 22 nt, Homo sapiens
uuuuuaugugcuaugcaaaaua

SEQ ID NO: 2002807 - RNA, 17 nt, Homo sapiens
cuccucuaggccucacu

SEQ ID NO: 2002808 - RNA, 14 nt, Homo sapiens
uuuuagagcauuaa

SEQ ID NO: 2002809 - RNA, 14 nt, Homo sapiens
cuacagaguaacaa

SEQ ID NO: 2002810 - RNA, 19 nt, Homo sapiens
aacaaaaugaaaauaucuu

SEQ ID NO: 2002811 - RNA, 16 nt, Homo sapiens
accagcauucaugccg

SEQ ID NO: 2002812 - RNA, 19 nt, Homo sapiens
ggcauuuuuguaaugagcc

SEQ ID NO: 2002813 - RNA, 16 nt, Homo sapiens
aauuaaacuaguuuaa

SEQ ID NO: 2002814 - RNA, 19 nt, Homo sapiens
uguaugaaagagcaaguga

SEQ ID NO: 2002815 - RNA, 13 nt, Homo sapiens
cuuaacagguuug

SEQ ID NO: 2002816 - RNA, 21 nt, Homo sapiens
ccuccucacccacccuguggc

SEQ ID NO: 2002817 - RNA, 14 nt, Homo sapiens
ccggcaaccuguaa

SEQ ID NO: 2002818 - RNA, 16 nt, Homo sapiens
auucaacccauuuacu

SEQ ID NO: 2002819 - RNA, 14 nt, Homo sapiens
uccggaggagacac

SEQ ID NO: 2002820 - RNA, 15 nt, Homo sapiens
uccacucccaggcag

SEQ ID NO: 2002821 - RNA, 19 nt, Homo sapiens
ugaaaauuuuuacauucau

SEQ ID NO: 2002822 - RNA, 13 nt, Homo sapiens
agacccacagacu

SEQ ID NO: 2002823 - RNA, 13 nt, Homo sapiens
ccuuccacccuuu

SEQ ID NO: 2002824 - RNA, 16 nt, Homo sapiens
uaaccguuucaggacc

SEQ ID NO: 2002825 - RNA, 12 nt, Homo sapiens
auagaccacugg

SEQ ID NO: 2002826 - RNA, 13 nt, Homo sapiens
acacauaauaaag

SEQ ID NO: 2002827 - RNA, 20 nt, Homo sapiens
aggggcuuugcuuuucaaac

SEQ ID NO: 2002828 - RNA, 19 nt, Homo sapiens
aggguagagaggacaaaga

SEQ ID NO: 2002829 - RNA, 22 nt, Homo sapiens
ugcccuucuauacuuucucaca

SEQ ID NO: 2002830 - RNA, 13 nt, Homo sapiens
agauauuguucaa

SEQ ID NO: 2002831 - RNA, 19 nt, Homo sapiens
ugucauuauguacaauaca

SEQ ID NO: 2002832 - RNA, 17 nt, Homo sapiens
ucacaguugauacauag

SEQ ID NO: 2002833 - RNA, 13 nt, Homo sapiens
acugcagcuuugu

SEQ ID NO: 2002834 - RNA, 19 nt, Homo sapiens
ccaggaggcuuaguccagu

SEQ ID NO: 2002835 - RNA, 12 nt, Homo sapiens
cagcacacuccc

SEQ ID NO: 2002836 - RNA, 12 nt, Homo sapiens
agaaaaaaucug

SEQ ID NO: 2002837 - RNA, 16 nt, Homo sapiens
ccaugugacuguauua

SEQ ID NO: 2002838 - RNA, 12 nt, Homo sapiens
ugaaauuuagua

SEQ ID NO: 2002839 - RNA, 19 nt, Homo sapiens
ccauccuguuuguaugaaa

SEQ ID NO: 2002840 - RNA, 12 nt, Homo sapiens
uaccacccagaa

SEQ ID NO: 2002841 - RNA, 16 nt, Homo sapiens
aguuucagagagucaa

SEQ ID NO: 2002842 - RNA, 14 nt, Homo sapiens
aggcucuaauguac

SEQ ID NO: 2002843 - RNA, 12 nt, Homo sapiens
caacuccagggg

SEQ ID NO: 2002844 - RNA, 18 nt, Homo sapiens
auucugaaaaagacauaa

SEQ ID NO: 2002845 - RNA, 22 nt, Homo sapiens
ucugacccagugcccccacuga

SEQ ID NO: 2002846 - RNA, 13 nt, Homo sapiens
gagcaucauucug

SEQ ID NO: 2002847 - RNA, 12 nt, Homo sapiens
agacagugcagu

SEQ ID NO: 2002848 - RNA, 14 nt, Homo sapiens
auuucuuuaauguc

SEQ ID NO: 2002849 - RNA, 21 nt, Homo sapiens
gaagcugcggcccugaucucc

SEQ ID NO: 2002850 - RNA, 20 nt, Homo sapiens
gaacccccucaaaagccaaa

SEQ ID NO: 2002851 - RNA, 12 nt, Homo sapiens
uggcacuuguau

SEQ ID NO: 2002852 - RNA, 13 nt, Homo sapiens
gacucuugcucuu

SEQ ID NO: 2002853 - RNA, 16 nt, Homo sapiens
agaucauaguugcaaa

SEQ ID NO: 2002854 - RNA, 16 nt, Homo sapiens
ugccuggcauauaguu

SEQ ID NO: 2002855 - RNA, 18 nt, Homo sapiens
acauucacugagugccua

SEQ ID NO: 2002856 - RNA, 19 nt, Homo sapiens
gauggucccaggaagcagg

SEQ ID NO: 2002857 - RNA, 18 nt, Homo sapiens
aucacgaggucaggagau

SEQ ID NO: 2002858 - RNA, 15 nt, Homo sapiens
auggugcugcucugu

SEQ ID NO: 2002859 - RNA, 13 nt, Homo sapiens
caucaacaaugau

SEQ ID NO: 2002860 - RNA, 13 nt, Homo sapiens
ccuugaugaagcc

SEQ ID NO: 2002861 - RNA, 11 nt, Homo sapiens
cuuugcugcug

SEQ ID NO: 2002862 - RNA, 15 nt, Homo sapiens
cacucuggaaccuua

SEQ ID NO: 2002863 - RNA, 13 nt, Homo sapiens
uguccgucccgcu

SEQ ID NO: 2002864 - RNA, 15 nt, Homo sapiens
uuuccauucauggau

SEQ ID NO: 2002865 - RNA, 22 nt, Homo sapiens
aaaugccacguggucacugugc

SEQ ID NO: 2002866 - RNA, 20 nt, Homo sapiens
gcuggagugcaguggugcga

SEQ ID NO: 2002867 - RNA, 16 nt, Homo sapiens
gaccugagguugggga

SEQ ID NO: 2002868 - RNA, 22 nt, Homo sapiens
aaugcuucagauauuauugcuu

SEQ ID NO: 2002869 - RNA, 21 nt, Homo sapiens
caaccaauaaaagugucacua

SEQ ID NO: 2002870 - RNA, 18 nt, Homo sapiens
ccccucagggggccagcu

SEQ ID NO: 2002871 - RNA, 19 nt, Homo sapiens
gugcugcagccaaagacag

SEQ ID NO: 2002872 - RNA, 17 nt, Homo sapiens
cccauggcucuugcaac

SEQ ID NO: 2002873 - RNA, 20 nt, Homo sapiens
aaccuacccuguccuagaga

SEQ ID NO: 2002874 - RNA, 14 nt, Homo sapiens
uuacauuguugagc

SEQ ID NO: 2002875 - RNA, 20 nt, Homo sapiens
augacuaauucuugcauauu

SEQ ID NO: 2002876 - RNA, 14 nt, Homo sapiens
aggccuuacagucu

SEQ ID NO: 2002877 - RNA, 20 nt, Homo sapiens
gaauaaaaauauguacaagu

SEQ ID NO: 2002878 - RNA, 19 nt, Homo sapiens
uucauguaauaaaucugag

SEQ ID NO: 2002879 - RNA, 13 nt, Homo sapiens
ucucugugugauc

SEQ ID NO: 2002880 - RNA, 17 nt, Homo sapiens
uuaauguauaauuugag

SEQ ID NO: 2002881 - RNA, 15 nt, Homo sapiens
cguccauggugcuaa

SEQ ID NO: 2002882 - RNA, 21 nt, Homo sapiens
cuuuucuuuauugcugugaau

SEQ ID NO: 2002883 - RNA, 15 nt, Homo sapiens
acagccaagugugac

SEQ ID NO: 2002884 - RNA, 13 nt, Homo sapiens
gaggccucaggga

SEQ ID NO: 2002885 - RNA, 15 nt, Homo sapiens
cagaagaaacuaccc

SEQ ID NO: 2002886 - RNA, 17 nt, Homo sapiens
acaauuguuacaguacu

SEQ ID NO: 2002887 - RNA, 23 nt, Homo sapiens
auacuuuauaucuguaaugauac

SEQ ID NO: 2002888 - RNA, 18 nt, Homo sapiens
aucuauaaaauagauaua

SEQ ID NO: 2002889 - RNA, 18 nt, Homo sapiens
aaaauaagcacugugcua

SEQ ID NO: 2002890 - RNA, 22 nt, Homo sapiens
accaaggccagccacaccacag

SEQ ID NO: 2002891 - RNA, 15 nt, Homo sapiens
cuuucagaaaaacaa

SEQ ID NO: 2002892 - RNA, 20 nt, Homo sapiens
caauacccaccucuguggau

SEQ ID NO: 2002893 - RNA, 15 nt, Homo sapiens
aagaagcuaccucag

SEQ ID NO: 2002894 - RNA, 18 nt, Homo sapiens
uggcgcgaucucagcuca

SEQ ID NO: 2002895 - RNA, 16 nt, Homo sapiens
uuccagcuccuguaac

SEQ ID NO: 2002896 - RNA, 12 nt, Homo sapiens
cgcuuuuguacg

SEQ ID NO: 2002897 - RNA, 11 nt, Homo sapiens
gugaaucugau

SEQ ID NO: 2002898 - RNA, 17 nt, Homo sapiens
uuucaccccacucugua

SEQ ID NO: 2002899 - RNA, 21 nt, Homo sapiens
cuuguuauuuaacccauuugu

SEQ ID NO: 2002900 - RNA, 20 nt, Homo sapiens
auugguggcagauuuuacaa

SEQ ID NO: 2002901 - RNA, 20 nt, Homo sapiens
auggcugcaagcgcacuuga

SEQ ID NO: 2002902 - RNA, 16 nt, Homo sapiens
aaccacauugaagaau

SEQ ID NO: 2002903 - RNA, 17 nt, Homo sapiens
cagaugagaguacaccc

SEQ ID NO: 2002904 - RNA, 20 nt, Homo sapiens
cuuuggaauacuucuaccau

SEQ ID NO: 2002905 - RNA, 17 nt, Homo sapiens
gacagaucaauggcgca

SEQ ID NO: 2002906 - RNA, 13 nt, Homo sapiens
aaagaaagagcug

SEQ ID NO: 2002907 - RNA, 18 nt, Homo sapiens
cuuuuuauucuacuacuu

SEQ ID NO: 2002908 - RNA, 14 nt, Homo sapiens
guacugucccagga

SEQ ID NO: 2002909 - RNA, 20 nt, Homo sapiens
guccccagccugcucccuag

SEQ ID NO: 2002910 - RNA, 16 nt, Homo sapiens
uugauuuuugaaguug

SEQ ID NO: 2002911 - RNA, 14 nt, Homo sapiens
augcuuacaaaguc

SEQ ID NO: 2002912 - RNA, 20 nt, Homo sapiens
guagacggaacaguguggaa

SEQ ID NO: 2002913 - RNA, 16 nt, Homo sapiens
cugucuucuuucucca

SEQ ID NO: 2002914 - RNA, 16 nt, Homo sapiens
ugcucccuccacagcu

SEQ ID NO: 2002915 - RNA, 20 nt, Homo sapiens
ucugagcacagcugcauuaa

SEQ ID NO: 2002916 - RNA, 14 nt, Homo sapiens
aagcuucucucuga

SEQ ID NO: 2002917 - RNA, 21 nt, Homo sapiens
aguuuuuuauuaugcauuaua

SEQ ID NO: 2002918 - RNA, 19 nt, Homo sapiens
cagugauuugccaaaguga

SEQ ID NO: 2002919 - RNA, 13 nt, Homo sapiens
cacugaacaugcu

SEQ ID NO: 2002920 - RNA, 20 nt, Homo sapiens
auggcucaacguuuuuggac

SEQ ID NO: 2002921 - RNA, 12 nt, Homo sapiens
gacucacucugu

SEQ ID NO: 2002922 - RNA, 16 nt, Homo sapiens
ugcauauuuuauuaua

SEQ ID NO: 2002923 - RNA, 16 nt, Homo sapiens
auugcagcagguggua

SEQ ID NO: 2002924 - RNA, 13 nt, Homo sapiens
accuguaguccca

SEQ ID NO: 2002925 - RNA, 13 nt, Homo sapiens
uuucauagauuug

SEQ ID NO: 2002926 - RNA, 14 nt, Homo sapiens
augccgcuacaaaa

SEQ ID NO: 2002927 - RNA, 23 nt, Homo sapiens
uaagucacuuugaggugucucaa

SEQ ID NO: 2002928 - RNA, 21 nt, Homo sapiens
aaaaaugcaagccaucucuaa

SEQ ID NO: 2002929 - RNA, 21 nt, Homo sapiens
cucauguugggagugagaaug

SEQ ID NO: 2002930 - RNA, 16 nt, Homo sapiens
gacaaccucauuuuaa

SEQ ID NO: 2002931 - RNA, 18 nt, Homo sapiens
cccauuuguaauguaucu

SEQ ID NO: 2002932 - RNA, 14 nt, Homo sapiens
gacaugagucuuug

SEQ ID NO: 2002933 - RNA, 16 nt, Homo sapiens
uuguuuguuacuguca

SEQ ID NO: 2002934 - RNA, 19 nt, Homo sapiens
agauuugcaacuaguaaaa

SEQ ID NO: 2002935 - RNA, 15 nt, Homo sapiens
cauauaaauguaaua

SEQ ID NO: 2002936 - RNA, 18 nt, Homo sapiens
ugcaugugcauauagaca

SEQ ID NO: 2002937 - RNA, 18 nt, Homo sapiens
caugaggaaaaaaaauca

SEQ ID NO: 2002938 - RNA, 18 nt, Homo sapiens
aaaauggaaauguaauaa

SEQ ID NO: 2002939 - RNA, 17 nt, Homo sapiens
acuuagcaugucccuac

SEQ ID NO: 2002940 - RNA, 20 nt, Homo sapiens
uccaugguccugucuguccu

SEQ ID NO: 2002941 - RNA, 22 nt, Homo sapiens
caauagacugaagagaccacag

SEQ ID NO: 2002942 - RNA, 15 nt, Homo sapiens
uuagcuguacuauaa

SEQ ID NO: 2002943 - RNA, 18 nt, Homo sapiens
agcaaauguuaugcauaa

SEQ ID NO: 2002944 - RNA, 16 nt, Homo sapiens
acucaccugcacuaac

SEQ ID NO: 2002945 - RNA, 19 nt, Homo sapiens
cagcgaccuuccucaucca

SEQ ID NO: 2002946 - RNA, 17 nt, Homo sapiens
uuuauagaugucaggaa

SEQ ID NO: 2002947 - RNA, 13 nt, Homo sapiens
uuuugcuauugua

SEQ ID NO: 2002948 - RNA, 20 nt, Homo sapiens
agugacugcagcuugccaaa

SEQ ID NO: 2002949 - RNA, 15 nt, Homo sapiens
aaaguuauugugaua

SEQ ID NO: 2002950 - RNA, 22 nt, Homo sapiens
aggccagcacucgcuagcagug

SEQ ID NO: 2002951 - RNA, 21 nt, Homo sapiens
agugacaucucuuugauguca

SEQ ID NO: 2002952 - RNA, 22 nt, Homo sapiens
ugaguuucuuaacccuuuccag

SEQ ID NO: 2002953 - RNA, 15 nt, Homo sapiens
cuuguuacccaugaa

SEQ ID NO: 2002954 - RNA, 22 nt, Homo sapiens
guagaaaugucuauguuuucua

SEQ ID NO: 2002955 - RNA, 19 nt, Homo sapiens
uggcuauuuucccaugcca

SEQ ID NO: 2002956 - RNA, 21 nt, Homo sapiens
aacuacccucucaaauggaca

SEQ ID NO: 2002957 - RNA, 15 nt, Homo sapiens
uacuaucauaauuca

SEQ ID NO: 2002958 - RNA, 19 nt, Homo sapiens
gagcugcuucacuagggaa

SEQ ID NO: 2002959 - RNA, 19 nt, Homo sapiens
aaccucacucuugccaacc

SEQ ID NO: 2002960 - RNA, 18 nt, Homo sapiens
uaucuuguaaauaaagac

SEQ ID NO: 2002961 - RNA, 15 nt, Homo sapiens
aaauaauugggugac

SEQ ID NO: 2002962 - RNA, 16 nt, Homo sapiens
gugggagggacuuugc

SEQ ID NO: 2002963 - RNA, 23 nt, Homo sapiens
ucacauuuguauguguguagacu

SEQ ID NO: 2002964 - RNA, 13 nt, Homo sapiens
uguacagacuguu

SEQ ID NO: 2002965 - RNA, 15 nt, Homo sapiens
aacuacaagccacga

SEQ ID NO: 2002966 - RNA, 22 nt, Homo sapiens
gguauuuuuauucaugugaagu

SEQ ID NO: 2002967 - RNA, 21 nt, Homo sapiens
ccugucuucugggcacagugg

SEQ ID NO: 2002968 - RNA, 14 nt, Homo sapiens
ugugugugugcaag

SEQ ID NO: 2002969 - RNA, 15 nt, Homo sapiens
gaagccccauccaac

SEQ ID NO: 2002970 - RNA, 22 nt, Homo sapiens
acccauuuacuuuggucaauau

SEQ ID NO: 2002971 - RNA, 20 nt, Homo sapiens
ugccugcuggagaaaaaaca

SEQ ID NO: 2002972 - RNA, 23 nt, Homo sapiens
guauagcauuuuuauucaugcca

SEQ ID NO: 2002973 - RNA, 20 nt, Homo sapiens
cauguaaggccuuucaauau

SEQ ID NO: 2002974 - RNA, 20 nt, Homo sapiens
ggacagacggaaaugaaauu

SEQ ID NO: 2002975 - RNA, 13 nt, Homo sapiens
agagugucuuucc

SEQ ID NO: 2002976 - RNA, 19 nt, Homo sapiens
uguaacauuguaaaguaug

SEQ ID NO: 2002977 - RNA, 13 nt, Homo sapiens
auggagaguucag

SEQ ID NO: 2002978 - RNA, 17 nt, Homo sapiens
agaaagcuggacugacc

SEQ ID NO: 2002979 - RNA, 20 nt, Homo sapiens
guauuucugauguguucucu

SEQ ID NO: 2002980 - RNA, 12 nt, Homo sapiens
aacaagcugaua

SEQ ID NO: 2002981 - RNA, 21 nt, Homo sapiens
cauuugauauacaugcucaac

SEQ ID NO: 2002982 - RNA, 17 nt, Homo sapiens
ccagggaggcugguccu

SEQ ID NO: 2002983 - RNA, 15 nt, Homo sapiens
uuccccgugcccuac

SEQ ID NO: 2002984 - RNA, 14 nt, Homo sapiens
uauagaaguagcaa

SEQ ID NO: 2002985 - RNA, 15 nt, Homo sapiens
acuuaagugcacuuu

SEQ ID NO: 2002986 - RNA, 23 nt, Homo sapiens
uaacaagaccucagugccuuccu

SEQ ID NO: 2002987 - RNA, 13 nt, Homo sapiens
ugacucacuccau

SEQ ID NO: 2002988 - RNA, 17 nt, Homo sapiens
ugccuaucugaccaaac

SEQ ID NO: 2002989 - RNA, 14 nt, Homo sapiens
ccuucuguggcuca

SEQ ID NO: 2002990 - RNA, 17 nt, Homo sapiens
caucaaccuucuuauua

SEQ ID NO: 2002991 - RNA, 13 nt, Homo sapiens
aaagccuccucau

SEQ ID NO: 2002992 - RNA, 18 nt, Homo sapiens
ucgguggccaugcuucuu

SEQ ID NO: 2002993 - RNA, 17 nt, Homo sapiens
uucuuccagcagaacag

SEQ ID NO: 2002994 - RNA, 13 nt, Homo sapiens
ccuuuugggcuca

SEQ ID NO: 2002995 - RNA, 14 nt, Homo sapiens
acacugaggacugu

SEQ ID NO: 2002996 - RNA, 17 nt, Homo sapiens
cagagcccugugucugu

SEQ ID NO: 2002997 - RNA, 15 nt, Homo sapiens
ggcauaccugugccu

SEQ ID NO: 2002998 - RNA, 16 nt, Homo sapiens
uauucgguaauaucau

SEQ ID NO: 2002999 - RNA, 22 nt, Homo sapiens
aaccacaaagcacaguuugaac

SEQ ID NO: 2003000 - RNA, 20 nt, Homo sapiens
ccuuaacacugagcugucau

SEQ ID NO: 2003001 - RNA, 17 nt, Homo sapiens
ccaugacauuucaucug

SEQ ID NO: 2003002 - RNA, 15 nt, Homo sapiens
uaaacuguugggaaa

SEQ ID NO: 2003003 - RNA, 19 nt, Homo sapiens
ucccuucuaggcaucuccu

SEQ ID NO: 2003004 - RNA, 15 nt, Homo sapiens
ugaaaccaugacugu

SEQ ID NO: 2003005 - RNA, 22 nt, Homo sapiens
cccugauuuauucuggugucua

SEQ ID NO: 2003006 - RNA, 10 nt, Homo sapiens
cccaucccau

SEQ ID NO: 2003007 - RNA, 19 nt, Homo sapiens
auagaaaauuaaacacaaa

SEQ ID NO: 2003008 - RNA, 13 nt, Homo sapiens
auuaauuuccacu

SEQ ID NO: 2003009 - RNA, 21 nt, Homo sapiens
uccugcuccagcagcacaccu

SEQ ID NO: 2003010 - RNA, 12 nt, Homo sapiens
uggggccaccaa

SEQ ID NO: 2003011 - RNA, 17 nt, Homo sapiens
cuuagucacuuauuuca

SEQ ID NO: 2003012 - RNA, 17 nt, Homo sapiens
guuugguaguuuugcca

SEQ ID NO: 2003013 - RNA, 14 nt, Homo sapiens
augugcucagggaa

SEQ ID NO: 2003014 - RNA, 22 nt, Homo sapiens
cuguaacugcauuagaaaccau

SEQ ID NO: 2003015 - RNA, 21 nt, Homo sapiens
gaugugaauugccugcagaga

SEQ ID NO: 2003016 - RNA, 12 nt, Homo sapiens
cucacaugacac

SEQ ID NO: 2003017 - RNA, 17 nt, Homo sapiens
ccaauaaaagcucuucu

SEQ ID NO: 2003018 - RNA, 13 nt, Homo sapiens
aagacccugccau

SEQ ID NO: 2003019 - RNA, 12 nt, Homo sapiens
gaauccauauca

SEQ ID NO: 2003020 - RNA, 20 nt, Homo sapiens
cuguuuuucaaaaauggaag

SEQ ID NO: 2003021 - RNA, 23 nt, Homo sapiens
uacaugcauuacugcaugcacuu

SEQ ID NO: 2003022 - RNA, 14 nt, Homo sapiens
uauacaauguuaca

SEQ ID NO: 2003023 - RNA, 15 nt, Homo sapiens
aggcauucucugaag

SEQ ID NO: 2003024 - RNA, 15 nt, Homo sapiens
gccagcacucgcuag

SEQ ID NO: 2003025 - RNA, 17 nt, Homo sapiens
gaaugggccacuguagg

SEQ ID NO: 2003026 - RNA, 16 nt, Homo sapiens
cugcagauagaaagca

SEQ ID NO: 2003027 - RNA, 19 nt, Homo sapiens
uccucugcaucuugcucug

SEQ ID NO: 2003028 - RNA, 23 nt, Homo sapiens
uuuucgaacaccaaaaaugaugc

SEQ ID NO: 2003029 - RNA, 20 nt, Homo sapiens
cuaacaccacacugaccaca

SEQ ID NO: 2003030 - RNA, 19 nt, Homo sapiens
ucccugguggggugugcau

SEQ ID NO: 2003031 - RNA, 16 nt, Homo sapiens
cauaauaaauaauuaa

SEQ ID NO: 2003032 - RNA, 20 nt, Homo sapiens
ucuaacucauauguucccaa

SEQ ID NO: 2003033 - RNA, 17 nt, Homo sapiens
uucccauuuacucuuga

SEQ ID NO: 2003034 - RNA, 17 nt, Homo sapiens
aagaaaaaggcauuuua

SEQ ID NO: 2003035 - RNA, 21 nt, Homo sapiens
ugucucccuucgacauugagc

SEQ ID NO: 2003036 - RNA, 21 nt, Homo sapiens
auaaccaggcugggcucagcu

SEQ ID NO: 2003037 - RNA, 14 nt, Homo sapiens
cacaucuuauuuau

SEQ ID NO: 2003038 - RNA, 19 nt, Homo sapiens
aagacuguggccugcccag

SEQ ID NO: 2003039 - RNA, 21 nt, Homo sapiens
cuauauaaaguacuacuguag

SEQ ID NO: 2003040 - RNA, 17 nt, Homo sapiens
cuauaauuucuguaaca

SEQ ID NO: 2003041 - RNA, 13 nt, Homo sapiens
uauuauaauccuc

SEQ ID NO: 2003042 - RNA, 16 nt, Homo sapiens
acucacccccaugauc

SEQ ID NO: 2003043 - RNA, 16 nt, Homo sapiens
auggugaaugaaguca

SEQ ID NO: 2003044 - RNA, 12 nt, Homo sapiens
agcuguguuacu

SEQ ID NO: 2003045 - RNA, 18 nt, Homo sapiens
gcagacaguuaagagaaa

SEQ ID NO: 2003046 - RNA, 13 nt, Homo sapiens
gccagggacccaa

SEQ ID NO: 2003047 - RNA, 22 nt, Homo sapiens
cacaagguacaaaaucuugcau

SEQ ID NO: 2003048 - RNA, 22 nt, Homo sapiens
agguccauuuuccuaaccacaa

SEQ ID NO: 2003049 - RNA, 16 nt, Homo sapiens
aaaaaggaaaacagac

SEQ ID NO: 2003050 - RNA, 18 nt, Homo sapiens
cugaauagacaguccaua

SEQ ID NO: 2003051 - RNA, 21 nt, Homo sapiens
ugaaugaguaggaaaggaaua

SEQ ID NO: 2003052 - RNA, 22 nt, Homo sapiens
acaucuguucuuugguguaauc

SEQ ID NO: 2003053 - RNA, 15 nt, Homo sapiens
auaccauggcacuga

SEQ ID NO: 2003054 - RNA, 13 nt, Homo sapiens
augcaaauaccca

SEQ ID NO: 2003055 - RNA, 17 nt, Homo sapiens
cuugaaugauacgauua

SEQ ID NO: 2003056 - RNA, 17 nt, Homo sapiens
ucccagccacucgggag

SEQ ID NO: 2003057 - RNA, 18 nt, Homo sapiens
ggggccacauuucaccuc

SEQ ID NO: 2003058 - RNA, 15 nt, Homo sapiens
agccauucuauauuc

SEQ ID NO: 2003059 - RNA, 23 nt, Homo sapiens
gaaagaaaguugcacggcugcug

SEQ ID NO: 2003060 - RNA, 17 nt, Homo sapiens
uucagccauagcuugau

SEQ ID NO: 2003061 - RNA, 18 nt, Homo sapiens
aacagagacuucuagaca

SEQ ID NO: 2003062 - RNA, 16 nt, Homo sapiens
uuuuaaaauugcagca

SEQ ID NO: 2003063 - RNA, 13 nt, Homo sapiens
cagaucaagugaa

SEQ ID NO: 2003064 - RNA, 16 nt, Homo sapiens
cacuggugccauguca

SEQ ID NO: 2003065 - RNA, 14 nt, Homo sapiens
cuggagggcacuuc

SEQ ID NO: 2003066 - RNA, 14 nt, Homo sapiens
guaaaaagugcagu

SEQ ID NO: 2003067 - RNA, 13 nt, Homo sapiens
aguuugcugccau

SEQ ID NO: 2003068 - RNA, 18 nt, Homo sapiens
acagcagggacaagauac

SEQ ID NO: 2003069 - RNA, 20 nt, Homo sapiens
gggagccgcuucuccaaguc

SEQ ID NO: 2003070 - RNA, 18 nt, Homo sapiens
cagaugcacacacacaga

SEQ ID NO: 2003071 - RNA, 21 nt, Homo sapiens
uucuguccuguaacuguuaca

SEQ ID NO: 2003072 - RNA, 18 nt, Homo sapiens
ccuugagaagccaaccac

SEQ ID NO: 2003073 - RNA, 17 nt, Homo sapiens
uccaccacaucugccag

SEQ ID NO: 2003074 - RNA, 12 nt, Homo sapiens
gagccaacaggu

SEQ ID NO: 2003075 - RNA, 21 nt, Homo sapiens
gggcaccuuccgacaucccag

SEQ ID NO: 2003076 - RNA, 21 nt, Homo sapiens
aaaaacuuaccuacuggggac

SEQ ID NO: 2003077 - RNA, 21 nt, Homo sapiens
augaguuuuugauagcuuuau

SEQ ID NO: 2003078 - RNA, 13 nt, Homo sapiens
cucuccucucuga

SEQ ID NO: 2003079 - RNA, 21 nt, Homo sapiens
cagacuagaaguuccuaguga

SEQ ID NO: 2003080 - RNA, 15 nt, Homo sapiens
auuguaguuaaugau

SEQ ID NO: 2003081 - RNA, 17 nt, Homo sapiens
uacucuggggugcugcc

SEQ ID NO: 2003082 - RNA, 15 nt, Homo sapiens
auauaggccagaguu

SEQ ID NO: 2003083 - RNA, 16 nt, Homo sapiens
ugcaaguccacugggg

SEQ ID NO: 2003084 - RNA, 15 nt, Homo sapiens
cuuguuaccauugua

SEQ ID NO: 2003085 - RNA, 18 nt, Homo sapiens
agauuuuauuuauggaau

SEQ ID NO: 2003086 - RNA, 13 nt, Homo sapiens
gagguggcugccu

SEQ ID NO: 2003087 - RNA, 16 nt, Homo sapiens
gugcuggccacacagc

SEQ ID NO: 2003088 - RNA, 16 nt, Homo sapiens
augaacauauucauga

SEQ ID NO: 2003089 - RNA, 15 nt, Homo sapiens
acuaucacauacaau

SEQ ID NO: 2003090 - RNA, 15 nt, Homo sapiens
aaaacaucacauucc

SEQ ID NO: 2003091 - RNA, 22 nt, Homo sapiens
gagaauguguuucaaaaccaug

SEQ ID NO: 2003092 - RNA, 15 nt, Homo sapiens
uuagagggagcccag

SEQ ID NO: 2003093 - RNA, 19 nt, Homo sapiens
aaggagcaucuaucagauu

SEQ ID NO: 2003094 - RNA, 23 nt, Homo sapiens
aacgugcauggauaugugccagg

SEQ ID NO: 2003095 - RNA, 12 nt, Homo sapiens
ccuggacugugu

SEQ ID NO: 2003096 - RNA, 20 nt, Homo sapiens
uuguuuagucuugucucaga

SEQ ID NO: 2003097 - RNA, 15 nt, Homo sapiens
ugccucaaguuccau

SEQ ID NO: 2003098 - RNA, 20 nt, Homo sapiens
acaucugagagaugacaggg

SEQ ID NO: 2003099 - RNA, 22 nt, Homo sapiens
caucugacaugcaucaucucau

SEQ ID NO: 2003100 - RNA, 22 nt, Homo sapiens
uacugacagaugguaucugcca

SEQ ID NO: 2003101 - RNA, 14 nt, Homo sapiens
cuaacuugcuuaaa

SEQ ID NO: 2003102 - RNA, 15 nt, Homo sapiens
uuaacaaaucagauc

SEQ ID NO: 2003103 - RNA, 23 nt, Homo sapiens
cauucagaagaaaaagaagcaac

SEQ ID NO: 2003104 - RNA, 15 nt, Homo sapiens
acccaugcagcugcu

SEQ ID NO: 2003105 - RNA, 14 nt, Homo sapiens
guggauaacaaaga

SEQ ID NO: 2003106 - RNA, 21 nt, Homo sapiens
cagccccucacauuccuaggg

SEQ ID NO: 2003107 - RNA, 16 nt, Homo sapiens
aguucuuagcccucua

SEQ ID NO: 2003108 - RNA, 12 nt, Homo sapiens
agaacucugaau

SEQ ID NO: 2003109 - RNA, 11 nt, Homo sapiens
uugaccacaga

SEQ ID NO: 2003110 - RNA, 13 nt, Homo sapiens
gcacuguguuuau

SEQ ID NO: 2003111 - RNA, 12 nt, Homo sapiens
aucacauuguuu

SEQ ID NO: 2003112 - RNA, 23 nt, Homo sapiens
uuucuuccacccacaaacuccag

SEQ ID NO: 2003113 - RNA, 14 nt, Homo sapiens
cagucuuugcucag

SEQ ID NO: 2003114 - RNA, 13 nt, Homo sapiens
gcagccacacuca

SEQ ID NO: 2003115 - RNA, 20 nt, Homo sapiens
uauuuuccuaguagauauau

SEQ ID NO: 2003116 - RNA, 20 nt, Homo sapiens
guacauacucaagagcauaa

SEQ ID NO: 2003117 - RNA, 20 nt, Homo sapiens
cacuaccauagcuacaucag

SEQ ID NO: 2003118 - RNA, 14 nt, Homo sapiens
cccuugucaucucu

SEQ ID NO: 2003119 - RNA, 14 nt, Homo sapiens
gcuaaaugucaauu

SEQ ID NO: 2003120 - RNA, 18 nt, Homo sapiens
gacuucaggagcugacag

SEQ ID NO: 2003121 - RNA, 22 nt, Homo sapiens
cugucaggguuggaaaguccaa

SEQ ID NO: 2003122 - RNA, 15 nt, Homo sapiens
acuguggcuucuuaa

SEQ ID NO: 2003123 - RNA, 13 nt, Homo sapiens
cacauuucuuuga

SEQ ID NO: 2003124 - RNA, 22 nt, Homo sapiens
gcagggugugugcuagccucug

SEQ ID NO: 2003125 - RNA, 21 nt, Homo sapiens
ugagaucggcccagcucugac

SEQ ID NO: 2003126 - RNA, 18 nt, Homo sapiens
cagagacccaagcugccu

SEQ ID NO: 2003127 - RNA, 14 nt, Homo sapiens
cuuucagugccugc

SEQ ID NO: 2003128 - RNA, 20 nt, Homo sapiens
acugccgaugcccaauccag

SEQ ID NO: 2003129 - RNA, 14 nt, Homo sapiens
aaaggaaaguucua

SEQ ID NO: 2003130 - RNA, 17 nt, Homo sapiens
uauaaguuguaccaaaa

SEQ ID NO: 2003131 - RNA, 17 nt, Homo sapiens
ugcagugagugcugcuc

SEQ ID NO: 2003132 - RNA, 21 nt, Homo sapiens
aaguggugagaacuacucagg

SEQ ID NO: 2003133 - RNA, 19 nt, Homo sapiens
cccaucuaagcugcagcuu

SEQ ID NO: 2003134 - RNA, 22 nt, Homo sapiens
uuauaugaagcaagcuguguua

SEQ ID NO: 2003135 - RNA, 17 nt, Homo sapiens
acguggcuuuuagacag

SEQ ID NO: 2003136 - RNA, 22 nt, Homo sapiens
gaguaauaagcauggugucagu

SEQ ID NO: 2003137 - RNA, 21 nt, Homo sapiens
ugucucucacagagaaaaagu

SEQ ID NO: 2003138 - RNA, 22 nt, Homo sapiens
cugcacuuuggguuuuuaacuc

SEQ ID NO: 2003139 - RNA, 13 nt, Homo sapiens
ccgucuuccugug

SEQ ID NO: 2003140 - RNA, 21 nt, Homo sapiens
ucagggaugcucauuccauga

SEQ ID NO: 2003141 - RNA, 15 nt, Homo sapiens
ggccaggauggucuc

SEQ ID NO: 2003142 - RNA, 19 nt, Homo sapiens
gaaggcucugggaucuccc

SEQ ID NO: 2003143 - RNA, 21 nt, Homo sapiens
gcugaagcgagcccucaggag

SEQ ID NO: 2003144 - RNA, 19 nt, Homo sapiens
agauucuaaugaugaucaa

SEQ ID NO: 2003145 - RNA, 16 nt, Homo sapiens
uaagaagagaauuccu

SEQ ID NO: 2003146 - RNA, 13 nt, Homo sapiens
aaaugccucagcu

SEQ ID NO: 2003147 - RNA, 13 nt, Homo sapiens
ucccacacugugc

SEQ ID NO: 2003148 - RNA, 13 nt, Homo sapiens
agggaccuaggca

SEQ ID NO: 2003149 - RNA, 23 nt, Homo sapiens
gucaauuuuuaacuuaucuccag

SEQ ID NO: 2003150 - RNA, 19 nt, Homo sapiens
aacuuucacuuugcaaaga

SEQ ID NO: 2003151 - RNA, 16 nt, Homo sapiens
cauauauugcauuucu

SEQ ID NO: 2003152 - RNA, 17 nt, Homo sapiens
uaaauauuuugguucau

SEQ ID NO: 2003153 - RNA, 17 nt, Homo sapiens
augauuuuuaaguacaa

SEQ ID NO: 2003154 - RNA, 22 nt, Homo sapiens
aauggugcaaauccuacugaau

SEQ ID NO: 2003155 - RNA, 20 nt, Homo sapiens
ccuguaaucccaacacuuuu

SEQ ID NO: 2003156 - RNA, 17 nt, Homo sapiens
auuucauuguaugaugu

SEQ ID NO: 2003157 - RNA, 19 nt, Homo sapiens
ugcuaauaaaugaccaguu

SEQ ID NO: 2003158 - RNA, 20 nt, Homo sapiens
guuuucaucauuucagccaa

SEQ ID NO: 2003159 - RNA, 21 nt, Homo sapiens
gauauucccucuuguccuuua

SEQ ID NO: 2003160 - RNA, 15 nt, Homo sapiens
ucuaccagagugaug

SEQ ID NO: 2003161 - RNA, 15 nt, Homo sapiens
acucaccagauuuac

SEQ ID NO: 2003162 - RNA, 16 nt, Homo sapiens
guacaaaacucuguau

SEQ ID NO: 2003163 - RNA, 23 nt, Homo sapiens
aaguauuuugcuuguuaaauucu

SEQ ID NO: 2003164 - RNA, 19 nt, Homo sapiens
ucuccccucagccaaugaa

SEQ ID NO: 2003165 - RNA, 14 nt, Homo sapiens
gcaucacagaaugu

SEQ ID NO: 2003166 - RNA, 13 nt, Homo sapiens
gcccugugcaacc

SEQ ID NO: 2003167 - RNA, 15 nt, Homo sapiens
agccuggggugaccu

SEQ ID NO: 2003168 - RNA, 17 nt, Homo sapiens
agcucugcgccaaucac

SEQ ID NO: 2003169 - RNA, 12 nt, Homo sapiens
ucauucuuuauu

SEQ ID NO: 2003170 - RNA, 19 nt, Homo sapiens
aaguauucugccuuugcag

SEQ ID NO: 2003171 - RNA, 20 nt, Homo sapiens
uuucucggcaccagugccuc

SEQ ID NO: 2003172 - RNA, 21 nt, Homo sapiens
cucagcuaaugaaguguuuag

SEQ ID NO: 2003173 - RNA, 16 nt, Homo sapiens
aguaagagugguggcc

SEQ ID NO: 2003174 - RNA, 13 nt, Homo sapiens
gucuucacuuccc

SEQ ID NO: 2003175 - RNA, 18 nt, Homo sapiens
uggaacugucucucauga

SEQ ID NO: 2003176 - RNA, 12 nt, Homo sapiens
aggaugcuucug

SEQ ID NO: 2003177 - RNA, 13 nt, Homo sapiens
ucccagugugugu

SEQ ID NO: 2003178 - RNA, 18 nt, Homo sapiens
gcaagagacucuggccuc

SEQ ID NO: 2003179 - RNA, 18 nt, Homo sapiens
aucucuucucagaaggaa

SEQ ID NO: 2003180 - RNA, 17 nt, Homo sapiens
ggaauauaaaacaguca

SEQ ID NO: 2003181 - RNA, 23 nt, Homo sapiens
auguaccggcuuccauccuguca

SEQ ID NO: 2003182 - RNA, 15 nt, Homo sapiens
cauaaaucacaaaua

SEQ ID NO: 2003183 - RNA, 15 nt, Homo sapiens
ugaauaaguuuuauu

SEQ ID NO: 2003184 - RNA, 14 nt, Homo sapiens
aggggagacaucac

SEQ ID NO: 2003185 - RNA, 20 nt, Homo sapiens
aggacuuaaaauagucucau

SEQ ID NO: 2003186 - RNA, 23 nt, Homo sapiens
uucucuguaaggcaaaauaaucu

SEQ ID NO: 2003187 - RNA, 14 nt, Homo sapiens
uggagaaucuuaca

SEQ ID NO: 2003188 - RNA, 23 nt, Homo sapiens
caaaaauaccauuuuaguaugaa

SEQ ID NO: 2003189 - RNA, 20 nt, Homo sapiens
agacuggggacccuggacau

SEQ ID NO: 2003190 - RNA, 20 nt, Homo sapiens
cucugccagcguccccggcc

SEQ ID NO: 2003191 - RNA, 22 nt, Homo sapiens
agguaugugucagccaugacca

SEQ ID NO: 2003192 - RNA, 14 nt, Homo sapiens
ugcccuguguggcu

SEQ ID NO: 2003193 - RNA, 13 nt, Homo sapiens
gucuagacuuucu

SEQ ID NO: 2003194 - RNA, 18 nt, Homo sapiens
uggcuucuaugaucagaa

SEQ ID NO: 2003195 - RNA, 23 nt, Homo sapiens
ugaguuuggucccuaaauuugca

SEQ ID NO: 2003196 - RNA, 12 nt, Homo sapiens
guuaccaagaag

SEQ ID NO: 2003197 - RNA, 16 nt, Homo sapiens
agaaucaaauugcuac

SEQ ID NO: 2003198 - RNA, 15 nt, Homo sapiens
ggguuuuuaaucucc

SEQ ID NO: 2003199 - RNA, 15 nt, Homo sapiens
ucggccucuugagag

SEQ ID NO: 2003200 - RNA, 16 nt, Homo sapiens
uuauagccagguaccu

SEQ ID NO: 2003201 - RNA, 21 nt, Homo sapiens
ccuuauuuuugaauugacuga

SEQ ID NO: 2003202 - RNA, 17 nt, Homo sapiens
ugcccagagccacagaa

SEQ ID NO: 2003203 - RNA, 18 nt, Homo sapiens
cagccuucuucucuuaau

SEQ ID NO: 2003204 - RNA, 14 nt, Homo sapiens
ccaugugaacagca

SEQ ID NO: 2003205 - RNA, 19 nt, Homo sapiens
caggacuaacaacugggaa

SEQ ID NO: 2003206 - RNA, 22 nt, Homo sapiens
uccaugugccuuucuuugccuc

SEQ ID NO: 2003207 - RNA, 17 nt, Homo sapiens
ugguaggauaucuuggc

SEQ ID NO: 2003208 - RNA, 20 nt, Homo sapiens
ggacccacgaaacugcccug

SEQ ID NO: 2003209 - RNA, 17 nt, Homo sapiens
auugauagaacuacuuu

SEQ ID NO: 2003210 - RNA, 18 nt, Homo sapiens
ugaaagcagggacuugaa

SEQ ID NO: 2003211 - RNA, 21 nt, Homo sapiens
gaccuccagcuaaacaccaac

SEQ ID NO: 2003212 - RNA, 21 nt, Homo sapiens
agccccucucuuauaauucca

SEQ ID NO: 2003213 - RNA, 15 nt, Homo sapiens
ugcaguuugaucaaa

SEQ ID NO: 2003214 - RNA, 13 nt, Homo sapiens
cccacauggugau

SEQ ID NO: 2003215 - RNA, 21 nt, Homo sapiens
acaauaaauguauucaaauac

SEQ ID NO: 2003216 - RNA, 22 nt, Homo sapiens
aagucagugcccaacuguuaua

SEQ ID NO: 2003217 - RNA, 21 nt, Homo sapiens
uagccaucagaugaggcuccu

SEQ ID NO: 2003218 - RNA, 23 nt, Homo sapiens
aaaagcugaucauaagugaauuu

SEQ ID NO: 2003219 - RNA, 18 nt, Homo sapiens
aggaaacucuccaugauu

SEQ ID NO: 2003220 - RNA, 22 nt, Homo sapiens
cauguauggaaucccacuguau

SEQ ID NO: 2003221 - RNA, 16 nt, Homo sapiens
gguuauuucugugcaa

SEQ ID NO: 2003222 - RNA, 18 nt, Homo sapiens
cagccugggcaacagagc

SEQ ID NO: 2003223 - RNA, 18 nt, Homo sapiens
acagggaagaaacuuucu

SEQ ID NO: 2003224 - RNA, 23 nt, Homo sapiens
aggcuccugguuguuccucucaa

SEQ ID NO: 2003225 - RNA, 21 nt, Homo sapiens
caucauuuccugggagaaaga

SEQ ID NO: 2003226 - RNA, 20 nt, Homo sapiens
ccaucccgaugaaccugcau

SEQ ID NO: 2003227 - RNA, 21 nt, Homo sapiens
ugcuaauaacagugcauauuc

SEQ ID NO: 2003228 - RNA, 14 nt, Homo sapiens
cucuuaguagggac

SEQ ID NO: 2003229 - RNA, 19 nt, Homo sapiens
gauucaagaacaagcaaug

SEQ ID NO: 2003230 - RNA, 20 nt, Homo sapiens
cagcaccccccauuuuuuca

SEQ ID NO: 2003231 - RNA, 19 nt, Homo sapiens
aagcaguugagauucucua

SEQ ID NO: 2003232 - RNA, 23 nt, Homo sapiens
acugucuuaauuaaguaaacuaa

SEQ ID NO: 2003233 - RNA, 14 nt, Homo sapiens
uaacauugcacuuu

SEQ ID NO: 2003234 - RNA, 16 nt, Homo sapiens
ccaauuagcauuccau

SEQ ID NO: 2003235 - RNA, 15 nt, Homo sapiens
accuaaggauaugca

SEQ ID NO: 2003236 - RNA, 12 nt, Homo sapiens
ggacgaauuugc

SEQ ID NO: 2003237 - RNA, 11 nt, Homo sapiens
guggaaccagu

SEQ ID NO: 2003238 - RNA, 11 nt, Homo sapiens
ucucuaugaaa

SEQ ID NO: 2003239 - RNA, 22 nt, Homo sapiens
uagcagggggggaaaugcauuu

SEQ ID NO: 2003240 - RNA, 13 nt, Homo sapiens
cuuaagaauucaa

SEQ ID NO: 2003241 - RNA, 13 nt, Homo sapiens
uauuugaacacuu

SEQ ID NO: 2003242 - RNA, 20 nt, Homo sapiens
guggucagagggacugucag

SEQ ID NO: 2003243 - RNA, 14 nt, Homo sapiens
aggcaaaguccagc

SEQ ID NO: 2003244 - RNA, 20 nt, Homo sapiens
uggacugggaagcauuacuu

SEQ ID NO: 2003245 - RNA, 14 nt, Homo sapiens
agggagguggcaag

SEQ ID NO: 2003246 - RNA, 15 nt, Homo sapiens
aucaagaaucauuga

SEQ ID NO: 2003247 - RNA, 14 nt, Homo sapiens
aaguuauugauguu

SEQ ID NO: 2003248 - RNA, 21 nt, Homo sapiens
ucgcgauuaagagacagagaa

SEQ ID NO: 2003249 - RNA, 14 nt, Homo sapiens
acuucagacucucu

SEQ ID NO: 2003250 - RNA, 12 nt, Homo sapiens
uaaaaugacuau

SEQ ID NO: 2003251 - RNA, 11 nt, Homo sapiens
uaaaaaaagca

SEQ ID NO: 2003252 - RNA, 16 nt, Homo sapiens
ugauuuaagacuauga

SEQ ID NO: 2003253 - RNA, 13 nt, Homo sapiens
ccuaucuuccuuc

SEQ ID NO: 2003254 - RNA, 23 nt, Homo sapiens
auauucacuugacuaaaaucacu

SEQ ID NO: 2003255 - RNA, 20 nt, Homo sapiens
augcaaaugccuccaagcca

SEQ ID NO: 2003256 - RNA, 12 nt, Homo sapiens
caggcagucucu

SEQ ID NO: 2003257 - RNA, 13 nt, Homo sapiens
cggucaccuuccu

SEQ ID NO: 2003258 - RNA, 19 nt, Homo sapiens
acccuuugucucugagaag

SEQ ID NO: 2003259 - RNA, 20 nt, Homo sapiens
ggccaagaaagaaaccagac

SEQ ID NO: 2003260 - RNA, 16 nt, Homo sapiens
guucagcuucagacuu

SEQ ID NO: 2003261 - RNA, 22 nt, Homo sapiens
auauuaggacuaaggaacuaaa

SEQ ID NO: 2003262 - RNA, 12 nt, Homo sapiens
ggagcaucuccu

SEQ ID NO: 2003263 - RNA, 12 nt, Homo sapiens
guuacaguacug

SEQ ID NO: 2003264 - RNA, 12 nt, Homo sapiens
ucacgugcaaag

SEQ ID NO: 2003265 - RNA, 22 nt, Homo sapiens
aaauacugugcagaauaaugga

SEQ ID NO: 2003266 - RNA, 13 nt, Homo sapiens
uaauuauuuacuc

SEQ ID NO: 2003267 - RNA, 18 nt, Homo sapiens
aaaguacuacuguagaac

SEQ ID NO: 2003268 - RNA, 17 nt, Homo sapiens
uuaagagaaaugagcug

SEQ ID NO: 2003269 - RNA, 18 nt, Homo sapiens
gauacauaaacuuuugca

SEQ ID NO: 2003270 - RNA, 18 nt, Homo sapiens
guuuaguauuaugucuua

SEQ ID NO: 2003271 - RNA, 17 nt, Homo sapiens
cacacaguaagcacuca

SEQ ID NO: 2003272 - RNA, 17 nt, Homo sapiens
caaauaaggacacaaac

SEQ ID NO: 2003273 - RNA, 17 nt, Homo sapiens
cagguccucaguguccu

SEQ ID NO: 2003274 - RNA, 19 nt, Homo sapiens
gcugcaggucaacagcuau

SEQ ID NO: 2003275 - RNA, 20 nt, Homo sapiens
agcauaguaccucugcuauu

SEQ ID NO: 2003276 - RNA, 13 nt, Homo sapiens
gaugauuguucaa

SEQ ID NO: 2003277 - RNA, 17 nt, Homo sapiens
cuuuuguuuaccagaga

SEQ ID NO: 2003278 - RNA, 21 nt, Homo sapiens
cagcacuccaccuugggaccu

SEQ ID NO: 2003279 - RNA, 22 nt, Homo sapiens
uuccuucuguacuaaaguauug

SEQ ID NO: 2003280 - RNA, 16 nt, Homo sapiens
gcccugucagcaugaa

SEQ ID NO: 2003281 - RNA, 13 nt, Homo sapiens
aggcugagcugca

SEQ ID NO: 2003282 - RNA, 16 nt, Homo sapiens
agucuuccaccuggaa

SEQ ID NO: 2003283 - RNA, 14 nt, Homo sapiens
ccaauaaaacugau

SEQ ID NO: 2003284 - RNA, 16 nt, Homo sapiens
gacgggaggcuggaag

SEQ ID NO: 2003285 - RNA, 19 nt, Homo sapiens
gcccaacugcagaccaacu

SEQ ID NO: 2003286 - RNA, 17 nt, Homo sapiens
cccacucaugacugcau

SEQ ID NO: 2003287 - RNA, 17 nt, Homo sapiens
ugacuucacccacgcau

SEQ ID NO: 2003288 - RNA, 20 nt, Homo sapiens
aguuuaauuaucugcauuua

SEQ ID NO: 2003289 - RNA, 22 nt, Homo sapiens
ugggcagcaaaacgacacugcg

SEQ ID NO: 2003290 - RNA, 17 nt, Homo sapiens
cacucaaaauaugucaa

SEQ ID NO: 2003291 - RNA, 17 nt, Homo sapiens
cuucucucacuguguua

SEQ ID NO: 2003292 - RNA, 17 nt, Homo sapiens
guguccccuccacuguc

SEQ ID NO: 2003293 - RNA, 22 nt, Homo sapiens
caaagcccucccuaccuaccaa

SEQ ID NO: 2003294 - RNA, 14 nt, Homo sapiens
uuuuuuacacaaau

SEQ ID NO: 2003295 - RNA, 12 nt, Homo sapiens
ugcugugcauuu

SEQ ID NO: 2003296 - RNA, 21 nt, Homo sapiens
cuuucauuaggcaaaguacaa

SEQ ID NO: 2003297 - RNA, 22 nt, Homo sapiens
acauauuaggaaaauauggguu

SEQ ID NO: 2003298 - RNA, 16 nt, Homo sapiens
cugggauaugacaagc

SEQ ID NO: 2003299 - RNA, 20 nt, Homo sapiens
ucaguacugacuuucugauu

SEQ ID NO: 2003300 - RNA, 16 nt, Homo sapiens
caucuucccuacccuu

SEQ ID NO: 2003301 - RNA, 19 nt, Homo sapiens
cuguggggcugagcaacau

SEQ ID NO: 2003302 - RNA, 22 nt, Homo sapiens
cuaauaaauauuuagucugcau

SEQ ID NO: 2003303 - RNA, 19 nt, Homo sapiens
ggcuuuuccaagcugccac

SEQ ID NO: 2003304 - RNA, 15 nt, Homo sapiens
gcuuucccaacagcu

SEQ ID NO: 2003305 - RNA, 19 nt, Homo sapiens
aagucuguuucugcuuccu

SEQ ID NO: 2003306 - RNA, 14 nt, Homo sapiens
uagggacuuggggc

SEQ ID NO: 2003307 - RNA, 16 nt, Homo sapiens
ggccgagcccacacca

SEQ ID NO: 2003308 - RNA, 18 nt, Homo sapiens
guuaauaaguuucacuga

SEQ ID NO: 2003309 - RNA, 13 nt, Homo sapiens
aggagacagcagc

SEQ ID NO: 2003310 - RNA, 14 nt, Homo sapiens
ggcuuuuccaggaa

SEQ ID NO: 2003311 - RNA, 16 nt, Homo sapiens
auugguagaaggauuu

SEQ ID NO: 2003312 - RNA, 14 nt, Homo sapiens
uccuggaaaacugg

SEQ ID NO: 2003313 - RNA, 15 nt, Homo sapiens
uuauuacaauguauc

SEQ ID NO: 2003314 - RNA, 19 nt, Homo sapiens
cuacccgagguuugcaaau

SEQ ID NO: 2003315 - RNA, 19 nt, Homo sapiens
uacacacauauacauauau

SEQ ID NO: 2003316 - RNA, 19 nt, Homo sapiens
cacuuuuuccauuucuuca

SEQ ID NO: 2003317 - RNA, 19 nt, Homo sapiens
gcucuccuucacucugaca

SEQ ID NO: 2003318 - RNA, 18 nt, Homo sapiens
ucguccaccccagugugc

SEQ ID NO: 2003319 - RNA, 22 nt, Homo sapiens
aaacuuauuugcugcagaauuu

SEQ ID NO: 2003320 - RNA, 20 nt, Homo sapiens
ugcaauuugucuagcaugcu

SEQ ID NO: 2003321 - RNA, 16 nt, Homo sapiens
caaacuucuggcuuca

SEQ ID NO: 2003322 - RNA, 22 nt, Homo sapiens
aucacugccacacucuccauca

SEQ ID NO: 2003323 - RNA, 14 nt, Homo sapiens
ugccuggccuuuau

SEQ ID NO: 2003324 - RNA, 14 nt, Homo sapiens
ugucuugccucuag

SEQ ID NO: 2003325 - RNA, 19 nt, Homo sapiens
aguuuguugugaggauuaa

SEQ ID NO: 2003326 - RNA, 20 nt, Homo sapiens
aagaugacacaacugcacuc

SEQ ID NO: 2003327 - RNA, 22 nt, Homo sapiens
ugugcaagaccguuuguccacu

SEQ ID NO: 2003328 - RNA, 15 nt, Homo sapiens
cuuaaguucuaugaa

SEQ ID NO: 2003329 - RNA, 15 nt, Homo sapiens
acaaagauacuugau

SEQ ID NO: 2003330 - RNA, 17 nt, Homo sapiens
cauguggcuaaaugccu

SEQ ID NO: 2003331 - RNA, 17 nt, Homo sapiens
cauuguagaagcagcau

SEQ ID NO: 2003332 - RNA, 22 nt, Homo sapiens
augaguuuuugauagcuuuauu

SEQ ID NO: 2003333 - RNA, 24 nt, Homo sapiens
uaaagcaguagacaauccccacau

SEQ ID NO: 2003334 - RNA, 22 nt, Homo sapiens
gcagugugcuccggccacacau

SEQ ID NO: 2003335 - RNA, 14 nt, Homo sapiens
ugcucugucuucca

SEQ ID NO: 2003336 - RNA, 22 nt, Homo sapiens
aacuguucuggccucagaccaa

SEQ ID NO: 2003337 - RNA, 19 nt, Homo sapiens
agcuaugcccggaccucca

SEQ ID NO: 2003338 - RNA, 16 nt, Homo sapiens
gaacaccaagugucug

SEQ ID NO: 2003339 - RNA, 15 nt, Homo sapiens
uccuccccucuugag

SEQ ID NO: 2003340 - RNA, 20 nt, Homo sapiens
aagccuuugacuuaaggguu

SEQ ID NO: 2003341 - RNA, 23 nt, Homo sapiens
uuuaaagccagucuuguucacau

SEQ ID NO: 2003342 - RNA, 19 nt, Homo sapiens
uguuuagaaugucaguuga

SEQ ID NO: 2003343 - RNA, 18 nt, Homo sapiens
uguacugugucucaugga

SEQ ID NO: 2003344 - RNA, 11 nt, Homo sapiens
ugcagcaauau

SEQ ID NO: 2003345 - RNA, 17 nt, Homo sapiens
agacuuucaaacauaua

SEQ ID NO: 2003346 - RNA, 17 nt, Homo sapiens
gcggcuucaccugcgug

SEQ ID NO: 2003347 - RNA, 20 nt, Homo sapiens
uaagcagaaagugccuuuca

SEQ ID NO: 2003348 - RNA, 14 nt, Homo sapiens
acucuugccuguuu

SEQ ID NO: 2003349 - RNA, 14 nt, Homo sapiens
uagcuaauaacaug

SEQ ID NO: 2003350 - RNA, 13 nt, Homo sapiens
uagagacuguaaa

SEQ ID NO: 2003351 - RNA, 19 nt, Homo sapiens
cauuagaagaaaacauaua

SEQ ID NO: 2003352 - RNA, 23 nt, Homo sapiens
cacauuuuggggcuagacuuccc

SEQ ID NO: 2003353 - RNA, 12 nt, Homo sapiens
aaauggcucaga

SEQ ID NO: 2003354 - RNA, 19 nt, Homo sapiens
ccagggggaagaugccaag

SEQ ID NO: 2003355 - RNA, 15 nt, Homo sapiens
ccuguccuaucacuc

SEQ ID NO: 2003356 - RNA, 13 nt, Homo sapiens
agccucagaauaa

SEQ ID NO: 2003357 - RNA, 15 nt, Homo sapiens
caauaucauaucauc

SEQ ID NO: 2003358 - RNA, 17 nt, Homo sapiens
acauuccauuugaagca

SEQ ID NO: 2003359 - RNA, 15 nt, Homo sapiens
uucauacacuaacca

SEQ ID NO: 2003360 - RNA, 17 nt, Homo sapiens
auugcuguugaucguca

SEQ ID NO: 2003361 - RNA, 15 nt, Homo sapiens
ugacccuuguggcac

SEQ ID NO: 2003362 - RNA, 13 nt, Homo sapiens
ccacccaguuccu

SEQ ID NO: 2003363 - RNA, 16 nt, Homo sapiens
accugccaaggagcau

SEQ ID NO: 2003364 - RNA, 17 nt, Homo sapiens
gcagcucuccaccagcu

SEQ ID NO: 2003365 - RNA, 20 nt, Homo sapiens
ucugcccugaacccacugcu

SEQ ID NO: 2003366 - RNA, 19 nt, Homo sapiens
aaucagccagacauggugg

SEQ ID NO: 2003367 - RNA, 21 nt, Homo sapiens
gcuuucucagugucagcacuc

SEQ ID NO: 2003368 - RNA, 12 nt, Homo sapiens
ugaagacuugcc

SEQ ID NO: 2003369 - RNA, 23 nt, Homo sapiens
uaaaaauugucuucauguacauu

SEQ ID NO: 2003370 - RNA, 16 nt, Homo sapiens
uucuuccaagacucca

SEQ ID NO: 2003371 - RNA, 14 nt, Homo sapiens
acugcuucauguga

SEQ ID NO: 2003372 - RNA, 20 nt, Homo sapiens
uaagacaucucaaauacagu

SEQ ID NO: 2003373 - RNA, 18 nt, Homo sapiens
agagcaaugacugugcuc

SEQ ID NO: 2003374 - RNA, 12 nt, Homo sapiens
accucuuuggaa

SEQ ID NO: 2003375 - RNA, 19 nt, Homo sapiens
uggggggacccagugcaga

SEQ ID NO: 2003376 - RNA, 16 nt, Homo sapiens
uuuguaauaaacucuc

SEQ ID NO: 2003377 - RNA, 22 nt, Homo sapiens
cauccugcucagcugcgucaug

SEQ ID NO: 2003378 - RNA, 19 nt, Homo sapiens
cauaugucacgaacuugaa

SEQ ID NO: 2003379 - RNA, 17 nt, Homo sapiens
guccaugugugugcaag

SEQ ID NO: 2003380 - RNA, 22 nt, Homo sapiens
aggauuuucuuuuuaacuuuac

SEQ ID NO: 2003381 - RNA, 14 nt, Homo sapiens
ucuaauaaacuugg

SEQ ID NO: 2003382 - RNA, 21 nt, Homo sapiens
cagaaaccaaagugaccucca

SEQ ID NO: 2003383 - RNA, 14 nt, Homo sapiens
acaauuuaaugcac

SEQ ID NO: 2003384 - RNA, 17 nt, Homo sapiens
aaguucaggcucugaga

SEQ ID NO: 2003385 - RNA, 14 nt, Homo sapiens
agcugagugaaaaa

SEQ ID NO: 2003386 - RNA, 20 nt, Homo sapiens
uugaggcaggcacugccaaa

SEQ ID NO: 2003387 - RNA, 15 nt, Homo sapiens
ugcccuauauaccuc

SEQ ID NO: 2003388 - RNA, 14 nt, Homo sapiens
uugauuaaugaacu

SEQ ID NO: 2003389 - RNA, 19 nt, Homo sapiens
ggcaagaacuuguuuacaa

SEQ ID NO: 2003390 - RNA, 15 nt, Homo sapiens
aaguggccuuuccag

SEQ ID NO: 2003391 - RNA, 22 nt, Homo sapiens
uauuggacauccccagaaaaga

SEQ ID NO: 2003392 - RNA, 15 nt, Homo sapiens
gccaggcagugcagc

SEQ ID NO: 2003393 - RNA, 23 nt, Homo sapiens
agccaacccaacugacuucugcu

SEQ ID NO: 2003394 - RNA, 18 nt, Homo sapiens
gaccuaaagcaagccuga

SEQ ID NO: 2003395 - RNA, 14 nt, Homo sapiens
ggagagagacucca

SEQ ID NO: 2003396 - RNA, 16 nt, Homo sapiens
ugggccugugugcacc

SEQ ID NO: 2003397 - RNA, 15 nt, Homo sapiens
acagagccaugacuc

SEQ ID NO: 2003398 - RNA, 19 nt, Homo sapiens
cugaaugcuccauuaaucc

SEQ ID NO: 2003399 - RNA, 15 nt, Homo sapiens
uuauaaaugagguca

SEQ ID NO: 2003400 - RNA, 23 nt, Homo sapiens
acagccaccaagaaguggcugcc

SEQ ID NO: 2003401 - RNA, 23 nt, Homo sapiens
gcaccaaagacaucagucuccaa

SEQ ID NO: 2003402 - RNA, 17 nt, Homo sapiens
uauaaggaaagccaaau

SEQ ID NO: 2003403 - RNA, 14 nt, Homo sapiens
uucuguuguuccau

SEQ ID NO: 2003404 - RNA, 16 nt, Homo sapiens
uuucuaccuuuacuac

SEQ ID NO: 2003405 - RNA, 22 nt, Homo sapiens
cucuguucucuccccucacauc

SEQ ID NO: 2003406 - RNA, 18 nt, Homo sapiens
accucaagggcuuuccca

SEQ ID NO: 2003407 - RNA, 20 nt, Homo sapiens
agaacuccaguuuucaaauc

SEQ ID NO: 2003408 - RNA, 15 nt, Homo sapiens
uuuaccguguguuau

SEQ ID NO: 2003409 - RNA, 16 nt, Homo sapiens
gcaucuugcuggcuac

SEQ ID NO: 2003410 - RNA, 20 nt, Homo sapiens
ucaugugaucacaauuugca

SEQ ID NO: 2003411 - RNA, 18 nt, Homo sapiens
uaaucaaugaucaucuca

SEQ ID NO: 2003412 - RNA, 13 nt, Homo sapiens
aacucuccuccau

SEQ ID NO: 2003413 - RNA, 23 nt, Homo sapiens
auacaugcaacagaagugacuuc

SEQ ID NO: 2003414 - RNA, 18 nt, Homo sapiens
gaaacccuuuuacaguca

SEQ ID NO: 2003415 - RNA, 19 nt, Homo sapiens
uugugaaguaggugaucuu

SEQ ID NO: 2003416 - RNA, 20 nt, Homo sapiens
uaaucuccugccagcucuuc

SEQ ID NO: 2003417 - RNA, 20 nt, Homo sapiens
ugcucagcccugcaccaugc

SEQ ID NO: 2003418 - RNA, 21 nt, Homo sapiens
ccaggaaaaaauaaaaggggg

SEQ ID NO: 2003419 - RNA, 14 nt, Homo sapiens
ucccccugcugcug

SEQ ID NO: 2003420 - RNA, 15 nt, Homo sapiens
cucccccuucuccca

SEQ ID NO: 2003421 - RNA, 23 nt, Homo sapiens
caaagaauuucaauuuguucagu

SEQ ID NO: 2003422 - RNA, 15 nt, Homo sapiens
ucaucucucuaccuc

SEQ ID NO: 2003423 - RNA, 20 nt, Homo sapiens
ucagugaagaugccagugaa

SEQ ID NO: 2003424 - RNA, 21 nt, Homo sapiens
gucugcucccaauucaccucg

SEQ ID NO: 2003425 - RNA, 14 nt, Homo sapiens
accaaacaaggaag

SEQ ID NO: 2003426 - RNA, 18 nt, Homo sapiens
uuucuagaguagcuccca

SEQ ID NO: 2003427 - RNA, 18 nt, Homo sapiens
cucugguccaugaacuca

SEQ ID NO: 2003428 - RNA, 22 nt, Homo sapiens
agaagcucucgauggacaauga

SEQ ID NO: 2003429 - RNA, 18 nt, Homo sapiens
cauggagagcuggagccu

SEQ ID NO: 2003430 - RNA, 18 nt, Homo sapiens
cucucagccccucagaga

SEQ ID NO: 2003431 - RNA, 13 nt, Homo sapiens
guaacauaaugca

SEQ ID NO: 2003432 - RNA, 17 nt, Homo sapiens
auccaggcaccaggacu

SEQ ID NO: 2003433 - RNA, 15 nt, Homo sapiens
gauuacaggugugag

SEQ ID NO: 2003434 - RNA, 15 nt, Homo sapiens
gaugcagauccagag

SEQ ID NO: 2003435 - RNA, 17 nt, Homo sapiens
ccagaguggcccaagac

SEQ ID NO: 2003436 - RNA, 19 nt, Homo sapiens
gauugaagcccagugaauu

SEQ ID NO: 2003437 - RNA, 17 nt, Homo sapiens
auuacuuuaauacucac

SEQ ID NO: 2003438 - RNA, 22 nt, Homo sapiens
uggguugcagacaggaaucuua

SEQ ID NO: 2003439 - RNA, 23 nt, Homo sapiens
aaagaauucucagcagagcucaa

SEQ ID NO: 2003440 - RNA, 14 nt, Homo sapiens
uucucaaaauuccu

SEQ ID NO: 2003441 - RNA, 21 nt, Homo sapiens
aagguuaaaggaaaagcacaa

SEQ ID NO: 2003442 - RNA, 18 nt, Homo sapiens
agugaaacuccaucucaa

SEQ ID NO: 2003443 - RNA, 21 nt, Homo sapiens
gcaaggcaggggcacgguggu

SEQ ID NO: 2003444 - RNA, 18 nt, Homo sapiens
uuccugagauucugggaa

SEQ ID NO: 2003445 - RNA, 19 nt, Homo sapiens
caccucaacuccgugcuua

SEQ ID NO: 2003446 - RNA, 12 nt, Homo sapiens
aaauacugccua

SEQ ID NO: 2003447 - RNA, 19 nt, Homo sapiens
gaggcacgcaccaccgcgc

SEQ ID NO: 2003448 - RNA, 16 nt, Homo sapiens
gggcccucugccucau

SEQ ID NO: 2003449 - RNA, 21 nt, Homo sapiens
ugacuucuuggugcuguugaa

SEQ ID NO: 2003450 - RNA, 22 nt, Homo sapiens
accuuauaguucauagcaauua

SEQ ID NO: 2003451 - RNA, 12 nt, Homo sapiens
gucacagccgcg

SEQ ID NO: 2003452 - RNA, 15 nt, Homo sapiens
cuuaggcaugcacag

SEQ ID NO: 2003453 - RNA, 20 nt, Homo sapiens
aaaaaggaaagaacugucau

SEQ ID NO: 2003454 - RNA, 15 nt, Homo sapiens
agguguguccuugaa

SEQ ID NO: 2003455 - RNA, 14 nt, Homo sapiens
aaaauuguggcauu

SEQ ID NO: 2003456 - RNA, 18 nt, Homo sapiens
guaugauuuauccucaca

SEQ ID NO: 2003457 - RNA, 23 nt, Homo sapiens
gggggcucccguggccuguagaa

SEQ ID NO: 2003458 - RNA, 20 nt, Homo sapiens
ugaaaauguaucugaguauu

SEQ ID NO: 2003459 - RNA, 22 nt, Homo sapiens
gaagauuuuauucuuauuucau

SEQ ID NO: 2003460 - RNA, 19 nt, Homo sapiens
cuccggccccaccucguga

SEQ ID NO: 2003461 - RNA, 15 nt, Homo sapiens
aauguuuucacugua

SEQ ID NO: 2003462 - RNA, 18 nt, Homo sapiens
ccaaaauuacuucucucu

SEQ ID NO: 2003463 - RNA, 21 nt, Homo sapiens
cagggcugcuccccaacaccu

SEQ ID NO: 2003464 - RNA, 15 nt, Homo sapiens
guuuuugcaggugag

SEQ ID NO: 2003465 - RNA, 21 nt, Homo sapiens
augccaacucagcccccugac

SEQ ID NO: 2003466 - RNA, 21 nt, Homo sapiens
ggauauacugcagcuuuacug

SEQ ID NO: 2003467 - RNA, 23 nt, Homo sapiens
gccaagcagggaggaagaagcuu

SEQ ID NO: 2003468 - RNA, 18 nt, Homo sapiens
auuuuuuuuuaacaucuc

SEQ ID NO: 2003469 - RNA, 21 nt, Homo sapiens
ccacacugcuacacuucugau

SEQ ID NO: 2003470 - RNA, 13 nt, Homo sapiens
ugaaaaugcaacu

SEQ ID NO: 2003471 - RNA, 17 nt, Homo sapiens
gcagauagaaagcauua

SEQ ID NO: 2003472 - RNA, 15 nt, Homo sapiens
gacagaucauuucag

SEQ ID NO: 2003473 - RNA, 20 nt, Homo sapiens
cugagcgggucauggggcaa

SEQ ID NO: 2003474 - RNA, 18 nt, Homo sapiens
ucauugauucguaugcca

SEQ ID NO: 2003475 - RNA, 20 nt, Homo sapiens
aguuuccuaggaugucaugu

SEQ ID NO: 2003476 - RNA, 20 nt, Homo sapiens
uauucaacagcaagugugaa

SEQ ID NO: 2003477 - RNA, 21 nt, Homo sapiens
cugcaaagggaaucucuugcc

SEQ ID NO: 2003478 - RNA, 13 nt, Homo sapiens
agaggaggagaaa

SEQ ID NO: 2003479 - RNA, 18 nt, Homo sapiens
cagauuucuacacuuuau

SEQ ID NO: 2003480 - RNA, 15 nt, Homo sapiens
caggaagagaaggag

SEQ ID NO: 2003481 - RNA, 23 nt, Homo sapiens
ccugguuuucucuuacugcagua

SEQ ID NO: 2003482 - RNA, 16 nt, Homo sapiens
agcgaaacacacaaac

SEQ ID NO: 2003483 - RNA, 14 nt, Homo sapiens
acaccauucauucc

SEQ ID NO: 2003484 - RNA, 18 nt, Homo sapiens
uacauaguucuuacuacu

SEQ ID NO: 2003485 - RNA, 15 nt, Homo sapiens
uauuaucauugaaag

SEQ ID NO: 2003486 - RNA, 15 nt, Homo sapiens
gguggggcuuggaag

SEQ ID NO: 2003487 - RNA, 18 nt, Homo sapiens
auaaugcuuuuacuaagc

SEQ ID NO: 2003488 - RNA, 22 nt, Homo sapiens
gacacuccaugagugucuguga

SEQ ID NO: 2003489 - RNA, 21 nt, Homo sapiens
acauaggcaaagcaaucaagc

SEQ ID NO: 2003490 - RNA, 22 nt, Homo sapiens
cuucccucucugcagacuuccc

SEQ ID NO: 2003491 - RNA, 16 nt, Homo sapiens
aaauaucuguuuuuaa

SEQ ID NO: 2003492 - RNA, 15 nt, Homo sapiens
ggccccccuccaggc

SEQ ID NO: 2003493 - RNA, 21 nt, Homo sapiens
ggccuugggaaggaaggcagu

SEQ ID NO: 2003494 - RNA, 19 nt, Homo sapiens
gcccagugcaugguggcca

SEQ ID NO: 2003495 - RNA, 19 nt, Homo sapiens
gcaaagugauucacugugc

SEQ ID NO: 2003496 - RNA, 19 nt, Homo sapiens
ucuugcuagacacacucca

SEQ ID NO: 2003497 - RNA, 21 nt, Homo sapiens
gcauucugagcaggggaacaa

SEQ ID NO: 2003498 - RNA, 15 nt, Homo sapiens
auuuuggggucucuu

SEQ ID NO: 2003499 - RNA, 23 nt, Homo sapiens
auaacauugcacuuuauaaacac

SEQ ID NO: 2003500 - RNA, 24 nt, Homo sapiens
agaagccuaauugucacaucaagc

SEQ ID NO: 2003501 - RNA, 21 nt, Homo sapiens
uccccaugggaucuugaggga

SEQ ID NO: 2003502 - RNA, 16 nt, Homo sapiens
uaucuaguguguccug

SEQ ID NO: 2003503 - RNA, 13 nt, Homo sapiens
agcaacugcagaa

SEQ ID NO: 2003504 - RNA, 23 nt, Homo sapiens
uuagaguauuccucaaaacugua

SEQ ID NO: 2003505 - RNA, 21 nt, Homo sapiens
guccacuguucuguucucaua

SEQ ID NO: 2003506 - RNA, 13 nt, Homo sapiens
caggacaccugcc

SEQ ID NO: 2003507 - RNA, 15 nt, Homo sapiens
gcugaugcauucccg

SEQ ID NO: 2003508 - RNA, 23 nt, Homo sapiens
guaggcgaaucauuuguucaaag

SEQ ID NO: 2003509 - RNA, 17 nt, Homo sapiens
aauucacuccacuugga

SEQ ID NO: 2003510 - RNA, 19 nt, Homo sapiens
ggagguggagauugcagug

SEQ ID NO: 2003511 - RNA, 14 nt, Homo sapiens
ugccaccacccacc

SEQ ID NO: 2003512 - RNA, 16 nt, Homo sapiens
gugacauuccacagag

SEQ ID NO: 2003513 - RNA, 16 nt, Homo sapiens
uuuucucugugcuuca

SEQ ID NO: 2003514 - RNA, 14 nt, Homo sapiens
caugaaucacugug

SEQ ID NO: 2003515 - RNA, 18 nt, Homo sapiens
aaaguuagguuauaagaa

SEQ ID NO: 2003516 - RNA, 15 nt, Homo sapiens
aaauaacuaguacaa

SEQ ID NO: 2003517 - RNA, 12 nt, Homo sapiens
uuugccacugaa

SEQ ID NO: 2003518 - RNA, 15 nt, Homo sapiens
aauguuuuuauuuca

SEQ ID NO: 2003519 - RNA, 20 nt, Homo sapiens
cuuuauagagugucucaggg

SEQ ID NO: 2003520 - RNA, 22 nt, Homo sapiens
augagccacugcaccugcccag

SEQ ID NO: 2003521 - RNA, 15 nt, Homo sapiens
aagcaaauguuggga

SEQ ID NO: 2003522 - RNA, 19 nt, Homo sapiens
ucuugcaaagcgacagauu

SEQ ID NO: 2003523 - RNA, 21 nt, Homo sapiens
uagcaguaaauacuugcaguu

SEQ ID NO: 2003524 - RNA, 17 nt, Homo sapiens
gauacgcuggucuggau

SEQ ID NO: 2003525 - RNA, 16 nt, Homo sapiens
ugccccaggacuguca

SEQ ID NO: 2003526 - RNA, 19 nt, Homo sapiens
ucuuaggguacagcccagg

SEQ ID NO: 2003527 - RNA, 16 nt, Homo sapiens
cagaauaaauaagcaa

SEQ ID NO: 2003528 - RNA, 17 nt, Homo sapiens
cauaguacuggcacaaa

SEQ ID NO: 2003529 - RNA, 15 nt, Homo sapiens
cccuccugucucuaa

SEQ ID NO: 2003530 - RNA, 17 nt, Homo sapiens
gcacauagagauaugca

SEQ ID NO: 2003531 - RNA, 12 nt, Homo sapiens
ccaaauacauua

SEQ ID NO: 2003532 - RNA, 16 nt, Homo sapiens
caguuauacccaguau

SEQ ID NO: 2003533 - RNA, 18 nt, Homo sapiens
ucccuugggcucugauga

SEQ ID NO: 2003534 - RNA, 20 nt, Homo sapiens
aucaugcgauggucccccac

SEQ ID NO: 2003535 - RNA, 18 nt, Homo sapiens
ccgugugugaaauucucu

SEQ ID NO: 2003536 - RNA, 14 nt, Homo sapiens
caccuucucggcaa

SEQ ID NO: 2003537 - RNA, 18 nt, Homo sapiens
auaucagugggcucucuu

SEQ ID NO: 2003538 - RNA, 18 nt, Homo sapiens
ccagaugagaagucugcu

SEQ ID NO: 2003539 - RNA, 16 nt, Homo sapiens
aaaagguaacuguaca

SEQ ID NO: 2003540 - RNA, 13 nt, Homo sapiens
cccagcgcagugc

SEQ ID NO: 2003541 - RNA, 19 nt, Homo sapiens
ucuaugaaguugcuguuua

SEQ ID NO: 2003542 - RNA, 22 nt, Homo sapiens
auuuguaaaucugccacaaaaa

SEQ ID NO: 2003543 - RNA, 20 nt, Homo sapiens
auuuacagcccucagcaaug

SEQ ID NO: 2003544 - RNA, 16 nt, Homo sapiens
ucuuuuaaaaucauga

SEQ ID NO: 2003545 - RNA, 23 nt, Homo sapiens
accuguuguccugaacugugagu

SEQ ID NO: 2003546 - RNA, 15 nt, Homo sapiens
gcauaugcacaguca

SEQ ID NO: 2003547 - RNA, 14 nt, Homo sapiens
agagagcccaugag

SEQ ID NO: 2003548 - RNA, 18 nt, Homo sapiens
acuacaugaaauaaugca

SEQ ID NO: 2003549 - RNA, 22 nt, Homo sapiens
gaguuuuccucuauacaucucu

SEQ ID NO: 2003550 - RNA, 14 nt, Homo sapiens
uccagcucaaggga

SEQ ID NO: 2003551 - RNA, 20 nt, Homo sapiens
aggagcccuuacccucccac

SEQ ID NO: 2003552 - RNA, 16 nt, Homo sapiens
cauucuggcucaggga

SEQ ID NO: 2003553 - RNA, 17 nt, Homo sapiens
caggaagcccaggagcc

SEQ ID NO: 2003554 - RNA, 16 nt, Homo sapiens
cagaaugaaaccacau

SEQ ID NO: 2003555 - RNA, 15 nt, Homo sapiens
aaacugccuuucugc

SEQ ID NO: 2003556 - RNA, 15 nt, Homo sapiens
uuaaccacaauacca

SEQ ID NO: 2003557 - RNA, 16 nt, Homo sapiens
gacgcccccaccagcu

SEQ ID NO: 2003558 - RNA, 19 nt, Homo sapiens
cacaccacaaccaccuuca

SEQ ID NO: 2003559 - RNA, 15 nt, Homo sapiens
ugcauuuauugccuc

SEQ ID NO: 2003560 - RNA, 20 nt, Homo sapiens
auuaguacuuauguugcaca

SEQ ID NO: 2003561 - RNA, 14 nt, Homo sapiens
aaggugaggggaug

SEQ ID NO: 2003562 - RNA, 23 nt, Homo sapiens
ccuaaccaugggcucagggccag

SEQ ID NO: 2003563 - RNA, 16 nt, Homo sapiens
gggaaggccugaggga

SEQ ID NO: 2003564 - RNA, 16 nt, Homo sapiens
ccuugcuuaccucuca

SEQ ID NO: 2003565 - RNA, 13 nt, Homo sapiens
aaugcuaaaacau

SEQ ID NO: 2003566 - RNA, 21 nt, Homo sapiens
cuccuuaaaauaaaacacugu

SEQ ID NO: 2003567 - RNA, 16 nt, Homo sapiens
ucuccuguggagucaa

SEQ ID NO: 2003568 - RNA, 21 nt, Homo sapiens
ucuucguacauagucuguucc

SEQ ID NO: 2003569 - RNA, 12 nt, Homo sapiens
augcugguggcc

SEQ ID NO: 2003570 - RNA, 18 nt, Homo sapiens
agaguggcagccaagagc

SEQ ID NO: 2003571 - RNA, 21 nt, Homo sapiens
auuuaauaaaugacaaaugua

SEQ ID NO: 2003572 - RNA, 21 nt, Homo sapiens
caauacuguaggaacaagcau

SEQ ID NO: 2003573 - RNA, 21 nt, Homo sapiens
gaagacccaguguaaagaaua

SEQ ID NO: 2003574 - RNA, 14 nt, Homo sapiens
uacuaaaccucaca

SEQ ID NO: 2003575 - RNA, 15 nt, Homo sapiens
uaaguuguugauguu

SEQ ID NO: 2003576 - RNA, 18 nt, Homo sapiens
agagaauggccugagaca

SEQ ID NO: 2003577 - RNA, 17 nt, Homo sapiens
aggggaugguagaccuu

SEQ ID NO: 2003578 - RNA, 18 nt, Homo sapiens
agugacuccagggugaca

SEQ ID NO: 2003579 - RNA, 23 nt, Homo sapiens
uccucugcuugucauucugcuaa

SEQ ID NO: 2003580 - RNA, 20 nt, Homo sapiens
cacgcagggccauccacugu

SEQ ID NO: 2003581 - RNA, 18 nt, Homo sapiens
ugaguaauuuucugaugg

SEQ ID NO: 2003582 - RNA, 22 nt, Homo sapiens
uccaucaccugaaacacuggac

SEQ ID NO: 2003583 - RNA, 19 nt, Homo sapiens
cagaaaauuaaacuacaga

SEQ ID NO: 2003584 - RNA, 22 nt, Homo sapiens
ccugagauccugcacaaggugg

SEQ ID NO: 2003585 - RNA, 16 nt, Homo sapiens
aacuucuguacaguaa

SEQ ID NO: 2003586 - RNA, 17 nt, Homo sapiens
accacugggcaaacaga

SEQ ID NO: 2003587 - RNA, 16 nt, Homo sapiens
uaccucuuaacaauuu

SEQ ID NO: 2003588 - RNA, 20 nt, Homo sapiens
ggcuggagugcaguggugcu

SEQ ID NO: 2003589 - RNA, 17 nt, Homo sapiens
gcuccagcaagcaaaca

SEQ ID NO: 2003590 - RNA, 23 nt, Homo sapiens
augaaugaaauauaaacugugag

SEQ ID NO: 2003591 - RNA, 21 nt, Homo sapiens
ggcugggggagggacugcuga

SEQ ID NO: 2003592 - RNA, 20 nt, Homo sapiens
ucuugaaaaacuuacaaguc

SEQ ID NO: 2003593 - RNA, 14 nt, Homo sapiens
gugauucuuagcaa

SEQ ID NO: 2003594 - RNA, 20 nt, Homo sapiens
aauuauugacacugaacuua

SEQ ID NO: 2003595 - RNA, 19 nt, Homo sapiens
gcgcucaggggcuccaugc

SEQ ID NO: 2003596 - RNA, 17 nt, Homo sapiens
ucagcagccucacugca

SEQ ID NO: 2003597 - RNA, 23 nt, Homo sapiens
caugguagaaaaugcaccaaaua

SEQ ID NO: 2003598 - RNA, 12 nt, Homo sapiens
aaugaacaucuc

SEQ ID NO: 2003599 - RNA, 13 nt, Homo sapiens
aagagauacccac

SEQ ID NO: 2003600 - RNA, 14 nt, Homo sapiens
ggcuccagcaccuu

SEQ ID NO: 2003601 - RNA, 23 nt, Homo sapiens
ucacuggcagccugcaccuggug

SEQ ID NO: 2003602 - RNA, 21 nt, Homo sapiens
uccuuagucccccuggucuga

SEQ ID NO: 2003603 - RNA, 12 nt, Homo sapiens
cggauggugcau

SEQ ID NO: 2003604 - RNA, 21 nt, Homo sapiens
uuucuaauacaagcauauguu

SEQ ID NO: 2003605 - RNA, 17 nt, Homo sapiens
agagugaagagcauuug

SEQ ID NO: 2003606 - RNA, 14 nt, Homo sapiens
ugaacuaaugauaa

SEQ ID NO: 2003607 - RNA, 17 nt, Homo sapiens
aaacauuaaauguccau

SEQ ID NO: 2003608 - RNA, 21 nt, Homo sapiens
agcagaaggcaggaccaugag

SEQ ID NO: 2003609 - RNA, 13 nt, Homo sapiens
acuggcaucuuaa

SEQ ID NO: 2003610 - RNA, 22 nt, Homo sapiens
acaguauggcagcuuuccucaa

SEQ ID NO: 2003611 - RNA, 19 nt, Homo sapiens
uccagccgcugcacaucac

SEQ ID NO: 2003612 - RNA, 21 nt, Homo sapiens
aaggugcacauuuuccacgga

SEQ ID NO: 2003613 - RNA, 15 nt, Homo sapiens
auccuguuaagagau

SEQ ID NO: 2003614 - RNA, 15 nt, Homo sapiens
accauggacacuaca

SEQ ID NO: 2003615 - RNA, 17 nt, Homo sapiens
agauucuagaugauuaa

SEQ ID NO: 2003616 - RNA, 16 nt, Homo sapiens
ugacaagggcugaccu

SEQ ID NO: 2003617 - RNA, 18 nt, Homo sapiens
ccagccugggcaacagau

SEQ ID NO: 2003618 - RNA, 19 nt, Homo sapiens
agagaugcgaaccacccaa

SEQ ID NO: 2003619 - RNA, 14 nt, Homo sapiens
cacuuaguaguuuu

SEQ ID NO: 2003620 - RNA, 18 nt, Homo sapiens
aauguucugggaagggac

SEQ ID NO: 2003621 - RNA, 18 nt, Homo sapiens
caaaugcacaucucaugg

SEQ ID NO: 2003622 - RNA, 20 nt, Homo sapiens
aagcaaauaaaugccuucca

SEQ ID NO: 2003623 - RNA, 20 nt, Homo sapiens
caugaggagggaaaagagug

SEQ ID NO: 2003624 - RNA, 16 nt, Homo sapiens
gcucucuguggugaga

SEQ ID NO: 2003625 - RNA, 22 nt, Homo sapiens
auguugguuuuuuagugcaauu

SEQ ID NO: 2003626 - RNA, 19 nt, Homo sapiens
uggaaaaugccaugaauua

SEQ ID NO: 2003627 - RNA, 22 nt, Homo sapiens
acuuggaaaauucucuuaauca

SEQ ID NO: 2003628 - RNA, 17 nt, Homo sapiens
ugccacagcucaacucg

SEQ ID NO: 2003629 - RNA, 13 nt, Homo sapiens
ccugagaauauua

SEQ ID NO: 2003630 - RNA, 18 nt, Homo sapiens
gcucaggacacaguggga

SEQ ID NO: 2003631 - RNA, 20 nt, Homo sapiens
ucacuugugcaguguugaca

SEQ ID NO: 2003632 - RNA, 19 nt, Homo sapiens
uccuccagccaccucaguc

SEQ ID NO: 2003633 - RNA, 19 nt, Homo sapiens
uaucuaauuugugccucac

SEQ ID NO: 2003634 - RNA, 19 nt, Homo sapiens
guguccaugugugugcaag

SEQ ID NO: 2003635 - RNA, 15 nt, Homo sapiens
agugcuccuggaaac

SEQ ID NO: 2003636 - RNA, 19 nt, Homo sapiens
uuuuuccuuuucaucuguu

SEQ ID NO: 2003637 - RNA, 11 nt, Homo sapiens
uuaugccaaau

SEQ ID NO: 2003638 - RNA, 14 nt, Homo sapiens
auguuaucagucuc

SEQ ID NO: 2003639 - RNA, 15 nt, Homo sapiens
uccccauugcuuaag

SEQ ID NO: 2003640 - RNA, 17 nt, Homo sapiens
uguucaguaguuccagg

SEQ ID NO: 2003641 - RNA, 17 nt, Homo sapiens
gagauggaauaaagccc

SEQ ID NO: 2003642 - RNA, 14 nt, Homo sapiens
uagcuacuguagaa

SEQ ID NO: 2003643 - RNA, 19 nt, Homo sapiens
auggauggcaaaugugaug

SEQ ID NO: 2003644 - RNA, 21 nt, Homo sapiens
ugcuuuuuaaagaaugcucuu

SEQ ID NO: 2003645 - RNA, 17 nt, Homo sapiens
uacacccaguugccaaa

SEQ ID NO: 2003646 - RNA, 15 nt, Homo sapiens
aaucauucuggcuua

SEQ ID NO: 2003647 - RNA, 14 nt, Homo sapiens
uucaaauacuuuug

SEQ ID NO: 2003648 - RNA, 19 nt, Homo sapiens
aaagagaauccaacuuuau

SEQ ID NO: 2003649 - RNA, 21 nt, Homo sapiens
cagcugguggccgugcugguc

SEQ ID NO: 2003650 - RNA, 13 nt, Homo sapiens
ccuaaaaucacag

SEQ ID NO: 2003651 - RNA, 16 nt, Homo sapiens
ggcuuaaaucaaaaga

SEQ ID NO: 2003652 - RNA, 19 nt, Homo sapiens
ccuagacucugugaucuga

SEQ ID NO: 2003653 - RNA, 18 nt, Homo sapiens
agauguucacccaaccac

SEQ ID NO: 2003654 - RNA, 21 nt, Homo sapiens
gaaucagaauuguagccaguu

SEQ ID NO: 2003655 - RNA, 23 nt, Homo sapiens
ucuugaaaauagaacaacuugca

SEQ ID NO: 2003656 - RNA, 20 nt, Homo sapiens
uguuuaaauauaaaucugau

SEQ ID NO: 2003657 - RNA, 15 nt, Homo sapiens
acugcuguaaacaca

SEQ ID NO: 2003658 - RNA, 19 nt, Homo sapiens
ugaccuugaaugaugccau

SEQ ID NO: 2003659 - RNA, 15 nt, Homo sapiens
ccugcacuguaaaau

SEQ ID NO: 2003660 - RNA, 19 nt, Homo sapiens
caacgagacacauugccuu

SEQ ID NO: 2003661 - RNA, 23 nt, Homo sapiens
gccuguaaguccaagcugugcga

SEQ ID NO: 2003662 - RNA, 20 nt, Homo sapiens
ugggagcaguccaugcauga

SEQ ID NO: 2003663 - RNA, 17 nt, Homo sapiens
gcauuccagcugucacu

SEQ ID NO: 2003664 - RNA, 20 nt, Homo sapiens
ccugcucagaugcuggucau

SEQ ID NO: 2003665 - RNA, 16 nt, Homo sapiens
auccaauagauacaag

SEQ ID NO: 2003666 - RNA, 19 nt, Homo sapiens
cuuuauuuugcuuccacau

SEQ ID NO: 2003667 - RNA, 13 nt, Homo sapiens
caugaaaaguuau

SEQ ID NO: 2003668 - RNA, 14 nt, Homo sapiens
auaugcauuaugaa

SEQ ID NO: 2003669 - RNA, 22 nt, Homo sapiens
ugugcucccucggucaccugug

SEQ ID NO: 2003670 - RNA, 16 nt, Homo sapiens
acacuuccauuaacuu

SEQ ID NO: 2003671 - RNA, 11 nt, Homo sapiens
aggugccucau

SEQ ID NO: 2003672 - RNA, 22 nt, Homo sapiens
acaaagggccaucguucaucca

SEQ ID NO: 2003673 - RNA, 15 nt, Homo sapiens
auccuacaacuucca

SEQ ID NO: 2003674 - RNA, 22 nt, Homo sapiens
guauuaauaaagcauucuuuaa

SEQ ID NO: 2003675 - RNA, 13 nt, Homo sapiens
aaccugaguauca

SEQ ID NO: 2003676 - RNA, 20 nt, Homo sapiens
cucccaaaauacugggauua

SEQ ID NO: 2003677 - RNA, 20 nt, Homo sapiens
ugcuugaacuuacaggugau

SEQ ID NO: 2003678 - RNA, 19 nt, Homo sapiens
accaaaauaaaaauugaaa

SEQ ID NO: 2003679 - RNA, 20 nt, Homo sapiens
cagucaaaacccaccaaaac

SEQ ID NO: 2003680 - RNA, 16 nt, Homo sapiens
uccaaaggcccuacca

SEQ ID NO: 2003681 - RNA, 20 nt, Homo sapiens
ggcucaggggagcaagcuua

SEQ ID NO: 2003682 - RNA, 21 nt, Homo sapiens
uaaaaaggaaauuagucuuuu

SEQ ID NO: 2003683 - RNA, 20 nt, Homo sapiens
auuacauagacugugaugua

SEQ ID NO: 2003684 - RNA, 23 nt, Homo sapiens
augagcccagaucaccaccugaa

SEQ ID NO: 2003685 - RNA, 17 nt, Homo sapiens
aagggaauccugagaaa

SEQ ID NO: 2003686 - RNA, 19 nt, Homo sapiens
cacucagagaugcauuugg

SEQ ID NO: 2003687 - RNA, 17 nt, Homo sapiens
auuuccuugacuucuuu

SEQ ID NO: 2003688 - RNA, 23 nt, Homo sapiens
uucccauuuuccuucaccgugac

SEQ ID NO: 2003689 - RNA, 22 nt, Homo sapiens
cucaaacagccacgagguggua

SEQ ID NO: 2003690 - RNA, 18 nt, Homo sapiens
ucccccugacaacacuca

SEQ ID NO: 2003691 - RNA, 21 nt, Homo sapiens
aggguaugucagugucacugg

SEQ ID NO: 2003692 - RNA, 18 nt, Homo sapiens
auucuuuuccaagcuccu

SEQ ID NO: 2003693 - RNA, 14 nt, Homo sapiens
aacagagacugaau

SEQ ID NO: 2003694 - RNA, 20 nt, Homo sapiens
aauguucugacagcauuuca

SEQ ID NO: 2003695 - RNA, 21 nt, Homo sapiens
uuuaaauauauauuauucuca

SEQ ID NO: 2003696 - RNA, 18 nt, Homo sapiens
ugccagaugugggcucag

SEQ ID NO: 2003697 - RNA, 19 nt, Homo sapiens
aauauaauaugcacacagu

SEQ ID NO: 2003698 - RNA, 14 nt, Homo sapiens
caaugucagaugaa

SEQ ID NO: 2003699 - RNA, 14 nt, Homo sapiens
gguagcagagggau

SEQ ID NO: 2003700 - RNA, 14 nt, Homo sapiens
uaguuuauuuacuc

SEQ ID NO: 2003701 - RNA, 22 nt, Homo sapiens
uguucauaauacaaaggugcua

SEQ ID NO: 2003702 - RNA, 15 nt, Homo sapiens
ugcaucaguacuuca

SEQ ID NO: 2003703 - RNA, 15 nt, Homo sapiens
uaaauaugugauuau

SEQ ID NO: 2003704 - RNA, 17 nt, Homo sapiens
uggacgagaaggugcuu

SEQ ID NO: 2003705 - RNA, 14 nt, Homo sapiens
caucuagcaauuuc

SEQ ID NO: 2003706 - RNA, 20 nt, Homo sapiens
caaaugguaggcauuuccua

SEQ ID NO: 2003707 - RNA, 17 nt, Homo sapiens
uacaggcgucugccacc

SEQ ID NO: 2003708 - RNA, 19 nt, Homo sapiens
gugggugcugccaugacag

SEQ ID NO: 2003709 - RNA, 18 nt, Homo sapiens
ucccuacccuaaccaagu

SEQ ID NO: 2003710 - RNA, 18 nt, Homo sapiens
agcuaucuugaaaauguu

SEQ ID NO: 2003711 - RNA, 16 nt, Homo sapiens
acccaagggcaggggc

SEQ ID NO: 2003712 - RNA, 13 nt, Homo sapiens
agcguuaugugca

SEQ ID NO: 2003713 - RNA, 21 nt, Homo sapiens
ucuaacuacaaggacaaugcc

SEQ ID NO: 2003714 - RNA, 14 nt, Homo sapiens
aacauacucauuua

SEQ ID NO: 2003715 - RNA, 21 nt, Homo sapiens
caagcgauccucccaccucag

SEQ ID NO: 2003716 - RNA, 12 nt, Homo sapiens
cugugcccugac

SEQ ID NO: 2003717 - RNA, 19 nt, Homo sapiens
ucucaccuacccaugaccu

SEQ ID NO: 2003718 - RNA, 22 nt, Homo sapiens
gauggcuaugccuugcacacag

SEQ ID NO: 2003719 - RNA, 21 nt, Homo sapiens
cacauaaacacauacauugcc

SEQ ID NO: 2003720 - RNA, 21 nt, Homo sapiens
acugggagaggugccagcaac

SEQ ID NO: 2003721 - RNA, 15 nt, Homo sapiens
auugccccuuugcag

SEQ ID NO: 2003722 - RNA, 19 nt, Homo sapiens
uagcugagccuucugauga

SEQ ID NO: 2003723 - RNA, 23 nt, Homo sapiens
uaauaaguuuugauauaaucuug

SEQ ID NO: 2003724 - RNA, 18 nt, Homo sapiens
aaagacuaugaucucauc

SEQ ID NO: 2003725 - RNA, 19 nt, Homo sapiens
agaauauuauguuccucaa

SEQ ID NO: 2003726 - RNA, 19 nt, Homo sapiens
guuggcuagagcuucugua

SEQ ID NO: 2003727 - RNA, 15 nt, Homo sapiens
uccuggccuggccau

SEQ ID NO: 2003728 - RNA, 18 nt, Homo sapiens
aggaagccaggugagaaa

SEQ ID NO: 2003729 - RNA, 15 nt, Homo sapiens
uuaucuuuauaugaa

SEQ ID NO: 2003730 - RNA, 13 nt, Homo sapiens
gucuucaacagcu

SEQ ID NO: 2003731 - RNA, 17 nt, Homo sapiens
uuuccugcuccuccagu

SEQ ID NO: 2003732 - RNA, 18 nt, Homo sapiens
ccauucucaaaaacaaag

SEQ ID NO: 2003733 - RNA, 14 nt, Homo sapiens
cuaaaggacuauua

SEQ ID NO: 2003734 - RNA, 13 nt, Homo sapiens
ucuggcugcacag

SEQ ID NO: 2003735 - RNA, 15 nt, Homo sapiens
ugcugucauuagucu

SEQ ID NO: 2003736 - RNA, 12 nt, Homo sapiens
uuagcacaaaga

SEQ ID NO: 2003737 - RNA, 14 nt, Homo sapiens
gccugagcucugac

SEQ ID NO: 2003738 - RNA, 13 nt, Homo sapiens
cuacuuugcagau

SEQ ID NO: 2003739 - RNA, 12 nt, Homo sapiens
acaaaaagggaa

SEQ ID NO: 2003740 - RNA, 20 nt, Homo sapiens
gcuccuggaggcccugguca

SEQ ID NO: 2003741 - RNA, 18 nt, Homo sapiens
gucuccucccugggcuaa

SEQ ID NO: 2003742 - RNA, 17 nt, Homo sapiens
cagguuuugucccugcu

SEQ ID NO: 2003743 - RNA, 17 nt, Homo sapiens
cuaccaaugccaaaagg

SEQ ID NO: 2003744 - RNA, 20 nt, Homo sapiens
uaagacccacaaacugccug

SEQ ID NO: 2003745 - RNA, 11 nt, Homo sapiens
uaguucuagau

SEQ ID NO: 2003746 - RNA, 17 nt, Homo sapiens
aaaaugugauguucuaa

SEQ ID NO: 2003747 - RNA, 13 nt, Homo sapiens
augugugugcuca

SEQ ID NO: 2003748 - RNA, 17 nt, Homo sapiens
cagcccuuuugucucug

SEQ ID NO: 2003749 - RNA, 14 nt, Homo sapiens
uuguaaaugucuga

SEQ ID NO: 2003750 - RNA, 14 nt, Homo sapiens
uuaccuuguauacu

SEQ ID NO: 2003751 - RNA, 15 nt, Homo sapiens
guuuuuacauucaau

SEQ ID NO: 2003752 - RNA, 20 nt, Homo sapiens
auugcuagccagcauuccau

SEQ ID NO: 2003753 - RNA, 17 nt, Homo sapiens
aauguucucaugaacua

SEQ ID NO: 2003754 - RNA, 19 nt, Homo sapiens
agaguggucuuucuggaga

SEQ ID NO: 2003755 - RNA, 18 nt, Homo sapiens
aaauauugcugugucuuc

SEQ ID NO: 2003756 - RNA, 18 nt, Homo sapiens
gagaauaggggagccaag

SEQ ID NO: 2003757 - RNA, 18 nt, Homo sapiens
aacuacgggcugcucuac

SEQ ID NO: 2003758 - RNA, 19 nt, Homo sapiens
guccaaggcacaaaccuua

SEQ ID NO: 2003759 - RNA, 13 nt, Homo sapiens
uugguuacuucau

SEQ ID NO: 2003760 - RNA, 13 nt, Homo sapiens
agcaauacaggga

SEQ ID NO: 2003761 - RNA, 22 nt, Homo sapiens
uuauuaagugccugagacaccc

SEQ ID NO: 2003762 - RNA, 17 nt, Homo sapiens
gaacuggccacgcacag

SEQ ID NO: 2003763 - RNA, 16 nt, Homo sapiens
gauccccaagugugaa

SEQ ID NO: 2003764 - RNA, 14 nt, Homo sapiens
gagucuccucccca

SEQ ID NO: 2003765 - RNA, 15 nt, Homo sapiens
uucauguaauaaaca

SEQ ID NO: 2003766 - RNA, 17 nt, Homo sapiens
cugcacccacgugcauu

SEQ ID NO: 2003767 - RNA, 21 nt, Homo sapiens
ucaacaugacauccagagaug

SEQ ID NO: 2003768 - RNA, 13 nt, Homo sapiens
ucugaccucuaua

SEQ ID NO: 2003769 - RNA, 15 nt, Homo sapiens
ccaaaagauacccaa

SEQ ID NO: 2003770 - RNA, 15 nt, Homo sapiens
cacaaaacagccuuu

SEQ ID NO: 2003771 - RNA, 22 nt, Homo sapiens
acuggcugggaguccuuaccuc

SEQ ID NO: 2003772 - RNA, 23 nt, Homo sapiens
auaacagaugugaaaauauacuu

SEQ ID NO: 2003773 - RNA, 14 nt, Homo sapiens
auauuggauaucaa

SEQ ID NO: 2003774 - RNA, 14 nt, Homo sapiens
caccaccauucucc

SEQ ID NO: 2003775 - RNA, 18 nt, Homo sapiens
gaugccguucccugaaca

SEQ ID NO: 2003776 - RNA, 14 nt, Homo sapiens
cuccuacaugaugu

SEQ ID NO: 2003777 - RNA, 20 nt, Homo sapiens
cggucccaguuuuguugccc

SEQ ID NO: 2003778 - RNA, 15 nt, Homo sapiens
cacauuucucugcaa

SEQ ID NO: 2003779 - RNA, 21 nt, Homo sapiens
agcguguguauccgacucuaa

SEQ ID NO: 2003780 - RNA, 17 nt, Homo sapiens
augcauacaaguuucau

SEQ ID NO: 2003781 - RNA, 19 nt, Homo sapiens
ucuuauuuauguaacaaag

SEQ ID NO: 2003782 - RNA, 13 nt, Homo sapiens
aauucuucugccu

SEQ ID NO: 2003783 - RNA, 19 nt, Homo sapiens
ucccauuucuguugcugga

SEQ ID NO: 2003784 - RNA, 22 nt, Homo sapiens
uuauauguggacuaaauaucug

SEQ ID NO: 2003785 - RNA, 17 nt, Homo sapiens
uguuauugcacuaugaa

SEQ ID NO: 2003786 - RNA, 22 nt, Homo sapiens
cuugaacaagaugugggccuug

SEQ ID NO: 2003787 - RNA, 22 nt, Homo sapiens
gcugaaagaaggggugccaaaa

SEQ ID NO: 2003788 - RNA, 19 nt, Homo sapiens
agccacugccacuccaguc

SEQ ID NO: 2003789 - RNA, 14 nt, Homo sapiens
uuuucuauucuugg

SEQ ID NO: 2003790 - RNA, 18 nt, Homo sapiens
uuuagccauuuucuuuaa

SEQ ID NO: 2003791 - RNA, 12 nt, Homo sapiens
gccucauuugaa

SEQ ID NO: 2003792 - RNA, 12 nt, Homo sapiens
gccacauuugau

SEQ ID NO: 2003793 - RNA, 16 nt, Homo sapiens
uuacaacauggcugau

SEQ ID NO: 2003794 - RNA, 16 nt, Homo sapiens
ccagaggacauaagua

SEQ ID NO: 2003795 - RNA, 18 nt, Homo sapiens
uccuaugcuauugacaau

SEQ ID NO: 2003796 - RNA, 18 nt, Homo sapiens
cugaaguguucucuagaa

SEQ ID NO: 2003797 - RNA, 19 nt, Homo sapiens
aacauaacuguaacauaua

SEQ ID NO: 2003798 - RNA, 18 nt, Homo sapiens
acuauugaaguugcagau

SEQ ID NO: 2003799 - RNA, 17 nt, Homo sapiens
cauguaccugcucuucu

SEQ ID NO: 2003800 - RNA, 20 nt, Homo sapiens
acugggugcgucuccaguca

SEQ ID NO: 2003801 - RNA, 20 nt, Homo sapiens
uuccauccuucaaauaaaca

SEQ ID NO: 2003802 - RNA, 14 nt, Homo sapiens
cagcugggcugugg

SEQ ID NO: 2003803 - RNA, 23 nt, Homo sapiens
ccuaagagauuuaucuuuauaca

SEQ ID NO: 2003804 - RNA, 20 nt, Homo sapiens
uguucccuccccgaucaucu

SEQ ID NO: 2003805 - RNA, 19 nt, Homo sapiens
ugcauuuucccagauacuu

SEQ ID NO: 2003806 - RNA, 13 nt, Homo sapiens
agaagagcacaga

SEQ ID NO: 2003807 - RNA, 14 nt, Homo sapiens
uuacgcccaucuca

SEQ ID NO: 2003808 - RNA, 16 nt, Homo sapiens
uuauauuucaaccaca

SEQ ID NO: 2003809 - RNA, 16 nt, Homo sapiens
gcaguacaaugugacu

SEQ ID NO: 2003810 - RNA, 13 nt, Homo sapiens
accaaagagacug

SEQ ID NO: 2003811 - RNA, 18 nt, Homo sapiens
uucaccaucaauccugau

SEQ ID NO: 2003812 - RNA, 21 nt, Homo sapiens
uaaagcuuaauaaaaacaacc

SEQ ID NO: 2003813 - RNA, 20 nt, Homo sapiens
ugaaauuugauaaacugaau

SEQ ID NO: 2003814 - RNA, 16 nt, Homo sapiens
gcacugaagagcucuu

SEQ ID NO: 2003815 - RNA, 14 nt, Homo sapiens
aaggagacauauca

SEQ ID NO: 2003816 - RNA, 16 nt, Homo sapiens
gcauacacacaugccc

SEQ ID NO: 2003817 - RNA, 16 nt, Homo sapiens
aacagccugacaacau

SEQ ID NO: 2003818 - RNA, 18 nt, Homo sapiens
aggugcauuguccuuuuc

SEQ ID NO: 2003819 - RNA, 15 nt, Homo sapiens
ucagagggaccucac

SEQ ID NO: 2003820 - RNA, 23 nt, Homo sapiens
auugaaauauaaugcaaaccaua

SEQ ID NO: 2003821 - RNA, 13 nt, Homo sapiens
gccugacgcauuc

SEQ ID NO: 2003822 - RNA, 18 nt, Homo sapiens
auacggaagagcagguga

SEQ ID NO: 2003823 - RNA, 12 nt, Homo sapiens
ucuguuaucuag

SEQ ID NO: 2003824 - RNA, 13 nt, Homo sapiens
aggaaacaugcag

SEQ ID NO: 2003825 - RNA, 16 nt, Homo sapiens
aaucugaugaaaauau

SEQ ID NO: 2003826 - RNA, 17 nt, Homo sapiens
auuuaaacucaagacaa

SEQ ID NO: 2003827 - RNA, 21 nt, Homo sapiens
ggucugcuucugcauucacag

SEQ ID NO: 2003828 - RNA, 19 nt, Homo sapiens
ccaaugggccuccagagac

SEQ ID NO: 2003829 - RNA, 20 nt, Homo sapiens
uagcauuuucugcaucucca

SEQ ID NO: 2003830 - RNA, 16 nt, Homo sapiens
ucccaccccagggauu

SEQ ID NO: 2003831 - RNA, 21 nt, Homo sapiens
uucaagugauucucaugccuc

SEQ ID NO: 2003832 - RNA, 19 nt, Homo sapiens
ccacccaccuguacucugg

SEQ ID NO: 2003833 - RNA, 18 nt, Homo sapiens
agccucgacacagagugg

SEQ ID NO: 2003834 - RNA, 16 nt, Homo sapiens
ucgucugguuccucaa

SEQ ID NO: 2003835 - RNA, 20 nt, Homo sapiens
cucauauauaucuaucuuau

SEQ ID NO: 2003836 - RNA, 16 nt, Homo sapiens
ugaucuacuugccuca

SEQ ID NO: 2003837 - RNA, 15 nt, Homo sapiens
uccaaaauaagauga

SEQ ID NO: 2003838 - RNA, 16 nt, Homo sapiens
ugaaaauugcaauaca

SEQ ID NO: 2003839 - RNA, 15 nt, Homo sapiens
gaucuuaauuuacuu

SEQ ID NO: 2003840 - RNA, 15 nt, Homo sapiens
cuuuccuaaagccaa

SEQ ID NO: 2003841 - RNA, 15 nt, Homo sapiens
acacucccaccagca

SEQ ID NO: 2003842 - RNA, 13 nt, Homo sapiens
aguauuacagugu

SEQ ID NO: 2003843 - RNA, 18 nt, Homo sapiens
auggagccuggaacugca

SEQ ID NO: 2003844 - RNA, 19 nt, Homo sapiens
cucccccacccaccucucu

SEQ ID NO: 2003845 - RNA, 14 nt, Homo sapiens
uuaacagcuuucuc

SEQ ID NO: 2003846 - RNA, 23 nt, Homo sapiens
cccguggagaauuggccagagcc

SEQ ID NO: 2003847 - RNA, 20 nt, Homo sapiens
aaaaaucccauuuaugcaau

SEQ ID NO: 2003848 - RNA, 16 nt, Homo sapiens
acgcacagugcaguug

SEQ ID NO: 2003849 - RNA, 17 nt, Homo sapiens
uggcauucacaucucau

SEQ ID NO: 2003850 - RNA, 21 nt, Homo sapiens
aagaauuuaauguacaguaaa

SEQ ID NO: 2003851 - RNA, 13 nt, Homo sapiens
aagucaaggagaa

SEQ ID NO: 2003852 - RNA, 18 nt, Homo sapiens
aauguuucacuaugauuu

SEQ ID NO: 2003853 - RNA, 19 nt, Homo sapiens
aucuuccaaaccccacuuu

SEQ ID NO: 2003854 - RNA, 18 nt, Homo sapiens
accccagcaugagugcug

SEQ ID NO: 2003855 - RNA, 14 nt, Homo sapiens
gcuaauauugcaau

SEQ ID NO: 2003856 - RNA, 15 nt, Homo sapiens
ugagcuuugcugcua

SEQ ID NO: 2003857 - RNA, 19 nt, Homo sapiens
ucaaugcccaacagggcaa

SEQ ID NO: 2003858 - RNA, 13 nt, Homo sapiens
aauaaaacucugc

SEQ ID NO: 2003859 - RNA, 23 nt, Homo sapiens
gaggucaggaguugaagaccagc

SEQ ID NO: 2003860 - RNA, 13 nt, Homo sapiens
ccaaauuccaugu

SEQ ID NO: 2003861 - RNA, 13 nt, Homo sapiens
aacgacacauuca

SEQ ID NO: 2003862 - RNA, 20 nt, Homo sapiens
uaaguggcuugucugcaguc

SEQ ID NO: 2003863 - RNA, 20 nt, Homo sapiens
aauuguaaauacauguacag

SEQ ID NO: 2003864 - RNA, 23 nt, Homo sapiens
guuuuggaagcucugaagucaca

SEQ ID NO: 2003865 - RNA, 17 nt, Homo sapiens
acacugcacacagugac

SEQ ID NO: 2003866 - RNA, 19 nt, Homo sapiens
ugccaggcuggagugcagu

SEQ ID NO: 2003867 - RNA, 19 nt, Homo sapiens
ugaauucuggucacauucc

SEQ ID NO: 2003868 - RNA, 11 nt, Homo sapiens
caucuguaaac

SEQ ID NO: 2003869 - RNA, 13 nt, Homo sapiens
cagggacgucuca

SEQ ID NO: 2003870 - RNA, 13 nt, Homo sapiens
gcagcagcucaca

SEQ ID NO: 2003871 - RNA, 13 nt, Homo sapiens
ggugcagcuguca

SEQ ID NO: 2003872 - RNA, 20 nt, Homo sapiens
uauaugaacauacaaaugca

SEQ ID NO: 2003873 - RNA, 13 nt, Homo sapiens
uaugauuauacaa

SEQ ID NO: 2003874 - RNA, 13 nt, Homo sapiens
auaagacaaugac

SEQ ID NO: 2003875 - RNA, 19 nt, Homo sapiens
gauuacauagaucagccau

SEQ ID NO: 2003876 - RNA, 12 nt, Homo sapiens
uccuucuguugc

SEQ ID NO: 2003877 - RNA, 16 nt, Homo sapiens
ccuccagcuucuggua

SEQ ID NO: 2003878 - RNA, 17 nt, Homo sapiens
acuuucuacaggccagc

SEQ ID NO: 2003879 - RNA, 17 nt, Homo sapiens
uaacaccaagaguagca

SEQ ID NO: 2003880 - RNA, 14 nt, Homo sapiens
uuaaccugggacca

SEQ ID NO: 2003881 - RNA, 16 nt, Homo sapiens
ugauggauauguuuuc

SEQ ID NO: 2003882 - RNA, 14 nt, Homo sapiens
cuucacaucuguca

SEQ ID NO: 2003883 - RNA, 17 nt, Homo sapiens
acucugaggacauggag

SEQ ID NO: 2003884 - RNA, 14 nt, Homo sapiens
aacggcccucuuga

SEQ ID NO: 2003885 - RNA, 15 nt, Homo sapiens
caaacacuagcucug

SEQ ID NO: 2003886 - RNA, 22 nt, Homo sapiens
acacucuggcugcucccugaca

SEQ ID NO: 2003887 - RNA, 18 nt, Homo sapiens
auccagcucuaagucuca

SEQ ID NO: 2003888 - RNA, 11 nt, Homo sapiens
auucuacauau

SEQ ID NO: 2003889 - RNA, 12 nt, Homo sapiens
uuugauacuuau

SEQ ID NO: 2003890 - RNA, 18 nt, Homo sapiens
uagaagagaaaugcugcu

SEQ ID NO: 2003891 - RNA, 11 nt, Homo sapiens
ucacugggcua

SEQ ID NO: 2003892 - RNA, 19 nt, Homo sapiens
gagacuccuaggcaggaca

SEQ ID NO: 2003893 - RNA, 20 nt, Homo sapiens
caguaaaguucauccuuuga

SEQ ID NO: 2003894 - RNA, 21 nt, Homo sapiens
gcagcccuaaugucugaccua

SEQ ID NO: 2003895 - RNA, 13 nt, Homo sapiens
cuuuucucucaaa

SEQ ID NO: 2003896 - RNA, 20 nt, Homo sapiens
cucccuaucuccuucccacc

SEQ ID NO: 2003897 - RNA, 17 nt, Homo sapiens
auaccauucacuacuca

SEQ ID NO: 2003898 - RNA, 21 nt, Homo sapiens
auggaaauucugcucagauag

SEQ ID NO: 2003899 - RNA, 15 nt, Homo sapiens
cugcaagauuucaca

SEQ ID NO: 2003900 - RNA, 13 nt, Homo sapiens
gaaacacaugcca

SEQ ID NO: 2003901 - RNA, 20 nt, Homo sapiens
aggcggguggaucacuugag

SEQ ID NO: 2003902 - RNA, 16 nt, Homo sapiens
agcggggcuacagucc

SEQ ID NO: 2003903 - RNA, 17 nt, Homo sapiens
ggagaguuguuggcaag

SEQ ID NO: 2003904 - RNA, 22 nt, Homo sapiens
ggcuuaacacagugggugguga

SEQ ID NO: 2003905 - RNA, 20 nt, Homo sapiens
ccuuuccccaccucuuacag

SEQ ID NO: 2003906 - RNA, 19 nt, Homo sapiens
gagagugucuucacggcag

SEQ ID NO: 2003907 - RNA, 17 nt, Homo sapiens
ugaggcaagagaauuac

SEQ ID NO: 2003908 - RNA, 13 nt, Homo sapiens
ccauuaccuguac

SEQ ID NO: 2003909 - RNA, 18 nt, Homo sapiens
auauucuggagucaucau

SEQ ID NO: 2003910 - RNA, 19 nt, Homo sapiens
cuagcuuagugcuaugugu

SEQ ID NO: 2003911 - RNA, 20 nt, Homo sapiens
aaaaggguacagaugugcug

SEQ ID NO: 2003912 - RNA, 21 nt, Homo sapiens
gauuucauaguucagaauuua

SEQ ID NO: 2003913 - RNA, 21 nt, Homo sapiens
cuaguauuucaugcugggaau

SEQ ID NO: 2003914 - RNA, 21 nt, Homo sapiens
cuacuuuaauauaaacccaua

SEQ ID NO: 2003915 - RNA, 23 nt, Homo sapiens
guuuuuuuuuuuuuuaacaugua

SEQ ID NO: 2003916 - RNA, 16 nt, Homo sapiens
ugaucuuugagcccau

SEQ ID NO: 2003917 - RNA, 21 nt, Homo sapiens
gaaagguacuauauuugcuag

SEQ ID NO: 2003918 - RNA, 18 nt, Homo sapiens
ucccucacuguugaauuu

SEQ ID NO: 2003919 - RNA, 23 nt, Homo sapiens
cuugaaaagcuaguguaccuccu

SEQ ID NO: 2003920 - RNA, 23 nt, Homo sapiens
agccacuauuguuagucucuuga

SEQ ID NO: 2003921 - RNA, 16 nt, Homo sapiens
cucuccucugucccca

SEQ ID NO: 2003922 - RNA, 17 nt, Homo sapiens
ccucuacaggcauuuaa

SEQ ID NO: 2003923 - RNA, 14 nt, Homo sapiens
ccagacggucagga

SEQ ID NO: 2003924 - RNA, 16 nt, Homo sapiens
cgagcacugaacuuug

SEQ ID NO: 2003925 - RNA, 18 nt, Homo sapiens
uaaacugaaucuauggcu

SEQ ID NO: 2003926 - RNA, 16 nt, Homo sapiens
guucuguagagccaau

SEQ ID NO: 2003927 - RNA, 16 nt, Homo sapiens
auuuuaaguaucccau

SEQ ID NO: 2003928 - RNA, 22 nt, Homo sapiens
caaaaccuacacacauaccuuc

SEQ ID NO: 2003929 - RNA, 16 nt, Homo sapiens
gaaaguggaaaaugac

SEQ ID NO: 2003930 - RNA, 16 nt, Homo sapiens
cuuauauuucauauca

SEQ ID NO: 2003931 - RNA, 16 nt, Homo sapiens
aaaaggauaugcagua

SEQ ID NO: 2003932 - RNA, 22 nt, Homo sapiens
uuuuggaggguccuccacaaua

SEQ ID NO: 2003933 - RNA, 11 nt, Homo sapiens
cgcacaguauu

SEQ ID NO: 2003934 - RNA, 17 nt, Homo sapiens
aguggaguaacuauuca

SEQ ID NO: 2003935 - RNA, 12 nt, Homo sapiens
uccuaccuuaau

SEQ ID NO: 2003936 - RNA, 20 nt, Homo sapiens
cccaggaccccuguccagga

SEQ ID NO: 2003937 - RNA, 22 nt, Homo sapiens
cugucccaaggugaaaugaagc

SEQ ID NO: 2003938 - RNA, 16 nt, Homo sapiens
cagcucuucaacauga

SEQ ID NO: 2003939 - RNA, 15 nt, Homo sapiens
aaagcaguguuuuca

SEQ ID NO: 2003940 - RNA, 14 nt, Homo sapiens
ucugagacagcagu

SEQ ID NO: 2003941 - RNA, 16 nt, Homo sapiens
auuacaggcacgugcc

SEQ ID NO: 2003942 - RNA, 22 nt, Homo sapiens
auuugcaaagaaaaguuucacc

SEQ ID NO: 2003943 - RNA, 17 nt, Homo sapiens
gaagccagcucccugaa

SEQ ID NO: 2003944 - RNA, 23 nt, Homo sapiens
aaggacucccggagccugugcag

SEQ ID NO: 2003945 - RNA, 23 nt, Homo sapiens
caagaggaaagcuuuuacugugu

SEQ ID NO: 2003946 - RNA, 15 nt, Homo sapiens
ugagaacacugugaa

SEQ ID NO: 2003947 - RNA, 19 nt, Homo sapiens
uuaauauggugacuuuuua

SEQ ID NO: 2003948 - RNA, 14 nt, Homo sapiens
uccuagacccguga

SEQ ID NO: 2003949 - RNA, 14 nt, Homo sapiens
caguuaauuugcac

SEQ ID NO: 2003950 - RNA, 16 nt, Homo sapiens
caaauaaauuaugcaa

SEQ ID NO: 2003951 - RNA, 17 nt, Homo sapiens
gccaacacuugaacuca

SEQ ID NO: 2003952 - RNA, 13 nt, Homo sapiens
auuuuacacaguu

SEQ ID NO: 2003953 - RNA, 17 nt, Homo sapiens
aauuauauuguccuccc

SEQ ID NO: 2003954 - RNA, 16 nt, Homo sapiens
ggccagccacagagca

SEQ ID NO: 2003955 - RNA, 23 nt, Homo sapiens
aggccgggugcaguggcuccuau

SEQ ID NO: 2003956 - RNA, 19 nt, Homo sapiens
gugggccuucagggaguga

SEQ ID NO: 2003957 - RNA, 18 nt, Homo sapiens
caagugauaucaccucuc

SEQ ID NO: 2003958 - RNA, 17 nt, Homo sapiens
uaccuccacccugcauu

SEQ ID NO: 2003959 - RNA, 22 nt, Homo sapiens
aaaauguccaccaauagaauga

SEQ ID NO: 2003960 - RNA, 15 nt, Homo sapiens
ugaucagugugcuaa

SEQ ID NO: 2003961 - RNA, 18 nt, Homo sapiens
uuacuguuccagauuccu

SEQ ID NO: 2003962 - RNA, 13 nt, Homo sapiens
caugcaugagcac

SEQ ID NO: 2003963 - RNA, 23 nt, Homo sapiens
aaaaugacaaaugacgucuucac

SEQ ID NO: 2003964 - RNA, 21 nt, Homo sapiens
caguaaagaccauuuaguccu

SEQ ID NO: 2003965 - RNA, 17 nt, Homo sapiens
ugaugugugagcuaugc

SEQ ID NO: 2003966 - RNA, 22 nt, Homo sapiens
ggacuacauauuugcacugaag

SEQ ID NO: 2003967 - RNA, 18 nt, Homo sapiens
ccaucccuaccacugugg

SEQ ID NO: 2003968 - RNA, 14 nt, Homo sapiens
aggcugcugcacac

SEQ ID NO: 2003969 - RNA, 22 nt, Homo sapiens
augacuucuuuacuaacacugg

SEQ ID NO: 2003970 - RNA, 13 nt, Homo sapiens
aacugaacauauu

SEQ ID NO: 2003971 - RNA, 18 nt, Homo sapiens
agccaggagcgcaucuca

SEQ ID NO: 2003972 - RNA, 13 nt, Homo sapiens
uuauuaacuacug

SEQ ID NO: 2003973 - RNA, 12 nt, Homo sapiens
aaugauucucaa

SEQ ID NO: 2003974 - RNA, 21 nt, Homo sapiens
uccaucacccaucucacucuc

SEQ ID NO: 2003975 - RNA, 16 nt, Homo sapiens
ugccucugccacacuc

SEQ ID NO: 2003976 - RNA, 13 nt, Homo sapiens
gugauucaaugaa

SEQ ID NO: 2003977 - RNA, 16 nt, Homo sapiens
cacagggauguacaag

SEQ ID NO: 2003978 - RNA, 15 nt, Homo sapiens
gcacaauuccaugac

SEQ ID NO: 2003979 - RNA, 19 nt, Homo sapiens
aaagccccucaccucagga

SEQ ID NO: 2003980 - RNA, 22 nt, Homo sapiens
aguaugcuuaaugguagcaacu

SEQ ID NO: 2003981 - RNA, 19 nt, Homo sapiens
uggcgugaucucagcucac

SEQ ID NO: 2003982 - RNA, 21 nt, Homo sapiens
gauugacugugcccaguacuu

SEQ ID NO: 2003983 - RNA, 17 nt, Homo sapiens
agcaggucuuucacuca

SEQ ID NO: 2003984 - RNA, 16 nt, Homo sapiens
ugccccacaugcaugu

SEQ ID NO: 2003985 - RNA, 15 nt, Homo sapiens
cuucugcugcccuga

SEQ ID NO: 2003986 - RNA, 21 nt, Homo sapiens
caaugaaagcauggcugagaa

SEQ ID NO: 2003987 - RNA, 22 nt, Homo sapiens
uggugucuugauauauuuauaa

SEQ ID NO: 2003988 - RNA, 21 nt, Homo sapiens
cuuaauauaaauucacuuuca

SEQ ID NO: 2003989 - RNA, 20 nt, Homo sapiens
aacucaaacucuuaaaaccc

SEQ ID NO: 2003990 - RNA, 18 nt, Homo sapiens
uaaagaaaugcauaaaag

SEQ ID NO: 2003991 - RNA, 18 nt, Homo sapiens
cacagaugauaauaugcu

SEQ ID NO: 2003992 - RNA, 20 nt, Homo sapiens
cuagagugcaguggugcgau

SEQ ID NO: 2003993 - RNA, 15 nt, Homo sapiens
uaaaacccagcaugu

SEQ ID NO: 2003994 - RNA, 18 nt, Homo sapiens
ucuucugacuacugggca

SEQ ID NO: 2003995 - RNA, 23 nt, Homo sapiens
guacuuauguugcacaaugagaa

SEQ ID NO: 2003996 - RNA, 22 nt, Homo sapiens
guaauuuguggaggacuuugaa

SEQ ID NO: 2003997 - RNA, 15 nt, Homo sapiens
ggcccaccuggaauc

SEQ ID NO: 2003998 - RNA, 14 nt, Homo sapiens
uugggagcugccaa

SEQ ID NO: 2003999 - RNA, 19 nt, Homo sapiens
caguuaaucagcaaccuga

SEQ ID NO: 2004000 - RNA, 14 nt, Homo sapiens
augacaaagacuga

SEQ ID NO: 2004001 - RNA, 14 nt, Homo sapiens
auguguaagacacu

SEQ ID NO: 2004002 - RNA, 14 nt, Homo sapiens
gacaguaaaugucu

SEQ ID NO: 2004003 - RNA, 15 nt, Homo sapiens
acauaaaaaagggac

SEQ ID NO: 2004004 - RNA, 15 nt, Homo sapiens
cucugcuccacagaa

SEQ ID NO: 2004005 - RNA, 12 nt, Homo sapiens
cuguucaaggaa

SEQ ID NO: 2004006 - RNA, 13 nt, Homo sapiens
agaauauaccuua

SEQ ID NO: 2004007 - RNA, 16 nt, Homo sapiens
agcgugugacuacucc

SEQ ID NO: 2004008 - RNA, 22 nt, Homo sapiens
cucuguacaucagacaauugca

SEQ ID NO: 2004009 - RNA, 12 nt, Homo sapiens
gaaggagccugc

SEQ ID NO: 2004010 - RNA, 22 nt, Homo sapiens
gaacauugggaaggaagcccgc

SEQ ID NO: 2004011 - RNA, 20 nt, Homo sapiens
uccggagugagcaauggagu

SEQ ID NO: 2004012 - RNA, 16 nt, Homo sapiens
ccugguacacucugau

SEQ ID NO: 2004013 - RNA, 13 nt, Homo sapiens
ucuuuuucacuug

SEQ ID NO: 2004014 - RNA, 18 nt, Homo sapiens
ugggucucaguguccuca

SEQ ID NO: 2004015 - RNA, 19 nt, Homo sapiens
auuuaaccauggcacugag

SEQ ID NO: 2004016 - RNA, 23 nt, Homo sapiens
ccaugaaaaugcaacaacaugua

SEQ ID NO: 2004017 - RNA, 20 nt, Homo sapiens
aaacauguuaaacguuacuu

SEQ ID NO: 2004018 - RNA, 17 nt, Homo sapiens
ccuuaaggagguagcuc

SEQ ID NO: 2004019 - RNA, 15 nt, Homo sapiens
gaacauuguacuguu

SEQ ID NO: 2004020 - RNA, 16 nt, Homo sapiens
uuuccugauaacauua

SEQ ID NO: 2004021 - RNA, 17 nt, Homo sapiens
cgaggcucuugcucaag

SEQ ID NO: 2004022 - RNA, 17 nt, Homo sapiens
accugccuuuuauagua

SEQ ID NO: 2004023 - RNA, 16 nt, Homo sapiens
ugaaaaguuugauuaa

SEQ ID NO: 2004024 - RNA, 14 nt, Homo sapiens
cacuacauucugaa

SEQ ID NO: 2004025 - RNA, 18 nt, Homo sapiens
ccagauggaacacuggaa

SEQ ID NO: 2004026 - RNA, 15 nt, Homo sapiens
ucgaauggggucccc

SEQ ID NO: 2004027 - RNA, 14 nt, Homo sapiens
auuccaagaacuau

SEQ ID NO: 2004028 - RNA, 14 nt, Homo sapiens
cuuccuccaauagu

SEQ ID NO: 2004029 - RNA, 18 nt, Homo sapiens
aaauucagugaugugccu

SEQ ID NO: 2004030 - RNA, 17 nt, Homo sapiens
aagacaccagagcagau

SEQ ID NO: 2004031 - RNA, 18 nt, Homo sapiens
gccgcaguuuggagucac

SEQ ID NO: 2004032 - RNA, 14 nt, Homo sapiens
cugcucccacagaa

SEQ ID NO: 2004033 - RNA, 14 nt, Homo sapiens
ccucuacuuuccag

SEQ ID NO: 2004034 - RNA, 16 nt, Homo sapiens
ucaaagccuugguaaa

SEQ ID NO: 2004035 - RNA, 22 nt, Homo sapiens
cacacacccccccacaaggaac

SEQ ID NO: 2004036 - RNA, 19 nt, Homo sapiens
auuaaagcauuuccuacca

SEQ ID NO: 2004037 - RNA, 22 nt, Homo sapiens
gcugcuggcacagacuucacac

SEQ ID NO: 2004038 - RNA, 23 nt, Homo sapiens
aaacuuggaauuuguaaccucag

SEQ ID NO: 2004039 - RNA, 20 nt, Homo sapiens
cuugccugugacauuuugcc

SEQ ID NO: 2004040 - RNA, 19 nt, Homo sapiens
ccuggggcgagcacuguga

SEQ ID NO: 2004041 - RNA, 13 nt, Homo sapiens
gugggcacuggug

SEQ ID NO: 2004042 - RNA, 12 nt, Homo sapiens
uaccaugggcua

SEQ ID NO: 2004043 - RNA, 22 nt, Homo sapiens
agcagaugguggagcugaauau

SEQ ID NO: 2004044 - RNA, 15 nt, Homo sapiens
aggucuguuucucug

SEQ ID NO: 2004045 - RNA, 17 nt, Homo sapiens
uguaaguuuaugcauac

SEQ ID NO: 2004046 - RNA, 14 nt, Homo sapiens
auuuccagacaaau

SEQ ID NO: 2004047 - RNA, 15 nt, Homo sapiens
uccucaaaacaggcc

SEQ ID NO: 2004048 - RNA, 16 nt, Homo sapiens
gaaguuauaccuuccu

SEQ ID NO: 2004049 - RNA, 16 nt, Homo sapiens
acaaaguauaacaauu

SEQ ID NO: 2004050 - RNA, 18 nt, Homo sapiens
aaaugguggcuucagcuc

SEQ ID NO: 2004051 - RNA, 15 nt, Homo sapiens
uaaaaccauuauuua

SEQ ID NO: 2004052 - RNA, 14 nt, Homo sapiens
uucaccuuccaugu

SEQ ID NO: 2004053 - RNA, 21 nt, Homo sapiens
ccaacuccuggagauuucagu

SEQ ID NO: 2004054 - RNA, 15 nt, Homo sapiens
gaucuggcagacuca

SEQ ID NO: 2004055 - RNA, 22 nt, Homo sapiens
gcucggagcggcgucccuucca

SEQ ID NO: 2004056 - RNA, 13 nt, Homo sapiens
acugagcggacag

SEQ ID NO: 2004057 - RNA, 16 nt, Homo sapiens
gaugcacuuaugcagu

SEQ ID NO: 2004058 - RNA, 21 nt, Homo sapiens
gcuguaaaaauguuacgugaa

SEQ ID NO: 2004059 - RNA, 14 nt, Homo sapiens
uugccaaacuaaau

SEQ ID NO: 2004060 - RNA, 17 nt, Homo sapiens
gggaagccccacuugaa

SEQ ID NO: 2004061 - RNA, 20 nt, Homo sapiens
uggacacccucaccacccaa

SEQ ID NO: 2004062 - RNA, 19 nt, Homo sapiens
uccaaccugccugugcaug

SEQ ID NO: 2004063 - RNA, 16 nt, Homo sapiens
ugcuaucgccaucaca

SEQ ID NO: 2004064 - RNA, 23 nt, Homo sapiens
accauggaguuaacaucaugaau

SEQ ID NO: 2004065 - RNA, 23 nt, Homo sapiens
ucagaauaaauggguaacacuga

SEQ ID NO: 2004066 - RNA, 20 nt, Homo sapiens
uucaugucucuacccacuau

SEQ ID NO: 2004067 - RNA, 13 nt, Homo sapiens
ccagccaccucuu

SEQ ID NO: 2004068 - RNA, 15 nt, Homo sapiens
agucauauguucuca

SEQ ID NO: 2004069 - RNA, 14 nt, Homo sapiens
ugggggaacacuga

SEQ ID NO: 2004070 - RNA, 14 nt, Homo sapiens
cccaggaaguugug

SEQ ID NO: 2004071 - RNA, 16 nt, Homo sapiens
ucaugacauguuauau

SEQ ID NO: 2004072 - RNA, 18 nt, Homo sapiens
aaagaugugcucccacca

SEQ ID NO: 2004073 - RNA, 14 nt, Homo sapiens
cagugcuacugaaa

SEQ ID NO: 2004074 - RNA, 11 nt, Homo sapiens
gacuguuacag

SEQ ID NO: 2004075 - RNA, 22 nt, Homo sapiens
guccauugaguaacacccccau

SEQ ID NO: 2004076 - RNA, 14 nt, Homo sapiens
aguguggaagcaga

SEQ ID NO: 2004077 - RNA, 18 nt, Homo sapiens
aacauugauuauaagcau

SEQ ID NO: 2004078 - RNA, 19 nt, Homo sapiens
uccuaggcucccugaggua

SEQ ID NO: 2004079 - RNA, 19 nt, Homo sapiens
uacagcuguccacacugaa

SEQ ID NO: 2004080 - RNA, 11 nt, Homo sapiens
aguugagauuc

SEQ ID NO: 2004081 - RNA, 19 nt, Homo sapiens
aaagugaggcucagauuaa

SEQ ID NO: 2004082 - RNA, 12 nt, Homo sapiens
cuggacacagag

SEQ ID NO: 2004083 - RNA, 16 nt, Homo sapiens
aguagaagauuugaug

SEQ ID NO: 2004084 - RNA, 14 nt, Homo sapiens
uuuacaucuaugua

SEQ ID NO: 2004085 - RNA, 16 nt, Homo sapiens
cugcugcccaggcuag

SEQ ID NO: 2004086 - RNA, 22 nt, Homo sapiens
ggcaucugacaugcaucaucuc

SEQ ID NO: 2004087 - RNA, 21 nt, Homo sapiens
cugagauccagcacaacucag

SEQ ID NO: 2004088 - RNA, 15 nt, Homo sapiens
uguauaauacuuugu

SEQ ID NO: 2004089 - RNA, 18 nt, Homo sapiens
agaaaaagaucuuucauu

SEQ ID NO: 2004090 - RNA, 13 nt, Homo sapiens
uucuuauaucuga

SEQ ID NO: 2004091 - RNA, 19 nt, Homo sapiens
cuugauaaaaaauuuauua

SEQ ID NO: 2004092 - RNA, 19 nt, Homo sapiens
ccuguggauaacauugcua

SEQ ID NO: 2004093 - RNA, 15 nt, Homo sapiens
ucugaucaaguauuu

SEQ ID NO: 2004094 - RNA, 23 nt, Homo sapiens
uucccuaaagaagauaaacacaa

SEQ ID NO: 2004095 - RNA, 17 nt, Homo sapiens
aaaagagagaucuugau

SEQ ID NO: 2004096 - RNA, 20 nt, Homo sapiens
uucgcucuugaggagcucaa

SEQ ID NO: 2004097 - RNA, 16 nt, Homo sapiens
ggcaagauaaacacuu

SEQ ID NO: 2004098 - RNA, 18 nt, Homo sapiens
cucaaaccaaaucacuga

SEQ ID NO: 2004099 - RNA, 21 nt, Homo sapiens
aucucagagguagggcugcca

SEQ ID NO: 2004100 - RNA, 20 nt, Homo sapiens
guauucucauaauacugaaa

SEQ ID NO: 2004101 - RNA, 14 nt, Homo sapiens
agcugccaugucag

SEQ ID NO: 2004102 - RNA, 15 nt, Homo sapiens
uucauucucucucau

SEQ ID NO: 2004103 - RNA, 18 nt, Homo sapiens
agccucuguccgccuuua

SEQ ID NO: 2004104 - RNA, 14 nt, Homo sapiens
cauaaucucuuucc

SEQ ID NO: 2004105 - RNA, 22 nt, Homo sapiens
cuuuuucagaaacagugaguua

SEQ ID NO: 2004106 - RNA, 16 nt, Homo sapiens
uucuugagcagcugaa

SEQ ID NO: 2004107 - RNA, 17 nt, Homo sapiens
acacgccugcaaacgcu

SEQ ID NO: 2004108 - RNA, 20 nt, Homo sapiens
gaauuguuauguaaacauca

SEQ ID NO: 2004109 - RNA, 15 nt, Homo sapiens
uuuucugauaaaaga

SEQ ID NO: 2004110 - RNA, 15 nt, Homo sapiens
cucagcauaaguaaa

SEQ ID NO: 2004111 - RNA, 22 nt, Homo sapiens
cucaugcccugccaagcagcag

SEQ ID NO: 2004112 - RNA, 12 nt, Homo sapiens
aagucacaucca

SEQ ID NO: 2004113 - RNA, 14 nt, Homo sapiens
accacuucagcuga

SEQ ID NO: 2004114 - RNA, 21 nt, Homo sapiens
agacugcaaaugcuauuguca

SEQ ID NO: 2004115 - RNA, 13 nt, Homo sapiens
agauaagcaagag

SEQ ID NO: 2004116 - RNA, 19 nt, Homo sapiens
gcagcaucuacuacucugu

SEQ ID NO: 2004117 - RNA, 20 nt, Homo sapiens
gcaccuacuuacaugcauua

SEQ ID NO: 2004118 - RNA, 16 nt, Homo sapiens
uuaacaacccuguuga

SEQ ID NO: 2004119 - RNA, 18 nt, Homo sapiens
agauauuuuaaacuuuug

SEQ ID NO: 2004120 - RNA, 16 nt, Homo sapiens
caguuaggcagugcag

SEQ ID NO: 2004121 - RNA, 18 nt, Homo sapiens
ugcagucuuguacuguga

SEQ ID NO: 2004122 - RNA, 20 nt, Homo sapiens
auggaauauuccccuaucuc

SEQ ID NO: 2004123 - RNA, 15 nt, Homo sapiens
guucauaacugcuac

SEQ ID NO: 2004124 - RNA, 20 nt, Homo sapiens
ggacgccugugucacgagcc

SEQ ID NO: 2004125 - RNA, 14 nt, Homo sapiens
ugacuugcaauaaa

SEQ ID NO: 2004126 - RNA, 17 nt, Homo sapiens
agaggcuuucaaaugua

SEQ ID NO: 2004127 - RNA, 18 nt, Homo sapiens
ugcccuccguccuggcag

SEQ ID NO: 2004128 - RNA, 23 nt, Homo sapiens
aacugcuuccuauaauuuugaua

SEQ ID NO: 2004129 - RNA, 19 nt, Homo sapiens
auuuucauuauuucaagga

SEQ ID NO: 2004130 - RNA, 13 nt, Homo sapiens
aauucaaaaguga

SEQ ID NO: 2004131 - RNA, 14 nt, Homo sapiens
agcauggcacuccc

SEQ ID NO: 2004132 - RNA, 23 nt, Homo sapiens
uccggacuccucucguacuugaa

SEQ ID NO: 2004133 - RNA, 15 nt, Homo sapiens
aaaaggccuuuggga

SEQ ID NO: 2004134 - RNA, 20 nt, Homo sapiens
gcacucaggagcacagccau

SEQ ID NO: 2004135 - RNA, 19 nt, Homo sapiens
auuggccugguauggcugc

SEQ ID NO: 2004136 - RNA, 21 nt, Homo sapiens
caaagaauacuagaaugguag

SEQ ID NO: 2004137 - RNA, 21 nt, Homo sapiens
aaaggcugacauucacugagu

SEQ ID NO: 2004138 - RNA, 15 nt, Homo sapiens
acaguugccagugau

SEQ ID NO: 2004139 - RNA, 22 nt, Homo sapiens
cuacaucucguauggauuucua

SEQ ID NO: 2004140 - RNA, 15 nt, Homo sapiens
aauaguugaaccuau

SEQ ID NO: 2004141 - RNA, 15 nt, Homo sapiens
aauaaaauacagcca

SEQ ID NO: 2004142 - RNA, 17 nt, Homo sapiens
accaaggaacaggaaac

SEQ ID NO: 2004143 - RNA, 17 nt, Homo sapiens
uggugaauaauuggaag

SEQ ID NO: 2004144 - RNA, 15 nt, Homo sapiens
cagaacuugaagggu

SEQ ID NO: 2004145 - RNA, 13 nt, Homo sapiens
cuauucugucccu

SEQ ID NO: 2004146 - RNA, 14 nt, Homo sapiens
agcagaagacucuc

SEQ ID NO: 2004147 - RNA, 18 nt, Homo sapiens
uuaacuuuuguaccaaau

SEQ ID NO: 2004148 - RNA, 17 nt, Homo sapiens
caggguaaaaggugcag

SEQ ID NO: 2004149 - RNA, 19 nt, Homo sapiens
agucgagauugcacugcug

SEQ ID NO: 2004150 - RNA, 17 nt, Homo sapiens
aaauccgugaagucaca

SEQ ID NO: 2004151 - RNA, 18 nt, Homo sapiens
uagaagcuguaacagaau

SEQ ID NO: 2004152 - RNA, 20 nt, Homo sapiens
uccacagagauuagccugua

SEQ ID NO: 2004153 - RNA, 16 nt, Homo sapiens
agaugaauaugagcuc

SEQ ID NO: 2004154 - RNA, 13 nt, Homo sapiens
aacccagcucuca

SEQ ID NO: 2004155 - RNA, 15 nt, Homo sapiens
uuaauaucaaugaag

SEQ ID NO: 2004156 - RNA, 23 nt, Homo sapiens
gcagaauugagagugauuccuuu

SEQ ID NO: 2004157 - RNA, 18 nt, Homo sapiens
cugccucaagcuauguga

SEQ ID NO: 2004158 - RNA, 21 nt, Homo sapiens
guuaccugaaaacacugugca

SEQ ID NO: 2004159 - RNA, 21 nt, Homo sapiens
uuucagggaguacacagguag

SEQ ID NO: 2004160 - RNA, 18 nt, Homo sapiens
gaauguuugucucauccc

SEQ ID NO: 2004161 - RNA, 22 nt, Homo sapiens
ggauuaaugucaauucuugcca

SEQ ID NO: 2004162 - RNA, 15 nt, Homo sapiens
aauugggauuugcag

SEQ ID NO: 2004163 - RNA, 23 nt, Homo sapiens
uguuacuagagaagaagccuucu

SEQ ID NO: 2004164 - RNA, 14 nt, Homo sapiens
aguugucuauucau

SEQ ID NO: 2004165 - RNA, 14 nt, Homo sapiens
gugcuucuucacuu

SEQ ID NO: 2004166 - RNA, 16 nt, Homo sapiens
uaggccaggugcaacc

SEQ ID NO: 2004167 - RNA, 22 nt, Homo sapiens
guucaggaggagacagucagga

SEQ ID NO: 2004168 - RNA, 16 nt, Homo sapiens
aaugaaauuuaaacau

SEQ ID NO: 2004169 - RNA, 15 nt, Homo sapiens
auaauuaaaucauag

SEQ ID NO: 2004170 - RNA, 18 nt, Homo sapiens
auuuccaacaccacagac

SEQ ID NO: 2004171 - RNA, 20 nt, Homo sapiens
gauggacagacucacaaccu

SEQ ID NO: 2004172 - RNA, 21 nt, Homo sapiens
ucucaguguuaauacugagaa

SEQ ID NO: 2004173 - RNA, 14 nt, Homo sapiens
uuuacaguggaauc

SEQ ID NO: 2004174 - RNA, 16 nt, Homo sapiens
ucaauauuuuuguaua

SEQ ID NO: 2004175 - RNA, 15 nt, Homo sapiens
uacuguuuuaauugu

SEQ ID NO: 2004176 - RNA, 21 nt, Homo sapiens
uagcaucuuugaauacaaaga

SEQ ID NO: 2004177 - RNA, 12 nt, Homo sapiens
acugaaacugga

SEQ ID NO: 2004178 - RNA, 13 nt, Homo sapiens
accugagcgcugu

SEQ ID NO: 2004179 - RNA, 13 nt, Homo sapiens
cuuguuugcuuca

SEQ ID NO: 2004180 - RNA, 22 nt, Homo sapiens
uucucuacuccaugguucucaa

SEQ ID NO: 2004181 - RNA, 20 nt, Homo sapiens
aacugugcugaaugcuuuag

SEQ ID NO: 2004182 - RNA, 18 nt, Homo sapiens
aauugaaaaguacaacua

SEQ ID NO: 2004183 - RNA, 20 nt, Homo sapiens
acaaucagcccagugcaaac

SEQ ID NO: 2004184 - RNA, 20 nt, Homo sapiens
cuuaagagaauccacauaaa

SEQ ID NO: 2004185 - RNA, 21 nt, Homo sapiens
agaccuggcacuggaugcaga

SEQ ID NO: 2004186 - RNA, 14 nt, Homo sapiens
agucaucuauucaa

SEQ ID NO: 2004187 - RNA, 21 nt, Homo sapiens
acauuugcuagugacauguac

SEQ ID NO: 2004188 - RNA, 22 nt, Homo sapiens
ucugccccaguugguguucaaa

SEQ ID NO: 2004189 - RNA, 13 nt, Homo sapiens
gccaaaacauacc

SEQ ID NO: 2004190 - RNA, 15 nt, Homo sapiens
uuggaaaggaaugca

SEQ ID NO: 2004191 - RNA, 15 nt, Homo sapiens
aggugauaguguuga

SEQ ID NO: 2004192 - RNA, 17 nt, Homo sapiens
uuuuagaaucucuuucg

SEQ ID NO: 2004193 - RNA, 11 nt, Homo sapiens
ccaaagcaaau

SEQ ID NO: 2004194 - RNA, 17 nt, Homo sapiens
uuuacacugucaaacau

SEQ ID NO: 2004195 - RNA, 22 nt, Homo sapiens
uauucaaggaucucaaagaaag

SEQ ID NO: 2004196 - RNA, 19 nt, Homo sapiens
cagaaguugugcuaaacca

SEQ ID NO: 2004197 - RNA, 13 nt, Homo sapiens
auguaucugugaa

SEQ ID NO: 2004198 - RNA, 15 nt, Homo sapiens
ggccugggagggcaa

SEQ ID NO: 2004199 - RNA, 11 nt, Homo sapiens
guaacuacugc

SEQ ID NO: 2004200 - RNA, 14 nt, Homo sapiens
gcucccuccuccag

SEQ ID NO: 2004201 - RNA, 18 nt, Homo sapiens
cagaagcagaagugcaau

SEQ ID NO: 2004202 - RNA, 21 nt, Homo sapiens
agagugccguaacaacugugg

SEQ ID NO: 2004203 - RNA, 20 nt, Homo sapiens
accagggaugucuguugaaa

SEQ ID NO: 2004204 - RNA, 16 nt, Homo sapiens
acucgaguccccauga

SEQ ID NO: 2004205 - RNA, 16 nt, Homo sapiens
guaccuuauugaucuu

SEQ ID NO: 2004206 - RNA, 12 nt, Homo sapiens
caugucaucaaa

SEQ ID NO: 2004207 - RNA, 12 nt, Homo sapiens
ucugucauucaa

SEQ ID NO: 2004208 - RNA, 15 nt, Homo sapiens
agaggccaggcaugg

SEQ ID NO: 2004209 - RNA, 17 nt, Homo sapiens
ucuaaauacaugccaca

SEQ ID NO: 2004210 - RNA, 20 nt, Homo sapiens
gagagcuucuguugcugccu

SEQ ID NO: 2004211 - RNA, 15 nt, Homo sapiens
cccucuucucacuuu

SEQ ID NO: 2004212 - RNA, 11 nt, Homo sapiens
ugaaagcaauc

SEQ ID NO: 2004213 - RNA, 13 nt, Homo sapiens
aagacacugccug

SEQ ID NO: 2004214 - RNA, 15 nt, Homo sapiens
ugcaagcuccaucuc

SEQ ID NO: 2004215 - RNA, 22 nt, Homo sapiens
aacauuauauugcaaugaagga

SEQ ID NO: 2004216 - RNA, 16 nt, Homo sapiens
ggaaaggagaguacuu

SEQ ID NO: 2004217 - RNA, 13 nt, Homo sapiens
gcaguuucugaca

SEQ ID NO: 2004218 - RNA, 17 nt, Homo sapiens
ugauacuuuagccauca

SEQ ID NO: 2004219 - RNA, 18 nt, Homo sapiens
aauugcucaaagcugucg

SEQ ID NO: 2004220 - RNA, 18 nt, Homo sapiens
uagcugggauuacaggcg

SEQ ID NO: 2004221 - RNA, 18 nt, Homo sapiens
cagcugggauuacaggug

SEQ ID NO: 2004222 - RNA, 20 nt, Homo sapiens
caugagacucagugcagaug

SEQ ID NO: 2004223 - RNA, 14 nt, Homo sapiens
agacuccaucucaa

SEQ ID NO: 2004224 - RNA, 13 nt, Homo sapiens
uacagaugcagcc

SEQ ID NO: 2004225 - RNA, 15 nt, Homo sapiens
uagaauucugggaac

SEQ ID NO: 2004226 - RNA, 19 nt, Homo sapiens
uagauucagguaauacaaa

SEQ ID NO: 2004227 - RNA, 23 nt, Homo sapiens
agauuauugugacuucacuguau

SEQ ID NO: 2004228 - RNA, 14 nt, Homo sapiens
aucucugcaggaug

SEQ ID NO: 2004229 - RNA, 13 nt, Homo sapiens
cuaauguuuacua

SEQ ID NO: 2004230 - RNA, 19 nt, Homo sapiens
ccaggagcugaggauaaag

SEQ ID NO: 2004231 - RNA, 20 nt, Homo sapiens
gugcuucgagugacugaccc

SEQ ID NO: 2004232 - RNA, 19 nt, Homo sapiens
ggcugggaacucaccuggg

SEQ ID NO: 2004233 - RNA, 16 nt, Homo sapiens
acauugcuugugccac

SEQ ID NO: 2004234 - RNA, 12 nt, Homo sapiens
gucagacugaaa

SEQ ID NO: 2004235 - RNA, 18 nt, Homo sapiens
gcaaccuccacauguuca

SEQ ID NO: 2004236 - RNA, 16 nt, Homo sapiens
cagagucaaugaacuu

SEQ ID NO: 2004237 - RNA, 20 nt, Homo sapiens
cugaacaaucaaagcacuug

SEQ ID NO: 2004238 - RNA, 16 nt, Homo sapiens
cagaaaaucacugugc

SEQ ID NO: 2004239 - RNA, 12 nt, Homo sapiens
ccagacuugaau

SEQ ID NO: 2004240 - RNA, 14 nt, Homo sapiens
cuagucuguaacuc

SEQ ID NO: 2004241 - RNA, 14 nt, Homo sapiens
cugcaauguaggaa

SEQ ID NO: 2004242 - RNA, 20 nt, Homo sapiens
ugaacuaguuuaauguggau

SEQ ID NO: 2004243 - RNA, 20 nt, Homo sapiens
agugcccaacccuaucccag

SEQ ID NO: 2004244 - RNA, 22 nt, Homo sapiens
gacagaaaaaaaaaaaaaauca

SEQ ID NO: 2004245 - RNA, 13 nt, Homo sapiens
ucuuccugcauuc

SEQ ID NO: 2004246 - RNA, 15 nt, Homo sapiens
ccaucuuaacugagg

SEQ ID NO: 2004247 - RNA, 15 nt, Homo sapiens
acaaggggucaaugu

SEQ ID NO: 2004248 - RNA, 22 nt, Homo sapiens
gaaaaugcaggagagcuucccc

SEQ ID NO: 2004249 - RNA, 19 nt, Homo sapiens
aucuguuaucuaguaugca

SEQ ID NO: 2004250 - RNA, 21 nt, Homo sapiens
ggcgacuccuagauccaggga

SEQ ID NO: 2004251 - RNA, 17 nt, Homo sapiens
ccaggcacggugguuca

SEQ ID NO: 2004252 - RNA, 22 nt, Homo sapiens
ucagaguggccaaucccugugu

SEQ ID NO: 2004253 - RNA, 18 nt, Homo sapiens
agcaucaaaauauuucag

SEQ ID NO: 2004254 - RNA, 16 nt, Homo sapiens
gacuauggagugcacc

SEQ ID NO: 2004255 - RNA, 20 nt, Homo sapiens
aaaugaucuguacuaucuag

SEQ ID NO: 2004256 - RNA, 16 nt, Homo sapiens
acacuaauugacauug

SEQ ID NO: 2004257 - RNA, 23 nt, Homo sapiens
gacacacuacaccacacacaaca

SEQ ID NO: 2004258 - RNA, 19 nt, Homo sapiens
gugagccgaggucaugcca

SEQ ID NO: 2004259 - RNA, 16 nt, Homo sapiens
uuguuccccacugaca

SEQ ID NO: 2004260 - RNA, 19 nt, Homo sapiens
gcuacccugaguucaucca

SEQ ID NO: 2004261 - RNA, 15 nt, Homo sapiens
accagaggagccuuu

SEQ ID NO: 2004262 - RNA, 13 nt, Homo sapiens
uguugauggugcu

SEQ ID NO: 2004263 - RNA, 14 nt, Homo sapiens
gcaccucucuggga

SEQ ID NO: 2004264 - RNA, 18 nt, Homo sapiens
gccuuagucucaguuugu

SEQ ID NO: 2004265 - RNA, 15 nt, Homo sapiens
ggccugcacagauac

SEQ ID NO: 2004266 - RNA, 12 nt, Homo sapiens
cucagugcuguc

SEQ ID NO: 2004267 - RNA, 22 nt, Homo sapiens
agagcuuguaauaaauacugca

SEQ ID NO: 2004268 - RNA, 22 nt, Homo sapiens
uuuuaaaaaaagaaaacuuuaa

SEQ ID NO: 2004269 - RNA, 14 nt, Homo sapiens
gcuuauaaaaucaa

SEQ ID NO: 2004270 - RNA, 17 nt, Homo sapiens
acuagguuucaccuccc

SEQ ID NO: 2004271 - RNA, 16 nt, Homo sapiens
ucaugugggguauuaa

SEQ ID NO: 2004272 - RNA, 15 nt, Homo sapiens
ccuuguggaaccaaa

SEQ ID NO: 2004273 - RNA, 20 nt, Homo sapiens
cccauuccacagcucugggc

SEQ ID NO: 2004274 - RNA, 17 nt, Homo sapiens
uccaucagcccaucuca

SEQ ID NO: 2004275 - RNA, 15 nt, Homo sapiens
cugcuuucucuacua

SEQ ID NO: 2004276 - RNA, 22 nt, Homo sapiens
auacacaucucugucaguguga

SEQ ID NO: 2004277 - RNA, 16 nt, Homo sapiens
uauaaugcaaaccaua

SEQ ID NO: 2004278 - RNA, 17 nt, Homo sapiens
caccagccaucaugugc

SEQ ID NO: 2004279 - RNA, 12 nt, Homo sapiens
ugccacaaugcc

SEQ ID NO: 2004280 - RNA, 12 nt, Homo sapiens
auagacaaauag

SEQ ID NO: 2004281 - RNA, 12 nt, Homo sapiens
uguaacaaugua

SEQ ID NO: 2004282 - RNA, 15 nt, Homo sapiens
cuuccuaccaaauau

SEQ ID NO: 2004283 - RNA, 22 nt, Homo sapiens
gaccacagaaguggaauuugaa

SEQ ID NO: 2004284 - RNA, 18 nt, Homo sapiens
aggcuucuccaaagggag

SEQ ID NO: 2004285 - RNA, 23 nt, Homo sapiens
gagacccccacaccucaguuccc

SEQ ID NO: 2004286 - RNA, 17 nt, Homo sapiens
cucauaggaugguacca

SEQ ID NO: 2004287 - RNA, 17 nt, Homo sapiens
uuguuuccauucuuguc

SEQ ID NO: 2004288 - RNA, 12 nt, Homo sapiens
agagcaggcuca

SEQ ID NO: 2004289 - RNA, 18 nt, Homo sapiens
gcuggugucacucugccu

SEQ ID NO: 2004290 - RNA, 16 nt, Homo sapiens
caacaacaaaccaaaa

SEQ ID NO: 2004291 - RNA, 21 nt, Homo sapiens
aaagugguguaaacuuguaca

SEQ ID NO: 2004292 - RNA, 13 nt, Homo sapiens
ucuucacauguaa

SEQ ID NO: 2004293 - RNA, 23 nt, Homo sapiens
ucucaguugauuuucuggauucc

SEQ ID NO: 2004294 - RNA, 15 nt, Homo sapiens
cgcagggccaugcag

SEQ ID NO: 2004295 - RNA, 22 nt, Homo sapiens
gugcaucuuugccucaacucca

SEQ ID NO: 2004296 - RNA, 22 nt, Homo sapiens
accugcauguguuguacaauac

SEQ ID NO: 2004297 - RNA, 19 nt, Homo sapiens
caucgaaauguauucaccu

SEQ ID NO: 2004298 - RNA, 12 nt, Homo sapiens
uuggccacagac

SEQ ID NO: 2004299 - RNA, 16 nt, Homo sapiens
acgcugguagagaugg

SEQ ID NO: 2004300 - RNA, 23 nt, Homo sapiens
ugaacaaacuaugaucacaguga

SEQ ID NO: 2004301 - RNA, 17 nt, Homo sapiens
cauucaugugggcauuu

SEQ ID NO: 2004302 - RNA, 13 nt, Homo sapiens
gauuagcuuugug

SEQ ID NO: 2004303 - RNA, 19 nt, Homo sapiens
uggccacacugugacacac

SEQ ID NO: 2004304 - RNA, 13 nt, Homo sapiens
acagucauuccaa

SEQ ID NO: 2004305 - RNA, 18 nt, Homo sapiens
aagagaaguuuucuugac

SEQ ID NO: 2004306 - RNA, 17 nt, Homo sapiens
uuucauuuacuguggcu

SEQ ID NO: 2004307 - RNA, 17 nt, Homo sapiens
cacaggcuccuguugua

SEQ ID NO: 2004308 - RNA, 12 nt, Homo sapiens
acagacucuucc

SEQ ID NO: 2004309 - RNA, 21 nt, Homo sapiens
uagaggcugccugggccuguu

SEQ ID NO: 2004310 - RNA, 21 nt, Homo sapiens
uuucuccuuuugaccaaauaa

SEQ ID NO: 2004311 - RNA, 21 nt, Homo sapiens
ugagaagauuuuaaaaccauu

SEQ ID NO: 2004312 - RNA, 16 nt, Homo sapiens
ccgggcaaacuggccg

SEQ ID NO: 2004313 - RNA, 20 nt, Homo sapiens
uuucacaaauauuaaaaagu

SEQ ID NO: 2004314 - RNA, 14 nt, Homo sapiens
uugauuuugcaaau

SEQ ID NO: 2004315 - RNA, 14 nt, Homo sapiens
uuguaauugcauua

SEQ ID NO: 2004316 - RNA, 13 nt, Homo sapiens
gagcccugucccu

SEQ ID NO: 2004317 - RNA, 15 nt, Homo sapiens
agcacuguuuauaca

SEQ ID NO: 2004318 - RNA, 22 nt, Homo sapiens
caaagaagacucaguaugcuuu

SEQ ID NO: 2004319 - RNA, 22 nt, Homo sapiens
agcucaaugaugcaggcaauaa

SEQ ID NO: 2004320 - RNA, 17 nt, Homo sapiens
gugcucauccucacugc

SEQ ID NO: 2004321 - RNA, 20 nt, Homo sapiens
auuccggauccuaagcaucu

SEQ ID NO: 2004322 - RNA, 20 nt, Homo sapiens
ucaccaacccagagaaccug

SEQ ID NO: 2004323 - RNA, 13 nt, Homo sapiens
uucuacucuccca

SEQ ID NO: 2004324 - RNA, 17 nt, Homo sapiens
ucccuggaggacucuag

SEQ ID NO: 2004325 - RNA, 14 nt, Homo sapiens
uauaaggacacuga

SEQ ID NO: 2004326 - RNA, 21 nt, Homo sapiens
acuuuaaaauucaaguuauac

SEQ ID NO: 2004327 - RNA, 16 nt, Homo sapiens
gcucacuacaaccucc

SEQ ID NO: 2004328 - RNA, 11 nt, Homo sapiens
ucuggggaccc

SEQ ID NO: 2004329 - RNA, 13 nt, Homo sapiens
ucuccacuucacu

SEQ ID NO: 2004330 - RNA, 19 nt, Homo sapiens
aaaauugaccucaaaagaa

SEQ ID NO: 2004331 - RNA, 17 nt, Homo sapiens
acauuuuuuugcaugca

SEQ ID NO: 2004332 - RNA, 15 nt, Homo sapiens
gcagacacaugccag

SEQ ID NO: 2004333 - RNA, 23 nt, Homo sapiens
acggccuucgucugguuccucaa

SEQ ID NO: 2004334 - RNA, 15 nt, Homo sapiens
agggcuccuguggca

SEQ ID NO: 2004335 - RNA, 19 nt, Homo sapiens
uacaaucagccacauucua

SEQ ID NO: 2004336 - RNA, 17 nt, Homo sapiens
ccuguuaaauauacacu

SEQ ID NO: 2004337 - RNA, 20 nt, Homo sapiens
uuuccuucauucaacccacc

SEQ ID NO: 2004338 - RNA, 17 nt, Homo sapiens
ucauggccacacuguga

SEQ ID NO: 2004339 - RNA, 12 nt, Homo sapiens
ucucucugcucc

SEQ ID NO: 2004340 - RNA, 20 nt, Homo sapiens
acaugaagcaaacuaacuuu

SEQ ID NO: 2004341 - RNA, 19 nt, Homo sapiens
auaaaagcucagaugacau

SEQ ID NO: 2004342 - RNA, 17 nt, Homo sapiens
acccuacgaaagcacag

SEQ ID NO: 2004343 - RNA, 17 nt, Homo sapiens
ucccuauggaagcauau

SEQ ID NO: 2004344 - RNA, 17 nt, Homo sapiens
ugagcagggaucugccc

SEQ ID NO: 2004345 - RNA, 12 nt, Homo sapiens
guucauugccac

SEQ ID NO: 2004346 - RNA, 22 nt, Homo sapiens
guuaucuucuaucaaagcacau

SEQ ID NO: 2004347 - RNA, 22 nt, Homo sapiens
acaugcuguuggccucaagcaa

SEQ ID NO: 2004348 - RNA, 20 nt, Homo sapiens
ucuuugaagcgagcagucag

SEQ ID NO: 2004349 - RNA, 19 nt, Homo sapiens
uucugucgccuuagcaugu

SEQ ID NO: 2004350 - RNA, 22 nt, Homo sapiens
gcagcuagcugcuuuucuguca

SEQ ID NO: 2004351 - RNA, 23 nt, Homo sapiens
ucugacccaagagguggggacca

SEQ ID NO: 2004352 - RNA, 22 nt, Homo sapiens
acauaguagguacccaauucaa

SEQ ID NO: 2004353 - RNA, 21 nt, Homo sapiens
cuuucucaaagagggggcucu

SEQ ID NO: 2004354 - RNA, 17 nt, Homo sapiens
uucacccuuaacccaag

SEQ ID NO: 2004355 - RNA, 17 nt, Homo sapiens
aauagcccagccuuuug

SEQ ID NO: 2004356 - RNA, 20 nt, Homo sapiens
agugagggcucacucagcca

SEQ ID NO: 2004357 - RNA, 18 nt, Homo sapiens
ggccuugguaugugccag

SEQ ID NO: 2004358 - RNA, 19 nt, Homo sapiens
uagaaugaucuauugcuca

SEQ ID NO: 2004359 - RNA, 15 nt, Homo sapiens
acucuuguacaaaag

SEQ ID NO: 2004360 - RNA, 16 nt, Homo sapiens
ugcaaggaaauuugca

SEQ ID NO: 2004361 - RNA, 20 nt, Homo sapiens
gagauuauaaguuugacaca

SEQ ID NO: 2004362 - RNA, 15 nt, Homo sapiens
caaauaugcaaagca

SEQ ID NO: 2004363 - RNA, 15 nt, Homo sapiens
acagugcacaugaac

SEQ ID NO: 2004364 - RNA, 17 nt, Homo sapiens
uacacacacaccuagcc

SEQ ID NO: 2004365 - RNA, 13 nt, Homo sapiens
gccagcccacaca

SEQ ID NO: 2004366 - RNA, 17 nt, Homo sapiens
uucuuauuaaucauaca

SEQ ID NO: 2004367 - RNA, 23 nt, Homo sapiens
guaguucuagcaguccccagcug

SEQ ID NO: 2004368 - RNA, 22 nt, Homo sapiens
ccaggauccagaagggguuugg

SEQ ID NO: 2004369 - RNA, 23 nt, Homo sapiens
cugccccuguucucuuccacucu

SEQ ID NO: 2004370 - RNA, 19 nt, Homo sapiens
uaagaagauacacugcagc

SEQ ID NO: 2004371 - RNA, 16 nt, Homo sapiens
cagagaccauugcaau

SEQ ID NO: 2004372 - RNA, 12 nt, Homo sapiens
ugcauuaucuau

SEQ ID NO: 2004373 - RNA, 21 nt, Homo sapiens
uugacuaaagcuauguuacau

SEQ ID NO: 2004374 - RNA, 17 nt, Homo sapiens
gugaaaguuaauccacu

SEQ ID NO: 2004375 - RNA, 18 nt, Homo sapiens
ccugcccgagagcucuua

SEQ ID NO: 2004376 - RNA, 12 nt, Homo sapiens
aagcaagcucac

SEQ ID NO: 2004377 - RNA, 22 nt, Homo sapiens
uauuucccuguuucuuccacag

SEQ ID NO: 2004378 - RNA, 17 nt, Homo sapiens
uguaaucucaaugcaag

SEQ ID NO: 2004379 - RNA, 16 nt, Homo sapiens
caaacuguaguuguuu

SEQ ID NO: 2004380 - RNA, 18 nt, Homo sapiens
ucccugggaacugguuca

SEQ ID NO: 2004381 - RNA, 11 nt, Homo sapiens
gaguggugcca

SEQ ID NO: 2004382 - RNA, 21 nt, Homo sapiens
ccaaauuguguauauaucuua

SEQ ID NO: 2004383 - RNA, 17 nt, Homo sapiens
cauggacacuccagugc

SEQ ID NO: 2004384 - RNA, 21 nt, Homo sapiens
caauuagcauuauguuuugca

SEQ ID NO: 2004385 - RNA, 19 nt, Homo sapiens
uuauuugucuccaugauac

SEQ ID NO: 2004386 - RNA, 16 nt, Homo sapiens
acuaacccaaugccug

SEQ ID NO: 2004387 - RNA, 18 nt, Homo sapiens
ggcugggagaaggugcuu

SEQ ID NO: 2004388 - RNA, 11 nt, Homo sapiens
uucaccagagc

SEQ ID NO: 2004389 - RNA, 16 nt, Homo sapiens
ugggucacauccaucc

SEQ ID NO: 2004390 - RNA, 13 nt, Homo sapiens
aucuuuucauuaa

SEQ ID NO: 2004391 - RNA, 21 nt, Homo sapiens
caucuugcccccucaucucac

SEQ ID NO: 2004392 - RNA, 13 nt, Homo sapiens
gauuuuacuuuaa

SEQ ID NO: 2004393 - RNA, 15 nt, Homo sapiens
accagcaguacucag

SEQ ID NO: 2004394 - RNA, 19 nt, Homo sapiens
ucuugaucagacauucaga

SEQ ID NO: 2004395 - RNA, 17 nt, Homo sapiens
guccccaccuccagucc

SEQ ID NO: 2004396 - RNA, 21 nt, Homo sapiens
uuuauugucugucuacauuuc

SEQ ID NO: 2004397 - RNA, 22 nt, Homo sapiens
aggacgaauuugcacagugaua

SEQ ID NO: 2004398 - RNA, 20 nt, Homo sapiens
aaucuuguuaaauugcuuau

SEQ ID NO: 2004399 - RNA, 23 nt, Homo sapiens
cacauugcuaccucagugcuccu

SEQ ID NO: 2004400 - RNA, 14 nt, Homo sapiens
aauuagcucugggg

SEQ ID NO: 2004401 - RNA, 18 nt, Homo sapiens
ucagauccuuuuauucuc

SEQ ID NO: 2004402 - RNA, 17 nt, Homo sapiens
gagugcugucgggacca

SEQ ID NO: 2004403 - RNA, 18 nt, Homo sapiens
ccuggauuccucacuuug

SEQ ID NO: 2004404 - RNA, 15 nt, Homo sapiens
ugaauuaaaacagcu

SEQ ID NO: 2004405 - RNA, 22 nt, Homo sapiens
gcagcuauuuuaagccaucuca

SEQ ID NO: 2004406 - RNA, 18 nt, Homo sapiens
gccacagggaagcucaca

SEQ ID NO: 2004407 - RNA, 18 nt, Homo sapiens
cacugaccuacucuugcc

SEQ ID NO: 2004408 - RNA, 22 nt, Homo sapiens
uaaugcuaaagaaaaagucauc

SEQ ID NO: 2004409 - RNA, 14 nt, Homo sapiens
auugugaugccaau

SEQ ID NO: 2004410 - RNA, 23 nt, Homo sapiens
ugcacaccaaaaaaauacuugag

SEQ ID NO: 2004411 - RNA, 14 nt, Homo sapiens
acaaauauugucau

SEQ ID NO: 2004412 - RNA, 14 nt, Homo sapiens
ugaagugugacuuc

SEQ ID NO: 2004413 - RNA, 15 nt, Homo sapiens
aggaaagcgccucca

SEQ ID NO: 2004414 - RNA, 16 nt, Homo sapiens
gacauuccuucuccca

SEQ ID NO: 2004415 - RNA, 23 nt, Homo sapiens
cuugaccucucauaaauuuacuu

SEQ ID NO: 2004416 - RNA, 18 nt, Homo sapiens
aggaaaauaaaugaacau

SEQ ID NO: 2004417 - RNA, 18 nt, Homo sapiens
aagauauuauucaccaug

SEQ ID NO: 2004418 - RNA, 15 nt, Homo sapiens
gccucgcucuugucu

SEQ ID NO: 2004419 - RNA, 21 nt, Homo sapiens
aguauugagcuuugcauuuau

SEQ ID NO: 2004420 - RNA, 20 nt, Homo sapiens
uggacuggcagacucaaggg

SEQ ID NO: 2004421 - RNA, 17 nt, Homo sapiens
auugaaaaugucacugu

SEQ ID NO: 2004422 - RNA, 13 nt, Homo sapiens
cccuauuagcucu

SEQ ID NO: 2004423 - RNA, 16 nt, Homo sapiens
gacccaaaacacagga

SEQ ID NO: 2004424 - RNA, 15 nt, Homo sapiens
gcuacacagacauua

SEQ ID NO: 2004425 - RNA, 20 nt, Homo sapiens
uauauugguuuuuccagcua

SEQ ID NO: 2004426 - RNA, 16 nt, Homo sapiens
gaaaguguaaagcauu

SEQ ID NO: 2004427 - RNA, 19 nt, Homo sapiens
aaguugaagguuaaaggaa

SEQ ID NO: 2004428 - RNA, 22 nt, Homo sapiens
uuucauugccuguguauggaaa

SEQ ID NO: 2004429 - RNA, 17 nt, Homo sapiens
gacagacagagaaggca

SEQ ID NO: 2004430 - RNA, 17 nt, Homo sapiens
cagacugaaaugugcuc

SEQ ID NO: 2004431 - RNA, 20 nt, Homo sapiens
aucugcauaaccgcacagac

SEQ ID NO: 2004432 - RNA, 23 nt, Homo sapiens
cagagagggaacagcauaugcaa

SEQ ID NO: 2004433 - RNA, 22 nt, Homo sapiens
guuuuaagaggcagggucucac

SEQ ID NO: 2004434 - RNA, 13 nt, Homo sapiens
ugggacagacagc

SEQ ID NO: 2004435 - RNA, 17 nt, Homo sapiens
cuuuaucccuaacuucu

SEQ ID NO: 2004436 - RNA, 15 nt, Homo sapiens
aaguaaauauuucag

SEQ ID NO: 2004437 - RNA, 21 nt, Homo sapiens
ucuggagcggaauuuaccuga

SEQ ID NO: 2004438 - RNA, 16 nt, Homo sapiens
uagacacuuuaccucu

SEQ ID NO: 2004439 - RNA, 14 nt, Homo sapiens
aauugacacuuaaa

SEQ ID NO: 2004440 - RNA, 14 nt, Homo sapiens
auuugacacauaaa

SEQ ID NO: 2004441 - RNA, 14 nt, Homo sapiens
cuuaagaguagcug

SEQ ID NO: 2004442 - RNA, 14 nt, Homo sapiens
gccgggcgcagugg

SEQ ID NO: 2004443 - RNA, 11 nt, Homo sapiens
aaucacuugaa

SEQ ID NO: 2004444 - RNA, 20 nt, Homo sapiens
auagcucacugcacccucaa

SEQ ID NO: 2004445 - RNA, 22 nt, Homo sapiens
ugauaugguucuuauucacuga

SEQ ID NO: 2004446 - RNA, 12 nt, Homo sapiens
auguaaggccuu

SEQ ID NO: 2004447 - RNA, 21 nt, Homo sapiens
uuugggagcacggacugucag

SEQ ID NO: 2004448 - RNA, 17 nt, Homo sapiens
cuauauuuuucugcuac

SEQ ID NO: 2004449 - RNA, 22 nt, Homo sapiens
ugaguugaugggggccaggaca

SEQ ID NO: 2004450 - RNA, 18 nt, Homo sapiens
acaaagaaaaaugauacu

SEQ ID NO: 2004451 - RNA, 22 nt, Homo sapiens
uccucaggcacacagcuacucu

SEQ ID NO: 2004452 - RNA, 17 nt, Homo sapiens
aauaaacucaaugagcu

SEQ ID NO: 2004453 - RNA, 17 nt, Homo sapiens
agcuuauuacucugaua

SEQ ID NO: 2004454 - RNA, 18 nt, Homo sapiens
gaccuggggggggcaaga

SEQ ID NO: 2004455 - RNA, 11 nt, Homo sapiens
uaucaucuuuu

SEQ ID NO: 2004456 - RNA, 11 nt, Homo sapiens
cuucaucucau

SEQ ID NO: 2004457 - RNA, 18 nt, Homo sapiens
caucuccaagaaugcuga

SEQ ID NO: 2004458 - RNA, 24 nt, Homo sapiens
ugagucccccagagaugucaucag

SEQ ID NO: 2004459 - RNA, 15 nt, Homo sapiens
gccugugcugugacu

SEQ ID NO: 2004460 - RNA, 20 nt, Homo sapiens
cucaguggcuucuccaggga

SEQ ID NO: 2004461 - RNA, 17 nt, Homo sapiens
agacccuguguccucca

SEQ ID NO: 2004462 - RNA, 17 nt, Homo sapiens
aucuugaauccuuccau

SEQ ID NO: 2004463 - RNA, 23 nt, Homo sapiens
uguuuuuuuuuuuuuugagacag

SEQ ID NO: 2004464 - RNA, 14 nt, Homo sapiens
ggaccacauuuuau

SEQ ID NO: 2004465 - RNA, 22 nt, Homo sapiens
ggaggcucugaagagauaccca

SEQ ID NO: 2004466 - RNA, 19 nt, Homo sapiens
gaguuuucuauuucacuaa

SEQ ID NO: 2004467 - RNA, 21 nt, Homo sapiens
cuguauuugaaauaagaauuc

SEQ ID NO: 2004468 - RNA, 14 nt, Homo sapiens
uggcacugguugua

SEQ ID NO: 2004469 - RNA, 15 nt, Homo sapiens
ggcgacuccaucucu

SEQ ID NO: 2004470 - RNA, 16 nt, Homo sapiens
aacacuaauggccaag

SEQ ID NO: 2004471 - RNA, 17 nt, Homo sapiens
ugcgugugcgugcaugu

SEQ ID NO: 2004472 - RNA, 21 nt, Homo sapiens
gugucucugcaucacccacag

SEQ ID NO: 2004473 - RNA, 20 nt, Homo sapiens
aaaccgccccaaucccucag

SEQ ID NO: 2004474 - RNA, 20 nt, Homo sapiens
ggaauccuuuggugccaacu

SEQ ID NO: 2004475 - RNA, 13 nt, Homo sapiens
auguacaucuuuc

SEQ ID NO: 2004476 - RNA, 20 nt, Homo sapiens
cacuguacacauaagccaaa

SEQ ID NO: 2004477 - RNA, 22 nt, Homo sapiens
agacuucucccauagcaaagag

SEQ ID NO: 2004478 - RNA, 15 nt, Homo sapiens
uauucaccaucaugu

SEQ ID NO: 2004479 - RNA, 16 nt, Homo sapiens
ccagccccaagcuggg

SEQ ID NO: 2004480 - RNA, 18 nt, Homo sapiens
uguagacaggaaagccag

SEQ ID NO: 2004481 - RNA, 16 nt, Homo sapiens
cugccuaauuuugcca

SEQ ID NO: 2004482 - RNA, 15 nt, Homo sapiens
ccucgcaugacuguu

SEQ ID NO: 2004483 - RNA, 21 nt, Homo sapiens
cuacaccacacacaacagcca

SEQ ID NO: 2004484 - RNA, 15 nt, Homo sapiens
ccugccuccuugaaa

SEQ ID NO: 2004485 - RNA, 23 nt, Homo sapiens
uuuuuucuuucaguccaaaauag

SEQ ID NO: 2004486 - RNA, 14 nt, Homo sapiens
agcauucuuuaaca

SEQ ID NO: 2004487 - RNA, 17 nt, Homo sapiens
auagaugugagccagca

SEQ ID NO: 2004488 - RNA, 16 nt, Homo sapiens
auuauugugacuucac

SEQ ID NO: 2004489 - RNA, 14 nt, Homo sapiens
cuguuaacuaugac

SEQ ID NO: 2004490 - RNA, 16 nt, Homo sapiens
gaaacuugcuuaucaa

SEQ ID NO: 2004491 - RNA, 13 nt, Homo sapiens
uucacaacuuuga

SEQ ID NO: 2004492 - RNA, 13 nt, Homo sapiens
accaaaacacugc

SEQ ID NO: 2004493 - RNA, 14 nt, Homo sapiens
aacccuuggucaca

SEQ ID NO: 2004494 - RNA, 15 nt, Homo sapiens
acuuccccauuucag

SEQ ID NO: 2004495 - RNA, 22 nt, Homo sapiens
gugacuuugucucuccuggcug

SEQ ID NO: 2004496 - RNA, 19 nt, Homo sapiens
auucuuaaaguggcuuuca

SEQ ID NO: 2004497 - RNA, 20 nt, Homo sapiens
agccauuauucucugaugca

SEQ ID NO: 2004498 - RNA, 16 nt, Homo sapiens
agcugggccuggucuc

SEQ ID NO: 2004499 - RNA, 23 nt, Homo sapiens
aggccuagacucugucuaccugg

SEQ ID NO: 2004500 - RNA, 18 nt, Homo sapiens
uaaaaaauaaaguaccac

SEQ ID NO: 2004501 - RNA, 18 nt, Homo sapiens
ggacgugcgcgaugccug

SEQ ID NO: 2004502 - RNA, 18 nt, Homo sapiens
uuugcacacuugugugug

SEQ ID NO: 2004503 - RNA, 18 nt, Homo sapiens
accucccuagguccuucc

SEQ ID NO: 2004504 - RNA, 17 nt, Homo sapiens
gagaaaaaaacuucuuu

SEQ ID NO: 2004505 - RNA, 14 nt, Homo sapiens
uacauagagaauaa

SEQ ID NO: 2004506 - RNA, 18 nt, Homo sapiens
aacguuuucuacuuugaa

SEQ ID NO: 2004507 - RNA, 15 nt, Homo sapiens
cugguuucaccagcg

SEQ ID NO: 2004508 - RNA, 17 nt, Homo sapiens
ucugaugaucauugcug

SEQ ID NO: 2004509 - RNA, 17 nt, Homo sapiens
agcuuaaugauucugau

SEQ ID NO: 2004510 - RNA, 19 nt, Homo sapiens
gccugcuaauagcugcuag

SEQ ID NO: 2004511 - RNA, 14 nt, Homo sapiens
acugaaaggcaugu

SEQ ID NO: 2004512 - RNA, 20 nt, Homo sapiens
ugccauccaugugcuaguca

SEQ ID NO: 2004513 - RNA, 18 nt, Homo sapiens
gugauggggucaucaaau

SEQ ID NO: 2004514 - RNA, 13 nt, Homo sapiens
ugggugucuguug

SEQ ID NO: 2004515 - RNA, 17 nt, Homo sapiens
uggaacugauugcuccc

SEQ ID NO: 2004516 - RNA, 15 nt, Homo sapiens
caauaaagaguaaau

SEQ ID NO: 2004517 - RNA, 16 nt, Homo sapiens
aaccuugaaugcugcc

SEQ ID NO: 2004518 - RNA, 14 nt, Homo sapiens
aacauguacaggaa

SEQ ID NO: 2004519 - RNA, 17 nt, Homo sapiens
gaggaagacaggcaaau

SEQ ID NO: 2004520 - RNA, 21 nt, Homo sapiens
auccuggguacugaaagccuu

SEQ ID NO: 2004521 - RNA, 20 nt, Homo sapiens
aggcaugaaauacugugccu

SEQ ID NO: 2004522 - RNA, 12 nt, Homo sapiens
gggcacaagcag

SEQ ID NO: 2004523 - RNA, 15 nt, Homo sapiens
augaagagcuaauuu

SEQ ID NO: 2004524 - RNA, 11 nt, Homo sapiens
ccacacaagcg

SEQ ID NO: 2004525 - RNA, 15 nt, Homo sapiens
ugagccagaguucac

SEQ ID NO: 2004526 - RNA, 20 nt, Homo sapiens
gcugaaucccgauaguacua

SEQ ID NO: 2004527 - RNA, 16 nt, Homo sapiens
uuucaguucaaucaaa

SEQ ID NO: 2004528 - RNA, 18 nt, Homo sapiens
guacugaaagccuuaggg

SEQ ID NO: 2004529 - RNA, 12 nt, Homo sapiens
aaaaugacauua

SEQ ID NO: 2004530 - RNA, 16 nt, Homo sapiens
cuaugccugucuuuac

SEQ ID NO: 2004531 - RNA, 17 nt, Homo sapiens
guaaccuuauauuuaca

SEQ ID NO: 2004532 - RNA, 17 nt, Homo sapiens
uguaauguaaauacauc

SEQ ID NO: 2004533 - RNA, 19 nt, Homo sapiens
cggagccaugucaugugcc

SEQ ID NO: 2004534 - RNA, 16 nt, Homo sapiens
augguccuuucuggaa

SEQ ID NO: 2004535 - RNA, 14 nt, Homo sapiens
agaaacagccugug

SEQ ID NO: 2004536 - RNA, 19 nt, Homo sapiens
agaggaccugagucugcua

SEQ ID NO: 2004537 - RNA, 15 nt, Homo sapiens
ucccacucaccaggc

SEQ ID NO: 2004538 - RNA, 14 nt, Homo sapiens
uuuugcuuggugga

SEQ ID NO: 2004539 - RNA, 16 nt, Homo sapiens
cggggaggaggcauuc

SEQ ID NO: 2004540 - RNA, 23 nt, Homo sapiens
auuggacuuaaaaucuaauucaa

SEQ ID NO: 2004541 - RNA, 14 nt, Homo sapiens
ccaauaaagcucac

SEQ ID NO: 2004542 - RNA, 19 nt, Homo sapiens
ucuucaugugucuugcaau

SEQ ID NO: 2004543 - RNA, 22 nt, Homo sapiens
cagacauuccuucuacauguaa

SEQ ID NO: 2004544 - RNA, 20 nt, Homo sapiens
guguauauuuuuguauguca

SEQ ID NO: 2004545 - RNA, 22 nt, Homo sapiens
aaguaucuaaauuuggaacuua

SEQ ID NO: 2004546 - RNA, 21 nt, Homo sapiens
accaaggagaggucuugcuca

SEQ ID NO: 2004547 - RNA, 15 nt, Homo sapiens
gcuuuucacugcugc

SEQ ID NO: 2004548 - RNA, 17 nt, Homo sapiens
ucucaacuuacauaugu

SEQ ID NO: 2004549 - RNA, 14 nt, Homo sapiens
ugucacuaugcuau

SEQ ID NO: 2004550 - RNA, 20 nt, Homo sapiens
guacaauucuuuaaaauuca

SEQ ID NO: 2004551 - RNA, 17 nt, Homo sapiens
gcugcccccuacccggc

SEQ ID NO: 2004552 - RNA, 12 nt, Homo sapiens
uguguacccugg

SEQ ID NO: 2004553 - RNA, 22 nt, Homo sapiens
ccaagcagagugauucaggggc

SEQ ID NO: 2004554 - RNA, 19 nt, Homo sapiens
aguuuuaggguacaugugc

SEQ ID NO: 2004555 - RNA, 19 nt, Homo sapiens
ggcauaauuuuucuuuauu

SEQ ID NO: 2004556 - RNA, 20 nt, Homo sapiens
ugguuuuacagcuccuuuga

SEQ ID NO: 2004557 - RNA, 13 nt, Homo sapiens
ugcuggacuguca

SEQ ID NO: 2004558 - RNA, 15 nt, Homo sapiens
auucaaugcauuuaa

SEQ ID NO: 2004559 - RNA, 23 nt, Homo sapiens
aaacuaagguuagaaacauuuug

SEQ ID NO: 2004560 - RNA, 14 nt, Homo sapiens
uccugaugacccag

SEQ ID NO: 2004561 - RNA, 14 nt, Homo sapiens
ugaaaguauucuaa

SEQ ID NO: 2004562 - RNA, 13 nt, Homo sapiens
cagugaaggcuaa

SEQ ID NO: 2004563 - RNA, 23 nt, Homo sapiens
uaaggggggcagggagugaugau

SEQ ID NO: 2004564 - RNA, 17 nt, Homo sapiens
aaauguggacaucauga

SEQ ID NO: 2004565 - RNA, 17 nt, Homo sapiens
uacuagcagucacuuga

SEQ ID NO: 2004566 - RNA, 23 nt, Homo sapiens
acagaugggcaaacccuggugcu

SEQ ID NO: 2004567 - RNA, 20 nt, Homo sapiens
uaaaguccuuucuagauccu

SEQ ID NO: 2004568 - RNA, 21 nt, Homo sapiens
ccagacagacaacacugggaa

SEQ ID NO: 2004569 - RNA, 14 nt, Homo sapiens
gaugaggggugcug

SEQ ID NO: 2004570 - RNA, 21 nt, Homo sapiens
gcaguccuuuguaaacagugu

SEQ ID NO: 2004571 - RNA, 19 nt, Homo sapiens
caagaugaggcaccaggaa

SEQ ID NO: 2004572 - RNA, 20 nt, Homo sapiens
aaaaauaaaguaccacacau

SEQ ID NO: 2004573 - RNA, 19 nt, Homo sapiens
ucugccucugacacacagc

SEQ ID NO: 2004574 - RNA, 20 nt, Homo sapiens
uaacuuggcuaacauagcac

SEQ ID NO: 2004575 - RNA, 15 nt, Homo sapiens
cacucugcaggguga

SEQ ID NO: 2004576 - RNA, 18 nt, Homo sapiens
cagccagagacagaggau

SEQ ID NO: 2004577 - RNA, 15 nt, Homo sapiens
uggccacaugucuuu

SEQ ID NO: 2004578 - RNA, 13 nt, Homo sapiens
cuccuccugucaa

SEQ ID NO: 2004579 - RNA, 23 nt, Homo sapiens
aacuuguuuuuauugcauuugcu

SEQ ID NO: 2004580 - RNA, 15 nt, Homo sapiens
auggcuaauaccugu

SEQ ID NO: 2004581 - RNA, 23 nt, Homo sapiens
agccggggaagagauccaaagac

SEQ ID NO: 2004582 - RNA, 18 nt, Homo sapiens
agaauauaaaaauaaagc

SEQ ID NO: 2004583 - RNA, 21 nt, Homo sapiens
uccugccugcaguauuacaga

SEQ ID NO: 2004584 - RNA, 15 nt, Homo sapiens
caucugucagugagu

SEQ ID NO: 2004585 - RNA, 20 nt, Homo sapiens
acuccucuccgcaguuccug

SEQ ID NO: 2004586 - RNA, 21 nt, Homo sapiens
aauuuaaaaaguuagccaggu

SEQ ID NO: 2004587 - RNA, 14 nt, Homo sapiens
gauagcaugucuuu

SEQ ID NO: 2004588 - RNA, 14 nt, Homo sapiens
uagauuaaacaaac

SEQ ID NO: 2004589 - RNA, 20 nt, Homo sapiens
uuuuuauauauaugcauaua

SEQ ID NO: 2004590 - RNA, 13 nt, Homo sapiens
aaguauguugaua

SEQ ID NO: 2004591 - RNA, 23 nt, Homo sapiens
aagucccagcgcggcugcuucug

SEQ ID NO: 2004592 - RNA, 19 nt, Homo sapiens
uguauuuuuaauauaugca

SEQ ID NO: 2004593 - RNA, 12 nt, Homo sapiens
aaauauuucaca

SEQ ID NO: 2004594 - RNA, 23 nt, Homo sapiens
uuuacuugcccugaacauacaca

SEQ ID NO: 2004595 - RNA, 13 nt, Homo sapiens
aggagcugcucag

SEQ ID NO: 2004596 - RNA, 17 nt, Homo sapiens
cucuuuugaauccaugc

SEQ ID NO: 2004597 - RNA, 15 nt, Homo sapiens
aguaugugcauuuaa

SEQ ID NO: 2004598 - RNA, 22 nt, Homo sapiens
aucuuuaccuccugaguaauaa

SEQ ID NO: 2004599 - RNA, 16 nt, Homo sapiens
ggccuggggccugaga

SEQ ID NO: 2004600 - RNA, 23 nt, Homo sapiens
cucuuguguuugacacuaagaaa

SEQ ID NO: 2004601 - RNA, 21 nt, Homo sapiens
aggugcagaccuugggggaag

SEQ ID NO: 2004602 - RNA, 20 nt, Homo sapiens
cacaggucaggggugacaca

SEQ ID NO: 2004603 - RNA, 20 nt, Homo sapiens
ucuuaugggauuacauguua

SEQ ID NO: 2004604 - RNA, 19 nt, Homo sapiens
aucucuagagugagaaucu

SEQ ID NO: 2004605 - RNA, 14 nt, Homo sapiens
cuagcuaacuaauu

SEQ ID NO: 2004606 - RNA, 13 nt, Homo sapiens
augccuugcacac

SEQ ID NO: 2004607 - RNA, 13 nt, Homo sapiens
aagcauugcucaa

SEQ ID NO: 2004608 - RNA, 17 nt, Homo sapiens
cugcuuuucccauugcc

SEQ ID NO: 2004609 - RNA, 14 nt, Homo sapiens
aacuacugccuuua

SEQ ID NO: 2004610 - RNA, 21 nt, Homo sapiens
caccagugccucagugcugca

SEQ ID NO: 2004611 - RNA, 22 nt, Homo sapiens
uuuagacuuuuaacuucaccuu

SEQ ID NO: 2004612 - RNA, 22 nt, Homo sapiens
aggaucagaaaguaauuucuuc

SEQ ID NO: 2004613 - RNA, 19 nt, Homo sapiens
aagcaucaaagcacuguuu

SEQ ID NO: 2004614 - RNA, 16 nt, Homo sapiens
cucaagcuguccuccc

SEQ ID NO: 2004615 - RNA, 13 nt, Homo sapiens
ucagaaagccaac

SEQ ID NO: 2004616 - RNA, 21 nt, Homo sapiens
cuuugccagaggcugauguca

SEQ ID NO: 2004617 - RNA, 18 nt, Homo sapiens
aaaauuaaggucugggag

SEQ ID NO: 2004618 - RNA, 21 nt, Homo sapiens
gccgucacuugugggggucca

SEQ ID NO: 2004619 - RNA, 16 nt, Homo sapiens
uuauaaauccagugac

SEQ ID NO: 2004620 - RNA, 14 nt, Homo sapiens
auaggugacagggc

SEQ ID NO: 2004621 - RNA, 18 nt, Homo sapiens
uacuguaagagacaugaa

SEQ ID NO: 2004622 - RNA, 21 nt, Homo sapiens
uuccuaguauacccacugcau

SEQ ID NO: 2004623 - RNA, 13 nt, Homo sapiens
acaaggugcacag

SEQ ID NO: 2004624 - RNA, 13 nt, Homo sapiens
cacaggugacaag

SEQ ID NO: 2004625 - RNA, 16 nt, Homo sapiens
uagaaucuauuuucua

SEQ ID NO: 2004626 - RNA, 23 nt, Homo sapiens
aaguuuuugauucuacucuuaua

SEQ ID NO: 2004627 - RNA, 17 nt, Homo sapiens
agcacccccagugcagc

SEQ ID NO: 2004628 - RNA, 20 nt, Homo sapiens
ucugagacuauaacugucau

SEQ ID NO: 2004629 - RNA, 17 nt, Homo sapiens
cagagguggcucuggaa

SEQ ID NO: 2004630 - RNA, 21 nt, Homo sapiens
uacucaguaaaucagugcagu

SEQ ID NO: 2004631 - RNA, 15 nt, Homo sapiens
aguacguguggcuug

SEQ ID NO: 2004632 - RNA, 20 nt, Homo sapiens
acaaagacaucccggcccaa

SEQ ID NO: 2004633 - RNA, 15 nt, Homo sapiens
agucggcacagugca

SEQ ID NO: 2004634 - RNA, 15 nt, Homo sapiens
agaccgcuccccaau

SEQ ID NO: 2004635 - RNA, 18 nt, Homo sapiens
aauaacucuccaguaaca

SEQ ID NO: 2004636 - RNA, 16 nt, Homo sapiens
uucaaucaaccaaagu

SEQ ID NO: 2004637 - RNA, 16 nt, Homo sapiens
gacaguuuaccauccu

SEQ ID NO: 2004638 - RNA, 16 nt, Homo sapiens
gccacaacgccuggcu

SEQ ID NO: 2004639 - RNA, 13 nt, Homo sapiens
gaaauuugcaaaa

SEQ ID NO: 2004640 - RNA, 23 nt, Homo sapiens
ugucacccagguuggagugcagu

SEQ ID NO: 2004641 - RNA, 17 nt, Homo sapiens
uucagacacuucaugga

SEQ ID NO: 2004642 - RNA, 23 nt, Homo sapiens
accuggcccagugcaaucugucc

SEQ ID NO: 2004643 - RNA, 21 nt, Homo sapiens
ccuuuucuaguuuuauacaaa

SEQ ID NO: 2004644 - RNA, 11 nt, Homo sapiens
ccugaggucag

SEQ ID NO: 2004645 - RNA, 22 nt, Homo sapiens
gaagcuauugauguuuccagaa

SEQ ID NO: 2004646 - RNA, 13 nt, Homo sapiens
aauuucagcuuca

SEQ ID NO: 2004647 - RNA, 13 nt, Homo sapiens
auuuucagcauca

SEQ ID NO: 2004648 - RNA, 16 nt, Homo sapiens
auggcgggcacugggu

SEQ ID NO: 2004649 - RNA, 15 nt, Homo sapiens
accugcagggagcag

SEQ ID NO: 2004650 - RNA, 16 nt, Homo sapiens
cgcccaggcuggagug

SEQ ID NO: 2004651 - RNA, 13 nt, Homo sapiens
ccuccagauauac

SEQ ID NO: 2004652 - RNA, 16 nt, Homo sapiens
aagcauggcccugcug

SEQ ID NO: 2004653 - RNA, 17 nt, Homo sapiens
auucgugacaacaugcg

SEQ ID NO: 2004654 - RNA, 17 nt, Homo sapiens
uggagcuaaaacuggcc

SEQ ID NO: 2004655 - RNA, 20 nt, Homo sapiens
uaugaaaaucuccaucucaa

SEQ ID NO: 2004656 - RNA, 16 nt, Homo sapiens
cuauucaguggcuaac

SEQ ID NO: 2004657 - RNA, 19 nt, Homo sapiens
auuuccucagcuuaucucu

SEQ ID NO: 2004658 - RNA, 20 nt, Homo sapiens
acuucagcucacacaugaga

SEQ ID NO: 2004659 - RNA, 13 nt, Homo sapiens
cuccacugaccug

SEQ ID NO: 2004660 - RNA, 13 nt, Homo sapiens
gcacagcugccaa

SEQ ID NO: 2004661 - RNA, 15 nt, Homo sapiens
uuccagaaugcugaa

SEQ ID NO: 2004662 - RNA, 23 nt, Homo sapiens
aguucaccagcccugagccaugg

SEQ ID NO: 2004663 - RNA, 22 nt, Homo sapiens
uuccagguagcucggcaccaac

SEQ ID NO: 2004664 - RNA, 23 nt, Homo sapiens
auaaauacaugcacacacuugca

SEQ ID NO: 2004665 - RNA, 17 nt, Homo sapiens
ugggaaggcaauuucau

SEQ ID NO: 2004666 - RNA, 16 nt, Homo sapiens
cuccucauccauuucu

SEQ ID NO: 2004667 - RNA, 21 nt, Homo sapiens
ugcuaccugauuucagcacaa

SEQ ID NO: 2004668 - RNA, 19 nt, Homo sapiens
caaauuugaauuuguauaa

SEQ ID NO: 2004669 - RNA, 15 nt, Homo sapiens
cucaacuaacaaaau

SEQ ID NO: 2004670 - RNA, 13 nt, Homo sapiens
aucuguaacucua

SEQ ID NO: 2004671 - RNA, 14 nt, Homo sapiens
acgacuaaccuauc

SEQ ID NO: 2004672 - RNA, 23 nt, Homo sapiens
uacuuuucaguuuuuaacauaau

SEQ ID NO: 2004673 - RNA, 23 nt, Homo sapiens
uauauuuuaucuugguaguacau

SEQ ID NO: 2004674 - RNA, 14 nt, Homo sapiens
auaugaucuugaua

SEQ ID NO: 2004675 - RNA, 19 nt, Homo sapiens
cguuugugaacgcugugau

SEQ ID NO: 2004676 - RNA, 18 nt, Homo sapiens
ccgcaggcuucguuugcc

SEQ ID NO: 2004677 - RNA, 15 nt, Homo sapiens
cugcauucacccaga

SEQ ID NO: 2004678 - RNA, 19 nt, Homo sapiens
cugaggaggguacuuuucc

SEQ ID NO: 2004679 - RNA, 13 nt, Homo sapiens
ucaaucucuaguu

SEQ ID NO: 2004680 - RNA, 16 nt, Homo sapiens
aauuauaacuauuaca

SEQ ID NO: 2004681 - RNA, 19 nt, Homo sapiens
ucaagaauauaauauguga

SEQ ID NO: 2004682 - RNA, 17 nt, Homo sapiens
ucuacuuugauucugau

SEQ ID NO: 2004683 - RNA, 23 nt, Homo sapiens
aauacauaguguauuuugcacaa

SEQ ID NO: 2004684 - RNA, 22 nt, Homo sapiens
aauaauguucauuaaguucuga

SEQ ID NO: 2004685 - RNA, 14 nt, Homo sapiens
agugauccucccac

SEQ ID NO: 2004686 - RNA, 21 nt, Homo sapiens
uuuuccccccaccccccagca

SEQ ID NO: 2004687 - RNA, 19 nt, Homo sapiens
aacaauuugcauaauacua

SEQ ID NO: 2004688 - RNA, 19 nt, Homo sapiens
caagcucaaggcaaugggc

SEQ ID NO: 2004689 - RNA, 13 nt, Homo sapiens
cuauugccaugag

SEQ ID NO: 2004690 - RNA, 20 nt, Homo sapiens
agcauaggugauccauguaa

SEQ ID NO: 2004691 - RNA, 13 nt, Homo sapiens
ucuugccuugucc

SEQ ID NO: 2004692 - RNA, 12 nt, Homo sapiens
ggaaagccauga

SEQ ID NO: 2004693 - RNA, 14 nt, Homo sapiens
cuagauggacccca

SEQ ID NO: 2004694 - RNA, 15 nt, Homo sapiens
ucacugagaaaggcu

SEQ ID NO: 2004695 - RNA, 16 nt, Homo sapiens
ucucuauucuuuccau

SEQ ID NO: 2004696 - RNA, 18 nt, Homo sapiens
gacuuuuaaucagugaag

SEQ ID NO: 2004697 - RNA, 21 nt, Homo sapiens
aagguucauugccauugucau

SEQ ID NO: 2004698 - RNA, 16 nt, Homo sapiens
cagguccaauuuguaa

SEQ ID NO: 2004699 - RNA, 21 nt, Homo sapiens
ggagaccuuccacaaagggua

SEQ ID NO: 2004700 - RNA, 15 nt, Homo sapiens
gacgauggcuuugcc

SEQ ID NO: 2004701 - RNA, 21 nt, Homo sapiens
cacaugucaagggauuacuua

SEQ ID NO: 2004702 - RNA, 17 nt, Homo sapiens
ugaaauuaaaauugcca

SEQ ID NO: 2004703 - RNA, 12 nt, Homo sapiens
uggaugcaugaa

SEQ ID NO: 2004704 - RNA, 17 nt, Homo sapiens
augauuauauagcacau

SEQ ID NO: 2004705 - RNA, 17 nt, Homo sapiens
ggcggagcuugcaguga

SEQ ID NO: 2004706 - RNA, 20 nt, Homo sapiens
cugucugccagcauaugcag

SEQ ID NO: 2004707 - RNA, 20 nt, Homo sapiens
aauguggguauugaguguga

SEQ ID NO: 2004708 - RNA, 13 nt, Homo sapiens
cccagccucuggc

SEQ ID NO: 2004709 - RNA, 15 nt, Homo sapiens
acuauuugaaaaaag

SEQ ID NO: 2004710 - RNA, 13 nt, Homo sapiens
aaacucuggcuca

SEQ ID NO: 2004711 - RNA, 12 nt, Homo sapiens
uuguaugccaau

SEQ ID NO: 2004712 - RNA, 17 nt, Homo sapiens
uguccaaacaggugcug

SEQ ID NO: 2004713 - RNA, 16 nt, Homo sapiens
cugaguagggggagca

SEQ ID NO: 2004714 - RNA, 20 nt, Homo sapiens
cugcaaauacuuccaaagag

SEQ ID NO: 2004715 - RNA, 18 nt, Homo sapiens
gcaaauauuuauaagcua

SEQ ID NO: 2004716 - RNA, 21 nt, Homo sapiens
aggggaagagauuagucucuu

SEQ ID NO: 2004717 - RNA, 12 nt, Homo sapiens
ccauaauacaua

SEQ ID NO: 2004718 - RNA, 22 nt, Homo sapiens
gaaauauggaacuuacauuguu

SEQ ID NO: 2004719 - RNA, 15 nt, Homo sapiens
aaaacuaaacugcug

SEQ ID NO: 2004720 - RNA, 18 nt, Homo sapiens
gagccuggggcaucccag

SEQ ID NO: 2004721 - RNA, 14 nt, Homo sapiens
uccauuccagaaua

SEQ ID NO: 2004722 - RNA, 20 nt, Homo sapiens
uuccucccaggaagcccagg

SEQ ID NO: 2004723 - RNA, 17 nt, Homo sapiens
uuccagcguacuauaau

SEQ ID NO: 2004724 - RNA, 23 nt, Homo sapiens
uaggcauuuggucucacuacuug

SEQ ID NO: 2004725 - RNA, 13 nt, Homo sapiens
ugagcagccuuuc

SEQ ID NO: 2004726 - RNA, 13 nt, Homo sapiens
ugcuuuccauauu

SEQ ID NO: 2004727 - RNA, 22 nt, Homo sapiens
ccaaggaaaggcauguacaaaa

SEQ ID NO: 2004728 - RNA, 17 nt, Homo sapiens
auuacagacaugaacug

SEQ ID NO: 2004729 - RNA, 19 nt, Homo sapiens
uaacaguucccaucaccau

SEQ ID NO: 2004730 - RNA, 11 nt, Homo sapiens
agaagaauuaa

SEQ ID NO: 2004731 - RNA, 17 nt, Homo sapiens
aguucaaggaacuugaa

SEQ ID NO: 2004732 - RNA, 16 nt, Homo sapiens
aauuugaaaauguccu

SEQ ID NO: 2004733 - RNA, 17 nt, Homo sapiens
uuucacuuuauugcuau

SEQ ID NO: 2004734 - RNA, 21 nt, Homo sapiens
cuugcugccacaccacauugc

SEQ ID NO: 2004735 - RNA, 13 nt, Homo sapiens
cagugguuccuuc

SEQ ID NO: 2004736 - RNA, 22 nt, Homo sapiens
uccaaacacugggcucugagga

SEQ ID NO: 2004737 - RNA, 17 nt, Homo sapiens
caaguuuuucauacugu

SEQ ID NO: 2004738 - RNA, 18 nt, Homo sapiens
uugcagaguccugcacag

SEQ ID NO: 2004739 - RNA, 15 nt, Homo sapiens
ucaucccuccaucuc

SEQ ID NO: 2004740 - RNA, 20 nt, Homo sapiens
agacggagucucgcucuguc

SEQ ID NO: 2004741 - RNA, 20 nt, Homo sapiens
uagagaauuccucuauuugu

SEQ ID NO: 2004742 - RNA, 17 nt, Homo sapiens
cauucacuugcauuucu

SEQ ID NO: 2004743 - RNA, 17 nt, Homo sapiens
ugcucauucauauuccu

SEQ ID NO: 2004744 - RNA, 19 nt, Homo sapiens
agagugcaaauuguacaag

SEQ ID NO: 2004745 - RNA, 11 nt, Homo sapiens
agaucagucag

SEQ ID NO: 2004746 - RNA, 15 nt, Homo sapiens
ugaagucucuaaugu

SEQ ID NO: 2004747 - RNA, 16 nt, Homo sapiens
gcuggcgucugcauac

SEQ ID NO: 2004748 - RNA, 20 nt, Homo sapiens
aaaaccccaucucuacuaaa

SEQ ID NO: 2004749 - RNA, 18 nt, Homo sapiens
ggggcuccagcaccuucu

SEQ ID NO: 2004750 - RNA, 13 nt, Homo sapiens
acaggcauuuccu

SEQ ID NO: 2004751 - RNA, 23 nt, Homo sapiens
aagacaggacccugggaccacag

SEQ ID NO: 2004752 - RNA, 21 nt, Homo sapiens
ugguugauuuugugcuguugu

SEQ ID NO: 2004753 - RNA, 22 nt, Homo sapiens
ccccugcuggcucuucugccca

SEQ ID NO: 2004754 - RNA, 19 nt, Homo sapiens
ucuuuuggggaagcuuucu

SEQ ID NO: 2004755 - RNA, 20 nt, Homo sapiens
gcgaccuuguggcaucguca

SEQ ID NO: 2004756 - RNA, 21 nt, Homo sapiens
agguguuugaaauauggaacu

SEQ ID NO: 2004757 - RNA, 19 nt, Homo sapiens
uguagcaucuaaugaaugu

SEQ ID NO: 2004758 - RNA, 14 nt, Homo sapiens
ggucuuccagaccu

SEQ ID NO: 2004759 - RNA, 14 nt, Homo sapiens
guuggugcuuuguu

SEQ ID NO: 2004760 - RNA, 14 nt, Homo sapiens
uuuaacaccagaaa

SEQ ID NO: 2004761 - RNA, 23 nt, Homo sapiens
ggauucagagaaaggcaagggag

SEQ ID NO: 2004762 - RNA, 20 nt, Homo sapiens
uuccuccugaagccucugcc

SEQ ID NO: 2004763 - RNA, 22 nt, Homo sapiens
cagaccucuacaagcaaaugga

SEQ ID NO: 2004764 - RNA, 14 nt, Homo sapiens
cgggagccauguca

SEQ ID NO: 2004765 - RNA, 20 nt, Homo sapiens
aauucaagugacacauuaau

SEQ ID NO: 2004766 - RNA, 14 nt, Homo sapiens
agccacaacugcca

SEQ ID NO: 2004767 - RNA, 15 nt, Homo sapiens
gugauuuacagggau

SEQ ID NO: 2004768 - RNA, 14 nt, Homo sapiens
uaaugacauaaaaa

SEQ ID NO: 2004769 - RNA, 22 nt, Homo sapiens
ccuucuccaccaaagacaguug

SEQ ID NO: 2004770 - RNA, 13 nt, Homo sapiens
cuaauagggcaau

SEQ ID NO: 2004771 - RNA, 13 nt, Homo sapiens
aacuggccagcca

SEQ ID NO: 2004772 - RNA, 19 nt, Homo sapiens
uauuaauaguucaguguau

SEQ ID NO: 2004773 - RNA, 11 nt, Homo sapiens
gugcugucaug

SEQ ID NO: 2004774 - RNA, 23 nt, Homo sapiens
cgugguaugagagggauggcuca

SEQ ID NO: 2004775 - RNA, 23 nt, Homo sapiens
uuauaagagggcauauacaguga

SEQ ID NO: 2004776 - RNA, 19 nt, Homo sapiens
acuaaguugcuaaccucaa

SEQ ID NO: 2004777 - RNA, 15 nt, Homo sapiens
agucuuaccaaugac

SEQ ID NO: 2004778 - RNA, 17 nt, Homo sapiens
aaaaucuauaacauaaa

SEQ ID NO: 2004779 - RNA, 23 nt, Homo sapiens
agcaacaugaauuaagaacugac

SEQ ID NO: 2004780 - RNA, 17 nt, Homo sapiens
aucuagaauucacugag

SEQ ID NO: 2004781 - RNA, 13 nt, Homo sapiens
uaauaauguuaag

SEQ ID NO: 2004782 - RNA, 22 nt, Homo sapiens
uaagcuguggucaaggcuacag

SEQ ID NO: 2004783 - RNA, 17 nt, Homo sapiens
acccuacagcagaucca

SEQ ID NO: 2004784 - RNA, 17 nt, Homo sapiens
aauaauaacaaucacaa

SEQ ID NO: 2004785 - RNA, 18 nt, Homo sapiens
gaucccgaagaauggaga

SEQ ID NO: 2004786 - RNA, 16 nt, Homo sapiens
caggcgugacucagca

SEQ ID NO: 2004787 - RNA, 18 nt, Homo sapiens
agucucaagaacugccau

SEQ ID NO: 2004788 - RNA, 16 nt, Homo sapiens
uuguaggcuguggggu

SEQ ID NO: 2004789 - RNA, 23 nt, Homo sapiens
accuuaaacuuucaauaucuuua

SEQ ID NO: 2004790 - RNA, 12 nt, Homo sapiens
uuaugugcaaua

SEQ ID NO: 2004791 - RNA, 18 nt, Homo sapiens
cugagucugcaugugcac

SEQ ID NO: 2004792 - RNA, 20 nt, Homo sapiens
ugacaccagccuuucuccca

SEQ ID NO: 2004793 - RNA, 14 nt, Homo sapiens
gauacauauacuga

SEQ ID NO: 2004794 - RNA, 20 nt, Homo sapiens
uuagaagcagaucauuuccc

SEQ ID NO: 2004795 - RNA, 12 nt, Homo sapiens
gaagucauccca

SEQ ID NO: 2004796 - RNA, 18 nt, Homo sapiens
auugucuuacuguugcau

SEQ ID NO: 2004797 - RNA, 19 nt, Homo sapiens
ucccauuaaagagccaguu

SEQ ID NO: 2004798 - RNA, 16 nt, Homo sapiens
aguauuuuaagucuac

SEQ ID NO: 2004799 - RNA, 14 nt, Homo sapiens
aagugauauugcca

SEQ ID NO: 2004800 - RNA, 21 nt, Homo sapiens
agauccuggucugcaccucua

SEQ ID NO: 2004801 - RNA, 16 nt, Homo sapiens
ugugaugcaugagcuc

SEQ ID NO: 2004802 - RNA, 20 nt, Homo sapiens
ccuuggauagauucagcucc

SEQ ID NO: 2004803 - RNA, 12 nt, Homo sapiens
acaucaauguuc

SEQ ID NO: 2004804 - RNA, 13 nt, Homo sapiens
uguauccaaguua

SEQ ID NO: 2004805 - RNA, 14 nt, Homo sapiens
acauguaucacuca

SEQ ID NO: 2004806 - RNA, 19 nt, Homo sapiens
ugggcugaugcugggaccc

SEQ ID NO: 2004807 - RNA, 18 nt, Homo sapiens
agcccacagcagcaauau

SEQ ID NO: 2004808 - RNA, 15 nt, Homo sapiens
auguaaauauuucaa

SEQ ID NO: 2004809 - RNA, 16 nt, Homo sapiens
auugguuuaguucuua

SEQ ID NO: 2004810 - RNA, 15 nt, Homo sapiens
gggagccucguccaa

SEQ ID NO: 2004811 - RNA, 21 nt, Homo sapiens
ucgggaaccucacucuugcca

SEQ ID NO: 2004812 - RNA, 23 nt, Homo sapiens
acaaacuaacuaauaaaauauau

SEQ ID NO: 2004813 - RNA, 19 nt, Homo sapiens
gaaaacacugugcacaucu

SEQ ID NO: 2004814 - RNA, 16 nt, Homo sapiens
aaggggggucucuggc

SEQ ID NO: 2004815 - RNA, 22 nt, Homo sapiens
caaagugaggggaaaccagggc

SEQ ID NO: 2004816 - RNA, 21 nt, Homo sapiens
uguuaaguccuuggcuugcca

SEQ ID NO: 2004817 - RNA, 16 nt, Homo sapiens
auuucucucugacccu

SEQ ID NO: 2004818 - RNA, 21 nt, Homo sapiens
cgugggacccugccagacuga

SEQ ID NO: 2004819 - RNA, 14 nt, Homo sapiens
acauuuugaucacu

SEQ ID NO: 2004820 - RNA, 20 nt, Homo sapiens
uggaggacagagggagacag

SEQ ID NO: 2004821 - RNA, 12 nt, Homo sapiens
accucauuauca

SEQ ID NO: 2004822 - RNA, 12 nt, Homo sapiens
gucacauugccu

SEQ ID NO: 2004823 - RNA, 22 nt, Homo sapiens
cucaacaggacuuaacaucaac

SEQ ID NO: 2004824 - RNA, 20 nt, Homo sapiens
ugcuguauaugcaaugucca

SEQ ID NO: 2004825 - RNA, 15 nt, Homo sapiens
aaccugaacuuucau

SEQ ID NO: 2004826 - RNA, 18 nt, Homo sapiens
auaggaagccacaaauuu

SEQ ID NO: 2004827 - RNA, 11 nt, Homo sapiens
uuugcuucccc

SEQ ID NO: 2004828 - RNA, 21 nt, Homo sapiens
cccaggucuuccugcuuucca

SEQ ID NO: 2004829 - RNA, 14 nt, Homo sapiens
aacaguaguuucuc

SEQ ID NO: 2004830 - RNA, 17 nt, Homo sapiens
gacauuccagcauuguc

SEQ ID NO: 2004831 - RNA, 14 nt, Homo sapiens
cuggacuucuuagu

SEQ ID NO: 2004832 - RNA, 22 nt, Homo sapiens
uaaaguauuuuauucuuauuca

SEQ ID NO: 2004833 - RNA, 12 nt, Homo sapiens
aguuauacacua

SEQ ID NO: 2004834 - RNA, 19 nt, Homo sapiens
caagguccccuccacaucc

SEQ ID NO: 2004835 - RNA, 23 nt, Homo sapiens
ugcgucccuccgagcuugggaua

SEQ ID NO: 2004836 - RNA, 23 nt, Homo sapiens
accagcacggcccugacugaauc

SEQ ID NO: 2004837 - RNA, 13 nt, Homo sapiens
aaaggaaccaccu

SEQ ID NO: 2004838 - RNA, 14 nt, Homo sapiens
ugcuguuauauuuc

SEQ ID NO: 2004839 - RNA, 13 nt, Homo sapiens
auuuaagugcagu

SEQ ID NO: 2004840 - RNA, 14 nt, Homo sapiens
gauuguaugaaguu

SEQ ID NO: 2004841 - RNA, 22 nt, Homo sapiens
gaugcaucaucucuuccucaca

SEQ ID NO: 2004842 - RNA, 14 nt, Homo sapiens
auaaaagauuuucc

SEQ ID NO: 2004843 - RNA, 14 nt, Homo sapiens
uaaagacucaaggu

SEQ ID NO: 2004844 - RNA, 16 nt, Homo sapiens
aaggucugcuuuucau

SEQ ID NO: 2004845 - RNA, 17 nt, Homo sapiens
uagaaaggagaccugua

SEQ ID NO: 2004846 - RNA, 17 nt, Homo sapiens
cuacucuuccuguccua

SEQ ID NO: 2004847 - RNA, 20 nt, Homo sapiens
uauacacuuggaguuugcau

SEQ ID NO: 2004848 - RNA, 22 nt, Homo sapiens
ugccacaacagaauaaagcagc

SEQ ID NO: 2004849 - RNA, 12 nt, Homo sapiens
auagccacuuac

SEQ ID NO: 2004850 - RNA, 12 nt, Homo sapiens
uucuaugcagau

SEQ ID NO: 2004851 - RNA, 15 nt, Homo sapiens
aauccagcaacaaaa

SEQ ID NO: 2004852 - RNA, 14 nt, Homo sapiens
cuuuuuuacacuga

SEQ ID NO: 2004853 - RNA, 17 nt, Homo sapiens
uaccuguguauuuggaa

SEQ ID NO: 2004854 - RNA, 21 nt, Homo sapiens
cggaugucccaucugcuccuc

SEQ ID NO: 2004855 - RNA, 22 nt, Homo sapiens
ucuucuuuuggcuuccaugaug

SEQ ID NO: 2004856 - RNA, 23 nt, Homo sapiens
cauuguacuagcuguagcuauug

SEQ ID NO: 2004857 - RNA, 15 nt, Homo sapiens
augaacuuucagcag

SEQ ID NO: 2004858 - RNA, 21 nt, Homo sapiens
aaccuuguacuuuacaaucau

SEQ ID NO: 2004859 - RNA, 12 nt, Homo sapiens
uccauauuuccg

SEQ ID NO: 2004860 - RNA, 14 nt, Homo sapiens
aacucagagccucc

SEQ ID NO: 2004861 - RNA, 20 nt, Homo sapiens
cugcaccugggcagcuccuc

SEQ ID NO: 2004862 - RNA, 15 nt, Homo sapiens
guuacuguauacuga

SEQ ID NO: 2004863 - RNA, 22 nt, Homo sapiens
cugaaggugauucaccaaaaua

SEQ ID NO: 2004864 - RNA, 15 nt, Homo sapiens
cuuugucucugagaa

SEQ ID NO: 2004865 - RNA, 18 nt, Homo sapiens
aguccaccugagcugcca

SEQ ID NO: 2004866 - RNA, 20 nt, Homo sapiens
cucaaagaugcguuugccuc

SEQ ID NO: 2004867 - RNA, 20 nt, Homo sapiens
uaaacaugagcgcugaugau

SEQ ID NO: 2004868 - RNA, 23 nt, Homo sapiens
auuuagaccccauacaaguuuau

SEQ ID NO: 2004869 - RNA, 17 nt, Homo sapiens
acucugcuucaguccac

SEQ ID NO: 2004870 - RNA, 16 nt, Homo sapiens
cuccccggaguucagu

SEQ ID NO: 2004871 - RNA, 19 nt, Homo sapiens
ucccuaacuuaacauugca

SEQ ID NO: 2004872 - RNA, 18 nt, Homo sapiens
ucuucacuucuaaaugca

SEQ ID NO: 2004873 - RNA, 21 nt, Homo sapiens
uacacugccuguauacuuuag

SEQ ID NO: 2004874 - RNA, 13 nt, Homo sapiens
cuccugugcucac

SEQ ID NO: 2004875 - RNA, 19 nt, Homo sapiens
uuggaaucccacuuaucaa

SEQ ID NO: 2004876 - RNA, 19 nt, Homo sapiens
agagcccauuaaucuugau

SEQ ID NO: 2004877 - RNA, 20 nt, Homo sapiens
accuuuugucucacacagca

SEQ ID NO: 2004878 - RNA, 22 nt, Homo sapiens
ccuuauauuuacaauaaaugaa

SEQ ID NO: 2004879 - RNA, 22 nt, Homo sapiens
caacauauacauuuuguugcag

SEQ ID NO: 2004880 - RNA, 15 nt, Homo sapiens
gaaggcccagccugu

SEQ ID NO: 2004881 - RNA, 14 nt, Homo sapiens
augaaugacaugac

SEQ ID NO: 2004882 - RNA, 16 nt, Homo sapiens
uacaaauuuuuacuca

SEQ ID NO: 2004883 - RNA, 23 nt, Homo sapiens
cucaggcaaagaaaaugaaaugc

SEQ ID NO: 2004884 - RNA, 20 nt, Homo sapiens
gcuuacagaauggaucaugu

SEQ ID NO: 2004885 - RNA, 15 nt, Homo sapiens
cuguagguucuugau

SEQ ID NO: 2004886 - RNA, 21 nt, Homo sapiens
agcucuaauguuugcauauaa

SEQ ID NO: 2004887 - RNA, 21 nt, Homo sapiens
ucccuguaauuguuguuugua

SEQ ID NO: 2004888 - RNA, 19 nt, Homo sapiens
guguaggaaaaaugcaagc

SEQ ID NO: 2004889 - RNA, 17 nt, Homo sapiens
ggcacuaaaccacuucu

SEQ ID NO: 2004890 - RNA, 15 nt, Homo sapiens
uuuaguaaauaaaca

SEQ ID NO: 2004891 - RNA, 13 nt, Homo sapiens
acccuacuuucug

SEQ ID NO: 2004892 - RNA, 21 nt, Homo sapiens
cauucuauccccaaucagcuc

SEQ ID NO: 2004893 - RNA, 14 nt, Homo sapiens
ggcucuugcucaag

SEQ ID NO: 2004894 - RNA, 13 nt, Homo sapiens
ugaggaggacaaa

SEQ ID NO: 2004895 - RNA, 17 nt, Homo sapiens
auacugaauuucuuuga

SEQ ID NO: 2004896 - RNA, 17 nt, Homo sapiens
cuucuugucagacauaa

SEQ ID NO: 2004897 - RNA, 21 nt, Homo sapiens
aaggccacacuggcaucuccc

SEQ ID NO: 2004898 - RNA, 16 nt, Homo sapiens
accacccuagucccuu

SEQ ID NO: 2004899 - RNA, 15 nt, Homo sapiens
guauuuuugucauau

SEQ ID NO: 2004900 - RNA, 20 nt, Homo sapiens
gacuccuuguggacuggcug

SEQ ID NO: 2004901 - RNA, 13 nt, Homo sapiens
agucugcagugag

SEQ ID NO: 2004902 - RNA, 18 nt, Homo sapiens
ccuugcagaacugccauu

SEQ ID NO: 2004903 - RNA, 22 nt, Homo sapiens
cuuccaggggagguucagugaa

SEQ ID NO: 2004904 - RNA, 22 nt, Homo sapiens
aaugaagacuacauuugugaac

SEQ ID NO: 2004905 - RNA, 21 nt, Homo sapiens
augaggcacgccugccuucuc

SEQ ID NO: 2004906 - RNA, 15 nt, Homo sapiens
ucccaauacaggcau

SEQ ID NO: 2004907 - RNA, 18 nt, Homo sapiens
agaacgagacuccaccuc

SEQ ID NO: 2004908 - RNA, 15 nt, Homo sapiens
augaccucaaugccu

SEQ ID NO: 2004909 - RNA, 17 nt, Homo sapiens
aggucuaggugcuuuaa

SEQ ID NO: 2004910 - RNA, 21 nt, Homo sapiens
guugccuuuuucauuuuccaa

SEQ ID NO: 2004911 - RNA, 12 nt, Homo sapiens
caguuugaacuc

SEQ ID NO: 2004912 - RNA, 20 nt, Homo sapiens
acauccacacagccaaucca

SEQ ID NO: 2004913 - RNA, 22 nt, Homo sapiens
uucaaugugauauaaacagcuu

SEQ ID NO: 2004914 - RNA, 17 nt, Homo sapiens
acaugcgugugucaggg

SEQ ID NO: 2004915 - RNA, 21 nt, Homo sapiens
agccaccuugaccguagggga

SEQ ID NO: 2004916 - RNA, 17 nt, Homo sapiens
uguauagaaaaaccaaa

SEQ ID NO: 2004917 - RNA, 16 nt, Homo sapiens
aguugacucugcucuu

SEQ ID NO: 2004918 - RNA, 18 nt, Homo sapiens
uggcaacauuguacaagu

SEQ ID NO: 2004919 - RNA, 17 nt, Homo sapiens
cuugcucucaaugcagg

SEQ ID NO: 2004920 - RNA, 21 nt, Homo sapiens
caaaaaagucaacaaacugca

SEQ ID NO: 2004921 - RNA, 13 nt, Homo sapiens
acccuaaugcaua

SEQ ID NO: 2004922 - RNA, 15 nt, Homo sapiens
cuuuuauuacugggg

SEQ ID NO: 2004923 - RNA, 18 nt, Homo sapiens
cagaagauuagcaugaaa

SEQ ID NO: 2004924 - RNA, 17 nt, Homo sapiens
uacaggugugagucacc

SEQ ID NO: 2004925 - RNA, 19 nt, Homo sapiens
cagcccaccucaacccaga

SEQ ID NO: 2004926 - RNA, 21 nt, Homo sapiens
caauggaguggcugccaugga

SEQ ID NO: 2004927 - RNA, 16 nt, Homo sapiens
cucuggcuggggagca

SEQ ID NO: 2004928 - RNA, 15 nt, Homo sapiens
aguaaauagugucau

SEQ ID NO: 2004929 - RNA, 15 nt, Homo sapiens
gauauaaaagacuga

SEQ ID NO: 2004930 - RNA, 19 nt, Homo sapiens
cauccccaccugucuucaa

SEQ ID NO: 2004931 - RNA, 15 nt, Homo sapiens
cuaccuucaaagcug

SEQ ID NO: 2004932 - RNA, 15 nt, Homo sapiens
aauauuuuauucuca

SEQ ID NO: 2004933 - RNA, 16 nt, Homo sapiens
cagggaauugauucaa

SEQ ID NO: 2004934 - RNA, 14 nt, Homo sapiens
ugcgauacacugca

SEQ ID NO: 2004935 - RNA, 14 nt, Homo sapiens
aguuauacuccuca

SEQ ID NO: 2004936 - RNA, 13 nt, Homo sapiens
agagguccugcca

SEQ ID NO: 2004937 - RNA, 16 nt, Homo sapiens
uuaagcucaguggcaa

SEQ ID NO: 2004938 - RNA, 20 nt, Homo sapiens
uaccuauaauuauaacuaua

SEQ ID NO: 2004939 - RNA, 23 nt, Homo sapiens
caguaucacgauuugcaggauuc

SEQ ID NO: 2004940 - RNA, 16 nt, Homo sapiens
ccucugggugacaaaa

SEQ ID NO: 2004941 - RNA, 18 nt, Homo sapiens
ggggcucuucaucugccu

SEQ ID NO: 2004942 - RNA, 19 nt, Homo sapiens
gugaggaagccuauuugaa

SEQ ID NO: 2004943 - RNA, 17 nt, Homo sapiens
aaaaaggaacacuggaa

SEQ ID NO: 2004944 - RNA, 16 nt, Homo sapiens
agccuggucugugcau

SEQ ID NO: 2004945 - RNA, 18 nt, Homo sapiens
acugcagguuggacccca

SEQ ID NO: 2004946 - RNA, 19 nt, Homo sapiens
gagugaaaacaucugcaca

SEQ ID NO: 2004947 - RNA, 21 nt, Homo sapiens
cagcuuugaaaaaacaccaug

SEQ ID NO: 2004948 - RNA, 22 nt, Homo sapiens
ugacacagggguguugugagag

SEQ ID NO: 2004949 - RNA, 17 nt, Homo sapiens
cuucagccuucaaagua

SEQ ID NO: 2004950 - RNA, 17 nt, Homo sapiens
ccucagccuccaaagua

SEQ ID NO: 2004951 - RNA, 16 nt, Homo sapiens
cacaacuuugcuuuua

SEQ ID NO: 2004952 - RNA, 14 nt, Homo sapiens
cauaagucauucca

SEQ ID NO: 2004953 - RNA, 15 nt, Homo sapiens
uggagccccugugug

SEQ ID NO: 2004954 - RNA, 16 nt, Homo sapiens
ugguucaccuguguac

SEQ ID NO: 2004955 - RNA, 15 nt, Homo sapiens
ugccuccagcacucc

SEQ ID NO: 2004956 - RNA, 18 nt, Homo sapiens
acaguauuaacaucaaag

SEQ ID NO: 2004957 - RNA, 14 nt, Homo sapiens
ucuuauacagauaa

SEQ ID NO: 2004958 - RNA, 20 nt, Homo sapiens
gagaucgcgccacugcacuc

SEQ ID NO: 2004959 - RNA, 20 nt, Homo sapiens
uaugugcacugucacuuugc

SEQ ID NO: 2004960 - RNA, 19 nt, Homo sapiens
cugaauugaggacuaugga

SEQ ID NO: 2004961 - RNA, 22 nt, Homo sapiens
uucaaaugugcugucaaaacaa

SEQ ID NO: 2004962 - RNA, 12 nt, Homo sapiens
cacaaacaugaa

SEQ ID NO: 2004963 - RNA, 12 nt, Homo sapiens
agaaagccaaau

SEQ ID NO: 2004964 - RNA, 21 nt, Homo sapiens
uaccaccaagggaucugccau

SEQ ID NO: 2004965 - RNA, 13 nt, Homo sapiens
uauauugcaaaaa

SEQ ID NO: 2004966 - RNA, 16 nt, Homo sapiens
agaaaaucuaccaaga

SEQ ID NO: 2004967 - RNA, 17 nt, Homo sapiens
cauccaggccauucccc

SEQ ID NO: 2004968 - RNA, 13 nt, Homo sapiens
ucaucugggcaaa

SEQ ID NO: 2004969 - RNA, 21 nt, Homo sapiens
uugugugcucauguaugugcg

SEQ ID NO: 2004970 - RNA, 17 nt, Homo sapiens
gacaggccagaugaacu

SEQ ID NO: 2004971 - RNA, 13 nt, Homo sapiens
gagucaugcacuc

SEQ ID NO: 2004972 - RNA, 20 nt, Homo sapiens
acaagugcugggucugucac

SEQ ID NO: 2004973 - RNA, 18 nt, Homo sapiens
agaugguuucuacuggcu

SEQ ID NO: 2004974 - RNA, 12 nt, Homo sapiens
aagcugcucacu

SEQ ID NO: 2004975 - RNA, 16 nt, Homo sapiens
cucaugcuucacuuag

SEQ ID NO: 2004976 - RNA, 21 nt, Homo sapiens
gucugaaacccuugagcucaa

SEQ ID NO: 2004977 - RNA, 17 nt, Homo sapiens
uagcaggaccugccaag

SEQ ID NO: 2004978 - RNA, 19 nt, Homo sapiens
auaaacacuguuuguucca

SEQ ID NO: 2004979 - RNA, 15 nt, Homo sapiens
accacugacagcuag

SEQ ID NO: 2004980 - RNA, 19 nt, Homo sapiens
aaugguuaagaacugugaa

SEQ ID NO: 2004981 - RNA, 20 nt, Homo sapiens
ugacaccuagauuauagucu

SEQ ID NO: 2004982 - RNA, 14 nt, Homo sapiens
aggcaaucacauag

SEQ ID NO: 2004983 - RNA, 20 nt, Homo sapiens
uuuucuauuguuguacacag

SEQ ID NO: 2004984 - RNA, 20 nt, Homo sapiens
gagcugacccagaguggagu

SEQ ID NO: 2004985 - RNA, 14 nt, Homo sapiens
uucuuuuucacuug

SEQ ID NO: 2004986 - RNA, 16 nt, Homo sapiens
aaaaauuaacauguca

SEQ ID NO: 2004987 - RNA, 16 nt, Homo sapiens
gaaaaucugcauguuu

SEQ ID NO: 2004988 - RNA, 15 nt, Homo sapiens
uuuccuuaguuuucu

SEQ ID NO: 2004989 - RNA, 15 nt, Homo sapiens
gacuggcucaugccu

SEQ ID NO: 2004990 - RNA, 22 nt, Homo sapiens
agaagguggaaggcaguguuau

SEQ ID NO: 2004991 - RNA, 17 nt, Homo sapiens
gggugauggccagagga

SEQ ID NO: 2004992 - RNA, 22 nt, Homo sapiens
auggcauaggcugacuuuugca

SEQ ID NO: 2004993 - RNA, 17 nt, Homo sapiens
agcugggagcacuggug

SEQ ID NO: 2004994 - RNA, 17 nt, Homo sapiens
acacgccuggcuuccag

SEQ ID NO: 2004995 - RNA, 15 nt, Homo sapiens
uagagaaaacaugca

SEQ ID NO: 2004996 - RNA, 19 nt, Homo sapiens
uccguucccaccucugagg

SEQ ID NO: 2004997 - RNA, 17 nt, Homo sapiens
cuucacgaacagcguuu

SEQ ID NO: 2004998 - RNA, 21 nt, Homo sapiens
aauggauucaacacugugcac

SEQ ID NO: 2004999 - RNA, 21 nt, Homo sapiens
ugcagaguauaugaggcuuga

SEQ ID NO: 2005000 - RNA, 15 nt, Homo sapiens
aaaagaggagccaga

SEQ ID NO: 2005001 - RNA, 17 nt, Homo sapiens
cuguagaacugauuuua

SEQ ID NO: 2005002 - RNA, 22 nt, Homo sapiens
caaggaguauauggacacuaca

SEQ ID NO: 2005003 - RNA, 13 nt, Homo sapiens
aagacuacaauaa

SEQ ID NO: 2005004 - RNA, 15 nt, Homo sapiens
ugcuauugaacugag

SEQ ID NO: 2005005 - RNA, 15 nt, Homo sapiens
ucacauuacauuaac

SEQ ID NO: 2005006 - RNA, 17 nt, Homo sapiens
uggagaaucugcugcau

SEQ ID NO: 2005007 - RNA, 12 nt, Homo sapiens
acuucucugaaa

SEQ ID NO: 2005008 - RNA, 17 nt, Homo sapiens
uguccugagcaccacac

SEQ ID NO: 2005009 - RNA, 16 nt, Homo sapiens
aggcauuccagcuccu

SEQ ID NO: 2005010 - RNA, 15 nt, Homo sapiens
auucuugcuugacuc

SEQ ID NO: 2005011 - RNA, 18 nt, Homo sapiens
ccucugcagaacagugaa

SEQ ID NO: 2005012 - RNA, 16 nt, Homo sapiens
aagaagugagcagugu

SEQ ID NO: 2005013 - RNA, 19 nt, Homo sapiens
cccaggcccugggggaccu

SEQ ID NO: 2005014 - RNA, 16 nt, Homo sapiens
ucaccuuccaugucag

SEQ ID NO: 2005015 - RNA, 14 nt, Homo sapiens
acaaaguucauuca

SEQ ID NO: 2005016 - RNA, 13 nt, Homo sapiens
gcccgugcccuac

SEQ ID NO: 2005017 - RNA, 13 nt, Homo sapiens
cagcucauaaaau

SEQ ID NO: 2005018 - RNA, 21 nt, Homo sapiens
auacugagucuuuacucuuga

SEQ ID NO: 2005019 - RNA, 15 nt, Homo sapiens
uuccucccccagcgu

SEQ ID NO: 2005020 - RNA, 11 nt, Homo sapiens
uaguccacaag

SEQ ID NO: 2005021 - RNA, 13 nt, Homo sapiens
uaauauacuaugc

SEQ ID NO: 2005022 - RNA, 19 nt, Homo sapiens
gguucccuccccagcuccu

SEQ ID NO: 2005023 - RNA, 21 nt, Homo sapiens
ucagugaagaauacuucucau

SEQ ID NO: 2005024 - RNA, 16 nt, Homo sapiens
aacucaccauagagac

SEQ ID NO: 2005025 - RNA, 16 nt, Homo sapiens
uaaauaaauugccucc

SEQ ID NO: 2005026 - RNA, 17 nt, Homo sapiens
caaugcugcccuuucug

SEQ ID NO: 2005027 - RNA, 15 nt, Homo sapiens
cuggggaauuacuuu

SEQ ID NO: 2005028 - RNA, 15 nt, Homo sapiens
uuccacccuggagac

SEQ ID NO: 2005029 - RNA, 20 nt, Homo sapiens
cucugccacccacucaggau

SEQ ID NO: 2005030 - RNA, 16 nt, Homo sapiens
ccuuucuccaguguaa

SEQ ID NO: 2005031 - RNA, 16 nt, Homo sapiens
ugccuucacugggcca

SEQ ID NO: 2005032 - RNA, 15 nt, Homo sapiens
augcuauuauacugu

SEQ ID NO: 2005033 - RNA, 15 nt, Homo sapiens
cagauguucaaauau

SEQ ID NO: 2005034 - RNA, 15 nt, Homo sapiens
aaaugccugacucag

SEQ ID NO: 2005035 - RNA, 13 nt, Homo sapiens
uuccccuacauca

SEQ ID NO: 2005036 - RNA, 14 nt, Homo sapiens
caccuaauaucaau

SEQ ID NO: 2005037 - RNA, 21 nt, Homo sapiens
caaagucgccagucacugcug

SEQ ID NO: 2005038 - RNA, 17 nt, Homo sapiens
acucaggggucauucau

SEQ ID NO: 2005039 - RNA, 22 nt, Homo sapiens
gcuauuuccagagccagcucaa

SEQ ID NO: 2005040 - RNA, 22 nt, Homo sapiens
gucucuucuauuucuuucuuuu

SEQ ID NO: 2005041 - RNA, 15 nt, Homo sapiens
ugcauuaaaccuguc

SEQ ID NO: 2005042 - RNA, 22 nt, Homo sapiens
aggcauguucagggaugcucau

SEQ ID NO: 2005043 - RNA, 21 nt, Homo sapiens
uauucuuuaaauuucaucuca

SEQ ID NO: 2005044 - RNA, 20 nt, Homo sapiens
caugcuggaaccugcaaaaa

SEQ ID NO: 2005045 - RNA, 20 nt, Homo sapiens
cccaggcuggagugcagugg

SEQ ID NO: 2005046 - RNA, 20 nt, Homo sapiens
cccaggcuagagugcaaugg

SEQ ID NO: 2005047 - RNA, 18 nt, Homo sapiens
gcagacaccauucauucc

SEQ ID NO: 2005048 - RNA, 20 nt, Homo sapiens
aauccagugaccucucucuc

SEQ ID NO: 2005049 - RNA, 14 nt, Homo sapiens
ggaaaguugcauuu

SEQ ID NO: 2005050 - RNA, 15 nt, Homo sapiens
uagaagaagcuuugc

SEQ ID NO: 2005051 - RNA, 19 nt, Homo sapiens
uaaauaaaaggacugugau

SEQ ID NO: 2005052 - RNA, 18 nt, Homo sapiens
ugaauagggaaguaacau

SEQ ID NO: 2005053 - RNA, 12 nt, Homo sapiens
cacugccaugga

SEQ ID NO: 2005054 - RNA, 21 nt, Homo sapiens
auucuaagagaaggccuuuaa

SEQ ID NO: 2005055 - RNA, 22 nt, Homo sapiens
gcccaugccaaggccucccuca

SEQ ID NO: 2005056 - RNA, 12 nt, Homo sapiens
auuuguucucac

SEQ ID NO: 2005057 - RNA, 17 nt, Homo sapiens
cugaacugcaacacugg

SEQ ID NO: 2005058 - RNA, 20 nt, Homo sapiens
aauuacuccaccaucaccuc

SEQ ID NO: 2005059 - RNA, 21 nt, Homo sapiens
aagguacuucaaauccuugaa

SEQ ID NO: 2005060 - RNA, 22 nt, Homo sapiens
augggggaaaauuauuuugaca

SEQ ID NO: 2005061 - RNA, 16 nt, Homo sapiens
augggaugcuugccua

SEQ ID NO: 2005062 - RNA, 22 nt, Homo sapiens
gcaguucgcagccacccugagg

SEQ ID NO: 2005063 - RNA, 10 nt, Homo sapiens
cccagugugu

SEQ ID NO: 2005064 - RNA, 14 nt, Homo sapiens
uggaaaacugccug

SEQ ID NO: 2005065 - RNA, 21 nt, Homo sapiens
caacaaaggcugaacuggauu

SEQ ID NO: 2005066 - RNA, 12 nt, Homo sapiens
gacacauucaca

SEQ ID NO: 2005067 - RNA, 17 nt, Homo sapiens
agcacuggggagucuuu

SEQ ID NO: 2005068 - RNA, 9 nt, Homo sapiens
aagcauuag

SEQ ID NO: 2005069 - RNA, 21 nt, Homo sapiens
cuggcuucucuuucucugagu

SEQ ID NO: 2005070 - RNA, 22 nt, Homo sapiens
acagaauggaaccaaaauguau

SEQ ID NO: 2005071 - RNA, 21 nt, Homo sapiens
uucauacacguaaaugcagaa

SEQ ID NO: 2005072 - RNA, 21 nt, Homo sapiens
acuugguuugugaauccaucu

SEQ ID NO: 2005073 - RNA, 16 nt, Homo sapiens
gcagaggccacaggaa

SEQ ID NO: 2005074 - RNA, 19 nt, Homo sapiens
uauaaaagguuguguacaa

SEQ ID NO: 2005075 - RNA, 15 nt, Homo sapiens
ccacuggccaucucc

SEQ ID NO: 2005076 - RNA, 21 nt, Homo sapiens
uuuccuggaauugccagcuga

SEQ ID NO: 2005077 - RNA, 19 nt, Homo sapiens
auuuaauuagggugaaaau

SEQ ID NO: 2005078 - RNA, 21 nt, Homo sapiens
uuuuugguauuuuuguguaua

SEQ ID NO: 2005079 - RNA, 18 nt, Homo sapiens
auuuuagucacuaagacu

SEQ ID NO: 2005080 - RNA, 20 nt, Homo sapiens
auuauucuuguaguuuaccu

SEQ ID NO: 2005081 - RNA, 16 nt, Homo sapiens
ucccagugucuggccc

SEQ ID NO: 2005082 - RNA, 17 nt, Homo sapiens
ucucagcugcuggauga

SEQ ID NO: 2005083 - RNA, 13 nt, Homo sapiens
caggcucugggaa

SEQ ID NO: 2005084 - RNA, 13 nt, Homo sapiens
auuuacaucccag

SEQ ID NO: 2005085 - RNA, 20 nt, Homo sapiens
cauauuuuuuuuacugucag

SEQ ID NO: 2005086 - RNA, 16 nt, Homo sapiens
acacaugugcuggcca

SEQ ID NO: 2005087 - RNA, 19 nt, Homo sapiens
ccagaguucuugcacccuc

SEQ ID NO: 2005088 - RNA, 21 nt, Homo sapiens
ggccuuuccuggcugaucaga

SEQ ID NO: 2005089 - RNA, 14 nt, Homo sapiens
uuuaaaauauuuag

SEQ ID NO: 2005090 - RNA, 14 nt, Homo sapiens
aucaguaugcuguu

SEQ ID NO: 2005091 - RNA, 18 nt, Homo sapiens
cagauacauaucugugua

SEQ ID NO: 2005092 - RNA, 15 nt, Homo sapiens
ucagaaccauccaua

SEQ ID NO: 2005093 - RNA, 20 nt, Homo sapiens
ugaagacagcccgauccucc

SEQ ID NO: 2005094 - RNA, 18 nt, Homo sapiens
ggaaucacuggcuguuaa

SEQ ID NO: 2005095 - RNA, 22 nt, Homo sapiens
ugugcugacucuggccuuacaa

SEQ ID NO: 2005096 - RNA, 19 nt, Homo sapiens
ugcaaauauaucugcuauu

SEQ ID NO: 2005097 - RNA, 14 nt, Homo sapiens
uguucuuuggugua

SEQ ID NO: 2005098 - RNA, 13 nt, Homo sapiens
caggaacauacag

SEQ ID NO: 2005099 - RNA, 23 nt, Homo sapiens
ugugaaugaugauccuaggcauu

SEQ ID NO: 2005100 - RNA, 16 nt, Homo sapiens
acucaguaauuucaaa

SEQ ID NO: 2005101 - RNA, 16 nt, Homo sapiens
aggauguuuagcagug

SEQ ID NO: 2005102 - RNA, 16 nt, Homo sapiens
uugaacgucacaucuu

SEQ ID NO: 2005103 - RNA, 15 nt, Homo sapiens
cuuuaaauggcuuua

SEQ ID NO: 2005104 - RNA, 22 nt, Homo sapiens
augaagcagagaggcacgugcc

SEQ ID NO: 2005105 - RNA, 22 nt, Homo sapiens
aagugacuuuggggauucuccc

SEQ ID NO: 2005106 - RNA, 16 nt, Homo sapiens
ucugccagaagauccc

SEQ ID NO: 2005107 - RNA, 21 nt, Homo sapiens
ucuccagggguuuacagugaa

SEQ ID NO: 2005108 - RNA, 13 nt, Homo sapiens
auuuucaagacuu

SEQ ID NO: 2005109 - RNA, 21 nt, Homo sapiens
ggaguggaggggcauagccuu

SEQ ID NO: 2005110 - RNA, 20 nt, Homo sapiens
aauccacucuccauuucuau

SEQ ID NO: 2005111 - RNA, 13 nt, Homo sapiens
agagcuguuccag

SEQ ID NO: 2005112 - RNA, 17 nt, Homo sapiens
agaagcucggacuuggc

SEQ ID NO: 2005113 - RNA, 18 nt, Homo sapiens
aaccuaguccgcugaaga

SEQ ID NO: 2005114 - RNA, 16 nt, Homo sapiens
aaugaaaucucaggaa

SEQ ID NO: 2005115 - RNA, 23 nt, Homo sapiens
uaucaacuuaauucuguuacaca

SEQ ID NO: 2005116 - RNA, 22 nt, Homo sapiens
ccagagguauuccucucuuaaa

SEQ ID NO: 2005117 - RNA, 21 nt, Homo sapiens
agcgauucuccugccuuggcc

SEQ ID NO: 2005118 - RNA, 18 nt, Homo sapiens
cuuggaggccaccgggac

SEQ ID NO: 2005119 - RNA, 14 nt, Homo sapiens
augcaagcacaaau

SEQ ID NO: 2005120 - RNA, 15 nt, Homo sapiens
gaaauagugacaagu

SEQ ID NO: 2005121 - RNA, 20 nt, Homo sapiens
uaccaaaugccuuucuagca

SEQ ID NO: 2005122 - RNA, 20 nt, Homo sapiens
cauguguggauguguaaaug

SEQ ID NO: 2005123 - RNA, 18 nt, Homo sapiens
uccucucccaaguucuuu

SEQ ID NO: 2005124 - RNA, 15 nt, Homo sapiens
ggcacggagggcagu

SEQ ID NO: 2005125 - RNA, 14 nt, Homo sapiens
aagcuucaagugau

SEQ ID NO: 2005126 - RNA, 19 nt, Homo sapiens
auaugcaccccuggaacca

SEQ ID NO: 2005127 - RNA, 14 nt, Homo sapiens
agcauugagcauaa

SEQ ID NO: 2005128 - RNA, 12 nt, Homo sapiens
auuucagcuuga

SEQ ID NO: 2005129 - RNA, 21 nt, Homo sapiens
cugcugugccaggacugugac

SEQ ID NO: 2005130 - RNA, 19 nt, Homo sapiens
cagcauuauucuucagaag

SEQ ID NO: 2005131 - RNA, 17 nt, Homo sapiens
ucccuucuauauccuca

SEQ ID NO: 2005132 - RNA, 22 nt, Homo sapiens
acccgccuggcuaacaaggcga

SEQ ID NO: 2005133 - RNA, 22 nt, Homo sapiens
ccccuccuuggcuuuaugcaaa

SEQ ID NO: 2005134 - RNA, 15 nt, Homo sapiens
auuuguucagugacu

SEQ ID NO: 2005135 - RNA, 17 nt, Homo sapiens
agacuccagccugaaug

SEQ ID NO: 2005136 - RNA, 17 nt, Homo sapiens
ccucugcuccugugguc

SEQ ID NO: 2005137 - RNA, 16 nt, Homo sapiens
gagacucugucucagu

SEQ ID NO: 2005138 - RNA, 17 nt, Homo sapiens
cagggcuguugucauuu

SEQ ID NO: 2005139 - RNA, 15 nt, Homo sapiens
aauguuuucugaaga

SEQ ID NO: 2005140 - RNA, 13 nt, Homo sapiens
uucaauaauccau

SEQ ID NO: 2005141 - RNA, 14 nt, Homo sapiens
gggcgcccagccca

SEQ ID NO: 2005142 - RNA, 20 nt, Homo sapiens
gagugaauuguguaccugaa

SEQ ID NO: 2005143 - RNA, 14 nt, Homo sapiens
gaagucugaucccu

SEQ ID NO: 2005144 - RNA, 17 nt, Homo sapiens
uaaugcccuauguguau

SEQ ID NO: 2005145 - RNA, 19 nt, Homo sapiens
cugugugaacguguaugua

SEQ ID NO: 2005146 - RNA, 16 nt, Homo sapiens
cuagguagugaccuaa

SEQ ID NO: 2005147 - RNA, 21 nt, Homo sapiens
gaaaaugauuuuacuuagcaa

SEQ ID NO: 2005148 - RNA, 12 nt, Homo sapiens
auuuauauucaa

SEQ ID NO: 2005149 - RNA, 16 nt, Homo sapiens
ucuggccacugcugca

SEQ ID NO: 2005150 - RNA, 23 nt, Homo sapiens
gucgagacuucacgggcaaucau

SEQ ID NO: 2005151 - RNA, 16 nt, Homo sapiens
augcuuucuccugaaa

SEQ ID NO: 2005152 - RNA, 14 nt, Homo sapiens
ucuacuugcuuaaa

SEQ ID NO: 2005153 - RNA, 17 nt, Homo sapiens
uccaaaggucugauguc

SEQ ID NO: 2005154 - RNA, 21 nt, Homo sapiens
gaggaacaaagacaaccacug

SEQ ID NO: 2005155 - RNA, 16 nt, Homo sapiens
acuaccccacaccagc

SEQ ID NO: 2005156 - RNA, 16 nt, Homo sapiens
gcaaauguccccuuga

SEQ ID NO: 2005157 - RNA, 12 nt, Homo sapiens
aguucacucucc

SEQ ID NO: 2005158 - RNA, 18 nt, Homo sapiens
uuuaaaguggguuauucu

SEQ ID NO: 2005159 - RNA, 20 nt, Homo sapiens
ugcacuuauauagcaccuuu

SEQ ID NO: 2005160 - RNA, 20 nt, Homo sapiens
uacuauuauggaauuacucu

SEQ ID NO: 2005161 - RNA, 23 nt, Homo sapiens
uuaaaauauuuuuaugugcaaua

SEQ ID NO: 2005162 - RNA, 17 nt, Homo sapiens
ugcaaguacaaguauau

SEQ ID NO: 2005163 - RNA, 23 nt, Homo sapiens
caaauagguagagucauucauau

SEQ ID NO: 2005164 - RNA, 18 nt, Homo sapiens
uucccccuuuacucauag

SEQ ID NO: 2005165 - RNA, 19 nt, Homo sapiens
uuguugcaguucagacaaa

SEQ ID NO: 2005166 - RNA, 16 nt, Homo sapiens
cauccacugugccaug

SEQ ID NO: 2005167 - RNA, 23 nt, Homo sapiens
uaucacuaagaaagaaaggaaag

SEQ ID NO: 2005168 - RNA, 16 nt, Homo sapiens
uggccugcagugacac

SEQ ID NO: 2005169 - RNA, 13 nt, Homo sapiens
acagauacuuugu

SEQ ID NO: 2005170 - RNA, 18 nt, Homo sapiens
uguaacuucuuaaucuaa

SEQ ID NO: 2005171 - RNA, 15 nt, Homo sapiens
agcagugagcacuga

SEQ ID NO: 2005172 - RNA, 12 nt, Homo sapiens
caguaucuccaa

SEQ ID NO: 2005173 - RNA, 18 nt, Homo sapiens
cacccaggaguauccucu

SEQ ID NO: 2005174 - RNA, 18 nt, Homo sapiens
cagcuuauggcaucucau

SEQ ID NO: 2005175 - RNA, 13 nt, Homo sapiens
gaaccgcccuccu

SEQ ID NO: 2005176 - RNA, 14 nt, Homo sapiens
gagaaacacuauuu

SEQ ID NO: 2005177 - RNA, 18 nt, Homo sapiens
cacauauacauaugauca

SEQ ID NO: 2005178 - RNA, 15 nt, Homo sapiens
cauauauuuguauga

SEQ ID NO: 2005179 - RNA, 16 nt, Homo sapiens
uuccuagaaacugaca

SEQ ID NO: 2005180 - RNA, 14 nt, Homo sapiens
gaguucaaguccga

SEQ ID NO: 2005181 - RNA, 12 nt, Homo sapiens
uauucuugugaa

SEQ ID NO: 2005182 - RNA, 19 nt, Homo sapiens
uuuucccagcccuuuccag

SEQ ID NO: 2005183 - RNA, 12 nt, Homo sapiens
uguucaaagcac

SEQ ID NO: 2005184 - RNA, 16 nt, Homo sapiens
ucccaguauaccucau

SEQ ID NO: 2005185 - RNA, 15 nt, Homo sapiens
auuuguauaucucaa

SEQ ID NO: 2005186 - RNA, 13 nt, Homo sapiens
uagcaagcacuug

SEQ ID NO: 2005187 - RNA, 18 nt, Homo sapiens
cagaaggcuacauauaca

SEQ ID NO: 2005188 - RNA, 23 nt, Homo sapiens
acacuccaucuccugcucaccac

SEQ ID NO: 2005189 - RNA, 16 nt, Homo sapiens
ugguuuauacuguaua

SEQ ID NO: 2005190 - RNA, 21 nt, Homo sapiens
ggcgagagguggagugucaca

SEQ ID NO: 2005191 - RNA, 21 nt, Homo sapiens
guuacauugcuggucuuguaa

SEQ ID NO: 2005192 - RNA, 20 nt, Homo sapiens
aauauggugggcacagaagu

SEQ ID NO: 2005193 - RNA, 21 nt, Homo sapiens
aagugagcugagauugcacca

SEQ ID NO: 2005194 - RNA, 14 nt, Homo sapiens
cuuuuuacacuuua

SEQ ID NO: 2005195 - RNA, 19 nt, Homo sapiens
cuuuugcauaagugcauga

SEQ ID NO: 2005196 - RNA, 19 nt, Homo sapiens
cagugugcaguggugcaug

SEQ ID NO: 2005197 - RNA, 20 nt, Homo sapiens
gcacuuuuguuauuccauca

SEQ ID NO: 2005198 - RNA, 12 nt, Homo sapiens
aacuuuguacca

SEQ ID NO: 2005199 - RNA, 17 nt, Homo sapiens
caaacacuccacccucc

SEQ ID NO: 2005200 - RNA, 16 nt, Homo sapiens
ggcaacuagauaucau

SEQ ID NO: 2005201 - RNA, 16 nt, Homo sapiens
aaaguacaaccugaau

SEQ ID NO: 2005202 - RNA, 16 nt, Homo sapiens
auuugugauacuuccu

SEQ ID NO: 2005203 - RNA, 13 nt, Homo sapiens
ccaggacaucucu

SEQ ID NO: 2005204 - RNA, 22 nt, Homo sapiens
aagugccuuaaccuagaggguc

SEQ ID NO: 2005205 - RNA, 19 nt, Homo sapiens
gauggggggggauguggau

SEQ ID NO: 2005206 - RNA, 18 nt, Homo sapiens
auaggauuauagauacuu

SEQ ID NO: 2005207 - RNA, 17 nt, Homo sapiens
cugggcugaccccggug

SEQ ID NO: 2005208 - RNA, 18 nt, Homo sapiens
cacuaaaguuaguaaaga

SEQ ID NO: 2005209 - RNA, 20 nt, Homo sapiens
uagcuucugcaauguuuauc

SEQ ID NO: 2005210 - RNA, 11 nt, Homo sapiens
acggaaccuac

SEQ ID NO: 2005211 - RNA, 23 nt, Homo sapiens
accucgccuguuggggaccucac

SEQ ID NO: 2005212 - RNA, 18 nt, Homo sapiens
uguaauuuuacacaaaua

SEQ ID NO: 2005213 - RNA, 17 nt, Homo sapiens
uucucugaggacacaga

SEQ ID NO: 2005214 - RNA, 14 nt, Homo sapiens
aaugacaaguauuu

SEQ ID NO: 2005215 - RNA, 22 nt, Homo sapiens
aauacuugcaacuaaggacaaa

SEQ ID NO: 2005216 - RNA, 16 nt, Homo sapiens
uauuuccccugucagu

SEQ ID NO: 2005217 - RNA, 19 nt, Homo sapiens
ucuguguguguguaugugg

SEQ ID NO: 2005218 - RNA, 22 nt, Homo sapiens
ccuaugauggauggcagacucu

SEQ ID NO: 2005219 - RNA, 17 nt, Homo sapiens
caaugggaaguaaagag

SEQ ID NO: 2005220 - RNA, 18 nt, Homo sapiens
gucaugccacugcacucu

SEQ ID NO: 2005221 - RNA, 22 nt, Homo sapiens
auucagugacggaugucuuaaa

SEQ ID NO: 2005222 - RNA, 16 nt, Homo sapiens
acccagggacacucca

SEQ ID NO: 2005223 - RNA, 13 nt, Homo sapiens
gccuccacuuccc

SEQ ID NO: 2005224 - RNA, 19 nt, Homo sapiens
cuuccacuuugaguaccaa

SEQ ID NO: 2005225 - RNA, 13 nt, Homo sapiens
agcgcgugcacag

SEQ ID NO: 2005226 - RNA, 14 nt, Homo sapiens
cuguuacccagaga

SEQ ID NO: 2005227 - RNA, 18 nt, Homo sapiens
uagagucugaacagcugu

SEQ ID NO: 2005228 - RNA, 17 nt, Homo sapiens
aauucaaaaaaaaaagc

SEQ ID NO: 2005229 - RNA, 21 nt, Homo sapiens
uuucuuccaaagcacauugaa

SEQ ID NO: 2005230 - RNA, 23 nt, Homo sapiens
uugucaacaaaaagacauggaag

SEQ ID NO: 2005231 - RNA, 16 nt, Homo sapiens
auauguguucauuaaa

SEQ ID NO: 2005232 - RNA, 19 nt, Homo sapiens
ccaugcucagcucagcauu

SEQ ID NO: 2005233 - RNA, 15 nt, Homo sapiens
auauagucacacuuu

SEQ ID NO: 2005234 - RNA, 23 nt, Homo sapiens
ccuguuagcuccucacuguggua

SEQ ID NO: 2005235 - RNA, 15 nt, Homo sapiens
caguaagacagugca

SEQ ID NO: 2005236 - RNA, 18 nt, Homo sapiens
agauuuuuuagaucuucc

SEQ ID NO: 2005237 - RNA, 15 nt, Homo sapiens
ucagacaagcugcau

SEQ ID NO: 2005238 - RNA, 17 nt, Homo sapiens
cagcauuggccuuaaua

SEQ ID NO: 2005239 - RNA, 21 nt, Homo sapiens
gccauccugauggaccugccc

SEQ ID NO: 2005240 - RNA, 17 nt, Homo sapiens
caccauguugcccagga

SEQ ID NO: 2005241 - RNA, 17 nt, Homo sapiens
cucccacucucugcaag

SEQ ID NO: 2005242 - RNA, 18 nt, Homo sapiens
auaaauaaauaagggaaa

SEQ ID NO: 2005243 - RNA, 18 nt, Homo sapiens
ugaguuucuuaacccuuu

SEQ ID NO: 2005244 - RNA, 18 nt, Homo sapiens
gaaaaguccacauaaccc

SEQ ID NO: 2005245 - RNA, 22 nt, Homo sapiens
ucagccuuuaagauaccuugau

SEQ ID NO: 2005246 - RNA, 19 nt, Homo sapiens
uguggcuucuuaaucuuuu

SEQ ID NO: 2005247 - RNA, 12 nt, Homo sapiens
ucuuuuuauuaa

SEQ ID NO: 2005248 - RNA, 12 nt, Homo sapiens
gcaggugcugcg

SEQ ID NO: 2005249 - RNA, 21 nt, Homo sapiens
agucauugauagaacuacuuu

SEQ ID NO: 2005250 - RNA, 19 nt, Homo sapiens
ccaaugagaucauugugaa

SEQ ID NO: 2005251 - RNA, 17 nt, Homo sapiens
agauuuuugauaucuca

SEQ ID NO: 2005252 - RNA, 21 nt, Homo sapiens
accaugaggauaaaaccuccu

SEQ ID NO: 2005253 - RNA, 17 nt, Homo sapiens
ucuagugcaguaaaggg

SEQ ID NO: 2005254 - RNA, 22 nt, Homo sapiens
uggaugaaucuugaaacacauu

SEQ ID NO: 2005255 - RNA, 15 nt, Homo sapiens
cauaagucauuccaa

SEQ ID NO: 2005256 - RNA, 16 nt, Homo sapiens
caaauuccauagcuca

SEQ ID NO: 2005257 - RNA, 16 nt, Homo sapiens
cguggcuccaccuuga

SEQ ID NO: 2005258 - RNA, 20 nt, Homo sapiens
uguaugauuacaucaaggcu

SEQ ID NO: 2005259 - RNA, 23 nt, Homo sapiens
acaugccgcgggcggccaggcaa

SEQ ID NO: 2005260 - RNA, 20 nt, Homo sapiens
ccagggcagaggccaugaag

SEQ ID NO: 2005261 - RNA, 19 nt, Homo sapiens
aguuuuguacauaacuuag

SEQ ID NO: 2005262 - RNA, 23 nt, Homo sapiens
ccugcugccggaagucaucccag

SEQ ID NO: 2005263 - RNA, 18 nt, Homo sapiens
gagggaccagacacaggu

SEQ ID NO: 2005264 - RNA, 19 nt, Homo sapiens
uggaacacaaagaccaaaa

SEQ ID NO: 2005265 - RNA, 19 nt, Homo sapiens
guaaaauguuuaaugguga

SEQ ID NO: 2005266 - RNA, 22 nt, Homo sapiens
ccuaggguuuuuaaaauaucug

SEQ ID NO: 2005267 - RNA, 16 nt, Homo sapiens
ucagcaacucgcuuua

SEQ ID NO: 2005268 - RNA, 15 nt, Homo sapiens
cauuagcccaagaga

SEQ ID NO: 2005269 - RNA, 21 nt, Homo sapiens
ugcagcccuugugaugugauu

SEQ ID NO: 2005270 - RNA, 15 nt, Homo sapiens
auccucaggauuuca

SEQ ID NO: 2005271 - RNA, 18 nt, Homo sapiens
cuccagaagauugggauu

SEQ ID NO: 2005272 - RNA, 22 nt, Homo sapiens
ucgaacugcuggauucaaguga

SEQ ID NO: 2005273 - RNA, 15 nt, Homo sapiens
acauaugugcuggaa

SEQ ID NO: 2005274 - RNA, 21 nt, Homo sapiens
ggcaaaauuaccucucuugcu

SEQ ID NO: 2005275 - RNA, 22 nt, Homo sapiens
uuuccugcgucagccccagagu

SEQ ID NO: 2005276 - RNA, 18 nt, Homo sapiens
cuaauuuauaacuauuau

SEQ ID NO: 2005277 - RNA, 21 nt, Homo sapiens
uugcgacugcucugauggcac

SEQ ID NO: 2005278 - RNA, 23 nt, Homo sapiens
gggcagaugucuccccugccacu

SEQ ID NO: 2005279 - RNA, 21 nt, Homo sapiens
cuuaacuguccaguccaguga

SEQ ID NO: 2005280 - RNA, 21 nt, Homo sapiens
aaauuggucaggaacuauuaa

SEQ ID NO: 2005281 - RNA, 21 nt, Homo sapiens
caucaucacgacacauuugcc

SEQ ID NO: 2005282 - RNA, 15 nt, Homo sapiens
gcuucuucaauggca

SEQ ID NO: 2005283 - RNA, 18 nt, Homo sapiens
augagacauccagcagau

SEQ ID NO: 2005284 - RNA, 23 nt, Homo sapiens
cagcuuucccuccccagaguucu

SEQ ID NO: 2005285 - RNA, 21 nt, Homo sapiens
aaagaucuuucaggacucuac

SEQ ID NO: 2005286 - RNA, 23 nt, Homo sapiens
cucccuuaauaaacucacaacuc

SEQ ID NO: 2005287 - RNA, 20 nt, Homo sapiens
gcgagcacugugagcaccug

SEQ ID NO: 2005288 - RNA, 21 nt, Homo sapiens
agggcuguggugccggugcuu

SEQ ID NO: 2005289 - RNA, 17 nt, Homo sapiens
uaguuucagagugugga

SEQ ID NO: 2005290 - RNA, 19 nt, Homo sapiens
uaacacuaccaauuuccca

SEQ ID NO: 2005291 - RNA, 19 nt, Homo sapiens
aacuucuccuacuguagca

SEQ ID NO: 2005292 - RNA, 22 nt, Homo sapiens
cccacgguggucaccaugccaa

SEQ ID NO: 2005293 - RNA, 15 nt, Homo sapiens
uaugcacacauauau

SEQ ID NO: 2005294 - RNA, 21 nt, Homo sapiens
agacaaaauauuuuccugcca

SEQ ID NO: 2005295 - RNA, 13 nt, Homo sapiens
ugauuuacaagac

SEQ ID NO: 2005296 - RNA, 18 nt, Homo sapiens
uuuggagauagauggaua

SEQ ID NO: 2005297 - RNA, 20 nt, Homo sapiens
auacugagauugucuguuca

SEQ ID NO: 2005298 - RNA, 21 nt, Homo sapiens
aacauuuaaagagauuucccu

SEQ ID NO: 2005299 - RNA, 16 nt, Homo sapiens
ugcuccuccuacccuu

SEQ ID NO: 2005300 - RNA, 14 nt, Homo sapiens
gcaucagcugcuca

SEQ ID NO: 2005301 - RNA, 15 nt, Homo sapiens
uugcagaugccaaaa

SEQ ID NO: 2005302 - RNA, 15 nt, Homo sapiens
auauagaguggaauc

SEQ ID NO: 2005303 - RNA, 15 nt, Homo sapiens
acuccacucccagca

SEQ ID NO: 2005304 - RNA, 18 nt, Homo sapiens
uucuugaacaaacuggaa

SEQ ID NO: 2005305 - RNA, 17 nt, Homo sapiens
aagaccuagugcucuua

SEQ ID NO: 2005306 - RNA, 23 nt, Homo sapiens
agcaacaggccauugugaaccaa

SEQ ID NO: 2005307 - RNA, 18 nt, Homo sapiens
ucagaaguuugcaucucg

SEQ ID NO: 2005308 - RNA, 16 nt, Homo sapiens
agucucuggaaaaaga

SEQ ID NO: 2005309 - RNA, 17 nt, Homo sapiens
ugcacgcuugcacacau

SEQ ID NO: 2005310 - RNA, 16 nt, Homo sapiens
caauaauuuuaacuuu

SEQ ID NO: 2005311 - RNA, 11 nt, Homo sapiens
aacccaaagug

SEQ ID NO: 2005312 - RNA, 15 nt, Homo sapiens
gaaaaaaaaacuggg

SEQ ID NO: 2005313 - RNA, 21 nt, Homo sapiens
acagcccaggauacuggcaca

SEQ ID NO: 2005314 - RNA, 14 nt, Homo sapiens
gauuucaugccugg

SEQ ID NO: 2005315 - RNA, 17 nt, Homo sapiens
ugaauuugccuuccuca

SEQ ID NO: 2005316 - RNA, 15 nt, Homo sapiens
cugaacaggaugcug

SEQ ID NO: 2005317 - RNA, 18 nt, Homo sapiens
uuugagacugguugcaua

SEQ ID NO: 2005318 - RNA, 22 nt, Homo sapiens
ugacauauuucauaagcacauc

SEQ ID NO: 2005319 - RNA, 16 nt, Homo sapiens
ccgcucagguagccac

SEQ ID NO: 2005320 - RNA, 18 nt, Homo sapiens
aaaccauuucagccaaac

SEQ ID NO: 2005321 - RNA, 13 nt, Homo sapiens
ugggccugccaaa

SEQ ID NO: 2005322 - RNA, 13 nt, Homo sapiens
gcagacacugccg

SEQ ID NO: 2005323 - RNA, 13 nt, Homo sapiens
caaagaaguuuaa

SEQ ID NO: 2005324 - RNA, 17 nt, Homo sapiens
cagcuccucuccagaca

SEQ ID NO: 2005325 - RNA, 11 nt, Homo sapiens
auaacugagaa

SEQ ID NO: 2005326 - RNA, 16 nt, Homo sapiens
cagcaacacacaugcu

SEQ ID NO: 2005327 - RNA, 15 nt, Homo sapiens
cccaggaugaagggg

SEQ ID NO: 2005328 - RNA, 16 nt, Homo sapiens
gccuccagccccaugu

SEQ ID NO: 2005329 - RNA, 22 nt, Homo sapiens
gccuggaccccuggaccgcuuu

SEQ ID NO: 2005330 - RNA, 21 nt, Homo sapiens
ugucagaaaccaguuauguga

SEQ ID NO: 2005331 - RNA, 23 nt, Homo sapiens
agccugaaacucauagacacuga

SEQ ID NO: 2005332 - RNA, 17 nt, Homo sapiens
aaguagggauuaauauu

SEQ ID NO: 2005333 - RNA, 14 nt, Homo sapiens
aggagggagcugcu

SEQ ID NO: 2005334 - RNA, 13 nt, Homo sapiens
uagaaaugagauc

SEQ ID NO: 2005335 - RNA, 22 nt, Homo sapiens
cuagugaacauucgaccuccau

SEQ ID NO: 2005336 - RNA, 23 nt, Homo sapiens
ugauucugcagguaaaagaccau

SEQ ID NO: 2005337 - RNA, 19 nt, Homo sapiens
augaacuguauuauugcaa

SEQ ID NO: 2005338 - RNA, 14 nt, Homo sapiens
guccucaccacagu

SEQ ID NO: 2005339 - RNA, 16 nt, Homo sapiens
acuucuaccuacauau

SEQ ID NO: 2005340 - RNA, 14 nt, Homo sapiens
uugucacagguuuu

SEQ ID NO: 2005341 - RNA, 22 nt, Homo sapiens
cuuugguaaugugucaaagaga

SEQ ID NO: 2005342 - RNA, 17 nt, Homo sapiens
agggucucacacuguga

SEQ ID NO: 2005343 - RNA, 23 nt, Homo sapiens
ccacacgcugcaccuaaagccua

SEQ ID NO: 2005344 - RNA, 20 nt, Homo sapiens
aaguauuuacugacugcuua

SEQ ID NO: 2005345 - RNA, 15 nt, Homo sapiens
accuccucucuacua

SEQ ID NO: 2005346 - RNA, 19 nt, Homo sapiens
acguuacugcauacugauc

SEQ ID NO: 2005347 - RNA, 19 nt, Homo sapiens
gaucgagaccaucuuggcc

SEQ ID NO: 2005348 - RNA, 17 nt, Homo sapiens
cuuauguauuuucuucc

SEQ ID NO: 2005349 - RNA, 12 nt, Homo sapiens
ccugcucaggaa

SEQ ID NO: 2005350 - RNA, 21 nt, Homo sapiens
ggaaggagacaggaugagguc

SEQ ID NO: 2005351 - RNA, 20 nt, Homo sapiens
uacaaguugaaauaugcucu

SEQ ID NO: 2005352 - RNA, 18 nt, Homo sapiens
uaauaaaacaucuuucca

SEQ ID NO: 2005353 - RNA, 21 nt, Homo sapiens
uggaaaaagcuccccaccccu

SEQ ID NO: 2005354 - RNA, 18 nt, Homo sapiens
uuugaauguuguguaaca

SEQ ID NO: 2005355 - RNA, 20 nt, Homo sapiens
ggcucugugcccggugccau

SEQ ID NO: 2005356 - RNA, 18 nt, Homo sapiens
ccagcugcugcuggagau

SEQ ID NO: 2005357 - RNA, 14 nt, Homo sapiens
ggugauacccaagu

SEQ ID NO: 2005358 - RNA, 16 nt, Homo sapiens
gagagcagccucuuga

SEQ ID NO: 2005359 - RNA, 13 nt, Homo sapiens
cccauagcacugg

SEQ ID NO: 2005360 - RNA, 13 nt, Homo sapiens
gggaggggguccu

SEQ ID NO: 2005361 - RNA, 14 nt, Homo sapiens
acaaggaugaauua

SEQ ID NO: 2005362 - RNA, 16 nt, Homo sapiens
uccaaagcauuuccca

SEQ ID NO: 2005363 - RNA, 16 nt, Homo sapiens
cuuauccagcugguga

SEQ ID NO: 2005364 - RNA, 18 nt, Homo sapiens
cuggcagcgccucccgcc

SEQ ID NO: 2005365 - RNA, 18 nt, Homo sapiens
caaguagggggucuaaaa

SEQ ID NO: 2005366 - RNA, 17 nt, Homo sapiens
uuauuugaaaacauaua

SEQ ID NO: 2005367 - RNA, 15 nt, Homo sapiens
uugcugcccuaggcu

SEQ ID NO: 2005368 - RNA, 20 nt, Homo sapiens
agcaagcuguguuacuugaa

SEQ ID NO: 2005369 - RNA, 18 nt, Homo sapiens
agcaagacuccaucucag

SEQ ID NO: 2005370 - RNA, 20 nt, Homo sapiens
acagagaagccuucaagcuc

SEQ ID NO: 2005371 - RNA, 19 nt, Homo sapiens
acacaugaaguccaagcau

SEQ ID NO: 2005372 - RNA, 21 nt, Homo sapiens
cagaguuccauguuuguacuc

SEQ ID NO: 2005373 - RNA, 19 nt, Homo sapiens
uggggagggugucugggga

SEQ ID NO: 2005374 - RNA, 10 nt, Homo sapiens
ggacaaaaca

SEQ ID NO: 2005375 - RNA, 21 nt, Homo sapiens
uuuagucauuaauguguaaca

SEQ ID NO: 2005376 - RNA, 13 nt, Homo sapiens
uguugacauccaa

SEQ ID NO: 2005377 - RNA, 22 nt, Homo sapiens
cauugaucauuuuuauaugaaa

SEQ ID NO: 2005378 - RNA, 15 nt, Homo sapiens
ccugguccaucucau

SEQ ID NO: 2005379 - RNA, 21 nt, Homo sapiens
uggaaaaaucagaagcacaaa

SEQ ID NO: 2005380 - RNA, 15 nt, Homo sapiens
acacaaauuuucaag

SEQ ID NO: 2005381 - RNA, 14 nt, Homo sapiens
cucucccuugaggg

SEQ ID NO: 2005382 - RNA, 19 nt, Homo sapiens
acgcaaaaaauaacuacag

SEQ ID NO: 2005383 - RNA, 15 nt, Homo sapiens
augaugacugaaaau

SEQ ID NO: 2005384 - RNA, 16 nt, Homo sapiens
acucaguugcaacuug

SEQ ID NO: 2005385 - RNA, 19 nt, Homo sapiens
caacaugguccuuguccca

SEQ ID NO: 2005386 - RNA, 19 nt, Homo sapiens
cuauaugcuuacugugcac

SEQ ID NO: 2005387 - RNA, 21 nt, Homo sapiens
gaccucuacaagcaaauggag

SEQ ID NO: 2005388 - RNA, 22 nt, Homo sapiens
auacacaaauauauacguauau

SEQ ID NO: 2005389 - RNA, 14 nt, Homo sapiens
acuuugacauuucc

SEQ ID NO: 2005390 - RNA, 14 nt, Homo sapiens
acaacuuucagugg

SEQ ID NO: 2005391 - RNA, 12 nt, Homo sapiens
accuugucauuu

SEQ ID NO: 2005392 - RNA, 19 nt, Homo sapiens
ugagagggaaucgacugua

SEQ ID NO: 2005393 - RNA, 18 nt, Homo sapiens
acaaguauggcuccucca

SEQ ID NO: 2005394 - RNA, 16 nt, Homo sapiens
uaccugcccucucuca

SEQ ID NO: 2005395 - RNA, 14 nt, Homo sapiens
cagggccauuucag

SEQ ID NO: 2005396 - RNA, 15 nt, Homo sapiens
cuguaguuccagcua

SEQ ID NO: 2005397 - RNA, 12 nt, Homo sapiens
ucuugugccaaa

SEQ ID NO: 2005398 - RNA, 19 nt, Homo sapiens
ggcucugugccuuggucuc

SEQ ID NO: 2005399 - RNA, 16 nt, Homo sapiens
aaggguuucucuauua

SEQ ID NO: 2005400 - RNA, 17 nt, Homo sapiens
gccucccaaagugcagg

SEQ ID NO: 2005401 - RNA, 13 nt, Homo sapiens
cagagaugacucu

SEQ ID NO: 2005402 - RNA, 13 nt, Homo sapiens
caagaucaaaaag

SEQ ID NO: 2005403 - RNA, 21 nt, Homo sapiens
cucuaacugugcaaagcagag

SEQ ID NO: 2005404 - RNA, 16 nt, Homo sapiens
uuccuaugcaguguca

SEQ ID NO: 2005405 - RNA, 13 nt, Homo sapiens
acaggcuccccau

SEQ ID NO: 2005406 - RNA, 18 nt, Homo sapiens
caugugguuacuaguaca

SEQ ID NO: 2005407 - RNA, 22 nt, Homo sapiens
agucacaggaagaaagcagaaa

SEQ ID NO: 2005408 - RNA, 22 nt, Homo sapiens
cagggucaaacuacauugagcc

SEQ ID NO: 2005409 - RNA, 13 nt, Homo sapiens
cuuuagcaaagaa

SEQ ID NO: 2005410 - RNA, 14 nt, Homo sapiens
aggcugguggcaag

SEQ ID NO: 2005411 - RNA, 17 nt, Homo sapiens
cauagccucaccaaggu

SEQ ID NO: 2005412 - RNA, 20 nt, Homo sapiens
aacaacugucaguucauccu

SEQ ID NO: 2005413 - RNA, 23 nt, Homo sapiens
auaaacaacgcauugccacggaa

SEQ ID NO: 2005414 - RNA, 21 nt, Homo sapiens
gacuuggccucucucuagggu

SEQ ID NO: 2005415 - RNA, 12 nt, Homo sapiens
ccguucacauac

SEQ ID NO: 2005416 - RNA, 14 nt, Homo sapiens
auccugcaggguag

SEQ ID NO: 2005417 - RNA, 17 nt, Homo sapiens
ugugugcgugugcgugc

SEQ ID NO: 2005418 - RNA, 19 nt, Homo sapiens
cuuuuuuuucuucaccuca

SEQ ID NO: 2005419 - RNA, 22 nt, Homo sapiens
ucaaaauuguuacccauuugaa

SEQ ID NO: 2005420 - RNA, 17 nt, Homo sapiens
ccaacguggcccagaga

SEQ ID NO: 2005421 - RNA, 19 nt, Homo sapiens
cuguacuuuuuucaaauau

SEQ ID NO: 2005422 - RNA, 21 nt, Homo sapiens
aauugauuauucugauuccac

SEQ ID NO: 2005423 - RNA, 19 nt, Homo sapiens
cacuucuaagaaaagccua

SEQ ID NO: 2005424 - RNA, 22 nt, Homo sapiens
aaauagugacaagugaagaaca

SEQ ID NO: 2005425 - RNA, 17 nt, Homo sapiens
ucugggaagggacaucu

SEQ ID NO: 2005426 - RNA, 15 nt, Homo sapiens
aucugaauaguguca

SEQ ID NO: 2005427 - RNA, 16 nt, Homo sapiens
auaggagagagaucau

SEQ ID NO: 2005428 - RNA, 21 nt, Homo sapiens
auaccaugagaaaucaugccu

SEQ ID NO: 2005429 - RNA, 14 nt, Homo sapiens
uagacuguuucaca

SEQ ID NO: 2005430 - RNA, 19 nt, Homo sapiens
auagacacuucaccaaaga

SEQ ID NO: 2005431 - RNA, 19 nt, Homo sapiens
cucuuaauucccaauccca

SEQ ID NO: 2005432 - RNA, 20 nt, Homo sapiens
guuuuacauuguugagcuau

SEQ ID NO: 2005433 - RNA, 15 nt, Homo sapiens
cuaagcugugugcag

SEQ ID NO: 2005434 - RNA, 20 nt, Homo sapiens
acacacgugagcaacugugc

SEQ ID NO: 2005435 - RNA, 22 nt, Homo sapiens
auaccauggcacugacaauggg

SEQ ID NO: 2005436 - RNA, 15 nt, Homo sapiens
auccucuuccucuga

SEQ ID NO: 2005437 - RNA, 16 nt, Homo sapiens
ccccaggccuguccac

SEQ ID NO: 2005438 - RNA, 19 nt, Homo sapiens
cuuaauggguacaauguac

SEQ ID NO: 2005439 - RNA, 22 nt, Homo sapiens
auguaacacugaugauagguua

SEQ ID NO: 2005440 - RNA, 23 nt, Homo sapiens
uggcucugucaccgccaugcaac

SEQ ID NO: 2005441 - RNA, 21 nt, Homo sapiens
auguuacaauuaaaaugacaa

SEQ ID NO: 2005442 - RNA, 13 nt, Homo sapiens
aacacaaauccaa

SEQ ID NO: 2005443 - RNA, 17 nt, Homo sapiens
ugugauugugagcuugc

SEQ ID NO: 2005444 - RNA, 17 nt, Homo sapiens
cuaccaucugauguuuc

SEQ ID NO: 2005445 - RNA, 20 nt, Homo sapiens
agccauagugucacuuccac

SEQ ID NO: 2005446 - RNA, 15 nt, Homo sapiens
gaggaaacaggccuc

SEQ ID NO: 2005447 - RNA, 17 nt, Homo sapiens
uguauacaaacaggugc

SEQ ID NO: 2005448 - RNA, 21 nt, Homo sapiens
gcucauaugcauguagucacu

SEQ ID NO: 2005449 - RNA, 21 nt, Homo sapiens
uucuuuaucccauuuuaucau

SEQ ID NO: 2005450 - RNA, 14 nt, Homo sapiens
gcccugagcuuucc

SEQ ID NO: 2005451 - RNA, 23 nt, Homo sapiens
aauuccagugccaggccagugac

SEQ ID NO: 2005452 - RNA, 22 nt, Homo sapiens
ccgauaccgggacacagaauua

SEQ ID NO: 2005453 - RNA, 16 nt, Homo sapiens
caggcuccccagugcu

SEQ ID NO: 2005454 - RNA, 20 nt, Homo sapiens
aacuucagaaagacagugac

SEQ ID NO: 2005455 - RNA, 20 nt, Homo sapiens
uaagaaaagccuaaucacag

SEQ ID NO: 2005456 - RNA, 18 nt, Homo sapiens
uuccggcacacugccaaa

SEQ ID NO: 2005457 - RNA, 22 nt, Homo sapiens
uuuacggugauauugugcaugc

SEQ ID NO: 2005458 - RNA, 19 nt, Homo sapiens
aaaggcauauauguacuag

SEQ ID NO: 2005459 - RNA, 22 nt, Homo sapiens
agcucaguuucuuuuucacuug

SEQ ID NO: 2005460 - RNA, 18 nt, Homo sapiens
auggagaaauaggaccuu

SEQ ID NO: 2005461 - RNA, 14 nt, Homo sapiens
gauccucugggaag

SEQ ID NO: 2005462 - RNA, 23 nt, Homo sapiens
auauugguauuugcaccaacaua

SEQ ID NO: 2005463 - RNA, 13 nt, Homo sapiens
accacucaguuaa

SEQ ID NO: 2005464 - RNA, 22 nt, Homo sapiens
uaacauuuaaauuccacagauu

SEQ ID NO: 2005465 - RNA, 12 nt, Homo sapiens
aacaaacuggag

SEQ ID NO: 2005466 - RNA, 14 nt, Homo sapiens
ucaauggugcuaua

SEQ ID NO: 2005467 - RNA, 15 nt, Homo sapiens
accugaaacaaccca

SEQ ID NO: 2005468 - RNA, 14 nt, Homo sapiens
accgccuccugcuc

SEQ ID NO: 2005469 - RNA, 10 nt, Homo sapiens
ugauccucac

SEQ ID NO: 2005470 - RNA, 15 nt, Homo sapiens
cauaaaaagaagccu

SEQ ID NO: 2005471 - RNA, 21 nt, Homo sapiens
ccaggccucgccugcccuccu

SEQ ID NO: 2005472 - RNA, 23 nt, Homo sapiens
guuauuuugucacccaaccuggc

SEQ ID NO: 2005473 - RNA, 15 nt, Homo sapiens
gaaccacuguguacu

SEQ ID NO: 2005474 - RNA, 18 nt, Homo sapiens
uuccaaccccuuuccacg

SEQ ID NO: 2005475 - RNA, 14 nt, Homo sapiens
cguuugacuagcca

SEQ ID NO: 2005476 - RNA, 17 nt, Homo sapiens
caagaaggaacaauaaa

SEQ ID NO: 2005477 - RNA, 16 nt, Homo sapiens
uuugcucauauuuccc

SEQ ID NO: 2005478 - RNA, 19 nt, Homo sapiens
gguaucaaccaaauggagu

SEQ ID NO: 2005479 - RNA, 22 nt, Homo sapiens
ugucaccaggauuacuagucaa

SEQ ID NO: 2005480 - RNA, 21 nt, Homo sapiens
aacuuauugcauaacagcaga

SEQ ID NO: 2005481 - RNA, 17 nt, Homo sapiens
aagcaauucuccugccu

SEQ ID NO: 2005482 - RNA, 17 nt, Homo sapiens
gcuuauuuaaucuguac

SEQ ID NO: 2005483 - RNA, 15 nt, Homo sapiens
aguccucuguggcca

SEQ ID NO: 2005484 - RNA, 14 nt, Homo sapiens
cagccauucuucag

SEQ ID NO: 2005485 - RNA, 15 nt, Homo sapiens
caaguucuaagauuc

SEQ ID NO: 2005486 - RNA, 19 nt, Homo sapiens
accauagaaagaugacaaa

SEQ ID NO: 2005487 - RNA, 19 nt, Homo sapiens
auucuccuuugcaguuccu

SEQ ID NO: 2005488 - RNA, 21 nt, Homo sapiens
gcaugugaagaaaggguguuu

SEQ ID NO: 2005489 - RNA, 15 nt, Homo sapiens
uggaaccacagucau

SEQ ID NO: 2005490 - RNA, 17 nt, Homo sapiens
uuuucaggaauacauuu

SEQ ID NO: 2005491 - RNA, 22 nt, Homo sapiens
caaaacagauauacucgaauca

SEQ ID NO: 2005492 - RNA, 19 nt, Homo sapiens
gcccaggucagccacuguu

SEQ ID NO: 2005493 - RNA, 18 nt, Homo sapiens
gccaugcuuccuauacag

SEQ ID NO: 2005494 - RNA, 22 nt, Homo sapiens
uagguagucaugcugugcauuu

SEQ ID NO: 2005495 - RNA, 14 nt, Homo sapiens
uucccuaaugaagu

SEQ ID NO: 2005496 - RNA, 15 nt, Homo sapiens
gaguacaccccaaca

SEQ ID NO: 2005497 - RNA, 14 nt, Homo sapiens
gagaugcuggagaa

SEQ ID NO: 2005498 - RNA, 11 nt, Homo sapiens
aggaagcccag

SEQ ID NO: 2005499 - RNA, 18 nt, Homo sapiens
uagcauuuuccuguuuac

SEQ ID NO: 2005500 - RNA, 22 nt, Homo sapiens
gucacccaggcuggagugcggu

SEQ ID NO: 2005501 - RNA, 20 nt, Homo sapiens
ugacauuuauauauugaauu

SEQ ID NO: 2005502 - RNA, 14 nt, Homo sapiens
aaaaucauaacuca

SEQ ID NO: 2005503 - RNA, 20 nt, Homo sapiens
gauugaauuuuuaagcaaau

SEQ ID NO: 2005504 - RNA, 16 nt, Homo sapiens
acauugguauucuggg

SEQ ID NO: 2005505 - RNA, 15 nt, Homo sapiens
ucuguuuugugaccu

SEQ ID NO: 2005506 - RNA, 18 nt, Homo sapiens
uuuuuaaaaauaaaggaa

SEQ ID NO: 2005507 - RNA, 19 nt, Homo sapiens
uggcgcuuagagaggacaa

SEQ ID NO: 2005508 - RNA, 22 nt, Homo sapiens
augccauccagaugugugcaau

SEQ ID NO: 2005509 - RNA, 16 nt, Homo sapiens
acaucagaaacugaau

SEQ ID NO: 2005510 - RNA, 22 nt, Homo sapiens
cagccacccugucaccuagcuc

SEQ ID NO: 2005511 - RNA, 22 nt, Homo sapiens
gcccagcuuauugugugcgcug

SEQ ID NO: 2005512 - RNA, 12 nt, Homo sapiens
ggaaaaugcauu

SEQ ID NO: 2005513 - RNA, 22 nt, Homo sapiens
gugccccacagcuaccugagac

SEQ ID NO: 2005514 - RNA, 16 nt, Homo sapiens
ugcagcuuggagacag

SEQ ID NO: 2005515 - RNA, 15 nt, Homo sapiens
aaauuagauuuggca

SEQ ID NO: 2005516 - RNA, 13 nt, Homo sapiens
auuuaaaacuggg

SEQ ID NO: 2005517 - RNA, 23 nt, Homo sapiens
augccacagaguaugaaggaaga

SEQ ID NO: 2005518 - RNA, 16 nt, Homo sapiens
caggagccagcagggc

SEQ ID NO: 2005519 - RNA, 19 nt, Homo sapiens
uuguuuaaaguauacucuu

SEQ ID NO: 2005520 - RNA, 22 nt, Homo sapiens
gcguacucagcacagcagugga

SEQ ID NO: 2005521 - RNA, 14 nt, Homo sapiens
uuguuaauacugua

SEQ ID NO: 2005522 - RNA, 18 nt, Homo sapiens
uacuuauagaauucaguc

SEQ ID NO: 2005523 - RNA, 14 nt, Homo sapiens
caacacccaguuuc

SEQ ID NO: 2005524 - RNA, 14 nt, Homo sapiens
agccaaacaguaug

SEQ ID NO: 2005525 - RNA, 23 nt, Homo sapiens
aaaaguuuagccccugaaagcca

SEQ ID NO: 2005526 - RNA, 21 nt, Homo sapiens
ccacugaccugguuguccagg

SEQ ID NO: 2005527 - RNA, 17 nt, Homo sapiens
uaagauuuucugggaua

SEQ ID NO: 2005528 - RNA, 22 nt, Homo sapiens
aguguugauucuagaugaucaa

SEQ ID NO: 2005529 - RNA, 22 nt, Homo sapiens
agccgagcggggagccaggaaa

SEQ ID NO: 2005530 - RNA, 22 nt, Homo sapiens
guggcuucacagacccacaaga

SEQ ID NO: 2005531 - RNA, 16 nt, Homo sapiens
cuuguucacacuuugc

SEQ ID NO: 2005532 - RNA, 14 nt, Homo sapiens
ugaugaccaagaau

SEQ ID NO: 2005533 - RNA, 14 nt, Homo sapiens
ggccugugcacugu

SEQ ID NO: 2005534 - RNA, 16 nt, Homo sapiens
aaucuaugauuccagg

SEQ ID NO: 2005535 - RNA, 23 nt, Homo sapiens
cagaaguggaaggauaaugagau

SEQ ID NO: 2005536 - RNA, 17 nt, Homo sapiens
uucuuuucccauugacu

SEQ ID NO: 2005537 - RNA, 20 nt, Homo sapiens
cucuaaaaauaaaaugaugu

SEQ ID NO: 2005538 - RNA, 15 nt, Homo sapiens
aucucugccuuugag

SEQ ID NO: 2005539 - RNA, 16 nt, Homo sapiens
aggaccggccuuugca

SEQ ID NO: 2005540 - RNA, 16 nt, Homo sapiens
gccuggacuuuccugc

SEQ ID NO: 2005541 - RNA, 16 nt, Homo sapiens
aucaguugaggccagg

SEQ ID NO: 2005542 - RNA, 15 nt, Homo sapiens
cuaccuagggacaca

SEQ ID NO: 2005543 - RNA, 18 nt, Homo sapiens
aaggcugggcaccucuag

SEQ ID NO: 2005544 - RNA, 18 nt, Homo sapiens
ucuuccuagugccuacaa

SEQ ID NO: 2005545 - RNA, 12 nt, Homo sapiens
uuucaugugauc

SEQ ID NO: 2005546 - RNA, 11 nt, Homo sapiens
ucucauuauuc

SEQ ID NO: 2005547 - RNA, 15 nt, Homo sapiens
ugaaauuuugcacca

SEQ ID NO: 2005548 - RNA, 13 nt, Homo sapiens
aauaaauuaugcu

SEQ ID NO: 2005549 - RNA, 15 nt, Homo sapiens
ucucacacauuccag

SEQ ID NO: 2005550 - RNA, 15 nt, Homo sapiens
gcaucuacacaauuu

SEQ ID NO: 2005551 - RNA, 18 nt, Homo sapiens
uacagaagauuaagacag

SEQ ID NO: 2005552 - RNA, 24 nt, Homo sapiens
auauagggaagaguucugaucugu

SEQ ID NO: 2005553 - RNA, 23 nt, Homo sapiens
auggucucagccuaggcccucau

SEQ ID NO: 2005554 - RNA, 16 nt, Homo sapiens
ucauuaaggucauuac

SEQ ID NO: 2005555 - RNA, 11 nt, Homo sapiens
aaacccagugc

SEQ ID NO: 2005556 - RNA, 20 nt, Homo sapiens
cucacacucauccacacuua

SEQ ID NO: 2005557 - RNA, 19 nt, Homo sapiens
cccugcgcuucaucucaug

SEQ ID NO: 2005558 - RNA, 13 nt, Homo sapiens
uuuggaguacaaa

SEQ ID NO: 2005559 - RNA, 23 nt, Homo sapiens
uauuugcacaaguacaguaacaa

SEQ ID NO: 2005560 - RNA, 19 nt, Homo sapiens
cuacgugacuguggcacac

SEQ ID NO: 2005561 - RNA, 15 nt, Homo sapiens
ucaaaagccaaaaaa

SEQ ID NO: 2005562 - RNA, 15 nt, Homo sapiens
caaggcgcucaggca

SEQ ID NO: 2005563 - RNA, 22 nt, Homo sapiens
uaaucagaaggagugugcuuua

SEQ ID NO: 2005564 - RNA, 18 nt, Homo sapiens
cgggaccaauacuacuga

SEQ ID NO: 2005565 - RNA, 16 nt, Homo sapiens
agaaaucggugucuga

SEQ ID NO: 2005566 - RNA, 14 nt, Homo sapiens
ugugugcagugaug

SEQ ID NO: 2005567 - RNA, 14 nt, Homo sapiens
uacuguacacggac

SEQ ID NO: 2005568 - RNA, 23 nt, Homo sapiens
cuguuuucaauaacaaagcacau

SEQ ID NO: 2005569 - RNA, 21 nt, Homo sapiens
gaaggaacuuugucacaucua

SEQ ID NO: 2005570 - RNA, 12 nt, Homo sapiens
ccauugcaaaag

SEQ ID NO: 2005571 - RNA, 19 nt, Homo sapiens
caaugcuuaaacuaaauaa

SEQ ID NO: 2005572 - RNA, 20 nt, Homo sapiens
ccagccgugaugcucaggcu

SEQ ID NO: 2005573 - RNA, 23 nt, Homo sapiens
ucugcagauagugccucugcaaa

SEQ ID NO: 2005574 - RNA, 22 nt, Homo sapiens
aauugcccuguugccuugagcu

SEQ ID NO: 2005575 - RNA, 14 nt, Homo sapiens
uaaugauucucaag

SEQ ID NO: 2005576 - RNA, 14 nt, Homo sapiens
acuuuguacaaaga

SEQ ID NO: 2005577 - RNA, 21 nt, Homo sapiens
agcugagaagaagcugaggau

SEQ ID NO: 2005578 - RNA, 19 nt, Homo sapiens
gcuccugagugcccucaga

SEQ ID NO: 2005579 - RNA, 18 nt, Homo sapiens
cuacaacccuacccuggc

SEQ ID NO: 2005580 - RNA, 17 nt, Homo sapiens
caaagugcuggaauuac

SEQ ID NO: 2005581 - RNA, 20 nt, Homo sapiens
auaaauuaaacaugcuguua

SEQ ID NO: 2005582 - RNA, 12 nt, Homo sapiens
uuguuccuccac

SEQ ID NO: 2005583 - RNA, 14 nt, Homo sapiens
aaacacuuacagaa

SEQ ID NO: 2005584 - RNA, 15 nt, Homo sapiens
cugugauccacccaa

SEQ ID NO: 2005585 - RNA, 21 nt, Homo sapiens
uccccuguuucaaucacuguc

SEQ ID NO: 2005586 - RNA, 16 nt, Homo sapiens
uacaguaucucagggc

SEQ ID NO: 2005587 - RNA, 14 nt, Homo sapiens
acaauuuuuauuuc

SEQ ID NO: 2005588 - RNA, 19 nt, Homo sapiens
acacaagcccacagcacag

SEQ ID NO: 2005589 - RNA, 17 nt, Homo sapiens
gcagcgccaggcugacc

SEQ ID NO: 2005590 - RNA, 19 nt, Homo sapiens
aauguguuucaaaaccaug

SEQ ID NO: 2005591 - RNA, 16 nt, Homo sapiens
cacugcuuaugcaguc

SEQ ID NO: 2005592 - RNA, 14 nt, Homo sapiens
cagcugguauggcc

SEQ ID NO: 2005593 - RNA, 12 nt, Homo sapiens
agcagcugagca

SEQ ID NO: 2005594 - RNA, 12 nt, Homo sapiens
ugaggcugugag

SEQ ID NO: 2005595 - RNA, 23 nt, Homo sapiens
cagucucauauuuaguauugaau

SEQ ID NO: 2005596 - RNA, 17 nt, Homo sapiens
uggcaagaccccaccuc

SEQ ID NO: 2005597 - RNA, 15 nt, Homo sapiens
uauauauacauaugu

SEQ ID NO: 2005598 - RNA, 22 nt, Homo sapiens
ggaggcuuuggguggcucacua

SEQ ID NO: 2005599 - RNA, 21 nt, Homo sapiens
agaauuuaaaacgcaugugca

SEQ ID NO: 2005600 - RNA, 19 nt, Homo sapiens
uucuggacccuccacuuca

SEQ ID NO: 2005601 - RNA, 14 nt, Homo sapiens
uauuuccugcuuau

SEQ ID NO: 2005602 - RNA, 18 nt, Homo sapiens
uucauguccuaaagaaga

SEQ ID NO: 2005603 - RNA, 21 nt, Homo sapiens
caccugaguguccuugcucua

SEQ ID NO: 2005604 - RNA, 13 nt, Homo sapiens
cuacucagcagua

SEQ ID NO: 2005605 - RNA, 15 nt, Homo sapiens
agccugaugauggaa

SEQ ID NO: 2005606 - RNA, 18 nt, Homo sapiens
augcaucacaugaugaaa

SEQ ID NO: 2005607 - RNA, 19 nt, Homo sapiens
aacccaaggaacaagagaa

SEQ ID NO: 2005608 - RNA, 23 nt, Homo sapiens
uagaugagguugagcuaugauau

SEQ ID NO: 2005609 - RNA, 11 nt, Homo sapiens
uauuuaucucc

SEQ ID NO: 2005610 - RNA, 22 nt, Homo sapiens
aauucccuguuauaauuugcac

SEQ ID NO: 2005611 - RNA, 21 nt, Homo sapiens
aaggucucauuaucuccauga

SEQ ID NO: 2005612 - RNA, 22 nt, Homo sapiens
gaaauauauaacaacaaugaag

SEQ ID NO: 2005613 - RNA, 12 nt, Homo sapiens
auagagugcagu

SEQ ID NO: 2005614 - RNA, 12 nt, Homo sapiens
cuggagugaaau

SEQ ID NO: 2005615 - RNA, 15 nt, Homo sapiens
gcauuugccacuuag

SEQ ID NO: 2005616 - RNA, 21 nt, Homo sapiens
aacccagcuguccguccucag

SEQ ID NO: 2005617 - RNA, 14 nt, Homo sapiens
cuucauagcaaugu

SEQ ID NO: 2005618 - RNA, 23 nt, Homo sapiens
guaggauauuuucccuaccuaag

SEQ ID NO: 2005619 - RNA, 20 nt, Homo sapiens
ucagccccuuuaaaucacca

SEQ ID NO: 2005620 - RNA, 22 nt, Homo sapiens
cugcacggugggagaccugcug

SEQ ID NO: 2005621 - RNA, 23 nt, Homo sapiens
ggauguuugcucagcuucuccaa

SEQ ID NO: 2005622 - RNA, 19 nt, Homo sapiens
agccucuucugccaagaga

SEQ ID NO: 2005623 - RNA, 22 nt, Homo sapiens
auuauuuugugcaacauaacaa

SEQ ID NO: 2005624 - RNA, 13 nt, Homo sapiens
gacugaggugccu

SEQ ID NO: 2005625 - RNA, 22 nt, Homo sapiens
gggcucccacaggaucagaggc

SEQ ID NO: 2005626 - RNA, 12 nt, Homo sapiens
uuuaaaguugau

SEQ ID NO: 2005627 - RNA, 19 nt, Homo sapiens
uuauuacauguaauuugau

SEQ ID NO: 2005628 - RNA, 16 nt, Homo sapiens
uauagcaagugcuauu

SEQ ID NO: 2005629 - RNA, 22 nt, Homo sapiens
caagaauuucucucuaugucug

SEQ ID NO: 2005630 - RNA, 20 nt, Homo sapiens
caccagcugcugugccccac

SEQ ID NO: 2005631 - RNA, 20 nt, Homo sapiens
gccaggaaguagcacaggcu

SEQ ID NO: 2005632 - RNA, 19 nt, Homo sapiens
acucagagcugcgggcuga

SEQ ID NO: 2005633 - RNA, 18 nt, Homo sapiens
aaagugcuaagguucuaa

SEQ ID NO: 2005634 - RNA, 14 nt, Homo sapiens
auuuacauauagcu

SEQ ID NO: 2005635 - RNA, 15 nt, Homo sapiens
ugcggauacuuugcu

SEQ ID NO: 2005636 - RNA, 12 nt, Homo sapiens
gaccuugcaaug

SEQ ID NO: 2005637 - RNA, 19 nt, Homo sapiens
ggaccuuugcacuuugcca

SEQ ID NO: 2005638 - RNA, 20 nt, Homo sapiens
acgguggcucacgccuguaa

SEQ ID NO: 2005639 - RNA, 14 nt, Homo sapiens
cccacauugcacuu

SEQ ID NO: 2005640 - RNA, 20 nt, Homo sapiens
aacacacacaaaaugcucaa

SEQ ID NO: 2005641 - RNA, 18 nt, Homo sapiens
uucacuccuacccccaga

SEQ ID NO: 2005642 - RNA, 13 nt, Homo sapiens
aaagcuguuccca

SEQ ID NO: 2005643 - RNA, 20 nt, Homo sapiens
gggcuaaaucccaagugucu

SEQ ID NO: 2005644 - RNA, 13 nt, Homo sapiens
acaagagcgagac

SEQ ID NO: 2005645 - RNA, 14 nt, Homo sapiens
gcgcucccgcauuu

SEQ ID NO: 2005646 - RNA, 16 nt, Homo sapiens
caugaaagcagugaag

SEQ ID NO: 2005647 - RNA, 24 nt, Homo sapiens
acaguuuugaaagaaaaauaccau

SEQ ID NO: 2005648 - RNA, 14 nt, Homo sapiens
ccugcccaugucca

SEQ ID NO: 2005649 - RNA, 17 nt, Homo sapiens
aggccgauggcccgggc

SEQ ID NO: 2005650 - RNA, 18 nt, Homo sapiens
cuucugggaacuuccuca

SEQ ID NO: 2005651 - RNA, 21 nt, Homo sapiens
aagauuaugugacuugcaaua

SEQ ID NO: 2005652 - RNA, 23 nt, Homo sapiens
cuccuggaggcccuggucagcuu

SEQ ID NO: 2005653 - RNA, 13 nt, Homo sapiens
ucucauguaaaau

SEQ ID NO: 2005654 - RNA, 12 nt, Homo sapiens
ucagauucauga

SEQ ID NO: 2005655 - RNA, 17 nt, Homo sapiens
caaacaaguaugaaucu

SEQ ID NO: 2005656 - RNA, 13 nt, Homo sapiens
cuagaacauucca

SEQ ID NO: 2005657 - RNA, 19 nt, Homo sapiens
uuuuaucuuugcuuuagaa

SEQ ID NO: 2005658 - RNA, 17 nt, Homo sapiens
uguagacacuuacuuga

SEQ ID NO: 2005659 - RNA, 13 nt, Homo sapiens
aagcuggagagac

SEQ ID NO: 2005660 - RNA, 19 nt, Homo sapiens
uccauuucuucugcacauc

SEQ ID NO: 2005661 - RNA, 18 nt, Homo sapiens
uuacaaguuuauauauau

SEQ ID NO: 2005662 - RNA, 24 nt, Homo sapiens
uuacaaagggccaucguucaucca

SEQ ID NO: 2005663 - RNA, 22 nt, Homo sapiens
caccaacaacagucagccagcu

SEQ ID NO: 2005664 - RNA, 17 nt, Homo sapiens
gucuugaacuccugacg

SEQ ID NO: 2005665 - RNA, 23 nt, Homo sapiens
ucuuuccaaaaggaacucuagaa

SEQ ID NO: 2005666 - RNA, 13 nt, Homo sapiens
ccauucuacuugc

SEQ ID NO: 2005667 - RNA, 23 nt, Homo sapiens
ccccugggcaagagaugggacaa

SEQ ID NO: 2005668 - RNA, 15 nt, Homo sapiens
cucaucaacaaucac

SEQ ID NO: 2005669 - RNA, 17 nt, Homo sapiens
cuuuugaauuacagaga

SEQ ID NO: 2005670 - RNA, 17 nt, Homo sapiens
ugugcaaccauguuugg

SEQ ID NO: 2005671 - RNA, 16 nt, Homo sapiens
gccuccucacaacaug

SEQ ID NO: 2005672 - RNA, 12 nt, Homo sapiens
guagcuagccug

SEQ ID NO: 2005673 - RNA, 16 nt, Homo sapiens
uccucuugaaccagaa

SEQ ID NO: 2005674 - RNA, 16 nt, Homo sapiens
gaaaacaugcugcucu

SEQ ID NO: 2005675 - RNA, 17 nt, Homo sapiens
auucgcagugcccagug

SEQ ID NO: 2005676 - RNA, 22 nt, Homo sapiens
augauaguuuucuagaugacau

SEQ ID NO: 2005677 - RNA, 15 nt, Homo sapiens
guuaugcaagcacaa

SEQ ID NO: 2005678 - RNA, 22 nt, Homo sapiens
ugguuagccuuaguuucucaga

SEQ ID NO: 2005679 - RNA, 20 nt, Homo sapiens
gcacuaauguguuaugagaa

SEQ ID NO: 2005680 - RNA, 18 nt, Homo sapiens
ccgcugcaaugccuagac

SEQ ID NO: 2005681 - RNA, 13 nt, Homo sapiens
acccuccucuugg

SEQ ID NO: 2005682 - RNA, 19 nt, Homo sapiens
uuccuaccuggcuggagac

SEQ ID NO: 2005683 - RNA, 21 nt, Homo sapiens
auauauguaaauuauaaguaa

SEQ ID NO: 2005684 - RNA, 22 nt, Homo sapiens
guaagaauuuuaauauugccau

SEQ ID NO: 2005685 - RNA, 22 nt, Homo sapiens
augcuguacuaaaauaugcagg

SEQ ID NO: 2005686 - RNA, 22 nt, Homo sapiens
ccagcuuuuagaaaaugcaguc

SEQ ID NO: 2005687 - RNA, 22 nt, Homo sapiens
cacaugagacaauuuugcuuca

SEQ ID NO: 2005688 - RNA, 23 nt, Homo sapiens
acacuucauuguaaaucacuugu

SEQ ID NO: 2005689 - RNA, 20 nt, Homo sapiens
cggagcaggggucugagcca

SEQ ID NO: 2005690 - RNA, 16 nt, Homo sapiens
aaguaccacacugagu

SEQ ID NO: 2005691 - RNA, 18 nt, Homo sapiens
ugccagugagcucgccau

SEQ ID NO: 2005692 - RNA, 18 nt, Homo sapiens
caagucaugugcauuucc

SEQ ID NO: 2005693 - RNA, 19 nt, Homo sapiens
caggggcuuaucucuucaa

SEQ ID NO: 2005694 - RNA, 22 nt, Homo sapiens
cuuuuguagaaugaaccacugc

SEQ ID NO: 2005695 - RNA, 20 nt, Homo sapiens
ugcugggaauuacaggcgug

SEQ ID NO: 2005696 - RNA, 19 nt, Homo sapiens
agcaggugucccugagaac

SEQ ID NO: 2005697 - RNA, 23 nt, Homo sapiens
uuggcauaacauaaaucugugaa

SEQ ID NO: 2005698 - RNA, 21 nt, Homo sapiens
gagacugggccuaggccagga

SEQ ID NO: 2005699 - RNA, 13 nt, Homo sapiens
aaaaacugaugaa

SEQ ID NO: 2005700 - RNA, 15 nt, Homo sapiens
uguugagauccagug

SEQ ID NO: 2005701 - RNA, 15 nt, Homo sapiens
ucuuaaaaugcaaua

SEQ ID NO: 2005702 - RNA, 18 nt, Homo sapiens
agccaggugagcucugac

SEQ ID NO: 2005703 - RNA, 13 nt, Homo sapiens
uaaacacugugua

SEQ ID NO: 2005704 - RNA, 21 nt, Homo sapiens
accaagaaaccacugggcaua

SEQ ID NO: 2005705 - RNA, 14 nt, Homo sapiens
ggcagcacugggaa

SEQ ID NO: 2005706 - RNA, 22 nt, Homo sapiens
gugguuguagaaggagccuugu

SEQ ID NO: 2005707 - RNA, 13 nt, Homo sapiens
caagaacauucaa

SEQ ID NO: 2005708 - RNA, 12 nt, Homo sapiens
ucccuaccucag

SEQ ID NO: 2005709 - RNA, 12 nt, Homo sapiens
acccuaccacag

SEQ ID NO: 2005710 - RNA, 21 nt, Homo sapiens
agaauguuauccaacuauuaa

SEQ ID NO: 2005711 - RNA, 20 nt, Homo sapiens
aaaggaaccaaccaacaaac

SEQ ID NO: 2005712 - RNA, 17 nt, Homo sapiens
gaaccauucccuaguca

SEQ ID NO: 2005713 - RNA, 22 nt, Homo sapiens
uugcaucccugaaacaucucaa

SEQ ID NO: 2005714 - RNA, 15 nt, Homo sapiens
gccugaagucacaca

SEQ ID NO: 2005715 - RNA, 19 nt, Homo sapiens
cagauaccuccaacccugc

SEQ ID NO: 2005716 - RNA, 23 nt, Homo sapiens
acucuggcuccuucuccauaaag

SEQ ID NO: 2005717 - RNA, 15 nt, Homo sapiens
uuuagugcacuuaau

SEQ ID NO: 2005718 - RNA, 12 nt, Homo sapiens
cugcaagacaga

SEQ ID NO: 2005719 - RNA, 14 nt, Homo sapiens
auuuuauuuaaucc

SEQ ID NO: 2005720 - RNA, 15 nt, Homo sapiens
ggaaaggcagaugua

SEQ ID NO: 2005721 - RNA, 19 nt, Homo sapiens
ugcuguaauaaauguauua

SEQ ID NO: 2005722 - RNA, 21 nt, Homo sapiens
cgagccagcucugggggcucc

SEQ ID NO: 2005723 - RNA, 17 nt, Homo sapiens
uuuggguuuugggucuu

SEQ ID NO: 2005724 - RNA, 18 nt, Homo sapiens
ggucuauugucuguauuu

SEQ ID NO: 2005725 - RNA, 18 nt, Homo sapiens
guacuacggagaaacuca

SEQ ID NO: 2005726 - RNA, 23 nt, Homo sapiens
uaucaugaagcacaucaauuaca

SEQ ID NO: 2005727 - RNA, 14 nt, Homo sapiens
aagagcauaauggu

SEQ ID NO: 2005728 - RNA, 13 nt, Homo sapiens
cccagcacauggc

SEQ ID NO: 2005729 - RNA, 13 nt, Homo sapiens
uggcaucaccugc

SEQ ID NO: 2005730 - RNA, 15 nt, Homo sapiens
gugcccucaccacca

SEQ ID NO: 2005731 - RNA, 21 nt, Homo sapiens
aauucaggccgcaagcagcug

SEQ ID NO: 2005732 - RNA, 12 nt, Homo sapiens
agccaguggcac

SEQ ID NO: 2005733 - RNA, 16 nt, Homo sapiens
gcugacgcgacuauca

SEQ ID NO: 2005734 - RNA, 17 nt, Homo sapiens
ggacuuuugaaaagcuu

SEQ ID NO: 2005735 - RNA, 15 nt, Homo sapiens
gggugcuacugggga

SEQ ID NO: 2005736 - RNA, 22 nt, Homo sapiens
aaaaugcccugucccuagcuca

SEQ ID NO: 2005737 - RNA, 16 nt, Homo sapiens
gcuauauauacuggaa

SEQ ID NO: 2005738 - RNA, 12 nt, Homo sapiens
ucaaugaagauu

SEQ ID NO: 2005739 - RNA, 12 nt, Homo sapiens
caggcaggagca

SEQ ID NO: 2005740 - RNA, 21 nt, Homo sapiens
cagauguucacccaaccacau

SEQ ID NO: 2005741 - RNA, 22 nt, Homo sapiens
guagaguuugaaggaggugagg

SEQ ID NO: 2005742 - RNA, 11 nt, Homo sapiens
augagcacaga

SEQ ID NO: 2005743 - RNA, 15 nt, Homo sapiens
accuguucucuuuaa

SEQ ID NO: 2005744 - RNA, 15 nt, Homo sapiens
uucuuuacauuugau

SEQ ID NO: 2005745 - RNA, 22 nt, Homo sapiens
uucagcuugagcugaaaagcuu

SEQ ID NO: 2005746 - RNA, 15 nt, Homo sapiens
uggccuccuaugccu

SEQ ID NO: 2005747 - RNA, 21 nt, Homo sapiens
gggcucaaacuucuaaggggu

SEQ ID NO: 2005748 - RNA, 13 nt, Homo sapiens
cuaacuucuaaaa

SEQ ID NO: 2005749 - RNA, 22 nt, Homo sapiens
aguuccgacugccaucuuggac

SEQ ID NO: 2005750 - RNA, 18 nt, Homo sapiens
aguuggcuucuaagccaa

SEQ ID NO: 2005751 - RNA, 18 nt, Homo sapiens
uauuuauguuugcacuug

SEQ ID NO: 2005752 - RNA, 18 nt, Homo sapiens
ucucugcaguuuuuccca

SEQ ID NO: 2005753 - RNA, 13 nt, Homo sapiens
uaaaggcaucuac

SEQ ID NO: 2005754 - RNA, 18 nt, Homo sapiens
aucccucggucagcaccg

SEQ ID NO: 2005755 - RNA, 22 nt, Homo sapiens
cauaacaaugucucaugaugua

SEQ ID NO: 2005756 - RNA, 19 nt, Homo sapiens
ggcuguuauaaaagcaaua

SEQ ID NO: 2005757 - RNA, 16 nt, Homo sapiens
uuuucuucagcauuua

SEQ ID NO: 2005758 - RNA, 16 nt, Homo sapiens
uggaauguacucuguu

SEQ ID NO: 2005759 - RNA, 19 nt, Homo sapiens
cuuuuucagaaacagugag

SEQ ID NO: 2005760 - RNA, 13 nt, Homo sapiens
cuuuaacaaaaca

SEQ ID NO: 2005761 - RNA, 22 nt, Homo sapiens
aucagccagcuaccccuugugg

SEQ ID NO: 2005762 - RNA, 14 nt, Homo sapiens
ucaguacuuuauga

SEQ ID NO: 2005763 - RNA, 18 nt, Homo sapiens
ugccaccaugccuaauuu

SEQ ID NO: 2005764 - RNA, 15 nt, Homo sapiens
uuuuuauguugccag

SEQ ID NO: 2005765 - RNA, 18 nt, Homo sapiens
aaucuucagggcacugcu

SEQ ID NO: 2005766 - RNA, 14 nt, Homo sapiens
uaauaaguacugug

SEQ ID NO: 2005767 - RNA, 17 nt, Homo sapiens
uggggcacagaugccug

SEQ ID NO: 2005768 - RNA, 17 nt, Homo sapiens
aaugucuugagcucuau

SEQ ID NO: 2005769 - RNA, 21 nt, Homo sapiens
aaugguuuugaauagaucuuu

SEQ ID NO: 2005770 - RNA, 17 nt, Homo sapiens
cagugcauuauguacac

SEQ ID NO: 2005771 - RNA, 21 nt, Homo sapiens
caaauggcaccgagacaauga

SEQ ID NO: 2005772 - RNA, 12 nt, Homo sapiens
aaaaaugccaag

SEQ ID NO: 2005773 - RNA, 15 nt, Homo sapiens
ccagugccauuucag

SEQ ID NO: 2005774 - RNA, 17 nt, Homo sapiens
uugcugugggugcagcu

SEQ ID NO: 2005775 - RNA, 15 nt, Homo sapiens
cuugacuugccauga

SEQ ID NO: 2005776 - RNA, 19 nt, Homo sapiens
uuucauccugauacuguag

SEQ ID NO: 2005777 - RNA, 23 nt, Homo sapiens
cuugucccacucaagccaagcag

SEQ ID NO: 2005778 - RNA, 12 nt, Homo sapiens
aacucaguguga

SEQ ID NO: 2005779 - RNA, 21 nt, Homo sapiens
cagccaggagagcuuaggguc

SEQ ID NO: 2005780 - RNA, 14 nt, Homo sapiens
ucccagcucacugc

SEQ ID NO: 2005781 - RNA, 22 nt, Homo sapiens
ucugagcccaagcuaagccauc

SEQ ID NO: 2005782 - RNA, 21 nt, Homo sapiens
cagcuccuuucccuuuuccau

SEQ ID NO: 2005783 - RNA, 20 nt, Homo sapiens
caguaacuuacccuuaggga

SEQ ID NO: 2005784 - RNA, 23 nt, Homo sapiens
acauauugcaggauucuguaaua

SEQ ID NO: 2005785 - RNA, 13 nt, Homo sapiens
uuuacuucuuuag

SEQ ID NO: 2005786 - RNA, 16 nt, Homo sapiens
uuccuauaugcacuua

SEQ ID NO: 2005787 - RNA, 17 nt, Homo sapiens
caacagcccugucucaa

SEQ ID NO: 2005788 - RNA, 22 nt, Homo sapiens
cuauuaagauacuuagauuaga

SEQ ID NO: 2005789 - RNA, 23 nt, Homo sapiens
gccuccuggguucacaccauucu

SEQ ID NO: 2005790 - RNA, 22 nt, Homo sapiens
aggcuccucaugaggccaugca

SEQ ID NO: 2005791 - RNA, 15 nt, Homo sapiens
cauuuccucuguucu

SEQ ID NO: 2005792 - RNA, 15 nt, Homo sapiens
aucaauaaaggggaa

SEQ ID NO: 2005793 - RNA, 19 nt, Homo sapiens
augcaagacuucacugcag

SEQ ID NO: 2005794 - RNA, 18 nt, Homo sapiens
ucuuaguugacaaccuag

SEQ ID NO: 2005795 - RNA, 20 nt, Homo sapiens
cagagcgagacucugucuca

SEQ ID NO: 2005796 - RNA, 23 nt, Homo sapiens
gcagcccgaagcccaguuucccu

SEQ ID NO: 2005797 - RNA, 23 nt, Homo sapiens
uuacucuaagaucuuagauucuc

SEQ ID NO: 2005798 - RNA, 14 nt, Homo sapiens
guaaucucugugaa

SEQ ID NO: 2005799 - RNA, 12 nt, Homo sapiens
caguucaagcua

SEQ ID NO: 2005800 - RNA, 14 nt, Homo sapiens
ccuugagaucuuag

SEQ ID NO: 2005801 - RNA, 14 nt, Homo sapiens
gaccauuuggucag

SEQ ID NO: 2005802 - RNA, 21 nt, Homo sapiens
uuuaccaagagagcacaugau

SEQ ID NO: 2005803 - RNA, 18 nt, Homo sapiens
gagucuauguucaaagac

SEQ ID NO: 2005804 - RNA, 13 nt, Homo sapiens
auauugugaaaag

SEQ ID NO: 2005805 - RNA, 22 nt, Homo sapiens
uagaggguagcuguggcuucua

SEQ ID NO: 2005806 - RNA, 15 nt, Homo sapiens
aaauucaaauuauuc

SEQ ID NO: 2005807 - RNA, 18 nt, Homo sapiens
uauaacauucaauuugcu

SEQ ID NO: 2005808 - RNA, 14 nt, Homo sapiens
ccagugacuugcaa

SEQ ID NO: 2005809 - RNA, 14 nt, Homo sapiens
cauaugccuacaaa

SEQ ID NO: 2005810 - RNA, 21 nt, Homo sapiens
uuuugggggucagcauccagu

SEQ ID NO: 2005811 - RNA, 14 nt, Homo sapiens
auuguagcuaugau

SEQ ID NO: 2005812 - RNA, 19 nt, Homo sapiens
gaaaaaggaaaaauauuga

SEQ ID NO: 2005813 - RNA, 16 nt, Homo sapiens
ucauuauuuuuuacaa

SEQ ID NO: 2005814 - RNA, 15 nt, Homo sapiens
agcaaaggcugagaa

SEQ ID NO: 2005815 - RNA, 15 nt, Homo sapiens
gagugccaucccuga

SEQ ID NO: 2005816 - RNA, 21 nt, Homo sapiens
aaaguuucaccuguauugaau

SEQ ID NO: 2005817 - RNA, 16 nt, Homo sapiens
aacacuuggcauacaa

SEQ ID NO: 2005818 - RNA, 18 nt, Homo sapiens
ccagauaaaaacaauaua

SEQ ID NO: 2005819 - RNA, 20 nt, Homo sapiens
augugacuaaaaaugcaucu

SEQ ID NO: 2005820 - RNA, 14 nt, Homo sapiens
uaugcccacucuaa

SEQ ID NO: 2005821 - RNA, 16 nt, Homo sapiens
ugagggacaaugccaa

SEQ ID NO: 2005822 - RNA, 14 nt, Homo sapiens
aaaauaaaguacgu

SEQ ID NO: 2005823 - RNA, 17 nt, Homo sapiens
ugugagaccaggggacc

SEQ ID NO: 2005824 - RNA, 19 nt, Homo sapiens
ucuuauugaaaacaacauu

SEQ ID NO: 2005825 - RNA, 16 nt, Homo sapiens
agcacucgagaccauc

SEQ ID NO: 2005826 - RNA, 16 nt, Homo sapiens
uacuauauaugacugg

SEQ ID NO: 2005827 - RNA, 19 nt, Homo sapiens
agcuuauguuaacugacaa

SEQ ID NO: 2005828 - RNA, 15 nt, Homo sapiens
aagaaaaaauaucuu

SEQ ID NO: 2005829 - RNA, 22 nt, Homo sapiens
cuggaaugggcacagcacagcc

SEQ ID NO: 2005830 - RNA, 11 nt, Homo sapiens
gacauauuuga

SEQ ID NO: 2005831 - RNA, 16 nt, Homo sapiens
ugucacguggcuucau

SEQ ID NO: 2005832 - RNA, 14 nt, Homo sapiens
cacuuccccaaaga

SEQ ID NO: 2005833 - RNA, 13 nt, Homo sapiens
caaagaauuccaa

SEQ ID NO: 2005834 - RNA, 17 nt, Homo sapiens
cacauccauauacauau

SEQ ID NO: 2005835 - RNA, 17 nt, Homo sapiens
auggcacuaacacuggg

SEQ ID NO: 2005836 - RNA, 18 nt, Homo sapiens
gcagugugucacacugag

SEQ ID NO: 2005837 - RNA, 16 nt, Homo sapiens
aaaccuacacagcugu

SEQ ID NO: 2005838 - RNA, 15 nt, Homo sapiens
uuauugcacuaugaa

SEQ ID NO: 2005839 - RNA, 20 nt, Homo sapiens
aauuaaagucuacacugccu

SEQ ID NO: 2005840 - RNA, 19 nt, Homo sapiens
agacucccaccccagggau

SEQ ID NO: 2005841 - RNA, 17 nt, Homo sapiens
gcauuaaaugcaaaaau

SEQ ID NO: 2005842 - RNA, 12 nt, Homo sapiens
ccagagugcagu

SEQ ID NO: 2005843 - RNA, 16 nt, Homo sapiens
ugguaggugugacaug

SEQ ID NO: 2005844 - RNA, 13 nt, Homo sapiens
cacaucacccaug

SEQ ID NO: 2005845 - RNA, 14 nt, Homo sapiens
cacggugcugagac

SEQ ID NO: 2005846 - RNA, 20 nt, Homo sapiens
aacacccaugaaucaaagac

SEQ ID NO: 2005847 - RNA, 16 nt, Homo sapiens
gacgacuguuuuccca

SEQ ID NO: 2005848 - RNA, 11 nt, Homo sapiens
aauacauauuu

SEQ ID NO: 2005849 - RNA, 21 nt, Homo sapiens
aacacagguguuggaagccag

SEQ ID NO: 2005850 - RNA, 14 nt, Homo sapiens
cauuuugcucugug

SEQ ID NO: 2005851 - RNA, 20 nt, Homo sapiens
auuuugcccaggcaacagua

SEQ ID NO: 2005852 - RNA, 17 nt, Homo sapiens
acucuugaaguacuuaa

SEQ ID NO: 2005853 - RNA, 16 nt, Homo sapiens
auucgauccccuguca

SEQ ID NO: 2005854 - RNA, 19 nt, Homo sapiens
cauaaaguaugccuuccug

SEQ ID NO: 2005855 - RNA, 14 nt, Homo sapiens
uauuccaccuuaaa

SEQ ID NO: 2005856 - RNA, 15 nt, Homo sapiens
uaaaucuccaaaaac

SEQ ID NO: 2005857 - RNA, 11 nt, Homo sapiens
uagcaauguuu

SEQ ID NO: 2005858 - RNA, 14 nt, Homo sapiens
ggagggcagguagc

SEQ ID NO: 2005859 - RNA, 14 nt, Homo sapiens
cauggccacaaagg

SEQ ID NO: 2005860 - RNA, 16 nt, Homo sapiens
auuucguguacugcaa

SEQ ID NO: 2005861 - RNA, 22 nt, Homo sapiens
caucuauuuugaugcagcauuu

SEQ ID NO: 2005862 - RNA, 16 nt, Homo sapiens
auuuucuuuuuuuaac

SEQ ID NO: 2005863 - RNA, 20 nt, Homo sapiens
agauauuucccaauacauac

SEQ ID NO: 2005864 - RNA, 22 nt, Homo sapiens
agcuuucuuauucagugaaaaa

SEQ ID NO: 2005865 - RNA, 13 nt, Homo sapiens
aggauuucagcca

SEQ ID NO: 2005866 - RNA, 21 nt, Homo sapiens
guacuuuucuguucaucacca

SEQ ID NO: 2005867 - RNA, 17 nt, Homo sapiens
cuggccugauugcagag

SEQ ID NO: 2005868 - RNA, 17 nt, Homo sapiens
ccauacauuauuucuuc

SEQ ID NO: 2005869 - RNA, 21 nt, Homo sapiens
guccacccaggcugcacugca

SEQ ID NO: 2005870 - RNA, 14 nt, Homo sapiens
gcucuggccacaac

SEQ ID NO: 2005871 - RNA, 16 nt, Homo sapiens
gcaggggguucuggga

SEQ ID NO: 2005872 - RNA, 17 nt, Homo sapiens
uuaugaucaauuguuaa

SEQ ID NO: 2005873 - RNA, 17 nt, Homo sapiens
auguaccauguugccca

SEQ ID NO: 2005874 - RNA, 18 nt, Homo sapiens
gcagcccuguguguguca

SEQ ID NO: 2005875 - RNA, 16 nt, Homo sapiens
uagccacuugucagag

SEQ ID NO: 2005876 - RNA, 14 nt, Homo sapiens
auuucagacauuuu

SEQ ID NO: 2005877 - RNA, 10 nt, Homo sapiens
aagagcauuu

SEQ ID NO: 2005878 - RNA, 22 nt, Homo sapiens
cccucugauuuccuucugcuau

SEQ ID NO: 2005879 - RNA, 23 nt, Homo sapiens
uuccgcaguguggccaggcugcc

SEQ ID NO: 2005880 - RNA, 18 nt, Homo sapiens
uuuggcucgggacuucaa

SEQ ID NO: 2005881 - RNA, 20 nt, Homo sapiens
auuugaaaacauaaucugca

SEQ ID NO: 2005882 - RNA, 16 nt, Homo sapiens
gcuccacgaagccuua

SEQ ID NO: 2005883 - RNA, 17 nt, Homo sapiens
guauuuuagacuuccug

SEQ ID NO: 2005884 - RNA, 16 nt, Homo sapiens
aaugaucagcuauaua

SEQ ID NO: 2005885 - RNA, 21 nt, Homo sapiens
ggugccaggcuguaagcauuc

SEQ ID NO: 2005886 - RNA, 22 nt, Homo sapiens
uaccaccaagaggaaaauauug

SEQ ID NO: 2005887 - RNA, 22 nt, Homo sapiens
aggcauaucaagguuccugauu

SEQ ID NO: 2005888 - RNA, 16 nt, Homo sapiens
ucauuucuugagguac

SEQ ID NO: 2005889 - RNA, 22 nt, Homo sapiens
auuuuuugguuaagcuuugaca

SEQ ID NO: 2005890 - RNA, 14 nt, Homo sapiens
aguucaagaccagc

SEQ ID NO: 2005891 - RNA, 16 nt, Homo sapiens
uaaaacacauuaugua

SEQ ID NO: 2005892 - RNA, 19 nt, Homo sapiens
cuacacucacaaucaucuu

SEQ ID NO: 2005893 - RNA, 12 nt, Homo sapiens
aauaaacaguca

SEQ ID NO: 2005894 - RNA, 21 nt, Homo sapiens
gccagacacagauacaugggg

SEQ ID NO: 2005895 - RNA, 18 nt, Homo sapiens
aggcgcugagacugugcu

SEQ ID NO: 2005896 - RNA, 20 nt, Homo sapiens
guaauacuuuacaaaccauu

SEQ ID NO: 2005897 - RNA, 21 nt, Homo sapiens
cauuuauaaaauaaugaacug

SEQ ID NO: 2005898 - RNA, 15 nt, Homo sapiens
ugacugggccacagc

SEQ ID NO: 2005899 - RNA, 16 nt, Homo sapiens
aucuuguuccaugccu

SEQ ID NO: 2005900 - RNA, 15 nt, Homo sapiens
uguacagacaacaaa

SEQ ID NO: 2005901 - RNA, 16 nt, Homo sapiens
caguguuuccagugac

SEQ ID NO: 2005902 - RNA, 21 nt, Homo sapiens
uuuuuaaacaaaaaaagcauu

SEQ ID NO: 2005903 - RNA, 19 nt, Homo sapiens
uccuggcccugaaggugcc

SEQ ID NO: 2005904 - RNA, 21 nt, Homo sapiens
aaaauaccaaggaacaggaaa

SEQ ID NO: 2005905 - RNA, 16 nt, Homo sapiens
uccauucagaugaaua

SEQ ID NO: 2005906 - RNA, 13 nt, Homo sapiens
uuauuucugcucu

SEQ ID NO: 2005907 - RNA, 18 nt, Homo sapiens
ucugcucuugaucugugu

SEQ ID NO: 2005908 - RNA, 16 nt, Homo sapiens
ugucccccaugcucug

SEQ ID NO: 2005909 - RNA, 15 nt, Homo sapiens
aacccucuaaaccau

SEQ ID NO: 2005910 - RNA, 16 nt, Homo sapiens
uuucacugugcaaaua

SEQ ID NO: 2005911 - RNA, 13 nt, Homo sapiens
uuugauacaaaau

SEQ ID NO: 2005912 - RNA, 23 nt, Homo sapiens
auuucauauuauuuuagugugua

SEQ ID NO: 2005913 - RNA, 17 nt, Homo sapiens
uugugacccagcacugc

SEQ ID NO: 2005914 - RNA, 15 nt, Homo sapiens
ggccacacacugagu

SEQ ID NO: 2005915 - RNA, 19 nt, Homo sapiens
agguagcccagcacuguga

SEQ ID NO: 2005916 - RNA, 13 nt, Homo sapiens
uuuccuucuugcc

SEQ ID NO: 2005917 - RNA, 19 nt, Homo sapiens
agacugguuuucugccaau

SEQ ID NO: 2005918 - RNA, 13 nt, Homo sapiens
agugagaacagca

SEQ ID NO: 2005919 - RNA, 12 nt, Homo sapiens
aagggacugagu

SEQ ID NO: 2005920 - RNA, 18 nt, Homo sapiens
auggaucuuaaagcauuc

SEQ ID NO: 2005921 - RNA, 21 nt, Homo sapiens
uaauuauaaaaaauuaacuua

SEQ ID NO: 2005922 - RNA, 21 nt, Homo sapiens
ucaaauguuuuaaaguuuaau

SEQ ID NO: 2005923 - RNA, 16 nt, Homo sapiens
gaccaggucuuguuca

SEQ ID NO: 2005924 - RNA, 12 nt, Homo sapiens
aaacucaucuga

SEQ ID NO: 2005925 - RNA, 15 nt, Homo sapiens
auggacauguaaaaa

SEQ ID NO: 2005926 - RNA, 19 nt, Homo sapiens
guaaugggauaugggguua

SEQ ID NO: 2005927 - RNA, 14 nt, Homo sapiens
gugacaucauucag

SEQ ID NO: 2005928 - RNA, 17 nt, Homo sapiens
aaggucuuggugccucu

SEQ ID NO: 2005929 - RNA, 17 nt, Homo sapiens
caaugcgcaaaaugcag

SEQ ID NO: 2005930 - RNA, 20 nt, Homo sapiens
auuuccagguagauuucuca

SEQ ID NO: 2005931 - RNA, 22 nt, Homo sapiens
cggggaggaaagcaaaauccaa

SEQ ID NO: 2005932 - RNA, 21 nt, Homo sapiens
uaugugagauuuccuuaucac

SEQ ID NO: 2005933 - RNA, 22 nt, Homo sapiens
cuguuucuucaaugguucucuu

SEQ ID NO: 2005934 - RNA, 22 nt, Homo sapiens
acuuuguacccaucaugugcuc

SEQ ID NO: 2005935 - RNA, 15 nt, Homo sapiens
ccaaaaucucuuaaa

SEQ ID NO: 2005936 - RNA, 23 nt, Homo sapiens
ggcuggugcuguggccaggguga

SEQ ID NO: 2005937 - RNA, 19 nt, Homo sapiens
uuauaugagggcagauuca

SEQ ID NO: 2005938 - RNA, 18 nt, Homo sapiens
ugggacauauuuuccuga

SEQ ID NO: 2005939 - RNA, 15 nt, Homo sapiens
aggcugacauucacu

SEQ ID NO: 2005940 - RNA, 18 nt, Homo sapiens
uuaagagaagaugugauu

SEQ ID NO: 2005941 - RNA, 22 nt, Homo sapiens
ucacacauauucuuaaugacau

SEQ ID NO: 2005942 - RNA, 20 nt, Homo sapiens
uauuacaugguuaacaucaa

SEQ ID NO: 2005943 - RNA, 16 nt, Homo sapiens
uggguuaagagcucac

SEQ ID NO: 2005944 - RNA, 16 nt, Homo sapiens
aggcaccagcaaaaca

SEQ ID NO: 2005945 - RNA, 23 nt, Homo sapiens
ucuaucaccaaggagccaaacau

SEQ ID NO: 2005946 - RNA, 22 nt, Homo sapiens
ccucauucuacuaaugugaugc

SEQ ID NO: 2005947 - RNA, 22 nt, Homo sapiens
aagcugcuccaggccugcagca

SEQ ID NO: 2005948 - RNA, 15 nt, Homo sapiens
ugccaugcccagaga

SEQ ID NO: 2005949 - RNA, 20 nt, Homo sapiens
uggguaagacuaaaucugua

SEQ ID NO: 2005950 - RNA, 19 nt, Homo sapiens
aaauagcauacaccaaaca

SEQ ID NO: 2005951 - RNA, 15 nt, Homo sapiens
gauguuuaggauaag

SEQ ID NO: 2005952 - RNA, 11 nt, Homo sapiens
gagcagggauu

SEQ ID NO: 2005953 - RNA, 18 nt, Homo sapiens
gaaauaaaacaacucuga

SEQ ID NO: 2005954 - RNA, 21 nt, Homo sapiens
caaacauaauaccaccauuua

SEQ ID NO: 2005955 - RNA, 20 nt, Homo sapiens
agaaaaugugucugcaacau

SEQ ID NO: 2005956 - RNA, 19 nt, Homo sapiens
guuaagacaaacugcauau

SEQ ID NO: 2005957 - RNA, 22 nt, Homo sapiens
uccuuugacuuauuguccccac

SEQ ID NO: 2005958 - RNA, 19 nt, Homo sapiens
cccagccuggccaccagcu

SEQ ID NO: 2005959 - RNA, 22 nt, Homo sapiens
cuugccaaaacagauauacucg

SEQ ID NO: 2005960 - RNA, 22 nt, Homo sapiens
acacuauuuaaguaaauacagu

SEQ ID NO: 2005961 - RNA, 14 nt, Homo sapiens
ucaugugaugucau

SEQ ID NO: 2005962 - RNA, 22 nt, Homo sapiens
aguucaccaugagggaagaaua

SEQ ID NO: 2005963 - RNA, 15 nt, Homo sapiens
uauguguaauaucau

SEQ ID NO: 2005964 - RNA, 14 nt, Homo sapiens
agcaguuagcucau

SEQ ID NO: 2005965 - RNA, 17 nt, Homo sapiens
ucaugccagugccuuau

SEQ ID NO: 2005966 - RNA, 19 nt, Homo sapiens
cagagcugaggcuuuggua

SEQ ID NO: 2005967 - RNA, 18 nt, Homo sapiens
uuggcaugaaggugucau

SEQ ID NO: 2005968 - RNA, 17 nt, Homo sapiens
gcuauggcccagaaaca

SEQ ID NO: 2005969 - RNA, 11 nt, Homo sapiens
aggugugaugg

SEQ ID NO: 2005970 - RNA, 11 nt, Homo sapiens
uuuugugaauu

SEQ ID NO: 2005971 - RNA, 22 nt, Homo sapiens
gccagugaaauagaacacagaa

SEQ ID NO: 2005972 - RNA, 21 nt, Homo sapiens
uccugaucaagguacaauucu

SEQ ID NO: 2005973 - RNA, 23 nt, Homo sapiens
ggcccuuccucuuugguggcaug

SEQ ID NO: 2005974 - RNA, 19 nt, Homo sapiens
aagugaacagaacuaucuc

SEQ ID NO: 2005975 - RNA, 12 nt, Homo sapiens
ucacaauuucag

SEQ ID NO: 2005976 - RNA, 22 nt, Homo sapiens
uuagaacggagcccucggugau

SEQ ID NO: 2005977 - RNA, 23 nt, Homo sapiens
ugagcuagagauaaaacagaauc

SEQ ID NO: 2005978 - RNA, 22 nt, Homo sapiens
aagcacugcucacgucucugcc

SEQ ID NO: 2005979 - RNA, 18 nt, Homo sapiens
guuaaagcagacagucac

SEQ ID NO: 2005980 - RNA, 20 nt, Homo sapiens
caaaugacaugcacugaccc

SEQ ID NO: 2005981 - RNA, 15 nt, Homo sapiens
cuuuggaaaucacac

SEQ ID NO: 2005982 - RNA, 15 nt, Homo sapiens
acaagauuaucuuau

SEQ ID NO: 2005983 - RNA, 14 nt, Homo sapiens
uuggaggcaaagga

SEQ ID NO: 2005984 - RNA, 16 nt, Homo sapiens
uucugauuucucuuca

SEQ ID NO: 2005985 - RNA, 13 nt, Homo sapiens
caaccacaugcag

SEQ ID NO: 2005986 - RNA, 20 nt, Homo sapiens
gaagacccuaucucccacaa

SEQ ID NO: 2005987 - RNA, 16 nt, Homo sapiens
aaauagcccagccuuu

SEQ ID NO: 2005988 - RNA, 21 nt, Homo sapiens
gacucacccucauaccaucug

SEQ ID NO: 2005989 - RNA, 18 nt, Homo sapiens
uccauccccaaacugugc

SEQ ID NO: 2005990 - RNA, 15 nt, Homo sapiens
acuugcauacagaga

SEQ ID NO: 2005991 - RNA, 13 nt, Homo sapiens
ggcuuccggcuga

SEQ ID NO: 2005992 - RNA, 20 nt, Homo sapiens
uaaaaccaagugcuuauaaa

SEQ ID NO: 2005993 - RNA, 16 nt, Homo sapiens
ccuggccaacauguca

SEQ ID NO: 2005994 - RNA, 17 nt, Homo sapiens
auggaugugcucacugg

SEQ ID NO: 2005995 - RNA, 23 nt, Homo sapiens
acccaggucuuccagaccugcuu

SEQ ID NO: 2005996 - RNA, 19 nt, Homo sapiens
uaacauuuaaauuccacag

SEQ ID NO: 2005997 - RNA, 15 nt, Homo sapiens
ugaguagccuaugaa

SEQ ID NO: 2005998 - RNA, 15 nt, Homo sapiens
uuuggaugucuguag

SEQ ID NO: 2005999 - RNA, 19 nt, Homo sapiens
acaauaaaaugucuucucc

SEQ ID NO: 2006000 - RNA, 20 nt, Homo sapiens
auucucugccuuuacuauau

SEQ ID NO: 2006001 - RNA, 14 nt, Homo sapiens
agguggcaaaguac

SEQ ID NO: 2006002 - RNA, 18 nt, Homo sapiens
gaagcacagcuccugcca

SEQ ID NO: 2006003 - RNA, 15 nt, Homo sapiens
ccuguaauuccagcu

SEQ ID NO: 2006004 - RNA, 20 nt, Homo sapiens
ucaaguucccaacugaguca

SEQ ID NO: 2006005 - RNA, 21 nt, Homo sapiens
cuggauguggagggggcgcgu

SEQ ID NO: 2006006 - RNA, 22 nt, Homo sapiens
agaaacuuggaugucacugccu

SEQ ID NO: 2006007 - RNA, 19 nt, Homo sapiens
uuucuaccuguguucauuc

SEQ ID NO: 2006008 - RNA, 17 nt, Homo sapiens
aaaugcaguccugagga

SEQ ID NO: 2006009 - RNA, 14 nt, Homo sapiens
cuugauugucuccu

SEQ ID NO: 2006010 - RNA, 14 nt, Homo sapiens
acaaagguuccauu

SEQ ID NO: 2006011 - RNA, 18 nt, Homo sapiens
uucugaugccaauacuag

SEQ ID NO: 2006012 - RNA, 18 nt, Homo sapiens
aacauggauuccacugaa

SEQ ID NO: 2006013 - RNA, 17 nt, Homo sapiens
augcuaauguuacuaga

SEQ ID NO: 2006014 - RNA, 23 nt, Homo sapiens
gggaaccaagggcccucacucag

SEQ ID NO: 2006015 - RNA, 12 nt, Homo sapiens
cagaaccaaagc

SEQ ID NO: 2006016 - RNA, 12 nt, Homo sapiens
augaaccacugc

SEQ ID NO: 2006017 - RNA, 12 nt, Homo sapiens
acucaccaccua

SEQ ID NO: 2006018 - RNA, 12 nt, Homo sapiens
caacaccaaaaa

SEQ ID NO: 2006019 - RNA, 21 nt, Homo sapiens
acuaaagagugaaugccauuu

SEQ ID NO: 2006020 - RNA, 14 nt, Homo sapiens
gaacaugaaucaaa

SEQ ID NO: 2006021 - RNA, 16 nt, Homo sapiens
cuuucugccagcaucu

SEQ ID NO: 2006022 - RNA, 16 nt, Homo sapiens
acugcacaucauguuu

SEQ ID NO: 2006023 - RNA, 14 nt, Homo sapiens
aucugaaugcuaua

SEQ ID NO: 2006024 - RNA, 17 nt, Homo sapiens
uuccauuguuuggagac

SEQ ID NO: 2006025 - RNA, 15 nt, Homo sapiens
aagaaagcauugcca

SEQ ID NO: 2006026 - RNA, 18 nt, Homo sapiens
cauccccaccugcugcag

SEQ ID NO: 2006027 - RNA, 23 nt, Homo sapiens
ugggggggcucccguggccugua

SEQ ID NO: 2006028 - RNA, 23 nt, Homo sapiens
gcuuagggggagcccuggugcua

SEQ ID NO: 2006029 - RNA, 16 nt, Homo sapiens
ccuaaucucauaccuc

SEQ ID NO: 2006030 - RNA, 17 nt, Homo sapiens
aagcugaaguuucacuc

SEQ ID NO: 2006031 - RNA, 20 nt, Homo sapiens
gccaguuucuuuggccagaa

SEQ ID NO: 2006032 - RNA, 17 nt, Homo sapiens
ugggaacacaucuggcu

SEQ ID NO: 2006033 - RNA, 13 nt, Homo sapiens
aaugccugugaag

SEQ ID NO: 2006034 - RNA, 15 nt, Homo sapiens
ugcucccagccugcu

SEQ ID NO: 2006035 - RNA, 15 nt, Homo sapiens
uucuaccauuugaau

SEQ ID NO: 2006036 - RNA, 21 nt, Homo sapiens
ucccuguucuuggaucugcca

SEQ ID NO: 2006037 - RNA, 21 nt, Homo sapiens
ugcuguuggcaucuugcugcu

SEQ ID NO: 2006038 - RNA, 17 nt, Homo sapiens
acgggccagcucuagua

SEQ ID NO: 2006039 - RNA, 13 nt, Homo sapiens
cccagcaucacuc

SEQ ID NO: 2006040 - RNA, 16 nt, Homo sapiens
uugugugugugcaagu

SEQ ID NO: 2006041 - RNA, 15 nt, Homo sapiens
uugguagacuuggac

SEQ ID NO: 2006042 - RNA, 15 nt, Homo sapiens
uuugugucacaaaga

SEQ ID NO: 2006043 - RNA, 22 nt, Homo sapiens
cccgccucuucuucuucagaag

SEQ ID NO: 2006044 - RNA, 22 nt, Homo sapiens
agagggggcgauauagagaaua

SEQ ID NO: 2006045 - RNA, 17 nt, Homo sapiens
gucccacuaucugggug

SEQ ID NO: 2006046 - RNA, 21 nt, Homo sapiens
ggcuuugugauaacuacuccc

SEQ ID NO: 2006047 - RNA, 23 nt, Homo sapiens
uuuuuggaaaccuggaacacaaa

SEQ ID NO: 2006048 - RNA, 18 nt, Homo sapiens
cacggauaucaauuugag

SEQ ID NO: 2006049 - RNA, 17 nt, Homo sapiens
ugcaguaugggaucuga

SEQ ID NO: 2006050 - RNA, 18 nt, Homo sapiens
uucgccauuuggccaggc

SEQ ID NO: 2006051 - RNA, 12 nt, Homo sapiens
ccacaagcacaa

SEQ ID NO: 2006052 - RNA, 20 nt, Homo sapiens
cuuccacccccaccauccag

SEQ ID NO: 2006053 - RNA, 21 nt, Homo sapiens
caguucuuagcccucuagaaa

SEQ ID NO: 2006054 - RNA, 16 nt, Homo sapiens
uaaauagugugauguu

SEQ ID NO: 2006055 - RNA, 16 nt, Homo sapiens
cuuuucuuuuccuuga

SEQ ID NO: 2006056 - RNA, 12 nt, Homo sapiens
aggagcucucca

SEQ ID NO: 2006057 - RNA, 17 nt, Homo sapiens
ugcuggacugaggacca

SEQ ID NO: 2006058 - RNA, 19 nt, Homo sapiens
cucaaucgagugagacaga

SEQ ID NO: 2006059 - RNA, 15 nt, Homo sapiens
cugauaccacugcac

SEQ ID NO: 2006060 - RNA, 14 nt, Homo sapiens
ucuugcacccucau

SEQ ID NO: 2006061 - RNA, 12 nt, Homo sapiens
guugacugcuga

SEQ ID NO: 2006062 - RNA, 23 nt, Homo sapiens
aaacuuaaggaagcaaaugcuac

SEQ ID NO: 2006063 - RNA, 21 nt, Homo sapiens
cugcauaaaugaauaaauuca

SEQ ID NO: 2006064 - RNA, 14 nt, Homo sapiens
gucuugcauuuaaa

SEQ ID NO: 2006065 - RNA, 16 nt, Homo sapiens
gugaccguuugcuaua

SEQ ID NO: 2006066 - RNA, 18 nt, Homo sapiens
aaucuaaaaauugaacua

SEQ ID NO: 2006067 - RNA, 21 nt, Homo sapiens
agcauccaaguauauaugaau

SEQ ID NO: 2006068 - RNA, 18 nt, Homo sapiens
agacguuaggcauuuccu

SEQ ID NO: 2006069 - RNA, 23 nt, Homo sapiens
guucuaugaauauggaaaggcca

SEQ ID NO: 2006070 - RNA, 21 nt, Homo sapiens
uuagagaaagaacuaugaaau

SEQ ID NO: 2006071 - RNA, 20 nt, Homo sapiens
cacauugguguuguacucaa

SEQ ID NO: 2006072 - RNA, 18 nt, Homo sapiens
ugaaccacauucagggaa

SEQ ID NO: 2006073 - RNA, 15 nt, Homo sapiens
ucccagucucuggca

SEQ ID NO: 2006074 - RNA, 13 nt, Homo sapiens
cagugagccauga

SEQ ID NO: 2006075 - RNA, 15 nt, Homo sapiens
cuucacucaugcaaa

SEQ ID NO: 2006076 - RNA, 22 nt, Homo sapiens
gaacauagacucacucuuccac

SEQ ID NO: 2006077 - RNA, 14 nt, Homo sapiens
cccagcaacccagg

SEQ ID NO: 2006078 - RNA, 22 nt, Homo sapiens
gaacugaaagaccagagggaca

SEQ ID NO: 2006079 - RNA, 23 nt, Homo sapiens
acacugaggccuuguguccuuua

SEQ ID NO: 2006080 - RNA, 18 nt, Homo sapiens
aaauaaaacaguaucucu

SEQ ID NO: 2006081 - RNA, 23 nt, Homo sapiens
cagaucccagcuucggcauuuga

SEQ ID NO: 2006082 - RNA, 19 nt, Homo sapiens
agugggugguggaucuguc

SEQ ID NO: 2006083 - RNA, 19 nt, Homo sapiens
cauauguaaggaagucaga

SEQ ID NO: 2006084 - RNA, 21 nt, Homo sapiens
uucaguaaaagcaaaaugaua

SEQ ID NO: 2006085 - RNA, 21 nt, Homo sapiens
ucucuuaugauacuugaggua

SEQ ID NO: 2006086 - RNA, 18 nt, Homo sapiens
cuggucccucuucucucc

SEQ ID NO: 2006087 - RNA, 15 nt, Homo sapiens
uccacgaggugaaaa

SEQ ID NO: 2006088 - RNA, 18 nt, Homo sapiens
auucacagcaagucacug

SEQ ID NO: 2006089 - RNA, 22 nt, Homo sapiens
ucuuaguacaccauaaacuggg

SEQ ID NO: 2006090 - RNA, 13 nt, Homo sapiens
acugacugacuua

SEQ ID NO: 2006091 - RNA, 14 nt, Homo sapiens
agcaagaauuauaa

SEQ ID NO: 2006092 - RNA, 22 nt, Homo sapiens
cccauacaauguauguacaaua

SEQ ID NO: 2006093 - RNA, 21 nt, Homo sapiens
guuucauacucuagauuuugu

SEQ ID NO: 2006094 - RNA, 19 nt, Homo sapiens
aauuuguaacuuuuaucca

SEQ ID NO: 2006095 - RNA, 16 nt, Homo sapiens
cuccucccagcuguac

SEQ ID NO: 2006096 - RNA, 16 nt, Homo sapiens
uuuguacacugcugua

SEQ ID NO: 2006097 - RNA, 14 nt, Homo sapiens
augaagcacaucaa

SEQ ID NO: 2006098 - RNA, 14 nt, Homo sapiens
uuuucucaauugua

SEQ ID NO: 2006099 - RNA, 15 nt, Homo sapiens
acagccauacuucca

SEQ ID NO: 2006100 - RNA, 17 nt, Homo sapiens
auaucucuguaaucucu

SEQ ID NO: 2006101 - RNA, 14 nt, Homo sapiens
ccaggaaucuugaa

SEQ ID NO: 2006102 - RNA, 12 nt, Homo sapiens
uuuccccagugu

SEQ ID NO: 2006103 - RNA, 13 nt, Homo sapiens
agccugucaagag

SEQ ID NO: 2006104 - RNA, 17 nt, Homo sapiens
uuuucagaguugcuuua

SEQ ID NO: 2006105 - RNA, 21 nt, Homo sapiens
cugguuuugacaucagcauua

SEQ ID NO: 2006106 - RNA, 20 nt, Homo sapiens
ucaugaacuaccccacaaca

SEQ ID NO: 2006107 - RNA, 22 nt, Homo sapiens
acaucucauccaucaaguugca

SEQ ID NO: 2006108 - RNA, 19 nt, Homo sapiens
ugaucaugccacugcacuc

SEQ ID NO: 2006109 - RNA, 21 nt, Homo sapiens
cucuuuguguaauagaucuga

SEQ ID NO: 2006110 - RNA, 21 nt, Homo sapiens
gagucugugcaguuucugaca

SEQ ID NO: 2006111 - RNA, 18 nt, Homo sapiens
gaaggacaaucccaggaa

SEQ ID NO: 2006112 - RNA, 14 nt, Homo sapiens
ucucauugaucaca

SEQ ID NO: 2006113 - RNA, 20 nt, Homo sapiens
ccuuagcccaagacuuggag

SEQ ID NO: 2006114 - RNA, 24 nt, Homo sapiens
auccauccuugccaauagugucau

SEQ ID NO: 2006115 - RNA, 18 nt, Homo sapiens
uauacauuugauguauug

SEQ ID NO: 2006116 - RNA, 16 nt, Homo sapiens
auuuuuuuaauagugc

SEQ ID NO: 2006117 - RNA, 19 nt, Homo sapiens
acaggucccaccuccagcc

SEQ ID NO: 2006118 - RNA, 15 nt, Homo sapiens
aguauguggaagugu

SEQ ID NO: 2006119 - RNA, 17 nt, Homo sapiens
aaagguccuugccuccu

SEQ ID NO: 2006120 - RNA, 15 nt, Homo sapiens
acaauuuacuuuuaa

SEQ ID NO: 2006121 - RNA, 15 nt, Homo sapiens
ucacucagcacuuuc

SEQ ID NO: 2006122 - RNA, 20 nt, Homo sapiens
caagaauuagaagucuuuca

SEQ ID NO: 2006123 - RNA, 15 nt, Homo sapiens
ugauccuugcugaua

SEQ ID NO: 2006124 - RNA, 19 nt, Homo sapiens
aaggcuuauauuaagcaaa

SEQ ID NO: 2006125 - RNA, 19 nt, Homo sapiens
acauguaagcauaacuuau

SEQ ID NO: 2006126 - RNA, 14 nt, Homo sapiens
auguguguugauac

SEQ ID NO: 2006127 - RNA, 21 nt, Homo sapiens
cugguuuaauuucauguguau

SEQ ID NO: 2006128 - RNA, 19 nt, Homo sapiens
cacuaauuuauaacuauua

SEQ ID NO: 2006129 - RNA, 21 nt, Homo sapiens
aacuuaucagggcuaguuuaa

SEQ ID NO: 2006130 - RNA, 22 nt, Homo sapiens
ucuuacguacacuguacuucug

SEQ ID NO: 2006131 - RNA, 18 nt, Homo sapiens
agagcgagaccgucucaa

SEQ ID NO: 2006132 - RNA, 22 nt, Homo sapiens
auaaguuacaucuacaaacagg

SEQ ID NO: 2006133 - RNA, 23 nt, Homo sapiens
agcagcacuuuuuaguucccuaa

SEQ ID NO: 2006134 - RNA, 20 nt, Homo sapiens
cgccacccucccacugccaa

SEQ ID NO: 2006135 - RNA, 22 nt, Homo sapiens
ugccucugucuagcaugccaac

SEQ ID NO: 2006136 - RNA, 14 nt, Homo sapiens
agaaugaaaggcaa

SEQ ID NO: 2006137 - RNA, 14 nt, Homo sapiens
aucuggaacccaga

SEQ ID NO: 2006138 - RNA, 18 nt, Homo sapiens
uauauucaguaaugaaga

SEQ ID NO: 2006139 - RNA, 17 nt, Homo sapiens
ucccccucucccaguug

SEQ ID NO: 2006140 - RNA, 15 nt, Homo sapiens
ucagauauucugcuc

SEQ ID NO: 2006141 - RNA, 20 nt, Homo sapiens
cugggaccacuggguacaag

SEQ ID NO: 2006142 - RNA, 22 nt, Homo sapiens
cccacugcuggugccagggugg

SEQ ID NO: 2006143 - RNA, 21 nt, Homo sapiens
uugauaccauggcacugacaa

SEQ ID NO: 2006144 - RNA, 21 nt, Homo sapiens
gaaaaauacuuuaauaguaaa

SEQ ID NO: 2006145 - RNA, 21 nt, Homo sapiens
uauuuuacccaaauacucaau

SEQ ID NO: 2006146 - RNA, 15 nt, Homo sapiens
uacugggacaaccuc

SEQ ID NO: 2006147 - RNA, 20 nt, Homo sapiens
gaagaaagccccucguugcc

SEQ ID NO: 2006148 - RNA, 13 nt, Homo sapiens
auacgcacuuugc

SEQ ID NO: 2006149 - RNA, 22 nt, Homo sapiens
guaauuuuguucuaguuuucag

SEQ ID NO: 2006150 - RNA, 22 nt, Homo sapiens
ggcaguuuggcaaacucuccac

SEQ ID NO: 2006151 - RNA, 16 nt, Homo sapiens
cuaggaugaagcccua

SEQ ID NO: 2006152 - RNA, 14 nt, Homo sapiens
ucaaauaguauaga

SEQ ID NO: 2006153 - RNA, 17 nt, Homo sapiens
ucuucaugguguccauu

SEQ ID NO: 2006154 - RNA, 20 nt, Homo sapiens
ucuacuacaucccacauuag

SEQ ID NO: 2006155 - RNA, 19 nt, Homo sapiens
aacccaaaaccucaugaca

SEQ ID NO: 2006156 - RNA, 14 nt, Homo sapiens
gguguugucgggga

SEQ ID NO: 2006157 - RNA, 20 nt, Homo sapiens
uuaugagaaaugccagugug

SEQ ID NO: 2006158 - RNA, 20 nt, Homo sapiens
augcugggcuguuuacuuua

SEQ ID NO: 2006159 - RNA, 19 nt, Homo sapiens
gcccacaacuugucaccca

SEQ ID NO: 2006160 - RNA, 20 nt, Homo sapiens
cuugcugggugguucucugg

SEQ ID NO: 2006161 - RNA, 14 nt, Homo sapiens
cccagggaaugcca

SEQ ID NO: 2006162 - RNA, 13 nt, Homo sapiens
gcggccaccagcg

SEQ ID NO: 2006163 - RNA, 14 nt, Homo sapiens
ggaaccacagugga

SEQ ID NO: 2006164 - RNA, 19 nt, Homo sapiens
gggugugcccacgaagaca

SEQ ID NO: 2006165 - RNA, 22 nt, Homo sapiens
agugaacaaauuucaaaaucuu

SEQ ID NO: 2006166 - RNA, 18 nt, Homo sapiens
ccacggacgccaccugcg

SEQ ID NO: 2006167 - RNA, 17 nt, Homo sapiens
cuucauuugacauuuag

SEQ ID NO: 2006168 - RNA, 21 nt, Homo sapiens
ccuuggagaggagaguggcag

SEQ ID NO: 2006169 - RNA, 13 nt, Homo sapiens
aagucaauuccac

SEQ ID NO: 2006170 - RNA, 13 nt, Homo sapiens
gauguuacuguau

SEQ ID NO: 2006171 - RNA, 14 nt, Homo sapiens
ugccuucugaaaug

SEQ ID NO: 2006172 - RNA, 22 nt, Homo sapiens
cuggagggguggcccagagcca

SEQ ID NO: 2006173 - RNA, 14 nt, Homo sapiens
guacaaaaugaauu

SEQ ID NO: 2006174 - RNA, 24 nt, Homo sapiens
gcaacggccaggguugugcuuucu

SEQ ID NO: 2006175 - RNA, 15 nt, Homo sapiens
ugaguaguaaucuca

SEQ ID NO: 2006176 - RNA, 22 nt, Homo sapiens
caccaacauugcuugugccaca

SEQ ID NO: 2006177 - RNA, 21 nt, Homo sapiens
aauucuuguaacuuucuucaa

SEQ ID NO: 2006178 - RNA, 19 nt, Homo sapiens
agcacaauuuauauuuucc

SEQ ID NO: 2006179 - RNA, 18 nt, Homo sapiens
aucuuggaaucaugcaaa

SEQ ID NO: 2006180 - RNA, 18 nt, Homo sapiens
auuaaugccauuaucccu

SEQ ID NO: 2006181 - RNA, 21 nt, Homo sapiens
cuccaugaugccccugagaug

SEQ ID NO: 2006182 - RNA, 18 nt, Homo sapiens
uugcaucaaucuuaaugu

SEQ ID NO: 2006183 - RNA, 21 nt, Homo sapiens
gagcuuuccuacuugcacucu

SEQ ID NO: 2006184 - RNA, 17 nt, Homo sapiens
ccuggccaccagcuucc

SEQ ID NO: 2006185 - RNA, 23 nt, Homo sapiens
cucaggccaauggcaacugccau

SEQ ID NO: 2006186 - RNA, 20 nt, Homo sapiens
agccccgucuggugccagug

SEQ ID NO: 2006187 - RNA, 15 nt, Homo sapiens
acaaugaguggacaa

SEQ ID NO: 2006188 - RNA, 23 nt, Homo sapiens
auggagacguggugggacuccag

SEQ ID NO: 2006189 - RNA, 22 nt, Homo sapiens
agaccuugcuuugagacuccuc

SEQ ID NO: 2006190 - RNA, 11 nt, Homo sapiens
gagggggcuca

SEQ ID NO: 2006191 - RNA, 12 nt, Homo sapiens
agaguggugggg

SEQ ID NO: 2006192 - RNA, 22 nt, Homo sapiens
agcaggaagcugugagagcagu

SEQ ID NO: 2006193 - RNA, 23 nt, Homo sapiens
cagaccuccaccuccuccagacc

SEQ ID NO: 2006194 - RNA, 21 nt, Homo sapiens
cauguaaauuaagugugugua

SEQ ID NO: 2006195 - RNA, 20 nt, Homo sapiens
aaggucuguacuaacaaagc

SEQ ID NO: 2006196 - RNA, 21 nt, Homo sapiens
uaacuuauauugaagacaauu

SEQ ID NO: 2006197 - RNA, 16 nt, Homo sapiens
auaagauacaucacag

SEQ ID NO: 2006198 - RNA, 15 nt, Homo sapiens
gaucucgaacuucug

SEQ ID NO: 2006199 - RNA, 15 nt, Homo sapiens
gucuauuuuguauau

SEQ ID NO: 2006200 - RNA, 11 nt, Homo sapiens
aaaauccugcu

SEQ ID NO: 2006201 - RNA, 18 nt, Homo sapiens
cgguugcagucacuguga

SEQ ID NO: 2006202 - RNA, 13 nt, Homo sapiens
caggccaccagcu

SEQ ID NO: 2006203 - RNA, 13 nt, Homo sapiens
gcaaggugcucac

SEQ ID NO: 2006204 - RNA, 14 nt, Homo sapiens
cauguguauacaua

SEQ ID NO: 2006205 - RNA, 12 nt, Homo sapiens
acaagugcccag

SEQ ID NO: 2006206 - RNA, 20 nt, Homo sapiens
uuuuauacaaaccuaccaaa

SEQ ID NO: 2006207 - RNA, 17 nt, Homo sapiens
cucuccgggaccugauc

SEQ ID NO: 2006208 - RNA, 13 nt, Homo sapiens
uuuucuacaaaua

SEQ ID NO: 2006209 - RNA, 17 nt, Homo sapiens
cuguccaccaccaccug

SEQ ID NO: 2006210 - RNA, 15 nt, Homo sapiens
acgugugcagacugu

SEQ ID NO: 2006211 - RNA, 15 nt, Homo sapiens
caguguccucaucua

SEQ ID NO: 2006212 - RNA, 18 nt, Homo sapiens
gcacaggccacuugcuca

SEQ ID NO: 2006213 - RNA, 16 nt, Homo sapiens
cagggcacugugccug

SEQ ID NO: 2006214 - RNA, 13 nt, Homo sapiens
cuccgaggccagu

SEQ ID NO: 2006215 - RNA, 20 nt, Homo sapiens
acagauauacucgaaucaga

SEQ ID NO: 2006216 - RNA, 14 nt, Homo sapiens
uacuaucucagaga

SEQ ID NO: 2006217 - RNA, 18 nt, Homo sapiens
gucauuuugcacuguaaa

SEQ ID NO: 2006218 - RNA, 14 nt, Homo sapiens
aggcucucacucca

SEQ ID NO: 2006219 - RNA, 18 nt, Homo sapiens
cucuucccccucucccag

SEQ ID NO: 2006220 - RNA, 17 nt, Homo sapiens
ucaccugcuggggaccu

SEQ ID NO: 2006221 - RNA, 18 nt, Homo sapiens
augguggagggcacuuca

SEQ ID NO: 2006222 - RNA, 12 nt, Homo sapiens
uuuauagcuguu

SEQ ID NO: 2006223 - RNA, 19 nt, Homo sapiens
caucugcaguggagccuga

SEQ ID NO: 2006224 - RNA, 18 nt, Homo sapiens
cauggguaaaaauauuuc

SEQ ID NO: 2006225 - RNA, 16 nt, Homo sapiens
ugaggcaggcagauca

SEQ ID NO: 2006226 - RNA, 20 nt, Homo sapiens
agcggacaguggcaggacag

SEQ ID NO: 2006227 - RNA, 22 nt, Homo sapiens
uugaagacuuuucuuucagcca

SEQ ID NO: 2006228 - RNA, 14 nt, Homo sapiens
cugaggccauuccc

SEQ ID NO: 2006229 - RNA, 22 nt, Homo sapiens
ccuugaaaacacuguucucugc

SEQ ID NO: 2006230 - RNA, 18 nt, Homo sapiens
caggauguguggcucauu

SEQ ID NO: 2006231 - RNA, 16 nt, Homo sapiens
caugucuacaugccau

SEQ ID NO: 2006232 - RNA, 19 nt, Homo sapiens
ccaagaaacuaguaucucu

SEQ ID NO: 2006233 - RNA, 17 nt, Homo sapiens
auacucaagagcauaau

SEQ ID NO: 2006234 - RNA, 15 nt, Homo sapiens
ccacaggaugcauau

SEQ ID NO: 2006235 - RNA, 16 nt, Homo sapiens
guggaaacagcuggua

SEQ ID NO: 2006236 - RNA, 19 nt, Homo sapiens
caaaggcagcugugucuga

SEQ ID NO: 2006237 - RNA, 18 nt, Homo sapiens
cucucaguucuacacuga

SEQ ID NO: 2006238 - RNA, 22 nt, Homo sapiens
acuguaguguagucaggugcuc

SEQ ID NO: 2006239 - RNA, 20 nt, Homo sapiens
agcacaagauacacgucaca

SEQ ID NO: 2006240 - RNA, 21 nt, Homo sapiens
uccuaaacucucuagcuuaag

SEQ ID NO: 2006241 - RNA, 19 nt, Homo sapiens
gcccagccuggaugccauc

SEQ ID NO: 2006242 - RNA, 22 nt, Homo sapiens
gagggagcauagaaggcaggug

SEQ ID NO: 2006243 - RNA, 21 nt, Homo sapiens
auuuucagagugacacccaag

SEQ ID NO: 2006244 - RNA, 23 nt, Homo sapiens
caaugcugccugggagccagggu

SEQ ID NO: 2006245 - RNA, 15 nt, Homo sapiens
aagaucucugucaca

SEQ ID NO: 2006246 - RNA, 13 nt, Homo sapiens
uagcaugugaagu

SEQ ID NO: 2006247 - RNA, 14 nt, Homo sapiens
aaacuaaugugaua

SEQ ID NO: 2006248 - RNA, 19 nt, Homo sapiens
uuaaaaugauuugggaaaa

SEQ ID NO: 2006249 - RNA, 17 nt, Homo sapiens
aagggacugguccaggc

SEQ ID NO: 2006250 - RNA, 19 nt, Homo sapiens
ucacccuccugagccucac

SEQ ID NO: 2006251 - RNA, 16 nt, Homo sapiens
auuguuuuaccagcuc

SEQ ID NO: 2006252 - RNA, 15 nt, Homo sapiens
augaugccauggcaa

SEQ ID NO: 2006253 - RNA, 13 nt, Homo sapiens
guaaaacauucac

SEQ ID NO: 2006254 - RNA, 18 nt, Homo sapiens
aaccuuauguagguugcc

SEQ ID NO: 2006255 - RNA, 23 nt, Homo sapiens
uaaauaguauuugagaguucuaa

SEQ ID NO: 2006256 - RNA, 13 nt, Homo sapiens
ggcuuaucuagcc

SEQ ID NO: 2006257 - RNA, 16 nt, Homo sapiens
cuuugcugcuaugaaa

SEQ ID NO: 2006258 - RNA, 20 nt, Homo sapiens
cauuugauauacaugcucaa

SEQ ID NO: 2006259 - RNA, 23 nt, Homo sapiens
gguaaagccucagcaacagccag

SEQ ID NO: 2006260 - RNA, 11 nt, Homo sapiens
cuccaccucaa

SEQ ID NO: 2006261 - RNA, 19 nt, Homo sapiens
auucucauuuguucucaca

SEQ ID NO: 2006262 - RNA, 14 nt, Homo sapiens
ugcugaguucuggu

SEQ ID NO: 2006263 - RNA, 13 nt, Homo sapiens
gaggccugagaca

SEQ ID NO: 2006264 - RNA, 22 nt, Homo sapiens
auuuaauaggacuuccuuugaa

SEQ ID NO: 2006265 - RNA, 17 nt, Homo sapiens
auguuaugcuccugcug

SEQ ID NO: 2006266 - RNA, 22 nt, Homo sapiens
ugguggagccaguaaacagagg

SEQ ID NO: 2006267 - RNA, 23 nt, Homo sapiens
auuuugcuucaggauccaaguga

SEQ ID NO: 2006268 - RNA, 22 nt, Homo sapiens
ucucacugugggaaggccagcu

SEQ ID NO: 2006269 - RNA, 22 nt, Homo sapiens
ccaggauuccucuuuucucugc

SEQ ID NO: 2006270 - RNA, 20 nt, Homo sapiens
acugaguauguucauugcca

SEQ ID NO: 2006271 - RNA, 16 nt, Homo sapiens
acuaaaggcuccugga

SEQ ID NO: 2006272 - RNA, 14 nt, Homo sapiens
acagaauugcuccu

SEQ ID NO: 2006273 - RNA, 20 nt, Homo sapiens
aggcuacucauucaguccca

SEQ ID NO: 2006274 - RNA, 14 nt, Homo sapiens
acuccuuugcagaa

SEQ ID NO: 2006275 - RNA, 19 nt, Homo sapiens
ugaccuuggcugacugggg

SEQ ID NO: 2006276 - RNA, 13 nt, Homo sapiens
cacucuugccaac

SEQ ID NO: 2006277 - RNA, 13 nt, Homo sapiens
ccaauuugcacuu

SEQ ID NO: 2006278 - RNA, 13 nt, Homo sapiens
cccuguugcaaag

SEQ ID NO: 2006279 - RNA, 14 nt, Homo sapiens
guuuguaaauaaga

SEQ ID NO: 2006280 - RNA, 22 nt, Homo sapiens
uauuuugguugcaguuuccaau

SEQ ID NO: 2006281 - RNA, 15 nt, Homo sapiens
agcagucucagcuca

SEQ ID NO: 2006282 - RNA, 12 nt, Homo sapiens
caccuguaggca

SEQ ID NO: 2006283 - RNA, 15 nt, Homo sapiens
ccugacaaggccagc

SEQ ID NO: 2006284 - RNA, 22 nt, Homo sapiens
caaacuggcugcuuuguucaau

SEQ ID NO: 2006285 - RNA, 18 nt, Homo sapiens
ugggcuugagcugcagaa

SEQ ID NO: 2006286 - RNA, 15 nt, Homo sapiens
ccacaaaaguacaau

SEQ ID NO: 2006287 - RNA, 22 nt, Homo sapiens
uccugggggcauaucucaguca

SEQ ID NO: 2006288 - RNA, 19 nt, Homo sapiens
gaaagcaacaaagauugag

SEQ ID NO: 2006289 - RNA, 15 nt, Homo sapiens
ggaugaugcugucau

SEQ ID NO: 2006290 - RNA, 21 nt, Homo sapiens
uguguucacguaguucuagca

SEQ ID NO: 2006291 - RNA, 13 nt, Homo sapiens
ugcaauguaguca

SEQ ID NO: 2006292 - RNA, 18 nt, Homo sapiens
auaugaauuuacuacuuu

SEQ ID NO: 2006293 - RNA, 20 nt, Homo sapiens
agguguaccucccccugccu

SEQ ID NO: 2006294 - RNA, 21 nt, Homo sapiens
ucgaaauguauucaccuuucu

SEQ ID NO: 2006295 - RNA, 14 nt, Homo sapiens
gaggcaauaaucuu

SEQ ID NO: 2006296 - RNA, 23 nt, Homo sapiens
acuucuuauggaauugauuugca

SEQ ID NO: 2006297 - RNA, 21 nt, Homo sapiens
agacagagagagagagcacuu

SEQ ID NO: 2006298 - RNA, 15 nt, Homo sapiens
auggauggcuguuaa

SEQ ID NO: 2006299 - RNA, 15 nt, Homo sapiens
agcauugcaggccaa

SEQ ID NO: 2006300 - RNA, 20 nt, Homo sapiens
uauuaagauacuuagauuag

SEQ ID NO: 2006301 - RNA, 22 nt, Homo sapiens
uguagucuccaugcaagauuuc

SEQ ID NO: 2006302 - RNA, 23 nt, Homo sapiens
cuuuccucuuaaugucucaaaau

SEQ ID NO: 2006303 - RNA, 19 nt, Homo sapiens
cuuugucucacgauuccag

SEQ ID NO: 2006304 - RNA, 15 nt, Homo sapiens
uguaugaccacuggg

SEQ ID NO: 2006305 - RNA, 15 nt, Homo sapiens
aucagucguuuuagu

SEQ ID NO: 2006306 - RNA, 15 nt, Homo sapiens
caacgaaaagcacau

SEQ ID NO: 2006307 - RNA, 22 nt, Homo sapiens
agcaugcuuugcugcuaugaaa

SEQ ID NO: 2006308 - RNA, 20 nt, Homo sapiens
ugcuuucccacccugggcaa

SEQ ID NO: 2006309 - RNA, 22 nt, Homo sapiens
gagagucccacugccucagguu

SEQ ID NO: 2006310 - RNA, 21 nt, Homo sapiens
ccuuugauaaauguauauaug

SEQ ID NO: 2006311 - RNA, 18 nt, Homo sapiens
augugguuuuuugccagg

SEQ ID NO: 2006312 - RNA, 15 nt, Homo sapiens
gcauaccacuugaag

SEQ ID NO: 2006313 - RNA, 20 nt, Homo sapiens
acagggucuuuuuucauuuc

SEQ ID NO: 2006314 - RNA, 16 nt, Homo sapiens
agaguaucauguacua

SEQ ID NO: 2006315 - RNA, 17 nt, Homo sapiens
aacuaggugaucucagu

SEQ ID NO: 2006316 - RNA, 15 nt, Homo sapiens
ucugucgcauuucau

SEQ ID NO: 2006317 - RNA, 10 nt, Homo sapiens
cugaguucag

SEQ ID NO: 2006318 - RNA, 15 nt, Homo sapiens
uuccggaaagccuuc

SEQ ID NO: 2006319 - RNA, 16 nt, Homo sapiens
cucuugcaaaguagcc

SEQ ID NO: 2006320 - RNA, 14 nt, Homo sapiens
ccacuggggcucag

SEQ ID NO: 2006321 - RNA, 19 nt, Homo sapiens
gaagaauguugauggugcu

SEQ ID NO: 2006322 - RNA, 17 nt, Homo sapiens
cuuauaucaucagcaua

SEQ ID NO: 2006323 - RNA, 18 nt, Homo sapiens
uaauaagcccacauauaa

SEQ ID NO: 2006324 - RNA, 18 nt, Homo sapiens
ugucucuugagcaucaau

SEQ ID NO: 2006325 - RNA, 19 nt, Homo sapiens
uguaagaaacacacugagg

SEQ ID NO: 2006326 - RNA, 14 nt, Homo sapiens
ugcuaccaucucau

SEQ ID NO: 2006327 - RNA, 16 nt, Homo sapiens
aucuuaagauucuuug

SEQ ID NO: 2006328 - RNA, 21 nt, Homo sapiens
uaagccccgucugaccccagc

SEQ ID NO: 2006329 - RNA, 15 nt, Homo sapiens
uugaccuccuugacu

SEQ ID NO: 2006330 - RNA, 20 nt, Homo sapiens
gaagggccccacucagggau

SEQ ID NO: 2006331 - RNA, 21 nt, Homo sapiens
ugcaguuguaggcauguagcu

SEQ ID NO: 2006332 - RNA, 13 nt, Homo sapiens
ccucucaaaugga

SEQ ID NO: 2006333 - RNA, 11 nt, Homo sapiens
aagucuugccu

SEQ ID NO: 2006334 - RNA, 15 nt, Homo sapiens
caaugcaaccaacua

SEQ ID NO: 2006335 - RNA, 21 nt, Homo sapiens
ucugagaaccaaaagaugccu

SEQ ID NO: 2006336 - RNA, 17 nt, Homo sapiens
acggcuaagaggcugcu

SEQ ID NO: 2006337 - RNA, 23 nt, Homo sapiens
ugaaucuuuuucagaaacaguga

SEQ ID NO: 2006338 - RNA, 16 nt, Homo sapiens
aauuuagugcauuuca

SEQ ID NO: 2006339 - RNA, 19 nt, Homo sapiens
ccuuaaugagaacauuuac

SEQ ID NO: 2006340 - RNA, 18 nt, Homo sapiens
aagugaggaagaguuuau

SEQ ID NO: 2006341 - RNA, 13 nt, Homo sapiens
auggcagugccug

SEQ ID NO: 2006342 - RNA, 18 nt, Homo sapiens
cuuaaacaaaaacuuucc

SEQ ID NO: 2006343 - RNA, 20 nt, Homo sapiens
uagugcacccagugacugac

SEQ ID NO: 2006344 - RNA, 14 nt, Homo sapiens
uuuauuuuuaacuc

SEQ ID NO: 2006345 - RNA, 23 nt, Homo sapiens
gauuugauaccauggcacugaca

SEQ ID NO: 2006346 - RNA, 17 nt, Homo sapiens
acacacacgcacucucc

SEQ ID NO: 2006347 - RNA, 20 nt, Homo sapiens
cagagcccagggcaucccau

SEQ ID NO: 2006348 - RNA, 20 nt, Homo sapiens
guucugcacccuacccaguu

SEQ ID NO: 2006349 - RNA, 18 nt, Homo sapiens
uuucucugccuucuucca

SEQ ID NO: 2006350 - RNA, 16 nt, Homo sapiens
ugaaaaccucuuucca

SEQ ID NO: 2006351 - RNA, 17 nt, Homo sapiens
uguggaaaacucacaga

SEQ ID NO: 2006352 - RNA, 17 nt, Homo sapiens
ucaucaccccaaaagca

SEQ ID NO: 2006353 - RNA, 17 nt, Homo sapiens
augguuaauacuauuaa

SEQ ID NO: 2006354 - RNA, 20 nt, Homo sapiens
uuuacuuuuuauuugcaacu

SEQ ID NO: 2006355 - RNA, 22 nt, Homo sapiens
uuuaaguacuugagacucuuga

SEQ ID NO: 2006356 - RNA, 19 nt, Homo sapiens
gagucugcauaaacuucau

SEQ ID NO: 2006357 - RNA, 21 nt, Homo sapiens
cugcuguugcuggacugagga

SEQ ID NO: 2006358 - RNA, 15 nt, Homo sapiens
aggcuggacugcaau

SEQ ID NO: 2006359 - RNA, 14 nt, Homo sapiens
cuggaagaaccacu

SEQ ID NO: 2006360 - RNA, 19 nt, Homo sapiens
aaugaauuuuuuccuacca

SEQ ID NO: 2006361 - RNA, 13 nt, Homo sapiens
ugauaacucugag

SEQ ID NO: 2006362 - RNA, 17 nt, Homo sapiens
ugauggcaacagaucug

SEQ ID NO: 2006363 - RNA, 22 nt, Homo sapiens
uaagugaugagggccucugcau

SEQ ID NO: 2006364 - RNA, 15 nt, Homo sapiens
gcuguccucuccccc

SEQ ID NO: 2006365 - RNA, 23 nt, Homo sapiens
aaugauauaggaaaauacauugu

SEQ ID NO: 2006366 - RNA, 22 nt, Homo sapiens
uggaaauagaaagaagccauau

SEQ ID NO: 2006367 - RNA, 18 nt, Homo sapiens
auccauaucagcucugca

SEQ ID NO: 2006368 - RNA, 11 nt, Homo sapiens
uagcucugauc

SEQ ID NO: 2006369 - RNA, 17 nt, Homo sapiens
cuuuaaaguaccuguag

SEQ ID NO: 2006370 - RNA, 19 nt, Homo sapiens
gcauagaguucagacuuuu

SEQ ID NO: 2006371 - RNA, 16 nt, Homo sapiens
aaggcucucacuccag

SEQ ID NO: 2006372 - RNA, 18 nt, Homo sapiens
caccaggacucagaggau

SEQ ID NO: 2006373 - RNA, 16 nt, Homo sapiens
ugggaaaggugcucaa

SEQ ID NO: 2006374 - RNA, 22 nt, Homo sapiens
uggaaacauucacuuuccugca

SEQ ID NO: 2006375 - RNA, 22 nt, Homo sapiens
cugcuugcagccaggagaaggu

SEQ ID NO: 2006376 - RNA, 21 nt, Homo sapiens
cuucaaaauaaaaaguaauga

SEQ ID NO: 2006377 - RNA, 14 nt, Homo sapiens
cucuuucucuauua

SEQ ID NO: 2006378 - RNA, 20 nt, Homo sapiens
cugaggccucacuacucgag

SEQ ID NO: 2006379 - RNA, 12 nt, Homo sapiens
gcccuacaguac

SEQ ID NO: 2006380 - RNA, 16 nt, Homo sapiens
cuuccaguuugcuuga

SEQ ID NO: 2006381 - RNA, 19 nt, Homo sapiens
aggauaagcacuagaucuc

SEQ ID NO: 2006382 - RNA, 17 nt, Homo sapiens
gauucuucacuguguuu

SEQ ID NO: 2006383 - RNA, 19 nt, Homo sapiens
aaguucgagucaaaguuga

SEQ ID NO: 2006384 - RNA, 16 nt, Homo sapiens
gcuuucugcuuacuga

SEQ ID NO: 2006385 - RNA, 18 nt, Homo sapiens
cccuggggucucugagca

SEQ ID NO: 2006386 - RNA, 16 nt, Homo sapiens
aaaauuaucuguucua

SEQ ID NO: 2006387 - RNA, 14 nt, Homo sapiens
agagggucacagug

SEQ ID NO: 2006388 - RNA, 13 nt, Homo sapiens
uccauucucugag

SEQ ID NO: 2006389 - RNA, 18 nt, Homo sapiens
caccauucccugccuugc

SEQ ID NO: 2006390 - RNA, 14 nt, Homo sapiens
cacccuugccaugg

SEQ ID NO: 2006391 - RNA, 22 nt, Homo sapiens
aauuagaauaguguucugcaaa

SEQ ID NO: 2006392 - RNA, 15 nt, Homo sapiens
caucaauucuuagaa

SEQ ID NO: 2006393 - RNA, 19 nt, Homo sapiens
uguguauaauuuaccucuc

SEQ ID NO: 2006394 - RNA, 18 nt, Homo sapiens
gcccucuucauuuagcca

SEQ ID NO: 2006395 - RNA, 13 nt, Homo sapiens
ucuugaugaugau

SEQ ID NO: 2006396 - RNA, 15 nt, Homo sapiens
acaccaguaccugaa

SEQ ID NO: 2006397 - RNA, 20 nt, Homo sapiens
caugggaaggggaggacccc

SEQ ID NO: 2006398 - RNA, 17 nt, Homo sapiens
cugaaagccuuagggaa

SEQ ID NO: 2006399 - RNA, 18 nt, Homo sapiens
gucauaaugaacacucau

SEQ ID NO: 2006400 - RNA, 15 nt, Homo sapiens
ucucuuagcaacuca

SEQ ID NO: 2006401 - RNA, 17 nt, Homo sapiens
cuuaauuuucaguauaa

SEQ ID NO: 2006402 - RNA, 12 nt, Homo sapiens
uaacaaccuggg

SEQ ID NO: 2006403 - RNA, 22 nt, Homo sapiens
gucaucaucauagguaacaguu

SEQ ID NO: 2006404 - RNA, 18 nt, Homo sapiens
gggagguauucgugcagc

SEQ ID NO: 2006405 - RNA, 13 nt, Homo sapiens
cauuucacaaaaa

SEQ ID NO: 2006406 - RNA, 12 nt, Homo sapiens
caggucagcuca

SEQ ID NO: 2006407 - RNA, 11 nt, Homo sapiens
agucaucuuug

SEQ ID NO: 2006408 - RNA, 16 nt, Homo sapiens
gacagccucugacuca

SEQ ID NO: 2006409 - RNA, 15 nt, Homo sapiens
auccauuacgugcau

SEQ ID NO: 2006410 - RNA, 19 nt, Homo sapiens
acaucuauuauaaaaccau

SEQ ID NO: 2006411 - RNA, 21 nt, Homo sapiens
ucuacauaaguaauucaagaa

SEQ ID NO: 2006412 - RNA, 14 nt, Homo sapiens
aagacguuuuccca

SEQ ID NO: 2006413 - RNA, 22 nt, Homo sapiens
caacauuaggaguaacuuucaa

SEQ ID NO: 2006414 - RNA, 15 nt, Homo sapiens
agacuggagugcagu

SEQ ID NO: 2006415 - RNA, 18 nt, Homo sapiens
augcauagcuuugcacuu

SEQ ID NO: 2006416 - RNA, 19 nt, Homo sapiens
gaacuaugcagugugcucc

SEQ ID NO: 2006417 - RNA, 16 nt, Homo sapiens
uuccagguuccaucca

SEQ ID NO: 2006418 - RNA, 12 nt, Homo sapiens
gaauaaugaagg

SEQ ID NO: 2006419 - RNA, 22 nt, Homo sapiens
agccuguggcuggcuggaaaaa

SEQ ID NO: 2006420 - RNA, 13 nt, Homo sapiens
uauaaguauucaa

SEQ ID NO: 2006421 - RNA, 22 nt, Homo sapiens
ugcccagcccccuggucuuuga

SEQ ID NO: 2006422 - RNA, 19 nt, Homo sapiens
gccuggaucccugcccuuc

SEQ ID NO: 2006423 - RNA, 14 nt, Homo sapiens
cacccagaacagug

SEQ ID NO: 2006424 - RNA, 21 nt, Homo sapiens
ugaacaaauuuucuggugcua

SEQ ID NO: 2006425 - RNA, 21 nt, Homo sapiens
cugugccaggacugugacuca

SEQ ID NO: 2006426 - RNA, 17 nt, Homo sapiens
uuguggucugagccaaa

SEQ ID NO: 2006427 - RNA, 19 nt, Homo sapiens
ccagggauugcccgugaag

SEQ ID NO: 2006428 - RNA, 16 nt, Homo sapiens
gcugugccccuccccc

SEQ ID NO: 2006429 - RNA, 22 nt, Homo sapiens
ugucccucauccauagcaccuc

SEQ ID NO: 2006430 - RNA, 13 nt, Homo sapiens
gucuuuuguuauu

SEQ ID NO: 2006431 - RNA, 13 nt, Homo sapiens
gucauuuguuaau

SEQ ID NO: 2006432 - RNA, 19 nt, Homo sapiens
aaugaaauauaaacuguga

SEQ ID NO: 2006433 - RNA, 12 nt, Homo sapiens
ucauuacagggc

SEQ ID NO: 2006434 - RNA, 20 nt, Homo sapiens
agggcucccgagucaugcac

SEQ ID NO: 2006435 - RNA, 21 nt, Homo sapiens
agauccugucuugcugaggga

SEQ ID NO: 2006436 - RNA, 18 nt, Homo sapiens
aaugcacguuucaaagcu

SEQ ID NO: 2006437 - RNA, 23 nt, Homo sapiens
ccuucugaagucugagcccauuu

SEQ ID NO: 2006438 - RNA, 22 nt, Homo sapiens
uggaagugcaucuacuugccag

SEQ ID NO: 2006439 - RNA, 23 nt, Homo sapiens
caugcaccuuauauuucugugua

SEQ ID NO: 2006440 - RNA, 21 nt, Homo sapiens
aggacuuguuaaagagcacug

SEQ ID NO: 2006441 - RNA, 11 nt, Homo sapiens
aaaaauccaua

SEQ ID NO: 2006442 - RNA, 21 nt, Homo sapiens
aaggagcagagagguggccac

SEQ ID NO: 2006443 - RNA, 22 nt, Homo sapiens
aaaauguaaaaacccugcuaaa

SEQ ID NO: 2006444 - RNA, 17 nt, Homo sapiens
caauuccugugcucaaa

SEQ ID NO: 2006445 - RNA, 16 nt, Homo sapiens
ugcaguguuaguauuc

SEQ ID NO: 2006446 - RNA, 14 nt, Homo sapiens
caacuacuauucaa

SEQ ID NO: 2006447 - RNA, 17 nt, Homo sapiens
aggugcuacaacaugug

SEQ ID NO: 2006448 - RNA, 21 nt, Homo sapiens
aucaguccuaccuuugcugau

SEQ ID NO: 2006449 - RNA, 20 nt, Homo sapiens
augaagcuaauugugcacau

SEQ ID NO: 2006450 - RNA, 23 nt, Homo sapiens
gcaaacccuggugcuuuccuuca

SEQ ID NO: 2006451 - RNA, 13 nt, Homo sapiens
uggcuucagggga

SEQ ID NO: 2006452 - RNA, 13 nt, Homo sapiens
uugcuucagugga

SEQ ID NO: 2006453 - RNA, 18 nt, Homo sapiens
aaaugcucaauuucagca

SEQ ID NO: 2006454 - RNA, 19 nt, Homo sapiens
ccugcugcugaccugauca

SEQ ID NO: 2006455 - RNA, 12 nt, Homo sapiens
cuggacacacua

SEQ ID NO: 2006456 - RNA, 19 nt, Homo sapiens
auuuggagauauaccuaau

SEQ ID NO: 2006457 - RNA, 20 nt, Homo sapiens
caagauucuagaugauuaaa

SEQ ID NO: 2006458 - RNA, 21 nt, Homo sapiens
ucuaaguuuuaggguacaugu

SEQ ID NO: 2006459 - RNA, 17 nt, Homo sapiens
uucuuaucacacuugca

SEQ ID NO: 2006460 - RNA, 15 nt, Homo sapiens
ggagcagaugccucc

SEQ ID NO: 2006461 - RNA, 12 nt, Homo sapiens
aacaccacaaac

SEQ ID NO: 2006462 - RNA, 17 nt, Homo sapiens
aggacaaaagggagcau

SEQ ID NO: 2006463 - RNA, 21 nt, Homo sapiens
aucuccacggucagauuugcu

SEQ ID NO: 2006464 - RNA, 12 nt, Homo sapiens
gcagacugcugc

SEQ ID NO: 2006465 - RNA, 17 nt, Homo sapiens
caaaauacacauucuug

SEQ ID NO: 2006466 - RNA, 14 nt, Homo sapiens
acucagugcagaug

SEQ ID NO: 2006467 - RNA, 22 nt, Homo sapiens
ugccuguucaguuacagaaagu

SEQ ID NO: 2006468 - RNA, 18 nt, Homo sapiens
ccacagacucaaugugcu

SEQ ID NO: 2006469 - RNA, 14 nt, Homo sapiens
auuugaguugugau

SEQ ID NO: 2006470 - RNA, 16 nt, Homo sapiens
uuguacguuuugcaca

SEQ ID NO: 2006471 - RNA, 15 nt, Homo sapiens
guagaugacuacuug

SEQ ID NO: 2006472 - RNA, 20 nt, Homo sapiens
caggcuguaugggaagcaug

SEQ ID NO: 2006473 - RNA, 17 nt, Homo sapiens
guaaaugaaacuaauca

SEQ ID NO: 2006474 - RNA, 23 nt, Homo sapiens
ucauccuuaaaacaauucuguga

SEQ ID NO: 2006475 - RNA, 23 nt, Homo sapiens
cagaugccaaccagacaccuccu

SEQ ID NO: 2006476 - RNA, 15 nt, Homo sapiens
auggaaaggacagug

SEQ ID NO: 2006477 - RNA, 22 nt, Homo sapiens
uaggccauuuguuacaguuucu

SEQ ID NO: 2006478 - RNA, 22 nt, Homo sapiens
auuuacuauauauauaugccuu

SEQ ID NO: 2006479 - RNA, 22 nt, Homo sapiens
ccacugcacuccagucuggcaa

SEQ ID NO: 2006480 - RNA, 19 nt, Homo sapiens
acuguuaucaggacuugag

SEQ ID NO: 2006481 - RNA, 16 nt, Homo sapiens
gaccacaggcucaggc

SEQ ID NO: 2006482 - RNA, 13 nt, Homo sapiens
ugugggucaggga

SEQ ID NO: 2006483 - RNA, 17 nt, Homo sapiens
uguccgucuguccugcg

SEQ ID NO: 2006484 - RNA, 14 nt, Homo sapiens
ggucucucgcugug

SEQ ID NO: 2006485 - RNA, 22 nt, Homo sapiens
ccaaacuggaaugagcagcuuu

SEQ ID NO: 2006486 - RNA, 21 nt, Homo sapiens
aaguccuaauaaacuuagcua

SEQ ID NO: 2006487 - RNA, 23 nt, Homo sapiens
cccauacaauguauguacaauac

SEQ ID NO: 2006488 - RNA, 19 nt, Homo sapiens
gccacauuucauugucuua

SEQ ID NO: 2006489 - RNA, 22 nt, Homo sapiens
ccuuauggccaauaacuuuuca

SEQ ID NO: 2006490 - RNA, 22 nt, Homo sapiens
uuacccuugagcugugugccac

SEQ ID NO: 2006491 - RNA, 16 nt, Homo sapiens
ugcagacaacaccuuc

SEQ ID NO: 2006492 - RNA, 18 nt, Homo sapiens
acccugccuuaucuugca

SEQ ID NO: 2006493 - RNA, 15 nt, Homo sapiens
agaccuuuggacuau

SEQ ID NO: 2006494 - RNA, 20 nt, Homo sapiens
cgacuuucuuuaacauauca

SEQ ID NO: 2006495 - RNA, 13 nt, Homo sapiens
gcacuucaucuga

SEQ ID NO: 2006496 - RNA, 20 nt, Homo sapiens
uccccagcauugcaguaugg

SEQ ID NO: 2006497 - RNA, 17 nt, Homo sapiens
cacagaauagcacaaac

SEQ ID NO: 2006498 - RNA, 22 nt, Homo sapiens
uuucaggauuauuuuaauuaau

SEQ ID NO: 2006499 - RNA, 15 nt, Homo sapiens
uggaagauagcugug

SEQ ID NO: 2006500 - RNA, 16 nt, Homo sapiens
ccaagcuccucaauca

SEQ ID NO: 2006501 - RNA, 20 nt, Homo sapiens
cucuguccgagugugccaca

SEQ ID NO: 2006502 - RNA, 17 nt, Homo sapiens
cauuauuucuaccauua

SEQ ID NO: 2006503 - RNA, 19 nt, Homo sapiens
ucaucugggggaguggaau

SEQ ID NO: 2006504 - RNA, 22 nt, Homo sapiens
ugccuagcaagcuggccucuac

SEQ ID NO: 2006505 - RNA, 22 nt, Homo sapiens
ccuaauaaauauuuagucugca

SEQ ID NO: 2006506 - RNA, 20 nt, Homo sapiens
gagccauagcugaucauguc

SEQ ID NO: 2006507 - RNA, 20 nt, Homo sapiens
aauagaaagaaaaauuggaa

SEQ ID NO: 2006508 - RNA, 16 nt, Homo sapiens
cagcuggggggcaccg

SEQ ID NO: 2006509 - RNA, 16 nt, Homo sapiens
gcucccaaaacauuuu

SEQ ID NO: 2006510 - RNA, 21 nt, Homo sapiens
aauccauccaaaguucccuau

SEQ ID NO: 2006511 - RNA, 18 nt, Homo sapiens
agacaggguuucaccaug

SEQ ID NO: 2006512 - RNA, 18 nt, Homo sapiens
ucacuucucacaaugucc

SEQ ID NO: 2006513 - RNA, 13 nt, Homo sapiens
cccggguacucag

SEQ ID NO: 2006514 - RNA, 13 nt, Homo sapiens
ucuaaguauuuga

SEQ ID NO: 2006515 - RNA, 14 nt, Homo sapiens
uuucccuuugccac

SEQ ID NO: 2006516 - RNA, 21 nt, Homo sapiens
cuguuccccucugcuacuagc

SEQ ID NO: 2006517 - RNA, 14 nt, Homo sapiens
uccuuacaauguga

SEQ ID NO: 2006518 - RNA, 12 nt, Homo sapiens
caugaaccacca

SEQ ID NO: 2006519 - RNA, 21 nt, Homo sapiens
aagacgauuugucaguuauuu

SEQ ID NO: 2006520 - RNA, 17 nt, Homo sapiens
augcucagaagccaguc

SEQ ID NO: 2006521 - RNA, 20 nt, Homo sapiens
aucuguuaccagaggacaaa

SEQ ID NO: 2006522 - RNA, 13 nt, Homo sapiens
uuaugcugugaca

SEQ ID NO: 2006523 - RNA, 13 nt, Homo sapiens
aauaaauguugcu

SEQ ID NO: 2006524 - RNA, 15 nt, Homo sapiens
aaucaaauugcuaca

SEQ ID NO: 2006525 - RNA, 17 nt, Homo sapiens
agccaagagucauguca

SEQ ID NO: 2006526 - RNA, 20 nt, Homo sapiens
uggcagagucagcugcugac

SEQ ID NO: 2006527 - RNA, 18 nt, Homo sapiens
ugucucaacuacucagcu

SEQ ID NO: 2006528 - RNA, 16 nt, Homo sapiens
cucucuccaucagagg

SEQ ID NO: 2006529 - RNA, 13 nt, Homo sapiens
aggucccugacau

SEQ ID NO: 2006530 - RNA, 15 nt, Homo sapiens
ggcugaauugggagu

SEQ ID NO: 2006531 - RNA, 14 nt, Homo sapiens
aaauugaacaaaga

SEQ ID NO: 2006532 - RNA, 22 nt, Homo sapiens
gcaaugaauccccaauaauugc

SEQ ID NO: 2006533 - RNA, 19 nt, Homo sapiens
ccccacacccgugucaugu

SEQ ID NO: 2006534 - RNA, 18 nt, Homo sapiens
auuaguacuuauguugca

SEQ ID NO: 2006535 - RNA, 16 nt, Homo sapiens
caaaccccugcagaua

SEQ ID NO: 2006536 - RNA, 15 nt, Homo sapiens
cauucacgggacuag

SEQ ID NO: 2006537 - RNA, 23 nt, Homo sapiens
cuuuucacugcuggcugccuuag

SEQ ID NO: 2006538 - RNA, 16 nt, Homo sapiens
aaguaaauuaggcagu

SEQ ID NO: 2006539 - RNA, 18 nt, Homo sapiens
gcucaguuggugcugcuu

SEQ ID NO: 2006540 - RNA, 15 nt, Homo sapiens
aacugcacaaugcau

SEQ ID NO: 2006541 - RNA, 21 nt, Homo sapiens
uuuguccuguuuucuacaggu

SEQ ID NO: 2006542 - RNA, 19 nt, Homo sapiens
auuuccaaaccuccacugc

SEQ ID NO: 2006543 - RNA, 20 nt, Homo sapiens
acaaccuagggugccuuaaa

SEQ ID NO: 2006544 - RNA, 19 nt, Homo sapiens
acugcacuccagccuggca

SEQ ID NO: 2006545 - RNA, 19 nt, Homo sapiens
auugcacucuagccuggca

SEQ ID NO: 2006546 - RNA, 22 nt, Homo sapiens
ugcccggccggagaacaucugc

SEQ ID NO: 2006547 - RNA, 14 nt, Homo sapiens
auguuauaucauau

SEQ ID NO: 2006548 - RNA, 17 nt, Homo sapiens
uugcugaucuuuucuaa

SEQ ID NO: 2006549 - RNA, 12 nt, Homo sapiens
ccuccauuugca

SEQ ID NO: 2006550 - RNA, 13 nt, Homo sapiens
ucugcacacucca

SEQ ID NO: 2006551 - RNA, 20 nt, Homo sapiens
ucuuagauauucacuaagga

SEQ ID NO: 2006552 - RNA, 17 nt, Homo sapiens
ccuuaugguacacucca

SEQ ID NO: 2006553 - RNA, 19 nt, Homo sapiens
gacucuggucauagaaaca

SEQ ID NO: 2006554 - RNA, 17 nt, Homo sapiens
aggaaaaaaaaacagcc

SEQ ID NO: 2006555 - RNA, 15 nt, Homo sapiens
aggcucuuccuugaa

SEQ ID NO: 2006556 - RNA, 23 nt, Homo sapiens
gauuaaacgugcagacuaugcaa

SEQ ID NO: 2006557 - RNA, 16 nt, Homo sapiens
uacucugcacuggugu

SEQ ID NO: 2006558 - RNA, 19 nt, Homo sapiens
acaagacccaaaaggcaga

SEQ ID NO: 2006559 - RNA, 18 nt, Homo sapiens
uggaaaaugcaaaagcac

SEQ ID NO: 2006560 - RNA, 18 nt, Homo sapiens
uguucauguuacucauga

SEQ ID NO: 2006561 - RNA, 23 nt, Homo sapiens
ggcuguccauggcagcuggucuu

SEQ ID NO: 2006562 - RNA, 14 nt, Homo sapiens
agccacagaccacc

SEQ ID NO: 2006563 - RNA, 22 nt, Homo sapiens
aggcagagguugcagugagcua

SEQ ID NO: 2006564 - RNA, 14 nt, Homo sapiens
ccccaguccaugcu

SEQ ID NO: 2006565 - RNA, 16 nt, Homo sapiens
uucugcugaccaaaug

SEQ ID NO: 2006566 - RNA, 21 nt, Homo sapiens
uggggagaggugugugacguu

SEQ ID NO: 2006567 - RNA, 23 nt, Homo sapiens
aagaugauggcucauuuacacuc

SEQ ID NO: 2006568 - RNA, 13 nt, Homo sapiens
ugcaugugcugca

SEQ ID NO: 2006569 - RNA, 22 nt, Homo sapiens
gaacuuacauacuaggugccuu

SEQ ID NO: 2006570 - RNA, 13 nt, Homo sapiens
auggcucccaagg

SEQ ID NO: 2006571 - RNA, 12 nt, Homo sapiens
ccacacacugag

SEQ ID NO: 2006572 - RNA, 18 nt, Homo sapiens
aagccccauuuccucaca

SEQ ID NO: 2006573 - RNA, 18 nt, Homo sapiens
augaccucucuacuuccc

SEQ ID NO: 2006574 - RNA, 17 nt, Homo sapiens
ucuucacuggcuuccau

SEQ ID NO: 2006575 - RNA, 16 nt, Homo sapiens
ugcccugacccuucca

SEQ ID NO: 2006576 - RNA, 22 nt, Homo sapiens
cuuucccagucccauuccucag

SEQ ID NO: 2006577 - RNA, 12 nt, Homo sapiens
aaagcuuuauga

SEQ ID NO: 2006578 - RNA, 21 nt, Homo sapiens
cuguaagauuguccagugcaa

SEQ ID NO: 2006579 - RNA, 15 nt, Homo sapiens
aaucuuuuacauuuu

SEQ ID NO: 2006580 - RNA, 17 nt, Homo sapiens
gaacagaaggaugaaug

SEQ ID NO: 2006581 - RNA, 20 nt, Homo sapiens
ucacaagcaugaagugcugu

SEQ ID NO: 2006582 - RNA, 22 nt, Homo sapiens
agaagacacaggaaacaaugua

SEQ ID NO: 2006583 - RNA, 21 nt, Homo sapiens
ccucuggccaaauaugcacuu

SEQ ID NO: 2006584 - RNA, 20 nt, Homo sapiens
auucccuuaaugguguuguu

SEQ ID NO: 2006585 - RNA, 12 nt, Homo sapiens
ccaguaguggga

SEQ ID NO: 2006586 - RNA, 22 nt, Homo sapiens
ucccacccugagauugggcaug

SEQ ID NO: 2006587 - RNA, 21 nt, Homo sapiens
agacguccuccguccauauca

SEQ ID NO: 2006588 - RNA, 13 nt, Homo sapiens
cuuagagggguga

SEQ ID NO: 2006589 - RNA, 12 nt, Homo sapiens
aaucauugucag

SEQ ID NO: 2006590 - RNA, 21 nt, Homo sapiens
augcugucccugcacugugcc

SEQ ID NO: 2006591 - RNA, 14 nt, Homo sapiens
ccaaaacauccacu

SEQ ID NO: 2006592 - RNA, 14 nt, Homo sapiens
gaaggaaccugugu

SEQ ID NO: 2006593 - RNA, 18 nt, Homo sapiens
aggcaucagguuguuaga

SEQ ID NO: 2006594 - RNA, 23 nt, Homo sapiens
gaacccgggagguggagauugca

SEQ ID NO: 2006595 - RNA, 19 nt, Homo sapiens
agaagaaaggcauugcaca

SEQ ID NO: 2006596 - RNA, 18 nt, Homo sapiens
ggacggcugugggaccag

SEQ ID NO: 2006597 - RNA, 21 nt, Homo sapiens
aucuucacaauauccaaugaa

SEQ ID NO: 2006598 - RNA, 10 nt, Homo sapiens
uuaccaaagc

SEQ ID NO: 2006599 - RNA, 20 nt, Homo sapiens
acaccuguaaucccagcaca

SEQ ID NO: 2006600 - RNA, 22 nt, Homo sapiens
ggaaagaugguguggguguccu

SEQ ID NO: 2006601 - RNA, 22 nt, Homo sapiens
uacugaacaugggagcucuuga

SEQ ID NO: 2006602 - RNA, 15 nt, Homo sapiens
cucaguucagaauca

SEQ ID NO: 2006603 - RNA, 17 nt, Homo sapiens
agucaaaaggugccugu

SEQ ID NO: 2006604 - RNA, 18 nt, Homo sapiens
acucuggccacccaaaca

SEQ ID NO: 2006605 - RNA, 17 nt, Homo sapiens
uagccugaaaauccaaa

SEQ ID NO: 2006606 - RNA, 16 nt, Homo sapiens
gaaaguucaacuucca

SEQ ID NO: 2006607 - RNA, 14 nt, Homo sapiens
gccuauaauacuug

SEQ ID NO: 2006608 - RNA, 19 nt, Homo sapiens
cccacguccugucagugcc

SEQ ID NO: 2006609 - RNA, 14 nt, Homo sapiens
uauccucuugccaa

SEQ ID NO: 2006610 - RNA, 13 nt, Homo sapiens
uuauaaacugacu

SEQ ID NO: 2006611 - RNA, 15 nt, Homo sapiens
cuuucuguucuccag

SEQ ID NO: 2006612 - RNA, 12 nt, Homo sapiens
uguugcaccuga

SEQ ID NO: 2006613 - RNA, 12 nt, Homo sapiens
cugugcacugua

SEQ ID NO: 2006614 - RNA, 18 nt, Homo sapiens
gcagauacauucaugagg

SEQ ID NO: 2006615 - RNA, 22 nt, Homo sapiens
gaagcacuagugcugccauuaa

SEQ ID NO: 2006616 - RNA, 17 nt, Homo sapiens
ucacuguaaaugguaau

SEQ ID NO: 2006617 - RNA, 20 nt, Homo sapiens
gcguccuggggccugugcac

SEQ ID NO: 2006618 - RNA, 18 nt, Homo sapiens
caaaaacaaaaaacugca

SEQ ID NO: 2006619 - RNA, 22 nt, Homo sapiens
uaaaugugccuauuggugucua

SEQ ID NO: 2006620 - RNA, 20 nt, Homo sapiens
acauguaauccuaaauuuac

SEQ ID NO: 2006621 - RNA, 22 nt, Homo sapiens
ugaaggaugcggcaggugcucu

SEQ ID NO: 2006622 - RNA, 21 nt, Homo sapiens
acaguccuguccucuggauca

SEQ ID NO: 2006623 - RNA, 21 nt, Homo sapiens
gcaccuuaagauuuugcaccu

SEQ ID NO: 2006624 - RNA, 18 nt, Homo sapiens
caaaacugcuuugugcau

SEQ ID NO: 2006625 - RNA, 13 nt, Homo sapiens
augauaugaccag

SEQ ID NO: 2006626 - RNA, 20 nt, Homo sapiens
uaaauggcauggaguauagu

SEQ ID NO: 2006627 - RNA, 23 nt, Homo sapiens
uguauauuuucugugcagccacu

SEQ ID NO: 2006628 - RNA, 18 nt, Homo sapiens
guggggcaggagugccag

SEQ ID NO: 2006629 - RNA, 16 nt, Homo sapiens
ugguccacauucugcu

SEQ ID NO: 2006630 - RNA, 15 nt, Homo sapiens
cucuucaagcuugaa

SEQ ID NO: 2006631 - RNA, 13 nt, Homo sapiens
ucuguaacuguca

SEQ ID NO: 2006632 - RNA, 21 nt, Homo sapiens
ugguuuacauuuaaagcauug

SEQ ID NO: 2006633 - RNA, 20 nt, Homo sapiens
guuuucuggaaguuuccuca

SEQ ID NO: 2006634 - RNA, 23 nt, Homo sapiens
ugccucccacccuucucagggac

SEQ ID NO: 2006635 - RNA, 18 nt, Homo sapiens
agaaugugggauauuucc

SEQ ID NO: 2006636 - RNA, 15 nt, Homo sapiens
gcauuuccagacuug

SEQ ID NO: 2006637 - RNA, 12 nt, Homo sapiens
uuucauugcaaa

SEQ ID NO: 2006638 - RNA, 20 nt, Homo sapiens
uuucuggguguguccagggg

SEQ ID NO: 2006639 - RNA, 19 nt, Homo sapiens
uucuuacccuguccuccac

SEQ ID NO: 2006640 - RNA, 13 nt, Homo sapiens
aacaaacccaggu

SEQ ID NO: 2006641 - RNA, 14 nt, Homo sapiens
acccagguucauga

SEQ ID NO: 2006642 - RNA, 21 nt, Homo sapiens
uuaauaacuuguccuauguca

SEQ ID NO: 2006643 - RNA, 22 nt, Homo sapiens
ugaaggcuuuaauaaaggccac

SEQ ID NO: 2006644 - RNA, 20 nt, Homo sapiens
aggcgggaggaucacuugag

SEQ ID NO: 2006645 - RNA, 17 nt, Homo sapiens
gguuugugauccaggaa

SEQ ID NO: 2006646 - RNA, 17 nt, Homo sapiens
acacaguauuacuucug

SEQ ID NO: 2006647 - RNA, 17 nt, Homo sapiens
uggggcugcuccccuaa

SEQ ID NO: 2006648 - RNA, 22 nt, Homo sapiens
cccacuugggccacacuaccca

SEQ ID NO: 2006649 - RNA, 17 nt, Homo sapiens
auuuaucugagcaauaa

SEQ ID NO: 2006650 - RNA, 15 nt, Homo sapiens
caagccugcaugcau

SEQ ID NO: 2006651 - RNA, 15 nt, Homo sapiens
cuaaaagcacacuca

SEQ ID NO: 2006652 - RNA, 19 nt, Homo sapiens
cugugggugcuaaggguaa

SEQ ID NO: 2006653 - RNA, 20 nt, Homo sapiens
uugagaaagaagagaagaag

SEQ ID NO: 2006654 - RNA, 22 nt, Homo sapiens
ugaagagauuucaacaagaaua

SEQ ID NO: 2006655 - RNA, 17 nt, Homo sapiens
aagggaagcuucuugcu

SEQ ID NO: 2006656 - RNA, 13 nt, Homo sapiens
cuugaacccaaga

SEQ ID NO: 2006657 - RNA, 21 nt, Homo sapiens
aagugaagagggagaagggau

SEQ ID NO: 2006658 - RNA, 22 nt, Homo sapiens
uccucacacacccugaggucag

SEQ ID NO: 2006659 - RNA, 22 nt, Homo sapiens
ggccuuggacaacugcauggag

SEQ ID NO: 2006660 - RNA, 13 nt, Homo sapiens
cgcgcaccgccca

SEQ ID NO: 2006661 - RNA, 16 nt, Homo sapiens
caugggcauauucuga

SEQ ID NO: 2006662 - RNA, 20 nt, Homo sapiens
ugucagugggccucauggua

SEQ ID NO: 2006663 - RNA, 24 nt, Homo sapiens
gcacaugagucgcacauguauugc

SEQ ID NO: 2006664 - RNA, 18 nt, Homo sapiens
ucaaguggacagugaaug

SEQ ID NO: 2006665 - RNA, 18 nt, Homo sapiens
ccaaugcacacacacaga

SEQ ID NO: 2006666 - RNA, 20 nt, Homo sapiens
agaaaaaugcuguuuauuca

SEQ ID NO: 2006667 - RNA, 23 nt, Homo sapiens
cugccggcucuaguaccuuuuca

SEQ ID NO: 2006668 - RNA, 15 nt, Homo sapiens
gcaauaauugacaaa

SEQ ID NO: 2006669 - RNA, 20 nt, Homo sapiens
aucacugauugggugccaug

SEQ ID NO: 2006670 - RNA, 23 nt, Homo sapiens
auaagaaccuuuugagugccuua

SEQ ID NO: 2006671 - RNA, 17 nt, Homo sapiens
uucauacagcacuacuu

SEQ ID NO: 2006672 - RNA, 22 nt, Homo sapiens
cuuuaagaagcaguguuuuaga

SEQ ID NO: 2006673 - RNA, 17 nt, Homo sapiens
ucagccuugaaaaacaa

SEQ ID NO: 2006674 - RNA, 17 nt, Homo sapiens
ccuuucccuacuccaug

SEQ ID NO: 2006675 - RNA, 14 nt, Homo sapiens
acugucaguucucu

SEQ ID NO: 2006676 - RNA, 23 nt, Homo sapiens
aaauaguugcugucauccacuuu

SEQ ID NO: 2006677 - RNA, 18 nt, Homo sapiens
gacaaaauccaucaggga

SEQ ID NO: 2006678 - RNA, 15 nt, Homo sapiens
auauaaccauuacau

SEQ ID NO: 2006679 - RNA, 16 nt, Homo sapiens
caaaaugaaccuugcu

SEQ ID NO: 2006680 - RNA, 14 nt, Homo sapiens
gcccugccaugcuc

SEQ ID NO: 2006681 - RNA, 11 nt, Homo sapiens
acuugugcacu

SEQ ID NO: 2006682 - RNA, 20 nt, Homo sapiens
uguuaaaauaagaacaaaga

SEQ ID NO: 2006683 - RNA, 13 nt, Homo sapiens
uccugaccaaaga

SEQ ID NO: 2006684 - RNA, 19 nt, Homo sapiens
gaggccccugucucagggu

SEQ ID NO: 2006685 - RNA, 16 nt, Homo sapiens
acucaauacuaccucu

SEQ ID NO: 2006686 - RNA, 17 nt, Homo sapiens
cauggacuguugccacc

SEQ ID NO: 2006687 - RNA, 17 nt, Homo sapiens
ugucccugagcagcuua

SEQ ID NO: 2006688 - RNA, 19 nt, Homo sapiens
aaaaauauuguuucugcau

SEQ ID NO: 2006689 - RNA, 21 nt, Homo sapiens
cugucuucagucucacagaga

SEQ ID NO: 2006690 - RNA, 14 nt, Homo sapiens
gaaagaaaaugucu

SEQ ID NO: 2006691 - RNA, 12 nt, Homo sapiens
agaagugcuuua

SEQ ID NO: 2006692 - RNA, 18 nt, Homo sapiens
ccaaugccaaaaggauaa

SEQ ID NO: 2006693 - RNA, 21 nt, Homo sapiens
gccucauauuguccucugcaa

SEQ ID NO: 2006694 - RNA, 19 nt, Homo sapiens
cacaaaggagugagugaaa

SEQ ID NO: 2006695 - RNA, 15 nt, Homo sapiens
uaguuggaaacaaau

SEQ ID NO: 2006696 - RNA, 20 nt, Homo sapiens
ugcagaauucaaaagugauu

SEQ ID NO: 2006697 - RNA, 23 nt, Homo sapiens
gauuaccgacacugucacuugac

SEQ ID NO: 2006698 - RNA, 16 nt, Homo sapiens
guaacuggaacacacu

SEQ ID NO: 2006699 - RNA, 13 nt, Homo sapiens
gcuuugguuuaaa

SEQ ID NO: 2006700 - RNA, 22 nt, Homo sapiens
acuauuccaucaauaggcaaaa

SEQ ID NO: 2006701 - RNA, 16 nt, Homo sapiens
gcuauaccagcagaaa

SEQ ID NO: 2006702 - RNA, 18 nt, Homo sapiens
aguccuggagcaaucaca

SEQ ID NO: 2006703 - RNA, 15 nt, Homo sapiens
augugaaaucauuca

SEQ ID NO: 2006704 - RNA, 15 nt, Homo sapiens
caacauggcacaugu

SEQ ID NO: 2006705 - RNA, 19 nt, Homo sapiens
acuaccuacugguguaauc

SEQ ID NO: 2006706 - RNA, 19 nt, Homo sapiens
agcuucccugaacacucau

SEQ ID NO: 2006707 - RNA, 15 nt, Homo sapiens
ugcugucccuauaca

SEQ ID NO: 2006708 - RNA, 17 nt, Homo sapiens
uaccuccuguguggaag

SEQ ID NO: 2006709 - RNA, 19 nt, Homo sapiens
uguccaggcuggagugcaa

SEQ ID NO: 2006710 - RNA, 18 nt, Homo sapiens
uacugggaaucaagacaa

SEQ ID NO: 2006711 - RNA, 13 nt, Homo sapiens
ccaacacccugag

SEQ ID NO: 2006712 - RNA, 23 nt, Homo sapiens
ccuagagucuuaaagcauuucag

SEQ ID NO: 2006713 - RNA, 15 nt, Homo sapiens
auauggaauuuugca

SEQ ID NO: 2006714 - RNA, 21 nt, Homo sapiens
uguaaauccuagacuugaaag

SEQ ID NO: 2006715 - RNA, 13 nt, Homo sapiens
aagugaggaugaa

SEQ ID NO: 2006716 - RNA, 22 nt, Homo sapiens
ugagcaaggagcacaagccaca

SEQ ID NO: 2006717 - RNA, 14 nt, Homo sapiens
uugaagaaucucuc

SEQ ID NO: 2006718 - RNA, 15 nt, Homo sapiens
gcuucccuccuucau

SEQ ID NO: 2006719 - RNA, 21 nt, Homo sapiens
ccacauauuuuagacacuucc

SEQ ID NO: 2006720 - RNA, 13 nt, Homo sapiens
aguagacauuuau

SEQ ID NO: 2006721 - RNA, 17 nt, Homo sapiens
cauucaaaaaccugguu

SEQ ID NO: 2006722 - RNA, 22 nt, Homo sapiens
uucacacugccagcguuaacag

SEQ ID NO: 2006723 - RNA, 16 nt, Homo sapiens
gauuuucauguugaug

SEQ ID NO: 2006724 - RNA, 12 nt, Homo sapiens
aaaauaguaaaa

SEQ ID NO: 2006725 - RNA, 15 nt, Homo sapiens
acaugcacgugugug

SEQ ID NO: 2006726 - RNA, 15 nt, Homo sapiens
cucauuugcucuuca

SEQ ID NO: 2006727 - RNA, 19 nt, Homo sapiens
auuuucuugaauggcaugc

SEQ ID NO: 2006728 - RNA, 15 nt, Homo sapiens
caggagcacuacaga

SEQ ID NO: 2006729 - RNA, 17 nt, Homo sapiens
uguccucuuugugauaa

SEQ ID NO: 2006730 - RNA, 17 nt, Homo sapiens
aauuacuaauuguaaaa

SEQ ID NO: 2006731 - RNA, 18 nt, Homo sapiens
gaucaucgccagaggugc

SEQ ID NO: 2006732 - RNA, 20 nt, Homo sapiens
ggaaccauguauaugagcuu

SEQ ID NO: 2006733 - RNA, 15 nt, Homo sapiens
agaggacagcuuccc

SEQ ID NO: 2006734 - RNA, 22 nt, Homo sapiens
caggcugaaauuucuuguucau

SEQ ID NO: 2006735 - RNA, 20 nt, Homo sapiens
gacuuagaggcaacaggauu

SEQ ID NO: 2006736 - RNA, 21 nt, Homo sapiens
uagagaggacaauacuggggu

SEQ ID NO: 2006737 - RNA, 21 nt, Homo sapiens
cccucugggggcucuggccaa

SEQ ID NO: 2006738 - RNA, 23 nt, Homo sapiens
auuucaccuugaaaaagcaccaa

SEQ ID NO: 2006739 - RNA, 18 nt, Homo sapiens
ucaggagcuagagccauu

SEQ ID NO: 2006740 - RNA, 23 nt, Homo sapiens
ugccuagagucuuucuccauuau

SEQ ID NO: 2006741 - RNA, 14 nt, Homo sapiens
gccaugauguauau

SEQ ID NO: 2006742 - RNA, 21 nt, Homo sapiens
ucuugaaguagacauggaauu

SEQ ID NO: 2006743 - RNA, 23 nt, Homo sapiens
gacaucaaagugguaaauacugu

SEQ ID NO: 2006744 - RNA, 19 nt, Homo sapiens
auacaaugguuaaaaucac

SEQ ID NO: 2006745 - RNA, 15 nt, Homo sapiens
agagcagaguuuacg

SEQ ID NO: 2006746 - RNA, 21 nt, Homo sapiens
acugcuucuaccaacuggaag

SEQ ID NO: 2006747 - RNA, 14 nt, Homo sapiens
uaaauaaaacugug

SEQ ID NO: 2006748 - RNA, 22 nt, Homo sapiens
cgaguacugggacaaccucauc

SEQ ID NO: 2006749 - RNA, 17 nt, Homo sapiens
uggugcaaacacagcuc

SEQ ID NO: 2006750 - RNA, 23 nt, Homo sapiens
ugaggcugugcaccuauucugua

SEQ ID NO: 2006751 - RNA, 22 nt, Homo sapiens
gucaacuggagugcucucucag

SEQ ID NO: 2006752 - RNA, 17 nt, Homo sapiens
cuucucaagugccuuaa

SEQ ID NO: 2006753 - RNA, 16 nt, Homo sapiens
uaaauauagagaugug

SEQ ID NO: 2006754 - RNA, 21 nt, Homo sapiens
gccacacuggucacaggcaaa

SEQ ID NO: 2006755 - RNA, 15 nt, Homo sapiens
aaggcucccuguccu

SEQ ID NO: 2006756 - RNA, 20 nt, Homo sapiens
ugcccccgcggguucuagac

SEQ ID NO: 2006757 - RNA, 12 nt, Homo sapiens
ugcccaucaucu

SEQ ID NO: 2006758 - RNA, 14 nt, Homo sapiens
ugcuuaaugccaga

SEQ ID NO: 2006759 - RNA, 21 nt, Homo sapiens
uuccuccuaaauuuccagggg

SEQ ID NO: 2006760 - RNA, 19 nt, Homo sapiens
agcaagaucccaucucuuu

SEQ ID NO: 2006761 - RNA, 15 nt, Homo sapiens
ucugauauucaccua

SEQ ID NO: 2006762 - RNA, 19 nt, Homo sapiens
ugcucuggggcacuguuga

SEQ ID NO: 2006763 - RNA, 14 nt, Homo sapiens
aauauucagagaaa

SEQ ID NO: 2006764 - RNA, 19 nt, Homo sapiens
uucagaaagcuucaaauua

SEQ ID NO: 2006765 - RNA, 13 nt, Homo sapiens
gaaugcuaaacag

SEQ ID NO: 2006766 - RNA, 18 nt, Homo sapiens
auuuaaaaaaaaaccuga

SEQ ID NO: 2006767 - RNA, 17 nt, Homo sapiens
agucagaagaucuuucu

SEQ ID NO: 2006768 - RNA, 19 nt, Homo sapiens
caaaagagaaaaacaaaac

SEQ ID NO: 2006769 - RNA, 20 nt, Homo sapiens
guugcaaaucacucugcaau

SEQ ID NO: 2006770 - RNA, 23 nt, Homo sapiens
uuacauugagcgugaccuugcaa

SEQ ID NO: 2006771 - RNA, 12 nt, Homo sapiens
guggauguauaa

SEQ ID NO: 2006772 - RNA, 17 nt, Homo sapiens
cagagugacauccagga

SEQ ID NO: 2006773 - RNA, 18 nt, Homo sapiens
ccagguagcucggcacca

SEQ ID NO: 2006774 - RNA, 20 nt, Homo sapiens
augugaucacuuucaggugg

SEQ ID NO: 2006775 - RNA, 18 nt, Homo sapiens
acaggagcugccauguca

SEQ ID NO: 2006776 - RNA, 18 nt, Homo sapiens
uccuacuggucucucuau

SEQ ID NO: 2006777 - RNA, 17 nt, Homo sapiens
aagaaaagauauguauu

SEQ ID NO: 2006778 - RNA, 21 nt, Homo sapiens
guuuucaaauaacgauuuuau

SEQ ID NO: 2006779 - RNA, 23 nt, Homo sapiens
cauuguguggucauaucuaguca

SEQ ID NO: 2006780 - RNA, 22 nt, Homo sapiens
ugugcacggcagcuugagccug

SEQ ID NO: 2006781 - RNA, 23 nt, Homo sapiens
gaguggcuucacuccugcuguaa

SEQ ID NO: 2006782 - RNA, 13 nt, Homo sapiens
ggcucugaugaaa

SEQ ID NO: 2006783 - RNA, 18 nt, Homo sapiens
cuggcuucuacacugggu

SEQ ID NO: 2006784 - RNA, 16 nt, Homo sapiens
ccggccaggugccucc

SEQ ID NO: 2006785 - RNA, 16 nt, Homo sapiens
gcauuugucaacaaag

SEQ ID NO: 2006786 - RNA, 17 nt, Homo sapiens
ugggaucgugcauuuga

SEQ ID NO: 2006787 - RNA, 17 nt, Homo sapiens
cuaucuuuucuggauga

SEQ ID NO: 2006788 - RNA, 19 nt, Homo sapiens
aaugucauugccauacagc

SEQ ID NO: 2006789 - RNA, 22 nt, Homo sapiens
agaguucacccugugcccuccg

SEQ ID NO: 2006790 - RNA, 19 nt, Homo sapiens
acaugguaauuaugugaua

SEQ ID NO: 2006791 - RNA, 16 nt, Homo sapiens
gucacuaaacucucau

SEQ ID NO: 2006792 - RNA, 14 nt, Homo sapiens
uuaugcaagcacaa

SEQ ID NO: 2006793 - RNA, 13 nt, Homo sapiens
acuguuuucccaa

SEQ ID NO: 2006794 - RNA, 21 nt, Homo sapiens
uucuuggagggcccacuugua

SEQ ID NO: 2006795 - RNA, 21 nt, Homo sapiens
gcccaugccuccagcuacaaa

SEQ ID NO: 2006796 - RNA, 14 nt, Homo sapiens
caaagacuauuccc

SEQ ID NO: 2006797 - RNA, 14 nt, Homo sapiens
gauugccaaauuga

SEQ ID NO: 2006798 - RNA, 15 nt, Homo sapiens
caggaaaugcugacc

SEQ ID NO: 2006799 - RNA, 14 nt, Homo sapiens
cucagcucuuccau

SEQ ID NO: 2006800 - RNA, 22 nt, Homo sapiens
uugagacuccucaguucuugcc

SEQ ID NO: 2006801 - RNA, 21 nt, Homo sapiens
ugcuugaguggacagcagcug

SEQ ID NO: 2006802 - RNA, 17 nt, Homo sapiens
agccuucagcagcagcu

SEQ ID NO: 2006803 - RNA, 16 nt, Homo sapiens
gcccuuuccuuccaga

SEQ ID NO: 2006804 - RNA, 12 nt, Homo sapiens
cccugugugaca

SEQ ID NO: 2006805 - RNA, 23 nt, Homo sapiens
accucucugaacugcaacacugg

SEQ ID NO: 2006806 - RNA, 21 nt, Homo sapiens
ccgugucucgcgcgacugaga

SEQ ID NO: 2006807 - RNA, 15 nt, Homo sapiens
gccggcgacucccca

SEQ ID NO: 2006808 - RNA, 19 nt, Homo sapiens
ggaaagcauggcucauucu

SEQ ID NO: 2006809 - RNA, 18 nt, Homo sapiens
caaaugugugcccagcuu

SEQ ID NO: 2006810 - RNA, 20 nt, Homo sapiens
auggccagugugaucccaag

SEQ ID NO: 2006811 - RNA, 23 nt, Homo sapiens
aaggcauguggccuuuaucucaa

SEQ ID NO: 2006812 - RNA, 16 nt, Homo sapiens
auauucagaaaauacu

SEQ ID NO: 2006813 - RNA, 17 nt, Homo sapiens
acuucaggagaacucau

SEQ ID NO: 2006814 - RNA, 22 nt, Homo sapiens
uaugauuguccguaggcccaua

SEQ ID NO: 2006815 - RNA, 15 nt, Homo sapiens
ugaugauccuucaga

SEQ ID NO: 2006816 - RNA, 21 nt, Homo sapiens
acaggcugaaauuucuuguuc

SEQ ID NO: 2006817 - RNA, 14 nt, Homo sapiens
accuaauacagcag

SEQ ID NO: 2006818 - RNA, 18 nt, Homo sapiens
aguaaccaaaacagcaua

SEQ ID NO: 2006819 - RNA, 22 nt, Homo sapiens
agacggauuaucuagagaauaa

SEQ ID NO: 2006820 - RNA, 19 nt, Homo sapiens
aucaaaaauauuccaucca

SEQ ID NO: 2006821 - RNA, 14 nt, Homo sapiens
gaaucauggagaaa

SEQ ID NO: 2006822 - RNA, 15 nt, Homo sapiens
guggaauugugcuga

SEQ ID NO: 2006823 - RNA, 19 nt, Homo sapiens
uucauggugaaaauguacu

SEQ ID NO: 2006824 - RNA, 18 nt, Homo sapiens
caguggugcaaacacagc

SEQ ID NO: 2006825 - RNA, 18 nt, Homo sapiens
uggacagucucaccuccu

SEQ ID NO: 2006826 - RNA, 19 nt, Homo sapiens
auuuuuuuucagcagacua

SEQ ID NO: 2006827 - RNA, 22 nt, Homo sapiens
cuaauguacaauaaagcaaugu

SEQ ID NO: 2006828 - RNA, 11 nt, Homo sapiens
ucuucccgccg

SEQ ID NO: 2006829 - RNA, 15 nt, Homo sapiens
cuaaagagcuuuagu

SEQ ID NO: 2006830 - RNA, 16 nt, Homo sapiens
ugcuggggaacuggcg

SEQ ID NO: 2006831 - RNA, 13 nt, Homo sapiens
gagaggagccaga

SEQ ID NO: 2006832 - RNA, 22 nt, Homo sapiens
ugaccgggcucacuugcucaaa

SEQ ID NO: 2006833 - RNA, 23 nt, Homo sapiens
acccagaguagagccaggugcuu

SEQ ID NO: 2006834 - RNA, 15 nt, Homo sapiens
gggagaagugauaug

SEQ ID NO: 2006835 - RNA, 16 nt, Homo sapiens
acacaggaacucugug

SEQ ID NO: 2006836 - RNA, 19 nt, Homo sapiens
uccaaugaaugaucauuga

SEQ ID NO: 2006837 - RNA, 15 nt, Homo sapiens
gcauaguccaaaaag

SEQ ID NO: 2006838 - RNA, 22 nt, Homo sapiens
aucaagaaaugucucugcuccu

SEQ ID NO: 2006839 - RNA, 18 nt, Homo sapiens
aaggaggccacuuugaga

SEQ ID NO: 2006840 - RNA, 21 nt, Homo sapiens
aaggaggacgguuaacuugua

SEQ ID NO: 2006841 - RNA, 20 nt, Homo sapiens
cuuugcaaugcaagcccuuu

SEQ ID NO: 2006842 - RNA, 16 nt, Homo sapiens
cucuccacccaugacc

SEQ ID NO: 2006843 - RNA, 14 nt, Homo sapiens
cccagcacacggcu

SEQ ID NO: 2006844 - RNA, 15 nt, Homo sapiens
ggcugaacuuggaga

SEQ ID NO: 2006845 - RNA, 13 nt, Homo sapiens
acagcuccuggcc

SEQ ID NO: 2006846 - RNA, 15 nt, Homo sapiens
uccucucuuaggggg

SEQ ID NO: 2006847 - RNA, 18 nt, Homo sapiens
augguuggaaaacacuuu

SEQ ID NO: 2006848 - RNA, 17 nt, Homo sapiens
cacgacucuuccugcaa

SEQ ID NO: 2006849 - RNA, 18 nt, Homo sapiens
cugugggcuucagcacuu

SEQ ID NO: 2006850 - RNA, 22 nt, Homo sapiens
accuauagaaauagaacacugc

SEQ ID NO: 2006851 - RNA, 19 nt, Homo sapiens
uagaauacccuaaaguaua

SEQ ID NO: 2006852 - RNA, 15 nt, Homo sapiens
aggcaugguagcuca

SEQ ID NO: 2006853 - RNA, 15 nt, Homo sapiens
uaauauuuauugcuu

SEQ ID NO: 2006854 - RNA, 14 nt, Homo sapiens
uauuuauuagccaa

SEQ ID NO: 2006855 - RNA, 21 nt, Homo sapiens
aaucauuaauucacaugucca

SEQ ID NO: 2006856 - RNA, 18 nt, Homo sapiens
aacuauauaagacauuaa

SEQ ID NO: 2006857 - RNA, 18 nt, Homo sapiens
uuggccaggcugaucuca

SEQ ID NO: 2006858 - RNA, 13 nt, Homo sapiens
uuagcuacacccc

SEQ ID NO: 2006859 - RNA, 17 nt, Homo sapiens
gucuaauucccuguuau

SEQ ID NO: 2006860 - RNA, 17 nt, Homo sapiens
uaacuauugaguuacag

SEQ ID NO: 2006861 - RNA, 18 nt, Homo sapiens
uuuuauaccaaagccaau

SEQ ID NO: 2006862 - RNA, 17 nt, Homo sapiens
ugugggucugcagguga

SEQ ID NO: 2006863 - RNA, 15 nt, Homo sapiens
uggaauaucacccaa

SEQ ID NO: 2006864 - RNA, 19 nt, Homo sapiens
guaucuuuugaacuggcaa

SEQ ID NO: 2006865 - RNA, 23 nt, Homo sapiens
ccuucuuuugggggucaacaguu

SEQ ID NO: 2006866 - RNA, 14 nt, Homo sapiens
acuccugacuguaa

SEQ ID NO: 2006867 - RNA, 18 nt, Homo sapiens
acuccugaccucagguga

SEQ ID NO: 2006868 - RNA, 14 nt, Homo sapiens
uuguccuaugucaa

SEQ ID NO: 2006869 - RNA, 14 nt, Homo sapiens
aaaauguaugucug

SEQ ID NO: 2006870 - RNA, 21 nt, Homo sapiens
ccuggggagugguuaggcagc

SEQ ID NO: 2006871 - RNA, 13 nt, Homo sapiens
cuuguaucaauau

SEQ ID NO: 2006872 - RNA, 12 nt, Homo sapiens
gugaucuaagca

SEQ ID NO: 2006873 - RNA, 17 nt, Homo sapiens
agacagaaccuuguuau

SEQ ID NO: 2006874 - RNA, 22 nt, Homo sapiens
gccagacgugcuccugcugacc

SEQ ID NO: 2006875 - RNA, 13 nt, Homo sapiens
agugcgguuuacu

SEQ ID NO: 2006876 - RNA, 16 nt, Homo sapiens
uugggacccaaaacac

SEQ ID NO: 2006877 - RNA, 16 nt, Homo sapiens
gaaaauggaauugcuu

SEQ ID NO: 2006878 - RNA, 10 nt, Homo sapiens
ccuugcagca

SEQ ID NO: 2006879 - RNA, 14 nt, Homo sapiens
cuuaagugugcaaa

SEQ ID NO: 2006880 - RNA, 16 nt, Homo sapiens
aguuagcucauuugag

SEQ ID NO: 2006881 - RNA, 20 nt, Homo sapiens
ucccuucuaccugccacuca

SEQ ID NO: 2006882 - RNA, 15 nt, Homo sapiens
accaaacuacuucau

SEQ ID NO: 2006883 - RNA, 16 nt, Homo sapiens
cacuguauugcuccuc

SEQ ID NO: 2006884 - RNA, 19 nt, Homo sapiens
cugagcaaaaagaccagcc

SEQ ID NO: 2006885 - RNA, 14 nt, Homo sapiens
cccuguucuuugaa

SEQ ID NO: 2006886 - RNA, 21 nt, Homo sapiens
agaagaacguaaguuguacaa

SEQ ID NO: 2006887 - RNA, 22 nt, Homo sapiens
gaaguggagagggugucaucua

SEQ ID NO: 2006888 - RNA, 14 nt, Homo sapiens
uuccaggugcccag

SEQ ID NO: 2006889 - RNA, 14 nt, Homo sapiens
uucuuugugccuuu

SEQ ID NO: 2006890 - RNA, 23 nt, Homo sapiens
aaccagauguuagaucaggggag

SEQ ID NO: 2006891 - RNA, 18 nt, Homo sapiens
uguuuuggcugcucucca

SEQ ID NO: 2006892 - RNA, 15 nt, Homo sapiens
acaaaugguagcaua

SEQ ID NO: 2006893 - RNA, 19 nt, Homo sapiens
gcacaaaccuuacuaugga

SEQ ID NO: 2006894 - RNA, 16 nt, Homo sapiens
agcucuguccuguuag

SEQ ID NO: 2006895 - RNA, 13 nt, Homo sapiens
caaaugugcugcu

SEQ ID NO: 2006896 - RNA, 15 nt, Homo sapiens
cuuguuaccuuuccc

SEQ ID NO: 2006897 - RNA, 11 nt, Homo sapiens
ccaguuugcac

SEQ ID NO: 2006898 - RNA, 16 nt, Homo sapiens
auuuucaguaccaaag

SEQ ID NO: 2006899 - RNA, 21 nt, Homo sapiens
acgguuaaauacuguguggaa

SEQ ID NO: 2006900 - RNA, 13 nt, Homo sapiens
agucaauuucuac

SEQ ID NO: 2006901 - RNA, 22 nt, Homo sapiens
ugccugguucuuaagaaucacu

SEQ ID NO: 2006902 - RNA, 17 nt, Homo sapiens
uugauuuauauguguaa

SEQ ID NO: 2006903 - RNA, 21 nt, Homo sapiens
cucuacuaaaacuacaaaaau

SEQ ID NO: 2006904 - RNA, 21 nt, Homo sapiens
agcagcugggauuacaggugc

SEQ ID NO: 2006905 - RNA, 20 nt, Homo sapiens
gugugccuccuagagugcag

SEQ ID NO: 2006906 - RNA, 17 nt, Homo sapiens
aguguggacaugagcag

SEQ ID NO: 2006907 - RNA, 15 nt, Homo sapiens
caggagagacaggau

SEQ ID NO: 2006908 - RNA, 12 nt, Homo sapiens
guuuagauauau

SEQ ID NO: 2006909 - RNA, 20 nt, Homo sapiens
auuuuccaauaaaauuuuca

SEQ ID NO: 2006910 - RNA, 13 nt, Homo sapiens
agggggugugcgu

SEQ ID NO: 2006911 - RNA, 22 nt, Homo sapiens
acagauguacaauuuagcuuaa

SEQ ID NO: 2006912 - RNA, 18 nt, Homo sapiens
uugggucacgguggcagu

SEQ ID NO: 2006913 - RNA, 21 nt, Homo sapiens
ugcaaccucuuugcucaacag

SEQ ID NO: 2006914 - RNA, 14 nt, Homo sapiens
guaacaucugccau

SEQ ID NO: 2006915 - RNA, 23 nt, Homo sapiens
uacaguuaauuaugugcauauua

SEQ ID NO: 2006916 - RNA, 12 nt, Homo sapiens
uggcucugggcc

SEQ ID NO: 2006917 - RNA, 20 nt, Homo sapiens
gcccugugagggcucacucg

SEQ ID NO: 2006918 - RNA, 14 nt, Homo sapiens
guuuucaguggacu

SEQ ID NO: 2006919 - RNA, 14 nt, Homo sapiens
aggggaagaaggaa

SEQ ID NO: 2006920 - RNA, 17 nt, Homo sapiens
uugcagauaacuuugac

SEQ ID NO: 2006921 - RNA, 17 nt, Homo sapiens
gugcuuacacaucucag

SEQ ID NO: 2006922 - RNA, 22 nt, Homo sapiens
ucaaagugugacauucaguguu

SEQ ID NO: 2006923 - RNA, 17 nt, Homo sapiens
aauuccauagcucaaua

SEQ ID NO: 2006924 - RNA, 19 nt, Homo sapiens
aaaucauacuuugccaaau

SEQ ID NO: 2006925 - RNA, 22 nt, Homo sapiens
ucacauuguacuuaaaccuccu

SEQ ID NO: 2006926 - RNA, 19 nt, Homo sapiens
cuagcuagaaauaugauuu

SEQ ID NO: 2006927 - RNA, 22 nt, Homo sapiens
ugcauuucauauuauuuuagug

SEQ ID NO: 2006928 - RNA, 12 nt, Homo sapiens
caccacagccuc

SEQ ID NO: 2006929 - RNA, 18 nt, Homo sapiens
aaauuauauuuugaacaa

SEQ ID NO: 2006930 - RNA, 21 nt, Homo sapiens
cgcuggccugcuuuacguauu

SEQ ID NO: 2006931 - RNA, 13 nt, Homo sapiens
acacuaaucacaa

SEQ ID NO: 2006932 - RNA, 16 nt, Homo sapiens
caauauuaaguccaaa

SEQ ID NO: 2006933 - RNA, 14 nt, Homo sapiens
gcuuuuuuacacaa

SEQ ID NO: 2006934 - RNA, 19 nt, Homo sapiens
gagcaauuugcacauguaa

SEQ ID NO: 2006935 - RNA, 15 nt, Homo sapiens
uugacuggcucaaga

SEQ ID NO: 2006936 - RNA, 21 nt, Homo sapiens
cauggggaaaaaaaucaucua

SEQ ID NO: 2006937 - RNA, 21 nt, Homo sapiens
caugugcggggaucaucugcc

SEQ ID NO: 2006938 - RNA, 22 nt, Homo sapiens
cuuggcaguauuccaugggaug

SEQ ID NO: 2006939 - RNA, 17 nt, Homo sapiens
agacaguaacauuucau

SEQ ID NO: 2006940 - RNA, 17 nt, Homo sapiens
ucuuugccagucauuca

SEQ ID NO: 2006941 - RNA, 16 nt, Homo sapiens
uacacaggagucuuca

SEQ ID NO: 2006942 - RNA, 15 nt, Homo sapiens
gguccuucccucucc

SEQ ID NO: 2006943 - RNA, 17 nt, Homo sapiens
auauuaugcaggggcaa

SEQ ID NO: 2006944 - RNA, 19 nt, Homo sapiens
gggaaaguaaauauuucag

SEQ ID NO: 2006945 - RNA, 20 nt, Homo sapiens
ccacagccgggugugugucu

SEQ ID NO: 2006946 - RNA, 19 nt, Homo sapiens
aaauacagagaaaucacca

SEQ ID NO: 2006947 - RNA, 15 nt, Homo sapiens
ugaagcuaaugucac

SEQ ID NO: 2006948 - RNA, 12 nt, Homo sapiens
ugaucucuuagg

SEQ ID NO: 2006949 - RNA, 19 nt, Homo sapiens
gacaagucauggacauuca

SEQ ID NO: 2006950 - RNA, 16 nt, Homo sapiens
gccccacauggcuuag

SEQ ID NO: 2006951 - RNA, 18 nt, Homo sapiens
ccuacugagcauuugcac

SEQ ID NO: 2006952 - RNA, 20 nt, Homo sapiens
aguccccuucuuuuggcccu

SEQ ID NO: 2006953 - RNA, 14 nt, Homo sapiens
ccgcaccgcuggga

SEQ ID NO: 2006954 - RNA, 23 nt, Homo sapiens
ggaggcuccaggacuccacugga

SEQ ID NO: 2006955 - RNA, 14 nt, Homo sapiens
uuaguucaauacag

SEQ ID NO: 2006956 - RNA, 22 nt, Homo sapiens
acagcugagugcccuguccuca

SEQ ID NO: 2006957 - RNA, 13 nt, Homo sapiens
ucucuagcacaau

SEQ ID NO: 2006958 - RNA, 18 nt, Homo sapiens
ucucccaaaaaacuacuu

SEQ ID NO: 2006959 - RNA, 13 nt, Homo sapiens
uauaagaaauaca

SEQ ID NO: 2006960 - RNA, 16 nt, Homo sapiens
accuggccuucagugu

SEQ ID NO: 2006961 - RNA, 19 nt, Homo sapiens
cauuuagaugcacuaccau

SEQ ID NO: 2006962 - RNA, 18 nt, Homo sapiens
caagugaggagugccagc

SEQ ID NO: 2006963 - RNA, 21 nt, Homo sapiens
cauauugcaggauucuguaau

SEQ ID NO: 2006964 - RNA, 20 nt, Homo sapiens
gaaaauaaguauccaucaga

SEQ ID NO: 2006965 - RNA, 15 nt, Homo sapiens
acacaacuuugcaaa

SEQ ID NO: 2006966 - RNA, 17 nt, Homo sapiens
uuuuacauuucauacaa

SEQ ID NO: 2006967 - RNA, 13 nt, Homo sapiens
acacugucugcau

SEQ ID NO: 2006968 - RNA, 23 nt, Homo sapiens
gucacccaggcuggaaugcagug

SEQ ID NO: 2006969 - RNA, 12 nt, Homo sapiens
gcacagaacaag

SEQ ID NO: 2006970 - RNA, 12 nt, Homo sapiens
uauuuucuccau

SEQ ID NO: 2006971 - RNA, 13 nt, Homo sapiens
uaauaaauacuca

SEQ ID NO: 2006972 - RNA, 20 nt, Homo sapiens
acuaauuuaguaauagccug

SEQ ID NO: 2006973 - RNA, 14 nt, Homo sapiens
gcagauuaaaagca

SEQ ID NO: 2006974 - RNA, 16 nt, Homo sapiens
acaugccaagcacugu

SEQ ID NO: 2006975 - RNA, 21 nt, Homo sapiens
agagaauuguagauaauacug

SEQ ID NO: 2006976 - RNA, 13 nt, Homo sapiens
ccagagagagcuc

SEQ ID NO: 2006977 - RNA, 22 nt, Homo sapiens
uaacaucuaaaaauagacuuaa

SEQ ID NO: 2006978 - RNA, 21 nt, Homo sapiens
ccuuucaguggcccuuucaac

SEQ ID NO: 2006979 - RNA, 19 nt, Homo sapiens
auuuucagcaaaguacaaa

SEQ ID NO: 2006980 - RNA, 11 nt, Homo sapiens
cugccaagagu

SEQ ID NO: 2006981 - RNA, 19 nt, Homo sapiens
ugcuggaagaauucuagca

SEQ ID NO: 2006982 - RNA, 16 nt, Homo sapiens
ugcuugagcucaggag

SEQ ID NO: 2006983 - RNA, 23 nt, Homo sapiens
gagccccuuggggguucagggaa

SEQ ID NO: 2006984 - RNA, 13 nt, Homo sapiens
gagaacgugccca

SEQ ID NO: 2006985 - RNA, 16 nt, Homo sapiens
uguuugaaauucuaga

SEQ ID NO: 2006986 - RNA, 13 nt, Homo sapiens
uggaaaucugcca

SEQ ID NO: 2006987 - RNA, 21 nt, Homo sapiens
aacuacuauuuuucuuuccaa

SEQ ID NO: 2006988 - RNA, 21 nt, Homo sapiens
uguaaauauuaugauggugga

SEQ ID NO: 2006989 - RNA, 16 nt, Homo sapiens
uacagaacuacuucuu

SEQ ID NO: 2006990 - RNA, 14 nt, Homo sapiens
uggcuaacacguga

SEQ ID NO: 2006991 - RNA, 14 nt, Homo sapiens
gugccccuuuccaa

SEQ ID NO: 2006992 - RNA, 23 nt, Homo sapiens
cuuccuggccccucucucacugg

SEQ ID NO: 2006993 - RNA, 16 nt, Homo sapiens
gaggacucaccacugc

SEQ ID NO: 2006994 - RNA, 16 nt, Homo sapiens
uaggauuuguguuuua

SEQ ID NO: 2006995 - RNA, 17 nt, Homo sapiens
aaccagugauccauguc

SEQ ID NO: 2006996 - RNA, 21 nt, Homo sapiens
ggaacucuagaagaccaaaug

SEQ ID NO: 2006997 - RNA, 14 nt, Homo sapiens
aagaugccuugagg

SEQ ID NO: 2006998 - RNA, 16 nt, Homo sapiens
gaccugaccggcaccu

SEQ ID NO: 2006999 - RNA, 14 nt, Homo sapiens
auuuucuucacuug

SEQ ID NO: 2007000 - RNA, 12 nt, Homo sapiens
ggggcuuguccu

SEQ ID NO: 2007001 - RNA, 21 nt, Homo sapiens
auaaugccaaugaacaucuca

SEQ ID NO: 2007002 - RNA, 19 nt, Homo sapiens
ccucccccgacgcucucuc

SEQ ID NO: 2007003 - RNA, 18 nt, Homo sapiens
cagaauguaucugugaag

SEQ ID NO: 2007004 - RNA, 13 nt, Homo sapiens
auguaaacauaag

SEQ ID NO: 2007005 - RNA, 16 nt, Homo sapiens
gguagagaaggagcag

SEQ ID NO: 2007006 - RNA, 21 nt, Homo sapiens
cuuggugcaaggccaucugcu

SEQ ID NO: 2007007 - RNA, 18 nt, Homo sapiens
acauuuacauagugcaaa

SEQ ID NO: 2007008 - RNA, 22 nt, Homo sapiens
augcccucauacccaugcacag

SEQ ID NO: 2007009 - RNA, 14 nt, Homo sapiens
gugaggaagcaaaa

SEQ ID NO: 2007010 - RNA, 18 nt, Homo sapiens
cucugauucuacagugau

SEQ ID NO: 2007011 - RNA, 14 nt, Homo sapiens
acaaaugaugccau

SEQ ID NO: 2007012 - RNA, 15 nt, Homo sapiens
caaaggcugacauuc

SEQ ID NO: 2007013 - RNA, 19 nt, Homo sapiens
uaaaagcaaggcucaaggg

SEQ ID NO: 2007014 - RNA, 22 nt, Homo sapiens
ucaauaaauacuuuaacuucca

SEQ ID NO: 2007015 - RNA, 17 nt, Homo sapiens
acagucaauggauccac

SEQ ID NO: 2007016 - RNA, 18 nt, Homo sapiens
aucuguuucuauguccaa

SEQ ID NO: 2007017 - RNA, 13 nt, Homo sapiens
ugaaaaaugcuca

SEQ ID NO: 2007018 - RNA, 13 nt, Homo sapiens
agaauaauggacu

SEQ ID NO: 2007019 - RNA, 13 nt, Homo sapiens
cagaauaauacaa

SEQ ID NO: 2007020 - RNA, 11 nt, Homo sapiens
gcuucacuggu

SEQ ID NO: 2007021 - RNA, 18 nt, Homo sapiens
cuuugcauagcuuucaca

SEQ ID NO: 2007022 - RNA, 14 nt, Homo sapiens
uaaauguaaacuca

SEQ ID NO: 2007023 - RNA, 22 nt, Homo sapiens
uuuaagcacccuagaggacuag

SEQ ID NO: 2007024 - RNA, 23 nt, Homo sapiens
ggcaggggugggagagccagcuc

SEQ ID NO: 2007025 - RNA, 18 nt, Homo sapiens
acuuugcaggaugaccuc

SEQ ID NO: 2007026 - RNA, 19 nt, Homo sapiens
ucacgccauucuccugccu

SEQ ID NO: 2007027 - RNA, 18 nt, Homo sapiens
aauuucuccgaaugucaa

SEQ ID NO: 2007028 - RNA, 15 nt, Homo sapiens
uccaaagacaagaaa

SEQ ID NO: 2007029 - RNA, 22 nt, Homo sapiens
gucagccaaaugacuucauuuc

SEQ ID NO: 2007030 - RNA, 19 nt, Homo sapiens
gcuaggacuuaaccuugaa

SEQ ID NO: 2007031 - RNA, 14 nt, Homo sapiens
aggacaucagcaaa

SEQ ID NO: 2007032 - RNA, 14 nt, Homo sapiens
uucccuucuugcau

SEQ ID NO: 2007033 - RNA, 21 nt, Homo sapiens
agcuuuucccaggagaccauu

SEQ ID NO: 2007034 - RNA, 20 nt, Homo sapiens
ccgugggguguauugacugg

SEQ ID NO: 2007035 - RNA, 15 nt, Homo sapiens
gcacaugaauccaua

SEQ ID NO: 2007036 - RNA, 16 nt, Homo sapiens
ggaugccgagcacuuu

SEQ ID NO: 2007037 - RNA, 19 nt, Homo sapiens
aaaacucauaauuauuuug

SEQ ID NO: 2007038 - RNA, 21 nt, Homo sapiens
uucagauuaagaguugccaaa

SEQ ID NO: 2007039 - RNA, 19 nt, Homo sapiens
auccauauuuuauuacugu

SEQ ID NO: 2007040 - RNA, 12 nt, Homo sapiens
acuuaccucaaa

SEQ ID NO: 2007041 - RNA, 18 nt, Homo sapiens
cugugacaaagaagacca

SEQ ID NO: 2007042 - RNA, 21 nt, Homo sapiens
ggagauuucuuguugcucaaa

SEQ ID NO: 2007043 - RNA, 22 nt, Homo sapiens
acagaacuaagaugaucaucuc

SEQ ID NO: 2007044 - RNA, 18 nt, Homo sapiens
ugccaguauguuccaaac

SEQ ID NO: 2007045 - RNA, 17 nt, Homo sapiens
cugugauaacagaguga

SEQ ID NO: 2007046 - RNA, 19 nt, Homo sapiens
gucccuugcuguaugcuga

SEQ ID NO: 2007047 - RNA, 18 nt, Homo sapiens
ccagucagacaaauucac

SEQ ID NO: 2007048 - RNA, 20 nt, Homo sapiens
gugcaauacggaacacuguc

SEQ ID NO: 2007049 - RNA, 21 nt, Homo sapiens
caagguccucugucagucaca

SEQ ID NO: 2007050 - RNA, 19 nt, Homo sapiens
agguggugggggcagggau

SEQ ID NO: 2007051 - RNA, 20 nt, Homo sapiens
auuucaaccgcuugccauau

SEQ ID NO: 2007052 - RNA, 22 nt, Homo sapiens
cuauuuucugcagaaauuugca

SEQ ID NO: 2007053 - RNA, 12 nt, Homo sapiens
cucggacugugu

SEQ ID NO: 2007054 - RNA, 16 nt, Homo sapiens
agggccccagcacuaa

SEQ ID NO: 2007055 - RNA, 20 nt, Homo sapiens
uaaucccagcuacucgagag

SEQ ID NO: 2007056 - RNA, 12 nt, Homo sapiens
agccugcucccu

SEQ ID NO: 2007057 - RNA, 15 nt, Homo sapiens
agauagagugaaaua

SEQ ID NO: 2007058 - RNA, 18 nt, Homo sapiens
uuucugagagagugccau

SEQ ID NO: 2007059 - RNA, 20 nt, Homo sapiens
aggacgauggggcaugaccu

SEQ ID NO: 2007060 - RNA, 15 nt, Homo sapiens
aucguaccuauugca

SEQ ID NO: 2007061 - RNA, 22 nt, Homo sapiens
agaggaugucucaaacuucaga

SEQ ID NO: 2007062 - RNA, 13 nt, Homo sapiens
aaguuacuguuga

SEQ ID NO: 2007063 - RNA, 20 nt, Homo sapiens
auauauauuuuugugcacau

SEQ ID NO: 2007064 - RNA, 21 nt, Homo sapiens
gaagcuguguccuugcaccug

SEQ ID NO: 2007065 - RNA, 16 nt, Homo sapiens
gaaaauggccaugcag

SEQ ID NO: 2007066 - RNA, 19 nt, Homo sapiens
auaagucaaaaggaacaaa

SEQ ID NO: 2007067 - RNA, 18 nt, Homo sapiens
ugaguaccucuuuuccca

SEQ ID NO: 2007068 - RNA, 13 nt, Homo sapiens
aauuacuaauaaa

SEQ ID NO: 2007069 - RNA, 20 nt, Homo sapiens
acacuccacuugaagcacuu

SEQ ID NO: 2007070 - RNA, 14 nt, Homo sapiens
cccauugucuuuac

SEQ ID NO: 2007071 - RNA, 20 nt, Homo sapiens
uaacugaaccaaauugcacu

SEQ ID NO: 2007072 - RNA, 15 nt, Homo sapiens
agcaucccucagccu

SEQ ID NO: 2007073 - RNA, 17 nt, Homo sapiens
uaaugaugcugucugaa

SEQ ID NO: 2007074 - RNA, 13 nt, Homo sapiens
uggaauaguggca

SEQ ID NO: 2007075 - RNA, 15 nt, Homo sapiens
aaaggguaauuuccu

SEQ ID NO: 2007076 - RNA, 14 nt, Homo sapiens
augucaugucugug

SEQ ID NO: 2007077 - RNA, 14 nt, Homo sapiens
gaaaaguucaggga

SEQ ID NO: 2007078 - RNA, 17 nt, Homo sapiens
aggugcccagaauuuac

SEQ ID NO: 2007079 - RNA, 19 nt, Homo sapiens
uuuuucucuuugugguuuc

SEQ ID NO: 2007080 - RNA, 18 nt, Homo sapiens
ucgccaaauaguuccauu

SEQ ID NO: 2007081 - RNA, 23 nt, Homo sapiens
augcacgugugcacacacaccac

SEQ ID NO: 2007082 - RNA, 18 nt, Homo sapiens
aucuaucaccugucauca

SEQ ID NO: 2007083 - RNA, 21 nt, Homo sapiens
gaggaaagugcguucucccag

SEQ ID NO: 2007084 - RNA, 22 nt, Homo sapiens
caacguagcuucuaccaugaac

SEQ ID NO: 2007085 - RNA, 14 nt, Homo sapiens
gacuggcugugaga

SEQ ID NO: 2007086 - RNA, 18 nt, Homo sapiens
ugagaagaacacaucagg

SEQ ID NO: 2007087 - RNA, 21 nt, Homo sapiens
caacuuagaaaccaaauuaca

SEQ ID NO: 2007088 - RNA, 21 nt, Homo sapiens
auuuccccuuuccaauuccaa

SEQ ID NO: 2007089 - RNA, 16 nt, Homo sapiens
auaaugaaauaguuau

SEQ ID NO: 2007090 - RNA, 20 nt, Homo sapiens
guagcuaggugcacauauac

SEQ ID NO: 2007091 - RNA, 18 nt, Homo sapiens
gcugcugggcucagugaa

SEQ ID NO: 2007092 - RNA, 17 nt, Homo sapiens
caaagucguuucaacuc

SEQ ID NO: 2007093 - RNA, 14 nt, Homo sapiens
ccaggccuccagaa

SEQ ID NO: 2007094 - RNA, 14 nt, Homo sapiens
cuugaacucuuggc

SEQ ID NO: 2007095 - RNA, 21 nt, Homo sapiens
acuaguugaacaucucacuuu

SEQ ID NO: 2007096 - RNA, 21 nt, Homo sapiens
ucuaacuuuugugaagaacua

SEQ ID NO: 2007097 - RNA, 13 nt, Homo sapiens
ugcugcagagaaa

SEQ ID NO: 2007098 - RNA, 14 nt, Homo sapiens
auccaaaaucuuga

SEQ ID NO: 2007099 - RNA, 16 nt, Homo sapiens
aaaaacaccuaaguga

SEQ ID NO: 2007100 - RNA, 18 nt, Homo sapiens
uaucuuacuuuccucuga

SEQ ID NO: 2007101 - RNA, 15 nt, Homo sapiens
aauacauauuuccaa

SEQ ID NO: 2007102 - RNA, 24 nt, Homo sapiens
uugcaucacagucacaugcccauu

SEQ ID NO: 2007103 - RNA, 12 nt, Homo sapiens
cagccucuagaa

SEQ ID NO: 2007104 - RNA, 16 nt, Homo sapiens
cuggacacacucucau

SEQ ID NO: 2007105 - RNA, 22 nt, Homo sapiens
uuuuauggcgauucccauugaa

SEQ ID NO: 2007106 - RNA, 14 nt, Homo sapiens
cuugacguggcacu

SEQ ID NO: 2007107 - RNA, 16 nt, Homo sapiens
caucugugccagagau

SEQ ID NO: 2007108 - RNA, 21 nt, Homo sapiens
ugccaaaaacuaaaauucaac

SEQ ID NO: 2007109 - RNA, 22 nt, Homo sapiens
aaccaaagugaccuccagagcu

SEQ ID NO: 2007110 - RNA, 18 nt, Homo sapiens
uucucaguaucaguauuu

SEQ ID NO: 2007111 - RNA, 14 nt, Homo sapiens
auaaaucaauucau

SEQ ID NO: 2007112 - RNA, 14 nt, Homo sapiens
uuaaaucauuucau

SEQ ID NO: 2007113 - RNA, 16 nt, Homo sapiens
ggaaagguccuguggg

SEQ ID NO: 2007114 - RNA, 20 nt, Homo sapiens
augauaagauuuaccuuuau

SEQ ID NO: 2007115 - RNA, 22 nt, Homo sapiens
aaaacauagacugaagauuuau

SEQ ID NO: 2007116 - RNA, 20 nt, Homo sapiens
guauuaacuuuauacacuug

SEQ ID NO: 2007117 - RNA, 18 nt, Homo sapiens
agucuaggcuaagcacuu

SEQ ID NO: 2007118 - RNA, 16 nt, Homo sapiens
ugcagaccgccccuca

SEQ ID NO: 2007119 - RNA, 18 nt, Homo sapiens
ggccaauucguucucugc

SEQ ID NO: 2007120 - RNA, 20 nt, Homo sapiens
augaaggaaggacuaugaca

SEQ ID NO: 2007121 - RNA, 21 nt, Homo sapiens
cucugugaacgauuuagaaag

SEQ ID NO: 2007122 - RNA, 11 nt, Homo sapiens
cuccucugucc

SEQ ID NO: 2007123 - RNA, 12 nt, Homo sapiens
gggacugggaug

SEQ ID NO: 2007124 - RNA, 16 nt, Homo sapiens
uaccaaucugugagaa

SEQ ID NO: 2007125 - RNA, 15 nt, Homo sapiens
gagucauaaaccuua

SEQ ID NO: 2007126 - RNA, 16 nt, Homo sapiens
ucaugaugcuucucag

SEQ ID NO: 2007127 - RNA, 13 nt, Homo sapiens
auaccacugcacu

SEQ ID NO: 2007128 - RNA, 13 nt, Homo sapiens
uauuaguguuauu

SEQ ID NO: 2007129 - RNA, 15 nt, Homo sapiens
gacuucuuccaggga

SEQ ID NO: 2007130 - RNA, 19 nt, Homo sapiens
cauuaaagagccaguuuau

SEQ ID NO: 2007131 - RNA, 16 nt, Homo sapiens
uuccauacuucucuca

SEQ ID NO: 2007132 - RNA, 19 nt, Homo sapiens
agagcuagaaccuagaagg

SEQ ID NO: 2007133 - RNA, 17 nt, Homo sapiens
cucauuaaaauugugau

SEQ ID NO: 2007134 - RNA, 21 nt, Homo sapiens
ccacauaccaggcaaccuccc

SEQ ID NO: 2007135 - RNA, 11 nt, Homo sapiens
caaugccaucu

SEQ ID NO: 2007136 - RNA, 18 nt, Homo sapiens
ucccaggcccagugcagu

SEQ ID NO: 2007137 - RNA, 19 nt, Homo sapiens
agugagcccaucugcacag

SEQ ID NO: 2007138 - RNA, 15 nt, Homo sapiens
uaaaagagggacccc

SEQ ID NO: 2007139 - RNA, 18 nt, Homo sapiens
cugaaaugugcucaggcc

SEQ ID NO: 2007140 - RNA, 20 nt, Homo sapiens
aauugggaaaaaagcaacug

SEQ ID NO: 2007141 - RNA, 16 nt, Homo sapiens
auucccagcucuaccc

SEQ ID NO: 2007142 - RNA, 16 nt, Homo sapiens
cauucaccaaccaaag

SEQ ID NO: 2007143 - RNA, 12 nt, Homo sapiens
agaacuggugcu

SEQ ID NO: 2007144 - RNA, 16 nt, Homo sapiens
cauaaaaguccuguca

SEQ ID NO: 2007145 - RNA, 16 nt, Homo sapiens
gcaaauaaaugccuuc

SEQ ID NO: 2007146 - RNA, 14 nt, Homo sapiens
gguucaacaucuaa

SEQ ID NO: 2007147 - RNA, 16 nt, Homo sapiens
auauuagcauugccaa

SEQ ID NO: 2007148 - RNA, 15 nt, Homo sapiens
agcagcuucugggac

SEQ ID NO: 2007149 - RNA, 17 nt, Homo sapiens
cagugaagacuaugaaa

SEQ ID NO: 2007150 - RNA, 22 nt, Homo sapiens
aaucaguuuauccugacauauu

SEQ ID NO: 2007151 - RNA, 16 nt, Homo sapiens
auuaugcaggggcaaa

SEQ ID NO: 2007152 - RNA, 18 nt, Homo sapiens
auuguaaaaccccaucuc

SEQ ID NO: 2007153 - RNA, 18 nt, Homo sapiens
uccagcccuggaucuccc

SEQ ID NO: 2007154 - RNA, 13 nt, Homo sapiens
ucauuuacugugu

SEQ ID NO: 2007155 - RNA, 15 nt, Homo sapiens
aauaauaaaucuggu

SEQ ID NO: 2007156 - RNA, 18 nt, Homo sapiens
ccugacccagggacucuc

SEQ ID NO: 2007157 - RNA, 13 nt, Homo sapiens
uacuaaagccaaa

SEQ ID NO: 2007158 - RNA, 19 nt, Homo sapiens
cacaaaggauuugaugcuu

SEQ ID NO: 2007159 - RNA, 18 nt, Homo sapiens
cucugucaacaucaaaga

SEQ ID NO: 2007160 - RNA, 19 nt, Homo sapiens
augucauaaaugucacaau

SEQ ID NO: 2007161 - RNA, 17 nt, Homo sapiens
ucaaauacaugcacagu

SEQ ID NO: 2007162 - RNA, 18 nt, Homo sapiens
cuuaaaaaauacuugcau

SEQ ID NO: 2007163 - RNA, 23 nt, Homo sapiens
cugcaucgagucaaaacucaaau

SEQ ID NO: 2007164 - RNA, 22 nt, Homo sapiens
cuuuuccugcucccuaaccuuu

SEQ ID NO: 2007165 - RNA, 14 nt, Homo sapiens
ugaccaacaguucc

SEQ ID NO: 2007166 - RNA, 22 nt, Homo sapiens
gcucuucagaggagcaucagcu

SEQ ID NO: 2007167 - RNA, 20 nt, Homo sapiens
acaggaugaaggcaaugcca

SEQ ID NO: 2007168 - RNA, 16 nt, Homo sapiens
aggaacugcuugugca

SEQ ID NO: 2007169 - RNA, 17 nt, Homo sapiens
acuaaaguauaucuuua

SEQ ID NO: 2007170 - RNA, 17 nt, Homo sapiens
gguugggaccaggccaa

SEQ ID NO: 2007171 - RNA, 13 nt, Homo sapiens
auagcauguaaua

SEQ ID NO: 2007172 - RNA, 18 nt, Homo sapiens
aauauuagcauugccaau

SEQ ID NO: 2007173 - RNA, 19 nt, Homo sapiens
uuauauuucacaggcugua

SEQ ID NO: 2007174 - RNA, 13 nt, Homo sapiens
ggagaaaauggac

SEQ ID NO: 2007175 - RNA, 23 nt, Homo sapiens
uugcuuucucuucuaauggaaua

SEQ ID NO: 2007176 - RNA, 23 nt, Homo sapiens
guuguuaaaacugguuuagcaca

SEQ ID NO: 2007177 - RNA, 15 nt, Homo sapiens
gugauggaccaaagc

SEQ ID NO: 2007178 - RNA, 22 nt, Homo sapiens
guuuuggguugaccccaaucca

SEQ ID NO: 2007179 - RNA, 23 nt, Homo sapiens
ggcauggugguuuacgccuauaa

SEQ ID NO: 2007180 - RNA, 22 nt, Homo sapiens
gaacuccccagggccuccagga

SEQ ID NO: 2007181 - RNA, 16 nt, Homo sapiens
cccgaaauagauccag

SEQ ID NO: 2007182 - RNA, 14 nt, Homo sapiens
cuuuagaacagugc

SEQ ID NO: 2007183 - RNA, 21 nt, Homo sapiens
gccuggguccucggcccugua

SEQ ID NO: 2007184 - RNA, 13 nt, Homo sapiens
auuguagcacauu

SEQ ID NO: 2007185 - RNA, 16 nt, Homo sapiens
augcuucugacuucau

SEQ ID NO: 2007186 - RNA, 16 nt, Homo sapiens
gccauaaaugaccuaa

SEQ ID NO: 2007187 - RNA, 20 nt, Homo sapiens
ccaacccugagcacucuuau

SEQ ID NO: 2007188 - RNA, 19 nt, Homo sapiens
aaauauuucaagacauuaa

SEQ ID NO: 2007189 - RNA, 22 nt, Homo sapiens
uccuccccuuugacccuauuca

SEQ ID NO: 2007190 - RNA, 16 nt, Homo sapiens
aacauugacccagaaa

SEQ ID NO: 2007191 - RNA, 22 nt, Homo sapiens
gcuccaagaccuguugguucca

SEQ ID NO: 2007192 - RNA, 15 nt, Homo sapiens
aucagccuugcuaaa

SEQ ID NO: 2007193 - RNA, 12 nt, Homo sapiens
acccaccucagc

SEQ ID NO: 2007194 - RNA, 14 nt, Homo sapiens
cucucuggacacuu

SEQ ID NO: 2007195 - RNA, 13 nt, Homo sapiens
acgaaaucuaggu

SEQ ID NO: 2007196 - RNA, 14 nt, Homo sapiens
gucuugaccucucc

SEQ ID NO: 2007197 - RNA, 14 nt, Homo sapiens
ggcuacacagggau

SEQ ID NO: 2007198 - RNA, 18 nt, Homo sapiens
uugaauagaaaaaguaau

SEQ ID NO: 2007199 - RNA, 18 nt, Homo sapiens
aguugccaacuauucuca

SEQ ID NO: 2007200 - RNA, 23 nt, Homo sapiens
cccacaaucuggcuuagugccac

SEQ ID NO: 2007201 - RNA, 11 nt, Homo sapiens
gguaugcauuu

SEQ ID NO: 2007202 - RNA, 18 nt, Homo sapiens
ucuuacaguguuuggaca

SEQ ID NO: 2007203 - RNA, 21 nt, Homo sapiens
gccuggucccacgagggugcc

SEQ ID NO: 2007204 - RNA, 20 nt, Homo sapiens
ugugugaggcucuguccuaa

SEQ ID NO: 2007205 - RNA, 19 nt, Homo sapiens
accuggcugccaacaugau

SEQ ID NO: 2007206 - RNA, 15 nt, Homo sapiens
caggaggucagcaca

SEQ ID NO: 2007207 - RNA, 14 nt, Homo sapiens
cuccccgcuccuaa

SEQ ID NO: 2007208 - RNA, 20 nt, Homo sapiens
auauauaacuuccuaugcaa

SEQ ID NO: 2007209 - RNA, 22 nt, Homo sapiens
aaauccauacccccugccccag

SEQ ID NO: 2007210 - RNA, 16 nt, Homo sapiens
cauggaauaaaccauu

SEQ ID NO: 2007211 - RNA, 15 nt, Homo sapiens
cuauaccaccuucaa

SEQ ID NO: 2007212 - RNA, 18 nt, Homo sapiens
acagucacuggcccaacc

SEQ ID NO: 2007213 - RNA, 22 nt, Homo sapiens
gagauggagucuugcucuguca

SEQ ID NO: 2007214 - RNA, 20 nt, Homo sapiens
uaagcugcugaaugcauuca

SEQ ID NO: 2007215 - RNA, 14 nt, Homo sapiens
gugagcacuaucuu

SEQ ID NO: 2007216 - RNA, 19 nt, Homo sapiens
uagcgcagccaugugauua

SEQ ID NO: 2007217 - RNA, 19 nt, Homo sapiens
aucuaaaaagacuaaccug

SEQ ID NO: 2007218 - RNA, 11 nt, Homo sapiens
uucagccaaaa

SEQ ID NO: 2007219 - RNA, 21 nt, Homo sapiens
uuuaaguauugcagucuaaaa

SEQ ID NO: 2007220 - RNA, 23 nt, Homo sapiens
ugaacuguuuggucgagucuuug

SEQ ID NO: 2007221 - RNA, 12 nt, Homo sapiens
ggaggaugacca

SEQ ID NO: 2007222 - RNA, 19 nt, Homo sapiens
uccccgcccguuuuacaaa

SEQ ID NO: 2007223 - RNA, 14 nt, Homo sapiens
gaucaaaaucaauu

SEQ ID NO: 2007224 - RNA, 23 nt, Homo sapiens
uauggagcuuuuccugauguucc

SEQ ID NO: 2007225 - RNA, 16 nt, Homo sapiens
agaauuggccaucuua

SEQ ID NO: 2007226 - RNA, 18 nt, Homo sapiens
uccaccugugcugcugca

SEQ ID NO: 2007227 - RNA, 16 nt, Homo sapiens
gcugaggacacucagu

SEQ ID NO: 2007228 - RNA, 23 nt, Homo sapiens
gucuaacuggggauauaauacua

SEQ ID NO: 2007229 - RNA, 15 nt, Homo sapiens
ucuguugggaugcca

SEQ ID NO: 2007230 - RNA, 21 nt, Homo sapiens
ucguaggggagagaucuccaa

SEQ ID NO: 2007231 - RNA, 22 nt, Homo sapiens
auaaagucauccucucacugca

SEQ ID NO: 2007232 - RNA, 15 nt, Homo sapiens
ucagaucaacaaauc

SEQ ID NO: 2007233 - RNA, 11 nt, Homo sapiens
uccuucuuccc

SEQ ID NO: 2007234 - RNA, 23 nt, Homo sapiens
gacuuucuaauuagagagcaucu

SEQ ID NO: 2007235 - RNA, 18 nt, Homo sapiens
ccagcaugcagguggugg

SEQ ID NO: 2007236 - RNA, 16 nt, Homo sapiens
cacaacuaggaccuca

SEQ ID NO: 2007237 - RNA, 16 nt, Homo sapiens
caccuucaauacuuca

SEQ ID NO: 2007238 - RNA, 16 nt, Homo sapiens
auaaaugacacaauga

SEQ ID NO: 2007239 - RNA, 16 nt, Homo sapiens
cucuacaaaaauacaa

SEQ ID NO: 2007240 - RNA, 18 nt, Homo sapiens
cugaaggaggccaccucc

SEQ ID NO: 2007241 - RNA, 18 nt, Homo sapiens
gaaagaggcaccaggaag

SEQ ID NO: 2007242 - RNA, 15 nt, Homo sapiens
uccagcccugcagcu

SEQ ID NO: 2007243 - RNA, 15 nt, Homo sapiens
uuaauauccaagacu

SEQ ID NO: 2007244 - RNA, 17 nt, Homo sapiens
auucuggaucugacccu

SEQ ID NO: 2007245 - RNA, 14 nt, Homo sapiens
cuuauuugguauaa

SEQ ID NO: 2007246 - RNA, 19 nt, Homo sapiens
uaccacauuccaugacgca

SEQ ID NO: 2007247 - RNA, 18 nt, Homo sapiens
guguucauaucuacucuu

SEQ ID NO: 2007248 - RNA, 22 nt, Homo sapiens
aucuuuuucucuaaaauagcca

SEQ ID NO: 2007249 - RNA, 16 nt, Homo sapiens
ugaauaaaaacuuugc

SEQ ID NO: 2007250 - RNA, 13 nt, Homo sapiens
ucaacugccucag

SEQ ID NO: 2007251 - RNA, 10 nt, Homo sapiens
gcgugcugcg

SEQ ID NO: 2007252 - RNA, 12 nt, Homo sapiens
aguucagaguuu

SEQ ID NO: 2007253 - RNA, 23 nt, Homo sapiens
ugggaaggaggccgcuaugcagg

SEQ ID NO: 2007254 - RNA, 14 nt, Homo sapiens
accuuuucaugguc

SEQ ID NO: 2007255 - RNA, 10 nt, Homo sapiens
agugagcucg

SEQ ID NO: 2007256 - RNA, 11 nt, Homo sapiens
gcccucgcugc

SEQ ID NO: 2007257 - RNA, 17 nt, Homo sapiens
cugagaaccgugacauc

SEQ ID NO: 2007258 - RNA, 16 nt, Homo sapiens
uuagaaggcuuaagaa

SEQ ID NO: 2007259 - RNA, 22 nt, Homo sapiens
ucuaaauauuucaugauucaca

SEQ ID NO: 2007260 - RNA, 22 nt, Homo sapiens
uccaaugaaaaaauuaaaaccu

SEQ ID NO: 2007261 - RNA, 20 nt, Homo sapiens
caggucagcgcgguccugac

SEQ ID NO: 2007262 - RNA, 18 nt, Homo sapiens
aauacuuaacuacuguuu

SEQ ID NO: 2007263 - RNA, 14 nt, Homo sapiens
ggcuuuuccaaaag

SEQ ID NO: 2007264 - RNA, 14 nt, Homo sapiens
aggugccaccgugc

SEQ ID NO: 2007265 - RNA, 16 nt, Homo sapiens
ucacugcacuguucag

SEQ ID NO: 2007266 - RNA, 14 nt, Homo sapiens
acaguacucacuuu

SEQ ID NO: 2007267 - RNA, 21 nt, Homo sapiens
cacgacuucugcccauucucu

SEQ ID NO: 2007268 - RNA, 21 nt, Homo sapiens
uccuugccuucgcauggcugg

SEQ ID NO: 2007269 - RNA, 12 nt, Homo sapiens
accucccaguga

SEQ ID NO: 2007270 - RNA, 19 nt, Homo sapiens
gaugcagcaccucucagga

SEQ ID NO: 2007271 - RNA, 14 nt, Homo sapiens
aggucuaaugauau

SEQ ID NO: 2007272 - RNA, 17 nt, Homo sapiens
aagccaggguccugagu

SEQ ID NO: 2007273 - RNA, 13 nt, Homo sapiens
cugagcacaguca

SEQ ID NO: 2007274 - RNA, 19 nt, Homo sapiens
uccauuuggacaaaaugga

SEQ ID NO: 2007275 - RNA, 18 nt, Homo sapiens
uucaaacugcaugauuca

SEQ ID NO: 2007276 - RNA, 12 nt, Homo sapiens
uucuuccuguca

SEQ ID NO: 2007277 - RNA, 20 nt, Homo sapiens
uaaaagcugaccccaaagac

SEQ ID NO: 2007278 - RNA, 14 nt, Homo sapiens
ccacagucugacac

SEQ ID NO: 2007279 - RNA, 16 nt, Homo sapiens
acauaccccacugggc

SEQ ID NO: 2007280 - RNA, 18 nt, Homo sapiens
uaaaaccugucaaugaua

SEQ ID NO: 2007281 - RNA, 15 nt, Homo sapiens
aguugcucaggacac

SEQ ID NO: 2007282 - RNA, 15 nt, Homo sapiens
auuccauuuacuuga

SEQ ID NO: 2007283 - RNA, 20 nt, Homo sapiens
ucauaacuaaugaauugaaa

SEQ ID NO: 2007284 - RNA, 17 nt, Homo sapiens
aauggucucuaacauuu

SEQ ID NO: 2007285 - RNA, 23 nt, Homo sapiens
augggggccaaggagaaaggcau

SEQ ID NO: 2007286 - RNA, 18 nt, Homo sapiens
aagcuuucaaauccuccc

SEQ ID NO: 2007287 - RNA, 18 nt, Homo sapiens
gacuuaggaaccuaccag

SEQ ID NO: 2007288 - RNA, 15 nt, Homo sapiens
gcuuuuacuaucugu

SEQ ID NO: 2007289 - RNA, 20 nt, Homo sapiens
cuggagucucucucucucca

SEQ ID NO: 2007290 - RNA, 14 nt, Homo sapiens
caugccccuggcug

SEQ ID NO: 2007291 - RNA, 22 nt, Homo sapiens
agucgcuggcauguuucacucc

SEQ ID NO: 2007292 - RNA, 16 nt, Homo sapiens
uaaaagaaacuguggu

SEQ ID NO: 2007293 - RNA, 22 nt, Homo sapiens
ccauucauauuaagacagugua

SEQ ID NO: 2007294 - RNA, 21 nt, Homo sapiens
auguuuucuagucacuuccuc

SEQ ID NO: 2007295 - RNA, 19 nt, Homo sapiens
uguuggguuguuacagagu

SEQ ID NO: 2007296 - RNA, 12 nt, Homo sapiens
aacgaaauuucc

SEQ ID NO: 2007297 - RNA, 13 nt, Homo sapiens
gacucagccucag

SEQ ID NO: 2007298 - RNA, 22 nt, Homo sapiens
acagcuugggaauccugcuaaa

SEQ ID NO: 2007299 - RNA, 20 nt, Homo sapiens
caguguccccuccacuguca

SEQ ID NO: 2007300 - RNA, 13 nt, Homo sapiens
aggggcacuggug

SEQ ID NO: 2007301 - RNA, 20 nt, Homo sapiens
ugccgcagggagggcugugg

SEQ ID NO: 2007302 - RNA, 17 nt, Homo sapiens
ggcuccuccucucugga

SEQ ID NO: 2007303 - RNA, 21 nt, Homo sapiens
gaguuuuuauuuuguuacaaa

SEQ ID NO: 2007304 - RNA, 17 nt, Homo sapiens
uguugaaaauguucaga

SEQ ID NO: 2007305 - RNA, 13 nt, Homo sapiens
caaucuuugccaa

SEQ ID NO: 2007306 - RNA, 20 nt, Homo sapiens
aguggccagcuucacucucu

SEQ ID NO: 2007307 - RNA, 19 nt, Homo sapiens
uuaguguucaaauacuuca

SEQ ID NO: 2007308 - RNA, 21 nt, Homo sapiens
gcuaagauuuagagaugaauu

SEQ ID NO: 2007309 - RNA, 20 nt, Homo sapiens
uguggauuuucuacuguaag

SEQ ID NO: 2007310 - RNA, 15 nt, Homo sapiens
cucugacccagcaga

SEQ ID NO: 2007311 - RNA, 22 nt, Homo sapiens
cugcugugcccucccauagcac

SEQ ID NO: 2007312 - RNA, 19 nt, Homo sapiens
caauggugcaaucacagcu

SEQ ID NO: 2007313 - RNA, 19 nt, Homo sapiens
agaauucaauuugaacuca

SEQ ID NO: 2007314 - RNA, 20 nt, Homo sapiens
cuugggacuuagaacaccgc

SEQ ID NO: 2007315 - RNA, 22 nt, Homo sapiens
uuuaguauguggcguaucaugc

SEQ ID NO: 2007316 - RNA, 22 nt, Homo sapiens
ugaacacuuuagguagaugaac

SEQ ID NO: 2007317 - RNA, 15 nt, Homo sapiens
aaaauuaauacugaa

SEQ ID NO: 2007318 - RNA, 21 nt, Homo sapiens
ugcauuugugcguaugcagug

SEQ ID NO: 2007319 - RNA, 21 nt, Homo sapiens
uagaauauuuuaagaauuuca

SEQ ID NO: 2007320 - RNA, 18 nt, Homo sapiens
cauuuaguacauccagaa

SEQ ID NO: 2007321 - RNA, 22 nt, Homo sapiens
gcuaaugaauuuuaaaagcaua

SEQ ID NO: 2007322 - RNA, 17 nt, Homo sapiens
ugguauaucuuuuucca

SEQ ID NO: 2007323 - RNA, 19 nt, Homo sapiens
gaugucaaaaugugauucu

SEQ ID NO: 2007324 - RNA, 16 nt, Homo sapiens
uugacauucugaaugc

SEQ ID NO: 2007325 - RNA, 15 nt, Homo sapiens
auguucuugguguuu

SEQ ID NO: 2007326 - RNA, 22 nt, Homo sapiens
cuccacucuuugaucagaaaca

SEQ ID NO: 2007327 - RNA, 17 nt, Homo sapiens
agccucugccgcugcca

SEQ ID NO: 2007328 - RNA, 22 nt, Homo sapiens
ucccaucacuucccuacaugga

SEQ ID NO: 2007329 - RNA, 22 nt, Homo sapiens
accauacucccuuucagggcca

SEQ ID NO: 2007330 - RNA, 22 nt, Homo sapiens
uccccggcacugcagucugcag

SEQ ID NO: 2007331 - RNA, 19 nt, Homo sapiens
uuguuaugaaaaugcuguu

SEQ ID NO: 2007332 - RNA, 16 nt, Homo sapiens
agucuuguacugugac

SEQ ID NO: 2007333 - RNA, 19 nt, Homo sapiens
auuuaauggcaaugcaaaa

SEQ ID NO: 2007334 - RNA, 16 nt, Homo sapiens
aaucuuggaguuucaa

SEQ ID NO: 2007335 - RNA, 19 nt, Homo sapiens
acaaaggugauuuuccugu

SEQ ID NO: 2007336 - RNA, 19 nt, Homo sapiens
cuuucaagcugcacugaca

SEQ ID NO: 2007337 - RNA, 19 nt, Homo sapiens
gccuuuuggaaauccaaau

SEQ ID NO: 2007338 - RNA, 17 nt, Homo sapiens
auucuacaaaaaaccag

SEQ ID NO: 2007339 - RNA, 16 nt, Homo sapiens
ugcaauccucccuacc

SEQ ID NO: 2007340 - RNA, 17 nt, Homo sapiens
acucauccugaacagca

SEQ ID NO: 2007341 - RNA, 10 nt, Homo sapiens
cauagcacuu

SEQ ID NO: 2007342 - RNA, 15 nt, Homo sapiens
ugacagcucuucaca

SEQ ID NO: 2007343 - RNA, 19 nt, Homo sapiens
gguggauuccgagugguga

SEQ ID NO: 2007344 - RNA, 17 nt, Homo sapiens
guacuuugaagauguca

SEQ ID NO: 2007345 - RNA, 20 nt, Homo sapiens
aaucuugcucugcuugacaa

SEQ ID NO: 2007346 - RNA, 17 nt, Homo sapiens
ugaccuccuggacugua

SEQ ID NO: 2007347 - RNA, 12 nt, Homo sapiens
uuuuccacccau

SEQ ID NO: 2007348 - RNA, 21 nt, Homo sapiens
gagaagugccccugcugccuc

SEQ ID NO: 2007349 - RNA, 18 nt, Homo sapiens
uguuggaaaaugugcaau

SEQ ID NO: 2007350 - RNA, 13 nt, Homo sapiens
agguuaagcacuu

SEQ ID NO: 2007351 - RNA, 13 nt, Homo sapiens
aggaaaagcacaa

SEQ ID NO: 2007352 - RNA, 17 nt, Homo sapiens
caaaccuugauuuguaa

SEQ ID NO: 2007353 - RNA, 21 nt, Homo sapiens
ucugggagcuacaaaauuuca

SEQ ID NO: 2007354 - RNA, 22 nt, Homo sapiens
ggaaauguucuuuagauggugg

SEQ ID NO: 2007355 - RNA, 14 nt, Homo sapiens
agcccauccauagu

SEQ ID NO: 2007356 - RNA, 23 nt, Homo sapiens
aaauccgugaagucacauuccac

SEQ ID NO: 2007357 - RNA, 15 nt, Homo sapiens
uguaaaaauagcaaa

SEQ ID NO: 2007358 - RNA, 18 nt, Homo sapiens
cucugguuuucuugccac

SEQ ID NO: 2007359 - RNA, 16 nt, Homo sapiens
uucgauuucuaccuca

SEQ ID NO: 2007360 - RNA, 19 nt, Homo sapiens
agcauuugauuaacauuug

SEQ ID NO: 2007361 - RNA, 15 nt, Homo sapiens
aauuacucaccaaaa

SEQ ID NO: 2007362 - RNA, 15 nt, Homo sapiens
cccacauccauucca

SEQ ID NO: 2007363 - RNA, 16 nt, Homo sapiens
cagaaauacaguauga

SEQ ID NO: 2007364 - RNA, 17 nt, Homo sapiens
agugggugaauguguga

SEQ ID NO: 2007365 - RNA, 20 nt, Homo sapiens
caccuaguggcuguccagug

SEQ ID NO: 2007366 - RNA, 13 nt, Homo sapiens
auuuuauuauaau

SEQ ID NO: 2007367 - RNA, 13 nt, Homo sapiens
acuuuauuacaau

SEQ ID NO: 2007368 - RNA, 13 nt, Homo sapiens
ccaggagcagcug

SEQ ID NO: 2007369 - RNA, 20 nt, Homo sapiens
auccucccaccucagcuucu

SEQ ID NO: 2007370 - RNA, 21 nt, Homo sapiens
uaaaauaaacaagcuguggua

SEQ ID NO: 2007371 - RNA, 17 nt, Homo sapiens
caaucauuuauucauug

SEQ ID NO: 2007372 - RNA, 15 nt, Homo sapiens
aucucugaacuggua

SEQ ID NO: 2007373 - RNA, 13 nt, Homo sapiens
ggccguggcacag

SEQ ID NO: 2007374 - RNA, 19 nt, Homo sapiens
caguaggguuugacauuuc

SEQ ID NO: 2007375 - RNA, 21 nt, Homo sapiens
gauuaaaaccaaaagaauuug

SEQ ID NO: 2007376 - RNA, 18 nt, Homo sapiens
ucaucauuuaucaucaca

SEQ ID NO: 2007377 - RNA, 16 nt, Homo sapiens
uccacauaagcacucc

SEQ ID NO: 2007378 - RNA, 23 nt, Homo sapiens
caaaauaagaugaaucacuuaau

SEQ ID NO: 2007379 - RNA, 21 nt, Homo sapiens
ugccauuagacugaauuuaac

SEQ ID NO: 2007380 - RNA, 14 nt, Homo sapiens
aauuagccaggugu

SEQ ID NO: 2007381 - RNA, 22 nt, Homo sapiens
uuucauauauaagacugcugca

SEQ ID NO: 2007382 - RNA, 12 nt, Homo sapiens
ucacaguugugu

SEQ ID NO: 2007383 - RNA, 15 nt, Homo sapiens
uguccagacacgucc

SEQ ID NO: 2007384 - RNA, 19 nt, Homo sapiens
cuggugguuuuucagcucc

SEQ ID NO: 2007385 - RNA, 15 nt, Homo sapiens
cuucuccaccaaaga

SEQ ID NO: 2007386 - RNA, 15 nt, Homo sapiens
ucccugcucuugcag

SEQ ID NO: 2007387 - RNA, 19 nt, Homo sapiens
auacaaacuuuguaauucu

SEQ ID NO: 2007388 - RNA, 19 nt, Homo sapiens
agggguugagggaagguuc

SEQ ID NO: 2007389 - RNA, 22 nt, Homo sapiens
uacacacacacacauacaguau

SEQ ID NO: 2007390 - RNA, 23 nt, Homo sapiens
aggagugccuucauacacuguac

SEQ ID NO: 2007391 - RNA, 18 nt, Homo sapiens
cacuuaucuuggaaucau

SEQ ID NO: 2007392 - RNA, 16 nt, Homo sapiens
auacauucuaugacau

SEQ ID NO: 2007393 - RNA, 14 nt, Homo sapiens
aguuucuucaaucu

SEQ ID NO: 2007394 - RNA, 14 nt, Homo sapiens
caugaacguuuucu

SEQ ID NO: 2007395 - RNA, 15 nt, Homo sapiens
gcagugcccagugau

SEQ ID NO: 2007396 - RNA, 17 nt, Homo sapiens
uguccuaccacucuaau

SEQ ID NO: 2007397 - RNA, 12 nt, Homo sapiens
uugaagcacuua

SEQ ID NO: 2007398 - RNA, 12 nt, Homo sapiens
agguuucaccuc

SEQ ID NO: 2007399 - RNA, 21 nt, Homo sapiens
uuauuguucacacaaagccug

SEQ ID NO: 2007400 - RNA, 23 nt, Homo sapiens
gauccucauauggcccaguguca

SEQ ID NO: 2007401 - RNA, 20 nt, Homo sapiens
acuaaauggccucucuccac

SEQ ID NO: 2007402 - RNA, 17 nt, Homo sapiens
gacagagcagugcugga

SEQ ID NO: 2007403 - RNA, 17 nt, Homo sapiens
ugacugcacccagcucc

SEQ ID NO: 2007404 - RNA, 22 nt, Homo sapiens
aauauuagguugucacgaugaa

SEQ ID NO: 2007405 - RNA, 22 nt, Homo sapiens
ugaaauuaugugacauuuuaca

SEQ ID NO: 2007406 - RNA, 12 nt, Homo sapiens
caugaagcccuu

SEQ ID NO: 2007407 - RNA, 12 nt, Homo sapiens
acagaagcaaau

SEQ ID NO: 2007408 - RNA, 14 nt, Homo sapiens
cauuucccacaucu

SEQ ID NO: 2007409 - RNA, 15 nt, Homo sapiens
ugucuuccuaucaaa

SEQ ID NO: 2007410 - RNA, 15 nt, Homo sapiens
caaguuucagaguca

SEQ ID NO: 2007411 - RNA, 21 nt, Homo sapiens
uucugguuauuauaaacagaa

SEQ ID NO: 2007412 - RNA, 20 nt, Homo sapiens
gccgugauuuucauugcugg

SEQ ID NO: 2007413 - RNA, 17 nt, Homo sapiens
aacuauuacaccaaaua

SEQ ID NO: 2007414 - RNA, 22 nt, Homo sapiens
acuugagucacaaagaacaugu

SEQ ID NO: 2007415 - RNA, 22 nt, Homo sapiens
caaaauuuuguaaauaugcaaa

SEQ ID NO: 2007416 - RNA, 16 nt, Homo sapiens
aauuuuauuaaaugca

SEQ ID NO: 2007417 - RNA, 22 nt, Homo sapiens
agcccucagcaaugugccuucu

SEQ ID NO: 2007418 - RNA, 18 nt, Homo sapiens
gccucagcugaaaacccg

SEQ ID NO: 2007419 - RNA, 16 nt, Homo sapiens
cauauguuuaucucac

SEQ ID NO: 2007420 - RNA, 18 nt, Homo sapiens
cuaggccugaaaugacau

SEQ ID NO: 2007421 - RNA, 21 nt, Homo sapiens
gcaacuaaaaugugucuugcu

SEQ ID NO: 2007422 - RNA, 17 nt, Homo sapiens
guggcuccuaccagcaa

SEQ ID NO: 2007423 - RNA, 20 nt, Homo sapiens
gccacuguuugucucaccua

SEQ ID NO: 2007424 - RNA, 14 nt, Homo sapiens
ggccacacgcugcc

SEQ ID NO: 2007425 - RNA, 16 nt, Homo sapiens
aaaucccuuguucuca

SEQ ID NO: 2007426 - RNA, 13 nt, Homo sapiens
acugggcuucuag

SEQ ID NO: 2007427 - RNA, 14 nt, Homo sapiens
aggagacuuguaca

SEQ ID NO: 2007428 - RNA, 17 nt, Homo sapiens
gaauucuguacuuccaa

SEQ ID NO: 2007429 - RNA, 18 nt, Homo sapiens
auuuucaugugguacuac

SEQ ID NO: 2007430 - RNA, 23 nt, Homo sapiens
aaagcuuucauguaaacugugca

SEQ ID NO: 2007431 - RNA, 22 nt, Homo sapiens
aaauauauauuauauauuuaca

SEQ ID NO: 2007432 - RNA, 16 nt, Homo sapiens
ccugcccagugcacuu

SEQ ID NO: 2007433 - RNA, 19 nt, Homo sapiens
auggaauauaaauaucaca

SEQ ID NO: 2007434 - RNA, 19 nt, Homo sapiens
cuaauggaaaaugauuuua

SEQ ID NO: 2007435 - RNA, 17 nt, Homo sapiens
caugugaaagugcacuu

SEQ ID NO: 2007436 - RNA, 19 nt, Homo sapiens
caggugugagccaccgugc

SEQ ID NO: 2007437 - RNA, 14 nt, Homo sapiens
ucuacacaacaugu

SEQ ID NO: 2007438 - RNA, 16 nt, Homo sapiens
agccucgcucuugucu

SEQ ID NO: 2007439 - RNA, 16 nt, Homo sapiens
ucugcuguugauucca

SEQ ID NO: 2007440 - RNA, 15 nt, Homo sapiens
acccuguuaauccca

SEQ ID NO: 2007441 - RNA, 22 nt, Homo sapiens
acaaacucuuuccuucaaagag

SEQ ID NO: 2007442 - RNA, 13 nt, Homo sapiens
guccaaggucuca

SEQ ID NO: 2007443 - RNA, 18 nt, Homo sapiens
gccagggcucagaugggg

SEQ ID NO: 2007444 - RNA, 23 nt, Homo sapiens
cugaacccagaaacaacacaauc

SEQ ID NO: 2007445 - RNA, 20 nt, Homo sapiens
ugagccagcccuccuugacc

SEQ ID NO: 2007446 - RNA, 19 nt, Homo sapiens
ucagccuuuugaugucuuu

SEQ ID NO: 2007447 - RNA, 19 nt, Homo sapiens
ucugcaggugagcagacag

SEQ ID NO: 2007448 - RNA, 16 nt, Homo sapiens
ggccaccccaccagaa

SEQ ID NO: 2007449 - RNA, 16 nt, Homo sapiens
acucuuguugugcucu

SEQ ID NO: 2007450 - RNA, 15 nt, Homo sapiens
agugaucucacuuaa

SEQ ID NO: 2007451 - RNA, 17 nt, Homo sapiens
cuauuuugaaaaaccau

SEQ ID NO: 2007452 - RNA, 15 nt, Homo sapiens
aaucuuuuauauuga

SEQ ID NO: 2007453 - RNA, 17 nt, Homo sapiens
gaaggagaggauuuggc

SEQ ID NO: 2007454 - RNA, 15 nt, Homo sapiens
agcucuggaccagcc

SEQ ID NO: 2007455 - RNA, 23 nt, Homo sapiens
gucuuucuguaagguggacuucc

SEQ ID NO: 2007456 - RNA, 18 nt, Homo sapiens
ggaugcuccagauggugg

SEQ ID NO: 2007457 - RNA, 20 nt, Homo sapiens
aauauaagaaaaguaaugaa

SEQ ID NO: 2007458 - RNA, 15 nt, Homo sapiens
caaauuaagaaucua

SEQ ID NO: 2007459 - RNA, 19 nt, Homo sapiens
ugacaucaaacuugugagg

SEQ ID NO: 2007460 - RNA, 15 nt, Homo sapiens
gaaugacugacaaag

SEQ ID NO: 2007461 - RNA, 22 nt, Homo sapiens
agagggacagaugaaugccgug

SEQ ID NO: 2007462 - RNA, 13 nt, Homo sapiens
uuaggacugacau

SEQ ID NO: 2007463 - RNA, 14 nt, Homo sapiens
ccuggcgugagaug

SEQ ID NO: 2007464 - RNA, 19 nt, Homo sapiens
auuuuccgccagaccucaa

SEQ ID NO: 2007465 - RNA, 19 nt, Homo sapiens
auuuuauucaagaaugcca

SEQ ID NO: 2007466 - RNA, 15 nt, Homo sapiens
cugguuauaacagca

SEQ ID NO: 2007467 - RNA, 13 nt, Homo sapiens
ggggucugcagca

SEQ ID NO: 2007468 - RNA, 12 nt, Homo sapiens
cuaaauaucaua

SEQ ID NO: 2007469 - RNA, 14 nt, Homo sapiens
uacauuugugcugu

SEQ ID NO: 2007470 - RNA, 21 nt, Homo sapiens
auuccucaagcaugagaccuu

SEQ ID NO: 2007471 - RNA, 18 nt, Homo sapiens
uuauuugugauguacugu

SEQ ID NO: 2007472 - RNA, 18 nt, Homo sapiens
ccugacagcuuuaucucc

SEQ ID NO: 2007473 - RNA, 13 nt, Homo sapiens
uguuggucugugu

SEQ ID NO: 2007474 - RNA, 17 nt, Homo sapiens
acauaaguaccucagca

SEQ ID NO: 2007475 - RNA, 18 nt, Homo sapiens
aaggcacuaaaaagagcu

SEQ ID NO: 2007476 - RNA, 14 nt, Homo sapiens
aacagcaaagccau

SEQ ID NO: 2007477 - RNA, 17 nt, Homo sapiens
acuucugacuacuuguu

SEQ ID NO: 2007478 - RNA, 14 nt, Homo sapiens
agaaagucucucau

SEQ ID NO: 2007479 - RNA, 12 nt, Homo sapiens
ugaaaaccuaaa

SEQ ID NO: 2007480 - RNA, 18 nt, Homo sapiens
ugaacucuuugaaugaca

SEQ ID NO: 2007481 - RNA, 16 nt, Homo sapiens
gauccacccaccucag

SEQ ID NO: 2007482 - RNA, 18 nt, Homo sapiens
ugaauguugugauguauu

SEQ ID NO: 2007483 - RNA, 13 nt, Homo sapiens
ccaaccucaggga

SEQ ID NO: 2007484 - RNA, 17 nt, Homo sapiens
agccauguuuaagauuu

SEQ ID NO: 2007485 - RNA, 20 nt, Homo sapiens
uauguuuccgaggcacuguu

SEQ ID NO: 2007486 - RNA, 16 nt, Homo sapiens
cugcuccaguccugga

SEQ ID NO: 2007487 - RNA, 22 nt, Homo sapiens
aaaccuauacucacuuucccaa

SEQ ID NO: 2007488 - RNA, 20 nt, Homo sapiens
uuaggaacuuuauguucuaa

SEQ ID NO: 2007489 - RNA, 15 nt, Homo sapiens
gccuuuccucaaaac

SEQ ID NO: 2007490 - RNA, 15 nt, Homo sapiens
uacucuauguaugca

SEQ ID NO: 2007491 - RNA, 15 nt, Homo sapiens
gaccgucuuuacccc

SEQ ID NO: 2007492 - RNA, 19 nt, Homo sapiens
auggucuccaccugugcuu

SEQ ID NO: 2007493 - RNA, 16 nt, Homo sapiens
ccuuccaagaagacca

SEQ ID NO: 2007494 - RNA, 17 nt, Homo sapiens
cagcugaaaguucuugc

SEQ ID NO: 2007495 - RNA, 18 nt, Homo sapiens
augucagugucacuggau

SEQ ID NO: 2007496 - RNA, 17 nt, Homo sapiens
augacagggaugccaac

SEQ ID NO: 2007497 - RNA, 11 nt, Homo sapiens
agaaucugggg

SEQ ID NO: 2007498 - RNA, 15 nt, Homo sapiens
ggucuucccuaccuc

SEQ ID NO: 2007499 - RNA, 21 nt, Homo sapiens
cauguccuucuuguccacggu

SEQ ID NO: 2007500 - RNA, 18 nt, Homo sapiens
ggucagaagagaggguga

SEQ ID NO: 2007501 - RNA, 23 nt, Homo sapiens
gccucgagggccgccugccuuag

SEQ ID NO: 2007502 - RNA, 14 nt, Homo sapiens
cgucucugcuaaac

SEQ ID NO: 2007503 - RNA, 11 nt, Homo sapiens
cuuucuuggcc

SEQ ID NO: 2007504 - RNA, 15 nt, Homo sapiens
ccauuaggcaugccu

SEQ ID NO: 2007505 - RNA, 20 nt, Homo sapiens
gggucuggcuguguggccaa

SEQ ID NO: 2007506 - RNA, 18 nt, Homo sapiens
cuuccagagaacacaggg

SEQ ID NO: 2007507 - RNA, 18 nt, Homo sapiens
uuauuggauucacaccca

SEQ ID NO: 2007508 - RNA, 17 nt, Homo sapiens
gcucccacuucugccag

SEQ ID NO: 2007509 - RNA, 18 nt, Homo sapiens
aaugggucucucuugccc

SEQ ID NO: 2007510 - RNA, 12 nt, Homo sapiens
cauuuagcacau

SEQ ID NO: 2007511 - RNA, 16 nt, Homo sapiens
cuuccgugagacacaa

SEQ ID NO: 2007512 - RNA, 17 nt, Homo sapiens
ugagccaguaaucuuua

SEQ ID NO: 2007513 - RNA, 23 nt, Homo sapiens
ugcacaagaauggaucacaagau

SEQ ID NO: 2007514 - RNA, 21 nt, Homo sapiens
cuugccagccagaagccucug

SEQ ID NO: 2007515 - RNA, 16 nt, Homo sapiens
gugcuugucauuccag

SEQ ID NO: 2007516 - RNA, 13 nt, Homo sapiens
cauggacagugug

SEQ ID NO: 2007517 - RNA, 22 nt, Homo sapiens
caacauaauuaaauuuugaguu

SEQ ID NO: 2007518 - RNA, 21 nt, Homo sapiens
agaaaacuugacauguagcuu

SEQ ID NO: 2007519 - RNA, 15 nt, Homo sapiens
caagugucucagucc

SEQ ID NO: 2007520 - RNA, 15 nt, Homo sapiens
aacuuguucuuccaa

SEQ ID NO: 2007521 - RNA, 17 nt, Homo sapiens
acaauuuauaugcuuca

SEQ ID NO: 2007522 - RNA, 16 nt, Homo sapiens
cuucagcccaccaccc

SEQ ID NO: 2007523 - RNA, 12 nt, Homo sapiens
gucuguuugcaa

SEQ ID NO: 2007524 - RNA, 14 nt, Homo sapiens
ucauuuagaacuug

SEQ ID NO: 2007525 - RNA, 19 nt, Homo sapiens
cagacacacacacacacaa

SEQ ID NO: 2007526 - RNA, 19 nt, Homo sapiens
cccacagggaacacauucc

SEQ ID NO: 2007527 - RNA, 12 nt, Homo sapiens
augucuccaugu

SEQ ID NO: 2007528 - RNA, 16 nt, Homo sapiens
ccccaggaauuuggga

SEQ ID NO: 2007529 - RNA, 16 nt, Homo sapiens
uuuuagaugaccaaaa

SEQ ID NO: 2007530 - RNA, 20 nt, Homo sapiens
acugcuuuccagccugggca

SEQ ID NO: 2007531 - RNA, 16 nt, Homo sapiens
aaucccugccacuggg

SEQ ID NO: 2007532 - RNA, 22 nt, Homo sapiens
aaagauauggaguuauguggau

SEQ ID NO: 2007533 - RNA, 16 nt, Homo sapiens
ccuuuacuaucauucu

SEQ ID NO: 2007534 - RNA, 16 nt, Homo sapiens
acuucuggcucacagg

SEQ ID NO: 2007535 - RNA, 16 nt, Homo sapiens
acuagagacucuguga

SEQ ID NO: 2007536 - RNA, 18 nt, Homo sapiens
auuccagcugucuugucu

SEQ ID NO: 2007537 - RNA, 16 nt, Homo sapiens
cucugaggcugaaauu

SEQ ID NO: 2007538 - RNA, 17 nt, Homo sapiens
aguuaggcagugcagua

SEQ ID NO: 2007539 - RNA, 20 nt, Homo sapiens
aauacugauguuccuaguga

SEQ ID NO: 2007540 - RNA, 14 nt, Homo sapiens
uuuaugaauaucau

SEQ ID NO: 2007541 - RNA, 23 nt, Homo sapiens
cagacccccccauuucccgcaca

SEQ ID NO: 2007542 - RNA, 22 nt, Homo sapiens
uacacuuugaacuacuagaaaa

SEQ ID NO: 2007543 - RNA, 20 nt, Homo sapiens
acugcaagcagggcucugcc

SEQ ID NO: 2007544 - RNA, 13 nt, Homo sapiens
uguguaacugaau

SEQ ID NO: 2007545 - RNA, 21 nt, Homo sapiens
ggccuaccccaguuccuagca

SEQ ID NO: 2007546 - RNA, 15 nt, Homo sapiens
cucuuaccuguaaua

SEQ ID NO: 2007547 - RNA, 16 nt, Homo sapiens
gaaccaagcaggagac

SEQ ID NO: 2007548 - RNA, 14 nt, Homo sapiens
acaggcuguagauu

SEQ ID NO: 2007549 - RNA, 21 nt, Homo sapiens
guucauauuuauacuuugcaa

SEQ ID NO: 2007550 - RNA, 15 nt, Homo sapiens
cuuuuugugucucca

SEQ ID NO: 2007551 - RNA, 20 nt, Homo sapiens
uauauguguauauauacaua

SEQ ID NO: 2007552 - RNA, 19 nt, Homo sapiens
augccuuucaaacauugag

SEQ ID NO: 2007553 - RNA, 11 nt, Homo sapiens
ucaguccuuga

SEQ ID NO: 2007554 - RNA, 16 nt, Homo sapiens
cuauuggcuuacugaa

SEQ ID NO: 2007555 - RNA, 14 nt, Homo sapiens
agacgguuaaauac

SEQ ID NO: 2007556 - RNA, 21 nt, Homo sapiens
aagcuccucucuugauucucu

SEQ ID NO: 2007557 - RNA, 19 nt, Homo sapiens
uugacccuugcugugaauu

SEQ ID NO: 2007558 - RNA, 15 nt, Homo sapiens
uccauccuuugcauu

SEQ ID NO: 2007559 - RNA, 15 nt, Homo sapiens
caacuuuaagauaga

SEQ ID NO: 2007560 - RNA, 15 nt, Homo sapiens
caaugauaaugcuaa

SEQ ID NO: 2007561 - RNA, 16 nt, Homo sapiens
uucugaucugaugcaa

SEQ ID NO: 2007562 - RNA, 19 nt, Homo sapiens
acauacaagagacauauaa

SEQ ID NO: 2007563 - RNA, 16 nt, Homo sapiens
uuuaaacuauaagcaa

SEQ ID NO: 2007564 - RNA, 13 nt, Homo sapiens
agggugucuguca

SEQ ID NO: 2007565 - RNA, 23 nt, Homo sapiens
uauccuuuguacuguagcuaaau

SEQ ID NO: 2007566 - RNA, 18 nt, Homo sapiens
aaauaagcucuccccaaa

SEQ ID NO: 2007567 - RNA, 20 nt, Homo sapiens
gcagauaacugcuguauuca

SEQ ID NO: 2007568 - RNA, 23 nt, Homo sapiens
uucuucuguuauuuauuucagca

SEQ ID NO: 2007569 - RNA, 17 nt, Homo sapiens
ccugcacugacucugga

SEQ ID NO: 2007570 - RNA, 20 nt, Homo sapiens
gggcacuacauaauugcugu

SEQ ID NO: 2007571 - RNA, 13 nt, Homo sapiens
ugcagcagagccu

SEQ ID NO: 2007572 - RNA, 24 nt, Homo sapiens
aaccagaauuaggucaaguucaua

SEQ ID NO: 2007573 - RNA, 13 nt, Homo sapiens
uaggcaaaguaca

SEQ ID NO: 2007574 - RNA, 22 nt, Homo sapiens
agaacaguuguccaggaugcug

SEQ ID NO: 2007575 - RNA, 19 nt, Homo sapiens
uccccaguauuaucuuacu

SEQ ID NO: 2007576 - RNA, 12 nt, Homo sapiens
uuuaaacaaagg

SEQ ID NO: 2007577 - RNA, 19 nt, Homo sapiens
uccauagauauaaagccau

SEQ ID NO: 2007578 - RNA, 19 nt, Homo sapiens
uucuggacauguccaggag

SEQ ID NO: 2007579 - RNA, 12 nt, Homo sapiens
auacaaacaauc

SEQ ID NO: 2007580 - RNA, 16 nt, Homo sapiens
cacaggcauagaguga

SEQ ID NO: 2007581 - RNA, 19 nt, Homo sapiens
auauauuugauacauauaa

SEQ ID NO: 2007582 - RNA, 21 nt, Homo sapiens
ucaaaucaguccuuugauucc

SEQ ID NO: 2007583 - RNA, 20 nt, Homo sapiens
cacguuuaaucccagcacuu

SEQ ID NO: 2007584 - RNA, 16 nt, Homo sapiens
caccacaaaucugaau

SEQ ID NO: 2007585 - RNA, 20 nt, Homo sapiens
cucuagugacuuccugguga

SEQ ID NO: 2007586 - RNA, 14 nt, Homo sapiens
ucagaguccuugca

SEQ ID NO: 2007587 - RNA, 18 nt, Homo sapiens
ugggugcccucuccaaag

SEQ ID NO: 2007588 - RNA, 23 nt, Homo sapiens
gagcugggaguagcauggacucu

SEQ ID NO: 2007589 - RNA, 18 nt, Homo sapiens
ucagcaaccugacucagg

SEQ ID NO: 2007590 - RNA, 15 nt, Homo sapiens
uccuacauuaauuau

SEQ ID NO: 2007591 - RNA, 12 nt, Homo sapiens
accucucagggc

SEQ ID NO: 2007592 - RNA, 12 nt, Homo sapiens
ggaccucaaagg

SEQ ID NO: 2007593 - RNA, 17 nt, Homo sapiens
ugcucuaggaagacauu

SEQ ID NO: 2007594 - RNA, 21 nt, Homo sapiens
aaauaaugguguccagucuuu

SEQ ID NO: 2007595 - RNA, 14 nt, Homo sapiens
gugaagagucuaca

SEQ ID NO: 2007596 - RNA, 17 nt, Homo sapiens
acaugagaucuagguga

SEQ ID NO: 2007597 - RNA, 18 nt, Homo sapiens
cuaucuuagguggagcua

SEQ ID NO: 2007598 - RNA, 14 nt, Homo sapiens
uaguuuauuucaac

SEQ ID NO: 2007599 - RNA, 22 nt, Homo sapiens
cacuggggaaacauaacuccau

SEQ ID NO: 2007600 - RNA, 23 nt, Homo sapiens
ccugcaguagaaugggggcagca

SEQ ID NO: 2007601 - RNA, 15 nt, Homo sapiens
ugguuuugaauauua

SEQ ID NO: 2007602 - RNA, 20 nt, Homo sapiens
agaccuaccucagguugcug

SEQ ID NO: 2007603 - RNA, 13 nt, Homo sapiens
auguuuacaggaa

SEQ ID NO: 2007604 - RNA, 13 nt, Homo sapiens
aucaauacagcuu

SEQ ID NO: 2007605 - RNA, 13 nt, Homo sapiens
agaaauacauauu

SEQ ID NO: 2007606 - RNA, 14 nt, Homo sapiens
cugagaccaaagaa

SEQ ID NO: 2007607 - RNA, 19 nt, Homo sapiens
cuggaucacagacacugca

SEQ ID NO: 2007608 - RNA, 11 nt, Homo sapiens
cuuugccaaau

SEQ ID NO: 2007609 - RNA, 20 nt, Homo sapiens
acuaggcaauguacucuucc

SEQ ID NO: 2007610 - RNA, 13 nt, Homo sapiens
aaucugaccaaaa

SEQ ID NO: 2007611 - RNA, 12 nt, Homo sapiens
uccgauguuugu

SEQ ID NO: 2007612 - RNA, 15 nt, Homo sapiens
aaucauuuucauuaa

SEQ ID NO: 2007613 - RNA, 15 nt, Homo sapiens
cuggcaauaaacucc

SEQ ID NO: 2007614 - RNA, 17 nt, Homo sapiens
ugaggccaggacuuuga

SEQ ID NO: 2007615 - RNA, 12 nt, Homo sapiens
aaaugccagugu

SEQ ID NO: 2007616 - RNA, 22 nt, Homo sapiens
aaaagccagggcuggagaacaa

SEQ ID NO: 2007617 - RNA, 23 nt, Homo sapiens
acuugaaaguuuuccaguauuga

SEQ ID NO: 2007618 - RNA, 20 nt, Homo sapiens
ugaaaauugucuucuucugu

SEQ ID NO: 2007619 - RNA, 13 nt, Homo sapiens
uucuagucaugug

SEQ ID NO: 2007620 - RNA, 14 nt, Homo sapiens
ugagaaauuuacua

SEQ ID NO: 2007621 - RNA, 19 nt, Homo sapiens
aacucuguuauucuucaaa

SEQ ID NO: 2007622 - RNA, 18 nt, Homo sapiens
caugauguauuguugcuu

SEQ ID NO: 2007623 - RNA, 23 nt, Homo sapiens
gcgaaaaacucaaccaaauggua

SEQ ID NO: 2007624 - RNA, 14 nt, Homo sapiens
auguuuuaaucucc

SEQ ID NO: 2007625 - RNA, 20 nt, Homo sapiens
uaccuggaugauucaggaga

SEQ ID NO: 2007626 - RNA, 19 nt, Homo sapiens
cauucuguauaaaugcaaa

SEQ ID NO: 2007627 - RNA, 22 nt, Homo sapiens
aaaauaaauauaucuaccccag

SEQ ID NO: 2007628 - RNA, 13 nt, Homo sapiens
ucuucuaugcuuu

SEQ ID NO: 2007629 - RNA, 13 nt, Homo sapiens
gcagcaaaaccuu

SEQ ID NO: 2007630 - RNA, 10 nt, Homo sapiens
uauggucaca

SEQ ID NO: 2007631 - RNA, 17 nt, Homo sapiens
uauuuaaauaaaaucac

SEQ ID NO: 2007632 - RNA, 18 nt, Homo sapiens
cuguguuucuggggacac

SEQ ID NO: 2007633 - RNA, 21 nt, Homo sapiens
aaggccagccauuuuucagua

SEQ ID NO: 2007634 - RNA, 16 nt, Homo sapiens
ggaggugaagguugcu

SEQ ID NO: 2007635 - RNA, 16 nt, Homo sapiens
caggauucucuucuca

SEQ ID NO: 2007636 - RNA, 13 nt, Homo sapiens
gcaaaggacagau

SEQ ID NO: 2007637 - RNA, 13 nt, Homo sapiens
acucuguccugga

SEQ ID NO: 2007638 - RNA, 17 nt, Homo sapiens
ugcuaaauauaaaaaca

SEQ ID NO: 2007639 - RNA, 19 nt, Homo sapiens
ugggaccagaaguguuuca

SEQ ID NO: 2007640 - RNA, 21 nt, Homo sapiens
uuacccuucugugcccagcuc

SEQ ID NO: 2007641 - RNA, 20 nt, Homo sapiens
uguaaauacucaugaaugaa

SEQ ID NO: 2007642 - RNA, 21 nt, Homo sapiens
ugaugauacuccaccagugaa

SEQ ID NO: 2007643 - RNA, 20 nt, Homo sapiens
aagaaaauuauugaguauga

SEQ ID NO: 2007644 - RNA, 18 nt, Homo sapiens
gauccugcuccagcagca

SEQ ID NO: 2007645 - RNA, 15 nt, Homo sapiens
ucaaaagaaugucca

SEQ ID NO: 2007646 - RNA, 12 nt, Homo sapiens
ugugcccgggga

SEQ ID NO: 2007647 - RNA, 11 nt, Homo sapiens
gcaaucaaaaa

SEQ ID NO: 2007648 - RNA, 18 nt, Homo sapiens
aggacaccuuuuaacuca

SEQ ID NO: 2007649 - RNA, 21 nt, Homo sapiens
gucuccucaugcccccucagu

SEQ ID NO: 2007650 - RNA, 13 nt, Homo sapiens
gauauauuccacc

SEQ ID NO: 2007651 - RNA, 22 nt, Homo sapiens
gucugccauugauccagcucag

SEQ ID NO: 2007652 - RNA, 14 nt, Homo sapiens
agaccgaccaccag

SEQ ID NO: 2007653 - RNA, 19 nt, Homo sapiens
uguggaguggacauucaaa

SEQ ID NO: 2007654 - RNA, 18 nt, Homo sapiens
cucuuugauuauuugcau

SEQ ID NO: 2007655 - RNA, 14 nt, Homo sapiens
aaguuggcuucuaa

SEQ ID NO: 2007656 - RNA, 20 nt, Homo sapiens
aaauugaauaguuuauuucu

SEQ ID NO: 2007657 - RNA, 15 nt, Homo sapiens
cagugaauauucaau

SEQ ID NO: 2007658 - RNA, 13 nt, Homo sapiens
agguauggcagag

SEQ ID NO: 2007659 - RNA, 15 nt, Homo sapiens
uugacaauaauuuca

SEQ ID NO: 2007660 - RNA, 14 nt, Homo sapiens
uguugguagccauu

SEQ ID NO: 2007661 - RNA, 16 nt, Homo sapiens
ugcaguguuuaaguca

SEQ ID NO: 2007662 - RNA, 15 nt, Homo sapiens
agcgauggugccugc

SEQ ID NO: 2007663 - RNA, 15 nt, Homo sapiens
caccugacucuugca

SEQ ID NO: 2007664 - RNA, 13 nt, Homo sapiens
uuuagaagagccu

SEQ ID NO: 2007665 - RNA, 18 nt, Homo sapiens
cauaaccccacccuugcc

SEQ ID NO: 2007666 - RNA, 20 nt, Homo sapiens
uaucuuaaccucaaaacugu

SEQ ID NO: 2007667 - RNA, 19 nt, Homo sapiens
auacaaucuuggagucaaa

SEQ ID NO: 2007668 - RNA, 14 nt, Homo sapiens
aggcaagagcucaa

SEQ ID NO: 2007669 - RNA, 21 nt, Homo sapiens
aacuuucucuuugccauuucu

SEQ ID NO: 2007670 - RNA, 20 nt, Homo sapiens
gaauacuuugaugauugcca

SEQ ID NO: 2007671 - RNA, 14 nt, Homo sapiens
ggauggaggccaga

SEQ ID NO: 2007672 - RNA, 14 nt, Homo sapiens
agcaagauguacua

SEQ ID NO: 2007673 - RNA, 11 nt, Homo sapiens
ucuucauggcc

SEQ ID NO: 2007674 - RNA, 23 nt, Homo sapiens
augucuguuucaaugaccuguau

SEQ ID NO: 2007675 - RNA, 16 nt, Homo sapiens
uuaacacuuaguguuc

SEQ ID NO: 2007676 - RNA, 15 nt, Homo sapiens
cuaauagaaaacugu

SEQ ID NO: 2007677 - RNA, 14 nt, Homo sapiens
aaaaacuucuuuaa

SEQ ID NO: 2007678 - RNA, 18 nt, Homo sapiens
ccuugcaaauagccagug

SEQ ID NO: 2007679 - RNA, 18 nt, Homo sapiens
agaagaccucccugugag

SEQ ID NO: 2007680 - RNA, 20 nt, Homo sapiens
gaugggagugcccccaacag

SEQ ID NO: 2007681 - RNA, 15 nt, Homo sapiens
cccauucuacacaga

SEQ ID NO: 2007682 - RNA, 21 nt, Homo sapiens
auggauuaaacaaguauaaaa

SEQ ID NO: 2007683 - RNA, 14 nt, Homo sapiens
agagcuaugcacac

SEQ ID NO: 2007684 - RNA, 22 nt, Homo sapiens
uuaaagaauucuguacccugau

SEQ ID NO: 2007685 - RNA, 15 nt, Homo sapiens
cagaggucucccaaa

SEQ ID NO: 2007686 - RNA, 18 nt, Homo sapiens
agaauaguaguaacuguu

SEQ ID NO: 2007687 - RNA, 16 nt, Homo sapiens
ucaguuuucagcuaua

SEQ ID NO: 2007688 - RNA, 15 nt, Homo sapiens
auugauuacuaucau

SEQ ID NO: 2007689 - RNA, 22 nt, Homo sapiens
aacuuggucugcagaccaucca

SEQ ID NO: 2007690 - RNA, 12 nt, Homo sapiens
aucuuuacacaa

SEQ ID NO: 2007691 - RNA, 15 nt, Homo sapiens
uguguucgacucagc

SEQ ID NO: 2007692 - RNA, 20 nt, Homo sapiens
ugcugaguauguuaagcucu

SEQ ID NO: 2007693 - RNA, 17 nt, Homo sapiens
cuucugcuuaaucugag

SEQ ID NO: 2007694 - RNA, 13 nt, Homo sapiens
aagcaacugugaa

SEQ ID NO: 2007695 - RNA, 15 nt, Homo sapiens
aaauuaaacccugcc

SEQ ID NO: 2007696 - RNA, 17 nt, Homo sapiens
guccauccgacugcccc

SEQ ID NO: 2007697 - RNA, 13 nt, Homo sapiens
augcucaagcccu

SEQ ID NO: 2007698 - RNA, 23 nt, Homo sapiens
ccagaaguuuuaacuuccagugg

SEQ ID NO: 2007699 - RNA, 16 nt, Homo sapiens
aacagcugacccagug

SEQ ID NO: 2007700 - RNA, 18 nt, Homo sapiens
cauggagcucugagauca

SEQ ID NO: 2007701 - RNA, 15 nt, Homo sapiens
cugucaccuagcuca

SEQ ID NO: 2007702 - RNA, 20 nt, Homo sapiens
aauaauacaguaucucaggg

SEQ ID NO: 2007703 - RNA, 23 nt, Homo sapiens
aggaagccagcaggcucucaggc

SEQ ID NO: 2007704 - RNA, 17 nt, Homo sapiens
uucccccuuccuaguga

SEQ ID NO: 2007705 - RNA, 16 nt, Homo sapiens
ucaaaccacaauaucc

SEQ ID NO: 2007706 - RNA, 16 nt, Homo sapiens
uauugcaaccuaguac

SEQ ID NO: 2007707 - RNA, 14 nt, Homo sapiens
aacauggccuuugc

SEQ ID NO: 2007708 - RNA, 18 nt, Homo sapiens
gggccaaagaaccaaaga

SEQ ID NO: 2007709 - RNA, 22 nt, Homo sapiens
gcccuagcccugcuccaacucc

SEQ ID NO: 2007710 - RNA, 20 nt, Homo sapiens
ugacucccgaugcaggggau

SEQ ID NO: 2007711 - RNA, 19 nt, Homo sapiens
uaacugugaaauaccacaa

SEQ ID NO: 2007712 - RNA, 19 nt, Homo sapiens
caggaaacuucgccagcug

SEQ ID NO: 2007713 - RNA, 18 nt, Homo sapiens
uagcuuucaguauuguaa

SEQ ID NO: 2007714 - RNA, 21 nt, Homo sapiens
cauuguuaccucuauauacca

SEQ ID NO: 2007715 - RNA, 15 nt, Homo sapiens
aauucgcugcaaccu

SEQ ID NO: 2007716 - RNA, 20 nt, Homo sapiens
ggcacagggucugcucuuuc

SEQ ID NO: 2007717 - RNA, 17 nt, Homo sapiens
acaugggcucuucacua

SEQ ID NO: 2007718 - RNA, 20 nt, Homo sapiens
auuggcugguaacaguucau

SEQ ID NO: 2007719 - RNA, 19 nt, Homo sapiens
guugugaaaaucugucaug

SEQ ID NO: 2007720 - RNA, 19 nt, Homo sapiens
caaacaugcggugccauga

SEQ ID NO: 2007721 - RNA, 14 nt, Homo sapiens
ggccagcagcaccu

SEQ ID NO: 2007722 - RNA, 17 nt, Homo sapiens
uaauuucuuacuaaaca

SEQ ID NO: 2007723 - RNA, 23 nt, Homo sapiens
uccaacggcaagggaacaaguac

SEQ ID NO: 2007724 - RNA, 19 nt, Homo sapiens
acuccuguaacugucucag

SEQ ID NO: 2007725 - RNA, 13 nt, Homo sapiens
uaguuuucauaca

SEQ ID NO: 2007726 - RNA, 18 nt, Homo sapiens
agucagcucugaucacau

SEQ ID NO: 2007727 - RNA, 12 nt, Homo sapiens
uugcacauucua

SEQ ID NO: 2007728 - RNA, 15 nt, Homo sapiens
guuugcagcugugag

SEQ ID NO: 2007729 - RNA, 13 nt, Homo sapiens
aacacaagccaca

SEQ ID NO: 2007730 - RNA, 19 nt, Homo sapiens
gacucuguccuuccaugca

SEQ ID NO: 2007731 - RNA, 19 nt, Homo sapiens
uccucagagcuaacauaaa

SEQ ID NO: 2007732 - RNA, 22 nt, Homo sapiens
ugagacuguuuauuaccagauu

SEQ ID NO: 2007733 - RNA, 19 nt, Homo sapiens
acuguacauaaaaugucau

SEQ ID NO: 2007734 - RNA, 21 nt, Homo sapiens
gccuuuauuaaaaacugagug

SEQ ID NO: 2007735 - RNA, 17 nt, Homo sapiens
aagccagaagcugagca

SEQ ID NO: 2007736 - RNA, 22 nt, Homo sapiens
ccccaagugcggggaguacaag

SEQ ID NO: 2007737 - RNA, 21 nt, Homo sapiens
auaaaguaauuguaugugcuu

SEQ ID NO: 2007738 - RNA, 22 nt, Homo sapiens
acucacccuccacaaagcaaag

SEQ ID NO: 2007739 - RNA, 18 nt, Homo sapiens
gccacagccaagcccacc

SEQ ID NO: 2007740 - RNA, 17 nt, Homo sapiens
uucauauuaugaugcca

SEQ ID NO: 2007741 - RNA, 13 nt, Homo sapiens
cacagggacacag

SEQ ID NO: 2007742 - RNA, 16 nt, Homo sapiens
cucauuuuauacccaa

SEQ ID NO: 2007743 - RNA, 18 nt, Homo sapiens
gcucucaggcugagggag

SEQ ID NO: 2007744 - RNA, 15 nt, Homo sapiens
aaauuguacaaccug

SEQ ID NO: 2007745 - RNA, 22 nt, Homo sapiens
ugacauuuugccaaaauuauua

SEQ ID NO: 2007746 - RNA, 20 nt, Homo sapiens
caugcuuugcugcuaugaaa

SEQ ID NO: 2007747 - RNA, 16 nt, Homo sapiens
auucuuuaucuugcaa

SEQ ID NO: 2007748 - RNA, 11 nt, Homo sapiens
aaaauaugcau

SEQ ID NO: 2007749 - RNA, 16 nt, Homo sapiens
ccauccuguauucuuc

SEQ ID NO: 2007750 - RNA, 15 nt, Homo sapiens
cuucugcaauauuau

SEQ ID NO: 2007751 - RNA, 15 nt, Homo sapiens
caacagcaaauuaau

SEQ ID NO: 2007752 - RNA, 16 nt, Homo sapiens
uggugccaucauugcu

SEQ ID NO: 2007753 - RNA, 22 nt, Homo sapiens
gccugccccccucaucucauuc

SEQ ID NO: 2007754 - RNA, 13 nt, Homo sapiens
caggcuggucuca

SEQ ID NO: 2007755 - RNA, 13 nt, Homo sapiens
gcaaccaauggca

SEQ ID NO: 2007756 - RNA, 23 nt, Homo sapiens
gaggccuauuguugaauaaaugu

SEQ ID NO: 2007757 - RNA, 15 nt, Homo sapiens
uguaaauagugauuu

SEQ ID NO: 2007758 - RNA, 19 nt, Homo sapiens
ggcugacacccaggcccga

SEQ ID NO: 2007759 - RNA, 18 nt, Homo sapiens
uacacucucuagcuuuag

SEQ ID NO: 2007760 - RNA, 15 nt, Homo sapiens
cuagucacauaucaa

SEQ ID NO: 2007761 - RNA, 19 nt, Homo sapiens
gcuuagaaggcacugggaa

SEQ ID NO: 2007762 - RNA, 22 nt, Homo sapiens
aauauaaaaggcaaauguguac

SEQ ID NO: 2007763 - RNA, 16 nt, Homo sapiens
acuagccacugagaag

SEQ ID NO: 2007764 - RNA, 15 nt, Homo sapiens
uggcauuuuacugua

SEQ ID NO: 2007765 - RNA, 20 nt, Homo sapiens
auggugguuguuucuuccaa

SEQ ID NO: 2007766 - RNA, 13 nt, Homo sapiens
cuccggacuccuc

SEQ ID NO: 2007767 - RNA, 16 nt, Homo sapiens
auugguugaaggucac

SEQ ID NO: 2007768 - RNA, 12 nt, Homo sapiens
agccagggcaca

SEQ ID NO: 2007769 - RNA, 12 nt, Homo sapiens
caaaccagcuuu

SEQ ID NO: 2007770 - RNA, 17 nt, Homo sapiens
cacauauggacucugca

SEQ ID NO: 2007771 - RNA, 17 nt, Homo sapiens
auaucaaaaaguauuaa

SEQ ID NO: 2007772 - RNA, 21 nt, Homo sapiens
aaucaagaggacaaucuagcu

SEQ ID NO: 2007773 - RNA, 15 nt, Homo sapiens
gccugucuagcucau

SEQ ID NO: 2007774 - RNA, 13 nt, Homo sapiens
aaugaccaaagau

SEQ ID NO: 2007775 - RNA, 18 nt, Homo sapiens
ucaauuugcgacugcucu

SEQ ID NO: 2007776 - RNA, 18 nt, Homo sapiens
cacccucaucgggcgcua

SEQ ID NO: 2007777 - RNA, 23 nt, Homo sapiens
auguugauuuuuacuguguuuua

SEQ ID NO: 2007778 - RNA, 22 nt, Homo sapiens
cugcugaccucccagugacccc

SEQ ID NO: 2007779 - RNA, 12 nt, Homo sapiens
aaaauguucauu

SEQ ID NO: 2007780 - RNA, 17 nt, Homo sapiens
ucagaucucuaacuuca

SEQ ID NO: 2007781 - RNA, 15 nt, Homo sapiens
gacagccccugcaac

SEQ ID NO: 2007782 - RNA, 22 nt, Homo sapiens
caaaaaucaccaucuuugucaa

SEQ ID NO: 2007783 - RNA, 13 nt, Homo sapiens
uuaucaguaguau

SEQ ID NO: 2007784 - RNA, 21 nt, Homo sapiens
acaaaucuucaguauuuucuc

SEQ ID NO: 2007785 - RNA, 23 nt, Homo sapiens
gcugcaucccuguguccacugag

SEQ ID NO: 2007786 - RNA, 19 nt, Homo sapiens
aguucuuccuccaccucca

SEQ ID NO: 2007787 - RNA, 13 nt, Homo sapiens
guucaguuuacua

SEQ ID NO: 2007788 - RNA, 17 nt, Homo sapiens
ccacagaguaagacauu

SEQ ID NO: 2007789 - RNA, 13 nt, Homo sapiens
auaaagcacauuc

SEQ ID NO: 2007790 - RNA, 22 nt, Homo sapiens
augccucauuaccuugugcuaa

SEQ ID NO: 2007791 - RNA, 13 nt, Homo sapiens
aaggucaccagca

SEQ ID NO: 2007792 - RNA, 20 nt, Homo sapiens
augccaaggccguggggcuc

SEQ ID NO: 2007793 - RNA, 14 nt, Homo sapiens
gucaauacugagcc

SEQ ID NO: 2007794 - RNA, 13 nt, Homo sapiens
auaauaacuggga

SEQ ID NO: 2007795 - RNA, 22 nt, Homo sapiens
agccaaggcaggcagaucacuu

SEQ ID NO: 2007796 - RNA, 14 nt, Homo sapiens
augauuuaggcuuc

SEQ ID NO: 2007797 - RNA, 13 nt, Homo sapiens
uuaaagaacugcu

SEQ ID NO: 2007798 - RNA, 13 nt, Homo sapiens
cuccuuugcacug

SEQ ID NO: 2007799 - RNA, 23 nt, Homo sapiens
aucucuguucuuucauacuacau

SEQ ID NO: 2007800 - RNA, 21 nt, Homo sapiens
guuauuuaucaauuuuuccca

SEQ ID NO: 2007801 - RNA, 22 nt, Homo sapiens
gaacgugugugcgcgugcuggu

SEQ ID NO: 2007802 - RNA, 18 nt, Homo sapiens
auuuguauccuugaugaa

SEQ ID NO: 2007803 - RNA, 18 nt, Homo sapiens
caccaaccagaccacuca

SEQ ID NO: 2007804 - RNA, 15 nt, Homo sapiens
cacaauuauuccaaa

SEQ ID NO: 2007805 - RNA, 17 nt, Homo sapiens
gaccugguuguccaggu

SEQ ID NO: 2007806 - RNA, 20 nt, Homo sapiens
agauuggggguuggaccaga

SEQ ID NO: 2007807 - RNA, 16 nt, Homo sapiens
uagugugaauauuaau

SEQ ID NO: 2007808 - RNA, 20 nt, Homo sapiens
uguuugguguuugucugugu

SEQ ID NO: 2007809 - RNA, 18 nt, Homo sapiens
cccauucacagauaccuc

SEQ ID NO: 2007810 - RNA, 17 nt, Homo sapiens
cguugcaugucgugacc

SEQ ID NO: 2007811 - RNA, 13 nt, Homo sapiens
gcaggugucuauc

SEQ ID NO: 2007812 - RNA, 16 nt, Homo sapiens
auuagacuccauguag

SEQ ID NO: 2007813 - RNA, 23 nt, Homo sapiens
gcaauggugucaguauccaggcu

SEQ ID NO: 2007814 - RNA, 14 nt, Homo sapiens
uggaguuguucaaa

SEQ ID NO: 2007815 - RNA, 14 nt, Homo sapiens
gggggcgugccugc

SEQ ID NO: 2007816 - RNA, 20 nt, Homo sapiens
acacaauucauuggcuccug

SEQ ID NO: 2007817 - RNA, 15 nt, Homo sapiens
uguggacgugcacug

SEQ ID NO: 2007818 - RNA, 17 nt, Homo sapiens
accuaaagcaagccuga

SEQ ID NO: 2007819 - RNA, 14 nt, Homo sapiens
aggcaugagccacc

SEQ ID NO: 2007820 - RNA, 18 nt, Homo sapiens
acuauuuagauaacaaga

SEQ ID NO: 2007821 - RNA, 13 nt, Homo sapiens
ggagguaacgggu

SEQ ID NO: 2007822 - RNA, 19 nt, Homo sapiens
aucuuugcuauggggacau

SEQ ID NO: 2007823 - RNA, 19 nt, Homo sapiens
uuggucaugugguacuuga

SEQ ID NO: 2007824 - RNA, 18 nt, Homo sapiens
gcaggauugauuaugcag

SEQ ID NO: 2007825 - RNA, 19 nt, Homo sapiens
aauacugccggucacccag

SEQ ID NO: 2007826 - RNA, 16 nt, Homo sapiens
cccuccccuuuugaaa

SEQ ID NO: 2007827 - RNA, 22 nt, Homo sapiens
cuacaauuuucccuugauaacc

SEQ ID NO: 2007828 - RNA, 18 nt, Homo sapiens
aaccugugcucauuuugc

SEQ ID NO: 2007829 - RNA, 22 nt, Homo sapiens
auauauuccccuaagauuugau

SEQ ID NO: 2007830 - RNA, 20 nt, Homo sapiens
aaaggaggacaagacccucu

SEQ ID NO: 2007831 - RNA, 17 nt, Homo sapiens
uuuuguuaggcuguaaa

SEQ ID NO: 2007832 - RNA, 19 nt, Homo sapiens
ucacgaaguuuguucauca

SEQ ID NO: 2007833 - RNA, 20 nt, Homo sapiens
cagcggcggaggcgcaggcg

SEQ ID NO: 2007834 - RNA, 17 nt, Homo sapiens
cccagcuuucaaaggac

SEQ ID NO: 2007835 - RNA, 14 nt, Homo sapiens
cccugcaccaugcu

SEQ ID NO: 2007836 - RNA, 17 nt, Homo sapiens
uuaugaguucuguauaa

SEQ ID NO: 2007837 - RNA, 21 nt, Homo sapiens
caucuuucauaguucuguuaa

SEQ ID NO: 2007838 - RNA, 18 nt, Homo sapiens
auaaaugucacugccaac

SEQ ID NO: 2007839 - RNA, 13 nt, Homo sapiens
accagcaggaaag

SEQ ID NO: 2007840 - RNA, 22 nt, Homo sapiens
uaugcuuucuauuuugagauca

SEQ ID NO: 2007841 - RNA, 19 nt, Homo sapiens
uugcuuggaagccagguac

SEQ ID NO: 2007842 - RNA, 15 nt, Homo sapiens
uaaugauagcuacug

SEQ ID NO: 2007843 - RNA, 17 nt, Homo sapiens
auacuauuuauauacaa

SEQ ID NO: 2007844 - RNA, 17 nt, Homo sapiens
aaaaaucuuuucauuaa

SEQ ID NO: 2007845 - RNA, 21 nt, Homo sapiens
cuccucuguuaaaaaaaauga

SEQ ID NO: 2007846 - RNA, 15 nt, Homo sapiens
cuuguucugggcuca

SEQ ID NO: 2007847 - RNA, 14 nt, Homo sapiens
uaacauuugccuua

SEQ ID NO: 2007848 - RNA, 17 nt, Homo sapiens
ugugggccaccagagaa

SEQ ID NO: 2007849 - RNA, 21 nt, Homo sapiens
ugacuuuauguuguaugauuc

SEQ ID NO: 2007850 - RNA, 22 nt, Homo sapiens
cuuucuugauugguucuuccaa

SEQ ID NO: 2007851 - RNA, 14 nt, Homo sapiens
uugcaaagccuuua

SEQ ID NO: 2007852 - RNA, 15 nt, Homo sapiens
agugacaaccaaaag

SEQ ID NO: 2007853 - RNA, 20 nt, Homo sapiens
cucucucagcuaucacauca

SEQ ID NO: 2007854 - RNA, 12 nt, Homo sapiens
acucaacauguu

SEQ ID NO: 2007855 - RNA, 13 nt, Homo sapiens
uugcugcaucucc

SEQ ID NO: 2007856 - RNA, 12 nt, Homo sapiens
agguccuagucg

SEQ ID NO: 2007857 - RNA, 20 nt, Homo sapiens
uguucaauauuuguauuugu

SEQ ID NO: 2007858 - RNA, 15 nt, Homo sapiens
gacccucacuuuucu

SEQ ID NO: 2007859 - RNA, 19 nt, Homo sapiens
uuggaaaaagccugugaaa

SEQ ID NO: 2007860 - RNA, 21 nt, Homo sapiens
gacaaaaggaaaggucucagc

SEQ ID NO: 2007861 - RNA, 15 nt, Homo sapiens
cauguuuuugccaaa

SEQ ID NO: 2007862 - RNA, 17 nt, Homo sapiens
cuguuuauuugcacuau

SEQ ID NO: 2007863 - RNA, 13 nt, Homo sapiens
auguuugcauuaa

SEQ ID NO: 2007864 - RNA, 13 nt, Homo sapiens
uauucccauuaga

SEQ ID NO: 2007865 - RNA, 21 nt, Homo sapiens
gcuuauucuaggucuguaauu

SEQ ID NO: 2007866 - RNA, 13 nt, Homo sapiens
aacuccagacuug

SEQ ID NO: 2007867 - RNA, 13 nt, Homo sapiens
agacucagugcag

SEQ ID NO: 2007868 - RNA, 12 nt, Homo sapiens
cagcacaucuca

SEQ ID NO: 2007869 - RNA, 15 nt, Homo sapiens
agcccagagcccggu

SEQ ID NO: 2007870 - RNA, 17 nt, Homo sapiens
gucuggcuguguugccc

SEQ ID NO: 2007871 - RNA, 20 nt, Homo sapiens
uggaagcuagaaugguggga

SEQ ID NO: 2007872 - RNA, 17 nt, Homo sapiens
aauucuuucaugagcuu

SEQ ID NO: 2007873 - RNA, 13 nt, Homo sapiens
gauagaggguacu

SEQ ID NO: 2007874 - RNA, 16 nt, Homo sapiens
cuuuaaaccacuaaaa

SEQ ID NO: 2007875 - RNA, 16 nt, Homo sapiens
cagacgauuguucuua

SEQ ID NO: 2007876 - RNA, 16 nt, Homo sapiens
ucaguguagacacagg

SEQ ID NO: 2007877 - RNA, 11 nt, Homo sapiens
cuaaauaugau

SEQ ID NO: 2007878 - RNA, 14 nt, Homo sapiens
aucauuucuaguau

SEQ ID NO: 2007879 - RNA, 14 nt, Homo sapiens
acucccuccaugug

SEQ ID NO: 2007880 - RNA, 18 nt, Homo sapiens
accacauagaacaugugu

SEQ ID NO: 2007881 - RNA, 18 nt, Homo sapiens
uuuugaaaaauacaucuu

SEQ ID NO: 2007882 - RNA, 17 nt, Homo sapiens
acuggcuccuuugccuc

SEQ ID NO: 2007883 - RNA, 19 nt, Homo sapiens
aacuuccagguuccaucca

SEQ ID NO: 2007884 - RNA, 17 nt, Homo sapiens
aaguuacuuaauugcca

SEQ ID NO: 2007885 - RNA, 14 nt, Homo sapiens
ucagagccagugaa

SEQ ID NO: 2007886 - RNA, 21 nt, Homo sapiens
auaagauuaaugaccugaauu

SEQ ID NO: 2007887 - RNA, 18 nt, Homo sapiens
cagaaaaauaagucaaaa

SEQ ID NO: 2007888 - RNA, 22 nt, Homo sapiens
aaugccaucagccccugggaac

SEQ ID NO: 2007889 - RNA, 19 nt, Homo sapiens
uagucagaauuagcugcuu

SEQ ID NO: 2007890 - RNA, 14 nt, Homo sapiens
gaacaggcagaaau

SEQ ID NO: 2007891 - RNA, 15 nt, Homo sapiens
gugagacuccaucuc

SEQ ID NO: 2007892 - RNA, 17 nt, Homo sapiens
aucgagaccaucuuggc

SEQ ID NO: 2007893 - RNA, 23 nt, Homo sapiens
cacaauccacaaaugaugcaggu

SEQ ID NO: 2007894 - RNA, 17 nt, Homo sapiens
acugauuaccugccaau

SEQ ID NO: 2007895 - RNA, 23 nt, Homo sapiens
aaagagagaucuugauccacaga

SEQ ID NO: 2007896 - RNA, 14 nt, Homo sapiens
agccaugugcagcc

SEQ ID NO: 2007897 - RNA, 22 nt, Homo sapiens
auugauagaaaucaggccuugc

SEQ ID NO: 2007898 - RNA, 17 nt, Homo sapiens
cauuaucacagugaaug

SEQ ID NO: 2007899 - RNA, 14 nt, Homo sapiens
accauugucuucca

SEQ ID NO: 2007900 - RNA, 15 nt, Homo sapiens
guaaauuaaccaaaa

SEQ ID NO: 2007901 - RNA, 16 nt, Homo sapiens
gucucuccuuguugcc

SEQ ID NO: 2007902 - RNA, 20 nt, Homo sapiens
ccagggggugggcugucacu

SEQ ID NO: 2007903 - RNA, 16 nt, Homo sapiens
aauguuauauaguuua

SEQ ID NO: 2007904 - RNA, 22 nt, Homo sapiens
aauuuacuguugcccauugcac

SEQ ID NO: 2007905 - RNA, 18 nt, Homo sapiens
ccuggagcccgaggcacc

SEQ ID NO: 2007906 - RNA, 12 nt, Homo sapiens
uuucucucuggc

SEQ ID NO: 2007907 - RNA, 20 nt, Homo sapiens
ucugauguuuugaugccauu

SEQ ID NO: 2007908 - RNA, 14 nt, Homo sapiens
uccauauaacaauu

SEQ ID NO: 2007909 - RNA, 23 nt, Homo sapiens
cuauggacgaccuccagcucuca

SEQ ID NO: 2007910 - RNA, 17 nt, Homo sapiens
caugcuucagugcugcu

SEQ ID NO: 2007911 - RNA, 18 nt, Homo sapiens
aaaaugaaccuugcuauc

SEQ ID NO: 2007912 - RNA, 17 nt, Homo sapiens
uucauaaaucuauucau

SEQ ID NO: 2007913 - RNA, 22 nt, Homo sapiens
aaauauuuuccugccacugugu

SEQ ID NO: 2007914 - RNA, 17 nt, Homo sapiens
auaggccuucauuaaca

SEQ ID NO: 2007915 - RNA, 17 nt, Homo sapiens
cacugggccuuuccaga

SEQ ID NO: 2007916 - RNA, 20 nt, Homo sapiens
cauaugcagccaaccaagau

SEQ ID NO: 2007917 - RNA, 14 nt, Homo sapiens
ucaucaugagacaa

SEQ ID NO: 2007918 - RNA, 17 nt, Homo sapiens
cugaaccagcacuaauc

SEQ ID NO: 2007919 - RNA, 16 nt, Homo sapiens
auuaguugaaagggau

SEQ ID NO: 2007920 - RNA, 16 nt, Homo sapiens
gccagcagaacugaag

SEQ ID NO: 2007921 - RNA, 16 nt, Homo sapiens
ugguacuaaggagaau

SEQ ID NO: 2007922 - RNA, 14 nt, Homo sapiens
uugccuaaauacuu

SEQ ID NO: 2007923 - RNA, 16 nt, Homo sapiens
agaagaggcuggugcu

SEQ ID NO: 2007924 - RNA, 18 nt, Homo sapiens
aaagcugugcacuugcag

SEQ ID NO: 2007925 - RNA, 19 nt, Homo sapiens
guucugugugagugcucug

SEQ ID NO: 2007926 - RNA, 20 nt, Homo sapiens
uacucugaaaacaaagcuua

SEQ ID NO: 2007927 - RNA, 14 nt, Homo sapiens
uccuauaccuuacu

SEQ ID NO: 2007928 - RNA, 14 nt, Homo sapiens
acauuagucauuca

SEQ ID NO: 2007929 - RNA, 15 nt, Homo sapiens
gacauuuguuuuuca

SEQ ID NO: 2007930 - RNA, 16 nt, Homo sapiens
cugaagccaaagccaa

SEQ ID NO: 2007931 - RNA, 14 nt, Homo sapiens
gcagcugaacagug

SEQ ID NO: 2007932 - RNA, 14 nt, Homo sapiens
aggccugagggcug

SEQ ID NO: 2007933 - RNA, 22 nt, Homo sapiens
ccugccucccaagguccucuca

SEQ ID NO: 2007934 - RNA, 22 nt, Homo sapiens
ggcagagccccuuaaagcugcu

SEQ ID NO: 2007935 - RNA, 17 nt, Homo sapiens
aguuggcccuucugccc

SEQ ID NO: 2007936 - RNA, 21 nt, Homo sapiens
agcaucaauuccaucagcaca

SEQ ID NO: 2007937 - RNA, 22 nt, Homo sapiens
uuuuugaagagaaguuguggcu

SEQ ID NO: 2007938 - RNA, 22 nt, Homo sapiens
uuccuccccaggacuuggucuu

SEQ ID NO: 2007939 - RNA, 12 nt, Homo sapiens
ccuguaacacau

SEQ ID NO: 2007940 - RNA, 20 nt, Homo sapiens
agccccggaaugcuuccagu

SEQ ID NO: 2007941 - RNA, 22 nt, Homo sapiens
cuuaaaagacuagaauccacac

SEQ ID NO: 2007942 - RNA, 17 nt, Homo sapiens
gucuuccaggcacucaa

SEQ ID NO: 2007943 - RNA, 24 nt, Homo sapiens
cuagaauauuuaaaacaucauuac

SEQ ID NO: 2007944 - RNA, 14 nt, Homo sapiens
cauaacuuaccucu

SEQ ID NO: 2007945 - RNA, 21 nt, Homo sapiens
ggaggcucaaauuuugaguua

SEQ ID NO: 2007946 - RNA, 13 nt, Homo sapiens
uggcccagccaaa

SEQ ID NO: 2007947 - RNA, 22 nt, Homo sapiens
ccuugagcugguuuucucugau

SEQ ID NO: 2007948 - RNA, 19 nt, Homo sapiens
aucaagguagaacaaagaa

SEQ ID NO: 2007949 - RNA, 20 nt, Homo sapiens
ugugccccagcagugccuug

SEQ ID NO: 2007950 - RNA, 16 nt, Homo sapiens
gucaugucacugaaau

SEQ ID NO: 2007951 - RNA, 18 nt, Homo sapiens
uugaagaagaguuucucc

SEQ ID NO: 2007952 - RNA, 21 nt, Homo sapiens
uccucuugccucucucaggag

SEQ ID NO: 2007953 - RNA, 18 nt, Homo sapiens
ggaaauaggcauaucaag

SEQ ID NO: 2007954 - RNA, 20 nt, Homo sapiens
cauaaaagaagaaacuauuu

SEQ ID NO: 2007955 - RNA, 14 nt, Homo sapiens
aaccugugauucau

SEQ ID NO: 2007956 - RNA, 18 nt, Homo sapiens
cagcagagaccaccacau

SEQ ID NO: 2007957 - RNA, 22 nt, Homo sapiens
cgguuccacgugggguggaauu

SEQ ID NO: 2007958 - RNA, 20 nt, Homo sapiens
uuucugauucugauugcuau

SEQ ID NO: 2007959 - RNA, 22 nt, Homo sapiens
cacggacuuaucugaucuuccu

SEQ ID NO: 2007960 - RNA, 17 nt, Homo sapiens
gaacuacuuuuggugcu

SEQ ID NO: 2007961 - RNA, 11 nt, Homo sapiens
uugcuugauau

SEQ ID NO: 2007962 - RNA, 15 nt, Homo sapiens
uggacagacagccac

SEQ ID NO: 2007963 - RNA, 18 nt, Homo sapiens
auagaaaaauaacuuuag

SEQ ID NO: 2007964 - RNA, 14 nt, Homo sapiens
gcuuuccucaaaaa

SEQ ID NO: 2007965 - RNA, 18 nt, Homo sapiens
aagaugagggcgcaagaa

SEQ ID NO: 2007966 - RNA, 22 nt, Homo sapiens
uucaccaaaucuugguugaugc

SEQ ID NO: 2007967 - RNA, 13 nt, Homo sapiens
gaccuuuauuuau

SEQ ID NO: 2007968 - RNA, 18 nt, Homo sapiens
uccagagacugggacuaa

SEQ ID NO: 2007969 - RNA, 15 nt, Homo sapiens
ugaacgcuuaaguca

SEQ ID NO: 2007970 - RNA, 23 nt, Homo sapiens
gccuccugugacgugaggcccau

SEQ ID NO: 2007971 - RNA, 19 nt, Homo sapiens
ugcaguggcuccgaucucu

SEQ ID NO: 2007972 - RNA, 13 nt, Homo sapiens
ugcucugccaccc

SEQ ID NO: 2007973 - RNA, 15 nt, Homo sapiens
guuaauaguacuauu

SEQ ID NO: 2007974 - RNA, 13 nt, Homo sapiens
gcuuaaugaaggu

SEQ ID NO: 2007975 - RNA, 20 nt, Homo sapiens
ccauggugacaucacucuag

SEQ ID NO: 2007976 - RNA, 20 nt, Homo sapiens
guagagacaguguuuugcca

SEQ ID NO: 2007977 - RNA, 16 nt, Homo sapiens
uaagagggcacacacu

SEQ ID NO: 2007978 - RNA, 22 nt, Homo sapiens
aaaauuagcugggcauggugcg

SEQ ID NO: 2007979 - RNA, 16 nt, Homo sapiens
ugugaucaucccaucu

SEQ ID NO: 2007980 - RNA, 16 nt, Homo sapiens
ucuugcuaauucucag

SEQ ID NO: 2007981 - RNA, 18 nt, Homo sapiens
acuccaggauuuaggccu

SEQ ID NO: 2007982 - RNA, 19 nt, Homo sapiens
ccggagugacagaguaaga

SEQ ID NO: 2007983 - RNA, 13 nt, Homo sapiens
cuuucugcaugac

SEQ ID NO: 2007984 - RNA, 21 nt, Homo sapiens
accugauguaccugaugcuau

SEQ ID NO: 2007985 - RNA, 15 nt, Homo sapiens
gagguuauaggucac

SEQ ID NO: 2007986 - RNA, 14 nt, Homo sapiens
accacugcacucca

SEQ ID NO: 2007987 - RNA, 13 nt, Homo sapiens
auuagaagccaag

SEQ ID NO: 2007988 - RNA, 21 nt, Homo sapiens
uuacgcuauccaguugcaggu

SEQ ID NO: 2007989 - RNA, 16 nt, Homo sapiens
gcuuggaccacuuaca

SEQ ID NO: 2007990 - RNA, 16 nt, Homo sapiens
gacaaagugagacucc

SEQ ID NO: 2007991 - RNA, 17 nt, Homo sapiens
cuggcccucgacacuca

SEQ ID NO: 2007992 - RNA, 16 nt, Homo sapiens
ugguccaucucugaaa

SEQ ID NO: 2007993 - RNA, 14 nt, Homo sapiens
acucagcccagcug

SEQ ID NO: 2007994 - RNA, 13 nt, Homo sapiens
gacaggucaguag

SEQ ID NO: 2007995 - RNA, 11 nt, Homo sapiens
aguggacaaau

SEQ ID NO: 2007996 - RNA, 16 nt, Homo sapiens
cauuacuuguauaaau

SEQ ID NO: 2007997 - RNA, 18 nt, Homo sapiens
auuugguuaauaagaauu

SEQ ID NO: 2007998 - RNA, 16 nt, Homo sapiens
gcaagaccagucacuc

SEQ ID NO: 2007999 - RNA, 13 nt, Homo sapiens
uauuucucuugcu

SEQ ID NO: 2008000 - RNA, 15 nt, Homo sapiens
augaucaaaaugcau

SEQ ID NO: 2008001 - RNA, 19 nt, Homo sapiens
uaggcauacucuccaggau

SEQ ID NO: 2008002 - RNA, 18 nt, Homo sapiens
aaaauuugaaauuuagcu

SEQ ID NO: 2008003 - RNA, 17 nt, Homo sapiens
cagauccucuucucaaa

SEQ ID NO: 2008004 - RNA, 15 nt, Homo sapiens
acuuuauuaguuuaa

SEQ ID NO: 2008005 - RNA, 18 nt, Homo sapiens
ugagcauggucacaagca

SEQ ID NO: 2008006 - RNA, 15 nt, Homo sapiens
agcugauuaccugaa

SEQ ID NO: 2008007 - RNA, 12 nt, Homo sapiens
ggaaguuuucag

SEQ ID NO: 2008008 - RNA, 21 nt, Homo sapiens
aaucagauucaggagcucagu

SEQ ID NO: 2008009 - RNA, 16 nt, Homo sapiens
uaaugaaauuccagau

SEQ ID NO: 2008010 - RNA, 18 nt, Homo sapiens
gaacaaucaaagcacuug

SEQ ID NO: 2008011 - RNA, 22 nt, Homo sapiens
cuuaagcagcaacagccuacaa

SEQ ID NO: 2008012 - RNA, 22 nt, Homo sapiens
cuagagacaggcaaacugcaaa

SEQ ID NO: 2008013 - RNA, 17 nt, Homo sapiens
acugucacacuggugcu

SEQ ID NO: 2008014 - RNA, 17 nt, Homo sapiens
gccuccccaugggcaca

SEQ ID NO: 2008015 - RNA, 14 nt, Homo sapiens
guucagcucacugu

SEQ ID NO: 2008016 - RNA, 19 nt, Homo sapiens
agaggaggggacccaugua

SEQ ID NO: 2008017 - RNA, 20 nt, Homo sapiens
ccugcagagccaauggugca

SEQ ID NO: 2008018 - RNA, 15 nt, Homo sapiens
cuauuuuuaaugcac

SEQ ID NO: 2008019 - RNA, 21 nt, Homo sapiens
cacuaaguaaccucuacaggc

SEQ ID NO: 2008020 - RNA, 15 nt, Homo sapiens
aaauacagucuucca

SEQ ID NO: 2008021 - RNA, 15 nt, Homo sapiens
aaggagcuuucucaa

SEQ ID NO: 2008022 - RNA, 23 nt, Homo sapiens
uuuccuuuggcuauuaaaaaagu

SEQ ID NO: 2008023 - RNA, 23 nt, Homo sapiens
ugagacaggagaccuggcacugg

SEQ ID NO: 2008024 - RNA, 16 nt, Homo sapiens
guuucuccauguuggu

SEQ ID NO: 2008025 - RNA, 23 nt, Homo sapiens
auuuaucuccugucuacaguuua

SEQ ID NO: 2008026 - RNA, 18 nt, Homo sapiens
uacuagccccccaguggu

SEQ ID NO: 2008027 - RNA, 17 nt, Homo sapiens
gccugagguuugccagc

SEQ ID NO: 2008028 - RNA, 19 nt, Homo sapiens
aacucaauauuuuccauga

SEQ ID NO: 2008029 - RNA, 18 nt, Homo sapiens
gcagaacagugagccaaa

SEQ ID NO: 2008030 - RNA, 15 nt, Homo sapiens
auacuagaguucaug

SEQ ID NO: 2008031 - RNA, 20 nt, Homo sapiens
cugccuuccaggagcaauuu

SEQ ID NO: 2008032 - RNA, 17 nt, Homo sapiens
gugggacaacaaagagg

SEQ ID NO: 2008033 - RNA, 17 nt, Homo sapiens
cugaucugugcagggua

SEQ ID NO: 2008034 - RNA, 16 nt, Homo sapiens
auuugcauacauucuu

SEQ ID NO: 2008035 - RNA, 23 nt, Homo sapiens
ccaacacaaccauaagcagccag

SEQ ID NO: 2008036 - RNA, 19 nt, Homo sapiens
cauucuuaaauauuuccau

SEQ ID NO: 2008037 - RNA, 16 nt, Homo sapiens
gccugcauggagaagg

SEQ ID NO: 2008038 - RNA, 16 nt, Homo sapiens
agaguauaugcacuuu

SEQ ID NO: 2008039 - RNA, 14 nt, Homo sapiens
cauaguccaaaaag

SEQ ID NO: 2008040 - RNA, 17 nt, Homo sapiens
uucuucagggccagucc

SEQ ID NO: 2008041 - RNA, 15 nt, Homo sapiens
uccccuacuucucag

SEQ ID NO: 2008042 - RNA, 20 nt, Homo sapiens
agucuacaaacugaacacug

SEQ ID NO: 2008043 - RNA, 21 nt, Homo sapiens
cucuccuuuucuccacuguca

SEQ ID NO: 2008044 - RNA, 12 nt, Homo sapiens
ucaucaaugugc

SEQ ID NO: 2008045 - RNA, 18 nt, Homo sapiens
aaucucuaaaaauccaua

SEQ ID NO: 2008046 - RNA, 18 nt, Homo sapiens
agggucauguacuucuuu

SEQ ID NO: 2008047 - RNA, 17 nt, Homo sapiens
cagauauucucuaguca

SEQ ID NO: 2008048 - RNA, 15 nt, Homo sapiens
gcaacuaaggacaaa

SEQ ID NO: 2008049 - RNA, 14 nt, Homo sapiens
cugcaugcucagga

SEQ ID NO: 2008050 - RNA, 19 nt, Homo sapiens
cuaggugcccgaguagcau

SEQ ID NO: 2008051 - RNA, 14 nt, Homo sapiens
uuucaagacuugau

SEQ ID NO: 2008052 - RNA, 19 nt, Homo sapiens
cugggaucuggcacacucc

SEQ ID NO: 2008053 - RNA, 19 nt, Homo sapiens
uagacauuucuccaaagaa

SEQ ID NO: 2008054 - RNA, 22 nt, Homo sapiens
agauguggacuuguaugcugcc

SEQ ID NO: 2008055 - RNA, 18 nt, Homo sapiens
uuuauauuuuuauagaca

SEQ ID NO: 2008056 - RNA, 20 nt, Homo sapiens
ccugccagguuuaaacauca

SEQ ID NO: 2008057 - RNA, 17 nt, Homo sapiens
uuucaaaauccaaaaag

SEQ ID NO: 2008058 - RNA, 13 nt, Homo sapiens
uuacuuaacucau

SEQ ID NO: 2008059 - RNA, 23 nt, Homo sapiens
cugaaggcaguggcaggggagca

SEQ ID NO: 2008060 - RNA, 17 nt, Homo sapiens
ugguagcucuuguugcu

SEQ ID NO: 2008061 - RNA, 17 nt, Homo sapiens
aagcuuauuuaagauca

SEQ ID NO: 2008062 - RNA, 20 nt, Homo sapiens
agcuaugauaagauugaaau

SEQ ID NO: 2008063 - RNA, 13 nt, Homo sapiens
ccguccacagggc

SEQ ID NO: 2008064 - RNA, 21 nt, Homo sapiens
ggggcucucagggaacagcag

SEQ ID NO: 2008065 - RNA, 22 nt, Homo sapiens
aacagcaauuguucagggaaua

SEQ ID NO: 2008066 - RNA, 22 nt, Homo sapiens
ugucuucccuucuuugcacuuu

SEQ ID NO: 2008067 - RNA, 13 nt, Homo sapiens
ucucggccuucac

SEQ ID NO: 2008068 - RNA, 21 nt, Homo sapiens
aacagauuuuagacuuaccuu

SEQ ID NO: 2008069 - RNA, 18 nt, Homo sapiens
ccuuccuaauaugcuuua

SEQ ID NO: 2008070 - RNA, 17 nt, Homo sapiens
gaacacaaaugaaaaug

SEQ ID NO: 2008071 - RNA, 21 nt, Homo sapiens
acacacggaugcacacacaga

SEQ ID NO: 2008072 - RNA, 19 nt, Homo sapiens
accuccccugaggcucagg

SEQ ID NO: 2008073 - RNA, 16 nt, Homo sapiens
aucaggcacugcgcca

SEQ ID NO: 2008074 - RNA, 23 nt, Homo sapiens
agaccucugggggauaagggagu

SEQ ID NO: 2008075 - RNA, 13 nt, Homo sapiens
ucacacucucuug

SEQ ID NO: 2008076 - RNA, 16 nt, Homo sapiens
uguauauuacauacau

SEQ ID NO: 2008077 - RNA, 22 nt, Homo sapiens
cuggguccgccuuaaucuggaa

SEQ ID NO: 2008078 - RNA, 14 nt, Homo sapiens
uccuggagcacugu

SEQ ID NO: 2008079 - RNA, 21 nt, Homo sapiens
uuagccuagucaugugccuug

SEQ ID NO: 2008080 - RNA, 15 nt, Homo sapiens
guuacauguagaaaa

SEQ ID NO: 2008081 - RNA, 21 nt, Homo sapiens
cccugcagggcuggucagggu

SEQ ID NO: 2008082 - RNA, 19 nt, Homo sapiens
gucuuucuuugucauucag

SEQ ID NO: 2008083 - RNA, 14 nt, Homo sapiens
acuucaaccuaguc

SEQ ID NO: 2008084 - RNA, 22 nt, Homo sapiens
uagaaaucccccuuucucuaau

SEQ ID NO: 2008085 - RNA, 23 nt, Homo sapiens
cagguccuuuagucuguuguucu

SEQ ID NO: 2008086 - RNA, 23 nt, Homo sapiens
gugacauauucugaggaccucca

SEQ ID NO: 2008087 - RNA, 12 nt, Homo sapiens
cugggugcuccc

SEQ ID NO: 2008088 - RNA, 21 nt, Homo sapiens
ggcacagccuggcuguggccu

SEQ ID NO: 2008089 - RNA, 14 nt, Homo sapiens
gauggccacuguga

SEQ ID NO: 2008090 - RNA, 14 nt, Homo sapiens
caccugucauucua

SEQ ID NO: 2008091 - RNA, 18 nt, Homo sapiens
uacaguaugcuugcucua

SEQ ID NO: 2008092 - RNA, 12 nt, Homo sapiens
ggaaugccuugg

SEQ ID NO: 2008093 - RNA, 13 nt, Homo sapiens
ggcucacacugug

SEQ ID NO: 2008094 - RNA, 14 nt, Homo sapiens
uucaggcaggccaa

SEQ ID NO: 2008095 - RNA, 16 nt, Homo sapiens
ugucuggacauucaga

SEQ ID NO: 2008096 - RNA, 17 nt, Homo sapiens
auaaaugaaucuuacuc

SEQ ID NO: 2008097 - RNA, 21 nt, Homo sapiens
uaagauuuuugaaaauccuga

SEQ ID NO: 2008098 - RNA, 17 nt, Homo sapiens
aucucccacaugccagg

SEQ ID NO: 2008099 - RNA, 16 nt, Homo sapiens
agaauucuuauacaca

SEQ ID NO: 2008100 - RNA, 19 nt, Homo sapiens
uaacagaucagaacaugaa

SEQ ID NO: 2008101 - RNA, 12 nt, Homo sapiens
auauguggaauc

SEQ ID NO: 2008102 - RNA, 14 nt, Homo sapiens
ugauaacaccaaga

SEQ ID NO: 2008103 - RNA, 20 nt, Homo sapiens
aguuaguuuuuaaucucucc

SEQ ID NO: 2008104 - RNA, 14 nt, Homo sapiens
cucagaggccugcu

SEQ ID NO: 2008105 - RNA, 14 nt, Homo sapiens
auuaacagauguag

SEQ ID NO: 2008106 - RNA, 19 nt, Homo sapiens
aaacauaauauagcuuaaa

SEQ ID NO: 2008107 - RNA, 21 nt, Homo sapiens
uugaaaaggaagaucaggcca

SEQ ID NO: 2008108 - RNA, 22 nt, Homo sapiens
cugauucugucaaugucuugaa

SEQ ID NO: 2008109 - RNA, 21 nt, Homo sapiens
aaacaaccauuuuuuguucug

SEQ ID NO: 2008110 - RNA, 19 nt, Homo sapiens
auacauuauuggacuucca

SEQ ID NO: 2008111 - RNA, 16 nt, Homo sapiens
cuauggaguagccauu

SEQ ID NO: 2008112 - RNA, 17 nt, Homo sapiens
cagcuucucuccacuga

SEQ ID NO: 2008113 - RNA, 13 nt, Homo sapiens
acagaccagugac

SEQ ID NO: 2008114 - RNA, 23 nt, Homo sapiens
guuuuaauccuuaacacauucaa

SEQ ID NO: 2008115 - RNA, 23 nt, Homo sapiens
ggacagugcccaugcaauggcuu

SEQ ID NO: 2008116 - RNA, 17 nt, Homo sapiens
cccagcuuggagugcca

SEQ ID NO: 2008117 - RNA, 16 nt, Homo sapiens
gccccgccugucacaa

SEQ ID NO: 2008118 - RNA, 14 nt, Homo sapiens
gacgaaaguggaaa

SEQ ID NO: 2008119 - RNA, 12 nt, Homo sapiens
accuauaccaau

SEQ ID NO: 2008120 - RNA, 14 nt, Homo sapiens
uaguccaauuccuu

SEQ ID NO: 2008121 - RNA, 17 nt, Homo sapiens
gacuuuucccaagccua

SEQ ID NO: 2008122 - RNA, 22 nt, Homo sapiens
acuuuuuuucugugacauuuau

SEQ ID NO: 2008123 - RNA, 14 nt, Homo sapiens
ugaacucuuggccu

SEQ ID NO: 2008124 - RNA, 14 nt, Homo sapiens
auacagcuaugaag

SEQ ID NO: 2008125 - RNA, 18 nt, Homo sapiens
ugaaucuaaaaccaaaua

SEQ ID NO: 2008126 - RNA, 19 nt, Homo sapiens
cacuuccuuuuaccugccc

SEQ ID NO: 2008127 - RNA, 21 nt, Homo sapiens
cuagcaguaaaagauaaauuu

SEQ ID NO: 2008128 - RNA, 21 nt, Homo sapiens
aaagguuaauuucugucaaau

SEQ ID NO: 2008129 - RNA, 20 nt, Homo sapiens
accuccuauggguugucacc

SEQ ID NO: 2008130 - RNA, 16 nt, Homo sapiens
gaaugaauacugggaa

SEQ ID NO: 2008131 - RNA, 14 nt, Homo sapiens
agacaccugaugac

SEQ ID NO: 2008132 - RNA, 13 nt, Homo sapiens
augaauuuacaga

SEQ ID NO: 2008133 - RNA, 13 nt, Homo sapiens
acaugauguauug

SEQ ID NO: 2008134 - RNA, 19 nt, Homo sapiens
ugugguuguuagguucaca

SEQ ID NO: 2008135 - RNA, 16 nt, Homo sapiens
uuggcuuaaauccagu

SEQ ID NO: 2008136 - RNA, 12 nt, Homo sapiens
cauuacacucca

SEQ ID NO: 2008137 - RNA, 21 nt, Homo sapiens
uuugucagucugggugucuca

SEQ ID NO: 2008138 - RNA, 23 nt, Homo sapiens
aaaagcauaauugaaaguucuga

SEQ ID NO: 2008139 - RNA, 21 nt, Homo sapiens
ugugguuuucagccuuucuaa

SEQ ID NO: 2008140 - RNA, 15 nt, Homo sapiens
acauaguguccugcc

SEQ ID NO: 2008141 - RNA, 15 nt, Homo sapiens
caccuugccaagcuu

SEQ ID NO: 2008142 - RNA, 22 nt, Homo sapiens
aaauauucaauaagaagucaaa

SEQ ID NO: 2008143 - RNA, 15 nt, Homo sapiens
cucccaaaugcaaac

SEQ ID NO: 2008144 - RNA, 23 nt, Homo sapiens
cacauaguagguacccaauucaa

SEQ ID NO: 2008145 - RNA, 22 nt, Homo sapiens
cugauucacagucucauuuuga

SEQ ID NO: 2008146 - RNA, 18 nt, Homo sapiens
gcccagucgagaccucac

SEQ ID NO: 2008147 - RNA, 17 nt, Homo sapiens
uaaacauugaaguaaug

SEQ ID NO: 2008148 - RNA, 17 nt, Homo sapiens
cauauuaacaugcuuau

SEQ ID NO: 2008149 - RNA, 13 nt, Homo sapiens
cugacuaacuuuu

SEQ ID NO: 2008150 - RNA, 19 nt, Homo sapiens
acguuggccucagggccag

SEQ ID NO: 2008151 - RNA, 18 nt, Homo sapiens
ugaccuggagaugcugcc

SEQ ID NO: 2008152 - RNA, 21 nt, Homo sapiens
uucuccccuuccuggacacac

SEQ ID NO: 2008153 - RNA, 14 nt, Homo sapiens
cauguucccagaaa

SEQ ID NO: 2008154 - RNA, 22 nt, Homo sapiens
cuccaacacaaggcuccaagac

SEQ ID NO: 2008155 - RNA, 16 nt, Homo sapiens
agccaucccgcuuagc

SEQ ID NO: 2008156 - RNA, 16 nt, Homo sapiens
ggcuggguaccaaugc

SEQ ID NO: 2008157 - RNA, 23 nt, Homo sapiens
ggcauggcaccugucgcccagug

SEQ ID NO: 2008158 - RNA, 14 nt, Homo sapiens
uguaauaacauuua

SEQ ID NO: 2008159 - RNA, 19 nt, Homo sapiens
ggcccaaguuucuaaggga

SEQ ID NO: 2008160 - RNA, 20 nt, Homo sapiens
gguucuugguagagauucau

SEQ ID NO: 2008161 - RNA, 17 nt, Homo sapiens
auaagugcuacuuugcc

SEQ ID NO: 2008162 - RNA, 19 nt, Homo sapiens
gcacuuuaacacagugucu

SEQ ID NO: 2008163 - RNA, 23 nt, Homo sapiens
gcacuuuugaaauaaaguauuua

SEQ ID NO: 2008164 - RNA, 14 nt, Homo sapiens
cacagacaguuucu

SEQ ID NO: 2008165 - RNA, 16 nt, Homo sapiens
cagucaaguucagagu

SEQ ID NO: 2008166 - RNA, 16 nt, Homo sapiens
cacacuguuuguguag

SEQ ID NO: 2008167 - RNA, 16 nt, Homo sapiens
agcacuugaugccacc

SEQ ID NO: 2008168 - RNA, 16 nt, Homo sapiens
ccagguucaugaauau

SEQ ID NO: 2008169 - RNA, 14 nt, Homo sapiens
ugcauucucuccca

SEQ ID NO: 2008170 - RNA, 15 nt, Homo sapiens
ugcauuuagcuguau

SEQ ID NO: 2008171 - RNA, 12 nt, Homo sapiens
aaauuguuauaa

SEQ ID NO: 2008172 - RNA, 20 nt, Homo sapiens
uuucaauucuguaauuacau

SEQ ID NO: 2008173 - RNA, 14 nt, Homo sapiens
gcacaagccacaag

SEQ ID NO: 2008174 - RNA, 22 nt, Homo sapiens
cccaggaccugcagggccaaug

SEQ ID NO: 2008175 - RNA, 12 nt, Homo sapiens
ucgcaacugucc

SEQ ID NO: 2008176 - RNA, 13 nt, Homo sapiens
gugugaagcugaa

SEQ ID NO: 2008177 - RNA, 22 nt, Homo sapiens
ugagacuccacucaggugcaca

SEQ ID NO: 2008178 - RNA, 22 nt, Homo sapiens
gaagcaaacuuauaaaucauau

SEQ ID NO: 2008179 - RNA, 17 nt, Homo sapiens
uggaaagcaccucauga

SEQ ID NO: 2008180 - RNA, 22 nt, Homo sapiens
uguggccuuuauguucuuucac

SEQ ID NO: 2008181 - RNA, 20 nt, Homo sapiens
uuuaauaaaugguuuauucu

SEQ ID NO: 2008182 - RNA, 13 nt, Homo sapiens
uagaaucuucuua

SEQ ID NO: 2008183 - RNA, 20 nt, Homo sapiens
gagcuugagcuccccuggag

SEQ ID NO: 2008184 - RNA, 16 nt, Homo sapiens
gcuuuuccucccucag

SEQ ID NO: 2008185 - RNA, 13 nt, Homo sapiens
acugacccuggag

SEQ ID NO: 2008186 - RNA, 22 nt, Homo sapiens
ugcaacccagucacacuguggc

SEQ ID NO: 2008187 - RNA, 19 nt, Homo sapiens
aaguguacaaauuuauuga

SEQ ID NO: 2008188 - RNA, 18 nt, Homo sapiens
ucaaacuccugaguucaa

SEQ ID NO: 2008189 - RNA, 21 nt, Homo sapiens
ccugugacccucucacuuugg

SEQ ID NO: 2008190 - RNA, 15 nt, Homo sapiens
aagaaucacuugaac

SEQ ID NO: 2008191 - RNA, 14 nt, Homo sapiens
ccacccugucugca

SEQ ID NO: 2008192 - RNA, 14 nt, Homo sapiens
ccagacugucucaa

SEQ ID NO: 2008193 - RNA, 15 nt, Homo sapiens
gagccuuuaccuuuu

SEQ ID NO: 2008194 - RNA, 14 nt, Homo sapiens
agcugguccuccac

SEQ ID NO: 2008195 - RNA, 13 nt, Homo sapiens
aauuggacagauu

SEQ ID NO: 2008196 - RNA, 19 nt, Homo sapiens
agcccaaaugccgcucuuc

SEQ ID NO: 2008197 - RNA, 20 nt, Homo sapiens
ccuauauuuagccccaacac

SEQ ID NO: 2008198 - RNA, 21 nt, Homo sapiens
guacuuuuaaaaacauaacau

SEQ ID NO: 2008199 - RNA, 20 nt, Homo sapiens
ugcucaagcagcaaaauccu

SEQ ID NO: 2008200 - RNA, 15 nt, Homo sapiens
cacaccugggcauuu

SEQ ID NO: 2008201 - RNA, 20 nt, Homo sapiens
ucauaauucagcacuuaacu

SEQ ID NO: 2008202 - RNA, 13 nt, Homo sapiens
uggccccuucuau

SEQ ID NO: 2008203 - RNA, 21 nt, Homo sapiens
cuccagccugggggacagaaa

SEQ ID NO: 2008204 - RNA, 19 nt, Homo sapiens
aucccagcuucggcauuug

SEQ ID NO: 2008205 - RNA, 14 nt, Homo sapiens
cccuccaagccugg

SEQ ID NO: 2008206 - RNA, 14 nt, Homo sapiens
agaccaaguuauca

SEQ ID NO: 2008207 - RNA, 16 nt, Homo sapiens
gagacugaaaauugca

SEQ ID NO: 2008208 - RNA, 19 nt, Homo sapiens
ccuuuccaagucacuagaa

SEQ ID NO: 2008209 - RNA, 19 nt, Homo sapiens
gagugcaauggcgugaucu

SEQ ID NO: 2008210 - RNA, 21 nt, Homo sapiens
acuauccaaaagagacaggga

SEQ ID NO: 2008211 - RNA, 18 nt, Homo sapiens
gccaaauguucaauauga

SEQ ID NO: 2008212 - RNA, 18 nt, Homo sapiens
aagagccggagccuccag

SEQ ID NO: 2008213 - RNA, 22 nt, Homo sapiens
cagaaaauaaaauauucacucu

SEQ ID NO: 2008214 - RNA, 16 nt, Homo sapiens
uguacaaauccacgaa

SEQ ID NO: 2008215 - RNA, 20 nt, Homo sapiens
guaguuagccaauaugcaau

SEQ ID NO: 2008216 - RNA, 23 nt, Homo sapiens
uggaagcuuguugaaaacccaga

SEQ ID NO: 2008217 - RNA, 19 nt, Homo sapiens
aacauaaacacauuuccau

SEQ ID NO: 2008218 - RNA, 20 nt, Homo sapiens
agcugggccccaugcucugc

SEQ ID NO: 2008219 - RNA, 23 nt, Homo sapiens
gcccuguccaaaagcgcccucac

SEQ ID NO: 2008220 - RNA, 14 nt, Homo sapiens
agcucuguuuucau

SEQ ID NO: 2008221 - RNA, 19 nt, Homo sapiens
aucaaucugcaguuuaaca

SEQ ID NO: 2008222 - RNA, 13 nt, Homo sapiens
uuguuauauacau

SEQ ID NO: 2008223 - RNA, 22 nt, Homo sapiens
guuauccugcuagcuguagaaa

SEQ ID NO: 2008224 - RNA, 19 nt, Homo sapiens
ugcaaauacaaucagccca

SEQ ID NO: 2008225 - RNA, 16 nt, Homo sapiens
acaguguaucaacaaa

SEQ ID NO: 2008226 - RNA, 18 nt, Homo sapiens
aauaugcaaucacugaaa

SEQ ID NO: 2008227 - RNA, 10 nt, Homo sapiens
uuagccuuua

SEQ ID NO: 2008228 - RNA, 18 nt, Homo sapiens
ugacaggcccaguggaac

SEQ ID NO: 2008229 - RNA, 13 nt, Homo sapiens
gcugcugugacag

SEQ ID NO: 2008230 - RNA, 14 nt, Homo sapiens
accuggaacaucuc

SEQ ID NO: 2008231 - RNA, 18 nt, Homo sapiens
ucauaguucccaggugau

SEQ ID NO: 2008232 - RNA, 17 nt, Homo sapiens
ggaaggcaaaugaugcc

SEQ ID NO: 2008233 - RNA, 17 nt, Homo sapiens
uggucuuagaugcagcg

SEQ ID NO: 2008234 - RNA, 16 nt, Homo sapiens
augcacaacagaguaa

SEQ ID NO: 2008235 - RNA, 16 nt, Homo sapiens
ucuucuccuccaugaa

SEQ ID NO: 2008236 - RNA, 22 nt, Homo sapiens
cagacuaaagauugcagcauuu

SEQ ID NO: 2008237 - RNA, 18 nt, Homo sapiens
aaaauaaacuaguuucca

SEQ ID NO: 2008238 - RNA, 14 nt, Homo sapiens
aaggcucagcuggu

SEQ ID NO: 2008239 - RNA, 21 nt, Homo sapiens
aacuugauagccugacagcag

SEQ ID NO: 2008240 - RNA, 19 nt, Homo sapiens
gaagguuagguuugucaac

SEQ ID NO: 2008241 - RNA, 10 nt, Homo sapiens
caauguuuca

SEQ ID NO: 2008242 - RNA, 13 nt, Homo sapiens
caagcaugcuugu

SEQ ID NO: 2008243 - RNA, 22 nt, Homo sapiens
cauaguagguacccaauucaau

SEQ ID NO: 2008244 - RNA, 13 nt, Homo sapiens
uuguauuaaggga

SEQ ID NO: 2008245 - RNA, 23 nt, Homo sapiens
uccuugaguuaauuccagugaag

SEQ ID NO: 2008246 - RNA, 23 nt, Homo sapiens
agcagaaaucuagaagacuguca

SEQ ID NO: 2008247 - RNA, 22 nt, Homo sapiens
agaaaucaaugguagcauuuag

SEQ ID NO: 2008248 - RNA, 15 nt, Homo sapiens
ugccucuggucccag

SEQ ID NO: 2008249 - RNA, 21 nt, Homo sapiens
aaugccuuuuguuuccaggaa

SEQ ID NO: 2008250 - RNA, 18 nt, Homo sapiens
agcaagacuuccagguag

SEQ ID NO: 2008251 - RNA, 16 nt, Homo sapiens
gaagccacuuucuaca

SEQ ID NO: 2008252 - RNA, 14 nt, Homo sapiens
aagcuguugaaguc

SEQ ID NO: 2008253 - RNA, 16 nt, Homo sapiens
gcugccaugcuuccaa

SEQ ID NO: 2008254 - RNA, 21 nt, Homo sapiens
aggggacaccuuggcuccuca

SEQ ID NO: 2008255 - RNA, 23 nt, Homo sapiens
auuauacccccugcaaagcccag

SEQ ID NO: 2008256 - RNA, 21 nt, Homo sapiens
gggucucucacuguugcagug

SEQ ID NO: 2008257 - RNA, 20 nt, Homo sapiens
gccaccagaccaugggccaa

SEQ ID NO: 2008258 - RNA, 14 nt, Homo sapiens
cauuccaccuuccc

SEQ ID NO: 2008259 - RNA, 20 nt, Homo sapiens
ucacuggguucccauucuga

SEQ ID NO: 2008260 - RNA, 16 nt, Homo sapiens
agauaccgccagcucc

SEQ ID NO: 2008261 - RNA, 21 nt, Homo sapiens
ucugugagacccccacaccuc

SEQ ID NO: 2008262 - RNA, 17 nt, Homo sapiens
cccccugggcagugcag

SEQ ID NO: 2008263 - RNA, 22 nt, Homo sapiens
uguccucagccuugccagagau

SEQ ID NO: 2008264 - RNA, 17 nt, Homo sapiens
agagaagagggggcuaa

SEQ ID NO: 2008265 - RNA, 18 nt, Homo sapiens
guauauuuaagaagccaa

SEQ ID NO: 2008266 - RNA, 16 nt, Homo sapiens
acuucugggggucacu

SEQ ID NO: 2008267 - RNA, 21 nt, Homo sapiens
accaaccuacaauuuucccuu

SEQ ID NO: 2008268 - RNA, 13 nt, Homo sapiens
accuggaaccaga

SEQ ID NO: 2008269 - RNA, 15 nt, Homo sapiens
ucaacaaacagugua

SEQ ID NO: 2008270 - RNA, 19 nt, Homo sapiens
auaugggaaaccauguagc

SEQ ID NO: 2008271 - RNA, 16 nt, Homo sapiens
caaucugccuaggguc

SEQ ID NO: 2008272 - RNA, 14 nt, Homo sapiens
gucuuuuaaacugg

SEQ ID NO: 2008273 - RNA, 13 nt, Homo sapiens
acuucaagugcau

SEQ ID NO: 2008274 - RNA, 23 nt, Homo sapiens
gaggccuggggugggacagggag

SEQ ID NO: 2008275 - RNA, 18 nt, Homo sapiens
caugugcccccucuacca

SEQ ID NO: 2008276 - RNA, 20 nt, Homo sapiens
uccaaauaaaaauaacauca

SEQ ID NO: 2008277 - RNA, 13 nt, Homo sapiens
cuccaucauggca

SEQ ID NO: 2008278 - RNA, 22 nt, Homo sapiens
ccaacagaggggcagccaggac

SEQ ID NO: 2008279 - RNA, 14 nt, Homo sapiens
cgcuugcuaucaug

SEQ ID NO: 2008280 - RNA, 17 nt, Homo sapiens
uugcagugaacugagac

SEQ ID NO: 2008281 - RNA, 15 nt, Homo sapiens
cacuccagccugggc

SEQ ID NO: 2008282 - RNA, 19 nt, Homo sapiens
cugggagcucaagugaucc

SEQ ID NO: 2008283 - RNA, 15 nt, Homo sapiens
gaacccggucccagg

SEQ ID NO: 2008284 - RNA, 17 nt, Homo sapiens
uuucauuuuuuuccagg

SEQ ID NO: 2008285 - RNA, 17 nt, Homo sapiens
uguacaaaacaguuuga

SEQ ID NO: 2008286 - RNA, 21 nt, Homo sapiens
uggaaaaacaggaaaggagca

SEQ ID NO: 2008287 - RNA, 15 nt, Homo sapiens
agagaacaucuggag

SEQ ID NO: 2008288 - RNA, 13 nt, Homo sapiens
ggagagaacugaa

SEQ ID NO: 2008289 - RNA, 17 nt, Homo sapiens
cucauuaauagcugccu

SEQ ID NO: 2008290 - RNA, 22 nt, Homo sapiens
aggugcuaugaagccaacugac

SEQ ID NO: 2008291 - RNA, 13 nt, Homo sapiens
cauuucuauacuu

SEQ ID NO: 2008292 - RNA, 22 nt, Homo sapiens
caggaugcugugauacacugaa

SEQ ID NO: 2008293 - RNA, 16 nt, Homo sapiens
ccuggacacucagacc

SEQ ID NO: 2008294 - RNA, 22 nt, Homo sapiens
uuugcaacugucucucuucuca

SEQ ID NO: 2008295 - RNA, 17 nt, Homo sapiens
uccgagauccaccagau

SEQ ID NO: 2008296 - RNA, 22 nt, Homo sapiens
gaucaaauugugcaguacuuug

SEQ ID NO: 2008297 - RNA, 14 nt, Homo sapiens
cagcaacuguuuaa

SEQ ID NO: 2008298 - RNA, 16 nt, Homo sapiens
uccuagaaugcagcug

SEQ ID NO: 2008299 - RNA, 21 nt, Homo sapiens
caugggcaccaaccugcauuu

SEQ ID NO: 2008300 - RNA, 21 nt, Homo sapiens
agugauucuccugccucagcc

SEQ ID NO: 2008301 - RNA, 18 nt, Homo sapiens
uccccucaacccuugaga

SEQ ID NO: 2008302 - RNA, 18 nt, Homo sapiens
uaaagcaauaugcauuua

SEQ ID NO: 2008303 - RNA, 15 nt, Homo sapiens
gacuccuccuccaaa

SEQ ID NO: 2008304 - RNA, 21 nt, Homo sapiens
ugcagguuauaaaagcauuaa

SEQ ID NO: 2008305 - RNA, 20 nt, Homo sapiens
cauuaauuuaauuacuacua

SEQ ID NO: 2008306 - RNA, 19 nt, Homo sapiens
auuaaagcaagagaauuau

SEQ ID NO: 2008307 - RNA, 14 nt, Homo sapiens
ugaccuucagcuca

SEQ ID NO: 2008308 - RNA, 20 nt, Homo sapiens
cagaggcucuaauguacaau

SEQ ID NO: 2008309 - RNA, 14 nt, Homo sapiens
gaccuccacauuaa

SEQ ID NO: 2008310 - RNA, 17 nt, Homo sapiens
aguugagaaacaguucc

SEQ ID NO: 2008311 - RNA, 19 nt, Homo sapiens
aaacauguuaaugacaaua

SEQ ID NO: 2008312 - RNA, 20 nt, Homo sapiens
ugagauccucaaaaaucauc

SEQ ID NO: 2008313 - RNA, 20 nt, Homo sapiens
uguguucuagaccucugggg

SEQ ID NO: 2008314 - RNA, 12 nt, Homo sapiens
cacaguccucau

SEQ ID NO: 2008315 - RNA, 15 nt, Homo sapiens
gcucuaaaccucagg

SEQ ID NO: 2008316 - RNA, 20 nt, Homo sapiens
uuaucugcuaugcuauugaa

SEQ ID NO: 2008317 - RNA, 13 nt, Homo sapiens
cuaaaccauucau

SEQ ID NO: 2008318 - RNA, 19 nt, Homo sapiens
aagcagaauaaagcaauuu

SEQ ID NO: 2008319 - RNA, 13 nt, Homo sapiens
ucgcuuugccauc

SEQ ID NO: 2008320 - RNA, 13 nt, Homo sapiens
ugucagagcccag

SEQ ID NO: 2008321 - RNA, 20 nt, Homo sapiens
auacguuugaaauaguugau

SEQ ID NO: 2008322 - RNA, 21 nt, Homo sapiens
ucagucaucaggugugcucag

SEQ ID NO: 2008323 - RNA, 17 nt, Homo sapiens
ugugcucuggggguccc

SEQ ID NO: 2008324 - RNA, 22 nt, Homo sapiens
acuauuuauaucacacaauaua

SEQ ID NO: 2008325 - RNA, 23 nt, Homo sapiens
cagccaucccgucuucuccaaca

SEQ ID NO: 2008326 - RNA, 18 nt, Homo sapiens
auuucucauaucaacuua

SEQ ID NO: 2008327 - RNA, 14 nt, Homo sapiens
ggacauaugcagug

SEQ ID NO: 2008328 - RNA, 23 nt, Homo sapiens
uggcuccuucacugaacaugccu

SEQ ID NO: 2008329 - RNA, 17 nt, Homo sapiens
gcugccuguauucucua

SEQ ID NO: 2008330 - RNA, 14 nt, Homo sapiens
ugaguauugcugau

SEQ ID NO: 2008331 - RNA, 19 nt, Homo sapiens
ugugucaggaaacauauuu

SEQ ID NO: 2008332 - RNA, 22 nt, Homo sapiens
agaagucacucacacuggccac

SEQ ID NO: 2008333 - RNA, 16 nt, Homo sapiens
aucauucccucucauc

SEQ ID NO: 2008334 - RNA, 12 nt, Homo sapiens
agacagaccuca

SEQ ID NO: 2008335 - RNA, 23 nt, Homo sapiens
gugguaaauauagaaccaugaau

SEQ ID NO: 2008336 - RNA, 21 nt, Homo sapiens
acuguuuuguaagugcugcua

SEQ ID NO: 2008337 - RNA, 17 nt, Homo sapiens
ucuggaccagccuguug

SEQ ID NO: 2008338 - RNA, 18 nt, Homo sapiens
ccaaauugaacucacugc

SEQ ID NO: 2008339 - RNA, 19 nt, Homo sapiens
ccugcccaauaaagcuuga

SEQ ID NO: 2008340 - RNA, 21 nt, Homo sapiens
uguguauucuguggauucuau

SEQ ID NO: 2008341 - RNA, 18 nt, Homo sapiens
aaacagcugccaccauca

SEQ ID NO: 2008342 - RNA, 22 nt, Homo sapiens
aaacucuauguccggcuuuaac

SEQ ID NO: 2008343 - RNA, 14 nt, Homo sapiens
ugugugacuccauu

SEQ ID NO: 2008344 - RNA, 13 nt, Homo sapiens
agugccucuuguc

SEQ ID NO: 2008345 - RNA, 13 nt, Homo sapiens
auuuccucugggc

SEQ ID NO: 2008346 - RNA, 20 nt, Homo sapiens
guaagaauaaagccacugua

SEQ ID NO: 2008347 - RNA, 19 nt, Homo sapiens
acaaagugacauuccugag

SEQ ID NO: 2008348 - RNA, 14 nt, Homo sapiens
caucugcugugguc

SEQ ID NO: 2008349 - RNA, 20 nt, Homo sapiens
uucccuuuuaaucaacugua

SEQ ID NO: 2008350 - RNA, 16 nt, Homo sapiens
accagggcaacucuug

SEQ ID NO: 2008351 - RNA, 19 nt, Homo sapiens
uggauggugguaucaggga

SEQ ID NO: 2008352 - RNA, 13 nt, Homo sapiens
gagacccgccugg

SEQ ID NO: 2008353 - RNA, 17 nt, Homo sapiens
ccauuuuuuucuuuacu

SEQ ID NO: 2008354 - RNA, 19 nt, Homo sapiens
cgugcccaucaagugcagu

SEQ ID NO: 2008355 - RNA, 19 nt, Homo sapiens
cgcaggccucagcaucucc

SEQ ID NO: 2008356 - RNA, 11 nt, Homo sapiens
cuugugccaua

SEQ ID NO: 2008357 - RNA, 11 nt, Homo sapiens
ccugugccaca

SEQ ID NO: 2008358 - RNA, 22 nt, Homo sapiens
ccuggagcaacuugaggguaau

SEQ ID NO: 2008359 - RNA, 20 nt, Homo sapiens
uuacuccugguucagugcca

SEQ ID NO: 2008360 - RNA, 21 nt, Homo sapiens
uccucauucccucgucuuucc

SEQ ID NO: 2008361 - RNA, 21 nt, Homo sapiens
auguacaccagagccucagug

SEQ ID NO: 2008362 - RNA, 16 nt, Homo sapiens
auugaauuuacauaua

SEQ ID NO: 2008363 - RNA, 18 nt, Homo sapiens
cagucccuccuguugcca

SEQ ID NO: 2008364 - RNA, 21 nt, Homo sapiens
uagcuaccucacuaugcugcu

SEQ ID NO: 2008365 - RNA, 22 nt, Homo sapiens
ugauacugcugagucagacugu

SEQ ID NO: 2008366 - RNA, 18 nt, Homo sapiens
aauuaacacaguguuuca

SEQ ID NO: 2008367 - RNA, 20 nt, Homo sapiens
cugaccccgccucaccaaua

SEQ ID NO: 2008368 - RNA, 19 nt, Homo sapiens
auuccaggcaugcacaauc

SEQ ID NO: 2008369 - RNA, 17 nt, Homo sapiens
gcaagccuugcuagaca

SEQ ID NO: 2008370 - RNA, 22 nt, Homo sapiens
auaaaagaaauaaaccaaagga

SEQ ID NO: 2008371 - RNA, 14 nt, Homo sapiens
augcaaagaugaac

SEQ ID NO: 2008372 - RNA, 17 nt, Homo sapiens
auguaucuauuuguaca

SEQ ID NO: 2008373 - RNA, 14 nt, Homo sapiens
aaaguaaaccacaa

SEQ ID NO: 2008374 - RNA, 17 nt, Homo sapiens
uguacauggaauaacau

SEQ ID NO: 2008375 - RNA, 17 nt, Homo sapiens
accuaaguacuguaaua

SEQ ID NO: 2008376 - RNA, 23 nt, Homo sapiens
cucucaacaucacauacagcuuc

SEQ ID NO: 2008377 - RNA, 22 nt, Homo sapiens
uauuauuugacaacaauccaaa

SEQ ID NO: 2008378 - RNA, 13 nt, Homo sapiens
aguuuuguugccc

SEQ ID NO: 2008379 - RNA, 18 nt, Homo sapiens
auccucaaacgacagagg

SEQ ID NO: 2008380 - RNA, 14 nt, Homo sapiens
uguccuuuguggau

SEQ ID NO: 2008381 - RNA, 22 nt, Homo sapiens
ugcacuuucccuagaaagccau

SEQ ID NO: 2008382 - RNA, 23 nt, Homo sapiens
cauagagaugagcccacccugcu

SEQ ID NO: 2008383 - RNA, 15 nt, Homo sapiens
agguugaacuuugcc

SEQ ID NO: 2008384 - RNA, 18 nt, Homo sapiens
gccccuggcucugaccga

SEQ ID NO: 2008385 - RNA, 23 nt, Homo sapiens
aacucuccugggccacguaucaa

SEQ ID NO: 2008386 - RNA, 15 nt, Homo sapiens
ucucuugaaccuggg

SEQ ID NO: 2008387 - RNA, 17 nt, Homo sapiens
ccaggacagcugugcuc

SEQ ID NO: 2008388 - RNA, 23 nt, Homo sapiens
ccugugaaacgucccacacuuug

SEQ ID NO: 2008389 - RNA, 12 nt, Homo sapiens
cauauaccagca

SEQ ID NO: 2008390 - RNA, 17 nt, Homo sapiens
agagugugaaacuuccu

SEQ ID NO: 2008391 - RNA, 14 nt, Homo sapiens
acagccugagaaau

SEQ ID NO: 2008392 - RNA, 23 nt, Homo sapiens
gacacugguggggauaggccagc

SEQ ID NO: 2008393 - RNA, 15 nt, Homo sapiens
aauuaaaucuagaca

SEQ ID NO: 2008394 - RNA, 13 nt, Homo sapiens
acauuaaauucac

SEQ ID NO: 2008395 - RNA, 18 nt, Homo sapiens
agacccacaaacugccug

SEQ ID NO: 2008396 - RNA, 17 nt, Homo sapiens
gaagaacauccaaggag

SEQ ID NO: 2008397 - RNA, 18 nt, Homo sapiens
aaaugcuugcucaggcuc

SEQ ID NO: 2008398 - RNA, 22 nt, Homo sapiens
gggccucaaaugcaccauguca

SEQ ID NO: 2008399 - RNA, 22 nt, Homo sapiens
cuauuccagcucauucauuuua

SEQ ID NO: 2008400 - RNA, 13 nt, Homo sapiens
uuagugcuuugug

SEQ ID NO: 2008401 - RNA, 20 nt, Homo sapiens
guaauagauuguuuugccac

SEQ ID NO: 2008402 - RNA, 13 nt, Homo sapiens
gcaacaagcuauu

SEQ ID NO: 2008403 - RNA, 13 nt, Homo sapiens
uuaaacaccaauu

SEQ ID NO: 2008404 - RNA, 13 nt, Homo sapiens
aaagagcucucca

SEQ ID NO: 2008405 - RNA, 15 nt, Homo sapiens
uaauaaaacugaugu

SEQ ID NO: 2008406 - RNA, 11 nt, Homo sapiens
caaaguaauag

SEQ ID NO: 2008407 - RNA, 18 nt, Homo sapiens
cagagaucccacacuacu

SEQ ID NO: 2008408 - RNA, 18 nt, Homo sapiens
uccagaacguagugagcc

SEQ ID NO: 2008409 - RNA, 14 nt, Homo sapiens
guuuucaguguaca

SEQ ID NO: 2008410 - RNA, 19 nt, Homo sapiens
aaauucuagagccagcugu

SEQ ID NO: 2008411 - RNA, 16 nt, Homo sapiens
agccaguggugcuaaa

SEQ ID NO: 2008412 - RNA, 14 nt, Homo sapiens
uacaugcauacaaa

SEQ ID NO: 2008413 - RNA, 14 nt, Homo sapiens
acuuuacaacuuag

SEQ ID NO: 2008414 - RNA, 14 nt, Homo sapiens
uuucugcauuucaa

SEQ ID NO: 2008415 - RNA, 22 nt, Homo sapiens
agccugucucuccuuguugccc

SEQ ID NO: 2008416 - RNA, 21 nt, Homo sapiens
caauggaccucucagcagaaa

SEQ ID NO: 2008417 - RNA, 15 nt, Homo sapiens
cgggacucaggugug

SEQ ID NO: 2008418 - RNA, 15 nt, Homo sapiens
uucacugcaaacaca

SEQ ID NO: 2008419 - RNA, 16 nt, Homo sapiens
ccuuucaaagccauuu

SEQ ID NO: 2008420 - RNA, 15 nt, Homo sapiens
aucugucuccuguau

SEQ ID NO: 2008421 - RNA, 19 nt, Homo sapiens
cuugaucaugaaucacugc

SEQ ID NO: 2008422 - RNA, 16 nt, Homo sapiens
acaugaaaaauaaucc

SEQ ID NO: 2008423 - RNA, 18 nt, Homo sapiens
cguuagggugaagcauua

SEQ ID NO: 2008424 - RNA, 16 nt, Homo sapiens
gccuacuaacauauaa

SEQ ID NO: 2008425 - RNA, 14 nt, Homo sapiens
aaauagaccucuca

SEQ ID NO: 2008426 - RNA, 21 nt, Homo sapiens
cuccacagagauacacagaua

SEQ ID NO: 2008427 - RNA, 15 nt, Homo sapiens
ccucccucugccagu

SEQ ID NO: 2008428 - RNA, 13 nt, Homo sapiens
cagcaugcugcug

SEQ ID NO: 2008429 - RNA, 19 nt, Homo sapiens
cugugcuccgugccuccac

SEQ ID NO: 2008430 - RNA, 17 nt, Homo sapiens
gagccaaguggggcccu

SEQ ID NO: 2008431 - RNA, 12 nt, Homo sapiens
gacuuuuagaca

SEQ ID NO: 2008432 - RNA, 19 nt, Homo sapiens
cugagaggggagaguccag

SEQ ID NO: 2008433 - RNA, 23 nt, Homo sapiens
agccuugugaugucauacagaga

SEQ ID NO: 2008434 - RNA, 18 nt, Homo sapiens
aaaauucagggcuuuaaa

SEQ ID NO: 2008435 - RNA, 21 nt, Homo sapiens
ugcaugcaaaauauacacuca

SEQ ID NO: 2008436 - RNA, 16 nt, Homo sapiens
gucagucccacugcac

SEQ ID NO: 2008437 - RNA, 14 nt, Homo sapiens
gaauccagugaaug

SEQ ID NO: 2008438 - RNA, 18 nt, Homo sapiens
cugcuuagacauaacaaa

SEQ ID NO: 2008439 - RNA, 22 nt, Homo sapiens
uucuaaggaaugcacaaauuga

SEQ ID NO: 2008440 - RNA, 22 nt, Homo sapiens
auucauccuuccauccaucuuu

SEQ ID NO: 2008441 - RNA, 15 nt, Homo sapiens
cccuucucugccuca

SEQ ID NO: 2008442 - RNA, 17 nt, Homo sapiens
uggccaucaggacuuuc

SEQ ID NO: 2008443 - RNA, 22 nt, Homo sapiens
ugccggagaggaagagacacuc

SEQ ID NO: 2008444 - RNA, 15 nt, Homo sapiens
uagaguggaaucucu

SEQ ID NO: 2008445 - RNA, 16 nt, Homo sapiens
gaauuugcaacaguaa

SEQ ID NO: 2008446 - RNA, 19 nt, Homo sapiens
cucagggcuggggccaaga

SEQ ID NO: 2008447 - RNA, 20 nt, Homo sapiens
aggugcacagaccacacagc

SEQ ID NO: 2008448 - RNA, 23 nt, Homo sapiens
gaccuuuauccagcuagugccaa

SEQ ID NO: 2008449 - RNA, 22 nt, Homo sapiens
cacagaauauuuuuauauuucc

SEQ ID NO: 2008450 - RNA, 17 nt, Homo sapiens
gcugaugaugucucuug

SEQ ID NO: 2008451 - RNA, 17 nt, Homo sapiens
guucuucagggccaguc

SEQ ID NO: 2008452 - RNA, 19 nt, Homo sapiens
uaaauacuguaacacugua

SEQ ID NO: 2008453 - RNA, 13 nt, Homo sapiens
aggaccagagcua

SEQ ID NO: 2008454 - RNA, 19 nt, Homo sapiens
agaauaauugaacaauaaa

SEQ ID NO: 2008455 - RNA, 23 nt, Homo sapiens
caaacuaggaggaaaagacagag

SEQ ID NO: 2008456 - RNA, 18 nt, Homo sapiens
ugaucucuuagaagccau

SEQ ID NO: 2008457 - RNA, 20 nt, Homo sapiens
uguaaacagaaauugcaaua

SEQ ID NO: 2008458 - RNA, 16 nt, Homo sapiens
uagaauagauauccac

SEQ ID NO: 2008459 - RNA, 20 nt, Homo sapiens
agaugucuuaaccucaggga

SEQ ID NO: 2008460 - RNA, 14 nt, Homo sapiens
aaaccugugugcca

SEQ ID NO: 2008461 - RNA, 23 nt, Homo sapiens
agccucucaccuggacuccagua

SEQ ID NO: 2008462 - RNA, 20 nt, Homo sapiens
gaggugugacuaacuaugca

SEQ ID NO: 2008463 - RNA, 15 nt, Homo sapiens
caauuuugcacugaa

SEQ ID NO: 2008464 - RNA, 18 nt, Homo sapiens
uccuaguagcuuuccucc

SEQ ID NO: 2008465 - RNA, 19 nt, Homo sapiens
cuagggauucaggcugcuu

SEQ ID NO: 2008466 - RNA, 17 nt, Homo sapiens
uacacuugggugaaaag

SEQ ID NO: 2008467 - RNA, 12 nt, Homo sapiens
ugagagcacaaa

SEQ ID NO: 2008468 - RNA, 18 nt, Homo sapiens
acucggucugagaagauu

SEQ ID NO: 2008469 - RNA, 13 nt, Homo sapiens
agaagcuaaccug

SEQ ID NO: 2008470 - RNA, 11 nt, Homo sapiens
gccccaugaaa

SEQ ID NO: 2008471 - RNA, 13 nt, Homo sapiens
augcccuaccugc

SEQ ID NO: 2008472 - RNA, 15 nt, Homo sapiens
gacaaccucauuuua

SEQ ID NO: 2008473 - RNA, 19 nt, Homo sapiens
uuccaacacugauuucccc

SEQ ID NO: 2008474 - RNA, 23 nt, Homo sapiens
ugagcauggggccaggaaagucu

SEQ ID NO: 2008475 - RNA, 20 nt, Homo sapiens
gauguaccagcaucucccag

SEQ ID NO: 2008476 - RNA, 22 nt, Homo sapiens
cuguguugucaacaaaccaagc

SEQ ID NO: 2008477 - RNA, 13 nt, Homo sapiens
caccucuuuguca

SEQ ID NO: 2008478 - RNA, 22 nt, Homo sapiens
ugcgccaaucccgccaugcuca

SEQ ID NO: 2008479 - RNA, 19 nt, Homo sapiens
uuuccauauuuuuugcaca

SEQ ID NO: 2008480 - RNA, 23 nt, Homo sapiens
gguccccccaccgcucaguguca

SEQ ID NO: 2008481 - RNA, 23 nt, Homo sapiens
aaaacacagagaugcugcaaaua

SEQ ID NO: 2008482 - RNA, 18 nt, Homo sapiens
acacaguguagugcucag

SEQ ID NO: 2008483 - RNA, 17 nt, Homo sapiens
aagaaguuauuuuccag

SEQ ID NO: 2008484 - RNA, 14 nt, Homo sapiens
cccaggcugcacug

SEQ ID NO: 2008485 - RNA, 14 nt, Homo sapiens
ccacuccugccagc

SEQ ID NO: 2008486 - RNA, 16 nt, Homo sapiens
aaauauaggcuuuaaa

SEQ ID NO: 2008487 - RNA, 13 nt, Homo sapiens
aacacuacagugg

SEQ ID NO: 2008488 - RNA, 15 nt, Homo sapiens
gaggcaagaaaagga

SEQ ID NO: 2008489 - RNA, 15 nt, Homo sapiens
ugcucuccuagagcu

SEQ ID NO: 2008490 - RNA, 19 nt, Homo sapiens
caaaggaaauaaagcauag

SEQ ID NO: 2008491 - RNA, 15 nt, Homo sapiens
aacagacuggcucca

SEQ ID NO: 2008492 - RNA, 14 nt, Homo sapiens
uuucccauuuugga

SEQ ID NO: 2008493 - RNA, 14 nt, Homo sapiens
ucacuguccuccaa

SEQ ID NO: 2008494 - RNA, 19 nt, Homo sapiens
ccaguuuuggaagugggga

SEQ ID NO: 2008495 - RNA, 12 nt, Homo sapiens
gcacaaacuguc

SEQ ID NO: 2008496 - RNA, 13 nt, Homo sapiens
auuaucuugcuca

SEQ ID NO: 2008497 - RNA, 15 nt, Homo sapiens
caaagcaaaggcagu

SEQ ID NO: 2008498 - RNA, 15 nt, Homo sapiens
gguucugucauguaa

SEQ ID NO: 2008499 - RNA, 18 nt, Homo sapiens
cuugucuuugacuugugu

SEQ ID NO: 2008500 - RNA, 14 nt, Homo sapiens
cauaaacaaugaug

SEQ ID NO: 2008501 - RNA, 21 nt, Homo sapiens
accccagguuuuucaucugaa

SEQ ID NO: 2008502 - RNA, 13 nt, Homo sapiens
aaacagcagguga

SEQ ID NO: 2008503 - RNA, 16 nt, Homo sapiens
aggaacagcaauggug

SEQ ID NO: 2008504 - RNA, 19 nt, Homo sapiens
acagccaggcggcuggaau

SEQ ID NO: 2008505 - RNA, 21 nt, Homo sapiens
gcuucaccagacuuuucucua

SEQ ID NO: 2008506 - RNA, 19 nt, Homo sapiens
uauucaauggaaagcugcu

SEQ ID NO: 2008507 - RNA, 17 nt, Homo sapiens
caacauccaaguggccu

SEQ ID NO: 2008508 - RNA, 14 nt, Homo sapiens
uuuaaugaacacaa

SEQ ID NO: 2008509 - RNA, 23 nt, Homo sapiens
uuuacaauaaaacuuugcugcca

SEQ ID NO: 2008510 - RNA, 19 nt, Homo sapiens
uguugcuuccguucaugga

SEQ ID NO: 2008511 - RNA, 14 nt, Homo sapiens
cuaacauaccuugu

SEQ ID NO: 2008512 - RNA, 14 nt, Homo sapiens
cguggcagucacca

SEQ ID NO: 2008513 - RNA, 13 nt, Homo sapiens
gcgauacacugca

SEQ ID NO: 2008514 - RNA, 19 nt, Homo sapiens
guaguuuugugaugcauuu

SEQ ID NO: 2008515 - RNA, 18 nt, Homo sapiens
agggggugacgcugaaga

SEQ ID NO: 2008516 - RNA, 20 nt, Homo sapiens
ugucccaccccuaccucuag

SEQ ID NO: 2008517 - RNA, 19 nt, Homo sapiens
auacacauuacagccaggu

SEQ ID NO: 2008518 - RNA, 17 nt, Homo sapiens
uaagcaaaaaacugcau

SEQ ID NO: 2008519 - RNA, 21 nt, Homo sapiens
acauagagaggcugugaaaca

SEQ ID NO: 2008520 - RNA, 18 nt, Homo sapiens
uacaguuuaacagaguuu

SEQ ID NO: 2008521 - RNA, 18 nt, Homo sapiens
auuuuugguauuuaugua

SEQ ID NO: 2008522 - RNA, 21 nt, Homo sapiens
aggcaugaaucacugugcuca

SEQ ID NO: 2008523 - RNA, 14 nt, Homo sapiens
ccuggcccaugugc

SEQ ID NO: 2008524 - RNA, 14 nt, Homo sapiens
cuguccccacugcc

SEQ ID NO: 2008525 - RNA, 19 nt, Homo sapiens
ggaagaauuauaacccaga

SEQ ID NO: 2008526 - RNA, 21 nt, Homo sapiens
ccuuacaguaaaguauagaaa

SEQ ID NO: 2008527 - RNA, 13 nt, Homo sapiens
ucugauaagcaag

SEQ ID NO: 2008528 - RNA, 18 nt, Homo sapiens
gcucaggagccaccagca

SEQ ID NO: 2008529 - RNA, 18 nt, Homo sapiens
cacaccaaagucagggag

SEQ ID NO: 2008530 - RNA, 22 nt, Homo sapiens
caaagaugaccauaaccacuga

SEQ ID NO: 2008531 - RNA, 23 nt, Homo sapiens
uaaauuuuuuugcaauccuuucc

SEQ ID NO: 2008532 - RNA, 14 nt, Homo sapiens
ugcaggugcuuuua

SEQ ID NO: 2008533 - RNA, 21 nt, Homo sapiens
guggguaaaauuagaugcaug

SEQ ID NO: 2008534 - RNA, 18 nt, Homo sapiens
gacgcauguuauggugcu

SEQ ID NO: 2008535 - RNA, 15 nt, Homo sapiens
uauuucuacauaguc

SEQ ID NO: 2008536 - RNA, 13 nt, Homo sapiens
aguaaagccucaa

SEQ ID NO: 2008537 - RNA, 15 nt, Homo sapiens
cagcaccagccugag

SEQ ID NO: 2008538 - RNA, 19 nt, Homo sapiens
ccaggguggaugaucucaa

SEQ ID NO: 2008539 - RNA, 20 nt, Homo sapiens
cuuuucugacccauguucac

SEQ ID NO: 2008540 - RNA, 14 nt, Homo sapiens
aagucugucuugcc

SEQ ID NO: 2008541 - RNA, 14 nt, Homo sapiens
uagguuuggacaaa

SEQ ID NO: 2008542 - RNA, 18 nt, Homo sapiens
ccucagccuccaccaucc

SEQ ID NO: 2008543 - RNA, 21 nt, Homo sapiens
cucaacuucucagacguucca

SEQ ID NO: 2008544 - RNA, 14 nt, Homo sapiens
accccaaccugcuc

SEQ ID NO: 2008545 - RNA, 20 nt, Homo sapiens
aauuguaucucauuacuuau

SEQ ID NO: 2008546 - RNA, 14 nt, Homo sapiens
ugguaaaaagaucc

SEQ ID NO: 2008547 - RNA, 19 nt, Homo sapiens
cugugggagucauggacau

SEQ ID NO: 2008548 - RNA, 13 nt, Homo sapiens
aucugcaguuuaa

SEQ ID NO: 2008549 - RNA, 16 nt, Homo sapiens
uuaaagaaagaaugca

SEQ ID NO: 2008550 - RNA, 22 nt, Homo sapiens
gccaccuuggaggaggaugcca

SEQ ID NO: 2008551 - RNA, 20 nt, Homo sapiens
uuaaagaaagucgaauuaau

SEQ ID NO: 2008552 - RNA, 17 nt, Homo sapiens
aaucucugauaucuuug

SEQ ID NO: 2008553 - RNA, 18 nt, Homo sapiens
gacauucacugagugccu

SEQ ID NO: 2008554 - RNA, 14 nt, Homo sapiens
gacccggcggcccu

SEQ ID NO: 2008555 - RNA, 18 nt, Homo sapiens
ccuuuaaauauuucacau

SEQ ID NO: 2008556 - RNA, 13 nt, Homo sapiens
uuauguacaacug

SEQ ID NO: 2008557 - RNA, 13 nt, Homo sapiens
uucuauacaaaua

SEQ ID NO: 2008558 - RNA, 16 nt, Homo sapiens
ccugugucagggcaca

SEQ ID NO: 2008559 - RNA, 15 nt, Homo sapiens
acuccugcuagaaca

SEQ ID NO: 2008560 - RNA, 13 nt, Homo sapiens
acuuuuacaguaa

SEQ ID NO: 2008561 - RNA, 20 nt, Homo sapiens
aauguaucuacauaccuaca

SEQ ID NO: 2008562 - RNA, 22 nt, Homo sapiens
uaaaacagguuauaacaguguu

SEQ ID NO: 2008563 - RNA, 22 nt, Homo sapiens
caaaaguuucuuacucaaggaa

SEQ ID NO: 2008564 - RNA, 16 nt, Homo sapiens
acagugaugauugaau

SEQ ID NO: 2008565 - RNA, 16 nt, Homo sapiens
aaagaaaugcccaucu

SEQ ID NO: 2008566 - RNA, 15 nt, Homo sapiens
auuuaauccgucaca

SEQ ID NO: 2008567 - RNA, 22 nt, Homo sapiens
gcuggucccggggccagcacuu

SEQ ID NO: 2008568 - RNA, 23 nt, Homo sapiens
cagaggcccuggaggucuccagg

SEQ ID NO: 2008569 - RNA, 12 nt, Homo sapiens
uaagugacaaaa

SEQ ID NO: 2008570 - RNA, 11 nt, Homo sapiens
augaaugucau

SEQ ID NO: 2008571 - RNA, 20 nt, Homo sapiens
cccuaaagacuaacuugaaa

SEQ ID NO: 2008572 - RNA, 14 nt, Homo sapiens
uguagcuaguaaga

SEQ ID NO: 2008573 - RNA, 17 nt, Homo sapiens
uauccauccucugagau

SEQ ID NO: 2008574 - RNA, 17 nt, Homo sapiens
uagugcaauuccaagaa

SEQ ID NO: 2008575 - RNA, 20 nt, Homo sapiens
acuucugucuccugucuuca

SEQ ID NO: 2008576 - RNA, 15 nt, Homo sapiens
uugggaauugcaugc

SEQ ID NO: 2008577 - RNA, 23 nt, Homo sapiens
ggcaacuugggaacuagacuccc

SEQ ID NO: 2008578 - RNA, 16 nt, Homo sapiens
agcugugcaggcaugg

SEQ ID NO: 2008579 - RNA, 11 nt, Homo sapiens
aaccgaauaaa

SEQ ID NO: 2008580 - RNA, 21 nt, Homo sapiens
ccccuacaucaaaugcucaag

SEQ ID NO: 2008581 - RNA, 21 nt, Homo sapiens
gcaugacacgaauauugcuga

SEQ ID NO: 2008582 - RNA, 15 nt, Homo sapiens
caggaaagacuggcc

SEQ ID NO: 2008583 - RNA, 19 nt, Homo sapiens
uccuuccacuuccaagauc

SEQ ID NO: 2008584 - RNA, 13 nt, Homo sapiens
gcaaccagcacau

SEQ ID NO: 2008585 - RNA, 20 nt, Homo sapiens
cagcucuuccccacccuggg

SEQ ID NO: 2008586 - RNA, 16 nt, Homo sapiens
aucucuaauauggcaa

SEQ ID NO: 2008587 - RNA, 12 nt, Homo sapiens
ugaaaccagcuu

SEQ ID NO: 2008588 - RNA, 15 nt, Homo sapiens
aauguaugcauucau

SEQ ID NO: 2008589 - RNA, 12 nt, Homo sapiens
uuuagaaaucaa

SEQ ID NO: 2008590 - RNA, 18 nt, Homo sapiens
auuuuaaauuccacugaa

SEQ ID NO: 2008591 - RNA, 12 nt, Homo sapiens
uucccucugcau

SEQ ID NO: 2008592 - RNA, 17 nt, Homo sapiens
ccuguugcuuuucacaa

SEQ ID NO: 2008593 - RNA, 12 nt, Homo sapiens
uugguacugaaa

SEQ ID NO: 2008594 - RNA, 21 nt, Homo sapiens
aaauggagggagccaucccuu

SEQ ID NO: 2008595 - RNA, 23 nt, Homo sapiens
aguccaccucccauuacuuugau

SEQ ID NO: 2008596 - RNA, 23 nt, Homo sapiens
ucugggggaaaaagccauaucau

SEQ ID NO: 2008597 - RNA, 15 nt, Homo sapiens
acacuauaucccaua

SEQ ID NO: 2008598 - RNA, 18 nt, Homo sapiens
uaaaagccuaccuaagca

SEQ ID NO: 2008599 - RNA, 14 nt, Homo sapiens
ggcugccugugugc

SEQ ID NO: 2008600 - RNA, 17 nt, Homo sapiens
agaauggaaaacagacu

SEQ ID NO: 2008601 - RNA, 12 nt, Homo sapiens
cauggcacugac

SEQ ID NO: 2008602 - RNA, 18 nt, Homo sapiens
agcaagaugcaaaugcau

SEQ ID NO: 2008603 - RNA, 20 nt, Homo sapiens
gagguccgacaaaccuggcg

SEQ ID NO: 2008604 - RNA, 21 nt, Homo sapiens
cuuuaaauguaaaauauuuga

SEQ ID NO: 2008605 - RNA, 14 nt, Homo sapiens
aauuccuaucucau

SEQ ID NO: 2008606 - RNA, 13 nt, Homo sapiens
ugcgaagacagag

SEQ ID NO: 2008607 - RNA, 18 nt, Homo sapiens
uggcugggcuggcugaag

SEQ ID NO: 2008608 - RNA, 12 nt, Homo sapiens
ucagcaucucac

SEQ ID NO: 2008609 - RNA, 20 nt, Homo sapiens
ccaacuucagcaaugaauug

SEQ ID NO: 2008610 - RNA, 20 nt, Homo sapiens
aagacccuuguggucccacc

SEQ ID NO: 2008611 - RNA, 12 nt, Homo sapiens
uuaacugucacc

SEQ ID NO: 2008612 - RNA, 17 nt, Homo sapiens
gaguuugccuguacucu

SEQ ID NO: 2008613 - RNA, 13 nt, Homo sapiens
ccaucccacugau

SEQ ID NO: 2008614 - RNA, 15 nt, Homo sapiens
caauugcagaugcca

SEQ ID NO: 2008615 - RNA, 14 nt, Homo sapiens
cucuucucauuuca

SEQ ID NO: 2008616 - RNA, 18 nt, Homo sapiens
aauuucacagaguacaaa

SEQ ID NO: 2008617 - RNA, 18 nt, Homo sapiens
uuagaaucagaauuugau

SEQ ID NO: 2008618 - RNA, 23 nt, Homo sapiens
cucucuuucuagaggugcuacau

SEQ ID NO: 2008619 - RNA, 12 nt, Homo sapiens
ggaccucaggug

SEQ ID NO: 2008620 - RNA, 15 nt, Homo sapiens
agguacgaaaagagg

SEQ ID NO: 2008621 - RNA, 13 nt, Homo sapiens
uaaauacuggugc

SEQ ID NO: 2008622 - RNA, 14 nt, Homo sapiens
uucucgaacugcau

SEQ ID NO: 2008623 - RNA, 17 nt, Homo sapiens
aguaucacacuguauau

SEQ ID NO: 2008624 - RNA, 17 nt, Homo sapiens
gcugagaagaagcugag

SEQ ID NO: 2008625 - RNA, 19 nt, Homo sapiens
ugggccagacaugccacaa

SEQ ID NO: 2008626 - RNA, 23 nt, Homo sapiens
guguuugaauugauuuuuaaaca

SEQ ID NO: 2008627 - RNA, 20 nt, Homo sapiens
ccaagggacccuuugccuuu

SEQ ID NO: 2008628 - RNA, 20 nt, Homo sapiens
cuguuuuacuguuacaauau

SEQ ID NO: 2008629 - RNA, 16 nt, Homo sapiens
agaagugucuaaaaac

SEQ ID NO: 2008630 - RNA, 12 nt, Homo sapiens
uguguccugggg

SEQ ID NO: 2008631 - RNA, 12 nt, Homo sapiens
guuuuccuuugu

SEQ ID NO: 2008632 - RNA, 20 nt, Homo sapiens
acgguguccaugccuuccau

SEQ ID NO: 2008633 - RNA, 21 nt, Homo sapiens
cuaugauauauuuauaucaua

SEQ ID NO: 2008634 - RNA, 13 nt, Homo sapiens
cuggagaggacaa

SEQ ID NO: 2008635 - RNA, 14 nt, Homo sapiens
uacguuuacauucu

SEQ ID NO: 2008636 - RNA, 17 nt, Homo sapiens
ugggguuggaagugcag

SEQ ID NO: 2008637 - RNA, 20 nt, Homo sapiens
uucucucacaguguacucua

SEQ ID NO: 2008638 - RNA, 22 nt, Homo sapiens
guuguaaguacucuaauauaca

SEQ ID NO: 2008639 - RNA, 14 nt, Homo sapiens
uacucagcuuuuuc

SEQ ID NO: 2008640 - RNA, 19 nt, Homo sapiens
ugagaguuuucuaaaguau

SEQ ID NO: 2008641 - RNA, 21 nt, Homo sapiens
ccacccaauugugguugugca

SEQ ID NO: 2008642 - RNA, 18 nt, Homo sapiens
cagaggcuuuuccagugu

SEQ ID NO: 2008643 - RNA, 17 nt, Homo sapiens
ucacuuguaccuuccac

SEQ ID NO: 2008644 - RNA, 23 nt, Homo sapiens
guuuuuaaagaaaagcauucaag

SEQ ID NO: 2008645 - RNA, 17 nt, Homo sapiens
acuguuagcacauugau

SEQ ID NO: 2008646 - RNA, 13 nt, Homo sapiens
ggauauuuacuac

SEQ ID NO: 2008647 - RNA, 14 nt, Homo sapiens
gaagauguugucau

SEQ ID NO: 2008648 - RNA, 21 nt, Homo sapiens
guuucauaggagacacaucca

SEQ ID NO: 2008649 - RNA, 17 nt, Homo sapiens
ucuuguuuuaagcaaau

SEQ ID NO: 2008650 - RNA, 17 nt, Homo sapiens
aaacugaaugacuugac

SEQ ID NO: 2008651 - RNA, 15 nt, Homo sapiens
ggccugguccaugau

SEQ ID NO: 2008652 - RNA, 18 nt, Homo sapiens
agccccaagccaugguga

SEQ ID NO: 2008653 - RNA, 16 nt, Homo sapiens
cacaaguuaguagcaa

SEQ ID NO: 2008654 - RNA, 17 nt, Homo sapiens
uggccucagcagcucuu

SEQ ID NO: 2008655 - RNA, 14 nt, Homo sapiens
aauggucaguauua

SEQ ID NO: 2008656 - RNA, 21 nt, Homo sapiens
aucuauuugugggugugcuau

SEQ ID NO: 2008657 - RNA, 20 nt, Homo sapiens
ccuuuugacagcugugcugu

SEQ ID NO: 2008658 - RNA, 21 nt, Homo sapiens
uucaguuccgucagaaagugu

SEQ ID NO: 2008659 - RNA, 16 nt, Homo sapiens
agggaucacugccaaa

SEQ ID NO: 2008660 - RNA, 13 nt, Homo sapiens
ccucuucccauga

SEQ ID NO: 2008661 - RNA, 23 nt, Homo sapiens
aauguuaauuaugcaguguuucc

SEQ ID NO: 2008662 - RNA, 17 nt, Homo sapiens
cauaccuacaccuaucu

SEQ ID NO: 2008663 - RNA, 18 nt, Homo sapiens
acagccaccguuucuucc

SEQ ID NO: 2008664 - RNA, 18 nt, Homo sapiens
auaaacgguuccugguga

SEQ ID NO: 2008665 - RNA, 20 nt, Homo sapiens
uguucuuuaagaguuuaaaa

SEQ ID NO: 2008666 - RNA, 12 nt, Homo sapiens
accagugaauga

SEQ ID NO: 2008667 - RNA, 12 nt, Homo sapiens
caaggugcucag

SEQ ID NO: 2008668 - RNA, 12 nt, Homo sapiens
aauaaagcaucc

SEQ ID NO: 2008669 - RNA, 11 nt, Homo sapiens
aguucauacau

SEQ ID NO: 2008670 - RNA, 16 nt, Homo sapiens
caaguauauaauuuac

SEQ ID NO: 2008671 - RNA, 17 nt, Homo sapiens
aacacuacauuacuuua

SEQ ID NO: 2008672 - RNA, 20 nt, Homo sapiens
uagccuuuaaaucauuuuua

SEQ ID NO: 2008673 - RNA, 17 nt, Homo sapiens
cacaguacaauguuuca

SEQ ID NO: 2008674 - RNA, 22 nt, Homo sapiens
gcagaacugaacuuauuaccua

SEQ ID NO: 2008675 - RNA, 18 nt, Homo sapiens
gcauuugcugcauuucaa

SEQ ID NO: 2008676 - RNA, 20 nt, Homo sapiens
cagacuggauaguccgucuc

SEQ ID NO: 2008677 - RNA, 15 nt, Homo sapiens
gucagagagaccuca

SEQ ID NO: 2008678 - RNA, 17 nt, Homo sapiens
aaggaagacaaugugaa

SEQ ID NO: 2008679 - RNA, 14 nt, Homo sapiens
ugaccggcugcuuu

SEQ ID NO: 2008680 - RNA, 13 nt, Homo sapiens
auucuuaagcacu

SEQ ID NO: 2008681 - RNA, 18 nt, Homo sapiens
cacuucauucacauucag

SEQ ID NO: 2008682 - RNA, 13 nt, Homo sapiens
cccucagauucca

SEQ ID NO: 2008683 - RNA, 14 nt, Homo sapiens
uagucacaccaucu

SEQ ID NO: 2008684 - RNA, 12 nt, Homo sapiens
aaaugagcauug

SEQ ID NO: 2008685 - RNA, 16 nt, Homo sapiens
uuucuucucccaaaug

SEQ ID NO: 2008686 - RNA, 17 nt, Homo sapiens
uuaaaaaaaaacauuca

SEQ ID NO: 2008687 - RNA, 17 nt, Homo sapiens
ugagaaaaugagugacu

SEQ ID NO: 2008688 - RNA, 18 nt, Homo sapiens
uaaagucacuuccagugu

SEQ ID NO: 2008689 - RNA, 21 nt, Homo sapiens
uuagcccuguguccugaguua

SEQ ID NO: 2008690 - RNA, 17 nt, Homo sapiens
agguuggugaauuucac

SEQ ID NO: 2008691 - RNA, 13 nt, Homo sapiens
gauagaaaugcca

SEQ ID NO: 2008692 - RNA, 22 nt, Homo sapiens
uggugcuuaggcuguauauuca

SEQ ID NO: 2008693 - RNA, 13 nt, Homo sapiens
cuaugcacugaag

SEQ ID NO: 2008694 - RNA, 16 nt, Homo sapiens
uuuaauauacuuuaaa

SEQ ID NO: 2008695 - RNA, 18 nt, Homo sapiens
ucagugcuuugcccuuga

SEQ ID NO: 2008696 - RNA, 22 nt, Homo sapiens
gcaaccuccacauguucaacua

SEQ ID NO: 2008697 - RNA, 20 nt, Homo sapiens
gcaacagaagugguuuccca

SEQ ID NO: 2008698 - RNA, 22 nt, Homo sapiens
ccacucugaaguaagagcaaug

SEQ ID NO: 2008699 - RNA, 17 nt, Homo sapiens
ggugagauggaaggaau

SEQ ID NO: 2008700 - RNA, 15 nt, Homo sapiens
aucacguuaccccaa

SEQ ID NO: 2008701 - RNA, 22 nt, Homo sapiens
accauggcacugacaaugggca

SEQ ID NO: 2008702 - RNA, 18 nt, Homo sapiens
ugaaagguaauacagcuu

SEQ ID NO: 2008703 - RNA, 14 nt, Homo sapiens
caugccuaguccaa

SEQ ID NO: 2008704 - RNA, 15 nt, Homo sapiens
uuccuagcuguaaau

SEQ ID NO: 2008705 - RNA, 21 nt, Homo sapiens
ucaaauuuggguauaugcagu

SEQ ID NO: 2008706 - RNA, 23 nt, Homo sapiens
uuaaaaaaauuuuaaguaucuag

SEQ ID NO: 2008707 - RNA, 22 nt, Homo sapiens
uguucaguaguuccaggacuca

SEQ ID NO: 2008708 - RNA, 18 nt, Homo sapiens
gcuucuaccaacuggaag

SEQ ID NO: 2008709 - RNA, 13 nt, Homo sapiens
gacaauacuguau

SEQ ID NO: 2008710 - RNA, 19 nt, Homo sapiens
ucagagcauuuuguugccu

SEQ ID NO: 2008711 - RNA, 23 nt, Homo sapiens
cagcugagguucccgacaccaga

SEQ ID NO: 2008712 - RNA, 17 nt, Homo sapiens
uuuaauugacauacuca

SEQ ID NO: 2008713 - RNA, 14 nt, Homo sapiens
guggccacuaagca

SEQ ID NO: 2008714 - RNA, 17 nt, Homo sapiens
ucauucugccugcucca

SEQ ID NO: 2008715 - RNA, 20 nt, Homo sapiens
ggcccagaggggcggggcca

SEQ ID NO: 2008716 - RNA, 20 nt, Homo sapiens
cuaggcuguuaaccuaugau

SEQ ID NO: 2008717 - RNA, 16 nt, Homo sapiens
ccugucuccacugugc

SEQ ID NO: 2008718 - RNA, 15 nt, Homo sapiens
acucuuacaccuguu

SEQ ID NO: 2008719 - RNA, 21 nt, Homo sapiens
uucacauaucuaguaugaaau

SEQ ID NO: 2008720 - RNA, 17 nt, Homo sapiens
cuuugaauaaaugucac

SEQ ID NO: 2008721 - RNA, 17 nt, Homo sapiens
uuuacaauuaaacucaa

SEQ ID NO: 2008722 - RNA, 20 nt, Homo sapiens
aauuguaaaauuuaaaucau

SEQ ID NO: 2008723 - RNA, 19 nt, Homo sapiens
gucccaucaauucuuagaa

SEQ ID NO: 2008724 - RNA, 17 nt, Homo sapiens
cuuguaaccagugcaga

SEQ ID NO: 2008725 - RNA, 14 nt, Homo sapiens
aaaaggcugccuaa

SEQ ID NO: 2008726 - RNA, 12 nt, Homo sapiens
acaauucugcau

SEQ ID NO: 2008727 - RNA, 13 nt, Homo sapiens
uugaggccaagga

SEQ ID NO: 2008728 - RNA, 22 nt, Homo sapiens
acuuacuguguaaauaaacuuu

SEQ ID NO: 2008729 - RNA, 20 nt, Homo sapiens
auguuggccaggauggucuc

SEQ ID NO: 2008730 - RNA, 14 nt, Homo sapiens
aucuuggacugaca

SEQ ID NO: 2008731 - RNA, 22 nt, Homo sapiens
cagugaagugccuuuuuccuag

SEQ ID NO: 2008732 - RNA, 18 nt, Homo sapiens
agaaucauugaaguauuu

SEQ ID NO: 2008733 - RNA, 22 nt, Homo sapiens
caugaccugaucacuagccugu

SEQ ID NO: 2008734 - RNA, 18 nt, Homo sapiens
ccugucucucucuucucu

SEQ ID NO: 2008735 - RNA, 19 nt, Homo sapiens
agauuuaaagaaaaccaca

SEQ ID NO: 2008736 - RNA, 14 nt, Homo sapiens
ccuugcccuuccag

SEQ ID NO: 2008737 - RNA, 18 nt, Homo sapiens
agcuccuccccacuagca

SEQ ID NO: 2008738 - RNA, 15 nt, Homo sapiens
cauggcauugaacug

SEQ ID NO: 2008739 - RNA, 19 nt, Homo sapiens
uaaauuauggcucuucacc

SEQ ID NO: 2008740 - RNA, 23 nt, Homo sapiens
uaaauauucccugacgacacuga

SEQ ID NO: 2008741 - RNA, 20 nt, Homo sapiens
ugaaauugaugccaguggaa

SEQ ID NO: 2008742 - RNA, 15 nt, Homo sapiens
gggaaagccaugacc

SEQ ID NO: 2008743 - RNA, 19 nt, Homo sapiens
cacagugacagucacuucc

SEQ ID NO: 2008744 - RNA, 17 nt, Homo sapiens
cuggcacauuucaggga

SEQ ID NO: 2008745 - RNA, 14 nt, Homo sapiens
aauguaauacugga

SEQ ID NO: 2008746 - RNA, 17 nt, Homo sapiens
aggaacaauaaaauguc

SEQ ID NO: 2008747 - RNA, 21 nt, Homo sapiens
aauuccacaucaaguguucca

SEQ ID NO: 2008748 - RNA, 12 nt, Homo sapiens
ucacacugaaac

SEQ ID NO: 2008749 - RNA, 21 nt, Homo sapiens
aggcauucuucuaaagcagac

SEQ ID NO: 2008750 - RNA, 15 nt, Homo sapiens
auuauugugccucag

SEQ ID NO: 2008751 - RNA, 12 nt, Homo sapiens
aaggagccagga

SEQ ID NO: 2008752 - RNA, 16 nt, Homo sapiens
gcagucacucuaguca

SEQ ID NO: 2008753 - RNA, 21 nt, Homo sapiens
aagccacgguguucugugaua

SEQ ID NO: 2008754 - RNA, 15 nt, Homo sapiens
acacaagacuggcag

SEQ ID NO: 2008755 - RNA, 23 nt, Homo sapiens
ggccugccuugaagccacugaag

SEQ ID NO: 2008756 - RNA, 19 nt, Homo sapiens
agcguuuccuuucuucccu

SEQ ID NO: 2008757 - RNA, 18 nt, Homo sapiens
ggucuuuguaucuuccau

SEQ ID NO: 2008758 - RNA, 12 nt, Homo sapiens
gaaaagcauccu

SEQ ID NO: 2008759 - RNA, 13 nt, Homo sapiens
ugauucaaauggg

SEQ ID NO: 2008760 - RNA, 19 nt, Homo sapiens
ggccagccccagcaccuca

SEQ ID NO: 2008761 - RNA, 16 nt, Homo sapiens
agguggcccuaaagga

SEQ ID NO: 2008762 - RNA, 16 nt, Homo sapiens
gccuuugccaggugac

SEQ ID NO: 2008763 - RNA, 13 nt, Homo sapiens
caaauaaacuagu

SEQ ID NO: 2008764 - RNA, 20 nt, Homo sapiens
cucgucuuggcacaaucuca

SEQ ID NO: 2008765 - RNA, 24 nt, Homo sapiens
aggagccugggaugauguugguca

SEQ ID NO: 2008766 - RNA, 12 nt, Homo sapiens
aggaauucucac

SEQ ID NO: 2008767 - RNA, 23 nt, Homo sapiens
ugugaacucagagccccucccug

SEQ ID NO: 2008768 - RNA, 16 nt, Homo sapiens
agaccugacaagcacu

SEQ ID NO: 2008769 - RNA, 15 nt, Homo sapiens
ccuucuccaucuuug

SEQ ID NO: 2008770 - RNA, 16 nt, Homo sapiens
auguggcauggcagaa

SEQ ID NO: 2008771 - RNA, 12 nt, Homo sapiens
gugccugagaca

SEQ ID NO: 2008772 - RNA, 15 nt, Homo sapiens
gauucacacccagcu

SEQ ID NO: 2008773 - RNA, 22 nt, Homo sapiens
agggaaugagaguuccuucuca

SEQ ID NO: 2008774 - RNA, 19 nt, Homo sapiens
cagaugaagacaucaggaa

SEQ ID NO: 2008775 - RNA, 15 nt, Homo sapiens
aggccucacacccag

SEQ ID NO: 2008776 - RNA, 18 nt, Homo sapiens
caaauucuucugaacuca

SEQ ID NO: 2008777 - RNA, 17 nt, Homo sapiens
agccaccugucccaccu

SEQ ID NO: 2008778 - RNA, 10 nt, Homo sapiens
caugcacauc

SEQ ID NO: 2008779 - RNA, 19 nt, Homo sapiens
cacuguaugccucugagca

SEQ ID NO: 2008780 - RNA, 15 nt, Homo sapiens
ggacaggcaggccag

SEQ ID NO: 2008781 - RNA, 23 nt, Homo sapiens
ccuauuagggaguuaugcaaaau

SEQ ID NO: 2008782 - RNA, 14 nt, Homo sapiens
uaccccaguuccua

SEQ ID NO: 2008783 - RNA, 14 nt, Homo sapiens
gaccauaaccacug

SEQ ID NO: 2008784 - RNA, 23 nt, Homo sapiens
aaauuccuuggcaugccuuccag

SEQ ID NO: 2008785 - RNA, 20 nt, Homo sapiens
uuguuaauaaaauagucacu

SEQ ID NO: 2008786 - RNA, 18 nt, Homo sapiens
ugagccaagaugacacaa

SEQ ID NO: 2008787 - RNA, 22 nt, Homo sapiens
ucccugggguggggauagggag

SEQ ID NO: 2008788 - RNA, 18 nt, Homo sapiens
aaugugaauagucaucuc

SEQ ID NO: 2008789 - RNA, 21 nt, Homo sapiens
ccccaguaucucuucagucuc

SEQ ID NO: 2008790 - RNA, 16 nt, Homo sapiens
ccuccaaaggucugau

SEQ ID NO: 2008791 - RNA, 12 nt, Homo sapiens
uucuuuggucaa

SEQ ID NO: 2008792 - RNA, 22 nt, Homo sapiens
ugcugccaggauugucacucca

SEQ ID NO: 2008793 - RNA, 19 nt, Homo sapiens
ugauacaguugcauguuau

SEQ ID NO: 2008794 - RNA, 20 nt, Homo sapiens
uggcacagaagcucaucuca

SEQ ID NO: 2008795 - RNA, 20 nt, Homo sapiens
ucucuccugauagucuuuca

SEQ ID NO: 2008796 - RNA, 16 nt, Homo sapiens
uauguuccuaagguca

SEQ ID NO: 2008797 - RNA, 23 nt, Homo sapiens
cuccauauuggacauccccagaa

SEQ ID NO: 2008798 - RNA, 14 nt, Homo sapiens
auauuuuccugcca

SEQ ID NO: 2008799 - RNA, 16 nt, Homo sapiens
uucucagcucuuccau

SEQ ID NO: 2008800 - RNA, 19 nt, Homo sapiens
agcccuuccuugccaguga

SEQ ID NO: 2008801 - RNA, 15 nt, Homo sapiens
uuuaaaaccacuaug

SEQ ID NO: 2008802 - RNA, 13 nt, Homo sapiens
gcaaccacugcuu

SEQ ID NO: 2008803 - RNA, 23 nt, Homo sapiens
aggccucucggugcuccaucucc

SEQ ID NO: 2008804 - RNA, 19 nt, Homo sapiens
cugucaaguuaacaaggaa

SEQ ID NO: 2008805 - RNA, 20 nt, Homo sapiens
cuaaagagcugcacagcaaa

SEQ ID NO: 2008806 - RNA, 20 nt, Homo sapiens
auugucaacacaaacuggcu

SEQ ID NO: 2008807 - RNA, 23 nt, Homo sapiens
ugaaagaucuucuuuaggaauaa

SEQ ID NO: 2008808 - RNA, 17 nt, Homo sapiens
cucccacaucccacugg

SEQ ID NO: 2008809 - RNA, 14 nt, Homo sapiens
agcagcccugcucu

SEQ ID NO: 2008810 - RNA, 13 nt, Homo sapiens
gugugggccagac

SEQ ID NO: 2008811 - RNA, 17 nt, Homo sapiens
acuauaagcccacuguu

SEQ ID NO: 2008812 - RNA, 18 nt, Homo sapiens
cucuauguaugcaucuau

SEQ ID NO: 2008813 - RNA, 21 nt, Homo sapiens
gagcccaggaguucaagacca

SEQ ID NO: 2008814 - RNA, 15 nt, Homo sapiens
ucccucuccaacugc

SEQ ID NO: 2008815 - RNA, 20 nt, Homo sapiens
ucaaccugguguuaggugug

SEQ ID NO: 2008816 - RNA, 20 nt, Homo sapiens
uuugacuuaagaaagcaaaa

SEQ ID NO: 2008817 - RNA, 15 nt, Homo sapiens
aguggucaggcaucu

SEQ ID NO: 2008818 - RNA, 17 nt, Homo sapiens
gaaaguguucuguuaca

SEQ ID NO: 2008819 - RNA, 14 nt, Homo sapiens
acacaguuauacau

SEQ ID NO: 2008820 - RNA, 15 nt, Homo sapiens
caaaggaaaccaaag

SEQ ID NO: 2008821 - RNA, 21 nt, Homo sapiens
aacuuuggaguuaguggauaa

SEQ ID NO: 2008822 - RNA, 21 nt, Homo sapiens
auugacaaccgagaagguuua

SEQ ID NO: 2008823 - RNA, 19 nt, Homo sapiens
ggaagcucugaagucacau

SEQ ID NO: 2008824 - RNA, 19 nt, Homo sapiens
cugagcgggagucagggac

SEQ ID NO: 2008825 - RNA, 15 nt, Homo sapiens
gggccgaauccccuc

SEQ ID NO: 2008826 - RNA, 18 nt, Homo sapiens
ccuccacucccacuuccc

SEQ ID NO: 2008827 - RNA, 19 nt, Homo sapiens
ggggacucgguaagcacuu

SEQ ID NO: 2008828 - RNA, 22 nt, Homo sapiens
agcaggugcugacuucaucucc

SEQ ID NO: 2008829 - RNA, 23 nt, Homo sapiens
cuagaagugguuuccugauaaca

SEQ ID NO: 2008830 - RNA, 21 nt, Homo sapiens
cuuaaaaaucuuguacauuau

SEQ ID NO: 2008831 - RNA, 21 nt, Homo sapiens
aguagcuggauuacaggcaug

SEQ ID NO: 2008832 - RNA, 13 nt, Homo sapiens
ccccagacacugg

SEQ ID NO: 2008833 - RNA, 15 nt, Homo sapiens
ucccagacacauuca

SEQ ID NO: 2008834 - RNA, 20 nt, Homo sapiens
cagaaaagaaaauauaguuu

SEQ ID NO: 2008835 - RNA, 16 nt, Homo sapiens
uagaagugccaucuca

SEQ ID NO: 2008836 - RNA, 22 nt, Homo sapiens
cgaggacuacaaccaauuuaca

SEQ ID NO: 2008837 - RNA, 19 nt, Homo sapiens
gcugguuagguccaccugc

SEQ ID NO: 2008838 - RNA, 14 nt, Homo sapiens
ccgugucaagcugc

SEQ ID NO: 2008839 - RNA, 15 nt, Homo sapiens
uacagauagauauau

SEQ ID NO: 2008840 - RNA, 20 nt, Homo sapiens
accagucccgucgugcaguc

SEQ ID NO: 2008841 - RNA, 21 nt, Homo sapiens
uuuaaccucuagagucacuga

SEQ ID NO: 2008842 - RNA, 20 nt, Homo sapiens
cuuacauuugaaaucuauga

SEQ ID NO: 2008843 - RNA, 21 nt, Homo sapiens
uuuucucaaccugggacuucc

SEQ ID NO: 2008844 - RNA, 17 nt, Homo sapiens
auaauucuuaacagugg

SEQ ID NO: 2008845 - RNA, 13 nt, Homo sapiens
acggcaccucggg

SEQ ID NO: 2008846 - RNA, 15 nt, Homo sapiens
cugaggaaugucuuu

SEQ ID NO: 2008847 - RNA, 20 nt, Homo sapiens
uguuuugcagaaugagccag

SEQ ID NO: 2008848 - RNA, 23 nt, Homo sapiens
uguggccuugcccgccagccuca

SEQ ID NO: 2008849 - RNA, 14 nt, Homo sapiens
caagccauuccaaa

SEQ ID NO: 2008850 - RNA, 14 nt, Homo sapiens
ggcuucucagcccu

SEQ ID NO: 2008851 - RNA, 15 nt, Homo sapiens
aaucuuuccaucuca

SEQ ID NO: 2008852 - RNA, 19 nt, Homo sapiens
ccugaagugaccccagcuc

SEQ ID NO: 2008853 - RNA, 17 nt, Homo sapiens
gcuuuucauagugcuca

SEQ ID NO: 2008854 - RNA, 15 nt, Homo sapiens
ucacuaugcugcuau

SEQ ID NO: 2008855 - RNA, 15 nt, Homo sapiens
ugaagccaaagccaa

SEQ ID NO: 2008856 - RNA, 12 nt, Homo sapiens
cucugugcuuug

SEQ ID NO: 2008857 - RNA, 19 nt, Homo sapiens
augcagcagggaugcccug

SEQ ID NO: 2008858 - RNA, 22 nt, Homo sapiens
gcuauagacccgaggaaacuca

SEQ ID NO: 2008859 - RNA, 13 nt, Homo sapiens
acagcagauucca

SEQ ID NO: 2008860 - RNA, 13 nt, Homo sapiens
ucuacgcccuucc

SEQ ID NO: 2008861 - RNA, 15 nt, Homo sapiens
aaaucuguuagcauu

SEQ ID NO: 2008862 - RNA, 22 nt, Homo sapiens
gaguguuuaccuggugcucuca

SEQ ID NO: 2008863 - RNA, 14 nt, Homo sapiens
caggggcaggcaca

SEQ ID NO: 2008864 - RNA, 15 nt, Homo sapiens
ugcaagugaacaaag

SEQ ID NO: 2008865 - RNA, 17 nt, Homo sapiens
agauuguccagugcaac

SEQ ID NO: 2008866 - RNA, 17 nt, Homo sapiens
ucuguugccauggugau

SEQ ID NO: 2008867 - RNA, 20 nt, Homo sapiens
ugggaaaguauucuguacuc

SEQ ID NO: 2008868 - RNA, 14 nt, Homo sapiens
uucucuaggaauca

SEQ ID NO: 2008869 - RNA, 14 nt, Homo sapiens
guguauguuuuaua

SEQ ID NO: 2008870 - RNA, 20 nt, Homo sapiens
acacagagcuuuggucugug

SEQ ID NO: 2008871 - RNA, 14 nt, Homo sapiens
aaauaguggccaga

SEQ ID NO: 2008872 - RNA, 17 nt, Homo sapiens
agauuucccuauuguga

SEQ ID NO: 2008873 - RNA, 21 nt, Homo sapiens
ccuuuggggugaacuaccuug

SEQ ID NO: 2008874 - RNA, 19 nt, Homo sapiens
cuuaagagaggggccaagu

SEQ ID NO: 2008875 - RNA, 15 nt, Homo sapiens
cuguaucuaguugua

SEQ ID NO: 2008876 - RNA, 22 nt, Homo sapiens
aggaagaucacuuugcucugau

SEQ ID NO: 2008877 - RNA, 15 nt, Homo sapiens
uacagacgucucaag

SEQ ID NO: 2008878 - RNA, 17 nt, Homo sapiens
auuuccuguguuugucc

SEQ ID NO: 2008879 - RNA, 12 nt, Homo sapiens
gauuuccaggga

SEQ ID NO: 2008880 - RNA, 12 nt, Homo sapiens
uccagcucugag

SEQ ID NO: 2008881 - RNA, 19 nt, Homo sapiens
aauguuuaauaaagcuuua

SEQ ID NO: 2008882 - RNA, 20 nt, Homo sapiens
cgaucucaacucacugcaag

SEQ ID NO: 2008883 - RNA, 14 nt, Homo sapiens
gcauaucacagaga

SEQ ID NO: 2008884 - RNA, 22 nt, Homo sapiens
gaaaaaaaaaaaaaaucacugu

SEQ ID NO: 2008885 - RNA, 22 nt, Homo sapiens
aucagugugauaaggacuuuag

SEQ ID NO: 2008886 - RNA, 16 nt, Homo sapiens
gaaugggcauuucuaa

SEQ ID NO: 2008887 - RNA, 20 nt, Homo sapiens
gagacuuggggaccagaggu

SEQ ID NO: 2008888 - RNA, 14 nt, Homo sapiens
aauuugucuuucaa

SEQ ID NO: 2008889 - RNA, 15 nt, Homo sapiens
ucugcugaccaaaug

SEQ ID NO: 2008890 - RNA, 20 nt, Homo sapiens
aucccaaggcuccugaccua

SEQ ID NO: 2008891 - RNA, 14 nt, Homo sapiens
aggaggcuagaaga

SEQ ID NO: 2008892 - RNA, 13 nt, Homo sapiens
auugcauccacua

SEQ ID NO: 2008893 - RNA, 16 nt, Homo sapiens
gacuuaaagcacugau

SEQ ID NO: 2008894 - RNA, 22 nt, Homo sapiens
ugccccucaacucuccuccaga

SEQ ID NO: 2008895 - RNA, 20 nt, Homo sapiens
ugaggaaaagacacccuguc

SEQ ID NO: 2008896 - RNA, 13 nt, Homo sapiens
cacucauuuggau

SEQ ID NO: 2008897 - RNA, 22 nt, Homo sapiens
aucucauuuuacacaaagggaa

SEQ ID NO: 2008898 - RNA, 16 nt, Homo sapiens
cacucagugccuccac

SEQ ID NO: 2008899 - RNA, 17 nt, Homo sapiens
cuuugacgggguuuucc

SEQ ID NO: 2008900 - RNA, 15 nt, Homo sapiens
cugucacaaccaaga

SEQ ID NO: 2008901 - RNA, 16 nt, Homo sapiens
gaagaucuaaacuuuu

SEQ ID NO: 2008902 - RNA, 20 nt, Homo sapiens
uaaacugaauauaaagcuua

SEQ ID NO: 2008903 - RNA, 16 nt, Homo sapiens
ucuaacaggcacuuug

SEQ ID NO: 2008904 - RNA, 15 nt, Homo sapiens
gacugcucgucuauc

SEQ ID NO: 2008905 - RNA, 19 nt, Homo sapiens
uuaaaugaacuacugcuau

SEQ ID NO: 2008906 - RNA, 20 nt, Homo sapiens
cucagccuugggaccgugcc

SEQ ID NO: 2008907 - RNA, 14 nt, Homo sapiens
agccugggcaacaa

SEQ ID NO: 2008908 - RNA, 18 nt, Homo sapiens
cugcucagagucuaucaa

SEQ ID NO: 2008909 - RNA, 21 nt, Homo sapiens
augauucccuccucgucaguc

SEQ ID NO: 2008910 - RNA, 17 nt, Homo sapiens
uccagcuaccaccacgg

SEQ ID NO: 2008911 - RNA, 13 nt, Homo sapiens
aaaggauuugaaa

SEQ ID NO: 2008912 - RNA, 15 nt, Homo sapiens
caugcuccaagacuu

SEQ ID NO: 2008913 - RNA, 16 nt, Homo sapiens
acaguuggcacuguaa

SEQ ID NO: 2008914 - RNA, 18 nt, Homo sapiens
uuuuauauuuauugugcu

SEQ ID NO: 2008915 - RNA, 13 nt, Homo sapiens
cuugagcaucagg

SEQ ID NO: 2008916 - RNA, 14 nt, Homo sapiens
ucucugugccuucg

SEQ ID NO: 2008917 - RNA, 15 nt, Homo sapiens
uagaagugugguggu

SEQ ID NO: 2008918 - RNA, 17 nt, Homo sapiens
aagaugggaaagaacca

SEQ ID NO: 2008919 - RNA, 22 nt, Homo sapiens
ggaaaaaauaacaaugaaaguu

SEQ ID NO: 2008920 - RNA, 18 nt, Homo sapiens
cuuaaaauaaaguuaaac

SEQ ID NO: 2008921 - RNA, 12 nt, Homo sapiens
aauucaucugaa

SEQ ID NO: 2008922 - RNA, 16 nt, Homo sapiens
uagagcaaucugggca

SEQ ID NO: 2008923 - RNA, 18 nt, Homo sapiens
uccuuuuucaacuuggaa

SEQ ID NO: 2008924 - RNA, 13 nt, Homo sapiens
guucauugcaaac

SEQ ID NO: 2008925 - RNA, 15 nt, Homo sapiens
ggaaaaguguuucca

SEQ ID NO: 2008926 - RNA, 13 nt, Homo sapiens
uggccauuuggcc

SEQ ID NO: 2008927 - RNA, 13 nt, Homo sapiens
cacauauucacau

SEQ ID NO: 2008928 - RNA, 22 nt, Homo sapiens
gccaccaagcugcucuccuuca

SEQ ID NO: 2008929 - RNA, 12 nt, Homo sapiens
aaagacuugaau

SEQ ID NO: 2008930 - RNA, 20 nt, Homo sapiens
aacauguuugggaaguccua

SEQ ID NO: 2008931 - RNA, 20 nt, Homo sapiens
cuccuguucacaccagagaa

SEQ ID NO: 2008932 - RNA, 20 nt, Homo sapiens
cuugaccucaggugauccac

SEQ ID NO: 2008933 - RNA, 14 nt, Homo sapiens
gaccucaggugauc

SEQ ID NO: 2008934 - RNA, 13 nt, Homo sapiens
ugcguacacagag

SEQ ID NO: 2008935 - RNA, 16 nt, Homo sapiens
ucaacauuuaaucaau

SEQ ID NO: 2008936 - RNA, 18 nt, Homo sapiens
cagagaccggacaagagc

SEQ ID NO: 2008937 - RNA, 20 nt, Homo sapiens
gucaauguugguuacuaaau

SEQ ID NO: 2008938 - RNA, 18 nt, Homo sapiens
gaaauaaauucugauucu

SEQ ID NO: 2008939 - RNA, 18 nt, Homo sapiens
aauuugugccacuuuaau

SEQ ID NO: 2008940 - RNA, 17 nt, Homo sapiens
ccuagcucacacucauc

SEQ ID NO: 2008941 - RNA, 20 nt, Homo sapiens
gcagccucaucccaggcagu

SEQ ID NO: 2008942 - RNA, 17 nt, Homo sapiens
ucagcugugaacaugga

SEQ ID NO: 2008943 - RNA, 21 nt, Homo sapiens
uaaaacaggcaaaguuuuaca

SEQ ID NO: 2008944 - RNA, 23 nt, Homo sapiens
auguacauaccuuguuauaugca

SEQ ID NO: 2008945 - RNA, 16 nt, Homo sapiens
agcuaguuugagccag

SEQ ID NO: 2008946 - RNA, 20 nt, Homo sapiens
auuguaguagggagugugua

SEQ ID NO: 2008947 - RNA, 17 nt, Homo sapiens
auccacaguacucacuu

SEQ ID NO: 2008948 - RNA, 19 nt, Homo sapiens
aauuuauuuccacuaaaaa

SEQ ID NO: 2008949 - RNA, 14 nt, Homo sapiens
aggugaauagcaca

SEQ ID NO: 2008950 - RNA, 14 nt, Homo sapiens
auguguuccuccug

SEQ ID NO: 2008951 - RNA, 21 nt, Homo sapiens
acuauuccacagggauaccuu

SEQ ID NO: 2008952 - RNA, 10 nt, Homo sapiens
accacuucag

SEQ ID NO: 2008953 - RNA, 19 nt, Homo sapiens
uuuccagugaguguaaaua

SEQ ID NO: 2008954 - RNA, 19 nt, Homo sapiens
acaaguuacauacauuuaa

SEQ ID NO: 2008955 - RNA, 16 nt, Homo sapiens
aauaaauaaaugcaau

SEQ ID NO: 2008956 - RNA, 19 nt, Homo sapiens
cuaguuuuuauacaugugu

SEQ ID NO: 2008957 - RNA, 18 nt, Homo sapiens
uauagacacacauacaua

SEQ ID NO: 2008958 - RNA, 22 nt, Homo sapiens
cucuugugacgugcacugugaa

SEQ ID NO: 2008959 - RNA, 20 nt, Homo sapiens
aaauuuuuuaaaaagcaaaa

SEQ ID NO: 2008960 - RNA, 11 nt, Homo sapiens
gcuuggaagaa

SEQ ID NO: 2008961 - RNA, 15 nt, Homo sapiens
cagcauuugauaaaa

SEQ ID NO: 2008962 - RNA, 13 nt, Homo sapiens
guguccuggugag

SEQ ID NO: 2008963 - RNA, 13 nt, Homo sapiens
gccuccuggccag

SEQ ID NO: 2008964 - RNA, 15 nt, Homo sapiens
agucucuugauucau

SEQ ID NO: 2008965 - RNA, 21 nt, Homo sapiens
gcuuuauccccguuucuugca

SEQ ID NO: 2008966 - RNA, 23 nt, Homo sapiens
uacuggcguggauuaaacuuaug

SEQ ID NO: 2008967 - RNA, 18 nt, Homo sapiens
uuaucaaugaugagguaa

SEQ ID NO: 2008968 - RNA, 15 nt, Homo sapiens
augccauagcauaau

SEQ ID NO: 2008969 - RNA, 21 nt, Homo sapiens
gagauaagguggcuucucacg

SEQ ID NO: 2008970 - RNA, 22 nt, Homo sapiens
cguccacaaaggucacaggcag

SEQ ID NO: 2008971 - RNA, 17 nt, Homo sapiens
cauguaaacugugcacc

SEQ ID NO: 2008972 - RNA, 18 nt, Homo sapiens
ucaaggccuucaguuuau

SEQ ID NO: 2008973 - RNA, 19 nt, Homo sapiens
caaguuuuggcagccauga

SEQ ID NO: 2008974 - RNA, 21 nt, Homo sapiens
cucucacuaggcuaaacucaa

SEQ ID NO: 2008975 - RNA, 15 nt, Homo sapiens
auaauuuucaagcaa

SEQ ID NO: 2008976 - RNA, 17 nt, Homo sapiens
agggaacugagcacagg

SEQ ID NO: 2008977 - RNA, 13 nt, Homo sapiens
caauaacaaacug

SEQ ID NO: 2008978 - RNA, 16 nt, Homo sapiens
ucugacgcaaaaccac

SEQ ID NO: 2008979 - RNA, 14 nt, Homo sapiens
accagggcugcucu

SEQ ID NO: 2008980 - RNA, 21 nt, Homo sapiens
gacacguuuggccagugacau

SEQ ID NO: 2008981 - RNA, 18 nt, Homo sapiens
ccuuccucccauuuccca

SEQ ID NO: 2008982 - RNA, 14 nt, Homo sapiens
cugcaggaucucac

SEQ ID NO: 2008983 - RNA, 18 nt, Homo sapiens
agcuaacagcaguuucag

SEQ ID NO: 2008984 - RNA, 16 nt, Homo sapiens
auuuuccaccaaauuc

SEQ ID NO: 2008985 - RNA, 17 nt, Homo sapiens
ggaucuaccagcauaaa

SEQ ID NO: 2008986 - RNA, 12 nt, Homo sapiens
auucugccaugg

SEQ ID NO: 2008987 - RNA, 12 nt, Homo sapiens
ccgcugccccug

SEQ ID NO: 2008988 - RNA, 18 nt, Homo sapiens
cacccaaccugacuuccu

SEQ ID NO: 2008989 - RNA, 11 nt, Homo sapiens
uuaaacgucau

SEQ ID NO: 2008990 - RNA, 19 nt, Homo sapiens
gacagcuaaaucauuugag

SEQ ID NO: 2008991 - RNA, 21 nt, Homo sapiens
aggcagcuuuuucucucccac

SEQ ID NO: 2008992 - RNA, 21 nt, Homo sapiens
ugggcuuguagaccacugucc

SEQ ID NO: 2008993 - RNA, 20 nt, Homo sapiens
guuugaauggagauucugau

SEQ ID NO: 2008994 - RNA, 17 nt, Homo sapiens
cuuuccaccaagcguuu

SEQ ID NO: 2008995 - RNA, 20 nt, Homo sapiens
aagaaggggccaucacagga

SEQ ID NO: 2008996 - RNA, 16 nt, Homo sapiens
cgucuauccuguguag

SEQ ID NO: 2008997 - RNA, 23 nt, Homo sapiens
accagcucccaugugcugagaac

SEQ ID NO: 2008998 - RNA, 12 nt, Homo sapiens
uuaauaccaaag

SEQ ID NO: 2008999 - RNA, 18 nt, Homo sapiens
gaguuggcguugugggca

SEQ ID NO: 2009000 - RNA, 15 nt, Homo sapiens
agcuccggccugucc

SEQ ID NO: 2009001 - RNA, 18 nt, Homo sapiens
cauaguuuaaacugcauu

SEQ ID NO: 2009002 - RNA, 14 nt, Homo sapiens
ucauuaaccaaaga

SEQ ID NO: 2009003 - RNA, 13 nt, Homo sapiens
ccuugcaauguuc

SEQ ID NO: 2009004 - RNA, 22 nt, Homo sapiens
gagaguuucuauggauucacuu

SEQ ID NO: 2009005 - RNA, 23 nt, Homo sapiens
uggaagagagaaagcauauugac

SEQ ID NO: 2009006 - RNA, 17 nt, Homo sapiens
gugaguuuccacugcau

SEQ ID NO: 2009007 - RNA, 19 nt, Homo sapiens
caacugcccagagccacag

SEQ ID NO: 2009008 - RNA, 19 nt, Homo sapiens
agcuauggcccaucuguau

SEQ ID NO: 2009009 - RNA, 21 nt, Homo sapiens
gagaucgcgccaguacauucc

SEQ ID NO: 2009010 - RNA, 18 nt, Homo sapiens
agccagaaaucccagcgc

SEQ ID NO: 2009011 - RNA, 16 nt, Homo sapiens
aacaauugcaacagaa

SEQ ID NO: 2009012 - RNA, 16 nt, Homo sapiens
aaauccuguuacuuaa

SEQ ID NO: 2009013 - RNA, 15 nt, Homo sapiens
aauaaaagaacaugc

SEQ ID NO: 2009014 - RNA, 18 nt, Homo sapiens
ccuuuuaccccugcacag

SEQ ID NO: 2009015 - RNA, 17 nt, Homo sapiens
guucugguuacuguucu

SEQ ID NO: 2009016 - RNA, 14 nt, Homo sapiens
guuguaaagaguug

SEQ ID NO: 2009017 - RNA, 20 nt, Homo sapiens
cucaaauauuugcuaugaag

SEQ ID NO: 2009018 - RNA, 15 nt, Homo sapiens
ccgagucucuucucc

SEQ ID NO: 2009019 - RNA, 19 nt, Homo sapiens
uggauaagugcuaccuuaa

SEQ ID NO: 2009020 - RNA, 12 nt, Homo sapiens
guuuuaccagcu

SEQ ID NO: 2009021 - RNA, 14 nt, Homo sapiens
ugacucuuccgugc

SEQ ID NO: 2009022 - RNA, 21 nt, Homo sapiens
guaauuaugguuaguagaggu

SEQ ID NO: 2009023 - RNA, 15 nt, Homo sapiens
acaaaccauugaaac

SEQ ID NO: 2009024 - RNA, 15 nt, Homo sapiens
cucuacagacuccaa

SEQ ID NO: 2009025 - RNA, 17 nt, Homo sapiens
cucgaugcagacagggg

SEQ ID NO: 2009026 - RNA, 16 nt, Homo sapiens
agugagggcucacuca

SEQ ID NO: 2009027 - RNA, 19 nt, Homo sapiens
uaauaaacacuggcucugg

SEQ ID NO: 2009028 - RNA, 15 nt, Homo sapiens
aacaccuagcuuuau

SEQ ID NO: 2009029 - RNA, 17 nt, Homo sapiens
gaaacuugcauacagag

SEQ ID NO: 2009030 - RNA, 14 nt, Homo sapiens
cacaaccacuguag

SEQ ID NO: 2009031 - RNA, 17 nt, Homo sapiens
uuaaucuuaagauucuu

SEQ ID NO: 2009032 - RNA, 15 nt, Homo sapiens
cucugcaguccuccg

SEQ ID NO: 2009033 - RNA, 15 nt, Homo sapiens
gguccugagcacugc

SEQ ID NO: 2009034 - RNA, 15 nt, Homo sapiens
auggcuaagcuuuau

SEQ ID NO: 2009035 - RNA, 21 nt, Homo sapiens
uauacuguaaagcgcagauaa

SEQ ID NO: 2009036 - RNA, 21 nt, Homo sapiens
augauugaaaauaaugcuguu

SEQ ID NO: 2009037 - RNA, 17 nt, Homo sapiens
ugaggaaggacuugacu

SEQ ID NO: 2009038 - RNA, 13 nt, Homo sapiens
caccucugugacc

SEQ ID NO: 2009039 - RNA, 19 nt, Homo sapiens
ugagucuguugugugucau

SEQ ID NO: 2009040 - RNA, 18 nt, Homo sapiens
auauuuuuagauaguuag

SEQ ID NO: 2009041 - RNA, 23 nt, Homo sapiens
cgagucuugcucuucaaugcuac

SEQ ID NO: 2009042 - RNA, 12 nt, Homo sapiens
ucuaaaacugcc

SEQ ID NO: 2009043 - RNA, 14 nt, Homo sapiens
accuagacuguaaa

SEQ ID NO: 2009044 - RNA, 22 nt, Homo sapiens
caaucaugaaauaugcaucuca

SEQ ID NO: 2009045 - RNA, 21 nt, Homo sapiens
uguuaaacuaaaaauuuacaa

SEQ ID NO: 2009046 - RNA, 19 nt, Homo sapiens
guuaggccuggcacagugu

SEQ ID NO: 2009047 - RNA, 17 nt, Homo sapiens
acaggugaaugugccac

SEQ ID NO: 2009048 - RNA, 18 nt, Homo sapiens
uugcuuccugcuauaagu

SEQ ID NO: 2009049 - RNA, 14 nt, Homo sapiens
acaucucuucaugc

SEQ ID NO: 2009050 - RNA, 13 nt, Homo sapiens
cuguccugucagu

SEQ ID NO: 2009051 - RNA, 16 nt, Homo sapiens
agagaaauaguuucac

SEQ ID NO: 2009052 - RNA, 17 nt, Homo sapiens
uucauuauugguuuuaa

SEQ ID NO: 2009053 - RNA, 20 nt, Homo sapiens
caguucugaauaacuugaag

SEQ ID NO: 2009054 - RNA, 17 nt, Homo sapiens
ugcaccaccaagccaag

SEQ ID NO: 2009055 - RNA, 18 nt, Homo sapiens
aggccauaggaguccuaa

SEQ ID NO: 2009056 - RNA, 18 nt, Homo sapiens
aucacgagaucaagagau

SEQ ID NO: 2009057 - RNA, 18 nt, Homo sapiens
uaggcaucacaugcucaa

SEQ ID NO: 2009058 - RNA, 15 nt, Homo sapiens
cucuuuguacugcuu

SEQ ID NO: 2009059 - RNA, 12 nt, Homo sapiens
gugcagugauac

SEQ ID NO: 2009060 - RNA, 18 nt, Homo sapiens
cugccucaggccaaggga

SEQ ID NO: 2009061 - RNA, 18 nt, Homo sapiens
agcugauuuuaacaauaa

SEQ ID NO: 2009062 - RNA, 20 nt, Homo sapiens
acuggggucuguguggugcc

SEQ ID NO: 2009063 - RNA, 20 nt, Homo sapiens
acacgguucaaaccugugaa

SEQ ID NO: 2009064 - RNA, 15 nt, Homo sapiens
gagacaccaaccgac

SEQ ID NO: 2009065 - RNA, 21 nt, Homo sapiens
cgugcgcgugagugugugagc

SEQ ID NO: 2009066 - RNA, 13 nt, Homo sapiens
aauauugaacuca

SEQ ID NO: 2009067 - RNA, 13 nt, Homo sapiens
uugucauacaaau

SEQ ID NO: 2009068 - RNA, 13 nt, Homo sapiens
ucuguccuuccau

SEQ ID NO: 2009069 - RNA, 18 nt, Homo sapiens
uuaguacccugcaggcca

SEQ ID NO: 2009070 - RNA, 16 nt, Homo sapiens
agcucuucaucugccc

SEQ ID NO: 2009071 - RNA, 12 nt, Homo sapiens
cagugcugccag

SEQ ID NO: 2009072 - RNA, 20 nt, Homo sapiens
cagcaauuguucagggaaua

SEQ ID NO: 2009073 - RNA, 15 nt, Homo sapiens
ugaggaccaaagaua

SEQ ID NO: 2009074 - RNA, 13 nt, Homo sapiens
ggaccuccaagcc

SEQ ID NO: 2009075 - RNA, 13 nt, Homo sapiens
ugaguccaaagaa

SEQ ID NO: 2009076 - RNA, 12 nt, Homo sapiens
gucacuaagacu

SEQ ID NO: 2009077 - RNA, 22 nt, Homo sapiens
aucacacacauggaaacccaua

SEQ ID NO: 2009078 - RNA, 14 nt, Homo sapiens
cuuacaaacaugug

SEQ ID NO: 2009079 - RNA, 13 nt, Homo sapiens
ucucuguugucua

SEQ ID NO: 2009080 - RNA, 11 nt, Homo sapiens
caucaucucag

SEQ ID NO: 2009081 - RNA, 11 nt, Homo sapiens
aaucaucuaag

SEQ ID NO: 2009082 - RNA, 22 nt, Homo sapiens
auuugaaauaauuuucaagcaa

SEQ ID NO: 2009083 - RNA, 14 nt, Homo sapiens
uaaucacaguguug

SEQ ID NO: 2009084 - RNA, 14 nt, Homo sapiens
acauauggaaauau

SEQ ID NO: 2009085 - RNA, 14 nt, Homo sapiens
aauguaggacugua

SEQ ID NO: 2009086 - RNA, 14 nt, Homo sapiens
ucuuaugguauuau

SEQ ID NO: 2009087 - RNA, 13 nt, Homo sapiens
augaagggaaauu

SEQ ID NO: 2009088 - RNA, 18 nt, Homo sapiens
aggguugacuuuacccau

SEQ ID NO: 2009089 - RNA, 15 nt, Homo sapiens
gacaauccuugagaa

SEQ ID NO: 2009090 - RNA, 14 nt, Homo sapiens
cccaggaccagcuc

SEQ ID NO: 2009091 - RNA, 15 nt, Homo sapiens
accagcccugaaggc

SEQ ID NO: 2009092 - RNA, 15 nt, Homo sapiens
ucauggccagcugcc

SEQ ID NO: 2009093 - RNA, 18 nt, Homo sapiens
uauaaaugauggcaaaaa

SEQ ID NO: 2009094 - RNA, 22 nt, Homo sapiens
uuaacuggcuucagccucccca

SEQ ID NO: 2009095 - RNA, 19 nt, Homo sapiens
ugggagucauggacaugaa

SEQ ID NO: 2009096 - RNA, 20 nt, Homo sapiens
ucugugucagcaucuuugcc

SEQ ID NO: 2009097 - RNA, 21 nt, Homo sapiens
agugguguuuagaaugucagu

SEQ ID NO: 2009098 - RNA, 14 nt, Homo sapiens
gcauggaguguuug

SEQ ID NO: 2009099 - RNA, 19 nt, Homo sapiens
agcugacaguccucuccac

SEQ ID NO: 2009100 - RNA, 23 nt, Homo sapiens
ucuguccaucugucuguccuacc

SEQ ID NO: 2009101 - RNA, 22 nt, Homo sapiens
aaccccagccugaccugagacu

SEQ ID NO: 2009102 - RNA, 20 nt, Homo sapiens
augcauaggaaguauggcau

SEQ ID NO: 2009103 - RNA, 13 nt, Homo sapiens
gcaccuaccacca

SEQ ID NO: 2009104 - RNA, 20 nt, Homo sapiens
cucuguaaaacacaccaauc

SEQ ID NO: 2009105 - RNA, 12 nt, Homo sapiens
cagccacuguca

SEQ ID NO: 2009106 - RNA, 12 nt, Homo sapiens
cacacacugugc

SEQ ID NO: 2009107 - RNA, 15 nt, Homo sapiens
uaugccacaagaacc

SEQ ID NO: 2009108 - RNA, 15 nt, Homo sapiens
aaggcaccuauaaaa

SEQ ID NO: 2009109 - RNA, 13 nt, Homo sapiens
ugucugaacuguu

SEQ ID NO: 2009110 - RNA, 11 nt, Homo sapiens
agggcacugaa

SEQ ID NO: 2009111 - RNA, 22 nt, Homo sapiens
auggccuggggaagcugugaaa

SEQ ID NO: 2009112 - RNA, 17 nt, Homo sapiens
accugcaaguugcucug

SEQ ID NO: 2009113 - RNA, 15 nt, Homo sapiens
ugugcacacauauac

SEQ ID NO: 2009114 - RNA, 15 nt, Homo sapiens
cauacugauguguug

SEQ ID NO: 2009115 - RNA, 16 nt, Homo sapiens
uucccauugcaguuga

SEQ ID NO: 2009116 - RNA, 16 nt, Homo sapiens
gaaaaaauaacacugu

SEQ ID NO: 2009117 - RNA, 15 nt, Homo sapiens
uggacuucaucucaa

SEQ ID NO: 2009118 - RNA, 13 nt, Homo sapiens
cugccccaugaaa

SEQ ID NO: 2009119 - RNA, 17 nt, Homo sapiens
cacugaggaccagccau

SEQ ID NO: 2009120 - RNA, 19 nt, Homo sapiens
uauucugucuggcauuaca

SEQ ID NO: 2009121 - RNA, 12 nt, Homo sapiens
ugaucagugaca

SEQ ID NO: 2009122 - RNA, 17 nt, Homo sapiens
ugaaccugaugagcaag

SEQ ID NO: 2009123 - RNA, 15 nt, Homo sapiens
cccaaggaagagcca

SEQ ID NO: 2009124 - RNA, 20 nt, Homo sapiens
cuuguagcucucugaccucc

SEQ ID NO: 2009125 - RNA, 17 nt, Homo sapiens
uccacuuggagcuaaaa

SEQ ID NO: 2009126 - RNA, 15 nt, Homo sapiens
uagaguauagcucug

SEQ ID NO: 2009127 - RNA, 22 nt, Homo sapiens
agguuagguuugucaacacaaa

SEQ ID NO: 2009128 - RNA, 15 nt, Homo sapiens
uucuguuaacugaau

SEQ ID NO: 2009129 - RNA, 14 nt, Homo sapiens
uggaaguacauaaa

SEQ ID NO: 2009130 - RNA, 15 nt, Homo sapiens
aaggcccacuucuuc

SEQ ID NO: 2009131 - RNA, 19 nt, Homo sapiens
acuggagcaucugacucac

SEQ ID NO: 2009132 - RNA, 23 nt, Homo sapiens
aaaucggaucuggggcucuggga

SEQ ID NO: 2009133 - RNA, 17 nt, Homo sapiens
agcuguucucauuccug

SEQ ID NO: 2009134 - RNA, 17 nt, Homo sapiens
ucaccaaggcagugcau

SEQ ID NO: 2009135 - RNA, 13 nt, Homo sapiens
agacauugcucua

SEQ ID NO: 2009136 - RNA, 16 nt, Homo sapiens
ccagcuuuuucucuca

SEQ ID NO: 2009137 - RNA, 17 nt, Homo sapiens
ucaucuugaaguuuuuc

SEQ ID NO: 2009138 - RNA, 18 nt, Homo sapiens
cauaucggcucacaaaga

SEQ ID NO: 2009139 - RNA, 14 nt, Homo sapiens
aagaagaauauucu

SEQ ID NO: 2009140 - RNA, 17 nt, Homo sapiens
uauuugucugugugcua

SEQ ID NO: 2009141 - RNA, 16 nt, Homo sapiens
uccucgguacucccau

SEQ ID NO: 2009142 - RNA, 23 nt, Homo sapiens
cugaacccugcuccguuggucag

SEQ ID NO: 2009143 - RNA, 22 nt, Homo sapiens
uaaauuaucaggcaaauuugca

SEQ ID NO: 2009144 - RNA, 16 nt, Homo sapiens
acacuauccaaugaau

SEQ ID NO: 2009145 - RNA, 17 nt, Homo sapiens
acaccaucucccaugaa

SEQ ID NO: 2009146 - RNA, 14 nt, Homo sapiens
aagaagucacugaa

SEQ ID NO: 2009147 - RNA, 17 nt, Homo sapiens
uuucauuuaucuauaau

SEQ ID NO: 2009148 - RNA, 16 nt, Homo sapiens
auagagcccagugagg

SEQ ID NO: 2009149 - RNA, 15 nt, Homo sapiens
ccauaccagucaccu

SEQ ID NO: 2009150 - RNA, 16 nt, Homo sapiens
uaagggaagcuggaau

SEQ ID NO: 2009151 - RNA, 22 nt, Homo sapiens
ccgccagccacaggaccaccuc

SEQ ID NO: 2009152 - RNA, 18 nt, Homo sapiens
ucaaucuguaaaacuaag

SEQ ID NO: 2009153 - RNA, 13 nt, Homo sapiens
caauccugucaua

SEQ ID NO: 2009154 - RNA, 16 nt, Homo sapiens
cauugauuucauugaa

SEQ ID NO: 2009155 - RNA, 22 nt, Homo sapiens
cagcaggggccaagcaggcacu

SEQ ID NO: 2009156 - RNA, 18 nt, Homo sapiens
uuaacuuauugcuagaua

SEQ ID NO: 2009157 - RNA, 21 nt, Homo sapiens
uccucuccuacccacuggucu

SEQ ID NO: 2009158 - RNA, 16 nt, Homo sapiens
ggagacacauucacaa

SEQ ID NO: 2009159 - RNA, 20 nt, Homo sapiens
cauuuguuuaauuuauacug

SEQ ID NO: 2009160 - RNA, 18 nt, Homo sapiens
cugagcacuguuuauaca

SEQ ID NO: 2009161 - RNA, 12 nt, Homo sapiens
ccucgcuaugug

SEQ ID NO: 2009162 - RNA, 12 nt, Homo sapiens
uuucaaacuuua

SEQ ID NO: 2009163 - RNA, 19 nt, Homo sapiens
uccuucucucacuguguua

SEQ ID NO: 2009164 - RNA, 16 nt, Homo sapiens
augucagccacuguga

SEQ ID NO: 2009165 - RNA, 19 nt, Homo sapiens
acaugaagggaugcugcaa

SEQ ID NO: 2009166 - RNA, 13 nt, Homo sapiens
aauuaaagaccua

SEQ ID NO: 2009167 - RNA, 15 nt, Homo sapiens
cagcuuauugucuag

SEQ ID NO: 2009168 - RNA, 16 nt, Homo sapiens
uccucuuaagacacua

SEQ ID NO: 2009169 - RNA, 18 nt, Homo sapiens
gucaaagugguacaggaa

SEQ ID NO: 2009170 - RNA, 20 nt, Homo sapiens
uggacacuugcucaugcccu

SEQ ID NO: 2009171 - RNA, 23 nt, Homo sapiens
ccuucccagaauguuacugacuc

SEQ ID NO: 2009172 - RNA, 16 nt, Homo sapiens
cuguacauaaauucca

SEQ ID NO: 2009173 - RNA, 20 nt, Homo sapiens
cauuugccaaaaauucaugc

SEQ ID NO: 2009174 - RNA, 21 nt, Homo sapiens
aguucaacugcuuacucccaa

SEQ ID NO: 2009175 - RNA, 21 nt, Homo sapiens
acuuauuucagguuaaauuaa

SEQ ID NO: 2009176 - RNA, 16 nt, Homo sapiens
uucuaaguuagacucu

SEQ ID NO: 2009177 - RNA, 22 nt, Homo sapiens
agauauaagauuuguacauauu

SEQ ID NO: 2009178 - RNA, 20 nt, Homo sapiens
guauaauuugaggugaaauu

SEQ ID NO: 2009179 - RNA, 18 nt, Homo sapiens
agagccauaaaugaccua

SEQ ID NO: 2009180 - RNA, 17 nt, Homo sapiens
auucugccgugugcccu

SEQ ID NO: 2009181 - RNA, 16 nt, Homo sapiens
guaaauccaugguguu

SEQ ID NO: 2009182 - RNA, 17 nt, Homo sapiens
agggucacgcuugccug

SEQ ID NO: 2009183 - RNA, 21 nt, Homo sapiens
uacuucuaaauuauaccauga

SEQ ID NO: 2009184 - RNA, 19 nt, Homo sapiens
agccuucugugcugugagu

SEQ ID NO: 2009185 - RNA, 14 nt, Homo sapiens
uccacucacuccag

SEQ ID NO: 2009186 - RNA, 14 nt, Homo sapiens
ucuuuacuguggaa

SEQ ID NO: 2009187 - RNA, 16 nt, Homo sapiens
gagagcaaauggcaaa

SEQ ID NO: 2009188 - RNA, 22 nt, Homo sapiens
caguguggcuucuaugagccca

SEQ ID NO: 2009189 - RNA, 12 nt, Homo sapiens
auauaaagucag

SEQ ID NO: 2009190 - RNA, 13 nt, Homo sapiens
uuaaaaagcaaaa

SEQ ID NO: 2009191 - RNA, 16 nt, Homo sapiens
ggcucacacagcuuaa

SEQ ID NO: 2009192 - RNA, 17 nt, Homo sapiens
caagaugaaacagggca

SEQ ID NO: 2009193 - RNA, 16 nt, Homo sapiens
ugucaaucccuugugc

SEQ ID NO: 2009194 - RNA, 17 nt, Homo sapiens
cagccaugucugcauuu

SEQ ID NO: 2009195 - RNA, 23 nt, Homo sapiens
agggaugccaacaccuucuuggc

SEQ ID NO: 2009196 - RNA, 16 nt, Homo sapiens
augucucuuguagaag

SEQ ID NO: 2009197 - RNA, 21 nt, Homo sapiens
caauaaaaccugggugucaga

SEQ ID NO: 2009198 - RNA, 21 nt, Homo sapiens
aagccagcccccuccagcuca

SEQ ID NO: 2009199 - RNA, 15 nt, Homo sapiens
aaauuccauuaucuu

SEQ ID NO: 2009200 - RNA, 14 nt, Homo sapiens
ggccucaucucaga

SEQ ID NO: 2009201 - RNA, 22 nt, Homo sapiens
aguauuuuuuaauccuaccuca

SEQ ID NO: 2009202 - RNA, 21 nt, Homo sapiens
auggaaauauuaugcaaauuc

SEQ ID NO: 2009203 - RNA, 19 nt, Homo sapiens
acggagggccgugugacac

SEQ ID NO: 2009204 - RNA, 20 nt, Homo sapiens
gagaguugaccccuccugaa

SEQ ID NO: 2009205 - RNA, 20 nt, Homo sapiens
cgacacugagcugugaccca

SEQ ID NO: 2009206 - RNA, 15 nt, Homo sapiens
cuuguccauguaaua

SEQ ID NO: 2009207 - RNA, 18 nt, Homo sapiens
ugcaccaggcacugcugc

SEQ ID NO: 2009208 - RNA, 15 nt, Homo sapiens
uggcgcgaucucagc

SEQ ID NO: 2009209 - RNA, 22 nt, Homo sapiens
ccgcauuuugggugccauuaaa

SEQ ID NO: 2009210 - RNA, 21 nt, Homo sapiens
uggaucgaguguagcugugaa

SEQ ID NO: 2009211 - RNA, 22 nt, Homo sapiens
aggagcaucagcugucugucau

SEQ ID NO: 2009212 - RNA, 22 nt, Homo sapiens
auccuucuuucuaguucagcug

SEQ ID NO: 2009213 - RNA, 18 nt, Homo sapiens
cugaaacuuaacgugauc

SEQ ID NO: 2009214 - RNA, 18 nt, Homo sapiens
cccccaggauugugcaau

SEQ ID NO: 2009215 - RNA, 18 nt, Homo sapiens
uucuauaagaaaaaggaa

SEQ ID NO: 2009216 - RNA, 22 nt, Homo sapiens
cagaacagggucauguuugcag

SEQ ID NO: 2009217 - RNA, 16 nt, Homo sapiens
cuuuuuuucuguacca

SEQ ID NO: 2009218 - RNA, 15 nt, Homo sapiens
aaauuagaggacacu

SEQ ID NO: 2009219 - RNA, 11 nt, Homo sapiens
aaggcaaugau

SEQ ID NO: 2009220 - RNA, 14 nt, Homo sapiens
cuauauauguguau

SEQ ID NO: 2009221 - RNA, 14 nt, Homo sapiens
ccgcacaugcacac

SEQ ID NO: 2009222 - RNA, 11 nt, Homo sapiens
ggcauagcucu

SEQ ID NO: 2009223 - RNA, 16 nt, Homo sapiens
ugauggcgggcacugg

SEQ ID NO: 2009224 - RNA, 12 nt, Homo sapiens
ugguggugguga

SEQ ID NO: 2009225 - RNA, 20 nt, Homo sapiens
aauugauuucuuuucuuccu

SEQ ID NO: 2009226 - RNA, 14 nt, Homo sapiens
ugaaaaugaaagga

SEQ ID NO: 2009227 - RNA, 15 nt, Homo sapiens
cccuguguagcucuc

SEQ ID NO: 2009228 - RNA, 14 nt, Homo sapiens
caggacugugacca

SEQ ID NO: 2009229 - RNA, 23 nt, Homo sapiens
ucagaaaacagagaaaggguaau

SEQ ID NO: 2009230 - RNA, 18 nt, Homo sapiens
cugaaaccuuaguuucaa

SEQ ID NO: 2009231 - RNA, 13 nt, Homo sapiens
ugcagagugcaga

SEQ ID NO: 2009232 - RNA, 14 nt, Homo sapiens
ggccuacagcuuug

SEQ ID NO: 2009233 - RNA, 13 nt, Homo sapiens
uaguuguucuccc

SEQ ID NO: 2009234 - RNA, 19 nt, Homo sapiens
uuauacaauaacccaguua

SEQ ID NO: 2009235 - RNA, 21 nt, Homo sapiens
caguggcuggugcccaugaag

SEQ ID NO: 2009236 - RNA, 19 nt, Homo sapiens
gguauugaacugcagguga

SEQ ID NO: 2009237 - RNA, 19 nt, Homo sapiens
accaauugucaugcuugac

SEQ ID NO: 2009238 - RNA, 20 nt, Homo sapiens
cgcccaaacuggagugcagu

SEQ ID NO: 2009239 - RNA, 21 nt, Homo sapiens
uauuguacucugcuuuaucaa

SEQ ID NO: 2009240 - RNA, 21 nt, Homo sapiens
gagcacggacugucaguucuc

SEQ ID NO: 2009241 - RNA, 22 nt, Homo sapiens
uucccuuugauuuuuugcugca

SEQ ID NO: 2009242 - RNA, 16 nt, Homo sapiens
ugcaaucuguguucga

SEQ ID NO: 2009243 - RNA, 16 nt, Homo sapiens
guuauaaaauaaugua

SEQ ID NO: 2009244 - RNA, 22 nt, Homo sapiens
uccauuuuuaaccccauuugca

SEQ ID NO: 2009245 - RNA, 16 nt, Homo sapiens
cuucaucaucuuaccu

SEQ ID NO: 2009246 - RNA, 14 nt, Homo sapiens
ggaauaaagcccuu

SEQ ID NO: 2009247 - RNA, 16 nt, Homo sapiens
guccucuugaagcaua

SEQ ID NO: 2009248 - RNA, 15 nt, Homo sapiens
cuccuuuuacagaau

SEQ ID NO: 2009249 - RNA, 21 nt, Homo sapiens
auucucagaguaaaauaggca

SEQ ID NO: 2009250 - RNA, 23 nt, Homo sapiens
uggcccucaguuucccuaucucg

SEQ ID NO: 2009251 - RNA, 23 nt, Homo sapiens
uuacuggugcagaugguugacau

SEQ ID NO: 2009252 - RNA, 18 nt, Homo sapiens
ucuagauuauaaacugac

SEQ ID NO: 2009253 - RNA, 13 nt, Homo sapiens
ucaggucccacua

SEQ ID NO: 2009254 - RNA, 16 nt, Homo sapiens
guaaggaggagaaaau

SEQ ID NO: 2009255 - RNA, 17 nt, Homo sapiens
cacuggagcugcacugc

SEQ ID NO: 2009256 - RNA, 21 nt, Homo sapiens
acccugaaugguuccaugccu

SEQ ID NO: 2009257 - RNA, 18 nt, Homo sapiens
uauaaauuugaaauccaa

SEQ ID NO: 2009258 - RNA, 19 nt, Homo sapiens
uuccauuugugugugugca

SEQ ID NO: 2009259 - RNA, 14 nt, Homo sapiens
gaggcagaaccagc

SEQ ID NO: 2009260 - RNA, 17 nt, Homo sapiens
acucuagagagccuuaa

SEQ ID NO: 2009261 - RNA, 19 nt, Homo sapiens
acuuuaaagauaagucuac

SEQ ID NO: 2009262 - RNA, 20 nt, Homo sapiens
aacccaccaucuacccacuu

SEQ ID NO: 2009263 - RNA, 12 nt, Homo sapiens
ccugauggcacc

SEQ ID NO: 2009264 - RNA, 16 nt, Homo sapiens
cguaagaccaccuucc

SEQ ID NO: 2009265 - RNA, 21 nt, Homo sapiens
ccuguguauggugaccucucc

SEQ ID NO: 2009266 - RNA, 14 nt, Homo sapiens
augaacuauugccu

SEQ ID NO: 2009267 - RNA, 19 nt, Homo sapiens
ucccauaagcuaagccuua

SEQ ID NO: 2009268 - RNA, 17 nt, Homo sapiens
uccacugugcacaccca

SEQ ID NO: 2009269 - RNA, 16 nt, Homo sapiens
uaaccaggauggucuc

SEQ ID NO: 2009270 - RNA, 14 nt, Homo sapiens
gaaaauuaauuccu

SEQ ID NO: 2009271 - RNA, 23 nt, Homo sapiens
cccaggagcugaggauaaagggc

SEQ ID NO: 2009272 - RNA, 19 nt, Homo sapiens
ucucauuugggcaccuuaa

SEQ ID NO: 2009273 - RNA, 16 nt, Homo sapiens
cacugcagaagacagu

SEQ ID NO: 2009274 - RNA, 20 nt, Homo sapiens
cucccagguucccccagcaa

SEQ ID NO: 2009275 - RNA, 19 nt, Homo sapiens
ggacagucaccucauggaa

SEQ ID NO: 2009276 - RNA, 14 nt, Homo sapiens
uauauauguagcca

SEQ ID NO: 2009277 - RNA, 15 nt, Homo sapiens
acaggcucugaccag

SEQ ID NO: 2009278 - RNA, 19 nt, Homo sapiens
uuuauggcucacuaugaau

SEQ ID NO: 2009279 - RNA, 22 nt, Homo sapiens
ugagagcauugggauaucuccu

SEQ ID NO: 2009280 - RNA, 16 nt, Homo sapiens
cuuuccuuucaauaaa

SEQ ID NO: 2009281 - RNA, 21 nt, Homo sapiens
uggcuuuugcggccaguauua

SEQ ID NO: 2009282 - RNA, 16 nt, Homo sapiens
uauuucaggauugcca

SEQ ID NO: 2009283 - RNA, 21 nt, Homo sapiens
accaagggggaugacauguga

SEQ ID NO: 2009284 - RNA, 22 nt, Homo sapiens
accgugcucauugcuaaccacu

SEQ ID NO: 2009285 - RNA, 14 nt, Homo sapiens
ucaaggugcucaau

SEQ ID NO: 2009286 - RNA, 20 nt, Homo sapiens
aauaaugcugcaaacuuaau

SEQ ID NO: 2009287 - RNA, 16 nt, Homo sapiens
uagaacuuugugccag

SEQ ID NO: 2009288 - RNA, 20 nt, Homo sapiens
cuuggggcggaacucacugc

SEQ ID NO: 2009289 - RNA, 14 nt, Homo sapiens
uaaaaaaacagcuu

SEQ ID NO: 2009290 - RNA, 15 nt, Homo sapiens
cuggucuucacugcc

SEQ ID NO: 2009291 - RNA, 18 nt, Homo sapiens
agucucucccgauaucac

SEQ ID NO: 2009292 - RNA, 19 nt, Homo sapiens
agcuaccuguggugauguu

SEQ ID NO: 2009293 - RNA, 17 nt, Homo sapiens
auuuagaacgacauguu

SEQ ID NO: 2009294 - RNA, 18 nt, Homo sapiens
uuuaaaacgcaugugcag

SEQ ID NO: 2009295 - RNA, 23 nt, Homo sapiens
cuccugacauuaagacacaccuc

SEQ ID NO: 2009296 - RNA, 16 nt, Homo sapiens
ugcucccugacugggg

SEQ ID NO: 2009297 - RNA, 13 nt, Homo sapiens
cuauacagccaua

SEQ ID NO: 2009298 - RNA, 12 nt, Homo sapiens
cauccagcagug

SEQ ID NO: 2009299 - RNA, 22 nt, Homo sapiens
uccccccaccuaacucaugcca

SEQ ID NO: 2009300 - RNA, 23 nt, Homo sapiens
cuuucugaaauagucaaauacga

SEQ ID NO: 2009301 - RNA, 18 nt, Homo sapiens
cuucauucuguaugugac

SEQ ID NO: 2009302 - RNA, 17 nt, Homo sapiens
uaguggccaucauuucu

SEQ ID NO: 2009303 - RNA, 14 nt, Homo sapiens
ugucuuuaauauaa

SEQ ID NO: 2009304 - RNA, 14 nt, Homo sapiens
uccuuuuuuauucc

SEQ ID NO: 2009305 - RNA, 23 nt, Homo sapiens
uccugaccuauaaccuguaggaa

SEQ ID NO: 2009306 - RNA, 19 nt, Homo sapiens
uuaacucuaucugucauac

SEQ ID NO: 2009307 - RNA, 20 nt, Homo sapiens
guuacaguaaauacacugug

SEQ ID NO: 2009308 - RNA, 20 nt, Homo sapiens
cuagcacuuugggaggccaa

SEQ ID NO: 2009309 - RNA, 18 nt, Homo sapiens
acacuugaccuucugucg

SEQ ID NO: 2009310 - RNA, 18 nt, Homo sapiens
cagccuugcaaauagcca

SEQ ID NO: 2009311 - RNA, 17 nt, Homo sapiens
gucauucuaacugcacu

SEQ ID NO: 2009312 - RNA, 19 nt, Homo sapiens
cucuacuaaaauucaaaaa

SEQ ID NO: 2009313 - RNA, 19 nt, Homo sapiens
uaccauuuuaucuuaucuu

SEQ ID NO: 2009314 - RNA, 17 nt, Homo sapiens
gauacuguugcacgugu

SEQ ID NO: 2009315 - RNA, 22 nt, Homo sapiens
cccaggcccagaccuucuagga

SEQ ID NO: 2009316 - RNA, 21 nt, Homo sapiens
augaggaaaacuguagucucu

SEQ ID NO: 2009317 - RNA, 15 nt, Homo sapiens
cuguaaguccaagcu

SEQ ID NO: 2009318 - RNA, 17 nt, Homo sapiens
aaauaaucaguguuucc

SEQ ID NO: 2009319 - RNA, 16 nt, Homo sapiens
gaggggcggggccagg

SEQ ID NO: 2009320 - RNA, 16 nt, Homo sapiens
aacagaucuugaaauc

SEQ ID NO: 2009321 - RNA, 20 nt, Homo sapiens
uuuggacuauguaaaccaca

SEQ ID NO: 2009322 - RNA, 18 nt, Homo sapiens
acuggggagucuuugugg

SEQ ID NO: 2009323 - RNA, 21 nt, Homo sapiens
cccuaaucacaugugcugcaa

SEQ ID NO: 2009324 - RNA, 21 nt, Homo sapiens
agcaggguauggccagcuuua

SEQ ID NO: 2009325 - RNA, 14 nt, Homo sapiens
auguauucuguucu

SEQ ID NO: 2009326 - RNA, 20 nt, Homo sapiens
acacaagugcgccuugcaaa

SEQ ID NO: 2009327 - RNA, 17 nt, Homo sapiens
agagggaccauguguca

SEQ ID NO: 2009328 - RNA, 15 nt, Homo sapiens
uauucugugcuguua

SEQ ID NO: 2009329 - RNA, 17 nt, Homo sapiens
gaccuuuuauccacuua

SEQ ID NO: 2009330 - RNA, 23 nt, Homo sapiens
auuuguuccugccacuguguacu

SEQ ID NO: 2009331 - RNA, 23 nt, Homo sapiens
cuuauggauguccccagcagaga

SEQ ID NO: 2009332 - RNA, 17 nt, Homo sapiens
cacucugucaccaggcu

SEQ ID NO: 2009333 - RNA, 15 nt, Homo sapiens
acuacauauuugcac

SEQ ID NO: 2009334 - RNA, 22 nt, Homo sapiens
caaaugauuucauauugaucuu

SEQ ID NO: 2009335 - RNA, 14 nt, Homo sapiens
cuucucccauuucc

SEQ ID NO: 2009336 - RNA, 14 nt, Homo sapiens
acacuuccccaucu

SEQ ID NO: 2009337 - RNA, 17 nt, Homo sapiens
agggauauuuaacugga

SEQ ID NO: 2009338 - RNA, 14 nt, Homo sapiens
aggaaucaucuccu

SEQ ID NO: 2009339 - RNA, 14 nt, Homo sapiens
aacuaaacacguga

SEQ ID NO: 2009340 - RNA, 15 nt, Homo sapiens
cccucgugcacacac

SEQ ID NO: 2009341 - RNA, 17 nt, Homo sapiens
ugccaaaaagcauacaa

SEQ ID NO: 2009342 - RNA, 15 nt, Homo sapiens
auauuucaaacauca

SEQ ID NO: 2009343 - RNA, 19 nt, Homo sapiens
cacguucuggacugucuuc

SEQ ID NO: 2009344 - RNA, 14 nt, Homo sapiens
gacccaaguagcug

SEQ ID NO: 2009345 - RNA, 20 nt, Homo sapiens
acaguuagcauggcuucaca

SEQ ID NO: 2009346 - RNA, 16 nt, Homo sapiens
uuuguaagcaauucua

SEQ ID NO: 2009347 - RNA, 21 nt, Homo sapiens
ccagaccccaaaccagcccuu

SEQ ID NO: 2009348 - RNA, 12 nt, Homo sapiens
acaacagugcua

SEQ ID NO: 2009349 - RNA, 14 nt, Homo sapiens
aaaauauaaaugca

SEQ ID NO: 2009350 - RNA, 18 nt, Homo sapiens
gacucuggauuuggugcu

SEQ ID NO: 2009351 - RNA, 23 nt, Homo sapiens
ugaugaaaagcagcuauuugccu

SEQ ID NO: 2009352 - RNA, 14 nt, Homo sapiens
uagaaugcauguaa

SEQ ID NO: 2009353 - RNA, 18 nt, Homo sapiens
gcauuuucuguuccaggu

SEQ ID NO: 2009354 - RNA, 20 nt, Homo sapiens
acuuaacaaaacaagugcaa

SEQ ID NO: 2009355 - RNA, 17 nt, Homo sapiens
auuggguuccauucuca

SEQ ID NO: 2009356 - RNA, 13 nt, Homo sapiens
uguauugagcaag

SEQ ID NO: 2009357 - RNA, 21 nt, Homo sapiens
ucaucaacaaagaaauauuau

SEQ ID NO: 2009358 - RNA, 16 nt, Homo sapiens
ggacgcuuccagacca

SEQ ID NO: 2009359 - RNA, 12 nt, Homo sapiens
gaguuuugcccc

SEQ ID NO: 2009360 - RNA, 21 nt, Homo sapiens
aggaaagagagaccccaguca

SEQ ID NO: 2009361 - RNA, 19 nt, Homo sapiens
caggugcuacaacauguga

SEQ ID NO: 2009362 - RNA, 14 nt, Homo sapiens
ugacggacucagac

SEQ ID NO: 2009363 - RNA, 14 nt, Homo sapiens
caaugugcacuuca

SEQ ID NO: 2009364 - RNA, 16 nt, Homo sapiens
uuaaacauuacuguuu

SEQ ID NO: 2009365 - RNA, 14 nt, Homo sapiens
ucaguuguacagug

SEQ ID NO: 2009366 - RNA, 19 nt, Homo sapiens
uucuguugcgccacugaga

SEQ ID NO: 2009367 - RNA, 14 nt, Homo sapiens
acaaucccaccuag

SEQ ID NO: 2009368 - RNA, 14 nt, Homo sapiens
aagcauugugagua

SEQ ID NO: 2009369 - RNA, 21 nt, Homo sapiens
aaagucagagacagauaccuc

SEQ ID NO: 2009370 - RNA, 13 nt, Homo sapiens
aguuccagcuuuu

SEQ ID NO: 2009371 - RNA, 12 nt, Homo sapiens
aaaaauggucaa

SEQ ID NO: 2009372 - RNA, 19 nt, Homo sapiens
cauagcgcuggcucaggaa

SEQ ID NO: 2009373 - RNA, 16 nt, Homo sapiens
cagagcuggaaggcag

SEQ ID NO: 2009374 - RNA, 12 nt, Homo sapiens
uaaaacucgcuu

SEQ ID NO: 2009375 - RNA, 12 nt, Homo sapiens
ugaaacuugaaa

SEQ ID NO: 2009376 - RNA, 12 nt, Homo sapiens
gaauacuuugau

SEQ ID NO: 2009377 - RNA, 12 nt, Homo sapiens
aagcagcugcag

SEQ ID NO: 2009378 - RNA, 15 nt, Homo sapiens
caguuauuucaaaaa

SEQ ID NO: 2009379 - RNA, 20 nt, Homo sapiens
uucuuagauacacuaaaaau

SEQ ID NO: 2009380 - RNA, 20 nt, Homo sapiens
aagacauugacagcaauuca

SEQ ID NO: 2009381 - RNA, 16 nt, Homo sapiens
aagacaacauuucuca

SEQ ID NO: 2009382 - RNA, 21 nt, Homo sapiens
guccaagccccccacaccuuu

SEQ ID NO: 2009383 - RNA, 21 nt, Homo sapiens
aaaucaugaaacuuguuucac

SEQ ID NO: 2009384 - RNA, 17 nt, Homo sapiens
agcauauauacuugcaa

SEQ ID NO: 2009385 - RNA, 14 nt, Homo sapiens
gaagacccagugua

SEQ ID NO: 2009386 - RNA, 15 nt, Homo sapiens
uugcucacagcugau

SEQ ID NO: 2009387 - RNA, 17 nt, Homo sapiens
uacauuucccugugcug

SEQ ID NO: 2009388 - RNA, 20 nt, Homo sapiens
aaauaauuuuauuaugcaac

SEQ ID NO: 2009389 - RNA, 22 nt, Homo sapiens
auguuuguaaauuaauacuuca

SEQ ID NO: 2009390 - RNA, 21 nt, Homo sapiens
agaaauauucuacacauaucu

SEQ ID NO: 2009391 - RNA, 22 nt, Homo sapiens
ucucucacucucuuccuuucau

SEQ ID NO: 2009392 - RNA, 12 nt, Homo sapiens
gaacuguucaca

SEQ ID NO: 2009393 - RNA, 20 nt, Homo sapiens
cugcgcccugugcagggaaa

SEQ ID NO: 2009394 - RNA, 19 nt, Homo sapiens
ucaggauucuguuccuuag

SEQ ID NO: 2009395 - RNA, 15 nt, Homo sapiens
ucauugcacuuuccu

SEQ ID NO: 2009396 - RNA, 15 nt, Homo sapiens
ucugugcacuagccu

SEQ ID NO: 2009397 - RNA, 23 nt, Homo sapiens
ucccucucaugucccuccaggga

SEQ ID NO: 2009398 - RNA, 14 nt, Homo sapiens
ugacuuugaauuua

SEQ ID NO: 2009399 - RNA, 17 nt, Homo sapiens
caucuaaucuaugcaug

SEQ ID NO: 2009400 - RNA, 19 nt, Homo sapiens
auuuaaauagaacuugauu

SEQ ID NO: 2009401 - RNA, 23 nt, Homo sapiens
uuugucaguguagaucaacucau

SEQ ID NO: 2009402 - RNA, 18 nt, Homo sapiens
ucuguagcaccuugcaua

SEQ ID NO: 2009403 - RNA, 14 nt, Homo sapiens
cugcacagauggau

SEQ ID NO: 2009404 - RNA, 22 nt, Homo sapiens
caaccaagaauguuaugugcaa

SEQ ID NO: 2009405 - RNA, 21 nt, Homo sapiens
ugaaauucugaauuugcaaag

SEQ ID NO: 2009406 - RNA, 17 nt, Homo sapiens
cuauuuuguuggaugac

SEQ ID NO: 2009407 - RNA, 18 nt, Homo sapiens
gcugaacauaacuucuca

SEQ ID NO: 2009408 - RNA, 19 nt, Homo sapiens
aaggacagcuacacgcuga

SEQ ID NO: 2009409 - RNA, 15 nt, Homo sapiens
aagacacacgaugcu

SEQ ID NO: 2009410 - RNA, 16 nt, Homo sapiens
agaucacauauucuag

SEQ ID NO: 2009411 - RNA, 15 nt, Homo sapiens
gcuuugagcaacuaa

SEQ ID NO: 2009412 - RNA, 17 nt, Homo sapiens
uucugcugaugcuacug

SEQ ID NO: 2009413 - RNA, 18 nt, Homo sapiens
ccuuucuccuuuguacuu

SEQ ID NO: 2009414 - RNA, 19 nt, Homo sapiens
auuuccuuuuugacacuga

SEQ ID NO: 2009415 - RNA, 18 nt, Homo sapiens
ggguaggccuuggcccac

SEQ ID NO: 2009416 - RNA, 12 nt, Homo sapiens
agucaaaccacu

SEQ ID NO: 2009417 - RNA, 18 nt, Homo sapiens
aacuuuguagacauuuug

SEQ ID NO: 2009418 - RNA, 13 nt, Homo sapiens
cacuugcucaaaa

SEQ ID NO: 2009419 - RNA, 16 nt, Homo sapiens
aggcacuguucaucuc

SEQ ID NO: 2009420 - RNA, 21 nt, Homo sapiens
ugggacauuugcucauggaau

SEQ ID NO: 2009421 - RNA, 23 nt, Homo sapiens
agucccucccccagcccugucau

SEQ ID NO: 2009422 - RNA, 21 nt, Homo sapiens
gcugcacaucacaacauuuac

SEQ ID NO: 2009423 - RNA, 22 nt, Homo sapiens
guaucugaguugccaagacaaa

SEQ ID NO: 2009424 - RNA, 14 nt, Homo sapiens
gcacaaagaugugc

SEQ ID NO: 2009425 - RNA, 15 nt, Homo sapiens
uuugguugcaauugu

SEQ ID NO: 2009426 - RNA, 16 nt, Homo sapiens
uggucagaugcagguu

SEQ ID NO: 2009427 - RNA, 21 nt, Homo sapiens
gaaacugaggccauuauuuca

SEQ ID NO: 2009428 - RNA, 14 nt, Homo sapiens
uauauauauuuugg

SEQ ID NO: 2009429 - RNA, 20 nt, Homo sapiens
ggguuucaccauguugccca

SEQ ID NO: 2009430 - RNA, 17 nt, Homo sapiens
gcuaugucaggcuuuca

SEQ ID NO: 2009431 - RNA, 20 nt, Homo sapiens
aagguguucaaacacaaccu

SEQ ID NO: 2009432 - RNA, 17 nt, Homo sapiens
ucauucaauaucugaca

SEQ ID NO: 2009433 - RNA, 21 nt, Homo sapiens
uuggauaauaacuagaucucc

SEQ ID NO: 2009434 - RNA, 19 nt, Homo sapiens
aaaaggguguugcuaagcu

SEQ ID NO: 2009435 - RNA, 14 nt, Homo sapiens
gagaggaugugcaa

SEQ ID NO: 2009436 - RNA, 23 nt, Homo sapiens
ccuguuccccagagaaaggggag

SEQ ID NO: 2009437 - RNA, 20 nt, Homo sapiens
ugcccaucagggcccaggga

SEQ ID NO: 2009438 - RNA, 18 nt, Homo sapiens
ccuaauuccacagcugcu

SEQ ID NO: 2009439 - RNA, 20 nt, Homo sapiens
aguggaguuuuauaaauuaa

SEQ ID NO: 2009440 - RNA, 14 nt, Homo sapiens
cccugccacucuca

SEQ ID NO: 2009441 - RNA, 21 nt, Homo sapiens
aauuuuuacuuagauacuaau

SEQ ID NO: 2009442 - RNA, 12 nt, Homo sapiens
ccucucuugccc

SEQ ID NO: 2009443 - RNA, 12 nt, Homo sapiens
cuucucuugucc

SEQ ID NO: 2009444 - RNA, 12 nt, Homo sapiens
ggugauggccag

SEQ ID NO: 2009445 - RNA, 13 nt, Homo sapiens
cauggaauuaccu

SEQ ID NO: 2009446 - RNA, 23 nt, Homo sapiens
ucccagcacuuugggaggccaag

SEQ ID NO: 2009447 - RNA, 13 nt, Homo sapiens
guagagccagcuu

SEQ ID NO: 2009448 - RNA, 14 nt, Homo sapiens
ccuccaacacaagg

SEQ ID NO: 2009449 - RNA, 14 nt, Homo sapiens
cccacccuggaaug

SEQ ID NO: 2009450 - RNA, 16 nt, Homo sapiens
agacuguggaacuauu

SEQ ID NO: 2009451 - RNA, 14 nt, Homo sapiens
gagcaggcugugag

SEQ ID NO: 2009452 - RNA, 17 nt, Homo sapiens
cauguaugucuuggaca

SEQ ID NO: 2009453 - RNA, 17 nt, Homo sapiens
ccaauuagucacugcug

SEQ ID NO: 2009454 - RNA, 21 nt, Homo sapiens
uucagcauccgcaggugcugg

SEQ ID NO: 2009455 - RNA, 23 nt, Homo sapiens
aaagccauauuccagcagugaaa

SEQ ID NO: 2009456 - RNA, 21 nt, Homo sapiens
cucgcacaccucugcaccuuu

SEQ ID NO: 2009457 - RNA, 21 nt, Homo sapiens
cccagaaugagacauccagca

SEQ ID NO: 2009458 - RNA, 11 nt, Homo sapiens
aaaaugcaaua

SEQ ID NO: 2009459 - RNA, 16 nt, Homo sapiens
uucaggagaaugugca

SEQ ID NO: 2009460 - RNA, 13 nt, Homo sapiens
uugcacacccacu

SEQ ID NO: 2009461 - RNA, 22 nt, Homo sapiens
cucuuauauuaggacuaaggaa

SEQ ID NO: 2009462 - RNA, 17 nt, Homo sapiens
cacagccaacgagacac

SEQ ID NO: 2009463 - RNA, 19 nt, Homo sapiens
auuuugccacugccuuuca

SEQ ID NO: 2009464 - RNA, 15 nt, Homo sapiens
augugauuugucuuc

SEQ ID NO: 2009465 - RNA, 17 nt, Homo sapiens
cauccccaccacugaua

SEQ ID NO: 2009466 - RNA, 23 nt, Homo sapiens
ucccaaccuccccugguccugca

SEQ ID NO: 2009467 - RNA, 19 nt, Homo sapiens
cuuggaguaaaacuguaua

SEQ ID NO: 2009468 - RNA, 13 nt, Homo sapiens
guggucgguggga

SEQ ID NO: 2009469 - RNA, 15 nt, Homo sapiens
ugcuguguaucugau

SEQ ID NO: 2009470 - RNA, 17 nt, Homo sapiens
gugcuucgacuacugcu

SEQ ID NO: 2009471 - RNA, 13 nt, Homo sapiens
ugaauaacuaaga

SEQ ID NO: 2009472 - RNA, 12 nt, Homo sapiens
aguuucuuccau

SEQ ID NO: 2009473 - RNA, 21 nt, Homo sapiens
acaacuuccacuccaagugag

SEQ ID NO: 2009474 - RNA, 13 nt, Homo sapiens
gcccccaucaccu

SEQ ID NO: 2009475 - RNA, 18 nt, Homo sapiens
ugaaaaauguaaauacuc

SEQ ID NO: 2009476 - RNA, 18 nt, Homo sapiens
gauuccaggcgaugugca

SEQ ID NO: 2009477 - RNA, 15 nt, Homo sapiens
aagcacuagaucucc

SEQ ID NO: 2009478 - RNA, 22 nt, Homo sapiens
ggcaucaaaaaagauagaucua

SEQ ID NO: 2009479 - RNA, 15 nt, Homo sapiens
uuccuggcugaugau

SEQ ID NO: 2009480 - RNA, 14 nt, Homo sapiens
agcuccacugccau

SEQ ID NO: 2009481 - RNA, 19 nt, Homo sapiens
ccucucucuucugcuccac

SEQ ID NO: 2009482 - RNA, 15 nt, Homo sapiens
aauggcauagcugga

SEQ ID NO: 2009483 - RNA, 14 nt, Homo sapiens
aaggggacauucca

SEQ ID NO: 2009484 - RNA, 22 nt, Homo sapiens
uaaacaaucagaccacauuuga

SEQ ID NO: 2009485 - RNA, 23 nt, Homo sapiens
cuucgggaagagaggaguucaau

SEQ ID NO: 2009486 - RNA, 13 nt, Homo sapiens
cucgucucaaaaa

SEQ ID NO: 2009487 - RNA, 16 nt, Homo sapiens
ucugccccacccucaa

SEQ ID NO: 2009488 - RNA, 14 nt, Homo sapiens
acacaugcauggca

SEQ ID NO: 2009489 - RNA, 22 nt, Homo sapiens
agaauaaguuuuauguucugcu

SEQ ID NO: 2009490 - RNA, 20 nt, Homo sapiens
aggccgggcgcgguggcuca

SEQ ID NO: 2009491 - RNA, 22 nt, Homo sapiens
agagguuggagcaggaugaggg

SEQ ID NO: 2009492 - RNA, 19 nt, Homo sapiens
guggagguugcugguacac

SEQ ID NO: 2009493 - RNA, 20 nt, Homo sapiens
guccuugggccuggccaguc

SEQ ID NO: 2009494 - RNA, 20 nt, Homo sapiens
agccccuuacuaugaucuca

SEQ ID NO: 2009495 - RNA, 15 nt, Homo sapiens
accacucucaggacc

SEQ ID NO: 2009496 - RNA, 16 nt, Homo sapiens
aggacaggaggcggcc

SEQ ID NO: 2009497 - RNA, 22 nt, Homo sapiens
acuuucccugacagcuguguac

SEQ ID NO: 2009498 - RNA, 13 nt, Homo sapiens
caaaaugcagcuu

SEQ ID NO: 2009499 - RNA, 14 nt, Homo sapiens
uuucacaauuccau

SEQ ID NO: 2009500 - RNA, 22 nt, Homo sapiens
gagcugcgcccuggauccucac

SEQ ID NO: 2009501 - RNA, 14 nt, Homo sapiens
uggaugcucgccau

SEQ ID NO: 2009502 - RNA, 17 nt, Homo sapiens
aguuggacuuguuuuaa

SEQ ID NO: 2009503 - RNA, 20 nt, Homo sapiens
caggccucucucugcuccau

SEQ ID NO: 2009504 - RNA, 12 nt, Homo sapiens
ccucauccuuuc

SEQ ID NO: 2009505 - RNA, 15 nt, Homo sapiens
aagcaggccuuuuga

SEQ ID NO: 2009506 - RNA, 17 nt, Homo sapiens
cuggggugggcaguuuu

SEQ ID NO: 2009507 - RNA, 12 nt, Homo sapiens
augcauacacuc

SEQ ID NO: 2009508 - RNA, 23 nt, Homo sapiens
cauccaaggcuguuaccauuuua

SEQ ID NO: 2009509 - RNA, 13 nt, Homo sapiens
acacugaugcaag

SEQ ID NO: 2009510 - RNA, 16 nt, Homo sapiens
caucaugaugaugaua

SEQ ID NO: 2009511 - RNA, 19 nt, Homo sapiens
caauuuguaauugcuuaca

SEQ ID NO: 2009512 - RNA, 16 nt, Homo sapiens
cgucagaccaguacug

SEQ ID NO: 2009513 - RNA, 22 nt, Homo sapiens
uuuaaaauaaaaaagcaaaaac

SEQ ID NO: 2009514 - RNA, 12 nt, Homo sapiens
uugcacauuaau

SEQ ID NO: 2009515 - RNA, 12 nt, Homo sapiens
aaauacauaugc

SEQ ID NO: 2009516 - RNA, 12 nt, Homo sapiens
aauuagugucau

SEQ ID NO: 2009517 - RNA, 20 nt, Homo sapiens
ucaccaaguguggaauugga

SEQ ID NO: 2009518 - RNA, 12 nt, Homo sapiens
acauaaacacuu

SEQ ID NO: 2009519 - RNA, 18 nt, Homo sapiens
ccuccugguaacagcuau

SEQ ID NO: 2009520 - RNA, 12 nt, Homo sapiens
ucuggggguccu

SEQ ID NO: 2009521 - RNA, 18 nt, Homo sapiens
aaguacugcaugaucuua

SEQ ID NO: 2009522 - RNA, 22 nt, Homo sapiens
gaagguagcccagcacugugaa

SEQ ID NO: 2009523 - RNA, 19 nt, Homo sapiens
ucuuugacguggagcugcu

SEQ ID NO: 2009524 - RNA, 19 nt, Homo sapiens
aaccccaucucuacugaaa

SEQ ID NO: 2009525 - RNA, 16 nt, Homo sapiens
cucccuggaucagaac

SEQ ID NO: 2009526 - RNA, 15 nt, Homo sapiens
accaccuuucacaaa

SEQ ID NO: 2009527 - RNA, 15 nt, Homo sapiens
gaguuugucauuaua

SEQ ID NO: 2009528 - RNA, 21 nt, Homo sapiens
accuuccuccugcagacaccu

SEQ ID NO: 2009529 - RNA, 16 nt, Homo sapiens
guuacugggcccugag

SEQ ID NO: 2009530 - RNA, 14 nt, Homo sapiens
aggguuacaaaucu

SEQ ID NO: 2009531 - RNA, 16 nt, Homo sapiens
aggucgccagugacuu

SEQ ID NO: 2009532 - RNA, 13 nt, Homo sapiens
ccaggcacaggca

SEQ ID NO: 2009533 - RNA, 11 nt, Homo sapiens
uaaaacuguga

SEQ ID NO: 2009534 - RNA, 14 nt, Homo sapiens
uaacacaugcacac

SEQ ID NO: 2009535 - RNA, 18 nt, Homo sapiens
agagucacuugaugugcc

SEQ ID NO: 2009536 - RNA, 19 nt, Homo sapiens
aacacagugcuauuugcau

SEQ ID NO: 2009537 - RNA, 21 nt, Homo sapiens
ggauuacaggugugggccacu

SEQ ID NO: 2009538 - RNA, 20 nt, Homo sapiens
ugaucgauguuaaacgucac

SEQ ID NO: 2009539 - RNA, 12 nt, Homo sapiens
cacauuacauga

SEQ ID NO: 2009540 - RNA, 16 nt, Homo sapiens
uucagcuucagacuuu

SEQ ID NO: 2009541 - RNA, 21 nt, Homo sapiens
caaagaacggugauguaguau

SEQ ID NO: 2009542 - RNA, 17 nt, Homo sapiens
aguuucauaccaaauau

SEQ ID NO: 2009543 - RNA, 15 nt, Homo sapiens
uuaaaauaacuucaa

SEQ ID NO: 2009544 - RNA, 21 nt, Homo sapiens
aagacagucuucuaauuccuc

SEQ ID NO: 2009545 - RNA, 23 nt, Homo sapiens
cuagauuaguaguaaaugcuuga

SEQ ID NO: 2009546 - RNA, 21 nt, Homo sapiens
caaguaucuaaauuuggaacu

SEQ ID NO: 2009547 - RNA, 22 nt, Homo sapiens
uuccccacccaguucuucauuu

SEQ ID NO: 2009548 - RNA, 12 nt, Homo sapiens
auuggcagcaga

SEQ ID NO: 2009549 - RNA, 14 nt, Homo sapiens
ucugccagaccuua

SEQ ID NO: 2009550 - RNA, 16 nt, Homo sapiens
agccuggaguuugaga

SEQ ID NO: 2009551 - RNA, 13 nt, Homo sapiens
uugucaaugcauc

SEQ ID NO: 2009552 - RNA, 13 nt, Homo sapiens
uuguuaaugcauu

SEQ ID NO: 2009553 - RNA, 15 nt, Homo sapiens
cagaaucccuuaaca

SEQ ID NO: 2009554 - RNA, 22 nt, Homo sapiens
cugacccuaaauguggacauca

SEQ ID NO: 2009555 - RNA, 14 nt, Homo sapiens
cuauuuucccaugc

SEQ ID NO: 2009556 - RNA, 14 nt, Homo sapiens
acauuuucauaugc

SEQ ID NO: 2009557 - RNA, 21 nt, Homo sapiens
gcagaugagcagucacacugu

SEQ ID NO: 2009558 - RNA, 21 nt, Homo sapiens
acaccuguaaucccagcacuu

SEQ ID NO: 2009559 - RNA, 18 nt, Homo sapiens
aggcagacaggaaggaag

SEQ ID NO: 2009560 - RNA, 18 nt, Homo sapiens
auuaagagguaagacuua

SEQ ID NO: 2009561 - RNA, 19 nt, Homo sapiens
ucuagaacuuaaguuugau

SEQ ID NO: 2009562 - RNA, 22 nt, Homo sapiens
uggccaggagggcccaggguca

SEQ ID NO: 2009563 - RNA, 14 nt, Homo sapiens
caggggccugcaga

SEQ ID NO: 2009564 - RNA, 15 nt, Homo sapiens
ccgacccccuuucua

SEQ ID NO: 2009565 - RNA, 21 nt, Homo sapiens
ccaaguuguucgggccaagga

SEQ ID NO: 2009566 - RNA, 22 nt, Homo sapiens
uucgacuucuuuccaugggcgu

SEQ ID NO: 2009567 - RNA, 18 nt, Homo sapiens
gcucucccucacaccucc

SEQ ID NO: 2009568 - RNA, 15 nt, Homo sapiens
aacuucaugcugucu

SEQ ID NO: 2009569 - RNA, 21 nt, Homo sapiens
accaacugcacaaucaguuua

SEQ ID NO: 2009570 - RNA, 12 nt, Homo sapiens
gaggaagggaca

SEQ ID NO: 2009571 - RNA, 11 nt, Homo sapiens
ccuuguuucaa

SEQ ID NO: 2009572 - RNA, 16 nt, Homo sapiens
uugagauccagugcag

SEQ ID NO: 2009573 - RNA, 23 nt, Homo sapiens
gcaaacccaaaaccucaugacag

SEQ ID NO: 2009574 - RNA, 16 nt, Homo sapiens
ucauuucaaucuuuuc

SEQ ID NO: 2009575 - RNA, 11 nt, Homo sapiens
aauccaaaaaa

SEQ ID NO: 2009576 - RNA, 18 nt, Homo sapiens
aaguucaggcucugagac

SEQ ID NO: 2009577 - RNA, 19 nt, Homo sapiens
auuguugauuuuguucaca

SEQ ID NO: 2009578 - RNA, 19 nt, Homo sapiens
aaggacucccggagccugu

SEQ ID NO: 2009579 - RNA, 20 nt, Homo sapiens
acacagcucuucuccaggcu

SEQ ID NO: 2009580 - RNA, 16 nt, Homo sapiens
uugcauuugcuguugu

SEQ ID NO: 2009581 - RNA, 23 nt, Homo sapiens
ucuuauuuaaugaaagacuguac

SEQ ID NO: 2009582 - RNA, 19 nt, Homo sapiens
gauccucacccgaaucucc

SEQ ID NO: 2009583 - RNA, 14 nt, Homo sapiens
gaaggaauuauucc

SEQ ID NO: 2009584 - RNA, 22 nt, Homo sapiens
agucaagacggauccacaguaa

SEQ ID NO: 2009585 - RNA, 21 nt, Homo sapiens
cagauuugcuguucacccaca

SEQ ID NO: 2009586 - RNA, 17 nt, Homo sapiens
auuccaaaaagcacaua

SEQ ID NO: 2009587 - RNA, 21 nt, Homo sapiens
aguauauuuccgcacuucaga

SEQ ID NO: 2009588 - RNA, 13 nt, Homo sapiens
aggggagacuuug

SEQ ID NO: 2009589 - RNA, 14 nt, Homo sapiens
ccucccaacucuaa

SEQ ID NO: 2009590 - RNA, 15 nt, Homo sapiens
ccaaagcagcugcag

SEQ ID NO: 2009591 - RNA, 17 nt, Homo sapiens
uugccaugugugcugaa

SEQ ID NO: 2009592 - RNA, 17 nt, Homo sapiens
auauuucugauacugcu

SEQ ID NO: 2009593 - RNA, 20 nt, Homo sapiens
gucaggauugcaggugccug

SEQ ID NO: 2009594 - RNA, 17 nt, Homo sapiens
ccaaggccccgagcuca

SEQ ID NO: 2009595 - RNA, 16 nt, Homo sapiens
auggggcagacacaac

SEQ ID NO: 2009596 - RNA, 20 nt, Homo sapiens
cauuugcuggacaaccaaca

SEQ ID NO: 2009597 - RNA, 13 nt, Homo sapiens
uucuaugcauaaa

SEQ ID NO: 2009598 - RNA, 15 nt, Homo sapiens
auaugaagaaucugc

SEQ ID NO: 2009599 - RNA, 22 nt, Homo sapiens
ccaggccuccccgguggccaga

SEQ ID NO: 2009600 - RNA, 20 nt, Homo sapiens
uuggagagagauguuccucu

SEQ ID NO: 2009601 - RNA, 15 nt, Homo sapiens
caggcacuuuagaaa

SEQ ID NO: 2009602 - RNA, 21 nt, Homo sapiens
gcauuuuauaggcauaccucc

SEQ ID NO: 2009603 - RNA, 17 nt, Homo sapiens
aggcuaugugagcacaa

SEQ ID NO: 2009604 - RNA, 19 nt, Homo sapiens
ugcauuagcacagauuuua

SEQ ID NO: 2009605 - RNA, 14 nt, Homo sapiens
ugaaaagcaaagga

SEQ ID NO: 2009606 - RNA, 17 nt, Homo sapiens
guaugugacaccaaagc

SEQ ID NO: 2009607 - RNA, 21 nt, Homo sapiens
gcuaacuuggagccccagugc

SEQ ID NO: 2009608 - RNA, 18 nt, Homo sapiens
ccaaaugaugccacuucc

SEQ ID NO: 2009609 - RNA, 18 nt, Homo sapiens
ugauacuucaggugcuuu

SEQ ID NO: 2009610 - RNA, 19 nt, Homo sapiens
aacugaaguaucugucuca

SEQ ID NO: 2009611 - RNA, 21 nt, Homo sapiens
cauuguuuuguguaacauauu

SEQ ID NO: 2009612 - RNA, 16 nt, Homo sapiens
cauucuacuugcucug

SEQ ID NO: 2009613 - RNA, 16 nt, Homo sapiens
ugggacuggcacuauu

SEQ ID NO: 2009614 - RNA, 14 nt, Homo sapiens
agccuguauagaca

SEQ ID NO: 2009615 - RNA, 20 nt, Homo sapiens
aagacgcucaagaauccucu

SEQ ID NO: 2009616 - RNA, 21 nt, Homo sapiens
ggaccuguuuagagaagccgg

SEQ ID NO: 2009617 - RNA, 22 nt, Homo sapiens
aaugugcuggugaacacuguga

SEQ ID NO: 2009618 - RNA, 20 nt, Homo sapiens
cuaaaguuacaaacagacca

SEQ ID NO: 2009619 - RNA, 17 nt, Homo sapiens
gaacgguaaauuucugu

SEQ ID NO: 2009620 - RNA, 17 nt, Homo sapiens
ggcuucucucucucuuu

SEQ ID NO: 2009621 - RNA, 20 nt, Homo sapiens
uggaaugccaaugucagcau

SEQ ID NO: 2009622 - RNA, 15 nt, Homo sapiens
auugggcgauuuggg

SEQ ID NO: 2009623 - RNA, 16 nt, Homo sapiens
accugaaugcucugua

SEQ ID NO: 2009624 - RNA, 24 nt, Homo sapiens
guacauguacugauuacugccuau

SEQ ID NO: 2009625 - RNA, 19 nt, Homo sapiens
caaaguuuggauuguauca

SEQ ID NO: 2009626 - RNA, 14 nt, Homo sapiens
ucauauguacuugu

SEQ ID NO: 2009627 - RNA, 16 nt, Homo sapiens
ggaaucucauccauca

SEQ ID NO: 2009628 - RNA, 18 nt, Homo sapiens
cagcuuucugugcagaga

SEQ ID NO: 2009629 - RNA, 16 nt, Homo sapiens
ucucaucaguaguuca

SEQ ID NO: 2009630 - RNA, 16 nt, Homo sapiens
uaugagggucagggca

SEQ ID NO: 2009631 - RNA, 13 nt, Homo sapiens
agcccuugggcac

SEQ ID NO: 2009632 - RNA, 19 nt, Homo sapiens
aauuuaugcauuucauuca

SEQ ID NO: 2009633 - RNA, 13 nt, Homo sapiens
ugcagcucaaggg

SEQ ID NO: 2009634 - RNA, 13 nt, Homo sapiens
agggaaauuucaa

SEQ ID NO: 2009635 - RNA, 20 nt, Homo sapiens
aggcagcccugccucugacu

SEQ ID NO: 2009636 - RNA, 18 nt, Homo sapiens
ccuguauucuacagcaga

SEQ ID NO: 2009637 - RNA, 22 nt, Homo sapiens
ugcacauugguuuaagcccaga

SEQ ID NO: 2009638 - RNA, 13 nt, Homo sapiens
aaauuaaauggau

SEQ ID NO: 2009639 - RNA, 14 nt, Homo sapiens
gauggcucguggga

SEQ ID NO: 2009640 - RNA, 20 nt, Homo sapiens
gccucccggguucacgccau

SEQ ID NO: 2009641 - RNA, 14 nt, Homo sapiens
caggugcauagcaa

SEQ ID NO: 2009642 - RNA, 12 nt, Homo sapiens
auguaugaugcu

SEQ ID NO: 2009643 - RNA, 15 nt, Homo sapiens
auccaugcugugcug

SEQ ID NO: 2009644 - RNA, 18 nt, Homo sapiens
ucuaagauggauuaaaca

SEQ ID NO: 2009645 - RNA, 22 nt, Homo sapiens
guaugccaccaacacugcucac

SEQ ID NO: 2009646 - RNA, 13 nt, Homo sapiens
uagcaugaugaaa

SEQ ID NO: 2009647 - RNA, 21 nt, Homo sapiens
uacuguucacacacacaguuu

SEQ ID NO: 2009648 - RNA, 22 nt, Homo sapiens
ugcugaaucaaaucucuuccac

SEQ ID NO: 2009649 - RNA, 23 nt, Homo sapiens
aaaaauaaaguaccacacauauu

SEQ ID NO: 2009650 - RNA, 21 nt, Homo sapiens
auaaaccugggcucagccuga

SEQ ID NO: 2009651 - RNA, 21 nt, Homo sapiens
aaaucagcaauuccccagcgu

SEQ ID NO: 2009652 - RNA, 19 nt, Homo sapiens
gaagaaaaaguacaaugaa

SEQ ID NO: 2009653 - RNA, 19 nt, Homo sapiens
accagggcaccgcagccaa

SEQ ID NO: 2009654 - RNA, 19 nt, Homo sapiens
cugcugccacagacugugg

SEQ ID NO: 2009655 - RNA, 22 nt, Homo sapiens
aauucugaaggggaaaaccuca

SEQ ID NO: 2009656 - RNA, 18 nt, Homo sapiens
agcagggaguacccagug

SEQ ID NO: 2009657 - RNA, 13 nt, Homo sapiens
uuauaacucaugg

SEQ ID NO: 2009658 - RNA, 23 nt, Homo sapiens
caggaguuggaagugugugaucu

SEQ ID NO: 2009659 - RNA, 19 nt, Homo sapiens
caaccaggcuccugugaua

SEQ ID NO: 2009660 - RNA, 19 nt, Homo sapiens
gcuacugaaaggcaguagu

SEQ ID NO: 2009661 - RNA, 15 nt, Homo sapiens
acccucccagucuca

SEQ ID NO: 2009662 - RNA, 16 nt, Homo sapiens
uaauuuaaguacuuga

SEQ ID NO: 2009663 - RNA, 21 nt, Homo sapiens
cacuccagaauccacaaagcc

SEQ ID NO: 2009664 - RNA, 18 nt, Homo sapiens
gcaagcaggaccuggcau

SEQ ID NO: 2009665 - RNA, 18 nt, Homo sapiens
cugguguuugcaaaggau

SEQ ID NO: 2009666 - RNA, 16 nt, Homo sapiens
caggacaaaaugcaga

SEQ ID NO: 2009667 - RNA, 19 nt, Homo sapiens
uagcuuuucccuguccuga

SEQ ID NO: 2009668 - RNA, 18 nt, Homo sapiens
agcccgggcuggcccaag

SEQ ID NO: 2009669 - RNA, 18 nt, Homo sapiens
auuccuuuccucuggccc

SEQ ID NO: 2009670 - RNA, 15 nt, Homo sapiens
gaggagguuucugca

SEQ ID NO: 2009671 - RNA, 13 nt, Homo sapiens
cacccaccagagu

SEQ ID NO: 2009672 - RNA, 17 nt, Homo sapiens
auuugggagacauguga

SEQ ID NO: 2009673 - RNA, 15 nt, Homo sapiens
acaaaggauuugaaa

SEQ ID NO: 2009674 - RNA, 15 nt, Homo sapiens
gugcacggggccagc

SEQ ID NO: 2009675 - RNA, 16 nt, Homo sapiens
accuacaaaaugagau

SEQ ID NO: 2009676 - RNA, 15 nt, Homo sapiens
aaauccaguuuccca

SEQ ID NO: 2009677 - RNA, 15 nt, Homo sapiens
aaacaaaguuuuaaa

SEQ ID NO: 2009678 - RNA, 17 nt, Homo sapiens
cggccugcccagucgac

SEQ ID NO: 2009679 - RNA, 16 nt, Homo sapiens
aagggauaguccaaag

SEQ ID NO: 2009680 - RNA, 16 nt, Homo sapiens
uagcccgcuagcauua

SEQ ID NO: 2009681 - RNA, 13 nt, Homo sapiens
gccaugccaggaa

SEQ ID NO: 2009682 - RNA, 22 nt, Homo sapiens
auccuuacagcuaucuguagaa

SEQ ID NO: 2009683 - RNA, 19 nt, Homo sapiens
gaagaaaucuuucucccuc

SEQ ID NO: 2009684 - RNA, 22 nt, Homo sapiens
cuuuaacccucacacugcucca

SEQ ID NO: 2009685 - RNA, 19 nt, Homo sapiens
cacaccugucugugcagau

SEQ ID NO: 2009686 - RNA, 21 nt, Homo sapiens
ugaagcucuuuacuguaaagg

SEQ ID NO: 2009687 - RNA, 18 nt, Homo sapiens
uccucuuucacuucuuau

SEQ ID NO: 2009688 - RNA, 19 nt, Homo sapiens
augaggaggucccacuugc

SEQ ID NO: 2009689 - RNA, 20 nt, Homo sapiens
caagcaauccaugaucuaua

SEQ ID NO: 2009690 - RNA, 20 nt, Homo sapiens
uccgggcaggggagccaggg

SEQ ID NO: 2009691 - RNA, 12 nt, Homo sapiens
ucuaaaaaccaa

SEQ ID NO: 2009692 - RNA, 12 nt, Homo sapiens
ccagaaaaucug

SEQ ID NO: 2009693 - RNA, 22 nt, Homo sapiens
uuaagacgguuaaauacugugu

SEQ ID NO: 2009694 - RNA, 15 nt, Homo sapiens
uauuucuaaaguaau

SEQ ID NO: 2009695 - RNA, 15 nt, Homo sapiens
augucccaacuugua

SEQ ID NO: 2009696 - RNA, 23 nt, Homo sapiens
aaaagucagagacagauaccucc

SEQ ID NO: 2009697 - RNA, 16 nt, Homo sapiens
uggcagccgugccuuc

SEQ ID NO: 2009698 - RNA, 17 nt, Homo sapiens
agaugcuuuugugagaa

SEQ ID NO: 2009699 - RNA, 15 nt, Homo sapiens
guaaauguaaacuca

SEQ ID NO: 2009700 - RNA, 13 nt, Homo sapiens
uacuuacguguga

SEQ ID NO: 2009701 - RNA, 17 nt, Homo sapiens
ggacucagggacucagg

SEQ ID NO: 2009702 - RNA, 19 nt, Homo sapiens
agcagggauuagguguuca

SEQ ID NO: 2009703 - RNA, 15 nt, Homo sapiens
caugguccccaagac

SEQ ID NO: 2009704 - RNA, 18 nt, Homo sapiens
ucaucuuucuuguuucau

SEQ ID NO: 2009705 - RNA, 16 nt, Homo sapiens
gcuguacuugaugaca

SEQ ID NO: 2009706 - RNA, 17 nt, Homo sapiens
ugucaaacaaagccaga

SEQ ID NO: 2009707 - RNA, 15 nt, Homo sapiens
uguugauuucuugua

SEQ ID NO: 2009708 - RNA, 13 nt, Homo sapiens
ccucuccacagga

SEQ ID NO: 2009709 - RNA, 21 nt, Homo sapiens
cacccuggaggauuucaucuc

SEQ ID NO: 2009710 - RNA, 22 nt, Homo sapiens
gcccguacccagcccugcugca

SEQ ID NO: 2009711 - RNA, 18 nt, Homo sapiens
auucaggcuacucauuca

SEQ ID NO: 2009712 - RNA, 14 nt, Homo sapiens
aagggguucuuugg

SEQ ID NO: 2009713 - RNA, 15 nt, Homo sapiens
uacauauacuuuuau

SEQ ID NO: 2009714 - RNA, 20 nt, Homo sapiens
caguaaaugugauucaccuc

SEQ ID NO: 2009715 - RNA, 14 nt, Homo sapiens
uaucuuuaccuccu

SEQ ID NO: 2009716 - RNA, 16 nt, Homo sapiens
acgauaaaauuacaaa

SEQ ID NO: 2009717 - RNA, 22 nt, Homo sapiens
uaaaccucaguuauuacaugua

SEQ ID NO: 2009718 - RNA, 22 nt, Homo sapiens
auuuuuccucuuucacuucuua

SEQ ID NO: 2009719 - RNA, 18 nt, Homo sapiens
uggaagacagagauggca

SEQ ID NO: 2009720 - RNA, 12 nt, Homo sapiens
aaggucaucuca

SEQ ID NO: 2009721 - RNA, 14 nt, Homo sapiens
aagagaagguuuau

SEQ ID NO: 2009722 - RNA, 11 nt, Homo sapiens
ccccacacccc

SEQ ID NO: 2009723 - RNA, 12 nt, Homo sapiens
ugcuccucaggg

SEQ ID NO: 2009724 - RNA, 17 nt, Homo sapiens
augagcuauccuuucaa

SEQ ID NO: 2009725 - RNA, 14 nt, Homo sapiens
cuucauguugaugu

SEQ ID NO: 2009726 - RNA, 19 nt, Homo sapiens
cuucugaggcgcugcuuug

SEQ ID NO: 2009727 - RNA, 15 nt, Homo sapiens
auuccaacuccugau

SEQ ID NO: 2009728 - RNA, 22 nt, Homo sapiens
ccugagcuuuggugcaucucau

SEQ ID NO: 2009729 - RNA, 12 nt, Homo sapiens
guacuggcacaa

SEQ ID NO: 2009730 - RNA, 17 nt, Homo sapiens
cacuuaagacuguguau

SEQ ID NO: 2009731 - RNA, 23 nt, Homo sapiens
augcuuauauuguucacuucuuu

SEQ ID NO: 2009732 - RNA, 23 nt, Homo sapiens
ccccagccugcucccuagccaga

SEQ ID NO: 2009733 - RNA, 13 nt, Homo sapiens
ccaaauucauccu

SEQ ID NO: 2009734 - RNA, 16 nt, Homo sapiens
ugcgggggagccaguu

SEQ ID NO: 2009735 - RNA, 18 nt, Homo sapiens
agugaaggcaagugcaau

SEQ ID NO: 2009736 - RNA, 20 nt, Homo sapiens
gaucugugccauagaacaag

SEQ ID NO: 2009737 - RNA, 13 nt, Homo sapiens
ucuaagucucaac

SEQ ID NO: 2009738 - RNA, 23 nt, Homo sapiens
guuucaaaaaaucugaccaaaac

SEQ ID NO: 2009739 - RNA, 16 nt, Homo sapiens
ugauguugucacuggu

SEQ ID NO: 2009740 - RNA, 15 nt, Homo sapiens
auagacacuucacca

SEQ ID NO: 2009741 - RNA, 18 nt, Homo sapiens
acucuuuaacacauucuu

SEQ ID NO: 2009742 - RNA, 16 nt, Homo sapiens
auggccaaacccucac

SEQ ID NO: 2009743 - RNA, 14 nt, Homo sapiens
ucucaagacugaaa

SEQ ID NO: 2009744 - RNA, 17 nt, Homo sapiens
uguagauguauuuucaa

SEQ ID NO: 2009745 - RNA, 15 nt, Homo sapiens
auucugcugaugcua

SEQ ID NO: 2009746 - RNA, 18 nt, Homo sapiens
cagaaauugugugugcaa

SEQ ID NO: 2009747 - RNA, 15 nt, Homo sapiens
auaaggauucaggga

SEQ ID NO: 2009748 - RNA, 22 nt, Homo sapiens
gacaacuaucaauucuugagac

SEQ ID NO: 2009749 - RNA, 22 nt, Homo sapiens
gaugggguuucaccauguuggc

SEQ ID NO: 2009750 - RNA, 22 nt, Homo sapiens
aauaauauugccuugauguuuc

SEQ ID NO: 2009751 - RNA, 20 nt, Homo sapiens
cagccuccagagaguaucug

SEQ ID NO: 2009752 - RNA, 15 nt, Homo sapiens
aguccaacaauguug

SEQ ID NO: 2009753 - RNA, 16 nt, Homo sapiens
aucuugcaguuuugua

SEQ ID NO: 2009754 - RNA, 18 nt, Homo sapiens
uaaauuuuuuuuggucaa

SEQ ID NO: 2009755 - RNA, 19 nt, Homo sapiens
caggagagagaaagccagg

SEQ ID NO: 2009756 - RNA, 14 nt, Homo sapiens
ugaggaaaaacuga

SEQ ID NO: 2009757 - RNA, 22 nt, Homo sapiens
uucucuucacagucacauucca

SEQ ID NO: 2009758 - RNA, 21 nt, Homo sapiens
acacaaauauugcuuggacua

SEQ ID NO: 2009759 - RNA, 15 nt, Homo sapiens
guaaccuagugaauu

SEQ ID NO: 2009760 - RNA, 11 nt, Homo sapiens
gagggggcucc

SEQ ID NO: 2009761 - RNA, 15 nt, Homo sapiens
uucuccugucucagc

SEQ ID NO: 2009762 - RNA, 16 nt, Homo sapiens
ugcaccaccaugccag

SEQ ID NO: 2009763 - RNA, 13 nt, Homo sapiens
aggugaugggcug

SEQ ID NO: 2009764 - RNA, 16 nt, Homo sapiens
ccagcugggguccugu

SEQ ID NO: 2009765 - RNA, 13 nt, Homo sapiens
caaaaacuguauu

SEQ ID NO: 2009766 - RNA, 19 nt, Homo sapiens
agaccuuuuaacuccucaa

SEQ ID NO: 2009767 - RNA, 21 nt, Homo sapiens
ccaggagaugcugggccaguu

SEQ ID NO: 2009768 - RNA, 11 nt, Homo sapiens
aaaacuuguaa

SEQ ID NO: 2009769 - RNA, 10 nt, Homo sapiens
acagugcaag

SEQ ID NO: 2009770 - RNA, 16 nt, Homo sapiens
gaccacagacucacau

SEQ ID NO: 2009771 - RNA, 17 nt, Homo sapiens
uucucaauuccaacagu

SEQ ID NO: 2009772 - RNA, 12 nt, Homo sapiens
uccucggcagcu

SEQ ID NO: 2009773 - RNA, 18 nt, Homo sapiens
uggagggcaugaagacag

SEQ ID NO: 2009774 - RNA, 16 nt, Homo sapiens
ccugcugggaagagcu

SEQ ID NO: 2009775 - RNA, 16 nt, Homo sapiens
cuuggcuuuagccaua

SEQ ID NO: 2009776 - RNA, 21 nt, Homo sapiens
aauaaacggacucaguggaca

SEQ ID NO: 2009777 - RNA, 12 nt, Homo sapiens
auauaacugccu

SEQ ID NO: 2009778 - RNA, 19 nt, Homo sapiens
gcccagaauaaacuggcag

SEQ ID NO: 2009779 - RNA, 20 nt, Homo sapiens
ggggucugguuagucgugac

SEQ ID NO: 2009780 - RNA, 19 nt, Homo sapiens
caacuaaaacccccaauaa

SEQ ID NO: 2009781 - RNA, 14 nt, Homo sapiens
uucaugaaucuugc

SEQ ID NO: 2009782 - RNA, 17 nt, Homo sapiens
aggugagaccaaaggau

SEQ ID NO: 2009783 - RNA, 13 nt, Homo sapiens
uggagugucacau

SEQ ID NO: 2009784 - RNA, 22 nt, Homo sapiens
agcuuuucaaaauuggacuuaa

SEQ ID NO: 2009785 - RNA, 20 nt, Homo sapiens
auaaccaguuuuugcagaga

SEQ ID NO: 2009786 - RNA, 16 nt, Homo sapiens
cagcucccugccaaac

SEQ ID NO: 2009787 - RNA, 21 nt, Homo sapiens
aacuaugucgaugcacaguau

SEQ ID NO: 2009788 - RNA, 21 nt, Homo sapiens
aucuguaagagcuugcuccag

SEQ ID NO: 2009789 - RNA, 18 nt, Homo sapiens
gggcucuagggacugcca

SEQ ID NO: 2009790 - RNA, 21 nt, Homo sapiens
ccuggggacuccucaaaccac

SEQ ID NO: 2009791 - RNA, 23 nt, Homo sapiens
uugguagggugaguguuuccacu

SEQ ID NO: 2009792 - RNA, 18 nt, Homo sapiens
ccccaccugccuggugca

SEQ ID NO: 2009793 - RNA, 19 nt, Homo sapiens
ccuaacacggugcucauuu

SEQ ID NO: 2009794 - RNA, 14 nt, Homo sapiens
acggugaaauccag

SEQ ID NO: 2009795 - RNA, 21 nt, Homo sapiens
uaaaacuauuuauugugcugg

SEQ ID NO: 2009796 - RNA, 11 nt, Homo sapiens
aaucagggaca

SEQ ID NO: 2009797 - RNA, 22 nt, Homo sapiens
agagguugcagugagcugagau

SEQ ID NO: 2009798 - RNA, 23 nt, Homo sapiens
aaaaccugaagacugaggacaaa

SEQ ID NO: 2009799 - RNA, 16 nt, Homo sapiens
cacauucaauaagcau

SEQ ID NO: 2009800 - RNA, 21 nt, Homo sapiens
ucugcagcccagccuagucag

SEQ ID NO: 2009801 - RNA, 17 nt, Homo sapiens
ucaacaggucacuugau

SEQ ID NO: 2009802 - RNA, 16 nt, Homo sapiens
cuacuuucucaaaaug

SEQ ID NO: 2009803 - RNA, 16 nt, Homo sapiens
augugaagucaccagu

SEQ ID NO: 2009804 - RNA, 23 nt, Homo sapiens
ucucuagaaggaaacgucuuuau

SEQ ID NO: 2009805 - RNA, 16 nt, Homo sapiens
uauguauuuuuaacua

SEQ ID NO: 2009806 - RNA, 22 nt, Homo sapiens
ugggcuggccagccaccacuga

SEQ ID NO: 2009807 - RNA, 20 nt, Homo sapiens
gacuucaugacaagcauuuu

SEQ ID NO: 2009808 - RNA, 20 nt, Homo sapiens
acuaauuuuuagauauucau

SEQ ID NO: 2009809 - RNA, 16 nt, Homo sapiens
ugaaaugaaugauucu

SEQ ID NO: 2009810 - RNA, 15 nt, Homo sapiens
ggaugaaaucauauu

SEQ ID NO: 2009811 - RNA, 13 nt, Homo sapiens
gcuaaauacugua

SEQ ID NO: 2009812 - RNA, 20 nt, Homo sapiens
aaguuucagauuugccauuc

SEQ ID NO: 2009813 - RNA, 20 nt, Homo sapiens
gagaagccuucagcuccagg

SEQ ID NO: 2009814 - RNA, 12 nt, Homo sapiens
gcccugcuccuc

SEQ ID NO: 2009815 - RNA, 12 nt, Homo sapiens
agguaugggaga

SEQ ID NO: 2009816 - RNA, 13 nt, Homo sapiens
cggagcucagugc

SEQ ID NO: 2009817 - RNA, 22 nt, Homo sapiens
cccugagggacuuggcaguaga

SEQ ID NO: 2009818 - RNA, 16 nt, Homo sapiens
uggaggagguggcuuc

SEQ ID NO: 2009819 - RNA, 14 nt, Homo sapiens
gguauguaacucuu

SEQ ID NO: 2009820 - RNA, 21 nt, Homo sapiens
auuuuucaaugggaagacuca

SEQ ID NO: 2009821 - RNA, 13 nt, Homo sapiens
cauuucaaucuuu

SEQ ID NO: 2009822 - RNA, 24 nt, Homo sapiens
ugcauguagucacuuuauaaguca

SEQ ID NO: 2009823 - RNA, 14 nt, Homo sapiens
gggugcagcugggu

SEQ ID NO: 2009824 - RNA, 22 nt, Homo sapiens
gauugaguucaucaugagccgu

SEQ ID NO: 2009825 - RNA, 14 nt, Homo sapiens
aagcacuguggauc

SEQ ID NO: 2009826 - RNA, 13 nt, Homo sapiens
gucccucuguaua

SEQ ID NO: 2009827 - RNA, 14 nt, Homo sapiens
ugaugaugcaugga

SEQ ID NO: 2009828 - RNA, 14 nt, Homo sapiens
aaaaauaaagggaa

SEQ ID NO: 2009829 - RNA, 17 nt, Homo sapiens
uuaaauuugauuuccau

SEQ ID NO: 2009830 - RNA, 13 nt, Homo sapiens
aacuguguguaca

SEQ ID NO: 2009831 - RNA, 21 nt, Homo sapiens
cauggaacacacgggaagucu

SEQ ID NO: 2009832 - RNA, 14 nt, Homo sapiens
gaagcccacccgcc

SEQ ID NO: 2009833 - RNA, 20 nt, Homo sapiens
agcccucagcccaccugggg

SEQ ID NO: 2009834 - RNA, 17 nt, Homo sapiens
gaauaaauaauucuucc

SEQ ID NO: 2009835 - RNA, 22 nt, Homo sapiens
acagcggcccggcccacgcaga

SEQ ID NO: 2009836 - RNA, 24 nt, Homo sapiens
uagguuguccauuuaugguaccua

SEQ ID NO: 2009837 - RNA, 16 nt, Homo sapiens
cacuguucuguucuca

SEQ ID NO: 2009838 - RNA, 20 nt, Homo sapiens
cacaguacaauaauguacuc

SEQ ID NO: 2009839 - RNA, 19 nt, Homo sapiens
auugcaguuuacaguauuu

SEQ ID NO: 2009840 - RNA, 22 nt, Homo sapiens
caagguccucucaguucucucc

SEQ ID NO: 2009841 - RNA, 13 nt, Homo sapiens
agaggagaaaaag

SEQ ID NO: 2009842 - RNA, 23 nt, Homo sapiens
accugcuggggaccucaccugcu

SEQ ID NO: 2009843 - RNA, 11 nt, Homo sapiens
ugggaauguuc

SEQ ID NO: 2009844 - RNA, 22 nt, Homo sapiens
uaugaaguugcaaugcuucaca

SEQ ID NO: 2009845 - RNA, 21 nt, Homo sapiens
auucucagggcuggagccugg

SEQ ID NO: 2009846 - RNA, 14 nt, Homo sapiens
cucaugccauucca

SEQ ID NO: 2009847 - RNA, 15 nt, Homo sapiens
agacaagucugagua

SEQ ID NO: 2009848 - RNA, 16 nt, Homo sapiens
ugagccuauaucuuca

SEQ ID NO: 2009849 - RNA, 19 nt, Homo sapiens
cacaaaugaagggauauaa

SEQ ID NO: 2009850 - RNA, 12 nt, Homo sapiens
gugugugcugcc

SEQ ID NO: 2009851 - RNA, 17 nt, Homo sapiens
ccaaaggaaggaagcaa

SEQ ID NO: 2009852 - RNA, 17 nt, Homo sapiens
aaaacccucagcacugu

SEQ ID NO: 2009853 - RNA, 15 nt, Homo sapiens
uuggauucacaccca

SEQ ID NO: 2009854 - RNA, 17 nt, Homo sapiens
uaaugauuuuacuuaac

SEQ ID NO: 2009855 - RNA, 16 nt, Homo sapiens
ccauuugugauacuuc

SEQ ID NO: 2009856 - RNA, 22 nt, Homo sapiens
ucugacucccaaagagcugccu

SEQ ID NO: 2009857 - RNA, 11 nt, Homo sapiens
aaaauacacuu

SEQ ID NO: 2009858 - RNA, 21 nt, Homo sapiens
auaaaguauccaugcaugugc

SEQ ID NO: 2009859 - RNA, 12 nt, Homo sapiens
aggaacccucag

SEQ ID NO: 2009860 - RNA, 22 nt, Homo sapiens
cuaagcaaaauugcuaaagaga

SEQ ID NO: 2009861 - RNA, 23 nt, Homo sapiens
auauguagauugccuuuggcaau

SEQ ID NO: 2009862 - RNA, 13 nt, Homo sapiens
uauauuaccaaug

SEQ ID NO: 2009863 - RNA, 12 nt, Homo sapiens
ugaacucuuaga

SEQ ID NO: 2009864 - RNA, 18 nt, Homo sapiens
acauuuauauagacuguu

SEQ ID NO: 2009865 - RNA, 17 nt, Homo sapiens
gaugcugccaaaccugc

SEQ ID NO: 2009866 - RNA, 23 nt, Homo sapiens
auuaaagauugcuuuauccagca

SEQ ID NO: 2009867 - RNA, 12 nt, Homo sapiens
agagccuggaag

SEQ ID NO: 2009868 - RNA, 22 nt, Homo sapiens
aaaacucugggaaauaagagag

SEQ ID NO: 2009869 - RNA, 17 nt, Homo sapiens
agcuuaaaaucugugaa

SEQ ID NO: 2009870 - RNA, 17 nt, Homo sapiens
ccuuggggagcacuugu

SEQ ID NO: 2009871 - RNA, 13 nt, Homo sapiens
caucccaccagcc

SEQ ID NO: 2009872 - RNA, 14 nt, Homo sapiens
caugggaaggggag

SEQ ID NO: 2009873 - RNA, 17 nt, Homo sapiens
cccaguuaccugcacaa

SEQ ID NO: 2009874 - RNA, 17 nt, Homo sapiens
uucaguuauuugcacaa

SEQ ID NO: 2009875 - RNA, 22 nt, Homo sapiens
auuguuuauguguuaugaacau

SEQ ID NO: 2009876 - RNA, 20 nt, Homo sapiens
ggugcugcuuucuuguugcu

SEQ ID NO: 2009877 - RNA, 15 nt, Homo sapiens
agcucagggcuucau

SEQ ID NO: 2009878 - RNA, 17 nt, Homo sapiens
ccuuugaagaaggcaag

SEQ ID NO: 2009879 - RNA, 13 nt, Homo sapiens
accucuaguaaau

SEQ ID NO: 2009880 - RNA, 17 nt, Homo sapiens
aaaucgcauuaaugaaa

SEQ ID NO: 2009881 - RNA, 20 nt, Homo sapiens
cuaucaaguauuauaccuuu

SEQ ID NO: 2009882 - RNA, 19 nt, Homo sapiens
uggcccccggguguaaaua

SEQ ID NO: 2009883 - RNA, 21 nt, Homo sapiens
auuuaggccaugggacaggga

SEQ ID NO: 2009884 - RNA, 21 nt, Homo sapiens
agcuuuggaaguuuagcucug

SEQ ID NO: 2009885 - RNA, 14 nt, Homo sapiens
aaaacacugugcac

SEQ ID NO: 2009886 - RNA, 22 nt, Homo sapiens
caguugaauauauucuauucca

SEQ ID NO: 2009887 - RNA, 14 nt, Homo sapiens
agcccugagccaug

SEQ ID NO: 2009888 - RNA, 17 nt, Homo sapiens
uaccuguauacagugca

SEQ ID NO: 2009889 - RNA, 24 nt, Homo sapiens
caugaugcuaguucuuacgcuuga

SEQ ID NO: 2009890 - RNA, 21 nt, Homo sapiens
cuuauuguuuguaaacaacaa

SEQ ID NO: 2009891 - RNA, 12 nt, Homo sapiens
ugaucauagaau

SEQ ID NO: 2009892 - RNA, 16 nt, Homo sapiens
ccauugugaaccaaug

SEQ ID NO: 2009893 - RNA, 14 nt, Homo sapiens
gcaaaguacaugua

SEQ ID NO: 2009894 - RNA, 24 nt, Homo sapiens
acacugccuagucgggacuuguaa

SEQ ID NO: 2009895 - RNA, 17 nt, Homo sapiens
agaauucuuuccuucau

SEQ ID NO: 2009896 - RNA, 16 nt, Homo sapiens
cacaauguuucuucau

SEQ ID NO: 2009897 - RNA, 19 nt, Homo sapiens
ccugucuaggugccccuga

SEQ ID NO: 2009898 - RNA, 14 nt, Homo sapiens
cuggaggcugacac

SEQ ID NO: 2009899 - RNA, 14 nt, Homo sapiens
aaauccuucuaauc

SEQ ID NO: 2009900 - RNA, 21 nt, Homo sapiens
cuucuuugccuucucuugucc

SEQ ID NO: 2009901 - RNA, 20 nt, Homo sapiens
uggugcuagaagacagacau

SEQ ID NO: 2009902 - RNA, 17 nt, Homo sapiens
gguccuuugagugucag

SEQ ID NO: 2009903 - RNA, 14 nt, Homo sapiens
ccacuaagaauuca

SEQ ID NO: 2009904 - RNA, 14 nt, Homo sapiens
aauuccagccacuc

SEQ ID NO: 2009905 - RNA, 22 nt, Homo sapiens
uuggaagcacuuuuucugcaua

SEQ ID NO: 2009906 - RNA, 18 nt, Homo sapiens
aaguuucauaccaaauau

SEQ ID NO: 2009907 - RNA, 20 nt, Homo sapiens
uuagugcuguaaaucagggu

SEQ ID NO: 2009908 - RNA, 20 nt, Homo sapiens
cugcucccaccaccagugag

SEQ ID NO: 2009909 - RNA, 11 nt, Homo sapiens
uuucugggacc

SEQ ID NO: 2009910 - RNA, 21 nt, Homo sapiens
guacucccauuaaauucagug

SEQ ID NO: 2009911 - RNA, 23 nt, Homo sapiens
gccuccccgguggccagagccag

SEQ ID NO: 2009912 - RNA, 17 nt, Homo sapiens
gugcugcucucuccgag

SEQ ID NO: 2009913 - RNA, 23 nt, Homo sapiens
ccuaaaacauaagaucacugcca

SEQ ID NO: 2009914 - RNA, 18 nt, Homo sapiens
uggaaaaaaaacauugca

SEQ ID NO: 2009915 - RNA, 17 nt, Homo sapiens
guccuggucaugcacau

SEQ ID NO: 2009916 - RNA, 19 nt, Homo sapiens
uggacaacagagaugccau

SEQ ID NO: 2009917 - RNA, 16 nt, Homo sapiens
uuucuuuuacagacua

SEQ ID NO: 2009918 - RNA, 18 nt, Homo sapiens
guuagagaauuuccuuac

SEQ ID NO: 2009919 - RNA, 12 nt, Homo sapiens
aagggccuggga

SEQ ID NO: 2009920 - RNA, 22 nt, Homo sapiens
cacccuuaagaagguauuuugu

SEQ ID NO: 2009921 - RNA, 18 nt, Homo sapiens
ugggaucucaucgaauaa

SEQ ID NO: 2009922 - RNA, 14 nt, Homo sapiens
aggaaacaacagcu

SEQ ID NO: 2009923 - RNA, 16 nt, Homo sapiens
cucuugucacauggaa

SEQ ID NO: 2009924 - RNA, 22 nt, Homo sapiens
aaccauaguuauuuacuugaaa

SEQ ID NO: 2009925 - RNA, 19 nt, Homo sapiens
gcggaaggucccucagaca

SEQ ID NO: 2009926 - RNA, 16 nt, Homo sapiens
ugucuuuaaugcaaua

SEQ ID NO: 2009927 - RNA, 21 nt, Homo sapiens
uguauuauaauaagcaaaaag

SEQ ID NO: 2009928 - RNA, 13 nt, Homo sapiens
uuaacaaacucuu

SEQ ID NO: 2009929 - RNA, 23 nt, Homo sapiens
gccugaaaaggacuucuggcuau

SEQ ID NO: 2009930 - RNA, 23 nt, Homo sapiens
uguaaaucugccacaaaaacagg

SEQ ID NO: 2009931 - RNA, 23 nt, Homo sapiens
aggacuaccagccauacaaauag

SEQ ID NO: 2009932 - RNA, 15 nt, Homo sapiens
ugagaacuugacaag

SEQ ID NO: 2009933 - RNA, 16 nt, Homo sapiens
auaucagcucuuucuc

SEQ ID NO: 2009934 - RNA, 14 nt, Homo sapiens
aggaugcaugcagg

SEQ ID NO: 2009935 - RNA, 15 nt, Homo sapiens
aacacucauuuccaa

SEQ ID NO: 2009936 - RNA, 16 nt, Homo sapiens
gaaaugaaugcugauu

SEQ ID NO: 2009937 - RNA, 19 nt, Homo sapiens
gucugaacggcugaauaug

SEQ ID NO: 2009938 - RNA, 13 nt, Homo sapiens
agcuucucucugc

SEQ ID NO: 2009939 - RNA, 22 nt, Homo sapiens
acuuuucacauccuugacuuuu

SEQ ID NO: 2009940 - RNA, 18 nt, Homo sapiens
guuuauuuacucacuuca

SEQ ID NO: 2009941 - RNA, 19 nt, Homo sapiens
aaugccugugaagcaguca

SEQ ID NO: 2009942 - RNA, 21 nt, Homo sapiens
guccucuucugcaucuugggg

SEQ ID NO: 2009943 - RNA, 12 nt, Homo sapiens
caucugcuccua

SEQ ID NO: 2009944 - RNA, 18 nt, Homo sapiens
gagccaccagggcacugu

SEQ ID NO: 2009945 - RNA, 14 nt, Homo sapiens
uaaaugaacuacug

SEQ ID NO: 2009946 - RNA, 18 nt, Homo sapiens
auucuagguuagucaaga

SEQ ID NO: 2009947 - RNA, 16 nt, Homo sapiens
ugacaaucaucuccaa

SEQ ID NO: 2009948 - RNA, 14 nt, Homo sapiens
caccaauccucacc

SEQ ID NO: 2009949 - RNA, 14 nt, Homo sapiens
uacacaucuuccac

SEQ ID NO: 2009950 - RNA, 17 nt, Homo sapiens
ccagagugauucuaguu

SEQ ID NO: 2009951 - RNA, 23 nt, Homo sapiens
gaucgcgccacugcacucuagcc

SEQ ID NO: 2009952 - RNA, 23 nt, Homo sapiens
ugggauuuccauguucuuauuaa

SEQ ID NO: 2009953 - RNA, 14 nt, Homo sapiens
uuaaucuuuucaca

SEQ ID NO: 2009954 - RNA, 14 nt, Homo sapiens
agagaaacuuugag

SEQ ID NO: 2009955 - RNA, 15 nt, Homo sapiens
gugccauuucagagg

SEQ ID NO: 2009956 - RNA, 22 nt, Homo sapiens
aggggcgacaguagugagcgcc

SEQ ID NO: 2009957 - RNA, 20 nt, Homo sapiens
gauaucuuggacaaaucaca

SEQ ID NO: 2009958 - RNA, 12 nt, Homo sapiens
uggaucaccugu

SEQ ID NO: 2009959 - RNA, 19 nt, Homo sapiens
augcacagagauaugcaca

SEQ ID NO: 2009960 - RNA, 17 nt, Homo sapiens
aauuuucuagauauuau

SEQ ID NO: 2009961 - RNA, 16 nt, Homo sapiens
ucugguggucucugcu

SEQ ID NO: 2009962 - RNA, 16 nt, Homo sapiens
aauaaacacucuugaa

SEQ ID NO: 2009963 - RNA, 14 nt, Homo sapiens
auaauugugcuuua

SEQ ID NO: 2009964 - RNA, 19 nt, Homo sapiens
uggcugccccgugacacau

SEQ ID NO: 2009965 - RNA, 22 nt, Homo sapiens
ucaucaguccauugcucuugag

SEQ ID NO: 2009966 - RNA, 23 nt, Homo sapiens
ccuagauaugaagaaucugcucu

SEQ ID NO: 2009967 - RNA, 17 nt, Homo sapiens
acugaagaagaugagcc

SEQ ID NO: 2009968 - RNA, 21 nt, Homo sapiens
aacagcuuugugaacguggca

SEQ ID NO: 2009969 - RNA, 22 nt, Homo sapiens
cacaaaaauagagaaaauucag

SEQ ID NO: 2009970 - RNA, 22 nt, Homo sapiens
ugaguugcacagcuaugaaggc

SEQ ID NO: 2009971 - RNA, 18 nt, Homo sapiens
cccagccccaaggggugg

SEQ ID NO: 2009972 - RNA, 14 nt, Homo sapiens
aaccaagucuacuu

SEQ ID NO: 2009973 - RNA, 15 nt, Homo sapiens
cuugaggcagggucu

SEQ ID NO: 2009974 - RNA, 20 nt, Homo sapiens
auguauaucuucuacaugca

SEQ ID NO: 2009975 - RNA, 16 nt, Homo sapiens
aagccuaugugccuuu

SEQ ID NO: 2009976 - RNA, 12 nt, Homo sapiens
caggcaaaagac

SEQ ID NO: 2009977 - RNA, 22 nt, Homo sapiens
acaguggacaaaguuaccagug

SEQ ID NO: 2009978 - RNA, 12 nt, Homo sapiens
caacuccagcuc

SEQ ID NO: 2009979 - RNA, 18 nt, Homo sapiens
gaaagcauccauuaauua

SEQ ID NO: 2009980 - RNA, 21 nt, Homo sapiens
aagcuuccuccuccucuccag

SEQ ID NO: 2009981 - RNA, 11 nt, Homo sapiens
ugaagcaagag

SEQ ID NO: 2009982 - RNA, 15 nt, Homo sapiens
uccucuucuucauug

SEQ ID NO: 2009983 - RNA, 13 nt, Homo sapiens
agcuccugggaag

SEQ ID NO: 2009984 - RNA, 19 nt, Homo sapiens
acugaaccacuuguagauu

SEQ ID NO: 2009985 - RNA, 22 nt, Homo sapiens
uaaucagguccucagagaauuu

SEQ ID NO: 2009986 - RNA, 23 nt, Homo sapiens
cuuccucacaccacaaaucugaa

SEQ ID NO: 2009987 - RNA, 16 nt, Homo sapiens
gauuuaggcacugcuu

SEQ ID NO: 2009988 - RNA, 16 nt, Homo sapiens
cauguaugcaugcaca

SEQ ID NO: 2009989 - RNA, 13 nt, Homo sapiens
gcucgagugaauu

SEQ ID NO: 2009990 - RNA, 16 nt, Homo sapiens
uauugucuaggccaga

SEQ ID NO: 2009991 - RNA, 17 nt, Homo sapiens
gugccccacaaggccca

SEQ ID NO: 2009992 - RNA, 15 nt, Homo sapiens
aaguuccucuagugc

SEQ ID NO: 2009993 - RNA, 15 nt, Homo sapiens
gaaguaugagggaaa

SEQ ID NO: 2009994 - RNA, 17 nt, Homo sapiens
aucucaucgucugcgca

SEQ ID NO: 2009995 - RNA, 19 nt, Homo sapiens
uaaaauaagcucagugaua

SEQ ID NO: 2009996 - RNA, 16 nt, Homo sapiens
ugaucugggucucuaa

SEQ ID NO: 2009997 - RNA, 16 nt, Homo sapiens
cagcagccccaggaga

SEQ ID NO: 2009998 - RNA, 23 nt, Homo sapiens
agugucugucugaggugacuuaa

SEQ ID NO: 2009999 - RNA, 21 nt, Homo sapiens
ccgagauaucgccacugcacu

SEQ ID NO: 2010000 - RNA, 19 nt, Homo sapiens
auaugauuuaaaacaugua

SEQ ID NO: 2010001 - RNA, 21 nt, Homo sapiens
augcacaguaucugcuguucu

SEQ ID NO: 2010002 - RNA, 22 nt, Homo sapiens
gacuaaaauguuucauuuaccu

SEQ ID NO: 2010003 - RNA, 21 nt, Homo sapiens
ggacugauucuguuguguuca

SEQ ID NO: 2010004 - RNA, 14 nt, Homo sapiens
auagucacaaaaau

SEQ ID NO: 2010005 - RNA, 22 nt, Homo sapiens
uacuucuuaggguuaugauuaa

SEQ ID NO: 2010006 - RNA, 20 nt, Homo sapiens
ugcaaaaccggcaaccugua

SEQ ID NO: 2010007 - RNA, 15 nt, Homo sapiens
aauuuaauauagcua

SEQ ID NO: 2010008 - RNA, 16 nt, Homo sapiens
ugggcuagauuacaga

SEQ ID NO: 2010009 - RNA, 15 nt, Homo sapiens
uacucuuauucuugg

SEQ ID NO: 2010010 - RNA, 20 nt, Homo sapiens
agcuuuuagaaauacugcaa

SEQ ID NO: 2010011 - RNA, 18 nt, Homo sapiens
acaggauggucucugcca

SEQ ID NO: 2010012 - RNA, 17 nt, Homo sapiens
ugauaaucccauacucu

SEQ ID NO: 2010013 - RNA, 14 nt, Homo sapiens
cugauacuagacua

SEQ ID NO: 2010014 - RNA, 19 nt, Homo sapiens
cuugucuacuggacuguaa

SEQ ID NO: 2010015 - RNA, 20 nt, Homo sapiens
acagagccaagcacugcuca

SEQ ID NO: 2010016 - RNA, 16 nt, Homo sapiens
gcaacacucacugccu

SEQ ID NO: 2010017 - RNA, 19 nt, Homo sapiens
ggagauagcuuucuuuccc

SEQ ID NO: 2010018 - RNA, 22 nt, Homo sapiens
ugccaaugguggaucuuugcua

SEQ ID NO: 2010019 - RNA, 16 nt, Homo sapiens
agggaugacugugauu

SEQ ID NO: 2010020 - RNA, 22 nt, Homo sapiens
ccugccuggguuuucuaacugu

SEQ ID NO: 2010021 - RNA, 19 nt, Homo sapiens
agggaaccgugauaagccu

SEQ ID NO: 2010022 - RNA, 15 nt, Homo sapiens
cacugaauucacucc

SEQ ID NO: 2010023 - RNA, 21 nt, Homo sapiens
uggauuacaggcaugugccac

SEQ ID NO: 2010024 - RNA, 20 nt, Homo sapiens
gcacaugugccacuguucag

SEQ ID NO: 2010025 - RNA, 14 nt, Homo sapiens
augcguauucugug

SEQ ID NO: 2010026 - RNA, 13 nt, Homo sapiens
cugaagcuaaaaa

SEQ ID NO: 2010027 - RNA, 18 nt, Homo sapiens
auaugaguacauacucaa

SEQ ID NO: 2010028 - RNA, 17 nt, Homo sapiens
acuggaagaaagcaaca

SEQ ID NO: 2010029 - RNA, 18 nt, Homo sapiens
ugauacuuugacaguguu

SEQ ID NO: 2010030 - RNA, 16 nt, Homo sapiens
auaucagggauucuau

SEQ ID NO: 2010031 - RNA, 14 nt, Homo sapiens
auaaacucucuagg

SEQ ID NO: 2010032 - RNA, 13 nt, Homo sapiens
cucuuugcccaaa

SEQ ID NO: 2010033 - RNA, 17 nt, Homo sapiens
ccauucugugugugacu

SEQ ID NO: 2010034 - RNA, 19 nt, Homo sapiens
agagguccuggccaucaaa

SEQ ID NO: 2010035 - RNA, 22 nt, Homo sapiens
agccugggacaguuuaucauga

SEQ ID NO: 2010036 - RNA, 17 nt, Homo sapiens
guaaugugucaaagaga

SEQ ID NO: 2010037 - RNA, 20 nt, Homo sapiens
aacuuuccuucauucaaccc

SEQ ID NO: 2010038 - RNA, 21 nt, Homo sapiens
uaguugaauguugcaauguga

SEQ ID NO: 2010039 - RNA, 19 nt, Homo sapiens
caccaggagagagggcaaa

SEQ ID NO: 2010040 - RNA, 23 nt, Homo sapiens
cucaaugcauuuucaagauacau

SEQ ID NO: 2010041 - RNA, 14 nt, Homo sapiens
cauaucagaccucu

SEQ ID NO: 2010042 - RNA, 16 nt, Homo sapiens
acacugggugcccaag

SEQ ID NO: 2010043 - RNA, 18 nt, Homo sapiens
acagaaauauauauacau

SEQ ID NO: 2010044 - RNA, 13 nt, Homo sapiens
uggcccacacuga

SEQ ID NO: 2010045 - RNA, 17 nt, Homo sapiens
ucagccccucacauucc

SEQ ID NO: 2010046 - RNA, 12 nt, Homo sapiens
caagagcucuuu

SEQ ID NO: 2010047 - RNA, 20 nt, Homo sapiens
cuacaauuccucugauaaua

SEQ ID NO: 2010048 - RNA, 17 nt, Homo sapiens
auccuagucauucuucc

SEQ ID NO: 2010049 - RNA, 18 nt, Homo sapiens
cauuagugaaaauucugu

SEQ ID NO: 2010050 - RNA, 16 nt, Homo sapiens
uauggaacucucucca

SEQ ID NO: 2010051 - RNA, 16 nt, Homo sapiens
ugacaaaaugacuggc

SEQ ID NO: 2010052 - RNA, 19 nt, Homo sapiens
uucauacacuguaccccag

SEQ ID NO: 2010053 - RNA, 15 nt, Homo sapiens
guaaauuuaagucca

SEQ ID NO: 2010054 - RNA, 15 nt, Homo sapiens
aaaucuuugugaaca

SEQ ID NO: 2010055 - RNA, 15 nt, Homo sapiens
ucacuucauaaucca

SEQ ID NO: 2010056 - RNA, 22 nt, Homo sapiens
ucagccuugggcaacugcagug

SEQ ID NO: 2010057 - RNA, 15 nt, Homo sapiens
ugacagagcagugcu

SEQ ID NO: 2010058 - RNA, 17 nt, Homo sapiens
gaaaacaaaaaacaaaa

SEQ ID NO: 2010059 - RNA, 17 nt, Homo sapiens
cuuagccucccaaagug

SEQ ID NO: 2010060 - RNA, 20 nt, Homo sapiens
uuugcguuugguuuacuugu

SEQ ID NO: 2010061 - RNA, 22 nt, Homo sapiens
aaggcucugaaauaaaaugcca

SEQ ID NO: 2010062 - RNA, 20 nt, Homo sapiens
ccuguaaucccaacacuuug

SEQ ID NO: 2010063 - RNA, 14 nt, Homo sapiens
aacauuuuacuacu

SEQ ID NO: 2010064 - RNA, 16 nt, Homo sapiens
uguacuauggucucuu

SEQ ID NO: 2010065 - RNA, 14 nt, Homo sapiens
aaucaagccugauu

SEQ ID NO: 2010066 - RNA, 20 nt, Homo sapiens
uguugauaaauuccacugga

SEQ ID NO: 2010067 - RNA, 22 nt, Homo sapiens
uaggcugagaugcaccaaguac

SEQ ID NO: 2010068 - RNA, 17 nt, Homo sapiens
guguaacacuugucaag

SEQ ID NO: 2010069 - RNA, 18 nt, Homo sapiens
ccaggagaagcucagcug

SEQ ID NO: 2010070 - RNA, 20 nt, Homo sapiens
cuuuuaguuuuaaaacucuu

SEQ ID NO: 2010071 - RNA, 22 nt, Homo sapiens
agagacacugggacacugucag

SEQ ID NO: 2010072 - RNA, 16 nt, Homo sapiens
ugagugaauacuuuga

SEQ ID NO: 2010073 - RNA, 22 nt, Homo sapiens
agauccacccucaaaugucaga

SEQ ID NO: 2010074 - RNA, 12 nt, Homo sapiens
gaagcaccagcc

SEQ ID NO: 2010075 - RNA, 15 nt, Homo sapiens
aaucaaggugacuaa

SEQ ID NO: 2010076 - RNA, 15 nt, Homo sapiens
uuggccugcugugau

SEQ ID NO: 2010077 - RNA, 20 nt, Homo sapiens
acagugcuuuccagccuuug

SEQ ID NO: 2010078 - RNA, 18 nt, Homo sapiens
aaaccacuaugcaaagaa

SEQ ID NO: 2010079 - RNA, 21 nt, Homo sapiens
agccuugugugaacucaccaa

SEQ ID NO: 2010080 - RNA, 14 nt, Homo sapiens
agugcaaucugucc

SEQ ID NO: 2010081 - RNA, 15 nt, Homo sapiens
ucuuucaucaaaaca

SEQ ID NO: 2010082 - RNA, 23 nt, Homo sapiens
auuuugugucuuuuaaacuggaa

SEQ ID NO: 2010083 - RNA, 13 nt, Homo sapiens
ccagcuaguuccu

SEQ ID NO: 2010084 - RNA, 20 nt, Homo sapiens
augacaaaugacgucuucac

SEQ ID NO: 2010085 - RNA, 17 nt, Homo sapiens
ucaagguggucaguaaa

SEQ ID NO: 2010086 - RNA, 13 nt, Homo sapiens
augucaaauccau

SEQ ID NO: 2010087 - RNA, 16 nt, Homo sapiens
uuauagaaagauagau

SEQ ID NO: 2010088 - RNA, 19 nt, Homo sapiens
uggaaaagcaaaacuguag

SEQ ID NO: 2010089 - RNA, 20 nt, Homo sapiens
caaccaccuuuccagccaua

SEQ ID NO: 2010090 - RNA, 18 nt, Homo sapiens
gguuuaugcucaauccau

SEQ ID NO: 2010091 - RNA, 19 nt, Homo sapiens
gagcccagauugugccacu

SEQ ID NO: 2010092 - RNA, 13 nt, Homo sapiens
uaugugcacucau

SEQ ID NO: 2010093 - RNA, 17 nt, Homo sapiens
uaauauuugaauugccu

SEQ ID NO: 2010094 - RNA, 15 nt, Homo sapiens
cuuagagaggacaau

SEQ ID NO: 2010095 - RNA, 14 nt, Homo sapiens
gagccccccuagca

SEQ ID NO: 2010096 - RNA, 20 nt, Homo sapiens
cauguccuaugccucacaaa

SEQ ID NO: 2010097 - RNA, 18 nt, Homo sapiens
ugcacgcugggcaaugag

SEQ ID NO: 2010098 - RNA, 21 nt, Homo sapiens
uccuaggggaacagaccagug

SEQ ID NO: 2010099 - RNA, 14 nt, Homo sapiens
ggucccugguccuu

SEQ ID NO: 2010100 - RNA, 17 nt, Homo sapiens
cauaguucugcaauaac

SEQ ID NO: 2010101 - RNA, 20 nt, Homo sapiens
cuuugaauaguccuaaaaag

SEQ ID NO: 2010102 - RNA, 13 nt, Homo sapiens
uuggaaagauuua

SEQ ID NO: 2010103 - RNA, 16 nt, Homo sapiens
ucagcacugucuuguc

SEQ ID NO: 2010104 - RNA, 20 nt, Homo sapiens
ggagugucggauccugugag

SEQ ID NO: 2010105 - RNA, 22 nt, Homo sapiens
aacacaaaccacaacugacaca

SEQ ID NO: 2010106 - RNA, 17 nt, Homo sapiens
auaucucaauuaccaau

SEQ ID NO: 2010107 - RNA, 22 nt, Homo sapiens
ggagggcgcuaugucguggcug

SEQ ID NO: 2010108 - RNA, 21 nt, Homo sapiens
uccuucuaccacuggggugcu

SEQ ID NO: 2010109 - RNA, 17 nt, Homo sapiens
uagaagagaaaugcugc

SEQ ID NO: 2010110 - RNA, 15 nt, Homo sapiens
caugacguaguauua

SEQ ID NO: 2010111 - RNA, 16 nt, Homo sapiens
auccuagacugcuccu

SEQ ID NO: 2010112 - RNA, 12 nt, Homo sapiens
uuuuuaaucucc

SEQ ID NO: 2010113 - RNA, 15 nt, Homo sapiens
agcaagaacauucaa

SEQ ID NO: 2010114 - RNA, 17 nt, Homo sapiens
ucaauccugucauauaa

SEQ ID NO: 2010115 - RNA, 23 nt, Homo sapiens
ucaccacugaaacccugcacuua

SEQ ID NO: 2010116 - RNA, 14 nt, Homo sapiens
uugauuuuuugccc

SEQ ID NO: 2010117 - RNA, 19 nt, Homo sapiens
gggugugaaagguuuccaa

SEQ ID NO: 2010118 - RNA, 19 nt, Homo sapiens
uagacucacagccguccaa

SEQ ID NO: 2010119 - RNA, 14 nt, Homo sapiens
cuaacaacaaauua

SEQ ID NO: 2010120 - RNA, 15 nt, Homo sapiens
ugugcucucggcuuc

SEQ ID NO: 2010121 - RNA, 15 nt, Homo sapiens
caaaugaauuuucca

SEQ ID NO: 2010122 - RNA, 17 nt, Homo sapiens
ugggccccucucauucc

SEQ ID NO: 2010123 - RNA, 22 nt, Homo sapiens
caaugauuaggaaucauucugu

SEQ ID NO: 2010124 - RNA, 19 nt, Homo sapiens
auguagacuuuugcuuuau

SEQ ID NO: 2010125 - RNA, 13 nt, Homo sapiens
cauaccucugacc

SEQ ID NO: 2010126 - RNA, 16 nt, Homo sapiens
aaaguaguccugugaa

SEQ ID NO: 2010127 - RNA, 14 nt, Homo sapiens
cagaauucacuguc

SEQ ID NO: 2010128 - RNA, 21 nt, Homo sapiens
cccuacuuccucugcaaaaag

SEQ ID NO: 2010129 - RNA, 23 nt, Homo sapiens
auauuauuguuuucuacugcuau

SEQ ID NO: 2010130 - RNA, 22 nt, Homo sapiens
ccuucccagcaguuugcugcca

SEQ ID NO: 2010131 - RNA, 21 nt, Homo sapiens
ggugcuauuucuauuccuuau

SEQ ID NO: 2010132 - RNA, 19 nt, Homo sapiens
gauguuucuggaauugaua

SEQ ID NO: 2010133 - RNA, 16 nt, Homo sapiens
auccugggauccagug

SEQ ID NO: 2010134 - RNA, 16 nt, Homo sapiens
uacuuagauacuaaua

SEQ ID NO: 2010135 - RNA, 22 nt, Homo sapiens
cuccagacuugggaaacuauuc

SEQ ID NO: 2010136 - RNA, 14 nt, Homo sapiens
uuuucuuuggcugc

SEQ ID NO: 2010137 - RNA, 20 nt, Homo sapiens
caggaggcccccaucuauga

SEQ ID NO: 2010138 - RNA, 18 nt, Homo sapiens
ucgaugagaaauugaacu

SEQ ID NO: 2010139 - RNA, 23 nt, Homo sapiens
uauguccauaucuaaccagugau

SEQ ID NO: 2010140 - RNA, 14 nt, Homo sapiens
agucaguccaggau

SEQ ID NO: 2010141 - RNA, 17 nt, Homo sapiens
aaacacaaaacaacaaa

SEQ ID NO: 2010142 - RNA, 19 nt, Homo sapiens
auuuguaauaauggauaau

SEQ ID NO: 2010143 - RNA, 20 nt, Homo sapiens
cugggauuacaggugugagc

SEQ ID NO: 2010144 - RNA, 16 nt, Homo sapiens
cacagaagcacaugca

SEQ ID NO: 2010145 - RNA, 20 nt, Homo sapiens
ccuauaugcagucucuuuau

SEQ ID NO: 2010146 - RNA, 18 nt, Homo sapiens
gacuugacagaacacugu

SEQ ID NO: 2010147 - RNA, 15 nt, Homo sapiens
uaucagcauauggca

SEQ ID NO: 2010148 - RNA, 22 nt, Homo sapiens
uuuaaauaaaauauuugcuuca

SEQ ID NO: 2010149 - RNA, 21 nt, Homo sapiens
uggaugacccuccccuaguca

SEQ ID NO: 2010150 - RNA, 19 nt, Homo sapiens
gauguuugaccuucagagc

SEQ ID NO: 2010151 - RNA, 12 nt, Homo sapiens
accacuugacag

SEQ ID NO: 2010152 - RNA, 21 nt, Homo sapiens
uuauccagaggguugugauuu

SEQ ID NO: 2010153 - RNA, 20 nt, Homo sapiens
auaucaaaaaaccuuuacag

SEQ ID NO: 2010154 - RNA, 15 nt, Homo sapiens
ugcgauagagucuca

SEQ ID NO: 2010155 - RNA, 18 nt, Homo sapiens
gacaauucauucauuugc

SEQ ID NO: 2010156 - RNA, 14 nt, Homo sapiens
cuuucuuguuucau

SEQ ID NO: 2010157 - RNA, 21 nt, Homo sapiens
gaagauagccagagagcccau

SEQ ID NO: 2010158 - RNA, 21 nt, Homo sapiens
aacuguuggcaaggugacauu

SEQ ID NO: 2010159 - RNA, 17 nt, Homo sapiens
ccugcaggcaggaacaa

SEQ ID NO: 2010160 - RNA, 22 nt, Homo sapiens
aaaauccuaagacacaaaugca

SEQ ID NO: 2010161 - RNA, 22 nt, Homo sapiens
aucuggcuuagugccacccacc

SEQ ID NO: 2010162 - RNA, 14 nt, Homo sapiens
gauaaaucauuuua

SEQ ID NO: 2010163 - RNA, 22 nt, Homo sapiens
ccugagauacaaggcccagaag

SEQ ID NO: 2010164 - RNA, 22 nt, Homo sapiens
gaaacauuguuaauauaauuua

SEQ ID NO: 2010165 - RNA, 18 nt, Homo sapiens
auguccucuugaagcaua

SEQ ID NO: 2010166 - RNA, 16 nt, Homo sapiens
cacacuggaugugauu

SEQ ID NO: 2010167 - RNA, 14 nt, Homo sapiens
ucaguguacaugga

SEQ ID NO: 2010168 - RNA, 16 nt, Homo sapiens
caagugaaaucaaagg

SEQ ID NO: 2010169 - RNA, 14 nt, Homo sapiens
ccuaggcugcauug

SEQ ID NO: 2010170 - RNA, 14 nt, Homo sapiens
ccaggauagacuuu

SEQ ID NO: 2010171 - RNA, 13 nt, Homo sapiens
acauguuaagaua

SEQ ID NO: 2010172 - RNA, 14 nt, Homo sapiens
ucaucccuuugguu

SEQ ID NO: 2010173 - RNA, 18 nt, Homo sapiens
gccaaugccacagccaag

SEQ ID NO: 2010174 - RNA, 15 nt, Homo sapiens
uaagaugacucugag

SEQ ID NO: 2010175 - RNA, 18 nt, Homo sapiens
caguaucucuucagucuc

SEQ ID NO: 2010176 - RNA, 17 nt, Homo sapiens
uacauuucaccuacuuu

SEQ ID NO: 2010177 - RNA, 21 nt, Homo sapiens
uucuguaaauggaacaaacaa

SEQ ID NO: 2010178 - RNA, 14 nt, Homo sapiens
gacaacaccuuccu

SEQ ID NO: 2010179 - RNA, 15 nt, Homo sapiens
aauccgcauugaugg

SEQ ID NO: 2010180 - RNA, 14 nt, Homo sapiens
aaguagcugcuacc

SEQ ID NO: 2010181 - RNA, 15 nt, Homo sapiens
guuccaaaagcacag

SEQ ID NO: 2010182 - RNA, 13 nt, Homo sapiens
agaccaugcacag

SEQ ID NO: 2010183 - RNA, 14 nt, Homo sapiens
cuguccuugcacac

SEQ ID NO: 2010184 - RNA, 19 nt, Homo sapiens
acuuuuuuccugucaauau

SEQ ID NO: 2010185 - RNA, 19 nt, Homo sapiens
ugugcagggugaagcagcu

SEQ ID NO: 2010186 - RNA, 12 nt, Homo sapiens
acauuugccaag

SEQ ID NO: 2010187 - RNA, 20 nt, Homo sapiens
aaauauucuacacauguaaa

SEQ ID NO: 2010188 - RNA, 20 nt, Homo sapiens
acgugguggcccagcuccuc

SEQ ID NO: 2010189 - RNA, 11 nt, Homo sapiens
aguuccuucac

SEQ ID NO: 2010190 - RNA, 15 nt, Homo sapiens
uuacagcacuacucu

SEQ ID NO: 2010191 - RNA, 23 nt, Homo sapiens
guucuguaguuauucugaugaua

SEQ ID NO: 2010192 - RNA, 14 nt, Homo sapiens
cugugugugggugu

SEQ ID NO: 2010193 - RNA, 17 nt, Homo sapiens
agcagagacuugggaca

SEQ ID NO: 2010194 - RNA, 22 nt, Homo sapiens
ugggcuccccaggaagcccacu

SEQ ID NO: 2010195 - RNA, 23 nt, Homo sapiens
ugagaaaaauagagcaaaaucaa

SEQ ID NO: 2010196 - RNA, 22 nt, Homo sapiens
guguacacauaugaacgcacaa

SEQ ID NO: 2010197 - RNA, 16 nt, Homo sapiens
agggguaugucuuuau

SEQ ID NO: 2010198 - RNA, 16 nt, Homo sapiens
ucugccccuccguccc

SEQ ID NO: 2010199 - RNA, 20 nt, Homo sapiens
acuuacuguuucugucagga

SEQ ID NO: 2010200 - RNA, 18 nt, Homo sapiens
ugggaccccagcugcucu

SEQ ID NO: 2010201 - RNA, 17 nt, Homo sapiens
agaucucgguuugccaa

SEQ ID NO: 2010202 - RNA, 21 nt, Homo sapiens
cuuuugaaguguuuuagucua

SEQ ID NO: 2010203 - RNA, 17 nt, Homo sapiens
ugccgcugucucugagg

SEQ ID NO: 2010204 - RNA, 22 nt, Homo sapiens
aaauaaauuauuauuuaaacau

SEQ ID NO: 2010205 - RNA, 20 nt, Homo sapiens
gacccacacuuccaugagaa

SEQ ID NO: 2010206 - RNA, 22 nt, Homo sapiens
ggauucccaccccacuucugca

SEQ ID NO: 2010207 - RNA, 13 nt, Homo sapiens
cuuuaaauggaaa

SEQ ID NO: 2010208 - RNA, 18 nt, Homo sapiens
cagcaacaagacugccag

SEQ ID NO: 2010209 - RNA, 16 nt, Homo sapiens
cuauguacugccuuag

SEQ ID NO: 2010210 - RNA, 15 nt, Homo sapiens
ugaacucgaagccca

SEQ ID NO: 2010211 - RNA, 23 nt, Homo sapiens
agggagcgccuccccaccacuga

SEQ ID NO: 2010212 - RNA, 16 nt, Homo sapiens
gcuggagaaauggcau

SEQ ID NO: 2010213 - RNA, 20 nt, Homo sapiens
aagauuguuucagacuuuug

SEQ ID NO: 2010214 - RNA, 18 nt, Homo sapiens
acugucuuaaagagagag

SEQ ID NO: 2010215 - RNA, 15 nt, Homo sapiens
acggcagcuguagcu

SEQ ID NO: 2010216 - RNA, 16 nt, Homo sapiens
cugugagcaagagcca

SEQ ID NO: 2010217 - RNA, 17 nt, Homo sapiens
aaagaguugaagacagc

SEQ ID NO: 2010218 - RNA, 15 nt, Homo sapiens
uuggauucuuuccau

SEQ ID NO: 2010219 - RNA, 16 nt, Homo sapiens
aaagguuacccuguaa

SEQ ID NO: 2010220 - RNA, 15 nt, Homo sapiens
uccccucucuuugag

SEQ ID NO: 2010221 - RNA, 16 nt, Homo sapiens
ggauuucugggacccc

SEQ ID NO: 2010222 - RNA, 22 nt, Homo sapiens
ggaaauauguucuaacagcauc

SEQ ID NO: 2010223 - RNA, 18 nt, Homo sapiens
ggucuguggccaguugac

SEQ ID NO: 2010224 - RNA, 20 nt, Homo sapiens
uuucaugcuuccagguaaaa

SEQ ID NO: 2010225 - RNA, 24 nt, Homo sapiens
uaacuucuccaaggagcaugucac

SEQ ID NO: 2010226 - RNA, 23 nt, Homo sapiens
uuuauauauauaaagucagugac

SEQ ID NO: 2010227 - RNA, 15 nt, Homo sapiens
ugcauggaguauuau

SEQ ID NO: 2010228 - RNA, 20 nt, Homo sapiens
agugaauguaaaaugcaaaa

SEQ ID NO: 2010229 - RNA, 14 nt, Homo sapiens
agccuugcucucuu

SEQ ID NO: 2010230 - RNA, 14 nt, Homo sapiens
ugcuuugcacuuuu

SEQ ID NO: 2010231 - RNA, 17 nt, Homo sapiens
agaauuggccaucuuaa

SEQ ID NO: 2010232 - RNA, 13 nt, Homo sapiens
ccugaugucuuaa

SEQ ID NO: 2010233 - RNA, 13 nt, Homo sapiens
ucacccaucucuc

SEQ ID NO: 2010234 - RNA, 21 nt, Homo sapiens
ggauucagauuucucuuugaa

SEQ ID NO: 2010235 - RNA, 17 nt, Homo sapiens
agaguucuccagacagg

SEQ ID NO: 2010236 - RNA, 14 nt, Homo sapiens
aauuacaagcugua

SEQ ID NO: 2010237 - RNA, 16 nt, Homo sapiens
caagacaauaauuaca

SEQ ID NO: 2010238 - RNA, 14 nt, Homo sapiens
gcaggagugacuca

SEQ ID NO: 2010239 - RNA, 17 nt, Homo sapiens
uuguuacuucugaggua

SEQ ID NO: 2010240 - RNA, 15 nt, Homo sapiens
aaguacaagcuguaa

SEQ ID NO: 2010241 - RNA, 18 nt, Homo sapiens
agaagaugguaccaccag

SEQ ID NO: 2010242 - RNA, 21 nt, Homo sapiens
gcaaaagaaagcaaauuauuu

SEQ ID NO: 2010243 - RNA, 15 nt, Homo sapiens
ugaagcuaauaauuc

SEQ ID NO: 2010244 - RNA, 19 nt, Homo sapiens
cauuaucuaguucauugaa

SEQ ID NO: 2010245 - RNA, 14 nt, Homo sapiens
uuccaggcugguuc

SEQ ID NO: 2010246 - RNA, 23 nt, Homo sapiens
cacuuaugagaugccugaagcca

SEQ ID NO: 2010247 - RNA, 15 nt, Homo sapiens
ugcuuuaacagucaa

SEQ ID NO: 2010248 - RNA, 20 nt, Homo sapiens
cugucauuuugcacuguaaa

SEQ ID NO: 2010249 - RNA, 19 nt, Homo sapiens
accaucccugauggcagaa

SEQ ID NO: 2010250 - RNA, 13 nt, Homo sapiens
cuuaccauauguu

SEQ ID NO: 2010251 - RNA, 15 nt, Homo sapiens
cgagcuuccucggua

SEQ ID NO: 2010252 - RNA, 14 nt, Homo sapiens
caaucgagauuugg

SEQ ID NO: 2010253 - RNA, 22 nt, Homo sapiens
acccuucucgcuuuugccauua

SEQ ID NO: 2010254 - RNA, 11 nt, Homo sapiens
accagcccaga

SEQ ID NO: 2010255 - RNA, 15 nt, Homo sapiens
cuugcauagucaaua

SEQ ID NO: 2010256 - RNA, 23 nt, Homo sapiens
acauuaugaugugugaaaacugg

SEQ ID NO: 2010257 - RNA, 21 nt, Homo sapiens
cuuaaacaauguccucuuuga

SEQ ID NO: 2010258 - RNA, 20 nt, Homo sapiens
cagguaaaauuuugucauau

SEQ ID NO: 2010259 - RNA, 20 nt, Homo sapiens
acccuccccacccugaacaa

SEQ ID NO: 2010260 - RNA, 23 nt, Homo sapiens
acguuuggcauuucucuuugaga

SEQ ID NO: 2010261 - RNA, 19 nt, Homo sapiens
gcuauuuugugaagccaug

SEQ ID NO: 2010262 - RNA, 22 nt, Homo sapiens
auagcauuucuagaacaauuac

SEQ ID NO: 2010263 - RNA, 18 nt, Homo sapiens
uagauuacugaugugaua

SEQ ID NO: 2010264 - RNA, 14 nt, Homo sapiens
aauucaagccuuag

SEQ ID NO: 2010265 - RNA, 17 nt, Homo sapiens
uucauggcaucacaucu

SEQ ID NO: 2010266 - RNA, 11 nt, Homo sapiens
aauacuuucag

SEQ ID NO: 2010267 - RNA, 17 nt, Homo sapiens
aagaguccauaaaaauc

SEQ ID NO: 2010268 - RNA, 18 nt, Homo sapiens
caaggccuugguggagca

SEQ ID NO: 2010269 - RNA, 23 nt, Homo sapiens
accccugucccaaccccagugga

SEQ ID NO: 2010270 - RNA, 17 nt, Homo sapiens
ugaaggcugaguguccg

SEQ ID NO: 2010271 - RNA, 22 nt, Homo sapiens
caauauugagcaguucccaagg

SEQ ID NO: 2010272 - RNA, 15 nt, Homo sapiens
gagccagcaacucca

SEQ ID NO: 2010273 - RNA, 21 nt, Homo sapiens
accaguguagcauuggaucaa

SEQ ID NO: 2010274 - RNA, 19 nt, Homo sapiens
ucugggcagcgcuaucuag

SEQ ID NO: 2010275 - RNA, 18 nt, Homo sapiens
cagugggaacugugcaaa

SEQ ID NO: 2010276 - RNA, 18 nt, Homo sapiens
ucuuauucaugcuuucuc

SEQ ID NO: 2010277 - RNA, 16 nt, Homo sapiens
ugccaacuguuggaau

SEQ ID NO: 2010278 - RNA, 13 nt, Homo sapiens
aaucugauugcac

SEQ ID NO: 2010279 - RNA, 16 nt, Homo sapiens
guuauuucacuugcca

SEQ ID NO: 2010280 - RNA, 13 nt, Homo sapiens
uuuuguguacugu

SEQ ID NO: 2010281 - RNA, 23 nt, Homo sapiens
cucauggguggcacucagucucu

SEQ ID NO: 2010282 - RNA, 20 nt, Homo sapiens
guggugcccaugaggacaaa

SEQ ID NO: 2010283 - RNA, 17 nt, Homo sapiens
uguccuggucaguuuuc

SEQ ID NO: 2010284 - RNA, 15 nt, Homo sapiens
ccccacaagaacucc

SEQ ID NO: 2010285 - RNA, 12 nt, Homo sapiens
uuugugcaagac

SEQ ID NO: 2010286 - RNA, 19 nt, Homo sapiens
uauugaugauaacacuuaa

SEQ ID NO: 2010287 - RNA, 13 nt, Homo sapiens
auccucccaccuc

SEQ ID NO: 2010288 - RNA, 19 nt, Homo sapiens
cccaaccaggcccugccau

SEQ ID NO: 2010289 - RNA, 22 nt, Homo sapiens
agauuauaauaaauugucauca

SEQ ID NO: 2010290 - RNA, 18 nt, Homo sapiens
caagcuuaauagcccucc

SEQ ID NO: 2010291 - RNA, 15 nt, Homo sapiens
uucugguucuacuuu

SEQ ID NO: 2010292 - RNA, 22 nt, Homo sapiens
gagacagcugauacuucauuua

SEQ ID NO: 2010293 - RNA, 15 nt, Homo sapiens
agagggugcagucca

SEQ ID NO: 2010294 - RNA, 15 nt, Homo sapiens
aaauuguaagccaga

SEQ ID NO: 2010295 - RNA, 16 nt, Homo sapiens
uguuuaagcaucacau

SEQ ID NO: 2010296 - RNA, 17 nt, Homo sapiens
cagcucggcgagcuccu

SEQ ID NO: 2010297 - RNA, 14 nt, Homo sapiens
cagcucccauuucu

SEQ ID NO: 2010298 - RNA, 17 nt, Homo sapiens
gugaagaaaaauguauu

SEQ ID NO: 2010299 - RNA, 21 nt, Homo sapiens
aaucuuaaugaacacacaagc

SEQ ID NO: 2010300 - RNA, 21 nt, Homo sapiens
auugcacuuuaugaaaacuga

SEQ ID NO: 2010301 - RNA, 22 nt, Homo sapiens
ugucauuaguauuucacaagaa

SEQ ID NO: 2010302 - RNA, 22 nt, Homo sapiens
accgguugauugaaauaucagu

SEQ ID NO: 2010303 - RNA, 21 nt, Homo sapiens
uaaaugugaaugaugauccua

SEQ ID NO: 2010304 - RNA, 16 nt, Homo sapiens
cccucacaggagcauc

SEQ ID NO: 2010305 - RNA, 21 nt, Homo sapiens
aaucuuugcuguauacuuuua

SEQ ID NO: 2010306 - RNA, 18 nt, Homo sapiens
gcaucuccccuagcucac

SEQ ID NO: 2010307 - RNA, 22 nt, Homo sapiens
acugcaaugcuggacacuacag

SEQ ID NO: 2010308 - RNA, 13 nt, Homo sapiens
cagccaugcccag

SEQ ID NO: 2010309 - RNA, 14 nt, Homo sapiens
ccaaaacaguuaau

SEQ ID NO: 2010310 - RNA, 15 nt, Homo sapiens
cccagguaauggcau

SEQ ID NO: 2010311 - RNA, 16 nt, Homo sapiens
uaaguguuugucauau

SEQ ID NO: 2010312 - RNA, 23 nt, Homo sapiens
gcucugauggcacauuagaugaa

SEQ ID NO: 2010313 - RNA, 23 nt, Homo sapiens
gagcuugaaauagugucugauga

SEQ ID NO: 2010314 - RNA, 19 nt, Homo sapiens
ccaugacugugaccaccuu

SEQ ID NO: 2010315 - RNA, 22 nt, Homo sapiens
uuuugguuugcagaugacaaaa

SEQ ID NO: 2010316 - RNA, 21 nt, Homo sapiens
cugugccucgcauccuaugcu

SEQ ID NO: 2010317 - RNA, 18 nt, Homo sapiens
gccgcuucgccaugugcu

SEQ ID NO: 2010318 - RNA, 12 nt, Homo sapiens
ccuuugcauuca

SEQ ID NO: 2010319 - RNA, 14 nt, Homo sapiens
augcuuuccugcac

SEQ ID NO: 2010320 - RNA, 12 nt, Homo sapiens
agugccaucuca

SEQ ID NO: 2010321 - RNA, 22 nt, Homo sapiens
uguuaaaaucuauucuguguug

SEQ ID NO: 2010322 - RNA, 13 nt, Homo sapiens
caggcacugccaa

SEQ ID NO: 2010323 - RNA, 23 nt, Homo sapiens
acaccucgcuguugucacaucuc

SEQ ID NO: 2010324 - RNA, 23 nt, Homo sapiens
ggcuuggagaugaauaggaugau

SEQ ID NO: 2010325 - RNA, 19 nt, Homo sapiens
uaacuucucugagucugaa

SEQ ID NO: 2010326 - RNA, 20 nt, Homo sapiens
acggggcucuucucauuuca

SEQ ID NO: 2010327 - RNA, 11 nt, Homo sapiens
uccaagcauuu

SEQ ID NO: 2010328 - RNA, 20 nt, Homo sapiens
augucacugccugacauuca

SEQ ID NO: 2010329 - RNA, 14 nt, Homo sapiens
agcucucacagaca

SEQ ID NO: 2010330 - RNA, 19 nt, Homo sapiens
cugacuuauggcaugacuc

SEQ ID NO: 2010331 - RNA, 20 nt, Homo sapiens
agacucaugaaagaccugaa

SEQ ID NO: 2010332 - RNA, 21 nt, Homo sapiens
acagccuuaaauccuuuacaa

SEQ ID NO: 2010333 - RNA, 21 nt, Homo sapiens
acaaccacauuucuggccauu

SEQ ID NO: 2010334 - RNA, 15 nt, Homo sapiens
ugcaacacauucauu

SEQ ID NO: 2010335 - RNA, 22 nt, Homo sapiens
cacaaauaacaucucaccuuca

SEQ ID NO: 2010336 - RNA, 21 nt, Homo sapiens
cugacugguugucagaaugga

SEQ ID NO: 2010337 - RNA, 17 nt, Homo sapiens
uauuuaagaaaagcacu

SEQ ID NO: 2010338 - RNA, 13 nt, Homo sapiens
uucuccaagcauc

SEQ ID NO: 2010339 - RNA, 13 nt, Homo sapiens
uucuacaagcaua

SEQ ID NO: 2010340 - RNA, 19 nt, Homo sapiens
cugccuccaggagcugcaa

SEQ ID NO: 2010341 - RNA, 20 nt, Homo sapiens
ugaacagccacgucagcuuu

SEQ ID NO: 2010342 - RNA, 17 nt, Homo sapiens
uccucuauuuugugaug

SEQ ID NO: 2010343 - RNA, 16 nt, Homo sapiens
aaauacaaucagccca

SEQ ID NO: 2010344 - RNA, 16 nt, Homo sapiens
ucccagcauguugaga

SEQ ID NO: 2010345 - RNA, 12 nt, Homo sapiens
gaugcacacaca

SEQ ID NO: 2010346 - RNA, 14 nt, Homo sapiens
ucuaaggagagcuc

SEQ ID NO: 2010347 - RNA, 22 nt, Homo sapiens
ucagaagaaagaaucuuuccau

SEQ ID NO: 2010348 - RNA, 18 nt, Homo sapiens
uacaagugcgcacuacca

SEQ ID NO: 2010349 - RNA, 14 nt, Homo sapiens
cgagaacagggaaa

SEQ ID NO: 2010350 - RNA, 15 nt, Homo sapiens
auuccaaacucucca

SEQ ID NO: 2010351 - RNA, 23 nt, Homo sapiens
aggagcugauacuuugacagugu

SEQ ID NO: 2010352 - RNA, 14 nt, Homo sapiens
caauuucuugguau

SEQ ID NO: 2010353 - RNA, 13 nt, Homo sapiens
uaaagucucaggu

SEQ ID NO: 2010354 - RNA, 19 nt, Homo sapiens
agaauauaaacauauacag

SEQ ID NO: 2010355 - RNA, 16 nt, Homo sapiens
cuuggccuaggucucc

SEQ ID NO: 2010356 - RNA, 18 nt, Homo sapiens
uagcaacuccccuacauc

SEQ ID NO: 2010357 - RNA, 18 nt, Homo sapiens
ggccaucugggcuucaca

SEQ ID NO: 2010358 - RNA, 21 nt, Homo sapiens
cugcauuuuacacauugacaa

SEQ ID NO: 2010359 - RNA, 21 nt, Homo sapiens
cacucauuuccaaucauacaa

SEQ ID NO: 2010360 - RNA, 12 nt, Homo sapiens
uccaaaaacugu

SEQ ID NO: 2010361 - RNA, 14 nt, Homo sapiens
augaaagugacuuu

SEQ ID NO: 2010362 - RNA, 21 nt, Homo sapiens
uuuucccgagcaaagucuaaa

SEQ ID NO: 2010363 - RNA, 13 nt, Homo sapiens
aguuuagggaaaa

SEQ ID NO: 2010364 - RNA, 20 nt, Homo sapiens
uccgcacagucgaagccaca

SEQ ID NO: 2010365 - RNA, 19 nt, Homo sapiens
guuucuuuuugccagcuau

SEQ ID NO: 2010366 - RNA, 14 nt, Homo sapiens
aaagagggcuuccu

SEQ ID NO: 2010367 - RNA, 16 nt, Homo sapiens
ccacuucugugggcau

SEQ ID NO: 2010368 - RNA, 14 nt, Homo sapiens
ccacugcucgugga

SEQ ID NO: 2010369 - RNA, 22 nt, Homo sapiens
ucccugccugaauaaaguaaug

SEQ ID NO: 2010370 - RNA, 13 nt, Homo sapiens
uuguacuugaaua

SEQ ID NO: 2010371 - RNA, 14 nt, Homo sapiens
cccgguacagggcc

SEQ ID NO: 2010372 - RNA, 22 nt, Homo sapiens
auaccugccugggacagccacu

SEQ ID NO: 2010373 - RNA, 18 nt, Homo sapiens
ugcugacaacuuagcuca

SEQ ID NO: 2010374 - RNA, 22 nt, Homo sapiens
cagaaccuguccuugcacacuc

SEQ ID NO: 2010375 - RNA, 21 nt, Homo sapiens
ucacaauaggccaggggaguu

SEQ ID NO: 2010376 - RNA, 14 nt, Homo sapiens
auuauugacacuga

SEQ ID NO: 2010377 - RNA, 19 nt, Homo sapiens
cuuauuuugugaacuauau

SEQ ID NO: 2010378 - RNA, 17 nt, Homo sapiens
guccuucgcccugugca

SEQ ID NO: 2010379 - RNA, 19 nt, Homo sapiens
agucaguucucauuauuca

SEQ ID NO: 2010380 - RNA, 12 nt, Homo sapiens
cugcacacaccu

SEQ ID NO: 2010381 - RNA, 17 nt, Homo sapiens
uuugucaguguagauca

SEQ ID NO: 2010382 - RNA, 17 nt, Homo sapiens
cauccacaggauuccag

SEQ ID NO: 2010383 - RNA, 19 nt, Homo sapiens
agacauggaauuuaugaau

SEQ ID NO: 2010384 - RNA, 22 nt, Homo sapiens
auggcagugacuccccagccca

SEQ ID NO: 2010385 - RNA, 16 nt, Homo sapiens
auuuuuuaaacuguag

SEQ ID NO: 2010386 - RNA, 13 nt, Homo sapiens
agaauuacagacu

SEQ ID NO: 2010387 - RNA, 11 nt, Homo sapiens
uugcacuuaaa

SEQ ID NO: 2010388 - RNA, 14 nt, Homo sapiens
agaaagauuugaug

SEQ ID NO: 2010389 - RNA, 14 nt, Homo sapiens
uuaucuucauuuga

SEQ ID NO: 2010390 - RNA, 17 nt, Homo sapiens
uaaauacucagugauga

SEQ ID NO: 2010391 - RNA, 14 nt, Homo sapiens
caagugccauucau

SEQ ID NO: 2010392 - RNA, 16 nt, Homo sapiens
ugcaaauccuucaugu

SEQ ID NO: 2010393 - RNA, 15 nt, Homo sapiens
uauucuuuccaugac

SEQ ID NO: 2010394 - RNA, 16 nt, Homo sapiens
cacauccaucuacuuu

SEQ ID NO: 2010395 - RNA, 17 nt, Homo sapiens
caaacagaaaacaugua

SEQ ID NO: 2010396 - RNA, 22 nt, Homo sapiens
uccuaaauuguuguaauugcau

SEQ ID NO: 2010397 - RNA, 19 nt, Homo sapiens
uucucuccuccacucugag

SEQ ID NO: 2010398 - RNA, 15 nt, Homo sapiens
cuuuauagugcacaa

SEQ ID NO: 2010399 - RNA, 14 nt, Homo sapiens
auuccuugccaugu

SEQ ID NO: 2010400 - RNA, 18 nt, Homo sapiens
ucuaccuuuugcuacuua

SEQ ID NO: 2010401 - RNA, 22 nt, Homo sapiens
ucagaguggaguugaaacugcu

SEQ ID NO: 2010402 - RNA, 13 nt, Homo sapiens
gcaaaaucuacca

SEQ ID NO: 2010403 - RNA, 23 nt, Homo sapiens
gaaugugccucucucuugcuuac

SEQ ID NO: 2010404 - RNA, 17 nt, Homo sapiens
gaaaucagagcuggcag

SEQ ID NO: 2010405 - RNA, 13 nt, Homo sapiens
aaacccaccaaaa

SEQ ID NO: 2010406 - RNA, 17 nt, Homo sapiens
accucuuugucagucug

SEQ ID NO: 2010407 - RNA, 19 nt, Homo sapiens
aguauaugucauuuacuca

SEQ ID NO: 2010408 - RNA, 11 nt, Homo sapiens
auacaugacug

SEQ ID NO: 2010409 - RNA, 14 nt, Homo sapiens
cuacugaacuguua

SEQ ID NO: 2010410 - RNA, 16 nt, Homo sapiens
auuaaaaauauauuau

SEQ ID NO: 2010411 - RNA, 21 nt, Homo sapiens
guggugcagccccaggaccaa

SEQ ID NO: 2010412 - RNA, 20 nt, Homo sapiens
cauauugauacaaacuguga

SEQ ID NO: 2010413 - RNA, 14 nt, Homo sapiens
aaaaucuugagaau

SEQ ID NO: 2010414 - RNA, 11 nt, Homo sapiens
agaaaccaaac

SEQ ID NO: 2010415 - RNA, 17 nt, Homo sapiens
gcauuuccuaggauaaa

SEQ ID NO: 2010416 - RNA, 13 nt, Homo sapiens
ucuaccaacugga

SEQ ID NO: 2010417 - RNA, 20 nt, Homo sapiens
cagcaucuucccaaaaccau

SEQ ID NO: 2010418 - RNA, 19 nt, Homo sapiens
ugccccuggaccugggaac

SEQ ID NO: 2010419 - RNA, 23 nt, Homo sapiens
aagauguguucaggcauuccagg

SEQ ID NO: 2010420 - RNA, 23 nt, Homo sapiens
ggcaauaaagugagacccuguca

SEQ ID NO: 2010421 - RNA, 14 nt, Homo sapiens
uacuagauucauaa

SEQ ID NO: 2010422 - RNA, 14 nt, Homo sapiens
auaagaaugaaucu

SEQ ID NO: 2010423 - RNA, 20 nt, Homo sapiens
uaucagguguauaaauguac

SEQ ID NO: 2010424 - RNA, 22 nt, Homo sapiens
uuuuuaagaaauuuugccuuua

SEQ ID NO: 2010425 - RNA, 22 nt, Homo sapiens
gacauaaaauuuaaaaacuuaa

SEQ ID NO: 2010426 - RNA, 19 nt, Homo sapiens
ugaagcccagcgacacaga

SEQ ID NO: 2010427 - RNA, 15 nt, Homo sapiens
acacucugaauucca

SEQ ID NO: 2010428 - RNA, 20 nt, Homo sapiens
caggaagagcuguguggccu

SEQ ID NO: 2010429 - RNA, 20 nt, Homo sapiens
auguuguugaggcugucaca

SEQ ID NO: 2010430 - RNA, 15 nt, Homo sapiens
acuggcaucuaguca

SEQ ID NO: 2010431 - RNA, 20 nt, Homo sapiens
aaauauuaugcaaauuccca

SEQ ID NO: 2010432 - RNA, 12 nt, Homo sapiens
acuauaugcaaa

SEQ ID NO: 2010433 - RNA, 15 nt, Homo sapiens
aucauuaauucacau

SEQ ID NO: 2010434 - RNA, 15 nt, Homo sapiens
ucccugcacagugac

SEQ ID NO: 2010435 - RNA, 17 nt, Homo sapiens
ugagcuucacugucauc

SEQ ID NO: 2010436 - RNA, 21 nt, Homo sapiens
gggagccauggaaggugccag

SEQ ID NO: 2010437 - RNA, 15 nt, Homo sapiens
ucauguaaguagcaa

SEQ ID NO: 2010438 - RNA, 20 nt, Homo sapiens
uucacuaaugaucacauucu

SEQ ID NO: 2010439 - RNA, 11 nt, Homo sapiens
aucucuuccau

SEQ ID NO: 2010440 - RNA, 17 nt, Homo sapiens
aaauuauguauguuuac

SEQ ID NO: 2010441 - RNA, 12 nt, Homo sapiens
aguauucuugca

SEQ ID NO: 2010442 - RNA, 18 nt, Homo sapiens
guucaguaguuccaggac

SEQ ID NO: 2010443 - RNA, 16 nt, Homo sapiens
guguuguggacacugc

SEQ ID NO: 2010444 - RNA, 15 nt, Homo sapiens
cuuacuccacuucgc

SEQ ID NO: 2010445 - RNA, 18 nt, Homo sapiens
ucaaaugauacagucagg

SEQ ID NO: 2010446 - RNA, 13 nt, Homo sapiens
uacuagugccauu

SEQ ID NO: 2010447 - RNA, 20 nt, Homo sapiens
cauccuuuucaaaaccuaaa

SEQ ID NO: 2010448 - RNA, 18 nt, Homo sapiens
caacccagggugugaaca

SEQ ID NO: 2010449 - RNA, 22 nt, Homo sapiens
auccacgagaccaugaugcauu

SEQ ID NO: 2010450 - RNA, 20 nt, Homo sapiens
ucaaugaauuuuauaaucug

SEQ ID NO: 2010451 - RNA, 22 nt, Homo sapiens
aguagaaagcauaacaaaaaga

SEQ ID NO: 2010452 - RNA, 17 nt, Homo sapiens
aggccucucucugcucc

SEQ ID NO: 2010453 - RNA, 13 nt, Homo sapiens
gaagcucccagcu

SEQ ID NO: 2010454 - RNA, 22 nt, Homo sapiens
ggucugcuuaaagcuucccucu

SEQ ID NO: 2010455 - RNA, 15 nt, Homo sapiens
aagaaaacucaaaga

SEQ ID NO: 2010456 - RNA, 20 nt, Homo sapiens
aggcugucgugagcuaugau

SEQ ID NO: 2010457 - RNA, 21 nt, Homo sapiens
agaauuuaccucuuaugagcu

SEQ ID NO: 2010458 - RNA, 18 nt, Homo sapiens
caugucugccaaaaugca

SEQ ID NO: 2010459 - RNA, 18 nt, Homo sapiens
gccuuagcaauaauccag

SEQ ID NO: 2010460 - RNA, 21 nt, Homo sapiens
uguuuuaaauuuugugguucc

SEQ ID NO: 2010461 - RNA, 19 nt, Homo sapiens
ccagcacugauuuuguaca

SEQ ID NO: 2010462 - RNA, 15 nt, Homo sapiens
aaaauuggcagugua

SEQ ID NO: 2010463 - RNA, 18 nt, Homo sapiens
aacuuuucuaacagaaag

SEQ ID NO: 2010464 - RNA, 16 nt, Homo sapiens
ugaacccaagagcaag

SEQ ID NO: 2010465 - RNA, 19 nt, Homo sapiens
gccugugguuacagugcag

SEQ ID NO: 2010466 - RNA, 19 nt, Homo sapiens
aauuauuuuuucuaugaac

SEQ ID NO: 2010467 - RNA, 20 nt, Homo sapiens
agcacagggggaagaagaag

SEQ ID NO: 2010468 - RNA, 17 nt, Homo sapiens
ugccaugcuggccaggc

SEQ ID NO: 2010469 - RNA, 12 nt, Homo sapiens
ucauuugcaguc

SEQ ID NO: 2010470 - RNA, 18 nt, Homo sapiens
auugcuaccucuuuguca

SEQ ID NO: 2010471 - RNA, 19 nt, Homo sapiens
ggguggcgcuggugcauuc

SEQ ID NO: 2010472 - RNA, 22 nt, Homo sapiens
caucugaaccacuuugccucug

SEQ ID NO: 2010473 - RNA, 19 nt, Homo sapiens
ugacugauccugaacaaga

SEQ ID NO: 2010474 - RNA, 13 nt, Homo sapiens
ucaaaaauacaaa

SEQ ID NO: 2010475 - RNA, 21 nt, Homo sapiens
gcgcaagacagcccaacagcu

SEQ ID NO: 2010476 - RNA, 15 nt, Homo sapiens
aauugaccaagugau

SEQ ID NO: 2010477 - RNA, 18 nt, Homo sapiens
agaaaucguagacaagca

SEQ ID NO: 2010478 - RNA, 18 nt, Homo sapiens
agugcuaaacaaguaaga

SEQ ID NO: 2010479 - RNA, 18 nt, Homo sapiens
aauauuccuaugcugcaa

SEQ ID NO: 2010480 - RNA, 17 nt, Homo sapiens
guaacagacuggcucca

SEQ ID NO: 2010481 - RNA, 16 nt, Homo sapiens
ccaacagcuuuuccca

SEQ ID NO: 2010482 - RNA, 14 nt, Homo sapiens
auucaugguucaag

SEQ ID NO: 2010483 - RNA, 14 nt, Homo sapiens
uaaaaaucauguga

SEQ ID NO: 2010484 - RNA, 18 nt, Homo sapiens
uugcauagcagcugcuac

SEQ ID NO: 2010485 - RNA, 21 nt, Homo sapiens
aggaaugcuuccgagacacca

SEQ ID NO: 2010486 - RNA, 13 nt, Homo sapiens
accucucauaaau

SEQ ID NO: 2010487 - RNA, 18 nt, Homo sapiens
gcucucccaacucuugca

SEQ ID NO: 2010488 - RNA, 21 nt, Homo sapiens
uguucuacaugaggacucaua

SEQ ID NO: 2010489 - RNA, 15 nt, Homo sapiens
aauccuagcacuuug

SEQ ID NO: 2010490 - RNA, 22 nt, Homo sapiens
acauuuaucuguacauacuuuu

SEQ ID NO: 2010491 - RNA, 19 nt, Homo sapiens
ccuacuagucaccagagac

SEQ ID NO: 2010492 - RNA, 18 nt, Homo sapiens
caaguguagguaucauuu

SEQ ID NO: 2010493 - RNA, 22 nt, Homo sapiens
aauucugggugcgagugugaga

SEQ ID NO: 2010494 - RNA, 21 nt, Homo sapiens
gccuccauguagaacuugaac

SEQ ID NO: 2010495 - RNA, 23 nt, Homo sapiens
ggaacucugcuugauuuuugccu

SEQ ID NO: 2010496 - RNA, 18 nt, Homo sapiens
cagcaaggggacaucuua

SEQ ID NO: 2010497 - RNA, 17 nt, Homo sapiens
aagguguuuccauuucu

SEQ ID NO: 2010498 - RNA, 13 nt, Homo sapiens
uucuccuuguaaa

SEQ ID NO: 2010499 - RNA, 16 nt, Homo sapiens
acacggaucugacaga

SEQ ID NO: 2010500 - RNA, 19 nt, Homo sapiens
gucucccuggccccaguga

SEQ ID NO: 2010501 - RNA, 16 nt, Homo sapiens
gauacaguucagguga

SEQ ID NO: 2010502 - RNA, 21 nt, Homo sapiens
aauguuuuacauuccauuuca

SEQ ID NO: 2010503 - RNA, 15 nt, Homo sapiens
gcgcuggacacucuc

SEQ ID NO: 2010504 - RNA, 14 nt, Homo sapiens
gaagaccucaagaa

SEQ ID NO: 2010505 - RNA, 14 nt, Homo sapiens
cugacacugugacc

SEQ ID NO: 2010506 - RNA, 18 nt, Homo sapiens
guugaaccguuucuuuaa

SEQ ID NO: 2010507 - RNA, 16 nt, Homo sapiens
cggagccugugcagcc

SEQ ID NO: 2010508 - RNA, 18 nt, Homo sapiens
caggaagaguucuauccc

SEQ ID NO: 2010509 - RNA, 15 nt, Homo sapiens
cagagaccauugcaa

SEQ ID NO: 2010510 - RNA, 15 nt, Homo sapiens
uaccuucaccaucug

SEQ ID NO: 2010511 - RNA, 13 nt, Homo sapiens
uguaugauaaaca

SEQ ID NO: 2010512 - RNA, 23 nt, Homo sapiens
augagaagucacucacuauugca

SEQ ID NO: 2010513 - RNA, 10 nt, Homo sapiens
caaagccaaa

SEQ ID NO: 2010514 - RNA, 15 nt, Homo sapiens
agcugauggccuugu

SEQ ID NO: 2010515 - RNA, 11 nt, Homo sapiens
aucaagccaua

SEQ ID NO: 2010516 - RNA, 14 nt, Homo sapiens
cgauugaaggugac

SEQ ID NO: 2010517 - RNA, 23 nt, Homo sapiens
gggacagacgaaggcaaccauuu

SEQ ID NO: 2010518 - RNA, 20 nt, Homo sapiens
cccuugcacaggccacuugc

SEQ ID NO: 2010519 - RNA, 23 nt, Homo sapiens
aaccugaauauaaauuuguguuc

SEQ ID NO: 2010520 - RNA, 11 nt, Homo sapiens
ccacagacuca

SEQ ID NO: 2010521 - RNA, 21 nt, Homo sapiens
uggaccacuccugaaugagac

SEQ ID NO: 2010522 - RNA, 20 nt, Homo sapiens
cacuuagacacuuuaccucu

SEQ ID NO: 2010523 - RNA, 14 nt, Homo sapiens
aggacucgcgcuac

SEQ ID NO: 2010524 - RNA, 19 nt, Homo sapiens
gaggccuccacuccuucca

SEQ ID NO: 2010525 - RNA, 16 nt, Homo sapiens
agaggcugcaaggauu

SEQ ID NO: 2010526 - RNA, 17 nt, Homo sapiens
uuauaaagacacaugca

SEQ ID NO: 2010527 - RNA, 20 nt, Homo sapiens
gcguuguguguuuucuggga

SEQ ID NO: 2010528 - RNA, 15 nt, Homo sapiens
acuauuugagguuaa

SEQ ID NO: 2010529 - RNA, 17 nt, Homo sapiens
agaauccaguuugcaau

SEQ ID NO: 2010530 - RNA, 17 nt, Homo sapiens
uaaguucagcacuuguc

SEQ ID NO: 2010531 - RNA, 21 nt, Homo sapiens
ggcugagugaaaacaucugca

SEQ ID NO: 2010532 - RNA, 19 nt, Homo sapiens
cauccaaagaacaucugca

SEQ ID NO: 2010533 - RNA, 20 nt, Homo sapiens
ucugauuuuggccaucagga

SEQ ID NO: 2010534 - RNA, 14 nt, Homo sapiens
guccccaccuaagc

SEQ ID NO: 2010535 - RNA, 20 nt, Homo sapiens
caauaaaagauaagugcagu

SEQ ID NO: 2010536 - RNA, 15 nt, Homo sapiens
gacacccacccugug

SEQ ID NO: 2010537 - RNA, 22 nt, Homo sapiens
aucaauaguguccuaugcaaua

SEQ ID NO: 2010538 - RNA, 18 nt, Homo sapiens
uucuguggcugccaucag

SEQ ID NO: 2010539 - RNA, 13 nt, Homo sapiens
auucauaauaugu

SEQ ID NO: 2010540 - RNA, 13 nt, Homo sapiens
uagguuaaaugca

SEQ ID NO: 2010541 - RNA, 17 nt, Homo sapiens
uuuugugaaguauucac

SEQ ID NO: 2010542 - RNA, 15 nt, Homo sapiens
uaaaaaucccaaaca

SEQ ID NO: 2010543 - RNA, 14 nt, Homo sapiens
caggccuacuguaa

SEQ ID NO: 2010544 - RNA, 15 nt, Homo sapiens
ugccagcucccaugu

SEQ ID NO: 2010545 - RNA, 17 nt, Homo sapiens
uuacccuaguucucuua

SEQ ID NO: 2010546 - RNA, 19 nt, Homo sapiens
aaccuauuucccuugccuc

SEQ ID NO: 2010547 - RNA, 16 nt, Homo sapiens
aagucucucuucugaa

SEQ ID NO: 2010548 - RNA, 16 nt, Homo sapiens
gccuaggaggccuucu

SEQ ID NO: 2010549 - RNA, 19 nt, Homo sapiens
auugaugagcacuccugau

SEQ ID NO: 2010550 - RNA, 11 nt, Homo sapiens
cagagcuccac

SEQ ID NO: 2010551 - RNA, 18 nt, Homo sapiens
agggaggcucugucucaa

SEQ ID NO: 2010552 - RNA, 17 nt, Homo sapiens
uuugagauucauauguc

SEQ ID NO: 2010553 - RNA, 18 nt, Homo sapiens
cagagaugaacaucuaac

SEQ ID NO: 2010554 - RNA, 18 nt, Homo sapiens
ucucacuauguugcccag

SEQ ID NO: 2010555 - RNA, 18 nt, Homo sapiens
gauggaggccuaccucuc

SEQ ID NO: 2010556 - RNA, 17 nt, Homo sapiens
ugaagcuaaugugaaug

SEQ ID NO: 2010557 - RNA, 19 nt, Homo sapiens
ugccccaucauugcaccug

SEQ ID NO: 2010558 - RNA, 16 nt, Homo sapiens
ugggggguggccugug

SEQ ID NO: 2010559 - RNA, 14 nt, Homo sapiens
ucuugaucugcuca

SEQ ID NO: 2010560 - RNA, 14 nt, Homo sapiens
guacacgugcacag

SEQ ID NO: 2010561 - RNA, 13 nt, Homo sapiens
aaaguugaugcua

SEQ ID NO: 2010562 - RNA, 17 nt, Homo sapiens
cuccuuaucaaaggaca

SEQ ID NO: 2010563 - RNA, 22 nt, Homo sapiens
gacauauuaugccugaaugacu

SEQ ID NO: 2010564 - RNA, 14 nt, Homo sapiens
gaccccuccucacu

SEQ ID NO: 2010565 - RNA, 14 nt, Homo sapiens
aguugaaagggaua

SEQ ID NO: 2010566 - RNA, 20 nt, Homo sapiens
gaaaugcuaugucauuucau

SEQ ID NO: 2010567 - RNA, 24 nt, Homo sapiens
guuagucaauccugucauauaaua

SEQ ID NO: 2010568 - RNA, 17 nt, Homo sapiens
aaagaaaauugccaaaa

SEQ ID NO: 2010569 - RNA, 23 nt, Homo sapiens
caggggucauagagcccagugag

SEQ ID NO: 2010570 - RNA, 20 nt, Homo sapiens
acagcuucacuagaguucuu

SEQ ID NO: 2010571 - RNA, 22 nt, Homo sapiens
cugaaauucuucaacuuggaaa

SEQ ID NO: 2010572 - RNA, 23 nt, Homo sapiens
guaucccugaggaaaaguccaca

SEQ ID NO: 2010573 - RNA, 16 nt, Homo sapiens
gccagagcaaacagaa

SEQ ID NO: 2010574 - RNA, 17 nt, Homo sapiens
uauuuauaaaugagcaa

SEQ ID NO: 2010575 - RNA, 15 nt, Homo sapiens
aaucugccuauugca

SEQ ID NO: 2010576 - RNA, 21 nt, Homo sapiens
uagauguuuauucuucuagag

SEQ ID NO: 2010577 - RNA, 17 nt, Homo sapiens
ucugaaauauagguuua

SEQ ID NO: 2010578 - RNA, 22 nt, Homo sapiens
ucccugguuaauucagcuugag

SEQ ID NO: 2010579 - RNA, 11 nt, Homo sapiens
auaauugucaa

SEQ ID NO: 2010580 - RNA, 14 nt, Homo sapiens
ugagugugugaaca

SEQ ID NO: 2010581 - RNA, 14 nt, Homo sapiens
uguguguguguaca

SEQ ID NO: 2010582 - RNA, 12 nt, Homo sapiens
ucuauccaaauc

SEQ ID NO: 2010583 - RNA, 12 nt, Homo sapiens
ggagacuggaaa

SEQ ID NO: 2010584 - RNA, 21 nt, Homo sapiens
auucccaggaguucugcucau

SEQ ID NO: 2010585 - RNA, 18 nt, Homo sapiens
gugagaccuuggcgcuac

SEQ ID NO: 2010586 - RNA, 16 nt, Homo sapiens
cagguuuccugacucc

SEQ ID NO: 2010587 - RNA, 12 nt, Homo sapiens
agcuuucuugcu

SEQ ID NO: 2010588 - RNA, 21 nt, Homo sapiens
aguuuuccucuauacaucucu

SEQ ID NO: 2010589 - RNA, 14 nt, Homo sapiens
uuuaccuaaucucc

SEQ ID NO: 2010590 - RNA, 17 nt, Homo sapiens
acgagauaccaucucac

SEQ ID NO: 2010591 - RNA, 16 nt, Homo sapiens
gcuugguguaaaccau

SEQ ID NO: 2010592 - RNA, 21 nt, Homo sapiens
caacuaaaaaaauuuuugaca

SEQ ID NO: 2010593 - RNA, 21 nt, Homo sapiens
aagaaccuuuugagugccuua

SEQ ID NO: 2010594 - RNA, 20 nt, Homo sapiens
gaagcccucggccuccagac

SEQ ID NO: 2010595 - RNA, 14 nt, Homo sapiens
gguacauauuucuu

SEQ ID NO: 2010596 - RNA, 19 nt, Homo sapiens
cuaaagaaaaagucaucca

SEQ ID NO: 2010597 - RNA, 18 nt, Homo sapiens
cuagggacuuucuaagaa

SEQ ID NO: 2010598 - RNA, 19 nt, Homo sapiens
caaggugacacauuacaaa

SEQ ID NO: 2010599 - RNA, 16 nt, Homo sapiens
ugggauugugguacaa

SEQ ID NO: 2010600 - RNA, 13 nt, Homo sapiens
cuggaaccacagg

SEQ ID NO: 2010601 - RNA, 13 nt, Homo sapiens
cugggaccacaga

SEQ ID NO: 2010602 - RNA, 20 nt, Homo sapiens
uuauagaccagaaccagagc

SEQ ID NO: 2010603 - RNA, 12 nt, Homo sapiens
auaagcagaguu

SEQ ID NO: 2010604 - RNA, 12 nt, Homo sapiens
aaagacaauucu

SEQ ID NO: 2010605 - RNA, 23 nt, Homo sapiens
uaaaacauuuguuucccccacag

SEQ ID NO: 2010606 - RNA, 23 nt, Homo sapiens
aaugagaaacuuugaucucugcu

SEQ ID NO: 2010607 - RNA, 23 nt, Homo sapiens
uagaacgcaacuuaggauggcua

SEQ ID NO: 2010608 - RNA, 22 nt, Homo sapiens
aucccucaaaacaaucuuguca

SEQ ID NO: 2010609 - RNA, 13 nt, Homo sapiens
aaauaauugccaa

SEQ ID NO: 2010610 - RNA, 23 nt, Homo sapiens
uuuuguagaugaacucuucucaa

SEQ ID NO: 2010611 - RNA, 14 nt, Homo sapiens
cacuguuucucuca

SEQ ID NO: 2010612 - RNA, 13 nt, Homo sapiens
uacucaucaucaa

SEQ ID NO: 2010613 - RNA, 14 nt, Homo sapiens
guccaucagccucc

SEQ ID NO: 2010614 - RNA, 21 nt, Homo sapiens
auggagcccaguuggaaaauu

SEQ ID NO: 2010615 - RNA, 19 nt, Homo sapiens
acuucuauaccacacagaa

SEQ ID NO: 2010616 - RNA, 22 nt, Homo sapiens
cucaucauuaauaagugaagaa

SEQ ID NO: 2010617 - RNA, 18 nt, Homo sapiens
acaaugacuaaagacaua

SEQ ID NO: 2010618 - RNA, 18 nt, Homo sapiens
ugccccccuccuuuccaa

SEQ ID NO: 2010619 - RNA, 23 nt, Homo sapiens
uucugcagguugaagccaugucu

SEQ ID NO: 2010620 - RNA, 20 nt, Homo sapiens
aauuucauagcuguacuucu

SEQ ID NO: 2010621 - RNA, 21 nt, Homo sapiens
ccaccucacugcaguagugca

SEQ ID NO: 2010622 - RNA, 20 nt, Homo sapiens
caaagggccugcccagacaa

SEQ ID NO: 2010623 - RNA, 15 nt, Homo sapiens
cuucaacaugcauau

SEQ ID NO: 2010624 - RNA, 20 nt, Homo sapiens
cacuggguuacagaaucaca

SEQ ID NO: 2010625 - RNA, 23 nt, Homo sapiens
cuccuggcaaucaauacagcuuc

SEQ ID NO: 2010626 - RNA, 22 nt, Homo sapiens
uacaggggccagaagaugaaca

SEQ ID NO: 2010627 - RNA, 15 nt, Homo sapiens
ugggaaaguugcauu

SEQ ID NO: 2010628 - RNA, 17 nt, Homo sapiens
gguguaagccuucaaag

SEQ ID NO: 2010629 - RNA, 16 nt, Homo sapiens
gggaccucccaggaca

SEQ ID NO: 2010630 - RNA, 16 nt, Homo sapiens
uccagauaugugccaa

SEQ ID NO: 2010631 - RNA, 12 nt, Homo sapiens
acuggccuccag

SEQ ID NO: 2010632 - RNA, 21 nt, Homo sapiens
aguacuuccugcaguacaaga

SEQ ID NO: 2010633 - RNA, 20 nt, Homo sapiens
agaacucccccaccuguggu

SEQ ID NO: 2010634 - RNA, 14 nt, Homo sapiens
acagcucuucucca

SEQ ID NO: 2010635 - RNA, 20 nt, Homo sapiens
caucugugcaguaagccugu

SEQ ID NO: 2010636 - RNA, 17 nt, Homo sapiens
cuuggcuucugugauga

SEQ ID NO: 2010637 - RNA, 18 nt, Homo sapiens
caaaugucuaccaacuga

SEQ ID NO: 2010638 - RNA, 16 nt, Homo sapiens
ugggugacuaucuccc

SEQ ID NO: 2010639 - RNA, 16 nt, Homo sapiens
uugggcaggaacacag

SEQ ID NO: 2010640 - RNA, 19 nt, Homo sapiens
accaguuuaaauugguuca

SEQ ID NO: 2010641 - RNA, 13 nt, Homo sapiens
gacaaggugcuaa

SEQ ID NO: 2010642 - RNA, 21 nt, Homo sapiens
gcacccacccaagacaaguga

SEQ ID NO: 2010643 - RNA, 22 nt, Homo sapiens
aucaacuuauuuuucaccaggu

SEQ ID NO: 2010644 - RNA, 12 nt, Homo sapiens
acccgaacuggc

SEQ ID NO: 2010645 - RNA, 14 nt, Homo sapiens
ugagguccugucua

SEQ ID NO: 2010646 - RNA, 18 nt, Homo sapiens
agagccugaagcuggccu

SEQ ID NO: 2010647 - RNA, 20 nt, Homo sapiens
gcuacagagccgagcaauau

SEQ ID NO: 2010648 - RNA, 14 nt, Homo sapiens
ucaguuggugcugc

SEQ ID NO: 2010649 - RNA, 14 nt, Homo sapiens
augcuuggauguaa

SEQ ID NO: 2010650 - RNA, 20 nt, Homo sapiens
aaccuccccaacagcacuua

SEQ ID NO: 2010651 - RNA, 18 nt, Homo sapiens
uugggaaaauaucacuuu

SEQ ID NO: 2010652 - RNA, 22 nt, Homo sapiens
agcacgcuggacagcacucugc

SEQ ID NO: 2010653 - RNA, 22 nt, Homo sapiens
ccaagcacccuuccacuuccau

SEQ ID NO: 2010654 - RNA, 23 nt, Homo sapiens
cuggagauaacagccucuugccc

SEQ ID NO: 2010655 - RNA, 14 nt, Homo sapiens
ccuguggagcucag

SEQ ID NO: 2010656 - RNA, 21 nt, Homo sapiens
acacuuguaaauaaagcugau

SEQ ID NO: 2010657 - RNA, 13 nt, Homo sapiens
auacuucauucuc

SEQ ID NO: 2010658 - RNA, 11 nt, Homo sapiens
ccagacuccag

SEQ ID NO: 2010659 - RNA, 14 nt, Homo sapiens
aaagcgcugcagua

SEQ ID NO: 2010660 - RNA, 22 nt, Homo sapiens
auauuaucacgcagaucacuaa

SEQ ID NO: 2010661 - RNA, 17 nt, Homo sapiens
gccuggacuuuccugca

SEQ ID NO: 2010662 - RNA, 15 nt, Homo sapiens
ggaaggaagagcaag

SEQ ID NO: 2010663 - RNA, 13 nt, Homo sapiens
cccugcgggucac

SEQ ID NO: 2010664 - RNA, 18 nt, Homo sapiens
cucuguccucucauccca

SEQ ID NO: 2010665 - RNA, 14 nt, Homo sapiens
uccaguucaaauaa

SEQ ID NO: 2010666 - RNA, 14 nt, Homo sapiens
acagggaggggaug

SEQ ID NO: 2010667 - RNA, 23 nt, Homo sapiens
caaaaccggguugccagcuccca

SEQ ID NO: 2010668 - RNA, 12 nt, Homo sapiens
aauccacaauaa

SEQ ID NO: 2010669 - RNA, 17 nt, Homo sapiens
ucuuagcucuaccggga

SEQ ID NO: 2010670 - RNA, 20 nt, Homo sapiens
uccuaagcuggagugcagug

SEQ ID NO: 2010671 - RNA, 17 nt, Homo sapiens
ggcccagagcaggaagc

SEQ ID NO: 2010672 - RNA, 19 nt, Homo sapiens
ggcccuguggcuccaggag

SEQ ID NO: 2010673 - RNA, 17 nt, Homo sapiens
cuucuuccuauuguaau

SEQ ID NO: 2010674 - RNA, 16 nt, Homo sapiens
cuguuuccuagcugug

SEQ ID NO: 2010675 - RNA, 17 nt, Homo sapiens
uugacacggccaugacc

SEQ ID NO: 2010676 - RNA, 17 nt, Homo sapiens
acgaaggccuguguguu

SEQ ID NO: 2010677 - RNA, 14 nt, Homo sapiens
agcauggggcuugu

SEQ ID NO: 2010678 - RNA, 18 nt, Homo sapiens
gacaugggccccagauac

SEQ ID NO: 2010679 - RNA, 16 nt, Homo sapiens
aagguaacuacugcua

SEQ ID NO: 2010680 - RNA, 23 nt, Homo sapiens
gggauuccaccuacuuauuucag

SEQ ID NO: 2010681 - RNA, 17 nt, Homo sapiens
uuauaguuaaucuauaa

SEQ ID NO: 2010682 - RNA, 19 nt, Homo sapiens
caggaacugaaaaccaguc

SEQ ID NO: 2010683 - RNA, 15 nt, Homo sapiens
uuccugaauacugaa

SEQ ID NO: 2010684 - RNA, 23 nt, Homo sapiens
uccuccuuaugacuccauucaaa

SEQ ID NO: 2010685 - RNA, 11 nt, Homo sapiens
acacagugaaa

SEQ ID NO: 2010686 - RNA, 20 nt, Homo sapiens
acacuuaugggccaagccca

SEQ ID NO: 2010687 - RNA, 18 nt, Homo sapiens
cugaucugugcuuuccag

SEQ ID NO: 2010688 - RNA, 17 nt, Homo sapiens
gcaccgccggcuuucag

SEQ ID NO: 2010689 - RNA, 18 nt, Homo sapiens
ucaucuucacugcaauuu

SEQ ID NO: 2010690 - RNA, 21 nt, Homo sapiens
agagcaggcuggcagcucucc

SEQ ID NO: 2010691 - RNA, 17 nt, Homo sapiens
auagcugucacaguaua

SEQ ID NO: 2010692 - RNA, 18 nt, Homo sapiens
caaaauuuuucaacccca

SEQ ID NO: 2010693 - RNA, 18 nt, Homo sapiens
caaaauacagcuaugaag

SEQ ID NO: 2010694 - RNA, 22 nt, Homo sapiens
auccaguguauaaauccaauau

SEQ ID NO: 2010695 - RNA, 17 nt, Homo sapiens
cagaaaccauuguucag

SEQ ID NO: 2010696 - RNA, 22 nt, Homo sapiens
uggagaacuaaagguggccaca

SEQ ID NO: 2010697 - RNA, 20 nt, Homo sapiens
aggggccagaagaugaacag

SEQ ID NO: 2010698 - RNA, 15 nt, Homo sapiens
uguggguauucacca

SEQ ID NO: 2010699 - RNA, 15 nt, Homo sapiens
aaguaauaucuuuca

SEQ ID NO: 2010700 - RNA, 14 nt, Homo sapiens
acacaucaguccac

SEQ ID NO: 2010701 - RNA, 23 nt, Homo sapiens
uaaacaucuccccucucaccuca

SEQ ID NO: 2010702 - RNA, 19 nt, Homo sapiens
auuuuuuuuuaacacuguc

SEQ ID NO: 2010703 - RNA, 17 nt, Homo sapiens
uuaauuguuaagauaug

SEQ ID NO: 2010704 - RNA, 20 nt, Homo sapiens
caagaauugaguaucacuuu

SEQ ID NO: 2010705 - RNA, 18 nt, Homo sapiens
gcuccauacacacgcugc

SEQ ID NO: 2010706 - RNA, 15 nt, Homo sapiens
ggugagugugcagua

SEQ ID NO: 2010707 - RNA, 13 nt, Homo sapiens
aauacaaaaaagu

SEQ ID NO: 2010708 - RNA, 18 nt, Homo sapiens
uaaagagaaacuuugugc

SEQ ID NO: 2010709 - RNA, 16 nt, Homo sapiens
caguugaucaaugaau

SEQ ID NO: 2010710 - RNA, 17 nt, Homo sapiens
uacccccaccacuaaga

SEQ ID NO: 2010711 - RNA, 14 nt, Homo sapiens
cuuuguaugacagu

SEQ ID NO: 2010712 - RNA, 19 nt, Homo sapiens
uuucguuuagaaucagaau

SEQ ID NO: 2010713 - RNA, 16 nt, Homo sapiens
uaguucagccauugug

SEQ ID NO: 2010714 - RNA, 22 nt, Homo sapiens
cagauacccauccaacuccucu

SEQ ID NO: 2010715 - RNA, 14 nt, Homo sapiens
aggaauuucaagaa

SEQ ID NO: 2010716 - RNA, 21 nt, Homo sapiens
ggcagaaacaaaaugacugua

SEQ ID NO: 2010717 - RNA, 18 nt, Homo sapiens
ugucauuuuuaacagcau

SEQ ID NO: 2010718 - RNA, 20 nt, Homo sapiens
uaaauauauauuucuaauau

SEQ ID NO: 2010719 - RNA, 22 nt, Homo sapiens
uauacccccccaugcagucuaa

SEQ ID NO: 2010720 - RNA, 14 nt, Homo sapiens
uuuucaguaggcuu

SEQ ID NO: 2010721 - RNA, 16 nt, Homo sapiens
gaaagaauaaacuuac

SEQ ID NO: 2010722 - RNA, 17 nt, Homo sapiens
ucuuagaguuuacaguu

SEQ ID NO: 2010723 - RNA, 18 nt, Homo sapiens
gugguuagagcugcucag

SEQ ID NO: 2010724 - RNA, 22 nt, Homo sapiens
auuggcuuuucauagugcucag

SEQ ID NO: 2010725 - RNA, 15 nt, Homo sapiens
cucugagugcuagcu

SEQ ID NO: 2010726 - RNA, 19 nt, Homo sapiens
cccaaaugugugcccagcu

SEQ ID NO: 2010727 - RNA, 22 nt, Homo sapiens
uccacuuguucuguacuuguaa

SEQ ID NO: 2010728 - RNA, 17 nt, Homo sapiens
ccuucacuguugcuuaa

SEQ ID NO: 2010729 - RNA, 16 nt, Homo sapiens
aguuauagcuucuuaa

SEQ ID NO: 2010730 - RNA, 19 nt, Homo sapiens
auggggcacugacagagaa

SEQ ID NO: 2010731 - RNA, 14 nt, Homo sapiens
gucucuccagugaa

SEQ ID NO: 2010732 - RNA, 12 nt, Homo sapiens
agugcugcagua

SEQ ID NO: 2010733 - RNA, 18 nt, Homo sapiens
uccuuggguauccccaac

SEQ ID NO: 2010734 - RNA, 16 nt, Homo sapiens
agcaauucuccugccu

SEQ ID NO: 2010735 - RNA, 19 nt, Homo sapiens
uccaggagaccuuccacaa

SEQ ID NO: 2010736 - RNA, 15 nt, Homo sapiens
agguaguuuggauau

SEQ ID NO: 2010737 - RNA, 23 nt, Homo sapiens
uccaucaggcagauaacugcugu

SEQ ID NO: 2010738 - RNA, 18 nt, Homo sapiens
cugggccugcuuuuccag

SEQ ID NO: 2010739 - RNA, 15 nt, Homo sapiens
gaaggacuggugcga

SEQ ID NO: 2010740 - RNA, 18 nt, Homo sapiens
gaauucugacuuacuuaa

SEQ ID NO: 2010741 - RNA, 12 nt, Homo sapiens
agacgcagcccu

SEQ ID NO: 2010742 - RNA, 22 nt, Homo sapiens
guuuaauugugauauuugacag

SEQ ID NO: 2010743 - RNA, 15 nt, Homo sapiens
uauacuguuauccau

SEQ ID NO: 2010744 - RNA, 13 nt, Homo sapiens
cuuaaagugaauu

SEQ ID NO: 2010745 - RNA, 18 nt, Homo sapiens
ggauccgugacagcacuu

SEQ ID NO: 2010746 - RNA, 16 nt, Homo sapiens
cccaagaaauguaaua

SEQ ID NO: 2010747 - RNA, 15 nt, Homo sapiens
gucuggaugcacaga

SEQ ID NO: 2010748 - RNA, 19 nt, Homo sapiens
ugaauguguugauuugaga

SEQ ID NO: 2010749 - RNA, 20 nt, Homo sapiens
ggagggcucgggguguguca

SEQ ID NO: 2010750 - RNA, 16 nt, Homo sapiens
aauucguuuuugcaau

SEQ ID NO: 2010751 - RNA, 15 nt, Homo sapiens
ucucguacuuucaca

SEQ ID NO: 2010752 - RNA, 20 nt, Homo sapiens
caugagacaauuuugcuuca

SEQ ID NO: 2010753 - RNA, 17 nt, Homo sapiens
auuuuguucauacauau

SEQ ID NO: 2010754 - RNA, 17 nt, Homo sapiens
cauuacugcaugcacuu

SEQ ID NO: 2010755 - RNA, 14 nt, Homo sapiens
cagcacugccagug

SEQ ID NO: 2010756 - RNA, 19 nt, Homo sapiens
uccccaacgaaaagcacau

SEQ ID NO: 2010757 - RNA, 16 nt, Homo sapiens
cgcauccucuuccauu

SEQ ID NO: 2010758 - RNA, 14 nt, Homo sapiens
cagcaaagugguuc

SEQ ID NO: 2010759 - RNA, 23 nt, Homo sapiens
ggcagccugaacacucaguugca

SEQ ID NO: 2010760 - RNA, 14 nt, Homo sapiens
cauguuauggugcu

SEQ ID NO: 2010761 - RNA, 14 nt, Homo sapiens
cuguuugcugugga

SEQ ID NO: 2010762 - RNA, 17 nt, Homo sapiens
aacacaaagacauggaa

SEQ ID NO: 2010763 - RNA, 14 nt, Homo sapiens
acagucacauucag

SEQ ID NO: 2010764 - RNA, 21 nt, Homo sapiens
cauauuuucuguccagucaau

SEQ ID NO: 2010765 - RNA, 20 nt, Homo sapiens
uggguugacuccugagcaua

SEQ ID NO: 2010766 - RNA, 15 nt, Homo sapiens
uggcaaagugcugua

SEQ ID NO: 2010767 - RNA, 22 nt, Homo sapiens
ugaccuuguugcaugauguauu

SEQ ID NO: 2010768 - RNA, 21 nt, Homo sapiens
uguacuguaauagugugauua

SEQ ID NO: 2010769 - RNA, 21 nt, Homo sapiens
uccaggaagaccccagcacag

SEQ ID NO: 2010770 - RNA, 15 nt, Homo sapiens
auucuauacuguuga

SEQ ID NO: 2010771 - RNA, 18 nt, Homo sapiens
caugagacucagugcaga

SEQ ID NO: 2010772 - RNA, 19 nt, Homo sapiens
cagcuccccuucugaauca

SEQ ID NO: 2010773 - RNA, 20 nt, Homo sapiens
aaaccauaccacacacauua

SEQ ID NO: 2010774 - RNA, 23 nt, Homo sapiens
uaggcggucaugugugcauguga

SEQ ID NO: 2010775 - RNA, 18 nt, Homo sapiens
ccuucuuucacaggcauc

SEQ ID NO: 2010776 - RNA, 13 nt, Homo sapiens
ccaguguccucca

SEQ ID NO: 2010777 - RNA, 23 nt, Homo sapiens
caggagcucaguuucuuuuucac

SEQ ID NO: 2010778 - RNA, 11 nt, Homo sapiens
cugcagggucc

SEQ ID NO: 2010779 - RNA, 22 nt, Homo sapiens
caacagaaguaucaagccaugu

SEQ ID NO: 2010780 - RNA, 10 nt, Homo sapiens
ugacccugua

SEQ ID NO: 2010781 - RNA, 12 nt, Homo sapiens
acuucuguuacu

SEQ ID NO: 2010782 - RNA, 22 nt, Homo sapiens
cuuugccaauucauuucucuau

SEQ ID NO: 2010783 - RNA, 21 nt, Homo sapiens
uagacuggugacugauucuuc

SEQ ID NO: 2010784 - RNA, 18 nt, Homo sapiens
cacuucuucuucuagaau

SEQ ID NO: 2010785 - RNA, 19 nt, Homo sapiens
agggcugggcuccacuuca

SEQ ID NO: 2010786 - RNA, 15 nt, Homo sapiens
caucaaguugcacac

SEQ ID NO: 2010787 - RNA, 19 nt, Homo sapiens
uacauuccaucacagccag

SEQ ID NO: 2010788 - RNA, 15 nt, Homo sapiens
cugcacguugugcac

SEQ ID NO: 2010789 - RNA, 19 nt, Homo sapiens
uccuucuaauuuuucagcu

SEQ ID NO: 2010790 - RNA, 21 nt, Homo sapiens
cccuugugagagcccauuccc

SEQ ID NO: 2010791 - RNA, 23 nt, Homo sapiens
ccuguaucucucacuauuaucua

SEQ ID NO: 2010792 - RNA, 20 nt, Homo sapiens
aggaggaagaauagggccca

SEQ ID NO: 2010793 - RNA, 23 nt, Homo sapiens
ucagguuugggguucguggaaag

SEQ ID NO: 2010794 - RNA, 19 nt, Homo sapiens
ugcaacauuuuaaggcaau

SEQ ID NO: 2010795 - RNA, 16 nt, Homo sapiens
caacauuuguuuuagu

SEQ ID NO: 2010796 - RNA, 22 nt, Homo sapiens
ucaucaggcuuggaaugaauuc

SEQ ID NO: 2010797 - RNA, 19 nt, Homo sapiens
aaagucuuaacaacagcuu

SEQ ID NO: 2010798 - RNA, 21 nt, Homo sapiens
ggauauuuaggguacuauuca

SEQ ID NO: 2010799 - RNA, 13 nt, Homo sapiens
aaugcagcuuuaa

SEQ ID NO: 2010800 - RNA, 13 nt, Homo sapiens
uauacagcauuga

SEQ ID NO: 2010801 - RNA, 14 nt, Homo sapiens
cuguucagcguuuu

SEQ ID NO: 2010802 - RNA, 21 nt, Homo sapiens
cauagccauggaacccugcca

SEQ ID NO: 2010803 - RNA, 13 nt, Homo sapiens
uacauucuucaag

SEQ ID NO: 2010804 - RNA, 16 nt, Homo sapiens
caaagcaacgacuacu

SEQ ID NO: 2010805 - RNA, 17 nt, Homo sapiens
uguuuuacccuugacug

SEQ ID NO: 2010806 - RNA, 19 nt, Homo sapiens
gugaauacauucuuugcua

SEQ ID NO: 2010807 - RNA, 17 nt, Homo sapiens
ccuccuugccuugggac

SEQ ID NO: 2010808 - RNA, 19 nt, Homo sapiens
agaguuguuguuugccaag

SEQ ID NO: 2010809 - RNA, 22 nt, Homo sapiens
cugccuauuuuaauaaacacuc

SEQ ID NO: 2010810 - RNA, 16 nt, Homo sapiens
cugucuggugccccuu

SEQ ID NO: 2010811 - RNA, 17 nt, Homo sapiens
ugugagccacagcacuc

SEQ ID NO: 2010812 - RNA, 19 nt, Homo sapiens
aaggaaaaauauuuugcac

SEQ ID NO: 2010813 - RNA, 20 nt, Homo sapiens
aggcuggugagguccuggug

SEQ ID NO: 2010814 - RNA, 16 nt, Homo sapiens
gagggcagucugcuca

SEQ ID NO: 2010815 - RNA, 15 nt, Homo sapiens
aggaggggccugagg

SEQ ID NO: 2010816 - RNA, 13 nt, Homo sapiens
ucauggaauugga

SEQ ID NO: 2010817 - RNA, 23 nt, Homo sapiens
aucuucucacauagguguuguca

SEQ ID NO: 2010818 - RNA, 18 nt, Homo sapiens
ucuccuguauaaucucuc

SEQ ID NO: 2010819 - RNA, 16 nt, Homo sapiens
caccuguuacuacuuc

SEQ ID NO: 2010820 - RNA, 14 nt, Homo sapiens
accuuggagccuga

SEQ ID NO: 2010821 - RNA, 14 nt, Homo sapiens
aggcgagagggcug

SEQ ID NO: 2010822 - RNA, 18 nt, Homo sapiens
caugcuucagugcugcuc

SEQ ID NO: 2010823 - RNA, 19 nt, Homo sapiens
aacuuggucugcagaccau

SEQ ID NO: 2010824 - RNA, 19 nt, Homo sapiens
uaaagggacuugaaguauu

SEQ ID NO: 2010825 - RNA, 19 nt, Homo sapiens
aggucccugugagcacaua

SEQ ID NO: 2010826 - RNA, 18 nt, Homo sapiens
aucuuugaccacgucauc

SEQ ID NO: 2010827 - RNA, 18 nt, Homo sapiens
cccaaugcacacaaaaca

SEQ ID NO: 2010828 - RNA, 17 nt, Homo sapiens
augaggauaucaucuuu

SEQ ID NO: 2010829 - RNA, 19 nt, Homo sapiens
ugagaguuuuggaugcagu

SEQ ID NO: 2010830 - RNA, 13 nt, Homo sapiens
aagaauggaagaa

SEQ ID NO: 2010831 - RNA, 20 nt, Homo sapiens
uaacaugcccuguucagcua

SEQ ID NO: 2010832 - RNA, 13 nt, Homo sapiens
uucagugguucag

SEQ ID NO: 2010833 - RNA, 17 nt, Homo sapiens
acaucuuuccaguccuu

SEQ ID NO: 2010834 - RNA, 18 nt, Homo sapiens
uccuaacauugugauuau

SEQ ID NO: 2010835 - RNA, 15 nt, Homo sapiens
cuggucccuugcagc

SEQ ID NO: 2010836 - RNA, 15 nt, Homo sapiens
caucugacuaugaca

SEQ ID NO: 2010837 - RNA, 17 nt, Homo sapiens
aacacaguaaaauauuc

SEQ ID NO: 2010838 - RNA, 17 nt, Homo sapiens
uucuugcuuugaaugca

SEQ ID NO: 2010839 - RNA, 18 nt, Homo sapiens
gacuguggaaccaaagcu

SEQ ID NO: 2010840 - RNA, 19 nt, Homo sapiens
ugagucuauguucaaagac

SEQ ID NO: 2010841 - RNA, 19 nt, Homo sapiens
gucucauaauugucaaaaa

SEQ ID NO: 2010842 - RNA, 16 nt, Homo sapiens
uaaauuuugugcaaaa

SEQ ID NO: 2010843 - RNA, 13 nt, Homo sapiens
cucuucccaugac

SEQ ID NO: 2010844 - RNA, 12 nt, Homo sapiens
uuuaauuccuua

SEQ ID NO: 2010845 - RNA, 12 nt, Homo sapiens
gcuguguguucu

SEQ ID NO: 2010846 - RNA, 13 nt, Homo sapiens
auucauaugcaga

SEQ ID NO: 2010847 - RNA, 12 nt, Homo sapiens
cuccccuaucca

SEQ ID NO: 2010848 - RNA, 19 nt, Homo sapiens
aaaaaucccauuucuugaa

SEQ ID NO: 2010849 - RNA, 19 nt, Homo sapiens
aucuguucuaugcuuccuc

SEQ ID NO: 2010850 - RNA, 15 nt, Homo sapiens
auuugagacuccuca

SEQ ID NO: 2010851 - RNA, 19 nt, Homo sapiens
uaaguuucacagcacuuac

SEQ ID NO: 2010852 - RNA, 14 nt, Homo sapiens
cucgaauaucuuaa

SEQ ID NO: 2010853 - RNA, 23 nt, Homo sapiens
gauuguaaauaaaggaugauggc

SEQ ID NO: 2010854 - RNA, 18 nt, Homo sapiens
uggccugcuaauagcugc

SEQ ID NO: 2010855 - RNA, 15 nt, Homo sapiens
uauucugcauggaaa

SEQ ID NO: 2010856 - RNA, 13 nt, Homo sapiens
ucucuuacauuga

SEQ ID NO: 2010857 - RNA, 16 nt, Homo sapiens
gagacacggucccacc

SEQ ID NO: 2010858 - RNA, 18 nt, Homo sapiens
gcuauggaaacuuuugua

SEQ ID NO: 2010859 - RNA, 20 nt, Homo sapiens
cucccagagcaccugcuguc

SEQ ID NO: 2010860 - RNA, 20 nt, Homo sapiens
cuugccauuuguagcuuugc

SEQ ID NO: 2010861 - RNA, 17 nt, Homo sapiens
aguccuaaaaguucuca

SEQ ID NO: 2010862 - RNA, 15 nt, Homo sapiens
cccuugaaaacugcu

SEQ ID NO: 2010863 - RNA, 20 nt, Homo sapiens
aggccacacagcacaugcac

SEQ ID NO: 2010864 - RNA, 17 nt, Homo sapiens
cuuggguugaucucuua

SEQ ID NO: 2010865 - RNA, 21 nt, Homo sapiens
cuaaaggugguuuuauuuucc

SEQ ID NO: 2010866 - RNA, 15 nt, Homo sapiens
ucaugcuguguaaua

SEQ ID NO: 2010867 - RNA, 16 nt, Homo sapiens
cucuuagaaaaaccac

SEQ ID NO: 2010868 - RNA, 18 nt, Homo sapiens
uaugccagugcucaaggu

SEQ ID NO: 2010869 - RNA, 22 nt, Homo sapiens
augaaaugaggucagagccugc

SEQ ID NO: 2010870 - RNA, 17 nt, Homo sapiens
ccaccaccuucuucucc

SEQ ID NO: 2010871 - RNA, 20 nt, Homo sapiens
cugccugucugcuugcaucu

SEQ ID NO: 2010872 - RNA, 22 nt, Homo sapiens
gaugaaaucugcuagaaaguua

SEQ ID NO: 2010873 - RNA, 13 nt, Homo sapiens
gaaaacuacauuu

SEQ ID NO: 2010874 - RNA, 17 nt, Homo sapiens
uagccuggcuauguccu

SEQ ID NO: 2010875 - RNA, 15 nt, Homo sapiens
caauuccucugggaa

SEQ ID NO: 2010876 - RNA, 17 nt, Homo sapiens
agaauaccaaaugauag

SEQ ID NO: 2010877 - RNA, 21 nt, Homo sapiens
aacuuuuguaagguacugaau

SEQ ID NO: 2010878 - RNA, 13 nt, Homo sapiens
auuuaagcaagau

SEQ ID NO: 2010879 - RNA, 17 nt, Homo sapiens
uuaauauggaucuguau

SEQ ID NO: 2010880 - RNA, 19 nt, Homo sapiens
uauguaugcugauuuacua

SEQ ID NO: 2010881 - RNA, 22 nt, Homo sapiens
caagcacccagcccuccugcuc

SEQ ID NO: 2010882 - RNA, 13 nt, Homo sapiens
cagaacugccauu

SEQ ID NO: 2010883 - RNA, 15 nt, Homo sapiens
auaaauauuauuaga

SEQ ID NO: 2010884 - RNA, 19 nt, Homo sapiens
caauaaaaugucuucuccc

SEQ ID NO: 2010885 - RNA, 16 nt, Homo sapiens
gccacagacaauaugg

SEQ ID NO: 2010886 - RNA, 22 nt, Homo sapiens
ggcuauuguccccuaaaccaaa

SEQ ID NO: 2010887 - RNA, 20 nt, Homo sapiens
ggaaaaaucuaaaaugugug

SEQ ID NO: 2010888 - RNA, 21 nt, Homo sapiens
aauuacaguugaaagcuguau

SEQ ID NO: 2010889 - RNA, 18 nt, Homo sapiens
agaaacaacacuguagua

SEQ ID NO: 2010890 - RNA, 21 nt, Homo sapiens
cugauucuggcuuuaagccuu

SEQ ID NO: 2010891 - RNA, 15 nt, Homo sapiens
cuuucucccagugaa

SEQ ID NO: 2010892 - RNA, 16 nt, Homo sapiens
uacugagaauagcaug

SEQ ID NO: 2010893 - RNA, 17 nt, Homo sapiens
gccagagucacaggaag

SEQ ID NO: 2010894 - RNA, 17 nt, Homo sapiens
ucacaucacauuuaaau

SEQ ID NO: 2010895 - RNA, 19 nt, Homo sapiens
caucuccuucaaauacuuu

SEQ ID NO: 2010896 - RNA, 19 nt, Homo sapiens
gcugggaaccagcaucuca

SEQ ID NO: 2010897 - RNA, 14 nt, Homo sapiens
caggcucugaccag

SEQ ID NO: 2010898 - RNA, 15 nt, Homo sapiens
cucagccuccagagu

SEQ ID NO: 2010899 - RNA, 17 nt, Homo sapiens
ccuucagaaaagacacu

SEQ ID NO: 2010900 - RNA, 22 nt, Homo sapiens
aucuuuacucccaagacuucau

SEQ ID NO: 2010901 - RNA, 22 nt, Homo sapiens
cuuagauauuucaugugcuaua

SEQ ID NO: 2010902 - RNA, 18 nt, Homo sapiens
aguuucauuuccuugucc

SEQ ID NO: 2010903 - RNA, 22 nt, Homo sapiens
uggguccucgcugcuggcugcu

SEQ ID NO: 2010904 - RNA, 21 nt, Homo sapiens
gugggcgcaaaggugccucau

SEQ ID NO: 2010905 - RNA, 14 nt, Homo sapiens
ugcacuucaguucc

SEQ ID NO: 2010906 - RNA, 22 nt, Homo sapiens
gaaugcuaaacagaugucuucu

SEQ ID NO: 2010907 - RNA, 18 nt, Homo sapiens
gacauaaggagugccuga

SEQ ID NO: 2010908 - RNA, 22 nt, Homo sapiens
uucugaacuggaacaugggcau

SEQ ID NO: 2010909 - RNA, 15 nt, Homo sapiens
gacucugccuuccag

SEQ ID NO: 2010910 - RNA, 20 nt, Homo sapiens
gugacuucuaguccaaauau

SEQ ID NO: 2010911 - RNA, 17 nt, Homo sapiens
auuaagagauugccauu

SEQ ID NO: 2010912 - RNA, 19 nt, Homo sapiens
accuucaauaaaguaucua

SEQ ID NO: 2010913 - RNA, 19 nt, Homo sapiens
ucccggggaggaaacacuu

SEQ ID NO: 2010914 - RNA, 22 nt, Homo sapiens
agacugugcccugggagcucug

SEQ ID NO: 2010915 - RNA, 19 nt, Homo sapiens
cucaguuucuucaccugua

SEQ ID NO: 2010916 - RNA, 21 nt, Homo sapiens
caacuacuauucaaaaccuca

SEQ ID NO: 2010917 - RNA, 16 nt, Homo sapiens
cacacagaggggaguc

SEQ ID NO: 2010918 - RNA, 13 nt, Homo sapiens
augaauacugaau

SEQ ID NO: 2010919 - RNA, 18 nt, Homo sapiens
cuggcuguguggccaagg

SEQ ID NO: 2010920 - RNA, 21 nt, Homo sapiens
ucagggucccauugcuguuca

SEQ ID NO: 2010921 - RNA, 14 nt, Homo sapiens
aaaugugugcccag

SEQ ID NO: 2010922 - RNA, 21 nt, Homo sapiens
cuagagguagaguuugaucau

SEQ ID NO: 2010923 - RNA, 20 nt, Homo sapiens
cuuguccaggaacugccugg

SEQ ID NO: 2010924 - RNA, 16 nt, Homo sapiens
gaaacuuugccucaag

SEQ ID NO: 2010925 - RNA, 18 nt, Homo sapiens
cggauauauacauagcau

SEQ ID NO: 2010926 - RNA, 19 nt, Homo sapiens
cuuuaagcagcgccaguga

SEQ ID NO: 2010927 - RNA, 12 nt, Homo sapiens
auguagucucau

SEQ ID NO: 2010928 - RNA, 16 nt, Homo sapiens
ugccucacuuccuaca

SEQ ID NO: 2010929 - RNA, 16 nt, Homo sapiens
gccuugggccuugcug

SEQ ID NO: 2010930 - RNA, 23 nt, Homo sapiens
auuauauucccaaaucucaaaag

SEQ ID NO: 2010931 - RNA, 13 nt, Homo sapiens
ugccucugccaca

SEQ ID NO: 2010932 - RNA, 20 nt, Homo sapiens
ugcacuguaaaaugugggau

SEQ ID NO: 2010933 - RNA, 17 nt, Homo sapiens
uauaugucaucucagug

SEQ ID NO: 2010934 - RNA, 20 nt, Homo sapiens
uggcaaccuggcucuggccc

SEQ ID NO: 2010935 - RNA, 14 nt, Homo sapiens
ggcgccuaagccuu

SEQ ID NO: 2010936 - RNA, 22 nt, Homo sapiens
agaacauggugugugucucuga

SEQ ID NO: 2010937 - RNA, 15 nt, Homo sapiens
ccguggagacugaga

SEQ ID NO: 2010938 - RNA, 16 nt, Homo sapiens
ucugcacacauaacac

SEQ ID NO: 2010939 - RNA, 12 nt, Homo sapiens
aaaggugcucaa

SEQ ID NO: 2010940 - RNA, 19 nt, Homo sapiens
acaccaucacccucugggc

SEQ ID NO: 2010941 - RNA, 12 nt, Homo sapiens
uauuaacuguca

SEQ ID NO: 2010942 - RNA, 17 nt, Homo sapiens
uuugccaugacauuuca

SEQ ID NO: 2010943 - RNA, 15 nt, Homo sapiens
guggcuucacagacc

SEQ ID NO: 2010944 - RNA, 20 nt, Homo sapiens
acucaucauuuucuacuugu

SEQ ID NO: 2010945 - RNA, 16 nt, Homo sapiens
cgagguccaagcacau

SEQ ID NO: 2010946 - RNA, 17 nt, Homo sapiens
augacaguaguaccaaa

SEQ ID NO: 2010947 - RNA, 22 nt, Homo sapiens
acauguguguauauauguguau

SEQ ID NO: 2010948 - RNA, 16 nt, Homo sapiens
cuauuacaccaaauaa

SEQ ID NO: 2010949 - RNA, 14 nt, Homo sapiens
uggaagucaucuca

SEQ ID NO: 2010950 - RNA, 12 nt, Homo sapiens
ugaccuguucag

SEQ ID NO: 2010951 - RNA, 22 nt, Homo sapiens
ggcccagggugccugcacuuug

SEQ ID NO: 2010952 - RNA, 16 nt, Homo sapiens
uccuuuuaauuuuccu

SEQ ID NO: 2010953 - RNA, 18 nt, Homo sapiens
cuuccuuuugagggagca

SEQ ID NO: 2010954 - RNA, 13 nt, Homo sapiens
ugugggggguccu

SEQ ID NO: 2010955 - RNA, 17 nt, Homo sapiens
cauaaauaaaguuucag

SEQ ID NO: 2010956 - RNA, 23 nt, Homo sapiens
ucaaaaaagaaaaaagaaaagaa

SEQ ID NO: 2010957 - RNA, 21 nt, Homo sapiens
augugccuaaauaaguuauaa

SEQ ID NO: 2010958 - RNA, 18 nt, Homo sapiens
aucagacugcuuugagaa

SEQ ID NO: 2010959 - RNA, 16 nt, Homo sapiens
gagcaguaaacuuucu

SEQ ID NO: 2010960 - RNA, 23 nt, Homo sapiens
agcugugccgggaggcagccaca

SEQ ID NO: 2010961 - RNA, 16 nt, Homo sapiens
ccugcaggcugcaguc

SEQ ID NO: 2010962 - RNA, 13 nt, Homo sapiens
gcuagaaggccac

SEQ ID NO: 2010963 - RNA, 21 nt, Homo sapiens
cugugggccccucaacagcca

SEQ ID NO: 2010964 - RNA, 17 nt, Homo sapiens
cacacugaaaccaaaac

SEQ ID NO: 2010965 - RNA, 15 nt, Homo sapiens
gcaaugacugugagc

SEQ ID NO: 2010966 - RNA, 22 nt, Homo sapiens
uauuacacaaagaacuugcugc

SEQ ID NO: 2010967 - RNA, 22 nt, Homo sapiens
auccuaggcuuaaaugcaauau

SEQ ID NO: 2010968 - RNA, 17 nt, Homo sapiens
acaaagucaagccacau

SEQ ID NO: 2010969 - RNA, 14 nt, Homo sapiens
ugagacuacaggug

SEQ ID NO: 2010970 - RNA, 13 nt, Homo sapiens
aauaaauuguaaa

SEQ ID NO: 2010971 - RNA, 23 nt, Homo sapiens
cugauaugugaauuuguuuguga

SEQ ID NO: 2010972 - RNA, 15 nt, Homo sapiens
auggccuggaaccca

SEQ ID NO: 2010973 - RNA, 19 nt, Homo sapiens
uugcagcugagugaaaaau

SEQ ID NO: 2010974 - RNA, 19 nt, Homo sapiens
auguuuuaaauaguugcaa

SEQ ID NO: 2010975 - RNA, 17 nt, Homo sapiens
uccucaagcagaccuac

SEQ ID NO: 2010976 - RNA, 15 nt, Homo sapiens
cuugaggauugugga

SEQ ID NO: 2010977 - RNA, 17 nt, Homo sapiens
agaaugccuaggccagc

SEQ ID NO: 2010978 - RNA, 13 nt, Homo sapiens
aucugagcuuaaa

SEQ ID NO: 2010979 - RNA, 14 nt, Homo sapiens
acugcuugaggaaa

SEQ ID NO: 2010980 - RNA, 14 nt, Homo sapiens
aaagauuguacuua

SEQ ID NO: 2010981 - RNA, 17 nt, Homo sapiens
ccuguauuuaagcaaau

SEQ ID NO: 2010982 - RNA, 12 nt, Homo sapiens
ugucucagcuca

SEQ ID NO: 2010983 - RNA, 21 nt, Homo sapiens
ccaugcauggugcaucagcag

SEQ ID NO: 2010984 - RNA, 19 nt, Homo sapiens
caauaacacugcuuauaaa

SEQ ID NO: 2010985 - RNA, 17 nt, Homo sapiens
ugaucauggucagcuca

SEQ ID NO: 2010986 - RNA, 17 nt, Homo sapiens
cucagcugcacauuccu

SEQ ID NO: 2010987 - RNA, 20 nt, Homo sapiens
caguugauuguacguagcca

SEQ ID NO: 2010988 - RNA, 21 nt, Homo sapiens
auauauucucuuugguguaca

SEQ ID NO: 2010989 - RNA, 22 nt, Homo sapiens
aaacucaagcuucuucacucac

SEQ ID NO: 2010990 - RNA, 24 nt, Homo sapiens
accguccagcaagugucaucacuu

SEQ ID NO: 2010991 - RNA, 16 nt, Homo sapiens
ugagaauugugcucaa

SEQ ID NO: 2010992 - RNA, 21 nt, Homo sapiens
cacaaauggcuacaucuccaa

SEQ ID NO: 2010993 - RNA, 17 nt, Homo sapiens
caaaccucugugagcau

SEQ ID NO: 2010994 - RNA, 23 nt, Homo sapiens
ccauguuauuuauaguguugcuu

SEQ ID NO: 2010995 - RNA, 13 nt, Homo sapiens
agaagacucugac

SEQ ID NO: 2010996 - RNA, 18 nt, Homo sapiens
gcauuuuccuguuuacug

SEQ ID NO: 2010997 - RNA, 23 nt, Homo sapiens
cuagguuguuuuuaaaaccacua

SEQ ID NO: 2010998 - RNA, 22 nt, Homo sapiens
uguguggcaaacuugcaguuua

SEQ ID NO: 2010999 - RNA, 17 nt, Homo sapiens
cagcugcuggaugacuu

SEQ ID NO: 2011000 - RNA, 20 nt, Homo sapiens
uuugauuagagaccagauca

SEQ ID NO: 2011001 - RNA, 18 nt, Homo sapiens
acaucggccuccaugacc

SEQ ID NO: 2011002 - RNA, 17 nt, Homo sapiens
ggcaauccuaagcaaaa

SEQ ID NO: 2011003 - RNA, 22 nt, Homo sapiens
uuuaauaacuaaaccagauucu

SEQ ID NO: 2011004 - RNA, 16 nt, Homo sapiens
ucaccagacacaccag

SEQ ID NO: 2011005 - RNA, 21 nt, Homo sapiens
cagugcuguaaacuuaacugu

SEQ ID NO: 2011006 - RNA, 18 nt, Homo sapiens
ccuccccaguucuacuga

SEQ ID NO: 2011007 - RNA, 21 nt, Homo sapiens
gaucugucugugcacaugccu

SEQ ID NO: 2011008 - RNA, 14 nt, Homo sapiens
gccgcagacaugaa

SEQ ID NO: 2011009 - RNA, 18 nt, Homo sapiens
caauguuuuuuauacuuc

SEQ ID NO: 2011010 - RNA, 15 nt, Homo sapiens
gaugacaaacccagg

SEQ ID NO: 2011011 - RNA, 22 nt, Homo sapiens
acaggacuuucauuguucuugg

SEQ ID NO: 2011012 - RNA, 21 nt, Homo sapiens
gucacuuguuucuacucaaaa

SEQ ID NO: 2011013 - RNA, 22 nt, Homo sapiens
gccucugacagcagccugugag

SEQ ID NO: 2011014 - RNA, 22 nt, Homo sapiens
uacguuccuauugucauuaaag

SEQ ID NO: 2011015 - RNA, 16 nt, Homo sapiens
gguggaaaauggugcc

SEQ ID NO: 2011016 - RNA, 19 nt, Homo sapiens
uguaauuuagucuaacaca

SEQ ID NO: 2011017 - RNA, 11 nt, Homo sapiens
gggaaccagag

SEQ ID NO: 2011018 - RNA, 13 nt, Homo sapiens
augccacauucaa

SEQ ID NO: 2011019 - RNA, 14 nt, Homo sapiens
ucaaugaaauggau

SEQ ID NO: 2011020 - RNA, 18 nt, Homo sapiens
aggaauaaagcugugagc

SEQ ID NO: 2011021 - RNA, 21 nt, Homo sapiens
ccucccuagccagcacuugua

SEQ ID NO: 2011022 - RNA, 15 nt, Homo sapiens
uccguucaauaagca

SEQ ID NO: 2011023 - RNA, 22 nt, Homo sapiens
ucucauugaaaaaaauauauga

SEQ ID NO: 2011024 - RNA, 15 nt, Homo sapiens
cuucagacguguaug

SEQ ID NO: 2011025 - RNA, 17 nt, Homo sapiens
cucagcgcuaagccaaa

SEQ ID NO: 2011026 - RNA, 21 nt, Homo sapiens
ccagguccugagagcugcuuu

SEQ ID NO: 2011027 - RNA, 13 nt, Homo sapiens
accucaacaaaga

SEQ ID NO: 2011028 - RNA, 16 nt, Homo sapiens
cagcccccacuccagu

SEQ ID NO: 2011029 - RNA, 15 nt, Homo sapiens
ggcacaccgggcacu

SEQ ID NO: 2011030 - RNA, 16 nt, Homo sapiens
ggacacuucucaggaa

SEQ ID NO: 2011031 - RNA, 19 nt, Homo sapiens
auuuuccucuaauuaaaau

SEQ ID NO: 2011032 - RNA, 21 nt, Homo sapiens
gagccccaagacucugcucuc

SEQ ID NO: 2011033 - RNA, 18 nt, Homo sapiens
agcuuuccaaggaagcag

SEQ ID NO: 2011034 - RNA, 19 nt, Homo sapiens
uuagaguaaugaaauggag

SEQ ID NO: 2011035 - RNA, 14 nt, Homo sapiens
uacuuacuccccac

SEQ ID NO: 2011036 - RNA, 17 nt, Homo sapiens
uggacaacauuuuacua

SEQ ID NO: 2011037 - RNA, 23 nt, Homo sapiens
cuagguacgaagagggguggugg

SEQ ID NO: 2011038 - RNA, 22 nt, Homo sapiens
caggcuggagugcaauggcaca

SEQ ID NO: 2011039 - RNA, 17 nt, Homo sapiens
gccugcaggacuuugcg

SEQ ID NO: 2011040 - RNA, 16 nt, Homo sapiens
ugacuuguacucugaa

SEQ ID NO: 2011041 - RNA, 17 nt, Homo sapiens
ucagguguuucuagacc

SEQ ID NO: 2011042 - RNA, 22 nt, Homo sapiens
gugaacacuuuugaaaauguac

SEQ ID NO: 2011043 - RNA, 11 nt, Homo sapiens
acagcucugcu

SEQ ID NO: 2011044 - RNA, 18 nt, Homo sapiens
aaaaugugcacacauaua

SEQ ID NO: 2011045 - RNA, 15 nt, Homo sapiens
caaccugugaucaag

SEQ ID NO: 2011046 - RNA, 22 nt, Homo sapiens
aagucauuaacaagaaacagga

SEQ ID NO: 2011047 - RNA, 18 nt, Homo sapiens
ugccuccuuugcaccuga

SEQ ID NO: 2011048 - RNA, 23 nt, Homo sapiens
uaagcagaaauccugcaaugaaa

SEQ ID NO: 2011049 - RNA, 19 nt, Homo sapiens
aacccuggaccaguggucu

SEQ ID NO: 2011050 - RNA, 11 nt, Homo sapiens
cagaggucucc

SEQ ID NO: 2011051 - RNA, 19 nt, Homo sapiens
uucuguggacaccacugag

SEQ ID NO: 2011052 - RNA, 17 nt, Homo sapiens
aaaugcucaauuucagc

SEQ ID NO: 2011053 - RNA, 16 nt, Homo sapiens
gagggagcugagaaga

SEQ ID NO: 2011054 - RNA, 15 nt, Homo sapiens
cauguuuacaggggu

SEQ ID NO: 2011055 - RNA, 21 nt, Homo sapiens
auacagaagcagugugagcag

SEQ ID NO: 2011056 - RNA, 14 nt, Homo sapiens
cucaaugccaguaa

SEQ ID NO: 2011057 - RNA, 15 nt, Homo sapiens
aaauugaauacacaa

SEQ ID NO: 2011058 - RNA, 12 nt, Homo sapiens
gccacacugugg

SEQ ID NO: 2011059 - RNA, 20 nt, Homo sapiens
auccauccccagaccaggac

SEQ ID NO: 2011060 - RNA, 18 nt, Homo sapiens
gccccacccuuuccucuu

SEQ ID NO: 2011061 - RNA, 20 nt, Homo sapiens
augaccuugaaugaugccau

SEQ ID NO: 2011062 - RNA, 21 nt, Homo sapiens
cuuugguccccagcauugcag

SEQ ID NO: 2011063 - RNA, 12 nt, Homo sapiens
ugguggugcacc

SEQ ID NO: 2011064 - RNA, 13 nt, Homo sapiens
gccccaauucgau

SEQ ID NO: 2011065 - RNA, 16 nt, Homo sapiens
agaaaacauaacugau

SEQ ID NO: 2011066 - RNA, 21 nt, Homo sapiens
uauucccugucacuacacacu

SEQ ID NO: 2011067 - RNA, 15 nt, Homo sapiens
ucacacauuggcuua

SEQ ID NO: 2011068 - RNA, 15 nt, Homo sapiens
aguuaauauagucac

SEQ ID NO: 2011069 - RNA, 15 nt, Homo sapiens
auguauaugcaauau

SEQ ID NO: 2011070 - RNA, 23 nt, Homo sapiens
ucucuacaaacucccacuuguca

SEQ ID NO: 2011071 - RNA, 18 nt, Homo sapiens
cauaugugccaaugugac

SEQ ID NO: 2011072 - RNA, 18 nt, Homo sapiens
ucugccauaaagccauuc

SEQ ID NO: 2011073 - RNA, 18 nt, Homo sapiens
acagcuuugcaccccuuu

SEQ ID NO: 2011074 - RNA, 18 nt, Homo sapiens
aacuccaccuucccacuu

SEQ ID NO: 2011075 - RNA, 24 nt, Homo sapiens
ccaguguaauaauaaaucguccuc

SEQ ID NO: 2011076 - RNA, 13 nt, Homo sapiens
gcagcaauaugcu

SEQ ID NO: 2011077 - RNA, 15 nt, Homo sapiens
aauuucauugaacua

SEQ ID NO: 2011078 - RNA, 20 nt, Homo sapiens
ugcagaagagaaacugaggc

SEQ ID NO: 2011079 - RNA, 16 nt, Homo sapiens
ucugaggacgugguga

SEQ ID NO: 2011080 - RNA, 20 nt, Homo sapiens
gguggcgggaauccuauuua

SEQ ID NO: 2011081 - RNA, 14 nt, Homo sapiens
acccucagcuguca

SEQ ID NO: 2011082 - RNA, 21 nt, Homo sapiens
auaauucuuauggcugcugaa

SEQ ID NO: 2011083 - RNA, 17 nt, Homo sapiens
cagagcugacacaggau

SEQ ID NO: 2011084 - RNA, 20 nt, Homo sapiens
ccuguaaucccagcuacuug

SEQ ID NO: 2011085 - RNA, 18 nt, Homo sapiens
acuuuccuguugcacuga

SEQ ID NO: 2011086 - RNA, 13 nt, Homo sapiens
gagacauuggcuu

SEQ ID NO: 2011087 - RNA, 22 nt, Homo sapiens
auguggaacaggaugcccacau

SEQ ID NO: 2011088 - RNA, 23 nt, Homo sapiens
aaccucaucucucuaacaauaua

SEQ ID NO: 2011089 - RNA, 17 nt, Homo sapiens
caacaaauugcccuuua

SEQ ID NO: 2011090 - RNA, 14 nt, Homo sapiens
uuucaugauauaau

SEQ ID NO: 2011091 - RNA, 16 nt, Homo sapiens
uuugcgauacacugca

SEQ ID NO: 2011092 - RNA, 16 nt, Homo sapiens
uuaguuauacuccuca

SEQ ID NO: 2011093 - RNA, 12 nt, Homo sapiens
augcgugugaac

SEQ ID NO: 2011094 - RNA, 13 nt, Homo sapiens
acuaaaaagaauu

SEQ ID NO: 2011095 - RNA, 19 nt, Homo sapiens
ugucuuuguucuucuacca

SEQ ID NO: 2011096 - RNA, 18 nt, Homo sapiens
caguaacuuuauguguaa

SEQ ID NO: 2011097 - RNA, 11 nt, Homo sapiens
gacaugcauug

SEQ ID NO: 2011098 - RNA, 15 nt, Homo sapiens
auagagcuguucaac

SEQ ID NO: 2011099 - RNA, 15 nt, Homo sapiens
aagguaauacuauaa

SEQ ID NO: 2011100 - RNA, 15 nt, Homo sapiens
aacaauccaugugau

SEQ ID NO: 2011101 - RNA, 12 nt, Homo sapiens
uucccugccaca

SEQ ID NO: 2011102 - RNA, 15 nt, Homo sapiens
ugguguccagucuuu

SEQ ID NO: 2011103 - RNA, 24 nt, Homo sapiens
gcauaagggcuucuggaacccaga

SEQ ID NO: 2011104 - RNA, 16 nt, Homo sapiens
cacuuagacacuuuac

SEQ ID NO: 2011105 - RNA, 16 nt, Homo sapiens
auacuagcauacuuaa

SEQ ID NO: 2011106 - RNA, 17 nt, Homo sapiens
caucugugggcacgcug

SEQ ID NO: 2011107 - RNA, 14 nt, Homo sapiens
caggccaacugccc

SEQ ID NO: 2011108 - RNA, 22 nt, Homo sapiens
uccagggagccggggcugugag

SEQ ID NO: 2011109 - RNA, 16 nt, Homo sapiens
cgccaaaacaagccaa

SEQ ID NO: 2011110 - RNA, 12 nt, Homo sapiens
uggucacuguca

SEQ ID NO: 2011111 - RNA, 17 nt, Homo sapiens
gcuuauuuaagaucaca

SEQ ID NO: 2011112 - RNA, 18 nt, Homo sapiens
uaauuauuuuagcacaaa

SEQ ID NO: 2011113 - RNA, 19 nt, Homo sapiens
ggaccaaaccuagccccuu

SEQ ID NO: 2011114 - RNA, 20 nt, Homo sapiens
acuccugaagggaaggcaaa

SEQ ID NO: 2011115 - RNA, 21 nt, Homo sapiens
ccagugcucacacaaucagac

SEQ ID NO: 2011116 - RNA, 18 nt, Homo sapiens
ugcuucuacaugaugcua

SEQ ID NO: 2011117 - RNA, 15 nt, Homo sapiens
uggaaaggggggagc

SEQ ID NO: 2011118 - RNA, 17 nt, Homo sapiens
uccauuuacuugaucau

SEQ ID NO: 2011119 - RNA, 17 nt, Homo sapiens
cuaaaaaucaugagauc

SEQ ID NO: 2011120 - RNA, 14 nt, Homo sapiens
acccaaugauucag

SEQ ID NO: 2011121 - RNA, 12 nt, Homo sapiens
acucccauaucu

SEQ ID NO: 2011122 - RNA, 22 nt, Homo sapiens
aaugagugaguucucacucugg

SEQ ID NO: 2011123 - RNA, 16 nt, Homo sapiens
uuagcagcauggcugc

SEQ ID NO: 2011124 - RNA, 13 nt, Homo sapiens
acagcagcacugu

SEQ ID NO: 2011125 - RNA, 15 nt, Homo sapiens
gcccccugguggaau

SEQ ID NO: 2011126 - RNA, 21 nt, Homo sapiens
aaaucacagaugcauauagac

SEQ ID NO: 2011127 - RNA, 14 nt, Homo sapiens
uugcauugugacua

SEQ ID NO: 2011128 - RNA, 16 nt, Homo sapiens
agcagcuaucucucag

SEQ ID NO: 2011129 - RNA, 18 nt, Homo sapiens
uuuaaaaauaguugcugu

SEQ ID NO: 2011130 - RNA, 19 nt, Homo sapiens
guguccaggagaccuucca

SEQ ID NO: 2011131 - RNA, 20 nt, Homo sapiens
ucacuuuugaagcaauauca

SEQ ID NO: 2011132 - RNA, 18 nt, Homo sapiens
caggggccaagcaggcac

SEQ ID NO: 2011133 - RNA, 18 nt, Homo sapiens
gaucucacacaccagggc

SEQ ID NO: 2011134 - RNA, 15 nt, Homo sapiens
ugacauugcauuugg

SEQ ID NO: 2011135 - RNA, 19 nt, Homo sapiens
cuggaaggacacagugaug

SEQ ID NO: 2011136 - RNA, 16 nt, Homo sapiens
uggagacagggcauuu

SEQ ID NO: 2011137 - RNA, 17 nt, Homo sapiens
cuaagaaagaaaugcua

SEQ ID NO: 2011138 - RNA, 19 nt, Homo sapiens
cagucucuucuaagcaaaa

SEQ ID NO: 2011139 - RNA, 20 nt, Homo sapiens
cccagaccuccccucuuccu

SEQ ID NO: 2011140 - RNA, 20 nt, Homo sapiens
uccccaguuaaugugccaaa

SEQ ID NO: 2011141 - RNA, 14 nt, Homo sapiens
aauaaaugacaaau

SEQ ID NO: 2011142 - RNA, 14 nt, Homo sapiens
ucauaauguauuau

SEQ ID NO: 2011143 - RNA, 16 nt, Homo sapiens
cccugaggucaugcau

SEQ ID NO: 2011144 - RNA, 16 nt, Homo sapiens
cugauggaacagaaua

SEQ ID NO: 2011145 - RNA, 23 nt, Homo sapiens
uguagcaaagcacauagagccag

SEQ ID NO: 2011146 - RNA, 19 nt, Homo sapiens
ccugaagaucaagccaguu

SEQ ID NO: 2011147 - RNA, 20 nt, Homo sapiens
uguguuucuagaaucacagc

SEQ ID NO: 2011148 - RNA, 12 nt, Homo sapiens
gcaagcaauaaa

SEQ ID NO: 2011149 - RNA, 17 nt, Homo sapiens
uuuugauuaguauaaua

SEQ ID NO: 2011150 - RNA, 15 nt, Homo sapiens
aauugaagcaaguga

SEQ ID NO: 2011151 - RNA, 22 nt, Homo sapiens
auguaucuaccucacuauucaa

SEQ ID NO: 2011152 - RNA, 15 nt, Homo sapiens
ucaaaaagacugugg

SEQ ID NO: 2011153 - RNA, 12 nt, Homo sapiens
acucuugcaggg

SEQ ID NO: 2011154 - RNA, 16 nt, Homo sapiens
guuucuacaacauauu

SEQ ID NO: 2011155 - RNA, 13 nt, Homo sapiens
auauuuguauaca

SEQ ID NO: 2011156 - RNA, 14 nt, Homo sapiens
cacgugcacagcuu

SEQ ID NO: 2011157 - RNA, 17 nt, Homo sapiens
uguucuuuuuucugucu

SEQ ID NO: 2011158 - RNA, 23 nt, Homo sapiens
cuaauaaauuuuagugugccuuc

SEQ ID NO: 2011159 - RNA, 19 nt, Homo sapiens
agcagggauuaaccucugc

SEQ ID NO: 2011160 - RNA, 14 nt, Homo sapiens
cuagccaucucaag

SEQ ID NO: 2011161 - RNA, 22 nt, Homo sapiens
cacugcacuuuccaaugccaca

SEQ ID NO: 2011162 - RNA, 18 nt, Homo sapiens
aggucaauuuccugaugc

SEQ ID NO: 2011163 - RNA, 18 nt, Homo sapiens
aaaguccccuuaagccaa

SEQ ID NO: 2011164 - RNA, 17 nt, Homo sapiens
guuuuaaauguaugauu

SEQ ID NO: 2011165 - RNA, 15 nt, Homo sapiens
uuuuugagaaagcaa

SEQ ID NO: 2011166 - RNA, 20 nt, Homo sapiens
cagccccaccuuggcugcug

SEQ ID NO: 2011167 - RNA, 21 nt, Homo sapiens
gacagauguuaagcgcugugu

SEQ ID NO: 2011168 - RNA, 21 nt, Homo sapiens
gccuccgcugggcuucauucc

SEQ ID NO: 2011169 - RNA, 19 nt, Homo sapiens
cugggccuccuccuagcug

SEQ ID NO: 2011170 - RNA, 23 nt, Homo sapiens
ucugcaacugaaauuacauauug

SEQ ID NO: 2011171 - RNA, 18 nt, Homo sapiens
ugugaaacucuacccuga

SEQ ID NO: 2011172 - RNA, 16 nt, Homo sapiens
accccaccagcaauac

SEQ ID NO: 2011173 - RNA, 15 nt, Homo sapiens
ccuccccuuccuguu

SEQ ID NO: 2011174 - RNA, 20 nt, Homo sapiens
cagggauaauuaaaaccauc

SEQ ID NO: 2011175 - RNA, 12 nt, Homo sapiens
uuaaaucaaaga

SEQ ID NO: 2011176 - RNA, 23 nt, Homo sapiens
gcagcaaacaaauaaaaugaaau

SEQ ID NO: 2011177 - RNA, 16 nt, Homo sapiens
uacuuuacaaaccauu

SEQ ID NO: 2011178 - RNA, 20 nt, Homo sapiens
guucagaaaagaagugaagu

SEQ ID NO: 2011179 - RNA, 23 nt, Homo sapiens
gcccucaggcuccccagugcucc

SEQ ID NO: 2011180 - RNA, 18 nt, Homo sapiens
auugucugcugccuccaa

SEQ ID NO: 2011181 - RNA, 23 nt, Homo sapiens
gcugaaugugauacaugccgaau

SEQ ID NO: 2011182 - RNA, 19 nt, Homo sapiens
cuuuguaucauucaucuuc

SEQ ID NO: 2011183 - RNA, 14 nt, Homo sapiens
aagcaauccaugau

SEQ ID NO: 2011184 - RNA, 14 nt, Homo sapiens
accaaagcucucuu

SEQ ID NO: 2011185 - RNA, 11 nt, Homo sapiens
acagcugugag

SEQ ID NO: 2011186 - RNA, 12 nt, Homo sapiens
cuaaagccucaa

SEQ ID NO: 2011187 - RNA, 20 nt, Homo sapiens
aauccauugaacuggaagaa

SEQ ID NO: 2011188 - RNA, 22 nt, Homo sapiens
caggaccgcgcuguuccggcuu

SEQ ID NO: 2011189 - RNA, 18 nt, Homo sapiens
uaugaaaagagcaaaaac

SEQ ID NO: 2011190 - RNA, 19 nt, Homo sapiens
gagccaugaaaucaacuca

SEQ ID NO: 2011191 - RNA, 16 nt, Homo sapiens
uagggccgacgcugug

SEQ ID NO: 2011192 - RNA, 12 nt, Homo sapiens
auaugauguuua

SEQ ID NO: 2011193 - RNA, 24 nt, Homo sapiens
auuauagcagagguaaguuaggaa

SEQ ID NO: 2011194 - RNA, 15 nt, Homo sapiens
uccuaaaacaacaga

SEQ ID NO: 2011195 - RNA, 15 nt, Homo sapiens
ugagacccuguucua

SEQ ID NO: 2011196 - RNA, 16 nt, Homo sapiens
guuauuguacaaguau

SEQ ID NO: 2011197 - RNA, 20 nt, Homo sapiens
cccacaacgugcaacugaca

SEQ ID NO: 2011198 - RNA, 17 nt, Homo sapiens
acaagcauucaagaaac

SEQ ID NO: 2011199 - RNA, 16 nt, Homo sapiens
aauacagcaaaccuaa

SEQ ID NO: 2011200 - RNA, 24 nt, Homo sapiens
uaucuacuuuagagucuucuccaa

SEQ ID NO: 2011201 - RNA, 22 nt, Homo sapiens
cagagcuuggacuggaugcaug

SEQ ID NO: 2011202 - RNA, 15 nt, Homo sapiens
aaauaacacugugaa

SEQ ID NO: 2011203 - RNA, 19 nt, Homo sapiens
cuacaagauuccugguuga

SEQ ID NO: 2011204 - RNA, 15 nt, Homo sapiens
ugaagcugcucacug

SEQ ID NO: 2011205 - RNA, 12 nt, Homo sapiens
ggcccaucugcc

SEQ ID NO: 2011206 - RNA, 12 nt, Homo sapiens
gcaccaucucac

SEQ ID NO: 2011207 - RNA, 18 nt, Homo sapiens
ucaauccaggagccuuga

SEQ ID NO: 2011208 - RNA, 13 nt, Homo sapiens
gauuuggugacca

SEQ ID NO: 2011209 - RNA, 23 nt, Homo sapiens
aauguucaguccaacaaaccaca

SEQ ID NO: 2011210 - RNA, 21 nt, Homo sapiens
acagcaaccucuucaugagcu

SEQ ID NO: 2011211 - RNA, 18 nt, Homo sapiens
guaccuauuugucaugua

SEQ ID NO: 2011212 - RNA, 17 nt, Homo sapiens
auauaacaauauaugau

SEQ ID NO: 2011213 - RNA, 17 nt, Homo sapiens
cuugcugauuugcacac

SEQ ID NO: 2011214 - RNA, 17 nt, Homo sapiens
cucuuuaugauaacaac

SEQ ID NO: 2011215 - RNA, 11 nt, Homo sapiens
aacacagggaa

SEQ ID NO: 2011216 - RNA, 16 nt, Homo sapiens
ugacaucuugcacggu

SEQ ID NO: 2011217 - RNA, 13 nt, Homo sapiens
ugaaaguguaaaa

SEQ ID NO: 2011218 - RNA, 13 nt, Homo sapiens
agaaagugaaaaa

SEQ ID NO: 2011219 - RNA, 13 nt, Homo sapiens
uguauguguauau

SEQ ID NO: 2011220 - RNA, 13 nt, Homo sapiens
aguaugugaauau

SEQ ID NO: 2011221 - RNA, 13 nt, Homo sapiens
aauaaaguggaaa

SEQ ID NO: 2011222 - RNA, 21 nt, Homo sapiens
ugcagcaccgaggggccuuug

SEQ ID NO: 2011223 - RNA, 18 nt, Homo sapiens
ugucaguucuaaccuccu

SEQ ID NO: 2011224 - RNA, 19 nt, Homo sapiens
guccccagagcuacaggcc

SEQ ID NO: 2011225 - RNA, 15 nt, Homo sapiens
guagucauuuugccc

SEQ ID NO: 2011226 - RNA, 15 nt, Homo sapiens
ugccccagagcuguu

SEQ ID NO: 2011227 - RNA, 22 nt, Homo sapiens
auguuauuuauagcuguagguu

SEQ ID NO: 2011228 - RNA, 19 nt, Homo sapiens
caucucuaaggagagcucu

SEQ ID NO: 2011229 - RNA, 18 nt, Homo sapiens
ugugacagucuugcauuc

SEQ ID NO: 2011230 - RNA, 20 nt, Homo sapiens
uauuguuccuuaucaccugc

SEQ ID NO: 2011231 - RNA, 20 nt, Homo sapiens
ggaaaauaaauucagaucaa

SEQ ID NO: 2011232 - RNA, 19 nt, Homo sapiens
ggccaguuucucugccuuc

SEQ ID NO: 2011233 - RNA, 19 nt, Homo sapiens
aaaugaaaaaaaugaucua

SEQ ID NO: 2011234 - RNA, 16 nt, Homo sapiens
auauucuuaacagauc

SEQ ID NO: 2011235 - RNA, 20 nt, Homo sapiens
aauccaagacagccacaccu

SEQ ID NO: 2011236 - RNA, 17 nt, Homo sapiens
acccuaagccacuggga

SEQ ID NO: 2011237 - RNA, 16 nt, Homo sapiens
uccuguuucuccuuag

SEQ ID NO: 2011238 - RNA, 19 nt, Homo sapiens
guaaucauuuuaaauucca

SEQ ID NO: 2011239 - RNA, 13 nt, Homo sapiens
gcuucucaucccc

SEQ ID NO: 2011240 - RNA, 20 nt, Homo sapiens
caucucuacuaaaaauacaa

SEQ ID NO: 2011241 - RNA, 20 nt, Homo sapiens
aucauuggaacaacugauac

SEQ ID NO: 2011242 - RNA, 16 nt, Homo sapiens
auuuaaucauuuccag

SEQ ID NO: 2011243 - RNA, 20 nt, Homo sapiens
uucuaaguuauuuuguacau

SEQ ID NO: 2011244 - RNA, 17 nt, Homo sapiens
ccuuuugucucugcaaa

SEQ ID NO: 2011245 - RNA, 15 nt, Homo sapiens
uguauucuauuuugc

SEQ ID NO: 2011246 - RNA, 21 nt, Homo sapiens
ggaucagcucuuccuguguuu

SEQ ID NO: 2011247 - RNA, 19 nt, Homo sapiens
uccaggauuuuaauuucag

SEQ ID NO: 2011248 - RNA, 19 nt, Homo sapiens
uaauagacucgcuagucag

SEQ ID NO: 2011249 - RNA, 21 nt, Homo sapiens
auagcugccuucaaggacugu

SEQ ID NO: 2011250 - RNA, 14 nt, Homo sapiens
aaugagaacuucaa

SEQ ID NO: 2011251 - RNA, 15 nt, Homo sapiens
uuuuuccccaaaguc

SEQ ID NO: 2011252 - RNA, 14 nt, Homo sapiens
agauggaauaucaa

SEQ ID NO: 2011253 - RNA, 20 nt, Homo sapiens
aacugggggcaaagguuuga

SEQ ID NO: 2011254 - RNA, 16 nt, Homo sapiens
caguuuauuuccacua

SEQ ID NO: 2011255 - RNA, 12 nt, Homo sapiens
uggccacagcca

SEQ ID NO: 2011256 - RNA, 12 nt, Homo sapiens
uggacacagccc

SEQ ID NO: 2011257 - RNA, 12 nt, Homo sapiens
uccccacaggga

SEQ ID NO: 2011258 - RNA, 20 nt, Homo sapiens
ugaaacuccaugcaaaccau

SEQ ID NO: 2011259 - RNA, 22 nt, Homo sapiens
uccaauagaaagaaacuaaaca

SEQ ID NO: 2011260 - RNA, 14 nt, Homo sapiens
uaauaaacuuccaa

SEQ ID NO: 2011261 - RNA, 22 nt, Homo sapiens
aggagguuauaccaggauuuau

SEQ ID NO: 2011262 - RNA, 20 nt, Homo sapiens
ucacaggacguugcuuuuuc

SEQ ID NO: 2011263 - RNA, 19 nt, Homo sapiens
uguucuauuucagugccaa

SEQ ID NO: 2011264 - RNA, 15 nt, Homo sapiens
uacuuuaccuccuau

SEQ ID NO: 2011265 - RNA, 18 nt, Homo sapiens
uuagaaaaauagcuguga

SEQ ID NO: 2011266 - RNA, 15 nt, Homo sapiens
gggugggacagggag

SEQ ID NO: 2011267 - RNA, 16 nt, Homo sapiens
ggucuaagguucagcc

SEQ ID NO: 2011268 - RNA, 15 nt, Homo sapiens
auuuauauuccauuu

SEQ ID NO: 2011269 - RNA, 13 nt, Homo sapiens
caauauuuugccu

SEQ ID NO: 2011270 - RNA, 16 nt, Homo sapiens
aagaacucaucacugu

SEQ ID NO: 2011271 - RNA, 16 nt, Homo sapiens
ggaacagcagauaaca

SEQ ID NO: 2011272 - RNA, 16 nt, Homo sapiens
caaauaaauucauaca

SEQ ID NO: 2011273 - RNA, 13 nt, Homo sapiens
gugcggacagccc

SEQ ID NO: 2011274 - RNA, 16 nt, Homo sapiens
agauucuauaguucua

SEQ ID NO: 2011275 - RNA, 23 nt, Homo sapiens
cuuaucuuaggauuuaccaaaua

SEQ ID NO: 2011276 - RNA, 17 nt, Homo sapiens
ucagguaauacaaacua

SEQ ID NO: 2011277 - RNA, 20 nt, Homo sapiens
uuugacaaagguaaaucaga

SEQ ID NO: 2011278 - RNA, 18 nt, Homo sapiens
guguugaggugagucaga

SEQ ID NO: 2011279 - RNA, 14 nt, Homo sapiens
ugcccauggcaugu

SEQ ID NO: 2011280 - RNA, 18 nt, Homo sapiens
ggccgggcaauccagaca

SEQ ID NO: 2011281 - RNA, 14 nt, Homo sapiens
uguaacccgcucau

SEQ ID NO: 2011282 - RNA, 18 nt, Homo sapiens
ugcuguugugcagugugc

SEQ ID NO: 2011283 - RNA, 19 nt, Homo sapiens
ugcugcaccaaugcacuga

SEQ ID NO: 2011284 - RNA, 19 nt, Homo sapiens
gaaacauagaaacauacac

SEQ ID NO: 2011285 - RNA, 16 nt, Homo sapiens
agugaaacauugaacu

SEQ ID NO: 2011286 - RNA, 20 nt, Homo sapiens
auaaaauauucauauauuau

SEQ ID NO: 2011287 - RNA, 21 nt, Homo sapiens
caacccuucuucauguucaau

SEQ ID NO: 2011288 - RNA, 14 nt, Homo sapiens
uuaacucagaucac

SEQ ID NO: 2011289 - RNA, 13 nt, Homo sapiens
gggccacagccag

SEQ ID NO: 2011290 - RNA, 11 nt, Homo sapiens
aaauucacugu

SEQ ID NO: 2011291 - RNA, 17 nt, Homo sapiens
ccccaguagcugggauu

SEQ ID NO: 2011292 - RNA, 22 nt, Homo sapiens
gaaguauuaguuacuugcuaua

SEQ ID NO: 2011293 - RNA, 17 nt, Homo sapiens
cccaggaaggacugugc

SEQ ID NO: 2011294 - RNA, 16 nt, Homo sapiens
cacaaaguccacuuua

SEQ ID NO: 2011295 - RNA, 20 nt, Homo sapiens
uccgcaguuccugucccuuc

SEQ ID NO: 2011296 - RNA, 12 nt, Homo sapiens
uccccagugugg

SEQ ID NO: 2011297 - RNA, 19 nt, Homo sapiens
ugcacacuucaaaucagag

SEQ ID NO: 2011298 - RNA, 18 nt, Homo sapiens
cccgaggaggugucucag

SEQ ID NO: 2011299 - RNA, 18 nt, Homo sapiens
auugucaugcuugacaca

SEQ ID NO: 2011300 - RNA, 22 nt, Homo sapiens
uagacuaucuagaacuugagaa

SEQ ID NO: 2011301 - RNA, 17 nt, Homo sapiens
ugcuacaagaacauuug

SEQ ID NO: 2011302 - RNA, 15 nt, Homo sapiens
aggcccaaagcacuu

SEQ ID NO: 2011303 - RNA, 17 nt, Homo sapiens
aacauuaucuaguucau

SEQ ID NO: 2011304 - RNA, 22 nt, Homo sapiens
agugacugggcaggcagcagaa

SEQ ID NO: 2011305 - RNA, 20 nt, Homo sapiens
cuuuuuuguggugucuagca

SEQ ID NO: 2011306 - RNA, 19 nt, Homo sapiens
cgcugaagcgccuccccca

SEQ ID NO: 2011307 - RNA, 15 nt, Homo sapiens
cauuuaaagauacca

SEQ ID NO: 2011308 - RNA, 20 nt, Homo sapiens
aaaacguaucaccuuuccca

SEQ ID NO: 2011309 - RNA, 21 nt, Homo sapiens
augaacaagcauucucuccau

SEQ ID NO: 2011310 - RNA, 21 nt, Homo sapiens
cuaaucaguaguucacuuuaa

SEQ ID NO: 2011311 - RNA, 16 nt, Homo sapiens
uuggugcaagugugca

SEQ ID NO: 2011312 - RNA, 14 nt, Homo sapiens
ugugagcuaugcaa

SEQ ID NO: 2011313 - RNA, 23 nt, Homo sapiens
caaaggcugcagcauugccauac

SEQ ID NO: 2011314 - RNA, 18 nt, Homo sapiens
agcagaucucauguccuc

SEQ ID NO: 2011315 - RNA, 17 nt, Homo sapiens
caccucaaauacauacc

SEQ ID NO: 2011316 - RNA, 18 nt, Homo sapiens
auggaugcuuuggcaaug

SEQ ID NO: 2011317 - RNA, 17 nt, Homo sapiens
accuuaagaagucuaua

SEQ ID NO: 2011318 - RNA, 13 nt, Homo sapiens
ucauaaauuuacu

SEQ ID NO: 2011319 - RNA, 13 nt, Homo sapiens
guuuaaaugcucu

SEQ ID NO: 2011320 - RNA, 17 nt, Homo sapiens
aucuguauaucagcucu

SEQ ID NO: 2011321 - RNA, 14 nt, Homo sapiens
uaagccacaggccc

SEQ ID NO: 2011322 - RNA, 13 nt, Homo sapiens
auaguagcauuuc

SEQ ID NO: 2011323 - RNA, 15 nt, Homo sapiens
agagaaugugcucau

SEQ ID NO: 2011324 - RNA, 17 nt, Homo sapiens
cuaggugcuauuuguca

SEQ ID NO: 2011325 - RNA, 20 nt, Homo sapiens
ucuugacucugaagggacuu

SEQ ID NO: 2011326 - RNA, 15 nt, Homo sapiens
aggacagcucuuccc

SEQ ID NO: 2011327 - RNA, 22 nt, Homo sapiens
ugcaaaccuguucaucuugcca

SEQ ID NO: 2011328 - RNA, 16 nt, Homo sapiens
ugcuccaaguugagac

SEQ ID NO: 2011329 - RNA, 16 nt, Homo sapiens
cuugccccaaaucuca

SEQ ID NO: 2011330 - RNA, 15 nt, Homo sapiens
ugguugaaaaccaca

SEQ ID NO: 2011331 - RNA, 19 nt, Homo sapiens
aucuaaaagaaaccuucca

SEQ ID NO: 2011332 - RNA, 19 nt, Homo sapiens
cugcuccgugugucucaug

SEQ ID NO: 2011333 - RNA, 12 nt, Homo sapiens
aauaaacuuaca

SEQ ID NO: 2011334 - RNA, 21 nt, Homo sapiens
agccucagaagccuucuugcu

SEQ ID NO: 2011335 - RNA, 15 nt, Homo sapiens
agauuuuaugcugcu

SEQ ID NO: 2011336 - RNA, 21 nt, Homo sapiens
gggggcggggaguauugaaug

SEQ ID NO: 2011337 - RNA, 21 nt, Homo sapiens
uaaaagcaggagguuaucugu

SEQ ID NO: 2011338 - RNA, 14 nt, Homo sapiens
aauauaaaagguaa

SEQ ID NO: 2011339 - RNA, 14 nt, Homo sapiens
cugcaguccuggug

SEQ ID NO: 2011340 - RNA, 12 nt, Homo sapiens
aucagucucuga

SEQ ID NO: 2011341 - RNA, 17 nt, Homo sapiens
ugaguacguugugcauu

SEQ ID NO: 2011342 - RNA, 14 nt, Homo sapiens
uuaggaccaggaga

SEQ ID NO: 2011343 - RNA, 22 nt, Homo sapiens
cauuucaauuagggaugcucaa

SEQ ID NO: 2011344 - RNA, 17 nt, Homo sapiens
caugguccauccccuga

SEQ ID NO: 2011345 - RNA, 19 nt, Homo sapiens
gaagcggagcuugcaguga

SEQ ID NO: 2011346 - RNA, 14 nt, Homo sapiens
agggagaagggaug

SEQ ID NO: 2011347 - RNA, 20 nt, Homo sapiens
aacauggccgugaacuuuau

SEQ ID NO: 2011348 - RNA, 18 nt, Homo sapiens
gacagcuuguggcuuuuu

SEQ ID NO: 2011349 - RNA, 13 nt, Homo sapiens
uagcucacugcac

SEQ ID NO: 2011350 - RNA, 21 nt, Homo sapiens
agaagagugaggacugacuca

SEQ ID NO: 2011351 - RNA, 12 nt, Homo sapiens
auucuccugacu

SEQ ID NO: 2011352 - RNA, 20 nt, Homo sapiens
ccugguuaaacaaaccagaa

SEQ ID NO: 2011353 - RNA, 23 nt, Homo sapiens
gccacacucuuucuccugcuuua

SEQ ID NO: 2011354 - RNA, 20 nt, Homo sapiens
gaguccuuacugaagccagg

SEQ ID NO: 2011355 - RNA, 12 nt, Homo sapiens
guuaauaaucua

SEQ ID NO: 2011356 - RNA, 21 nt, Homo sapiens
agagcguuacuguagaccuuu

SEQ ID NO: 2011357 - RNA, 17 nt, Homo sapiens
ucucauucugugccauu

SEQ ID NO: 2011358 - RNA, 23 nt, Homo sapiens
uuccugagccagcccuccuugac

SEQ ID NO: 2011359 - RNA, 14 nt, Homo sapiens
aaaucaaacuguag

SEQ ID NO: 2011360 - RNA, 14 nt, Homo sapiens
ucaaagaaagugua

SEQ ID NO: 2011361 - RNA, 11 nt, Homo sapiens
ccuuucuaguu

SEQ ID NO: 2011362 - RNA, 22 nt, Homo sapiens
cagagagggcaggcaugaaguu

SEQ ID NO: 2011363 - RNA, 12 nt, Homo sapiens
cacgagcuauau

SEQ ID NO: 2011364 - RNA, 14 nt, Homo sapiens
aacagaacuccacu

SEQ ID NO: 2011365 - RNA, 17 nt, Homo sapiens
aguacuuaaacuuccac

SEQ ID NO: 2011366 - RNA, 21 nt, Homo sapiens
ugcacacuccccugcacugga

SEQ ID NO: 2011367 - RNA, 14 nt, Homo sapiens
guguagccugugca

SEQ ID NO: 2011368 - RNA, 12 nt, Homo sapiens
cgaugugcaagu

SEQ ID NO: 2011369 - RNA, 16 nt, Homo sapiens
ugagcguccaggugau

SEQ ID NO: 2011370 - RNA, 18 nt, Homo sapiens
caccagaggcugcagaag

SEQ ID NO: 2011371 - RNA, 15 nt, Homo sapiens
cucauaaucuauaaa

SEQ ID NO: 2011372 - RNA, 22 nt, Homo sapiens
aucccaggggcuuaucucuuca

SEQ ID NO: 2011373 - RNA, 17 nt, Homo sapiens
agcauaaaacuuuggca

SEQ ID NO: 2011374 - RNA, 17 nt, Homo sapiens
ugagagaaagccacaaa

SEQ ID NO: 2011375 - RNA, 14 nt, Homo sapiens
auuuuauacuugcc

SEQ ID NO: 2011376 - RNA, 22 nt, Homo sapiens
uaaaagccccagcuuggcucac

SEQ ID NO: 2011377 - RNA, 21 nt, Homo sapiens
caaggcugucgccugcaccuu

SEQ ID NO: 2011378 - RNA, 18 nt, Homo sapiens
aacucagaucugucugau

SEQ ID NO: 2011379 - RNA, 16 nt, Homo sapiens
cucaucucuuagcucc

SEQ ID NO: 2011380 - RNA, 20 nt, Homo sapiens
uuaguugguuugugugauca

SEQ ID NO: 2011381 - RNA, 14 nt, Homo sapiens
ucuccucucucuau

SEQ ID NO: 2011382 - RNA, 15 nt, Homo sapiens
ugcucagccaagcuu

SEQ ID NO: 2011383 - RNA, 17 nt, Homo sapiens
aaccaccaggugucaaa

SEQ ID NO: 2011384 - RNA, 23 nt, Homo sapiens
ugcccugaguggaucuccaagga

SEQ ID NO: 2011385 - RNA, 18 nt, Homo sapiens
cuuuguacuuugugcaaa

SEQ ID NO: 2011386 - RNA, 12 nt, Homo sapiens
ugaaaaaugcuc

SEQ ID NO: 2011387 - RNA, 12 nt, Homo sapiens
uguaaaaugcac

SEQ ID NO: 2011388 - RNA, 23 nt, Homo sapiens
gaacauggacuuucuugcaugaa

SEQ ID NO: 2011389 - RNA, 12 nt, Homo sapiens
gaaaaacaggga

SEQ ID NO: 2011390 - RNA, 16 nt, Homo sapiens
aacaaauauuucacuu

SEQ ID NO: 2011391 - RNA, 17 nt, Homo sapiens
auauuucugaaaaccua

SEQ ID NO: 2011392 - RNA, 14 nt, Homo sapiens
acucuaguauucca

SEQ ID NO: 2011393 - RNA, 20 nt, Homo sapiens
ccucugaggcucagcccuga

SEQ ID NO: 2011394 - RNA, 20 nt, Homo sapiens
ucugggucagaccugagguu

SEQ ID NO: 2011395 - RNA, 17 nt, Homo sapiens
agcaacugcccuuccag

SEQ ID NO: 2011396 - RNA, 19 nt, Homo sapiens
ucgcaaaaugaugugaaag

SEQ ID NO: 2011397 - RNA, 17 nt, Homo sapiens
gagggaacagugcccaa

SEQ ID NO: 2011398 - RNA, 15 nt, Homo sapiens
gccaccacuccugcc

SEQ ID NO: 2011399 - RNA, 20 nt, Homo sapiens
uacccucaccugucaggccu

SEQ ID NO: 2011400 - RNA, 21 nt, Homo sapiens
agaaaacccgacaacauuucu

SEQ ID NO: 2011401 - RNA, 15 nt, Homo sapiens
ucaccacugacagau

SEQ ID NO: 2011402 - RNA, 17 nt, Homo sapiens
uagauaauaaaauugcu

SEQ ID NO: 2011403 - RNA, 19 nt, Homo sapiens
agagccccuuaaagcugcu

SEQ ID NO: 2011404 - RNA, 22 nt, Homo sapiens
ucauuauucuuuuucaguuuua

SEQ ID NO: 2011405 - RNA, 23 nt, Homo sapiens
auccuaagcgaagaugauuucag

SEQ ID NO: 2011406 - RNA, 22 nt, Homo sapiens
uaucuuuaaagacuugaugaau

SEQ ID NO: 2011407 - RNA, 15 nt, Homo sapiens
aucccccagccucaa

SEQ ID NO: 2011408 - RNA, 13 nt, Homo sapiens
acagaagugacuu

SEQ ID NO: 2011409 - RNA, 17 nt, Homo sapiens
uguguuuauuacugcuu

SEQ ID NO: 2011410 - RNA, 19 nt, Homo sapiens
gccuacuuaagagugcugu

SEQ ID NO: 2011411 - RNA, 16 nt, Homo sapiens
caugcccugugcaacc

SEQ ID NO: 2011412 - RNA, 20 nt, Homo sapiens
ccaggucacggggcaccaaa

SEQ ID NO: 2011413 - RNA, 15 nt, Homo sapiens
uacgaaauuagaaaa

SEQ ID NO: 2011414 - RNA, 14 nt, Homo sapiens
uggccaaacuggug

SEQ ID NO: 2011415 - RNA, 14 nt, Homo sapiens
uaccucuuggcugc

SEQ ID NO: 2011416 - RNA, 20 nt, Homo sapiens
aagaaucuauaguucacuga

SEQ ID NO: 2011417 - RNA, 13 nt, Homo sapiens
cuaagacauguaa

SEQ ID NO: 2011418 - RNA, 13 nt, Homo sapiens
gcagucacuggag

SEQ ID NO: 2011419 - RNA, 17 nt, Homo sapiens
uuauccuaucucuccaa

SEQ ID NO: 2011420 - RNA, 19 nt, Homo sapiens
uccaaaucucauguucaaa

SEQ ID NO: 2011421 - RNA, 13 nt, Homo sapiens
ccggggguccagg

SEQ ID NO: 2011422 - RNA, 16 nt, Homo sapiens
gagacaauuucacaug

SEQ ID NO: 2011423 - RNA, 20 nt, Homo sapiens
gaccaagacuuuugucugau

SEQ ID NO: 2011424 - RNA, 19 nt, Homo sapiens
ccaaggaugaccacacccg

SEQ ID NO: 2011425 - RNA, 17 nt, Homo sapiens
caucagagaugggaaaa

SEQ ID NO: 2011426 - RNA, 17 nt, Homo sapiens
gcggcugcaucuuccag

SEQ ID NO: 2011427 - RNA, 13 nt, Homo sapiens
cacgcaguauuga

SEQ ID NO: 2011428 - RNA, 17 nt, Homo sapiens
acggcucaugccuguaa

SEQ ID NO: 2011429 - RNA, 20 nt, Homo sapiens
gaaccuggaccccagccuug

SEQ ID NO: 2011430 - RNA, 19 nt, Homo sapiens
aacaguuuagcccaucucu

SEQ ID NO: 2011431 - RNA, 17 nt, Homo sapiens
gggcacagcaucuguag

SEQ ID NO: 2011432 - RNA, 13 nt, Homo sapiens
gcuaaggcuuccg

SEQ ID NO: 2011433 - RNA, 22 nt, Homo sapiens
cuuauuuuugaauugacugaga

SEQ ID NO: 2011434 - RNA, 22 nt, Homo sapiens
ucccauuuuggaaccuaauaaa

SEQ ID NO: 2011435 - RNA, 21 nt, Homo sapiens
cccccuuccuuuggugccuca

SEQ ID NO: 2011436 - RNA, 18 nt, Homo sapiens
uucaaugaucuagguuua

SEQ ID NO: 2011437 - RNA, 21 nt, Homo sapiens
uucccucucaugguaccugcu

SEQ ID NO: 2011438 - RNA, 13 nt, Homo sapiens
aagggacugaggc

SEQ ID NO: 2011439 - RNA, 16 nt, Homo sapiens
cugcgccugacauuca

SEQ ID NO: 2011440 - RNA, 23 nt, Homo sapiens
gcuccccaauccaacccaugcau

SEQ ID NO: 2011441 - RNA, 13 nt, Homo sapiens
uggcgacaaaagu

SEQ ID NO: 2011442 - RNA, 23 nt, Homo sapiens
gucaguugcaaauuuuagcguua

SEQ ID NO: 2011443 - RNA, 22 nt, Homo sapiens
gucaaaguaaaacuugcugccu

SEQ ID NO: 2011444 - RNA, 17 nt, Homo sapiens
auaaagucaaaucaaua

SEQ ID NO: 2011445 - RNA, 23 nt, Homo sapiens
caacauggugaaaccccgucucu

SEQ ID NO: 2011446 - RNA, 14 nt, Homo sapiens
ccuagaccuggacc

SEQ ID NO: 2011447 - RNA, 23 nt, Homo sapiens
gcuccagacacaccugaacacau

SEQ ID NO: 2011448 - RNA, 19 nt, Homo sapiens
aaucauacuuucucuucaa

SEQ ID NO: 2011449 - RNA, 21 nt, Homo sapiens
uugaacaagaugugggccuug

SEQ ID NO: 2011450 - RNA, 13 nt, Homo sapiens
gagcagaacaggu

SEQ ID NO: 2011451 - RNA, 20 nt, Homo sapiens
gaaagcuuuauacaguugaa

SEQ ID NO: 2011452 - RNA, 16 nt, Homo sapiens
cugugugagauuguga

SEQ ID NO: 2011453 - RNA, 17 nt, Homo sapiens
aagaaggcaccucucug

SEQ ID NO: 2011454 - RNA, 16 nt, Homo sapiens
agagaccccuuccuuu

SEQ ID NO: 2011455 - RNA, 19 nt, Homo sapiens
aggaacuggcuccuuugcc

SEQ ID NO: 2011456 - RNA, 15 nt, Homo sapiens
cuacacccucugccc

SEQ ID NO: 2011457 - RNA, 17 nt, Homo sapiens
uucauuagccaugcaac

SEQ ID NO: 2011458 - RNA, 17 nt, Homo sapiens
acuuggagagagauuca

SEQ ID NO: 2011459 - RNA, 16 nt, Homo sapiens
gaaauggccacuacuu

SEQ ID NO: 2011460 - RNA, 20 nt, Homo sapiens
uugcccaggcuggucucaaa

SEQ ID NO: 2011461 - RNA, 13 nt, Homo sapiens
aaaauguuugcug

SEQ ID NO: 2011462 - RNA, 14 nt, Homo sapiens
cuuucucaccagcc

SEQ ID NO: 2011463 - RNA, 19 nt, Homo sapiens
augcccugugcaaccucuu

SEQ ID NO: 2011464 - RNA, 14 nt, Homo sapiens
gaguaauaagcaug

SEQ ID NO: 2011465 - RNA, 19 nt, Homo sapiens
cuccccuugucugcacugu

SEQ ID NO: 2011466 - RNA, 15 nt, Homo sapiens
uaacucacugagggu

SEQ ID NO: 2011467 - RNA, 17 nt, Homo sapiens
ugggaaaaugcacacau

SEQ ID NO: 2011468 - RNA, 14 nt, Homo sapiens
ucuuccugccucag

SEQ ID NO: 2011469 - RNA, 19 nt, Homo sapiens
cauaauaaaaggcauucau

SEQ ID NO: 2011470 - RNA, 19 nt, Homo sapiens
augaauuugucgcaaagac

SEQ ID NO: 2011471 - RNA, 15 nt, Homo sapiens
ucuucgcugcuagag

SEQ ID NO: 2011472 - RNA, 15 nt, Homo sapiens
uugcucuuucagaac

SEQ ID NO: 2011473 - RNA, 24 nt, Homo sapiens
aauuaggaaagaaaaaaaguagga

SEQ ID NO: 2011474 - RNA, 12 nt, Homo sapiens
uacuauuuaguc

SEQ ID NO: 2011475 - RNA, 21 nt, Homo sapiens
uuuugccagugaagccuccaa

SEQ ID NO: 2011476 - RNA, 17 nt, Homo sapiens
aauucuccugccuuagc

SEQ ID NO: 2011477 - RNA, 21 nt, Homo sapiens
uaguuccuaauggauucaauu

SEQ ID NO: 2011478 - RNA, 13 nt, Homo sapiens
accacaucugcca

SEQ ID NO: 2011479 - RNA, 12 nt, Homo sapiens
uagcaguggcag

SEQ ID NO: 2011480 - RNA, 14 nt, Homo sapiens
guugccuauaacag

SEQ ID NO: 2011481 - RNA, 23 nt, Homo sapiens
uggucucaaacucccgaccucag

SEQ ID NO: 2011482 - RNA, 14 nt, Homo sapiens
gcagccuccagggc

SEQ ID NO: 2011483 - RNA, 22 nt, Homo sapiens
ugcagaugcguccgaagggaaa

SEQ ID NO: 2011484 - RNA, 17 nt, Homo sapiens
cgagaagguacugaaau

SEQ ID NO: 2011485 - RNA, 11 nt, Homo sapiens
auguguugccu

SEQ ID NO: 2011486 - RNA, 11 nt, Homo sapiens
acuuguugcug

SEQ ID NO: 2011487 - RNA, 16 nt, Homo sapiens
cugaucuuugccccug

SEQ ID NO: 2011488 - RNA, 21 nt, Homo sapiens
uuuaaaaaauaacauauucuu

SEQ ID NO: 2011489 - RNA, 15 nt, Homo sapiens
cagugcuuuccagcc

SEQ ID NO: 2011490 - RNA, 23 nt, Homo sapiens
ugcacuuuuccguuucagcggaa

SEQ ID NO: 2011491 - RNA, 16 nt, Homo sapiens
auauuuccauuaacag

SEQ ID NO: 2011492 - RNA, 20 nt, Homo sapiens
cagaccauuguuucuaauaa

SEQ ID NO: 2011493 - RNA, 13 nt, Homo sapiens
ccguucaacuuuu

SEQ ID NO: 2011494 - RNA, 13 nt, Homo sapiens
aauaaacaucagu

SEQ ID NO: 2011495 - RNA, 23 nt, Homo sapiens
agaguccuggcccuugaugccca

SEQ ID NO: 2011496 - RNA, 19 nt, Homo sapiens
uuguaaacuaguacuauua

SEQ ID NO: 2011497 - RNA, 19 nt, Homo sapiens
aaaguacucagaggcugac

SEQ ID NO: 2011498 - RNA, 21 nt, Homo sapiens
auuacccccucauuguuuauu

SEQ ID NO: 2011499 - RNA, 22 nt, Homo sapiens
uccucuucucugcauaccguga

SEQ ID NO: 2011500 - RNA, 11 nt, Homo sapiens
guucuuaccug

SEQ ID NO: 2011501 - RNA, 23 nt, Homo sapiens
cuugccucugcucugugcacuca

SEQ ID NO: 2011502 - RNA, 22 nt, Homo sapiens
ugacucaagacuuccagagccu

SEQ ID NO: 2011503 - RNA, 12 nt, Homo sapiens
cacacugaagaa

SEQ ID NO: 2011504 - RNA, 13 nt, Homo sapiens
cuggcucaucucu

SEQ ID NO: 2011505 - RNA, 20 nt, Homo sapiens
aguugcaauaaacucaguca

SEQ ID NO: 2011506 - RNA, 22 nt, Homo sapiens
aucuccagugggaacucuucaa

SEQ ID NO: 2011507 - RNA, 15 nt, Homo sapiens
gcauuuaauguagcc

SEQ ID NO: 2011508 - RNA, 16 nt, Homo sapiens
ggaggaagcuacccaa

SEQ ID NO: 2011509 - RNA, 14 nt, Homo sapiens
gaaucuggagacca

SEQ ID NO: 2011510 - RNA, 22 nt, Homo sapiens
agacagauucuucacuguguuu

SEQ ID NO: 2011511 - RNA, 22 nt, Homo sapiens
ggccuuugcuacacugcugaca

SEQ ID NO: 2011512 - RNA, 14 nt, Homo sapiens
aucagaauguuuca

SEQ ID NO: 2011513 - RNA, 15 nt, Homo sapiens
uauaggucacuccug

SEQ ID NO: 2011514 - RNA, 19 nt, Homo sapiens
acaccagagcccacuucca

SEQ ID NO: 2011515 - RNA, 21 nt, Homo sapiens
augccaccaacacugcucaca

SEQ ID NO: 2011516 - RNA, 23 nt, Homo sapiens
cauggacaugcuucagugcugcu

SEQ ID NO: 2011517 - RNA, 18 nt, Homo sapiens
uuacauuagugauuccau

SEQ ID NO: 2011518 - RNA, 13 nt, Homo sapiens
caagcuaggguuu

SEQ ID NO: 2011519 - RNA, 19 nt, Homo sapiens
agccauuuuuuaaaugaca

SEQ ID NO: 2011520 - RNA, 12 nt, Homo sapiens
cagcugcugaag

SEQ ID NO: 2011521 - RNA, 17 nt, Homo sapiens
acaucagacaauugcau

SEQ ID NO: 2011522 - RNA, 19 nt, Homo sapiens
uaugaagcuuucuuuccua

SEQ ID NO: 2011523 - RNA, 13 nt, Homo sapiens
cucauuguagaaa

SEQ ID NO: 2011524 - RNA, 20 nt, Homo sapiens
ccuugaauccagaacacaac

SEQ ID NO: 2011525 - RNA, 17 nt, Homo sapiens
aacaauuacauggcucu

SEQ ID NO: 2011526 - RNA, 15 nt, Homo sapiens
gagauuauucuuugu

SEQ ID NO: 2011527 - RNA, 20 nt, Homo sapiens
ucagagccccuacagcauug

SEQ ID NO: 2011528 - RNA, 19 nt, Homo sapiens
gcaguuucugacacuuguu

SEQ ID NO: 2011529 - RNA, 13 nt, Homo sapiens
gguuggcaaaaua

SEQ ID NO: 2011530 - RNA, 15 nt, Homo sapiens
uggagaauugaaaag

SEQ ID NO: 2011531 - RNA, 15 nt, Homo sapiens
cagaaaaucaaagag

SEQ ID NO: 2011532 - RNA, 18 nt, Homo sapiens
ugagccccauacagggca

SEQ ID NO: 2011533 - RNA, 22 nt, Homo sapiens
uuucuaguagcacaacugauaa

SEQ ID NO: 2011534 - RNA, 14 nt, Homo sapiens
aauucuacuggaaa

SEQ ID NO: 2011535 - RNA, 19 nt, Homo sapiens
ucuacagagugauagccuu

SEQ ID NO: 2011536 - RNA, 17 nt, Homo sapiens
uguagauaacagcaaga

SEQ ID NO: 2011537 - RNA, 21 nt, Homo sapiens
caggaggaaagaauugcucca

SEQ ID NO: 2011538 - RNA, 14 nt, Homo sapiens
gccugacuuuuaca

SEQ ID NO: 2011539 - RNA, 14 nt, Homo sapiens
uccagccuguuucc

SEQ ID NO: 2011540 - RNA, 17 nt, Homo sapiens
uuauugauucacuuacu

SEQ ID NO: 2011541 - RNA, 15 nt, Homo sapiens
caccucuuggcuuug

SEQ ID NO: 2011542 - RNA, 12 nt, Homo sapiens
acuucuaggauu

SEQ ID NO: 2011543 - RNA, 23 nt, Homo sapiens
agaaauauuuucagcaaaacuuu

SEQ ID NO: 2011544 - RNA, 23 nt, Homo sapiens
uccaaggaacuucaugcuugauu

SEQ ID NO: 2011545 - RNA, 13 nt, Homo sapiens
cugucucugcuau

SEQ ID NO: 2011546 - RNA, 22 nt, Homo sapiens
gucucuaaguuaugacugugaa

SEQ ID NO: 2011547 - RNA, 18 nt, Homo sapiens
uagcguuuccgugagcuc

SEQ ID NO: 2011548 - RNA, 14 nt, Homo sapiens
cuacacaauuuaau

SEQ ID NO: 2011549 - RNA, 20 nt, Homo sapiens
guuuaauuguaggucaauga

SEQ ID NO: 2011550 - RNA, 23 nt, Homo sapiens
aauuguuuuuaaguuuucaugaa

SEQ ID NO: 2011551 - RNA, 14 nt, Homo sapiens
ccaguguacugcuu

SEQ ID NO: 2011552 - RNA, 16 nt, Homo sapiens
gcuugucauuccagag

SEQ ID NO: 2011553 - RNA, 16 nt, Homo sapiens
cccagccucucuuccu

SEQ ID NO: 2011554 - RNA, 20 nt, Homo sapiens
gcauaccuuuauugugaucu

SEQ ID NO: 2011555 - RNA, 19 nt, Homo sapiens
gagguugggcugagacccu

SEQ ID NO: 2011556 - RNA, 19 nt, Homo sapiens
cucuuccucucuuccucca

SEQ ID NO: 2011557 - RNA, 18 nt, Homo sapiens
uaaucaucaaguaauaca

SEQ ID NO: 2011558 - RNA, 18 nt, Homo sapiens
cuuaauucuuuucacuca

SEQ ID NO: 2011559 - RNA, 16 nt, Homo sapiens
cgcaucucagugcagg

SEQ ID NO: 2011560 - RNA, 23 nt, Homo sapiens
uaaaauaaagcuaccauuuuaca

SEQ ID NO: 2011561 - RNA, 16 nt, Homo sapiens
cucggggagugccacu

SEQ ID NO: 2011562 - RNA, 16 nt, Homo sapiens
augaccuugggguaca

SEQ ID NO: 2011563 - RNA, 22 nt, Homo sapiens
auccagauugggugccagcaua

SEQ ID NO: 2011564 - RNA, 20 nt, Homo sapiens
cagauuggcucacacugaga

SEQ ID NO: 2011565 - RNA, 16 nt, Homo sapiens
auauaaggaaagcaau

SEQ ID NO: 2011566 - RNA, 19 nt, Homo sapiens
agguggcaggaccaggacu

SEQ ID NO: 2011567 - RNA, 15 nt, Homo sapiens
gacacacacagcuuc

SEQ ID NO: 2011568 - RNA, 13 nt, Homo sapiens
caaggaaacucga

SEQ ID NO: 2011569 - RNA, 20 nt, Homo sapiens
cagcuagaaaaggccuucuu

SEQ ID NO: 2011570 - RNA, 15 nt, Homo sapiens
guuacaugcauacuu

SEQ ID NO: 2011571 - RNA, 18 nt, Homo sapiens
ugcaggaucccuacugcc

SEQ ID NO: 2011572 - RNA, 17 nt, Homo sapiens
agcccauagcacugggc

SEQ ID NO: 2011573 - RNA, 16 nt, Homo sapiens
acauaaacuuguacuu

SEQ ID NO: 2011574 - RNA, 19 nt, Homo sapiens
cagauucauauaaccacaa

SEQ ID NO: 2011575 - RNA, 19 nt, Homo sapiens
ugaagagugaagagcauuu

SEQ ID NO: 2011576 - RNA, 16 nt, Homo sapiens
agagcucuacaggccu

SEQ ID NO: 2011577 - RNA, 11 nt, Homo sapiens
ccuaccccaga

SEQ ID NO: 2011578 - RNA, 17 nt, Homo sapiens
cuguggcaaaugccagu

SEQ ID NO: 2011579 - RNA, 18 nt, Homo sapiens
auggugcuagaagaauuu

SEQ ID NO: 2011580 - RNA, 12 nt, Homo sapiens
uuggaaggugac

SEQ ID NO: 2011581 - RNA, 13 nt, Homo sapiens
gcaaugccauuuc

SEQ ID NO: 2011582 - RNA, 22 nt, Homo sapiens
aaacucagccugggacaguuua

SEQ ID NO: 2011583 - RNA, 19 nt, Homo sapiens
cugacucucgugcauuuca

SEQ ID NO: 2011584 - RNA, 17 nt, Homo sapiens
gaaugugguuacuuccu

SEQ ID NO: 2011585 - RNA, 17 nt, Homo sapiens
ccugagaguggugcccu

SEQ ID NO: 2011586 - RNA, 16 nt, Homo sapiens
aaaaugucuguuucaa

SEQ ID NO: 2011587 - RNA, 21 nt, Homo sapiens
aaguaacaugcauacuuuauu

SEQ ID NO: 2011588 - RNA, 16 nt, Homo sapiens
uaaagacuacaauaaa

SEQ ID NO: 2011589 - RNA, 17 nt, Homo sapiens
ccuucaaguaugugcua

SEQ ID NO: 2011590 - RNA, 18 nt, Homo sapiens
cuguuuuuacaguggaau

SEQ ID NO: 2011591 - RNA, 15 nt, Homo sapiens
uaacugaacugugaa

SEQ ID NO: 2011592 - RNA, 20 nt, Homo sapiens
uguggucagcgguaugugcg

SEQ ID NO: 2011593 - RNA, 17 nt, Homo sapiens
aacuaggcucauacuca

SEQ ID NO: 2011594 - RNA, 15 nt, Homo sapiens
uauuucagaaauaca

SEQ ID NO: 2011595 - RNA, 10 nt, Homo sapiens
guugcagcug

SEQ ID NO: 2011596 - RNA, 22 nt, Homo sapiens
uccuuuuuauuuuuuuguacag

SEQ ID NO: 2011597 - RNA, 14 nt, Homo sapiens
aucugagaaacucu

SEQ ID NO: 2011598 - RNA, 20 nt, Homo sapiens
aaaggcccuucaccucugga

SEQ ID NO: 2011599 - RNA, 18 nt, Homo sapiens
cugaggauguaaagauca

SEQ ID NO: 2011600 - RNA, 16 nt, Homo sapiens
agaggggacauuuccc

SEQ ID NO: 2011601 - RNA, 19 nt, Homo sapiens
acaaaucuuuccauaucca

SEQ ID NO: 2011602 - RNA, 14 nt, Homo sapiens
uaguacaauucuua

SEQ ID NO: 2011603 - RNA, 11 nt, Homo sapiens
guagugcaagc

SEQ ID NO: 2011604 - RNA, 18 nt, Homo sapiens
gaaguccccucuacuuua

SEQ ID NO: 2011605 - RNA, 22 nt, Homo sapiens
augugaaggggagagacagggg

SEQ ID NO: 2011606 - RNA, 12 nt, Homo sapiens
cccaacugugau

SEQ ID NO: 2011607 - RNA, 21 nt, Homo sapiens
accucuugaaaauagaacaac

SEQ ID NO: 2011608 - RNA, 13 nt, Homo sapiens
gaguagauugauu

SEQ ID NO: 2011609 - RNA, 14 nt, Homo sapiens
uucucaugugaucc

SEQ ID NO: 2011610 - RNA, 20 nt, Homo sapiens
uuaauaaccugccaguccca

SEQ ID NO: 2011611 - RNA, 17 nt, Homo sapiens
uggcucagccagcacuu

SEQ ID NO: 2011612 - RNA, 14 nt, Homo sapiens
guucaagacugaaa

SEQ ID NO: 2011613 - RNA, 19 nt, Homo sapiens
cugcuucaaacucaaacac

SEQ ID NO: 2011614 - RNA, 16 nt, Homo sapiens
caucagucaaugaaua

SEQ ID NO: 2011615 - RNA, 23 nt, Homo sapiens
gcaugguggaacccccaucucua

SEQ ID NO: 2011616 - RNA, 24 nt, Homo sapiens
agccaaagccaauaacacacagcu

SEQ ID NO: 2011617 - RNA, 17 nt, Homo sapiens
cauuuccgaagaccuuc

SEQ ID NO: 2011618 - RNA, 11 nt, Homo sapiens
gccuuacacaa

SEQ ID NO: 2011619 - RNA, 12 nt, Homo sapiens
aaaauaccaaau

SEQ ID NO: 2011620 - RNA, 21 nt, Homo sapiens
caggauugaccuuugcacgaa

SEQ ID NO: 2011621 - RNA, 13 nt, Homo sapiens
auugcauguuaau

SEQ ID NO: 2011622 - RNA, 20 nt, Homo sapiens
gccugcacucuuauuucacu

SEQ ID NO: 2011623 - RNA, 15 nt, Homo sapiens
uucuuuuuguacuuu

SEQ ID NO: 2011624 - RNA, 15 nt, Homo sapiens
cucauaaaaagcaaa

SEQ ID NO: 2011625 - RNA, 13 nt, Homo sapiens
aggccacauugac

SEQ ID NO: 2011626 - RNA, 16 nt, Homo sapiens
gacuauuuaccaggga

SEQ ID NO: 2011627 - RNA, 12 nt, Homo sapiens
uguaaugcugca

SEQ ID NO: 2011628 - RNA, 17 nt, Homo sapiens
uggaaaaucacaccacc

SEQ ID NO: 2011629 - RNA, 17 nt, Homo sapiens
uagcuauucuuugacca

SEQ ID NO: 2011630 - RNA, 17 nt, Homo sapiens
cuuuauccaauccucag

SEQ ID NO: 2011631 - RNA, 13 nt, Homo sapiens
uuuucuuugccau

SEQ ID NO: 2011632 - RNA, 22 nt, Homo sapiens
cuuuauagaucagccagugacc

SEQ ID NO: 2011633 - RNA, 21 nt, Homo sapiens
cccauuaaagagccaguuuau

SEQ ID NO: 2011634 - RNA, 21 nt, Homo sapiens
cuguuggccucaagcaaggaa

SEQ ID NO: 2011635 - RNA, 17 nt, Homo sapiens
acacccccaagccacag

SEQ ID NO: 2011636 - RNA, 19 nt, Homo sapiens
cugcucuuuuauacuguac

SEQ ID NO: 2011637 - RNA, 13 nt, Homo sapiens
ugacuaccagcua

SEQ ID NO: 2011638 - RNA, 13 nt, Homo sapiens
agauuaccugcca

SEQ ID NO: 2011639 - RNA, 13 nt, Homo sapiens
agcuuaccugaca

SEQ ID NO: 2011640 - RNA, 14 nt, Homo sapiens
uuauugacacugaa

SEQ ID NO: 2011641 - RNA, 14 nt, Homo sapiens
gaaagaggugaaag

SEQ ID NO: 2011642 - RNA, 17 nt, Homo sapiens
acuccuggagauuucag

SEQ ID NO: 2011643 - RNA, 18 nt, Homo sapiens
ccacacgauuagcuuuau

SEQ ID NO: 2011644 - RNA, 15 nt, Homo sapiens
ccccaucuuccagcc

SEQ ID NO: 2011645 - RNA, 16 nt, Homo sapiens
aucuucuuucaugaag

SEQ ID NO: 2011646 - RNA, 12 nt, Homo sapiens
caggaaaauuaa

SEQ ID NO: 2011647 - RNA, 16 nt, Homo sapiens
aaucagacacaauuag

SEQ ID NO: 2011648 - RNA, 16 nt, Homo sapiens
ccuagauccagggaua

SEQ ID NO: 2011649 - RNA, 22 nt, Homo sapiens
uagcagaaaggaaaagauuccu

SEQ ID NO: 2011650 - RNA, 22 nt, Homo sapiens
aacaauguuucuucaguggcaa

SEQ ID NO: 2011651 - RNA, 18 nt, Homo sapiens
caagugguccacaagcuu

SEQ ID NO: 2011652 - RNA, 15 nt, Homo sapiens
uauagauauuacugg

SEQ ID NO: 2011653 - RNA, 15 nt, Homo sapiens
augcaacaacaugua

SEQ ID NO: 2011654 - RNA, 15 nt, Homo sapiens
cuaaaggacuauuau

SEQ ID NO: 2011655 - RNA, 13 nt, Homo sapiens
cucuuuaugacug

SEQ ID NO: 2011656 - RNA, 12 nt, Homo sapiens
ccgcacuuccuu

SEQ ID NO: 2011657 - RNA, 15 nt, Homo sapiens
uuccaaugaugggau

SEQ ID NO: 2011658 - RNA, 19 nt, Homo sapiens
uguucugcgcuguguacaa

SEQ ID NO: 2011659 - RNA, 21 nt, Homo sapiens
aaugcuucaaguuuagugcau

SEQ ID NO: 2011660 - RNA, 14 nt, Homo sapiens
gagcuugcuccaga

SEQ ID NO: 2011661 - RNA, 20 nt, Homo sapiens
aaccuacagaauacuagcca

SEQ ID NO: 2011662 - RNA, 21 nt, Homo sapiens
gcuggugggauaggagggugc

SEQ ID NO: 2011663 - RNA, 14 nt, Homo sapiens
cacucccugccaac

SEQ ID NO: 2011664 - RNA, 21 nt, Homo sapiens
uguacccuggcuacaacuuca

SEQ ID NO: 2011665 - RNA, 18 nt, Homo sapiens
aacacguggguauuuaau

SEQ ID NO: 2011666 - RNA, 21 nt, Homo sapiens
guaaccugggaaagccaugac

SEQ ID NO: 2011667 - RNA, 22 nt, Homo sapiens
uccccagcucccccaggcagaa

SEQ ID NO: 2011668 - RNA, 14 nt, Homo sapiens
gucaccuagcucaa

SEQ ID NO: 2011669 - RNA, 18 nt, Homo sapiens
caugccaaguaucuuucc

SEQ ID NO: 2011670 - RNA, 16 nt, Homo sapiens
agaucaauuucuccca

SEQ ID NO: 2011671 - RNA, 23 nt, Homo sapiens
gucuauaucauaacuauacuuga

SEQ ID NO: 2011672 - RNA, 18 nt, Homo sapiens
ccccugguaaaccaagcc

SEQ ID NO: 2011673 - RNA, 18 nt, Homo sapiens
ggccuaggugcgcagugu

SEQ ID NO: 2011674 - RNA, 13 nt, Homo sapiens
cucauuacuguga

SEQ ID NO: 2011675 - RNA, 18 nt, Homo sapiens
gcuccugcccagccaccc

SEQ ID NO: 2011676 - RNA, 18 nt, Homo sapiens
cuauaagcaugacauacu

SEQ ID NO: 2011677 - RNA, 22 nt, Homo sapiens
agacuuguuucuccaugggcuc

SEQ ID NO: 2011678 - RNA, 20 nt, Homo sapiens
aagcccuuguccccaugaaa

SEQ ID NO: 2011679 - RNA, 14 nt, Homo sapiens
ucgaugcucacugc

SEQ ID NO: 2011680 - RNA, 18 nt, Homo sapiens
gguagcuauuuguuuaca

SEQ ID NO: 2011681 - RNA, 21 nt, Homo sapiens
acauacaccuaugucauuuca

SEQ ID NO: 2011682 - RNA, 18 nt, Homo sapiens
cucugacccuccuucuau

SEQ ID NO: 2011683 - RNA, 18 nt, Homo sapiens
gaaauaacuggaagugaa

SEQ ID NO: 2011684 - RNA, 13 nt, Homo sapiens
cuaccacauucac

SEQ ID NO: 2011685 - RNA, 23 nt, Homo sapiens
cagcauuagagaaaugaauuaua

SEQ ID NO: 2011686 - RNA, 17 nt, Homo sapiens
ucugcugucucaucaca

SEQ ID NO: 2011687 - RNA, 13 nt, Homo sapiens
auaccccuaacau

SEQ ID NO: 2011688 - RNA, 16 nt, Homo sapiens
cagggacuccaugcug

SEQ ID NO: 2011689 - RNA, 20 nt, Homo sapiens
cacacuccuccaaggcacaa

SEQ ID NO: 2011690 - RNA, 13 nt, Homo sapiens
ggcaaagguuuau

SEQ ID NO: 2011691 - RNA, 18 nt, Homo sapiens
aucucagaucacugcaac

SEQ ID NO: 2011692 - RNA, 21 nt, Homo sapiens
cccucggccugggauuucaga

SEQ ID NO: 2011693 - RNA, 13 nt, Homo sapiens
ccgugacccugag

SEQ ID NO: 2011694 - RNA, 15 nt, Homo sapiens
cauucccugggccaa

SEQ ID NO: 2011695 - RNA, 20 nt, Homo sapiens
uaccauuguacccugcugua

SEQ ID NO: 2011696 - RNA, 15 nt, Homo sapiens
gacggaauuggguuu

SEQ ID NO: 2011697 - RNA, 15 nt, Homo sapiens
auauauuuccacuuc

SEQ ID NO: 2011698 - RNA, 20 nt, Homo sapiens
acucaagugccauucauccu

SEQ ID NO: 2011699 - RNA, 21 nt, Homo sapiens
auauguuuggaauauuccacu

SEQ ID NO: 2011700 - RNA, 21 nt, Homo sapiens
aucuuguccaaguuguuucau

SEQ ID NO: 2011701 - RNA, 15 nt, Homo sapiens
cuuuuaacauaauau

SEQ ID NO: 2011702 - RNA, 23 nt, Homo sapiens
ucagaccuuuacugauacuacaa

SEQ ID NO: 2011703 - RNA, 15 nt, Homo sapiens
ggcagaaaacagcuc

SEQ ID NO: 2011704 - RNA, 18 nt, Homo sapiens
cauagcagaugguuucca

SEQ ID NO: 2011705 - RNA, 22 nt, Homo sapiens
aaaguauuagcaugagcuuucc

SEQ ID NO: 2011706 - RNA, 18 nt, Homo sapiens
cuaccaagugaccauaaa

SEQ ID NO: 2011707 - RNA, 22 nt, Homo sapiens
cauugagcgugaccuugcaaug

SEQ ID NO: 2011708 - RNA, 22 nt, Homo sapiens
gccccacacagcuacagcuuuc

SEQ ID NO: 2011709 - RNA, 21 nt, Homo sapiens
uccaugccuauuuacuggaaa

SEQ ID NO: 2011710 - RNA, 16 nt, Homo sapiens
gacccagggacucucc

SEQ ID NO: 2011711 - RNA, 18 nt, Homo sapiens
agcccucaggucagggug

SEQ ID NO: 2011712 - RNA, 23 nt, Homo sapiens
acuggaaaggaaagaugaugcuc

SEQ ID NO: 2011713 - RNA, 22 nt, Homo sapiens
uauuuaaccuaguucaaugugc

SEQ ID NO: 2011714 - RNA, 12 nt, Homo sapiens
ucagggucuaag

SEQ ID NO: 2011715 - RNA, 12 nt, Homo sapiens
ccgggguccagg

SEQ ID NO: 2011716 - RNA, 15 nt, Homo sapiens
gacucucugccugcu

SEQ ID NO: 2011717 - RNA, 14 nt, Homo sapiens
ugggagcaggagau

SEQ ID NO: 2011718 - RNA, 18 nt, Homo sapiens
cugauccauaaagacaau

SEQ ID NO: 2011719 - RNA, 18 nt, Homo sapiens
uaauucucaugugauccu

SEQ ID NO: 2011720 - RNA, 12 nt, Homo sapiens
cugugacugaca

SEQ ID NO: 2011721 - RNA, 12 nt, Homo sapiens
cacugacuguga

SEQ ID NO: 2011722 - RNA, 17 nt, Homo sapiens
ugagaauuaucaccaug

SEQ ID NO: 2011723 - RNA, 18 nt, Homo sapiens
gcuuuccguaaaugcaaa

SEQ ID NO: 2011724 - RNA, 20 nt, Homo sapiens
aacaguuccuucagcuucca

SEQ ID NO: 2011725 - RNA, 17 nt, Homo sapiens
ccugucgauuagacugg

SEQ ID NO: 2011726 - RNA, 14 nt, Homo sapiens
aaaaccuuccccag

SEQ ID NO: 2011727 - RNA, 17 nt, Homo sapiens
ugcaauaacagcugcaa

SEQ ID NO: 2011728 - RNA, 15 nt, Homo sapiens
gucauccauauuugc

SEQ ID NO: 2011729 - RNA, 12 nt, Homo sapiens
aaucuguugcua

SEQ ID NO: 2011730 - RNA, 21 nt, Homo sapiens
cucccucuggaggcaggcuug

SEQ ID NO: 2011731 - RNA, 22 nt, Homo sapiens
uaccccaguuccuagcacugcc

SEQ ID NO: 2011732 - RNA, 13 nt, Homo sapiens
uauuagauuuauu

SEQ ID NO: 2011733 - RNA, 19 nt, Homo sapiens
uaaacuaauauuuguuuca

SEQ ID NO: 2011734 - RNA, 19 nt, Homo sapiens
caacuacccaccuggggau

SEQ ID NO: 2011735 - RNA, 16 nt, Homo sapiens
cuacaggaucuuuauu

SEQ ID NO: 2011736 - RNA, 13 nt, Homo sapiens
ucacuauuaucua

SEQ ID NO: 2011737 - RNA, 18 nt, Homo sapiens
cggagaggcugcacuugu

SEQ ID NO: 2011738 - RNA, 18 nt, Homo sapiens
cugugccuccccccagac

SEQ ID NO: 2011739 - RNA, 17 nt, Homo sapiens
agcucggcgaauucuca

SEQ ID NO: 2011740 - RNA, 14 nt, Homo sapiens
uuucaguugcagua

SEQ ID NO: 2011741 - RNA, 23 nt, Homo sapiens
gccagaagucacauuuuaccaau

SEQ ID NO: 2011742 - RNA, 13 nt, Homo sapiens
aauuguagcacau

SEQ ID NO: 2011743 - RNA, 14 nt, Homo sapiens
agauuaauuacucu

SEQ ID NO: 2011744 - RNA, 21 nt, Homo sapiens
cagagaaucucuagugaauuu

SEQ ID NO: 2011745 - RNA, 23 nt, Homo sapiens
agugaaacuugggcacaugcuca

SEQ ID NO: 2011746 - RNA, 19 nt, Homo sapiens
auuaaagcucuucauuucu

SEQ ID NO: 2011747 - RNA, 15 nt, Homo sapiens
uggagcugaaaacau

SEQ ID NO: 2011748 - RNA, 22 nt, Homo sapiens
augacauuuguauucucagaca

SEQ ID NO: 2011749 - RNA, 22 nt, Homo sapiens
agacuuggcuccaccacugaua

SEQ ID NO: 2011750 - RNA, 18 nt, Homo sapiens
aggggucgccaacacuug

SEQ ID NO: 2011751 - RNA, 19 nt, Homo sapiens
caguuauuuugucacccaa

SEQ ID NO: 2011752 - RNA, 13 nt, Homo sapiens
uguggguuucuaa

SEQ ID NO: 2011753 - RNA, 23 nt, Homo sapiens
ucagcuuuauaauaaacuguuua

SEQ ID NO: 2011754 - RNA, 18 nt, Homo sapiens
accacaaacggagccccu

SEQ ID NO: 2011755 - RNA, 14 nt, Homo sapiens
cacauucugccuug

SEQ ID NO: 2011756 - RNA, 20 nt, Homo sapiens
gccuguugaagaugcuugua

SEQ ID NO: 2011757 - RNA, 16 nt, Homo sapiens
gcucuuggacaacagc

SEQ ID NO: 2011758 - RNA, 17 nt, Homo sapiens
ugacugauguuggggaa

SEQ ID NO: 2011759 - RNA, 19 nt, Homo sapiens
caggacugugccagcacaa

SEQ ID NO: 2011760 - RNA, 20 nt, Homo sapiens
gccacugauauucagaauua

SEQ ID NO: 2011761 - RNA, 20 nt, Homo sapiens
ucuggauuucauacuguaac

SEQ ID NO: 2011762 - RNA, 15 nt, Homo sapiens
uggcauaaaucugaa

SEQ ID NO: 2011763 - RNA, 19 nt, Homo sapiens
gcauaaaaauuaaauggau

SEQ ID NO: 2011764 - RNA, 17 nt, Homo sapiens
gaaggcuacauauacau

SEQ ID NO: 2011765 - RNA, 16 nt, Homo sapiens
ugcacucauguggacu

SEQ ID NO: 2011766 - RNA, 20 nt, Homo sapiens
cuccugugcuagaugugcaa

SEQ ID NO: 2011767 - RNA, 16 nt, Homo sapiens
ugaauauucaacagcu

SEQ ID NO: 2011768 - RNA, 20 nt, Homo sapiens
gacagggcccuggagcucag

SEQ ID NO: 2011769 - RNA, 18 nt, Homo sapiens
augagggaaauugcuauu

SEQ ID NO: 2011770 - RNA, 19 nt, Homo sapiens
cccaccugucaaacaaagc

SEQ ID NO: 2011771 - RNA, 18 nt, Homo sapiens
ccugcuucacaccccuca

SEQ ID NO: 2011772 - RNA, 14 nt, Homo sapiens
gucaccagccugac

SEQ ID NO: 2011773 - RNA, 17 nt, Homo sapiens
aagauuuccuacuuucu

SEQ ID NO: 2011774 - RNA, 17 nt, Homo sapiens
augauacugauuaugaa

SEQ ID NO: 2011775 - RNA, 16 nt, Homo sapiens
uacuuuucugccaaaa

SEQ ID NO: 2011776 - RNA, 12 nt, Homo sapiens
ugcuucucuuua

SEQ ID NO: 2011777 - RNA, 14 nt, Homo sapiens
guaagcauucugag

SEQ ID NO: 2011778 - RNA, 13 nt, Homo sapiens
cauuuggccucuu

SEQ ID NO: 2011779 - RNA, 20 nt, Homo sapiens
caagcagggaagccccagug

SEQ ID NO: 2011780 - RNA, 22 nt, Homo sapiens
aagacauucaccaacaacaguc

SEQ ID NO: 2011781 - RNA, 20 nt, Homo sapiens
cuuaaccagaucauugugaa

SEQ ID NO: 2011782 - RNA, 15 nt, Homo sapiens
uaaagguuaccuguu

SEQ ID NO: 2011783 - RNA, 14 nt, Homo sapiens
ggaaacaguccaaa

SEQ ID NO: 2011784 - RNA, 14 nt, Homo sapiens
uggacuugccuaaa

SEQ ID NO: 2011785 - RNA, 20 nt, Homo sapiens
cagacuuuggaaaaugcauu

SEQ ID NO: 2011786 - RNA, 21 nt, Homo sapiens
agcucgcuggcuuucucucug

SEQ ID NO: 2011787 - RNA, 18 nt, Homo sapiens
aguuuuguacauaacuua

SEQ ID NO: 2011788 - RNA, 19 nt, Homo sapiens
uaaauauagaaccaugaau

SEQ ID NO: 2011789 - RNA, 15 nt, Homo sapiens
caaaaaaaucugcag

SEQ ID NO: 2011790 - RNA, 21 nt, Homo sapiens
uccuucugccuaacuuguaaa

SEQ ID NO: 2011791 - RNA, 22 nt, Homo sapiens
aaaguuccaugaauucuugauu

SEQ ID NO: 2011792 - RNA, 21 nt, Homo sapiens
gaauaaauguaucugaauauc

SEQ ID NO: 2011793 - RNA, 18 nt, Homo sapiens
cucugggucucagugucc

SEQ ID NO: 2011794 - RNA, 14 nt, Homo sapiens
cugccucugccucc

SEQ ID NO: 2011795 - RNA, 20 nt, Homo sapiens
uccugaggcagaaccuggug

SEQ ID NO: 2011796 - RNA, 19 nt, Homo sapiens
ugauacccaacaguuuauu

SEQ ID NO: 2011797 - RNA, 17 nt, Homo sapiens
uaacugcaccugggcag

SEQ ID NO: 2011798 - RNA, 14 nt, Homo sapiens
ccucagacccagga

SEQ ID NO: 2011799 - RNA, 18 nt, Homo sapiens
gugcugggagaugcucuc

SEQ ID NO: 2011800 - RNA, 16 nt, Homo sapiens
ccaggcuggucucaaa

SEQ ID NO: 2011801 - RNA, 21 nt, Homo sapiens
cugguucuguuuugcacccag

SEQ ID NO: 2011802 - RNA, 23 nt, Homo sapiens
cccaacugcucugcccacuguga

SEQ ID NO: 2011803 - RNA, 16 nt, Homo sapiens
agaugagaguacaccc

SEQ ID NO: 2011804 - RNA, 15 nt, Homo sapiens
uccuugauaacagcu

SEQ ID NO: 2011805 - RNA, 14 nt, Homo sapiens
ccucuguguuagaa

SEQ ID NO: 2011806 - RNA, 22 nt, Homo sapiens
ugaagaguccgugguugcccua

SEQ ID NO: 2011807 - RNA, 21 nt, Homo sapiens
auuucucuugcuggaacuguu

SEQ ID NO: 2011808 - RNA, 19 nt, Homo sapiens
gauaaugcuguugccucau

SEQ ID NO: 2011809 - RNA, 19 nt, Homo sapiens
auuugcacccaugccauag

SEQ ID NO: 2011810 - RNA, 19 nt, Homo sapiens
ugaccuuucugagugacau

SEQ ID NO: 2011811 - RNA, 19 nt, Homo sapiens
gcucccaggagggcuuugu

SEQ ID NO: 2011812 - RNA, 22 nt, Homo sapiens
uggaaaccaaggaaagugaaac

SEQ ID NO: 2011813 - RNA, 23 nt, Homo sapiens
ccgcgcuggcggugaaaauuuca

SEQ ID NO: 2011814 - RNA, 20 nt, Homo sapiens
caagaggaaggggugcugug

SEQ ID NO: 2011815 - RNA, 20 nt, Homo sapiens
uuuguguguaccugugacua

SEQ ID NO: 2011816 - RNA, 17 nt, Homo sapiens
aauauccauacagucaa

SEQ ID NO: 2011817 - RNA, 17 nt, Homo sapiens
cugcacccacccaggag

SEQ ID NO: 2011818 - RNA, 21 nt, Homo sapiens
caugguggugagcaccuguaa

SEQ ID NO: 2011819 - RNA, 15 nt, Homo sapiens
ggaaguucaacuucc

SEQ ID NO: 2011820 - RNA, 19 nt, Homo sapiens
uaaacugaaugaacaaccu

SEQ ID NO: 2011821 - RNA, 21 nt, Homo sapiens
aaguguuggccaucauuucau

SEQ ID NO: 2011822 - RNA, 23 nt, Homo sapiens
uaacuugugauuccagggcuguu

SEQ ID NO: 2011823 - RNA, 16 nt, Homo sapiens
gcccuucaagugcacu

SEQ ID NO: 2011824 - RNA, 18 nt, Homo sapiens
uuacacuguuucaucuca

SEQ ID NO: 2011825 - RNA, 20 nt, Homo sapiens
cacaggacugaaaagggaau

SEQ ID NO: 2011826 - RNA, 14 nt, Homo sapiens
gauuagaacacuca

SEQ ID NO: 2011827 - RNA, 14 nt, Homo sapiens
uuugaaugugugaa

SEQ ID NO: 2011828 - RNA, 15 nt, Homo sapiens
gccuauaagccaaaa

SEQ ID NO: 2011829 - RNA, 15 nt, Homo sapiens
uguucauauguacuu

SEQ ID NO: 2011830 - RNA, 14 nt, Homo sapiens
acuguuucaaauca

SEQ ID NO: 2011831 - RNA, 22 nt, Homo sapiens
auggcagggccucaucucaccu

SEQ ID NO: 2011832 - RNA, 15 nt, Homo sapiens
agaaaaccaaagggu

SEQ ID NO: 2011833 - RNA, 21 nt, Homo sapiens
ugcaucaauauguauuacaaa

SEQ ID NO: 2011834 - RNA, 14 nt, Homo sapiens
aauggaaaccaagg

SEQ ID NO: 2011835 - RNA, 14 nt, Homo sapiens
gacaguauugccac

SEQ ID NO: 2011836 - RNA, 17 nt, Homo sapiens
gaaaggccacucaggau

SEQ ID NO: 2011837 - RNA, 13 nt, Homo sapiens
cugaagaaauugg

SEQ ID NO: 2011838 - RNA, 13 nt, Homo sapiens
cuuucuaacaaaa

SEQ ID NO: 2011839 - RNA, 13 nt, Homo sapiens
cagugcucauuca

SEQ ID NO: 2011840 - RNA, 18 nt, Homo sapiens
cccuaaagucucagguga

SEQ ID NO: 2011841 - RNA, 24 nt, Homo sapiens
uuuuaaaaaaauaaaacaguaucu

SEQ ID NO: 2011842 - RNA, 20 nt, Homo sapiens
cagcucugucccaggauggu

SEQ ID NO: 2011843 - RNA, 18 nt, Homo sapiens
aagguucuuuagcuguca

SEQ ID NO: 2011844 - RNA, 17 nt, Homo sapiens
acuuucccacacuguga

SEQ ID NO: 2011845 - RNA, 20 nt, Homo sapiens
caucacuagccaugauaacu

SEQ ID NO: 2011846 - RNA, 14 nt, Homo sapiens
uauggcgaacacag

SEQ ID NO: 2011847 - RNA, 20 nt, Homo sapiens
gcccagacucaaggccucca

SEQ ID NO: 2011848 - RNA, 15 nt, Homo sapiens
ggauugcaaugcccg

SEQ ID NO: 2011849 - RNA, 13 nt, Homo sapiens
aaaagaagugugc

SEQ ID NO: 2011850 - RNA, 14 nt, Homo sapiens
augugugagugugu

SEQ ID NO: 2011851 - RNA, 21 nt, Homo sapiens
cauuccuuagcagcucaggcg

SEQ ID NO: 2011852 - RNA, 20 nt, Homo sapiens
aguagcugggauuacaggug

SEQ ID NO: 2011853 - RNA, 15 nt, Homo sapiens
guaaaaacaaagaaa

SEQ ID NO: 2011854 - RNA, 11 nt, Homo sapiens
cgcgugcacac

SEQ ID NO: 2011855 - RNA, 15 nt, Homo sapiens
ucgaaggaaccugug

SEQ ID NO: 2011856 - RNA, 21 nt, Homo sapiens
auugagcagaagaucaaggag

SEQ ID NO: 2011857 - RNA, 14 nt, Homo sapiens
acuucccugggaac

SEQ ID NO: 2011858 - RNA, 20 nt, Homo sapiens
cuacccucagucuacacuca

SEQ ID NO: 2011859 - RNA, 13 nt, Homo sapiens
agcaagauugaaa

SEQ ID NO: 2011860 - RNA, 13 nt, Homo sapiens
gacaacaucgcaa

SEQ ID NO: 2011861 - RNA, 17 nt, Homo sapiens
acaaagcaaaggcaguc

SEQ ID NO: 2011862 - RNA, 14 nt, Homo sapiens
uaguguucacaaac

SEQ ID NO: 2011863 - RNA, 20 nt, Homo sapiens
accccguuuuccagcaugug

SEQ ID NO: 2011864 - RNA, 14 nt, Homo sapiens
caccuugacagggc

SEQ ID NO: 2011865 - RNA, 16 nt, Homo sapiens
caaggguggccuugaa

SEQ ID NO: 2011866 - RNA, 16 nt, Homo sapiens
cccuucucugcccauu

SEQ ID NO: 2011867 - RNA, 18 nt, Homo sapiens
caagucauggacauucau

SEQ ID NO: 2011868 - RNA, 13 nt, Homo sapiens
gaacugaagccac

SEQ ID NO: 2011869 - RNA, 17 nt, Homo sapiens
uaaaaagagauugcuuc

SEQ ID NO: 2011870 - RNA, 18 nt, Homo sapiens
aauaauauguacuaagaa

SEQ ID NO: 2011871 - RNA, 15 nt, Homo sapiens
aucugucaugagcau

SEQ ID NO: 2011872 - RNA, 21 nt, Homo sapiens
cauugaaaucagcaugacaaa

SEQ ID NO: 2011873 - RNA, 23 nt, Homo sapiens
gugggacuccaggccagcuccuu

SEQ ID NO: 2011874 - RNA, 21 nt, Homo sapiens
gaaaggcaaaaaugugcccuu

SEQ ID NO: 2011875 - RNA, 24 nt, Homo sapiens
ccaaguuccacuuuucugcaggua

SEQ ID NO: 2011876 - RNA, 22 nt, Homo sapiens
guaacugugccaguucuuucca

SEQ ID NO: 2011877 - RNA, 16 nt, Homo sapiens
uauuguuucaauugca

SEQ ID NO: 2011878 - RNA, 21 nt, Homo sapiens
aucuucuguuccacauccaca

SEQ ID NO: 2011879 - RNA, 18 nt, Homo sapiens
ggcacauucuuaucucca

SEQ ID NO: 2011880 - RNA, 16 nt, Homo sapiens
aaugaaccuucugcaa

SEQ ID NO: 2011881 - RNA, 20 nt, Homo sapiens
agcagacaggccccgugagg

SEQ ID NO: 2011882 - RNA, 21 nt, Homo sapiens
caagugagagagaugggagcu

SEQ ID NO: 2011883 - RNA, 20 nt, Homo sapiens
uaucaguuuuauagcuuuau

SEQ ID NO: 2011884 - RNA, 21 nt, Homo sapiens
gcagauaacagaaaggcuuuu

SEQ ID NO: 2011885 - RNA, 13 nt, Homo sapiens
uaggaacuuuaug

SEQ ID NO: 2011886 - RNA, 19 nt, Homo sapiens
gacugcaguggacaguccc

SEQ ID NO: 2011887 - RNA, 20 nt, Homo sapiens
ugggagcccugaccuuggcu

SEQ ID NO: 2011888 - RNA, 17 nt, Homo sapiens
uaaauagcuauauccau

SEQ ID NO: 2011889 - RNA, 23 nt, Homo sapiens
ggccugaaucaaggaaagccagg

SEQ ID NO: 2011890 - RNA, 16 nt, Homo sapiens
cagaccauccaccagg

SEQ ID NO: 2011891 - RNA, 18 nt, Homo sapiens
aaugugggaagaaacaaa

SEQ ID NO: 2011892 - RNA, 16 nt, Homo sapiens
aacaacagaucugcag

SEQ ID NO: 2011893 - RNA, 14 nt, Homo sapiens
cuuauugacuauua

SEQ ID NO: 2011894 - RNA, 17 nt, Homo sapiens
cagacacacacacacaa

SEQ ID NO: 2011895 - RNA, 18 nt, Homo sapiens
aaauuacuggaaggcuuc

SEQ ID NO: 2011896 - RNA, 22 nt, Homo sapiens
uguuuccuccccaucagccucc

SEQ ID NO: 2011897 - RNA, 20 nt, Homo sapiens
uaaauuuuaagguauucgaa

SEQ ID NO: 2011898 - RNA, 18 nt, Homo sapiens
cacuucaaugcacauggu

SEQ ID NO: 2011899 - RNA, 22 nt, Homo sapiens
cuaucacuuuaaauacuauuau

SEQ ID NO: 2011900 - RNA, 22 nt, Homo sapiens
gcuuuagaugaggaaaugaucc

SEQ ID NO: 2011901 - RNA, 20 nt, Homo sapiens
ccaggccauaccaggugcua

SEQ ID NO: 2011902 - RNA, 21 nt, Homo sapiens
agauuggaauaggaaauggau

SEQ ID NO: 2011903 - RNA, 12 nt, Homo sapiens
acuccugccuau

SEQ ID NO: 2011904 - RNA, 12 nt, Homo sapiens
gccucagcucau

SEQ ID NO: 2011905 - RNA, 12 nt, Homo sapiens
ucuucagaacac

SEQ ID NO: 2011906 - RNA, 22 nt, Homo sapiens
caccaagagccaauaucuaggc

SEQ ID NO: 2011907 - RNA, 18 nt, Homo sapiens
aauugcagcuguacugag

SEQ ID NO: 2011908 - RNA, 22 nt, Homo sapiens
gucaggauucuucaaggagaau

SEQ ID NO: 2011909 - RNA, 20 nt, Homo sapiens
uaauauggaucagagcauuu

SEQ ID NO: 2011910 - RNA, 19 nt, Homo sapiens
gucauuauccuugcuauga

SEQ ID NO: 2011911 - RNA, 15 nt, Homo sapiens
aguuacuaauauauc

SEQ ID NO: 2011912 - RNA, 18 nt, Homo sapiens
cugaacccacaccugggc

SEQ ID NO: 2011913 - RNA, 15 nt, Homo sapiens
caaaagcuuuuuacu

SEQ ID NO: 2011914 - RNA, 20 nt, Homo sapiens
ucaggagggcagccacggag

SEQ ID NO: 2011915 - RNA, 19 nt, Homo sapiens
uacuucuggagucuauaaa

SEQ ID NO: 2011916 - RNA, 17 nt, Homo sapiens
gcauccuccaguguuac

SEQ ID NO: 2011917 - RNA, 14 nt, Homo sapiens
uccugcugucuucu

SEQ ID NO: 2011918 - RNA, 13 nt, Homo sapiens
uauuaguauuaau

SEQ ID NO: 2011919 - RNA, 23 nt, Homo sapiens
uauuguacauugggcacauaucu

SEQ ID NO: 2011920 - RNA, 20 nt, Homo sapiens
uuaagucauccacagcccaa

SEQ ID NO: 2011921 - RNA, 16 nt, Homo sapiens
ugcagagagguuguga

SEQ ID NO: 2011922 - RNA, 13 nt, Homo sapiens
gagaaggaugguu

SEQ ID NO: 2011923 - RNA, 19 nt, Homo sapiens
ugccugggguguaaugagc

SEQ ID NO: 2011924 - RNA, 15 nt, Homo sapiens
cugggauguuuugag

SEQ ID NO: 2011925 - RNA, 21 nt, Homo sapiens
cuugugucuuuagugcuccaa

SEQ ID NO: 2011926 - RNA, 14 nt, Homo sapiens
cugcuccacccaug

SEQ ID NO: 2011927 - RNA, 18 nt, Homo sapiens
ugucgccaccacuuccag

SEQ ID NO: 2011928 - RNA, 14 nt, Homo sapiens
gagcagcagcacca

SEQ ID NO: 2011929 - RNA, 14 nt, Homo sapiens
ccacagcacagcca

SEQ ID NO: 2011930 - RNA, 22 nt, Homo sapiens
ucauuccaaucuauugcuucac

SEQ ID NO: 2011931 - RNA, 17 nt, Homo sapiens
acaaauccauaauuauu

SEQ ID NO: 2011932 - RNA, 21 nt, Homo sapiens
caggaaguuacccuauauguc

SEQ ID NO: 2011933 - RNA, 21 nt, Homo sapiens
agaaucuagagcaaagccauc

SEQ ID NO: 2011934 - RNA, 20 nt, Homo sapiens
ucgccaugaucagacauaca

SEQ ID NO: 2011935 - RNA, 12 nt, Homo sapiens
cauugauuggua

SEQ ID NO: 2011936 - RNA, 12 nt, Homo sapiens
ugcaaaguaaua

SEQ ID NO: 2011937 - RNA, 16 nt, Homo sapiens
ugacaauccuugagaa

SEQ ID NO: 2011938 - RNA, 12 nt, Homo sapiens
gaagcacuacac

SEQ ID NO: 2011939 - RNA, 13 nt, Homo sapiens
aauuguacugaau

SEQ ID NO: 2011940 - RNA, 19 nt, Homo sapiens
acaucaguuuaaacaaagg

SEQ ID NO: 2011941 - RNA, 18 nt, Homo sapiens
gaaaaagucagcuacaaa

SEQ ID NO: 2011942 - RNA, 18 nt, Homo sapiens
cugcugagugcaccacuu

SEQ ID NO: 2011943 - RNA, 14 nt, Homo sapiens
caccugugcugcug

SEQ ID NO: 2011944 - RNA, 14 nt, Homo sapiens
cuccucugcagcuc

SEQ ID NO: 2011945 - RNA, 22 nt, Homo sapiens
uuaacuuuacuaaguaaucuca

SEQ ID NO: 2011946 - RNA, 14 nt, Homo sapiens
uccaaucggagaca

SEQ ID NO: 2011947 - RNA, 17 nt, Homo sapiens
cauggaguagagucagg

SEQ ID NO: 2011948 - RNA, 19 nt, Homo sapiens
acuccauauggaggccuca

SEQ ID NO: 2011949 - RNA, 21 nt, Homo sapiens
aagaaggccagcccacugggc

SEQ ID NO: 2011950 - RNA, 13 nt, Homo sapiens
cuacuuugccaca

SEQ ID NO: 2011951 - RNA, 14 nt, Homo sapiens
aacacauuguguca

SEQ ID NO: 2011952 - RNA, 12 nt, Homo sapiens
cauaauggacua

SEQ ID NO: 2011953 - RNA, 16 nt, Homo sapiens
aacaauuacuggcuca

SEQ ID NO: 2011954 - RNA, 13 nt, Homo sapiens
ucagaucaugccc

SEQ ID NO: 2011955 - RNA, 20 nt, Homo sapiens
cuucuauucagcauuguacu

SEQ ID NO: 2011956 - RNA, 21 nt, Homo sapiens
uuacucccaggaucagcagaa

SEQ ID NO: 2011957 - RNA, 18 nt, Homo sapiens
auuucauccagggaaaug

SEQ ID NO: 2011958 - RNA, 14 nt, Homo sapiens
caaagcaaaggauc

SEQ ID NO: 2011959 - RNA, 15 nt, Homo sapiens
ugaguacaugcacac

SEQ ID NO: 2011960 - RNA, 20 nt, Homo sapiens
gcauguggugauuggccaca

SEQ ID NO: 2011961 - RNA, 16 nt, Homo sapiens
auauagacaccaagga

SEQ ID NO: 2011962 - RNA, 16 nt, Homo sapiens
ucaccucuugccuucu

SEQ ID NO: 2011963 - RNA, 22 nt, Homo sapiens
cugcuaugcuauugaaguuuug

SEQ ID NO: 2011964 - RNA, 21 nt, Homo sapiens
auccaacuccucuagucagca

SEQ ID NO: 2011965 - RNA, 18 nt, Homo sapiens
ugguacuaccccagccau

SEQ ID NO: 2011966 - RNA, 15 nt, Homo sapiens
ucaaagcugggauua

SEQ ID NO: 2011967 - RNA, 19 nt, Homo sapiens
uccuaucucccuggcucac

SEQ ID NO: 2011968 - RNA, 14 nt, Homo sapiens
uuucuacaaugcac

SEQ ID NO: 2011969 - RNA, 18 nt, Homo sapiens
gcccagccagcagguucu

SEQ ID NO: 2011970 - RNA, 12 nt, Homo sapiens
uaccacuuagaa

SEQ ID NO: 2011971 - RNA, 13 nt, Homo sapiens
uccucacaugccc

SEQ ID NO: 2011972 - RNA, 22 nt, Homo sapiens
ggauauuuugaaaugaacuuug

SEQ ID NO: 2011973 - RNA, 20 nt, Homo sapiens
uauuauuccagaucugcagu

SEQ ID NO: 2011974 - RNA, 15 nt, Homo sapiens
uguggucacacugug

SEQ ID NO: 2011975 - RNA, 20 nt, Homo sapiens
ccuguucuuggguaaggaaa

SEQ ID NO: 2011976 - RNA, 22 nt, Homo sapiens
uugaauuuuucuuccucuccac

SEQ ID NO: 2011977 - RNA, 16 nt, Homo sapiens
ugcaugauaucuucaa

SEQ ID NO: 2011978 - RNA, 16 nt, Homo sapiens
cuggaaauucugcugc

SEQ ID NO: 2011979 - RNA, 19 nt, Homo sapiens
uaugguagaaaaauuucac

SEQ ID NO: 2011980 - RNA, 17 nt, Homo sapiens
acauuuuauuacacuaa

SEQ ID NO: 2011981 - RNA, 17 nt, Homo sapiens
uccuuacucccaggcac

SEQ ID NO: 2011982 - RNA, 19 nt, Homo sapiens
aaagccuggggcaaagcug

SEQ ID NO: 2011983 - RNA, 21 nt, Homo sapiens
agacacuacaugaugacucaa

SEQ ID NO: 2011984 - RNA, 15 nt, Homo sapiens
augcagcuacuggaa

SEQ ID NO: 2011985 - RNA, 20 nt, Homo sapiens
ugucuuccauuaagaacacu

SEQ ID NO: 2011986 - RNA, 14 nt, Homo sapiens
auaaaaccaaagaa

SEQ ID NO: 2011987 - RNA, 18 nt, Homo sapiens
ugucuuggacacuguaca

SEQ ID NO: 2011988 - RNA, 16 nt, Homo sapiens
cuggucaguacccacu

SEQ ID NO: 2011989 - RNA, 13 nt, Homo sapiens
agacagugcugcc

SEQ ID NO: 2011990 - RNA, 13 nt, Homo sapiens
auuccagaagaag

SEQ ID NO: 2011991 - RNA, 20 nt, Homo sapiens
ggaagagcucuucaguuuuu

SEQ ID NO: 2011992 - RNA, 19 nt, Homo sapiens
ccgugaggccagagacaca

SEQ ID NO: 2011993 - RNA, 17 nt, Homo sapiens
cucaauucaaauccaua

SEQ ID NO: 2011994 - RNA, 11 nt, Homo sapiens
ccuacuucuca

SEQ ID NO: 2011995 - RNA, 16 nt, Homo sapiens
ucugucccacugggac

SEQ ID NO: 2011996 - RNA, 22 nt, Homo sapiens
uccuccagaccccuguggcaga

SEQ ID NO: 2011997 - RNA, 12 nt, Homo sapiens
aucuucacaaaa

SEQ ID NO: 2011998 - RNA, 12 nt, Homo sapiens
uuaaucacuacu

SEQ ID NO: 2011999 - RNA, 18 nt, Homo sapiens
acaauaaaauacagccau

SEQ ID NO: 2012000 - RNA, 12 nt, Homo sapiens
ggaaaucaaaag

SEQ ID NO: 2012001 - RNA, 16 nt, Homo sapiens
uccacccagugcugaa

SEQ ID NO: 2012002 - RNA, 16 nt, Homo sapiens
augguaauaagcacug

SEQ ID NO: 2012003 - RNA, 20 nt, Homo sapiens
cagaagagucuuugauucac

SEQ ID NO: 2012004 - RNA, 22 nt, Homo sapiens
ccaaguguaaaaacaaugugcu

SEQ ID NO: 2012005 - RNA, 19 nt, Homo sapiens
gaagcuguuuuaucguuaa

SEQ ID NO: 2012006 - RNA, 18 nt, Homo sapiens
uggaagaggcaccugucc

SEQ ID NO: 2012007 - RNA, 22 nt, Homo sapiens
cgagggcacuaccgggggcucu

SEQ ID NO: 2012008 - RNA, 16 nt, Homo sapiens
uucaugacaagcauuu

SEQ ID NO: 2012009 - RNA, 13 nt, Homo sapiens
aucugcaguggag

SEQ ID NO: 2012010 - RNA, 22 nt, Homo sapiens
auaacacagagagacagacuug

SEQ ID NO: 2012011 - RNA, 13 nt, Homo sapiens
cccagggcacuuc

SEQ ID NO: 2012012 - RNA, 18 nt, Homo sapiens
gugaaguguucugcugag

SEQ ID NO: 2012013 - RNA, 19 nt, Homo sapiens
ccacaccgagacaccaccu

SEQ ID NO: 2012014 - RNA, 17 nt, Homo sapiens
cauuugugaagcuuacu

SEQ ID NO: 2012015 - RNA, 12 nt, Homo sapiens
accuacagagca

SEQ ID NO: 2012016 - RNA, 19 nt, Homo sapiens
cuccccucugcccuguaua

SEQ ID NO: 2012017 - RNA, 22 nt, Homo sapiens
aguggcauguggguugugauau

SEQ ID NO: 2012018 - RNA, 14 nt, Homo sapiens
caugcugaaaacca

SEQ ID NO: 2012019 - RNA, 16 nt, Homo sapiens
gaguuugccuguacuc

SEQ ID NO: 2012020 - RNA, 17 nt, Homo sapiens
uaggaaaguuucuucaa

SEQ ID NO: 2012021 - RNA, 20 nt, Homo sapiens
uggcucugagagccccagga

SEQ ID NO: 2012022 - RNA, 20 nt, Homo sapiens
uggcacuuuugaugaaauaa

SEQ ID NO: 2012023 - RNA, 19 nt, Homo sapiens
ccucagcgggggccuugaa

SEQ ID NO: 2012024 - RNA, 16 nt, Homo sapiens
uuguacuguaucuauu

SEQ ID NO: 2012025 - RNA, 15 nt, Homo sapiens
uccgguuaucaagca

SEQ ID NO: 2012026 - RNA, 20 nt, Homo sapiens
cacugggugcccaagcucag

SEQ ID NO: 2012027 - RNA, 12 nt, Homo sapiens
ccaacuccagua

SEQ ID NO: 2012028 - RNA, 14 nt, Homo sapiens
acuuuauuuugcuu

SEQ ID NO: 2012029 - RNA, 22 nt, Homo sapiens
accacaaaggacccaaucccca

SEQ ID NO: 2012030 - RNA, 20 nt, Homo sapiens
cuauacauagagcucuauuu

SEQ ID NO: 2012031 - RNA, 20 nt, Homo sapiens
ggagagagaggcugccucag

SEQ ID NO: 2012032 - RNA, 23 nt, Homo sapiens
uggucaagggcugucauugcaca

SEQ ID NO: 2012033 - RNA, 13 nt, Homo sapiens
cauagacugaaga

SEQ ID NO: 2012034 - RNA, 21 nt, Homo sapiens
auuccugccccaucacuuaca

SEQ ID NO: 2012035 - RNA, 18 nt, Homo sapiens
caauauuucuucacaaag

SEQ ID NO: 2012036 - RNA, 19 nt, Homo sapiens
augcuuuaaaaaacacagu

SEQ ID NO: 2012037 - RNA, 15 nt, Homo sapiens
cugucuccuuucacc

SEQ ID NO: 2012038 - RNA, 22 nt, Homo sapiens
uucacugccccagacacagugc

SEQ ID NO: 2012039 - RNA, 13 nt, Homo sapiens
uuuguaacauuca

SEQ ID NO: 2012040 - RNA, 14 nt, Homo sapiens
cuguugcaccucag

SEQ ID NO: 2012041 - RNA, 16 nt, Homo sapiens
aaaugcaaacacugug

SEQ ID NO: 2012042 - RNA, 22 nt, Homo sapiens
cuccugcggcucagccuugcac

SEQ ID NO: 2012043 - RNA, 15 nt, Homo sapiens
gucacuucuccugcu

SEQ ID NO: 2012044 - RNA, 12 nt, Homo sapiens
accacuccacuc

SEQ ID NO: 2012045 - RNA, 19 nt, Homo sapiens
uugauguaaugaaauucca

SEQ ID NO: 2012046 - RNA, 14 nt, Homo sapiens
cauggaaugcaauu

SEQ ID NO: 2012047 - RNA, 22 nt, Homo sapiens
cucuugaaaaaugcauguugcc

SEQ ID NO: 2012048 - RNA, 19 nt, Homo sapiens
gcugcuuucuguugucauu

SEQ ID NO: 2012049 - RNA, 15 nt, Homo sapiens
ggacccaucuuccac

SEQ ID NO: 2012050 - RNA, 15 nt, Homo sapiens
cuuggcuuuaugcaa

SEQ ID NO: 2012051 - RNA, 21 nt, Homo sapiens
aaggggauauagugauggggc

SEQ ID NO: 2012052 - RNA, 22 nt, Homo sapiens
agcucugagacccuuuucucag

SEQ ID NO: 2012053 - RNA, 13 nt, Homo sapiens
ccuguaguacaag

SEQ ID NO: 2012054 - RNA, 21 nt, Homo sapiens
auaacuuuaugaagugcuaca

SEQ ID NO: 2012055 - RNA, 20 nt, Homo sapiens
aucuucuugcaucuaaugaa

SEQ ID NO: 2012056 - RNA, 12 nt, Homo sapiens
uggagacagggu

SEQ ID NO: 2012057 - RNA, 17 nt, Homo sapiens
acucgcugaugaguuaa

SEQ ID NO: 2012058 - RNA, 22 nt, Homo sapiens
caccagcgaacucucagaaaua

SEQ ID NO: 2012059 - RNA, 15 nt, Homo sapiens
ccauaauuauuauuu

SEQ ID NO: 2012060 - RNA, 19 nt, Homo sapiens
ugguuaaacagcagcacuu

SEQ ID NO: 2012061 - RNA, 18 nt, Homo sapiens
uuaugugaauuuugccau

SEQ ID NO: 2012062 - RNA, 16 nt, Homo sapiens
gagacuauaacuguca

SEQ ID NO: 2012063 - RNA, 13 nt, Homo sapiens
uauggauaaucug

SEQ ID NO: 2012064 - RNA, 18 nt, Homo sapiens
cugauaaggaucuaggag

SEQ ID NO: 2012065 - RNA, 16 nt, Homo sapiens
guguguuuacugaugc

SEQ ID NO: 2012066 - RNA, 19 nt, Homo sapiens
acacugucacuagucucac

SEQ ID NO: 2012067 - RNA, 17 nt, Homo sapiens
cauccugucaucugaga

SEQ ID NO: 2012068 - RNA, 18 nt, Homo sapiens
uaccacaggaugcauauu

SEQ ID NO: 2012069 - RNA, 16 nt, Homo sapiens
accccgagacuaccag

SEQ ID NO: 2012070 - RNA, 22 nt, Homo sapiens
aacucugacaagggcugaccug

SEQ ID NO: 2012071 - RNA, 18 nt, Homo sapiens
uguuccccuuccacugag

SEQ ID NO: 2012072 - RNA, 13 nt, Homo sapiens
ucugcugagcucu

SEQ ID NO: 2012073 - RNA, 18 nt, Homo sapiens
auagugaccuguguuuca

SEQ ID NO: 2012074 - RNA, 18 nt, Homo sapiens
caguguuuccagugacac

SEQ ID NO: 2012075 - RNA, 16 nt, Homo sapiens
auuaaaacucauuuag

SEQ ID NO: 2012076 - RNA, 20 nt, Homo sapiens
ggucuucaagacgacagcuc

SEQ ID NO: 2012077 - RNA, 17 nt, Homo sapiens
ugcugggcccaccaccu

SEQ ID NO: 2012078 - RNA, 20 nt, Homo sapiens
aaaaugaagcugacaauuua

SEQ ID NO: 2012079 - RNA, 15 nt, Homo sapiens
guacuaauaugcaau

SEQ ID NO: 2012080 - RNA, 23 nt, Homo sapiens
uuggcaccccuuucuaguucaau

SEQ ID NO: 2012081 - RNA, 18 nt, Homo sapiens
ucccagguugacaccauu

SEQ ID NO: 2012082 - RNA, 19 nt, Homo sapiens
auuuguaaauuuucaagca

SEQ ID NO: 2012083 - RNA, 20 nt, Homo sapiens
gucugaagguaauacuauaa

SEQ ID NO: 2012084 - RNA, 16 nt, Homo sapiens
auagugacaugcacac

SEQ ID NO: 2012085 - RNA, 19 nt, Homo sapiens
uagaaaauguucaccuaga

SEQ ID NO: 2012086 - RNA, 19 nt, Homo sapiens
cugaccccagcauucucag

SEQ ID NO: 2012087 - RNA, 18 nt, Homo sapiens
acuucuucaccucuucca

SEQ ID NO: 2012088 - RNA, 18 nt, Homo sapiens
cauauauacacauauaca

SEQ ID NO: 2012089 - RNA, 18 nt, Homo sapiens
cauauauauacauauaua

SEQ ID NO: 2012090 - RNA, 21 nt, Homo sapiens
aagugucaccccucacuguga

SEQ ID NO: 2012091 - RNA, 12 nt, Homo sapiens
auuaauaucaca

SEQ ID NO: 2012092 - RNA, 18 nt, Homo sapiens
uggagagggacuggcaga

SEQ ID NO: 2012093 - RNA, 18 nt, Homo sapiens
uaaagccuacccuauucu

SEQ ID NO: 2012094 - RNA, 14 nt, Homo sapiens
ucauucuuugcagu

SEQ ID NO: 2012095 - RNA, 13 nt, Homo sapiens
gccucaaguucca

SEQ ID NO: 2012096 - RNA, 17 nt, Homo sapiens
acgugcucccucagcuc

SEQ ID NO: 2012097 - RNA, 18 nt, Homo sapiens
cuggcuguuguauuacca

SEQ ID NO: 2012098 - RNA, 14 nt, Homo sapiens
agugugccugcuau

SEQ ID NO: 2012099 - RNA, 23 nt, Homo sapiens
gcucucaccgggcuacuaccugg

SEQ ID NO: 2012100 - RNA, 22 nt, Homo sapiens
gaauuauuguagacaugcccaa

SEQ ID NO: 2012101 - RNA, 13 nt, Homo sapiens
cacccaauuccac

SEQ ID NO: 2012102 - RNA, 17 nt, Homo sapiens
gagaugguuuugcccuc

SEQ ID NO: 2012103 - RNA, 20 nt, Homo sapiens
gaacaugcagcaaggggaca

SEQ ID NO: 2012104 - RNA, 15 nt, Homo sapiens
ggcuucuccaaaggg

SEQ ID NO: 2012105 - RNA, 23 nt, Homo sapiens
uaauuuuucuuauuuagcccaua

SEQ ID NO: 2012106 - RNA, 23 nt, Homo sapiens
uaauuccacuuguucauucugug

SEQ ID NO: 2012107 - RNA, 17 nt, Homo sapiens
cugaagguguguccuca

SEQ ID NO: 2012108 - RNA, 18 nt, Homo sapiens
gaagucccaccagggacc

SEQ ID NO: 2012109 - RNA, 17 nt, Homo sapiens
ccuuccaggaaugcugg

SEQ ID NO: 2012110 - RNA, 22 nt, Homo sapiens
ucuuaucacacuugcaaaugaa

SEQ ID NO: 2012111 - RNA, 22 nt, Homo sapiens
cagauuugauuuuugcuuucuu

SEQ ID NO: 2012112 - RNA, 23 nt, Homo sapiens
aggacagaacccuccaccccuac

SEQ ID NO: 2012113 - RNA, 13 nt, Homo sapiens
ggugucuguaauc

SEQ ID NO: 2012114 - RNA, 15 nt, Homo sapiens
accacauuccaugac

SEQ ID NO: 2012115 - RNA, 19 nt, Homo sapiens
augaaggaaggacuaugac

SEQ ID NO: 2012116 - RNA, 15 nt, Homo sapiens
cagacucacuguggg

SEQ ID NO: 2012117 - RNA, 16 nt, Homo sapiens
uguaaaugcauuggaa

SEQ ID NO: 2012118 - RNA, 13 nt, Homo sapiens
acuugaaggcauu

SEQ ID NO: 2012119 - RNA, 22 nt, Homo sapiens
ccugcucacaucugaaucuccu

SEQ ID NO: 2012120 - RNA, 13 nt, Homo sapiens
gaaaacaggcaaa

SEQ ID NO: 2012121 - RNA, 16 nt, Homo sapiens
ggaccaugaaacauug

SEQ ID NO: 2012122 - RNA, 16 nt, Homo sapiens
caguaaugcaaauuaa

SEQ ID NO: 2012123 - RNA, 19 nt, Homo sapiens
gaccuuugauuuuuugccc

SEQ ID NO: 2012124 - RNA, 15 nt, Homo sapiens
gagggacguggugcc

SEQ ID NO: 2012125 - RNA, 15 nt, Homo sapiens
uaauaaugggagacu

SEQ ID NO: 2012126 - RNA, 23 nt, Homo sapiens
gugcauucaaccuuaccaaaaaa

SEQ ID NO: 2012127 - RNA, 19 nt, Homo sapiens
gcuccuguguucuagaccu

SEQ ID NO: 2012128 - RNA, 15 nt, Homo sapiens
ucucagucugcagua

SEQ ID NO: 2012129 - RNA, 22 nt, Homo sapiens
ucgagcaugcccugagcucucu

SEQ ID NO: 2012130 - RNA, 22 nt, Homo sapiens
gacagcauuacacgccacaacu

SEQ ID NO: 2012131 - RNA, 16 nt, Homo sapiens
gcgugcgagcacacac

SEQ ID NO: 2012132 - RNA, 18 nt, Homo sapiens
uggagcaagagaauuuca

SEQ ID NO: 2012133 - RNA, 14 nt, Homo sapiens
cuauuuaucuguag

SEQ ID NO: 2012134 - RNA, 14 nt, Homo sapiens
auuauauauacauu

SEQ ID NO: 2012135 - RNA, 17 nt, Homo sapiens
ugauuuuugagcccuug

SEQ ID NO: 2012136 - RNA, 16 nt, Homo sapiens
ccaaaaaugcacccaa

SEQ ID NO: 2012137 - RNA, 17 nt, Homo sapiens
gaauacuaaauuauagu

SEQ ID NO: 2012138 - RNA, 22 nt, Homo sapiens
ugagaaacuuugaucucugcuu

SEQ ID NO: 2012139 - RNA, 12 nt, Homo sapiens
caucuggagacc

SEQ ID NO: 2012140 - RNA, 16 nt, Homo sapiens
acucaggauccaguga

SEQ ID NO: 2012141 - RNA, 12 nt, Homo sapiens
uauguuacauua

SEQ ID NO: 2012142 - RNA, 19 nt, Homo sapiens
agacauaguucagccacaa

SEQ ID NO: 2012143 - RNA, 19 nt, Homo sapiens
uucuccauuacaguguaaa

SEQ ID NO: 2012144 - RNA, 20 nt, Homo sapiens
agguccuccaucccaacagc

SEQ ID NO: 2012145 - RNA, 20 nt, Homo sapiens
uucucuuaaucacuacugua

SEQ ID NO: 2012146 - RNA, 18 nt, Homo sapiens
cauuauaccgcagaguau

SEQ ID NO: 2012147 - RNA, 19 nt, Homo sapiens
uauuuaaacucaagacaau

SEQ ID NO: 2012148 - RNA, 16 nt, Homo sapiens
uuuaauaacauaacaa

SEQ ID NO: 2012149 - RNA, 15 nt, Homo sapiens
aaauagaacacugcc

SEQ ID NO: 2012150 - RNA, 13 nt, Homo sapiens
agaucugucuuga

SEQ ID NO: 2012151 - RNA, 22 nt, Homo sapiens
ggcaaagauuuuuggcacuuug

SEQ ID NO: 2012152 - RNA, 22 nt, Homo sapiens
ugauccguguguaccaucuuug

SEQ ID NO: 2012153 - RNA, 21 nt, Homo sapiens
gaaaagucaggugcaguccca

SEQ ID NO: 2012154 - RNA, 13 nt, Homo sapiens
cucaggaugcauc

SEQ ID NO: 2012155 - RNA, 14 nt, Homo sapiens
uugcugcgugacau

SEQ ID NO: 2012156 - RNA, 19 nt, Homo sapiens
cuaagcuuugccagcugcu

SEQ ID NO: 2012157 - RNA, 13 nt, Homo sapiens
cuggcaaucaaua

SEQ ID NO: 2012158 - RNA, 22 nt, Homo sapiens
acuuucuuagcucaagagagag

SEQ ID NO: 2012159 - RNA, 22 nt, Homo sapiens
cauuaauuucaaucaaccaaag

SEQ ID NO: 2012160 - RNA, 17 nt, Homo sapiens
ucacagugucuguaaau

SEQ ID NO: 2012161 - RNA, 14 nt, Homo sapiens
ucuacagacuccca

SEQ ID NO: 2012162 - RNA, 13 nt, Homo sapiens
uuugcacaggaug

SEQ ID NO: 2012163 - RNA, 19 nt, Homo sapiens
aggagugccaggaccagcc

SEQ ID NO: 2012164 - RNA, 23 nt, Homo sapiens
accugcuuugagauuuccugaca

SEQ ID NO: 2012165 - RNA, 14 nt, Homo sapiens
aaggaaaaugacuc

SEQ ID NO: 2012166 - RNA, 19 nt, Homo sapiens
uuuugcuugggaaacucaa

SEQ ID NO: 2012167 - RNA, 22 nt, Homo sapiens
augagucggauacccuggagca

SEQ ID NO: 2012168 - RNA, 19 nt, Homo sapiens
aacaaaucaucucgcuaaa

SEQ ID NO: 2012169 - RNA, 16 nt, Homo sapiens
aagcaguuucucucca

SEQ ID NO: 2012170 - RNA, 20 nt, Homo sapiens
uugugccuggcucagagcca

SEQ ID NO: 2012171 - RNA, 18 nt, Homo sapiens
ugaaucugaacugcucua

SEQ ID NO: 2012172 - RNA, 21 nt, Homo sapiens
gcccagagaacaagcacugug

SEQ ID NO: 2012173 - RNA, 20 nt, Homo sapiens
caauguauuugucaaugcau

SEQ ID NO: 2012174 - RNA, 16 nt, Homo sapiens
aucuggaauuccaguc

SEQ ID NO: 2012175 - RNA, 15 nt, Homo sapiens
auggcuuuaugcuag

SEQ ID NO: 2012176 - RNA, 20 nt, Homo sapiens
cauauacaauaauguaauuu

SEQ ID NO: 2012177 - RNA, 18 nt, Homo sapiens
uuucuucagaauuaucca

SEQ ID NO: 2012178 - RNA, 19 nt, Homo sapiens
cuugcucccucuccaagac

SEQ ID NO: 2012179 - RNA, 17 nt, Homo sapiens
aucuguucuaugcuucc

SEQ ID NO: 2012180 - RNA, 14 nt, Homo sapiens
gguguggcaguuac

SEQ ID NO: 2012181 - RNA, 15 nt, Homo sapiens
augugggaguggaac

SEQ ID NO: 2012182 - RNA, 14 nt, Homo sapiens
gucaaaggcauuuu

SEQ ID NO: 2012183 - RNA, 15 nt, Homo sapiens
cauccagauagguua

SEQ ID NO: 2012184 - RNA, 15 nt, Homo sapiens
gccucccguguucaa

SEQ ID NO: 2012185 - RNA, 20 nt, Homo sapiens
cagcaguugaucagacugaa

SEQ ID NO: 2012186 - RNA, 21 nt, Homo sapiens
aacucuucaguuaauucuuag

SEQ ID NO: 2012187 - RNA, 18 nt, Homo sapiens
acuucaaaaacugucaaa

SEQ ID NO: 2012188 - RNA, 19 nt, Homo sapiens
uucucacaaaaaggcaaau

SEQ ID NO: 2012189 - RNA, 15 nt, Homo sapiens
cagcugaugacucaa

SEQ ID NO: 2012190 - RNA, 14 nt, Homo sapiens
aaauuacagucauc

SEQ ID NO: 2012191 - RNA, 19 nt, Homo sapiens
ggcaggguucuccaagggc

SEQ ID NO: 2012192 - RNA, 15 nt, Homo sapiens
cuaggugacauauac

SEQ ID NO: 2012193 - RNA, 16 nt, Homo sapiens
cuacuacccccacaga

SEQ ID NO: 2012194 - RNA, 15 nt, Homo sapiens
ugucaaaagccagau

SEQ ID NO: 2012195 - RNA, 22 nt, Homo sapiens
gguagucccuguuuuugcagua

SEQ ID NO: 2012196 - RNA, 15 nt, Homo sapiens
gcaucuuagugccuu

SEQ ID NO: 2012197 - RNA, 21 nt, Homo sapiens
aggucuuuugaauucacaccu

SEQ ID NO: 2012198 - RNA, 21 nt, Homo sapiens
augaagccugugccaccugca

SEQ ID NO: 2012199 - RNA, 10 nt, Homo sapiens
cacugaagaa

SEQ ID NO: 2012200 - RNA, 23 nt, Homo sapiens
ugacaagcugacuuggcacuuaa

SEQ ID NO: 2012201 - RNA, 16 nt, Homo sapiens
aggagggcagcagggu

SEQ ID NO: 2012202 - RNA, 20 nt, Homo sapiens
ucugcagggagcaacucucc

SEQ ID NO: 2012203 - RNA, 11 nt, Homo sapiens
uuauagcucua

SEQ ID NO: 2012204 - RNA, 11 nt, Homo sapiens
cuguagcuuug

SEQ ID NO: 2012205 - RNA, 20 nt, Homo sapiens
aaagcugaauccuuccauuu

SEQ ID NO: 2012206 - RNA, 20 nt, Homo sapiens
cauguccacaaugcacaugu

SEQ ID NO: 2012207 - RNA, 12 nt, Homo sapiens
aguuucuuucag

SEQ ID NO: 2012208 - RNA, 12 nt, Homo sapiens
cacacacacucu

SEQ ID NO: 2012209 - RNA, 13 nt, Homo sapiens
uggaccacaggca

SEQ ID NO: 2012210 - RNA, 18 nt, Homo sapiens
cagcuggccaccauggca

SEQ ID NO: 2012211 - RNA, 14 nt, Homo sapiens
acccagucccacac

SEQ ID NO: 2012212 - RNA, 11 nt, Homo sapiens
acuccaaggag

SEQ ID NO: 2012213 - RNA, 21 nt, Homo sapiens
uugcaauaacagcugcaauuc

SEQ ID NO: 2012214 - RNA, 22 nt, Homo sapiens
caucacuggcucucuaauucca

SEQ ID NO: 2012215 - RNA, 21 nt, Homo sapiens
uaggaacucaguccuguacuc

SEQ ID NO: 2012216 - RNA, 15 nt, Homo sapiens
uuuaaaccgcuaaaa

SEQ ID NO: 2012217 - RNA, 15 nt, Homo sapiens
ucuucauggugacac

SEQ ID NO: 2012218 - RNA, 16 nt, Homo sapiens
ucaccuggcuucccag

SEQ ID NO: 2012219 - RNA, 22 nt, Homo sapiens
aaauuugcaaauauuagcuuau

SEQ ID NO: 2012220 - RNA, 16 nt, Homo sapiens
uuacaagcaucaugga

SEQ ID NO: 2012221 - RNA, 15 nt, Homo sapiens
ugagucggaagcucc

SEQ ID NO: 2012222 - RNA, 15 nt, Homo sapiens
ugugcuggacuguuu

SEQ ID NO: 2012223 - RNA, 21 nt, Homo sapiens
guuacagugaugcugugcuau

SEQ ID NO: 2012224 - RNA, 18 nt, Homo sapiens
acccaauuacacacagcg

SEQ ID NO: 2012225 - RNA, 14 nt, Homo sapiens
gaauaguugaaccu

SEQ ID NO: 2012226 - RNA, 23 nt, Homo sapiens
auucaauuugcgacugcucugau

SEQ ID NO: 2012227 - RNA, 21 nt, Homo sapiens
aacguagaucgaagccaaagc

SEQ ID NO: 2012228 - RNA, 11 nt, Homo sapiens
uguaaacugga

SEQ ID NO: 2012229 - RNA, 11 nt, Homo sapiens
uuuaaacugua

SEQ ID NO: 2012230 - RNA, 19 nt, Homo sapiens
augugaugguacacagugg

SEQ ID NO: 2012231 - RNA, 14 nt, Homo sapiens
accugcugcaugaa

SEQ ID NO: 2012232 - RNA, 20 nt, Homo sapiens
gcccaggcuggagggcagug

SEQ ID NO: 2012233 - RNA, 20 nt, Homo sapiens
gcccaugcuggagugcagug

SEQ ID NO: 2012234 - RNA, 22 nt, Homo sapiens
ggcaccuuaagauuuugcaccu

SEQ ID NO: 2012235 - RNA, 13 nt, Homo sapiens
agauaacugagaa

SEQ ID NO: 2012236 - RNA, 20 nt, Homo sapiens
cacugccuuagccucuugga

SEQ ID NO: 2012237 - RNA, 23 nt, Homo sapiens
aagaaaucauuuagugacuuaau

SEQ ID NO: 2012238 - RNA, 12 nt, Homo sapiens
aggauugugcug

SEQ ID NO: 2012239 - RNA, 15 nt, Homo sapiens
ugaacaugauaguua

SEQ ID NO: 2012240 - RNA, 14 nt, Homo sapiens
augaaaaugaauau

SEQ ID NO: 2012241 - RNA, 14 nt, Homo sapiens
ugcccccuccccca

SEQ ID NO: 2012242 - RNA, 16 nt, Homo sapiens
accucuucuucuccaa

SEQ ID NO: 2012243 - RNA, 17 nt, Homo sapiens
agaugucuuccuaucaa

SEQ ID NO: 2012244 - RNA, 13 nt, Homo sapiens
auauugaauguga

SEQ ID NO: 2012245 - RNA, 18 nt, Homo sapiens
cggcuccuucaagcugcu

SEQ ID NO: 2012246 - RNA, 18 nt, Homo sapiens
caaggaguacuccaagac

SEQ ID NO: 2012247 - RNA, 12 nt, Homo sapiens
acgggcagccac

SEQ ID NO: 2012248 - RNA, 18 nt, Homo sapiens
auaucaaaucuaccacug

SEQ ID NO: 2012249 - RNA, 17 nt, Homo sapiens
auugacucugcauuuga

SEQ ID NO: 2012250 - RNA, 20 nt, Homo sapiens
ugaaagcugauuacugucaa

SEQ ID NO: 2012251 - RNA, 19 nt, Homo sapiens
gaccaccccucucgccuca

SEQ ID NO: 2012252 - RNA, 23 nt, Homo sapiens
uuccaaaaguacuagcaauaagu

SEQ ID NO: 2012253 - RNA, 21 nt, Homo sapiens
gaccaauuuauccuugaccaa

SEQ ID NO: 2012254 - RNA, 15 nt, Homo sapiens
ucauugguguacugu

SEQ ID NO: 2012255 - RNA, 15 nt, Homo sapiens
auggaagugucugga

SEQ ID NO: 2012256 - RNA, 23 nt, Homo sapiens
uucccacaaaagacagacccagu

SEQ ID NO: 2012257 - RNA, 11 nt, Homo sapiens
aauaaagccuc

SEQ ID NO: 2012258 - RNA, 23 nt, Homo sapiens
aaggaaacuuuuuuuguuugcuc

SEQ ID NO: 2012259 - RNA, 15 nt, Homo sapiens
ucacgucacacuugg

SEQ ID NO: 2012260 - RNA, 20 nt, Homo sapiens
auacacaugagauaauaugc

SEQ ID NO: 2012261 - RNA, 19 nt, Homo sapiens
aacaagaguugucuugucc

SEQ ID NO: 2012262 - RNA, 18 nt, Homo sapiens
aauauauccugaaagcau

SEQ ID NO: 2012263 - RNA, 15 nt, Homo sapiens
gaugcugcuccgccc

SEQ ID NO: 2012264 - RNA, 16 nt, Homo sapiens
gcuucuccaaagggag

SEQ ID NO: 2012265 - RNA, 20 nt, Homo sapiens
ucaccugcuggggaccucac

SEQ ID NO: 2012266 - RNA, 19 nt, Homo sapiens
ggugcuggguucccacucc

SEQ ID NO: 2012267 - RNA, 19 nt, Homo sapiens
auacaugcauacacucuca

SEQ ID NO: 2012268 - RNA, 19 nt, Homo sapiens
acaugcugaaagucuucau

SEQ ID NO: 2012269 - RNA, 22 nt, Homo sapiens
uacuggauaaacuugcuucaga

SEQ ID NO: 2012270 - RNA, 16 nt, Homo sapiens
gccccagcccaagucc

SEQ ID NO: 2012271 - RNA, 14 nt, Homo sapiens
gucaggagccagca

SEQ ID NO: 2012272 - RNA, 13 nt, Homo sapiens
ccauguaaccacu

SEQ ID NO: 2012273 - RNA, 23 nt, Homo sapiens
acagaaaagacucugaccagaga

SEQ ID NO: 2012274 - RNA, 23 nt, Homo sapiens
cucuuguagcauccuguuuguau

SEQ ID NO: 2012275 - RNA, 23 nt, Homo sapiens
aagagaugcacuauauguuuaca

SEQ ID NO: 2012276 - RNA, 12 nt, Homo sapiens
gcagauacuuga

SEQ ID NO: 2012277 - RNA, 21 nt, Homo sapiens
gagcacauaguguccugccca

SEQ ID NO: 2012278 - RNA, 17 nt, Homo sapiens
gagaagcucucgaggga

SEQ ID NO: 2012279 - RNA, 15 nt, Homo sapiens
cauaaagaaagugag

SEQ ID NO: 2012280 - RNA, 21 nt, Homo sapiens
uccuuuccuuuuuuugauaua

SEQ ID NO: 2012281 - RNA, 17 nt, Homo sapiens
auccagaugaacugaga

SEQ ID NO: 2012282 - RNA, 20 nt, Homo sapiens
aucuacaccugaggacaaga

SEQ ID NO: 2012283 - RNA, 10 nt, Homo sapiens
caugcaauaa

SEQ ID NO: 2012284 - RNA, 21 nt, Homo sapiens
aagauuacccucggucauucc

SEQ ID NO: 2012285 - RNA, 20 nt, Homo sapiens
caaaaacaaaaaaccacaaa

SEQ ID NO: 2012286 - RNA, 19 nt, Homo sapiens
uucugacgcagccugagaa

SEQ ID NO: 2012287 - RNA, 16 nt, Homo sapiens
guccaccccagugugc

SEQ ID NO: 2012288 - RNA, 12 nt, Homo sapiens
gcaucauucccc

SEQ ID NO: 2012289 - RNA, 19 nt, Homo sapiens
uuucucuccaucagaauga

SEQ ID NO: 2012290 - RNA, 17 nt, Homo sapiens
gaaaugauaugaccaaa

SEQ ID NO: 2012291 - RNA, 13 nt, Homo sapiens
uuauaaaccuuca

SEQ ID NO: 2012292 - RNA, 14 nt, Homo sapiens
uguauggaagacaa

SEQ ID NO: 2012293 - RNA, 12 nt, Homo sapiens
aggucacuuaag

SEQ ID NO: 2012294 - RNA, 15 nt, Homo sapiens
agaauacaagccacu

SEQ ID NO: 2012295 - RNA, 16 nt, Homo sapiens
cucugccuuugcucug

SEQ ID NO: 2012296 - RNA, 19 nt, Homo sapiens
auuuauaacagcauucuug

SEQ ID NO: 2012297 - RNA, 12 nt, Homo sapiens
ccacggagcuga

SEQ ID NO: 2012298 - RNA, 23 nt, Homo sapiens
auccuccccaccagagcugccuc

SEQ ID NO: 2012299 - RNA, 19 nt, Homo sapiens
ccuggagcccauccagucu

SEQ ID NO: 2012300 - RNA, 24 nt, Homo sapiens
ugagaaauuccacccacguggaga

SEQ ID NO: 2012301 - RNA, 21 nt, Homo sapiens
uguagcuaucauuacuggcug

SEQ ID NO: 2012302 - RNA, 17 nt, Homo sapiens
ccuuuuuccauaguguu

SEQ ID NO: 2012303 - RNA, 18 nt, Homo sapiens
ugggcuggggcugcuccc

SEQ ID NO: 2012304 - RNA, 15 nt, Homo sapiens
ugccugagaacacca

SEQ ID NO: 2012305 - RNA, 16 nt, Homo sapiens
aggcuguccuguacau

SEQ ID NO: 2012306 - RNA, 16 nt, Homo sapiens
cuuccaggaaugcugg

SEQ ID NO: 2012307 - RNA, 15 nt, Homo sapiens
ucuagaauacauauu

SEQ ID NO: 2012308 - RNA, 12 nt, Homo sapiens
ugaaaaggaauu

SEQ ID NO: 2012309 - RNA, 19 nt, Homo sapiens
cucugcccuuuuuaauuaa

SEQ ID NO: 2012310 - RNA, 14 nt, Homo sapiens
gccagccacaggac

SEQ ID NO: 2012311 - RNA, 13 nt, Homo sapiens
auuguacaaguca

SEQ ID NO: 2012312 - RNA, 16 nt, Homo sapiens
aauucuaacaagucau

SEQ ID NO: 2012313 - RNA, 14 nt, Homo sapiens
cagggccucaaagu

SEQ ID NO: 2012314 - RNA, 22 nt, Homo sapiens
uuuggacaagaggaaaaauacu

SEQ ID NO: 2012315 - RNA, 23 nt, Homo sapiens
agcuucuguugcugccucaugcu

SEQ ID NO: 2012316 - RNA, 13 nt, Homo sapiens
auguaaaccacau

SEQ ID NO: 2012317 - RNA, 14 nt, Homo sapiens
aaugaaugcuuaaa

SEQ ID NO: 2012318 - RNA, 14 nt, Homo sapiens
auuauuugcauguu

SEQ ID NO: 2012319 - RNA, 14 nt, Homo sapiens
ucuaagggaccuca

SEQ ID NO: 2012320 - RNA, 22 nt, Homo sapiens
uuuaauugaaagggacaaguau

SEQ ID NO: 2012321 - RNA, 14 nt, Homo sapiens
auauuccacguuug

SEQ ID NO: 2012322 - RNA, 17 nt, Homo sapiens
ugacaaauuuagccaau

SEQ ID NO: 2012323 - RNA, 16 nt, Homo sapiens
auacaaacaagcacag

SEQ ID NO: 2012324 - RNA, 16 nt, Homo sapiens
acaucuuguaacuuaa

SEQ ID NO: 2012325 - RNA, 14 nt, Homo sapiens
uuccuauuugcaca

SEQ ID NO: 2012326 - RNA, 20 nt, Homo sapiens
guagugugugcuuacaguaa

SEQ ID NO: 2012327 - RNA, 14 nt, Homo sapiens
aaguucaacuucca

SEQ ID NO: 2012328 - RNA, 13 nt, Homo sapiens
accucgugaucca

SEQ ID NO: 2012329 - RNA, 23 nt, Homo sapiens
agcaugcucaguuggugcugcuu

SEQ ID NO: 2012330 - RNA, 16 nt, Homo sapiens
cccaauccccagacuc

SEQ ID NO: 2012331 - RNA, 16 nt, Homo sapiens
cagauucgagucacgu

SEQ ID NO: 2012332 - RNA, 19 nt, Homo sapiens
uacucgagcccacccagca

SEQ ID NO: 2012333 - RNA, 21 nt, Homo sapiens
uaccaagacuaagcaccauaa

SEQ ID NO: 2012334 - RNA, 21 nt, Homo sapiens
uccuacuuuacauaugcuuua

SEQ ID NO: 2012335 - RNA, 15 nt, Homo sapiens
aaggagaaggcagga

SEQ ID NO: 2012336 - RNA, 18 nt, Homo sapiens
augaugagguaguaccuu

SEQ ID NO: 2012337 - RNA, 18 nt, Homo sapiens
gagaacucugagcagugc

SEQ ID NO: 2012338 - RNA, 18 nt, Homo sapiens
aguuaaagccacagaugg

SEQ ID NO: 2012339 - RNA, 21 nt, Homo sapiens
gcauucuuuuggcaguucuga

SEQ ID NO: 2012340 - RNA, 21 nt, Homo sapiens
aagcugcuuaacccauggauc

SEQ ID NO: 2012341 - RNA, 14 nt, Homo sapiens
uucauuucauuuca

SEQ ID NO: 2012342 - RNA, 22 nt, Homo sapiens
agugagcauccuuuugcucugu

SEQ ID NO: 2012343 - RNA, 20 nt, Homo sapiens
acugacauauaucuauuaca

SEQ ID NO: 2012344 - RNA, 21 nt, Homo sapiens
cuggcacucuuguucccacac

SEQ ID NO: 2012345 - RNA, 21 nt, Homo sapiens
agugaggcugcacccacccag

SEQ ID NO: 2012346 - RNA, 19 nt, Homo sapiens
guucacauaggcucucagg

SEQ ID NO: 2012347 - RNA, 20 nt, Homo sapiens
auaugcauaaacaacaguac

SEQ ID NO: 2012348 - RNA, 22 nt, Homo sapiens
ccaggaagguagcccagcacug

SEQ ID NO: 2012349 - RNA, 13 nt, Homo sapiens
uacacacauauac

SEQ ID NO: 2012350 - RNA, 13 nt, Homo sapiens
uacauacauauau

SEQ ID NO: 2012351 - RNA, 13 nt, Homo sapiens
cucccacacuucc

SEQ ID NO: 2012352 - RNA, 16 nt, Homo sapiens
uaaaacccaagugccu

SEQ ID NO: 2012353 - RNA, 14 nt, Homo sapiens
gaccaggcaccagg

SEQ ID NO: 2012354 - RNA, 14 nt, Homo sapiens
ucagaauguguuau

SEQ ID NO: 2012355 - RNA, 15 nt, Homo sapiens
caggcgcugugcuau

SEQ ID NO: 2012356 - RNA, 17 nt, Homo sapiens
uagcggaucucacucag

SEQ ID NO: 2012357 - RNA, 22 nt, Homo sapiens
uugguacaguucauaauucacc

SEQ ID NO: 2012358 - RNA, 13 nt, Homo sapiens
gacuucgaaaaca

SEQ ID NO: 2012359 - RNA, 17 nt, Homo sapiens
ugcuggauucaagugau

SEQ ID NO: 2012360 - RNA, 22 nt, Homo sapiens
uaugcagccaaccaagaugcaa

SEQ ID NO: 2012361 - RNA, 14 nt, Homo sapiens
cuuuaauauuugcu

SEQ ID NO: 2012362 - RNA, 13 nt, Homo sapiens
uauauguguauau

SEQ ID NO: 2012363 - RNA, 13 nt, Homo sapiens
cagaagugcagaa

SEQ ID NO: 2012364 - RNA, 13 nt, Homo sapiens
gugcaguggugca

SEQ ID NO: 2012365 - RNA, 18 nt, Homo sapiens
uccuccagaauggagcug

SEQ ID NO: 2012366 - RNA, 12 nt, Homo sapiens
agagaguugucu

SEQ ID NO: 2012367 - RNA, 18 nt, Homo sapiens
aaagacaccuacugagug

SEQ ID NO: 2012368 - RNA, 13 nt, Homo sapiens
uuagaccaugcua

SEQ ID NO: 2012369 - RNA, 13 nt, Homo sapiens
gcuuaauaaguau

SEQ ID NO: 2012370 - RNA, 16 nt, Homo sapiens
gcccacgucacgugua

SEQ ID NO: 2012371 - RNA, 11 nt, Homo sapiens
aaaaugucuca

SEQ ID NO: 2012372 - RNA, 13 nt, Homo sapiens
acauaaagccaug

SEQ ID NO: 2012373 - RNA, 18 nt, Homo sapiens
agaccaguugggagcacu

SEQ ID NO: 2012374 - RNA, 15 nt, Homo sapiens
cagauuccacacaaa

SEQ ID NO: 2012375 - RNA, 18 nt, Homo sapiens
ugccucgaacuggcugca

SEQ ID NO: 2012376 - RNA, 20 nt, Homo sapiens
ggcucaauugaaagugggca

SEQ ID NO: 2012377 - RNA, 15 nt, Homo sapiens
uaaaacaaaaccaac

SEQ ID NO: 2012378 - RNA, 16 nt, Homo sapiens
agagcuacacaaacac

SEQ ID NO: 2012379 - RNA, 16 nt, Homo sapiens
guccccuccacuguca

SEQ ID NO: 2012380 - RNA, 14 nt, Homo sapiens
agccugagcucauc

SEQ ID NO: 2012381 - RNA, 17 nt, Homo sapiens
cgagagcagacaccagc

SEQ ID NO: 2012382 - RNA, 19 nt, Homo sapiens
caggcacccucccaguuac

SEQ ID NO: 2012383 - RNA, 22 nt, Homo sapiens
uacacgucacaaagaccuugcu

SEQ ID NO: 2012384 - RNA, 17 nt, Homo sapiens
gucuccauuguuuugcc

SEQ ID NO: 2012385 - RNA, 12 nt, Homo sapiens
cucaugcuguuu

SEQ ID NO: 2012386 - RNA, 16 nt, Homo sapiens
acccuggagaguucaa

SEQ ID NO: 2012387 - RNA, 14 nt, Homo sapiens
aaaguacuucucca

SEQ ID NO: 2012388 - RNA, 20 nt, Homo sapiens
uauaauauuauacugcuaua

SEQ ID NO: 2012389 - RNA, 14 nt, Homo sapiens
gcaucuacacagcc

SEQ ID NO: 2012390 - RNA, 19 nt, Homo sapiens
agcaacuccccuacaucaa

SEQ ID NO: 2012391 - RNA, 16 nt, Homo sapiens
uauuugcuuuuugcua

SEQ ID NO: 2012392 - RNA, 20 nt, Homo sapiens
guuaauucaccuauguuauu

SEQ ID NO: 2012393 - RNA, 14 nt, Homo sapiens
uacugauuaacuca

SEQ ID NO: 2012394 - RNA, 14 nt, Homo sapiens
uccucuuuaccugu

SEQ ID NO: 2012395 - RNA, 16 nt, Homo sapiens
guggauaacuuuacag

SEQ ID NO: 2012396 - RNA, 17 nt, Homo sapiens
ucuuggccuaaaccuca

SEQ ID NO: 2012397 - RNA, 17 nt, Homo sapiens
auguacagggguaguuu

SEQ ID NO: 2012398 - RNA, 15 nt, Homo sapiens
caaaaagcuucccca

SEQ ID NO: 2012399 - RNA, 20 nt, Homo sapiens
uuucaucugggaaagacauc

SEQ ID NO: 2012400 - RNA, 15 nt, Homo sapiens
acgugggcaagucau

SEQ ID NO: 2012401 - RNA, 19 nt, Homo sapiens
uccuaaaacaaaagcucau

SEQ ID NO: 2012402 - RNA, 16 nt, Homo sapiens
ggagacagaaagccuc

SEQ ID NO: 2012403 - RNA, 23 nt, Homo sapiens
gguggagggaaggauaaagccac

SEQ ID NO: 2012404 - RNA, 12 nt, Homo sapiens
uggcaaagcuca

SEQ ID NO: 2012405 - RNA, 17 nt, Homo sapiens
acacuuauugcuuugaa

SEQ ID NO: 2012406 - RNA, 21 nt, Homo sapiens
cugcauuugauagcaauguaa

SEQ ID NO: 2012407 - RNA, 17 nt, Homo sapiens
uuagguuuuguacaauu

SEQ ID NO: 2012408 - RNA, 15 nt, Homo sapiens
aagccuuauuuuuca

SEQ ID NO: 2012409 - RNA, 18 nt, Homo sapiens
gaucuaucaauagucaag

SEQ ID NO: 2012410 - RNA, 17 nt, Homo sapiens
aacuuugucacaucuaa

SEQ ID NO: 2012411 - RNA, 18 nt, Homo sapiens
cguauagggcacucccag

SEQ ID NO: 2012412 - RNA, 19 nt, Homo sapiens
aucacauucgaguguuuca

SEQ ID NO: 2012413 - RNA, 18 nt, Homo sapiens
accuguuuccuggaccag

SEQ ID NO: 2012414 - RNA, 16 nt, Homo sapiens
cucccaccggugccaa

SEQ ID NO: 2012415 - RNA, 15 nt, Homo sapiens
ccugagugaccuccu

SEQ ID NO: 2012416 - RNA, 21 nt, Homo sapiens
agucauugucgcucagcaaua

SEQ ID NO: 2012417 - RNA, 20 nt, Homo sapiens
uaaauauauuguacucuuua

SEQ ID NO: 2012418 - RNA, 13 nt, Homo sapiens
cacagagaccccc

SEQ ID NO: 2012419 - RNA, 20 nt, Homo sapiens
aggcccagggagcaauggga

SEQ ID NO: 2012420 - RNA, 18 nt, Homo sapiens
uggauugggggggccaaa

SEQ ID NO: 2012421 - RNA, 15 nt, Homo sapiens
cagugcuccaguaua

SEQ ID NO: 2012422 - RNA, 18 nt, Homo sapiens
ugaaagugaauaaacuuc

SEQ ID NO: 2012423 - RNA, 12 nt, Homo sapiens
cuucuguauuca

SEQ ID NO: 2012424 - RNA, 24 nt, Homo sapiens
guucagcacugucccuugccucaa

SEQ ID NO: 2012425 - RNA, 23 nt, Homo sapiens
auacacuccacuugaagcacuua

SEQ ID NO: 2012426 - RNA, 14 nt, Homo sapiens
caauauaguauucu

SEQ ID NO: 2012427 - RNA, 15 nt, Homo sapiens
ucguccgucacuuau

SEQ ID NO: 2012428 - RNA, 14 nt, Homo sapiens
cugcaacccuggug

SEQ ID NO: 2012429 - RNA, 13 nt, Homo sapiens
aucaaagaauuac

SEQ ID NO: 2012430 - RNA, 18 nt, Homo sapiens
gguuggcccccacguggg

SEQ ID NO: 2012431 - RNA, 22 nt, Homo sapiens
aagccagggcuggagaacaaga

SEQ ID NO: 2012432 - RNA, 22 nt, Homo sapiens
auugaguaucacuuuaacucag

SEQ ID NO: 2012433 - RNA, 13 nt, Homo sapiens
uugacagcuauaa

SEQ ID NO: 2012434 - RNA, 23 nt, Homo sapiens
acccuaccuuccccagacuugca

SEQ ID NO: 2012435 - RNA, 20 nt, Homo sapiens
gcccucagccccacuucuca

SEQ ID NO: 2012436 - RNA, 18 nt, Homo sapiens
cccacaagauccaggcag

SEQ ID NO: 2012437 - RNA, 19 nt, Homo sapiens
cugagaguugcuuccaguc

SEQ ID NO: 2012438 - RNA, 19 nt, Homo sapiens
guccuguccagacacgucc

SEQ ID NO: 2012439 - RNA, 14 nt, Homo sapiens
auagucaaguccac

SEQ ID NO: 2012440 - RNA, 18 nt, Homo sapiens
cagcccacccucugugag

SEQ ID NO: 2012441 - RNA, 16 nt, Homo sapiens
guuggagcuacugcaa

SEQ ID NO: 2012442 - RNA, 15 nt, Homo sapiens
uguauaucuguauau

SEQ ID NO: 2012443 - RNA, 15 nt, Homo sapiens
uuguuugcuuguuug

SEQ ID NO: 2012444 - RNA, 22 nt, Homo sapiens
uugcaacccagggcaaauggaa

SEQ ID NO: 2012445 - RNA, 18 nt, Homo sapiens
ucuccaguuugcaccugu

SEQ ID NO: 2012446 - RNA, 12 nt, Homo sapiens
cauuucucaagg

SEQ ID NO: 2012447 - RNA, 18 nt, Homo sapiens
acugcuggaguccagugc

SEQ ID NO: 2012448 - RNA, 17 nt, Homo sapiens
aguguuuugcacaucau

SEQ ID NO: 2012449 - RNA, 18 nt, Homo sapiens
aucaauccaaauucccuc

SEQ ID NO: 2012450 - RNA, 22 nt, Homo sapiens
gagcuccagcuccguucccaag

SEQ ID NO: 2012451 - RNA, 22 nt, Homo sapiens
cucucccugucacgcucauguc

SEQ ID NO: 2012452 - RNA, 18 nt, Homo sapiens
aaugauugauuauaucau

SEQ ID NO: 2012453 - RNA, 20 nt, Homo sapiens
uaagaguguucaacugugag

SEQ ID NO: 2012454 - RNA, 17 nt, Homo sapiens
agaauguaucugugaag

SEQ ID NO: 2012455 - RNA, 15 nt, Homo sapiens
cagcccacacccagc

SEQ ID NO: 2012456 - RNA, 17 nt, Homo sapiens
auugucgcucagcaaua

SEQ ID NO: 2012457 - RNA, 16 nt, Homo sapiens
uggucauaucuaguca

SEQ ID NO: 2012458 - RNA, 14 nt, Homo sapiens
acuccuuauuuggc

SEQ ID NO: 2012459 - RNA, 20 nt, Homo sapiens
ucaucuucacagauuguucu

SEQ ID NO: 2012460 - RNA, 19 nt, Homo sapiens
uaggggagggguugccaca

SEQ ID NO: 2012461 - RNA, 22 nt, Homo sapiens
gcaacaagaccaccacuucgaa

SEQ ID NO: 2012462 - RNA, 16 nt, Homo sapiens
gagcccuggcaggaug

SEQ ID NO: 2012463 - RNA, 19 nt, Homo sapiens
caggagaccacggggagca

SEQ ID NO: 2012464 - RNA, 22 nt, Homo sapiens
uaaagcaaagcgcuaaguaaaa

SEQ ID NO: 2012465 - RNA, 22 nt, Homo sapiens
ucuguaaaagcagacccaccuc

SEQ ID NO: 2012466 - RNA, 13 nt, Homo sapiens
uucuggagucaca

SEQ ID NO: 2012467 - RNA, 13 nt, Homo sapiens
aagccugaggcug

SEQ ID NO: 2012468 - RNA, 14 nt, Homo sapiens
auaguaaugugaug

SEQ ID NO: 2012469 - RNA, 20 nt, Homo sapiens
gaagcaggagauuugcuuga

SEQ ID NO: 2012470 - RNA, 18 nt, Homo sapiens
agaagaaaagcacuggga

SEQ ID NO: 2012471 - RNA, 24 nt, Homo sapiens
cacuuuaauugaagaacugcacuu

SEQ ID NO: 2012472 - RNA, 20 nt, Homo sapiens
cuuugcucuuuuaauaacaa

SEQ ID NO: 2012473 - RNA, 21 nt, Homo sapiens
cguucccggguagccacugga

SEQ ID NO: 2012474 - RNA, 12 nt, Homo sapiens
agaaaaaccacu

SEQ ID NO: 2012475 - RNA, 17 nt, Homo sapiens
aguagaaugacagcuag

SEQ ID NO: 2012476 - RNA, 21 nt, Homo sapiens
agcaucugccaggacacugcc

SEQ ID NO: 2012477 - RNA, 21 nt, Homo sapiens
guuuuuaguucugacuuugaa

SEQ ID NO: 2012478 - RNA, 19 nt, Homo sapiens
ucugaacacauacuagaaa

SEQ ID NO: 2012479 - RNA, 15 nt, Homo sapiens
cuaccccugaugaga

SEQ ID NO: 2012480 - RNA, 13 nt, Homo sapiens
ggucauugugaau

SEQ ID NO: 2012481 - RNA, 14 nt, Homo sapiens
gcugacuguagcuu

SEQ ID NO: 2012482 - RNA, 12 nt, Homo sapiens
uacuaaccugga

SEQ ID NO: 2012483 - RNA, 14 nt, Homo sapiens
agcuagaauaccac

SEQ ID NO: 2012484 - RNA, 17 nt, Homo sapiens
gcagcacaccccacagc

SEQ ID NO: 2012485 - RNA, 13 nt, Homo sapiens
cagagacuaugua

SEQ ID NO: 2012486 - RNA, 19 nt, Homo sapiens
agguuagauucucauucac

SEQ ID NO: 2012487 - RNA, 15 nt, Homo sapiens
ugagcucccaggugc

SEQ ID NO: 2012488 - RNA, 14 nt, Homo sapiens
auucccacugccag

SEQ ID NO: 2012489 - RNA, 14 nt, Homo sapiens
ccuguucuuucuua

SEQ ID NO: 2012490 - RNA, 19 nt, Homo sapiens
gaaugaaaggcaaugacaa

SEQ ID NO: 2012491 - RNA, 18 nt, Homo sapiens
ugugcaguccuggguccu

SEQ ID NO: 2012492 - RNA, 18 nt, Homo sapiens
cauaaauuauuucuaaaa

SEQ ID NO: 2012493 - RNA, 13 nt, Homo sapiens
gacaaauucuguu

SEQ ID NO: 2012494 - RNA, 15 nt, Homo sapiens
acucuccucuuccag

SEQ ID NO: 2012495 - RNA, 13 nt, Homo sapiens
cccugaaagccau

SEQ ID NO: 2012496 - RNA, 13 nt, Homo sapiens
cccucucaggcug

SEQ ID NO: 2012497 - RNA, 13 nt, Homo sapiens
gggaucagaucaa

SEQ ID NO: 2012498 - RNA, 23 nt, Homo sapiens
guggcaugaagauuuucuuucuc

SEQ ID NO: 2012499 - RNA, 18 nt, Homo sapiens
ucauaauuucuucacuca

SEQ ID NO: 2012500 - RNA, 18 nt, Homo sapiens
auagugugagaacuucca

SEQ ID NO: 2012501 - RNA, 20 nt, Homo sapiens
cccuucacuguccauuccaa

SEQ ID NO: 2012502 - RNA, 12 nt, Homo sapiens
uucaagcuauaa

SEQ ID NO: 2012503 - RNA, 13 nt, Homo sapiens
gacucaguguuga

SEQ ID NO: 2012504 - RNA, 19 nt, Homo sapiens
agugggaaauauuuagcaa

SEQ ID NO: 2012505 - RNA, 21 nt, Homo sapiens
accaaaggagacauaucacug

SEQ ID NO: 2012506 - RNA, 17 nt, Homo sapiens
cggggucacuugcaauu

SEQ ID NO: 2012507 - RNA, 21 nt, Homo sapiens
uccuaggcucugggugcagua

SEQ ID NO: 2012508 - RNA, 15 nt, Homo sapiens
uccucagaaagugua

SEQ ID NO: 2012509 - RNA, 17 nt, Homo sapiens
caaagaaaguggucuua

SEQ ID NO: 2012510 - RNA, 19 nt, Homo sapiens
gacaucuccucuaucacau

SEQ ID NO: 2012511 - RNA, 22 nt, Homo sapiens
gaauuaccauuaauuacauaca

SEQ ID NO: 2012512 - RNA, 21 nt, Homo sapiens
guggccccacccuuuccucuu

SEQ ID NO: 2012513 - RNA, 16 nt, Homo sapiens
cagauuuugcuguaua

SEQ ID NO: 2012514 - RNA, 12 nt, Homo sapiens
agcuguuuauuu

SEQ ID NO: 2012515 - RNA, 15 nt, Homo sapiens
aguuugagacuccaa

SEQ ID NO: 2012516 - RNA, 15 nt, Homo sapiens
augccuagaguuuac

SEQ ID NO: 2012517 - RNA, 15 nt, Homo sapiens
ugagauccuuuaaau

SEQ ID NO: 2012518 - RNA, 21 nt, Homo sapiens
cacugccugcucuucagacuu

SEQ ID NO: 2012519 - RNA, 13 nt, Homo sapiens
uuucuuuccaaaa

SEQ ID NO: 2012520 - RNA, 13 nt, Homo sapiens
accugcaguuccu

SEQ ID NO: 2012521 - RNA, 14 nt, Homo sapiens
uucagcuauuuagu

SEQ ID NO: 2012522 - RNA, 19 nt, Homo sapiens
cacauguccaagaagccca

SEQ ID NO: 2012523 - RNA, 17 nt, Homo sapiens
accauauugcccagggu

SEQ ID NO: 2012524 - RNA, 15 nt, Homo sapiens
cuccuugggcagggu

SEQ ID NO: 2012525 - RNA, 15 nt, Homo sapiens
ugggccuguggcauu

SEQ ID NO: 2012526 - RNA, 18 nt, Homo sapiens
cagagcgauggagcaguc

SEQ ID NO: 2012527 - RNA, 23 nt, Homo sapiens
ucucaucaacaaagaaauauuau

SEQ ID NO: 2012528 - RNA, 18 nt, Homo sapiens
cccuuccagccugggaca

SEQ ID NO: 2012529 - RNA, 22 nt, Homo sapiens
cccucuucuucucccugugugg

SEQ ID NO: 2012530 - RNA, 15 nt, Homo sapiens
uucugcuaugacaaa

SEQ ID NO: 2012531 - RNA, 19 nt, Homo sapiens
agccucugggucagugguc

SEQ ID NO: 2012532 - RNA, 14 nt, Homo sapiens
aauccuuccaugaa

SEQ ID NO: 2012533 - RNA, 22 nt, Homo sapiens
gccaccaguguccuccaagugc

SEQ ID NO: 2012534 - RNA, 16 nt, Homo sapiens
auuuuuugaauaugcc

SEQ ID NO: 2012535 - RNA, 14 nt, Homo sapiens
uacaucucugugag

SEQ ID NO: 2012536 - RNA, 20 nt, Homo sapiens
caugcauagagugugaugua

SEQ ID NO: 2012537 - RNA, 16 nt, Homo sapiens
uagcuagugauuuaca

SEQ ID NO: 2012538 - RNA, 22 nt, Homo sapiens
uggagccugggauuucuaugca

SEQ ID NO: 2012539 - RNA, 23 nt, Homo sapiens
gggcggauucagcgaagucucau

SEQ ID NO: 2012540 - RNA, 22 nt, Homo sapiens
gaggacggggagauagaacugu

SEQ ID NO: 2012541 - RNA, 18 nt, Homo sapiens
accaaugaaaacaguccc

SEQ ID NO: 2012542 - RNA, 20 nt, Homo sapiens
gccucugcuccccugugaac

SEQ ID NO: 2012543 - RNA, 15 nt, Homo sapiens
aaucaacagaugaua

SEQ ID NO: 2012544 - RNA, 20 nt, Homo sapiens
uucugcaucacccaaucaau

SEQ ID NO: 2012545 - RNA, 16 nt, Homo sapiens
cagcauuugauuaaca

SEQ ID NO: 2012546 - RNA, 20 nt, Homo sapiens
acaggagacuugagcuugac

SEQ ID NO: 2012547 - RNA, 14 nt, Homo sapiens
gcaccuauucugua

SEQ ID NO: 2012548 - RNA, 16 nt, Homo sapiens
gcccagcugcaccugc

SEQ ID NO: 2012549 - RNA, 16 nt, Homo sapiens
cauuuggaacaacaaa

SEQ ID NO: 2012550 - RNA, 23 nt, Homo sapiens
uccauaaaguaauuuugugaaag

SEQ ID NO: 2012551 - RNA, 23 nt, Homo sapiens
acauagcuuuagagaagccauaa

SEQ ID NO: 2012552 - RNA, 16 nt, Homo sapiens
caauacccacugccag

SEQ ID NO: 2012553 - RNA, 13 nt, Homo sapiens
cugagcuuuccag

SEQ ID NO: 2012554 - RNA, 15 nt, Homo sapiens
cacugggaaacagag

SEQ ID NO: 2012555 - RNA, 15 nt, Homo sapiens
aggcauaucagucuc

SEQ ID NO: 2012556 - RNA, 16 nt, Homo sapiens
cuauuggaaugugguc

SEQ ID NO: 2012557 - RNA, 17 nt, Homo sapiens
aagaugucucacagccc

SEQ ID NO: 2012558 - RNA, 12 nt, Homo sapiens
cgagcuggccga

SEQ ID NO: 2012559 - RNA, 19 nt, Homo sapiens
auaccuucuggcugugcua

SEQ ID NO: 2012560 - RNA, 15 nt, Homo sapiens
ucccugcuuugcauc

SEQ ID NO: 2012561 - RNA, 18 nt, Homo sapiens
acccaccccguagauucc

SEQ ID NO: 2012562 - RNA, 20 nt, Homo sapiens
ccugcccugggauguccaca

SEQ ID NO: 2012563 - RNA, 12 nt, Homo sapiens
ugccacaaccag

SEQ ID NO: 2012564 - RNA, 20 nt, Homo sapiens
ccucucugugggauaucaca

SEQ ID NO: 2012565 - RNA, 20 nt, Homo sapiens
cuaaggaaguaucagcacua

SEQ ID NO: 2012566 - RNA, 13 nt, Homo sapiens
cauacaggugccu

SEQ ID NO: 2012567 - RNA, 15 nt, Homo sapiens
ucuggccacugcugc

SEQ ID NO: 2012568 - RNA, 23 nt, Homo sapiens
ucucaaaauaaaaccagaaagag

SEQ ID NO: 2012569 - RNA, 18 nt, Homo sapiens
cuuaccagaagcuuccau

SEQ ID NO: 2012570 - RNA, 17 nt, Homo sapiens
cugcuuucuuguugcug

SEQ ID NO: 2012571 - RNA, 14 nt, Homo sapiens
gcuucuaggugccc

SEQ ID NO: 2012572 - RNA, 17 nt, Homo sapiens
auuauauuacauuuuac

SEQ ID NO: 2012573 - RNA, 11 nt, Homo sapiens
gucucuuuaua

SEQ ID NO: 2012574 - RNA, 18 nt, Homo sapiens
caaugggcacugauuuga

SEQ ID NO: 2012575 - RNA, 18 nt, Homo sapiens
caggcuguucugcacuga

SEQ ID NO: 2012576 - RNA, 15 nt, Homo sapiens
cucaugguacuguag

SEQ ID NO: 2012577 - RNA, 11 nt, Homo sapiens
uaugcacacac

SEQ ID NO: 2012578 - RNA, 14 nt, Homo sapiens
agaaaggaaguaua

SEQ ID NO: 2012579 - RNA, 21 nt, Homo sapiens
gcagagggucuccaagggcau

SEQ ID NO: 2012580 - RNA, 17 nt, Homo sapiens
ucccuccccugcucaga

SEQ ID NO: 2012581 - RNA, 17 nt, Homo sapiens
accccaccuugccaagc

SEQ ID NO: 2012582 - RNA, 19 nt, Homo sapiens
agacagacaacacugggaa

SEQ ID NO: 2012583 - RNA, 13 nt, Homo sapiens
ccauaacauacca

SEQ ID NO: 2012584 - RNA, 13 nt, Homo sapiens
uaccaguugccuu

SEQ ID NO: 2012585 - RNA, 22 nt, Homo sapiens
ccaggcccggggcuggcggcua

SEQ ID NO: 2012586 - RNA, 15 nt, Homo sapiens
cauguccuacaacag

SEQ ID NO: 2012587 - RNA, 15 nt, Homo sapiens
acuaggugaucucag

SEQ ID NO: 2012588 - RNA, 18 nt, Homo sapiens
gaggggccugcaggugag

SEQ ID NO: 2012589 - RNA, 17 nt, Homo sapiens
gaaagcuggugucugau

SEQ ID NO: 2012590 - RNA, 17 nt, Homo sapiens
aauugacugaagcacag

SEQ ID NO: 2012591 - RNA, 21 nt, Homo sapiens
ugguccuaagcaccugccuca

SEQ ID NO: 2012592 - RNA, 22 nt, Homo sapiens
caggacugaguccccuccagga

SEQ ID NO: 2012593 - RNA, 16 nt, Homo sapiens
gguuccccacacaggg

SEQ ID NO: 2012594 - RNA, 22 nt, Homo sapiens
uuuaaaaggcccuguggucugg

SEQ ID NO: 2012595 - RNA, 15 nt, Homo sapiens
aaaagaccaguccau

SEQ ID NO: 2012596 - RNA, 18 nt, Homo sapiens
ggggucuccuauacucua

SEQ ID NO: 2012597 - RNA, 23 nt, Homo sapiens
gcaacaauauccuuuuacugcag

SEQ ID NO: 2012598 - RNA, 23 nt, Homo sapiens
cuuuaccaaaugaaaugccaaag

SEQ ID NO: 2012599 - RNA, 15 nt, Homo sapiens
uuuucagaugucuua

SEQ ID NO: 2012600 - RNA, 11 nt, Homo sapiens
gauuguguuaa

SEQ ID NO: 2012601 - RNA, 18 nt, Homo sapiens
caaaauaaagaauaugcc

SEQ ID NO: 2012602 - RNA, 11 nt, Homo sapiens
uccaccccagu

SEQ ID NO: 2012603 - RNA, 14 nt, Homo sapiens
acgugccugugguc

SEQ ID NO: 2012604 - RNA, 18 nt, Homo sapiens
acuucuuuuccaaaaaua

SEQ ID NO: 2012605 - RNA, 21 nt, Homo sapiens
gcuacuccccagaccucaggg

SEQ ID NO: 2012606 - RNA, 20 nt, Homo sapiens
aaggcgugggggacaagaag

SEQ ID NO: 2012607 - RNA, 13 nt, Homo sapiens
ugucucugagaac

SEQ ID NO: 2012608 - RNA, 14 nt, Homo sapiens
ugcuggcauuugca

SEQ ID NO: 2012609 - RNA, 21 nt, Homo sapiens
aauagccuaauacaacaugua

SEQ ID NO: 2012610 - RNA, 20 nt, Homo sapiens
cacuauagccauuugcccca

SEQ ID NO: 2012611 - RNA, 22 nt, Homo sapiens
ucacugaggccugagacccagg

SEQ ID NO: 2012612 - RNA, 21 nt, Homo sapiens
cauggugaaaaccccaucucu

SEQ ID NO: 2012613 - RNA, 13 nt, Homo sapiens
ggagucucagagc

SEQ ID NO: 2012614 - RNA, 13 nt, Homo sapiens
aaacgcuacugag

SEQ ID NO: 2012615 - RNA, 22 nt, Homo sapiens
uauucuuuaaacaaauaugaaa

SEQ ID NO: 2012616 - RNA, 16 nt, Homo sapiens
agagacaggauuucac

SEQ ID NO: 2012617 - RNA, 13 nt, Homo sapiens
ggcccagugccag

SEQ ID NO: 2012618 - RNA, 13 nt, Homo sapiens
ucccuucuuuuuc

SEQ ID NO: 2012619 - RNA, 19 nt, Homo sapiens
uagaucaaggagcccagaa

SEQ ID NO: 2012620 - RNA, 16 nt, Homo sapiens
ccucacucaggaaccc

SEQ ID NO: 2012621 - RNA, 20 nt, Homo sapiens
uuaagagcuugaucugugau

SEQ ID NO: 2012622 - RNA, 18 nt, Homo sapiens
uccugaaauaaacacugg

SEQ ID NO: 2012623 - RNA, 13 nt, Homo sapiens
aggaaagcaauaa

SEQ ID NO: 2012624 - RNA, 17 nt, Homo sapiens
ugucuaaaaugccucag

SEQ ID NO: 2012625 - RNA, 13 nt, Homo sapiens
aacuuuucuauua

SEQ ID NO: 2012626 - RNA, 13 nt, Homo sapiens
ucccauucacucu

SEQ ID NO: 2012627 - RNA, 13 nt, Homo sapiens
acaaaauugcaga

SEQ ID NO: 2012628 - RNA, 20 nt, Homo sapiens
guggauuaaagugcccagca

SEQ ID NO: 2012629 - RNA, 19 nt, Homo sapiens
uuucaaucucugacuaaaa

SEQ ID NO: 2012630 - RNA, 21 nt, Homo sapiens
acuuggaaauggcaugcaaaa

SEQ ID NO: 2012631 - RNA, 14 nt, Homo sapiens
cuuuuauguagcac

SEQ ID NO: 2012632 - RNA, 17 nt, Homo sapiens
uaaaauaaggauuuuuc

SEQ ID NO: 2012633 - RNA, 22 nt, Homo sapiens
cuggcacugaauuaaucaucua

SEQ ID NO: 2012634 - RNA, 22 nt, Homo sapiens
caguaucucuucagucucuaua

SEQ ID NO: 2012635 - RNA, 14 nt, Homo sapiens
uguuaugggcacug

SEQ ID NO: 2012636 - RNA, 20 nt, Homo sapiens
ucaagacuaucuacaaaaau

SEQ ID NO: 2012637 - RNA, 15 nt, Homo sapiens
gucuucaguuucauu

SEQ ID NO: 2012638 - RNA, 18 nt, Homo sapiens
uuuggcuauaagugcuca

SEQ ID NO: 2012639 - RNA, 17 nt, Homo sapiens
uuaaauaauacauuuau

SEQ ID NO: 2012640 - RNA, 15 nt, Homo sapiens
acgagugaaacuccg

SEQ ID NO: 2012641 - RNA, 20 nt, Homo sapiens
uaaagaucgcccccaccucc

SEQ ID NO: 2012642 - RNA, 17 nt, Homo sapiens
ggcuggaaucuggagag

SEQ ID NO: 2012643 - RNA, 12 nt, Homo sapiens
cagcugugauga

SEQ ID NO: 2012644 - RNA, 21 nt, Homo sapiens
caaaaggaggugaaaucccug

SEQ ID NO: 2012645 - RNA, 18 nt, Homo sapiens
aguggcaccaccauggcu

SEQ ID NO: 2012646 - RNA, 15 nt, Homo sapiens
acugaauucagcacc

SEQ ID NO: 2012647 - RNA, 24 nt, Homo sapiens
uccguucccaaggauacucgugaa

SEQ ID NO: 2012648 - RNA, 21 nt, Homo sapiens
uccaaauuugaauggauuaaa

SEQ ID NO: 2012649 - RNA, 18 nt, Homo sapiens
ugaaguucacucagaggg

SEQ ID NO: 2012650 - RNA, 21 nt, Homo sapiens
ggcaacaagagcgagacuccg

SEQ ID NO: 2012651 - RNA, 20 nt, Homo sapiens
ggacggcccugccugccucu

SEQ ID NO: 2012652 - RNA, 17 nt, Homo sapiens
gccaaccccacccagcu

SEQ ID NO: 2012653 - RNA, 14 nt, Homo sapiens
cucguuuuccuuag

SEQ ID NO: 2012654 - RNA, 13 nt, Homo sapiens
aagugaaagcaag

SEQ ID NO: 2012655 - RNA, 18 nt, Homo sapiens
cagaacuauaacauucaa

SEQ ID NO: 2012656 - RNA, 20 nt, Homo sapiens
cuuaaaauugguaauugaau

SEQ ID NO: 2012657 - RNA, 19 nt, Homo sapiens
cauucucuuugauaacaaa

SEQ ID NO: 2012658 - RNA, 22 nt, Homo sapiens
gauagcaagguuuggugcaaag

SEQ ID NO: 2012659 - RNA, 14 nt, Homo sapiens
gguugaggggacca

SEQ ID NO: 2012660 - RNA, 18 nt, Homo sapiens
uuuggcauuccugaauaa

SEQ ID NO: 2012661 - RNA, 20 nt, Homo sapiens
cuguguuuguacugugcagu

SEQ ID NO: 2012662 - RNA, 13 nt, Homo sapiens
uuucuuaaaaagu

SEQ ID NO: 2012663 - RNA, 21 nt, Homo sapiens
gaaacucuucaggcaccugaa

SEQ ID NO: 2012664 - RNA, 20 nt, Homo sapiens
guuuaaauucuaguguccau

SEQ ID NO: 2012665 - RNA, 15 nt, Homo sapiens
cgagagagucuucca

SEQ ID NO: 2012666 - RNA, 22 nt, Homo sapiens
uuucaauacuuacauaucugac

SEQ ID NO: 2012667 - RNA, 21 nt, Homo sapiens
augccacccaguugugacaau

SEQ ID NO: 2012668 - RNA, 12 nt, Homo sapiens
gagaauugagaa

SEQ ID NO: 2012669 - RNA, 18 nt, Homo sapiens
ugcaauuuuacugugaaa

SEQ ID NO: 2012670 - RNA, 18 nt, Homo sapiens
ugacacgucugccuaccc

SEQ ID NO: 2012671 - RNA, 21 nt, Homo sapiens
agagacucucccugacggugg

SEQ ID NO: 2012672 - RNA, 20 nt, Homo sapiens
cagaugcuuuucugucucug

SEQ ID NO: 2012673 - RNA, 13 nt, Homo sapiens
ucucucacaugga

SEQ ID NO: 2012674 - RNA, 13 nt, Homo sapiens
auucucacucgga

SEQ ID NO: 2012675 - RNA, 15 nt, Homo sapiens
uauuagcucacugaa

SEQ ID NO: 2012676 - RNA, 18 nt, Homo sapiens
aucccaucccaucccauc

SEQ ID NO: 2012677 - RNA, 13 nt, Homo sapiens
cugcaccuuguga

SEQ ID NO: 2012678 - RNA, 14 nt, Homo sapiens
ucugucacccaguc

SEQ ID NO: 2012679 - RNA, 13 nt, Homo sapiens
acgacuucagggc

SEQ ID NO: 2012680 - RNA, 13 nt, Homo sapiens
gccgggacaugca

SEQ ID NO: 2012681 - RNA, 14 nt, Homo sapiens
acagagagcuccuc

SEQ ID NO: 2012682 - RNA, 16 nt, Homo sapiens
aaucuuccugccucag

SEQ ID NO: 2012683 - RNA, 12 nt, Homo sapiens
uugauagucaau

SEQ ID NO: 2012684 - RNA, 18 nt, Homo sapiens
ucaauaaauuguaauugu

SEQ ID NO: 2012685 - RNA, 15 nt, Homo sapiens
ucggcugaccaugcu

SEQ ID NO: 2012686 - RNA, 16 nt, Homo sapiens
ucuaguucagcugccc

SEQ ID NO: 2012687 - RNA, 21 nt, Homo sapiens
gggaagaccagcuuugcagug

SEQ ID NO: 2012688 - RNA, 15 nt, Homo sapiens
aguucauggauaugu

SEQ ID NO: 2012689 - RNA, 15 nt, Homo sapiens
uaauauaacugccuu

SEQ ID NO: 2012690 - RNA, 20 nt, Homo sapiens
cuugggcaugggggagccuu

SEQ ID NO: 2012691 - RNA, 13 nt, Homo sapiens
uuagagcacuuuu

SEQ ID NO: 2012692 - RNA, 20 nt, Homo sapiens
gccaagagugcacuacugua

SEQ ID NO: 2012693 - RNA, 20 nt, Homo sapiens
gcaccgggcuggccugacac

SEQ ID NO: 2012694 - RNA, 22 nt, Homo sapiens
cauuaaaacaagagaccacuuc

SEQ ID NO: 2012695 - RNA, 15 nt, Homo sapiens
ugacagugaugcugc

SEQ ID NO: 2012696 - RNA, 22 nt, Homo sapiens
auagauccucugauauacaauu

SEQ ID NO: 2012697 - RNA, 22 nt, Homo sapiens
ugaacucagaccacuugcauua

SEQ ID NO: 2012698 - RNA, 22 nt, Homo sapiens
agccaugggaaccucauaugca

SEQ ID NO: 2012699 - RNA, 15 nt, Homo sapiens
uuaaaagucauuauu

SEQ ID NO: 2012700 - RNA, 21 nt, Homo sapiens
uuagaauugcuggaugcauuu

SEQ ID NO: 2012701 - RNA, 13 nt, Homo sapiens
acuugcaaucaaa

SEQ ID NO: 2012702 - RNA, 13 nt, Homo sapiens
gagugcaucccag

SEQ ID NO: 2012703 - RNA, 18 nt, Homo sapiens
gccguggcuauaccuggg

SEQ ID NO: 2012704 - RNA, 17 nt, Homo sapiens
cuugguuaucaaauaca

SEQ ID NO: 2012705 - RNA, 15 nt, Homo sapiens
ccccuacugcuguga

SEQ ID NO: 2012706 - RNA, 19 nt, Homo sapiens
ugaucacggcucacugcag

SEQ ID NO: 2012707 - RNA, 22 nt, Homo sapiens
uauugguaauuuuaugagcugu

SEQ ID NO: 2012708 - RNA, 21 nt, Homo sapiens
cuaggaaacucacacuccccu

SEQ ID NO: 2012709 - RNA, 22 nt, Homo sapiens
gugaaacccccaucucuacuaa

SEQ ID NO: 2012710 - RNA, 19 nt, Homo sapiens
uuagagcuggcaccagaac

SEQ ID NO: 2012711 - RNA, 18 nt, Homo sapiens
gcaugugucaugcaugaa

SEQ ID NO: 2012712 - RNA, 14 nt, Homo sapiens
acccuuugcugacu

SEQ ID NO: 2012713 - RNA, 12 nt, Homo sapiens
cugaaauugcau

SEQ ID NO: 2012714 - RNA, 21 nt, Homo sapiens
gacaccaaacugccaaaaaca

SEQ ID NO: 2012715 - RNA, 13 nt, Homo sapiens
uggcaggaucuca

SEQ ID NO: 2012716 - RNA, 13 nt, Homo sapiens
guaccacugggau

SEQ ID NO: 2012717 - RNA, 17 nt, Homo sapiens
cuuaggucgccauuccc

SEQ ID NO: 2012718 - RNA, 14 nt, Homo sapiens
aagggaacagucca

SEQ ID NO: 2012719 - RNA, 21 nt, Homo sapiens
ucaaugggaagaugugcaaca

SEQ ID NO: 2012720 - RNA, 14 nt, Homo sapiens
uagacuagcaaucu

SEQ ID NO: 2012721 - RNA, 21 nt, Homo sapiens
cccaauacauaccacuuugaa

SEQ ID NO: 2012722 - RNA, 16 nt, Homo sapiens
uccacuuguucagggc

SEQ ID NO: 2012723 - RNA, 15 nt, Homo sapiens
ccugcacacacaugc

SEQ ID NO: 2012724 - RNA, 20 nt, Homo sapiens
gcagcuuagacuaaggccau

SEQ ID NO: 2012725 - RNA, 18 nt, Homo sapiens
accugccuuccauuuuga

SEQ ID NO: 2012726 - RNA, 19 nt, Homo sapiens
caggaguucaagaccagcc

SEQ ID NO: 2012727 - RNA, 18 nt, Homo sapiens
gcaggaguagcugagcuc

SEQ ID NO: 2012728 - RNA, 21 nt, Homo sapiens
ggggacccaucuuccaccuca

SEQ ID NO: 2012729 - RNA, 21 nt, Homo sapiens
uugccucaacagcaggaggca

SEQ ID NO: 2012730 - RNA, 18 nt, Homo sapiens
cugaauuggcuuccagau

SEQ ID NO: 2012731 - RNA, 16 nt, Homo sapiens
acucgcccuaggcccu

SEQ ID NO: 2012732 - RNA, 22 nt, Homo sapiens
aaaaugucacuauaucuuccca

SEQ ID NO: 2012733 - RNA, 15 nt, Homo sapiens
uccuggacagcugug

SEQ ID NO: 2012734 - RNA, 15 nt, Homo sapiens
ugcuucugauggugu

SEQ ID NO: 2012735 - RNA, 19 nt, Homo sapiens
aauuuauaugcaugcacag

SEQ ID NO: 2012736 - RNA, 15 nt, Homo sapiens
gccagaggcucuaau

SEQ ID NO: 2012737 - RNA, 23 nt, Homo sapiens
gagaggaaaaguaaggugcaguu

SEQ ID NO: 2012738 - RNA, 17 nt, Homo sapiens
uugcuucaaaccccagg

SEQ ID NO: 2012739 - RNA, 20 nt, Homo sapiens
ugagccaccaugcccggcua

SEQ ID NO: 2012740 - RNA, 23 nt, Homo sapiens
cuacuucuccccuccucuugccu

SEQ ID NO: 2012741 - RNA, 17 nt, Homo sapiens
auuaaaagucacucuga

SEQ ID NO: 2012742 - RNA, 20 nt, Homo sapiens
caggcagucuuugcucagug

SEQ ID NO: 2012743 - RNA, 23 nt, Homo sapiens
aagugcugagauuacagguguga

SEQ ID NO: 2012744 - RNA, 19 nt, Homo sapiens
cuaugauaauuacaauaca

SEQ ID NO: 2012745 - RNA, 17 nt, Homo sapiens
auccaaacauccuggag

SEQ ID NO: 2012746 - RNA, 22 nt, Homo sapiens
uagaagacagacaucuguggaa

SEQ ID NO: 2012747 - RNA, 16 nt, Homo sapiens
cucaccguggauuuuc

SEQ ID NO: 2012748 - RNA, 16 nt, Homo sapiens
ugguucaccugaauca

SEQ ID NO: 2012749 - RNA, 14 nt, Homo sapiens
agagcccaugcuca

SEQ ID NO: 2012750 - RNA, 22 nt, Homo sapiens
cuaugucagcaguauuggcuga

SEQ ID NO: 2012751 - RNA, 18 nt, Homo sapiens
gaguagucuguagcuuga

SEQ ID NO: 2012752 - RNA, 13 nt, Homo sapiens
cccggugccaucu

SEQ ID NO: 2012753 - RNA, 14 nt, Homo sapiens
aaggcucauuuaaa

SEQ ID NO: 2012754 - RNA, 14 nt, Homo sapiens
ccacaggugugagc

SEQ ID NO: 2012755 - RNA, 18 nt, Homo sapiens
ggcaacgugcgugucucu

SEQ ID NO: 2012756 - RNA, 20 nt, Homo sapiens
uaaguuugaaacuaacucau

SEQ ID NO: 2012757 - RNA, 21 nt, Homo sapiens
cuaagccaagagucaugucaa

SEQ ID NO: 2012758 - RNA, 19 nt, Homo sapiens
aguugcagccagggccagu

SEQ ID NO: 2012759 - RNA, 17 nt, Homo sapiens
aaggucugcacuccuuu

SEQ ID NO: 2012760 - RNA, 19 nt, Homo sapiens
uguucccuagagagaauaa

SEQ ID NO: 2012761 - RNA, 13 nt, Homo sapiens
aaucugcugccau

SEQ ID NO: 2012762 - RNA, 17 nt, Homo sapiens
ucagaaccuugucccag

SEQ ID NO: 2012763 - RNA, 20 nt, Homo sapiens
aagcuuggggaacccaugag

SEQ ID NO: 2012764 - RNA, 16 nt, Homo sapiens
uucagcuacuuuccau

SEQ ID NO: 2012765 - RNA, 14 nt, Homo sapiens
uucuaaugucuuca

SEQ ID NO: 2012766 - RNA, 15 nt, Homo sapiens
gcauuuaacugccuu

SEQ ID NO: 2012767 - RNA, 21 nt, Homo sapiens
cauaaaagaaaaucuuuaggc

SEQ ID NO: 2012768 - RNA, 22 nt, Homo sapiens
acaucuccaggcuuucaauguu

SEQ ID NO: 2012769 - RNA, 14 nt, Homo sapiens
uaaaaagugugacu

SEQ ID NO: 2012770 - RNA, 21 nt, Homo sapiens
cgcuucugcuuaaucugagaa

SEQ ID NO: 2012771 - RNA, 15 nt, Homo sapiens
aauccugaagagcau

SEQ ID NO: 2012772 - RNA, 17 nt, Homo sapiens
ggugcaagaccuagucc

SEQ ID NO: 2012773 - RNA, 20 nt, Homo sapiens
ugagggcagcuuugcaaaau

SEQ ID NO: 2012774 - RNA, 13 nt, Homo sapiens
uuguuuaaaguau

SEQ ID NO: 2012775 - RNA, 17 nt, Homo sapiens
cuguaauuucacuuuag

SEQ ID NO: 2012776 - RNA, 19 nt, Homo sapiens
ccccacccccugggcagau

SEQ ID NO: 2012777 - RNA, 15 nt, Homo sapiens
ugugagagaaagugu

SEQ ID NO: 2012778 - RNA, 15 nt, Homo sapiens
aaauacuguguuuca

SEQ ID NO: 2012779 - RNA, 19 nt, Homo sapiens
agugcacacggaugcacag

SEQ ID NO: 2012780 - RNA, 19 nt, Homo sapiens
accuguuagcagacaggcc

SEQ ID NO: 2012781 - RNA, 22 nt, Homo sapiens
uuauuuaaaacucaccucccaa

SEQ ID NO: 2012782 - RNA, 13 nt, Homo sapiens
gcccagcaggggc

SEQ ID NO: 2012783 - RNA, 22 nt, Homo sapiens
ugagcagccucuggacagccag

SEQ ID NO: 2012784 - RNA, 12 nt, Homo sapiens
ucagccuugcac

SEQ ID NO: 2012785 - RNA, 22 nt, Homo sapiens
aaauguaucugaguauugaaug

SEQ ID NO: 2012786 - RNA, 17 nt, Homo sapiens
agacccagagagcuuaa

SEQ ID NO: 2012787 - RNA, 18 nt, Homo sapiens
gucaguguagacacaggu

SEQ ID NO: 2012788 - RNA, 17 nt, Homo sapiens
ccaaaguccucugcucc

SEQ ID NO: 2012789 - RNA, 23 nt, Homo sapiens
cugugguaguccucccaagcugu

SEQ ID NO: 2012790 - RNA, 15 nt, Homo sapiens
uaucgaacacauuca

SEQ ID NO: 2012791 - RNA, 22 nt, Homo sapiens
gugcuucagaguuuguguguau

SEQ ID NO: 2012792 - RNA, 19 nt, Homo sapiens
accuguguuucuugccuca

SEQ ID NO: 2012793 - RNA, 17 nt, Homo sapiens
agagacuuaucuuuuag

SEQ ID NO: 2012794 - RNA, 17 nt, Homo sapiens
ugggucuaggacacagu

SEQ ID NO: 2012795 - RNA, 13 nt, Homo sapiens
ccaggacuuugag

SEQ ID NO: 2012796 - RNA, 14 nt, Homo sapiens
uggccaacauggug

SEQ ID NO: 2012797 - RNA, 15 nt, Homo sapiens
gcugugccaccaccc

SEQ ID NO: 2012798 - RNA, 21 nt, Homo sapiens
gauucacauaguuuauuucaa

SEQ ID NO: 2012799 - RNA, 15 nt, Homo sapiens
uuuaaagaaaaccac

SEQ ID NO: 2012800 - RNA, 21 nt, Homo sapiens
cagcuaagcccccuacugaga

SEQ ID NO: 2012801 - RNA, 18 nt, Homo sapiens
gcaaauuuggggguuucu

SEQ ID NO: 2012802 - RNA, 16 nt, Homo sapiens
aagauuuuagcuacau

SEQ ID NO: 2012803 - RNA, 16 nt, Homo sapiens
cgguauaacacaucua

SEQ ID NO: 2012804 - RNA, 22 nt, Homo sapiens
ucccaggaggggcuucugggca

SEQ ID NO: 2012805 - RNA, 21 nt, Homo sapiens
acauguggguggagaagggag

SEQ ID NO: 2012806 - RNA, 14 nt, Homo sapiens
ggcaucaaauguca

SEQ ID NO: 2012807 - RNA, 20 nt, Homo sapiens
gacaggaacccuugcaucca

SEQ ID NO: 2012808 - RNA, 22 nt, Homo sapiens
auaagaaaacauguaaaggggg

SEQ ID NO: 2012809 - RNA, 16 nt, Homo sapiens
ucaacaccucugcaca

SEQ ID NO: 2012810 - RNA, 21 nt, Homo sapiens
uggaggggcagagccaggaag

SEQ ID NO: 2012811 - RNA, 17 nt, Homo sapiens
aacauaaguugcauuua

SEQ ID NO: 2012812 - RNA, 20 nt, Homo sapiens
aguaggugggggaacacuga

SEQ ID NO: 2012813 - RNA, 20 nt, Homo sapiens
guaaauaauuuucuaagaca

SEQ ID NO: 2012814 - RNA, 18 nt, Homo sapiens
auauguaaguacuuccac

SEQ ID NO: 2012815 - RNA, 15 nt, Homo sapiens
cuucugccacgcuuu

SEQ ID NO: 2012816 - RNA, 23 nt, Homo sapiens
aucaagaacaugucagcaauguc

SEQ ID NO: 2012817 - RNA, 18 nt, Homo sapiens
ucuuggggugcagcacuu

SEQ ID NO: 2012818 - RNA, 20 nt, Homo sapiens
agcaugcauccuuugcacug

SEQ ID NO: 2012819 - RNA, 20 nt, Homo sapiens
accaguugaauaaaagugca

SEQ ID NO: 2012820 - RNA, 15 nt, Homo sapiens
ugacacaaagcuucu

SEQ ID NO: 2012821 - RNA, 22 nt, Homo sapiens
cuccuuccuucccagaauguua

SEQ ID NO: 2012822 - RNA, 13 nt, Homo sapiens
agaugccuacuuu

SEQ ID NO: 2012823 - RNA, 21 nt, Homo sapiens
gaagguacuguaugaucaaau

SEQ ID NO: 2012824 - RNA, 13 nt, Homo sapiens
acauugcuuuuau

SEQ ID NO: 2012825 - RNA, 19 nt, Homo sapiens
cagcacucugaaacugaga

SEQ ID NO: 2012826 - RNA, 14 nt, Homo sapiens
ggagggagcggcau

SEQ ID NO: 2012827 - RNA, 17 nt, Homo sapiens
acgugaucaguguugca

SEQ ID NO: 2012828 - RNA, 12 nt, Homo sapiens
cuggcucugaga

SEQ ID NO: 2012829 - RNA, 21 nt, Homo sapiens
caggagaaguuaagaauugag

SEQ ID NO: 2012830 - RNA, 18 nt, Homo sapiens
guacuuugacaaacugaa

SEQ ID NO: 2012831 - RNA, 15 nt, Homo sapiens
acgcaaggugugcuc

SEQ ID NO: 2012832 - RNA, 22 nt, Homo sapiens
ucacaagugagcccucuugccc

SEQ ID NO: 2012833 - RNA, 21 nt, Homo sapiens
caagcaugcaauaaugugcaa

SEQ ID NO: 2012834 - RNA, 22 nt, Homo sapiens
aacuuaccauucaacugaacaa

SEQ ID NO: 2012835 - RNA, 15 nt, Homo sapiens
cagugcuuuucacua

SEQ ID NO: 2012836 - RNA, 16 nt, Homo sapiens
acaguggccaaagagg

SEQ ID NO: 2012837 - RNA, 20 nt, Homo sapiens
uggauucuucccacacagaa

SEQ ID NO: 2012838 - RNA, 19 nt, Homo sapiens
caagcagcuggugcuccaa

SEQ ID NO: 2012839 - RNA, 15 nt, Homo sapiens
auugaucaccaugaa

SEQ ID NO: 2012840 - RNA, 12 nt, Homo sapiens
uuucaguauuau

SEQ ID NO: 2012841 - RNA, 18 nt, Homo sapiens
acauccacacagccaaua

SEQ ID NO: 2012842 - RNA, 14 nt, Homo sapiens
cugaguucaaguca

SEQ ID NO: 2012843 - RNA, 10 nt, Homo sapiens
ggaauuacaa

SEQ ID NO: 2012844 - RNA, 17 nt, Homo sapiens
aggccaaggaaugaucc

SEQ ID NO: 2012845 - RNA, 18 nt, Homo sapiens
ccauguaaucagauuuau

SEQ ID NO: 2012846 - RNA, 16 nt, Homo sapiens
agcagucaauacaaau

SEQ ID NO: 2012847 - RNA, 22 nt, Homo sapiens
acgcacaugcgaccccgaggaa

SEQ ID NO: 2012848 - RNA, 13 nt, Homo sapiens
agagagccuggug

SEQ ID NO: 2012849 - RNA, 20 nt, Homo sapiens
ugauaaucaguuuccacuac

SEQ ID NO: 2012850 - RNA, 11 nt, Homo sapiens
acaucuuucac

SEQ ID NO: 2012851 - RNA, 16 nt, Homo sapiens
agagauucuugugccu

SEQ ID NO: 2012852 - RNA, 13 nt, Homo sapiens
agccucacucagc

SEQ ID NO: 2012853 - RNA, 12 nt, Homo sapiens
agcacuuugcaa

SEQ ID NO: 2012854 - RNA, 19 nt, Homo sapiens
agcaguauuaacuucacag

SEQ ID NO: 2012855 - RNA, 17 nt, Homo sapiens
cagccaacaugugacua

SEQ ID NO: 2012856 - RNA, 18 nt, Homo sapiens
aagcugccucaaggaauu

SEQ ID NO: 2012857 - RNA, 16 nt, Homo sapiens
aggcauagaggcuucu

SEQ ID NO: 2012858 - RNA, 14 nt, Homo sapiens
guucacacuccuau

SEQ ID NO: 2012859 - RNA, 22 nt, Homo sapiens
cugcacggggcauuccugcuuc

SEQ ID NO: 2012860 - RNA, 16 nt, Homo sapiens
uauugaauaagccauu

SEQ ID NO: 2012861 - RNA, 16 nt, Homo sapiens
uuuccaauaugugauu

SEQ ID NO: 2012862 - RNA, 17 nt, Homo sapiens
cagcuuuucagugaaug

SEQ ID NO: 2012863 - RNA, 21 nt, Homo sapiens
ucuguagcucaaucugcaaac

SEQ ID NO: 2012864 - RNA, 14 nt, Homo sapiens
gcaauuaaagugau

SEQ ID NO: 2012865 - RNA, 15 nt, Homo sapiens
uugguuaucauggga

SEQ ID NO: 2012866 - RNA, 13 nt, Homo sapiens
ugcaacuuguaaa

SEQ ID NO: 2012867 - RNA, 10 nt, Homo sapiens
aaagggaccc

SEQ ID NO: 2012868 - RNA, 23 nt, Homo sapiens
aaucacacgucuggcuucacaga

SEQ ID NO: 2012869 - RNA, 18 nt, Homo sapiens
gaauugugcaaccaucac

SEQ ID NO: 2012870 - RNA, 13 nt, Homo sapiens
ucaaauuccagaa

SEQ ID NO: 2012871 - RNA, 18 nt, Homo sapiens
cagaggaaaaacagagga

SEQ ID NO: 2012872 - RNA, 17 nt, Homo sapiens
ucugacccauguucacg

SEQ ID NO: 2012873 - RNA, 15 nt, Homo sapiens
acacagcaugugcca

SEQ ID NO: 2012874 - RNA, 17 nt, Homo sapiens
uuuuuggucacuccagu

SEQ ID NO: 2012875 - RNA, 14 nt, Homo sapiens
auggcuacaucucc

SEQ ID NO: 2012876 - RNA, 15 nt, Homo sapiens
agcucuaguucaaau

SEQ ID NO: 2012877 - RNA, 15 nt, Homo sapiens
uucuaaagagcacuu

SEQ ID NO: 2012878 - RNA, 19 nt, Homo sapiens
agucugccacuugucaaag

SEQ ID NO: 2012879 - RNA, 18 nt, Homo sapiens
cauuguaacaugacacuu

SEQ ID NO: 2012880 - RNA, 22 nt, Homo sapiens
cuuuacauuuucaguaccaaag

SEQ ID NO: 2012881 - RNA, 20 nt, Homo sapiens
ugacauucaggcaaugucua

SEQ ID NO: 2012882 - RNA, 16 nt, Homo sapiens
cuggaagcauggagca

SEQ ID NO: 2012883 - RNA, 14 nt, Homo sapiens
gccaccucuugggc

SEQ ID NO: 2012884 - RNA, 13 nt, Homo sapiens
uuggcucuaguca

SEQ ID NO: 2012885 - RNA, 13 nt, Homo sapiens
agcauaugcaaag

SEQ ID NO: 2012886 - RNA, 17 nt, Homo sapiens
ugcuagucacuggaaau

SEQ ID NO: 2012887 - RNA, 20 nt, Homo sapiens
uuggacacuuaguuauuuac

SEQ ID NO: 2012888 - RNA, 18 nt, Homo sapiens
acaucuuggucagauuug

SEQ ID NO: 2012889 - RNA, 21 nt, Homo sapiens
ggcgagaaacaagacaagcuc

SEQ ID NO: 2012890 - RNA, 19 nt, Homo sapiens
uagaacuugcagcugaugu

SEQ ID NO: 2012891 - RNA, 13 nt, Homo sapiens
aaccucugaggac

SEQ ID NO: 2012892 - RNA, 15 nt, Homo sapiens
aaaaguaaacaacau

SEQ ID NO: 2012893 - RNA, 22 nt, Homo sapiens
guuucaaauggacucauggcuu

SEQ ID NO: 2012894 - RNA, 20 nt, Homo sapiens
acauuccugacccucacuuu

SEQ ID NO: 2012895 - RNA, 17 nt, Homo sapiens
aaggccucauccugggg

SEQ ID NO: 2012896 - RNA, 22 nt, Homo sapiens
gcaugaggaggucccacuugca

SEQ ID NO: 2012897 - RNA, 22 nt, Homo sapiens
ucugggguccauucucugaguc

SEQ ID NO: 2012898 - RNA, 22 nt, Homo sapiens
ugugcuggacacuguccaugaa

SEQ ID NO: 2012899 - RNA, 19 nt, Homo sapiens
ugggcauggccgcuucuag

SEQ ID NO: 2012900 - RNA, 17 nt, Homo sapiens
caaauaugggcugaggu

SEQ ID NO: 2012901 - RNA, 23 nt, Homo sapiens
ucaggcuggucuugaacuccugg

SEQ ID NO: 2012902 - RNA, 14 nt, Homo sapiens
ugauauuggcuuaa

SEQ ID NO: 2012903 - RNA, 21 nt, Homo sapiens
gcccugaaagucccagaucaa

SEQ ID NO: 2012904 - RNA, 14 nt, Homo sapiens
gcucagaacccauc

SEQ ID NO: 2012905 - RNA, 18 nt, Homo sapiens
gaagccaaacaaaggccc

SEQ ID NO: 2012906 - RNA, 18 nt, Homo sapiens
cuccacuuggacaugggc

SEQ ID NO: 2012907 - RNA, 21 nt, Homo sapiens
aggucuccagagggugaaagc

SEQ ID NO: 2012908 - RNA, 19 nt, Homo sapiens
cggccuaugagaugaaaua

SEQ ID NO: 2012909 - RNA, 14 nt, Homo sapiens
aaguaaucacuuaa

SEQ ID NO: 2012910 - RNA, 18 nt, Homo sapiens
uacauaaugguacuccca

SEQ ID NO: 2012911 - RNA, 18 nt, Homo sapiens
aaauuguaacuacacuaa

SEQ ID NO: 2012912 - RNA, 16 nt, Homo sapiens
acuuuucuuuuuccca

SEQ ID NO: 2012913 - RNA, 19 nt, Homo sapiens
ugcaacagggggcaaagau

SEQ ID NO: 2012914 - RNA, 20 nt, Homo sapiens
ggaucuucccacuuugccac

SEQ ID NO: 2012915 - RNA, 14 nt, Homo sapiens
ccuaaaaaacacug

SEQ ID NO: 2012916 - RNA, 17 nt, Homo sapiens
cacguugugcacaugua

SEQ ID NO: 2012917 - RNA, 12 nt, Homo sapiens
cuuuuguacuga

SEQ ID NO: 2012918 - RNA, 19 nt, Homo sapiens
acaccucuaggacuccaca

SEQ ID NO: 2012919 - RNA, 24 nt, Homo sapiens
cacugccccugcaccugcuucuca

SEQ ID NO: 2012920 - RNA, 14 nt, Homo sapiens
cuuaaucacuacug

SEQ ID NO: 2012921 - RNA, 23 nt, Homo sapiens
gagccuguaaacuuuaucacuua

SEQ ID NO: 2012922 - RNA, 15 nt, Homo sapiens
gaauucagcucagcu

SEQ ID NO: 2012923 - RNA, 15 nt, Homo sapiens
uugacucggauuuga

SEQ ID NO: 2012924 - RNA, 14 nt, Homo sapiens
cgucugacucuggg

SEQ ID NO: 2012925 - RNA, 16 nt, Homo sapiens
aaagcacagcucucac

SEQ ID NO: 2012926 - RNA, 11 nt, Homo sapiens
ccaagguccug

SEQ ID NO: 2012927 - RNA, 17 nt, Homo sapiens
uacuuagagcagugaag

SEQ ID NO: 2012928 - RNA, 13 nt, Homo sapiens
cauguaccacaua

SEQ ID NO: 2012929 - RNA, 16 nt, Homo sapiens
cuuggacccaugacuc

SEQ ID NO: 2012930 - RNA, 14 nt, Homo sapiens
uuucaccacuccuc

SEQ ID NO: 2012931 - RNA, 14 nt, Homo sapiens
cgccaucaugucuu

SEQ ID NO: 2012932 - RNA, 18 nt, Homo sapiens
gccaucucaagcaaguuu

SEQ ID NO: 2012933 - RNA, 21 nt, Homo sapiens
aaaugaacauuuaacuagccu

SEQ ID NO: 2012934 - RNA, 14 nt, Homo sapiens
uaacugaggcucag

SEQ ID NO: 2012935 - RNA, 20 nt, Homo sapiens
ugaacaugcaguucauuauu

SEQ ID NO: 2012936 - RNA, 20 nt, Homo sapiens
acaagugguguuuauugcaa

SEQ ID NO: 2012937 - RNA, 14 nt, Homo sapiens
acgaaaauaaagua

SEQ ID NO: 2012938 - RNA, 18 nt, Homo sapiens
augaaucucccacuccag

SEQ ID NO: 2012939 - RNA, 20 nt, Homo sapiens
cuagaguauaccugugguuu

SEQ ID NO: 2012940 - RNA, 20 nt, Homo sapiens
ucugaaucaugucuguaucc

SEQ ID NO: 2012941 - RNA, 22 nt, Homo sapiens
uugauaaaugacacaaugaagu

SEQ ID NO: 2012942 - RNA, 14 nt, Homo sapiens
agugaccauuuuag

SEQ ID NO: 2012943 - RNA, 19 nt, Homo sapiens
aagaaguugcugcagauuc

SEQ ID NO: 2012944 - RNA, 15 nt, Homo sapiens
uuggucuagugugcu

SEQ ID NO: 2012945 - RNA, 20 nt, Homo sapiens
cuuugguuauuucugugcaa

SEQ ID NO: 2012946 - RNA, 17 nt, Homo sapiens
agcuucauuuugguaag

SEQ ID NO: 2012947 - RNA, 11 nt, Homo sapiens
uaauaagcaau

SEQ ID NO: 2012948 - RNA, 14 nt, Homo sapiens
acuuacuuuacuca

SEQ ID NO: 2012949 - RNA, 16 nt, Homo sapiens
cauuucaaucuuuuca

SEQ ID NO: 2012950 - RNA, 13 nt, Homo sapiens
ugaaaaacuuaag

SEQ ID NO: 2012951 - RNA, 13 nt, Homo sapiens
agugguucaagca

SEQ ID NO: 2012952 - RNA, 18 nt, Homo sapiens
agacauggagacuccugc

SEQ ID NO: 2012953 - RNA, 15 nt, Homo sapiens
cccucagcugccuca

SEQ ID NO: 2012954 - RNA, 16 nt, Homo sapiens
caccugaaugugucug

SEQ ID NO: 2012955 - RNA, 16 nt, Homo sapiens
caauaaaaccacugua

SEQ ID NO: 2012956 - RNA, 15 nt, Homo sapiens
uggacaauaaucuca

SEQ ID NO: 2012957 - RNA, 23 nt, Homo sapiens
gauaagcaguuaugugaccucac

SEQ ID NO: 2012958 - RNA, 14 nt, Homo sapiens
ggcuagcuucugcu

SEQ ID NO: 2012959 - RNA, 15 nt, Homo sapiens
uccggugccuuccac

SEQ ID NO: 2012960 - RNA, 22 nt, Homo sapiens
uagcaaacaaauggcuuacuua

SEQ ID NO: 2012961 - RNA, 15 nt, Homo sapiens
gcugggcaccacagg

SEQ ID NO: 2012962 - RNA, 16 nt, Homo sapiens
gaggccaggaugccug

SEQ ID NO: 2012963 - RNA, 13 nt, Homo sapiens
aggucucaugccu

SEQ ID NO: 2012964 - RNA, 21 nt, Homo sapiens
guaucuuuuuauucagcucau

SEQ ID NO: 2012965 - RNA, 15 nt, Homo sapiens
aagugagcaguguua

SEQ ID NO: 2012966 - RNA, 20 nt, Homo sapiens
acuuccaggggaaccugcca

SEQ ID NO: 2012967 - RNA, 21 nt, Homo sapiens
cauuaaaggaaacguggcagg

SEQ ID NO: 2012968 - RNA, 19 nt, Homo sapiens
agcugcauuugucuggccu

SEQ ID NO: 2012969 - RNA, 20 nt, Homo sapiens
aaccuccaccucccggguuc

SEQ ID NO: 2012970 - RNA, 16 nt, Homo sapiens
gggggaagagcacagc

SEQ ID NO: 2012971 - RNA, 23 nt, Homo sapiens
ucacaaaacacuucgagcacugu

SEQ ID NO: 2012972 - RNA, 22 nt, Homo sapiens
gcccacauauaaauguacuuuu

SEQ ID NO: 2012973 - RNA, 20 nt, Homo sapiens
gcaauaaacuccuacuaaau

SEQ ID NO: 2012974 - RNA, 15 nt, Homo sapiens
acaggugggcuguau

SEQ ID NO: 2012975 - RNA, 22 nt, Homo sapiens
agaaaaaaaaaugccauaauac

SEQ ID NO: 2012976 - RNA, 15 nt, Homo sapiens
ugaaaauaaaaagag

SEQ ID NO: 2012977 - RNA, 21 nt, Homo sapiens
gacucugccauuaaaacauua

SEQ ID NO: 2012978 - RNA, 22 nt, Homo sapiens
cugacaaaggugguaaauucag

SEQ ID NO: 2012979 - RNA, 12 nt, Homo sapiens
uccuaugcugca

SEQ ID NO: 2012980 - RNA, 18 nt, Homo sapiens
aucaugaaaaaugaucuc

SEQ ID NO: 2012981 - RNA, 21 nt, Homo sapiens
gaggugguaagaacaccugac

SEQ ID NO: 2012982 - RNA, 12 nt, Homo sapiens
gccagaagugaa

SEQ ID NO: 2012983 - RNA, 15 nt, Homo sapiens
uauccuuagcucaca

SEQ ID NO: 2012984 - RNA, 15 nt, Homo sapiens
ucagauuuauuuccc

SEQ ID NO: 2012985 - RNA, 21 nt, Homo sapiens
agguguucuucauuaccucag

SEQ ID NO: 2012986 - RNA, 22 nt, Homo sapiens
ccacaacuugucacccaaagcc

SEQ ID NO: 2012987 - RNA, 13 nt, Homo sapiens
gcuuuaccuuuau

SEQ ID NO: 2012988 - RNA, 18 nt, Homo sapiens
gagcaacucccucucagc

SEQ ID NO: 2012989 - RNA, 21 nt, Homo sapiens
acuguucgucacucaaaugaa

SEQ ID NO: 2012990 - RNA, 12 nt, Homo sapiens
aacaaccaucuc

SEQ ID NO: 2012991 - RNA, 22 nt, Homo sapiens
cucgaucuuccagaagcuguac

SEQ ID NO: 2012992 - RNA, 15 nt, Homo sapiens
aguagauccauuucc

SEQ ID NO: 2012993 - RNA, 16 nt, Homo sapiens
cauuacccacgugaca

SEQ ID NO: 2012994 - RNA, 18 nt, Homo sapiens
uauggguugucaauagua

SEQ ID NO: 2012995 - RNA, 20 nt, Homo sapiens
agagauauuuauguacucuc

SEQ ID NO: 2012996 - RNA, 18 nt, Homo sapiens
gaaaaaaaccacacaaag

SEQ ID NO: 2012997 - RNA, 19 nt, Homo sapiens
aagugguagcucuuguugc

SEQ ID NO: 2012998 - RNA, 20 nt, Homo sapiens
ucagugaaaaagauguacag

SEQ ID NO: 2012999 - RNA, 13 nt, Homo sapiens
ccaagaagaccau

SEQ ID NO: 2013000 - RNA, 19 nt, Homo sapiens
agacaaugugccacagauc

SEQ ID NO: 2013001 - RNA, 14 nt, Homo sapiens
caagaguuagaaca

SEQ ID NO: 2013002 - RNA, 14 nt, Homo sapiens
uagccuccaaaagu

SEQ ID NO: 2013003 - RNA, 16 nt, Homo sapiens
ucgccgaggagagcaa

SEQ ID NO: 2013004 - RNA, 22 nt, Homo sapiens
uccugcucacccgccucuugcc

SEQ ID NO: 2013005 - RNA, 17 nt, Homo sapiens
ucuuccauuugcaaggg

SEQ ID NO: 2013006 - RNA, 21 nt, Homo sapiens
agcuguguaccaaucgucuca

SEQ ID NO: 2013007 - RNA, 18 nt, Homo sapiens
auauaauucuuaugccau

SEQ ID NO: 2013008 - RNA, 22 nt, Homo sapiens
ggucugcuggcuucuacacugg

SEQ ID NO: 2013009 - RNA, 21 nt, Homo sapiens
cacagauuaaacuucaccuac

SEQ ID NO: 2013010 - RNA, 22 nt, Homo sapiens
uggcaaaaucuuguuaauguca

SEQ ID NO: 2013011 - RNA, 16 nt, Homo sapiens
acuauuacgugcuauu

SEQ ID NO: 2013012 - RNA, 22 nt, Homo sapiens
cucugagaacagacguuaccaa

SEQ ID NO: 2013013 - RNA, 17 nt, Homo sapiens
ucaggauuaacuaaaga

SEQ ID NO: 2013014 - RNA, 13 nt, Homo sapiens
gcucugucuuucc

SEQ ID NO: 2013015 - RNA, 14 nt, Homo sapiens
aggcccaguucucg

SEQ ID NO: 2013016 - RNA, 11 nt, Homo sapiens
gauaguguucu

SEQ ID NO: 2013017 - RNA, 15 nt, Homo sapiens
uaccaaauauuugaa

SEQ ID NO: 2013018 - RNA, 17 nt, Homo sapiens
uguccccagucagagau

SEQ ID NO: 2013019 - RNA, 14 nt, Homo sapiens
cacaaaauucuuau

SEQ ID NO: 2013020 - RNA, 14 nt, Homo sapiens
uacaguuuaacaga

SEQ ID NO: 2013021 - RNA, 16 nt, Homo sapiens
uaaaauagacuaaccu

SEQ ID NO: 2013022 - RNA, 12 nt, Homo sapiens
accacagacugu

SEQ ID NO: 2013023 - RNA, 22 nt, Homo sapiens
ucauguuguugaggcugucaca

SEQ ID NO: 2013024 - RNA, 13 nt, Homo sapiens
cuggcugcaguga

SEQ ID NO: 2013025 - RNA, 13 nt, Homo sapiens
accauuuaugugu

SEQ ID NO: 2013026 - RNA, 22 nt, Homo sapiens
aucuuauuacugagagugcaaa

SEQ ID NO: 2013027 - RNA, 20 nt, Homo sapiens
guguccuggggacuuccuca

SEQ ID NO: 2013028 - RNA, 19 nt, Homo sapiens
uauauuuuugguugucaau

SEQ ID NO: 2013029 - RNA, 16 nt, Homo sapiens
ccuccuuugcuggcau

SEQ ID NO: 2013030 - RNA, 23 nt, Homo sapiens
uagucccaaagaggcuacuguaa

SEQ ID NO: 2013031 - RNA, 19 nt, Homo sapiens
agaaaagcccugagaucag

SEQ ID NO: 2013032 - RNA, 15 nt, Homo sapiens
uguaagaggugcucu

SEQ ID NO: 2013033 - RNA, 17 nt, Homo sapiens
agacucaaugugcucug

SEQ ID NO: 2013034 - RNA, 21 nt, Homo sapiens
auguaauuuguacaggggcca

SEQ ID NO: 2013035 - RNA, 22 nt, Homo sapiens
acuguacaaaaaaaucuuccaa

SEQ ID NO: 2013036 - RNA, 16 nt, Homo sapiens
ugcgguggcucaugcc

SEQ ID NO: 2013037 - RNA, 20 nt, Homo sapiens
aaugcuccauucaggccuau

SEQ ID NO: 2013038 - RNA, 16 nt, Homo sapiens
uccuaaaacaccugga

SEQ ID NO: 2013039 - RNA, 23 nt, Homo sapiens
cuaaugugccccauguccaaguc

SEQ ID NO: 2013040 - RNA, 22 nt, Homo sapiens
ccccaggucuuccugcuuucca

SEQ ID NO: 2013041 - RNA, 17 nt, Homo sapiens
aauaaugcuuugagaag

SEQ ID NO: 2013042 - RNA, 17 nt, Homo sapiens
agauucaagacaagagc

SEQ ID NO: 2013043 - RNA, 23 nt, Homo sapiens
ugauaguauuuucuacuagccau

SEQ ID NO: 2013044 - RNA, 17 nt, Homo sapiens
cuucccaauugccacau

SEQ ID NO: 2013045 - RNA, 21 nt, Homo sapiens
cauucaccugcccugugcaug

SEQ ID NO: 2013046 - RNA, 20 nt, Homo sapiens
cauuuaaauuccacagauua

SEQ ID NO: 2013047 - RNA, 17 nt, Homo sapiens
uucuccagacaggguuc

SEQ ID NO: 2013048 - RNA, 20 nt, Homo sapiens
uuaagugccauuacuacugu

SEQ ID NO: 2013049 - RNA, 17 nt, Homo sapiens
gaacaugauaguuaaac

SEQ ID NO: 2013050 - RNA, 16 nt, Homo sapiens
acuauucuauggccau

SEQ ID NO: 2013051 - RNA, 15 nt, Homo sapiens
caugauuucuucuua

SEQ ID NO: 2013052 - RNA, 23 nt, Homo sapiens
ggacccacaaaagaaggcucaca

SEQ ID NO: 2013053 - RNA, 18 nt, Homo sapiens
uccuuuccuuuuuugaga

SEQ ID NO: 2013054 - RNA, 18 nt, Homo sapiens
caaagagacccagucaau

SEQ ID NO: 2013055 - RNA, 20 nt, Homo sapiens
ucaugcaagugcuaugccaa

SEQ ID NO: 2013056 - RNA, 15 nt, Homo sapiens
uguucacacuguaaa

SEQ ID NO: 2013057 - RNA, 18 nt, Homo sapiens
cagaauggggaauggaga

SEQ ID NO: 2013058 - RNA, 13 nt, Homo sapiens
gucaggccaucaa

SEQ ID NO: 2013059 - RNA, 20 nt, Homo sapiens
auuaaacugggaaaugagau

SEQ ID NO: 2013060 - RNA, 14 nt, Homo sapiens
aaaguuugcucaag

SEQ ID NO: 2013061 - RNA, 19 nt, Homo sapiens
auaugaccauuugacuguu

SEQ ID NO: 2013062 - RNA, 18 nt, Homo sapiens
ggcuucacagccacaccu

SEQ ID NO: 2013063 - RNA, 17 nt, Homo sapiens
acuuacugccuuagucc

SEQ ID NO: 2013064 - RNA, 18 nt, Homo sapiens
cucacuggaggagcagcu

SEQ ID NO: 2013065 - RNA, 15 nt, Homo sapiens
cacuccauguuugca

SEQ ID NO: 2013066 - RNA, 13 nt, Homo sapiens
gugcggugcaaag

SEQ ID NO: 2013067 - RNA, 14 nt, Homo sapiens
ugaguaucacuuua

SEQ ID NO: 2013068 - RNA, 23 nt, Homo sapiens
cugagugcuagaguaggugcaga

SEQ ID NO: 2013069 - RNA, 21 nt, Homo sapiens
gaaauuuuaaugaagugcaau

SEQ ID NO: 2013070 - RNA, 18 nt, Homo sapiens
gcccugcaccaugcugcu

SEQ ID NO: 2013071 - RNA, 22 nt, Homo sapiens
uuaaaagguuaaauauugucau

SEQ ID NO: 2013072 - RNA, 22 nt, Homo sapiens
cccagaaccucuaagugcugcu

SEQ ID NO: 2013073 - RNA, 16 nt, Homo sapiens
uaucaaauacauuuaa

SEQ ID NO: 2013074 - RNA, 19 nt, Homo sapiens
aaaggcugcagcauugcca

SEQ ID NO: 2013075 - RNA, 17 nt, Homo sapiens
ucuuuaccuucauuuca

SEQ ID NO: 2013076 - RNA, 18 nt, Homo sapiens
aguuuccucaucugcaga

SEQ ID NO: 2013077 - RNA, 14 nt, Homo sapiens
gagaagcaaugggu

SEQ ID NO: 2013078 - RNA, 17 nt, Homo sapiens
auuauacagaccuaaua

SEQ ID NO: 2013079 - RNA, 23 nt, Homo sapiens
cuuccuguccccaaaaugugaug

SEQ ID NO: 2013080 - RNA, 23 nt, Homo sapiens
caauacaggcaugaaccacugca

SEQ ID NO: 2013081 - RNA, 12 nt, Homo sapiens
ugaaaccaaaac

SEQ ID NO: 2013082 - RNA, 12 nt, Homo sapiens
aaacaccaugaa

SEQ ID NO: 2013083 - RNA, 22 nt, Homo sapiens
cucauggggaagcuuccaugau

SEQ ID NO: 2013084 - RNA, 23 nt, Homo sapiens
cagucugcucugcugcucugacc

SEQ ID NO: 2013085 - RNA, 20 nt, Homo sapiens
uaaauaaaggagaaaagugg

SEQ ID NO: 2013086 - RNA, 15 nt, Homo sapiens
aucaagugucuucca

SEQ ID NO: 2013087 - RNA, 17 nt, Homo sapiens
ugcauucuuuugcacac

SEQ ID NO: 2013088 - RNA, 19 nt, Homo sapiens
guagccugggcucacugug

SEQ ID NO: 2013089 - RNA, 14 nt, Homo sapiens
ccuaauggaccucc

SEQ ID NO: 2013090 - RNA, 20 nt, Homo sapiens
aggacaacaagauacaaaua

SEQ ID NO: 2013091 - RNA, 12 nt, Homo sapiens
ucccacugccaa

SEQ ID NO: 2013092 - RNA, 13 nt, Homo sapiens
cauucccuuucau

SEQ ID NO: 2013093 - RNA, 13 nt, Homo sapiens
cucuucuugugaa

SEQ ID NO: 2013094 - RNA, 21 nt, Homo sapiens
cuuuucccagagaccuucuga

SEQ ID NO: 2013095 - RNA, 22 nt, Homo sapiens
agccaggccugaccucaagcaa

SEQ ID NO: 2013096 - RNA, 17 nt, Homo sapiens
aggacuagaaccuggag

SEQ ID NO: 2013097 - RNA, 17 nt, Homo sapiens
ccagcuaucugccugac

SEQ ID NO: 2013098 - RNA, 18 nt, Homo sapiens
caaaagaggauguucacc

SEQ ID NO: 2013099 - RNA, 15 nt, Homo sapiens
uccucugacuugcca

SEQ ID NO: 2013100 - RNA, 17 nt, Homo sapiens
accuuguuaagacaaaa

SEQ ID NO: 2013101 - RNA, 13 nt, Homo sapiens
aaucuugccuuug

SEQ ID NO: 2013102 - RNA, 20 nt, Homo sapiens
aacauuucacaaauguuuag

SEQ ID NO: 2013103 - RNA, 16 nt, Homo sapiens
aaaccuaucucaggga

SEQ ID NO: 2013104 - RNA, 21 nt, Homo sapiens
acauguaugcuauuacauaca

SEQ ID NO: 2013105 - RNA, 23 nt, Homo sapiens
ccauaaaauuggauuacaguaug

SEQ ID NO: 2013106 - RNA, 12 nt, Homo sapiens
uaucaccaaaaa

SEQ ID NO: 2013107 - RNA, 14 nt, Homo sapiens
gugugugugcauau

SEQ ID NO: 2013108 - RNA, 23 nt, Homo sapiens
uauuacccccuuuccucuugggc

SEQ ID NO: 2013109 - RNA, 22 nt, Homo sapiens
ggaagcuccaguccugcucucu

SEQ ID NO: 2013110 - RNA, 11 nt, Homo sapiens
aagccacugcc

SEQ ID NO: 2013111 - RNA, 15 nt, Homo sapiens
agaagacuggaucaa

SEQ ID NO: 2013112 - RNA, 22 nt, Homo sapiens
gcagccccgaguuguuuccucg

SEQ ID NO: 2013113 - RNA, 23 nt, Homo sapiens
ugagaucgugccguuacucucca

SEQ ID NO: 2013114 - RNA, 21 nt, Homo sapiens
gacucucacgauaugcaaguu

SEQ ID NO: 2013115 - RNA, 21 nt, Homo sapiens
gagcaaugggcuuugcugcuu

SEQ ID NO: 2013116 - RNA, 17 nt, Homo sapiens
agaugucagcuucccag

SEQ ID NO: 2013117 - RNA, 18 nt, Homo sapiens
cagcaacaugauaccugg

SEQ ID NO: 2013118 - RNA, 18 nt, Homo sapiens
cuacccuugagucauauu

SEQ ID NO: 2013119 - RNA, 14 nt, Homo sapiens
caucuacauacaca

SEQ ID NO: 2013120 - RNA, 19 nt, Homo sapiens
uggggcacugggcgucuga

SEQ ID NO: 2013121 - RNA, 17 nt, Homo sapiens
cauguuuucuagccuua

SEQ ID NO: 2013122 - RNA, 21 nt, Homo sapiens
auagccuagauaugaauauau

SEQ ID NO: 2013123 - RNA, 19 nt, Homo sapiens
aggcagaucuuugauggag

SEQ ID NO: 2013124 - RNA, 16 nt, Homo sapiens
aguaguaaugauucuc

SEQ ID NO: 2013125 - RNA, 17 nt, Homo sapiens
gggacaauaaauuuugc

SEQ ID NO: 2013126 - RNA, 18 nt, Homo sapiens
acagacaacaaaccuguu

SEQ ID NO: 2013127 - RNA, 16 nt, Homo sapiens
auuuucaaugugauau

SEQ ID NO: 2013128 - RNA, 19 nt, Homo sapiens
ggcagcugauccaggcaau

SEQ ID NO: 2013129 - RNA, 20 nt, Homo sapiens
ugaucucccuucagcaacuu

SEQ ID NO: 2013130 - RNA, 21 nt, Homo sapiens
ugggaugagagggcccagaag

SEQ ID NO: 2013131 - RNA, 19 nt, Homo sapiens
uggaaauagugauuuccac

SEQ ID NO: 2013132 - RNA, 18 nt, Homo sapiens
uuucuggaggucucugaa

SEQ ID NO: 2013133 - RNA, 21 nt, Homo sapiens
ggacuuaccgccuggaggcag

SEQ ID NO: 2013134 - RNA, 16 nt, Homo sapiens
gcugcagucacauuga

SEQ ID NO: 2013135 - RNA, 21 nt, Homo sapiens
aaagguaauucugaaccagaa

SEQ ID NO: 2013136 - RNA, 20 nt, Homo sapiens
auaugaucaguguuacugcc

SEQ ID NO: 2013137 - RNA, 19 nt, Homo sapiens
ggacuaucaggaguccacu

SEQ ID NO: 2013138 - RNA, 14 nt, Homo sapiens
auaucuacuguggu

SEQ ID NO: 2013139 - RNA, 13 nt, Homo sapiens
gaaaaaugcugcu

SEQ ID NO: 2013140 - RNA, 16 nt, Homo sapiens
gagcccgguacagggc

SEQ ID NO: 2013141 - RNA, 14 nt, Homo sapiens
acuccuaaaucaag

SEQ ID NO: 2013142 - RNA, 14 nt, Homo sapiens
auacguacauacac

SEQ ID NO: 2013143 - RNA, 14 nt, Homo sapiens
auguauacaugugc

SEQ ID NO: 2013144 - RNA, 14 nt, Homo sapiens
caagauaccaaggc

SEQ ID NO: 2013145 - RNA, 19 nt, Homo sapiens
caucaccugaaacacugga

SEQ ID NO: 2013146 - RNA, 20 nt, Homo sapiens
cucagcugccaagcacucga

SEQ ID NO: 2013147 - RNA, 23 nt, Homo sapiens
ugcaucuaaugaaaaacaaaaag

SEQ ID NO: 2013148 - RNA, 21 nt, Homo sapiens
agugaccaaaggugugcccug

SEQ ID NO: 2013149 - RNA, 23 nt, Homo sapiens
cagaagacuucuauggaccacaa

SEQ ID NO: 2013150 - RNA, 20 nt, Homo sapiens
gcaggcacuucacacaguaa

SEQ ID NO: 2013151 - RNA, 14 nt, Homo sapiens
cagcuuuugccuuu

SEQ ID NO: 2013152 - RNA, 14 nt, Homo sapiens
agaaaccaugacaa

SEQ ID NO: 2013153 - RNA, 20 nt, Homo sapiens
agcacauaguguuuaaagac

SEQ ID NO: 2013154 - RNA, 13 nt, Homo sapiens
cauauggaaaucc

SEQ ID NO: 2013155 - RNA, 15 nt, Homo sapiens
guaucuucacacucu

SEQ ID NO: 2013156 - RNA, 16 nt, Homo sapiens
caagauggagaugucu

SEQ ID NO: 2013157 - RNA, 17 nt, Homo sapiens
uguuuuggacuacauau

SEQ ID NO: 2013158 - RNA, 12 nt, Homo sapiens
ggcuacugccac

SEQ ID NO: 2013159 - RNA, 16 nt, Homo sapiens
caaauggggacaggaa

SEQ ID NO: 2013160 - RNA, 14 nt, Homo sapiens
gcuucugcacacaa

SEQ ID NO: 2013161 - RNA, 16 nt, Homo sapiens
aauaguaaacuaaagu

SEQ ID NO: 2013162 - RNA, 15 nt, Homo sapiens
uccuuauuaauacaa

SEQ ID NO: 2013163 - RNA, 18 nt, Homo sapiens
ucaagacuauguucucca

SEQ ID NO: 2013164 - RNA, 13 nt, Homo sapiens
uugaaggugcugu

SEQ ID NO: 2013165 - RNA, 19 nt, Homo sapiens
gagccuccaauugcagugg

SEQ ID NO: 2013166 - RNA, 16 nt, Homo sapiens
ucaaaacccugucucc

SEQ ID NO: 2013167 - RNA, 14 nt, Homo sapiens
aaaacaaugcagua

SEQ ID NO: 2013168 - RNA, 18 nt, Homo sapiens
aggcuguuaaccuaugau

SEQ ID NO: 2013169 - RNA, 15 nt, Homo sapiens
uauaugacauuguua

SEQ ID NO: 2013170 - RNA, 15 nt, Homo sapiens
ggagaaaagccagau

SEQ ID NO: 2013171 - RNA, 22 nt, Homo sapiens
gacaccaagaaaccacugggca

SEQ ID NO: 2013172 - RNA, 20 nt, Homo sapiens
uucaaauucuucugaacuca

SEQ ID NO: 2013173 - RNA, 17 nt, Homo sapiens
uaaguauaaguauucaa

SEQ ID NO: 2013174 - RNA, 16 nt, Homo sapiens
uugucagccaccuccc

SEQ ID NO: 2013175 - RNA, 22 nt, Homo sapiens
cuguauauuugaaacugcuaau

SEQ ID NO: 2013176 - RNA, 16 nt, Homo sapiens
ucagagaacuuuccca

SEQ ID NO: 2013177 - RNA, 21 nt, Homo sapiens
acgcugcugcaggacauuaau

SEQ ID NO: 2013178 - RNA, 18 nt, Homo sapiens
ccgacaccacugggaacc

SEQ ID NO: 2013179 - RNA, 23 nt, Homo sapiens
agugaguauaacucuaacugaug

SEQ ID NO: 2013180 - RNA, 22 nt, Homo sapiens
uccgcaagcaucaucccuggau

SEQ ID NO: 2013181 - RNA, 22 nt, Homo sapiens
uaaauaguagaaaaaucagagu

SEQ ID NO: 2013182 - RNA, 14 nt, Homo sapiens
cagcugcuuugaca

SEQ ID NO: 2013183 - RNA, 15 nt, Homo sapiens
aauguauuugcuaua

SEQ ID NO: 2013184 - RNA, 16 nt, Homo sapiens
uugcaaaucuugaaau

SEQ ID NO: 2013185 - RNA, 16 nt, Homo sapiens
uguuuggacagcugau

SEQ ID NO: 2013186 - RNA, 23 nt, Homo sapiens
augugacuccuaugaucucaggu

SEQ ID NO: 2013187 - RNA, 19 nt, Homo sapiens
ggaggcgcggccucccgag

SEQ ID NO: 2013188 - RNA, 16 nt, Homo sapiens
uugugcuuucaccaga

SEQ ID NO: 2013189 - RNA, 18 nt, Homo sapiens
aaggccagcccacacagc

SEQ ID NO: 2013190 - RNA, 16 nt, Homo sapiens
gcaaggggacauucca

SEQ ID NO: 2013191 - RNA, 23 nt, Homo sapiens
ucugaugaugucggucuugcaaa

SEQ ID NO: 2013192 - RNA, 12 nt, Homo sapiens
cugaacauacac

SEQ ID NO: 2013193 - RNA, 17 nt, Homo sapiens
agaauaagaauuugcau

SEQ ID NO: 2013194 - RNA, 19 nt, Homo sapiens
cuuuccucucuuuguucuc

SEQ ID NO: 2013195 - RNA, 20 nt, Homo sapiens
aaagauaugugggugcuccu

SEQ ID NO: 2013196 - RNA, 18 nt, Homo sapiens
acuauagccauuugcccc

SEQ ID NO: 2013197 - RNA, 13 nt, Homo sapiens
aaauguauauaca

SEQ ID NO: 2013198 - RNA, 13 nt, Homo sapiens
gcagaugacaaaa

SEQ ID NO: 2013199 - RNA, 16 nt, Homo sapiens
ccagcaguguugcuca

SEQ ID NO: 2013200 - RNA, 16 nt, Homo sapiens
uagucgccccucagag

SEQ ID NO: 2013201 - RNA, 12 nt, Homo sapiens
gaaaccaugacu

SEQ ID NO: 2013202 - RNA, 13 nt, Homo sapiens
cuuuuuucauuuc

SEQ ID NO: 2013203 - RNA, 17 nt, Homo sapiens
cgugacacaaacacaca

SEQ ID NO: 2013204 - RNA, 22 nt, Homo sapiens
aaggauuuuaccaaagcaucaa

SEQ ID NO: 2013205 - RNA, 23 nt, Homo sapiens
ccuguaucuugggggacagggcu

SEQ ID NO: 2013206 - RNA, 21 nt, Homo sapiens
ccucugucauucgcucccaca

SEQ ID NO: 2013207 - RNA, 15 nt, Homo sapiens
caauacuaaauguac

SEQ ID NO: 2013208 - RNA, 22 nt, Homo sapiens
caauuugucuagcaugcugagu

SEQ ID NO: 2013209 - RNA, 13 nt, Homo sapiens
cuacuguugcaca

SEQ ID NO: 2013210 - RNA, 22 nt, Homo sapiens
cccugaggagggcccugaggaa

SEQ ID NO: 2013211 - RNA, 14 nt, Homo sapiens
uuccuuccuuccuc

SEQ ID NO: 2013212 - RNA, 21 nt, Homo sapiens
cgggaccaauggguuugccaa

SEQ ID NO: 2013213 - RNA, 15 nt, Homo sapiens
auacucgaaucagac

SEQ ID NO: 2013214 - RNA, 22 nt, Homo sapiens
gcaaauaaaauaaaugaaaucu

SEQ ID NO: 2013215 - RNA, 17 nt, Homo sapiens
ugugagaggaucaucug

SEQ ID NO: 2013216 - RNA, 19 nt, Homo sapiens
cacaguguuuuuauugcuc

SEQ ID NO: 2013217 - RNA, 13 nt, Homo sapiens
ucacugccguccc

SEQ ID NO: 2013218 - RNA, 19 nt, Homo sapiens
agaucaggagaaacucggg

SEQ ID NO: 2013219 - RNA, 23 nt, Homo sapiens
ucuccccuggggagccugaggag

SEQ ID NO: 2013220 - RNA, 23 nt, Homo sapiens
acggaugauuggauuauucauuu

SEQ ID NO: 2013221 - RNA, 14 nt, Homo sapiens
aagaaaaugauugc

SEQ ID NO: 2013222 - RNA, 13 nt, Homo sapiens
ucucaguggagcc

SEQ ID NO: 2013223 - RNA, 15 nt, Homo sapiens
auuuaauccaaacag

SEQ ID NO: 2013224 - RNA, 15 nt, Homo sapiens
cuaguuugaccucau

SEQ ID NO: 2013225 - RNA, 15 nt, Homo sapiens
gaugcauauagacac

SEQ ID NO: 2013226 - RNA, 17 nt, Homo sapiens
ccagcugggguccuguc

SEQ ID NO: 2013227 - RNA, 22 nt, Homo sapiens
aauucuucuguccugagaagca

SEQ ID NO: 2013228 - RNA, 13 nt, Homo sapiens
aguuugcuuucaa

SEQ ID NO: 2013229 - RNA, 14 nt, Homo sapiens
ucugugccugaaua

SEQ ID NO: 2013230 - RNA, 14 nt, Homo sapiens
aaugcauguccuca

SEQ ID NO: 2013231 - RNA, 22 nt, Homo sapiens
ucuagaggcaucaccugggacc

SEQ ID NO: 2013232 - RNA, 14 nt, Homo sapiens
cagugcaacacuga

SEQ ID NO: 2013233 - RNA, 14 nt, Homo sapiens
gagagcaagacaga

SEQ ID NO: 2013234 - RNA, 22 nt, Homo sapiens
aauauaugucuauauacacaga

SEQ ID NO: 2013235 - RNA, 22 nt, Homo sapiens
gccuuuugggaauaauagcaca

SEQ ID NO: 2013236 - RNA, 15 nt, Homo sapiens
guucauccuauucuu

SEQ ID NO: 2013237 - RNA, 16 nt, Homo sapiens
uaauuauuguuuauau

SEQ ID NO: 2013238 - RNA, 20 nt, Homo sapiens
gcuguuuccauagggugaca

SEQ ID NO: 2013239 - RNA, 19 nt, Homo sapiens
gguccugaguggcugaaau

SEQ ID NO: 2013240 - RNA, 15 nt, Homo sapiens
gaacuuucacauagc

SEQ ID NO: 2013241 - RNA, 14 nt, Homo sapiens
caauuuugcacuga

SEQ ID NO: 2013242 - RNA, 18 nt, Homo sapiens
cuaacuuuccuucauuca

SEQ ID NO: 2013243 - RNA, 16 nt, Homo sapiens
auuucuauagccaaaa

SEQ ID NO: 2013244 - RNA, 18 nt, Homo sapiens
ugcauugguuuuccauga

SEQ ID NO: 2013245 - RNA, 15 nt, Homo sapiens
gcccaguguguuucu

SEQ ID NO: 2013246 - RNA, 19 nt, Homo sapiens
uagucccggaggccuuccc

SEQ ID NO: 2013247 - RNA, 15 nt, Homo sapiens
cuauggcaucuuccc

SEQ ID NO: 2013248 - RNA, 23 nt, Homo sapiens
ucaugcuguugcugcuacugucu

SEQ ID NO: 2013249 - RNA, 14 nt, Homo sapiens
ucguuuaccaaaua

SEQ ID NO: 2013250 - RNA, 19 nt, Homo sapiens
acauaauuuugugcaugaa

SEQ ID NO: 2013251 - RNA, 18 nt, Homo sapiens
cuucaaacuauacuacaa

SEQ ID NO: 2013252 - RNA, 17 nt, Homo sapiens
gcugggcugagccaaag

SEQ ID NO: 2013253 - RNA, 23 nt, Homo sapiens
uagauugccuuuggcaauucuuc

SEQ ID NO: 2013254 - RNA, 20 nt, Homo sapiens
guuugaauaccagcuuucua

SEQ ID NO: 2013255 - RNA, 21 nt, Homo sapiens
gacucuuccagguucacugag

SEQ ID NO: 2013256 - RNA, 13 nt, Homo sapiens
gaaaaaugcuguu

SEQ ID NO: 2013257 - RNA, 13 nt, Homo sapiens
uuagacauaacaa

SEQ ID NO: 2013258 - RNA, 18 nt, Homo sapiens
gacucugggcuauggaca

SEQ ID NO: 2013259 - RNA, 14 nt, Homo sapiens
uugucaucuuuuag

SEQ ID NO: 2013260 - RNA, 15 nt, Homo sapiens
aacaccaugaaucuu

SEQ ID NO: 2013261 - RNA, 12 nt, Homo sapiens
cuccucugcuag

SEQ ID NO: 2013262 - RNA, 22 nt, Homo sapiens
cucugaguaccuuuuaguauua

SEQ ID NO: 2013263 - RNA, 15 nt, Homo sapiens
auuaaaacuucuuaa

SEQ ID NO: 2013264 - RNA, 22 nt, Homo sapiens
auucucuguaaguguagcucaa

SEQ ID NO: 2013265 - RNA, 22 nt, Homo sapiens
cccaaggccuuuccuacaugcc

SEQ ID NO: 2013266 - RNA, 15 nt, Homo sapiens
uuuacugucuaugga

SEQ ID NO: 2013267 - RNA, 16 nt, Homo sapiens
cugugacuagaaccau

SEQ ID NO: 2013268 - RNA, 20 nt, Homo sapiens
gguguuauuuucugagagac

SEQ ID NO: 2013269 - RNA, 18 nt, Homo sapiens
gaaugacugacaaagaca

SEQ ID NO: 2013270 - RNA, 23 nt, Homo sapiens
caggaugacgugcuccguagcuc

SEQ ID NO: 2013271 - RNA, 16 nt, Homo sapiens
ggucugauuucaggau

SEQ ID NO: 2013272 - RNA, 21 nt, Homo sapiens
guuacuuuuucuuguauucau

SEQ ID NO: 2013273 - RNA, 14 nt, Homo sapiens
gaacugaacuuauu

SEQ ID NO: 2013274 - RNA, 14 nt, Homo sapiens
caaaagaaguucau

SEQ ID NO: 2013275 - RNA, 19 nt, Homo sapiens
gguggacuugaacuuuccu

SEQ ID NO: 2013276 - RNA, 14 nt, Homo sapiens
ugccaccuggaccc

SEQ ID NO: 2013277 - RNA, 14 nt, Homo sapiens
ugguuccaaagaca

SEQ ID NO: 2013278 - RNA, 15 nt, Homo sapiens
gcugacuccuggucc

SEQ ID NO: 2013279 - RNA, 16 nt, Homo sapiens
uugauuuagagaugau

SEQ ID NO: 2013280 - RNA, 12 nt, Homo sapiens
uaaacugcaguu

SEQ ID NO: 2013281 - RNA, 13 nt, Homo sapiens
aucuccugaguau

SEQ ID NO: 2013282 - RNA, 19 nt, Homo sapiens
cuuccuguguaacaucugc

SEQ ID NO: 2013283 - RNA, 17 nt, Homo sapiens
cuauaucaaaaaaccuu

SEQ ID NO: 2013284 - RNA, 21 nt, Homo sapiens
cucuccuagcccuccugaggg

SEQ ID NO: 2013285 - RNA, 14 nt, Homo sapiens
ucccaccugcaucu

SEQ ID NO: 2013286 - RNA, 14 nt, Homo sapiens
uccucucugcacac

SEQ ID NO: 2013287 - RNA, 18 nt, Homo sapiens
uccaucgcugucaucuca

SEQ ID NO: 2013288 - RNA, 19 nt, Homo sapiens
aggaggcggcagugcaaca

SEQ ID NO: 2013289 - RNA, 19 nt, Homo sapiens
guaguaaauucauauccau

SEQ ID NO: 2013290 - RNA, 16 nt, Homo sapiens
cuguaacacacuaaca

SEQ ID NO: 2013291 - RNA, 16 nt, Homo sapiens
cacuauaucuguauau

SEQ ID NO: 2013292 - RNA, 17 nt, Homo sapiens
uccuaaacuuucaaguc

SEQ ID NO: 2013293 - RNA, 18 nt, Homo sapiens
acacugaguuugaacaca

SEQ ID NO: 2013294 - RNA, 21 nt, Homo sapiens
aauugagcagagaaccugcuc

SEQ ID NO: 2013295 - RNA, 19 nt, Homo sapiens
caccuggcucucaccucua

SEQ ID NO: 2013296 - RNA, 23 nt, Homo sapiens
gaaggaggcuggcuuguccccuc

SEQ ID NO: 2013297 - RNA, 12 nt, Homo sapiens
guucuugcucca

SEQ ID NO: 2013298 - RNA, 18 nt, Homo sapiens
ucagcuuccuuccuucug

SEQ ID NO: 2013299 - RNA, 21 nt, Homo sapiens
uuccaaguuccugcacuccag

SEQ ID NO: 2013300 - RNA, 19 nt, Homo sapiens
gagaugaccuugacauacc

SEQ ID NO: 2013301 - RNA, 19 nt, Homo sapiens
caaaugaucagccuugcaa

SEQ ID NO: 2013302 - RNA, 21 nt, Homo sapiens
ccauugugauuauuguuacua

SEQ ID NO: 2013303 - RNA, 12 nt, Homo sapiens
uuugucacugaa

SEQ ID NO: 2013304 - RNA, 17 nt, Homo sapiens
aaauuccuugauucaca

SEQ ID NO: 2013305 - RNA, 22 nt, Homo sapiens
ugaaacaaaaugagcucuccua

SEQ ID NO: 2013306 - RNA, 16 nt, Homo sapiens
gcacuguuucuucuca

SEQ ID NO: 2013307 - RNA, 15 nt, Homo sapiens
cuucagaaauguuaa

SEQ ID NO: 2013308 - RNA, 15 nt, Homo sapiens
agcgcuguaaacccu

SEQ ID NO: 2013309 - RNA, 20 nt, Homo sapiens
gugcaugcagcaucuaagua

SEQ ID NO: 2013310 - RNA, 18 nt, Homo sapiens
uuccuacuccguuccugg

SEQ ID NO: 2013311 - RNA, 16 nt, Homo sapiens
uaaugcauauuccccu

SEQ ID NO: 2013312 - RNA, 17 nt, Homo sapiens
aucucuuagaagccaug

SEQ ID NO: 2013313 - RNA, 21 nt, Homo sapiens
ucuuucuagaggugcuacaua

SEQ ID NO: 2013314 - RNA, 19 nt, Homo sapiens
uaauauugugucauagaau

SEQ ID NO: 2013315 - RNA, 19 nt, Homo sapiens
cgccacaucccucucugcu

SEQ ID NO: 2013316 - RNA, 13 nt, Homo sapiens
uugaaccaauaau

SEQ ID NO: 2013317 - RNA, 20 nt, Homo sapiens
cuggccuuuguaagugcagg

SEQ ID NO: 2013318 - RNA, 18 nt, Homo sapiens
cuguuugucugauguggc

SEQ ID NO: 2013319 - RNA, 23 nt, Homo sapiens
cuauggguugucaauaguauuaa

SEQ ID NO: 2013320 - RNA, 16 nt, Homo sapiens
uaaaguugguauuaau

SEQ ID NO: 2013321 - RNA, 16 nt, Homo sapiens
gcacauccaggcaaug

SEQ ID NO: 2013322 - RNA, 16 nt, Homo sapiens
cacagugucaggcacu

SEQ ID NO: 2013323 - RNA, 14 nt, Homo sapiens
caugaaucucucaa

SEQ ID NO: 2013324 - RNA, 18 nt, Homo sapiens
acaagugccccuggccaa

SEQ ID NO: 2013325 - RNA, 18 nt, Homo sapiens
agcaggagguuaucugug

SEQ ID NO: 2013326 - RNA, 17 nt, Homo sapiens
gccgccaguacuuguca

SEQ ID NO: 2013327 - RNA, 19 nt, Homo sapiens
cagaaucccucuacaugga

SEQ ID NO: 2013328 - RNA, 20 nt, Homo sapiens
caagcacaaauuucaucucc

SEQ ID NO: 2013329 - RNA, 16 nt, Homo sapiens
ucagugugaugaauca

SEQ ID NO: 2013330 - RNA, 21 nt, Homo sapiens
cuuccacaaaauuaugcugca

SEQ ID NO: 2013331 - RNA, 20 nt, Homo sapiens
caugaagggagggucccugu

SEQ ID NO: 2013332 - RNA, 13 nt, Homo sapiens
guuuauaaugcaa

SEQ ID NO: 2013333 - RNA, 16 nt, Homo sapiens
aauucuagcauuuuau

SEQ ID NO: 2013334 - RNA, 17 nt, Homo sapiens
ggagcaauuugcacaug

SEQ ID NO: 2013335 - RNA, 16 nt, Homo sapiens
cucuuuuccuccucca

SEQ ID NO: 2013336 - RNA, 21 nt, Homo sapiens
uugacuggccuccagauucca

SEQ ID NO: 2013337 - RNA, 21 nt, Homo sapiens
guuuaacucagaucacuacug

SEQ ID NO: 2013338 - RNA, 17 nt, Homo sapiens
agauucuguaugcggug

SEQ ID NO: 2013339 - RNA, 14 nt, Homo sapiens
uccccucaccuccu

SEQ ID NO: 2013340 - RNA, 18 nt, Homo sapiens
ugauggcaacagaaacca

SEQ ID NO: 2013341 - RNA, 12 nt, Homo sapiens
aaaaugugcaau

SEQ ID NO: 2013342 - RNA, 16 nt, Homo sapiens
cacacagcugcccuag

SEQ ID NO: 2013343 - RNA, 13 nt, Homo sapiens
auaaauuuaucag

SEQ ID NO: 2013344 - RNA, 19 nt, Homo sapiens
accuuggaucagaugaacu

SEQ ID NO: 2013345 - RNA, 13 nt, Homo sapiens
cucagcauaccug

SEQ ID NO: 2013346 - RNA, 15 nt, Homo sapiens
cuaugcaagccuugc

SEQ ID NO: 2013347 - RNA, 21 nt, Homo sapiens
uaaacauccuucaagaacucu

SEQ ID NO: 2013348 - RNA, 15 nt, Homo sapiens
uuguaagacuuacaa

SEQ ID NO: 2013349 - RNA, 12 nt, Homo sapiens
caaggguuuuca

SEQ ID NO: 2013350 - RNA, 20 nt, Homo sapiens
uaauauuguaacuugcaugu

SEQ ID NO: 2013351 - RNA, 18 nt, Homo sapiens
ugggccgucuggccugug

SEQ ID NO: 2013352 - RNA, 19 nt, Homo sapiens
uugaaugugguuacuuccu

SEQ ID NO: 2013353 - RNA, 16 nt, Homo sapiens
cugagaaggacaccuc

SEQ ID NO: 2013354 - RNA, 19 nt, Homo sapiens
uccccagacucagcuggaa

SEQ ID NO: 2013355 - RNA, 14 nt, Homo sapiens
gaagaucaggcaca

SEQ ID NO: 2013356 - RNA, 15 nt, Homo sapiens
cauaagccacuuccc

SEQ ID NO: 2013357 - RNA, 14 nt, Homo sapiens
ccagcagcuggaau

SEQ ID NO: 2013358 - RNA, 23 nt, Homo sapiens
gcgguuuauagguaaugauggaa

SEQ ID NO: 2013359 - RNA, 20 nt, Homo sapiens
cuggcaucaggucugggcaa

SEQ ID NO: 2013360 - RNA, 16 nt, Homo sapiens
ucuugauuaauguacu

SEQ ID NO: 2013361 - RNA, 19 nt, Homo sapiens
cucugcagucucuauacca

SEQ ID NO: 2013362 - RNA, 21 nt, Homo sapiens
aguagaacuuuguauaguuau

SEQ ID NO: 2013363 - RNA, 23 nt, Homo sapiens
uggaggguugaccccuggucuca

SEQ ID NO: 2013364 - RNA, 21 nt, Homo sapiens
uauacaagauaagcuuccagg

SEQ ID NO: 2013365 - RNA, 21 nt, Homo sapiens
ucuaauuaaauggcaucagca

SEQ ID NO: 2013366 - RNA, 16 nt, Homo sapiens
gagggaaaacagaaaa

SEQ ID NO: 2013367 - RNA, 17 nt, Homo sapiens
uccaggcuugggcucca

SEQ ID NO: 2013368 - RNA, 15 nt, Homo sapiens
acauguccuauuacu

SEQ ID NO: 2013369 - RNA, 13 nt, Homo sapiens
aacuguuuucuca

SEQ ID NO: 2013370 - RNA, 15 nt, Homo sapiens
ucaguacacuuggug

SEQ ID NO: 2013371 - RNA, 17 nt, Homo sapiens
ucuugucauugccagcu

SEQ ID NO: 2013372 - RNA, 14 nt, Homo sapiens
uagcaccccuacuc

SEQ ID NO: 2013373 - RNA, 13 nt, Homo sapiens
cuuugucugaaaa

SEQ ID NO: 2013374 - RNA, 17 nt, Homo sapiens
ggccuggcccucacuca

SEQ ID NO: 2013375 - RNA, 11 nt, Homo sapiens
uugggauuugc

SEQ ID NO: 2013376 - RNA, 15 nt, Homo sapiens
accucccugugagag

SEQ ID NO: 2013377 - RNA, 18 nt, Homo sapiens
gggccccucaucugcuca

SEQ ID NO: 2013378 - RNA, 17 nt, Homo sapiens
uguuaguauaagcuuuu

SEQ ID NO: 2013379 - RNA, 19 nt, Homo sapiens
auacaaccucccucuuguu

SEQ ID NO: 2013380 - RNA, 13 nt, Homo sapiens
auguuuucuaauu

SEQ ID NO: 2013381 - RNA, 23 nt, Homo sapiens
cccuuguggaaccaaauguaucc

SEQ ID NO: 2013382 - RNA, 16 nt, Homo sapiens
cugccugcggcccaga

SEQ ID NO: 2013383 - RNA, 24 nt, Homo sapiens
aguccaggcugcuagaggugcuca

SEQ ID NO: 2013384 - RNA, 17 nt, Homo sapiens
ggaggccaccucuccaa

SEQ ID NO: 2013385 - RNA, 15 nt, Homo sapiens
ugggccguaucuccg

SEQ ID NO: 2013386 - RNA, 20 nt, Homo sapiens
ggaccaugugucacuugugc

SEQ ID NO: 2013387 - RNA, 15 nt, Homo sapiens
uuuugugaugcauuu

SEQ ID NO: 2013388 - RNA, 14 nt, Homo sapiens
augagaaucaugca

SEQ ID NO: 2013389 - RNA, 19 nt, Homo sapiens
agcguuccuagagaagaca

SEQ ID NO: 2013390 - RNA, 12 nt, Homo sapiens
uuugaauuuugu

SEQ ID NO: 2013391 - RNA, 19 nt, Homo sapiens
uccccagcccuuuuguuga

SEQ ID NO: 2013392 - RNA, 22 nt, Homo sapiens
acucaccagccucugcucuuau

SEQ ID NO: 2013393 - RNA, 18 nt, Homo sapiens
uugggaggauacagagga

SEQ ID NO: 2013394 - RNA, 16 nt, Homo sapiens
cauagagaauacacau

SEQ ID NO: 2013395 - RNA, 14 nt, Homo sapiens
ccagccacugcagc

SEQ ID NO: 2013396 - RNA, 16 nt, Homo sapiens
auguauuucaucucaa

SEQ ID NO: 2013397 - RNA, 19 nt, Homo sapiens
gggacaucgccaaggacug

SEQ ID NO: 2013398 - RNA, 18 nt, Homo sapiens
aagaaaguaaacuguaau

SEQ ID NO: 2013399 - RNA, 19 nt, Homo sapiens
cuaaguuaugacugugaaa

SEQ ID NO: 2013400 - RNA, 13 nt, Homo sapiens
agcuguuagggcu

SEQ ID NO: 2013401 - RNA, 13 nt, Homo sapiens
acaguuccuucag

SEQ ID NO: 2013402 - RNA, 20 nt, Homo sapiens
agaaacccccucauggaucu

SEQ ID NO: 2013403 - RNA, 15 nt, Homo sapiens
ucuacucuuacuucc

SEQ ID NO: 2013404 - RNA, 18 nt, Homo sapiens
agcugagggacguggugc

SEQ ID NO: 2013405 - RNA, 19 nt, Homo sapiens
ucaaaaguaaugcuucaau

SEQ ID NO: 2013406 - RNA, 13 nt, Homo sapiens
cacugacugggac

SEQ ID NO: 2013407 - RNA, 19 nt, Homo sapiens
cacaggaaccacaagacug

SEQ ID NO: 2013408 - RNA, 16 nt, Homo sapiens
uccugccccacacucc

SEQ ID NO: 2013409 - RNA, 16 nt, Homo sapiens
gcucacgugucuuuag

SEQ ID NO: 2013410 - RNA, 14 nt, Homo sapiens
gccaggcuugccug

SEQ ID NO: 2013411 - RNA, 19 nt, Homo sapiens
agggauuuucagcccucag

SEQ ID NO: 2013412 - RNA, 14 nt, Homo sapiens
cacagagucaggau

SEQ ID NO: 2013413 - RNA, 18 nt, Homo sapiens
auuuuauacccaaaaccc

SEQ ID NO: 2013414 - RNA, 14 nt, Homo sapiens
caaacccaaaaaag

SEQ ID NO: 2013415 - RNA, 16 nt, Homo sapiens
aaucucccacuccagc

SEQ ID NO: 2013416 - RNA, 24 nt, Homo sapiens
guaaucccccaggagaacaucuuu

SEQ ID NO: 2013417 - RNA, 15 nt, Homo sapiens
cugagcagccacuac

SEQ ID NO: 2013418 - RNA, 16 nt, Homo sapiens
ucauagaaacugcuuu

SEQ ID NO: 2013419 - RNA, 20 nt, Homo sapiens
aguauugcgaaugugcagaa

SEQ ID NO: 2013420 - RNA, 17 nt, Homo sapiens
cugcucuuguucuacug

SEQ ID NO: 2013421 - RNA, 18 nt, Homo sapiens
gcuggcaaccacuaagaa

SEQ ID NO: 2013422 - RNA, 23 nt, Homo sapiens
aguaaguacuuaauaaacugugg

SEQ ID NO: 2013423 - RNA, 11 nt, Homo sapiens
caagacauuuc

SEQ ID NO: 2013424 - RNA, 16 nt, Homo sapiens
uaacuguggacaaaag

SEQ ID NO: 2013425 - RNA, 18 nt, Homo sapiens
ugacguggagcugcucaa

SEQ ID NO: 2013426 - RNA, 18 nt, Homo sapiens
cuugaucaauucccuuga

SEQ ID NO: 2013427 - RNA, 12 nt, Homo sapiens
aguuuguauuaa

SEQ ID NO: 2013428 - RNA, 17 nt, Homo sapiens
ucagugccuucucucag

SEQ ID NO: 2013429 - RNA, 21 nt, Homo sapiens
cagauguccgucucucuugcu

SEQ ID NO: 2013430 - RNA, 23 nt, Homo sapiens
acucagcugcucugcaagcagaa

SEQ ID NO: 2013431 - RNA, 13 nt, Homo sapiens
auguuuuauauca

SEQ ID NO: 2013432 - RNA, 13 nt, Homo sapiens
acacaucaaauau

SEQ ID NO: 2013433 - RNA, 10 nt, Homo sapiens
gaagugcaau

SEQ ID NO: 2013434 - RNA, 12 nt, Homo sapiens
cagcccuggauu

SEQ ID NO: 2013435 - RNA, 23 nt, Homo sapiens
caaggcuuggcacacugccagug

SEQ ID NO: 2013436 - RNA, 12 nt, Homo sapiens
acucacugugau

SEQ ID NO: 2013437 - RNA, 14 nt, Homo sapiens
cuggaguccagugc

SEQ ID NO: 2013438 - RNA, 17 nt, Homo sapiens
cuauaaaaacaaaaacu

SEQ ID NO: 2013439 - RNA, 19 nt, Homo sapiens
caaucaaaugguguuuucu

SEQ ID NO: 2013440 - RNA, 15 nt, Homo sapiens
cuacagaggugaaau

SEQ ID NO: 2013441 - RNA, 13 nt, Homo sapiens
ccugcuaaggagu

SEQ ID NO: 2013442 - RNA, 16 nt, Homo sapiens
augaguuuuacauuac

SEQ ID NO: 2013443 - RNA, 14 nt, Homo sapiens
cacggaugcacaga

SEQ ID NO: 2013444 - RNA, 22 nt, Homo sapiens
uuuuuauuugaaaauuugcuga

SEQ ID NO: 2013445 - RNA, 18 nt, Homo sapiens
ugucagggaguguucccu

SEQ ID NO: 2013446 - RNA, 12 nt, Homo sapiens
uuagcucugauc

SEQ ID NO: 2013447 - RNA, 12 nt, Homo sapiens
acucacagaguc

SEQ ID NO: 2013448 - RNA, 15 nt, Homo sapiens
guugauacuugaaua

SEQ ID NO: 2013449 - RNA, 15 nt, Homo sapiens
auaguuuacugagaa

SEQ ID NO: 2013450 - RNA, 23 nt, Homo sapiens
ugaauaaaugauuaaaaaaucag

SEQ ID NO: 2013451 - RNA, 19 nt, Homo sapiens
caucuguaaaauagucuca

SEQ ID NO: 2013452 - RNA, 21 nt, Homo sapiens
cugcauuucuaacaagcuccc

SEQ ID NO: 2013453 - RNA, 16 nt, Homo sapiens
cuacugauuguuucau

SEQ ID NO: 2013454 - RNA, 16 nt, Homo sapiens
gcagcuggaggcugcu

SEQ ID NO: 2013455 - RNA, 14 nt, Homo sapiens
ccagcaaagguugg

SEQ ID NO: 2013456 - RNA, 23 nt, Homo sapiens
acuuuugggcguaagaccaaaug

SEQ ID NO: 2013457 - RNA, 16 nt, Homo sapiens
aguagugcaccaucuc

SEQ ID NO: 2013458 - RNA, 16 nt, Homo sapiens
uuacaagacuguaaau

SEQ ID NO: 2013459 - RNA, 19 nt, Homo sapiens
auaaucuuguagacacuua

SEQ ID NO: 2013460 - RNA, 16 nt, Homo sapiens
gcugcucacauucuga

SEQ ID NO: 2013461 - RNA, 13 nt, Homo sapiens
aaagaaauuucca

SEQ ID NO: 2013462 - RNA, 21 nt, Homo sapiens
aaggugcgagggccacagccc

SEQ ID NO: 2013463 - RNA, 15 nt, Homo sapiens
cugcuacuuccccag

SEQ ID NO: 2013464 - RNA, 17 nt, Homo sapiens
aguggccuguaagucca

SEQ ID NO: 2013465 - RNA, 19 nt, Homo sapiens
cuuagauguuccaguaauc

SEQ ID NO: 2013466 - RNA, 16 nt, Homo sapiens
uaaaugucacugccaa

SEQ ID NO: 2013467 - RNA, 18 nt, Homo sapiens
gcccacauuaagcacugu

SEQ ID NO: 2013468 - RNA, 20 nt, Homo sapiens
aacccuucagauuugccuua

SEQ ID NO: 2013469 - RNA, 13 nt, Homo sapiens
ggaauaaauaugc

SEQ ID NO: 2013470 - RNA, 22 nt, Homo sapiens
gaaucaaagacauuucauccac

SEQ ID NO: 2013471 - RNA, 13 nt, Homo sapiens
uuguugacuguga

SEQ ID NO: 2013472 - RNA, 21 nt, Homo sapiens
cagaguuccugcggagugaag

SEQ ID NO: 2013473 - RNA, 16 nt, Homo sapiens
cugccagcucucugau

SEQ ID NO: 2013474 - RNA, 21 nt, Homo sapiens
ugaccaaacuguggguauugu

SEQ ID NO: 2013475 - RNA, 20 nt, Homo sapiens
accaggacucccuccucacc

SEQ ID NO: 2013476 - RNA, 16 nt, Homo sapiens
gguugucaccaagcua

SEQ ID NO: 2013477 - RNA, 21 nt, Homo sapiens
aaugacuuacuguacaugaaa

SEQ ID NO: 2013478 - RNA, 15 nt, Homo sapiens
guugcaguaagccaa

SEQ ID NO: 2013479 - RNA, 17 nt, Homo sapiens
uuccugaauacugaaac

SEQ ID NO: 2013480 - RNA, 16 nt, Homo sapiens
aaaauaaggaacauga

SEQ ID NO: 2013481 - RNA, 21 nt, Homo sapiens
uggaaucuucuccaguaugaa

SEQ ID NO: 2013482 - RNA, 20 nt, Homo sapiens
auuuccuucucauaaccuca

SEQ ID NO: 2013483 - RNA, 14 nt, Homo sapiens
gaucaaaauuacuu

SEQ ID NO: 2013484 - RNA, 20 nt, Homo sapiens
acucuaucauuggccuccaa

SEQ ID NO: 2013485 - RNA, 18 nt, Homo sapiens
gaaucuauaguucacuga

SEQ ID NO: 2013486 - RNA, 14 nt, Homo sapiens
aaacugcucuggaa

SEQ ID NO: 2013487 - RNA, 15 nt, Homo sapiens
ugaauaccuauaauu

SEQ ID NO: 2013488 - RNA, 13 nt, Homo sapiens
uccuauuccaugc

SEQ ID NO: 2013489 - RNA, 19 nt, Homo sapiens
augccacagaauuugcuaa

SEQ ID NO: 2013490 - RNA, 20 nt, Homo sapiens
gaacauuguucugaacacuu

SEQ ID NO: 2013491 - RNA, 22 nt, Homo sapiens
aacuaacucacucaauuuuccc

SEQ ID NO: 2013492 - RNA, 19 nt, Homo sapiens
cugcaaacauguugccucg

SEQ ID NO: 2013493 - RNA, 14 nt, Homo sapiens
acacuaauuuccaa

SEQ ID NO: 2013494 - RNA, 14 nt, Homo sapiens
uauagagauaugca

SEQ ID NO: 2013495 - RNA, 23 nt, Homo sapiens
ccuggccuuaaaaggggcccaag

SEQ ID NO: 2013496 - RNA, 17 nt, Homo sapiens
uaagcaaaggaaaccaa

SEQ ID NO: 2013497 - RNA, 13 nt, Homo sapiens
aaaauagcaacac

SEQ ID NO: 2013498 - RNA, 13 nt, Homo sapiens
accuagcauuuca

SEQ ID NO: 2013499 - RNA, 16 nt, Homo sapiens
ccgcaaguucagggaa

SEQ ID NO: 2013500 - RNA, 20 nt, Homo sapiens
ucgcuggguccucugcagug

SEQ ID NO: 2013501 - RNA, 18 nt, Homo sapiens
uuucuaacuccagugaag

SEQ ID NO: 2013502 - RNA, 21 nt, Homo sapiens
uauagaaauagaacacugccu

SEQ ID NO: 2013503 - RNA, 16 nt, Homo sapiens
gcuccugucaccauga

SEQ ID NO: 2013504 - RNA, 15 nt, Homo sapiens
auuucagauauucca

SEQ ID NO: 2013505 - RNA, 12 nt, Homo sapiens
acccaauuucca

SEQ ID NO: 2013506 - RNA, 13 nt, Homo sapiens
caggccuuaggga

SEQ ID NO: 2013507 - RNA, 19 nt, Homo sapiens
agccagucugcgucaggca

SEQ ID NO: 2013508 - RNA, 19 nt, Homo sapiens
cgugguaugaaaugucuga

SEQ ID NO: 2013509 - RNA, 21 nt, Homo sapiens
ggggccccagcgucugcaggg

SEQ ID NO: 2013510 - RNA, 17 nt, Homo sapiens
aauacuugccugugaca

SEQ ID NO: 2013511 - RNA, 23 nt, Homo sapiens
gaaagagagagugugugggucua

SEQ ID NO: 2013512 - RNA, 20 nt, Homo sapiens
agggugagacacugcacaga

SEQ ID NO: 2013513 - RNA, 16 nt, Homo sapiens
cuaauuaaaaugugca

SEQ ID NO: 2013514 - RNA, 20 nt, Homo sapiens
uauuuguuuaaaaagcgcua

SEQ ID NO: 2013515 - RNA, 18 nt, Homo sapiens
aggggccucucuauucau

SEQ ID NO: 2013516 - RNA, 13 nt, Homo sapiens
accagcaggacac

SEQ ID NO: 2013517 - RNA, 23 nt, Homo sapiens
augauuucauguacugcauuauu

SEQ ID NO: 2013518 - RNA, 22 nt, Homo sapiens
acagagagagauuccaucucaa

SEQ ID NO: 2013519 - RNA, 17 nt, Homo sapiens
gagggugaggagcugga

SEQ ID NO: 2013520 - RNA, 17 nt, Homo sapiens
uacucuugucauuuuua

SEQ ID NO: 2013521 - RNA, 13 nt, Homo sapiens
agguucuugccuu

SEQ ID NO: 2013522 - RNA, 13 nt, Homo sapiens
agguccuugccuc

SEQ ID NO: 2013523 - RNA, 19 nt, Homo sapiens
aguaaaguauuuuugauua

SEQ ID NO: 2013524 - RNA, 19 nt, Homo sapiens
ggagagagccuuggccuga

SEQ ID NO: 2013525 - RNA, 20 nt, Homo sapiens
caaguuggcuucuaaucaaa

SEQ ID NO: 2013526 - RNA, 17 nt, Homo sapiens
agcauguuuuguauaca

SEQ ID NO: 2013527 - RNA, 13 nt, Homo sapiens
ucaccuuacaggg

SEQ ID NO: 2013528 - RNA, 21 nt, Homo sapiens
uuacugaaaacaaaauaucug

SEQ ID NO: 2013529 - RNA, 22 nt, Homo sapiens
uccugggugcugucaugcccag

SEQ ID NO: 2013530 - RNA, 22 nt, Homo sapiens
gccucggaucagccuugagaga

SEQ ID NO: 2013531 - RNA, 14 nt, Homo sapiens
cuaaaauacuugag

SEQ ID NO: 2013532 - RNA, 16 nt, Homo sapiens
cacagagggacuugag

SEQ ID NO: 2013533 - RNA, 19 nt, Homo sapiens
uagagacaggguuucacca

SEQ ID NO: 2013534 - RNA, 18 nt, Homo sapiens
ucccuccucauucucucc

SEQ ID NO: 2013535 - RNA, 23 nt, Homo sapiens
augcagaaggagucugaugcuca

SEQ ID NO: 2013536 - RNA, 13 nt, Homo sapiens
aagucacuuuuau

SEQ ID NO: 2013537 - RNA, 16 nt, Homo sapiens
ucuucauaauuucuuc

SEQ ID NO: 2013538 - RNA, 21 nt, Homo sapiens
ugugccauguuauucagcuca

SEQ ID NO: 2013539 - RNA, 22 nt, Homo sapiens
acacccauagugcacacuugua

SEQ ID NO: 2013540 - RNA, 14 nt, Homo sapiens
augcuaaaugucaa

SEQ ID NO: 2013541 - RNA, 13 nt, Homo sapiens
acuucaaauugca

SEQ ID NO: 2013542 - RNA, 18 nt, Homo sapiens
uuuguuuuuuaagggagg

SEQ ID NO: 2013543 - RNA, 11 nt, Homo sapiens
ccccacugacc

SEQ ID NO: 2013544 - RNA, 11 nt, Homo sapiens
augcacugcug

SEQ ID NO: 2013545 - RNA, 11 nt, Homo sapiens
aaccacugcac

SEQ ID NO: 2013546 - RNA, 23 nt, Homo sapiens
aagaaauguaagggaaacugcca

SEQ ID NO: 2013547 - RNA, 20 nt, Homo sapiens
ucaauguauuaauaucucca

SEQ ID NO: 2013548 - RNA, 21 nt, Homo sapiens
agccaggugagaaaaccaugg

SEQ ID NO: 2013549 - RNA, 17 nt, Homo sapiens
gcugccaggacaccugc

SEQ ID NO: 2013550 - RNA, 21 nt, Homo sapiens
auguucuauuucagugccaau

SEQ ID NO: 2013551 - RNA, 14 nt, Homo sapiens
auugcagaacauga

SEQ ID NO: 2013552 - RNA, 15 nt, Homo sapiens
cuccacaccucuaaa

SEQ ID NO: 2013553 - RNA, 15 nt, Homo sapiens
uaauuaacuaacuca

SEQ ID NO: 2013554 - RNA, 19 nt, Homo sapiens
caccagcccugagccaugg

SEQ ID NO: 2013555 - RNA, 16 nt, Homo sapiens
cuggccuggcacauca

SEQ ID NO: 2013556 - RNA, 17 nt, Homo sapiens
ucaacugaaaagacuca

SEQ ID NO: 2013557 - RNA, 13 nt, Homo sapiens
agggaugcagugc

SEQ ID NO: 2013558 - RNA, 18 nt, Homo sapiens
aucucaauggaaacauca

SEQ ID NO: 2013559 - RNA, 21 nt, Homo sapiens
aggcaauuccugauggaaaau

SEQ ID NO: 2013560 - RNA, 22 nt, Homo sapiens
auaugccauaaaccucaaguua

SEQ ID NO: 2013561 - RNA, 14 nt, Homo sapiens
uccuccuguguaca

SEQ ID NO: 2013562 - RNA, 22 nt, Homo sapiens
guucagaccaaugcucaacucc

SEQ ID NO: 2013563 - RNA, 21 nt, Homo sapiens
gcugccucguagagugaccuc

SEQ ID NO: 2013564 - RNA, 23 nt, Homo sapiens
uuuuaccaaagugucuuuugaca

SEQ ID NO: 2013565 - RNA, 15 nt, Homo sapiens
cagaagaaugggaau

SEQ ID NO: 2013566 - RNA, 22 nt, Homo sapiens
acccaguaacucaucugucacc

SEQ ID NO: 2013567 - RNA, 18 nt, Homo sapiens
gggauauggcugcccagg

SEQ ID NO: 2013568 - RNA, 12 nt, Homo sapiens
caauaaacugaa

SEQ ID NO: 2013569 - RNA, 12 nt, Homo sapiens
ugauaaaccaaa

SEQ ID NO: 2013570 - RNA, 21 nt, Homo sapiens
cuuguagcucucugaccuccu

SEQ ID NO: 2013571 - RNA, 23 nt, Homo sapiens
ugccaucaccauacacaguggca

SEQ ID NO: 2013572 - RNA, 10 nt, Homo sapiens
gaaccaugaa

SEQ ID NO: 2013573 - RNA, 17 nt, Homo sapiens
auaaaguccucuucccu

SEQ ID NO: 2013574 - RNA, 23 nt, Homo sapiens
cuacuaguaauaauguaauacug

SEQ ID NO: 2013575 - RNA, 17 nt, Homo sapiens
uccaacgauuagcuuuu

SEQ ID NO: 2013576 - RNA, 17 nt, Homo sapiens
uucuauuacgugcaaua

SEQ ID NO: 2013577 - RNA, 15 nt, Homo sapiens
ccagagcugccagug

SEQ ID NO: 2013578 - RNA, 20 nt, Homo sapiens
uggagacuaaccccaccaca

SEQ ID NO: 2013579 - RNA, 18 nt, Homo sapiens
ucucuugcacucaaagcu

SEQ ID NO: 2013580 - RNA, 18 nt, Homo sapiens
ucuaaagauggaguuucu

SEQ ID NO: 2013581 - RNA, 17 nt, Homo sapiens
gacucaaugcacugaca

SEQ ID NO: 2013582 - RNA, 20 nt, Homo sapiens
agaagaaauacuccuguauu

SEQ ID NO: 2013583 - RNA, 16 nt, Homo sapiens
auuuucauucugccaa

SEQ ID NO: 2013584 - RNA, 12 nt, Homo sapiens
uagaguuugugu

SEQ ID NO: 2013585 - RNA, 18 nt, Homo sapiens
caagaguggacucagugg

SEQ ID NO: 2013586 - RNA, 22 nt, Homo sapiens
cagguuugcaccuaagugugua

SEQ ID NO: 2013587 - RNA, 14 nt, Homo sapiens
cacucuaauauuca

SEQ ID NO: 2013588 - RNA, 18 nt, Homo sapiens
uccaaaauuccaucccua

SEQ ID NO: 2013589 - RNA, 21 nt, Homo sapiens
aggcccgcagagcacagagca

SEQ ID NO: 2013590 - RNA, 16 nt, Homo sapiens
aaaguaagcauuucca

SEQ ID NO: 2013591 - RNA, 18 nt, Homo sapiens
uggaauaauccuaaacau

SEQ ID NO: 2013592 - RNA, 21 nt, Homo sapiens
ccuucagcaugccugaacuac

SEQ ID NO: 2013593 - RNA, 15 nt, Homo sapiens
gcagcagagaaccau

SEQ ID NO: 2013594 - RNA, 17 nt, Homo sapiens
uacgaucccccaagugu

SEQ ID NO: 2013595 - RNA, 21 nt, Homo sapiens
cuaacagcaacagcaagaaau

SEQ ID NO: 2013596 - RNA, 17 nt, Homo sapiens
ggcaaauaaaagcauuu

SEQ ID NO: 2013597 - RNA, 23 nt, Homo sapiens
uugguggcagaguggauucuuga

SEQ ID NO: 2013598 - RNA, 17 nt, Homo sapiens
aaaaaggcauaugcaau

SEQ ID NO: 2013599 - RNA, 14 nt, Homo sapiens
ccgucuugaucgga

SEQ ID NO: 2013600 - RNA, 15 nt, Homo sapiens
guagagacaguguuu

SEQ ID NO: 2013601 - RNA, 14 nt, Homo sapiens
ccauccucaucucu

SEQ ID NO: 2013602 - RNA, 15 nt, Homo sapiens
gccauguggacuggu

SEQ ID NO: 2013603 - RNA, 14 nt, Homo sapiens
acaguaucccacau

SEQ ID NO: 2013604 - RNA, 16 nt, Homo sapiens
uccaaccccaacucca

SEQ ID NO: 2013605 - RNA, 14 nt, Homo sapiens
uggcaggacacugc

SEQ ID NO: 2013606 - RNA, 18 nt, Homo sapiens
ucaauggaaacaucacug

SEQ ID NO: 2013607 - RNA, 17 nt, Homo sapiens
ugguggcaaauaucuca

SEQ ID NO: 2013608 - RNA, 16 nt, Homo sapiens
cuucuaauuccaagau

SEQ ID NO: 2013609 - RNA, 16 nt, Homo sapiens
caagaagccagcacca

SEQ ID NO: 2013610 - RNA, 12 nt, Homo sapiens
cuuucaccucag

SEQ ID NO: 2013611 - RNA, 16 nt, Homo sapiens
cugcccgacucagguc

SEQ ID NO: 2013612 - RNA, 17 nt, Homo sapiens
ggaagccuuuugcaaau

SEQ ID NO: 2013613 - RNA, 20 nt, Homo sapiens
ccuguuuuaaaugaaccaaa

SEQ ID NO: 2013614 - RNA, 19 nt, Homo sapiens
cccuggagugugucagagc

SEQ ID NO: 2013615 - RNA, 18 nt, Homo sapiens
cauuguuauaaagacaca

SEQ ID NO: 2013616 - RNA, 20 nt, Homo sapiens
cagcagaauugacaguugaa

SEQ ID NO: 2013617 - RNA, 17 nt, Homo sapiens
aucuaguaugcauuucu

SEQ ID NO: 2013618 - RNA, 22 nt, Homo sapiens
augaaccuggcaagucacagga

SEQ ID NO: 2013619 - RNA, 10 nt, Homo sapiens
uuuccaggga

SEQ ID NO: 2013620 - RNA, 20 nt, Homo sapiens
uaacuguagcucaaguuuaa

SEQ ID NO: 2013621 - RNA, 19 nt, Homo sapiens
ccagaaguaaaguuuauuu

SEQ ID NO: 2013622 - RNA, 13 nt, Homo sapiens
guucauuaccucc

SEQ ID NO: 2013623 - RNA, 21 nt, Homo sapiens
agucagacuccuagacucacu

SEQ ID NO: 2013624 - RNA, 19 nt, Homo sapiens
ucagucagcaaacuccaca

SEQ ID NO: 2013625 - RNA, 17 nt, Homo sapiens
ccuuucaugucuuucca

SEQ ID NO: 2013626 - RNA, 21 nt, Homo sapiens
aucauauccuaugacccagca

SEQ ID NO: 2013627 - RNA, 15 nt, Homo sapiens
ugaccaggcccugcu

SEQ ID NO: 2013628 - RNA, 10 nt, Homo sapiens
agcagucaau

SEQ ID NO: 2013629 - RNA, 20 nt, Homo sapiens
uaauaagcagagagaucuau

SEQ ID NO: 2013630 - RNA, 13 nt, Homo sapiens
uuagaugugacac

SEQ ID NO: 2013631 - RNA, 12 nt, Homo sapiens
guguucuuccca

SEQ ID NO: 2013632 - RNA, 14 nt, Homo sapiens
gucagauuagggcg

SEQ ID NO: 2013633 - RNA, 13 nt, Homo sapiens
cacacacacagcc

SEQ ID NO: 2013634 - RNA, 17 nt, Homo sapiens
uugaagccgucucaugc

SEQ ID NO: 2013635 - RNA, 22 nt, Homo sapiens
gucccuuacagaggaccaugcu

SEQ ID NO: 2013636 - RNA, 19 nt, Homo sapiens
ugugugcccccagauuuaa

SEQ ID NO: 2013637 - RNA, 12 nt, Homo sapiens
guauuagucaca

SEQ ID NO: 2013638 - RNA, 12 nt, Homo sapiens
gucuuagucaaa

SEQ ID NO: 2013639 - RNA, 12 nt, Homo sapiens
ccugaccccagu

SEQ ID NO: 2013640 - RNA, 11 nt, Homo sapiens
auucuuggccc

SEQ ID NO: 2013641 - RNA, 13 nt, Homo sapiens
gcaacagcacugg

SEQ ID NO: 2013642 - RNA, 18 nt, Homo sapiens
ucagucucuguguaauca

SEQ ID NO: 2013643 - RNA, 13 nt, Homo sapiens
uuaggagcagcuc

SEQ ID NO: 2013644 - RNA, 15 nt, Homo sapiens
gcacacaccugccug

SEQ ID NO: 2013645 - RNA, 19 nt, Homo sapiens
agaauuuaucccuuuacaa

SEQ ID NO: 2013646 - RNA, 22 nt, Homo sapiens
uucagucaaagauacacaaucu

SEQ ID NO: 2013647 - RNA, 17 nt, Homo sapiens
acaauacaggcuaggga

SEQ ID NO: 2013648 - RNA, 23 nt, Homo sapiens
uguccugcccacccuaccagcuc

SEQ ID NO: 2013649 - RNA, 17 nt, Homo sapiens
augcauauuuuugcaca

SEQ ID NO: 2013650 - RNA, 22 nt, Homo sapiens
agacccacgugcuaggggauga

SEQ ID NO: 2013651 - RNA, 15 nt, Homo sapiens
agauuucaugucacu

SEQ ID NO: 2013652 - RNA, 19 nt, Homo sapiens
gcaaguugacaaaugccaa

SEQ ID NO: 2013653 - RNA, 17 nt, Homo sapiens
auugugaccacucugaa

SEQ ID NO: 2013654 - RNA, 16 nt, Homo sapiens
aggcucugcuucucca

SEQ ID NO: 2013655 - RNA, 15 nt, Homo sapiens
uugugagccagcagc

SEQ ID NO: 2013656 - RNA, 19 nt, Homo sapiens
ucugcacuucuguuccagg

SEQ ID NO: 2013657 - RNA, 19 nt, Homo sapiens
agagacucgcucacuccca

SEQ ID NO: 2013658 - RNA, 15 nt, Homo sapiens
gagaguuugaaaaau

SEQ ID NO: 2013659 - RNA, 16 nt, Homo sapiens
agagaccacuuccuua

SEQ ID NO: 2013660 - RNA, 13 nt, Homo sapiens
ucauauuuugcca

SEQ ID NO: 2013661 - RNA, 17 nt, Homo sapiens
cagaacuuuaguauuaa

SEQ ID NO: 2013662 - RNA, 18 nt, Homo sapiens
cucauuguagacaugggu

SEQ ID NO: 2013663 - RNA, 23 nt, Homo sapiens
ucuaaaauaaacaagcuguggua

SEQ ID NO: 2013664 - RNA, 11 nt, Homo sapiens
accugaagucu

SEQ ID NO: 2013665 - RNA, 14 nt, Homo sapiens
auuauucaaaaaca

SEQ ID NO: 2013666 - RNA, 20 nt, Homo sapiens
cgggguugucgagaucucag

SEQ ID NO: 2013667 - RNA, 16 nt, Homo sapiens
caagggagacaccagu

SEQ ID NO: 2013668 - RNA, 15 nt, Homo sapiens
gcauugaacauuucu

SEQ ID NO: 2013669 - RNA, 13 nt, Homo sapiens
gcucuuugacaac

SEQ ID NO: 2013670 - RNA, 22 nt, Homo sapiens
uacauauguauuauauaaacuu

SEQ ID NO: 2013671 - RNA, 21 nt, Homo sapiens
uagcuggcuguacugccaagg

SEQ ID NO: 2013672 - RNA, 12 nt, Homo sapiens
acucuacugcug

SEQ ID NO: 2013673 - RNA, 18 nt, Homo sapiens
gaguaaggcacacccaaa

SEQ ID NO: 2013674 - RNA, 19 nt, Homo sapiens
caggccgugugucugucag

SEQ ID NO: 2013675 - RNA, 16 nt, Homo sapiens
gcucuuggaagagcuc

SEQ ID NO: 2013676 - RNA, 19 nt, Homo sapiens
uuccccgugggccauggca

SEQ ID NO: 2013677 - RNA, 18 nt, Homo sapiens
ggagcccagcggcccaag

SEQ ID NO: 2013678 - RNA, 17 nt, Homo sapiens
ccuggggcagaaagcca

SEQ ID NO: 2013679 - RNA, 16 nt, Homo sapiens
agccugccucccaagg

SEQ ID NO: 2013680 - RNA, 20 nt, Homo sapiens
ucuggcagccucccauccag

SEQ ID NO: 2013681 - RNA, 22 nt, Homo sapiens
cacaugccuuuuaaaaguucuu

SEQ ID NO: 2013682 - RNA, 16 nt, Homo sapiens
caacauuuaaugagca

SEQ ID NO: 2013683 - RNA, 16 nt, Homo sapiens
uccacaccauucaggu

SEQ ID NO: 2013684 - RNA, 12 nt, Homo sapiens
ugaaguuacaaa

SEQ ID NO: 2013685 - RNA, 16 nt, Homo sapiens
ugaacucuuaggcaca

SEQ ID NO: 2013686 - RNA, 17 nt, Homo sapiens
gagucccuauaguuuca

SEQ ID NO: 2013687 - RNA, 23 nt, Homo sapiens
uguagagauuuggggugguugau

SEQ ID NO: 2013688 - RNA, 11 nt, Homo sapiens
ucuacaaggac

SEQ ID NO: 2013689 - RNA, 14 nt, Homo sapiens
ccauaggacugugg

SEQ ID NO: 2013690 - RNA, 21 nt, Homo sapiens
agagcaguauauuaaaacaau

SEQ ID NO: 2013691 - RNA, 13 nt, Homo sapiens
cacucugcaagaa

SEQ ID NO: 2013692 - RNA, 16 nt, Homo sapiens
ugaacuguaaaugcuc

SEQ ID NO: 2013693 - RNA, 15 nt, Homo sapiens
cacguucugcucauc

SEQ ID NO: 2013694 - RNA, 17 nt, Homo sapiens
uacaaccugaauacccu

SEQ ID NO: 2013695 - RNA, 21 nt, Homo sapiens
cuuucacaggacucugcagau

SEQ ID NO: 2013696 - RNA, 18 nt, Homo sapiens
cugguggccgugcugguc

SEQ ID NO: 2013697 - RNA, 12 nt, Homo sapiens
gaccugcugaca

SEQ ID NO: 2013698 - RNA, 16 nt, Homo sapiens
uuauuaaauaaucucu

SEQ ID NO: 2013699 - RNA, 10 nt, Homo sapiens
auacacugua

SEQ ID NO: 2013700 - RNA, 12 nt, Homo sapiens
uaaaacagauuu

SEQ ID NO: 2013701 - RNA, 20 nt, Homo sapiens
auguuggcaaaucacuucaa

SEQ ID NO: 2013702 - RNA, 18 nt, Homo sapiens
gagugguauauacaagua

SEQ ID NO: 2013703 - RNA, 22 nt, Homo sapiens
agaugugggcagugaugucacu

SEQ ID NO: 2013704 - RNA, 18 nt, Homo sapiens
caggcagccugccuuuaa

SEQ ID NO: 2013705 - RNA, 17 nt, Homo sapiens
caagacugacgccaggg

SEQ ID NO: 2013706 - RNA, 14 nt, Homo sapiens
aaguuauaccuucc

SEQ ID NO: 2013707 - RNA, 17 nt, Homo sapiens
ccagugcaacaaaauca

SEQ ID NO: 2013708 - RNA, 19 nt, Homo sapiens
cacauacaugucacauuua

SEQ ID NO: 2013709 - RNA, 16 nt, Homo sapiens
cuucccuaguucuuug

SEQ ID NO: 2013710 - RNA, 17 nt, Homo sapiens
uucuccugugugauuga

SEQ ID NO: 2013711 - RNA, 15 nt, Homo sapiens
caaacaccuuauuug

SEQ ID NO: 2013712 - RNA, 16 nt, Homo sapiens
aaugcuaaccuuguag

SEQ ID NO: 2013713 - RNA, 12 nt, Homo sapiens
auuuuacauuga

SEQ ID NO: 2013714 - RNA, 20 nt, Homo sapiens
aucauguuaguaauaccucu

SEQ ID NO: 2013715 - RNA, 16 nt, Homo sapiens
auaaaugacagaucuc

SEQ ID NO: 2013716 - RNA, 17 nt, Homo sapiens
aacucgggcucccgggu

SEQ ID NO: 2013717 - RNA, 17 nt, Homo sapiens
auucucauuauuucauc

SEQ ID NO: 2013718 - RNA, 21 nt, Homo sapiens
accagcguuggguuugcucau

SEQ ID NO: 2013719 - RNA, 19 nt, Homo sapiens
ucaagugccuuauucucac

SEQ ID NO: 2013720 - RNA, 19 nt, Homo sapiens
cugagaaaacuaagucaga

SEQ ID NO: 2013721 - RNA, 14 nt, Homo sapiens
aaacagaagccuga

SEQ ID NO: 2013722 - RNA, 15 nt, Homo sapiens
cucagagcagccucu

SEQ ID NO: 2013723 - RNA, 16 nt, Homo sapiens
ccuauugcuguaaaua

SEQ ID NO: 2013724 - RNA, 16 nt, Homo sapiens
uuucaguaagucucau

SEQ ID NO: 2013725 - RNA, 16 nt, Homo sapiens
acucuugaucucucuu

SEQ ID NO: 2013726 - RNA, 23 nt, Homo sapiens
acucccagugcuugcaagauucc

SEQ ID NO: 2013727 - RNA, 16 nt, Homo sapiens
accccgacugcucagu

SEQ ID NO: 2013728 - RNA, 19 nt, Homo sapiens
uuccaaggaagcagaagac

SEQ ID NO: 2013729 - RNA, 15 nt, Homo sapiens
ggaaacugcacuguu

SEQ ID NO: 2013730 - RNA, 21 nt, Homo sapiens
cucccugaucccgugugccac

SEQ ID NO: 2013731 - RNA, 17 nt, Homo sapiens
aauggugaaaugcagag

SEQ ID NO: 2013732 - RNA, 16 nt, Homo sapiens
cagaccugaaucacaa

SEQ ID NO: 2013733 - RNA, 18 nt, Homo sapiens
gacuuguuugucuuccau

SEQ ID NO: 2013734 - RNA, 13 nt, Homo sapiens
aggaaagcacagc

SEQ ID NO: 2013735 - RNA, 23 nt, Homo sapiens
cugaaagggaaggagacacauuc

SEQ ID NO: 2013736 - RNA, 18 nt, Homo sapiens
ucccucagugaaguagca

SEQ ID NO: 2013737 - RNA, 19 nt, Homo sapiens
ugcaauuuucuaagcaauu

SEQ ID NO: 2013738 - RNA, 23 nt, Homo sapiens
ggcaauaguggaacgaacuuucc

SEQ ID NO: 2013739 - RNA, 21 nt, Homo sapiens
cuuggugcgagggaagcaauu

SEQ ID NO: 2013740 - RNA, 16 nt, Homo sapiens
caccugaaacacugga

SEQ ID NO: 2013741 - RNA, 18 nt, Homo sapiens
agacacauuggcuuugua

SEQ ID NO: 2013742 - RNA, 22 nt, Homo sapiens
uugggagauuucauuuucuaca

SEQ ID NO: 2013743 - RNA, 17 nt, Homo sapiens
cauugagucauuauccu

SEQ ID NO: 2013744 - RNA, 15 nt, Homo sapiens
uggccuagucccuuc

SEQ ID NO: 2013745 - RNA, 17 nt, Homo sapiens
aggacccaggucugcug

SEQ ID NO: 2013746 - RNA, 23 nt, Homo sapiens
uguggagggauugaacacaggca

SEQ ID NO: 2013747 - RNA, 22 nt, Homo sapiens
gaucucggcucagugcaaccuc

SEQ ID NO: 2013748 - RNA, 14 nt, Homo sapiens
uccccgugccaaaa

SEQ ID NO: 2013749 - RNA, 16 nt, Homo sapiens
ucugcaguggagccug

SEQ ID NO: 2013750 - RNA, 14 nt, Homo sapiens
guuauguuugcacu

SEQ ID NO: 2013751 - RNA, 14 nt, Homo sapiens
caaugcaaaugucu

SEQ ID NO: 2013752 - RNA, 19 nt, Homo sapiens
ucccuuaauaaacucacaa

SEQ ID NO: 2013753 - RNA, 21 nt, Homo sapiens
cuucugguuguauuucuauau

SEQ ID NO: 2013754 - RNA, 16 nt, Homo sapiens
uucuauuuccuggaau

SEQ ID NO: 2013755 - RNA, 19 nt, Homo sapiens
cgcccugggcugucuguca

SEQ ID NO: 2013756 - RNA, 19 nt, Homo sapiens
gacaccaauaaauguuugu

SEQ ID NO: 2013757 - RNA, 14 nt, Homo sapiens
acaauucaagcuga

SEQ ID NO: 2013758 - RNA, 19 nt, Homo sapiens
gaaagcagcacacauugug

SEQ ID NO: 2013759 - RNA, 21 nt, Homo sapiens
acccgggaggcagagguugca

SEQ ID NO: 2013760 - RNA, 19 nt, Homo sapiens
gaagccugaggcaaaaacu

SEQ ID NO: 2013761 - RNA, 17 nt, Homo sapiens
gauggcauccugugaag

SEQ ID NO: 2013762 - RNA, 15 nt, Homo sapiens
guacaggcaacaaug

SEQ ID NO: 2013763 - RNA, 14 nt, Homo sapiens
caaaacauugugcc

SEQ ID NO: 2013764 - RNA, 21 nt, Homo sapiens
cugacuauugaaguugcagau

SEQ ID NO: 2013765 - RNA, 19 nt, Homo sapiens
gcugggaaauucaugugga

SEQ ID NO: 2013766 - RNA, 18 nt, Homo sapiens
agaagggccugcucugcu

SEQ ID NO: 2013767 - RNA, 13 nt, Homo sapiens
ccagccuaggugg

SEQ ID NO: 2013768 - RNA, 22 nt, Homo sapiens
gccacucccagauggcucuuuc

SEQ ID NO: 2013769 - RNA, 18 nt, Homo sapiens
gaaauagagccaacugau

SEQ ID NO: 2013770 - RNA, 23 nt, Homo sapiens
caaccaucucauccuauuacuuu

SEQ ID NO: 2013771 - RNA, 21 nt, Homo sapiens
uccucauuuacuggauuugac

SEQ ID NO: 2013772 - RNA, 13 nt, Homo sapiens
gccagaguuccug

SEQ ID NO: 2013773 - RNA, 21 nt, Homo sapiens
ccucaaaccuaccacucagga

SEQ ID NO: 2013774 - RNA, 15 nt, Homo sapiens
aggcacaagucauac

SEQ ID NO: 2013775 - RNA, 20 nt, Homo sapiens
cagucgaugcguucacucca

SEQ ID NO: 2013776 - RNA, 18 nt, Homo sapiens
cauccaaaucuagccaga

SEQ ID NO: 2013777 - RNA, 22 nt, Homo sapiens
ugccaacuuuuuguuacagauu

SEQ ID NO: 2013778 - RNA, 14 nt, Homo sapiens
caggcaccaugcug

SEQ ID NO: 2013779 - RNA, 16 nt, Homo sapiens
acaaaagcaaagugaa

SEQ ID NO: 2013780 - RNA, 22 nt, Homo sapiens
auuucaaauuguuuucagugaa

SEQ ID NO: 2013781 - RNA, 15 nt, Homo sapiens
aagggccuugaaucc

SEQ ID NO: 2013782 - RNA, 17 nt, Homo sapiens
cucaaacuccugaccuc

SEQ ID NO: 2013783 - RNA, 20 nt, Homo sapiens
ggagugcccccaacagcacc

SEQ ID NO: 2013784 - RNA, 21 nt, Homo sapiens
acauguagaauucgcagugau

SEQ ID NO: 2013785 - RNA, 15 nt, Homo sapiens
ugcaugaucugucaa

SEQ ID NO: 2013786 - RNA, 16 nt, Homo sapiens
uguauauacauauuau

SEQ ID NO: 2013787 - RNA, 17 nt, Homo sapiens
cuaaacacaacaauaac

SEQ ID NO: 2013788 - RNA, 23 nt, Homo sapiens
uaaaaugaauuuguuguuccuuu

SEQ ID NO: 2013789 - RNA, 16 nt, Homo sapiens
uaucuugcaccccaaa

SEQ ID NO: 2013790 - RNA, 23 nt, Homo sapiens
gaugucaauaggaauugcauuag

SEQ ID NO: 2013791 - RNA, 21 nt, Homo sapiens
acauuuucuauaacauaugau

SEQ ID NO: 2013792 - RNA, 22 nt, Homo sapiens
caaagugcaugucacaugccac

SEQ ID NO: 2013793 - RNA, 17 nt, Homo sapiens
agccaggugcugugaca

SEQ ID NO: 2013794 - RNA, 19 nt, Homo sapiens
uacauuuuuuaaaacugaa

SEQ ID NO: 2013795 - RNA, 22 nt, Homo sapiens
ccaucgcacaccaaauuuggca

SEQ ID NO: 2013796 - RNA, 15 nt, Homo sapiens
cccuaguaacugcug

SEQ ID NO: 2013797 - RNA, 13 nt, Homo sapiens
uuuuuuaaacuag

SEQ ID NO: 2013798 - RNA, 18 nt, Homo sapiens
ugcaaauagaacuaauac

SEQ ID NO: 2013799 - RNA, 19 nt, Homo sapiens
cucugucaccugagaccca

SEQ ID NO: 2013800 - RNA, 20 nt, Homo sapiens
acaaaaggcuggaugugcuu

SEQ ID NO: 2013801 - RNA, 19 nt, Homo sapiens
caaagcaccugaaccacug

SEQ ID NO: 2013802 - RNA, 16 nt, Homo sapiens
cugccacucuacaggu

SEQ ID NO: 2013803 - RNA, 14 nt, Homo sapiens
cacccuuuccagga

SEQ ID NO: 2013804 - RNA, 19 nt, Homo sapiens
caauguuaucaaccaacug

SEQ ID NO: 2013805 - RNA, 20 nt, Homo sapiens
ggcacugugauacaguuuug

SEQ ID NO: 2013806 - RNA, 19 nt, Homo sapiens
ucacccaucaaaagcacca

SEQ ID NO: 2013807 - RNA, 18 nt, Homo sapiens
uauucauuagcugugauu

SEQ ID NO: 2013808 - RNA, 14 nt, Homo sapiens
ucaaacucaaacac

SEQ ID NO: 2013809 - RNA, 13 nt, Homo sapiens
acagucaaucuau

SEQ ID NO: 2013810 - RNA, 16 nt, Homo sapiens
uccaugcugccuccag

SEQ ID NO: 2013811 - RNA, 19 nt, Homo sapiens
agcuagaugugucuuacca

SEQ ID NO: 2013812 - RNA, 19 nt, Homo sapiens
agcaaacccagugucagga

SEQ ID NO: 2013813 - RNA, 18 nt, Homo sapiens
ugaccuugugacaauaca

SEQ ID NO: 2013814 - RNA, 22 nt, Homo sapiens
aauuacuuugugaauagaacuc

SEQ ID NO: 2013815 - RNA, 14 nt, Homo sapiens
ucaccugggaugac

SEQ ID NO: 2013816 - RNA, 15 nt, Homo sapiens
ucuuuauagugcaca

SEQ ID NO: 2013817 - RNA, 14 nt, Homo sapiens
uuuauuaucaccau

SEQ ID NO: 2013818 - RNA, 16 nt, Homo sapiens
ugauaauaauugauca

SEQ ID NO: 2013819 - RNA, 21 nt, Homo sapiens
acugcgcagccuuacccaguc

SEQ ID NO: 2013820 - RNA, 10 nt, Homo sapiens
ugaacuuugg

SEQ ID NO: 2013821 - RNA, 23 nt, Homo sapiens
agggcaaaaucgccauaggccaa

SEQ ID NO: 2013822 - RNA, 20 nt, Homo sapiens
ccaaggguaugggaagccau

SEQ ID NO: 2013823 - RNA, 22 nt, Homo sapiens
uuuaaaaauguuugaguauucu

SEQ ID NO: 2013824 - RNA, 21 nt, Homo sapiens
augcucauacuuggacaguua

SEQ ID NO: 2013825 - RNA, 11 nt, Homo sapiens
aucagcuuugu

SEQ ID NO: 2013826 - RNA, 20 nt, Homo sapiens
agcucagaguugagaccuuu

SEQ ID NO: 2013827 - RNA, 14 nt, Homo sapiens
uaguagagcaguau

SEQ ID NO: 2013828 - RNA, 20 nt, Homo sapiens
ccaguaaaaauccacuauuu

SEQ ID NO: 2013829 - RNA, 15 nt, Homo sapiens
acugaggucacuggg

SEQ ID NO: 2013830 - RNA, 23 nt, Homo sapiens
aggcuggucucgaacugcuggau

SEQ ID NO: 2013831 - RNA, 16 nt, Homo sapiens
augcaaaguagcaauu

SEQ ID NO: 2013832 - RNA, 18 nt, Homo sapiens
gagccuggggaggccagg

SEQ ID NO: 2013833 - RNA, 18 nt, Homo sapiens
cuccuaccuuuugucucu

SEQ ID NO: 2013834 - RNA, 16 nt, Homo sapiens
uagccugugcuggacc

SEQ ID NO: 2013835 - RNA, 16 nt, Homo sapiens
ugaauuuuacuugcac

SEQ ID NO: 2013836 - RNA, 16 nt, Homo sapiens
agauguucucuaucau

SEQ ID NO: 2013837 - RNA, 24 nt, Homo sapiens
aaauucugaugagcauuacuauuc

SEQ ID NO: 2013838 - RNA, 16 nt, Homo sapiens
uagaccuccagcuguu

SEQ ID NO: 2013839 - RNA, 14 nt, Homo sapiens
cacccuaccagcuc

SEQ ID NO: 2013840 - RNA, 19 nt, Homo sapiens
ugugugucuccaugcacau

SEQ ID NO: 2013841 - RNA, 14 nt, Homo sapiens
cuggguagcuguaa

SEQ ID NO: 2013842 - RNA, 23 nt, Homo sapiens
guaaguacucuaauauacagugu

SEQ ID NO: 2013843 - RNA, 19 nt, Homo sapiens
cagaguuggauaagccaau

SEQ ID NO: 2013844 - RNA, 23 nt, Homo sapiens
augguggccagccagaucaagga

SEQ ID NO: 2013845 - RNA, 18 nt, Homo sapiens
uuuaagagaaaugagcug

SEQ ID NO: 2013846 - RNA, 23 nt, Homo sapiens
ucugccagcgccaaaacaagcca

SEQ ID NO: 2013847 - RNA, 18 nt, Homo sapiens
agggcccagcccaaguga

SEQ ID NO: 2013848 - RNA, 14 nt, Homo sapiens
cgagccugcacugg

SEQ ID NO: 2013849 - RNA, 18 nt, Homo sapiens
uauaauguauacauuaca

SEQ ID NO: 2013850 - RNA, 13 nt, Homo sapiens
gaaagccuuccau

SEQ ID NO: 2013851 - RNA, 21 nt, Homo sapiens
ugucuggagugguaacagcuc

SEQ ID NO: 2013852 - RNA, 20 nt, Homo sapiens
uacguucagaggugcagcug

SEQ ID NO: 2013853 - RNA, 16 nt, Homo sapiens
aucacauaugugcaua

SEQ ID NO: 2013854 - RNA, 13 nt, Homo sapiens
aauguucauccca

SEQ ID NO: 2013855 - RNA, 16 nt, Homo sapiens
aaguacaauaauucau

SEQ ID NO: 2013856 - RNA, 22 nt, Homo sapiens
gcugcugccccuuaaacacagg

SEQ ID NO: 2013857 - RNA, 21 nt, Homo sapiens
acccuccaggccucaguuucu

SEQ ID NO: 2013858 - RNA, 18 nt, Homo sapiens
aggaagcuugucacugga

SEQ ID NO: 2013859 - RNA, 16 nt, Homo sapiens
aauuacaggcacauac

SEQ ID NO: 2013860 - RNA, 14 nt, Homo sapiens
acaaauugagacag

SEQ ID NO: 2013861 - RNA, 21 nt, Homo sapiens
ucuguguugacccuuugucca

SEQ ID NO: 2013862 - RNA, 23 nt, Homo sapiens
uauggacaaaauugcagauacca

SEQ ID NO: 2013863 - RNA, 14 nt, Homo sapiens
uuuaaaguaugcau

SEQ ID NO: 2013864 - RNA, 17 nt, Homo sapiens
ugucccaccccuaccuc

SEQ ID NO: 2013865 - RNA, 13 nt, Homo sapiens
acuuauuuugcuu

SEQ ID NO: 2013866 - RNA, 22 nt, Homo sapiens
aauagcugccuucaaggacugu

SEQ ID NO: 2013867 - RNA, 18 nt, Homo sapiens
uagaaagaaacugcucua

SEQ ID NO: 2013868 - RNA, 15 nt, Homo sapiens
aagacaugcuugggu

SEQ ID NO: 2013869 - RNA, 22 nt, Homo sapiens
agaacauuccucugcagcacuu

SEQ ID NO: 2013870 - RNA, 19 nt, Homo sapiens
uaagacuucuggugcugcu

SEQ ID NO: 2013871 - RNA, 18 nt, Homo sapiens
uccuuugaaagcuguaua

SEQ ID NO: 2013872 - RNA, 15 nt, Homo sapiens
ucccuggagaaggga

SEQ ID NO: 2013873 - RNA, 15 nt, Homo sapiens
cucacacccaaagca

SEQ ID NO: 2013874 - RNA, 19 nt, Homo sapiens
uuagaaugguugaguuaca

SEQ ID NO: 2013875 - RNA, 23 nt, Homo sapiens
acugccuuuuuguaauccuguac

SEQ ID NO: 2013876 - RNA, 15 nt, Homo sapiens
ugccagugccucuca

SEQ ID NO: 2013877 - RNA, 18 nt, Homo sapiens
agcuuguucacacuuugc

SEQ ID NO: 2013878 - RNA, 23 nt, Homo sapiens
cuacagaaaagacaaacaguaga

SEQ ID NO: 2013879 - RNA, 16 nt, Homo sapiens
ugaggaaggaacagca

SEQ ID NO: 2013880 - RNA, 20 nt, Homo sapiens
cugacaucaaaaaaggcagu

SEQ ID NO: 2013881 - RNA, 14 nt, Homo sapiens
ggacagaauucucc

SEQ ID NO: 2013882 - RNA, 14 nt, Homo sapiens
cauggccuaugcac

SEQ ID NO: 2013883 - RNA, 21 nt, Homo sapiens
uuccuagggaugugugagaau

SEQ ID NO: 2013884 - RNA, 21 nt, Homo sapiens
cuucaucugaaacccacagau

SEQ ID NO: 2013885 - RNA, 18 nt, Homo sapiens
ggaagugaaaacuuugua

SEQ ID NO: 2013886 - RNA, 18 nt, Homo sapiens
gacuuggagagagauuca

SEQ ID NO: 2013887 - RNA, 23 nt, Homo sapiens
gcaguguaacgaugcacuuugga

SEQ ID NO: 2013888 - RNA, 18 nt, Homo sapiens
cugaggaugugagccuga

SEQ ID NO: 2013889 - RNA, 15 nt, Homo sapiens
cuuucaucagaggaa

SEQ ID NO: 2013890 - RNA, 19 nt, Homo sapiens
aacauccacaauaaccaag

SEQ ID NO: 2013891 - RNA, 20 nt, Homo sapiens
acugcaaaugcuauugucag

SEQ ID NO: 2013892 - RNA, 23 nt, Homo sapiens
cugucuagggcgaagacccuuau

SEQ ID NO: 2013893 - RNA, 17 nt, Homo sapiens
ugauuuagaccaaaaga

SEQ ID NO: 2013894 - RNA, 22 nt, Homo sapiens
uggagacagacugauguguaua

SEQ ID NO: 2013895 - RNA, 18 nt, Homo sapiens
ccccucuacccacuucuc

SEQ ID NO: 2013896 - RNA, 13 nt, Homo sapiens
auaaagacugaga

SEQ ID NO: 2013897 - RNA, 19 nt, Homo sapiens
ucacagccucaagucacuc

SEQ ID NO: 2013898 - RNA, 22 nt, Homo sapiens
ccguccucaccccuguccucac

SEQ ID NO: 2013899 - RNA, 22 nt, Homo sapiens
uguuucuacagaaauaacagcu

SEQ ID NO: 2013900 - RNA, 15 nt, Homo sapiens
auuuguagauuuacu

SEQ ID NO: 2013901 - RNA, 22 nt, Homo sapiens
gcuggaauuauucuaugucaau

SEQ ID NO: 2013902 - RNA, 18 nt, Homo sapiens
ucuugcuuccaagaccau

SEQ ID NO: 2013903 - RNA, 20 nt, Homo sapiens
ugcugggauuacagguguga

SEQ ID NO: 2013904 - RNA, 15 nt, Homo sapiens
cuugcaguacaucaa

SEQ ID NO: 2013905 - RNA, 14 nt, Homo sapiens
ugaacgcugugaug

SEQ ID NO: 2013906 - RNA, 19 nt, Homo sapiens
caugcuuguggaugacucu

SEQ ID NO: 2013907 - RNA, 17 nt, Homo sapiens
cuccaaggcaguggaaa

SEQ ID NO: 2013908 - RNA, 15 nt, Homo sapiens
cagugaccccugacc

SEQ ID NO: 2013909 - RNA, 17 nt, Homo sapiens
aauacacacucaaauca

SEQ ID NO: 2013910 - RNA, 18 nt, Homo sapiens
cgaaaacccccaaaccag

SEQ ID NO: 2013911 - RNA, 17 nt, Homo sapiens
aauuucagaaccaaaag

SEQ ID NO: 2013912 - RNA, 22 nt, Homo sapiens
ugcucccaccacggggucugca

SEQ ID NO: 2013913 - RNA, 14 nt, Homo sapiens
augagaaguacuuu

SEQ ID NO: 2013914 - RNA, 23 nt, Homo sapiens
gucagaagcuuggcaugaccuca

SEQ ID NO: 2013915 - RNA, 18 nt, Homo sapiens
agaugaguuuuauugacu

SEQ ID NO: 2013916 - RNA, 15 nt, Homo sapiens
uuauacuucuuuauu

SEQ ID NO: 2013917 - RNA, 16 nt, Homo sapiens
uggggcugaugcaguu

SEQ ID NO: 2013918 - RNA, 17 nt, Homo sapiens
gcucugcauaagauuau

SEQ ID NO: 2013919 - RNA, 15 nt, Homo sapiens
caaccugggcauucc

SEQ ID NO: 2013920 - RNA, 15 nt, Homo sapiens
uacuacuauucuguu

SEQ ID NO: 2013921 - RNA, 15 nt, Homo sapiens
cagaaccacugaguc

SEQ ID NO: 2013922 - RNA, 16 nt, Homo sapiens
agcauguacaguguuc

SEQ ID NO: 2013923 - RNA, 14 nt, Homo sapiens
cagcuguuaccuga

SEQ ID NO: 2013924 - RNA, 19 nt, Homo sapiens
uaacagaaaaaugaaauuu

SEQ ID NO: 2013925 - RNA, 15 nt, Homo sapiens
caacagacuguugag

SEQ ID NO: 2013926 - RNA, 13 nt, Homo sapiens
uggccuucacuuu

SEQ ID NO: 2013927 - RNA, 13 nt, Homo sapiens
agaugacucugag

SEQ ID NO: 2013928 - RNA, 12 nt, Homo sapiens
cuaaucucucac

SEQ ID NO: 2013929 - RNA, 19 nt, Homo sapiens
guuuucaguggacuaucuu

SEQ ID NO: 2013930 - RNA, 19 nt, Homo sapiens
ugacaaugaagugacacuu

SEQ ID NO: 2013931 - RNA, 15 nt, Homo sapiens
aaagcauccaugugu

SEQ ID NO: 2013932 - RNA, 13 nt, Homo sapiens
auaggacuguggc

SEQ ID NO: 2013933 - RNA, 22 nt, Homo sapiens
cuauugaacugagccaaacaca

SEQ ID NO: 2013934 - RNA, 12 nt, Homo sapiens
caguaaaaucaa

SEQ ID NO: 2013935 - RNA, 21 nt, Homo sapiens
aagauacuaauagaguacuua

SEQ ID NO: 2013936 - RNA, 15 nt, Homo sapiens
cacugcuugaggaaa

SEQ ID NO: 2013937 - RNA, 15 nt, Homo sapiens
caauaaagcaaugug

SEQ ID NO: 2013938 - RNA, 19 nt, Homo sapiens
uaaaaauaaaaaacauaua

SEQ ID NO: 2013939 - RNA, 18 nt, Homo sapiens
caaggauggguccagaag

SEQ ID NO: 2013940 - RNA, 16 nt, Homo sapiens
uaaaaaccaacuguga

SEQ ID NO: 2013941 - RNA, 14 nt, Homo sapiens
uuuggccagaacac

SEQ ID NO: 2013942 - RNA, 23 nt, Homo sapiens
caacuguuuuugaagaagggaaa

SEQ ID NO: 2013943 - RNA, 18 nt, Homo sapiens
cuauuauaaaacuugaau

SEQ ID NO: 2013944 - RNA, 18 nt, Homo sapiens
guguuucguuaagcagua

SEQ ID NO: 2013945 - RNA, 20 nt, Homo sapiens
cagugugugccacaggauug

SEQ ID NO: 2013946 - RNA, 14 nt, Homo sapiens
aggauaaacugcag

SEQ ID NO: 2013947 - RNA, 14 nt, Homo sapiens
aagaccaauauuca

SEQ ID NO: 2013948 - RNA, 16 nt, Homo sapiens
ccuauaccggagcucc

SEQ ID NO: 2013949 - RNA, 22 nt, Homo sapiens
agaaaaucuaccaagaacagag

SEQ ID NO: 2013950 - RNA, 22 nt, Homo sapiens
cucuugucauucucauccaaaa

SEQ ID NO: 2013951 - RNA, 11 nt, Homo sapiens
uucuacuuccu

SEQ ID NO: 2013952 - RNA, 23 nt, Homo sapiens
gagaggaccuaucccaaaugugg

SEQ ID NO: 2013953 - RNA, 23 nt, Homo sapiens
cagcuucaaaugcaaauucauca

SEQ ID NO: 2013954 - RNA, 13 nt, Homo sapiens
auagaaugaacuu

SEQ ID NO: 2013955 - RNA, 15 nt, Homo sapiens
ucagaaggcucuauc

SEQ ID NO: 2013956 - RNA, 18 nt, Homo sapiens
ucuguccagcagucacuu

SEQ ID NO: 2013957 - RNA, 15 nt, Homo sapiens
aaugcucaaucucag

SEQ ID NO: 2013958 - RNA, 16 nt, Homo sapiens
uuacuaaaucuacucu

SEQ ID NO: 2013959 - RNA, 15 nt, Homo sapiens
cucccaaaugaaaac

SEQ ID NO: 2013960 - RNA, 23 nt, Homo sapiens
ucugggugugcuuuuugggacca

SEQ ID NO: 2013961 - RNA, 16 nt, Homo sapiens
gaaccugaugcugacu

SEQ ID NO: 2013962 - RNA, 17 nt, Homo sapiens
gaagugucacagccaua

SEQ ID NO: 2013963 - RNA, 18 nt, Homo sapiens
uggaagacuuaauucuga

SEQ ID NO: 2013964 - RNA, 20 nt, Homo sapiens
ugugagagagcggcugguuc

SEQ ID NO: 2013965 - RNA, 15 nt, Homo sapiens
ccuggcgcuucggcu

SEQ ID NO: 2013966 - RNA, 11 nt, Homo sapiens
ggaugacauua

SEQ ID NO: 2013967 - RNA, 13 nt, Homo sapiens
agaaagcuacaga

SEQ ID NO: 2013968 - RNA, 22 nt, Homo sapiens
aauccugagcucaaaucucugu

SEQ ID NO: 2013969 - RNA, 13 nt, Homo sapiens
cucuuccuugaau

SEQ ID NO: 2013970 - RNA, 19 nt, Homo sapiens
auucauucguauccagcuc

SEQ ID NO: 2013971 - RNA, 18 nt, Homo sapiens
acagaccgaccaccagca

SEQ ID NO: 2013972 - RNA, 14 nt, Homo sapiens
agcccucuucugac

SEQ ID NO: 2013973 - RNA, 16 nt, Homo sapiens
uuaaacuucauaugua

SEQ ID NO: 2013974 - RNA, 22 nt, Homo sapiens
cgaggguaugucagugucacug

SEQ ID NO: 2013975 - RNA, 14 nt, Homo sapiens
uaggauuacaggca

SEQ ID NO: 2013976 - RNA, 19 nt, Homo sapiens
cuuaaaagauucacuaaag

SEQ ID NO: 2013977 - RNA, 19 nt, Homo sapiens
caaggugggccuugcuacc

SEQ ID NO: 2013978 - RNA, 14 nt, Homo sapiens
uucccuugcuggaa

SEQ ID NO: 2013979 - RNA, 16 nt, Homo sapiens
uauaccagguuaccuc

SEQ ID NO: 2013980 - RNA, 14 nt, Homo sapiens
aaaugcccaaaaga

SEQ ID NO: 2013981 - RNA, 18 nt, Homo sapiens
ugaacacauugugucaca

SEQ ID NO: 2013982 - RNA, 19 nt, Homo sapiens
auauauguguauauauaca

SEQ ID NO: 2013983 - RNA, 14 nt, Homo sapiens
aaggcaucuaagac

SEQ ID NO: 2013984 - RNA, 11 nt, Homo sapiens
acccugugacc

SEQ ID NO: 2013985 - RNA, 11 nt, Homo sapiens
uaccuguguac

SEQ ID NO: 2013986 - RNA, 20 nt, Homo sapiens
ugagcagaugauuccccuag

SEQ ID NO: 2013987 - RNA, 23 nt, Homo sapiens
ccuccuggaacuugaguuauuaa

SEQ ID NO: 2013988 - RNA, 19 nt, Homo sapiens
caugcauaaauaugcagug

SEQ ID NO: 2013989 - RNA, 12 nt, Homo sapiens
auuuuacagcua

SEQ ID NO: 2013990 - RNA, 12 nt, Homo sapiens
aucuuacagcca

SEQ ID NO: 2013991 - RNA, 14 nt, Homo sapiens
ucuuuccucaaaga

SEQ ID NO: 2013992 - RNA, 22 nt, Homo sapiens
gccgaaccugauaccugccugg

SEQ ID NO: 2013993 - RNA, 18 nt, Homo sapiens
cuuuagagcauugccauu

SEQ ID NO: 2013994 - RNA, 16 nt, Homo sapiens
ccucucacuagugcca

SEQ ID NO: 2013995 - RNA, 19 nt, Homo sapiens
ugucauuucauuccauugc

SEQ ID NO: 2013996 - RNA, 17 nt, Homo sapiens
gcuuguuucuuguuauu

SEQ ID NO: 2013997 - RNA, 13 nt, Homo sapiens
gucuguuugccac

SEQ ID NO: 2013998 - RNA, 11 nt, Homo sapiens
ugcucauguau

SEQ ID NO: 2013999 - RNA, 16 nt, Homo sapiens
cugggaccugaaugac

SEQ ID NO: 2014000 - RNA, 17 nt, Homo sapiens
gagccuccuagggcuua

SEQ ID NO: 2014001 - RNA, 17 nt, Homo sapiens
ucucagaauaacuaccu

SEQ ID NO: 2014002 - RNA, 15 nt, Homo sapiens
uuuuaagugauguca

SEQ ID NO: 2014003 - RNA, 22 nt, Homo sapiens
auugaacaaaaauguuuccacu

SEQ ID NO: 2014004 - RNA, 18 nt, Homo sapiens
uuagcauuuucaauguga

SEQ ID NO: 2014005 - RNA, 24 nt, Homo sapiens
uuuuaaaaucaauagauucaucac

SEQ ID NO: 2014006 - RNA, 14 nt, Homo sapiens
gauaaacauuccag

SEQ ID NO: 2014007 - RNA, 17 nt, Homo sapiens
cuuuccucuggcccagu

SEQ ID NO: 2014008 - RNA, 21 nt, Homo sapiens
uccaauuauuacaguccuuca

SEQ ID NO: 2014009 - RNA, 13 nt, Homo sapiens
uaaacugaguuua

SEQ ID NO: 2014010 - RNA, 14 nt, Homo sapiens
cuggcuuugucucu

SEQ ID NO: 2014011 - RNA, 15 nt, Homo sapiens
aaacauguucacuua

SEQ ID NO: 2014012 - RNA, 22 nt, Homo sapiens
ccaugcugcuggggaagacagu

SEQ ID NO: 2014013 - RNA, 22 nt, Homo sapiens
aucaagucuuuuuuauauuuau

SEQ ID NO: 2014014 - RNA, 21 nt, Homo sapiens
ugcuucauaaaugaagcagcu

SEQ ID NO: 2014015 - RNA, 14 nt, Homo sapiens
cauugguaucugau

SEQ ID NO: 2014016 - RNA, 21 nt, Homo sapiens
uuuugcacauuuuguggcugu

SEQ ID NO: 2014017 - RNA, 16 nt, Homo sapiens
gaaauuaguguuuuca

SEQ ID NO: 2014018 - RNA, 13 nt, Homo sapiens
cacagugccccag

SEQ ID NO: 2014019 - RNA, 16 nt, Homo sapiens
uauacuucacacugaa

SEQ ID NO: 2014020 - RNA, 21 nt, Homo sapiens
uucauggguuuaccacuaacu

SEQ ID NO: 2014021 - RNA, 17 nt, Homo sapiens
ucuguuccuguccagca

SEQ ID NO: 2014022 - RNA, 17 nt, Homo sapiens
caccugccaaaugaaua

SEQ ID NO: 2014023 - RNA, 22 nt, Homo sapiens
ccgaauucuaugagcaugccaa

SEQ ID NO: 2014024 - RNA, 15 nt, Homo sapiens
aagcauaaugacaga

SEQ ID NO: 2014025 - RNA, 21 nt, Homo sapiens
aggguaaugcgugcaguuccu

SEQ ID NO: 2014026 - RNA, 16 nt, Homo sapiens
cuuggcuccugagaaa

SEQ ID NO: 2014027 - RNA, 17 nt, Homo sapiens
gugguuuucuguuucua

SEQ ID NO: 2014028 - RNA, 15 nt, Homo sapiens
ccauccuugagucaa

SEQ ID NO: 2014029 - RNA, 17 nt, Homo sapiens
ccuucgugcaacuguag

SEQ ID NO: 2014030 - RNA, 19 nt, Homo sapiens
ucugaggccugagugagug

SEQ ID NO: 2014031 - RNA, 21 nt, Homo sapiens
gggucucgcuuuguugcccag

SEQ ID NO: 2014032 - RNA, 18 nt, Homo sapiens
ucccugcucuaacaccug

SEQ ID NO: 2014033 - RNA, 21 nt, Homo sapiens
ugcucccuagccagaggcucu

SEQ ID NO: 2014034 - RNA, 19 nt, Homo sapiens
aaguagggauuaauauuua

SEQ ID NO: 2014035 - RNA, 18 nt, Homo sapiens
ugcagaaccacaaacaau

SEQ ID NO: 2014036 - RNA, 14 nt, Homo sapiens
agucaccacccagc

SEQ ID NO: 2014037 - RNA, 15 nt, Homo sapiens
uacagaaauauccau

SEQ ID NO: 2014038 - RNA, 19 nt, Homo sapiens
ccuuccacggauccaugua

SEQ ID NO: 2014039 - RNA, 19 nt, Homo sapiens
auauauuuccuuauucaga

SEQ ID NO: 2014040 - RNA, 15 nt, Homo sapiens
augcuauauaaucug

SEQ ID NO: 2014041 - RNA, 15 nt, Homo sapiens
aucugaguuacagaa

SEQ ID NO: 2014042 - RNA, 18 nt, Homo sapiens
acuaaacuaccaccucag

SEQ ID NO: 2014043 - RNA, 17 nt, Homo sapiens
gccagugagaagcugag

SEQ ID NO: 2014044 - RNA, 13 nt, Homo sapiens
uccgugccuccac

SEQ ID NO: 2014045 - RNA, 18 nt, Homo sapiens
uuucucugagaucaugag

SEQ ID NO: 2014046 - RNA, 18 nt, Homo sapiens
uacacacaguggauggac

SEQ ID NO: 2014047 - RNA, 18 nt, Homo sapiens
auaggcgcaggugcacag

SEQ ID NO: 2014048 - RNA, 15 nt, Homo sapiens
cgucaggccuaccuc

SEQ ID NO: 2014049 - RNA, 14 nt, Homo sapiens
cccugccuucacug

SEQ ID NO: 2014050 - RNA, 18 nt, Homo sapiens
ugugaagccuuccccuua

SEQ ID NO: 2014051 - RNA, 13 nt, Homo sapiens
uacugacuugagg

SEQ ID NO: 2014052 - RNA, 19 nt, Homo sapiens
ccaaggugcacauuuucca

SEQ ID NO: 2014053 - RNA, 16 nt, Homo sapiens
auugccuugauguuuc

SEQ ID NO: 2014054 - RNA, 19 nt, Homo sapiens
aaaguaagaggacuacuca

SEQ ID NO: 2014055 - RNA, 17 nt, Homo sapiens
cugucagucguguugcu

SEQ ID NO: 2014056 - RNA, 13 nt, Homo sapiens
ugagaagugcacu

SEQ ID NO: 2014057 - RNA, 13 nt, Homo sapiens
auugcaaccagca

SEQ ID NO: 2014058 - RNA, 21 nt, Homo sapiens
cagaagcuuuuuguuugcauc

SEQ ID NO: 2014059 - RNA, 14 nt, Homo sapiens
aaaucccucucaca

SEQ ID NO: 2014060 - RNA, 15 nt, Homo sapiens
ugcaaacacaccuug

SEQ ID NO: 2014061 - RNA, 22 nt, Homo sapiens
ccucugugccccucaugcugau

SEQ ID NO: 2014062 - RNA, 16 nt, Homo sapiens
aaauccacaagccauu

SEQ ID NO: 2014063 - RNA, 18 nt, Homo sapiens
uuugagacagggucucac

SEQ ID NO: 2014064 - RNA, 22 nt, Homo sapiens
ugaaaaugcaucacaugaugaa

SEQ ID NO: 2014065 - RNA, 13 nt, Homo sapiens
ugguggucccugc

SEQ ID NO: 2014066 - RNA, 19 nt, Homo sapiens
uucacaugaugcacuucaa

SEQ ID NO: 2014067 - RNA, 15 nt, Homo sapiens
aaacuucaaauaucu

SEQ ID NO: 2014068 - RNA, 20 nt, Homo sapiens
aaucuggcuccuguuuccau

SEQ ID NO: 2014069 - RNA, 15 nt, Homo sapiens
auuuaagaaacuuau

SEQ ID NO: 2014070 - RNA, 21 nt, Homo sapiens
ccagcauugucugacugugag

SEQ ID NO: 2014071 - RNA, 17 nt, Homo sapiens
agauuuuuaagaacuuc

SEQ ID NO: 2014072 - RNA, 19 nt, Homo sapiens
acacagguggugucacugu

SEQ ID NO: 2014073 - RNA, 18 nt, Homo sapiens
aaucaacagaaguaucaa

SEQ ID NO: 2014074 - RNA, 22 nt, Homo sapiens
uaaagcuaccauuuuacauuuc

SEQ ID NO: 2014075 - RNA, 19 nt, Homo sapiens
auagagaauuccuauuuaa

SEQ ID NO: 2014076 - RNA, 13 nt, Homo sapiens
ucucacacaucac

SEQ ID NO: 2014077 - RNA, 13 nt, Homo sapiens
cuuaaucuaaucu

SEQ ID NO: 2014078 - RNA, 21 nt, Homo sapiens
gauuucccacugcacuccagc

SEQ ID NO: 2014079 - RNA, 19 nt, Homo sapiens
cucggagcuggcccagggg

SEQ ID NO: 2014080 - RNA, 23 nt, Homo sapiens
uuaaccucugcuuuuaucucaga

SEQ ID NO: 2014081 - RNA, 23 nt, Homo sapiens
agucaaaguucaaaaauauucau

SEQ ID NO: 2014082 - RNA, 22 nt, Homo sapiens
auuuacugcucuagaaaguaua

SEQ ID NO: 2014083 - RNA, 17 nt, Homo sapiens
accacuccauucccaac

SEQ ID NO: 2014084 - RNA, 14 nt, Homo sapiens
ggaaacccuuagga

SEQ ID NO: 2014085 - RNA, 15 nt, Homo sapiens
guggaccuggacaaa

SEQ ID NO: 2014086 - RNA, 21 nt, Homo sapiens
uagcaugccuccaaaaauuca

SEQ ID NO: 2014087 - RNA, 13 nt, Homo sapiens
cuccucuguuauu

SEQ ID NO: 2014088 - RNA, 17 nt, Homo sapiens
gauuuaaaauuguucua

SEQ ID NO: 2014089 - RNA, 14 nt, Homo sapiens
agaaagcuucuuca

SEQ ID NO: 2014090 - RNA, 18 nt, Homo sapiens
aaagggaaugggucugca

SEQ ID NO: 2014091 - RNA, 16 nt, Homo sapiens
auuagguguacuguac

SEQ ID NO: 2014092 - RNA, 22 nt, Homo sapiens
uguguuccuaacaggaauuuuc

SEQ ID NO: 2014093 - RNA, 19 nt, Homo sapiens
uuacaugcugcuauacaca

SEQ ID NO: 2014094 - RNA, 12 nt, Homo sapiens
aucucugugaaa

SEQ ID NO: 2014095 - RNA, 18 nt, Homo sapiens
ucaauaaaagagcugucu

SEQ ID NO: 2014096 - RNA, 14 nt, Homo sapiens
caaaaauauauuaa

SEQ ID NO: 2014097 - RNA, 15 nt, Homo sapiens
gcugggacuggccag

SEQ ID NO: 2014098 - RNA, 13 nt, Homo sapiens
caaugacaucucc

SEQ ID NO: 2014099 - RNA, 15 nt, Homo sapiens
gcggccgccuguccu

SEQ ID NO: 2014100 - RNA, 22 nt, Homo sapiens
uggccgaucggggcacugcagg

SEQ ID NO: 2014101 - RNA, 23 nt, Homo sapiens
aacaauuaauggauucaguauua

SEQ ID NO: 2014102 - RNA, 18 nt, Homo sapiens
gauuuggccacacugggg

SEQ ID NO: 2014103 - RNA, 17 nt, Homo sapiens
agaaaaaacuagagccu

SEQ ID NO: 2014104 - RNA, 19 nt, Homo sapiens
auuagucgcacauguauug

SEQ ID NO: 2014105 - RNA, 19 nt, Homo sapiens
aacuuuccucgccugacaa

SEQ ID NO: 2014106 - RNA, 17 nt, Homo sapiens
uuaagacaguguacaaa

SEQ ID NO: 2014107 - RNA, 15 nt, Homo sapiens
auaaauucacuuuca

SEQ ID NO: 2014108 - RNA, 12 nt, Homo sapiens
uguaaacaguuc

SEQ ID NO: 2014109 - RNA, 16 nt, Homo sapiens
uaagaguucuugcccu

SEQ ID NO: 2014110 - RNA, 13 nt, Homo sapiens
auuuugcacugua

SEQ ID NO: 2014111 - RNA, 9 nt, Homo sapiens
cacaugcua

SEQ ID NO: 2014112 - RNA, 14 nt, Homo sapiens
uaagaagucuauaa

SEQ ID NO: 2014113 - RNA, 23 nt, Homo sapiens
auauuguuugcuaagcauuccaa

SEQ ID NO: 2014114 - RNA, 22 nt, Homo sapiens
guuucucucacauuacuguaua

SEQ ID NO: 2014115 - RNA, 17 nt, Homo sapiens
gcaaaaccaacucucua

SEQ ID NO: 2014116 - RNA, 15 nt, Homo sapiens
uccaggccugaaguc

SEQ ID NO: 2014117 - RNA, 14 nt, Homo sapiens
ggaacugcuugugc

SEQ ID NO: 2014118 - RNA, 13 nt, Homo sapiens
aagcauucuucaa

SEQ ID NO: 2014119 - RNA, 17 nt, Homo sapiens
gcuuuggguagugccau

SEQ ID NO: 2014120 - RNA, 13 nt, Homo sapiens
cagaaccaaaucu

SEQ ID NO: 2014121 - RNA, 19 nt, Homo sapiens
ugcucuuacuacagcuuca

SEQ ID NO: 2014122 - RNA, 23 nt, Homo sapiens
gguccugcagccugcaggaccuc

SEQ ID NO: 2014123 - RNA, 18 nt, Homo sapiens
uccugggagaaccucagg

SEQ ID NO: 2014124 - RNA, 15 nt, Homo sapiens
uuuguaaacuucuga

SEQ ID NO: 2014125 - RNA, 18 nt, Homo sapiens
cauugauacaaaguacag

SEQ ID NO: 2014126 - RNA, 15 nt, Homo sapiens
cuggggccugugcac

SEQ ID NO: 2014127 - RNA, 13 nt, Homo sapiens
ugagcuacuucaa

SEQ ID NO: 2014128 - RNA, 18 nt, Homo sapiens
cccuuuccagauauucaa

SEQ ID NO: 2014129 - RNA, 16 nt, Homo sapiens
guccccugacccagag

SEQ ID NO: 2014130 - RNA, 12 nt, Homo sapiens
aaaucagacucu

SEQ ID NO: 2014131 - RNA, 13 nt, Homo sapiens
auggccucugggg

SEQ ID NO: 2014132 - RNA, 22 nt, Homo sapiens
cagaggacacaggcagcuucca

SEQ ID NO: 2014133 - RNA, 23 nt, Homo sapiens
ucauaauaucaugugcacuucaa

SEQ ID NO: 2014134 - RNA, 20 nt, Homo sapiens
ugaaagacaguccaagcccu

SEQ ID NO: 2014135 - RNA, 17 nt, Homo sapiens
cccggccagcgggcaca

SEQ ID NO: 2014136 - RNA, 14 nt, Homo sapiens
uccugccacaugga

SEQ ID NO: 2014137 - RNA, 19 nt, Homo sapiens
uuaaaguaaugagcaugau

SEQ ID NO: 2014138 - RNA, 19 nt, Homo sapiens
caaucucagcucacuguga

SEQ ID NO: 2014139 - RNA, 19 nt, Homo sapiens
ugcaauuugccaguuuauu

SEQ ID NO: 2014140 - RNA, 16 nt, Homo sapiens
aacagcuggugcccug

SEQ ID NO: 2014141 - RNA, 22 nt, Homo sapiens
cugaacacgaagcuuaguauaa

SEQ ID NO: 2014142 - RNA, 11 nt, Homo sapiens
auggcacugac

SEQ ID NO: 2014143 - RNA, 13 nt, Homo sapiens
cacacucagugac

SEQ ID NO: 2014144 - RNA, 21 nt, Homo sapiens
guuccagcaaacaaaauggac

SEQ ID NO: 2014145 - RNA, 18 nt, Homo sapiens
agcacgcggccuugucug

SEQ ID NO: 2014146 - RNA, 18 nt, Homo sapiens
cccuuccuaagucuguca

SEQ ID NO: 2014147 - RNA, 21 nt, Homo sapiens
guggcccagcuauuaccacac

SEQ ID NO: 2014148 - RNA, 17 nt, Homo sapiens
cauggaaauguccucca

SEQ ID NO: 2014149 - RNA, 22 nt, Homo sapiens
ucccucaaaacaaucuugucau

SEQ ID NO: 2014150 - RNA, 21 nt, Homo sapiens
cuuagugccacccaccuuugc

SEQ ID NO: 2014151 - RNA, 19 nt, Homo sapiens
acacuguccccacagcagg

SEQ ID NO: 2014152 - RNA, 20 nt, Homo sapiens
cuuuuuuucuuguccucauu

SEQ ID NO: 2014153 - RNA, 21 nt, Homo sapiens
ugcagcggcacaaaugcaccu

SEQ ID NO: 2014154 - RNA, 18 nt, Homo sapiens
ggccaaguguacauuuga

SEQ ID NO: 2014155 - RNA, 18 nt, Homo sapiens
aaaacagaggcacuuaau

SEQ ID NO: 2014156 - RNA, 18 nt, Homo sapiens
aggacaggacccucagga

SEQ ID NO: 2014157 - RNA, 15 nt, Homo sapiens
aggagaugaggcugg

SEQ ID NO: 2014158 - RNA, 19 nt, Homo sapiens
uagacucuguaaccaccuc

SEQ ID NO: 2014159 - RNA, 17 nt, Homo sapiens
ucucaaaccuccaaaag

SEQ ID NO: 2014160 - RNA, 13 nt, Homo sapiens
ccaaagcaucaau

SEQ ID NO: 2014161 - RNA, 13 nt, Homo sapiens
cuguugcauugua

SEQ ID NO: 2014162 - RNA, 13 nt, Homo sapiens
uuccugcacucca

SEQ ID NO: 2014163 - RNA, 15 nt, Homo sapiens
aggugcuauguccca

SEQ ID NO: 2014164 - RNA, 17 nt, Homo sapiens
augauacuugguccuua

SEQ ID NO: 2014165 - RNA, 15 nt, Homo sapiens
gcucacccaguccug

SEQ ID NO: 2014166 - RNA, 15 nt, Homo sapiens
uaauaucaacucuga

SEQ ID NO: 2014167 - RNA, 22 nt, Homo sapiens
uaaauaucuauuaaccauucua

SEQ ID NO: 2014168 - RNA, 23 nt, Homo sapiens
ucagaccuuugucugaaggauuu

SEQ ID NO: 2014169 - RNA, 20 nt, Homo sapiens
gcugucgccgcuagucuuau

SEQ ID NO: 2014170 - RNA, 16 nt, Homo sapiens
ccaacuacacaccccc

SEQ ID NO: 2014171 - RNA, 16 nt, Homo sapiens
uguaaagaaauuuacu

SEQ ID NO: 2014172 - RNA, 13 nt, Homo sapiens
cccaaacccuuaa

SEQ ID NO: 2014173 - RNA, 13 nt, Homo sapiens
aucuaaccacuua

SEQ ID NO: 2014174 - RNA, 20 nt, Homo sapiens
cagcuuggggccaccaaagc

SEQ ID NO: 2014175 - RNA, 16 nt, Homo sapiens
aucagccucgcucuug

SEQ ID NO: 2014176 - RNA, 23 nt, Homo sapiens
gcaacaauucucccgggacucug

SEQ ID NO: 2014177 - RNA, 17 nt, Homo sapiens
agcauuuccacaccaag

SEQ ID NO: 2014178 - RNA, 14 nt, Homo sapiens
accugcaagcagaa

SEQ ID NO: 2014179 - RNA, 20 nt, Homo sapiens
guucuaugcuaaacugugaa

SEQ ID NO: 2014180 - RNA, 13 nt, Homo sapiens
aucuaccugcuug

SEQ ID NO: 2014181 - RNA, 20 nt, Homo sapiens
ugacuguguuguaccaaaau

SEQ ID NO: 2014182 - RNA, 17 nt, Homo sapiens
agccauuuuacauagca

SEQ ID NO: 2014183 - RNA, 12 nt, Homo sapiens
gaugaugugaug

SEQ ID NO: 2014184 - RNA, 22 nt, Homo sapiens
cagagggggccuucacagugac

SEQ ID NO: 2014185 - RNA, 23 nt, Homo sapiens
ugaccuaaauuauuuacugcaaa

SEQ ID NO: 2014186 - RNA, 18 nt, Homo sapiens
ccugggcugaccccggug

SEQ ID NO: 2014187 - RNA, 19 nt, Homo sapiens
ucagcacguguggccuguu

SEQ ID NO: 2014188 - RNA, 13 nt, Homo sapiens
caggaaucugcca

SEQ ID NO: 2014189 - RNA, 14 nt, Homo sapiens
aauauaaauuguac

SEQ ID NO: 2014190 - RNA, 23 nt, Homo sapiens
acucuugaggauguaaugcauua

SEQ ID NO: 2014191 - RNA, 20 nt, Homo sapiens
augaacuauggacggugcuc

SEQ ID NO: 2014192 - RNA, 19 nt, Homo sapiens
gaaaaguuauuagugguuu

SEQ ID NO: 2014193 - RNA, 19 nt, Homo sapiens
cugcuugccgaaacuggaa

SEQ ID NO: 2014194 - RNA, 22 nt, Homo sapiens
accuaguacuuuauuaguuuaa

SEQ ID NO: 2014195 - RNA, 19 nt, Homo sapiens
ugagaagccuucagcucca

SEQ ID NO: 2014196 - RNA, 13 nt, Homo sapiens
uggagcagcuauu

SEQ ID NO: 2014197 - RNA, 14 nt, Homo sapiens
cacagagaguccca

SEQ ID NO: 2014198 - RNA, 22 nt, Homo sapiens
auuucauguuuuugaucaaaaa

SEQ ID NO: 2014199 - RNA, 22 nt, Homo sapiens
cugaccuccccgcugugggggu

SEQ ID NO: 2014200 - RNA, 20 nt, Homo sapiens
ucacauagcugggauuugaa

SEQ ID NO: 2014201 - RNA, 21 nt, Homo sapiens
ugauaagcugcacaugacuac

SEQ ID NO: 2014202 - RNA, 18 nt, Homo sapiens
acuucccgccuccaugac

SEQ ID NO: 2014203 - RNA, 15 nt, Homo sapiens
auuuaguuggaauau

SEQ ID NO: 2014204 - RNA, 21 nt, Homo sapiens
uuuugauuguuuuaacaguua

SEQ ID NO: 2014205 - RNA, 20 nt, Homo sapiens
cuuacauuucagacauaucc

SEQ ID NO: 2014206 - RNA, 14 nt, Homo sapiens
uuaaaaaucuuggu

SEQ ID NO: 2014207 - RNA, 15 nt, Homo sapiens
auauuuauauauuaa

SEQ ID NO: 2014208 - RNA, 15 nt, Homo sapiens
aggggaguaggggug

SEQ ID NO: 2014209 - RNA, 15 nt, Homo sapiens
uguauacuuguauuc

SEQ ID NO: 2014210 - RNA, 15 nt, Homo sapiens
auggcuauauggcaa

SEQ ID NO: 2014211 - RNA, 17 nt, Homo sapiens
guggauugcucaucuca

SEQ ID NO: 2014212 - RNA, 17 nt, Homo sapiens
gcucaggguucaucuga

SEQ ID NO: 2014213 - RNA, 19 nt, Homo sapiens
gcuauuuauuaaguauuuu

SEQ ID NO: 2014214 - RNA, 16 nt, Homo sapiens
uucuuggcuucuggga

SEQ ID NO: 2014215 - RNA, 18 nt, Homo sapiens
ugcauaauuauauacucc

SEQ ID NO: 2014216 - RNA, 17 nt, Homo sapiens
guauucuacuuguucua

SEQ ID NO: 2014217 - RNA, 17 nt, Homo sapiens
ucagcaaggugugaaug

SEQ ID NO: 2014218 - RNA, 19 nt, Homo sapiens
guguauccgacucuaagcu

SEQ ID NO: 2014219 - RNA, 13 nt, Homo sapiens
uuugaauucuucc

SEQ ID NO: 2014220 - RNA, 22 nt, Homo sapiens
ugugcacacccaugcacacuca

SEQ ID NO: 2014221 - RNA, 19 nt, Homo sapiens
gggaaaagaagcugucaga

SEQ ID NO: 2014222 - RNA, 18 nt, Homo sapiens
auuacauaaucuguacaa

SEQ ID NO: 2014223 - RNA, 10 nt, Homo sapiens
cuuuugccac

SEQ ID NO: 2014224 - RNA, 14 nt, Homo sapiens
uggcuucugugaug

SEQ ID NO: 2014225 - RNA, 14 nt, Homo sapiens
ugcaaucuguccag

SEQ ID NO: 2014226 - RNA, 21 nt, Homo sapiens
aauugugagcgaauuagcaau

SEQ ID NO: 2014227 - RNA, 14 nt, Homo sapiens
agauccagugcuga

SEQ ID NO: 2014228 - RNA, 23 nt, Homo sapiens
acucuucccuuccccucucucau

SEQ ID NO: 2014229 - RNA, 15 nt, Homo sapiens
cauuccuugcugaaa

SEQ ID NO: 2014230 - RNA, 16 nt, Homo sapiens
uaaaaaucaagacacu

SEQ ID NO: 2014231 - RNA, 23 nt, Homo sapiens
aaauguuuguuuauaucacuguc

SEQ ID NO: 2014232 - RNA, 20 nt, Homo sapiens
auccagcucuugcucaguga

SEQ ID NO: 2014233 - RNA, 22 nt, Homo sapiens
gggcauuuagggagcagaugac

SEQ ID NO: 2014234 - RNA, 20 nt, Homo sapiens
gagugacuacacacaguacg

SEQ ID NO: 2014235 - RNA, 16 nt, Homo sapiens
acuauugaaaucaagc

SEQ ID NO: 2014236 - RNA, 19 nt, Homo sapiens
ucugacuuaagcaaaagaa

SEQ ID NO: 2014237 - RNA, 23 nt, Homo sapiens
aaguuugggccagugaacagggu

SEQ ID NO: 2014238 - RNA, 18 nt, Homo sapiens
aaccuagugcugauucac

SEQ ID NO: 2014239 - RNA, 17 nt, Homo sapiens
gccaggccugaccucaa

SEQ ID NO: 2014240 - RNA, 22 nt, Homo sapiens
cucagccguucuugacaucaag

SEQ ID NO: 2014241 - RNA, 18 nt, Homo sapiens
cgauccuggggcccucag

SEQ ID NO: 2014242 - RNA, 18 nt, Homo sapiens
gaaauuucccacacccca

SEQ ID NO: 2014243 - RNA, 17 nt, Homo sapiens
augcugcucauccaaag

SEQ ID NO: 2014244 - RNA, 20 nt, Homo sapiens
agucugggccccaucauuaa

SEQ ID NO: 2014245 - RNA, 15 nt, Homo sapiens
aacaacuugcuacuu

SEQ ID NO: 2014246 - RNA, 14 nt, Homo sapiens
aaggaaacaagcuu

SEQ ID NO: 2014247 - RNA, 17 nt, Homo sapiens
aauuagguccacuucaa

SEQ ID NO: 2014248 - RNA, 20 nt, Homo sapiens
gccacuccagaccccuggcu

SEQ ID NO: 2014249 - RNA, 20 nt, Homo sapiens
aggccuuacugucugcacuu

SEQ ID NO: 2014250 - RNA, 18 nt, Homo sapiens
cuaaaaaggcauguaauu

SEQ ID NO: 2014251 - RNA, 24 nt, Homo sapiens
gaauacuggccaugccuggagaca

SEQ ID NO: 2014252 - RNA, 18 nt, Homo sapiens
uuaaggagguagcuccca

SEQ ID NO: 2014253 - RNA, 13 nt, Homo sapiens
aacacuauucucc

SEQ ID NO: 2014254 - RNA, 16 nt, Homo sapiens
ucacucccaccugcau

SEQ ID NO: 2014255 - RNA, 22 nt, Homo sapiens
accaccccacccaccuuugcag

SEQ ID NO: 2014256 - RNA, 16 nt, Homo sapiens
aagccuuuaaaaccag

SEQ ID NO: 2014257 - RNA, 16 nt, Homo sapiens
agcagugucuuccaua

SEQ ID NO: 2014258 - RNA, 16 nt, Homo sapiens
uauuucuccuuugcaa

SEQ ID NO: 2014259 - RNA, 16 nt, Homo sapiens
cucuuuuauacuguac

SEQ ID NO: 2014260 - RNA, 17 nt, Homo sapiens
ccugcccuguccaaaag

SEQ ID NO: 2014261 - RNA, 23 nt, Homo sapiens
cuaauuuaugaauuuuacuugca

SEQ ID NO: 2014262 - RNA, 18 nt, Homo sapiens
gacccuugauuuugcccc

SEQ ID NO: 2014263 - RNA, 17 nt, Homo sapiens
ugguagaccacugccau

SEQ ID NO: 2014264 - RNA, 21 nt, Homo sapiens
ggcuauaccugggcauacuaa

SEQ ID NO: 2014265 - RNA, 13 nt, Homo sapiens
accaugcauuucu

SEQ ID NO: 2014266 - RNA, 20 nt, Homo sapiens
gcuuuguguuugguuuacau

SEQ ID NO: 2014267 - RNA, 20 nt, Homo sapiens
ucuaaccugauuuaccucuu

SEQ ID NO: 2014268 - RNA, 18 nt, Homo sapiens
caugcagugccggcugcc

SEQ ID NO: 2014269 - RNA, 15 nt, Homo sapiens
uauacauuacaauca

SEQ ID NO: 2014270 - RNA, 14 nt, Homo sapiens
aguuggaauguugu

SEQ ID NO: 2014271 - RNA, 15 nt, Homo sapiens
ccaucuaugucccuu

SEQ ID NO: 2014272 - RNA, 17 nt, Homo sapiens
cuagauuccauacagug

SEQ ID NO: 2014273 - RNA, 21 nt, Homo sapiens
acugcaguaucccaacugcag

SEQ ID NO: 2014274 - RNA, 15 nt, Homo sapiens
gcuuugaaaaaguuu

SEQ ID NO: 2014275 - RNA, 12 nt, Homo sapiens
ccucucuugccu

SEQ ID NO: 2014276 - RNA, 22 nt, Homo sapiens
uggaagaaaauuaggccucaaa

SEQ ID NO: 2014277 - RNA, 11 nt, Homo sapiens
ggucuugacuc

SEQ ID NO: 2014278 - RNA, 13 nt, Homo sapiens
cuaugaguuuucu

SEQ ID NO: 2014279 - RNA, 23 nt, Homo sapiens
aagacucuuuuugguuguccuca

SEQ ID NO: 2014280 - RNA, 22 nt, Homo sapiens
ucucccuguacaguguuaccau

SEQ ID NO: 2014281 - RNA, 21 nt, Homo sapiens
ucugcccuguauauaauacua

SEQ ID NO: 2014282 - RNA, 18 nt, Homo sapiens
ugccagagcuccaugcau

SEQ ID NO: 2014283 - RNA, 22 nt, Homo sapiens
auuaaucuacuguaucaauaaa

SEQ ID NO: 2014284 - RNA, 22 nt, Homo sapiens
uaaccuuguucucugcuugaca

SEQ ID NO: 2014285 - RNA, 15 nt, Homo sapiens
gcaugacaaaccuua

SEQ ID NO: 2014286 - RNA, 19 nt, Homo sapiens
guacauggcauugagacau

SEQ ID NO: 2014287 - RNA, 17 nt, Homo sapiens
agaauucuuuuuacauc

SEQ ID NO: 2014288 - RNA, 15 nt, Homo sapiens
gaggacccagggcuc

SEQ ID NO: 2014289 - RNA, 23 nt, Homo sapiens
ccugacaauuugugauaucuaau

SEQ ID NO: 2014290 - RNA, 21 nt, Homo sapiens
acuugcuaucuauaaaaaaga

SEQ ID NO: 2014291 - RNA, 22 nt, Homo sapiens
ucaaaagucuggcccacugugc

SEQ ID NO: 2014292 - RNA, 23 nt, Homo sapiens
caaggcugcgggagaagaaguuu

SEQ ID NO: 2014293 - RNA, 19 nt, Homo sapiens
ccuccaccuccggguucaa

SEQ ID NO: 2014294 - RNA, 22 nt, Homo sapiens
ugguagguuugaaugacguguc

SEQ ID NO: 2014295 - RNA, 22 nt, Homo sapiens
cugugauuaggugaagggaugg

SEQ ID NO: 2014296 - RNA, 13 nt, Homo sapiens
uguccugccugug

SEQ ID NO: 2014297 - RNA, 13 nt, Homo sapiens
aguaucugagauu

SEQ ID NO: 2014298 - RNA, 17 nt, Homo sapiens
agaagaucaaugaucac

SEQ ID NO: 2014299 - RNA, 18 nt, Homo sapiens
aaacacccagaagcagua

SEQ ID NO: 2014300 - RNA, 21 nt, Homo sapiens
cugaggccccucuccaagagg

SEQ ID NO: 2014301 - RNA, 23 nt, Homo sapiens
cuuucuucaccaagugcaauaga

SEQ ID NO: 2014302 - RNA, 17 nt, Homo sapiens
ugugaacucaccaaaca

SEQ ID NO: 2014303 - RNA, 16 nt, Homo sapiens
ggccuuaaaagccauc

SEQ ID NO: 2014304 - RNA, 15 nt, Homo sapiens
gcuggcccugaugac

SEQ ID NO: 2014305 - RNA, 20 nt, Homo sapiens
acagcccucacuaacaaaga

SEQ ID NO: 2014306 - RNA, 19 nt, Homo sapiens
cccagguucagacugagcu

SEQ ID NO: 2014307 - RNA, 18 nt, Homo sapiens
uaaaucagaaaguuuaga

SEQ ID NO: 2014308 - RNA, 19 nt, Homo sapiens
aaccauaaacuguacaaau

SEQ ID NO: 2014309 - RNA, 15 nt, Homo sapiens
gugggcagguggugg

SEQ ID NO: 2014310 - RNA, 12 nt, Homo sapiens
uuugaaucugac

SEQ ID NO: 2014311 - RNA, 15 nt, Homo sapiens
aaaaccaacaaugug

SEQ ID NO: 2014312 - RNA, 15 nt, Homo sapiens
accaguagacaacug

SEQ ID NO: 2014313 - RNA, 15 nt, Homo sapiens
cuuucaucacuaccu

SEQ ID NO: 2014314 - RNA, 20 nt, Homo sapiens
ucaaagaugccccauuccuu

SEQ ID NO: 2014315 - RNA, 16 nt, Homo sapiens
aagccagcaggagcuc

SEQ ID NO: 2014316 - RNA, 22 nt, Homo sapiens
ccugcugacuauuugaccccca

SEQ ID NO: 2014317 - RNA, 20 nt, Homo sapiens
cuaucgucaggaaaccaaau

SEQ ID NO: 2014318 - RNA, 16 nt, Homo sapiens
uucuuaaaauacucac

SEQ ID NO: 2014319 - RNA, 18 nt, Homo sapiens
ccucaaugaaugggaugu

SEQ ID NO: 2014320 - RNA, 16 nt, Homo sapiens
acucugggcacaagca

SEQ ID NO: 2014321 - RNA, 17 nt, Homo sapiens
auaaauuaaaauuacac

SEQ ID NO: 2014322 - RNA, 15 nt, Homo sapiens
uucucucuccagggu

SEQ ID NO: 2014323 - RNA, 10 nt, Homo sapiens
aggugucuga

SEQ ID NO: 2014324 - RNA, 13 nt, Homo sapiens
agcugcucauuuc

SEQ ID NO: 2014325 - RNA, 14 nt, Homo sapiens
aaccagaccacuca

SEQ ID NO: 2014326 - RNA, 14 nt, Homo sapiens
gaaguauugcugaa

SEQ ID NO: 2014327 - RNA, 20 nt, Homo sapiens
uuugaauauauacauucuau

SEQ ID NO: 2014328 - RNA, 20 nt, Homo sapiens
gccccuggucccucugcagu

SEQ ID NO: 2014329 - RNA, 21 nt, Homo sapiens
uccuauuaaucuucagcugaa

SEQ ID NO: 2014330 - RNA, 15 nt, Homo sapiens
uaagcugcuggaaac

SEQ ID NO: 2014331 - RNA, 13 nt, Homo sapiens
cagugaccuuccu

SEQ ID NO: 2014332 - RNA, 21 nt, Homo sapiens
acgacaaagcaucauuguaaa

SEQ ID NO: 2014333 - RNA, 19 nt, Homo sapiens
gugcaguggugccaucacc

SEQ ID NO: 2014334 - RNA, 19 nt, Homo sapiens
uagaaauauagccaaaaau

SEQ ID NO: 2014335 - RNA, 22 nt, Homo sapiens
uggguuccaauccuggcucugu

SEQ ID NO: 2014336 - RNA, 20 nt, Homo sapiens
caggggcuucacccaugaaa

SEQ ID NO: 2014337 - RNA, 23 nt, Homo sapiens
aguauaaacccauuuuggugcaa

SEQ ID NO: 2014338 - RNA, 20 nt, Homo sapiens
uuaauccguaguuauuuugc

SEQ ID NO: 2014339 - RNA, 12 nt, Homo sapiens
auuuaugaaggc

SEQ ID NO: 2014340 - RNA, 13 nt, Homo sapiens
gcuuaggucauga

SEQ ID NO: 2014341 - RNA, 21 nt, Homo sapiens
ucaacaacacagcaaaaccau

SEQ ID NO: 2014342 - RNA, 15 nt, Homo sapiens
auuucagcagggaug

SEQ ID NO: 2014343 - RNA, 13 nt, Homo sapiens
aacuuuauugcau

SEQ ID NO: 2014344 - RNA, 21 nt, Homo sapiens
ccucccuguccccugagguua

SEQ ID NO: 2014345 - RNA, 17 nt, Homo sapiens
cugaacauguacacugg

SEQ ID NO: 2014346 - RNA, 23 nt, Homo sapiens
ggcgugggggcucaugccuguaa

SEQ ID NO: 2014347 - RNA, 21 nt, Homo sapiens
aauuggcuuuucauagugcuc

SEQ ID NO: 2014348 - RNA, 12 nt, Homo sapiens
uuggaucuugaa

SEQ ID NO: 2014349 - RNA, 20 nt, Homo sapiens
acauaaacaccauuuaguca

SEQ ID NO: 2014350 - RNA, 20 nt, Homo sapiens
gacucaagugauccuccugu

SEQ ID NO: 2014351 - RNA, 17 nt, Homo sapiens
auugucgguuaccucug

SEQ ID NO: 2014352 - RNA, 22 nt, Homo sapiens
ucuucaagacgacagcucugua

SEQ ID NO: 2014353 - RNA, 16 nt, Homo sapiens
uguuagcccaagguua

SEQ ID NO: 2014354 - RNA, 16 nt, Homo sapiens
ccuaggaggcuggcca

SEQ ID NO: 2014355 - RNA, 14 nt, Homo sapiens
guauugagggccag

SEQ ID NO: 2014356 - RNA, 23 nt, Homo sapiens
ggacagcccuuccucccauuucc

SEQ ID NO: 2014357 - RNA, 13 nt, Homo sapiens
aaaccuguuggcu

SEQ ID NO: 2014358 - RNA, 15 nt, Homo sapiens
ugcagucugggugcu

SEQ ID NO: 2014359 - RNA, 15 nt, Homo sapiens
gcagggaggggcaug

SEQ ID NO: 2014360 - RNA, 14 nt, Homo sapiens
gagcuggaaggcag

SEQ ID NO: 2014361 - RNA, 15 nt, Homo sapiens
ccaaauuaucuugau

SEQ ID NO: 2014362 - RNA, 14 nt, Homo sapiens
ccuuacuugcacug

SEQ ID NO: 2014363 - RNA, 16 nt, Homo sapiens
gaccuggagacugaca

SEQ ID NO: 2014364 - RNA, 16 nt, Homo sapiens
aaucgggaaauuuaca

SEQ ID NO: 2014365 - RNA, 16 nt, Homo sapiens
ucuuggaagacuuaau

SEQ ID NO: 2014366 - RNA, 22 nt, Homo sapiens
acggugcugagacuacaggugu

SEQ ID NO: 2014367 - RNA, 22 nt, Homo sapiens
cuagggaggaccaaagggaugg

SEQ ID NO: 2014368 - RNA, 17 nt, Homo sapiens
cuggacagcagaagccu

SEQ ID NO: 2014369 - RNA, 16 nt, Homo sapiens
gaagauuagcauccca

SEQ ID NO: 2014370 - RNA, 14 nt, Homo sapiens
gaaguaagccucau

SEQ ID NO: 2014371 - RNA, 22 nt, Homo sapiens
caacaagcaagcucccaaggga

SEQ ID NO: 2014372 - RNA, 19 nt, Homo sapiens
ggcaacauaauaagacuuu

SEQ ID NO: 2014373 - RNA, 14 nt, Homo sapiens
uacuggaaaccuaa

SEQ ID NO: 2014374 - RNA, 20 nt, Homo sapiens
ugcugguguccugaccaccc

SEQ ID NO: 2014375 - RNA, 13 nt, Homo sapiens
cuagagacagaug

SEQ ID NO: 2014376 - RNA, 15 nt, Homo sapiens
ccaggccaucuucca

SEQ ID NO: 2014377 - RNA, 14 nt, Homo sapiens
cugcggcuguguag

SEQ ID NO: 2014378 - RNA, 19 nt, Homo sapiens
uuucugcgggucauauuca

SEQ ID NO: 2014379 - RNA, 15 nt, Homo sapiens
acccuaccaugaauc

SEQ ID NO: 2014380 - RNA, 13 nt, Homo sapiens
cauauagacugua

SEQ ID NO: 2014381 - RNA, 20 nt, Homo sapiens
uaggggaacagaccagugac

SEQ ID NO: 2014382 - RNA, 16 nt, Homo sapiens
uuauaccgcagaguau

SEQ ID NO: 2014383 - RNA, 13 nt, Homo sapiens
cugggcaaucaga

SEQ ID NO: 2014384 - RNA, 20 nt, Homo sapiens
aauucacagugcucuuuucu

SEQ ID NO: 2014385 - RNA, 17 nt, Homo sapiens
aguuuuaaggacuucau

SEQ ID NO: 2014386 - RNA, 17 nt, Homo sapiens
guaucuauuuuccucua

SEQ ID NO: 2014387 - RNA, 18 nt, Homo sapiens
cucuccaaauacugaugg

SEQ ID NO: 2014388 - RNA, 14 nt, Homo sapiens
gggugugucugcuc

SEQ ID NO: 2014389 - RNA, 20 nt, Homo sapiens
agaaauucauuaugcugcua

SEQ ID NO: 2014390 - RNA, 16 nt, Homo sapiens
agaggcucagcacuuu

SEQ ID NO: 2014391 - RNA, 15 nt, Homo sapiens
ugauaaaacacugcc

SEQ ID NO: 2014392 - RNA, 15 nt, Homo sapiens
ucacaagauggaauu

SEQ ID NO: 2014393 - RNA, 20 nt, Homo sapiens
aagugguuuguagacuuccu

SEQ ID NO: 2014394 - RNA, 18 nt, Homo sapiens
uaugugagaacuuuucau

SEQ ID NO: 2014395 - RNA, 13 nt, Homo sapiens
gcaucucagccua

SEQ ID NO: 2014396 - RNA, 19 nt, Homo sapiens
agggaaggcugcuguguag

SEQ ID NO: 2014397 - RNA, 14 nt, Homo sapiens
uauuuaacucuuaa

SEQ ID NO: 2014398 - RNA, 14 nt, Homo sapiens
caaaugacccaaag

SEQ ID NO: 2014399 - RNA, 20 nt, Homo sapiens
accacguuaacugcauuuua

SEQ ID NO: 2014400 - RNA, 20 nt, Homo sapiens
gacaaggggagggccaggau

SEQ ID NO: 2014401 - RNA, 13 nt, Homo sapiens
uuauugugccuca

SEQ ID NO: 2014402 - RNA, 20 nt, Homo sapiens
gaugcucauuccaugacucu

SEQ ID NO: 2014403 - RNA, 17 nt, Homo sapiens
uggaauuuggacaagug

SEQ ID NO: 2014404 - RNA, 19 nt, Homo sapiens
ucuugcgggucugucaggg

SEQ ID NO: 2014405 - RNA, 21 nt, Homo sapiens
cuuguucauaagauuaugaaa

SEQ ID NO: 2014406 - RNA, 22 nt, Homo sapiens
cugucacguucuggaacauucu

SEQ ID NO: 2014407 - RNA, 19 nt, Homo sapiens
agcauucucuccauuucac

SEQ ID NO: 2014408 - RNA, 15 nt, Homo sapiens
acaggaggaguauga

SEQ ID NO: 2014409 - RNA, 13 nt, Homo sapiens
auaugagcuuuau

SEQ ID NO: 2014410 - RNA, 16 nt, Homo sapiens
uuaaaacucuggugau

SEQ ID NO: 2014411 - RNA, 19 nt, Homo sapiens
cgucuaaacuguuuacuca

SEQ ID NO: 2014412 - RNA, 13 nt, Homo sapiens
cccaggccaggga

SEQ ID NO: 2014413 - RNA, 14 nt, Homo sapiens
uuaaauauugucau

SEQ ID NO: 2014414 - RNA, 13 nt, Homo sapiens
uccauuauaaaca

SEQ ID NO: 2014415 - RNA, 14 nt, Homo sapiens
aggagauacugaac

SEQ ID NO: 2014416 - RNA, 13 nt, Homo sapiens
ugaaacacuggac

SEQ ID NO: 2014417 - RNA, 23 nt, Homo sapiens
aacauauuggaauguacauguca

SEQ ID NO: 2014418 - RNA, 18 nt, Homo sapiens
aacccuuuuccuccagac

SEQ ID NO: 2014419 - RNA, 17 nt, Homo sapiens
auuauuucaacuaaugu

SEQ ID NO: 2014420 - RNA, 17 nt, Homo sapiens
auggaggccuaccucuc

SEQ ID NO: 2014421 - RNA, 17 nt, Homo sapiens
auggccuuggagggcau

SEQ ID NO: 2014422 - RNA, 16 nt, Homo sapiens
uuaauuggagugcagc

SEQ ID NO: 2014423 - RNA, 15 nt, Homo sapiens
ugcccggugccaucu

SEQ ID NO: 2014424 - RNA, 15 nt, Homo sapiens
aggaagauggagguu

SEQ ID NO: 2014425 - RNA, 15 nt, Homo sapiens
cuucucauacgucca

SEQ ID NO: 2014426 - RNA, 21 nt, Homo sapiens
ugcauaguucccauguuaaau

SEQ ID NO: 2014427 - RNA, 23 nt, Homo sapiens
auccauugccaucagugaucuca

SEQ ID NO: 2014428 - RNA, 12 nt, Homo sapiens
uuucaaaauucu

SEQ ID NO: 2014429 - RNA, 13 nt, Homo sapiens
aaaggaauggccu

SEQ ID NO: 2014430 - RNA, 16 nt, Homo sapiens
gaacaaagagagcuca

SEQ ID NO: 2014431 - RNA, 21 nt, Homo sapiens
auucuuuguauuaccaaagca

SEQ ID NO: 2014432 - RNA, 20 nt, Homo sapiens
ugcccaagcuggagugaagu

SEQ ID NO: 2014433 - RNA, 14 nt, Homo sapiens
auggcucuaaaaag

SEQ ID NO: 2014434 - RNA, 21 nt, Homo sapiens
accagggagcugcaggggcau

SEQ ID NO: 2014435 - RNA, 19 nt, Homo sapiens
cuggaaggugccacuccag

SEQ ID NO: 2014436 - RNA, 13 nt, Homo sapiens
acaaauuccacau

SEQ ID NO: 2014437 - RNA, 23 nt, Homo sapiens
agauuaagagauggguuugacaa

SEQ ID NO: 2014438 - RNA, 17 nt, Homo sapiens
guuggccucagggccag

SEQ ID NO: 2014439 - RNA, 14 nt, Homo sapiens
cauagcgacagugu

SEQ ID NO: 2014440 - RNA, 21 nt, Homo sapiens
uacaacauaaucuaguuuaca

SEQ ID NO: 2014441 - RNA, 16 nt, Homo sapiens
gaagaaguaguuuacu

SEQ ID NO: 2014442 - RNA, 13 nt, Homo sapiens
aggaaagggauug

SEQ ID NO: 2014443 - RNA, 22 nt, Homo sapiens
ccuccauaugcuguacaugaca

SEQ ID NO: 2014444 - RNA, 15 nt, Homo sapiens
cagggcuuaccugua

SEQ ID NO: 2014445 - RNA, 15 nt, Homo sapiens
uuuagugauacugga

SEQ ID NO: 2014446 - RNA, 16 nt, Homo sapiens
augccccggccaccuc

SEQ ID NO: 2014447 - RNA, 22 nt, Homo sapiens
cgcucugccauucaacucggaa

SEQ ID NO: 2014448 - RNA, 15 nt, Homo sapiens
gacccaggcaccugc

SEQ ID NO: 2014449 - RNA, 12 nt, Homo sapiens
aaagaacaugua

SEQ ID NO: 2014450 - RNA, 17 nt, Homo sapiens
cccugcacacacaugca

SEQ ID NO: 2014451 - RNA, 12 nt, Homo sapiens
uagugugaauua

SEQ ID NO: 2014452 - RNA, 14 nt, Homo sapiens
gugugugugcacac

SEQ ID NO: 2014453 - RNA, 21 nt, Homo sapiens
uccucaauggaaccaaauaua

SEQ ID NO: 2014454 - RNA, 20 nt, Homo sapiens
aaaacaucuuaguugaugcu

SEQ ID NO: 2014455 - RNA, 17 nt, Homo sapiens
gaagucuugucucaaga

SEQ ID NO: 2014456 - RNA, 24 nt, Homo sapiens
aggauucuaccugaacugaaagga

SEQ ID NO: 2014457 - RNA, 15 nt, Homo sapiens
aucucaguaccccau

SEQ ID NO: 2014458 - RNA, 19 nt, Homo sapiens
ucuggcugccccaaccugc

SEQ ID NO: 2014459 - RNA, 16 nt, Homo sapiens
uaugaaaacuagcauu

SEQ ID NO: 2014460 - RNA, 11 nt, Homo sapiens
gcccucaccag

SEQ ID NO: 2014461 - RNA, 17 nt, Homo sapiens
gagcaaaaggcagcuca

SEQ ID NO: 2014462 - RNA, 22 nt, Homo sapiens
ugagcuugcuggagaguggcau

SEQ ID NO: 2014463 - RNA, 20 nt, Homo sapiens
agacugaagauggaaaaagu

SEQ ID NO: 2014464 - RNA, 22 nt, Homo sapiens
ugaaacccuugagcucaaguga

SEQ ID NO: 2014465 - RNA, 22 nt, Homo sapiens
cuccaaggaccucucucaaugc

SEQ ID NO: 2014466 - RNA, 21 nt, Homo sapiens
aaaguucacauuaacucaggc

SEQ ID NO: 2014467 - RNA, 19 nt, Homo sapiens
uaaaaugaaaugcauuuug

SEQ ID NO: 2014468 - RNA, 23 nt, Homo sapiens
cuuaacuguccaguccagugaug

SEQ ID NO: 2014469 - RNA, 22 nt, Homo sapiens
gccuuuaucaagagacuccuga

SEQ ID NO: 2014470 - RNA, 18 nt, Homo sapiens
ccugacagcaaacacagu

SEQ ID NO: 2014471 - RNA, 12 nt, Homo sapiens
agccgcccugag

SEQ ID NO: 2014472 - RNA, 13 nt, Homo sapiens
acuugagcaccgu

SEQ ID NO: 2014473 - RNA, 17 nt, Homo sapiens
accccaaggaccugccu

SEQ ID NO: 2014474 - RNA, 12 nt, Homo sapiens
cgguaagcacuu

SEQ ID NO: 2014475 - RNA, 12 nt, Homo sapiens
cuauucaucuca

SEQ ID NO: 2014476 - RNA, 23 nt, Homo sapiens
acuuucuguguugaagcacuguu

SEQ ID NO: 2014477 - RNA, 14 nt, Homo sapiens
gacaguccacaggg

SEQ ID NO: 2014478 - RNA, 14 nt, Homo sapiens
gcauauauucaguu

SEQ ID NO: 2014479 - RNA, 17 nt, Homo sapiens
cagauguaaaugccaca

SEQ ID NO: 2014480 - RNA, 18 nt, Homo sapiens
gaucuccaaggaccaggu

SEQ ID NO: 2014481 - RNA, 17 nt, Homo sapiens
ucugauuucugcccuug

SEQ ID NO: 2014482 - RNA, 20 nt, Homo sapiens
ucaacagaugauaguccaau

SEQ ID NO: 2014483 - RNA, 21 nt, Homo sapiens
acagccacuaaaacacaaaaa

SEQ ID NO: 2014484 - RNA, 18 nt, Homo sapiens
uggcagcauugacucugu

SEQ ID NO: 2014485 - RNA, 18 nt, Homo sapiens
aagcaaugguugaugaua

SEQ ID NO: 2014486 - RNA, 15 nt, Homo sapiens
auaugaauucaagaa

SEQ ID NO: 2014487 - RNA, 14 nt, Homo sapiens
acccugggcagcua

SEQ ID NO: 2014488 - RNA, 23 nt, Homo sapiens
caggucuccuccaccgccauggc

SEQ ID NO: 2014489 - RNA, 20 nt, Homo sapiens
acaggcagauguuugccuca

SEQ ID NO: 2014490 - RNA, 21 nt, Homo sapiens
cuuuaagugcacaacauuaca

SEQ ID NO: 2014491 - RNA, 17 nt, Homo sapiens
augcuaauuuggggaaa

SEQ ID NO: 2014492 - RNA, 15 nt, Homo sapiens
auuuaagguacuuaa

SEQ ID NO: 2014493 - RNA, 13 nt, Homo sapiens
agcuucuguccug

SEQ ID NO: 2014494 - RNA, 19 nt, Homo sapiens
cauagcaagacacaucccu

SEQ ID NO: 2014495 - RNA, 18 nt, Homo sapiens
aaacuaguaauacugucu

SEQ ID NO: 2014496 - RNA, 16 nt, Homo sapiens
ccagagagaacaacag

SEQ ID NO: 2014497 - RNA, 20 nt, Homo sapiens
agggagaagugacauugcau

SEQ ID NO: 2014498 - RNA, 14 nt, Homo sapiens
ugacuuucauugga

SEQ ID NO: 2014499 - RNA, 17 nt, Homo sapiens
ugauggcuugacaugug

SEQ ID NO: 2014500 - RNA, 20 nt, Homo sapiens
auuguuauauuacuugccua

SEQ ID NO: 2014501 - RNA, 22 nt, Homo sapiens
gccugacuagaccccacccuga

SEQ ID NO: 2014502 - RNA, 13 nt, Homo sapiens
gcaauugcuucuc

SEQ ID NO: 2014503 - RNA, 20 nt, Homo sapiens
aauauucaugcgcugcuuuu

SEQ ID NO: 2014504 - RNA, 17 nt, Homo sapiens
auguguuucaaaaccau

SEQ ID NO: 2014505 - RNA, 14 nt, Homo sapiens
agaugaacucugaa

SEQ ID NO: 2014506 - RNA, 18 nt, Homo sapiens
ugagcgaaauugucuuua

SEQ ID NO: 2014507 - RNA, 23 nt, Homo sapiens
cuggccauguggcccuccagugu

SEQ ID NO: 2014508 - RNA, 15 nt, Homo sapiens
agggaaaagauuucu

SEQ ID NO: 2014509 - RNA, 16 nt, Homo sapiens
gcuuuuaaaugaccaa

SEQ ID NO: 2014510 - RNA, 20 nt, Homo sapiens
cauagcugggauuugaacug

SEQ ID NO: 2014511 - RNA, 14 nt, Homo sapiens
cuauccaaucaauc

SEQ ID NO: 2014512 - RNA, 17 nt, Homo sapiens
agcaggggauggcgcua

SEQ ID NO: 2014513 - RNA, 12 nt, Homo sapiens
gcaguuagcuca

SEQ ID NO: 2014514 - RNA, 20 nt, Homo sapiens
gggacaagacaaaaccaaaa

SEQ ID NO: 2014515 - RNA, 17 nt, Homo sapiens
gccaagugaguugaaua

SEQ ID NO: 2014516 - RNA, 13 nt, Homo sapiens
cuuaagcacuuug

SEQ ID NO: 2014517 - RNA, 19 nt, Homo sapiens
agggugcagcccucuugcc

SEQ ID NO: 2014518 - RNA, 17 nt, Homo sapiens
uuuccagcagaagacaa

SEQ ID NO: 2014519 - RNA, 20 nt, Homo sapiens
aaaugcugugcaaacagugu

SEQ ID NO: 2014520 - RNA, 13 nt, Homo sapiens
ugaacuugccuua

SEQ ID NO: 2014521 - RNA, 23 nt, Homo sapiens
auaucauggaauuuccauugaca

SEQ ID NO: 2014522 - RNA, 17 nt, Homo sapiens
gugugacaccaccacug

SEQ ID NO: 2014523 - RNA, 14 nt, Homo sapiens
cacagcccauccau

SEQ ID NO: 2014524 - RNA, 15 nt, Homo sapiens
cacuucaccaaggaa

SEQ ID NO: 2014525 - RNA, 20 nt, Homo sapiens
gaaaagaaucggcaauguuu

SEQ ID NO: 2014526 - RNA, 19 nt, Homo sapiens
uugcaaacaacugaaaugu

SEQ ID NO: 2014527 - RNA, 23 nt, Homo sapiens
ccaucagugaauccugaaacugg

SEQ ID NO: 2014528 - RNA, 21 nt, Homo sapiens
uucagaacuguuaaaggucau

SEQ ID NO: 2014529 - RNA, 21 nt, Homo sapiens
aggcuguuuauauguucacag

SEQ ID NO: 2014530 - RNA, 15 nt, Homo sapiens
caucugcugcacaua

SEQ ID NO: 2014531 - RNA, 21 nt, Homo sapiens
uguauccauuaaccugggcau

SEQ ID NO: 2014532 - RNA, 19 nt, Homo sapiens
cccuagccuugcuuguuaa

SEQ ID NO: 2014533 - RNA, 22 nt, Homo sapiens
agaagggaagcuuuguuugaaa

SEQ ID NO: 2014534 - RNA, 13 nt, Homo sapiens
gguauaaugauac

SEQ ID NO: 2014535 - RNA, 19 nt, Homo sapiens
aggaccuuaagacagagua

SEQ ID NO: 2014536 - RNA, 18 nt, Homo sapiens
aauucauuguuuugcaaa

SEQ ID NO: 2014537 - RNA, 19 nt, Homo sapiens
uuccuugccacaaucacua

SEQ ID NO: 2014538 - RNA, 17 nt, Homo sapiens
cuguugucacaucucag

SEQ ID NO: 2014539 - RNA, 17 nt, Homo sapiens
gccaggaggccugcuag

SEQ ID NO: 2014540 - RNA, 19 nt, Homo sapiens
gcacaacaguucucuucua

SEQ ID NO: 2014541 - RNA, 18 nt, Homo sapiens
cacugcgggagcucugua

SEQ ID NO: 2014542 - RNA, 16 nt, Homo sapiens
ucuccugccaccaaga

SEQ ID NO: 2014543 - RNA, 18 nt, Homo sapiens
gacucgauguguacucua

SEQ ID NO: 2014544 - RNA, 14 nt, Homo sapiens
aucugaacucucaa

SEQ ID NO: 2014545 - RNA, 17 nt, Homo sapiens
uucuguugcugccucau

SEQ ID NO: 2014546 - RNA, 14 nt, Homo sapiens
ugcuccagaauuaa

SEQ ID NO: 2014547 - RNA, 14 nt, Homo sapiens
aguuauaaauacau

SEQ ID NO: 2014548 - RNA, 18 nt, Homo sapiens
agcucuuuccuaaugagc

SEQ ID NO: 2014549 - RNA, 21 nt, Homo sapiens
agacagggucucgcucuguug

SEQ ID NO: 2014550 - RNA, 21 nt, Homo sapiens
cucacugggccuccaaccaug

SEQ ID NO: 2014551 - RNA, 23 nt, Homo sapiens
cagccuccuaggcucccugaggu

SEQ ID NO: 2014552 - RNA, 16 nt, Homo sapiens
aacuucagguggauga

SEQ ID NO: 2014553 - RNA, 17 nt, Homo sapiens
gaacccuagcuguguca

SEQ ID NO: 2014554 - RNA, 23 nt, Homo sapiens
uggaacacaaugacuaaagacau

SEQ ID NO: 2014555 - RNA, 14 nt, Homo sapiens
agacaaagcaaagc

SEQ ID NO: 2014556 - RNA, 20 nt, Homo sapiens
cuuuggacacacacagcuuc

SEQ ID NO: 2014557 - RNA, 19 nt, Homo sapiens
guaaaggcuauacuugucu

SEQ ID NO: 2014558 - RNA, 15 nt, Homo sapiens
gcaggcguacagguu

SEQ ID NO: 2014559 - RNA, 21 nt, Homo sapiens
agaguuacauguuaacugagg

SEQ ID NO: 2014560 - RNA, 21 nt, Homo sapiens
agcccugucuguuugccacac

SEQ ID NO: 2014561 - RNA, 18 nt, Homo sapiens
cucuggacagaugaauac

SEQ ID NO: 2014562 - RNA, 18 nt, Homo sapiens
ugcccccagccccggggu

SEQ ID NO: 2014563 - RNA, 22 nt, Homo sapiens
aucuguguuuuauugacaucuc

SEQ ID NO: 2014564 - RNA, 22 nt, Homo sapiens
cucugaaacuuaauuacaucca

SEQ ID NO: 2014565 - RNA, 20 nt, Homo sapiens
uuggggaagccaggugagcu

SEQ ID NO: 2014566 - RNA, 13 nt, Homo sapiens
gcacuacucugug

SEQ ID NO: 2014567 - RNA, 20 nt, Homo sapiens
cagagcuuccuggggaccaa

SEQ ID NO: 2014568 - RNA, 19 nt, Homo sapiens
auuccuguucccaugagau

SEQ ID NO: 2014569 - RNA, 17 nt, Homo sapiens
ugcuucaguacuuguga

SEQ ID NO: 2014570 - RNA, 17 nt, Homo sapiens
gaagucuaagagugaag

SEQ ID NO: 2014571 - RNA, 20 nt, Homo sapiens
ccagugccauuccacuccac

SEQ ID NO: 2014572 - RNA, 21 nt, Homo sapiens
caaagcaccucaagugcaagg

SEQ ID NO: 2014573 - RNA, 22 nt, Homo sapiens
accccaacagcacccucuccag

SEQ ID NO: 2014574 - RNA, 21 nt, Homo sapiens
agcacccuggagagugcacau

SEQ ID NO: 2014575 - RNA, 17 nt, Homo sapiens
ccuacacacacacuccc

SEQ ID NO: 2014576 - RNA, 18 nt, Homo sapiens
ucuucacaggcacuccug

SEQ ID NO: 2014577 - RNA, 16 nt, Homo sapiens
gcuucuguaaucaaua

SEQ ID NO: 2014578 - RNA, 21 nt, Homo sapiens
ugacuuuucugacccauguuc

SEQ ID NO: 2014579 - RNA, 20 nt, Homo sapiens
ucaacacaaagacacaggaa

SEQ ID NO: 2014580 - RNA, 14 nt, Homo sapiens
aauucacacaaaga

SEQ ID NO: 2014581 - RNA, 18 nt, Homo sapiens
aucuaccacuguaugagu

SEQ ID NO: 2014582 - RNA, 19 nt, Homo sapiens
caucucucuggaguuuucu

SEQ ID NO: 2014583 - RNA, 16 nt, Homo sapiens
uccucagaggacaguu

SEQ ID NO: 2014584 - RNA, 15 nt, Homo sapiens
auauaauauauguca

SEQ ID NO: 2014585 - RNA, 18 nt, Homo sapiens
agagcagauucuagcaca

SEQ ID NO: 2014586 - RNA, 19 nt, Homo sapiens
aauuacuuauuguauuuau

SEQ ID NO: 2014587 - RNA, 22 nt, Homo sapiens
ucugucaggguuggaaagucca

SEQ ID NO: 2014588 - RNA, 15 nt, Homo sapiens
ugucauuacauagaa

SEQ ID NO: 2014589 - RNA, 13 nt, Homo sapiens
uugcauugccaag

SEQ ID NO: 2014590 - RNA, 21 nt, Homo sapiens
uggaaauguccaagcuaugua

SEQ ID NO: 2014591 - RNA, 16 nt, Homo sapiens
uggucaaguaguuuga

SEQ ID NO: 2014592 - RNA, 13 nt, Homo sapiens
ggagaaaugccag

SEQ ID NO: 2014593 - RNA, 15 nt, Homo sapiens
gaaccuuacuggcac

SEQ ID NO: 2014594 - RNA, 21 nt, Homo sapiens
ucucaccugggccuaucuucu

SEQ ID NO: 2014595 - RNA, 19 nt, Homo sapiens
caauuauuugaagauuuaa

SEQ ID NO: 2014596 - RNA, 17 nt, Homo sapiens
caucuugaucaaccaaa

SEQ ID NO: 2014597 - RNA, 16 nt, Homo sapiens
cuuuacauggaugcca

SEQ ID NO: 2014598 - RNA, 21 nt, Homo sapiens
cuccuucuucaaacaggaauu

SEQ ID NO: 2014599 - RNA, 22 nt, Homo sapiens
guaaguuacaugaaggcagcag

SEQ ID NO: 2014600 - RNA, 15 nt, Homo sapiens
aaggugaaccaaaga

SEQ ID NO: 2014601 - RNA, 22 nt, Homo sapiens
cuccuaggggaacagaccagug

SEQ ID NO: 2014602 - RNA, 22 nt, Homo sapiens
uucugugccagacauugcucuc

SEQ ID NO: 2014603 - RNA, 15 nt, Homo sapiens
cauccagguuuauga

SEQ ID NO: 2014604 - RNA, 14 nt, Homo sapiens
uggaaauacacuca

SEQ ID NO: 2014605 - RNA, 19 nt, Homo sapiens
cagucccuaaaaacacaga

SEQ ID NO: 2014606 - RNA, 21 nt, Homo sapiens
cuagcucacacucauccacac

SEQ ID NO: 2014607 - RNA, 15 nt, Homo sapiens
gugaagcugggagaa

SEQ ID NO: 2014608 - RNA, 19 nt, Homo sapiens
auaaccuuuauaugauaua

SEQ ID NO: 2014609 - RNA, 16 nt, Homo sapiens
gaaauuuacacaguga

SEQ ID NO: 2014610 - RNA, 16 nt, Homo sapiens
auccauuaaaaauggg

SEQ ID NO: 2014611 - RNA, 17 nt, Homo sapiens
aucauuggaauuccuug

SEQ ID NO: 2014612 - RNA, 21 nt, Homo sapiens
aggccugggaccucccacugc

SEQ ID NO: 2014613 - RNA, 15 nt, Homo sapiens
uccugaacuggccac

SEQ ID NO: 2014614 - RNA, 19 nt, Homo sapiens
uaguggguacaucaagucc

SEQ ID NO: 2014615 - RNA, 17 nt, Homo sapiens
agaaccucuccaaagag

SEQ ID NO: 2014616 - RNA, 21 nt, Homo sapiens
ucuuugguuccucauggcugu

SEQ ID NO: 2014617 - RNA, 15 nt, Homo sapiens
ccacuuugcucugaa

SEQ ID NO: 2014618 - RNA, 13 nt, Homo sapiens
uuagucaugugac

SEQ ID NO: 2014619 - RNA, 23 nt, Homo sapiens
ucccaagagcauaacuguucuca

SEQ ID NO: 2014620 - RNA, 19 nt, Homo sapiens
cuggguaugcucugugaca

SEQ ID NO: 2014621 - RNA, 21 nt, Homo sapiens
gcuguugaagaaacuacuaau

SEQ ID NO: 2014622 - RNA, 16 nt, Homo sapiens
agcucccgggcacauc

SEQ ID NO: 2014623 - RNA, 21 nt, Homo sapiens
aaccaacauuaaaacucauaa

SEQ ID NO: 2014624 - RNA, 19 nt, Homo sapiens
cuccacuuggcuccucuca

SEQ ID NO: 2014625 - RNA, 17 nt, Homo sapiens
aucggucagaagcacca

SEQ ID NO: 2014626 - RNA, 21 nt, Homo sapiens
aaaagaucuugaauagucuca

SEQ ID NO: 2014627 - RNA, 16 nt, Homo sapiens
gcaggcccaugggagg

SEQ ID NO: 2014628 - RNA, 23 nt, Homo sapiens
uauauaaacaauaaaaacaacuu

SEQ ID NO: 2014629 - RNA, 13 nt, Homo sapiens
ugguauggccuua

SEQ ID NO: 2014630 - RNA, 19 nt, Homo sapiens
agcacauucgggccauuuc

SEQ ID NO: 2014631 - RNA, 15 nt, Homo sapiens
gaggcuaauucugca

SEQ ID NO: 2014632 - RNA, 18 nt, Homo sapiens
aagggcagcuccacaggg

SEQ ID NO: 2014633 - RNA, 14 nt, Homo sapiens
ggucagagugaauu

SEQ ID NO: 2014634 - RNA, 17 nt, Homo sapiens
ccugccgucaccaccac

SEQ ID NO: 2014635 - RNA, 19 nt, Homo sapiens
aagaagcauacaacuuugg

SEQ ID NO: 2014636 - RNA, 15 nt, Homo sapiens
ccaucucauucaggu

SEQ ID NO: 2014637 - RNA, 20 nt, Homo sapiens
caacuguuucccugcugaau

SEQ ID NO: 2014638 - RNA, 16 nt, Homo sapiens
gagaaguugcugcuug

SEQ ID NO: 2014639 - RNA, 13 nt, Homo sapiens
agcauuucuugau

SEQ ID NO: 2014640 - RNA, 13 nt, Homo sapiens
ccaaacagugacu

SEQ ID NO: 2014641 - RNA, 13 nt, Homo sapiens
cccaucagugcca

SEQ ID NO: 2014642 - RNA, 17 nt, Homo sapiens
auuuuggaaccuaauaa

SEQ ID NO: 2014643 - RNA, 18 nt, Homo sapiens
acuuucucaaauuauuaa

SEQ ID NO: 2014644 - RNA, 19 nt, Homo sapiens
gaguuuuacucuuguugcc

SEQ ID NO: 2014645 - RNA, 13 nt, Homo sapiens
ccagcaguuguaa

SEQ ID NO: 2014646 - RNA, 11 nt, Homo sapiens
cucacucccua

SEQ ID NO: 2014647 - RNA, 17 nt, Homo sapiens
caguggcgugaucucag

SEQ ID NO: 2014648 - RNA, 22 nt, Homo sapiens
uucuuuguaaugaaaaccacau

SEQ ID NO: 2014649 - RNA, 16 nt, Homo sapiens
ggccaucacuuucauu

SEQ ID NO: 2014650 - RNA, 21 nt, Homo sapiens
cacacaucccagcccaaucca

SEQ ID NO: 2014651 - RNA, 20 nt, Homo sapiens
cuugcaugcuugcauaagag

SEQ ID NO: 2014652 - RNA, 18 nt, Homo sapiens
agagccuucaagugccaa

SEQ ID NO: 2014653 - RNA, 18 nt, Homo sapiens
aaauuuuggggggaacau

SEQ ID NO: 2014654 - RNA, 18 nt, Homo sapiens
ucacauucugcauacuaa

SEQ ID NO: 2014655 - RNA, 14 nt, Homo sapiens
auugcaggccaaac

SEQ ID NO: 2014656 - RNA, 18 nt, Homo sapiens
gaacuggaccaucuccaa

SEQ ID NO: 2014657 - RNA, 22 nt, Homo sapiens
uccaauuuuaauuuaguaaaug

SEQ ID NO: 2014658 - RNA, 15 nt, Homo sapiens
gcuggggcacuuuaa

SEQ ID NO: 2014659 - RNA, 22 nt, Homo sapiens
cauuuaccuuuucuccuacaaa

SEQ ID NO: 2014660 - RNA, 16 nt, Homo sapiens
agucugucauccagaa

SEQ ID NO: 2014661 - RNA, 20 nt, Homo sapiens
ccuuccagcacccugcaaaa

SEQ ID NO: 2014662 - RNA, 17 nt, Homo sapiens
ugcacuuauuugucaaa

SEQ ID NO: 2014663 - RNA, 17 nt, Homo sapiens
cuaaauggugcuuuaua

SEQ ID NO: 2014664 - RNA, 13 nt, Homo sapiens
aucuaaaccauau

SEQ ID NO: 2014665 - RNA, 19 nt, Homo sapiens
acuaucgguucaaguugau

SEQ ID NO: 2014666 - RNA, 18 nt, Homo sapiens
uagaugccagggcuggaa

SEQ ID NO: 2014667 - RNA, 12 nt, Homo sapiens
ccagauugcaac

SEQ ID NO: 2014668 - RNA, 23 nt, Homo sapiens
uaugagacguuuuuggaagagua

SEQ ID NO: 2014669 - RNA, 17 nt, Homo sapiens
auaaauuauagaaucua

SEQ ID NO: 2014670 - RNA, 18 nt, Homo sapiens
caacacaaacuggcuuaa

SEQ ID NO: 2014671 - RNA, 17 nt, Homo sapiens
aguucaccagacucuau

SEQ ID NO: 2014672 - RNA, 22 nt, Homo sapiens
gaaauuugugauggccaagaaa

SEQ ID NO: 2014673 - RNA, 22 nt, Homo sapiens
aaaucaggguuaguauugucca

SEQ ID NO: 2014674 - RNA, 16 nt, Homo sapiens
ucagaccacauuugaa

SEQ ID NO: 2014675 - RNA, 19 nt, Homo sapiens
uaacaguucacuuuuuaca

SEQ ID NO: 2014676 - RNA, 21 nt, Homo sapiens
gcuaguccggacccaccucac

SEQ ID NO: 2014677 - RNA, 18 nt, Homo sapiens
accagggacccuggagua

SEQ ID NO: 2014678 - RNA, 14 nt, Homo sapiens
gaauuauaucuaau

SEQ ID NO: 2014679 - RNA, 16 nt, Homo sapiens
gaaagcagaaaaucua

SEQ ID NO: 2014680 - RNA, 19 nt, Homo sapiens
uggcuucuaugagcccaga

SEQ ID NO: 2014681 - RNA, 20 nt, Homo sapiens
aaacaguaaugacucucuga

SEQ ID NO: 2014682 - RNA, 15 nt, Homo sapiens
ucuucucuccagugu

SEQ ID NO: 2014683 - RNA, 12 nt, Homo sapiens
gugaauugccag

SEQ ID NO: 2014684 - RNA, 17 nt, Homo sapiens
acuggcucaaagacaau

SEQ ID NO: 2014685 - RNA, 19 nt, Homo sapiens
ugaagagcuugcuuugauu

SEQ ID NO: 2014686 - RNA, 17 nt, Homo sapiens
auuucugugaagcaaaa

SEQ ID NO: 2014687 - RNA, 14 nt, Homo sapiens
cauauauugcauuu

SEQ ID NO: 2014688 - RNA, 22 nt, Homo sapiens
aaagccuugugugaacucacca

SEQ ID NO: 2014689 - RNA, 23 nt, Homo sapiens
caucauuaauaccuaaacuguau

SEQ ID NO: 2014690 - RNA, 11 nt, Homo sapiens
acacacagcac

SEQ ID NO: 2014691 - RNA, 21 nt, Homo sapiens
aucccuaacaucaugcauuca

SEQ ID NO: 2014692 - RNA, 20 nt, Homo sapiens
uuuaucaugaagcacaucaa

SEQ ID NO: 2014693 - RNA, 14 nt, Homo sapiens
uacugaaaauccaa

SEQ ID NO: 2014694 - RNA, 14 nt, Homo sapiens
acuaauuuuugcuu

SEQ ID NO: 2014695 - RNA, 22 nt, Homo sapiens
cuccccagacucucagguggag

SEQ ID NO: 2014696 - RNA, 23 nt, Homo sapiens
auccuguaguacaagauuaucuu

SEQ ID NO: 2014697 - RNA, 20 nt, Homo sapiens
uaaagccuguggguuugguc

SEQ ID NO: 2014698 - RNA, 23 nt, Homo sapiens
cuaccucugagaagacacaaggu

SEQ ID NO: 2014699 - RNA, 19 nt, Homo sapiens
ccacaugugacacauaugc

SEQ ID NO: 2014700 - RNA, 22 nt, Homo sapiens
uuccagccaucaccuuagacca

SEQ ID NO: 2014701 - RNA, 19 nt, Homo sapiens
guacauucacagcacgggc

SEQ ID NO: 2014702 - RNA, 17 nt, Homo sapiens
aauaaucccaaggcaaa

SEQ ID NO: 2014703 - RNA, 16 nt, Homo sapiens
uucucuauugcaagca

SEQ ID NO: 2014704 - RNA, 13 nt, Homo sapiens
uggagaaccucau

SEQ ID NO: 2014705 - RNA, 17 nt, Homo sapiens
gaaaggcagccuccuua

SEQ ID NO: 2014706 - RNA, 18 nt, Homo sapiens
ccuuaaguauaacuaauu

SEQ ID NO: 2014707 - RNA, 14 nt, Homo sapiens
ucucagauuuccac

SEQ ID NO: 2014708 - RNA, 21 nt, Homo sapiens
augcuuccgccuuuccggggc

SEQ ID NO: 2014709 - RNA, 16 nt, Homo sapiens
caaggguuuguugaac

SEQ ID NO: 2014710 - RNA, 15 nt, Homo sapiens
guucuucuuccugaa

SEQ ID NO: 2014711 - RNA, 22 nt, Homo sapiens
ccauaucugugcaauggaauau

SEQ ID NO: 2014712 - RNA, 19 nt, Homo sapiens
uuaaggguuaaaucagaga

SEQ ID NO: 2014713 - RNA, 19 nt, Homo sapiens
auauucgguuggaaccuaa

SEQ ID NO: 2014714 - RNA, 15 nt, Homo sapiens
uaaauuuuaucucag

SEQ ID NO: 2014715 - RNA, 15 nt, Homo sapiens
uccugugucaaucca

SEQ ID NO: 2014716 - RNA, 19 nt, Homo sapiens
gaaguggcugccaaagaga

SEQ ID NO: 2014717 - RNA, 15 nt, Homo sapiens
uaaacucagaucuga

SEQ ID NO: 2014718 - RNA, 20 nt, Homo sapiens
agucaugaagcccaagugaa

SEQ ID NO: 2014719 - RNA, 13 nt, Homo sapiens
uacaauucauugu

SEQ ID NO: 2014720 - RNA, 16 nt, Homo sapiens
ccugacuucuguuuag

SEQ ID NO: 2014721 - RNA, 18 nt, Homo sapiens
cuaaucaguuguaacaau

SEQ ID NO: 2014722 - RNA, 19 nt, Homo sapiens
cuuuaaaaaaaaaucuugu

SEQ ID NO: 2014723 - RNA, 21 nt, Homo sapiens
ugccagacccacugaaaugac

SEQ ID NO: 2014724 - RNA, 13 nt, Homo sapiens
ugggcacuggccc

SEQ ID NO: 2014725 - RNA, 14 nt, Homo sapiens
accaagccucugga

SEQ ID NO: 2014726 - RNA, 21 nt, Homo sapiens
agcuaagagcaguacucugaa

SEQ ID NO: 2014727 - RNA, 20 nt, Homo sapiens
ugagucgagauugcacugcu

SEQ ID NO: 2014728 - RNA, 21 nt, Homo sapiens
caucagacuccugugcaacuu

SEQ ID NO: 2014729 - RNA, 16 nt, Homo sapiens
cugcgggccagggucc

SEQ ID NO: 2014730 - RNA, 19 nt, Homo sapiens
auguuaguuuugcuccuuc

SEQ ID NO: 2014731 - RNA, 22 nt, Homo sapiens
ucgucugcgauuuuaucuguua

SEQ ID NO: 2014732 - RNA, 18 nt, Homo sapiens
ugugggccucaaggguag

SEQ ID NO: 2014733 - RNA, 16 nt, Homo sapiens
ccagcacuuugggagg

SEQ ID NO: 2014734 - RNA, 16 nt, Homo sapiens
ggcucuugacuacuug

SEQ ID NO: 2014735 - RNA, 16 nt, Homo sapiens
ugaauuucaguccuua

SEQ ID NO: 2014736 - RNA, 22 nt, Homo sapiens
cacuuagacacguguuguucca

SEQ ID NO: 2014737 - RNA, 18 nt, Homo sapiens
ggaaguaaccauuugcac

SEQ ID NO: 2014738 - RNA, 13 nt, Homo sapiens
gcacugacagugg

SEQ ID NO: 2014739 - RNA, 15 nt, Homo sapiens
auuuuauuaugcaug

SEQ ID NO: 2014740 - RNA, 23 nt, Homo sapiens
ccauaagaggugaucucugggag

SEQ ID NO: 2014741 - RNA, 13 nt, Homo sapiens
aggaagggccaga

SEQ ID NO: 2014742 - RNA, 20 nt, Homo sapiens
gaguccagcacccagguaaa

SEQ ID NO: 2014743 - RNA, 16 nt, Homo sapiens
agaauuuggggcuucc

SEQ ID NO: 2014744 - RNA, 24 nt, Homo sapiens
aggucugacaguagcucuuagacu

SEQ ID NO: 2014745 - RNA, 17 nt, Homo sapiens
aauaauuuuccugugac

SEQ ID NO: 2014746 - RNA, 14 nt, Homo sapiens
uaaaguacugggau

SEQ ID NO: 2014747 - RNA, 16 nt, Homo sapiens
auuucacaagcuauuu

SEQ ID NO: 2014748 - RNA, 16 nt, Homo sapiens
auuuucuuaaaccaac

SEQ ID NO: 2014749 - RNA, 21 nt, Homo sapiens
ccccugcugcugucaccucuc

SEQ ID NO: 2014750 - RNA, 13 nt, Homo sapiens
ugcugugcuaugg

SEQ ID NO: 2014751 - RNA, 21 nt, Homo sapiens
caguguggggauaaagacaga

SEQ ID NO: 2014752 - RNA, 22 nt, Homo sapiens
uaugaggcauuuguuugaacug

SEQ ID NO: 2014753 - RNA, 13 nt, Homo sapiens
uagaccuaacugu

SEQ ID NO: 2014754 - RNA, 13 nt, Homo sapiens
aaggucuaucuac

SEQ ID NO: 2014755 - RNA, 20 nt, Homo sapiens
agugaaaaugccacauuuug

SEQ ID NO: 2014756 - RNA, 17 nt, Homo sapiens
accaugucguaguuacu

SEQ ID NO: 2014757 - RNA, 19 nt, Homo sapiens
ucugcauguuacauaagau

SEQ ID NO: 2014758 - RNA, 22 nt, Homo sapiens
agcaucugccaggacacugccu

SEQ ID NO: 2014759 - RNA, 20 nt, Homo sapiens
uuucaccccacagacacuua

SEQ ID NO: 2014760 - RNA, 17 nt, Homo sapiens
acgccucccugagcacu

SEQ ID NO: 2014761 - RNA, 23 nt, Homo sapiens
uaauguuuuuugccacagcuuuu

SEQ ID NO: 2014762 - RNA, 13 nt, Homo sapiens
cuuugcaaagacc

SEQ ID NO: 2014763 - RNA, 19 nt, Homo sapiens
uggauuuucuacuguaaga

SEQ ID NO: 2014764 - RNA, 15 nt, Homo sapiens
guccucauucuugcc

SEQ ID NO: 2014765 - RNA, 13 nt, Homo sapiens
cccugcagaggaa

SEQ ID NO: 2014766 - RNA, 20 nt, Homo sapiens
gcaauucaugguucaaguau

SEQ ID NO: 2014767 - RNA, 13 nt, Homo sapiens
caaccaugcaaau

SEQ ID NO: 2014768 - RNA, 13 nt, Homo sapiens
cucacaugcuccu

SEQ ID NO: 2014769 - RNA, 13 nt, Homo sapiens
uguccauguguau

SEQ ID NO: 2014770 - RNA, 18 nt, Homo sapiens
cacuuucccacgucacuu

SEQ ID NO: 2014771 - RNA, 17 nt, Homo sapiens
cccagguacauccauga

SEQ ID NO: 2014772 - RNA, 16 nt, Homo sapiens
uggucgucaugcuguc

SEQ ID NO: 2014773 - RNA, 19 nt, Homo sapiens
ugcuguugggauauaguca

SEQ ID NO: 2014774 - RNA, 20 nt, Homo sapiens
ggaucguccuggauucacug

SEQ ID NO: 2014775 - RNA, 18 nt, Homo sapiens
agucacaccuuagugcua

SEQ ID NO: 2014776 - RNA, 21 nt, Homo sapiens
caguaacaaaauugacagcuu

SEQ ID NO: 2014777 - RNA, 15 nt, Homo sapiens
uauuaagaccaaaga

SEQ ID NO: 2014778 - RNA, 13 nt, Homo sapiens
gcggaucaucuaa

SEQ ID NO: 2014779 - RNA, 21 nt, Homo sapiens
uuugaagucuucccucagauu

SEQ ID NO: 2014780 - RNA, 14 nt, Homo sapiens
aacuucauuugaca

SEQ ID NO: 2014781 - RNA, 13 nt, Homo sapiens
agacucacauuua

SEQ ID NO: 2014782 - RNA, 21 nt, Homo sapiens
caguuuuuuaaaaauguguca

SEQ ID NO: 2014783 - RNA, 13 nt, Homo sapiens
uuauacacugucu

SEQ ID NO: 2014784 - RNA, 16 nt, Homo sapiens
aagcaggaagcucaga

SEQ ID NO: 2014785 - RNA, 21 nt, Homo sapiens
ugcggcucuggcccacugagc

SEQ ID NO: 2014786 - RNA, 14 nt, Homo sapiens
acugggggaaucaa

SEQ ID NO: 2014787 - RNA, 18 nt, Homo sapiens
cacaguaauacucauucc

SEQ ID NO: 2014788 - RNA, 17 nt, Homo sapiens
gcccagaugaucacuga

SEQ ID NO: 2014789 - RNA, 15 nt, Homo sapiens
augccuccuucccag

SEQ ID NO: 2014790 - RNA, 18 nt, Homo sapiens
cguucccagaccauggga

SEQ ID NO: 2014791 - RNA, 19 nt, Homo sapiens
acugcuggaaaaagcccua

SEQ ID NO: 2014792 - RNA, 19 nt, Homo sapiens
cagacaacuuguccugacu

SEQ ID NO: 2014793 - RNA, 15 nt, Homo sapiens
acacuggugccaacc

SEQ ID NO: 2014794 - RNA, 17 nt, Homo sapiens
aguuaauaaguugaugu

SEQ ID NO: 2014795 - RNA, 22 nt, Homo sapiens
cagcuuguucugggcucaggga

SEQ ID NO: 2014796 - RNA, 16 nt, Homo sapiens
agcaaagauuaaaugu

SEQ ID NO: 2014797 - RNA, 20 nt, Homo sapiens
ccugauaacaaccuggagac

SEQ ID NO: 2014798 - RNA, 23 nt, Homo sapiens
agaaagcuagaggugaacuagua

SEQ ID NO: 2014799 - RNA, 16 nt, Homo sapiens
aguuucguaugcacuc

SEQ ID NO: 2014800 - RNA, 22 nt, Homo sapiens
uucauuagggcaaagaucucag

SEQ ID NO: 2014801 - RNA, 19 nt, Homo sapiens
gacgccugauggugcugcu

SEQ ID NO: 2014802 - RNA, 18 nt, Homo sapiens
ucuauucuuuccaugaca

SEQ ID NO: 2014803 - RNA, 13 nt, Homo sapiens
ucagagacagaua

SEQ ID NO: 2014804 - RNA, 17 nt, Homo sapiens
gacuuauuaggacuuug

SEQ ID NO: 2014805 - RNA, 11 nt, Homo sapiens
uuggugacaau

SEQ ID NO: 2014806 - RNA, 17 nt, Homo sapiens
ucagccuaggcccucau

SEQ ID NO: 2014807 - RNA, 19 nt, Homo sapiens
aacaaaagcuuuucuuucc

SEQ ID NO: 2014808 - RNA, 14 nt, Homo sapiens
ccaaaauauauauu

SEQ ID NO: 2014809 - RNA, 16 nt, Homo sapiens
uauauaagccaaaaaa

SEQ ID NO: 2014810 - RNA, 14 nt, Homo sapiens
aucaugucauugau

SEQ ID NO: 2014811 - RNA, 16 nt, Homo sapiens
uauaacuguauuugaa

SEQ ID NO: 2014812 - RNA, 23 nt, Homo sapiens
gcuuccucccuggugugaacucu

SEQ ID NO: 2014813 - RNA, 13 nt, Homo sapiens
ggggcagcacaga

SEQ ID NO: 2014814 - RNA, 13 nt, Homo sapiens
gcaccagcaggca

SEQ ID NO: 2014815 - RNA, 14 nt, Homo sapiens
auauaaaguuacac

SEQ ID NO: 2014816 - RNA, 15 nt, Homo sapiens
ccugccacaguucac

SEQ ID NO: 2014817 - RNA, 21 nt, Homo sapiens
cuugaucuuaacaaagccuuu

SEQ ID NO: 2014818 - RNA, 13 nt, Homo sapiens
gguguaccaccca

SEQ ID NO: 2014819 - RNA, 19 nt, Homo sapiens
ccagaugauccuugcacag

SEQ ID NO: 2014820 - RNA, 16 nt, Homo sapiens
aaauugcuccauuccu

SEQ ID NO: 2014821 - RNA, 13 nt, Homo sapiens
acagcagagacca

SEQ ID NO: 2014822 - RNA, 21 nt, Homo sapiens
gucagcucucuccuuucaggg

SEQ ID NO: 2014823 - RNA, 22 nt, Homo sapiens
aucucagaaaauauuaaggaaa

SEQ ID NO: 2014824 - RNA, 16 nt, Homo sapiens
uccagcccagcacugg

SEQ ID NO: 2014825 - RNA, 20 nt, Homo sapiens
uuuacaaaacuacaugagaa

SEQ ID NO: 2014826 - RNA, 22 nt, Homo sapiens
gugaaaaaccuauuacuacuaa

SEQ ID NO: 2014827 - RNA, 22 nt, Homo sapiens
cuucugcuguauacuguacuga

SEQ ID NO: 2014828 - RNA, 13 nt, Homo sapiens
aaggagaaucaaa

SEQ ID NO: 2014829 - RNA, 18 nt, Homo sapiens
acagaucaucuuggaacu

SEQ ID NO: 2014830 - RNA, 20 nt, Homo sapiens
cagaccccgggucuccuugg

SEQ ID NO: 2014831 - RNA, 17 nt, Homo sapiens
cucaccugcucuucaag

SEQ ID NO: 2014832 - RNA, 21 nt, Homo sapiens
auccucccuuugguaccuuaa

SEQ ID NO: 2014833 - RNA, 22 nt, Homo sapiens
ugcuggagucuccugaggacac

SEQ ID NO: 2014834 - RNA, 16 nt, Homo sapiens
gcacaugccucucuca

SEQ ID NO: 2014835 - RNA, 22 nt, Homo sapiens
ccucuuucuuucuuuuguguug

SEQ ID NO: 2014836 - RNA, 15 nt, Homo sapiens
cuugagagacacugg

SEQ ID NO: 2014837 - RNA, 20 nt, Homo sapiens
auucccuuucccauccauaa

SEQ ID NO: 2014838 - RNA, 22 nt, Homo sapiens
agguugcuguugugcagugugc

SEQ ID NO: 2014839 - RNA, 14 nt, Homo sapiens
aguuauucauucug

SEQ ID NO: 2014840 - RNA, 23 nt, Homo sapiens
gaugaaagaauuggagugauaau

SEQ ID NO: 2014841 - RNA, 21 nt, Homo sapiens
ccuuucaucuggauucuacaa

SEQ ID NO: 2014842 - RNA, 21 nt, Homo sapiens
aggagaggcgggagaacugaa

SEQ ID NO: 2014843 - RNA, 20 nt, Homo sapiens
aguagacauuuuaacaagaa

SEQ ID NO: 2014844 - RNA, 18 nt, Homo sapiens
agucacuuccacuggugg

SEQ ID NO: 2014845 - RNA, 15 nt, Homo sapiens
cacuucauagaugag

SEQ ID NO: 2014846 - RNA, 12 nt, Homo sapiens
cccuggagcuca

SEQ ID NO: 2014847 - RNA, 16 nt, Homo sapiens
cggccuccacaugaca

SEQ ID NO: 2014848 - RNA, 17 nt, Homo sapiens
ugaagagauacagccuu

SEQ ID NO: 2014849 - RNA, 16 nt, Homo sapiens
uuguauucauguucau

SEQ ID NO: 2014850 - RNA, 15 nt, Homo sapiens
uaaacagugucauau

SEQ ID NO: 2014851 - RNA, 15 nt, Homo sapiens
caaggaauaauucaa

SEQ ID NO: 2014852 - RNA, 16 nt, Homo sapiens
auuuauuuauguagga

SEQ ID NO: 2014853 - RNA, 18 nt, Homo sapiens
cuugugacccagcacugc

SEQ ID NO: 2014854 - RNA, 23 nt, Homo sapiens
auccaggaagaccccagcacaga

SEQ ID NO: 2014855 - RNA, 22 nt, Homo sapiens
ggaauaucacacucgucuuucc

SEQ ID NO: 2014856 - RNA, 19 nt, Homo sapiens
cagauccgugcgugaagua

SEQ ID NO: 2014857 - RNA, 18 nt, Homo sapiens
aaggauauuuacuacuuu

SEQ ID NO: 2014858 - RNA, 20 nt, Homo sapiens
auguuccaauaaaacuuuau

SEQ ID NO: 2014859 - RNA, 21 nt, Homo sapiens
aacaaaauugacagcuuucua

SEQ ID NO: 2014860 - RNA, 15 nt, Homo sapiens
cuucuggauucuugg

SEQ ID NO: 2014861 - RNA, 12 nt, Homo sapiens
acugcucaagaa

SEQ ID NO: 2014862 - RNA, 15 nt, Homo sapiens
acauaucugacuucu

SEQ ID NO: 2014863 - RNA, 21 nt, Homo sapiens
uugagaaauuuuuuuuuccag

SEQ ID NO: 2014864 - RNA, 16 nt, Homo sapiens
aaacgcagacacugua

SEQ ID NO: 2014865 - RNA, 23 nt, Homo sapiens
ccgcaaucucggcucacugcaac

SEQ ID NO: 2014866 - RNA, 16 nt, Homo sapiens
ccaggugguacuuugg

SEQ ID NO: 2014867 - RNA, 17 nt, Homo sapiens
acacacacgccaaugca

SEQ ID NO: 2014868 - RNA, 16 nt, Homo sapiens
cuccccaucauuggua

SEQ ID NO: 2014869 - RNA, 14 nt, Homo sapiens
aaaguuuucuccca

SEQ ID NO: 2014870 - RNA, 21 nt, Homo sapiens
gucaucaaauauuaccaaaaa

SEQ ID NO: 2014871 - RNA, 22 nt, Homo sapiens
aacauuguacaagucacccagc

SEQ ID NO: 2014872 - RNA, 21 nt, Homo sapiens
gcaugucucucugccaagauc

SEQ ID NO: 2014873 - RNA, 21 nt, Homo sapiens
gccccccuccuugcucugcag

SEQ ID NO: 2014874 - RNA, 20 nt, Homo sapiens
gcccagagaacaagcacugu

SEQ ID NO: 2014875 - RNA, 17 nt, Homo sapiens
agcuacuauguacugcc

SEQ ID NO: 2014876 - RNA, 22 nt, Homo sapiens
aauauuuucagcaaaacuuucc

SEQ ID NO: 2014877 - RNA, 15 nt, Homo sapiens
cacugacaguuaaua

SEQ ID NO: 2014878 - RNA, 21 nt, Homo sapiens
gccagcuucgagcuacaugca

SEQ ID NO: 2014879 - RNA, 12 nt, Homo sapiens
uacgaucucuug

SEQ ID NO: 2014880 - RNA, 13 nt, Homo sapiens
auauaauccacuu

SEQ ID NO: 2014881 - RNA, 18 nt, Homo sapiens
ccaaaaauuauguguugc

SEQ ID NO: 2014882 - RNA, 18 nt, Homo sapiens
ugaggaguccagcacaac

SEQ ID NO: 2014883 - RNA, 11 nt, Homo sapiens
aacacaugaua

SEQ ID NO: 2014884 - RNA, 22 nt, Homo sapiens
uccaccacugcuuaagugccua

SEQ ID NO: 2014885 - RNA, 15 nt, Homo sapiens
cugacaaagacaucg

SEQ ID NO: 2014886 - RNA, 14 nt, Homo sapiens
aacccuucaacucc

SEQ ID NO: 2014887 - RNA, 20 nt, Homo sapiens
aucugacuucucacuuccua

SEQ ID NO: 2014888 - RNA, 18 nt, Homo sapiens
cucaugccagcagcacgu

SEQ ID NO: 2014889 - RNA, 15 nt, Homo sapiens
ucagauacacuguga

SEQ ID NO: 2014890 - RNA, 17 nt, Homo sapiens
cuauugaccgagcacau

SEQ ID NO: 2014891 - RNA, 24 nt, Homo sapiens
gcaccuugugucuguacacguguc

SEQ ID NO: 2014892 - RNA, 21 nt, Homo sapiens
guauuuguuccugccacugug

SEQ ID NO: 2014893 - RNA, 15 nt, Homo sapiens
cagccccuuucccca

SEQ ID NO: 2014894 - RNA, 17 nt, Homo sapiens
aauauuucaauaacuua

SEQ ID NO: 2014895 - RNA, 18 nt, Homo sapiens
cugggaccucccacugcc

SEQ ID NO: 2014896 - RNA, 18 nt, Homo sapiens
cacuguuucuugcuugua

SEQ ID NO: 2014897 - RNA, 14 nt, Homo sapiens
gugcagaucuuuga

SEQ ID NO: 2014898 - RNA, 18 nt, Homo sapiens
caagggccaguugguguu

SEQ ID NO: 2014899 - RNA, 19 nt, Homo sapiens
ugaauucaaagcaugucaa

SEQ ID NO: 2014900 - RNA, 20 nt, Homo sapiens
uccaacugucagaucuggau

SEQ ID NO: 2014901 - RNA, 13 nt, Homo sapiens
aucucccugcuuu

SEQ ID NO: 2014902 - RNA, 13 nt, Homo sapiens
uggucauccaaac

SEQ ID NO: 2014903 - RNA, 15 nt, Homo sapiens
caagcaggaagcuca

SEQ ID NO: 2014904 - RNA, 19 nt, Homo sapiens
uaaccucagugucauuuau

SEQ ID NO: 2014905 - RNA, 23 nt, Homo sapiens
gaagaaaagaaucacaguacuuu

SEQ ID NO: 2014906 - RNA, 20 nt, Homo sapiens
augggagauuaaaaccagag

SEQ ID NO: 2014907 - RNA, 22 nt, Homo sapiens
guguuuaaaacaugcacgguga

SEQ ID NO: 2014908 - RNA, 16 nt, Homo sapiens
gagaaagugacaugca

SEQ ID NO: 2014909 - RNA, 22 nt, Homo sapiens
agaaaugcaauaacucugggag

SEQ ID NO: 2014910 - RNA, 19 nt, Homo sapiens
guuucaucguaaacauacu

SEQ ID NO: 2014911 - RNA, 20 nt, Homo sapiens
agucaauggcuuguucauca

SEQ ID NO: 2014912 - RNA, 15 nt, Homo sapiens
ucucugaugcacugu

SEQ ID NO: 2014913 - RNA, 22 nt, Homo sapiens
ugauucuuccaaggaaauacau

SEQ ID NO: 2014914 - RNA, 15 nt, Homo sapiens
caaggccccagagac

SEQ ID NO: 2014915 - RNA, 15 nt, Homo sapiens
gaucagaauguuuca

SEQ ID NO: 2014916 - RNA, 20 nt, Homo sapiens
cacacagaaaauauacugua

SEQ ID NO: 2014917 - RNA, 13 nt, Homo sapiens
aaaagacauggaa

SEQ ID NO: 2014918 - RNA, 15 nt, Homo sapiens
agagguuucuugaau

SEQ ID NO: 2014919 - RNA, 19 nt, Homo sapiens
uauuucccauuugugccag

SEQ ID NO: 2014920 - RNA, 21 nt, Homo sapiens
uucuugaguuuagugaucuga

SEQ ID NO: 2014921 - RNA, 14 nt, Homo sapiens
guuucaacugugcu

SEQ ID NO: 2014922 - RNA, 14 nt, Homo sapiens
guugaaacuguuau

SEQ ID NO: 2014923 - RNA, 19 nt, Homo sapiens
uuaaggauuuuaugcuuua

SEQ ID NO: 2014924 - RNA, 19 nt, Homo sapiens
guaaaucaagaccaaagag

SEQ ID NO: 2014925 - RNA, 22 nt, Homo sapiens
caucugaguugagcacugguca

SEQ ID NO: 2014926 - RNA, 13 nt, Homo sapiens
ucaugaagcacau

SEQ ID NO: 2014927 - RNA, 18 nt, Homo sapiens
auuaugugaaaucaaagc

SEQ ID NO: 2014928 - RNA, 18 nt, Homo sapiens
cuuuccauccccuagaaa

SEQ ID NO: 2014929 - RNA, 18 nt, Homo sapiens
uaaaacuaaggcuuuuau

SEQ ID NO: 2014930 - RNA, 20 nt, Homo sapiens
aaaaauugguacuuguuuca

SEQ ID NO: 2014931 - RNA, 19 nt, Homo sapiens
cccugcgucuccugcccac

SEQ ID NO: 2014932 - RNA, 13 nt, Homo sapiens
uaaaauuaugaaa

SEQ ID NO: 2014933 - RNA, 14 nt, Homo sapiens
cccagcccagcacc

SEQ ID NO: 2014934 - RNA, 18 nt, Homo sapiens
agcugacuguucuuggua

SEQ ID NO: 2014935 - RNA, 17 nt, Homo sapiens
uaaacagugaacuuguc

SEQ ID NO: 2014936 - RNA, 16 nt, Homo sapiens
auaaagcagaagcaac

SEQ ID NO: 2014937 - RNA, 17 nt, Homo sapiens
aguuuuauauacugugu

SEQ ID NO: 2014938 - RNA, 12 nt, Homo sapiens
caagcuccucaa

SEQ ID NO: 2014939 - RNA, 14 nt, Homo sapiens
aauuauauagcaaa

SEQ ID NO: 2014940 - RNA, 21 nt, Homo sapiens
gaugccuguguacugccuuaa

SEQ ID NO: 2014941 - RNA, 22 nt, Homo sapiens
cauugguuaauuuuuacaugga

SEQ ID NO: 2014942 - RNA, 22 nt, Homo sapiens
ggagaaucuccgcuuguccaag

SEQ ID NO: 2014943 - RNA, 15 nt, Homo sapiens
ccacacagugcucaa

SEQ ID NO: 2014944 - RNA, 16 nt, Homo sapiens
cuuuguccauuauuca

SEQ ID NO: 2014945 - RNA, 16 nt, Homo sapiens
uaugcauguagcauau

SEQ ID NO: 2014946 - RNA, 20 nt, Homo sapiens
aggagcaacagcgauggcag

SEQ ID NO: 2014947 - RNA, 13 nt, Homo sapiens
ugagaacucugcc

SEQ ID NO: 2014948 - RNA, 23 nt, Homo sapiens
caguaaacuuucucugcaaagac

SEQ ID NO: 2014949 - RNA, 17 nt, Homo sapiens
uagaaacaugacacuga

SEQ ID NO: 2014950 - RNA, 16 nt, Homo sapiens
uuuagucuguauugau

SEQ ID NO: 2014951 - RNA, 17 nt, Homo sapiens
aauccuuuauagcuuug

SEQ ID NO: 2014952 - RNA, 21 nt, Homo sapiens
gcacaacgcaccagacacuca

SEQ ID NO: 2014953 - RNA, 20 nt, Homo sapiens
ucuguuggccagugugacaa

SEQ ID NO: 2014954 - RNA, 14 nt, Homo sapiens
guccuccccucaca

SEQ ID NO: 2014955 - RNA, 14 nt, Homo sapiens
cucugcauguuaca

SEQ ID NO: 2014956 - RNA, 14 nt, Homo sapiens
uauaaauaucacaa

SEQ ID NO: 2014957 - RNA, 20 nt, Homo sapiens
uuguuucuuacgcuugcuau

SEQ ID NO: 2014958 - RNA, 21 nt, Homo sapiens
cauugauguaauuuaaaacuu

SEQ ID NO: 2014959 - RNA, 18 nt, Homo sapiens
aacacugacuccugugga

SEQ ID NO: 2014960 - RNA, 18 nt, Homo sapiens
cagagcugcugaggacaa

SEQ ID NO: 2014961 - RNA, 16 nt, Homo sapiens
uuguguuacaauaagu

SEQ ID NO: 2014962 - RNA, 19 nt, Homo sapiens
cagcucugagccagauuac

SEQ ID NO: 2014963 - RNA, 21 nt, Homo sapiens
ggaaugcucccagcugugcug

SEQ ID NO: 2014964 - RNA, 23 nt, Homo sapiens
aucucccaugugcauaacaaauu

SEQ ID NO: 2014965 - RNA, 17 nt, Homo sapiens
caggaaauaucugugaa

SEQ ID NO: 2014966 - RNA, 22 nt, Homo sapiens
uucaaaccaaucaaaugguguu

SEQ ID NO: 2014967 - RNA, 15 nt, Homo sapiens
cucacacacacagcu

SEQ ID NO: 2014968 - RNA, 18 nt, Homo sapiens
ccaaaacauaccauuucu

SEQ ID NO: 2014969 - RNA, 13 nt, Homo sapiens
cuacaaaaacaca

SEQ ID NO: 2014970 - RNA, 16 nt, Homo sapiens
uaaaagaguggaacua

SEQ ID NO: 2014971 - RNA, 16 nt, Homo sapiens
ucuguaggaaccgugg

SEQ ID NO: 2014972 - RNA, 14 nt, Homo sapiens
aaucaaaugcaauu

SEQ ID NO: 2014973 - RNA, 17 nt, Homo sapiens
ggagaccccgguggcag

SEQ ID NO: 2014974 - RNA, 12 nt, Homo sapiens
acacaucacuua

SEQ ID NO: 2014975 - RNA, 21 nt, Homo sapiens
uaaaccaucucccuggugcuu

SEQ ID NO: 2014976 - RNA, 14 nt, Homo sapiens
uuugauucuccagc

SEQ ID NO: 2014977 - RNA, 11 nt, Homo sapiens
aagacucugac

SEQ ID NO: 2014978 - RNA, 17 nt, Homo sapiens
caaagaggcugccccuc

SEQ ID NO: 2014979 - RNA, 23 nt, Homo sapiens
uucugguggagagaagugagaau

SEQ ID NO: 2014980 - RNA, 16 nt, Homo sapiens
ggcuucccuaaacugc

SEQ ID NO: 2014981 - RNA, 23 nt, Homo sapiens
cugcuaauaccucuuacuuugcu

SEQ ID NO: 2014982 - RNA, 14 nt, Homo sapiens
caaguguacaguga

SEQ ID NO: 2014983 - RNA, 17 nt, Homo sapiens
ucucccgggacucugca

SEQ ID NO: 2014984 - RNA, 17 nt, Homo sapiens
aggacaagggcucagag

SEQ ID NO: 2014985 - RNA, 21 nt, Homo sapiens
uuagcaugaauccuacauaca

SEQ ID NO: 2014986 - RNA, 23 nt, Homo sapiens
uuuuggucuucagccucccucag

SEQ ID NO: 2014987 - RNA, 23 nt, Homo sapiens
agcuuggauggagacuccaugag

SEQ ID NO: 2014988 - RNA, 15 nt, Homo sapiens
cuaagaaacacucau

SEQ ID NO: 2014989 - RNA, 15 nt, Homo sapiens
aaauaauauccaccu

SEQ ID NO: 2014990 - RNA, 17 nt, Homo sapiens
cugggaaagccaugacc

SEQ ID NO: 2014991 - RNA, 22 nt, Homo sapiens
auuuguccuuggggacaucuca

SEQ ID NO: 2014992 - RNA, 17 nt, Homo sapiens
gggugcccucuccaaag

SEQ ID NO: 2014993 - RNA, 12 nt, Homo sapiens
caugguacugua

SEQ ID NO: 2014994 - RNA, 12 nt, Homo sapiens
uuaucugugcaa

SEQ ID NO: 2014995 - RNA, 16 nt, Homo sapiens
uuuguauuauuacaaa

SEQ ID NO: 2014996 - RNA, 22 nt, Homo sapiens
auaugcuaauuaaauaauacaa

SEQ ID NO: 2014997 - RNA, 13 nt, Homo sapiens
agagcaucugccc

SEQ ID NO: 2014998 - RNA, 17 nt, Homo sapiens
aaccagaagaaguguga

SEQ ID NO: 2014999 - RNA, 16 nt, Homo sapiens
uuccaucagcacaaag

SEQ ID NO: 2015000 - RNA, 23 nt, Homo sapiens
guuugaaucuacauucacuuuuu

SEQ ID NO: 2015001 - RNA, 15 nt, Homo sapiens
uacagcaagagccac

SEQ ID NO: 2015002 - RNA, 23 nt, Homo sapiens
cuguuacucugucccacguccaa

SEQ ID NO: 2015003 - RNA, 11 nt, Homo sapiens
augauguuucg

SEQ ID NO: 2015004 - RNA, 21 nt, Homo sapiens
aagaugucauuuccaccagca

SEQ ID NO: 2015005 - RNA, 23 nt, Homo sapiens
auguaauuucugcacaggucucu

SEQ ID NO: 2015006 - RNA, 15 nt, Homo sapiens
uggaagcacagcuuc

SEQ ID NO: 2015007 - RNA, 21 nt, Homo sapiens
uugugguuucucuggcccuga

SEQ ID NO: 2015008 - RNA, 17 nt, Homo sapiens
uugcagccugaccaaaa

SEQ ID NO: 2015009 - RNA, 22 nt, Homo sapiens
ccuugacgcgagaggcucugag

SEQ ID NO: 2015010 - RNA, 16 nt, Homo sapiens
uucacagccaggagau

SEQ ID NO: 2015011 - RNA, 15 nt, Homo sapiens
gaauagugcuugcug

SEQ ID NO: 2015012 - RNA, 13 nt, Homo sapiens
uucccaucgcugg

SEQ ID NO: 2015013 - RNA, 11 nt, Homo sapiens
aaccuaugaag

SEQ ID NO: 2015014 - RNA, 15 nt, Homo sapiens
gaaaucagcaggacg

SEQ ID NO: 2015015 - RNA, 13 nt, Homo sapiens
uuacacacugucu

SEQ ID NO: 2015016 - RNA, 22 nt, Homo sapiens
agaauacauuguacuuauacac

SEQ ID NO: 2015017 - RNA, 20 nt, Homo sapiens
ugaaagagaauagacaguau

SEQ ID NO: 2015018 - RNA, 21 nt, Homo sapiens
gcugguauuuaucugcaaggu

SEQ ID NO: 2015019 - RNA, 13 nt, Homo sapiens
uggccaucuccac

SEQ ID NO: 2015020 - RNA, 20 nt, Homo sapiens
gucucccaacaagugcucuu

SEQ ID NO: 2015021 - RNA, 13 nt, Homo sapiens
aauuuccaugaua

SEQ ID NO: 2015022 - RNA, 12 nt, Homo sapiens
cuccacaccucu

SEQ ID NO: 2015023 - RNA, 12 nt, Homo sapiens
auacacacauau

SEQ ID NO: 2015024 - RNA, 19 nt, Homo sapiens
ugaguauucauuuugcaac

SEQ ID NO: 2015025 - RNA, 13 nt, Homo sapiens
uauuugcacuaug

SEQ ID NO: 2015026 - RNA, 13 nt, Homo sapiens
caaaugcauuuag

SEQ ID NO: 2015027 - RNA, 14 nt, Homo sapiens
aaacauuuaccaau

SEQ ID NO: 2015028 - RNA, 14 nt, Homo sapiens
gcaacauugaccca

SEQ ID NO: 2015029 - RNA, 15 nt, Homo sapiens
gauucugugccucca

SEQ ID NO: 2015030 - RNA, 17 nt, Homo sapiens
gccaccucuaaauaugc

SEQ ID NO: 2015031 - RNA, 14 nt, Homo sapiens
cugcccacaccacc

SEQ ID NO: 2015032 - RNA, 21 nt, Homo sapiens
acccagggaggcgauggccac

SEQ ID NO: 2015033 - RNA, 16 nt, Homo sapiens
aucaaucugcaguuua

SEQ ID NO: 2015034 - RNA, 20 nt, Homo sapiens
gcuaugauuaaauuuacuua

SEQ ID NO: 2015035 - RNA, 21 nt, Homo sapiens
agcgaaauauuacaguagugc

SEQ ID NO: 2015036 - RNA, 19 nt, Homo sapiens
agagcgagacuccaucucu

SEQ ID NO: 2015037 - RNA, 22 nt, Homo sapiens
uaauguugauuuuaauccugua

SEQ ID NO: 2015038 - RNA, 21 nt, Homo sapiens
aauacuuuuuuuuuaaagcca

SEQ ID NO: 2015039 - RNA, 14 nt, Homo sapiens
agaaggcauguucc

SEQ ID NO: 2015040 - RNA, 14 nt, Homo sapiens
ugauuugcucucua

SEQ ID NO: 2015041 - RNA, 13 nt, Homo sapiens
ugcauguuuucca

SEQ ID NO: 2015042 - RNA, 14 nt, Homo sapiens
augaacccauccaa

SEQ ID NO: 2015043 - RNA, 14 nt, Homo sapiens
cucucuaccagucu

SEQ ID NO: 2015044 - RNA, 15 nt, Homo sapiens
cauaaaugauuaauu

SEQ ID NO: 2015045 - RNA, 15 nt, Homo sapiens
auuucuugcauucau

SEQ ID NO: 2015046 - RNA, 14 nt, Homo sapiens
cuugcuggaugcug

SEQ ID NO: 2015047 - RNA, 18 nt, Homo sapiens
ccagaagccuccuuacau

SEQ ID NO: 2015048 - RNA, 23 nt, Homo sapiens
gacaugaagggaugcugcaaugu

SEQ ID NO: 2015049 - RNA, 21 nt, Homo sapiens
uccauggcagcuggucuuuau

SEQ ID NO: 2015050 - RNA, 23 nt, Homo sapiens
ggcugucaggacaccagccuggu

SEQ ID NO: 2015051 - RNA, 17 nt, Homo sapiens
ggcaggaccugccuagc

SEQ ID NO: 2015052 - RNA, 17 nt, Homo sapiens
ucccuuuacagcaccac

SEQ ID NO: 2015053 - RNA, 20 nt, Homo sapiens
caacauauuguuucaguguu

SEQ ID NO: 2015054 - RNA, 17 nt, Homo sapiens
gacaacuucaaaauaca

SEQ ID NO: 2015055 - RNA, 17 nt, Homo sapiens
uuggguggagaagccau

SEQ ID NO: 2015056 - RNA, 19 nt, Homo sapiens
aagaaagcuauauaugaau

SEQ ID NO: 2015057 - RNA, 22 nt, Homo sapiens
ucaaacaacauuccaccccagc

SEQ ID NO: 2015058 - RNA, 14 nt, Homo sapiens
aaaugucaugagau

SEQ ID NO: 2015059 - RNA, 15 nt, Homo sapiens
agucuguaccucaaa

SEQ ID NO: 2015060 - RNA, 16 nt, Homo sapiens
gucuccuaagcaccug

SEQ ID NO: 2015061 - RNA, 14 nt, Homo sapiens
caucuuugauacuu

SEQ ID NO: 2015062 - RNA, 16 nt, Homo sapiens
cagaccaaccuuccau

SEQ ID NO: 2015063 - RNA, 15 nt, Homo sapiens
ugaagcaaacacauu

SEQ ID NO: 2015064 - RNA, 14 nt, Homo sapiens
agccucaaccuccc

SEQ ID NO: 2015065 - RNA, 20 nt, Homo sapiens
guuucaaaauagacaaguuu

SEQ ID NO: 2015066 - RNA, 12 nt, Homo sapiens
uauuuucuucca

SEQ ID NO: 2015067 - RNA, 23 nt, Homo sapiens
aggccuuggccaagcugcugcuu

SEQ ID NO: 2015068 - RNA, 14 nt, Homo sapiens
gcucgcugccauca

SEQ ID NO: 2015069 - RNA, 18 nt, Homo sapiens
gucacguuuggugcuucu

SEQ ID NO: 2015070 - RNA, 17 nt, Homo sapiens
aguuaugauguaaucuc

SEQ ID NO: 2015071 - RNA, 21 nt, Homo sapiens
agaaauucuuaauuuggaucu

SEQ ID NO: 2015072 - RNA, 15 nt, Homo sapiens
acuggccaugcaagu

SEQ ID NO: 2015073 - RNA, 10 nt, Homo sapiens
cccagggugg

SEQ ID NO: 2015074 - RNA, 16 nt, Homo sapiens
acaccaacgaggugau

SEQ ID NO: 2015075 - RNA, 15 nt, Homo sapiens
cucagagcauuucaa

SEQ ID NO: 2015076 - RNA, 15 nt, Homo sapiens
cuuuggucauuuccc

SEQ ID NO: 2015077 - RNA, 16 nt, Homo sapiens
cccugcacaccagaga

SEQ ID NO: 2015078 - RNA, 20 nt, Homo sapiens
auugagauucauccauauug

SEQ ID NO: 2015079 - RNA, 22 nt, Homo sapiens
uuauaccaguguuaagugacau

SEQ ID NO: 2015080 - RNA, 22 nt, Homo sapiens
aagguauugcaaggucacuuug

SEQ ID NO: 2015081 - RNA, 22 nt, Homo sapiens
uaaaaguuuuuuauuaugcauu

SEQ ID NO: 2015082 - RNA, 18 nt, Homo sapiens
gccacccucccacugcca

SEQ ID NO: 2015083 - RNA, 13 nt, Homo sapiens
uccugggauucaa

SEQ ID NO: 2015084 - RNA, 21 nt, Homo sapiens
gagcaaucagaauugugcuuu

SEQ ID NO: 2015085 - RNA, 22 nt, Homo sapiens
aaaugagucaaaguucaaaaau

SEQ ID NO: 2015086 - RNA, 23 nt, Homo sapiens
agcugggguggggaccucaggcc

SEQ ID NO: 2015087 - RNA, 22 nt, Homo sapiens
augcaaaguaaaaaaauaugaa

SEQ ID NO: 2015088 - RNA, 21 nt, Homo sapiens
gauuugucugagacauuucca

SEQ ID NO: 2015089 - RNA, 15 nt, Homo sapiens
agucauccugccaac

SEQ ID NO: 2015090 - RNA, 20 nt, Homo sapiens
augagcaugcucccucaugc

SEQ ID NO: 2015091 - RNA, 16 nt, Homo sapiens
ugacuauuuauacaaa

SEQ ID NO: 2015092 - RNA, 14 nt, Homo sapiens
uaaagguucaugca

SEQ ID NO: 2015093 - RNA, 16 nt, Homo sapiens
acgaauauggacauau

SEQ ID NO: 2015094 - RNA, 19 nt, Homo sapiens
agugaacacacacaaggga

SEQ ID NO: 2015095 - RNA, 11 nt, Homo sapiens
acaauucacuu

SEQ ID NO: 2015096 - RNA, 19 nt, Homo sapiens
uuucaguauuaaacucucc

SEQ ID NO: 2015097 - RNA, 18 nt, Homo sapiens
cacugggacuugcaaaaa

SEQ ID NO: 2015098 - RNA, 18 nt, Homo sapiens
uguucagaauguagcauu

SEQ ID NO: 2015099 - RNA, 21 nt, Homo sapiens
ugauuaguauucaggcacuga

SEQ ID NO: 2015100 - RNA, 17 nt, Homo sapiens
gcuuucauaaaucaugu

SEQ ID NO: 2015101 - RNA, 12 nt, Homo sapiens
cgcucccgggac

SEQ ID NO: 2015102 - RNA, 18 nt, Homo sapiens
ugaacaacuguugggaua

SEQ ID NO: 2015103 - RNA, 15 nt, Homo sapiens
ugacugauuucaaau

SEQ ID NO: 2015104 - RNA, 16 nt, Homo sapiens
uggagguugaagccaa

SEQ ID NO: 2015105 - RNA, 22 nt, Homo sapiens
caggaagcccacacuaugcaca

SEQ ID NO: 2015106 - RNA, 18 nt, Homo sapiens
caacagaaacaugccaga

SEQ ID NO: 2015107 - RNA, 13 nt, Homo sapiens
acacaguuguuga

SEQ ID NO: 2015108 - RNA, 13 nt, Homo sapiens
ggcucuguccuaa

SEQ ID NO: 2015109 - RNA, 17 nt, Homo sapiens
acacaaaccacaccaca

SEQ ID NO: 2015110 - RNA, 18 nt, Homo sapiens
accacuaaaguauagaga

SEQ ID NO: 2015111 - RNA, 20 nt, Homo sapiens
auaaucacauuaucaucuga

SEQ ID NO: 2015112 - RNA, 12 nt, Homo sapiens
agcaagcaauaa

SEQ ID NO: 2015113 - RNA, 18 nt, Homo sapiens
ccauagugcacacuugua

SEQ ID NO: 2015114 - RNA, 12 nt, Homo sapiens
guaaaagacugg

SEQ ID NO: 2015115 - RNA, 23 nt, Homo sapiens
agauaacagcuuaacauuuacau

SEQ ID NO: 2015116 - RNA, 19 nt, Homo sapiens
auacuuuuuucuaguuuca

SEQ ID NO: 2015117 - RNA, 14 nt, Homo sapiens
gagcugccuaugcc

SEQ ID NO: 2015118 - RNA, 17 nt, Homo sapiens
aacaucuuuuacauucu

SEQ ID NO: 2015119 - RNA, 16 nt, Homo sapiens
cuuaguaauagaucac

SEQ ID NO: 2015120 - RNA, 19 nt, Homo sapiens
uguauagauccacagggag

SEQ ID NO: 2015121 - RNA, 17 nt, Homo sapiens
uuauccacaacuuuuca

SEQ ID NO: 2015122 - RNA, 12 nt, Homo sapiens
uauuaagauaua

SEQ ID NO: 2015123 - RNA, 14 nt, Homo sapiens
ucuugaacuccuga

SEQ ID NO: 2015124 - RNA, 14 nt, Homo sapiens
agcauuacaguauu

SEQ ID NO: 2015125 - RNA, 18 nt, Homo sapiens
acuuugagcacacuuuac

SEQ ID NO: 2015126 - RNA, 13 nt, Homo sapiens
gaauuacuguaac

SEQ ID NO: 2015127 - RNA, 22 nt, Homo sapiens
gaaaaaaaaaaaaaagaacaac

SEQ ID NO: 2015128 - RNA, 18 nt, Homo sapiens
uggaucuguugggaacca

SEQ ID NO: 2015129 - RNA, 16 nt, Homo sapiens
aauugacaacccaaac

SEQ ID NO: 2015130 - RNA, 20 nt, Homo sapiens
uuccaugggauacaaccucc

SEQ ID NO: 2015131 - RNA, 15 nt, Homo sapiens
ccugacuugagccac

SEQ ID NO: 2015132 - RNA, 22 nt, Homo sapiens
acucaucugccaagcuccucaa

SEQ ID NO: 2015133 - RNA, 14 nt, Homo sapiens
uacauaauacuuga

SEQ ID NO: 2015134 - RNA, 15 nt, Homo sapiens
uguuuaagacauuuu

SEQ ID NO: 2015135 - RNA, 17 nt, Homo sapiens
gggaaggugagccagac

SEQ ID NO: 2015136 - RNA, 19 nt, Homo sapiens
augcacacaggugcacaga

SEQ ID NO: 2015137 - RNA, 14 nt, Homo sapiens
aagcagcugcagca

SEQ ID NO: 2015138 - RNA, 18 nt, Homo sapiens
cuuauuuuaccuucucau

SEQ ID NO: 2015139 - RNA, 18 nt, Homo sapiens
ccaacacugccagcauuu

SEQ ID NO: 2015140 - RNA, 21 nt, Homo sapiens
ugucaucaucacccuuucauu

SEQ ID NO: 2015141 - RNA, 20 nt, Homo sapiens
aauauauauauccucuguau

SEQ ID NO: 2015142 - RNA, 20 nt, Homo sapiens
gguuugcccagagccaagcu

SEQ ID NO: 2015143 - RNA, 14 nt, Homo sapiens
caaugacuuuccua

SEQ ID NO: 2015144 - RNA, 20 nt, Homo sapiens
agaggacuggacgugcucag

SEQ ID NO: 2015145 - RNA, 13 nt, Homo sapiens
aaacacucuugaa

SEQ ID NO: 2015146 - RNA, 16 nt, Homo sapiens
cucccaggcauucccc

SEQ ID NO: 2015147 - RNA, 12 nt, Homo sapiens
agacaugacucu

SEQ ID NO: 2015148 - RNA, 14 nt, Homo sapiens
uucuccugagcucc

SEQ ID NO: 2015149 - RNA, 15 nt, Homo sapiens
ggaugguugaaugag

SEQ ID NO: 2015150 - RNA, 22 nt, Homo sapiens
gccugggagggugguuccuguu

SEQ ID NO: 2015151 - RNA, 18 nt, Homo sapiens
cuucaccccuauggugcu

SEQ ID NO: 2015152 - RNA, 19 nt, Homo sapiens
gccuaaccccauuccugug

SEQ ID NO: 2015153 - RNA, 15 nt, Homo sapiens
agcuggggacagcuu

SEQ ID NO: 2015154 - RNA, 13 nt, Homo sapiens
cgggacagacuaa

SEQ ID NO: 2015155 - RNA, 16 nt, Homo sapiens
ugucacagugcuacaa

SEQ ID NO: 2015156 - RNA, 11 nt, Homo sapiens
gccucuugccc

SEQ ID NO: 2015157 - RNA, 15 nt, Homo sapiens
acugaaaccaaaaca

SEQ ID NO: 2015158 - RNA, 20 nt, Homo sapiens
uuuggaacagcaugcugcug

SEQ ID NO: 2015159 - RNA, 22 nt, Homo sapiens
cccacucccuggcucucagaag

SEQ ID NO: 2015160 - RNA, 16 nt, Homo sapiens
uguucucagcacauau

SEQ ID NO: 2015161 - RNA, 17 nt, Homo sapiens
cagagaaaauugugaaa

SEQ ID NO: 2015162 - RNA, 17 nt, Homo sapiens
guauguaacuacaggaa

SEQ ID NO: 2015163 - RNA, 15 nt, Homo sapiens
aaauaugagagcaau

SEQ ID NO: 2015164 - RNA, 22 nt, Homo sapiens
cucucuuccuuucauucuagua

SEQ ID NO: 2015165 - RNA, 17 nt, Homo sapiens
ugcacuccuacugaguu

SEQ ID NO: 2015166 - RNA, 17 nt, Homo sapiens
uuccaaagagucaucau

SEQ ID NO: 2015167 - RNA, 15 nt, Homo sapiens
uuucucuuuccaaac

SEQ ID NO: 2015168 - RNA, 21 nt, Homo sapiens
cagagaagaccaaagcauugc

SEQ ID NO: 2015169 - RNA, 17 nt, Homo sapiens
acuggaguccagucucu

SEQ ID NO: 2015170 - RNA, 22 nt, Homo sapiens
gcaggauuugggcucuuggaau

SEQ ID NO: 2015171 - RNA, 14 nt, Homo sapiens
ggucucccaaacgc

SEQ ID NO: 2015172 - RNA, 14 nt, Homo sapiens
acugcacucuagcc

SEQ ID NO: 2015173 - RNA, 13 nt, Homo sapiens
uuuucaccugaga

SEQ ID NO: 2015174 - RNA, 21 nt, Homo sapiens
aacuucaauauccacuucuuu

SEQ ID NO: 2015175 - RNA, 22 nt, Homo sapiens
uaggaugugcuaggucuaagau

SEQ ID NO: 2015176 - RNA, 14 nt, Homo sapiens
gauauauccuaacu

SEQ ID NO: 2015177 - RNA, 19 nt, Homo sapiens
gaaauguaaaauugaaaau

SEQ ID NO: 2015178 - RNA, 13 nt, Homo sapiens
uguggacacagcu

SEQ ID NO: 2015179 - RNA, 18 nt, Homo sapiens
gugucucugaggacguca

SEQ ID NO: 2015180 - RNA, 20 nt, Homo sapiens
gagacuccgucacaacaaca

SEQ ID NO: 2015181 - RNA, 14 nt, Homo sapiens
ucagcaacaugaua

SEQ ID NO: 2015182 - RNA, 19 nt, Homo sapiens
gagaauucucgaacugcau

SEQ ID NO: 2015183 - RNA, 22 nt, Homo sapiens
ggugaaacccagucacugugag

SEQ ID NO: 2015184 - RNA, 23 nt, Homo sapiens
ucuacauagucagcuacuucuga

SEQ ID NO: 2015185 - RNA, 18 nt, Homo sapiens
agcaaauaaagcagucau

SEQ ID NO: 2015186 - RNA, 17 nt, Homo sapiens
cuuccucuuccagcaac

SEQ ID NO: 2015187 - RNA, 22 nt, Homo sapiens
uucaauuuacagguaccaguac

SEQ ID NO: 2015188 - RNA, 17 nt, Homo sapiens
cucagaucacuacugca

SEQ ID NO: 2015189 - RNA, 20 nt, Homo sapiens
aaaguauggcagugggagac

SEQ ID NO: 2015190 - RNA, 16 nt, Homo sapiens
cguuccacauccacac

SEQ ID NO: 2015191 - RNA, 15 nt, Homo sapiens
acuacuccugaggau

SEQ ID NO: 2015192 - RNA, 18 nt, Homo sapiens
acccccaugaccacugcc

SEQ ID NO: 2015193 - RNA, 18 nt, Homo sapiens
ccuguuaccugucuugcu

SEQ ID NO: 2015194 - RNA, 15 nt, Homo sapiens
auuuuugauacaguu

SEQ ID NO: 2015195 - RNA, 23 nt, Homo sapiens
auguugguacccuggacagugcc

SEQ ID NO: 2015196 - RNA, 21 nt, Homo sapiens
agugcuuaugucauagccuua

SEQ ID NO: 2015197 - RNA, 21 nt, Homo sapiens
acuuuuggcauuuuacuguac

SEQ ID NO: 2015198 - RNA, 20 nt, Homo sapiens
guaacacuggcgagcaggug

SEQ ID NO: 2015199 - RNA, 14 nt, Homo sapiens
gccccucaccugcc

SEQ ID NO: 2015200 - RNA, 15 nt, Homo sapiens
cugccagcuugugag

SEQ ID NO: 2015201 - RNA, 16 nt, Homo sapiens
caguuacuuaccugca

SEQ ID NO: 2015202 - RNA, 18 nt, Homo sapiens
agacccaaggcucacugc

SEQ ID NO: 2015203 - RNA, 17 nt, Homo sapiens
accaagcucacaccugu

SEQ ID NO: 2015204 - RNA, 23 nt, Homo sapiens
aauauauauuaagugugccaaau

SEQ ID NO: 2015205 - RNA, 23 nt, Homo sapiens
ugucuagaauguggauuugauuc

SEQ ID NO: 2015206 - RNA, 16 nt, Homo sapiens
uaaucacugcauuuca

SEQ ID NO: 2015207 - RNA, 22 nt, Homo sapiens
ucuugcucuaucucacagcaca

SEQ ID NO: 2015208 - RNA, 14 nt, Homo sapiens
gaccaugcugugag

SEQ ID NO: 2015209 - RNA, 20 nt, Homo sapiens
caggugcaagccacuauguc

SEQ ID NO: 2015210 - RNA, 23 nt, Homo sapiens
ccuuaaugauccguuccauugca

SEQ ID NO: 2015211 - RNA, 23 nt, Homo sapiens
accugggugugcuccaggcuucc

SEQ ID NO: 2015212 - RNA, 14 nt, Homo sapiens
cuugccacugccau

SEQ ID NO: 2015213 - RNA, 20 nt, Homo sapiens
aagagucacaauuugcaaau

SEQ ID NO: 2015214 - RNA, 13 nt, Homo sapiens
cuggauucauucu

SEQ ID NO: 2015215 - RNA, 16 nt, Homo sapiens
gcugcaaaaguucuca

SEQ ID NO: 2015216 - RNA, 21 nt, Homo sapiens
aagguuaguaucaucagauag

SEQ ID NO: 2015217 - RNA, 18 nt, Homo sapiens
acccugaguugcuuuuca

SEQ ID NO: 2015218 - RNA, 20 nt, Homo sapiens
uaucuuuaaagccgugcucu

SEQ ID NO: 2015219 - RNA, 19 nt, Homo sapiens
uaaucugaaacacagucau

SEQ ID NO: 2015220 - RNA, 12 nt, Homo sapiens
aaaaugccacag

SEQ ID NO: 2015221 - RNA, 19 nt, Homo sapiens
uaaaagagacaaacuguaa

SEQ ID NO: 2015222 - RNA, 19 nt, Homo sapiens
augcacauccauucccaag

SEQ ID NO: 2015223 - RNA, 13 nt, Homo sapiens
cuagagacaguga

SEQ ID NO: 2015224 - RNA, 22 nt, Homo sapiens
ugcccugggccauaugugcuau

SEQ ID NO: 2015225 - RNA, 15 nt, Homo sapiens
caaugaguguuauaa

SEQ ID NO: 2015226 - RNA, 19 nt, Homo sapiens
cuuuuaaugccuuccacau

SEQ ID NO: 2015227 - RNA, 22 nt, Homo sapiens
cuucaaugggcucuuccaacaa

SEQ ID NO: 2015228 - RNA, 14 nt, Homo sapiens
gaaaacuaaucuaa

SEQ ID NO: 2015229 - RNA, 16 nt, Homo sapiens
ucuucucaagcacuga

SEQ ID NO: 2015230 - RNA, 17 nt, Homo sapiens
cuucuuuauacuguaau

SEQ ID NO: 2015231 - RNA, 21 nt, Homo sapiens
aacgcaauguuucuagagaca

SEQ ID NO: 2015232 - RNA, 15 nt, Homo sapiens
aaguaaauguugaca

SEQ ID NO: 2015233 - RNA, 19 nt, Homo sapiens
aaagaccugaauaccacuu

SEQ ID NO: 2015234 - RNA, 19 nt, Homo sapiens
uccacccacaguucagacc

SEQ ID NO: 2015235 - RNA, 22 nt, Homo sapiens
ugcuaccaauaggcagacugug

SEQ ID NO: 2015236 - RNA, 21 nt, Homo sapiens
ggacuuccuuuaggaucucag

SEQ ID NO: 2015237 - RNA, 13 nt, Homo sapiens
aggauuaauuuau

SEQ ID NO: 2015238 - RNA, 21 nt, Homo sapiens
ucaaaauaccccuaacauacu

SEQ ID NO: 2015239 - RNA, 16 nt, Homo sapiens
agcagguuaagaauuu

SEQ ID NO: 2015240 - RNA, 17 nt, Homo sapiens
cagcucuuucucuuugu

SEQ ID NO: 2015241 - RNA, 14 nt, Homo sapiens
gugguaacugccag

SEQ ID NO: 2015242 - RNA, 14 nt, Homo sapiens
ugccacucauuccu

SEQ ID NO: 2015243 - RNA, 12 nt, Homo sapiens
cagggcacuucc

SEQ ID NO: 2015244 - RNA, 16 nt, Homo sapiens
ccgaaaccaaagaaga

SEQ ID NO: 2015245 - RNA, 15 nt, Homo sapiens
agguuuaaagcugaa

SEQ ID NO: 2015246 - RNA, 19 nt, Homo sapiens
aaaauuuuuugugauuuca

SEQ ID NO: 2015247 - RNA, 21 nt, Homo sapiens
agucauguuucugcaguauuc

SEQ ID NO: 2015248 - RNA, 13 nt, Homo sapiens
cuuuagaaugaga

SEQ ID NO: 2015249 - RNA, 14 nt, Homo sapiens
uggcugccccguga

SEQ ID NO: 2015250 - RNA, 19 nt, Homo sapiens
agggugaggcccacucugu

SEQ ID NO: 2015251 - RNA, 19 nt, Homo sapiens
uaaauaugccuaguaacac

SEQ ID NO: 2015252 - RNA, 24 nt, Homo sapiens
cuccaggcucccucccucccagau

SEQ ID NO: 2015253 - RNA, 18 nt, Homo sapiens
ccuuuucucucacccauc

SEQ ID NO: 2015254 - RNA, 22 nt, Homo sapiens
acccuccccugucuucucucaa

SEQ ID NO: 2015255 - RNA, 13 nt, Homo sapiens
uuuauuauauaua

SEQ ID NO: 2015256 - RNA, 14 nt, Homo sapiens
uuuaucuuaaccuc

SEQ ID NO: 2015257 - RNA, 21 nt, Homo sapiens
cuaauuuuuggagaaauguca

SEQ ID NO: 2015258 - RNA, 16 nt, Homo sapiens
uccaaucggagacaaa

SEQ ID NO: 2015259 - RNA, 21 nt, Homo sapiens
gaguguaguggcacaaucuca

SEQ ID NO: 2015260 - RNA, 16 nt, Homo sapiens
ccaugugcugcugugg

SEQ ID NO: 2015261 - RNA, 19 nt, Homo sapiens
gucccuuggucuguacaaa

SEQ ID NO: 2015262 - RNA, 21 nt, Homo sapiens
ggcucagagggggacugcugc

SEQ ID NO: 2015263 - RNA, 15 nt, Homo sapiens
aaauccucucuauca

SEQ ID NO: 2015264 - RNA, 20 nt, Homo sapiens
cuugagugaucccaaaccaa

SEQ ID NO: 2015265 - RNA, 17 nt, Homo sapiens
aauacuuaacacgugaa

SEQ ID NO: 2015266 - RNA, 15 nt, Homo sapiens
uauaaaaagcuucca

SEQ ID NO: 2015267 - RNA, 18 nt, Homo sapiens
ccaaggucuacucccucc

SEQ ID NO: 2015268 - RNA, 20 nt, Homo sapiens
auuuaguuuuuaacaaucua

SEQ ID NO: 2015269 - RNA, 22 nt, Homo sapiens
cuaacucccuccucacacucca

SEQ ID NO: 2015270 - RNA, 14 nt, Homo sapiens
aaucccuccuucau

SEQ ID NO: 2015271 - RNA, 17 nt, Homo sapiens
gaccuugaaaagcagua

SEQ ID NO: 2015272 - RNA, 18 nt, Homo sapiens
cugcucugcccacuguga

SEQ ID NO: 2015273 - RNA, 21 nt, Homo sapiens
ugcggcugccauuggagccaa

SEQ ID NO: 2015274 - RNA, 18 nt, Homo sapiens
ugaaauguauagcugcuu

SEQ ID NO: 2015275 - RNA, 15 nt, Homo sapiens
cgcccgcugagcuga

SEQ ID NO: 2015276 - RNA, 15 nt, Homo sapiens
aagugcugcacucaa

SEQ ID NO: 2015277 - RNA, 14 nt, Homo sapiens
auauuaagcacuuu

SEQ ID NO: 2015278 - RNA, 23 nt, Homo sapiens
cacaggcuggcgcucggcuccac

SEQ ID NO: 2015279 - RNA, 20 nt, Homo sapiens
cuucauucuccuuguuguug

SEQ ID NO: 2015280 - RNA, 15 nt, Homo sapiens
accuuuaaauaucau

SEQ ID NO: 2015281 - RNA, 19 nt, Homo sapiens
augcuaaaggagcaucuau

SEQ ID NO: 2015282 - RNA, 13 nt, Homo sapiens
agcccuugcccag

SEQ ID NO: 2015283 - RNA, 15 nt, Homo sapiens
uaagaaggcacuuaa

SEQ ID NO: 2015284 - RNA, 13 nt, Homo sapiens
cuggccucaagca

SEQ ID NO: 2015285 - RNA, 19 nt, Homo sapiens
aauccggagcgcggcagua

SEQ ID NO: 2015286 - RNA, 13 nt, Homo sapiens
accccagccugaa

SEQ ID NO: 2015287 - RNA, 21 nt, Homo sapiens
agucuaauuuugucaaaucau

SEQ ID NO: 2015288 - RNA, 13 nt, Homo sapiens
aggaguagucuca

SEQ ID NO: 2015289 - RNA, 16 nt, Homo sapiens
ggccgcuucccuaccc

SEQ ID NO: 2015290 - RNA, 14 nt, Homo sapiens
gaaaaguagacaau

SEQ ID NO: 2015291 - RNA, 13 nt, Homo sapiens
accacaacuauuu

SEQ ID NO: 2015292 - RNA, 21 nt, Homo sapiens
gcccacacacuuuccaucucu

SEQ ID NO: 2015293 - RNA, 19 nt, Homo sapiens
accauucagaucacugaau

SEQ ID NO: 2015294 - RNA, 22 nt, Homo sapiens
uaaggguuuuuuuuuuuagcuu

SEQ ID NO: 2015295 - RNA, 14 nt, Homo sapiens
aacuuugcaaaaag

SEQ ID NO: 2015296 - RNA, 22 nt, Homo sapiens
auucucuuaaucacuacuguau

SEQ ID NO: 2015297 - RNA, 13 nt, Homo sapiens
aaggaaauucuua

SEQ ID NO: 2015298 - RNA, 16 nt, Homo sapiens
cuauuguuaccucuga

SEQ ID NO: 2015299 - RNA, 21 nt, Homo sapiens
aauagaauauagcaucuuuca

SEQ ID NO: 2015300 - RNA, 20 nt, Homo sapiens
guaucuuuuuuaaacuguaa

SEQ ID NO: 2015301 - RNA, 15 nt, Homo sapiens
cuccugccaggguga

SEQ ID NO: 2015302 - RNA, 16 nt, Homo sapiens
caaaugccuugaacug

SEQ ID NO: 2015303 - RNA, 17 nt, Homo sapiens
uaucucucagugaacug

SEQ ID NO: 2015304 - RNA, 22 nt, Homo sapiens
cugcuugugagaccauuagcau

SEQ ID NO: 2015305 - RNA, 13 nt, Homo sapiens
aggagcguguccu

SEQ ID NO: 2015306 - RNA, 15 nt, Homo sapiens
ccuggccgaugguac

SEQ ID NO: 2015307 - RNA, 17 nt, Homo sapiens
guuuggacagcugauaa

SEQ ID NO: 2015308 - RNA, 12 nt, Homo sapiens
aauuuacuuugu

SEQ ID NO: 2015309 - RNA, 21 nt, Homo sapiens
auauuacugaucuuaccuuua

SEQ ID NO: 2015310 - RNA, 21 nt, Homo sapiens
auuauucugauuccacuuuua

SEQ ID NO: 2015311 - RNA, 13 nt, Homo sapiens
cauugcuuaccuu

SEQ ID NO: 2015312 - RNA, 15 nt, Homo sapiens
ccagcguuaacacaa

SEQ ID NO: 2015313 - RNA, 14 nt, Homo sapiens
acauuuucuacccu

SEQ ID NO: 2015314 - RNA, 16 nt, Homo sapiens
ugagauuuugcaaucu

SEQ ID NO: 2015315 - RNA, 17 nt, Homo sapiens
gaaguaaauuauuuuau

SEQ ID NO: 2015316 - RNA, 23 nt, Homo sapiens
ccugaauauuuguuauguagaua

SEQ ID NO: 2015317 - RNA, 15 nt, Homo sapiens
ucuuaguuuacuuau

SEQ ID NO: 2015318 - RNA, 22 nt, Homo sapiens
ugccuggagccugggcagcacc

SEQ ID NO: 2015319 - RNA, 13 nt, Homo sapiens
gaugaugaucuca

SEQ ID NO: 2015320 - RNA, 17 nt, Homo sapiens
acggugaaccgcaugga

SEQ ID NO: 2015321 - RNA, 13 nt, Homo sapiens
gaauaaagccuuu

SEQ ID NO: 2015322 - RNA, 20 nt, Homo sapiens
auguaaaaacuuucacugaa

SEQ ID NO: 2015323 - RNA, 17 nt, Homo sapiens
cacauacuacacauuca

SEQ ID NO: 2015324 - RNA, 18 nt, Homo sapiens
cacugaggguggcacuca

SEQ ID NO: 2015325 - RNA, 18 nt, Homo sapiens
ugaggaaaugauccccaa

SEQ ID NO: 2015326 - RNA, 14 nt, Homo sapiens
agggagccauggaa

SEQ ID NO: 2015327 - RNA, 14 nt, Homo sapiens
ucugcaguagggga

SEQ ID NO: 2015328 - RNA, 19 nt, Homo sapiens
accuuacuuaaagcuuguu

SEQ ID NO: 2015329 - RNA, 22 nt, Homo sapiens
uaaauaucauaaucugaugaua

SEQ ID NO: 2015330 - RNA, 19 nt, Homo sapiens
gaccaggugucucugagaa

SEQ ID NO: 2015331 - RNA, 16 nt, Homo sapiens
gaaucacuucugagaa

SEQ ID NO: 2015332 - RNA, 16 nt, Homo sapiens
ccccaacaugcacuga

SEQ ID NO: 2015333 - RNA, 14 nt, Homo sapiens
agacucauaccaca

SEQ ID NO: 2015334 - RNA, 18 nt, Homo sapiens
cucagucaugcauaaaua

SEQ ID NO: 2015335 - RNA, 13 nt, Homo sapiens
ccaagaacauaaa

SEQ ID NO: 2015336 - RNA, 13 nt, Homo sapiens
cucagaacaccaa

SEQ ID NO: 2015337 - RNA, 18 nt, Homo sapiens
aguggcauuuccugguca

SEQ ID NO: 2015338 - RNA, 16 nt, Homo sapiens
gcucacuacaugggcc

SEQ ID NO: 2015339 - RNA, 22 nt, Homo sapiens
ugucugagaugcagccagcauu

SEQ ID NO: 2015340 - RNA, 20 nt, Homo sapiens
uggaaguaagaaauauuacu

SEQ ID NO: 2015341 - RNA, 22 nt, Homo sapiens
auuauuuccaguguucuaugaa

SEQ ID NO: 2015342 - RNA, 23 nt, Homo sapiens
ucugugcuuugacucaccuguua

SEQ ID NO: 2015343 - RNA, 14 nt, Homo sapiens
cugauuuauugaaa

SEQ ID NO: 2015344 - RNA, 23 nt, Homo sapiens
gucccuucuucccuaaucagcuc

SEQ ID NO: 2015345 - RNA, 17 nt, Homo sapiens
cagugcuguacuugaug

SEQ ID NO: 2015346 - RNA, 16 nt, Homo sapiens
cugcccuaacuguaca

SEQ ID NO: 2015347 - RNA, 21 nt, Homo sapiens
acccugggguaaguggaguug

SEQ ID NO: 2015348 - RNA, 22 nt, Homo sapiens
cuaacagcccuccucugcacuc

SEQ ID NO: 2015349 - RNA, 17 nt, Homo sapiens
aacucucauuauucucu

SEQ ID NO: 2015350 - RNA, 24 nt, Homo sapiens
uaauaaaucucuucuuugcugcag

SEQ ID NO: 2015351 - RNA, 21 nt, Homo sapiens
uaguaugggaaaaaaacugaa

SEQ ID NO: 2015352 - RNA, 19 nt, Homo sapiens
ccccaaaaauugacuuaga

SEQ ID NO: 2015353 - RNA, 17 nt, Homo sapiens
aucaagggccuacuuua

SEQ ID NO: 2015354 - RNA, 19 nt, Homo sapiens
aggucagggggcacugucu

SEQ ID NO: 2015355 - RNA, 23 nt, Homo sapiens
uucaaaaaauuauuuuaggcaaa

SEQ ID NO: 2015356 - RNA, 19 nt, Homo sapiens
uggccuuaagaacuguguc

SEQ ID NO: 2015357 - RNA, 21 nt, Homo sapiens
uacaguauuauuuaguaaaau

SEQ ID NO: 2015358 - RNA, 18 nt, Homo sapiens
augaaacaaauaaucaca

SEQ ID NO: 2015359 - RNA, 21 nt, Homo sapiens
gcccaggaucguuuuuuccca

SEQ ID NO: 2015360 - RNA, 19 nt, Homo sapiens
ggccaauaaauaugauguu

SEQ ID NO: 2015361 - RNA, 15 nt, Homo sapiens
agaaugugacaggca

SEQ ID NO: 2015362 - RNA, 17 nt, Homo sapiens
uaugugugguacuuugc

SEQ ID NO: 2015363 - RNA, 17 nt, Homo sapiens
gugauagagccuuugau

SEQ ID NO: 2015364 - RNA, 14 nt, Homo sapiens
ccucugaaaaccaa

SEQ ID NO: 2015365 - RNA, 12 nt, Homo sapiens
aucacugccaaa

SEQ ID NO: 2015366 - RNA, 21 nt, Homo sapiens
uggcaacagagcaagacucca

SEQ ID NO: 2015367 - RNA, 15 nt, Homo sapiens
ggcaugucugguuca

SEQ ID NO: 2015368 - RNA, 17 nt, Homo sapiens
aaacgagggcugaugga

SEQ ID NO: 2015369 - RNA, 18 nt, Homo sapiens
cuuaugcuuaaauucaag

SEQ ID NO: 2015370 - RNA, 13 nt, Homo sapiens
gagcaguccaugc

SEQ ID NO: 2015371 - RNA, 17 nt, Homo sapiens
cuggucccucugcaguc

SEQ ID NO: 2015372 - RNA, 17 nt, Homo sapiens
guuuccccaccagugaa

SEQ ID NO: 2015373 - RNA, 11 nt, Homo sapiens
guugugcucuu

SEQ ID NO: 2015374 - RNA, 18 nt, Homo sapiens
uuuccugagcccuaaaca

SEQ ID NO: 2015375 - RNA, 16 nt, Homo sapiens
agacugggcugaggga

SEQ ID NO: 2015376 - RNA, 14 nt, Homo sapiens
gccuacuccaaaau

SEQ ID NO: 2015377 - RNA, 15 nt, Homo sapiens
gcuucugcauucaca

SEQ ID NO: 2015378 - RNA, 21 nt, Homo sapiens
aagccacagggaagcauguac

SEQ ID NO: 2015379 - RNA, 12 nt, Homo sapiens
cacccacaugug

SEQ ID NO: 2015380 - RNA, 15 nt, Homo sapiens
gagugguuguugcca

SEQ ID NO: 2015381 - RNA, 21 nt, Homo sapiens
ccucccacccugcaaagggaa

SEQ ID NO: 2015382 - RNA, 12 nt, Homo sapiens
cucccagccuuu

SEQ ID NO: 2015383 - RNA, 12 nt, Homo sapiens
aucccagcauuu

SEQ ID NO: 2015384 - RNA, 20 nt, Homo sapiens
uagcuauuaaaaaaaaucag

SEQ ID NO: 2015385 - RNA, 19 nt, Homo sapiens
cacccaugccauagaaacu

SEQ ID NO: 2015386 - RNA, 23 nt, Homo sapiens
agugagaacuaggugugcaagaa

SEQ ID NO: 2015387 - RNA, 14 nt, Homo sapiens
aaaugcagaacuua

SEQ ID NO: 2015388 - RNA, 17 nt, Homo sapiens
uccuggaaauucugcug

SEQ ID NO: 2015389 - RNA, 15 nt, Homo sapiens
aguaacaacaaaaua

SEQ ID NO: 2015390 - RNA, 15 nt, Homo sapiens
ucuucuaaauggcaa

SEQ ID NO: 2015391 - RNA, 19 nt, Homo sapiens
aaaggagccuacuccaaga

SEQ ID NO: 2015392 - RNA, 18 nt, Homo sapiens
guaauccuagcacuuugg

SEQ ID NO: 2015393 - RNA, 17 nt, Homo sapiens
aggcuccagcacuucag

SEQ ID NO: 2015394 - RNA, 21 nt, Homo sapiens
aauuuuuuuccagaauugaga

SEQ ID NO: 2015395 - RNA, 22 nt, Homo sapiens
ucaggugucccugcacuugcag

SEQ ID NO: 2015396 - RNA, 16 nt, Homo sapiens
cauuuguaaaaaguag

SEQ ID NO: 2015397 - RNA, 21 nt, Homo sapiens
ugcuuuccuucuuugggauag

SEQ ID NO: 2015398 - RNA, 18 nt, Homo sapiens
auaaacaguagugauagu

SEQ ID NO: 2015399 - RNA, 21 nt, Homo sapiens
aagccacauuauuucuagucc

SEQ ID NO: 2015400 - RNA, 14 nt, Homo sapiens
aucacuaccuuuau

SEQ ID NO: 2015401 - RNA, 23 nt, Homo sapiens
auauaguccagacacuuaacuca

SEQ ID NO: 2015402 - RNA, 17 nt, Homo sapiens
acacuggaacauuccag

SEQ ID NO: 2015403 - RNA, 18 nt, Homo sapiens
cugaccuuccaaaccuca

SEQ ID NO: 2015404 - RNA, 18 nt, Homo sapiens
cuccuggcuguccuacca

SEQ ID NO: 2015405 - RNA, 15 nt, Homo sapiens
gcccuccgcccuucc

SEQ ID NO: 2015406 - RNA, 18 nt, Homo sapiens
uuuaucaccucauucuga

SEQ ID NO: 2015407 - RNA, 15 nt, Homo sapiens
ugagaucauugugaa

SEQ ID NO: 2015408 - RNA, 21 nt, Homo sapiens
cacaaucuguucuacucuuaa

SEQ ID NO: 2015409 - RNA, 13 nt, Homo sapiens
ccuauaaauauua

SEQ ID NO: 2015410 - RNA, 16 nt, Homo sapiens
auuuauuuaagcauca

SEQ ID NO: 2015411 - RNA, 21 nt, Homo sapiens
auuacccacccgaccuggcug

SEQ ID NO: 2015412 - RNA, 15 nt, Homo sapiens
gaaagucauaguuuu

SEQ ID NO: 2015413 - RNA, 20 nt, Homo sapiens
uucugucccacuacaucugg

SEQ ID NO: 2015414 - RNA, 14 nt, Homo sapiens
auugacgaacuggc

SEQ ID NO: 2015415 - RNA, 15 nt, Homo sapiens
gcuaugguugccacc

SEQ ID NO: 2015416 - RNA, 15 nt, Homo sapiens
accauuuaucuaccc

SEQ ID NO: 2015417 - RNA, 16 nt, Homo sapiens
gccgucaaaagguaaa

SEQ ID NO: 2015418 - RNA, 19 nt, Homo sapiens
uccaguuucccaccaccuu

SEQ ID NO: 2015419 - RNA, 17 nt, Homo sapiens
gccauggucacccucag

SEQ ID NO: 2015420 - RNA, 14 nt, Homo sapiens
uaugaggcuggggc

SEQ ID NO: 2015421 - RNA, 20 nt, Homo sapiens
aaucaguguguuacuaucua

SEQ ID NO: 2015422 - RNA, 16 nt, Homo sapiens
caguguuuccacacuu

SEQ ID NO: 2015423 - RNA, 20 nt, Homo sapiens
uaugaugguggaucaagaca

SEQ ID NO: 2015424 - RNA, 20 nt, Homo sapiens
guaacacaguguagugcuca

SEQ ID NO: 2015425 - RNA, 20 nt, Homo sapiens
agugcucuggggcacuguug

SEQ ID NO: 2015426 - RNA, 13 nt, Homo sapiens
gucaaaaaucugu

SEQ ID NO: 2015427 - RNA, 21 nt, Homo sapiens
uaagaggauagaauacaugga

SEQ ID NO: 2015428 - RNA, 20 nt, Homo sapiens
gcacuguucccccugugcag

SEQ ID NO: 2015429 - RNA, 22 nt, Homo sapiens
ccacucugagugaauacuuuga

SEQ ID NO: 2015430 - RNA, 16 nt, Homo sapiens
ccuuuugaccaaauaa

SEQ ID NO: 2015431 - RNA, 16 nt, Homo sapiens
cacccuuuccucuuaa

SEQ ID NO: 2015432 - RNA, 12 nt, Homo sapiens
agaaauguacaa

SEQ ID NO: 2015433 - RNA, 14 nt, Homo sapiens
acuuauuuauauaa

SEQ ID NO: 2015434 - RNA, 18 nt, Homo sapiens
aguaggggcuacugugac

SEQ ID NO: 2015435 - RNA, 18 nt, Homo sapiens
agguccccauacuccuau

SEQ ID NO: 2015436 - RNA, 18 nt, Homo sapiens
ggacuucugggucuccag

SEQ ID NO: 2015437 - RNA, 12 nt, Homo sapiens
aaauuaaacccu

SEQ ID NO: 2015438 - RNA, 18 nt, Homo sapiens
cugcauuaucuugcucau

SEQ ID NO: 2015439 - RNA, 14 nt, Homo sapiens
caaugcucaacucc

SEQ ID NO: 2015440 - RNA, 16 nt, Homo sapiens
aucucucccacuuccu

SEQ ID NO: 2015441 - RNA, 16 nt, Homo sapiens
cugcucuacccaugag

SEQ ID NO: 2015442 - RNA, 16 nt, Homo sapiens
ccuucagaaugcuccu

SEQ ID NO: 2015443 - RNA, 18 nt, Homo sapiens
cugugcugauucaauaaa

SEQ ID NO: 2015444 - RNA, 18 nt, Homo sapiens
ugauucaaauugcugcuu

SEQ ID NO: 2015445 - RNA, 14 nt, Homo sapiens
ucuaaaauagccac

SEQ ID NO: 2015446 - RNA, 14 nt, Homo sapiens
uaaacucaagacaa

SEQ ID NO: 2015447 - RNA, 17 nt, Homo sapiens
aucuuacacaucugcca

SEQ ID NO: 2015448 - RNA, 13 nt, Homo sapiens
gcucuuuauaugu

SEQ ID NO: 2015449 - RNA, 23 nt, Homo sapiens
auaaagucaaggacgaauuugca

SEQ ID NO: 2015450 - RNA, 17 nt, Homo sapiens
cuacaucaaaugcucaa

SEQ ID NO: 2015451 - RNA, 13 nt, Homo sapiens
gccugguuugcaa

SEQ ID NO: 2015452 - RNA, 20 nt, Homo sapiens
cguuuguuccccaagacauu

SEQ ID NO: 2015453 - RNA, 15 nt, Homo sapiens
gagcagagaaggcca

SEQ ID NO: 2015454 - RNA, 19 nt, Homo sapiens
cuaaaauuagaugaacuca

SEQ ID NO: 2015455 - RNA, 19 nt, Homo sapiens
uuugcuagacucuagacaa

SEQ ID NO: 2015456 - RNA, 20 nt, Homo sapiens
cuaauguuaggucaagcuau

SEQ ID NO: 2015457 - RNA, 15 nt, Homo sapiens
uggagcccuguaauu

SEQ ID NO: 2015458 - RNA, 21 nt, Homo sapiens
cagcauuaaaaaaaaucaaaa

SEQ ID NO: 2015459 - RNA, 14 nt, Homo sapiens
uauuacuaguacua

SEQ ID NO: 2015460 - RNA, 14 nt, Homo sapiens
aagaggcagggucu

SEQ ID NO: 2015461 - RNA, 22 nt, Homo sapiens
uuacuauugcucuuacuugaaa

SEQ ID NO: 2015462 - RNA, 20 nt, Homo sapiens
cuauuucaauacuuacauau

SEQ ID NO: 2015463 - RNA, 20 nt, Homo sapiens
uccuggcccuggaaggugcc

SEQ ID NO: 2015464 - RNA, 15 nt, Homo sapiens
uggggacagaccagc

SEQ ID NO: 2015465 - RNA, 16 nt, Homo sapiens
aacucacuuuaaauau

SEQ ID NO: 2015466 - RNA, 20 nt, Homo sapiens
augaucagcuguuugucaua

SEQ ID NO: 2015467 - RNA, 20 nt, Homo sapiens
uggaaguuucuggugccauu

SEQ ID NO: 2015468 - RNA, 16 nt, Homo sapiens
uauguaaacaucauaa

SEQ ID NO: 2015469 - RNA, 16 nt, Homo sapiens
gucauaucuagucacu

SEQ ID NO: 2015470 - RNA, 20 nt, Homo sapiens
cucuguaaaacgcaccaauc

SEQ ID NO: 2015471 - RNA, 19 nt, Homo sapiens
aagagaaaaaauauuuucc

SEQ ID NO: 2015472 - RNA, 14 nt, Homo sapiens
accaucuucuguac

SEQ ID NO: 2015473 - RNA, 16 nt, Homo sapiens
ucaugaguaacugauu

SEQ ID NO: 2015474 - RNA, 23 nt, Homo sapiens
guguuggcaaacgagacuuucuc

SEQ ID NO: 2015475 - RNA, 17 nt, Homo sapiens
gggccccucagggcugu

SEQ ID NO: 2015476 - RNA, 20 nt, Homo sapiens
aauuacugugagaacuguga

SEQ ID NO: 2015477 - RNA, 14 nt, Homo sapiens
gaauaccagcuuuc

SEQ ID NO: 2015478 - RNA, 18 nt, Homo sapiens
cgauugagaacugacaaa

SEQ ID NO: 2015479 - RNA, 21 nt, Homo sapiens
agaugugcuuugcugcacaaa

SEQ ID NO: 2015480 - RNA, 15 nt, Homo sapiens
cugaggccagaguca

SEQ ID NO: 2015481 - RNA, 16 nt, Homo sapiens
gcacaccccugcacac

SEQ ID NO: 2015482 - RNA, 18 nt, Homo sapiens
agaaaaguaauuuuguca

SEQ ID NO: 2015483 - RNA, 14 nt, Homo sapiens
aaagacauagccaa

SEQ ID NO: 2015484 - RNA, 15 nt, Homo sapiens
cuguuguaugccugg

SEQ ID NO: 2015485 - RNA, 22 nt, Homo sapiens
cuguccuugaaaaacaaaguuu

SEQ ID NO: 2015486 - RNA, 13 nt, Homo sapiens
uguaacacuuguc

SEQ ID NO: 2015487 - RNA, 22 nt, Homo sapiens
agaggaaugugggcuauguagu

SEQ ID NO: 2015488 - RNA, 20 nt, Homo sapiens
agacaaaccuuaaaacagcu

SEQ ID NO: 2015489 - RNA, 17 nt, Homo sapiens
ggcacaggaugcugugu

SEQ ID NO: 2015490 - RNA, 15 nt, Homo sapiens
ucaccucugccucaa

SEQ ID NO: 2015491 - RNA, 15 nt, Homo sapiens
aggacgaauuugcac

SEQ ID NO: 2015492 - RNA, 15 nt, Homo sapiens
uucaaccccaugaga

SEQ ID NO: 2015493 - RNA, 19 nt, Homo sapiens
gagguggagcuugcaguga

SEQ ID NO: 2015494 - RNA, 23 nt, Homo sapiens
uuuccuagcuaggagcaggcuug

SEQ ID NO: 2015495 - RNA, 17 nt, Homo sapiens
gcuaaaggacaguggau

SEQ ID NO: 2015496 - RNA, 19 nt, Homo sapiens
acugcggugaacauuuccu

SEQ ID NO: 2015497 - RNA, 15 nt, Homo sapiens
cucugcuguagcuua

SEQ ID NO: 2015498 - RNA, 14 nt, Homo sapiens
ucugcccuuuccua

SEQ ID NO: 2015499 - RNA, 12 nt, Homo sapiens
gauucuucagcu

SEQ ID NO: 2015500 - RNA, 20 nt, Homo sapiens
aacauuaaaauuagcacuaa

SEQ ID NO: 2015501 - RNA, 14 nt, Homo sapiens
cuucaaauccugcc

SEQ ID NO: 2015502 - RNA, 13 nt, Homo sapiens
ggggugacacaga

SEQ ID NO: 2015503 - RNA, 22 nt, Homo sapiens
cuuaagaacugcuucaugugaa

SEQ ID NO: 2015504 - RNA, 22 nt, Homo sapiens
uuacuaaggaguaaucugugua

SEQ ID NO: 2015505 - RNA, 20 nt, Homo sapiens
aauauauauggucauauaca

SEQ ID NO: 2015506 - RNA, 18 nt, Homo sapiens
gcuuauaucuggccucug

SEQ ID NO: 2015507 - RNA, 12 nt, Homo sapiens
cugaaaauugau

SEQ ID NO: 2015508 - RNA, 23 nt, Homo sapiens
agaagacugucagcuuccaaaca

SEQ ID NO: 2015509 - RNA, 14 nt, Homo sapiens
aucacaaaugacuu

SEQ ID NO: 2015510 - RNA, 22 nt, Homo sapiens
agauucaaggccccgagcuguu

SEQ ID NO: 2015511 - RNA, 20 nt, Homo sapiens
cucccaaagugcugggauua

SEQ ID NO: 2015512 - RNA, 19 nt, Homo sapiens
accuuuuccugcggcauca

SEQ ID NO: 2015513 - RNA, 14 nt, Homo sapiens
ggucaaugucauaa

SEQ ID NO: 2015514 - RNA, 20 nt, Homo sapiens
agaggaaugaggcucuguaa

SEQ ID NO: 2015515 - RNA, 11 nt, Homo sapiens
auuaaacaauu

SEQ ID NO: 2015516 - RNA, 13 nt, Homo sapiens
uauauucuuuaaa

SEQ ID NO: 2015517 - RNA, 17 nt, Homo sapiens
acauugcauugugacua

SEQ ID NO: 2015518 - RNA, 15 nt, Homo sapiens
cuaucaccugucauc

SEQ ID NO: 2015519 - RNA, 13 nt, Homo sapiens
ucugcacugagga

SEQ ID NO: 2015520 - RNA, 13 nt, Homo sapiens
uagagggcccaaa

SEQ ID NO: 2015521 - RNA, 12 nt, Homo sapiens
ccccgagcucag

SEQ ID NO: 2015522 - RNA, 19 nt, Homo sapiens
uacacccaguucugaauaa

SEQ ID NO: 2015523 - RNA, 21 nt, Homo sapiens
aauugggggaggacacauuug

SEQ ID NO: 2015524 - RNA, 19 nt, Homo sapiens
gucuccagaguuguucucu

SEQ ID NO: 2015525 - RNA, 14 nt, Homo sapiens
cugcagaaccaguc

SEQ ID NO: 2015526 - RNA, 12 nt, Homo sapiens
uaaggucuuugu

SEQ ID NO: 2015527 - RNA, 12 nt, Homo sapiens
agcaucaaccua

SEQ ID NO: 2015528 - RNA, 19 nt, Homo sapiens
ucugggaguggggaaguga

SEQ ID NO: 2015529 - RNA, 19 nt, Homo sapiens
gcauuauguacuacaugac

SEQ ID NO: 2015530 - RNA, 12 nt, Homo sapiens
ucuucauggaau

SEQ ID NO: 2015531 - RNA, 16 nt, Homo sapiens
aaaguuguagcuccag

SEQ ID NO: 2015532 - RNA, 13 nt, Homo sapiens
uccuccccauaca

SEQ ID NO: 2015533 - RNA, 14 nt, Homo sapiens
ccaauggauucaug

SEQ ID NO: 2015534 - RNA, 22 nt, Homo sapiens
aucuuacagguaucaggcacag

SEQ ID NO: 2015535 - RNA, 15 nt, Homo sapiens
uucagcugaacacaa

SEQ ID NO: 2015536 - RNA, 18 nt, Homo sapiens
cagaggaguacaggugaa

SEQ ID NO: 2015537 - RNA, 16 nt, Homo sapiens
gguuggagugcagugg

SEQ ID NO: 2015538 - RNA, 14 nt, Homo sapiens
augcuauuugcaau

SEQ ID NO: 2015539 - RNA, 16 nt, Homo sapiens
agguccugcauuucuc

SEQ ID NO: 2015540 - RNA, 15 nt, Homo sapiens
uucuucaagauccca

SEQ ID NO: 2015541 - RNA, 23 nt, Homo sapiens
agaguguauuacaacaaucugga

SEQ ID NO: 2015542 - RNA, 15 nt, Homo sapiens
gcaugaauagauucu

SEQ ID NO: 2015543 - RNA, 15 nt, Homo sapiens
caacaguucaaagaa

SEQ ID NO: 2015544 - RNA, 16 nt, Homo sapiens
cccagccucagaucca

SEQ ID NO: 2015545 - RNA, 18 nt, Homo sapiens
uccaggcccacggcucaa

SEQ ID NO: 2015546 - RNA, 21 nt, Homo sapiens
cacuaaaccgauaaugcauga

SEQ ID NO: 2015547 - RNA, 14 nt, Homo sapiens
gugauuuuugaaca

SEQ ID NO: 2015548 - RNA, 13 nt, Homo sapiens
gccugacugccca

SEQ ID NO: 2015549 - RNA, 13 nt, Homo sapiens
ugccuuugcuccu

SEQ ID NO: 2015550 - RNA, 13 nt, Homo sapiens
ugaauuugcuaau

SEQ ID NO: 2015551 - RNA, 13 nt, Homo sapiens
ugguuuugcuguu

SEQ ID NO: 2015552 - RNA, 16 nt, Homo sapiens
uuuuguguuuugguua

SEQ ID NO: 2015553 - RNA, 18 nt, Homo sapiens
uggggccugugcacuguu

SEQ ID NO: 2015554 - RNA, 22 nt, Homo sapiens
gcccugcaggcuguuuauaugu

SEQ ID NO: 2015555 - RNA, 22 nt, Homo sapiens
caccucacgcucuggacaugau

SEQ ID NO: 2015556 - RNA, 12 nt, Homo sapiens
ugacuauggaaa

SEQ ID NO: 2015557 - RNA, 18 nt, Homo sapiens
cuggacacagccccaugu

SEQ ID NO: 2015558 - RNA, 18 nt, Homo sapiens
ucauugucuuauaugcuu

SEQ ID NO: 2015559 - RNA, 18 nt, Homo sapiens
cugcauguuugcuguucc

SEQ ID NO: 2015560 - RNA, 16 nt, Homo sapiens
ugaguaaucauacuca

SEQ ID NO: 2015561 - RNA, 15 nt, Homo sapiens
gauugggauuuccau

SEQ ID NO: 2015562 - RNA, 16 nt, Homo sapiens
cuaauaucaaaugcag

SEQ ID NO: 2015563 - RNA, 16 nt, Homo sapiens
aggugugaacagggaa

SEQ ID NO: 2015564 - RNA, 21 nt, Homo sapiens
gagggucaaaggagaacaaga

SEQ ID NO: 2015565 - RNA, 23 nt, Homo sapiens
aggaggaaggagccuauggcauc

SEQ ID NO: 2015566 - RNA, 21 nt, Homo sapiens
ugggcccucccuuuaccuuca

SEQ ID NO: 2015567 - RNA, 20 nt, Homo sapiens
cucuucucauuuuuuccuga

SEQ ID NO: 2015568 - RNA, 15 nt, Homo sapiens
aaauguacauuucca

SEQ ID NO: 2015569 - RNA, 23 nt, Homo sapiens
acaauaggaucccccuucuugcc

SEQ ID NO: 2015570 - RNA, 17 nt, Homo sapiens
uuuguuaugacagugaa

SEQ ID NO: 2015571 - RNA, 14 nt, Homo sapiens
gcuuugccuauuga

SEQ ID NO: 2015572 - RNA, 23 nt, Homo sapiens
caaaaugcagucuuaccaaugac

SEQ ID NO: 2015573 - RNA, 18 nt, Homo sapiens
uaaagcaaagugagucau

SEQ ID NO: 2015574 - RNA, 23 nt, Homo sapiens
auugucauggggaucaauuuuca

SEQ ID NO: 2015575 - RNA, 10 nt, Homo sapiens
gaagcaaagg

SEQ ID NO: 2015576 - RNA, 23 nt, Homo sapiens
ucuacaagcauuugcccugugga

SEQ ID NO: 2015577 - RNA, 23 nt, Homo sapiens
ugggcucacuucuaauaacugca

SEQ ID NO: 2015578 - RNA, 12 nt, Homo sapiens
gcagacaggcug

SEQ ID NO: 2015579 - RNA, 12 nt, Homo sapiens
gaagacaggaug

SEQ ID NO: 2015580 - RNA, 13 nt, Homo sapiens
agagaggcugccu

SEQ ID NO: 2015581 - RNA, 14 nt, Homo sapiens
acagaguuucacuc

SEQ ID NO: 2015582 - RNA, 13 nt, Homo sapiens
aucuggugcgugu

SEQ ID NO: 2015583 - RNA, 17 nt, Homo sapiens
gaauuccaacucacuuu

SEQ ID NO: 2015584 - RNA, 20 nt, Homo sapiens
gauuaaccugcaugcagcaa

SEQ ID NO: 2015585 - RNA, 16 nt, Homo sapiens
uaagcagaaauccugc

SEQ ID NO: 2015586 - RNA, 20 nt, Homo sapiens
cucccaaaugcaaacagucu

SEQ ID NO: 2015587 - RNA, 19 nt, Homo sapiens
cuucauucuccguugucau

SEQ ID NO: 2015588 - RNA, 22 nt, Homo sapiens
acaucagauuagagagucucaa

SEQ ID NO: 2015589 - RNA, 14 nt, Homo sapiens
aauuugacucauga

SEQ ID NO: 2015590 - RNA, 15 nt, Homo sapiens
ugcacguugugcaca

SEQ ID NO: 2015591 - RNA, 22 nt, Homo sapiens
ccugguggcuucagcaguccuu

SEQ ID NO: 2015592 - RNA, 23 nt, Homo sapiens
uccuggcaucaguagcaucugua

SEQ ID NO: 2015593 - RNA, 23 nt, Homo sapiens
aauuucuucuccuggaguugcau

SEQ ID NO: 2015594 - RNA, 14 nt, Homo sapiens
ggaaaaacugacag

SEQ ID NO: 2015595 - RNA, 20 nt, Homo sapiens
ccauucugucuuccuaggaa

SEQ ID NO: 2015596 - RNA, 16 nt, Homo sapiens
caacccacaccaaaua

SEQ ID NO: 2015597 - RNA, 22 nt, Homo sapiens
aaaaacuacuguuaacacugcu

SEQ ID NO: 2015598 - RNA, 18 nt, Homo sapiens
ucucugagaacagacguu

SEQ ID NO: 2015599 - RNA, 23 nt, Homo sapiens
cugcaucgauccccagccuggug

SEQ ID NO: 2015600 - RNA, 14 nt, Homo sapiens
agggagugagugca

SEQ ID NO: 2015601 - RNA, 13 nt, Homo sapiens
uaguguguaaaau

SEQ ID NO: 2015602 - RNA, 22 nt, Homo sapiens
gugaaacccuacgaaagcacag

SEQ ID NO: 2015603 - RNA, 19 nt, Homo sapiens
acuucuuuaaaaaaacaca

SEQ ID NO: 2015604 - RNA, 15 nt, Homo sapiens
ugcagcuacuggaau

SEQ ID NO: 2015605 - RNA, 18 nt, Homo sapiens
cucucaggccaaacucac

SEQ ID NO: 2015606 - RNA, 12 nt, Homo sapiens
ugccgaauuugg

SEQ ID NO: 2015607 - RNA, 21 nt, Homo sapiens
agcuggcaauauuacaauccu

SEQ ID NO: 2015608 - RNA, 18 nt, Homo sapiens
auccagcccugguucugg

SEQ ID NO: 2015609 - RNA, 20 nt, Homo sapiens
augcugucaagcaccugcau

SEQ ID NO: 2015610 - RNA, 19 nt, Homo sapiens
aaguauauacugaagugug

SEQ ID NO: 2015611 - RNA, 16 nt, Homo sapiens
ugaacaaaguuuacca

SEQ ID NO: 2015612 - RNA, 23 nt, Homo sapiens
gaguaggugggggaacacugaga

SEQ ID NO: 2015613 - RNA, 21 nt, Homo sapiens
cauacaggcauacacaugcac

SEQ ID NO: 2015614 - RNA, 13 nt, Homo sapiens
ucgcaauuacuug

SEQ ID NO: 2015615 - RNA, 15 nt, Homo sapiens
acucaaggacagcca

SEQ ID NO: 2015616 - RNA, 20 nt, Homo sapiens
uuguugcuuaucuuuuccaa

SEQ ID NO: 2015617 - RNA, 18 nt, Homo sapiens
ucuccugcccacucugac

SEQ ID NO: 2015618 - RNA, 19 nt, Homo sapiens
gaaaagagagcagagaaua

SEQ ID NO: 2015619 - RNA, 16 nt, Homo sapiens
gucccuguggccuuca

SEQ ID NO: 2015620 - RNA, 14 nt, Homo sapiens
cuuuuuccaaacaa

SEQ ID NO: 2015621 - RNA, 17 nt, Homo sapiens
gaccuggaaucagugaa

SEQ ID NO: 2015622 - RNA, 18 nt, Homo sapiens
cauagcccagaucagcuc

SEQ ID NO: 2015623 - RNA, 16 nt, Homo sapiens
auuccuggcucuaccc

SEQ ID NO: 2015624 - RNA, 17 nt, Homo sapiens
aagaugucuucuguuca

SEQ ID NO: 2015625 - RNA, 17 nt, Homo sapiens
gcuuuuauccacuggca

SEQ ID NO: 2015626 - RNA, 17 nt, Homo sapiens
ccaaagaccaauauuca

SEQ ID NO: 2015627 - RNA, 16 nt, Homo sapiens
gagaaggaaaugcagg

SEQ ID NO: 2015628 - RNA, 22 nt, Homo sapiens
gcccuaagagugucacugagcu

SEQ ID NO: 2015629 - RNA, 17 nt, Homo sapiens
gccagacgcauccugcc

SEQ ID NO: 2015630 - RNA, 19 nt, Homo sapiens
aagccggcucuucaaagac

SEQ ID NO: 2015631 - RNA, 22 nt, Homo sapiens
auugucucccuuccagcaauaa

SEQ ID NO: 2015632 - RNA, 17 nt, Homo sapiens
uccaccagccugcacua

SEQ ID NO: 2015633 - RNA, 20 nt, Homo sapiens
gacaguccaaaccacuccac

SEQ ID NO: 2015634 - RNA, 20 nt, Homo sapiens
uaauguacaauaaagcaaug

SEQ ID NO: 2015635 - RNA, 17 nt, Homo sapiens
auagcagcagugcaugg

SEQ ID NO: 2015636 - RNA, 22 nt, Homo sapiens
caauauacaacuguaaagcaaa

SEQ ID NO: 2015637 - RNA, 16 nt, Homo sapiens
aauucaccuucacuua

SEQ ID NO: 2015638 - RNA, 22 nt, Homo sapiens
aaaaugaugguaccauguaaca

SEQ ID NO: 2015639 - RNA, 22 nt, Homo sapiens
auuacguaugucugguucucaa

SEQ ID NO: 2015640 - RNA, 13 nt, Homo sapiens
cgaaaacagucaa

SEQ ID NO: 2015641 - RNA, 13 nt, Homo sapiens
cugaccccagugu

SEQ ID NO: 2015642 - RNA, 13 nt, Homo sapiens
ucugacacacagc

SEQ ID NO: 2015643 - RNA, 13 nt, Homo sapiens
ucagccacacuga

SEQ ID NO: 2015644 - RNA, 16 nt, Homo sapiens
aaauuugggaggguga

SEQ ID NO: 2015645 - RNA, 15 nt, Homo sapiens
agcugcuuugagcua

SEQ ID NO: 2015646 - RNA, 17 nt, Homo sapiens
ucuccacugggugccaa

SEQ ID NO: 2015647 - RNA, 22 nt, Homo sapiens
cucaaucucagcuaacauucca

SEQ ID NO: 2015648 - RNA, 21 nt, Homo sapiens
uccccuuuguguagaaagcca

SEQ ID NO: 2015649 - RNA, 12 nt, Homo sapiens
gaggccaucuca

SEQ ID NO: 2015650 - RNA, 12 nt, Homo sapiens
guggccaucaca

SEQ ID NO: 2015651 - RNA, 14 nt, Homo sapiens
uauuagcccagaaa

SEQ ID NO: 2015652 - RNA, 15 nt, Homo sapiens
ccaacucuccacaaa

SEQ ID NO: 2015653 - RNA, 16 nt, Homo sapiens
aguuauuaaucuggac

SEQ ID NO: 2015654 - RNA, 21 nt, Homo sapiens
uuacgauuauaguaccacugc

SEQ ID NO: 2015655 - RNA, 18 nt, Homo sapiens
caaggccaagauuguccu

SEQ ID NO: 2015656 - RNA, 14 nt, Homo sapiens
acgcaguuacugaa

SEQ ID NO: 2015657 - RNA, 18 nt, Homo sapiens
ccugcccaggagcagcuu

SEQ ID NO: 2015658 - RNA, 12 nt, Homo sapiens
augcucacuuua

SEQ ID NO: 2015659 - RNA, 17 nt, Homo sapiens
cacaguucuccauuuca

SEQ ID NO: 2015660 - RNA, 23 nt, Homo sapiens
aggucggaccagcuuuucccaaa

SEQ ID NO: 2015661 - RNA, 16 nt, Homo sapiens
uaauacuucauucucu

SEQ ID NO: 2015662 - RNA, 22 nt, Homo sapiens
agccaccaugcccagcucagag

SEQ ID NO: 2015663 - RNA, 17 nt, Homo sapiens
uaacaccaucuggaguc

SEQ ID NO: 2015664 - RNA, 16 nt, Homo sapiens
agcagccaagggauga

SEQ ID NO: 2015665 - RNA, 14 nt, Homo sapiens
gcugucacuuccca

SEQ ID NO: 2015666 - RNA, 18 nt, Homo sapiens
gcuggaggaacauuggga

SEQ ID NO: 2015667 - RNA, 21 nt, Homo sapiens
uucaaauuuagcaaccuagaa

SEQ ID NO: 2015668 - RNA, 15 nt, Homo sapiens
acauuuagaugcacu

SEQ ID NO: 2015669 - RNA, 15 nt, Homo sapiens
uuccuuuuuucccau

SEQ ID NO: 2015670 - RNA, 19 nt, Homo sapiens
gaauucuggacaacccaag

SEQ ID NO: 2015671 - RNA, 15 nt, Homo sapiens
cauauuagugcagcc

SEQ ID NO: 2015672 - RNA, 19 nt, Homo sapiens
acaaauaaaccugaggcag

SEQ ID NO: 2015673 - RNA, 22 nt, Homo sapiens
uuccauguaucuuuugaacugg

SEQ ID NO: 2015674 - RNA, 22 nt, Homo sapiens
acaacaaaggauuaauugcugc

SEQ ID NO: 2015675 - RNA, 20 nt, Homo sapiens
aaagagcauauucacugguu

SEQ ID NO: 2015676 - RNA, 22 nt, Homo sapiens
ggcugaacccccacucacacaa

SEQ ID NO: 2015677 - RNA, 23 nt, Homo sapiens
cuacacagaggacccaggggaaa

SEQ ID NO: 2015678 - RNA, 15 nt, Homo sapiens
uuaccugagagauuu

SEQ ID NO: 2015679 - RNA, 22 nt, Homo sapiens
aaacaucagcugaauucacuua

SEQ ID NO: 2015680 - RNA, 12 nt, Homo sapiens
uucuacagccuc

SEQ ID NO: 2015681 - RNA, 21 nt, Homo sapiens
gugugcccacugaacaugcuc

SEQ ID NO: 2015682 - RNA, 14 nt, Homo sapiens
ugaucacugugaac

SEQ ID NO: 2015683 - RNA, 22 nt, Homo sapiens
aaacaauguuuuaaacauucuu

SEQ ID NO: 2015684 - RNA, 17 nt, Homo sapiens
gugcaagugugugcaug

SEQ ID NO: 2015685 - RNA, 19 nt, Homo sapiens
guauuuccagugcaauugu

SEQ ID NO: 2015686 - RNA, 20 nt, Homo sapiens
aggccgggcacgguggcuca

SEQ ID NO: 2015687 - RNA, 22 nt, Homo sapiens
aaacccgacaacauuucugcca

SEQ ID NO: 2015688 - RNA, 19 nt, Homo sapiens
caaagugcugagauuacag

SEQ ID NO: 2015689 - RNA, 18 nt, Homo sapiens
acacaguaauugugacaa

SEQ ID NO: 2015690 - RNA, 20 nt, Homo sapiens
ccccaguagagaaacauuug

SEQ ID NO: 2015691 - RNA, 20 nt, Homo sapiens
agggcccggugccuguagca

SEQ ID NO: 2015692 - RNA, 20 nt, Homo sapiens
auaguacucuuuguagcaaa

SEQ ID NO: 2015693 - RNA, 14 nt, Homo sapiens
aacacugaaucaug

SEQ ID NO: 2015694 - RNA, 13 nt, Homo sapiens
cuaccaagauaua

SEQ ID NO: 2015695 - RNA, 18 nt, Homo sapiens
acagagaggaguugccag

SEQ ID NO: 2015696 - RNA, 15 nt, Homo sapiens
cgcuaauguacuacg

SEQ ID NO: 2015697 - RNA, 15 nt, Homo sapiens
ugcaucugcacauag

SEQ ID NO: 2015698 - RNA, 21 nt, Homo sapiens
gccacuggacugucuaugaac

SEQ ID NO: 2015699 - RNA, 18 nt, Homo sapiens
gacugccggucauuugaa

SEQ ID NO: 2015700 - RNA, 22 nt, Homo sapiens
guuucuuaauuuggaaacuaau

SEQ ID NO: 2015701 - RNA, 20 nt, Homo sapiens
uccugagcagcugggauuac

SEQ ID NO: 2015702 - RNA, 20 nt, Homo sapiens
caucuucuuauuuuccaaau

SEQ ID NO: 2015703 - RNA, 18 nt, Homo sapiens
uccacuuccauguugucu

SEQ ID NO: 2015704 - RNA, 19 nt, Homo sapiens
auguuaauuaaacugaaga

SEQ ID NO: 2015705 - RNA, 13 nt, Homo sapiens
uacuugcauuuau

SEQ ID NO: 2015706 - RNA, 13 nt, Homo sapiens
uucuugcauauau

SEQ ID NO: 2015707 - RNA, 22 nt, Homo sapiens
aagaaguugcuaagugugcuua

SEQ ID NO: 2015708 - RNA, 18 nt, Homo sapiens
ccaaacccagccucuaga

SEQ ID NO: 2015709 - RNA, 15 nt, Homo sapiens
aaaagguuaucuuaa

SEQ ID NO: 2015710 - RNA, 22 nt, Homo sapiens
aaugauugauuauaucauuuug

SEQ ID NO: 2015711 - RNA, 21 nt, Homo sapiens
acccuggucuccguggcacuu

SEQ ID NO: 2015712 - RNA, 18 nt, Homo sapiens
augccauguauguugcau

SEQ ID NO: 2015713 - RNA, 17 nt, Homo sapiens
gauagcaaacacugggg

SEQ ID NO: 2015714 - RNA, 15 nt, Homo sapiens
aaagcugcugggcca

SEQ ID NO: 2015715 - RNA, 18 nt, Homo sapiens
aauaaaguuugcuuucag

SEQ ID NO: 2015716 - RNA, 15 nt, Homo sapiens
ucaaugcucuaacaa

SEQ ID NO: 2015717 - RNA, 19 nt, Homo sapiens
aguagagacaggguuucac

SEQ ID NO: 2015718 - RNA, 17 nt, Homo sapiens
caacaccaucacagcuu

SEQ ID NO: 2015719 - RNA, 19 nt, Homo sapiens
agagagaagcaaguggugg

SEQ ID NO: 2015720 - RNA, 20 nt, Homo sapiens
cuuaucaagcagccaaggga

SEQ ID NO: 2015721 - RNA, 16 nt, Homo sapiens
aauuaguaauugucaa

SEQ ID NO: 2015722 - RNA, 19 nt, Homo sapiens
cugaaauguuuuuaaugua

SEQ ID NO: 2015723 - RNA, 22 nt, Homo sapiens
gcgugaucucggcucacugcaa

SEQ ID NO: 2015724 - RNA, 23 nt, Homo sapiens
gugaugcaguuaguauagcuuua

SEQ ID NO: 2015725 - RNA, 16 nt, Homo sapiens
ccagugcagguauuuc

SEQ ID NO: 2015726 - RNA, 20 nt, Homo sapiens
cagugaaugugucuggaccu

SEQ ID NO: 2015727 - RNA, 22 nt, Homo sapiens
ucucaagccgcaucccagacuu

SEQ ID NO: 2015728 - RNA, 22 nt, Homo sapiens
ugaaaacucacagaacuaugua

SEQ ID NO: 2015729 - RNA, 19 nt, Homo sapiens
agcuuaaugcuacauguga

SEQ ID NO: 2015730 - RNA, 19 nt, Homo sapiens
cagacugcagacauucuca

SEQ ID NO: 2015731 - RNA, 14 nt, Homo sapiens
aacugccagaacau

SEQ ID NO: 2015732 - RNA, 18 nt, Homo sapiens
caggagggcacuggagcu

SEQ ID NO: 2015733 - RNA, 14 nt, Homo sapiens
gggcaggaccaaug

SEQ ID NO: 2015734 - RNA, 22 nt, Homo sapiens
auuuauguggauuuugcaugua

SEQ ID NO: 2015735 - RNA, 23 nt, Homo sapiens
acauccuuucuuuuaaugaugcc

SEQ ID NO: 2015736 - RNA, 19 nt, Homo sapiens
ugcagggucacucaucuaa

SEQ ID NO: 2015737 - RNA, 18 nt, Homo sapiens
aagacagaaaagugccug

SEQ ID NO: 2015738 - RNA, 15 nt, Homo sapiens
ucucugguuguccuc

SEQ ID NO: 2015739 - RNA, 14 nt, Homo sapiens
caggaggaucacag

SEQ ID NO: 2015740 - RNA, 17 nt, Homo sapiens
uucagcaguuucugaca

SEQ ID NO: 2015741 - RNA, 21 nt, Homo sapiens
uccuccucucucuacuugaau

SEQ ID NO: 2015742 - RNA, 19 nt, Homo sapiens
acaccuguagucccagcua

SEQ ID NO: 2015743 - RNA, 23 nt, Homo sapiens
ucaccaucuuucuaaucuuuuuc

SEQ ID NO: 2015744 - RNA, 15 nt, Homo sapiens
ucaaaacucuaucaa

SEQ ID NO: 2015745 - RNA, 17 nt, Homo sapiens
acaaagagcccaauuac

SEQ ID NO: 2015746 - RNA, 22 nt, Homo sapiens
auaaucucuuuaaauggcuuua

SEQ ID NO: 2015747 - RNA, 23 nt, Homo sapiens
ggccaggaaggacagacuggccg

SEQ ID NO: 2015748 - RNA, 20 nt, Homo sapiens
gcaaagaacucauuugaaug

SEQ ID NO: 2015749 - RNA, 13 nt, Homo sapiens
cauggguuccucc

SEQ ID NO: 2015750 - RNA, 16 nt, Homo sapiens
acaacuaugauuugga

SEQ ID NO: 2015751 - RNA, 19 nt, Homo sapiens
guuuuaauuuucuuguaua

SEQ ID NO: 2015752 - RNA, 12 nt, Homo sapiens
caguccagugau

SEQ ID NO: 2015753 - RNA, 17 nt, Homo sapiens
aaccagagccauggacu

SEQ ID NO: 2015754 - RNA, 17 nt, Homo sapiens
ccaugcucaaccacugu

SEQ ID NO: 2015755 - RNA, 20 nt, Homo sapiens
auuuggaaggcaaagacauu

SEQ ID NO: 2015756 - RNA, 22 nt, Homo sapiens
ucuguaaauaccauugacacau

SEQ ID NO: 2015757 - RNA, 16 nt, Homo sapiens
ugccugguggcagcug

SEQ ID NO: 2015758 - RNA, 14 nt, Homo sapiens
ugcauauauuuuag

SEQ ID NO: 2015759 - RNA, 22 nt, Homo sapiens
uuuucuaaaaugaugauaguau

SEQ ID NO: 2015760 - RNA, 17 nt, Homo sapiens
aucaaaagaauguccaa

SEQ ID NO: 2015761 - RNA, 16 nt, Homo sapiens
auggcacccaugcacc

SEQ ID NO: 2015762 - RNA, 14 nt, Homo sapiens
ugcuucccaaacuc

SEQ ID NO: 2015763 - RNA, 16 nt, Homo sapiens
caagcuugaggccaag

SEQ ID NO: 2015764 - RNA, 21 nt, Homo sapiens
agacagggucucacuguguug

SEQ ID NO: 2015765 - RNA, 22 nt, Homo sapiens
gguaugucauucgcuacuauga

SEQ ID NO: 2015766 - RNA, 16 nt, Homo sapiens
cuugcuggaccugaau

SEQ ID NO: 2015767 - RNA, 23 nt, Homo sapiens
acaguguuggagguuaaggcaua

SEQ ID NO: 2015768 - RNA, 19 nt, Homo sapiens
aaggauuuuaccaaagcau

SEQ ID NO: 2015769 - RNA, 14 nt, Homo sapiens
acuuuuauuuccag

SEQ ID NO: 2015770 - RNA, 15 nt, Homo sapiens
cccuuacacagauug

SEQ ID NO: 2015771 - RNA, 15 nt, Homo sapiens
auacugaugagacaa

SEQ ID NO: 2015772 - RNA, 22 nt, Homo sapiens
uaggcuggaagagccaaagaau

SEQ ID NO: 2015773 - RNA, 20 nt, Homo sapiens
gccauucagucuagcuuuua

SEQ ID NO: 2015774 - RNA, 21 nt, Homo sapiens
uguuguauuuucuuacugaag

SEQ ID NO: 2015775 - RNA, 14 nt, Homo sapiens
uaauuuuugcaauu

SEQ ID NO: 2015776 - RNA, 14 nt, Homo sapiens
ucuacuuugauucu

SEQ ID NO: 2015777 - RNA, 22 nt, Homo sapiens
gccccugggguggccaccagua

SEQ ID NO: 2015778 - RNA, 20 nt, Homo sapiens
acaaugaacccccaugaugu

SEQ ID NO: 2015779 - RNA, 20 nt, Homo sapiens
aggccaggcacaguggcuca

SEQ ID NO: 2015780 - RNA, 20 nt, Homo sapiens
uagggugcugcgcagcaucc

SEQ ID NO: 2015781 - RNA, 17 nt, Homo sapiens
gaaagugacaugcauuc

SEQ ID NO: 2015782 - RNA, 21 nt, Homo sapiens
auuucucucuuauaugccaga

SEQ ID NO: 2015783 - RNA, 16 nt, Homo sapiens
caugagaugagaugac

SEQ ID NO: 2015784 - RNA, 19 nt, Homo sapiens
caacuauuucuuucaucag

SEQ ID NO: 2015785 - RNA, 16 nt, Homo sapiens
agcaaccagucaaaac

SEQ ID NO: 2015786 - RNA, 17 nt, Homo sapiens
gcaacaauaaaguacuu

SEQ ID NO: 2015787 - RNA, 12 nt, Homo sapiens
aaaaaggccuuu

SEQ ID NO: 2015788 - RNA, 21 nt, Homo sapiens
cacacaggccuggcccagcca

SEQ ID NO: 2015789 - RNA, 20 nt, Homo sapiens
agaaaaugugaguaguacaa

SEQ ID NO: 2015790 - RNA, 17 nt, Homo sapiens
uacaacucggggacaaa

SEQ ID NO: 2015791 - RNA, 15 nt, Homo sapiens
gauggccccuccagc

SEQ ID NO: 2015792 - RNA, 18 nt, Homo sapiens
ccaggccagagggcagug

SEQ ID NO: 2015793 - RNA, 23 nt, Homo sapiens
aauacacaucucugucaguguga

SEQ ID NO: 2015794 - RNA, 20 nt, Homo sapiens
caaacucuguacagcaaggu

SEQ ID NO: 2015795 - RNA, 14 nt, Homo sapiens
guggauaaccacag

SEQ ID NO: 2015796 - RNA, 19 nt, Homo sapiens
cagccuggacgacauagcg

SEQ ID NO: 2015797 - RNA, 21 nt, Homo sapiens
aguaauaauguaauacuguag

SEQ ID NO: 2015798 - RNA, 15 nt, Homo sapiens
agaaauacuugaacu

SEQ ID NO: 2015799 - RNA, 14 nt, Homo sapiens
gcagugccucuugu

SEQ ID NO: 2015800 - RNA, 15 nt, Homo sapiens
ucuaaccuugaaugc

SEQ ID NO: 2015801 - RNA, 13 nt, Homo sapiens
uugagaaugguua

SEQ ID NO: 2015802 - RNA, 17 nt, Homo sapiens
aauggaaauguaauaau

SEQ ID NO: 2015803 - RNA, 16 nt, Homo sapiens
gggagcaugcuucccu

SEQ ID NO: 2015804 - RNA, 18 nt, Homo sapiens
cuuaaugcuacaugugag

SEQ ID NO: 2015805 - RNA, 22 nt, Homo sapiens
gucuaggauaacuugcuuucuu

SEQ ID NO: 2015806 - RNA, 16 nt, Homo sapiens
ccuuaugauauucuca

SEQ ID NO: 2015807 - RNA, 13 nt, Homo sapiens
cacugacagauuu

SEQ ID NO: 2015808 - RNA, 12 nt, Homo sapiens
augcuuauggaa

SEQ ID NO: 2015809 - RNA, 17 nt, Homo sapiens
gcugccuccacucccac

SEQ ID NO: 2015810 - RNA, 13 nt, Homo sapiens
uuuuuagucugug

SEQ ID NO: 2015811 - RNA, 14 nt, Homo sapiens
agagaccuauguaa

SEQ ID NO: 2015812 - RNA, 16 nt, Homo sapiens
aaccgcacaugugcca

SEQ ID NO: 2015813 - RNA, 16 nt, Homo sapiens
auacuuuauagcacau

SEQ ID NO: 2015814 - RNA, 20 nt, Homo sapiens
cacaacgcaccagacacuca

SEQ ID NO: 2015815 - RNA, 21 nt, Homo sapiens
gcucacaccuguccuucucag

SEQ ID NO: 2015816 - RNA, 11 nt, Homo sapiens
ugaacuuugaa

SEQ ID NO: 2015817 - RNA, 16 nt, Homo sapiens
aagaacaaaagaagca

SEQ ID NO: 2015818 - RNA, 16 nt, Homo sapiens
ucagggccucaggcac

SEQ ID NO: 2015819 - RNA, 16 nt, Homo sapiens
ugcagccgugcaggag

SEQ ID NO: 2015820 - RNA, 20 nt, Homo sapiens
ugaauacauuuugcacaaag

SEQ ID NO: 2015821 - RNA, 18 nt, Homo sapiens
aagcugucaccucuugau

SEQ ID NO: 2015822 - RNA, 16 nt, Homo sapiens
cagagcaaaugagcuc

SEQ ID NO: 2015823 - RNA, 14 nt, Homo sapiens
uucuuucauguaag

SEQ ID NO: 2015824 - RNA, 15 nt, Homo sapiens
uuaguucuucaaaga

SEQ ID NO: 2015825 - RNA, 21 nt, Homo sapiens
ucucagggaagcccagcucca

SEQ ID NO: 2015826 - RNA, 17 nt, Homo sapiens
ugcuuccuggucuggca

SEQ ID NO: 2015827 - RNA, 17 nt, Homo sapiens
ucuuuuuuaauuuccag

SEQ ID NO: 2015828 - RNA, 19 nt, Homo sapiens
uaacuuuaccaugcucaau

SEQ ID NO: 2015829 - RNA, 13 nt, Homo sapiens
auuguaagccaga

SEQ ID NO: 2015830 - RNA, 14 nt, Homo sapiens
aggcugugagccaa

SEQ ID NO: 2015831 - RNA, 14 nt, Homo sapiens
uuaaugguaucugu

SEQ ID NO: 2015832 - RNA, 21 nt, Homo sapiens
ccuuucauuaggcaaaguaca

SEQ ID NO: 2015833 - RNA, 17 nt, Homo sapiens
gcccagucccuggagcu

SEQ ID NO: 2015834 - RNA, 23 nt, Homo sapiens
aauacaccgauaaccacagggga

SEQ ID NO: 2015835 - RNA, 21 nt, Homo sapiens
gcugguccccuccucagugac

SEQ ID NO: 2015836 - RNA, 17 nt, Homo sapiens
aacuauuaaagugccau

SEQ ID NO: 2015837 - RNA, 12 nt, Homo sapiens
ggaacauuucag

SEQ ID NO: 2015838 - RNA, 19 nt, Homo sapiens
aggcaaaguuuacagaugu

SEQ ID NO: 2015839 - RNA, 18 nt, Homo sapiens
cugagauuuccuccuggc

SEQ ID NO: 2015840 - RNA, 18 nt, Homo sapiens
cagagccaagcacugcuc

SEQ ID NO: 2015841 - RNA, 13 nt, Homo sapiens
uacucgucuuccu

SEQ ID NO: 2015842 - RNA, 21 nt, Homo sapiens
cagaaaugaaacagacccuca

SEQ ID NO: 2015843 - RNA, 22 nt, Homo sapiens
acuuccuggccucuucugggcu

SEQ ID NO: 2015844 - RNA, 21 nt, Homo sapiens
gucaaaacccaccaaaaccaa

SEQ ID NO: 2015845 - RNA, 19 nt, Homo sapiens
ugugaacuauuaaucaucc

SEQ ID NO: 2015846 - RNA, 23 nt, Homo sapiens
aaccaagucuacuucacuaauga

SEQ ID NO: 2015847 - RNA, 20 nt, Homo sapiens
cugcuuuugagagcucuuca

SEQ ID NO: 2015848 - RNA, 18 nt, Homo sapiens
ucaccucuagguccccau

SEQ ID NO: 2015849 - RNA, 17 nt, Homo sapiens
agcacuccccuugccuu

SEQ ID NO: 2015850 - RNA, 15 nt, Homo sapiens
caaaggaaucacuuu

SEQ ID NO: 2015851 - RNA, 14 nt, Homo sapiens
ccaaaacacugucu

SEQ ID NO: 2015852 - RNA, 19 nt, Homo sapiens
ugcuaaccuuuucaccucc

SEQ ID NO: 2015853 - RNA, 14 nt, Homo sapiens
aucauucuccuugc

SEQ ID NO: 2015854 - RNA, 16 nt, Homo sapiens
uagauuuuucugugaa

SEQ ID NO: 2015855 - RNA, 17 nt, Homo sapiens
cgccguauuccagagau

SEQ ID NO: 2015856 - RNA, 13 nt, Homo sapiens
gcugcaacagugg

SEQ ID NO: 2015857 - RNA, 21 nt, Homo sapiens
aacccagcuagaaugugccug

SEQ ID NO: 2015858 - RNA, 17 nt, Homo sapiens
cccucagauuuccauug

SEQ ID NO: 2015859 - RNA, 21 nt, Homo sapiens
ugauaagagggcacacacugu

SEQ ID NO: 2015860 - RNA, 20 nt, Homo sapiens
uccgggaacuuugcagcaua

SEQ ID NO: 2015861 - RNA, 14 nt, Homo sapiens
aaaucuccaucuca

SEQ ID NO: 2015862 - RNA, 14 nt, Homo sapiens
cacaaucccuaaaa

SEQ ID NO: 2015863 - RNA, 14 nt, Homo sapiens
cauuuuaaggcaau

SEQ ID NO: 2015864 - RNA, 12 nt, Homo sapiens
ccacagucccau

SEQ ID NO: 2015865 - RNA, 14 nt, Homo sapiens
aacgaaacauuuag

SEQ ID NO: 2015866 - RNA, 21 nt, Homo sapiens
gaugaagacccuauuucagaa

SEQ ID NO: 2015867 - RNA, 17 nt, Homo sapiens
aguacuuauagaccuua

SEQ ID NO: 2015868 - RNA, 17 nt, Homo sapiens
agcugagaaaacuaagu

SEQ ID NO: 2015869 - RNA, 22 nt, Homo sapiens
ugaauaauacaguaucucaggg

SEQ ID NO: 2015870 - RNA, 19 nt, Homo sapiens
uuaaagcuuauccauaaaa

SEQ ID NO: 2015871 - RNA, 19 nt, Homo sapiens
ucccugucacacacuggac

SEQ ID NO: 2015872 - RNA, 18 nt, Homo sapiens
gcugugacuucuccaggu

SEQ ID NO: 2015873 - RNA, 22 nt, Homo sapiens
uuuggggggagggggguuuugu

SEQ ID NO: 2015874 - RNA, 21 nt, Homo sapiens
ugaaccaaugcuuucucaugu

SEQ ID NO: 2015875 - RNA, 14 nt, Homo sapiens
aguguguauccaga

SEQ ID NO: 2015876 - RNA, 16 nt, Homo sapiens
ucaaaacaagacuccu

SEQ ID NO: 2015877 - RNA, 23 nt, Homo sapiens
caaagccuccuccagccgccaug

SEQ ID NO: 2015878 - RNA, 13 nt, Homo sapiens
aacgcauugccac

SEQ ID NO: 2015879 - RNA, 13 nt, Homo sapiens
aaugaauugcuaa

SEQ ID NO: 2015880 - RNA, 17 nt, Homo sapiens
caagguuauuggacacc

SEQ ID NO: 2015881 - RNA, 16 nt, Homo sapiens
acgucauuugugcaag

SEQ ID NO: 2015882 - RNA, 22 nt, Homo sapiens
ccuuagauugaaguaaacugca

SEQ ID NO: 2015883 - RNA, 14 nt, Homo sapiens
agugcaauggguaa

SEQ ID NO: 2015884 - RNA, 12 nt, Homo sapiens
cugaaaagccau

SEQ ID NO: 2015885 - RNA, 15 nt, Homo sapiens
aauguccaccaugaa

SEQ ID NO: 2015886 - RNA, 13 nt, Homo sapiens
cuugucagaauuu

SEQ ID NO: 2015887 - RNA, 21 nt, Homo sapiens
caugauggggaaggaguacaa

SEQ ID NO: 2015888 - RNA, 19 nt, Homo sapiens
caggauuggccacauugcc

SEQ ID NO: 2015889 - RNA, 19 nt, Homo sapiens
caggauuuuaaacauguaa

SEQ ID NO: 2015890 - RNA, 22 nt, Homo sapiens
gugcaugcuuuaaaaaacacag

SEQ ID NO: 2015891 - RNA, 23 nt, Homo sapiens
auucucagugagggcucuggauu

SEQ ID NO: 2015892 - RNA, 19 nt, Homo sapiens
uuggcagagacacuuuguc

SEQ ID NO: 2015893 - RNA, 23 nt, Homo sapiens
uuuaaaccagggaugucuguuga

SEQ ID NO: 2015894 - RNA, 18 nt, Homo sapiens
cuccccuuaaaggggaga

SEQ ID NO: 2015895 - RNA, 12 nt, Homo sapiens
cucuacaaaaag

SEQ ID NO: 2015896 - RNA, 15 nt, Homo sapiens
auacaacacaaagag

SEQ ID NO: 2015897 - RNA, 18 nt, Homo sapiens
uagagauaugcagaagga

SEQ ID NO: 2015898 - RNA, 22 nt, Homo sapiens
cuucaaaguuuucugcuguaaa

SEQ ID NO: 2015899 - RNA, 20 nt, Homo sapiens
ggaugaagauucuccugugc

SEQ ID NO: 2015900 - RNA, 19 nt, Homo sapiens
uguuccuguuugcugggag

SEQ ID NO: 2015901 - RNA, 16 nt, Homo sapiens
caagccccugccucca

SEQ ID NO: 2015902 - RNA, 19 nt, Homo sapiens
cacccagagggaguagaau

SEQ ID NO: 2015903 - RNA, 15 nt, Homo sapiens
gacaaguauggcucc

SEQ ID NO: 2015904 - RNA, 13 nt, Homo sapiens
ucaauacaauccu

SEQ ID NO: 2015905 - RNA, 14 nt, Homo sapiens
agcaguuacuguga

SEQ ID NO: 2015906 - RNA, 16 nt, Homo sapiens
ggaaagcaucaccuca

SEQ ID NO: 2015907 - RNA, 23 nt, Homo sapiens
uucuaccuuccugcaacaccuug

SEQ ID NO: 2015908 - RNA, 21 nt, Homo sapiens
cuaccagguguucuacacuca

SEQ ID NO: 2015909 - RNA, 17 nt, Homo sapiens
ucagauacacugugaua

SEQ ID NO: 2015910 - RNA, 21 nt, Homo sapiens
gcccacugcugcaguagggga

SEQ ID NO: 2015911 - RNA, 14 nt, Homo sapiens
aguaugaaccacau

SEQ ID NO: 2015912 - RNA, 19 nt, Homo sapiens
aaaagcaaauacugacuuu

SEQ ID NO: 2015913 - RNA, 19 nt, Homo sapiens
acugacacuuugccagaaa

SEQ ID NO: 2015914 - RNA, 14 nt, Homo sapiens
gauucuaaucucau

SEQ ID NO: 2015915 - RNA, 22 nt, Homo sapiens
caucuaugaggguguuuccucu

SEQ ID NO: 2015916 - RNA, 22 nt, Homo sapiens
auccuacaaggcuggcagugac

SEQ ID NO: 2015917 - RNA, 20 nt, Homo sapiens
cgagauugcaccacugcacu

SEQ ID NO: 2015918 - RNA, 20 nt, Homo sapiens
caagauugcgccacugcacu

SEQ ID NO: 2015919 - RNA, 12 nt, Homo sapiens
ucuaaaccagaa

SEQ ID NO: 2015920 - RNA, 14 nt, Homo sapiens
ccuugcaagccaua

SEQ ID NO: 2015921 - RNA, 18 nt, Homo sapiens
cuugaauaaauuugccca

SEQ ID NO: 2015922 - RNA, 14 nt, Homo sapiens
cauuucaagacaga

SEQ ID NO: 2015923 - RNA, 12 nt, Homo sapiens
ugccccucucgu

SEQ ID NO: 2015924 - RNA, 22 nt, Homo sapiens
cagaagugcuuucuucucccaa

SEQ ID NO: 2015925 - RNA, 13 nt, Homo sapiens
gagagccugugau

SEQ ID NO: 2015926 - RNA, 16 nt, Homo sapiens
uucacuuugugauuau

SEQ ID NO: 2015927 - RNA, 14 nt, Homo sapiens
cuccaccacauccu

SEQ ID NO: 2015928 - RNA, 22 nt, Homo sapiens
agcuuuucuuuuuuaauuucca

SEQ ID NO: 2015929 - RNA, 23 nt, Homo sapiens
acaauuuggucuuagcuuuacau

SEQ ID NO: 2015930 - RNA, 10 nt, Homo sapiens
cuuguauuca

SEQ ID NO: 2015931 - RNA, 13 nt, Homo sapiens
aagaucaagcucc

SEQ ID NO: 2015932 - RNA, 15 nt, Homo sapiens
gagggcuacaaagga

SEQ ID NO: 2015933 - RNA, 22 nt, Homo sapiens
cuuucccccacacccagaucac

SEQ ID NO: 2015934 - RNA, 18 nt, Homo sapiens
acuuuuuuucugauucaa

SEQ ID NO: 2015935 - RNA, 18 nt, Homo sapiens
caacaacaaaauaaagcu

SEQ ID NO: 2015936 - RNA, 21 nt, Homo sapiens
uagaaacacacauuucuuuga

SEQ ID NO: 2015937 - RNA, 22 nt, Homo sapiens
guauucaauuugauucuaugac

SEQ ID NO: 2015938 - RNA, 15 nt, Homo sapiens
guuuuacuaucucac

SEQ ID NO: 2015939 - RNA, 18 nt, Homo sapiens
uuguaagacacacagccu

SEQ ID NO: 2015940 - RNA, 21 nt, Homo sapiens
uaaaauuuuaaaaagucaauu

SEQ ID NO: 2015941 - RNA, 20 nt, Homo sapiens
ucccggauuuuuguuaauau

SEQ ID NO: 2015942 - RNA, 18 nt, Homo sapiens
ucggagugaauguggcag

SEQ ID NO: 2015943 - RNA, 18 nt, Homo sapiens
ucaccaucagucaaugaa

SEQ ID NO: 2015944 - RNA, 16 nt, Homo sapiens
ggucuuaauucugacc

SEQ ID NO: 2015945 - RNA, 15 nt, Homo sapiens
cgcgugcaugcacac

SEQ ID NO: 2015946 - RNA, 13 nt, Homo sapiens
ugcauccuacucc

SEQ ID NO: 2015947 - RNA, 14 nt, Homo sapiens
aggcccgcaccgcu

SEQ ID NO: 2015948 - RNA, 16 nt, Homo sapiens
gacuuggggucaggaa

SEQ ID NO: 2015949 - RNA, 22 nt, Homo sapiens
ucacaagaaaacuauaagccaa

SEQ ID NO: 2015950 - RNA, 19 nt, Homo sapiens
agaaacaugacacugaccu

SEQ ID NO: 2015951 - RNA, 11 nt, Homo sapiens
ggacuguguug

SEQ ID NO: 2015952 - RNA, 13 nt, Homo sapiens
caaauaaucacaa

SEQ ID NO: 2015953 - RNA, 13 nt, Homo sapiens
cccagguucaaug

SEQ ID NO: 2015954 - RNA, 16 nt, Homo sapiens
auuuaaacaccuccuc

SEQ ID NO: 2015955 - RNA, 16 nt, Homo sapiens
acuccaacauccacuc

SEQ ID NO: 2015956 - RNA, 22 nt, Homo sapiens
aauuuauuuugugaacacuuuu

SEQ ID NO: 2015957 - RNA, 12 nt, Homo sapiens
aaagaugaugcu

SEQ ID NO: 2015958 - RNA, 18 nt, Homo sapiens
ucagaaaccccacuucca

SEQ ID NO: 2015959 - RNA, 17 nt, Homo sapiens
ucucagagaucuugcau

SEQ ID NO: 2015960 - RNA, 15 nt, Homo sapiens
ccaacauacuuuaag

SEQ ID NO: 2015961 - RNA, 20 nt, Homo sapiens
auauuuagccccauuacacu

SEQ ID NO: 2015962 - RNA, 15 nt, Homo sapiens
uuuucucugugcuuc

SEQ ID NO: 2015963 - RNA, 16 nt, Homo sapiens
gaagaauggcuuucaa

SEQ ID NO: 2015964 - RNA, 18 nt, Homo sapiens
gauggggcaagggcacaa

SEQ ID NO: 2015965 - RNA, 13 nt, Homo sapiens
ggacacugugaca

SEQ ID NO: 2015966 - RNA, 13 nt, Homo sapiens
uccuucuggccuu

SEQ ID NO: 2015967 - RNA, 17 nt, Homo sapiens
acagugaugaauguacu

SEQ ID NO: 2015968 - RNA, 19 nt, Homo sapiens
cucuguaaaaacacugaaa

SEQ ID NO: 2015969 - RNA, 9 nt, Homo sapiens
cacauucac

SEQ ID NO: 2015970 - RNA, 21 nt, Homo sapiens
caccgagugaggccauagcaa

SEQ ID NO: 2015971 - RNA, 14 nt, Homo sapiens
aucauggcucacug

SEQ ID NO: 2015972 - RNA, 17 nt, Homo sapiens
aucaacauuuguuccau

SEQ ID NO: 2015973 - RNA, 20 nt, Homo sapiens
gaaagagaaugcaccccuga

SEQ ID NO: 2015974 - RNA, 13 nt, Homo sapiens
auacuuaauacug

SEQ ID NO: 2015975 - RNA, 15 nt, Homo sapiens
uccggaacagccaaa

SEQ ID NO: 2015976 - RNA, 15 nt, Homo sapiens
gcucacaagcccagg

SEQ ID NO: 2015977 - RNA, 14 nt, Homo sapiens
uacccacugccaug

SEQ ID NO: 2015978 - RNA, 16 nt, Homo sapiens
uuagcaauaacauaca

SEQ ID NO: 2015979 - RNA, 18 nt, Homo sapiens
cugggauggaggggagug

SEQ ID NO: 2015980 - RNA, 20 nt, Homo sapiens
ccuguuuaaaaaaaguauau

SEQ ID NO: 2015981 - RNA, 23 nt, Homo sapiens
gaugcucaucugagccagcaccg

SEQ ID NO: 2015982 - RNA, 15 nt, Homo sapiens
auugcauuuauaugu

SEQ ID NO: 2015983 - RNA, 21 nt, Homo sapiens
ccagaccuuaagacacuguga

SEQ ID NO: 2015984 - RNA, 14 nt, Homo sapiens
cuagagaacaugcc

SEQ ID NO: 2015985 - RNA, 13 nt, Homo sapiens
accucucaccucc

SEQ ID NO: 2015986 - RNA, 12 nt, Homo sapiens
gagauucccacc

SEQ ID NO: 2015987 - RNA, 18 nt, Homo sapiens
uuggcaugccacagggga

SEQ ID NO: 2015988 - RNA, 10 nt, Homo sapiens
acaguggaau

SEQ ID NO: 2015989 - RNA, 20 nt, Homo sapiens
caucuuacaaaaacaagaca

SEQ ID NO: 2015990 - RNA, 13 nt, Homo sapiens
ucaaguuauguca

SEQ ID NO: 2015991 - RNA, 23 nt, Homo sapiens
ucaagacagaugagcaggagcuu

SEQ ID NO: 2015992 - RNA, 13 nt, Homo sapiens
acccucauuucac

SEQ ID NO: 2015993 - RNA, 19 nt, Homo sapiens
cuuugcauagcuuucacaa

SEQ ID NO: 2015994 - RNA, 13 nt, Homo sapiens
acuuuuauaagaa

SEQ ID NO: 2015995 - RNA, 23 nt, Homo sapiens
aagacagacaucuguggaaugau

SEQ ID NO: 2015996 - RNA, 16 nt, Homo sapiens
acauccacaugcucug

SEQ ID NO: 2015997 - RNA, 20 nt, Homo sapiens
acgaugaaauugaaccuggu

SEQ ID NO: 2015998 - RNA, 13 nt, Homo sapiens
cgcucaucaccua

SEQ ID NO: 2015999 - RNA, 17 nt, Homo sapiens
cugcucagugaucucac

SEQ ID NO: 2016000 - RNA, 22 nt, Homo sapiens
agaaauguaccggcuuccaucc

SEQ ID NO: 2016001 - RNA, 23 nt, Homo sapiens
uaaacuucaccuacauuaucuca

SEQ ID NO: 2016002 - RNA, 14 nt, Homo sapiens
ucucaaaacuguac

SEQ ID NO: 2016003 - RNA, 14 nt, Homo sapiens
cccuucuuuccauu

SEQ ID NO: 2016004 - RNA, 14 nt, Homo sapiens
aagacacagacaaa

SEQ ID NO: 2016005 - RNA, 12 nt, Homo sapiens
agggaguagaaa

SEQ ID NO: 2016006 - RNA, 13 nt, Homo sapiens
uaacuguuacagu

SEQ ID NO: 2016007 - RNA, 14 nt, Homo sapiens
ucgguguucugucc

SEQ ID NO: 2016008 - RNA, 13 nt, Homo sapiens
acucuucuugcaa

SEQ ID NO: 2016009 - RNA, 14 nt, Homo sapiens
cuuaaaauuagcau

SEQ ID NO: 2016010 - RNA, 10 nt, Homo sapiens
caugcaaaau

SEQ ID NO: 2016011 - RNA, 23 nt, Homo sapiens
cugauuugggcugaauguaugua

SEQ ID NO: 2016012 - RNA, 18 nt, Homo sapiens
cuuccaucugauugugau

SEQ ID NO: 2016013 - RNA, 13 nt, Homo sapiens
gaggcugcagcca

SEQ ID NO: 2016014 - RNA, 17 nt, Homo sapiens
acuaacaaacagauucu

SEQ ID NO: 2016015 - RNA, 16 nt, Homo sapiens
aacccaggagcaucca

SEQ ID NO: 2016016 - RNA, 11 nt, Homo sapiens
aaauccccaag

SEQ ID NO: 2016017 - RNA, 12 nt, Homo sapiens
uggaguggcaug

SEQ ID NO: 2016018 - RNA, 19 nt, Homo sapiens
auaaaaugcaaaugcacuc

SEQ ID NO: 2016019 - RNA, 18 nt, Homo sapiens
acaauaauuuucuaccug

SEQ ID NO: 2016020 - RNA, 21 nt, Homo sapiens
aacacugcugcuccagugcag

SEQ ID NO: 2016021 - RNA, 23 nt, Homo sapiens
auggcccccaauaaaggcagcug

SEQ ID NO: 2016022 - RNA, 19 nt, Homo sapiens
caaguguuuuacuaucuca

SEQ ID NO: 2016023 - RNA, 17 nt, Homo sapiens
acacagcaugcauuuag

SEQ ID NO: 2016024 - RNA, 17 nt, Homo sapiens
caacaaagucacccacu

SEQ ID NO: 2016025 - RNA, 19 nt, Homo sapiens
aggcucuggcccuugccuu

SEQ ID NO: 2016026 - RNA, 22 nt, Homo sapiens
ugaagaacaguaacugccauca

SEQ ID NO: 2016027 - RNA, 19 nt, Homo sapiens
cccuacccccaguaaaauc

SEQ ID NO: 2016028 - RNA, 14 nt, Homo sapiens
ccgccgcaccagcc

SEQ ID NO: 2016029 - RNA, 22 nt, Homo sapiens
gaaaauggaugacaaagaaaau

SEQ ID NO: 2016030 - RNA, 17 nt, Homo sapiens
ucuguccagccagcucc

SEQ ID NO: 2016031 - RNA, 19 nt, Homo sapiens
ccaucucuacaaaaagcau

SEQ ID NO: 2016032 - RNA, 17 nt, Homo sapiens
uguuauucaauggaauc

SEQ ID NO: 2016033 - RNA, 17 nt, Homo sapiens
uaagguagaacuugaga

SEQ ID NO: 2016034 - RNA, 16 nt, Homo sapiens
uccugcugcaugaccu

SEQ ID NO: 2016035 - RNA, 15 nt, Homo sapiens
gacuugaaugcugcc

SEQ ID NO: 2016036 - RNA, 10 nt, Homo sapiens
ucagccacua

SEQ ID NO: 2016037 - RNA, 16 nt, Homo sapiens
cagugcccccacugac

SEQ ID NO: 2016038 - RNA, 18 nt, Homo sapiens
cauucuuuuuucuauuca

SEQ ID NO: 2016039 - RNA, 18 nt, Homo sapiens
guaauaaagugaacuuug

SEQ ID NO: 2016040 - RNA, 17 nt, Homo sapiens
cuggcuccuugugccag

SEQ ID NO: 2016041 - RNA, 20 nt, Homo sapiens
gugauacacugaaaggaaaa

SEQ ID NO: 2016042 - RNA, 15 nt, Homo sapiens
ccuguccagcaggua

SEQ ID NO: 2016043 - RNA, 16 nt, Homo sapiens
cuguaggaacaagcau

SEQ ID NO: 2016044 - RNA, 21 nt, Homo sapiens
gcuacaagaaugcaaaaaauc

SEQ ID NO: 2016045 - RNA, 23 nt, Homo sapiens
cauuggucuaauuuauucaaagg

SEQ ID NO: 2016046 - RNA, 17 nt, Homo sapiens
agacugaagauggcuuu

SEQ ID NO: 2016047 - RNA, 17 nt, Homo sapiens
uuuaaauaaaagcacaa

SEQ ID NO: 2016048 - RNA, 21 nt, Homo sapiens
aucccugaaacaucucaacaa

SEQ ID NO: 2016049 - RNA, 19 nt, Homo sapiens
gaugaaaaccacccuauca

SEQ ID NO: 2016050 - RNA, 15 nt, Homo sapiens
auuuuaaaguaucau

SEQ ID NO: 2016051 - RNA, 15 nt, Homo sapiens
ucuuucucauguugg

SEQ ID NO: 2016052 - RNA, 16 nt, Homo sapiens
auguauuuagcuugaa

SEQ ID NO: 2016053 - RNA, 22 nt, Homo sapiens
caaguauauuuauuucuagcaa

SEQ ID NO: 2016054 - RNA, 16 nt, Homo sapiens
ucuguuuggaagacca

SEQ ID NO: 2016055 - RNA, 17 nt, Homo sapiens
gaagcauuuacuuugug

SEQ ID NO: 2016056 - RNA, 18 nt, Homo sapiens
ugaaauauauaacaacaa

SEQ ID NO: 2016057 - RNA, 15 nt, Homo sapiens
ccuguggcugcccuc

SEQ ID NO: 2016058 - RNA, 15 nt, Homo sapiens
ccccuggcugugcuc

SEQ ID NO: 2016059 - RNA, 11 nt, Homo sapiens
gccaggugccg

SEQ ID NO: 2016060 - RNA, 16 nt, Homo sapiens
auuccuaacuaucacu

SEQ ID NO: 2016061 - RNA, 18 nt, Homo sapiens
ugcuauacugcauacuuu

SEQ ID NO: 2016062 - RNA, 20 nt, Homo sapiens
uguuugucauauggaauuua

SEQ ID NO: 2016063 - RNA, 14 nt, Homo sapiens
gaguuuuuguauaa

SEQ ID NO: 2016064 - RNA, 22 nt, Homo sapiens
auucggcucccuggagccagac

SEQ ID NO: 2016065 - RNA, 11 nt, Homo sapiens
uauaccaaaaa

SEQ ID NO: 2016066 - RNA, 20 nt, Homo sapiens
ucccgaggggaagcgauuac

SEQ ID NO: 2016067 - RNA, 22 nt, Homo sapiens
accccuuucuaguucaaugccu

SEQ ID NO: 2016068 - RNA, 19 nt, Homo sapiens
agcauguucguauuacaag

SEQ ID NO: 2016069 - RNA, 13 nt, Homo sapiens
gcauccucucuau

SEQ ID NO: 2016070 - RNA, 13 nt, Homo sapiens
ugguuuggauguu

SEQ ID NO: 2016071 - RNA, 18 nt, Homo sapiens
uuccuccuccaucaccug

SEQ ID NO: 2016072 - RNA, 19 nt, Homo sapiens
cagugcauccuucaucaca

SEQ ID NO: 2016073 - RNA, 19 nt, Homo sapiens
uggauccagccaugccuga

SEQ ID NO: 2016074 - RNA, 16 nt, Homo sapiens
ccaucugcagcaagac

SEQ ID NO: 2016075 - RNA, 18 nt, Homo sapiens
cuuagguccaaggucucc

SEQ ID NO: 2016076 - RNA, 18 nt, Homo sapiens
cuggaggcacgcaccacu

SEQ ID NO: 2016077 - RNA, 16 nt, Homo sapiens
gucuuccuuguggaau

SEQ ID NO: 2016078 - RNA, 17 nt, Homo sapiens
ucuaucugaaaucccaa

SEQ ID NO: 2016079 - RNA, 22 nt, Homo sapiens
agugccucaagaggaaugaaaa

SEQ ID NO: 2016080 - RNA, 13 nt, Homo sapiens
uggguucauccua

SEQ ID NO: 2016081 - RNA, 15 nt, Homo sapiens
ugaauuucacaagcu

SEQ ID NO: 2016082 - RNA, 22 nt, Homo sapiens
agucacaaugaguuugggcaua

SEQ ID NO: 2016083 - RNA, 17 nt, Homo sapiens
gacuucuaggauuuauu

SEQ ID NO: 2016084 - RNA, 18 nt, Homo sapiens
gaagcccaggagccucac

SEQ ID NO: 2016085 - RNA, 21 nt, Homo sapiens
cuuucuuugaccucuucucuc

SEQ ID NO: 2016086 - RNA, 18 nt, Homo sapiens
guuauucuaguacuagaa

SEQ ID NO: 2016087 - RNA, 19 nt, Homo sapiens
ucugguuucuaccagcuca

SEQ ID NO: 2016088 - RNA, 14 nt, Homo sapiens
gcagggcagccugu

SEQ ID NO: 2016089 - RNA, 16 nt, Homo sapiens
ucccacccacagccau

SEQ ID NO: 2016090 - RNA, 22 nt, Homo sapiens
cuuugcccacguguccugaggg

SEQ ID NO: 2016091 - RNA, 18 nt, Homo sapiens
guacucccaaacugacaa

SEQ ID NO: 2016092 - RNA, 14 nt, Homo sapiens
agaaguaacugucc

SEQ ID NO: 2016093 - RNA, 17 nt, Homo sapiens
gaaaccaggaacucugg

SEQ ID NO: 2016094 - RNA, 15 nt, Homo sapiens
aauauauaaccagug

SEQ ID NO: 2016095 - RNA, 23 nt, Homo sapiens
aauauuuucauacagcauuacaa

SEQ ID NO: 2016096 - RNA, 14 nt, Homo sapiens
gaaaaagagccauu

SEQ ID NO: 2016097 - RNA, 15 nt, Homo sapiens
ucgcaucauugcaga

SEQ ID NO: 2016098 - RNA, 16 nt, Homo sapiens
auugccuauaauacuu

SEQ ID NO: 2016099 - RNA, 13 nt, Homo sapiens
cuuuuuacuauua

SEQ ID NO: 2016100 - RNA, 22 nt, Homo sapiens
cuccuaagcaacuaggccuuca

SEQ ID NO: 2016101 - RNA, 13 nt, Homo sapiens
ugauaguuacuca

SEQ ID NO: 2016102 - RNA, 15 nt, Homo sapiens
guauuauuugcuaua

SEQ ID NO: 2016103 - RNA, 23 nt, Homo sapiens
uggagugucaccagcugccaaaa

SEQ ID NO: 2016104 - RNA, 21 nt, Homo sapiens
aagaaagucuaucuaaugaca

SEQ ID NO: 2016105 - RNA, 20 nt, Homo sapiens
gccuugauucccuuguuauu

SEQ ID NO: 2016106 - RNA, 21 nt, Homo sapiens
aauuaggagaggcagagauag

SEQ ID NO: 2016107 - RNA, 14 nt, Homo sapiens
uauuguagcucaau

SEQ ID NO: 2016108 - RNA, 18 nt, Homo sapiens
uagagcucuauuucucua

SEQ ID NO: 2016109 - RNA, 14 nt, Homo sapiens
aaucuacuguauca

SEQ ID NO: 2016110 - RNA, 17 nt, Homo sapiens
cccucacacacacagcu

SEQ ID NO: 2016111 - RNA, 19 nt, Homo sapiens
aauucugaauuaagcacag

SEQ ID NO: 2016112 - RNA, 13 nt, Homo sapiens
agccaacacuuga

SEQ ID NO: 2016113 - RNA, 16 nt, Homo sapiens
guaacucaucugucac

SEQ ID NO: 2016114 - RNA, 12 nt, Homo sapiens
auggcuuugugc

SEQ ID NO: 2016115 - RNA, 20 nt, Homo sapiens
caugguggcacgugccugua

SEQ ID NO: 2016116 - RNA, 15 nt, Homo sapiens
cacucagguucuuca

SEQ ID NO: 2016117 - RNA, 21 nt, Homo sapiens
cuguugacucuaguacuguga

SEQ ID NO: 2016118 - RNA, 21 nt, Homo sapiens
uuccuugaauguggcuugaga

SEQ ID NO: 2016119 - RNA, 19 nt, Homo sapiens
ccugagcugggagggaacc

SEQ ID NO: 2016120 - RNA, 16 nt, Homo sapiens
aacuucuuugaaguua

SEQ ID NO: 2016121 - RNA, 19 nt, Homo sapiens
aaccagacucuugccuguu

SEQ ID NO: 2016122 - RNA, 21 nt, Homo sapiens
gguggcaccugccacucugcc

SEQ ID NO: 2016123 - RNA, 14 nt, Homo sapiens
acccacuaucccau

SEQ ID NO: 2016124 - RNA, 20 nt, Homo sapiens
acugacccccaucugagcug

SEQ ID NO: 2016125 - RNA, 21 nt, Homo sapiens
gucucgaacuccuggccucaa

SEQ ID NO: 2016126 - RNA, 21 nt, Homo sapiens
acagccaccaagaaguggcug

SEQ ID NO: 2016127 - RNA, 16 nt, Homo sapiens
cgugcacacaccagag

SEQ ID NO: 2016128 - RNA, 14 nt, Homo sapiens
uugcauccuaacuc

SEQ ID NO: 2016129 - RNA, 13 nt, Homo sapiens
ucugaaacuucau

SEQ ID NO: 2016130 - RNA, 23 nt, Homo sapiens
aauagcguucagcagcacucacc

SEQ ID NO: 2016131 - RNA, 16 nt, Homo sapiens
uagaucugucccuuaa

SEQ ID NO: 2016132 - RNA, 19 nt, Homo sapiens
agggugacguuagcauuac

SEQ ID NO: 2016133 - RNA, 15 nt, Homo sapiens
uuuccaaaaccagaa

SEQ ID NO: 2016134 - RNA, 16 nt, Homo sapiens
cuccugcccgcugggc

SEQ ID NO: 2016135 - RNA, 13 nt, Homo sapiens
cuuuucacaaaua

SEQ ID NO: 2016136 - RNA, 14 nt, Homo sapiens
auagaaaacugaaa

SEQ ID NO: 2016137 - RNA, 13 nt, Homo sapiens
uaugaauucauuc

SEQ ID NO: 2016138 - RNA, 14 nt, Homo sapiens
cuuaacaaagccuu

SEQ ID NO: 2016139 - RNA, 18 nt, Homo sapiens
uccuacuguaugugggaa

SEQ ID NO: 2016140 - RNA, 10 nt, Homo sapiens
ugugucuuag

SEQ ID NO: 2016141 - RNA, 18 nt, Homo sapiens
uagaaagaaacaaccugc

SEQ ID NO: 2016142 - RNA, 20 nt, Homo sapiens
uccguggcacugcauacaau

SEQ ID NO: 2016143 - RNA, 19 nt, Homo sapiens
cagauauuaaauaacagug

SEQ ID NO: 2016144 - RNA, 15 nt, Homo sapiens
aacuuauuaucacuu

SEQ ID NO: 2016145 - RNA, 13 nt, Homo sapiens
aacugaugaagga

SEQ ID NO: 2016146 - RNA, 20 nt, Homo sapiens
ucaugccaaguaucuuucca

SEQ ID NO: 2016147 - RNA, 18 nt, Homo sapiens
acuuuguguuuucaucuc

SEQ ID NO: 2016148 - RNA, 14 nt, Homo sapiens
aaaugaauacgaac

SEQ ID NO: 2016149 - RNA, 14 nt, Homo sapiens
auuaucaauguucu

SEQ ID NO: 2016150 - RNA, 21 nt, Homo sapiens
caaagaaguguauuuacaaua

SEQ ID NO: 2016151 - RNA, 19 nt, Homo sapiens
cagagguucugucuacagg

SEQ ID NO: 2016152 - RNA, 12 nt, Homo sapiens
gaaaugcaaaau

SEQ ID NO: 2016153 - RNA, 20 nt, Homo sapiens
caccuguggggccuggggag

SEQ ID NO: 2016154 - RNA, 22 nt, Homo sapiens
ccgucucaaaaaaaagaaaaug

SEQ ID NO: 2016155 - RNA, 19 nt, Homo sapiens
uggagucuguucuagggaa

SEQ ID NO: 2016156 - RNA, 18 nt, Homo sapiens
aaucuguuuauuggaugg

SEQ ID NO: 2016157 - RNA, 18 nt, Homo sapiens
guccgcugccccaugugu

SEQ ID NO: 2016158 - RNA, 23 nt, Homo sapiens
ugaucacaugugcccucugccag

SEQ ID NO: 2016159 - RNA, 22 nt, Homo sapiens
guggaaagaaagaccaucuccc

SEQ ID NO: 2016160 - RNA, 22 nt, Homo sapiens
cuuugacacuuuucauaucauu

SEQ ID NO: 2016161 - RNA, 21 nt, Homo sapiens
augugggggucuguguguuua

SEQ ID NO: 2016162 - RNA, 17 nt, Homo sapiens
gcuacugaaacuuaccu

SEQ ID NO: 2016163 - RNA, 14 nt, Homo sapiens
guguucauuguaaa

SEQ ID NO: 2016164 - RNA, 23 nt, Homo sapiens
uggcccagcaggcaggcacugug

SEQ ID NO: 2016165 - RNA, 13 nt, Homo sapiens
acuucagaaauau

SEQ ID NO: 2016166 - RNA, 19 nt, Homo sapiens
acaggaagcugcaauucuc

SEQ ID NO: 2016167 - RNA, 13 nt, Homo sapiens
auuuccuaugcaa

SEQ ID NO: 2016168 - RNA, 17 nt, Homo sapiens
gaaauaaaaagcaugac

SEQ ID NO: 2016169 - RNA, 23 nt, Homo sapiens
aagcauguuuuguugcucagugu

SEQ ID NO: 2016170 - RNA, 14 nt, Homo sapiens
caggaagacugaca

SEQ ID NO: 2016171 - RNA, 14 nt, Homo sapiens
guggccacagcagg

SEQ ID NO: 2016172 - RNA, 21 nt, Homo sapiens
ggaccugccaagaagauuccu

SEQ ID NO: 2016173 - RNA, 14 nt, Homo sapiens
augaaaacaccuga

SEQ ID NO: 2016174 - RNA, 19 nt, Homo sapiens
agccugggcaacagagcaa

SEQ ID NO: 2016175 - RNA, 22 nt, Homo sapiens
guuggucugccuucugcugaaa

SEQ ID NO: 2016176 - RNA, 13 nt, Homo sapiens
aggugacagugag

SEQ ID NO: 2016177 - RNA, 18 nt, Homo sapiens
ugaaaugguccaguacaa

SEQ ID NO: 2016178 - RNA, 16 nt, Homo sapiens
ucccugcacaccagag

SEQ ID NO: 2016179 - RNA, 16 nt, Homo sapiens
uuaaauucacuuucaa

SEQ ID NO: 2016180 - RNA, 15 nt, Homo sapiens
caauauaucuugucu

SEQ ID NO: 2016181 - RNA, 15 nt, Homo sapiens
ucauuuucugcaagc

SEQ ID NO: 2016182 - RNA, 15 nt, Homo sapiens
acauagccagcauuu

SEQ ID NO: 2016183 - RNA, 14 nt, Homo sapiens
ucuuauaauuccag

SEQ ID NO: 2016184 - RNA, 19 nt, Homo sapiens
ucccaguucauguugcuca

SEQ ID NO: 2016185 - RNA, 22 nt, Homo sapiens
cugucaggagauggaagaguca

SEQ ID NO: 2016186 - RNA, 17 nt, Homo sapiens
ugcuggaggugagacac

SEQ ID NO: 2016187 - RNA, 22 nt, Homo sapiens
aaaggaauccacucccaggcag

SEQ ID NO: 2016188 - RNA, 13 nt, Homo sapiens
acgagaagcagca

SEQ ID NO: 2016189 - RNA, 21 nt, Homo sapiens
cuauuuucaacauaacugaag

SEQ ID NO: 2016190 - RNA, 22 nt, Homo sapiens
uuucaucugcugcugaaacugu

SEQ ID NO: 2016191 - RNA, 14 nt, Homo sapiens
gcucagaauugcac

SEQ ID NO: 2016192 - RNA, 20 nt, Homo sapiens
cugauuugauaccauggcac

SEQ ID NO: 2016193 - RNA, 15 nt, Homo sapiens
caggaaaugugcaca

SEQ ID NO: 2016194 - RNA, 13 nt, Homo sapiens
uacguccuuccac

SEQ ID NO: 2016195 - RNA, 17 nt, Homo sapiens
uguucagggcugugauc

SEQ ID NO: 2016196 - RNA, 19 nt, Homo sapiens
ccacguggccgcugcccac

SEQ ID NO: 2016197 - RNA, 21 nt, Homo sapiens
aaaggacaccuuuuaacucac

SEQ ID NO: 2016198 - RNA, 12 nt, Homo sapiens
caugugaaggga

SEQ ID NO: 2016199 - RNA, 16 nt, Homo sapiens
caacaguggcuaauaa

SEQ ID NO: 2016200 - RNA, 15 nt, Homo sapiens
uacucuagauaccua

SEQ ID NO: 2016201 - RNA, 22 nt, Homo sapiens
ccaacccccgccaccucagggc

SEQ ID NO: 2016202 - RNA, 23 nt, Homo sapiens
auaaauuuuauaacagaauuaaa

SEQ ID NO: 2016203 - RNA, 13 nt, Homo sapiens
ccuaucugaccaa

SEQ ID NO: 2016204 - RNA, 15 nt, Homo sapiens
guagucagacuggau

SEQ ID NO: 2016205 - RNA, 21 nt, Homo sapiens
ugugcauguauguauacaguu

SEQ ID NO: 2016206 - RNA, 15 nt, Homo sapiens
aauccucucugcaag

SEQ ID NO: 2016207 - RNA, 15 nt, Homo sapiens
uaaauuggagaugca

SEQ ID NO: 2016208 - RNA, 22 nt, Homo sapiens
gaauucuggauaucucaggagc

SEQ ID NO: 2016209 - RNA, 23 nt, Homo sapiens
ucucaacugggaaaccccugaaa

SEQ ID NO: 2016210 - RNA, 18 nt, Homo sapiens
gugccacuuugacucaga

SEQ ID NO: 2016211 - RNA, 23 nt, Homo sapiens
ugagucgaagaguggacaaacag

SEQ ID NO: 2016212 - RNA, 12 nt, Homo sapiens
cauuacuuugau

SEQ ID NO: 2016213 - RNA, 12 nt, Homo sapiens
caucacuuugac

SEQ ID NO: 2016214 - RNA, 14 nt, Homo sapiens
agaugaaacagggc

SEQ ID NO: 2016215 - RNA, 16 nt, Homo sapiens
ccuauuuuuggaagag

SEQ ID NO: 2016216 - RNA, 11 nt, Homo sapiens
ucaagcugcac

SEQ ID NO: 2016217 - RNA, 20 nt, Homo sapiens
ccccugcugucucucugggc

SEQ ID NO: 2016218 - RNA, 21 nt, Homo sapiens
uucuacuccauggugaacuga

SEQ ID NO: 2016219 - RNA, 21 nt, Homo sapiens
cugccuuagccuaccauguga

SEQ ID NO: 2016220 - RNA, 22 nt, Homo sapiens
cagccagucugcagaagcauuu

SEQ ID NO: 2016221 - RNA, 13 nt, Homo sapiens
auuuguugagcaa

SEQ ID NO: 2016222 - RNA, 22 nt, Homo sapiens
uuuuauuugagacagagucuca

SEQ ID NO: 2016223 - RNA, 15 nt, Homo sapiens
aggggucagcagggg

SEQ ID NO: 2016224 - RNA, 15 nt, Homo sapiens
augcauaaagccaaa

SEQ ID NO: 2016225 - RNA, 22 nt, Homo sapiens
aaugcaaggugaacaccacuuu

SEQ ID NO: 2016226 - RNA, 16 nt, Homo sapiens
gugaggaagcaaguga

SEQ ID NO: 2016227 - RNA, 17 nt, Homo sapiens
gucugccuucugcugaa

SEQ ID NO: 2016228 - RNA, 14 nt, Homo sapiens
aaaguuacauugug

SEQ ID NO: 2016229 - RNA, 19 nt, Homo sapiens
uccaagaauaaagucuuuc

SEQ ID NO: 2016230 - RNA, 20 nt, Homo sapiens
ggcagucaugcugggucucc

SEQ ID NO: 2016231 - RNA, 20 nt, Homo sapiens
acugauguccggagagacag

SEQ ID NO: 2016232 - RNA, 19 nt, Homo sapiens
cauuuuuucagucauauaa

SEQ ID NO: 2016233 - RNA, 16 nt, Homo sapiens
uacauguaauuugaug

SEQ ID NO: 2016234 - RNA, 16 nt, Homo sapiens
auucugaccauggaua

SEQ ID NO: 2016235 - RNA, 18 nt, Homo sapiens
cuggaacguuucacugca

SEQ ID NO: 2016236 - RNA, 14 nt, Homo sapiens
cuguggacugaccu

SEQ ID NO: 2016237 - RNA, 17 nt, Homo sapiens
cugagguuggauuugcu

SEQ ID NO: 2016238 - RNA, 16 nt, Homo sapiens
gccuugugcuguuaau

SEQ ID NO: 2016239 - RNA, 21 nt, Homo sapiens
auaauggacucagcucugucu

SEQ ID NO: 2016240 - RNA, 15 nt, Homo sapiens
gccauugcuuaccuu

SEQ ID NO: 2016241 - RNA, 19 nt, Homo sapiens
aaauuggagaaaagcacuu

SEQ ID NO: 2016242 - RNA, 13 nt, Homo sapiens
aaaggacugugau

SEQ ID NO: 2016243 - RNA, 20 nt, Homo sapiens
aagcuggagugcaguggcau

SEQ ID NO: 2016244 - RNA, 20 nt, Homo sapiens
aucucgccaccccuccuucc

SEQ ID NO: 2016245 - RNA, 13 nt, Homo sapiens
uauuuuaaucacc

SEQ ID NO: 2016246 - RNA, 23 nt, Homo sapiens
guacuuugcugaaugucauuuua

SEQ ID NO: 2016247 - RNA, 15 nt, Homo sapiens
cacagcuucucuaca

SEQ ID NO: 2016248 - RNA, 18 nt, Homo sapiens
ccugcauuucucuucuca

SEQ ID NO: 2016249 - RNA, 11 nt, Homo sapiens
cuccuuuacaa

SEQ ID NO: 2016250 - RNA, 22 nt, Homo sapiens
cauuugaguuuauaucucucau

SEQ ID NO: 2016251 - RNA, 15 nt, Homo sapiens
guaaucaucauagaa

SEQ ID NO: 2016252 - RNA, 19 nt, Homo sapiens
agugagcaagggggcccaa

SEQ ID NO: 2016253 - RNA, 15 nt, Homo sapiens
uauuuauugcugaau

SEQ ID NO: 2016254 - RNA, 12 nt, Homo sapiens
gaaaguacccag

SEQ ID NO: 2016255 - RNA, 21 nt, Homo sapiens
gccuccagggcauugcucagc

SEQ ID NO: 2016256 - RNA, 16 nt, Homo sapiens
gggcuuuuacaccagu

SEQ ID NO: 2016257 - RNA, 14 nt, Homo sapiens
acagcugugugagc

SEQ ID NO: 2016258 - RNA, 18 nt, Homo sapiens
uaugugugaggagcugcu

SEQ ID NO: 2016259 - RNA, 21 nt, Homo sapiens
gucucuuagaauuuguuucau

SEQ ID NO: 2016260 - RNA, 21 nt, Homo sapiens
ccacagaccuacugcacugag

SEQ ID NO: 2016261 - RNA, 22 nt, Homo sapiens
aacacagugaaacuccaucuca

SEQ ID NO: 2016262 - RNA, 13 nt, Homo sapiens
gaccuaaccacuu

SEQ ID NO: 2016263 - RNA, 17 nt, Homo sapiens
gauucucuccuacuguu

SEQ ID NO: 2016264 - RNA, 17 nt, Homo sapiens
acuuggaacacaaugac

SEQ ID NO: 2016265 - RNA, 16 nt, Homo sapiens
aaccccucgcccaguc

SEQ ID NO: 2016266 - RNA, 19 nt, Homo sapiens
acugccugcccagugccau

SEQ ID NO: 2016267 - RNA, 19 nt, Homo sapiens
caggguccuccggggcuca

SEQ ID NO: 2016268 - RNA, 23 nt, Homo sapiens
gcaucuccuguuuuuugaugcuu

SEQ ID NO: 2016269 - RNA, 21 nt, Homo sapiens
cucuauuuguucagaucucau

SEQ ID NO: 2016270 - RNA, 15 nt, Homo sapiens
guuaacaacuugaau

SEQ ID NO: 2016271 - RNA, 17 nt, Homo sapiens
aagauccaauucaucuu

SEQ ID NO: 2016272 - RNA, 19 nt, Homo sapiens
acccucagaugcacaugag

SEQ ID NO: 2016273 - RNA, 23 nt, Homo sapiens
aggcuuggcggagggagcggcau

SEQ ID NO: 2016274 - RNA, 17 nt, Homo sapiens
uccuaaugauuagcacu

SEQ ID NO: 2016275 - RNA, 20 nt, Homo sapiens
cuucccaaguagcugggauu

SEQ ID NO: 2016276 - RNA, 19 nt, Homo sapiens
auguuugaucacacagcca

SEQ ID NO: 2016277 - RNA, 17 nt, Homo sapiens
cccagagggaguagaau

SEQ ID NO: 2016278 - RNA, 11 nt, Homo sapiens
ccuccaugcac

SEQ ID NO: 2016279 - RNA, 19 nt, Homo sapiens
ggagacaaaagcaguuucu

SEQ ID NO: 2016280 - RNA, 22 nt, Homo sapiens
aucugagaccccaaacucucca

SEQ ID NO: 2016281 - RNA, 12 nt, Homo sapiens
ugauaaacugaa

SEQ ID NO: 2016282 - RNA, 12 nt, Homo sapiens
uccaaaacuccu

SEQ ID NO: 2016283 - RNA, 21 nt, Homo sapiens
ggauuuucuuuuuaacuuuac

SEQ ID NO: 2016284 - RNA, 21 nt, Homo sapiens
uucuuaauuuggaaacuaaua

SEQ ID NO: 2016285 - RNA, 23 nt, Homo sapiens
acauaagccacaggccccaguua

SEQ ID NO: 2016286 - RNA, 12 nt, Homo sapiens
uccuuugcacug

SEQ ID NO: 2016287 - RNA, 13 nt, Homo sapiens
ugaauaucuucca

SEQ ID NO: 2016288 - RNA, 13 nt, Homo sapiens
cagcugaugcuca

SEQ ID NO: 2016289 - RNA, 13 nt, Homo sapiens
gucuuguguuucu

SEQ ID NO: 2016290 - RNA, 21 nt, Homo sapiens
ucucuuuggcuggaauuacaa

SEQ ID NO: 2016291 - RNA, 20 nt, Homo sapiens
ugaaugaacacucuuuugcu

SEQ ID NO: 2016292 - RNA, 19 nt, Homo sapiens
uuggaauuuaaaaauaucg

SEQ ID NO: 2016293 - RNA, 20 nt, Homo sapiens
aagcuguccucccaccucag

SEQ ID NO: 2016294 - RNA, 15 nt, Homo sapiens
aauuucuagacagua

SEQ ID NO: 2016295 - RNA, 15 nt, Homo sapiens
gaagggaauugcuca

SEQ ID NO: 2016296 - RNA, 18 nt, Homo sapiens
cuuuuaagaaacauucuu

SEQ ID NO: 2016297 - RNA, 19 nt, Homo sapiens
aucaucaucuugucuaaga

SEQ ID NO: 2016298 - RNA, 13 nt, Homo sapiens
aaacugauuuauc

SEQ ID NO: 2016299 - RNA, 17 nt, Homo sapiens
uacuccgugaggcugcu

SEQ ID NO: 2016300 - RNA, 20 nt, Homo sapiens
acugcccuuuuaaauggcau

SEQ ID NO: 2016301 - RNA, 11 nt, Homo sapiens
ccaucccacau

SEQ ID NO: 2016302 - RNA, 17 nt, Homo sapiens
aaauccuagacuugaaa

SEQ ID NO: 2016303 - RNA, 14 nt, Homo sapiens
caguaauguuccuc

SEQ ID NO: 2016304 - RNA, 19 nt, Homo sapiens
uggagauccuuucucucaa

SEQ ID NO: 2016305 - RNA, 19 nt, Homo sapiens
gaaacacuuucaggaccuu

SEQ ID NO: 2016306 - RNA, 16 nt, Homo sapiens
caaccaaaagucuuca

SEQ ID NO: 2016307 - RNA, 18 nt, Homo sapiens
uaguccccuuuccucuaa

SEQ ID NO: 2016308 - RNA, 18 nt, Homo sapiens
uaucucacacucaugcau

SEQ ID NO: 2016309 - RNA, 23 nt, Homo sapiens
ggauuaccagggacuaucuuugc

SEQ ID NO: 2016310 - RNA, 17 nt, Homo sapiens
acucccgccucagggcc

SEQ ID NO: 2016311 - RNA, 18 nt, Homo sapiens
guaaagggcgcaaagggc

SEQ ID NO: 2016312 - RNA, 13 nt, Homo sapiens
acaguuuguucag

SEQ ID NO: 2016313 - RNA, 20 nt, Homo sapiens
augccuguggugaagugugg

SEQ ID NO: 2016314 - RNA, 20 nt, Homo sapiens
aaguauaucuaucuauauau

SEQ ID NO: 2016315 - RNA, 20 nt, Homo sapiens
uauuauuguagucuugcauu

SEQ ID NO: 2016316 - RNA, 12 nt, Homo sapiens
cauggugcagug

SEQ ID NO: 2016317 - RNA, 21 nt, Homo sapiens
caagguccggaugucacucau

SEQ ID NO: 2016318 - RNA, 17 nt, Homo sapiens
ucuaaaaucccuuucaa

SEQ ID NO: 2016319 - RNA, 20 nt, Homo sapiens
aguggcaaguaaguuauaga

SEQ ID NO: 2016320 - RNA, 18 nt, Homo sapiens
aaaauacaugacauuuau

SEQ ID NO: 2016321 - RNA, 17 nt, Homo sapiens
auuugguggaugugaug

SEQ ID NO: 2016322 - RNA, 14 nt, Homo sapiens
ugcauaagauuaaa

SEQ ID NO: 2016323 - RNA, 23 nt, Homo sapiens
ugguuacagcccagacuuuacca

SEQ ID NO: 2016324 - RNA, 17 nt, Homo sapiens
cagaugcugauguucag

SEQ ID NO: 2016325 - RNA, 19 nt, Homo sapiens
aagcggaaaguuagugcuu

SEQ ID NO: 2016326 - RNA, 18 nt, Homo sapiens
gggggccagcagcagggg

SEQ ID NO: 2016327 - RNA, 18 nt, Homo sapiens
cggaagcucacagugaca

SEQ ID NO: 2016328 - RNA, 19 nt, Homo sapiens
cacacacgccaaugcacac

SEQ ID NO: 2016329 - RNA, 18 nt, Homo sapiens
uuauauuuugugcuauca

SEQ ID NO: 2016330 - RNA, 13 nt, Homo sapiens
gagccauucugug

SEQ ID NO: 2016331 - RNA, 16 nt, Homo sapiens
ucugccuggguuuugu

SEQ ID NO: 2016332 - RNA, 16 nt, Homo sapiens
gcuggucuaagaauga

SEQ ID NO: 2016333 - RNA, 16 nt, Homo sapiens
aacauuuggcauuccu

SEQ ID NO: 2016334 - RNA, 14 nt, Homo sapiens
agcaauuaaagaca

SEQ ID NO: 2016335 - RNA, 22 nt, Homo sapiens
aaaggacugauuugaugccucu

SEQ ID NO: 2016336 - RNA, 23 nt, Homo sapiens
ugugccugugguuaacaucucag

SEQ ID NO: 2016337 - RNA, 21 nt, Homo sapiens
uuuauauaaaauccauccaaa

SEQ ID NO: 2016338 - RNA, 18 nt, Homo sapiens
ucacagcuguaauaacaa

SEQ ID NO: 2016339 - RNA, 17 nt, Homo sapiens
caagcacaaagcucaag

SEQ ID NO: 2016340 - RNA, 18 nt, Homo sapiens
uucguggagcccagcgag

SEQ ID NO: 2016341 - RNA, 17 nt, Homo sapiens
auguuuugggaaacacu

SEQ ID NO: 2016342 - RNA, 20 nt, Homo sapiens
ucccuuagccccgaguuuaa

SEQ ID NO: 2016343 - RNA, 18 nt, Homo sapiens
uguuuuuuuuccaaaaac

SEQ ID NO: 2016344 - RNA, 19 nt, Homo sapiens
cccaguaacucaucuguca

SEQ ID NO: 2016345 - RNA, 20 nt, Homo sapiens
aacuggaauccuuucagcaa

SEQ ID NO: 2016346 - RNA, 16 nt, Homo sapiens
cagguuugaugccugu

SEQ ID NO: 2016347 - RNA, 17 nt, Homo sapiens
caggggcuccccgcaga

SEQ ID NO: 2016348 - RNA, 15 nt, Homo sapiens
gauucaggggucuga

SEQ ID NO: 2016349 - RNA, 21 nt, Homo sapiens
ugcuauccaaucucaucucuu

SEQ ID NO: 2016350 - RNA, 20 nt, Homo sapiens
auauuuguguaaaguaugca

SEQ ID NO: 2016351 - RNA, 20 nt, Homo sapiens
auuagguagaccuugaauac

SEQ ID NO: 2016352 - RNA, 21 nt, Homo sapiens
gccaccucggaucccacugau

SEQ ID NO: 2016353 - RNA, 13 nt, Homo sapiens
uauaucacugucu

SEQ ID NO: 2016354 - RNA, 13 nt, Homo sapiens
aaaaacacagaca

SEQ ID NO: 2016355 - RNA, 15 nt, Homo sapiens
uauuugacaacaauc

SEQ ID NO: 2016356 - RNA, 16 nt, Homo sapiens
ccuggacacaacacca

SEQ ID NO: 2016357 - RNA, 17 nt, Homo sapiens
ugugguacuacuguaag

SEQ ID NO: 2016358 - RNA, 15 nt, Homo sapiens
ugcauguggcuuuuu

SEQ ID NO: 2016359 - RNA, 21 nt, Homo sapiens
uagauucuuaauucaugagga

SEQ ID NO: 2016360 - RNA, 12 nt, Homo sapiens
aauggucaucca

SEQ ID NO: 2016361 - RNA, 18 nt, Homo sapiens
gagaaaagggauggagcu

SEQ ID NO: 2016362 - RNA, 19 nt, Homo sapiens
agcggcuggguggugaagg

SEQ ID NO: 2016363 - RNA, 22 nt, Homo sapiens
cugcaaaauggagagaauacaa

SEQ ID NO: 2016364 - RNA, 17 nt, Homo sapiens
aauuuagucacaccauc

SEQ ID NO: 2016365 - RNA, 15 nt, Homo sapiens
ccacuguuacauuuc

SEQ ID NO: 2016366 - RNA, 19 nt, Homo sapiens
caggccuaguaaccaaggc

SEQ ID NO: 2016367 - RNA, 21 nt, Homo sapiens
uauguacauaggcagcacuag

SEQ ID NO: 2016368 - RNA, 16 nt, Homo sapiens
uuuaagaguagcagua

SEQ ID NO: 2016369 - RNA, 13 nt, Homo sapiens
uguuuauacugua

SEQ ID NO: 2016370 - RNA, 13 nt, Homo sapiens
aaauaaaaagagu

SEQ ID NO: 2016371 - RNA, 22 nt, Homo sapiens
auucguucucugccacagggac

SEQ ID NO: 2016372 - RNA, 14 nt, Homo sapiens
auacaagguauaau

SEQ ID NO: 2016373 - RNA, 18 nt, Homo sapiens
agccagccugaccuuccu

SEQ ID NO: 2016374 - RNA, 18 nt, Homo sapiens
ucccagcuacaccuuucu

SEQ ID NO: 2016375 - RNA, 15 nt, Homo sapiens
aucugaaauguuaca

SEQ ID NO: 2016376 - RNA, 14 nt, Homo sapiens
aucucaauucuucc

SEQ ID NO: 2016377 - RNA, 22 nt, Homo sapiens
cagggagaggcugugucccugc

SEQ ID NO: 2016378 - RNA, 21 nt, Homo sapiens
guccucagccuugccagagau

SEQ ID NO: 2016379 - RNA, 16 nt, Homo sapiens
agcuggggacagcuuu

SEQ ID NO: 2016380 - RNA, 20 nt, Homo sapiens
cccaggcccugccagagcag

SEQ ID NO: 2016381 - RNA, 19 nt, Homo sapiens
auucuucucgacuucagga

SEQ ID NO: 2016382 - RNA, 21 nt, Homo sapiens
ggcuguguuuucgaugaugau

SEQ ID NO: 2016383 - RNA, 23 nt, Homo sapiens
cggccuggggcgagcacugugag

SEQ ID NO: 2016384 - RNA, 22 nt, Homo sapiens
cucacggaaccguagacuagga

SEQ ID NO: 2016385 - RNA, 17 nt, Homo sapiens
cugauuuacuuaauuca

SEQ ID NO: 2016386 - RNA, 22 nt, Homo sapiens
aggcgggagggccugcagugau

SEQ ID NO: 2016387 - RNA, 18 nt, Homo sapiens
uaaaagcaucccugugag

SEQ ID NO: 2016388 - RNA, 14 nt, Homo sapiens
uguauccagucuga

SEQ ID NO: 2016389 - RNA, 13 nt, Homo sapiens
gaacucaaggguu

SEQ ID NO: 2016390 - RNA, 12 nt, Homo sapiens
gccacuaaguac

SEQ ID NO: 2016391 - RNA, 19 nt, Homo sapiens
auacuucaugagcauucau

SEQ ID NO: 2016392 - RNA, 18 nt, Homo sapiens
uguggcacuugggcauuu

SEQ ID NO: 2016393 - RNA, 23 nt, Homo sapiens
ucucuccccauccccacccaguc

SEQ ID NO: 2016394 - RNA, 17 nt, Homo sapiens
uuagaaagcaaagauua

SEQ ID NO: 2016395 - RNA, 14 nt, Homo sapiens
ucaaaaacaaagag

SEQ ID NO: 2016396 - RNA, 19 nt, Homo sapiens
uuguuuuacccuauacauc

SEQ ID NO: 2016397 - RNA, 16 nt, Homo sapiens
gaacuggcaauugucu

SEQ ID NO: 2016398 - RNA, 22 nt, Homo sapiens
uauuguuaaaaccuuacuuaaa

SEQ ID NO: 2016399 - RNA, 23 nt, Homo sapiens
auucaagaggaauuccagcaucu

SEQ ID NO: 2016400 - RNA, 23 nt, Homo sapiens
gucuccugagcacccagaacucc

SEQ ID NO: 2016401 - RNA, 10 nt, Homo sapiens
cccuugccug

SEQ ID NO: 2016402 - RNA, 13 nt, Homo sapiens
uuacgugagccag

SEQ ID NO: 2016403 - RNA, 15 nt, Homo sapiens
ggaucaggaacccuu

SEQ ID NO: 2016404 - RNA, 21 nt, Homo sapiens
ugccccaguaacucacuuuaa

SEQ ID NO: 2016405 - RNA, 22 nt, Homo sapiens
agacccaacagcagugaucuca

SEQ ID NO: 2016406 - RNA, 21 nt, Homo sapiens
ggucagccugcugugcccaca

SEQ ID NO: 2016407 - RNA, 20 nt, Homo sapiens
agcucacuguggugucugug

SEQ ID NO: 2016408 - RNA, 17 nt, Homo sapiens
auaaagacaacaaaaga

SEQ ID NO: 2016409 - RNA, 19 nt, Homo sapiens
gaauuagcguuuaauccac

SEQ ID NO: 2016410 - RNA, 22 nt, Homo sapiens
acucugcuaccccuacugaaau

SEQ ID NO: 2016411 - RNA, 14 nt, Homo sapiens
uaacacggugcuca

SEQ ID NO: 2016412 - RNA, 16 nt, Homo sapiens
uaauuuuuugcagucu

SEQ ID NO: 2016413 - RNA, 16 nt, Homo sapiens
uucauauugcaucaua

SEQ ID NO: 2016414 - RNA, 21 nt, Homo sapiens
uuccaccuguaaaaacugcac

SEQ ID NO: 2016415 - RNA, 17 nt, Homo sapiens
agaagggcuuacaggca

SEQ ID NO: 2016416 - RNA, 22 nt, Homo sapiens
auguguaagaacaacuaccuga

SEQ ID NO: 2016417 - RNA, 19 nt, Homo sapiens
aguaacacacuuccagugu

SEQ ID NO: 2016418 - RNA, 15 nt, Homo sapiens
caggaccuugggcac

SEQ ID NO: 2016419 - RNA, 11 nt, Homo sapiens
cuaacauuucc

SEQ ID NO: 2016420 - RNA, 21 nt, Homo sapiens
agaaguuuguuauagauuuag

SEQ ID NO: 2016421 - RNA, 23 nt, Homo sapiens
accaagaagggcuagaaccugga

SEQ ID NO: 2016422 - RNA, 13 nt, Homo sapiens
uauaauucuggga

SEQ ID NO: 2016423 - RNA, 18 nt, Homo sapiens
gccucgugccaugaucug

SEQ ID NO: 2016424 - RNA, 18 nt, Homo sapiens
caguggcagacaaacaga

SEQ ID NO: 2016425 - RNA, 22 nt, Homo sapiens
aagcauuuggugccuauuugaa

SEQ ID NO: 2016426 - RNA, 16 nt, Homo sapiens
agcauccccugugaac

SEQ ID NO: 2016427 - RNA, 12 nt, Homo sapiens
uacaguaugcuu

SEQ ID NO: 2016428 - RNA, 21 nt, Homo sapiens
gcugagggguggccaucuccu

SEQ ID NO: 2016429 - RNA, 19 nt, Homo sapiens
cccagaaacagugugcaug

SEQ ID NO: 2016430 - RNA, 19 nt, Homo sapiens
cuagugcuuuucagugaua

SEQ ID NO: 2016431 - RNA, 21 nt, Homo sapiens
uguacaccccaggacaguuua

SEQ ID NO: 2016432 - RNA, 14 nt, Homo sapiens
cuguaccucagugg

SEQ ID NO: 2016433 - RNA, 21 nt, Homo sapiens
cagaaagaaggacacuuguau

SEQ ID NO: 2016434 - RNA, 17 nt, Homo sapiens
aguaucauucuuuacau

SEQ ID NO: 2016435 - RNA, 17 nt, Homo sapiens
aaagcaagcucuucucc

SEQ ID NO: 2016436 - RNA, 21 nt, Homo sapiens
ugagcucccaggugcagccag

SEQ ID NO: 2016437 - RNA, 13 nt, Homo sapiens
auguuauuauuaa

SEQ ID NO: 2016438 - RNA, 21 nt, Homo sapiens
caaagggaaaaaagaguuuaa

SEQ ID NO: 2016439 - RNA, 15 nt, Homo sapiens
ccugcaucugucugu

SEQ ID NO: 2016440 - RNA, 19 nt, Homo sapiens
cuaugacuucgacagcauc

SEQ ID NO: 2016441 - RNA, 14 nt, Homo sapiens
aagugccucaagag

SEQ ID NO: 2016442 - RNA, 15 nt, Homo sapiens
auuuaaucaguguga

SEQ ID NO: 2016443 - RNA, 20 nt, Homo sapiens
acucucagucagugucauga

SEQ ID NO: 2016444 - RNA, 21 nt, Homo sapiens
aaaucagacgggcacaguggu

SEQ ID NO: 2016445 - RNA, 16 nt, Homo sapiens
cuguuuaaaaaaccac

SEQ ID NO: 2016446 - RNA, 21 nt, Homo sapiens
auuuugaaauauaguaaacac

SEQ ID NO: 2016447 - RNA, 21 nt, Homo sapiens
agggagacccccaucuuuaca

SEQ ID NO: 2016448 - RNA, 19 nt, Homo sapiens
uaaagaaaaugaacugccc

SEQ ID NO: 2016449 - RNA, 12 nt, Homo sapiens
ucagcucugauc

SEQ ID NO: 2016450 - RNA, 17 nt, Homo sapiens
uguuuuucuuuaaucaa

SEQ ID NO: 2016451 - RNA, 23 nt, Homo sapiens
uguccuauuaguguuauaugaac

SEQ ID NO: 2016452 - RNA, 23 nt, Homo sapiens
cuuggacugaagggguucucaca

SEQ ID NO: 2016453 - RNA, 14 nt, Homo sapiens
gucugucucuauau

SEQ ID NO: 2016454 - RNA, 21 nt, Homo sapiens
aauugacauaaccaacauuaa

SEQ ID NO: 2016455 - RNA, 15 nt, Homo sapiens
uuugaaacauuugcc

SEQ ID NO: 2016456 - RNA, 15 nt, Homo sapiens
ccagccaccaccacu

SEQ ID NO: 2016457 - RNA, 18 nt, Homo sapiens
ccaaagugcugagauuac

SEQ ID NO: 2016458 - RNA, 22 nt, Homo sapiens
acacaugaaccauccuucccau

SEQ ID NO: 2016459 - RNA, 16 nt, Homo sapiens
acaacuucagcaguac

SEQ ID NO: 2016460 - RNA, 12 nt, Homo sapiens
ggagucacugcc

SEQ ID NO: 2016461 - RNA, 17 nt, Homo sapiens
cugcauaaaugaauaaa

SEQ ID NO: 2016462 - RNA, 15 nt, Homo sapiens
caauaguuaccucaa

SEQ ID NO: 2016463 - RNA, 17 nt, Homo sapiens
ucucccccguguucccc

SEQ ID NO: 2016464 - RNA, 21 nt, Homo sapiens
cuccauggaaacgaagcacca

SEQ ID NO: 2016465 - RNA, 23 nt, Homo sapiens
gaaaaaaaaggcaguauucccuu

SEQ ID NO: 2016466 - RNA, 22 nt, Homo sapiens
ugacugguccuaaucuguaaau

SEQ ID NO: 2016467 - RNA, 22 nt, Homo sapiens
guucuucuuucucuguauuccg

SEQ ID NO: 2016468 - RNA, 22 nt, Homo sapiens
uccugccucagccuccugagca

SEQ ID NO: 2016469 - RNA, 18 nt, Homo sapiens
gaggcucccucuugacgu

SEQ ID NO: 2016470 - RNA, 21 nt, Homo sapiens
uacaaacaauuaacugagcau

SEQ ID NO: 2016471 - RNA, 13 nt, Homo sapiens
uaaugggauuuca

SEQ ID NO: 2016472 - RNA, 20 nt, Homo sapiens
auugaggcuaaguaaccuga

SEQ ID NO: 2016473 - RNA, 15 nt, Homo sapiens
aucuaauaccauccu

SEQ ID NO: 2016474 - RNA, 14 nt, Homo sapiens
uugcaccacugcac

SEQ ID NO: 2016475 - RNA, 14 nt, Homo sapiens
cacagccauacagc

SEQ ID NO: 2016476 - RNA, 15 nt, Homo sapiens
ggucaguugccaaag

SEQ ID NO: 2016477 - RNA, 13 nt, Homo sapiens
ggacacugaucca

SEQ ID NO: 2016478 - RNA, 22 nt, Homo sapiens
ccaauucaaucccggaagggac

SEQ ID NO: 2016479 - RNA, 21 nt, Homo sapiens
acuucuuaguaugugcauuua

SEQ ID NO: 2016480 - RNA, 23 nt, Homo sapiens
gcuugucaaauagcaaggccagg

SEQ ID NO: 2016481 - RNA, 13 nt, Homo sapiens
caauccccaaagg

SEQ ID NO: 2016482 - RNA, 17 nt, Homo sapiens
aggccuggcucauucug

SEQ ID NO: 2016483 - RNA, 13 nt, Homo sapiens
uccuaauucaauc

SEQ ID NO: 2016484 - RNA, 13 nt, Homo sapiens
uauuucaugugcu

SEQ ID NO: 2016485 - RNA, 22 nt, Homo sapiens
gcuugugaacaccuccuagcca

SEQ ID NO: 2016486 - RNA, 19 nt, Homo sapiens
ucaccaaaucagcugcuac

SEQ ID NO: 2016487 - RNA, 14 nt, Homo sapiens
aguaaucacuuaaa

SEQ ID NO: 2016488 - RNA, 14 nt, Homo sapiens
cucaaucaagcaaa

SEQ ID NO: 2016489 - RNA, 13 nt, Homo sapiens
caggaucaccucc

SEQ ID NO: 2016490 - RNA, 19 nt, Homo sapiens
aaggcccaacugguucagg

SEQ ID NO: 2016491 - RNA, 16 nt, Homo sapiens
gagacgaaugccauug

SEQ ID NO: 2016492 - RNA, 19 nt, Homo sapiens
aaguuuuuuuagaagacaa

SEQ ID NO: 2016493 - RNA, 18 nt, Homo sapiens
uuggaggaagcauccaaa

SEQ ID NO: 2016494 - RNA, 22 nt, Homo sapiens
uuccagcaugaggaacuagcca

SEQ ID NO: 2016495 - RNA, 22 nt, Homo sapiens
ucucgcucccuuucagguuuac

SEQ ID NO: 2016496 - RNA, 20 nt, Homo sapiens
uguauggagagaaaacagac

SEQ ID NO: 2016497 - RNA, 20 nt, Homo sapiens
agguugggaaggcaccugcu

SEQ ID NO: 2016498 - RNA, 17 nt, Homo sapiens
cuucugacuacugggca

SEQ ID NO: 2016499 - RNA, 11 nt, Homo sapiens
uuucugucaag

SEQ ID NO: 2016500 - RNA, 19 nt, Homo sapiens
gucagcaaaggguggguuu

SEQ ID NO: 2016501 - RNA, 15 nt, Homo sapiens
uuccuuggcccagca

SEQ ID NO: 2016502 - RNA, 13 nt, Homo sapiens
uaccaagcauuua

SEQ ID NO: 2016503 - RNA, 14 nt, Homo sapiens
caaaguugccuaaa

SEQ ID NO: 2016504 - RNA, 16 nt, Homo sapiens
uugcagauaacaaaca

SEQ ID NO: 2016505 - RNA, 18 nt, Homo sapiens
cugcuuuguauccaugag

SEQ ID NO: 2016506 - RNA, 19 nt, Homo sapiens
uagagacgggguuucacca

SEQ ID NO: 2016507 - RNA, 15 nt, Homo sapiens
auuuugugcaugaaa

SEQ ID NO: 2016508 - RNA, 17 nt, Homo sapiens
agggacauugaaguguu

SEQ ID NO: 2016509 - RNA, 16 nt, Homo sapiens
uucucaaccuuaucaa

SEQ ID NO: 2016510 - RNA, 22 nt, Homo sapiens
auaggggagccugugguggccu

SEQ ID NO: 2016511 - RNA, 13 nt, Homo sapiens
aagaauuucuuca

SEQ ID NO: 2016512 - RNA, 22 nt, Homo sapiens
gccagauggccccuccacuggg

SEQ ID NO: 2016513 - RNA, 22 nt, Homo sapiens
agcuguuguacauuuaugauuu

SEQ ID NO: 2016514 - RNA, 16 nt, Homo sapiens
uuacuaaguaaucuca

SEQ ID NO: 2016515 - RNA, 23 nt, Homo sapiens
ggggugcagaugguacugcugag

SEQ ID NO: 2016516 - RNA, 18 nt, Homo sapiens
aaccccaaaugcucucuc

SEQ ID NO: 2016517 - RNA, 22 nt, Homo sapiens
agggauuuugaauaugccaaac

SEQ ID NO: 2016518 - RNA, 22 nt, Homo sapiens
aaguaugugguacuacuguaag

SEQ ID NO: 2016519 - RNA, 15 nt, Homo sapiens
uacuuugugcuugua

SEQ ID NO: 2016520 - RNA, 16 nt, Homo sapiens
gccuggucguuuucaa

SEQ ID NO: 2016521 - RNA, 13 nt, Homo sapiens
uccugugauccac

SEQ ID NO: 2016522 - RNA, 13 nt, Homo sapiens
cacugugacacac

SEQ ID NO: 2016523 - RNA, 12 nt, Homo sapiens
uguaacugcuga

SEQ ID NO: 2016524 - RNA, 16 nt, Homo sapiens
aguuuaucaugucagu

SEQ ID NO: 2016525 - RNA, 14 nt, Homo sapiens
cagacucacugugg

SEQ ID NO: 2016526 - RNA, 20 nt, Homo sapiens
uccugcccucacaucuucca

SEQ ID NO: 2016527 - RNA, 23 nt, Homo sapiens
cuacacgguucaaaccugugaag

SEQ ID NO: 2016528 - RNA, 22 nt, Homo sapiens
ucucacaugauuccagccauca

SEQ ID NO: 2016529 - RNA, 20 nt, Homo sapiens
aagucaucauaauucagcuc

SEQ ID NO: 2016530 - RNA, 17 nt, Homo sapiens
gcuggaaaaaggugaau

SEQ ID NO: 2016531 - RNA, 16 nt, Homo sapiens
ucuggaagaaagcccu

SEQ ID NO: 2016532 - RNA, 20 nt, Homo sapiens
gcccagcagggccucaaagu

SEQ ID NO: 2016533 - RNA, 17 nt, Homo sapiens
aaaaggcauaugcaaua

SEQ ID NO: 2016534 - RNA, 23 nt, Homo sapiens
gcacacagcuuagaagugcuaua

SEQ ID NO: 2016535 - RNA, 16 nt, Homo sapiens
gaacaagcaugaucuu

SEQ ID NO: 2016536 - RNA, 17 nt, Homo sapiens
acuccuggagcacugua

SEQ ID NO: 2016537 - RNA, 18 nt, Homo sapiens
ugagaauauguaacagcc

SEQ ID NO: 2016538 - RNA, 19 nt, Homo sapiens
auuccccugcccaggugug

SEQ ID NO: 2016539 - RNA, 17 nt, Homo sapiens
aacugacauugcuccaa

SEQ ID NO: 2016540 - RNA, 14 nt, Homo sapiens
agaucauucacuca

SEQ ID NO: 2016541 - RNA, 14 nt, Homo sapiens
cugaggcagggaag

SEQ ID NO: 2016542 - RNA, 16 nt, Homo sapiens
gcuuuggguagugcca

SEQ ID NO: 2016543 - RNA, 12 nt, Homo sapiens
aaugaaaggagu

SEQ ID NO: 2016544 - RNA, 16 nt, Homo sapiens
cagccucacuccucag

SEQ ID NO: 2016545 - RNA, 23 nt, Homo sapiens
agcaauuccaggcugagccauga

SEQ ID NO: 2016546 - RNA, 20 nt, Homo sapiens
gccugcccccuugggugacc

SEQ ID NO: 2016547 - RNA, 17 nt, Homo sapiens
uaugguuagcugucaca

SEQ ID NO: 2016548 - RNA, 22 nt, Homo sapiens
uauucaauaccgcucaguauuu

SEQ ID NO: 2016549 - RNA, 14 nt, Homo sapiens
uuaauaaucuuggc

SEQ ID NO: 2016550 - RNA, 13 nt, Homo sapiens
uuaaagagccagu

SEQ ID NO: 2016551 - RNA, 17 nt, Homo sapiens
ggaaugaaauaauucaa

SEQ ID NO: 2016552 - RNA, 17 nt, Homo sapiens
uaaaguguggaagcaga

SEQ ID NO: 2016553 - RNA, 14 nt, Homo sapiens
gucugagccaaaga

SEQ ID NO: 2016554 - RNA, 11 nt, Homo sapiens
aagaaggccag

SEQ ID NO: 2016555 - RNA, 11 nt, Homo sapiens
aaaaaggccaa

SEQ ID NO: 2016556 - RNA, 18 nt, Homo sapiens
uucccccaucuagccauu

SEQ ID NO: 2016557 - RNA, 15 nt, Homo sapiens
gccaugacugcucag

SEQ ID NO: 2016558 - RNA, 14 nt, Homo sapiens
acaguguaagcuua

SEQ ID NO: 2016559 - RNA, 17 nt, Homo sapiens
gaaggcugucuaccuga

SEQ ID NO: 2016560 - RNA, 20 nt, Homo sapiens
cauaccagagucuggagcug

SEQ ID NO: 2016561 - RNA, 16 nt, Homo sapiens
aauauaacugccuuaa

SEQ ID NO: 2016562 - RNA, 15 nt, Homo sapiens
aaagauuauccuguu

SEQ ID NO: 2016563 - RNA, 14 nt, Homo sapiens
acacgaguuccaga

SEQ ID NO: 2016564 - RNA, 16 nt, Homo sapiens
ugucuauuaaagauau

SEQ ID NO: 2016565 - RNA, 16 nt, Homo sapiens
cuauauuuugaucuau

SEQ ID NO: 2016566 - RNA, 15 nt, Homo sapiens
ggugaagacccagag

SEQ ID NO: 2016567 - RNA, 17 nt, Homo sapiens
cuaagcccccacacaga

SEQ ID NO: 2016568 - RNA, 17 nt, Homo sapiens
ggauuuuucuacauucu

SEQ ID NO: 2016569 - RNA, 14 nt, Homo sapiens
cuaccugucuguag

SEQ ID NO: 2016570 - RNA, 19 nt, Homo sapiens
aaaaaauucacaugaugca

SEQ ID NO: 2016571 - RNA, 17 nt, Homo sapiens
uucugauaagacuggaa

SEQ ID NO: 2016572 - RNA, 16 nt, Homo sapiens
ccucccucccagagca

SEQ ID NO: 2016573 - RNA, 14 nt, Homo sapiens
uguuaacuauugua

SEQ ID NO: 2016574 - RNA, 20 nt, Homo sapiens
uuucauuuucucucagguga

SEQ ID NO: 2016575 - RNA, 19 nt, Homo sapiens
uucacauauaucaaaguga

SEQ ID NO: 2016576 - RNA, 18 nt, Homo sapiens
ugauacugauuaugaaau

SEQ ID NO: 2016577 - RNA, 18 nt, Homo sapiens
uuaauguacguuacagcu

SEQ ID NO: 2016578 - RNA, 17 nt, Homo sapiens
uggcagucucaguccaa

SEQ ID NO: 2016579 - RNA, 13 nt, Homo sapiens
cccucaaaagcac

SEQ ID NO: 2016580 - RNA, 19 nt, Homo sapiens
caaaaacaaagaguaucau

SEQ ID NO: 2016581 - RNA, 21 nt, Homo sapiens
aggaccucccucccccuggca

SEQ ID NO: 2016582 - RNA, 19 nt, Homo sapiens
ucaaucaacaucucuugag

SEQ ID NO: 2016583 - RNA, 15 nt, Homo sapiens
uuguaauaauaaaga

SEQ ID NO: 2016584 - RNA, 12 nt, Homo sapiens
uugaaacuguau

SEQ ID NO: 2016585 - RNA, 20 nt, Homo sapiens
uuuucaccaggggugcucac

SEQ ID NO: 2016586 - RNA, 19 nt, Homo sapiens
aacuggaacacacuuggga

SEQ ID NO: 2016587 - RNA, 16 nt, Homo sapiens
acaauccaucucucaa

SEQ ID NO: 2016588 - RNA, 19 nt, Homo sapiens
ggacaaguagccaccugag

SEQ ID NO: 2016589 - RNA, 19 nt, Homo sapiens
uaguuugacucaguauagg

SEQ ID NO: 2016590 - RNA, 22 nt, Homo sapiens
caugaacaucuuuagugucuga

SEQ ID NO: 2016591 - RNA, 15 nt, Homo sapiens
ccuaaggcaugaaua

SEQ ID NO: 2016592 - RNA, 21 nt, Homo sapiens
aaucuguccguucacaugugu

SEQ ID NO: 2016593 - RNA, 21 nt, Homo sapiens
aguugaucuggaacccagacu

SEQ ID NO: 2016594 - RNA, 15 nt, Homo sapiens
uuaaauguuucucaa

SEQ ID NO: 2016595 - RNA, 15 nt, Homo sapiens
uagcugggcuuacag

SEQ ID NO: 2016596 - RNA, 19 nt, Homo sapiens
ugagcccccugcacccacc

SEQ ID NO: 2016597 - RNA, 22 nt, Homo sapiens
gcccugggaccgcuacaccacu

SEQ ID NO: 2016598 - RNA, 12 nt, Homo sapiens
aacuuagcucac

SEQ ID NO: 2016599 - RNA, 17 nt, Homo sapiens
cuucacaauucauggaa

SEQ ID NO: 2016600 - RNA, 16 nt, Homo sapiens
uguagugugucagagu

SEQ ID NO: 2016601 - RNA, 14 nt, Homo sapiens
gaaaggucaucuca

SEQ ID NO: 2016602 - RNA, 11 nt, Homo sapiens
uugcuuucuau

SEQ ID NO: 2016603 - RNA, 12 nt, Homo sapiens
caccacuguaua

SEQ ID NO: 2016604 - RNA, 15 nt, Homo sapiens
gccucccugagcacu

SEQ ID NO: 2016605 - RNA, 16 nt, Homo sapiens
caaacauucuaauuaa

SEQ ID NO: 2016606 - RNA, 22 nt, Homo sapiens
uaaaagcaagaucuacuacauc

SEQ ID NO: 2016607 - RNA, 20 nt, Homo sapiens
aaaaugggaaaccaguucau

SEQ ID NO: 2016608 - RNA, 18 nt, Homo sapiens
ccaggcgggcaccaaaca

SEQ ID NO: 2016609 - RNA, 17 nt, Homo sapiens
gcccaggagaccacggg

SEQ ID NO: 2016610 - RNA, 19 nt, Homo sapiens
ccccauucuauaaauucaa

SEQ ID NO: 2016611 - RNA, 14 nt, Homo sapiens
acauuaacggugcu

SEQ ID NO: 2016612 - RNA, 15 nt, Homo sapiens
ucauucaucaugaaa

SEQ ID NO: 2016613 - RNA, 20 nt, Homo sapiens
augaagaaucacgauuucau

SEQ ID NO: 2016614 - RNA, 20 nt, Homo sapiens
ugacaccgugggucauuaca

SEQ ID NO: 2016615 - RNA, 22 nt, Homo sapiens
cuuaaauguagcaauggcacug

SEQ ID NO: 2016616 - RNA, 14 nt, Homo sapiens
ugagugaacaacua

SEQ ID NO: 2016617 - RNA, 20 nt, Homo sapiens
auaagacaguugggauccaa

SEQ ID NO: 2016618 - RNA, 12 nt, Homo sapiens
gcugagugcugg

SEQ ID NO: 2016619 - RNA, 19 nt, Homo sapiens
cgguucuguuauaccccau

SEQ ID NO: 2016620 - RNA, 17 nt, Homo sapiens
uggagauuucaguuacu

SEQ ID NO: 2016621 - RNA, 19 nt, Homo sapiens
auaaucauuaaaauuaaca

SEQ ID NO: 2016622 - RNA, 18 nt, Homo sapiens
agccucugggugacaaaa

SEQ ID NO: 2016623 - RNA, 22 nt, Homo sapiens
auugaaaauuuuuaaauauuca

SEQ ID NO: 2016624 - RNA, 21 nt, Homo sapiens
cuuauucuuugaguaauguga

SEQ ID NO: 2016625 - RNA, 15 nt, Homo sapiens
ugugaucacuguaaa

SEQ ID NO: 2016626 - RNA, 15 nt, Homo sapiens
uuggccagugugaca

SEQ ID NO: 2016627 - RNA, 19 nt, Homo sapiens
uuuucuguggaucauuucc

SEQ ID NO: 2016628 - RNA, 17 nt, Homo sapiens
uagaugugucuuaccag

SEQ ID NO: 2016629 - RNA, 19 nt, Homo sapiens
cuucucagauuucugagga

SEQ ID NO: 2016630 - RNA, 10 nt, Homo sapiens
acucucucuu

SEQ ID NO: 2016631 - RNA, 10 nt, Homo sapiens
ucucucucau

SEQ ID NO: 2016632 - RNA, 14 nt, Homo sapiens
cagggcaaccaaua

SEQ ID NO: 2016633 - RNA, 18 nt, Homo sapiens
agcgauucuccugucuca

SEQ ID NO: 2016634 - RNA, 18 nt, Homo sapiens
cuuuugcaggauaauaau

SEQ ID NO: 2016635 - RNA, 21 nt, Homo sapiens
cuggccacaguaauuggucau

SEQ ID NO: 2016636 - RNA, 22 nt, Homo sapiens
cugaaggaaaaacacaagcaaa

SEQ ID NO: 2016637 - RNA, 13 nt, Homo sapiens
gcuuaagcaauaa

SEQ ID NO: 2016638 - RNA, 16 nt, Homo sapiens
uguaccaucauaagau

SEQ ID NO: 2016639 - RNA, 19 nt, Homo sapiens
acuccagccugggugacaa

SEQ ID NO: 2016640 - RNA, 16 nt, Homo sapiens
augauauaacccuaac

SEQ ID NO: 2016641 - RNA, 23 nt, Homo sapiens
uugaaagggacaaguaucaucua

SEQ ID NO: 2016642 - RNA, 20 nt, Homo sapiens
uaaacagaacuccacugcaa

SEQ ID NO: 2016643 - RNA, 23 nt, Homo sapiens
uuagcucucccaacucuugcaca

SEQ ID NO: 2016644 - RNA, 21 nt, Homo sapiens
gucuccaagggcaucacuggg

SEQ ID NO: 2016645 - RNA, 12 nt, Homo sapiens
agaaacuuccuu

SEQ ID NO: 2016646 - RNA, 17 nt, Homo sapiens
uggaaucauaugggaua

SEQ ID NO: 2016647 - RNA, 18 nt, Homo sapiens
accauuagcauuugucaa

SEQ ID NO: 2016648 - RNA, 20 nt, Homo sapiens
uucccaaauaaacucuaaac

SEQ ID NO: 2016649 - RNA, 12 nt, Homo sapiens
cugggugccugc

SEQ ID NO: 2016650 - RNA, 23 nt, Homo sapiens
ugcauuuaaauacagucuuccau

SEQ ID NO: 2016651 - RNA, 21 nt, Homo sapiens
aaagcuccauuuuuagugaaa

SEQ ID NO: 2016652 - RNA, 18 nt, Homo sapiens
aauguacuacauuugcau

SEQ ID NO: 2016653 - RNA, 14 nt, Homo sapiens
accaaguugugcuu

SEQ ID NO: 2016654 - RNA, 20 nt, Homo sapiens
ucaaggaauaauucaaguca

SEQ ID NO: 2016655 - RNA, 21 nt, Homo sapiens
ggggugugccugucuguuaca

SEQ ID NO: 2016656 - RNA, 21 nt, Homo sapiens
gauuccuagauuacaucugcc

SEQ ID NO: 2016657 - RNA, 23 nt, Homo sapiens
acacagcacucucuaaaucuucc

SEQ ID NO: 2016658 - RNA, 15 nt, Homo sapiens
augcuucaugugcug

SEQ ID NO: 2016659 - RNA, 13 nt, Homo sapiens
cuaggaacaugug

SEQ ID NO: 2016660 - RNA, 21 nt, Homo sapiens
guauaaucuuguagacacuua

SEQ ID NO: 2016661 - RNA, 15 nt, Homo sapiens
auaaagaaauugcaa

SEQ ID NO: 2016662 - RNA, 13 nt, Homo sapiens
ucuuucuuucugc

SEQ ID NO: 2016663 - RNA, 22 nt, Homo sapiens
aaagcacuccugcuuaaucuuc

SEQ ID NO: 2016664 - RNA, 20 nt, Homo sapiens
cagacaucaagcucaaggca

SEQ ID NO: 2016665 - RNA, 22 nt, Homo sapiens
cucugagauacuaauaggugug

SEQ ID NO: 2016666 - RNA, 16 nt, Homo sapiens
acgcaggagaaucacu

SEQ ID NO: 2016667 - RNA, 16 nt, Homo sapiens
ucugaggccugaguga

SEQ ID NO: 2016668 - RNA, 16 nt, Homo sapiens
auauuuuagaaccaca

SEQ ID NO: 2016669 - RNA, 15 nt, Homo sapiens
acguaagcacuguuu

SEQ ID NO: 2016670 - RNA, 16 nt, Homo sapiens
cagucucauuuugaca

SEQ ID NO: 2016671 - RNA, 16 nt, Homo sapiens
cuggguucccuaggcc

SEQ ID NO: 2016672 - RNA, 20 nt, Homo sapiens
aggccaggcauggugguuua

SEQ ID NO: 2016673 - RNA, 23 nt, Homo sapiens
aucuggauucuacaaaaaaccag

SEQ ID NO: 2016674 - RNA, 21 nt, Homo sapiens
uuuuauuuuuaugugcucuca

SEQ ID NO: 2016675 - RNA, 18 nt, Homo sapiens
gccuguggcuggcuggaa

SEQ ID NO: 2016676 - RNA, 14 nt, Homo sapiens
ucuacaugaugcua

SEQ ID NO: 2016677 - RNA, 16 nt, Homo sapiens
aaauuucuagccugca

SEQ ID NO: 2016678 - RNA, 22 nt, Homo sapiens
caguucaacugcuuacucccaa

SEQ ID NO: 2016679 - RNA, 18 nt, Homo sapiens
ugccagaugauuguucaa

SEQ ID NO: 2016680 - RNA, 11 nt, Homo sapiens
uaucuuaccug

SEQ ID NO: 2016681 - RNA, 18 nt, Homo sapiens
caaacaaaaacuguugcu

SEQ ID NO: 2016682 - RNA, 17 nt, Homo sapiens
gauuccuucuugcucag

SEQ ID NO: 2016683 - RNA, 17 nt, Homo sapiens
ggaagucucagcagcuc

SEQ ID NO: 2016684 - RNA, 19 nt, Homo sapiens
aaugugcagugucuuguaa

SEQ ID NO: 2016685 - RNA, 18 nt, Homo sapiens
guggacgugcacugacag

SEQ ID NO: 2016686 - RNA, 22 nt, Homo sapiens
gaaacucauaauagacuuccca

SEQ ID NO: 2016687 - RNA, 19 nt, Homo sapiens
uaguuaaaaaaacaaacag

SEQ ID NO: 2016688 - RNA, 18 nt, Homo sapiens
auaaacaccaacccagga

SEQ ID NO: 2016689 - RNA, 22 nt, Homo sapiens
acccucccuaccugaggccuau

SEQ ID NO: 2016690 - RNA, 15 nt, Homo sapiens
augcuugauuccagu

SEQ ID NO: 2016691 - RNA, 16 nt, Homo sapiens
auguguguugauacug

SEQ ID NO: 2016692 - RNA, 13 nt, Homo sapiens
ccugcauuaacug

SEQ ID NO: 2016693 - RNA, 18 nt, Homo sapiens
uuaguuccugugcacagc

SEQ ID NO: 2016694 - RNA, 17 nt, Homo sapiens
agggcuggcccuaggca

SEQ ID NO: 2016695 - RNA, 17 nt, Homo sapiens
agaacuguauuuaguga

SEQ ID NO: 2016696 - RNA, 11 nt, Homo sapiens
guaagugcuuu

SEQ ID NO: 2016697 - RNA, 17 nt, Homo sapiens
ccccaugacaggaguuu

SEQ ID NO: 2016698 - RNA, 17 nt, Homo sapiens
uguuucuaaacaguuga

SEQ ID NO: 2016699 - RNA, 20 nt, Homo sapiens
auguggcuacugacauaucu

SEQ ID NO: 2016700 - RNA, 23 nt, Homo sapiens
gaaagguagcccccgagggaugu

SEQ ID NO: 2016701 - RNA, 19 nt, Homo sapiens
caguuguuaaaaugagcau

SEQ ID NO: 2016702 - RNA, 15 nt, Homo sapiens
cuaaugagauauauc

SEQ ID NO: 2016703 - RNA, 18 nt, Homo sapiens
caucuccauugcauucau

SEQ ID NO: 2016704 - RNA, 23 nt, Homo sapiens
augguucuggacggcccagcagc

SEQ ID NO: 2016705 - RNA, 16 nt, Homo sapiens
ugaaaucgaauggaga

SEQ ID NO: 2016706 - RNA, 17 nt, Homo sapiens
uuuugaaaaugcuuuag

SEQ ID NO: 2016707 - RNA, 17 nt, Homo sapiens
uauuugcugaccacacu

SEQ ID NO: 2016708 - RNA, 11 nt, Homo sapiens
acacacacugg

SEQ ID NO: 2016709 - RNA, 11 nt, Homo sapiens
ucacacacagg

SEQ ID NO: 2016710 - RNA, 14 nt, Homo sapiens
ugagaaacauugcu

SEQ ID NO: 2016711 - RNA, 15 nt, Homo sapiens
agaugccacauucaa

SEQ ID NO: 2016712 - RNA, 19 nt, Homo sapiens
aggcaaugugggaucucag

SEQ ID NO: 2016713 - RNA, 18 nt, Homo sapiens
ucccuuauuuugugaucu

SEQ ID NO: 2016714 - RNA, 17 nt, Homo sapiens
guguucacucagcacuu

SEQ ID NO: 2016715 - RNA, 16 nt, Homo sapiens
cgaccacagggccuug

SEQ ID NO: 2016716 - RNA, 15 nt, Homo sapiens
gagggagaugggagg

SEQ ID NO: 2016717 - RNA, 15 nt, Homo sapiens
uaguucucagcucuu

SEQ ID NO: 2016718 - RNA, 20 nt, Homo sapiens
aguguaaaucuaaacauaaa

SEQ ID NO: 2016719 - RNA, 16 nt, Homo sapiens
ccuggaccaggucuca

SEQ ID NO: 2016720 - RNA, 16 nt, Homo sapiens
accucgcuccaacucc

SEQ ID NO: 2016721 - RNA, 12 nt, Homo sapiens
cucugcauagac

SEQ ID NO: 2016722 - RNA, 21 nt, Homo sapiens
acccccaucuuuacaaagaaa

SEQ ID NO: 2016723 - RNA, 14 nt, Homo sapiens
gagaguacauggca

SEQ ID NO: 2016724 - RNA, 13 nt, Homo sapiens
caagaucuuuaca

SEQ ID NO: 2016725 - RNA, 12 nt, Homo sapiens
uguacaaagccc

SEQ ID NO: 2016726 - RNA, 19 nt, Homo sapiens
agccuuaaaaugcauugaa

SEQ ID NO: 2016727 - RNA, 18 nt, Homo sapiens
cagauuguuucuauacaa

SEQ ID NO: 2016728 - RNA, 16 nt, Homo sapiens
ugcaagugugugcaug

SEQ ID NO: 2016729 - RNA, 14 nt, Homo sapiens
uguuuccacacuua

SEQ ID NO: 2016730 - RNA, 23 nt, Homo sapiens
cuucagcagcuagagcucaguau

SEQ ID NO: 2016731 - RNA, 23 nt, Homo sapiens
acaauucagucuagccacaaagg

SEQ ID NO: 2016732 - RNA, 17 nt, Homo sapiens
uuacauuuuccugugua

SEQ ID NO: 2016733 - RNA, 18 nt, Homo sapiens
gccagcauuaccacagcu

SEQ ID NO: 2016734 - RNA, 18 nt, Homo sapiens
aauguugcaacacauuca

SEQ ID NO: 2016735 - RNA, 16 nt, Homo sapiens
uuagauguguauacag

SEQ ID NO: 2016736 - RNA, 16 nt, Homo sapiens
accuuuucaccuccaa

SEQ ID NO: 2016737 - RNA, 21 nt, Homo sapiens
ugcccacccugggagacagac

SEQ ID NO: 2016738 - RNA, 18 nt, Homo sapiens
uuauuauggguauguguu

SEQ ID NO: 2016739 - RNA, 14 nt, Homo sapiens
aacuggacucagga

SEQ ID NO: 2016740 - RNA, 14 nt, Homo sapiens
acuguagucucuga

SEQ ID NO: 2016741 - RNA, 19 nt, Homo sapiens
cuggagugcaacggcauga

SEQ ID NO: 2016742 - RNA, 20 nt, Homo sapiens
uccuugcccagacuacaggg

SEQ ID NO: 2016743 - RNA, 12 nt, Homo sapiens
caacaguuuucc

SEQ ID NO: 2016744 - RNA, 12 nt, Homo sapiens
uaaaaguucuca

SEQ ID NO: 2016745 - RNA, 20 nt, Homo sapiens
cucaucuccagcuaacugug

SEQ ID NO: 2016746 - RNA, 24 nt, Homo sapiens
gggccaugcagaccucaugcccag

SEQ ID NO: 2016747 - RNA, 13 nt, Homo sapiens
uucuuauaacaua

SEQ ID NO: 2016748 - RNA, 20 nt, Homo sapiens
uuagugauuauauuucaccc

SEQ ID NO: 2016749 - RNA, 19 nt, Homo sapiens
uaguccuagugaaccucac

SEQ ID NO: 2016750 - RNA, 17 nt, Homo sapiens
ugcguugaugacuuuuu

SEQ ID NO: 2016751 - RNA, 15 nt, Homo sapiens
accauauaccaucuc

SEQ ID NO: 2016752 - RNA, 17 nt, Homo sapiens
gcacaauaguaaccugg

SEQ ID NO: 2016753 - RNA, 17 nt, Homo sapiens
ucaaacuccugaccuca

SEQ ID NO: 2016754 - RNA, 12 nt, Homo sapiens
ggccagggcaca

SEQ ID NO: 2016755 - RNA, 15 nt, Homo sapiens
caggccauacuuuac

SEQ ID NO: 2016756 - RNA, 13 nt, Homo sapiens
auugaucacagau

SEQ ID NO: 2016757 - RNA, 12 nt, Homo sapiens
acagaggugcug

SEQ ID NO: 2016758 - RNA, 16 nt, Homo sapiens
gacacgcaacuggcuc

SEQ ID NO: 2016759 - RNA, 18 nt, Homo sapiens
aacuugcugcugugccug

SEQ ID NO: 2016760 - RNA, 14 nt, Homo sapiens
gcaagucacuggcc

SEQ ID NO: 2016761 - RNA, 22 nt, Homo sapiens
ggucaaaaagugauggcuuuca

SEQ ID NO: 2016762 - RNA, 16 nt, Homo sapiens
cacagaggcuggcacu

SEQ ID NO: 2016763 - RNA, 23 nt, Homo sapiens
ucauaaagucuuugaagugacuu

SEQ ID NO: 2016764 - RNA, 16 nt, Homo sapiens
cagaauauucucccau

SEQ ID NO: 2016765 - RNA, 21 nt, Homo sapiens
ggggcaaggugggggagccug

SEQ ID NO: 2016766 - RNA, 14 nt, Homo sapiens
ugcagccugacccc

SEQ ID NO: 2016767 - RNA, 15 nt, Homo sapiens
gaguagauacucuca

SEQ ID NO: 2016768 - RNA, 14 nt, Homo sapiens
aguuuuaaacuggu

SEQ ID NO: 2016769 - RNA, 18 nt, Homo sapiens
ucaacuuuuccuuucaua

SEQ ID NO: 2016770 - RNA, 17 nt, Homo sapiens
gagugaucucagcucac

SEQ ID NO: 2016771 - RNA, 13 nt, Homo sapiens
auagaaaccucuc

SEQ ID NO: 2016772 - RNA, 20 nt, Homo sapiens
uagccaaacaacaacaaaaa

SEQ ID NO: 2016773 - RNA, 21 nt, Homo sapiens
ucaagcaugcaauaaugugca

SEQ ID NO: 2016774 - RNA, 21 nt, Homo sapiens
aauagacauuucuccaaagaa

SEQ ID NO: 2016775 - RNA, 19 nt, Homo sapiens
ucauggaaguggcagugaa

SEQ ID NO: 2016776 - RNA, 11 nt, Homo sapiens
uucacuugcca

SEQ ID NO: 2016777 - RNA, 16 nt, Homo sapiens
gauauccaugaugcug

SEQ ID NO: 2016778 - RNA, 19 nt, Homo sapiens
uccuuggguauuagaguuu

SEQ ID NO: 2016779 - RNA, 16 nt, Homo sapiens
auaccaguacuugagg

SEQ ID NO: 2016780 - RNA, 12 nt, Homo sapiens
acucauccugau

SEQ ID NO: 2016781 - RNA, 15 nt, Homo sapiens
cuugaacugucuacc

SEQ ID NO: 2016782 - RNA, 13 nt, Homo sapiens
uucccagcugucu

SEQ ID NO: 2016783 - RNA, 18 nt, Homo sapiens
uauacacaacuuugcaaa

SEQ ID NO: 2016784 - RNA, 16 nt, Homo sapiens
cuuuauuuccacugug

SEQ ID NO: 2016785 - RNA, 23 nt, Homo sapiens
aaccagacagagggucacagugu

SEQ ID NO: 2016786 - RNA, 21 nt, Homo sapiens
uagagagccccugacaauccu

SEQ ID NO: 2016787 - RNA, 19 nt, Homo sapiens
gcuggaggacaguggcaca

SEQ ID NO: 2016788 - RNA, 21 nt, Homo sapiens
uggcaaagaacucauuugaau

SEQ ID NO: 2016789 - RNA, 21 nt, Homo sapiens
cagacauuccuucuacaugua

SEQ ID NO: 2016790 - RNA, 22 nt, Homo sapiens
cuuuuugggugauuaaaaaacu

SEQ ID NO: 2016791 - RNA, 11 nt, Homo sapiens
gaucuaucugu

SEQ ID NO: 2016792 - RNA, 21 nt, Homo sapiens
uccaagccuuauuuugaguaa

SEQ ID NO: 2016793 - RNA, 23 nt, Homo sapiens
agucauccaacaagaagaaauau

SEQ ID NO: 2016794 - RNA, 18 nt, Homo sapiens
gcuguaaucccagcacuu

SEQ ID NO: 2016795 - RNA, 18 nt, Homo sapiens
uuaacaacuugaauuaca

SEQ ID NO: 2016796 - RNA, 17 nt, Homo sapiens
gggcgaccccgucacag

SEQ ID NO: 2016797 - RNA, 18 nt, Homo sapiens
agacaacaccuuccuccu

SEQ ID NO: 2016798 - RNA, 22 nt, Homo sapiens
cagcuguaagaagagacuggga

SEQ ID NO: 2016799 - RNA, 15 nt, Homo sapiens
acaagugaaaacuga

SEQ ID NO: 2016800 - RNA, 20 nt, Homo sapiens
gucuguguucgacucagccu

SEQ ID NO: 2016801 - RNA, 16 nt, Homo sapiens
aagagaggucuggaaa

SEQ ID NO: 2016802 - RNA, 23 nt, Homo sapiens
cccugggcaucagaccuuaacca

SEQ ID NO: 2016803 - RNA, 18 nt, Homo sapiens
auuugugaacuggaagaa

SEQ ID NO: 2016804 - RNA, 13 nt, Homo sapiens
caguuucucagaa

SEQ ID NO: 2016805 - RNA, 14 nt, Homo sapiens
acauauuaagaaua

SEQ ID NO: 2016806 - RNA, 15 nt, Homo sapiens
auucggauuugacaa

SEQ ID NO: 2016807 - RNA, 14 nt, Homo sapiens
aucaucuuugccaa

SEQ ID NO: 2016808 - RNA, 18 nt, Homo sapiens
uaaagcccauugcugcaa

SEQ ID NO: 2016809 - RNA, 17 nt, Homo sapiens
aaccucuguauuugaau

SEQ ID NO: 2016810 - RNA, 20 nt, Homo sapiens
caacugcagaaaauguccuc

SEQ ID NO: 2016811 - RNA, 21 nt, Homo sapiens
ccaucggaaaggaauccacau

SEQ ID NO: 2016812 - RNA, 14 nt, Homo sapiens
aagcauacuuugua

SEQ ID NO: 2016813 - RNA, 21 nt, Homo sapiens
cggcagggugucccaggagcc

SEQ ID NO: 2016814 - RNA, 10 nt, Homo sapiens
ugaccacaga

SEQ ID NO: 2016815 - RNA, 16 nt, Homo sapiens
caguuccuccaagagg

SEQ ID NO: 2016816 - RNA, 19 nt, Homo sapiens
gagaguaguuuuucagcua

SEQ ID NO: 2016817 - RNA, 12 nt, Homo sapiens
uucuugcaauuu

SEQ ID NO: 2016818 - RNA, 19 nt, Homo sapiens
agcuuaagggaauaugcau

SEQ ID NO: 2016819 - RNA, 14 nt, Homo sapiens
ucuucaccauuugg

SEQ ID NO: 2016820 - RNA, 16 nt, Homo sapiens
caagacuucacugcag

SEQ ID NO: 2016821 - RNA, 14 nt, Homo sapiens
cucuacagugccaa

SEQ ID NO: 2016822 - RNA, 23 nt, Homo sapiens
caaagcguuucuuuacuucucac

SEQ ID NO: 2016823 - RNA, 22 nt, Homo sapiens
cuuuugguuugggcuguauuga

SEQ ID NO: 2016824 - RNA, 22 nt, Homo sapiens
uucagagugguuucauugccuu

SEQ ID NO: 2016825 - RNA, 22 nt, Homo sapiens
cccuguuuuaauucaacccagc

SEQ ID NO: 2016826 - RNA, 14 nt, Homo sapiens
cucuguaggccaaa

SEQ ID NO: 2016827 - RNA, 18 nt, Homo sapiens
agccuaggaccacucagc

SEQ ID NO: 2016828 - RNA, 13 nt, Homo sapiens
cuccagucuucca

SEQ ID NO: 2016829 - RNA, 21 nt, Homo sapiens
uaggcggucaugugugcaugu

SEQ ID NO: 2016830 - RNA, 16 nt, Homo sapiens
ccugcccugcccucac

SEQ ID NO: 2016831 - RNA, 16 nt, Homo sapiens
uugcccagucuuucau

SEQ ID NO: 2016832 - RNA, 21 nt, Homo sapiens
aguggaaaaugaccucaagga

SEQ ID NO: 2016833 - RNA, 13 nt, Homo sapiens
auucccaagccau

SEQ ID NO: 2016834 - RNA, 13 nt, Homo sapiens
aaauuaacaccca

SEQ ID NO: 2016835 - RNA, 22 nt, Homo sapiens
caaacaggcaguuggccagaga

SEQ ID NO: 2016836 - RNA, 23 nt, Homo sapiens
aauugaagagagauauaucugaa

SEQ ID NO: 2016837 - RNA, 17 nt, Homo sapiens
gugccuuugaccaucuc

SEQ ID NO: 2016838 - RNA, 19 nt, Homo sapiens
cggcacuggguuugcuccc

SEQ ID NO: 2016839 - RNA, 13 nt, Homo sapiens
acccaagggcaga

SEQ ID NO: 2016840 - RNA, 22 nt, Homo sapiens
auaugcacacacagaugcacac

SEQ ID NO: 2016841 - RNA, 13 nt, Homo sapiens
accuuguuuauua

SEQ ID NO: 2016842 - RNA, 21 nt, Homo sapiens
gaaaucaguaaacacugugua

SEQ ID NO: 2016843 - RNA, 16 nt, Homo sapiens
aaacugaaugucaaga

SEQ ID NO: 2016844 - RNA, 15 nt, Homo sapiens
ucaaaccacaauauc

SEQ ID NO: 2016845 - RNA, 17 nt, Homo sapiens
acaaugguuuauuccca

SEQ ID NO: 2016846 - RNA, 14 nt, Homo sapiens
gucaaaacuacuga

SEQ ID NO: 2016847 - RNA, 19 nt, Homo sapiens
acuccuaagggacugugag

SEQ ID NO: 2016848 - RNA, 22 nt, Homo sapiens
aguugagucuccucucugagac

SEQ ID NO: 2016849 - RNA, 13 nt, Homo sapiens
agugagauacaaa

SEQ ID NO: 2016850 - RNA, 12 nt, Homo sapiens
ugacucugcauu

SEQ ID NO: 2016851 - RNA, 23 nt, Homo sapiens
uagauuaaauaaaugucuuuaua

SEQ ID NO: 2016852 - RNA, 15 nt, Homo sapiens
cuggccgcugugcca

SEQ ID NO: 2016853 - RNA, 12 nt, Homo sapiens
aaagugugaaug

SEQ ID NO: 2016854 - RNA, 12 nt, Homo sapiens
caagugugcaug

SEQ ID NO: 2016855 - RNA, 12 nt, Homo sapiens
aauaugugaaaa

SEQ ID NO: 2016856 - RNA, 23 nt, Homo sapiens
ucugugacuugaaguuuagucag

SEQ ID NO: 2016857 - RNA, 18 nt, Homo sapiens
gaagacgaagaagcaagg

SEQ ID NO: 2016858 - RNA, 18 nt, Homo sapiens
uuuccuaugcuauugaca

SEQ ID NO: 2016859 - RNA, 20 nt, Homo sapiens
caguccgccaaacacuccac

SEQ ID NO: 2016860 - RNA, 17 nt, Homo sapiens
auuuaauuaaagcacac

SEQ ID NO: 2016861 - RNA, 17 nt, Homo sapiens
cuggggggacccagugc

SEQ ID NO: 2016862 - RNA, 13 nt, Homo sapiens
cuguccagacaag

SEQ ID NO: 2016863 - RNA, 20 nt, Homo sapiens
cccaggucuugacaccagcu

SEQ ID NO: 2016864 - RNA, 17 nt, Homo sapiens
ccuccaaucuugagauu

SEQ ID NO: 2016865 - RNA, 14 nt, Homo sapiens
agaggaggggacca

SEQ ID NO: 2016866 - RNA, 22 nt, Homo sapiens
ugcuuuccagccuuuggugcuu

SEQ ID NO: 2016867 - RNA, 17 nt, Homo sapiens
cauucuaaaucacuuua

SEQ ID NO: 2016868 - RNA, 18 nt, Homo sapiens
gacaguguagcacucuac

SEQ ID NO: 2016869 - RNA, 17 nt, Homo sapiens
uaagccaauaaauaaua

SEQ ID NO: 2016870 - RNA, 21 nt, Homo sapiens
ccugucaggcucuuacagcca

SEQ ID NO: 2016871 - RNA, 21 nt, Homo sapiens
ugggaccuuuuguacuuuauu

SEQ ID NO: 2016872 - RNA, 20 nt, Homo sapiens
aguuugaagcacaacucccu

SEQ ID NO: 2016873 - RNA, 14 nt, Homo sapiens
ugcuggacugagga

SEQ ID NO: 2016874 - RNA, 15 nt, Homo sapiens
cacaugaugugcaua

SEQ ID NO: 2016875 - RNA, 17 nt, Homo sapiens
gcauuucaccauucaaa

SEQ ID NO: 2016876 - RNA, 14 nt, Homo sapiens
aagcugcucuggaa

SEQ ID NO: 2016877 - RNA, 15 nt, Homo sapiens
gcaucucaucuggac

SEQ ID NO: 2016878 - RNA, 18 nt, Homo sapiens
agagggcauauacaguga

SEQ ID NO: 2016879 - RNA, 17 nt, Homo sapiens
gagacaggguuucacug

SEQ ID NO: 2016880 - RNA, 18 nt, Homo sapiens
aauguggagaacuaaagg

SEQ ID NO: 2016881 - RNA, 23 nt, Homo sapiens
cacauaaaaaugcaacgcuguaa

SEQ ID NO: 2016882 - RNA, 21 nt, Homo sapiens
ucacacaacacugaugugacu

SEQ ID NO: 2016883 - RNA, 16 nt, Homo sapiens
cuuaggaaccuaccag

SEQ ID NO: 2016884 - RNA, 13 nt, Homo sapiens
cacacaccucuag

SEQ ID NO: 2016885 - RNA, 17 nt, Homo sapiens
cuuugcugcauuuuaca

SEQ ID NO: 2016886 - RNA, 17 nt, Homo sapiens
uauugaaaaugucacug

SEQ ID NO: 2016887 - RNA, 17 nt, Homo sapiens
uccaggacuguugauga

SEQ ID NO: 2016888 - RNA, 13 nt, Homo sapiens
agcugacuguucu

SEQ ID NO: 2016889 - RNA, 19 nt, Homo sapiens
ucacauuuaccauaauuua

SEQ ID NO: 2016890 - RNA, 13 nt, Homo sapiens
gaaagguagugua

SEQ ID NO: 2016891 - RNA, 20 nt, Homo sapiens
aaucaccccucucagugcac

SEQ ID NO: 2016892 - RNA, 14 nt, Homo sapiens
aaugcuccaugaaa

SEQ ID NO: 2016893 - RNA, 18 nt, Homo sapiens
caguuaaaauguguuucu

SEQ ID NO: 2016894 - RNA, 14 nt, Homo sapiens
accaaggaagcagc

SEQ ID NO: 2016895 - RNA, 22 nt, Homo sapiens
acuucugucuucacaacagauu

SEQ ID NO: 2016896 - RNA, 14 nt, Homo sapiens
accugaaauuccaa

SEQ ID NO: 2016897 - RNA, 18 nt, Homo sapiens
ucagcucuggcucacaga

SEQ ID NO: 2016898 - RNA, 17 nt, Homo sapiens
ucaucagaugccugcuu

SEQ ID NO: 2016899 - RNA, 23 nt, Homo sapiens
aaauaugagccgguuauuacuuc

SEQ ID NO: 2016900 - RNA, 13 nt, Homo sapiens
acacagaccacca

SEQ ID NO: 2016901 - RNA, 13 nt, Homo sapiens
cugcccuucucac

SEQ ID NO: 2016902 - RNA, 17 nt, Homo sapiens
acccguucaacuuuucc

SEQ ID NO: 2016903 - RNA, 21 nt, Homo sapiens
acucagcacauucgggaccaa

SEQ ID NO: 2016904 - RNA, 19 nt, Homo sapiens
uucaccugcugcuugcccc

SEQ ID NO: 2016905 - RNA, 22 nt, Homo sapiens
uagcaagcuggccucuaccaca

SEQ ID NO: 2016906 - RNA, 17 nt, Homo sapiens
gagauugugccacuuca

SEQ ID NO: 2016907 - RNA, 19 nt, Homo sapiens
agcuuauuauagaauugca

SEQ ID NO: 2016908 - RNA, 12 nt, Homo sapiens
uaggcagggaag

SEQ ID NO: 2016909 - RNA, 13 nt, Homo sapiens
uggucugugcauu

SEQ ID NO: 2016910 - RNA, 21 nt, Homo sapiens
ccugucuaggucaguacccac

SEQ ID NO: 2016911 - RNA, 18 nt, Homo sapiens
cccagggccugacuugag

SEQ ID NO: 2016912 - RNA, 15 nt, Homo sapiens
acuguguacugugga

SEQ ID NO: 2016913 - RNA, 20 nt, Homo sapiens
uuugaaauaaauuuuaauuc

SEQ ID NO: 2016914 - RNA, 18 nt, Homo sapiens
caaagcaaggaucuuuca

SEQ ID NO: 2016915 - RNA, 15 nt, Homo sapiens
gaauguguuugaaca

SEQ ID NO: 2016916 - RNA, 17 nt, Homo sapiens
caauggcaggaucucag

SEQ ID NO: 2016917 - RNA, 17 nt, Homo sapiens
gaagggcaggagcucac

SEQ ID NO: 2016918 - RNA, 23 nt, Homo sapiens
ucuaucucucuuuacauuuuggu

SEQ ID NO: 2016919 - RNA, 13 nt, Homo sapiens
gcccucuaccuga

SEQ ID NO: 2016920 - RNA, 20 nt, Homo sapiens
uguugcugaaagacuaccuc

SEQ ID NO: 2016921 - RNA, 15 nt, Homo sapiens
aauuuugcaccagcg

SEQ ID NO: 2016922 - RNA, 21 nt, Homo sapiens
aaaauggaccuaucuguaaga

SEQ ID NO: 2016923 - RNA, 15 nt, Homo sapiens
aaucaauucuaguca

SEQ ID NO: 2016924 - RNA, 22 nt, Homo sapiens
acuuagugcuguuuuuaaucca

SEQ ID NO: 2016925 - RNA, 14 nt, Homo sapiens
gcgcagaugugcag

SEQ ID NO: 2016926 - RNA, 14 nt, Homo sapiens
uuauuaauucauua

SEQ ID NO: 2016927 - RNA, 15 nt, Homo sapiens
uaaaaagugggcaaa

SEQ ID NO: 2016928 - RNA, 18 nt, Homo sapiens
aggcuggggaaguccucu

SEQ ID NO: 2016929 - RNA, 15 nt, Homo sapiens
gcauuagugcugaua

SEQ ID NO: 2016930 - RNA, 14 nt, Homo sapiens
aucuccagcaugua

SEQ ID NO: 2016931 - RNA, 14 nt, Homo sapiens
guccagauuuacac

SEQ ID NO: 2016932 - RNA, 23 nt, Homo sapiens
gcacucgauuguuguaaacuguu

SEQ ID NO: 2016933 - RNA, 14 nt, Homo sapiens
caguguccucaggg

SEQ ID NO: 2016934 - RNA, 20 nt, Homo sapiens
ucagccuaagagacugguga

SEQ ID NO: 2016935 - RNA, 13 nt, Homo sapiens
cauugccuagcuc

SEQ ID NO: 2016936 - RNA, 16 nt, Homo sapiens
ucagcucaucuucacu

SEQ ID NO: 2016937 - RNA, 21 nt, Homo sapiens
uuugggagaaaacgucuugcu

SEQ ID NO: 2016938 - RNA, 16 nt, Homo sapiens
gcugcucccuuuauca

SEQ ID NO: 2016939 - RNA, 21 nt, Homo sapiens
uauggaauaucaucugucauu

SEQ ID NO: 2016940 - RNA, 16 nt, Homo sapiens
uuuggugcaauauucu

SEQ ID NO: 2016941 - RNA, 18 nt, Homo sapiens
gcuuggcugcucuuccag

SEQ ID NO: 2016942 - RNA, 16 nt, Homo sapiens
aucauauucauaugca

SEQ ID NO: 2016943 - RNA, 16 nt, Homo sapiens
aauuggacucugucac

SEQ ID NO: 2016944 - RNA, 14 nt, Homo sapiens
ugcaaccuucgcca

SEQ ID NO: 2016945 - RNA, 20 nt, Homo sapiens
ggaaggagaaggagugccau

SEQ ID NO: 2016946 - RNA, 16 nt, Homo sapiens
ucuggcuucaaaaagc

SEQ ID NO: 2016947 - RNA, 17 nt, Homo sapiens
cuuuggauaauaggaau

SEQ ID NO: 2016948 - RNA, 15 nt, Homo sapiens
gaucagcgacccuga

SEQ ID NO: 2016949 - RNA, 17 nt, Homo sapiens
uuaaauugcuugaaugu

SEQ ID NO: 2016950 - RNA, 19 nt, Homo sapiens
ucuccuucaaaacauucuc

SEQ ID NO: 2016951 - RNA, 16 nt, Homo sapiens
ugcuugacaacaucug

SEQ ID NO: 2016952 - RNA, 16 nt, Homo sapiens
uaacauuuaaauucca

SEQ ID NO: 2016953 - RNA, 18 nt, Homo sapiens
uugucuacauagugacau

SEQ ID NO: 2016954 - RNA, 15 nt, Homo sapiens
uguguguuugccaau

SEQ ID NO: 2016955 - RNA, 23 nt, Homo sapiens
acaggucuuugccauaacuuuau

SEQ ID NO: 2016956 - RNA, 16 nt, Homo sapiens
agcauguuuucacuaa

SEQ ID NO: 2016957 - RNA, 14 nt, Homo sapiens
ugacaaguagggca

SEQ ID NO: 2016958 - RNA, 15 nt, Homo sapiens
caccaaaacugcucc

SEQ ID NO: 2016959 - RNA, 16 nt, Homo sapiens
uaauggccuuccauaa

SEQ ID NO: 2016960 - RNA, 18 nt, Homo sapiens
cauugcacuccagccugg

SEQ ID NO: 2016961 - RNA, 17 nt, Homo sapiens
ucuuuuaagcccaucaa

SEQ ID NO: 2016962 - RNA, 18 nt, Homo sapiens
caaccaaagacacugucc

SEQ ID NO: 2016963 - RNA, 15 nt, Homo sapiens
uugcaacuuagcuca

SEQ ID NO: 2016964 - RNA, 16 nt, Homo sapiens
auauuuccaauaacua

SEQ ID NO: 2016965 - RNA, 18 nt, Homo sapiens
guccuccucuaccucucu

SEQ ID NO: 2016966 - RNA, 12 nt, Homo sapiens
uugucauucaag

SEQ ID NO: 2016967 - RNA, 16 nt, Homo sapiens
cagaggauggcuuccc

SEQ ID NO: 2016968 - RNA, 22 nt, Homo sapiens
cuuggcgagauuugggggugcu

SEQ ID NO: 2016969 - RNA, 13 nt, Homo sapiens
uugugacugucac

SEQ ID NO: 2016970 - RNA, 18 nt, Homo sapiens
ugugacaauggcaacaau

SEQ ID NO: 2016971 - RNA, 17 nt, Homo sapiens
uaacucccccucauuca

SEQ ID NO: 2016972 - RNA, 18 nt, Homo sapiens
acccauaucugugcaaug

SEQ ID NO: 2016973 - RNA, 16 nt, Homo sapiens
uuccaaagccagugaa

SEQ ID NO: 2016974 - RNA, 13 nt, Homo sapiens
aguuuucaaguca

SEQ ID NO: 2016975 - RNA, 18 nt, Homo sapiens
uaaaauuaugccauagca

SEQ ID NO: 2016976 - RNA, 19 nt, Homo sapiens
ccuugugaacccugcaaua

SEQ ID NO: 2016977 - RNA, 13 nt, Homo sapiens
auuauaaucaaaa

SEQ ID NO: 2016978 - RNA, 16 nt, Homo sapiens
caauuauuacauuuau

SEQ ID NO: 2016979 - RNA, 13 nt, Homo sapiens
cucuuauaauucc

SEQ ID NO: 2016980 - RNA, 21 nt, Homo sapiens
ucugcaagcacaucugcauuu

SEQ ID NO: 2016981 - RNA, 17 nt, Homo sapiens
gaagcuucuugcugcca

SEQ ID NO: 2016982 - RNA, 15 nt, Homo sapiens
accauguauguggua

SEQ ID NO: 2016983 - RNA, 20 nt, Homo sapiens
uaacgauaaaagacagugaa

SEQ ID NO: 2016984 - RNA, 11 nt, Homo sapiens
aggucuagccu

SEQ ID NO: 2016985 - RNA, 21 nt, Homo sapiens
acacaaaaaaaauuuuagcuc

SEQ ID NO: 2016986 - RNA, 14 nt, Homo sapiens
cugccucuggguga

SEQ ID NO: 2016987 - RNA, 15 nt, Homo sapiens
uguugcugcuacugu

SEQ ID NO: 2016988 - RNA, 19 nt, Homo sapiens
ugaaaauaauuuacuguga

SEQ ID NO: 2016989 - RNA, 12 nt, Homo sapiens
ggauuuauguau

SEQ ID NO: 2016990 - RNA, 16 nt, Homo sapiens
ucuaugucucaugaug

SEQ ID NO: 2016991 - RNA, 17 nt, Homo sapiens
guauaugucuuuuaccc

SEQ ID NO: 2016992 - RNA, 14 nt, Homo sapiens
gagaggaagcacac

SEQ ID NO: 2016993 - RNA, 20 nt, Homo sapiens
aggagaaacucccauguaug

SEQ ID NO: 2016994 - RNA, 19 nt, Homo sapiens
ccgcugacugcaccagcgc

SEQ ID NO: 2016995 - RNA, 19 nt, Homo sapiens
cucagaggguuguucuccu

SEQ ID NO: 2016996 - RNA, 17 nt, Homo sapiens
cugucugcacagagggu

SEQ ID NO: 2016997 - RNA, 16 nt, Homo sapiens
uaugcuaccuacugau

SEQ ID NO: 2016998 - RNA, 17 nt, Homo sapiens
cugagcaucacaauaaa

SEQ ID NO: 2016999 - RNA, 21 nt, Homo sapiens
aaaauuaagagauacauuccc

SEQ ID NO: 2017000 - RNA, 19 nt, Homo sapiens
agccugaagggugccuagu

SEQ ID NO: 2017001 - RNA, 17 nt, Homo sapiens
acucauagcacuucccc

SEQ ID NO: 2017002 - RNA, 16 nt, Homo sapiens
uacuagcauaugaguu

SEQ ID NO: 2017003 - RNA, 16 nt, Homo sapiens
cuugcuuucucucuca

SEQ ID NO: 2017004 - RNA, 15 nt, Homo sapiens
uccagugccuggauc

SEQ ID NO: 2017005 - RNA, 19 nt, Homo sapiens
gcuucagcagcacccaugu

SEQ ID NO: 2017006 - RNA, 22 nt, Homo sapiens
aauauauuguaaucacauuccu

SEQ ID NO: 2017007 - RNA, 17 nt, Homo sapiens
ugcccucccgcaccuuc

SEQ ID NO: 2017008 - RNA, 20 nt, Homo sapiens
agugaaaauuuuauugaaua

SEQ ID NO: 2017009 - RNA, 20 nt, Homo sapiens
ccacucagguucuucagggc

SEQ ID NO: 2017010 - RNA, 16 nt, Homo sapiens
cuggcagguggaacuu

SEQ ID NO: 2017011 - RNA, 17 nt, Homo sapiens
cuucuaccaacuggaag

SEQ ID NO: 2017012 - RNA, 22 nt, Homo sapiens
cuucaaagugugugugugcagg

SEQ ID NO: 2017013 - RNA, 15 nt, Homo sapiens
ugauauugcagcuua

SEQ ID NO: 2017014 - RNA, 15 nt, Homo sapiens
ccuucaaaagcacug

SEQ ID NO: 2017015 - RNA, 16 nt, Homo sapiens
cuauguuacauguaca

SEQ ID NO: 2017016 - RNA, 21 nt, Homo sapiens
gaagaagaaccaggcauggaa

SEQ ID NO: 2017017 - RNA, 20 nt, Homo sapiens
ugcuuagugucccuuaccug

SEQ ID NO: 2017018 - RNA, 21 nt, Homo sapiens
caaguaagaaagugaagcaaa

SEQ ID NO: 2017019 - RNA, 16 nt, Homo sapiens
ggaagaaccacugucu

SEQ ID NO: 2017020 - RNA, 19 nt, Homo sapiens
ucagggaccugcugcucag

SEQ ID NO: 2017021 - RNA, 12 nt, Homo sapiens
ggugacacucua

SEQ ID NO: 2017022 - RNA, 17 nt, Homo sapiens
guguauauuuauucaua

SEQ ID NO: 2017023 - RNA, 24 nt, Homo sapiens
ugccaagcuuuuuugccacaaaga

SEQ ID NO: 2017024 - RNA, 22 nt, Homo sapiens
ugagacuauaaagcaguagaca

SEQ ID NO: 2017025 - RNA, 13 nt, Homo sapiens
aauuacacacagc

SEQ ID NO: 2017026 - RNA, 13 nt, Homo sapiens
aaauguccaugau

SEQ ID NO: 2017027 - RNA, 22 nt, Homo sapiens
gacaacgggcccauggccuugg

SEQ ID NO: 2017028 - RNA, 16 nt, Homo sapiens
aguucuaagauucuaa

SEQ ID NO: 2017029 - RNA, 14 nt, Homo sapiens
cuugcauuaugcaa

SEQ ID NO: 2017030 - RNA, 14 nt, Homo sapiens
aaggacuucauccc

SEQ ID NO: 2017031 - RNA, 13 nt, Homo sapiens
caccaugaucacu

SEQ ID NO: 2017032 - RNA, 22 nt, Homo sapiens
auugauuguauuguugaaaaag

SEQ ID NO: 2017033 - RNA, 13 nt, Homo sapiens
ucugcagucucua

SEQ ID NO: 2017034 - RNA, 15 nt, Homo sapiens
guaaaaucugacaua

SEQ ID NO: 2017035 - RNA, 21 nt, Homo sapiens
uuggguaagggacuccagaag

SEQ ID NO: 2017036 - RNA, 22 nt, Homo sapiens
cucaagugauccuccugacuca

SEQ ID NO: 2017037 - RNA, 22 nt, Homo sapiens
aauucucagucaguaauugcca

SEQ ID NO: 2017038 - RNA, 13 nt, Homo sapiens
uggaugcuccuuc

SEQ ID NO: 2017039 - RNA, 22 nt, Homo sapiens
aucaguuacaguggcaguauug

SEQ ID NO: 2017040 - RNA, 21 nt, Homo sapiens
agauauguugaauuaacauaa

SEQ ID NO: 2017041 - RNA, 19 nt, Homo sapiens
ucaauaauuauuugucuca

SEQ ID NO: 2017042 - RNA, 18 nt, Homo sapiens
ucaaguuaugaaauacuu

SEQ ID NO: 2017043 - RNA, 18 nt, Homo sapiens
aauagccugcgcuguuuu

SEQ ID NO: 2017044 - RNA, 19 nt, Homo sapiens
aucucggcucacugcaaau

SEQ ID NO: 2017045 - RNA, 22 nt, Homo sapiens
uaaaaaacuucccaacucacuu

SEQ ID NO: 2017046 - RNA, 18 nt, Homo sapiens
auuuuaccuaguuugcac

SEQ ID NO: 2017047 - RNA, 17 nt, Homo sapiens
ucauuuuaacaucugag

SEQ ID NO: 2017048 - RNA, 18 nt, Homo sapiens
caggugguuuuugguuac

SEQ ID NO: 2017049 - RNA, 15 nt, Homo sapiens
gucauagcuaugaca

SEQ ID NO: 2017050 - RNA, 21 nt, Homo sapiens
caagacuccaucucaaaaaag

SEQ ID NO: 2017051 - RNA, 17 nt, Homo sapiens
uaaacgguuccugguga

SEQ ID NO: 2017052 - RNA, 22 nt, Homo sapiens
agaccaagacuuuugucugauc

SEQ ID NO: 2017053 - RNA, 17 nt, Homo sapiens
aaaacuggcccuguuuc

SEQ ID NO: 2017054 - RNA, 17 nt, Homo sapiens
uccaagaauguaucaau

SEQ ID NO: 2017055 - RNA, 20 nt, Homo sapiens
guaagccaguuggcuucuaa

SEQ ID NO: 2017056 - RNA, 20 nt, Homo sapiens
ggcaugagcuacuaugccca

SEQ ID NO: 2017057 - RNA, 22 nt, Homo sapiens
cugagggauuuucacagugugc

SEQ ID NO: 2017058 - RNA, 17 nt, Homo sapiens
cucaccugcuggccccu

SEQ ID NO: 2017059 - RNA, 18 nt, Homo sapiens
gaagcacacacacaaaaa

SEQ ID NO: 2017060 - RNA, 16 nt, Homo sapiens
acaagccuuggaccaa

SEQ ID NO: 2017061 - RNA, 15 nt, Homo sapiens
aaaccaucucuguga

SEQ ID NO: 2017062 - RNA, 14 nt, Homo sapiens
cuaaaaauaucaca

SEQ ID NO: 2017063 - RNA, 16 nt, Homo sapiens
auacauagcaugacau

SEQ ID NO: 2017064 - RNA, 13 nt, Homo sapiens
agcaaacaccagu

SEQ ID NO: 2017065 - RNA, 12 nt, Homo sapiens
agauguuuauuu

SEQ ID NO: 2017066 - RNA, 13 nt, Homo sapiens
auuguuuaaucuu

SEQ ID NO: 2017067 - RNA, 13 nt, Homo sapiens
gaggaacaguauu

SEQ ID NO: 2017068 - RNA, 20 nt, Homo sapiens
auguccuuuguguccauuga

SEQ ID NO: 2017069 - RNA, 16 nt, Homo sapiens
ugccugugccagguga

SEQ ID NO: 2017070 - RNA, 22 nt, Homo sapiens
accuguacacacacagacacac

SEQ ID NO: 2017071 - RNA, 13 nt, Homo sapiens
aaguacccuuuug

SEQ ID NO: 2017072 - RNA, 18 nt, Homo sapiens
cucuucaauaaaccacaa

SEQ ID NO: 2017073 - RNA, 16 nt, Homo sapiens
agaguguuugugagcu

SEQ ID NO: 2017074 - RNA, 21 nt, Homo sapiens
ccuuggcaguggacucagaaa

SEQ ID NO: 2017075 - RNA, 16 nt, Homo sapiens
ccucuccccuccagaa

SEQ ID NO: 2017076 - RNA, 19 nt, Homo sapiens
cuaugauauuuucugugcc

SEQ ID NO: 2017077 - RNA, 16 nt, Homo sapiens
gcucagagcugcugag

SEQ ID NO: 2017078 - RNA, 23 nt, Homo sapiens
ccugcugcaucuucccacagugg

SEQ ID NO: 2017079 - RNA, 21 nt, Homo sapiens
ugucaaagaaaacuuccaaaa

SEQ ID NO: 2017080 - RNA, 13 nt, Homo sapiens
uauguacuaagca

SEQ ID NO: 2017081 - RNA, 21 nt, Homo sapiens
guauauaaauuuucccaaaac

SEQ ID NO: 2017082 - RNA, 13 nt, Homo sapiens
uguagcaugaugu

SEQ ID NO: 2017083 - RNA, 21 nt, Homo sapiens
guaugugccaguacuuaccag

SEQ ID NO: 2017084 - RNA, 19 nt, Homo sapiens
uaagucccaguauaccuca

SEQ ID NO: 2017085 - RNA, 17 nt, Homo sapiens
cuaucgcaaaucacaaa

SEQ ID NO: 2017086 - RNA, 20 nt, Homo sapiens
cuccuguagccacuggcaua

SEQ ID NO: 2017087 - RNA, 23 nt, Homo sapiens
agcaaaggacuuaaaauuaccaa

SEQ ID NO: 2017088 - RNA, 14 nt, Homo sapiens
ggugacaaccauua

SEQ ID NO: 2017089 - RNA, 18 nt, Homo sapiens
acuugagccaguuaccuu

SEQ ID NO: 2017090 - RNA, 14 nt, Homo sapiens
gcucucacaugcac

SEQ ID NO: 2017091 - RNA, 15 nt, Homo sapiens
gcaggaggugccuga

SEQ ID NO: 2017092 - RNA, 15 nt, Homo sapiens
ucagauagaaugaca

SEQ ID NO: 2017093 - RNA, 23 nt, Homo sapiens
guccagcaaacucuugcaugugg

SEQ ID NO: 2017094 - RNA, 20 nt, Homo sapiens
ggaugguguuacugcaguug

SEQ ID NO: 2017095 - RNA, 21 nt, Homo sapiens
acugucaugugcgaacacagu

SEQ ID NO: 2017096 - RNA, 14 nt, Homo sapiens
uugucaccaaauac

SEQ ID NO: 2017097 - RNA, 15 nt, Homo sapiens
acaucgcacacuggg

SEQ ID NO: 2017098 - RNA, 14 nt, Homo sapiens
aagacaacucugaa

SEQ ID NO: 2017099 - RNA, 17 nt, Homo sapiens
uacaugggguuuucaau

SEQ ID NO: 2017100 - RNA, 15 nt, Homo sapiens
aaacaaugaaauauu

SEQ ID NO: 2017101 - RNA, 18 nt, Homo sapiens
guuggcugggaacucacc

SEQ ID NO: 2017102 - RNA, 21 nt, Homo sapiens
acauucuagcugagaagcaau

SEQ ID NO: 2017103 - RNA, 20 nt, Homo sapiens
gacauuauaaguacuugguc

SEQ ID NO: 2017104 - RNA, 20 nt, Homo sapiens
ccucuguauuaguuuuugau

SEQ ID NO: 2017105 - RNA, 19 nt, Homo sapiens
aagagugagacuccaccuc

SEQ ID NO: 2017106 - RNA, 14 nt, Homo sapiens
ggacccuccacuca

SEQ ID NO: 2017107 - RNA, 22 nt, Homo sapiens
ugaaggaagagaagacauuugc

SEQ ID NO: 2017108 - RNA, 13 nt, Homo sapiens
cucagcagcaucg

SEQ ID NO: 2017109 - RNA, 17 nt, Homo sapiens
caaaugcaccaugucaa

SEQ ID NO: 2017110 - RNA, 13 nt, Homo sapiens
ucucaccacuuca

SEQ ID NO: 2017111 - RNA, 13 nt, Homo sapiens
cuucuccaucucu

SEQ ID NO: 2017112 - RNA, 20 nt, Homo sapiens
auucagaaauucuccaggau

SEQ ID NO: 2017113 - RNA, 17 nt, Homo sapiens
acaacucgaaucacuca

SEQ ID NO: 2017114 - RNA, 21 nt, Homo sapiens
cagaggauaauuagcaucuca

SEQ ID NO: 2017115 - RNA, 13 nt, Homo sapiens
ugcuuacaaagac

SEQ ID NO: 2017116 - RNA, 19 nt, Homo sapiens
ccugauuuuacacacauua

SEQ ID NO: 2017117 - RNA, 15 nt, Homo sapiens
gaauaccucccucau

SEQ ID NO: 2017118 - RNA, 16 nt, Homo sapiens
uaaccgggacuacaga

SEQ ID NO: 2017119 - RNA, 21 nt, Homo sapiens
cagucacaugaccugaucacu

SEQ ID NO: 2017120 - RNA, 16 nt, Homo sapiens
uaauuaguaacaugug

SEQ ID NO: 2017121 - RNA, 15 nt, Homo sapiens
ucguggacugugcug

SEQ ID NO: 2017122 - RNA, 16 nt, Homo sapiens
ugggaggagugguggg

SEQ ID NO: 2017123 - RNA, 16 nt, Homo sapiens
gcucgcuacacuacuc

SEQ ID NO: 2017124 - RNA, 14 nt, Homo sapiens
guuccacugagcuc

SEQ ID NO: 2017125 - RNA, 21 nt, Homo sapiens
uucuguucugucucauaugau

SEQ ID NO: 2017126 - RNA, 12 nt, Homo sapiens
caguugccaaag

SEQ ID NO: 2017127 - RNA, 11 nt, Homo sapiens
gggcaucucaa

SEQ ID NO: 2017128 - RNA, 19 nt, Homo sapiens
agcauaccaguucuugcaa

SEQ ID NO: 2017129 - RNA, 22 nt, Homo sapiens
gccuuguuugaguuuuuccucc

SEQ ID NO: 2017130 - RNA, 18 nt, Homo sapiens
uucauauuuauacuuugc

SEQ ID NO: 2017131 - RNA, 15 nt, Homo sapiens
ugccugcugccauag

SEQ ID NO: 2017132 - RNA, 16 nt, Homo sapiens
accuccaccugugaga

SEQ ID NO: 2017133 - RNA, 17 nt, Homo sapiens
uaagcaaacuuauuugc

SEQ ID NO: 2017134 - RNA, 22 nt, Homo sapiens
uugcacacaaaaauaaagacua

SEQ ID NO: 2017135 - RNA, 15 nt, Homo sapiens
cugaaaggaugaucc

SEQ ID NO: 2017136 - RNA, 16 nt, Homo sapiens
ucuuaaccuauuuauu

SEQ ID NO: 2017137 - RNA, 15 nt, Homo sapiens
gcggccagggcggcc

SEQ ID NO: 2017138 - RNA, 20 nt, Homo sapiens
gacaggagaaacacuugaac

SEQ ID NO: 2017139 - RNA, 20 nt, Homo sapiens
acagaaguauuuuaauucac

SEQ ID NO: 2017140 - RNA, 20 nt, Homo sapiens
auuacaguuuggaaguguua

SEQ ID NO: 2017141 - RNA, 21 nt, Homo sapiens
cauugguggcaucacagaccc

SEQ ID NO: 2017142 - RNA, 13 nt, Homo sapiens
uugacuaucacau

SEQ ID NO: 2017143 - RNA, 16 nt, Homo sapiens
augauuucacagugug

SEQ ID NO: 2017144 - RNA, 15 nt, Homo sapiens
gcaagugugugcaug

SEQ ID NO: 2017145 - RNA, 11 nt, Homo sapiens
auuuccagggg

SEQ ID NO: 2017146 - RNA, 16 nt, Homo sapiens
acccugaguucaucca

SEQ ID NO: 2017147 - RNA, 21 nt, Homo sapiens
auaucugagcucuuugcacua

SEQ ID NO: 2017148 - RNA, 19 nt, Homo sapiens
aacuugacaguaaaucaca

SEQ ID NO: 2017149 - RNA, 19 nt, Homo sapiens
acccaccagggcucagcuc

SEQ ID NO: 2017150 - RNA, 17 nt, Homo sapiens
acucuucucucugcucu

SEQ ID NO: 2017151 - RNA, 18 nt, Homo sapiens
ccugggagaugcagcugg

SEQ ID NO: 2017152 - RNA, 16 nt, Homo sapiens
uggaguugacucggug

SEQ ID NO: 2017153 - RNA, 14 nt, Homo sapiens
guuaaucuccucag

SEQ ID NO: 2017154 - RNA, 18 nt, Homo sapiens
gcuaggguggucagagga

SEQ ID NO: 2017155 - RNA, 14 nt, Homo sapiens
uguguacuggucag

SEQ ID NO: 2017156 - RNA, 20 nt, Homo sapiens
cugcaucuccacuuggcauu

SEQ ID NO: 2017157 - RNA, 22 nt, Homo sapiens
uuaugagaaugacccugucaag

SEQ ID NO: 2017158 - RNA, 17 nt, Homo sapiens
agugacuucacagagac

SEQ ID NO: 2017159 - RNA, 13 nt, Homo sapiens
aagacacaugcag

SEQ ID NO: 2017160 - RNA, 13 nt, Homo sapiens
uggacacaaacag

SEQ ID NO: 2017161 - RNA, 15 nt, Homo sapiens
ccaccaccacuggcc

SEQ ID NO: 2017162 - RNA, 17 nt, Homo sapiens
cccacccccacugccag

SEQ ID NO: 2017163 - RNA, 12 nt, Homo sapiens
acccugugacuc

SEQ ID NO: 2017164 - RNA, 16 nt, Homo sapiens
uccaugggcuggcaug

SEQ ID NO: 2017165 - RNA, 17 nt, Homo sapiens
ucaagugagccaggaaa

SEQ ID NO: 2017166 - RNA, 12 nt, Homo sapiens
aauuuauuacaa

SEQ ID NO: 2017167 - RNA, 21 nt, Homo sapiens
agccucugacuuaagcugccu

SEQ ID NO: 2017168 - RNA, 21 nt, Homo sapiens
gcuucucagauuucugaggaa

SEQ ID NO: 2017169 - RNA, 14 nt, Homo sapiens
cuugcuuacaggaa

SEQ ID NO: 2017170 - RNA, 13 nt, Homo sapiens
cucauugaaaugu

SEQ ID NO: 2017171 - RNA, 11 nt, Homo sapiens
uuacuugauaa

SEQ ID NO: 2017172 - RNA, 20 nt, Homo sapiens
cucaauggauuugaugcugu

SEQ ID NO: 2017173 - RNA, 20 nt, Homo sapiens
aggcacugcccuuuucagga

SEQ ID NO: 2017174 - RNA, 14 nt, Homo sapiens
gcccauaaccagua

SEQ ID NO: 2017175 - RNA, 12 nt, Homo sapiens
aaaauacuacac

SEQ ID NO: 2017176 - RNA, 16 nt, Homo sapiens
ugggagagacacuccc

SEQ ID NO: 2017177 - RNA, 17 nt, Homo sapiens
cuguaugugagcuguaa

SEQ ID NO: 2017178 - RNA, 15 nt, Homo sapiens
uuccuacaaaaugga

SEQ ID NO: 2017179 - RNA, 20 nt, Homo sapiens
cuauauucuggugaguuaau

SEQ ID NO: 2017180 - RNA, 14 nt, Homo sapiens
caaagagaccagcc

SEQ ID NO: 2017181 - RNA, 19 nt, Homo sapiens
aaccauggcagacucacca

SEQ ID NO: 2017182 - RNA, 21 nt, Homo sapiens
gggguccccgcccucucucau

SEQ ID NO: 2017183 - RNA, 19 nt, Homo sapiens
uguaauauuucuucaaaua

SEQ ID NO: 2017184 - RNA, 22 nt, Homo sapiens
ucugacgcaaaaccacuuuccu

SEQ ID NO: 2017185 - RNA, 19 nt, Homo sapiens
gacucagcgcuccuccugu

SEQ ID NO: 2017186 - RNA, 19 nt, Homo sapiens
uaauacauacuaaugaagu

SEQ ID NO: 2017187 - RNA, 15 nt, Homo sapiens
aaccacaaaccaccc

SEQ ID NO: 2017188 - RNA, 16 nt, Homo sapiens
uagguuuuuaugggaa

SEQ ID NO: 2017189 - RNA, 15 nt, Homo sapiens
guuuuaaacuugccu

SEQ ID NO: 2017190 - RNA, 20 nt, Homo sapiens
caacuugggaacuagacucc

SEQ ID NO: 2017191 - RNA, 14 nt, Homo sapiens
aagggauggcaaga

SEQ ID NO: 2017192 - RNA, 14 nt, Homo sapiens
uaauauccauauag

SEQ ID NO: 2017193 - RNA, 21 nt, Homo sapiens
cccuguggcaggacacacaug

SEQ ID NO: 2017194 - RNA, 19 nt, Homo sapiens
cgucucuacaaaaauacaa

SEQ ID NO: 2017195 - RNA, 11 nt, Homo sapiens
cauacugguga

SEQ ID NO: 2017196 - RNA, 15 nt, Homo sapiens
agaagaaauagcaga

SEQ ID NO: 2017197 - RNA, 22 nt, Homo sapiens
ggccaaggugggauuuguaaag

SEQ ID NO: 2017198 - RNA, 21 nt, Homo sapiens
uaaguucuaugaagaguauua

SEQ ID NO: 2017199 - RNA, 14 nt, Homo sapiens
ugguggacaugcac

SEQ ID NO: 2017200 - RNA, 18 nt, Homo sapiens
guccuguuuuugucaugu

SEQ ID NO: 2017201 - RNA, 20 nt, Homo sapiens
ugccuucucuaaacauuuca

SEQ ID NO: 2017202 - RNA, 19 nt, Homo sapiens
uacauuuuaaacacauuag

SEQ ID NO: 2017203 - RNA, 11 nt, Homo sapiens
uucgcuugcuu

SEQ ID NO: 2017204 - RNA, 16 nt, Homo sapiens
cacugugucccaaaaa

SEQ ID NO: 2017205 - RNA, 23 nt, Homo sapiens
gccuccaccccccagaaccuguc

SEQ ID NO: 2017206 - RNA, 17 nt, Homo sapiens
guguuucugucucucca

SEQ ID NO: 2017207 - RNA, 18 nt, Homo sapiens
uuccaaagaaauggaaau

SEQ ID NO: 2017208 - RNA, 20 nt, Homo sapiens
ugaccaaaaucagcuuugua

SEQ ID NO: 2017209 - RNA, 11 nt, Homo sapiens
cccuugcccaa

SEQ ID NO: 2017210 - RNA, 15 nt, Homo sapiens
ugccuuugugguggg

SEQ ID NO: 2017211 - RNA, 16 nt, Homo sapiens
ugaguucgaggacuac

SEQ ID NO: 2017212 - RNA, 17 nt, Homo sapiens
aaugauaaaauagccaa

SEQ ID NO: 2017213 - RNA, 14 nt, Homo sapiens
cuucucuucuuuau

SEQ ID NO: 2017214 - RNA, 16 nt, Homo sapiens
agcacaugguuuaaau

SEQ ID NO: 2017215 - RNA, 11 nt, Homo sapiens
gauuucacaua

SEQ ID NO: 2017216 - RNA, 12 nt, Homo sapiens
aggcaguucucu

SEQ ID NO: 2017217 - RNA, 15 nt, Homo sapiens
cacaguaagucauuu

SEQ ID NO: 2017218 - RNA, 13 nt, Homo sapiens
gacuugcaaucca

SEQ ID NO: 2017219 - RNA, 20 nt, Homo sapiens
gacauuucauauaaauggaa

SEQ ID NO: 2017220 - RNA, 23 nt, Homo sapiens
guagucaccuaugucugugccuc

SEQ ID NO: 2017221 - RNA, 17 nt, Homo sapiens
ccugucugaacuguuaa

SEQ ID NO: 2017222 - RNA, 18 nt, Homo sapiens
aaagcaggggaguaugca

SEQ ID NO: 2017223 - RNA, 19 nt, Homo sapiens
cagcuaaaauaagcucagu

SEQ ID NO: 2017224 - RNA, 20 nt, Homo sapiens
cuucuggagggaagcaccau

SEQ ID NO: 2017225 - RNA, 17 nt, Homo sapiens
ugcugcccauguuucaa

SEQ ID NO: 2017226 - RNA, 16 nt, Homo sapiens
uauguacuguuauuga

SEQ ID NO: 2017227 - RNA, 21 nt, Homo sapiens
uuugggagaaaacuucucaca

SEQ ID NO: 2017228 - RNA, 18 nt, Homo sapiens
uguaaaagagucaucugg

SEQ ID NO: 2017229 - RNA, 13 nt, Homo sapiens
gaucaagccaguu

SEQ ID NO: 2017230 - RNA, 22 nt, Homo sapiens
cucagccuaggcccucaugaua

SEQ ID NO: 2017231 - RNA, 14 nt, Homo sapiens
aggcuucaguuacc

SEQ ID NO: 2017232 - RNA, 23 nt, Homo sapiens
gugcagagugagcugccagacac

SEQ ID NO: 2017233 - RNA, 19 nt, Homo sapiens
gauucucaccugccuucaa

SEQ ID NO: 2017234 - RNA, 13 nt, Homo sapiens
cauuuaaucugcu

SEQ ID NO: 2017235 - RNA, 14 nt, Homo sapiens
ggcucaaucucggc

SEQ ID NO: 2017236 - RNA, 16 nt, Homo sapiens
ugagcagucacacugu

SEQ ID NO: 2017237 - RNA, 16 nt, Homo sapiens
cugggcaucucugagc

SEQ ID NO: 2017238 - RNA, 21 nt, Homo sapiens
uaguacuuugugcucauaaau

SEQ ID NO: 2017239 - RNA, 22 nt, Homo sapiens
gguccuucuugaauucauguac

SEQ ID NO: 2017240 - RNA, 22 nt, Homo sapiens
gcaaaaaaucuuccaaagacaa

SEQ ID NO: 2017241 - RNA, 14 nt, Homo sapiens
uaaauguugcccua

SEQ ID NO: 2017242 - RNA, 19 nt, Homo sapiens
uuucaaauaggaugcauuc

SEQ ID NO: 2017243 - RNA, 20 nt, Homo sapiens
gccgcuucagaugacagaug

SEQ ID NO: 2017244 - RNA, 15 nt, Homo sapiens
gaaucagguuuccaa

SEQ ID NO: 2017245 - RNA, 16 nt, Homo sapiens
gagcaucgaagcucug

SEQ ID NO: 2017246 - RNA, 14 nt, Homo sapiens
cucucuuuacauuu

SEQ ID NO: 2017247 - RNA, 14 nt, Homo sapiens
acugaaggggcaca

SEQ ID NO: 2017248 - RNA, 13 nt, Homo sapiens
agaguagugcuug

SEQ ID NO: 2017249 - RNA, 15 nt, Homo sapiens
uuuaucuuaaccuca

SEQ ID NO: 2017250 - RNA, 20 nt, Homo sapiens
ugcccaccugugaucccagc

SEQ ID NO: 2017251 - RNA, 19 nt, Homo sapiens
cauuugguguggauuuucu

SEQ ID NO: 2017252 - RNA, 13 nt, Homo sapiens
ccucucucaggcc

SEQ ID NO: 2017253 - RNA, 21 nt, Homo sapiens
gucaccaguuaaaagcauuuu

SEQ ID NO: 2017254 - RNA, 15 nt, Homo sapiens
augucagugcugaug

SEQ ID NO: 2017255 - RNA, 15 nt, Homo sapiens
acaguuuuaagcaga

SEQ ID NO: 2017256 - RNA, 13 nt, Homo sapiens
cauaguccaaaaa

SEQ ID NO: 2017257 - RNA, 12 nt, Homo sapiens
uuucaagagauc

SEQ ID NO: 2017258 - RNA, 21 nt, Homo sapiens
ucucuuaccgcgagacugaga

SEQ ID NO: 2017259 - RNA, 16 nt, Homo sapiens
accugcgcaaagggcg

SEQ ID NO: 2017260 - RNA, 20 nt, Homo sapiens
aagcaagacuguugcucaaa

SEQ ID NO: 2017261 - RNA, 22 nt, Homo sapiens
uacugggacaccauuaccaaaa

SEQ ID NO: 2017262 - RNA, 21 nt, Homo sapiens
gugaggacaaaucuguuguuu

SEQ ID NO: 2017263 - RNA, 18 nt, Homo sapiens
agcugggacuacaggugu

SEQ ID NO: 2017264 - RNA, 19 nt, Homo sapiens
uugcucauaacagguauca

SEQ ID NO: 2017265 - RNA, 14 nt, Homo sapiens
ugaaaaaggaucau

SEQ ID NO: 2017266 - RNA, 19 nt, Homo sapiens
cugccuuugcuuaagccau

SEQ ID NO: 2017267 - RNA, 16 nt, Homo sapiens
ugaucuugauauuccu

SEQ ID NO: 2017268 - RNA, 23 nt, Homo sapiens
uccugaaaucauauagaaaggcu

SEQ ID NO: 2017269 - RNA, 20 nt, Homo sapiens
cauugcugacuguguauaua

SEQ ID NO: 2017270 - RNA, 17 nt, Homo sapiens
gaaaggaagaccucaag

SEQ ID NO: 2017271 - RNA, 19 nt, Homo sapiens
aaccauauauauacauaua

SEQ ID NO: 2017272 - RNA, 21 nt, Homo sapiens
auguuaaagaugcacagaaua

SEQ ID NO: 2017273 - RNA, 15 nt, Homo sapiens
caauuuuguugcauc

SEQ ID NO: 2017274 - RNA, 20 nt, Homo sapiens
uauugcagaagcaguuauug

SEQ ID NO: 2017275 - RNA, 14 nt, Homo sapiens
uacauucuugcuaa

SEQ ID NO: 2017276 - RNA, 18 nt, Homo sapiens
uaccuaccguagcuuuuu

SEQ ID NO: 2017277 - RNA, 17 nt, Homo sapiens
agggcagagcacauggc

SEQ ID NO: 2017278 - RNA, 14 nt, Homo sapiens
aaacuggacaaugu

SEQ ID NO: 2017279 - RNA, 14 nt, Homo sapiens
aguuuuaucuucag

SEQ ID NO: 2017280 - RNA, 14 nt, Homo sapiens
gaagcuuccaugau

SEQ ID NO: 2017281 - RNA, 16 nt, Homo sapiens
aggacuuccauuugcu

SEQ ID NO: 2017282 - RNA, 17 nt, Homo sapiens
acaacuuaguguaauau

SEQ ID NO: 2017283 - RNA, 11 nt, Homo sapiens
uucucuuucac

SEQ ID NO: 2017284 - RNA, 22 nt, Homo sapiens
uucaucaaguagcguuggagac

SEQ ID NO: 2017285 - RNA, 19 nt, Homo sapiens
agggagggguuauagcuuc

SEQ ID NO: 2017286 - RNA, 22 nt, Homo sapiens
agccaaggauagaagcugcagu

SEQ ID NO: 2017287 - RNA, 18 nt, Homo sapiens
agagucuuaaagcauuuc

SEQ ID NO: 2017288 - RNA, 16 nt, Homo sapiens
cagagagcagugugga

SEQ ID NO: 2017289 - RNA, 13 nt, Homo sapiens
uuuuuaauuggcc

SEQ ID NO: 2017290 - RNA, 12 nt, Homo sapiens
cuacugcugguu

SEQ ID NO: 2017291 - RNA, 20 nt, Homo sapiens
cgugaucaucaccacugaca

SEQ ID NO: 2017292 - RNA, 22 nt, Homo sapiens
ugaaacuugggcacaugcucag

SEQ ID NO: 2017293 - RNA, 21 nt, Homo sapiens
ggcccucccugucuccagggc

SEQ ID NO: 2017294 - RNA, 18 nt, Homo sapiens
ggcauguuucaccacaac

SEQ ID NO: 2017295 - RNA, 16 nt, Homo sapiens
ccauugcccugugagg

SEQ ID NO: 2017296 - RNA, 22 nt, Homo sapiens
ccacuagacguuguaaugcaca

SEQ ID NO: 2017297 - RNA, 22 nt, Homo sapiens
gcaugagggccacauuccaugg

SEQ ID NO: 2017298 - RNA, 19 nt, Homo sapiens
ugaaugugagguguugcua

SEQ ID NO: 2017299 - RNA, 22 nt, Homo sapiens
cccagucagaguugugcacaug

SEQ ID NO: 2017300 - RNA, 24 nt, Homo sapiens
aaacaugcuaaauaguucuaucag

SEQ ID NO: 2017301 - RNA, 18 nt, Homo sapiens
auuuuugcacauucuaca

SEQ ID NO: 2017302 - RNA, 23 nt, Homo sapiens
acgaagucuguuuuaaugacaag

SEQ ID NO: 2017303 - RNA, 22 nt, Homo sapiens
uccaugauuuuaaauugugauc

SEQ ID NO: 2017304 - RNA, 17 nt, Homo sapiens
gccuauuucucuuugca

SEQ ID NO: 2017305 - RNA, 17 nt, Homo sapiens
uggcaucugcucuagau

SEQ ID NO: 2017306 - RNA, 21 nt, Homo sapiens
ugcuuaggcacucauggguaa

SEQ ID NO: 2017307 - RNA, 22 nt, Homo sapiens
aggguaagggaauuuaauacuu

SEQ ID NO: 2017308 - RNA, 21 nt, Homo sapiens
cuugucgggguggggguggga

SEQ ID NO: 2017309 - RNA, 18 nt, Homo sapiens
gccccgggaugcaccggu

SEQ ID NO: 2017310 - RNA, 20 nt, Homo sapiens
gccauaaaacauuaagaaaa

SEQ ID NO: 2017311 - RNA, 19 nt, Homo sapiens
uucaagagucuaaacccca

SEQ ID NO: 2017312 - RNA, 14 nt, Homo sapiens
uccaccugaggaac

SEQ ID NO: 2017313 - RNA, 16 nt, Homo sapiens
auuagguuucagcaga

SEQ ID NO: 2017314 - RNA, 16 nt, Homo sapiens
ggcugcgcacuguguc

SEQ ID NO: 2017315 - RNA, 12 nt, Homo sapiens
aaccauuugcac

SEQ ID NO: 2017316 - RNA, 19 nt, Homo sapiens
cuauaccuggggacuugau

SEQ ID NO: 2017317 - RNA, 17 nt, Homo sapiens
acacaggcuccaaacug

SEQ ID NO: 2017318 - RNA, 14 nt, Homo sapiens
cuaaggaaugcaca

SEQ ID NO: 2017319 - RNA, 14 nt, Homo sapiens
gugcaacagacaaa

SEQ ID NO: 2017320 - RNA, 18 nt, Homo sapiens
cauauuguauguaaguaa

SEQ ID NO: 2017321 - RNA, 13 nt, Homo sapiens
ccggacugaccaa

SEQ ID NO: 2017322 - RNA, 21 nt, Homo sapiens
cccuguucuuugaaguggcac

SEQ ID NO: 2017323 - RNA, 15 nt, Homo sapiens
auucagaccagggaa

SEQ ID NO: 2017324 - RNA, 15 nt, Homo sapiens
auguggauacaguca

SEQ ID NO: 2017325 - RNA, 23 nt, Homo sapiens
auucuacuucugucuuccuucau

SEQ ID NO: 2017326 - RNA, 23 nt, Homo sapiens
aucugugguuuauaaucuugcac

SEQ ID NO: 2017327 - RNA, 12 nt, Homo sapiens
gaggcucagaga

SEQ ID NO: 2017328 - RNA, 22 nt, Homo sapiens
cauuaauguugauuucuaguua

SEQ ID NO: 2017329 - RNA, 15 nt, Homo sapiens
uguucccuugaccau

SEQ ID NO: 2017330 - RNA, 20 nt, Homo sapiens
gccccacugacacccagugu

SEQ ID NO: 2017331 - RNA, 18 nt, Homo sapiens
uuugcaaauaacuuacaa

SEQ ID NO: 2017332 - RNA, 17 nt, Homo sapiens
uguucacaggcugcuaa

SEQ ID NO: 2017333 - RNA, 16 nt, Homo sapiens
caccuagagcuccagu

SEQ ID NO: 2017334 - RNA, 13 nt, Homo sapiens
gaauacuauguau

SEQ ID NO: 2017335 - RNA, 17 nt, Homo sapiens
guacaaaguaagccaug

SEQ ID NO: 2017336 - RNA, 19 nt, Homo sapiens
guucguggggaacugcgug

SEQ ID NO: 2017337 - RNA, 19 nt, Homo sapiens
uaauauuacucuaugauga

SEQ ID NO: 2017338 - RNA, 18 nt, Homo sapiens
gcugucaggacaccagcc

SEQ ID NO: 2017339 - RNA, 21 nt, Homo sapiens
uggaauaaacagugagcauau

SEQ ID NO: 2017340 - RNA, 22 nt, Homo sapiens
uuucuguucauagauauuggaa

SEQ ID NO: 2017341 - RNA, 17 nt, Homo sapiens
caagacuugauacugca

SEQ ID NO: 2017342 - RNA, 15 nt, Homo sapiens
gaaauacaccuggac

SEQ ID NO: 2017343 - RNA, 14 nt, Homo sapiens
guagcuccacaaga

SEQ ID NO: 2017344 - RNA, 14 nt, Homo sapiens
gcucacaccuguaa

SEQ ID NO: 2017345 - RNA, 15 nt, Homo sapiens
guaauaacugugaag

SEQ ID NO: 2017346 - RNA, 13 nt, Homo sapiens
acuuccuuugaga

SEQ ID NO: 2017347 - RNA, 15 nt, Homo sapiens
uuccucccaacaagc

SEQ ID NO: 2017348 - RNA, 13 nt, Homo sapiens
gaauuuacucagg

SEQ ID NO: 2017349 - RNA, 24 nt, Homo sapiens
uaauuuuagaugccugugaaauag

SEQ ID NO: 2017350 - RNA, 13 nt, Homo sapiens
auuaaacagccaa

SEQ ID NO: 2017351 - RNA, 13 nt, Homo sapiens
guuauacaaccau

SEQ ID NO: 2017352 - RNA, 13 nt, Homo sapiens
agagggccuuugc

SEQ ID NO: 2017353 - RNA, 17 nt, Homo sapiens
gggcguugggagccuag

SEQ ID NO: 2017354 - RNA, 20 nt, Homo sapiens
agacagagcagaucagucuu

SEQ ID NO: 2017355 - RNA, 17 nt, Homo sapiens
ccucacgcucuccauca

SEQ ID NO: 2017356 - RNA, 15 nt, Homo sapiens
gcuucucuugccuaa

SEQ ID NO: 2017357 - RNA, 13 nt, Homo sapiens
aauccuugcuauu

SEQ ID NO: 2017358 - RNA, 19 nt, Homo sapiens
guaugaugucacacaagcu

SEQ ID NO: 2017359 - RNA, 20 nt, Homo sapiens
gacuaagccaagcuguguuc

SEQ ID NO: 2017360 - RNA, 19 nt, Homo sapiens
uugucacgucuucugagaa

SEQ ID NO: 2017361 - RNA, 17 nt, Homo sapiens
cccauuauuauuucugu

SEQ ID NO: 2017362 - RNA, 13 nt, Homo sapiens
ucccgaagccacc

SEQ ID NO: 2017363 - RNA, 14 nt, Homo sapiens
aacccacuuugucu

SEQ ID NO: 2017364 - RNA, 15 nt, Homo sapiens
aggaagggacugguc

SEQ ID NO: 2017365 - RNA, 15 nt, Homo sapiens
gccauccaugugcua

SEQ ID NO: 2017366 - RNA, 18 nt, Homo sapiens
gugccuuggugugcugua

SEQ ID NO: 2017367 - RNA, 22 nt, Homo sapiens
ucccaauuucagacucccauuc

SEQ ID NO: 2017368 - RNA, 18 nt, Homo sapiens
ccagaccauugucuucca

SEQ ID NO: 2017369 - RNA, 14 nt, Homo sapiens
guccuugugcauga

SEQ ID NO: 2017370 - RNA, 14 nt, Homo sapiens
aauuaaaugcaugu

SEQ ID NO: 2017371 - RNA, 21 nt, Homo sapiens
cucuacuugaauacucucaca

SEQ ID NO: 2017372 - RNA, 14 nt, Homo sapiens
aacuccauuugaac

SEQ ID NO: 2017373 - RNA, 21 nt, Homo sapiens
guggacuacacagcuccugag

SEQ ID NO: 2017374 - RNA, 16 nt, Homo sapiens
caaugaugguuuaaua

SEQ ID NO: 2017375 - RNA, 15 nt, Homo sapiens
caacgagcagugccg

SEQ ID NO: 2017376 - RNA, 20 nt, Homo sapiens
uuagauaauaacugucuucu

SEQ ID NO: 2017377 - RNA, 14 nt, Homo sapiens
uccuccuuugccua

SEQ ID NO: 2017378 - RNA, 15 nt, Homo sapiens
uaaacuuuauuccaa

SEQ ID NO: 2017379 - RNA, 22 nt, Homo sapiens
cugcuguguggacuucaucuca

SEQ ID NO: 2017380 - RNA, 13 nt, Homo sapiens
gucccaggggccu

SEQ ID NO: 2017381 - RNA, 17 nt, Homo sapiens
uccagagauuugcuuua

SEQ ID NO: 2017382 - RNA, 21 nt, Homo sapiens
gguaauggaggccaagccugc

SEQ ID NO: 2017383 - RNA, 17 nt, Homo sapiens
agcaacuguuaugaaau

SEQ ID NO: 2017384 - RNA, 15 nt, Homo sapiens
agcuagugagcaaaa

SEQ ID NO: 2017385 - RNA, 19 nt, Homo sapiens
ucagccuccgccauuccaa

SEQ ID NO: 2017386 - RNA, 21 nt, Homo sapiens
uaucuccuuuaaugacauuga

SEQ ID NO: 2017387 - RNA, 23 nt, Homo sapiens
gagcagcugaacuuacuugccuc

SEQ ID NO: 2017388 - RNA, 20 nt, Homo sapiens
caugaaagcaucugagcuaa

SEQ ID NO: 2017389 - RNA, 24 nt, Homo sapiens
uuggcuucugugaugagcugaucu

SEQ ID NO: 2017390 - RNA, 16 nt, Homo sapiens
ucugccuaugcacuga

SEQ ID NO: 2017391 - RNA, 22 nt, Homo sapiens
gggcuuaccaggugagaaguga

SEQ ID NO: 2017392 - RNA, 13 nt, Homo sapiens
ugcucccacacuu

SEQ ID NO: 2017393 - RNA, 15 nt, Homo sapiens
cuucccuguucuccc

SEQ ID NO: 2017394 - RNA, 22 nt, Homo sapiens
ccagccagaggguagggcacaa

SEQ ID NO: 2017395 - RNA, 18 nt, Homo sapiens
aauaguauccagcacaga

SEQ ID NO: 2017396 - RNA, 20 nt, Homo sapiens
cuccuuuuuugcaugugcaa

SEQ ID NO: 2017397 - RNA, 17 nt, Homo sapiens
caauaaagcaauguggu

SEQ ID NO: 2017398 - RNA, 19 nt, Homo sapiens
gauggagaggcggguccca

SEQ ID NO: 2017399 - RNA, 20 nt, Homo sapiens
gcguggacucugcacauguc

SEQ ID NO: 2017400 - RNA, 20 nt, Homo sapiens
aggaagacuugaagcacaga

SEQ ID NO: 2017401 - RNA, 13 nt, Homo sapiens
uagaaacaauaaa

SEQ ID NO: 2017402 - RNA, 13 nt, Homo sapiens
uuaaaacaaagaa

SEQ ID NO: 2017403 - RNA, 13 nt, Homo sapiens
auccuuccccaac

SEQ ID NO: 2017404 - RNA, 17 nt, Homo sapiens
cuuuauuaaugaacugu

SEQ ID NO: 2017405 - RNA, 21 nt, Homo sapiens
agacaggguuucgcaauguug

SEQ ID NO: 2017406 - RNA, 16 nt, Homo sapiens
acuucacuaccaaaug

SEQ ID NO: 2017407 - RNA, 18 nt, Homo sapiens
gauuuauucuggugucua

SEQ ID NO: 2017408 - RNA, 19 nt, Homo sapiens
ccuuucuugcagauucuau

SEQ ID NO: 2017409 - RNA, 22 nt, Homo sapiens
uaaacacaaauagaacauucca

SEQ ID NO: 2017410 - RNA, 20 nt, Homo sapiens
cgacacugucacuugaccaa

SEQ ID NO: 2017411 - RNA, 12 nt, Homo sapiens
auugacuuuguc

SEQ ID NO: 2017412 - RNA, 17 nt, Homo sapiens
ccuaaaauaaacaugaa

SEQ ID NO: 2017413 - RNA, 19 nt, Homo sapiens
cacccugcaggacuugcca

SEQ ID NO: 2017414 - RNA, 13 nt, Homo sapiens
ccagcaggagcca

SEQ ID NO: 2017415 - RNA, 12 nt, Homo sapiens
auuuaguugaua

SEQ ID NO: 2017416 - RNA, 12 nt, Homo sapiens
uaauaaaacuga

SEQ ID NO: 2017417 - RNA, 15 nt, Homo sapiens
cuauguggcuguauc

SEQ ID NO: 2017418 - RNA, 13 nt, Homo sapiens
ccuaccucagguu

SEQ ID NO: 2017419 - RNA, 11 nt, Homo sapiens
guacaauaaua

SEQ ID NO: 2017420 - RNA, 16 nt, Homo sapiens
gagggcagucgauaga

SEQ ID NO: 2017421 - RNA, 17 nt, Homo sapiens
gagggggcgcgugcagg

SEQ ID NO: 2017422 - RNA, 14 nt, Homo sapiens
acagucauguguca

SEQ ID NO: 2017423 - RNA, 16 nt, Homo sapiens
gaagucuagaguuccu

SEQ ID NO: 2017424 - RNA, 21 nt, Homo sapiens
ggucccgaauggaguccagac

SEQ ID NO: 2017425 - RNA, 19 nt, Homo sapiens
uucccaucuguuucugugu

SEQ ID NO: 2017426 - RNA, 19 nt, Homo sapiens
acagaaaguggugcucagu

SEQ ID NO: 2017427 - RNA, 14 nt, Homo sapiens
ggcugccuccuuug

SEQ ID NO: 2017428 - RNA, 19 nt, Homo sapiens
uacugucuucuucauguca

SEQ ID NO: 2017429 - RNA, 21 nt, Homo sapiens
ggucugagucuauguucaaag

SEQ ID NO: 2017430 - RNA, 12 nt, Homo sapiens
aaauauuugaca

SEQ ID NO: 2017431 - RNA, 16 nt, Homo sapiens
cccacucccuguccau

SEQ ID NO: 2017432 - RNA, 14 nt, Homo sapiens
gccagucagacgcc

SEQ ID NO: 2017433 - RNA, 15 nt, Homo sapiens
ccuucuccagacaaa

SEQ ID NO: 2017434 - RNA, 14 nt, Homo sapiens
acauuuuaaaugaa

SEQ ID NO: 2017435 - RNA, 15 nt, Homo sapiens
guucgggcuuuucac

SEQ ID NO: 2017436 - RNA, 21 nt, Homo sapiens
ggacagaccuucaacuuccaa

SEQ ID NO: 2017437 - RNA, 18 nt, Homo sapiens
aagauaguugaaaagccu

SEQ ID NO: 2017438 - RNA, 14 nt, Homo sapiens
gucucucucguauu

SEQ ID NO: 2017439 - RNA, 20 nt, Homo sapiens
uuucacaccuuguggagaac

SEQ ID NO: 2017440 - RNA, 13 nt, Homo sapiens
cuugagauuuccc

SEQ ID NO: 2017441 - RNA, 21 nt, Homo sapiens
uauagaaaucuagaauuuuua

SEQ ID NO: 2017442 - RNA, 16 nt, Homo sapiens
uccccucagauuccac

SEQ ID NO: 2017443 - RNA, 17 nt, Homo sapiens
ccccacaggagcauguc

SEQ ID NO: 2017444 - RNA, 20 nt, Homo sapiens
uacauaaaguaugugcauau

SEQ ID NO: 2017445 - RNA, 20 nt, Homo sapiens
uuguuugcaucugaaagaga

SEQ ID NO: 2017446 - RNA, 17 nt, Homo sapiens
aagauaucagagcucuu

SEQ ID NO: 2017447 - RNA, 19 nt, Homo sapiens
uguuaauuuacuuucugca

SEQ ID NO: 2017448 - RNA, 18 nt, Homo sapiens
uccagagacaacagguaa

SEQ ID NO: 2017449 - RNA, 16 nt, Homo sapiens
aauuauuucacuuuag

SEQ ID NO: 2017450 - RNA, 14 nt, Homo sapiens
cagaaagccucaga

SEQ ID NO: 2017451 - RNA, 15 nt, Homo sapiens
gugcuuuuggcagag

SEQ ID NO: 2017452 - RNA, 23 nt, Homo sapiens
auucccaaaccuaaugaucaucu

SEQ ID NO: 2017453 - RNA, 13 nt, Homo sapiens
cacguuuguauca

SEQ ID NO: 2017454 - RNA, 16 nt, Homo sapiens
auccaggccugggaau

SEQ ID NO: 2017455 - RNA, 14 nt, Homo sapiens
ccgugggcaucuca

SEQ ID NO: 2017456 - RNA, 20 nt, Homo sapiens
cugccuggauuucuuccuau

SEQ ID NO: 2017457 - RNA, 15 nt, Homo sapiens
uaccugccagauaac

SEQ ID NO: 2017458 - RNA, 20 nt, Homo sapiens
gaggcagagguugcaaugag

SEQ ID NO: 2017459 - RNA, 19 nt, Homo sapiens
guggucagagggacuguca

SEQ ID NO: 2017460 - RNA, 15 nt, Homo sapiens
gcaaaugacaugcac

SEQ ID NO: 2017461 - RNA, 21 nt, Homo sapiens
gaaaaacaacaaauaauuuaa

SEQ ID NO: 2017462 - RNA, 18 nt, Homo sapiens
guuucauuugcuugcccc

SEQ ID NO: 2017463 - RNA, 20 nt, Homo sapiens
auuguuuuuguugucuuuau

SEQ ID NO: 2017464 - RNA, 14 nt, Homo sapiens
aaccuuggcauaag

SEQ ID NO: 2017465 - RNA, 20 nt, Homo sapiens
caggugccccucucuccauc

SEQ ID NO: 2017466 - RNA, 22 nt, Homo sapiens
uuucuugcuggauuauugcuua

SEQ ID NO: 2017467 - RNA, 15 nt, Homo sapiens
cggggugcuguggug

SEQ ID NO: 2017468 - RNA, 19 nt, Homo sapiens
gcagugccaggaacccuua

SEQ ID NO: 2017469 - RNA, 18 nt, Homo sapiens
ucugaaugugcugaucau

SEQ ID NO: 2017470 - RNA, 21 nt, Homo sapiens
aaaaauaaacggaaguuacau

SEQ ID NO: 2017471 - RNA, 20 nt, Homo sapiens
agaaaaccgagaauauucaa

SEQ ID NO: 2017472 - RNA, 14 nt, Homo sapiens
gagcauuugcaccu

SEQ ID NO: 2017473 - RNA, 18 nt, Homo sapiens
auaaaagauguacuugug

SEQ ID NO: 2017474 - RNA, 15 nt, Homo sapiens
aacugacaaccugug

SEQ ID NO: 2017475 - RNA, 15 nt, Homo sapiens
gcgggacagagggug

SEQ ID NO: 2017476 - RNA, 18 nt, Homo sapiens
auuuuaauuccacuuuaa

SEQ ID NO: 2017477 - RNA, 21 nt, Homo sapiens
ugggauggggcauguggccaa

SEQ ID NO: 2017478 - RNA, 13 nt, Homo sapiens
ugcaagugcaaaa

SEQ ID NO: 2017479 - RNA, 23 nt, Homo sapiens
auauguccacuguucuguucuca

SEQ ID NO: 2017480 - RNA, 20 nt, Homo sapiens
gguguguucguggagccaca

SEQ ID NO: 2017481 - RNA, 15 nt, Homo sapiens
cugcuuguauuccaa

SEQ ID NO: 2017482 - RNA, 22 nt, Homo sapiens
cuacagagcagcuccccaggag

SEQ ID NO: 2017483 - RNA, 23 nt, Homo sapiens
uauaguauucauuuuccuaccua

SEQ ID NO: 2017484 - RNA, 13 nt, Homo sapiens
agggacugacacg

SEQ ID NO: 2017485 - RNA, 19 nt, Homo sapiens
agccaggcacacacugugc

SEQ ID NO: 2017486 - RNA, 17 nt, Homo sapiens
gguugaagggcaguguu

SEQ ID NO: 2017487 - RNA, 23 nt, Homo sapiens
uuauguuaaaucaauaaagacca

SEQ ID NO: 2017488 - RNA, 23 nt, Homo sapiens
uacaaugugaaaagagugaauag

SEQ ID NO: 2017489 - RNA, 20 nt, Homo sapiens
aggcuggguugucacugaga

SEQ ID NO: 2017490 - RNA, 20 nt, Homo sapiens
ccgugugagugugacagggc

SEQ ID NO: 2017491 - RNA, 20 nt, Homo sapiens
agcccucccuggcugugagc

SEQ ID NO: 2017492 - RNA, 15 nt, Homo sapiens
cacuguguuacugcu

SEQ ID NO: 2017493 - RNA, 19 nt, Homo sapiens
aauuguauuacaaauccaa

SEQ ID NO: 2017494 - RNA, 20 nt, Homo sapiens
aguccagccuggagaugaaa

SEQ ID NO: 2017495 - RNA, 18 nt, Homo sapiens
ugaaccuaaacauagaaa

SEQ ID NO: 2017496 - RNA, 17 nt, Homo sapiens
augcaaacaaaauccaa

SEQ ID NO: 2017497 - RNA, 18 nt, Homo sapiens
ccugggggcagugacugg

SEQ ID NO: 2017498 - RNA, 20 nt, Homo sapiens
uaggauaauguccaacuaaa

SEQ ID NO: 2017499 - RNA, 21 nt, Homo sapiens
uuccaaagguuucaacuguaa

SEQ ID NO: 2017500 - RNA, 19 nt, Homo sapiens
aggugggaggaucauuuga

SEQ ID NO: 2017501 - RNA, 15 nt, Homo sapiens
ucuuguuuaccaaag

SEQ ID NO: 2017502 - RNA, 13 nt, Homo sapiens
uggccuugcagcu

SEQ ID NO: 2017503 - RNA, 22 nt, Homo sapiens
cugauggccaggccucagggac

SEQ ID NO: 2017504 - RNA, 23 nt, Homo sapiens
uacaucagacucuagaaaaaagg

SEQ ID NO: 2017505 - RNA, 18 nt, Homo sapiens
gagccauguuaauguaau

SEQ ID NO: 2017506 - RNA, 22 nt, Homo sapiens
caugucuuuccuauuugcacac

SEQ ID NO: 2017507 - RNA, 18 nt, Homo sapiens
aggcucuguaaccuuauc

SEQ ID NO: 2017508 - RNA, 12 nt, Homo sapiens
uuauugugaauu

SEQ ID NO: 2017509 - RNA, 12 nt, Homo sapiens
uauaugugauaa

SEQ ID NO: 2017510 - RNA, 19 nt, Homo sapiens
caacaagucauuccaugaa

SEQ ID NO: 2017511 - RNA, 13 nt, Homo sapiens
aucaaaaugcucu

SEQ ID NO: 2017512 - RNA, 23 nt, Homo sapiens
cauagaaaauuaaacacaaagug

SEQ ID NO: 2017513 - RNA, 18 nt, Homo sapiens
ccuaaaaagauugccaau

SEQ ID NO: 2017514 - RNA, 21 nt, Homo sapiens
uaccccaggagacucugggaa

SEQ ID NO: 2017515 - RNA, 22 nt, Homo sapiens
cacuguuuaacugggagugaua

SEQ ID NO: 2017516 - RNA, 21 nt, Homo sapiens
uucccaaagauccacccaaau

SEQ ID NO: 2017517 - RNA, 21 nt, Homo sapiens
cucuucauucccacugcacuu

SEQ ID NO: 2017518 - RNA, 13 nt, Homo sapiens
guuccaguggcuu

SEQ ID NO: 2017519 - RNA, 13 nt, Homo sapiens
gcuuuccaaaacc

SEQ ID NO: 2017520 - RNA, 14 nt, Homo sapiens
uuacuuugaauuua

SEQ ID NO: 2017521 - RNA, 20 nt, Homo sapiens
ccucccaguuugcuggguuu

SEQ ID NO: 2017522 - RNA, 16 nt, Homo sapiens
uuagcauaagccagaa

SEQ ID NO: 2017523 - RNA, 17 nt, Homo sapiens
cauucaucauguucaca

SEQ ID NO: 2017524 - RNA, 22 nt, Homo sapiens
aggugagcgcuuugcagucaca

SEQ ID NO: 2017525 - RNA, 17 nt, Homo sapiens
gcccugggcuggcacag

SEQ ID NO: 2017526 - RNA, 14 nt, Homo sapiens
ucacucuggcauau

SEQ ID NO: 2017527 - RNA, 18 nt, Homo sapiens
gauuugugcucacuuuug

SEQ ID NO: 2017528 - RNA, 22 nt, Homo sapiens
ucccacuuaucaaaucauucaa

SEQ ID NO: 2017529 - RNA, 14 nt, Homo sapiens
gaagaacugcaaaa

SEQ ID NO: 2017530 - RNA, 13 nt, Homo sapiens
aggaugcaugcag

SEQ ID NO: 2017531 - RNA, 23 nt, Homo sapiens
uauauuguuuucaggugcucaaa

SEQ ID NO: 2017532 - RNA, 15 nt, Homo sapiens
aagacuacagcacac

SEQ ID NO: 2017533 - RNA, 23 nt, Homo sapiens
cugaggccaggggagacaucgca

SEQ ID NO: 2017534 - RNA, 12 nt, Homo sapiens
aaaugacaugga

SEQ ID NO: 2017535 - RNA, 16 nt, Homo sapiens
uguucagaaauaugaa

SEQ ID NO: 2017536 - RNA, 19 nt, Homo sapiens
cuaucggggucacuugcaa

SEQ ID NO: 2017537 - RNA, 14 nt, Homo sapiens
ucacguguggaauu

SEQ ID NO: 2017538 - RNA, 13 nt, Homo sapiens
cuaucuguuaaag

SEQ ID NO: 2017539 - RNA, 18 nt, Homo sapiens
ugcaguucuucaucauga

SEQ ID NO: 2017540 - RNA, 20 nt, Homo sapiens
ccucuuuguuuaucucugag

SEQ ID NO: 2017541 - RNA, 12 nt, Homo sapiens
aaccugugauga

SEQ ID NO: 2017542 - RNA, 16 nt, Homo sapiens
ugugaaguggaaaugu

SEQ ID NO: 2017543 - RNA, 16 nt, Homo sapiens
uaguauaaaaauguua

SEQ ID NO: 2017544 - RNA, 16 nt, Homo sapiens
uaucacgccuacuuaa

SEQ ID NO: 2017545 - RNA, 13 nt, Homo sapiens
ggcagagccagug

SEQ ID NO: 2017546 - RNA, 19 nt, Homo sapiens
uauggaucccaauucauuu

SEQ ID NO: 2017547 - RNA, 17 nt, Homo sapiens
cccucaaaagccaaaaa

SEQ ID NO: 2017548 - RNA, 19 nt, Homo sapiens
uaacuuuucaccaaugagc

SEQ ID NO: 2017549 - RNA, 15 nt, Homo sapiens
uugggccccagggaa

SEQ ID NO: 2017550 - RNA, 21 nt, Homo sapiens
aaccuugguguaguugaacug

SEQ ID NO: 2017551 - RNA, 19 nt, Homo sapiens
auguaccggcuuccauccu

SEQ ID NO: 2017552 - RNA, 20 nt, Homo sapiens
caguuucagguguuuaguug

SEQ ID NO: 2017553 - RNA, 18 nt, Homo sapiens
uauuauuuugcaguuuug

SEQ ID NO: 2017554 - RNA, 22 nt, Homo sapiens
cgcgccccacgagaccccggcu

SEQ ID NO: 2017555 - RNA, 22 nt, Homo sapiens
cuaucucauagggaugcuguga

SEQ ID NO: 2017556 - RNA, 23 nt, Homo sapiens
uaguaaauaaugauucaauguga

SEQ ID NO: 2017557 - RNA, 14 nt, Homo sapiens
uccagaagcacugg

SEQ ID NO: 2017558 - RNA, 12 nt, Homo sapiens
ugaucaacuguu

SEQ ID NO: 2017559 - RNA, 18 nt, Homo sapiens
gucuagaaaccaguaugg

SEQ ID NO: 2017560 - RNA, 23 nt, Homo sapiens
gcagaacugaagagacuaggcgc

SEQ ID NO: 2017561 - RNA, 18 nt, Homo sapiens
uguucacuuauugacuau

SEQ ID NO: 2017562 - RNA, 18 nt, Homo sapiens
aguacuuuauuaguuuaa

SEQ ID NO: 2017563 - RNA, 16 nt, Homo sapiens
gcuuauauuucuucgc

SEQ ID NO: 2017564 - RNA, 16 nt, Homo sapiens
cagguuaugcuuugag

SEQ ID NO: 2017565 - RNA, 20 nt, Homo sapiens
gaaaaguuuccccauuauuu

SEQ ID NO: 2017566 - RNA, 16 nt, Homo sapiens
cccagagucaucugau

SEQ ID NO: 2017567 - RNA, 16 nt, Homo sapiens
cauuaggucaccugug

SEQ ID NO: 2017568 - RNA, 17 nt, Homo sapiens
aaggcuugucagcacuu

SEQ ID NO: 2017569 - RNA, 20 nt, Homo sapiens
augagaaaguucucauuuaa

SEQ ID NO: 2017570 - RNA, 15 nt, Homo sapiens
caggaccugccaaga

SEQ ID NO: 2017571 - RNA, 19 nt, Homo sapiens
aggaagaggcugcacugca

SEQ ID NO: 2017572 - RNA, 23 nt, Homo sapiens
uacccugacacaagaaguucuug

SEQ ID NO: 2017573 - RNA, 18 nt, Homo sapiens
augcauauccugagccau

SEQ ID NO: 2017574 - RNA, 14 nt, Homo sapiens
acaauucauugugu

SEQ ID NO: 2017575 - RNA, 14 nt, Homo sapiens
uuuccaaaccuuau

SEQ ID NO: 2017576 - RNA, 17 nt, Homo sapiens
cuguguugaagcacugu

SEQ ID NO: 2017577 - RNA, 16 nt, Homo sapiens
caccugccgucuucac

SEQ ID NO: 2017578 - RNA, 20 nt, Homo sapiens
agacuaguugaacaucucac

SEQ ID NO: 2017579 - RNA, 22 nt, Homo sapiens
auccugucuggccuucaguuuc

SEQ ID NO: 2017580 - RNA, 13 nt, Homo sapiens
aagugguacuuga

SEQ ID NO: 2017581 - RNA, 22 nt, Homo sapiens
gaggaauaaagcugugagcaaa

SEQ ID NO: 2017582 - RNA, 19 nt, Homo sapiens
aagucugcccuagagucau

SEQ ID NO: 2017583 - RNA, 19 nt, Homo sapiens
augcguacguuuccugaga

SEQ ID NO: 2017584 - RNA, 21 nt, Homo sapiens
auguauuuuccuaaugugauc

SEQ ID NO: 2017585 - RNA, 19 nt, Homo sapiens
ccaaggaggggcuguaaaa

SEQ ID NO: 2017586 - RNA, 19 nt, Homo sapiens
ucccugaggaaugaaaaag

SEQ ID NO: 2017587 - RNA, 23 nt, Homo sapiens
gacauuucuaucuugaauuucau

SEQ ID NO: 2017588 - RNA, 19 nt, Homo sapiens
cugucauuaguauuucaca

SEQ ID NO: 2017589 - RNA, 18 nt, Homo sapiens
cugauagacaaguaguua

SEQ ID NO: 2017590 - RNA, 20 nt, Homo sapiens
caacaugugacuaauuggaa

SEQ ID NO: 2017591 - RNA, 16 nt, Homo sapiens
gauaagaguccuauaa

SEQ ID NO: 2017592 - RNA, 17 nt, Homo sapiens
auggaagacaaauacac

SEQ ID NO: 2017593 - RNA, 22 nt, Homo sapiens
uuggaaauuuugaugcuuguau

SEQ ID NO: 2017594 - RNA, 13 nt, Homo sapiens
uguucugucccag

SEQ ID NO: 2017595 - RNA, 15 nt, Homo sapiens
aaggcaguucagucc

SEQ ID NO: 2017596 - RNA, 15 nt, Homo sapiens
ugcagccacuguuaa

SEQ ID NO: 2017597 - RNA, 23 nt, Homo sapiens
ggucugcucuuucucugccagug

SEQ ID NO: 2017598 - RNA, 16 nt, Homo sapiens
gcaggaaaauggacau

SEQ ID NO: 2017599 - RNA, 21 nt, Homo sapiens
gcauccauggggucucucaca

SEQ ID NO: 2017600 - RNA, 16 nt, Homo sapiens
ugaguuuauauucuga

SEQ ID NO: 2017601 - RNA, 10 nt, Homo sapiens
cauugaacaa

SEQ ID NO: 2017602 - RNA, 13 nt, Homo sapiens
augcauacaguaa

SEQ ID NO: 2017603 - RNA, 23 nt, Homo sapiens
auguagcaguucugcacuuugac

SEQ ID NO: 2017604 - RNA, 10 nt, Homo sapiens
acuagcauua

SEQ ID NO: 2017605 - RNA, 18 nt, Homo sapiens
ccagcacucugaaacuga

SEQ ID NO: 2017606 - RNA, 19 nt, Homo sapiens
caccaaugaaccccaguca

SEQ ID NO: 2017607 - RNA, 20 nt, Homo sapiens
ccuaaggugagugugcagua

SEQ ID NO: 2017608 - RNA, 17 nt, Homo sapiens
agggugacccauuucag

SEQ ID NO: 2017609 - RNA, 23 nt, Homo sapiens
uucccaauuaggaaguguaacag

SEQ ID NO: 2017610 - RNA, 18 nt, Homo sapiens
uuggaguuagguccucac

SEQ ID NO: 2017611 - RNA, 22 nt, Homo sapiens
aaggugcuacgguagugaugaa

SEQ ID NO: 2017612 - RNA, 13 nt, Homo sapiens
gcuagcaguacua

SEQ ID NO: 2017613 - RNA, 15 nt, Homo sapiens
aguccaggacugggu

SEQ ID NO: 2017614 - RNA, 16 nt, Homo sapiens
uuuccuggcagucuca

SEQ ID NO: 2017615 - RNA, 15 nt, Homo sapiens
ucaccaagagccaau

SEQ ID NO: 2017616 - RNA, 14 nt, Homo sapiens
acucugugugugua

SEQ ID NO: 2017617 - RNA, 20 nt, Homo sapiens
aggauguuuggucuuuaaug

SEQ ID NO: 2017618 - RNA, 15 nt, Homo sapiens
uacaagagccaugua

SEQ ID NO: 2017619 - RNA, 15 nt, Homo sapiens
agacaugugcacuug

SEQ ID NO: 2017620 - RNA, 14 nt, Homo sapiens
ucucagcugcugaa

SEQ ID NO: 2017621 - RNA, 22 nt, Homo sapiens
ccucaucuguaaaauggagaca

SEQ ID NO: 2017622 - RNA, 18 nt, Homo sapiens
aacuggguuccugcaaug

SEQ ID NO: 2017623 - RNA, 15 nt, Homo sapiens
cucaggccacagugg

SEQ ID NO: 2017624 - RNA, 18 nt, Homo sapiens
cucuaacauaccuuguca

SEQ ID NO: 2017625 - RNA, 20 nt, Homo sapiens
gacaguuagagaugcugauu

SEQ ID NO: 2017626 - RNA, 18 nt, Homo sapiens
acaaaccucucagcacua

SEQ ID NO: 2017627 - RNA, 14 nt, Homo sapiens
gacugaagauuuca

SEQ ID NO: 2017628 - RNA, 22 nt, Homo sapiens
ccaaaggguuaauauuuaaccu

SEQ ID NO: 2017629 - RNA, 14 nt, Homo sapiens
gggccccucagguc

SEQ ID NO: 2017630 - RNA, 18 nt, Homo sapiens
cguagagcacagccucac

SEQ ID NO: 2017631 - RNA, 16 nt, Homo sapiens
gaccauuagcauugca

SEQ ID NO: 2017632 - RNA, 13 nt, Homo sapiens
gcagggcucuuug

SEQ ID NO: 2017633 - RNA, 16 nt, Homo sapiens
ugccucccacuucacu

SEQ ID NO: 2017634 - RNA, 15 nt, Homo sapiens
ccgaccggugcauga

SEQ ID NO: 2017635 - RNA, 15 nt, Homo sapiens
cuuaaaaaaugucca

SEQ ID NO: 2017636 - RNA, 21 nt, Homo sapiens
gagcaguguuucguguguguu

SEQ ID NO: 2017637 - RNA, 13 nt, Homo sapiens
agagcaaagugac

SEQ ID NO: 2017638 - RNA, 16 nt, Homo sapiens
auaugaagaaucugcu

SEQ ID NO: 2017639 - RNA, 14 nt, Homo sapiens
aaggaaacaaagca

SEQ ID NO: 2017640 - RNA, 23 nt, Homo sapiens
cagcucccgaagccugagcucau

SEQ ID NO: 2017641 - RNA, 23 nt, Homo sapiens
agccucugaucuggcagacucau

SEQ ID NO: 2017642 - RNA, 18 nt, Homo sapiens
caaauuccuacaguuucu

SEQ ID NO: 2017643 - RNA, 12 nt, Homo sapiens
gccguguagaag

SEQ ID NO: 2017644 - RNA, 18 nt, Homo sapiens
acauguuauucaauguga

SEQ ID NO: 2017645 - RNA, 23 nt, Homo sapiens
cauacugaaaaaaugcugagcca

SEQ ID NO: 2017646 - RNA, 16 nt, Homo sapiens
agcucuggugcuuuag

SEQ ID NO: 2017647 - RNA, 14 nt, Homo sapiens
auguguaugcagaa

SEQ ID NO: 2017648 - RNA, 20 nt, Homo sapiens
uugggucccuugcugcaaac

SEQ ID NO: 2017649 - RNA, 16 nt, Homo sapiens
aauacagcagaacucc

SEQ ID NO: 2017650 - RNA, 14 nt, Homo sapiens
cgcgcgacugagaa

SEQ ID NO: 2017651 - RNA, 15 nt, Homo sapiens
uaaagcaaggccuug

SEQ ID NO: 2017652 - RNA, 20 nt, Homo sapiens
gguaaugaugauucaaucau

SEQ ID NO: 2017653 - RNA, 13 nt, Homo sapiens
aucaaucucuagu

SEQ ID NO: 2017654 - RNA, 15 nt, Homo sapiens
uggccuggggucccu

SEQ ID NO: 2017655 - RNA, 21 nt, Homo sapiens
accgggcacucagaagacacu

SEQ ID NO: 2017656 - RNA, 21 nt, Homo sapiens
caaaauaguuguaggggaaau

SEQ ID NO: 2017657 - RNA, 18 nt, Homo sapiens
agcaacaggaaucucaga

SEQ ID NO: 2017658 - RNA, 21 nt, Homo sapiens
caggaaaauguauccagagga

SEQ ID NO: 2017659 - RNA, 16 nt, Homo sapiens
aaacauuauugucaac

SEQ ID NO: 2017660 - RNA, 19 nt, Homo sapiens
agauguagucucacacugu

SEQ ID NO: 2017661 - RNA, 21 nt, Homo sapiens
aggcucugcacagacaagcag

SEQ ID NO: 2017662 - RNA, 19 nt, Homo sapiens
uaguuuuucagucuauggg

SEQ ID NO: 2017663 - RNA, 14 nt, Homo sapiens
acacacacacacuc

SEQ ID NO: 2017664 - RNA, 14 nt, Homo sapiens
aauuaaacaauuua

SEQ ID NO: 2017665 - RNA, 18 nt, Homo sapiens
aggcaggguuaaacugca

SEQ ID NO: 2017666 - RNA, 14 nt, Homo sapiens
uucaucagcauuua

SEQ ID NO: 2017667 - RNA, 19 nt, Homo sapiens
gacuuucuucuagugcuuu

SEQ ID NO: 2017668 - RNA, 13 nt, Homo sapiens
uaacuucaaugua

SEQ ID NO: 2017669 - RNA, 19 nt, Homo sapiens
caguaggaaaucaggcagu

SEQ ID NO: 2017670 - RNA, 18 nt, Homo sapiens
aguuugugcucuacuguu

SEQ ID NO: 2017671 - RNA, 13 nt, Homo sapiens
cuuuagugcucca

SEQ ID NO: 2017672 - RNA, 13 nt, Homo sapiens
aauuagugaacca

SEQ ID NO: 2017673 - RNA, 20 nt, Homo sapiens
uaggccagcaccaucucuuu

SEQ ID NO: 2017674 - RNA, 16 nt, Homo sapiens
ccagcaggacagugac

SEQ ID NO: 2017675 - RNA, 19 nt, Homo sapiens
uccuguacaauugcaucac

SEQ ID NO: 2017676 - RNA, 14 nt, Homo sapiens
ugcaugcucaggac

SEQ ID NO: 2017677 - RNA, 20 nt, Homo sapiens
auacgaagauaaagcuuuau

SEQ ID NO: 2017678 - RNA, 22 nt, Homo sapiens
agagccauggacucuacacugu

SEQ ID NO: 2017679 - RNA, 15 nt, Homo sapiens
ugaugucagauuugg

SEQ ID NO: 2017680 - RNA, 18 nt, Homo sapiens
ucucaucaguauccagug

SEQ ID NO: 2017681 - RNA, 21 nt, Homo sapiens
uaauacuauauuuauacugua

SEQ ID NO: 2017682 - RNA, 21 nt, Homo sapiens
cuguaaacuuuaucacuuaaa

SEQ ID NO: 2017683 - RNA, 15 nt, Homo sapiens
ccacaguguggggca

SEQ ID NO: 2017684 - RNA, 12 nt, Homo sapiens
ucuaaccaaaua

SEQ ID NO: 2017685 - RNA, 17 nt, Homo sapiens
aacugccacaagcacaa

SEQ ID NO: 2017686 - RNA, 17 nt, Homo sapiens
gcccauucuucugggug

SEQ ID NO: 2017687 - RNA, 14 nt, Homo sapiens
guacuuguuugcaa

SEQ ID NO: 2017688 - RNA, 17 nt, Homo sapiens
guucuagugaaacugca

SEQ ID NO: 2017689 - RNA, 12 nt, Homo sapiens
acagugaugcug

SEQ ID NO: 2017690 - RNA, 16 nt, Homo sapiens
cuuaaacauccaauaa

SEQ ID NO: 2017691 - RNA, 11 nt, Homo sapiens
gcuaagccauc

SEQ ID NO: 2017692 - RNA, 16 nt, Homo sapiens
aucaaaccccauggag

SEQ ID NO: 2017693 - RNA, 23 nt, Homo sapiens
cauaaauuuaugguucucaggcc

SEQ ID NO: 2017694 - RNA, 15 nt, Homo sapiens
aagcuggcuuucauc

SEQ ID NO: 2017695 - RNA, 17 nt, Homo sapiens
aggauuaagauacacuc

SEQ ID NO: 2017696 - RNA, 22 nt, Homo sapiens
ccaccccuaaguagucaucaau

SEQ ID NO: 2017697 - RNA, 20 nt, Homo sapiens
caauuagucugucacuccau

SEQ ID NO: 2017698 - RNA, 20 nt, Homo sapiens
uacuguuugauauaccaaau

SEQ ID NO: 2017699 - RNA, 21 nt, Homo sapiens
cccauccaggucuugacucau

SEQ ID NO: 2017700 - RNA, 22 nt, Homo sapiens
ucuuacugcaggcaagugggau

SEQ ID NO: 2017701 - RNA, 16 nt, Homo sapiens
uugauuuguucaugaa

SEQ ID NO: 2017702 - RNA, 17 nt, Homo sapiens
agggcauuuccaaguua

SEQ ID NO: 2017703 - RNA, 19 nt, Homo sapiens
ggguugucgagaucucagg

SEQ ID NO: 2017704 - RNA, 21 nt, Homo sapiens
cuaaucugauguuaaccaaug

SEQ ID NO: 2017705 - RNA, 20 nt, Homo sapiens
cagguguuacuuacaguccc

SEQ ID NO: 2017706 - RNA, 22 nt, Homo sapiens
aguguucuuugcauuucugucc

SEQ ID NO: 2017707 - RNA, 15 nt, Homo sapiens
uuaaagcagacaguc

SEQ ID NO: 2017708 - RNA, 20 nt, Homo sapiens
acagaauuuuaaagagcaua

SEQ ID NO: 2017709 - RNA, 21 nt, Homo sapiens
gaaagggguuggggugacagu

SEQ ID NO: 2017710 - RNA, 18 nt, Homo sapiens
aaaauauuucauuuugau

SEQ ID NO: 2017711 - RNA, 18 nt, Homo sapiens
aaaacaagauuaauuuca

SEQ ID NO: 2017712 - RNA, 23 nt, Homo sapiens
guauuuucuuacacugugucauu

SEQ ID NO: 2017713 - RNA, 14 nt, Homo sapiens
gaaaugcagaguca

SEQ ID NO: 2017714 - RNA, 19 nt, Homo sapiens
auaugugcuuguguguaug

SEQ ID NO: 2017715 - RNA, 12 nt, Homo sapiens
uggcuacugugc

SEQ ID NO: 2017716 - RNA, 19 nt, Homo sapiens
uuaacagagauugaacucc

SEQ ID NO: 2017717 - RNA, 18 nt, Homo sapiens
ccuugcuguuuaaaagua

SEQ ID NO: 2017718 - RNA, 13 nt, Homo sapiens
uccagugugagau

SEQ ID NO: 2017719 - RNA, 21 nt, Homo sapiens
aagauuuguacuacaguucuu

SEQ ID NO: 2017720 - RNA, 21 nt, Homo sapiens
cugaacacccuccuucacucc

SEQ ID NO: 2017721 - RNA, 21 nt, Homo sapiens
auacugcucaucauuccuuga

SEQ ID NO: 2017722 - RNA, 15 nt, Homo sapiens
uccaucuuucacuau

SEQ ID NO: 2017723 - RNA, 12 nt, Homo sapiens
caaguuugucac

SEQ ID NO: 2017724 - RNA, 18 nt, Homo sapiens
uuaaccgcacaugcacac

SEQ ID NO: 2017725 - RNA, 14 nt, Homo sapiens
caucauauuccaac

SEQ ID NO: 2017726 - RNA, 14 nt, Homo sapiens
cacaccauucuccu

SEQ ID NO: 2017727 - RNA, 16 nt, Homo sapiens
uaagucugagaaggcu

SEQ ID NO: 2017728 - RNA, 18 nt, Homo sapiens
guuuccugguccaucuca

SEQ ID NO: 2017729 - RNA, 21 nt, Homo sapiens
uggcuuaaaagcaaguuucag

SEQ ID NO: 2017730 - RNA, 13 nt, Homo sapiens
uauguugcuauaa

SEQ ID NO: 2017731 - RNA, 13 nt, Homo sapiens
cuggaugccugau

SEQ ID NO: 2017732 - RNA, 12 nt, Homo sapiens
cuuuuuugccaa

SEQ ID NO: 2017733 - RNA, 16 nt, Homo sapiens
cucagucagcccagug

SEQ ID NO: 2017734 - RNA, 19 nt, Homo sapiens
uucugguuuucgaagacua

SEQ ID NO: 2017735 - RNA, 14 nt, Homo sapiens
caaagacacaggaa

SEQ ID NO: 2017736 - RNA, 19 nt, Homo sapiens
aauuucagccuacauugau

SEQ ID NO: 2017737 - RNA, 22 nt, Homo sapiens
ugggcuccugacaauacuguau

SEQ ID NO: 2017738 - RNA, 21 nt, Homo sapiens
cgugaagggauuuuagucaca

SEQ ID NO: 2017739 - RNA, 16 nt, Homo sapiens
aggaaugcugggcugu

SEQ ID NO: 2017740 - RNA, 16 nt, Homo sapiens
aagaaaacuaggcaau

SEQ ID NO: 2017741 - RNA, 17 nt, Homo sapiens
ugggcccaggacuguug

SEQ ID NO: 2017742 - RNA, 17 nt, Homo sapiens
uagcccuucaagugcac

SEQ ID NO: 2017743 - RNA, 20 nt, Homo sapiens
uaaaugggaacugauguaga

SEQ ID NO: 2017744 - RNA, 19 nt, Homo sapiens
gagacauguaccuugacca

SEQ ID NO: 2017745 - RNA, 19 nt, Homo sapiens
ucuacaacugaucauuugc

SEQ ID NO: 2017746 - RNA, 14 nt, Homo sapiens
gcuaccucuucuau

SEQ ID NO: 2017747 - RNA, 12 nt, Homo sapiens
cagaccagugac

SEQ ID NO: 2017748 - RNA, 23 nt, Homo sapiens
  misc_feature (7)..(7): n is a, c, g or u
acccagnagggcgucgcuggaca

SEQ ID NO: 2017749 - RNA, 14 nt, Homo sapiens
ccgguuaucaguug

SEQ ID NO: 2017750 - RNA, 15 nt, Homo sapiens
ugacagaacacagau

SEQ ID NO: 2017751 - RNA, 15 nt, Homo sapiens
uaagaagagugcugu

SEQ ID NO: 2017752 - RNA, 12 nt, Homo sapiens
auuccuugcaca

SEQ ID NO: 2017753 - RNA, 19 nt, Homo sapiens
guugagucgucaucacuuu

SEQ ID NO: 2017754 - RNA, 21 nt, Homo sapiens
cauguggaguggacauucaaa

SEQ ID NO: 2017755 - RNA, 17 nt, Homo sapiens
uguauuagucacagaga

SEQ ID NO: 2017756 - RNA, 22 nt, Homo sapiens
aggaguucucaucccucuguca

SEQ ID NO: 2017757 - RNA, 15 nt, Homo sapiens
uuacugcaguucauc

SEQ ID NO: 2017758 - RNA, 14 nt, Homo sapiens
uaguugcacuucag

SEQ ID NO: 2017759 - RNA, 21 nt, Homo sapiens
gaaaugcccaucuaugucccu

SEQ ID NO: 2017760 - RNA, 21 nt, Homo sapiens
auaauuuuuaaaccaaucaaa

SEQ ID NO: 2017761 - RNA, 19 nt, Homo sapiens
auuucacucucaaacuuca

SEQ ID NO: 2017762 - RNA, 12 nt, Homo sapiens
aguguaauucca

SEQ ID NO: 2017763 - RNA, 18 nt, Homo sapiens
gaucgagaccaucuuggc

SEQ ID NO: 2017764 - RNA, 21 nt, Homo sapiens
acuucuacauccaauguauga

SEQ ID NO: 2017765 - RNA, 18 nt, Homo sapiens
cuaugggacugcagugcc

SEQ ID NO: 2017766 - RNA, 21 nt, Homo sapiens
agccugugcgccgggggaccu

SEQ ID NO: 2017767 - RNA, 15 nt, Homo sapiens
uguggcaaugggauu

SEQ ID NO: 2017768 - RNA, 23 nt, Homo sapiens
uguaaagugugggagaccgagga

SEQ ID NO: 2017769 - RNA, 16 nt, Homo sapiens
aggcccuugggcaccu

SEQ ID NO: 2017770 - RNA, 15 nt, Homo sapiens
aaugacaauggugcc

SEQ ID NO: 2017771 - RNA, 16 nt, Homo sapiens
uguaacacugcaagaa

SEQ ID NO: 2017772 - RNA, 19 nt, Homo sapiens
ucuuucuuacacaagagcu

SEQ ID NO: 2017773 - RNA, 22 nt, Homo sapiens
ucugguuuugcuauuagacugu

SEQ ID NO: 2017774 - RNA, 20 nt, Homo sapiens
augcugucuucguacuggga

SEQ ID NO: 2017775 - RNA, 21 nt, Homo sapiens
acauggccuaugcacauaugg

SEQ ID NO: 2017776 - RNA, 18 nt, Homo sapiens
agagucagcauggagagc

SEQ ID NO: 2017777 - RNA, 22 nt, Homo sapiens
aaugauuucaaaaugauauuca

SEQ ID NO: 2017778 - RNA, 20 nt, Homo sapiens
acuuaucucuaaaccaucua

SEQ ID NO: 2017779 - RNA, 14 nt, Homo sapiens
aaaaaugaaugacu

SEQ ID NO: 2017780 - RNA, 18 nt, Homo sapiens
auggacacuccagugcca

SEQ ID NO: 2017781 - RNA, 14 nt, Homo sapiens
auugccugccaugg

SEQ ID NO: 2017782 - RNA, 17 nt, Homo sapiens
acugaaggccacuugag

SEQ ID NO: 2017783 - RNA, 13 nt, Homo sapiens
uccuacuuucucc

SEQ ID NO: 2017784 - RNA, 12 nt, Homo sapiens
caggguggggga

SEQ ID NO: 2017785 - RNA, 20 nt, Homo sapiens
aaaacagaucugaauucugc

SEQ ID NO: 2017786 - RNA, 20 nt, Homo sapiens
agcugcagucccaugcacaa

SEQ ID NO: 2017787 - RNA, 18 nt, Homo sapiens
uaaucucuccaccuucca

SEQ ID NO: 2017788 - RNA, 17 nt, Homo sapiens
cgggaugaccuccagaa

SEQ ID NO: 2017789 - RNA, 19 nt, Homo sapiens
uccuguacucuggggugcu

SEQ ID NO: 2017790 - RNA, 22 nt, Homo sapiens
aaucaaguauuugggaagugaa

SEQ ID NO: 2017791 - RNA, 15 nt, Homo sapiens
cagauucccagagca

SEQ ID NO: 2017792 - RNA, 15 nt, Homo sapiens
cugcgucccugcuca

SEQ ID NO: 2017793 - RNA, 19 nt, Homo sapiens
cagccuggccaguauggug

SEQ ID NO: 2017794 - RNA, 19 nt, Homo sapiens
uuuuccuucacaaugguuu

SEQ ID NO: 2017795 - RNA, 21 nt, Homo sapiens
ggaagccagaucuaugccaca

SEQ ID NO: 2017796 - RNA, 19 nt, Homo sapiens
aacauuaugagagacugcu

SEQ ID NO: 2017797 - RNA, 17 nt, Homo sapiens
uaagcucuuuaugacug

SEQ ID NO: 2017798 - RNA, 18 nt, Homo sapiens
aauaguuuugauccuaaa

SEQ ID NO: 2017799 - RNA, 18 nt, Homo sapiens
ugguccugcagaagcaga

SEQ ID NO: 2017800 - RNA, 13 nt, Homo sapiens
ugccaaccagagc

SEQ ID NO: 2017801 - RNA, 22 nt, Homo sapiens
ucucuggcuggggagcagggag

SEQ ID NO: 2017802 - RNA, 21 nt, Homo sapiens
ucuuuugaaagaacaucaguu

SEQ ID NO: 2017803 - RNA, 13 nt, Homo sapiens
accccaccuugcc

SEQ ID NO: 2017804 - RNA, 13 nt, Homo sapiens
acgccaccuuccc

SEQ ID NO: 2017805 - RNA, 11 nt, Homo sapiens
cucaugcugcc

SEQ ID NO: 2017806 - RNA, 23 nt, Homo sapiens
cggagacggagucccaccuuggc

SEQ ID NO: 2017807 - RNA, 23 nt, Homo sapiens
ugggcaaagccccucacacugca

SEQ ID NO: 2017808 - RNA, 20 nt, Homo sapiens
ccucucccuugggcucugau

SEQ ID NO: 2017809 - RNA, 21 nt, Homo sapiens
ucuagggaccagaaccaaacc

SEQ ID NO: 2017810 - RNA, 17 nt, Homo sapiens
gugagcagcggacuuca

SEQ ID NO: 2017811 - RNA, 16 nt, Homo sapiens
aguccagcacuggaag

SEQ ID NO: 2017812 - RNA, 23 nt, Homo sapiens
ucccuuccccaugcuuccuugcc

SEQ ID NO: 2017813 - RNA, 21 nt, Homo sapiens
gaagacauuaagcagccuuaa

SEQ ID NO: 2017814 - RNA, 21 nt, Homo sapiens
caguauuaacacuaaauugca

SEQ ID NO: 2017815 - RNA, 18 nt, Homo sapiens
cuuuuaaacugcaguuuu

SEQ ID NO: 2017816 - RNA, 21 nt, Homo sapiens
cuaggauaacuggcacccaga

SEQ ID NO: 2017817 - RNA, 20 nt, Homo sapiens
ugucaagcugcucugagcca

SEQ ID NO: 2017818 - RNA, 19 nt, Homo sapiens
gugauauggugaagggaag

SEQ ID NO: 2017819 - RNA, 19 nt, Homo sapiens
ccaccuggauggaucugcu

SEQ ID NO: 2017820 - RNA, 13 nt, Homo sapiens
uaacgcagcacuu

SEQ ID NO: 2017821 - RNA, 18 nt, Homo sapiens
augaauauagaugcuggc

SEQ ID NO: 2017822 - RNA, 15 nt, Homo sapiens
gcagagacagugggc

SEQ ID NO: 2017823 - RNA, 21 nt, Homo sapiens
ucccuugaaagggaacaccug

SEQ ID NO: 2017824 - RNA, 15 nt, Homo sapiens
agaucacgccacugc

SEQ ID NO: 2017825 - RNA, 15 nt, Homo sapiens
aaccugaauggucug

SEQ ID NO: 2017826 - RNA, 15 nt, Homo sapiens
uccauuacugugauu

SEQ ID NO: 2017827 - RNA, 13 nt, Homo sapiens
aaguaaauuaaac

SEQ ID NO: 2017828 - RNA, 17 nt, Homo sapiens
gucagggguuucuucaa

SEQ ID NO: 2017829 - RNA, 23 nt, Homo sapiens
agcagucuuucuauccuguucuu

SEQ ID NO: 2017830 - RNA, 17 nt, Homo sapiens
caucauaauucagcucu

SEQ ID NO: 2017831 - RNA, 14 nt, Homo sapiens
uauucaaugaacuu

SEQ ID NO: 2017832 - RNA, 18 nt, Homo sapiens
gaguuuuacccagacuca

SEQ ID NO: 2017833 - RNA, 15 nt, Homo sapiens
agcaaaccuagcccc

SEQ ID NO: 2017834 - RNA, 16 nt, Homo sapiens
aaauuaacugcuccaa

SEQ ID NO: 2017835 - RNA, 16 nt, Homo sapiens
aaaagaaaagccgaaa

SEQ ID NO: 2017836 - RNA, 19 nt, Homo sapiens
aaugucaagaucacaaaga

SEQ ID NO: 2017837 - RNA, 13 nt, Homo sapiens
caggcacugggca

SEQ ID NO: 2017838 - RNA, 19 nt, Homo sapiens
ccagcugcaggaaucaaaa

SEQ ID NO: 2017839 - RNA, 14 nt, Homo sapiens
uuuaaauuagauaa

SEQ ID NO: 2017840 - RNA, 16 nt, Homo sapiens
ugcagcccacugccug

SEQ ID NO: 2017841 - RNA, 21 nt, Homo sapiens
auuuucuuucucuacuuugag

SEQ ID NO: 2017842 - RNA, 20 nt, Homo sapiens
cucaguggacuuuccacccc

SEQ ID NO: 2017843 - RNA, 17 nt, Homo sapiens
uucuguaauuacauauu

SEQ ID NO: 2017844 - RNA, 19 nt, Homo sapiens
cagcugccaucgaccugga

SEQ ID NO: 2017845 - RNA, 18 nt, Homo sapiens
auggaaguaaagccucaa

SEQ ID NO: 2017846 - RNA, 19 nt, Homo sapiens
gccacagugggcagucaca

SEQ ID NO: 2017847 - RNA, 16 nt, Homo sapiens
ucgugguagaagccag

SEQ ID NO: 2017848 - RNA, 13 nt, Homo sapiens
cucaagucucagu

SEQ ID NO: 2017849 - RNA, 14 nt, Homo sapiens
cuccuuuccaaaua

SEQ ID NO: 2017850 - RNA, 20 nt, Homo sapiens
guuaauaucugauacuguau

SEQ ID NO: 2017851 - RNA, 17 nt, Homo sapiens
acuuaucaaaucauuca

SEQ ID NO: 2017852 - RNA, 22 nt, Homo sapiens
aaaaauguuuuuagaacaugua

SEQ ID NO: 2017853 - RNA, 17 nt, Homo sapiens
cccaucacacucggcca

SEQ ID NO: 2017854 - RNA, 23 nt, Homo sapiens
agcaaucucuugcauuucuggac

SEQ ID NO: 2017855 - RNA, 14 nt, Homo sapiens
agcugccuguuucc

SEQ ID NO: 2017856 - RNA, 16 nt, Homo sapiens
aagcuuuaucuuugug

SEQ ID NO: 2017857 - RNA, 17 nt, Homo sapiens
aucaauaaauguugcaa

SEQ ID NO: 2017858 - RNA, 18 nt, Homo sapiens
aguguugacauagccuuu

SEQ ID NO: 2017859 - RNA, 14 nt, Homo sapiens
auagcccuguaaca

SEQ ID NO: 2017860 - RNA, 23 nt, Homo sapiens
cagacacaugcuauguucugucu

SEQ ID NO: 2017861 - RNA, 18 nt, Homo sapiens
cauuuuuuuuucaaucaa

SEQ ID NO: 2017862 - RNA, 17 nt, Homo sapiens
ucaaagugacuauucag

SEQ ID NO: 2017863 - RNA, 17 nt, Homo sapiens
acugaugccauguuuag

SEQ ID NO: 2017864 - RNA, 14 nt, Homo sapiens
gcggagcuuuccac

SEQ ID NO: 2017865 - RNA, 23 nt, Homo sapiens
aaaauuaaacuacagaauauuaa

SEQ ID NO: 2017866 - RNA, 17 nt, Homo sapiens
uuacuuaauucagucuc

SEQ ID NO: 2017867 - RNA, 21 nt, Homo sapiens
acauuguauuaauaccaaagu

SEQ ID NO: 2017868 - RNA, 21 nt, Homo sapiens
cuaaaagggggcuauucccug

SEQ ID NO: 2017869 - RNA, 14 nt, Homo sapiens
cuggaagcuuucau

SEQ ID NO: 2017870 - RNA, 14 nt, Homo sapiens
cugguugcuuucua

SEQ ID NO: 2017871 - RNA, 21 nt, Homo sapiens
ccauccuccccagcgccaucu

SEQ ID NO: 2017872 - RNA, 16 nt, Homo sapiens
cagcugccucugcucc

SEQ ID NO: 2017873 - RNA, 16 nt, Homo sapiens
cagaaagcaucccuca

SEQ ID NO: 2017874 - RNA, 14 nt, Homo sapiens
cugcuggccaaagu

SEQ ID NO: 2017875 - RNA, 22 nt, Homo sapiens
uaaucaaugaaguagcugagaa

SEQ ID NO: 2017876 - RNA, 15 nt, Homo sapiens
gcccuaaaagcacac

SEQ ID NO: 2017877 - RNA, 20 nt, Homo sapiens
aauugugaaaaugaauauca

SEQ ID NO: 2017878 - RNA, 16 nt, Homo sapiens
augauauuuaacuuuu

SEQ ID NO: 2017879 - RNA, 17 nt, Homo sapiens
cacugacucugacucau

SEQ ID NO: 2017880 - RNA, 19 nt, Homo sapiens
gcaucugaaauaggaaaca

SEQ ID NO: 2017881 - RNA, 14 nt, Homo sapiens
cagagauaugcaca

SEQ ID NO: 2017882 - RNA, 15 nt, Homo sapiens
gacuggagugcagug

SEQ ID NO: 2017883 - RNA, 14 nt, Homo sapiens
gauugauugaugua

SEQ ID NO: 2017884 - RNA, 13 nt, Homo sapiens
uaaggucccuggg

SEQ ID NO: 2017885 - RNA, 11 nt, Homo sapiens
cacugcuguag

SEQ ID NO: 2017886 - RNA, 13 nt, Homo sapiens
uagauaccaaaug

SEQ ID NO: 2017887 - RNA, 14 nt, Homo sapiens
aaugcuauguucug

SEQ ID NO: 2017888 - RNA, 21 nt, Homo sapiens
gcugggaacauguaccacuga

SEQ ID NO: 2017889 - RNA, 15 nt, Homo sapiens
gaaaucaguguagaa

SEQ ID NO: 2017890 - RNA, 22 nt, Homo sapiens
uugaaagcugaaaagcauacaa

SEQ ID NO: 2017891 - RNA, 22 nt, Homo sapiens
caaaaguugauuucuucuucau

SEQ ID NO: 2017892 - RNA, 20 nt, Homo sapiens
ugccccucugccuugcccuc

SEQ ID NO: 2017893 - RNA, 17 nt, Homo sapiens
ccccccaacacugugcc

SEQ ID NO: 2017894 - RNA, 23 nt, Homo sapiens
acgggaaaggaaacgccccgggc

SEQ ID NO: 2017895 - RNA, 13 nt, Homo sapiens
ucagucugugaaa

SEQ ID NO: 2017896 - RNA, 17 nt, Homo sapiens
uggcacgggaccacucc

SEQ ID NO: 2017897 - RNA, 13 nt, Homo sapiens
caaaguuaugcaa

SEQ ID NO: 2017898 - RNA, 14 nt, Homo sapiens
uugcaggcaugcau

SEQ ID NO: 2017899 - RNA, 20 nt, Homo sapiens
cuaaaaacacagacauucug

SEQ ID NO: 2017900 - RNA, 15 nt, Homo sapiens
uaagaacuuugcaca

SEQ ID NO: 2017901 - RNA, 15 nt, Homo sapiens
gguuaagaauguaua

SEQ ID NO: 2017902 - RNA, 18 nt, Homo sapiens
caugacauccacaugcac

SEQ ID NO: 2017903 - RNA, 16 nt, Homo sapiens
gaauucugguguuuau

SEQ ID NO: 2017904 - RNA, 20 nt, Homo sapiens
uacuuaaaaauagucuucca

SEQ ID NO: 2017905 - RNA, 15 nt, Homo sapiens
cuccgccagccacag

SEQ ID NO: 2017906 - RNA, 12 nt, Homo sapiens
auauacuaauau

SEQ ID NO: 2017907 - RNA, 12 nt, Homo sapiens
uauaacuauaua

SEQ ID NO: 2017908 - RNA, 13 nt, Homo sapiens
uagaacacccacu

SEQ ID NO: 2017909 - RNA, 22 nt, Homo sapiens
ugugacuccagccugcccucag

SEQ ID NO: 2017910 - RNA, 18 nt, Homo sapiens
cuugggcaacugcaguga

SEQ ID NO: 2017911 - RNA, 20 nt, Homo sapiens
cuagucugugugggacugua

SEQ ID NO: 2017912 - RNA, 18 nt, Homo sapiens
uacaugaaacuacucaua

SEQ ID NO: 2017913 - RNA, 15 nt, Homo sapiens
ccagagcgugcacuu

SEQ ID NO: 2017914 - RNA, 17 nt, Homo sapiens
ccacuucuucauucucu

SEQ ID NO: 2017915 - RNA, 18 nt, Homo sapiens
auuugaagaaugaacaaa

SEQ ID NO: 2017916 - RNA, 13 nt, Homo sapiens
cgagcacuuucca

SEQ ID NO: 2017917 - RNA, 18 nt, Homo sapiens
uucugcauucucuaguca

SEQ ID NO: 2017918 - RNA, 13 nt, Homo sapiens
guagcaacuaaaa

SEQ ID NO: 2017919 - RNA, 20 nt, Homo sapiens
acgcuguggcccugccuggc

SEQ ID NO: 2017920 - RNA, 22 nt, Homo sapiens
ucccugccuaaggaagcuaaaa

SEQ ID NO: 2017921 - RNA, 15 nt, Homo sapiens
gaugcuuuaccaaac

SEQ ID NO: 2017922 - RNA, 17 nt, Homo sapiens
gcucagaucucauggga

SEQ ID NO: 2017923 - RNA, 18 nt, Homo sapiens
augguacuauguuagccc

SEQ ID NO: 2017924 - RNA, 23 nt, Homo sapiens
uccaagauaagaugaaucauuua

SEQ ID NO: 2017925 - RNA, 19 nt, Homo sapiens
uuaacacugagauccagag

SEQ ID NO: 2017926 - RNA, 21 nt, Homo sapiens
caagauggaggggcugacuca

SEQ ID NO: 2017927 - RNA, 21 nt, Homo sapiens
ccacgugcaguaucucaagau

SEQ ID NO: 2017928 - RNA, 18 nt, Homo sapiens
uuagaaacagcuucucaa

SEQ ID NO: 2017929 - RNA, 18 nt, Homo sapiens
uguaaaucauuauaaaua

SEQ ID NO: 2017930 - RNA, 15 nt, Homo sapiens
ucuuuaaacugcuuu

SEQ ID NO: 2017931 - RNA, 20 nt, Homo sapiens
ugaugguauaaacaggagac

SEQ ID NO: 2017932 - RNA, 22 nt, Homo sapiens
ugucugguacuauuggaacaaa

SEQ ID NO: 2017933 - RNA, 20 nt, Homo sapiens
agaggguuuuucucacugug

SEQ ID NO: 2017934 - RNA, 22 nt, Homo sapiens
cacacguuuaaucccagcacuu

SEQ ID NO: 2017935 - RNA, 14 nt, Homo sapiens
gugaagacccagga

SEQ ID NO: 2017936 - RNA, 16 nt, Homo sapiens
ccaugaaucuuuuuga

SEQ ID NO: 2017937 - RNA, 22 nt, Homo sapiens
auuuaauucuaguuucucucaa

SEQ ID NO: 2017938 - RNA, 19 nt, Homo sapiens
cuugaguuccucugcaguu

SEQ ID NO: 2017939 - RNA, 16 nt, Homo sapiens
cuguccaggagcuaau

SEQ ID NO: 2017940 - RNA, 11 nt, Homo sapiens
accuuuguacg

SEQ ID NO: 2017941 - RNA, 21 nt, Homo sapiens
uaccugaacugaaaggacugu

SEQ ID NO: 2017942 - RNA, 18 nt, Homo sapiens
aagugaggccacugaaga

SEQ ID NO: 2017943 - RNA, 13 nt, Homo sapiens
auauucccaagcu

SEQ ID NO: 2017944 - RNA, 17 nt, Homo sapiens
ucaggaguugaagacca

SEQ ID NO: 2017945 - RNA, 20 nt, Homo sapiens
aaaaauucuguuguuccauu

SEQ ID NO: 2017946 - RNA, 19 nt, Homo sapiens
agugucuugagacuuuauc

SEQ ID NO: 2017947 - RNA, 15 nt, Homo sapiens
uauauuucaucauga

SEQ ID NO: 2017948 - RNA, 16 nt, Homo sapiens
guaauuaagugcaauu

SEQ ID NO: 2017949 - RNA, 19 nt, Homo sapiens
ugauccaccccgccuuggc

SEQ ID NO: 2017950 - RNA, 19 nt, Homo sapiens
uccauagcuucauccacug

SEQ ID NO: 2017951 - RNA, 13 nt, Homo sapiens
gccagcucaggau

SEQ ID NO: 2017952 - RNA, 17 nt, Homo sapiens
uuuaaugccuuccacau

SEQ ID NO: 2017953 - RNA, 23 nt, Homo sapiens
aguuuauuccagagcugccagug

SEQ ID NO: 2017954 - RNA, 18 nt, Homo sapiens
agcucagggacuggcaca

SEQ ID NO: 2017955 - RNA, 21 nt, Homo sapiens
ccgacagacauggacaaggag

SEQ ID NO: 2017956 - RNA, 23 nt, Homo sapiens
ccugacacgugauggaccaaagc

SEQ ID NO: 2017957 - RNA, 23 nt, Homo sapiens
caguaaacagaggaguacaggug

SEQ ID NO: 2017958 - RNA, 18 nt, Homo sapiens
acuuuccuuccucauuuc

SEQ ID NO: 2017959 - RNA, 17 nt, Homo sapiens
gagcuccccagaucucc

SEQ ID NO: 2017960 - RNA, 15 nt, Homo sapiens
cucccaggaccaaga

SEQ ID NO: 2017961 - RNA, 19 nt, Homo sapiens
accuagaaguauuuuuguc

SEQ ID NO: 2017962 - RNA, 19 nt, Homo sapiens
cuccaaagucacacagagu

SEQ ID NO: 2017963 - RNA, 18 nt, Homo sapiens
cagggaauuaaugacaga

SEQ ID NO: 2017964 - RNA, 18 nt, Homo sapiens
acaccccaccucuuccuu

SEQ ID NO: 2017965 - RNA, 13 nt, Homo sapiens
augaacaaauucu

SEQ ID NO: 2017966 - RNA, 17 nt, Homo sapiens
cccugguccuucacugg

SEQ ID NO: 2017967 - RNA, 12 nt, Homo sapiens
gaagaugcauug

SEQ ID NO: 2017968 - RNA, 12 nt, Homo sapiens
gaaaaugcauua

SEQ ID NO: 2017969 - RNA, 12 nt, Homo sapiens
guucaugcaaac

SEQ ID NO: 2017970 - RNA, 20 nt, Homo sapiens
ccaugucagcaaaaagcaaa

SEQ ID NO: 2017971 - RNA, 18 nt, Homo sapiens
ugcaaucacuuuuggaca

SEQ ID NO: 2017972 - RNA, 13 nt, Homo sapiens
ugugugcauguau

SEQ ID NO: 2017973 - RNA, 19 nt, Homo sapiens
cccauucuguuccaccacu

SEQ ID NO: 2017974 - RNA, 17 nt, Homo sapiens
aaagacaaaaaccaagu

SEQ ID NO: 2017975 - RNA, 22 nt, Homo sapiens
ucuuguaaagguccuggcaaag

SEQ ID NO: 2017976 - RNA, 16 nt, Homo sapiens
cucccccagcacagau

SEQ ID NO: 2017977 - RNA, 22 nt, Homo sapiens
cuuaguccuacccugaaccuau

SEQ ID NO: 2017978 - RNA, 15 nt, Homo sapiens
acuucacacuaugga

SEQ ID NO: 2017979 - RNA, 22 nt, Homo sapiens
uggcuugggacuaaaugcccug

SEQ ID NO: 2017980 - RNA, 16 nt, Homo sapiens
ugggagccaacuguca

SEQ ID NO: 2017981 - RNA, 13 nt, Homo sapiens
gggaagaccagcu

SEQ ID NO: 2017982 - RNA, 19 nt, Homo sapiens
uuaaucugccauaaagcca

SEQ ID NO: 2017983 - RNA, 13 nt, Homo sapiens
aaguggucuggga

SEQ ID NO: 2017984 - RNA, 22 nt, Homo sapiens
gaagaauuuaauggacugugaa

SEQ ID NO: 2017985 - RNA, 20 nt, Homo sapiens
cucgaaaacucauguugaaa

SEQ ID NO: 2017986 - RNA, 19 nt, Homo sapiens
ccaggaaaggauuuuauaa

SEQ ID NO: 2017987 - RNA, 18 nt, Homo sapiens
uaauaucuaaaguuauau

SEQ ID NO: 2017988 - RNA, 16 nt, Homo sapiens
cgcauacacacauaua

SEQ ID NO: 2017989 - RNA, 16 nt, Homo sapiens
uuuuccccacauucua

SEQ ID NO: 2017990 - RNA, 19 nt, Homo sapiens
aagagacugcuugacaaag

SEQ ID NO: 2017991 - RNA, 13 nt, Homo sapiens
cuuuccucaaaaa

SEQ ID NO: 2017992 - RNA, 15 nt, Homo sapiens
aagagggacagagcc

SEQ ID NO: 2017993 - RNA, 15 nt, Homo sapiens
guucugucuacaggg

SEQ ID NO: 2017994 - RNA, 13 nt, Homo sapiens
uacacggcuguga

SEQ ID NO: 2017995 - RNA, 21 nt, Homo sapiens
agacuugguccuaagcaccug

SEQ ID NO: 2017996 - RNA, 19 nt, Homo sapiens
cugaauaaauaauucuucc

SEQ ID NO: 2017997 - RNA, 19 nt, Homo sapiens
ggggacgcccccagugaga

SEQ ID NO: 2017998 - RNA, 13 nt, Homo sapiens
aaccccaugggcu

SEQ ID NO: 2017999 - RNA, 15 nt, Homo sapiens
cugucggugggacuc

SEQ ID NO: 2018000 - RNA, 15 nt, Homo sapiens
gauaaacaacauuga

SEQ ID NO: 2018001 - RNA, 18 nt, Homo sapiens
ccucauggcucuggcaca

SEQ ID NO: 2018002 - RNA, 24 nt, Homo sapiens
ugaggaugugucccaucuagggaa

SEQ ID NO: 2018003 - RNA, 20 nt, Homo sapiens
gaucuccagcucuaacaaaa

SEQ ID NO: 2018004 - RNA, 21 nt, Homo sapiens
cuagacauucuuuuaaugcca

SEQ ID NO: 2018005 - RNA, 16 nt, Homo sapiens
cacaccacaaauggga

SEQ ID NO: 2018006 - RNA, 22 nt, Homo sapiens
ucuauuguauauauaaucuaua

SEQ ID NO: 2018007 - RNA, 15 nt, Homo sapiens
uggaacucuugcuau

SEQ ID NO: 2018008 - RNA, 18 nt, Homo sapiens
augcugccuucucugggc

SEQ ID NO: 2018009 - RNA, 15 nt, Homo sapiens
uuccucucugcaaau

SEQ ID NO: 2018010 - RNA, 18 nt, Homo sapiens
cuaauuccuguguagcuu

SEQ ID NO: 2018011 - RNA, 16 nt, Homo sapiens
cugucaacaucaaaga

SEQ ID NO: 2018012 - RNA, 12 nt, Homo sapiens
cuggugcaugac

SEQ ID NO: 2018013 - RNA, 12 nt, Homo sapiens
guuagccucuug

SEQ ID NO: 2018014 - RNA, 18 nt, Homo sapiens
guagggagcuaaggaaga

SEQ ID NO: 2018015 - RNA, 18 nt, Homo sapiens
aaaauuggcuaguugaau

SEQ ID NO: 2018016 - RNA, 18 nt, Homo sapiens
caaacagacaagcaggca

SEQ ID NO: 2018017 - RNA, 13 nt, Homo sapiens
ugacuacaaagau

SEQ ID NO: 2018018 - RNA, 13 nt, Homo sapiens
uagaaacaagaca

SEQ ID NO: 2018019 - RNA, 13 nt, Homo sapiens
uggaaacaaaaca

SEQ ID NO: 2018020 - RNA, 19 nt, Homo sapiens
uuuaguucaauacagugaa

SEQ ID NO: 2018021 - RNA, 21 nt, Homo sapiens
ccuaugccuucaaauaguaua

SEQ ID NO: 2018022 - RNA, 16 nt, Homo sapiens
gaauaaucagauuucu

SEQ ID NO: 2018023 - RNA, 19 nt, Homo sapiens
cucagccgugcacucccua

SEQ ID NO: 2018024 - RNA, 22 nt, Homo sapiens
uuacguccacaccgagcccagu

SEQ ID NO: 2018025 - RNA, 14 nt, Homo sapiens
uaaaauauccacug

SEQ ID NO: 2018026 - RNA, 15 nt, Homo sapiens
gagagucucccaggg

SEQ ID NO: 2018027 - RNA, 16 nt, Homo sapiens
gggcgcaggcccagug

SEQ ID NO: 2018028 - RNA, 14 nt, Homo sapiens
cuaaacagauauaa

SEQ ID NO: 2018029 - RNA, 14 nt, Homo sapiens
cucaccagaucuca

SEQ ID NO: 2018030 - RNA, 23 nt, Homo sapiens
aggacaaauugagacagugcaca

SEQ ID NO: 2018031 - RNA, 14 nt, Homo sapiens
uacaauuacaucuc

SEQ ID NO: 2018032 - RNA, 18 nt, Homo sapiens
aaaauggaauaacauauc

SEQ ID NO: 2018033 - RNA, 14 nt, Homo sapiens
uguacggacacugu

SEQ ID NO: 2018034 - RNA, 19 nt, Homo sapiens
accaggcugggcucagcuc

SEQ ID NO: 2018035 - RNA, 23 nt, Homo sapiens
ugagaagauaaaaacugcccauu

SEQ ID NO: 2018036 - RNA, 20 nt, Homo sapiens
uugggacauugcaauuugca

SEQ ID NO: 2018037 - RNA, 12 nt, Homo sapiens
uauuaagauauc

SEQ ID NO: 2018038 - RNA, 18 nt, Homo sapiens
agcugggacuacaggcuc

SEQ ID NO: 2018039 - RNA, 21 nt, Homo sapiens
acagcaaaauuguggcauuuu

SEQ ID NO: 2018040 - RNA, 22 nt, Homo sapiens
aauguccuucuuuaucugugau

SEQ ID NO: 2018041 - RNA, 16 nt, Homo sapiens
caaccuugcugggacu

SEQ ID NO: 2018042 - RNA, 15 nt, Homo sapiens
ucaucaaucaaauaa

SEQ ID NO: 2018043 - RNA, 22 nt, Homo sapiens
ccauguagaagcugcaucuugu

SEQ ID NO: 2018044 - RNA, 19 nt, Homo sapiens
gacaaagcaaaaagugaug

SEQ ID NO: 2018045 - RNA, 15 nt, Homo sapiens
ccccucuucugcuaa

SEQ ID NO: 2018046 - RNA, 16 nt, Homo sapiens
cauagaaauauugacu

SEQ ID NO: 2018047 - RNA, 23 nt, Homo sapiens
ggagucuaucuggcauucagaga

SEQ ID NO: 2018048 - RNA, 19 nt, Homo sapiens
acaugcacuuggcugcaua

SEQ ID NO: 2018049 - RNA, 17 nt, Homo sapiens
cuauaaugaucuaagaa

SEQ ID NO: 2018050 - RNA, 18 nt, Homo sapiens
agaaacucgggcacuccc

SEQ ID NO: 2018051 - RNA, 19 nt, Homo sapiens
gaucucugaccucugcuga

SEQ ID NO: 2018052 - RNA, 14 nt, Homo sapiens
ugggaagaagcagu

SEQ ID NO: 2018053 - RNA, 13 nt, Homo sapiens
aauucagcacuua

SEQ ID NO: 2018054 - RNA, 21 nt, Homo sapiens
cugcuuucuuguugcugcauc

SEQ ID NO: 2018055 - RNA, 16 nt, Homo sapiens
aacauuuuguuuaugu

SEQ ID NO: 2018056 - RNA, 23 nt, Homo sapiens
cugcccuucucccauccaagaga

SEQ ID NO: 2018057 - RNA, 19 nt, Homo sapiens
ugaaagagaagcacuaaga

SEQ ID NO: 2018058 - RNA, 13 nt, Homo sapiens
auccuccaacagc

SEQ ID NO: 2018059 - RNA, 17 nt, Homo sapiens
gaucacaaggucaggag

SEQ ID NO: 2018060 - RNA, 23 nt, Homo sapiens
cugucaggcaguagcagcugugu

SEQ ID NO: 2018061 - RNA, 17 nt, Homo sapiens
acaucagaaguuugcau

SEQ ID NO: 2018062 - RNA, 14 nt, Homo sapiens
acacugucaaugag

SEQ ID NO: 2018063 - RNA, 20 nt, Homo sapiens
gacagcucucugugcacuga

SEQ ID NO: 2018064 - RNA, 18 nt, Homo sapiens
ccuuuuuuccuuuccuga

SEQ ID NO: 2018065 - RNA, 14 nt, Homo sapiens
ugauucaaaccaaa

SEQ ID NO: 2018066 - RNA, 15 nt, Homo sapiens
ugccaacuauucuca

SEQ ID NO: 2018067 - RNA, 14 nt, Homo sapiens
ugacauugugucag

SEQ ID NO: 2018068 - RNA, 16 nt, Homo sapiens
gaaccugaaggugcug

SEQ ID NO: 2018069 - RNA, 22 nt, Homo sapiens
ccugugaggacugguugucucu

SEQ ID NO: 2018070 - RNA, 14 nt, Homo sapiens
caauaggagucuua

SEQ ID NO: 2018071 - RNA, 21 nt, Homo sapiens
gaggcccccuggugugucuga

SEQ ID NO: 2018072 - RNA, 17 nt, Homo sapiens
aacuucaccugcaaagc

SEQ ID NO: 2018073 - RNA, 17 nt, Homo sapiens
cucugucuuccugguca

SEQ ID NO: 2018074 - RNA, 12 nt, Homo sapiens
ccaugugaaaau

SEQ ID NO: 2018075 - RNA, 20 nt, Homo sapiens
aguggugugaucucggcuca

SEQ ID NO: 2018076 - RNA, 20 nt, Homo sapiens
gguuggggugacagucauca

SEQ ID NO: 2018077 - RNA, 19 nt, Homo sapiens
gaaagaaguucacaucaga

SEQ ID NO: 2018078 - RNA, 18 nt, Homo sapiens
uguuggcaaggagccagg

SEQ ID NO: 2018079 - RNA, 16 nt, Homo sapiens
uaaccacuaacauugu

SEQ ID NO: 2018080 - RNA, 18 nt, Homo sapiens
ugggaggcugugauuugc

SEQ ID NO: 2018081 - RNA, 22 nt, Homo sapiens
cugaaaucuacaggccucaggg

SEQ ID NO: 2018082 - RNA, 16 nt, Homo sapiens
gauauauuuauaucau

SEQ ID NO: 2018083 - RNA, 22 nt, Homo sapiens
gauucaauaaaaugcacugacc

SEQ ID NO: 2018084 - RNA, 22 nt, Homo sapiens
gagccuuggggaguccacaggc

SEQ ID NO: 2018085 - RNA, 19 nt, Homo sapiens
gaaagacuggcccucuagc

SEQ ID NO: 2018086 - RNA, 19 nt, Homo sapiens
ugauggcucauuuacacuc

SEQ ID NO: 2018087 - RNA, 17 nt, Homo sapiens
cauaucccuuccucuca

SEQ ID NO: 2018088 - RNA, 14 nt, Homo sapiens
cagcaggggcugcc

SEQ ID NO: 2018089 - RNA, 17 nt, Homo sapiens
ccaggcgugguggcaca

SEQ ID NO: 2018090 - RNA, 22 nt, Homo sapiens
aacauuuguuuuagucugaaca

SEQ ID NO: 2018091 - RNA, 21 nt, Homo sapiens
auaguguagaaaagaacugga

SEQ ID NO: 2018092 - RNA, 14 nt, Homo sapiens
cugaaguagccuga

SEQ ID NO: 2018093 - RNA, 14 nt, Homo sapiens
ggcagagccaucca

SEQ ID NO: 2018094 - RNA, 18 nt, Homo sapiens
uuauuauagaauugcaca

SEQ ID NO: 2018095 - RNA, 20 nt, Homo sapiens
gagaguacagugagccaaga

SEQ ID NO: 2018096 - RNA, 9 nt, Homo sapiens
uaccacagc

SEQ ID NO: 2018097 - RNA, 22 nt, Homo sapiens
cuggguucuggggcaucagcca

SEQ ID NO: 2018098 - RNA, 21 nt, Homo sapiens
uacgaugcaauucuagccaaa

SEQ ID NO: 2018099 - RNA, 23 nt, Homo sapiens
acacauccgccuuuuguauacau

SEQ ID NO: 2018100 - RNA, 17 nt, Homo sapiens
uacugaucuuuguauau

SEQ ID NO: 2018101 - RNA, 18 nt, Homo sapiens
aucugagggagacugcaa

SEQ ID NO: 2018102 - RNA, 21 nt, Homo sapiens
aaagauucgucaacuuucuua

SEQ ID NO: 2018103 - RNA, 22 nt, Homo sapiens
guugcacccagcccuggucuca

SEQ ID NO: 2018104 - RNA, 16 nt, Homo sapiens
ucggggacacaggcca

SEQ ID NO: 2018105 - RNA, 17 nt, Homo sapiens
agucaacaaccaugcca

SEQ ID NO: 2018106 - RNA, 14 nt, Homo sapiens
cuagcaacaacuua

SEQ ID NO: 2018107 - RNA, 20 nt, Homo sapiens
accacgggacaucacagggu

SEQ ID NO: 2018108 - RNA, 12 nt, Homo sapiens
aacuuguaaaua

SEQ ID NO: 2018109 - RNA, 22 nt, Homo sapiens
cauccugaccuccuggacugua

SEQ ID NO: 2018110 - RNA, 22 nt, Homo sapiens
aaaaugcaacauguguacuuaa

SEQ ID NO: 2018111 - RNA, 17 nt, Homo sapiens
ucugucuuuauaaucua

SEQ ID NO: 2018112 - RNA, 17 nt, Homo sapiens
aaaaaccugcaguuuug

SEQ ID NO: 2018113 - RNA, 23 nt, Homo sapiens
uucucaaaacccuuaaaagaagg

SEQ ID NO: 2018114 - RNA, 20 nt, Homo sapiens
cuugaaucucugaauuugag

SEQ ID NO: 2018115 - RNA, 16 nt, Homo sapiens
cugcuguaugugagcu

SEQ ID NO: 2018116 - RNA, 23 nt, Homo sapiens
uuggccagcaaaaacugugggaa

SEQ ID NO: 2018117 - RNA, 14 nt, Homo sapiens
aucccgucuuccag

SEQ ID NO: 2018118 - RNA, 14 nt, Homo sapiens
uuuccuucauucau

SEQ ID NO: 2018119 - RNA, 14 nt, Homo sapiens
aucccuucuuccau

SEQ ID NO: 2018120 - RNA, 14 nt, Homo sapiens
uuaaaaucauaaca

SEQ ID NO: 2018121 - RNA, 23 nt, Homo sapiens
gacaaugcugccaugcccaccau

SEQ ID NO: 2018122 - RNA, 15 nt, Homo sapiens
gcuuuagccauacac

SEQ ID NO: 2018123 - RNA, 15 nt, Homo sapiens
auguacugccuuagu

SEQ ID NO: 2018124 - RNA, 20 nt, Homo sapiens
uucgcuggcugaucauugca

SEQ ID NO: 2018125 - RNA, 22 nt, Homo sapiens
uguggcuuuugaauaucuucca

SEQ ID NO: 2018126 - RNA, 19 nt, Homo sapiens
gcccucugcauccucugga

SEQ ID NO: 2018127 - RNA, 14 nt, Homo sapiens
caagguuccacaga

SEQ ID NO: 2018128 - RNA, 16 nt, Homo sapiens
agcugccccucccuca

SEQ ID NO: 2018129 - RNA, 13 nt, Homo sapiens
gccugcuggagag

SEQ ID NO: 2018130 - RNA, 19 nt, Homo sapiens
uuacucccaggcacugucu

SEQ ID NO: 2018131 - RNA, 15 nt, Homo sapiens
agguuggagcagugc

SEQ ID NO: 2018132 - RNA, 14 nt, Homo sapiens
ccauuugacuguuc

SEQ ID NO: 2018133 - RNA, 12 nt, Homo sapiens
acuggacacaaa

SEQ ID NO: 2018134 - RNA, 20 nt, Homo sapiens
gaucauuucccaaaauucua

SEQ ID NO: 2018135 - RNA, 22 nt, Homo sapiens
ucaaaaugaaggcuuaguucaa

SEQ ID NO: 2018136 - RNA, 21 nt, Homo sapiens
ugucugaagguaauacuauaa

SEQ ID NO: 2018137 - RNA, 19 nt, Homo sapiens
uuacuagaagaugaauaca

SEQ ID NO: 2018138 - RNA, 17 nt, Homo sapiens
ugcaaacugagcugcuu

SEQ ID NO: 2018139 - RNA, 13 nt, Homo sapiens
uggcacauuucag

SEQ ID NO: 2018140 - RNA, 15 nt, Homo sapiens
gguaguuguggcuuu

SEQ ID NO: 2018141 - RNA, 21 nt, Homo sapiens
aaaugacuauuucuacccuuu

SEQ ID NO: 2018142 - RNA, 13 nt, Homo sapiens
gucccuuccaggc

SEQ ID NO: 2018143 - RNA, 13 nt, Homo sapiens
uucagcucugaaa

SEQ ID NO: 2018144 - RNA, 18 nt, Homo sapiens
uaauuucaugggacuaaa

SEQ ID NO: 2018145 - RNA, 21 nt, Homo sapiens
acucaucuugggaagggccau

SEQ ID NO: 2018146 - RNA, 17 nt, Homo sapiens
ugaagugucacagccug

SEQ ID NO: 2018147 - RNA, 14 nt, Homo sapiens
aauguguggugcua

SEQ ID NO: 2018148 - RNA, 15 nt, Homo sapiens
aaugaugccacuucc

SEQ ID NO: 2018149 - RNA, 13 nt, Homo sapiens
auaguacuauuaa

SEQ ID NO: 2018150 - RNA, 13 nt, Homo sapiens
aauguacuaaaaa

SEQ ID NO: 2018151 - RNA, 19 nt, Homo sapiens
auuuggacucuaagcucua

SEQ ID NO: 2018152 - RNA, 14 nt, Homo sapiens
cacaaauagaguuu

SEQ ID NO: 2018153 - RNA, 17 nt, Homo sapiens
acuccccauuggugcua

SEQ ID NO: 2018154 - RNA, 23 nt, Homo sapiens
ccacuguuaagccauguguucca

SEQ ID NO: 2018155 - RNA, 22 nt, Homo sapiens
ugguguagugcauggacaucua

SEQ ID NO: 2018156 - RNA, 10 nt, Homo sapiens
ugugugcaug

SEQ ID NO: 2018157 - RNA, 18 nt, Homo sapiens
auuuuuauuuuugcacaa

SEQ ID NO: 2018158 - RNA, 14 nt, Homo sapiens
uauuuccuuuccag

SEQ ID NO: 2018159 - RNA, 14 nt, Homo sapiens
aagacagauuacca

SEQ ID NO: 2018160 - RNA, 16 nt, Homo sapiens
agacauugcaccagau

SEQ ID NO: 2018161 - RNA, 22 nt, Homo sapiens
ugaagacccaggagagacagag

SEQ ID NO: 2018162 - RNA, 18 nt, Homo sapiens
uacaccucaaauaccacc

SEQ ID NO: 2018163 - RNA, 14 nt, Homo sapiens
gccaagaaugccca

SEQ ID NO: 2018164 - RNA, 23 nt, Homo sapiens
acugggcucccgggccccacaga

SEQ ID NO: 2018165 - RNA, 18 nt, Homo sapiens
cuuuggaagugaggcauu

SEQ ID NO: 2018166 - RNA, 14 nt, Homo sapiens
uaccuccugagaaa

SEQ ID NO: 2018167 - RNA, 20 nt, Homo sapiens
cugaacaauauauacuuaua

SEQ ID NO: 2018168 - RNA, 16 nt, Homo sapiens
cagaccaguacuggga

SEQ ID NO: 2018169 - RNA, 15 nt, Homo sapiens
uccaccaaguucuca

SEQ ID NO: 2018170 - RNA, 14 nt, Homo sapiens
ugaucuguacuuug

SEQ ID NO: 2018171 - RNA, 19 nt, Homo sapiens
cugagccccauacagggca

SEQ ID NO: 2018172 - RNA, 15 nt, Homo sapiens
uccaaaagaguccau

SEQ ID NO: 2018173 - RNA, 15 nt, Homo sapiens
agcacgugucucaga

SEQ ID NO: 2018174 - RNA, 20 nt, Homo sapiens
cacccugucucaguaccucc

SEQ ID NO: 2018175 - RNA, 16 nt, Homo sapiens
gucuccgcacuuggaa

SEQ ID NO: 2018176 - RNA, 17 nt, Homo sapiens
cugaaaagauccuauua

SEQ ID NO: 2018177 - RNA, 18 nt, Homo sapiens
uugauaguuuggcuauaa

SEQ ID NO: 2018178 - RNA, 17 nt, Homo sapiens
ucuuuggaggugcugcu

SEQ ID NO: 2018179 - RNA, 17 nt, Homo sapiens
gaccuguccaggugagu

SEQ ID NO: 2018180 - RNA, 23 nt, Homo sapiens
acacuacuugagaaaaugcagga

SEQ ID NO: 2018181 - RNA, 17 nt, Homo sapiens
ggcugaaggacugugac

SEQ ID NO: 2018182 - RNA, 17 nt, Homo sapiens
caacaaaaagacaugga

SEQ ID NO: 2018183 - RNA, 23 nt, Homo sapiens
aacagugggcguugggagccuag

SEQ ID NO: 2018184 - RNA, 19 nt, Homo sapiens
gugcuacucucacucagcc

SEQ ID NO: 2018185 - RNA, 13 nt, Homo sapiens
cuuugcuugccuc

SEQ ID NO: 2018186 - RNA, 15 nt, Homo sapiens
gcagaacuuaaucug

SEQ ID NO: 2018187 - RNA, 19 nt, Homo sapiens
cuuuuucuuuacaaacaaa

SEQ ID NO: 2018188 - RNA, 17 nt, Homo sapiens
gggcugguuuugcuucc

SEQ ID NO: 2018189 - RNA, 23 nt, Homo sapiens
aggggaccaugaagagacucucu

SEQ ID NO: 2018190 - RNA, 23 nt, Homo sapiens
acuuaauacaaaacugugaauac

SEQ ID NO: 2018191 - RNA, 23 nt, Homo sapiens
cugggagugguggcucaugccug

SEQ ID NO: 2018192 - RNA, 18 nt, Homo sapiens
cccagaccccgacaccgg

SEQ ID NO: 2018193 - RNA, 18 nt, Homo sapiens
aaucaagucagcaacaga

SEQ ID NO: 2018194 - RNA, 21 nt, Homo sapiens
caccugggucuuuaugcauga

SEQ ID NO: 2018195 - RNA, 20 nt, Homo sapiens
aaugcacaguacuguuucaa

SEQ ID NO: 2018196 - RNA, 13 nt, Homo sapiens
gauaucacuucca

SEQ ID NO: 2018197 - RNA, 14 nt, Homo sapiens
gcagccuucugaca

SEQ ID NO: 2018198 - RNA, 23 nt, Homo sapiens
auuaaguggcuuuuuaacaugaa

SEQ ID NO: 2018199 - RNA, 14 nt, Homo sapiens
ggcccugccaugcu

SEQ ID NO: 2018200 - RNA, 13 nt, Homo sapiens
caagaugguccau

SEQ ID NO: 2018201 - RNA, 19 nt, Homo sapiens
uacacaaggaaggcauuug

SEQ ID NO: 2018202 - RNA, 18 nt, Homo sapiens
cacagccaauaaacacca

SEQ ID NO: 2018203 - RNA, 13 nt, Homo sapiens
acgcuaccaaauc

SEQ ID NO: 2018204 - RNA, 15 nt, Homo sapiens
cugugcuacguguga

SEQ ID NO: 2018205 - RNA, 22 nt, Homo sapiens
gcaauuguuaaucaaagauuga

SEQ ID NO: 2018206 - RNA, 21 nt, Homo sapiens
gauucuguguuccuguccaaa

SEQ ID NO: 2018207 - RNA, 18 nt, Homo sapiens
uucuauuaaggacauuua

SEQ ID NO: 2018208 - RNA, 14 nt, Homo sapiens
uauuugcuaugucc

SEQ ID NO: 2018209 - RNA, 12 nt, Homo sapiens
cuguuucauuca

SEQ ID NO: 2018210 - RNA, 21 nt, Homo sapiens
cacugaaccuuguugaugcca

SEQ ID NO: 2018211 - RNA, 22 nt, Homo sapiens
ccugggugacagagcaagugag

SEQ ID NO: 2018212 - RNA, 20 nt, Homo sapiens
uaacuguucaaacucaggcc

SEQ ID NO: 2018213 - RNA, 11 nt, Homo sapiens
aagauggauuu

SEQ ID NO: 2018214 - RNA, 22 nt, Homo sapiens
agcauggguccuugaugccaga

SEQ ID NO: 2018215 - RNA, 20 nt, Homo sapiens
ugcugcuccccuaaagccag

SEQ ID NO: 2018216 - RNA, 14 nt, Homo sapiens
auuccaguggaaca

SEQ ID NO: 2018217 - RNA, 20 nt, Homo sapiens
cagccuccugaguagcuggg

SEQ ID NO: 2018218 - RNA, 18 nt, Homo sapiens
ugggagaugcugggaccc

SEQ ID NO: 2018219 - RNA, 22 nt, Homo sapiens
accacuucccgccuccaugacu

SEQ ID NO: 2018220 - RNA, 20 nt, Homo sapiens
cagcuccagcuguuaccuga

SEQ ID NO: 2018221 - RNA, 16 nt, Homo sapiens
uaauuauaaauaucau

SEQ ID NO: 2018222 - RNA, 11 nt, Homo sapiens
gggcccugacu

SEQ ID NO: 2018223 - RNA, 22 nt, Homo sapiens
acaguguuuuaauaaaugguuu

SEQ ID NO: 2018224 - RNA, 19 nt, Homo sapiens
ucuccuuuaaugacauuga

SEQ ID NO: 2018225 - RNA, 14 nt, Homo sapiens
aagccucauuugaa

SEQ ID NO: 2018226 - RNA, 14 nt, Homo sapiens
cuggcucccaggac

SEQ ID NO: 2018227 - RNA, 12 nt, Homo sapiens
ccuguugugugc

SEQ ID NO: 2018228 - RNA, 19 nt, Homo sapiens
aucaggugugcucagggga

SEQ ID NO: 2018229 - RNA, 13 nt, Homo sapiens
aguccugggagac

SEQ ID NO: 2018230 - RNA, 19 nt, Homo sapiens
auuggcccugacaaaaagg

SEQ ID NO: 2018231 - RNA, 17 nt, Homo sapiens
uggguccuuagugcaau

SEQ ID NO: 2018232 - RNA, 19 nt, Homo sapiens
uuggucacccuaaggaaag

SEQ ID NO: 2018233 - RNA, 12 nt, Homo sapiens
agaggggagcag

SEQ ID NO: 2018234 - RNA, 17 nt, Homo sapiens
gacacaggggacacuga

SEQ ID NO: 2018235 - RNA, 16 nt, Homo sapiens
gcuggcaauauuacaa

SEQ ID NO: 2018236 - RNA, 16 nt, Homo sapiens
agaagaagugaacacu

SEQ ID NO: 2018237 - RNA, 21 nt, Homo sapiens
ugcacaaaagggacuuggaaa

SEQ ID NO: 2018238 - RNA, 12 nt, Homo sapiens
cuggcugggcuu

SEQ ID NO: 2018239 - RNA, 15 nt, Homo sapiens
gaaagacacugccug

SEQ ID NO: 2018240 - RNA, 18 nt, Homo sapiens
gaaauaagcccaacagac

SEQ ID NO: 2018241 - RNA, 16 nt, Homo sapiens
cagcauggguccuuga

SEQ ID NO: 2018242 - RNA, 14 nt, Homo sapiens
ugugccaucagcuc

SEQ ID NO: 2018243 - RNA, 21 nt, Homo sapiens
gcaaaggggaggcaucagugu

SEQ ID NO: 2018244 - RNA, 16 nt, Homo sapiens
gaagaaagcucagagu

SEQ ID NO: 2018245 - RNA, 15 nt, Homo sapiens
ugggauuacagggau

SEQ ID NO: 2018246 - RNA, 19 nt, Homo sapiens
cacaaugcaucauaaaaca

SEQ ID NO: 2018247 - RNA, 21 nt, Homo sapiens
cccaguggaauggaaagaaug

SEQ ID NO: 2018248 - RNA, 16 nt, Homo sapiens
acuucgaaaccuggga

SEQ ID NO: 2018249 - RNA, 12 nt, Homo sapiens
ugaaggggccag

SEQ ID NO: 2018250 - RNA, 21 nt, Homo sapiens
ccuggcuguggguaucaggac

SEQ ID NO: 2018251 - RNA, 18 nt, Homo sapiens
uccugaagccucugcccu

SEQ ID NO: 2018252 - RNA, 20 nt, Homo sapiens
aaggagcaucagccagugaa

SEQ ID NO: 2018253 - RNA, 15 nt, Homo sapiens
accagaaagcuucau

SEQ ID NO: 2018254 - RNA, 12 nt, Homo sapiens
uuacuccagugg

SEQ ID NO: 2018255 - RNA, 18 nt, Homo sapiens
agcucacggaagggaugc

SEQ ID NO: 2018256 - RNA, 18 nt, Homo sapiens
uacaggugaaggcucuca

SEQ ID NO: 2018257 - RNA, 16 nt, Homo sapiens
uugcugaauguugcau

SEQ ID NO: 2018258 - RNA, 19 nt, Homo sapiens
ggauuuuauguugacauuu

SEQ ID NO: 2018259 - RNA, 19 nt, Homo sapiens
aagaagcaguuuacuuuag

SEQ ID NO: 2018260 - RNA, 17 nt, Homo sapiens
uuaauuuuccaaugcac

SEQ ID NO: 2018261 - RNA, 14 nt, Homo sapiens
gcucagccaagcuu

SEQ ID NO: 2018262 - RNA, 14 nt, Homo sapiens
ucacgccauugcac

SEQ ID NO: 2018263 - RNA, 14 nt, Homo sapiens
cucuugaucagugu

SEQ ID NO: 2018264 - RNA, 18 nt, Homo sapiens
ucugauguggcaaaaggc

SEQ ID NO: 2018265 - RNA, 18 nt, Homo sapiens
ugggggugccgcucucuc

SEQ ID NO: 2018266 - RNA, 19 nt, Homo sapiens
aaucacucacaagcaaucc

SEQ ID NO: 2018267 - RNA, 18 nt, Homo sapiens
ccuguggucucugaccag

SEQ ID NO: 2018268 - RNA, 16 nt, Homo sapiens
auguauauuuugauga

SEQ ID NO: 2018269 - RNA, 14 nt, Homo sapiens
cuugagggaccaau

SEQ ID NO: 2018270 - RNA, 15 nt, Homo sapiens
guuguggugugccau

SEQ ID NO: 2018271 - RNA, 18 nt, Homo sapiens
uugaaaagaaaaccacag

SEQ ID NO: 2018272 - RNA, 15 nt, Homo sapiens
uccauucacagccag

SEQ ID NO: 2018273 - RNA, 17 nt, Homo sapiens
uucccuucccagaccag

SEQ ID NO: 2018274 - RNA, 21 nt, Homo sapiens
uccuaauaauaucccacuggg

SEQ ID NO: 2018275 - RNA, 21 nt, Homo sapiens
cucuguuuucucucuguuaca

SEQ ID NO: 2018276 - RNA, 21 nt, Homo sapiens
uagacccccaagccccacuga

SEQ ID NO: 2018277 - RNA, 19 nt, Homo sapiens
guuuacuuuggacuaaaga

SEQ ID NO: 2018278 - RNA, 20 nt, Homo sapiens
uguggcaaacuugcaguuua

SEQ ID NO: 2018279 - RNA, 18 nt, Homo sapiens
uacaauaaaaacauugcc

SEQ ID NO: 2018280 - RNA, 21 nt, Homo sapiens
uuugcuaaaugugaaugauga

SEQ ID NO: 2018281 - RNA, 20 nt, Homo sapiens
uauuggaccagaaguccuau

SEQ ID NO: 2018282 - RNA, 22 nt, Homo sapiens
ugaauugcccguuuccauacag

SEQ ID NO: 2018283 - RNA, 14 nt, Homo sapiens
ugauaacuacugac

SEQ ID NO: 2018284 - RNA, 22 nt, Homo sapiens
auuauauuuccuuaaaauguga

SEQ ID NO: 2018285 - RNA, 17 nt, Homo sapiens
aggacugaaaagggaau

SEQ ID NO: 2018286 - RNA, 22 nt, Homo sapiens
uaccacaugccaagcacugugc

SEQ ID NO: 2018287 - RNA, 16 nt, Homo sapiens
guaacauccuuucuau

SEQ ID NO: 2018288 - RNA, 16 nt, Homo sapiens
uguugaagugagcuga

SEQ ID NO: 2018289 - RNA, 12 nt, Homo sapiens
gauuuuggcaaa

SEQ ID NO: 2018290 - RNA, 14 nt, Homo sapiens
aaaggaaaugauug

SEQ ID NO: 2018291 - RNA, 16 nt, Homo sapiens
aacacuagacaugcca

SEQ ID NO: 2018292 - RNA, 16 nt, Homo sapiens
caucuugaauuguaag

SEQ ID NO: 2018293 - RNA, 19 nt, Homo sapiens
guaccugaaagcacuguag

SEQ ID NO: 2018294 - RNA, 17 nt, Homo sapiens
aauuguuguucuguuaa

SEQ ID NO: 2018295 - RNA, 13 nt, Homo sapiens
acacuagucugug

SEQ ID NO: 2018296 - RNA, 13 nt, Homo sapiens
acaauacauauau

SEQ ID NO: 2018297 - RNA, 13 nt, Homo sapiens
aauguacaucagu

SEQ ID NO: 2018298 - RNA, 16 nt, Homo sapiens
ccccauaguucacuga

SEQ ID NO: 2018299 - RNA, 21 nt, Homo sapiens
ggcauaucggcucacaaagag

SEQ ID NO: 2018300 - RNA, 17 nt, Homo sapiens
aaugcaccuagcugugc

SEQ ID NO: 2018301 - RNA, 16 nt, Homo sapiens
uagaggagaaccugga

SEQ ID NO: 2018302 - RNA, 20 nt, Homo sapiens
aaaugacucuggggagguga

SEQ ID NO: 2018303 - RNA, 14 nt, Homo sapiens
gccuaauuuaccaa

SEQ ID NO: 2018304 - RNA, 20 nt, Homo sapiens
ucugugaccccuccuuguca

SEQ ID NO: 2018305 - RNA, 18 nt, Homo sapiens
aauaaauguuuuauuucu

SEQ ID NO: 2018306 - RNA, 16 nt, Homo sapiens
gcuuuggugcaucuca

SEQ ID NO: 2018307 - RNA, 16 nt, Homo sapiens
aggccuuacaucuggc

SEQ ID NO: 2018308 - RNA, 14 nt, Homo sapiens
cucgcuacaagaac

SEQ ID NO: 2018309 - RNA, 19 nt, Homo sapiens
caaguugguaaauucacaa

SEQ ID NO: 2018310 - RNA, 14 nt, Homo sapiens
uuaaaaaagcaaau

SEQ ID NO: 2018311 - RNA, 23 nt, Homo sapiens
aauaacauuuaaauuccacagau

SEQ ID NO: 2018312 - RNA, 16 nt, Homo sapiens
ucccucuaacaucucc

SEQ ID NO: 2018313 - RNA, 22 nt, Homo sapiens
gaccagaucagauaauuaugcu

SEQ ID NO: 2018314 - RNA, 16 nt, Homo sapiens
ugagcuccaguggaag

SEQ ID NO: 2018315 - RNA, 15 nt, Homo sapiens
aagagaucaagccau

SEQ ID NO: 2018316 - RNA, 15 nt, Homo sapiens
ugcccgaaaccagag

SEQ ID NO: 2018317 - RNA, 13 nt, Homo sapiens
guaccacuacuua

SEQ ID NO: 2018318 - RNA, 17 nt, Homo sapiens
uucuuauuuugcauucc

SEQ ID NO: 2018319 - RNA, 13 nt, Homo sapiens
agcuguugcuauu

SEQ ID NO: 2018320 - RNA, 17 nt, Homo sapiens
agagacacaaguggccu

SEQ ID NO: 2018321 - RNA, 18 nt, Homo sapiens
aucacacccacgggugcu

SEQ ID NO: 2018322 - RNA, 20 nt, Homo sapiens
accuuccaugucaagauuca

SEQ ID NO: 2018323 - RNA, 17 nt, Homo sapiens
ugcuaaaugcacugacc

SEQ ID NO: 2018324 - RNA, 13 nt, Homo sapiens
agcaaagucucca

SEQ ID NO: 2018325 - RNA, 23 nt, Homo sapiens
acauucuuggucacaaagcuauu

SEQ ID NO: 2018326 - RNA, 15 nt, Homo sapiens
gcacucauggguaau

SEQ ID NO: 2018327 - RNA, 14 nt, Homo sapiens
gucugugacauuuc

SEQ ID NO: 2018328 - RNA, 15 nt, Homo sapiens
uaauagaagcuuaaa

SEQ ID NO: 2018329 - RNA, 15 nt, Homo sapiens
auaacaaagcccuua

SEQ ID NO: 2018330 - RNA, 19 nt, Homo sapiens
aauucuguacuuccaauuu

SEQ ID NO: 2018331 - RNA, 14 nt, Homo sapiens
uaagcagaggaaua

SEQ ID NO: 2018332 - RNA, 16 nt, Homo sapiens
ccaaagagacuggagc

SEQ ID NO: 2018333 - RNA, 18 nt, Homo sapiens
aagucucuuuuuuacaaa

SEQ ID NO: 2018334 - RNA, 20 nt, Homo sapiens
gcaggaggccauuuacuuga

SEQ ID NO: 2018335 - RNA, 23 nt, Homo sapiens
cucccggguucaagcgauuuccu

SEQ ID NO: 2018336 - RNA, 15 nt, Homo sapiens
aaggaccuuggaaga

SEQ ID NO: 2018337 - RNA, 18 nt, Homo sapiens
gagaaacaggcucugaga

SEQ ID NO: 2018338 - RNA, 20 nt, Homo sapiens
gaauuugucggguucuccca

SEQ ID NO: 2018339 - RNA, 18 nt, Homo sapiens
uucccuugcacuguauca

SEQ ID NO: 2018340 - RNA, 19 nt, Homo sapiens
gccccaugaagccacagcc

SEQ ID NO: 2018341 - RNA, 12 nt, Homo sapiens
gaaaccaaaaca

SEQ ID NO: 2018342 - RNA, 17 nt, Homo sapiens
ggacagaauaauacaau

SEQ ID NO: 2018343 - RNA, 20 nt, Homo sapiens
guguuuaacauucacagccc

SEQ ID NO: 2018344 - RNA, 18 nt, Homo sapiens
acccuguagcgccagugu

SEQ ID NO: 2018345 - RNA, 17 nt, Homo sapiens
gccucccaaagugcuga

SEQ ID NO: 2018346 - RNA, 13 nt, Homo sapiens
uuggagacagggu

SEQ ID NO: 2018347 - RNA, 21 nt, Homo sapiens
caggccaggagacuguuaaag

SEQ ID NO: 2018348 - RNA, 12 nt, Homo sapiens
uggggaggacaa

SEQ ID NO: 2018349 - RNA, 19 nt, Homo sapiens
ugcuagcugcuaugggaaa

SEQ ID NO: 2018350 - RNA, 22 nt, Homo sapiens
uugaagagauuucaacauauca

SEQ ID NO: 2018351 - RNA, 16 nt, Homo sapiens
uacuauguacugccuu

SEQ ID NO: 2018352 - RNA, 20 nt, Homo sapiens
cuagguaggcuucuaccugc

SEQ ID NO: 2018353 - RNA, 22 nt, Homo sapiens
uccaucgcgccagcgaccucuc

SEQ ID NO: 2018354 - RNA, 19 nt, Homo sapiens
cagggcuauagcucaggac

SEQ ID NO: 2018355 - RNA, 19 nt, Homo sapiens
cuggacuuucuccaaaggc

SEQ ID NO: 2018356 - RNA, 18 nt, Homo sapiens
uauaaaaagaugaucgcu

SEQ ID NO: 2018357 - RNA, 21 nt, Homo sapiens
uuauauaauuuugcagcagaa

SEQ ID NO: 2018358 - RNA, 11 nt, Homo sapiens
gcuaaagcaac

SEQ ID NO: 2018359 - RNA, 18 nt, Homo sapiens
aagagaaacauucuuucc

SEQ ID NO: 2018360 - RNA, 14 nt, Homo sapiens
gcuuagcuugaggg

SEQ ID NO: 2018361 - RNA, 17 nt, Homo sapiens
gcaggucugcaggccac

SEQ ID NO: 2018362 - RNA, 16 nt, Homo sapiens
ggccagagggacuuug

SEQ ID NO: 2018363 - RNA, 14 nt, Homo sapiens
uuacaugaagcaga

SEQ ID NO: 2018364 - RNA, 10 nt, Homo sapiens
uaugugaaca

SEQ ID NO: 2018365 - RNA, 20 nt, Homo sapiens
cagaagcuuuuuguuugcau

SEQ ID NO: 2018366 - RNA, 19 nt, Homo sapiens
aagucucauggcaguccca

SEQ ID NO: 2018367 - RNA, 16 nt, Homo sapiens
gcucuuagcagcuucc

SEQ ID NO: 2018368 - RNA, 18 nt, Homo sapiens
guagaauauucagacaaa

SEQ ID NO: 2018369 - RNA, 15 nt, Homo sapiens
ccauucccaccagcu

SEQ ID NO: 2018370 - RNA, 17 nt, Homo sapiens
ugccauugucuuuccuc

SEQ ID NO: 2018371 - RNA, 13 nt, Homo sapiens
cuuggccccagag

SEQ ID NO: 2018372 - RNA, 23 nt, Homo sapiens
ccagauuggcucacacugagaau

SEQ ID NO: 2018373 - RNA, 17 nt, Homo sapiens
cauuucuuuucugcaug

SEQ ID NO: 2018374 - RNA, 16 nt, Homo sapiens
auuucaugugcuauag

SEQ ID NO: 2018375 - RNA, 17 nt, Homo sapiens
ccagggaggagucagua

SEQ ID NO: 2018376 - RNA, 21 nt, Homo sapiens
acgcguauuuacagccagugg

SEQ ID NO: 2018377 - RNA, 20 nt, Homo sapiens
cuuaauaaaagaacaugcuu

SEQ ID NO: 2018378 - RNA, 17 nt, Homo sapiens
cuggcauuacaggugug

SEQ ID NO: 2018379 - RNA, 23 nt, Homo sapiens
ucauucaguauuuauugagcauc

SEQ ID NO: 2018380 - RNA, 15 nt, Homo sapiens
gccauguggucauac

SEQ ID NO: 2018381 - RNA, 23 nt, Homo sapiens
ccucaggcccaggaguccaggcc

SEQ ID NO: 2018382 - RNA, 19 nt, Homo sapiens
cuucaaguuagcucaggag

SEQ ID NO: 2018383 - RNA, 15 nt, Homo sapiens
acaugcugugcucuu

SEQ ID NO: 2018384 - RNA, 15 nt, Homo sapiens
acucuaagacuacag

SEQ ID NO: 2018385 - RNA, 23 nt, Homo sapiens
ucuuuuaaagaaauaaccacugc

SEQ ID NO: 2018386 - RNA, 12 nt, Homo sapiens
agugcaucccag

SEQ ID NO: 2018387 - RNA, 12 nt, Homo sapiens
aacccugucucu

SEQ ID NO: 2018388 - RNA, 12 nt, Homo sapiens
cucccuguaacu

SEQ ID NO: 2018389 - RNA, 13 nt, Homo sapiens
cacaacauccuca

SEQ ID NO: 2018390 - RNA, 18 nt, Homo sapiens
caaaaauacucacauggc

SEQ ID NO: 2018391 - RNA, 15 nt, Homo sapiens
auccacugugccaug

SEQ ID NO: 2018392 - RNA, 17 nt, Homo sapiens
caggauuggcacaagcu

SEQ ID NO: 2018393 - RNA, 14 nt, Homo sapiens
ucuaaguguaaaaa

SEQ ID NO: 2018394 - RNA, 17 nt, Homo sapiens
aaaugguaagaguuucu

SEQ ID NO: 2018395 - RNA, 20 nt, Homo sapiens
cuuccugaguggugccaaac

SEQ ID NO: 2018396 - RNA, 12 nt, Homo sapiens
gcagcucaggga

SEQ ID NO: 2018397 - RNA, 18 nt, Homo sapiens
cuuguuaauugauuuggg

SEQ ID NO: 2018398 - RNA, 20 nt, Homo sapiens
uauuuagagacagagucuca

SEQ ID NO: 2018399 - RNA, 20 nt, Homo sapiens
ugcaugucugccuaugcacu

SEQ ID NO: 2018400 - RNA, 16 nt, Homo sapiens
auagucuggcaccaaa

SEQ ID NO: 2018401 - RNA, 12 nt, Homo sapiens
caguaguggaaa

SEQ ID NO: 2018402 - RNA, 19 nt, Homo sapiens
auauaguaacacacuucca

SEQ ID NO: 2018403 - RNA, 14 nt, Homo sapiens
guguuccccagcug

SEQ ID NO: 2018404 - RNA, 20 nt, Homo sapiens
auaaggcuguuaacauuaca

SEQ ID NO: 2018405 - RNA, 16 nt, Homo sapiens
ugaugcuaccaugccu

SEQ ID NO: 2018406 - RNA, 11 nt, Homo sapiens
gccugauggcc

SEQ ID NO: 2018407 - RNA, 22 nt, Homo sapiens
acacucugcagacugcuagugu

SEQ ID NO: 2018408 - RNA, 18 nt, Homo sapiens
gggaggaagcuacccaag

SEQ ID NO: 2018409 - RNA, 21 nt, Homo sapiens
aggcacccucagggagccucc

SEQ ID NO: 2018410 - RNA, 12 nt, Homo sapiens
aagcacauucca

SEQ ID NO: 2018411 - RNA, 16 nt, Homo sapiens
ugacauauuaugccug

SEQ ID NO: 2018412 - RNA, 18 nt, Homo sapiens
ccuguguugugcucagga

SEQ ID NO: 2018413 - RNA, 17 nt, Homo sapiens
cccucccagcugcacuu

SEQ ID NO: 2018414 - RNA, 22 nt, Homo sapiens
cuguggguccgauaauaucuuu

SEQ ID NO: 2018415 - RNA, 16 nt, Homo sapiens
gcaaagaaaagccaga

SEQ ID NO: 2018416 - RNA, 16 nt, Homo sapiens
cucaguagucagacug

SEQ ID NO: 2018417 - RNA, 23 nt, Homo sapiens
cugugcccagcacagugccugac

SEQ ID NO: 2018418 - RNA, 17 nt, Homo sapiens
cucuaacagcaccaaau

SEQ ID NO: 2018419 - RNA, 17 nt, Homo sapiens
aauguguuugaacaugu

SEQ ID NO: 2018420 - RNA, 22 nt, Homo sapiens
acugaguuaaauuauacuggag

SEQ ID NO: 2018421 - RNA, 22 nt, Homo sapiens
auuagagggagcccagucugga

SEQ ID NO: 2018422 - RNA, 22 nt, Homo sapiens
agcaggauggcuggaacacugu

SEQ ID NO: 2018423 - RNA, 17 nt, Homo sapiens
cccaggagccuaguaca

SEQ ID NO: 2018424 - RNA, 13 nt, Homo sapiens
uaaugaauaccuu

SEQ ID NO: 2018425 - RNA, 13 nt, Homo sapiens
aagacauaauuca

SEQ ID NO: 2018426 - RNA, 13 nt, Homo sapiens
aucuuccuuccuc

SEQ ID NO: 2018427 - RNA, 17 nt, Homo sapiens
cuuugcugcugcucuca

SEQ ID NO: 2018428 - RNA, 18 nt, Homo sapiens
agcaugcacacugagaau

SEQ ID NO: 2018429 - RNA, 17 nt, Homo sapiens
ucaucaaaaucugcaca

SEQ ID NO: 2018430 - RNA, 21 nt, Homo sapiens
gcguaccguacacagagggac

SEQ ID NO: 2018431 - RNA, 21 nt, Homo sapiens
gauccacccccaagcacucca

SEQ ID NO: 2018432 - RNA, 14 nt, Homo sapiens
cuuguucacacucu

SEQ ID NO: 2018433 - RNA, 19 nt, Homo sapiens
uguucuacccguuccaaaa

SEQ ID NO: 2018434 - RNA, 16 nt, Homo sapiens
acugucauauaaugca

SEQ ID NO: 2018435 - RNA, 17 nt, Homo sapiens
acacuaauacaccaggu

SEQ ID NO: 2018436 - RNA, 20 nt, Homo sapiens
ugcccagacucaaggccucc

SEQ ID NO: 2018437 - RNA, 15 nt, Homo sapiens
cagcuauaccugugc

SEQ ID NO: 2018438 - RNA, 18 nt, Homo sapiens
aauguuguccugugucau

SEQ ID NO: 2018439 - RNA, 15 nt, Homo sapiens
gcuggcugcaccccu

SEQ ID NO: 2018440 - RNA, 20 nt, Homo sapiens
uuucccauuuguugcugcug

SEQ ID NO: 2018441 - RNA, 21 nt, Homo sapiens
aagcaauuacaauacaucuaa

SEQ ID NO: 2018442 - RNA, 24 nt, Homo sapiens
aagaguucuauggagacuuugcug

SEQ ID NO: 2018443 - RNA, 13 nt, Homo sapiens
aucucuucagucu

SEQ ID NO: 2018444 - RNA, 20 nt, Homo sapiens
cauucaucuuguguuuuaua

SEQ ID NO: 2018445 - RNA, 19 nt, Homo sapiens
uaaaugacugucuuaucac

SEQ ID NO: 2018446 - RNA, 19 nt, Homo sapiens
ugagcacauuugacuccac

SEQ ID NO: 2018447 - RNA, 19 nt, Homo sapiens
caccacgagaaacauccug

SEQ ID NO: 2018448 - RNA, 23 nt, Homo sapiens
agagaauauuauaaagugcuuua

SEQ ID NO: 2018449 - RNA, 13 nt, Homo sapiens
uaaguauugacuc

SEQ ID NO: 2018450 - RNA, 23 nt, Homo sapiens
aauauuuucuuccuucucagcac

SEQ ID NO: 2018451 - RNA, 12 nt, Homo sapiens
agccuaaaucuc

SEQ ID NO: 2018452 - RNA, 18 nt, Homo sapiens
uccagauauccacauaaa

SEQ ID NO: 2018453 - RNA, 18 nt, Homo sapiens
accacagggccagaggga

SEQ ID NO: 2018454 - RNA, 18 nt, Homo sapiens
acuggcugucugccugua

SEQ ID NO: 2018455 - RNA, 20 nt, Homo sapiens
ucucugaguccuuugcuaau

SEQ ID NO: 2018456 - RNA, 13 nt, Homo sapiens
aucuguaagcucu

SEQ ID NO: 2018457 - RNA, 20 nt, Homo sapiens
caagugaugcuaaaaccuga

SEQ ID NO: 2018458 - RNA, 22 nt, Homo sapiens
uuaaauaaaaauuacuguguua

SEQ ID NO: 2018459 - RNA, 15 nt, Homo sapiens
uugucucacacagca

SEQ ID NO: 2018460 - RNA, 16 nt, Homo sapiens
auguuccguucaucug

SEQ ID NO: 2018461 - RNA, 16 nt, Homo sapiens
ugcauccaagguucua

SEQ ID NO: 2018462 - RNA, 19 nt, Homo sapiens
caaaaagggaaguaagcaa

SEQ ID NO: 2018463 - RNA, 17 nt, Homo sapiens
aggagaaaaagcuuaau

SEQ ID NO: 2018464 - RNA, 14 nt, Homo sapiens
ccaauuuuuuauaa

SEQ ID NO: 2018465 - RNA, 22 nt, Homo sapiens
agauuuaaaaaaagaacauaaa

SEQ ID NO: 2018466 - RNA, 21 nt, Homo sapiens
cauuuuguaaguugaagcaaa

SEQ ID NO: 2018467 - RNA, 15 nt, Homo sapiens
uccuaacauauaugu

SEQ ID NO: 2018468 - RNA, 18 nt, Homo sapiens
gcccacagcaggugcuga

SEQ ID NO: 2018469 - RNA, 20 nt, Homo sapiens
aacuuccgccuccuguguuc

SEQ ID NO: 2018470 - RNA, 18 nt, Homo sapiens
gaaccucauugcuaccac

SEQ ID NO: 2018471 - RNA, 19 nt, Homo sapiens
acagcuaacacacagcucc

SEQ ID NO: 2018472 - RNA, 14 nt, Homo sapiens
cugcuccgcugccu

SEQ ID NO: 2018473 - RNA, 23 nt, Homo sapiens
guuuccucagccucacccugcau

SEQ ID NO: 2018474 - RNA, 23 nt, Homo sapiens
ggcuaagucaagaucaacauucc

SEQ ID NO: 2018475 - RNA, 13 nt, Homo sapiens
ccguuucuuucaa

SEQ ID NO: 2018476 - RNA, 17 nt, Homo sapiens
uuugcuuaaaauugcua

SEQ ID NO: 2018477 - RNA, 14 nt, Homo sapiens
ggaaagauuacuuu

SEQ ID NO: 2018478 - RNA, 13 nt, Homo sapiens
gaagaacuugcau

SEQ ID NO: 2018479 - RNA, 18 nt, Homo sapiens
caaauuuuaucuccagau

SEQ ID NO: 2018480 - RNA, 15 nt, Homo sapiens
guccaauguaccaug

SEQ ID NO: 2018481 - RNA, 21 nt, Homo sapiens
cagaauaacugguacacuuca

SEQ ID NO: 2018482 - RNA, 17 nt, Homo sapiens
ggccacagccacuaauc

SEQ ID NO: 2018483 - RNA, 21 nt, Homo sapiens
gccuccuguggccugccaguc

SEQ ID NO: 2018484 - RNA, 23 nt, Homo sapiens
gcaucacugauucccucucccac

SEQ ID NO: 2018485 - RNA, 13 nt, Homo sapiens
uaaaggggguucu

SEQ ID NO: 2018486 - RNA, 14 nt, Homo sapiens
augaguauggauug

SEQ ID NO: 2018487 - RNA, 11 nt, Homo sapiens
aaucucugagc

SEQ ID NO: 2018488 - RNA, 16 nt, Homo sapiens
cauggguuuaccacua

SEQ ID NO: 2018489 - RNA, 14 nt, Homo sapiens
ccaccugucccacu

SEQ ID NO: 2018490 - RNA, 15 nt, Homo sapiens
caguuacauaauuca

SEQ ID NO: 2018491 - RNA, 15 nt, Homo sapiens
guaaucaacauucca

SEQ ID NO: 2018492 - RNA, 15 nt, Homo sapiens
guaacguacauuugu

SEQ ID NO: 2018493 - RNA, 22 nt, Homo sapiens
ugcuggcaccucagacaaucca

SEQ ID NO: 2018494 - RNA, 20 nt, Homo sapiens
uuacaucuccuugaucaugu

SEQ ID NO: 2018495 - RNA, 19 nt, Homo sapiens
uggagcccauccagucucc

SEQ ID NO: 2018496 - RNA, 23 nt, Homo sapiens
agccugcaguuauuaacacuaac

SEQ ID NO: 2018497 - RNA, 20 nt, Homo sapiens
uuaauuuggaaacuaauaaa

SEQ ID NO: 2018498 - RNA, 19 nt, Homo sapiens
caagaaagcauugccagcu

SEQ ID NO: 2018499 - RNA, 21 nt, Homo sapiens
caaauugggaaauccauucca

SEQ ID NO: 2018500 - RNA, 22 nt, Homo sapiens
gcuacugaugggaaugauuaag

SEQ ID NO: 2018501 - RNA, 21 nt, Homo sapiens
ucccaaugaaauacugagaug

SEQ ID NO: 2018502 - RNA, 23 nt, Homo sapiens
aguaggugggggaacacugagaa

SEQ ID NO: 2018503 - RNA, 16 nt, Homo sapiens
cauucaagagucucau

SEQ ID NO: 2018504 - RNA, 13 nt, Homo sapiens
gagucuugcuaua

SEQ ID NO: 2018505 - RNA, 15 nt, Homo sapiens
acaugguuaccucug

SEQ ID NO: 2018506 - RNA, 15 nt, Homo sapiens
guaaaaacuguucuc

SEQ ID NO: 2018507 - RNA, 21 nt, Homo sapiens
agugcugaaauaaaaugauaa

SEQ ID NO: 2018508 - RNA, 22 nt, Homo sapiens
ucauugucccucuucacucccc

SEQ ID NO: 2018509 - RNA, 21 nt, Homo sapiens
ugauagaagugcauucuccuc

SEQ ID NO: 2018510 - RNA, 17 nt, Homo sapiens
uaaaauuuccacaagca

SEQ ID NO: 2018511 - RNA, 14 nt, Homo sapiens
caggccuaccucac

SEQ ID NO: 2018512 - RNA, 21 nt, Homo sapiens
uaucuccagcggcccugucau

SEQ ID NO: 2018513 - RNA, 19 nt, Homo sapiens
aucucccugcuucauaucu

SEQ ID NO: 2018514 - RNA, 13 nt, Homo sapiens
ugaaucagaguga

SEQ ID NO: 2018515 - RNA, 17 nt, Homo sapiens
cccagagugaacacucu

SEQ ID NO: 2018516 - RNA, 15 nt, Homo sapiens
cuugauuaguguagu

SEQ ID NO: 2018517 - RNA, 20 nt, Homo sapiens
cucagccucccgaguagcug

SEQ ID NO: 2018518 - RNA, 14 nt, Homo sapiens
gguguauuugccag

SEQ ID NO: 2018519 - RNA, 14 nt, Homo sapiens
ucccuguugcugaa

SEQ ID NO: 2018520 - RNA, 11 nt, Homo sapiens
ugaaacauuug

SEQ ID NO: 2018521 - RNA, 18 nt, Homo sapiens
auagcgauuauaaucucc

SEQ ID NO: 2018522 - RNA, 23 nt, Homo sapiens
cacccaucguccaccccagugug

SEQ ID NO: 2018523 - RNA, 14 nt, Homo sapiens
gcauucacaucuca

SEQ ID NO: 2018524 - RNA, 16 nt, Homo sapiens
cguggacucugugcuc

SEQ ID NO: 2018525 - RNA, 22 nt, Homo sapiens
aaacugauuacguuuacauucu

SEQ ID NO: 2018526 - RNA, 14 nt, Homo sapiens
augucuccaucucu

SEQ ID NO: 2018527 - RNA, 22 nt, Homo sapiens
ggcaccuccuacgucaaacaug

SEQ ID NO: 2018528 - RNA, 20 nt, Homo sapiens
guuucaaguacuguaacugu

SEQ ID NO: 2018529 - RNA, 18 nt, Homo sapiens
uugucaccccaagccaua

SEQ ID NO: 2018530 - RNA, 16 nt, Homo sapiens
aauguaugagacuggg

SEQ ID NO: 2018531 - RNA, 16 nt, Homo sapiens
gcacccugacaagugu

SEQ ID NO: 2018532 - RNA, 17 nt, Homo sapiens
uggucuguuugacuuua

SEQ ID NO: 2018533 - RNA, 12 nt, Homo sapiens
agaagagggaga

SEQ ID NO: 2018534 - RNA, 20 nt, Homo sapiens
ugaauacucugcccucuaga

SEQ ID NO: 2018535 - RNA, 19 nt, Homo sapiens
uuuuuccgguguuguacua

SEQ ID NO: 2018536 - RNA, 20 nt, Homo sapiens
agauuugggagaagggcaga

SEQ ID NO: 2018537 - RNA, 14 nt, Homo sapiens
uuccaaucaugaaa

SEQ ID NO: 2018538 - RNA, 19 nt, Homo sapiens
uggaggggagggaucuccu

SEQ ID NO: 2018539 - RNA, 17 nt, Homo sapiens
aauuccaguuaaccuau

SEQ ID NO: 2018540 - RNA, 16 nt, Homo sapiens
uacugaguagcuuuca

SEQ ID NO: 2018541 - RNA, 14 nt, Homo sapiens
cuguuggucugucc

SEQ ID NO: 2018542 - RNA, 19 nt, Homo sapiens
acaagagaggcgucugcug

SEQ ID NO: 2018543 - RNA, 22 nt, Homo sapiens
gacccucgcaaaaugaugugaa

SEQ ID NO: 2018544 - RNA, 15 nt, Homo sapiens
cauuuggaccacagc

SEQ ID NO: 2018545 - RNA, 17 nt, Homo sapiens
uucaaggcccucagcau

SEQ ID NO: 2018546 - RNA, 12 nt, Homo sapiens
aagcuccaguga

SEQ ID NO: 2018547 - RNA, 22 nt, Homo sapiens
agccugacuagaacuccugucu

SEQ ID NO: 2018548 - RNA, 14 nt, Homo sapiens
ccacucccaggcag

SEQ ID NO: 2018549 - RNA, 21 nt, Homo sapiens
cuucugagcaccuacuuacau

SEQ ID NO: 2018550 - RNA, 23 nt, Homo sapiens
aagccccuuggcccucucccaug

SEQ ID NO: 2018551 - RNA, 17 nt, Homo sapiens
gauuuaauuuccagggu

SEQ ID NO: 2018552 - RNA, 20 nt, Homo sapiens
auggggucucgcucugucac

SEQ ID NO: 2018553 - RNA, 21 nt, Homo sapiens
uauucuuuguauuaccaaagc

SEQ ID NO: 2018554 - RNA, 13 nt, Homo sapiens
uaaaucaaaccag

SEQ ID NO: 2018555 - RNA, 20 nt, Homo sapiens
aaugaaaaacaaaaagcuaa

SEQ ID NO: 2018556 - RNA, 14 nt, Homo sapiens
ucaagccacauggu

SEQ ID NO: 2018557 - RNA, 16 nt, Homo sapiens
aaggaggccacgugau

SEQ ID NO: 2018558 - RNA, 22 nt, Homo sapiens
gaggacugguucugaggccaga

SEQ ID NO: 2018559 - RNA, 23 nt, Homo sapiens
aucauuuccugggagaaagacca

SEQ ID NO: 2018560 - RNA, 17 nt, Homo sapiens
cucagcaacaguggaau

SEQ ID NO: 2018561 - RNA, 12 nt, Homo sapiens
uaauuagugaac

SEQ ID NO: 2018562 - RNA, 21 nt, Homo sapiens
caagugauggucauucauauc

SEQ ID NO: 2018563 - RNA, 12 nt, Homo sapiens
agaaagcuuaag

SEQ ID NO: 2018564 - RNA, 17 nt, Homo sapiens
guguuccugugaucucg

SEQ ID NO: 2018565 - RNA, 13 nt, Homo sapiens
aucagacuugauu

SEQ ID NO: 2018566 - RNA, 22 nt, Homo sapiens
ucuggcagaggagggagcauca

SEQ ID NO: 2018567 - RNA, 21 nt, Homo sapiens
auccuucuccccaaggucugu

SEQ ID NO: 2018568 - RNA, 16 nt, Homo sapiens
uauuucucugaauuca

SEQ ID NO: 2018569 - RNA, 20 nt, Homo sapiens
cacucaaugguuaacuaauu

SEQ ID NO: 2018570 - RNA, 22 nt, Homo sapiens
caguuuaaaagcacgacagugg

SEQ ID NO: 2018571 - RNA, 17 nt, Homo sapiens
gcacgggaugcguggga

SEQ ID NO: 2018572 - RNA, 20 nt, Homo sapiens
cuaauuuucuagauuuucua

SEQ ID NO: 2018573 - RNA, 11 nt, Homo sapiens
cuucucccacc

SEQ ID NO: 2018574 - RNA, 12 nt, Homo sapiens
augcucaccuga

SEQ ID NO: 2018575 - RNA, 21 nt, Homo sapiens
ugacacaccccuaaguacaag

SEQ ID NO: 2018576 - RNA, 17 nt, Homo sapiens
uacuauuacuauuacua

SEQ ID NO: 2018577 - RNA, 14 nt, Homo sapiens
cuucuuaaucugaa

SEQ ID NO: 2018578 - RNA, 16 nt, Homo sapiens
agaaaaugugccauuu

SEQ ID NO: 2018579 - RNA, 18 nt, Homo sapiens
uucaugugguacuacuga

SEQ ID NO: 2018580 - RNA, 15 nt, Homo sapiens
gauuuaauguugauu

SEQ ID NO: 2018581 - RNA, 16 nt, Homo sapiens
ugggccuccaaagccc

SEQ ID NO: 2018582 - RNA, 16 nt, Homo sapiens
cagucuuccaccugga

SEQ ID NO: 2018583 - RNA, 14 nt, Homo sapiens
aagccccugcccau

SEQ ID NO: 2018584 - RNA, 20 nt, Homo sapiens
ugccuguuauaacucugcac

SEQ ID NO: 2018585 - RNA, 21 nt, Homo sapiens
uucacaaaaugcacuucuauu

SEQ ID NO: 2018586 - RNA, 21 nt, Homo sapiens
agugaccuuuucuucauuuug

SEQ ID NO: 2018587 - RNA, 16 nt, Homo sapiens
agaucucccuucucau

SEQ ID NO: 2018588 - RNA, 15 nt, Homo sapiens
cagccuucacuggag

SEQ ID NO: 2018589 - RNA, 19 nt, Homo sapiens
aggucauuacuaaccauag

SEQ ID NO: 2018590 - RNA, 14 nt, Homo sapiens
ucucguacuugaac

SEQ ID NO: 2018591 - RNA, 18 nt, Homo sapiens
uucaaagugugacauuca

SEQ ID NO: 2018592 - RNA, 18 nt, Homo sapiens
gucugaaaucagugccua

SEQ ID NO: 2018593 - RNA, 21 nt, Homo sapiens
aacuuacgaucucuugacaua

SEQ ID NO: 2018594 - RNA, 15 nt, Homo sapiens
ccccaugcacuguga

SEQ ID NO: 2018595 - RNA, 12 nt, Homo sapiens
uguguuucacaa

SEQ ID NO: 2018596 - RNA, 20 nt, Homo sapiens
augagucauccgcuaucaca

SEQ ID NO: 2018597 - RNA, 17 nt, Homo sapiens
aggacaguuaaguauuu

SEQ ID NO: 2018598 - RNA, 15 nt, Homo sapiens
acucuuauuacuguu

SEQ ID NO: 2018599 - RNA, 23 nt, Homo sapiens
acauuuuccugagaccucaauga

SEQ ID NO: 2018600 - RNA, 18 nt, Homo sapiens
cgacuaucccugcacaua

SEQ ID NO: 2018601 - RNA, 13 nt, Homo sapiens
aagugacacagca

SEQ ID NO: 2018602 - RNA, 13 nt, Homo sapiens
ccauuucacuggc

SEQ ID NO: 2018603 - RNA, 12 nt, Homo sapiens
ucucagacacua

SEQ ID NO: 2018604 - RNA, 22 nt, Homo sapiens
uaagagggcacacacuguguac

SEQ ID NO: 2018605 - RNA, 16 nt, Homo sapiens
cuucaaaacaauauaa

SEQ ID NO: 2018606 - RNA, 22 nt, Homo sapiens
gcaaacaguguucugugacaaa

SEQ ID NO: 2018607 - RNA, 18 nt, Homo sapiens
ccaaagcagcacuuauaa

SEQ ID NO: 2018608 - RNA, 21 nt, Homo sapiens
cuucccucucugcagacuucc

SEQ ID NO: 2018609 - RNA, 17 nt, Homo sapiens
gaaaaaaaaagaauuac

SEQ ID NO: 2018610 - RNA, 16 nt, Homo sapiens
gaugaaauaacuccuu

SEQ ID NO: 2018611 - RNA, 15 nt, Homo sapiens
uggugcccaccagcu

SEQ ID NO: 2018612 - RNA, 16 nt, Homo sapiens
cucaagcuaaguaaaa

SEQ ID NO: 2018613 - RNA, 21 nt, Homo sapiens
gaggacagccugccucugcca

SEQ ID NO: 2018614 - RNA, 11 nt, Homo sapiens
uugcacuuugu

SEQ ID NO: 2018615 - RNA, 16 nt, Homo sapiens
aaaagccguaacccag

SEQ ID NO: 2018616 - RNA, 15 nt, Homo sapiens
cgacccacucucaaa

SEQ ID NO: 2018617 - RNA, 15 nt, Homo sapiens
ccuccuaaauuucca

SEQ ID NO: 2018618 - RNA, 20 nt, Homo sapiens
cuaaaauauauauagaaaua

SEQ ID NO: 2018619 - RNA, 21 nt, Homo sapiens
uggacuucuuaguuguuucuc

SEQ ID NO: 2018620 - RNA, 16 nt, Homo sapiens
aagaacugaagcucuu

SEQ ID NO: 2018621 - RNA, 19 nt, Homo sapiens
auaccaaaauguugcugaa

SEQ ID NO: 2018622 - RNA, 21 nt, Homo sapiens
gaaugauucacauccucucaa

SEQ ID NO: 2018623 - RNA, 14 nt, Homo sapiens
aaaugaccucaagg

SEQ ID NO: 2018624 - RNA, 14 nt, Homo sapiens
gaagaucaggccaa

SEQ ID NO: 2018625 - RNA, 13 nt, Homo sapiens
guguaccagagaa

SEQ ID NO: 2018626 - RNA, 17 nt, Homo sapiens
caucacuguaaagacaa

SEQ ID NO: 2018627 - RNA, 17 nt, Homo sapiens
agaauccccacagggaa

SEQ ID NO: 2018628 - RNA, 19 nt, Homo sapiens
gucugaacucccgccacau

SEQ ID NO: 2018629 - RNA, 15 nt, Homo sapiens
cucuacacccugaag

SEQ ID NO: 2018630 - RNA, 14 nt, Homo sapiens
caggccaaagaucc

SEQ ID NO: 2018631 - RNA, 15 nt, Homo sapiens
uuagcuguaaacuga

SEQ ID NO: 2018632 - RNA, 22 nt, Homo sapiens
auagucucauucugucacccag

SEQ ID NO: 2018633 - RNA, 17 nt, Homo sapiens
gaacuuaaccuugcaaa

SEQ ID NO: 2018634 - RNA, 22 nt, Homo sapiens
agauguauuuguuguagacuua

SEQ ID NO: 2018635 - RNA, 21 nt, Homo sapiens
ucuguguuggcccaagcucuu

SEQ ID NO: 2018636 - RNA, 12 nt, Homo sapiens
uaaaaucaggaa

SEQ ID NO: 2018637 - RNA, 13 nt, Homo sapiens
agccuuaagccau

SEQ ID NO: 2018638 - RNA, 22 nt, Homo sapiens
cuucuuggacuucuugaaauca

SEQ ID NO: 2018639 - RNA, 18 nt, Homo sapiens
ugggcugcacaggcacug

SEQ ID NO: 2018640 - RNA, 18 nt, Homo sapiens
accuuuggcugguagcag

SEQ ID NO: 2018641 - RNA, 23 nt, Homo sapiens
uaaauugggaaaacuccaucaau

SEQ ID NO: 2018642 - RNA, 16 nt, Homo sapiens
cuagggccucagucug

SEQ ID NO: 2018643 - RNA, 16 nt, Homo sapiens
cuagucugucagggcc

SEQ ID NO: 2018644 - RNA, 14 nt, Homo sapiens
ggacagauugccug

SEQ ID NO: 2018645 - RNA, 20 nt, Homo sapiens
gucacaggaagaaagcagaa

SEQ ID NO: 2018646 - RNA, 19 nt, Homo sapiens
ccauggcuggaugugcauc

SEQ ID NO: 2018647 - RNA, 21 nt, Homo sapiens
auacaccuacugguuaaauaa

SEQ ID NO: 2018648 - RNA, 18 nt, Homo sapiens
agacaugagcauggcuga

SEQ ID NO: 2018649 - RNA, 14 nt, Homo sapiens
caccgguuaacugu

SEQ ID NO: 2018650 - RNA, 18 nt, Homo sapiens
auaaugagauguaacuca

SEQ ID NO: 2018651 - RNA, 18 nt, Homo sapiens
uacauagucuguuccuuu

SEQ ID NO: 2018652 - RNA, 17 nt, Homo sapiens
gaaucuacuaauuccac

SEQ ID NO: 2018653 - RNA, 18 nt, Homo sapiens
ucccaaauagcagcacag

SEQ ID NO: 2018654 - RNA, 23 nt, Homo sapiens
ggaagauauaacauucaguuccc

SEQ ID NO: 2018655 - RNA, 22 nt, Homo sapiens
gacugugaaggguguacucccu

SEQ ID NO: 2018656 - RNA, 13 nt, Homo sapiens
caaugcagugcag

SEQ ID NO: 2018657 - RNA, 22 nt, Homo sapiens
gcguaacaaacaaaaucaugga

SEQ ID NO: 2018658 - RNA, 19 nt, Homo sapiens
aguuaauccacaucuuuac

SEQ ID NO: 2018659 - RNA, 23 nt, Homo sapiens
gugaugccucccuguugaagcuc

SEQ ID NO: 2018660 - RNA, 17 nt, Homo sapiens
ugagcccaaggcacuga

SEQ ID NO: 2018661 - RNA, 17 nt, Homo sapiens
uuuaaugaugugucaua

SEQ ID NO: 2018662 - RNA, 13 nt, Homo sapiens
cucgcuguugcug

SEQ ID NO: 2018663 - RNA, 16 nt, Homo sapiens
ucacuggcuggccuga

SEQ ID NO: 2018664 - RNA, 21 nt, Homo sapiens
acgugguggcccagcuccuca

SEQ ID NO: 2018665 - RNA, 22 nt, Homo sapiens
caauggauauuuguacuguuua

SEQ ID NO: 2018666 - RNA, 20 nt, Homo sapiens
uaaggucuuggaacuugccu

SEQ ID NO: 2018667 - RNA, 22 nt, Homo sapiens
cuggccucacauuucucugugu

SEQ ID NO: 2018668 - RNA, 16 nt, Homo sapiens
gcuuaacacuaccaau

SEQ ID NO: 2018669 - RNA, 22 nt, Homo sapiens
uggaagauuagagguuugucaa

SEQ ID NO: 2018670 - RNA, 19 nt, Homo sapiens
aggaaggacuaugacaaau

SEQ ID NO: 2018671 - RNA, 10 nt, Homo sapiens
auucagcgaa

SEQ ID NO: 2018672 - RNA, 21 nt, Homo sapiens
aaagcaaaggauguguuuuca

SEQ ID NO: 2018673 - RNA, 22 nt, Homo sapiens
accuuggagaggagaguggcag

SEQ ID NO: 2018674 - RNA, 13 nt, Homo sapiens
auacccguugaua

SEQ ID NO: 2018675 - RNA, 15 nt, Homo sapiens
guuaaaaaaauggaa

SEQ ID NO: 2018676 - RNA, 16 nt, Homo sapiens
uggccagccagaucaa

SEQ ID NO: 2018677 - RNA, 17 nt, Homo sapiens
cacuauauugcacaggc

SEQ ID NO: 2018678 - RNA, 14 nt, Homo sapiens
gauucaccaaaaua

SEQ ID NO: 2018679 - RNA, 16 nt, Homo sapiens
aucuuuagugcuuucu

SEQ ID NO: 2018680 - RNA, 20 nt, Homo sapiens
aggccaagcccaauacagcc

SEQ ID NO: 2018681 - RNA, 14 nt, Homo sapiens
uuaaaauaagaaca

SEQ ID NO: 2018682 - RNA, 14 nt, Homo sapiens
aguccauauuucaa

SEQ ID NO: 2018683 - RNA, 14 nt, Homo sapiens
ugcaaauaaucaca

SEQ ID NO: 2018684 - RNA, 22 nt, Homo sapiens
acagguuuuguguuuugucauu

SEQ ID NO: 2018685 - RNA, 16 nt, Homo sapiens
gugcuauaacauucug

SEQ ID NO: 2018686 - RNA, 14 nt, Homo sapiens
cuccccucccugcc

SEQ ID NO: 2018687 - RNA, 16 nt, Homo sapiens
auaaauucaucagaau

SEQ ID NO: 2018688 - RNA, 14 nt, Homo sapiens
ggugggacagggac

SEQ ID NO: 2018689 - RNA, 16 nt, Homo sapiens
guauucaucuuuugua

SEQ ID NO: 2018690 - RNA, 16 nt, Homo sapiens
ccuggcuugcagggaa

SEQ ID NO: 2018691 - RNA, 15 nt, Homo sapiens
aauuuuacugugaaa

SEQ ID NO: 2018692 - RNA, 12 nt, Homo sapiens
cacgaauggacc

SEQ ID NO: 2018693 - RNA, 13 nt, Homo sapiens
cuggcucagggag

SEQ ID NO: 2018694 - RNA, 17 nt, Homo sapiens
uguacagaugaaugaua

SEQ ID NO: 2018695 - RNA, 20 nt, Homo sapiens
aacccaacuaaagugcuuga

SEQ ID NO: 2018696 - RNA, 18 nt, Homo sapiens
gauaggaguucacuucau

SEQ ID NO: 2018697 - RNA, 20 nt, Homo sapiens
gacaggcuucgucucagaag

SEQ ID NO: 2018698 - RNA, 16 nt, Homo sapiens
uauguauuaagccaaa

SEQ ID NO: 2018699 - RNA, 16 nt, Homo sapiens
cuuaaaggaccuuccc

SEQ ID NO: 2018700 - RNA, 19 nt, Homo sapiens
caagauuuuuucauuucaa

SEQ ID NO: 2018701 - RNA, 20 nt, Homo sapiens
guaucuaccucacuauucaa

SEQ ID NO: 2018702 - RNA, 16 nt, Homo sapiens
ugcuggcuugcacuuu

SEQ ID NO: 2018703 - RNA, 16 nt, Homo sapiens
gacuggaacuugaacu

SEQ ID NO: 2018704 - RNA, 17 nt, Homo sapiens
agaaacaugacacugac

SEQ ID NO: 2018705 - RNA, 13 nt, Homo sapiens
cuuuaaaacaaaa

SEQ ID NO: 2018706 - RNA, 15 nt, Homo sapiens
ccaauggugcuuccc

SEQ ID NO: 2018707 - RNA, 17 nt, Homo sapiens
auuucuuaccaguguga

SEQ ID NO: 2018708 - RNA, 14 nt, Homo sapiens
cauauaaguuugaa

SEQ ID NO: 2018709 - RNA, 17 nt, Homo sapiens
ccuaggaggcuggccaa

SEQ ID NO: 2018710 - RNA, 18 nt, Homo sapiens
uacucuugaaauguagaa

SEQ ID NO: 2018711 - RNA, 14 nt, Homo sapiens
cagaaacaaaaagc

SEQ ID NO: 2018712 - RNA, 18 nt, Homo sapiens
caugaugaccugaaguuc

SEQ ID NO: 2018713 - RNA, 14 nt, Homo sapiens
auuaacaaaaugua

SEQ ID NO: 2018714 - RNA, 15 nt, Homo sapiens
acuguugagucaaaa

SEQ ID NO: 2018715 - RNA, 18 nt, Homo sapiens
uacaggugugugccacca

SEQ ID NO: 2018716 - RNA, 15 nt, Homo sapiens
aucaagaugugacau

SEQ ID NO: 2018717 - RNA, 12 nt, Homo sapiens
agcaucuucuca

SEQ ID NO: 2018718 - RNA, 22 nt, Homo sapiens
gcccagaauccccaagugccug

SEQ ID NO: 2018719 - RNA, 22 nt, Homo sapiens
ucuuagggcaucgcuccuccuc

SEQ ID NO: 2018720 - RNA, 14 nt, Homo sapiens
gauucacaucucau

SEQ ID NO: 2018721 - RNA, 19 nt, Homo sapiens
aggcagugggucuucccuc

SEQ ID NO: 2018722 - RNA, 16 nt, Homo sapiens
acuuugagcuacugcc

SEQ ID NO: 2018723 - RNA, 19 nt, Homo sapiens
gcagccagauccccagggc

SEQ ID NO: 2018724 - RNA, 16 nt, Homo sapiens
aaauugggcaugccau

SEQ ID NO: 2018725 - RNA, 21 nt, Homo sapiens
acuugucagugggaaacaaac

SEQ ID NO: 2018726 - RNA, 13 nt, Homo sapiens
aguucucuucucc

SEQ ID NO: 2018727 - RNA, 15 nt, Homo sapiens
cagagagaggcauuu

SEQ ID NO: 2018728 - RNA, 15 nt, Homo sapiens
gaaggcagcuugugg

SEQ ID NO: 2018729 - RNA, 23 nt, Homo sapiens
ggaacagcacuggggagucuuug

SEQ ID NO: 2018730 - RNA, 13 nt, Homo sapiens
gcuguaaagcaaa

SEQ ID NO: 2018731 - RNA, 13 nt, Homo sapiens
ugugaaaaugaau

SEQ ID NO: 2018732 - RNA, 23 nt, Homo sapiens
uagcccaccuggguuggaggaag

SEQ ID NO: 2018733 - RNA, 16 nt, Homo sapiens
gacaggaaaggcccuc

SEQ ID NO: 2018734 - RNA, 22 nt, Homo sapiens
aggcugcagaugaucagggauc

SEQ ID NO: 2018735 - RNA, 23 nt, Homo sapiens
aaccguguaacacgugaaggcaa

SEQ ID NO: 2018736 - RNA, 15 nt, Homo sapiens
uccaacuuucacagu

SEQ ID NO: 2018737 - RNA, 15 nt, Homo sapiens
ucuuggaucugccau

SEQ ID NO: 2018738 - RNA, 15 nt, Homo sapiens
uaccagagauuuacc

SEQ ID NO: 2018739 - RNA, 22 nt, Homo sapiens
uggcuugacuguuuucuuuaug

SEQ ID NO: 2018740 - RNA, 14 nt, Homo sapiens
aagggaaagccaga

SEQ ID NO: 2018741 - RNA, 21 nt, Homo sapiens
acauagccagauguagucuca

SEQ ID NO: 2018742 - RNA, 14 nt, Homo sapiens
gaaaacuucucaca

SEQ ID NO: 2018743 - RNA, 14 nt, Homo sapiens
cccuguucaugccg

SEQ ID NO: 2018744 - RNA, 16 nt, Homo sapiens
cuuggcagccuuguga

SEQ ID NO: 2018745 - RNA, 14 nt, Homo sapiens
cacacccaacuaau

SEQ ID NO: 2018746 - RNA, 14 nt, Homo sapiens
gaaaaucauuugag

SEQ ID NO: 2018747 - RNA, 12 nt, Homo sapiens
gagucuaccucu

SEQ ID NO: 2018748 - RNA, 14 nt, Homo sapiens
acaauaaauguauu

SEQ ID NO: 2018749 - RNA, 18 nt, Homo sapiens
ccaguucccagaaggcau

SEQ ID NO: 2018750 - RNA, 14 nt, Homo sapiens
auuccugcuucucu

SEQ ID NO: 2018751 - RNA, 22 nt, Homo sapiens
ccgguugcuggucaggucccca

SEQ ID NO: 2018752 - RNA, 18 nt, Homo sapiens
gcagcuggggcuagggga

SEQ ID NO: 2018753 - RNA, 20 nt, Homo sapiens
guacauuccugauacugggu

SEQ ID NO: 2018754 - RNA, 23 nt, Homo sapiens
auuucaaaacucauuuccuaugu

SEQ ID NO: 2018755 - RNA, 15 nt, Homo sapiens
cuucugaggaugcug

SEQ ID NO: 2018756 - RNA, 13 nt, Homo sapiens
aagcacaacugaa

SEQ ID NO: 2018757 - RNA, 20 nt, Homo sapiens
aacauagauuuaagugaaua

SEQ ID NO: 2018758 - RNA, 20 nt, Homo sapiens
gagacuccucaguucuugcc

SEQ ID NO: 2018759 - RNA, 13 nt, Homo sapiens
auucuaaaccaaa

SEQ ID NO: 2018760 - RNA, 21 nt, Homo sapiens
auguugucacugguggcucau

SEQ ID NO: 2018761 - RNA, 14 nt, Homo sapiens
augggcacuggaaa

SEQ ID NO: 2018762 - RNA, 13 nt, Homo sapiens
uggcccaagaccc

SEQ ID NO: 2018763 - RNA, 22 nt, Homo sapiens
uuaauaaaccauuuuuacuugg

SEQ ID NO: 2018764 - RNA, 14 nt, Homo sapiens
accucaaaacacuu

SEQ ID NO: 2018765 - RNA, 22 nt, Homo sapiens
augcugcugagcacaucucuuc

SEQ ID NO: 2018766 - RNA, 14 nt, Homo sapiens
uugcccaugccucc

SEQ ID NO: 2018767 - RNA, 14 nt, Homo sapiens
cuuccaaggccaga

SEQ ID NO: 2018768 - RNA, 16 nt, Homo sapiens
agucguuucaggacau

SEQ ID NO: 2018769 - RNA, 18 nt, Homo sapiens
agcagcggccgcucgccc

SEQ ID NO: 2018770 - RNA, 17 nt, Homo sapiens
uaaugagggcugaguuu

SEQ ID NO: 2018771 - RNA, 17 nt, Homo sapiens
aaagauuuaagcacaaa

SEQ ID NO: 2018772 - RNA, 21 nt, Homo sapiens
ugcagacaacccuguccucag

SEQ ID NO: 2018773 - RNA, 15 nt, Homo sapiens
cugcuucugcacuuc

SEQ ID NO: 2018774 - RNA, 20 nt, Homo sapiens
aguaaguaccacucaggcca

SEQ ID NO: 2018775 - RNA, 21 nt, Homo sapiens
uccucuguucuaaccacuuca

SEQ ID NO: 2018776 - RNA, 19 nt, Homo sapiens
agguauaaggacucacaca

SEQ ID NO: 2018777 - RNA, 16 nt, Homo sapiens
aagugggacauucaaa

SEQ ID NO: 2018778 - RNA, 21 nt, Homo sapiens
uggggcuaggaaauccagggu

SEQ ID NO: 2018779 - RNA, 20 nt, Homo sapiens
aaccaauuuguucugugcaa

SEQ ID NO: 2018780 - RNA, 17 nt, Homo sapiens
ggcaaaugagugacaau

SEQ ID NO: 2018781 - RNA, 13 nt, Homo sapiens
cuuaaaaacucac

SEQ ID NO: 2018782 - RNA, 13 nt, Homo sapiens
uuuaaaaauucac

SEQ ID NO: 2018783 - RNA, 14 nt, Homo sapiens
cuuuauagcuuugg

SEQ ID NO: 2018784 - RNA, 13 nt, Homo sapiens
aaagaagcuuuau

SEQ ID NO: 2018785 - RNA, 17 nt, Homo sapiens
caaaacaaaacaacaac

SEQ ID NO: 2018786 - RNA, 23 nt, Homo sapiens
aguuuccagcuaagccugaugau

SEQ ID NO: 2018787 - RNA, 13 nt, Homo sapiens
ccucuuugaggga

SEQ ID NO: 2018788 - RNA, 20 nt, Homo sapiens
cagacugaucaggaccucca

SEQ ID NO: 2018789 - RNA, 15 nt, Homo sapiens
ccauugguccaagau

SEQ ID NO: 2018790 - RNA, 12 nt, Homo sapiens
gaguuggucacc

SEQ ID NO: 2018791 - RNA, 18 nt, Homo sapiens
gagcaguagguaggcuca

SEQ ID NO: 2018792 - RNA, 18 nt, Homo sapiens
ccguacgacucuuuucca

SEQ ID NO: 2018793 - RNA, 14 nt, Homo sapiens
auguguggacucaa

SEQ ID NO: 2018794 - RNA, 22 nt, Homo sapiens
acuuuuuucuuauuuaacuuaa

SEQ ID NO: 2018795 - RNA, 17 nt, Homo sapiens
gcuggaagacugugcag

SEQ ID NO: 2018796 - RNA, 12 nt, Homo sapiens
uugcgucaugua

SEQ ID NO: 2018797 - RNA, 23 nt, Homo sapiens
caccgguguccuguuccugccac

SEQ ID NO: 2018798 - RNA, 16 nt, Homo sapiens
gacagucucacucugu

SEQ ID NO: 2018799 - RNA, 20 nt, Homo sapiens
uugcaucguggagacagggc

SEQ ID NO: 2018800 - RNA, 23 nt, Homo sapiens
auucuccucaguggcuucuccag

SEQ ID NO: 2018801 - RNA, 20 nt, Homo sapiens
cuggguaagaagaaagcaaa

SEQ ID NO: 2018802 - RNA, 15 nt, Homo sapiens
uugacagaagcuauu

SEQ ID NO: 2018803 - RNA, 22 nt, Homo sapiens
cugucaccacgugcaguaucuc

SEQ ID NO: 2018804 - RNA, 17 nt, Homo sapiens
ucagauguguguucuca

SEQ ID NO: 2018805 - RNA, 16 nt, Homo sapiens
cagccgugagugcaga

SEQ ID NO: 2018806 - RNA, 15 nt, Homo sapiens
uucauuuguaacuuu

SEQ ID NO: 2018807 - RNA, 23 nt, Homo sapiens
gagggaggaacguggucaacuca

SEQ ID NO: 2018808 - RNA, 19 nt, Homo sapiens
aacucucugagauguguuc

SEQ ID NO: 2018809 - RNA, 14 nt, Homo sapiens
ugauuuuuuuccac

SEQ ID NO: 2018810 - RNA, 18 nt, Homo sapiens
ucaugaguaccucaaagg

SEQ ID NO: 2018811 - RNA, 14 nt, Homo sapiens
ugaggcuucucagc

SEQ ID NO: 2018812 - RNA, 22 nt, Homo sapiens
uuuaugcagaagcauauuuugc

SEQ ID NO: 2018813 - RNA, 14 nt, Homo sapiens
cagcugugcacuuu

SEQ ID NO: 2018814 - RNA, 14 nt, Homo sapiens
caguagugcaccau

SEQ ID NO: 2018815 - RNA, 22 nt, Homo sapiens
ucugacugagagcccacugcag

SEQ ID NO: 2018816 - RNA, 15 nt, Homo sapiens
gacucugaccacagc

SEQ ID NO: 2018817 - RNA, 19 nt, Homo sapiens
guuuaauggguaugcucag

SEQ ID NO: 2018818 - RNA, 13 nt, Homo sapiens
gucugaccagaga

SEQ ID NO: 2018819 - RNA, 15 nt, Homo sapiens
aucuagguucaggaa

SEQ ID NO: 2018820 - RNA, 18 nt, Homo sapiens
uuuaauauuuccaaugug

SEQ ID NO: 2018821 - RNA, 20 nt, Homo sapiens
ucuuugccuguucaguuaca

SEQ ID NO: 2018822 - RNA, 11 nt, Homo sapiens
aauaugugauu

SEQ ID NO: 2018823 - RNA, 17 nt, Homo sapiens
caaugaacccccaugau

SEQ ID NO: 2018824 - RNA, 19 nt, Homo sapiens
ggagauuugcucaauaccu

SEQ ID NO: 2018825 - RNA, 20 nt, Homo sapiens
agauuuaaagaaaaccacag

SEQ ID NO: 2018826 - RNA, 19 nt, Homo sapiens
cccacuaucugggugcaug

SEQ ID NO: 2018827 - RNA, 19 nt, Homo sapiens
caccaaagaauuguaggca

SEQ ID NO: 2018828 - RNA, 18 nt, Homo sapiens
ccagguacgcacagacag

SEQ ID NO: 2018829 - RNA, 22 nt, Homo sapiens
acacacagguggugucacuguc

SEQ ID NO: 2018830 - RNA, 14 nt, Homo sapiens
cuauaaaaacugcc

SEQ ID NO: 2018831 - RNA, 14 nt, Homo sapiens
ccagaaaaauuucc

SEQ ID NO: 2018832 - RNA, 14 nt, Homo sapiens
accucuuggcuuug

SEQ ID NO: 2018833 - RNA, 19 nt, Homo sapiens
ccaucuccaagaaugcuga

SEQ ID NO: 2018834 - RNA, 18 nt, Homo sapiens
auccaauccuagcccuca

SEQ ID NO: 2018835 - RNA, 16 nt, Homo sapiens
gaauggacauuucuaa

SEQ ID NO: 2018836 - RNA, 15 nt, Homo sapiens
uucaaagaugcauuu

SEQ ID NO: 2018837 - RNA, 13 nt, Homo sapiens
caaagcaaagcca

SEQ ID NO: 2018838 - RNA, 21 nt, Homo sapiens
uguuuacaggauauuccaaaa

SEQ ID NO: 2018839 - RNA, 23 nt, Homo sapiens
cuugcccccucaucucacugccc

SEQ ID NO: 2018840 - RNA, 15 nt, Homo sapiens
uuguguccacuguga

SEQ ID NO: 2018841 - RNA, 15 nt, Homo sapiens
ccuggccuaccacag

SEQ ID NO: 2018842 - RNA, 20 nt, Homo sapiens
uguccacuguucuguucuca

SEQ ID NO: 2018843 - RNA, 20 nt, Homo sapiens
cacugcgcccagcuauacug

SEQ ID NO: 2018844 - RNA, 16 nt, Homo sapiens
gcccuggcccaggugc

SEQ ID NO: 2018845 - RNA, 14 nt, Homo sapiens
gaagggaguguucc

SEQ ID NO: 2018846 - RNA, 22 nt, Homo sapiens
auucauggggagccucacagca

SEQ ID NO: 2018847 - RNA, 17 nt, Homo sapiens
aauuagaggauugcacu

SEQ ID NO: 2018848 - RNA, 18 nt, Homo sapiens
ucccaucacuguauccau

SEQ ID NO: 2018849 - RNA, 12 nt, Homo sapiens
auaauguuauag

SEQ ID NO: 2018850 - RNA, 14 nt, Homo sapiens
auacaagauacuuu

SEQ ID NO: 2018851 - RNA, 21 nt, Homo sapiens
ccccuagaauaaucucauccc

SEQ ID NO: 2018852 - RNA, 17 nt, Homo sapiens
uuuacaguuacaguuga

SEQ ID NO: 2018853 - RNA, 20 nt, Homo sapiens
cagcuucuuuacuacugcaa

SEQ ID NO: 2018854 - RNA, 12 nt, Homo sapiens
cuccccagugaa

SEQ ID NO: 2018855 - RNA, 23 nt, Homo sapiens
gcaaaaucuguucuaacauguaa

SEQ ID NO: 2018856 - RNA, 16 nt, Homo sapiens
auaagcuaugucacua

SEQ ID NO: 2018857 - RNA, 16 nt, Homo sapiens
gcugccagccuucucc

SEQ ID NO: 2018858 - RNA, 22 nt, Homo sapiens
cugaguccacucggagugcccu

SEQ ID NO: 2018859 - RNA, 15 nt, Homo sapiens
auaaaauguauucaa

SEQ ID NO: 2018860 - RNA, 20 nt, Homo sapiens
uccuggcuugggccugagua

SEQ ID NO: 2018861 - RNA, 20 nt, Homo sapiens
uuaaaaacuagagcacagaa

SEQ ID NO: 2018862 - RNA, 17 nt, Homo sapiens
aaagaacugcuuaguau

SEQ ID NO: 2018863 - RNA, 19 nt, Homo sapiens
cguguguguguuucaucug

SEQ ID NO: 2018864 - RNA, 18 nt, Homo sapiens
ggacugaccaaagacugc

SEQ ID NO: 2018865 - RNA, 17 nt, Homo sapiens
cagccaaggugcuaaaa

SEQ ID NO: 2018866 - RNA, 15 nt, Homo sapiens
caccagccagaggau

SEQ ID NO: 2018867 - RNA, 13 nt, Homo sapiens
augucuguagcau

SEQ ID NO: 2018868 - RNA, 19 nt, Homo sapiens
aauaccuccuccagaucag

SEQ ID NO: 2018869 - RNA, 23 nt, Homo sapiens
uaccugauggaaguaaagccuca

SEQ ID NO: 2018870 - RNA, 15 nt, Homo sapiens
gcaggggcuggagau

SEQ ID NO: 2018871 - RNA, 21 nt, Homo sapiens
aucaaacuagcugucacuuuu

SEQ ID NO: 2018872 - RNA, 13 nt, Homo sapiens
uaacuuuaccaug

SEQ ID NO: 2018873 - RNA, 14 nt, Homo sapiens
aguuuuaacugugg

SEQ ID NO: 2018874 - RNA, 16 nt, Homo sapiens
aacauguacuacagcu

SEQ ID NO: 2018875 - RNA, 15 nt, Homo sapiens
guaaaggaaccaguc

SEQ ID NO: 2018876 - RNA, 23 nt, Homo sapiens
gaaagaaugcauuccagaacaaa

SEQ ID NO: 2018877 - RNA, 22 nt, Homo sapiens
uaaacuaaaaaaaaaaaggccg

SEQ ID NO: 2018878 - RNA, 16 nt, Homo sapiens
ccugcugagcucugag

SEQ ID NO: 2018879 - RNA, 14 nt, Homo sapiens
aagucuagaaucau

SEQ ID NO: 2018880 - RNA, 21 nt, Homo sapiens
ugcacacucauacacaugugc

SEQ ID NO: 2018881 - RNA, 16 nt, Homo sapiens
gauaguugauuuucaa

SEQ ID NO: 2018882 - RNA, 15 nt, Homo sapiens
augaauuauccugua

SEQ ID NO: 2018883 - RNA, 21 nt, Homo sapiens
cacagaaaggccacucaggau

SEQ ID NO: 2018884 - RNA, 19 nt, Homo sapiens
aaauuacagcuucacccug

SEQ ID NO: 2018885 - RNA, 13 nt, Homo sapiens
ccgagggcccaac

SEQ ID NO: 2018886 - RNA, 15 nt, Homo sapiens
gaaggcugagugucc

SEQ ID NO: 2018887 - RNA, 18 nt, Homo sapiens
ugauccagagcacagauc

SEQ ID NO: 2018888 - RNA, 22 nt, Homo sapiens
uggauguucugacccugcuuca

SEQ ID NO: 2018889 - RNA, 15 nt, Homo sapiens
caguggcucaaucuc

SEQ ID NO: 2018890 - RNA, 14 nt, Homo sapiens
aucugccaugugaa

SEQ ID NO: 2018891 - RNA, 13 nt, Homo sapiens
cuuuccacauuca

SEQ ID NO: 2018892 - RNA, 22 nt, Homo sapiens
caguuggggcuguucauggcaa

SEQ ID NO: 2018893 - RNA, 15 nt, Homo sapiens
uuucagcaauccaug

SEQ ID NO: 2018894 - RNA, 17 nt, Homo sapiens
uaccuuaaacuguguaa

SEQ ID NO: 2018895 - RNA, 21 nt, Homo sapiens
gggcggggcuccugagggagc

SEQ ID NO: 2018896 - RNA, 14 nt, Homo sapiens
cugcuggcugugac

SEQ ID NO: 2018897 - RNA, 18 nt, Homo sapiens
accauuuuugaaaccaaa

SEQ ID NO: 2018898 - RNA, 14 nt, Homo sapiens
uuacuaauauaucu

SEQ ID NO: 2018899 - RNA, 16 nt, Homo sapiens
gcacugaggaccagcc

SEQ ID NO: 2018900 - RNA, 23 nt, Homo sapiens
aucaugacccacccagugucuuu

SEQ ID NO: 2018901 - RNA, 17 nt, Homo sapiens
auauugacacugucccu

SEQ ID NO: 2018902 - RNA, 15 nt, Homo sapiens
acuauuuacaaggau

SEQ ID NO: 2018903 - RNA, 18 nt, Homo sapiens
cuugaacuucaccugcaa

SEQ ID NO: 2018904 - RNA, 11 nt, Homo sapiens
accagggaugg

SEQ ID NO: 2018905 - RNA, 18 nt, Homo sapiens
gcacaccuguuauugcca

SEQ ID NO: 2018906 - RNA, 13 nt, Homo sapiens
ugguaaaucuuuu

SEQ ID NO: 2018907 - RNA, 17 nt, Homo sapiens
gauuuaugacauuacaa

SEQ ID NO: 2018908 - RNA, 18 nt, Homo sapiens
aaauguauggcaugugua

SEQ ID NO: 2018909 - RNA, 20 nt, Homo sapiens
uagacucaugguguguuaca

SEQ ID NO: 2018910 - RNA, 18 nt, Homo sapiens
ugguuaauaaaacugcac

SEQ ID NO: 2018911 - RNA, 13 nt, Homo sapiens
gaggacucaaggg

SEQ ID NO: 2018912 - RNA, 13 nt, Homo sapiens
auggaggccagug

SEQ ID NO: 2018913 - RNA, 21 nt, Homo sapiens
uagacugaagugccagaucaa

SEQ ID NO: 2018914 - RNA, 23 nt, Homo sapiens
agugcugagcaagcaauguacac

SEQ ID NO: 2018915 - RNA, 20 nt, Homo sapiens
acaacuuguguucuauuaau

SEQ ID NO: 2018916 - RNA, 12 nt, Homo sapiens
cagcgagugcau

SEQ ID NO: 2018917 - RNA, 14 nt, Homo sapiens
ggaugcagccuuug

SEQ ID NO: 2018918 - RNA, 16 nt, Homo sapiens
uccauagugacuuuuc

SEQ ID NO: 2018919 - RNA, 21 nt, Homo sapiens
agacagcacuacagauaucau

SEQ ID NO: 2018920 - RNA, 16 nt, Homo sapiens
acaucugcauuucuac

SEQ ID NO: 2018921 - RNA, 21 nt, Homo sapiens
gucuugaccugaacucugcaa

SEQ ID NO: 2018922 - RNA, 20 nt, Homo sapiens
gaugacgugaagccacagga

SEQ ID NO: 2018923 - RNA, 13 nt, Homo sapiens
aaaacuaauuucc

SEQ ID NO: 2018924 - RNA, 15 nt, Homo sapiens
acucaaaucaguaua

SEQ ID NO: 2018925 - RNA, 15 nt, Homo sapiens
ccuucaauacuuaaa

SEQ ID NO: 2018926 - RNA, 15 nt, Homo sapiens
aauaaauucauacau

SEQ ID NO: 2018927 - RNA, 18 nt, Homo sapiens
ccugcuggcucuucugcc

SEQ ID NO: 2018928 - RNA, 16 nt, Homo sapiens
uccuuaacacauucaa

SEQ ID NO: 2018929 - RNA, 13 nt, Homo sapiens
aaccucuacauau

SEQ ID NO: 2018930 - RNA, 14 nt, Homo sapiens
gcaugaccugugac

SEQ ID NO: 2018931 - RNA, 22 nt, Homo sapiens
uucuagguggagguugugcaug

SEQ ID NO: 2018932 - RNA, 22 nt, Homo sapiens
uuuggcagugauauucaucaua

SEQ ID NO: 2018933 - RNA, 13 nt, Homo sapiens
gccuucaaacucc

SEQ ID NO: 2018934 - RNA, 22 nt, Homo sapiens
caauuacuccaccaucaccucu

SEQ ID NO: 2018935 - RNA, 15 nt, Homo sapiens
gcugcugccuggcca

SEQ ID NO: 2018936 - RNA, 12 nt, Homo sapiens
cuacaagcuugu

SEQ ID NO: 2018937 - RNA, 15 nt, Homo sapiens
uuaugaacagacuuu

SEQ ID NO: 2018938 - RNA, 17 nt, Homo sapiens
caauaaggcagugcagu

SEQ ID NO: 2018939 - RNA, 22 nt, Homo sapiens
ucgaggacugauacugcaguga

SEQ ID NO: 2018940 - RNA, 22 nt, Homo sapiens
cucaccuuguaaccagugcaga

SEQ ID NO: 2018941 - RNA, 20 nt, Homo sapiens
guugaaauguucugucaaau

SEQ ID NO: 2018942 - RNA, 15 nt, Homo sapiens
ucagcacaggaauuc

SEQ ID NO: 2018943 - RNA, 21 nt, Homo sapiens
ucaagugaucugccgccucag

SEQ ID NO: 2018944 - RNA, 20 nt, Homo sapiens
cagaaccugcuccuggagua

SEQ ID NO: 2018945 - RNA, 14 nt, Homo sapiens
auuuaaagcuuuca

SEQ ID NO: 2018946 - RNA, 16 nt, Homo sapiens
ccuguuccuuccugca

SEQ ID NO: 2018947 - RNA, 12 nt, Homo sapiens
uuccucacauuc

SEQ ID NO: 2018948 - RNA, 16 nt, Homo sapiens
gccuugaguuccaguu

SEQ ID NO: 2018949 - RNA, 15 nt, Homo sapiens
uaguuaacuaugauu

SEQ ID NO: 2018950 - RNA, 19 nt, Homo sapiens
ucaucaacuuauuauauga

SEQ ID NO: 2018951 - RNA, 19 nt, Homo sapiens
agccacauacuagcaucuu

SEQ ID NO: 2018952 - RNA, 22 nt, Homo sapiens
gaccauaaccccggaagccaaa

SEQ ID NO: 2018953 - RNA, 18 nt, Homo sapiens
augcugacaaugcugcca

SEQ ID NO: 2018954 - RNA, 16 nt, Homo sapiens
gcaugguuugcaugac

SEQ ID NO: 2018955 - RNA, 19 nt, Homo sapiens
cugccaccaagauguguuc

SEQ ID NO: 2018956 - RNA, 20 nt, Homo sapiens
cgaggcggguggaucacuug

SEQ ID NO: 2018957 - RNA, 17 nt, Homo sapiens
aauauauuuccauuaaa

SEQ ID NO: 2018958 - RNA, 21 nt, Homo sapiens
cagagcacuguguaaccagca

SEQ ID NO: 2018959 - RNA, 17 nt, Homo sapiens
ucccgcgggaagccagc

SEQ ID NO: 2018960 - RNA, 18 nt, Homo sapiens
ucaaugcaucaauuuacc

SEQ ID NO: 2018961 - RNA, 14 nt, Homo sapiens
uacaccccaccucu

SEQ ID NO: 2018962 - RNA, 16 nt, Homo sapiens
aucauaugauucugcu

SEQ ID NO: 2018963 - RNA, 12 nt, Homo sapiens
cuaucaguaaua

SEQ ID NO: 2018964 - RNA, 20 nt, Homo sapiens
gcgcuguuuucucagcucca

SEQ ID NO: 2018965 - RNA, 22 nt, Homo sapiens
agugaaagguauugcacuacau

SEQ ID NO: 2018966 - RNA, 17 nt, Homo sapiens
cuccagaaucugcuguu

SEQ ID NO: 2018967 - RNA, 17 nt, Homo sapiens
caauagugaaaugccac

SEQ ID NO: 2018968 - RNA, 16 nt, Homo sapiens
uuaacugaagcucuaa

SEQ ID NO: 2018969 - RNA, 16 nt, Homo sapiens
cugcaccaacucaccu

SEQ ID NO: 2018970 - RNA, 14 nt, Homo sapiens
guuuagugaucuga

SEQ ID NO: 2018971 - RNA, 15 nt, Homo sapiens
accuaggggucuugu

SEQ ID NO: 2018972 - RNA, 14 nt, Homo sapiens
aauucucagagugu

SEQ ID NO: 2018973 - RNA, 13 nt, Homo sapiens
ucucaagcaaguu

SEQ ID NO: 2018974 - RNA, 18 nt, Homo sapiens
uuugaggcucaccagaau

SEQ ID NO: 2018975 - RNA, 20 nt, Homo sapiens
gaccuccccacccccgcugg

SEQ ID NO: 2018976 - RNA, 23 nt, Homo sapiens
gggaggcaagugugggggguccu

SEQ ID NO: 2018977 - RNA, 19 nt, Homo sapiens
gaaauaccaacugaaguca

SEQ ID NO: 2018978 - RNA, 23 nt, Homo sapiens
cagacagguggaaaaacugagac

SEQ ID NO: 2018979 - RNA, 22 nt, Homo sapiens
ucccgugaguggauugugagaa

SEQ ID NO: 2018980 - RNA, 16 nt, Homo sapiens
augaaaagucauucag

SEQ ID NO: 2018981 - RNA, 18 nt, Homo sapiens
gacagaaggaacacugcu

SEQ ID NO: 2018982 - RNA, 17 nt, Homo sapiens
gaaaccuguacauaugu

SEQ ID NO: 2018983 - RNA, 17 nt, Homo sapiens
gaaaccaaaacauaaaa

SEQ ID NO: 2018984 - RNA, 14 nt, Homo sapiens
uacgcaucagacag

SEQ ID NO: 2018985 - RNA, 15 nt, Homo sapiens
auccuuaaacugcca

SEQ ID NO: 2018986 - RNA, 15 nt, Homo sapiens
acugcuaaauccuca

SEQ ID NO: 2018987 - RNA, 17 nt, Homo sapiens
ugaauugaaauggggcg

SEQ ID NO: 2018988 - RNA, 23 nt, Homo sapiens
aucucagcuccugaaaaaugccu

SEQ ID NO: 2018989 - RNA, 23 nt, Homo sapiens
ccuuacauguccuccuaaggggc

SEQ ID NO: 2018990 - RNA, 17 nt, Homo sapiens
cuuccuguuacugagau

SEQ ID NO: 2018991 - RNA, 17 nt, Homo sapiens
caugcuccgccuguaaa

SEQ ID NO: 2018992 - RNA, 15 nt, Homo sapiens
cugggagcacuuugu

SEQ ID NO: 2018993 - RNA, 16 nt, Homo sapiens
uuccuuuaaaugaaua

SEQ ID NO: 2018994 - RNA, 17 nt, Homo sapiens
ugaaaguggacaaggag

SEQ ID NO: 2018995 - RNA, 20 nt, Homo sapiens
ucauucaauaaauuguaauu

SEQ ID NO: 2018996 - RNA, 14 nt, Homo sapiens
cuacacugaugcaa

SEQ ID NO: 2018997 - RNA, 20 nt, Homo sapiens
guuuuuguuaguucacuuca

SEQ ID NO: 2018998 - RNA, 20 nt, Homo sapiens
uaauuuauaugcaugcacag

SEQ ID NO: 2018999 - RNA, 23 nt, Homo sapiens
aggaacucuuuccuguaucauaa

SEQ ID NO: 2019000 - RNA, 20 nt, Homo sapiens
augccccauggggcaucucu

SEQ ID NO: 2019001 - RNA, 19 nt, Homo sapiens
ugaaaugcuuguugaauca

SEQ ID NO: 2019002 - RNA, 15 nt, Homo sapiens
ugacgacaagugcug

SEQ ID NO: 2019003 - RNA, 18 nt, Homo sapiens
gugcaauggcaccaucuu

SEQ ID NO: 2019004 - RNA, 11 nt, Homo sapiens
uaccuuuuuga

SEQ ID NO: 2019005 - RNA, 17 nt, Homo sapiens
acuggacccuguugcua

SEQ ID NO: 2019006 - RNA, 14 nt, Homo sapiens
uuugagcucuggaa

SEQ ID NO: 2019007 - RNA, 17 nt, Homo sapiens
aagccucggaucagccu

SEQ ID NO: 2019008 - RNA, 20 nt, Homo sapiens
ugaagauucuccugugcuag

SEQ ID NO: 2019009 - RNA, 15 nt, Homo sapiens
aucuugucucaaaaa

SEQ ID NO: 2019010 - RNA, 22 nt, Homo sapiens
ccaguuggcccuucugcccuua

SEQ ID NO: 2019011 - RNA, 21 nt, Homo sapiens
aguccgugggcuggcaguuug

SEQ ID NO: 2019012 - RNA, 17 nt, Homo sapiens
uauuuaucaaguguauu

SEQ ID NO: 2019013 - RNA, 16 nt, Homo sapiens
cuuguuccuguuacaa

SEQ ID NO: 2019014 - RNA, 13 nt, Homo sapiens
uuguggagaucac

SEQ ID NO: 2019015 - RNA, 12 nt, Homo sapiens
cuagaaacagac

SEQ ID NO: 2019016 - RNA, 20 nt, Homo sapiens
aagcuguuggauuucaguga

SEQ ID NO: 2019017 - RNA, 19 nt, Homo sapiens
accaagguggcuucuccuu

SEQ ID NO: 2019018 - RNA, 15 nt, Homo sapiens
gcauuuucacuuuug

SEQ ID NO: 2019019 - RNA, 17 nt, Homo sapiens
uccaacuccaacaucca

SEQ ID NO: 2019020 - RNA, 16 nt, Homo sapiens
gauggucucgaucucc

SEQ ID NO: 2019021 - RNA, 20 nt, Homo sapiens
ucagcugcuguugaacuuuu

SEQ ID NO: 2019022 - RNA, 23 nt, Homo sapiens
cugacgaaauggaaacacacaca

SEQ ID NO: 2019023 - RNA, 13 nt, Homo sapiens
cuuaaaacacuuc

SEQ ID NO: 2019024 - RNA, 14 nt, Homo sapiens
gggagaguccaggc

SEQ ID NO: 2019025 - RNA, 13 nt, Homo sapiens
aagggguucucac

SEQ ID NO: 2019026 - RNA, 19 nt, Homo sapiens
agcaggugccagagcuaaa

SEQ ID NO: 2019027 - RNA, 20 nt, Homo sapiens
ucuagggcagaguauguucu

SEQ ID NO: 2019028 - RNA, 14 nt, Homo sapiens
aauaucucucaccc

SEQ ID NO: 2019029 - RNA, 14 nt, Homo sapiens
aaccuugugccuug

SEQ ID NO: 2019030 - RNA, 19 nt, Homo sapiens
aagcaauugaaaugcauug

SEQ ID NO: 2019031 - RNA, 20 nt, Homo sapiens
caaggccgagggccaggcag

SEQ ID NO: 2019032 - RNA, 19 nt, Homo sapiens
gguuugcaugacuuuacac

SEQ ID NO: 2019033 - RNA, 14 nt, Homo sapiens
augaaugaauaacu

SEQ ID NO: 2019034 - RNA, 14 nt, Homo sapiens
gaagaagagaggca

SEQ ID NO: 2019035 - RNA, 15 nt, Homo sapiens
cucuugccucucuca

SEQ ID NO: 2019036 - RNA, 16 nt, Homo sapiens
cagugccauaagcaag

SEQ ID NO: 2019037 - RNA, 13 nt, Homo sapiens
aaauacauaccua

SEQ ID NO: 2019038 - RNA, 12 nt, Homo sapiens
aaguauuugaaa

SEQ ID NO: 2019039 - RNA, 16 nt, Homo sapiens
ucugccagaauacugg

SEQ ID NO: 2019040 - RNA, 17 nt, Homo sapiens
uagagaggcugugaaac

SEQ ID NO: 2019041 - RNA, 18 nt, Homo sapiens
cccaucaucucugccuuu

SEQ ID NO: 2019042 - RNA, 18 nt, Homo sapiens
acauguaauaaauucaaa

SEQ ID NO: 2019043 - RNA, 22 nt, Homo sapiens
aguggcucguguuucacagugg

SEQ ID NO: 2019044 - RNA, 21 nt, Homo sapiens
acagauuuuuggagaaaggau

SEQ ID NO: 2019045 - RNA, 23 nt, Homo sapiens
acggccugagaggagcguguccu

SEQ ID NO: 2019046 - RNA, 15 nt, Homo sapiens
cugcaggcagggcug

SEQ ID NO: 2019047 - RNA, 15 nt, Homo sapiens
cggcaggcauggcug

SEQ ID NO: 2019048 - RNA, 14 nt, Homo sapiens
cuuuuaaaauccac

SEQ ID NO: 2019049 - RNA, 23 nt, Homo sapiens
ucuuugacugaaaaaaaaaaaga

SEQ ID NO: 2019050 - RNA, 16 nt, Homo sapiens
uguaauaugacagaua

SEQ ID NO: 2019051 - RNA, 18 nt, Homo sapiens
augcaagauuguuuucag

SEQ ID NO: 2019052 - RNA, 14 nt, Homo sapiens
auuagcaaggcaga

SEQ ID NO: 2019053 - RNA, 21 nt, Homo sapiens
ucucccagugggugaugcuuu

SEQ ID NO: 2019054 - RNA, 17 nt, Homo sapiens
ugugcuaugaaacaauc

SEQ ID NO: 2019055 - RNA, 17 nt, Homo sapiens
ucacagcccucaugauc

SEQ ID NO: 2019056 - RNA, 19 nt, Homo sapiens
cuuugaacacaccucucuc

SEQ ID NO: 2019057 - RNA, 21 nt, Homo sapiens
uaaaaucuaguuuuggcaaga

SEQ ID NO: 2019058 - RNA, 21 nt, Homo sapiens
caugaacuuguaaaggaauuu

SEQ ID NO: 2019059 - RNA, 20 nt, Homo sapiens
acuccaaaccuuacucugag

SEQ ID NO: 2019060 - RNA, 21 nt, Homo sapiens
agauauauaugugcucuuaau

SEQ ID NO: 2019061 - RNA, 17 nt, Homo sapiens
cccacgagggugccgug

SEQ ID NO: 2019062 - RNA, 10 nt, Homo sapiens
aguugagauu

SEQ ID NO: 2019063 - RNA, 13 nt, Homo sapiens
guuuauaauuaau

SEQ ID NO: 2019064 - RNA, 16 nt, Homo sapiens
aaaaugucuucuccca

SEQ ID NO: 2019065 - RNA, 15 nt, Homo sapiens
uuuagcagcugaaaa

SEQ ID NO: 2019066 - RNA, 21 nt, Homo sapiens
caggccagagccugugggcag

SEQ ID NO: 2019067 - RNA, 17 nt, Homo sapiens
aucauaacucacuuuaa

SEQ ID NO: 2019068 - RNA, 15 nt, Homo sapiens
ugcaauaaaaugggu

SEQ ID NO: 2019069 - RNA, 12 nt, Homo sapiens
uguucaagagca

SEQ ID NO: 2019070 - RNA, 18 nt, Homo sapiens
aggagaagaggaacaucc

SEQ ID NO: 2019071 - RNA, 18 nt, Homo sapiens
uuuaugugcucuccaaau

SEQ ID NO: 2019072 - RNA, 20 nt, Homo sapiens
ccagcaagaugaaacagggc

SEQ ID NO: 2019073 - RNA, 15 nt, Homo sapiens
ucuacauggcuuuga

SEQ ID NO: 2019074 - RNA, 15 nt, Homo sapiens
ucuacuuuaucaauu

SEQ ID NO: 2019075 - RNA, 14 nt, Homo sapiens
agcucuggggacag

SEQ ID NO: 2019076 - RNA, 19 nt, Homo sapiens
uaaaauauaaucucuauaa

SEQ ID NO: 2019077 - RNA, 13 nt, Homo sapiens
caggggacacugg

SEQ ID NO: 2019078 - RNA, 15 nt, Homo sapiens
aacucagacauucca

SEQ ID NO: 2019079 - RNA, 17 nt, Homo sapiens
aauagcaaaacuaaaua

SEQ ID NO: 2019080 - RNA, 14 nt, Homo sapiens
uauucaaaaccuca

SEQ ID NO: 2019081 - RNA, 17 nt, Homo sapiens
uacuuucuggcacauaa

SEQ ID NO: 2019082 - RNA, 11 nt, Homo sapiens
aguagucagaa

SEQ ID NO: 2019083 - RNA, 18 nt, Homo sapiens
acaacagaaaccaaaacu

SEQ ID NO: 2019084 - RNA, 21 nt, Homo sapiens
ccauggcagacucaccaccua

SEQ ID NO: 2019085 - RNA, 13 nt, Homo sapiens
uccuuccuaagaa

SEQ ID NO: 2019086 - RNA, 17 nt, Homo sapiens
uucuuauguugcccagu

SEQ ID NO: 2019087 - RNA, 17 nt, Homo sapiens
uacuucaaaagccauaa

SEQ ID NO: 2019088 - RNA, 15 nt, Homo sapiens
accugcuuaugcauu

SEQ ID NO: 2019089 - RNA, 20 nt, Homo sapiens
aaagcaucaauacaaccagc

SEQ ID NO: 2019090 - RNA, 14 nt, Homo sapiens
aaaugccacacuug

SEQ ID NO: 2019091 - RNA, 17 nt, Homo sapiens
aguggaugcugugcuac

SEQ ID NO: 2019092 - RNA, 17 nt, Homo sapiens
ucuauuuugccacaagc

SEQ ID NO: 2019093 - RNA, 17 nt, Homo sapiens
uugggugaacuaaccaa

SEQ ID NO: 2019094 - RNA, 14 nt, Homo sapiens
cugugccugugacu

SEQ ID NO: 2019095 - RNA, 21 nt, Homo sapiens
cagguuuagaggaccagugag

SEQ ID NO: 2019096 - RNA, 15 nt, Homo sapiens
cccagcccagagcca

SEQ ID NO: 2019097 - RNA, 18 nt, Homo sapiens
augcuuuuacuaagcacu

SEQ ID NO: 2019098 - RNA, 13 nt, Homo sapiens
aucaaugaaguag

SEQ ID NO: 2019099 - RNA, 16 nt, Homo sapiens
gaacuuagauguuaaa

SEQ ID NO: 2019100 - RNA, 13 nt, Homo sapiens
cagcuuauauuca

SEQ ID NO: 2019101 - RNA, 13 nt, Homo sapiens
caucugucagcca

SEQ ID NO: 2019102 - RNA, 13 nt, Homo sapiens
gauuucuaccuca

SEQ ID NO: 2019103 - RNA, 21 nt, Homo sapiens
acuacaguguuuuccuuugca

SEQ ID NO: 2019104 - RNA, 15 nt, Homo sapiens
aagcaaaaucuaaaa

SEQ ID NO: 2019105 - RNA, 17 nt, Homo sapiens
guuugaauuacagggaa

SEQ ID NO: 2019106 - RNA, 19 nt, Homo sapiens
acuugauguguuaucucuu

SEQ ID NO: 2019107 - RNA, 18 nt, Homo sapiens
agccauucuuuuaaauau

SEQ ID NO: 2019108 - RNA, 13 nt, Homo sapiens
aucuacaacauaa

SEQ ID NO: 2019109 - RNA, 18 nt, Homo sapiens
agacacugguuuacacuu

SEQ ID NO: 2019110 - RNA, 22 nt, Homo sapiens
aaacuccugccccuguucucuu

SEQ ID NO: 2019111 - RNA, 22 nt, Homo sapiens
gguucugcuacuccccagaccu

SEQ ID NO: 2019112 - RNA, 15 nt, Homo sapiens
gugguuugagacacu

SEQ ID NO: 2019113 - RNA, 13 nt, Homo sapiens
gagagaaaaaaga

SEQ ID NO: 2019114 - RNA, 17 nt, Homo sapiens
uccaaccugcaaagauc

SEQ ID NO: 2019115 - RNA, 13 nt, Homo sapiens
auuugagaaaaua

SEQ ID NO: 2019116 - RNA, 20 nt, Homo sapiens
aaaccggguugccagcuccc

SEQ ID NO: 2019117 - RNA, 13 nt, Homo sapiens
uagcuucaugccu

SEQ ID NO: 2019118 - RNA, 13 nt, Homo sapiens
aaaugcauggugc

SEQ ID NO: 2019119 - RNA, 17 nt, Homo sapiens
gaugaaggggcucuuca

SEQ ID NO: 2019120 - RNA, 18 nt, Homo sapiens
ccuuucuguugccaguca

SEQ ID NO: 2019121 - RNA, 14 nt, Homo sapiens
uccaaccacuguac

SEQ ID NO: 2019122 - RNA, 20 nt, Homo sapiens
uuugggguugaaaauucaaa

SEQ ID NO: 2019123 - RNA, 15 nt, Homo sapiens
auauguauaggagcu

SEQ ID NO: 2019124 - RNA, 22 nt, Homo sapiens
gauacaaauguuagucccuaac

SEQ ID NO: 2019125 - RNA, 17 nt, Homo sapiens
ugauagugcaaggaaug

SEQ ID NO: 2019126 - RNA, 21 nt, Homo sapiens
auguacuguacuaauucuuac

SEQ ID NO: 2019127 - RNA, 16 nt, Homo sapiens
cuucaucacacacuga

SEQ ID NO: 2019128 - RNA, 23 nt, Homo sapiens
auugggagaagccgcagggacag

SEQ ID NO: 2019129 - RNA, 15 nt, Homo sapiens
ucaagaaaugugacu

SEQ ID NO: 2019130 - RNA, 22 nt, Homo sapiens
aacauguggcuugaauuaagaa

SEQ ID NO: 2019131 - RNA, 18 nt, Homo sapiens
agcaaaacuccaucucaa

SEQ ID NO: 2019132 - RNA, 16 nt, Homo sapiens
cauguggacugugcca

SEQ ID NO: 2019133 - RNA, 15 nt, Homo sapiens
uuuaaauaaagacaa

SEQ ID NO: 2019134 - RNA, 21 nt, Homo sapiens
ugagaacagaucuccaaagcu

SEQ ID NO: 2019135 - RNA, 20 nt, Homo sapiens
auacuagacucauacucaac

SEQ ID NO: 2019136 - RNA, 22 nt, Homo sapiens
guguauggguuaaaucaaagau

SEQ ID NO: 2019137 - RNA, 20 nt, Homo sapiens
ggguggggcuccuaccuggg

SEQ ID NO: 2019138 - RNA, 15 nt, Homo sapiens
uccugcagccagaaa

SEQ ID NO: 2019139 - RNA, 21 nt, Homo sapiens
aaauagauuucuuugcacaau

SEQ ID NO: 2019140 - RNA, 18 nt, Homo sapiens
agcaaguguacaguauuu

SEQ ID NO: 2019141 - RNA, 12 nt, Homo sapiens
caggaaugggcu

SEQ ID NO: 2019142 - RNA, 16 nt, Homo sapiens
auucucauaugacuaa

SEQ ID NO: 2019143 - RNA, 21 nt, Homo sapiens
cccuguaccacaaacacauua

SEQ ID NO: 2019144 - RNA, 17 nt, Homo sapiens
acacggugggcugagua

SEQ ID NO: 2019145 - RNA, 14 nt, Homo sapiens
caaccagcauucau

SEQ ID NO: 2019146 - RNA, 13 nt, Homo sapiens
ucuagauaccacu

SEQ ID NO: 2019147 - RNA, 20 nt, Homo sapiens
uuaauaugauucuaguacau

SEQ ID NO: 2019148 - RNA, 16 nt, Homo sapiens
agcaggggaggugagg

SEQ ID NO: 2019149 - RNA, 22 nt, Homo sapiens
cauaaagaggcguugcuuucac

SEQ ID NO: 2019150 - RNA, 11 nt, Homo sapiens
gaacacuaacc

SEQ ID NO: 2019151 - RNA, 20 nt, Homo sapiens
auccacacaugaaucugcac

SEQ ID NO: 2019152 - RNA, 18 nt, Homo sapiens
gaccucagggcacaaaga

SEQ ID NO: 2019153 - RNA, 15 nt, Homo sapiens
ccaggaggugcagug

SEQ ID NO: 2019154 - RNA, 13 nt, Homo sapiens
caagcgcacuuga

SEQ ID NO: 2019155 - RNA, 15 nt, Homo sapiens
aggucaaacuguggg

SEQ ID NO: 2019156 - RNA, 23 nt, Homo sapiens
aaugacaccacacucugccugaa

SEQ ID NO: 2019157 - RNA, 18 nt, Homo sapiens
gcaugagucuguuuccca

SEQ ID NO: 2019158 - RNA, 21 nt, Homo sapiens
aaacuuccuucuuacuugcca

SEQ ID NO: 2019159 - RNA, 14 nt, Homo sapiens
ucuuaccugggacc

SEQ ID NO: 2019160 - RNA, 12 nt, Homo sapiens
gauagugccucu

SEQ ID NO: 2019161 - RNA, 13 nt, Homo sapiens
uggugugccucag

SEQ ID NO: 2019162 - RNA, 13 nt, Homo sapiens
ucugaccaaaaca

SEQ ID NO: 2019163 - RNA, 18 nt, Homo sapiens
cacacugcacacaugcac

SEQ ID NO: 2019164 - RNA, 20 nt, Homo sapiens
ucugcauuuauuaguauucu

SEQ ID NO: 2019165 - RNA, 16 nt, Homo sapiens
cugucauaacauccag

SEQ ID NO: 2019166 - RNA, 15 nt, Homo sapiens
gaacacagcaugugc

SEQ ID NO: 2019167 - RNA, 21 nt, Homo sapiens
uuaagaagucuauaaugcaau

SEQ ID NO: 2019168 - RNA, 19 nt, Homo sapiens
agcugcugggauugggaag

SEQ ID NO: 2019169 - RNA, 20 nt, Homo sapiens
accuacugcuuacuguugcu

SEQ ID NO: 2019170 - RNA, 19 nt, Homo sapiens
cugaacauaguagauugac

SEQ ID NO: 2019171 - RNA, 18 nt, Homo sapiens
cacugccauuacccagug

SEQ ID NO: 2019172 - RNA, 23 nt, Homo sapiens
cccugacacgugauggaccaaag

SEQ ID NO: 2019173 - RNA, 10 nt, Homo sapiens
auguccugca

SEQ ID NO: 2019174 - RNA, 15 nt, Homo sapiens
ugagccucuuuguaa

SEQ ID NO: 2019175 - RNA, 21 nt, Homo sapiens
agcccacaguucuccauuuca

SEQ ID NO: 2019176 - RNA, 17 nt, Homo sapiens
aauauauuccugagauu

SEQ ID NO: 2019177 - RNA, 21 nt, Homo sapiens
aauggaagaguguuucuucca

SEQ ID NO: 2019178 - RNA, 16 nt, Homo sapiens
ugugggugucagucag

SEQ ID NO: 2019179 - RNA, 17 nt, Homo sapiens
cuuagguugacauucag

SEQ ID NO: 2019180 - RNA, 19 nt, Homo sapiens
uuuggugggcuuuggagcu

SEQ ID NO: 2019181 - RNA, 19 nt, Homo sapiens
aaacaagagaccacuuccu

SEQ ID NO: 2019182 - RNA, 17 nt, Homo sapiens
aacaaauagucuaucaa

SEQ ID NO: 2019183 - RNA, 17 nt, Homo sapiens
aaaacucaguaucauaa

SEQ ID NO: 2019184 - RNA, 14 nt, Homo sapiens
cagagggcagucua

SEQ ID NO: 2019185 - RNA, 17 nt, Homo sapiens
cuucuuuccuuguucag

SEQ ID NO: 2019186 - RNA, 17 nt, Homo sapiens
gcauuccuagaaauuga

SEQ ID NO: 2019187 - RNA, 22 nt, Homo sapiens
cuaaagguuuuaaccgcacaug

SEQ ID NO: 2019188 - RNA, 18 nt, Homo sapiens
ccuccugaagccacagca

SEQ ID NO: 2019189 - RNA, 14 nt, Homo sapiens
gcuauuacugucug

SEQ ID NO: 2019190 - RNA, 17 nt, Homo sapiens
cuguuaugcaagcacaa

SEQ ID NO: 2019191 - RNA, 21 nt, Homo sapiens
accucuuuuguuguccuugcc

SEQ ID NO: 2019192 - RNA, 13 nt, Homo sapiens
gcuagggugguca

SEQ ID NO: 2019193 - RNA, 18 nt, Homo sapiens
agcaggggaacaaaauaa

SEQ ID NO: 2019194 - RNA, 16 nt, Homo sapiens
ucucaauguacauaga

SEQ ID NO: 2019195 - RNA, 12 nt, Homo sapiens
aauauguacaag

SEQ ID NO: 2019196 - RNA, 12 nt, Homo sapiens
aauguguacaaa

SEQ ID NO: 2019197 - RNA, 19 nt, Homo sapiens
caggcucuccaggugguca

SEQ ID NO: 2019198 - RNA, 13 nt, Homo sapiens
gccaaaaccaaac

SEQ ID NO: 2019199 - RNA, 20 nt, Homo sapiens
cauuguguauagaacuggau

SEQ ID NO: 2019200 - RNA, 14 nt, Homo sapiens
ggcagccaucaaag

SEQ ID NO: 2019201 - RNA, 16 nt, Homo sapiens
agacgggguuucauca

SEQ ID NO: 2019202 - RNA, 23 nt, Homo sapiens
ccaugccugcucccugucugugu

SEQ ID NO: 2019203 - RNA, 22 nt, Homo sapiens
uucagugauaucuuucucauua

SEQ ID NO: 2019204 - RNA, 16 nt, Homo sapiens
cccaaugccugugaag

SEQ ID NO: 2019205 - RNA, 15 nt, Homo sapiens
cucaguaacagugca

SEQ ID NO: 2019206 - RNA, 14 nt, Homo sapiens
auaugcaaagcacu

SEQ ID NO: 2019207 - RNA, 12 nt, Homo sapiens
acccccagugua

SEQ ID NO: 2019208 - RNA, 13 nt, Homo sapiens
augcucaguauug

SEQ ID NO: 2019209 - RNA, 21 nt, Homo sapiens
gagcccuucacuccugagaaa

SEQ ID NO: 2019210 - RNA, 11 nt, Homo sapiens
gaauuuccucu

SEQ ID NO: 2019211 - RNA, 16 nt, Homo sapiens
agcaggggcauugcug

SEQ ID NO: 2019212 - RNA, 13 nt, Homo sapiens
auauacauucuau

SEQ ID NO: 2019213 - RNA, 16 nt, Homo sapiens
cccaucccuauccaua

SEQ ID NO: 2019214 - RNA, 23 nt, Homo sapiens
uaauauuuuugaaaaaugcacug

SEQ ID NO: 2019215 - RNA, 19 nt, Homo sapiens
uccagagggcacucagaag

SEQ ID NO: 2019216 - RNA, 23 nt, Homo sapiens
gcaccugcccccacagcuccuug

SEQ ID NO: 2019217 - RNA, 22 nt, Homo sapiens
cuuuuggggaggaguugucugu

SEQ ID NO: 2019218 - RNA, 16 nt, Homo sapiens
agggcagaauagcuga

SEQ ID NO: 2019219 - RNA, 14 nt, Homo sapiens
aaaaucacuugaac

SEQ ID NO: 2019220 - RNA, 18 nt, Homo sapiens
cucaaccaaugccaaaaa

SEQ ID NO: 2019221 - RNA, 17 nt, Homo sapiens
agucuucucucuggcuc

SEQ ID NO: 2019222 - RNA, 20 nt, Homo sapiens
ugguguugggaagggguccu

SEQ ID NO: 2019223 - RNA, 12 nt, Homo sapiens
ucaaaucacugc

SEQ ID NO: 2019224 - RNA, 15 nt, Homo sapiens
aguugacaaaugcca

SEQ ID NO: 2019225 - RNA, 16 nt, Homo sapiens
auauuacccuguaaua

SEQ ID NO: 2019226 - RNA, 13 nt, Homo sapiens
aggaguaagggaa

SEQ ID NO: 2019227 - RNA, 15 nt, Homo sapiens
caaaaucuuguuaau

SEQ ID NO: 2019228 - RNA, 23 nt, Homo sapiens
caguuuaaucuucacaauaucca

SEQ ID NO: 2019229 - RNA, 13 nt, Homo sapiens
ccucccaccagga

SEQ ID NO: 2019230 - RNA, 15 nt, Homo sapiens
cuaaauguaucuuua

SEQ ID NO: 2019231 - RNA, 13 nt, Homo sapiens
cagagcuuuucag

SEQ ID NO: 2019232 - RNA, 16 nt, Homo sapiens
cagagagagcucugca

SEQ ID NO: 2019233 - RNA, 19 nt, Homo sapiens
cgaaacacacaaaccagcc

SEQ ID NO: 2019234 - RNA, 23 nt, Homo sapiens
auaagguuuuaaguuguuugcau

SEQ ID NO: 2019235 - RNA, 19 nt, Homo sapiens
gcccccuguggaugcugcu

SEQ ID NO: 2019236 - RNA, 15 nt, Homo sapiens
acgcagaccaacaga

SEQ ID NO: 2019237 - RNA, 15 nt, Homo sapiens
ugguguauguaugag

SEQ ID NO: 2019238 - RNA, 15 nt, Homo sapiens
cggccacacgugucc

SEQ ID NO: 2019239 - RNA, 21 nt, Homo sapiens
ugguuuauaauaaacucuuaa

SEQ ID NO: 2019240 - RNA, 21 nt, Homo sapiens
ggcagucaugcugggucucca

SEQ ID NO: 2019241 - RNA, 14 nt, Homo sapiens
agcaucucaguggu

SEQ ID NO: 2019242 - RNA, 19 nt, Homo sapiens
aaguuuacaaucaaaggaa

SEQ ID NO: 2019243 - RNA, 18 nt, Homo sapiens
uggauuucacggagacag

SEQ ID NO: 2019244 - RNA, 18 nt, Homo sapiens
agccaccaaggcugccug

SEQ ID NO: 2019245 - RNA, 19 nt, Homo sapiens
ggaccacaggcaugcacca

SEQ ID NO: 2019246 - RNA, 21 nt, Homo sapiens
uucccccugcuuccaccucac

SEQ ID NO: 2019247 - RNA, 23 nt, Homo sapiens
aacuguccuuccauuugggauau

SEQ ID NO: 2019248 - RNA, 17 nt, Homo sapiens
auuuauauugcagauug

SEQ ID NO: 2019249 - RNA, 14 nt, Homo sapiens
accaaacacccaca

SEQ ID NO: 2019250 - RNA, 22 nt, Homo sapiens
gauaugacaacucuuauuugaa

SEQ ID NO: 2019251 - RNA, 20 nt, Homo sapiens
ugcccggcuaauuuuuugca

SEQ ID NO: 2019252 - RNA, 23 nt, Homo sapiens
uugaaccagaaccagucuuucaa

SEQ ID NO: 2019253 - RNA, 18 nt, Homo sapiens
ugcagucccacacugugc

SEQ ID NO: 2019254 - RNA, 20 nt, Homo sapiens
uuaauuuacuuuaagcauug

SEQ ID NO: 2019255 - RNA, 14 nt, Homo sapiens
cuggugagugcaag

SEQ ID NO: 2019256 - RNA, 13 nt, Homo sapiens
aacaaacugugua

SEQ ID NO: 2019257 - RNA, 20 nt, Homo sapiens
cuagagcuaugcacaccaaa

SEQ ID NO: 2019258 - RNA, 21 nt, Homo sapiens
cucuuggcuccccacauuggc

SEQ ID NO: 2019259 - RNA, 18 nt, Homo sapiens
gaaucagucuauccacag

SEQ ID NO: 2019260 - RNA, 22 nt, Homo sapiens
acagcagccacuuugcuaccau

SEQ ID NO: 2019261 - RNA, 16 nt, Homo sapiens
gugguggccagcagca

SEQ ID NO: 2019262 - RNA, 17 nt, Homo sapiens
agaacauuccauuugcu

SEQ ID NO: 2019263 - RNA, 14 nt, Homo sapiens
gcgugcaugcacac

SEQ ID NO: 2019264 - RNA, 17 nt, Homo sapiens
aaagcuaccauuuauca

SEQ ID NO: 2019265 - RNA, 19 nt, Homo sapiens
uaagaucacagugaacuua

SEQ ID NO: 2019266 - RNA, 20 nt, Homo sapiens
acaguggcggcaacauugaa

SEQ ID NO: 2019267 - RNA, 17 nt, Homo sapiens
cuugcacacaugcacac

SEQ ID NO: 2019268 - RNA, 17 nt, Homo sapiens
caacacuaauacacuaa

SEQ ID NO: 2019269 - RNA, 21 nt, Homo sapiens
uuccauuaaguacaugugcca

SEQ ID NO: 2019270 - RNA, 19 nt, Homo sapiens
ccuuuuaccugagacuuuc

SEQ ID NO: 2019271 - RNA, 15 nt, Homo sapiens
aaagcaacaucuuca

SEQ ID NO: 2019272 - RNA, 17 nt, Homo sapiens
cuugcuaccaguauuua

SEQ ID NO: 2019273 - RNA, 18 nt, Homo sapiens
auaaucuaggcaugaaga

SEQ ID NO: 2019274 - RNA, 20 nt, Homo sapiens
agaaaauccccaacuaugca

SEQ ID NO: 2019275 - RNA, 19 nt, Homo sapiens
auuaauguuucuucuccaa

SEQ ID NO: 2019276 - RNA, 20 nt, Homo sapiens
ucuacuacaaacuucaaaga

SEQ ID NO: 2019277 - RNA, 18 nt, Homo sapiens
ugguggaaggugugcucg

SEQ ID NO: 2019278 - RNA, 17 nt, Homo sapiens
uggaaagaaaaagcaau

SEQ ID NO: 2019279 - RNA, 14 nt, Homo sapiens
ugucuuuggugcuu

SEQ ID NO: 2019280 - RNA, 13 nt, Homo sapiens
gcuuccaccucac

SEQ ID NO: 2019281 - RNA, 12 nt, Homo sapiens
cagaccaaagca

SEQ ID NO: 2019282 - RNA, 15 nt, Homo sapiens
aaauguaucugaaua

SEQ ID NO: 2019283 - RNA, 12 nt, Homo sapiens
aagccaugugcu

SEQ ID NO: 2019284 - RNA, 16 nt, Homo sapiens
ccacuuguucauucug

SEQ ID NO: 2019285 - RNA, 20 nt, Homo sapiens
uuaugguuuuauaacuauau

SEQ ID NO: 2019286 - RNA, 15 nt, Homo sapiens
cucuguucauuucac

SEQ ID NO: 2019287 - RNA, 17 nt, Homo sapiens
ccgggcacugucaugcc

SEQ ID NO: 2019288 - RNA, 18 nt, Homo sapiens
ugccagggacugacaaaa

SEQ ID NO: 2019289 - RNA, 21 nt, Homo sapiens
augucaaaaauauuuuuaugu

SEQ ID NO: 2019290 - RNA, 19 nt, Homo sapiens
gggaauacaucuguggaca

SEQ ID NO: 2019291 - RNA, 19 nt, Homo sapiens
ugacuauggcuaccaaaaa

SEQ ID NO: 2019292 - RNA, 12 nt, Homo sapiens
aguaaguacaaa

SEQ ID NO: 2019293 - RNA, 11 nt, Homo sapiens
caggcauuuaa

SEQ ID NO: 2019294 - RNA, 18 nt, Homo sapiens
uaugcaaaucagcuuuau

SEQ ID NO: 2019295 - RNA, 18 nt, Homo sapiens
ggaauuucuuaacuucuu

SEQ ID NO: 2019296 - RNA, 17 nt, Homo sapiens
uguugcuuccguucaug

SEQ ID NO: 2019297 - RNA, 13 nt, Homo sapiens
aaauauuccugca

SEQ ID NO: 2019298 - RNA, 15 nt, Homo sapiens
gcagcugccagagaa

SEQ ID NO: 2019299 - RNA, 19 nt, Homo sapiens
gaggugaauacucuugaaa

SEQ ID NO: 2019300 - RNA, 14 nt, Homo sapiens
gaugugguugcaua

SEQ ID NO: 2019301 - RNA, 18 nt, Homo sapiens
caucccugaaacaucuca

SEQ ID NO: 2019302 - RNA, 21 nt, Homo sapiens
aauguuuaaaagcaaaacugc

SEQ ID NO: 2019303 - RNA, 14 nt, Homo sapiens
aagcagcgggcuaa

SEQ ID NO: 2019304 - RNA, 16 nt, Homo sapiens
gaaauuuaagcacaaa

SEQ ID NO: 2019305 - RNA, 19 nt, Homo sapiens
cauuaaaauccaguauuau

SEQ ID NO: 2019306 - RNA, 14 nt, Homo sapiens
aucucaccuccugc

SEQ ID NO: 2019307 - RNA, 13 nt, Homo sapiens
acaaagauuugca

SEQ ID NO: 2019308 - RNA, 18 nt, Homo sapiens
cauggaaugcaauuugac

SEQ ID NO: 2019309 - RNA, 19 nt, Homo sapiens
cacuguuugucucaccuac

SEQ ID NO: 2019310 - RNA, 18 nt, Homo sapiens
ucgugcgacaggcauuua

SEQ ID NO: 2019311 - RNA, 18 nt, Homo sapiens
gccaggccucagggacca

SEQ ID NO: 2019312 - RNA, 16 nt, Homo sapiens
aacauaauguuuucac

SEQ ID NO: 2019313 - RNA, 18 nt, Homo sapiens
cugucagcuuccaaacau

SEQ ID NO: 2019314 - RNA, 18 nt, Homo sapiens
ucccuuuuuacacuuuau

SEQ ID NO: 2019315 - RNA, 20 nt, Homo sapiens
auauacuucacucacuuuuc

SEQ ID NO: 2019316 - RNA, 16 nt, Homo sapiens
ccacaagagugaauuu

SEQ ID NO: 2019317 - RNA, 21 nt, Homo sapiens
cuuuacaaaaagacacuugau

SEQ ID NO: 2019318 - RNA, 15 nt, Homo sapiens
uuggcucacuacaac

SEQ ID NO: 2019319 - RNA, 13 nt, Homo sapiens
cuguggaugcuuc

SEQ ID NO: 2019320 - RNA, 14 nt, Homo sapiens
ucccgucucgccug

SEQ ID NO: 2019321 - RNA, 20 nt, Homo sapiens
aacauggauuccacugaaau

SEQ ID NO: 2019322 - RNA, 17 nt, Homo sapiens
aagagagacauugccuc

SEQ ID NO: 2019323 - RNA, 14 nt, Homo sapiens
auucuuuugccaag

SEQ ID NO: 2019324 - RNA, 16 nt, Homo sapiens
gggacaacguccuucc

SEQ ID NO: 2019325 - RNA, 17 nt, Homo sapiens
aucuagaagacugucag

SEQ ID NO: 2019326 - RNA, 17 nt, Homo sapiens
uaucuauuaaccauucu

SEQ ID NO: 2019327 - RNA, 21 nt, Homo sapiens
guuagggagaugaguugcagu

SEQ ID NO: 2019328 - RNA, 16 nt, Homo sapiens
cccagccugggauccu

SEQ ID NO: 2019329 - RNA, 13 nt, Homo sapiens
caaaguccagccu

SEQ ID NO: 2019330 - RNA, 15 nt, Homo sapiens
aaaucaguuauguca

SEQ ID NO: 2019331 - RNA, 15 nt, Homo sapiens
ccaccucaggggaga

SEQ ID NO: 2019332 - RNA, 14 nt, Homo sapiens
cuaucccaagccaa

SEQ ID NO: 2019333 - RNA, 19 nt, Homo sapiens
ugcucacauaucugucauu

SEQ ID NO: 2019334 - RNA, 13 nt, Homo sapiens
guguuuucagucu

SEQ ID NO: 2019335 - RNA, 21 nt, Homo sapiens
guaaugacaaauaaguggaaa

SEQ ID NO: 2019336 - RNA, 23 nt, Homo sapiens
uagagcaaccagucaaaaccaga

SEQ ID NO: 2019337 - RNA, 21 nt, Homo sapiens
agcccucaggccagugccagg

SEQ ID NO: 2019338 - RNA, 11 nt, Homo sapiens
ccucuaugaag

SEQ ID NO: 2019339 - RNA, 12 nt, Homo sapiens
agcaaacuccag

SEQ ID NO: 2019340 - RNA, 19 nt, Homo sapiens
uuccaguagagcuucuuau

SEQ ID NO: 2019341 - RNA, 19 nt, Homo sapiens
caaguucauucauacucaa

SEQ ID NO: 2019342 - RNA, 12 nt, Homo sapiens
ugugaucuauac

SEQ ID NO: 2019343 - RNA, 13 nt, Homo sapiens
uucuauuagucac

SEQ ID NO: 2019344 - RNA, 14 nt, Homo sapiens
ccuguguacugccu

SEQ ID NO: 2019345 - RNA, 21 nt, Homo sapiens
ccuccgugagcaccaccaggg

SEQ ID NO: 2019346 - RNA, 16 nt, Homo sapiens
cucuucucugcaaugc

SEQ ID NO: 2019347 - RNA, 15 nt, Homo sapiens
uuuauguccuauguu

SEQ ID NO: 2019348 - RNA, 16 nt, Homo sapiens
uaaaugcccucucuga

SEQ ID NO: 2019349 - RNA, 14 nt, Homo sapiens
ccacacggucuuca

SEQ ID NO: 2019350 - RNA, 15 nt, Homo sapiens
agcuaggaugguucu

SEQ ID NO: 2019351 - RNA, 23 nt, Homo sapiens
uagcaagauagucuucaguuuca

SEQ ID NO: 2019352 - RNA, 15 nt, Homo sapiens
gauucauaagacacu

SEQ ID NO: 2019353 - RNA, 14 nt, Homo sapiens
ccugaagucacaca

SEQ ID NO: 2019354 - RNA, 15 nt, Homo sapiens
auuuaacugacuuaa

SEQ ID NO: 2019355 - RNA, 21 nt, Homo sapiens
auguaaaugcaucuguccuca

SEQ ID NO: 2019356 - RNA, 22 nt, Homo sapiens
auuucagauaaacaacaaauaa

SEQ ID NO: 2019357 - RNA, 18 nt, Homo sapiens
cacccuccacaaagcaaa

SEQ ID NO: 2019358 - RNA, 15 nt, Homo sapiens
uucaguuuauuucca

SEQ ID NO: 2019359 - RNA, 22 nt, Homo sapiens
aacuucccuuaagagucaucca

SEQ ID NO: 2019360 - RNA, 23 nt, Homo sapiens
agguaacuucucccuucuccuga

SEQ ID NO: 2019361 - RNA, 20 nt, Homo sapiens
auccugucuguacuaaaaau

SEQ ID NO: 2019362 - RNA, 18 nt, Homo sapiens
guauauuacaaugaucac

SEQ ID NO: 2019363 - RNA, 19 nt, Homo sapiens
cuauucccuggggcugcug

SEQ ID NO: 2019364 - RNA, 11 nt, Homo sapiens
ugagaccagug

SEQ ID NO: 2019365 - RNA, 20 nt, Homo sapiens
gcccccaguaucucuucagu

SEQ ID NO: 2019366 - RNA, 17 nt, Homo sapiens
cauggccagcagcaccu

SEQ ID NO: 2019367 - RNA, 19 nt, Homo sapiens
aagggguuggggugacagu

SEQ ID NO: 2019368 - RNA, 10 nt, Homo sapiens
gaccaaagga

SEQ ID NO: 2019369 - RNA, 18 nt, Homo sapiens
acuggagcugcacugcau

SEQ ID NO: 2019370 - RNA, 18 nt, Homo sapiens
gcgcccaagcucagcuua

SEQ ID NO: 2019371 - RNA, 18 nt, Homo sapiens
aguguccuuccucugucc

SEQ ID NO: 2019372 - RNA, 17 nt, Homo sapiens
aauugcuugacccaggu

SEQ ID NO: 2019373 - RNA, 15 nt, Homo sapiens
aagaaauaaccacug

SEQ ID NO: 2019374 - RNA, 20 nt, Homo sapiens
caucauacuaaaagcaaugu

SEQ ID NO: 2019375 - RNA, 20 nt, Homo sapiens
cucacagcaacaugugacaa

SEQ ID NO: 2019376 - RNA, 13 nt, Homo sapiens
aaauccaauauca

SEQ ID NO: 2019377 - RNA, 20 nt, Homo sapiens
ucgaaccuugaccgacauga

SEQ ID NO: 2019378 - RNA, 13 nt, Homo sapiens
acuuugccauuaa

SEQ ID NO: 2019379 - RNA, 21 nt, Homo sapiens
cguuuuguugccaaggcagaa

SEQ ID NO: 2019380 - RNA, 17 nt, Homo sapiens
aauggacuguacaauaa

SEQ ID NO: 2019381 - RNA, 17 nt, Homo sapiens
accaaugauucauaaca

SEQ ID NO: 2019382 - RNA, 14 nt, Homo sapiens
aggccuuggguguu

SEQ ID NO: 2019383 - RNA, 18 nt, Homo sapiens
gaggugcgcucaccucag

SEQ ID NO: 2019384 - RNA, 18 nt, Homo sapiens
cauauccaacaugugcuc

SEQ ID NO: 2019385 - RNA, 14 nt, Homo sapiens
gaaaguucuggaaa

SEQ ID NO: 2019386 - RNA, 21 nt, Homo sapiens
cuugcagauacauucaugagg

SEQ ID NO: 2019387 - RNA, 14 nt, Homo sapiens
ugugagaacuguga

SEQ ID NO: 2019388 - RNA, 12 nt, Homo sapiens
guucuugggaua

SEQ ID NO: 2019389 - RNA, 18 nt, Homo sapiens
uguucauacugauguguu

SEQ ID NO: 2019390 - RNA, 15 nt, Homo sapiens
uccgggacgcuucca

SEQ ID NO: 2019391 - RNA, 20 nt, Homo sapiens
aaguauccaauuaugugaca

SEQ ID NO: 2019392 - RNA, 21 nt, Homo sapiens
gacaggcaugaaucacugugc

SEQ ID NO: 2019393 - RNA, 19 nt, Homo sapiens
aaaugucaucagaacuuuu

SEQ ID NO: 2019394 - RNA, 19 nt, Homo sapiens
cuauauccauguacuguag

SEQ ID NO: 2019395 - RNA, 16 nt, Homo sapiens
aagaaaaccauuuuag

SEQ ID NO: 2019396 - RNA, 22 nt, Homo sapiens
uuauggcugcauaguauuccau

SEQ ID NO: 2019397 - RNA, 19 nt, Homo sapiens
uaaggaacauguacuguua

SEQ ID NO: 2019398 - RNA, 13 nt, Homo sapiens
aaucagcaauaaa

SEQ ID NO: 2019399 - RNA, 20 nt, Homo sapiens
acugacucggcagugugcag

SEQ ID NO: 2019400 - RNA, 15 nt, Homo sapiens
acugucucucaugaa

SEQ ID NO: 2019401 - RNA, 15 nt, Homo sapiens
cuccacagugcugcu

SEQ ID NO: 2019402 - RNA, 20 nt, Homo sapiens
caugccaucuccacccugag

SEQ ID NO: 2019403 - RNA, 13 nt, Homo sapiens
agucacaccaucu

SEQ ID NO: 2019404 - RNA, 13 nt, Homo sapiens
caccucacagcca

SEQ ID NO: 2019405 - RNA, 13 nt, Homo sapiens
cuacauucacuuc

SEQ ID NO: 2019406 - RNA, 21 nt, Homo sapiens
uuacauaacaggcauugcacu

SEQ ID NO: 2019407 - RNA, 20 nt, Homo sapiens
ucagccauccgcagacugcu

SEQ ID NO: 2019408 - RNA, 20 nt, Homo sapiens
uggaggcuccaggacuccac

SEQ ID NO: 2019409 - RNA, 21 nt, Homo sapiens
gugugucaggcccucugccug

SEQ ID NO: 2019410 - RNA, 15 nt, Homo sapiens
caagaaugcuuuaau

SEQ ID NO: 2019411 - RNA, 20 nt, Homo sapiens
uagagaacugucacccugag

SEQ ID NO: 2019412 - RNA, 16 nt, Homo sapiens
ugggcaacacagugag

SEQ ID NO: 2019413 - RNA, 18 nt, Homo sapiens
cuguuuucccaaccuccu

SEQ ID NO: 2019414 - RNA, 22 nt, Homo sapiens
uuggcauccgaaaccagcaucu

SEQ ID NO: 2019415 - RNA, 23 nt, Homo sapiens
cuuugagggacugccucugccac

SEQ ID NO: 2019416 - RNA, 21 nt, Homo sapiens
cccuggcugaccccaaagagc

SEQ ID NO: 2019417 - RNA, 14 nt, Homo sapiens
aaucacucagugau

SEQ ID NO: 2019418 - RNA, 17 nt, Homo sapiens
uuccgucuaaucucuca

SEQ ID NO: 2019419 - RNA, 22 nt, Homo sapiens
gcaauaauccaguaaucuaaag

SEQ ID NO: 2019420 - RNA, 14 nt, Homo sapiens
ugccagccauucuu

SEQ ID NO: 2019421 - RNA, 19 nt, Homo sapiens
gcucaauauuccugaauga

SEQ ID NO: 2019422 - RNA, 13 nt, Homo sapiens
auuugcacacugc

SEQ ID NO: 2019423 - RNA, 16 nt, Homo sapiens
uuugagagacugccau

SEQ ID NO: 2019424 - RNA, 17 nt, Homo sapiens
uuuggucaacuuaccaa

SEQ ID NO: 2019425 - RNA, 22 nt, Homo sapiens
auugaaaccauuccaguaggaa

SEQ ID NO: 2019426 - RNA, 16 nt, Homo sapiens
ugcaguaaacuuuuaa

SEQ ID NO: 2019427 - RNA, 19 nt, Homo sapiens
agcacagacucaaagggaa

SEQ ID NO: 2019428 - RNA, 22 nt, Homo sapiens
uauccagaggaauugauuguca

SEQ ID NO: 2019429 - RNA, 20 nt, Homo sapiens
gaaagagcugaaaauggaga

SEQ ID NO: 2019430 - RNA, 15 nt, Homo sapiens
aggagccuacuccaa

SEQ ID NO: 2019431 - RNA, 13 nt, Homo sapiens
acucugagacaaa

SEQ ID NO: 2019432 - RNA, 13 nt, Homo sapiens
uuugaauacacau

SEQ ID NO: 2019433 - RNA, 21 nt, Homo sapiens
acuaucaauaauacaaagcaa

SEQ ID NO: 2019434 - RNA, 21 nt, Homo sapiens
cagcccucaggccagugccag

SEQ ID NO: 2019435 - RNA, 12 nt, Homo sapiens
gccagccucuag

SEQ ID NO: 2019436 - RNA, 22 nt, Homo sapiens
acugagugccuacucuuugcca

SEQ ID NO: 2019437 - RNA, 19 nt, Homo sapiens
auauacuuugccacugcug

SEQ ID NO: 2019438 - RNA, 13 nt, Homo sapiens
auugccaaccagu

SEQ ID NO: 2019439 - RNA, 12 nt, Homo sapiens
ggugcaguccag

SEQ ID NO: 2019440 - RNA, 19 nt, Homo sapiens
uauuucauauaaauggaau

SEQ ID NO: 2019441 - RNA, 21 nt, Homo sapiens
aucaguuaacauuaacaucua

SEQ ID NO: 2019442 - RNA, 14 nt, Homo sapiens
ucucucuucccuca

SEQ ID NO: 2019443 - RNA, 19 nt, Homo sapiens
gugggucucugggcuguca

SEQ ID NO: 2019444 - RNA, 22 nt, Homo sapiens
cuucccuucucuccuucccucu

SEQ ID NO: 2019445 - RNA, 14 nt, Homo sapiens
cacugcagacauga

SEQ ID NO: 2019446 - RNA, 19 nt, Homo sapiens
ugcaagcaaaucccauuuc

SEQ ID NO: 2019447 - RNA, 12 nt, Homo sapiens
uugaacaucuca

SEQ ID NO: 2019448 - RNA, 17 nt, Homo sapiens
auaagcucccagggccu

SEQ ID NO: 2019449 - RNA, 20 nt, Homo sapiens
guuuauuccagagaagccag

SEQ ID NO: 2019450 - RNA, 15 nt, Homo sapiens
agcacugggugacca

SEQ ID NO: 2019451 - RNA, 23 nt, Homo sapiens
cucaucacauaaagaaauucaag

SEQ ID NO: 2019452 - RNA, 14 nt, Homo sapiens
uccccacacugacc

SEQ ID NO: 2019453 - RNA, 21 nt, Homo sapiens
aaggucuaccugaaaauucaa

SEQ ID NO: 2019454 - RNA, 13 nt, Homo sapiens
ugaugcagcauuu

SEQ ID NO: 2019455 - RNA, 11 nt, Homo sapiens
agagggcuccu

SEQ ID NO: 2019456 - RNA, 22 nt, Homo sapiens
auuagaaacacacuuuugcaca

SEQ ID NO: 2019457 - RNA, 18 nt, Homo sapiens
augauacuguuucuugca

SEQ ID NO: 2019458 - RNA, 13 nt, Homo sapiens
uccucucugcaag

SEQ ID NO: 2019459 - RNA, 16 nt, Homo sapiens
ggaggcaguccaucua

SEQ ID NO: 2019460 - RNA, 11 nt, Homo sapiens
cuccacucuga

SEQ ID NO: 2019461 - RNA, 20 nt, Homo sapiens
auguggagugagaacagcau

SEQ ID NO: 2019462 - RNA, 22 nt, Homo sapiens
uggcaagagcguuacuguagac

SEQ ID NO: 2019463 - RNA, 13 nt, Homo sapiens
ucaccccauuuca

SEQ ID NO: 2019464 - RNA, 20 nt, Homo sapiens
aaccgaagggacuggaucug

SEQ ID NO: 2019465 - RNA, 13 nt, Homo sapiens
uacucagacuguu

SEQ ID NO: 2019466 - RNA, 15 nt, Homo sapiens
augagucaaugugca

SEQ ID NO: 2019467 - RNA, 15 nt, Homo sapiens
agcuguugccucagu

SEQ ID NO: 2019468 - RNA, 16 nt, Homo sapiens
aauuaccagauaguua

SEQ ID NO: 2019469 - RNA, 17 nt, Homo sapiens
ucacuuaaaacuuuuaa

SEQ ID NO: 2019470 - RNA, 21 nt, Homo sapiens
caaccuggcaaaaaugcaaca

SEQ ID NO: 2019471 - RNA, 17 nt, Homo sapiens
uuuauaaagauauacca

SEQ ID NO: 2019472 - RNA, 17 nt, Homo sapiens
ugaagaaagagacugug

SEQ ID NO: 2019473 - RNA, 22 nt, Homo sapiens
ucugcuaauucgagucauggcu

SEQ ID NO: 2019474 - RNA, 18 nt, Homo sapiens
ccuguccugacucucucc

SEQ ID NO: 2019475 - RNA, 15 nt, Homo sapiens
ugacucuucaggcca

SEQ ID NO: 2019476 - RNA, 14 nt, Homo sapiens
uuguauuacuagaa

SEQ ID NO: 2019477 - RNA, 14 nt, Homo sapiens
aaaagcaauacugu

SEQ ID NO: 2019478 - RNA, 12 nt, Homo sapiens
aguauaacaguu

SEQ ID NO: 2019479 - RNA, 23 nt, Homo sapiens
uaaaaacaugagaaaugugaacu

SEQ ID NO: 2019480 - RNA, 19 nt, Homo sapiens
cggccagugcggcugccag

SEQ ID NO: 2019481 - RNA, 19 nt, Homo sapiens
acacucuauaagauuccaa

SEQ ID NO: 2019482 - RNA, 15 nt, Homo sapiens
uugaugacucaucaa

SEQ ID NO: 2019483 - RNA, 21 nt, Homo sapiens
guucuaccucaggcagcucaa

SEQ ID NO: 2019484 - RNA, 14 nt, Homo sapiens
ggccacaacagggc

SEQ ID NO: 2019485 - RNA, 17 nt, Homo sapiens
cauguucccaaaacaau

SEQ ID NO: 2019486 - RNA, 13 nt, Homo sapiens
gccuuuuuguaua

SEQ ID NO: 2019487 - RNA, 15 nt, Homo sapiens
cuguuacacaugaca

SEQ ID NO: 2019488 - RNA, 15 nt, Homo sapiens
ucuuaacacugaaac

SEQ ID NO: 2019489 - RNA, 15 nt, Homo sapiens
auuuuaaauacaaaa

SEQ ID NO: 2019490 - RNA, 15 nt, Homo sapiens
aagcuguuauuugca

SEQ ID NO: 2019491 - RNA, 21 nt, Homo sapiens
gcugucaaggccgagggccag

SEQ ID NO: 2019492 - RNA, 20 nt, Homo sapiens
agcuguuuaugcauagauaa

SEQ ID NO: 2019493 - RNA, 20 nt, Homo sapiens
aaccaauagacuguccugca

SEQ ID NO: 2019494 - RNA, 16 nt, Homo sapiens
aaagugucacuaagaa

SEQ ID NO: 2019495 - RNA, 20 nt, Homo sapiens
accccaggcucaacugagga

SEQ ID NO: 2019496 - RNA, 18 nt, Homo sapiens
guucucaacagacccagu

SEQ ID NO: 2019497 - RNA, 19 nt, Homo sapiens
gaaaaauaugauacucuca

SEQ ID NO: 2019498 - RNA, 18 nt, Homo sapiens
cuuggacucuccuaguga

SEQ ID NO: 2019499 - RNA, 17 nt, Homo sapiens
ccagcuaaggacauuuc

SEQ ID NO: 2019500 - RNA, 17 nt, Homo sapiens
aaguugcugaugaacuc

SEQ ID NO: 2019501 - RNA, 16 nt, Homo sapiens
ccagaaccacacuuga

SEQ ID NO: 2019502 - RNA, 18 nt, Homo sapiens
guacuguguuugauuugu

SEQ ID NO: 2019503 - RNA, 18 nt, Homo sapiens
aaucaagaaaauaugcca

SEQ ID NO: 2019504 - RNA, 23 nt, Homo sapiens
aauuuauuugugauguacuguaa

SEQ ID NO: 2019505 - RNA, 16 nt, Homo sapiens
uguaucuaaagucuuc

SEQ ID NO: 2019506 - RNA, 23 nt, Homo sapiens
ggaauauaagguuaagauaucau

SEQ ID NO: 2019507 - RNA, 19 nt, Homo sapiens
caugcuuuagccauacaca

SEQ ID NO: 2019508 - RNA, 14 nt, Homo sapiens
gcaaccucuuugcu

SEQ ID NO: 2019509 - RNA, 16 nt, Homo sapiens
uuccucuugcauuuca

SEQ ID NO: 2019510 - RNA, 19 nt, Homo sapiens
aaaaacuguuaaucagacu

SEQ ID NO: 2019511 - RNA, 22 nt, Homo sapiens
gagcaucccccaaaguucacaa

SEQ ID NO: 2019512 - RNA, 23 nt, Homo sapiens
aacugguauuguuuacguuugau

SEQ ID NO: 2019513 - RNA, 13 nt, Homo sapiens
gcauaaugcaauc

SEQ ID NO: 2019514 - RNA, 13 nt, Homo sapiens
gcaaaaugcaaac

SEQ ID NO: 2019515 - RNA, 17 nt, Homo sapiens
acugauggcagacaucu

SEQ ID NO: 2019516 - RNA, 17 nt, Homo sapiens
agaaacacguaucccac

SEQ ID NO: 2019517 - RNA, 18 nt, Homo sapiens
gaggcagcuguugcagug

SEQ ID NO: 2019518 - RNA, 21 nt, Homo sapiens
cagcaaaagcccuaacuucuu

SEQ ID NO: 2019519 - RNA, 19 nt, Homo sapiens
ugaaaaaaagggcacucug

SEQ ID NO: 2019520 - RNA, 17 nt, Homo sapiens
cugggcugaacacucca

SEQ ID NO: 2019521 - RNA, 20 nt, Homo sapiens
cacaguauuuacugugcuaa

SEQ ID NO: 2019522 - RNA, 14 nt, Homo sapiens
ucagcagugaugcu

SEQ ID NO: 2019523 - RNA, 22 nt, Homo sapiens
cucuuaagcuuccgccgucuca

SEQ ID NO: 2019524 - RNA, 13 nt, Homo sapiens
uguugacauagcc

SEQ ID NO: 2019525 - RNA, 19 nt, Homo sapiens
aucaauauugggccuaaaa

SEQ ID NO: 2019526 - RNA, 11 nt, Homo sapiens
cucaaagggaa

SEQ ID NO: 2019527 - RNA, 16 nt, Homo sapiens
guuggucuguacugau

SEQ ID NO: 2019528 - RNA, 12 nt, Homo sapiens
ugggcugcugca

SEQ ID NO: 2019529 - RNA, 21 nt, Homo sapiens
uggcucaugccucuaaucuca

SEQ ID NO: 2019530 - RNA, 14 nt, Homo sapiens
ucaugauaaucugg

SEQ ID NO: 2019531 - RNA, 22 nt, Homo sapiens
acaugguugauuuugugcuguu

SEQ ID NO: 2019532 - RNA, 22 nt, Homo sapiens
agaacauuaauuauauguauau

SEQ ID NO: 2019533 - RNA, 20 nt, Homo sapiens
acuguuugucucaccuaccc

SEQ ID NO: 2019534 - RNA, 18 nt, Homo sapiens
gcauccuccccaccagag

SEQ ID NO: 2019535 - RNA, 13 nt, Homo sapiens
uggacaugauuua

SEQ ID NO: 2019536 - RNA, 18 nt, Homo sapiens
aauaagcaaucaagguua

SEQ ID NO: 2019537 - RNA, 13 nt, Homo sapiens
ggcacuguucaau

SEQ ID NO: 2019538 - RNA, 22 nt, Homo sapiens
agcacuucucaccaaacuucau

SEQ ID NO: 2019539 - RNA, 15 nt, Homo sapiens
gcucuucucauuuca

SEQ ID NO: 2019540 - RNA, 19 nt, Homo sapiens
ccugccuuaggguagugcu

SEQ ID NO: 2019541 - RNA, 13 nt, Homo sapiens
uguaccucagugg

SEQ ID NO: 2019542 - RNA, 13 nt, Homo sapiens
aggaccucugggg

SEQ ID NO: 2019543 - RNA, 15 nt, Homo sapiens
ggcugaccaugcuca

SEQ ID NO: 2019544 - RNA, 13 nt, Homo sapiens
cacaacacaauca

SEQ ID NO: 2019545 - RNA, 14 nt, Homo sapiens
gaaauaaacacugg

SEQ ID NO: 2019546 - RNA, 14 nt, Homo sapiens
gacuugaacaaaga

SEQ ID NO: 2019547 - RNA, 22 nt, Homo sapiens
guuccaggaauuuugugugauu

SEQ ID NO: 2019548 - RNA, 16 nt, Homo sapiens
ccagaauggaacucaa

SEQ ID NO: 2019549 - RNA, 13 nt, Homo sapiens
uccagggacaagc

SEQ ID NO: 2019550 - RNA, 17 nt, Homo sapiens
aauugcucauaagcaau

SEQ ID NO: 2019551 - RNA, 23 nt, Homo sapiens
ccagugagaugacauugccucag

SEQ ID NO: 2019552 - RNA, 16 nt, Homo sapiens
caagugugcauggcug

SEQ ID NO: 2019553 - RNA, 15 nt, Homo sapiens
cuuuccuuuccauug

SEQ ID NO: 2019554 - RNA, 14 nt, Homo sapiens
cuacagaaagcaaa

SEQ ID NO: 2019555 - RNA, 17 nt, Homo sapiens
gugagaaggagauucaa

SEQ ID NO: 2019556 - RNA, 19 nt, Homo sapiens
auauaaauuuguguucuca

SEQ ID NO: 2019557 - RNA, 19 nt, Homo sapiens
uccugagucugggcaauga

SEQ ID NO: 2019558 - RNA, 16 nt, Homo sapiens
cuguauagggcucguu

SEQ ID NO: 2019559 - RNA, 14 nt, Homo sapiens
ucacaguuacguga

SEQ ID NO: 2019560 - RNA, 15 nt, Homo sapiens
cauuacagauucugc

SEQ ID NO: 2019561 - RNA, 18 nt, Homo sapiens
acguguagccaaccugcu

SEQ ID NO: 2019562 - RNA, 17 nt, Homo sapiens
cauuuaauaacuuugcu

SEQ ID NO: 2019563 - RNA, 15 nt, Homo sapiens
accaucacagcuugu

SEQ ID NO: 2019564 - RNA, 23 nt, Homo sapiens
uagcuuuagggcaauauugccau

SEQ ID NO: 2019565 - RNA, 15 nt, Homo sapiens
cacaaagagaguuaa

SEQ ID NO: 2019566 - RNA, 13 nt, Homo sapiens
caugugcaccugc

SEQ ID NO: 2019567 - RNA, 14 nt, Homo sapiens
guguccacauaauc

SEQ ID NO: 2019568 - RNA, 18 nt, Homo sapiens
gcaaacaaaaccaauuca

SEQ ID NO: 2019569 - RNA, 19 nt, Homo sapiens
aauaugcaauccuacuucu

SEQ ID NO: 2019570 - RNA, 17 nt, Homo sapiens
uuaauuuggaaacuaau

SEQ ID NO: 2019571 - RNA, 15 nt, Homo sapiens
uuuugccugcaagag

SEQ ID NO: 2019572 - RNA, 23 nt, Homo sapiens
caaauacauaccuacugacugau

SEQ ID NO: 2019573 - RNA, 20 nt, Homo sapiens
accaaacccggccugauuaa

SEQ ID NO: 2019574 - RNA, 18 nt, Homo sapiens
agugcggcacugcaaaga

SEQ ID NO: 2019575 - RNA, 22 nt, Homo sapiens
cacuccuuccugccaccugcug

SEQ ID NO: 2019576 - RNA, 21 nt, Homo sapiens
agaaagcaaaugugaccugug

SEQ ID NO: 2019577 - RNA, 17 nt, Homo sapiens
cucgaagcccuuccagu

SEQ ID NO: 2019578 - RNA, 16 nt, Homo sapiens
acaacauuucauauca

SEQ ID NO: 2019579 - RNA, 16 nt, Homo sapiens
ggacaugagauuuuau

SEQ ID NO: 2019580 - RNA, 12 nt, Homo sapiens
acccagcaaaac

SEQ ID NO: 2019581 - RNA, 21 nt, Homo sapiens
cccacagucccaucugcuuca

SEQ ID NO: 2019582 - RNA, 21 nt, Homo sapiens
aagcucccagcuccuuucaug

SEQ ID NO: 2019583 - RNA, 17 nt, Homo sapiens
cugcauguucauugcaa

SEQ ID NO: 2019584 - RNA, 15 nt, Homo sapiens
gacccuagcucuuuc

SEQ ID NO: 2019585 - RNA, 17 nt, Homo sapiens
accaacaguuccuucag

SEQ ID NO: 2019586 - RNA, 19 nt, Homo sapiens
uaccucgcaucauugcaga

SEQ ID NO: 2019587 - RNA, 20 nt, Homo sapiens
gagcaugcucaguuggugcu

SEQ ID NO: 2019588 - RNA, 19 nt, Homo sapiens
agccccugggaauguucca

SEQ ID NO: 2019589 - RNA, 16 nt, Homo sapiens
ggaguggaaggugagg

SEQ ID NO: 2019590 - RNA, 12 nt, Homo sapiens
acugaagccaca

SEQ ID NO: 2019591 - RNA, 12 nt, Homo sapiens
acgagcuauauu

SEQ ID NO: 2019592 - RNA, 19 nt, Homo sapiens
uuucuuucaaagaagccag

SEQ ID NO: 2019593 - RNA, 20 nt, Homo sapiens
uuccaauuuacauacucugc

SEQ ID NO: 2019594 - RNA, 16 nt, Homo sapiens
auauuaagaaugaucu

SEQ ID NO: 2019595 - RNA, 23 nt, Homo sapiens
aguaucugucucauccaaaaagu

SEQ ID NO: 2019596 - RNA, 14 nt, Homo sapiens
gcuuccacaugugc

SEQ ID NO: 2019597 - RNA, 21 nt, Homo sapiens
gccugucccaggacucacccu

SEQ ID NO: 2019598 - RNA, 13 nt, Homo sapiens
ccaguucuugcaa

SEQ ID NO: 2019599 - RNA, 15 nt, Homo sapiens
agcugcuuccagugg

SEQ ID NO: 2019600 - RNA, 20 nt, Homo sapiens
gccucagggugcacacagga

SEQ ID NO: 2019601 - RNA, 15 nt, Homo sapiens
caucaggguuugcaa

SEQ ID NO: 2019602 - RNA, 18 nt, Homo sapiens
cccaucagcacucuguaa

SEQ ID NO: 2019603 - RNA, 23 nt, Homo sapiens
cuagguagagauauuggaaggcu

SEQ ID NO: 2019604 - RNA, 12 nt, Homo sapiens
aggggucacuua

SEQ ID NO: 2019605 - RNA, 17 nt, Homo sapiens
aacugcagucacugcac

SEQ ID NO: 2019606 - RNA, 21 nt, Homo sapiens
uggggcccaagcaugccccac

SEQ ID NO: 2019607 - RNA, 16 nt, Homo sapiens
uguuacuaaauccuuu

SEQ ID NO: 2019608 - RNA, 22 nt, Homo sapiens
gcauucaaaaagacagcagaca

SEQ ID NO: 2019609 - RNA, 23 nt, Homo sapiens
accccuuccuccccaaccugcaa

SEQ ID NO: 2019610 - RNA, 14 nt, Homo sapiens
gagagaaagccaca

SEQ ID NO: 2019611 - RNA, 14 nt, Homo sapiens
gagaggaagccacg

SEQ ID NO: 2019612 - RNA, 22 nt, Homo sapiens
auuguucagcaugcaauacaua

SEQ ID NO: 2019613 - RNA, 16 nt, Homo sapiens
acaaggacacgcgccc

SEQ ID NO: 2019614 - RNA, 18 nt, Homo sapiens
uaccuuggcugauguugc

SEQ ID NO: 2019615 - RNA, 12 nt, Homo sapiens
aauaaaaaagcc

SEQ ID NO: 2019616 - RNA, 18 nt, Homo sapiens
uucauuuauucauguuau

SEQ ID NO: 2019617 - RNA, 15 nt, Homo sapiens
uuuggauaaacaaca

SEQ ID NO: 2019618 - RNA, 16 nt, Homo sapiens
ucacaccucacuguca

SEQ ID NO: 2019619 - RNA, 15 nt, Homo sapiens
cucugugcucugaau

SEQ ID NO: 2019620 - RNA, 17 nt, Homo sapiens
cuacccuauucuaucca

SEQ ID NO: 2019621 - RNA, 17 nt, Homo sapiens
gccuauucacuugcuga

SEQ ID NO: 2019622 - RNA, 18 nt, Homo sapiens
uuaaaaucucaacuauaa

SEQ ID NO: 2019623 - RNA, 21 nt, Homo sapiens
augaaaaaaaucuuugcuugu

SEQ ID NO: 2019624 - RNA, 14 nt, Homo sapiens
agcccuuugcucug

SEQ ID NO: 2019625 - RNA, 10 nt, Homo sapiens
uacuuuuugg

SEQ ID NO: 2019626 - RNA, 17 nt, Homo sapiens
uuaugaauaguuuccaa

SEQ ID NO: 2019627 - RNA, 23 nt, Homo sapiens
agguggcccuuguuuacagugag

SEQ ID NO: 2019628 - RNA, 19 nt, Homo sapiens
agaucacaaauaguguuga

SEQ ID NO: 2019629 - RNA, 18 nt, Homo sapiens
caaagcccauagcacugg

SEQ ID NO: 2019630 - RNA, 13 nt, Homo sapiens
cuaaccacuucag

SEQ ID NO: 2019631 - RNA, 15 nt, Homo sapiens
cucgacaaaggccac

SEQ ID NO: 2019632 - RNA, 17 nt, Homo sapiens
ccuuagagcuuggacag

SEQ ID NO: 2019633 - RNA, 21 nt, Homo sapiens
acauucuuguuuuaagugccu

SEQ ID NO: 2019634 - RNA, 12 nt, Homo sapiens
ccagagguugug

SEQ ID NO: 2019635 - RNA, 21 nt, Homo sapiens
uaaaacucaaccccuucgaua

SEQ ID NO: 2019636 - RNA, 21 nt, Homo sapiens
acccugcucccacgccugcuu

SEQ ID NO: 2019637 - RNA, 16 nt, Homo sapiens
caaugcuucuguugau

SEQ ID NO: 2019638 - RNA, 21 nt, Homo sapiens
acuguagcaaccugaaauuaa

SEQ ID NO: 2019639 - RNA, 19 nt, Homo sapiens
caaugccacagacaacuca

SEQ ID NO: 2019640 - RNA, 18 nt, Homo sapiens
acaucaagccugugauug

SEQ ID NO: 2019641 - RNA, 16 nt, Homo sapiens
ucaaguaauucugcug

SEQ ID NO: 2019642 - RNA, 22 nt, Homo sapiens
ugacuuccugaacaaccagcug

SEQ ID NO: 2019643 - RNA, 15 nt, Homo sapiens
guuuuaugcauugau

SEQ ID NO: 2019644 - RNA, 23 nt, Homo sapiens
gaugcccaccguuaggauucagg

SEQ ID NO: 2019645 - RNA, 19 nt, Homo sapiens
acaugugucccagccacag

SEQ ID NO: 2019646 - RNA, 13 nt, Homo sapiens
uaaaugacuugga

SEQ ID NO: 2019647 - RNA, 17 nt, Homo sapiens
gcaaaaauauauaugua

SEQ ID NO: 2019648 - RNA, 13 nt, Homo sapiens
uauuuauuuucag

SEQ ID NO: 2019649 - RNA, 12 nt, Homo sapiens
gagaacugcuga

SEQ ID NO: 2019650 - RNA, 16 nt, Homo sapiens
gcagcagcccccagcu

SEQ ID NO: 2019651 - RNA, 21 nt, Homo sapiens
uuauucaauaacuauugcugc

SEQ ID NO: 2019652 - RNA, 14 nt, Homo sapiens
cggucacaccucac

SEQ ID NO: 2019653 - RNA, 16 nt, Homo sapiens
aguggcauucacaucu

SEQ ID NO: 2019654 - RNA, 19 nt, Homo sapiens
guaaucccaguacuuggga

SEQ ID NO: 2019655 - RNA, 19 nt, Homo sapiens
agguugcagacucucucuu

SEQ ID NO: 2019656 - RNA, 16 nt, Homo sapiens
cugcuaauagcugcua

SEQ ID NO: 2019657 - RNA, 17 nt, Homo sapiens
auagccuaggugacaga

SEQ ID NO: 2019658 - RNA, 13 nt, Homo sapiens
cagccaccacuga

SEQ ID NO: 2019659 - RNA, 22 nt, Homo sapiens
agccugggcguacagagcacau

SEQ ID NO: 2019660 - RNA, 19 nt, Homo sapiens
auuccugucagagcuuuca

SEQ ID NO: 2019661 - RNA, 20 nt, Homo sapiens
gcaagaucugcucgcugaga

SEQ ID NO: 2019662 - RNA, 22 nt, Homo sapiens
ggauugggacgcacagugcagu

SEQ ID NO: 2019663 - RNA, 23 nt, Homo sapiens
aaaugaugacgugucuccucacu

SEQ ID NO: 2019664 - RNA, 22 nt, Homo sapiens
accagucccuccccaaaugcuu

SEQ ID NO: 2019665 - RNA, 13 nt, Homo sapiens
uuauaucaucagc

SEQ ID NO: 2019666 - RNA, 12 nt, Homo sapiens
uccucuguucac

SEQ ID NO: 2019667 - RNA, 23 nt, Homo sapiens
agcuaaguugcaccaacuuugaa

SEQ ID NO: 2019668 - RNA, 18 nt, Homo sapiens
aacagccccagucuuccu

SEQ ID NO: 2019669 - RNA, 17 nt, Homo sapiens
aauuguuuuaccagcuc

SEQ ID NO: 2019670 - RNA, 20 nt, Homo sapiens
ucaaauggacucauggcuua

SEQ ID NO: 2019671 - RNA, 23 nt, Homo sapiens
acuguauuuauugugaugccuug

SEQ ID NO: 2019672 - RNA, 20 nt, Homo sapiens
aauucaaucagagcuccagu

SEQ ID NO: 2019673 - RNA, 23 nt, Homo sapiens
uuaguagagacaguguuuugcca

SEQ ID NO: 2019674 - RNA, 15 nt, Homo sapiens
agugggcagugcaug

SEQ ID NO: 2019675 - RNA, 13 nt, Homo sapiens
aaaaaaaccacag

SEQ ID NO: 2019676 - RNA, 13 nt, Homo sapiens
cucagaacauaaa

SEQ ID NO: 2019677 - RNA, 13 nt, Homo sapiens
aacaaaaccaaag

SEQ ID NO: 2019678 - RNA, 13 nt, Homo sapiens
cucugccuuugag

SEQ ID NO: 2019679 - RNA, 20 nt, Homo sapiens
cagaguguccugcuaccuuu

SEQ ID NO: 2019680 - RNA, 17 nt, Homo sapiens
gaauuguuccaguacua

SEQ ID NO: 2019681 - RNA, 21 nt, Homo sapiens
agccccagggcccugcucagg

SEQ ID NO: 2019682 - RNA, 13 nt, Homo sapiens
cacacuuacugua

SEQ ID NO: 2019683 - RNA, 23 nt, Homo sapiens
uaacacagaccccuagggauuua

SEQ ID NO: 2019684 - RNA, 20 nt, Homo sapiens
ggguucauuugugaugacau

SEQ ID NO: 2019685 - RNA, 19 nt, Homo sapiens
aaguggcagcuucacucga

SEQ ID NO: 2019686 - RNA, 18 nt, Homo sapiens
aaaaugagagcuguaacu

SEQ ID NO: 2019687 - RNA, 12 nt, Homo sapiens
ucucucauuccc

SEQ ID NO: 2019688 - RNA, 18 nt, Homo sapiens
cagcaguuugugaucugu

SEQ ID NO: 2019689 - RNA, 16 nt, Homo sapiens
ugucucauccaaaaag

SEQ ID NO: 2019690 - RNA, 14 nt, Homo sapiens
ccacacccaugugu

SEQ ID NO: 2019691 - RNA, 15 nt, Homo sapiens
uaggauuaauaaaga

SEQ ID NO: 2019692 - RNA, 21 nt, Homo sapiens
aauguaaaauaaaggcucugu

SEQ ID NO: 2019693 - RNA, 17 nt, Homo sapiens
caagaaauugccuccuu

SEQ ID NO: 2019694 - RNA, 15 nt, Homo sapiens
uaaaauucuagucuc

SEQ ID NO: 2019695 - RNA, 20 nt, Homo sapiens
cuaaucaccauguaagcacu

SEQ ID NO: 2019696 - RNA, 16 nt, Homo sapiens
cugccgcccggugcca

SEQ ID NO: 2019697 - RNA, 14 nt, Homo sapiens
cugagcugcucuga

SEQ ID NO: 2019698 - RNA, 19 nt, Homo sapiens
cccaucgccccaccgcagc

SEQ ID NO: 2019699 - RNA, 13 nt, Homo sapiens
ucccuagcccuuc

SEQ ID NO: 2019700 - RNA, 14 nt, Homo sapiens
caucucaagugcca

SEQ ID NO: 2019701 - RNA, 14 nt, Homo sapiens
gcugccauccaugu

SEQ ID NO: 2019702 - RNA, 12 nt, Homo sapiens
aagaaaucuggu

SEQ ID NO: 2019703 - RNA, 23 nt, Homo sapiens
uuacuguauuuaagaaaacacca

SEQ ID NO: 2019704 - RNA, 22 nt, Homo sapiens
auuugcuuuaaugagugcaccu

SEQ ID NO: 2019705 - RNA, 19 nt, Homo sapiens
caaguguucacugcuccuu

SEQ ID NO: 2019706 - RNA, 17 nt, Homo sapiens
auauauuuuuaccaucu

SEQ ID NO: 2019707 - RNA, 15 nt, Homo sapiens
cuuucgaaagcaaug

SEQ ID NO: 2019708 - RNA, 17 nt, Homo sapiens
cagucacaugugcucuc

SEQ ID NO: 2019709 - RNA, 22 nt, Homo sapiens
ggaauguugggucucacucucu

SEQ ID NO: 2019710 - RNA, 15 nt, Homo sapiens
caggaauagaugugg

SEQ ID NO: 2019711 - RNA, 15 nt, Homo sapiens
gugcucacugaccug

SEQ ID NO: 2019712 - RNA, 12 nt, Homo sapiens
gcgcugugcugg

SEQ ID NO: 2019713 - RNA, 12 nt, Homo sapiens
aggaauacucau

SEQ ID NO: 2019714 - RNA, 23 nt, Homo sapiens
cagagccaugucuucucccugga

SEQ ID NO: 2019715 - RNA, 14 nt, Homo sapiens
cugccuucucagga

SEQ ID NO: 2019716 - RNA, 20 nt, Homo sapiens
caggaauuugggacccugcu

SEQ ID NO: 2019717 - RNA, 20 nt, Homo sapiens
ucaucaggcuuggaaugaau

SEQ ID NO: 2019718 - RNA, 16 nt, Homo sapiens
auaagcccaauaucag

SEQ ID NO: 2019719 - RNA, 17 nt, Homo sapiens
cuuuuccaaaauuacuu

SEQ ID NO: 2019720 - RNA, 14 nt, Homo sapiens
aguugggauuacag

SEQ ID NO: 2019721 - RNA, 18 nt, Homo sapiens
ugucuacacacccugcau

SEQ ID NO: 2019722 - RNA, 22 nt, Homo sapiens
acacaaugcuauugaaauuacu

SEQ ID NO: 2019723 - RNA, 21 nt, Homo sapiens
aaauauccagccaguacagua

SEQ ID NO: 2019724 - RNA, 17 nt, Homo sapiens
gccaaacacuagcucug

SEQ ID NO: 2019725 - RNA, 16 nt, Homo sapiens
ugcaucuccccucaga

SEQ ID NO: 2019726 - RNA, 12 nt, Homo sapiens
uguaccacuggg

SEQ ID NO: 2019727 - RNA, 17 nt, Homo sapiens
agaguuuuaacuuuuaa

SEQ ID NO: 2019728 - RNA, 17 nt, Homo sapiens
aacuucuuccugugaag

SEQ ID NO: 2019729 - RNA, 15 nt, Homo sapiens
guagcucaaucugca

SEQ ID NO: 2019730 - RNA, 15 nt, Homo sapiens
ugccuaucugacuuc

SEQ ID NO: 2019731 - RNA, 14 nt, Homo sapiens
uggcuacuuuuuca

SEQ ID NO: 2019732 - RNA, 16 nt, Homo sapiens
guauaaguaacacuag

SEQ ID NO: 2019733 - RNA, 19 nt, Homo sapiens
aaaauucauaaccaaagag

SEQ ID NO: 2019734 - RNA, 11 nt, Homo sapiens
agaucuuucaa

SEQ ID NO: 2019735 - RNA, 22 nt, Homo sapiens
gcuaggucugaccaaaaccaga

SEQ ID NO: 2019736 - RNA, 17 nt, Homo sapiens
gguccacucuuguugaa

SEQ ID NO: 2019737 - RNA, 16 nt, Homo sapiens
gccuuccucucucuac

SEQ ID NO: 2019738 - RNA, 21 nt, Homo sapiens
ucaucuuguugccauggaguu

SEQ ID NO: 2019739 - RNA, 11 nt, Homo sapiens
aaggcaucuga

SEQ ID NO: 2019740 - RNA, 17 nt, Homo sapiens
auggugaaaucugcucu

SEQ ID NO: 2019741 - RNA, 15 nt, Homo sapiens
aaaguauuauucaaa

SEQ ID NO: 2019742 - RNA, 18 nt, Homo sapiens
agcagcauaggaacaaua

SEQ ID NO: 2019743 - RNA, 23 nt, Homo sapiens
agccucuagagcagacuacagcu

SEQ ID NO: 2019744 - RNA, 17 nt, Homo sapiens
caggugccuucccagac

SEQ ID NO: 2019745 - RNA, 21 nt, Homo sapiens
aauugcaacagaagcaaaaau

SEQ ID NO: 2019746 - RNA, 21 nt, Homo sapiens
gucugaguaagcccucaggag

SEQ ID NO: 2019747 - RNA, 15 nt, Homo sapiens
gcucuggaggagcaa

SEQ ID NO: 2019748 - RNA, 21 nt, Homo sapiens
ucagggaaggaggagccuguc

SEQ ID NO: 2019749 - RNA, 23 nt, Homo sapiens
cccagcccaaccgggaaaggcau

SEQ ID NO: 2019750 - RNA, 18 nt, Homo sapiens
uaaaguaugguauugaaa

SEQ ID NO: 2019751 - RNA, 19 nt, Homo sapiens
ccagcagaucccagcucac

SEQ ID NO: 2019752 - RNA, 14 nt, Homo sapiens
uaaauaauugcucc

SEQ ID NO: 2019753 - RNA, 22 nt, Homo sapiens
acaauggucauuuccagacaaa

SEQ ID NO: 2019754 - RNA, 14 nt, Homo sapiens
caucuugaguauuu

SEQ ID NO: 2019755 - RNA, 18 nt, Homo sapiens
cugcccgggagggcuucc

SEQ ID NO: 2019756 - RNA, 18 nt, Homo sapiens
caagaagggacugagaga

SEQ ID NO: 2019757 - RNA, 23 nt, Homo sapiens
ugagaagauucaauuuaaaauca

SEQ ID NO: 2019758 - RNA, 14 nt, Homo sapiens
gucaucaucacauu

SEQ ID NO: 2019759 - RNA, 21 nt, Homo sapiens
ucucuacuaaaaacacaaaag

SEQ ID NO: 2019760 - RNA, 14 nt, Homo sapiens
uuaacauauuugca

SEQ ID NO: 2019761 - RNA, 14 nt, Homo sapiens
cuguccuauggaag

SEQ ID NO: 2019762 - RNA, 18 nt, Homo sapiens
aguacuuuuggugucauu

SEQ ID NO: 2019763 - RNA, 14 nt, Homo sapiens
aguggaacagucac

SEQ ID NO: 2019764 - RNA, 17 nt, Homo sapiens
gcugguccugcacauga

SEQ ID NO: 2019765 - RNA, 13 nt, Homo sapiens
cacaaaguguaua

SEQ ID NO: 2019766 - RNA, 18 nt, Homo sapiens
acauaucgcugacuucau

SEQ ID NO: 2019767 - RNA, 13 nt, Homo sapiens
aaugcuucuuccc

SEQ ID NO: 2019768 - RNA, 17 nt, Homo sapiens
auucucaguaacuuuua

SEQ ID NO: 2019769 - RNA, 18 nt, Homo sapiens
cucuguucccaguaguua

SEQ ID NO: 2019770 - RNA, 22 nt, Homo sapiens
ggacaauuagauaaauguccau

SEQ ID NO: 2019771 - RNA, 15 nt, Homo sapiens
cagacacaacccaau

SEQ ID NO: 2019772 - RNA, 23 nt, Homo sapiens
guuccuuggguuauuauuuugca

SEQ ID NO: 2019773 - RNA, 19 nt, Homo sapiens
ucccaaaccuaaugaucau

SEQ ID NO: 2019774 - RNA, 24 nt, Homo sapiens
ggucaucugaccuucaccuuggau

SEQ ID NO: 2019775 - RNA, 13 nt, Homo sapiens
gacauauuugaau

SEQ ID NO: 2019776 - RNA, 17 nt, Homo sapiens
ucagcugagguuugcac

SEQ ID NO: 2019777 - RNA, 17 nt, Homo sapiens
ugaaaacuuagccagag

SEQ ID NO: 2019778 - RNA, 15 nt, Homo sapiens
auuaggacuguauaa

SEQ ID NO: 2019779 - RNA, 20 nt, Homo sapiens
acugcuguguuugagcucug

SEQ ID NO: 2019780 - RNA, 17 nt, Homo sapiens
gaguaacgagaagacaa

SEQ ID NO: 2019781 - RNA, 23 nt, Homo sapiens
accaccugguuccggcucugcac

SEQ ID NO: 2019782 - RNA, 19 nt, Homo sapiens
guuuaccuuguauacugua

SEQ ID NO: 2019783 - RNA, 20 nt, Homo sapiens
agacagggcaaucuugucca

SEQ ID NO: 2019784 - RNA, 15 nt, Homo sapiens
uaucagcuacaauug

SEQ ID NO: 2019785 - RNA, 14 nt, Homo sapiens
gagcugggcagcug

SEQ ID NO: 2019786 - RNA, 20 nt, Homo sapiens
ccuguccccaagacacuucc

SEQ ID NO: 2019787 - RNA, 19 nt, Homo sapiens
aaccaaagucacaaaucau

SEQ ID NO: 2019788 - RNA, 21 nt, Homo sapiens
acagggcuucucucaggccca

SEQ ID NO: 2019789 - RNA, 16 nt, Homo sapiens
uaugugguugauaaug

SEQ ID NO: 2019790 - RNA, 22 nt, Homo sapiens
agaaagaggagcgugucucuga

SEQ ID NO: 2019791 - RNA, 24 nt, Homo sapiens
aggaauccuggaccaagcacaaaa

SEQ ID NO: 2019792 - RNA, 22 nt, Homo sapiens
aguuucuccuuuugaccaaaua

SEQ ID NO: 2019793 - RNA, 17 nt, Homo sapiens
cgagcaggcuacuguca

SEQ ID NO: 2019794 - RNA, 18 nt, Homo sapiens
acaggccauggauggaaa

SEQ ID NO: 2019795 - RNA, 21 nt, Homo sapiens
gcacuucccauuuguguuuca

SEQ ID NO: 2019796 - RNA, 14 nt, Homo sapiens
ggacagacagcagc

SEQ ID NO: 2019797 - RNA, 17 nt, Homo sapiens
gcacccacuuaaucuac

SEQ ID NO: 2019798 - RNA, 21 nt, Homo sapiens
caauccacaaugagaugcaug

SEQ ID NO: 2019799 - RNA, 16 nt, Homo sapiens
cuuccaagucauucuc

SEQ ID NO: 2019800 - RNA, 19 nt, Homo sapiens
ugugccacaccccaugcac

SEQ ID NO: 2019801 - RNA, 18 nt, Homo sapiens
acaagccugaguccaguu

SEQ ID NO: 2019802 - RNA, 20 nt, Homo sapiens
caaauuaucuuuuuucuucc

SEQ ID NO: 2019803 - RNA, 19 nt, Homo sapiens
gcacagaaggaaucugugc

SEQ ID NO: 2019804 - RNA, 17 nt, Homo sapiens
uuauuaaaauucugaau

SEQ ID NO: 2019805 - RNA, 16 nt, Homo sapiens
uagagacaggguuuca

SEQ ID NO: 2019806 - RNA, 20 nt, Homo sapiens
gcaaaaugguccuguggcug

SEQ ID NO: 2019807 - RNA, 15 nt, Homo sapiens
gaggccucgacccac

SEQ ID NO: 2019808 - RNA, 16 nt, Homo sapiens
gcaggagucucugcca

SEQ ID NO: 2019809 - RNA, 20 nt, Homo sapiens
cagaugccuacaaccauccc

SEQ ID NO: 2019810 - RNA, 21 nt, Homo sapiens
agcagaugaccccuccccuaa

SEQ ID NO: 2019811 - RNA, 20 nt, Homo sapiens
auaaaaucuaauuaauucuu

SEQ ID NO: 2019812 - RNA, 19 nt, Homo sapiens
uucauucauuucauuguga

SEQ ID NO: 2019813 - RNA, 14 nt, Homo sapiens
guuuaauauuccaa

SEQ ID NO: 2019814 - RNA, 14 nt, Homo sapiens
caugcucaguauug

SEQ ID NO: 2019815 - RNA, 17 nt, Homo sapiens
agcagguaguccaggau

SEQ ID NO: 2019816 - RNA, 19 nt, Homo sapiens
agugccacccgcaggugug

SEQ ID NO: 2019817 - RNA, 19 nt, Homo sapiens
cuauccuguguauguauaa

SEQ ID NO: 2019818 - RNA, 15 nt, Homo sapiens
agacaguauugccac

SEQ ID NO: 2019819 - RNA, 23 nt, Homo sapiens
accagaugggaugggcuuucuca

SEQ ID NO: 2019820 - RNA, 24 nt, Homo sapiens
aaucuuuuguuuuaauauaagaau

SEQ ID NO: 2019821 - RNA, 13 nt, Homo sapiens
aggucagccugga

SEQ ID NO: 2019822 - RNA, 23 nt, Homo sapiens
ucaagcuggugcuacuguuugau

SEQ ID NO: 2019823 - RNA, 14 nt, Homo sapiens
ucaaaauaaucuga

SEQ ID NO: 2019824 - RNA, 19 nt, Homo sapiens
uagaacacccacuggccag

SEQ ID NO: 2019825 - RNA, 18 nt, Homo sapiens
gagcccggaggacaggcu

SEQ ID NO: 2019826 - RNA, 20 nt, Homo sapiens
uggagcgagcagaugcaauc

SEQ ID NO: 2019827 - RNA, 23 nt, Homo sapiens
cuacguuggugcaagugugcaug

SEQ ID NO: 2019828 - RNA, 15 nt, Homo sapiens
agugagccuggugga

SEQ ID NO: 2019829 - RNA, 16 nt, Homo sapiens
uuuagaagugugaauu

SEQ ID NO: 2019830 - RNA, 18 nt, Homo sapiens
uuccacucccuuugccag

SEQ ID NO: 2019831 - RNA, 23 nt, Homo sapiens
uaaucaaagauugaacacugcgu

SEQ ID NO: 2019832 - RNA, 16 nt, Homo sapiens
gccuagccgaccucag

SEQ ID NO: 2019833 - RNA, 20 nt, Homo sapiens
aaucuuuggguaacuucaaa

SEQ ID NO: 2019834 - RNA, 17 nt, Homo sapiens
uggugugauugcacaga

SEQ ID NO: 2019835 - RNA, 22 nt, Homo sapiens
cuggagauggacaacucaauga

SEQ ID NO: 2019836 - RNA, 14 nt, Homo sapiens
auuuaguuccacaa

SEQ ID NO: 2019837 - RNA, 19 nt, Homo sapiens
uaccauauggaaugccaaa

SEQ ID NO: 2019838 - RNA, 13 nt, Homo sapiens
accuucauucucc

SEQ ID NO: 2019839 - RNA, 16 nt, Homo sapiens
acagugaggugcccag

SEQ ID NO: 2019840 - RNA, 21 nt, Homo sapiens
auguguguauguuuauguuaa

SEQ ID NO: 2019841 - RNA, 21 nt, Homo sapiens
ggaaggguggauugauguuua

SEQ ID NO: 2019842 - RNA, 18 nt, Homo sapiens
ugaccuuuaaaugcaaca

SEQ ID NO: 2019843 - RNA, 21 nt, Homo sapiens
ccacaccuggaaacagaccaa

SEQ ID NO: 2019844 - RNA, 14 nt, Homo sapiens
guccuguucuuccu

SEQ ID NO: 2019845 - RNA, 16 nt, Homo sapiens
agucccaaaacccuua

SEQ ID NO: 2019846 - RNA, 15 nt, Homo sapiens
ucacaagccaagguc

SEQ ID NO: 2019847 - RNA, 12 nt, Homo sapiens
uugauauacuuu

SEQ ID NO: 2019848 - RNA, 24 nt, Homo sapiens
acugauuccuuuaugaugacugcu

SEQ ID NO: 2019849 - RNA, 14 nt, Homo sapiens
caguucugcuccuc

SEQ ID NO: 2019850 - RNA, 23 nt, Homo sapiens
uaaaauguauuauguccugugag

SEQ ID NO: 2019851 - RNA, 13 nt, Homo sapiens
acccugaccagcu

SEQ ID NO: 2019852 - RNA, 12 nt, Homo sapiens
gaaauaguucca

SEQ ID NO: 2019853 - RNA, 16 nt, Homo sapiens
ugcugaaguacagucc

SEQ ID NO: 2019854 - RNA, 19 nt, Homo sapiens
aaggauugggagcauggga

SEQ ID NO: 2019855 - RNA, 23 nt, Homo sapiens
aggcagaucugugccccaugccu

SEQ ID NO: 2019856 - RNA, 17 nt, Homo sapiens
gacagucguucccagug

SEQ ID NO: 2019857 - RNA, 18 nt, Homo sapiens
ugccaagggguuaaugaa

SEQ ID NO: 2019858 - RNA, 19 nt, Homo sapiens
uguacagaguaaguucuca

SEQ ID NO: 2019859 - RNA, 19 nt, Homo sapiens
ccccaagcagccagccagu

SEQ ID NO: 2019860 - RNA, 23 nt, Homo sapiens
gagcucaguugagaaacaguucc

SEQ ID NO: 2019861 - RNA, 12 nt, Homo sapiens
cacuuugccucc

SEQ ID NO: 2019862 - RNA, 19 nt, Homo sapiens
cugggcuugugaacaccuc

SEQ ID NO: 2019863 - RNA, 16 nt, Homo sapiens
ucugcccgcuccaugg

SEQ ID NO: 2019864 - RNA, 19 nt, Homo sapiens
aauuguaaacuguacuagu

SEQ ID NO: 2019865 - RNA, 17 nt, Homo sapiens
aaagaggcuaugugagc

SEQ ID NO: 2019866 - RNA, 14 nt, Homo sapiens
cucugauacagaca

SEQ ID NO: 2019867 - RNA, 21 nt, Homo sapiens
ugcuacagggcucacagaauu

SEQ ID NO: 2019868 - RNA, 20 nt, Homo sapiens
ugauuauucuuguucaggga

SEQ ID NO: 2019869 - RNA, 16 nt, Homo sapiens
cucuaguugacuucaa

SEQ ID NO: 2019870 - RNA, 19 nt, Homo sapiens
accaaaucuggaagccaaa

SEQ ID NO: 2019871 - RNA, 20 nt, Homo sapiens
uccaaggacucuaaaagggg

SEQ ID NO: 2019872 - RNA, 17 nt, Homo sapiens
ugauugcaggaagggaa

SEQ ID NO: 2019873 - RNA, 21 nt, Homo sapiens
auguuaagcaucuaaggacaa

SEQ ID NO: 2019874 - RNA, 16 nt, Homo sapiens
uaacuauaaggugccu

SEQ ID NO: 2019875 - RNA, 19 nt, Homo sapiens
gucuuggaaaaaaaccaca

SEQ ID NO: 2019876 - RNA, 15 nt, Homo sapiens
agagccaagcaagaa

SEQ ID NO: 2019877 - RNA, 21 nt, Homo sapiens
aaucuguacauuuuguuguaa

SEQ ID NO: 2019878 - RNA, 15 nt, Homo sapiens
gaccugacaccuuuc

SEQ ID NO: 2019879 - RNA, 17 nt, Homo sapiens
aaaggauaauuauccaa

SEQ ID NO: 2019880 - RNA, 18 nt, Homo sapiens
uuacuauuucacaacagc

SEQ ID NO: 2019881 - RNA, 19 nt, Homo sapiens
uccuucacauuuacuagcu

SEQ ID NO: 2019882 - RNA, 14 nt, Homo sapiens
gugagcaugagcuc

SEQ ID NO: 2019883 - RNA, 18 nt, Homo sapiens
uaugagccuuugcacagg

SEQ ID NO: 2019884 - RNA, 19 nt, Homo sapiens
gaaaauaaaauuuaacuca

SEQ ID NO: 2019885 - RNA, 16 nt, Homo sapiens
gccuuauaaaccaauc

SEQ ID NO: 2019886 - RNA, 13 nt, Homo sapiens
ucccacacaagac

SEQ ID NO: 2019887 - RNA, 15 nt, Homo sapiens
gaucccgucuuccag

SEQ ID NO: 2019888 - RNA, 22 nt, Homo sapiens
ucuugucaagucagaacagcca

SEQ ID NO: 2019889 - RNA, 13 nt, Homo sapiens
aaccagacuucuc

SEQ ID NO: 2019890 - RNA, 17 nt, Homo sapiens
uagaaaauuuucuaguc

SEQ ID NO: 2019891 - RNA, 18 nt, Homo sapiens
gcacucccucccagagaa

SEQ ID NO: 2019892 - RNA, 16 nt, Homo sapiens
caagucaccaugccug

SEQ ID NO: 2019893 - RNA, 17 nt, Homo sapiens
aguguguucaugcaaca

SEQ ID NO: 2019894 - RNA, 10 nt, Homo sapiens
aaagccucau

SEQ ID NO: 2019895 - RNA, 15 nt, Homo sapiens
ggcggggacugcugg

SEQ ID NO: 2019896 - RNA, 18 nt, Homo sapiens
ccugauucccugugguga

SEQ ID NO: 2019897 - RNA, 20 nt, Homo sapiens
ugcccuccccagagcacugg

SEQ ID NO: 2019898 - RNA, 16 nt, Homo sapiens
gugauaacacuggagu

SEQ ID NO: 2019899 - RNA, 17 nt, Homo sapiens
auucauagucuuuggag

SEQ ID NO: 2019900 - RNA, 22 nt, Homo sapiens
acccuguuuuauugaguucuga

SEQ ID NO: 2019901 - RNA, 18 nt, Homo sapiens
auauuuuuuucugaaauu

SEQ ID NO: 2019902 - RNA, 13 nt, Homo sapiens
cacugacuguaug

SEQ ID NO: 2019903 - RNA, 22 nt, Homo sapiens
augcaagugguuuccuggugcu

SEQ ID NO: 2019904 - RNA, 18 nt, Homo sapiens
acaggcaacgcagaccaa

SEQ ID NO: 2019905 - RNA, 13 nt, Homo sapiens
uuuaaaucaagga

SEQ ID NO: 2019906 - RNA, 15 nt, Homo sapiens
cagugagccauguuc

SEQ ID NO: 2019907 - RNA, 18 nt, Homo sapiens
guuggccugcacuggugu

SEQ ID NO: 2019908 - RNA, 17 nt, Homo sapiens
auagaacaacauauaca

SEQ ID NO: 2019909 - RNA, 13 nt, Homo sapiens
gucaugaguuuau

SEQ ID NO: 2019910 - RNA, 15 nt, Homo sapiens
uccucccucauucca

SEQ ID NO: 2019911 - RNA, 14 nt, Homo sapiens
aaaagcaagaucua

SEQ ID NO: 2019912 - RNA, 18 nt, Homo sapiens
auaaucugaggaagggag

SEQ ID NO: 2019913 - RNA, 23 nt, Homo sapiens
auaaaauccuaagacacaaaugc

SEQ ID NO: 2019914 - RNA, 18 nt, Homo sapiens
acaugcucauguguacac

SEQ ID NO: 2019915 - RNA, 21 nt, Homo sapiens
caccaaacugcacacacagcu

SEQ ID NO: 2019916 - RNA, 15 nt, Homo sapiens
uuugcuaucugggcu

SEQ ID NO: 2019917 - RNA, 22 nt, Homo sapiens
augucccagccuggccuguggc

SEQ ID NO: 2019918 - RNA, 16 nt, Homo sapiens
cuccaucgcaguguuc

SEQ ID NO: 2019919 - RNA, 16 nt, Homo sapiens
auguggaaaagccaag

SEQ ID NO: 2019920 - RNA, 16 nt, Homo sapiens
auccauuaucaugugu

SEQ ID NO: 2019921 - RNA, 12 nt, Homo sapiens
acugaaugucau

SEQ ID NO: 2019922 - RNA, 16 nt, Homo sapiens
uccuauaaucugucaa

SEQ ID NO: 2019923 - RNA, 15 nt, Homo sapiens
cugggacacagauca

SEQ ID NO: 2019924 - RNA, 14 nt, Homo sapiens
cuugccuaucugac

SEQ ID NO: 2019925 - RNA, 15 nt, Homo sapiens
ugacugaaacauuca

SEQ ID NO: 2019926 - RNA, 20 nt, Homo sapiens
cucugacuggagucuaggaa

SEQ ID NO: 2019927 - RNA, 15 nt, Homo sapiens
ccugacacaggccag

SEQ ID NO: 2019928 - RNA, 16 nt, Homo sapiens
aaucagaccacauuug

SEQ ID NO: 2019929 - RNA, 15 nt, Homo sapiens
uugcuguuuacuuga

SEQ ID NO: 2019930 - RNA, 12 nt, Homo sapiens
aggccugagcug

SEQ ID NO: 2019931 - RNA, 16 nt, Homo sapiens
cucaacagacccagug

SEQ ID NO: 2019932 - RNA, 16 nt, Homo sapiens
gaaggugccuggccau

SEQ ID NO: 2019933 - RNA, 19 nt, Homo sapiens
aacacacgaggagcaugca

SEQ ID NO: 2019934 - RNA, 21 nt, Homo sapiens
aucaaaugccccgaauuuagu

SEQ ID NO: 2019935 - RNA, 20 nt, Homo sapiens
cacauccugaaaaggguguu

SEQ ID NO: 2019936 - RNA, 12 nt, Homo sapiens
auguugaugaaa

SEQ ID NO: 2019937 - RNA, 14 nt, Homo sapiens
aggguggaauauca

SEQ ID NO: 2019938 - RNA, 11 nt, Homo sapiens
guagcuuccca

SEQ ID NO: 2019939 - RNA, 18 nt, Homo sapiens
ucuggcugaggauuucaa

SEQ ID NO: 2019940 - RNA, 16 nt, Homo sapiens
cagacuucccacggcu

SEQ ID NO: 2019941 - RNA, 14 nt, Homo sapiens
auauguugauuuau

SEQ ID NO: 2019942 - RNA, 17 nt, Homo sapiens
uaaauacuguaacacug

SEQ ID NO: 2019943 - RNA, 17 nt, Homo sapiens
cuguucuucaguccuuu

SEQ ID NO: 2019944 - RNA, 17 nt, Homo sapiens
cuuguuuacaugcuuau

SEQ ID NO: 2019945 - RNA, 18 nt, Homo sapiens
uccugccauucuucuggu

SEQ ID NO: 2019946 - RNA, 14 nt, Homo sapiens
ccucauccaugcag

SEQ ID NO: 2019947 - RNA, 16 nt, Homo sapiens
gguuuccaaagacagu

SEQ ID NO: 2019948 - RNA, 21 nt, Homo sapiens
gcagcccacagaggacagugc

SEQ ID NO: 2019949 - RNA, 17 nt, Homo sapiens
cucuugccaaccuguaa

SEQ ID NO: 2019950 - RNA, 15 nt, Homo sapiens
cucaggaugagggaa

SEQ ID NO: 2019951 - RNA, 14 nt, Homo sapiens
caaccacaagcaca

SEQ ID NO: 2019952 - RNA, 19 nt, Homo sapiens
accagauaguuauauuaaa

SEQ ID NO: 2019953 - RNA, 20 nt, Homo sapiens
uaacuggacauucuggggaa

SEQ ID NO: 2019954 - RNA, 17 nt, Homo sapiens
gaucauuuagauuuguu

SEQ ID NO: 2019955 - RNA, 21 nt, Homo sapiens
aaccacgaaugagguaggcac

SEQ ID NO: 2019956 - RNA, 22 nt, Homo sapiens
auccugugccagguacuaugca

SEQ ID NO: 2019957 - RNA, 16 nt, Homo sapiens
gcuauauuucagugac

SEQ ID NO: 2019958 - RNA, 23 nt, Homo sapiens
acaacuuucuccuacucuuccuu

SEQ ID NO: 2019959 - RNA, 19 nt, Homo sapiens
aagaagagaucagaaugau

SEQ ID NO: 2019960 - RNA, 17 nt, Homo sapiens
cuuucaauucugugaua

SEQ ID NO: 2019961 - RNA, 18 nt, Homo sapiens
cuagugaagauguuguca

SEQ ID NO: 2019962 - RNA, 12 nt, Homo sapiens
auacucugcuau

SEQ ID NO: 2019963 - RNA, 21 nt, Homo sapiens
uaccuggugcucucaacagga

SEQ ID NO: 2019964 - RNA, 22 nt, Homo sapiens
aaauugcuuuugaaaaacaacu

SEQ ID NO: 2019965 - RNA, 14 nt, Homo sapiens
aaagugaacuugau

SEQ ID NO: 2019966 - RNA, 22 nt, Homo sapiens
uguuuugauuuguagcacugag

SEQ ID NO: 2019967 - RNA, 17 nt, Homo sapiens
uauaguggugucccuaa

SEQ ID NO: 2019968 - RNA, 18 nt, Homo sapiens
agcuugaauuucaaauau

SEQ ID NO: 2019969 - RNA, 13 nt, Homo sapiens
gagcagcugagau

SEQ ID NO: 2019970 - RNA, 16 nt, Homo sapiens
ggaagacaagcauuuu

SEQ ID NO: 2019971 - RNA, 21 nt, Homo sapiens
cuuuccuucuuucauuuuaaa

SEQ ID NO: 2019972 - RNA, 18 nt, Homo sapiens
caauacaaauauugugau

SEQ ID NO: 2019973 - RNA, 22 nt, Homo sapiens
ucuguuccaagugugugugcaa

SEQ ID NO: 2019974 - RNA, 22 nt, Homo sapiens
ucuggagcaaccuacugucuaa

SEQ ID NO: 2019975 - RNA, 21 nt, Homo sapiens
uuguugaagaaugaaaggcaa

SEQ ID NO: 2019976 - RNA, 17 nt, Homo sapiens
gccacuccugcuucucu

SEQ ID NO: 2019977 - RNA, 23 nt, Homo sapiens
aagacuucgcgcauaucacuaau

SEQ ID NO: 2019978 - RNA, 20 nt, Homo sapiens
ucauguucuugcagucauca

SEQ ID NO: 2019979 - RNA, 14 nt, Homo sapiens
uaugcccagcguuu

SEQ ID NO: 2019980 - RNA, 19 nt, Homo sapiens
gcucgagucacauucugcu

SEQ ID NO: 2019981 - RNA, 22 nt, Homo sapiens
gaggaucagcacugccagugga

SEQ ID NO: 2019982 - RNA, 14 nt, Homo sapiens
accuauauuccuug

SEQ ID NO: 2019983 - RNA, 20 nt, Homo sapiens
uuaaguuguugauguuuuaa

SEQ ID NO: 2019984 - RNA, 13 nt, Homo sapiens
uugaagccaaaga

SEQ ID NO: 2019985 - RNA, 19 nt, Homo sapiens
ucuuaaguugaucuaauga

SEQ ID NO: 2019986 - RNA, 19 nt, Homo sapiens
uauacagaccuaauaucau

SEQ ID NO: 2019987 - RNA, 12 nt, Homo sapiens
aaaugauuucag

SEQ ID NO: 2019988 - RNA, 15 nt, Homo sapiens
agucacugagcauca

SEQ ID NO: 2019989 - RNA, 20 nt, Homo sapiens
uuguugccuucaucuucacu

SEQ ID NO: 2019990 - RNA, 23 nt, Homo sapiens
uagccugaguguccacagggaca

SEQ ID NO: 2019991 - RNA, 20 nt, Homo sapiens
caagcuuuguauauaaauga

SEQ ID NO: 2019992 - RNA, 19 nt, Homo sapiens
aauucagcaguuuuauccu

SEQ ID NO: 2019993 - RNA, 17 nt, Homo sapiens
acagggucugccuccag

SEQ ID NO: 2019994 - RNA, 21 nt, Homo sapiens
ugagccuaugauauuccccau

SEQ ID NO: 2019995 - RNA, 23 nt, Homo sapiens
uauuauuuuauguugcauagaau

SEQ ID NO: 2019996 - RNA, 20 nt, Homo sapiens
uuaccagcuuaagaguccaa

SEQ ID NO: 2019997 - RNA, 17 nt, Homo sapiens
aauuucucccuauguuu

SEQ ID NO: 2019998 - RNA, 15 nt, Homo sapiens
gagcaacagaggaca

SEQ ID NO: 2019999 - RNA, 10 nt, Homo sapiens
aaauauuugc

SEQ ID NO: 2020000 - RNA, 15 nt, Homo sapiens
uccccaaaccauaaa

SEQ ID NO: 2020001 - RNA, 18 nt, Homo sapiens
cagagaauauauacauuc

SEQ ID NO: 2020002 - RNA, 13 nt, Homo sapiens
caacagcagugau

SEQ ID NO: 2020003 - RNA, 19 nt, Homo sapiens
ugcgccaucuucacauucu

SEQ ID NO: 2020004 - RNA, 22 nt, Homo sapiens
ugacauucugauucgaaugaca

SEQ ID NO: 2020005 - RNA, 15 nt, Homo sapiens
ccaguuaacaucauc

SEQ ID NO: 2020006 - RNA, 15 nt, Homo sapiens
uaguuuaugguucug

SEQ ID NO: 2020007 - RNA, 12 nt, Homo sapiens
ccaguuuguacg

SEQ ID NO: 2020008 - RNA, 15 nt, Homo sapiens
acagcuuuccucaaa

SEQ ID NO: 2020009 - RNA, 21 nt, Homo sapiens
cauucggggaagcugcacaug

SEQ ID NO: 2020010 - RNA, 16 nt, Homo sapiens
agggcugcaggggauu

SEQ ID NO: 2020011 - RNA, 13 nt, Homo sapiens
gaggggugcucau

SEQ ID NO: 2020012 - RNA, 15 nt, Homo sapiens
cauaguaauuucacu

SEQ ID NO: 2020013 - RNA, 21 nt, Homo sapiens
acagggggugggaaggggaug

SEQ ID NO: 2020014 - RNA, 11 nt, Homo sapiens
ugacaugcaca

SEQ ID NO: 2020015 - RNA, 23 nt, Homo sapiens
agucacucuagucaaugacauga

SEQ ID NO: 2020016 - RNA, 21 nt, Homo sapiens
agaaucucauuacugcuucau

SEQ ID NO: 2020017 - RNA, 16 nt, Homo sapiens
aaacgggaacaugccc

SEQ ID NO: 2020018 - RNA, 17 nt, Homo sapiens
uaagauauauacaugga

SEQ ID NO: 2020019 - RNA, 19 nt, Homo sapiens
aaauguguuagcacugaua

SEQ ID NO: 2020020 - RNA, 14 nt, Homo sapiens
acagacaaagcaua

SEQ ID NO: 2020021 - RNA, 18 nt, Homo sapiens
aaaccaaguuuuacuaaa

SEQ ID NO: 2020022 - RNA, 17 nt, Homo sapiens
acaagagacaugagauu

SEQ ID NO: 2020023 - RNA, 17 nt, Homo sapiens
gcauagagcccuggcca

SEQ ID NO: 2020024 - RNA, 12 nt, Homo sapiens
aaugcacuccug

SEQ ID NO: 2020025 - RNA, 21 nt, Homo sapiens
aucuauaaaaagaaguguucc

SEQ ID NO: 2020026 - RNA, 10 nt, Homo sapiens
acugucuucc

SEQ ID NO: 2020027 - RNA, 15 nt, Homo sapiens
aggccacaccacagc

SEQ ID NO: 2020028 - RNA, 19 nt, Homo sapiens
auaagucaauuccuagaag

SEQ ID NO: 2020029 - RNA, 22 nt, Homo sapiens
ccugcaaccucggggagugcca

SEQ ID NO: 2020030 - RNA, 14 nt, Homo sapiens
guaaaauuauuuca

SEQ ID NO: 2020031 - RNA, 20 nt, Homo sapiens
ccaugugccugcaccaggag

SEQ ID NO: 2020032 - RNA, 19 nt, Homo sapiens
uuuaaaauaagcuuucuca

SEQ ID NO: 2020033 - RNA, 13 nt, Homo sapiens
auuauacaaucuc

SEQ ID NO: 2020034 - RNA, 19 nt, Homo sapiens
guucucaggaccuguucaa

SEQ ID NO: 2020035 - RNA, 20 nt, Homo sapiens
aaauagugccuuacuauaug

SEQ ID NO: 2020036 - RNA, 22 nt, Homo sapiens
agaauggcuuuggucucuugcu

SEQ ID NO: 2020037 - RNA, 15 nt, Homo sapiens
uuaaaugacagugaa

SEQ ID NO: 2020038 - RNA, 14 nt, Homo sapiens
agagucaugucaaa

SEQ ID NO: 2020039 - RNA, 14 nt, Homo sapiens
uuuacagcuuuguu

SEQ ID NO: 2020040 - RNA, 18 nt, Homo sapiens
acucaguuguuccuacuc

SEQ ID NO: 2020041 - RNA, 20 nt, Homo sapiens
acucuacuuccucuuaccua

SEQ ID NO: 2020042 - RNA, 20 nt, Homo sapiens
cugugugaaugugggcacug

SEQ ID NO: 2020043 - RNA, 19 nt, Homo sapiens
guagguggauccagggaaa

SEQ ID NO: 2020044 - RNA, 19 nt, Homo sapiens
auuacaauuuguauuacuu

SEQ ID NO: 2020045 - RNA, 23 nt, Homo sapiens
gagacaccaaacugccaaaaaca

SEQ ID NO: 2020046 - RNA, 20 nt, Homo sapiens
aaaugcuauggaaauacauu

SEQ ID NO: 2020047 - RNA, 20 nt, Homo sapiens
uugcucuaugucugccuucg

SEQ ID NO: 2020048 - RNA, 21 nt, Homo sapiens
uggcacuuggggcaccuugcu

SEQ ID NO: 2020049 - RNA, 19 nt, Homo sapiens
ccuacuuuucuuuccucag

SEQ ID NO: 2020050 - RNA, 23 nt, Homo sapiens
gcagagaaaauugugaaagugac

SEQ ID NO: 2020051 - RNA, 22 nt, Homo sapiens
cugcuaaauaucaccuagcaug

SEQ ID NO: 2020052 - RNA, 21 nt, Homo sapiens
aagacuuggguugaucucuua

SEQ ID NO: 2020053 - RNA, 15 nt, Homo sapiens
aggaagucuaccugg

SEQ ID NO: 2020054 - RNA, 18 nt, Homo sapiens
ucaauuuuaaacauaucc

SEQ ID NO: 2020055 - RNA, 18 nt, Homo sapiens
acuuuuuuauccaccucc

SEQ ID NO: 2020056 - RNA, 12 nt, Homo sapiens
ugccucaguaua

SEQ ID NO: 2020057 - RNA, 16 nt, Homo sapiens
cugaaccuuccaucuc

SEQ ID NO: 2020058 - RNA, 23 nt, Homo sapiens
ugacucccaaguuuccauagcaa

SEQ ID NO: 2020059 - RNA, 15 nt, Homo sapiens
acauuugugcauaaa

SEQ ID NO: 2020060 - RNA, 12 nt, Homo sapiens
cccagcucugac

SEQ ID NO: 2020061 - RNA, 14 nt, Homo sapiens
ccagcugugugaga

SEQ ID NO: 2020062 - RNA, 12 nt, Homo sapiens
cagaaaucacaa

SEQ ID NO: 2020063 - RNA, 20 nt, Homo sapiens
uaaaacuuaccuaagugaca

SEQ ID NO: 2020064 - RNA, 20 nt, Homo sapiens
gccacuugaguuggggccau

SEQ ID NO: 2020065 - RNA, 14 nt, Homo sapiens
uugaaacaaacaug

SEQ ID NO: 2020066 - RNA, 16 nt, Homo sapiens
caggaaagaagcauuu

SEQ ID NO: 2020067 - RNA, 13 nt, Homo sapiens
augcauacuggug

SEQ ID NO: 2020068 - RNA, 16 nt, Homo sapiens
aucagauaccuguggg

SEQ ID NO: 2020069 - RNA, 18 nt, Homo sapiens
auuuuuuugugaucuguu

SEQ ID NO: 2020070 - RNA, 19 nt, Homo sapiens
ccuuaagggguaucaugua

SEQ ID NO: 2020071 - RNA, 23 nt, Homo sapiens
uguaugggagauggcagcaguga

SEQ ID NO: 2020072 - RNA, 20 nt, Homo sapiens
ugucaaugugaacguccaca

SEQ ID NO: 2020073 - RNA, 16 nt, Homo sapiens
uguacuucacugucag

SEQ ID NO: 2020074 - RNA, 15 nt, Homo sapiens
caucuucucagcucc

SEQ ID NO: 2020075 - RNA, 20 nt, Homo sapiens
augagguguugugcauuugu

SEQ ID NO: 2020076 - RNA, 14 nt, Homo sapiens
aagcaugugucaug

SEQ ID NO: 2020077 - RNA, 22 nt, Homo sapiens
ucuguauugcagcuaagcucaa

SEQ ID NO: 2020078 - RNA, 20 nt, Homo sapiens
uucaccuccugacaguauua

SEQ ID NO: 2020079 - RNA, 20 nt, Homo sapiens
gauuuaauuuguuguuaaua

SEQ ID NO: 2020080 - RNA, 21 nt, Homo sapiens
ucauaaugaauaaagugcaaa

SEQ ID NO: 2020081 - RNA, 13 nt, Homo sapiens
gaacaaacagggc

SEQ ID NO: 2020082 - RNA, 16 nt, Homo sapiens
aggcaugagaaucacu

SEQ ID NO: 2020083 - RNA, 18 nt, Homo sapiens
caacauuuuuucccagug

SEQ ID NO: 2020084 - RNA, 20 nt, Homo sapiens
cguguuccccucuugucucc

SEQ ID NO: 2020085 - RNA, 14 nt, Homo sapiens
gcaagcccagggca

SEQ ID NO: 2020086 - RNA, 19 nt, Homo sapiens
uacauguccuccuaagggg

SEQ ID NO: 2020087 - RNA, 17 nt, Homo sapiens
caguaacuuguuuacau

SEQ ID NO: 2020088 - RNA, 13 nt, Homo sapiens
uccuguaagacaa

SEQ ID NO: 2020089 - RNA, 22 nt, Homo sapiens
aagaauaauguacguacuaccu

SEQ ID NO: 2020090 - RNA, 21 nt, Homo sapiens
acagccucacuuggucugcca

SEQ ID NO: 2020091 - RNA, 14 nt, Homo sapiens
ccgugacaguuuac

SEQ ID NO: 2020092 - RNA, 16 nt, Homo sapiens
cugugaauaaagccac

SEQ ID NO: 2020093 - RNA, 20 nt, Homo sapiens
ugugaaaaugugugugugcu

SEQ ID NO: 2020094 - RNA, 14 nt, Homo sapiens
ucuucgcugugaug

SEQ ID NO: 2020095 - RNA, 14 nt, Homo sapiens
ggucaggaguuuga

SEQ ID NO: 2020096 - RNA, 14 nt, Homo sapiens
acauauauuuugca

SEQ ID NO: 2020097 - RNA, 20 nt, Homo sapiens
cccucaaaugacccaaagac

SEQ ID NO: 2020098 - RNA, 22 nt, Homo sapiens
guauucacaucauuugggauac

SEQ ID NO: 2020099 - RNA, 20 nt, Homo sapiens
cagccuaaucccgugccccu

SEQ ID NO: 2020100 - RNA, 22 nt, Homo sapiens
uauaagcacagacaauucuaau

SEQ ID NO: 2020101 - RNA, 16 nt, Homo sapiens
agugaccccugaccuc

SEQ ID NO: 2020102 - RNA, 15 nt, Homo sapiens
uuaaaaucauaacau

SEQ ID NO: 2020103 - RNA, 16 nt, Homo sapiens
ccauugaacagcugug

SEQ ID NO: 2020104 - RNA, 18 nt, Homo sapiens
uaaaaauggauacuggug

SEQ ID NO: 2020105 - RNA, 17 nt, Homo sapiens
cuucugggaacccugcc

SEQ ID NO: 2020106 - RNA, 16 nt, Homo sapiens
ccacaauggcugggag

SEQ ID NO: 2020107 - RNA, 22 nt, Homo sapiens
ugcaggcaggaacaaacagggc

SEQ ID NO: 2020108 - RNA, 16 nt, Homo sapiens
cugccaugcccagaga

SEQ ID NO: 2020109 - RNA, 17 nt, Homo sapiens
uuuauuuacaucuaugu

SEQ ID NO: 2020110 - RNA, 15 nt, Homo sapiens
uacauuuggugcacu

SEQ ID NO: 2020111 - RNA, 18 nt, Homo sapiens
agaccuguguuacuaaaa

SEQ ID NO: 2020112 - RNA, 21 nt, Homo sapiens
uaugcagagguccacaacaca

SEQ ID NO: 2020113 - RNA, 20 nt, Homo sapiens
auuauccaguagaaaauguu

SEQ ID NO: 2020114 - RNA, 17 nt, Homo sapiens
uuaaauaaaaaaguuua

SEQ ID NO: 2020115 - RNA, 19 nt, Homo sapiens
acuucagguaaaaacuuca

SEQ ID NO: 2020116 - RNA, 18 nt, Homo sapiens
ugagaacuccucauuccc

SEQ ID NO: 2020117 - RNA, 19 nt, Homo sapiens
cauuugugucagcaugucu

SEQ ID NO: 2020118 - RNA, 18 nt, Homo sapiens
cagugagaagacuggcag

SEQ ID NO: 2020119 - RNA, 12 nt, Homo sapiens
aauuaugacugc

SEQ ID NO: 2020120 - RNA, 18 nt, Homo sapiens
cuccuggucgcuuugcca

SEQ ID NO: 2020121 - RNA, 15 nt, Homo sapiens
aucacaugugcugca

SEQ ID NO: 2020122 - RNA, 13 nt, Homo sapiens
auguucugugaua

SEQ ID NO: 2020123 - RNA, 20 nt, Homo sapiens
caggucuuccugcuuuccau

SEQ ID NO: 2020124 - RNA, 22 nt, Homo sapiens
guaacauauucuguaugaacuu

SEQ ID NO: 2020125 - RNA, 14 nt, Homo sapiens
uuguaagaaaacca

SEQ ID NO: 2020126 - RNA, 19 nt, Homo sapiens
agagcuacaugguggagca

SEQ ID NO: 2020127 - RNA, 21 nt, Homo sapiens
auugaagugucgaaagcaacu

SEQ ID NO: 2020128 - RNA, 12 nt, Homo sapiens
ccuugugucugu

SEQ ID NO: 2020129 - RNA, 12 nt, Homo sapiens
acugacuacugg

SEQ ID NO: 2020130 - RNA, 13 nt, Homo sapiens
accccuccucacu

SEQ ID NO: 2020131 - RNA, 13 nt, Homo sapiens
ugcauuccagaac

SEQ ID NO: 2020132 - RNA, 18 nt, Homo sapiens
caaaacaauauuacuuug

SEQ ID NO: 2020133 - RNA, 23 nt, Homo sapiens
ccgcugcuugaguggacagcagc

SEQ ID NO: 2020134 - RNA, 18 nt, Homo sapiens
cuuuaaaugacaguaaua

SEQ ID NO: 2020135 - RNA, 14 nt, Homo sapiens
cauaacaugcuuua

SEQ ID NO: 2020136 - RNA, 17 nt, Homo sapiens
guuaaucauguauuaaa

SEQ ID NO: 2020137 - RNA, 22 nt, Homo sapiens
cuccucuagaagaagccaagaa

SEQ ID NO: 2020138 - RNA, 15 nt, Homo sapiens
uuucacccucaugaa

SEQ ID NO: 2020139 - RNA, 21 nt, Homo sapiens
cugcaucuuaguuuacuggau

SEQ ID NO: 2020140 - RNA, 13 nt, Homo sapiens
agcaaagggcuca

SEQ ID NO: 2020141 - RNA, 18 nt, Homo sapiens
caacaggguuuuuuucca

SEQ ID NO: 2020142 - RNA, 20 nt, Homo sapiens
aucuuucaagggaccucucc

SEQ ID NO: 2020143 - RNA, 18 nt, Homo sapiens
gcugcuugguagcacuuu

SEQ ID NO: 2020144 - RNA, 19 nt, Homo sapiens
agucaccaaauagugugaa

SEQ ID NO: 2020145 - RNA, 24 nt, Homo sapiens
ggucuaggaacauacuucagcuca

SEQ ID NO: 2020146 - RNA, 21 nt, Homo sapiens
agauaaucgagucuaccucuu

SEQ ID NO: 2020147 - RNA, 14 nt, Homo sapiens
cuacaugugcugga

SEQ ID NO: 2020148 - RNA, 20 nt, Homo sapiens
gauccccagccuacugccuc

SEQ ID NO: 2020149 - RNA, 14 nt, Homo sapiens
uauggauuuggacu

SEQ ID NO: 2020150 - RNA, 17 nt, Homo sapiens
agugucuuaguuugaau

SEQ ID NO: 2020151 - RNA, 23 nt, Homo sapiens
aaucgauucugcagcaccggccu

SEQ ID NO: 2020152 - RNA, 14 nt, Homo sapiens
uagauuaacccuau

SEQ ID NO: 2020153 - RNA, 16 nt, Homo sapiens
caggauuaaaagccau

SEQ ID NO: 2020154 - RNA, 16 nt, Homo sapiens
cgauugaaagaaccag

SEQ ID NO: 2020155 - RNA, 14 nt, Homo sapiens
aaacaaaucaugca

SEQ ID NO: 2020156 - RNA, 20 nt, Homo sapiens
gcagaagcaggguacccuuu

SEQ ID NO: 2020157 - RNA, 13 nt, Homo sapiens
auuuauauuucaa

SEQ ID NO: 2020158 - RNA, 14 nt, Homo sapiens
uguuacgugugcaa

SEQ ID NO: 2020159 - RNA, 15 nt, Homo sapiens
agcucuggcuuccag

SEQ ID NO: 2020160 - RNA, 22 nt, Homo sapiens
uggucuccccgcagucguccca

SEQ ID NO: 2020161 - RNA, 23 nt, Homo sapiens
gucuaaaaauaaaaugcauuuaa

SEQ ID NO: 2020162 - RNA, 19 nt, Homo sapiens
ggagacucaggacugcuga

SEQ ID NO: 2020163 - RNA, 11 nt, Homo sapiens
aaaauuacuuc

SEQ ID NO: 2020164 - RNA, 13 nt, Homo sapiens
ucuuggggaauau

SEQ ID NO: 2020165 - RNA, 14 nt, Homo sapiens
uuugaggguguaua

SEQ ID NO: 2020166 - RNA, 21 nt, Homo sapiens
cucauuccuuuccucuggccc

SEQ ID NO: 2020167 - RNA, 14 nt, Homo sapiens
cccaggcuggagug

SEQ ID NO: 2020168 - RNA, 19 nt, Homo sapiens
ucuucccuuuuacauacug

SEQ ID NO: 2020169 - RNA, 20 nt, Homo sapiens
uagauaauaaaauugcuccc

SEQ ID NO: 2020170 - RNA, 20 nt, Homo sapiens
gccccucccugccagcaccc

SEQ ID NO: 2020171 - RNA, 14 nt, Homo sapiens
aaauauacaacuuu

SEQ ID NO: 2020172 - RNA, 21 nt, Homo sapiens
cuccucacuggaggagcagcu

SEQ ID NO: 2020173 - RNA, 14 nt, Homo sapiens
cauuguucacuucu

SEQ ID NO: 2020174 - RNA, 21 nt, Homo sapiens
ggucauauaaaauauauuuau

SEQ ID NO: 2020175 - RNA, 15 nt, Homo sapiens
acccucuggagauaa

SEQ ID NO: 2020176 - RNA, 18 nt, Homo sapiens
auuuccagaaauacaauu

SEQ ID NO: 2020177 - RNA, 21 nt, Homo sapiens
cauagggugcucugaggucaa

SEQ ID NO: 2020178 - RNA, 22 nt, Homo sapiens
uuaagcugggauaaucacauua

SEQ ID NO: 2020179 - RNA, 16 nt, Homo sapiens
acugaccagccuccau

SEQ ID NO: 2020180 - RNA, 14 nt, Homo sapiens
uaaagugauuucau

SEQ ID NO: 2020181 - RNA, 14 nt, Homo sapiens
agcagauacuuugu

SEQ ID NO: 2020182 - RNA, 14 nt, Homo sapiens
gccacuugacauuc

SEQ ID NO: 2020183 - RNA, 22 nt, Homo sapiens
uuuugcauuucucuuccuaaau

SEQ ID NO: 2020184 - RNA, 12 nt, Homo sapiens
auccaccugccu

SEQ ID NO: 2020185 - RNA, 17 nt, Homo sapiens
cuucuugguuuucucuc

SEQ ID NO: 2020186 - RNA, 18 nt, Homo sapiens
ggcccaccuuauagagag

SEQ ID NO: 2020187 - RNA, 13 nt, Homo sapiens
aucucauguucaa

SEQ ID NO: 2020188 - RNA, 21 nt, Homo sapiens
ugaugcccugcugaccaugca

SEQ ID NO: 2020189 - RNA, 22 nt, Homo sapiens
ucuggaaaccaaauaggcuuua

SEQ ID NO: 2020190 - RNA, 17 nt, Homo sapiens
uuaccucuauuuugcca

SEQ ID NO: 2020191 - RNA, 17 nt, Homo sapiens
cucugaugcagaaauua

SEQ ID NO: 2020192 - RNA, 16 nt, Homo sapiens
cccaaaacaguucuag

SEQ ID NO: 2020193 - RNA, 21 nt, Homo sapiens
uagaaacuuguuagaaaugca

SEQ ID NO: 2020194 - RNA, 19 nt, Homo sapiens
uuguucuccucguccauca

SEQ ID NO: 2020195 - RNA, 20 nt, Homo sapiens
caggugugagccaccacucc

SEQ ID NO: 2020196 - RNA, 15 nt, Homo sapiens
ugcacugagggccac

SEQ ID NO: 2020197 - RNA, 21 nt, Homo sapiens
cucucugcccaaguugcucug

SEQ ID NO: 2020198 - RNA, 14 nt, Homo sapiens
gauucaugccaauu

SEQ ID NO: 2020199 - RNA, 18 nt, Homo sapiens
agagggacagaugaccaa

SEQ ID NO: 2020200 - RNA, 22 nt, Homo sapiens
acaaauuaaggguuaaaucaga

SEQ ID NO: 2020201 - RNA, 21 nt, Homo sapiens
acaauggcuaauucccagagu

SEQ ID NO: 2020202 - RNA, 14 nt, Homo sapiens
cauccgcgugugcc

SEQ ID NO: 2020203 - RNA, 19 nt, Homo sapiens
acaaccucauuuuaacuca

SEQ ID NO: 2020204 - RNA, 14 nt, Homo sapiens
ggauacagugccca

SEQ ID NO: 2020205 - RNA, 23 nt, Homo sapiens
uuacuuuaaugauuauaaucaua

SEQ ID NO: 2020206 - RNA, 15 nt, Homo sapiens
cacacaaguuugaga

SEQ ID NO: 2020207 - RNA, 18 nt, Homo sapiens
ccucaagcaaggaagcag

SEQ ID NO: 2020208 - RNA, 15 nt, Homo sapiens
caccuagacuguaaa

SEQ ID NO: 2020209 - RNA, 12 nt, Homo sapiens
cucuucugcuaa

SEQ ID NO: 2020210 - RNA, 23 nt, Homo sapiens
cuuuuuagcaaggccuugguguu

SEQ ID NO: 2020211 - RNA, 11 nt, Homo sapiens
uaaucuuguca

SEQ ID NO: 2020212 - RNA, 23 nt, Homo sapiens
ucccuuaauuuaagucauuuuca

SEQ ID NO: 2020213 - RNA, 21 nt, Homo sapiens
uguuaccauacugucucugga

SEQ ID NO: 2020214 - RNA, 19 nt, Homo sapiens
ccagaggcagagugaaaua

SEQ ID NO: 2020215 - RNA, 22 nt, Homo sapiens
ugccaggagauucagagcucaa

SEQ ID NO: 2020216 - RNA, 23 nt, Homo sapiens
cuaguugaauacuugaaccauaa

SEQ ID NO: 2020217 - RNA, 14 nt, Homo sapiens
uuuaacccauuugu

SEQ ID NO: 2020218 - RNA, 23 nt, Homo sapiens
guuguucuuuaacccucacuggg

SEQ ID NO: 2020219 - RNA, 23 nt, Homo sapiens
ggaauggggaacccgcucuccca

SEQ ID NO: 2020220 - RNA, 17 nt, Homo sapiens
uccccagagcuacaggc

SEQ ID NO: 2020221 - RNA, 16 nt, Homo sapiens
uggcucuggacaggca

SEQ ID NO: 2020222 - RNA, 16 nt, Homo sapiens
cauagauucaccugua

SEQ ID NO: 2020223 - RNA, 22 nt, Homo sapiens
ugcucaaagauguaauguaguu

SEQ ID NO: 2020224 - RNA, 12 nt, Homo sapiens
cuaugccuaaaa

SEQ ID NO: 2020225 - RNA, 18 nt, Homo sapiens
uggugaggcgaaggccag

SEQ ID NO: 2020226 - RNA, 16 nt, Homo sapiens
agguggcaggugagca

SEQ ID NO: 2020227 - RNA, 17 nt, Homo sapiens
ugguguuuucuuaugca

SEQ ID NO: 2020228 - RNA, 22 nt, Homo sapiens
caucuccagcuggaucccaggg

SEQ ID NO: 2020229 - RNA, 16 nt, Homo sapiens
auucagugcauuuuca

SEQ ID NO: 2020230 - RNA, 17 nt, Homo sapiens
cccacugcacacagggu

SEQ ID NO: 2020231 - RNA, 16 nt, Homo sapiens
guccugucaccaagga

SEQ ID NO: 2020232 - RNA, 23 nt, Homo sapiens
auaaauccucagguaguacuggg

SEQ ID NO: 2020233 - RNA, 21 nt, Homo sapiens
uuguauucuccuuugcacugu

SEQ ID NO: 2020234 - RNA, 18 nt, Homo sapiens
acaugucccugucccucu

SEQ ID NO: 2020235 - RNA, 21 nt, Homo sapiens
uuacuguacccucgcaugacu

SEQ ID NO: 2020236 - RNA, 21 nt, Homo sapiens
uggagcccuaaccccuuccag

SEQ ID NO: 2020237 - RNA, 17 nt, Homo sapiens
agccuccugcccagucc

SEQ ID NO: 2020238 - RNA, 21 nt, Homo sapiens
acccacuucuaaauagcaauu

SEQ ID NO: 2020239 - RNA, 16 nt, Homo sapiens
ucuguugugugucaug

SEQ ID NO: 2020240 - RNA, 22 nt, Homo sapiens
aacucucuucucuuucucucuc

SEQ ID NO: 2020241 - RNA, 15 nt, Homo sapiens
auuugaguugugauu

SEQ ID NO: 2020242 - RNA, 17 nt, Homo sapiens
uggaagaagaaaggacu

SEQ ID NO: 2020243 - RNA, 17 nt, Homo sapiens
auuaaaauuccuaaugg

SEQ ID NO: 2020244 - RNA, 19 nt, Homo sapiens
aggcaagguuuacacugcg

SEQ ID NO: 2020245 - RNA, 12 nt, Homo sapiens
cucuaaacacac

SEQ ID NO: 2020246 - RNA, 18 nt, Homo sapiens
caauauaauaauuagcca

SEQ ID NO: 2020247 - RNA, 21 nt, Homo sapiens
aaugcccagccccuucugacc

SEQ ID NO: 2020248 - RNA, 19 nt, Homo sapiens
guccacuuguggguccugg

SEQ ID NO: 2020249 - RNA, 22 nt, Homo sapiens
uauuucuucuacugcuaucuac

SEQ ID NO: 2020250 - RNA, 13 nt, Homo sapiens
ggccacgugugcu

SEQ ID NO: 2020251 - RNA, 18 nt, Homo sapiens
agauuaagaguugccaaa

SEQ ID NO: 2020252 - RNA, 21 nt, Homo sapiens
ggcuccugugcuuucccugaa

SEQ ID NO: 2020253 - RNA, 18 nt, Homo sapiens
ugagcaaacaaaaccacc

SEQ ID NO: 2020254 - RNA, 17 nt, Homo sapiens
ucacaacauuuacuuaa

SEQ ID NO: 2020255 - RNA, 18 nt, Homo sapiens
accaaauaaaguaccauu

SEQ ID NO: 2020256 - RNA, 17 nt, Homo sapiens
uaaaagagggaccccug

SEQ ID NO: 2020257 - RNA, 18 nt, Homo sapiens
caacauuccuuguuugua

SEQ ID NO: 2020258 - RNA, 19 nt, Homo sapiens
gaaucuguagcugugcuuu

SEQ ID NO: 2020259 - RNA, 14 nt, Homo sapiens
ggccaguggcacuc

SEQ ID NO: 2020260 - RNA, 19 nt, Homo sapiens
augguaaccucuacuauga

SEQ ID NO: 2020261 - RNA, 15 nt, Homo sapiens
uaaucauggagcaag

SEQ ID NO: 2020262 - RNA, 17 nt, Homo sapiens
aaaugaauuuacagaac

SEQ ID NO: 2020263 - RNA, 13 nt, Homo sapiens
gccaaauguaauu

SEQ ID NO: 2020264 - RNA, 13 nt, Homo sapiens
auggacuguacua

SEQ ID NO: 2020265 - RNA, 12 nt, Homo sapiens
cuacaugcaauu

SEQ ID NO: 2020266 - RNA, 13 nt, Homo sapiens
uaaaaaucuccau

SEQ ID NO: 2020267 - RNA, 19 nt, Homo sapiens
uggagcaagugacaugcca

SEQ ID NO: 2020268 - RNA, 18 nt, Homo sapiens
aguaugaaaaugucauug

SEQ ID NO: 2020269 - RNA, 18 nt, Homo sapiens
aggggagaugacauuugc

SEQ ID NO: 2020270 - RNA, 21 nt, Homo sapiens
ccucugcuacuccauccugaa

SEQ ID NO: 2020271 - RNA, 23 nt, Homo sapiens
gcaacauguguacuuaauuucuu

SEQ ID NO: 2020272 - RNA, 16 nt, Homo sapiens
gucugagaacucaggc

SEQ ID NO: 2020273 - RNA, 15 nt, Homo sapiens
caguguuuccaguga

SEQ ID NO: 2020274 - RNA, 21 nt, Homo sapiens
auggugaaaccccgucuguac

SEQ ID NO: 2020275 - RNA, 17 nt, Homo sapiens
auaaugcuguugccuca

SEQ ID NO: 2020276 - RNA, 23 nt, Homo sapiens
ccauucuguuuggaucuauagaa

SEQ ID NO: 2020277 - RNA, 21 nt, Homo sapiens
uucaguacacuugguguacug

SEQ ID NO: 2020278 - RNA, 20 nt, Homo sapiens
cuuaaaguugacauuuaacu

SEQ ID NO: 2020279 - RNA, 18 nt, Homo sapiens
cauccugguuuccacugu

SEQ ID NO: 2020280 - RNA, 20 nt, Homo sapiens
gcacuuuaucuugggaccaa

SEQ ID NO: 2020281 - RNA, 14 nt, Homo sapiens
aauuucucugcucu

SEQ ID NO: 2020282 - RNA, 22 nt, Homo sapiens
uggaccacuguuucuugcuugu

SEQ ID NO: 2020283 - RNA, 20 nt, Homo sapiens
cgucaugggccccccaugca

SEQ ID NO: 2020284 - RNA, 21 nt, Homo sapiens
cuguuuccucuugaucucaaa

SEQ ID NO: 2020285 - RNA, 23 nt, Homo sapiens
ugugcccccugaaacagcugcca

SEQ ID NO: 2020286 - RNA, 17 nt, Homo sapiens
cuuccauucuuucuucc

SEQ ID NO: 2020287 - RNA, 22 nt, Homo sapiens
augaaaagauuaugaucucaga

SEQ ID NO: 2020288 - RNA, 16 nt, Homo sapiens
guaccgcgucuacccu

SEQ ID NO: 2020289 - RNA, 11 nt, Homo sapiens
cucagcccagc

SEQ ID NO: 2020290 - RNA, 23 nt, Homo sapiens
uauaacuacuccggagacagggu

SEQ ID NO: 2020291 - RNA, 14 nt, Homo sapiens
cauugauacaugca

SEQ ID NO: 2020292 - RNA, 19 nt, Homo sapiens
uauuaaucuggacauucga

SEQ ID NO: 2020293 - RNA, 21 nt, Homo sapiens
uuuuaaagaaaacuugcacuu

SEQ ID NO: 2020294 - RNA, 23 nt, Homo sapiens
gcacugaaguggcccucccucag

SEQ ID NO: 2020295 - RNA, 18 nt, Homo sapiens
acuugaugauacaaugaa

SEQ ID NO: 2020296 - RNA, 21 nt, Homo sapiens
aaugggagccuuuccaaugaa

SEQ ID NO: 2020297 - RNA, 13 nt, Homo sapiens
cacugaaaccaaa

SEQ ID NO: 2020298 - RNA, 20 nt, Homo sapiens
cccagagaggguggugaccu

SEQ ID NO: 2020299 - RNA, 18 nt, Homo sapiens
cuuucccacacugugaac

SEQ ID NO: 2020300 - RNA, 16 nt, Homo sapiens
aggccugccuucucag

SEQ ID NO: 2020301 - RNA, 21 nt, Homo sapiens
caggaauuucuguuagcaaua

SEQ ID NO: 2020302 - RNA, 14 nt, Homo sapiens
gcuuucccucccca

SEQ ID NO: 2020303 - RNA, 19 nt, Homo sapiens
gaauucuuaaauaugugga

SEQ ID NO: 2020304 - RNA, 19 nt, Homo sapiens
uccugacucuucaggccag

SEQ ID NO: 2020305 - RNA, 20 nt, Homo sapiens
cugugcccggggaaaggcaa

SEQ ID NO: 2020306 - RNA, 19 nt, Homo sapiens
agcaaaaugcuucugcaca

SEQ ID NO: 2020307 - RNA, 13 nt, Homo sapiens
uuaugaacuacag

SEQ ID NO: 2020308 - RNA, 18 nt, Homo sapiens
aaaucacuuuaccugcag

SEQ ID NO: 2020309 - RNA, 17 nt, Homo sapiens
uccacucugaggucuca

SEQ ID NO: 2020310 - RNA, 18 nt, Homo sapiens
uaaaaauaaaaaacauau

SEQ ID NO: 2020311 - RNA, 12 nt, Homo sapiens
uugugccuuuag

SEQ ID NO: 2020312 - RNA, 23 nt, Homo sapiens
aauuguauuuuuguauguggcau

SEQ ID NO: 2020313 - RNA, 18 nt, Homo sapiens
cucagggggcccgggcug

SEQ ID NO: 2020314 - RNA, 15 nt, Homo sapiens
uuucuucaguggcaa

SEQ ID NO: 2020315 - RNA, 16 nt, Homo sapiens
caggcagguccagggu

SEQ ID NO: 2020316 - RNA, 19 nt, Homo sapiens
cuaacuuaauguguauuca

SEQ ID NO: 2020317 - RNA, 18 nt, Homo sapiens
ccuuuccagucauuucaa

SEQ ID NO: 2020318 - RNA, 15 nt, Homo sapiens
aucuccuggcuuuac

SEQ ID NO: 2020319 - RNA, 20 nt, Homo sapiens
aaaugugcacuuuauccuca

SEQ ID NO: 2020320 - RNA, 13 nt, Homo sapiens
uuuuugagcacaa

SEQ ID NO: 2020321 - RNA, 16 nt, Homo sapiens
uuuaggaaacucucca

SEQ ID NO: 2020322 - RNA, 16 nt, Homo sapiens
aaacauacuuacauuu

SEQ ID NO: 2020323 - RNA, 16 nt, Homo sapiens
uucuuuuuaacuuuac

SEQ ID NO: 2020324 - RNA, 20 nt, Homo sapiens
ucccccaucccccacugcca

SEQ ID NO: 2020325 - RNA, 15 nt, Homo sapiens
aggauuaaugaucau

SEQ ID NO: 2020326 - RNA, 18 nt, Homo sapiens
guaacauaguccagagaa

SEQ ID NO: 2020327 - RNA, 20 nt, Homo sapiens
aguugaauuuauuggcuuuu

SEQ ID NO: 2020328 - RNA, 17 nt, Homo sapiens
uuucugcaaacaccaac

SEQ ID NO: 2020329 - RNA, 20 nt, Homo sapiens
caugcauggccucccagcca

SEQ ID NO: 2020330 - RNA, 14 nt, Homo sapiens
cucugggcucacac

SEQ ID NO: 2020331 - RNA, 14 nt, Homo sapiens
ugauucaugucuca

SEQ ID NO: 2020332 - RNA, 13 nt, Homo sapiens
ucauuugaacaac

SEQ ID NO: 2020333 - RNA, 16 nt, Homo sapiens
aacauuauauugcaau

SEQ ID NO: 2020334 - RNA, 20 nt, Homo sapiens
ucuaacaguauuuguacaaa

SEQ ID NO: 2020335 - RNA, 15 nt, Homo sapiens
uggccacaguggcac

SEQ ID NO: 2020336 - RNA, 18 nt, Homo sapiens
aaccuugugugaguguga

SEQ ID NO: 2020337 - RNA, 13 nt, Homo sapiens
uucuuagcuguca

SEQ ID NO: 2020338 - RNA, 20 nt, Homo sapiens
ugccuguagagccagccuug

SEQ ID NO: 2020339 - RNA, 15 nt, Homo sapiens
cggagucuugcucug

SEQ ID NO: 2020340 - RNA, 14 nt, Homo sapiens
aaggcccuucagcc

SEQ ID NO: 2020341 - RNA, 22 nt, Homo sapiens
auccaaauugccugaacauggc

SEQ ID NO: 2020342 - RNA, 21 nt, Homo sapiens
aggcagagauagaaccuggag

SEQ ID NO: 2020343 - RNA, 23 nt, Homo sapiens
gguaagaugucuugaaaacaugu

SEQ ID NO: 2020344 - RNA, 15 nt, Homo sapiens
uccaaauaaccaugu

SEQ ID NO: 2020345 - RNA, 14 nt, Homo sapiens
ugccucacugugac

SEQ ID NO: 2020346 - RNA, 21 nt, Homo sapiens
aggacuuguuucccuuuccug

SEQ ID NO: 2020347 - RNA, 17 nt, Homo sapiens
gaacacugcacucuuaa

SEQ ID NO: 2020348 - RNA, 16 nt, Homo sapiens
ugccugcccagggagg

SEQ ID NO: 2020349 - RNA, 19 nt, Homo sapiens
gacgcuuccagaccaccug

SEQ ID NO: 2020350 - RNA, 18 nt, Homo sapiens
gugauuucuuucuuugca

SEQ ID NO: 2020351 - RNA, 21 nt, Homo sapiens
uguucccccagccugccaaau

SEQ ID NO: 2020352 - RNA, 13 nt, Homo sapiens
aacaacucuaguc

SEQ ID NO: 2020353 - RNA, 23 nt, Homo sapiens
ccaagcaaccuggguccaaauaa

SEQ ID NO: 2020354 - RNA, 16 nt, Homo sapiens
ucuacaggccuuucag

SEQ ID NO: 2020355 - RNA, 13 nt, Homo sapiens
cuaauaacagugc

SEQ ID NO: 2020356 - RNA, 21 nt, Homo sapiens
aaguacuuguaguuccacuua

SEQ ID NO: 2020357 - RNA, 15 nt, Homo sapiens
aguaggggcauggua

SEQ ID NO: 2020358 - RNA, 17 nt, Homo sapiens
ggagauggcgucuacca

SEQ ID NO: 2020359 - RNA, 13 nt, Homo sapiens
acaguuggcacuu

SEQ ID NO: 2020360 - RNA, 23 nt, Homo sapiens
uucugggggaaaaagccauauca

SEQ ID NO: 2020361 - RNA, 16 nt, Homo sapiens
caggacuuguuuacaa

SEQ ID NO: 2020362 - RNA, 21 nt, Homo sapiens
uaggagacugguuaggacaaa

SEQ ID NO: 2020363 - RNA, 18 nt, Homo sapiens
ugguggcagugccuguaa

SEQ ID NO: 2020364 - RNA, 20 nt, Homo sapiens
cggggaggcuccugccugag

SEQ ID NO: 2020365 - RNA, 13 nt, Homo sapiens
cuagcaaguguaa

SEQ ID NO: 2020366 - RNA, 19 nt, Homo sapiens
auauuucucccaacuuauc

SEQ ID NO: 2020367 - RNA, 11 nt, Homo sapiens
ugcgcacacac

SEQ ID NO: 2020368 - RNA, 19 nt, Homo sapiens
agaagaucuaauaccaucc

SEQ ID NO: 2020369 - RNA, 21 nt, Homo sapiens
agcauggccgcaacuucccag

SEQ ID NO: 2020370 - RNA, 19 nt, Homo sapiens
cuauacacuuaaugauaca

SEQ ID NO: 2020371 - RNA, 19 nt, Homo sapiens
aaugucucggucacaucag

SEQ ID NO: 2020372 - RNA, 18 nt, Homo sapiens
ugcaaacuuguaucugaa

SEQ ID NO: 2020373 - RNA, 13 nt, Homo sapiens
cucacagaguaug

SEQ ID NO: 2020374 - RNA, 17 nt, Homo sapiens
cauagagugaucuuucc

SEQ ID NO: 2020375 - RNA, 21 nt, Homo sapiens
cugacauuucuucuagugaug

SEQ ID NO: 2020376 - RNA, 16 nt, Homo sapiens
uuaguuuuauauugcu

SEQ ID NO: 2020377 - RNA, 17 nt, Homo sapiens
cauuucuacaaugcaca

SEQ ID NO: 2020378 - RNA, 15 nt, Homo sapiens
uaugguuugccauua

SEQ ID NO: 2020379 - RNA, 18 nt, Homo sapiens
gaauaaauggagauucag

SEQ ID NO: 2020380 - RNA, 16 nt, Homo sapiens
uuguuugucaucuuca

SEQ ID NO: 2020381 - RNA, 13 nt, Homo sapiens
gugaaccaaagag

SEQ ID NO: 2020382 - RNA, 13 nt, Homo sapiens
guaaaccaaaaag

SEQ ID NO: 2020383 - RNA, 22 nt, Homo sapiens
uggacugaccuuguaaaagaca

SEQ ID NO: 2020384 - RNA, 14 nt, Homo sapiens
cgugaccagcagua

SEQ ID NO: 2020385 - RNA, 20 nt, Homo sapiens
uuaaaugaacuugauagcua

SEQ ID NO: 2020386 - RNA, 17 nt, Homo sapiens
ggaucucucuagugaug

SEQ ID NO: 2020387 - RNA, 22 nt, Homo sapiens
ugcaguaggggcuacugugacc

SEQ ID NO: 2020388 - RNA, 16 nt, Homo sapiens
cuggauggcaccucag

SEQ ID NO: 2020389 - RNA, 16 nt, Homo sapiens
ucacaaauugaucaag

SEQ ID NO: 2020390 - RNA, 19 nt, Homo sapiens
uuaauuuuuauacugacaa

SEQ ID NO: 2020391 - RNA, 17 nt, Homo sapiens
uugggaaagcucuuguc

SEQ ID NO: 2020392 - RNA, 14 nt, Homo sapiens
gaagcgcuucugca

SEQ ID NO: 2020393 - RNA, 23 nt, Homo sapiens
ccuuaauguauuugauguauucu

SEQ ID NO: 2020394 - RNA, 20 nt, Homo sapiens
ccagguggcccgguugaacu

SEQ ID NO: 2020395 - RNA, 23 nt, Homo sapiens
aguauucuaauaagcuaguugaa

SEQ ID NO: 2020396 - RNA, 17 nt, Homo sapiens
aaccaugaccucacccc

SEQ ID NO: 2020397 - RNA, 11 nt, Homo sapiens
aacugccaaag

SEQ ID NO: 2020398 - RNA, 11 nt, Homo sapiens
aagugccaaac

SEQ ID NO: 2020399 - RNA, 17 nt, Homo sapiens
ugugcuggccucucuga

SEQ ID NO: 2020400 - RNA, 14 nt, Homo sapiens
uuaaaugaacauca

SEQ ID NO: 2020401 - RNA, 21 nt, Homo sapiens
agaguuuaguccuuacugucu

SEQ ID NO: 2020402 - RNA, 16 nt, Homo sapiens
acaacucaaugaaaau

SEQ ID NO: 2020403 - RNA, 12 nt, Homo sapiens
cguaaugaauuu

SEQ ID NO: 2020404 - RNA, 20 nt, Homo sapiens
aaugcugcccucacugccuc

SEQ ID NO: 2020405 - RNA, 17 nt, Homo sapiens
cugcugcaggacauuaa

SEQ ID NO: 2020406 - RNA, 15 nt, Homo sapiens
aggagagcuuagggu

SEQ ID NO: 2020407 - RNA, 19 nt, Homo sapiens
guaagcagaguucuuugca

SEQ ID NO: 2020408 - RNA, 18 nt, Homo sapiens
aucagacugacaguuuac

SEQ ID NO: 2020409 - RNA, 18 nt, Homo sapiens
ucucccaguccauuucca

SEQ ID NO: 2020410 - RNA, 16 nt, Homo sapiens
aucuaccuguguguau

SEQ ID NO: 2020411 - RNA, 23 nt, Homo sapiens
accuaguacgacuucauuccuuc

SEQ ID NO: 2020412 - RNA, 12 nt, Homo sapiens
agaaacagccac

SEQ ID NO: 2020413 - RNA, 13 nt, Homo sapiens
uguuaccuaaagu

SEQ ID NO: 2020414 - RNA, 19 nt, Homo sapiens
ugggcuucgucuacuccuu

SEQ ID NO: 2020415 - RNA, 16 nt, Homo sapiens
caaaaucaucuuacau

SEQ ID NO: 2020416 - RNA, 15 nt, Homo sapiens
cccagugccaagcac

SEQ ID NO: 2020417 - RNA, 15 nt, Homo sapiens
uaccgugacugaaaa

SEQ ID NO: 2020418 - RNA, 11 nt, Homo sapiens
uaggauuccau

SEQ ID NO: 2020419 - RNA, 23 nt, Homo sapiens
gcuuuguauucaaaaauuaucua

SEQ ID NO: 2020420 - RNA, 14 nt, Homo sapiens
uaacaucaaagacu

SEQ ID NO: 2020421 - RNA, 17 nt, Homo sapiens
acuuugccacugcugua

SEQ ID NO: 2020422 - RNA, 21 nt, Homo sapiens
acucugucuuguucacugcag

SEQ ID NO: 2020423 - RNA, 18 nt, Homo sapiens
caugagaaauuaccaaaa

SEQ ID NO: 2020424 - RNA, 14 nt, Homo sapiens
acccacuuugucca

SEQ ID NO: 2020425 - RNA, 18 nt, Homo sapiens
ucugccccguuucuugcc

SEQ ID NO: 2020426 - RNA, 17 nt, Homo sapiens
aggagauuccggugccu

SEQ ID NO: 2020427 - RNA, 15 nt, Homo sapiens
aaaagacauguugua

SEQ ID NO: 2020428 - RNA, 14 nt, Homo sapiens
uuaaggcagcucau

SEQ ID NO: 2020429 - RNA, 22 nt, Homo sapiens
ugcacagaucugcuugaucaau

SEQ ID NO: 2020430 - RNA, 13 nt, Homo sapiens
gcuuaccccuuca

SEQ ID NO: 2020431 - RNA, 19 nt, Homo sapiens
ccugaauguuucagaccac

SEQ ID NO: 2020432 - RNA, 14 nt, Homo sapiens
agacauaacaaaac

SEQ ID NO: 2020433 - RNA, 22 nt, Homo sapiens
cuggaaugaagaccaugccuag

SEQ ID NO: 2020434 - RNA, 15 nt, Homo sapiens
ucugcagacugcuag

SEQ ID NO: 2020435 - RNA, 16 nt, Homo sapiens
gagaugaaaaagacug

SEQ ID NO: 2020436 - RNA, 18 nt, Homo sapiens
gcagggaaggaauccugg

SEQ ID NO: 2020437 - RNA, 12 nt, Homo sapiens
uucucccagcgu

SEQ ID NO: 2020438 - RNA, 23 nt, Homo sapiens
aaucauuuugaguuugccucagu

SEQ ID NO: 2020439 - RNA, 17 nt, Homo sapiens
gcaauacuaauugagaa

SEQ ID NO: 2020440 - RNA, 15 nt, Homo sapiens
uaaauguauguauuu

SEQ ID NO: 2020441 - RNA, 13 nt, Homo sapiens
aaggacaaugccu

SEQ ID NO: 2020442 - RNA, 20 nt, Homo sapiens
auugcacguguguauugcaa

SEQ ID NO: 2020443 - RNA, 21 nt, Homo sapiens
uguuaguuauaaauagccuuc

SEQ ID NO: 2020444 - RNA, 20 nt, Homo sapiens
aaagaagauaaacacaaaau

SEQ ID NO: 2020445 - RNA, 23 nt, Homo sapiens
caggacguuagacuguugggaca

SEQ ID NO: 2020446 - RNA, 18 nt, Homo sapiens
acucaugguguguuacac

SEQ ID NO: 2020447 - RNA, 14 nt, Homo sapiens
ggcuccacugggau

SEQ ID NO: 2020448 - RNA, 18 nt, Homo sapiens
cagacaauaaacccucag

SEQ ID NO: 2020449 - RNA, 16 nt, Homo sapiens
cauccucugcuuguca

SEQ ID NO: 2020450 - RNA, 23 nt, Homo sapiens
uaucacaugaauauaaaugggaa

SEQ ID NO: 2020451 - RNA, 17 nt, Homo sapiens
uucuucagcuugauccu

SEQ ID NO: 2020452 - RNA, 19 nt, Homo sapiens
caaaccuguguaggcauuu

SEQ ID NO: 2020453 - RNA, 16 nt, Homo sapiens
acccucuuccugugau

SEQ ID NO: 2020454 - RNA, 12 nt, Homo sapiens
ggauauauuuga

SEQ ID NO: 2020455 - RNA, 19 nt, Homo sapiens
uucccugauggaaccauaa

SEQ ID NO: 2020456 - RNA, 19 nt, Homo sapiens
aagaaacucuauggucuua

SEQ ID NO: 2020457 - RNA, 21 nt, Homo sapiens
auaugcagaauggcauuugca

SEQ ID NO: 2020458 - RNA, 23 nt, Homo sapiens
uccccaacccugagcacucuuau

SEQ ID NO: 2020459 - RNA, 16 nt, Homo sapiens
cagauucaagugcaau

SEQ ID NO: 2020460 - RNA, 21 nt, Homo sapiens
uauaggcaugagccacugagc

SEQ ID NO: 2020461 - RNA, 20 nt, Homo sapiens
caaagaaaggagacuuuaug

SEQ ID NO: 2020462 - RNA, 18 nt, Homo sapiens
aggcaagauaaaccaaug

SEQ ID NO: 2020463 - RNA, 21 nt, Homo sapiens
agaggggacagaguucaggga

SEQ ID NO: 2020464 - RNA, 16 nt, Homo sapiens
gccccaacucuuuauc

SEQ ID NO: 2020465 - RNA, 16 nt, Homo sapiens
ggcuggucugauggaa

SEQ ID NO: 2020466 - RNA, 14 nt, Homo sapiens
ucuguguugagcgu

SEQ ID NO: 2020467 - RNA, 14 nt, Homo sapiens
aaguuguuuuaucc

SEQ ID NO: 2020468 - RNA, 22 nt, Homo sapiens
guucaagcgauucuccugccuc

SEQ ID NO: 2020469 - RNA, 19 nt, Homo sapiens
cugaccuccuggacuguag

SEQ ID NO: 2020470 - RNA, 13 nt, Homo sapiens
cccuacaaaggcu

SEQ ID NO: 2020471 - RNA, 22 nt, Homo sapiens
uuauugacaucucuuuugagcu

SEQ ID NO: 2020472 - RNA, 14 nt, Homo sapiens
uuaagcacuacaua

SEQ ID NO: 2020473 - RNA, 23 nt, Homo sapiens
gaaaaagauauuguauuaucaua

SEQ ID NO: 2020474 - RNA, 16 nt, Homo sapiens
aaagauagacaucaga

SEQ ID NO: 2020475 - RNA, 19 nt, Homo sapiens
cguacccagccauguguug

SEQ ID NO: 2020476 - RNA, 18 nt, Homo sapiens
cugagaaccaaccaauga

SEQ ID NO: 2020477 - RNA, 19 nt, Homo sapiens
cucauuccuucccagagau

SEQ ID NO: 2020478 - RNA, 19 nt, Homo sapiens
acagcaucccuucccacau

SEQ ID NO: 2020479 - RNA, 20 nt, Homo sapiens
agguggauuccgagugguga

SEQ ID NO: 2020480 - RNA, 13 nt, Homo sapiens
caccgaugcacac

SEQ ID NO: 2020481 - RNA, 13 nt, Homo sapiens
augagaugaugcc

SEQ ID NO: 2020482 - RNA, 17 nt, Homo sapiens
uuccuaaccugucagaa

SEQ ID NO: 2020483 - RNA, 17 nt, Homo sapiens
gaucucagagcauuuca

SEQ ID NO: 2020484 - RNA, 23 nt, Homo sapiens
aauguuuccuguggaaauaugca

SEQ ID NO: 2020485 - RNA, 14 nt, Homo sapiens
ccuaaggugucuga

SEQ ID NO: 2020486 - RNA, 14 nt, Homo sapiens
gcuugagucucaag

SEQ ID NO: 2020487 - RNA, 22 nt, Homo sapiens
guagagacaguguuuugccaug

SEQ ID NO: 2020488 - RNA, 18 nt, Homo sapiens
cuuuccuuuccuuucauu

SEQ ID NO: 2020489 - RNA, 21 nt, Homo sapiens
ucagacugaacuuacacugua

SEQ ID NO: 2020490 - RNA, 17 nt, Homo sapiens
uggugaugcgcaguugc

SEQ ID NO: 2020491 - RNA, 13 nt, Homo sapiens
agguguagaccag

SEQ ID NO: 2020492 - RNA, 20 nt, Homo sapiens
gauguuugaggcuuucagaa

SEQ ID NO: 2020493 - RNA, 21 nt, Homo sapiens
acuaucugaagauuuccauuu

SEQ ID NO: 2020494 - RNA, 19 nt, Homo sapiens
aauauggaaugggcucagu

SEQ ID NO: 2020495 - RNA, 14 nt, Homo sapiens
caaaauccuugccu

SEQ ID NO: 2020496 - RNA, 19 nt, Homo sapiens
caucuauaaagaagaacuu

SEQ ID NO: 2020497 - RNA, 18 nt, Homo sapiens
cacagcuuuaugauauca

SEQ ID NO: 2020498 - RNA, 20 nt, Homo sapiens
auucugugucucugcaucca

SEQ ID NO: 2020499 - RNA, 20 nt, Homo sapiens
acgaauucuucuggggucag

SEQ ID NO: 2020500 - RNA, 23 nt, Homo sapiens
acagccuuauuuuuguaugccuu

SEQ ID NO: 2020501 - RNA, 20 nt, Homo sapiens
aguccgacaaagcuacuuga

SEQ ID NO: 2020502 - RNA, 21 nt, Homo sapiens
acccaccuacuuagauauuuc

SEQ ID NO: 2020503 - RNA, 22 nt, Homo sapiens
ucacaugccgcccccagcagcu

SEQ ID NO: 2020504 - RNA, 19 nt, Homo sapiens
cauacccacacagucacag

SEQ ID NO: 2020505 - RNA, 18 nt, Homo sapiens
ugcgcacgaccuacauua

SEQ ID NO: 2020506 - RNA, 21 nt, Homo sapiens
cggagcucccgggcacaucca

SEQ ID NO: 2020507 - RNA, 18 nt, Homo sapiens
aaggaaacuggguuccug

SEQ ID NO: 2020508 - RNA, 18 nt, Homo sapiens
uaaaugcaaacacugugu

SEQ ID NO: 2020509 - RNA, 10 nt, Homo sapiens
auaugugaga

SEQ ID NO: 2020510 - RNA, 14 nt, Homo sapiens
cagccaggacaucu

SEQ ID NO: 2020511 - RNA, 16 nt, Homo sapiens
aagcugacuuggcacu

SEQ ID NO: 2020512 - RNA, 15 nt, Homo sapiens
uuaacccaaagaagc

SEQ ID NO: 2020513 - RNA, 17 nt, Homo sapiens
uaugcauuuggaauuag

SEQ ID NO: 2020514 - RNA, 20 nt, Homo sapiens
gcaaagcugaugacaacuuc

SEQ ID NO: 2020515 - RNA, 21 nt, Homo sapiens
cugacacauagaaaacaauca

SEQ ID NO: 2020516 - RNA, 23 nt, Homo sapiens
agaugccgcggaaggucccucag

SEQ ID NO: 2020517 - RNA, 18 nt, Homo sapiens
ccagucugucuacugugg

SEQ ID NO: 2020518 - RNA, 14 nt, Homo sapiens
gucucauacucacc

SEQ ID NO: 2020519 - RNA, 16 nt, Homo sapiens
ugacucugacuuugag

SEQ ID NO: 2020520 - RNA, 16 nt, Homo sapiens
gguaaguaaacaguca

SEQ ID NO: 2020521 - RNA, 22 nt, Homo sapiens
auccaggacuuuguuaacuuca

SEQ ID NO: 2020522 - RNA, 18 nt, Homo sapiens
cuuggauguuuuuaguuc

SEQ ID NO: 2020523 - RNA, 14 nt, Homo sapiens
ugagagaccugcuc

SEQ ID NO: 2020524 - RNA, 18 nt, Homo sapiens
caagaaaucccugagaca

SEQ ID NO: 2020525 - RNA, 23 nt, Homo sapiens
ucccaccucucugagcucugcau

SEQ ID NO: 2020526 - RNA, 13 nt, Homo sapiens
uuuagcguguaaa

SEQ ID NO: 2020527 - RNA, 19 nt, Homo sapiens
uacugaggagcaaagcagc

SEQ ID NO: 2020528 - RNA, 15 nt, Homo sapiens
guccacaacaauaug

SEQ ID NO: 2020529 - RNA, 15 nt, Homo sapiens
cauucugcacucaga

SEQ ID NO: 2020530 - RNA, 19 nt, Homo sapiens
ugugcugcaccccaugugg

SEQ ID NO: 2020531 - RNA, 12 nt, Homo sapiens
accuggauccag

SEQ ID NO: 2020532 - RNA, 17 nt, Homo sapiens
aaauucauuaugcugcu

SEQ ID NO: 2020533 - RNA, 14 nt, Homo sapiens
agccaggcugacca

SEQ ID NO: 2020534 - RNA, 17 nt, Homo sapiens
uaccuuacugcaauuug

SEQ ID NO: 2020535 - RNA, 19 nt, Homo sapiens
ugcucaguuggugcugcuu

SEQ ID NO: 2020536 - RNA, 22 nt, Homo sapiens
guggaaauaaaaagaaggaaaa

SEQ ID NO: 2020537 - RNA, 21 nt, Homo sapiens
cagagaagaccacaccaagga

SEQ ID NO: 2020538 - RNA, 22 nt, Homo sapiens
uggaugggcccugcaagacaca

SEQ ID NO: 2020539 - RNA, 15 nt, Homo sapiens
gacucuugcucuuuc

SEQ ID NO: 2020540 - RNA, 18 nt, Homo sapiens
auuuccaaaccuccacug

SEQ ID NO: 2020541 - RNA, 19 nt, Homo sapiens
agcggucuucaggcauuuu

SEQ ID NO: 2020542 - RNA, 21 nt, Homo sapiens
cauccuaaucugaauggugcu

SEQ ID NO: 2020543 - RNA, 21 nt, Homo sapiens
gacuucuguuuucaaucucgu

SEQ ID NO: 2020544 - RNA, 13 nt, Homo sapiens
uccgcauccuagu

SEQ ID NO: 2020545 - RNA, 13 nt, Homo sapiens
cuaacaucuccau

SEQ ID NO: 2020546 - RNA, 15 nt, Homo sapiens
acacaggucagggcu

SEQ ID NO: 2020547 - RNA, 20 nt, Homo sapiens
cugacuguuuauuuaaggau

SEQ ID NO: 2020548 - RNA, 13 nt, Homo sapiens
cuagaagugugaa

SEQ ID NO: 2020549 - RNA, 13 nt, Homo sapiens
aaaugacagaucu

SEQ ID NO: 2020550 - RNA, 21 nt, Homo sapiens
gauugauuuuuuuucuuuaaa

SEQ ID NO: 2020551 - RNA, 18 nt, Homo sapiens
aagaggagacaguuuacc

SEQ ID NO: 2020552 - RNA, 16 nt, Homo sapiens
agcuguugaucuuuca

SEQ ID NO: 2020553 - RNA, 15 nt, Homo sapiens
cacagucuuggcuca

SEQ ID NO: 2020554 - RNA, 19 nt, Homo sapiens
agcauugcuauuuaucuca

SEQ ID NO: 2020555 - RNA, 13 nt, Homo sapiens
cagacaugccaca

SEQ ID NO: 2020556 - RNA, 16 nt, Homo sapiens
ccaaucagcacucugu

SEQ ID NO: 2020557 - RNA, 18 nt, Homo sapiens
aagguuugagaagcacug

SEQ ID NO: 2020558 - RNA, 18 nt, Homo sapiens
cucuucaucccauuccag

SEQ ID NO: 2020559 - RNA, 14 nt, Homo sapiens
uaaacucucuagcu

SEQ ID NO: 2020560 - RNA, 15 nt, Homo sapiens
ucgugacuacauuga

SEQ ID NO: 2020561 - RNA, 17 nt, Homo sapiens
uuauaagcauugccauu

SEQ ID NO: 2020562 - RNA, 20 nt, Homo sapiens
auuguaacuaauacuacugu

SEQ ID NO: 2020563 - RNA, 18 nt, Homo sapiens
gucaguuucacucccucu

SEQ ID NO: 2020564 - RNA, 20 nt, Homo sapiens
auaacuuuucuaaagccuua

SEQ ID NO: 2020565 - RNA, 16 nt, Homo sapiens
ccagcagcacccagug

SEQ ID NO: 2020566 - RNA, 22 nt, Homo sapiens
aaaauccaagcugcucauuuca

SEQ ID NO: 2020567 - RNA, 17 nt, Homo sapiens
uccuguacuuuuuccag

SEQ ID NO: 2020568 - RNA, 17 nt, Homo sapiens
cuauaauuaugcaguac

SEQ ID NO: 2020569 - RNA, 21 nt, Homo sapiens
cauuccugggacuaugcugua

SEQ ID NO: 2020570 - RNA, 16 nt, Homo sapiens
ccacuugaagcacuua

SEQ ID NO: 2020571 - RNA, 9 nt, Homo sapiens
aaagggaug

SEQ ID NO: 2020572 - RNA, 18 nt, Homo sapiens
ggaguagaaaaaucucau

SEQ ID NO: 2020573 - RNA, 19 nt, Homo sapiens
cuuacuugcaaaauggaga

SEQ ID NO: 2020574 - RNA, 14 nt, Homo sapiens
gugacggacucaga

SEQ ID NO: 2020575 - RNA, 21 nt, Homo sapiens
cuaaauaaucuuacucuagau

SEQ ID NO: 2020576 - RNA, 20 nt, Homo sapiens
accaaugcccagcaggggag

SEQ ID NO: 2020577 - RNA, 17 nt, Homo sapiens
uacaaaauauccaagcc

SEQ ID NO: 2020578 - RNA, 15 nt, Homo sapiens
cuaaaguacugagca

SEQ ID NO: 2020579 - RNA, 15 nt, Homo sapiens
gcuaaguguggagcu

SEQ ID NO: 2020580 - RNA, 20 nt, Homo sapiens
aacuggucuuccauuuugcc

SEQ ID NO: 2020581 - RNA, 15 nt, Homo sapiens
agacaauaaaacacu

SEQ ID NO: 2020582 - RNA, 15 nt, Homo sapiens
aauucaaaaguucca

SEQ ID NO: 2020583 - RNA, 15 nt, Homo sapiens
uaugucuauguguau

SEQ ID NO: 2020584 - RNA, 16 nt, Homo sapiens
uggcugcccugcagaa

SEQ ID NO: 2020585 - RNA, 15 nt, Homo sapiens
agccuguuacaggaa

SEQ ID NO: 2020586 - RNA, 21 nt, Homo sapiens
ugcauuaauaauagcuaauaa

SEQ ID NO: 2020587 - RNA, 15 nt, Homo sapiens
aacaucccacagugg

SEQ ID NO: 2020588 - RNA, 20 nt, Homo sapiens
gcaaaacaaauucaaauaau

SEQ ID NO: 2020589 - RNA, 21 nt, Homo sapiens
aacaugguuacaaucauugcu

SEQ ID NO: 2020590 - RNA, 15 nt, Homo sapiens
gcuuugcacuucaaa

SEQ ID NO: 2020591 - RNA, 20 nt, Homo sapiens
gcgcuguuggggcugcucau

SEQ ID NO: 2020592 - RNA, 19 nt, Homo sapiens
uggaauaauacauacuaau

SEQ ID NO: 2020593 - RNA, 13 nt, Homo sapiens
gucauggucugag

SEQ ID NO: 2020594 - RNA, 15 nt, Homo sapiens
ucagaauccaaguga

SEQ ID NO: 2020595 - RNA, 23 nt, Homo sapiens
uaauugugaauaaaaauugauga

SEQ ID NO: 2020596 - RNA, 23 nt, Homo sapiens
ccauagcaacuccccuacaucaa

SEQ ID NO: 2020597 - RNA, 13 nt, Homo sapiens
uuguggggcuccc

SEQ ID NO: 2020598 - RNA, 23 nt, Homo sapiens
ccaguuuggguaaaauacuuuua

SEQ ID NO: 2020599 - RNA, 18 nt, Homo sapiens
gccaggcuggagugcagu

SEQ ID NO: 2020600 - RNA, 21 nt, Homo sapiens
guagcagauccccagccucug

SEQ ID NO: 2020601 - RNA, 21 nt, Homo sapiens
guacauauggaaauccuguua

SEQ ID NO: 2020602 - RNA, 17 nt, Homo sapiens
gaagaugggaaaaccau

SEQ ID NO: 2020603 - RNA, 21 nt, Homo sapiens
ccuuggugauuccgcagugag

SEQ ID NO: 2020604 - RNA, 17 nt, Homo sapiens
ccucuacuguugcacag

SEQ ID NO: 2020605 - RNA, 18 nt, Homo sapiens
cuacauuccacccuguua

SEQ ID NO: 2020606 - RNA, 23 nt, Homo sapiens
cuaggcgugguggugcaugccug

SEQ ID NO: 2020607 - RNA, 13 nt, Homo sapiens
uaguaucucuggc

SEQ ID NO: 2020608 - RNA, 12 nt, Homo sapiens
cacuacuuaaaa

SEQ ID NO: 2020609 - RNA, 16 nt, Homo sapiens
gcugugugaauuccca

SEQ ID NO: 2020610 - RNA, 21 nt, Homo sapiens
caugcauuuugcagcagugag

SEQ ID NO: 2020611 - RNA, 21 nt, Homo sapiens
gagggugaggggcuggcacug

SEQ ID NO: 2020612 - RNA, 17 nt, Homo sapiens
agccuccuucagcagcu

SEQ ID NO: 2020613 - RNA, 18 nt, Homo sapiens
gcuucaccaagaagcaaa

SEQ ID NO: 2020614 - RNA, 24 nt, Homo sapiens
caggcaacgugcgugucucugcca

SEQ ID NO: 2020615 - RNA, 19 nt, Homo sapiens
uagagaaacacuaaagcau

SEQ ID NO: 2020616 - RNA, 22 nt, Homo sapiens
cgugagaccgcagucugcuuag

SEQ ID NO: 2020617 - RNA, 15 nt, Homo sapiens
ugauuugccacugau

SEQ ID NO: 2020618 - RNA, 23 nt, Homo sapiens
acuugauucuugugauugacuuu

SEQ ID NO: 2020619 - RNA, 15 nt, Homo sapiens
auuuuguucugcaaa

SEQ ID NO: 2020620 - RNA, 14 nt, Homo sapiens
gaugucuucuagcu

SEQ ID NO: 2020621 - RNA, 22 nt, Homo sapiens
uauuuuuucaauuuaaagguua

SEQ ID NO: 2020622 - RNA, 20 nt, Homo sapiens
gaauuucaauguccagugag

SEQ ID NO: 2020623 - RNA, 20 nt, Homo sapiens
ucccuagccagaggcucuaa

SEQ ID NO: 2020624 - RNA, 15 nt, Homo sapiens
gaaugaggcuugcug

SEQ ID NO: 2020625 - RNA, 15 nt, Homo sapiens
uuuccaggcuagucc

SEQ ID NO: 2020626 - RNA, 16 nt, Homo sapiens
ccaaauuauuguccaa

SEQ ID NO: 2020627 - RNA, 20 nt, Homo sapiens
uuauacuagguuaacauuug

SEQ ID NO: 2020628 - RNA, 17 nt, Homo sapiens
gaucuaauaaacuucca

SEQ ID NO: 2020629 - RNA, 19 nt, Homo sapiens
uucggccagagcugaagag

SEQ ID NO: 2020630 - RNA, 11 nt, Homo sapiens
ggaaugaagca

SEQ ID NO: 2020631 - RNA, 14 nt, Homo sapiens
gcccuuaccugcca

SEQ ID NO: 2020632 - RNA, 19 nt, Homo sapiens
caacccaaauguucaucaa

SEQ ID NO: 2020633 - RNA, 18 nt, Homo sapiens
ucacuaccuuuauagcuc

SEQ ID NO: 2020634 - RNA, 21 nt, Homo sapiens
ggaagcuuucugucuccuuaa

SEQ ID NO: 2020635 - RNA, 21 nt, Homo sapiens
caguugcacuacauaaucucu

SEQ ID NO: 2020636 - RNA, 15 nt, Homo sapiens
uccagucacacuccc

SEQ ID NO: 2020637 - RNA, 19 nt, Homo sapiens
uccuguucucucugugcuc

SEQ ID NO: 2020638 - RNA, 21 nt, Homo sapiens
gaggcaacccgugcucagcug

SEQ ID NO: 2020639 - RNA, 19 nt, Homo sapiens
uuacccaggguggagugca

SEQ ID NO: 2020640 - RNA, 15 nt, Homo sapiens
uugugugucaugcca

SEQ ID NO: 2020641 - RNA, 15 nt, Homo sapiens
auguugcucagucuc

SEQ ID NO: 2020642 - RNA, 18 nt, Homo sapiens
ccaggaucccucccagau

SEQ ID NO: 2020643 - RNA, 14 nt, Homo sapiens
uuaaucaaucuuug

SEQ ID NO: 2020644 - RNA, 14 nt, Homo sapiens
agcaucagcaagac

SEQ ID NO: 2020645 - RNA, 21 nt, Homo sapiens
cccuuaccugaaccagccugg

SEQ ID NO: 2020646 - RNA, 21 nt, Homo sapiens
cccucaccuguagcagccagu

SEQ ID NO: 2020647 - RNA, 13 nt, Homo sapiens
gcaaccauuugua

SEQ ID NO: 2020648 - RNA, 22 nt, Homo sapiens
ugucuauuguauauauaaucua

SEQ ID NO: 2020649 - RNA, 23 nt, Homo sapiens
gaccugggugggaggaaacugua

SEQ ID NO: 2020650 - RNA, 17 nt, Homo sapiens
aguucuuuacuggugau

SEQ ID NO: 2020651 - RNA, 22 nt, Homo sapiens
caaucuauuuuugugugcugug

SEQ ID NO: 2020652 - RNA, 11 nt, Homo sapiens
gacgcugugcu

SEQ ID NO: 2020653 - RNA, 21 nt, Homo sapiens
uucuuccucaaagcauuugca

SEQ ID NO: 2020654 - RNA, 18 nt, Homo sapiens
cacugugaccugcuccug

SEQ ID NO: 2020655 - RNA, 18 nt, Homo sapiens
gauggcgaccaccaaagu

SEQ ID NO: 2020656 - RNA, 14 nt, Homo sapiens
aaggccucuaggga

SEQ ID NO: 2020657 - RNA, 23 nt, Homo sapiens
uaacaccagacagacaacacugg

SEQ ID NO: 2020658 - RNA, 21 nt, Homo sapiens
aggaauacuucaccuuuccuc

SEQ ID NO: 2020659 - RNA, 22 nt, Homo sapiens
aacacugucaauggacugcacc

SEQ ID NO: 2020660 - RNA, 21 nt, Homo sapiens
gaguuucuccuuuugaccaaa

SEQ ID NO: 2020661 - RNA, 19 nt, Homo sapiens
ggggccaggggaucccucu

SEQ ID NO: 2020662 - RNA, 12 nt, Homo sapiens
acggccacaguc

SEQ ID NO: 2020663 - RNA, 15 nt, Homo sapiens
aucuuagacauuuau

SEQ ID NO: 2020664 - RNA, 12 nt, Homo sapiens
ccuggcaagaau

SEQ ID NO: 2020665 - RNA, 15 nt, Homo sapiens
acccaggccacugac

SEQ ID NO: 2020666 - RNA, 16 nt, Homo sapiens
cugccacugaccucac

SEQ ID NO: 2020667 - RNA, 15 nt, Homo sapiens
agggcauugcucagc

SEQ ID NO: 2020668 - RNA, 23 nt, Homo sapiens
aaccucuggcuagaggacauauu

SEQ ID NO: 2020669 - RNA, 12 nt, Homo sapiens
uuauuuuugcaa

SEQ ID NO: 2020670 - RNA, 13 nt, Homo sapiens
guugggcuuccau

SEQ ID NO: 2020671 - RNA, 23 nt, Homo sapiens
aguguguaaaauuaauguaauaa

SEQ ID NO: 2020672 - RNA, 20 nt, Homo sapiens
cugauuuaaaagggcucuuu

SEQ ID NO: 2020673 - RNA, 14 nt, Homo sapiens
aauuaaaugaagcc

SEQ ID NO: 2020674 - RNA, 16 nt, Homo sapiens
ggcagaagaacgugga

SEQ ID NO: 2020675 - RNA, 14 nt, Homo sapiens
ucugcaaguccacu

SEQ ID NO: 2020676 - RNA, 21 nt, Homo sapiens
agauggaaaaacuugugcuau

SEQ ID NO: 2020677 - RNA, 14 nt, Homo sapiens
uucuacaaccagag

SEQ ID NO: 2020678 - RNA, 18 nt, Homo sapiens
gaaugucaagaaaaggag

SEQ ID NO: 2020679 - RNA, 16 nt, Homo sapiens
cgguuugcuacauucu

SEQ ID NO: 2020680 - RNA, 21 nt, Homo sapiens
aaugcaguacaggacauauau

SEQ ID NO: 2020681 - RNA, 16 nt, Homo sapiens
aaguggacuuguuacc

SEQ ID NO: 2020682 - RNA, 15 nt, Homo sapiens
agaugggacaauuag

SEQ ID NO: 2020683 - RNA, 19 nt, Homo sapiens
ugugucccccucuguccag

SEQ ID NO: 2020684 - RNA, 16 nt, Homo sapiens
cgaguuccaccccauc

SEQ ID NO: 2020685 - RNA, 21 nt, Homo sapiens
caggucauauuaauauauuuc

SEQ ID NO: 2020686 - RNA, 21 nt, Homo sapiens
accaucuccagcuauuuacac

SEQ ID NO: 2020687 - RNA, 16 nt, Homo sapiens
gggacacucauauugc

SEQ ID NO: 2020688 - RNA, 21 nt, Homo sapiens
acuuauauuuaaaacuugccu

SEQ ID NO: 2020689 - RNA, 15 nt, Homo sapiens
aaggaagauuugacg

SEQ ID NO: 2020690 - RNA, 13 nt, Homo sapiens
guguaugucagug

SEQ ID NO: 2020691 - RNA, 17 nt, Homo sapiens
uguguguacaacacugg

SEQ ID NO: 2020692 - RNA, 20 nt, Homo sapiens
ugcuugccgacuggcuguga

SEQ ID NO: 2020693 - RNA, 19 nt, Homo sapiens
ggcuggacaugggugggcu

SEQ ID NO: 2020694 - RNA, 17 nt, Homo sapiens
aaugcuaauuaggcaaa

SEQ ID NO: 2020695 - RNA, 23 nt, Homo sapiens
uagcauugaaguguuugcugcag

SEQ ID NO: 2020696 - RNA, 15 nt, Homo sapiens
aggaaaaugaauaau

SEQ ID NO: 2020697 - RNA, 20 nt, Homo sapiens
ugccuuccgacaccacuggg

SEQ ID NO: 2020698 - RNA, 12 nt, Homo sapiens
ggauaacaccac

SEQ ID NO: 2020699 - RNA, 17 nt, Homo sapiens
ggcugcucuccaucucu

SEQ ID NO: 2020700 - RNA, 14 nt, Homo sapiens
ugccugagggucac

SEQ ID NO: 2020701 - RNA, 14 nt, Homo sapiens
gccuagagucuuuc

SEQ ID NO: 2020702 - RNA, 18 nt, Homo sapiens
uuacagcuuaaaguaugc

SEQ ID NO: 2020703 - RNA, 17 nt, Homo sapiens
uaacccaggaaugaaga

SEQ ID NO: 2020704 - RNA, 23 nt, Homo sapiens
ugccugggagaguggaccugugc

SEQ ID NO: 2020705 - RNA, 22 nt, Homo sapiens
aaaagcagugggcuccuggcag

SEQ ID NO: 2020706 - RNA, 13 nt, Homo sapiens
accgcgaggccua

SEQ ID NO: 2020707 - RNA, 18 nt, Homo sapiens
cccacuguguuuugcuca

SEQ ID NO: 2020708 - RNA, 17 nt, Homo sapiens
cagucacccuucugggc

SEQ ID NO: 2020709 - RNA, 18 nt, Homo sapiens
cacuuaauaauuuuuacc

SEQ ID NO: 2020710 - RNA, 13 nt, Homo sapiens
uucaguaugcaaa

SEQ ID NO: 2020711 - RNA, 13 nt, Homo sapiens
gaaggcaaaaaga

SEQ ID NO: 2020712 - RNA, 15 nt, Homo sapiens
agucaacauaugcaa

SEQ ID NO: 2020713 - RNA, 18 nt, Homo sapiens
ggcugucggugugcuguc

SEQ ID NO: 2020714 - RNA, 16 nt, Homo sapiens
aaugaacuacugcuau

SEQ ID NO: 2020715 - RNA, 20 nt, Homo sapiens
caagaagcguuaugugcagu

SEQ ID NO: 2020716 - RNA, 22 nt, Homo sapiens
aaagucacccagggacacucca

SEQ ID NO: 2020717 - RNA, 18 nt, Homo sapiens
caaauacuuagcaaaaag

SEQ ID NO: 2020718 - RNA, 22 nt, Homo sapiens
accuuauuaaugaucagcuaua

SEQ ID NO: 2020719 - RNA, 16 nt, Homo sapiens
uuaaucaucaguuccu

SEQ ID NO: 2020720 - RNA, 19 nt, Homo sapiens
aggccucuuuuccugaaga

SEQ ID NO: 2020721 - RNA, 22 nt, Homo sapiens
uagcugucauggugcaauuugu

SEQ ID NO: 2020722 - RNA, 16 nt, Homo sapiens
cagcccacguucucuc

SEQ ID NO: 2020723 - RNA, 20 nt, Homo sapiens
cuucaaauguuuaaaccacu

SEQ ID NO: 2020724 - RNA, 13 nt, Homo sapiens
cucugggcagcug

SEQ ID NO: 2020725 - RNA, 12 nt, Homo sapiens
aguucauugugg

SEQ ID NO: 2020726 - RNA, 21 nt, Homo sapiens
agggucccauuucucacugag

SEQ ID NO: 2020727 - RNA, 22 nt, Homo sapiens
ccuccaggauagacuuuuccca

SEQ ID NO: 2020728 - RNA, 18 nt, Homo sapiens
caucuucaggcccagcca

SEQ ID NO: 2020729 - RNA, 22 nt, Homo sapiens
ugaggaauucuguauagauuag

SEQ ID NO: 2020730 - RNA, 15 nt, Homo sapiens
cauggccgcugccca

SEQ ID NO: 2020731 - RNA, 14 nt, Homo sapiens
aagugacaugccau

SEQ ID NO: 2020732 - RNA, 19 nt, Homo sapiens
gucacaccugacaaaugga

SEQ ID NO: 2020733 - RNA, 20 nt, Homo sapiens
gugccagggcccaccccagc

SEQ ID NO: 2020734 - RNA, 15 nt, Homo sapiens
cugcaccccugaugu

SEQ ID NO: 2020735 - RNA, 12 nt, Homo sapiens
acagacgugugc

SEQ ID NO: 2020736 - RNA, 14 nt, Homo sapiens
auaaagcguccucu

SEQ ID NO: 2020737 - RNA, 13 nt, Homo sapiens
gagagccaaacag

SEQ ID NO: 2020738 - RNA, 18 nt, Homo sapiens
gagcaggcucagacucug

SEQ ID NO: 2020739 - RNA, 21 nt, Homo sapiens
ccuucuugaguugaagaucuu

SEQ ID NO: 2020740 - RNA, 13 nt, Homo sapiens
ucaucagccuuuu

SEQ ID NO: 2020741 - RNA, 21 nt, Homo sapiens
uacaauuaugucucuugagca

SEQ ID NO: 2020742 - RNA, 17 nt, Homo sapiens
auacugauuacagaugu

SEQ ID NO: 2020743 - RNA, 13 nt, Homo sapiens
aacauuugccaag

SEQ ID NO: 2020744 - RNA, 20 nt, Homo sapiens
aucaggaccuccaagccacu

SEQ ID NO: 2020745 - RNA, 17 nt, Homo sapiens
cagucacauuccaagcc

SEQ ID NO: 2020746 - RNA, 17 nt, Homo sapiens
acuauuaagagcaauaa

SEQ ID NO: 2020747 - RNA, 22 nt, Homo sapiens
uggauaauuuucauagcugccu

SEQ ID NO: 2020748 - RNA, 19 nt, Homo sapiens
ugacucuagcaaggcucau

SEQ ID NO: 2020749 - RNA, 18 nt, Homo sapiens
ggccaagaaaauugccuu

SEQ ID NO: 2020750 - RNA, 22 nt, Homo sapiens
gagaacaacaggcaggggccca

SEQ ID NO: 2020751 - RNA, 21 nt, Homo sapiens
ggguugcugguccugcacaug

SEQ ID NO: 2020752 - RNA, 17 nt, Homo sapiens
cauugauaaucuucagg

SEQ ID NO: 2020753 - RNA, 15 nt, Homo sapiens
uuguauuaccauuac

SEQ ID NO: 2020754 - RNA, 19 nt, Homo sapiens
uuaauuuuuuuuacuauaa

SEQ ID NO: 2020755 - RNA, 20 nt, Homo sapiens
cgugagugacauagccucau

SEQ ID NO: 2020756 - RNA, 23 nt, Homo sapiens
gacuuccccacugcucucugugg

SEQ ID NO: 2020757 - RNA, 18 nt, Homo sapiens
aauucauggaacuuucau

SEQ ID NO: 2020758 - RNA, 19 nt, Homo sapiens
uacaggugaaggcucucac

SEQ ID NO: 2020759 - RNA, 18 nt, Homo sapiens
uaaauggcauaccaaaau

SEQ ID NO: 2020760 - RNA, 18 nt, Homo sapiens
uguaaucccaguacuugg

SEQ ID NO: 2020761 - RNA, 17 nt, Homo sapiens
cuguccugaucugugau

SEQ ID NO: 2020762 - RNA, 18 nt, Homo sapiens
acuagaccuguaacuuuu

SEQ ID NO: 2020763 - RNA, 23 nt, Homo sapiens
gggcaacauagugagauucuguu

SEQ ID NO: 2020764 - RNA, 19 nt, Homo sapiens
ucugaugaaaacaaaauca

SEQ ID NO: 2020765 - RNA, 18 nt, Homo sapiens
ccuuuucuauuuaccucc

SEQ ID NO: 2020766 - RNA, 11 nt, Homo sapiens
agaggcucagc

SEQ ID NO: 2020767 - RNA, 18 nt, Homo sapiens
uagcagagggaucaagca

SEQ ID NO: 2020768 - RNA, 14 nt, Homo sapiens
uacugaguaugugg

SEQ ID NO: 2020769 - RNA, 16 nt, Homo sapiens
cccagcagugccuugu

SEQ ID NO: 2020770 - RNA, 20 nt, Homo sapiens
auuuaaaaaaacgagcaauu

SEQ ID NO: 2020771 - RNA, 18 nt, Homo sapiens
acugcagcuaacuuauca

SEQ ID NO: 2020772 - RNA, 14 nt, Homo sapiens
cgcaggguggagau

SEQ ID NO: 2020773 - RNA, 14 nt, Homo sapiens
uguccuguccugcu

SEQ ID NO: 2020774 - RNA, 17 nt, Homo sapiens
gugacaagccaauguga

SEQ ID NO: 2020775 - RNA, 11 nt, Homo sapiens
acagugcagua

SEQ ID NO: 2020776 - RNA, 15 nt, Homo sapiens
cuuuacguacuguaa

SEQ ID NO: 2020777 - RNA, 17 nt, Homo sapiens
aacagaucgagucacaa

SEQ ID NO: 2020778 - RNA, 16 nt, Homo sapiens
gaugacaacaaucuca

SEQ ID NO: 2020779 - RNA, 22 nt, Homo sapiens
ccugcucccuagccagaggcuc

SEQ ID NO: 2020780 - RNA, 17 nt, Homo sapiens
ugcuggugacucaugcc

SEQ ID NO: 2020781 - RNA, 23 nt, Homo sapiens
cuuauuuaagaucacagugaacu

SEQ ID NO: 2020782 - RNA, 12 nt, Homo sapiens
ccacgucucucu

SEQ ID NO: 2020783 - RNA, 14 nt, Homo sapiens
aacagccuuuuccc

SEQ ID NO: 2020784 - RNA, 22 nt, Homo sapiens
gcacugcggcugucuccuugaa

SEQ ID NO: 2020785 - RNA, 11 nt, Homo sapiens
caaaugcauga

SEQ ID NO: 2020786 - RNA, 11 nt, Homo sapiens
ugcaugcacac

SEQ ID NO: 2020787 - RNA, 14 nt, Homo sapiens
ucuggacacagccc

SEQ ID NO: 2020788 - RNA, 16 nt, Homo sapiens
aaucagccacauucua

SEQ ID NO: 2020789 - RNA, 21 nt, Homo sapiens
ugauggaagaugguccgugcc

SEQ ID NO: 2020790 - RNA, 18 nt, Homo sapiens
uuagcuccaaaccuucac

SEQ ID NO: 2020791 - RNA, 15 nt, Homo sapiens
agcuucacauuugcg

SEQ ID NO: 2020792 - RNA, 14 nt, Homo sapiens
gccgggcucagugg

SEQ ID NO: 2020793 - RNA, 17 nt, Homo sapiens
guaaauaaagacauuca

SEQ ID NO: 2020794 - RNA, 21 nt, Homo sapiens
ugaagaugccagugaaacuuc

SEQ ID NO: 2020795 - RNA, 14 nt, Homo sapiens
acaagagaugggau

SEQ ID NO: 2020796 - RNA, 20 nt, Homo sapiens
uugugauaaauuugauccca

SEQ ID NO: 2020797 - RNA, 16 nt, Homo sapiens
ugggaaggaaggcagu

SEQ ID NO: 2020798 - RNA, 15 nt, Homo sapiens
cugugcuaguuuuac

SEQ ID NO: 2020799 - RNA, 12 nt, Homo sapiens
cuuucuaccuga

SEQ ID NO: 2020800 - RNA, 14 nt, Homo sapiens
uaaacuaguacuau

SEQ ID NO: 2020801 - RNA, 22 nt, Homo sapiens
augugcuauuaagagcacguau

SEQ ID NO: 2020802 - RNA, 19 nt, Homo sapiens
acucagaucacuacugcag

SEQ ID NO: 2020803 - RNA, 18 nt, Homo sapiens
aucagccugucucuucca

SEQ ID NO: 2020804 - RNA, 14 nt, Homo sapiens
ugacuucucacuuc

SEQ ID NO: 2020805 - RNA, 18 nt, Homo sapiens
auauauuugaaauaguau

SEQ ID NO: 2020806 - RNA, 15 nt, Homo sapiens
gcccccacccagucc

SEQ ID NO: 2020807 - RNA, 15 nt, Homo sapiens
aacucaguuccaaag

SEQ ID NO: 2020808 - RNA, 18 nt, Homo sapiens
cauaaagccuuggaugua

SEQ ID NO: 2020809 - RNA, 16 nt, Homo sapiens
ccugaugcccagguca

SEQ ID NO: 2020810 - RNA, 16 nt, Homo sapiens
cccugugucugucaca

SEQ ID NO: 2020811 - RNA, 11 nt, Homo sapiens
uaaagccaguu

SEQ ID NO: 2020812 - RNA, 18 nt, Homo sapiens
cagcuauaccugcacguu

SEQ ID NO: 2020813 - RNA, 22 nt, Homo sapiens
cagcagaaucggcuuugcagug

SEQ ID NO: 2020814 - RNA, 12 nt, Homo sapiens
cccacagaugau

SEQ ID NO: 2020815 - RNA, 22 nt, Homo sapiens
uuuuuacaucuaucccagagua

SEQ ID NO: 2020816 - RNA, 19 nt, Homo sapiens
ccacucaggcccaaagccu

SEQ ID NO: 2020817 - RNA, 21 nt, Homo sapiens
ccugugaacugaacucugaca

SEQ ID NO: 2020818 - RNA, 12 nt, Homo sapiens
acauuaucucac

SEQ ID NO: 2020819 - RNA, 22 nt, Homo sapiens
cacaauguggauuuggggacca

SEQ ID NO: 2020820 - RNA, 19 nt, Homo sapiens
gugggaacucacuuucccu

SEQ ID NO: 2020821 - RNA, 16 nt, Homo sapiens
uguagcaguacugaga

SEQ ID NO: 2020822 - RNA, 15 nt, Homo sapiens
cucuauaacagaucc

SEQ ID NO: 2020823 - RNA, 21 nt, Homo sapiens
cagcagaagccuccaagcaca

SEQ ID NO: 2020824 - RNA, 18 nt, Homo sapiens
aucccguaccucuuccca

SEQ ID NO: 2020825 - RNA, 22 nt, Homo sapiens
gcagauugcaguucugauucau

SEQ ID NO: 2020826 - RNA, 14 nt, Homo sapiens
cagcugucugucau

SEQ ID NO: 2020827 - RNA, 19 nt, Homo sapiens
aauggaugugcucacuggg

SEQ ID NO: 2020828 - RNA, 11 nt, Homo sapiens
acccucagggc

SEQ ID NO: 2020829 - RNA, 14 nt, Homo sapiens
ccaaacucaccugc

SEQ ID NO: 2020830 - RNA, 15 nt, Homo sapiens
gaaguggcaccuaau

SEQ ID NO: 2020831 - RNA, 19 nt, Homo sapiens
uuuuguugaaauagcuuua

SEQ ID NO: 2020832 - RNA, 15 nt, Homo sapiens
cacggacuguccacc

SEQ ID NO: 2020833 - RNA, 16 nt, Homo sapiens
aauaaaaguacugaag

SEQ ID NO: 2020834 - RNA, 16 nt, Homo sapiens
uguaagaaauacugua

SEQ ID NO: 2020835 - RNA, 19 nt, Homo sapiens
aagaaaaaaggccuugaau

SEQ ID NO: 2020836 - RNA, 16 nt, Homo sapiens
cccuaaucacaugugc

SEQ ID NO: 2020837 - RNA, 14 nt, Homo sapiens
uucacucagcacuu

SEQ ID NO: 2020838 - RNA, 14 nt, Homo sapiens
acauauaucugaug

SEQ ID NO: 2020839 - RNA, 16 nt, Homo sapiens
gccuuuccccagugug

SEQ ID NO: 2020840 - RNA, 14 nt, Homo sapiens
ugaauucuggaauc

SEQ ID NO: 2020841 - RNA, 23 nt, Homo sapiens
agaagcugcauguuaagugccau

SEQ ID NO: 2020842 - RNA, 12 nt, Homo sapiens
ggcuaaaguaaa

SEQ ID NO: 2020843 - RNA, 14 nt, Homo sapiens
gugaguucucaggg

SEQ ID NO: 2020844 - RNA, 17 nt, Homo sapiens
cuucccagagggagcag

SEQ ID NO: 2020845 - RNA, 14 nt, Homo sapiens
aacagaaguaucaa

SEQ ID NO: 2020846 - RNA, 15 nt, Homo sapiens
ucagaaacaaagcau

SEQ ID NO: 2020847 - RNA, 18 nt, Homo sapiens
acagaacccuccaccccu

SEQ ID NO: 2020848 - RNA, 23 nt, Homo sapiens
cccccuuccuguccccaggggag

SEQ ID NO: 2020849 - RNA, 15 nt, Homo sapiens
acuuuggaacacuac

SEQ ID NO: 2020850 - RNA, 13 nt, Homo sapiens
acccaagccugau

SEQ ID NO: 2020851 - RNA, 23 nt, Homo sapiens
gcuuuugaaauccagaaguuuua

SEQ ID NO: 2020852 - RNA, 10 nt, Homo sapiens
uggagccagg

SEQ ID NO: 2020853 - RNA, 12 nt, Homo sapiens
cugauauuuuag

SEQ ID NO: 2020854 - RNA, 18 nt, Homo sapiens
uaccccuguuaagcaauu

SEQ ID NO: 2020855 - RNA, 17 nt, Homo sapiens
ggauucaucagcauuug

SEQ ID NO: 2020856 - RNA, 21 nt, Homo sapiens
cccacgcuaguuccauccacg

SEQ ID NO: 2020857 - RNA, 15 nt, Homo sapiens
gaaauguucucauga

SEQ ID NO: 2020858 - RNA, 20 nt, Homo sapiens
gaauuuguauuaaaaagccu

SEQ ID NO: 2020859 - RNA, 21 nt, Homo sapiens
caucgcagcuucagcaucucc

SEQ ID NO: 2020860 - RNA, 18 nt, Homo sapiens
caguaaauccucauuuga

SEQ ID NO: 2020861 - RNA, 15 nt, Homo sapiens
ggaguuagaggccag

SEQ ID NO: 2020862 - RNA, 18 nt, Homo sapiens
caucacuugccaauguac

SEQ ID NO: 2020863 - RNA, 18 nt, Homo sapiens
ggaaacaagucagucauu

SEQ ID NO: 2020864 - RNA, 15 nt, Homo sapiens
aggcggaucuuugga

SEQ ID NO: 2020865 - RNA, 15 nt, Homo sapiens
cuugcuucugcugua

SEQ ID NO: 2020866 - RNA, 22 nt, Homo sapiens
acaagaguuucaaaacauacaa

SEQ ID NO: 2020867 - RNA, 16 nt, Homo sapiens
ugucaccuugaugacu

SEQ ID NO: 2020868 - RNA, 23 nt, Homo sapiens
aauugucagaucguucauugccu

SEQ ID NO: 2020869 - RNA, 21 nt, Homo sapiens
ccaagcaaaccaauggugauc

SEQ ID NO: 2020870 - RNA, 13 nt, Homo sapiens
uugcugaugguga

SEQ ID NO: 2020871 - RNA, 15 nt, Homo sapiens
auguuacugccuuaa

SEQ ID NO: 2020872 - RNA, 18 nt, Homo sapiens
cagauagugccucugcaa

SEQ ID NO: 2020873 - RNA, 23 nt, Homo sapiens
gcccagagagggaagaugaccug

SEQ ID NO: 2020874 - RNA, 22 nt, Homo sapiens
gaauaaucuaaauucauacuca

SEQ ID NO: 2020875 - RNA, 15 nt, Homo sapiens
ggcauuguguucacu

SEQ ID NO: 2020876 - RNA, 19 nt, Homo sapiens
cuggguggccucgggacac

SEQ ID NO: 2020877 - RNA, 19 nt, Homo sapiens
uacuuuuuuauagcuuaac

SEQ ID NO: 2020878 - RNA, 21 nt, Homo sapiens
uuacaguucguccugacuaca

SEQ ID NO: 2020879 - RNA, 16 nt, Homo sapiens
ucuugcuucagaccau

SEQ ID NO: 2020880 - RNA, 23 nt, Homo sapiens
aacuccuuucuuaucuugaccau

SEQ ID NO: 2020881 - RNA, 20 nt, Homo sapiens
uucauauguaccauguacau

SEQ ID NO: 2020882 - RNA, 13 nt, Homo sapiens
ucacagaugggca

SEQ ID NO: 2020883 - RNA, 22 nt, Homo sapiens
acugagccccgcagaccucccc

SEQ ID NO: 2020884 - RNA, 17 nt, Homo sapiens
cuaccccuuucuucucg

SEQ ID NO: 2020885 - RNA, 18 nt, Homo sapiens
accagagaauggacacca

SEQ ID NO: 2020886 - RNA, 14 nt, Homo sapiens
augcuguacaugac

SEQ ID NO: 2020887 - RNA, 21 nt, Homo sapiens
uugaccuguuucaccaguguu

SEQ ID NO: 2020888 - RNA, 12 nt, Homo sapiens
uuaauguucaca

SEQ ID NO: 2020889 - RNA, 15 nt, Homo sapiens
ccaucaagugcaguc

SEQ ID NO: 2020890 - RNA, 21 nt, Homo sapiens
gcccagggagguggcagggaa

SEQ ID NO: 2020891 - RNA, 16 nt, Homo sapiens
cuucuuaacagacuca

SEQ ID NO: 2020892 - RNA, 18 nt, Homo sapiens
agauuacuccuuccuucc

SEQ ID NO: 2020893 - RNA, 20 nt, Homo sapiens
acaagugguuaaaacauagc

SEQ ID NO: 2020894 - RNA, 15 nt, Homo sapiens
uacccugaucaccuc

SEQ ID NO: 2020895 - RNA, 11 nt, Homo sapiens
gaugacauuuc

SEQ ID NO: 2020896 - RNA, 20 nt, Homo sapiens
auuuacacuacauuguacaa

SEQ ID NO: 2020897 - RNA, 17 nt, Homo sapiens
acagggcugguguggcu

SEQ ID NO: 2020898 - RNA, 21 nt, Homo sapiens
cuucgaaaaucuagaggaaaa

SEQ ID NO: 2020899 - RNA, 14 nt, Homo sapiens
caguuuaaucuuuu

SEQ ID NO: 2020900 - RNA, 17 nt, Homo sapiens
uuguaccugacuuccac

SEQ ID NO: 2020901 - RNA, 17 nt, Homo sapiens
ggggagacuucuuggcu

SEQ ID NO: 2020902 - RNA, 20 nt, Homo sapiens
uacuuuuauaauaaaaggaa

SEQ ID NO: 2020903 - RNA, 12 nt, Homo sapiens
auuuucuugaug

SEQ ID NO: 2020904 - RNA, 23 nt, Homo sapiens
aauugccugccauggcugugaca

SEQ ID NO: 2020905 - RNA, 21 nt, Homo sapiens
cuugcaguaucggcacuguac

SEQ ID NO: 2020906 - RNA, 16 nt, Homo sapiens
ccgugcuuaaccaaag

SEQ ID NO: 2020907 - RNA, 23 nt, Homo sapiens
auuaagcauguuuuguugcucag

SEQ ID NO: 2020908 - RNA, 17 nt, Homo sapiens
agaucccagaguuauuu

SEQ ID NO: 2020909 - RNA, 20 nt, Homo sapiens
guuauuugcacacugcacug

SEQ ID NO: 2020910 - RNA, 19 nt, Homo sapiens
cagcuucuugcacuccuuc

SEQ ID NO: 2020911 - RNA, 15 nt, Homo sapiens
uugccgcugggagag

SEQ ID NO: 2020912 - RNA, 16 nt, Homo sapiens
ccuguuacacaugaca

SEQ ID NO: 2020913 - RNA, 18 nt, Homo sapiens
ccccgcuucuccugguca

SEQ ID NO: 2020914 - RNA, 12 nt, Homo sapiens
auguucuaguua

SEQ ID NO: 2020915 - RNA, 15 nt, Homo sapiens
caaucagaugccuca

SEQ ID NO: 2020916 - RNA, 17 nt, Homo sapiens
ucugccucuauucaauu

SEQ ID NO: 2020917 - RNA, 14 nt, Homo sapiens
cugccauuuaccag

SEQ ID NO: 2020918 - RNA, 14 nt, Homo sapiens
ugcugggagugugg

SEQ ID NO: 2020919 - RNA, 17 nt, Homo sapiens
uuccuaucccaucccau

SEQ ID NO: 2020920 - RNA, 21 nt, Homo sapiens
cuuuucuggcaaaaaggagcc

SEQ ID NO: 2020921 - RNA, 21 nt, Homo sapiens
acucacagccguccaacuuaa

SEQ ID NO: 2020922 - RNA, 12 nt, Homo sapiens
cuauuuccagag

SEQ ID NO: 2020923 - RNA, 14 nt, Homo sapiens
gcacucacaggcua

SEQ ID NO: 2020924 - RNA, 21 nt, Homo sapiens
ucccgacagcccaucaccucu

SEQ ID NO: 2020925 - RNA, 15 nt, Homo sapiens
ucaguguugacauag

SEQ ID NO: 2020926 - RNA, 19 nt, Homo sapiens
gaagacagaaccacagggc

SEQ ID NO: 2020927 - RNA, 14 nt, Homo sapiens
ccaucgauuuguau

SEQ ID NO: 2020928 - RNA, 19 nt, Homo sapiens
gcagcucaaguuagcauuu

SEQ ID NO: 2020929 - RNA, 20 nt, Homo sapiens
ccucaguuuuaucauuuuca

SEQ ID NO: 2020930 - RNA, 17 nt, Homo sapiens
ggcugagagaguggcau

SEQ ID NO: 2020931 - RNA, 23 nt, Homo sapiens
ccauguguguguacaacacuggu

SEQ ID NO: 2020932 - RNA, 17 nt, Homo sapiens
gauacuugccaaaauga

SEQ ID NO: 2020933 - RNA, 15 nt, Homo sapiens
ccagaacugccccca

SEQ ID NO: 2020934 - RNA, 17 nt, Homo sapiens
uuuauaugcacauuucu

SEQ ID NO: 2020935 - RNA, 15 nt, Homo sapiens
cucuaagcgugcuga

SEQ ID NO: 2020936 - RNA, 22 nt, Homo sapiens
uugccuggggccacauagcuca

SEQ ID NO: 2020937 - RNA, 21 nt, Homo sapiens
cagcuuuucccaagaugucaa

SEQ ID NO: 2020938 - RNA, 15 nt, Homo sapiens
aagagguugaagcua

SEQ ID NO: 2020939 - RNA, 17 nt, Homo sapiens
uggaaaggaaugcaaag

SEQ ID NO: 2020940 - RNA, 19 nt, Homo sapiens
aaaauucucuuaaucacua

SEQ ID NO: 2020941 - RNA, 23 nt, Homo sapiens
ucugcuggaaacagacucgauuc

SEQ ID NO: 2020942 - RNA, 20 nt, Homo sapiens
uacaaugacaaguaugauga

SEQ ID NO: 2020943 - RNA, 15 nt, Homo sapiens
auuacaaccauauau

SEQ ID NO: 2020944 - RNA, 15 nt, Homo sapiens
auaauaaccaaacau

SEQ ID NO: 2020945 - RNA, 15 nt, Homo sapiens
acaagccacuaccuu

SEQ ID NO: 2020946 - RNA, 22 nt, Homo sapiens
aauccuacuuuucgaacaccaa

SEQ ID NO: 2020947 - RNA, 17 nt, Homo sapiens
gccuccuaaagugcuga

SEQ ID NO: 2020948 - RNA, 23 nt, Homo sapiens
ggagggguuuuggugauacccaa

SEQ ID NO: 2020949 - RNA, 18 nt, Homo sapiens
aaauagagugcauuugaa

SEQ ID NO: 2020950 - RNA, 15 nt, Homo sapiens
ugguacaaguuuaca

SEQ ID NO: 2020951 - RNA, 14 nt, Homo sapiens
uuugcuuugcucuc

SEQ ID NO: 2020952 - RNA, 13 nt, Homo sapiens
aaucccaaccauc

SEQ ID NO: 2020953 - RNA, 18 nt, Homo sapiens
acauguaaugacacuucu

SEQ ID NO: 2020954 - RNA, 21 nt, Homo sapiens
ccuguaucagcacuccucauc

SEQ ID NO: 2020955 - RNA, 15 nt, Homo sapiens
auauuaaaagaacuc

SEQ ID NO: 2020956 - RNA, 14 nt, Homo sapiens
aaucaaagccaggg

SEQ ID NO: 2020957 - RNA, 19 nt, Homo sapiens
aaccuggagccugaauaca

SEQ ID NO: 2020958 - RNA, 18 nt, Homo sapiens
uuguacaauuacugugag

SEQ ID NO: 2020959 - RNA, 23 nt, Homo sapiens
gaaauucuucccuggggguccca

SEQ ID NO: 2020960 - RNA, 18 nt, Homo sapiens
uagaaagcugcugugauc

SEQ ID NO: 2020961 - RNA, 15 nt, Homo sapiens
agaagacacagggga

SEQ ID NO: 2020962 - RNA, 21 nt, Homo sapiens
cauaaauccccaaacccugaa

SEQ ID NO: 2020963 - RNA, 21 nt, Homo sapiens
ugagcccccugaccuuccaaa

SEQ ID NO: 2020964 - RNA, 15 nt, Homo sapiens
gaacgaguuguuggc

SEQ ID NO: 2020965 - RNA, 16 nt, Homo sapiens
ggucuuuucaugugca

SEQ ID NO: 2020966 - RNA, 15 nt, Homo sapiens
ccaccuaugugccaa

SEQ ID NO: 2020967 - RNA, 18 nt, Homo sapiens
agccuccugaucaggaaa

SEQ ID NO: 2020968 - RNA, 22 nt, Homo sapiens
caaacugaaugacuugacuuca

SEQ ID NO: 2020969 - RNA, 17 nt, Homo sapiens
uuugaaauaaugacaua

SEQ ID NO: 2020970 - RNA, 12 nt, Homo sapiens
cccuuaaguuca

SEQ ID NO: 2020971 - RNA, 17 nt, Homo sapiens
aggcucaggccauggcu

SEQ ID NO: 2020972 - RNA, 19 nt, Homo sapiens
aacauuucuuaaacacaaa

SEQ ID NO: 2020973 - RNA, 21 nt, Homo sapiens
agauguuuaaauaaauuguga

SEQ ID NO: 2020974 - RNA, 21 nt, Homo sapiens
cauuuuguugcuuuugugaac

SEQ ID NO: 2020975 - RNA, 18 nt, Homo sapiens
augaaaaagucagcuaca

SEQ ID NO: 2020976 - RNA, 17 nt, Homo sapiens
ucacugucuugccagau

SEQ ID NO: 2020977 - RNA, 17 nt, Homo sapiens
ucugggaacccugugca

SEQ ID NO: 2020978 - RNA, 17 nt, Homo sapiens
auuuuucuuuccaaguc

SEQ ID NO: 2020979 - RNA, 20 nt, Homo sapiens
uuguccuugaagcuuguauc

SEQ ID NO: 2020980 - RNA, 16 nt, Homo sapiens
auggucacagagagac

SEQ ID NO: 2020981 - RNA, 19 nt, Homo sapiens
uccuguguuccugugaucu

SEQ ID NO: 2020982 - RNA, 15 nt, Homo sapiens
uguaauaaaucugag

SEQ ID NO: 2020983 - RNA, 13 nt, Homo sapiens
auuuaugugcacu

SEQ ID NO: 2020984 - RNA, 13 nt, Homo sapiens
auuuuugugcaca

SEQ ID NO: 2020985 - RNA, 16 nt, Homo sapiens
cagggucucucccuca

SEQ ID NO: 2020986 - RNA, 17 nt, Homo sapiens
uucccucuuuucuuacu

SEQ ID NO: 2020987 - RNA, 15 nt, Homo sapiens
acccaucugcucacc

SEQ ID NO: 2020988 - RNA, 13 nt, Homo sapiens
agagcagaaccaa

SEQ ID NO: 2020989 - RNA, 16 nt, Homo sapiens
aauugaucgacuugcc

SEQ ID NO: 2020990 - RNA, 18 nt, Homo sapiens
agcugggauuacaggugu

SEQ ID NO: 2020991 - RNA, 16 nt, Homo sapiens
caguuuucuugcagau

SEQ ID NO: 2020992 - RNA, 17 nt, Homo sapiens
uugaaagcccaaggugc

SEQ ID NO: 2020993 - RNA, 10 nt, Homo sapiens
gaagugcucu

SEQ ID NO: 2020994 - RNA, 20 nt, Homo sapiens
uuuucuaaagggaucugcuu

SEQ ID NO: 2020995 - RNA, 18 nt, Homo sapiens
acaaagccuuauccagca

SEQ ID NO: 2020996 - RNA, 21 nt, Homo sapiens
cuauggacagcauugccagua

SEQ ID NO: 2020997 - RNA, 13 nt, Homo sapiens
cagcucaagggag

SEQ ID NO: 2020998 - RNA, 12 nt, Homo sapiens
uucccacaaaga

SEQ ID NO: 2020999 - RNA, 17 nt, Homo sapiens
ucuaagccuuuccauaa

SEQ ID NO: 2021000 - RNA, 15 nt, Homo sapiens
agugagccacuagcu

SEQ ID NO: 2021001 - RNA, 18 nt, Homo sapiens
uauuugugggugugcuau

SEQ ID NO: 2021002 - RNA, 19 nt, Homo sapiens
acaaugaggcugcuuauga

SEQ ID NO: 2021003 - RNA, 19 nt, Homo sapiens
gggaacccagcccuggggu

SEQ ID NO: 2021004 - RNA, 12 nt, Homo sapiens
uguuuacagggg

SEQ ID NO: 2021005 - RNA, 23 nt, Homo sapiens
aagguuuugaaaucccaucaggu

SEQ ID NO: 2021006 - RNA, 17 nt, Homo sapiens
cuacugccccucuccga

SEQ ID NO: 2021007 - RNA, 17 nt, Homo sapiens
cucaguucgaccaaacu

SEQ ID NO: 2021008 - RNA, 11 nt, Homo sapiens
uccucuuucac

SEQ ID NO: 2021009 - RNA, 17 nt, Homo sapiens
ggacccuggaaauggac

SEQ ID NO: 2021010 - RNA, 23 nt, Homo sapiens
ugaaauacuauuuaaagccuccu

SEQ ID NO: 2021011 - RNA, 15 nt, Homo sapiens
gcuggaugauggucu

SEQ ID NO: 2021012 - RNA, 19 nt, Homo sapiens
agugcuuuuacuaucugug

SEQ ID NO: 2021013 - RNA, 14 nt, Homo sapiens
augcauuacugcau

SEQ ID NO: 2021014 - RNA, 14 nt, Homo sapiens
auuaaguacuuaag

SEQ ID NO: 2021015 - RNA, 14 nt, Homo sapiens
uucuaacaguacca

SEQ ID NO: 2021016 - RNA, 13 nt, Homo sapiens
ucccccgcuguaa

SEQ ID NO: 2021017 - RNA, 22 nt, Homo sapiens
gccugggaugauguuggucaaa

SEQ ID NO: 2021018 - RNA, 23 nt, Homo sapiens
cccuccccaacaccccacugagc

SEQ ID NO: 2021019 - RNA, 22 nt, Homo sapiens
gucuugaagugaucauuucaca

SEQ ID NO: 2021020 - RNA, 15 nt, Homo sapiens
ggauagggaaagggu

SEQ ID NO: 2021021 - RNA, 19 nt, Homo sapiens
ugcugcgcguggugcugag

SEQ ID NO: 2021022 - RNA, 20 nt, Homo sapiens
agcugugcucagcacaggcc

SEQ ID NO: 2021023 - RNA, 20 nt, Homo sapiens
accaguugugauacaauaaa

SEQ ID NO: 2021024 - RNA, 18 nt, Homo sapiens
aauaaacuuacauauuua

SEQ ID NO: 2021025 - RNA, 14 nt, Homo sapiens
caaggggucacuua

SEQ ID NO: 2021026 - RNA, 14 nt, Homo sapiens
ugcugugacuuccu

SEQ ID NO: 2021027 - RNA, 16 nt, Homo sapiens
ccaaaucccagggaag

SEQ ID NO: 2021028 - RNA, 14 nt, Homo sapiens
augaagaaucugcu

SEQ ID NO: 2021029 - RNA, 14 nt, Homo sapiens
aagaugaucaucuc

SEQ ID NO: 2021030 - RNA, 21 nt, Homo sapiens
gccagcaaugacaucucaggg

SEQ ID NO: 2021031 - RNA, 21 nt, Homo sapiens
ugccauuugggcuuauuuaga

SEQ ID NO: 2021032 - RNA, 20 nt, Homo sapiens
uugugaugaugcugugacaa

SEQ ID NO: 2021033 - RNA, 14 nt, Homo sapiens
ccuucaucuggaac

SEQ ID NO: 2021034 - RNA, 22 nt, Homo sapiens
cuuggcugcagccaucccgcuu

SEQ ID NO: 2021035 - RNA, 23 nt, Homo sapiens
cugcagagggcacagaaaaugga

SEQ ID NO: 2021036 - RNA, 18 nt, Homo sapiens
uucugguuuguaaggugg

SEQ ID NO: 2021037 - RNA, 14 nt, Homo sapiens
ugacucugacuuug

SEQ ID NO: 2021038 - RNA, 16 nt, Homo sapiens
gccagcagccucugau

SEQ ID NO: 2021039 - RNA, 15 nt, Homo sapiens
caggcuuacugagcu

SEQ ID NO: 2021040 - RNA, 20 nt, Homo sapiens
aauggaaauuccaacagauu

SEQ ID NO: 2021041 - RNA, 15 nt, Homo sapiens
caauuagcauuccau

SEQ ID NO: 2021042 - RNA, 21 nt, Homo sapiens
gcaagaaguugaaaaacaguu

SEQ ID NO: 2021043 - RNA, 20 nt, Homo sapiens
ucuauugucuacuugcgauu

SEQ ID NO: 2021044 - RNA, 18 nt, Homo sapiens
aaauucugaugagcauua

SEQ ID NO: 2021045 - RNA, 16 nt, Homo sapiens
ugggagagacugugag

SEQ ID NO: 2021046 - RNA, 22 nt, Homo sapiens
cugggccccaccaccuaggcca

SEQ ID NO: 2021047 - RNA, 21 nt, Homo sapiens
caaccaaagggggacagugau

SEQ ID NO: 2021048 - RNA, 17 nt, Homo sapiens
cacaaccagccacacag

SEQ ID NO: 2021049 - RNA, 23 nt, Homo sapiens
aaggaaacuggguuccugcaaug

SEQ ID NO: 2021050 - RNA, 20 nt, Homo sapiens
ggcuaagaaauagacaguca

SEQ ID NO: 2021051 - RNA, 18 nt, Homo sapiens
aaugauuuuaucugugaa

SEQ ID NO: 2021052 - RNA, 20 nt, Homo sapiens
ugacaaaagcagcacaagga

SEQ ID NO: 2021053 - RNA, 18 nt, Homo sapiens
gucuuguagaaaucucag

SEQ ID NO: 2021054 - RNA, 23 nt, Homo sapiens
ugcaagcuaaagccccucuauac

SEQ ID NO: 2021055 - RNA, 21 nt, Homo sapiens
gaugcacucucagaccaagca

SEQ ID NO: 2021056 - RNA, 17 nt, Homo sapiens
ucuguaauacauaucau

SEQ ID NO: 2021057 - RNA, 23 nt, Homo sapiens
gcagagagggucacugggggaca

SEQ ID NO: 2021058 - RNA, 17 nt, Homo sapiens
aucuucacagcacauuu

SEQ ID NO: 2021059 - RNA, 19 nt, Homo sapiens
cuguuucaucucagcuuuu

SEQ ID NO: 2021060 - RNA, 20 nt, Homo sapiens
gcagaauguuguacuugaaa

SEQ ID NO: 2021061 - RNA, 20 nt, Homo sapiens
uucuccagaaggcaauacca

SEQ ID NO: 2021062 - RNA, 13 nt, Homo sapiens
guucacaugccac

SEQ ID NO: 2021063 - RNA, 16 nt, Homo sapiens
uacaauacaguacuca

SEQ ID NO: 2021064 - RNA, 23 nt, Homo sapiens
guggugggcccugaugcugccag

SEQ ID NO: 2021065 - RNA, 17 nt, Homo sapiens
acacagagggccaguaa

SEQ ID NO: 2021066 - RNA, 14 nt, Homo sapiens
uuaaaauagcaaaa

SEQ ID NO: 2021067 - RNA, 14 nt, Homo sapiens
uguggcugcaucuu

SEQ ID NO: 2021068 - RNA, 19 nt, Homo sapiens
agauguccucagaagucag

SEQ ID NO: 2021069 - RNA, 23 nt, Homo sapiens
acaauacugggguuggacuguaa

SEQ ID NO: 2021070 - RNA, 16 nt, Homo sapiens
aacugaaaaaugucag

SEQ ID NO: 2021071 - RNA, 15 nt, Homo sapiens
uaugaaguauauaau

SEQ ID NO: 2021072 - RNA, 23 nt, Homo sapiens
cauuuguauuguucauaauauca

SEQ ID NO: 2021073 - RNA, 13 nt, Homo sapiens
uggggacggugua

SEQ ID NO: 2021074 - RNA, 13 nt, Homo sapiens
ucaucuucuggaa

SEQ ID NO: 2021075 - RNA, 14 nt, Homo sapiens
uccccagcuaggaa

SEQ ID NO: 2021076 - RNA, 23 nt, Homo sapiens
uggaagaggaacagcacugggga

SEQ ID NO: 2021077 - RNA, 17 nt, Homo sapiens
ccugaccucgugaucua

SEQ ID NO: 2021078 - RNA, 14 nt, Homo sapiens
gugucuguguauau

SEQ ID NO: 2021079 - RNA, 14 nt, Homo sapiens
agccugagugucca

SEQ ID NO: 2021080 - RNA, 12 nt, Homo sapiens
gaaacauuucag

SEQ ID NO: 2021081 - RNA, 14 nt, Homo sapiens
uggcaacugcugau

SEQ ID NO: 2021082 - RNA, 22 nt, Homo sapiens
aaaauguuugaguauucugcau

SEQ ID NO: 2021083 - RNA, 18 nt, Homo sapiens
ugguaggaaauagaauga

SEQ ID NO: 2021084 - RNA, 12 nt, Homo sapiens
accuccugccuc

SEQ ID NO: 2021085 - RNA, 15 nt, Homo sapiens
aaaaauggaaauacc

SEQ ID NO: 2021086 - RNA, 17 nt, Homo sapiens
uuggaaauugggugugc

SEQ ID NO: 2021087 - RNA, 21 nt, Homo sapiens
ggaauugcagcuguacugagg

SEQ ID NO: 2021088 - RNA, 14 nt, Homo sapiens
ucaauuugaacuca

SEQ ID NO: 2021089 - RNA, 21 nt, Homo sapiens
uuuaaccaauaacuagcuucu

SEQ ID NO: 2021090 - RNA, 12 nt, Homo sapiens
ugguagaaccac

SEQ ID NO: 2021091 - RNA, 16 nt, Homo sapiens
aacccaggaguggaua

SEQ ID NO: 2021092 - RNA, 14 nt, Homo sapiens
uucagccccuccuc

SEQ ID NO: 2021093 - RNA, 19 nt, Homo sapiens
uuuaugugcaaaaucuguu

SEQ ID NO: 2021094 - RNA, 23 nt, Homo sapiens
ccaacaacaauguguuguaaaaa

SEQ ID NO: 2021095 - RNA, 14 nt, Homo sapiens
aggagcugcucagg

SEQ ID NO: 2021096 - RNA, 22 nt, Homo sapiens
agccacuugccugugcuacaau

SEQ ID NO: 2021097 - RNA, 19 nt, Homo sapiens
acuagagugcucugacccu

SEQ ID NO: 2021098 - RNA, 14 nt, Homo sapiens
caaucuucauuuaa

SEQ ID NO: 2021099 - RNA, 18 nt, Homo sapiens
ccuuucauuaggcaaagu

SEQ ID NO: 2021100 - RNA, 22 nt, Homo sapiens
aagaacucccuucuccccucag

SEQ ID NO: 2021101 - RNA, 23 nt, Homo sapiens
uuuucagaucauggcauccaaga

SEQ ID NO: 2021102 - RNA, 16 nt, Homo sapiens
ccccgcuaaggaagau

SEQ ID NO: 2021103 - RNA, 19 nt, Homo sapiens
aacaugaccaaaaaccaaa

SEQ ID NO: 2021104 - RNA, 23 nt, Homo sapiens
cagccacccugucaccuagcuca

SEQ ID NO: 2021105 - RNA, 14 nt, Homo sapiens
cauaaaaaaaugau

SEQ ID NO: 2021106 - RNA, 14 nt, Homo sapiens
cucugaaggguaau

SEQ ID NO: 2021107 - RNA, 14 nt, Homo sapiens
ucagauccuacccc

SEQ ID NO: 2021108 - RNA, 16 nt, Homo sapiens
cuggauuauugcuuag

SEQ ID NO: 2021109 - RNA, 13 nt, Homo sapiens
aucugucuguccu

SEQ ID NO: 2021110 - RNA, 19 nt, Homo sapiens
aucucugugguuacaagaa

SEQ ID NO: 2021111 - RNA, 16 nt, Homo sapiens
aauucuuuggaacuuu

SEQ ID NO: 2021112 - RNA, 14 nt, Homo sapiens
guacagacauauuu

SEQ ID NO: 2021113 - RNA, 16 nt, Homo sapiens
agcaggagauugagaa

SEQ ID NO: 2021114 - RNA, 13 nt, Homo sapiens
gucugcacucuaa

SEQ ID NO: 2021115 - RNA, 18 nt, Homo sapiens
acauacauauuaucucau

SEQ ID NO: 2021116 - RNA, 16 nt, Homo sapiens
auuuauucugccaaac

SEQ ID NO: 2021117 - RNA, 20 nt, Homo sapiens
gacuucucaaagagaauugu

SEQ ID NO: 2021118 - RNA, 20 nt, Homo sapiens
ggcggguggaucacgagguc

SEQ ID NO: 2021119 - RNA, 20 nt, Homo sapiens
ggucucacucugucgcucag

SEQ ID NO: 2021120 - RNA, 17 nt, Homo sapiens
uaaaugaaacuuggcca

SEQ ID NO: 2021121 - RNA, 19 nt, Homo sapiens
cauggaugcuuuggcaaug

SEQ ID NO: 2021122 - RNA, 19 nt, Homo sapiens
gagguccugcuacccagua

SEQ ID NO: 2021123 - RNA, 17 nt, Homo sapiens
ccugucuccagcugccu

SEQ ID NO: 2021124 - RNA, 20 nt, Homo sapiens
uguaaaauacauguaccuau

SEQ ID NO: 2021125 - RNA, 17 nt, Homo sapiens
caguacuuccugcagua

SEQ ID NO: 2021126 - RNA, 14 nt, Homo sapiens
gauucuucccacac

SEQ ID NO: 2021127 - RNA, 14 nt, Homo sapiens
uuaaaaaaacaauc

SEQ ID NO: 2021128 - RNA, 14 nt, Homo sapiens
acacacaauuacua

SEQ ID NO: 2021129 - RNA, 17 nt, Homo sapiens
uggaauguacaugucaa

SEQ ID NO: 2021130 - RNA, 20 nt, Homo sapiens
ugcucuugggaagaccagcu

SEQ ID NO: 2021131 - RNA, 20 nt, Homo sapiens
cgaacuguucacacugcaga

SEQ ID NO: 2021132 - RNA, 19 nt, Homo sapiens
aggggcucagcaaggugug

SEQ ID NO: 2021133 - RNA, 18 nt, Homo sapiens
augcacagucauacaagu

SEQ ID NO: 2021134 - RNA, 18 nt, Homo sapiens
ccaauuuuuccagcauuu

SEQ ID NO: 2021135 - RNA, 16 nt, Homo sapiens
accaaauaaaguacca

SEQ ID NO: 2021136 - RNA, 17 nt, Homo sapiens
ugccaucaaacuguaaa

SEQ ID NO: 2021137 - RNA, 20 nt, Homo sapiens
caucucacuuugccccaguu

SEQ ID NO: 2021138 - RNA, 23 nt, Homo sapiens
gaguaguuguuggucuguagcaa

SEQ ID NO: 2021139 - RNA, 22 nt, Homo sapiens
gagacagugggcacuaagggug

SEQ ID NO: 2021140 - RNA, 17 nt, Homo sapiens
caagaucaaaaauuaga

SEQ ID NO: 2021141 - RNA, 22 nt, Homo sapiens
ugcuucuggcuaccuguuugaa

SEQ ID NO: 2021142 - RNA, 15 nt, Homo sapiens
uucuccucccagcgu

SEQ ID NO: 2021143 - RNA, 14 nt, Homo sapiens
agaguaacccuguc

SEQ ID NO: 2021144 - RNA, 20 nt, Homo sapiens
cucugccccuucuguuucca

SEQ ID NO: 2021145 - RNA, 15 nt, Homo sapiens
uaaguauguuugaau

SEQ ID NO: 2021146 - RNA, 20 nt, Homo sapiens
accgugccuggcugauucag

SEQ ID NO: 2021147 - RNA, 20 nt, Homo sapiens
cagagacuggcagccaggga

SEQ ID NO: 2021148 - RNA, 13 nt, Homo sapiens
agcccugccaguu

SEQ ID NO: 2021149 - RNA, 20 nt, Homo sapiens
ggagccugaagggugccuag

SEQ ID NO: 2021150 - RNA, 16 nt, Homo sapiens
caaagguuacauguga

SEQ ID NO: 2021151 - RNA, 13 nt, Homo sapiens
aggacuaugacaa

SEQ ID NO: 2021152 - RNA, 11 nt, Homo sapiens
cguuaccagag

SEQ ID NO: 2021153 - RNA, 17 nt, Homo sapiens
ucggaugaccaaaccag

SEQ ID NO: 2021154 - RNA, 23 nt, Homo sapiens
ucugccggcccccaggacaagug

SEQ ID NO: 2021155 - RNA, 19 nt, Homo sapiens
uuuccugaggguuuucuca

SEQ ID NO: 2021156 - RNA, 23 nt, Homo sapiens
auauaacccuaggaauuuagaca

SEQ ID NO: 2021157 - RNA, 15 nt, Homo sapiens
uugugagagcccagu

SEQ ID NO: 2021158 - RNA, 19 nt, Homo sapiens
gaaagucaacauguaguaa

SEQ ID NO: 2021159 - RNA, 21 nt, Homo sapiens
auauacuuguggucccagaua

SEQ ID NO: 2021160 - RNA, 15 nt, Homo sapiens
gagaggauacauuua

SEQ ID NO: 2021161 - RNA, 16 nt, Homo sapiens
ugaugauaguggugga

SEQ ID NO: 2021162 - RNA, 12 nt, Homo sapiens
ccacuugggagc

SEQ ID NO: 2021163 - RNA, 22 nt, Homo sapiens
gugggucuggccguacuuguga

SEQ ID NO: 2021164 - RNA, 16 nt, Homo sapiens
guucuccucuaucuua

SEQ ID NO: 2021165 - RNA, 21 nt, Homo sapiens
auuaauguuuauuuagcucug

SEQ ID NO: 2021166 - RNA, 18 nt, Homo sapiens
aaucaugccauugcacuc

SEQ ID NO: 2021167 - RNA, 22 nt, Homo sapiens
aauguguuuuaucacuucauuc

SEQ ID NO: 2021168 - RNA, 14 nt, Homo sapiens
ucugcugucucucc

SEQ ID NO: 2021169 - RNA, 22 nt, Homo sapiens
agccccuccuuccuucaagcca

SEQ ID NO: 2021170 - RNA, 14 nt, Homo sapiens
acuugaacccagga

SEQ ID NO: 2021171 - RNA, 16 nt, Homo sapiens
ccuucuucccaaucau

SEQ ID NO: 2021172 - RNA, 23 nt, Homo sapiens
cucccuccccagaaacagugugc

SEQ ID NO: 2021173 - RNA, 15 nt, Homo sapiens
uucaugaccauccug

SEQ ID NO: 2021174 - RNA, 18 nt, Homo sapiens
ucggagaggacacuucaa

SEQ ID NO: 2021175 - RNA, 20 nt, Homo sapiens
ggcagcaagguggccacagu

SEQ ID NO: 2021176 - RNA, 19 nt, Homo sapiens
caccauaagcuacugccau

SEQ ID NO: 2021177 - RNA, 19 nt, Homo sapiens
guccaaacuuaacagauca

SEQ ID NO: 2021178 - RNA, 17 nt, Homo sapiens
acucacugugcuccuaa

SEQ ID NO: 2021179 - RNA, 20 nt, Homo sapiens
agauccccaagccuggcaag

SEQ ID NO: 2021180 - RNA, 17 nt, Homo sapiens
uguagacccuaacccgg

SEQ ID NO: 2021181 - RNA, 23 nt, Homo sapiens
ccuuacggucaugaugucugcaa

SEQ ID NO: 2021182 - RNA, 20 nt, Homo sapiens
gacauggauuugaugaaagu

SEQ ID NO: 2021183 - RNA, 18 nt, Homo sapiens
ucauggauagauuuucac

SEQ ID NO: 2021184 - RNA, 21 nt, Homo sapiens
cccagcacuuugggaggccaa

SEQ ID NO: 2021185 - RNA, 16 nt, Homo sapiens
acuuaauucugauuag

SEQ ID NO: 2021186 - RNA, 18 nt, Homo sapiens
acggccacgucaugucuc

SEQ ID NO: 2021187 - RNA, 17 nt, Homo sapiens
aaggccucccacaguga

SEQ ID NO: 2021188 - RNA, 22 nt, Homo sapiens
caaauuaaaacugagacacauu

SEQ ID NO: 2021189 - RNA, 14 nt, Homo sapiens
ugcuguagagccau

SEQ ID NO: 2021190 - RNA, 10 nt, Homo sapiens
caguaacuga

SEQ ID NO: 2021191 - RNA, 19 nt, Homo sapiens
cuggggggguugggcgggc

SEQ ID NO: 2021192 - RNA, 16 nt, Homo sapiens
uggacaaagaaccuuc

SEQ ID NO: 2021193 - RNA, 18 nt, Homo sapiens
cuauagccuaggugacag

SEQ ID NO: 2021194 - RNA, 17 nt, Homo sapiens
aguagaaucucagcacu

SEQ ID NO: 2021195 - RNA, 13 nt, Homo sapiens
cccucuucugagc

SEQ ID NO: 2021196 - RNA, 13 nt, Homo sapiens
gggccgcucugau

SEQ ID NO: 2021197 - RNA, 15 nt, Homo sapiens
cugaaagaugaucau

SEQ ID NO: 2021198 - RNA, 19 nt, Homo sapiens
uuaaaauagcaaaagaaga

SEQ ID NO: 2021199 - RNA, 22 nt, Homo sapiens
uaguucuguauauagggcacaa

SEQ ID NO: 2021200 - RNA, 23 nt, Homo sapiens
aauccacagcuauauccugaugc

SEQ ID NO: 2021201 - RNA, 13 nt, Homo sapiens
auccuaacauuca

SEQ ID NO: 2021202 - RNA, 13 nt, Homo sapiens
ucucaaacucccu

SEQ ID NO: 2021203 - RNA, 19 nt, Homo sapiens
gacacagacucauccugaa

SEQ ID NO: 2021204 - RNA, 15 nt, Homo sapiens
ugguaaaugccacac

SEQ ID NO: 2021205 - RNA, 15 nt, Homo sapiens
auauccuauggucuu

SEQ ID NO: 2021206 - RNA, 17 nt, Homo sapiens
cuuggggcccagugcau

SEQ ID NO: 2021207 - RNA, 17 nt, Homo sapiens
cauaaugaaugcuauug

SEQ ID NO: 2021208 - RNA, 20 nt, Homo sapiens
ccaccaaugggccuccagag

SEQ ID NO: 2021209 - RNA, 15 nt, Homo sapiens
cuccuuuaguuucag

SEQ ID NO: 2021210 - RNA, 19 nt, Homo sapiens
ugagccaucgcuuuugacc

SEQ ID NO: 2021211 - RNA, 21 nt, Homo sapiens
caaggaggguguaauggagca

SEQ ID NO: 2021212 - RNA, 16 nt, Homo sapiens
cagauaaaugugcaaa

SEQ ID NO: 2021213 - RNA, 13 nt, Homo sapiens
gcuucuuuucacu

SEQ ID NO: 2021214 - RNA, 19 nt, Homo sapiens
gccugugccgcacuagccu

SEQ ID NO: 2021215 - RNA, 20 nt, Homo sapiens
agcccuguacccaccccagc

SEQ ID NO: 2021216 - RNA, 18 nt, Homo sapiens
gugcaaaauggucaguau

SEQ ID NO: 2021217 - RNA, 16 nt, Homo sapiens
aacugacaaugaaggg

SEQ ID NO: 2021218 - RNA, 24 nt, Homo sapiens
uucuaguuuugucaaacuguagaa

SEQ ID NO: 2021219 - RNA, 23 nt, Homo sapiens
aacuaauccuucuggcagauuca

SEQ ID NO: 2021220 - RNA, 13 nt, Homo sapiens
cacacacauacag

SEQ ID NO: 2021221 - RNA, 22 nt, Homo sapiens
gaaaaugauuuuacuuagcaau

SEQ ID NO: 2021222 - RNA, 19 nt, Homo sapiens
cucccgggggcacugccug

SEQ ID NO: 2021223 - RNA, 17 nt, Homo sapiens
cuaagaaauaaaacugu

SEQ ID NO: 2021224 - RNA, 16 nt, Homo sapiens
gagaagggcucagaga

SEQ ID NO: 2021225 - RNA, 20 nt, Homo sapiens
ccaggcaggcugugcgcuga

SEQ ID NO: 2021226 - RNA, 22 nt, Homo sapiens
cugauuuaaacuucuuaacugg

SEQ ID NO: 2021227 - RNA, 21 nt, Homo sapiens
ugcacugucgauaaucagaga

SEQ ID NO: 2021228 - RNA, 12 nt, Homo sapiens
caaauccauaga

SEQ ID NO: 2021229 - RNA, 18 nt, Homo sapiens
ggaaguuuaaacauuucu

SEQ ID NO: 2021230 - RNA, 21 nt, Homo sapiens
ugcccaaggauagguauuuua

SEQ ID NO: 2021231 - RNA, 16 nt, Homo sapiens
uaggccaucucagcuu

SEQ ID NO: 2021232 - RNA, 18 nt, Homo sapiens
uggucucauguaacacau

SEQ ID NO: 2021233 - RNA, 22 nt, Homo sapiens
cugagcucucugaaaguuguca

SEQ ID NO: 2021234 - RNA, 21 nt, Homo sapiens
uacauucccaagguuacuuaa

SEQ ID NO: 2021235 - RNA, 23 nt, Homo sapiens
uuaaaauuuuucuuaagacagag

SEQ ID NO: 2021236 - RNA, 21 nt, Homo sapiens
cucuuuguagcuaacagugaa

SEQ ID NO: 2021237 - RNA, 12 nt, Homo sapiens
gaagcauuuacu

SEQ ID NO: 2021238 - RNA, 12 nt, Homo sapiens
uucucauuguag

SEQ ID NO: 2021239 - RNA, 21 nt, Homo sapiens
auaaaaagauguucagucauu

SEQ ID NO: 2021240 - RNA, 19 nt, Homo sapiens
aguaguugguuuccuucac

SEQ ID NO: 2021241 - RNA, 17 nt, Homo sapiens
acucagagaaacaaugg

SEQ ID NO: 2021242 - RNA, 14 nt, Homo sapiens
aagaccccaucucu

SEQ ID NO: 2021243 - RNA, 22 nt, Homo sapiens
ugcccacauuaagcacugugga

SEQ ID NO: 2021244 - RNA, 20 nt, Homo sapiens
uacaggggcccgccaccaca

SEQ ID NO: 2021245 - RNA, 19 nt, Homo sapiens
cuuuuauggaugauuaaau

SEQ ID NO: 2021246 - RNA, 18 nt, Homo sapiens
uuacaaugauaugaucau

SEQ ID NO: 2021247 - RNA, 15 nt, Homo sapiens
cuguuccacauccac

SEQ ID NO: 2021248 - RNA, 16 nt, Homo sapiens
gugccauugcacucca

SEQ ID NO: 2021249 - RNA, 11 nt, Homo sapiens
ggcugggcuac

SEQ ID NO: 2021250 - RNA, 14 nt, Homo sapiens
cccuggcucugcca

SEQ ID NO: 2021251 - RNA, 11 nt, Homo sapiens
aauucuugaua

SEQ ID NO: 2021252 - RNA, 20 nt, Homo sapiens
gccagaggaaccagcacucc

SEQ ID NO: 2021253 - RNA, 20 nt, Homo sapiens
uguugucagcccaugcuuau

SEQ ID NO: 2021254 - RNA, 14 nt, Homo sapiens
cuccuugucugugc

SEQ ID NO: 2021255 - RNA, 17 nt, Homo sapiens
gaugaggcuggccaagc

SEQ ID NO: 2021256 - RNA, 14 nt, Homo sapiens
acagggauuaucau

SEQ ID NO: 2021257 - RNA, 17 nt, Homo sapiens
cggccuuuguugcucag

SEQ ID NO: 2021258 - RNA, 22 nt, Homo sapiens
ugcaagcacaaauuucaucucc

SEQ ID NO: 2021259 - RNA, 21 nt, Homo sapiens
uuagagguuugucaacacaaa

SEQ ID NO: 2021260 - RNA, 20 nt, Homo sapiens
aaccuccgcaucccggguuc

SEQ ID NO: 2021261 - RNA, 21 nt, Homo sapiens
aagacaucagauccugggcac

SEQ ID NO: 2021262 - RNA, 23 nt, Homo sapiens
gcaaaacaaggacuagagcucag

SEQ ID NO: 2021263 - RNA, 19 nt, Homo sapiens
ucucuuuuuaccuuuaaca

SEQ ID NO: 2021264 - RNA, 22 nt, Homo sapiens
cuauccauaguccuggucccca

SEQ ID NO: 2021265 - RNA, 17 nt, Homo sapiens
uggagccccaggggaca

SEQ ID NO: 2021266 - RNA, 15 nt, Homo sapiens
acugugaauguucca

SEQ ID NO: 2021267 - RNA, 17 nt, Homo sapiens
uucaccuagcaacauau

SEQ ID NO: 2021268 - RNA, 19 nt, Homo sapiens
ccaugccaguaacugugcu

SEQ ID NO: 2021269 - RNA, 17 nt, Homo sapiens
accucugugaccaacug

SEQ ID NO: 2021270 - RNA, 21 nt, Homo sapiens
gagccgagauugcaccacugc

SEQ ID NO: 2021271 - RNA, 21 nt, Homo sapiens
ccuucucuacucaugccagau

SEQ ID NO: 2021272 - RNA, 14 nt, Homo sapiens
ugcuguuuugccag

SEQ ID NO: 2021273 - RNA, 18 nt, Homo sapiens
caggaugaguuacuugaa

SEQ ID NO: 2021274 - RNA, 24 nt, Homo sapiens
uccccuuccuggacacacucucau

SEQ ID NO: 2021275 - RNA, 21 nt, Homo sapiens
uauuuuguaaugcugcacaga

SEQ ID NO: 2021276 - RNA, 20 nt, Homo sapiens
cucucagccagcuguuuaag

SEQ ID NO: 2021277 - RNA, 22 nt, Homo sapiens
uucucagauguugaaacuuuga

SEQ ID NO: 2021278 - RNA, 14 nt, Homo sapiens
caggcugcaguggc

SEQ ID NO: 2021279 - RNA, 16 nt, Homo sapiens
ucaaccauaacacuug

SEQ ID NO: 2021280 - RNA, 13 nt, Homo sapiens
cuucugcuucaaa

SEQ ID NO: 2021281 - RNA, 15 nt, Homo sapiens
gauccagccauuccu

SEQ ID NO: 2021282 - RNA, 16 nt, Homo sapiens
uaggagguuauuucaa

SEQ ID NO: 2021283 - RNA, 20 nt, Homo sapiens
caguaggcaguagacuauaa

SEQ ID NO: 2021284 - RNA, 16 nt, Homo sapiens
aucuuuucauuaaaga

SEQ ID NO: 2021285 - RNA, 14 nt, Homo sapiens
caccucaccaaaac

SEQ ID NO: 2021286 - RNA, 16 nt, Homo sapiens
acgagaagguacugaa

SEQ ID NO: 2021287 - RNA, 20 nt, Homo sapiens
ugccucagccaguggcacag

SEQ ID NO: 2021288 - RNA, 19 nt, Homo sapiens
cacccccaccauccaggug

SEQ ID NO: 2021289 - RNA, 16 nt, Homo sapiens
aaaaggucucaccaca

SEQ ID NO: 2021290 - RNA, 17 nt, Homo sapiens
aaccuacccucagugag

SEQ ID NO: 2021291 - RNA, 22 nt, Homo sapiens
uuucaguacacccaguugccaa

SEQ ID NO: 2021292 - RNA, 19 nt, Homo sapiens
gccuccaacccuagcaaaa

SEQ ID NO: 2021293 - RNA, 16 nt, Homo sapiens
ccuuucaaagcacuua

SEQ ID NO: 2021294 - RNA, 17 nt, Homo sapiens
cuuucucaugcauagac

SEQ ID NO: 2021295 - RNA, 13 nt, Homo sapiens
agagacacuccaa

SEQ ID NO: 2021296 - RNA, 14 nt, Homo sapiens
gaaagccauugacc

SEQ ID NO: 2021297 - RNA, 11 nt, Homo sapiens
agcaugugcaa

SEQ ID NO: 2021298 - RNA, 18 nt, Homo sapiens
aaaggaaacaaacucuca

SEQ ID NO: 2021299 - RNA, 17 nt, Homo sapiens
aacacuuauguuauaca

SEQ ID NO: 2021300 - RNA, 18 nt, Homo sapiens
uuugugaaagugccaaaa

SEQ ID NO: 2021301 - RNA, 12 nt, Homo sapiens
ccacugugguuu

SEQ ID NO: 2021302 - RNA, 15 nt, Homo sapiens
uguaaaucacuugua

SEQ ID NO: 2021303 - RNA, 13 nt, Homo sapiens
agcaacucuggcc

SEQ ID NO: 2021304 - RNA, 18 nt, Homo sapiens
ccccaggagaacaucuuu

SEQ ID NO: 2021305 - RNA, 18 nt, Homo sapiens
acuccuggccucaaguga

SEQ ID NO: 2021306 - RNA, 14 nt, Homo sapiens
uugauucagcucau

SEQ ID NO: 2021307 - RNA, 19 nt, Homo sapiens
augggggcaggaaagccac

SEQ ID NO: 2021308 - RNA, 16 nt, Homo sapiens
aagcaagaauggagga

SEQ ID NO: 2021309 - RNA, 18 nt, Homo sapiens
aagauauauguguauaca

SEQ ID NO: 2021310 - RNA, 21 nt, Homo sapiens
augauuucuaugaacuugucu

SEQ ID NO: 2021311 - RNA, 11 nt, Homo sapiens
uguacacugcc

SEQ ID NO: 2021312 - RNA, 21 nt, Homo sapiens
cccaccuugccagggcagggu

SEQ ID NO: 2021313 - RNA, 19 nt, Homo sapiens
gucaauggcuuguucauca

SEQ ID NO: 2021314 - RNA, 14 nt, Homo sapiens
agcuggccuuugua

SEQ ID NO: 2021315 - RNA, 19 nt, Homo sapiens
ugcuugccauucucuugca

SEQ ID NO: 2021316 - RNA, 11 nt, Homo sapiens
ccuaccuuuau

SEQ ID NO: 2021317 - RNA, 23 nt, Homo sapiens
aauuucuaguaccugugacucuu

SEQ ID NO: 2021318 - RNA, 15 nt, Homo sapiens
gccucucccugccug

SEQ ID NO: 2021319 - RNA, 16 nt, Homo sapiens
acaguacuuuccagca

SEQ ID NO: 2021320 - RNA, 17 nt, Homo sapiens
cgguuaccucugcaugg

SEQ ID NO: 2021321 - RNA, 19 nt, Homo sapiens
caguguuauuaguguaugc

SEQ ID NO: 2021322 - RNA, 12 nt, Homo sapiens
acaucaggaaau

SEQ ID NO: 2021323 - RNA, 18 nt, Homo sapiens
aucuaaaguaaaaaggga

SEQ ID NO: 2021324 - RNA, 23 nt, Homo sapiens
ugauagugucccacggugccuug

SEQ ID NO: 2021325 - RNA, 20 nt, Homo sapiens
uguuuuaucauuaccauuaa

SEQ ID NO: 2021326 - RNA, 16 nt, Homo sapiens
aaguuccuacuaggca

SEQ ID NO: 2021327 - RNA, 22 nt, Homo sapiens
acaugaaaauuuuugaguuaca

SEQ ID NO: 2021328 - RNA, 18 nt, Homo sapiens
uaguaacguguuacugga

SEQ ID NO: 2021329 - RNA, 17 nt, Homo sapiens
ccacuaaaaauauuguu

SEQ ID NO: 2021330 - RNA, 16 nt, Homo sapiens
cgugguggugggugcc

SEQ ID NO: 2021331 - RNA, 19 nt, Homo sapiens
gcuacacagaucacagcuu

SEQ ID NO: 2021332 - RNA, 17 nt, Homo sapiens
ucaguaccauuugaucu

SEQ ID NO: 2021333 - RNA, 15 nt, Homo sapiens
aacaggacauagcac

SEQ ID NO: 2021334 - RNA, 17 nt, Homo sapiens
ucuuacaggaagccucu

SEQ ID NO: 2021335 - RNA, 23 nt, Homo sapiens
caacagauggcugcgcaccaucu

SEQ ID NO: 2021336 - RNA, 15 nt, Homo sapiens
guuaaauucaaugua

SEQ ID NO: 2021337 - RNA, 18 nt, Homo sapiens
cauggaugauucuuuucc

SEQ ID NO: 2021338 - RNA, 16 nt, Homo sapiens
ugagagggcccagaag

SEQ ID NO: 2021339 - RNA, 20 nt, Homo sapiens
cagcuaccccugcagcuggg

SEQ ID NO: 2021340 - RNA, 18 nt, Homo sapiens
cuuuaaaauguaaagcca

SEQ ID NO: 2021341 - RNA, 19 nt, Homo sapiens
ucaguuucucaaacugagc

SEQ ID NO: 2021342 - RNA, 12 nt, Homo sapiens
uaaagaauacuu

SEQ ID NO: 2021343 - RNA, 15 nt, Homo sapiens
auuaaaugcaucaau

SEQ ID NO: 2021344 - RNA, 17 nt, Homo sapiens
cuugucacgaauuccau

SEQ ID NO: 2021345 - RNA, 16 nt, Homo sapiens
gguugguuuaaugcaa

SEQ ID NO: 2021346 - RNA, 11 nt, Homo sapiens
cagauuauuca

SEQ ID NO: 2021347 - RNA, 13 nt, Homo sapiens
gauggaccaaagc

SEQ ID NO: 2021348 - RNA, 22 nt, Homo sapiens
uaagaauguugguuuacuuuca

SEQ ID NO: 2021349 - RNA, 17 nt, Homo sapiens
gcaucuaagacauucac

SEQ ID NO: 2021350 - RNA, 19 nt, Homo sapiens
acaccacuuucugcuuucc

SEQ ID NO: 2021351 - RNA, 21 nt, Homo sapiens
ugagauuauaggcaccuacca

SEQ ID NO: 2021352 - RNA, 14 nt, Homo sapiens
ccuauuuauuugag

SEQ ID NO: 2021353 - RNA, 19 nt, Homo sapiens
guagcucuguccacucuga

SEQ ID NO: 2021354 - RNA, 24 nt, Homo sapiens
gccagaacacacucuacaaaauga

SEQ ID NO: 2021355 - RNA, 15 nt, Homo sapiens
aagagaaccaugugc

SEQ ID NO: 2021356 - RNA, 18 nt, Homo sapiens
cuccuggccucaagcaau

SEQ ID NO: 2021357 - RNA, 17 nt, Homo sapiens
agugccaccacacucag

SEQ ID NO: 2021358 - RNA, 20 nt, Homo sapiens
guuggggaauaaauggauau

SEQ ID NO: 2021359 - RNA, 14 nt, Homo sapiens
ugggagagucucac

SEQ ID NO: 2021360 - RNA, 19 nt, Homo sapiens
aagaauguuaagauuuauc

SEQ ID NO: 2021361 - RNA, 16 nt, Homo sapiens
gagaaggagugccaua

SEQ ID NO: 2021362 - RNA, 12 nt, Homo sapiens
agugaauauuca

SEQ ID NO: 2021363 - RNA, 17 nt, Homo sapiens
agguggaaggacccugu

SEQ ID NO: 2021364 - RNA, 16 nt, Homo sapiens
uuugugugugugcaag

SEQ ID NO: 2021365 - RNA, 19 nt, Homo sapiens
ucugagaaagacuauucaa

SEQ ID NO: 2021366 - RNA, 18 nt, Homo sapiens
auucccuuugcauguuaa

SEQ ID NO: 2021367 - RNA, 17 nt, Homo sapiens
uuauagaagaaugcaug

SEQ ID NO: 2021368 - RNA, 18 nt, Homo sapiens
cuguaguuuggagacaaa

SEQ ID NO: 2021369 - RNA, 14 nt, Homo sapiens
cccuggacuauggu

SEQ ID NO: 2021370 - RNA, 14 nt, Homo sapiens
cacucgacucugcu

SEQ ID NO: 2021371 - RNA, 13 nt, Homo sapiens
aaaauguaugcau

SEQ ID NO: 2021372 - RNA, 12 nt, Homo sapiens
aguguuucuaca

SEQ ID NO: 2021373 - RNA, 16 nt, Homo sapiens
auggaacucucuccac

SEQ ID NO: 2021374 - RNA, 14 nt, Homo sapiens
agguucugagauaa

SEQ ID NO: 2021375 - RNA, 13 nt, Homo sapiens
uccuuaaugcaga

SEQ ID NO: 2021376 - RNA, 15 nt, Homo sapiens
ugcacaaguacagua

SEQ ID NO: 2021377 - RNA, 12 nt, Homo sapiens
ucaugacaguca

SEQ ID NO: 2021378 - RNA, 16 nt, Homo sapiens
guaauccagcaauaca

SEQ ID NO: 2021379 - RNA, 12 nt, Homo sapiens
cuauuuaugcaa

SEQ ID NO: 2021380 - RNA, 12 nt, Homo sapiens
gccuuuaucuca

SEQ ID NO: 2021381 - RNA, 13 nt, Homo sapiens
auccagugacaug

SEQ ID NO: 2021382 - RNA, 17 nt, Homo sapiens
aggggcaagcucuugcc

SEQ ID NO: 2021383 - RNA, 21 nt, Homo sapiens
cauuagaauuuacagcaagaa

SEQ ID NO: 2021384 - RNA, 14 nt, Homo sapiens
ggcccgaacaggga

SEQ ID NO: 2021385 - RNA, 19 nt, Homo sapiens
guccaggagcuaaucugac

SEQ ID NO: 2021386 - RNA, 15 nt, Homo sapiens
cagauugugccacug

SEQ ID NO: 2021387 - RNA, 20 nt, Homo sapiens
guuaggaggugcagacacuu

SEQ ID NO: 2021388 - RNA, 20 nt, Homo sapiens
gugauuuauaugaaaagagg

SEQ ID NO: 2021389 - RNA, 20 nt, Homo sapiens
auuauuaaugaaaauaagaa

SEQ ID NO: 2021390 - RNA, 20 nt, Homo sapiens
uauuuuauaccaaagccaau

SEQ ID NO: 2021391 - RNA, 14 nt, Homo sapiens
ugauacaguauuau

SEQ ID NO: 2021392 - RNA, 21 nt, Homo sapiens
ccugcugggguccuuuguuag

SEQ ID NO: 2021393 - RNA, 22 nt, Homo sapiens
ucaagcagaaaaacaggcacag

SEQ ID NO: 2021394 - RNA, 17 nt, Homo sapiens
agauuuuucucaucucc

SEQ ID NO: 2021395 - RNA, 18 nt, Homo sapiens
agucacccagagcacagg

SEQ ID NO: 2021396 - RNA, 13 nt, Homo sapiens
acaaaaggcuuug

SEQ ID NO: 2021397 - RNA, 21 nt, Homo sapiens
acuucucccgugagccaggca

SEQ ID NO: 2021398 - RNA, 22 nt, Homo sapiens
guguuuguauguaaacauuucu

SEQ ID NO: 2021399 - RNA, 17 nt, Homo sapiens
gauugaauuaaaacagc

SEQ ID NO: 2021400 - RNA, 18 nt, Homo sapiens
ucuggaccuugagcauca

SEQ ID NO: 2021401 - RNA, 20 nt, Homo sapiens
ugccuggucugucuggaucc

SEQ ID NO: 2021402 - RNA, 13 nt, Homo sapiens
ucuagaacagcca

SEQ ID NO: 2021403 - RNA, 22 nt, Homo sapiens
cucaguaaacgggaacaugccc

SEQ ID NO: 2021404 - RNA, 17 nt, Homo sapiens
cauggguucaauuggac

SEQ ID NO: 2021405 - RNA, 13 nt, Homo sapiens
uuuacuaacacug

SEQ ID NO: 2021406 - RNA, 22 nt, Homo sapiens
ugugcucuacuguuacuaggcu

SEQ ID NO: 2021407 - RNA, 15 nt, Homo sapiens
agacuagagggcaga

SEQ ID NO: 2021408 - RNA, 15 nt, Homo sapiens
gaaauaaaaagaagg

SEQ ID NO: 2021409 - RNA, 15 nt, Homo sapiens
auguccugccuuuua

SEQ ID NO: 2021410 - RNA, 21 nt, Homo sapiens
agugauugacacacagcacuc

SEQ ID NO: 2021411 - RNA, 14 nt, Homo sapiens
ugggcucugaugaa

SEQ ID NO: 2021412 - RNA, 17 nt, Homo sapiens
caaggacuagagcucag

SEQ ID NO: 2021413 - RNA, 13 nt, Homo sapiens
ccagaugauccca

SEQ ID NO: 2021414 - RNA, 12 nt, Homo sapiens
gcaauacaaaga

SEQ ID NO: 2021415 - RNA, 13 nt, Homo sapiens
accaggcuacaag

SEQ ID NO: 2021416 - RNA, 21 nt, Homo sapiens
ucuccucaacccacauggggu

SEQ ID NO: 2021417 - RNA, 12 nt, Homo sapiens
acucagcuuugc

SEQ ID NO: 2021418 - RNA, 22 nt, Homo sapiens
ucaagacgucacccuccauucu

SEQ ID NO: 2021419 - RNA, 14 nt, Homo sapiens
caaugacaucucag

SEQ ID NO: 2021420 - RNA, 23 nt, Homo sapiens
gaggucaggaguucaagaccagc

SEQ ID NO: 2021421 - RNA, 20 nt, Homo sapiens
aggacgauuucacugacacu

SEQ ID NO: 2021422 - RNA, 21 nt, Homo sapiens
gauuacaaaucagaagucauc

SEQ ID NO: 2021423 - RNA, 12 nt, Homo sapiens
ccgccuggagau

SEQ ID NO: 2021424 - RNA, 16 nt, Homo sapiens
auacauuccugagauu

SEQ ID NO: 2021425 - RNA, 19 nt, Homo sapiens
gcuugaccuuuaagagaaa

SEQ ID NO: 2021426 - RNA, 17 nt, Homo sapiens
aaugaagccuuagccag

SEQ ID NO: 2021427 - RNA, 19 nt, Homo sapiens
gauagccuaguuaaauauu

SEQ ID NO: 2021428 - RNA, 15 nt, Homo sapiens
acaaacacauuguga

SEQ ID NO: 2021429 - RNA, 20 nt, Homo sapiens
agagaaccucagguacggag

SEQ ID NO: 2021430 - RNA, 18 nt, Homo sapiens
uaaaguauaauguuuauu

SEQ ID NO: 2021431 - RNA, 19 nt, Homo sapiens
uguaaacuauaaacuacug

SEQ ID NO: 2021432 - RNA, 21 nt, Homo sapiens
guauaggggcaacuguaugaa

SEQ ID NO: 2021433 - RNA, 14 nt, Homo sapiens
ugaagcucuggcca

SEQ ID NO: 2021434 - RNA, 22 nt, Homo sapiens
aaugacuuuuugaaaguaaaag

SEQ ID NO: 2021435 - RNA, 17 nt, Homo sapiens
aagacagagcagaucag

SEQ ID NO: 2021436 - RNA, 17 nt, Homo sapiens
cagccaaucacaagcag

SEQ ID NO: 2021437 - RNA, 16 nt, Homo sapiens
cuucugcacccagaaa

SEQ ID NO: 2021438 - RNA, 18 nt, Homo sapiens
ugcauuccuuacuugcac

SEQ ID NO: 2021439 - RNA, 21 nt, Homo sapiens
agugccaggugaucuccugug

SEQ ID NO: 2021440 - RNA, 15 nt, Homo sapiens
auaucuuauguuaaa

SEQ ID NO: 2021441 - RNA, 13 nt, Homo sapiens
cauccugcuuccu

SEQ ID NO: 2021442 - RNA, 16 nt, Homo sapiens
cauuuagucaugugac

SEQ ID NO: 2021443 - RNA, 15 nt, Homo sapiens
ucuaaaggacauaca

SEQ ID NO: 2021444 - RNA, 17 nt, Homo sapiens
uaagcauuccaacuauc

SEQ ID NO: 2021445 - RNA, 18 nt, Homo sapiens
caaccaauggaaugugau

SEQ ID NO: 2021446 - RNA, 16 nt, Homo sapiens
aagcuccuuuggcaga

SEQ ID NO: 2021447 - RNA, 21 nt, Homo sapiens
aaugcaagccaucucuaauaa

SEQ ID NO: 2021448 - RNA, 17 nt, Homo sapiens
uuucuuuuucugucucu

SEQ ID NO: 2021449 - RNA, 21 nt, Homo sapiens
aguguauauuuuugguggugg

SEQ ID NO: 2021450 - RNA, 15 nt, Homo sapiens
caauaaacucaguca

SEQ ID NO: 2021451 - RNA, 18 nt, Homo sapiens
cuguccaguuuccaaagg

SEQ ID NO: 2021452 - RNA, 23 nt, Homo sapiens
ugcgcaaggccucgcucuugaca

SEQ ID NO: 2021453 - RNA, 19 nt, Homo sapiens
ggaaggacuugacugggga

SEQ ID NO: 2021454 - RNA, 20 nt, Homo sapiens
caaagcacuguuucucucac

SEQ ID NO: 2021455 - RNA, 19 nt, Homo sapiens
uauauuugaaauaguauac

SEQ ID NO: 2021456 - RNA, 13 nt, Homo sapiens
ucccagagcaccu

SEQ ID NO: 2021457 - RNA, 20 nt, Homo sapiens
aagaacccugcaaauggcua

SEQ ID NO: 2021458 - RNA, 22 nt, Homo sapiens
gauggagugugcagacagccau

SEQ ID NO: 2021459 - RNA, 17 nt, Homo sapiens
gaaccagggcucuucuc

SEQ ID NO: 2021460 - RNA, 23 nt, Homo sapiens
uucaaaagucuggcccacugugc

SEQ ID NO: 2021461 - RNA, 14 nt, Homo sapiens
aacacuuaccccau

SEQ ID NO: 2021462 - RNA, 16 nt, Homo sapiens
cagugggagcccugac

SEQ ID NO: 2021463 - RNA, 13 nt, Homo sapiens
caugcacuucuua

SEQ ID NO: 2021464 - RNA, 19 nt, Homo sapiens
aaauauuaauauccuguaa

SEQ ID NO: 2021465 - RNA, 18 nt, Homo sapiens
uaaguucccuucuauauc

SEQ ID NO: 2021466 - RNA, 15 nt, Homo sapiens
cuugaaaacugggac

SEQ ID NO: 2021467 - RNA, 22 nt, Homo sapiens
uaacaggcucaauauuccugaa

SEQ ID NO: 2021468 - RNA, 14 nt, Homo sapiens
ccaaucccauuccu

SEQ ID NO: 2021469 - RNA, 23 nt, Homo sapiens
uuuagcauaguaccucugcuauu

SEQ ID NO: 2021470 - RNA, 22 nt, Homo sapiens
uuggcugcauaaaugugguaca

SEQ ID NO: 2021471 - RNA, 19 nt, Homo sapiens
auuugcacacguccauguu

SEQ ID NO: 2021472 - RNA, 18 nt, Homo sapiens
aggccaagggacaguggu

SEQ ID NO: 2021473 - RNA, 22 nt, Homo sapiens
acuccauaguuugggcuuguac

SEQ ID NO: 2021474 - RNA, 15 nt, Homo sapiens
agccuauggcaucuu

SEQ ID NO: 2021475 - RNA, 19 nt, Homo sapiens
uccacuucuuguuccccac

SEQ ID NO: 2021476 - RNA, 14 nt, Homo sapiens
auauguaucuaguc

SEQ ID NO: 2021477 - RNA, 22 nt, Homo sapiens
ucuugacuuuguaucuucacug

SEQ ID NO: 2021478 - RNA, 19 nt, Homo sapiens
guaggaaccugcacacgag

SEQ ID NO: 2021479 - RNA, 16 nt, Homo sapiens
aauacacauauuugca

SEQ ID NO: 2021480 - RNA, 19 nt, Homo sapiens
cuuuucaacacacaaagca

SEQ ID NO: 2021481 - RNA, 15 nt, Homo sapiens
ugaguaaaacacaua

SEQ ID NO: 2021482 - RNA, 15 nt, Homo sapiens
acucuugaugugaag

SEQ ID NO: 2021483 - RNA, 20 nt, Homo sapiens
guugccuccagggccucucc

SEQ ID NO: 2021484 - RNA, 22 nt, Homo sapiens
acagauuuaagaauaccugaga

SEQ ID NO: 2021485 - RNA, 20 nt, Homo sapiens
ucucagccauaggugcaguu

SEQ ID NO: 2021486 - RNA, 12 nt, Homo sapiens
aauuucacuuaa

SEQ ID NO: 2021487 - RNA, 16 nt, Homo sapiens
gcagccaggacccgcc

SEQ ID NO: 2021488 - RNA, 20 nt, Homo sapiens
aaguuccccaucccugucau

SEQ ID NO: 2021489 - RNA, 17 nt, Homo sapiens
ucuggcgucuguuucaa

SEQ ID NO: 2021490 - RNA, 17 nt, Homo sapiens
gucaccacccagcccuu

SEQ ID NO: 2021491 - RNA, 18 nt, Homo sapiens
cauggagacagcaguuuc

SEQ ID NO: 2021492 - RNA, 16 nt, Homo sapiens
aaagcagacagucaca

SEQ ID NO: 2021493 - RNA, 18 nt, Homo sapiens
cuggucucuacauaaaau

SEQ ID NO: 2021494 - RNA, 17 nt, Homo sapiens
ugccaucuguagcuaua

SEQ ID NO: 2021495 - RNA, 22 nt, Homo sapiens
ugggcacagcucuucacaccau

SEQ ID NO: 2021496 - RNA, 19 nt, Homo sapiens
gauaaguggggacuagugu

SEQ ID NO: 2021497 - RNA, 18 nt, Homo sapiens
aaccucucuucuaccuua

SEQ ID NO: 2021498 - RNA, 21 nt, Homo sapiens
uagugguuuaucagcaaaaaa

SEQ ID NO: 2021499 - RNA, 18 nt, Homo sapiens
aaauguucaaauucacgu

SEQ ID NO: 2021500 - RNA, 18 nt, Homo sapiens
caaacccuaaaccucuuc

SEQ ID NO: 2021501 - RNA, 18 nt, Homo sapiens
gaaauaaaagcuuugcaa

SEQ ID NO: 2021502 - RNA, 18 nt, Homo sapiens
acggucaguccaugucuc

SEQ ID NO: 2021503 - RNA, 20 nt, Homo sapiens
cugaaggaauagccagagag

SEQ ID NO: 2021504 - RNA, 12 nt, Homo sapiens
cuccggggagcg

SEQ ID NO: 2021505 - RNA, 12 nt, Homo sapiens
agcaaaugacaa

SEQ ID NO: 2021506 - RNA, 18 nt, Homo sapiens
accugccucugaccccag

SEQ ID NO: 2021507 - RNA, 17 nt, Homo sapiens
agauucaaucccaggau

SEQ ID NO: 2021508 - RNA, 19 nt, Homo sapiens
uucuggggacaccucagga

SEQ ID NO: 2021509 - RNA, 14 nt, Homo sapiens
gcaaguucaugugu

SEQ ID NO: 2021510 - RNA, 13 nt, Homo sapiens
uuaguauucugcc

SEQ ID NO: 2021511 - RNA, 22 nt, Homo sapiens
uguacuguuuuuaauguucaca

SEQ ID NO: 2021512 - RNA, 19 nt, Homo sapiens
auaacuucucugugaacua

SEQ ID NO: 2021513 - RNA, 21 nt, Homo sapiens
cugcaguuagagcugagcacu

SEQ ID NO: 2021514 - RNA, 13 nt, Homo sapiens
gcauguugaauau

SEQ ID NO: 2021515 - RNA, 15 nt, Homo sapiens
cugacugaaggggcu

SEQ ID NO: 2021516 - RNA, 16 nt, Homo sapiens
cuggucccacucaguc

SEQ ID NO: 2021517 - RNA, 16 nt, Homo sapiens
aauauagcaagaccac

SEQ ID NO: 2021518 - RNA, 19 nt, Homo sapiens
cucuuuauuuuuugauuga

SEQ ID NO: 2021519 - RNA, 19 nt, Homo sapiens
gccauauuguguaauuuaa

SEQ ID NO: 2021520 - RNA, 13 nt, Homo sapiens
agaaacauuucag

SEQ ID NO: 2021521 - RNA, 19 nt, Homo sapiens
ccacucaggggucauucau

SEQ ID NO: 2021522 - RNA, 14 nt, Homo sapiens
aaucaaagaaguaa

SEQ ID NO: 2021523 - RNA, 19 nt, Homo sapiens
aucccaggaugggugucug

SEQ ID NO: 2021524 - RNA, 23 nt, Homo sapiens
gggcagaguuucugcaguuccau

SEQ ID NO: 2021525 - RNA, 19 nt, Homo sapiens
agcaaaacuggacaauguc

SEQ ID NO: 2021526 - RNA, 20 nt, Homo sapiens
ccucaaaaaauugcacauag

SEQ ID NO: 2021527 - RNA, 21 nt, Homo sapiens
guuucccauuuguugcugcug

SEQ ID NO: 2021528 - RNA, 18 nt, Homo sapiens
uaaaaauccacuauuucc

SEQ ID NO: 2021529 - RNA, 20 nt, Homo sapiens
uugaagggcaggugcuucag

SEQ ID NO: 2021530 - RNA, 17 nt, Homo sapiens
cgcugccucaacacuga

SEQ ID NO: 2021531 - RNA, 19 nt, Homo sapiens
cucagagcaggggccagau

SEQ ID NO: 2021532 - RNA, 16 nt, Homo sapiens
uugaaaaaguguacau

SEQ ID NO: 2021533 - RNA, 20 nt, Homo sapiens
aaugccaggcagaaaacugg

SEQ ID NO: 2021534 - RNA, 12 nt, Homo sapiens
uauuguaccuaa

SEQ ID NO: 2021535 - RNA, 22 nt, Homo sapiens
auuagaacuucaagcucuccaa

SEQ ID NO: 2021536 - RNA, 20 nt, Homo sapiens
uuaccacugugguuuugacu

SEQ ID NO: 2021537 - RNA, 17 nt, Homo sapiens
agaugggagccuuuacc

SEQ ID NO: 2021538 - RNA, 21 nt, Homo sapiens
gggcgugccuggcgcccagug

SEQ ID NO: 2021539 - RNA, 19 nt, Homo sapiens
ccaucauccuuuguucuga

SEQ ID NO: 2021540 - RNA, 15 nt, Homo sapiens
ucugcaaaaugucau

SEQ ID NO: 2021541 - RNA, 16 nt, Homo sapiens
cagcaagccaugcccc

SEQ ID NO: 2021542 - RNA, 14 nt, Homo sapiens
caacaguuaccucc

SEQ ID NO: 2021543 - RNA, 18 nt, Homo sapiens
aucacccuucccugcucc

SEQ ID NO: 2021544 - RNA, 20 nt, Homo sapiens
aaacaaaaaaagcaucucac

SEQ ID NO: 2021545 - RNA, 22 nt, Homo sapiens
caaucacguugaaacaagugca

SEQ ID NO: 2021546 - RNA, 20 nt, Homo sapiens
uuuaagcuuuccuguugaau

SEQ ID NO: 2021547 - RNA, 18 nt, Homo sapiens
uagcagaaugugcuucuc

SEQ ID NO: 2021548 - RNA, 20 nt, Homo sapiens
uacacugugauaaguucuuu

SEQ ID NO: 2021549 - RNA, 13 nt, Homo sapiens
guucuuagcugaa

SEQ ID NO: 2021550 - RNA, 19 nt, Homo sapiens
gccaggcugcccaucaggg

SEQ ID NO: 2021551 - RNA, 15 nt, Homo sapiens
accaaaacuauucca

SEQ ID NO: 2021552 - RNA, 15 nt, Homo sapiens
cucugggucuuggcc

SEQ ID NO: 2021553 - RNA, 21 nt, Homo sapiens
aggaggccacaugauacuuau

SEQ ID NO: 2021554 - RNA, 18 nt, Homo sapiens
guccccuccccucucagc

SEQ ID NO: 2021555 - RNA, 23 nt, Homo sapiens
uggggcuuuaacuccugcuagaa

SEQ ID NO: 2021556 - RNA, 20 nt, Homo sapiens
gcccaggucucucaacuuca

SEQ ID NO: 2021557 - RNA, 21 nt, Homo sapiens
cagacaucaagcucaaggcaa

SEQ ID NO: 2021558 - RNA, 18 nt, Homo sapiens
cuagccccgagacaccau

SEQ ID NO: 2021559 - RNA, 15 nt, Homo sapiens
cugaaugguuuucaa

SEQ ID NO: 2021560 - RNA, 12 nt, Homo sapiens
ggauaugcugcu

SEQ ID NO: 2021561 - RNA, 15 nt, Homo sapiens
gaaacauuguuaaua

SEQ ID NO: 2021562 - RNA, 20 nt, Homo sapiens
acuuaucugagucacuugaa

SEQ ID NO: 2021563 - RNA, 15 nt, Homo sapiens
cccacauuuuccuua

SEQ ID NO: 2021564 - RNA, 22 nt, Homo sapiens
ucaucccacccucucacaguuc

SEQ ID NO: 2021565 - RNA, 16 nt, Homo sapiens
caggucugaugccaaa

SEQ ID NO: 2021566 - RNA, 16 nt, Homo sapiens
cacaaaaugucucagu

SEQ ID NO: 2021567 - RNA, 16 nt, Homo sapiens
ggauauaggucaguga

SEQ ID NO: 2021568 - RNA, 13 nt, Homo sapiens
uauguauggaaua

SEQ ID NO: 2021569 - RNA, 16 nt, Homo sapiens
ucccaucucacacaug

SEQ ID NO: 2021570 - RNA, 13 nt, Homo sapiens
uccccguccacag

SEQ ID NO: 2021571 - RNA, 20 nt, Homo sapiens
caaagaacugccccaucucc

SEQ ID NO: 2021572 - RNA, 20 nt, Homo sapiens
uacccaccgcccuugccgaa

SEQ ID NO: 2021573 - RNA, 13 nt, Homo sapiens
gcgcacuuaccug

SEQ ID NO: 2021574 - RNA, 19 nt, Homo sapiens
augaacuuggauauucaag

SEQ ID NO: 2021575 - RNA, 19 nt, Homo sapiens
gccugggacagccacugga

SEQ ID NO: 2021576 - RNA, 14 nt, Homo sapiens
cugggcagacuuga

SEQ ID NO: 2021577 - RNA, 14 nt, Homo sapiens
uuuugaauugucaa

SEQ ID NO: 2021578 - RNA, 17 nt, Homo sapiens
ccuuuguccugcguuuu

SEQ ID NO: 2021579 - RNA, 21 nt, Homo sapiens
aggaagcuuggcugcucaguu

SEQ ID NO: 2021580 - RNA, 18 nt, Homo sapiens
cccuccugaggucuggau

SEQ ID NO: 2021581 - RNA, 19 nt, Homo sapiens
uagaauuaguggcacuugc

SEQ ID NO: 2021582 - RNA, 15 nt, Homo sapiens
cuuuuauuuucacag

SEQ ID NO: 2021583 - RNA, 17 nt, Homo sapiens
cuuucauaaagucuugc

SEQ ID NO: 2021584 - RNA, 18 nt, Homo sapiens
aucccuggggcugugcau

SEQ ID NO: 2021585 - RNA, 22 nt, Homo sapiens
gccuguaauccuagcacuuugg

SEQ ID NO: 2021586 - RNA, 19 nt, Homo sapiens
ccagccugaggcagccacu

SEQ ID NO: 2021587 - RNA, 22 nt, Homo sapiens
cacaccccagacgaugucuuca

SEQ ID NO: 2021588 - RNA, 21 nt, Homo sapiens
cagccaaucuggacacuucuu

SEQ ID NO: 2021589 - RNA, 19 nt, Homo sapiens
aaaaugcaaagcugaagac

SEQ ID NO: 2021590 - RNA, 16 nt, Homo sapiens
gcucuuucucugccag

SEQ ID NO: 2021591 - RNA, 14 nt, Homo sapiens
ucacacccuaauaa

SEQ ID NO: 2021592 - RNA, 21 nt, Homo sapiens
cuguauuuucgggauucuuug

SEQ ID NO: 2021593 - RNA, 18 nt, Homo sapiens
aauuguaucaaaugugac

SEQ ID NO: 2021594 - RNA, 20 nt, Homo sapiens
guggguacccccaggaccag

SEQ ID NO: 2021595 - RNA, 18 nt, Homo sapiens
ggccaggggaguuuccaa

SEQ ID NO: 2021596 - RNA, 22 nt, Homo sapiens
gcuuaguccaauuccuugcaca

SEQ ID NO: 2021597 - RNA, 22 nt, Homo sapiens
uuaucaagcauuuaccaugugc

SEQ ID NO: 2021598 - RNA, 15 nt, Homo sapiens
cggcccagggagggu

SEQ ID NO: 2021599 - RNA, 22 nt, Homo sapiens
ugcuaacccccaaauacucuga

SEQ ID NO: 2021600 - RNA, 23 nt, Homo sapiens
agauacaaccuuuuuauuuucac

SEQ ID NO: 2021601 - RNA, 20 nt, Homo sapiens
aaaaccagucuguguuuaca

SEQ ID NO: 2021602 - RNA, 21 nt, Homo sapiens
aagacauauaacgcagucuaa

SEQ ID NO: 2021603 - RNA, 17 nt, Homo sapiens
ugcaaaguuacagaugc

SEQ ID NO: 2021604 - RNA, 18 nt, Homo sapiens
uuguaaaccggcuggacc

SEQ ID NO: 2021605 - RNA, 19 nt, Homo sapiens
auucaccaauuuccuuuaa

SEQ ID NO: 2021606 - RNA, 17 nt, Homo sapiens
cuuacccucucuuucaa

SEQ ID NO: 2021607 - RNA, 23 nt, Homo sapiens
uugcuguggacuauuauuacaua

SEQ ID NO: 2021608 - RNA, 15 nt, Homo sapiens
cucgcccaacuccac

SEQ ID NO: 2021609 - RNA, 14 nt, Homo sapiens
aagccaagcaaacc

SEQ ID NO: 2021610 - RNA, 15 nt, Homo sapiens
uuuaauccuaccuca

SEQ ID NO: 2021611 - RNA, 12 nt, Homo sapiens
uaauaacauaca

SEQ ID NO: 2021612 - RNA, 12 nt, Homo sapiens
ugcuaacaugaa

SEQ ID NO: 2021613 - RNA, 14 nt, Homo sapiens
uaaaucccaagugu

SEQ ID NO: 2021614 - RNA, 18 nt, Homo sapiens
ggguggcaggugaccuuc

SEQ ID NO: 2021615 - RNA, 14 nt, Homo sapiens
ucucgccaucagcu

SEQ ID NO: 2021616 - RNA, 22 nt, Homo sapiens
uagagaaggaaagcuuuggcag

SEQ ID NO: 2021617 - RNA, 19 nt, Homo sapiens
uuuuuaguagagauggggu

SEQ ID NO: 2021618 - RNA, 22 nt, Homo sapiens
acagaucaagugaacauuacau

SEQ ID NO: 2021619 - RNA, 12 nt, Homo sapiens
uauaacccaaaa

SEQ ID NO: 2021620 - RNA, 18 nt, Homo sapiens
augauauuccccauuucc

SEQ ID NO: 2021621 - RNA, 19 nt, Homo sapiens
cuuugcaguuggacucuca

SEQ ID NO: 2021622 - RNA, 19 nt, Homo sapiens
cuuuacuguuagucauuug

SEQ ID NO: 2021623 - RNA, 24 nt, Homo sapiens
cacauagagauaugcacacacaga

SEQ ID NO: 2021624 - RNA, 13 nt, Homo sapiens
gaccacaacuauu

SEQ ID NO: 2021625 - RNA, 19 nt, Homo sapiens
aauuugauugcuuugcugc

SEQ ID NO: 2021626 - RNA, 14 nt, Homo sapiens
guccgcaccagcug

SEQ ID NO: 2021627 - RNA, 16 nt, Homo sapiens
gugucuggacauucag

SEQ ID NO: 2021628 - RNA, 16 nt, Homo sapiens
uuccuuuccucuggcc

SEQ ID NO: 2021629 - RNA, 15 nt, Homo sapiens
ucuaaaaugauacug

SEQ ID NO: 2021630 - RNA, 12 nt, Homo sapiens
aagcaugcugag

SEQ ID NO: 2021631 - RNA, 17 nt, Homo sapiens
ucacccgggacucuccc

SEQ ID NO: 2021632 - RNA, 16 nt, Homo sapiens
ggaagccagcagggaa

SEQ ID NO: 2021633 - RNA, 18 nt, Homo sapiens
agcugugacauauucuga

SEQ ID NO: 2021634 - RNA, 18 nt, Homo sapiens
agccuauugcaacaaagu

SEQ ID NO: 2021635 - RNA, 19 nt, Homo sapiens
aggcaccugcuggaaacca

SEQ ID NO: 2021636 - RNA, 20 nt, Homo sapiens
ggcuuuaauagucaccuuca

SEQ ID NO: 2021637 - RNA, 20 nt, Homo sapiens
augccccauuggauuacuuu

SEQ ID NO: 2021638 - RNA, 17 nt, Homo sapiens
cucgcuucauaggcaga

SEQ ID NO: 2021639 - RNA, 20 nt, Homo sapiens
cugcaucaucaucacaaccu

SEQ ID NO: 2021640 - RNA, 22 nt, Homo sapiens
ugggcgcuguuuucucagcucc

SEQ ID NO: 2021641 - RNA, 16 nt, Homo sapiens
guagccagucuagaca

SEQ ID NO: 2021642 - RNA, 16 nt, Homo sapiens
caggaagaaggacuug

SEQ ID NO: 2021643 - RNA, 19 nt, Homo sapiens
ggaauuuucagucaucuca

SEQ ID NO: 2021644 - RNA, 17 nt, Homo sapiens
ucaguaaauuuuggaaa

SEQ ID NO: 2021645 - RNA, 21 nt, Homo sapiens
caugcuuaauaaacaugucac

SEQ ID NO: 2021646 - RNA, 21 nt, Homo sapiens
gguuggcugggcccagaaggu

SEQ ID NO: 2021647 - RNA, 14 nt, Homo sapiens
cacacacgaugcau

SEQ ID NO: 2021648 - RNA, 17 nt, Homo sapiens
gcacugcucccuacccc

SEQ ID NO: 2021649 - RNA, 18 nt, Homo sapiens
ggucagggcucagaguga

SEQ ID NO: 2021650 - RNA, 13 nt, Homo sapiens
gguggcacuuuuu

SEQ ID NO: 2021651 - RNA, 15 nt, Homo sapiens
gaaagcucuaaagac

SEQ ID NO: 2021652 - RNA, 14 nt, Homo sapiens
uuuucccccuauca

SEQ ID NO: 2021653 - RNA, 14 nt, Homo sapiens
caagacccuaugaa

SEQ ID NO: 2021654 - RNA, 19 nt, Homo sapiens
cagcaaggauggagcugaa

SEQ ID NO: 2021655 - RNA, 19 nt, Homo sapiens
cuuuuaauuuaaaaacaca

SEQ ID NO: 2021656 - RNA, 14 nt, Homo sapiens
gugcuguaauuuaa

SEQ ID NO: 2021657 - RNA, 22 nt, Homo sapiens
auaaaugacaagcaaagaauga

SEQ ID NO: 2021658 - RNA, 20 nt, Homo sapiens
ugcugcccagcagccccuga

SEQ ID NO: 2021659 - RNA, 16 nt, Homo sapiens
ucucagcaggcaaaga

SEQ ID NO: 2021660 - RNA, 16 nt, Homo sapiens
auaaaucuaaagucua

SEQ ID NO: 2021661 - RNA, 17 nt, Homo sapiens
gaacuaccccacaacac

SEQ ID NO: 2021662 - RNA, 21 nt, Homo sapiens
agucacgccugaaacuuugag

SEQ ID NO: 2021663 - RNA, 23 nt, Homo sapiens
ccgcgugaucaaagccacacucu

SEQ ID NO: 2021664 - RNA, 19 nt, Homo sapiens
auaaaacuuuuccaaugac

SEQ ID NO: 2021665 - RNA, 16 nt, Homo sapiens
acuguggugugcagug

SEQ ID NO: 2021666 - RNA, 15 nt, Homo sapiens
auuaaaugacacuca

SEQ ID NO: 2021667 - RNA, 22 nt, Homo sapiens
ugucuccuccagcgugguggaa

SEQ ID NO: 2021668 - RNA, 15 nt, Homo sapiens
caaggcagaaagaua

SEQ ID NO: 2021669 - RNA, 20 nt, Homo sapiens
ggaugauuauuuucuguucu

SEQ ID NO: 2021670 - RNA, 18 nt, Homo sapiens
gacuccccccuuccaaau

SEQ ID NO: 2021671 - RNA, 20 nt, Homo sapiens
ugugaaacauuuuuucuucu

SEQ ID NO: 2021672 - RNA, 13 nt, Homo sapiens
cacagugugcucc

SEQ ID NO: 2021673 - RNA, 15 nt, Homo sapiens
uucuuacacauacag

SEQ ID NO: 2021674 - RNA, 22 nt, Homo sapiens
cauauguauuuuugucauagca

SEQ ID NO: 2021675 - RNA, 18 nt, Homo sapiens
ugcauccguaguucccug

SEQ ID NO: 2021676 - RNA, 17 nt, Homo sapiens
acagccucagcacaucc

SEQ ID NO: 2021677 - RNA, 13 nt, Homo sapiens
cuaagaucuugcc

SEQ ID NO: 2021678 - RNA, 21 nt, Homo sapiens
ugggcccacccggugggaccc

SEQ ID NO: 2021679 - RNA, 17 nt, Homo sapiens
cccaagugccaagacac

SEQ ID NO: 2021680 - RNA, 21 nt, Homo sapiens
cuucuaccccaccugaccucu

SEQ ID NO: 2021681 - RNA, 19 nt, Homo sapiens
acuacauuggaagcuuuga

SEQ ID NO: 2021682 - RNA, 18 nt, Homo sapiens
accuguaauccuagcacu

SEQ ID NO: 2021683 - RNA, 14 nt, Homo sapiens
agccagcccugccu

SEQ ID NO: 2021684 - RNA, 15 nt, Homo sapiens
aaaugacaaagccau

SEQ ID NO: 2021685 - RNA, 21 nt, Homo sapiens
uaauuggaagaaauuccugua

SEQ ID NO: 2021686 - RNA, 23 nt, Homo sapiens
auuugaauuuuguguuagagauu

SEQ ID NO: 2021687 - RNA, 17 nt, Homo sapiens
uuuucucuaacuucuca

SEQ ID NO: 2021688 - RNA, 13 nt, Homo sapiens
acuuacauuccag

SEQ ID NO: 2021689 - RNA, 21 nt, Homo sapiens
ugccccaucccaugcugucca

SEQ ID NO: 2021690 - RNA, 12 nt, Homo sapiens
aucucugggcug

SEQ ID NO: 2021691 - RNA, 18 nt, Homo sapiens
ugggguaguuguguuuca

SEQ ID NO: 2021692 - RNA, 20 nt, Homo sapiens
accuucacgauuaacuguga

SEQ ID NO: 2021693 - RNA, 16 nt, Homo sapiens
ucaaauaucuaagcaa

SEQ ID NO: 2021694 - RNA, 18 nt, Homo sapiens
auacauggguagcuucug

SEQ ID NO: 2021695 - RNA, 17 nt, Homo sapiens
aucuccauaaacaugaa

SEQ ID NO: 2021696 - RNA, 14 nt, Homo sapiens
ccuagauaugaaua

SEQ ID NO: 2021697 - RNA, 17 nt, Homo sapiens
ugcccuuuuaauacagg

SEQ ID NO: 2021698 - RNA, 22 nt, Homo sapiens
uauccuuugugagccuaugaua

SEQ ID NO: 2021699 - RNA, 12 nt, Homo sapiens
gcuucucaaagu

SEQ ID NO: 2021700 - RNA, 20 nt, Homo sapiens
auauuuuucccaggacuaga

SEQ ID NO: 2021701 - RNA, 16 nt, Homo sapiens
uaucuuaaagcacuua

SEQ ID NO: 2021702 - RNA, 13 nt, Homo sapiens
aucuguucauuca

SEQ ID NO: 2021703 - RNA, 17 nt, Homo sapiens
cauaguaguaugaugau

SEQ ID NO: 2021704 - RNA, 15 nt, Homo sapiens
gaauauaaauaucac

SEQ ID NO: 2021705 - RNA, 12 nt, Homo sapiens
agcgauucucau

SEQ ID NO: 2021706 - RNA, 17 nt, Homo sapiens
auaaguuuuagaaucuu

SEQ ID NO: 2021707 - RNA, 13 nt, Homo sapiens
agcuaaacugaau

SEQ ID NO: 2021708 - RNA, 15 nt, Homo sapiens
caaugcacacaaaac

SEQ ID NO: 2021709 - RNA, 14 nt, Homo sapiens
cagaggugcagcug

SEQ ID NO: 2021710 - RNA, 17 nt, Homo sapiens
ucaauuucucugaggac

SEQ ID NO: 2021711 - RNA, 23 nt, Homo sapiens
caauuccuccagagacacugagc

SEQ ID NO: 2021712 - RNA, 18 nt, Homo sapiens
gccugccgcugcaccugc

SEQ ID NO: 2021713 - RNA, 20 nt, Homo sapiens
agacuauggagccuggcaca

SEQ ID NO: 2021714 - RNA, 19 nt, Homo sapiens
uaaggugcaauaagaauuu

SEQ ID NO: 2021715 - RNA, 20 nt, Homo sapiens
acugagccuccacagcagug

SEQ ID NO: 2021716 - RNA, 20 nt, Homo sapiens
gacucugguggcugccagcu

SEQ ID NO: 2021717 - RNA, 22 nt, Homo sapiens
aagaaacagauaccauacucau

SEQ ID NO: 2021718 - RNA, 17 nt, Homo sapiens
gauggagggacuggggu

SEQ ID NO: 2021719 - RNA, 17 nt, Homo sapiens
uuucaccacaugugcac

SEQ ID NO: 2021720 - RNA, 18 nt, Homo sapiens
augcagccuucuuuucaa

SEQ ID NO: 2021721 - RNA, 23 nt, Homo sapiens
aagcuccggauggaggccagcua

SEQ ID NO: 2021722 - RNA, 16 nt, Homo sapiens
ucuucugagcacagau

SEQ ID NO: 2021723 - RNA, 18 nt, Homo sapiens
aauucuaaauaaugcaaa

SEQ ID NO: 2021724 - RNA, 12 nt, Homo sapiens
augaaucacugc

SEQ ID NO: 2021725 - RNA, 19 nt, Homo sapiens
aauugcaccugaaaaaccu

SEQ ID NO: 2021726 - RNA, 15 nt, Homo sapiens
aaugcuaaacagaug

SEQ ID NO: 2021727 - RNA, 23 nt, Homo sapiens
cgcccagugcagucggugguacc

SEQ ID NO: 2021728 - RNA, 15 nt, Homo sapiens
gucacagaagcagcu

SEQ ID NO: 2021729 - RNA, 18 nt, Homo sapiens
gcaguuuuuuucuugucu

SEQ ID NO: 2021730 - RNA, 14 nt, Homo sapiens
uaaaauagucucau

SEQ ID NO: 2021731 - RNA, 23 nt, Homo sapiens
cagcauuuagugaaguugugcaa

SEQ ID NO: 2021732 - RNA, 20 nt, Homo sapiens
aggucaucggcguggcccaa

SEQ ID NO: 2021733 - RNA, 21 nt, Homo sapiens
ccagcuacucaggaggcugag

SEQ ID NO: 2021734 - RNA, 13 nt, Homo sapiens
agaaaaccuggag

SEQ ID NO: 2021735 - RNA, 17 nt, Homo sapiens
auuuauuuuccagcuua

SEQ ID NO: 2021736 - RNA, 13 nt, Homo sapiens
gcgccaagacuca

SEQ ID NO: 2021737 - RNA, 23 nt, Homo sapiens
gucucacuacuugaccauucuca

SEQ ID NO: 2021738 - RNA, 19 nt, Homo sapiens
cgaagucgccacguggccu

SEQ ID NO: 2021739 - RNA, 14 nt, Homo sapiens
agaaagaaagggaa

SEQ ID NO: 2021740 - RNA, 23 nt, Homo sapiens
uaaaaacccuguauggcacuuau

SEQ ID NO: 2021741 - RNA, 14 nt, Homo sapiens
ucuaguggccuuag

SEQ ID NO: 2021742 - RNA, 14 nt, Homo sapiens
cuuguaaagacaga

SEQ ID NO: 2021743 - RNA, 21 nt, Homo sapiens
gauucagauauaaauguuuaa

SEQ ID NO: 2021744 - RNA, 13 nt, Homo sapiens
aaaagcauuuucu

SEQ ID NO: 2021745 - RNA, 18 nt, Homo sapiens
uagugauagagugcagug

SEQ ID NO: 2021746 - RNA, 15 nt, Homo sapiens
ugcgcucugccauuc

SEQ ID NO: 2021747 - RNA, 16 nt, Homo sapiens
ccaucccagcacugca

SEQ ID NO: 2021748 - RNA, 15 nt, Homo sapiens
ucuaguucagagcca

SEQ ID NO: 2021749 - RNA, 14 nt, Homo sapiens
ccucuacaggcauu

SEQ ID NO: 2021750 - RNA, 20 nt, Homo sapiens
aagaauaaaaugcagugaaa

SEQ ID NO: 2021751 - RNA, 19 nt, Homo sapiens
caggaugaaggcgugcaag

SEQ ID NO: 2021752 - RNA, 13 nt, Homo sapiens
uuugguuucucaa

SEQ ID NO: 2021753 - RNA, 18 nt, Homo sapiens
ggcuauauauacuggaag

SEQ ID NO: 2021754 - RNA, 22 nt, Homo sapiens
cgaucuuugaauauacuuaccu

SEQ ID NO: 2021755 - RNA, 19 nt, Homo sapiens
caaguggcaugugcuguga

SEQ ID NO: 2021756 - RNA, 18 nt, Homo sapiens
gauugcagagugaccagc

SEQ ID NO: 2021757 - RNA, 17 nt, Homo sapiens
uggagcaaccuacuguc

SEQ ID NO: 2021758 - RNA, 21 nt, Homo sapiens
ccugcccuuaccugccaggaa

SEQ ID NO: 2021759 - RNA, 20 nt, Homo sapiens
agugacagcuugaguggguu

SEQ ID NO: 2021760 - RNA, 17 nt, Homo sapiens
gagugauaugauccaga

SEQ ID NO: 2021761 - RNA, 22 nt, Homo sapiens
ccgugacagcccgcaggaucag

SEQ ID NO: 2021762 - RNA, 11 nt, Homo sapiens
cucuccaaagg

SEQ ID NO: 2021763 - RNA, 11 nt, Homo sapiens
cguggauuuua

SEQ ID NO: 2021764 - RNA, 16 nt, Homo sapiens
auuuauggaacuuccc

SEQ ID NO: 2021765 - RNA, 19 nt, Homo sapiens
auuagaaaauuuuauggac

SEQ ID NO: 2021766 - RNA, 20 nt, Homo sapiens
ggagccagcucccagcccac

SEQ ID NO: 2021767 - RNA, 21 nt, Homo sapiens
gggaacauaaaaacuacugaa

SEQ ID NO: 2021768 - RNA, 15 nt, Homo sapiens
cuaaguuauuguuaa

SEQ ID NO: 2021769 - RNA, 22 nt, Homo sapiens
ugaaucugggguuuccaucaga

SEQ ID NO: 2021770 - RNA, 13 nt, Homo sapiens
uccucugacucag

SEQ ID NO: 2021771 - RNA, 23 nt, Homo sapiens
ugaacacacauggaugcacacac

SEQ ID NO: 2021772 - RNA, 20 nt, Homo sapiens
agugaaaauuuuuacauuca

SEQ ID NO: 2021773 - RNA, 17 nt, Homo sapiens
auggcaggcaucgccau

SEQ ID NO: 2021774 - RNA, 19 nt, Homo sapiens
uauacauuuuacauaugga

SEQ ID NO: 2021775 - RNA, 23 nt, Homo sapiens
uucugugcagagaugacugucca

SEQ ID NO: 2021776 - RNA, 15 nt, Homo sapiens
uaauguuuacuauau

SEQ ID NO: 2021777 - RNA, 17 nt, Homo sapiens
uugaccgggagacagag

SEQ ID NO: 2021778 - RNA, 17 nt, Homo sapiens
cagugaugcugugcuau

SEQ ID NO: 2021779 - RNA, 14 nt, Homo sapiens
uggcaaugggacuc

SEQ ID NO: 2021780 - RNA, 19 nt, Homo sapiens
auagacuggauggaaagac

SEQ ID NO: 2021781 - RNA, 20 nt, Homo sapiens
acuguuuaauugacauacuc

SEQ ID NO: 2021782 - RNA, 20 nt, Homo sapiens
acacauaaaagcacaaagac

SEQ ID NO: 2021783 - RNA, 13 nt, Homo sapiens
acaacuuagcuca

SEQ ID NO: 2021784 - RNA, 17 nt, Homo sapiens
guaaaauggaggccauu

SEQ ID NO: 2021785 - RNA, 17 nt, Homo sapiens
ugcaggggccacaucca

SEQ ID NO: 2021786 - RNA, 21 nt, Homo sapiens
uccaggagcagcgugcaggag

SEQ ID NO: 2021787 - RNA, 14 nt, Homo sapiens
aucuacacuccagu

SEQ ID NO: 2021788 - RNA, 22 nt, Homo sapiens
ucuugggccaagccagcugccu

SEQ ID NO: 2021789 - RNA, 18 nt, Homo sapiens
aauaaaccgaaaguguua

SEQ ID NO: 2021790 - RNA, 15 nt, Homo sapiens
auuauucccauucua

SEQ ID NO: 2021791 - RNA, 18 nt, Homo sapiens
cuuaguaaucccccuugc

SEQ ID NO: 2021792 - RNA, 18 nt, Homo sapiens
gagaaggaaaagacugaa

SEQ ID NO: 2021793 - RNA, 16 nt, Homo sapiens
aaccuguaauaaauau

SEQ ID NO: 2021794 - RNA, 15 nt, Homo sapiens
ucgggcuucaccgcc

SEQ ID NO: 2021795 - RNA, 17 nt, Homo sapiens
caccagcggccuugaag

SEQ ID NO: 2021796 - RNA, 14 nt, Homo sapiens
ccuuuccucaaaac

SEQ ID NO: 2021797 - RNA, 14 nt, Homo sapiens
aauuuucuacaaau

SEQ ID NO: 2021798 - RNA, 17 nt, Homo sapiens
cccaucaauucuuagaa

SEQ ID NO: 2021799 - RNA, 14 nt, Homo sapiens
uaacuuuuugccaa

SEQ ID NO: 2021800 - RNA, 22 nt, Homo sapiens
uucaauuucccacccaucucca

SEQ ID NO: 2021801 - RNA, 19 nt, Homo sapiens
aauuaaagggcagauauuc

SEQ ID NO: 2021802 - RNA, 15 nt, Homo sapiens
cuugaagcugcucac

SEQ ID NO: 2021803 - RNA, 19 nt, Homo sapiens
uuccaccaggccgugccuu

SEQ ID NO: 2021804 - RNA, 11 nt, Homo sapiens
auuccucagau

SEQ ID NO: 2021805 - RNA, 15 nt, Homo sapiens
auauugcuucccugc

SEQ ID NO: 2021806 - RNA, 12 nt, Homo sapiens
guaucugucaca

SEQ ID NO: 2021807 - RNA, 17 nt, Homo sapiens
uuccucuuaauucccaa

SEQ ID NO: 2021808 - RNA, 22 nt, Homo sapiens
uuuuaacuucuugucuauaguu

SEQ ID NO: 2021809 - RNA, 13 nt, Homo sapiens
ccuuuguguaaua

SEQ ID NO: 2021810 - RNA, 13 nt, Homo sapiens
ucaaugugcauaa

SEQ ID NO: 2021811 - RNA, 14 nt, Homo sapiens
uaauucagguacca

SEQ ID NO: 2021812 - RNA, 14 nt, Homo sapiens
auaaagccacuuuc

SEQ ID NO: 2021813 - RNA, 17 nt, Homo sapiens
gucucagugcuauccua

SEQ ID NO: 2021814 - RNA, 22 nt, Homo sapiens
ccuguguuuuucuuugggucua

SEQ ID NO: 2021815 - RNA, 15 nt, Homo sapiens
agggcagaggccaug

SEQ ID NO: 2021816 - RNA, 21 nt, Homo sapiens
agagucgcaucucagugcagg

SEQ ID NO: 2021817 - RNA, 13 nt, Homo sapiens
uagcacugggaac

SEQ ID NO: 2021818 - RNA, 21 nt, Homo sapiens
agccugcucccccacccccuc

SEQ ID NO: 2021819 - RNA, 14 nt, Homo sapiens
cugucggugggacc

SEQ ID NO: 2021820 - RNA, 21 nt, Homo sapiens
ugcuuaauuuaaauagcauua

SEQ ID NO: 2021821 - RNA, 17 nt, Homo sapiens
cucuaccugcacacugu

SEQ ID NO: 2021822 - RNA, 22 nt, Homo sapiens
cuuuaguuuuugugaaguuuaa

SEQ ID NO: 2021823 - RNA, 16 nt, Homo sapiens
cuguggguauucacca

SEQ ID NO: 2021824 - RNA, 18 nt, Homo sapiens
auagauuaauggcacuga

SEQ ID NO: 2021825 - RNA, 15 nt, Homo sapiens
gcugcuaaaggacag

SEQ ID NO: 2021826 - RNA, 19 nt, Homo sapiens
cagugccaaaaacaacaac

SEQ ID NO: 2021827 - RNA, 23 nt, Homo sapiens
agcuauguggcugcugcugccac

SEQ ID NO: 2021828 - RNA, 21 nt, Homo sapiens
aacacugagaaaaagcauuaa

SEQ ID NO: 2021829 - RNA, 23 nt, Homo sapiens
uguuaaugagaaaauggcuuuaa

SEQ ID NO: 2021830 - RNA, 19 nt, Homo sapiens
gaacaguuuuuaagcuaua

SEQ ID NO: 2021831 - RNA, 13 nt, Homo sapiens
cucucucuuauca

SEQ ID NO: 2021832 - RNA, 13 nt, Homo sapiens
acuggaagcacag

SEQ ID NO: 2021833 - RNA, 15 nt, Homo sapiens
auacugcccaaggau

SEQ ID NO: 2021834 - RNA, 15 nt, Homo sapiens
uccauugauucaggg

SEQ ID NO: 2021835 - RNA, 15 nt, Homo sapiens
ugugcgccuacagga

SEQ ID NO: 2021836 - RNA, 13 nt, Homo sapiens
acgauuucagcua

SEQ ID NO: 2021837 - RNA, 19 nt, Homo sapiens
aaacugacgcuagucaaua

SEQ ID NO: 2021838 - RNA, 18 nt, Homo sapiens
ccuaggccaaaugcacaa

SEQ ID NO: 2021839 - RNA, 19 nt, Homo sapiens
ccuccugauaguaguaaaa

SEQ ID NO: 2021840 - RNA, 19 nt, Homo sapiens
uugcuguccugaucuguga

SEQ ID NO: 2021841 - RNA, 14 nt, Homo sapiens
uuccuucuguugcu

SEQ ID NO: 2021842 - RNA, 23 nt, Homo sapiens
caagucgcuccuagguucuuaag

SEQ ID NO: 2021843 - RNA, 16 nt, Homo sapiens
gaaggcagccaccagc

SEQ ID NO: 2021844 - RNA, 13 nt, Homo sapiens
gcucacuugccuu

SEQ ID NO: 2021845 - RNA, 15 nt, Homo sapiens
uucacuugccaugca

SEQ ID NO: 2021846 - RNA, 22 nt, Homo sapiens
ugaagugugcacguugcuucag

SEQ ID NO: 2021847 - RNA, 12 nt, Homo sapiens
gccuugaugaag

SEQ ID NO: 2021848 - RNA, 17 nt, Homo sapiens
uagaauuggagaguaaa

SEQ ID NO: 2021849 - RNA, 22 nt, Homo sapiens
uucuacauuauucuucacuuaa

SEQ ID NO: 2021850 - RNA, 14 nt, Homo sapiens
ccuaugcugcaaua

SEQ ID NO: 2021851 - RNA, 14 nt, Homo sapiens
ccagugcugcugua

SEQ ID NO: 2021852 - RNA, 14 nt, Homo sapiens
auugaacucugaga

SEQ ID NO: 2021853 - RNA, 13 nt, Homo sapiens
uuuuauauguugc

SEQ ID NO: 2021854 - RNA, 19 nt, Homo sapiens
aggcugugcaccuauucug

SEQ ID NO: 2021855 - RNA, 23 nt, Homo sapiens
aaaauauauaugugcaguauuuu

SEQ ID NO: 2021856 - RNA, 17 nt, Homo sapiens
ugaucucuguuacaaaa

SEQ ID NO: 2021857 - RNA, 21 nt, Homo sapiens
gaggagcagccucgaggcugg

SEQ ID NO: 2021858 - RNA, 17 nt, Homo sapiens
cucucauuucaagcaga

SEQ ID NO: 2021859 - RNA, 12 nt, Homo sapiens
ccagaacccaga

SEQ ID NO: 2021860 - RNA, 11 nt, Homo sapiens
aaucagggugg

SEQ ID NO: 2021861 - RNA, 22 nt, Homo sapiens
cacgcagucugcuucagugcag

SEQ ID NO: 2021862 - RNA, 21 nt, Homo sapiens
ucuaaugacacgguaggccaa

SEQ ID NO: 2021863 - RNA, 21 nt, Homo sapiens
uggagaugucuucguacaguu

SEQ ID NO: 2021864 - RNA, 22 nt, Homo sapiens
auuuaccuguuuuucaguauuu

SEQ ID NO: 2021865 - RNA, 16 nt, Homo sapiens
uaauagaaacauugaa

SEQ ID NO: 2021866 - RNA, 19 nt, Homo sapiens
ccucuuuccuccucaugaa

SEQ ID NO: 2021867 - RNA, 15 nt, Homo sapiens
uggaugugcauuucu

SEQ ID NO: 2021868 - RNA, 23 nt, Homo sapiens
guaaaaauuuuuuugcauuuuca

SEQ ID NO: 2021869 - RNA, 16 nt, Homo sapiens
aacagauguagcaaca

SEQ ID NO: 2021870 - RNA, 19 nt, Homo sapiens
acagcaugugcaauaugcc

SEQ ID NO: 2021871 - RNA, 13 nt, Homo sapiens
ucaaggaagucuu

SEQ ID NO: 2021872 - RNA, 22 nt, Homo sapiens
acccuggauugaaagugaaaau

SEQ ID NO: 2021873 - RNA, 20 nt, Homo sapiens
aaaagcccaccugaaagccu

SEQ ID NO: 2021874 - RNA, 20 nt, Homo sapiens
caaauaggagugaguguaug

SEQ ID NO: 2021875 - RNA, 12 nt, Homo sapiens
ucaagguggcug

SEQ ID NO: 2021876 - RNA, 15 nt, Homo sapiens
gcugccuguggugag

SEQ ID NO: 2021877 - RNA, 22 nt, Homo sapiens
gauuuuaaaaaauguuaugcag

SEQ ID NO: 2021878 - RNA, 15 nt, Homo sapiens
gcuccaucaaugagg

SEQ ID NO: 2021879 - RNA, 18 nt, Homo sapiens
cauuuguuuuguuuacag

SEQ ID NO: 2021880 - RNA, 13 nt, Homo sapiens
guuguuguuguug

SEQ ID NO: 2021881 - RNA, 22 nt, Homo sapiens
uaucuugcgaauccaagcuccc

SEQ ID NO: 2021882 - RNA, 21 nt, Homo sapiens
ugguguaguuucuucauuuca

SEQ ID NO: 2021883 - RNA, 22 nt, Homo sapiens
ucagaaguaaaggaauuugaug

SEQ ID NO: 2021884 - RNA, 18 nt, Homo sapiens
gcacccagccucuaggga

SEQ ID NO: 2021885 - RNA, 16 nt, Homo sapiens
uguacaguuugcugua

SEQ ID NO: 2021886 - RNA, 16 nt, Homo sapiens
uggaauacuaaaguua

SEQ ID NO: 2021887 - RNA, 19 nt, Homo sapiens
gaguguaguugaugacugu

SEQ ID NO: 2021888 - RNA, 14 nt, Homo sapiens
uauaucaaucucuc

SEQ ID NO: 2021889 - RNA, 14 nt, Homo sapiens
caaaaaaaccacaa

SEQ ID NO: 2021890 - RNA, 14 nt, Homo sapiens
gaaaaaaagcacaa

SEQ ID NO: 2021891 - RNA, 14 nt, Homo sapiens
ggucgugaggccag

SEQ ID NO: 2021892 - RNA, 18 nt, Homo sapiens
uaagcuucuagacacucc

SEQ ID NO: 2021893 - RNA, 13 nt, Homo sapiens
cucuuuugcacaa

SEQ ID NO: 2021894 - RNA, 17 nt, Homo sapiens
ggcaacauaccaagacc

SEQ ID NO: 2021895 - RNA, 18 nt, Homo sapiens
cuguagccuaaacuccaa

SEQ ID NO: 2021896 - RNA, 14 nt, Homo sapiens
augcuauuuauuaa

SEQ ID NO: 2021897 - RNA, 15 nt, Homo sapiens
caccaccugcucacu

SEQ ID NO: 2021898 - RNA, 22 nt, Homo sapiens
uacucagacuguugcacucuaa

SEQ ID NO: 2021899 - RNA, 17 nt, Homo sapiens
ucauuuauaaaaccauc

SEQ ID NO: 2021900 - RNA, 14 nt, Homo sapiens
ugacuuggggacaa

SEQ ID NO: 2021901 - RNA, 13 nt, Homo sapiens
gccugucucauuc

SEQ ID NO: 2021902 - RNA, 14 nt, Homo sapiens
agaggaaagacagg

SEQ ID NO: 2021903 - RNA, 14 nt, Homo sapiens
agauuuaccacuug

SEQ ID NO: 2021904 - RNA, 19 nt, Homo sapiens
caaagguuccaacuguaua

SEQ ID NO: 2021905 - RNA, 19 nt, Homo sapiens
aauugcagaagaaacuccu

SEQ ID NO: 2021906 - RNA, 13 nt, Homo sapiens
aguuacaccucca

SEQ ID NO: 2021907 - RNA, 17 nt, Homo sapiens
ucauaaggcauauacaa

SEQ ID NO: 2021908 - RNA, 15 nt, Homo sapiens
cuuacgaucucuuga

SEQ ID NO: 2021909 - RNA, 13 nt, Homo sapiens
gaugucagaauuu

SEQ ID NO: 2021910 - RNA, 22 nt, Homo sapiens
uaugaaauaaaauuacacagua

SEQ ID NO: 2021911 - RNA, 23 nt, Homo sapiens
uauucuaacuuuuauuuuuauca

SEQ ID NO: 2021912 - RNA, 19 nt, Homo sapiens
uacaagaguuucaaaacau

SEQ ID NO: 2021913 - RNA, 20 nt, Homo sapiens
uggaucuguugggaaccaga

SEQ ID NO: 2021914 - RNA, 16 nt, Homo sapiens
cuauuguguuucacaa

SEQ ID NO: 2021915 - RNA, 16 nt, Homo sapiens
guccucaguccacugc

SEQ ID NO: 2021916 - RNA, 21 nt, Homo sapiens
gacauauguagaugugcugca

SEQ ID NO: 2021917 - RNA, 17 nt, Homo sapiens
cugccucuccagcacuu

SEQ ID NO: 2021918 - RNA, 17 nt, Homo sapiens
agcaaauauauaaugca

SEQ ID NO: 2021919 - RNA, 17 nt, Homo sapiens
aauuaaucuugcuucau

SEQ ID NO: 2021920 - RNA, 16 nt, Homo sapiens
ggagugugugacauuc

SEQ ID NO: 2021921 - RNA, 17 nt, Homo sapiens
aaucucuucaugcuuga

SEQ ID NO: 2021922 - RNA, 15 nt, Homo sapiens
aauguauuaauaucu

SEQ ID NO: 2021923 - RNA, 17 nt, Homo sapiens
ugacuuccuuauugguu

SEQ ID NO: 2021924 - RNA, 15 nt, Homo sapiens
uaaaacauuaagaaa

SEQ ID NO: 2021925 - RNA, 22 nt, Homo sapiens
ugccuugcuagcugaccuggag

SEQ ID NO: 2021926 - RNA, 13 nt, Homo sapiens
uucuuacuuuguu

SEQ ID NO: 2021927 - RNA, 20 nt, Homo sapiens
uaaccagacacaaacugcca

SEQ ID NO: 2021928 - RNA, 20 nt, Homo sapiens
ggaacaaaguaacagccuuu

SEQ ID NO: 2021929 - RNA, 16 nt, Homo sapiens
aucagggcccugcccc

SEQ ID NO: 2021930 - RNA, 20 nt, Homo sapiens
cggccacgucccugcacucu

SEQ ID NO: 2021931 - RNA, 15 nt, Homo sapiens
cauguauugcacauu

SEQ ID NO: 2021932 - RNA, 14 nt, Homo sapiens
cagcauugccuagg

SEQ ID NO: 2021933 - RNA, 22 nt, Homo sapiens
aaggcccagccuguaacugucc

SEQ ID NO: 2021934 - RNA, 14 nt, Homo sapiens
cacauggaacuuua

SEQ ID NO: 2021935 - RNA, 18 nt, Homo sapiens
guuuucucaugaugccuu

SEQ ID NO: 2021936 - RNA, 13 nt, Homo sapiens
caaugagccauga

SEQ ID NO: 2021937 - RNA, 12 nt, Homo sapiens
guucuguucauc

SEQ ID NO: 2021938 - RNA, 18 nt, Homo sapiens
gaggacacuaaccacgcu

SEQ ID NO: 2021939 - RNA, 16 nt, Homo sapiens
guacugauuuuagcau

SEQ ID NO: 2021940 - RNA, 20 nt, Homo sapiens
aagcugcuccaggccugcag

SEQ ID NO: 2021941 - RNA, 17 nt, Homo sapiens
auaucaugguaaugaca

SEQ ID NO: 2021942 - RNA, 13 nt, Homo sapiens
gggaaccauuuca

SEQ ID NO: 2021943 - RNA, 22 nt, Homo sapiens
ugcuucucuaaaacagcacuau

SEQ ID NO: 2021944 - RNA, 18 nt, Homo sapiens
aucagcacacggcuccca

SEQ ID NO: 2021945 - RNA, 15 nt, Homo sapiens
agaaggagaggcucu

SEQ ID NO: 2021946 - RNA, 23 nt, Homo sapiens
acuuucuugaaaagaagcaagga

SEQ ID NO: 2021947 - RNA, 12 nt, Homo sapiens
cccagcuuccug

SEQ ID NO: 2021948 - RNA, 11 nt, Homo sapiens
aacuguugcuc

SEQ ID NO: 2021949 - RNA, 18 nt, Homo sapiens
cccucuguccagccagcu

SEQ ID NO: 2021950 - RNA, 23 nt, Homo sapiens
gccucuagcugaauugagccuaa

SEQ ID NO: 2021951 - RNA, 14 nt, Homo sapiens
ucccaucucuacaa

SEQ ID NO: 2021952 - RNA, 19 nt, Homo sapiens
aguaauagcgccucuuuua

SEQ ID NO: 2021953 - RNA, 15 nt, Homo sapiens
cuaccaaagcccacu

SEQ ID NO: 2021954 - RNA, 23 nt, Homo sapiens
ugcaccaaauaggaucauaugaa

SEQ ID NO: 2021955 - RNA, 15 nt, Homo sapiens
uuaagcaacuggaaa

SEQ ID NO: 2021956 - RNA, 15 nt, Homo sapiens
aacucagcugaucug

SEQ ID NO: 2021957 - RNA, 16 nt, Homo sapiens
gaugugauuagugucu

SEQ ID NO: 2021958 - RNA, 19 nt, Homo sapiens
ccugaccuccaguccugcu

SEQ ID NO: 2021959 - RNA, 16 nt, Homo sapiens
ugccucagcuucccaa

SEQ ID NO: 2021960 - RNA, 18 nt, Homo sapiens
uguaucagcacuccucau

SEQ ID NO: 2021961 - RNA, 21 nt, Homo sapiens
auucagauuguuuaaaugccu

SEQ ID NO: 2021962 - RNA, 17 nt, Homo sapiens
agcuagugucaccugca

SEQ ID NO: 2021963 - RNA, 22 nt, Homo sapiens
ccuuccauuucuacuguauaaa

SEQ ID NO: 2021964 - RNA, 20 nt, Homo sapiens
augggcagugccuccuggga

SEQ ID NO: 2021965 - RNA, 20 nt, Homo sapiens
uagaaaugcggucuggucuc

SEQ ID NO: 2021966 - RNA, 14 nt, Homo sapiens
aagcacaaacuguc

SEQ ID NO: 2021967 - RNA, 15 nt, Homo sapiens
uugaaaccuuaguac

SEQ ID NO: 2021968 - RNA, 19 nt, Homo sapiens
uggggguuuuccaagcccu

SEQ ID NO: 2021969 - RNA, 19 nt, Homo sapiens
aacaacuguggucaauccg

SEQ ID NO: 2021970 - RNA, 16 nt, Homo sapiens
ucaaguccgacaacac

SEQ ID NO: 2021971 - RNA, 18 nt, Homo sapiens
cuggagucugccaaaaca

SEQ ID NO: 2021972 - RNA, 12 nt, Homo sapiens
aauccuguacaa

SEQ ID NO: 2021973 - RNA, 17 nt, Homo sapiens
auaaaauauaaucuaau

SEQ ID NO: 2021974 - RNA, 15 nt, Homo sapiens
gagcacagcaaggga

SEQ ID NO: 2021975 - RNA, 22 nt, Homo sapiens
cuggaugguucccagaggguuu

SEQ ID NO: 2021976 - RNA, 16 nt, Homo sapiens
auaaauaguauuccaa

SEQ ID NO: 2021977 - RNA, 14 nt, Homo sapiens
uuuguaauauaucc

SEQ ID NO: 2021978 - RNA, 22 nt, Homo sapiens
cuuugugucgauuucaccaaga

SEQ ID NO: 2021979 - RNA, 16 nt, Homo sapiens
augacuuaauuuuaga

SEQ ID NO: 2021980 - RNA, 20 nt, Homo sapiens
auauugcaggagacauuuuc

SEQ ID NO: 2021981 - RNA, 15 nt, Homo sapiens
ucagauggcauaaau

SEQ ID NO: 2021982 - RNA, 18 nt, Homo sapiens
aaaauaacagauuucuca

SEQ ID NO: 2021983 - RNA, 14 nt, Homo sapiens
aaacagaucugaau

SEQ ID NO: 2021984 - RNA, 22 nt, Homo sapiens
cugcaaaaugucuuaaugcaaa

SEQ ID NO: 2021985 - RNA, 16 nt, Homo sapiens
uacuugagacucuuga

SEQ ID NO: 2021986 - RNA, 23 nt, Homo sapiens
gcugccuccauuauccauuccca

SEQ ID NO: 2021987 - RNA, 23 nt, Homo sapiens
aagcagagguggcgauuuguuaa

SEQ ID NO: 2021988 - RNA, 13 nt, Homo sapiens
uugauucacuuca

SEQ ID NO: 2021989 - RNA, 16 nt, Homo sapiens
uaaaucauuaagacaa

SEQ ID NO: 2021990 - RNA, 17 nt, Homo sapiens
cuccgugaugcuguuuu

SEQ ID NO: 2021991 - RNA, 19 nt, Homo sapiens
uucagccccuagugcuauu

SEQ ID NO: 2021992 - RNA, 18 nt, Homo sapiens
ugcucauugaacuuuaag

SEQ ID NO: 2021993 - RNA, 18 nt, Homo sapiens
gcuccagugccagcaaua

SEQ ID NO: 2021994 - RNA, 14 nt, Homo sapiens
uaucacaagugauu

SEQ ID NO: 2021995 - RNA, 18 nt, Homo sapiens
agcauaugcagagcccca

SEQ ID NO: 2021996 - RNA, 20 nt, Homo sapiens
aagaccaguccuguuugcag

SEQ ID NO: 2021997 - RNA, 15 nt, Homo sapiens
ugacaugacugcaau

SEQ ID NO: 2021998 - RNA, 14 nt, Homo sapiens
aaacuaaagauaca

SEQ ID NO: 2021999 - RNA, 17 nt, Homo sapiens
cucuccuagagcucugu

SEQ ID NO: 2022000 - RNA, 15 nt, Homo sapiens
ucaaacuuuacucua

SEQ ID NO: 2022001 - RNA, 16 nt, Homo sapiens
ccagaaggaaccagcc

SEQ ID NO: 2022002 - RNA, 16 nt, Homo sapiens
cacauagauaccuuca

SEQ ID NO: 2022003 - RNA, 15 nt, Homo sapiens
uuuacgacugaagaa

SEQ ID NO: 2022004 - RNA, 15 nt, Homo sapiens
gccagugcugugagc

SEQ ID NO: 2022005 - RNA, 20 nt, Homo sapiens
uaaauaaagucuuacugugc

SEQ ID NO: 2022006 - RNA, 18 nt, Homo sapiens
uuuaaaugaaagugagac

SEQ ID NO: 2022007 - RNA, 19 nt, Homo sapiens
agagcugggaaacagggag

SEQ ID NO: 2022008 - RNA, 13 nt, Homo sapiens
agcccucacauua

SEQ ID NO: 2022009 - RNA, 17 nt, Homo sapiens
gguuuggggucugccac

SEQ ID NO: 2022010 - RNA, 14 nt, Homo sapiens
acuugaagccaucu

SEQ ID NO: 2022011 - RNA, 16 nt, Homo sapiens
uuauugugaucuauca

SEQ ID NO: 2022012 - RNA, 16 nt, Homo sapiens
uauguacaacauuuau

SEQ ID NO: 2022013 - RNA, 17 nt, Homo sapiens
cuugaacucuguucccc

SEQ ID NO: 2022014 - RNA, 17 nt, Homo sapiens
cugcccacauacgugag

SEQ ID NO: 2022015 - RNA, 19 nt, Homo sapiens
acuguagaaggccagcuga

SEQ ID NO: 2022016 - RNA, 15 nt, Homo sapiens
gagcagaacccagac

SEQ ID NO: 2022017 - RNA, 18 nt, Homo sapiens
cagcaaugccugccugaa

SEQ ID NO: 2022018 - RNA, 20 nt, Homo sapiens
aauuauuuauuacuugugca

SEQ ID NO: 2022019 - RNA, 14 nt, Homo sapiens
agcaggcaauuuca

SEQ ID NO: 2022020 - RNA, 18 nt, Homo sapiens
cgugacccucugcugaag

SEQ ID NO: 2022021 - RNA, 17 nt, Homo sapiens
ggccagcagccuuccag

SEQ ID NO: 2022022 - RNA, 18 nt, Homo sapiens
cuagaauggaaaacugcc

SEQ ID NO: 2022023 - RNA, 13 nt, Homo sapiens
gaucuuacaggua

SEQ ID NO: 2022024 - RNA, 22 nt, Homo sapiens
caaugauauaggaaaauacauu

SEQ ID NO: 2022025 - RNA, 16 nt, Homo sapiens
cuggccccuagaauca

SEQ ID NO: 2022026 - RNA, 13 nt, Homo sapiens
aaggauguuuaua

SEQ ID NO: 2022027 - RNA, 22 nt, Homo sapiens
acuccaaacagaccccuguuca

SEQ ID NO: 2022028 - RNA, 19 nt, Homo sapiens
agugaggacaaaaucacau

SEQ ID NO: 2022029 - RNA, 21 nt, Homo sapiens
caugaccaacaucgcagacac

SEQ ID NO: 2022030 - RNA, 20 nt, Homo sapiens
gcuuccuaaguagcuggguu

SEQ ID NO: 2022031 - RNA, 13 nt, Homo sapiens
acagagacagaaa

SEQ ID NO: 2022032 - RNA, 19 nt, Homo sapiens
acgcccagagaacaagcac

SEQ ID NO: 2022033 - RNA, 17 nt, Homo sapiens
acaauuugauacauaau

SEQ ID NO: 2022034 - RNA, 19 nt, Homo sapiens
aggagacaagaaauccagu

SEQ ID NO: 2022035 - RNA, 18 nt, Homo sapiens
aucagcuagggacuacuu

SEQ ID NO: 2022036 - RNA, 17 nt, Homo sapiens
aagacauuuccuaccug

SEQ ID NO: 2022037 - RNA, 23 nt, Homo sapiens
uaaauucacauaggcaauaucuu

SEQ ID NO: 2022038 - RNA, 15 nt, Homo sapiens
uauucucugcaauuu

SEQ ID NO: 2022039 - RNA, 14 nt, Homo sapiens
gccacccucuggga

SEQ ID NO: 2022040 - RNA, 13 nt, Homo sapiens
uuuugucaccuca

SEQ ID NO: 2022041 - RNA, 20 nt, Homo sapiens
auucauucuggucuuugaaa

SEQ ID NO: 2022042 - RNA, 20 nt, Homo sapiens
gcaggagggacuggacagau

SEQ ID NO: 2022043 - RNA, 22 nt, Homo sapiens
gcaggguuuuaucucugucuac

SEQ ID NO: 2022044 - RNA, 21 nt, Homo sapiens
ucugccaggugucuggucugu

SEQ ID NO: 2022045 - RNA, 19 nt, Homo sapiens
cugaaggggcuuggaacca

SEQ ID NO: 2022046 - RNA, 19 nt, Homo sapiens
aaaaugaguaggaugucuc

SEQ ID NO: 2022047 - RNA, 20 nt, Homo sapiens
aagccuggacgcagccacac

SEQ ID NO: 2022048 - RNA, 14 nt, Homo sapiens
ugagcaauggagug

SEQ ID NO: 2022049 - RNA, 19 nt, Homo sapiens
gcaggucccugugagcaca

SEQ ID NO: 2022050 - RNA, 18 nt, Homo sapiens
cuagaaccuguagagcua

SEQ ID NO: 2022051 - RNA, 23 nt, Homo sapiens
aaaauguuuuuaaacagugucau

SEQ ID NO: 2022052 - RNA, 23 nt, Homo sapiens
gauugauagaaaauccuucagcu

SEQ ID NO: 2022053 - RNA, 19 nt, Homo sapiens
augguuucuuuaaaaccau

SEQ ID NO: 2022054 - RNA, 18 nt, Homo sapiens
ccucguuaggacaaggcu

SEQ ID NO: 2022055 - RNA, 17 nt, Homo sapiens
aguucuuacacauucca

SEQ ID NO: 2022056 - RNA, 17 nt, Homo sapiens
aaauaagagcagucaca

SEQ ID NO: 2022057 - RNA, 14 nt, Homo sapiens
uaaguaaaccaaaa

SEQ ID NO: 2022058 - RNA, 18 nt, Homo sapiens
ccuggguggaaauccugc

SEQ ID NO: 2022059 - RNA, 19 nt, Homo sapiens
acccuuguguccacuguga

SEQ ID NO: 2022060 - RNA, 15 nt, Homo sapiens
cuacaguagcugcua

SEQ ID NO: 2022061 - RNA, 16 nt, Homo sapiens
uuuuuagugcauccag

SEQ ID NO: 2022062 - RNA, 20 nt, Homo sapiens
guugucccagggcugaugcu

SEQ ID NO: 2022063 - RNA, 14 nt, Homo sapiens
cuagaggaauauaa

SEQ ID NO: 2022064 - RNA, 15 nt, Homo sapiens
cugaggaguguccug

SEQ ID NO: 2022065 - RNA, 19 nt, Homo sapiens
ucacuucauagcucaccag

SEQ ID NO: 2022066 - RNA, 16 nt, Homo sapiens
ccuaagucacuuugag

SEQ ID NO: 2022067 - RNA, 16 nt, Homo sapiens
ggcuccugagacacau

SEQ ID NO: 2022068 - RNA, 15 nt, Homo sapiens
gaagacuguugugcu

SEQ ID NO: 2022069 - RNA, 16 nt, Homo sapiens
uaaagcuuugugcaga

SEQ ID NO: 2022070 - RNA, 19 nt, Homo sapiens
uacaaaaaauuagccagau

SEQ ID NO: 2022071 - RNA, 12 nt, Homo sapiens
caucacacuggg

SEQ ID NO: 2022072 - RNA, 15 nt, Homo sapiens
aauucugcucagaua

SEQ ID NO: 2022073 - RNA, 14 nt, Homo sapiens
gcccaccaccuguc

SEQ ID NO: 2022074 - RNA, 17 nt, Homo sapiens
uucaugguuuccuccag

SEQ ID NO: 2022075 - RNA, 16 nt, Homo sapiens
aggcaugguggcucac

SEQ ID NO: 2022076 - RNA, 20 nt, Homo sapiens
guaccauauucagcauuuga

SEQ ID NO: 2022077 - RNA, 20 nt, Homo sapiens
ugauguacagauucuuucag

SEQ ID NO: 2022078 - RNA, 19 nt, Homo sapiens
aaauaccacaagccugaga

SEQ ID NO: 2022079 - RNA, 21 nt, Homo sapiens
uaauguguuuuuaauuaucua

SEQ ID NO: 2022080 - RNA, 16 nt, Homo sapiens
gagucagcugcugacc

SEQ ID NO: 2022081 - RNA, 16 nt, Homo sapiens
caugugcuggguggua

SEQ ID NO: 2022082 - RNA, 21 nt, Homo sapiens
agaagucauaaacagcauuua

SEQ ID NO: 2022083 - RNA, 13 nt, Homo sapiens
aauuuuaccaaaa

SEQ ID NO: 2022084 - RNA, 23 nt, Homo sapiens
aaaaggguuucuugacaaugggg

SEQ ID NO: 2022085 - RNA, 16 nt, Homo sapiens
uuuucaacuuggauca

SEQ ID NO: 2022086 - RNA, 13 nt, Homo sapiens
uuuuccauguguu

SEQ ID NO: 2022087 - RNA, 18 nt, Homo sapiens
cugggcuucuguccaagg

SEQ ID NO: 2022088 - RNA, 23 nt, Homo sapiens
aggcauuuuuguaaugagccauu

SEQ ID NO: 2022089 - RNA, 19 nt, Homo sapiens
acacugaaucucaccugcu

SEQ ID NO: 2022090 - RNA, 17 nt, Homo sapiens
uggccccuccuugcaac

SEQ ID NO: 2022091 - RNA, 16 nt, Homo sapiens
uuucccucgcuaugug

SEQ ID NO: 2022092 - RNA, 15 nt, Homo sapiens
uccugggucuuucau

SEQ ID NO: 2022093 - RNA, 21 nt, Homo sapiens
aauauuuauauugucacucau

SEQ ID NO: 2022094 - RNA, 13 nt, Homo sapiens
gcagggcccugug

SEQ ID NO: 2022095 - RNA, 14 nt, Homo sapiens
ugaacccuaugugu

SEQ ID NO: 2022096 - RNA, 14 nt, Homo sapiens
caagcacugacacu

SEQ ID NO: 2022097 - RNA, 17 nt, Homo sapiens
cuuuagaaacucaaaaa

SEQ ID NO: 2022098 - RNA, 19 nt, Homo sapiens
auaugucagagcuguuaua

SEQ ID NO: 2022099 - RNA, 23 nt, Homo sapiens
uuugaaccauccacuuacauaua

SEQ ID NO: 2022100 - RNA, 17 nt, Homo sapiens
gauaaagagacagugau

SEQ ID NO: 2022101 - RNA, 12 nt, Homo sapiens
cgcccagugcag

SEQ ID NO: 2022102 - RNA, 20 nt, Homo sapiens
ucuguuuuauauagaaacac

SEQ ID NO: 2022103 - RNA, 15 nt, Homo sapiens
uaucugaacucacag

SEQ ID NO: 2022104 - RNA, 17 nt, Homo sapiens
uaaggucuaaucaguga

SEQ ID NO: 2022105 - RNA, 13 nt, Homo sapiens
caccuuccauguc

SEQ ID NO: 2022106 - RNA, 21 nt, Homo sapiens
aaugaagguuaggauuuaaca

SEQ ID NO: 2022107 - RNA, 20 nt, Homo sapiens
caaaucauccauccuugcca

SEQ ID NO: 2022108 - RNA, 13 nt, Homo sapiens
cuuagaacaccug

SEQ ID NO: 2022109 - RNA, 20 nt, Homo sapiens
cagaauccuugucauuuccu

SEQ ID NO: 2022110 - RNA, 15 nt, Homo sapiens
cugcuacuugcucug

SEQ ID NO: 2022111 - RNA, 19 nt, Homo sapiens
cuguugguaaagcacaugg

SEQ ID NO: 2022112 - RNA, 22 nt, Homo sapiens
aauguaguuuugugaugcauuu

SEQ ID NO: 2022113 - RNA, 21 nt, Homo sapiens
caccccuucgacaugcugcca

SEQ ID NO: 2022114 - RNA, 17 nt, Homo sapiens
acuggaguuagaucucu

SEQ ID NO: 2022115 - RNA, 12 nt, Homo sapiens
agccugccaaga

SEQ ID NO: 2022116 - RNA, 14 nt, Homo sapiens
auccagccauuccu

SEQ ID NO: 2022117 - RNA, 19 nt, Homo sapiens
gcuaaacgcaaugucauuu

SEQ ID NO: 2022118 - RNA, 19 nt, Homo sapiens
ggaguagaauuaagucaga

SEQ ID NO: 2022119 - RNA, 19 nt, Homo sapiens
ugagaacugguucuugccu

SEQ ID NO: 2022120 - RNA, 15 nt, Homo sapiens
accacaagacauuuc

SEQ ID NO: 2022121 - RNA, 17 nt, Homo sapiens
uuaaugcacuuucuauc

SEQ ID NO: 2022122 - RNA, 16 nt, Homo sapiens
cacugccgucaccucu

SEQ ID NO: 2022123 - RNA, 20 nt, Homo sapiens
uuauuugggggaggcuucag

SEQ ID NO: 2022124 - RNA, 15 nt, Homo sapiens
cagggccuccagccc

SEQ ID NO: 2022125 - RNA, 22 nt, Homo sapiens
ucaggaguagucucauaucagg

SEQ ID NO: 2022126 - RNA, 22 nt, Homo sapiens
aguaacacagggcagcuaguac

SEQ ID NO: 2022127 - RNA, 20 nt, Homo sapiens
aggagcggccagaagaucua

SEQ ID NO: 2022128 - RNA, 23 nt, Homo sapiens
agaccaucuucuaucuucuuucc

SEQ ID NO: 2022129 - RNA, 12 nt, Homo sapiens
aaaauaacuuau

SEQ ID NO: 2022130 - RNA, 18 nt, Homo sapiens
ugacuguguauagugcca

SEQ ID NO: 2022131 - RNA, 18 nt, Homo sapiens
aaagcuucugcaauauua

SEQ ID NO: 2022132 - RNA, 18 nt, Homo sapiens
cagccaggagaugcuggg

SEQ ID NO: 2022133 - RNA, 19 nt, Homo sapiens
acugaagcaaagaagggaa

SEQ ID NO: 2022134 - RNA, 15 nt, Homo sapiens
ggucucucuugcccc

SEQ ID NO: 2022135 - RNA, 20 nt, Homo sapiens
gggaaagagagaugggccag

SEQ ID NO: 2022136 - RNA, 15 nt, Homo sapiens
uggcccuacugggag

SEQ ID NO: 2022137 - RNA, 17 nt, Homo sapiens
aaugccaauucaucuca

SEQ ID NO: 2022138 - RNA, 22 nt, Homo sapiens
aaauagcuacagugacagauuu

SEQ ID NO: 2022139 - RNA, 23 nt, Homo sapiens
cauuuaagaacugaggaaccuga

SEQ ID NO: 2022140 - RNA, 21 nt, Homo sapiens
gaaguuagggaugacugugau

SEQ ID NO: 2022141 - RNA, 19 nt, Homo sapiens
uucauuuuuaaucaugaaa

SEQ ID NO: 2022142 - RNA, 14 nt, Homo sapiens
ucuucaaccaggga

SEQ ID NO: 2022143 - RNA, 13 nt, Homo sapiens
acaucacauucca

SEQ ID NO: 2022144 - RNA, 19 nt, Homo sapiens
uauucucacuccaccaccc

SEQ ID NO: 2022145 - RNA, 19 nt, Homo sapiens
aaugcaguagccagcacgu

SEQ ID NO: 2022146 - RNA, 22 nt, Homo sapiens
gauucgaaacuccauugaguca

SEQ ID NO: 2022147 - RNA, 16 nt, Homo sapiens
augaguuucacuguac

SEQ ID NO: 2022148 - RNA, 20 nt, Homo sapiens
caagaucacgccauugcacu

SEQ ID NO: 2022149 - RNA, 18 nt, Homo sapiens
gagacaaccagaucagga

SEQ ID NO: 2022150 - RNA, 21 nt, Homo sapiens
ugcucucuugugacgugcacu

SEQ ID NO: 2022151 - RNA, 18 nt, Homo sapiens
aguacaguaguaucugcu

SEQ ID NO: 2022152 - RNA, 16 nt, Homo sapiens
auucugccccacaccc

SEQ ID NO: 2022153 - RNA, 18 nt, Homo sapiens
agcagugaagcaauuuca

SEQ ID NO: 2022154 - RNA, 15 nt, Homo sapiens
auaucaucuguggac

SEQ ID NO: 2022155 - RNA, 18 nt, Homo sapiens
auggagugcaccaaagag

SEQ ID NO: 2022156 - RNA, 17 nt, Homo sapiens
uuauaucagauucuugg

SEQ ID NO: 2022157 - RNA, 14 nt, Homo sapiens
uuugcccauucucu

SEQ ID NO: 2022158 - RNA, 11 nt, Homo sapiens
aacacagugaa

SEQ ID NO: 2022159 - RNA, 19 nt, Homo sapiens
cauguugucaauacguaua

SEQ ID NO: 2022160 - RNA, 11 nt, Homo sapiens
ggaauaaucuc

SEQ ID NO: 2022161 - RNA, 16 nt, Homo sapiens
guacaggcaacaauga

SEQ ID NO: 2022162 - RNA, 18 nt, Homo sapiens
acugaaaacuugccguua

SEQ ID NO: 2022163 - RNA, 17 nt, Homo sapiens
aucuccagugugccaga

SEQ ID NO: 2022164 - RNA, 17 nt, Homo sapiens
aucuaucacccaggaau

SEQ ID NO: 2022165 - RNA, 15 nt, Homo sapiens
ugucacccauuggug

SEQ ID NO: 2022166 - RNA, 22 nt, Homo sapiens
uuacaaauagguagagucauuc

SEQ ID NO: 2022167 - RNA, 22 nt, Homo sapiens
uuuacauccagaguucugugac

SEQ ID NO: 2022168 - RNA, 16 nt, Homo sapiens
caaaugcaucuuugau

SEQ ID NO: 2022169 - RNA, 22 nt, Homo sapiens
uucucuccaccuuaguacuuua

SEQ ID NO: 2022170 - RNA, 12 nt, Homo sapiens
cagugaccaaac

SEQ ID NO: 2022171 - RNA, 21 nt, Homo sapiens
caguugugauaauagcauuuu

SEQ ID NO: 2022172 - RNA, 16 nt, Homo sapiens
gaaagcauaucccacc

SEQ ID NO: 2022173 - RNA, 18 nt, Homo sapiens
ugaucuaagcaguggcau

SEQ ID NO: 2022174 - RNA, 23 nt, Homo sapiens
acuuuggaaccagacucuugccu

SEQ ID NO: 2022175 - RNA, 22 nt, Homo sapiens
auuucuuuucuggccaaaagca

SEQ ID NO: 2022176 - RNA, 22 nt, Homo sapiens
ucaaggaaaagaauucucagca

SEQ ID NO: 2022177 - RNA, 19 nt, Homo sapiens
ccucccaaccccagugccu

SEQ ID NO: 2022178 - RNA, 16 nt, Homo sapiens
ugacauucaugccugg

SEQ ID NO: 2022179 - RNA, 13 nt, Homo sapiens
aggaccuuaccug

SEQ ID NO: 2022180 - RNA, 18 nt, Homo sapiens
uuuaaacaaugaagugaa

SEQ ID NO: 2022181 - RNA, 18 nt, Homo sapiens
acuuaauacaaaacugug

SEQ ID NO: 2022182 - RNA, 18 nt, Homo sapiens
augcguaaacgacacucu

SEQ ID NO: 2022183 - RNA, 14 nt, Homo sapiens
caacaagccugaaa

SEQ ID NO: 2022184 - RNA, 22 nt, Homo sapiens
cugcguaggagagaacagggau

SEQ ID NO: 2022185 - RNA, 16 nt, Homo sapiens
guuagaaacaccagcc

SEQ ID NO: 2022186 - RNA, 21 nt, Homo sapiens
accagcagagcaccuuagaca

SEQ ID NO: 2022187 - RNA, 16 nt, Homo sapiens
auccagaggugaggga

SEQ ID NO: 2022188 - RNA, 12 nt, Homo sapiens
aaucacaucucc

SEQ ID NO: 2022189 - RNA, 18 nt, Homo sapiens
aagugucuacaugugcca

SEQ ID NO: 2022190 - RNA, 15 nt, Homo sapiens
gcagguugaucagug

SEQ ID NO: 2022191 - RNA, 22 nt, Homo sapiens
ucagauuggaauguuacaucug

SEQ ID NO: 2022192 - RNA, 15 nt, Homo sapiens
uuuugcuacauucua

SEQ ID NO: 2022193 - RNA, 20 nt, Homo sapiens
aucaacccaauaauucugua

SEQ ID NO: 2022194 - RNA, 16 nt, Homo sapiens
cacgaacucauuaaca

SEQ ID NO: 2022195 - RNA, 15 nt, Homo sapiens
aauaauccauuuuca

SEQ ID NO: 2022196 - RNA, 15 nt, Homo sapiens
cugugccagaccuca

SEQ ID NO: 2022197 - RNA, 17 nt, Homo sapiens
acaacauugcauuguga

SEQ ID NO: 2022198 - RNA, 14 nt, Homo sapiens
uggacugguuuuca

SEQ ID NO: 2022199 - RNA, 14 nt, Homo sapiens
gacuagugcuuuac

SEQ ID NO: 2022200 - RNA, 20 nt, Homo sapiens
accccuccaggaaugaucuc

SEQ ID NO: 2022201 - RNA, 21 nt, Homo sapiens
agguguuaaaaaccauuauaa

SEQ ID NO: 2022202 - RNA, 12 nt, Homo sapiens
gaggcugcagaa

SEQ ID NO: 2022203 - RNA, 19 nt, Homo sapiens
cagaccagcucccagaugg

SEQ ID NO: 2022204 - RNA, 24 nt, Homo sapiens
uugcaugggcuaaugaagaucaua

SEQ ID NO: 2022205 - RNA, 20 nt, Homo sapiens
ugacguguaaaugcugguau

SEQ ID NO: 2022206 - RNA, 16 nt, Homo sapiens
uugcuauguugcccaa

SEQ ID NO: 2022207 - RNA, 23 nt, Homo sapiens
gaucuuccguggucagagugcca

SEQ ID NO: 2022208 - RNA, 22 nt, Homo sapiens
ucuuuuugggcuuucauagugu

SEQ ID NO: 2022209 - RNA, 20 nt, Homo sapiens
cccacaggagcguguccuau

SEQ ID NO: 2022210 - RNA, 13 nt, Homo sapiens
cugagugauccac

SEQ ID NO: 2022211 - RNA, 13 nt, Homo sapiens
uccugugacuguc

SEQ ID NO: 2022212 - RNA, 13 nt, Homo sapiens
cuguguuaugcaa

SEQ ID NO: 2022213 - RNA, 16 nt, Homo sapiens
uucccaauacauacca

SEQ ID NO: 2022214 - RNA, 19 nt, Homo sapiens
cucccgaguagcugggauu

SEQ ID NO: 2022215 - RNA, 18 nt, Homo sapiens
auccugccacaggaccca

SEQ ID NO: 2022216 - RNA, 24 nt, Homo sapiens
cauggcaucuucaauaugaaucua

SEQ ID NO: 2022217 - RNA, 20 nt, Homo sapiens
gcggcucaaaaggaaaccaa

SEQ ID NO: 2022218 - RNA, 20 nt, Homo sapiens
cacccuuccaucugauucca

SEQ ID NO: 2022219 - RNA, 22 nt, Homo sapiens
ucugucuccucaguuaaguguu

SEQ ID NO: 2022220 - RNA, 21 nt, Homo sapiens
cauccuucaaauaaacauguc

SEQ ID NO: 2022221 - RNA, 16 nt, Homo sapiens
caaccuuaacuuacua

SEQ ID NO: 2022222 - RNA, 23 nt, Homo sapiens
ugcauaccacuuuuguucuuggu

SEQ ID NO: 2022223 - RNA, 22 nt, Homo sapiens
aguuagaaaggguucagggcau

SEQ ID NO: 2022224 - RNA, 20 nt, Homo sapiens
uggcaagaaugaaauacucu

SEQ ID NO: 2022225 - RNA, 15 nt, Homo sapiens
aaugucucaugucaa

SEQ ID NO: 2022226 - RNA, 15 nt, Homo sapiens
aauaaauuuuccauu

SEQ ID NO: 2022227 - RNA, 19 nt, Homo sapiens
cuguacauacucaguaaaa

SEQ ID NO: 2022228 - RNA, 17 nt, Homo sapiens
ccugugugugcugccag

SEQ ID NO: 2022229 - RNA, 14 nt, Homo sapiens
ggaagauggcauaa

SEQ ID NO: 2022230 - RNA, 16 nt, Homo sapiens
uauagauaacugcaua

SEQ ID NO: 2022231 - RNA, 13 nt, Homo sapiens
caccaagugcaau

SEQ ID NO: 2022232 - RNA, 21 nt, Homo sapiens
ccugccaggauuaaaagccau

SEQ ID NO: 2022233 - RNA, 17 nt, Homo sapiens
guggguggcacugaccu

SEQ ID NO: 2022234 - RNA, 23 nt, Homo sapiens
uaggcuaagagaugugacuacag

SEQ ID NO: 2022235 - RNA, 18 nt, Homo sapiens
cagaauggaaauuuauaa

SEQ ID NO: 2022236 - RNA, 24 nt, Homo sapiens
agaucucccacugcggggagacag

SEQ ID NO: 2022237 - RNA, 12 nt, Homo sapiens
guucuaaccacu

SEQ ID NO: 2022238 - RNA, 13 nt, Homo sapiens
caaaacauuucau

SEQ ID NO: 2022239 - RNA, 21 nt, Homo sapiens
gccuaaaaauaaagcacaaac

SEQ ID NO: 2022240 - RNA, 13 nt, Homo sapiens
uaaaacaucucau

SEQ ID NO: 2022241 - RNA, 14 nt, Homo sapiens
gagagaaagccagg

SEQ ID NO: 2022242 - RNA, 20 nt, Homo sapiens
uuucuaccaccgcauccuca

SEQ ID NO: 2022243 - RNA, 15 nt, Homo sapiens
cuguugguaaagcac

SEQ ID NO: 2022244 - RNA, 12 nt, Homo sapiens
caaacuggcuua

SEQ ID NO: 2022245 - RNA, 14 nt, Homo sapiens
auggagcaagcucu

SEQ ID NO: 2022246 - RNA, 14 nt, Homo sapiens
gggagaaagcaaua

SEQ ID NO: 2022247 - RNA, 23 nt, Homo sapiens
caagaguuuguucuguucugggg

SEQ ID NO: 2022248 - RNA, 20 nt, Homo sapiens
acacauugcauuuugauaaa

SEQ ID NO: 2022249 - RNA, 20 nt, Homo sapiens
cauaaugaauaaagugcaaa

SEQ ID NO: 2022250 - RNA, 17 nt, Homo sapiens
acaagugcagcugugac

SEQ ID NO: 2022251 - RNA, 23 nt, Homo sapiens
ucgaauacaaaucaaagauuugu

SEQ ID NO: 2022252 - RNA, 21 nt, Homo sapiens
cuuuccuaaaacaguagugua

SEQ ID NO: 2022253 - RNA, 15 nt, Homo sapiens
cacucagacuguaua

SEQ ID NO: 2022254 - RNA, 23 nt, Homo sapiens
cagacuguguauucauugaaguc

SEQ ID NO: 2022255 - RNA, 18 nt, Homo sapiens
cugcacggggcauuccug

SEQ ID NO: 2022256 - RNA, 14 nt, Homo sapiens
auucagugcauuuu

SEQ ID NO: 2022257 - RNA, 16 nt, Homo sapiens
cacuacaaaaagcuag

SEQ ID NO: 2022258 - RNA, 22 nt, Homo sapiens
cacaaacucuguacagcaaggu

SEQ ID NO: 2022259 - RNA, 15 nt, Homo sapiens
acccacuggcacauu

SEQ ID NO: 2022260 - RNA, 15 nt, Homo sapiens
gaauucugaacuuuu

SEQ ID NO: 2022261 - RNA, 20 nt, Homo sapiens
gacaauaaagauauuuccaa

SEQ ID NO: 2022262 - RNA, 21 nt, Homo sapiens
uugugcuggauggagcccagg

SEQ ID NO: 2022263 - RNA, 19 nt, Homo sapiens
uccagaggagacuuugagu

SEQ ID NO: 2022264 - RNA, 15 nt, Homo sapiens
aauugcgcucagggg

SEQ ID NO: 2022265 - RNA, 10 nt, Homo sapiens
ccaaggcaaa

SEQ ID NO: 2022266 - RNA, 19 nt, Homo sapiens
uaucacugaacaaacuaaa

SEQ ID NO: 2022267 - RNA, 14 nt, Homo sapiens
uccugaacuuucuc

SEQ ID NO: 2022268 - RNA, 17 nt, Homo sapiens
ugcuggagucgggacua

SEQ ID NO: 2022269 - RNA, 22 nt, Homo sapiens
agauguauucuuuauaauugaa

SEQ ID NO: 2022270 - RNA, 19 nt, Homo sapiens
uacugcuucuuuucacuuc

SEQ ID NO: 2022271 - RNA, 14 nt, Homo sapiens
aauggaaccaaaua

SEQ ID NO: 2022272 - RNA, 15 nt, Homo sapiens
cgcagcccgggagau

SEQ ID NO: 2022273 - RNA, 11 nt, Homo sapiens
ugcaaugugaa

SEQ ID NO: 2022274 - RNA, 18 nt, Homo sapiens
agccucuucucugaugac

SEQ ID NO: 2022275 - RNA, 13 nt, Homo sapiens
auccagccuccag

SEQ ID NO: 2022276 - RNA, 19 nt, Homo sapiens
acaggaauacuuaacucaa

SEQ ID NO: 2022277 - RNA, 22 nt, Homo sapiens
cacuucccaggaucugcuccaa

SEQ ID NO: 2022278 - RNA, 14 nt, Homo sapiens
gaugcugacaucca

SEQ ID NO: 2022279 - RNA, 14 nt, Homo sapiens
gcugcugaccucca

SEQ ID NO: 2022280 - RNA, 18 nt, Homo sapiens
uuauaugauucacaugcu

SEQ ID NO: 2022281 - RNA, 16 nt, Homo sapiens
aggcuuuaucucaggg

SEQ ID NO: 2022282 - RNA, 14 nt, Homo sapiens
guucccccaaccuc

SEQ ID NO: 2022283 - RNA, 20 nt, Homo sapiens
ugagaauuaucaccaugaca

SEQ ID NO: 2022284 - RNA, 23 nt, Homo sapiens
acagauuuugaaucugugugcau

SEQ ID NO: 2022285 - RNA, 19 nt, Homo sapiens
ucugacuuaagugugcaaa

SEQ ID NO: 2022286 - RNA, 16 nt, Homo sapiens
acgcucaucucuggaa

SEQ ID NO: 2022287 - RNA, 14 nt, Homo sapiens
agaacuucccucca

SEQ ID NO: 2022288 - RNA, 18 nt, Homo sapiens
caggcgugguggcucacc

SEQ ID NO: 2022289 - RNA, 13 nt, Homo sapiens
ugcuccauuucaa

SEQ ID NO: 2022290 - RNA, 22 nt, Homo sapiens
uuauguuuauuauuugcacaga

SEQ ID NO: 2022291 - RNA, 14 nt, Homo sapiens
uuggcaaugcacug

SEQ ID NO: 2022292 - RNA, 18 nt, Homo sapiens
uaauagcguucagcagca

SEQ ID NO: 2022293 - RNA, 18 nt, Homo sapiens
cuaacgaccacagggucu

SEQ ID NO: 2022294 - RNA, 14 nt, Homo sapiens
agacaacacuggga

SEQ ID NO: 2022295 - RNA, 17 nt, Homo sapiens
cacacccuccccauuca

SEQ ID NO: 2022296 - RNA, 15 nt, Homo sapiens
gguucaagugacucu

SEQ ID NO: 2022297 - RNA, 21 nt, Homo sapiens
ugcuaaacucuuucauccccu

SEQ ID NO: 2022298 - RNA, 13 nt, Homo sapiens
gagucaccaggaa

SEQ ID NO: 2022299 - RNA, 15 nt, Homo sapiens
uuucaacgucuugcu

SEQ ID NO: 2022300 - RNA, 19 nt, Homo sapiens
aaggacuaggguccugggg

SEQ ID NO: 2022301 - RNA, 23 nt, Homo sapiens
uggccucacccaccccugcacag

SEQ ID NO: 2022302 - RNA, 17 nt, Homo sapiens
aauuuuaaaaaagggag

SEQ ID NO: 2022303 - RNA, 22 nt, Homo sapiens
acgucauuaagguuaugcacug

SEQ ID NO: 2022304 - RNA, 19 nt, Homo sapiens
aaucuccacuguuauucua

SEQ ID NO: 2022305 - RNA, 14 nt, Homo sapiens
aucuccugcugauu

SEQ ID NO: 2022306 - RNA, 14 nt, Homo sapiens
uaucaaaugcauuu

SEQ ID NO: 2022307 - RNA, 14 nt, Homo sapiens
gauuuaauucacau

SEQ ID NO: 2022308 - RNA, 20 nt, Homo sapiens
acccgggggagcccagugaa

SEQ ID NO: 2022309 - RNA, 19 nt, Homo sapiens
acagaaccaaaucguggca

SEQ ID NO: 2022310 - RNA, 22 nt, Homo sapiens
uccaccccuuguuuagcauaua

SEQ ID NO: 2022311 - RNA, 15 nt, Homo sapiens
uauucugcaacagcc

SEQ ID NO: 2022312 - RNA, 17 nt, Homo sapiens
agcaggacacugaucca

SEQ ID NO: 2022313 - RNA, 22 nt, Homo sapiens
ucuaaaaacaguuaagacaaca

SEQ ID NO: 2022314 - RNA, 16 nt, Homo sapiens
gugguuuuuugccagg

SEQ ID NO: 2022315 - RNA, 18 nt, Homo sapiens
accccucccucuguccac

SEQ ID NO: 2022316 - RNA, 18 nt, Homo sapiens
cuucccauacuugcauac

SEQ ID NO: 2022317 - RNA, 15 nt, Homo sapiens
cuugggauugucuua

SEQ ID NO: 2022318 - RNA, 14 nt, Homo sapiens
ugggucagcccagc

SEQ ID NO: 2022319 - RNA, 22 nt, Homo sapiens
accuauugagggugacagccac

SEQ ID NO: 2022320 - RNA, 23 nt, Homo sapiens
gaguucucacuauguuucucaga

SEQ ID NO: 2022321 - RNA, 15 nt, Homo sapiens
gcugcagguggcaga

SEQ ID NO: 2022322 - RNA, 15 nt, Homo sapiens
agacgagguuucacu

SEQ ID NO: 2022323 - RNA, 15 nt, Homo sapiens
aggauaggcuuuauu

SEQ ID NO: 2022324 - RNA, 23 nt, Homo sapiens
auuguggauuauaaaaaauguaa

SEQ ID NO: 2022325 - RNA, 19 nt, Homo sapiens
acucuucaguuaagccuuu

SEQ ID NO: 2022326 - RNA, 18 nt, Homo sapiens
uguauguuccucuaugaa

SEQ ID NO: 2022327 - RNA, 14 nt, Homo sapiens
ucauuuuacuggua

SEQ ID NO: 2022328 - RNA, 22 nt, Homo sapiens
ucucaaggauccagacucucau

SEQ ID NO: 2022329 - RNA, 23 nt, Homo sapiens
caaaaguauuuaacgacccaguc

SEQ ID NO: 2022330 - RNA, 14 nt, Homo sapiens
uaagaggauguggu

SEQ ID NO: 2022331 - RNA, 18 nt, Homo sapiens
agauucuuuauaucugaa

SEQ ID NO: 2022332 - RNA, 17 nt, Homo sapiens
uucugccucuccaggca

SEQ ID NO: 2022333 - RNA, 16 nt, Homo sapiens
cuggcccacugugcag

SEQ ID NO: 2022334 - RNA, 12 nt, Homo sapiens
cucccaccuccu

SEQ ID NO: 2022335 - RNA, 17 nt, Homo sapiens
agagagaauuugcuuua

SEQ ID NO: 2022336 - RNA, 19 nt, Homo sapiens
acugcccgaggcgccagcu

SEQ ID NO: 2022337 - RNA, 18 nt, Homo sapiens
acaucuggaaaauaaaag

SEQ ID NO: 2022338 - RNA, 15 nt, Homo sapiens
cuaagauaguaacaa

SEQ ID NO: 2022339 - RNA, 19 nt, Homo sapiens
aacucuccuacacuuccau

SEQ ID NO: 2022340 - RNA, 21 nt, Homo sapiens
caauaaaggcaccucccccaa

SEQ ID NO: 2022341 - RNA, 17 nt, Homo sapiens
gaaugaacaaugugggc

SEQ ID NO: 2022342 - RNA, 18 nt, Homo sapiens
ucuucucuguuauuccug

SEQ ID NO: 2022343 - RNA, 14 nt, Homo sapiens
cuuaauagacuucu

SEQ ID NO: 2022344 - RNA, 15 nt, Homo sapiens
uaucuuagcuggaua

SEQ ID NO: 2022345 - RNA, 17 nt, Homo sapiens
agcuucucugcugcuua

SEQ ID NO: 2022346 - RNA, 18 nt, Homo sapiens
gcuccuccugcccugucc

SEQ ID NO: 2022347 - RNA, 13 nt, Homo sapiens
guggguccuuugg

SEQ ID NO: 2022348 - RNA, 21 nt, Homo sapiens
uccaccugcuaaucacaucca

SEQ ID NO: 2022349 - RNA, 15 nt, Homo sapiens
accaagugguuucca

SEQ ID NO: 2022350 - RNA, 16 nt, Homo sapiens
aagguacugaagcuuu

SEQ ID NO: 2022351 - RNA, 15 nt, Homo sapiens
uacagagaaccugga

SEQ ID NO: 2022352 - RNA, 16 nt, Homo sapiens
uaucaaaaagauauca

SEQ ID NO: 2022353 - RNA, 22 nt, Homo sapiens
cagcacuuuccuguugcacuga

SEQ ID NO: 2022354 - RNA, 12 nt, Homo sapiens
gggcaauggauu

SEQ ID NO: 2022355 - RNA, 23 nt, Homo sapiens
gcaguauggaauuccagugccag

SEQ ID NO: 2022356 - RNA, 18 nt, Homo sapiens
caagaguuguugugcaag

SEQ ID NO: 2022357 - RNA, 17 nt, Homo sapiens
cagccucccugucacuc

SEQ ID NO: 2022358 - RNA, 17 nt, Homo sapiens
aucacucauucuaugaa

SEQ ID NO: 2022359 - RNA, 14 nt, Homo sapiens
ccugcaggccaguc

SEQ ID NO: 2022360 - RNA, 20 nt, Homo sapiens
aauguauuuguuugcaauuu

SEQ ID NO: 2022361 - RNA, 15 nt, Homo sapiens
cacgugcagcaccug

SEQ ID NO: 2022362 - RNA, 23 nt, Homo sapiens
uccucaaauacaugcacagucau

SEQ ID NO: 2022363 - RNA, 13 nt, Homo sapiens
augagaagacaug

SEQ ID NO: 2022364 - RNA, 23 nt, Homo sapiens
cucuggccucagccgacugcaca

SEQ ID NO: 2022365 - RNA, 15 nt, Homo sapiens
ggauaaauaucuuac

SEQ ID NO: 2022366 - RNA, 16 nt, Homo sapiens
agccacaaccaaaaaa

SEQ ID NO: 2022367 - RNA, 18 nt, Homo sapiens
uuguuacauaccugggua

SEQ ID NO: 2022368 - RNA, 16 nt, Homo sapiens
caucuauauauauaug

SEQ ID NO: 2022369 - RNA, 18 nt, Homo sapiens
ggcgccaucuauggugug

SEQ ID NO: 2022370 - RNA, 19 nt, Homo sapiens
aggggcaguuuuagcagca

SEQ ID NO: 2022371 - RNA, 12 nt, Homo sapiens
agaaugcaugua

SEQ ID NO: 2022372 - RNA, 22 nt, Homo sapiens
caucauuaaaagcaaggcucaa

SEQ ID NO: 2022373 - RNA, 15 nt, Homo sapiens
uugugauaugcacaa

SEQ ID NO: 2022374 - RNA, 22 nt, Homo sapiens
aauaaaaauucauaaccaaaga

SEQ ID NO: 2022375 - RNA, 13 nt, Homo sapiens
gcuccagcaucca

SEQ ID NO: 2022376 - RNA, 18 nt, Homo sapiens
ccagcucacgucacacuu

SEQ ID NO: 2022377 - RNA, 15 nt, Homo sapiens
gcaaucuggucugaa

SEQ ID NO: 2022378 - RNA, 20 nt, Homo sapiens
acuccucacacuuacuguaa

SEQ ID NO: 2022379 - RNA, 14 nt, Homo sapiens
aaucccucuaccuu

SEQ ID NO: 2022380 - RNA, 21 nt, Homo sapiens
ggcuuuuauuagaaagccaua

SEQ ID NO: 2022381 - RNA, 17 nt, Homo sapiens
caaguuucaucagucaa

SEQ ID NO: 2022382 - RNA, 12 nt, Homo sapiens
auaauauacaug

SEQ ID NO: 2022383 - RNA, 16 nt, Homo sapiens
gacgaguaacuccccu

SEQ ID NO: 2022384 - RNA, 21 nt, Homo sapiens
auuuccaguuuuucuuuacuu

SEQ ID NO: 2022385 - RNA, 15 nt, Homo sapiens
ucauauguaaucucu

SEQ ID NO: 2022386 - RNA, 17 nt, Homo sapiens
uaagagagugaacauau

SEQ ID NO: 2022387 - RNA, 17 nt, Homo sapiens
cuuuggcuuugcaaaau

SEQ ID NO: 2022388 - RNA, 20 nt, Homo sapiens
uaaggaauaugagcuuuaug

SEQ ID NO: 2022389 - RNA, 13 nt, Homo sapiens
ugcaaacuuuauu

SEQ ID NO: 2022390 - RNA, 22 nt, Homo sapiens
aacauguggacuuuuacaauaa

SEQ ID NO: 2022391 - RNA, 18 nt, Homo sapiens
ccugaccuauaaccugua

SEQ ID NO: 2022392 - RNA, 17 nt, Homo sapiens
cuaugagcacauaggac

SEQ ID NO: 2022393 - RNA, 14 nt, Homo sapiens
caguucagugaggu

SEQ ID NO: 2022394 - RNA, 23 nt, Homo sapiens
aaaugucaguaguuucuuauuaa

SEQ ID NO: 2022395 - RNA, 17 nt, Homo sapiens
aacuuuuuguuacagau

SEQ ID NO: 2022396 - RNA, 12 nt, Homo sapiens
uugugacuucaa

SEQ ID NO: 2022397 - RNA, 21 nt, Homo sapiens
ugacuccuaagggacugugag

SEQ ID NO: 2022398 - RNA, 20 nt, Homo sapiens
cagaggugggcagguggugg

SEQ ID NO: 2022399 - RNA, 18 nt, Homo sapiens
aucuccaaacuaaacccu

SEQ ID NO: 2022400 - RNA, 21 nt, Homo sapiens
auuguaauuugggaacauaaa

SEQ ID NO: 2022401 - RNA, 16 nt, Homo sapiens
caagcauaagcaaaac

SEQ ID NO: 2022402 - RNA, 18 nt, Homo sapiens
guuugaaaauaugccugc

SEQ ID NO: 2022403 - RNA, 20 nt, Homo sapiens
cauguaccuuguguacuuuc

SEQ ID NO: 2022404 - RNA, 13 nt, Homo sapiens
gacgacagaugcu

SEQ ID NO: 2022405 - RNA, 21 nt, Homo sapiens
uacuuuauguauggagcucua

SEQ ID NO: 2022406 - RNA, 20 nt, Homo sapiens
ucaauguuuagcagauuuaa

SEQ ID NO: 2022407 - RNA, 21 nt, Homo sapiens
uaucuucguuaguaaucugua

SEQ ID NO: 2022408 - RNA, 18 nt, Homo sapiens
ccaggcaccaucucccuu

SEQ ID NO: 2022409 - RNA, 13 nt, Homo sapiens
uuaaugguagcau

SEQ ID NO: 2022410 - RNA, 15 nt, Homo sapiens
aaggaaugcuuggaa

SEQ ID NO: 2022411 - RNA, 13 nt, Homo sapiens
uccuuuuaucucc

SEQ ID NO: 2022412 - RNA, 16 nt, Homo sapiens
acccgugggugugugu

SEQ ID NO: 2022413 - RNA, 17 nt, Homo sapiens
aucucaaaucacaagga

SEQ ID NO: 2022414 - RNA, 16 nt, Homo sapiens
ggaaaauggccaugca

SEQ ID NO: 2022415 - RNA, 15 nt, Homo sapiens
acagugcagugcuca

SEQ ID NO: 2022416 - RNA, 20 nt, Homo sapiens
uauuggcugguaaauugcca

SEQ ID NO: 2022417 - RNA, 23 nt, Homo sapiens
aaaacguugaauugaugaugcag

SEQ ID NO: 2022418 - RNA, 18 nt, Homo sapiens
aagcuccugcuacuuccc

SEQ ID NO: 2022419 - RNA, 18 nt, Homo sapiens
ucaacaacaaaccaaaac

SEQ ID NO: 2022420 - RNA, 14 nt, Homo sapiens
aaaugugauacauu

SEQ ID NO: 2022421 - RNA, 17 nt, Homo sapiens
uaaaggagaaaaguggg

SEQ ID NO: 2022422 - RNA, 17 nt, Homo sapiens
aacuugaauacuuugag

SEQ ID NO: 2022423 - RNA, 15 nt, Homo sapiens
uuuccugugacaaaa

SEQ ID NO: 2022424 - RNA, 19 nt, Homo sapiens
accaagaaaaccaguggaa

SEQ ID NO: 2022425 - RNA, 12 nt, Homo sapiens
auccaugcacuu

SEQ ID NO: 2022426 - RNA, 16 nt, Homo sapiens
ucccaauuacauucac

SEQ ID NO: 2022427 - RNA, 21 nt, Homo sapiens
ucccaggguuauagacagucg

SEQ ID NO: 2022428 - RNA, 21 nt, Homo sapiens
ugcuccuaaaccauugagcua

SEQ ID NO: 2022429 - RNA, 18 nt, Homo sapiens
agcgcucgauggaccuca

SEQ ID NO: 2022430 - RNA, 12 nt, Homo sapiens
cuguccaaaagg

SEQ ID NO: 2022431 - RNA, 22 nt, Homo sapiens
cuaucggggucacuugcaauug

SEQ ID NO: 2022432 - RNA, 15 nt, Homo sapiens
caccuccacccagug

SEQ ID NO: 2022433 - RNA, 21 nt, Homo sapiens
gaaggucugucauaggacucu

SEQ ID NO: 2022434 - RNA, 18 nt, Homo sapiens
ggcugacaugaagcuguu

SEQ ID NO: 2022435 - RNA, 18 nt, Homo sapiens
aaaauauggacuuccaau

SEQ ID NO: 2022436 - RNA, 15 nt, Homo sapiens
uaaauauaucuaccc

SEQ ID NO: 2022437 - RNA, 19 nt, Homo sapiens
agagccacucuucaaguag

SEQ ID NO: 2022438 - RNA, 18 nt, Homo sapiens
uagcuguuuuuuucauua

SEQ ID NO: 2022439 - RNA, 18 nt, Homo sapiens
gccgcagggcacugaaag

SEQ ID NO: 2022440 - RNA, 16 nt, Homo sapiens
ucagcuauaccugcac

SEQ ID NO: 2022441 - RNA, 14 nt, Homo sapiens
agagaaugccauuc

SEQ ID NO: 2022442 - RNA, 20 nt, Homo sapiens
cuugauuagugccuucugcc

SEQ ID NO: 2022443 - RNA, 22 nt, Homo sapiens
agguuuacacugcggaagccaa

SEQ ID NO: 2022444 - RNA, 15 nt, Homo sapiens
guggguaauuguaca

SEQ ID NO: 2022445 - RNA, 18 nt, Homo sapiens
ucauuuaacucuuugaaa

SEQ ID NO: 2022446 - RNA, 12 nt, Homo sapiens
cuugauucacaa

SEQ ID NO: 2022447 - RNA, 19 nt, Homo sapiens
augugugaaggucuugccu

SEQ ID NO: 2022448 - RNA, 15 nt, Homo sapiens
aagaacucaugugau

SEQ ID NO: 2022449 - RNA, 21 nt, Homo sapiens
gaccgggccgcuagaugggca

SEQ ID NO: 2022450 - RNA, 22 nt, Homo sapiens
cugucuguauagugucuguauu

SEQ ID NO: 2022451 - RNA, 16 nt, Homo sapiens
aauugauaacauggaa

SEQ ID NO: 2022452 - RNA, 14 nt, Homo sapiens
caguucaauaacaa

SEQ ID NO: 2022453 - RNA, 17 nt, Homo sapiens
acucagguggugccccu

SEQ ID NO: 2022454 - RNA, 20 nt, Homo sapiens
ugaaauuuucuuaaccccua

SEQ ID NO: 2022455 - RNA, 15 nt, Homo sapiens
caaagggauguucac

SEQ ID NO: 2022456 - RNA, 15 nt, Homo sapiens
uuguugaaagccaug

SEQ ID NO: 2022457 - RNA, 15 nt, Homo sapiens
auuccaaagucucua

SEQ ID NO: 2022458 - RNA, 19 nt, Homo sapiens
ucaauuacuugaaguugcu

SEQ ID NO: 2022459 - RNA, 15 nt, Homo sapiens
ccaauuucagacucc

SEQ ID NO: 2022460 - RNA, 21 nt, Homo sapiens
guuucauucuauuggucaauu

SEQ ID NO: 2022461 - RNA, 14 nt, Homo sapiens
ugaaugccagucca

SEQ ID NO: 2022462 - RNA, 13 nt, Homo sapiens
cccagagccacag

SEQ ID NO: 2022463 - RNA, 19 nt, Homo sapiens
guuuucugcuuuaauuuca

SEQ ID NO: 2022464 - RNA, 23 nt, Homo sapiens
agucuuguuguuuucccaaagag

SEQ ID NO: 2022465 - RNA, 17 nt, Homo sapiens
uaauaaagcauucuuua

SEQ ID NO: 2022466 - RNA, 11 nt, Homo sapiens
uucacacuccu

SEQ ID NO: 2022467 - RNA, 16 nt, Homo sapiens
aucaugggcuggacau

SEQ ID NO: 2022468 - RNA, 19 nt, Homo sapiens
uggauaacaccaccauuca

SEQ ID NO: 2022469 - RNA, 16 nt, Homo sapiens
agcuacuugcaauuca

SEQ ID NO: 2022470 - RNA, 21 nt, Homo sapiens
caucuacccugcugaccuccc

SEQ ID NO: 2022471 - RNA, 19 nt, Homo sapiens
uuaacauagagaacuguca

SEQ ID NO: 2022472 - RNA, 19 nt, Homo sapiens
ccucuuaccaguauuuaac

SEQ ID NO: 2022473 - RNA, 13 nt, Homo sapiens
aaauuuucaccug

SEQ ID NO: 2022474 - RNA, 15 nt, Homo sapiens
gccaauuuucuucau

SEQ ID NO: 2022475 - RNA, 23 nt, Homo sapiens
guuacuauaugccgcuacaaaaa

SEQ ID NO: 2022476 - RNA, 11 nt, Homo sapiens
cgcaugugcag

SEQ ID NO: 2022477 - RNA, 19 nt, Homo sapiens
gcaaagguauuaguacaau

SEQ ID NO: 2022478 - RNA, 16 nt, Homo sapiens
uuuguauacacauaau

SEQ ID NO: 2022479 - RNA, 15 nt, Homo sapiens
augaaguauugcuaa

SEQ ID NO: 2022480 - RNA, 15 nt, Homo sapiens
aguggauaaauauac

SEQ ID NO: 2022481 - RNA, 12 nt, Homo sapiens
uugaagagcaaa

SEQ ID NO: 2022482 - RNA, 16 nt, Homo sapiens
aaaugauagauuugac

SEQ ID NO: 2022483 - RNA, 19 nt, Homo sapiens
uucggauguuauauuaaaa

SEQ ID NO: 2022484 - RNA, 19 nt, Homo sapiens
ccuccacagcuaccucuuc

SEQ ID NO: 2022485 - RNA, 22 nt, Homo sapiens
guuugauguccccaaaguacca

SEQ ID NO: 2022486 - RNA, 16 nt, Homo sapiens
cuuaaaauuaccagac

SEQ ID NO: 2022487 - RNA, 21 nt, Homo sapiens
cagaggauuuaacugugaacc

SEQ ID NO: 2022488 - RNA, 22 nt, Homo sapiens
uccuucaauuaaaaaaaggggg

SEQ ID NO: 2022489 - RNA, 22 nt, Homo sapiens
acaaacucacacaaccaugacg

SEQ ID NO: 2022490 - RNA, 19 nt, Homo sapiens
aguuugucaucccugauga

SEQ ID NO: 2022491 - RNA, 16 nt, Homo sapiens
uacaucuauguaucua

SEQ ID NO: 2022492 - RNA, 22 nt, Homo sapiens
caaugauaugcaagugcaaaag

SEQ ID NO: 2022493 - RNA, 13 nt, Homo sapiens
ggcccaacaggcc

SEQ ID NO: 2022494 - RNA, 20 nt, Homo sapiens
ggaaaaagaaugaugcuaug

SEQ ID NO: 2022495 - RNA, 21 nt, Homo sapiens
ccuucuuuuccugggugcuca

SEQ ID NO: 2022496 - RNA, 15 nt, Homo sapiens
cagcaucucacuucu

SEQ ID NO: 2022497 - RNA, 18 nt, Homo sapiens
cccgguacaaguggcuca

SEQ ID NO: 2022498 - RNA, 11 nt, Homo sapiens
uaugaccagug

SEQ ID NO: 2022499 - RNA, 14 nt, Homo sapiens
uccuuauugcauug

SEQ ID NO: 2022500 - RNA, 10 nt, Homo sapiens
gccaaaaagg

SEQ ID NO: 2022501 - RNA, 19 nt, Homo sapiens
ccuucuuucucuucccucc

SEQ ID NO: 2022502 - RNA, 23 nt, Homo sapiens
caaaaaagccccagcccauuccu

SEQ ID NO: 2022503 - RNA, 16 nt, Homo sapiens
cugagcgcaagccaca

SEQ ID NO: 2022504 - RNA, 19 nt, Homo sapiens
cagugaccagucacugacc

SEQ ID NO: 2022505 - RNA, 15 nt, Homo sapiens
cacgcaagggcauca

SEQ ID NO: 2022506 - RNA, 17 nt, Homo sapiens
aagucaacaaccaugcc

SEQ ID NO: 2022507 - RNA, 16 nt, Homo sapiens
gcuacuuugagccucu

SEQ ID NO: 2022508 - RNA, 19 nt, Homo sapiens
agaucuuuuaaaaaggcag

SEQ ID NO: 2022509 - RNA, 13 nt, Homo sapiens
caaugggcacuga

SEQ ID NO: 2022510 - RNA, 13 nt, Homo sapiens
gaaauagacuuug

SEQ ID NO: 2022511 - RNA, 14 nt, Homo sapiens
gagcugggggccau

SEQ ID NO: 2022512 - RNA, 20 nt, Homo sapiens
gcugcagugacgugcaccug

SEQ ID NO: 2022513 - RNA, 21 nt, Homo sapiens
gcaaggaccuaaaacaucuca

SEQ ID NO: 2022514 - RNA, 15 nt, Homo sapiens
ucaacaaaaagacau

SEQ ID NO: 2022515 - RNA, 16 nt, Homo sapiens
augccaauucaucuca

SEQ ID NO: 2022516 - RNA, 20 nt, Homo sapiens
gaaguugcuaagugugcuua

SEQ ID NO: 2022517 - RNA, 14 nt, Homo sapiens
cauuuuugugagcc

SEQ ID NO: 2022518 - RNA, 22 nt, Homo sapiens
gcuuagaauugcuggaugcauu

SEQ ID NO: 2022519 - RNA, 21 nt, Homo sapiens
ugugcuuaauaauaccaagac

SEQ ID NO: 2022520 - RNA, 15 nt, Homo sapiens
ugggguuauguauca

SEQ ID NO: 2022521 - RNA, 17 nt, Homo sapiens
gucccauggacacucca

SEQ ID NO: 2022522 - RNA, 13 nt, Homo sapiens
aaccacuuucuaa

SEQ ID NO: 2022523 - RNA, 13 nt, Homo sapiens
aaucucuuuccau

SEQ ID NO: 2022524 - RNA, 21 nt, Homo sapiens
uuggugaaauaauaaaaugca

SEQ ID NO: 2022525 - RNA, 18 nt, Homo sapiens
uuauaaacaacaucaaaa

SEQ ID NO: 2022526 - RNA, 22 nt, Homo sapiens
acuugguuuuuggcucuuucag

SEQ ID NO: 2022527 - RNA, 14 nt, Homo sapiens
uaauuauauuucua

SEQ ID NO: 2022528 - RNA, 18 nt, Homo sapiens
cuagaaugcacaccaaaa

SEQ ID NO: 2022529 - RNA, 20 nt, Homo sapiens
uuacuuuuuuuuaugaucaa

SEQ ID NO: 2022530 - RNA, 18 nt, Homo sapiens
uaaacagauggcacuuug

SEQ ID NO: 2022531 - RNA, 16 nt, Homo sapiens
gagacccguccauuug

SEQ ID NO: 2022532 - RNA, 14 nt, Homo sapiens
acuaguaaagcaaa

SEQ ID NO: 2022533 - RNA, 16 nt, Homo sapiens
caaaaguuuaaaaagc

SEQ ID NO: 2022534 - RNA, 23 nt, Homo sapiens
ggagguugugucacugacucagg

SEQ ID NO: 2022535 - RNA, 18 nt, Homo sapiens
ucacaagaaucaccucaa

SEQ ID NO: 2022536 - RNA, 19 nt, Homo sapiens
augaauuuuuuucaucuuc

SEQ ID NO: 2022537 - RNA, 19 nt, Homo sapiens
cuggagggaagcacugccu

SEQ ID NO: 2022538 - RNA, 19 nt, Homo sapiens
cuguggcuguggagacaau

SEQ ID NO: 2022539 - RNA, 16 nt, Homo sapiens
agcagcaacuuguccu

SEQ ID NO: 2022540 - RNA, 22 nt, Homo sapiens
gugaguggggaggagacucagg

SEQ ID NO: 2022541 - RNA, 20 nt, Homo sapiens
accccaaacuuccagguucc

SEQ ID NO: 2022542 - RNA, 18 nt, Homo sapiens
uggccuaugcacauaugg

SEQ ID NO: 2022543 - RNA, 19 nt, Homo sapiens
agaaauuuugccugccauu

SEQ ID NO: 2022544 - RNA, 15 nt, Homo sapiens
ugacuguggcauuuu

SEQ ID NO: 2022545 - RNA, 18 nt, Homo sapiens
aucagugacucacuucca

SEQ ID NO: 2022546 - RNA, 13 nt, Homo sapiens
ugugucccuccug

SEQ ID NO: 2022547 - RNA, 16 nt, Homo sapiens
auauuucuaacuauau

SEQ ID NO: 2022548 - RNA, 20 nt, Homo sapiens
cucuucaauagcuaagcauc

SEQ ID NO: 2022549 - RNA, 14 nt, Homo sapiens
cuacucagacuguu

SEQ ID NO: 2022550 - RNA, 13 nt, Homo sapiens
ucuuuauaauucu

SEQ ID NO: 2022551 - RNA, 12 nt, Homo sapiens
uuuccuguucag

SEQ ID NO: 2022552 - RNA, 14 nt, Homo sapiens
ugcaccaccaugcc

SEQ ID NO: 2022553 - RNA, 19 nt, Homo sapiens
gacucucacacugaaucag

SEQ ID NO: 2022554 - RNA, 17 nt, Homo sapiens
cgccaauaaaccaauga

SEQ ID NO: 2022555 - RNA, 17 nt, Homo sapiens
aagaccgccccagggcu

SEQ ID NO: 2022556 - RNA, 15 nt, Homo sapiens
auguucucagauuuc

SEQ ID NO: 2022557 - RNA, 23 nt, Homo sapiens
uuaaagccugaguuugcuuucaa

SEQ ID NO: 2022558 - RNA, 15 nt, Homo sapiens
gugaugccugacaca

SEQ ID NO: 2022559 - RNA, 13 nt, Homo sapiens
ggucaaugcaguu

SEQ ID NO: 2022560 - RNA, 12 nt, Homo sapiens
agucacauuagu

SEQ ID NO: 2022561 - RNA, 15 nt, Homo sapiens
uguaagaugaagaua

SEQ ID NO: 2022562 - RNA, 21 nt, Homo sapiens
ucaaaacauacaagagacaua

SEQ ID NO: 2022563 - RNA, 19 nt, Homo sapiens
ucuuacauuacuaaggcua

SEQ ID NO: 2022564 - RNA, 18 nt, Homo sapiens
uuucccaaauguauugau

SEQ ID NO: 2022565 - RNA, 14 nt, Homo sapiens
cuauguuauauuga

SEQ ID NO: 2022566 - RNA, 22 nt, Homo sapiens
uccaugucgccucugcauucag

SEQ ID NO: 2022567 - RNA, 19 nt, Homo sapiens
ccaugaaacugacucauca

SEQ ID NO: 2022568 - RNA, 18 nt, Homo sapiens
uguuaugcuccugcugau

SEQ ID NO: 2022569 - RNA, 19 nt, Homo sapiens
aauaacuagaucuccugua

SEQ ID NO: 2022570 - RNA, 18 nt, Homo sapiens
cccaucuuuuguucuccu

SEQ ID NO: 2022571 - RNA, 19 nt, Homo sapiens
aacuucguuuaaugaaugc

SEQ ID NO: 2022572 - RNA, 19 nt, Homo sapiens
ccauucagugcagcauaua

SEQ ID NO: 2022573 - RNA, 19 nt, Homo sapiens
ugcaaaguaugccagggga

SEQ ID NO: 2022574 - RNA, 19 nt, Homo sapiens
cgaugcuggggucaaagac

SEQ ID NO: 2022575 - RNA, 17 nt, Homo sapiens
ucucaggagucucuggu

SEQ ID NO: 2022576 - RNA, 15 nt, Homo sapiens
gccucaaugccagua

SEQ ID NO: 2022577 - RNA, 22 nt, Homo sapiens
aacugagucacucacauugaga

SEQ ID NO: 2022578 - RNA, 22 nt, Homo sapiens
agccuaaaaauaaagcacaaac

SEQ ID NO: 2022579 - RNA, 18 nt, Homo sapiens
agccugguggcaauaagg

SEQ ID NO: 2022580 - RNA, 15 nt, Homo sapiens
acuuauauauuugau

SEQ ID NO: 2022581 - RNA, 19 nt, Homo sapiens
ggacacucaaacacaucau

SEQ ID NO: 2022582 - RNA, 13 nt, Homo sapiens
gauuugcacagaa

SEQ ID NO: 2022583 - RNA, 20 nt, Homo sapiens
guugcauuuaugaugcaguu

SEQ ID NO: 2022584 - RNA, 23 nt, Homo sapiens
gcauacagguuaaccugcagaaa

SEQ ID NO: 2022585 - RNA, 21 nt, Homo sapiens
agcgcucagaacaguaucuuu

SEQ ID NO: 2022586 - RNA, 12 nt, Homo sapiens
uaaccuuuucaa

SEQ ID NO: 2022587 - RNA, 15 nt, Homo sapiens
ccgacagucuggaaa

SEQ ID NO: 2022588 - RNA, 14 nt, Homo sapiens
ucuugccugcucca

SEQ ID NO: 2022589 - RNA, 23 nt, Homo sapiens
ugguagcuuucaguauuguaaag

SEQ ID NO: 2022590 - RNA, 19 nt, Homo sapiens
cgcccuuggcuucugugau

SEQ ID NO: 2022591 - RNA, 16 nt, Homo sapiens
gcaccuuugcacagga

SEQ ID NO: 2022592 - RNA, 17 nt, Homo sapiens
ucagagcuccucacuua

SEQ ID NO: 2022593 - RNA, 20 nt, Homo sapiens
cucaccuagaccuugccucc

SEQ ID NO: 2022594 - RNA, 20 nt, Homo sapiens
uuggcuuuaugcaaauacaa

SEQ ID NO: 2022595 - RNA, 12 nt, Homo sapiens
aggagcuccuuc

SEQ ID NO: 2022596 - RNA, 16 nt, Homo sapiens
gccuccugggggaccu

SEQ ID NO: 2022597 - RNA, 20 nt, Homo sapiens
aacugcaagcccacagauga

SEQ ID NO: 2022598 - RNA, 13 nt, Homo sapiens
aguggugccaaac

SEQ ID NO: 2022599 - RNA, 14 nt, Homo sapiens
uuuuguugccuuca

SEQ ID NO: 2022600 - RNA, 22 nt, Homo sapiens
ccaggcugagagccggccgugg

SEQ ID NO: 2022601 - RNA, 17 nt, Homo sapiens
ggauccggggcuuguac

SEQ ID NO: 2022602 - RNA, 16 nt, Homo sapiens
cauccaggacugagau

SEQ ID NO: 2022603 - RNA, 18 nt, Homo sapiens
aaguuauaauaacugaac

SEQ ID NO: 2022604 - RNA, 16 nt, Homo sapiens
ucuguggaagauauca

SEQ ID NO: 2022605 - RNA, 16 nt, Homo sapiens
cuaaugagacugacca

SEQ ID NO: 2022606 - RNA, 16 nt, Homo sapiens
caggaaccauuuucac

SEQ ID NO: 2022607 - RNA, 16 nt, Homo sapiens
uugcuaggagauacuc

SEQ ID NO: 2022608 - RNA, 22 nt, Homo sapiens
gaaugcauugcaucaucaccau

SEQ ID NO: 2022609 - RNA, 21 nt, Homo sapiens
cucauuggacccuuccauggu

SEQ ID NO: 2022610 - RNA, 17 nt, Homo sapiens
ugaggaaugucuuucag

SEQ ID NO: 2022611 - RNA, 23 nt, Homo sapiens
uguagaaaaugaggaaaugccac

SEQ ID NO: 2022612 - RNA, 21 nt, Homo sapiens
cugccaggcucucuuugccca

SEQ ID NO: 2022613 - RNA, 20 nt, Homo sapiens
uucuaaguggggugcauccc

SEQ ID NO: 2022614 - RNA, 22 nt, Homo sapiens
aaacgccccgggcaaagggucu

SEQ ID NO: 2022615 - RNA, 13 nt, Homo sapiens
aagccucauccac

SEQ ID NO: 2022616 - RNA, 16 nt, Homo sapiens
gccuccccaacccugc

SEQ ID NO: 2022617 - RNA, 16 nt, Homo sapiens
accagucucacccacu

SEQ ID NO: 2022618 - RNA, 15 nt, Homo sapiens
auagaaaugucucaa

SEQ ID NO: 2022619 - RNA, 12 nt, Homo sapiens
ugcuucucucac

SEQ ID NO: 2022620 - RNA, 15 nt, Homo sapiens
cauugaaagugaaau

SEQ ID NO: 2022621 - RNA, 22 nt, Homo sapiens
ucaaagccauauggacacugug

SEQ ID NO: 2022622 - RNA, 20 nt, Homo sapiens
ugcuacccugaguucaucca

SEQ ID NO: 2022623 - RNA, 15 nt, Homo sapiens
uccuuguauucugag

SEQ ID NO: 2022624 - RNA, 21 nt, Homo sapiens
aggccgauuugggaaccaagc

SEQ ID NO: 2022625 - RNA, 20 nt, Homo sapiens
aagacauacuccuuccauca

SEQ ID NO: 2022626 - RNA, 13 nt, Homo sapiens
ucuauguacugua

SEQ ID NO: 2022627 - RNA, 19 nt, Homo sapiens
auugucaccagggcuggaa

SEQ ID NO: 2022628 - RNA, 18 nt, Homo sapiens
uuaaacauaaagaauuca

SEQ ID NO: 2022629 - RNA, 18 nt, Homo sapiens
aaugucauucucuucucu

SEQ ID NO: 2022630 - RNA, 16 nt, Homo sapiens
augacuuuauugcauc

SEQ ID NO: 2022631 - RNA, 22 nt, Homo sapiens
aaaucaguugugaauacauucu

SEQ ID NO: 2022632 - RNA, 16 nt, Homo sapiens
uggccguuugcuuaau

SEQ ID NO: 2022633 - RNA, 17 nt, Homo sapiens
cagcaggagcucugacu

SEQ ID NO: 2022634 - RNA, 18 nt, Homo sapiens
uaguguauuuugcacaaa

SEQ ID NO: 2022635 - RNA, 19 nt, Homo sapiens
uuugaggggccugugugga

SEQ ID NO: 2022636 - RNA, 21 nt, Homo sapiens
ugcagagcgccgugaguucuc

SEQ ID NO: 2022637 - RNA, 20 nt, Homo sapiens
ucagcucccauuucuacucu

SEQ ID NO: 2022638 - RNA, 22 nt, Homo sapiens
caugccaacaagaaugcauuga

SEQ ID NO: 2022639 - RNA, 12 nt, Homo sapiens
acucgacccaga

SEQ ID NO: 2022640 - RNA, 21 nt, Homo sapiens
aauuagagcaagaacauucaa

SEQ ID NO: 2022641 - RNA, 16 nt, Homo sapiens
ucuauccucuguaaac

SEQ ID NO: 2022642 - RNA, 17 nt, Homo sapiens
uguuggugugaauuugc

SEQ ID NO: 2022643 - RNA, 11 nt, Homo sapiens
cauugaccucu

SEQ ID NO: 2022644 - RNA, 14 nt, Homo sapiens
ccccuacaucaaau

SEQ ID NO: 2022645 - RNA, 13 nt, Homo sapiens
cauccaacacugg

SEQ ID NO: 2022646 - RNA, 21 nt, Homo sapiens
ggaauccauguaaauugcaaa

SEQ ID NO: 2022647 - RNA, 16 nt, Homo sapiens
ucuccugcagucugug

SEQ ID NO: 2022648 - RNA, 18 nt, Homo sapiens
gagucuucaucuuagggc

SEQ ID NO: 2022649 - RNA, 11 nt, Homo sapiens
caaaguacaga

SEQ ID NO: 2022650 - RNA, 20 nt, Homo sapiens
ugcauaugugugugugugca

SEQ ID NO: 2022651 - RNA, 18 nt, Homo sapiens
ucagaacuucaucugcca

SEQ ID NO: 2022652 - RNA, 14 nt, Homo sapiens
acaauccacucuca

SEQ ID NO: 2022653 - RNA, 20 nt, Homo sapiens
uggccacacuggaauccagu

SEQ ID NO: 2022654 - RNA, 14 nt, Homo sapiens
ucacagacugcugu

SEQ ID NO: 2022655 - RNA, 15 nt, Homo sapiens
cauaaaggacacugg

SEQ ID NO: 2022656 - RNA, 20 nt, Homo sapiens
uacaguguauguacuaagca

SEQ ID NO: 2022657 - RNA, 22 nt, Homo sapiens
guugaucucuuagaagccaugg

SEQ ID NO: 2022658 - RNA, 18 nt, Homo sapiens
uaacaacuugaauuacaa

SEQ ID NO: 2022659 - RNA, 21 nt, Homo sapiens
uucaguucuuacacauuccau

SEQ ID NO: 2022660 - RNA, 11 nt, Homo sapiens
cuucuacagcc

SEQ ID NO: 2022661 - RNA, 21 nt, Homo sapiens
caaaaucaggcuuugucugcu

SEQ ID NO: 2022662 - RNA, 20 nt, Homo sapiens
cauuguuaagaaaguauuug

SEQ ID NO: 2022663 - RNA, 17 nt, Homo sapiens
aauugacaaugauuuau

SEQ ID NO: 2022664 - RNA, 15 nt, Homo sapiens
ucccggccauucucc

SEQ ID NO: 2022665 - RNA, 16 nt, Homo sapiens
uacaguuauccugcaa

SEQ ID NO: 2022666 - RNA, 16 nt, Homo sapiens
gacauuuagccuucaa

SEQ ID NO: 2022667 - RNA, 16 nt, Homo sapiens
uccagcuguacuguag

SEQ ID NO: 2022668 - RNA, 22 nt, Homo sapiens
uaaaaggcaagucaaauaccac

SEQ ID NO: 2022669 - RNA, 23 nt, Homo sapiens
cucaucauagcaauaacauuccc

SEQ ID NO: 2022670 - RNA, 13 nt, Homo sapiens
ugagaggugacac

SEQ ID NO: 2022671 - RNA, 19 nt, Homo sapiens
ugaucuuugugacccacac

SEQ ID NO: 2022672 - RNA, 13 nt, Homo sapiens
ccuucggcagcua

SEQ ID NO: 2022673 - RNA, 12 nt, Homo sapiens
ugucuaccucag

SEQ ID NO: 2022674 - RNA, 17 nt, Homo sapiens
auggagcaggacucuau

SEQ ID NO: 2022675 - RNA, 15 nt, Homo sapiens
uuccgauacaaagug

SEQ ID NO: 2022676 - RNA, 17 nt, Homo sapiens
ccagaauaaacuggcag

SEQ ID NO: 2022677 - RNA, 19 nt, Homo sapiens
aacauguuuuaacauuauu

SEQ ID NO: 2022678 - RNA, 23 nt, Homo sapiens
ucccuugcuguaugcugaucauc

SEQ ID NO: 2022679 - RNA, 13 nt, Homo sapiens
cuucacauuugcg

SEQ ID NO: 2022680 - RNA, 17 nt, Homo sapiens
acccacccuaccacagu

SEQ ID NO: 2022681 - RNA, 12 nt, Homo sapiens
uuggagcaaacc

SEQ ID NO: 2022682 - RNA, 23 nt, Homo sapiens
gaggagcaagguuuaaauuuguu

SEQ ID NO: 2022683 - RNA, 23 nt, Homo sapiens
aaacuggaaaguacguuaugaua

SEQ ID NO: 2022684 - RNA, 18 nt, Homo sapiens
cagcccgggucaucugua

SEQ ID NO: 2022685 - RNA, 13 nt, Homo sapiens
uuauuuuuugcca

SEQ ID NO: 2022686 - RNA, 14 nt, Homo sapiens
ugaagaccuggacu

SEQ ID NO: 2022687 - RNA, 13 nt, Homo sapiens
cuaaauccaaaga

SEQ ID NO: 2022688 - RNA, 17 nt, Homo sapiens
cucaugguauguaacuc

SEQ ID NO: 2022689 - RNA, 22 nt, Homo sapiens
gggacauuucccuccugggaga

SEQ ID NO: 2022690 - RNA, 20 nt, Homo sapiens
cuugccuaaauacaagggcu

SEQ ID NO: 2022691 - RNA, 20 nt, Homo sapiens
aggcuaccaacuuguaucca

SEQ ID NO: 2022692 - RNA, 18 nt, Homo sapiens
auuauuacuggcaaaaac

SEQ ID NO: 2022693 - RNA, 16 nt, Homo sapiens
aauaucaacucugaaa

SEQ ID NO: 2022694 - RNA, 20 nt, Homo sapiens
aaguaauucugcugucucag

SEQ ID NO: 2022695 - RNA, 17 nt, Homo sapiens
aagggauuuuuacaucc

SEQ ID NO: 2022696 - RNA, 13 nt, Homo sapiens
guccaguuugugc

SEQ ID NO: 2022697 - RNA, 14 nt, Homo sapiens
gagaggaagccagc

SEQ ID NO: 2022698 - RNA, 11 nt, Homo sapiens
cacaaagggaa

SEQ ID NO: 2022699 - RNA, 18 nt, Homo sapiens
auucauccuuccauccau

SEQ ID NO: 2022700 - RNA, 23 nt, Homo sapiens
auuuacuggacaaagaauuccaa

SEQ ID NO: 2022701 - RNA, 21 nt, Homo sapiens
gaaggcuuuaauaaaggccac

SEQ ID NO: 2022702 - RNA, 13 nt, Homo sapiens
cugaaaagccaug

SEQ ID NO: 2022703 - RNA, 15 nt, Homo sapiens
ggacuucugccugaa

SEQ ID NO: 2022704 - RNA, 17 nt, Homo sapiens
aggaaaaucacaucucc

SEQ ID NO: 2022705 - RNA, 20 nt, Homo sapiens
aaucccacauuagcuuguua

SEQ ID NO: 2022706 - RNA, 21 nt, Homo sapiens
agcuucucuacagacuccaaa

SEQ ID NO: 2022707 - RNA, 12 nt, Homo sapiens
caggccagagaa

SEQ ID NO: 2022708 - RNA, 15 nt, Homo sapiens
ugucccuguagcuca

SEQ ID NO: 2022709 - RNA, 16 nt, Homo sapiens
uacuucaagaucugaa

SEQ ID NO: 2022710 - RNA, 23 nt, Homo sapiens
ggguucuggggcaucagccagcu

SEQ ID NO: 2022711 - RNA, 14 nt, Homo sapiens
gcaugaagcacauu

SEQ ID NO: 2022712 - RNA, 20 nt, Homo sapiens
cuguaacgccuguuacacac

SEQ ID NO: 2022713 - RNA, 19 nt, Homo sapiens
cacugcagucugggcccca

SEQ ID NO: 2022714 - RNA, 19 nt, Homo sapiens
guggaccauggaguggcag

SEQ ID NO: 2022715 - RNA, 13 nt, Homo sapiens
cccccccaacaag

SEQ ID NO: 2022716 - RNA, 14 nt, Homo sapiens
acugcaaaguguau

SEQ ID NO: 2022717 - RNA, 20 nt, Homo sapiens
cacauuuuuaaaagaacaau

SEQ ID NO: 2022718 - RNA, 22 nt, Homo sapiens
ucagcagaauacugcuugcuua

SEQ ID NO: 2022719 - RNA, 20 nt, Homo sapiens
uaaucacuauuguuccagca

SEQ ID NO: 2022720 - RNA, 18 nt, Homo sapiens
auuuguauucucugcaau

SEQ ID NO: 2022721 - RNA, 17 nt, Homo sapiens
cugaaaccagugacuca

SEQ ID NO: 2022722 - RNA, 23 nt, Homo sapiens
gguauuucaaaacacaucuuucc

SEQ ID NO: 2022723 - RNA, 19 nt, Homo sapiens
uuauucuaaacagacucau

SEQ ID NO: 2022724 - RNA, 16 nt, Homo sapiens
aucuaugccacaagaa

SEQ ID NO: 2022725 - RNA, 13 nt, Homo sapiens
cacacccuaccuu

SEQ ID NO: 2022726 - RNA, 18 nt, Homo sapiens
ugcacguguguauugcaa

SEQ ID NO: 2022727 - RNA, 16 nt, Homo sapiens
agagguucugcacucc

SEQ ID NO: 2022728 - RNA, 21 nt, Homo sapiens
aggcguacuacccagcucugu

SEQ ID NO: 2022729 - RNA, 17 nt, Homo sapiens
auaaaauuuuuauguaa

SEQ ID NO: 2022730 - RNA, 20 nt, Homo sapiens
ugauuugguugcacuuuaga

SEQ ID NO: 2022731 - RNA, 13 nt, Homo sapiens
agagcuggaugca

SEQ ID NO: 2022732 - RNA, 17 nt, Homo sapiens
cauuuuagaaugucaau

SEQ ID NO: 2022733 - RNA, 20 nt, Homo sapiens
uaggaauucguaaucauccc

SEQ ID NO: 2022734 - RNA, 16 nt, Homo sapiens
uaaaacuacaugguca

SEQ ID NO: 2022735 - RNA, 14 nt, Homo sapiens
cugcccucccucag

SEQ ID NO: 2022736 - RNA, 17 nt, Homo sapiens
gccccucugaccugcac

SEQ ID NO: 2022737 - RNA, 21 nt, Homo sapiens
ggaaaggauuuuaccaaagca

SEQ ID NO: 2022738 - RNA, 17 nt, Homo sapiens
agcucuaaagcagagau

SEQ ID NO: 2022739 - RNA, 14 nt, Homo sapiens
caccacagugcccc

SEQ ID NO: 2022740 - RNA, 23 nt, Homo sapiens
gagggacagcucacgaggcuugg

SEQ ID NO: 2022741 - RNA, 18 nt, Homo sapiens
gccauugauccagcucag

SEQ ID NO: 2022742 - RNA, 21 nt, Homo sapiens
ucacuuaaacuuugucacuuc

SEQ ID NO: 2022743 - RNA, 23 nt, Homo sapiens
uuccucauuuuuauauucauuua

SEQ ID NO: 2022744 - RNA, 20 nt, Homo sapiens
ccugucucuuuccacuuugu

SEQ ID NO: 2022745 - RNA, 21 nt, Homo sapiens
agccuuuuuuccugggccaga

SEQ ID NO: 2022746 - RNA, 16 nt, Homo sapiens
acaugcuuauaacauu

SEQ ID NO: 2022747 - RNA, 13 nt, Homo sapiens
acuccaugcugcc

SEQ ID NO: 2022748 - RNA, 20 nt, Homo sapiens
acuugcaauaaaguuauuca

SEQ ID NO: 2022749 - RNA, 21 nt, Homo sapiens
uaaaaucaauucauguuugaa

SEQ ID NO: 2022750 - RNA, 12 nt, Homo sapiens
gcaucuaucugg

SEQ ID NO: 2022751 - RNA, 15 nt, Homo sapiens
agggagaaccucucc

SEQ ID NO: 2022752 - RNA, 16 nt, Homo sapiens
gaacagcauaugcaaa

SEQ ID NO: 2022753 - RNA, 22 nt, Homo sapiens
gguauaugcacaaaacuacuuu

SEQ ID NO: 2022754 - RNA, 15 nt, Homo sapiens
ucgacggcacgcacu

SEQ ID NO: 2022755 - RNA, 15 nt, Homo sapiens
uccugaguuagauuu

SEQ ID NO: 2022756 - RNA, 15 nt, Homo sapiens
acuauguacugccuu

SEQ ID NO: 2022757 - RNA, 16 nt, Homo sapiens
augaccauaaaauuag

SEQ ID NO: 2022758 - RNA, 14 nt, Homo sapiens
gagacagccaggug

SEQ ID NO: 2022759 - RNA, 16 nt, Homo sapiens
augccuccaagccauu

SEQ ID NO: 2022760 - RNA, 11 nt, Homo sapiens
cacagugcaua

SEQ ID NO: 2022761 - RNA, 20 nt, Homo sapiens
uguaaucccagcacuuggag

SEQ ID NO: 2022762 - RNA, 21 nt, Homo sapiens
ugcaguuuugccuaauggcaa

SEQ ID NO: 2022763 - RNA, 15 nt, Homo sapiens
ugcaccacuugacag

SEQ ID NO: 2022764 - RNA, 18 nt, Homo sapiens
ccacacauuaguacuuau

SEQ ID NO: 2022765 - RNA, 17 nt, Homo sapiens
agaaguugagagagcaa

SEQ ID NO: 2022766 - RNA, 19 nt, Homo sapiens
gcaucccugagacagggag

SEQ ID NO: 2022767 - RNA, 20 nt, Homo sapiens
aggguuucaccauguugccc

SEQ ID NO: 2022768 - RNA, 16 nt, Homo sapiens
gucucccuucuugggu

SEQ ID NO: 2022769 - RNA, 13 nt, Homo sapiens
ccacaaaucugaa

SEQ ID NO: 2022770 - RNA, 13 nt, Homo sapiens
ucaaaaauuugca

SEQ ID NO: 2022771 - RNA, 18 nt, Homo sapiens
aucauugccaucaccauu

SEQ ID NO: 2022772 - RNA, 20 nt, Homo sapiens
gccucugccucccaaagugc

SEQ ID NO: 2022773 - RNA, 21 nt, Homo sapiens
auuaccacucaagaagacacu

SEQ ID NO: 2022774 - RNA, 13 nt, Homo sapiens
ucuaauugcugug

SEQ ID NO: 2022775 - RNA, 21 nt, Homo sapiens
cggcugagucaugaucucccu

SEQ ID NO: 2022776 - RNA, 17 nt, Homo sapiens
ccacggugccuccagau

SEQ ID NO: 2022777 - RNA, 21 nt, Homo sapiens
uuagucuguuuucuaaagcca

SEQ ID NO: 2022778 - RNA, 15 nt, Homo sapiens
ugccaucccaaaaau

SEQ ID NO: 2022779 - RNA, 13 nt, Homo sapiens
cugugaccauuua

SEQ ID NO: 2022780 - RNA, 13 nt, Homo sapiens
ggcauggauccag

SEQ ID NO: 2022781 - RNA, 16 nt, Homo sapiens
aucaccuggcugagca

SEQ ID NO: 2022782 - RNA, 16 nt, Homo sapiens
aggccuaggaccucag

SEQ ID NO: 2022783 - RNA, 14 nt, Homo sapiens
caaaguguacaaau

SEQ ID NO: 2022784 - RNA, 13 nt, Homo sapiens
agagacugugagg

SEQ ID NO: 2022785 - RNA, 17 nt, Homo sapiens
cagcauggucuuaugca

SEQ ID NO: 2022786 - RNA, 18 nt, Homo sapiens
uguacaaaauauccaagc

SEQ ID NO: 2022787 - RNA, 19 nt, Homo sapiens
cuuauucuacugaaauuau

SEQ ID NO: 2022788 - RNA, 21 nt, Homo sapiens
gucugguucacaguuuagcau

SEQ ID NO: 2022789 - RNA, 15 nt, Homo sapiens
uucucgauucuuuga

SEQ ID NO: 2022790 - RNA, 15 nt, Homo sapiens
cucaauaaacaguca

SEQ ID NO: 2022791 - RNA, 11 nt, Homo sapiens
uaugcugcuau

SEQ ID NO: 2022792 - RNA, 19 nt, Homo sapiens
ccuaucuccugacagaagg

SEQ ID NO: 2022793 - RNA, 23 nt, Homo sapiens
gagcagagcucuccccuccugcu

SEQ ID NO: 2022794 - RNA, 19 nt, Homo sapiens
caaggucaugccacugcac

SEQ ID NO: 2022795 - RNA, 13 nt, Homo sapiens
ucagcccuggauu

SEQ ID NO: 2022796 - RNA, 22 nt, Homo sapiens
cuggcugggaguccuuaccucg

SEQ ID NO: 2022797 - RNA, 18 nt, Homo sapiens
ccaguguaacauguuuua

SEQ ID NO: 2022798 - RNA, 21 nt, Homo sapiens
aaccaagagauaacuguaaau

SEQ ID NO: 2022799 - RNA, 16 nt, Homo sapiens
aaacuauugagccuug

SEQ ID NO: 2022800 - RNA, 18 nt, Homo sapiens
aguugugacagucacugc

SEQ ID NO: 2022801 - RNA, 22 nt, Homo sapiens
caaggucacuuugcguguguca

SEQ ID NO: 2022802 - RNA, 13 nt, Homo sapiens
ccugcagagccaa

SEQ ID NO: 2022803 - RNA, 16 nt, Homo sapiens
aaagauacgacuuuau

SEQ ID NO: 2022804 - RNA, 20 nt, Homo sapiens
gaucucaauuugcaguauuc

SEQ ID NO: 2022805 - RNA, 20 nt, Homo sapiens
gauggugguaaacauucucu

SEQ ID NO: 2022806 - RNA, 19 nt, Homo sapiens
gcaaauaaucacagauuag

SEQ ID NO: 2022807 - RNA, 15 nt, Homo sapiens
ggcugcacaacagcc

SEQ ID NO: 2022808 - RNA, 18 nt, Homo sapiens
uggauuccagcauuugcc

SEQ ID NO: 2022809 - RNA, 20 nt, Homo sapiens
gaauuaagcguuguaguaaa

SEQ ID NO: 2022810 - RNA, 15 nt, Homo sapiens
ucaccagauuugcua

SEQ ID NO: 2022811 - RNA, 18 nt, Homo sapiens
uauuuuaggaaacucucc

SEQ ID NO: 2022812 - RNA, 23 nt, Homo sapiens
auugggaaaugaaaaaaaaaugg

SEQ ID NO: 2022813 - RNA, 23 nt, Homo sapiens
acagaaggacugaagaccagcug

SEQ ID NO: 2022814 - RNA, 20 nt, Homo sapiens
accaaugaaaacauguacua

SEQ ID NO: 2022815 - RNA, 12 nt, Homo sapiens
auucucagggcu

SEQ ID NO: 2022816 - RNA, 14 nt, Homo sapiens
uuuaugaugcaguu

SEQ ID NO: 2022817 - RNA, 20 nt, Homo sapiens
aaugacugaagacaggcaca

SEQ ID NO: 2022818 - RNA, 22 nt, Homo sapiens
ucaccaggauuuauacauacag

SEQ ID NO: 2022819 - RNA, 21 nt, Homo sapiens
gcuuauaaaaauaaagggaag

SEQ ID NO: 2022820 - RNA, 17 nt, Homo sapiens
cugacccagugccccca

SEQ ID NO: 2022821 - RNA, 19 nt, Homo sapiens
cagccagaaggggcugcuu

SEQ ID NO: 2022822 - RNA, 16 nt, Homo sapiens
aaaaaccaaaacugug

SEQ ID NO: 2022823 - RNA, 18 nt, Homo sapiens
cauuuugugaagcccugu

SEQ ID NO: 2022824 - RNA, 15 nt, Homo sapiens
gacauacuuaaugca

SEQ ID NO: 2022825 - RNA, 16 nt, Homo sapiens
gaggacaaaaggaaug

SEQ ID NO: 2022826 - RNA, 17 nt, Homo sapiens
ggugugaauaaaagcau

SEQ ID NO: 2022827 - RNA, 23 nt, Homo sapiens
uagucccaccuuggagcauuuau

SEQ ID NO: 2022828 - RNA, 21 nt, Homo sapiens
auggggaaaagaaaaaccacg

SEQ ID NO: 2022829 - RNA, 16 nt, Homo sapiens
cucagaauacagacaa

SEQ ID NO: 2022830 - RNA, 18 nt, Homo sapiens
accucgaaugcuccuaaa

SEQ ID NO: 2022831 - RNA, 15 nt, Homo sapiens
cuccaccugcacauu

SEQ ID NO: 2022832 - RNA, 18 nt, Homo sapiens
ucuaaccaaagagucucu

SEQ ID NO: 2022833 - RNA, 20 nt, Homo sapiens
gaauuggcuuccagauuuua

SEQ ID NO: 2022834 - RNA, 14 nt, Homo sapiens
aacuuccaguauca

SEQ ID NO: 2022835 - RNA, 14 nt, Homo sapiens
aaaccacaguccuc

SEQ ID NO: 2022836 - RNA, 22 nt, Homo sapiens
gguucacagaagcacagcaccc

SEQ ID NO: 2022837 - RNA, 17 nt, Homo sapiens
caaacucaaacuugaga

SEQ ID NO: 2022838 - RNA, 23 nt, Homo sapiens
aucuuuguguaaucuaaguauau

SEQ ID NO: 2022839 - RNA, 18 nt, Homo sapiens
cuggccuuguaucuugca

SEQ ID NO: 2022840 - RNA, 16 nt, Homo sapiens
uaaaugauguguuggu

SEQ ID NO: 2022841 - RNA, 16 nt, Homo sapiens
aguuccuggcaucucu

SEQ ID NO: 2022842 - RNA, 17 nt, Homo sapiens
ugacuuucgauuaugcu

SEQ ID NO: 2022843 - RNA, 17 nt, Homo sapiens
ccagaugugguugcaua

SEQ ID NO: 2022844 - RNA, 16 nt, Homo sapiens
caugaacaaagauaua

SEQ ID NO: 2022845 - RNA, 19 nt, Homo sapiens
uauuacaccuuuaucucaa

SEQ ID NO: 2022846 - RNA, 13 nt, Homo sapiens
cucagcacaggcc

SEQ ID NO: 2022847 - RNA, 20 nt, Homo sapiens
uuguauuuuuuuucuuguau

SEQ ID NO: 2022848 - RNA, 19 nt, Homo sapiens
agacagagcccccaagccu

SEQ ID NO: 2022849 - RNA, 15 nt, Homo sapiens
acgcaacuggcucaa

SEQ ID NO: 2022850 - RNA, 16 nt, Homo sapiens
uuauuacggugauccu

SEQ ID NO: 2022851 - RNA, 22 nt, Homo sapiens
caagacuggcauggacaucagc

SEQ ID NO: 2022852 - RNA, 14 nt, Homo sapiens
agauggccaugccc

SEQ ID NO: 2022853 - RNA, 22 nt, Homo sapiens
ugccuugugaauuugcugcuau

SEQ ID NO: 2022854 - RNA, 18 nt, Homo sapiens
acaggaaggaaugcaaaa

SEQ ID NO: 2022855 - RNA, 22 nt, Homo sapiens
auuucaugggacuaaaugaacu

SEQ ID NO: 2022856 - RNA, 15 nt, Homo sapiens
caccaugaacuugau

SEQ ID NO: 2022857 - RNA, 22 nt, Homo sapiens
uagaguaacacauaacauugua

SEQ ID NO: 2022858 - RNA, 17 nt, Homo sapiens
agucuuaucugagcuga

SEQ ID NO: 2022859 - RNA, 20 nt, Homo sapiens
guuucacccuacuccuccag

SEQ ID NO: 2022860 - RNA, 22 nt, Homo sapiens
agauucaauuaaguuauuaaca

SEQ ID NO: 2022861 - RNA, 17 nt, Homo sapiens
aaacuuucucuuugcca

SEQ ID NO: 2022862 - RNA, 20 nt, Homo sapiens
cuccuaggccugauuguccu

SEQ ID NO: 2022863 - RNA, 23 nt, Homo sapiens
uuaccugaagggguuuucuugau

SEQ ID NO: 2022864 - RNA, 13 nt, Homo sapiens
ucuaccaagaaca

SEQ ID NO: 2022865 - RNA, 21 nt, Homo sapiens
gugggagcagcgguuugggga

SEQ ID NO: 2022866 - RNA, 15 nt, Homo sapiens
gaggaaaaguccaca

SEQ ID NO: 2022867 - RNA, 14 nt, Homo sapiens
aacagaaacuucuc

SEQ ID NO: 2022868 - RNA, 14 nt, Homo sapiens
gccuacagccagaa

SEQ ID NO: 2022869 - RNA, 17 nt, Homo sapiens
guacucuuaacuccuag

SEQ ID NO: 2022870 - RNA, 13 nt, Homo sapiens
cguaggcaagaag

SEQ ID NO: 2022871 - RNA, 18 nt, Homo sapiens
cugccucucggugaccuc

SEQ ID NO: 2022872 - RNA, 22 nt, Homo sapiens
cagcuugaaccugcuuccuggc

SEQ ID NO: 2022873 - RNA, 13 nt, Homo sapiens
cauguacugagac

SEQ ID NO: 2022874 - RNA, 18 nt, Homo sapiens
auacggcccaugcaauuu

SEQ ID NO: 2022875 - RNA, 17 nt, Homo sapiens
cuuagccaagcaguuuc

SEQ ID NO: 2022876 - RNA, 17 nt, Homo sapiens
ugcgcuuuauugcccau

SEQ ID NO: 2022877 - RNA, 19 nt, Homo sapiens
aaagaggauuaagcuuuuu

SEQ ID NO: 2022878 - RNA, 22 nt, Homo sapiens
gaagugacacuuugacauuucc

SEQ ID NO: 2022879 - RNA, 14 nt, Homo sapiens
uguguucugucacc

SEQ ID NO: 2022880 - RNA, 20 nt, Homo sapiens
gcaggccuuuuugagccaau

SEQ ID NO: 2022881 - RNA, 17 nt, Homo sapiens
ugagcaugccccaaaaa

SEQ ID NO: 2022882 - RNA, 20 nt, Homo sapiens
uguaaauacuguuuuuaaca

SEQ ID NO: 2022883 - RNA, 23 nt, Homo sapiens
aucugugugcccuagggcucaga

SEQ ID NO: 2022884 - RNA, 16 nt, Homo sapiens
aacauuugcugccauu

SEQ ID NO: 2022885 - RNA, 21 nt, Homo sapiens
uugucaacuugaaauguguuc

SEQ ID NO: 2022886 - RNA, 21 nt, Homo sapiens
ugugagugagggagacaggaa

SEQ ID NO: 2022887 - RNA, 13 nt, Homo sapiens
aagaaucagucuu

SEQ ID NO: 2022888 - RNA, 18 nt, Homo sapiens
uaguuacuguaaaaugca

SEQ ID NO: 2022889 - RNA, 15 nt, Homo sapiens
acuccggagguagag

SEQ ID NO: 2022890 - RNA, 17 nt, Homo sapiens
ccugugccuaacagcau

SEQ ID NO: 2022891 - RNA, 16 nt, Homo sapiens
agaaugacccugucaa

SEQ ID NO: 2022892 - RNA, 16 nt, Homo sapiens
accaccugccagccau

SEQ ID NO: 2022893 - RNA, 19 nt, Homo sapiens
uguuaaaauguacacugga

SEQ ID NO: 2022894 - RNA, 19 nt, Homo sapiens
ucuuucagaaagcuuugaa

SEQ ID NO: 2022895 - RNA, 13 nt, Homo sapiens
caguugugacaau

SEQ ID NO: 2022896 - RNA, 15 nt, Homo sapiens
auuuucuguuccagg

SEQ ID NO: 2022897 - RNA, 20 nt, Homo sapiens
caaggagucagauggcaaug

SEQ ID NO: 2022898 - RNA, 16 nt, Homo sapiens
gggcagggcccacgug

SEQ ID NO: 2022899 - RNA, 22 nt, Homo sapiens
ccuagagaaaacuugaauucau

SEQ ID NO: 2022900 - RNA, 19 nt, Homo sapiens
gauggagugcaguggcuca

SEQ ID NO: 2022901 - RNA, 13 nt, Homo sapiens
ugggcuggggccu

SEQ ID NO: 2022902 - RNA, 17 nt, Homo sapiens
uaaaagcaucacaugaa

SEQ ID NO: 2022903 - RNA, 17 nt, Homo sapiens
gaccacugggcaaugau

SEQ ID NO: 2022904 - RNA, 16 nt, Homo sapiens
gcagugucuguaccuc

SEQ ID NO: 2022905 - RNA, 19 nt, Homo sapiens
accuggguaacaaagugag

SEQ ID NO: 2022906 - RNA, 19 nt, Homo sapiens
acaugcucacacauuacaa

SEQ ID NO: 2022907 - RNA, 13 nt, Homo sapiens
auguuaugcagug

SEQ ID NO: 2022908 - RNA, 22 nt, Homo sapiens
gaacacuaaacagacuauuuaa

SEQ ID NO: 2022909 - RNA, 18 nt, Homo sapiens
uucaaacggccucacuag

SEQ ID NO: 2022910 - RNA, 19 nt, Homo sapiens
ugaagauucaggcuugcau

SEQ ID NO: 2022911 - RNA, 23 nt, Homo sapiens
uggacuuuccagagaccaguauu

SEQ ID NO: 2022912 - RNA, 22 nt, Homo sapiens
cucccuguucaaggccccugac

SEQ ID NO: 2022913 - RNA, 19 nt, Homo sapiens
uucagugagccccucccca

SEQ ID NO: 2022914 - RNA, 12 nt, Homo sapiens
aucaagcacuuc

SEQ ID NO: 2022915 - RNA, 12 nt, Homo sapiens
caucagcaaaca

SEQ ID NO: 2022916 - RNA, 23 nt, Homo sapiens
guucaguccucccagacuaccug

SEQ ID NO: 2022917 - RNA, 20 nt, Homo sapiens
cugugacuuucaaggacauu

SEQ ID NO: 2022918 - RNA, 20 nt, Homo sapiens
gcuauuucaggcccucagcu

SEQ ID NO: 2022919 - RNA, 15 nt, Homo sapiens
uccauguauauauuc

SEQ ID NO: 2022920 - RNA, 21 nt, Homo sapiens
ucucaggaccacccugccaag

SEQ ID NO: 2022921 - RNA, 14 nt, Homo sapiens
augagcauuuagca

SEQ ID NO: 2022922 - RNA, 20 nt, Homo sapiens
gcaucugggcaggaugacuu

SEQ ID NO: 2022923 - RNA, 22 nt, Homo sapiens
ugucuaugacgcaaagaucacc

SEQ ID NO: 2022924 - RNA, 13 nt, Homo sapiens
caagauugacagg

SEQ ID NO: 2022925 - RNA, 15 nt, Homo sapiens
cuuuugccagccugu

SEQ ID NO: 2022926 - RNA, 14 nt, Homo sapiens
guuccugacacuca

SEQ ID NO: 2022927 - RNA, 18 nt, Homo sapiens
ggcagggccccugacccu

SEQ ID NO: 2022928 - RNA, 13 nt, Homo sapiens
aggguugagcugg

SEQ ID NO: 2022929 - RNA, 21 nt, Homo sapiens
caaucucguuuagugccaaug

SEQ ID NO: 2022930 - RNA, 23 nt, Homo sapiens
uucuugucagacauaaagccaug

SEQ ID NO: 2022931 - RNA, 14 nt, Homo sapiens
agcccaaucugcca

SEQ ID NO: 2022932 - RNA, 21 nt, Homo sapiens
ccacgccaguugccucuugaa

SEQ ID NO: 2022933 - RNA, 20 nt, Homo sapiens
cgggugguccgggaagugag

SEQ ID NO: 2022934 - RNA, 15 nt, Homo sapiens
agggaugccauaccu

SEQ ID NO: 2022935 - RNA, 15 nt, Homo sapiens
agcccaggaucucuu

SEQ ID NO: 2022936 - RNA, 20 nt, Homo sapiens
gugcauucauucauccucuu

SEQ ID NO: 2022937 - RNA, 13 nt, Homo sapiens
acuguggcauuuu

SEQ ID NO: 2022938 - RNA, 15 nt, Homo sapiens
caccacgucacuuca

SEQ ID NO: 2022939 - RNA, 23 nt, Homo sapiens
cagcccuuacaguauuguuacca

SEQ ID NO: 2022940 - RNA, 21 nt, Homo sapiens
cuuugcucccuguugcugaaa

SEQ ID NO: 2022941 - RNA, 20 nt, Homo sapiens
cagugaguugggauuggaca

SEQ ID NO: 2022942 - RNA, 20 nt, Homo sapiens
uguuaggaaaugucaucaaa

SEQ ID NO: 2022943 - RNA, 16 nt, Homo sapiens
aucguucuuucuagcu

SEQ ID NO: 2022944 - RNA, 18 nt, Homo sapiens
acuggucagcuugcucag

SEQ ID NO: 2022945 - RNA, 17 nt, Homo sapiens
gggggccuucacaguga

SEQ ID NO: 2022946 - RNA, 17 nt, Homo sapiens
cccauaauaaaauauca

SEQ ID NO: 2022947 - RNA, 14 nt, Homo sapiens
uggccggcuggaaa

SEQ ID NO: 2022948 - RNA, 15 nt, Homo sapiens
gaacauuuacuacag

SEQ ID NO: 2022949 - RNA, 19 nt, Homo sapiens
ugcagcugcuuuugcauuu

SEQ ID NO: 2022950 - RNA, 23 nt, Homo sapiens
uguuugugacccugagaaggcaa

SEQ ID NO: 2022951 - RNA, 23 nt, Homo sapiens
cuaacugcaauguggauguuuua

SEQ ID NO: 2022952 - RNA, 18 nt, Homo sapiens
cccacuggacaacacuga

SEQ ID NO: 2022953 - RNA, 18 nt, Homo sapiens
uggauuguauugugagau

SEQ ID NO: 2022954 - RNA, 19 nt, Homo sapiens
uauccugugcuaugcugga

SEQ ID NO: 2022955 - RNA, 19 nt, Homo sapiens
uggcugugggcucccuucc

SEQ ID NO: 2022956 - RNA, 21 nt, Homo sapiens
auuggaaguguucaagaaaua

SEQ ID NO: 2022957 - RNA, 21 nt, Homo sapiens
cuggagugcaguggugugauc

SEQ ID NO: 2022958 - RNA, 14 nt, Homo sapiens
auuuauagcaagau

SEQ ID NO: 2022959 - RNA, 14 nt, Homo sapiens
accaaccagaccac

SEQ ID NO: 2022960 - RNA, 18 nt, Homo sapiens
ucuacccuagauccaauu

SEQ ID NO: 2022961 - RNA, 15 nt, Homo sapiens
ccacgaggugcagua

SEQ ID NO: 2022962 - RNA, 20 nt, Homo sapiens
ugcaguggcaccaucucagu

SEQ ID NO: 2022963 - RNA, 16 nt, Homo sapiens
augacauggugaaaau

SEQ ID NO: 2022964 - RNA, 15 nt, Homo sapiens
uagaaagaugagauc

SEQ ID NO: 2022965 - RNA, 23 nt, Homo sapiens
ugcuguauugcccccaugggguc

SEQ ID NO: 2022966 - RNA, 23 nt, Homo sapiens
cagccuccugagcagcugggauu

SEQ ID NO: 2022967 - RNA, 18 nt, Homo sapiens
uguuaguggaaaauggaa

SEQ ID NO: 2022968 - RNA, 13 nt, Homo sapiens
aaagguuguguac

SEQ ID NO: 2022969 - RNA, 14 nt, Homo sapiens
uacuccagccuggg

SEQ ID NO: 2022970 - RNA, 22 nt, Homo sapiens
gugaggccugcacagcuaagug

SEQ ID NO: 2022971 - RNA, 18 nt, Homo sapiens
caacucagaaugcucuac

SEQ ID NO: 2022972 - RNA, 15 nt, Homo sapiens
auuccuugguaauau

SEQ ID NO: 2022973 - RNA, 15 nt, Homo sapiens
cuuuccuucauucaa

SEQ ID NO: 2022974 - RNA, 16 nt, Homo sapiens
ccuuucauaccuugaa

SEQ ID NO: 2022975 - RNA, 22 nt, Homo sapiens
auucagaugaauagauggaauu

SEQ ID NO: 2022976 - RNA, 18 nt, Homo sapiens
cauauauauaguuaugca

SEQ ID NO: 2022977 - RNA, 13 nt, Homo sapiens
ugcuugaauauua

SEQ ID NO: 2022978 - RNA, 13 nt, Homo sapiens
caauaugauuugc

SEQ ID NO: 2022979 - RNA, 15 nt, Homo sapiens
uucacauugaaucau

SEQ ID NO: 2022980 - RNA, 15 nt, Homo sapiens
gcugaggccuaugca

SEQ ID NO: 2022981 - RNA, 18 nt, Homo sapiens
uugcagugagugcugcuc

SEQ ID NO: 2022982 - RNA, 13 nt, Homo sapiens
aaaaggcccucug

SEQ ID NO: 2022983 - RNA, 15 nt, Homo sapiens
ugccuuuuauguaaa

SEQ ID NO: 2022984 - RNA, 18 nt, Homo sapiens
gcuguuuccaggaaauua

SEQ ID NO: 2022985 - RNA, 16 nt, Homo sapiens
caaugccauuuugcua

SEQ ID NO: 2022986 - RNA, 21 nt, Homo sapiens
aaacugugcuucucuaugaua

SEQ ID NO: 2022987 - RNA, 17 nt, Homo sapiens
guccaggaacugccugg

SEQ ID NO: 2022988 - RNA, 15 nt, Homo sapiens
ucaguucucuacucc

SEQ ID NO: 2022989 - RNA, 14 nt, Homo sapiens
aucguuuugcccga

SEQ ID NO: 2022990 - RNA, 20 nt, Homo sapiens
aaagccugaaguggaaugac

SEQ ID NO: 2022991 - RNA, 14 nt, Homo sapiens
augccugucuuaga

SEQ ID NO: 2022992 - RNA, 22 nt, Homo sapiens
cugucucaaaaccggguugcca

SEQ ID NO: 2022993 - RNA, 17 nt, Homo sapiens
uuaaaauacauuuggcc

SEQ ID NO: 2022994 - RNA, 20 nt, Homo sapiens
guucagauguuucaucaaug

SEQ ID NO: 2022995 - RNA, 14 nt, Homo sapiens
auagaacauccaga

SEQ ID NO: 2022996 - RNA, 19 nt, Homo sapiens
uuuccauccauuaccucca

SEQ ID NO: 2022997 - RNA, 20 nt, Homo sapiens
ucucaaccccaucauccugc

SEQ ID NO: 2022998 - RNA, 16 nt, Homo sapiens
uccagcccccaguguc

SEQ ID NO: 2022999 - RNA, 15 nt, Homo sapiens
cccagacuacuauuu

SEQ ID NO: 2023000 - RNA, 16 nt, Homo sapiens
gggcagcaccuccuaa

SEQ ID NO: 2023001 - RNA, 14 nt, Homo sapiens
uggcaccugcacac

SEQ ID NO: 2023002 - RNA, 21 nt, Homo sapiens
auacuaaaccagcauacccuu

SEQ ID NO: 2023003 - RNA, 19 nt, Homo sapiens
uuucuguucuguuggauga

SEQ ID NO: 2023004 - RNA, 12 nt, Homo sapiens
auuuggacaaaa

SEQ ID NO: 2023005 - RNA, 15 nt, Homo sapiens
uccuugaaaccagcu

SEQ ID NO: 2023006 - RNA, 18 nt, Homo sapiens
cuucaggcagccagugug

SEQ ID NO: 2023007 - RNA, 16 nt, Homo sapiens
caacucacagcuucuc

SEQ ID NO: 2023008 - RNA, 15 nt, Homo sapiens
gggucgugguggaga

SEQ ID NO: 2023009 - RNA, 16 nt, Homo sapiens
agugguuaagauuccu

SEQ ID NO: 2023010 - RNA, 15 nt, Homo sapiens
acuuagacuccucuu

SEQ ID NO: 2023011 - RNA, 15 nt, Homo sapiens
uccaugaacaucaug

SEQ ID NO: 2023012 - RNA, 15 nt, Homo sapiens
uuauuacucuauaca

SEQ ID NO: 2023013 - RNA, 14 nt, Homo sapiens
gaagcacagcuccu

SEQ ID NO: 2023014 - RNA, 23 nt, Homo sapiens
ucacagcccagcccgcccacugg

SEQ ID NO: 2023015 - RNA, 21 nt, Homo sapiens
aaggucaaacuaauucucaca

SEQ ID NO: 2023016 - RNA, 17 nt, Homo sapiens
ccucagggauccucugc

SEQ ID NO: 2023017 - RNA, 13 nt, Homo sapiens
ucacuucccugaa

SEQ ID NO: 2023018 - RNA, 17 nt, Homo sapiens
gacuauacauacuauaa

SEQ ID NO: 2023019 - RNA, 12 nt, Homo sapiens
cagcaucugccu

SEQ ID NO: 2023020 - RNA, 23 nt, Homo sapiens
gccccaugcuggagccuguguaa

SEQ ID NO: 2023021 - RNA, 16 nt, Homo sapiens
cagaacaaacccugug

SEQ ID NO: 2023022 - RNA, 12 nt, Homo sapiens
agaccuaccuag

SEQ ID NO: 2023023 - RNA, 20 nt, Homo sapiens
ugccccauucucacugcuau

SEQ ID NO: 2023024 - RNA, 18 nt, Homo sapiens
agccauguuaacaugaca

SEQ ID NO: 2023025 - RNA, 19 nt, Homo sapiens
uauggcagacauugugcua

SEQ ID NO: 2023026 - RNA, 21 nt, Homo sapiens
cuuagccccagggcacucaga

SEQ ID NO: 2023027 - RNA, 23 nt, Homo sapiens
aauauaaaacuguacuucacugu

SEQ ID NO: 2023028 - RNA, 13 nt, Homo sapiens
cugggcccaaagg

SEQ ID NO: 2023029 - RNA, 22 nt, Homo sapiens
ugcugccuuuguugaggugcaa

SEQ ID NO: 2023030 - RNA, 13 nt, Homo sapiens
aagcaccaucccc

SEQ ID NO: 2023031 - RNA, 17 nt, Homo sapiens
ucugaacguuugguuca

SEQ ID NO: 2023032 - RNA, 17 nt, Homo sapiens
gaaggaaggcuuugaaa

SEQ ID NO: 2023033 - RNA, 16 nt, Homo sapiens
acucuaguacugugaa

SEQ ID NO: 2023034 - RNA, 16 nt, Homo sapiens
uccguaguucccugaa

SEQ ID NO: 2023035 - RNA, 20 nt, Homo sapiens
aggccacaggagacauuacu

SEQ ID NO: 2023036 - RNA, 18 nt, Homo sapiens
caugacacugaccuugga

SEQ ID NO: 2023037 - RNA, 20 nt, Homo sapiens
auuuccccuuuccaauucca

SEQ ID NO: 2023038 - RNA, 23 nt, Homo sapiens
caucaucacaaccuaaauggaga

SEQ ID NO: 2023039 - RNA, 16 nt, Homo sapiens
uaggacuaaguucuca

SEQ ID NO: 2023040 - RNA, 16 nt, Homo sapiens
auugacuucauuuuau

SEQ ID NO: 2023041 - RNA, 15 nt, Homo sapiens
cacucagccauucuc

SEQ ID NO: 2023042 - RNA, 13 nt, Homo sapiens
cccugaagccagc

SEQ ID NO: 2023043 - RNA, 16 nt, Homo sapiens
acucuaggguccagug

SEQ ID NO: 2023044 - RNA, 22 nt, Homo sapiens
aagcucagucgucccagcagca

SEQ ID NO: 2023045 - RNA, 14 nt, Homo sapiens
cucugucauaugca

SEQ ID NO: 2023046 - RNA, 20 nt, Homo sapiens
gcccaguuggaggagacugg

SEQ ID NO: 2023047 - RNA, 18 nt, Homo sapiens
acuauuuagauauaacac

SEQ ID NO: 2023048 - RNA, 17 nt, Homo sapiens
ucuccagcccugacuaa

SEQ ID NO: 2023049 - RNA, 20 nt, Homo sapiens
aaauaaacacuagacuguau

SEQ ID NO: 2023050 - RNA, 15 nt, Homo sapiens
aauguaugcuucaua

SEQ ID NO: 2023051 - RNA, 16 nt, Homo sapiens
auaaauacaaagcaaa

SEQ ID NO: 2023052 - RNA, 16 nt, Homo sapiens
guauugaaaacacuua

SEQ ID NO: 2023053 - RNA, 22 nt, Homo sapiens
aaccagagggggcgugccugcc

SEQ ID NO: 2023054 - RNA, 13 nt, Homo sapiens
augaagcagauuu

SEQ ID NO: 2023055 - RNA, 19 nt, Homo sapiens
ggccucucuguacacugcc

SEQ ID NO: 2023056 - RNA, 22 nt, Homo sapiens
ucuucgguggccuugagucucu

SEQ ID NO: 2023057 - RNA, 22 nt, Homo sapiens
ugccuaggguccuguccaugcc

SEQ ID NO: 2023058 - RNA, 15 nt, Homo sapiens
aaaguucaauacucu

SEQ ID NO: 2023059 - RNA, 14 nt, Homo sapiens
aaugacuggcuccu

SEQ ID NO: 2023060 - RNA, 19 nt, Homo sapiens
accucaccaagcugcugug

SEQ ID NO: 2023061 - RNA, 21 nt, Homo sapiens
uucuauaugaauuuaaauaua

SEQ ID NO: 2023062 - RNA, 22 nt, Homo sapiens
auagaugaguguuaaacuagau

SEQ ID NO: 2023063 - RNA, 18 nt, Homo sapiens
uugguaaaaaugcugcuc

SEQ ID NO: 2023064 - RNA, 17 nt, Homo sapiens
aaguuaaauguguguaa

SEQ ID NO: 2023065 - RNA, 18 nt, Homo sapiens
aaggcugucucagauaaa

SEQ ID NO: 2023066 - RNA, 22 nt, Homo sapiens
caagugagcagagauguacugc

SEQ ID NO: 2023067 - RNA, 18 nt, Homo sapiens
ugaaaucaauguguacaa

SEQ ID NO: 2023068 - RNA, 20 nt, Homo sapiens
aagcucguccccauugcuua

SEQ ID NO: 2023069 - RNA, 14 nt, Homo sapiens
acauuucucacuga

SEQ ID NO: 2023070 - RNA, 12 nt, Homo sapiens
aggaacucuggc

SEQ ID NO: 2023071 - RNA, 19 nt, Homo sapiens
ggcaacagagcaagacucc

SEQ ID NO: 2023072 - RNA, 19 nt, Homo sapiens
ggcgacagagcgagacucc

SEQ ID NO: 2023073 - RNA, 13 nt, Homo sapiens
aaccaccuuucag

SEQ ID NO: 2023074 - RNA, 16 nt, Homo sapiens
guuugggcuucagccu

SEQ ID NO: 2023075 - RNA, 15 nt, Homo sapiens
aggagcccuucucuu

SEQ ID NO: 2023076 - RNA, 15 nt, Homo sapiens
uugcacagcaucuca

SEQ ID NO: 2023077 - RNA, 16 nt, Homo sapiens
aggaaguagaagucau

SEQ ID NO: 2023078 - RNA, 13 nt, Homo sapiens
uugucagcacugu

SEQ ID NO: 2023079 - RNA, 15 nt, Homo sapiens
cuagcuggauuuccu

SEQ ID NO: 2023080 - RNA, 13 nt, Homo sapiens
uccugacuguaac

SEQ ID NO: 2023081 - RNA, 15 nt, Homo sapiens
cuguaaaauggaaaa

SEQ ID NO: 2023082 - RNA, 17 nt, Homo sapiens
acuugugaaacacagcu

SEQ ID NO: 2023083 - RNA, 15 nt, Homo sapiens
aaauuauucugcccu

SEQ ID NO: 2023084 - RNA, 19 nt, Homo sapiens
auacuuaaucucacauuca

SEQ ID NO: 2023085 - RNA, 19 nt, Homo sapiens
aucuuugguggccaaagau

SEQ ID NO: 2023086 - RNA, 22 nt, Homo sapiens
ugcuaagccccagcaagcaauc

SEQ ID NO: 2023087 - RNA, 14 nt, Homo sapiens
ugcauugucugcaa

SEQ ID NO: 2023088 - RNA, 18 nt, Homo sapiens
gccccuccacuggggaau

SEQ ID NO: 2023089 - RNA, 18 nt, Homo sapiens
aaaugaguugugaugaau

SEQ ID NO: 2023090 - RNA, 19 nt, Homo sapiens
aguaaucccagcuacucag

SEQ ID NO: 2023091 - RNA, 11 nt, Homo sapiens
cuugugccuug

SEQ ID NO: 2023092 - RNA, 17 nt, Homo sapiens
gccccagagcagggugu

SEQ ID NO: 2023093 - RNA, 13 nt, Homo sapiens
uccucuugccaca

SEQ ID NO: 2023094 - RNA, 20 nt, Homo sapiens
aguaaaacuccgagugaacu

SEQ ID NO: 2023095 - RNA, 14 nt, Homo sapiens
cauuuguagcuuug

SEQ ID NO: 2023096 - RNA, 22 nt, Homo sapiens
cccucuccuuccuuacccaaac

SEQ ID NO: 2023097 - RNA, 22 nt, Homo sapiens
aaaauguuagagcagaauucau

SEQ ID NO: 2023098 - RNA, 19 nt, Homo sapiens
gggcucagcagccagagga

SEQ ID NO: 2023099 - RNA, 20 nt, Homo sapiens
cugacaccgucgaccaggaa

SEQ ID NO: 2023100 - RNA, 13 nt, Homo sapiens
augcuaaaaccug

SEQ ID NO: 2023101 - RNA, 19 nt, Homo sapiens
acugggaccugagucaaug

SEQ ID NO: 2023102 - RNA, 14 nt, Homo sapiens
cuagcucacacuca

SEQ ID NO: 2023103 - RNA, 13 nt, Homo sapiens
ggagccaccagca

SEQ ID NO: 2023104 - RNA, 20 nt, Homo sapiens
gcacuuugggaggccaagga

SEQ ID NO: 2023105 - RNA, 17 nt, Homo sapiens
gacaaggagacugccuu

SEQ ID NO: 2023106 - RNA, 21 nt, Homo sapiens
ugggauagagaauguuccaga

SEQ ID NO: 2023107 - RNA, 13 nt, Homo sapiens
aguguuuucacaa

SEQ ID NO: 2023108 - RNA, 16 nt, Homo sapiens
aaccccuccccuccau

SEQ ID NO: 2023109 - RNA, 18 nt, Homo sapiens
ucuuauuaguuccccaaa

SEQ ID NO: 2023110 - RNA, 19 nt, Homo sapiens
uugagucuguuuuguaaag

SEQ ID NO: 2023111 - RNA, 22 nt, Homo sapiens
gccugccuuaccgagagccaaa

SEQ ID NO: 2023112 - RNA, 14 nt, Homo sapiens
cacuugaagcacuu

SEQ ID NO: 2023113 - RNA, 17 nt, Homo sapiens
cauucccuccacccacu

SEQ ID NO: 2023114 - RNA, 23 nt, Homo sapiens
gaucacuuguuguuuuacuaaag

SEQ ID NO: 2023115 - RNA, 16 nt, Homo sapiens
ccaauuccaauuucaa

SEQ ID NO: 2023116 - RNA, 17 nt, Homo sapiens
gacguguccuacagccu

SEQ ID NO: 2023117 - RNA, 22 nt, Homo sapiens
uagagaauaaaccaggccuguu

SEQ ID NO: 2023118 - RNA, 21 nt, Homo sapiens
aaaauaugugcuugaaaugag

SEQ ID NO: 2023119 - RNA, 13 nt, Homo sapiens
uggcugacugggg

SEQ ID NO: 2023120 - RNA, 16 nt, Homo sapiens
agccagcucccagcca

SEQ ID NO: 2023121 - RNA, 15 nt, Homo sapiens
acagaacugcaguca

SEQ ID NO: 2023122 - RNA, 17 nt, Homo sapiens
acacaacuccacugucu

SEQ ID NO: 2023123 - RNA, 15 nt, Homo sapiens
acaaugaaaugcucu

SEQ ID NO: 2023124 - RNA, 11 nt, Homo sapiens
cauucaaagaa

SEQ ID NO: 2023125 - RNA, 15 nt, Homo sapiens
ucugccuuuucacug

SEQ ID NO: 2023126 - RNA, 15 nt, Homo sapiens
gguggcgcgcaccug

SEQ ID NO: 2023127 - RNA, 12 nt, Homo sapiens
aaauagccacaa

SEQ ID NO: 2023128 - RNA, 12 nt, Homo sapiens
ccgaagcccagu

SEQ ID NO: 2023129 - RNA, 12 nt, Homo sapiens
acauagccaaaa

SEQ ID NO: 2023130 - RNA, 18 nt, Homo sapiens
uuuuaaauaauugcauca

SEQ ID NO: 2023131 - RNA, 20 nt, Homo sapiens
aacuagguuuuugcuucucc

SEQ ID NO: 2023132 - RNA, 16 nt, Homo sapiens
agugugauauacaaag

SEQ ID NO: 2023133 - RNA, 23 nt, Homo sapiens
uuauccuagauuauaucaaagua

SEQ ID NO: 2023134 - RNA, 13 nt, Homo sapiens
ccagaacucuucc

SEQ ID NO: 2023135 - RNA, 13 nt, Homo sapiens
aagaaguguuccu

SEQ ID NO: 2023136 - RNA, 23 nt, Homo sapiens
ccaaaugaguucccuugauucaa

SEQ ID NO: 2023137 - RNA, 17 nt, Homo sapiens
auaagucaaaauaaucu

SEQ ID NO: 2023138 - RNA, 15 nt, Homo sapiens
augcacugcaaauac

SEQ ID NO: 2023139 - RNA, 16 nt, Homo sapiens
uccaucagaugacaag

SEQ ID NO: 2023140 - RNA, 12 nt, Homo sapiens
aauggggccaga

SEQ ID NO: 2023141 - RNA, 19 nt, Homo sapiens
aguguugccaccauaccuc

SEQ ID NO: 2023142 - RNA, 20 nt, Homo sapiens
acugacccuggucaccagag

SEQ ID NO: 2023143 - RNA, 16 nt, Homo sapiens
ucucacacaguuuaaa

SEQ ID NO: 2023144 - RNA, 18 nt, Homo sapiens
cugaucaucgaggagcua

SEQ ID NO: 2023145 - RNA, 14 nt, Homo sapiens
ggacuacagcuuuc

SEQ ID NO: 2023146 - RNA, 22 nt, Homo sapiens
cuucuaggauagcuaacuguaa

SEQ ID NO: 2023147 - RNA, 11 nt, Homo sapiens
accuauugcca

SEQ ID NO: 2023148 - RNA, 24 nt, Homo sapiens
uugaucuguuuuggauguugcuau

SEQ ID NO: 2023149 - RNA, 13 nt, Homo sapiens
acccaacuugcca

SEQ ID NO: 2023150 - RNA, 23 nt, Homo sapiens
cccaugaccccaaagccaagggc

SEQ ID NO: 2023151 - RNA, 15 nt, Homo sapiens
aaaagguuauauacc

SEQ ID NO: 2023152 - RNA, 13 nt, Homo sapiens
augaucaucucac

SEQ ID NO: 2023153 - RNA, 16 nt, Homo sapiens
aacuguggacaaaagu

SEQ ID NO: 2023154 - RNA, 18 nt, Homo sapiens
uaccguaacaauguuugu

SEQ ID NO: 2023155 - RNA, 20 nt, Homo sapiens
gcgucagucgauauucccag

SEQ ID NO: 2023156 - RNA, 20 nt, Homo sapiens
gcuaaauauuuaccuugaaa

SEQ ID NO: 2023157 - RNA, 16 nt, Homo sapiens
gaaagcuaucucugag

SEQ ID NO: 2023158 - RNA, 17 nt, Homo sapiens
gccuggccucucagccu

SEQ ID NO: 2023159 - RNA, 17 nt, Homo sapiens
caggggcucuguggcaa

SEQ ID NO: 2023160 - RNA, 15 nt, Homo sapiens
aauaauuaauuucau

SEQ ID NO: 2023161 - RNA, 14 nt, Homo sapiens
uuguguacaaagua

SEQ ID NO: 2023162 - RNA, 16 nt, Homo sapiens
cacuucuccaucgcag

SEQ ID NO: 2023163 - RNA, 14 nt, Homo sapiens
accugugcugacca

SEQ ID NO: 2023164 - RNA, 13 nt, Homo sapiens
gaaguauugcuga

SEQ ID NO: 2023165 - RNA, 13 nt, Homo sapiens
aagugaucugucc

SEQ ID NO: 2023166 - RNA, 15 nt, Homo sapiens
ucauaagacaaugga

SEQ ID NO: 2023167 - RNA, 15 nt, Homo sapiens
accacuuacggacag

SEQ ID NO: 2023168 - RNA, 21 nt, Homo sapiens
agcuuuaacuuguaaaccaca

SEQ ID NO: 2023169 - RNA, 13 nt, Homo sapiens
augaaucaaaagu

SEQ ID NO: 2023170 - RNA, 15 nt, Homo sapiens
agugcgccuugcaaa

SEQ ID NO: 2023171 - RNA, 23 nt, Homo sapiens
auggugaaacccugucucuccua

SEQ ID NO: 2023172 - RNA, 14 nt, Homo sapiens
uucaagacuuccuc

SEQ ID NO: 2023173 - RNA, 20 nt, Homo sapiens
uugccugcaugaaacauguu

SEQ ID NO: 2023174 - RNA, 16 nt, Homo sapiens
cgccugccuucuccuu

SEQ ID NO: 2023175 - RNA, 18 nt, Homo sapiens
uauuuaaagacaaagaca

SEQ ID NO: 2023176 - RNA, 20 nt, Homo sapiens
gaaugaucagcaucugugau

SEQ ID NO: 2023177 - RNA, 14 nt, Homo sapiens
ucuuccuccaccuc

SEQ ID NO: 2023178 - RNA, 22 nt, Homo sapiens
agccuggagcggagcuugccug

SEQ ID NO: 2023179 - RNA, 14 nt, Homo sapiens
agcaagcucugccc

SEQ ID NO: 2023180 - RNA, 21 nt, Homo sapiens
ggaguauacaugacugcaacu

SEQ ID NO: 2023181 - RNA, 17 nt, Homo sapiens
cuaaaaaugguuaucau

SEQ ID NO: 2023182 - RNA, 18 nt, Homo sapiens
ccuggcuugcuguggcua

SEQ ID NO: 2023183 - RNA, 13 nt, Homo sapiens
aauugacuuccuc

SEQ ID NO: 2023184 - RNA, 17 nt, Homo sapiens
ccuguagcagucacuga

SEQ ID NO: 2023185 - RNA, 15 nt, Homo sapiens
uccaaaaguuaaacu

SEQ ID NO: 2023186 - RNA, 14 nt, Homo sapiens
gagaugacagugau

SEQ ID NO: 2023187 - RNA, 21 nt, Homo sapiens
uaaugucgaacucugaaacaa

SEQ ID NO: 2023188 - RNA, 13 nt, Homo sapiens
uaaaacagaaucu

SEQ ID NO: 2023189 - RNA, 17 nt, Homo sapiens
auucucgcuucccugaa

SEQ ID NO: 2023190 - RNA, 17 nt, Homo sapiens
augaaacccuaucucua

SEQ ID NO: 2023191 - RNA, 13 nt, Homo sapiens
caccucuguucau

SEQ ID NO: 2023192 - RNA, 21 nt, Homo sapiens
auuuaucuuccauaugcucuu

SEQ ID NO: 2023193 - RNA, 16 nt, Homo sapiens
agggcgugaaacacaa

SEQ ID NO: 2023194 - RNA, 15 nt, Homo sapiens
auuucugcaucagcu

SEQ ID NO: 2023195 - RNA, 21 nt, Homo sapiens
guguguagcuaagcuaccuug

SEQ ID NO: 2023196 - RNA, 18 nt, Homo sapiens
agcuuagacuaaggccau

SEQ ID NO: 2023197 - RNA, 18 nt, Homo sapiens
aauguuuuccuugccaaa

SEQ ID NO: 2023198 - RNA, 14 nt, Homo sapiens
ccugaguuucucuc

SEQ ID NO: 2023199 - RNA, 21 nt, Homo sapiens
gaaaggcuauuuucagaugaa

SEQ ID NO: 2023200 - RNA, 13 nt, Homo sapiens
uguauauguauuc

SEQ ID NO: 2023201 - RNA, 22 nt, Homo sapiens
uugccuccuguucugcccacga

SEQ ID NO: 2023202 - RNA, 22 nt, Homo sapiens
aggaaugacccuuuugugucua

SEQ ID NO: 2023203 - RNA, 15 nt, Homo sapiens
gauagccccacagga

SEQ ID NO: 2023204 - RNA, 18 nt, Homo sapiens
aggcugugaaacacacau

SEQ ID NO: 2023205 - RNA, 11 nt, Homo sapiens
gagggggaccu

SEQ ID NO: 2023206 - RNA, 17 nt, Homo sapiens
ugccaaccuguucuuag

SEQ ID NO: 2023207 - RNA, 20 nt, Homo sapiens
guacaguauguuuuacaugu

SEQ ID NO: 2023208 - RNA, 21 nt, Homo sapiens
ccuaaaaggcagaguacaaag

SEQ ID NO: 2023209 - RNA, 19 nt, Homo sapiens
ugccuuucaaagugcacac

SEQ ID NO: 2023210 - RNA, 15 nt, Homo sapiens
cuauacauuccugag

SEQ ID NO: 2023211 - RNA, 17 nt, Homo sapiens
ugccaucaacuacuauu

SEQ ID NO: 2023212 - RNA, 15 nt, Homo sapiens
agauaaacugauguu

SEQ ID NO: 2023213 - RNA, 13 nt, Homo sapiens
cagcuuucuugcu

SEQ ID NO: 2023214 - RNA, 13 nt, Homo sapiens
uauauuuccuuau

SEQ ID NO: 2023215 - RNA, 20 nt, Homo sapiens
ccagggugggaagagaagaa

SEQ ID NO: 2023216 - RNA, 14 nt, Homo sapiens
aaauaucaaaaagg

SEQ ID NO: 2023217 - RNA, 21 nt, Homo sapiens
ucuguaaaucaagaccaaaga

SEQ ID NO: 2023218 - RNA, 18 nt, Homo sapiens
uuguguaggaaaucugaa

SEQ ID NO: 2023219 - RNA, 15 nt, Homo sapiens
uacauugugcugcac

SEQ ID NO: 2023220 - RNA, 14 nt, Homo sapiens
cacauugcauagua

SEQ ID NO: 2023221 - RNA, 19 nt, Homo sapiens
aggcauccugugugcugac

SEQ ID NO: 2023222 - RNA, 20 nt, Homo sapiens
cagccuccccaccuucuuca

SEQ ID NO: 2023223 - RNA, 15 nt, Homo sapiens
cuccauuuaccagua

SEQ ID NO: 2023224 - RNA, 15 nt, Homo sapiens
aggagugacaugaag

SEQ ID NO: 2023225 - RNA, 15 nt, Homo sapiens
ucaagucugcacaga

SEQ ID NO: 2023226 - RNA, 21 nt, Homo sapiens
ucaaucuuuuagcacaugugu

SEQ ID NO: 2023227 - RNA, 17 nt, Homo sapiens
uaaaggcaccuccccca

SEQ ID NO: 2023228 - RNA, 22 nt, Homo sapiens
uccucaaagggagagagugcua

SEQ ID NO: 2023229 - RNA, 17 nt, Homo sapiens
cuguugcccauugcacu

SEQ ID NO: 2023230 - RNA, 15 nt, Homo sapiens
auuagcucuggacca

SEQ ID NO: 2023231 - RNA, 19 nt, Homo sapiens
gccccugcccgagagcucu

SEQ ID NO: 2023232 - RNA, 14 nt, Homo sapiens
cucagcaugcaucc

SEQ ID NO: 2023233 - RNA, 19 nt, Homo sapiens
uacuggaccccgccuccca

SEQ ID NO: 2023234 - RNA, 18 nt, Homo sapiens
cuguuauuaacaaacauc

SEQ ID NO: 2023235 - RNA, 18 nt, Homo sapiens
auguaucagccagccuuc

SEQ ID NO: 2023236 - RNA, 14 nt, Homo sapiens
ugugccuauagucc

SEQ ID NO: 2023237 - RNA, 20 nt, Homo sapiens
uuuuaaauguauacuauagu

SEQ ID NO: 2023238 - RNA, 23 nt, Homo sapiens
gguucccaucauuuccuguguca

SEQ ID NO: 2023239 - RNA, 20 nt, Homo sapiens
cguugaagaggaagggcaaa

SEQ ID NO: 2023240 - RNA, 19 nt, Homo sapiens
auauuggcauagaaaaaag

SEQ ID NO: 2023241 - RNA, 18 nt, Homo sapiens
aaguagcaacccugugau

SEQ ID NO: 2023242 - RNA, 17 nt, Homo sapiens
ggcugcccccaacacuc

SEQ ID NO: 2023243 - RNA, 13 nt, Homo sapiens
cauucgucaucac

SEQ ID NO: 2023244 - RNA, 21 nt, Homo sapiens
gccggccaaggccucuaggga

SEQ ID NO: 2023245 - RNA, 15 nt, Homo sapiens
ucagauccagggaca

SEQ ID NO: 2023246 - RNA, 15 nt, Homo sapiens
aacaacaaaccaaaa

SEQ ID NO: 2023247 - RNA, 15 nt, Homo sapiens
uuccccuuaaaucag

SEQ ID NO: 2023248 - RNA, 23 nt, Homo sapiens
aacaacaaaacaauuacuaauga

SEQ ID NO: 2023249 - RNA, 22 nt, Homo sapiens
aaggccagcgccagaacccaga

SEQ ID NO: 2023250 - RNA, 21 nt, Homo sapiens
aacacauuugcccaauuccag

SEQ ID NO: 2023251 - RNA, 22 nt, Homo sapiens
gucuagcauucugcaacauuua

SEQ ID NO: 2023252 - RNA, 14 nt, Homo sapiens
acuaaacauuuugu

SEQ ID NO: 2023253 - RNA, 22 nt, Homo sapiens
cuccucugauuucaguucacug

SEQ ID NO: 2023254 - RNA, 18 nt, Homo sapiens
ugggcgacagagcaagac

SEQ ID NO: 2023255 - RNA, 18 nt, Homo sapiens
uggcagcaugcgauguca

SEQ ID NO: 2023256 - RNA, 21 nt, Homo sapiens
ucaggguuuuuagauuaaaca

SEQ ID NO: 2023257 - RNA, 19 nt, Homo sapiens
uucaagacaagagcuguua

SEQ ID NO: 2023258 - RNA, 12 nt, Homo sapiens
aagcagcuugaa

SEQ ID NO: 2023259 - RNA, 14 nt, Homo sapiens
agaauuguaucuca

SEQ ID NO: 2023260 - RNA, 21 nt, Homo sapiens
auccuugggagucauuaccac

SEQ ID NO: 2023261 - RNA, 14 nt, Homo sapiens
cugacgaacuccuu

SEQ ID NO: 2023262 - RNA, 20 nt, Homo sapiens
gccagccugguccaugcagg

SEQ ID NO: 2023263 - RNA, 19 nt, Homo sapiens
accucucuccuuugcugag

SEQ ID NO: 2023264 - RNA, 14 nt, Homo sapiens
uuguaucugaagac

SEQ ID NO: 2023265 - RNA, 19 nt, Homo sapiens
caggcaucugccucuggaa

SEQ ID NO: 2023266 - RNA, 14 nt, Homo sapiens
aauuuaaugcugcc

SEQ ID NO: 2023267 - RNA, 20 nt, Homo sapiens
acagaaagagacuccgucuc

SEQ ID NO: 2023268 - RNA, 12 nt, Homo sapiens
ggcaaugggcua

SEQ ID NO: 2023269 - RNA, 13 nt, Homo sapiens
uacaauugugagc

SEQ ID NO: 2023270 - RNA, 23 nt, Homo sapiens
ccucgggggaaagcacaccucau

SEQ ID NO: 2023271 - RNA, 20 nt, Homo sapiens
cucguggccccgugaacuca

SEQ ID NO: 2023272 - RNA, 14 nt, Homo sapiens
caguuugcacuuaa

SEQ ID NO: 2023273 - RNA, 15 nt, Homo sapiens
uacuacuguaaaugu

SEQ ID NO: 2023274 - RNA, 20 nt, Homo sapiens
aucauaaaacuuuuguguca

SEQ ID NO: 2023275 - RNA, 19 nt, Homo sapiens
cacuuuauauuuuccucuu

SEQ ID NO: 2023276 - RNA, 19 nt, Homo sapiens
aaaaaucccuccaccuucc

SEQ ID NO: 2023277 - RNA, 14 nt, Homo sapiens
ccuccuggugccca

SEQ ID NO: 2023278 - RNA, 22 nt, Homo sapiens
guucacacucagaacccaggac

SEQ ID NO: 2023279 - RNA, 14 nt, Homo sapiens
ugauauccaugcca

SEQ ID NO: 2023280 - RNA, 21 nt, Homo sapiens
agucacugucccucaaaugac

SEQ ID NO: 2023281 - RNA, 14 nt, Homo sapiens
uuucaccauuuccg

SEQ ID NO: 2023282 - RNA, 22 nt, Homo sapiens
cauguuuauccauguacuuucc

SEQ ID NO: 2023283 - RNA, 12 nt, Homo sapiens
gauugggguccc

SEQ ID NO: 2023284 - RNA, 17 nt, Homo sapiens
caagaugcuaguucauu

SEQ ID NO: 2023285 - RNA, 12 nt, Homo sapiens
gcucccauuccu

SEQ ID NO: 2023286 - RNA, 22 nt, Homo sapiens
uuggugguuaugucccaugacc

SEQ ID NO: 2023287 - RNA, 21 nt, Homo sapiens
uucuuggcccucaguuugcag

SEQ ID NO: 2023288 - RNA, 22 nt, Homo sapiens
aucucagcuaacauuccauguu

SEQ ID NO: 2023289 - RNA, 21 nt, Homo sapiens
gcaggcaaacgggucgugaug

SEQ ID NO: 2023290 - RNA, 14 nt, Homo sapiens
ccucaagugauccu

SEQ ID NO: 2023291 - RNA, 12 nt, Homo sapiens
cucuuucgccaa

SEQ ID NO: 2023292 - RNA, 19 nt, Homo sapiens
ugcugaauuucaggcauuu

SEQ ID NO: 2023293 - RNA, 19 nt, Homo sapiens
auggaggucauacaugcau

SEQ ID NO: 2023294 - RNA, 13 nt, Homo sapiens
gcuguugagugag

SEQ ID NO: 2023295 - RNA, 20 nt, Homo sapiens
ggcucaagugaucuucccac

SEQ ID NO: 2023296 - RNA, 21 nt, Homo sapiens
uaagaaaucucccaugugcau

SEQ ID NO: 2023297 - RNA, 22 nt, Homo sapiens
uggcucuguuaugcaagcacaa

SEQ ID NO: 2023298 - RNA, 19 nt, Homo sapiens
gggcuggaaaagucacaca

SEQ ID NO: 2023299 - RNA, 16 nt, Homo sapiens
acugaacuguguguaa

SEQ ID NO: 2023300 - RNA, 19 nt, Homo sapiens
acuugccaggcucccuuuc

SEQ ID NO: 2023301 - RNA, 17 nt, Homo sapiens
aucagagauaaagcuua

SEQ ID NO: 2023302 - RNA, 19 nt, Homo sapiens
gacaggcaaagacugcagu

SEQ ID NO: 2023303 - RNA, 13 nt, Homo sapiens
gccagagccucug

SEQ ID NO: 2023304 - RNA, 23 nt, Homo sapiens
auaauauggaucagagcauuuau

SEQ ID NO: 2023305 - RNA, 22 nt, Homo sapiens
cugggugucugggcucaagcuu

SEQ ID NO: 2023306 - RNA, 12 nt, Homo sapiens
aaggugcucaca

SEQ ID NO: 2023307 - RNA, 19 nt, Homo sapiens
gaaguggugacauuuugca

SEQ ID NO: 2023308 - RNA, 17 nt, Homo sapiens
caagcgcucauguugag

SEQ ID NO: 2023309 - RNA, 15 nt, Homo sapiens
cuccuacuaugcaau

SEQ ID NO: 2023310 - RNA, 18 nt, Homo sapiens
gguauuuucuagacugug

SEQ ID NO: 2023311 - RNA, 15 nt, Homo sapiens
cuugaaguaugccuu

SEQ ID NO: 2023312 - RNA, 13 nt, Homo sapiens
gucauuacagggc

SEQ ID NO: 2023313 - RNA, 23 nt, Homo sapiens
aaaacuucaacguaagacugugu

SEQ ID NO: 2023314 - RNA, 19 nt, Homo sapiens
cucuucaguuaagccuuug

SEQ ID NO: 2023315 - RNA, 13 nt, Homo sapiens
ucuaaacuuuauu

SEQ ID NO: 2023316 - RNA, 12 nt, Homo sapiens
caaguccagagc

SEQ ID NO: 2023317 - RNA, 21 nt, Homo sapiens
agcucucugcaaagaugauuu

SEQ ID NO: 2023318 - RNA, 14 nt, Homo sapiens
cuacugaacccugc

SEQ ID NO: 2023319 - RNA, 13 nt, Homo sapiens
gagucagugcauu

SEQ ID NO: 2023320 - RNA, 17 nt, Homo sapiens
aaccugauacauuuaca

SEQ ID NO: 2023321 - RNA, 19 nt, Homo sapiens
agacuggggcauccugugc

SEQ ID NO: 2023322 - RNA, 13 nt, Homo sapiens
uuaauguucuaua

SEQ ID NO: 2023323 - RNA, 16 nt, Homo sapiens
cauuucaaucauugaa

SEQ ID NO: 2023324 - RNA, 16 nt, Homo sapiens
gcgaaugacaaaauca

SEQ ID NO: 2023325 - RNA, 22 nt, Homo sapiens
aaauugccaagugccuaugcaa

SEQ ID NO: 2023326 - RNA, 16 nt, Homo sapiens
uucuucuuuuacuuga

SEQ ID NO: 2023327 - RNA, 23 nt, Homo sapiens
aaccugcacguugugcacaugua

SEQ ID NO: 2023328 - RNA, 15 nt, Homo sapiens
auucagcuaaauuca

SEQ ID NO: 2023329 - RNA, 12 nt, Homo sapiens
ucuggaggucau

SEQ ID NO: 2023330 - RNA, 18 nt, Homo sapiens
aaacagcaguuugugaua

SEQ ID NO: 2023331 - RNA, 14 nt, Homo sapiens
auucacuuacugac

SEQ ID NO: 2023332 - RNA, 22 nt, Homo sapiens
uccugcaaacccauuuccagcu

SEQ ID NO: 2023333 - RNA, 17 nt, Homo sapiens
caccgccauggcuucca

SEQ ID NO: 2023334 - RNA, 23 nt, Homo sapiens
accugacaggugaggucuguucc

SEQ ID NO: 2023335 - RNA, 15 nt, Homo sapiens
cuucccccagggucc

SEQ ID NO: 2023336 - RNA, 14 nt, Homo sapiens
uuguugcugucaag

SEQ ID NO: 2023337 - RNA, 15 nt, Homo sapiens
cauucgaguguuuca

SEQ ID NO: 2023338 - RNA, 18 nt, Homo sapiens
uaaaaugaacaucucuug

SEQ ID NO: 2023339 - RNA, 15 nt, Homo sapiens
auuguauuacuagaa

SEQ ID NO: 2023340 - RNA, 14 nt, Homo sapiens
accucaaaggugau

SEQ ID NO: 2023341 - RNA, 17 nt, Homo sapiens
agucuguaaaaccagca

SEQ ID NO: 2023342 - RNA, 11 nt, Homo sapiens
ugugcuuuuag

SEQ ID NO: 2023343 - RNA, 20 nt, Homo sapiens
aguggucaggcaucuucccu

SEQ ID NO: 2023344 - RNA, 17 nt, Homo sapiens
aaagugauucacugugc

SEQ ID NO: 2023345 - RNA, 15 nt, Homo sapiens
aaaggaaaccaagug

SEQ ID NO: 2023346 - RNA, 23 nt, Homo sapiens
uaggaauaagcucuaguucuuaa

SEQ ID NO: 2023347 - RNA, 19 nt, Homo sapiens
aaaaacacuccagucugcc

SEQ ID NO: 2023348 - RNA, 12 nt, Homo sapiens
guuuuaguaaaa

SEQ ID NO: 2023349 - RNA, 18 nt, Homo sapiens
agaaaggagagucuugca

SEQ ID NO: 2023350 - RNA, 16 nt, Homo sapiens
uaaagcauuacaguau

SEQ ID NO: 2023351 - RNA, 19 nt, Homo sapiens
uccaacggcaagggaacaa

SEQ ID NO: 2023352 - RNA, 14 nt, Homo sapiens
caacccgagucauu

SEQ ID NO: 2023353 - RNA, 21 nt, Homo sapiens
auggagacaagggcaucaucu

SEQ ID NO: 2023354 - RNA, 15 nt, Homo sapiens
aaagaaaaguuucac

SEQ ID NO: 2023355 - RNA, 18 nt, Homo sapiens
ggagggucugcagggaau

SEQ ID NO: 2023356 - RNA, 13 nt, Homo sapiens
gauuauuccucag

SEQ ID NO: 2023357 - RNA, 23 nt, Homo sapiens
gucucaucuccugacccucccac

SEQ ID NO: 2023358 - RNA, 21 nt, Homo sapiens
ucuagugauugugagugccuu

SEQ ID NO: 2023359 - RNA, 18 nt, Homo sapiens
cagcuccugccaggguga

SEQ ID NO: 2023360 - RNA, 15 nt, Homo sapiens
ucucaugagugccaa

SEQ ID NO: 2023361 - RNA, 12 nt, Homo sapiens
uuauacuuucag

SEQ ID NO: 2023362 - RNA, 13 nt, Homo sapiens
cccaacccaugaa

SEQ ID NO: 2023363 - RNA, 22 nt, Homo sapiens
cuuuggagagcucaguacaggg

SEQ ID NO: 2023364 - RNA, 21 nt, Homo sapiens
caaauguuuuuaauccaaaga

SEQ ID NO: 2023365 - RNA, 13 nt, Homo sapiens
aagagccaucuga

SEQ ID NO: 2023366 - RNA, 15 nt, Homo sapiens
uggggacacagauca

SEQ ID NO: 2023367 - RNA, 21 nt, Homo sapiens
acucuggagguuuguuuagaa

SEQ ID NO: 2023368 - RNA, 18 nt, Homo sapiens
accuugucauuuuggucu

SEQ ID NO: 2023369 - RNA, 16 nt, Homo sapiens
gagacccacaggucua

SEQ ID NO: 2023370 - RNA, 15 nt, Homo sapiens
cagagucuugcuacc

SEQ ID NO: 2023371 - RNA, 16 nt, Homo sapiens
augugcaaccacugcu

SEQ ID NO: 2023372 - RNA, 10 nt, Homo sapiens
auugugaugu

SEQ ID NO: 2023373 - RNA, 17 nt, Homo sapiens
auauagcaagugcuauu

SEQ ID NO: 2023374 - RNA, 18 nt, Homo sapiens
agcaauuccccuacauca

SEQ ID NO: 2023375 - RNA, 21 nt, Homo sapiens
gacaugguugucaucacuagu

SEQ ID NO: 2023376 - RNA, 21 nt, Homo sapiens
cagagaugucaucagagcucc

SEQ ID NO: 2023377 - RNA, 14 nt, Homo sapiens
acugugccacaaug

SEQ ID NO: 2023378 - RNA, 10 nt, Homo sapiens
agcuccucac

SEQ ID NO: 2023379 - RNA, 20 nt, Homo sapiens
uuaucccccaaaaugcauuu

SEQ ID NO: 2023380 - RNA, 16 nt, Homo sapiens
auugugcuucgaguga

SEQ ID NO: 2023381 - RNA, 21 nt, Homo sapiens
gaucaguggugucugugaagg

SEQ ID NO: 2023382 - RNA, 20 nt, Homo sapiens
acugaucuaagcaguggcau

SEQ ID NO: 2023383 - RNA, 23 nt, Homo sapiens
cuuagccauuuuucaaagcaauu

SEQ ID NO: 2023384 - RNA, 21 nt, Homo sapiens
ccauuauuauuucuguucuua

SEQ ID NO: 2023385 - RNA, 16 nt, Homo sapiens
aauuuugaaaaacugc

SEQ ID NO: 2023386 - RNA, 22 nt, Homo sapiens
cugaaacuucucaaccagaaga

SEQ ID NO: 2023387 - RNA, 18 nt, Homo sapiens
accccgagaagugcucuu

SEQ ID NO: 2023388 - RNA, 16 nt, Homo sapiens
accugaacugaugggu

SEQ ID NO: 2023389 - RNA, 19 nt, Homo sapiens
cuuauaagaaaacauguaa

SEQ ID NO: 2023390 - RNA, 21 nt, Homo sapiens
gccuuuucucaccugucaucu

SEQ ID NO: 2023391 - RNA, 18 nt, Homo sapiens
uggccuccaauucugacc

SEQ ID NO: 2023392 - RNA, 19 nt, Homo sapiens
caugaauaauccaccccuu

SEQ ID NO: 2023393 - RNA, 19 nt, Homo sapiens
uuaaaaacuuaaguaccaa

SEQ ID NO: 2023394 - RNA, 18 nt, Homo sapiens
aucuuuagaaacaucagu

SEQ ID NO: 2023395 - RNA, 12 nt, Homo sapiens
agguuucaagac

SEQ ID NO: 2023396 - RNA, 22 nt, Homo sapiens
aagaaaaaauucccucauuuaa

SEQ ID NO: 2023397 - RNA, 13 nt, Homo sapiens
cacuuuacauucu

SEQ ID NO: 2023398 - RNA, 22 nt, Homo sapiens
uuuuuauaaaaaugagugcuua

SEQ ID NO: 2023399 - RNA, 14 nt, Homo sapiens
caaugaacacuuaa

SEQ ID NO: 2023400 - RNA, 14 nt, Homo sapiens
uagagacuguagau

SEQ ID NO: 2023401 - RNA, 19 nt, Homo sapiens
uguuucacaguuugaaaua

SEQ ID NO: 2023402 - RNA, 14 nt, Homo sapiens
ugagugaugaauca

SEQ ID NO: 2023403 - RNA, 19 nt, Homo sapiens
agagauggucaauuaacaa

SEQ ID NO: 2023404 - RNA, 18 nt, Homo sapiens
cagaagauuauuuacuga

SEQ ID NO: 2023405 - RNA, 19 nt, Homo sapiens
gcggcuuucacugcugagu

SEQ ID NO: 2023406 - RNA, 18 nt, Homo sapiens
ucucuucagaaaacccuu

SEQ ID NO: 2023407 - RNA, 20 nt, Homo sapiens
cguguucacucagcacuuuc

SEQ ID NO: 2023408 - RNA, 13 nt, Homo sapiens
cuuggggggccaa

SEQ ID NO: 2023409 - RNA, 14 nt, Homo sapiens
agaaggccagccca

SEQ ID NO: 2023410 - RNA, 15 nt, Homo sapiens
uccugccagcccagc

SEQ ID NO: 2023411 - RNA, 12 nt, Homo sapiens
ucuccacuccau

SEQ ID NO: 2023412 - RNA, 19 nt, Homo sapiens
ugaauaaagggaacaugca

SEQ ID NO: 2023413 - RNA, 23 nt, Homo sapiens
aagucugagcgaggagugacugc

SEQ ID NO: 2023414 - RNA, 22 nt, Homo sapiens
agagagacccugccaacuuucc

SEQ ID NO: 2023415 - RNA, 19 nt, Homo sapiens
gcacuagagaaacuugaau

SEQ ID NO: 2023416 - RNA, 21 nt, Homo sapiens
ucugauugguccaacaguuug

SEQ ID NO: 2023417 - RNA, 17 nt, Homo sapiens
caaaaauaaacgaacuc

SEQ ID NO: 2023418 - RNA, 15 nt, Homo sapiens
gcaagcucugccucc

SEQ ID NO: 2023419 - RNA, 18 nt, Homo sapiens
ugccccgucuacagcucc

SEQ ID NO: 2023420 - RNA, 22 nt, Homo sapiens
gaccuugagaagauucuuccca

SEQ ID NO: 2023421 - RNA, 16 nt, Homo sapiens
aaugagggccaagaaa

SEQ ID NO: 2023422 - RNA, 23 nt, Homo sapiens
ggcagcugauuuugucacugucu

SEQ ID NO: 2023423 - RNA, 19 nt, Homo sapiens
cacuauucuuaacuauuca

SEQ ID NO: 2023424 - RNA, 19 nt, Homo sapiens
uucuccuucaaaacacuca

SEQ ID NO: 2023425 - RNA, 20 nt, Homo sapiens
gcauuuuacaagaucuugca

SEQ ID NO: 2023426 - RNA, 19 nt, Homo sapiens
gaauuauaggcgugcacca

SEQ ID NO: 2023427 - RNA, 12 nt, Homo sapiens
acuuuaaccaau

SEQ ID NO: 2023428 - RNA, 20 nt, Homo sapiens
caaaugccaaaauucauuca

SEQ ID NO: 2023429 - RNA, 22 nt, Homo sapiens
cagccaaccuaauuaccuguau

SEQ ID NO: 2023430 - RNA, 20 nt, Homo sapiens
gugaaccaacccccaucucc

SEQ ID NO: 2023431 - RNA, 16 nt, Homo sapiens
acaauaaggucaaugc

SEQ ID NO: 2023432 - RNA, 21 nt, Homo sapiens
ccucucaaauucagcucugau

SEQ ID NO: 2023433 - RNA, 17 nt, Homo sapiens
uuguacguuuugcacau

SEQ ID NO: 2023434 - RNA, 17 nt, Homo sapiens
cgggggagcuggaaaua

SEQ ID NO: 2023435 - RNA, 20 nt, Homo sapiens
ggacacauugccccaugaga

SEQ ID NO: 2023436 - RNA, 15 nt, Homo sapiens
ggccacccagccagg

SEQ ID NO: 2023437 - RNA, 19 nt, Homo sapiens
gagcuggggcugagggaug

SEQ ID NO: 2023438 - RNA, 17 nt, Homo sapiens
ccaagcgagagcagcug

SEQ ID NO: 2023439 - RNA, 21 nt, Homo sapiens
cgcuggcuuuccagcuuagaa

SEQ ID NO: 2023440 - RNA, 15 nt, Homo sapiens
uagauggaccugccu

SEQ ID NO: 2023441 - RNA, 11 nt, Homo sapiens
aaaaacaacca

SEQ ID NO: 2023442 - RNA, 18 nt, Homo sapiens
aaucagagagcucacuaa

SEQ ID NO: 2023443 - RNA, 18 nt, Homo sapiens
gcugggugcgaaggcaga

SEQ ID NO: 2023444 - RNA, 14 nt, Homo sapiens
gggcauccauacca

SEQ ID NO: 2023445 - RNA, 19 nt, Homo sapiens
acagagccaagcacugcuc

SEQ ID NO: 2023446 - RNA, 15 nt, Homo sapiens
agucagaaccacuaa

SEQ ID NO: 2023447 - RNA, 18 nt, Homo sapiens
aaagguugaguuuuccac

SEQ ID NO: 2023448 - RNA, 14 nt, Homo sapiens
auauaaacugugag

SEQ ID NO: 2023449 - RNA, 22 nt, Homo sapiens
aucagcauuuuucuuuagucau

SEQ ID NO: 2023450 - RNA, 17 nt, Homo sapiens
guucagcauucuuagcc

SEQ ID NO: 2023451 - RNA, 16 nt, Homo sapiens
ucacuacaguacagug

SEQ ID NO: 2023452 - RNA, 16 nt, Homo sapiens
aggcuggaaugcagug

SEQ ID NO: 2023453 - RNA, 16 nt, Homo sapiens
acaaauacaaaauccu

SEQ ID NO: 2023454 - RNA, 19 nt, Homo sapiens
aauccagagauaauugcca

SEQ ID NO: 2023455 - RNA, 16 nt, Homo sapiens
guaacaaaaguauagu

SEQ ID NO: 2023456 - RNA, 20 nt, Homo sapiens
uguuuccuguggaaauaugc

SEQ ID NO: 2023457 - RNA, 21 nt, Homo sapiens
cuccauuugcaauugaccucu

SEQ ID NO: 2023458 - RNA, 21 nt, Homo sapiens
cacagagguccggguuuagua

SEQ ID NO: 2023459 - RNA, 16 nt, Homo sapiens
agccagaggcucuaau

SEQ ID NO: 2023460 - RNA, 18 nt, Homo sapiens
agcaaaagggaggaacac

SEQ ID NO: 2023461 - RNA, 12 nt, Homo sapiens
uccuuuguugcu

SEQ ID NO: 2023462 - RNA, 22 nt, Homo sapiens
gugaacagguucuccaggugau

SEQ ID NO: 2023463 - RNA, 12 nt, Homo sapiens
guuuuuuuccaa

SEQ ID NO: 2023464 - RNA, 22 nt, Homo sapiens
ccugcacuaaagccagccugac

SEQ ID NO: 2023465 - RNA, 21 nt, Homo sapiens
gauuuauuaauuaaaccagac

SEQ ID NO: 2023466 - RNA, 16 nt, Homo sapiens
ugcuagucacuggaaa

SEQ ID NO: 2023467 - RNA, 22 nt, Homo sapiens
cagccuuuccaagucacuagaa

SEQ ID NO: 2023468 - RNA, 20 nt, Homo sapiens
ggcugcugaaacucauuuga

SEQ ID NO: 2023469 - RNA, 20 nt, Homo sapiens
caauauggacauguaaaaag

SEQ ID NO: 2023470 - RNA, 12 nt, Homo sapiens
cauucaacugga

SEQ ID NO: 2023471 - RNA, 15 nt, Homo sapiens
agacuuaacacuucu

SEQ ID NO: 2023472 - RNA, 18 nt, Homo sapiens
aagcacaaacuucuguaa

SEQ ID NO: 2023473 - RNA, 16 nt, Homo sapiens
gagaguuuugucuuga

SEQ ID NO: 2023474 - RNA, 17 nt, Homo sapiens
gcugguaaucuugcucu

SEQ ID NO: 2023475 - RNA, 18 nt, Homo sapiens
accccacagacacuuaca

SEQ ID NO: 2023476 - RNA, 13 nt, Homo sapiens
accguuucaggac

SEQ ID NO: 2023477 - RNA, 23 nt, Homo sapiens
caguuuuaaaaaaaacaauucca

SEQ ID NO: 2023478 - RNA, 15 nt, Homo sapiens
aucaccuguuagcau

SEQ ID NO: 2023479 - RNA, 21 nt, Homo sapiens
ccaccuuccccagaaccaggg

SEQ ID NO: 2023480 - RNA, 18 nt, Homo sapiens
aaauggggaaauugcaga

SEQ ID NO: 2023481 - RNA, 14 nt, Homo sapiens
uaaaaaacauuuau

SEQ ID NO: 2023482 - RNA, 13 nt, Homo sapiens
ugguggagcugcu

SEQ ID NO: 2023483 - RNA, 12 nt, Homo sapiens
gucagugucugg

SEQ ID NO: 2023484 - RNA, 15 nt, Homo sapiens
auagcagcagugcau

SEQ ID NO: 2023485 - RNA, 14 nt, Homo sapiens
gaccugauccugga

SEQ ID NO: 2023486 - RNA, 16 nt, Homo sapiens
cugauuugaagggaaa

SEQ ID NO: 2023487 - RNA, 23 nt, Homo sapiens
guacacagaggcgggucuauaac

SEQ ID NO: 2023488 - RNA, 14 nt, Homo sapiens
aaccuacucugcaa

SEQ ID NO: 2023489 - RNA, 19 nt, Homo sapiens
auauuugaaauaguauaca

SEQ ID NO: 2023490 - RNA, 19 nt, Homo sapiens
ccuucgguggaagagcuca

SEQ ID NO: 2023491 - RNA, 20 nt, Homo sapiens
agaaggacugaagaccagcu

SEQ ID NO: 2023492 - RNA, 17 nt, Homo sapiens
aguacaaccacuaucuu

SEQ ID NO: 2023493 - RNA, 17 nt, Homo sapiens
augagaaggaauuugag

SEQ ID NO: 2023494 - RNA, 15 nt, Homo sapiens
aauguauuccuguag

SEQ ID NO: 2023495 - RNA, 12 nt, Homo sapiens
uuucccaucuca

SEQ ID NO: 2023496 - RNA, 16 nt, Homo sapiens
ccagccuagcccacuu

SEQ ID NO: 2023497 - RNA, 21 nt, Homo sapiens
ugggacgcaggagaucaucug

SEQ ID NO: 2023498 - RNA, 23 nt, Homo sapiens
auggugcauuuauuauguucaag

SEQ ID NO: 2023499 - RNA, 20 nt, Homo sapiens
uaaauauuuagucugcauug

SEQ ID NO: 2023500 - RNA, 15 nt, Homo sapiens
ucaguugccaaagga

SEQ ID NO: 2023501 - RNA, 15 nt, Homo sapiens
auaaauacgaaacuc

SEQ ID NO: 2023502 - RNA, 19 nt, Homo sapiens
uaauuagcuugauuuaauc

SEQ ID NO: 2023503 - RNA, 17 nt, Homo sapiens
ucucaguacagcacucc

SEQ ID NO: 2023504 - RNA, 20 nt, Homo sapiens
cccaccuccgccccagacac

SEQ ID NO: 2023505 - RNA, 21 nt, Homo sapiens
uacgugggagucugugcauuu

SEQ ID NO: 2023506 - RNA, 14 nt, Homo sapiens
caauauucaguggu

SEQ ID NO: 2023507 - RNA, 14 nt, Homo sapiens
auaguuacugugcc

SEQ ID NO: 2023508 - RNA, 23 nt, Homo sapiens
ggcgaugcucccucagccucaga

SEQ ID NO: 2023509 - RNA, 14 nt, Homo sapiens
cucuguguaucuca

SEQ ID NO: 2023510 - RNA, 21 nt, Homo sapiens
agagccucggcccuagcauug

SEQ ID NO: 2023511 - RNA, 23 nt, Homo sapiens
aaguccaaccugccugugcauga

SEQ ID NO: 2023512 - RNA, 21 nt, Homo sapiens
uugaauaugccaaacacauua

SEQ ID NO: 2023513 - RNA, 23 nt, Homo sapiens
auuccuuggcaugccuuccagca

SEQ ID NO: 2023514 - RNA, 23 nt, Homo sapiens
gacuuccccugccuccuacucca

SEQ ID NO: 2023515 - RNA, 17 nt, Homo sapiens
agcgauggagcagucuc

SEQ ID NO: 2023516 - RNA, 14 nt, Homo sapiens
uuacuccaccauca

SEQ ID NO: 2023517 - RNA, 14 nt, Homo sapiens
aauggacuggccag

SEQ ID NO: 2023518 - RNA, 22 nt, Homo sapiens
aguuuaggacccaagguggucu

SEQ ID NO: 2023519 - RNA, 15 nt, Homo sapiens
gagaaccaaccaaug

SEQ ID NO: 2023520 - RNA, 12 nt, Homo sapiens
caaugcucuccu

SEQ ID NO: 2023521 - RNA, 15 nt, Homo sapiens
cagcugucaauagau

SEQ ID NO: 2023522 - RNA, 20 nt, Homo sapiens
ucuuugcucccugcaagaaa

SEQ ID NO: 2023523 - RNA, 21 nt, Homo sapiens
agaguauuuuuaacacuuaaa

SEQ ID NO: 2023524 - RNA, 16 nt, Homo sapiens
agggcuggucagggug

SEQ ID NO: 2023525 - RNA, 23 nt, Homo sapiens
uguguaacacuguccaucuugca

SEQ ID NO: 2023526 - RNA, 17 nt, Homo sapiens
ccucaguuuuaucauuu

SEQ ID NO: 2023527 - RNA, 15 nt, Homo sapiens
acauuuuauacugua

SEQ ID NO: 2023528 - RNA, 22 nt, Homo sapiens
gcuuaccuuuuccuauucuguu

SEQ ID NO: 2023529 - RNA, 18 nt, Homo sapiens
uuauaucuguggucuuca

SEQ ID NO: 2023530 - RNA, 16 nt, Homo sapiens
auuccagucauuuugg

SEQ ID NO: 2023531 - RNA, 22 nt, Homo sapiens
ugaagcccuccaaaagcacuua

SEQ ID NO: 2023532 - RNA, 15 nt, Homo sapiens
uaggauaucuuggcu

SEQ ID NO: 2023533 - RNA, 16 nt, Homo sapiens
ccaggaggcggcagug

SEQ ID NO: 2023534 - RNA, 16 nt, Homo sapiens
acacagggaggggaug

SEQ ID NO: 2023535 - RNA, 13 nt, Homo sapiens
ggauggaaaggga

SEQ ID NO: 2023536 - RNA, 22 nt, Homo sapiens
cauuguucagaaaagcaccucu

SEQ ID NO: 2023537 - RNA, 21 nt, Homo sapiens
uaaaaaucuagcacacucuuc

SEQ ID NO: 2023538 - RNA, 18 nt, Homo sapiens
ccagaaaagguacacuuu

SEQ ID NO: 2023539 - RNA, 19 nt, Homo sapiens
ccagcccagaagugcagaa

SEQ ID NO: 2023540 - RNA, 17 nt, Homo sapiens
uuucuaacucaggggug

SEQ ID NO: 2023541 - RNA, 20 nt, Homo sapiens
gcacccagcuuggcagaugu

SEQ ID NO: 2023542 - RNA, 18 nt, Homo sapiens
ucacuaccugccaugcau

SEQ ID NO: 2023543 - RNA, 18 nt, Homo sapiens
ucucccuagugccuucca

SEQ ID NO: 2023544 - RNA, 12 nt, Homo sapiens
caacugagaucu

SEQ ID NO: 2023545 - RNA, 14 nt, Homo sapiens
ccuuacaguaggag

SEQ ID NO: 2023546 - RNA, 22 nt, Homo sapiens
uggauauagaaaggagaccugu

SEQ ID NO: 2023547 - RNA, 21 nt, Homo sapiens
ucaaagcacuguuucucucac

SEQ ID NO: 2023548 - RNA, 18 nt, Homo sapiens
acugaauguguuugaaca

SEQ ID NO: 2023549 - RNA, 18 nt, Homo sapiens
ggagcaggaccuacuagg

SEQ ID NO: 2023550 - RNA, 18 nt, Homo sapiens
auuaagggucguuuuagg

SEQ ID NO: 2023551 - RNA, 17 nt, Homo sapiens
aggcuacagaaugagac

SEQ ID NO: 2023552 - RNA, 20 nt, Homo sapiens
uacaaaaauaguagaacaag

SEQ ID NO: 2023553 - RNA, 16 nt, Homo sapiens
ccacccauaccacagc

SEQ ID NO: 2023554 - RNA, 19 nt, Homo sapiens
agcaagcuagaacuggaag

SEQ ID NO: 2023555 - RNA, 21 nt, Homo sapiens
gcucuagauucauaaauacaa

SEQ ID NO: 2023556 - RNA, 22 nt, Homo sapiens
auuucaugucuuuacuggaccu

SEQ ID NO: 2023557 - RNA, 20 nt, Homo sapiens
uuguaguuuuggcuaguccu

SEQ ID NO: 2023558 - RNA, 14 nt, Homo sapiens
uugaccuucugucg

SEQ ID NO: 2023559 - RNA, 22 nt, Homo sapiens
ccagagagaaucaacagaucaa

SEQ ID NO: 2023560 - RNA, 14 nt, Homo sapiens
agauucuucugugu

SEQ ID NO: 2023561 - RNA, 20 nt, Homo sapiens
ugacccuuuugugucuauga

SEQ ID NO: 2023562 - RNA, 13 nt, Homo sapiens
gaugaggugcuuu

SEQ ID NO: 2023563 - RNA, 14 nt, Homo sapiens
gcccagagcccagc

SEQ ID NO: 2023564 - RNA, 18 nt, Homo sapiens
uguccgcuuucaugaaca

SEQ ID NO: 2023565 - RNA, 15 nt, Homo sapiens
gcagagcauucagac

SEQ ID NO: 2023566 - RNA, 13 nt, Homo sapiens
acuugcuccuuuc

SEQ ID NO: 2023567 - RNA, 16 nt, Homo sapiens
cagugcgguuccucau

SEQ ID NO: 2023568 - RNA, 22 nt, Homo sapiens
aagggagagaucaaguugagac

SEQ ID NO: 2023569 - RNA, 22 nt, Homo sapiens
ugcuuugcaggaagugucuaga

SEQ ID NO: 2023570 - RNA, 13 nt, Homo sapiens
auuaaagcuguua

SEQ ID NO: 2023571 - RNA, 14 nt, Homo sapiens
auucauaugcauau

SEQ ID NO: 2023572 - RNA, 17 nt, Homo sapiens
guaauaauguaauacug

SEQ ID NO: 2023573 - RNA, 18 nt, Homo sapiens
cugaggccacccacugac

SEQ ID NO: 2023574 - RNA, 14 nt, Homo sapiens
gcccagcacauagc

SEQ ID NO: 2023575 - RNA, 21 nt, Homo sapiens
gaaagcaauacuguacauaaa

SEQ ID NO: 2023576 - RNA, 16 nt, Homo sapiens
ggugcucuuugcugca

SEQ ID NO: 2023577 - RNA, 14 nt, Homo sapiens
uagcuguguccuca

SEQ ID NO: 2023578 - RNA, 13 nt, Homo sapiens
uugauuugggaga

SEQ ID NO: 2023579 - RNA, 18 nt, Homo sapiens
guggugaacagaacaaaa

SEQ ID NO: 2023580 - RNA, 18 nt, Homo sapiens
auaauacugugcagauuu

SEQ ID NO: 2023581 - RNA, 19 nt, Homo sapiens
cugugucagcgggugcacc

SEQ ID NO: 2023582 - RNA, 19 nt, Homo sapiens
ugccaggcuugcagucucc

SEQ ID NO: 2023583 - RNA, 17 nt, Homo sapiens
agacuuuuaaagacuug

SEQ ID NO: 2023584 - RNA, 20 nt, Homo sapiens
cacccgagcuagagugcagu

SEQ ID NO: 2023585 - RNA, 21 nt, Homo sapiens
agaggaaauucuccacugugc

SEQ ID NO: 2023586 - RNA, 16 nt, Homo sapiens
gagaucuguugauuga

SEQ ID NO: 2023587 - RNA, 23 nt, Homo sapiens
ccaagccucugucuuuucuggga

SEQ ID NO: 2023588 - RNA, 17 nt, Homo sapiens
uaaaaguaugcagauua

SEQ ID NO: 2023589 - RNA, 22 nt, Homo sapiens
uuauuaaaaaaaucauacauuc

SEQ ID NO: 2023590 - RNA, 13 nt, Homo sapiens
uaggcacaugugg

SEQ ID NO: 2023591 - RNA, 15 nt, Homo sapiens
ccgagccagcagcug

SEQ ID NO: 2023592 - RNA, 17 nt, Homo sapiens
gcucuccuccaccucaa

SEQ ID NO: 2023593 - RNA, 13 nt, Homo sapiens
caagaagacugua

SEQ ID NO: 2023594 - RNA, 13 nt, Homo sapiens
ugcucacaguguu

SEQ ID NO: 2023595 - RNA, 16 nt, Homo sapiens
cauguugaaggugccc

SEQ ID NO: 2023596 - RNA, 14 nt, Homo sapiens
auaauuaaggccag

SEQ ID NO: 2023597 - RNA, 13 nt, Homo sapiens
acccacugggaca

SEQ ID NO: 2023598 - RNA, 18 nt, Homo sapiens
ccugccucaugcucucua

SEQ ID NO: 2023599 - RNA, 15 nt, Homo sapiens
uucagcagacuauga

SEQ ID NO: 2023600 - RNA, 21 nt, Homo sapiens
gaggccagggcagcaagggac

SEQ ID NO: 2023601 - RNA, 19 nt, Homo sapiens
cuggaaaccucuacauauu

SEQ ID NO: 2023602 - RNA, 18 nt, Homo sapiens
ccuaauucugccuuaaau

SEQ ID NO: 2023603 - RNA, 14 nt, Homo sapiens
ugacaugucucaca

SEQ ID NO: 2023604 - RNA, 21 nt, Homo sapiens
uucacaaauauaguugaacaa

SEQ ID NO: 2023605 - RNA, 17 nt, Homo sapiens
aagggacugagaaauuu

SEQ ID NO: 2023606 - RNA, 22 nt, Homo sapiens
cauugauuuuugauagacugaa

SEQ ID NO: 2023607 - RNA, 22 nt, Homo sapiens
gcuuccaggcugagagccggcc

SEQ ID NO: 2023608 - RNA, 14 nt, Homo sapiens
aaacaaauguguaa

SEQ ID NO: 2023609 - RNA, 22 nt, Homo sapiens
augcaauuugacuuggcauaau

SEQ ID NO: 2023610 - RNA, 13 nt, Homo sapiens
uuuauccuugacc

SEQ ID NO: 2023611 - RNA, 15 nt, Homo sapiens
uuuugugaccacagu

SEQ ID NO: 2023612 - RNA, 18 nt, Homo sapiens
gcaugucucaauaguaaa

SEQ ID NO: 2023613 - RNA, 23 nt, Homo sapiens
aacauauguauacaaauuguuuc

SEQ ID NO: 2023614 - RNA, 23 nt, Homo sapiens
cagagcucaagauucagacucca

SEQ ID NO: 2023615 - RNA, 13 nt, Homo sapiens
auaaacauuugca

SEQ ID NO: 2023616 - RNA, 13 nt, Homo sapiens
aaauuauuugcag

SEQ ID NO: 2023617 - RNA, 22 nt, Homo sapiens
agcccagcuuggcccuuuccuu

SEQ ID NO: 2023618 - RNA, 22 nt, Homo sapiens
ggcuaagaagugacucuugcaa

SEQ ID NO: 2023619 - RNA, 12 nt, Homo sapiens
ggcagauuugag

SEQ ID NO: 2023620 - RNA, 16 nt, Homo sapiens
aacccaaauccaagcu

SEQ ID NO: 2023621 - RNA, 19 nt, Homo sapiens
agaccagccccaccaugca

SEQ ID NO: 2023622 - RNA, 17 nt, Homo sapiens
aggaacagcucgggcca

SEQ ID NO: 2023623 - RNA, 14 nt, Homo sapiens
acuacuugagaaaa

SEQ ID NO: 2023624 - RNA, 20 nt, Homo sapiens
aaacugguguucugguucau

SEQ ID NO: 2023625 - RNA, 17 nt, Homo sapiens
acuaugacuacacagaa

SEQ ID NO: 2023626 - RNA, 19 nt, Homo sapiens
aaguucaacaacaaaacau

SEQ ID NO: 2023627 - RNA, 19 nt, Homo sapiens
uuucaacuuuguuccuaaa

SEQ ID NO: 2023628 - RNA, 19 nt, Homo sapiens
cuuaggauuuaccaaauag

SEQ ID NO: 2023629 - RNA, 15 nt, Homo sapiens
uccacuauuaaucuu

SEQ ID NO: 2023630 - RNA, 14 nt, Homo sapiens
ugcuuuauacacug

SEQ ID NO: 2023631 - RNA, 15 nt, Homo sapiens
auuuucugcaucucc

SEQ ID NO: 2023632 - RNA, 22 nt, Homo sapiens
uuuugcugucuuucucuaaaua

SEQ ID NO: 2023633 - RNA, 18 nt, Homo sapiens
aaauguaauaaguaucac

SEQ ID NO: 2023634 - RNA, 11 nt, Homo sapiens
ccuaaaaucuu

SEQ ID NO: 2023635 - RNA, 13 nt, Homo sapiens
accauguacauaa

SEQ ID NO: 2023636 - RNA, 22 nt, Homo sapiens
cgagcuaguuaaacagugccau

SEQ ID NO: 2023637 - RNA, 16 nt, Homo sapiens
uuuucuguguguuccu

SEQ ID NO: 2023638 - RNA, 17 nt, Homo sapiens
ucaccaccgagacaguu

SEQ ID NO: 2023639 - RNA, 21 nt, Homo sapiens
ugcccccaccccauucccgca

SEQ ID NO: 2023640 - RNA, 18 nt, Homo sapiens
accauaggacuguggcaa

SEQ ID NO: 2023641 - RNA, 21 nt, Homo sapiens
acugggguguggagacuugaa

SEQ ID NO: 2023642 - RNA, 12 nt, Homo sapiens
gagugaggccau

SEQ ID NO: 2023643 - RNA, 22 nt, Homo sapiens
aaaguucuuucucguggguaaa

SEQ ID NO: 2023644 - RNA, 17 nt, Homo sapiens
cagagaccaaaugucac

SEQ ID NO: 2023645 - RNA, 12 nt, Homo sapiens
gauccccaaccc

SEQ ID NO: 2023646 - RNA, 15 nt, Homo sapiens
cuuuuuaaacagugu

SEQ ID NO: 2023647 - RNA, 20 nt, Homo sapiens
ucuggcauuacaauugcagu

SEQ ID NO: 2023648 - RNA, 15 nt, Homo sapiens
gcagguauggaaggg

SEQ ID NO: 2023649 - RNA, 18 nt, Homo sapiens
ugcugggcugagugacac

SEQ ID NO: 2023650 - RNA, 13 nt, Homo sapiens
ggguuuacaggca

SEQ ID NO: 2023651 - RNA, 17 nt, Homo sapiens
cagaucauauuucacaa

SEQ ID NO: 2023652 - RNA, 22 nt, Homo sapiens
agcaguccuuaucaccagccuc

SEQ ID NO: 2023653 - RNA, 22 nt, Homo sapiens
guauaguucacuuacucuuaca

SEQ ID NO: 2023654 - RNA, 21 nt, Homo sapiens
gccacaugccgcgucccugcc

SEQ ID NO: 2023655 - RNA, 13 nt, Homo sapiens
cuguucugcugaa

SEQ ID NO: 2023656 - RNA, 13 nt, Homo sapiens
ugcuucugugcaa

SEQ ID NO: 2023657 - RNA, 12 nt, Homo sapiens
ccgagaagaaca

SEQ ID NO: 2023658 - RNA, 21 nt, Homo sapiens
caaacagauguuuguuuucaa

SEQ ID NO: 2023659 - RNA, 16 nt, Homo sapiens
uccacuuggagcuaaa

SEQ ID NO: 2023660 - RNA, 19 nt, Homo sapiens
aucucacuuaguccuuuau

SEQ ID NO: 2023661 - RNA, 19 nt, Homo sapiens
ucagaucuaucuugucaau

SEQ ID NO: 2023662 - RNA, 21 nt, Homo sapiens
uauuucucucuuaacacuggc

SEQ ID NO: 2023663 - RNA, 19 nt, Homo sapiens
aaaaucuguacaugucucc

SEQ ID NO: 2023664 - RNA, 16 nt, Homo sapiens
gggagccagggugaga

SEQ ID NO: 2023665 - RNA, 14 nt, Homo sapiens
gcaguaacuggaac

SEQ ID NO: 2023666 - RNA, 22 nt, Homo sapiens
cuugaaagaaaauaccaaggaa

SEQ ID NO: 2023667 - RNA, 19 nt, Homo sapiens
cuggaaauugagguccaug

SEQ ID NO: 2023668 - RNA, 23 nt, Homo sapiens
ucagugaguaauuuuggauuuug

SEQ ID NO: 2023669 - RNA, 10 nt, Homo sapiens
uuuacauuua

SEQ ID NO: 2023670 - RNA, 15 nt, Homo sapiens
cucacucuugccaac

SEQ ID NO: 2023671 - RNA, 20 nt, Homo sapiens
ucagccucuuaaagcugccu

SEQ ID NO: 2023672 - RNA, 14 nt, Homo sapiens
cacaagcucagguc

SEQ ID NO: 2023673 - RNA, 23 nt, Homo sapiens
uaugccagggcgcacuuuccacu

SEQ ID NO: 2023674 - RNA, 16 nt, Homo sapiens
cuucaagaacauucua

SEQ ID NO: 2023675 - RNA, 12 nt, Homo sapiens
cuccugucucag

SEQ ID NO: 2023676 - RNA, 12 nt, Homo sapiens
aaucccuuucug

SEQ ID NO: 2023677 - RNA, 21 nt, Homo sapiens
ggugcuuauuaagaccaaaga

SEQ ID NO: 2023678 - RNA, 14 nt, Homo sapiens
aaaauguguauaca

SEQ ID NO: 2023679 - RNA, 12 nt, Homo sapiens
cgaugugcccag

SEQ ID NO: 2023680 - RNA, 21 nt, Homo sapiens
aagaacaauauugacuuuguc

SEQ ID NO: 2023681 - RNA, 22 nt, Homo sapiens
ccugaaacccuccccaggucuu

SEQ ID NO: 2023682 - RNA, 15 nt, Homo sapiens
aggugguucucuuca

SEQ ID NO: 2023683 - RNA, 20 nt, Homo sapiens
cuggcaggaagggacugcca

SEQ ID NO: 2023684 - RNA, 23 nt, Homo sapiens
cuucacuaccaaaugagcauuag

SEQ ID NO: 2023685 - RNA, 16 nt, Homo sapiens
uaaagaugaaugucag

SEQ ID NO: 2023686 - RNA, 13 nt, Homo sapiens
agcauauggugcu

SEQ ID NO: 2023687 - RNA, 15 nt, Homo sapiens
gggaaggucaccagc

SEQ ID NO: 2023688 - RNA, 21 nt, Homo sapiens
aguuccugugggugugucucu

SEQ ID NO: 2023689 - RNA, 18 nt, Homo sapiens
cuuacaaagaaagcacuu

SEQ ID NO: 2023690 - RNA, 22 nt, Homo sapiens
uuuugcccuugacaaagucaag

SEQ ID NO: 2023691 - RNA, 12 nt, Homo sapiens
caaaaacugaaa

SEQ ID NO: 2023692 - RNA, 12 nt, Homo sapiens
aauuuaucucuu

SEQ ID NO: 2023693 - RNA, 17 nt, Homo sapiens
uuauuacuaauugucua

SEQ ID NO: 2023694 - RNA, 12 nt, Homo sapiens
ccagcccaaagc

SEQ ID NO: 2023695 - RNA, 20 nt, Homo sapiens
cugaccagggcaaggccccu

SEQ ID NO: 2023696 - RNA, 16 nt, Homo sapiens
uauuuagcugccaaau

SEQ ID NO: 2023697 - RNA, 18 nt, Homo sapiens
cucagagguagggcugcc

SEQ ID NO: 2023698 - RNA, 12 nt, Homo sapiens
agaauuuacuca

SEQ ID NO: 2023699 - RNA, 24 nt, Homo sapiens
uggacaauaaucucacuaccuuau

SEQ ID NO: 2023700 - RNA, 21 nt, Homo sapiens
auaaguguucaguguugacau

SEQ ID NO: 2023701 - RNA, 16 nt, Homo sapiens
ccaaagaucucaaagu

SEQ ID NO: 2023702 - RNA, 15 nt, Homo sapiens
cuucuagaaagcccc

SEQ ID NO: 2023703 - RNA, 22 nt, Homo sapiens
acaaaaggcuuuggcaacagaa

SEQ ID NO: 2023704 - RNA, 17 nt, Homo sapiens
ucuuugguguaaucucu

SEQ ID NO: 2023705 - RNA, 14 nt, Homo sapiens
cucuaugucugccu

SEQ ID NO: 2023706 - RNA, 22 nt, Homo sapiens
auuaaaaaaagacauaauucac

SEQ ID NO: 2023707 - RNA, 16 nt, Homo sapiens
ggcaaacccuggugcu

SEQ ID NO: 2023708 - RNA, 22 nt, Homo sapiens
guucaugcccccuuugacugau

SEQ ID NO: 2023709 - RNA, 17 nt, Homo sapiens
gcagaggcuccacaggc

SEQ ID NO: 2023710 - RNA, 16 nt, Homo sapiens
uaugaaucacaguauu

SEQ ID NO: 2023711 - RNA, 17 nt, Homo sapiens
ccuucccucuuucccca

SEQ ID NO: 2023712 - RNA, 16 nt, Homo sapiens
uggaagucuccaugaa

SEQ ID NO: 2023713 - RNA, 16 nt, Homo sapiens
ccaucggcaggcagug

SEQ ID NO: 2023714 - RNA, 21 nt, Homo sapiens
aggaugauaaaagcacuuacu

SEQ ID NO: 2023715 - RNA, 20 nt, Homo sapiens
ugcuuucaacuuaaaucacu

SEQ ID NO: 2023716 - RNA, 15 nt, Homo sapiens
cugcuggugcuaaaa

SEQ ID NO: 2023717 - RNA, 17 nt, Homo sapiens
aucuccuguccaucagc

SEQ ID NO: 2023718 - RNA, 16 nt, Homo sapiens
gcauggaaaccaaaag

SEQ ID NO: 2023719 - RNA, 20 nt, Homo sapiens
cuccacaccucuaaacaucu

SEQ ID NO: 2023720 - RNA, 16 nt, Homo sapiens
cugccauaacauacca

SEQ ID NO: 2023721 - RNA, 20 nt, Homo sapiens
uucaaaccuacuaauccagc

SEQ ID NO: 2023722 - RNA, 14 nt, Homo sapiens
gagcaguucccaag

SEQ ID NO: 2023723 - RNA, 13 nt, Homo sapiens
auaugaccaaaau

SEQ ID NO: 2023724 - RNA, 22 nt, Homo sapiens
cauauguacuuguuugcuauga

SEQ ID NO: 2023725 - RNA, 19 nt, Homo sapiens
cauuauuuuuuacaauggc

SEQ ID NO: 2023726 - RNA, 19 nt, Homo sapiens
cauaagucuaaauaaauga

SEQ ID NO: 2023727 - RNA, 19 nt, Homo sapiens
accacugcuuaagugccua

SEQ ID NO: 2023728 - RNA, 19 nt, Homo sapiens
aaauggcuguagguggugu

SEQ ID NO: 2023729 - RNA, 20 nt, Homo sapiens
ucucaggggugauaacucag

SEQ ID NO: 2023730 - RNA, 18 nt, Homo sapiens
cucagaaaagugacagug

SEQ ID NO: 2023731 - RNA, 21 nt, Homo sapiens
gcguauuggcuuuuucagagu

SEQ ID NO: 2023732 - RNA, 14 nt, Homo sapiens
ucugcuauaaacuu

SEQ ID NO: 2023733 - RNA, 14 nt, Homo sapiens
guagcuguuuugaa

SEQ ID NO: 2023734 - RNA, 15 nt, Homo sapiens
acuaaugaagauacg

SEQ ID NO: 2023735 - RNA, 15 nt, Homo sapiens
uggggcccacauuag

SEQ ID NO: 2023736 - RNA, 13 nt, Homo sapiens
gaagaugugaagg

SEQ ID NO: 2023737 - RNA, 15 nt, Homo sapiens
cagagcuggaccagu

SEQ ID NO: 2023738 - RNA, 19 nt, Homo sapiens
agauuguguuuguucauaa

SEQ ID NO: 2023739 - RNA, 22 nt, Homo sapiens
gguaaucgccaaauaguuccau

SEQ ID NO: 2023740 - RNA, 14 nt, Homo sapiens
acuugaauuacaac

SEQ ID NO: 2023741 - RNA, 23 nt, Homo sapiens
auaguguuggaaaaugugcaaua

SEQ ID NO: 2023742 - RNA, 12 nt, Homo sapiens
cuaugagcugcu

SEQ ID NO: 2023743 - RNA, 23 nt, Homo sapiens
caauauauuuuuacugcuuucug

SEQ ID NO: 2023744 - RNA, 13 nt, Homo sapiens
accaagugcaaua

SEQ ID NO: 2023745 - RNA, 14 nt, Homo sapiens
ugcacuagccugug

SEQ ID NO: 2023746 - RNA, 15 nt, Homo sapiens
auggauguuugucaa

SEQ ID NO: 2023747 - RNA, 15 nt, Homo sapiens
gaugacccucugacc

SEQ ID NO: 2023748 - RNA, 14 nt, Homo sapiens
cuuuaggaucucag

SEQ ID NO: 2023749 - RNA, 22 nt, Homo sapiens
ugggaggccgcggccaccgcca

SEQ ID NO: 2023750 - RNA, 14 nt, Homo sapiens
aauaggaauaagcu

SEQ ID NO: 2023751 - RNA, 16 nt, Homo sapiens
cagcuucuuugccaag

SEQ ID NO: 2023752 - RNA, 21 nt, Homo sapiens
aggcuuuuccguaaacauaua

SEQ ID NO: 2023753 - RNA, 17 nt, Homo sapiens
ucuaguucauugaauca

SEQ ID NO: 2023754 - RNA, 18 nt, Homo sapiens
ccuuaaggaucaccccag

SEQ ID NO: 2023755 - RNA, 20 nt, Homo sapiens
cugccuuaggguagugcuaa

SEQ ID NO: 2023756 - RNA, 15 nt, Homo sapiens
guaaucauuaucuca

SEQ ID NO: 2023757 - RNA, 15 nt, Homo sapiens
gaaaccauuuuccca

SEQ ID NO: 2023758 - RNA, 20 nt, Homo sapiens
ccaaagugccacucauuccu

SEQ ID NO: 2023759 - RNA, 14 nt, Homo sapiens
uugauugcuguuga

SEQ ID NO: 2023760 - RNA, 19 nt, Homo sapiens
cugccaugguaaucagaaa

SEQ ID NO: 2023761 - RNA, 19 nt, Homo sapiens
auauauuccgcacucaagg

SEQ ID NO: 2023762 - RNA, 18 nt, Homo sapiens
ucuauguuuguauuugga

SEQ ID NO: 2023763 - RNA, 15 nt, Homo sapiens
gacagaaccacaggg

SEQ ID NO: 2023764 - RNA, 13 nt, Homo sapiens
ucuuuaacacagc

SEQ ID NO: 2023765 - RNA, 15 nt, Homo sapiens
cuccucgagauccca

SEQ ID NO: 2023766 - RNA, 18 nt, Homo sapiens
accuuuugugguucucaa

SEQ ID NO: 2023767 - RNA, 19 nt, Homo sapiens
gcuugaaaaggugaccuug

SEQ ID NO: 2023768 - RNA, 18 nt, Homo sapiens
gaguuaggcuauucacaa

SEQ ID NO: 2023769 - RNA, 21 nt, Homo sapiens
cacccuccuggccucauacag

SEQ ID NO: 2023770 - RNA, 23 nt, Homo sapiens
acagucugcucaacacgacugca

SEQ ID NO: 2023771 - RNA, 18 nt, Homo sapiens
aacuguaugggagcuuaa

SEQ ID NO: 2023772 - RNA, 18 nt, Homo sapiens
uacacuaaaguuacaaac

SEQ ID NO: 2023773 - RNA, 15 nt, Homo sapiens
acccuggaguucuug

SEQ ID NO: 2023774 - RNA, 21 nt, Homo sapiens
agcuggcagagagcacaguga

SEQ ID NO: 2023775 - RNA, 18 nt, Homo sapiens
uguacugauucaauuuga

SEQ ID NO: 2023776 - RNA, 19 nt, Homo sapiens
ucaucauauuguauguaag

SEQ ID NO: 2023777 - RNA, 15 nt, Homo sapiens
agcgagaacuacgca

SEQ ID NO: 2023778 - RNA, 20 nt, Homo sapiens
aaacaauuguaaauuucuuu

SEQ ID NO: 2023779 - RNA, 21 nt, Homo sapiens
ucuccagccaauuucaaagaa

SEQ ID NO: 2023780 - RNA, 18 nt, Homo sapiens
aggugaaaauccaucuca

SEQ ID NO: 2023781 - RNA, 23 nt, Homo sapiens
agcagagcaaaaugcucuugucc

SEQ ID NO: 2023782 - RNA, 23 nt, Homo sapiens
ggagucagucuucacuugcacug

SEQ ID NO: 2023783 - RNA, 17 nt, Homo sapiens
caggaacguuucugaac

SEQ ID NO: 2023784 - RNA, 17 nt, Homo sapiens
ucagucgcuagcauuuc

SEQ ID NO: 2023785 - RNA, 13 nt, Homo sapiens
agugguagguuaa

SEQ ID NO: 2023786 - RNA, 21 nt, Homo sapiens
cuugcuuugcagccccacaga

SEQ ID NO: 2023787 - RNA, 19 nt, Homo sapiens
agugcaguggcgugaucuc

SEQ ID NO: 2023788 - RNA, 13 nt, Homo sapiens
caaaauaaucuga

SEQ ID NO: 2023789 - RNA, 20 nt, Homo sapiens
ccuuuuaucaauaaagcacu

SEQ ID NO: 2023790 - RNA, 13 nt, Homo sapiens
caacccgaggcaa

SEQ ID NO: 2023791 - RNA, 22 nt, Homo sapiens
cagugacugaauucugccuugg

SEQ ID NO: 2023792 - RNA, 23 nt, Homo sapiens
ccccgcuucuccguacaccccag

SEQ ID NO: 2023793 - RNA, 12 nt, Homo sapiens
uccaucaugccc

SEQ ID NO: 2023794 - RNA, 14 nt, Homo sapiens
gagacaguugcccg

SEQ ID NO: 2023795 - RNA, 19 nt, Homo sapiens
aguuauugauaaguucaua

SEQ ID NO: 2023796 - RNA, 16 nt, Homo sapiens
accuucuuccacagca

SEQ ID NO: 2023797 - RNA, 15 nt, Homo sapiens
acucggcgugcuccu

SEQ ID NO: 2023798 - RNA, 20 nt, Homo sapiens
cagagaaaauaaaagcacuu

SEQ ID NO: 2023799 - RNA, 18 nt, Homo sapiens
cagccuggaagagggcaa

SEQ ID NO: 2023800 - RNA, 10 nt, Homo sapiens
aauguucaca

SEQ ID NO: 2023801 - RNA, 21 nt, Homo sapiens
cccagcaggacagugacccca

SEQ ID NO: 2023802 - RNA, 13 nt, Homo sapiens
accauuaccaaaa

SEQ ID NO: 2023803 - RNA, 19 nt, Homo sapiens
cugaugcuuuuagcucaaa

SEQ ID NO: 2023804 - RNA, 22 nt, Homo sapiens
gaguggaccacgaccucgucca

SEQ ID NO: 2023805 - RNA, 22 nt, Homo sapiens
cuaucucucaagagugcugaga

SEQ ID NO: 2023806 - RNA, 18 nt, Homo sapiens
uuggguacugggugcugu

SEQ ID NO: 2023807 - RNA, 12 nt, Homo sapiens
gacugagcucaa

SEQ ID NO: 2023808 - RNA, 12 nt, Homo sapiens
uacaggacauca

SEQ ID NO: 2023809 - RNA, 20 nt, Homo sapiens
cagacuggauuuuugcucug

SEQ ID NO: 2023810 - RNA, 19 nt, Homo sapiens
cauggugugaguccaaaga

SEQ ID NO: 2023811 - RNA, 11 nt, Homo sapiens
uuuuuccaaau

SEQ ID NO: 2023812 - RNA, 19 nt, Homo sapiens
uuuaaaccugauuuacuag

SEQ ID NO: 2023813 - RNA, 15 nt, Homo sapiens
uggcauuuguuccac

SEQ ID NO: 2023814 - RNA, 16 nt, Homo sapiens
cuacuagggaggcuga

SEQ ID NO: 2023815 - RNA, 22 nt, Homo sapiens
auugacaggcacuauucuaauc

SEQ ID NO: 2023816 - RNA, 16 nt, Homo sapiens
uaaagucaaaugccaa

SEQ ID NO: 2023817 - RNA, 17 nt, Homo sapiens
cuacagguccaggguug

SEQ ID NO: 2023818 - RNA, 23 nt, Homo sapiens
cuuccaaccccuuuccacgagcu

SEQ ID NO: 2023819 - RNA, 19 nt, Homo sapiens
cuuuaagguauugugcauc

SEQ ID NO: 2023820 - RNA, 23 nt, Homo sapiens
cccuagccagagaauagaucagu

SEQ ID NO: 2023821 - RNA, 18 nt, Homo sapiens
acuucucuuaaguggucu

SEQ ID NO: 2023822 - RNA, 22 nt, Homo sapiens
aaguuuauuauuuucaaaggaa

SEQ ID NO: 2023823 - RNA, 12 nt, Homo sapiens
cauuggcacugu

SEQ ID NO: 2023824 - RNA, 18 nt, Homo sapiens
ccugcuaaggcugccuca

SEQ ID NO: 2023825 - RNA, 23 nt, Homo sapiens
gcuauugacuaaucuuugcugaa

SEQ ID NO: 2023826 - RNA, 16 nt, Homo sapiens
ucaugcaagacuucac

SEQ ID NO: 2023827 - RNA, 14 nt, Homo sapiens
agccaaaugguuua

SEQ ID NO: 2023828 - RNA, 18 nt, Homo sapiens
uaccacuuuucauugcaa

SEQ ID NO: 2023829 - RNA, 24 nt, Homo sapiens
gcccaggucccuccucagaccucc

SEQ ID NO: 2023830 - RNA, 17 nt, Homo sapiens
uaccaaguuacuugaaa

SEQ ID NO: 2023831 - RNA, 23 nt, Homo sapiens
uaauuaauaaagaaaaagaagua

SEQ ID NO: 2023832 - RNA, 15 nt, Homo sapiens
uugauaacucagugg

SEQ ID NO: 2023833 - RNA, 21 nt, Homo sapiens
uggccaggccucuuggcaguc

SEQ ID NO: 2023834 - RNA, 19 nt, Homo sapiens
uucaggcacaucauuggaa

SEQ ID NO: 2023835 - RNA, 14 nt, Homo sapiens
gauucauaaugacu

SEQ ID NO: 2023836 - RNA, 12 nt, Homo sapiens
ucuuauugcaaa

SEQ ID NO: 2023837 - RNA, 19 nt, Homo sapiens
uucacauacacucaaacaa

SEQ ID NO: 2023838 - RNA, 16 nt, Homo sapiens
gacucuaauaugauua

SEQ ID NO: 2023839 - RNA, 23 nt, Homo sapiens
caacugugcuacacuugcaccug

SEQ ID NO: 2023840 - RNA, 13 nt, Homo sapiens
uuguaaaggaaau

SEQ ID NO: 2023841 - RNA, 22 nt, Homo sapiens
cacuucugggucaugcacugag

SEQ ID NO: 2023842 - RNA, 19 nt, Homo sapiens
caucauuggaaaugaaacu

SEQ ID NO: 2023843 - RNA, 20 nt, Homo sapiens
accuacauuaauuuaugcag

SEQ ID NO: 2023844 - RNA, 18 nt, Homo sapiens
auuuuguauaaaugggaa

SEQ ID NO: 2023845 - RNA, 16 nt, Homo sapiens
acaucucagugcuguc

SEQ ID NO: 2023846 - RNA, 13 nt, Homo sapiens
ccuccugcuccuc

SEQ ID NO: 2023847 - RNA, 13 nt, Homo sapiens
ucccuugcccuuu

SEQ ID NO: 2023848 - RNA, 22 nt, Homo sapiens
gaaagguacuauauuugcuaga

SEQ ID NO: 2023849 - RNA, 14 nt, Homo sapiens
cugcuugaacccag

SEQ ID NO: 2023850 - RNA, 13 nt, Homo sapiens
caaggcauaccug

SEQ ID NO: 2023851 - RNA, 15 nt, Homo sapiens
aaucaaacagggaca

SEQ ID NO: 2023852 - RNA, 19 nt, Homo sapiens
gaggcagaaaauugcacaa

SEQ ID NO: 2023853 - RNA, 12 nt, Homo sapiens
ccugcagcacgg

SEQ ID NO: 2023854 - RNA, 18 nt, Homo sapiens
ucccccaaaggugccacc

SEQ ID NO: 2023855 - RNA, 22 nt, Homo sapiens
gcgugaaggccgagaagcaaga

SEQ ID NO: 2023856 - RNA, 14 nt, Homo sapiens
agcucuuguugcuu

SEQ ID NO: 2023857 - RNA, 15 nt, Homo sapiens
ucaagcugugagaca

SEQ ID NO: 2023858 - RNA, 16 nt, Homo sapiens
gggugggccacucucc

SEQ ID NO: 2023859 - RNA, 15 nt, Homo sapiens
acuucuaccaggacg

SEQ ID NO: 2023860 - RNA, 23 nt, Homo sapiens
agaacuuugcauagcagcugcua

SEQ ID NO: 2023861 - RNA, 23 nt, Homo sapiens
gagauguugaaauuacauuauuu

SEQ ID NO: 2023862 - RNA, 23 nt, Homo sapiens
caauuuuaaaaugaaaugcauuu

SEQ ID NO: 2023863 - RNA, 22 nt, Homo sapiens
agacaaagaugucuuaaccuca

SEQ ID NO: 2023864 - RNA, 15 nt, Homo sapiens
acugacugaacugua

SEQ ID NO: 2023865 - RNA, 18 nt, Homo sapiens
guaguuuauaaaagacug

SEQ ID NO: 2023866 - RNA, 13 nt, Homo sapiens
gcauuaacaaagu

SEQ ID NO: 2023867 - RNA, 17 nt, Homo sapiens
ggaccaguggugccuug

SEQ ID NO: 2023868 - RNA, 17 nt, Homo sapiens
gcggagguugcaaugag

SEQ ID NO: 2023869 - RNA, 12 nt, Homo sapiens
gccaauuucacc

SEQ ID NO: 2023870 - RNA, 14 nt, Homo sapiens
gaaauacuguacaa

SEQ ID NO: 2023871 - RNA, 16 nt, Homo sapiens
ucagggccccugggga

SEQ ID NO: 2023872 - RNA, 13 nt, Homo sapiens
ccaggugaaggag

SEQ ID NO: 2023873 - RNA, 22 nt, Homo sapiens
auacucugcccucuagagccuu

SEQ ID NO: 2023874 - RNA, 19 nt, Homo sapiens
ccgagcucuccuuguuacc

SEQ ID NO: 2023875 - RNA, 13 nt, Homo sapiens
aacucccuuccuu

SEQ ID NO: 2023876 - RNA, 16 nt, Homo sapiens
gaugcauggaguguuu

SEQ ID NO: 2023877 - RNA, 22 nt, Homo sapiens
uggcaaaggucccugagcucuu

SEQ ID NO: 2023878 - RNA, 19 nt, Homo sapiens
ccuuugaccccagcagcuu

SEQ ID NO: 2023879 - RNA, 13 nt, Homo sapiens
auacagccugcaa

SEQ ID NO: 2023880 - RNA, 17 nt, Homo sapiens
uugcccuucacaguguu

SEQ ID NO: 2023881 - RNA, 15 nt, Homo sapiens
agcuucgucagcucc

SEQ ID NO: 2023882 - RNA, 14 nt, Homo sapiens
aguuuccuaauggu

SEQ ID NO: 2023883 - RNA, 13 nt, Homo sapiens
ucauucauucacu

SEQ ID NO: 2023884 - RNA, 13 nt, Homo sapiens
auauacauauaca

SEQ ID NO: 2023885 - RNA, 23 nt, Homo sapiens
gaucugauaaggaucuaggagaa

SEQ ID NO: 2023886 - RNA, 17 nt, Homo sapiens
acacggaugcacagaga

SEQ ID NO: 2023887 - RNA, 19 nt, Homo sapiens
aaaccucagcuagcucugc

SEQ ID NO: 2023888 - RNA, 17 nt, Homo sapiens
ucucuggcucuugucca

SEQ ID NO: 2023889 - RNA, 18 nt, Homo sapiens
aaaaugcuuucuuggcca

SEQ ID NO: 2023890 - RNA, 22 nt, Homo sapiens
gcuguacaccccaggacaguuu

SEQ ID NO: 2023891 - RNA, 16 nt, Homo sapiens
cauaaaaguuggcuca

SEQ ID NO: 2023892 - RNA, 23 nt, Homo sapiens
cggcaacugccuuccugccucuc

SEQ ID NO: 2023893 - RNA, 20 nt, Homo sapiens
aauuggcugccaagagucca

SEQ ID NO: 2023894 - RNA, 11 nt, Homo sapiens
uaaaugaaaua

SEQ ID NO: 2023895 - RNA, 14 nt, Homo sapiens
aaaaagaaguuucu

SEQ ID NO: 2023896 - RNA, 13 nt, Homo sapiens
cuaaucacaucca

SEQ ID NO: 2023897 - RNA, 17 nt, Homo sapiens
aagucagagaaaacacu

SEQ ID NO: 2023898 - RNA, 23 nt, Homo sapiens
caaagugcugggauuacuggcau

SEQ ID NO: 2023899 - RNA, 17 nt, Homo sapiens
caacuagaaacagcucc

SEQ ID NO: 2023900 - RNA, 16 nt, Homo sapiens
ggcugaaaaugcaaag

SEQ ID NO: 2023901 - RNA, 20 nt, Homo sapiens
ugcacagucacugcucuuca

SEQ ID NO: 2023902 - RNA, 21 nt, Homo sapiens
uacaaagucagggcguucaua

SEQ ID NO: 2023903 - RNA, 20 nt, Homo sapiens
agcuggguacugacugagau

SEQ ID NO: 2023904 - RNA, 20 nt, Homo sapiens
ucuaugaacuuagaguuuac

SEQ ID NO: 2023905 - RNA, 16 nt, Homo sapiens
guuccuggcugaugau

SEQ ID NO: 2023906 - RNA, 20 nt, Homo sapiens
gagaccccaccagccucacc

SEQ ID NO: 2023907 - RNA, 17 nt, Homo sapiens
caauaaagcacugagca

SEQ ID NO: 2023908 - RNA, 13 nt, Homo sapiens
aggauagcuucau

SEQ ID NO: 2023909 - RNA, 20 nt, Homo sapiens
aaagcuuuggugccuggaaa

SEQ ID NO: 2023910 - RNA, 12 nt, Homo sapiens
ugauacauccaa

SEQ ID NO: 2023911 - RNA, 13 nt, Homo sapiens
ccccagugcuccu

SEQ ID NO: 2023912 - RNA, 18 nt, Homo sapiens
ccuccagggcgagcacuu

SEQ ID NO: 2023913 - RNA, 17 nt, Homo sapiens
uguguacuguauagaca

SEQ ID NO: 2023914 - RNA, 23 nt, Homo sapiens
cauuagcauucugguuuugacau

SEQ ID NO: 2023915 - RNA, 18 nt, Homo sapiens
gccuuuccagaacuacca

SEQ ID NO: 2023916 - RNA, 22 nt, Homo sapiens
auagguauguagcaguaucuca

SEQ ID NO: 2023917 - RNA, 12 nt, Homo sapiens
cuuccuuucauu

SEQ ID NO: 2023918 - RNA, 16 nt, Homo sapiens
cuuuuucuacauguga

SEQ ID NO: 2023919 - RNA, 14 nt, Homo sapiens
gcaguuuacuuuag

SEQ ID NO: 2023920 - RNA, 13 nt, Homo sapiens
accccuaccucua

SEQ ID NO: 2023921 - RNA, 23 nt, Homo sapiens
acaaacaagaggacuguguugug

SEQ ID NO: 2023922 - RNA, 16 nt, Homo sapiens
uggacacugugguuau

SEQ ID NO: 2023923 - RNA, 12 nt, Homo sapiens
uagccugugcug

SEQ ID NO: 2023924 - RNA, 21 nt, Homo sapiens
ccugauguggcauauggagcc

SEQ ID NO: 2023925 - RNA, 14 nt, Homo sapiens
auuugaaugcauuu

SEQ ID NO: 2023926 - RNA, 14 nt, Homo sapiens
ccuggagagacaga

SEQ ID NO: 2023927 - RNA, 17 nt, Homo sapiens
cccaggccagugcugug

SEQ ID NO: 2023928 - RNA, 18 nt, Homo sapiens
uuccugucuuaccaaaca

SEQ ID NO: 2023929 - RNA, 21 nt, Homo sapiens
ccggaguucugcccaugggaa

SEQ ID NO: 2023930 - RNA, 16 nt, Homo sapiens
ugucacuaaacaagaa

SEQ ID NO: 2023931 - RNA, 21 nt, Homo sapiens
uaaagugaggccacugaagag

SEQ ID NO: 2023932 - RNA, 17 nt, Homo sapiens
ccacaaauaacaucuca

SEQ ID NO: 2023933 - RNA, 20 nt, Homo sapiens
uucagaucgaaauuggacug

SEQ ID NO: 2023934 - RNA, 14 nt, Homo sapiens
aggccccagccaag

SEQ ID NO: 2023935 - RNA, 19 nt, Homo sapiens
caaacacaccgaugcacac

SEQ ID NO: 2023936 - RNA, 16 nt, Homo sapiens
cacaccgugugccaua

SEQ ID NO: 2023937 - RNA, 20 nt, Homo sapiens
uguuaaaacaaccaguuaaa

SEQ ID NO: 2023938 - RNA, 18 nt, Homo sapiens
caggaagucuucagggaa

SEQ ID NO: 2023939 - RNA, 23 nt, Homo sapiens
auccccacagcuggcucugacaa

SEQ ID NO: 2023940 - RNA, 15 nt, Homo sapiens
uacugcaaacagugu

SEQ ID NO: 2023941 - RNA, 16 nt, Homo sapiens
agcuauaacuaagcau

SEQ ID NO: 2023942 - RNA, 17 nt, Homo sapiens
uccuaauuuuagugaca

SEQ ID NO: 2023943 - RNA, 22 nt, Homo sapiens
gcuggcuggaaaaaggugaaug

SEQ ID NO: 2023944 - RNA, 23 nt, Homo sapiens
ggcauggugguugggacccagug

SEQ ID NO: 2023945 - RNA, 21 nt, Homo sapiens
auuacauccucugcuugucau

SEQ ID NO: 2023946 - RNA, 23 nt, Homo sapiens
gauuccagugcaguagugccaaa

SEQ ID NO: 2023947 - RNA, 15 nt, Homo sapiens
uaaaagaaggaugaa

SEQ ID NO: 2023948 - RNA, 16 nt, Homo sapiens
ugagacauugugaaaa

SEQ ID NO: 2023949 - RNA, 12 nt, Homo sapiens
agauucuagcac

SEQ ID NO: 2023950 - RNA, 22 nt, Homo sapiens
uguaagcucuacugaggugcua

SEQ ID NO: 2023951 - RNA, 13 nt, Homo sapiens
uaaaaugcacuga

SEQ ID NO: 2023952 - RNA, 11 nt, Homo sapiens
aaaacugugac

SEQ ID NO: 2023953 - RNA, 11 nt, Homo sapiens
aacacugugaa

SEQ ID NO: 2023954 - RNA, 11 nt, Homo sapiens
agaacuguggc

SEQ ID NO: 2023955 - RNA, 23 nt, Homo sapiens
cugaacaaacuaaaggugcacug

SEQ ID NO: 2023956 - RNA, 14 nt, Homo sapiens
gaaauucuguggug

SEQ ID NO: 2023957 - RNA, 22 nt, Homo sapiens
uuuccuuuuuccugugacaaaa

SEQ ID NO: 2023958 - RNA, 22 nt, Homo sapiens
uucacagcacaguacacacaaa

SEQ ID NO: 2023959 - RNA, 13 nt, Homo sapiens
ccucacuggggca

SEQ ID NO: 2023960 - RNA, 15 nt, Homo sapiens
caggcgugguggcac

SEQ ID NO: 2023961 - RNA, 16 nt, Homo sapiens
caaguaacaauaugau

SEQ ID NO: 2023962 - RNA, 19 nt, Homo sapiens
cuaaacaggauucuuuaau

SEQ ID NO: 2023963 - RNA, 17 nt, Homo sapiens
caggucaauacaguaca

SEQ ID NO: 2023964 - RNA, 15 nt, Homo sapiens
cuccugggagacaaa

SEQ ID NO: 2023965 - RNA, 18 nt, Homo sapiens
uuccauuuccaagcacuu

SEQ ID NO: 2023966 - RNA, 13 nt, Homo sapiens
gauuucaaaugca

SEQ ID NO: 2023967 - RNA, 21 nt, Homo sapiens
gggagcauagcagaggggcca

SEQ ID NO: 2023968 - RNA, 20 nt, Homo sapiens
cuaggucgccagugaaauag

SEQ ID NO: 2023969 - RNA, 16 nt, Homo sapiens
uggaaugguaggauau

SEQ ID NO: 2023970 - RNA, 18 nt, Homo sapiens
cugagcacagcugcauua

SEQ ID NO: 2023971 - RNA, 18 nt, Homo sapiens
agcugccuccuggucucu

SEQ ID NO: 2023972 - RNA, 13 nt, Homo sapiens
ccagcagaagcca

SEQ ID NO: 2023973 - RNA, 16 nt, Homo sapiens
gcugccaggacaccug

SEQ ID NO: 2023974 - RNA, 19 nt, Homo sapiens
ucgcugggcucaacauaga

SEQ ID NO: 2023975 - RNA, 17 nt, Homo sapiens
cagagcugccaccugcc

SEQ ID NO: 2023976 - RNA, 23 nt, Homo sapiens
caccacagcagagaccaccacau

SEQ ID NO: 2023977 - RNA, 15 nt, Homo sapiens
cuaauuuuguugaaa

SEQ ID NO: 2023978 - RNA, 23 nt, Homo sapiens
ccaggggaaggaaggagggcaca

SEQ ID NO: 2023979 - RNA, 15 nt, Homo sapiens
cuguaaauguauuca

SEQ ID NO: 2023980 - RNA, 22 nt, Homo sapiens
gcacguguggccuguucuucua

SEQ ID NO: 2023981 - RNA, 14 nt, Homo sapiens
ugacaagcagauac

SEQ ID NO: 2023982 - RNA, 14 nt, Homo sapiens
cuacuugcuguaga

SEQ ID NO: 2023983 - RNA, 12 nt, Homo sapiens
ggucaucaaauu

SEQ ID NO: 2023984 - RNA, 13 nt, Homo sapiens
uuagacaguaugc

SEQ ID NO: 2023985 - RNA, 13 nt, Homo sapiens
uaaaccaguuuaa

SEQ ID NO: 2023986 - RNA, 20 nt, Homo sapiens
gcagggcgccaagucuggca

SEQ ID NO: 2023987 - RNA, 17 nt, Homo sapiens
ccuuccuaaacccaaug

SEQ ID NO: 2023988 - RNA, 13 nt, Homo sapiens
uacuuaaauuccc

SEQ ID NO: 2023989 - RNA, 13 nt, Homo sapiens
uaaccaaauuauu

SEQ ID NO: 2023990 - RNA, 13 nt, Homo sapiens
cugggcagguggg

SEQ ID NO: 2023991 - RNA, 13 nt, Homo sapiens
uauccuguucuca

SEQ ID NO: 2023992 - RNA, 16 nt, Homo sapiens
ccacagaaguucaaua

SEQ ID NO: 2023993 - RNA, 22 nt, Homo sapiens
cuccauugguguugacauacau

SEQ ID NO: 2023994 - RNA, 17 nt, Homo sapiens
gaucuauguacuguaau

SEQ ID NO: 2023995 - RNA, 17 nt, Homo sapiens
cuuuauaaaagcaaaag

SEQ ID NO: 2023996 - RNA, 20 nt, Homo sapiens
uuacauguaugguuacuaaa

SEQ ID NO: 2023997 - RNA, 15 nt, Homo sapiens
aauagucucacuguc

SEQ ID NO: 2023998 - RNA, 13 nt, Homo sapiens
aaucuaucacuuu

SEQ ID NO: 2023999 - RNA, 12 nt, Homo sapiens
cccuuuugcauu

SEQ ID NO: 2024000 - RNA, 15 nt, Homo sapiens
gugggcaccucagaa

SEQ ID NO: 2024001 - RNA, 17 nt, Homo sapiens
uauuguguauguagccu

SEQ ID NO: 2024002 - RNA, 18 nt, Homo sapiens
ggcagguagccaggggga

SEQ ID NO: 2024003 - RNA, 22 nt, Homo sapiens
ugcugcauuuucuucacuugca

SEQ ID NO: 2024004 - RNA, 18 nt, Homo sapiens
auuguauaauuaugaagc

SEQ ID NO: 2024005 - RNA, 20 nt, Homo sapiens
cauccuuuuacuuuuugccc

SEQ ID NO: 2024006 - RNA, 14 nt, Homo sapiens
acacccaauuccac

SEQ ID NO: 2024007 - RNA, 21 nt, Homo sapiens
uagucugaagucuggaacacu

SEQ ID NO: 2024008 - RNA, 14 nt, Homo sapiens
cuacaaacacugca

SEQ ID NO: 2024009 - RNA, 18 nt, Homo sapiens
ucugaccauuucaggggu

SEQ ID NO: 2024010 - RNA, 14 nt, Homo sapiens
cagccuacugccuc

SEQ ID NO: 2024011 - RNA, 21 nt, Homo sapiens
ccuacagggacacuaucacuc

SEQ ID NO: 2024012 - RNA, 16 nt, Homo sapiens
caccugggcugaggca

SEQ ID NO: 2024013 - RNA, 14 nt, Homo sapiens
uaauucaccaauuu

SEQ ID NO: 2024014 - RNA, 14 nt, Homo sapiens
cgcaccacugcacu

SEQ ID NO: 2024015 - RNA, 23 nt, Homo sapiens
aagcugcucagggaaaagcagcu

SEQ ID NO: 2024016 - RNA, 17 nt, Homo sapiens
uggugugaccauguuca

SEQ ID NO: 2024017 - RNA, 17 nt, Homo sapiens
cagcugcucccaaauaa

SEQ ID NO: 2024018 - RNA, 13 nt, Homo sapiens
guuugcauuccag

SEQ ID NO: 2024019 - RNA, 13 nt, Homo sapiens
gccuucauuuuau

SEQ ID NO: 2024020 - RNA, 23 nt, Homo sapiens
ccuccccaaggagacacaacaac

SEQ ID NO: 2024021 - RNA, 17 nt, Homo sapiens
ugaagaguaguuuacua

SEQ ID NO: 2024022 - RNA, 20 nt, Homo sapiens
auaaacaaauaacaaugugc

SEQ ID NO: 2024023 - RNA, 21 nt, Homo sapiens
cagaaauguuaaacugagaca

SEQ ID NO: 2024024 - RNA, 17 nt, Homo sapiens
ucacguggaaaugucuc

SEQ ID NO: 2024025 - RNA, 19 nt, Homo sapiens
acagagaggggcagggaag

SEQ ID NO: 2024026 - RNA, 17 nt, Homo sapiens
uugucaaaaaguuccau

SEQ ID NO: 2024027 - RNA, 16 nt, Homo sapiens
uuugcauagcuuucca

SEQ ID NO: 2024028 - RNA, 22 nt, Homo sapiens
aaguaaucucacagcauuugcc

SEQ ID NO: 2024029 - RNA, 21 nt, Homo sapiens
uuaccuuguuauuuaacccau

SEQ ID NO: 2024030 - RNA, 16 nt, Homo sapiens
aauccuuaacauauuu

SEQ ID NO: 2024031 - RNA, 21 nt, Homo sapiens
ggucuggggcagcagagccau

SEQ ID NO: 2024032 - RNA, 13 nt, Homo sapiens
cacagcauuguau

SEQ ID NO: 2024033 - RNA, 15 nt, Homo sapiens
uaauuuuggauuuug

SEQ ID NO: 2024034 - RNA, 13 nt, Homo sapiens
auuggauuccucu

SEQ ID NO: 2024035 - RNA, 14 nt, Homo sapiens
ggugggggagccag

SEQ ID NO: 2024036 - RNA, 13 nt, Homo sapiens
uccaccacagcaa

SEQ ID NO: 2024037 - RNA, 21 nt, Homo sapiens
auuaacuuuuuaaaacacaac

SEQ ID NO: 2024038 - RNA, 20 nt, Homo sapiens
guagagauggagucuugcua

SEQ ID NO: 2024039 - RNA, 21 nt, Homo sapiens
uagucuuggaaaaaaaccaca

SEQ ID NO: 2024040 - RNA, 21 nt, Homo sapiens
accugguguaugaaauuggac

SEQ ID NO: 2024041 - RNA, 14 nt, Homo sapiens
aucaaucuggugcu

SEQ ID NO: 2024042 - RNA, 19 nt, Homo sapiens
aagcgagacuccaucucaa

SEQ ID NO: 2024043 - RNA, 13 nt, Homo sapiens
cugcugcugccaa

SEQ ID NO: 2024044 - RNA, 14 nt, Homo sapiens
ccacucccaaagcu

SEQ ID NO: 2024045 - RNA, 16 nt, Homo sapiens
guguuugaagucugcu

SEQ ID NO: 2024046 - RNA, 17 nt, Homo sapiens
ucuagaggccugaaauc

SEQ ID NO: 2024047 - RNA, 23 nt, Homo sapiens
ugccuggagacagauacguaguu

SEQ ID NO: 2024048 - RNA, 19 nt, Homo sapiens
uagcuugauugcucagaga

SEQ ID NO: 2024049 - RNA, 20 nt, Homo sapiens
caaacccuagccuugcuugu

SEQ ID NO: 2024050 - RNA, 18 nt, Homo sapiens
agaaauagugcacuccaa

SEQ ID NO: 2024051 - RNA, 22 nt, Homo sapiens
ccugauuccuuuaaaugaauau

SEQ ID NO: 2024052 - RNA, 19 nt, Homo sapiens
uccacccuuggacuuucuu

SEQ ID NO: 2024053 - RNA, 21 nt, Homo sapiens
cacaggcuggcugcguguucu

SEQ ID NO: 2024054 - RNA, 20 nt, Homo sapiens
acgcuccuauaggaccaaga

SEQ ID NO: 2024055 - RNA, 19 nt, Homo sapiens
cucaaugcacaacaaagga

SEQ ID NO: 2024056 - RNA, 13 nt, Homo sapiens
agaaaucauagaa

SEQ ID NO: 2024057 - RNA, 14 nt, Homo sapiens
ugcucugugcagac

SEQ ID NO: 2024058 - RNA, 14 nt, Homo sapiens
aaugucuucuccca

SEQ ID NO: 2024059 - RNA, 21 nt, Homo sapiens
cuauauaguuccuugccuuaa

SEQ ID NO: 2024060 - RNA, 23 nt, Homo sapiens
auuaguacuggauuauucaggcu

SEQ ID NO: 2024061 - RNA, 17 nt, Homo sapiens
cuggccauccaugugau

SEQ ID NO: 2024062 - RNA, 16 nt, Homo sapiens
acugcauuucacucug

SEQ ID NO: 2024063 - RNA, 18 nt, Homo sapiens
uuccacccacguggagac

SEQ ID NO: 2024064 - RNA, 12 nt, Homo sapiens
guaagcaaacaa

SEQ ID NO: 2024065 - RNA, 16 nt, Homo sapiens
caaaguguuaaucuua

SEQ ID NO: 2024066 - RNA, 18 nt, Homo sapiens
uuccugguuaagcaggca

SEQ ID NO: 2024067 - RNA, 12 nt, Homo sapiens
ccacugaccaga

SEQ ID NO: 2024068 - RNA, 12 nt, Homo sapiens
auuuucugucag

SEQ ID NO: 2024069 - RNA, 17 nt, Homo sapiens
gcaaaauuuaugcaaau

SEQ ID NO: 2024070 - RNA, 22 nt, Homo sapiens
aucaucggaguugacagugaaa

SEQ ID NO: 2024071 - RNA, 19 nt, Homo sapiens
aggcuaugggguaggagaa

SEQ ID NO: 2024072 - RNA, 22 nt, Homo sapiens
cagccuggacaccucucaugca

SEQ ID NO: 2024073 - RNA, 21 nt, Homo sapiens
ccuccuagccugcucugccac

SEQ ID NO: 2024074 - RNA, 15 nt, Homo sapiens
auuuaugaauuuuac

SEQ ID NO: 2024075 - RNA, 16 nt, Homo sapiens
auauacucaguucuca

SEQ ID NO: 2024076 - RNA, 20 nt, Homo sapiens
cuaucuacugagacaugacu

SEQ ID NO: 2024077 - RNA, 19 nt, Homo sapiens
uuguggaauugagcagaga

SEQ ID NO: 2024078 - RNA, 23 nt, Homo sapiens
gccacugccacacgucugacccu

SEQ ID NO: 2024079 - RNA, 17 nt, Homo sapiens
agccucugaauaugaac

SEQ ID NO: 2024080 - RNA, 20 nt, Homo sapiens
acuucucucaucugggcaaa

SEQ ID NO: 2024081 - RNA, 22 nt, Homo sapiens
aguacaugauaaaugauagaca

SEQ ID NO: 2024082 - RNA, 22 nt, Homo sapiens
cuucuuuucaccucuuuaacca

SEQ ID NO: 2024083 - RNA, 16 nt, Homo sapiens
aacaagccucaaaguc

SEQ ID NO: 2024084 - RNA, 19 nt, Homo sapiens
caucaggggcaggaaccag

SEQ ID NO: 2024085 - RNA, 14 nt, Homo sapiens
gugaucacuuucag

SEQ ID NO: 2024086 - RNA, 15 nt, Homo sapiens
caccaucaacuuaaa

SEQ ID NO: 2024087 - RNA, 21 nt, Homo sapiens
accauccugccauccuugacu

SEQ ID NO: 2024088 - RNA, 13 nt, Homo sapiens
ggcuaacauccca

SEQ ID NO: 2024089 - RNA, 20 nt, Homo sapiens
acaacagguaaaacagggcc

SEQ ID NO: 2024090 - RNA, 17 nt, Homo sapiens
uggggagaucggggcca

SEQ ID NO: 2024091 - RNA, 16 nt, Homo sapiens
aucuccccuucacaug

SEQ ID NO: 2024092 - RNA, 22 nt, Homo sapiens
cacacugggugcgucuccaguc

SEQ ID NO: 2024093 - RNA, 16 nt, Homo sapiens
aaucuugcucacagcu

SEQ ID NO: 2024094 - RNA, 14 nt, Homo sapiens
cugggcuacaauuu

SEQ ID NO: 2024095 - RNA, 19 nt, Homo sapiens
cccuagaaagcugcuguga

SEQ ID NO: 2024096 - RNA, 21 nt, Homo sapiens
cagcaccgauggccauguaaa

SEQ ID NO: 2024097 - RNA, 23 nt, Homo sapiens
gggcugaguggucugacaccaaa

SEQ ID NO: 2024098 - RNA, 14 nt, Homo sapiens
auguuuuaacuuau

SEQ ID NO: 2024099 - RNA, 17 nt, Homo sapiens
agagaaagugacaugca

SEQ ID NO: 2024100 - RNA, 19 nt, Homo sapiens
cccugcgggugaacaaagc

SEQ ID NO: 2024101 - RNA, 16 nt, Homo sapiens
aacacaugaacauuga

SEQ ID NO: 2024102 - RNA, 16 nt, Homo sapiens
caugacugcucaggcc

SEQ ID NO: 2024103 - RNA, 21 nt, Homo sapiens
cucagugggacaaaccagagc

SEQ ID NO: 2024104 - RNA, 14 nt, Homo sapiens
caaugccugugaag

SEQ ID NO: 2024105 - RNA, 13 nt, Homo sapiens
ugacuaagccaag

SEQ ID NO: 2024106 - RNA, 18 nt, Homo sapiens
caaagcagcacauggugu

SEQ ID NO: 2024107 - RNA, 16 nt, Homo sapiens
ccuuugccuuugccuc

SEQ ID NO: 2024108 - RNA, 14 nt, Homo sapiens
acggaauuccaaua

SEQ ID NO: 2024109 - RNA, 22 nt, Homo sapiens
gugcuccucucgcacaaugcau

SEQ ID NO: 2024110 - RNA, 13 nt, Homo sapiens
cucacaccuguaa

SEQ ID NO: 2024111 - RNA, 23 nt, Homo sapiens
gucuaccaaguaagacaucucaa

SEQ ID NO: 2024112 - RNA, 20 nt, Homo sapiens
uguuacugcuuugcaaagac

SEQ ID NO: 2024113 - RNA, 11 nt, Homo sapiens
acuaugacaaa

SEQ ID NO: 2024114 - RNA, 19 nt, Homo sapiens
uccuuaaaucguuuagcau

SEQ ID NO: 2024115 - RNA, 17 nt, Homo sapiens
uauuugcacuuguggaa

SEQ ID NO: 2024116 - RNA, 21 nt, Homo sapiens
cugggggggccgcucuccccc

SEQ ID NO: 2024117 - RNA, 16 nt, Homo sapiens
ugggcucugaacacac

SEQ ID NO: 2024118 - RNA, 21 nt, Homo sapiens
ugaugcgggccagugcuccag

SEQ ID NO: 2024119 - RNA, 23 nt, Homo sapiens
gaaauuuucaauuugagauucua

SEQ ID NO: 2024120 - RNA, 18 nt, Homo sapiens
aagcuguaucacugccuu

SEQ ID NO: 2024121 - RNA, 22 nt, Homo sapiens
agacaucucaggauuucaccag

SEQ ID NO: 2024122 - RNA, 20 nt, Homo sapiens
cagauuuuagacuuaccuug

SEQ ID NO: 2024123 - RNA, 15 nt, Homo sapiens
ucuuccucuuaccug

SEQ ID NO: 2024124 - RNA, 18 nt, Homo sapiens
acuuuuuaccuaguacaa

SEQ ID NO: 2024125 - RNA, 21 nt, Homo sapiens
agccuccaauguacaacuucc

SEQ ID NO: 2024126 - RNA, 13 nt, Homo sapiens
ggacccucaggug

SEQ ID NO: 2024127 - RNA, 21 nt, Homo sapiens
cauguacuuaauaacacuuca

SEQ ID NO: 2024128 - RNA, 10 nt, Homo sapiens
caucuucccu

SEQ ID NO: 2024129 - RNA, 19 nt, Homo sapiens
gagguggagguugcauuga

SEQ ID NO: 2024130 - RNA, 14 nt, Homo sapiens
gagaagcacagcuc

SEQ ID NO: 2024131 - RNA, 19 nt, Homo sapiens
agcaacaacugucaguuca

SEQ ID NO: 2024132 - RNA, 21 nt, Homo sapiens
guuggccucagggccaggaag

SEQ ID NO: 2024133 - RNA, 21 nt, Homo sapiens
ucacagguuaaugugguguua

SEQ ID NO: 2024134 - RNA, 20 nt, Homo sapiens
ccaguccaguuucccaaaaa

SEQ ID NO: 2024135 - RNA, 17 nt, Homo sapiens
uaauaugauuauacaaa

SEQ ID NO: 2024136 - RNA, 18 nt, Homo sapiens
gcucagggaaaagcagcu

SEQ ID NO: 2024137 - RNA, 14 nt, Homo sapiens
gagcgugcuuucaa

SEQ ID NO: 2024138 - RNA, 16 nt, Homo sapiens
cuguuuuguaaagucc

SEQ ID NO: 2024139 - RNA, 16 nt, Homo sapiens
ugcuaccuuugucuca

SEQ ID NO: 2024140 - RNA, 23 nt, Homo sapiens
ggcuaucaacauguuauucaaug

SEQ ID NO: 2024141 - RNA, 23 nt, Homo sapiens
acaauguauuugucaaugcauca

SEQ ID NO: 2024142 - RNA, 16 nt, Homo sapiens
ugaaugaacuaguuua

SEQ ID NO: 2024143 - RNA, 23 nt, Homo sapiens
ucaccagcccugcgccaccucac

SEQ ID NO: 2024144 - RNA, 11 nt, Homo sapiens
gcuacaacagc

SEQ ID NO: 2024145 - RNA, 16 nt, Homo sapiens
aucacaggacauuaag

SEQ ID NO: 2024146 - RNA, 14 nt, Homo sapiens
uuggaauucgugca

SEQ ID NO: 2024147 - RNA, 14 nt, Homo sapiens
uaacauaccuuguc

SEQ ID NO: 2024148 - RNA, 16 nt, Homo sapiens
agcuggguacugacug

SEQ ID NO: 2024149 - RNA, 15 nt, Homo sapiens
agcagacacccugug

SEQ ID NO: 2024150 - RNA, 15 nt, Homo sapiens
cauuaccuguagcuu

SEQ ID NO: 2024151 - RNA, 18 nt, Homo sapiens
agugagacuccaccucaa

SEQ ID NO: 2024152 - RNA, 17 nt, Homo sapiens
aggucacauagcuggga

SEQ ID NO: 2024153 - RNA, 15 nt, Homo sapiens
cccuggccuagcaua

SEQ ID NO: 2024154 - RNA, 13 nt, Homo sapiens
ggaagacuuuaaa

SEQ ID NO: 2024155 - RNA, 13 nt, Homo sapiens
uuuaaacugguag

SEQ ID NO: 2024156 - RNA, 15 nt, Homo sapiens
aaaaauaaacucugc

SEQ ID NO: 2024157 - RNA, 22 nt, Homo sapiens
ugcagcugcuuguugucaagua

SEQ ID NO: 2024158 - RNA, 23 nt, Homo sapiens
ugaacauaggaaaauagaaacuu

SEQ ID NO: 2024159 - RNA, 14 nt, Homo sapiens
aguuuccucaguga

SEQ ID NO: 2024160 - RNA, 14 nt, Homo sapiens
accccacagaguug

SEQ ID NO: 2024161 - RNA, 16 nt, Homo sapiens
uccauugcucuugagu

SEQ ID NO: 2024162 - RNA, 15 nt, Homo sapiens
uaaaaaaagcuaaaa

SEQ ID NO: 2024163 - RNA, 18 nt, Homo sapiens
auucugaagcaacauuuu

SEQ ID NO: 2024164 - RNA, 12 nt, Homo sapiens
ugcacacgcaca

SEQ ID NO: 2024165 - RNA, 12 nt, Homo sapiens
uggccacgcagc

SEQ ID NO: 2024166 - RNA, 15 nt, Homo sapiens
cugauacccagagca

SEQ ID NO: 2024167 - RNA, 23 nt, Homo sapiens
caccugcuccaggagguuugcag

SEQ ID NO: 2024168 - RNA, 17 nt, Homo sapiens
cugccaucucucccacu

SEQ ID NO: 2024169 - RNA, 12 nt, Homo sapiens
gggggaccuggg

SEQ ID NO: 2024170 - RNA, 12 nt, Homo sapiens
gcaggaccucag

SEQ ID NO: 2024171 - RNA, 17 nt, Homo sapiens
cugaauaaaugauuaaa

SEQ ID NO: 2024172 - RNA, 17 nt, Homo sapiens
acagagggacagugggc

SEQ ID NO: 2024173 - RNA, 17 nt, Homo sapiens
gugccagcucaggugac

SEQ ID NO: 2024174 - RNA, 17 nt, Homo sapiens
agucucuugacuccacu

SEQ ID NO: 2024175 - RNA, 12 nt, Homo sapiens
aguugugcacau

SEQ ID NO: 2024176 - RNA, 16 nt, Homo sapiens
guggccaucaaccucu

SEQ ID NO: 2024177 - RNA, 14 nt, Homo sapiens
ucaggucccaucaa

SEQ ID NO: 2024178 - RNA, 22 nt, Homo sapiens
cuggucccggggccagcacuuc

SEQ ID NO: 2024179 - RNA, 14 nt, Homo sapiens
acaauguucauccc

SEQ ID NO: 2024180 - RNA, 20 nt, Homo sapiens
uagaauaauacuagucuuau

SEQ ID NO: 2024181 - RNA, 20 nt, Homo sapiens
guaacucuguaauuccuaac

SEQ ID NO: 2024182 - RNA, 21 nt, Homo sapiens
agguggaaaaacagcauguac

SEQ ID NO: 2024183 - RNA, 19 nt, Homo sapiens
agcaucgugcuguuugccu

SEQ ID NO: 2024184 - RNA, 14 nt, Homo sapiens
ucacucaagccuga

SEQ ID NO: 2024185 - RNA, 12 nt, Homo sapiens
auuuuaaaacaa

SEQ ID NO: 2024186 - RNA, 23 nt, Homo sapiens
cauccaugcugugcuguguuauu

SEQ ID NO: 2024187 - RNA, 11 nt, Homo sapiens
auccaguuuag

SEQ ID NO: 2024188 - RNA, 13 nt, Homo sapiens
ucaaauacaugca

SEQ ID NO: 2024189 - RNA, 16 nt, Homo sapiens
auacaguaugaucuca

SEQ ID NO: 2024190 - RNA, 17 nt, Homo sapiens
ucacuucuaaaccaaaa

SEQ ID NO: 2024191 - RNA, 18 nt, Homo sapiens
guauuccaccacaggaau

SEQ ID NO: 2024192 - RNA, 15 nt, Homo sapiens
gcaaaacuuuacuuu

SEQ ID NO: 2024193 - RNA, 12 nt, Homo sapiens
aagaagcuguca

SEQ ID NO: 2024194 - RNA, 22 nt, Homo sapiens
guauccguucaauaagcauuuc

SEQ ID NO: 2024195 - RNA, 20 nt, Homo sapiens
cuacaggcacaagucaccau

SEQ ID NO: 2024196 - RNA, 13 nt, Homo sapiens
uaaccuguuuuca

SEQ ID NO: 2024197 - RNA, 15 nt, Homo sapiens
gccuggcauuucaca

SEQ ID NO: 2024198 - RNA, 13 nt, Homo sapiens
agcccacaucuca

SEQ ID NO: 2024199 - RNA, 17 nt, Homo sapiens
cagcugaagaacaucug

SEQ ID NO: 2024200 - RNA, 16 nt, Homo sapiens
auccacccaccucagc

SEQ ID NO: 2024201 - RNA, 23 nt, Homo sapiens
gccauugaucauaaacugacuau

SEQ ID NO: 2024202 - RNA, 22 nt, Homo sapiens
acacgcccuccccagacuccac

SEQ ID NO: 2024203 - RNA, 16 nt, Homo sapiens
cuaguaugaaauuaua

SEQ ID NO: 2024204 - RNA, 16 nt, Homo sapiens
cauggcagauuugcaa

SEQ ID NO: 2024205 - RNA, 18 nt, Homo sapiens
caguguguguaacagggu

SEQ ID NO: 2024206 - RNA, 16 nt, Homo sapiens
uccagaaugaagaauu

SEQ ID NO: 2024207 - RNA, 15 nt, Homo sapiens
gcuuuacagugccac

SEQ ID NO: 2024208 - RNA, 22 nt, Homo sapiens
ggaggcagagguugcagugaac

SEQ ID NO: 2024209 - RNA, 15 nt, Homo sapiens
uaaagauaaugcugc

SEQ ID NO: 2024210 - RNA, 17 nt, Homo sapiens
auguguugcagcuuuau

SEQ ID NO: 2024211 - RNA, 17 nt, Homo sapiens
uauccuaauuguccaca

SEQ ID NO: 2024212 - RNA, 19 nt, Homo sapiens
aacuccugaccucagguga

SEQ ID NO: 2024213 - RNA, 17 nt, Homo sapiens
cugugccacaaugcagu

SEQ ID NO: 2024214 - RNA, 18 nt, Homo sapiens
auugcaaagauguuuaca

SEQ ID NO: 2024215 - RNA, 21 nt, Homo sapiens
caguuugaagcccaaucugca

SEQ ID NO: 2024216 - RNA, 15 nt, Homo sapiens
augugguagccucac

SEQ ID NO: 2024217 - RNA, 16 nt, Homo sapiens
uaacucuagaauuugg

SEQ ID NO: 2024218 - RNA, 19 nt, Homo sapiens
acuugcauucagaacauaa

SEQ ID NO: 2024219 - RNA, 21 nt, Homo sapiens
cccucguggccagcccggcug

SEQ ID NO: 2024220 - RNA, 20 nt, Homo sapiens
cauguacuuucccuguguac

SEQ ID NO: 2024221 - RNA, 18 nt, Homo sapiens
augucagguacauaacau

SEQ ID NO: 2024222 - RNA, 21 nt, Homo sapiens
uuuggacuggcuucucccagg

SEQ ID NO: 2024223 - RNA, 14 nt, Homo sapiens
cacuuuucacuuau

SEQ ID NO: 2024224 - RNA, 19 nt, Homo sapiens
cauuaaggggaagaaugaa

SEQ ID NO: 2024225 - RNA, 20 nt, Homo sapiens
agauaugaagaaucugcucu

SEQ ID NO: 2024226 - RNA, 14 nt, Homo sapiens
cucccccaacagcu

SEQ ID NO: 2024227 - RNA, 16 nt, Homo sapiens
cacaugugcacaugca

SEQ ID NO: 2024228 - RNA, 14 nt, Homo sapiens
uaccaucuaaucua

SEQ ID NO: 2024229 - RNA, 15 nt, Homo sapiens
uucuaauaaacagac

SEQ ID NO: 2024230 - RNA, 17 nt, Homo sapiens
uggaugucaaacaguaa

SEQ ID NO: 2024231 - RNA, 17 nt, Homo sapiens
aaucccagacuacuuca

SEQ ID NO: 2024232 - RNA, 15 nt, Homo sapiens
accaggaggacaaga

SEQ ID NO: 2024233 - RNA, 13 nt, Homo sapiens
aaauuauuaucuu

SEQ ID NO: 2024234 - RNA, 13 nt, Homo sapiens
gaucuugccucca

SEQ ID NO: 2024235 - RNA, 13 nt, Homo sapiens
cacaacacagaua

SEQ ID NO: 2024236 - RNA, 19 nt, Homo sapiens
aaguagcugugaacauugu

SEQ ID NO: 2024237 - RNA, 14 nt, Homo sapiens
acguucugcugcuu

SEQ ID NO: 2024238 - RNA, 18 nt, Homo sapiens
uuacuguuuuauguugau

SEQ ID NO: 2024239 - RNA, 18 nt, Homo sapiens
cuuuuuuuuuuaaucucc

SEQ ID NO: 2024240 - RNA, 16 nt, Homo sapiens
guggaaugcagggaag

SEQ ID NO: 2024241 - RNA, 16 nt, Homo sapiens
guaaaauccaaagaac

SEQ ID NO: 2024242 - RNA, 18 nt, Homo sapiens
uuuacuugaucauucuca

SEQ ID NO: 2024243 - RNA, 15 nt, Homo sapiens
gaagguaaaacaaau

SEQ ID NO: 2024244 - RNA, 13 nt, Homo sapiens
gcacuauuugccg

SEQ ID NO: 2024245 - RNA, 23 nt, Homo sapiens
caacacaagcuggaagcacaugu

SEQ ID NO: 2024246 - RNA, 17 nt, Homo sapiens
aucugggcaaaugaaaa

SEQ ID NO: 2024247 - RNA, 20 nt, Homo sapiens
uccugaccuccuggacugua

SEQ ID NO: 2024248 - RNA, 20 nt, Homo sapiens
cccugccccugugggacuca

SEQ ID NO: 2024249 - RNA, 14 nt, Homo sapiens
ucccagcuacuagg

SEQ ID NO: 2024250 - RNA, 20 nt, Homo sapiens
agguaacuguacugggccau

SEQ ID NO: 2024251 - RNA, 15 nt, Homo sapiens
gcugugggccaaaau

SEQ ID NO: 2024252 - RNA, 17 nt, Homo sapiens
ccuucauaugugcagua

SEQ ID NO: 2024253 - RNA, 23 nt, Homo sapiens
gacagauuccaggcgaugugcaa

SEQ ID NO: 2024254 - RNA, 21 nt, Homo sapiens
cagguucugacucuuggcaca

SEQ ID NO: 2024255 - RNA, 20 nt, Homo sapiens
gaaaauaguccuccaaaaca

SEQ ID NO: 2024256 - RNA, 20 nt, Homo sapiens
cuacgaagaaagacuccuuu

SEQ ID NO: 2024257 - RNA, 16 nt, Homo sapiens
guuaccauucacaaua

SEQ ID NO: 2024258 - RNA, 17 nt, Homo sapiens
aaaagaacaacugccaa

SEQ ID NO: 2024259 - RNA, 13 nt, Homo sapiens
uaaauaugagaua

SEQ ID NO: 2024260 - RNA, 14 nt, Homo sapiens
uguaaaugcucaaa

SEQ ID NO: 2024261 - RNA, 19 nt, Homo sapiens
gagcagcuucugggaccau

SEQ ID NO: 2024262 - RNA, 20 nt, Homo sapiens
cgcacaugacauagcacuug

SEQ ID NO: 2024263 - RNA, 17 nt, Homo sapiens
cuuggccuacagucauc

SEQ ID NO: 2024264 - RNA, 14 nt, Homo sapiens
caggggaguuccug

SEQ ID NO: 2024265 - RNA, 20 nt, Homo sapiens
gaaaguccaauuccaaagcc

SEQ ID NO: 2024266 - RNA, 20 nt, Homo sapiens
ucuuguggucaucauggcca

SEQ ID NO: 2024267 - RNA, 13 nt, Homo sapiens
auguuaucaacca

SEQ ID NO: 2024268 - RNA, 17 nt, Homo sapiens
ccacuuugguaaugugu

SEQ ID NO: 2024269 - RNA, 15 nt, Homo sapiens
uuucucccugcagcc

SEQ ID NO: 2024270 - RNA, 15 nt, Homo sapiens
uuucuugcugcagug

SEQ ID NO: 2024271 - RNA, 18 nt, Homo sapiens
ucaucggaaauggcggua

SEQ ID NO: 2024272 - RNA, 14 nt, Homo sapiens
ucaagggcuuuauu

SEQ ID NO: 2024273 - RNA, 17 nt, Homo sapiens
uuuuaagaagcauuuua

SEQ ID NO: 2024274 - RNA, 20 nt, Homo sapiens
caacauguuacugaccagca

SEQ ID NO: 2024275 - RNA, 13 nt, Homo sapiens
auccgccuaccuc

SEQ ID NO: 2024276 - RNA, 17 nt, Homo sapiens
aagucuucaaauuugau

SEQ ID NO: 2024277 - RNA, 13 nt, Homo sapiens
auggaagcaauaa

SEQ ID NO: 2024278 - RNA, 16 nt, Homo sapiens
ggccuuagaaaacaug

SEQ ID NO: 2024279 - RNA, 19 nt, Homo sapiens
cuugacccugagcugacca

SEQ ID NO: 2024280 - RNA, 23 nt, Homo sapiens
uuuucauugcccgaaaccagagc

SEQ ID NO: 2024281 - RNA, 18 nt, Homo sapiens
auucuaguacauaauuga

SEQ ID NO: 2024282 - RNA, 15 nt, Homo sapiens
accuucuugcuccua

SEQ ID NO: 2024283 - RNA, 22 nt, Homo sapiens
ucaagcauguauuuuugucaau

SEQ ID NO: 2024284 - RNA, 19 nt, Homo sapiens
aaacugguugucaguuaca

SEQ ID NO: 2024285 - RNA, 22 nt, Homo sapiens
gaugccgagguaaaaguucuuu

SEQ ID NO: 2024286 - RNA, 18 nt, Homo sapiens
auuauuugaaaacacugc

SEQ ID NO: 2024287 - RNA, 23 nt, Homo sapiens
uccagugggcugaugcugggacc

SEQ ID NO: 2024288 - RNA, 13 nt, Homo sapiens
ggagacugagauc

SEQ ID NO: 2024289 - RNA, 21 nt, Homo sapiens
cuguacuguugggaaguuuug

SEQ ID NO: 2024290 - RNA, 17 nt, Homo sapiens
acagguggugucacugu

SEQ ID NO: 2024291 - RNA, 17 nt, Homo sapiens
caagaguucagugcuca

SEQ ID NO: 2024292 - RNA, 13 nt, Homo sapiens
ccgcaauacugua

SEQ ID NO: 2024293 - RNA, 15 nt, Homo sapiens
gcccagacccagugg

SEQ ID NO: 2024294 - RNA, 16 nt, Homo sapiens
uaguuccucuucuuaa

SEQ ID NO: 2024295 - RNA, 23 nt, Homo sapiens
acaaucucagcucacugugaccu

SEQ ID NO: 2024296 - RNA, 19 nt, Homo sapiens
agacagucgagaagccagg

SEQ ID NO: 2024297 - RNA, 22 nt, Homo sapiens
aaauaagcaugagacuauguaa

SEQ ID NO: 2024298 - RNA, 18 nt, Homo sapiens
aaaauucucauuacucuu

SEQ ID NO: 2024299 - RNA, 15 nt, Homo sapiens
agaauagaaaacacg

SEQ ID NO: 2024300 - RNA, 19 nt, Homo sapiens
ccuucucucuuacauugaa

SEQ ID NO: 2024301 - RNA, 15 nt, Homo sapiens
uucuggucacauucc

SEQ ID NO: 2024302 - RNA, 19 nt, Homo sapiens
agcacccagguuuugcacu

SEQ ID NO: 2024303 - RNA, 20 nt, Homo sapiens
accagaucagggacuugaau

SEQ ID NO: 2024304 - RNA, 18 nt, Homo sapiens
ucuuucugacacacuuag

SEQ ID NO: 2024305 - RNA, 18 nt, Homo sapiens
aguuucuuacacacuguc

SEQ ID NO: 2024306 - RNA, 16 nt, Homo sapiens
ugaccuagacagagau

SEQ ID NO: 2024307 - RNA, 21 nt, Homo sapiens
ucugagaaucacggugguaaa

SEQ ID NO: 2024308 - RNA, 14 nt, Homo sapiens
guucccaagcaaag

SEQ ID NO: 2024309 - RNA, 16 nt, Homo sapiens
ucccaaaucucaaaag

SEQ ID NO: 2024310 - RNA, 22 nt, Homo sapiens
caaaaaugggaaaccaguucau

SEQ ID NO: 2024311 - RNA, 12 nt, Homo sapiens
caggccagguag

SEQ ID NO: 2024312 - RNA, 14 nt, Homo sapiens
ugugauccaggaau

SEQ ID NO: 2024313 - RNA, 19 nt, Homo sapiens
agaccaguugggagcacug

SEQ ID NO: 2024314 - RNA, 15 nt, Homo sapiens
agaugggugucacuu

SEQ ID NO: 2024315 - RNA, 19 nt, Homo sapiens
ugauggguuaguggaugga

SEQ ID NO: 2024316 - RNA, 22 nt, Homo sapiens
aagcucaucucagcuccugaaa

SEQ ID NO: 2024317 - RNA, 20 nt, Homo sapiens
gcauuugguacacacuugac

SEQ ID NO: 2024318 - RNA, 18 nt, Homo sapiens
ucaacaguucauugcuca

SEQ ID NO: 2024319 - RNA, 20 nt, Homo sapiens
auagucccagcuacucggga

SEQ ID NO: 2024320 - RNA, 12 nt, Homo sapiens
uaggaagcccuc

SEQ ID NO: 2024321 - RNA, 19 nt, Homo sapiens
gcaccauacucaugcaugc

SEQ ID NO: 2024322 - RNA, 12 nt, Homo sapiens
agaugauguccu

SEQ ID NO: 2024323 - RNA, 17 nt, Homo sapiens
cugucacuacaauuuaa

SEQ ID NO: 2024324 - RNA, 20 nt, Homo sapiens
aauuugggagagccauacau

SEQ ID NO: 2024325 - RNA, 15 nt, Homo sapiens
gaguuauugaagcag

SEQ ID NO: 2024326 - RNA, 15 nt, Homo sapiens
auuacaaaugcaauu

SEQ ID NO: 2024327 - RNA, 17 nt, Homo sapiens
agaucacaccacugcac

SEQ ID NO: 2024328 - RNA, 15 nt, Homo sapiens
aguggcgugaucucg

SEQ ID NO: 2024329 - RNA, 16 nt, Homo sapiens
uauuuuuguaccauau

SEQ ID NO: 2024330 - RNA, 15 nt, Homo sapiens
aaauugcuccuugac

SEQ ID NO: 2024331 - RNA, 14 nt, Homo sapiens
uuaaugcugcuaca

SEQ ID NO: 2024332 - RNA, 20 nt, Homo sapiens
cugcagcauugccauaccau

SEQ ID NO: 2024333 - RNA, 19 nt, Homo sapiens
caugggcuaaugaagauca

SEQ ID NO: 2024334 - RNA, 13 nt, Homo sapiens
ucuccccacucca

SEQ ID NO: 2024335 - RNA, 21 nt, Homo sapiens
aaacuuggaugucacugccug

SEQ ID NO: 2024336 - RNA, 19 nt, Homo sapiens
aagcacccagcccuccugc

SEQ ID NO: 2024337 - RNA, 13 nt, Homo sapiens
agaggagaacaaa

SEQ ID NO: 2024338 - RNA, 21 nt, Homo sapiens
ccucagccucucaaguagcug

SEQ ID NO: 2024339 - RNA, 20 nt, Homo sapiens
uguuacugaauuugcuaaua

SEQ ID NO: 2024340 - RNA, 19 nt, Homo sapiens
acagcagcaaaggucacca

SEQ ID NO: 2024341 - RNA, 18 nt, Homo sapiens
gucaagcgauugucugag

SEQ ID NO: 2024342 - RNA, 14 nt, Homo sapiens
gcucucucuagaau

SEQ ID NO: 2024343 - RNA, 20 nt, Homo sapiens
uccacgggaagccuccguca

SEQ ID NO: 2024344 - RNA, 23 nt, Homo sapiens
auuaauugguuugugccuuacau

SEQ ID NO: 2024345 - RNA, 19 nt, Homo sapiens
ggugcauagcaagugaaag

SEQ ID NO: 2024346 - RNA, 21 nt, Homo sapiens
uauauuauuguuuucuacugc

SEQ ID NO: 2024347 - RNA, 16 nt, Homo sapiens
ucacguaagacuuuuu

SEQ ID NO: 2024348 - RNA, 21 nt, Homo sapiens
aggacgguuaacuuguauauu

SEQ ID NO: 2024349 - RNA, 19 nt, Homo sapiens
uauccacaaaugcuauuca

SEQ ID NO: 2024350 - RNA, 19 nt, Homo sapiens
cuugcagagcaugaccuga

SEQ ID NO: 2024351 - RNA, 17 nt, Homo sapiens
caguucauguugcucag

SEQ ID NO: 2024352 - RNA, 12 nt, Homo sapiens
cccacuuugcca

SEQ ID NO: 2024353 - RNA, 14 nt, Homo sapiens
ccucacugcugauu

SEQ ID NO: 2024354 - RNA, 14 nt, Homo sapiens
ucacuucauucaca

SEQ ID NO: 2024355 - RNA, 17 nt, Homo sapiens
cugagucagacugucag

SEQ ID NO: 2024356 - RNA, 18 nt, Homo sapiens
cuaucccugcggccucca

SEQ ID NO: 2024357 - RNA, 21 nt, Homo sapiens
auccccuugucugaacuggag

SEQ ID NO: 2024358 - RNA, 20 nt, Homo sapiens
agccgagccaugugucuuua

SEQ ID NO: 2024359 - RNA, 21 nt, Homo sapiens
uaguucuaucugaauccaaga

SEQ ID NO: 2024360 - RNA, 21 nt, Homo sapiens
uugucuggcaaggacuuugua

SEQ ID NO: 2024361 - RNA, 15 nt, Homo sapiens
cacacagacauauau

SEQ ID NO: 2024362 - RNA, 15 nt, Homo sapiens
cccaagauagaguca

SEQ ID NO: 2024363 - RNA, 15 nt, Homo sapiens
ccaucugaagccacc

SEQ ID NO: 2024364 - RNA, 17 nt, Homo sapiens
caguguauuucuucaaa

SEQ ID NO: 2024365 - RNA, 20 nt, Homo sapiens
cagauagcaucagaccugca

SEQ ID NO: 2024366 - RNA, 15 nt, Homo sapiens
uaaauguuaccucua

SEQ ID NO: 2024367 - RNA, 21 nt, Homo sapiens
cacuaaaagaauugugacaua

SEQ ID NO: 2024368 - RNA, 17 nt, Homo sapiens
gcgccuccuuccuugcu

SEQ ID NO: 2024369 - RNA, 16 nt, Homo sapiens
ccacugccucagguuc

SEQ ID NO: 2024370 - RNA, 20 nt, Homo sapiens
acagagagacagacuugaga

SEQ ID NO: 2024371 - RNA, 20 nt, Homo sapiens
ugagggaggagggcuuugaa

SEQ ID NO: 2024372 - RNA, 15 nt, Homo sapiens
cggggauguguccug

SEQ ID NO: 2024373 - RNA, 24 nt, Homo sapiens
gccaccaaaggccagggucacuga

SEQ ID NO: 2024374 - RNA, 15 nt, Homo sapiens
acuuacagaucuauc

SEQ ID NO: 2024375 - RNA, 15 nt, Homo sapiens
cugacaccaccaucu

SEQ ID NO: 2024376 - RNA, 13 nt, Homo sapiens
ggguggaugaucu

SEQ ID NO: 2024377 - RNA, 13 nt, Homo sapiens
auaaagcugugcu

SEQ ID NO: 2024378 - RNA, 21 nt, Homo sapiens
ucagagcuaauaagugcuuuc

SEQ ID NO: 2024379 - RNA, 15 nt, Homo sapiens
cgagauaccaucuca

SEQ ID NO: 2024380 - RNA, 13 nt, Homo sapiens
acaaaauuaagca

SEQ ID NO: 2024381 - RNA, 17 nt, Homo sapiens
gguggcggcagggccag

SEQ ID NO: 2024382 - RNA, 16 nt, Homo sapiens
cccucgugcacacaca

SEQ ID NO: 2024383 - RNA, 12 nt, Homo sapiens
gaaucuugacuu

SEQ ID NO: 2024384 - RNA, 21 nt, Homo sapiens
ccaacuaaugccuuacucuuc

SEQ ID NO: 2024385 - RNA, 16 nt, Homo sapiens
aaaccaguauuguaca

SEQ ID NO: 2024386 - RNA, 11 nt, Homo sapiens
gucaugcccuc

SEQ ID NO: 2024387 - RNA, 16 nt, Homo sapiens
ccaaaauacuucugag

SEQ ID NO: 2024388 - RNA, 15 nt, Homo sapiens
gccaggaaucugcca

SEQ ID NO: 2024389 - RNA, 23 nt, Homo sapiens
agacaggcaaauaaaagugaccu

SEQ ID NO: 2024390 - RNA, 16 nt, Homo sapiens
uguaguguaccauucu

SEQ ID NO: 2024391 - RNA, 12 nt, Homo sapiens
agcuuaccuggg

SEQ ID NO: 2024392 - RNA, 19 nt, Homo sapiens
cagggcucccugcccugac

SEQ ID NO: 2024393 - RNA, 13 nt, Homo sapiens
uaggucaagaaga

SEQ ID NO: 2024394 - RNA, 22 nt, Homo sapiens
uacuuagugguaugucucuuua

SEQ ID NO: 2024395 - RNA, 23 nt, Homo sapiens
uugcuggaaggcccacuguccag

SEQ ID NO: 2024396 - RNA, 22 nt, Homo sapiens
gcaguaaacuaagggugucaag

SEQ ID NO: 2024397 - RNA, 19 nt, Homo sapiens
aggaaaauguauccagagg

SEQ ID NO: 2024398 - RNA, 13 nt, Homo sapiens
ccaggggagaccc

SEQ ID NO: 2024399 - RNA, 15 nt, Homo sapiens
ucuuccacuuugaua

SEQ ID NO: 2024400 - RNA, 19 nt, Homo sapiens
ggcccagaagccugaucuu

SEQ ID NO: 2024401 - RNA, 14 nt, Homo sapiens
uccugccaggguga

SEQ ID NO: 2024402 - RNA, 17 nt, Homo sapiens
uccuguggaaauaugca

SEQ ID NO: 2024403 - RNA, 20 nt, Homo sapiens
uuuuugaaaauagagcaaua

SEQ ID NO: 2024404 - RNA, 19 nt, Homo sapiens
auucuuuuugaaaugucaa

SEQ ID NO: 2024405 - RNA, 14 nt, Homo sapiens
acuauuaguguuaa

SEQ ID NO: 2024406 - RNA, 19 nt, Homo sapiens
agucaccacccagcccuuc

SEQ ID NO: 2024407 - RNA, 21 nt, Homo sapiens
uaggcagcaaaagaccaaauc

SEQ ID NO: 2024408 - RNA, 13 nt, Homo sapiens
cucuaaagaccau

SEQ ID NO: 2024409 - RNA, 13 nt, Homo sapiens
auuauaagccuua

SEQ ID NO: 2024410 - RNA, 12 nt, Homo sapiens
acauggacaaua

SEQ ID NO: 2024411 - RNA, 22 nt, Homo sapiens
aaucucuacgacuaaucaccua

SEQ ID NO: 2024412 - RNA, 17 nt, Homo sapiens
ugcccaagguugcacag

SEQ ID NO: 2024413 - RNA, 18 nt, Homo sapiens
cagaaagcuagaaagugu

SEQ ID NO: 2024414 - RNA, 13 nt, Homo sapiens
gaaguguugcaug

SEQ ID NO: 2024415 - RNA, 18 nt, Homo sapiens
cugaaagaaaaaguacaa

SEQ ID NO: 2024416 - RNA, 17 nt, Homo sapiens
uuguuuaacggcagugu

SEQ ID NO: 2024417 - RNA, 20 nt, Homo sapiens
ugguuuuccagcgaagggaa

SEQ ID NO: 2024418 - RNA, 16 nt, Homo sapiens
uauacuaccaaaagag

SEQ ID NO: 2024419 - RNA, 16 nt, Homo sapiens
gaaagaugucuaugua

SEQ ID NO: 2024420 - RNA, 16 nt, Homo sapiens
aaagagugaaugccau

SEQ ID NO: 2024421 - RNA, 18 nt, Homo sapiens
agcggaggagaccagcuc

SEQ ID NO: 2024422 - RNA, 14 nt, Homo sapiens
agacuguugcacuc

SEQ ID NO: 2024423 - RNA, 12 nt, Homo sapiens
aaaugacuguau

SEQ ID NO: 2024424 - RNA, 19 nt, Homo sapiens
uucuggggaaagacacugc

SEQ ID NO: 2024425 - RNA, 17 nt, Homo sapiens
aaauuaguaauguacua

SEQ ID NO: 2024426 - RNA, 22 nt, Homo sapiens
uagcaccggggaacaauuucuc

SEQ ID NO: 2024427 - RNA, 22 nt, Homo sapiens
guccaucucaagugccauauuc

SEQ ID NO: 2024428 - RNA, 14 nt, Homo sapiens
auucuacuagucaa

SEQ ID NO: 2024429 - RNA, 18 nt, Homo sapiens
auuuaguucaacuguaua

SEQ ID NO: 2024430 - RNA, 16 nt, Homo sapiens
gacauagcgagacucc

SEQ ID NO: 2024431 - RNA, 14 nt, Homo sapiens
ccugacaccuuuca

SEQ ID NO: 2024432 - RNA, 23 nt, Homo sapiens
uuagaaagaaaauuauauucugu

SEQ ID NO: 2024433 - RNA, 16 nt, Homo sapiens
ucuuccagcaugcauc

SEQ ID NO: 2024434 - RNA, 23 nt, Homo sapiens
gagaggucucagguucuuuccau

SEQ ID NO: 2024435 - RNA, 14 nt, Homo sapiens
ccaauuucucuuaa

SEQ ID NO: 2024436 - RNA, 20 nt, Homo sapiens
uaucaauguuuguccuguau

SEQ ID NO: 2024437 - RNA, 19 nt, Homo sapiens
uaguuugaggaaauuugca

SEQ ID NO: 2024438 - RNA, 20 nt, Homo sapiens
uuguguccaggauguacaaa

SEQ ID NO: 2024439 - RNA, 21 nt, Homo sapiens
uaacaaaauugacagcuuucu

SEQ ID NO: 2024440 - RNA, 19 nt, Homo sapiens
ucacugagcuccccagauc

SEQ ID NO: 2024441 - RNA, 15 nt, Homo sapiens
aaauaacaaauuaaa

SEQ ID NO: 2024442 - RNA, 15 nt, Homo sapiens
ugaggacauguggaa

SEQ ID NO: 2024443 - RNA, 17 nt, Homo sapiens
cacuuauaccaugagug

SEQ ID NO: 2024444 - RNA, 11 nt, Homo sapiens
ugucuuugaau

SEQ ID NO: 2024445 - RNA, 11 nt, Homo sapiens
aaccuuugugc

SEQ ID NO: 2024446 - RNA, 22 nt, Homo sapiens
agucuaaccugcgucauuucag

SEQ ID NO: 2024447 - RNA, 13 nt, Homo sapiens
gcagcccagagag

SEQ ID NO: 2024448 - RNA, 20 nt, Homo sapiens
ggguccacacggucuucaca

SEQ ID NO: 2024449 - RNA, 23 nt, Homo sapiens
uggaggacagugggaacuggagg

SEQ ID NO: 2024450 - RNA, 13 nt, Homo sapiens
ucaggcacaguaa

SEQ ID NO: 2024451 - RNA, 19 nt, Homo sapiens
aagccgccuagugcagaga

SEQ ID NO: 2024452 - RNA, 14 nt, Homo sapiens
uuccagaaggucac

SEQ ID NO: 2024453 - RNA, 20 nt, Homo sapiens
caggcuuggggagcuuuaag

SEQ ID NO: 2024454 - RNA, 17 nt, Homo sapiens
cuucucauaggugucca

SEQ ID NO: 2024455 - RNA, 20 nt, Homo sapiens
uacucccucuucacuguggc

SEQ ID NO: 2024456 - RNA, 16 nt, Homo sapiens
gacuagauacuacuuu

SEQ ID NO: 2024457 - RNA, 23 nt, Homo sapiens
aaacaugggguuggcugggccca

SEQ ID NO: 2024458 - RNA, 17 nt, Homo sapiens
ccuguccccucagcucc

SEQ ID NO: 2024459 - RNA, 17 nt, Homo sapiens
acaauaugggcacuuua

SEQ ID NO: 2024460 - RNA, 14 nt, Homo sapiens
caaauacacauaca

SEQ ID NO: 2024461 - RNA, 14 nt, Homo sapiens
ugaccccaugucuc

SEQ ID NO: 2024462 - RNA, 14 nt, Homo sapiens
uuacuacauuucca

SEQ ID NO: 2024463 - RNA, 17 nt, Homo sapiens
auuuuugucauauguau

SEQ ID NO: 2024464 - RNA, 21 nt, Homo sapiens
aaguaacugugagaacccagu

SEQ ID NO: 2024465 - RNA, 18 nt, Homo sapiens
uuccaugacgacauacau

SEQ ID NO: 2024466 - RNA, 18 nt, Homo sapiens
uggcagugaccauggcac

SEQ ID NO: 2024467 - RNA, 18 nt, Homo sapiens
uaccaugcaggauuugaa

SEQ ID NO: 2024468 - RNA, 18 nt, Homo sapiens
ugcacgcggacuccgggg

SEQ ID NO: 2024469 - RNA, 13 nt, Homo sapiens
aaaagcaccugcc

SEQ ID NO: 2024470 - RNA, 19 nt, Homo sapiens
caggcugggccauguccaa

SEQ ID NO: 2024471 - RNA, 18 nt, Homo sapiens
caaagucagcagggacca

SEQ ID NO: 2024472 - RNA, 18 nt, Homo sapiens
ggcacgaucucagcucac

SEQ ID NO: 2024473 - RNA, 20 nt, Homo sapiens
acccagaggguggguguuca

SEQ ID NO: 2024474 - RNA, 19 nt, Homo sapiens
gucccgggcacugucaugc

SEQ ID NO: 2024475 - RNA, 22 nt, Homo sapiens
agcacuuuguuucauauucuca

SEQ ID NO: 2024476 - RNA, 11 nt, Homo sapiens
uucugugcaaa

SEQ ID NO: 2024477 - RNA, 16 nt, Homo sapiens
ucccagcugcacuuua

SEQ ID NO: 2024478 - RNA, 20 nt, Homo sapiens
uaugauaaauuugacuguua

SEQ ID NO: 2024479 - RNA, 21 nt, Homo sapiens
acgugaggccccugugcagua

SEQ ID NO: 2024480 - RNA, 14 nt, Homo sapiens
gaaaaucauaggca

SEQ ID NO: 2024481 - RNA, 23 nt, Homo sapiens
auccugauuauugaauguuauau

SEQ ID NO: 2024482 - RNA, 14 nt, Homo sapiens
ugagaagaaugacu

SEQ ID NO: 2024483 - RNA, 18 nt, Homo sapiens
aaucuggcuuagugccac

SEQ ID NO: 2024484 - RNA, 20 nt, Homo sapiens
caggaguggccguugcuaca

SEQ ID NO: 2024485 - RNA, 17 nt, Homo sapiens
uuaaaguuuaaugccua

SEQ ID NO: 2024486 - RNA, 12 nt, Homo sapiens
caguagugcauu

SEQ ID NO: 2024487 - RNA, 12 nt, Homo sapiens
cugaagugcuua

SEQ ID NO: 2024488 - RNA, 13 nt, Homo sapiens
agugaguccaggc

SEQ ID NO: 2024489 - RNA, 21 nt, Homo sapiens
gucccucuggaaagaaacaug

SEQ ID NO: 2024490 - RNA, 20 nt, Homo sapiens
uauuacaguuuaucuauggc

SEQ ID NO: 2024491 - RNA, 14 nt, Homo sapiens
acacccaagaagaa

SEQ ID NO: 2024492 - RNA, 16 nt, Homo sapiens
cuuccccuucuugcca

SEQ ID NO: 2024493 - RNA, 20 nt, Homo sapiens
cuguucuccaggcuucacag

SEQ ID NO: 2024494 - RNA, 11 nt, Homo sapiens
agaaacccaag

SEQ ID NO: 2024495 - RNA, 21 nt, Homo sapiens
aacaggguuugauagcacuua

SEQ ID NO: 2024496 - RNA, 12 nt, Homo sapiens
guguuugggaug

SEQ ID NO: 2024497 - RNA, 15 nt, Homo sapiens
ccuccugaaagccug

SEQ ID NO: 2024498 - RNA, 21 nt, Homo sapiens
augggagagguucugugcaaa

SEQ ID NO: 2024499 - RNA, 17 nt, Homo sapiens
caagcugagugacugua

SEQ ID NO: 2024500 - RNA, 19 nt, Homo sapiens
gggcagaagugaaugccug

SEQ ID NO: 2024501 - RNA, 21 nt, Homo sapiens
aauccauggccuuauuuggaa

SEQ ID NO: 2024502 - RNA, 22 nt, Homo sapiens
gugcuuggaaaauguucugaca

SEQ ID NO: 2024503 - RNA, 17 nt, Homo sapiens
cauugcuuuccacugag

SEQ ID NO: 2024504 - RNA, 18 nt, Homo sapiens
ucauaugugcaguauuua

SEQ ID NO: 2024505 - RNA, 13 nt, Homo sapiens
uaccaauguucua

SEQ ID NO: 2024506 - RNA, 16 nt, Homo sapiens
aacagcaucaauuuuc

SEQ ID NO: 2024507 - RNA, 20 nt, Homo sapiens
cucacugaaaacaucuggaa

SEQ ID NO: 2024508 - RNA, 18 nt, Homo sapiens
auuacugaaaaugauucc

SEQ ID NO: 2024509 - RNA, 17 nt, Homo sapiens
uugucagcaauuuaacu

SEQ ID NO: 2024510 - RNA, 22 nt, Homo sapiens
gcgggauuuaugugcacugccu

SEQ ID NO: 2024511 - RNA, 23 nt, Homo sapiens
uccaggcgugguggcacacaccu

SEQ ID NO: 2024512 - RNA, 23 nt, Homo sapiens
guuuuccagcauguguucuguua

SEQ ID NO: 2024513 - RNA, 15 nt, Homo sapiens
uugcuuggacuaccu

SEQ ID NO: 2024514 - RNA, 19 nt, Homo sapiens
acuuacuaaaucuacucuu

SEQ ID NO: 2024515 - RNA, 23 nt, Homo sapiens
guuguucauugaugggauuuuug

SEQ ID NO: 2024516 - RNA, 22 nt, Homo sapiens
uuaaaggguauacuaagugaua

SEQ ID NO: 2024517 - RNA, 16 nt, Homo sapiens
aagcacggcugugggu

SEQ ID NO: 2024518 - RNA, 19 nt, Homo sapiens
ccuuagagauugccccaga

SEQ ID NO: 2024519 - RNA, 20 nt, Homo sapiens
ccauauaucuuauguuaaag

SEQ ID NO: 2024520 - RNA, 17 nt, Homo sapiens
ugagaaggcucuugcca

SEQ ID NO: 2024521 - RNA, 14 nt, Homo sapiens
guucuggaugcauu

SEQ ID NO: 2024522 - RNA, 15 nt, Homo sapiens
cugagaaacuuccuu

SEQ ID NO: 2024523 - RNA, 13 nt, Homo sapiens
acucuccagacau

SEQ ID NO: 2024524 - RNA, 15 nt, Homo sapiens
cucaguggaucacac

SEQ ID NO: 2024525 - RNA, 14 nt, Homo sapiens
gccuugggccucau

SEQ ID NO: 2024526 - RNA, 16 nt, Homo sapiens
gcucaaaucuauucag

SEQ ID NO: 2024527 - RNA, 18 nt, Homo sapiens
cuuugugccaucacugag

SEQ ID NO: 2024528 - RNA, 20 nt, Homo sapiens
acagcugggcaaagccacaa

SEQ ID NO: 2024529 - RNA, 15 nt, Homo sapiens
acccuuccugccaag

SEQ ID NO: 2024530 - RNA, 12 nt, Homo sapiens
gugccaccauca

SEQ ID NO: 2024531 - RNA, 18 nt, Homo sapiens
aguacuccccuccuugaa

SEQ ID NO: 2024532 - RNA, 18 nt, Homo sapiens
uuagaaucugaguauaaa

SEQ ID NO: 2024533 - RNA, 19 nt, Homo sapiens
aauuuguaauugcuuacau

SEQ ID NO: 2024534 - RNA, 19 nt, Homo sapiens
aucacuagguaacuuauua

SEQ ID NO: 2024535 - RNA, 19 nt, Homo sapiens
guccccuaacccccagucc

SEQ ID NO: 2024536 - RNA, 18 nt, Homo sapiens
ucucauauuuuuacaaau

SEQ ID NO: 2024537 - RNA, 14 nt, Homo sapiens
caggaauacauuug

SEQ ID NO: 2024538 - RNA, 20 nt, Homo sapiens
acuccuuaaaauaaaacacu

SEQ ID NO: 2024539 - RNA, 18 nt, Homo sapiens
gcuuagauuguagcuguu

SEQ ID NO: 2024540 - RNA, 21 nt, Homo sapiens
gacacagauggcaccuguggc

SEQ ID NO: 2024541 - RNA, 14 nt, Homo sapiens
cucacuagcugucu

SEQ ID NO: 2024542 - RNA, 18 nt, Homo sapiens
uauguggcguaucaugca

SEQ ID NO: 2024543 - RNA, 13 nt, Homo sapiens
gccaccaucugga

SEQ ID NO: 2024544 - RNA, 22 nt, Homo sapiens
ugaacuuuuuuuuuuuaagagu

SEQ ID NO: 2024545 - RNA, 19 nt, Homo sapiens
acugcuuguaaaggugcuc

SEQ ID NO: 2024546 - RNA, 17 nt, Homo sapiens
uacaaacacaagcaaaa

SEQ ID NO: 2024547 - RNA, 17 nt, Homo sapiens
aauaaaaacaaaaccac

SEQ ID NO: 2024548 - RNA, 13 nt, Homo sapiens
cggcuguggagau

SEQ ID NO: 2024549 - RNA, 22 nt, Homo sapiens
acaacauuuuucaguuugcaaa

SEQ ID NO: 2024550 - RNA, 15 nt, Homo sapiens
gacagacggaaauga

SEQ ID NO: 2024551 - RNA, 15 nt, Homo sapiens
caaaauaguuuuaaa

SEQ ID NO: 2024552 - RNA, 13 nt, Homo sapiens
cagccuguugccc

SEQ ID NO: 2024553 - RNA, 14 nt, Homo sapiens
uuuugaaaugucaa

SEQ ID NO: 2024554 - RNA, 16 nt, Homo sapiens
aacaagggcagugaga

SEQ ID NO: 2024555 - RNA, 17 nt, Homo sapiens
uauuacuccuugccauu

SEQ ID NO: 2024556 - RNA, 18 nt, Homo sapiens
cuucccagaaucucugag

SEQ ID NO: 2024557 - RNA, 18 nt, Homo sapiens
cugguaaauugccauggc

SEQ ID NO: 2024558 - RNA, 17 nt, Homo sapiens
gaccccuuuaaacuguc

SEQ ID NO: 2024559 - RNA, 17 nt, Homo sapiens
uuuguagccuuccucca

SEQ ID NO: 2024560 - RNA, 15 nt, Homo sapiens
uaaaguauuccaccu

SEQ ID NO: 2024561 - RNA, 19 nt, Homo sapiens
uucugaacuugggaacaca

SEQ ID NO: 2024562 - RNA, 20 nt, Homo sapiens
uuucauaagaauucuguuga

SEQ ID NO: 2024563 - RNA, 18 nt, Homo sapiens
gcauagagaauguguuga

SEQ ID NO: 2024564 - RNA, 19 nt, Homo sapiens
caagguguuuccauuucuc

SEQ ID NO: 2024565 - RNA, 19 nt, Homo sapiens
guccaggccucucucugcu

SEQ ID NO: 2024566 - RNA, 14 nt, Homo sapiens
ucagcagacaagga

SEQ ID NO: 2024567 - RNA, 12 nt, Homo sapiens
gaaacaguucuc

SEQ ID NO: 2024568 - RNA, 12 nt, Homo sapiens
ucuccagugaaa

SEQ ID NO: 2024569 - RNA, 21 nt, Homo sapiens
gaggcucuaauguacaauaaa

SEQ ID NO: 2024570 - RNA, 13 nt, Homo sapiens
ucaggggugcugg

SEQ ID NO: 2024571 - RNA, 15 nt, Homo sapiens
caagaaaucugacaa

SEQ ID NO: 2024572 - RNA, 14 nt, Homo sapiens
agaguguagcugua

SEQ ID NO: 2024573 - RNA, 18 nt, Homo sapiens
aaucucaccccaucccac

SEQ ID NO: 2024574 - RNA, 18 nt, Homo sapiens
aauaccauccugcccauu

SEQ ID NO: 2024575 - RNA, 18 nt, Homo sapiens
gagccaccagcaaagcgc

SEQ ID NO: 2024576 - RNA, 20 nt, Homo sapiens
aaaauauauaauauacuaaa

SEQ ID NO: 2024577 - RNA, 21 nt, Homo sapiens
gagaacacagugcuauuugca

SEQ ID NO: 2024578 - RNA, 18 nt, Homo sapiens
caaggacagccaccaaga

SEQ ID NO: 2024579 - RNA, 20 nt, Homo sapiens
uuccuucuuucucuucccuc

SEQ ID NO: 2024580 - RNA, 21 nt, Homo sapiens
aaaccuuaagaguucuaacca

SEQ ID NO: 2024581 - RNA, 17 nt, Homo sapiens
aaagcaaaacugcaaau

SEQ ID NO: 2024582 - RNA, 20 nt, Homo sapiens
caaaauguucuauuuaacaa

SEQ ID NO: 2024583 - RNA, 16 nt, Homo sapiens
accggcuccacuuucc

SEQ ID NO: 2024584 - RNA, 22 nt, Homo sapiens
gacauggaggugccggaugcag

SEQ ID NO: 2024585 - RNA, 22 nt, Homo sapiens
aaagggugagacuccaucucaa

SEQ ID NO: 2024586 - RNA, 12 nt, Homo sapiens
aacguggcugcu

SEQ ID NO: 2024587 - RNA, 18 nt, Homo sapiens
cacuugacuuugccacau

SEQ ID NO: 2024588 - RNA, 16 nt, Homo sapiens
gaaacagucacuauca

SEQ ID NO: 2024589 - RNA, 22 nt, Homo sapiens
ugucuaauuaaaacacuuucaa

SEQ ID NO: 2024590 - RNA, 17 nt, Homo sapiens
uuacagacaaccuauca

SEQ ID NO: 2024591 - RNA, 21 nt, Homo sapiens
uccuaacguuuucuacuuuga

SEQ ID NO: 2024592 - RNA, 19 nt, Homo sapiens
ugcuggguuuccacacagc

SEQ ID NO: 2024593 - RNA, 20 nt, Homo sapiens
uggcagcuguuucucaugaa

SEQ ID NO: 2024594 - RNA, 22 nt, Homo sapiens
gcaguaaagaagaaagcuuuua

SEQ ID NO: 2024595 - RNA, 19 nt, Homo sapiens
aaaauguuucuacagauau

SEQ ID NO: 2024596 - RNA, 17 nt, Homo sapiens
caauaucaucccugucu

SEQ ID NO: 2024597 - RNA, 16 nt, Homo sapiens
uaaauuugacuguuau

SEQ ID NO: 2024598 - RNA, 18 nt, Homo sapiens
gaagcagaagugcaaucc

SEQ ID NO: 2024599 - RNA, 20 nt, Homo sapiens
ccuucucaggcuggcaucuc

SEQ ID NO: 2024600 - RNA, 20 nt, Homo sapiens
gcagagaaccaaaggggcca

SEQ ID NO: 2024601 - RNA, 14 nt, Homo sapiens
cuuuguaccaucug

SEQ ID NO: 2024602 - RNA, 15 nt, Homo sapiens
gauuuaaaacaucuc

SEQ ID NO: 2024603 - RNA, 17 nt, Homo sapiens
ucaguccaaagggcaug

SEQ ID NO: 2024604 - RNA, 21 nt, Homo sapiens
cuccaccccauuuuacagagg

SEQ ID NO: 2024605 - RNA, 20 nt, Homo sapiens
guaaauuaaguguguguaua

SEQ ID NO: 2024606 - RNA, 23 nt, Homo sapiens
caaacuaccuuccaguuccucau

SEQ ID NO: 2024607 - RNA, 13 nt, Homo sapiens
gaggagccucaga

SEQ ID NO: 2024608 - RNA, 12 nt, Homo sapiens
cucugugccacc

SEQ ID NO: 2024609 - RNA, 12 nt, Homo sapiens
cuuugugccauc

SEQ ID NO: 2024610 - RNA, 19 nt, Homo sapiens
aaaagaggccagcucugca

SEQ ID NO: 2024611 - RNA, 23 nt, Homo sapiens
guccaggacugggucugaccugg

SEQ ID NO: 2024612 - RNA, 14 nt, Homo sapiens
ccaggccugccagc

SEQ ID NO: 2024613 - RNA, 19 nt, Homo sapiens
cuggcaagccugucuucag

SEQ ID NO: 2024614 - RNA, 15 nt, Homo sapiens
ggcacauuccuugcc

SEQ ID NO: 2024615 - RNA, 17 nt, Homo sapiens
agaagccaagcgcucau

SEQ ID NO: 2024616 - RNA, 15 nt, Homo sapiens
uuguuggaugaaauu

SEQ ID NO: 2024617 - RNA, 12 nt, Homo sapiens
cacugucugcug

SEQ ID NO: 2024618 - RNA, 11 nt, Homo sapiens
ccuucagaaaa

SEQ ID NO: 2024619 - RNA, 22 nt, Homo sapiens
uuacauuuucucugaugauguc

SEQ ID NO: 2024620 - RNA, 11 nt, Homo sapiens
caggcucugag

SEQ ID NO: 2024621 - RNA, 11 nt, Homo sapiens
ccugcucugcu

SEQ ID NO: 2024622 - RNA, 11 nt, Homo sapiens
caugcucugau

SEQ ID NO: 2024623 - RNA, 14 nt, Homo sapiens
gugucgggcaugac

SEQ ID NO: 2024624 - RNA, 14 nt, Homo sapiens
cuaacauagauuua

SEQ ID NO: 2024625 - RNA, 14 nt, Homo sapiens
guaacguacauuug

SEQ ID NO: 2024626 - RNA, 21 nt, Homo sapiens
uguagaagacaaaauguucac

SEQ ID NO: 2024627 - RNA, 22 nt, Homo sapiens
auacugcugaguucuggucugu

SEQ ID NO: 2024628 - RNA, 19 nt, Homo sapiens
uguacacuaccaaacacuc

SEQ ID NO: 2024629 - RNA, 14 nt, Homo sapiens
caugagaugaugcc

SEQ ID NO: 2024630 - RNA, 19 nt, Homo sapiens
auuugcaaacuuacuuaau

SEQ ID NO: 2024631 - RNA, 22 nt, Homo sapiens
aucaguccaucccagagggacc

SEQ ID NO: 2024632 - RNA, 15 nt, Homo sapiens
aucuauauuuuacau

SEQ ID NO: 2024633 - RNA, 24 nt, Homo sapiens
auccuuggaaauuggaagagcaca

SEQ ID NO: 2024634 - RNA, 12 nt, Homo sapiens
agugcacagcug

SEQ ID NO: 2024635 - RNA, 19 nt, Homo sapiens
agcaauccucucaccucag

SEQ ID NO: 2024636 - RNA, 14 nt, Homo sapiens
accucaaguucuug

SEQ ID NO: 2024637 - RNA, 16 nt, Homo sapiens
uccagcucaucugcca

SEQ ID NO: 2024638 - RNA, 17 nt, Homo sapiens
ugaugccuccuuggcca

SEQ ID NO: 2024639 - RNA, 17 nt, Homo sapiens
auacucacuuucccaaa

SEQ ID NO: 2024640 - RNA, 22 nt, Homo sapiens
ugucuucagccucuccaggcac

SEQ ID NO: 2024641 - RNA, 20 nt, Homo sapiens
acaccaccacugugucccag

SEQ ID NO: 2024642 - RNA, 18 nt, Homo sapiens
aacaccaagugaggccau

SEQ ID NO: 2024643 - RNA, 18 nt, Homo sapiens
aauccaugggucuggcua

SEQ ID NO: 2024644 - RNA, 23 nt, Homo sapiens
caucucagguuggcggcagacac

SEQ ID NO: 2024645 - RNA, 19 nt, Homo sapiens
cuuuaugaauguguaaugg

SEQ ID NO: 2024646 - RNA, 15 nt, Homo sapiens
accaggaugugcuau

SEQ ID NO: 2024647 - RNA, 16 nt, Homo sapiens
ugggcauuuugacaac

SEQ ID NO: 2024648 - RNA, 17 nt, Homo sapiens
acaaugcaugugcuguc

SEQ ID NO: 2024649 - RNA, 14 nt, Homo sapiens
acuaaucuuauuca

SEQ ID NO: 2024650 - RNA, 21 nt, Homo sapiens
uauaagcaagaaggcaaaaau

SEQ ID NO: 2024651 - RNA, 22 nt, Homo sapiens
accauuaaaaaguuggaguuau

SEQ ID NO: 2024652 - RNA, 21 nt, Homo sapiens
guuaauacgcaggcaucugau

SEQ ID NO: 2024653 - RNA, 20 nt, Homo sapiens
ccacacacaguccaacucuu

SEQ ID NO: 2024654 - RNA, 17 nt, Homo sapiens
cagguaccucuuucagg

SEQ ID NO: 2024655 - RNA, 17 nt, Homo sapiens
ucaccuggcacauucau

SEQ ID NO: 2024656 - RNA, 14 nt, Homo sapiens
cccuauucuaucca

SEQ ID NO: 2024657 - RNA, 13 nt, Homo sapiens
uguacacagaauu

SEQ ID NO: 2024658 - RNA, 23 nt, Homo sapiens
caagugggauuugcauaaaguga

SEQ ID NO: 2024659 - RNA, 13 nt, Homo sapiens
auuccuucacuca

SEQ ID NO: 2024660 - RNA, 18 nt, Homo sapiens
ucaccaaacggugaauau

SEQ ID NO: 2024661 - RNA, 18 nt, Homo sapiens
cugugccucuuagcaugc

SEQ ID NO: 2024662 - RNA, 22 nt, Homo sapiens
cuaauucuggcaggaccucacc

SEQ ID NO: 2024663 - RNA, 12 nt, Homo sapiens
auggccaugcag

SEQ ID NO: 2024664 - RNA, 15 nt, Homo sapiens
aucugcugcaccuug

SEQ ID NO: 2024665 - RNA, 17 nt, Homo sapiens
gaagccucuauugccau

SEQ ID NO: 2024666 - RNA, 21 nt, Homo sapiens
gcuaauugcuggcuggcugcc

SEQ ID NO: 2024667 - RNA, 16 nt, Homo sapiens
ugcuggucacugccau

SEQ ID NO: 2024668 - RNA, 12 nt, Homo sapiens
agaagacuguca

SEQ ID NO: 2024669 - RNA, 12 nt, Homo sapiens
ggcuugggacau

SEQ ID NO: 2024670 - RNA, 22 nt, Homo sapiens
aucuugagccacagucacugga

SEQ ID NO: 2024671 - RNA, 12 nt, Homo sapiens
guaacuccagau

SEQ ID NO: 2024672 - RNA, 19 nt, Homo sapiens
gggucugucaggguuggaa

SEQ ID NO: 2024673 - RNA, 21 nt, Homo sapiens
aaaugucucuuuaaugucaca

SEQ ID NO: 2024674 - RNA, 18 nt, Homo sapiens
gcugcaaacccaugaagc

SEQ ID NO: 2024675 - RNA, 13 nt, Homo sapiens
uugcucuucacca

SEQ ID NO: 2024676 - RNA, 20 nt, Homo sapiens
uagcccucagcccaccuggg

SEQ ID NO: 2024677 - RNA, 14 nt, Homo sapiens
caggaggaggccaa

SEQ ID NO: 2024678 - RNA, 19 nt, Homo sapiens
ucugcuuuagcuuuccaau

SEQ ID NO: 2024679 - RNA, 20 nt, Homo sapiens
auugagugcuccugugugcu

SEQ ID NO: 2024680 - RNA, 15 nt, Homo sapiens
ugagagaaguacaaa

SEQ ID NO: 2024681 - RNA, 18 nt, Homo sapiens
caggagcaggaacagaga

SEQ ID NO: 2024682 - RNA, 18 nt, Homo sapiens
ucaaaacauucauaggca

SEQ ID NO: 2024683 - RNA, 16 nt, Homo sapiens
cugcacccacccagga

SEQ ID NO: 2024684 - RNA, 16 nt, Homo sapiens
gacagugcugcagcuc

SEQ ID NO: 2024685 - RNA, 20 nt, Homo sapiens
uaggaugggagagcuagaaa

SEQ ID NO: 2024686 - RNA, 21 nt, Homo sapiens
agcagaacucuugacuuccug

SEQ ID NO: 2024687 - RNA, 15 nt, Homo sapiens
agaguaaaucccacg

SEQ ID NO: 2024688 - RNA, 12 nt, Homo sapiens
gcccaauuccag

SEQ ID NO: 2024689 - RNA, 18 nt, Homo sapiens
agggcaucgaucuuccuc

SEQ ID NO: 2024690 - RNA, 23 nt, Homo sapiens
agaccugaaagaugggcaaaaga

SEQ ID NO: 2024691 - RNA, 20 nt, Homo sapiens
gccauuaugcaaauggagau

SEQ ID NO: 2024692 - RNA, 22 nt, Homo sapiens
ggagcauagaaggcaggugagc

SEQ ID NO: 2024693 - RNA, 19 nt, Homo sapiens
cauccaccuucacaccacu

SEQ ID NO: 2024694 - RNA, 16 nt, Homo sapiens
accccaggaacaauaa

SEQ ID NO: 2024695 - RNA, 22 nt, Homo sapiens
cauagauuucgaagccacagag

SEQ ID NO: 2024696 - RNA, 14 nt, Homo sapiens
acuuccuugcucuc

SEQ ID NO: 2024697 - RNA, 14 nt, Homo sapiens
cccuaggacaggag

SEQ ID NO: 2024698 - RNA, 10 nt, Homo sapiens
uccuaccugg

SEQ ID NO: 2024699 - RNA, 16 nt, Homo sapiens
ucucuguuuacccucc

SEQ ID NO: 2024700 - RNA, 20 nt, Homo sapiens
ugugccauggaugauucuuu

SEQ ID NO: 2024701 - RNA, 15 nt, Homo sapiens
aauagcgugagcuaa

SEQ ID NO: 2024702 - RNA, 15 nt, Homo sapiens
augguuuacugcugu

SEQ ID NO: 2024703 - RNA, 15 nt, Homo sapiens
ccucuggacacagcc

SEQ ID NO: 2024704 - RNA, 19 nt, Homo sapiens
uggaagcaguuucagagaa

SEQ ID NO: 2024705 - RNA, 21 nt, Homo sapiens
cgcugcccagagccuggggau

SEQ ID NO: 2024706 - RNA, 18 nt, Homo sapiens
acgcagccugcagacuca

SEQ ID NO: 2024707 - RNA, 20 nt, Homo sapiens
caucaggaguuccagugcug

SEQ ID NO: 2024708 - RNA, 19 nt, Homo sapiens
guuuccuauguuucacugu

SEQ ID NO: 2024709 - RNA, 15 nt, Homo sapiens
caggcccgcgggcac

SEQ ID NO: 2024710 - RNA, 15 nt, Homo sapiens
gguuaaaucaaagau

SEQ ID NO: 2024711 - RNA, 14 nt, Homo sapiens
uccaccacaucugc

SEQ ID NO: 2024712 - RNA, 17 nt, Homo sapiens
uucuacugaacagucca

SEQ ID NO: 2024713 - RNA, 14 nt, Homo sapiens
uaaaucacaggcau

SEQ ID NO: 2024714 - RNA, 23 nt, Homo sapiens
agccaaaggauaaguguccccua

SEQ ID NO: 2024715 - RNA, 20 nt, Homo sapiens
cuugcucugagcacagguga

SEQ ID NO: 2024716 - RNA, 13 nt, Homo sapiens
ccugagagucagg

SEQ ID NO: 2024717 - RNA, 19 nt, Homo sapiens
auaaggggaagacuuuaaa

SEQ ID NO: 2024718 - RNA, 21 nt, Homo sapiens
uuccugacagaugccugguga

SEQ ID NO: 2024719 - RNA, 15 nt, Homo sapiens
auguuccugcuguau

SEQ ID NO: 2024720 - RNA, 23 nt, Homo sapiens
acucuacuucagucaauagccau

SEQ ID NO: 2024721 - RNA, 15 nt, Homo sapiens
gccugagggcaguac

SEQ ID NO: 2024722 - RNA, 20 nt, Homo sapiens
ucauguccccaaaccugcaa

SEQ ID NO: 2024723 - RNA, 19 nt, Homo sapiens
aucuuggagaaugugagaa

SEQ ID NO: 2024724 - RNA, 12 nt, Homo sapiens
cccaugugaaaa

SEQ ID NO: 2024725 - RNA, 12 nt, Homo sapiens
uaucuacuuuag

SEQ ID NO: 2024726 - RNA, 21 nt, Homo sapiens
uggcugaccugggcccacaga

SEQ ID NO: 2024727 - RNA, 16 nt, Homo sapiens
gcaugaggaucaguuu

SEQ ID NO: 2024728 - RNA, 19 nt, Homo sapiens
acuccucucgcauggugug

SEQ ID NO: 2024729 - RNA, 22 nt, Homo sapiens
gugccauggccccccacucccc

SEQ ID NO: 2024730 - RNA, 20 nt, Homo sapiens
cuggagaagaauggcuuuca

SEQ ID NO: 2024731 - RNA, 14 nt, Homo sapiens
uguaauucagguac

SEQ ID NO: 2024732 - RNA, 18 nt, Homo sapiens
gacggauguaaggugcac

SEQ ID NO: 2024733 - RNA, 21 nt, Homo sapiens
acuacuuuaauaaagaauuaa

SEQ ID NO: 2024734 - RNA, 22 nt, Homo sapiens
cugaggcgcugcuuugucaaaa

SEQ ID NO: 2024735 - RNA, 16 nt, Homo sapiens
uggguaacugucaagu

SEQ ID NO: 2024736 - RNA, 18 nt, Homo sapiens
ccccaugaccuccagcuu

SEQ ID NO: 2024737 - RNA, 17 nt, Homo sapiens
ggacaaggcuagaucau

SEQ ID NO: 2024738 - RNA, 14 nt, Homo sapiens
auucaauccuacuu

SEQ ID NO: 2024739 - RNA, 12 nt, Homo sapiens
acacaggcaaag

SEQ ID NO: 2024740 - RNA, 13 nt, Homo sapiens
cuucuaagccaaa

SEQ ID NO: 2024741 - RNA, 19 nt, Homo sapiens
acuuuaauucuuuucccag

SEQ ID NO: 2024742 - RNA, 15 nt, Homo sapiens
cugaauucuuuucaa

SEQ ID NO: 2024743 - RNA, 13 nt, Homo sapiens
ggaauaugcauug

SEQ ID NO: 2024744 - RNA, 14 nt, Homo sapiens
gugccuuaucaaau

SEQ ID NO: 2024745 - RNA, 19 nt, Homo sapiens
uagcaugaguuuaaaucaa

SEQ ID NO: 2024746 - RNA, 18 nt, Homo sapiens
gcaaauauuauccagcaa

SEQ ID NO: 2024747 - RNA, 10 nt, Homo sapiens
aaauguguac

SEQ ID NO: 2024748 - RNA, 19 nt, Homo sapiens
uccuacagcacuacugggu

SEQ ID NO: 2024749 - RNA, 16 nt, Homo sapiens
uuccuguguucucuua

SEQ ID NO: 2024750 - RNA, 17 nt, Homo sapiens
cagcacccccuucucug

SEQ ID NO: 2024751 - RNA, 19 nt, Homo sapiens
agauguuauacaaccauca

SEQ ID NO: 2024752 - RNA, 18 nt, Homo sapiens
uuccaauacuucauuaau

SEQ ID NO: 2024753 - RNA, 23 nt, Homo sapiens
uggaccagaaugaaaacuguaaa

SEQ ID NO: 2024754 - RNA, 21 nt, Homo sapiens
ugugaacagcuugcugucacu

SEQ ID NO: 2024755 - RNA, 23 nt, Homo sapiens
cugagugacugcagcuugccaaa

SEQ ID NO: 2024756 - RNA, 19 nt, Homo sapiens
cauaacuuauugcugauuu

SEQ ID NO: 2024757 - RNA, 22 nt, Homo sapiens
uguucccuccccgaucaucuuu

SEQ ID NO: 2024758 - RNA, 22 nt, Homo sapiens
ugauuuucaaaaccagcuccca

SEQ ID NO: 2024759 - RNA, 16 nt, Homo sapiens
acuccucccugaugua

SEQ ID NO: 2024760 - RNA, 20 nt, Homo sapiens
gccacuguccggaaauucau

SEQ ID NO: 2024761 - RNA, 13 nt, Homo sapiens
agaacuccugacu

SEQ ID NO: 2024762 - RNA, 17 nt, Homo sapiens
ggagguagcucccagca

SEQ ID NO: 2024763 - RNA, 17 nt, Homo sapiens
uaauuuauaugcaugca

SEQ ID NO: 2024764 - RNA, 15 nt, Homo sapiens
ccucuuuacucuggg

SEQ ID NO: 2024765 - RNA, 21 nt, Homo sapiens
aaugugcuauuugcaaacuua

SEQ ID NO: 2024766 - RNA, 17 nt, Homo sapiens
uccacaagaacaauuca

SEQ ID NO: 2024767 - RNA, 16 nt, Homo sapiens
augacuugccauuaaa

SEQ ID NO: 2024768 - RNA, 18 nt, Homo sapiens
accuaucaguauggugcu

SEQ ID NO: 2024769 - RNA, 19 nt, Homo sapiens
ccagugaaaauugaugcua

SEQ ID NO: 2024770 - RNA, 19 nt, Homo sapiens
guuaaaauguuuacuguaa

SEQ ID NO: 2024771 - RNA, 16 nt, Homo sapiens
caagugcucuuuccac

SEQ ID NO: 2024772 - RNA, 14 nt, Homo sapiens
gagagaaaucugaa

SEQ ID NO: 2024773 - RNA, 13 nt, Homo sapiens
auccaacuccagc

SEQ ID NO: 2024774 - RNA, 18 nt, Homo sapiens
ugagcgggaggcagaguu

SEQ ID NO: 2024775 - RNA, 20 nt, Homo sapiens
cccuaauuagggcauccugc

SEQ ID NO: 2024776 - RNA, 15 nt, Homo sapiens
ccuucccaauccagu

SEQ ID NO: 2024777 - RNA, 22 nt, Homo sapiens
gcgcgagccaugauguggagug

SEQ ID NO: 2024778 - RNA, 14 nt, Homo sapiens
gguccugaggccaa

SEQ ID NO: 2024779 - RNA, 13 nt, Homo sapiens
cauucagugacau

SEQ ID NO: 2024780 - RNA, 13 nt, Homo sapiens
gauucagucacau

SEQ ID NO: 2024781 - RNA, 20 nt, Homo sapiens
gcaaccuccaccuccugggu

SEQ ID NO: 2024782 - RNA, 22 nt, Homo sapiens
aggagacaguuuaccauccuca

SEQ ID NO: 2024783 - RNA, 23 nt, Homo sapiens
agcccuugggcacugcacccugu

SEQ ID NO: 2024784 - RNA, 20 nt, Homo sapiens
acuguuuuauuaugauucau

SEQ ID NO: 2024785 - RNA, 20 nt, Homo sapiens
acucacaagaagaccagacu

SEQ ID NO: 2024786 - RNA, 15 nt, Homo sapiens
ccaaauagcagcaca

SEQ ID NO: 2024787 - RNA, 22 nt, Homo sapiens
uuucauuuggaaugaauacagc

SEQ ID NO: 2024788 - RNA, 21 nt, Homo sapiens
ucaagucauuccacacauuuc

SEQ ID NO: 2024789 - RNA, 23 nt, Homo sapiens
aauucaucuuucuaacucaagga

SEQ ID NO: 2024790 - RNA, 14 nt, Homo sapiens
cuuuacauaagaaa

SEQ ID NO: 2024791 - RNA, 14 nt, Homo sapiens
ucaauuugaaauca

SEQ ID NO: 2024792 - RNA, 18 nt, Homo sapiens
aguauuggaagacuuggg

SEQ ID NO: 2024793 - RNA, 11 nt, Homo sapiens
gucucuagcca

SEQ ID NO: 2024794 - RNA, 16 nt, Homo sapiens
caaaaauguaugccac

SEQ ID NO: 2024795 - RNA, 16 nt, Homo sapiens
uaaaaucuuacuuugu

SEQ ID NO: 2024796 - RNA, 14 nt, Homo sapiens
ggaaagaugcauuu

SEQ ID NO: 2024797 - RNA, 19 nt, Homo sapiens
auuuuuaguuuaaaaaccu

SEQ ID NO: 2024798 - RNA, 10 nt, Homo sapiens
acaugccagu

SEQ ID NO: 2024799 - RNA, 18 nt, Homo sapiens
cacccaccuaugugccaa

SEQ ID NO: 2024800 - RNA, 19 nt, Homo sapiens
caaacuguauacauuacaa

SEQ ID NO: 2024801 - RNA, 21 nt, Homo sapiens
cuuauuuaacaagcaagcaaa

SEQ ID NO: 2024802 - RNA, 22 nt, Homo sapiens
accugccccccacucugcacag

SEQ ID NO: 2024803 - RNA, 15 nt, Homo sapiens
aucacuuuaauuuag

SEQ ID NO: 2024804 - RNA, 22 nt, Homo sapiens
ugcugaaggagggucaccgcau

SEQ ID NO: 2024805 - RNA, 21 nt, Homo sapiens
cugugucucaggugugcccug

SEQ ID NO: 2024806 - RNA, 16 nt, Homo sapiens
aucugugaacauguua

SEQ ID NO: 2024807 - RNA, 17 nt, Homo sapiens
acgauugacaccaaaau

SEQ ID NO: 2024808 - RNA, 13 nt, Homo sapiens
auaguuacugugu

SEQ ID NO: 2024809 - RNA, 12 nt, Homo sapiens
ucaaggcacugc

SEQ ID NO: 2024810 - RNA, 22 nt, Homo sapiens
uauaugcaucuuuguugcuuau

SEQ ID NO: 2024811 - RNA, 15 nt, Homo sapiens
auggcccuaccagac

SEQ ID NO: 2024812 - RNA, 17 nt, Homo sapiens
gacaugaaauacuuuaa

SEQ ID NO: 2024813 - RNA, 20 nt, Homo sapiens
auaaagacaaucacugccaa

SEQ ID NO: 2024814 - RNA, 16 nt, Homo sapiens
auggucauuugggaaa

SEQ ID NO: 2024815 - RNA, 14 nt, Homo sapiens
aguuauuggaucag

SEQ ID NO: 2024816 - RNA, 13 nt, Homo sapiens
aacggcaagggaa

SEQ ID NO: 2024817 - RNA, 18 nt, Homo sapiens
ccuccagagaaacccagg

SEQ ID NO: 2024818 - RNA, 23 nt, Homo sapiens
ggagcagcuucugggaccauaag

SEQ ID NO: 2024819 - RNA, 16 nt, Homo sapiens
cgggauccagcucauc

SEQ ID NO: 2024820 - RNA, 18 nt, Homo sapiens
cagccgaggucccugcug

SEQ ID NO: 2024821 - RNA, 23 nt, Homo sapiens
gauucccugauggaaccauaaua

SEQ ID NO: 2024822 - RNA, 13 nt, Homo sapiens
uucuggacaggau

SEQ ID NO: 2024823 - RNA, 19 nt, Homo sapiens
cccguggccuggcaucugu

SEQ ID NO: 2024824 - RNA, 16 nt, Homo sapiens
cgucccauaccuuguu

SEQ ID NO: 2024825 - RNA, 16 nt, Homo sapiens
ucuacauacuauggaa

SEQ ID NO: 2024826 - RNA, 22 nt, Homo sapiens
cauucuccguugucauugacuu

SEQ ID NO: 2024827 - RNA, 16 nt, Homo sapiens
uuucuaggacugaauu

SEQ ID NO: 2024828 - RNA, 19 nt, Homo sapiens
ccuccaugaauaucaguua

SEQ ID NO: 2024829 - RNA, 19 nt, Homo sapiens
cagacgucucaagacugaa

SEQ ID NO: 2024830 - RNA, 15 nt, Homo sapiens
gcaucauaauggacu

SEQ ID NO: 2024831 - RNA, 14 nt, Homo sapiens
ccucauacacagaa

SEQ ID NO: 2024832 - RNA, 12 nt, Homo sapiens
uuaaauauauca

SEQ ID NO: 2024833 - RNA, 20 nt, Homo sapiens
ugccaauagugucauccuca

SEQ ID NO: 2024834 - RNA, 14 nt, Homo sapiens
auaggucacuccug

SEQ ID NO: 2024835 - RNA, 15 nt, Homo sapiens
ggcauuucacaaaac

SEQ ID NO: 2024836 - RNA, 20 nt, Homo sapiens
cuccagaguagcugggacua

SEQ ID NO: 2024837 - RNA, 13 nt, Homo sapiens
agagagccuuaac

SEQ ID NO: 2024838 - RNA, 14 nt, Homo sapiens
cagaccgggguucc

SEQ ID NO: 2024839 - RNA, 17 nt, Homo sapiens
caggucucugugggugg

SEQ ID NO: 2024840 - RNA, 23 nt, Homo sapiens
ugcacaugggauugcuaaaacag

SEQ ID NO: 2024841 - RNA, 12 nt, Homo sapiens
cccccacugagc

SEQ ID NO: 2024842 - RNA, 12 nt, Homo sapiens
gagacacuccca

SEQ ID NO: 2024843 - RNA, 20 nt, Homo sapiens
caccauggauuucagaggag

SEQ ID NO: 2024844 - RNA, 15 nt, Homo sapiens
ucaguccucuuuccu

SEQ ID NO: 2024845 - RNA, 14 nt, Homo sapiens
uauuagacaugaaa

SEQ ID NO: 2024846 - RNA, 22 nt, Homo sapiens
cagagaagcauccuccacaucc

SEQ ID NO: 2024847 - RNA, 18 nt, Homo sapiens
uagccagaauucuacccu

SEQ ID NO: 2024848 - RNA, 12 nt, Homo sapiens
caggcagacuac

SEQ ID NO: 2024849 - RNA, 23 nt, Homo sapiens
ugaugagucgguccucuuuccag

SEQ ID NO: 2024850 - RNA, 16 nt, Homo sapiens
gcccagagacccagcg

SEQ ID NO: 2024851 - RNA, 22 nt, Homo sapiens
aggaugagggaauccugucacc

SEQ ID NO: 2024852 - RNA, 20 nt, Homo sapiens
aguagaugcaucuaagcagg

SEQ ID NO: 2024853 - RNA, 18 nt, Homo sapiens
uggcaaauaaaagcauuu

SEQ ID NO: 2024854 - RNA, 15 nt, Homo sapiens
uauaacgcagucuaa

SEQ ID NO: 2024855 - RNA, 18 nt, Homo sapiens
gucgaagcaaucagcaaa

SEQ ID NO: 2024856 - RNA, 22 nt, Homo sapiens
ggaaggugcuugccugggacca

SEQ ID NO: 2024857 - RNA, 18 nt, Homo sapiens
uccaggaaccacaccaca

SEQ ID NO: 2024858 - RNA, 13 nt, Homo sapiens
auguggugcuuuu

SEQ ID NO: 2024859 - RNA, 15 nt, Homo sapiens
gaaaucgaugagaaa

SEQ ID NO: 2024860 - RNA, 13 nt, Homo sapiens
aguaacaggcuca

SEQ ID NO: 2024861 - RNA, 18 nt, Homo sapiens
ucacucccuaggcccaag

SEQ ID NO: 2024862 - RNA, 16 nt, Homo sapiens
cagacuaugcagcuca

SEQ ID NO: 2024863 - RNA, 23 nt, Homo sapiens
uccuuaaaaaauaaaguacgugu

SEQ ID NO: 2024864 - RNA, 13 nt, Homo sapiens
acucuacaauucc

SEQ ID NO: 2024865 - RNA, 13 nt, Homo sapiens
ucccuacauuccc

SEQ ID NO: 2024866 - RNA, 18 nt, Homo sapiens
gucguuuuuuucauucca

SEQ ID NO: 2024867 - RNA, 17 nt, Homo sapiens
acagagaucucagaggu

SEQ ID NO: 2024868 - RNA, 22 nt, Homo sapiens
cucgugcccaucaagugcaguc

SEQ ID NO: 2024869 - RNA, 16 nt, Homo sapiens
auaguauuccauggug

SEQ ID NO: 2024870 - RNA, 18 nt, Homo sapiens
gagccuggaacugacccu

SEQ ID NO: 2024871 - RNA, 23 nt, Homo sapiens
acuuucccagaaaaaaaaaaacu

SEQ ID NO: 2024872 - RNA, 11 nt, Homo sapiens
ugcgagcugcc

SEQ ID NO: 2024873 - RNA, 15 nt, Homo sapiens
gucuucaccaaguga

SEQ ID NO: 2024874 - RNA, 14 nt, Homo sapiens
ccuaacucaugcca

SEQ ID NO: 2024875 - RNA, 21 nt, Homo sapiens
uuccacucagcaucagcgugg

SEQ ID NO: 2024876 - RNA, 15 nt, Homo sapiens
uguaacuuccugcug

SEQ ID NO: 2024877 - RNA, 18 nt, Homo sapiens
cgcggugcugacugaggc

SEQ ID NO: 2024878 - RNA, 20 nt, Homo sapiens
uguacauaguggucauuugg

SEQ ID NO: 2024879 - RNA, 22 nt, Homo sapiens
cugcacugaugcugccccucau

SEQ ID NO: 2024880 - RNA, 15 nt, Homo sapiens
ggaaguaccaagaac

SEQ ID NO: 2024881 - RNA, 23 nt, Homo sapiens
acagagauuugguuaagcucaca

SEQ ID NO: 2024882 - RNA, 14 nt, Homo sapiens
agccaguucugaca

SEQ ID NO: 2024883 - RNA, 18 nt, Homo sapiens
aacccucagaaacacugg

SEQ ID NO: 2024884 - RNA, 19 nt, Homo sapiens
cuaaucaguuguaacaaua

SEQ ID NO: 2024885 - RNA, 18 nt, Homo sapiens
uaagaacaccugcauucu

SEQ ID NO: 2024886 - RNA, 16 nt, Homo sapiens
guaacccugucuggau

SEQ ID NO: 2024887 - RNA, 19 nt, Homo sapiens
cauucccauggaguugcca

SEQ ID NO: 2024888 - RNA, 15 nt, Homo sapiens
cacaagaauugaaua

SEQ ID NO: 2024889 - RNA, 12 nt, Homo sapiens
gccacagcagcu

SEQ ID NO: 2024890 - RNA, 16 nt, Homo sapiens
gaauuuacaguuccuu

SEQ ID NO: 2024891 - RNA, 22 nt, Homo sapiens
gaaaaaauacucaacauuauua

SEQ ID NO: 2024892 - RNA, 16 nt, Homo sapiens
ucucaccuacuccaga

SEQ ID NO: 2024893 - RNA, 22 nt, Homo sapiens
acuuaccacucgugcaucccug

SEQ ID NO: 2024894 - RNA, 19 nt, Homo sapiens
ugaguugcccaucuuguuu

SEQ ID NO: 2024895 - RNA, 12 nt, Homo sapiens
aagccugagucc

SEQ ID NO: 2024896 - RNA, 22 nt, Homo sapiens
uggcauucauauuucauauuca

SEQ ID NO: 2024897 - RNA, 23 nt, Homo sapiens
ugagaugaaggaaggacuaugac

SEQ ID NO: 2024898 - RNA, 17 nt, Homo sapiens
cugggacuacaggugug

SEQ ID NO: 2024899 - RNA, 14 nt, Homo sapiens
aucaauggugcaaa

SEQ ID NO: 2024900 - RNA, 20 nt, Homo sapiens
cuggaaacagcaguguauau

SEQ ID NO: 2024901 - RNA, 14 nt, Homo sapiens
aauggaaagcuuuu

SEQ ID NO: 2024902 - RNA, 18 nt, Homo sapiens
cuagauaauaaaauugcu

SEQ ID NO: 2024903 - RNA, 14 nt, Homo sapiens
gagaauguguguag

SEQ ID NO: 2024904 - RNA, 23 nt, Homo sapiens
agcucguaauuuuuuaacuguaa

SEQ ID NO: 2024905 - RNA, 14 nt, Homo sapiens
cuguaaucccagcu

SEQ ID NO: 2024906 - RNA, 18 nt, Homo sapiens
cuugaaaguuuucuaaac

SEQ ID NO: 2024907 - RNA, 21 nt, Homo sapiens
auaaucuccuuuuaugcucac

SEQ ID NO: 2024908 - RNA, 23 nt, Homo sapiens
cuauucaggcuguuguuggcuua

SEQ ID NO: 2024909 - RNA, 21 nt, Homo sapiens
uuaauaugccuguuauuccua

SEQ ID NO: 2024910 - RNA, 17 nt, Homo sapiens
ggagugagaucuuacag

SEQ ID NO: 2024911 - RNA, 13 nt, Homo sapiens
aagauaaauuuca

SEQ ID NO: 2024912 - RNA, 17 nt, Homo sapiens
gccugaaagcaacagcu

SEQ ID NO: 2024913 - RNA, 21 nt, Homo sapiens
aaucucaucccaacaaacuuu

SEQ ID NO: 2024914 - RNA, 15 nt, Homo sapiens
uagaguaacaguaaa

SEQ ID NO: 2024915 - RNA, 22 nt, Homo sapiens
cuucaucaauuuuuauacauau

SEQ ID NO: 2024916 - RNA, 19 nt, Homo sapiens
uccagauccagacuguaag

SEQ ID NO: 2024917 - RNA, 23 nt, Homo sapiens
ugcacaaggaaauaaagcguccu

SEQ ID NO: 2024918 - RNA, 16 nt, Homo sapiens
cuuaaguuuaccaaau

SEQ ID NO: 2024919 - RNA, 11 nt, Homo sapiens
guauacaguau

SEQ ID NO: 2024920 - RNA, 14 nt, Homo sapiens
gaaaaaacuuugac

SEQ ID NO: 2024921 - RNA, 15 nt, Homo sapiens
gcugaaaaaacaccu

SEQ ID NO: 2024922 - RNA, 16 nt, Homo sapiens
caacucuccaauguuc

SEQ ID NO: 2024923 - RNA, 16 nt, Homo sapiens
uuccucccuucugucc

SEQ ID NO: 2024924 - RNA, 16 nt, Homo sapiens
ccucuuccccuugccc

SEQ ID NO: 2024925 - RNA, 21 nt, Homo sapiens
gagaccacacugcacacagug

SEQ ID NO: 2024926 - RNA, 13 nt, Homo sapiens
acugugucugucc

SEQ ID NO: 2024927 - RNA, 14 nt, Homo sapiens
uccccggaguaccu

SEQ ID NO: 2024928 - RNA, 19 nt, Homo sapiens
auaaagcaaaaguagccau

SEQ ID NO: 2024929 - RNA, 16 nt, Homo sapiens
uauuuccaaaagcaca

SEQ ID NO: 2024930 - RNA, 15 nt, Homo sapiens
cuauuccauauuaaa

SEQ ID NO: 2024931 - RNA, 15 nt, Homo sapiens
uguugacugcugcuc

SEQ ID NO: 2024932 - RNA, 20 nt, Homo sapiens
ugaacaggccgcacaucuca

SEQ ID NO: 2024933 - RNA, 17 nt, Homo sapiens
cacuuugggaggccaag

SEQ ID NO: 2024934 - RNA, 22 nt, Homo sapiens
cucaggacagaacaguguuuaa

SEQ ID NO: 2024935 - RNA, 11 nt, Homo sapiens
ggagugccaca

SEQ ID NO: 2024936 - RNA, 18 nt, Homo sapiens
ugugaucuauaccaccuu

SEQ ID NO: 2024937 - RNA, 18 nt, Homo sapiens
uccuaagcuggagugcag

SEQ ID NO: 2024938 - RNA, 12 nt, Homo sapiens
aacauggccuuu

SEQ ID NO: 2024939 - RNA, 14 nt, Homo sapiens
ucucucuucuccac

SEQ ID NO: 2024940 - RNA, 13 nt, Homo sapiens
aaugucagauaau

SEQ ID NO: 2024941 - RNA, 16 nt, Homo sapiens
aggugggcaugccacc

SEQ ID NO: 2024942 - RNA, 18 nt, Homo sapiens
aauuaaaauggaugccuu

SEQ ID NO: 2024943 - RNA, 18 nt, Homo sapiens
ucuaguuggcaagucuca

SEQ ID NO: 2024944 - RNA, 12 nt, Homo sapiens
guucagccuuug

SEQ ID NO: 2024945 - RNA, 18 nt, Homo sapiens
caggcugaaaacaaugga

SEQ ID NO: 2024946 - RNA, 14 nt, Homo sapiens
ccaggaccaugcag

SEQ ID NO: 2024947 - RNA, 15 nt, Homo sapiens
uauaaagucuaagca

SEQ ID NO: 2024948 - RNA, 19 nt, Homo sapiens
uuucucucuguguggcaaa

SEQ ID NO: 2024949 - RNA, 15 nt, Homo sapiens
cucuuacaaccaaga

SEQ ID NO: 2024950 - RNA, 19 nt, Homo sapiens
cuuggaucccaggggcuua

SEQ ID NO: 2024951 - RNA, 17 nt, Homo sapiens
cucuggagaguaaucug

SEQ ID NO: 2024952 - RNA, 21 nt, Homo sapiens
uucuaaugauggcccauucua

SEQ ID NO: 2024953 - RNA, 16 nt, Homo sapiens
auaaagagacugagcc

SEQ ID NO: 2024954 - RNA, 21 nt, Homo sapiens
aaauaaggauaauaaucauuc

SEQ ID NO: 2024955 - RNA, 16 nt, Homo sapiens
acacugaccuguguuc

SEQ ID NO: 2024956 - RNA, 17 nt, Homo sapiens
agccuagccaccuccca

SEQ ID NO: 2024957 - RNA, 22 nt, Homo sapiens
uuccugcgcauggugcagugcc

SEQ ID NO: 2024958 - RNA, 12 nt, Homo sapiens
aacuguguaaaa

SEQ ID NO: 2024959 - RNA, 15 nt, Homo sapiens
ugcccagggcucagc

SEQ ID NO: 2024960 - RNA, 18 nt, Homo sapiens
aaugcccugaaacuacug

SEQ ID NO: 2024961 - RNA, 23 nt, Homo sapiens
gguuuuucccaccaauccucacc

SEQ ID NO: 2024962 - RNA, 11 nt, Homo sapiens
guuguguuccu

SEQ ID NO: 2024963 - RNA, 19 nt, Homo sapiens
aaaugaaacaaauaaucac

SEQ ID NO: 2024964 - RNA, 14 nt, Homo sapiens
aaagauguacugag

SEQ ID NO: 2024965 - RNA, 22 nt, Homo sapiens
acugggaggccgggcauggugg

SEQ ID NO: 2024966 - RNA, 14 nt, Homo sapiens
aagggccacuggga

SEQ ID NO: 2024967 - RNA, 14 nt, Homo sapiens
aauaaccacuuaaa

SEQ ID NO: 2024968 - RNA, 21 nt, Homo sapiens
aucaaguuugaccagugcagu

SEQ ID NO: 2024969 - RNA, 16 nt, Homo sapiens
cggguaccaugcugcc

SEQ ID NO: 2024970 - RNA, 18 nt, Homo sapiens
ugccuugguaaaaacugc

SEQ ID NO: 2024971 - RNA, 20 nt, Homo sapiens
guuuugaaggcaaaauugca

SEQ ID NO: 2024972 - RNA, 23 nt, Homo sapiens
aaagguuucuauuuucucugaua

SEQ ID NO: 2024973 - RNA, 14 nt, Homo sapiens
uguaaauaugcaaa

SEQ ID NO: 2024974 - RNA, 14 nt, Homo sapiens
cacauguacauaug

SEQ ID NO: 2024975 - RNA, 14 nt, Homo sapiens
cacauauacauaua

SEQ ID NO: 2024976 - RNA, 17 nt, Homo sapiens
cuugauaauacuugacc

SEQ ID NO: 2024977 - RNA, 21 nt, Homo sapiens
uuuaaaauaaaugaagugaga

SEQ ID NO: 2024978 - RNA, 13 nt, Homo sapiens
aaaaacugaacua

SEQ ID NO: 2024979 - RNA, 22 nt, Homo sapiens
aagguggauuuucaucaggggc

SEQ ID NO: 2024980 - RNA, 22 nt, Homo sapiens
cugucacccauauggucccugg

SEQ ID NO: 2024981 - RNA, 16 nt, Homo sapiens
auucaaggaugcacag

SEQ ID NO: 2024982 - RNA, 23 nt, Homo sapiens
caaagauuauuccugguaaagga

SEQ ID NO: 2024983 - RNA, 12 nt, Homo sapiens
aguauauguaac

SEQ ID NO: 2024984 - RNA, 17 nt, Homo sapiens
ugcgcugggcacuuccc

SEQ ID NO: 2024985 - RNA, 17 nt, Homo sapiens
auccccuuggcugugag

SEQ ID NO: 2024986 - RNA, 18 nt, Homo sapiens
gccacaucacuacaguac

SEQ ID NO: 2024987 - RNA, 14 nt, Homo sapiens
cauuuguguggaaa

SEQ ID NO: 2024988 - RNA, 23 nt, Homo sapiens
cauugaugccaagcuuuuuugcc

SEQ ID NO: 2024989 - RNA, 12 nt, Homo sapiens
ccucauggaauu

SEQ ID NO: 2024990 - RNA, 16 nt, Homo sapiens
cuccucacgcaacuca

SEQ ID NO: 2024991 - RNA, 23 nt, Homo sapiens
gcugaaccccaccucccucccac

SEQ ID NO: 2024992 - RNA, 23 nt, Homo sapiens
ccccuuauccaggacucugucaa

SEQ ID NO: 2024993 - RNA, 23 nt, Homo sapiens
ccuuccuccccagucuacguucu

SEQ ID NO: 2024994 - RNA, 14 nt, Homo sapiens
augaggggccucag

SEQ ID NO: 2024995 - RNA, 18 nt, Homo sapiens
auuccaaggccugugaau

SEQ ID NO: 2024996 - RNA, 14 nt, Homo sapiens
cacgcuggcuucca

SEQ ID NO: 2024997 - RNA, 15 nt, Homo sapiens
gucacuccucucuag

SEQ ID NO: 2024998 - RNA, 17 nt, Homo sapiens
gagagauucaugcugau

SEQ ID NO: 2024999 - RNA, 14 nt, Homo sapiens
ccgggcuggagaaa

SEQ ID NO: 2025000 - RNA, 17 nt, Homo sapiens
gggcaauggaaauacca

SEQ ID NO: 2025001 - RNA, 13 nt, Homo sapiens
caaugucacuuaa

SEQ ID NO: 2025002 - RNA, 15 nt, Homo sapiens
cuuauccuccaugaa

SEQ ID NO: 2025003 - RNA, 18 nt, Homo sapiens
ccauucucagguggugau

SEQ ID NO: 2025004 - RNA, 13 nt, Homo sapiens
aacgucuccuagc

SEQ ID NO: 2025005 - RNA, 13 nt, Homo sapiens
aaugcuuccaagc

SEQ ID NO: 2025006 - RNA, 17 nt, Homo sapiens
uggcccccacagaaaga

SEQ ID NO: 2025007 - RNA, 14 nt, Homo sapiens
cacuguuaagccau

SEQ ID NO: 2025008 - RNA, 15 nt, Homo sapiens
auuuugauuucuuaa

SEQ ID NO: 2025009 - RNA, 17 nt, Homo sapiens
cuccuuugcuagugucu

SEQ ID NO: 2025010 - RNA, 19 nt, Homo sapiens
auacuauucuuuaauugca

SEQ ID NO: 2025011 - RNA, 12 nt, Homo sapiens
uagagugcacau

SEQ ID NO: 2025012 - RNA, 21 nt, Homo sapiens
ucucagccccuuuaaaucacc

SEQ ID NO: 2025013 - RNA, 14 nt, Homo sapiens
aacaguaugcacaa

SEQ ID NO: 2025014 - RNA, 17 nt, Homo sapiens
ccccucagcaaggggcu

SEQ ID NO: 2025015 - RNA, 14 nt, Homo sapiens
gaaggagauuccac

SEQ ID NO: 2025016 - RNA, 14 nt, Homo sapiens
cguacuuguaauau

SEQ ID NO: 2025017 - RNA, 14 nt, Homo sapiens
gggccggggcugcc

SEQ ID NO: 2025018 - RNA, 20 nt, Homo sapiens
accgucaauaggcaaagggg

SEQ ID NO: 2025019 - RNA, 23 nt, Homo sapiens
cuguuguucuguggucacaguga

SEQ ID NO: 2025020 - RNA, 22 nt, Homo sapiens
cagggcucucuguaucagucuu

SEQ ID NO: 2025021 - RNA, 14 nt, Homo sapiens
acuugggagcaaaa

SEQ ID NO: 2025022 - RNA, 20 nt, Homo sapiens
aauuauaagagacuuaucuu

SEQ ID NO: 2025023 - RNA, 16 nt, Homo sapiens
ucuuacuuugugcaaa

SEQ ID NO: 2025024 - RNA, 18 nt, Homo sapiens
aaaccuagcuaggcuaag

SEQ ID NO: 2025025 - RNA, 17 nt, Homo sapiens
uuaaaaccacagaacag

SEQ ID NO: 2025026 - RNA, 16 nt, Homo sapiens
uaugaauuuuacuugc

SEQ ID NO: 2025027 - RNA, 18 nt, Homo sapiens
agggcagacaugccuugg

SEQ ID NO: 2025028 - RNA, 22 nt, Homo sapiens
agaagugaaaaucuacacucca

SEQ ID NO: 2025029 - RNA, 15 nt, Homo sapiens
uucuccucacuguau

SEQ ID NO: 2025030 - RNA, 15 nt, Homo sapiens
uuugucucaccucau

SEQ ID NO: 2025031 - RNA, 20 nt, Homo sapiens
ucaaagauauuuugcuuugu

SEQ ID NO: 2025032 - RNA, 18 nt, Homo sapiens
cugccccgaaagugcuga

SEQ ID NO: 2025033 - RNA, 21 nt, Homo sapiens
auaauagacuucccacucuag

SEQ ID NO: 2025034 - RNA, 20 nt, Homo sapiens
aauuauuuucaagagagugu

SEQ ID NO: 2025035 - RNA, 15 nt, Homo sapiens
uacaagaaguuuauu

SEQ ID NO: 2025036 - RNA, 22 nt, Homo sapiens
acacuaugcacugcuguaacug

SEQ ID NO: 2025037 - RNA, 17 nt, Homo sapiens
aguugaaauaugcucuu

SEQ ID NO: 2025038 - RNA, 15 nt, Homo sapiens
cacaucucuguagau

SEQ ID NO: 2025039 - RNA, 14 nt, Homo sapiens
cuuccgacaccacu

SEQ ID NO: 2025040 - RNA, 20 nt, Homo sapiens
ccagucucagagaccagcac

SEQ ID NO: 2025041 - RNA, 17 nt, Homo sapiens
aaaagcucagaugacau

SEQ ID NO: 2025042 - RNA, 13 nt, Homo sapiens
aauccaauacugc

SEQ ID NO: 2025043 - RNA, 19 nt, Homo sapiens
auuagccgucccagugaaa

SEQ ID NO: 2025044 - RNA, 15 nt, Homo sapiens
cugcaucaaaggaga

SEQ ID NO: 2025045 - RNA, 12 nt, Homo sapiens
aauuuuguugca

SEQ ID NO: 2025046 - RNA, 21 nt, Homo sapiens
uaaccugggaccuguggucau

SEQ ID NO: 2025047 - RNA, 23 nt, Homo sapiens
uaaaucgcauuaaugaaauacca

SEQ ID NO: 2025048 - RNA, 14 nt, Homo sapiens
auuagcuuuuggag

SEQ ID NO: 2025049 - RNA, 16 nt, Homo sapiens
cuucgugugcugcugc

SEQ ID NO: 2025050 - RNA, 19 nt, Homo sapiens
cccacauguguccauccca

SEQ ID NO: 2025051 - RNA, 16 nt, Homo sapiens
gcucucgcacaccucu

SEQ ID NO: 2025052 - RNA, 12 nt, Homo sapiens
aaaaagccaaaa

SEQ ID NO: 2025053 - RNA, 12 nt, Homo sapiens
cacuagcccacu

SEQ ID NO: 2025054 - RNA, 12 nt, Homo sapiens
ucaaagccucaa

SEQ ID NO: 2025055 - RNA, 21 nt, Homo sapiens
cuacuuuaagcacuacauaaa

SEQ ID NO: 2025056 - RNA, 15 nt, Homo sapiens
uaucuucuacaugca

SEQ ID NO: 2025057 - RNA, 23 nt, Homo sapiens
cuaaauugaauacacaaauuucc

SEQ ID NO: 2025058 - RNA, 16 nt, Homo sapiens
ucauucaagccuguga

SEQ ID NO: 2025059 - RNA, 11 nt, Homo sapiens
acgcagaucac

SEQ ID NO: 2025060 - RNA, 22 nt, Homo sapiens
uugccaucugaugucguaccuc

SEQ ID NO: 2025061 - RNA, 20 nt, Homo sapiens
accccgagaccucacuuuau

SEQ ID NO: 2025062 - RNA, 21 nt, Homo sapiens
ccacaguucuaagacccaaag

SEQ ID NO: 2025063 - RNA, 20 nt, Homo sapiens
uuuccuuuuuuaaaaaugca

SEQ ID NO: 2025064 - RNA, 23 nt, Homo sapiens
uuuugcaaauaguagaguaucag

SEQ ID NO: 2025065 - RNA, 15 nt, Homo sapiens
cguggucaagcacuc

SEQ ID NO: 2025066 - RNA, 15 nt, Homo sapiens
cccagccaacugccc

SEQ ID NO: 2025067 - RNA, 15 nt, Homo sapiens
aggucauugguggca

SEQ ID NO: 2025068 - RNA, 18 nt, Homo sapiens
cugucaccaugacuuccu

SEQ ID NO: 2025069 - RNA, 12 nt, Homo sapiens
ccacgugcagua

SEQ ID NO: 2025070 - RNA, 17 nt, Homo sapiens
caaguuauuaaucuuau

SEQ ID NO: 2025071 - RNA, 23 nt, Homo sapiens
guguguccaugugugugcaagug

SEQ ID NO: 2025072 - RNA, 22 nt, Homo sapiens
cuggagaaaagggauggagcug

SEQ ID NO: 2025073 - RNA, 17 nt, Homo sapiens
gccauuuuccuuuacac

SEQ ID NO: 2025074 - RNA, 16 nt, Homo sapiens
uagucaauccaagacu

SEQ ID NO: 2025075 - RNA, 16 nt, Homo sapiens
cccuuaaacuuccaaa

SEQ ID NO: 2025076 - RNA, 14 nt, Homo sapiens
cucuccagccauug

SEQ ID NO: 2025077 - RNA, 20 nt, Homo sapiens
ucagagcccucaacuauucu

SEQ ID NO: 2025078 - RNA, 23 nt, Homo sapiens
gacaauaaaacauuccugugaaa

SEQ ID NO: 2025079 - RNA, 20 nt, Homo sapiens
uaggcaggaccaugggacca

SEQ ID NO: 2025080 - RNA, 15 nt, Homo sapiens
acauaauauagcuua

SEQ ID NO: 2025081 - RNA, 12 nt, Homo sapiens
accacucugucu

SEQ ID NO: 2025082 - RNA, 22 nt, Homo sapiens
aaccuauuucucuuucuuuaca

SEQ ID NO: 2025083 - RNA, 15 nt, Homo sapiens
uuauuggauucacac

SEQ ID NO: 2025084 - RNA, 19 nt, Homo sapiens
auacugcggaccaagggac

SEQ ID NO: 2025085 - RNA, 14 nt, Homo sapiens
auuaacauggccau

SEQ ID NO: 2025086 - RNA, 16 nt, Homo sapiens
aagcaguucgacaaau

SEQ ID NO: 2025087 - RNA, 21 nt, Homo sapiens
agugugaacaaaagaugcucu

SEQ ID NO: 2025088 - RNA, 14 nt, Homo sapiens
aggauaucuuggcu

SEQ ID NO: 2025089 - RNA, 23 nt, Homo sapiens
uccaacaugaaaacaauucuuau

SEQ ID NO: 2025090 - RNA, 23 nt, Homo sapiens
uauagauuucuauaaaagcaaga

SEQ ID NO: 2025091 - RNA, 18 nt, Homo sapiens
cagaauuuugggacauuu

SEQ ID NO: 2025092 - RNA, 20 nt, Homo sapiens
agcacuuuggacauggcuca

SEQ ID NO: 2025093 - RNA, 19 nt, Homo sapiens
gagccucaaccuucugggg

SEQ ID NO: 2025094 - RNA, 23 nt, Homo sapiens
aguacucaguaaaucagugcagu

SEQ ID NO: 2025095 - RNA, 22 nt, Homo sapiens
gggagauucaugcgaugugucc

SEQ ID NO: 2025096 - RNA, 14 nt, Homo sapiens
aucuuuggacagaa

SEQ ID NO: 2025097 - RNA, 20 nt, Homo sapiens
gaaaaauuaauuuacuagaa

SEQ ID NO: 2025098 - RNA, 21 nt, Homo sapiens
gugucccuggcgcugugcuag

SEQ ID NO: 2025099 - RNA, 11 nt, Homo sapiens
ugaauaucauu

SEQ ID NO: 2025100 - RNA, 21 nt, Homo sapiens
ugcccagugagacuguguugu

SEQ ID NO: 2025101 - RNA, 12 nt, Homo sapiens
ugccuuauguaa

SEQ ID NO: 2025102 - RNA, 15 nt, Homo sapiens
gugucauuucauucc

SEQ ID NO: 2025103 - RNA, 14 nt, Homo sapiens
caugacaagaacaa

SEQ ID NO: 2025104 - RNA, 12 nt, Homo sapiens
gccagacuuccc

SEQ ID NO: 2025105 - RNA, 15 nt, Homo sapiens
cuaacuacuguagaa

SEQ ID NO: 2025106 - RNA, 14 nt, Homo sapiens
uggacugggugcca

SEQ ID NO: 2025107 - RNA, 18 nt, Homo sapiens
auuaagauggucauauua

SEQ ID NO: 2025108 - RNA, 12 nt, Homo sapiens
cuagaaugagca

SEQ ID NO: 2025109 - RNA, 21 nt, Homo sapiens
aguaccugaaaaaaugccaag

SEQ ID NO: 2025110 - RNA, 14 nt, Homo sapiens
gaaaaauuuguaua

SEQ ID NO: 2025111 - RNA, 17 nt, Homo sapiens
accaggggcaccggcug

SEQ ID NO: 2025112 - RNA, 15 nt, Homo sapiens
gaaaaaaaguugcaa

SEQ ID NO: 2025113 - RNA, 22 nt, Homo sapiens
gcaagcugcuugcccaagucac

SEQ ID NO: 2025114 - RNA, 17 nt, Homo sapiens
gcugcuuauaguuugcu

SEQ ID NO: 2025115 - RNA, 17 nt, Homo sapiens
ugcaucuuugauguguu

SEQ ID NO: 2025116 - RNA, 19 nt, Homo sapiens
aaaaacuggcaacauucca

SEQ ID NO: 2025117 - RNA, 12 nt, Homo sapiens
auuccauugccu

SEQ ID NO: 2025118 - RNA, 17 nt, Homo sapiens
caggagaucgagaccau

SEQ ID NO: 2025119 - RNA, 24 nt, Homo sapiens
cacauuugauuauauacuauguau

SEQ ID NO: 2025120 - RNA, 16 nt, Homo sapiens
cggagucucgcucugu

SEQ ID NO: 2025121 - RNA, 16 nt, Homo sapiens
uuaaagauugcuuuau

SEQ ID NO: 2025122 - RNA, 15 nt, Homo sapiens
gcccagugcugccac

SEQ ID NO: 2025123 - RNA, 23 nt, Homo sapiens
uuggaggccugacuuggggacaa

SEQ ID NO: 2025124 - RNA, 18 nt, Homo sapiens
uguaugaaaaauugggga

SEQ ID NO: 2025125 - RNA, 16 nt, Homo sapiens
ucagaugacucucucc

SEQ ID NO: 2025126 - RNA, 22 nt, Homo sapiens
gccauucucccucuuguuuuca

SEQ ID NO: 2025127 - RNA, 16 nt, Homo sapiens
auuauauuguuuuaua

SEQ ID NO: 2025128 - RNA, 20 nt, Homo sapiens
ccauguugcacuguuugcau

SEQ ID NO: 2025129 - RNA, 12 nt, Homo sapiens
cauuaccauuca

SEQ ID NO: 2025130 - RNA, 15 nt, Homo sapiens
agagaggaucacuua

SEQ ID NO: 2025131 - RNA, 16 nt, Homo sapiens
gccccugcccccagag

SEQ ID NO: 2025132 - RNA, 16 nt, Homo sapiens
gagcccuccccaggaa

SEQ ID NO: 2025133 - RNA, 16 nt, Homo sapiens
caauaagccauucuaa

SEQ ID NO: 2025134 - RNA, 19 nt, Homo sapiens
uggcacugagaaacaugca

SEQ ID NO: 2025135 - RNA, 21 nt, Homo sapiens
cuggagggcuugguaaaacac

SEQ ID NO: 2025136 - RNA, 22 nt, Homo sapiens
cccgggacagggucuugcaagc

SEQ ID NO: 2025137 - RNA, 12 nt, Homo sapiens
ugacagcugcuc

SEQ ID NO: 2025138 - RNA, 17 nt, Homo sapiens
ugauuggugcuuaccuu

SEQ ID NO: 2025139 - RNA, 15 nt, Homo sapiens
uucauccguguaacc

SEQ ID NO: 2025140 - RNA, 14 nt, Homo sapiens
auucaaaagugauu

SEQ ID NO: 2025141 - RNA, 18 nt, Homo sapiens
ugagaaacgcucaugaca

SEQ ID NO: 2025142 - RNA, 19 nt, Homo sapiens
cagugcuucaacgauguga

SEQ ID NO: 2025143 - RNA, 23 nt, Homo sapiens
uuuugaaaaaguguacaugaaga

SEQ ID NO: 2025144 - RNA, 14 nt, Homo sapiens
ugugcccaccagcg

SEQ ID NO: 2025145 - RNA, 14 nt, Homo sapiens
agcaugaggcaaaa

SEQ ID NO: 2025146 - RNA, 19 nt, Homo sapiens
ggcuauggacacaggguga

SEQ ID NO: 2025147 - RNA, 17 nt, Homo sapiens
gauucacauguuuucaa

SEQ ID NO: 2025148 - RNA, 11 nt, Homo sapiens
uaaauaaacua

SEQ ID NO: 2025149 - RNA, 15 nt, Homo sapiens
gccacacacugaguu

SEQ ID NO: 2025150 - RNA, 18 nt, Homo sapiens
gaguugagauuuugcaau

SEQ ID NO: 2025151 - RNA, 11 nt, Homo sapiens
caucucccacc

SEQ ID NO: 2025152 - RNA, 20 nt, Homo sapiens
cagcaagacuucucuuugcc

SEQ ID NO: 2025153 - RNA, 13 nt, Homo sapiens
cauauuaccagcu

SEQ ID NO: 2025154 - RNA, 20 nt, Homo sapiens
gaaguagcugagaaaacuaa

SEQ ID NO: 2025155 - RNA, 23 nt, Homo sapiens
ccugccaggcccuuugcacugag

SEQ ID NO: 2025156 - RNA, 14 nt, Homo sapiens
ugugguuugucaga

SEQ ID NO: 2025157 - RNA, 18 nt, Homo sapiens
aauguuacugaucaugca

SEQ ID NO: 2025158 - RNA, 16 nt, Homo sapiens
uuagguagcaacaaca

SEQ ID NO: 2025159 - RNA, 14 nt, Homo sapiens
gcauuuaagaguga

SEQ ID NO: 2025160 - RNA, 17 nt, Homo sapiens
gaacagagucucaggac

SEQ ID NO: 2025161 - RNA, 16 nt, Homo sapiens
uaaugcggacacuuuu

SEQ ID NO: 2025162 - RNA, 22 nt, Homo sapiens
uccugagugugggcuucugaaa

SEQ ID NO: 2025163 - RNA, 13 nt, Homo sapiens
gguagaacacugc

SEQ ID NO: 2025164 - RNA, 18 nt, Homo sapiens
caggagagucacuugaac

SEQ ID NO: 2025165 - RNA, 22 nt, Homo sapiens
aggauuucucuaacccuauccu

SEQ ID NO: 2025166 - RNA, 17 nt, Homo sapiens
gcaguggugcccuuccu

SEQ ID NO: 2025167 - RNA, 21 nt, Homo sapiens
uuccaguuuuuugccacugca

SEQ ID NO: 2025168 - RNA, 16 nt, Homo sapiens
ugacuucuucccaaga

SEQ ID NO: 2025169 - RNA, 16 nt, Homo sapiens
ugacuccuaugaucuc

SEQ ID NO: 2025170 - RNA, 13 nt, Homo sapiens
caaagaggugacu

SEQ ID NO: 2025171 - RNA, 21 nt, Homo sapiens
agcuacauauaugaacaaauc

SEQ ID NO: 2025172 - RNA, 14 nt, Homo sapiens
aaauaagcuauauu

SEQ ID NO: 2025173 - RNA, 14 nt, Homo sapiens
uuaauugcauuuaa

SEQ ID NO: 2025174 - RNA, 16 nt, Homo sapiens
gcuacaaacauaucaa

SEQ ID NO: 2025175 - RNA, 17 nt, Homo sapiens
auugcccgaaaccagag

SEQ ID NO: 2025176 - RNA, 18 nt, Homo sapiens
guccuuugauaaccaaau

SEQ ID NO: 2025177 - RNA, 16 nt, Homo sapiens
aaaccugccuugcaca

SEQ ID NO: 2025178 - RNA, 18 nt, Homo sapiens
agccgcgugugacagucu

SEQ ID NO: 2025179 - RNA, 18 nt, Homo sapiens
cuucccccuuccaaauaa

SEQ ID NO: 2025180 - RNA, 23 nt, Homo sapiens
uaggucacuugaagccaaacugu

SEQ ID NO: 2025181 - RNA, 16 nt, Homo sapiens
uguuugcagcugugag

SEQ ID NO: 2025182 - RNA, 21 nt, Homo sapiens
ccuugugaugucauacagaga

SEQ ID NO: 2025183 - RNA, 23 nt, Homo sapiens
caugcuuuagauuauauauuccg

SEQ ID NO: 2025184 - RNA, 22 nt, Homo sapiens
aagauggcuuccgugagacaca

SEQ ID NO: 2025185 - RNA, 16 nt, Homo sapiens
auccucagccgagaaa

SEQ ID NO: 2025186 - RNA, 14 nt, Homo sapiens
ucauuacaguucuu

SEQ ID NO: 2025187 - RNA, 11 nt, Homo sapiens
cugcacucaag

SEQ ID NO: 2025188 - RNA, 14 nt, Homo sapiens
uaguggugacugug

SEQ ID NO: 2025189 - RNA, 19 nt, Homo sapiens
acccuccuggccucagacu

SEQ ID NO: 2025190 - RNA, 17 nt, Homo sapiens
cggagcugcugcugcuc

SEQ ID NO: 2025191 - RNA, 22 nt, Homo sapiens
gaagcaucugucuugucauucc

SEQ ID NO: 2025192 - RNA, 13 nt, Homo sapiens
uuuaaagacaugu

SEQ ID NO: 2025193 - RNA, 20 nt, Homo sapiens
ccagauaacuuagcuuauga

SEQ ID NO: 2025194 - RNA, 13 nt, Homo sapiens
acuacugggcaaa

SEQ ID NO: 2025195 - RNA, 19 nt, Homo sapiens
augguuuuccaucuuaucu

SEQ ID NO: 2025196 - RNA, 13 nt, Homo sapiens
gauuuguaauuaa

SEQ ID NO: 2025197 - RNA, 22 nt, Homo sapiens
auccugacacauuuucaaguga

SEQ ID NO: 2025198 - RNA, 22 nt, Homo sapiens
ggcaacacugaaggaacaguua

SEQ ID NO: 2025199 - RNA, 20 nt, Homo sapiens
gaaaguaagggaagcagaag

SEQ ID NO: 2025200 - RNA, 23 nt, Homo sapiens
cccagcagaggcaggcugggacg

SEQ ID NO: 2025201 - RNA, 22 nt, Homo sapiens
gcacagcaggcugccagugccu

SEQ ID NO: 2025202 - RNA, 19 nt, Homo sapiens
ucaagcaauccaagugauc

SEQ ID NO: 2025203 - RNA, 17 nt, Homo sapiens
ugcaucugcuacugugu

SEQ ID NO: 2025204 - RNA, 20 nt, Homo sapiens
agaugauaaucccauacucu

SEQ ID NO: 2025205 - RNA, 19 nt, Homo sapiens
uagcauuuucugcaucucc

SEQ ID NO: 2025206 - RNA, 22 nt, Homo sapiens
ucgagcugugcucgggugcugc

SEQ ID NO: 2025207 - RNA, 19 nt, Homo sapiens
uccaccucgggcacauuuu

SEQ ID NO: 2025208 - RNA, 18 nt, Homo sapiens
ucugcuguuccaguggua

SEQ ID NO: 2025209 - RNA, 22 nt, Homo sapiens
gcuucuuaaaaacuguguauca

SEQ ID NO: 2025210 - RNA, 13 nt, Homo sapiens
ccagugaccccag

SEQ ID NO: 2025211 - RNA, 22 nt, Homo sapiens
uucucaaaugcuaaaugcaaac

SEQ ID NO: 2025212 - RNA, 21 nt, Homo sapiens
guaauaauaaucccaaggcaa

SEQ ID NO: 2025213 - RNA, 12 nt, Homo sapiens
cgaacuuaacag

SEQ ID NO: 2025214 - RNA, 11 nt, Homo sapiens
uucaauuccau

SEQ ID NO: 2025215 - RNA, 21 nt, Homo sapiens
uuagcaguuuccucagugaug

SEQ ID NO: 2025216 - RNA, 21 nt, Homo sapiens
aauacaggcaugaaccacugc

SEQ ID NO: 2025217 - RNA, 15 nt, Homo sapiens
acuuauaucaucagc

SEQ ID NO: 2025218 - RNA, 19 nt, Homo sapiens
uguugcgggaagucaggga

SEQ ID NO: 2025219 - RNA, 13 nt, Homo sapiens
aaugucauaaaga

SEQ ID NO: 2025220 - RNA, 16 nt, Homo sapiens
acucagcuaucagcuc

SEQ ID NO: 2025221 - RNA, 20 nt, Homo sapiens
cucccacaggggccaugucc

SEQ ID NO: 2025222 - RNA, 13 nt, Homo sapiens
gcucacauuccca

SEQ ID NO: 2025223 - RNA, 14 nt, Homo sapiens
ccucugcuuaaaaa

SEQ ID NO: 2025224 - RNA, 16 nt, Homo sapiens
cuuuaacagucuaaaa

SEQ ID NO: 2025225 - RNA, 23 nt, Homo sapiens
ugagauccuuuaaauccuuccau

SEQ ID NO: 2025226 - RNA, 14 nt, Homo sapiens
agggacacuuaccc

SEQ ID NO: 2025227 - RNA, 15 nt, Homo sapiens
guguucaccauccca

SEQ ID NO: 2025228 - RNA, 20 nt, Homo sapiens
ggagaggggaccaugcaaag

SEQ ID NO: 2025229 - RNA, 16 nt, Homo sapiens
cugaaucacaauguaa

SEQ ID NO: 2025230 - RNA, 16 nt, Homo sapiens
agaaaccacaagcaaa

SEQ ID NO: 2025231 - RNA, 17 nt, Homo sapiens
uuaaaauaagcauuuag

SEQ ID NO: 2025232 - RNA, 15 nt, Homo sapiens
guccccauacuccua

SEQ ID NO: 2025233 - RNA, 17 nt, Homo sapiens
ugaaggaauguauuucu

SEQ ID NO: 2025234 - RNA, 15 nt, Homo sapiens
accucuugucagugc

SEQ ID NO: 2025235 - RNA, 22 nt, Homo sapiens
caaaacaaacaaccugccacaa

SEQ ID NO: 2025236 - RNA, 17 nt, Homo sapiens
aacgcacacaguaucua

SEQ ID NO: 2025237 - RNA, 23 nt, Homo sapiens
ccaaagagacuggagcaucugac

SEQ ID NO: 2025238 - RNA, 12 nt, Homo sapiens
uucccaaaaaca

SEQ ID NO: 2025239 - RNA, 15 nt, Homo sapiens
aucugauuaauccau

SEQ ID NO: 2025240 - RNA, 15 nt, Homo sapiens
agcaggaagaacauu

SEQ ID NO: 2025241 - RNA, 19 nt, Homo sapiens
acaccugccuccacuucuc

SEQ ID NO: 2025242 - RNA, 16 nt, Homo sapiens
gaaaaggaagacuaga

SEQ ID NO: 2025243 - RNA, 16 nt, Homo sapiens
gccuuguggugugugc

SEQ ID NO: 2025244 - RNA, 22 nt, Homo sapiens
aaccccucuuagcuuacaggaa

SEQ ID NO: 2025245 - RNA, 20 nt, Homo sapiens
aggauauaguagccaugaca

SEQ ID NO: 2025246 - RNA, 14 nt, Homo sapiens
uuuaucaaagcaua

SEQ ID NO: 2025247 - RNA, 22 nt, Homo sapiens
gggccacucaggggucauucau

SEQ ID NO: 2025248 - RNA, 13 nt, Homo sapiens
ccagcucacagga

SEQ ID NO: 2025249 - RNA, 11 nt, Homo sapiens
agacugcauau

SEQ ID NO: 2025250 - RNA, 20 nt, Homo sapiens
uaguauggccugacagcucu

SEQ ID NO: 2025251 - RNA, 20 nt, Homo sapiens
uuuaguggcucagaacugca

SEQ ID NO: 2025252 - RNA, 17 nt, Homo sapiens
aguuuucuaaacucaau

SEQ ID NO: 2025253 - RNA, 13 nt, Homo sapiens
aauuuuagucacu

SEQ ID NO: 2025254 - RNA, 22 nt, Homo sapiens
ccauuaaauugccuuuguaaua

SEQ ID NO: 2025255 - RNA, 23 nt, Homo sapiens
ugggagaaccucguugacaugca

SEQ ID NO: 2025256 - RNA, 12 nt, Homo sapiens
ggagacaauguc

SEQ ID NO: 2025257 - RNA, 22 nt, Homo sapiens
cugacagugugggacaggcucu

SEQ ID NO: 2025258 - RNA, 13 nt, Homo sapiens
ucuaagacaauca

SEQ ID NO: 2025259 - RNA, 13 nt, Homo sapiens
gcaaauaauggaa

SEQ ID NO: 2025260 - RNA, 18 nt, Homo sapiens
cccugcccuuggcaccca

SEQ ID NO: 2025261 - RNA, 22 nt, Homo sapiens
gaacccugggccauccucacau

SEQ ID NO: 2025262 - RNA, 17 nt, Homo sapiens
cacacagugacaaaagg

SEQ ID NO: 2025263 - RNA, 15 nt, Homo sapiens
cugguccugcacaug

SEQ ID NO: 2025264 - RNA, 13 nt, Homo sapiens
cugccagcaucug

SEQ ID NO: 2025265 - RNA, 18 nt, Homo sapiens
agagcaggccagcccgga

SEQ ID NO: 2025266 - RNA, 19 nt, Homo sapiens
gcagccuggggucugacaa

SEQ ID NO: 2025267 - RNA, 22 nt, Homo sapiens
cauagauaguucauucauucaa

SEQ ID NO: 2025268 - RNA, 15 nt, Homo sapiens
ucuuuguccccaaau

SEQ ID NO: 2025269 - RNA, 18 nt, Homo sapiens
aagaagcuuucaguauua

SEQ ID NO: 2025270 - RNA, 18 nt, Homo sapiens
cuccacaguuuugccuua

SEQ ID NO: 2025271 - RNA, 19 nt, Homo sapiens
uccauucccaagaugccug

SEQ ID NO: 2025272 - RNA, 18 nt, Homo sapiens
guugcauugagcugagau

SEQ ID NO: 2025273 - RNA, 22 nt, Homo sapiens
gugccuccccugcucaucucca

SEQ ID NO: 2025274 - RNA, 22 nt, Homo sapiens
gguggcccugacugucagggag

SEQ ID NO: 2025275 - RNA, 19 nt, Homo sapiens
aaagacuguacaaaguaga

SEQ ID NO: 2025276 - RNA, 16 nt, Homo sapiens
gaacaucaucaaggca

SEQ ID NO: 2025277 - RNA, 21 nt, Homo sapiens
uugucagaccauaagaguuuc

SEQ ID NO: 2025278 - RNA, 16 nt, Homo sapiens
cccugucuuccucugc

SEQ ID NO: 2025279 - RNA, 12 nt, Homo sapiens
aaaccacuguac

SEQ ID NO: 2025280 - RNA, 12 nt, Homo sapiens
aagacacuguga

SEQ ID NO: 2025281 - RNA, 16 nt, Homo sapiens
cacauggaaacccaua

SEQ ID NO: 2025282 - RNA, 20 nt, Homo sapiens
cuuauauuauuuucuguaau

SEQ ID NO: 2025283 - RNA, 9 nt, Homo sapiens
acacacugu

SEQ ID NO: 2025284 - RNA, 22 nt, Homo sapiens
accucuucaugagcuugaacaa

SEQ ID NO: 2025285 - RNA, 17 nt, Homo sapiens
gagaacacagggcugca

SEQ ID NO: 2025286 - RNA, 19 nt, Homo sapiens
agaaaugugucaucaggag

SEQ ID NO: 2025287 - RNA, 23 nt, Homo sapiens
cuaaccuuugggccaauuuacug

SEQ ID NO: 2025288 - RNA, 19 nt, Homo sapiens
ugucauuggaaacacugcc

SEQ ID NO: 2025289 - RNA, 16 nt, Homo sapiens
ggcuguugcucaggag

SEQ ID NO: 2025290 - RNA, 16 nt, Homo sapiens
acuugaagacugugaa

SEQ ID NO: 2025291 - RNA, 13 nt, Homo sapiens
cugaggaccugcg

SEQ ID NO: 2025292 - RNA, 13 nt, Homo sapiens
caaaaaaccacaa

SEQ ID NO: 2025293 - RNA, 16 nt, Homo sapiens
ccuaugacauuacugu

SEQ ID NO: 2025294 - RNA, 24 nt, Homo sapiens
gauaauuaaggccagaggcccauu

SEQ ID NO: 2025295 - RNA, 16 nt, Homo sapiens
uaaaacuuaugcuagu

SEQ ID NO: 2025296 - RNA, 13 nt, Homo sapiens
auuucauaacuag

SEQ ID NO: 2025297 - RNA, 18 nt, Homo sapiens
ugaagagaccaagacucu

SEQ ID NO: 2025298 - RNA, 14 nt, Homo sapiens
cuggggaagacagu

SEQ ID NO: 2025299 - RNA, 21 nt, Homo sapiens
augcaccaaguacagccuuca

SEQ ID NO: 2025300 - RNA, 18 nt, Homo sapiens
aucaaaauauuucaguga

SEQ ID NO: 2025301 - RNA, 18 nt, Homo sapiens
gaacuagccaaaccagga

SEQ ID NO: 2025302 - RNA, 19 nt, Homo sapiens
uauccauguacuuucccug

SEQ ID NO: 2025303 - RNA, 23 nt, Homo sapiens
agcuuaauaaguauuuauugcau

SEQ ID NO: 2025304 - RNA, 21 nt, Homo sapiens
augaagaccuuuuucugcacu

SEQ ID NO: 2025305 - RNA, 19 nt, Homo sapiens
cucugcuaugucugugaug

SEQ ID NO: 2025306 - RNA, 13 nt, Homo sapiens
aaugccuuuauau

SEQ ID NO: 2025307 - RNA, 21 nt, Homo sapiens
gcccccgacaggcuggcucuc

SEQ ID NO: 2025308 - RNA, 13 nt, Homo sapiens
uacugugugaaga

SEQ ID NO: 2025309 - RNA, 20 nt, Homo sapiens
aggaacauccggaacagcca

SEQ ID NO: 2025310 - RNA, 16 nt, Homo sapiens
agccucaaaugcagua

SEQ ID NO: 2025311 - RNA, 23 nt, Homo sapiens
agucagaggauggccagugucug

SEQ ID NO: 2025312 - RNA, 14 nt, Homo sapiens
cuuuaccuguucaa

SEQ ID NO: 2025313 - RNA, 13 nt, Homo sapiens
cgggugggaacca

SEQ ID NO: 2025314 - RNA, 15 nt, Homo sapiens
uaagcccacauauaa

SEQ ID NO: 2025315 - RNA, 18 nt, Homo sapiens
ccagaaugaacaacacaa

SEQ ID NO: 2025316 - RNA, 19 nt, Homo sapiens
uuuaaaaaagcauuauccu

SEQ ID NO: 2025317 - RNA, 15 nt, Homo sapiens
caaugugcacuucac

SEQ ID NO: 2025318 - RNA, 15 nt, Homo sapiens
aaggaaauauuucaa

SEQ ID NO: 2025319 - RNA, 23 nt, Homo sapiens
ggaaauguucuuuagaugguggc

SEQ ID NO: 2025320 - RNA, 17 nt, Homo sapiens
cuacuuuuuuuugacau

SEQ ID NO: 2025321 - RNA, 17 nt, Homo sapiens
aauuuaaaacacagaga

SEQ ID NO: 2025322 - RNA, 14 nt, Homo sapiens
augaguaucugugg

SEQ ID NO: 2025323 - RNA, 22 nt, Homo sapiens
ggcacugacugauagcuuacac

SEQ ID NO: 2025324 - RNA, 14 nt, Homo sapiens
agcaagacuccauu

SEQ ID NO: 2025325 - RNA, 14 nt, Homo sapiens
uguucaaugaauau

SEQ ID NO: 2025326 - RNA, 21 nt, Homo sapiens
guugcucuguuucuuccuuuc

SEQ ID NO: 2025327 - RNA, 18 nt, Homo sapiens
auaucacuuacucaguua

SEQ ID NO: 2025328 - RNA, 18 nt, Homo sapiens
uuaaugaaauaucuguau

SEQ ID NO: 2025329 - RNA, 12 nt, Homo sapiens
caggcacuccaa

SEQ ID NO: 2025330 - RNA, 14 nt, Homo sapiens
ucuacaaaggccau

SEQ ID NO: 2025331 - RNA, 18 nt, Homo sapiens
uguuauuauuuugcacug

SEQ ID NO: 2025332 - RNA, 15 nt, Homo sapiens
aauuugacaaaaccc

SEQ ID NO: 2025333 - RNA, 23 nt, Homo sapiens
uccaggcuugccucaaguuccau

SEQ ID NO: 2025334 - RNA, 17 nt, Homo sapiens
caauuuaaaaagcaaaa

SEQ ID NO: 2025335 - RNA, 15 nt, Homo sapiens
ggcaaggcugaggug

SEQ ID NO: 2025336 - RNA, 14 nt, Homo sapiens
cccccaaggaggca

SEQ ID NO: 2025337 - RNA, 22 nt, Homo sapiens
gcaaggacugcagggacugcca

SEQ ID NO: 2025338 - RNA, 21 nt, Homo sapiens
cucugucaauuguacgcgcca

SEQ ID NO: 2025339 - RNA, 24 nt, Homo sapiens
acaguuuacagacgcugcugucac

SEQ ID NO: 2025340 - RNA, 13 nt, Homo sapiens
gucacgccugaaa

SEQ ID NO: 2025341 - RNA, 19 nt, Homo sapiens
acucuuuggaacaacagcu

SEQ ID NO: 2025342 - RNA, 19 nt, Homo sapiens
caugacugaaggacaucug

SEQ ID NO: 2025343 - RNA, 21 nt, Homo sapiens
auuuuguguguaccugugacu

SEQ ID NO: 2025344 - RNA, 13 nt, Homo sapiens
agagugcaauggu

SEQ ID NO: 2025345 - RNA, 23 nt, Homo sapiens
gcaaauaagcucuauuauauucg

SEQ ID NO: 2025346 - RNA, 14 nt, Homo sapiens
agcuuuauuucaaa

SEQ ID NO: 2025347 - RNA, 14 nt, Homo sapiens
caacaauuguccca

SEQ ID NO: 2025348 - RNA, 19 nt, Homo sapiens
guaguuuuguacauaacuu

SEQ ID NO: 2025349 - RNA, 14 nt, Homo sapiens
uugccugcaaaaau

SEQ ID NO: 2025350 - RNA, 15 nt, Homo sapiens
ucuuuucacaaauaa

SEQ ID NO: 2025351 - RNA, 20 nt, Homo sapiens
gaauugugaauaaguuuuca

SEQ ID NO: 2025352 - RNA, 20 nt, Homo sapiens
agcccugcaccaugcugcug

SEQ ID NO: 2025353 - RNA, 13 nt, Homo sapiens
guugucacugaga

SEQ ID NO: 2025354 - RNA, 12 nt, Homo sapiens
cucacugccaaa

SEQ ID NO: 2025355 - RNA, 12 nt, Homo sapiens
cucccugccaac

SEQ ID NO: 2025356 - RNA, 21 nt, Homo sapiens
auuggacgguuucuagccucu

SEQ ID NO: 2025357 - RNA, 20 nt, Homo sapiens
uuacauuguaguuaaacaaa

SEQ ID NO: 2025358 - RNA, 23 nt, Homo sapiens
cuaaugucacaacauggugcuac

SEQ ID NO: 2025359 - RNA, 14 nt, Homo sapiens
ccaacccuauccca

SEQ ID NO: 2025360 - RNA, 11 nt, Homo sapiens
cugccaccacc

SEQ ID NO: 2025361 - RNA, 15 nt, Homo sapiens
ugaauaaauguguug

SEQ ID NO: 2025362 - RNA, 20 nt, Homo sapiens
auuugucccuaugcauauca

SEQ ID NO: 2025363 - RNA, 19 nt, Homo sapiens
ccuggaucuccucaagucc

SEQ ID NO: 2025364 - RNA, 19 nt, Homo sapiens
cuuuaauuugcuacuguca

SEQ ID NO: 2025365 - RNA, 11 nt, Homo sapiens
auuauucugau

SEQ ID NO: 2025366 - RNA, 16 nt, Homo sapiens
aagauggcaacuguau

SEQ ID NO: 2025367 - RNA, 23 nt, Homo sapiens
uaauaugaguaauacaucaaaga

SEQ ID NO: 2025368 - RNA, 20 nt, Homo sapiens
aaaguguuuugcccuauaua

SEQ ID NO: 2025369 - RNA, 16 nt, Homo sapiens
accccaaaugcucucu

SEQ ID NO: 2025370 - RNA, 14 nt, Homo sapiens
ucaaaugauucauu

SEQ ID NO: 2025371 - RNA, 16 nt, Homo sapiens
caacuaaggacaaauu

SEQ ID NO: 2025372 - RNA, 21 nt, Homo sapiens
aagacugaguacguugugcau

SEQ ID NO: 2025373 - RNA, 19 nt, Homo sapiens
uugucuaaagcuaaacaaa

SEQ ID NO: 2025374 - RNA, 19 nt, Homo sapiens
accucuucaugagcuugaa

SEQ ID NO: 2025375 - RNA, 20 nt, Homo sapiens
uuuaucaaacacacuuccag

SEQ ID NO: 2025376 - RNA, 12 nt, Homo sapiens
gccagugacaga

SEQ ID NO: 2025377 - RNA, 16 nt, Homo sapiens
gaauuauuauuuggcu

SEQ ID NO: 2025378 - RNA, 22 nt, Homo sapiens
cuugugguuagcaagacugcaa

SEQ ID NO: 2025379 - RNA, 18 nt, Homo sapiens
cuaauauuccacguuugu

SEQ ID NO: 2025380 - RNA, 21 nt, Homo sapiens
agaguccuauuugcacuguag

SEQ ID NO: 2025381 - RNA, 13 nt, Homo sapiens
uuagcuacugcua

SEQ ID NO: 2025382 - RNA, 13 nt, Homo sapiens
augacacaguugg

SEQ ID NO: 2025383 - RNA, 19 nt, Homo sapiens
auaagauggaagcuuccag

SEQ ID NO: 2025384 - RNA, 18 nt, Homo sapiens
uugggaugggaucccagg

SEQ ID NO: 2025385 - RNA, 16 nt, Homo sapiens
uaauacauucacccag

SEQ ID NO: 2025386 - RNA, 21 nt, Homo sapiens
ggcuccgggcaccaggggcca

SEQ ID NO: 2025387 - RNA, 17 nt, Homo sapiens
aagagcuuaacagugug

SEQ ID NO: 2025388 - RNA, 22 nt, Homo sapiens
accagauggcauccuugggacc

SEQ ID NO: 2025389 - RNA, 14 nt, Homo sapiens
augccauaugccuu

SEQ ID NO: 2025390 - RNA, 15 nt, Homo sapiens
caagcuagacugugu

SEQ ID NO: 2025391 - RNA, 17 nt, Homo sapiens
gaacauguuuaaugggu

SEQ ID NO: 2025392 - RNA, 20 nt, Homo sapiens
auuguggucacaacuugaug

SEQ ID NO: 2025393 - RNA, 20 nt, Homo sapiens
uagugcuuuaccuuuauuaa

SEQ ID NO: 2025394 - RNA, 15 nt, Homo sapiens
caguuugauaccugc

SEQ ID NO: 2025395 - RNA, 16 nt, Homo sapiens
uuugcagcagaagcca

SEQ ID NO: 2025396 - RNA, 16 nt, Homo sapiens
guuuguuacuauguau

SEQ ID NO: 2025397 - RNA, 20 nt, Homo sapiens
uagcaauuccccuacaucaa

SEQ ID NO: 2025398 - RNA, 19 nt, Homo sapiens
uucucuacagaugucccau

SEQ ID NO: 2025399 - RNA, 15 nt, Homo sapiens
ugcauguugccauga

SEQ ID NO: 2025400 - RNA, 18 nt, Homo sapiens
uuuaaagaaaaguucuua

SEQ ID NO: 2025401 - RNA, 20 nt, Homo sapiens
ugacaggccauccauucaca

SEQ ID NO: 2025402 - RNA, 12 nt, Homo sapiens
acaucucuucau

SEQ ID NO: 2025403 - RNA, 17 nt, Homo sapiens
aacuauauucauuucca

SEQ ID NO: 2025404 - RNA, 19 nt, Homo sapiens
acaauaaaguuugcuuuca

SEQ ID NO: 2025405 - RNA, 22 nt, Homo sapiens
ggaccugccaaugauuccagac

SEQ ID NO: 2025406 - RNA, 23 nt, Homo sapiens
cauauguguguguggguaugugu

SEQ ID NO: 2025407 - RNA, 14 nt, Homo sapiens
auucucaccugccu

SEQ ID NO: 2025408 - RNA, 15 nt, Homo sapiens
agauguuugccucau

SEQ ID NO: 2025409 - RNA, 21 nt, Homo sapiens
gaaaucaugccuaguuauuca

SEQ ID NO: 2025410 - RNA, 19 nt, Homo sapiens
augacuuagcgucaagaca

SEQ ID NO: 2025411 - RNA, 16 nt, Homo sapiens
auuccuggaaaacugg

SEQ ID NO: 2025412 - RNA, 16 nt, Homo sapiens
aaaauguuauucuguu

SEQ ID NO: 2025413 - RNA, 19 nt, Homo sapiens
cccaccagcaauacaaaga

SEQ ID NO: 2025414 - RNA, 22 nt, Homo sapiens
aggcuggggccccuaagcuccu

SEQ ID NO: 2025415 - RNA, 16 nt, Homo sapiens
ucauugaaacuacacu

SEQ ID NO: 2025416 - RNA, 18 nt, Homo sapiens
caaugcaaaguacaugua

SEQ ID NO: 2025417 - RNA, 22 nt, Homo sapiens
auuuuauauauuaugucauuca

SEQ ID NO: 2025418 - RNA, 17 nt, Homo sapiens
cagcaaggaaagcucac

SEQ ID NO: 2025419 - RNA, 19 nt, Homo sapiens
agaguaaauagcauucucu

SEQ ID NO: 2025420 - RNA, 14 nt, Homo sapiens
auuugauaccaugg

SEQ ID NO: 2025421 - RNA, 16 nt, Homo sapiens
uaaucccaguuacuca

SEQ ID NO: 2025422 - RNA, 21 nt, Homo sapiens
uuucuaauaaucauaaacuau

SEQ ID NO: 2025423 - RNA, 23 nt, Homo sapiens
uaaguccucuagugaauguaggc

SEQ ID NO: 2025424 - RNA, 18 nt, Homo sapiens
auuuacugucuuaaauca

SEQ ID NO: 2025425 - RNA, 20 nt, Homo sapiens
cuuccuccagggacucuggg

SEQ ID NO: 2025426 - RNA, 16 nt, Homo sapiens
ccacgugcacagcuuc

SEQ ID NO: 2025427 - RNA, 15 nt, Homo sapiens
gacagacagaaggca

SEQ ID NO: 2025428 - RNA, 17 nt, Homo sapiens
uacauuuaauaaaacug

SEQ ID NO: 2025429 - RNA, 18 nt, Homo sapiens
uccuguacauuucacaaa

SEQ ID NO: 2025430 - RNA, 17 nt, Homo sapiens
aaggcuaaaaagcaaca

SEQ ID NO: 2025431 - RNA, 22 nt, Homo sapiens
agauggcagagggcagagcaca

SEQ ID NO: 2025432 - RNA, 23 nt, Homo sapiens
uaccaucuaaucuaugcauguau

SEQ ID NO: 2025433 - RNA, 20 nt, Homo sapiens
aguccuauuuagacauguaa

SEQ ID NO: 2025434 - RNA, 14 nt, Homo sapiens
uacagaggucucug

SEQ ID NO: 2025435 - RNA, 21 nt, Homo sapiens
cucaguguuuuggacuccauc

SEQ ID NO: 2025436 - RNA, 17 nt, Homo sapiens
gaauucugcccuggaca

SEQ ID NO: 2025437 - RNA, 23 nt, Homo sapiens
uguccauccuccucuccaugcaa

SEQ ID NO: 2025438 - RNA, 17 nt, Homo sapiens
gcagcagaggcaggacc

SEQ ID NO: 2025439 - RNA, 23 nt, Homo sapiens
ugcuuccucccaacaagcagcug

SEQ ID NO: 2025440 - RNA, 13 nt, Homo sapiens
acaaaauacacac

SEQ ID NO: 2025441 - RNA, 20 nt, Homo sapiens
uggagcaagugacaugccau

SEQ ID NO: 2025442 - RNA, 20 nt, Homo sapiens
cccuccaaaggaacucuaga

SEQ ID NO: 2025443 - RNA, 15 nt, Homo sapiens
agcuugggugcauuu

SEQ ID NO: 2025444 - RNA, 11 nt, Homo sapiens
uccacuuguau

SEQ ID NO: 2025445 - RNA, 21 nt, Homo sapiens
ucugaaccagaauuacauguu

SEQ ID NO: 2025446 - RNA, 20 nt, Homo sapiens
uucuaacauguuuugugcag

SEQ ID NO: 2025447 - RNA, 17 nt, Homo sapiens
ugaaaccuaccuaggca

SEQ ID NO: 2025448 - RNA, 14 nt, Homo sapiens
caaaaagauaccuu

SEQ ID NO: 2025449 - RNA, 15 nt, Homo sapiens
ugaugaguccagaac

SEQ ID NO: 2025450 - RNA, 12 nt, Homo sapiens
gcauaagcaaaa

SEQ ID NO: 2025451 - RNA, 17 nt, Homo sapiens
acacccaaagcauggac

SEQ ID NO: 2025452 - RNA, 13 nt, Homo sapiens
uucuauucaaaag

SEQ ID NO: 2025453 - RNA, 20 nt, Homo sapiens
cuugugcccgauucuuucag

SEQ ID NO: 2025454 - RNA, 12 nt, Homo sapiens
agacugcuuccc

SEQ ID NO: 2025455 - RNA, 21 nt, Homo sapiens
uaagagggagggagggcucca

SEQ ID NO: 2025456 - RNA, 21 nt, Homo sapiens
cuguuucccuuugauucucca

SEQ ID NO: 2025457 - RNA, 16 nt, Homo sapiens
ugaaaaaauacuaccu

SEQ ID NO: 2025458 - RNA, 14 nt, Homo sapiens
ggcugccagccagg

SEQ ID NO: 2025459 - RNA, 18 nt, Homo sapiens
agccucccgaguagcugg

SEQ ID NO: 2025460 - RNA, 16 nt, Homo sapiens
gacuacucagcacugu

SEQ ID NO: 2025461 - RNA, 17 nt, Homo sapiens
cagucagucacaaacca

SEQ ID NO: 2025462 - RNA, 11 nt, Homo sapiens
cacagacugac

SEQ ID NO: 2025463 - RNA, 22 nt, Homo sapiens
ugcacaguaauaugaaagccac

SEQ ID NO: 2025464 - RNA, 15 nt, Homo sapiens
gcguccaugcucaga

SEQ ID NO: 2025465 - RNA, 22 nt, Homo sapiens
cauccaaacucagaaggcuuug

SEQ ID NO: 2025466 - RNA, 22 nt, Homo sapiens
gaagagagagagagagguucug

SEQ ID NO: 2025467 - RNA, 21 nt, Homo sapiens
auucuugcuaugaaaaguuuc

SEQ ID NO: 2025468 - RNA, 18 nt, Homo sapiens
gauggaaaaaagccuuca

SEQ ID NO: 2025469 - RNA, 23 nt, Homo sapiens
ggauaaucacauuaucaucugaa

SEQ ID NO: 2025470 - RNA, 14 nt, Homo sapiens
agagccugugugaa

SEQ ID NO: 2025471 - RNA, 16 nt, Homo sapiens
aucaaagcaucuugca

SEQ ID NO: 2025472 - RNA, 23 nt, Homo sapiens
ccauuauuucaaccgcuugccau

SEQ ID NO: 2025473 - RNA, 18 nt, Homo sapiens
ccucuucuuugugccuuu

SEQ ID NO: 2025474 - RNA, 14 nt, Homo sapiens
gcagacaugccuug

SEQ ID NO: 2025475 - RNA, 17 nt, Homo sapiens
gcuuuagaaacagugca

SEQ ID NO: 2025476 - RNA, 13 nt, Homo sapiens
ggcuucagccagu

SEQ ID NO: 2025477 - RNA, 19 nt, Homo sapiens
cauauauauucuacauaua

SEQ ID NO: 2025478 - RNA, 19 nt, Homo sapiens
guauaaaauaaaauacauu

SEQ ID NO: 2025479 - RNA, 14 nt, Homo sapiens
uuuauagcucauca

SEQ ID NO: 2025480 - RNA, 16 nt, Homo sapiens
guggcgaguccagaca

SEQ ID NO: 2025481 - RNA, 23 nt, Homo sapiens
uacccacacacauacacacauau

SEQ ID NO: 2025482 - RNA, 16 nt, Homo sapiens
augugcauaguuucuu

SEQ ID NO: 2025483 - RNA, 18 nt, Homo sapiens
aaaaccaacaaugugauu

SEQ ID NO: 2025484 - RNA, 19 nt, Homo sapiens
agccuccuuucuggcuuug

SEQ ID NO: 2025485 - RNA, 14 nt, Homo sapiens
cauguucauucaca

SEQ ID NO: 2025486 - RNA, 12 nt, Homo sapiens
uuguugucuaaa

SEQ ID NO: 2025487 - RNA, 15 nt, Homo sapiens
uguuacagcuacuau

SEQ ID NO: 2025488 - RNA, 15 nt, Homo sapiens
cacaguuuugccuua

SEQ ID NO: 2025489 - RNA, 16 nt, Homo sapiens
gggaacacgugugcac

SEQ ID NO: 2025490 - RNA, 22 nt, Homo sapiens
auauacauuagacacacauaua

SEQ ID NO: 2025491 - RNA, 22 nt, Homo sapiens
ugaaaagagaaacuuaaaugaa

SEQ ID NO: 2025492 - RNA, 13 nt, Homo sapiens
gcagcaggugcaa

SEQ ID NO: 2025493 - RNA, 23 nt, Homo sapiens
cauuaucuuugcuguuauugaca

SEQ ID NO: 2025494 - RNA, 14 nt, Homo sapiens
gugguccacugagc

SEQ ID NO: 2025495 - RNA, 17 nt, Homo sapiens
aagcccauagcacuggg

SEQ ID NO: 2025496 - RNA, 21 nt, Homo sapiens
acacaggccagcuccacagug

SEQ ID NO: 2025497 - RNA, 21 nt, Homo sapiens
uccuacuuagggaagaaaaag

SEQ ID NO: 2025498 - RNA, 18 nt, Homo sapiens
gaugcauguucaaaccaa

SEQ ID NO: 2025499 - RNA, 15 nt, Homo sapiens
uggacuuauucauuc

SEQ ID NO: 2025500 - RNA, 19 nt, Homo sapiens
cugaccagcagcgccuuuc

SEQ ID NO: 2025501 - RNA, 15 nt, Homo sapiens
ucgaacuuuuuccaa

SEQ ID NO: 2025502 - RNA, 14 nt, Homo sapiens
ccccugcuccagaa

SEQ ID NO: 2025503 - RNA, 23 nt, Homo sapiens
uuuuaaaagguagagucuuacaa

SEQ ID NO: 2025504 - RNA, 15 nt, Homo sapiens
auuauuauucaaaaa

SEQ ID NO: 2025505 - RNA, 14 nt, Homo sapiens
uguguucacuacau

SEQ ID NO: 2025506 - RNA, 14 nt, Homo sapiens
cuucuccaugagac

SEQ ID NO: 2025507 - RNA, 22 nt, Homo sapiens
gacugcacccaggaggggaaca

SEQ ID NO: 2025508 - RNA, 14 nt, Homo sapiens
uauccuuagcucac

SEQ ID NO: 2025509 - RNA, 12 nt, Homo sapiens
agcugucugcuc

SEQ ID NO: 2025510 - RNA, 22 nt, Homo sapiens
cauuuaguuugauuauucagug

SEQ ID NO: 2025511 - RNA, 19 nt, Homo sapiens
ccaccaggccucacuggcu

SEQ ID NO: 2025512 - RNA, 14 nt, Homo sapiens
acauuucuauuuca

SEQ ID NO: 2025513 - RNA, 17 nt, Homo sapiens
uacauuuacugugagcu

SEQ ID NO: 2025514 - RNA, 17 nt, Homo sapiens
gcacaaagacacagacu

SEQ ID NO: 2025515 - RNA, 18 nt, Homo sapiens
guuucaagcuaccuucau

SEQ ID NO: 2025516 - RNA, 16 nt, Homo sapiens
cagccuugaacucugg

SEQ ID NO: 2025517 - RNA, 16 nt, Homo sapiens
aaccuugucaguuuuu

SEQ ID NO: 2025518 - RNA, 11 nt, Homo sapiens
gggugcuccug

SEQ ID NO: 2025519 - RNA, 18 nt, Homo sapiens
gcuguguucacacuguaa

SEQ ID NO: 2025520 - RNA, 20 nt, Homo sapiens
ucucggcuuauggcaaccuc

SEQ ID NO: 2025521 - RNA, 12 nt, Homo sapiens
gcuaggccagag

SEQ ID NO: 2025522 - RNA, 14 nt, Homo sapiens
aucccagcaucuca

SEQ ID NO: 2025523 - RNA, 21 nt, Homo sapiens
cugccuuuguugaggugcaag

SEQ ID NO: 2025524 - RNA, 18 nt, Homo sapiens
ugugucaugcaugaagga

SEQ ID NO: 2025525 - RNA, 21 nt, Homo sapiens
gccggcccgccucuccucggu

SEQ ID NO: 2025526 - RNA, 21 nt, Homo sapiens
ugucaaagcauugagaucucc

SEQ ID NO: 2025527 - RNA, 23 nt, Homo sapiens
gcaaggauccugugcugcugucu

SEQ ID NO: 2025528 - RNA, 13 nt, Homo sapiens
uccuuauguuaag

SEQ ID NO: 2025529 - RNA, 15 nt, Homo sapiens
agggugcccucugcu

SEQ ID NO: 2025530 - RNA, 16 nt, Homo sapiens
gaccauccuauuuaac

SEQ ID NO: 2025531 - RNA, 19 nt, Homo sapiens
cucaguaaggcagugcagu

SEQ ID NO: 2025532 - RNA, 10 nt, Homo sapiens
gcccuuccag

SEQ ID NO: 2025533 - RNA, 16 nt, Homo sapiens
caggcaggcaccuggg

SEQ ID NO: 2025534 - RNA, 20 nt, Homo sapiens
uuaauuucaaucaaccaaag

SEQ ID NO: 2025535 - RNA, 19 nt, Homo sapiens
cuuuccaaugccacagaca

SEQ ID NO: 2025536 - RNA, 12 nt, Homo sapiens
gaaagcugugaa

SEQ ID NO: 2025537 - RNA, 13 nt, Homo sapiens
cccagaacaugga

SEQ ID NO: 2025538 - RNA, 13 nt, Homo sapiens
aacugccauaaca

SEQ ID NO: 2025539 - RNA, 20 nt, Homo sapiens
ggagguggagauugcaguga

SEQ ID NO: 2025540 - RNA, 16 nt, Homo sapiens
aaucuacgucuuuauu

SEQ ID NO: 2025541 - RNA, 20 nt, Homo sapiens
gccaaggagggugagugcaa

SEQ ID NO: 2025542 - RNA, 13 nt, Homo sapiens
ugcccaucauccc

SEQ ID NO: 2025543 - RNA, 15 nt, Homo sapiens
cacccgacuuuggaa

SEQ ID NO: 2025544 - RNA, 23 nt, Homo sapiens
gaauuacuuguguuacuugccaa

SEQ ID NO: 2025545 - RNA, 21 nt, Homo sapiens
cugggccguuacaucugugca

SEQ ID NO: 2025546 - RNA, 22 nt, Homo sapiens
cacagaucacacacaugcacac

SEQ ID NO: 2025547 - RNA, 18 nt, Homo sapiens
aagguuaaaaaguucaua

SEQ ID NO: 2025548 - RNA, 23 nt, Homo sapiens
uuagaaaugacugcauuugauau

SEQ ID NO: 2025549 - RNA, 19 nt, Homo sapiens
ggcaugccaaauguuccau

SEQ ID NO: 2025550 - RNA, 12 nt, Homo sapiens
ucacaccacagg

SEQ ID NO: 2025551 - RNA, 19 nt, Homo sapiens
ccguuugcuuaaugccaga

SEQ ID NO: 2025552 - RNA, 12 nt, Homo sapiens
ucacacccugac

SEQ ID NO: 2025553 - RNA, 17 nt, Homo sapiens
uagccgcccaugcacug

SEQ ID NO: 2025554 - RNA, 19 nt, Homo sapiens
caggacagguggugcaaau

SEQ ID NO: 2025555 - RNA, 22 nt, Homo sapiens
uccacaccugcggcccaaucca

SEQ ID NO: 2025556 - RNA, 12 nt, Homo sapiens
gaccgugcagcu

SEQ ID NO: 2025557 - RNA, 21 nt, Homo sapiens
cucuuaucucagucaugcaua

SEQ ID NO: 2025558 - RNA, 15 nt, Homo sapiens
accauucuacugugu

SEQ ID NO: 2025559 - RNA, 20 nt, Homo sapiens
uggcccauagaaacaugaca

SEQ ID NO: 2025560 - RNA, 17 nt, Homo sapiens
aggauuccuucuucccc

SEQ ID NO: 2025561 - RNA, 18 nt, Homo sapiens
agauaagaaaugaucuuu

SEQ ID NO: 2025562 - RNA, 16 nt, Homo sapiens
auguguaaagauuuau

SEQ ID NO: 2025563 - RNA, 15 nt, Homo sapiens
acguggagcugcuca

SEQ ID NO: 2025564 - RNA, 14 nt, Homo sapiens
ugguugaauaaagc

SEQ ID NO: 2025565 - RNA, 21 nt, Homo sapiens
aguagcuccgcgugucucauu

SEQ ID NO: 2025566 - RNA, 13 nt, Homo sapiens
aaguaauuuacaa

SEQ ID NO: 2025567 - RNA, 15 nt, Homo sapiens
guaguaccccaagaa

SEQ ID NO: 2025568 - RNA, 18 nt, Homo sapiens
ucccacuuccuccuaccu

SEQ ID NO: 2025569 - RNA, 17 nt, Homo sapiens
ccucauuuauacuauua

SEQ ID NO: 2025570 - RNA, 21 nt, Homo sapiens
aaauucccucuggaguuucau

SEQ ID NO: 2025571 - RNA, 17 nt, Homo sapiens
aggucuguggugcagug

SEQ ID NO: 2025572 - RNA, 12 nt, Homo sapiens
agugacagucag

SEQ ID NO: 2025573 - RNA, 21 nt, Homo sapiens
uuacagagaggagaaacacau

SEQ ID NO: 2025574 - RNA, 10 nt, Homo sapiens
uaaugcugug

SEQ ID NO: 2025575 - RNA, 13 nt, Homo sapiens
aauaacauggccu

SEQ ID NO: 2025576 - RNA, 20 nt, Homo sapiens
uuacucauugcccccaccuc

SEQ ID NO: 2025577 - RNA, 23 nt, Homo sapiens
cagugguauccugugacauguaa

SEQ ID NO: 2025578 - RNA, 23 nt, Homo sapiens
aaaaaccaucaaguugugccaaa

SEQ ID NO: 2025579 - RNA, 19 nt, Homo sapiens
uugauugaguucaucauga

SEQ ID NO: 2025580 - RNA, 18 nt, Homo sapiens
agucauuugaggaucuca

SEQ ID NO: 2025581 - RNA, 18 nt, Homo sapiens
cguaaacgacacucucug

SEQ ID NO: 2025582 - RNA, 15 nt, Homo sapiens
accgagacacuuuau

SEQ ID NO: 2025583 - RNA, 16 nt, Homo sapiens
uuguguaauacuucau

SEQ ID NO: 2025584 - RNA, 15 nt, Homo sapiens
gaauuuaaaaucaua

SEQ ID NO: 2025585 - RNA, 19 nt, Homo sapiens
gggcgcacuuuccacugga

SEQ ID NO: 2025586 - RNA, 13 nt, Homo sapiens
ggcuuggggacca

SEQ ID NO: 2025587 - RNA, 13 nt, Homo sapiens
cuaugaagacauc

SEQ ID NO: 2025588 - RNA, 13 nt, Homo sapiens
gauucaacacaua

SEQ ID NO: 2025589 - RNA, 22 nt, Homo sapiens
aacuuucauuuuuuuccaggcu

SEQ ID NO: 2025590 - RNA, 22 nt, Homo sapiens
agguaggcauucugagcagggg

SEQ ID NO: 2025591 - RNA, 18 nt, Homo sapiens
aaaauguacauacuaugu

SEQ ID NO: 2025592 - RNA, 17 nt, Homo sapiens
aucucaaccauccccuc

SEQ ID NO: 2025593 - RNA, 22 nt, Homo sapiens
auuugaaccagugauccauguc

SEQ ID NO: 2025594 - RNA, 15 nt, Homo sapiens
uaaaaugugugccau

SEQ ID NO: 2025595 - RNA, 18 nt, Homo sapiens
auugguccaacaguuuga

SEQ ID NO: 2025596 - RNA, 18 nt, Homo sapiens
augcagauuauuugccca

SEQ ID NO: 2025597 - RNA, 15 nt, Homo sapiens
auugacgcauauuua

SEQ ID NO: 2025598 - RNA, 10 nt, Homo sapiens
ggccucagaa

SEQ ID NO: 2025599 - RNA, 17 nt, Homo sapiens
aaagacaggcaaacggc

SEQ ID NO: 2025600 - RNA, 17 nt, Homo sapiens
aaugugaccuggggcag

SEQ ID NO: 2025601 - RNA, 14 nt, Homo sapiens
aaagaaaacaugag

SEQ ID NO: 2025602 - RNA, 15 nt, Homo sapiens
gucaccaucucaggc

SEQ ID NO: 2025603 - RNA, 15 nt, Homo sapiens
uuaaacagugcuuug

SEQ ID NO: 2025604 - RNA, 22 nt, Homo sapiens
ucuaacauauucaaugcaagua

SEQ ID NO: 2025605 - RNA, 19 nt, Homo sapiens
cauuuuccuucaccgugac

SEQ ID NO: 2025606 - RNA, 23 nt, Homo sapiens
cucccaggguggacuucagugug

SEQ ID NO: 2025607 - RNA, 12 nt, Homo sapiens
cugcucuugcag

SEQ ID NO: 2025608 - RNA, 13 nt, Homo sapiens
cacuucauucccc

SEQ ID NO: 2025609 - RNA, 13 nt, Homo sapiens
caauucauucacc

SEQ ID NO: 2025610 - RNA, 22 nt, Homo sapiens
auccauuucaggacucucucca

SEQ ID NO: 2025611 - RNA, 16 nt, Homo sapiens
ugucauggugcaauuu

SEQ ID NO: 2025612 - RNA, 19 nt, Homo sapiens
uaacauaugcaaacauaac

SEQ ID NO: 2025613 - RNA, 17 nt, Homo sapiens
cucuuugcugcacuauu

SEQ ID NO: 2025614 - RNA, 16 nt, Homo sapiens
ucaugguacuacccca

SEQ ID NO: 2025615 - RNA, 21 nt, Homo sapiens
cuggaucaagggguucccacu

SEQ ID NO: 2025616 - RNA, 14 nt, Homo sapiens
acaugugagccaaa

SEQ ID NO: 2025617 - RNA, 16 nt, Homo sapiens
uccuucaagcugcuga

SEQ ID NO: 2025618 - RNA, 16 nt, Homo sapiens
gcauugaaaugagcac

SEQ ID NO: 2025619 - RNA, 20 nt, Homo sapiens
aaugagggcgugaaacacaa

SEQ ID NO: 2025620 - RNA, 15 nt, Homo sapiens
gaaaccccacuucca

SEQ ID NO: 2025621 - RNA, 19 nt, Homo sapiens
gagucacugccaagucaua

SEQ ID NO: 2025622 - RNA, 18 nt, Homo sapiens
uuaaaacuucaaauaucu

SEQ ID NO: 2025623 - RNA, 14 nt, Homo sapiens
ccauuuuacagagg

SEQ ID NO: 2025624 - RNA, 23 nt, Homo sapiens
acagucauuaauuuucaacucaa

SEQ ID NO: 2025625 - RNA, 19 nt, Homo sapiens
auaacaucucuuucaucua

SEQ ID NO: 2025626 - RNA, 13 nt, Homo sapiens
cacaggacaugcu

SEQ ID NO: 2025627 - RNA, 17 nt, Homo sapiens
acugucucuccagugaa

SEQ ID NO: 2025628 - RNA, 11 nt, Homo sapiens
gagaaaaccuu

SEQ ID NO: 2025629 - RNA, 13 nt, Homo sapiens
cccucaacaggcc

SEQ ID NO: 2025630 - RNA, 14 nt, Homo sapiens
ggaauuuggaguga

SEQ ID NO: 2025631 - RNA, 12 nt, Homo sapiens
uauauauacaua

SEQ ID NO: 2025632 - RNA, 12 nt, Homo sapiens
cuaauauauuaa

SEQ ID NO: 2025633 - RNA, 16 nt, Homo sapiens
cucccugguugccucu

SEQ ID NO: 2025634 - RNA, 15 nt, Homo sapiens
cccuuacauguccuc

SEQ ID NO: 2025635 - RNA, 21 nt, Homo sapiens
aggcaguugagaaaauuugaa

SEQ ID NO: 2025636 - RNA, 17 nt, Homo sapiens
uucagauaacuguuauu

SEQ ID NO: 2025637 - RNA, 17 nt, Homo sapiens
acacaguaaaagcagga

SEQ ID NO: 2025638 - RNA, 15 nt, Homo sapiens
aacaaucuuagacau

SEQ ID NO: 2025639 - RNA, 17 nt, Homo sapiens
uaagaagugacucuugc

SEQ ID NO: 2025640 - RNA, 21 nt, Homo sapiens
aguccacagaagugagcuccu

SEQ ID NO: 2025641 - RNA, 21 nt, Homo sapiens
ucugagccagucccucagcca

SEQ ID NO: 2025642 - RNA, 17 nt, Homo sapiens
ccuggccgccuccagga

SEQ ID NO: 2025643 - RNA, 14 nt, Homo sapiens
caagcgaccaagga

SEQ ID NO: 2025644 - RNA, 15 nt, Homo sapiens
uguuggcuucucaau

SEQ ID NO: 2025645 - RNA, 19 nt, Homo sapiens
cauagugaccuguguuuca

SEQ ID NO: 2025646 - RNA, 15 nt, Homo sapiens
cagagcuaguuuuca

SEQ ID NO: 2025647 - RNA, 16 nt, Homo sapiens
gauucuucccauucuc

SEQ ID NO: 2025648 - RNA, 20 nt, Homo sapiens
aucucugugauuaccucuca

SEQ ID NO: 2025649 - RNA, 17 nt, Homo sapiens
cagaaaacaaaucuuca

SEQ ID NO: 2025650 - RNA, 17 nt, Homo sapiens
uacuuccuaaauuucag

SEQ ID NO: 2025651 - RNA, 17 nt, Homo sapiens
agccugagcagagacau

SEQ ID NO: 2025652 - RNA, 20 nt, Homo sapiens
agaagcuaauguaggacugu

SEQ ID NO: 2025653 - RNA, 13 nt, Homo sapiens
aacacuggugcca

SEQ ID NO: 2025654 - RNA, 18 nt, Homo sapiens
aagugguagaaacuuuaa

SEQ ID NO: 2025655 - RNA, 21 nt, Homo sapiens
cugucauuccaugagucuuca

SEQ ID NO: 2025656 - RNA, 17 nt, Homo sapiens
aggcaguuuagugcauc

SEQ ID NO: 2025657 - RNA, 21 nt, Homo sapiens
agauuacaggugugagccacu

SEQ ID NO: 2025658 - RNA, 18 nt, Homo sapiens
uggacuguuuccugagua

SEQ ID NO: 2025659 - RNA, 14 nt, Homo sapiens
aaguccuaucucau

SEQ ID NO: 2025660 - RNA, 16 nt, Homo sapiens
agagguugcaaugagc

SEQ ID NO: 2025661 - RNA, 13 nt, Homo sapiens
cugaugcuguaca

SEQ ID NO: 2025662 - RNA, 20 nt, Homo sapiens
cauacaaauucuacuuuaau

SEQ ID NO: 2025663 - RNA, 21 nt, Homo sapiens
ucauagugauagagugcagug

SEQ ID NO: 2025664 - RNA, 19 nt, Homo sapiens
aaucaccaaggcugauuaa

SEQ ID NO: 2025665 - RNA, 19 nt, Homo sapiens
uuaauaaaauaauucucaa

SEQ ID NO: 2025666 - RNA, 23 nt, Homo sapiens
ccuguuuucuuaggcacugaggg

SEQ ID NO: 2025667 - RNA, 22 nt, Homo sapiens
gaaacccuguuuuauugaguuc

SEQ ID NO: 2025668 - RNA, 22 nt, Homo sapiens
acaaugcaucauaaaacaaauc

SEQ ID NO: 2025669 - RNA, 17 nt, Homo sapiens
accauuaagucaugugu

SEQ ID NO: 2025670 - RNA, 15 nt, Homo sapiens
ugaaccaguccugcu

SEQ ID NO: 2025671 - RNA, 11 nt, Homo sapiens
gaaacuaauaa

SEQ ID NO: 2025672 - RNA, 15 nt, Homo sapiens
uacuuuuuguaaaaa

SEQ ID NO: 2025673 - RNA, 15 nt, Homo sapiens
uaaaauuugucuuaa

SEQ ID NO: 2025674 - RNA, 14 nt, Homo sapiens
cacacaugcauccu

SEQ ID NO: 2025675 - RNA, 18 nt, Homo sapiens
cucucuauagcaccaggg

SEQ ID NO: 2025676 - RNA, 13 nt, Homo sapiens
accugcuggugag

SEQ ID NO: 2025677 - RNA, 14 nt, Homo sapiens
cugagguacagaga

SEQ ID NO: 2025678 - RNA, 15 nt, Homo sapiens
aaaaacccugcuaaa

SEQ ID NO: 2025679 - RNA, 22 nt, Homo sapiens
uaugaugaugaaaauuuuacca

SEQ ID NO: 2025680 - RNA, 21 nt, Homo sapiens
uaagguacacacuuucauuua

SEQ ID NO: 2025681 - RNA, 20 nt, Homo sapiens
aaugggcacagcacagccag

SEQ ID NO: 2025682 - RNA, 18 nt, Homo sapiens
ccagagagcaacucugag

SEQ ID NO: 2025683 - RNA, 13 nt, Homo sapiens
gcaguauccagaa

SEQ ID NO: 2025684 - RNA, 16 nt, Homo sapiens
agaacauucuaccaaa

SEQ ID NO: 2025685 - RNA, 21 nt, Homo sapiens
ugccauauguggaacaagcag

SEQ ID NO: 2025686 - RNA, 12 nt, Homo sapiens
aucaagauauau

SEQ ID NO: 2025687 - RNA, 18 nt, Homo sapiens
ggcugggcaccguguccu

SEQ ID NO: 2025688 - RNA, 16 nt, Homo sapiens
cuacuucucagucccc

SEQ ID NO: 2025689 - RNA, 18 nt, Homo sapiens
ccccagaguagcuggaau

SEQ ID NO: 2025690 - RNA, 14 nt, Homo sapiens
aaguccagcuuucu

SEQ ID NO: 2025691 - RNA, 21 nt, Homo sapiens
auuuguccuuggggacaucuc

SEQ ID NO: 2025692 - RNA, 12 nt, Homo sapiens
aagauaaagguu

SEQ ID NO: 2025693 - RNA, 13 nt, Homo sapiens
ggggcuguggaug

SEQ ID NO: 2025694 - RNA, 19 nt, Homo sapiens
gaaaacacuguuucuggua

SEQ ID NO: 2025695 - RNA, 20 nt, Homo sapiens
gccgggcaggguguggggcc

SEQ ID NO: 2025696 - RNA, 19 nt, Homo sapiens
uucaugugguucagugccu

SEQ ID NO: 2025697 - RNA, 17 nt, Homo sapiens
ccuugaggauuguggaa

SEQ ID NO: 2025698 - RNA, 19 nt, Homo sapiens
ccaaaugaugccacuuccc

SEQ ID NO: 2025699 - RNA, 16 nt, Homo sapiens
gauaauacagauuugu

SEQ ID NO: 2025700 - RNA, 15 nt, Homo sapiens
augucuuucagccaa

SEQ ID NO: 2025701 - RNA, 15 nt, Homo sapiens
acugacccugaggag

SEQ ID NO: 2025702 - RNA, 22 nt, Homo sapiens
auuucucccuucaauccuguca

SEQ ID NO: 2025703 - RNA, 20 nt, Homo sapiens
acucucugguuuacuucaaa

SEQ ID NO: 2025704 - RNA, 24 nt, Homo sapiens
gccuggagacuuccuaugugugca

SEQ ID NO: 2025705 - RNA, 11 nt, Homo sapiens
uaaugggaccc

SEQ ID NO: 2025706 - RNA, 13 nt, Homo sapiens
ccacaucugccag

SEQ ID NO: 2025707 - RNA, 15 nt, Homo sapiens
uuuaauuacaaugga

SEQ ID NO: 2025708 - RNA, 20 nt, Homo sapiens
cugcccugcccccucggggg

SEQ ID NO: 2025709 - RNA, 15 nt, Homo sapiens
gacacauacauguca

SEQ ID NO: 2025710 - RNA, 20 nt, Homo sapiens
uuucagguaaauaaaucuau

SEQ ID NO: 2025711 - RNA, 16 nt, Homo sapiens
gagugcaguggcucaa

SEQ ID NO: 2025712 - RNA, 17 nt, Homo sapiens
ccuuucuuucuuccuuc

SEQ ID NO: 2025713 - RNA, 12 nt, Homo sapiens
ugagcugugagu

SEQ ID NO: 2025714 - RNA, 17 nt, Homo sapiens
augucuauauguuuauu

SEQ ID NO: 2025715 - RNA, 20 nt, Homo sapiens
uauguaguccguuaacacua

SEQ ID NO: 2025716 - RNA, 21 nt, Homo sapiens
cuucaagccuggcccagugag

SEQ ID NO: 2025717 - RNA, 19 nt, Homo sapiens
accgggcuggccugacaca

SEQ ID NO: 2025718 - RNA, 14 nt, Homo sapiens
agccugcacagugg

SEQ ID NO: 2025719 - RNA, 23 nt, Homo sapiens
cauauuuuuauauuauguuaaag

SEQ ID NO: 2025720 - RNA, 20 nt, Homo sapiens
aaugauuuacuggaauuaca

SEQ ID NO: 2025721 - RNA, 13 nt, Homo sapiens
ugccuccagcauu

SEQ ID NO: 2025722 - RNA, 12 nt, Homo sapiens
gaaucauugugc

SEQ ID NO: 2025723 - RNA, 19 nt, Homo sapiens
ugucuuuauaaucuacucc

SEQ ID NO: 2025724 - RNA, 20 nt, Homo sapiens
aaccauaggacuguggcaaa

SEQ ID NO: 2025725 - RNA, 17 nt, Homo sapiens
auucugugaccaaaaua

SEQ ID NO: 2025726 - RNA, 15 nt, Homo sapiens
aaaguuaaauugcac

SEQ ID NO: 2025727 - RNA, 16 nt, Homo sapiens
gaaaauauuuuguuaa

SEQ ID NO: 2025728 - RNA, 21 nt, Homo sapiens
gagcacuguuuauacacugug

SEQ ID NO: 2025729 - RNA, 22 nt, Homo sapiens
uccccuugcccagggcucagcc

SEQ ID NO: 2025730 - RNA, 22 nt, Homo sapiens
aaaccauucuuuccccucagga

SEQ ID NO: 2025731 - RNA, 19 nt, Homo sapiens
aaguaccacacauauugca

SEQ ID NO: 2025732 - RNA, 14 nt, Homo sapiens
agcauacaacugga

SEQ ID NO: 2025733 - RNA, 19 nt, Homo sapiens
aaccucuuuucugcaucau

SEQ ID NO: 2025734 - RNA, 21 nt, Homo sapiens
aaauguaggcaucaugcaugu

SEQ ID NO: 2025735 - RNA, 22 nt, Homo sapiens
uauaaugaaaaaggauaaugca

SEQ ID NO: 2025736 - RNA, 17 nt, Homo sapiens
ucacagaguagaaacuc

SEQ ID NO: 2025737 - RNA, 14 nt, Homo sapiens
gcauggcugccucu

SEQ ID NO: 2025738 - RNA, 15 nt, Homo sapiens
caggcagaaggcagu

SEQ ID NO: 2025739 - RNA, 20 nt, Homo sapiens
auuuuaagguugcacacagu

SEQ ID NO: 2025740 - RNA, 12 nt, Homo sapiens
agguucuacccu

SEQ ID NO: 2025741 - RNA, 15 nt, Homo sapiens
agccacacaugggca

SEQ ID NO: 2025742 - RNA, 16 nt, Homo sapiens
ccuucucugaaaacaa

SEQ ID NO: 2025743 - RNA, 18 nt, Homo sapiens
aaccauucccaagccaug

SEQ ID NO: 2025744 - RNA, 19 nt, Homo sapiens
cucuaagcacauuccaaac

SEQ ID NO: 2025745 - RNA, 17 nt, Homo sapiens
cuucucacauccaucua

SEQ ID NO: 2025746 - RNA, 20 nt, Homo sapiens
agaaccaagcacuaccagua

SEQ ID NO: 2025747 - RNA, 18 nt, Homo sapiens
uccgccuuuuguauacau

SEQ ID NO: 2025748 - RNA, 13 nt, Homo sapiens
cuaaaaguacaaa

SEQ ID NO: 2025749 - RNA, 21 nt, Homo sapiens
cuguguauuuaacugccuugu

SEQ ID NO: 2025750 - RNA, 17 nt, Homo sapiens
acuuucucagcauauau

SEQ ID NO: 2025751 - RNA, 19 nt, Homo sapiens
aucaguugcaggugccaau

SEQ ID NO: 2025752 - RNA, 18 nt, Homo sapiens
ggcaucaggaauugucaa

SEQ ID NO: 2025753 - RNA, 15 nt, Homo sapiens
gaaauugaccauaca

SEQ ID NO: 2025754 - RNA, 23 nt, Homo sapiens
guuuauucuuccaacacauuuca

SEQ ID NO: 2025755 - RNA, 23 nt, Homo sapiens
uuugagacggcgcaccuaucacc

SEQ ID NO: 2025756 - RNA, 16 nt, Homo sapiens
guagguggaucaccug

SEQ ID NO: 2025757 - RNA, 12 nt, Homo sapiens
gacacacuggug

SEQ ID NO: 2025758 - RNA, 20 nt, Homo sapiens
agccuggcuauacagugcau

SEQ ID NO: 2025759 - RNA, 21 nt, Homo sapiens
caacagaaguauuucugugga

SEQ ID NO: 2025760 - RNA, 21 nt, Homo sapiens
ucugagauuuuugauaucuca

SEQ ID NO: 2025761 - RNA, 23 nt, Homo sapiens
uacaaguagguuuacauuacuga

SEQ ID NO: 2025762 - RNA, 14 nt, Homo sapiens
ucacugcaaaacca

SEQ ID NO: 2025763 - RNA, 11 nt, Homo sapiens
cuucaccucac

SEQ ID NO: 2025764 - RNA, 12 nt, Homo sapiens
ggggaagccaga

SEQ ID NO: 2025765 - RNA, 21 nt, Homo sapiens
aggcauggucugcccucugca

SEQ ID NO: 2025766 - RNA, 15 nt, Homo sapiens
ucauaggucccugac

SEQ ID NO: 2025767 - RNA, 15 nt, Homo sapiens
cuucuuacuggugcu

SEQ ID NO: 2025768 - RNA, 14 nt, Homo sapiens
ugcagagagaucau

SEQ ID NO: 2025769 - RNA, 15 nt, Homo sapiens
uguaaucccagcuau

SEQ ID NO: 2025770 - RNA, 14 nt, Homo sapiens
accugcucacaggg

SEQ ID NO: 2025771 - RNA, 16 nt, Homo sapiens
auuuagauuuaucacu

SEQ ID NO: 2025772 - RNA, 15 nt, Homo sapiens
cagcccaaagcugca

SEQ ID NO: 2025773 - RNA, 22 nt, Homo sapiens
ugagaccuugcuaagcacucua

SEQ ID NO: 2025774 - RNA, 19 nt, Homo sapiens
ccaaguaaaauauuaacau

SEQ ID NO: 2025775 - RNA, 20 nt, Homo sapiens
auguggacuuauucauuccu

SEQ ID NO: 2025776 - RNA, 16 nt, Homo sapiens
aaucaggcaguucccu

SEQ ID NO: 2025777 - RNA, 15 nt, Homo sapiens
cauccaaacucagaa

SEQ ID NO: 2025778 - RNA, 12 nt, Homo sapiens
ucuaccaagaac

SEQ ID NO: 2025779 - RNA, 23 nt, Homo sapiens
ugcucuugaaccugugcucauuu

SEQ ID NO: 2025780 - RNA, 15 nt, Homo sapiens
gggguccugauuuca

SEQ ID NO: 2025781 - RNA, 14 nt, Homo sapiens
gaaacccucuguca

SEQ ID NO: 2025782 - RNA, 15 nt, Homo sapiens
auaugacacaucucu

SEQ ID NO: 2025783 - RNA, 14 nt, Homo sapiens
cagcaaaucacgac

SEQ ID NO: 2025784 - RNA, 12 nt, Homo sapiens
cuuggugauuga

SEQ ID NO: 2025785 - RNA, 20 nt, Homo sapiens
aauagcuauauccauguacu

SEQ ID NO: 2025786 - RNA, 13 nt, Homo sapiens
acaccccacaggc

SEQ ID NO: 2025787 - RNA, 14 nt, Homo sapiens
gaagagucaugugg

SEQ ID NO: 2025788 - RNA, 16 nt, Homo sapiens
cugcauuuacagugua

SEQ ID NO: 2025789 - RNA, 20 nt, Homo sapiens
gacaggcucugcuucuccaa

SEQ ID NO: 2025790 - RNA, 17 nt, Homo sapiens
uucaucacacacugaga

SEQ ID NO: 2025791 - RNA, 17 nt, Homo sapiens
uguacauuugagugucu

SEQ ID NO: 2025792 - RNA, 19 nt, Homo sapiens
cacguuccacgacagauga

SEQ ID NO: 2025793 - RNA, 20 nt, Homo sapiens
ucacaaaaaaacuguuauca

SEQ ID NO: 2025794 - RNA, 20 nt, Homo sapiens
agcugaacacaagcaaaccu

SEQ ID NO: 2025795 - RNA, 20 nt, Homo sapiens
ucugcuagguagaggcauuu

SEQ ID NO: 2025796 - RNA, 16 nt, Homo sapiens
cuauugaaauuacuga

SEQ ID NO: 2025797 - RNA, 19 nt, Homo sapiens
ggagcccccucuuccacuc

SEQ ID NO: 2025798 - RNA, 15 nt, Homo sapiens
gaacaggacaugggg

SEQ ID NO: 2025799 - RNA, 17 nt, Homo sapiens
gaaauuaccagauauaa

SEQ ID NO: 2025800 - RNA, 17 nt, Homo sapiens
gucauuuccuaugcaaa

SEQ ID NO: 2025801 - RNA, 22 nt, Homo sapiens
cccauguuagcuccaaagcauu

SEQ ID NO: 2025802 - RNA, 19 nt, Homo sapiens
aaaucaaauaugcaaagca

SEQ ID NO: 2025803 - RNA, 21 nt, Homo sapiens
ucuucuccugccuaauuuuga

SEQ ID NO: 2025804 - RNA, 16 nt, Homo sapiens
cugaaagggcacuuaa

SEQ ID NO: 2025805 - RNA, 20 nt, Homo sapiens
uuaauauuugcacaugggau

SEQ ID NO: 2025806 - RNA, 22 nt, Homo sapiens
ucaaaguggaaaggaucacaga

SEQ ID NO: 2025807 - RNA, 14 nt, Homo sapiens
agugugugugcaau

SEQ ID NO: 2025808 - RNA, 16 nt, Homo sapiens
cugagaacuccugacu

SEQ ID NO: 2025809 - RNA, 14 nt, Homo sapiens
uuaaaauucuccug

SEQ ID NO: 2025810 - RNA, 13 nt, Homo sapiens
cuaauuaggguac

SEQ ID NO: 2025811 - RNA, 18 nt, Homo sapiens
acaucaacauuccaggga

SEQ ID NO: 2025812 - RNA, 16 nt, Homo sapiens
gagacaugcugacuuu

SEQ ID NO: 2025813 - RNA, 12 nt, Homo sapiens
acaugcaggcug

SEQ ID NO: 2025814 - RNA, 18 nt, Homo sapiens
cuaccucaggcagcucaa

SEQ ID NO: 2025815 - RNA, 17 nt, Homo sapiens
caaaauaaagugacaga

SEQ ID NO: 2025816 - RNA, 21 nt, Homo sapiens
ugucaagaugaugaugaucuu

SEQ ID NO: 2025817 - RNA, 21 nt, Homo sapiens
ucuauuucacuggagcacaau

SEQ ID NO: 2025818 - RNA, 17 nt, Homo sapiens
uaacauucccacugcca

SEQ ID NO: 2025819 - RNA, 18 nt, Homo sapiens
ccacuggcccuguuucuc

SEQ ID NO: 2025820 - RNA, 15 nt, Homo sapiens
aguuucacaugagcu

SEQ ID NO: 2025821 - RNA, 19 nt, Homo sapiens
uuuaauggcccccaaaauc

SEQ ID NO: 2025822 - RNA, 20 nt, Homo sapiens
aaaggaacaaaacaacacaa

SEQ ID NO: 2025823 - RNA, 18 nt, Homo sapiens
cagggccccucuacccac

SEQ ID NO: 2025824 - RNA, 16 nt, Homo sapiens
aaagcugggauuucag

SEQ ID NO: 2025825 - RNA, 17 nt, Homo sapiens
ccagggaggcagccuag

SEQ ID NO: 2025826 - RNA, 15 nt, Homo sapiens
augucauagccaaag

SEQ ID NO: 2025827 - RNA, 15 nt, Homo sapiens
gaaauucucugcgau

SEQ ID NO: 2025828 - RNA, 19 nt, Homo sapiens
cuugaagacaacucugaaa

SEQ ID NO: 2025829 - RNA, 14 nt, Homo sapiens
cucuacugcuaaau

SEQ ID NO: 2025830 - RNA, 14 nt, Homo sapiens
uaaaucuguacuuu

SEQ ID NO: 2025831 - RNA, 12 nt, Homo sapiens
aaaaaagucaga

SEQ ID NO: 2025832 - RNA, 17 nt, Homo sapiens
auccuacauaauaccca

SEQ ID NO: 2025833 - RNA, 12 nt, Homo sapiens
uaaagcaaauuu

SEQ ID NO: 2025834 - RNA, 22 nt, Homo sapiens
aggcacaggcuccuguauuuga

SEQ ID NO: 2025835 - RNA, 17 nt, Homo sapiens
auacagagguccugcca

SEQ ID NO: 2025836 - RNA, 17 nt, Homo sapiens
gauuauuuaaaugggaa

SEQ ID NO: 2025837 - RNA, 23 nt, Homo sapiens
guaaucuauguauauacauuuau

SEQ ID NO: 2025838 - RNA, 22 nt, Homo sapiens
cuggcuguguugucagcacugu

SEQ ID NO: 2025839 - RNA, 15 nt, Homo sapiens
cuaucacacaguggg

SEQ ID NO: 2025840 - RNA, 18 nt, Homo sapiens
agauuucucaagaaggaa

SEQ ID NO: 2025841 - RNA, 20 nt, Homo sapiens
guagucccagcuacuuggga

SEQ ID NO: 2025842 - RNA, 17 nt, Homo sapiens
uccaggguguagccuac

SEQ ID NO: 2025843 - RNA, 21 nt, Homo sapiens
aauacauaccuacugacugau

SEQ ID NO: 2025844 - RNA, 18 nt, Homo sapiens
ccacccugccucuaccca

SEQ ID NO: 2025845 - RNA, 13 nt, Homo sapiens
agccacacuugaa

SEQ ID NO: 2025846 - RNA, 19 nt, Homo sapiens
aggauucaggcagcagugu

SEQ ID NO: 2025847 - RNA, 14 nt, Homo sapiens
guaaggacuguaaa

SEQ ID NO: 2025848 - RNA, 23 nt, Homo sapiens
ccugguucccuccccaaggccac

SEQ ID NO: 2025849 - RNA, 16 nt, Homo sapiens
gugggugcagcuguca

SEQ ID NO: 2025850 - RNA, 13 nt, Homo sapiens
uaaaaccaaagag

SEQ ID NO: 2025851 - RNA, 20 nt, Homo sapiens
gacaagguucccaagacaau

SEQ ID NO: 2025852 - RNA, 16 nt, Homo sapiens
gggcaggcugggccau

SEQ ID NO: 2025853 - RNA, 21 nt, Homo sapiens
auuuuggggagacaaagggaa

SEQ ID NO: 2025854 - RNA, 13 nt, Homo sapiens
ccacuaaaacaca

SEQ ID NO: 2025855 - RNA, 22 nt, Homo sapiens
ccaucuugaucuuugagcccau

SEQ ID NO: 2025856 - RNA, 11 nt, Homo sapiens
ggcacuggguc

SEQ ID NO: 2025857 - RNA, 15 nt, Homo sapiens
acucuucucggcuca

SEQ ID NO: 2025858 - RNA, 16 nt, Homo sapiens
cucagcagacauccac

SEQ ID NO: 2025859 - RNA, 22 nt, Homo sapiens
aggcaucucccaccagcucuau

SEQ ID NO: 2025860 - RNA, 16 nt, Homo sapiens
uguugacaugggacau

SEQ ID NO: 2025861 - RNA, 20 nt, Homo sapiens
agaucgcgccacugcacugc

SEQ ID NO: 2025862 - RNA, 16 nt, Homo sapiens
acugaugcuucuguca

SEQ ID NO: 2025863 - RNA, 23 nt, Homo sapiens
cuggcuuuuuccucugagcccag

SEQ ID NO: 2025864 - RNA, 18 nt, Homo sapiens
uugguguaguugaacuga

SEQ ID NO: 2025865 - RNA, 16 nt, Homo sapiens
agacgguuuccaggga

SEQ ID NO: 2025866 - RNA, 19 nt, Homo sapiens
uacagaaacaacugccaaa

SEQ ID NO: 2025867 - RNA, 16 nt, Homo sapiens
auaaaguuacuugaau

SEQ ID NO: 2025868 - RNA, 22 nt, Homo sapiens
cagcuucuguccucuucuguga

SEQ ID NO: 2025869 - RNA, 17 nt, Homo sapiens
ccacaggagagacuggu

SEQ ID NO: 2025870 - RNA, 13 nt, Homo sapiens
ggacucauugcuu

SEQ ID NO: 2025871 - RNA, 22 nt, Homo sapiens
caagcacuuuauauuuuccucu

SEQ ID NO: 2025872 - RNA, 14 nt, Homo sapiens
uauuuuucucauga

SEQ ID NO: 2025873 - RNA, 18 nt, Homo sapiens
caguugugaauacauucu

SEQ ID NO: 2025874 - RNA, 19 nt, Homo sapiens
uuaacuguauuucaguauu

SEQ ID NO: 2025875 - RNA, 13 nt, Homo sapiens
aaaacuaagcaca

SEQ ID NO: 2025876 - RNA, 19 nt, Homo sapiens
aaccaccuggucugcaugu

SEQ ID NO: 2025877 - RNA, 19 nt, Homo sapiens
cuaaagguccacaggucua

SEQ ID NO: 2025878 - RNA, 17 nt, Homo sapiens
accugcuggggaccuca

SEQ ID NO: 2025879 - RNA, 18 nt, Homo sapiens
acucuuguugaguucugu

SEQ ID NO: 2025880 - RNA, 21 nt, Homo sapiens
accccggcaggcccugcagug

SEQ ID NO: 2025881 - RNA, 16 nt, Homo sapiens
gguccauacaccagca

SEQ ID NO: 2025882 - RNA, 12 nt, Homo sapiens
aauacuacugua

SEQ ID NO: 2025883 - RNA, 17 nt, Homo sapiens
uuccacuuguguauauu

SEQ ID NO: 2025884 - RNA, 19 nt, Homo sapiens
ugaaagaugauuugcaaug

SEQ ID NO: 2025885 - RNA, 14 nt, Homo sapiens
uuuugcauugccaa

SEQ ID NO: 2025886 - RNA, 15 nt, Homo sapiens
gacuucucuugaauu

SEQ ID NO: 2025887 - RNA, 14 nt, Homo sapiens
auuacaauugucau

SEQ ID NO: 2025888 - RNA, 12 nt, Homo sapiens
ucuuugcugcaa

SEQ ID NO: 2025889 - RNA, 17 nt, Homo sapiens
cagaagcugcccucagc

SEQ ID NO: 2025890 - RNA, 19 nt, Homo sapiens
uaacuuagaaugcuucaag

SEQ ID NO: 2025891 - RNA, 16 nt, Homo sapiens
acuuucucuuggacau

SEQ ID NO: 2025892 - RNA, 22 nt, Homo sapiens
uuuaauggacacuuuucaccuc

SEQ ID NO: 2025893 - RNA, 15 nt, Homo sapiens
agcaaugcaaugugg

SEQ ID NO: 2025894 - RNA, 15 nt, Homo sapiens
gcucauuuacuugaa

SEQ ID NO: 2025895 - RNA, 12 nt, Homo sapiens
uccaggccucag

SEQ ID NO: 2025896 - RNA, 14 nt, Homo sapiens
uucuguguguuccu

SEQ ID NO: 2025897 - RNA, 22 nt, Homo sapiens
agaagcuccauggacgugucug

SEQ ID NO: 2025898 - RNA, 15 nt, Homo sapiens
caaggcaacugugag

SEQ ID NO: 2025899 - RNA, 11 nt, Homo sapiens
gaaaaauaaga

SEQ ID NO: 2025900 - RNA, 23 nt, Homo sapiens
ccaaggaaacuuugccaaauaua

SEQ ID NO: 2025901 - RNA, 15 nt, Homo sapiens
aaaugcucacugggg

SEQ ID NO: 2025902 - RNA, 23 nt, Homo sapiens
uucucuuagggucgcugcauaaa

SEQ ID NO: 2025903 - RNA, 11 nt, Homo sapiens
agaguacaaac

SEQ ID NO: 2025904 - RNA, 13 nt, Homo sapiens
auuggcacugugg

SEQ ID NO: 2025905 - RNA, 13 nt, Homo sapiens
uuggucacagggu

SEQ ID NO: 2025906 - RNA, 23 nt, Homo sapiens
auggaacgcuaaugaaacacagc

SEQ ID NO: 2025907 - RNA, 17 nt, Homo sapiens
acaagagaucuacacau

SEQ ID NO: 2025908 - RNA, 15 nt, Homo sapiens
uaacaggcacuuuga

SEQ ID NO: 2025909 - RNA, 17 nt, Homo sapiens
aauggguguaugaaugg

SEQ ID NO: 2025910 - RNA, 12 nt, Homo sapiens
accccuuuccac

SEQ ID NO: 2025911 - RNA, 18 nt, Homo sapiens
acaaaacuguaacugcau

SEQ ID NO: 2025912 - RNA, 23 nt, Homo sapiens
cuuaacuuggaucauuucuggua

SEQ ID NO: 2025913 - RNA, 16 nt, Homo sapiens
ugaucucaaagcacaa

SEQ ID NO: 2025914 - RNA, 23 nt, Homo sapiens
augacccccgcaaguuugcacuc

SEQ ID NO: 2025915 - RNA, 13 nt, Homo sapiens
agucccauuugac

SEQ ID NO: 2025916 - RNA, 22 nt, Homo sapiens
cuugcugcugcugcacccaacu

SEQ ID NO: 2025917 - RNA, 23 nt, Homo sapiens
uucaaaugggagacucuuugaaa

SEQ ID NO: 2025918 - RNA, 17 nt, Homo sapiens
agcccacagaggacagu

SEQ ID NO: 2025919 - RNA, 21 nt, Homo sapiens
cuucauccaaugcaggcuguu

SEQ ID NO: 2025920 - RNA, 20 nt, Homo sapiens
uuaggauagaauauuuacaa

SEQ ID NO: 2025921 - RNA, 18 nt, Homo sapiens
aaguugauucauauugca

SEQ ID NO: 2025922 - RNA, 17 nt, Homo sapiens
ggaagcaccagccucag

SEQ ID NO: 2025923 - RNA, 18 nt, Homo sapiens
uuuuucccuaucacugaa

SEQ ID NO: 2025924 - RNA, 18 nt, Homo sapiens
cugaugauaauuuaucua

SEQ ID NO: 2025925 - RNA, 12 nt, Homo sapiens
uggcacuggcca

SEQ ID NO: 2025926 - RNA, 14 nt, Homo sapiens
uaauggaaacuguc

SEQ ID NO: 2025927 - RNA, 17 nt, Homo sapiens
aagaaaaaaaaacuggg

SEQ ID NO: 2025928 - RNA, 15 nt, Homo sapiens
cuggugugcucucuu

SEQ ID NO: 2025929 - RNA, 15 nt, Homo sapiens
aaguauacaguucaa

SEQ ID NO: 2025930 - RNA, 21 nt, Homo sapiens
uugccugggauaucacuucau

SEQ ID NO: 2025931 - RNA, 17 nt, Homo sapiens
gcucacuugcucaaaac

SEQ ID NO: 2025932 - RNA, 20 nt, Homo sapiens
ugccuagaaauaucuuucuc

SEQ ID NO: 2025933 - RNA, 13 nt, Homo sapiens
cuuucuaaaucaa

SEQ ID NO: 2025934 - RNA, 20 nt, Homo sapiens
gcugucaggagauggaagag

SEQ ID NO: 2025935 - RNA, 19 nt, Homo sapiens
uuaucaucucaccacacca

SEQ ID NO: 2025936 - RNA, 18 nt, Homo sapiens
agaauuugagugcucuga

SEQ ID NO: 2025937 - RNA, 14 nt, Homo sapiens
caccuccuuggcac

SEQ ID NO: 2025938 - RNA, 12 nt, Homo sapiens
aggucaggagau

SEQ ID NO: 2025939 - RNA, 12 nt, Homo sapiens
gaggcagggaag

SEQ ID NO: 2025940 - RNA, 17 nt, Homo sapiens
acucagggagcauuuaa

SEQ ID NO: 2025941 - RNA, 15 nt, Homo sapiens
agauugaacuuuccc

SEQ ID NO: 2025942 - RNA, 20 nt, Homo sapiens
cucugcuacuccauccugaa

SEQ ID NO: 2025943 - RNA, 17 nt, Homo sapiens
accagagccucagugag

SEQ ID NO: 2025944 - RNA, 19 nt, Homo sapiens
aaguaaagauuaaaaccaa

SEQ ID NO: 2025945 - RNA, 15 nt, Homo sapiens
auuaguuuguggcua

SEQ ID NO: 2025946 - RNA, 13 nt, Homo sapiens
uuauuccaacucc

SEQ ID NO: 2025947 - RNA, 14 nt, Homo sapiens
auccauuaccucca

SEQ ID NO: 2025948 - RNA, 14 nt, Homo sapiens
aguggcugcuucuc

SEQ ID NO: 2025949 - RNA, 22 nt, Homo sapiens
auuucgaagccacagagucucu

SEQ ID NO: 2025950 - RNA, 22 nt, Homo sapiens
guguugauacuguugcacgugu

SEQ ID NO: 2025951 - RNA, 18 nt, Homo sapiens
uuguuaucagauauguga

SEQ ID NO: 2025952 - RNA, 16 nt, Homo sapiens
uguuuuggacuacaua

SEQ ID NO: 2025953 - RNA, 23 nt, Homo sapiens
uuguuauuuucgcacaaugggaa

SEQ ID NO: 2025954 - RNA, 20 nt, Homo sapiens
uagacuuuaaagaauaaagu

SEQ ID NO: 2025955 - RNA, 20 nt, Homo sapiens
aaaucugauuagaaguauaa

SEQ ID NO: 2025956 - RNA, 10 nt, Homo sapiens
ccuguuucau

SEQ ID NO: 2025957 - RNA, 17 nt, Homo sapiens
agauggggccugggcug

SEQ ID NO: 2025958 - RNA, 15 nt, Homo sapiens
uucuuuuaaaccauu

SEQ ID NO: 2025959 - RNA, 13 nt, Homo sapiens
uuccccugcugac

SEQ ID NO: 2025960 - RNA, 21 nt, Homo sapiens
cuguauuauaauaagcaaaaa

SEQ ID NO: 2025961 - RNA, 16 nt, Homo sapiens
cucauaaaguagauua

SEQ ID NO: 2025962 - RNA, 18 nt, Homo sapiens
uagaaaugaccaauauua

SEQ ID NO: 2025963 - RNA, 16 nt, Homo sapiens
ucaauuauuacauuua

SEQ ID NO: 2025964 - RNA, 16 nt, Homo sapiens
auaaaguuaaauugca

SEQ ID NO: 2025965 - RNA, 21 nt, Homo sapiens
cagagacucgaguccccauga

SEQ ID NO: 2025966 - RNA, 15 nt, Homo sapiens
aggucucugaacuca

SEQ ID NO: 2025967 - RNA, 14 nt, Homo sapiens
uaguuuuaguucug

SEQ ID NO: 2025968 - RNA, 15 nt, Homo sapiens
uggacauuuguucca

SEQ ID NO: 2025969 - RNA, 15 nt, Homo sapiens
gaauuugagcuugug

SEQ ID NO: 2025970 - RNA, 22 nt, Homo sapiens
cuggccccuuugggcccugcau

SEQ ID NO: 2025971 - RNA, 23 nt, Homo sapiens
uucaagaccagccuggacagcuu

SEQ ID NO: 2025972 - RNA, 16 nt, Homo sapiens
aauauaaaguguaaua

SEQ ID NO: 2025973 - RNA, 21 nt, Homo sapiens
guggagguauugccuugugaa

SEQ ID NO: 2025974 - RNA, 16 nt, Homo sapiens
augaugcccuaacuug

SEQ ID NO: 2025975 - RNA, 16 nt, Homo sapiens
gacucccgccuuugac

SEQ ID NO: 2025976 - RNA, 20 nt, Homo sapiens
caagauggcgaccaccaaag

SEQ ID NO: 2025977 - RNA, 20 nt, Homo sapiens
acugucgugcaaacccagug

SEQ ID NO: 2025978 - RNA, 17 nt, Homo sapiens
cuccaaaccuccagccu

SEQ ID NO: 2025979 - RNA, 17 nt, Homo sapiens
ucuugaacucuuggccu

SEQ ID NO: 2025980 - RNA, 15 nt, Homo sapiens
agucaaaacacuugu

SEQ ID NO: 2025981 - RNA, 16 nt, Homo sapiens
gagcagugauucucuc

SEQ ID NO: 2025982 - RNA, 13 nt, Homo sapiens
acagguacaggcu

SEQ ID NO: 2025983 - RNA, 20 nt, Homo sapiens
caagauccgagucuacccag

SEQ ID NO: 2025984 - RNA, 17 nt, Homo sapiens
ggcggagcgccagugga

SEQ ID NO: 2025985 - RNA, 13 nt, Homo sapiens
guuucuccaagca

SEQ ID NO: 2025986 - RNA, 14 nt, Homo sapiens
gggagucuuugcac

SEQ ID NO: 2025987 - RNA, 17 nt, Homo sapiens
auaugcuguacaugaca

SEQ ID NO: 2025988 - RNA, 17 nt, Homo sapiens
ucccagugggugaugcu

SEQ ID NO: 2025989 - RNA, 22 nt, Homo sapiens
ucaugguauuugaccauuuuag

SEQ ID NO: 2025990 - RNA, 14 nt, Homo sapiens
cuggguguguuuca

SEQ ID NO: 2025991 - RNA, 18 nt, Homo sapiens
uaagggaauccugagaaa

SEQ ID NO: 2025992 - RNA, 13 nt, Homo sapiens
guuuuguuucauc

SEQ ID NO: 2025993 - RNA, 13 nt, Homo sapiens
aaaaugacuuuau

SEQ ID NO: 2025994 - RNA, 15 nt, Homo sapiens
uggacagaagcagcu

SEQ ID NO: 2025995 - RNA, 24 nt, Homo sapiens
aauaaaaaaaaaccuagugcugau

SEQ ID NO: 2025996 - RNA, 20 nt, Homo sapiens
ucuacugcccugagccugaa

SEQ ID NO: 2025997 - RNA, 13 nt, Homo sapiens
acaugcaccuacc

SEQ ID NO: 2025998 - RNA, 23 nt, Homo sapiens
aaaaauuggucacccuaaggaaa

SEQ ID NO: 2025999 - RNA, 18 nt, Homo sapiens
auagauuuagcuauuuau

SEQ ID NO: 2026000 - RNA, 20 nt, Homo sapiens
cccgugacuguuacuuuaua

SEQ ID NO: 2026001 - RNA, 19 nt, Homo sapiens
gaaggacacagugaugaau

SEQ ID NO: 2026002 - RNA, 19 nt, Homo sapiens
agccucugcccugccuccc

SEQ ID NO: 2026003 - RNA, 15 nt, Homo sapiens
ucugcuaaauuuaau

SEQ ID NO: 2026004 - RNA, 21 nt, Homo sapiens
ugccucauuaccuugugcuaa

SEQ ID NO: 2026005 - RNA, 22 nt, Homo sapiens
cuguucucuuguauagcugaaa

SEQ ID NO: 2026006 - RNA, 19 nt, Homo sapiens
cagccuccugaguagcuga

SEQ ID NO: 2026007 - RNA, 19 nt, Homo sapiens
gcacaccauugcaugaauu

SEQ ID NO: 2026008 - RNA, 16 nt, Homo sapiens
cauguaggaguguuua

SEQ ID NO: 2026009 - RNA, 20 nt, Homo sapiens
cuuugacugaucagugugau

SEQ ID NO: 2026010 - RNA, 17 nt, Homo sapiens
acaagcuaggugcuaau

SEQ ID NO: 2026011 - RNA, 17 nt, Homo sapiens
auuuuaaaacagaagaa

SEQ ID NO: 2026012 - RNA, 13 nt, Homo sapiens
gucuucuugcaau

SEQ ID NO: 2026013 - RNA, 14 nt, Homo sapiens
agcucucuuuccca

SEQ ID NO: 2026014 - RNA, 19 nt, Homo sapiens
ccacaaaauuaugcugcau

SEQ ID NO: 2026015 - RNA, 12 nt, Homo sapiens
uugaaccuucaa

SEQ ID NO: 2026016 - RNA, 16 nt, Homo sapiens
cccuuccuaagucugu

SEQ ID NO: 2026017 - RNA, 19 nt, Homo sapiens
ucugcgaucaucgucauuu

SEQ ID NO: 2026018 - RNA, 18 nt, Homo sapiens
acauacuguugaugucua

SEQ ID NO: 2026019 - RNA, 15 nt, Homo sapiens
ccuaguaugccaaaa

SEQ ID NO: 2026020 - RNA, 17 nt, Homo sapiens
agcuuguccagguugau

SEQ ID NO: 2026021 - RNA, 18 nt, Homo sapiens
uaaacccaguugccaucu

SEQ ID NO: 2026022 - RNA, 16 nt, Homo sapiens
uuagggacacuuucac

SEQ ID NO: 2026023 - RNA, 15 nt, Homo sapiens
gcccagggcaucuug

SEQ ID NO: 2026024 - RNA, 23 nt, Homo sapiens
ugaaguuacacauaacuucuuac

SEQ ID NO: 2026025 - RNA, 13 nt, Homo sapiens
uccccuugguucu

SEQ ID NO: 2026026 - RNA, 11 nt, Homo sapiens
uauaggauuuu

SEQ ID NO: 2026027 - RNA, 23 nt, Homo sapiens
aacagugucauauacaauuguca

SEQ ID NO: 2026028 - RNA, 22 nt, Homo sapiens
ugccacuagguuucaccuccca

SEQ ID NO: 2026029 - RNA, 16 nt, Homo sapiens
uaugcucccucugugu

SEQ ID NO: 2026030 - RNA, 23 nt, Homo sapiens
ucagaagcccauuaaaauaguua

SEQ ID NO: 2026031 - RNA, 16 nt, Homo sapiens
cucugacccuagcucu

SEQ ID NO: 2026032 - RNA, 15 nt, Homo sapiens
agauacauguugccu

SEQ ID NO: 2026033 - RNA, 13 nt, Homo sapiens
cccagcccggcug

SEQ ID NO: 2026034 - RNA, 14 nt, Homo sapiens
uccccucucaaagg

SEQ ID NO: 2026035 - RNA, 16 nt, Homo sapiens
augucuguuaacuuaa

SEQ ID NO: 2026036 - RNA, 18 nt, Homo sapiens
uaaaauaaaaggauuaug

SEQ ID NO: 2026037 - RNA, 21 nt, Homo sapiens
uagcagaaguauaaagugauc

SEQ ID NO: 2026038 - RNA, 17 nt, Homo sapiens
caguagcaguggauguu

SEQ ID NO: 2026039 - RNA, 17 nt, Homo sapiens
uauaugugaacauuuau

SEQ ID NO: 2026040 - RNA, 19 nt, Homo sapiens
cagccaacagcuacaacag

SEQ ID NO: 2026041 - RNA, 13 nt, Homo sapiens
gucaugcccuuaa

SEQ ID NO: 2026042 - RNA, 19 nt, Homo sapiens
ggugcaugggcucgccgug

SEQ ID NO: 2026043 - RNA, 17 nt, Homo sapiens
cugcaccgccucagggu

SEQ ID NO: 2026044 - RNA, 16 nt, Homo sapiens
cagguguuuauacagc

SEQ ID NO: 2026045 - RNA, 18 nt, Homo sapiens
cccugagcuuucugcuau

SEQ ID NO: 2026046 - RNA, 21 nt, Homo sapiens
uuuuuacacauguaucuaugc

SEQ ID NO: 2026047 - RNA, 14 nt, Homo sapiens
ucuuuaugacuguu

SEQ ID NO: 2026048 - RNA, 14 nt, Homo sapiens
ucuguuugacuuua

SEQ ID NO: 2026049 - RNA, 17 nt, Homo sapiens
ucagcaacagagcaaaa

SEQ ID NO: 2026050 - RNA, 16 nt, Homo sapiens
gaaaagaagacucuga

SEQ ID NO: 2026051 - RNA, 22 nt, Homo sapiens
uucauagugauagagugcagug

SEQ ID NO: 2026052 - RNA, 17 nt, Homo sapiens
uaugagaaauuagucac

SEQ ID NO: 2026053 - RNA, 23 nt, Homo sapiens
ucaugaaaaccugaagaguucac

SEQ ID NO: 2026054 - RNA, 20 nt, Homo sapiens
uuugacuugcaugaagagaa

SEQ ID NO: 2026055 - RNA, 21 nt, Homo sapiens
aacuagaaggcuucucuccac

SEQ ID NO: 2026056 - RNA, 13 nt, Homo sapiens
cacagguauuuca

SEQ ID NO: 2026057 - RNA, 19 nt, Homo sapiens
cuccugacuguucuuccca

SEQ ID NO: 2026058 - RNA, 22 nt, Homo sapiens
ucaagcauuuaccaugugcuaa

SEQ ID NO: 2026059 - RNA, 22 nt, Homo sapiens
cccuucuugguuuccaaaggca

SEQ ID NO: 2026060 - RNA, 17 nt, Homo sapiens
ucuauuucucuccuuaa

SEQ ID NO: 2026061 - RNA, 12 nt, Homo sapiens
caacccaugagu

SEQ ID NO: 2026062 - RNA, 12 nt, Homo sapiens
gaccgcaauaau

SEQ ID NO: 2026063 - RNA, 21 nt, Homo sapiens
cuggcuccuuaucagugccau

SEQ ID NO: 2026064 - RNA, 19 nt, Homo sapiens
gcccgcgcucuuucuuccc

SEQ ID NO: 2026065 - RNA, 21 nt, Homo sapiens
auaucuagauuuuucugugaa

SEQ ID NO: 2026066 - RNA, 17 nt, Homo sapiens
uaaauaucacaguauua

SEQ ID NO: 2026067 - RNA, 14 nt, Homo sapiens
cucacgucucucuu

SEQ ID NO: 2026068 - RNA, 17 nt, Homo sapiens
caguagcugagugcacu

SEQ ID NO: 2026069 - RNA, 13 nt, Homo sapiens
aauucuugccaaa

SEQ ID NO: 2026070 - RNA, 13 nt, Homo sapiens
ccucaacagcagg

SEQ ID NO: 2026071 - RNA, 15 nt, Homo sapiens
aauauccugcuugau

SEQ ID NO: 2026072 - RNA, 19 nt, Homo sapiens
cugagacaaauccuaggcu

SEQ ID NO: 2026073 - RNA, 22 nt, Homo sapiens
aggauaggcuuuauucugcaag

SEQ ID NO: 2026074 - RNA, 18 nt, Homo sapiens
acgauuuugaacauacuu

SEQ ID NO: 2026075 - RNA, 21 nt, Homo sapiens
uuuauggagaguucaggagaa

SEQ ID NO: 2026076 - RNA, 23 nt, Homo sapiens
auuuugcuaaggagaagcuaaua

SEQ ID NO: 2026077 - RNA, 19 nt, Homo sapiens
uggagggggagcaccagcg

SEQ ID NO: 2026078 - RNA, 17 nt, Homo sapiens
uuauaaacuuucugagu

SEQ ID NO: 2026079 - RNA, 17 nt, Homo sapiens
aaauaaagcagaagcaa

SEQ ID NO: 2026080 - RNA, 15 nt, Homo sapiens
ucugccuuacaaaau

SEQ ID NO: 2026081 - RNA, 16 nt, Homo sapiens
ucccaaucagcacuga

SEQ ID NO: 2026082 - RNA, 16 nt, Homo sapiens
aggcucauggacgaga

SEQ ID NO: 2026083 - RNA, 17 nt, Homo sapiens
ugucccuauucugccau

SEQ ID NO: 2026084 - RNA, 15 nt, Homo sapiens
aaacagggugggcaa

SEQ ID NO: 2026085 - RNA, 22 nt, Homo sapiens
gugaauacugcuacagcaauuu

SEQ ID NO: 2026086 - RNA, 22 nt, Homo sapiens
aucuaguguuggggauccuggc

SEQ ID NO: 2026087 - RNA, 12 nt, Homo sapiens
gcuagucuuuca

SEQ ID NO: 2026088 - RNA, 13 nt, Homo sapiens
aacccugggcucc

SEQ ID NO: 2026089 - RNA, 13 nt, Homo sapiens
aaccaugggcuca

SEQ ID NO: 2026090 - RNA, 19 nt, Homo sapiens
aaaggggcaggagcucaga

SEQ ID NO: 2026091 - RNA, 23 nt, Homo sapiens
acuuacauggguguuuugaucuc

SEQ ID NO: 2026092 - RNA, 15 nt, Homo sapiens
aacgauuuaauucuc

SEQ ID NO: 2026093 - RNA, 13 nt, Homo sapiens
auagacaguuugu

SEQ ID NO: 2026094 - RNA, 12 nt, Homo sapiens
uguucucagggg

SEQ ID NO: 2026095 - RNA, 18 nt, Homo sapiens
uccuggaguacaaacaca

SEQ ID NO: 2026096 - RNA, 20 nt, Homo sapiens
ugaaaaaaaucuuugcuugu

SEQ ID NO: 2026097 - RNA, 13 nt, Homo sapiens
aacuugcaauacc

SEQ ID NO: 2026098 - RNA, 15 nt, Homo sapiens
uuguguucaguucca

SEQ ID NO: 2026099 - RNA, 20 nt, Homo sapiens
uccuuuauacacaguggauu

SEQ ID NO: 2026100 - RNA, 21 nt, Homo sapiens
gccccaugaccuccagcuuuc

SEQ ID NO: 2026101 - RNA, 18 nt, Homo sapiens
ccuguacucccagcacuu

SEQ ID NO: 2026102 - RNA, 16 nt, Homo sapiens
cgcuauacugcacuua

SEQ ID NO: 2026103 - RNA, 16 nt, Homo sapiens
gguaauacaaacuaua

SEQ ID NO: 2026104 - RNA, 18 nt, Homo sapiens
ugugcugggugagcucuu

SEQ ID NO: 2026105 - RNA, 17 nt, Homo sapiens
agauacagaauaaugga

SEQ ID NO: 2026106 - RNA, 15 nt, Homo sapiens
aucuguaguaauuua

SEQ ID NO: 2026107 - RNA, 21 nt, Homo sapiens
agacaagugacuguaucugug

SEQ ID NO: 2026108 - RNA, 14 nt, Homo sapiens
uaggccccacaagg

SEQ ID NO: 2026109 - RNA, 15 nt, Homo sapiens
ucaacaagccugaaa

SEQ ID NO: 2026110 - RNA, 21 nt, Homo sapiens
uaaugucuucauaaaguacuu

SEQ ID NO: 2026111 - RNA, 16 nt, Homo sapiens
gacaagcaacccaaac

SEQ ID NO: 2026112 - RNA, 19 nt, Homo sapiens
aauucaugcaucucaacaa

SEQ ID NO: 2026113 - RNA, 15 nt, Homo sapiens
uccacucugccauuc

SEQ ID NO: 2026114 - RNA, 13 nt, Homo sapiens
gacaacuuccucu

SEQ ID NO: 2026115 - RNA, 20 nt, Homo sapiens
ccaagaaagccuucaagaug

SEQ ID NO: 2026116 - RNA, 22 nt, Homo sapiens
ucauuuucaaugcacauuaguu

SEQ ID NO: 2026117 - RNA, 12 nt, Homo sapiens
gaggcugagaca

SEQ ID NO: 2026118 - RNA, 17 nt, Homo sapiens
aacaagugcucuuucca

SEQ ID NO: 2026119 - RNA, 14 nt, Homo sapiens
aauuucagucaauu

SEQ ID NO: 2026120 - RNA, 16 nt, Homo sapiens
uucucaucauauugua

SEQ ID NO: 2026121 - RNA, 21 nt, Homo sapiens
aggaaucaugaaaaaugaucu

SEQ ID NO: 2026122 - RNA, 15 nt, Homo sapiens
gauggacuacugaag

SEQ ID NO: 2026123 - RNA, 18 nt, Homo sapiens
uaagaggauagcuauauu

SEQ ID NO: 2026124 - RNA, 21 nt, Homo sapiens
cucaauaaaaguuuccuuuca

SEQ ID NO: 2026125 - RNA, 15 nt, Homo sapiens
gcaaacuuuauuuug

SEQ ID NO: 2026126 - RNA, 18 nt, Homo sapiens
gacugacuggcaccaaca

SEQ ID NO: 2026127 - RNA, 16 nt, Homo sapiens
uagacuuuugcuuuau

SEQ ID NO: 2026128 - RNA, 20 nt, Homo sapiens
agacaguccuuucccaccau

SEQ ID NO: 2026129 - RNA, 16 nt, Homo sapiens
ucuaauuauguagcuc

SEQ ID NO: 2026130 - RNA, 22 nt, Homo sapiens
uuguaagaguguagaagcauuc

SEQ ID NO: 2026131 - RNA, 13 nt, Homo sapiens
acaaaagcgaaac

SEQ ID NO: 2026132 - RNA, 15 nt, Homo sapiens
uuagccccagggauc

SEQ ID NO: 2026133 - RNA, 17 nt, Homo sapiens
gaguguuuuuguaucac

SEQ ID NO: 2026134 - RNA, 18 nt, Homo sapiens
uugcagccagggccagug

SEQ ID NO: 2026135 - RNA, 21 nt, Homo sapiens
accuaauauucaaugaacuuc

SEQ ID NO: 2026136 - RNA, 15 nt, Homo sapiens
agcuguaaaauggaa

SEQ ID NO: 2026137 - RNA, 19 nt, Homo sapiens
cagaucgggagcaaaccaa

SEQ ID NO: 2026138 - RNA, 14 nt, Homo sapiens
caucaacacaauga

SEQ ID NO: 2026139 - RNA, 17 nt, Homo sapiens
aaacagccccucuggac

SEQ ID NO: 2026140 - RNA, 11 nt, Homo sapiens
gagagaccucu

SEQ ID NO: 2026141 - RNA, 17 nt, Homo sapiens
cagagagacagacuuga

SEQ ID NO: 2026142 - RNA, 18 nt, Homo sapiens
gagcuuugguaaucucug

SEQ ID NO: 2026143 - RNA, 14 nt, Homo sapiens
uguugcuuguauaa

SEQ ID NO: 2026144 - RNA, 19 nt, Homo sapiens
cuauaccaccuucaauauc

SEQ ID NO: 2026145 - RNA, 24 nt, Homo sapiens
agaaaaaaguguuuauaaugcaau

SEQ ID NO: 2026146 - RNA, 14 nt, Homo sapiens
guuuccucuguaua

SEQ ID NO: 2026147 - RNA, 20 nt, Homo sapiens
uaaacacacagaucugcauc

SEQ ID NO: 2026148 - RNA, 14 nt, Homo sapiens
auuaaaauauccca

SEQ ID NO: 2026149 - RNA, 20 nt, Homo sapiens
gccaggaccacagagcuccu

SEQ ID NO: 2026150 - RNA, 22 nt, Homo sapiens
gauguaaaaaugaaaagccaaa

SEQ ID NO: 2026151 - RNA, 14 nt, Homo sapiens
cguauguuuguacu

SEQ ID NO: 2026152 - RNA, 19 nt, Homo sapiens
gaccaguauuguuuaccca

SEQ ID NO: 2026153 - RNA, 15 nt, Homo sapiens
ucauucucaguccca

SEQ ID NO: 2026154 - RNA, 14 nt, Homo sapiens
gaauggaaccaaaa

SEQ ID NO: 2026155 - RNA, 17 nt, Homo sapiens
caccugucaaccugaau

SEQ ID NO: 2026156 - RNA, 14 nt, Homo sapiens
gaacacagugccug

SEQ ID NO: 2026157 - RNA, 19 nt, Homo sapiens
ucaguuuucauaguaucca

SEQ ID NO: 2026158 - RNA, 20 nt, Homo sapiens
gcaccucggggacaccagag

SEQ ID NO: 2026159 - RNA, 12 nt, Homo sapiens
uaaggccugaau

SEQ ID NO: 2026160 - RNA, 19 nt, Homo sapiens
accuaauugucuauuccug

SEQ ID NO: 2026161 - RNA, 13 nt, Homo sapiens
ucaaaaaguaauc

SEQ ID NO: 2026162 - RNA, 18 nt, Homo sapiens
uggccagaaauaaaggga

SEQ ID NO: 2026163 - RNA, 13 nt, Homo sapiens
aauuugucuuuca

SEQ ID NO: 2026164 - RNA, 19 nt, Homo sapiens
cugagucucugaaugaagc

SEQ ID NO: 2026165 - RNA, 15 nt, Homo sapiens
ugaauugaaucuaca

SEQ ID NO: 2026166 - RNA, 24 nt, Homo sapiens
guggcucacuacugaacacaugug

SEQ ID NO: 2026167 - RNA, 20 nt, Homo sapiens
ucagccccacuccacaguua

SEQ ID NO: 2026168 - RNA, 13 nt, Homo sapiens
uaagaaauguaua

SEQ ID NO: 2026169 - RNA, 16 nt, Homo sapiens
cucagggagcagggaa

SEQ ID NO: 2026170 - RNA, 12 nt, Homo sapiens
uuagggggaaaa

SEQ ID NO: 2026171 - RNA, 22 nt, Homo sapiens
uugccugcagauugucugugau

SEQ ID NO: 2026172 - RNA, 18 nt, Homo sapiens
ucuggcugugcuaccuga

SEQ ID NO: 2026173 - RNA, 18 nt, Homo sapiens
agggcagcuccagugcca

SEQ ID NO: 2026174 - RNA, 23 nt, Homo sapiens
acgcacacccugccccuggugcc

SEQ ID NO: 2026175 - RNA, 21 nt, Homo sapiens
uccaaugccacauacuugcag

SEQ ID NO: 2026176 - RNA, 19 nt, Homo sapiens
agagaaagaaagaacguuc

SEQ ID NO: 2026177 - RNA, 17 nt, Homo sapiens
ggugaguguucagagag

SEQ ID NO: 2026178 - RNA, 20 nt, Homo sapiens
uggggacacagcaucagcuc

SEQ ID NO: 2026179 - RNA, 15 nt, Homo sapiens
aggaccgccaaagaa

SEQ ID NO: 2026180 - RNA, 13 nt, Homo sapiens
gaaugacauugaa

SEQ ID NO: 2026181 - RNA, 13 nt, Homo sapiens
cuggcucccaugu

SEQ ID NO: 2026182 - RNA, 22 nt, Homo sapiens
augucccaccacagucccucac

SEQ ID NO: 2026183 - RNA, 18 nt, Homo sapiens
caaaucucaaaguguaca

SEQ ID NO: 2026184 - RNA, 19 nt, Homo sapiens
caagacuuccucaugaauc

SEQ ID NO: 2026185 - RNA, 21 nt, Homo sapiens
aggccauugugaaccaaugca

SEQ ID NO: 2026186 - RNA, 18 nt, Homo sapiens
caauuuaaggaacacaga

SEQ ID NO: 2026187 - RNA, 24 nt, Homo sapiens
cagaaggaaccagcguguauauga

SEQ ID NO: 2026188 - RNA, 14 nt, Homo sapiens
agaugcugcugaag

SEQ ID NO: 2026189 - RNA, 13 nt, Homo sapiens
ugguaugcauuaa

SEQ ID NO: 2026190 - RNA, 18 nt, Homo sapiens
cauugaaguaaugaauuu

SEQ ID NO: 2026191 - RNA, 16 nt, Homo sapiens
uaauguugcuggauca

SEQ ID NO: 2026192 - RNA, 23 nt, Homo sapiens
acaugaaucccacccacauguga

SEQ ID NO: 2026193 - RNA, 13 nt, Homo sapiens
ucuggauuuuccc

SEQ ID NO: 2026194 - RNA, 12 nt, Homo sapiens
ccuaucugcaaa

SEQ ID NO: 2026195 - RNA, 14 nt, Homo sapiens
gauuucuccaggau

SEQ ID NO: 2026196 - RNA, 21 nt, Homo sapiens
uuugggguguggaugucgaga

SEQ ID NO: 2026197 - RNA, 16 nt, Homo sapiens
ccaaaaauugccaagu

SEQ ID NO: 2026198 - RNA, 17 nt, Homo sapiens
uucaacauguacaggaa

SEQ ID NO: 2026199 - RNA, 16 nt, Homo sapiens
aaucauaaaacuugau

SEQ ID NO: 2026200 - RNA, 15 nt, Homo sapiens
gaguggggggacaga

SEQ ID NO: 2026201 - RNA, 17 nt, Homo sapiens
ccugugccugugacucu

SEQ ID NO: 2026202 - RNA, 18 nt, Homo sapiens
aucauauuuaaagggaau

SEQ ID NO: 2026203 - RNA, 18 nt, Homo sapiens
acauugccuucuggagcu

SEQ ID NO: 2026204 - RNA, 17 nt, Homo sapiens
cggugccucucccaugg

SEQ ID NO: 2026205 - RNA, 13 nt, Homo sapiens
acacugcaguuuc

SEQ ID NO: 2026206 - RNA, 13 nt, Homo sapiens
uacuuaaauuaca

SEQ ID NO: 2026207 - RNA, 23 nt, Homo sapiens
ccguuucauuuagucaugugacc

SEQ ID NO: 2026208 - RNA, 20 nt, Homo sapiens
caguuagaacuguuggauac

SEQ ID NO: 2026209 - RNA, 15 nt, Homo sapiens
acagauuaaagaaga

SEQ ID NO: 2026210 - RNA, 13 nt, Homo sapiens
cgccagacuguua

SEQ ID NO: 2026211 - RNA, 20 nt, Homo sapiens
ccgcaccccuccuccuugcu

SEQ ID NO: 2026212 - RNA, 21 nt, Homo sapiens
acaagauggauggaaagggag

SEQ ID NO: 2026213 - RNA, 23 nt, Homo sapiens
ucugcuuguugcauuuccagcug

SEQ ID NO: 2026214 - RNA, 22 nt, Homo sapiens
gcugggagguugggaggcugug

SEQ ID NO: 2026215 - RNA, 18 nt, Homo sapiens
gacaauuugccauagcag

SEQ ID NO: 2026216 - RNA, 19 nt, Homo sapiens
uuugggguguggaugucga

SEQ ID NO: 2026217 - RNA, 16 nt, Homo sapiens
auagauguuuccuugc

SEQ ID NO: 2026218 - RNA, 21 nt, Homo sapiens
uaugauguauacccauaaaga

SEQ ID NO: 2026219 - RNA, 17 nt, Homo sapiens
cuuuuguauaacuacua

SEQ ID NO: 2026220 - RNA, 12 nt, Homo sapiens
gcucuagucacu

SEQ ID NO: 2026221 - RNA, 18 nt, Homo sapiens
auuuacaugcaccuuaua

SEQ ID NO: 2026222 - RNA, 23 nt, Homo sapiens
gcaccagguguuaaaaaccauua

SEQ ID NO: 2026223 - RNA, 19 nt, Homo sapiens
cuaccaucuaaucuaugca

SEQ ID NO: 2026224 - RNA, 16 nt, Homo sapiens
auccaguuucccaugc

SEQ ID NO: 2026225 - RNA, 20 nt, Homo sapiens
acaguuuauaaagccaagaa

SEQ ID NO: 2026226 - RNA, 18 nt, Homo sapiens
gaggccccacugaugcug

SEQ ID NO: 2026227 - RNA, 17 nt, Homo sapiens
uugaagguguaaauggg

SEQ ID NO: 2026228 - RNA, 15 nt, Homo sapiens
auaccuuuccagggu

SEQ ID NO: 2026229 - RNA, 19 nt, Homo sapiens
auuccugcaaaauuaccua

SEQ ID NO: 2026230 - RNA, 13 nt, Homo sapiens
aauauuaaacacu

SEQ ID NO: 2026231 - RNA, 13 nt, Homo sapiens
caaugccugugaa

SEQ ID NO: 2026232 - RNA, 19 nt, Homo sapiens
cauuugcaggaucugucug

SEQ ID NO: 2026233 - RNA, 22 nt, Homo sapiens
aaaugacaauuuuuuccacuua

SEQ ID NO: 2026234 - RNA, 18 nt, Homo sapiens
gaauuugaacagcucacc

SEQ ID NO: 2026235 - RNA, 21 nt, Homo sapiens
ugaagucacacuguaaccuca

SEQ ID NO: 2026236 - RNA, 13 nt, Homo sapiens
uuucacagugucu

SEQ ID NO: 2026237 - RNA, 16 nt, Homo sapiens
agaacuguggcacuua

SEQ ID NO: 2026238 - RNA, 17 nt, Homo sapiens
augguaauaaucuggaa

SEQ ID NO: 2026239 - RNA, 16 nt, Homo sapiens
augauuguacuuugaa

SEQ ID NO: 2026240 - RNA, 12 nt, Homo sapiens
accaaaucucag

SEQ ID NO: 2026241 - RNA, 17 nt, Homo sapiens
uaggcauguagcuacag

SEQ ID NO: 2026242 - RNA, 15 nt, Homo sapiens
aaauaucccagagaa

SEQ ID NO: 2026243 - RNA, 15 nt, Homo sapiens
acagcuacacagauc

SEQ ID NO: 2026244 - RNA, 14 nt, Homo sapiens
uguagauugccuuu

SEQ ID NO: 2026245 - RNA, 16 nt, Homo sapiens
ggaauaauacauacua

SEQ ID NO: 2026246 - RNA, 15 nt, Homo sapiens
aacuccuccuugccu

SEQ ID NO: 2026247 - RNA, 15 nt, Homo sapiens
aauaucuggcacugu

SEQ ID NO: 2026248 - RNA, 17 nt, Homo sapiens
ugcaguggcaccaucuc

SEQ ID NO: 2026249 - RNA, 20 nt, Homo sapiens
auucaaacaggucgagcugu

SEQ ID NO: 2026250 - RNA, 12 nt, Homo sapiens
gaaaaauucauu

SEQ ID NO: 2026251 - RNA, 20 nt, Homo sapiens
uggauggaguuaaacuugau

SEQ ID NO: 2026252 - RNA, 20 nt, Homo sapiens
ggaguacggcugguguguca

SEQ ID NO: 2026253 - RNA, 15 nt, Homo sapiens
gagccugaacaugcc

SEQ ID NO: 2026254 - RNA, 13 nt, Homo sapiens
ggcugacggugaa

SEQ ID NO: 2026255 - RNA, 20 nt, Homo sapiens
uggaggucacauucaggaag

SEQ ID NO: 2026256 - RNA, 20 nt, Homo sapiens
ucaauauuugagcaguagga

SEQ ID NO: 2026257 - RNA, 20 nt, Homo sapiens
caguaacagugcaguacuca

SEQ ID NO: 2026258 - RNA, 17 nt, Homo sapiens
aaggacucuuccaccuc

SEQ ID NO: 2026259 - RNA, 13 nt, Homo sapiens
caagaggaagacc

SEQ ID NO: 2026260 - RNA, 15 nt, Homo sapiens
aauccaaaccacagu

SEQ ID NO: 2026261 - RNA, 19 nt, Homo sapiens
gagaacaccagagaccuca

SEQ ID NO: 2026262 - RNA, 14 nt, Homo sapiens
ucuggaaacuacca

SEQ ID NO: 2026263 - RNA, 20 nt, Homo sapiens
ccuggggcccaaguugcagu

SEQ ID NO: 2026264 - RNA, 21 nt, Homo sapiens
aggcccgacagagagaugaag

SEQ ID NO: 2026265 - RNA, 20 nt, Homo sapiens
cguaugguggcucaugucua

SEQ ID NO: 2026266 - RNA, 16 nt, Homo sapiens
acuguuccagauuccu

SEQ ID NO: 2026267 - RNA, 15 nt, Homo sapiens
cauauuugcacugaa

SEQ ID NO: 2026268 - RNA, 18 nt, Homo sapiens
caggcugaucgggcaaug

SEQ ID NO: 2026269 - RNA, 21 nt, Homo sapiens
aaucuguguucgauggcucaa

SEQ ID NO: 2026270 - RNA, 12 nt, Homo sapiens
ugcugcuugccc

SEQ ID NO: 2026271 - RNA, 11 nt, Homo sapiens
acaugacuguu

SEQ ID NO: 2026272 - RNA, 14 nt, Homo sapiens
cuugugcucaagga

SEQ ID NO: 2026273 - RNA, 21 nt, Homo sapiens
uuccggccuccugucccucau

SEQ ID NO: 2026274 - RNA, 19 nt, Homo sapiens
cucagucauuuuuaaccuc

SEQ ID NO: 2026275 - RNA, 20 nt, Homo sapiens
acccaaucugcacacuccag

SEQ ID NO: 2026276 - RNA, 15 nt, Homo sapiens
uaguucuugugcaug

SEQ ID NO: 2026277 - RNA, 16 nt, Homo sapiens
caaggaugucugccac

SEQ ID NO: 2026278 - RNA, 22 nt, Homo sapiens
ucaguccauugcucuugagucu

SEQ ID NO: 2026279 - RNA, 16 nt, Homo sapiens
accaauaacuagcuuc

SEQ ID NO: 2026280 - RNA, 14 nt, Homo sapiens
cagggggacuagcc

SEQ ID NO: 2026281 - RNA, 18 nt, Homo sapiens
aaauuguuuuuacugucu

SEQ ID NO: 2026282 - RNA, 14 nt, Homo sapiens
uuagaaauuuaaca

SEQ ID NO: 2026283 - RNA, 15 nt, Homo sapiens
acgucccgggcacug

SEQ ID NO: 2026284 - RNA, 15 nt, Homo sapiens
caaggucauggucug

SEQ ID NO: 2026285 - RNA, 21 nt, Homo sapiens
uucauccuaaagaacaaagua

SEQ ID NO: 2026286 - RNA, 18 nt, Homo sapiens
cuggugagguugaggaau

SEQ ID NO: 2026287 - RNA, 18 nt, Homo sapiens
cuccacacacuucuucca

SEQ ID NO: 2026288 - RNA, 18 nt, Homo sapiens
aucuuugccuuuaucucu

SEQ ID NO: 2026289 - RNA, 13 nt, Homo sapiens
caauuuucauccc

SEQ ID NO: 2026290 - RNA, 17 nt, Homo sapiens
aauagccaguuccugcc

SEQ ID NO: 2026291 - RNA, 19 nt, Homo sapiens
agcuucaugugacacaggg

SEQ ID NO: 2026292 - RNA, 19 nt, Homo sapiens
augguguagaacacuaauu

SEQ ID NO: 2026293 - RNA, 16 nt, Homo sapiens
accgagucucuucucc

SEQ ID NO: 2026294 - RNA, 17 nt, Homo sapiens
gagaccuaccucagguu

SEQ ID NO: 2026295 - RNA, 23 nt, Homo sapiens
aaagauggccauauuaccccuuu

SEQ ID NO: 2026296 - RNA, 18 nt, Homo sapiens
gccagggcaaugaugaau

SEQ ID NO: 2026297 - RNA, 13 nt, Homo sapiens
gcucagaacagua

SEQ ID NO: 2026298 - RNA, 21 nt, Homo sapiens
uguacacauguauccuuucac

SEQ ID NO: 2026299 - RNA, 23 nt, Homo sapiens
aaaauugcaauuucuuagguaac

SEQ ID NO: 2026300 - RNA, 13 nt, Homo sapiens
uuaagaaaauaca

SEQ ID NO: 2026301 - RNA, 15 nt, Homo sapiens
caaggcugacuucuc

SEQ ID NO: 2026302 - RNA, 19 nt, Homo sapiens
ccauuucugaacuguuaca

SEQ ID NO: 2026303 - RNA, 18 nt, Homo sapiens
ugccacacgucugacccu

SEQ ID NO: 2026304 - RNA, 17 nt, Homo sapiens
aaauauauaauauacaa

SEQ ID NO: 2026305 - RNA, 22 nt, Homo sapiens
aaaugcaacauacgggaaguuu

SEQ ID NO: 2026306 - RNA, 20 nt, Homo sapiens
gagccauugaacagcuguga

SEQ ID NO: 2026307 - RNA, 17 nt, Homo sapiens
cuggggugcugccugaa

SEQ ID NO: 2026308 - RNA, 17 nt, Homo sapiens
gccagguaggaugaaca

SEQ ID NO: 2026309 - RNA, 15 nt, Homo sapiens
acagaggaucugcuu

SEQ ID NO: 2026310 - RNA, 13 nt, Homo sapiens
cguuuuugcaaua

SEQ ID NO: 2026311 - RNA, 20 nt, Homo sapiens
agaccugaagugugcacguu

SEQ ID NO: 2026312 - RNA, 12 nt, Homo sapiens
uaaaauugucag

SEQ ID NO: 2026313 - RNA, 19 nt, Homo sapiens
cugggugguguacaagcau

SEQ ID NO: 2026314 - RNA, 15 nt, Homo sapiens
cuguauaucagcucu

SEQ ID NO: 2026315 - RNA, 15 nt, Homo sapiens
aguaauaucuuucag

SEQ ID NO: 2026316 - RNA, 17 nt, Homo sapiens
ggauugggagauuucau

SEQ ID NO: 2026317 - RNA, 18 nt, Homo sapiens
acaaugaugccgaacauu

SEQ ID NO: 2026318 - RNA, 15 nt, Homo sapiens
uaccaugugcuaaua

SEQ ID NO: 2026319 - RNA, 17 nt, Homo sapiens
aggguauuaauaugcua

SEQ ID NO: 2026320 - RNA, 13 nt, Homo sapiens
gucucaguccaga

SEQ ID NO: 2026321 - RNA, 22 nt, Homo sapiens
ccuuucccuaagccagcugccc

SEQ ID NO: 2026322 - RNA, 15 nt, Homo sapiens
ucugaaacuucccaa

SEQ ID NO: 2026323 - RNA, 16 nt, Homo sapiens
cugaauaaauacaaag

SEQ ID NO: 2026324 - RNA, 17 nt, Homo sapiens
uccugcuccacaguguu

SEQ ID NO: 2026325 - RNA, 15 nt, Homo sapiens
acuaaggugcuaaau

SEQ ID NO: 2026326 - RNA, 21 nt, Homo sapiens
aaaccauaaaacccuauacaa

SEQ ID NO: 2026327 - RNA, 12 nt, Homo sapiens
gggcagggauga

SEQ ID NO: 2026328 - RNA, 13 nt, Homo sapiens
aagcacaugaaua

SEQ ID NO: 2026329 - RNA, 16 nt, Homo sapiens
uucacuuguauugacu

SEQ ID NO: 2026330 - RNA, 17 nt, Homo sapiens
ugagcaccuguaauccc

SEQ ID NO: 2026331 - RNA, 21 nt, Homo sapiens
aaucuaacaucguggcugugg

SEQ ID NO: 2026332 - RNA, 22 nt, Homo sapiens
cugcccagucgaccccaaagga

SEQ ID NO: 2026333 - RNA, 14 nt, Homo sapiens
aggaucucucagga

SEQ ID NO: 2026334 - RNA, 17 nt, Homo sapiens
agagaaagugugugauu

SEQ ID NO: 2026335 - RNA, 14 nt, Homo sapiens
uggaugcugugaag

SEQ ID NO: 2026336 - RNA, 21 nt, Homo sapiens
ucccugugcugauccugcuga

SEQ ID NO: 2026337 - RNA, 20 nt, Homo sapiens
augucuuaaauaaaacuauu

SEQ ID NO: 2026338 - RNA, 19 nt, Homo sapiens
gccugcucccuagccagag

SEQ ID NO: 2026339 - RNA, 19 nt, Homo sapiens
ggcuuccagguaucuccag

SEQ ID NO: 2026340 - RNA, 22 nt, Homo sapiens
caggcucaacugaggauguggc

SEQ ID NO: 2026341 - RNA, 20 nt, Homo sapiens
ccuuucuuaucuugaccaua

SEQ ID NO: 2026342 - RNA, 22 nt, Homo sapiens
aguugaagccgucucaugcaga

SEQ ID NO: 2026343 - RNA, 15 nt, Homo sapiens
gccguacugucuaug

SEQ ID NO: 2026344 - RNA, 17 nt, Homo sapiens
ccauccucaaacacugc

SEQ ID NO: 2026345 - RNA, 15 nt, Homo sapiens
ucugggcagcuguca

SEQ ID NO: 2026346 - RNA, 16 nt, Homo sapiens
aggacuuugcgguggg

SEQ ID NO: 2026347 - RNA, 15 nt, Homo sapiens
aucagaaaaguaauu

SEQ ID NO: 2026348 - RNA, 21 nt, Homo sapiens
guacagccuuuuauggaccaa

SEQ ID NO: 2026349 - RNA, 19 nt, Homo sapiens
aguccagagucuaggcaau

SEQ ID NO: 2026350 - RNA, 13 nt, Homo sapiens
gggccagugcagu

SEQ ID NO: 2026351 - RNA, 22 nt, Homo sapiens
uguguucugucaccaacugaag

SEQ ID NO: 2026352 - RNA, 16 nt, Homo sapiens
uaggccucaguguccu

SEQ ID NO: 2026353 - RNA, 15 nt, Homo sapiens
gaaaguguuuugccc

SEQ ID NO: 2026354 - RNA, 14 nt, Homo sapiens
agggguccagccuc

SEQ ID NO: 2026355 - RNA, 19 nt, Homo sapiens
agagaugccaugauaucac

SEQ ID NO: 2026356 - RNA, 18 nt, Homo sapiens
guugcucuguacccauga

SEQ ID NO: 2026357 - RNA, 17 nt, Homo sapiens
uguaugucuauguguau

SEQ ID NO: 2026358 - RNA, 17 nt, Homo sapiens
cauaaagcauguuucau

SEQ ID NO: 2026359 - RNA, 15 nt, Homo sapiens
uuucaguuuauuuga

SEQ ID NO: 2026360 - RNA, 15 nt, Homo sapiens
cuccccuggggagcc

SEQ ID NO: 2026361 - RNA, 16 nt, Homo sapiens
ccaacaggcccagcuu

SEQ ID NO: 2026362 - RNA, 22 nt, Homo sapiens
ugcccggggcagcugccagaga

SEQ ID NO: 2026363 - RNA, 15 nt, Homo sapiens
agaucugucccuuaa

SEQ ID NO: 2026364 - RNA, 15 nt, Homo sapiens
gcuugggcuucaucc

SEQ ID NO: 2026365 - RNA, 18 nt, Homo sapiens
gaaucauauucauaugca

SEQ ID NO: 2026366 - RNA, 19 nt, Homo sapiens
cauggggugggccucuggu

SEQ ID NO: 2026367 - RNA, 12 nt, Homo sapiens
caaaagauguau

SEQ ID NO: 2026368 - RNA, 14 nt, Homo sapiens
uugucugguccuga

SEQ ID NO: 2026369 - RNA, 14 nt, Homo sapiens
caugugaagagaau

SEQ ID NO: 2026370 - RNA, 22 nt, Homo sapiens
ccuuugagcaagccgagcucuc

SEQ ID NO: 2026371 - RNA, 16 nt, Homo sapiens
acugaaauauaccuuu

SEQ ID NO: 2026372 - RNA, 11 nt, Homo sapiens
uugacaaugac

SEQ ID NO: 2026373 - RNA, 16 nt, Homo sapiens
agcccgugcacccugg

SEQ ID NO: 2026374 - RNA, 17 nt, Homo sapiens
cuggucaguugccaaag

SEQ ID NO: 2026375 - RNA, 14 nt, Homo sapiens
cuuaagccaagaag

SEQ ID NO: 2026376 - RNA, 14 nt, Homo sapiens
uagggacacuuuca

SEQ ID NO: 2026377 - RNA, 16 nt, Homo sapiens
gccacgaaugaaugaa

SEQ ID NO: 2026378 - RNA, 14 nt, Homo sapiens
guaaguguucucau

SEQ ID NO: 2026379 - RNA, 21 nt, Homo sapiens
ggcuuuacaaagcuggcaaua

SEQ ID NO: 2026380 - RNA, 14 nt, Homo sapiens
caguggauuuccca

SEQ ID NO: 2026381 - RNA, 16 nt, Homo sapiens
caguucaacucaugga

SEQ ID NO: 2026382 - RNA, 16 nt, Homo sapiens
gguccaggccuacucc

SEQ ID NO: 2026383 - RNA, 14 nt, Homo sapiens
uaguaaaacacaga

SEQ ID NO: 2026384 - RNA, 14 nt, Homo sapiens
cucuguaauugaau

SEQ ID NO: 2026385 - RNA, 14 nt, Homo sapiens
gugucauacugugc

SEQ ID NO: 2026386 - RNA, 13 nt, Homo sapiens
cuguccaaaugga

SEQ ID NO: 2026387 - RNA, 19 nt, Homo sapiens
ccaucagugcucuguaaaa

SEQ ID NO: 2026388 - RNA, 21 nt, Homo sapiens
aaaggccugcacacaagccca

SEQ ID NO: 2026389 - RNA, 17 nt, Homo sapiens
ggagggcucagggcagu

SEQ ID NO: 2026390 - RNA, 14 nt, Homo sapiens
uucccaaaucuguc

SEQ ID NO: 2026391 - RNA, 15 nt, Homo sapiens
caucuuccauuucca

SEQ ID NO: 2026392 - RNA, 17 nt, Homo sapiens
aucuuaguucuguauau

SEQ ID NO: 2026393 - RNA, 20 nt, Homo sapiens
cuguugggagaaagcaauac

SEQ ID NO: 2026394 - RNA, 22 nt, Homo sapiens
aauuacuuauuggauauucauu

SEQ ID NO: 2026395 - RNA, 13 nt, Homo sapiens
cauuucagagccc

SEQ ID NO: 2026396 - RNA, 19 nt, Homo sapiens
ggcuuugcagggagaccag

SEQ ID NO: 2026397 - RNA, 16 nt, Homo sapiens
aaaaggugauugucac

SEQ ID NO: 2026398 - RNA, 15 nt, Homo sapiens
ucccgggcccagaaa

SEQ ID NO: 2026399 - RNA, 17 nt, Homo sapiens
ggcaggagggcaugugc

SEQ ID NO: 2026400 - RNA, 20 nt, Homo sapiens
augccuuuucccaacuccag

SEQ ID NO: 2026401 - RNA, 19 nt, Homo sapiens
uaaaccacacacacaaggu

SEQ ID NO: 2026402 - RNA, 15 nt, Homo sapiens
gcuggaaauggacac

SEQ ID NO: 2026403 - RNA, 13 nt, Homo sapiens
ucuccugccugcc

SEQ ID NO: 2026404 - RNA, 15 nt, Homo sapiens
gcagagguugcaaug

SEQ ID NO: 2026405 - RNA, 15 nt, Homo sapiens
uaggaaauucugaug

SEQ ID NO: 2026406 - RNA, 16 nt, Homo sapiens
uguaaguaaugauaca

SEQ ID NO: 2026407 - RNA, 16 nt, Homo sapiens
agaagcagaaacuggc

SEQ ID NO: 2026408 - RNA, 21 nt, Homo sapiens
agagccaaccucggcuugugg

SEQ ID NO: 2026409 - RNA, 16 nt, Homo sapiens
ccucaaguuccagugc

SEQ ID NO: 2026410 - RNA, 15 nt, Homo sapiens
agaaacacacaguca

SEQ ID NO: 2026411 - RNA, 23 nt, Homo sapiens
gagauugcucuggggcuugcuau

SEQ ID NO: 2026412 - RNA, 12 nt, Homo sapiens
uauauacauuuc

SEQ ID NO: 2026413 - RNA, 17 nt, Homo sapiens
uuuaaaaguuucaaugu

SEQ ID NO: 2026414 - RNA, 15 nt, Homo sapiens
guacagauacuguga

SEQ ID NO: 2026415 - RNA, 22 nt, Homo sapiens
cuucaggaaccucgaguacugu

SEQ ID NO: 2026416 - RNA, 10 nt, Homo sapiens
aaaauaugcc

SEQ ID NO: 2026417 - RNA, 17 nt, Homo sapiens
augagcugguuugacuc

SEQ ID NO: 2026418 - RNA, 14 nt, Homo sapiens
uugggcucacuucu

SEQ ID NO: 2026419 - RNA, 21 nt, Homo sapiens
cucucuaacccacagguguug

SEQ ID NO: 2026420 - RNA, 19 nt, Homo sapiens
uuugaucuugugcuaugaa

SEQ ID NO: 2026421 - RNA, 16 nt, Homo sapiens
guaguuggcagaaaua

SEQ ID NO: 2026422 - RNA, 19 nt, Homo sapiens
uaaaaagugugcuuaacau

SEQ ID NO: 2026423 - RNA, 20 nt, Homo sapiens
cugggaauguccuguagaga

SEQ ID NO: 2026424 - RNA, 13 nt, Homo sapiens
aaggaaaagccaa

SEQ ID NO: 2026425 - RNA, 18 nt, Homo sapiens
aacacagucuggcaguug

SEQ ID NO: 2026426 - RNA, 14 nt, Homo sapiens
aggaguacagguga

SEQ ID NO: 2026427 - RNA, 14 nt, Homo sapiens
aaaacuacaaauca

SEQ ID NO: 2026428 - RNA, 18 nt, Homo sapiens
auuugugccgacacuguu

SEQ ID NO: 2026429 - RNA, 18 nt, Homo sapiens
augcucuuuucacagcua

SEQ ID NO: 2026430 - RNA, 21 nt, Homo sapiens
gaacaaugaaaaaagucucca

SEQ ID NO: 2026431 - RNA, 17 nt, Homo sapiens
uaugcugcaacaaaaug

SEQ ID NO: 2026432 - RNA, 15 nt, Homo sapiens
uauucguuacucuaa

SEQ ID NO: 2026433 - RNA, 16 nt, Homo sapiens
ugaccccuuucacuua

SEQ ID NO: 2026434 - RNA, 22 nt, Homo sapiens
cugucgcugcuucgugggauac

SEQ ID NO: 2026435 - RNA, 18 nt, Homo sapiens
caccucaccccguuacag

SEQ ID NO: 2026436 - RNA, 14 nt, Homo sapiens
cuaguucagagcca

SEQ ID NO: 2026437 - RNA, 14 nt, Homo sapiens
ccaugcugugagca

SEQ ID NO: 2026438 - RNA, 19 nt, Homo sapiens
uuccagcccaucuccgggg

SEQ ID NO: 2026439 - RNA, 22 nt, Homo sapiens
ggaauagguuucaacauaugaa

SEQ ID NO: 2026440 - RNA, 17 nt, Homo sapiens
cauguuugguaccaaga

SEQ ID NO: 2026441 - RNA, 19 nt, Homo sapiens
uggauuccucacagccuug

SEQ ID NO: 2026442 - RNA, 19 nt, Homo sapiens
acacuuacuguaagacauu

SEQ ID NO: 2026443 - RNA, 18 nt, Homo sapiens
gucuauuuuauaucuguu

SEQ ID NO: 2026444 - RNA, 18 nt, Homo sapiens
caccgugugccauagaau

SEQ ID NO: 2026445 - RNA, 21 nt, Homo sapiens
gugccaauguuguguguugca

SEQ ID NO: 2026446 - RNA, 16 nt, Homo sapiens
cagucucauugucacc

SEQ ID NO: 2026447 - RNA, 18 nt, Homo sapiens
ccaacccagcaguucucu

SEQ ID NO: 2026448 - RNA, 15 nt, Homo sapiens
aaugacaaacaugau

SEQ ID NO: 2026449 - RNA, 22 nt, Homo sapiens
uggggccaccaaagcugcccac

SEQ ID NO: 2026450 - RNA, 14 nt, Homo sapiens
agcugcuucuccca

SEQ ID NO: 2026451 - RNA, 14 nt, Homo sapiens
ugggaucauugcau

SEQ ID NO: 2026452 - RNA, 17 nt, Homo sapiens
agaugaagacaacagca

SEQ ID NO: 2026453 - RNA, 15 nt, Homo sapiens
ccuuuucaucuccag

SEQ ID NO: 2026454 - RNA, 21 nt, Homo sapiens
guuuguuuauaucacugucua

SEQ ID NO: 2026455 - RNA, 22 nt, Homo sapiens
cuccuguguggaguuauucacu

SEQ ID NO: 2026456 - RNA, 18 nt, Homo sapiens
uuauuaauuaaacaagug

SEQ ID NO: 2026457 - RNA, 15 nt, Homo sapiens
cugaggucaggaguu

SEQ ID NO: 2026458 - RNA, 20 nt, Homo sapiens
ucccuugaggaaacaacagc

SEQ ID NO: 2026459 - RNA, 14 nt, Homo sapiens
gaagucccaagacc

SEQ ID NO: 2026460 - RNA, 21 nt, Homo sapiens
ggagagaaguuaauccacauc

SEQ ID NO: 2026461 - RNA, 16 nt, Homo sapiens
acaaugagcaaugagg

SEQ ID NO: 2026462 - RNA, 18 nt, Homo sapiens
guggauuuuuaccuuugu

SEQ ID NO: 2026463 - RNA, 23 nt, Homo sapiens
uacaguguccuaccacucuaauc

SEQ ID NO: 2026464 - RNA, 14 nt, Homo sapiens
gccaucguccuggg

SEQ ID NO: 2026465 - RNA, 11 nt, Homo sapiens
cucaugaacua

SEQ ID NO: 2026466 - RNA, 14 nt, Homo sapiens
agccucugcugcca

SEQ ID NO: 2026467 - RNA, 14 nt, Homo sapiens
gcccaccugcauca

SEQ ID NO: 2026468 - RNA, 14 nt, Homo sapiens
auucaccaaccaaa

SEQ ID NO: 2026469 - RNA, 16 nt, Homo sapiens
guccuguuucugucaa

SEQ ID NO: 2026470 - RNA, 17 nt, Homo sapiens
aaagaauuggacaugau

SEQ ID NO: 2026471 - RNA, 12 nt, Homo sapiens
uaaacucucuag

SEQ ID NO: 2026472 - RNA, 17 nt, Homo sapiens
ugagugaaaaaagucac

SEQ ID NO: 2026473 - RNA, 18 nt, Homo sapiens
ucaguuucucaaacugag

SEQ ID NO: 2026474 - RNA, 13 nt, Homo sapiens
ugaaggugauuca

SEQ ID NO: 2026475 - RNA, 17 nt, Homo sapiens
uaaaauuaauguaauaa

SEQ ID NO: 2026476 - RNA, 17 nt, Homo sapiens
uaagauuuugcaccugu

SEQ ID NO: 2026477 - RNA, 18 nt, Homo sapiens
ccugacuuuguaguucug

SEQ ID NO: 2026478 - RNA, 15 nt, Homo sapiens
aucugugcagggcug

SEQ ID NO: 2026479 - RNA, 15 nt, Homo sapiens
aggacucccugcuua

SEQ ID NO: 2026480 - RNA, 18 nt, Homo sapiens
gaagcuuugaguugacuu

SEQ ID NO: 2026481 - RNA, 22 nt, Homo sapiens
uacuucuguggaaguagcuuug

SEQ ID NO: 2026482 - RNA, 21 nt, Homo sapiens
guucucacugucuccuggucu

SEQ ID NO: 2026483 - RNA, 22 nt, Homo sapiens
aggaagcuuggggaacccauga

SEQ ID NO: 2026484 - RNA, 13 nt, Homo sapiens
ugcaggggucccc

SEQ ID NO: 2026485 - RNA, 21 nt, Homo sapiens
aaaauacaaaaaucagccaga

SEQ ID NO: 2026486 - RNA, 16 nt, Homo sapiens
auggagaaaaugcuua

SEQ ID NO: 2026487 - RNA, 15 nt, Homo sapiens
acguucaaacaggcc

SEQ ID NO: 2026488 - RNA, 15 nt, Homo sapiens
cuugaucauucucag

SEQ ID NO: 2026489 - RNA, 22 nt, Homo sapiens
ucugcuguuuuuuuugcugcua

SEQ ID NO: 2026490 - RNA, 23 nt, Homo sapiens
accuuguuuugcugucuucauca

SEQ ID NO: 2026491 - RNA, 21 nt, Homo sapiens
augaauaaauccucucuauca

SEQ ID NO: 2026492 - RNA, 17 nt, Homo sapiens
caccagcaguguuuaaa

SEQ ID NO: 2026493 - RNA, 16 nt, Homo sapiens
uagugauuuccuuaau

SEQ ID NO: 2026494 - RNA, 20 nt, Homo sapiens
ucauugaccugaggcccuuc

SEQ ID NO: 2026495 - RNA, 20 nt, Homo sapiens
ucuaagguaguaacuuucca

SEQ ID NO: 2026496 - RNA, 12 nt, Homo sapiens
cagaagugugac

SEQ ID NO: 2026497 - RNA, 14 nt, Homo sapiens
uagaauuugcacac

SEQ ID NO: 2026498 - RNA, 18 nt, Homo sapiens
cuuuaaaauuuuuuuaga

SEQ ID NO: 2026499 - RNA, 17 nt, Homo sapiens
gagcucacagcuggaca

SEQ ID NO: 2026500 - RNA, 10 nt, Homo sapiens
gcgcugugcu

SEQ ID NO: 2026501 - RNA, 18 nt, Homo sapiens
uaugauuuaagacuauga

SEQ ID NO: 2026502 - RNA, 15 nt, Homo sapiens
gacaccauuuaucua

SEQ ID NO: 2026503 - RNA, 19 nt, Homo sapiens
ugcacacauauacauguag

SEQ ID NO: 2026504 - RNA, 19 nt, Homo sapiens
uguuaccucugacaucaag

SEQ ID NO: 2026505 - RNA, 15 nt, Homo sapiens
ucgagagcuggccaa

SEQ ID NO: 2026506 - RNA, 16 nt, Homo sapiens
acauugcuaagaugcu

SEQ ID NO: 2026507 - RNA, 21 nt, Homo sapiens
uaugugaucaauuuugacuua

SEQ ID NO: 2026508 - RNA, 13 nt, Homo sapiens
uucaacaugugcu

SEQ ID NO: 2026509 - RNA, 14 nt, Homo sapiens
uauuuuacauagau

SEQ ID NO: 2026510 - RNA, 21 nt, Homo sapiens
ggauggacgaacaggggccaa

SEQ ID NO: 2026511 - RNA, 14 nt, Homo sapiens
auccuugacuuuga

SEQ ID NO: 2026512 - RNA, 23 nt, Homo sapiens
acaggggugcugcagguggcaga

SEQ ID NO: 2026513 - RNA, 22 nt, Homo sapiens
auugagccuugcauguacuuga

SEQ ID NO: 2026514 - RNA, 21 nt, Homo sapiens
cagacggaugcccauuccugc

SEQ ID NO: 2026515 - RNA, 21 nt, Homo sapiens
ucagaauuaagcagaacacug

SEQ ID NO: 2026516 - RNA, 15 nt, Homo sapiens
acaauaaaagagcuu

SEQ ID NO: 2026517 - RNA, 12 nt, Homo sapiens
caaugucauguc

SEQ ID NO: 2026518 - RNA, 19 nt, Homo sapiens
agcauaaauaaaacugaau

SEQ ID NO: 2026519 - RNA, 17 nt, Homo sapiens
ugcagcagaagccaaau

SEQ ID NO: 2026520 - RNA, 21 nt, Homo sapiens
gguauuuguggaaacugucau

SEQ ID NO: 2026521 - RNA, 15 nt, Homo sapiens
uucagucaucuccaa

SEQ ID NO: 2026522 - RNA, 15 nt, Homo sapiens
guuuauuaacuugag

SEQ ID NO: 2026523 - RNA, 16 nt, Homo sapiens
acaaagggauguucac

SEQ ID NO: 2026524 - RNA, 22 nt, Homo sapiens
cccaugugccucuccugggaca

SEQ ID NO: 2026525 - RNA, 13 nt, Homo sapiens
cagagugccacug

SEQ ID NO: 2026526 - RNA, 13 nt, Homo sapiens
aggacugcagcuc

SEQ ID NO: 2026527 - RNA, 13 nt, Homo sapiens
agcuuugcaggau

SEQ ID NO: 2026528 - RNA, 22 nt, Homo sapiens
agugaguggccccaccuguguc

SEQ ID NO: 2026529 - RNA, 20 nt, Homo sapiens
ugacuggcccacacgugcau

SEQ ID NO: 2026530 - RNA, 18 nt, Homo sapiens
accucacacgcugggcuu

SEQ ID NO: 2026531 - RNA, 20 nt, Homo sapiens
aguguagcauuggaucaaaa

SEQ ID NO: 2026532 - RNA, 21 nt, Homo sapiens
acaaauuucauuuccauuuaa

SEQ ID NO: 2026533 - RNA, 21 nt, Homo sapiens
gugcuccguagcuucuagucu

SEQ ID NO: 2026534 - RNA, 20 nt, Homo sapiens
acagcuuugcugcugaaggc

SEQ ID NO: 2026535 - RNA, 14 nt, Homo sapiens
gaauaauacauacu

SEQ ID NO: 2026536 - RNA, 21 nt, Homo sapiens
gagaagcaaauauguuugcau

SEQ ID NO: 2026537 - RNA, 23 nt, Homo sapiens
cuguucaguguaaauaguuacuc

SEQ ID NO: 2026538 - RNA, 18 nt, Homo sapiens
ugugacccacuuaccuug

SEQ ID NO: 2026539 - RNA, 21 nt, Homo sapiens
aaacucuucgggagacauguu

SEQ ID NO: 2026540 - RNA, 13 nt, Homo sapiens
uaucugugcuuug

SEQ ID NO: 2026541 - RNA, 19 nt, Homo sapiens
cugcugaucaaugaaaugc

SEQ ID NO: 2026542 - RNA, 12 nt, Homo sapiens
uccagcaccugu

SEQ ID NO: 2026543 - RNA, 18 nt, Homo sapiens
uguaucauuaauguaggu

SEQ ID NO: 2026544 - RNA, 10 nt, Homo sapiens
acacacucca

SEQ ID NO: 2026545 - RNA, 23 nt, Homo sapiens
auaaccguuuccuuucauuuacu

SEQ ID NO: 2026546 - RNA, 15 nt, Homo sapiens
ugucccccuacccac

SEQ ID NO: 2026547 - RNA, 14 nt, Homo sapiens
gcucacuguucuau

SEQ ID NO: 2026548 - RNA, 21 nt, Homo sapiens
cacugcuggguuuuacaucca

SEQ ID NO: 2026549 - RNA, 14 nt, Homo sapiens
guuccuccuacuua

SEQ ID NO: 2026550 - RNA, 17 nt, Homo sapiens
uagugaaacugcauuau

SEQ ID NO: 2026551 - RNA, 18 nt, Homo sapiens
gaaauuccaguugcaauu

SEQ ID NO: 2026552 - RNA, 18 nt, Homo sapiens
uaagcaucuaaggacaag

SEQ ID NO: 2026553 - RNA, 13 nt, Homo sapiens
aauggcagcuuaa

SEQ ID NO: 2026554 - RNA, 18 nt, Homo sapiens
cagauuuccucacuaccu

SEQ ID NO: 2026555 - RNA, 14 nt, Homo sapiens
ugguaaaaccuguu

SEQ ID NO: 2026556 - RNA, 14 nt, Homo sapiens
augguagccuuagg

SEQ ID NO: 2026557 - RNA, 16 nt, Homo sapiens
accaauaggugcaaaa

SEQ ID NO: 2026558 - RNA, 16 nt, Homo sapiens
cggaugaccauaugca

SEQ ID NO: 2026559 - RNA, 14 nt, Homo sapiens
ugacauagcacuug

SEQ ID NO: 2026560 - RNA, 16 nt, Homo sapiens
ugacauaagugcuauu

SEQ ID NO: 2026561 - RNA, 13 nt, Homo sapiens
ucccugggggccu

SEQ ID NO: 2026562 - RNA, 14 nt, Homo sapiens
uccaagguggcaua

SEQ ID NO: 2026563 - RNA, 21 nt, Homo sapiens
auggagaagacuucuuugcaa

SEQ ID NO: 2026564 - RNA, 21 nt, Homo sapiens
ccuguaaaagauacugaggaa

SEQ ID NO: 2026565 - RNA, 17 nt, Homo sapiens
ugguaaauuaguauuua

SEQ ID NO: 2026566 - RNA, 18 nt, Homo sapiens
cucaagugagccaagaaa

SEQ ID NO: 2026567 - RNA, 22 nt, Homo sapiens
gcaaacauaggaauaugacuca

SEQ ID NO: 2026568 - RNA, 22 nt, Homo sapiens
gagaguggcaggugggcugccu

SEQ ID NO: 2026569 - RNA, 14 nt, Homo sapiens
auuuguaagacuua

SEQ ID NO: 2026570 - RNA, 20 nt, Homo sapiens
uuucuggugaugcccaaaga

SEQ ID NO: 2026571 - RNA, 16 nt, Homo sapiens
gcucccacaagccuga

SEQ ID NO: 2026572 - RNA, 21 nt, Homo sapiens
gaauaaauaaguaaauacauu

SEQ ID NO: 2026573 - RNA, 14 nt, Homo sapiens
gggacauaucagug

SEQ ID NO: 2026574 - RNA, 14 nt, Homo sapiens
uccuggcugagaaa

SEQ ID NO: 2026575 - RNA, 13 nt, Homo sapiens
ugacuuugccaaa

SEQ ID NO: 2026576 - RNA, 20 nt, Homo sapiens
cugccuccaggagggcauca

SEQ ID NO: 2026577 - RNA, 17 nt, Homo sapiens
cuaacagugaaaagaga

SEQ ID NO: 2026578 - RNA, 19 nt, Homo sapiens
auauuuugaaaugaacuuu

SEQ ID NO: 2026579 - RNA, 16 nt, Homo sapiens
uuccccaagacauucu

SEQ ID NO: 2026580 - RNA, 17 nt, Homo sapiens
caggaagggagaacuug

SEQ ID NO: 2026581 - RNA, 19 nt, Homo sapiens
uguacccuuccuacagaua

SEQ ID NO: 2026582 - RNA, 21 nt, Homo sapiens
augaaaacauagcaucucagg

SEQ ID NO: 2026583 - RNA, 21 nt, Homo sapiens
uaauuuauuauuaacauaccu

SEQ ID NO: 2026584 - RNA, 12 nt, Homo sapiens
auagagugaaau

SEQ ID NO: 2026585 - RNA, 12 nt, Homo sapiens
cuggagugcagu

SEQ ID NO: 2026586 - RNA, 21 nt, Homo sapiens
gaaaccaggacaagcuacuua

SEQ ID NO: 2026587 - RNA, 21 nt, Homo sapiens
aggccaggcgagccugacucu

SEQ ID NO: 2026588 - RNA, 20 nt, Homo sapiens
uagaaaggcaguucagguau

SEQ ID NO: 2026589 - RNA, 19 nt, Homo sapiens
agaaucuuguuuugaaaau

SEQ ID NO: 2026590 - RNA, 20 nt, Homo sapiens
ugcauucuucugagcacugu

SEQ ID NO: 2026591 - RNA, 15 nt, Homo sapiens
gcacaucuugucuaa

SEQ ID NO: 2026592 - RNA, 19 nt, Homo sapiens
cugagaugcacgaugcugg

SEQ ID NO: 2026593 - RNA, 17 nt, Homo sapiens
aacaaacaaacaaacug

SEQ ID NO: 2026594 - RNA, 17 nt, Homo sapiens
uauuuuuuaacaugaaa

SEQ ID NO: 2026595 - RNA, 13 nt, Homo sapiens
uaaguuuuugcca

SEQ ID NO: 2026596 - RNA, 19 nt, Homo sapiens
aguuugguccuggggacca

SEQ ID NO: 2026597 - RNA, 13 nt, Homo sapiens
cuaccaacuggaa

SEQ ID NO: 2026598 - RNA, 23 nt, Homo sapiens
cucgauuagacuccauguaguua

SEQ ID NO: 2026599 - RNA, 21 nt, Homo sapiens
cgauuuuuuuuuuuuccucuu

SEQ ID NO: 2026600 - RNA, 20 nt, Homo sapiens
uaucauuggaacaacugaua

SEQ ID NO: 2026601 - RNA, 14 nt, Homo sapiens
uucgguuccagaca

SEQ ID NO: 2026602 - RNA, 15 nt, Homo sapiens
cccaguguccaugga

SEQ ID NO: 2026603 - RNA, 13 nt, Homo sapiens
gcaucuugccagc

SEQ ID NO: 2026604 - RNA, 21 nt, Homo sapiens
caguguccccuccacugucac

SEQ ID NO: 2026605 - RNA, 20 nt, Homo sapiens
aaguccacagaagugagcuc

SEQ ID NO: 2026606 - RNA, 18 nt, Homo sapiens
agcaaaugcuacauauau

SEQ ID NO: 2026607 - RNA, 22 nt, Homo sapiens
aaauacacugugaagagacuuu

SEQ ID NO: 2026608 - RNA, 14 nt, Homo sapiens
uucuuucugcuaua

SEQ ID NO: 2026609 - RNA, 15 nt, Homo sapiens
augcuuuuucucaga

SEQ ID NO: 2026610 - RNA, 21 nt, Homo sapiens
aggaguuuugggaaugcacuu

SEQ ID NO: 2026611 - RNA, 22 nt, Homo sapiens
auaugcagcugugauacuugua

SEQ ID NO: 2026612 - RNA, 14 nt, Homo sapiens
caugugcuugugcc

SEQ ID NO: 2026613 - RNA, 23 nt, Homo sapiens
caaguuaaagugaauaaccacuu

SEQ ID NO: 2026614 - RNA, 17 nt, Homo sapiens
ccaaaauuaccaaaaau

SEQ ID NO: 2026615 - RNA, 12 nt, Homo sapiens
ucagagacagau

SEQ ID NO: 2026616 - RNA, 22 nt, Homo sapiens
acacugaaauauacacacagca

SEQ ID NO: 2026617 - RNA, 13 nt, Homo sapiens
auucuuccugcuu

SEQ ID NO: 2026618 - RNA, 13 nt, Homo sapiens
aacuuagucaaua

SEQ ID NO: 2026619 - RNA, 14 nt, Homo sapiens
uagaaaaaggaaug

SEQ ID NO: 2026620 - RNA, 19 nt, Homo sapiens
gugcugggauuacaggcgu

SEQ ID NO: 2026621 - RNA, 20 nt, Homo sapiens
uguaaaacgcaccaaucagc

SEQ ID NO: 2026622 - RNA, 20 nt, Homo sapiens
ugcacugaccuguaggucag

SEQ ID NO: 2026623 - RNA, 12 nt, Homo sapiens
cacacacuccuu

SEQ ID NO: 2026624 - RNA, 20 nt, Homo sapiens
ugugaugugucacagguuaa

SEQ ID NO: 2026625 - RNA, 13 nt, Homo sapiens
cagaggccaugaa

SEQ ID NO: 2026626 - RNA, 14 nt, Homo sapiens
aaugcaauguggaa

SEQ ID NO: 2026627 - RNA, 16 nt, Homo sapiens
cugcuguuaaagacau

SEQ ID NO: 2026628 - RNA, 23 nt, Homo sapiens
aacucugaaagagcaaaccuaac

SEQ ID NO: 2026629 - RNA, 15 nt, Homo sapiens
auacuuuaaaggaaa

SEQ ID NO: 2026630 - RNA, 17 nt, Homo sapiens
caagcauucugugcaua

SEQ ID NO: 2026631 - RNA, 22 nt, Homo sapiens
guggguuuuuuugaauguuggu

SEQ ID NO: 2026632 - RNA, 24 nt, Homo sapiens
cucccuuuguuuaaaaugucauuu

SEQ ID NO: 2026633 - RNA, 15 nt, Homo sapiens
ccaagaccacccucc

SEQ ID NO: 2026634 - RNA, 22 nt, Homo sapiens
uggcuguuggccccucugcugu

SEQ ID NO: 2026635 - RNA, 21 nt, Homo sapiens
uccuggagcuauucacagugc

SEQ ID NO: 2026636 - RNA, 19 nt, Homo sapiens
uauuugcccaaaucuucuu

SEQ ID NO: 2026637 - RNA, 12 nt, Homo sapiens
uauaaacacaaa

SEQ ID NO: 2026638 - RNA, 22 nt, Homo sapiens
aacucucuccuguauaaucucu

SEQ ID NO: 2026639 - RNA, 19 nt, Homo sapiens
augggagcuuaacuuuaua

SEQ ID NO: 2026640 - RNA, 19 nt, Homo sapiens
ccagaugugaaaacaucuc

SEQ ID NO: 2026641 - RNA, 18 nt, Homo sapiens
aggguccuccuccaucuu

SEQ ID NO: 2026642 - RNA, 22 nt, Homo sapiens
aaggugagcugggggcgagaaa

SEQ ID NO: 2026643 - RNA, 18 nt, Homo sapiens
cagaaggaaccagccaug

SEQ ID NO: 2026644 - RNA, 20 nt, Homo sapiens
gcuaaugaagcuauugagaa

SEQ ID NO: 2026645 - RNA, 17 nt, Homo sapiens
caagucaaauaccacau

SEQ ID NO: 2026646 - RNA, 19 nt, Homo sapiens
uccuguucacaccagagaa

SEQ ID NO: 2026647 - RNA, 11 nt, Homo sapiens
aguccagugac

SEQ ID NO: 2026648 - RNA, 15 nt, Homo sapiens
aaagcacaaucaacu

SEQ ID NO: 2026649 - RNA, 14 nt, Homo sapiens
accccacaagcacc

SEQ ID NO: 2026650 - RNA, 23 nt, Homo sapiens
guuaagaguccuuuugaauuaaa

SEQ ID NO: 2026651 - RNA, 17 nt, Homo sapiens
auuggccagagccugug

SEQ ID NO: 2026652 - RNA, 16 nt, Homo sapiens
cuaugucuagcacaug

SEQ ID NO: 2026653 - RNA, 13 nt, Homo sapiens
aaaugagcaggga

SEQ ID NO: 2026654 - RNA, 23 nt, Homo sapiens
auuauuugggagggaaaagggaa

SEQ ID NO: 2026655 - RNA, 12 nt, Homo sapiens
gccucuugcccc

SEQ ID NO: 2026656 - RNA, 19 nt, Homo sapiens
ugcuguuaauauaguuuag

SEQ ID NO: 2026657 - RNA, 20 nt, Homo sapiens
gcgugucucugccauguggc

SEQ ID NO: 2026658 - RNA, 13 nt, Homo sapiens
agcaaauauauaa

SEQ ID NO: 2026659 - RNA, 22 nt, Homo sapiens
agcucuuucucuuuguauuuca

SEQ ID NO: 2026660 - RNA, 21 nt, Homo sapiens
cugugccaacuacuacuggug

SEQ ID NO: 2026661 - RNA, 17 nt, Homo sapiens
cuaggccuuuccucugc

SEQ ID NO: 2026662 - RNA, 20 nt, Homo sapiens
guuuaggaucaucucugcag

SEQ ID NO: 2026663 - RNA, 20 nt, Homo sapiens
ugcaaccacugcaauaucuu

SEQ ID NO: 2026664 - RNA, 19 nt, Homo sapiens
uuccacccugcccuggccu

SEQ ID NO: 2026665 - RNA, 12 nt, Homo sapiens
agugauccucag

SEQ ID NO: 2026666 - RNA, 18 nt, Homo sapiens
cuugggaugaagagggua

SEQ ID NO: 2026667 - RNA, 22 nt, Homo sapiens
uuugggagcccaugggggagcu

SEQ ID NO: 2026668 - RNA, 21 nt, Homo sapiens
cucugaaaacaaugcugagaa

SEQ ID NO: 2026669 - RNA, 21 nt, Homo sapiens
gggguuugcuuguaaaaccaa

SEQ ID NO: 2026670 - RNA, 22 nt, Homo sapiens
ccucggagccccccacucagua

SEQ ID NO: 2026671 - RNA, 16 nt, Homo sapiens
ugcaaaccuauuuccc

SEQ ID NO: 2026672 - RNA, 20 nt, Homo sapiens
gcacugagcagggaucugcc

SEQ ID NO: 2026673 - RNA, 14 nt, Homo sapiens
aaacugucuuggcu

SEQ ID NO: 2026674 - RNA, 23 nt, Homo sapiens
ccuuaacuuuaaaugacauuugu

SEQ ID NO: 2026675 - RNA, 19 nt, Homo sapiens
ucaguuucuucaccuguaa

SEQ ID NO: 2026676 - RNA, 18 nt, Homo sapiens
auuacuguugcauuuacu

SEQ ID NO: 2026677 - RNA, 14 nt, Homo sapiens
uauuaugcccaguu

SEQ ID NO: 2026678 - RNA, 23 nt, Homo sapiens
auguuuaugaaggguaagggaau

SEQ ID NO: 2026679 - RNA, 14 nt, Homo sapiens
uguggauuccagca

SEQ ID NO: 2026680 - RNA, 16 nt, Homo sapiens
auagccaggcucucug

SEQ ID NO: 2026681 - RNA, 23 nt, Homo sapiens
aaauauauauuauauauuuacaa

SEQ ID NO: 2026682 - RNA, 13 nt, Homo sapiens
cugaaaaaugccu

SEQ ID NO: 2026683 - RNA, 22 nt, Homo sapiens
guuucuccuguuggcucacagg

SEQ ID NO: 2026684 - RNA, 15 nt, Homo sapiens
cacucaauuucucug

SEQ ID NO: 2026685 - RNA, 16 nt, Homo sapiens
auuauuggauucacac

SEQ ID NO: 2026686 - RNA, 19 nt, Homo sapiens
caaaagcacuuugugcugu

SEQ ID NO: 2026687 - RNA, 22 nt, Homo sapiens
aagagcagcugccauugcagau

SEQ ID NO: 2026688 - RNA, 21 nt, Homo sapiens
gaaugaagccuuagccaggag

SEQ ID NO: 2026689 - RNA, 18 nt, Homo sapiens
cuaauagaaccaagaauu

SEQ ID NO: 2026690 - RNA, 13 nt, Homo sapiens
auaugcagccgcu

SEQ ID NO: 2026691 - RNA, 18 nt, Homo sapiens
ugccuccuggguucaagc

SEQ ID NO: 2026692 - RNA, 14 nt, Homo sapiens
cugguuuggaguuu

SEQ ID NO: 2026693 - RNA, 15 nt, Homo sapiens
acagagaugugcaug

SEQ ID NO: 2026694 - RNA, 14 nt, Homo sapiens
uccaaggguuuuca

SEQ ID NO: 2026695 - RNA, 20 nt, Homo sapiens
gccgagaucacaccacugua

SEQ ID NO: 2026696 - RNA, 20 nt, Homo sapiens
gcugagaucacaccacugca

SEQ ID NO: 2026697 - RNA, 22 nt, Homo sapiens
gccaacagguggggagagacag

SEQ ID NO: 2026698 - RNA, 17 nt, Homo sapiens
ugccacuugcacugugc

SEQ ID NO: 2026699 - RNA, 17 nt, Homo sapiens
acuaccuuuauagcucu

SEQ ID NO: 2026700 - RNA, 14 nt, Homo sapiens
uugucaauuaccag

SEQ ID NO: 2026701 - RNA, 17 nt, Homo sapiens
acauagguguugucaag

SEQ ID NO: 2026702 - RNA, 14 nt, Homo sapiens
ugaaccuuugucca

SEQ ID NO: 2026703 - RNA, 14 nt, Homo sapiens
uuuccucuguucac

SEQ ID NO: 2026704 - RNA, 20 nt, Homo sapiens
aguacuauuacuaguacuag

SEQ ID NO: 2026705 - RNA, 17 nt, Homo sapiens
uuuagagcguuugguua

SEQ ID NO: 2026706 - RNA, 15 nt, Homo sapiens
acauuguacuguugc

SEQ ID NO: 2026707 - RNA, 14 nt, Homo sapiens
aaacuggauucaca

SEQ ID NO: 2026708 - RNA, 23 nt, Homo sapiens
gauuuaccuguuuuucaguauuu

SEQ ID NO: 2026709 - RNA, 23 nt, Homo sapiens
acuuaagggaacugaaucacuua

SEQ ID NO: 2026710 - RNA, 15 nt, Homo sapiens
aagguauuugggaaa

SEQ ID NO: 2026711 - RNA, 18 nt, Homo sapiens
cauucagagcuauggugc

SEQ ID NO: 2026712 - RNA, 21 nt, Homo sapiens
ucuucgcagccuagauaugaa

SEQ ID NO: 2026713 - RNA, 17 nt, Homo sapiens
augacgguauuaugcuu

SEQ ID NO: 2026714 - RNA, 17 nt, Homo sapiens
uacauuuagucuuccuu

SEQ ID NO: 2026715 - RNA, 19 nt, Homo sapiens
cugggguccccacucccug

SEQ ID NO: 2026716 - RNA, 14 nt, Homo sapiens
aacagcaccucccc

SEQ ID NO: 2026717 - RNA, 18 nt, Homo sapiens
ugauugcauccacuagcu

SEQ ID NO: 2026718 - RNA, 17 nt, Homo sapiens
gaacugcgugccagugu

SEQ ID NO: 2026719 - RNA, 22 nt, Homo sapiens
ggauuuggguuuggaaauggag

SEQ ID NO: 2026720 - RNA, 20 nt, Homo sapiens
ggauuguuguuuaacuugua

SEQ ID NO: 2026721 - RNA, 20 nt, Homo sapiens
ggcaugagauagcugguguu

SEQ ID NO: 2026722 - RNA, 12 nt, Homo sapiens
augaaaagccau

SEQ ID NO: 2026723 - RNA, 13 nt, Homo sapiens
cugcaacgcugcc

SEQ ID NO: 2026724 - RNA, 13 nt, Homo sapiens
aggaugacaguga

SEQ ID NO: 2026725 - RNA, 21 nt, Homo sapiens
uagcuccccuggcuggcuccu

SEQ ID NO: 2026726 - RNA, 15 nt, Homo sapiens
aacaugugaggccug

SEQ ID NO: 2026727 - RNA, 15 nt, Homo sapiens
gcacagagauaugca

SEQ ID NO: 2026728 - RNA, 22 nt, Homo sapiens
uccaucacccguacaggcaauu

SEQ ID NO: 2026729 - RNA, 12 nt, Homo sapiens
uuauugagcucu

SEQ ID NO: 2026730 - RNA, 23 nt, Homo sapiens
acaaccuaacuuauggacuguuu

SEQ ID NO: 2026731 - RNA, 19 nt, Homo sapiens
ugugccauuauauuugcau

SEQ ID NO: 2026732 - RNA, 17 nt, Homo sapiens
aacaaagaacaagcauu

SEQ ID NO: 2026733 - RNA, 19 nt, Homo sapiens
accuggcagcucuggacag

SEQ ID NO: 2026734 - RNA, 14 nt, Homo sapiens
ugaaugcuauugaa

SEQ ID NO: 2026735 - RNA, 14 nt, Homo sapiens
accacugggaacca

SEQ ID NO: 2026736 - RNA, 23 nt, Homo sapiens
acccaccugguacugacccagga

SEQ ID NO: 2026737 - RNA, 15 nt, Homo sapiens
aaggagaaaggcaug

SEQ ID NO: 2026738 - RNA, 18 nt, Homo sapiens
acccagggaaggugcuga

SEQ ID NO: 2026739 - RNA, 16 nt, Homo sapiens
gaaaaauugucugcau

SEQ ID NO: 2026740 - RNA, 21 nt, Homo sapiens
gagcgccggauuugcucccac

SEQ ID NO: 2026741 - RNA, 15 nt, Homo sapiens
uaaugucagucuaca

SEQ ID NO: 2026742 - RNA, 14 nt, Homo sapiens
uccaaaugcuuuca

SEQ ID NO: 2026743 - RNA, 23 nt, Homo sapiens
uaccacucgcguguuccccaagc

SEQ ID NO: 2026744 - RNA, 22 nt, Homo sapiens
ugggagcucuguuuucaugcua

SEQ ID NO: 2026745 - RNA, 13 nt, Homo sapiens
ucaaaugauccuu

SEQ ID NO: 2026746 - RNA, 17 nt, Homo sapiens
auuccucaugucaucaa

SEQ ID NO: 2026747 - RNA, 22 nt, Homo sapiens
gucaaaauuguuuaccauagaa

SEQ ID NO: 2026748 - RNA, 19 nt, Homo sapiens
ccgagcggggagccaggaa

SEQ ID NO: 2026749 - RNA, 23 nt, Homo sapiens
ccugcucaacauaggccugcuca

SEQ ID NO: 2026750 - RNA, 18 nt, Homo sapiens
cuuucguugauggccaaa

SEQ ID NO: 2026751 - RNA, 10 nt, Homo sapiens
gaauuuccac

SEQ ID NO: 2026752 - RNA, 14 nt, Homo sapiens
gcuccuccaugccu

SEQ ID NO: 2026753 - RNA, 18 nt, Homo sapiens
uguccaugugugugcaag

SEQ ID NO: 2026754 - RNA, 16 nt, Homo sapiens
uucagaaacagugagu

SEQ ID NO: 2026755 - RNA, 15 nt, Homo sapiens
caggaaaggccccaa

SEQ ID NO: 2026756 - RNA, 21 nt, Homo sapiens
cagagcgccaggaagccagag

SEQ ID NO: 2026757 - RNA, 15 nt, Homo sapiens
gcccacagcaggcca

SEQ ID NO: 2026758 - RNA, 14 nt, Homo sapiens
agaagucucccugc

SEQ ID NO: 2026759 - RNA, 18 nt, Homo sapiens
gguucuuuagcugucacu

SEQ ID NO: 2026760 - RNA, 18 nt, Homo sapiens
guucacaaguaaucuguu

SEQ ID NO: 2026761 - RNA, 13 nt, Homo sapiens
cacuugcucagcc

SEQ ID NO: 2026762 - RNA, 14 nt, Homo sapiens
accucacucuugcc

SEQ ID NO: 2026763 - RNA, 18 nt, Homo sapiens
uggcgggugccuguaauc

SEQ ID NO: 2026764 - RNA, 15 nt, Homo sapiens
ccucaauucacauag

SEQ ID NO: 2026765 - RNA, 12 nt, Homo sapiens
cucuaugccugc

SEQ ID NO: 2026766 - RNA, 17 nt, Homo sapiens
ucuggaggucaucuggc

SEQ ID NO: 2026767 - RNA, 15 nt, Homo sapiens
acugaaaagccaugu

SEQ ID NO: 2026768 - RNA, 17 nt, Homo sapiens
acaugguccaugucuau

SEQ ID NO: 2026769 - RNA, 23 nt, Homo sapiens
agccccuggucccucugcagucu

SEQ ID NO: 2026770 - RNA, 20 nt, Homo sapiens
aauauagacuggauaaucaa

SEQ ID NO: 2026771 - RNA, 20 nt, Homo sapiens
aucccgagcaacccucugaa

SEQ ID NO: 2026772 - RNA, 15 nt, Homo sapiens
gaagacacugcaaag

SEQ ID NO: 2026773 - RNA, 16 nt, Homo sapiens
uuauccuguuacugaa

SEQ ID NO: 2026774 - RNA, 16 nt, Homo sapiens
uugacuggcuguguga

SEQ ID NO: 2026775 - RNA, 18 nt, Homo sapiens
cagaauuaacuauaacaa

SEQ ID NO: 2026776 - RNA, 14 nt, Homo sapiens
aaaucuauagcauu

SEQ ID NO: 2026777 - RNA, 18 nt, Homo sapiens
ucugcaagggcccagagu

SEQ ID NO: 2026778 - RNA, 14 nt, Homo sapiens
uagaauaaucuauu

SEQ ID NO: 2026779 - RNA, 14 nt, Homo sapiens
auucaagaaugcca

SEQ ID NO: 2026780 - RNA, 14 nt, Homo sapiens
ccgccagaccucaa

SEQ ID NO: 2026781 - RNA, 19 nt, Homo sapiens
ccauguuucauuaaucaag

SEQ ID NO: 2026782 - RNA, 13 nt, Homo sapiens
gacacaugcuguu

SEQ ID NO: 2026783 - RNA, 15 nt, Homo sapiens
auugcacugcuguuc

SEQ ID NO: 2026784 - RNA, 13 nt, Homo sapiens
uuccucagccucc

SEQ ID NO: 2026785 - RNA, 19 nt, Homo sapiens
aauucaaauaaccuaaaaa

SEQ ID NO: 2026786 - RNA, 22 nt, Homo sapiens
ccaauaauaaagacauuuccua

SEQ ID NO: 2026787 - RNA, 14 nt, Homo sapiens
aauaucacacucgu

SEQ ID NO: 2026788 - RNA, 13 nt, Homo sapiens
agugcccuaggcc

SEQ ID NO: 2026789 - RNA, 18 nt, Homo sapiens
ugaauuauauguucagau

SEQ ID NO: 2026790 - RNA, 14 nt, Homo sapiens
guccucacaugccc

SEQ ID NO: 2026791 - RNA, 13 nt, Homo sapiens
ucuauagcagauu

SEQ ID NO: 2026792 - RNA, 18 nt, Homo sapiens
ugaacuguggggugugca

SEQ ID NO: 2026793 - RNA, 16 nt, Homo sapiens
ucauuaauacuguagu

SEQ ID NO: 2026794 - RNA, 16 nt, Homo sapiens
uggaacacucucugag

SEQ ID NO: 2026795 - RNA, 15 nt, Homo sapiens
uguccucuacauacc

SEQ ID NO: 2026796 - RNA, 22 nt, Homo sapiens
agacaaugauauugacacuguc

SEQ ID NO: 2026797 - RNA, 18 nt, Homo sapiens
aacgacaaagcaugguau

SEQ ID NO: 2026798 - RNA, 20 nt, Homo sapiens
agggcgagguaaaguuuaug

SEQ ID NO: 2026799 - RNA, 12 nt, Homo sapiens
agaacuacugau

SEQ ID NO: 2026800 - RNA, 15 nt, Homo sapiens
uccugacucacugac

SEQ ID NO: 2026801 - RNA, 22 nt, Homo sapiens
ucccagagaugacaaauggaga

SEQ ID NO: 2026802 - RNA, 21 nt, Homo sapiens
accugugcacagccauggcug

SEQ ID NO: 2026803 - RNA, 13 nt, Homo sapiens
augacaagcacua

SEQ ID NO: 2026804 - RNA, 17 nt, Homo sapiens
auggcccagccacugca

SEQ ID NO: 2026805 - RNA, 15 nt, Homo sapiens
gcaaauacaaucagc

SEQ ID NO: 2026806 - RNA, 17 nt, Homo sapiens
gcaggaucccuacugcc

SEQ ID NO: 2026807 - RNA, 17 nt, Homo sapiens
ucuccugaccucgugau

SEQ ID NO: 2026808 - RNA, 19 nt, Homo sapiens
uguuaacauuagcaaauau

SEQ ID NO: 2026809 - RNA, 21 nt, Homo sapiens
aaccaagguuuugaaauccca

SEQ ID NO: 2026810 - RNA, 19 nt, Homo sapiens
uagcuauuuucuuacagug

SEQ ID NO: 2026811 - RNA, 20 nt, Homo sapiens
acaaauauaaaacuauaagu

SEQ ID NO: 2026812 - RNA, 17 nt, Homo sapiens
uagaaagaaaaauugga

SEQ ID NO: 2026813 - RNA, 16 nt, Homo sapiens
cagcagaauggaggca

SEQ ID NO: 2026814 - RNA, 22 nt, Homo sapiens
gcaaccucuuugcucaacagaa

SEQ ID NO: 2026815 - RNA, 17 nt, Homo sapiens
acugguaaaaagaucca

SEQ ID NO: 2026816 - RNA, 17 nt, Homo sapiens
ucauauacaauugucau

SEQ ID NO: 2026817 - RNA, 22 nt, Homo sapiens
aaccgauugccuuuauuuugcu

SEQ ID NO: 2026818 - RNA, 20 nt, Homo sapiens
auguugagcugaguuccuua

SEQ ID NO: 2026819 - RNA, 14 nt, Homo sapiens
uucuguuuccauag

SEQ ID NO: 2026820 - RNA, 16 nt, Homo sapiens
uuuucuggccuuucau

SEQ ID NO: 2026821 - RNA, 19 nt, Homo sapiens
auuucaaauugaauuugca

SEQ ID NO: 2026822 - RNA, 12 nt, Homo sapiens
ggcauacuaaua

SEQ ID NO: 2026823 - RNA, 16 nt, Homo sapiens
cuacagagaagccuuc

SEQ ID NO: 2026824 - RNA, 20 nt, Homo sapiens
aagauuucauggacacugau

SEQ ID NO: 2026825 - RNA, 19 nt, Homo sapiens
uccucacauacccacacau

SEQ ID NO: 2026826 - RNA, 14 nt, Homo sapiens
ccuccugcacacag

SEQ ID NO: 2026827 - RNA, 16 nt, Homo sapiens
aaguccacuuuacuca

SEQ ID NO: 2026828 - RNA, 15 nt, Homo sapiens
aggugaucucuggga

SEQ ID NO: 2026829 - RNA, 15 nt, Homo sapiens
gcuguuuacagacaa

SEQ ID NO: 2026830 - RNA, 20 nt, Homo sapiens
ggccccuucucucccugcca

SEQ ID NO: 2026831 - RNA, 16 nt, Homo sapiens
uuaauugcucuaugcc

SEQ ID NO: 2026832 - RNA, 20 nt, Homo sapiens
ugcucuugcaucugggccag

SEQ ID NO: 2026833 - RNA, 15 nt, Homo sapiens
uacacagcccaagag

SEQ ID NO: 2026834 - RNA, 17 nt, Homo sapiens
agagccugagacuggaa

SEQ ID NO: 2026835 - RNA, 21 nt, Homo sapiens
accugguagaucaagcauuac

SEQ ID NO: 2026836 - RNA, 16 nt, Homo sapiens
gcuagacauugcaauu

SEQ ID NO: 2026837 - RNA, 19 nt, Homo sapiens
uccaggugaggcccaagag

SEQ ID NO: 2026838 - RNA, 19 nt, Homo sapiens
aaaugagccccuucauccg

SEQ ID NO: 2026839 - RNA, 21 nt, Homo sapiens
cugugcaugguggcaccagcg

SEQ ID NO: 2026840 - RNA, 19 nt, Homo sapiens
cuuuaaagccugccucuuc

SEQ ID NO: 2026841 - RNA, 21 nt, Homo sapiens
auuaaacugaaucacaaugua

SEQ ID NO: 2026842 - RNA, 17 nt, Homo sapiens
ucccaggaagcagggag

SEQ ID NO: 2026843 - RNA, 19 nt, Homo sapiens
ugcagaggucagacuaaga

SEQ ID NO: 2026844 - RNA, 20 nt, Homo sapiens
accauggauagaaucaauau

SEQ ID NO: 2026845 - RNA, 14 nt, Homo sapiens
ucccaacuugccuu

SEQ ID NO: 2026846 - RNA, 19 nt, Homo sapiens
agauauugugaaguacaua

SEQ ID NO: 2026847 - RNA, 20 nt, Homo sapiens
ccgaggcugggacacugugu

SEQ ID NO: 2026848 - RNA, 23 nt, Homo sapiens
cuagugcuuccacuucuaugcaa

SEQ ID NO: 2026849 - RNA, 20 nt, Homo sapiens
gaaagccucagaguccugcc

SEQ ID NO: 2026850 - RNA, 23 nt, Homo sapiens
agacagaacuccugcauggcuca

SEQ ID NO: 2026851 - RNA, 18 nt, Homo sapiens
agucucucucugccaugg

SEQ ID NO: 2026852 - RNA, 10 nt, Homo sapiens
ucaauggagu

SEQ ID NO: 2026853 - RNA, 14 nt, Homo sapiens
uugauuauuugcau

SEQ ID NO: 2026854 - RNA, 14 nt, Homo sapiens
cucauuaucuccau

SEQ ID NO: 2026855 - RNA, 22 nt, Homo sapiens
ugaagucucaagaacugccaua

SEQ ID NO: 2026856 - RNA, 21 nt, Homo sapiens
acuguguauguuuuauaucaa

SEQ ID NO: 2026857 - RNA, 21 nt, Homo sapiens
gccuuugcccacguguccuga

SEQ ID NO: 2026858 - RNA, 19 nt, Homo sapiens
auuguuguaagagugauuu

SEQ ID NO: 2026859 - RNA, 16 nt, Homo sapiens
cuacaaaaauacaauu

SEQ ID NO: 2026860 - RNA, 13 nt, Homo sapiens
guaaauguucaag

SEQ ID NO: 2026861 - RNA, 13 nt, Homo sapiens
uuuuaugugcuug

SEQ ID NO: 2026862 - RNA, 21 nt, Homo sapiens
uggauacagaaugaaucccau

SEQ ID NO: 2026863 - RNA, 23 nt, Homo sapiens
acccgccuuggccucccaaagug

SEQ ID NO: 2026864 - RNA, 17 nt, Homo sapiens
aaacaccaaaaagggau

SEQ ID NO: 2026865 - RNA, 12 nt, Homo sapiens
guagaugugauu

SEQ ID NO: 2026866 - RNA, 16 nt, Homo sapiens
guuugaaccaagaacu

SEQ ID NO: 2026867 - RNA, 21 nt, Homo sapiens
acaucaacugaucucauuucu

SEQ ID NO: 2026868 - RNA, 19 nt, Homo sapiens
agaaccaugguaugaaggu

SEQ ID NO: 2026869 - RNA, 18 nt, Homo sapiens
auauucaagguuauaugu

SEQ ID NO: 2026870 - RNA, 22 nt, Homo sapiens
agcaucuucacuucuaaaugca

SEQ ID NO: 2026871 - RNA, 18 nt, Homo sapiens
uggcugauuucaaaugca

SEQ ID NO: 2026872 - RNA, 22 nt, Homo sapiens
ccucaacaacguaaacuuccua

SEQ ID NO: 2026873 - RNA, 17 nt, Homo sapiens
gugaucccagccagggc

SEQ ID NO: 2026874 - RNA, 17 nt, Homo sapiens
cuguucuagagugacag

SEQ ID NO: 2026875 - RNA, 19 nt, Homo sapiens
cuggaggcucccaugggcu

SEQ ID NO: 2026876 - RNA, 21 nt, Homo sapiens
aacaaccguuggaaacauaac

SEQ ID NO: 2026877 - RNA, 20 nt, Homo sapiens
uaagcucacguccugagaaa

SEQ ID NO: 2026878 - RNA, 15 nt, Homo sapiens
ccugccugugaguga

SEQ ID NO: 2026879 - RNA, 19 nt, Homo sapiens
gugggucccagagaccuca

SEQ ID NO: 2026880 - RNA, 13 nt, Homo sapiens
ccuaugccuucaa

SEQ ID NO: 2026881 - RNA, 16 nt, Homo sapiens
accuacuaggccauua

SEQ ID NO: 2026882 - RNA, 16 nt, Homo sapiens
aggcccgcaccgcugg

SEQ ID NO: 2026883 - RNA, 21 nt, Homo sapiens
agcaaaccacauaaucucucu

SEQ ID NO: 2026884 - RNA, 13 nt, Homo sapiens
uagauuuggcauc

SEQ ID NO: 2026885 - RNA, 18 nt, Homo sapiens
guggagauuuacacuaca

SEQ ID NO: 2026886 - RNA, 15 nt, Homo sapiens
augaguuucacugua

SEQ ID NO: 2026887 - RNA, 20 nt, Homo sapiens
cagguguaagccaccgugcc

SEQ ID NO: 2026888 - RNA, 15 nt, Homo sapiens
guguucccgugccug

SEQ ID NO: 2026889 - RNA, 19 nt, Homo sapiens
ggagagcccgugggggcag

SEQ ID NO: 2026890 - RNA, 17 nt, Homo sapiens
cagagggagacuccauc

SEQ ID NO: 2026891 - RNA, 17 nt, Homo sapiens
ucccagcccccugacca

SEQ ID NO: 2026892 - RNA, 14 nt, Homo sapiens
accuaagucauucc

SEQ ID NO: 2026893 - RNA, 21 nt, Homo sapiens
ugagcuaggggggucagccag

SEQ ID NO: 2026894 - RNA, 23 nt, Homo sapiens
cagugucguuuauauuguagcag

SEQ ID NO: 2026895 - RNA, 17 nt, Homo sapiens
agccaagagugcacuac

SEQ ID NO: 2026896 - RNA, 15 nt, Homo sapiens
cacaagcagggcacu

SEQ ID NO: 2026897 - RNA, 21 nt, Homo sapiens
cauaaaaauaaaucaguucau

SEQ ID NO: 2026898 - RNA, 15 nt, Homo sapiens
aggagcuggaggggu

SEQ ID NO: 2026899 - RNA, 15 nt, Homo sapiens
ggacagcccuuccuc

SEQ ID NO: 2026900 - RNA, 20 nt, Homo sapiens
auucagauuucucuuugaaa

SEQ ID NO: 2026901 - RNA, 21 nt, Homo sapiens
cgauguuauuagauguuacaa

SEQ ID NO: 2026902 - RNA, 13 nt, Homo sapiens
acauggagcucuu

SEQ ID NO: 2026903 - RNA, 23 nt, Homo sapiens
cucucauguuccuggcgugagau

SEQ ID NO: 2026904 - RNA, 13 nt, Homo sapiens
cucaggagacaau

SEQ ID NO: 2026905 - RNA, 15 nt, Homo sapiens
augaauccuacauac

SEQ ID NO: 2026906 - RNA, 20 nt, Homo sapiens
ugguuaauaaguuucacuga

SEQ ID NO: 2026907 - RNA, 19 nt, Homo sapiens
agaugugagccuugugcau

SEQ ID NO: 2026908 - RNA, 20 nt, Homo sapiens
aaauuaaaugcauguccuca

SEQ ID NO: 2026909 - RNA, 21 nt, Homo sapiens
cccuuccacugccucugccuu

SEQ ID NO: 2026910 - RNA, 17 nt, Homo sapiens
uccugccgcaacaguuu

SEQ ID NO: 2026911 - RNA, 13 nt, Homo sapiens
auauuacagugaa

SEQ ID NO: 2026912 - RNA, 12 nt, Homo sapiens
cuuuuacuguga

SEQ ID NO: 2026913 - RNA, 23 nt, Homo sapiens
accuaauucuuguagaugcauua

SEQ ID NO: 2026914 - RNA, 19 nt, Homo sapiens
caauccguucccuucugcc

SEQ ID NO: 2026915 - RNA, 19 nt, Homo sapiens
cuagagacagugaugccug

SEQ ID NO: 2026916 - RNA, 19 nt, Homo sapiens
uauuuauugaguaccuacu

SEQ ID NO: 2026917 - RNA, 23 nt, Homo sapiens
aaccccuuuucaguuugaacucu

SEQ ID NO: 2026918 - RNA, 15 nt, Homo sapiens
ugugauagcacuuuc

SEQ ID NO: 2026919 - RNA, 11 nt, Homo sapiens
uauaauuuuga

SEQ ID NO: 2026920 - RNA, 16 nt, Homo sapiens
caguuuacuuugccaa

SEQ ID NO: 2026921 - RNA, 21 nt, Homo sapiens
caaucacagggaauggccaca

SEQ ID NO: 2026922 - RNA, 18 nt, Homo sapiens
cgccuaggauuucagcca

SEQ ID NO: 2026923 - RNA, 15 nt, Homo sapiens
auuugccagcuuuau

SEQ ID NO: 2026924 - RNA, 17 nt, Homo sapiens
cuaguaagaugcacuga

SEQ ID NO: 2026925 - RNA, 17 nt, Homo sapiens
gccuuuaucucagccau

SEQ ID NO: 2026926 - RNA, 12 nt, Homo sapiens
agugcaggacaa

SEQ ID NO: 2026927 - RNA, 15 nt, Homo sapiens
auuugccauagccuu

SEQ ID NO: 2026928 - RNA, 18 nt, Homo sapiens
caccauuucugucacuca

SEQ ID NO: 2026929 - RNA, 19 nt, Homo sapiens
gcucuaaauuaagacagca

SEQ ID NO: 2026930 - RNA, 22 nt, Homo sapiens
caaaggagugagugaaacuccc

SEQ ID NO: 2026931 - RNA, 13 nt, Homo sapiens
ggcccaauucugc

SEQ ID NO: 2026932 - RNA, 21 nt, Homo sapiens
gugacaagugacccccagcua

SEQ ID NO: 2026933 - RNA, 13 nt, Homo sapiens
uaugcagauacuu

SEQ ID NO: 2026934 - RNA, 15 nt, Homo sapiens
uugugugaguguacc

SEQ ID NO: 2026935 - RNA, 14 nt, Homo sapiens
cuggggacaccagc

SEQ ID NO: 2026936 - RNA, 20 nt, Homo sapiens
auauucuaaguuagacucuu

SEQ ID NO: 2026937 - RNA, 12 nt, Homo sapiens
augcaggggaug

SEQ ID NO: 2026938 - RNA, 15 nt, Homo sapiens
ucuggguagcuguaa

SEQ ID NO: 2026939 - RNA, 22 nt, Homo sapiens
caguaaaugcagacugcugcaa

SEQ ID NO: 2026940 - RNA, 22 nt, Homo sapiens
acauggagaaaaccaaaaugau

SEQ ID NO: 2026941 - RNA, 21 nt, Homo sapiens
ccuacuuuugggaaucuguag

SEQ ID NO: 2026942 - RNA, 17 nt, Homo sapiens
ccagagagagcucugca

SEQ ID NO: 2026943 - RNA, 17 nt, Homo sapiens
gaaggccuugcugucau

SEQ ID NO: 2026944 - RNA, 19 nt, Homo sapiens
uuguaccuuauugaucuuu

SEQ ID NO: 2026945 - RNA, 17 nt, Homo sapiens
cuucccccagcaccauu

SEQ ID NO: 2026946 - RNA, 19 nt, Homo sapiens
uaagaauguuuugcacuga

SEQ ID NO: 2026947 - RNA, 22 nt, Homo sapiens
cugccuuguuuggauuggcacu

SEQ ID NO: 2026948 - RNA, 22 nt, Homo sapiens
cuuucaagaagugccaguugau

SEQ ID NO: 2026949 - RNA, 16 nt, Homo sapiens
gcuggaauuucugcug

SEQ ID NO: 2026950 - RNA, 23 nt, Homo sapiens
guaacuguaaagaugaaugucag

SEQ ID NO: 2026951 - RNA, 16 nt, Homo sapiens
cuuggagugugugaua

SEQ ID NO: 2026952 - RNA, 20 nt, Homo sapiens
cuuccaaagugcugggauua

SEQ ID NO: 2026953 - RNA, 15 nt, Homo sapiens
accagcauauugugu

SEQ ID NO: 2026954 - RNA, 17 nt, Homo sapiens
agcaauguggauaugac

SEQ ID NO: 2026955 - RNA, 15 nt, Homo sapiens
gucacaccaucuuaa

SEQ ID NO: 2026956 - RNA, 16 nt, Homo sapiens
ucagguucuucagggc

SEQ ID NO: 2026957 - RNA, 18 nt, Homo sapiens
uuucagugugagucagaa

SEQ ID NO: 2026958 - RNA, 22 nt, Homo sapiens
uauuugguucuccgugaugcug

SEQ ID NO: 2026959 - RNA, 22 nt, Homo sapiens
uaaauccuagcagacacugccu

SEQ ID NO: 2026960 - RNA, 12 nt, Homo sapiens
aagaacauguga

SEQ ID NO: 2026961 - RNA, 13 nt, Homo sapiens
aguauuuugccac

SEQ ID NO: 2026962 - RNA, 20 nt, Homo sapiens
uaagcugggauaaucacauu

SEQ ID NO: 2026963 - RNA, 18 nt, Homo sapiens
uaguucagccauugugga

SEQ ID NO: 2026964 - RNA, 15 nt, Homo sapiens
aaucaucucucauca

SEQ ID NO: 2026965 - RNA, 19 nt, Homo sapiens
gcauggccgcaacuuccca

SEQ ID NO: 2026966 - RNA, 21 nt, Homo sapiens
gcaaaagugagggcuugucau

SEQ ID NO: 2026967 - RNA, 13 nt, Homo sapiens
acaugaaugcagu

SEQ ID NO: 2026968 - RNA, 11 nt, Homo sapiens
aggcuguucuc

SEQ ID NO: 2026969 - RNA, 24 nt, Homo sapiens
ugcuaauuuugaaaaacugcucau

SEQ ID NO: 2026970 - RNA, 19 nt, Homo sapiens
gcagggaagcucuaccgca

SEQ ID NO: 2026971 - RNA, 24 nt, Homo sapiens
ucagaaccugcuccuggaguacac

SEQ ID NO: 2026972 - RNA, 15 nt, Homo sapiens
aaaucuuuagggaau

SEQ ID NO: 2026973 - RNA, 17 nt, Homo sapiens
ccucauguccacucagu

SEQ ID NO: 2026974 - RNA, 14 nt, Homo sapiens
uaaagauacauacc

SEQ ID NO: 2026975 - RNA, 21 nt, Homo sapiens
acauucccuggccgcuucucc

SEQ ID NO: 2026976 - RNA, 18 nt, Homo sapiens
gcauguaaaaaccuugua

SEQ ID NO: 2026977 - RNA, 15 nt, Homo sapiens
aauaaacauucucaa

SEQ ID NO: 2026978 - RNA, 20 nt, Homo sapiens
uauaagcagauuuaacaauu

SEQ ID NO: 2026979 - RNA, 20 nt, Homo sapiens
uuuuacaucaaaaucuggca

SEQ ID NO: 2026980 - RNA, 17 nt, Homo sapiens
guccccucacgugacca

SEQ ID NO: 2026981 - RNA, 15 nt, Homo sapiens
acagcugagcacauu

SEQ ID NO: 2026982 - RNA, 21 nt, Homo sapiens
ucucagugaaauaacuaccuu

SEQ ID NO: 2026983 - RNA, 21 nt, Homo sapiens
cuaguuugcuuugcugaccaa

SEQ ID NO: 2026984 - RNA, 16 nt, Homo sapiens
auggaagggcaaguuu

SEQ ID NO: 2026985 - RNA, 14 nt, Homo sapiens
cugcccaagcacuu

SEQ ID NO: 2026986 - RNA, 16 nt, Homo sapiens
guuucaugagcccaaa

SEQ ID NO: 2026987 - RNA, 22 nt, Homo sapiens
acuugcauauuguuggcacaga

SEQ ID NO: 2026988 - RNA, 19 nt, Homo sapiens
uucaugccugggccugcag

SEQ ID NO: 2026989 - RNA, 21 nt, Homo sapiens
caaagcuucacuucauuuuaa

SEQ ID NO: 2026990 - RNA, 17 nt, Homo sapiens
uuaccacagcaacugac

SEQ ID NO: 2026991 - RNA, 12 nt, Homo sapiens
uauauccaugua

SEQ ID NO: 2026992 - RNA, 15 nt, Homo sapiens
cacauaauucauuaa

SEQ ID NO: 2026993 - RNA, 17 nt, Homo sapiens
gucugagaaauuuacaa

SEQ ID NO: 2026994 - RNA, 18 nt, Homo sapiens
guacaaugugacuuugaa

SEQ ID NO: 2026995 - RNA, 14 nt, Homo sapiens
gcaauacuguccag

SEQ ID NO: 2026996 - RNA, 24 nt, Homo sapiens
cuauugccccuuacgacucucacc

SEQ ID NO: 2026997 - RNA, 12 nt, Homo sapiens
aacaugcauauu

SEQ ID NO: 2026998 - RNA, 18 nt, Homo sapiens
aaaagucuacgcucuccu

SEQ ID NO: 2026999 - RNA, 22 nt, Homo sapiens
agccuacuuucacacuaagaaa

SEQ ID NO: 2027000 - RNA, 23 nt, Homo sapiens
aaacauaacaaaaucacuuccau

SEQ ID NO: 2027001 - RNA, 18 nt, Homo sapiens
uuaaugacagaaugagca

SEQ ID NO: 2027002 - RNA, 18 nt, Homo sapiens
gcagacaguguuuugcac

SEQ ID NO: 2027003 - RNA, 21 nt, Homo sapiens
agugcauggccacagccaccu

SEQ ID NO: 2027004 - RNA, 22 nt, Homo sapiens
ccugaagaucaagccaguucuc

SEQ ID NO: 2027005 - RNA, 20 nt, Homo sapiens
gcauuggguagcuauacuca

SEQ ID NO: 2027006 - RNA, 22 nt, Homo sapiens
auaauccacgcucaucuugcaa

SEQ ID NO: 2027007 - RNA, 18 nt, Homo sapiens
aagucaugguccuggcug

SEQ ID NO: 2027008 - RNA, 20 nt, Homo sapiens
cuuaagaacuuuaauugaca

SEQ ID NO: 2027009 - RNA, 16 nt, Homo sapiens
auugaggaaaaacuga

SEQ ID NO: 2027010 - RNA, 18 nt, Homo sapiens
ccaaggacugagggcagu

SEQ ID NO: 2027011 - RNA, 19 nt, Homo sapiens
cucaggccugcgagaagac

SEQ ID NO: 2027012 - RNA, 21 nt, Homo sapiens
ugguauuuucuagacugugaa

SEQ ID NO: 2027013 - RNA, 12 nt, Homo sapiens
ucaaauguucuc

SEQ ID NO: 2027014 - RNA, 20 nt, Homo sapiens
aggagugcgugccugcuacg

SEQ ID NO: 2027015 - RNA, 20 nt, Homo sapiens
gaagcaaaaacuacccagau

SEQ ID NO: 2027016 - RNA, 17 nt, Homo sapiens
uagaugugacacauucu

SEQ ID NO: 2027017 - RNA, 23 nt, Homo sapiens
aggggcugcagggccacuggaag

SEQ ID NO: 2027018 - RNA, 16 nt, Homo sapiens
ugaacauaacuucuca

SEQ ID NO: 2027019 - RNA, 20 nt, Homo sapiens
acuaauuuuuauuuuugcug

SEQ ID NO: 2027020 - RNA, 22 nt, Homo sapiens
gcagggccaagugcccaugagc

SEQ ID NO: 2027021 - RNA, 22 nt, Homo sapiens
ucacgacucuaccauguccaau

SEQ ID NO: 2027022 - RNA, 12 nt, Homo sapiens
uggaagauggca

SEQ ID NO: 2027023 - RNA, 12 nt, Homo sapiens
gugaagauuuca

SEQ ID NO: 2027024 - RNA, 19 nt, Homo sapiens
gagacagagacaaguaauu

SEQ ID NO: 2027025 - RNA, 19 nt, Homo sapiens
cuggagaagcucccaggaa

SEQ ID NO: 2027026 - RNA, 14 nt, Homo sapiens
cagacucucuguga

SEQ ID NO: 2027027 - RNA, 23 nt, Homo sapiens
agguggguccaggaaggcagcug

SEQ ID NO: 2027028 - RNA, 22 nt, Homo sapiens
caucgaggagcuagaacauucc

SEQ ID NO: 2027029 - RNA, 18 nt, Homo sapiens
ugacauuuuacaauguaa

SEQ ID NO: 2027030 - RNA, 20 nt, Homo sapiens
acauaagaccauaacagcca

SEQ ID NO: 2027031 - RNA, 16 nt, Homo sapiens
aagucagcacuaccuc

SEQ ID NO: 2027032 - RNA, 17 nt, Homo sapiens
auguacuacauuugcau

SEQ ID NO: 2027033 - RNA, 15 nt, Homo sapiens
gugcacaagucuuuc

SEQ ID NO: 2027034 - RNA, 16 nt, Homo sapiens
gggcucccaggggucu

SEQ ID NO: 2027035 - RNA, 13 nt, Homo sapiens
augcacacugaga

SEQ ID NO: 2027036 - RNA, 23 nt, Homo sapiens
aaaauauguuuggaauauuccac

SEQ ID NO: 2027037 - RNA, 20 nt, Homo sapiens
cucuuuuauaacuugcauua

SEQ ID NO: 2027038 - RNA, 23 nt, Homo sapiens
uagauuccucuugccucucucag

SEQ ID NO: 2027039 - RNA, 21 nt, Homo sapiens
cugagacagguuaagggguga

SEQ ID NO: 2027040 - RNA, 16 nt, Homo sapiens
uugcuagcaacaacuu

SEQ ID NO: 2027041 - RNA, 21 nt, Homo sapiens
ucuccauccuaccacaaugca

SEQ ID NO: 2027042 - RNA, 13 nt, Homo sapiens
uaaauugcucugu

SEQ ID NO: 2027043 - RNA, 13 nt, Homo sapiens
caagaugcccuaa

SEQ ID NO: 2027044 - RNA, 23 nt, Homo sapiens
ucagugggaaacaaacugucuaa

SEQ ID NO: 2027045 - RNA, 15 nt, Homo sapiens
agucuguucacugca

SEQ ID NO: 2027046 - RNA, 22 nt, Homo sapiens
gcuccugcccaggccacagaga

SEQ ID NO: 2027047 - RNA, 20 nt, Homo sapiens
ccccuguggccaacugcaaa

SEQ ID NO: 2027048 - RNA, 19 nt, Homo sapiens
agucugaaucucccaagga

SEQ ID NO: 2027049 - RNA, 21 nt, Homo sapiens
gcugcugugggaaaugguacu

SEQ ID NO: 2027050 - RNA, 20 nt, Homo sapiens
gagucuugugugcauugcug

SEQ ID NO: 2027051 - RNA, 12 nt, Homo sapiens
gcaaucuugccc

SEQ ID NO: 2027052 - RNA, 12 nt, Homo sapiens
ccccucuuccaa

SEQ ID NO: 2027053 - RNA, 20 nt, Homo sapiens
agcauuaaaaauaagccaaa

SEQ ID NO: 2027054 - RNA, 17 nt, Homo sapiens
auucuugauguaaaauc

SEQ ID NO: 2027055 - RNA, 13 nt, Homo sapiens
uuagagaaaugca

SEQ ID NO: 2027056 - RNA, 21 nt, Homo sapiens
aaacugcuuacuuaugccaua

SEQ ID NO: 2027057 - RNA, 22 nt, Homo sapiens
ugaguugcacuuauugaccauu

SEQ ID NO: 2027058 - RNA, 17 nt, Homo sapiens
ggguuucauauccagcu

SEQ ID NO: 2027059 - RNA, 12 nt, Homo sapiens
gacauaccuuuu

SEQ ID NO: 2027060 - RNA, 20 nt, Homo sapiens
uuagauauuaggggggaaag

SEQ ID NO: 2027061 - RNA, 16 nt, Homo sapiens
ugcacuguagauuuaa

SEQ ID NO: 2027062 - RNA, 16 nt, Homo sapiens
agugagaaauuaugaa

SEQ ID NO: 2027063 - RNA, 12 nt, Homo sapiens
acauuaugaugu

SEQ ID NO: 2027064 - RNA, 17 nt, Homo sapiens
guuaacagagcuaagaa

SEQ ID NO: 2027065 - RNA, 18 nt, Homo sapiens
aaauuaaaccaacaacaa

SEQ ID NO: 2027066 - RNA, 20 nt, Homo sapiens
uaauaaaaaucaugcuuaua

SEQ ID NO: 2027067 - RNA, 17 nt, Homo sapiens
gaagcucacccaauaaa

SEQ ID NO: 2027068 - RNA, 22 nt, Homo sapiens
acucauccgccuggcccgggaa

SEQ ID NO: 2027069 - RNA, 20 nt, Homo sapiens
uugguggcgcgcaccuguag

SEQ ID NO: 2027070 - RNA, 19 nt, Homo sapiens
cccucaucucacugcccag

SEQ ID NO: 2027071 - RNA, 21 nt, Homo sapiens
ugggaaaaaaguuuugaugaa

SEQ ID NO: 2027072 - RNA, 15 nt, Homo sapiens
ccuuuccuacaguug

SEQ ID NO: 2027073 - RNA, 17 nt, Homo sapiens
agugagcugcacugacc

SEQ ID NO: 2027074 - RNA, 23 nt, Homo sapiens
gguaacucccauaucuccuuuaa

SEQ ID NO: 2027075 - RNA, 14 nt, Homo sapiens
auuguaguguucaa

SEQ ID NO: 2027076 - RNA, 14 nt, Homo sapiens
auauaauaagccca

SEQ ID NO: 2027077 - RNA, 13 nt, Homo sapiens
cuguaaacuacca

SEQ ID NO: 2027078 - RNA, 20 nt, Homo sapiens
ggacuuccagugcucagagg

SEQ ID NO: 2027079 - RNA, 20 nt, Homo sapiens
ugcuaugaagccaacugaca

SEQ ID NO: 2027080 - RNA, 16 nt, Homo sapiens
cuacuucuacauccaa

SEQ ID NO: 2027081 - RNA, 23 nt, Homo sapiens
uaaagagucuggccuggacccug

SEQ ID NO: 2027082 - RNA, 16 nt, Homo sapiens
cuucagccaaacacaa

SEQ ID NO: 2027083 - RNA, 19 nt, Homo sapiens
agauaaucuuuuacauuga

SEQ ID NO: 2027084 - RNA, 18 nt, Homo sapiens
ugcaaccagggagcugca

SEQ ID NO: 2027085 - RNA, 14 nt, Homo sapiens
acuaggcuguguau

SEQ ID NO: 2027086 - RNA, 14 nt, Homo sapiens
augaggcugcuuau

SEQ ID NO: 2027087 - RNA, 18 nt, Homo sapiens
aagagagggcugagccau

SEQ ID NO: 2027088 - RNA, 19 nt, Homo sapiens
cuccacagcgagggcagcu

SEQ ID NO: 2027089 - RNA, 20 nt, Homo sapiens
gcgucgcuggacaacccaga

SEQ ID NO: 2027090 - RNA, 22 nt, Homo sapiens
ugaguguuguuuuaaucagaga

SEQ ID NO: 2027091 - RNA, 23 nt, Homo sapiens
cagaaauauucuacacauaucuu

SEQ ID NO: 2027092 - RNA, 13 nt, Homo sapiens
aguuagccaaaca

SEQ ID NO: 2027093 - RNA, 23 nt, Homo sapiens
ccccaggcccaccaucaccaccg

SEQ ID NO: 2027094 - RNA, 19 nt, Homo sapiens
uacaagcuaagaguuuaca

SEQ ID NO: 2027095 - RNA, 19 nt, Homo sapiens
uggcccucuuugaaagggc

SEQ ID NO: 2027096 - RNA, 21 nt, Homo sapiens
ccuuugcauucaucucucaaa

SEQ ID NO: 2027097 - RNA, 14 nt, Homo sapiens
uuuuacuacccaaa

SEQ ID NO: 2027098 - RNA, 14 nt, Homo sapiens
cuuaacuauccuaa

SEQ ID NO: 2027099 - RNA, 14 nt, Homo sapiens
uccuccuacuuaca

SEQ ID NO: 2027100 - RNA, 17 nt, Homo sapiens
uaggaggaaaauuccau

SEQ ID NO: 2027101 - RNA, 16 nt, Homo sapiens
acaaucuuccaaagaa

SEQ ID NO: 2027102 - RNA, 17 nt, Homo sapiens
ccaggagacucugggaa

SEQ ID NO: 2027103 - RNA, 19 nt, Homo sapiens
gaagugacaccaguucuuu

SEQ ID NO: 2027104 - RNA, 16 nt, Homo sapiens
cagcuaagaugccaug

SEQ ID NO: 2027105 - RNA, 14 nt, Homo sapiens
ccuugaacugucua

SEQ ID NO: 2027106 - RNA, 15 nt, Homo sapiens
acaguauuacagugu

SEQ ID NO: 2027107 - RNA, 14 nt, Homo sapiens
agaaugaaguggag

SEQ ID NO: 2027108 - RNA, 17 nt, Homo sapiens
auaggacauugugucag

SEQ ID NO: 2027109 - RNA, 17 nt, Homo sapiens
cagcacucugaaacuga

SEQ ID NO: 2027110 - RNA, 22 nt, Homo sapiens
caccugcuggaaaccacacuuc

SEQ ID NO: 2027111 - RNA, 19 nt, Homo sapiens
uacagaauguucuauuguc

SEQ ID NO: 2027112 - RNA, 19 nt, Homo sapiens
ccugaaaagcugcauuuaa

SEQ ID NO: 2027113 - RNA, 16 nt, Homo sapiens
ucgggaaauuuacaca

SEQ ID NO: 2027114 - RNA, 22 nt, Homo sapiens
cugaacagaagcucuuacucuu

SEQ ID NO: 2027115 - RNA, 15 nt, Homo sapiens
gcaaguggcuuucaa

SEQ ID NO: 2027116 - RNA, 18 nt, Homo sapiens
ucauuucuuccucugcau

SEQ ID NO: 2027117 - RNA, 21 nt, Homo sapiens
agacauauucuuggagaacuu

SEQ ID NO: 2027118 - RNA, 23 nt, Homo sapiens
caaugcugcuuugguuaaucucu

SEQ ID NO: 2027119 - RNA, 22 nt, Homo sapiens
aggagcaaucuaagcuguguua

SEQ ID NO: 2027120 - RNA, 20 nt, Homo sapiens
caaagauuucaugacgaaga

SEQ ID NO: 2027121 - RNA, 20 nt, Homo sapiens
uaccuguggugauguugcca

SEQ ID NO: 2027122 - RNA, 14 nt, Homo sapiens
guaacgauguugua

SEQ ID NO: 2027123 - RNA, 17 nt, Homo sapiens
agagggggcacuguggu

SEQ ID NO: 2027124 - RNA, 18 nt, Homo sapiens
ucaacgaugugacugcca

SEQ ID NO: 2027125 - RNA, 15 nt, Homo sapiens
uagcauccugugacc

SEQ ID NO: 2027126 - RNA, 20 nt, Homo sapiens
uguuguaucaaagugugaua

SEQ ID NO: 2027127 - RNA, 14 nt, Homo sapiens
ucaagagacacugc

SEQ ID NO: 2027128 - RNA, 17 nt, Homo sapiens
gagucagggcugugcuu

SEQ ID NO: 2027129 - RNA, 15 nt, Homo sapiens
gcaggucccuaauaa

SEQ ID NO: 2027130 - RNA, 12 nt, Homo sapiens
uuugaggccaaa

SEQ ID NO: 2027131 - RNA, 17 nt, Homo sapiens
agacaagaagacuguca

SEQ ID NO: 2027132 - RNA, 21 nt, Homo sapiens
uacaaggguauccugugcuau

SEQ ID NO: 2027133 - RNA, 19 nt, Homo sapiens
aaacagauuguuugcaaag

SEQ ID NO: 2027134 - RNA, 17 nt, Homo sapiens
guuacaguggcaguauu

SEQ ID NO: 2027135 - RNA, 17 nt, Homo sapiens
uccuuaugauauucuca

SEQ ID NO: 2027136 - RNA, 17 nt, Homo sapiens
acucaguuguuccuacu

SEQ ID NO: 2027137 - RNA, 20 nt, Homo sapiens
acauugaauuagaaacauaa

SEQ ID NO: 2027138 - RNA, 20 nt, Homo sapiens
acuuuguauaugaaucaaaa

SEQ ID NO: 2027139 - RNA, 19 nt, Homo sapiens
auuacauauuugcauaugu

SEQ ID NO: 2027140 - RNA, 17 nt, Homo sapiens
gcuagguuaaaggccag

SEQ ID NO: 2027141 - RNA, 15 nt, Homo sapiens
uucaauccugauuca

SEQ ID NO: 2027142 - RNA, 14 nt, Homo sapiens
ccacugccaaagaa

SEQ ID NO: 2027143 - RNA, 19 nt, Homo sapiens
uccuauuaaaacacagcuu

SEQ ID NO: 2027144 - RNA, 23 nt, Homo sapiens
uuuccccaaggccucucacccca

SEQ ID NO: 2027145 - RNA, 16 nt, Homo sapiens
acagcaugugccuuaa

SEQ ID NO: 2027146 - RNA, 16 nt, Homo sapiens
aaggggaggaaccaga

SEQ ID NO: 2027147 - RNA, 15 nt, Homo sapiens
ucacuuucucucuua

SEQ ID NO: 2027148 - RNA, 15 nt, Homo sapiens
auuucaacauaucau

SEQ ID NO: 2027149 - RNA, 17 nt, Homo sapiens
ugucagcaucuuugccc

SEQ ID NO: 2027150 - RNA, 19 nt, Homo sapiens
auugcuggcaacaacagau

SEQ ID NO: 2027151 - RNA, 18 nt, Homo sapiens
uucuucaacaugcuccaa

SEQ ID NO: 2027152 - RNA, 18 nt, Homo sapiens
cucugugcugcaucccac

SEQ ID NO: 2027153 - RNA, 14 nt, Homo sapiens
aguuuuggaaucua

SEQ ID NO: 2027154 - RNA, 22 nt, Homo sapiens
uuagagaggugaggaucuggua

SEQ ID NO: 2027155 - RNA, 22 nt, Homo sapiens
uacuccagccugggcaacagag

SEQ ID NO: 2027156 - RNA, 23 nt, Homo sapiens
cucagcauuucuuuucuggccaa

SEQ ID NO: 2027157 - RNA, 23 nt, Homo sapiens
ugugucucuggaacccaggaccu

SEQ ID NO: 2027158 - RNA, 23 nt, Homo sapiens
agggucugugugaaugugggcac

SEQ ID NO: 2027159 - RNA, 19 nt, Homo sapiens
caucucauuaaaaggcccu

SEQ ID NO: 2027160 - RNA, 22 nt, Homo sapiens
cuugcauuacuuugaauuuaau

SEQ ID NO: 2027161 - RNA, 22 nt, Homo sapiens
uccaaguaagaguacugggaga

SEQ ID NO: 2027162 - RNA, 12 nt, Homo sapiens
uguaacuuucau

SEQ ID NO: 2027163 - RNA, 21 nt, Homo sapiens
acccagacuggaaugcaguga

SEQ ID NO: 2027164 - RNA, 17 nt, Homo sapiens
caauaaacagucacugg

SEQ ID NO: 2027165 - RNA, 19 nt, Homo sapiens
aguuacuguguaaacucau

SEQ ID NO: 2027166 - RNA, 17 nt, Homo sapiens
cacccucccuccagggu

SEQ ID NO: 2027167 - RNA, 16 nt, Homo sapiens
uucagaauaaaugggu

SEQ ID NO: 2027168 - RNA, 13 nt, Homo sapiens
aacucaugggaag

SEQ ID NO: 2027169 - RNA, 11 nt, Homo sapiens
cagcuagacac

SEQ ID NO: 2027170 - RNA, 15 nt, Homo sapiens
aggcggaucaucuaa

SEQ ID NO: 2027171 - RNA, 15 nt, Homo sapiens
acagaaagcacaaag

SEQ ID NO: 2027172 - RNA, 17 nt, Homo sapiens
ugcaugaaguaauaugc

SEQ ID NO: 2027173 - RNA, 16 nt, Homo sapiens
guauagcugcuuccag

SEQ ID NO: 2027174 - RNA, 23 nt, Homo sapiens
ccccaggcugggcuguucacucu

SEQ ID NO: 2027175 - RNA, 15 nt, Homo sapiens
cagcagagacggggu

SEQ ID NO: 2027176 - RNA, 23 nt, Homo sapiens
augcaccuaaaaucuaauuagaa

SEQ ID NO: 2027177 - RNA, 22 nt, Homo sapiens
auucugagcaaaggcccugggu

SEQ ID NO: 2027178 - RNA, 22 nt, Homo sapiens
aaccugugauuucugugccauu

SEQ ID NO: 2027179 - RNA, 20 nt, Homo sapiens
ugugcaugaaaaggauuccu

SEQ ID NO: 2027180 - RNA, 12 nt, Homo sapiens
accucaggugau

SEQ ID NO: 2027181 - RNA, 16 nt, Homo sapiens
aaaccacuagaacucu

SEQ ID NO: 2027182 - RNA, 16 nt, Homo sapiens
ugcccauuuacacuuu

SEQ ID NO: 2027183 - RNA, 19 nt, Homo sapiens
cuucagggugagugaaugg

SEQ ID NO: 2027184 - RNA, 17 nt, Homo sapiens
ccucgcaucauugcaga

SEQ ID NO: 2027185 - RNA, 16 nt, Homo sapiens
cucacuugguaaauga

SEQ ID NO: 2027186 - RNA, 17 nt, Homo sapiens
gcugccugcugugcugg

SEQ ID NO: 2027187 - RNA, 18 nt, Homo sapiens
ggccgaaccccccacucc

SEQ ID NO: 2027188 - RNA, 20 nt, Homo sapiens
ucguccuuagaauacuguau

SEQ ID NO: 2027189 - RNA, 16 nt, Homo sapiens
ugagacccccaucucu

SEQ ID NO: 2027190 - RNA, 19 nt, Homo sapiens
uagcaggcccagcuggggc

SEQ ID NO: 2027191 - RNA, 13 nt, Homo sapiens
caaagucugcauc

SEQ ID NO: 2027192 - RNA, 17 nt, Homo sapiens
ucucgaggcagcagugg

SEQ ID NO: 2027193 - RNA, 21 nt, Homo sapiens
ucaauaaacugugucuguccc

SEQ ID NO: 2027194 - RNA, 14 nt, Homo sapiens
ccacacagggugca

SEQ ID NO: 2027195 - RNA, 15 nt, Homo sapiens
aucugcuucuaguga

SEQ ID NO: 2027196 - RNA, 23 nt, Homo sapiens
cagcaggcauaaggcaccaguua

SEQ ID NO: 2027197 - RNA, 20 nt, Homo sapiens
cuauauucuauacacacccu

SEQ ID NO: 2027198 - RNA, 16 nt, Homo sapiens
ucuguacuaacaaagc

SEQ ID NO: 2027199 - RNA, 14 nt, Homo sapiens
ggcaucugugcgug

SEQ ID NO: 2027200 - RNA, 21 nt, Homo sapiens
aaggaccuaaauucguagcaa

SEQ ID NO: 2027201 - RNA, 18 nt, Homo sapiens
ugaacugaggcccuguga

SEQ ID NO: 2027202 - RNA, 18 nt, Homo sapiens
ugucucaaaauaaaacca

SEQ ID NO: 2027203 - RNA, 15 nt, Homo sapiens
agacucagugcagau

SEQ ID NO: 2027204 - RNA, 13 nt, Homo sapiens
ucaauaugguguc

SEQ ID NO: 2027205 - RNA, 12 nt, Homo sapiens
ggaaaucuccuc

SEQ ID NO: 2027206 - RNA, 14 nt, Homo sapiens
ugcacaggcacugu

SEQ ID NO: 2027207 - RNA, 14 nt, Homo sapiens
cacacuggugcuga

SEQ ID NO: 2027208 - RNA, 21 nt, Homo sapiens
cacaguccuaccucaguucaa

SEQ ID NO: 2027209 - RNA, 12 nt, Homo sapiens
acgcagccagga

SEQ ID NO: 2027210 - RNA, 12 nt, Homo sapiens
cuuggugcuauc

SEQ ID NO: 2027211 - RNA, 22 nt, Homo sapiens
ugcacguucuauauugugccaa

SEQ ID NO: 2027212 - RNA, 18 nt, Homo sapiens
cacaagcuggaagcacau

SEQ ID NO: 2027213 - RNA, 16 nt, Homo sapiens
gcaaaauauaucacuu

SEQ ID NO: 2027214 - RNA, 22 nt, Homo sapiens
ucuuaaccaguuguggugugag

SEQ ID NO: 2027215 - RNA, 17 nt, Homo sapiens
aaccaccgacucucauu

SEQ ID NO: 2027216 - RNA, 18 nt, Homo sapiens
aggccauuccccgucucu

SEQ ID NO: 2027217 - RNA, 20 nt, Homo sapiens
uccaucuauugauaguuuca

SEQ ID NO: 2027218 - RNA, 16 nt, Homo sapiens
ucuuucuucuauguga

SEQ ID NO: 2027219 - RNA, 18 nt, Homo sapiens
cugguguuuuaugggcca

SEQ ID NO: 2027220 - RNA, 20 nt, Homo sapiens
auaggacucuagacggcauc

SEQ ID NO: 2027221 - RNA, 18 nt, Homo sapiens
augagaaugucauuugcu

SEQ ID NO: 2027222 - RNA, 16 nt, Homo sapiens
gagcacagcugcauua

SEQ ID NO: 2027223 - RNA, 19 nt, Homo sapiens
uggcgcuggcuucaggaau

SEQ ID NO: 2027224 - RNA, 18 nt, Homo sapiens
aacacaguguagugcuca

SEQ ID NO: 2027225 - RNA, 18 nt, Homo sapiens
gugcagacacuugcucuc

SEQ ID NO: 2027226 - RNA, 14 nt, Homo sapiens
gugaaccaucucag

SEQ ID NO: 2027227 - RNA, 19 nt, Homo sapiens
uaguugaauggggucucaa

SEQ ID NO: 2027228 - RNA, 18 nt, Homo sapiens
cugaaaggggcagauuaa

SEQ ID NO: 2027229 - RNA, 14 nt, Homo sapiens
cugucugugcagau

SEQ ID NO: 2027230 - RNA, 12 nt, Homo sapiens
aagugcagucag

SEQ ID NO: 2027231 - RNA, 22 nt, Homo sapiens
aacagagcaagacucugucuca

SEQ ID NO: 2027232 - RNA, 13 nt, Homo sapiens
ucacgacucuucc

SEQ ID NO: 2027233 - RNA, 15 nt, Homo sapiens
agaaauuuggcuaua

SEQ ID NO: 2027234 - RNA, 11 nt, Homo sapiens
auucuuguccu

SEQ ID NO: 2027235 - RNA, 21 nt, Homo sapiens
aaaggagagagagagagagua

SEQ ID NO: 2027236 - RNA, 17 nt, Homo sapiens
gaugcauuucuaucaaa

SEQ ID NO: 2027237 - RNA, 22 nt, Homo sapiens
aagaccggcugguggagcugcu

SEQ ID NO: 2027238 - RNA, 14 nt, Homo sapiens
aaccccuucuuuac

SEQ ID NO: 2027239 - RNA, 18 nt, Homo sapiens
ccuuguuuguacuguaug

SEQ ID NO: 2027240 - RNA, 19 nt, Homo sapiens
cuaauggcuuucacuuucu

SEQ ID NO: 2027241 - RNA, 19 nt, Homo sapiens
agaagagaauucaguauuu

SEQ ID NO: 2027242 - RNA, 13 nt, Homo sapiens
aauacguacuuua

SEQ ID NO: 2027243 - RNA, 12 nt, Homo sapiens
auguuugcacuu

SEQ ID NO: 2027244 - RNA, 16 nt, Homo sapiens
aacucaaacucuuaaa

SEQ ID NO: 2027245 - RNA, 14 nt, Homo sapiens
gaucgcaccacugc

SEQ ID NO: 2027246 - RNA, 14 nt, Homo sapiens
gcccaaacccuuaa

SEQ ID NO: 2027247 - RNA, 13 nt, Homo sapiens
uaaugaugccaug

SEQ ID NO: 2027248 - RNA, 13 nt, Homo sapiens
aagauucaauuaa

SEQ ID NO: 2027249 - RNA, 15 nt, Homo sapiens
gagagaguucucaca

SEQ ID NO: 2027250 - RNA, 20 nt, Homo sapiens
augucaaauggauguaauau

SEQ ID NO: 2027251 - RNA, 16 nt, Homo sapiens
ugaggggcucucucau

SEQ ID NO: 2027252 - RNA, 17 nt, Homo sapiens
aauguggagaacauuca

SEQ ID NO: 2027253 - RNA, 16 nt, Homo sapiens
acauccccuucugcaa

SEQ ID NO: 2027254 - RNA, 13 nt, Homo sapiens
uugcggacagcca

SEQ ID NO: 2027255 - RNA, 23 nt, Homo sapiens
cccaaccucaaugcccugccauu

SEQ ID NO: 2027256 - RNA, 18 nt, Homo sapiens
agucuaccugcuggacag

SEQ ID NO: 2027257 - RNA, 15 nt, Homo sapiens
ccacauaagaaggca

SEQ ID NO: 2027258 - RNA, 17 nt, Homo sapiens
gacacagacccacagaa

SEQ ID NO: 2027259 - RNA, 21 nt, Homo sapiens
uuuauuggcuuuucugaucca

SEQ ID NO: 2027260 - RNA, 22 nt, Homo sapiens
aucuucaauuuauuacugaaaa

SEQ ID NO: 2027261 - RNA, 13 nt, Homo sapiens
ugggaaaguugca

SEQ ID NO: 2027262 - RNA, 14 nt, Homo sapiens
cugcaaaaugaaga

SEQ ID NO: 2027263 - RNA, 15 nt, Homo sapiens
cucagucucuuccac

SEQ ID NO: 2027264 - RNA, 15 nt, Homo sapiens
uggauguaaugcacu

SEQ ID NO: 2027265 - RNA, 21 nt, Homo sapiens
ugacaguauauuugaaacugu

SEQ ID NO: 2027266 - RNA, 16 nt, Homo sapiens
gcaaucacaacacugg

SEQ ID NO: 2027267 - RNA, 14 nt, Homo sapiens
augcauacacacac

SEQ ID NO: 2027268 - RNA, 16 nt, Homo sapiens
acaccuguuauugcca

SEQ ID NO: 2027269 - RNA, 16 nt, Homo sapiens
ugguuagcuuaauaga

SEQ ID NO: 2027270 - RNA, 20 nt, Homo sapiens
aauucucagucaugcacuca

SEQ ID NO: 2027271 - RNA, 15 nt, Homo sapiens
aaaucugccuagaaa

SEQ ID NO: 2027272 - RNA, 12 nt, Homo sapiens
auuuuuuaaucc

SEQ ID NO: 2027273 - RNA, 14 nt, Homo sapiens
auucacagagccuu

SEQ ID NO: 2027274 - RNA, 14 nt, Homo sapiens
cacugcauaccaac

SEQ ID NO: 2027275 - RNA, 20 nt, Homo sapiens
agccugugugaaaauacugg

SEQ ID NO: 2027276 - RNA, 16 nt, Homo sapiens
ugcaugcaggcugugu

SEQ ID NO: 2027277 - RNA, 20 nt, Homo sapiens
ucauaaaaggacucucagcc

SEQ ID NO: 2027278 - RNA, 14 nt, Homo sapiens
cuugaagggcuuua

SEQ ID NO: 2027279 - RNA, 14 nt, Homo sapiens
uagacuaauugugu

SEQ ID NO: 2027280 - RNA, 19 nt, Homo sapiens
cacucuugggcuuggccca

SEQ ID NO: 2027281 - RNA, 16 nt, Homo sapiens
aagucaaauaccacau

SEQ ID NO: 2027282 - RNA, 14 nt, Homo sapiens
ccugaccucaggua

SEQ ID NO: 2027283 - RNA, 16 nt, Homo sapiens
gucaaacuaauucuca

SEQ ID NO: 2027284 - RNA, 22 nt, Homo sapiens
cuaggauaggaacugggccuug

SEQ ID NO: 2027285 - RNA, 22 nt, Homo sapiens
aggcugaggugggaaaaucacu

SEQ ID NO: 2027286 - RNA, 14 nt, Homo sapiens
ugucuccacugugc

SEQ ID NO: 2027287 - RNA, 22 nt, Homo sapiens
uguuuuuuuguuaaucauagca

SEQ ID NO: 2027288 - RNA, 16 nt, Homo sapiens
gcaguuggccaaaacu

SEQ ID NO: 2027289 - RNA, 20 nt, Homo sapiens
gcgugagaccgcagucugcu

SEQ ID NO: 2027290 - RNA, 21 nt, Homo sapiens
agcuucuuugccaagaccuuu

SEQ ID NO: 2027291 - RNA, 17 nt, Homo sapiens
uaugcaguaugcuuaau

SEQ ID NO: 2027292 - RNA, 20 nt, Homo sapiens
aauccuauuuaucagacucu

SEQ ID NO: 2027293 - RNA, 15 nt, Homo sapiens
ucacauuuugccuuu

SEQ ID NO: 2027294 - RNA, 20 nt, Homo sapiens
uauuaauauauaguccagac

SEQ ID NO: 2027295 - RNA, 21 nt, Homo sapiens
cucuggacucuaaagaccaaa

SEQ ID NO: 2027296 - RNA, 13 nt, Homo sapiens
gagcuuggccaga

SEQ ID NO: 2027297 - RNA, 20 nt, Homo sapiens
uaacagacugaaaugugcuc

SEQ ID NO: 2027298 - RNA, 23 nt, Homo sapiens
agaaccucaaacuaggaggaaaa

SEQ ID NO: 2027299 - RNA, 22 nt, Homo sapiens
gggccuuugccagcagagccag

SEQ ID NO: 2027300 - RNA, 20 nt, Homo sapiens
aacugguuuaggauuacuua

SEQ ID NO: 2027301 - RNA, 23 nt, Homo sapiens
uccacugcaauacuaauugagaa

SEQ ID NO: 2027302 - RNA, 16 nt, Homo sapiens
gcuuuaaccaccccau

SEQ ID NO: 2027303 - RNA, 19 nt, Homo sapiens
gacucacacuugggcgcuc

SEQ ID NO: 2027304 - RNA, 14 nt, Homo sapiens
ucagggccaggaag

SEQ ID NO: 2027305 - RNA, 21 nt, Homo sapiens
uaauuaaauucugagccugau

SEQ ID NO: 2027306 - RNA, 22 nt, Homo sapiens
gagacuccuaggcaggacaugc

SEQ ID NO: 2027307 - RNA, 18 nt, Homo sapiens
cuuuugaauuuuugguua

SEQ ID NO: 2027308 - RNA, 23 nt, Homo sapiens
uucuaaauaugaaugaaugggau

SEQ ID NO: 2027309 - RNA, 17 nt, Homo sapiens
caaugggccuccagaga

SEQ ID NO: 2027310 - RNA, 20 nt, Homo sapiens
cagcccaugugcaccugccc

SEQ ID NO: 2027311 - RNA, 15 nt, Homo sapiens
cacuuauaaauaucc

SEQ ID NO: 2027312 - RNA, 17 nt, Homo sapiens
auaaucuuguagacacu

SEQ ID NO: 2027313 - RNA, 21 nt, Homo sapiens
agguggguugaaagccaagga

SEQ ID NO: 2027314 - RNA, 15 nt, Homo sapiens
ccaaacuacuuucuu

SEQ ID NO: 2027315 - RNA, 20 nt, Homo sapiens
cuaagaaaugcugaaaauca

SEQ ID NO: 2027316 - RNA, 14 nt, Homo sapiens
cggugcucaggggg

SEQ ID NO: 2027317 - RNA, 15 nt, Homo sapiens
uggaaagcagcagcu

SEQ ID NO: 2027318 - RNA, 15 nt, Homo sapiens
uggcgagcagccacu

SEQ ID NO: 2027319 - RNA, 19 nt, Homo sapiens
gcucuucagcacaaagaca

SEQ ID NO: 2027320 - RNA, 18 nt, Homo sapiens
uuaagcccuaagguccua

SEQ ID NO: 2027321 - RNA, 18 nt, Homo sapiens
auggugggguuguucacc

SEQ ID NO: 2027322 - RNA, 17 nt, Homo sapiens
ccuuggaaauacuguau

SEQ ID NO: 2027323 - RNA, 16 nt, Homo sapiens
gacaagggcugaccug

SEQ ID NO: 2027324 - RNA, 18 nt, Homo sapiens
acagaauaauguguuaaa

SEQ ID NO: 2027325 - RNA, 21 nt, Homo sapiens
cuugaacuguggccaccuaga

SEQ ID NO: 2027326 - RNA, 12 nt, Homo sapiens
acagacccagug

SEQ ID NO: 2027327 - RNA, 13 nt, Homo sapiens
uucuuuccuccag

SEQ ID NO: 2027328 - RNA, 16 nt, Homo sapiens
uacugcucuccuccac

SEQ ID NO: 2027329 - RNA, 14 nt, Homo sapiens
uuacauacuuuauc

SEQ ID NO: 2027330 - RNA, 17 nt, Homo sapiens
cuaccucagugcuccug

SEQ ID NO: 2027331 - RNA, 21 nt, Homo sapiens
ugcuuauaagcaacaugaauu

SEQ ID NO: 2027332 - RNA, 16 nt, Homo sapiens
caauaaagucauuaau

SEQ ID NO: 2027333 - RNA, 20 nt, Homo sapiens
ugugccuggcucugauucuu

SEQ ID NO: 2027334 - RNA, 13 nt, Homo sapiens
acagugaaagccc

SEQ ID NO: 2027335 - RNA, 13 nt, Homo sapiens
augacuuacuuuc

SEQ ID NO: 2027336 - RNA, 13 nt, Homo sapiens
auuuauuacugaa

SEQ ID NO: 2027337 - RNA, 22 nt, Homo sapiens
cucaaaugacccaaagaccaau

SEQ ID NO: 2027338 - RNA, 22 nt, Homo sapiens
ccacacuucucaggacacaggc

SEQ ID NO: 2027339 - RNA, 14 nt, Homo sapiens
uuguaaauaugcaa

SEQ ID NO: 2027340 - RNA, 14 nt, Homo sapiens
ucacaaauacauaa

SEQ ID NO: 2027341 - RNA, 12 nt, Homo sapiens
uugugauugccu

SEQ ID NO: 2027342 - RNA, 17 nt, Homo sapiens
aaccuuuaaugagaaaa

SEQ ID NO: 2027343 - RNA, 23 nt, Homo sapiens
cauugaugacaugggauugaguu

SEQ ID NO: 2027344 - RNA, 17 nt, Homo sapiens
cuaugaauaugaucccu

SEQ ID NO: 2027345 - RNA, 21 nt, Homo sapiens
gccucucugcuccaccuugug

SEQ ID NO: 2027346 - RNA, 20 nt, Homo sapiens
caguggcagggcacagggcc

SEQ ID NO: 2027347 - RNA, 21 nt, Homo sapiens
gagggcacagaaaauggaaga

SEQ ID NO: 2027348 - RNA, 20 nt, Homo sapiens
ccuagccuuugggcacaauu

SEQ ID NO: 2027349 - RNA, 16 nt, Homo sapiens
accgccccucccugaa

SEQ ID NO: 2027350 - RNA, 14 nt, Homo sapiens
cauggaaguacuau

SEQ ID NO: 2027351 - RNA, 14 nt, Homo sapiens
cccagaacugagga

SEQ ID NO: 2027352 - RNA, 17 nt, Homo sapiens
cuucuuucagacuugcc

SEQ ID NO: 2027353 - RNA, 19 nt, Homo sapiens
ucaaauacaugcacaguca

SEQ ID NO: 2027354 - RNA, 17 nt, Homo sapiens
aguuucaaaccuacuaa

SEQ ID NO: 2027355 - RNA, 20 nt, Homo sapiens
uucuagacaguauugccacc

SEQ ID NO: 2027356 - RNA, 13 nt, Homo sapiens
uauguguaaguau

SEQ ID NO: 2027357 - RNA, 20 nt, Homo sapiens
uggcaauaaacuccuacuaa

SEQ ID NO: 2027358 - RNA, 14 nt, Homo sapiens
uaauuuaacaagcu

SEQ ID NO: 2027359 - RNA, 16 nt, Homo sapiens
auagaagugauugaau

SEQ ID NO: 2027360 - RNA, 14 nt, Homo sapiens
gaagcacagugauc

SEQ ID NO: 2027361 - RNA, 17 nt, Homo sapiens
gcuagaagugugaagug

SEQ ID NO: 2027362 - RNA, 13 nt, Homo sapiens
cauuucauacaaa

SEQ ID NO: 2027363 - RNA, 12 nt, Homo sapiens
ucuuaauacugu

SEQ ID NO: 2027364 - RNA, 12 nt, Homo sapiens
gaguuggaauca

SEQ ID NO: 2027365 - RNA, 18 nt, Homo sapiens
ucaauuguuaauuguaau

SEQ ID NO: 2027366 - RNA, 21 nt, Homo sapiens
cagugggaccaaugaaagcau

SEQ ID NO: 2027367 - RNA, 17 nt, Homo sapiens
ugagaaacuuccuuuga

SEQ ID NO: 2027368 - RNA, 14 nt, Homo sapiens
uagaagcacuacac

SEQ ID NO: 2027369 - RNA, 16 nt, Homo sapiens
guucccucauucugca

SEQ ID NO: 2027370 - RNA, 12 nt, Homo sapiens
ggccagugacau

SEQ ID NO: 2027371 - RNA, 21 nt, Homo sapiens
caauuaaaaccauuaccuuaa

SEQ ID NO: 2027372 - RNA, 22 nt, Homo sapiens
cgaacuauuuucaaagacuuaa

SEQ ID NO: 2027373 - RNA, 20 nt, Homo sapiens
uugauaguuuacaaacaaga

SEQ ID NO: 2027374 - RNA, 18 nt, Homo sapiens
gcaauaauacaacuauca

SEQ ID NO: 2027375 - RNA, 17 nt, Homo sapiens
accauauacagcucaga

SEQ ID NO: 2027376 - RNA, 22 nt, Homo sapiens
ccccuuuuauuaauacauucac

SEQ ID NO: 2027377 - RNA, 20 nt, Homo sapiens
gagaugaaucaaaaccagug

SEQ ID NO: 2027378 - RNA, 16 nt, Homo sapiens
ucaccaucuacaccag

SEQ ID NO: 2027379 - RNA, 17 nt, Homo sapiens
cuagcugggcacagugg

SEQ ID NO: 2027380 - RNA, 18 nt, Homo sapiens
caccagugguacuaagca

SEQ ID NO: 2027381 - RNA, 17 nt, Homo sapiens
auaugacagauaaccua

SEQ ID NO: 2027382 - RNA, 18 nt, Homo sapiens
caacauucuguguucaca

SEQ ID NO: 2027383 - RNA, 21 nt, Homo sapiens
aauauaaugaugcugucugaa

SEQ ID NO: 2027384 - RNA, 14 nt, Homo sapiens
aacuuaagcaaagg

SEQ ID NO: 2027385 - RNA, 17 nt, Homo sapiens
agaaacgcucaugacag

SEQ ID NO: 2027386 - RNA, 16 nt, Homo sapiens
uuaacuaugauuccaa

SEQ ID NO: 2027387 - RNA, 16 nt, Homo sapiens
auaagcaauaccagca

SEQ ID NO: 2027388 - RNA, 13 nt, Homo sapiens
ccuggcacaccag

SEQ ID NO: 2027389 - RNA, 19 nt, Homo sapiens
acauauuacuccacaccuu

SEQ ID NO: 2027390 - RNA, 17 nt, Homo sapiens
uuguagaagucacauuc

SEQ ID NO: 2027391 - RNA, 13 nt, Homo sapiens
uuuuucuccagcu

SEQ ID NO: 2027392 - RNA, 20 nt, Homo sapiens
aacaaacaggauauccaagg

SEQ ID NO: 2027393 - RNA, 17 nt, Homo sapiens
gagacaggguuucacca

SEQ ID NO: 2027394 - RNA, 17 nt, Homo sapiens
auguuuggaauauucca

SEQ ID NO: 2027395 - RNA, 18 nt, Homo sapiens
uguucaccaucccaaagc

SEQ ID NO: 2027396 - RNA, 14 nt, Homo sapiens
ucacaaccagccac

SEQ ID NO: 2027397 - RNA, 13 nt, Homo sapiens
ucugacuguuguc

SEQ ID NO: 2027398 - RNA, 13 nt, Homo sapiens
ucagaagccaguc

SEQ ID NO: 2027399 - RNA, 13 nt, Homo sapiens
cagauauuucaca

SEQ ID NO: 2027400 - RNA, 13 nt, Homo sapiens
ggggaaguggcca

SEQ ID NO: 2027401 - RNA, 11 nt, Homo sapiens
guuguugccaa

SEQ ID NO: 2027402 - RNA, 20 nt, Homo sapiens
guuacuaaauuuucuaauua

SEQ ID NO: 2027403 - RNA, 23 nt, Homo sapiens
auggcagaaagauggagaggcau

SEQ ID NO: 2027404 - RNA, 22 nt, Homo sapiens
augaccuuggacaaucaugaaa

SEQ ID NO: 2027405 - RNA, 22 nt, Homo sapiens
cauuuuuugagguaucacugca

SEQ ID NO: 2027406 - RNA, 17 nt, Homo sapiens
cugguacuuagaguuuc

SEQ ID NO: 2027407 - RNA, 22 nt, Homo sapiens
guuuaucuucuuccagauuucc

SEQ ID NO: 2027408 - RNA, 21 nt, Homo sapiens
cuucaagucccaucauagaaa

SEQ ID NO: 2027409 - RNA, 11 nt, Homo sapiens
acacagccaca

SEQ ID NO: 2027410 - RNA, 17 nt, Homo sapiens
agauauuauucauucau

SEQ ID NO: 2027411 - RNA, 14 nt, Homo sapiens
gaacuccugaccuc

SEQ ID NO: 2027412 - RNA, 21 nt, Homo sapiens
acucuggaaguccccgggagc

SEQ ID NO: 2027413 - RNA, 16 nt, Homo sapiens
aaucccaguucuuccu

SEQ ID NO: 2027414 - RNA, 12 nt, Homo sapiens
caucuaccugag

SEQ ID NO: 2027415 - RNA, 22 nt, Homo sapiens
aacagauggauagucuguccaa

SEQ ID NO: 2027416 - RNA, 18 nt, Homo sapiens
caaaauacagcacuuuga

SEQ ID NO: 2027417 - RNA, 20 nt, Homo sapiens
cacaacccccaggaaacaca

SEQ ID NO: 2027418 - RNA, 13 nt, Homo sapiens
uugaauucaauuc

SEQ ID NO: 2027419 - RNA, 20 nt, Homo sapiens
caccaaagccaccucuguca

SEQ ID NO: 2027420 - RNA, 18 nt, Homo sapiens
cucuuuccucuaacucau

SEQ ID NO: 2027421 - RNA, 15 nt, Homo sapiens
uaaagccucaugugu

SEQ ID NO: 2027422 - RNA, 17 nt, Homo sapiens
gcucuugugauguuugc

SEQ ID NO: 2027423 - RNA, 22 nt, Homo sapiens
gcaagccuccugaucaggaaac

SEQ ID NO: 2027424 - RNA, 19 nt, Homo sapiens
uggaggauaauugaggcua

SEQ ID NO: 2027425 - RNA, 14 nt, Homo sapiens
cacccccacugcca

SEQ ID NO: 2027426 - RNA, 20 nt, Homo sapiens
aauauaaauuuaucauuuag

SEQ ID NO: 2027427 - RNA, 17 nt, Homo sapiens
acccaacucuguacaaa

SEQ ID NO: 2027428 - RNA, 23 nt, Homo sapiens
uuccgaggccccugucucagggu

SEQ ID NO: 2027429 - RNA, 20 nt, Homo sapiens
ucagcugccuggaggccaga

SEQ ID NO: 2027430 - RNA, 17 nt, Homo sapiens
cuucuguagugccaugg

SEQ ID NO: 2027431 - RNA, 15 nt, Homo sapiens
uugagugcacugacu

SEQ ID NO: 2027432 - RNA, 18 nt, Homo sapiens
cuuccugaggaugggcaa

SEQ ID NO: 2027433 - RNA, 19 nt, Homo sapiens
gucauuugcugugaacuga

SEQ ID NO: 2027434 - RNA, 14 nt, Homo sapiens
aucuugugcuucuu

SEQ ID NO: 2027435 - RNA, 17 nt, Homo sapiens
cuauauuaggauaucag

SEQ ID NO: 2027436 - RNA, 21 nt, Homo sapiens
ucuuuccacuccuccuagcca

SEQ ID NO: 2027437 - RNA, 13 nt, Homo sapiens
auaaagugaaugu

SEQ ID NO: 2027438 - RNA, 13 nt, Homo sapiens
uaugaguguuaau

SEQ ID NO: 2027439 - RNA, 22 nt, Homo sapiens
uacucaccucaccccacugugg

SEQ ID NO: 2027440 - RNA, 22 nt, Homo sapiens
ucugcuuacaauucccugcugu

SEQ ID NO: 2027441 - RNA, 15 nt, Homo sapiens
aucugcgugacaaua

SEQ ID NO: 2027442 - RNA, 18 nt, Homo sapiens
ccugaggcccccaucucc

SEQ ID NO: 2027443 - RNA, 21 nt, Homo sapiens
aggaaagccucacugauauau

SEQ ID NO: 2027444 - RNA, 18 nt, Homo sapiens
augagacuacuucagaau

SEQ ID NO: 2027445 - RNA, 20 nt, Homo sapiens
ucugagaagacacaagguga

SEQ ID NO: 2027446 - RNA, 22 nt, Homo sapiens
cgugugugugugauugcacgug

SEQ ID NO: 2027447 - RNA, 22 nt, Homo sapiens
uuagauuaacccuauuaaucua

SEQ ID NO: 2027448 - RNA, 12 nt, Homo sapiens
ugggcaccucag

SEQ ID NO: 2027449 - RNA, 16 nt, Homo sapiens
ucucuaaaucagggug

SEQ ID NO: 2027450 - RNA, 14 nt, Homo sapiens
gucauuacuucuga

SEQ ID NO: 2027451 - RNA, 20 nt, Homo sapiens
aguguggauguucagaauuu

SEQ ID NO: 2027452 - RNA, 13 nt, Homo sapiens
uccuccagaucaa

SEQ ID NO: 2027453 - RNA, 14 nt, Homo sapiens
aggucuccaagacc

SEQ ID NO: 2027454 - RNA, 21 nt, Homo sapiens
cagacuugccaggcucccuuu

SEQ ID NO: 2027455 - RNA, 13 nt, Homo sapiens
aucauuuuagaca

SEQ ID NO: 2027456 - RNA, 21 nt, Homo sapiens
uagagucuuaaagcauuucag

SEQ ID NO: 2027457 - RNA, 22 nt, Homo sapiens
cccaucacccaagccacaagcu

SEQ ID NO: 2027458 - RNA, 13 nt, Homo sapiens
gugcucaccagcc

SEQ ID NO: 2027459 - RNA, 19 nt, Homo sapiens
gaaaagcagcccuuggcca

SEQ ID NO: 2027460 - RNA, 23 nt, Homo sapiens
guugggggcaguguuguggcccu

SEQ ID NO: 2027461 - RNA, 17 nt, Homo sapiens
cuguuuuagcugaggga

SEQ ID NO: 2027462 - RNA, 20 nt, Homo sapiens
uccauccaucuuuccaucca

SEQ ID NO: 2027463 - RNA, 15 nt, Homo sapiens
acauacaacuucaua

SEQ ID NO: 2027464 - RNA, 16 nt, Homo sapiens
uccuauuaaaggaaua

SEQ ID NO: 2027465 - RNA, 24 nt, Homo sapiens
ucugagacaccugaugaccuguua

SEQ ID NO: 2027466 - RNA, 18 nt, Homo sapiens
ucuuccaaagcacauuga

SEQ ID NO: 2027467 - RNA, 22 nt, Homo sapiens
aggugcugauccuaagaauuuu

SEQ ID NO: 2027468 - RNA, 21 nt, Homo sapiens
cagguauuuuaacugugugaa

SEQ ID NO: 2027469 - RNA, 19 nt, Homo sapiens
cauguguuguacaauacca

SEQ ID NO: 2027470 - RNA, 13 nt, Homo sapiens
uuucuccuuuuga

SEQ ID NO: 2027471 - RNA, 11 nt, Homo sapiens
agaauuugcau

SEQ ID NO: 2027472 - RNA, 19 nt, Homo sapiens
cccggagguugggugggcc

SEQ ID NO: 2027473 - RNA, 19 nt, Homo sapiens
ggcugacauuguggcacau

SEQ ID NO: 2027474 - RNA, 14 nt, Homo sapiens
gaaauguacauggc

SEQ ID NO: 2027475 - RNA, 18 nt, Homo sapiens
auuuuuuugcauuuucac

SEQ ID NO: 2027476 - RNA, 17 nt, Homo sapiens
agugcccugcuuugcaa

SEQ ID NO: 2027477 - RNA, 23 nt, Homo sapiens
gauuuguauuuauauuagagugc

SEQ ID NO: 2027478 - RNA, 14 nt, Homo sapiens
uguaccauuugccu

SEQ ID NO: 2027479 - RNA, 15 nt, Homo sapiens
acauuuguuccugga

SEQ ID NO: 2027480 - RNA, 15 nt, Homo sapiens
aacaaacuacugugu

SEQ ID NO: 2027481 - RNA, 21 nt, Homo sapiens
caaaaaaaaaaaaacaaaaga

SEQ ID NO: 2027482 - RNA, 14 nt, Homo sapiens
guguugaccacaga

SEQ ID NO: 2027483 - RNA, 17 nt, Homo sapiens
auuuguauuuugcuuaa

SEQ ID NO: 2027484 - RNA, 14 nt, Homo sapiens
aacucucuagcuua

SEQ ID NO: 2027485 - RNA, 19 nt, Homo sapiens
cugccaggggcagugaagu

SEQ ID NO: 2027486 - RNA, 19 nt, Homo sapiens
auuuaaguuaucaacuuua

SEQ ID NO: 2027487 - RNA, 19 nt, Homo sapiens
ucacaugcuugaugguuua

SEQ ID NO: 2027488 - RNA, 21 nt, Homo sapiens
ucccuccuuauuuuugaauug

SEQ ID NO: 2027489 - RNA, 21 nt, Homo sapiens
ucugcagcacccagaacugag

SEQ ID NO: 2027490 - RNA, 23 nt, Homo sapiens
cuaaauaucauaaucugaugaua

SEQ ID NO: 2027491 - RNA, 15 nt, Homo sapiens
ccucacccugcauag

SEQ ID NO: 2027492 - RNA, 16 nt, Homo sapiens
ucuuguaaaccuggag

SEQ ID NO: 2027493 - RNA, 15 nt, Homo sapiens
aguguggagacgggu

SEQ ID NO: 2027494 - RNA, 18 nt, Homo sapiens
aggauggccuggaaccca

SEQ ID NO: 2027495 - RNA, 21 nt, Homo sapiens
ucaccaaucauaguguaccca

SEQ ID NO: 2027496 - RNA, 16 nt, Homo sapiens
agggacuccaguucac

SEQ ID NO: 2027497 - RNA, 16 nt, Homo sapiens
aaguauuggcaaagau

SEQ ID NO: 2027498 - RNA, 20 nt, Homo sapiens
auucuauuucugcugugauu

SEQ ID NO: 2027499 - RNA, 13 nt, Homo sapiens
ccuugugcuccug

SEQ ID NO: 2027500 - RNA, 23 nt, Homo sapiens
cccaggcuggagagcacugccag

SEQ ID NO: 2027501 - RNA, 19 nt, Homo sapiens
ucguucaacuccacucacu

SEQ ID NO: 2027502 - RNA, 17 nt, Homo sapiens
gacaugcuuugugccau

SEQ ID NO: 2027503 - RNA, 15 nt, Homo sapiens
aaauuuuuauguaaa

SEQ ID NO: 2027504 - RNA, 19 nt, Homo sapiens
guaguuucugcauuucaag

SEQ ID NO: 2027505 - RNA, 13 nt, Homo sapiens
gagaccuccaaua

SEQ ID NO: 2027506 - RNA, 23 nt, Homo sapiens
cacucuugaaaaaugcauguugc

SEQ ID NO: 2027507 - RNA, 21 nt, Homo sapiens
guggcagcuggggagcagcug

SEQ ID NO: 2027508 - RNA, 14 nt, Homo sapiens
auagucauaccugg

SEQ ID NO: 2027509 - RNA, 23 nt, Homo sapiens
aaaucuaugccuaaaaaguauca

SEQ ID NO: 2027510 - RNA, 23 nt, Homo sapiens
ccaugaagcuggcccucagcucc

SEQ ID NO: 2027511 - RNA, 14 nt, Homo sapiens
cacagcuacagcuu

SEQ ID NO: 2027512 - RNA, 17 nt, Homo sapiens
cuucacagaugccuacu

SEQ ID NO: 2027513 - RNA, 17 nt, Homo sapiens
ugaugaugaucaugaug

SEQ ID NO: 2027514 - RNA, 12 nt, Homo sapiens
caguagacagau

SEQ ID NO: 2027515 - RNA, 22 nt, Homo sapiens
guucaccuucaaaauguucuau

SEQ ID NO: 2027516 - RNA, 23 nt, Homo sapiens
gccuugucuucuuagcugucacc

SEQ ID NO: 2027517 - RNA, 14 nt, Homo sapiens
aauaugaaagccac

SEQ ID NO: 2027518 - RNA, 18 nt, Homo sapiens
cccacauccugugccucc

SEQ ID NO: 2027519 - RNA, 13 nt, Homo sapiens
auauuugcuagac

SEQ ID NO: 2027520 - RNA, 17 nt, Homo sapiens
cuaauaugacauaugac

SEQ ID NO: 2027521 - RNA, 21 nt, Homo sapiens
aacacggggcuugcaacuuag

SEQ ID NO: 2027522 - RNA, 22 nt, Homo sapiens
uagccaggauggacuccaucuc

SEQ ID NO: 2027523 - RNA, 15 nt, Homo sapiens
ucagaguggcugaga

SEQ ID NO: 2027524 - RNA, 13 nt, Homo sapiens
uccuugucaauac

SEQ ID NO: 2027525 - RNA, 16 nt, Homo sapiens
uuaguauucauucugc

SEQ ID NO: 2027526 - RNA, 23 nt, Homo sapiens
cuggccucgugaucugcccuucu

SEQ ID NO: 2027527 - RNA, 20 nt, Homo sapiens
agggagacuccgcuguggga

SEQ ID NO: 2027528 - RNA, 22 nt, Homo sapiens
cuugaugucccgaccguugcca

SEQ ID NO: 2027529 - RNA, 23 nt, Homo sapiens
ccagaggaauugauugucagcca

SEQ ID NO: 2027530 - RNA, 18 nt, Homo sapiens
uggaaaugaccaggccaa

SEQ ID NO: 2027531 - RNA, 13 nt, Homo sapiens
cuacagagcagac

SEQ ID NO: 2027532 - RNA, 20 nt, Homo sapiens
ucaggugguccuuccaccuc

SEQ ID NO: 2027533 - RNA, 20 nt, Homo sapiens
uaaucaggaguucugccagg

SEQ ID NO: 2027534 - RNA, 15 nt, Homo sapiens
guugauacuuguucc

SEQ ID NO: 2027535 - RNA, 14 nt, Homo sapiens
uccagugcaguugu

SEQ ID NO: 2027536 - RNA, 16 nt, Homo sapiens
cgauugagaacugaca

SEQ ID NO: 2027537 - RNA, 23 nt, Homo sapiens
ggaccaccccugguguguagcua

SEQ ID NO: 2027538 - RNA, 15 nt, Homo sapiens
ccuggcggagcucuc

SEQ ID NO: 2027539 - RNA, 19 nt, Homo sapiens
ugcacaguugccacauuua

SEQ ID NO: 2027540 - RNA, 21 nt, Homo sapiens
caagucgagagggcuguugga

SEQ ID NO: 2027541 - RNA, 19 nt, Homo sapiens
ugccacagugguacucugu

SEQ ID NO: 2027542 - RNA, 14 nt, Homo sapiens
ugccucuccccaaa

SEQ ID NO: 2027543 - RNA, 19 nt, Homo sapiens
aguaaccucuacaggcauu

SEQ ID NO: 2027544 - RNA, 16 nt, Homo sapiens
ucuguacaacuaccuc

SEQ ID NO: 2027545 - RNA, 18 nt, Homo sapiens
aaaagcccauucauucca

SEQ ID NO: 2027546 - RNA, 20 nt, Homo sapiens
acgccaggcaccacagccuc

SEQ ID NO: 2027547 - RNA, 20 nt, Homo sapiens
acccagguuggagugcagug

SEQ ID NO: 2027548 - RNA, 16 nt, Homo sapiens
auggauuaaauggcac

SEQ ID NO: 2027549 - RNA, 13 nt, Homo sapiens
ugcaugaaacaug

SEQ ID NO: 2027550 - RNA, 14 nt, Homo sapiens
auggauuuaugaca

SEQ ID NO: 2027551 - RNA, 21 nt, Homo sapiens
aggaaggaaagaaagaaggaa

SEQ ID NO: 2027552 - RNA, 18 nt, Homo sapiens
caucugcauucccagcuc

SEQ ID NO: 2027553 - RNA, 23 nt, Homo sapiens
uggacaaagggaaauacucuuaa

SEQ ID NO: 2027554 - RNA, 20 nt, Homo sapiens
auguauguuuggcucugcuu

SEQ ID NO: 2027555 - RNA, 20 nt, Homo sapiens
aaagaugaucuacucagaaa

SEQ ID NO: 2027556 - RNA, 15 nt, Homo sapiens
guagagucacuggaa

SEQ ID NO: 2027557 - RNA, 17 nt, Homo sapiens
agguuucucaaagaaau

SEQ ID NO: 2027558 - RNA, 23 nt, Homo sapiens
ugagguugggaaggcaccugcuc

SEQ ID NO: 2027559 - RNA, 22 nt, Homo sapiens
acaaacaagaaagcuauuccaa

SEQ ID NO: 2027560 - RNA, 23 nt, Homo sapiens
cagcuggaguucaugucgcaaca

SEQ ID NO: 2027561 - RNA, 13 nt, Homo sapiens
cuauuacuaguac

SEQ ID NO: 2027562 - RNA, 18 nt, Homo sapiens
guaaauguggauuuugua

SEQ ID NO: 2027563 - RNA, 21 nt, Homo sapiens
ucauaaaaguagcaaccuuca

SEQ ID NO: 2027564 - RNA, 20 nt, Homo sapiens
gacaugaaauaaagaauuua

SEQ ID NO: 2027565 - RNA, 18 nt, Homo sapiens
cuccacuugaagcacuua

SEQ ID NO: 2027566 - RNA, 15 nt, Homo sapiens
cuggacuugccuaaa

SEQ ID NO: 2027567 - RNA, 14 nt, Homo sapiens
uauaucaaaucauc

SEQ ID NO: 2027568 - RNA, 13 nt, Homo sapiens
uuaaaaacauaga

SEQ ID NO: 2027569 - RNA, 15 nt, Homo sapiens
uggucggccaguaca

SEQ ID NO: 2027570 - RNA, 19 nt, Homo sapiens
cagaggcagcauuuuugca

SEQ ID NO: 2027571 - RNA, 22 nt, Homo sapiens
cuucucuauaucaugcuuuaaa

SEQ ID NO: 2027572 - RNA, 19 nt, Homo sapiens
cccugccagcaacgcucac

SEQ ID NO: 2027573 - RNA, 15 nt, Homo sapiens
acccaggcaggugca

SEQ ID NO: 2027574 - RNA, 21 nt, Homo sapiens
ugaccuuccuccuccucuuca

SEQ ID NO: 2027575 - RNA, 18 nt, Homo sapiens
cuggcuccuucaccaccc

SEQ ID NO: 2027576 - RNA, 13 nt, Homo sapiens
uuaaaaucagauu

SEQ ID NO: 2027577 - RNA, 13 nt, Homo sapiens
ugaaaaucauauu

SEQ ID NO: 2027578 - RNA, 13 nt, Homo sapiens
aacuucauauuaa

SEQ ID NO: 2027579 - RNA, 16 nt, Homo sapiens
aaaauagguuuguagu

SEQ ID NO: 2027580 - RNA, 19 nt, Homo sapiens
aguuuaccccuuggcuuug

SEQ ID NO: 2027581 - RNA, 15 nt, Homo sapiens
ggucaaaggcucaaa

SEQ ID NO: 2027582 - RNA, 23 nt, Homo sapiens
ggccucaccuggcuucccaggac

SEQ ID NO: 2027583 - RNA, 23 nt, Homo sapiens
aagagagcgagacccugucucaa

SEQ ID NO: 2027584 - RNA, 21 nt, Homo sapiens
uggaagagccugcaggugcug

SEQ ID NO: 2027585 - RNA, 18 nt, Homo sapiens
acaaauguuuuaaacuca

SEQ ID NO: 2027586 - RNA, 20 nt, Homo sapiens
uggccgggucccugagcucc

SEQ ID NO: 2027587 - RNA, 23 nt, Homo sapiens
aacaucuggagagagagcaagau

SEQ ID NO: 2027588 - RNA, 17 nt, Homo sapiens
gccauguuauuuauagu

SEQ ID NO: 2027589 - RNA, 16 nt, Homo sapiens
gcccacguacccaggu

SEQ ID NO: 2027590 - RNA, 19 nt, Homo sapiens
cagcuguacuagugccauu

SEQ ID NO: 2027591 - RNA, 20 nt, Homo sapiens
cauuacagggaaugccugag

SEQ ID NO: 2027592 - RNA, 17 nt, Homo sapiens
uggacaggagucagugu

SEQ ID NO: 2027593 - RNA, 13 nt, Homo sapiens
accagggaugcug

SEQ ID NO: 2027594 - RNA, 16 nt, Homo sapiens
guagccugugcaugua

SEQ ID NO: 2027595 - RNA, 15 nt, Homo sapiens
cugaggaugcaucuu

SEQ ID NO: 2027596 - RNA, 19 nt, Homo sapiens
gaaauaauuuuuagaaucu

SEQ ID NO: 2027597 - RNA, 18 nt, Homo sapiens
guggcgcgggagcuggga

SEQ ID NO: 2027598 - RNA, 17 nt, Homo sapiens
ucacuaauacuaauuca

SEQ ID NO: 2027599 - RNA, 18 nt, Homo sapiens
uagaaaggggcccauuca

SEQ ID NO: 2027600 - RNA, 15 nt, Homo sapiens
uugucagacuuccaa

SEQ ID NO: 2027601 - RNA, 16 nt, Homo sapiens
gacaguauuauuaaua

SEQ ID NO: 2027602 - RNA, 15 nt, Homo sapiens
cacagccuggccccu

SEQ ID NO: 2027603 - RNA, 13 nt, Homo sapiens
agaguuggaguga

SEQ ID NO: 2027604 - RNA, 15 nt, Homo sapiens
acacugaaaauguca

SEQ ID NO: 2027605 - RNA, 20 nt, Homo sapiens
aggccugggcaggacccugc

SEQ ID NO: 2027606 - RNA, 22 nt, Homo sapiens
gacagagucucaaucuguuacc

SEQ ID NO: 2027607 - RNA, 14 nt, Homo sapiens
agacuuguucucag

SEQ ID NO: 2027608 - RNA, 16 nt, Homo sapiens
ugccuccaauguggua

SEQ ID NO: 2027609 - RNA, 17 nt, Homo sapiens
gaacagugaaagucaau

SEQ ID NO: 2027610 - RNA, 20 nt, Homo sapiens
ccuuccagaucacugccaca

SEQ ID NO: 2027611 - RNA, 20 nt, Homo sapiens
acaggcaccuauguggcaug

SEQ ID NO: 2027612 - RNA, 20 nt, Homo sapiens
cuuccuuaauucacucccac

SEQ ID NO: 2027613 - RNA, 16 nt, Homo sapiens
aacacugcuguccaca

SEQ ID NO: 2027614 - RNA, 17 nt, Homo sapiens
aucuuagggaacuuuga

SEQ ID NO: 2027615 - RNA, 20 nt, Homo sapiens
aaaugagccauccccagggc

SEQ ID NO: 2027616 - RNA, 12 nt, Homo sapiens
ugucccauuugc

SEQ ID NO: 2027617 - RNA, 18 nt, Homo sapiens
ucacaaccaccuaaucag

SEQ ID NO: 2027618 - RNA, 16 nt, Homo sapiens
uaggaaucaaauaucc

SEQ ID NO: 2027619 - RNA, 22 nt, Homo sapiens
agggucucacucuguugcccag

SEQ ID NO: 2027620 - RNA, 15 nt, Homo sapiens
augaauucuggucac

SEQ ID NO: 2027621 - RNA, 19 nt, Homo sapiens
cuggagugcaguggcgcau

SEQ ID NO: 2027622 - RNA, 22 nt, Homo sapiens
uaaaagucuaguuaccuacuuu

SEQ ID NO: 2027623 - RNA, 16 nt, Homo sapiens
cucagaauugcacauc

SEQ ID NO: 2027624 - RNA, 18 nt, Homo sapiens
ucuucuccuggaguugca

SEQ ID NO: 2027625 - RNA, 17 nt, Homo sapiens
ccuaaugcuugcugcug

SEQ ID NO: 2027626 - RNA, 16 nt, Homo sapiens
gaugugaucacugaga

SEQ ID NO: 2027627 - RNA, 15 nt, Homo sapiens
uaaauaaaagcuaga

SEQ ID NO: 2027628 - RNA, 21 nt, Homo sapiens
ccuagcugguagcauaaauaa

SEQ ID NO: 2027629 - RNA, 17 nt, Homo sapiens
guaacgaugcacuuugg

SEQ ID NO: 2027630 - RNA, 22 nt, Homo sapiens
gugucaguuacuuuuuuaguaa

SEQ ID NO: 2027631 - RNA, 13 nt, Homo sapiens
auaauucacucaa

SEQ ID NO: 2027632 - RNA, 22 nt, Homo sapiens
gguggggacagguaaguggcag

SEQ ID NO: 2027633 - RNA, 21 nt, Homo sapiens
caauuucccauuuuggaaccu

SEQ ID NO: 2027634 - RNA, 12 nt, Homo sapiens
uuuccaucuccc

SEQ ID NO: 2027635 - RNA, 13 nt, Homo sapiens
gcagacauucuca

SEQ ID NO: 2027636 - RNA, 11 nt, Homo sapiens
cagcagagcca

SEQ ID NO: 2027637 - RNA, 19 nt, Homo sapiens
agccccccaccccacagau

SEQ ID NO: 2027638 - RNA, 19 nt, Homo sapiens
gccaugagaguucugucac

SEQ ID NO: 2027639 - RNA, 21 nt, Homo sapiens
uccagaaaaaugaaaagcaau

SEQ ID NO: 2027640 - RNA, 20 nt, Homo sapiens
guuguuaaugaaaaugucag

SEQ ID NO: 2027641 - RNA, 22 nt, Homo sapiens
ucccccuccuccgggggccaag

SEQ ID NO: 2027642 - RNA, 22 nt, Homo sapiens
uucuguuuuguuguuugauuca

SEQ ID NO: 2027643 - RNA, 14 nt, Homo sapiens
uuucucagcccuga

SEQ ID NO: 2027644 - RNA, 21 nt, Homo sapiens
gccauaccauucccauggagu

SEQ ID NO: 2027645 - RNA, 15 nt, Homo sapiens
aggggccaagcagug

SEQ ID NO: 2027646 - RNA, 16 nt, Homo sapiens
uuauccucugaucucc

SEQ ID NO: 2027647 - RNA, 14 nt, Homo sapiens
auguggguggcaaa

SEQ ID NO: 2027648 - RNA, 20 nt, Homo sapiens
uugcagcggcuccugcaaaa

SEQ ID NO: 2027649 - RNA, 18 nt, Homo sapiens
uguuuauguaacuaucaa

SEQ ID NO: 2027650 - RNA, 18 nt, Homo sapiens
auuuauauaauacauuaa

SEQ ID NO: 2027651 - RNA, 13 nt, Homo sapiens
cuucuugggggua

SEQ ID NO: 2027652 - RNA, 14 nt, Homo sapiens
gacuugaacaaaaa

SEQ ID NO: 2027653 - RNA, 21 nt, Homo sapiens
uguuucaccaguguuuuaccc

SEQ ID NO: 2027654 - RNA, 14 nt, Homo sapiens
cacagugugcucca

SEQ ID NO: 2027655 - RNA, 13 nt, Homo sapiens
gaucaguugccaa

SEQ ID NO: 2027656 - RNA, 18 nt, Homo sapiens
ucaccgggcuacuaccug

SEQ ID NO: 2027657 - RNA, 15 nt, Homo sapiens
augaaaccacuggaa

SEQ ID NO: 2027658 - RNA, 22 nt, Homo sapiens
acaccuuuucuauuuaccuccu

SEQ ID NO: 2027659 - RNA, 22 nt, Homo sapiens
ugcuguggcccccuguccccaa

SEQ ID NO: 2027660 - RNA, 17 nt, Homo sapiens
aacugugagagaauaau

SEQ ID NO: 2027661 - RNA, 11 nt, Homo sapiens
uugaaaacugc

SEQ ID NO: 2027662 - RNA, 13 nt, Homo sapiens
cccaucugugaau

SEQ ID NO: 2027663 - RNA, 13 nt, Homo sapiens
ccaugcugugcug

SEQ ID NO: 2027664 - RNA, 23 nt, Homo sapiens
auuucugcuaaauaucaccuagc

SEQ ID NO: 2027665 - RNA, 16 nt, Homo sapiens
agggucccucugugua

SEQ ID NO: 2027666 - RNA, 24 nt, Homo sapiens
acagggcucccgagucaugcacuc

SEQ ID NO: 2027667 - RNA, 20 nt, Homo sapiens
uggcuguugggagccuguga

SEQ ID NO: 2027668 - RNA, 22 nt, Homo sapiens
acaugcauugcucuuauucugu

SEQ ID NO: 2027669 - RNA, 19 nt, Homo sapiens
uuucaauuuaucaaucucu

SEQ ID NO: 2027670 - RNA, 18 nt, Homo sapiens
augcaaauagauucagag

SEQ ID NO: 2027671 - RNA, 22 nt, Homo sapiens
ggaagcccccaaguugauauuu

SEQ ID NO: 2027672 - RNA, 14 nt, Homo sapiens
aagaaucagucuug

SEQ ID NO: 2027673 - RNA, 20 nt, Homo sapiens
caguucccuccugcccagga

SEQ ID NO: 2027674 - RNA, 18 nt, Homo sapiens
aaauggccaaagcacaug

SEQ ID NO: 2027675 - RNA, 16 nt, Homo sapiens
gaggacaguggcacaa

SEQ ID NO: 2027676 - RNA, 14 nt, Homo sapiens
acguaccuucaugu

SEQ ID NO: 2027677 - RNA, 15 nt, Homo sapiens
gaauuucuuguuucu

SEQ ID NO: 2027678 - RNA, 20 nt, Homo sapiens
gaugaugugguuuuuugcca

SEQ ID NO: 2027679 - RNA, 17 nt, Homo sapiens
aucucaagcaaguuuaa

SEQ ID NO: 2027680 - RNA, 21 nt, Homo sapiens
caagcuccuuaaccuuccaug

SEQ ID NO: 2027681 - RNA, 17 nt, Homo sapiens
cugccucggccucccaa

SEQ ID NO: 2027682 - RNA, 19 nt, Homo sapiens
auuucuuauuauuauaugu

SEQ ID NO: 2027683 - RNA, 13 nt, Homo sapiens
ccugguccaugau

SEQ ID NO: 2027684 - RNA, 13 nt, Homo sapiens
acuguucccugag

SEQ ID NO: 2027685 - RNA, 18 nt, Homo sapiens
ugcuuaaaaaugccaaaa

SEQ ID NO: 2027686 - RNA, 20 nt, Homo sapiens
agucagacuucagacuuuca

SEQ ID NO: 2027687 - RNA, 18 nt, Homo sapiens
ucuucuucccauggugcu

SEQ ID NO: 2027688 - RNA, 19 nt, Homo sapiens
uguguguauguuugcacac

SEQ ID NO: 2027689 - RNA, 22 nt, Homo sapiens
ugaagauguugguuaugguguu

SEQ ID NO: 2027690 - RNA, 16 nt, Homo sapiens
cuggaagauacauaaa

SEQ ID NO: 2027691 - RNA, 20 nt, Homo sapiens
gugaagaugguuucaauuca

SEQ ID NO: 2027692 - RNA, 19 nt, Homo sapiens
cuacuuccugugacuucag

SEQ ID NO: 2027693 - RNA, 23 nt, Homo sapiens
auaaaagagaagaugaggcauga

SEQ ID NO: 2027694 - RNA, 22 nt, Homo sapiens
cuuucaagggaccucuccauga

SEQ ID NO: 2027695 - RNA, 20 nt, Homo sapiens
gcaaccuccaccuucugggu

SEQ ID NO: 2027696 - RNA, 16 nt, Homo sapiens
acauaggaagggaucu

SEQ ID NO: 2027697 - RNA, 13 nt, Homo sapiens
acaggaguguccu

SEQ ID NO: 2027698 - RNA, 21 nt, Homo sapiens
caauguguggcucagugccug

SEQ ID NO: 2027699 - RNA, 12 nt, Homo sapiens
cccagaggccac

SEQ ID NO: 2027700 - RNA, 15 nt, Homo sapiens
ugucgugcuucauag

SEQ ID NO: 2027701 - RNA, 18 nt, Homo sapiens
augcacagagauaugcac

SEQ ID NO: 2027702 - RNA, 23 nt, Homo sapiens
cauuuuuuucuaauggaauguga

SEQ ID NO: 2027703 - RNA, 21 nt, Homo sapiens
aucuuaaaaguguuguuauca

SEQ ID NO: 2027704 - RNA, 16 nt, Homo sapiens
acaaucucaauuccau

SEQ ID NO: 2027705 - RNA, 20 nt, Homo sapiens
aaauuuuuccuuagcauugu

SEQ ID NO: 2027706 - RNA, 20 nt, Homo sapiens
cuucaggagaugaugugaug

SEQ ID NO: 2027707 - RNA, 22 nt, Homo sapiens
acaaaacaccagacccuggaac

SEQ ID NO: 2027708 - RNA, 23 nt, Homo sapiens
ugccaauugaauaggaucaaauu

SEQ ID NO: 2027709 - RNA, 18 nt, Homo sapiens
uucagaaccauccauagu

SEQ ID NO: 2027710 - RNA, 14 nt, Homo sapiens
aaacuccaugcaaa

SEQ ID NO: 2027711 - RNA, 18 nt, Homo sapiens
agaccugccugugugcuc

SEQ ID NO: 2027712 - RNA, 14 nt, Homo sapiens
aaacugcugccuga

SEQ ID NO: 2027713 - RNA, 18 nt, Homo sapiens
agcccagaauagcuuuga

SEQ ID NO: 2027714 - RNA, 12 nt, Homo sapiens
cacugcacucca

SEQ ID NO: 2027715 - RNA, 12 nt, Homo sapiens
cagugcacucga

SEQ ID NO: 2027716 - RNA, 22 nt, Homo sapiens
uugaaugaaaaauuuaagcauu

SEQ ID NO: 2027717 - RNA, 13 nt, Homo sapiens
agcacgccuuagc

SEQ ID NO: 2027718 - RNA, 15 nt, Homo sapiens
uaacacucauuucca

SEQ ID NO: 2027719 - RNA, 23 nt, Homo sapiens
auacuguugauacaaaccacugu

SEQ ID NO: 2027720 - RNA, 16 nt, Homo sapiens
ccaagaaaauaucacu

SEQ ID NO: 2027721 - RNA, 16 nt, Homo sapiens
uccugagcaguguaca

SEQ ID NO: 2027722 - RNA, 17 nt, Homo sapiens
gcagcugaagccagcuc

SEQ ID NO: 2027723 - RNA, 17 nt, Homo sapiens
gaccuuuucucucccau

SEQ ID NO: 2027724 - RNA, 18 nt, Homo sapiens
augcuuuucauaggcuua

SEQ ID NO: 2027725 - RNA, 18 nt, Homo sapiens
aauauagauuaaaucaua

SEQ ID NO: 2027726 - RNA, 21 nt, Homo sapiens
agaauacacauuuuuugccac

SEQ ID NO: 2027727 - RNA, 15 nt, Homo sapiens
uauuugaaccaauaa

SEQ ID NO: 2027728 - RNA, 15 nt, Homo sapiens
aaaugcuguucucaa

SEQ ID NO: 2027729 - RNA, 13 nt, Homo sapiens
acauuagaucuag

SEQ ID NO: 2027730 - RNA, 16 nt, Homo sapiens
auuccuucuugcucag

SEQ ID NO: 2027731 - RNA, 14 nt, Homo sapiens
aaucuccucagaca

SEQ ID NO: 2027732 - RNA, 12 nt, Homo sapiens
cccagauccuca

SEQ ID NO: 2027733 - RNA, 14 nt, Homo sapiens
cuuggccaagcagg

SEQ ID NO: 2027734 - RNA, 14 nt, Homo sapiens
aaccaauaaaggaa

SEQ ID NO: 2027735 - RNA, 16 nt, Homo sapiens
ggagcacagucaguga

SEQ ID NO: 2027736 - RNA, 17 nt, Homo sapiens
agaagaacauccaagga

SEQ ID NO: 2027737 - RNA, 24 nt, Homo sapiens
aagucccaugaauacacaacucca

SEQ ID NO: 2027738 - RNA, 16 nt, Homo sapiens
acuguaugaagucaua

SEQ ID NO: 2027739 - RNA, 22 nt, Homo sapiens
aaguuuuaagagaagaugugau

SEQ ID NO: 2027740 - RNA, 21 nt, Homo sapiens
uuucuugcuucauaugacaaa

SEQ ID NO: 2027741 - RNA, 23 nt, Homo sapiens
aguagaacaaaaacuauuaucac

SEQ ID NO: 2027742 - RNA, 22 nt, Homo sapiens
cagauauaagagaagucucauu

SEQ ID NO: 2027743 - RNA, 22 nt, Homo sapiens
acuucuuuaagcggacccgcua

SEQ ID NO: 2027744 - RNA, 16 nt, Homo sapiens
cugcaggagcaguuug

SEQ ID NO: 2027745 - RNA, 23 nt, Homo sapiens
gacacuucaaugggagugaacau

SEQ ID NO: 2027746 - RNA, 20 nt, Homo sapiens
auauucaaacauuauucuca

SEQ ID NO: 2027747 - RNA, 14 nt, Homo sapiens
uuuauguucucaga

SEQ ID NO: 2027748 - RNA, 15 nt, Homo sapiens
aguaagcaacuagcu

SEQ ID NO: 2027749 - RNA, 20 nt, Homo sapiens
accacauccugaaaagggug

SEQ ID NO: 2027750 - RNA, 19 nt, Homo sapiens
gagccaccaaacccggccu

SEQ ID NO: 2027751 - RNA, 21 nt, Homo sapiens
ggcccaaagcccagcucuuug

SEQ ID NO: 2027752 - RNA, 16 nt, Homo sapiens
aaggaaaguagcaagg

SEQ ID NO: 2027753 - RNA, 20 nt, Homo sapiens
ccuauuaggauaccacuuuu

SEQ ID NO: 2027754 - RNA, 20 nt, Homo sapiens
agugacuguucaagagcaca

SEQ ID NO: 2027755 - RNA, 18 nt, Homo sapiens
auauauuuccacuucuuc

SEQ ID NO: 2027756 - RNA, 16 nt, Homo sapiens
agaaauacauuaugcu

SEQ ID NO: 2027757 - RNA, 18 nt, Homo sapiens
gaagcccagcucugggaa

SEQ ID NO: 2027758 - RNA, 21 nt, Homo sapiens
aaucaucucucaucacuuuuc

SEQ ID NO: 2027759 - RNA, 15 nt, Homo sapiens
aaagucaggugcagu

SEQ ID NO: 2027760 - RNA, 20 nt, Homo sapiens
uuacuuccuaucaagccagu

SEQ ID NO: 2027761 - RNA, 22 nt, Homo sapiens
cacuugccugugcuacaauuca

SEQ ID NO: 2027762 - RNA, 13 nt, Homo sapiens
cuauccugcccag

SEQ ID NO: 2027763 - RNA, 19 nt, Homo sapiens
aacccuggauaagucacuu

SEQ ID NO: 2027764 - RNA, 15 nt, Homo sapiens
augacaguagucaca

SEQ ID NO: 2027765 - RNA, 14 nt, Homo sapiens
acacucaccaugaa

SEQ ID NO: 2027766 - RNA, 21 nt, Homo sapiens
uaguggcuguucaugcuccaa

SEQ ID NO: 2027767 - RNA, 19 nt, Homo sapiens
cucaaucacacugaagcca

SEQ ID NO: 2027768 - RNA, 12 nt, Homo sapiens
cuugcugccaaa

SEQ ID NO: 2027769 - RNA, 20 nt, Homo sapiens
uagcuuguuaguaaugcucu

SEQ ID NO: 2027770 - RNA, 12 nt, Homo sapiens
uaaaaacaggag

SEQ ID NO: 2027771 - RNA, 15 nt, Homo sapiens
aauuauccacaugaa

SEQ ID NO: 2027772 - RNA, 15 nt, Homo sapiens
ugaggacuucuugcu

SEQ ID NO: 2027773 - RNA, 15 nt, Homo sapiens
auucaggguuauaca

SEQ ID NO: 2027774 - RNA, 20 nt, Homo sapiens
guucuuguggaagacacuug

SEQ ID NO: 2027775 - RNA, 23 nt, Homo sapiens
agccguugaggcgguuuccugaa

SEQ ID NO: 2027776 - RNA, 18 nt, Homo sapiens
caggcagagaaucauacu

SEQ ID NO: 2027777 - RNA, 17 nt, Homo sapiens
ccuuuggugacuucaca

SEQ ID NO: 2027778 - RNA, 19 nt, Homo sapiens
aucaaggugcucuucucau

SEQ ID NO: 2027779 - RNA, 15 nt, Homo sapiens
auggaucaaccaagu

SEQ ID NO: 2027780 - RNA, 12 nt, Homo sapiens
cuuaguguuucu

SEQ ID NO: 2027781 - RNA, 22 nt, Homo sapiens
ugccugcuuuuuauggccugug

SEQ ID NO: 2027782 - RNA, 21 nt, Homo sapiens
ggcuguguugguguggcccau

SEQ ID NO: 2027783 - RNA, 13 nt, Homo sapiens
uaauggaaaccaa

SEQ ID NO: 2027784 - RNA, 22 nt, Homo sapiens
ugaguuauuaaaaucauaggaa

SEQ ID NO: 2027785 - RNA, 14 nt, Homo sapiens
uguccugccagcug

SEQ ID NO: 2027786 - RNA, 16 nt, Homo sapiens
uagagaugggguuuca

SEQ ID NO: 2027787 - RNA, 19 nt, Homo sapiens
cccuuggugagaaagggau

SEQ ID NO: 2027788 - RNA, 20 nt, Homo sapiens
uguugacauacaaaccauga

SEQ ID NO: 2027789 - RNA, 18 nt, Homo sapiens
gugcugcagguggcagag

SEQ ID NO: 2027790 - RNA, 15 nt, Homo sapiens
cuauaaaaucuuaga

SEQ ID NO: 2027791 - RNA, 22 nt, Homo sapiens
uaaaauauauuuaugauaacua

SEQ ID NO: 2027792 - RNA, 17 nt, Homo sapiens
uacauucccugcaucca

SEQ ID NO: 2027793 - RNA, 15 nt, Homo sapiens
cugugaaauucucag

SEQ ID NO: 2027794 - RNA, 15 nt, Homo sapiens
uccgcggaccgggga

SEQ ID NO: 2027795 - RNA, 16 nt, Homo sapiens
ugggagagucaaggga

SEQ ID NO: 2027796 - RNA, 15 nt, Homo sapiens
gugugaaugugggca

SEQ ID NO: 2027797 - RNA, 15 nt, Homo sapiens
uauuucauuauguaa

SEQ ID NO: 2027798 - RNA, 14 nt, Homo sapiens
aaacgaagcaccau

SEQ ID NO: 2027799 - RNA, 21 nt, Homo sapiens
auggauugauaauugcauuca

SEQ ID NO: 2027800 - RNA, 16 nt, Homo sapiens
cucuggaucacagaca

SEQ ID NO: 2027801 - RNA, 18 nt, Homo sapiens
ccccaacaccccacugag

SEQ ID NO: 2027802 - RNA, 13 nt, Homo sapiens
uguuucuacacau

SEQ ID NO: 2027803 - RNA, 22 nt, Homo sapiens
caacccugugcaugacugaugu

SEQ ID NO: 2027804 - RNA, 16 nt, Homo sapiens
ucacaaacuacaaagc

SEQ ID NO: 2027805 - RNA, 22 nt, Homo sapiens
cacaagugguguuuauugcaau

SEQ ID NO: 2027806 - RNA, 23 nt, Homo sapiens
caaggaaaaaugcugcuucuccu

SEQ ID NO: 2027807 - RNA, 15 nt, Homo sapiens
aaauucaagccuuag

SEQ ID NO: 2027808 - RNA, 22 nt, Homo sapiens
caaaaauagaaauuagauuugu

SEQ ID NO: 2027809 - RNA, 14 nt, Homo sapiens
ucuuacuaaaaagu

SEQ ID NO: 2027810 - RNA, 14 nt, Homo sapiens
uauaacuaacaugu

SEQ ID NO: 2027811 - RNA, 18 nt, Homo sapiens
gucucucuucucagagug

SEQ ID NO: 2027812 - RNA, 13 nt, Homo sapiens
agggagcuugcca

SEQ ID NO: 2027813 - RNA, 14 nt, Homo sapiens
uacugaugagacaa

SEQ ID NO: 2027814 - RNA, 17 nt, Homo sapiens
uguuucauuuaccucua

SEQ ID NO: 2027815 - RNA, 23 nt, Homo sapiens
gcccugcuuuugcauaaugcaau

SEQ ID NO: 2027816 - RNA, 17 nt, Homo sapiens
ccaagaaaauaucacug

SEQ ID NO: 2027817 - RNA, 19 nt, Homo sapiens
cgcagagguguaggggugg

SEQ ID NO: 2027818 - RNA, 14 nt, Homo sapiens
agauagaaccugga

SEQ ID NO: 2027819 - RNA, 16 nt, Homo sapiens
gaauccauaucagcuc

SEQ ID NO: 2027820 - RNA, 12 nt, Homo sapiens
acucuccaugau

SEQ ID NO: 2027821 - RNA, 19 nt, Homo sapiens
gaauccauguaaauugcaa

SEQ ID NO: 2027822 - RNA, 14 nt, Homo sapiens
gccaaaaugacuuu

SEQ ID NO: 2027823 - RNA, 16 nt, Homo sapiens
cuuuucuuuuucuccc

SEQ ID NO: 2027824 - RNA, 16 nt, Homo sapiens
agaugugaacuugaag

SEQ ID NO: 2027825 - RNA, 23 nt, Homo sapiens
ugcugggauuacaggcgugaucc

SEQ ID NO: 2027826 - RNA, 22 nt, Homo sapiens
cuggagggcaguggcacgaucu

SEQ ID NO: 2027827 - RNA, 22 nt, Homo sapiens
uggaagcaauaagccauucuaa

SEQ ID NO: 2027828 - RNA, 17 nt, Homo sapiens
caagaauuagggcccca

SEQ ID NO: 2027829 - RNA, 13 nt, Homo sapiens
aacucuuaucuca

SEQ ID NO: 2027830 - RNA, 22 nt, Homo sapiens
ccccuuaggucgcgcucuugca

SEQ ID NO: 2027831 - RNA, 16 nt, Homo sapiens
uaaauuccacagauua

SEQ ID NO: 2027832 - RNA, 19 nt, Homo sapiens
aggguuccccuggccuuaa

SEQ ID NO: 2027833 - RNA, 18 nt, Homo sapiens
cuucaccuccuucugcag

SEQ ID NO: 2027834 - RNA, 16 nt, Homo sapiens
uacuuuggcugugaug

SEQ ID NO: 2027835 - RNA, 17 nt, Homo sapiens
agugaagccaaagggac

SEQ ID NO: 2027836 - RNA, 14 nt, Homo sapiens
uuccagguucuggu

SEQ ID NO: 2027837 - RNA, 16 nt, Homo sapiens
ucaacuuaagguauau

SEQ ID NO: 2027838 - RNA, 16 nt, Homo sapiens
acuuuuauugagcucu

SEQ ID NO: 2027839 - RNA, 16 nt, Homo sapiens
aaauauuuacauuuug

SEQ ID NO: 2027840 - RNA, 16 nt, Homo sapiens
uccuauaguacuuuau

SEQ ID NO: 2027841 - RNA, 14 nt, Homo sapiens
ucaaagcuugccgu

SEQ ID NO: 2027842 - RNA, 15 nt, Homo sapiens
ucacuggcuguuaau

SEQ ID NO: 2027843 - RNA, 16 nt, Homo sapiens
uaagccagugagacca

SEQ ID NO: 2027844 - RNA, 21 nt, Homo sapiens
uuuucaagcuucacauuugcg

SEQ ID NO: 2027845 - RNA, 16 nt, Homo sapiens
cacagugcugccccuu

SEQ ID NO: 2027846 - RNA, 13 nt, Homo sapiens
ggaaccagcccag

SEQ ID NO: 2027847 - RNA, 13 nt, Homo sapiens
uucuaguuucacg

SEQ ID NO: 2027848 - RNA, 14 nt, Homo sapiens
uccacgaagccuua

SEQ ID NO: 2027849 - RNA, 18 nt, Homo sapiens
acuauuugauaaugcaua

SEQ ID NO: 2027850 - RNA, 16 nt, Homo sapiens
gacgugcugggaccaa

SEQ ID NO: 2027851 - RNA, 15 nt, Homo sapiens
caggaaagcagcaaa

SEQ ID NO: 2027852 - RNA, 14 nt, Homo sapiens
gugcuuguuuacag

SEQ ID NO: 2027853 - RNA, 17 nt, Homo sapiens
aguuuuagaaaugagau

SEQ ID NO: 2027854 - RNA, 17 nt, Homo sapiens
cuuuuauaauacauuaa

SEQ ID NO: 2027855 - RNA, 13 nt, Homo sapiens
uucugcaguguuu

SEQ ID NO: 2027856 - RNA, 20 nt, Homo sapiens
aggcuagcuggagccuggga

SEQ ID NO: 2027857 - RNA, 19 nt, Homo sapiens
ucuccuaauccugucagcu

SEQ ID NO: 2027858 - RNA, 20 nt, Homo sapiens
cagcagcauuuuuauuucag

SEQ ID NO: 2027859 - RNA, 20 nt, Homo sapiens
aaauacuucaugagcauuca

SEQ ID NO: 2027860 - RNA, 15 nt, Homo sapiens
uguuuucacuguaau

SEQ ID NO: 2027861 - RNA, 14 nt, Homo sapiens
gagacccggggaug

SEQ ID NO: 2027862 - RNA, 17 nt, Homo sapiens
guccagucaaguucccu

SEQ ID NO: 2027863 - RNA, 15 nt, Homo sapiens
auaguaaguucagca

SEQ ID NO: 2027864 - RNA, 14 nt, Homo sapiens
gacaccauucugaa

SEQ ID NO: 2027865 - RNA, 13 nt, Homo sapiens
gugcccaugugua

SEQ ID NO: 2027866 - RNA, 17 nt, Homo sapiens
guuaugcggucuaggga

SEQ ID NO: 2027867 - RNA, 22 nt, Homo sapiens
cauagagagcaagacgcugugc

SEQ ID NO: 2027868 - RNA, 18 nt, Homo sapiens
ccuuuaauguugcccaca

SEQ ID NO: 2027869 - RNA, 19 nt, Homo sapiens
cagaaaggugauuccagga

SEQ ID NO: 2027870 - RNA, 15 nt, Homo sapiens
agacccacaggucua

SEQ ID NO: 2027871 - RNA, 10 nt, Homo sapiens
acaacauguu

SEQ ID NO: 2027872 - RNA, 12 nt, Homo sapiens
acagaccuaaua

SEQ ID NO: 2027873 - RNA, 14 nt, Homo sapiens
acccacucuucaca

SEQ ID NO: 2027874 - RNA, 19 nt, Homo sapiens
aaauaacacuguacugcaa

SEQ ID NO: 2027875 - RNA, 17 nt, Homo sapiens
accccaguuccuagcac

SEQ ID NO: 2027876 - RNA, 19 nt, Homo sapiens
uagugagggccucaagucc

SEQ ID NO: 2027877 - RNA, 14 nt, Homo sapiens
aaaagccucaguga

SEQ ID NO: 2027878 - RNA, 20 nt, Homo sapiens
auuuucagugcuuucucaaa

SEQ ID NO: 2027879 - RNA, 19 nt, Homo sapiens
agcaucccaagguucaaua

SEQ ID NO: 2027880 - RNA, 19 nt, Homo sapiens
uuaaaagaaaacacuguca

SEQ ID NO: 2027881 - RNA, 23 nt, Homo sapiens
cacacagugucuguguacaugua

SEQ ID NO: 2027882 - RNA, 15 nt, Homo sapiens
auaaaccugaccucc

SEQ ID NO: 2027883 - RNA, 15 nt, Homo sapiens
ugcccagagccacag

SEQ ID NO: 2027884 - RNA, 13 nt, Homo sapiens
uucuaaugaccca

SEQ ID NO: 2027885 - RNA, 21 nt, Homo sapiens
ccuaagaucucgguuugccaa

SEQ ID NO: 2027886 - RNA, 17 nt, Homo sapiens
acuucaggggcacuuca

SEQ ID NO: 2027887 - RNA, 17 nt, Homo sapiens
gcgaacugcacugcugu

SEQ ID NO: 2027888 - RNA, 20 nt, Homo sapiens
ccaaccgaacaugaccaaaa

SEQ ID NO: 2027889 - RNA, 23 nt, Homo sapiens
uaauugcaccauaguaugcucug

SEQ ID NO: 2027890 - RNA, 20 nt, Homo sapiens
caacaccagccccacuucug

SEQ ID NO: 2027891 - RNA, 16 nt, Homo sapiens
ugaagaggagaacaaa

SEQ ID NO: 2027892 - RNA, 16 nt, Homo sapiens
ccuuuauaagguuguc

SEQ ID NO: 2027893 - RNA, 19 nt, Homo sapiens
auggagguucucucggagu

SEQ ID NO: 2027894 - RNA, 15 nt, Homo sapiens
gcccguuuguacaug

SEQ ID NO: 2027895 - RNA, 22 nt, Homo sapiens
ugucucuguuuuguaagcuuua

SEQ ID NO: 2027896 - RNA, 23 nt, Homo sapiens
auaaacaugaugucaacuuccuu

SEQ ID NO: 2027897 - RNA, 23 nt, Homo sapiens
cugaugccuguguacugccuuaa

SEQ ID NO: 2027898 - RNA, 18 nt, Homo sapiens
cacugaauaaauaaguaa

SEQ ID NO: 2027899 - RNA, 13 nt, Homo sapiens
acucugaagggac

SEQ ID NO: 2027900 - RNA, 17 nt, Homo sapiens
caucccgaagccaucac

SEQ ID NO: 2027901 - RNA, 19 nt, Homo sapiens
caacugaggauguggcuua

SEQ ID NO: 2027902 - RNA, 18 nt, Homo sapiens
auggccaaaucgcaguga

SEQ ID NO: 2027903 - RNA, 19 nt, Homo sapiens
gcccagaauucccagcugu

SEQ ID NO: 2027904 - RNA, 18 nt, Homo sapiens
auaugauuuuuauccaug

SEQ ID NO: 2027905 - RNA, 22 nt, Homo sapiens
aggagccaguggggaagugcgu

SEQ ID NO: 2027906 - RNA, 13 nt, Homo sapiens
acugcacuuacau

SEQ ID NO: 2027907 - RNA, 14 nt, Homo sapiens
accaucaagccacc

SEQ ID NO: 2027908 - RNA, 19 nt, Homo sapiens
ugaguuuaggcagcuucuc

SEQ ID NO: 2027909 - RNA, 15 nt, Homo sapiens
uguccgggcucagaa

SEQ ID NO: 2027910 - RNA, 17 nt, Homo sapiens
uucuaauuuuuaagcaa

SEQ ID NO: 2027911 - RNA, 20 nt, Homo sapiens
ggauauccuuucacucugca

SEQ ID NO: 2027912 - RNA, 21 nt, Homo sapiens
uuguaauaguccauggacaau

SEQ ID NO: 2027913 - RNA, 14 nt, Homo sapiens
aaaauucagaugcu

SEQ ID NO: 2027914 - RNA, 14 nt, Homo sapiens
cucaauacacagaa

SEQ ID NO: 2027915 - RNA, 15 nt, Homo sapiens
aacauuagaugucau

SEQ ID NO: 2027916 - RNA, 21 nt, Homo sapiens
auucacauuuuaacauaggca

SEQ ID NO: 2027917 - RNA, 21 nt, Homo sapiens
agcuacaguuguccagaucac

SEQ ID NO: 2027918 - RNA, 13 nt, Homo sapiens
uuaauuauauagu

SEQ ID NO: 2027919 - RNA, 18 nt, Homo sapiens
gaaccucacucuugccaa

SEQ ID NO: 2027920 - RNA, 16 nt, Homo sapiens
auugucuguaaugaca

SEQ ID NO: 2027921 - RNA, 21 nt, Homo sapiens
auuguaccaggaugugcuauu

SEQ ID NO: 2027922 - RNA, 16 nt, Homo sapiens
acccccuaaaauccau

SEQ ID NO: 2027923 - RNA, 23 nt, Homo sapiens
gaauuuugucuccugcuuggaaa

SEQ ID NO: 2027924 - RNA, 16 nt, Homo sapiens
acacugcagagacuaa

SEQ ID NO: 2027925 - RNA, 14 nt, Homo sapiens
cuaguuaauccaaa

SEQ ID NO: 2027926 - RNA, 18 nt, Homo sapiens
agacaaguaaucacuaac

SEQ ID NO: 2027927 - RNA, 21 nt, Homo sapiens
gaagaccucccuucaggugcc

SEQ ID NO: 2027928 - RNA, 15 nt, Homo sapiens
auuccucacuuugaa

SEQ ID NO: 2027929 - RNA, 17 nt, Homo sapiens
caacccuucuucauguu

SEQ ID NO: 2027930 - RNA, 18 nt, Homo sapiens
acacccuggaguggcaug

SEQ ID NO: 2027931 - RNA, 17 nt, Homo sapiens
aacugaaugagaaccaa

SEQ ID NO: 2027932 - RNA, 19 nt, Homo sapiens
uauauuuuugcuaaaccua

SEQ ID NO: 2027933 - RNA, 13 nt, Homo sapiens
gaggaaacuuuga

SEQ ID NO: 2027934 - RNA, 15 nt, Homo sapiens
cgcaauugcucaugc

SEQ ID NO: 2027935 - RNA, 23 nt, Homo sapiens
auacaguuuggcuuuuuucacau

SEQ ID NO: 2027936 - RNA, 16 nt, Homo sapiens
aauaauagcuagcuau

SEQ ID NO: 2027937 - RNA, 17 nt, Homo sapiens
guccaggguugaucaca

SEQ ID NO: 2027938 - RNA, 16 nt, Homo sapiens
gcucccugaagccagc

SEQ ID NO: 2027939 - RNA, 22 nt, Homo sapiens
gugugaagauuauaaaagccaa

SEQ ID NO: 2027940 - RNA, 18 nt, Homo sapiens
cacugggugccaaguccu

SEQ ID NO: 2027941 - RNA, 12 nt, Homo sapiens
aagaauacuuga

SEQ ID NO: 2027942 - RNA, 12 nt, Homo sapiens
aaucacuugaau

SEQ ID NO: 2027943 - RNA, 17 nt, Homo sapiens
auaauugaagaauggga

SEQ ID NO: 2027944 - RNA, 22 nt, Homo sapiens
uggucaugugguacuugaggga

SEQ ID NO: 2027945 - RNA, 22 nt, Homo sapiens
uguuaaggaaacucuuaucuca

SEQ ID NO: 2027946 - RNA, 13 nt, Homo sapiens
cucuugcacucaa

SEQ ID NO: 2027947 - RNA, 13 nt, Homo sapiens
aagaagcaaaguu

SEQ ID NO: 2027948 - RNA, 14 nt, Homo sapiens
aguucucaauguuc

SEQ ID NO: 2027949 - RNA, 22 nt, Homo sapiens
caagcaguaauuaauaucuccu

SEQ ID NO: 2027950 - RNA, 14 nt, Homo sapiens
aaaguuaacuacac

SEQ ID NO: 2027951 - RNA, 12 nt, Homo sapiens
acaggucuuccg

SEQ ID NO: 2027952 - RNA, 12 nt, Homo sapiens
acaagucuucca

SEQ ID NO: 2027953 - RNA, 21 nt, Homo sapiens
ugcucaaaauugcuucuaaaa

SEQ ID NO: 2027954 - RNA, 17 nt, Homo sapiens
uacccaaggcucuucuc

SEQ ID NO: 2027955 - RNA, 16 nt, Homo sapiens
gaugucguggacucca

SEQ ID NO: 2027956 - RNA, 13 nt, Homo sapiens
cagaaaauucugu

SEQ ID NO: 2027957 - RNA, 19 nt, Homo sapiens
gugacagcugcaagccagg

SEQ ID NO: 2027958 - RNA, 15 nt, Homo sapiens
aaccucacucuugcc

SEQ ID NO: 2027959 - RNA, 15 nt, Homo sapiens
cauucauccuuccau

SEQ ID NO: 2027960 - RNA, 13 nt, Homo sapiens
cuuuauaacccaa

SEQ ID NO: 2027961 - RNA, 16 nt, Homo sapiens
uaccaauuauggaaau

SEQ ID NO: 2027962 - RNA, 12 nt, Homo sapiens
auguaagaagaa

SEQ ID NO: 2027963 - RNA, 19 nt, Homo sapiens
auacgcucaggugguugug

SEQ ID NO: 2027964 - RNA, 24 nt, Homo sapiens
accuggcccagugcaaucugucca

SEQ ID NO: 2027965 - RNA, 13 nt, Homo sapiens
cuuucuccuccaa

SEQ ID NO: 2027966 - RNA, 22 nt, Homo sapiens
augcuguuguuguuacuucccu

SEQ ID NO: 2027967 - RNA, 18 nt, Homo sapiens
gagaaagaaaaccuggag

SEQ ID NO: 2027968 - RNA, 14 nt, Homo sapiens
gaaaagaaaccugg

SEQ ID NO: 2027969 - RNA, 16 nt, Homo sapiens
aaauuacuuggcuuuu

SEQ ID NO: 2027970 - RNA, 23 nt, Homo sapiens
uaauuccccccacccccugccaa

SEQ ID NO: 2027971 - RNA, 23 nt, Homo sapiens
gaccaucucucccuccuggugaa

SEQ ID NO: 2027972 - RNA, 13 nt, Homo sapiens
gaaagaacaucag

SEQ ID NO: 2027973 - RNA, 15 nt, Homo sapiens
acucuucagaggaau

SEQ ID NO: 2027974 - RNA, 13 nt, Homo sapiens
ugcaaaaaacaua

SEQ ID NO: 2027975 - RNA, 17 nt, Homo sapiens
ggcagcuccugaccaaa

SEQ ID NO: 2027976 - RNA, 19 nt, Homo sapiens
ucauguaauuuuguaucac

SEQ ID NO: 2027977 - RNA, 23 nt, Homo sapiens
agcuauaacauuugcugaauaug

SEQ ID NO: 2027978 - RNA, 15 nt, Homo sapiens
aaaacugaaccacaa

SEQ ID NO: 2027979 - RNA, 17 nt, Homo sapiens
ucuuucugagugccuuc

SEQ ID NO: 2027980 - RNA, 21 nt, Homo sapiens
cagauguacaauuuagcuuaa

SEQ ID NO: 2027981 - RNA, 16 nt, Homo sapiens
accacccagagcaccc

SEQ ID NO: 2027982 - RNA, 19 nt, Homo sapiens
gaaaaccaaagggugcuag

SEQ ID NO: 2027983 - RNA, 14 nt, Homo sapiens
ugucccccaaaaaa

SEQ ID NO: 2027984 - RNA, 22 nt, Homo sapiens
aaccaaauuacaaguauucagu

SEQ ID NO: 2027985 - RNA, 15 nt, Homo sapiens
agccuuagacaaaug

SEQ ID NO: 2027986 - RNA, 22 nt, Homo sapiens
uguucagaagaaagauugcuau

SEQ ID NO: 2027987 - RNA, 19 nt, Homo sapiens
ugcuaauggauguagccag

SEQ ID NO: 2027988 - RNA, 17 nt, Homo sapiens
acaacaaaaaccaaaaa

SEQ ID NO: 2027989 - RNA, 19 nt, Homo sapiens
auucuuccaaguucauuca

SEQ ID NO: 2027990 - RNA, 20 nt, Homo sapiens
aucugaggaaggugcuugcc

SEQ ID NO: 2027991 - RNA, 14 nt, Homo sapiens
auggcagccuacuc

SEQ ID NO: 2027992 - RNA, 17 nt, Homo sapiens
gacuccugugcaacuuu

SEQ ID NO: 2027993 - RNA, 15 nt, Homo sapiens
aagaggaacuugacc

SEQ ID NO: 2027994 - RNA, 12 nt, Homo sapiens
acaucucagugc

SEQ ID NO: 2027995 - RNA, 17 nt, Homo sapiens
aggcugaggcaggagaa

SEQ ID NO: 2027996 - RNA, 15 nt, Homo sapiens
auuuuuccaacuacu

SEQ ID NO: 2027997 - RNA, 17 nt, Homo sapiens
ccuucuuccauccuuag

SEQ ID NO: 2027998 - RNA, 18 nt, Homo sapiens
guugugggcaacacaugc

SEQ ID NO: 2027999 - RNA, 10 nt, Homo sapiens
ggcauuauua

SEQ ID NO: 2028000 - RNA, 23 nt, Homo sapiens
augagacuuugaaacuaucucau

SEQ ID NO: 2028001 - RNA, 14 nt, Homo sapiens
cuccuuugcacuga

SEQ ID NO: 2028002 - RNA, 12 nt, Homo sapiens
auuuuuacuuca

SEQ ID NO: 2028003 - RNA, 16 nt, Homo sapiens
cacacacacaaggugc

SEQ ID NO: 2028004 - RNA, 16 nt, Homo sapiens
accagagaacagcucc

SEQ ID NO: 2028005 - RNA, 13 nt, Homo sapiens
caagccaccuucc

SEQ ID NO: 2028006 - RNA, 16 nt, Homo sapiens
ugauucacagucucau

SEQ ID NO: 2028007 - RNA, 20 nt, Homo sapiens
caccuaaacccucugugaaa

SEQ ID NO: 2028008 - RNA, 22 nt, Homo sapiens
agugcaguggcgugaucucagc

SEQ ID NO: 2028009 - RNA, 15 nt, Homo sapiens
acagaaccacagggc

SEQ ID NO: 2028010 - RNA, 16 nt, Homo sapiens
uuacaagguguccuca

SEQ ID NO: 2028011 - RNA, 20 nt, Homo sapiens
uaccacaugccaagcacugu

SEQ ID NO: 2028012 - RNA, 13 nt, Homo sapiens
aguccuacagaug

SEQ ID NO: 2028013 - RNA, 19 nt, Homo sapiens
gcuucugcucacauucccu

SEQ ID NO: 2028014 - RNA, 13 nt, Homo sapiens
agccaugccagcu

SEQ ID NO: 2028015 - RNA, 12 nt, Homo sapiens
cccccugugcag

SEQ ID NO: 2028016 - RNA, 16 nt, Homo sapiens
aucuaguuuacuuccu

SEQ ID NO: 2028017 - RNA, 20 nt, Homo sapiens
cauuuccucuguucuuuuca

SEQ ID NO: 2028018 - RNA, 19 nt, Homo sapiens
cuucuaaacccaauccaaa

SEQ ID NO: 2028019 - RNA, 17 nt, Homo sapiens
ccaagucuagcuuuccu

SEQ ID NO: 2028020 - RNA, 22 nt, Homo sapiens
uguccuuggcagaggcagggaa

SEQ ID NO: 2028021 - RNA, 18 nt, Homo sapiens
agaagcuuaagugggcag

SEQ ID NO: 2028022 - RNA, 15 nt, Homo sapiens
ugucauuuugcacug

SEQ ID NO: 2028023 - RNA, 17 nt, Homo sapiens
aucugucauuaucaaaa

SEQ ID NO: 2028024 - RNA, 22 nt, Homo sapiens
ugaggagcugacauagggguaa

SEQ ID NO: 2028025 - RNA, 12 nt, Homo sapiens
uguuuccaguga

SEQ ID NO: 2028026 - RNA, 19 nt, Homo sapiens
cagcgucacuccagugcuc

SEQ ID NO: 2028027 - RNA, 21 nt, Homo sapiens
uaugccucugcucccaacuuc

SEQ ID NO: 2028028 - RNA, 17 nt, Homo sapiens
ugaguuacuucccuuag

SEQ ID NO: 2028029 - RNA, 14 nt, Homo sapiens
auguucacugugag

SEQ ID NO: 2028030 - RNA, 17 nt, Homo sapiens
uccagcaagaagggagu

SEQ ID NO: 2028031 - RNA, 16 nt, Homo sapiens
aaggucaccugcacuc

SEQ ID NO: 2028032 - RNA, 15 nt, Homo sapiens
aagaucuguuuugaa

SEQ ID NO: 2028033 - RNA, 16 nt, Homo sapiens
ugcaugcugucccuua

SEQ ID NO: 2028034 - RNA, 15 nt, Homo sapiens
aggaagaaaugucag

SEQ ID NO: 2028035 - RNA, 17 nt, Homo sapiens
cucagucuacacucaca

SEQ ID NO: 2028036 - RNA, 15 nt, Homo sapiens
cauauauguagcuuu

SEQ ID NO: 2028037 - RNA, 20 nt, Homo sapiens
ccgaggcucgagcucggggc

SEQ ID NO: 2028038 - RNA, 22 nt, Homo sapiens
aucagacugcggugaacauuuc

SEQ ID NO: 2028039 - RNA, 15 nt, Homo sapiens
uggugcaaucuuggc

SEQ ID NO: 2028040 - RNA, 20 nt, Homo sapiens
aguccaguccuuuguugcug

SEQ ID NO: 2028041 - RNA, 13 nt, Homo sapiens
caaaacacccaaa

SEQ ID NO: 2028042 - RNA, 15 nt, Homo sapiens
uguauuaaugcuaua

SEQ ID NO: 2028043 - RNA, 15 nt, Homo sapiens
ugggggaaagcacag

SEQ ID NO: 2028044 - RNA, 18 nt, Homo sapiens
ucuucuugggcuuugcua

SEQ ID NO: 2028045 - RNA, 13 nt, Homo sapiens
cagguagacagac

SEQ ID NO: 2028046 - RNA, 17 nt, Homo sapiens
gugaaugagaaaggugu

SEQ ID NO: 2028047 - RNA, 16 nt, Homo sapiens
gcccuaagggacuuaa

SEQ ID NO: 2028048 - RNA, 18 nt, Homo sapiens
uuugccagugggaacucc

SEQ ID NO: 2028049 - RNA, 18 nt, Homo sapiens
uguaauaauaaaucgucc

SEQ ID NO: 2028050 - RNA, 14 nt, Homo sapiens
ugaaucauguagua

SEQ ID NO: 2028051 - RNA, 21 nt, Homo sapiens
auauguaugugugaguguaug

SEQ ID NO: 2028052 - RNA, 21 nt, Homo sapiens
accccaacaugccugcaccug

SEQ ID NO: 2028053 - RNA, 15 nt, Homo sapiens
auuacuagaagauga

SEQ ID NO: 2028054 - RNA, 15 nt, Homo sapiens
ugacagaaggaacac

SEQ ID NO: 2028055 - RNA, 11 nt, Homo sapiens
agucugugaaa

SEQ ID NO: 2028056 - RNA, 11 nt, Homo sapiens
aaucugugaga

SEQ ID NO: 2028057 - RNA, 13 nt, Homo sapiens
ccauucacaccag

SEQ ID NO: 2028058 - RNA, 20 nt, Homo sapiens
gcuuaacacuaucauggacu

SEQ ID NO: 2028059 - RNA, 20 nt, Homo sapiens
guugucuggcuuuuugcacg

SEQ ID NO: 2028060 - RNA, 18 nt, Homo sapiens
gguugaagcagacuggau

SEQ ID NO: 2028061 - RNA, 14 nt, Homo sapiens
acucccuaagucca

SEQ ID NO: 2028062 - RNA, 20 nt, Homo sapiens
uaacucuaacugauguucca

SEQ ID NO: 2028063 - RNA, 20 nt, Homo sapiens
gugaagaauuuagaucuuau

SEQ ID NO: 2028064 - RNA, 21 nt, Homo sapiens
uuuucuuaaauauuaugugaa

SEQ ID NO: 2028065 - RNA, 13 nt, Homo sapiens
uaugcagugugcu

SEQ ID NO: 2028066 - RNA, 17 nt, Homo sapiens
aauuuucacaugaacau

SEQ ID NO: 2028067 - RNA, 22 nt, Homo sapiens
acacuaucauggacuacaccag

SEQ ID NO: 2028068 - RNA, 22 nt, Homo sapiens
aguucuguuguguuugucaaaa

SEQ ID NO: 2028069 - RNA, 17 nt, Homo sapiens
uaauauuccuggcauac

SEQ ID NO: 2028070 - RNA, 18 nt, Homo sapiens
gugcauugaauacucuga

SEQ ID NO: 2028071 - RNA, 15 nt, Homo sapiens
uaaaaccaucuggca

SEQ ID NO: 2028072 - RNA, 20 nt, Homo sapiens
guuagugauuauauuucacc

SEQ ID NO: 2028073 - RNA, 16 nt, Homo sapiens
cugcccugcugagcac

SEQ ID NO: 2028074 - RNA, 20 nt, Homo sapiens
gcuuaaccuuuccaguuuau

SEQ ID NO: 2028075 - RNA, 14 nt, Homo sapiens
cgagcaggguguuu

SEQ ID NO: 2028076 - RNA, 17 nt, Homo sapiens
aguugacugacugagca

SEQ ID NO: 2028077 - RNA, 21 nt, Homo sapiens
auuuagcccuucuaggcaaaa

SEQ ID NO: 2028078 - RNA, 21 nt, Homo sapiens
ugauugagagcagccucuuga

SEQ ID NO: 2028079 - RNA, 18 nt, Homo sapiens
accucucucagagcaucu

SEQ ID NO: 2028080 - RNA, 22 nt, Homo sapiens
auggggcucagauggacuggga

SEQ ID NO: 2028081 - RNA, 15 nt, Homo sapiens
cuguguggucuccag

SEQ ID NO: 2028082 - RNA, 18 nt, Homo sapiens
uugaggcucugucacuga

SEQ ID NO: 2028083 - RNA, 13 nt, Homo sapiens
auagaagaagcua

SEQ ID NO: 2028084 - RNA, 20 nt, Homo sapiens
ccacaugugacacauaugca

SEQ ID NO: 2028085 - RNA, 13 nt, Homo sapiens
gaaaaguguauua

SEQ ID NO: 2028086 - RNA, 17 nt, Homo sapiens
cauaacuggauuuugaa

SEQ ID NO: 2028087 - RNA, 16 nt, Homo sapiens
aaacucacaacucucu

SEQ ID NO: 2028088 - RNA, 14 nt, Homo sapiens
uggauuuuuaccag

SEQ ID NO: 2028089 - RNA, 12 nt, Homo sapiens
gguagcauucuu

SEQ ID NO: 2028090 - RNA, 23 nt, Homo sapiens
caaauggugguuguuucuuccaa

SEQ ID NO: 2028091 - RNA, 20 nt, Homo sapiens
ugcucuugagucuuugcaga

SEQ ID NO: 2028092 - RNA, 22 nt, Homo sapiens
ugacuaugggagucaacucaac

SEQ ID NO: 2028093 - RNA, 19 nt, Homo sapiens
acugcgccgaccccgccac

SEQ ID NO: 2028094 - RNA, 14 nt, Homo sapiens
ccuucuccaucucu

SEQ ID NO: 2028095 - RNA, 19 nt, Homo sapiens
aaagcgagaucccaucucu

SEQ ID NO: 2028096 - RNA, 12 nt, Homo sapiens
aguggcuucucc

SEQ ID NO: 2028097 - RNA, 13 nt, Homo sapiens
auaaucuucugcc

SEQ ID NO: 2028098 - RNA, 16 nt, Homo sapiens
cuggauggucaucucg

SEQ ID NO: 2028099 - RNA, 17 nt, Homo sapiens
aauuucaaaagaacauu

SEQ ID NO: 2028100 - RNA, 14 nt, Homo sapiens
auuaugacaguuau

SEQ ID NO: 2028101 - RNA, 16 nt, Homo sapiens
agccccagccagcccu

SEQ ID NO: 2028102 - RNA, 22 nt, Homo sapiens
ugaggggguaauaaaccuccuu

SEQ ID NO: 2028103 - RNA, 21 nt, Homo sapiens
uagucaauauuugguauuuca

SEQ ID NO: 2028104 - RNA, 20 nt, Homo sapiens
cuuauuguagcauccuggaa

SEQ ID NO: 2028105 - RNA, 19 nt, Homo sapiens
aaaguguucauugcacaau

SEQ ID NO: 2028106 - RNA, 20 nt, Homo sapiens
caacagaacuucacagugac

SEQ ID NO: 2028107 - RNA, 17 nt, Homo sapiens
gaguagggacucagggc

SEQ ID NO: 2028108 - RNA, 12 nt, Homo sapiens
ugacugcaauga

SEQ ID NO: 2028109 - RNA, 20 nt, Homo sapiens
ucccaguggcugcugcccag

SEQ ID NO: 2028110 - RNA, 17 nt, Homo sapiens
uggccauuaccaucucu

SEQ ID NO: 2028111 - RNA, 21 nt, Homo sapiens
cucuuccccaucucacucuua

SEQ ID NO: 2028112 - RNA, 14 nt, Homo sapiens
aaggaauccacucc

SEQ ID NO: 2028113 - RNA, 20 nt, Homo sapiens
ucacgucgucuucuguauac

SEQ ID NO: 2028114 - RNA, 21 nt, Homo sapiens
gggcggcaggaccagccagca

SEQ ID NO: 2028115 - RNA, 23 nt, Homo sapiens
cucagcuucuucacaggcacucc

SEQ ID NO: 2028116 - RNA, 22 nt, Homo sapiens
uuauugaaagagucugggaccc

SEQ ID NO: 2028117 - RNA, 20 nt, Homo sapiens
agcaggcgccaagugcuaug

SEQ ID NO: 2028118 - RNA, 19 nt, Homo sapiens
cuggcagagagcacaguga

SEQ ID NO: 2028119 - RNA, 14 nt, Homo sapiens
agccagcacuugua

SEQ ID NO: 2028120 - RNA, 19 nt, Homo sapiens
ccagcagccccacaccagg

SEQ ID NO: 2028121 - RNA, 18 nt, Homo sapiens
ccuucgccucccaggaga

SEQ ID NO: 2028122 - RNA, 21 nt, Homo sapiens
ccuguaaggcaggcccauuca

SEQ ID NO: 2028123 - RNA, 18 nt, Homo sapiens
ggaaaaggcuuacuugcc

SEQ ID NO: 2028124 - RNA, 14 nt, Homo sapiens
acucuacagacucc

SEQ ID NO: 2028125 - RNA, 16 nt, Homo sapiens
gacauguggggccagg

SEQ ID NO: 2028126 - RNA, 13 nt, Homo sapiens
aaauagauccaau

SEQ ID NO: 2028127 - RNA, 20 nt, Homo sapiens
acugaagggcuuuggcuuua

SEQ ID NO: 2028128 - RNA, 21 nt, Homo sapiens
auuuccuuuccagucauuuca

SEQ ID NO: 2028129 - RNA, 21 nt, Homo sapiens
ccuagcuaccuucucuaccca

SEQ ID NO: 2028130 - RNA, 15 nt, Homo sapiens
uucauauucaugcaa

SEQ ID NO: 2028131 - RNA, 13 nt, Homo sapiens
ccuucucagggac

SEQ ID NO: 2028132 - RNA, 12 nt, Homo sapiens
acacuaccccau

SEQ ID NO: 2028133 - RNA, 19 nt, Homo sapiens
cccaaacuggagugcagug

SEQ ID NO: 2028134 - RNA, 17 nt, Homo sapiens
aucuccucagacaguaa

SEQ ID NO: 2028135 - RNA, 23 nt, Homo sapiens
aauugcccuguugccuugagcuc

SEQ ID NO: 2028136 - RNA, 23 nt, Homo sapiens
ccccuccagcaaauaaagcauga

SEQ ID NO: 2028137 - RNA, 18 nt, Homo sapiens
agcaagccgagcucuccu

SEQ ID NO: 2028138 - RNA, 17 nt, Homo sapiens
gacaaccaccagguguc

SEQ ID NO: 2028139 - RNA, 20 nt, Homo sapiens
aaacagauauuacagcuuau

SEQ ID NO: 2028140 - RNA, 22 nt, Homo sapiens
ucccagcccugcccagaguaug

SEQ ID NO: 2028141 - RNA, 16 nt, Homo sapiens
acugccucuccagcac

SEQ ID NO: 2028142 - RNA, 22 nt, Homo sapiens
cauuugagcucuggaagccucu

SEQ ID NO: 2028143 - RNA, 20 nt, Homo sapiens
cuacuagaaaauaccaaaug

SEQ ID NO: 2028144 - RNA, 15 nt, Homo sapiens
gcagacggaaggagg

SEQ ID NO: 2028145 - RNA, 11 nt, Homo sapiens
guggguggugg

SEQ ID NO: 2028146 - RNA, 18 nt, Homo sapiens
caccagggcaacucuugg

SEQ ID NO: 2028147 - RNA, 21 nt, Homo sapiens
uuauguguaguugucucucuu

SEQ ID NO: 2028148 - RNA, 24 nt, Homo sapiens
ucacuggccccuacuuuguggcaa

SEQ ID NO: 2028149 - RNA, 15 nt, Homo sapiens
ggaaaggugcucaaa

SEQ ID NO: 2028150 - RNA, 18 nt, Homo sapiens
uggacaaaaugacuugaa

SEQ ID NO: 2028151 - RNA, 15 nt, Homo sapiens
cuugcaaagauuucu

SEQ ID NO: 2028152 - RNA, 19 nt, Homo sapiens
ugucuucguacaguucuuc

SEQ ID NO: 2028153 - RNA, 13 nt, Homo sapiens
caguauuccaugg

SEQ ID NO: 2028154 - RNA, 15 nt, Homo sapiens
ccagaggcaguaacc

SEQ ID NO: 2028155 - RNA, 16 nt, Homo sapiens
auauaaagaaauaccu

SEQ ID NO: 2028156 - RNA, 14 nt, Homo sapiens
gcaauuacugcugu

SEQ ID NO: 2028157 - RNA, 18 nt, Homo sapiens
cuggggccccaucuugau

SEQ ID NO: 2028158 - RNA, 14 nt, Homo sapiens
cccaaaacagcuuu

SEQ ID NO: 2028159 - RNA, 18 nt, Homo sapiens
aaguuccaguguucucuc

SEQ ID NO: 2028160 - RNA, 20 nt, Homo sapiens
cccugguggcuucagcaguc

SEQ ID NO: 2028161 - RNA, 19 nt, Homo sapiens
uggucugccucugagccac

SEQ ID NO: 2028162 - RNA, 14 nt, Homo sapiens
aggggcuggcuuca

SEQ ID NO: 2028163 - RNA, 15 nt, Homo sapiens
acaucacacaguaua

SEQ ID NO: 2028164 - RNA, 16 nt, Homo sapiens
acccaagcacaaacug

SEQ ID NO: 2028165 - RNA, 17 nt, Homo sapiens
agauggggcgagccagg

SEQ ID NO: 2028166 - RNA, 14 nt, Homo sapiens
aauucaaguuacca

SEQ ID NO: 2028167 - RNA, 16 nt, Homo sapiens
gucuguggcacauucu

SEQ ID NO: 2028168 - RNA, 20 nt, Homo sapiens
ucuuacuacuuuaaauccua

SEQ ID NO: 2028169 - RNA, 17 nt, Homo sapiens
ugugugacaccaccacu

SEQ ID NO: 2028170 - RNA, 22 nt, Homo sapiens
cuuagacuaguugaacaucuca

SEQ ID NO: 2028171 - RNA, 14 nt, Homo sapiens
cauuguugucaagg

SEQ ID NO: 2028172 - RNA, 22 nt, Homo sapiens
aauaugccuagcacaaguacca

SEQ ID NO: 2028173 - RNA, 16 nt, Homo sapiens
gaacuuucaccuucau

SEQ ID NO: 2028174 - RNA, 20 nt, Homo sapiens
aucagccuccgccauuccaa

SEQ ID NO: 2028175 - RNA, 19 nt, Homo sapiens
caugaaaauuuuaaaaaua

SEQ ID NO: 2028176 - RNA, 16 nt, Homo sapiens
gcccacucugaccggg

SEQ ID NO: 2028177 - RNA, 18 nt, Homo sapiens
acuuagucuguacuucau

SEQ ID NO: 2028178 - RNA, 18 nt, Homo sapiens
guucccacugaaauggac

SEQ ID NO: 2028179 - RNA, 23 nt, Homo sapiens
augucugauuuaacacuauccaa

SEQ ID NO: 2028180 - RNA, 22 nt, Homo sapiens
auuugaccggaucuacacccac

SEQ ID NO: 2028181 - RNA, 19 nt, Homo sapiens
ucgcucagucagugcacua

SEQ ID NO: 2028182 - RNA, 12 nt, Homo sapiens
aaggacagggcu

SEQ ID NO: 2028183 - RNA, 22 nt, Homo sapiens
uaacacauagcgccgugcugua

SEQ ID NO: 2028184 - RNA, 19 nt, Homo sapiens
agaaaagcaguuugcacuu

SEQ ID NO: 2028185 - RNA, 23 nt, Homo sapiens
cgagacgccuuugugagcuguga

SEQ ID NO: 2028186 - RNA, 18 nt, Homo sapiens
gccuacuuaagagugcug

SEQ ID NO: 2028187 - RNA, 16 nt, Homo sapiens
gccagagcugugccug

SEQ ID NO: 2028188 - RNA, 15 nt, Homo sapiens
agggcucaaggguga

SEQ ID NO: 2028189 - RNA, 21 nt, Homo sapiens
uggcuuuccaggagacauaua

SEQ ID NO: 2028190 - RNA, 16 nt, Homo sapiens
agcuaaacaugcugcc

SEQ ID NO: 2028191 - RNA, 18 nt, Homo sapiens
uuauuuauccuugucuga

SEQ ID NO: 2028192 - RNA, 13 nt, Homo sapiens
ugcccugggccag

SEQ ID NO: 2028193 - RNA, 22 nt, Homo sapiens
uuuauugagguauaauucaccc

SEQ ID NO: 2028194 - RNA, 17 nt, Homo sapiens
auauucacuaaggacuu

SEQ ID NO: 2028195 - RNA, 17 nt, Homo sapiens
aguaguugacagugcua

SEQ ID NO: 2028196 - RNA, 20 nt, Homo sapiens
auaaugguuuuuaacaccuu

SEQ ID NO: 2028197 - RNA, 18 nt, Homo sapiens
ccuagccaaugucuccuc

SEQ ID NO: 2028198 - RNA, 15 nt, Homo sapiens
acgaucuuccuggcu

SEQ ID NO: 2028199 - RNA, 15 nt, Homo sapiens
agcagaacugaaccg

SEQ ID NO: 2028200 - RNA, 17 nt, Homo sapiens
uguugcuuuguugcacu

SEQ ID NO: 2028201 - RNA, 23 nt, Homo sapiens
gccccucccucccagagcaccug

SEQ ID NO: 2028202 - RNA, 16 nt, Homo sapiens
cucccugaagccuuug

SEQ ID NO: 2028203 - RNA, 18 nt, Homo sapiens
gugcaugagaaugucauu

SEQ ID NO: 2028204 - RNA, 14 nt, Homo sapiens
ugggucaguuguau

SEQ ID NO: 2028205 - RNA, 20 nt, Homo sapiens
uguguucacuacauugugca

SEQ ID NO: 2028206 - RNA, 22 nt, Homo sapiens
ucagauguggcaauucagggcg

SEQ ID NO: 2028207 - RNA, 14 nt, Homo sapiens
gaaggcucugggau

SEQ ID NO: 2028208 - RNA, 18 nt, Homo sapiens
ugaucaaaggcacacagc

SEQ ID NO: 2028209 - RNA, 13 nt, Homo sapiens
ugaaacacuuugc

SEQ ID NO: 2028210 - RNA, 12 nt, Homo sapiens
uuuuggcuuuau

SEQ ID NO: 2028211 - RNA, 18 nt, Homo sapiens
agaagacucgucuuggca

SEQ ID NO: 2028212 - RNA, 20 nt, Homo sapiens
cacagucacugauguacaau

SEQ ID NO: 2028213 - RNA, 13 nt, Homo sapiens
acaucuuaccucu

SEQ ID NO: 2028214 - RNA, 15 nt, Homo sapiens
augaggccaucucag

SEQ ID NO: 2028215 - RNA, 20 nt, Homo sapiens
aagguuuuagacccauagca

SEQ ID NO: 2028216 - RNA, 22 nt, Homo sapiens
agugcaguggcgcgaucucagc

SEQ ID NO: 2028217 - RNA, 23 nt, Homo sapiens
uagaaguuuggcugcugucauaa

SEQ ID NO: 2028218 - RNA, 12 nt, Homo sapiens
ugguugcaauug

SEQ ID NO: 2028219 - RNA, 20 nt, Homo sapiens
ucacaagaauuuaaaacgca

SEQ ID NO: 2028220 - RNA, 19 nt, Homo sapiens
ugagccacagucacuggau

SEQ ID NO: 2028221 - RNA, 16 nt, Homo sapiens
cugaaauuccaguuua

SEQ ID NO: 2028222 - RNA, 15 nt, Homo sapiens
acuuuggacuaaaga

SEQ ID NO: 2028223 - RNA, 15 nt, Homo sapiens
acaaagaauuaucca

SEQ ID NO: 2028224 - RNA, 22 nt, Homo sapiens
ugggaucguccuggauucacug

SEQ ID NO: 2028225 - RNA, 18 nt, Homo sapiens
ggaacuagccaccaacuc

SEQ ID NO: 2028226 - RNA, 21 nt, Homo sapiens
uugcaaauaccuccucccuaa

SEQ ID NO: 2028227 - RNA, 22 nt, Homo sapiens
augucucuacccacuaugcaca

SEQ ID NO: 2028228 - RNA, 16 nt, Homo sapiens
ucuguguagaaacugg

SEQ ID NO: 2028229 - RNA, 17 nt, Homo sapiens
acaaaccuugugcucuu

SEQ ID NO: 2028230 - RNA, 23 nt, Homo sapiens
aucaguaucagaauacuugcacu

SEQ ID NO: 2028231 - RNA, 19 nt, Homo sapiens
gcacuacauaaacugacuu

SEQ ID NO: 2028232 - RNA, 15 nt, Homo sapiens
gucugggcucagaca

SEQ ID NO: 2028233 - RNA, 17 nt, Homo sapiens
uaaacaaauaacaaugu

SEQ ID NO: 2028234 - RNA, 22 nt, Homo sapiens
cucuugggaaacggaaugaccu

SEQ ID NO: 2028235 - RNA, 12 nt, Homo sapiens
acgcaugugcag

SEQ ID NO: 2028236 - RNA, 12 nt, Homo sapiens
gaacauguaagg

SEQ ID NO: 2028237 - RNA, 17 nt, Homo sapiens
cccugccccucuggcca

SEQ ID NO: 2028238 - RNA, 24 nt, Homo sapiens
ccuuguccuugaaaguaggauaua

SEQ ID NO: 2028239 - RNA, 12 nt, Homo sapiens
aaugaccccaga

SEQ ID NO: 2028240 - RNA, 21 nt, Homo sapiens
aaugugguacauacacaccag

SEQ ID NO: 2028241 - RNA, 20 nt, Homo sapiens
accacugugcucaaccagac

SEQ ID NO: 2028242 - RNA, 18 nt, Homo sapiens
uauuuuuuuaagcuguaa

SEQ ID NO: 2028243 - RNA, 24 nt, Homo sapiens
agagggaugggagagucaagggaa

SEQ ID NO: 2028244 - RNA, 18 nt, Homo sapiens
ggcgacugugaaacugga

SEQ ID NO: 2028245 - RNA, 18 nt, Homo sapiens
gacaugcuucagugcugc

SEQ ID NO: 2028246 - RNA, 15 nt, Homo sapiens
cuugacuaucacaua

SEQ ID NO: 2028247 - RNA, 18 nt, Homo sapiens
aagcaugaaacauuucag

SEQ ID NO: 2028248 - RNA, 17 nt, Homo sapiens
cagcccuuccuugggga

SEQ ID NO: 2028249 - RNA, 18 nt, Homo sapiens
caucacuuaacugauguu

SEQ ID NO: 2028250 - RNA, 17 nt, Homo sapiens
caaaaauugacuuagau

SEQ ID NO: 2028251 - RNA, 21 nt, Homo sapiens
augcugcuuuaggaauucugc

SEQ ID NO: 2028252 - RNA, 20 nt, Homo sapiens
cuugccaagcagugcacauu

SEQ ID NO: 2028253 - RNA, 17 nt, Homo sapiens
gggaucucaggggcugu

SEQ ID NO: 2028254 - RNA, 18 nt, Homo sapiens
aauguacuacugagcuuc

SEQ ID NO: 2028255 - RNA, 19 nt, Homo sapiens
cuccuagccccuucuucca

SEQ ID NO: 2028256 - RNA, 18 nt, Homo sapiens
cuaaaagugggcuugauu

SEQ ID NO: 2028257 - RNA, 15 nt, Homo sapiens
gugcaguuuucagga

SEQ ID NO: 2028258 - RNA, 20 nt, Homo sapiens
agccucuggccgucacacgu

SEQ ID NO: 2028259 - RNA, 14 nt, Homo sapiens
uaagcugauuugau

SEQ ID NO: 2028260 - RNA, 13 nt, Homo sapiens
ugugucuguacac

SEQ ID NO: 2028261 - RNA, 17 nt, Homo sapiens
aaacuacccuccagagu

SEQ ID NO: 2028262 - RNA, 17 nt, Homo sapiens
cuguguccaucagugac

SEQ ID NO: 2028263 - RNA, 21 nt, Homo sapiens
aguggcgugaucuuggcucac

SEQ ID NO: 2028264 - RNA, 18 nt, Homo sapiens
cugaguauaaauuuacuu

SEQ ID NO: 2028265 - RNA, 17 nt, Homo sapiens
cagaguuguacacugug

SEQ ID NO: 2028266 - RNA, 14 nt, Homo sapiens
guucccugugucau

SEQ ID NO: 2028267 - RNA, 18 nt, Homo sapiens
aaauuguuguaauugcau

SEQ ID NO: 2028268 - RNA, 16 nt, Homo sapiens
gcacccaggcuccaug

SEQ ID NO: 2028269 - RNA, 18 nt, Homo sapiens
caaagcuaggaugguucu

SEQ ID NO: 2028270 - RNA, 18 nt, Homo sapiens
ccaaaucucaacuucuca

SEQ ID NO: 2028271 - RNA, 24 nt, Homo sapiens
cagagccacagggucugccuccag

SEQ ID NO: 2028272 - RNA, 17 nt, Homo sapiens
agugacaaggcccugag

SEQ ID NO: 2028273 - RNA, 18 nt, Homo sapiens
acucagccacccugaguu

SEQ ID NO: 2028274 - RNA, 14 nt, Homo sapiens
ucuccccuccagag

SEQ ID NO: 2028275 - RNA, 23 nt, Homo sapiens
ugucaggugugauaaaauguuga

SEQ ID NO: 2028276 - RNA, 20 nt, Homo sapiens
ugucagcuacuaaugauguu

SEQ ID NO: 2028277 - RNA, 14 nt, Homo sapiens
uauaaauauacaua

SEQ ID NO: 2028278 - RNA, 13 nt, Homo sapiens
augguggguacaa

SEQ ID NO: 2028279 - RNA, 16 nt, Homo sapiens
uuagucuucaguaugc

SEQ ID NO: 2028280 - RNA, 17 nt, Homo sapiens
aaaagaaugugcuauga

SEQ ID NO: 2028281 - RNA, 14 nt, Homo sapiens
ggcgccuucucgga

SEQ ID NO: 2028282 - RNA, 22 nt, Homo sapiens
caaaaggaacucuagaagacca

SEQ ID NO: 2028283 - RNA, 16 nt, Homo sapiens
cauccaguaucuugaa

SEQ ID NO: 2028284 - RNA, 14 nt, Homo sapiens
gacagagucucacu

SEQ ID NO: 2028285 - RNA, 17 nt, Homo sapiens
caaagauccccaaaaca

SEQ ID NO: 2028286 - RNA, 14 nt, Homo sapiens
ugcugcucucucaa

SEQ ID NO: 2028287 - RNA, 18 nt, Homo sapiens
acaccuuaauaugcugca

SEQ ID NO: 2028288 - RNA, 18 nt, Homo sapiens
cauauauuggcacugcua

SEQ ID NO: 2028289 - RNA, 16 nt, Homo sapiens
gcugaaagaggccaaa

SEQ ID NO: 2028290 - RNA, 20 nt, Homo sapiens
uggaggcugucuucucaggc

SEQ ID NO: 2028291 - RNA, 14 nt, Homo sapiens
caagcuagaaggcc

SEQ ID NO: 2028292 - RNA, 16 nt, Homo sapiens
agcccgccgucagggu

SEQ ID NO: 2028293 - RNA, 16 nt, Homo sapiens
accuuucuaaaccucu

SEQ ID NO: 2028294 - RNA, 12 nt, Homo sapiens
acaguaucacug

SEQ ID NO: 2028295 - RNA, 15 nt, Homo sapiens
cuagucaccagagac

SEQ ID NO: 2028296 - RNA, 22 nt, Homo sapiens
uucucacuuuccuuuucuuguc

SEQ ID NO: 2028297 - RNA, 12 nt, Homo sapiens
cucaaucaugaa

SEQ ID NO: 2028298 - RNA, 17 nt, Homo sapiens
uauuuucucauugcucu

SEQ ID NO: 2028299 - RNA, 21 nt, Homo sapiens
gcacauguguaagacacugug

SEQ ID NO: 2028300 - RNA, 19 nt, Homo sapiens
uguuaauuuuuugguacaa

SEQ ID NO: 2028301 - RNA, 15 nt, Homo sapiens
aguccaggguggaug

SEQ ID NO: 2028302 - RNA, 22 nt, Homo sapiens
ggcuacaauuuucucccaggaa

SEQ ID NO: 2028303 - RNA, 20 nt, Homo sapiens
cacauaauuuugugcaugaa

SEQ ID NO: 2028304 - RNA, 13 nt, Homo sapiens
agccaccaagaca

SEQ ID NO: 2028305 - RNA, 15 nt, Homo sapiens
uuaaauaguggguaa

SEQ ID NO: 2028306 - RNA, 19 nt, Homo sapiens
gucccucccaccucuguga

SEQ ID NO: 2028307 - RNA, 16 nt, Homo sapiens
ucuccguggcacuugu

SEQ ID NO: 2028308 - RNA, 16 nt, Homo sapiens
cuacguuauacugaaa

SEQ ID NO: 2028309 - RNA, 14 nt, Homo sapiens
gaaaugucugccau

SEQ ID NO: 2028310 - RNA, 18 nt, Homo sapiens
cuugcacccgcaagucaa

SEQ ID NO: 2028311 - RNA, 20 nt, Homo sapiens
aggacacagcacaagggcac

SEQ ID NO: 2028312 - RNA, 15 nt, Homo sapiens
cuuuaagcugugaug

SEQ ID NO: 2028313 - RNA, 22 nt, Homo sapiens
aggguauaaauuauauccguga

SEQ ID NO: 2028314 - RNA, 19 nt, Homo sapiens
uagcggugaagaguacaga

SEQ ID NO: 2028315 - RNA, 13 nt, Homo sapiens
auagccacuuuua

SEQ ID NO: 2028316 - RNA, 15 nt, Homo sapiens
gcccaggcuggaaug

SEQ ID NO: 2028317 - RNA, 15 nt, Homo sapiens
uggcacguaagcucc

SEQ ID NO: 2028318 - RNA, 20 nt, Homo sapiens
uugauauuuauuuuuugcca

SEQ ID NO: 2028319 - RNA, 14 nt, Homo sapiens
aggaaaagugcaag

SEQ ID NO: 2028320 - RNA, 12 nt, Homo sapiens
ccaggccaguga

SEQ ID NO: 2028321 - RNA, 18 nt, Homo sapiens
aaggcugagaacacugug

SEQ ID NO: 2028322 - RNA, 15 nt, Homo sapiens
gcugggcuucagugg

SEQ ID NO: 2028323 - RNA, 19 nt, Homo sapiens
uucagccaaaacauaccau

SEQ ID NO: 2028324 - RNA, 16 nt, Homo sapiens
uggagaugaggugcuc

SEQ ID NO: 2028325 - RNA, 15 nt, Homo sapiens
uuuuaagcugcaaau

SEQ ID NO: 2028326 - RNA, 17 nt, Homo sapiens
aaacugaaagcuuuaau

SEQ ID NO: 2028327 - RNA, 19 nt, Homo sapiens
acaaacuucuuucacucac

SEQ ID NO: 2028328 - RNA, 19 nt, Homo sapiens
gggcugcaaugcagcaugu

SEQ ID NO: 2028329 - RNA, 22 nt, Homo sapiens
ucaugaguggauggauggacag

SEQ ID NO: 2028330 - RNA, 14 nt, Homo sapiens
gguuaaggggucca

SEQ ID NO: 2028331 - RNA, 18 nt, Homo sapiens
aacuuaaaaaaagcacau

SEQ ID NO: 2028332 - RNA, 16 nt, Homo sapiens
auaagaugaaucacuu

SEQ ID NO: 2028333 - RNA, 15 nt, Homo sapiens
uguucaccuucaaaa

SEQ ID NO: 2028334 - RNA, 14 nt, Homo sapiens
auagucucucucuu

SEQ ID NO: 2028335 - RNA, 13 nt, Homo sapiens
aaaaucccuuaau

SEQ ID NO: 2028336 - RNA, 17 nt, Homo sapiens
ugggcgaggccugacac

SEQ ID NO: 2028337 - RNA, 15 nt, Homo sapiens
cuucuucuuccaaau

SEQ ID NO: 2028338 - RNA, 14 nt, Homo sapiens
aggaggaucacuug

SEQ ID NO: 2028339 - RNA, 16 nt, Homo sapiens
uuacacggagugugcu

SEQ ID NO: 2028340 - RNA, 12 nt, Homo sapiens
aauccucucuau

SEQ ID NO: 2028341 - RNA, 19 nt, Homo sapiens
caauacuuacauaucugac

SEQ ID NO: 2028342 - RNA, 17 nt, Homo sapiens
aggagaggaugcacagu

SEQ ID NO: 2028343 - RNA, 17 nt, Homo sapiens
ggaguucaggaacccuu

SEQ ID NO: 2028344 - RNA, 14 nt, Homo sapiens
gcccaggccaugug

SEQ ID NO: 2028345 - RNA, 14 nt, Homo sapiens
gucggugccuucaa

SEQ ID NO: 2028346 - RNA, 12 nt, Homo sapiens
ugcucucuucag

SEQ ID NO: 2028347 - RNA, 20 nt, Homo sapiens
ucaucuauaaagaagaacuu

SEQ ID NO: 2028348 - RNA, 20 nt, Homo sapiens
gacaauaaaacauuccugug

SEQ ID NO: 2028349 - RNA, 19 nt, Homo sapiens
auauuguagcucaauacaa

SEQ ID NO: 2028350 - RNA, 20 nt, Homo sapiens
gugcccccagacgcacgugg

SEQ ID NO: 2028351 - RNA, 20 nt, Homo sapiens
ggcagcugcuggcugugaca

SEQ ID NO: 2028352 - RNA, 20 nt, Homo sapiens
cacuuucaggaacacucuga

SEQ ID NO: 2028353 - RNA, 22 nt, Homo sapiens
cuaagcaguaagcuaucuucaa

SEQ ID NO: 2028354 - RNA, 19 nt, Homo sapiens
auaagcagaagcacauaug

SEQ ID NO: 2028355 - RNA, 17 nt, Homo sapiens
aauaagugcuuuccuua

SEQ ID NO: 2028356 - RNA, 23 nt, Homo sapiens
guagacaugcacacccauucaca

SEQ ID NO: 2028357 - RNA, 18 nt, Homo sapiens
aucauuugaguucaggag

SEQ ID NO: 2028358 - RNA, 16 nt, Homo sapiens
uguaacuaugcuguua

SEQ ID NO: 2028359 - RNA, 17 nt, Homo sapiens
guuauuauauaauuaca

SEQ ID NO: 2028360 - RNA, 16 nt, Homo sapiens
cuccuugaagguucuc

SEQ ID NO: 2028361 - RNA, 13 nt, Homo sapiens
gaggagcuucccc

SEQ ID NO: 2028362 - RNA, 18 nt, Homo sapiens
ucacauucgaguguuuca

SEQ ID NO: 2028363 - RNA, 15 nt, Homo sapiens
acauuugcuacuguu

SEQ ID NO: 2028364 - RNA, 20 nt, Homo sapiens
cacuuauacccaugaacuua

SEQ ID NO: 2028365 - RNA, 18 nt, Homo sapiens
ucaagccugugcaaaaaa

SEQ ID NO: 2028366 - RNA, 21 nt, Homo sapiens
ccaugggguccuaccaauaga

SEQ ID NO: 2028367 - RNA, 15 nt, Homo sapiens
ccagaaaaguggcuc

SEQ ID NO: 2028368 - RNA, 21 nt, Homo sapiens
gcagugucuguaaaagagccu

SEQ ID NO: 2028369 - RNA, 16 nt, Homo sapiens
cgaugcugcuauggaa

SEQ ID NO: 2028370 - RNA, 16 nt, Homo sapiens
ugcaauccaaugcacu

SEQ ID NO: 2028371 - RNA, 22 nt, Homo sapiens
gaagucucugauuaguugacag

SEQ ID NO: 2028372 - RNA, 20 nt, Homo sapiens
uaaguugcuaggaacaugug

SEQ ID NO: 2028373 - RNA, 17 nt, Homo sapiens
uuguuggaaaguaacug

SEQ ID NO: 2028374 - RNA, 14 nt, Homo sapiens
augggaagcauuag

SEQ ID NO: 2028375 - RNA, 22 nt, Homo sapiens
cugaaauuauuuuuaaggauaa

SEQ ID NO: 2028376 - RNA, 22 nt, Homo sapiens
ggaugauuucaucuucuggaau

SEQ ID NO: 2028377 - RNA, 22 nt, Homo sapiens
cccauuuuuccuuuugccgacc

SEQ ID NO: 2028378 - RNA, 13 nt, Homo sapiens
cguuccuauuguc

SEQ ID NO: 2028379 - RNA, 19 nt, Homo sapiens
cucccgaguagcugagauu

SEQ ID NO: 2028380 - RNA, 14 nt, Homo sapiens
ugagcgaucauuua

SEQ ID NO: 2028381 - RNA, 17 nt, Homo sapiens
cuauauugcacugugac

SEQ ID NO: 2028382 - RNA, 21 nt, Homo sapiens
cuuaaauuugauuuacauaua

SEQ ID NO: 2028383 - RNA, 15 nt, Homo sapiens
accugccuucucacu

SEQ ID NO: 2028384 - RNA, 18 nt, Homo sapiens
auggcaucauuauaagcu

SEQ ID NO: 2028385 - RNA, 17 nt, Homo sapiens
gaaauacguccuuccac

SEQ ID NO: 2028386 - RNA, 20 nt, Homo sapiens
caggagucugccacuuguca

SEQ ID NO: 2028387 - RNA, 17 nt, Homo sapiens
ggaaaaggggcuccuug

SEQ ID NO: 2028388 - RNA, 22 nt, Homo sapiens
uagcuuuaauuaagcucucaua

SEQ ID NO: 2028389 - RNA, 18 nt, Homo sapiens
cuugcugacaacuuccag

SEQ ID NO: 2028390 - RNA, 19 nt, Homo sapiens
gucacugcucuggacugug

SEQ ID NO: 2028391 - RNA, 18 nt, Homo sapiens
auauugaaagguagcaau

SEQ ID NO: 2028392 - RNA, 20 nt, Homo sapiens
augaccuggcaacaaaaagu

SEQ ID NO: 2028393 - RNA, 20 nt, Homo sapiens
gcaaacaaauaaaaugaaau

SEQ ID NO: 2028394 - RNA, 13 nt, Homo sapiens
uucccaugacugc

SEQ ID NO: 2028395 - RNA, 17 nt, Homo sapiens
uacucuaccaugguucu

SEQ ID NO: 2028396 - RNA, 16 nt, Homo sapiens
acucuuagccccagac

SEQ ID NO: 2028397 - RNA, 23 nt, Homo sapiens
ugaguuuucacucuucuaaugca

SEQ ID NO: 2028398 - RNA, 18 nt, Homo sapiens
cuccaagcucacgaccuu

SEQ ID NO: 2028399 - RNA, 15 nt, Homo sapiens
caaacaugaagugug

SEQ ID NO: 2028400 - RNA, 12 nt, Homo sapiens
cccuccaugucu

SEQ ID NO: 2028401 - RNA, 16 nt, Homo sapiens
aaguuuaauugacuua

SEQ ID NO: 2028402 - RNA, 22 nt, Homo sapiens
uaaaaaauguuaugcaggcuua

SEQ ID NO: 2028403 - RNA, 11 nt, Homo sapiens
ggaaguacugc

SEQ ID NO: 2028404 - RNA, 19 nt, Homo sapiens
gccuccucuacaauuugcc

SEQ ID NO: 2028405 - RNA, 19 nt, Homo sapiens
gauuccuuuguaucagggu

SEQ ID NO: 2028406 - RNA, 17 nt, Homo sapiens
uucacauccccaaaggu

SEQ ID NO: 2028407 - RNA, 12 nt, Homo sapiens
ccaacugaccac

SEQ ID NO: 2028408 - RNA, 14 nt, Homo sapiens
cacuaaacuuuauu

SEQ ID NO: 2028409 - RNA, 12 nt, Homo sapiens
agaacaaaaacu

SEQ ID NO: 2028410 - RNA, 22 nt, Homo sapiens
cucaucuaaaagaaaaaggcau

SEQ ID NO: 2028411 - RNA, 18 nt, Homo sapiens
aaguuucccuuccuccau

SEQ ID NO: 2028412 - RNA, 19 nt, Homo sapiens
acaagacugccauauuaaa

SEQ ID NO: 2028413 - RNA, 22 nt, Homo sapiens
ucaugcaagacuucacugcagc

SEQ ID NO: 2028414 - RNA, 19 nt, Homo sapiens
aucucuuaugggauuacau

SEQ ID NO: 2028415 - RNA, 20 nt, Homo sapiens
cugaggcauuuuuacuacua

SEQ ID NO: 2028416 - RNA, 21 nt, Homo sapiens
ccaguacguacauauuuuaau

SEQ ID NO: 2028417 - RNA, 15 nt, Homo sapiens
uucuuuaaccaaaca

SEQ ID NO: 2028418 - RNA, 20 nt, Homo sapiens
uagagcuagaugugucuuac

SEQ ID NO: 2028419 - RNA, 14 nt, Homo sapiens
caagaucaacauuc

SEQ ID NO: 2028420 - RNA, 16 nt, Homo sapiens
accucuccucuuuuca

SEQ ID NO: 2028421 - RNA, 14 nt, Homo sapiens
accgcauccuccag

SEQ ID NO: 2028422 - RNA, 15 nt, Homo sapiens
aaggaaaaaugcugc

SEQ ID NO: 2028423 - RNA, 15 nt, Homo sapiens
agcugcacugaccuc

SEQ ID NO: 2028424 - RNA, 20 nt, Homo sapiens
uacguggagggguuuagcca

SEQ ID NO: 2028425 - RNA, 14 nt, Homo sapiens
cccaucagugcucu

SEQ ID NO: 2028426 - RNA, 21 nt, Homo sapiens
auagccuaauacaacauguag

SEQ ID NO: 2028427 - RNA, 15 nt, Homo sapiens
accugucuccacugu

SEQ ID NO: 2028428 - RNA, 22 nt, Homo sapiens
caggcuggagugaucucagcuc

SEQ ID NO: 2028429 - RNA, 20 nt, Homo sapiens
ucuuagcacaccuacaccuc

SEQ ID NO: 2028430 - RNA, 19 nt, Homo sapiens
caugcaucuuccacuggaa

SEQ ID NO: 2028431 - RNA, 18 nt, Homo sapiens
aauaauucuuaacagugg

SEQ ID NO: 2028432 - RNA, 15 nt, Homo sapiens
accaaccacagcauc

SEQ ID NO: 2028433 - RNA, 16 nt, Homo sapiens
aaagucauuuaaugua

SEQ ID NO: 2028434 - RNA, 14 nt, Homo sapiens
aucagcacugaaaa

SEQ ID NO: 2028435 - RNA, 21 nt, Homo sapiens
cagaucuuagggaugauuaaa

SEQ ID NO: 2028436 - RNA, 22 nt, Homo sapiens
uuuuuccccugcuccccugaga

SEQ ID NO: 2028437 - RNA, 15 nt, Homo sapiens
cugaguucacucucc

SEQ ID NO: 2028438 - RNA, 13 nt, Homo sapiens
aaaaucuuguaca

SEQ ID NO: 2028439 - RNA, 19 nt, Homo sapiens
acgaggagcuuccagugca

SEQ ID NO: 2028440 - RNA, 15 nt, Homo sapiens
aacauaauacauuaa

SEQ ID NO: 2028441 - RNA, 17 nt, Homo sapiens
gcacugcccaucaguga

SEQ ID NO: 2028442 - RNA, 15 nt, Homo sapiens
gaaccagcaaugaga

SEQ ID NO: 2028443 - RNA, 16 nt, Homo sapiens
acaaaccgagugcaau

SEQ ID NO: 2028444 - RNA, 13 nt, Homo sapiens
aaggagccagcuc

SEQ ID NO: 2028445 - RNA, 16 nt, Homo sapiens
ccugaccugagccaga

SEQ ID NO: 2028446 - RNA, 20 nt, Homo sapiens
auaaagaauuaacagagauu

SEQ ID NO: 2028447 - RNA, 13 nt, Homo sapiens
agaaaaaccaaug

SEQ ID NO: 2028448 - RNA, 20 nt, Homo sapiens
uaaguaguugguuuccuuca

SEQ ID NO: 2028449 - RNA, 17 nt, Homo sapiens
cacugugcuuacaguga

SEQ ID NO: 2028450 - RNA, 17 nt, Homo sapiens
agaauauuauuaugugc

SEQ ID NO: 2028451 - RNA, 14 nt, Homo sapiens
aaugcucaaugugc

SEQ ID NO: 2028452 - RNA, 20 nt, Homo sapiens
agaagccugaugcugacauu

SEQ ID NO: 2028453 - RNA, 16 nt, Homo sapiens
ugagaagcugcucaac

SEQ ID NO: 2028454 - RNA, 22 nt, Homo sapiens
ugguccugugccccgaccccac

SEQ ID NO: 2028455 - RNA, 17 nt, Homo sapiens
uggucuccucccaaaau

SEQ ID NO: 2028456 - RNA, 14 nt, Homo sapiens
uuagguugcuucag

SEQ ID NO: 2028457 - RNA, 17 nt, Homo sapiens
acaaacagaauuuucca

SEQ ID NO: 2028458 - RNA, 20 nt, Homo sapiens
agauacuggacuaaguggaa

SEQ ID NO: 2028459 - RNA, 18 nt, Homo sapiens
cagaucuuccguggucag

SEQ ID NO: 2028460 - RNA, 17 nt, Homo sapiens
guuaggaaaauuucaca

SEQ ID NO: 2028461 - RNA, 15 nt, Homo sapiens
aagucuccuguauca

SEQ ID NO: 2028462 - RNA, 13 nt, Homo sapiens
uagcccagcacug

SEQ ID NO: 2028463 - RNA, 19 nt, Homo sapiens
aauucugauguuacugaga

SEQ ID NO: 2028464 - RNA, 17 nt, Homo sapiens
aaugaaaggagcagugg

SEQ ID NO: 2028465 - RNA, 18 nt, Homo sapiens
ccucgacguuuacaagcc

SEQ ID NO: 2028466 - RNA, 13 nt, Homo sapiens
augccagcuauaa

SEQ ID NO: 2028467 - RNA, 19 nt, Homo sapiens
acuucuggaagucaucuca

SEQ ID NO: 2028468 - RNA, 19 nt, Homo sapiens
gacagggcaaacaacugaa

SEQ ID NO: 2028469 - RNA, 17 nt, Homo sapiens
gucauccucaugcugcu

SEQ ID NO: 2028470 - RNA, 15 nt, Homo sapiens
uuucauauugaucuu

SEQ ID NO: 2028471 - RNA, 22 nt, Homo sapiens
cauuauaucauuggaacaacug

SEQ ID NO: 2028472 - RNA, 18 nt, Homo sapiens
uaacauuuaaauuccaca

SEQ ID NO: 2028473 - RNA, 14 nt, Homo sapiens
cauggcuggcagag

SEQ ID NO: 2028474 - RNA, 14 nt, Homo sapiens
gaacgcugccucag

SEQ ID NO: 2028475 - RNA, 19 nt, Homo sapiens
uacuuacccucaccuguca

SEQ ID NO: 2028476 - RNA, 15 nt, Homo sapiens
auuucuucugcacaa

SEQ ID NO: 2028477 - RNA, 20 nt, Homo sapiens
cuaguguuucugcagaggca

SEQ ID NO: 2028478 - RNA, 18 nt, Homo sapiens
ucccaguaaagauaccau

SEQ ID NO: 2028479 - RNA, 21 nt, Homo sapiens
caaaccuaaaaauuuugugac

SEQ ID NO: 2028480 - RNA, 14 nt, Homo sapiens
ugcuugauuaaaca

SEQ ID NO: 2028481 - RNA, 14 nt, Homo sapiens
ugcagcucccagaa

SEQ ID NO: 2028482 - RNA, 18 nt, Homo sapiens
uauaaguaauacaggauu

SEQ ID NO: 2028483 - RNA, 19 nt, Homo sapiens
ccuucauuuuuaagacugu

SEQ ID NO: 2028484 - RNA, 17 nt, Homo sapiens
augagggaacuguguag

SEQ ID NO: 2028485 - RNA, 15 nt, Homo sapiens
cagagcauugugcaa

SEQ ID NO: 2028486 - RNA, 16 nt, Homo sapiens
aagguucccaagacaa

SEQ ID NO: 2028487 - RNA, 19 nt, Homo sapiens
uauucuaauaaaagcaucu

SEQ ID NO: 2028488 - RNA, 16 nt, Homo sapiens
gaucuuuggacagaag

SEQ ID NO: 2028489 - RNA, 17 nt, Homo sapiens
agcuguuuauggccuca

SEQ ID NO: 2028490 - RNA, 17 nt, Homo sapiens
ucuuuaaaauaaggaua

SEQ ID NO: 2028491 - RNA, 23 nt, Homo sapiens
uaaugccuuucaucuugaaguua

SEQ ID NO: 2028492 - RNA, 19 nt, Homo sapiens
agacugcaugacagucaca

SEQ ID NO: 2028493 - RNA, 18 nt, Homo sapiens
cuccaaagagaaaccuau

SEQ ID NO: 2028494 - RNA, 18 nt, Homo sapiens
cauuuaugaugcaguuuc

SEQ ID NO: 2028495 - RNA, 13 nt, Homo sapiens
cgccuggcacauu

SEQ ID NO: 2028496 - RNA, 22 nt, Homo sapiens
caucagugaauccugaaacugg

SEQ ID NO: 2028497 - RNA, 18 nt, Homo sapiens
ggcuguacgucugguguu

SEQ ID NO: 2028498 - RNA, 16 nt, Homo sapiens
ucuccuuugcacuguu

SEQ ID NO: 2028499 - RNA, 16 nt, Homo sapiens
gucccuccacauuucc

SEQ ID NO: 2028500 - RNA, 12 nt, Homo sapiens
cagaaagcacuc

SEQ ID NO: 2028501 - RNA, 17 nt, Homo sapiens
aaaaacugaaaauacuu

SEQ ID NO: 2028502 - RNA, 24 nt, Homo sapiens
gccggagccccuugggcaggucac

SEQ ID NO: 2028503 - RNA, 13 nt, Homo sapiens
ugcccaauuccag

SEQ ID NO: 2028504 - RNA, 22 nt, Homo sapiens
ccucaccacacccaggucucuu

SEQ ID NO: 2028505 - RNA, 11 nt, Homo sapiens
gaaggcagcug

SEQ ID NO: 2028506 - RNA, 15 nt, Homo sapiens
cauggagccugcuga

SEQ ID NO: 2028507 - RNA, 22 nt, Homo sapiens
ggcagugagugccaugcuuuuu

SEQ ID NO: 2028508 - RNA, 14 nt, Homo sapiens
accaaucauuuuaa

SEQ ID NO: 2028509 - RNA, 22 nt, Homo sapiens
aggucugauaguccucugcuaa

SEQ ID NO: 2028510 - RNA, 14 nt, Homo sapiens
uaaaaagugcuaua

SEQ ID NO: 2028511 - RNA, 14 nt, Homo sapiens
uaucaugugcacuu

SEQ ID NO: 2028512 - RNA, 17 nt, Homo sapiens
agaaaguuccaaauguu

SEQ ID NO: 2028513 - RNA, 16 nt, Homo sapiens
agggucucacuauauu

SEQ ID NO: 2028514 - RNA, 16 nt, Homo sapiens
gagauaggaaacugaa

SEQ ID NO: 2028515 - RNA, 17 nt, Homo sapiens
acuggucuccuugcuuc

SEQ ID NO: 2028516 - RNA, 15 nt, Homo sapiens
gcacagaggucagga

SEQ ID NO: 2028517 - RNA, 21 nt, Homo sapiens
aauggugaagaacuagcauau

SEQ ID NO: 2028518 - RNA, 15 nt, Homo sapiens
acaugugauugugau

SEQ ID NO: 2028519 - RNA, 13 nt, Homo sapiens
aaaacaggccagg

SEQ ID NO: 2028520 - RNA, 23 nt, Homo sapiens
uccaauuuuaauauuaacuuuua

SEQ ID NO: 2028521 - RNA, 23 nt, Homo sapiens
caaacccacccuuucuacuucca

SEQ ID NO: 2028522 - RNA, 14 nt, Homo sapiens
uauagcugugugaa

SEQ ID NO: 2028523 - RNA, 19 nt, Homo sapiens
auacagaauugugucugca

SEQ ID NO: 2028524 - RNA, 18 nt, Homo sapiens
gagauuuucaacauuuca

SEQ ID NO: 2028525 - RNA, 12 nt, Homo sapiens
ggaaaaaugucc

SEQ ID NO: 2028526 - RNA, 21 nt, Homo sapiens
cggaagucaucccagugcaca

SEQ ID NO: 2028527 - RNA, 19 nt, Homo sapiens
uauggcuucacauucauug

SEQ ID NO: 2028528 - RNA, 13 nt, Homo sapiens
cuuucacuuccca

SEQ ID NO: 2028529 - RNA, 13 nt, Homo sapiens
uccucacucuuca

SEQ ID NO: 2028530 - RNA, 20 nt, Homo sapiens
uguguggcaaugggauuugg

SEQ ID NO: 2028531 - RNA, 20 nt, Homo sapiens
cuuuguuuggauguaauuua

SEQ ID NO: 2028532 - RNA, 18 nt, Homo sapiens
caucucggggaccugcuu

SEQ ID NO: 2028533 - RNA, 17 nt, Homo sapiens
cggcaaccccaguucug

SEQ ID NO: 2028534 - RNA, 22 nt, Homo sapiens
accaauggcuccuugcccucaa

SEQ ID NO: 2028535 - RNA, 13 nt, Homo sapiens
aaaaaaauuacuu

SEQ ID NO: 2028536 - RNA, 16 nt, Homo sapiens
ucccugguucugauga

SEQ ID NO: 2028537 - RNA, 23 nt, Homo sapiens
aaaaguggaguuguuuuaacaga

SEQ ID NO: 2028538 - RNA, 17 nt, Homo sapiens
uaucugacagagcauca

SEQ ID NO: 2028539 - RNA, 14 nt, Homo sapiens
auggauucuauuua

SEQ ID NO: 2028540 - RNA, 22 nt, Homo sapiens
ggagaaauaugguacucauuaa

SEQ ID NO: 2028541 - RNA, 23 nt, Homo sapiens
cuuuacuguaaaggcaagccagc

SEQ ID NO: 2028542 - RNA, 21 nt, Homo sapiens
aagugaggacaaaaucacauu

SEQ ID NO: 2028543 - RNA, 22 nt, Homo sapiens
uccuuuacaaacauacagucca

SEQ ID NO: 2028544 - RNA, 17 nt, Homo sapiens
gaaaacacuguucucug

SEQ ID NO: 2028545 - RNA, 18 nt, Homo sapiens
gagccagcccuccuugac

SEQ ID NO: 2028546 - RNA, 17 nt, Homo sapiens
aaaaaucagcuggguac

SEQ ID NO: 2028547 - RNA, 16 nt, Homo sapiens
aaguaugagggaaaau

SEQ ID NO: 2028548 - RNA, 21 nt, Homo sapiens
cuggaguuucauguacaagau

SEQ ID NO: 2028549 - RNA, 15 nt, Homo sapiens
auccuguguaccuca

SEQ ID NO: 2028550 - RNA, 16 nt, Homo sapiens
uuaacuggcaugucau

SEQ ID NO: 2028551 - RNA, 21 nt, Homo sapiens
aucagugcuccuguaagucaa

SEQ ID NO: 2028552 - RNA, 22 nt, Homo sapiens
acugaguacguugugcauuugg

SEQ ID NO: 2028553 - RNA, 19 nt, Homo sapiens
ucuagccugggcaacaaca

SEQ ID NO: 2028554 - RNA, 14 nt, Homo sapiens
aagcugccauauau

SEQ ID NO: 2028555 - RNA, 15 nt, Homo sapiens
cugcugugacugugu

SEQ ID NO: 2028556 - RNA, 22 nt, Homo sapiens
cuuggccaucuaaacaucauca

SEQ ID NO: 2028557 - RNA, 15 nt, Homo sapiens
gcuagaaauaagccc

SEQ ID NO: 2028558 - RNA, 13 nt, Homo sapiens
aacgccgagugca

SEQ ID NO: 2028559 - RNA, 16 nt, Homo sapiens
uacagacauucaauga

SEQ ID NO: 2028560 - RNA, 19 nt, Homo sapiens
ccccaccugaccucugcaa

SEQ ID NO: 2028561 - RNA, 23 nt, Homo sapiens
aaugggauguaugaauacagcag

SEQ ID NO: 2028562 - RNA, 20 nt, Homo sapiens
acugguaaagccucauuuga

SEQ ID NO: 2028563 - RNA, 22 nt, Homo sapiens
aaugcuugaauauuacuggaua

SEQ ID NO: 2028564 - RNA, 14 nt, Homo sapiens
uaaaucgcuaccuu

SEQ ID NO: 2028565 - RNA, 17 nt, Homo sapiens
auguuagacucugguca

SEQ ID NO: 2028566 - RNA, 20 nt, Homo sapiens
uguuacacauacacacucau

SEQ ID NO: 2028567 - RNA, 15 nt, Homo sapiens
aaaugcacacauuuc

SEQ ID NO: 2028568 - RNA, 23 nt, Homo sapiens
uccugaauuggcuacuaguuuaa

SEQ ID NO: 2028569 - RNA, 17 nt, Homo sapiens
ucaguaugaagacacug

SEQ ID NO: 2028570 - RNA, 16 nt, Homo sapiens
ucaucaggcuuggaau

SEQ ID NO: 2028571 - RNA, 16 nt, Homo sapiens
ugccaagacaaaucaa

SEQ ID NO: 2028572 - RNA, 15 nt, Homo sapiens
ucuucccacuccagc

SEQ ID NO: 2028573 - RNA, 23 nt, Homo sapiens
gccacuccccuaaacuccaggau

SEQ ID NO: 2028574 - RNA, 15 nt, Homo sapiens
aguuggaucucuaca

SEQ ID NO: 2028575 - RNA, 12 nt, Homo sapiens
aacauaucuuua

SEQ ID NO: 2028576 - RNA, 14 nt, Homo sapiens
uauguauaucauuc

SEQ ID NO: 2028577 - RNA, 16 nt, Homo sapiens
uaagcuacugccaucc

SEQ ID NO: 2028578 - RNA, 18 nt, Homo sapiens
gaaggaaccagcaaugag

SEQ ID NO: 2028579 - RNA, 13 nt, Homo sapiens
aagaaagugcaga

SEQ ID NO: 2028580 - RNA, 17 nt, Homo sapiens
acacacagauaugcaca

SEQ ID NO: 2028581 - RNA, 17 nt, Homo sapiens
aggccagcaccaucucu

SEQ ID NO: 2028582 - RNA, 23 nt, Homo sapiens
ccagcaggaaaguacagaugcag

SEQ ID NO: 2028583 - RNA, 17 nt, Homo sapiens
guccauuccccaggugg

SEQ ID NO: 2028584 - RNA, 11 nt, Homo sapiens
aauaaaacugu

SEQ ID NO: 2028585 - RNA, 11 nt, Homo sapiens
aaaaaaacuga

SEQ ID NO: 2028586 - RNA, 11 nt, Homo sapiens
aagaaaacugg

SEQ ID NO: 2028587 - RNA, 20 nt, Homo sapiens
uauccugcuagcuguagaaa

SEQ ID NO: 2028588 - RNA, 15 nt, Homo sapiens
cugauaaguuucaua

SEQ ID NO: 2028589 - RNA, 18 nt, Homo sapiens
ucaaagggaguuuugcca

SEQ ID NO: 2028590 - RNA, 15 nt, Homo sapiens
accagacccugaauu

SEQ ID NO: 2028591 - RNA, 16 nt, Homo sapiens
uauagaaguuugucca

SEQ ID NO: 2028592 - RNA, 11 nt, Homo sapiens
agaagugccau

SEQ ID NO: 2028593 - RNA, 19 nt, Homo sapiens
gugacauauauauguauau

SEQ ID NO: 2028594 - RNA, 22 nt, Homo sapiens
acgcagucugcuucagugcagu

SEQ ID NO: 2028595 - RNA, 18 nt, Homo sapiens
ucaagcacccuguucccu

SEQ ID NO: 2028596 - RNA, 21 nt, Homo sapiens
cuagucaugugccuugaacau

SEQ ID NO: 2028597 - RNA, 17 nt, Homo sapiens
ugaucaagaacauguca

SEQ ID NO: 2028598 - RNA, 16 nt, Homo sapiens
gcuucacggacaggaa

SEQ ID NO: 2028599 - RNA, 14 nt, Homo sapiens
acaaaucagacaua

SEQ ID NO: 2028600 - RNA, 19 nt, Homo sapiens
auaccuaugucaacaguau

SEQ ID NO: 2028601 - RNA, 13 nt, Homo sapiens
cucucccagugaa

SEQ ID NO: 2028602 - RNA, 13 nt, Homo sapiens
cuucaaucacugu

SEQ ID NO: 2028603 - RNA, 13 nt, Homo sapiens
ccugaaucauucu

SEQ ID NO: 2028604 - RNA, 19 nt, Homo sapiens
uccuacgauacgcuacuau

SEQ ID NO: 2028605 - RNA, 14 nt, Homo sapiens
gcaguauagacaau

SEQ ID NO: 2028606 - RNA, 17 nt, Homo sapiens
guauuuuguauuugcau

SEQ ID NO: 2028607 - RNA, 16 nt, Homo sapiens
auuacauggcuguggu

SEQ ID NO: 2028608 - RNA, 13 nt, Homo sapiens
cacacgcauuaau

SEQ ID NO: 2028609 - RNA, 21 nt, Homo sapiens
gaccugauguaaacagugucu

SEQ ID NO: 2028610 - RNA, 22 nt, Homo sapiens
ucuugucgggagauugaaccac

SEQ ID NO: 2028611 - RNA, 18 nt, Homo sapiens
cgagggacuccagauaca

SEQ ID NO: 2028612 - RNA, 13 nt, Homo sapiens
accgucaauguga

SEQ ID NO: 2028613 - RNA, 12 nt, Homo sapiens
gcuccaucucau

SEQ ID NO: 2028614 - RNA, 17 nt, Homo sapiens
gugagaccaggggacca

SEQ ID NO: 2028615 - RNA, 21 nt, Homo sapiens
gcaagggcagaacacuaaccu

SEQ ID NO: 2028616 - RNA, 18 nt, Homo sapiens
uaaucccagcacuuggag

SEQ ID NO: 2028617 - RNA, 19 nt, Homo sapiens
uuucuagcucugacagccu

SEQ ID NO: 2028618 - RNA, 16 nt, Homo sapiens
uuacagcaagagccac

SEQ ID NO: 2028619 - RNA, 14 nt, Homo sapiens
acuugggagcugcu

SEQ ID NO: 2028620 - RNA, 20 nt, Homo sapiens
cuaaggaagauuacucagua

SEQ ID NO: 2028621 - RNA, 12 nt, Homo sapiens
gguccuugcccu

SEQ ID NO: 2028622 - RNA, 21 nt, Homo sapiens
uucaccugggcugaggcaucc

SEQ ID NO: 2028623 - RNA, 19 nt, Homo sapiens
ccacaaacuccauccagau

SEQ ID NO: 2028624 - RNA, 15 nt, Homo sapiens
accuuggacuccucc

SEQ ID NO: 2028625 - RNA, 13 nt, Homo sapiens
uucccccagacag

SEQ ID NO: 2028626 - RNA, 12 nt, Homo sapiens
acuguacugugu

SEQ ID NO: 2028627 - RNA, 16 nt, Homo sapiens
gauauagaaacucuca

SEQ ID NO: 2028628 - RNA, 23 nt, Homo sapiens
uugcaccccuccuauaccauaug

SEQ ID NO: 2028629 - RNA, 16 nt, Homo sapiens
agaguaaugaggcuug

SEQ ID NO: 2028630 - RNA, 15 nt, Homo sapiens
uuaaucaugagauaa

SEQ ID NO: 2028631 - RNA, 18 nt, Homo sapiens
cacacauuauuaccccac

SEQ ID NO: 2028632 - RNA, 21 nt, Homo sapiens
caacccccgacuucaucccaa

SEQ ID NO: 2028633 - RNA, 12 nt, Homo sapiens
acgccaacaaaa

SEQ ID NO: 2028634 - RNA, 24 nt, Homo sapiens
acauuuuacuacaguaaauggcag

SEQ ID NO: 2028635 - RNA, 14 nt, Homo sapiens
gaucacugaucuug

SEQ ID NO: 2028636 - RNA, 19 nt, Homo sapiens
augcuggucauccugggca

SEQ ID NO: 2028637 - RNA, 22 nt, Homo sapiens
ugugagauuuuuuauugcuagu

SEQ ID NO: 2028638 - RNA, 16 nt, Homo sapiens
cuacacugacacuggu

SEQ ID NO: 2028639 - RNA, 21 nt, Homo sapiens
aggcuucucauccacugugcu

SEQ ID NO: 2028640 - RNA, 15 nt, Homo sapiens
gcauaugcaucccaa

SEQ ID NO: 2028641 - RNA, 13 nt, Homo sapiens
augaugcuaugaa

SEQ ID NO: 2028642 - RNA, 22 nt, Homo sapiens
aagccucagcaaacccaaagau

SEQ ID NO: 2028643 - RNA, 15 nt, Homo sapiens
guuuuugucuaugaa

SEQ ID NO: 2028644 - RNA, 12 nt, Homo sapiens
uucaaaacauuc

SEQ ID NO: 2028645 - RNA, 17 nt, Homo sapiens
caaacugcagcugugag

SEQ ID NO: 2028646 - RNA, 14 nt, Homo sapiens
auuugucacuggaa

SEQ ID NO: 2028647 - RNA, 20 nt, Homo sapiens
gcuagauucuaacauauugc

SEQ ID NO: 2028648 - RNA, 10 nt, Homo sapiens
aaaugguugu

SEQ ID NO: 2028649 - RNA, 14 nt, Homo sapiens
acaaucuugaacau

SEQ ID NO: 2028650 - RNA, 14 nt, Homo sapiens
uccagaagggucau

SEQ ID NO: 2028651 - RNA, 15 nt, Homo sapiens
acccuaccagcuccu

SEQ ID NO: 2028652 - RNA, 21 nt, Homo sapiens
augaaucuucacaaaacacuu

SEQ ID NO: 2028653 - RNA, 18 nt, Homo sapiens
uugcugcuuguacacuca

SEQ ID NO: 2028654 - RNA, 14 nt, Homo sapiens
acauguggcccaac

SEQ ID NO: 2028655 - RNA, 18 nt, Homo sapiens
aacccuggagaguucaau

SEQ ID NO: 2028656 - RNA, 14 nt, Homo sapiens
uauuaaucagaaga

SEQ ID NO: 2028657 - RNA, 21 nt, Homo sapiens
ugccaaccggucacccaggag

SEQ ID NO: 2028658 - RNA, 18 nt, Homo sapiens
ggcauagccacuugcuca

SEQ ID NO: 2028659 - RNA, 15 nt, Homo sapiens
uucucaaagauuuga

SEQ ID NO: 2028660 - RNA, 18 nt, Homo sapiens
uucuuaccucauuugcau

SEQ ID NO: 2028661 - RNA, 23 nt, Homo sapiens
cuuuggcagaaucccccaaagaa

SEQ ID NO: 2028662 - RNA, 21 nt, Homo sapiens
caggacccagggaaugccagg

SEQ ID NO: 2028663 - RNA, 21 nt, Homo sapiens
ccaggagguugagaaugcagu

SEQ ID NO: 2028664 - RNA, 17 nt, Homo sapiens
aagggaaggcaaaggca

SEQ ID NO: 2028665 - RNA, 12 nt, Homo sapiens
uacauacugcug

SEQ ID NO: 2028666 - RNA, 15 nt, Homo sapiens
aagacauaugcauuu

SEQ ID NO: 2028667 - RNA, 18 nt, Homo sapiens
ugacauauauauguauau

SEQ ID NO: 2028668 - RNA, 18 nt, Homo sapiens
auaaagaucacacaucaa

SEQ ID NO: 2028669 - RNA, 23 nt, Homo sapiens
cuccaguuagaaugcaccaugga

SEQ ID NO: 2028670 - RNA, 19 nt, Homo sapiens
uguggucagcagaugccag

SEQ ID NO: 2028671 - RNA, 23 nt, Homo sapiens
ucuucuuugacuauaacaaaauc

SEQ ID NO: 2028672 - RNA, 20 nt, Homo sapiens
cguucaccuccaagcauuuc

SEQ ID NO: 2028673 - RNA, 20 nt, Homo sapiens
gucucuuaauucugaugcua

SEQ ID NO: 2028674 - RNA, 19 nt, Homo sapiens
gcacugaccccgaccucag

SEQ ID NO: 2028675 - RNA, 18 nt, Homo sapiens
ccaaaguuugcucaagga

SEQ ID NO: 2028676 - RNA, 23 nt, Homo sapiens
aaaaaggccuuugggauuugccg

SEQ ID NO: 2028677 - RNA, 15 nt, Homo sapiens
uguuuuaacagaugc

SEQ ID NO: 2028678 - RNA, 16 nt, Homo sapiens
gccaaaauaaugcacc

SEQ ID NO: 2028679 - RNA, 16 nt, Homo sapiens
aaauucugucaggggu

SEQ ID NO: 2028680 - RNA, 22 nt, Homo sapiens
acugaauucuggacagauuuaa

SEQ ID NO: 2028681 - RNA, 20 nt, Homo sapiens
gcccauucuaaacuccuuuc

SEQ ID NO: 2028682 - RNA, 14 nt, Homo sapiens
uaagcaugcuucua

SEQ ID NO: 2028683 - RNA, 12 nt, Homo sapiens
acucccuccuca

SEQ ID NO: 2028684 - RNA, 15 nt, Homo sapiens
auacagaguuuuaga

SEQ ID NO: 2028685 - RNA, 19 nt, Homo sapiens
ucaggaucaagaaaguguu

SEQ ID NO: 2028686 - RNA, 23 nt, Homo sapiens
accuuuugggaaaugcugauuua

SEQ ID NO: 2028687 - RNA, 16 nt, Homo sapiens
uaaaauuucuuagaaa

SEQ ID NO: 2028688 - RNA, 15 nt, Homo sapiens
uuaauggauucagua

SEQ ID NO: 2028689 - RNA, 23 nt, Homo sapiens
agccuguuuccccaauuccucug

SEQ ID NO: 2028690 - RNA, 21 nt, Homo sapiens
gauaaagugccuauaaaggaa

SEQ ID NO: 2028691 - RNA, 16 nt, Homo sapiens
cuuuagagaaugccac

SEQ ID NO: 2028692 - RNA, 17 nt, Homo sapiens
agggaaggugaagauga

SEQ ID NO: 2028693 - RNA, 15 nt, Homo sapiens
cuccacaugcuggug

SEQ ID NO: 2028694 - RNA, 18 nt, Homo sapiens
agcaucuugcauccaaac

SEQ ID NO: 2028695 - RNA, 15 nt, Homo sapiens
uuccuggguccugcc

SEQ ID NO: 2028696 - RNA, 22 nt, Homo sapiens
cacuacccgugaauuauauggc

SEQ ID NO: 2028697 - RNA, 19 nt, Homo sapiens
accuacgcacauaccuuca

SEQ ID NO: 2028698 - RNA, 22 nt, Homo sapiens
uauacaucuuccccuaaugccu

SEQ ID NO: 2028699 - RNA, 19 nt, Homo sapiens
aaauaauaacaaucacaaa

SEQ ID NO: 2028700 - RNA, 14 nt, Homo sapiens
uaagauuuuccauu

SEQ ID NO: 2028701 - RNA, 15 nt, Homo sapiens
cuuuaaaauauuguu

SEQ ID NO: 2028702 - RNA, 15 nt, Homo sapiens
gcccaucuuccugag

SEQ ID NO: 2028703 - RNA, 22 nt, Homo sapiens
uaacaucgugggucacuacagg

SEQ ID NO: 2028704 - RNA, 12 nt, Homo sapiens
uaguacuugaaa

SEQ ID NO: 2028705 - RNA, 19 nt, Homo sapiens
uuucuauuuuguuggauga

SEQ ID NO: 2028706 - RNA, 15 nt, Homo sapiens
agaccuucuccuuca

SEQ ID NO: 2028707 - RNA, 16 nt, Homo sapiens
gaccucugggcuuuga

SEQ ID NO: 2028708 - RNA, 19 nt, Homo sapiens
gccgggccuagaccuggug

SEQ ID NO: 2028709 - RNA, 20 nt, Homo sapiens
cccaaccugacuuccucugc

SEQ ID NO: 2028710 - RNA, 15 nt, Homo sapiens
cagcaccugcuccca

SEQ ID NO: 2028711 - RNA, 18 nt, Homo sapiens
agaugucuagguacuuca

SEQ ID NO: 2028712 - RNA, 16 nt, Homo sapiens
cagacgggcaagaagc

SEQ ID NO: 2028713 - RNA, 16 nt, Homo sapiens
gaucuuugugccaaac

SEQ ID NO: 2028714 - RNA, 13 nt, Homo sapiens
aaagcacuggaaa

SEQ ID NO: 2028715 - RNA, 13 nt, Homo sapiens
aaggcacugggaa

SEQ ID NO: 2028716 - RNA, 21 nt, Homo sapiens
ugacaaugacugugcuacugu

SEQ ID NO: 2028717 - RNA, 22 nt, Homo sapiens
ccaucaauucuuagaauaucua

SEQ ID NO: 2028718 - RNA, 20 nt, Homo sapiens
agcaucugaccaucugugac

SEQ ID NO: 2028719 - RNA, 22 nt, Homo sapiens
gcaggggaacaaaauaagggcc

SEQ ID NO: 2028720 - RNA, 16 nt, Homo sapiens
uagaaaagggaacuga

SEQ ID NO: 2028721 - RNA, 22 nt, Homo sapiens
gagugaauacacuggaauucag

SEQ ID NO: 2028722 - RNA, 16 nt, Homo sapiens
gauccuuuuauucucc

SEQ ID NO: 2028723 - RNA, 17 nt, Homo sapiens
aaaacgcaccaaucagc

SEQ ID NO: 2028724 - RNA, 21 nt, Homo sapiens
gcuacucuguuccuucacauc

SEQ ID NO: 2028725 - RNA, 14 nt, Homo sapiens
caauggugcuuccc

SEQ ID NO: 2028726 - RNA, 17 nt, Homo sapiens
uucugcacccagccaaa

SEQ ID NO: 2028727 - RNA, 21 nt, Homo sapiens
agugucucugccuugagucau

SEQ ID NO: 2028728 - RNA, 13 nt, Homo sapiens
cagagaccaaaua

SEQ ID NO: 2028729 - RNA, 14 nt, Homo sapiens
ggucuuugcuccag

SEQ ID NO: 2028730 - RNA, 22 nt, Homo sapiens
agcuuuaccagguuguccucaa

SEQ ID NO: 2028731 - RNA, 19 nt, Homo sapiens
uuguuaucuuccacuggaa

SEQ ID NO: 2028732 - RNA, 21 nt, Homo sapiens
ugaggaaauauuuccauuaac

SEQ ID NO: 2028733 - RNA, 23 nt, Homo sapiens
cggccuugucugucucagcucaa

SEQ ID NO: 2028734 - RNA, 13 nt, Homo sapiens
aauuaaaaaccac

SEQ ID NO: 2028735 - RNA, 13 nt, Homo sapiens
accgcugaauaug

SEQ ID NO: 2028736 - RNA, 16 nt, Homo sapiens
acacugaugcuuagau

SEQ ID NO: 2028737 - RNA, 18 nt, Homo sapiens
aacaguauuuguacaaau

SEQ ID NO: 2028738 - RNA, 15 nt, Homo sapiens
uucaagagugcaguu

SEQ ID NO: 2028739 - RNA, 17 nt, Homo sapiens
agaaaugguauguagag

SEQ ID NO: 2028740 - RNA, 18 nt, Homo sapiens
ggaaguuucuggugccau

SEQ ID NO: 2028741 - RNA, 17 nt, Homo sapiens
ucaacuugcaauuugca

SEQ ID NO: 2028742 - RNA, 16 nt, Homo sapiens
aacuauucuguuccac

SEQ ID NO: 2028743 - RNA, 22 nt, Homo sapiens
auuguuuuuuacucgucuuccu

SEQ ID NO: 2028744 - RNA, 22 nt, Homo sapiens
accaaugugugaaguaugcacu

SEQ ID NO: 2028745 - RNA, 17 nt, Homo sapiens
agccacgaggugcaaca

SEQ ID NO: 2028746 - RNA, 15 nt, Homo sapiens
cuguuuuucagggag

SEQ ID NO: 2028747 - RNA, 20 nt, Homo sapiens
aguauggcuccuccauaucu

SEQ ID NO: 2028748 - RNA, 23 nt, Homo sapiens
auccaagcaucccuuugcccaga

SEQ ID NO: 2028749 - RNA, 14 nt, Homo sapiens
cauugguccaagau

SEQ ID NO: 2028750 - RNA, 20 nt, Homo sapiens
uauaucgcuggccagcauua

SEQ ID NO: 2028751 - RNA, 20 nt, Homo sapiens
gcuuacaaagccuuacacag

SEQ ID NO: 2028752 - RNA, 18 nt, Homo sapiens
gccccacugacacccagu

SEQ ID NO: 2028753 - RNA, 13 nt, Homo sapiens
uaacgugugcgca

SEQ ID NO: 2028754 - RNA, 19 nt, Homo sapiens
cuggccccuucuccagcaa

SEQ ID NO: 2028755 - RNA, 17 nt, Homo sapiens
aaugguggcuucagcuc

SEQ ID NO: 2028756 - RNA, 21 nt, Homo sapiens
aaucaacccugcaaucacuuu

SEQ ID NO: 2028757 - RNA, 13 nt, Homo sapiens
caguugacuuacu

SEQ ID NO: 2028758 - RNA, 20 nt, Homo sapiens
cgugucacgggcaucauucu

SEQ ID NO: 2028759 - RNA, 15 nt, Homo sapiens
gaaaauaguguaaga

SEQ ID NO: 2028760 - RNA, 20 nt, Homo sapiens
caggucccugugagcacaua

SEQ ID NO: 2028761 - RNA, 15 nt, Homo sapiens
uuuuaugcuacugaa

SEQ ID NO: 2028762 - RNA, 15 nt, Homo sapiens
gaacuggacugugug

SEQ ID NO: 2028763 - RNA, 15 nt, Homo sapiens
gaauguaacugcuga

SEQ ID NO: 2028764 - RNA, 19 nt, Homo sapiens
agauccggcagcacaagcu

SEQ ID NO: 2028765 - RNA, 19 nt, Homo sapiens
acccuccccuagucacuca

SEQ ID NO: 2028766 - RNA, 22 nt, Homo sapiens
uauguccauccauauauauuca

SEQ ID NO: 2028767 - RNA, 20 nt, Homo sapiens
cugcaguacaacaguuuuag

SEQ ID NO: 2028768 - RNA, 16 nt, Homo sapiens
aguaauuucaguguaa

SEQ ID NO: 2028769 - RNA, 14 nt, Homo sapiens
aucucaguggcaca

SEQ ID NO: 2028770 - RNA, 23 nt, Homo sapiens
ucccuggcuccuccgucugaccc

SEQ ID NO: 2028771 - RNA, 23 nt, Homo sapiens
uguaacaguugcauugacuguca

SEQ ID NO: 2028772 - RNA, 15 nt, Homo sapiens
gccgucagagcagug

SEQ ID NO: 2028773 - RNA, 15 nt, Homo sapiens
aauauaaaaauguga

SEQ ID NO: 2028774 - RNA, 21 nt, Homo sapiens
aucuggccuaugacccugugc

SEQ ID NO: 2028775 - RNA, 17 nt, Homo sapiens
aauagcuauacauuaau

SEQ ID NO: 2028776 - RNA, 23 nt, Homo sapiens
acauaauguuaguagcacugaga

SEQ ID NO: 2028777 - RNA, 22 nt, Homo sapiens
agaugguccgugcccaggcccu

SEQ ID NO: 2028778 - RNA, 14 nt, Homo sapiens
auauuuacuguuag

SEQ ID NO: 2028779 - RNA, 21 nt, Homo sapiens
caaccuguucuuccuaccaaa

SEQ ID NO: 2028780 - RNA, 14 nt, Homo sapiens
ccuguuaggucuca

SEQ ID NO: 2028781 - RNA, 14 nt, Homo sapiens
ccacagacucccuc

SEQ ID NO: 2028782 - RNA, 20 nt, Homo sapiens
cucugccuuggggaggcuga

SEQ ID NO: 2028783 - RNA, 23 nt, Homo sapiens
ggacucagcucugucugcucaau

SEQ ID NO: 2028784 - RNA, 16 nt, Homo sapiens
guaaaaaggccuccug

SEQ ID NO: 2028785 - RNA, 16 nt, Homo sapiens
auauccaaaccaaaua

SEQ ID NO: 2028786 - RNA, 22 nt, Homo sapiens
cugaccucaagcaaccaugaac

SEQ ID NO: 2028787 - RNA, 23 nt, Homo sapiens
ccuaccacauucacuacugcaaa

SEQ ID NO: 2028788 - RNA, 21 nt, Homo sapiens
uaaagggagaaggaagggcag

SEQ ID NO: 2028789 - RNA, 23 nt, Homo sapiens
acucucuauaaguguucaguguu

SEQ ID NO: 2028790 - RNA, 18 nt, Homo sapiens
aaggcauuccucaucacc

SEQ ID NO: 2028791 - RNA, 16 nt, Homo sapiens
auuguacuaaagccaa

SEQ ID NO: 2028792 - RNA, 18 nt, Homo sapiens
aaagauggcuuccgugag

SEQ ID NO: 2028793 - RNA, 13 nt, Homo sapiens
aauuaugugcaaa

SEQ ID NO: 2028794 - RNA, 11 nt, Homo sapiens
augcacacugu

SEQ ID NO: 2028795 - RNA, 20 nt, Homo sapiens
cugaaauauuuucuacuuua

SEQ ID NO: 2028796 - RNA, 17 nt, Homo sapiens
ugccucucgguggccag

SEQ ID NO: 2028797 - RNA, 17 nt, Homo sapiens
aggucccuccucagacc

SEQ ID NO: 2028798 - RNA, 16 nt, Homo sapiens
acagacacaauaugua

SEQ ID NO: 2028799 - RNA, 17 nt, Homo sapiens
caagaaaggagagucuu

SEQ ID NO: 2028800 - RNA, 11 nt, Homo sapiens
ucccacuaaug

SEQ ID NO: 2028801 - RNA, 14 nt, Homo sapiens
guguggaguggagg

SEQ ID NO: 2028802 - RNA, 14 nt, Homo sapiens
agauaggauggaac

SEQ ID NO: 2028803 - RNA, 16 nt, Homo sapiens
ggacgcacacagcuuu

SEQ ID NO: 2028804 - RNA, 17 nt, Homo sapiens
agaggcucugagggucu

SEQ ID NO: 2028805 - RNA, 16 nt, Homo sapiens
caaagguuaucaacca

SEQ ID NO: 2028806 - RNA, 16 nt, Homo sapiens
aaacugcgaggccagu

SEQ ID NO: 2028807 - RNA, 22 nt, Homo sapiens
aacaaccucggcuccuggacuc

SEQ ID NO: 2028808 - RNA, 22 nt, Homo sapiens
ugauaaaauaaguaacauauaa

SEQ ID NO: 2028809 - RNA, 19 nt, Homo sapiens
ucuguaaaaugcaccaauc

SEQ ID NO: 2028810 - RNA, 14 nt, Homo sapiens
uaggaaaugaauga

SEQ ID NO: 2028811 - RNA, 15 nt, Homo sapiens
auuucaacaagaaua

SEQ ID NO: 2028812 - RNA, 22 nt, Homo sapiens
agacucaaagggagaggucuca

SEQ ID NO: 2028813 - RNA, 23 nt, Homo sapiens
gcccagccuuguaaauaaccaca

SEQ ID NO: 2028814 - RNA, 17 nt, Homo sapiens
ggagcuggggaaacuca

SEQ ID NO: 2028815 - RNA, 20 nt, Homo sapiens
cacucugaagaauccuguaa

SEQ ID NO: 2028816 - RNA, 17 nt, Homo sapiens
accccugcucuacccau

SEQ ID NO: 2028817 - RNA, 20 nt, Homo sapiens
aggacgaauuugcacaguga

SEQ ID NO: 2028818 - RNA, 19 nt, Homo sapiens
uguuuguaugucuguguau

SEQ ID NO: 2028819 - RNA, 15 nt, Homo sapiens
caggaguucugcuca

SEQ ID NO: 2028820 - RNA, 23 nt, Homo sapiens
aagaaucaccaguggguauucaa

SEQ ID NO: 2028821 - RNA, 16 nt, Homo sapiens
ugauuaaagugcucac

SEQ ID NO: 2028822 - RNA, 20 nt, Homo sapiens
aaaaugucuguuaacuuaau

SEQ ID NO: 2028823 - RNA, 15 nt, Homo sapiens
ugcagcugugccaua

SEQ ID NO: 2028824 - RNA, 20 nt, Homo sapiens
ucagauuccuuucccuuuag

SEQ ID NO: 2028825 - RNA, 16 nt, Homo sapiens
cauauggaaugccaaa

SEQ ID NO: 2028826 - RNA, 20 nt, Homo sapiens
ucaaaccuuucuggccuguu

SEQ ID NO: 2028827 - RNA, 14 nt, Homo sapiens
ugaaaauacaucuu

SEQ ID NO: 2028828 - RNA, 12 nt, Homo sapiens
ggcucuggucuc

SEQ ID NO: 2028829 - RNA, 20 nt, Homo sapiens
guguaaacaaaaugaagcug

SEQ ID NO: 2028830 - RNA, 22 nt, Homo sapiens
uguccuaaucauauaccagagg

SEQ ID NO: 2028831 - RNA, 18 nt, Homo sapiens
auagacuguaagcuccau

SEQ ID NO: 2028832 - RNA, 21 nt, Homo sapiens
ucaaaggaaaacaccuuuauu

SEQ ID NO: 2028833 - RNA, 16 nt, Homo sapiens
acggaggugccugagg

SEQ ID NO: 2028834 - RNA, 20 nt, Homo sapiens
uggagaauacugccaaaaca

SEQ ID NO: 2028835 - RNA, 15 nt, Homo sapiens
gccuauauauuuaau

SEQ ID NO: 2028836 - RNA, 15 nt, Homo sapiens
cuuucuuuacauacc

SEQ ID NO: 2028837 - RNA, 16 nt, Homo sapiens
aaugcaccucauucca

SEQ ID NO: 2028838 - RNA, 20 nt, Homo sapiens
aauuauauaaaucauuucaa

SEQ ID NO: 2028839 - RNA, 16 nt, Homo sapiens
uggacggagggucccc

SEQ ID NO: 2028840 - RNA, 15 nt, Homo sapiens
uggaacaccuccuca

SEQ ID NO: 2028841 - RNA, 17 nt, Homo sapiens
aaugaauaaacaguuau

SEQ ID NO: 2028842 - RNA, 19 nt, Homo sapiens
aaggucuguggugcagugu

SEQ ID NO: 2028843 - RNA, 22 nt, Homo sapiens
caguggugagaucacaguucau

SEQ ID NO: 2028844 - RNA, 14 nt, Homo sapiens
cuucgcaaccgcaa

SEQ ID NO: 2028845 - RNA, 19 nt, Homo sapiens
aguaaaguaugaaacauuc

SEQ ID NO: 2028846 - RNA, 23 nt, Homo sapiens
aagggcacgagagagucuuccag

SEQ ID NO: 2028847 - RNA, 18 nt, Homo sapiens
aaaagaugauuucucaaa

SEQ ID NO: 2028848 - RNA, 11 nt, Homo sapiens
guugcuucccg

SEQ ID NO: 2028849 - RNA, 18 nt, Homo sapiens
cagucucuucuaagcaaa

SEQ ID NO: 2028850 - RNA, 21 nt, Homo sapiens
gucaucauuugucuuugaacg

SEQ ID NO: 2028851 - RNA, 22 nt, Homo sapiens
uuagccauuuuucaaagcaauu

SEQ ID NO: 2028852 - RNA, 17 nt, Homo sapiens
uuccccccaaaacugau

SEQ ID NO: 2028853 - RNA, 17 nt, Homo sapiens
uaagacagagucucacu

SEQ ID NO: 2028854 - RNA, 16 nt, Homo sapiens
cugggagcagcucugu

SEQ ID NO: 2028855 - RNA, 20 nt, Homo sapiens
cuccacugugccuuugcaaa

SEQ ID NO: 2028856 - RNA, 16 nt, Homo sapiens
ccugaggucagggagu

SEQ ID NO: 2028857 - RNA, 21 nt, Homo sapiens
uuaccagugaaaaaauguaau

SEQ ID NO: 2028858 - RNA, 20 nt, Homo sapiens
agacaggguuucaccauguu

SEQ ID NO: 2028859 - RNA, 19 nt, Homo sapiens
gucaccuucuaccaccagg

SEQ ID NO: 2028860 - RNA, 16 nt, Homo sapiens
uccucagugacugugu

SEQ ID NO: 2028861 - RNA, 14 nt, Homo sapiens
gaaacuuuuguacu

SEQ ID NO: 2028862 - RNA, 18 nt, Homo sapiens
gcuuuuaagaaacacagg

SEQ ID NO: 2028863 - RNA, 21 nt, Homo sapiens
gcucccauuucuacucuccca

SEQ ID NO: 2028864 - RNA, 20 nt, Homo sapiens
ugaucaagguuaacaaagaa

SEQ ID NO: 2028865 - RNA, 23 nt, Homo sapiens
auacagaugguguccugcaugua

SEQ ID NO: 2028866 - RNA, 20 nt, Homo sapiens
ugccgaaacccuugacuguu

SEQ ID NO: 2028867 - RNA, 20 nt, Homo sapiens
aacaacguugacaaguuuug

SEQ ID NO: 2028868 - RNA, 18 nt, Homo sapiens
uaggugggagccaccacu

SEQ ID NO: 2028869 - RNA, 23 nt, Homo sapiens
cccucuuguuuucacuucacuuu

SEQ ID NO: 2028870 - RNA, 21 nt, Homo sapiens
cuggagaaagggaaguggaag

SEQ ID NO: 2028871 - RNA, 13 nt, Homo sapiens
cuguccuuucuca

SEQ ID NO: 2028872 - RNA, 20 nt, Homo sapiens
cuacguuggugcaagugugc

SEQ ID NO: 2028873 - RNA, 23 nt, Homo sapiens
ugucugggcucagacauccacau

SEQ ID NO: 2028874 - RNA, 14 nt, Homo sapiens
auauguuuuauuca

SEQ ID NO: 2028875 - RNA, 18 nt, Homo sapiens
uauauuauuacuaauugu

SEQ ID NO: 2028876 - RNA, 14 nt, Homo sapiens
agacccccauccag

SEQ ID NO: 2028877 - RNA, 23 nt, Homo sapiens
cagauggcaauggguacuccagc

SEQ ID NO: 2028878 - RNA, 14 nt, Homo sapiens
aaaacuugcugccu

SEQ ID NO: 2028879 - RNA, 14 nt, Homo sapiens
augauuugcaacuu

SEQ ID NO: 2028880 - RNA, 18 nt, Homo sapiens
guguucuuuguuccacug

SEQ ID NO: 2028881 - RNA, 14 nt, Homo sapiens
gguccuccuaucuc

SEQ ID NO: 2028882 - RNA, 14 nt, Homo sapiens
uguguacaauguga

SEQ ID NO: 2028883 - RNA, 17 nt, Homo sapiens
aguccagauauuucaca

SEQ ID NO: 2028884 - RNA, 16 nt, Homo sapiens
uaugcuuuuucucaga

SEQ ID NO: 2028885 - RNA, 20 nt, Homo sapiens
aacagaaaugaccacgugaa

SEQ ID NO: 2028886 - RNA, 21 nt, Homo sapiens
ucacgugcaaagccaccaaca

SEQ ID NO: 2028887 - RNA, 17 nt, Homo sapiens
ucaaagcagaagucugg

SEQ ID NO: 2028888 - RNA, 17 nt, Homo sapiens
cuauaguguaauaaugu

SEQ ID NO: 2028889 - RNA, 16 nt, Homo sapiens
cacaaaaucuguccaa

SEQ ID NO: 2028890 - RNA, 17 nt, Homo sapiens
acagaggagagucccag

SEQ ID NO: 2028891 - RNA, 21 nt, Homo sapiens
uauguaaauagaaacguguau

SEQ ID NO: 2028892 - RNA, 23 nt, Homo sapiens
aauguguccuaucuaucuuccaa

SEQ ID NO: 2028893 - RNA, 18 nt, Homo sapiens
uugaaugucuuuggcuca

SEQ ID NO: 2028894 - RNA, 15 nt, Homo sapiens
aaggugcucaaagau

SEQ ID NO: 2028895 - RNA, 21 nt, Homo sapiens
ugugugcacguacacacacau

SEQ ID NO: 2028896 - RNA, 12 nt, Homo sapiens
ccagguggcacc

SEQ ID NO: 2028897 - RNA, 22 nt, Homo sapiens
gagcacaaggccuuaauggaca

SEQ ID NO: 2028898 - RNA, 22 nt, Homo sapiens
ccucuucucugcauaccgugaa

SEQ ID NO: 2028899 - RNA, 13 nt, Homo sapiens
ugagcccagcuca

SEQ ID NO: 2028900 - RNA, 16 nt, Homo sapiens
uccuaaaguacuggga

SEQ ID NO: 2028901 - RNA, 22 nt, Homo sapiens
gguuugaaguggagucucauga

SEQ ID NO: 2028902 - RNA, 19 nt, Homo sapiens
aaccaguugauuuaaauau

SEQ ID NO: 2028903 - RNA, 23 nt, Homo sapiens
uguaacaauuauguuuucagugc

SEQ ID NO: 2028904 - RNA, 15 nt, Homo sapiens
gcagcaggaaggccc

SEQ ID NO: 2028905 - RNA, 21 nt, Homo sapiens
aagaugcccuaguugugauca

SEQ ID NO: 2028906 - RNA, 14 nt, Homo sapiens
guucagaacacuuu

SEQ ID NO: 2028907 - RNA, 21 nt, Homo sapiens
cuucagauauaagacuuuccc

SEQ ID NO: 2028908 - RNA, 12 nt, Homo sapiens
cuguaaauaugu

SEQ ID NO: 2028909 - RNA, 19 nt, Homo sapiens
augcugguuuucuacccaa

SEQ ID NO: 2028910 - RNA, 22 nt, Homo sapiens
gaggcuucugauacguguauga

SEQ ID NO: 2028911 - RNA, 18 nt, Homo sapiens
auaaaucugccauuucaa

SEQ ID NO: 2028912 - RNA, 18 nt, Homo sapiens
acaacuaauuauaaugca

SEQ ID NO: 2028913 - RNA, 15 nt, Homo sapiens
aaaccuugcacaggu

SEQ ID NO: 2028914 - RNA, 14 nt, Homo sapiens
cuuccaaaccucaa

SEQ ID NO: 2028915 - RNA, 16 nt, Homo sapiens
gcaggcagaaggcagu

SEQ ID NO: 2028916 - RNA, 19 nt, Homo sapiens
agaggacccuuacgugaga

SEQ ID NO: 2028917 - RNA, 13 nt, Homo sapiens
caggggcucugcu

SEQ ID NO: 2028918 - RNA, 14 nt, Homo sapiens
accccgccaugcau

SEQ ID NO: 2028919 - RNA, 12 nt, Homo sapiens
cucaagacuuua

SEQ ID NO: 2028920 - RNA, 13 nt, Homo sapiens
cagucuacccaga

SEQ ID NO: 2028921 - RNA, 21 nt, Homo sapiens
ccuucccaaucagcacugaaa

SEQ ID NO: 2028922 - RNA, 19 nt, Homo sapiens
uccuaccaauggauucaug

SEQ ID NO: 2028923 - RNA, 13 nt, Homo sapiens
uucugguacagag

SEQ ID NO: 2028924 - RNA, 13 nt, Homo sapiens
uugcaagauucca

SEQ ID NO: 2028925 - RNA, 12 nt, Homo sapiens
aaaacuuccuau

SEQ ID NO: 2028926 - RNA, 12 nt, Homo sapiens
aucacuuccacu

SEQ ID NO: 2028927 - RNA, 18 nt, Homo sapiens
aauuuauuauuaagguaa

SEQ ID NO: 2028928 - RNA, 19 nt, Homo sapiens
gcccaguguuugugcaagg

SEQ ID NO: 2028929 - RNA, 20 nt, Homo sapiens
ugacauaaacccaucuguaa

SEQ ID NO: 2028930 - RNA, 16 nt, Homo sapiens
acaccuguaaucucag

SEQ ID NO: 2028931 - RNA, 19 nt, Homo sapiens
cugccuugcugugaaauuu

SEQ ID NO: 2028932 - RNA, 16 nt, Homo sapiens
gcacugcucaagaacu

SEQ ID NO: 2028933 - RNA, 14 nt, Homo sapiens
aggagcugccaugu

SEQ ID NO: 2028934 - RNA, 18 nt, Homo sapiens
guugguucuugacucuga

SEQ ID NO: 2028935 - RNA, 13 nt, Homo sapiens
auucacaguaucu

SEQ ID NO: 2028936 - RNA, 18 nt, Homo sapiens
gccucccccgaaugcauu

SEQ ID NO: 2028937 - RNA, 23 nt, Homo sapiens
caaauggcagaaccaaagcucaa

SEQ ID NO: 2028938 - RNA, 20 nt, Homo sapiens
cagcguggguguugaaucca

SEQ ID NO: 2028939 - RNA, 17 nt, Homo sapiens
uccaaguugagauuuua

SEQ ID NO: 2028940 - RNA, 15 nt, Homo sapiens
uugaggcugcagauu

SEQ ID NO: 2028941 - RNA, 18 nt, Homo sapiens
gaacccaguguuuccaca

SEQ ID NO: 2028942 - RNA, 16 nt, Homo sapiens
uucuggaaagugcaau

SEQ ID NO: 2028943 - RNA, 16 nt, Homo sapiens
aacaagacacccaagu

SEQ ID NO: 2028944 - RNA, 18 nt, Homo sapiens
aacugaaagcacaugaau

SEQ ID NO: 2028945 - RNA, 17 nt, Homo sapiens
ccagccagggcucaauc

SEQ ID NO: 2028946 - RNA, 13 nt, Homo sapiens
uuuuguagccuuc

SEQ ID NO: 2028947 - RNA, 22 nt, Homo sapiens
aaugagcuccugcucauugugg

SEQ ID NO: 2028948 - RNA, 16 nt, Homo sapiens
auuuuuuaaguucaau

SEQ ID NO: 2028949 - RNA, 19 nt, Homo sapiens
ccugucccauggacacucc

SEQ ID NO: 2028950 - RNA, 18 nt, Homo sapiens
uggaaacccauaggccca

SEQ ID NO: 2028951 - RNA, 16 nt, Homo sapiens
uugaugccacccagaa

SEQ ID NO: 2028952 - RNA, 17 nt, Homo sapiens
aucagcaggaaugcucu

SEQ ID NO: 2028953 - RNA, 19 nt, Homo sapiens
aucacuuuugcacauuccc

SEQ ID NO: 2028954 - RNA, 20 nt, Homo sapiens
gagaacccggcaacaucagu

SEQ ID NO: 2028955 - RNA, 18 nt, Homo sapiens
ucuaucuucauguacuca

SEQ ID NO: 2028956 - RNA, 15 nt, Homo sapiens
aaugaaugacauuga

SEQ ID NO: 2028957 - RNA, 17 nt, Homo sapiens
acacugcggaagccaaa

SEQ ID NO: 2028958 - RNA, 15 nt, Homo sapiens
cagaggguacuuuaa

SEQ ID NO: 2028959 - RNA, 20 nt, Homo sapiens
uagcucucccaacucuugca

SEQ ID NO: 2028960 - RNA, 19 nt, Homo sapiens
uaacggcagugucauuccc

SEQ ID NO: 2028961 - RNA, 16 nt, Homo sapiens
gguaacaguggcugcu

SEQ ID NO: 2028962 - RNA, 18 nt, Homo sapiens
acccgucagagaccuggg

SEQ ID NO: 2028963 - RNA, 19 nt, Homo sapiens
gauggaggucacacuggua

SEQ ID NO: 2028964 - RNA, 18 nt, Homo sapiens
acccugaccugcugugca

SEQ ID NO: 2028965 - RNA, 18 nt, Homo sapiens
guuauauuuaaugcauua

SEQ ID NO: 2028966 - RNA, 13 nt, Homo sapiens
caucacacacuga

SEQ ID NO: 2028967 - RNA, 17 nt, Homo sapiens
ggaauaaaaucuggcca

SEQ ID NO: 2028968 - RNA, 15 nt, Homo sapiens
cugcacguaacacuc

SEQ ID NO: 2028969 - RNA, 19 nt, Homo sapiens
ugaauugcccguuuccaua

SEQ ID NO: 2028970 - RNA, 13 nt, Homo sapiens
acauuaagcacug

SEQ ID NO: 2028971 - RNA, 18 nt, Homo sapiens
accguggggaaggggugc

SEQ ID NO: 2028972 - RNA, 19 nt, Homo sapiens
auuucuuuaaaugcuuuua

SEQ ID NO: 2028973 - RNA, 21 nt, Homo sapiens
gcacguucuauauugugccaa

SEQ ID NO: 2028974 - RNA, 20 nt, Homo sapiens
uaucugcgugcacuucccag

SEQ ID NO: 2028975 - RNA, 16 nt, Homo sapiens
ggaacagccccagugc

SEQ ID NO: 2028976 - RNA, 17 nt, Homo sapiens
uuuacuuccaugauacu

SEQ ID NO: 2028977 - RNA, 15 nt, Homo sapiens
uugaaaacacacuca

SEQ ID NO: 2028978 - RNA, 16 nt, Homo sapiens
acagagcuucccugac

SEQ ID NO: 2028979 - RNA, 13 nt, Homo sapiens
uccagccaccacc

SEQ ID NO: 2028980 - RNA, 15 nt, Homo sapiens
gaaguucacaucaga

SEQ ID NO: 2028981 - RNA, 17 nt, Homo sapiens
cagagguuugcuuccuc

SEQ ID NO: 2028982 - RNA, 14 nt, Homo sapiens
uacuggugcaguca

SEQ ID NO: 2028983 - RNA, 14 nt, Homo sapiens
uaacagugcauauu

SEQ ID NO: 2028984 - RNA, 20 nt, Homo sapiens
acagccucuuagaugcaguu

SEQ ID NO: 2028985 - RNA, 17 nt, Homo sapiens
gcaugggggcccaaagg

SEQ ID NO: 2028986 - RNA, 22 nt, Homo sapiens
cccaccuauccccauucucugc

SEQ ID NO: 2028987 - RNA, 21 nt, Homo sapiens
aguaaagccguuguuuacuua

SEQ ID NO: 2028988 - RNA, 20 nt, Homo sapiens
cagugagcugagauugcgcc

SEQ ID NO: 2028989 - RNA, 14 nt, Homo sapiens
ugaaguucacucag

SEQ ID NO: 2028990 - RNA, 17 nt, Homo sapiens
aguuuacccaugaagau

SEQ ID NO: 2028991 - RNA, 21 nt, Homo sapiens
uuuaagaaauuccuagugucu

SEQ ID NO: 2028992 - RNA, 14 nt, Homo sapiens
uugcaacacacaga

SEQ ID NO: 2028993 - RNA, 19 nt, Homo sapiens
agacaaauguaacacacac

SEQ ID NO: 2028994 - RNA, 17 nt, Homo sapiens
cuuaucugugcgugaaa

SEQ ID NO: 2028995 - RNA, 15 nt, Homo sapiens
gcucuuugcugcacu

SEQ ID NO: 2028996 - RNA, 18 nt, Homo sapiens
ugggcccuggccuggauu

SEQ ID NO: 2028997 - RNA, 15 nt, Homo sapiens
ccugagccacaaaaa

SEQ ID NO: 2028998 - RNA, 16 nt, Homo sapiens
acuucucuugccuuaa

SEQ ID NO: 2028999 - RNA, 22 nt, Homo sapiens
auuggcuacuaguuuaagcaaa

SEQ ID NO: 2029000 - RNA, 16 nt, Homo sapiens
caguccuuaucugcuc

SEQ ID NO: 2029001 - RNA, 18 nt, Homo sapiens
uauuagagcugccugugc

SEQ ID NO: 2029002 - RNA, 15 nt, Homo sapiens
gauuucacaucagcu

SEQ ID NO: 2029003 - RNA, 22 nt, Homo sapiens
accucuuccuccucgcugccag

SEQ ID NO: 2029004 - RNA, 13 nt, Homo sapiens
cagcccccugacc

SEQ ID NO: 2029005 - RNA, 13 nt, Homo sapiens
aaacacauauuca

SEQ ID NO: 2029006 - RNA, 13 nt, Homo sapiens
guucucaugaacu

SEQ ID NO: 2029007 - RNA, 14 nt, Homo sapiens
cucagcuccacaac

SEQ ID NO: 2029008 - RNA, 19 nt, Homo sapiens
caccuuuccuguucaugac

SEQ ID NO: 2029009 - RNA, 23 nt, Homo sapiens
uggugcgggcaccuguaguccua

SEQ ID NO: 2029010 - RNA, 20 nt, Homo sapiens
ugaagcuguuauuugcaguc

SEQ ID NO: 2029011 - RNA, 21 nt, Homo sapiens
aaucauauuugaaaaccauau

SEQ ID NO: 2029012 - RNA, 15 nt, Homo sapiens
cuuauccugcauugu

SEQ ID NO: 2029013 - RNA, 11 nt, Homo sapiens
agacuuucaag

SEQ ID NO: 2029014 - RNA, 19 nt, Homo sapiens
caauaagacaugcuuacuu

SEQ ID NO: 2029015 - RNA, 17 nt, Homo sapiens
cagaguggcccaagacu

SEQ ID NO: 2029016 - RNA, 15 nt, Homo sapiens
aauaaaaagguuuaa

SEQ ID NO: 2029017 - RNA, 14 nt, Homo sapiens
uaccuuuaaauuga

SEQ ID NO: 2029018 - RNA, 18 nt, Homo sapiens
aagcagaugcaaagaggc

SEQ ID NO: 2029019 - RNA, 18 nt, Homo sapiens
cagauuaucuacuuagau

SEQ ID NO: 2029020 - RNA, 17 nt, Homo sapiens
acauuaaaucacuugaa

SEQ ID NO: 2029021 - RNA, 13 nt, Homo sapiens
uuaaaauguaguu

SEQ ID NO: 2029022 - RNA, 23 nt, Homo sapiens
aaugcccuuccagugggacccca

SEQ ID NO: 2029023 - RNA, 15 nt, Homo sapiens
accugucacuugcac

SEQ ID NO: 2029024 - RNA, 16 nt, Homo sapiens
aaucagucuaccaagg

SEQ ID NO: 2029025 - RNA, 15 nt, Homo sapiens
gcccuucacugucac

SEQ ID NO: 2029026 - RNA, 20 nt, Homo sapiens
ccacaaccuuccagcuccau

SEQ ID NO: 2029027 - RNA, 22 nt, Homo sapiens
aaguagacuucauuuuuccuaa

SEQ ID NO: 2029028 - RNA, 16 nt, Homo sapiens
uacuggagagauuuaa

SEQ ID NO: 2029029 - RNA, 13 nt, Homo sapiens
cacaguuugcaau

SEQ ID NO: 2029030 - RNA, 21 nt, Homo sapiens
augaguguaguugaugacugu

SEQ ID NO: 2029031 - RNA, 21 nt, Homo sapiens
agcuaaaaaauuguuaaacuu

SEQ ID NO: 2029032 - RNA, 19 nt, Homo sapiens
uaacuuaccucugcuucug

SEQ ID NO: 2029033 - RNA, 17 nt, Homo sapiens
aaaucauuuaucuggau

SEQ ID NO: 2029034 - RNA, 15 nt, Homo sapiens
accauacacacuguu

SEQ ID NO: 2029035 - RNA, 15 nt, Homo sapiens
acuaguaccuucaga

SEQ ID NO: 2029036 - RNA, 15 nt, Homo sapiens
cacacugaaucagcu

SEQ ID NO: 2029037 - RNA, 22 nt, Homo sapiens
agagcagauggccuggcugcug

SEQ ID NO: 2029038 - RNA, 21 nt, Homo sapiens
uuuaggaaaaauaauucuauu

SEQ ID NO: 2029039 - RNA, 13 nt, Homo sapiens
cugcaaugacugc

SEQ ID NO: 2029040 - RNA, 12 nt, Homo sapiens
ccacccaugacc

SEQ ID NO: 2029041 - RNA, 17 nt, Homo sapiens
uuaccuucauaugcagu

SEQ ID NO: 2029042 - RNA, 18 nt, Homo sapiens
aacaauaaaguacuuuac

SEQ ID NO: 2029043 - RNA, 17 nt, Homo sapiens
uucacacuauccagcua

SEQ ID NO: 2029044 - RNA, 20 nt, Homo sapiens
aggccugacugccaagccau

SEQ ID NO: 2029045 - RNA, 14 nt, Homo sapiens
gagcuacugaugaa

SEQ ID NO: 2029046 - RNA, 18 nt, Homo sapiens
agcacaagucucagggga

SEQ ID NO: 2029047 - RNA, 14 nt, Homo sapiens
gccccaugagacag

SEQ ID NO: 2029048 - RNA, 14 nt, Homo sapiens
acccaaugggaccg

SEQ ID NO: 2029049 - RNA, 14 nt, Homo sapiens
ggaaugcaccuccc

SEQ ID NO: 2029050 - RNA, 13 nt, Homo sapiens
aagaccuggaccg

SEQ ID NO: 2029051 - RNA, 13 nt, Homo sapiens
ucccaagacugcu

SEQ ID NO: 2029052 - RNA, 20 nt, Homo sapiens
cuuugauugcugagagccau

SEQ ID NO: 2029053 - RNA, 15 nt, Homo sapiens
gauaauacacuauua

SEQ ID NO: 2029054 - RNA, 14 nt, Homo sapiens
aucugucauucaag

SEQ ID NO: 2029055 - RNA, 13 nt, Homo sapiens
gcagaggcaccuc

SEQ ID NO: 2029056 - RNA, 20 nt, Homo sapiens
ccauugugauuguggaagau

SEQ ID NO: 2029057 - RNA, 16 nt, Homo sapiens
aauaauaaaaugcaaa

SEQ ID NO: 2029058 - RNA, 17 nt, Homo sapiens
aaggucaggaugagaac

SEQ ID NO: 2029059 - RNA, 12 nt, Homo sapiens
gugcacacaccu

SEQ ID NO: 2029060 - RNA, 21 nt, Homo sapiens
cucugcagcccagccuaguca

SEQ ID NO: 2029061 - RNA, 14 nt, Homo sapiens
aagucuaauucaca

SEQ ID NO: 2029062 - RNA, 17 nt, Homo sapiens
cuugcaaaugaaugccu

SEQ ID NO: 2029063 - RNA, 20 nt, Homo sapiens
cuguggcauucauauuucau

SEQ ID NO: 2029064 - RNA, 13 nt, Homo sapiens
aaaccaguaucgu

SEQ ID NO: 2029065 - RNA, 23 nt, Homo sapiens
gagacuccaucucuuuaaaaaca

SEQ ID NO: 2029066 - RNA, 20 nt, Homo sapiens
ucccacucauguuguuccca

SEQ ID NO: 2029067 - RNA, 23 nt, Homo sapiens
uuuuacaagaaaacaauggggcu

SEQ ID NO: 2029068 - RNA, 16 nt, Homo sapiens
cuucuuccuuaauuca

SEQ ID NO: 2029069 - RNA, 16 nt, Homo sapiens
uugggagauuucauuu

SEQ ID NO: 2029070 - RNA, 21 nt, Homo sapiens
guacucauaaaggacacugga

SEQ ID NO: 2029071 - RNA, 15 nt, Homo sapiens
uauggaaaaaaccaa

SEQ ID NO: 2029072 - RNA, 22 nt, Homo sapiens
uaaauguauuuaauuaaaucuc

SEQ ID NO: 2029073 - RNA, 22 nt, Homo sapiens
aaauggaaaaauaaacacuaca

SEQ ID NO: 2029074 - RNA, 14 nt, Homo sapiens
cucuguacacugcc

SEQ ID NO: 2029075 - RNA, 12 nt, Homo sapiens
gguccaucucau

SEQ ID NO: 2029076 - RNA, 16 nt, Homo sapiens
cugaugacauuccacc

SEQ ID NO: 2029077 - RNA, 17 nt, Homo sapiens
auuuuuuaaggaaacaa

SEQ ID NO: 2029078 - RNA, 14 nt, Homo sapiens
aggcuuacugagcu

SEQ ID NO: 2029079 - RNA, 17 nt, Homo sapiens
uguaaaauagucucauu

SEQ ID NO: 2029080 - RNA, 13 nt, Homo sapiens
uaauauacauaac

SEQ ID NO: 2029081 - RNA, 23 nt, Homo sapiens
uguuucuacacauugcuaccuca

SEQ ID NO: 2029082 - RNA, 16 nt, Homo sapiens
uaauaaagucuaugga

SEQ ID NO: 2029083 - RNA, 15 nt, Homo sapiens
auuuuacacauugac

SEQ ID NO: 2029084 - RNA, 17 nt, Homo sapiens
augcagaauggcauuug

SEQ ID NO: 2029085 - RNA, 21 nt, Homo sapiens
uucuacgcugccucaacacug

SEQ ID NO: 2029086 - RNA, 16 nt, Homo sapiens
aauacuguguaccuca

SEQ ID NO: 2029087 - RNA, 14 nt, Homo sapiens
ggcugagugacaca

SEQ ID NO: 2029088 - RNA, 22 nt, Homo sapiens
gacuuucugaagccucacuuau

SEQ ID NO: 2029089 - RNA, 22 nt, Homo sapiens
aucgagauguccauagucaaau

SEQ ID NO: 2029090 - RNA, 19 nt, Homo sapiens
aagagucuggccuggaccc

SEQ ID NO: 2029091 - RNA, 20 nt, Homo sapiens
auucuaugccuguauuucca

SEQ ID NO: 2029092 - RNA, 21 nt, Homo sapiens
aaauaugauuuuauuugacaa

SEQ ID NO: 2029093 - RNA, 18 nt, Homo sapiens
gccacugcccaaagccau

SEQ ID NO: 2029094 - RNA, 17 nt, Homo sapiens
ccuagaauaaucucauc

SEQ ID NO: 2029095 - RNA, 14 nt, Homo sapiens
auuuuagacuuccu

SEQ ID NO: 2029096 - RNA, 20 nt, Homo sapiens
cuguggcucugcaugacaaa

SEQ ID NO: 2029097 - RNA, 17 nt, Homo sapiens
aagucaugugcauuucc

SEQ ID NO: 2029098 - RNA, 17 nt, Homo sapiens
aacuuugacuuugccca

SEQ ID NO: 2029099 - RNA, 21 nt, Homo sapiens
agaaaccuauuaagucaucau

SEQ ID NO: 2029100 - RNA, 16 nt, Homo sapiens
aguaacaggaucagug

SEQ ID NO: 2029101 - RNA, 19 nt, Homo sapiens
caaagucauaauugcauug

SEQ ID NO: 2029102 - RNA, 20 nt, Homo sapiens
augugucccaugcauaacac

SEQ ID NO: 2029103 - RNA, 13 nt, Homo sapiens
ccauccuauuuaa

SEQ ID NO: 2029104 - RNA, 23 nt, Homo sapiens
agcaacagccuaaucccgugccc

SEQ ID NO: 2029105 - RNA, 22 nt, Homo sapiens
aagcaauucuaguguaaaucau

SEQ ID NO: 2029106 - RNA, 17 nt, Homo sapiens
gaaauuccagcaauaag

SEQ ID NO: 2029107 - RNA, 17 nt, Homo sapiens
gcaugaacuguccuucc

SEQ ID NO: 2029108 - RNA, 18 nt, Homo sapiens
aucccgugaaagaauuau

SEQ ID NO: 2029109 - RNA, 17 nt, Homo sapiens
ccaugaaacugacucau

SEQ ID NO: 2029110 - RNA, 23 nt, Homo sapiens
cacgguggugcaugccuguaauc

SEQ ID NO: 2029111 - RNA, 19 nt, Homo sapiens
gaccucaucagccuuggga

SEQ ID NO: 2029112 - RNA, 20 nt, Homo sapiens
gaaaccuguuaaaacaacca

SEQ ID NO: 2029113 - RNA, 20 nt, Homo sapiens
gaauugcccguuuccauaca

SEQ ID NO: 2029114 - RNA, 22 nt, Homo sapiens
cacaguucccuuuauuucacau

SEQ ID NO: 2029115 - RNA, 18 nt, Homo sapiens
uucuauuucacuaaucau

SEQ ID NO: 2029116 - RNA, 20 nt, Homo sapiens
auaacagcaggguaccugaa

SEQ ID NO: 2029117 - RNA, 22 nt, Homo sapiens
ucacuaaaaauuuuuacaaaac

SEQ ID NO: 2029118 - RNA, 17 nt, Homo sapiens
ccugggcggcacgggcu

SEQ ID NO: 2029119 - RNA, 19 nt, Homo sapiens
ugcaccaggcacugcugca

SEQ ID NO: 2029120 - RNA, 15 nt, Homo sapiens
gcccuucuaggcaaa

SEQ ID NO: 2029121 - RNA, 17 nt, Homo sapiens
ugguucuuagaccucaa

SEQ ID NO: 2029122 - RNA, 15 nt, Homo sapiens
uaauaugagauuucu

SEQ ID NO: 2029123 - RNA, 16 nt, Homo sapiens
aucacuuaaaugucac

SEQ ID NO: 2029124 - RNA, 22 nt, Homo sapiens
uuuuaaacugguuuuuugcaua

SEQ ID NO: 2029125 - RNA, 11 nt, Homo sapiens
aggaccaugcu

SEQ ID NO: 2029126 - RNA, 13 nt, Homo sapiens
aaccagugccaag

SEQ ID NO: 2029127 - RNA, 13 nt, Homo sapiens
uuucugccuaucu

SEQ ID NO: 2029128 - RNA, 22 nt, Homo sapiens
uugacugcugaauuaaugugau

SEQ ID NO: 2029129 - RNA, 15 nt, Homo sapiens
aucccaagguuucca

SEQ ID NO: 2029130 - RNA, 14 nt, Homo sapiens
cuucaguugaucuu

SEQ ID NO: 2029131 - RNA, 16 nt, Homo sapiens
gucccagagaccucau

SEQ ID NO: 2029132 - RNA, 15 nt, Homo sapiens
aggcaaggaugucug

SEQ ID NO: 2029133 - RNA, 14 nt, Homo sapiens
ugagcaagagccag

SEQ ID NO: 2029134 - RNA, 19 nt, Homo sapiens
aauauuuauauugucacuc

SEQ ID NO: 2029135 - RNA, 16 nt, Homo sapiens
aguacauaauugauua

SEQ ID NO: 2029136 - RNA, 14 nt, Homo sapiens
uuccuuaaagcauu

SEQ ID NO: 2029137 - RNA, 17 nt, Homo sapiens
aacguuuugaacuaaua

SEQ ID NO: 2029138 - RNA, 17 nt, Homo sapiens
caagauuugaccaaauc

SEQ ID NO: 2029139 - RNA, 17 nt, Homo sapiens
cucagcccccugcuuca

SEQ ID NO: 2029140 - RNA, 19 nt, Homo sapiens
acaaauggcuuacuuacaa

SEQ ID NO: 2029141 - RNA, 15 nt, Homo sapiens
gaaauaaauguaccu

SEQ ID NO: 2029142 - RNA, 23 nt, Homo sapiens
aaaaagcucugaagacccaaaga

SEQ ID NO: 2029143 - RNA, 16 nt, Homo sapiens
gaauuuccacuguaau

SEQ ID NO: 2029144 - RNA, 18 nt, Homo sapiens
cuuugaugucauauggaa

SEQ ID NO: 2029145 - RNA, 15 nt, Homo sapiens
cuacagagaucccac

SEQ ID NO: 2029146 - RNA, 13 nt, Homo sapiens
cagucucacuuug

SEQ ID NO: 2029147 - RNA, 16 nt, Homo sapiens
ucacauuuacuagcug

SEQ ID NO: 2029148 - RNA, 23 nt, Homo sapiens
cauggcucuggcacaguguaauc

SEQ ID NO: 2029149 - RNA, 21 nt, Homo sapiens
cccaaacuuauggacacugcc

SEQ ID NO: 2029150 - RNA, 23 nt, Homo sapiens
uauuuaaauaaagucucucugac

SEQ ID NO: 2029151 - RNA, 14 nt, Homo sapiens
aaauuaacaugaua

SEQ ID NO: 2029152 - RNA, 14 nt, Homo sapiens
cuguuaaccaaaua

SEQ ID NO: 2029153 - RNA, 14 nt, Homo sapiens
cagacaaccuauca

SEQ ID NO: 2029154 - RNA, 14 nt, Homo sapiens
augaagacaaauag

SEQ ID NO: 2029155 - RNA, 16 nt, Homo sapiens
auacuuuucucaauau

SEQ ID NO: 2029156 - RNA, 19 nt, Homo sapiens
uggggagacuuggggccag

SEQ ID NO: 2029157 - RNA, 20 nt, Homo sapiens
agggaguguuugugucugac

SEQ ID NO: 2029158 - RNA, 15 nt, Homo sapiens
agagcugucuugucg

SEQ ID NO: 2029159 - RNA, 19 nt, Homo sapiens
aaugugggcuauguaguca

SEQ ID NO: 2029160 - RNA, 18 nt, Homo sapiens
aaaggucccuccccagac

SEQ ID NO: 2029161 - RNA, 20 nt, Homo sapiens
uuccccuccuuggcuuuaug

SEQ ID NO: 2029162 - RNA, 19 nt, Homo sapiens
ucugccuucuccaugcuga

SEQ ID NO: 2029163 - RNA, 20 nt, Homo sapiens
cugcuaauauuaaaccuuuc

SEQ ID NO: 2029164 - RNA, 23 nt, Homo sapiens
cagccuuaaauccuuuacaagau

SEQ ID NO: 2029165 - RNA, 14 nt, Homo sapiens
aaaucagucucaca

SEQ ID NO: 2029166 - RNA, 21 nt, Homo sapiens
gaaaucauaguuuaaacugca

SEQ ID NO: 2029167 - RNA, 23 nt, Homo sapiens
uaccucgugguguguuugccuug

SEQ ID NO: 2029168 - RNA, 20 nt, Homo sapiens
gcacacacaagugcacagag

SEQ ID NO: 2029169 - RNA, 22 nt, Homo sapiens
aucuuucccucuucgguguucu

SEQ ID NO: 2029170 - RNA, 15 nt, Homo sapiens
uaaagcaauguggua

SEQ ID NO: 2029171 - RNA, 22 nt, Homo sapiens
gaggcuccuguuagcuccucac

SEQ ID NO: 2029172 - RNA, 12 nt, Homo sapiens
cuccugaccaaa

SEQ ID NO: 2029173 - RNA, 22 nt, Homo sapiens
gaagauguccgugagaacauca

SEQ ID NO: 2029174 - RNA, 13 nt, Homo sapiens
agaccucagggca

SEQ ID NO: 2029175 - RNA, 17 nt, Homo sapiens
acaauaaugaguucacu

SEQ ID NO: 2029176 - RNA, 23 nt, Homo sapiens
auuacuaguacuauuacuaguac

SEQ ID NO: 2029177 - RNA, 21 nt, Homo sapiens
ucucugagucaaauccagugg

SEQ ID NO: 2029178 - RNA, 17 nt, Homo sapiens
auaccagaaagcucuac

SEQ ID NO: 2029179 - RNA, 17 nt, Homo sapiens
ccucagccuccugggua

SEQ ID NO: 2029180 - RNA, 18 nt, Homo sapiens
aucuuuccuugucucuca

SEQ ID NO: 2029181 - RNA, 15 nt, Homo sapiens
agcccuuuacuugac

SEQ ID NO: 2029182 - RNA, 20 nt, Homo sapiens
acucacaucuuuuucacuga

SEQ ID NO: 2029183 - RNA, 15 nt, Homo sapiens
aaagaggugcugcuu

SEQ ID NO: 2029184 - RNA, 21 nt, Homo sapiens
agacccccauucugacaucca

SEQ ID NO: 2029185 - RNA, 15 nt, Homo sapiens
ccagaagcagcagcu

SEQ ID NO: 2029186 - RNA, 20 nt, Homo sapiens
cuuggagcuaaaacuggccc

SEQ ID NO: 2029187 - RNA, 20 nt, Homo sapiens
cugaauaccacuuaccucaa

SEQ ID NO: 2029188 - RNA, 12 nt, Homo sapiens
agugguuucccu

SEQ ID NO: 2029189 - RNA, 20 nt, Homo sapiens
gagacaggauuucacugugu

SEQ ID NO: 2029190 - RNA, 21 nt, Homo sapiens
gcuguuuugauuuguacugaa

SEQ ID NO: 2029191 - RNA, 14 nt, Homo sapiens
auaagacuacugaa

SEQ ID NO: 2029192 - RNA, 21 nt, Homo sapiens
acugaauaaauaaguaaauac

SEQ ID NO: 2029193 - RNA, 19 nt, Homo sapiens
cuauuuggggcuugaugac

SEQ ID NO: 2029194 - RNA, 14 nt, Homo sapiens
accacaaaucugaa

SEQ ID NO: 2029195 - RNA, 14 nt, Homo sapiens
ggcuggaugagcuc

SEQ ID NO: 2029196 - RNA, 22 nt, Homo sapiens
gggcaaacagaagaauuuuucu

SEQ ID NO: 2029197 - RNA, 20 nt, Homo sapiens
ugcaaaguacuguaagaaua

SEQ ID NO: 2029198 - RNA, 21 nt, Homo sapiens
cuaucugcacucuaaacugca

SEQ ID NO: 2029199 - RNA, 13 nt, Homo sapiens
uuaacaucucaga

SEQ ID NO: 2029200 - RNA, 21 nt, Homo sapiens
acugggccugcuagucuguca

SEQ ID NO: 2029201 - RNA, 14 nt, Homo sapiens
acaaaaacauggcc

SEQ ID NO: 2029202 - RNA, 18 nt, Homo sapiens
acaccugcagugccagcu

SEQ ID NO: 2029203 - RNA, 22 nt, Homo sapiens
cuuuuccaugcacccucauaca

SEQ ID NO: 2029204 - RNA, 23 nt, Homo sapiens
ccuucucuugaggccugugcucu

SEQ ID NO: 2029205 - RNA, 13 nt, Homo sapiens
ucagcccaucuca

SEQ ID NO: 2029206 - RNA, 17 nt, Homo sapiens
gugguccuuugggguga

SEQ ID NO: 2029207 - RNA, 19 nt, Homo sapiens
gauaaaaagaaaguuuaua

SEQ ID NO: 2029208 - RNA, 13 nt, Homo sapiens
uucuauauucuca

SEQ ID NO: 2029209 - RNA, 21 nt, Homo sapiens
cuuaaugauccguuccauugc

SEQ ID NO: 2029210 - RNA, 20 nt, Homo sapiens
aauguaaaaacuuucacuga

SEQ ID NO: 2029211 - RNA, 19 nt, Homo sapiens
augucuaucaacuuuaauc

SEQ ID NO: 2029212 - RNA, 18 nt, Homo sapiens
cuggagaccgaggccaga

SEQ ID NO: 2029213 - RNA, 17 nt, Homo sapiens
ucauuaauaauuugcuc

SEQ ID NO: 2029214 - RNA, 17 nt, Homo sapiens
uguuuguauacauauau

SEQ ID NO: 2029215 - RNA, 17 nt, Homo sapiens
uguaaacuuacuagcuu

SEQ ID NO: 2029216 - RNA, 22 nt, Homo sapiens
uugguaagauugcacuguucug

SEQ ID NO: 2029217 - RNA, 13 nt, Homo sapiens
ugggcccuaggca

SEQ ID NO: 2029218 - RNA, 20 nt, Homo sapiens
aaaucaguaaacacugugua

SEQ ID NO: 2029219 - RNA, 14 nt, Homo sapiens
ucuguuccugucca

SEQ ID NO: 2029220 - RNA, 20 nt, Homo sapiens
gccauugugaaccaaugcaa

SEQ ID NO: 2029221 - RNA, 18 nt, Homo sapiens
cauugaggaccucaucca

SEQ ID NO: 2029222 - RNA, 19 nt, Homo sapiens
uguaaauguguuagcacug

SEQ ID NO: 2029223 - RNA, 12 nt, Homo sapiens
gccuuucuuugc

SEQ ID NO: 2029224 - RNA, 12 nt, Homo sapiens
uguaccuugaua

SEQ ID NO: 2029225 - RNA, 20 nt, Homo sapiens
gcuagugacuugugucccau

SEQ ID NO: 2029226 - RNA, 13 nt, Homo sapiens
acaauuuggagca

SEQ ID NO: 2029227 - RNA, 19 nt, Homo sapiens
aggaggggugaguccccua

SEQ ID NO: 2029228 - RNA, 14 nt, Homo sapiens
ugccccucucuggg

SEQ ID NO: 2029229 - RNA, 17 nt, Homo sapiens
auuuccuuugcgcaaac

SEQ ID NO: 2029230 - RNA, 23 nt, Homo sapiens
gaagaugacgaguaacuccccuc

SEQ ID NO: 2029231 - RNA, 13 nt, Homo sapiens
uuugccagugccu

SEQ ID NO: 2029232 - RNA, 19 nt, Homo sapiens
gagugucacugagcugugu

SEQ ID NO: 2029233 - RNA, 23 nt, Homo sapiens
aaaacuuggaauucucucaccuc

SEQ ID NO: 2029234 - RNA, 21 nt, Homo sapiens
aguuucugauuuuuauucuca

SEQ ID NO: 2029235 - RNA, 22 nt, Homo sapiens
acucugccuacuucugagcaaa

SEQ ID NO: 2029236 - RNA, 21 nt, Homo sapiens
cagcauuauuugaaaacacug

SEQ ID NO: 2029237 - RNA, 19 nt, Homo sapiens
ucaccagacccgagucaau

SEQ ID NO: 2029238 - RNA, 15 nt, Homo sapiens
aaaauuaauaucaca

SEQ ID NO: 2029239 - RNA, 13 nt, Homo sapiens
gacauuaacucau

SEQ ID NO: 2029240 - RNA, 17 nt, Homo sapiens
uuaaaucucaaauuuau

SEQ ID NO: 2029241 - RNA, 18 nt, Homo sapiens
agagaccugcccucucug

SEQ ID NO: 2029242 - RNA, 20 nt, Homo sapiens
gcugcagguguuugaccucc

SEQ ID NO: 2029243 - RNA, 15 nt, Homo sapiens
cacaagaacaauuca

SEQ ID NO: 2029244 - RNA, 14 nt, Homo sapiens
accaccaagccaag

SEQ ID NO: 2029245 - RNA, 22 nt, Homo sapiens
aauucugccuuaaauaaaacug

SEQ ID NO: 2029246 - RNA, 19 nt, Homo sapiens
cugggccaagucaaagaca

SEQ ID NO: 2029247 - RNA, 23 nt, Homo sapiens
aucucaguauuuugaaauuguaa

SEQ ID NO: 2029248 - RNA, 21 nt, Homo sapiens
cccucugacuugacaagccuu

SEQ ID NO: 2029249 - RNA, 18 nt, Homo sapiens
uucauuuucugcaagccu

SEQ ID NO: 2029250 - RNA, 16 nt, Homo sapiens
aaagaucauuauuuaa

SEQ ID NO: 2029251 - RNA, 23 nt, Homo sapiens
cccacgugccugcuuaccugcca

SEQ ID NO: 2029252 - RNA, 22 nt, Homo sapiens
gcaugaucuuucugcaggaaau

SEQ ID NO: 2029253 - RNA, 20 nt, Homo sapiens
uauuacaccuuuaucucaag

SEQ ID NO: 2029254 - RNA, 20 nt, Homo sapiens
gcaacccaccaucuacccac

SEQ ID NO: 2029255 - RNA, 15 nt, Homo sapiens
augcacacgugugca

SEQ ID NO: 2029256 - RNA, 20 nt, Homo sapiens
gcagcuuuauguucauuugu

SEQ ID NO: 2029257 - RNA, 23 nt, Homo sapiens
uccagcuucugguacucuccuag

SEQ ID NO: 2029258 - RNA, 16 nt, Homo sapiens
gcuagcuuuccuuuac

SEQ ID NO: 2029259 - RNA, 23 nt, Homo sapiens
auuuuuuuaagacagagucucac

SEQ ID NO: 2029260 - RNA, 16 nt, Homo sapiens
aggaaauauugagaga

SEQ ID NO: 2029261 - RNA, 16 nt, Homo sapiens
cuuguggcauauccau

SEQ ID NO: 2029262 - RNA, 19 nt, Homo sapiens
uccuagccuuauccucuga

SEQ ID NO: 2029263 - RNA, 19 nt, Homo sapiens
ccugcccagaucccagaag

SEQ ID NO: 2029264 - RNA, 19 nt, Homo sapiens
uuuucguguaucucuaugu

SEQ ID NO: 2029265 - RNA, 19 nt, Homo sapiens
guaaaguuuauuacuuuau

SEQ ID NO: 2029266 - RNA, 20 nt, Homo sapiens
agggagaaacuucugcucag

SEQ ID NO: 2029267 - RNA, 15 nt, Homo sapiens
aaaaaucccaaacaa

SEQ ID NO: 2029268 - RNA, 23 nt, Homo sapiens
ucuagacaagauauuguacauaa

SEQ ID NO: 2029269 - RNA, 22 nt, Homo sapiens
ucuucucucccacgugcacagc

SEQ ID NO: 2029270 - RNA, 21 nt, Homo sapiens
ccaagggcagaucacagguua

SEQ ID NO: 2029271 - RNA, 13 nt, Homo sapiens
ugcuuaaucugag

SEQ ID NO: 2029272 - RNA, 12 nt, Homo sapiens
auggaccacagu

SEQ ID NO: 2029273 - RNA, 17 nt, Homo sapiens
aauccauuucaggacuc

SEQ ID NO: 2029274 - RNA, 22 nt, Homo sapiens
aggauucucaccagcugugucc

SEQ ID NO: 2029275 - RNA, 16 nt, Homo sapiens
ugucuugagcucuaaa

SEQ ID NO: 2029276 - RNA, 22 nt, Homo sapiens
ugaaacuuuaauucuuuuauca

SEQ ID NO: 2029277 - RNA, 22 nt, Homo sapiens
agcaaagaggacucgcuuguaa

SEQ ID NO: 2029278 - RNA, 16 nt, Homo sapiens
cuaguauaucagugac

SEQ ID NO: 2029279 - RNA, 23 nt, Homo sapiens
cgaaagccucucaguacagcacu

SEQ ID NO: 2029280 - RNA, 21 nt, Homo sapiens
gcccucaccccugguucucau

SEQ ID NO: 2029281 - RNA, 13 nt, Homo sapiens
cccucagacuggg

SEQ ID NO: 2029282 - RNA, 19 nt, Homo sapiens
gcauuugugcccacucucc

SEQ ID NO: 2029283 - RNA, 20 nt, Homo sapiens
uuaguguucaaauacuucaa

SEQ ID NO: 2029284 - RNA, 24 nt, Homo sapiens
ucugcuuaauacaucuacaaccau

SEQ ID NO: 2029285 - RNA, 14 nt, Homo sapiens
aagaauuuaucucu

SEQ ID NO: 2029286 - RNA, 20 nt, Homo sapiens
uguuacuuuuucuuguauuc

SEQ ID NO: 2029287 - RNA, 23 nt, Homo sapiens
uuucccccuccucagauggggca

SEQ ID NO: 2029288 - RNA, 22 nt, Homo sapiens
gccuccugauguuuguaucaua

SEQ ID NO: 2029289 - RNA, 21 nt, Homo sapiens
agugggcugcuagaagcacga

SEQ ID NO: 2029290 - RNA, 19 nt, Homo sapiens
ccaaagcuugccacuuucc

SEQ ID NO: 2029291 - RNA, 21 nt, Homo sapiens
gugcuauuaggaaauucugau

SEQ ID NO: 2029292 - RNA, 19 nt, Homo sapiens
cuaucauaauucagcacuu

SEQ ID NO: 2029293 - RNA, 15 nt, Homo sapiens
auuguaaaacuaucu

SEQ ID NO: 2029294 - RNA, 22 nt, Homo sapiens
caggaccaccacuuauagggua

SEQ ID NO: 2029295 - RNA, 16 nt, Homo sapiens
uguaauguaacagcaa

SEQ ID NO: 2029296 - RNA, 22 nt, Homo sapiens
cuaacacuuuaguuauauucac

SEQ ID NO: 2029297 - RNA, 21 nt, Homo sapiens
uccugcucccagcgcacacaa

SEQ ID NO: 2029298 - RNA, 16 nt, Homo sapiens
uuuuuguaaagccaag

SEQ ID NO: 2029299 - RNA, 22 nt, Homo sapiens
agaagugggugggcacacugaa

SEQ ID NO: 2029300 - RNA, 14 nt, Homo sapiens
cagaauuguccuca

SEQ ID NO: 2029301 - RNA, 17 nt, Homo sapiens
ucagucuuuuccaugaa

SEQ ID NO: 2029302 - RNA, 20 nt, Homo sapiens
ucaguguugacauagccuuu

SEQ ID NO: 2029303 - RNA, 17 nt, Homo sapiens
cuguaacauauucugua

SEQ ID NO: 2029304 - RNA, 14 nt, Homo sapiens
uccuuccacuucag

SEQ ID NO: 2029305 - RNA, 23 nt, Homo sapiens
ugucaauugauauuucuguguag

SEQ ID NO: 2029306 - RNA, 18 nt, Homo sapiens
cagugugugaaaauucag

SEQ ID NO: 2029307 - RNA, 16 nt, Homo sapiens
aaauacaaaacuucca

SEQ ID NO: 2029308 - RNA, 16 nt, Homo sapiens
ucaaauauuccauucu

SEQ ID NO: 2029309 - RNA, 16 nt, Homo sapiens
gcauaucugccuuuau

SEQ ID NO: 2029310 - RNA, 11 nt, Homo sapiens
aaugugcuguu

SEQ ID NO: 2029311 - RNA, 11 nt, Homo sapiens
aaagugcugua

SEQ ID NO: 2029312 - RNA, 16 nt, Homo sapiens
cuccucgucuuugaac

SEQ ID NO: 2029313 - RNA, 14 nt, Homo sapiens
acgugagccaggua

SEQ ID NO: 2029314 - RNA, 19 nt, Homo sapiens
cacagcuucucuacagacu

SEQ ID NO: 2029315 - RNA, 17 nt, Homo sapiens
ugcaaacaaaaugaugg

SEQ ID NO: 2029316 - RNA, 19 nt, Homo sapiens
auuuaugagaaaguucuca

SEQ ID NO: 2029317 - RNA, 11 nt, Homo sapiens
gugaacacugg

SEQ ID NO: 2029318 - RNA, 14 nt, Homo sapiens
agaaacuauaugca

SEQ ID NO: 2029319 - RNA, 21 nt, Homo sapiens
guucuauauaaaaaacauaau

SEQ ID NO: 2029320 - RNA, 19 nt, Homo sapiens
cugaguuuagggucaagga

SEQ ID NO: 2029321 - RNA, 23 nt, Homo sapiens
aaaucauguuuuuucugcaauga

SEQ ID NO: 2029322 - RNA, 20 nt, Homo sapiens
auaaaguuggccauguauua

SEQ ID NO: 2029323 - RNA, 16 nt, Homo sapiens
guuggaaagaacauuu

SEQ ID NO: 2029324 - RNA, 13 nt, Homo sapiens
agccaggacaucu

SEQ ID NO: 2029325 - RNA, 17 nt, Homo sapiens
gaguugccagggaagaa

SEQ ID NO: 2029326 - RNA, 14 nt, Homo sapiens
aaccuuugggccaa

SEQ ID NO: 2029327 - RNA, 18 nt, Homo sapiens
aacagugugcucauagaa

SEQ ID NO: 2029328 - RNA, 15 nt, Homo sapiens
uggacauaagacaga

SEQ ID NO: 2029329 - RNA, 12 nt, Homo sapiens
accagugacuuu

SEQ ID NO: 2029330 - RNA, 20 nt, Homo sapiens
uccugagggguauccuccua

SEQ ID NO: 2029331 - RNA, 17 nt, Homo sapiens
caccccagagugggaga

SEQ ID NO: 2029332 - RNA, 12 nt, Homo sapiens
agauggggacca

SEQ ID NO: 2029333 - RNA, 15 nt, Homo sapiens
aaauuccagaaugaa

SEQ ID NO: 2029334 - RNA, 18 nt, Homo sapiens
ucccuauucguagccauc

SEQ ID NO: 2029335 - RNA, 12 nt, Homo sapiens
cuagauacugga

SEQ ID NO: 2029336 - RNA, 22 nt, Homo sapiens
gcauguaguuaacaauuuugca

SEQ ID NO: 2029337 - RNA, 18 nt, Homo sapiens
caaugcugucugguugcg

SEQ ID NO: 2029338 - RNA, 11 nt, Homo sapiens
uuuucuuuaac

SEQ ID NO: 2029339 - RNA, 16 nt, Homo sapiens
gauucaucauuuucuc

SEQ ID NO: 2029340 - RNA, 22 nt, Homo sapiens
ccaacugcaagucacaaaggaa

SEQ ID NO: 2029341 - RNA, 19 nt, Homo sapiens
acaagugcuguugggauau

SEQ ID NO: 2029342 - RNA, 14 nt, Homo sapiens
gagaacacuagaca

SEQ ID NO: 2029343 - RNA, 14 nt, Homo sapiens
caucugcucugaga

SEQ ID NO: 2029344 - RNA, 13 nt, Homo sapiens
aaugcaguccuga

SEQ ID NO: 2029345 - RNA, 22 nt, Homo sapiens
ccaggugggacuuagcagugag

SEQ ID NO: 2029346 - RNA, 21 nt, Homo sapiens
gaagaaauccauaacaccccc

SEQ ID NO: 2029347 - RNA, 21 nt, Homo sapiens
aaugcauagagcccuggccag

SEQ ID NO: 2029348 - RNA, 22 nt, Homo sapiens
cuugaaauaccagugaaccaaa

SEQ ID NO: 2029349 - RNA, 19 nt, Homo sapiens
cugccuugguauagcauau

SEQ ID NO: 2029350 - RNA, 21 nt, Homo sapiens
uggacuugauagcaaacacug

SEQ ID NO: 2029351 - RNA, 10 nt, Homo sapiens
aauucaccuc

SEQ ID NO: 2029352 - RNA, 14 nt, Homo sapiens
caccaaguucucau

SEQ ID NO: 2029353 - RNA, 19 nt, Homo sapiens
auugcuauuuauuuuuaca

SEQ ID NO: 2029354 - RNA, 15 nt, Homo sapiens
aggaagguggugcuu

SEQ ID NO: 2029355 - RNA, 17 nt, Homo sapiens
ggaauguaugugcacau

SEQ ID NO: 2029356 - RNA, 17 nt, Homo sapiens
gaguagaauugcauuga

SEQ ID NO: 2029357 - RNA, 13 nt, Homo sapiens
aggacacuuccug

SEQ ID NO: 2029358 - RNA, 21 nt, Homo sapiens
uauuuaugagaaaguucucau

SEQ ID NO: 2029359 - RNA, 19 nt, Homo sapiens
acccuaugauuuauucccu

SEQ ID NO: 2029360 - RNA, 23 nt, Homo sapiens
aaccucagggcucccaggggucu

SEQ ID NO: 2029361 - RNA, 19 nt, Homo sapiens
ugaagugcuuaguguacuu

SEQ ID NO: 2029362 - RNA, 16 nt, Homo sapiens
acacauauauacauac

SEQ ID NO: 2029363 - RNA, 17 nt, Homo sapiens
uucauuuucucuaauau

SEQ ID NO: 2029364 - RNA, 16 nt, Homo sapiens
auugcaccacugcacu

SEQ ID NO: 2029365 - RNA, 16 nt, Homo sapiens
uccucccccaguuccu

SEQ ID NO: 2029366 - RNA, 19 nt, Homo sapiens
uccacacuuccugagccag

SEQ ID NO: 2029367 - RNA, 23 nt, Homo sapiens
ugaguccauguccuaugccucac

SEQ ID NO: 2029368 - RNA, 14 nt, Homo sapiens
ccaaauguguauaa

SEQ ID NO: 2029369 - RNA, 18 nt, Homo sapiens
aaaauaaaauauacccau

SEQ ID NO: 2029370 - RNA, 23 nt, Homo sapiens
gguccccccacagcuccaggaca

SEQ ID NO: 2029371 - RNA, 22 nt, Homo sapiens
caguuugcaguauacacacuuu

SEQ ID NO: 2029372 - RNA, 19 nt, Homo sapiens
ggaaacuggaugaggucau

SEQ ID NO: 2029373 - RNA, 23 nt, Homo sapiens
cagggucucacuauauugcucag

SEQ ID NO: 2029374 - RNA, 16 nt, Homo sapiens
uaaacucugcacuuau

SEQ ID NO: 2029375 - RNA, 16 nt, Homo sapiens
uacacccugcccucau

SEQ ID NO: 2029376 - RNA, 16 nt, Homo sapiens
ccuaaacuguaucaua

SEQ ID NO: 2029377 - RNA, 18 nt, Homo sapiens
caaaauuaauacauucua

SEQ ID NO: 2029378 - RNA, 17 nt, Homo sapiens
guaccuauuuggugcua

SEQ ID NO: 2029379 - RNA, 22 nt, Homo sapiens
uuagagagauuggccagcaaaa

SEQ ID NO: 2029380 - RNA, 15 nt, Homo sapiens
cccugugccaucacc

SEQ ID NO: 2029381 - RNA, 15 nt, Homo sapiens
ccucaccccacugug

SEQ ID NO: 2029382 - RNA, 17 nt, Homo sapiens
agauaugcaaauggcua

SEQ ID NO: 2029383 - RNA, 22 nt, Homo sapiens
ucaugagggcuggaugcucucg

SEQ ID NO: 2029384 - RNA, 20 nt, Homo sapiens
cuacacccuuggacuugagg

SEQ ID NO: 2029385 - RNA, 13 nt, Homo sapiens
cuguucuagggaa

SEQ ID NO: 2029386 - RNA, 22 nt, Homo sapiens
auaguuuggcuauaagugcuca

SEQ ID NO: 2029387 - RNA, 23 nt, Homo sapiens
uuaucauauugauacaaacugug

SEQ ID NO: 2029388 - RNA, 23 nt, Homo sapiens
cuuuuuuuuucaccugaaacacu

SEQ ID NO: 2029389 - RNA, 16 nt, Homo sapiens
cuugguaaacaacaga

SEQ ID NO: 2029390 - RNA, 13 nt, Homo sapiens
cugcuccacccuu

SEQ ID NO: 2029391 - RNA, 20 nt, Homo sapiens
uccauggcuaagaccacaga

SEQ ID NO: 2029392 - RNA, 15 nt, Homo sapiens
cucuaauguacaaua

SEQ ID NO: 2029393 - RNA, 23 nt, Homo sapiens
agcccagccugcauacuugccac

SEQ ID NO: 2029394 - RNA, 17 nt, Homo sapiens
aacccaauuuuguuuca

SEQ ID NO: 2029395 - RNA, 14 nt, Homo sapiens
agucuggggaccag

SEQ ID NO: 2029396 - RNA, 13 nt, Homo sapiens
uauauauuacaag

SEQ ID NO: 2029397 - RNA, 18 nt, Homo sapiens
cagacauacaaacauaag

SEQ ID NO: 2029398 - RNA, 22 nt, Homo sapiens
ugcccuuggccugaagucccag

SEQ ID NO: 2029399 - RNA, 17 nt, Homo sapiens
ucugcauccagagauuc

SEQ ID NO: 2029400 - RNA, 18 nt, Homo sapiens
caacucugagaucuaagg

SEQ ID NO: 2029401 - RNA, 13 nt, Homo sapiens
aauacccacugcc

SEQ ID NO: 2029402 - RNA, 20 nt, Homo sapiens
auuuaguaaaauuaucuguu

SEQ ID NO: 2029403 - RNA, 15 nt, Homo sapiens
uaugccaaaauauca

SEQ ID NO: 2029404 - RNA, 21 nt, Homo sapiens
gcggggacucgguaagcacuu

SEQ ID NO: 2029405 - RNA, 23 nt, Homo sapiens
ucuguggguuucuaaagcugcca

SEQ ID NO: 2029406 - RNA, 17 nt, Homo sapiens
uguaucaccucuucaca

SEQ ID NO: 2029407 - RNA, 14 nt, Homo sapiens
aggacaaccugcug

SEQ ID NO: 2029408 - RNA, 23 nt, Homo sapiens
agggauaggaagugccccagggu

SEQ ID NO: 2029409 - RNA, 15 nt, Homo sapiens
ugaucacacaguguu

SEQ ID NO: 2029410 - RNA, 21 nt, Homo sapiens
cuguaacugucaccugaaaua

SEQ ID NO: 2029411 - RNA, 13 nt, Homo sapiens
gaucucccuuaau

SEQ ID NO: 2029412 - RNA, 18 nt, Homo sapiens
caaauaggaucauaugaa

SEQ ID NO: 2029413 - RNA, 17 nt, Homo sapiens
ucugugaccugucagaa

SEQ ID NO: 2029414 - RNA, 14 nt, Homo sapiens
auaugacugauuac

SEQ ID NO: 2029415 - RNA, 21 nt, Homo sapiens
cugauauuuacuggaaaccua

SEQ ID NO: 2029416 - RNA, 17 nt, Homo sapiens
agugccuggccaaaggg

SEQ ID NO: 2029417 - RNA, 14 nt, Homo sapiens
gugguucauuccac

SEQ ID NO: 2029418 - RNA, 24 nt, Homo sapiens
ucauacaaaggacaguacacacuu

SEQ ID NO: 2029419 - RNA, 21 nt, Homo sapiens
caguccuaccugagcaacaag

SEQ ID NO: 2029420 - RNA, 19 nt, Homo sapiens
aaaauauaugacuuugaau

SEQ ID NO: 2029421 - RNA, 21 nt, Homo sapiens
cacauuaaaggaaaaauagca

SEQ ID NO: 2029422 - RNA, 11 nt, Homo sapiens
aaugugucauc

SEQ ID NO: 2029423 - RNA, 23 nt, Homo sapiens
cucugucuugggcguuugaacuc

SEQ ID NO: 2029424 - RNA, 18 nt, Homo sapiens
ccugauauaucaaacuga

SEQ ID NO: 2029425 - RNA, 17 nt, Homo sapiens
ccaacagagcugggcua

SEQ ID NO: 2029426 - RNA, 22 nt, Homo sapiens
acuucuaguuuggcauuucaca

SEQ ID NO: 2029427 - RNA, 21 nt, Homo sapiens
ucaacaaguaacuuuguagaa

SEQ ID NO: 2029428 - RNA, 16 nt, Homo sapiens
cuggauugcagacuca

SEQ ID NO: 2029429 - RNA, 17 nt, Homo sapiens
cuuuguggcaguggcca

SEQ ID NO: 2029430 - RNA, 16 nt, Homo sapiens
cagugaaucuguuuca

SEQ ID NO: 2029431 - RNA, 16 nt, Homo sapiens
ucaggccccgccccau

SEQ ID NO: 2029432 - RNA, 23 nt, Homo sapiens
cccaaauccuuagaucuggcaug

SEQ ID NO: 2029433 - RNA, 14 nt, Homo sapiens
gugcugggaggucc

SEQ ID NO: 2029434 - RNA, 14 nt, Homo sapiens
ugcauaaccuuuac

SEQ ID NO: 2029435 - RNA, 16 nt, Homo sapiens
cuuuccaucuaucacu

SEQ ID NO: 2029436 - RNA, 15 nt, Homo sapiens
ccagacaaaaagcua

SEQ ID NO: 2029437 - RNA, 20 nt, Homo sapiens
gauucccugauggaaccaua

SEQ ID NO: 2029438 - RNA, 16 nt, Homo sapiens
uuaaaugacaauuuau

SEQ ID NO: 2029439 - RNA, 13 nt, Homo sapiens
gacuacaaccaau

SEQ ID NO: 2029440 - RNA, 13 nt, Homo sapiens
cacuucaagcaaa

SEQ ID NO: 2029441 - RNA, 20 nt, Homo sapiens
aggguccucaguccacugcu

SEQ ID NO: 2029442 - RNA, 17 nt, Homo sapiens
uauugauucaccuccua

SEQ ID NO: 2029443 - RNA, 22 nt, Homo sapiens
aauccuguccucagcuucuuaa

SEQ ID NO: 2029444 - RNA, 12 nt, Homo sapiens
uuccaguguuug

SEQ ID NO: 2029445 - RNA, 20 nt, Homo sapiens
aaccaagcauuuuggaauga

SEQ ID NO: 2029446 - RNA, 20 nt, Homo sapiens
gcacuuacagcucuggccac

SEQ ID NO: 2029447 - RNA, 15 nt, Homo sapiens
acuguucuugcugcu

SEQ ID NO: 2029448 - RNA, 21 nt, Homo sapiens
caagggcuuuguuuugcacac

SEQ ID NO: 2029449 - RNA, 22 nt, Homo sapiens
cuuuaaucuccuauuccuucac

SEQ ID NO: 2029450 - RNA, 17 nt, Homo sapiens
gaauauuaugcccaguu

SEQ ID NO: 2029451 - RNA, 21 nt, Homo sapiens
cucuccuugccuggugaccua

SEQ ID NO: 2029452 - RNA, 15 nt, Homo sapiens
auuucuacuuugaua

SEQ ID NO: 2029453 - RNA, 15 nt, Homo sapiens
ucaucuucacagauu

SEQ ID NO: 2029454 - RNA, 13 nt, Homo sapiens
gaaaaccagcgca

SEQ ID NO: 2029455 - RNA, 12 nt, Homo sapiens
acaugacuguuu

SEQ ID NO: 2029456 - RNA, 14 nt, Homo sapiens
agaacaauauaguc

SEQ ID NO: 2029457 - RNA, 23 nt, Homo sapiens
ugauuuuuugcugcagacucauc

SEQ ID NO: 2029458 - RNA, 19 nt, Homo sapiens
cugagauagcuuagugucu

SEQ ID NO: 2029459 - RNA, 15 nt, Homo sapiens
uggaauucuacugga

SEQ ID NO: 2029460 - RNA, 15 nt, Homo sapiens
augugacgcacugua

SEQ ID NO: 2029461 - RNA, 22 nt, Homo sapiens
ugccuuccccagggugucucua

SEQ ID NO: 2029462 - RNA, 22 nt, Homo sapiens
aagaauuuucagcaaaguacaa

SEQ ID NO: 2029463 - RNA, 14 nt, Homo sapiens
aaaagcugccugga

SEQ ID NO: 2029464 - RNA, 20 nt, Homo sapiens
acuaccuaacauuauuuauu

SEQ ID NO: 2029465 - RNA, 18 nt, Homo sapiens
ggccacaccgagacacca

SEQ ID NO: 2029466 - RNA, 12 nt, Homo sapiens
gauacagucucc

SEQ ID NO: 2029467 - RNA, 15 nt, Homo sapiens
ugggggaggcccaau

SEQ ID NO: 2029468 - RNA, 12 nt, Homo sapiens
caacauagugaa

SEQ ID NO: 2029469 - RNA, 18 nt, Homo sapiens
aagccauagggggcugca

SEQ ID NO: 2029470 - RNA, 22 nt, Homo sapiens
acagcuuucuugcucccuucag

SEQ ID NO: 2029471 - RNA, 17 nt, Homo sapiens
guggaucccagcuuggu

SEQ ID NO: 2029472 - RNA, 17 nt, Homo sapiens
ugugaccuuugucuaga

SEQ ID NO: 2029473 - RNA, 21 nt, Homo sapiens
ugcaggggaugguguggucaa

SEQ ID NO: 2029474 - RNA, 12 nt, Homo sapiens
cuggagccucag

SEQ ID NO: 2029475 - RNA, 12 nt, Homo sapiens
cugcagccucac

SEQ ID NO: 2029476 - RNA, 20 nt, Homo sapiens
cuuccaucccaggacaccac

SEQ ID NO: 2029477 - RNA, 15 nt, Homo sapiens
ccucagguucaauau

SEQ ID NO: 2029478 - RNA, 18 nt, Homo sapiens
ucaccuagcugcucucua

SEQ ID NO: 2029479 - RNA, 14 nt, Homo sapiens
gcaaugauuacucu

SEQ ID NO: 2029480 - RNA, 22 nt, Homo sapiens
gagggcgcggggcggggagcga

SEQ ID NO: 2029481 - RNA, 18 nt, Homo sapiens
cuggccacugaaaagcuu

SEQ ID NO: 2029482 - RNA, 15 nt, Homo sapiens
uuugcaagagugaug

SEQ ID NO: 2029483 - RNA, 22 nt, Homo sapiens
uccuuccugccaccugcugcug

SEQ ID NO: 2029484 - RNA, 17 nt, Homo sapiens
aaucuaccuugcagugu

SEQ ID NO: 2029485 - RNA, 21 nt, Homo sapiens
guugacuuuccucccauuuua

SEQ ID NO: 2029486 - RNA, 17 nt, Homo sapiens
ugaauaaauccaaaaca

SEQ ID NO: 2029487 - RNA, 17 nt, Homo sapiens
augaaagaggcauuccc

SEQ ID NO: 2029488 - RNA, 16 nt, Homo sapiens
ucacagaauagcacaa

SEQ ID NO: 2029489 - RNA, 16 nt, Homo sapiens
cugggugccaguccau

SEQ ID NO: 2029490 - RNA, 21 nt, Homo sapiens
acaagaggcuucccuaguuua

SEQ ID NO: 2029491 - RNA, 12 nt, Homo sapiens
uucgcuugagaa

SEQ ID NO: 2029492 - RNA, 16 nt, Homo sapiens
gccacaggacugagcc

SEQ ID NO: 2029493 - RNA, 15 nt, Homo sapiens
gaguuccuucucacu

SEQ ID NO: 2029494 - RNA, 19 nt, Homo sapiens
cucaccuagccugaugaga

SEQ ID NO: 2029495 - RNA, 18 nt, Homo sapiens
ggaacaagaauugcuaaa

SEQ ID NO: 2029496 - RNA, 23 nt, Homo sapiens
gaaauaaagagcuguuauacugu

SEQ ID NO: 2029497 - RNA, 20 nt, Homo sapiens
caacuuagaaaccaaauuac

SEQ ID NO: 2029498 - RNA, 18 nt, Homo sapiens
aggcaauccuaccuugcu

SEQ ID NO: 2029499 - RNA, 17 nt, Homo sapiens
ggugcucuuucccuuua

SEQ ID NO: 2029500 - RNA, 14 nt, Homo sapiens
auauguguaucuca

SEQ ID NO: 2029501 - RNA, 18 nt, Homo sapiens
acuuuauaugaaaaggaa

SEQ ID NO: 2029502 - RNA, 15 nt, Homo sapiens
ugcuccuacuuucag

SEQ ID NO: 2029503 - RNA, 21 nt, Homo sapiens
ugauaaccaagaaugucucca

SEQ ID NO: 2029504 - RNA, 18 nt, Homo sapiens
cuccuccagcccacccaa

SEQ ID NO: 2029505 - RNA, 12 nt, Homo sapiens
caggauucuccu

SEQ ID NO: 2029506 - RNA, 22 nt, Homo sapiens
cuuaccuguugucugaaacaua

SEQ ID NO: 2029507 - RNA, 21 nt, Homo sapiens
cuuccaaauuugaauggauua

SEQ ID NO: 2029508 - RNA, 21 nt, Homo sapiens
acagaagccugaugcugacau

SEQ ID NO: 2029509 - RNA, 12 nt, Homo sapiens
uggccagccaua

SEQ ID NO: 2029510 - RNA, 15 nt, Homo sapiens
acaaaucauaaugua

SEQ ID NO: 2029511 - RNA, 17 nt, Homo sapiens
agaaaaccucaagggcu

SEQ ID NO: 2029512 - RNA, 23 nt, Homo sapiens
cugcacuauagccuaggugacag

SEQ ID NO: 2029513 - RNA, 18 nt, Homo sapiens
ggaacaggagugacucug

SEQ ID NO: 2029514 - RNA, 18 nt, Homo sapiens
gcaucggacaagaccccc

SEQ ID NO: 2029515 - RNA, 19 nt, Homo sapiens
cuauagaaaacgauuuuga

SEQ ID NO: 2029516 - RNA, 20 nt, Homo sapiens
uaauucauaaaucacaaaua

SEQ ID NO: 2029517 - RNA, 17 nt, Homo sapiens
ccugucacacacuggac

SEQ ID NO: 2029518 - RNA, 12 nt, Homo sapiens
auauuuuccaua

SEQ ID NO: 2029519 - RNA, 20 nt, Homo sapiens
auucugucuggcauuacaau

SEQ ID NO: 2029520 - RNA, 23 nt, Homo sapiens
gagcuggggugcacuggggaccc

SEQ ID NO: 2029521 - RNA, 20 nt, Homo sapiens
acgaaguguugcauggaugu

SEQ ID NO: 2029522 - RNA, 16 nt, Homo sapiens
gcccucccucccucca

SEQ ID NO: 2029523 - RNA, 16 nt, Homo sapiens
aggaaucauucuguaa

SEQ ID NO: 2029524 - RNA, 20 nt, Homo sapiens
gccuugagucaucuauucaa

SEQ ID NO: 2029525 - RNA, 16 nt, Homo sapiens
agaacaguuucaucag

SEQ ID NO: 2029526 - RNA, 17 nt, Homo sapiens
gcccugacccuguggaa

SEQ ID NO: 2029527 - RNA, 17 nt, Homo sapiens
cugaaaauuuaucaugu

SEQ ID NO: 2029528 - RNA, 13 nt, Homo sapiens
ccucucacuuugg

SEQ ID NO: 2029529 - RNA, 21 nt, Homo sapiens
guccccuacccccaguaaaau

SEQ ID NO: 2029530 - RNA, 22 nt, Homo sapiens
guuuguaacuuuuuacauuaca

SEQ ID NO: 2029531 - RNA, 22 nt, Homo sapiens
augagguccuucuguagugcca

SEQ ID NO: 2029532 - RNA, 15 nt, Homo sapiens
aaauagggcuuuuaa

SEQ ID NO: 2029533 - RNA, 16 nt, Homo sapiens
cuggugucaccccaga

SEQ ID NO: 2029534 - RNA, 22 nt, Homo sapiens
ccauacguucagaggugcagcu

SEQ ID NO: 2029535 - RNA, 15 nt, Homo sapiens
acauaucccuuccag

SEQ ID NO: 2029536 - RNA, 15 nt, Homo sapiens
caacuuguuuuccca

SEQ ID NO: 2029537 - RNA, 22 nt, Homo sapiens
aucaccaaucauaguguaccca

SEQ ID NO: 2029538 - RNA, 14 nt, Homo sapiens
cagugguguuacau

SEQ ID NO: 2029539 - RNA, 21 nt, Homo sapiens
caucccccaaggaugaaauca

SEQ ID NO: 2029540 - RNA, 21 nt, Homo sapiens
agcuuccagugcauguugcca

SEQ ID NO: 2029541 - RNA, 21 nt, Homo sapiens
gcaggaacccuuggucacaug

SEQ ID NO: 2029542 - RNA, 18 nt, Homo sapiens
uuacaaauggacauagga

SEQ ID NO: 2029543 - RNA, 23 nt, Homo sapiens
ccagcaggauggcaggggcaaag

SEQ ID NO: 2029544 - RNA, 18 nt, Homo sapiens
acguggaugaagcagaga

SEQ ID NO: 2029545 - RNA, 19 nt, Homo sapiens
gcccagaccacugucucca

SEQ ID NO: 2029546 - RNA, 22 nt, Homo sapiens
cgagacuccaccucuaccaaaa

SEQ ID NO: 2029547 - RNA, 21 nt, Homo sapiens
accuaugagauggccaugcuc

SEQ ID NO: 2029548 - RNA, 20 nt, Homo sapiens
cuuacaauuggcacuaaaga

SEQ ID NO: 2029549 - RNA, 22 nt, Homo sapiens
augaaaugaauuuacagaacag

SEQ ID NO: 2029550 - RNA, 15 nt, Homo sapiens
ugacaauacaaauac

SEQ ID NO: 2029551 - RNA, 16 nt, Homo sapiens
auuuagggaaagguag

SEQ ID NO: 2029552 - RNA, 18 nt, Homo sapiens
aauauauggcauuugcag

SEQ ID NO: 2029553 - RNA, 22 nt, Homo sapiens
uuuugggcuuucauaguguuca

SEQ ID NO: 2029554 - RNA, 15 nt, Homo sapiens
ucugccccagcuuua

SEQ ID NO: 2029555 - RNA, 21 nt, Homo sapiens
aggaaaacugagacucagaca

SEQ ID NO: 2029556 - RNA, 22 nt, Homo sapiens
cuacagaguguuauaacaccau

SEQ ID NO: 2029557 - RNA, 14 nt, Homo sapiens
aaauauauaugugu

SEQ ID NO: 2029558 - RNA, 14 nt, Homo sapiens
cgugacaacaugcg

SEQ ID NO: 2029559 - RNA, 18 nt, Homo sapiens
ugcaagcuccaguagcuc

SEQ ID NO: 2029560 - RNA, 16 nt, Homo sapiens
gcuuauggauucauau

SEQ ID NO: 2029561 - RNA, 17 nt, Homo sapiens
caauaaggauuuauucu

SEQ ID NO: 2029562 - RNA, 22 nt, Homo sapiens
cugggaacaacuucaguccaac

SEQ ID NO: 2029563 - RNA, 12 nt, Homo sapiens
uccacucugagg

SEQ ID NO: 2029564 - RNA, 15 nt, Homo sapiens
auaacagcuuucuua

SEQ ID NO: 2029565 - RNA, 11 nt, Homo sapiens
aucucugggcu

SEQ ID NO: 2029566 - RNA, 23 nt, Homo sapiens
aaucagaauaaauuaauauugua

SEQ ID NO: 2029567 - RNA, 17 nt, Homo sapiens
uucuaaaagagaaggaa

SEQ ID NO: 2029568 - RNA, 22 nt, Homo sapiens
ucccgcuucugaagcugcugca

SEQ ID NO: 2029569 - RNA, 14 nt, Homo sapiens
gagaaggccuggaa

SEQ ID NO: 2029570 - RNA, 22 nt, Homo sapiens
gccuggucaauaaaccacuguu

SEQ ID NO: 2029571 - RNA, 18 nt, Homo sapiens
acuaaagacgguauuaaa

SEQ ID NO: 2029572 - RNA, 13 nt, Homo sapiens
cuuuuugccaaau

SEQ ID NO: 2029573 - RNA, 22 nt, Homo sapiens
acagcagagcuagguggaaaag

SEQ ID NO: 2029574 - RNA, 12 nt, Homo sapiens
ucucacacuccu

SEQ ID NO: 2029575 - RNA, 14 nt, Homo sapiens
gaucuagaagggac

SEQ ID NO: 2029576 - RNA, 20 nt, Homo sapiens
uggaggaucauuugagccca

SEQ ID NO: 2029577 - RNA, 11 nt, Homo sapiens
uccagugccag

SEQ ID NO: 2029578 - RNA, 13 nt, Homo sapiens
gcccuugagggag

SEQ ID NO: 2029579 - RNA, 22 nt, Homo sapiens
agaggauaaggaggcacugcug

SEQ ID NO: 2029580 - RNA, 21 nt, Homo sapiens
cgccacucccgggccaagaca

SEQ ID NO: 2029581 - RNA, 21 nt, Homo sapiens
accagaccuguucugaccuca

SEQ ID NO: 2029582 - RNA, 14 nt, Homo sapiens
cagcccugaaggca

SEQ ID NO: 2029583 - RNA, 23 nt, Homo sapiens
agggggccuugcggaagccauag

SEQ ID NO: 2029584 - RNA, 21 nt, Homo sapiens
ucuucacuugaguuggcugug

SEQ ID NO: 2029585 - RNA, 23 nt, Homo sapiens
ggcaaaggaaauugucaucugcc

SEQ ID NO: 2029586 - RNA, 13 nt, Homo sapiens
acuuaaagcaaaa

SEQ ID NO: 2029587 - RNA, 15 nt, Homo sapiens
cacuccacucagguu

SEQ ID NO: 2029588 - RNA, 19 nt, Homo sapiens
cccgugagcgccugugcac

SEQ ID NO: 2029589 - RNA, 18 nt, Homo sapiens
cacuaauggggcggugag

SEQ ID NO: 2029590 - RNA, 15 nt, Homo sapiens
ugccugaagucacac

SEQ ID NO: 2029591 - RNA, 15 nt, Homo sapiens
uaggauugacauacc

SEQ ID NO: 2029592 - RNA, 15 nt, Homo sapiens
gccacgaacacgcau

SEQ ID NO: 2029593 - RNA, 14 nt, Homo sapiens
aagaugauccuucu

SEQ ID NO: 2029594 - RNA, 21 nt, Homo sapiens
ugcugcugaccugaucaccuc

SEQ ID NO: 2029595 - RNA, 15 nt, Homo sapiens
gacaggaaaggcccu

SEQ ID NO: 2029596 - RNA, 22 nt, Homo sapiens
gugauuuuggccacacugucaa

SEQ ID NO: 2029597 - RNA, 13 nt, Homo sapiens
cucuugaggcaca

SEQ ID NO: 2029598 - RNA, 15 nt, Homo sapiens
auucagaauuauaca

SEQ ID NO: 2029599 - RNA, 18 nt, Homo sapiens
acaugaaugcagucaugc

SEQ ID NO: 2029600 - RNA, 20 nt, Homo sapiens
aguauucucuuuucaagaag

SEQ ID NO: 2029601 - RNA, 14 nt, Homo sapiens
accaaauaguuugu

SEQ ID NO: 2029602 - RNA, 15 nt, Homo sapiens
ugauguuaaccaaug

SEQ ID NO: 2029603 - RNA, 14 nt, Homo sapiens
gaaugugcuuugua

SEQ ID NO: 2029604 - RNA, 19 nt, Homo sapiens
cagucggcacagugcagca

SEQ ID NO: 2029605 - RNA, 17 nt, Homo sapiens
uuucagauuuauuuccc

SEQ ID NO: 2029606 - RNA, 15 nt, Homo sapiens
ucacuguguccaggu

SEQ ID NO: 2029607 - RNA, 14 nt, Homo sapiens
ucuaaugugcauua

SEQ ID NO: 2029608 - RNA, 15 nt, Homo sapiens
cucagcaccccuguc

SEQ ID NO: 2029609 - RNA, 21 nt, Homo sapiens
acaaaacuuccucaaugcauu

SEQ ID NO: 2029610 - RNA, 14 nt, Homo sapiens
gcucagaccagcuc

SEQ ID NO: 2029611 - RNA, 16 nt, Homo sapiens
ccgggcccgggcacug

SEQ ID NO: 2029612 - RNA, 16 nt, Homo sapiens
cuucuccuccaugaac

SEQ ID NO: 2029613 - RNA, 22 nt, Homo sapiens
aaggcauguggccuuuaucuca

SEQ ID NO: 2029614 - RNA, 18 nt, Homo sapiens
cuaugccuuuuguagcug

SEQ ID NO: 2029615 - RNA, 20 nt, Homo sapiens
cgccuccaacccuagcaaaa

SEQ ID NO: 2029616 - RNA, 18 nt, Homo sapiens
gcaguuucaaguaccaaa

SEQ ID NO: 2029617 - RNA, 23 nt, Homo sapiens
uuuaaaaaaaaaaaaaaagccaa

SEQ ID NO: 2029618 - RNA, 22 nt, Homo sapiens
aacuauuuauuuuuucuaagug

SEQ ID NO: 2029619 - RNA, 21 nt, Homo sapiens
ggcauucauauuucauauuca

SEQ ID NO: 2029620 - RNA, 19 nt, Homo sapiens
accucagggacaacauuuu

SEQ ID NO: 2029621 - RNA, 17 nt, Homo sapiens
ccuuuuggucuucagcc

SEQ ID NO: 2029622 - RNA, 17 nt, Homo sapiens
aucccugguuccuagca

SEQ ID NO: 2029623 - RNA, 21 nt, Homo sapiens
gcccacuucccguuuccucuu

SEQ ID NO: 2029624 - RNA, 17 nt, Homo sapiens
aggcuggagugcaaugg

SEQ ID NO: 2029625 - RNA, 17 nt, Homo sapiens
ccaggagccucacuggg

SEQ ID NO: 2029626 - RNA, 19 nt, Homo sapiens
agucuaguaguuucucugu

SEQ ID NO: 2029627 - RNA, 14 nt, Homo sapiens
uaaauaaacuaaua

SEQ ID NO: 2029628 - RNA, 14 nt, Homo sapiens
uugccaaacagcca

SEQ ID NO: 2029629 - RNA, 23 nt, Homo sapiens
uacaccucaauccuccauuugcu

SEQ ID NO: 2029630 - RNA, 20 nt, Homo sapiens
ccugccaugggcaaagccau

SEQ ID NO: 2029631 - RNA, 22 nt, Homo sapiens
ccauggccaccccagagccauc

SEQ ID NO: 2029632 - RNA, 20 nt, Homo sapiens
agcaggaacuucuagcucau

SEQ ID NO: 2029633 - RNA, 15 nt, Homo sapiens
ccccaaccaggcuaa

SEQ ID NO: 2029634 - RNA, 18 nt, Homo sapiens
ucacuaauacuuacuguu

SEQ ID NO: 2029635 - RNA, 22 nt, Homo sapiens
agaaauauaugcagcugugaua

SEQ ID NO: 2029636 - RNA, 14 nt, Homo sapiens
auucuaugacugaa

SEQ ID NO: 2029637 - RNA, 20 nt, Homo sapiens
ucuccccagagcugccugcu

SEQ ID NO: 2029638 - RNA, 22 nt, Homo sapiens
uuuuugacucccagaucaguca

SEQ ID NO: 2029639 - RNA, 21 nt, Homo sapiens
aagguuggcaacauuguacaa

SEQ ID NO: 2029640 - RNA, 22 nt, Homo sapiens
gauaugcaaauuccauagcuca

SEQ ID NO: 2029641 - RNA, 19 nt, Homo sapiens
cuagauuuucuacuuuauu

SEQ ID NO: 2029642 - RNA, 15 nt, Homo sapiens
cuauguauuuggaaa

SEQ ID NO: 2029643 - RNA, 23 nt, Homo sapiens
cucauggacugaguuuauacuca

SEQ ID NO: 2029644 - RNA, 21 nt, Homo sapiens
agcauccuggccaacauggug

SEQ ID NO: 2029645 - RNA, 19 nt, Homo sapiens
aacccacaccgucuuccuu

SEQ ID NO: 2029646 - RNA, 18 nt, Homo sapiens
guuccacuuguuugcacu

SEQ ID NO: 2029647 - RNA, 12 nt, Homo sapiens
aagagucaucca

SEQ ID NO: 2029648 - RNA, 15 nt, Homo sapiens
cauucagugagacac

SEQ ID NO: 2029649 - RNA, 13 nt, Homo sapiens
cuaaugauauaaa

SEQ ID NO: 2029650 - RNA, 13 nt, Homo sapiens
acacucaugcuga

SEQ ID NO: 2029651 - RNA, 14 nt, Homo sapiens
aaucagagacaaaa

SEQ ID NO: 2029652 - RNA, 19 nt, Homo sapiens
auauagugcaauagugcaa

SEQ ID NO: 2029653 - RNA, 19 nt, Homo sapiens
gaucaacagaucaacaaua

SEQ ID NO: 2029654 - RNA, 20 nt, Homo sapiens
auuucaugugucaacuucaa

SEQ ID NO: 2029655 - RNA, 14 nt, Homo sapiens
gcuagacuagucuc

SEQ ID NO: 2029656 - RNA, 22 nt, Homo sapiens
gugcuguauaaaaucagccaau

SEQ ID NO: 2029657 - RNA, 20 nt, Homo sapiens
cuuggcgggugggagacucc

SEQ ID NO: 2029658 - RNA, 19 nt, Homo sapiens
ugaagauuauaaaagccaa

SEQ ID NO: 2029659 - RNA, 15 nt, Homo sapiens
auauuuacuguuaga

SEQ ID NO: 2029660 - RNA, 13 nt, Homo sapiens
cagucauuguacu

SEQ ID NO: 2029661 - RNA, 14 nt, Homo sapiens
cugaccaggcuucu

SEQ ID NO: 2029662 - RNA, 16 nt, Homo sapiens
cucauaauacugaaau

SEQ ID NO: 2029663 - RNA, 16 nt, Homo sapiens
ucccgaggcuacagca

SEQ ID NO: 2029664 - RNA, 16 nt, Homo sapiens
ucucagcucccauuuc

SEQ ID NO: 2029665 - RNA, 15 nt, Homo sapiens
uggagaaacaagaca

SEQ ID NO: 2029666 - RNA, 23 nt, Homo sapiens
ucaaguagaacaaaaacuauuau

SEQ ID NO: 2029667 - RNA, 16 nt, Homo sapiens
gccaagggacacagga

SEQ ID NO: 2029668 - RNA, 16 nt, Homo sapiens
gaaaaaagaaccaaaa

SEQ ID NO: 2029669 - RNA, 23 nt, Homo sapiens
caucugaaugaaaauaacugaac

SEQ ID NO: 2029670 - RNA, 18 nt, Homo sapiens
agcugcucacugcucaca

SEQ ID NO: 2029671 - RNA, 19 nt, Homo sapiens
ucacugugcuccaaccuga

SEQ ID NO: 2029672 - RNA, 21 nt, Homo sapiens
uaccaccagacugcaaugcca

SEQ ID NO: 2029673 - RNA, 16 nt, Homo sapiens
ggccaaagcacaugca

SEQ ID NO: 2029674 - RNA, 17 nt, Homo sapiens
gccaucaccgcugggug

SEQ ID NO: 2029675 - RNA, 18 nt, Homo sapiens
guacugccuuagugcuga

SEQ ID NO: 2029676 - RNA, 18 nt, Homo sapiens
cagaaucccguaacaccu

SEQ ID NO: 2029677 - RNA, 16 nt, Homo sapiens
ccuuugggauuugccg

SEQ ID NO: 2029678 - RNA, 16 nt, Homo sapiens
cauaauccuuucugcc

SEQ ID NO: 2029679 - RNA, 17 nt, Homo sapiens
aucuuuucucugcuuau

SEQ ID NO: 2029680 - RNA, 21 nt, Homo sapiens
agcccuggcucccaccuguuu

SEQ ID NO: 2029681 - RNA, 13 nt, Homo sapiens
cacugaaauggac

SEQ ID NO: 2029682 - RNA, 19 nt, Homo sapiens
aaauauuguugaacacuug

SEQ ID NO: 2029683 - RNA, 17 nt, Homo sapiens
aaaaacaacucaugcca

SEQ ID NO: 2029684 - RNA, 21 nt, Homo sapiens
auuuuaaguuucucugcagaa

SEQ ID NO: 2029685 - RNA, 18 nt, Homo sapiens
ccaguguucuaugaacaa

SEQ ID NO: 2029686 - RNA, 15 nt, Homo sapiens
agaacuacagcuuuu

SEQ ID NO: 2029687 - RNA, 14 nt, Homo sapiens
uagagaugagccca

SEQ ID NO: 2029688 - RNA, 13 nt, Homo sapiens
gagaggggaccau

SEQ ID NO: 2029689 - RNA, 21 nt, Homo sapiens
uacaugacccggaugaacuca

SEQ ID NO: 2029690 - RNA, 23 nt, Homo sapiens
gguaagagcagcacucgaugaca

SEQ ID NO: 2029691 - RNA, 19 nt, Homo sapiens
uccuuaauagccauaugca

SEQ ID NO: 2029692 - RNA, 12 nt, Homo sapiens
acucagcacugu

SEQ ID NO: 2029693 - RNA, 23 nt, Homo sapiens
auauucuguugcuuuacaguuac

SEQ ID NO: 2029694 - RNA, 17 nt, Homo sapiens
ucugcauacuaaccuau

SEQ ID NO: 2029695 - RNA, 17 nt, Homo sapiens
gaauuuccuguaauaua

SEQ ID NO: 2029696 - RNA, 12 nt, Homo sapiens
agaugggacugg

SEQ ID NO: 2029697 - RNA, 21 nt, Homo sapiens
caaagucaagccacaugguga

SEQ ID NO: 2029698 - RNA, 14 nt, Homo sapiens
gcauuuuucugacg

SEQ ID NO: 2029699 - RNA, 20 nt, Homo sapiens
ucacacuuuguaauuugcaa

SEQ ID NO: 2029700 - RNA, 22 nt, Homo sapiens
acaugaaucaaaagugccucaa

SEQ ID NO: 2029701 - RNA, 22 nt, Homo sapiens
cuggggcuccgaaauuccaagg

SEQ ID NO: 2029702 - RNA, 14 nt, Homo sapiens
caacccaaccucau

SEQ ID NO: 2029703 - RNA, 22 nt, Homo sapiens
accuagugguuucuacucucac

SEQ ID NO: 2029704 - RNA, 13 nt, Homo sapiens
ucuauaccaccuu

SEQ ID NO: 2029705 - RNA, 18 nt, Homo sapiens
augagccacugugcccag

SEQ ID NO: 2029706 - RNA, 22 nt, Homo sapiens
gaggaccccagcuuuucuugcc

SEQ ID NO: 2029707 - RNA, 20 nt, Homo sapiens
uacugagacaugacuaggaa

SEQ ID NO: 2029708 - RNA, 16 nt, Homo sapiens
uuaauauauccuaaau

SEQ ID NO: 2029709 - RNA, 15 nt, Homo sapiens
uccgccgcaccagcc

SEQ ID NO: 2029710 - RNA, 22 nt, Homo sapiens
uggcugguggaacaaccugcug

SEQ ID NO: 2029711 - RNA, 14 nt, Homo sapiens
gccuuucacaggac

SEQ ID NO: 2029712 - RNA, 15 nt, Homo sapiens
aagacauacugcuug

SEQ ID NO: 2029713 - RNA, 15 nt, Homo sapiens
gccaauuacuugaag

SEQ ID NO: 2029714 - RNA, 22 nt, Homo sapiens
uaugaggaaaaguuuaaccuaa

SEQ ID NO: 2029715 - RNA, 13 nt, Homo sapiens
uccccuuccugcc

SEQ ID NO: 2029716 - RNA, 15 nt, Homo sapiens
gauacuccaaccaua

SEQ ID NO: 2029717 - RNA, 19 nt, Homo sapiens
aauuauugugccucagccu

SEQ ID NO: 2029718 - RNA, 22 nt, Homo sapiens
caaaauaaagaucacacaucaa

SEQ ID NO: 2029719 - RNA, 14 nt, Homo sapiens
ugcuauaaguuuua

SEQ ID NO: 2029720 - RNA, 21 nt, Homo sapiens
aaacagcggcuccacuaaaga

SEQ ID NO: 2029721 - RNA, 17 nt, Homo sapiens
gcaccugaaccacugug

SEQ ID NO: 2029722 - RNA, 17 nt, Homo sapiens
uaacuauuuacauauaa

SEQ ID NO: 2029723 - RNA, 11 nt, Homo sapiens
uugaugugcac

SEQ ID NO: 2029724 - RNA, 14 nt, Homo sapiens
uggugaaugcugcu

SEQ ID NO: 2029725 - RNA, 14 nt, Homo sapiens
cuacacacaaacca

SEQ ID NO: 2029726 - RNA, 16 nt, Homo sapiens
acaguuauaucaagcu

SEQ ID NO: 2029727 - RNA, 13 nt, Homo sapiens
gccacaguggcca

SEQ ID NO: 2029728 - RNA, 19 nt, Homo sapiens
acaaagucuaaggaagaau

SEQ ID NO: 2029729 - RNA, 15 nt, Homo sapiens
ucgucucuuuacaga

SEQ ID NO: 2029730 - RNA, 14 nt, Homo sapiens
acuucucaagauac

SEQ ID NO: 2029731 - RNA, 21 nt, Homo sapiens
gcuucauucaagucagcucuu

SEQ ID NO: 2029732 - RNA, 16 nt, Homo sapiens
cacgugucucagacug

SEQ ID NO: 2029733 - RNA, 12 nt, Homo sapiens
gugaauuugcca

SEQ ID NO: 2029734 - RNA, 20 nt, Homo sapiens
agaaacagaagauuacaaaa

SEQ ID NO: 2029735 - RNA, 17 nt, Homo sapiens
gauucauauugcaucau

SEQ ID NO: 2029736 - RNA, 19 nt, Homo sapiens
acagcucuucucagugucu

SEQ ID NO: 2029737 - RNA, 13 nt, Homo sapiens
cauauaugcaaaa

SEQ ID NO: 2029738 - RNA, 18 nt, Homo sapiens
gacagucaaggagaugag

SEQ ID NO: 2029739 - RNA, 12 nt, Homo sapiens
ccuaaugcuuuu

SEQ ID NO: 2029740 - RNA, 15 nt, Homo sapiens
auuuuagacuuccug

SEQ ID NO: 2029741 - RNA, 18 nt, Homo sapiens
uuaauauuuaaccucuuu

SEQ ID NO: 2029742 - RNA, 19 nt, Homo sapiens
gcauauuaauuucuucccc

SEQ ID NO: 2029743 - RNA, 21 nt, Homo sapiens
caagcugguggccucugcagg

SEQ ID NO: 2029744 - RNA, 20 nt, Homo sapiens
ugucccggggcuccacugaa

SEQ ID NO: 2029745 - RNA, 22 nt, Homo sapiens
caacaggcuguucugcacugaa

SEQ ID NO: 2029746 - RNA, 17 nt, Homo sapiens
ugauuuauuugcuucuu

SEQ ID NO: 2029747 - RNA, 14 nt, Homo sapiens
cugucaccacaucu

SEQ ID NO: 2029748 - RNA, 11 nt, Homo sapiens
augaugccaug

SEQ ID NO: 2029749 - RNA, 17 nt, Homo sapiens
guuucacacuagucaca

SEQ ID NO: 2029750 - RNA, 21 nt, Homo sapiens
ccugcaugaaacauguucuca

SEQ ID NO: 2029751 - RNA, 14 nt, Homo sapiens
accaugcugagaca

SEQ ID NO: 2029752 - RNA, 17 nt, Homo sapiens
ugccacuuugacucaga

SEQ ID NO: 2029753 - RNA, 16 nt, Homo sapiens
ccaucuguaaauaucc

SEQ ID NO: 2029754 - RNA, 12 nt, Homo sapiens
ucagcucuaugu

SEQ ID NO: 2029755 - RNA, 20 nt, Homo sapiens
ucgagauggcagauucccac

SEQ ID NO: 2029756 - RNA, 18 nt, Homo sapiens
augaccuuuuugcagugu

SEQ ID NO: 2029757 - RNA, 12 nt, Homo sapiens
cguggacuuggc

SEQ ID NO: 2029758 - RNA, 18 nt, Homo sapiens
gagcaagacucugucuca

SEQ ID NO: 2029759 - RNA, 14 nt, Homo sapiens
ugcgccaccucacu

SEQ ID NO: 2029760 - RNA, 20 nt, Homo sapiens
aggcgauggacaauuaugau

SEQ ID NO: 2029761 - RNA, 19 nt, Homo sapiens
uguaauuuguaacuuuuau

SEQ ID NO: 2029762 - RNA, 19 nt, Homo sapiens
guuauuguuguugccaaag

SEQ ID NO: 2029763 - RNA, 17 nt, Homo sapiens
uugcaguucccacauua

SEQ ID NO: 2029764 - RNA, 18 nt, Homo sapiens
agcuuuuuacucaaagag

SEQ ID NO: 2029765 - RNA, 19 nt, Homo sapiens
caguauuaaaauuuggcca

SEQ ID NO: 2029766 - RNA, 19 nt, Homo sapiens
aagguguuuuccugaagaa

SEQ ID NO: 2029767 - RNA, 18 nt, Homo sapiens
uaccacauuuucuuuauc

SEQ ID NO: 2029768 - RNA, 13 nt, Homo sapiens
cccugcuuucuac

SEQ ID NO: 2029769 - RNA, 17 nt, Homo sapiens
caucccaggacaccaca

SEQ ID NO: 2029770 - RNA, 24 nt, Homo sapiens
ggaucuugcaaaagaugucugauc

SEQ ID NO: 2029771 - RNA, 22 nt, Homo sapiens
gaaaagaccuacagacuaagaa

SEQ ID NO: 2029772 - RNA, 22 nt, Homo sapiens
gagaauaaaacguuaguuaauc

SEQ ID NO: 2029773 - RNA, 13 nt, Homo sapiens
acagcucuuguuu

SEQ ID NO: 2029774 - RNA, 23 nt, Homo sapiens
cagacccacagaagguguucaaa

SEQ ID NO: 2029775 - RNA, 23 nt, Homo sapiens
uuccaugcaacuggaguuccuua

SEQ ID NO: 2029776 - RNA, 20 nt, Homo sapiens
acgcaccgccugaaggcaca

SEQ ID NO: 2029777 - RNA, 18 nt, Homo sapiens
guuuauuuccaucuguau

SEQ ID NO: 2029778 - RNA, 16 nt, Homo sapiens
auugugaaguacauau

SEQ ID NO: 2029779 - RNA, 21 nt, Homo sapiens
uuuuuguacuuuucugguucc

SEQ ID NO: 2029780 - RNA, 22 nt, Homo sapiens
agaggcaaugauuguuaauuua

SEQ ID NO: 2029781 - RNA, 14 nt, Homo sapiens
cuuugucuucuaua

SEQ ID NO: 2029782 - RNA, 23 nt, Homo sapiens
auaguagaacgcuaucugggaag

SEQ ID NO: 2029783 - RNA, 15 nt, Homo sapiens
cugcacugaugcugc

SEQ ID NO: 2029784 - RNA, 13 nt, Homo sapiens
agcguggggcuaa

SEQ ID NO: 2029785 - RNA, 22 nt, Homo sapiens
aucuguaguuuguauagccuca

SEQ ID NO: 2029786 - RNA, 18 nt, Homo sapiens
uggcaugcuaaagccuuc

SEQ ID NO: 2029787 - RNA, 21 nt, Homo sapiens
cacauuuagauccugguuuca

SEQ ID NO: 2029788 - RNA, 20 nt, Homo sapiens
guggacaaagucaacuucca

SEQ ID NO: 2029789 - RNA, 15 nt, Homo sapiens
agaaaauacaauaaa

SEQ ID NO: 2029790 - RNA, 15 nt, Homo sapiens
acagaggcgaaggca

SEQ ID NO: 2029791 - RNA, 16 nt, Homo sapiens
ugcagaggcugagcag

SEQ ID NO: 2029792 - RNA, 20 nt, Homo sapiens
ucacuuaaaggcacaaauag

SEQ ID NO: 2029793 - RNA, 15 nt, Homo sapiens
gacccacacuuccau

SEQ ID NO: 2029794 - RNA, 19 nt, Homo sapiens
gcauuccuguaacuuuuaa

SEQ ID NO: 2029795 - RNA, 13 nt, Homo sapiens
uaagaaugaaaua

SEQ ID NO: 2029796 - RNA, 18 nt, Homo sapiens
acucucucccucuacuaa

SEQ ID NO: 2029797 - RNA, 13 nt, Homo sapiens
ggcuaauucugca

SEQ ID NO: 2029798 - RNA, 12 nt, Homo sapiens
aaauuaagaagg

SEQ ID NO: 2029799 - RNA, 21 nt, Homo sapiens
gaaugugugggcccaaggccc

SEQ ID NO: 2029800 - RNA, 19 nt, Homo sapiens
ugcacguugugcacaugua

SEQ ID NO: 2029801 - RNA, 13 nt, Homo sapiens
gacuccaaccuca

SEQ ID NO: 2029802 - RNA, 21 nt, Homo sapiens
gugacaauuaaaagugucuug

SEQ ID NO: 2029803 - RNA, 18 nt, Homo sapiens
ugaccuuccaaaccucaa

SEQ ID NO: 2029804 - RNA, 16 nt, Homo sapiens
caccucaagugccuua

SEQ ID NO: 2029805 - RNA, 16 nt, Homo sapiens
acacaaucugaaacag

SEQ ID NO: 2029806 - RNA, 17 nt, Homo sapiens
ugaagaaaggaacugag

SEQ ID NO: 2029807 - RNA, 16 nt, Homo sapiens
gccugugggaggggga

SEQ ID NO: 2029808 - RNA, 15 nt, Homo sapiens
ucugagacauuccac

SEQ ID NO: 2029809 - RNA, 15 nt, Homo sapiens
acaauuuaugaauug

SEQ ID NO: 2029810 - RNA, 16 nt, Homo sapiens
aguagaaguuacuuaa

SEQ ID NO: 2029811 - RNA, 18 nt, Homo sapiens
accuugacuugccaugaa

SEQ ID NO: 2029812 - RNA, 17 nt, Homo sapiens
agugucuagacauauuu

SEQ ID NO: 2029813 - RNA, 20 nt, Homo sapiens
uguaacgccuguuacacaca

SEQ ID NO: 2029814 - RNA, 18 nt, Homo sapiens
ugagcuggucaguugcca

SEQ ID NO: 2029815 - RNA, 16 nt, Homo sapiens
agccacccucccagcu

SEQ ID NO: 2029816 - RNA, 19 nt, Homo sapiens
ccuugguucccccacugau

SEQ ID NO: 2029817 - RNA, 18 nt, Homo sapiens
agaugcacuuaugcagua

SEQ ID NO: 2029818 - RNA, 16 nt, Homo sapiens
gagaguaagcacuuaa

SEQ ID NO: 2029819 - RNA, 13 nt, Homo sapiens
ccaaugaugguca

SEQ ID NO: 2029820 - RNA, 21 nt, Homo sapiens
agcccuggcccagagcuggaa

SEQ ID NO: 2029821 - RNA, 22 nt, Homo sapiens
cauccacaggguuuugacacuu

SEQ ID NO: 2029822 - RNA, 21 nt, Homo sapiens
agccacagaugggcaaacccu

SEQ ID NO: 2029823 - RNA, 14 nt, Homo sapiens
ggaaguugacuuau

SEQ ID NO: 2029824 - RNA, 20 nt, Homo sapiens
aggaacuggugucuucaggg

SEQ ID NO: 2029825 - RNA, 20 nt, Homo sapiens
augcugaccauccaggcaua

SEQ ID NO: 2029826 - RNA, 17 nt, Homo sapiens
acauaaaaguuggcuca

SEQ ID NO: 2029827 - RNA, 22 nt, Homo sapiens
caaagugacacagagcaauggu

SEQ ID NO: 2029828 - RNA, 19 nt, Homo sapiens
cucuacaucuucugccuua

SEQ ID NO: 2029829 - RNA, 18 nt, Homo sapiens
auacgguuuucauugaca

SEQ ID NO: 2029830 - RNA, 20 nt, Homo sapiens
ucaagcgauucucaugccuc

SEQ ID NO: 2029831 - RNA, 20 nt, Homo sapiens
ucaagagauucuccugccuc

SEQ ID NO: 2029832 - RNA, 20 nt, Homo sapiens
gugauacuguacauagcugu

SEQ ID NO: 2029833 - RNA, 22 nt, Homo sapiens
aggauacauaaugggccacuga

SEQ ID NO: 2029834 - RNA, 15 nt, Homo sapiens
uaaaugaagcagcuu

SEQ ID NO: 2029835 - RNA, 20 nt, Homo sapiens
ugugcaauuuguaaauauug

SEQ ID NO: 2029836 - RNA, 18 nt, Homo sapiens
ccagaaagugacaagcuc

SEQ ID NO: 2029837 - RNA, 20 nt, Homo sapiens
cucuugaucucaaagcacaa

SEQ ID NO: 2029838 - RNA, 19 nt, Homo sapiens
gcccauucgcaugaggaau

SEQ ID NO: 2029839 - RNA, 12 nt, Homo sapiens
uggugaccaccc

SEQ ID NO: 2029840 - RNA, 23 nt, Homo sapiens
auauuuaucucuuccugcuccuc

SEQ ID NO: 2029841 - RNA, 16 nt, Homo sapiens
uuucacuuaccugaaa

SEQ ID NO: 2029842 - RNA, 13 nt, Homo sapiens
aacuccuguuuca

SEQ ID NO: 2029843 - RNA, 13 nt, Homo sapiens
ucuucuagugcuu

SEQ ID NO: 2029844 - RNA, 19 nt, Homo sapiens
aggagccuuuugcucucug

SEQ ID NO: 2029845 - RNA, 24 nt, Homo sapiens
uaaaaaagggcuugggagauucau

SEQ ID NO: 2029846 - RNA, 22 nt, Homo sapiens
cccaugaucuucaagcagggaa

SEQ ID NO: 2029847 - RNA, 12 nt, Homo sapiens
caggaaauuacu

SEQ ID NO: 2029848 - RNA, 16 nt, Homo sapiens
gauguugucuuggcuu

SEQ ID NO: 2029849 - RNA, 16 nt, Homo sapiens
agcaauacucaucaga

SEQ ID NO: 2029850 - RNA, 20 nt, Homo sapiens
uuuaguccagagauagaaua

SEQ ID NO: 2029851 - RNA, 15 nt, Homo sapiens
uaaacaguagugaua

SEQ ID NO: 2029852 - RNA, 20 nt, Homo sapiens
uauguuuagauaaaauugaa

SEQ ID NO: 2029853 - RNA, 17 nt, Homo sapiens
gccaggauuggggaccu

SEQ ID NO: 2029854 - RNA, 23 nt, Homo sapiens
cuccaucaguuagagcugacaca

SEQ ID NO: 2029855 - RNA, 13 nt, Homo sapiens
gcucuccuuugag

SEQ ID NO: 2029856 - RNA, 19 nt, Homo sapiens
agcuccuuucaugcuccau

SEQ ID NO: 2029857 - RNA, 24 nt, Homo sapiens
uggaguuucauguacaagaugaag

SEQ ID NO: 2029858 - RNA, 14 nt, Homo sapiens
gggaagaaacacuc

SEQ ID NO: 2029859 - RNA, 21 nt, Homo sapiens
cucccagauagaaugucaaua

SEQ ID NO: 2029860 - RNA, 15 nt, Homo sapiens
aagaaggcaauauua

SEQ ID NO: 2029861 - RNA, 19 nt, Homo sapiens
ccgaccccaucccuaucca

SEQ ID NO: 2029862 - RNA, 20 nt, Homo sapiens
agacaugagccuccgcgccu

SEQ ID NO: 2029863 - RNA, 22 nt, Homo sapiens
caaaaaaaaaaaaaggcagugg

SEQ ID NO: 2029864 - RNA, 16 nt, Homo sapiens
caucugcugcaguuac

SEQ ID NO: 2029865 - RNA, 23 nt, Homo sapiens
ucccuggcccccucccuggauga

SEQ ID NO: 2029866 - RNA, 16 nt, Homo sapiens
aggaggauuugucuga

SEQ ID NO: 2029867 - RNA, 17 nt, Homo sapiens
acaaagaggagcugcug

SEQ ID NO: 2029868 - RNA, 17 nt, Homo sapiens
ugucaccuugaugacuu

SEQ ID NO: 2029869 - RNA, 19 nt, Homo sapiens
cagcacaccccacagccaa

SEQ ID NO: 2029870 - RNA, 11 nt, Homo sapiens
aacccagcugu

SEQ ID NO: 2029871 - RNA, 15 nt, Homo sapiens
agucugguagcucag

SEQ ID NO: 2029872 - RNA, 15 nt, Homo sapiens
gaccaccacuucgaa

SEQ ID NO: 2029873 - RNA, 21 nt, Homo sapiens
uaaagauaacccuuauuccau

SEQ ID NO: 2029874 - RNA, 10 nt, Homo sapiens
ggaguuacaa

SEQ ID NO: 2029875 - RNA, 18 nt, Homo sapiens
uucaauaacaaagcacau

SEQ ID NO: 2029876 - RNA, 20 nt, Homo sapiens
gcacagaggauggcuucccc

SEQ ID NO: 2029877 - RNA, 13 nt, Homo sapiens
auaaaauaauucu

SEQ ID NO: 2029878 - RNA, 13 nt, Homo sapiens
caucuauacaaaa

SEQ ID NO: 2029879 - RNA, 17 nt, Homo sapiens
gagccuuccacagcccg

SEQ ID NO: 2029880 - RNA, 20 nt, Homo sapiens
gauuccagcccacauuggau

SEQ ID NO: 2029881 - RNA, 18 nt, Homo sapiens
ugaaugaaacuauuacuc

SEQ ID NO: 2029882 - RNA, 16 nt, Homo sapiens
agcaaaauuacuacca

SEQ ID NO: 2029883 - RNA, 21 nt, Homo sapiens
aguuaugauguaaucucucug

SEQ ID NO: 2029884 - RNA, 17 nt, Homo sapiens
ccuuuccuauuucccca

SEQ ID NO: 2029885 - RNA, 15 nt, Homo sapiens
agccugggcaaugug

SEQ ID NO: 2029886 - RNA, 22 nt, Homo sapiens
ugagguuuuauacuucagguua

SEQ ID NO: 2029887 - RNA, 19 nt, Homo sapiens
uguucgauugaaauuuugc

SEQ ID NO: 2029888 - RNA, 14 nt, Homo sapiens
gccuuaagcagaac

SEQ ID NO: 2029889 - RNA, 20 nt, Homo sapiens
cauccuguuuguaugaaauu

SEQ ID NO: 2029890 - RNA, 16 nt, Homo sapiens
ugauaagugacaaaag

SEQ ID NO: 2029891 - RNA, 18 nt, Homo sapiens
gucuaaaaacaccaaaaa

SEQ ID NO: 2029892 - RNA, 21 nt, Homo sapiens
accgguucccacaagccugcc

SEQ ID NO: 2029893 - RNA, 16 nt, Homo sapiens
ggcuaaugaagaucau

SEQ ID NO: 2029894 - RNA, 18 nt, Homo sapiens
cugucgcacccacuguga

SEQ ID NO: 2029895 - RNA, 16 nt, Homo sapiens
uuucuguauauacuca

SEQ ID NO: 2029896 - RNA, 18 nt, Homo sapiens
uaagaagacccuauuucc

SEQ ID NO: 2029897 - RNA, 15 nt, Homo sapiens
cuuuccucccaaagg

SEQ ID NO: 2029898 - RNA, 15 nt, Homo sapiens
aauacuguauuugag

SEQ ID NO: 2029899 - RNA, 18 nt, Homo sapiens
uuacuccuucuguuuuga

SEQ ID NO: 2029900 - RNA, 23 nt, Homo sapiens
gaugcggaaggauugcaaugccc

SEQ ID NO: 2029901 - RNA, 19 nt, Homo sapiens
ccucggugcagagugcaga

SEQ ID NO: 2029902 - RNA, 18 nt, Homo sapiens
cagacgucucaagacuga

SEQ ID NO: 2029903 - RNA, 16 nt, Homo sapiens
ugugccuuacauuauu

SEQ ID NO: 2029904 - RNA, 15 nt, Homo sapiens
guuaacuuaugucuc

SEQ ID NO: 2029905 - RNA, 19 nt, Homo sapiens
gagaaguugagcagguauc

SEQ ID NO: 2029906 - RNA, 16 nt, Homo sapiens
aaaauguaaagccaug

SEQ ID NO: 2029907 - RNA, 14 nt, Homo sapiens
agagggcaggcaug

SEQ ID NO: 2029908 - RNA, 18 nt, Homo sapiens
gccuguguacagaccucc

SEQ ID NO: 2029909 - RNA, 21 nt, Homo sapiens
cauuuuauuuagcaagguguu

SEQ ID NO: 2029910 - RNA, 21 nt, Homo sapiens
gaugcauucgguuuugugauu

SEQ ID NO: 2029911 - RNA, 19 nt, Homo sapiens
gccgguaaguaaacaguca

SEQ ID NO: 2029912 - RNA, 18 nt, Homo sapiens
cugguggugggccccuga

SEQ ID NO: 2029913 - RNA, 18 nt, Homo sapiens
cugugugugugugugcau

SEQ ID NO: 2029914 - RNA, 19 nt, Homo sapiens
uucagcuuuucagugaaug

SEQ ID NO: 2029915 - RNA, 14 nt, Homo sapiens
ggugugaacauguu

SEQ ID NO: 2029916 - RNA, 15 nt, Homo sapiens
gaaucaacagaucaa

SEQ ID NO: 2029917 - RNA, 17 nt, Homo sapiens
caggauaucacauugga

SEQ ID NO: 2029918 - RNA, 13 nt, Homo sapiens
auagucacacuuu

SEQ ID NO: 2029919 - RNA, 16 nt, Homo sapiens
uuugauauccaugcca

SEQ ID NO: 2029920 - RNA, 14 nt, Homo sapiens
caagagaaggagau

SEQ ID NO: 2029921 - RNA, 15 nt, Homo sapiens
caccaucugccaaug

SEQ ID NO: 2029922 - RNA, 15 nt, Homo sapiens
gacccagucccacac

SEQ ID NO: 2029923 - RNA, 14 nt, Homo sapiens
aaauuauuugcuaa

SEQ ID NO: 2029924 - RNA, 14 nt, Homo sapiens
cuucccuccaucca

SEQ ID NO: 2029925 - RNA, 15 nt, Homo sapiens
cagcgaccccaggac

SEQ ID NO: 2029926 - RNA, 23 nt, Homo sapiens
cucagauauagauccugagcuca

SEQ ID NO: 2029927 - RNA, 19 nt, Homo sapiens
aguuuuuguaaagcccuug

SEQ ID NO: 2029928 - RNA, 15 nt, Homo sapiens
cagcugacccaguga

SEQ ID NO: 2029929 - RNA, 14 nt, Homo sapiens
gccccagaccugcc

SEQ ID NO: 2029930 - RNA, 12 nt, Homo sapiens
gaagcccagcau

SEQ ID NO: 2029931 - RNA, 22 nt, Homo sapiens
guggcgagaaauaaaguuugcu

SEQ ID NO: 2029932 - RNA, 15 nt, Homo sapiens
cgagacuccaucucu

SEQ ID NO: 2029933 - RNA, 15 nt, Homo sapiens
cagcacccugcaaaa

SEQ ID NO: 2029934 - RNA, 21 nt, Homo sapiens
ucaugccgcugugucuaugaa

SEQ ID NO: 2029935 - RNA, 18 nt, Homo sapiens
accaacaccaucacagcu

SEQ ID NO: 2029936 - RNA, 22 nt, Homo sapiens
gagcagaugcaaugacucagga

SEQ ID NO: 2029937 - RNA, 22 nt, Homo sapiens
uauuuucccuacccugcaacuu

SEQ ID NO: 2029938 - RNA, 12 nt, Homo sapiens
cucaccaaaacg

SEQ ID NO: 2029939 - RNA, 13 nt, Homo sapiens
uaugcaugcacag

SEQ ID NO: 2029940 - RNA, 14 nt, Homo sapiens
ucuccaaguacuuu

SEQ ID NO: 2029941 - RNA, 17 nt, Homo sapiens
uugcuaacacacagagc

SEQ ID NO: 2029942 - RNA, 15 nt, Homo sapiens
cauagcucacuguaa

SEQ ID NO: 2029943 - RNA, 21 nt, Homo sapiens
uguuuucuguucccuugccau

SEQ ID NO: 2029944 - RNA, 17 nt, Homo sapiens
auauccagauggcaugu

SEQ ID NO: 2029945 - RNA, 17 nt, Homo sapiens
gcuucauuuuugggaga

SEQ ID NO: 2029946 - RNA, 21 nt, Homo sapiens
aggucuccccugauccagaca

SEQ ID NO: 2029947 - RNA, 23 nt, Homo sapiens
acagcaaccucuucaugagcuug

SEQ ID NO: 2029948 - RNA, 14 nt, Homo sapiens
ucugccaaacauua

SEQ ID NO: 2029949 - RNA, 23 nt, Homo sapiens
agagguuccuguuugaacccagg

SEQ ID NO: 2029950 - RNA, 21 nt, Homo sapiens
uggguauuuuucaaaugcuuu

SEQ ID NO: 2029951 - RNA, 22 nt, Homo sapiens
gcccccaggacccccccagucc

SEQ ID NO: 2029952 - RNA, 18 nt, Homo sapiens
uuggcuuuugcuuggcag

SEQ ID NO: 2029953 - RNA, 19 nt, Homo sapiens
agcaauuugaucaguauau

SEQ ID NO: 2029954 - RNA, 16 nt, Homo sapiens
accaaagcugcccacu

SEQ ID NO: 2029955 - RNA, 21 nt, Homo sapiens
cucaaaggccagaccugcaga

SEQ ID NO: 2029956 - RNA, 19 nt, Homo sapiens
aggugauccacccaccucg

SEQ ID NO: 2029957 - RNA, 13 nt, Homo sapiens
gcccaagugccau

SEQ ID NO: 2029958 - RNA, 13 nt, Homo sapiens
ucacaaguucaau

SEQ ID NO: 2029959 - RNA, 23 nt, Homo sapiens
ccggcucugguggccacugagcu

SEQ ID NO: 2029960 - RNA, 13 nt, Homo sapiens
uuagguugcugac

SEQ ID NO: 2029961 - RNA, 20 nt, Homo sapiens
agacaccaccacccuugcca

SEQ ID NO: 2029962 - RNA, 21 nt, Homo sapiens
cauuugccaaaaauucaugcc

SEQ ID NO: 2029963 - RNA, 21 nt, Homo sapiens
caaguaguauucauguuguua

SEQ ID NO: 2029964 - RNA, 16 nt, Homo sapiens
guaaucuguacauuuu

SEQ ID NO: 2029965 - RNA, 14 nt, Homo sapiens
uaagauuucucuaa

SEQ ID NO: 2029966 - RNA, 22 nt, Homo sapiens
agagaacugcaacugaaugacu

SEQ ID NO: 2029967 - RNA, 14 nt, Homo sapiens
gagagaucugcugu

SEQ ID NO: 2029968 - RNA, 17 nt, Homo sapiens
uaucuuaaaacuccugu

SEQ ID NO: 2029969 - RNA, 14 nt, Homo sapiens
ugagauaacauuuc

SEQ ID NO: 2029970 - RNA, 15 nt, Homo sapiens
agggcucccaggcca

SEQ ID NO: 2029971 - RNA, 14 nt, Homo sapiens
accugguuuguucu

SEQ ID NO: 2029972 - RNA, 20 nt, Homo sapiens
gcaguggacucagaaagcca

SEQ ID NO: 2029973 - RNA, 16 nt, Homo sapiens
aauggcaaagacugga

SEQ ID NO: 2029974 - RNA, 21 nt, Homo sapiens
cugcaaagcaaaacagacugu

SEQ ID NO: 2029975 - RNA, 20 nt, Homo sapiens
gugauucaaacuucugugua

SEQ ID NO: 2029976 - RNA, 23 nt, Homo sapiens
ggaaggagggucccgguguaucc

SEQ ID NO: 2029977 - RNA, 19 nt, Homo sapiens
ccuguguaucguggagaaa

SEQ ID NO: 2029978 - RNA, 14 nt, Homo sapiens
uguaccugugcacg

SEQ ID NO: 2029979 - RNA, 19 nt, Homo sapiens
cauuaauauugcagucaau

SEQ ID NO: 2029980 - RNA, 13 nt, Homo sapiens
agaaaugcugcug

SEQ ID NO: 2029981 - RNA, 23 nt, Homo sapiens
gcugagaaauuguuuugcaaaug

SEQ ID NO: 2029982 - RNA, 18 nt, Homo sapiens
gaaugacggcaaacucag

SEQ ID NO: 2029983 - RNA, 13 nt, Homo sapiens
cuuacuacacuga

SEQ ID NO: 2029984 - RNA, 16 nt, Homo sapiens
cacuaaccuuccaaaa

SEQ ID NO: 2029985 - RNA, 19 nt, Homo sapiens
agaauucacacaacuacuu

SEQ ID NO: 2029986 - RNA, 17 nt, Homo sapiens
gcuuuguguuuacuuuu

SEQ ID NO: 2029987 - RNA, 20 nt, Homo sapiens
aagauauuugaauauguauc

SEQ ID NO: 2029988 - RNA, 19 nt, Homo sapiens
ugccacuaacuucuaaaga

SEQ ID NO: 2029989 - RNA, 19 nt, Homo sapiens
cugcagacaccugccuuaa

SEQ ID NO: 2029990 - RNA, 18 nt, Homo sapiens
ggcagcauccccuugaac

SEQ ID NO: 2029991 - RNA, 21 nt, Homo sapiens
aauggaucccaaucugagaaa

SEQ ID NO: 2029992 - RNA, 13 nt, Homo sapiens
gcaggucugagau

SEQ ID NO: 2029993 - RNA, 22 nt, Homo sapiens
cuuauauuuggcccaaacucau

SEQ ID NO: 2029994 - RNA, 14 nt, Homo sapiens
uaugguauuacaaa

SEQ ID NO: 2029995 - RNA, 21 nt, Homo sapiens
ugguauaauuauuuacucuua

SEQ ID NO: 2029996 - RNA, 17 nt, Homo sapiens
ugaaaaugucacuguua

SEQ ID NO: 2029997 - RNA, 20 nt, Homo sapiens
agggguucuggaaacauuca

SEQ ID NO: 2029998 - RNA, 16 nt, Homo sapiens
cccagggaugcaaagg

SEQ ID NO: 2029999 - RNA, 14 nt, Homo sapiens
uucuauugggauau

SEQ ID NO: 2030000 - RNA, 15 nt, Homo sapiens
uuguaaaugcuauua

SEQ ID NO: 2030001 - RNA, 17 nt, Homo sapiens
acacccgacuccucaaa

SEQ ID NO: 2030002 - RNA, 21 nt, Homo sapiens
uuggacaacuagccucaucuc

SEQ ID NO: 2030003 - RNA, 21 nt, Homo sapiens
guaauuucuguguauuuugag

SEQ ID NO: 2030004 - RNA, 19 nt, Homo sapiens
acaccauucuccugccuca

SEQ ID NO: 2030005 - RNA, 16 nt, Homo sapiens
caagucuuccaugacc

SEQ ID NO: 2030006 - RNA, 22 nt, Homo sapiens
aauuagagcaagaacauucaaa

SEQ ID NO: 2030007 - RNA, 17 nt, Homo sapiens
agcuguucugucuuccc

SEQ ID NO: 2030008 - RNA, 22 nt, Homo sapiens
cucaaugcaguuagcugaagaa

SEQ ID NO: 2030009 - RNA, 15 nt, Homo sapiens
ugggacucucuugau

SEQ ID NO: 2030010 - RNA, 14 nt, Homo sapiens
aauuucaauaucaa

SEQ ID NO: 2030011 - RNA, 15 nt, Homo sapiens
uggugccuggagcua

SEQ ID NO: 2030012 - RNA, 14 nt, Homo sapiens
cucuucgauguacu

SEQ ID NO: 2030013 - RNA, 13 nt, Homo sapiens
uggauaaguagaa

SEQ ID NO: 2030014 - RNA, 17 nt, Homo sapiens
cugaucgggaagcccuu

SEQ ID NO: 2030015 - RNA, 13 nt, Homo sapiens
ugauaaaguaauu

SEQ ID NO: 2030016 - RNA, 14 nt, Homo sapiens
cauuaguuuugcau

SEQ ID NO: 2030017 - RNA, 18 nt, Homo sapiens
auuauuucaccaagccaa

SEQ ID NO: 2030018 - RNA, 12 nt, Homo sapiens
caacuaccugag

SEQ ID NO: 2030019 - RNA, 14 nt, Homo sapiens
cauuuguuuugcuu

SEQ ID NO: 2030020 - RNA, 13 nt, Homo sapiens
uuucaguaccaaa

SEQ ID NO: 2030021 - RNA, 13 nt, Homo sapiens
uccagcaccaagg

SEQ ID NO: 2030022 - RNA, 17 nt, Homo sapiens
aaugagcaaauggaaca

SEQ ID NO: 2030023 - RNA, 20 nt, Homo sapiens
ggccacccgccucccucuca

SEQ ID NO: 2030024 - RNA, 16 nt, Homo sapiens
augacuuugagauuau

SEQ ID NO: 2030025 - RNA, 15 nt, Homo sapiens
agcacacagggcagu

SEQ ID NO: 2030026 - RNA, 17 nt, Homo sapiens
uaaaguauuuaagguac

SEQ ID NO: 2030027 - RNA, 14 nt, Homo sapiens
ggacugacauuucu

SEQ ID NO: 2030028 - RNA, 13 nt, Homo sapiens
cugggugagcucu

SEQ ID NO: 2030029 - RNA, 22 nt, Homo sapiens
guucccuuggccucagaauuca

SEQ ID NO: 2030030 - RNA, 15 nt, Homo sapiens
agauccugguuggug

SEQ ID NO: 2030031 - RNA, 14 nt, Homo sapiens
ucagcccuccaugg

SEQ ID NO: 2030032 - RNA, 16 nt, Homo sapiens
guugaguguguggucu

SEQ ID NO: 2030033 - RNA, 20 nt, Homo sapiens
ucagggaaaacagaagcaaa

SEQ ID NO: 2030034 - RNA, 12 nt, Homo sapiens
auacaguggcag

SEQ ID NO: 2030035 - RNA, 19 nt, Homo sapiens
agaugcgcugugccaaagc

SEQ ID NO: 2030036 - RNA, 12 nt, Homo sapiens
caaugcugccau

SEQ ID NO: 2030037 - RNA, 19 nt, Homo sapiens
ugugguuacacagugugaa

SEQ ID NO: 2030038 - RNA, 14 nt, Homo sapiens
auaaugaggaugau

SEQ ID NO: 2030039 - RNA, 23 nt, Homo sapiens
ugugauuacugcaaucacugugc

SEQ ID NO: 2030040 - RNA, 19 nt, Homo sapiens
cauggagagccccugcuaa

SEQ ID NO: 2030041 - RNA, 13 nt, Homo sapiens
cuuucagggccaa

SEQ ID NO: 2030042 - RNA, 22 nt, Homo sapiens
acuuuauugcuuaauuucugcc

SEQ ID NO: 2030043 - RNA, 21 nt, Homo sapiens
agugccgaaaacuucacugug

SEQ ID NO: 2030044 - RNA, 19 nt, Homo sapiens
agacaaugacuuacuguac

SEQ ID NO: 2030045 - RNA, 13 nt, Homo sapiens
caacuucccacac

SEQ ID NO: 2030046 - RNA, 21 nt, Homo sapiens
uacccgaaagcaucacugccu

SEQ ID NO: 2030047 - RNA, 15 nt, Homo sapiens
ugugcagggaaucau

SEQ ID NO: 2030048 - RNA, 14 nt, Homo sapiens
uuaacuuuuugcca

SEQ ID NO: 2030049 - RNA, 17 nt, Homo sapiens
cagagcagaugaggaaa

SEQ ID NO: 2030050 - RNA, 17 nt, Homo sapiens
ccuucuuaaagccuuau

SEQ ID NO: 2030051 - RNA, 15 nt, Homo sapiens
cacacugugccccac

SEQ ID NO: 2030052 - RNA, 19 nt, Homo sapiens
aaugcuggggccuggaaua

SEQ ID NO: 2030053 - RNA, 15 nt, Homo sapiens
uccccuccagccuuu

SEQ ID NO: 2030054 - RNA, 17 nt, Homo sapiens
uugauuuuuaauggaaa

SEQ ID NO: 2030055 - RNA, 10 nt, Homo sapiens
ccacucucag

SEQ ID NO: 2030056 - RNA, 18 nt, Homo sapiens
aagaucacgccacuggac

SEQ ID NO: 2030057 - RNA, 17 nt, Homo sapiens
ucucaaaucugcuuuca

SEQ ID NO: 2030058 - RNA, 15 nt, Homo sapiens
agcaaguucugagag

SEQ ID NO: 2030059 - RNA, 22 nt, Homo sapiens
agcaaguccuuaggcuacugua

SEQ ID NO: 2030060 - RNA, 18 nt, Homo sapiens
uacugguugacauuuuga

SEQ ID NO: 2030061 - RNA, 17 nt, Homo sapiens
ugaucaaauauuucaac

SEQ ID NO: 2030062 - RNA, 22 nt, Homo sapiens
caaauauagauagguagaacua

SEQ ID NO: 2030063 - RNA, 22 nt, Homo sapiens
cuguugguggcaaaauugccaa

SEQ ID NO: 2030064 - RNA, 17 nt, Homo sapiens
gggaccccccuugccca

SEQ ID NO: 2030065 - RNA, 18 nt, Homo sapiens
ucucaggcgcuucuccaa

SEQ ID NO: 2030066 - RNA, 16 nt, Homo sapiens
gaggaagccuauuuga

SEQ ID NO: 2030067 - RNA, 15 nt, Homo sapiens
ccaaaauggugggau

SEQ ID NO: 2030068 - RNA, 20 nt, Homo sapiens
acaaaaacucuuauuacugu

SEQ ID NO: 2030069 - RNA, 20 nt, Homo sapiens
accuccaucccccucugucu

SEQ ID NO: 2030070 - RNA, 14 nt, Homo sapiens
guguccucagggag

SEQ ID NO: 2030071 - RNA, 19 nt, Homo sapiens
cugaauuugauucuccagc

SEQ ID NO: 2030072 - RNA, 19 nt, Homo sapiens
acccauccugaacugggau

SEQ ID NO: 2030073 - RNA, 18 nt, Homo sapiens
uggaggccgggugcucag

SEQ ID NO: 2030074 - RNA, 19 nt, Homo sapiens
accuucaggcagccagugu

SEQ ID NO: 2030075 - RNA, 22 nt, Homo sapiens
aacuacauuaccuguucuugcc

SEQ ID NO: 2030076 - RNA, 14 nt, Homo sapiens
uauagugaugccau

SEQ ID NO: 2030077 - RNA, 15 nt, Homo sapiens
gcugaaacucauuug

SEQ ID NO: 2030078 - RNA, 13 nt, Homo sapiens
uaacacugugaag

SEQ ID NO: 2030079 - RNA, 20 nt, Homo sapiens
acuauuauaagugcuucaca

SEQ ID NO: 2030080 - RNA, 22 nt, Homo sapiens
gaaugaagacucgcaauuucac

SEQ ID NO: 2030081 - RNA, 15 nt, Homo sapiens
aaaaauaagcuuuau

SEQ ID NO: 2030082 - RNA, 23 nt, Homo sapiens
aucccucucucccuagugccuuc

SEQ ID NO: 2030083 - RNA, 19 nt, Homo sapiens
guaacugcagaaacauaac

SEQ ID NO: 2030084 - RNA, 21 nt, Homo sapiens
agacauucucgcuucccugaa

SEQ ID NO: 2030085 - RNA, 20 nt, Homo sapiens
uaucugcuauaaacuuuaca

SEQ ID NO: 2030086 - RNA, 22 nt, Homo sapiens
ugucacucuguaguuacugugg

SEQ ID NO: 2030087 - RNA, 16 nt, Homo sapiens
uccucucucacaaauc

SEQ ID NO: 2030088 - RNA, 18 nt, Homo sapiens
cuggcccagaugauauaa

SEQ ID NO: 2030089 - RNA, 15 nt, Homo sapiens
gacaguaguccccuc

SEQ ID NO: 2030090 - RNA, 20 nt, Homo sapiens
gaaucggagcgaagcagaga

SEQ ID NO: 2030091 - RNA, 23 nt, Homo sapiens
cugcccacgucccgggcacuguc

SEQ ID NO: 2030092 - RNA, 19 nt, Homo sapiens
ucuaauaaaauauaaucua

SEQ ID NO: 2030093 - RNA, 23 nt, Homo sapiens
ccacuaaaguagggaaguuuuau

SEQ ID NO: 2030094 - RNA, 22 nt, Homo sapiens
uaaagucuagaaaauaaugcaa

SEQ ID NO: 2030095 - RNA, 23 nt, Homo sapiens
agugcuauuucagcaacaaccau

SEQ ID NO: 2030096 - RNA, 21 nt, Homo sapiens
gccucgaggacugauacugca

SEQ ID NO: 2030097 - RNA, 15 nt, Homo sapiens
ccuugaaauuucuca

SEQ ID NO: 2030098 - RNA, 17 nt, Homo sapiens
cacucaggggaccccac

SEQ ID NO: 2030099 - RNA, 17 nt, Homo sapiens
ccaccguucagucauuu

SEQ ID NO: 2030100 - RNA, 15 nt, Homo sapiens
aucuagaagacuguc

SEQ ID NO: 2030101 - RNA, 19 nt, Homo sapiens
guuguucaguugccaagga

SEQ ID NO: 2030102 - RNA, 15 nt, Homo sapiens
agcagauuugcacug

SEQ ID NO: 2030103 - RNA, 22 nt, Homo sapiens
aaauaaagcuguucucauuccu

SEQ ID NO: 2030104 - RNA, 20 nt, Homo sapiens
cuuuaugcaaauacaaucag

SEQ ID NO: 2030105 - RNA, 23 nt, Homo sapiens
aguucaguggcauucacaucuca

SEQ ID NO: 2030106 - RNA, 12 nt, Homo sapiens
agaugucaaaac

SEQ ID NO: 2030107 - RNA, 18 nt, Homo sapiens
uacuugccacacacuguu

SEQ ID NO: 2030108 - RNA, 15 nt, Homo sapiens
acagcagucagggac

SEQ ID NO: 2030109 - RNA, 20 nt, Homo sapiens
uugccugggaaacauagcag

SEQ ID NO: 2030110 - RNA, 16 nt, Homo sapiens
acuuggucaccuugcc

SEQ ID NO: 2030111 - RNA, 22 nt, Homo sapiens
aggaaacuaauuuccugauaca

SEQ ID NO: 2030112 - RNA, 19 nt, Homo sapiens
auugaaaaauaaaaaccau

SEQ ID NO: 2030113 - RNA, 18 nt, Homo sapiens
accuccuuggguagugag

SEQ ID NO: 2030114 - RNA, 16 nt, Homo sapiens
ucccauuggcaaaaga

SEQ ID NO: 2030115 - RNA, 12 nt, Homo sapiens
caggguggacca

SEQ ID NO: 2030116 - RNA, 22 nt, Homo sapiens
cacugaguauguucauugccac

SEQ ID NO: 2030117 - RNA, 21 nt, Homo sapiens
ucaaccccuccccuccauccc

SEQ ID NO: 2030118 - RNA, 14 nt, Homo sapiens
cgcagccuccaguu

SEQ ID NO: 2030119 - RNA, 23 nt, Homo sapiens
agcuugagggacaaugccacuau

SEQ ID NO: 2030120 - RNA, 23 nt, Homo sapiens
uuuccauauuuuauuuuucaaaa

SEQ ID NO: 2030121 - RNA, 14 nt, Homo sapiens
cugcaaaaugucau

SEQ ID NO: 2030122 - RNA, 14 nt, Homo sapiens
gccuaaagaauccc

SEQ ID NO: 2030123 - RNA, 20 nt, Homo sapiens
ugugcucuggcaccaucagc

SEQ ID NO: 2030124 - RNA, 22 nt, Homo sapiens
cagagcucaagauucagacucc

SEQ ID NO: 2030125 - RNA, 22 nt, Homo sapiens
aauuggaacuccuauuccuugc

SEQ ID NO: 2030126 - RNA, 19 nt, Homo sapiens
ggaccauugaccucagcug

SEQ ID NO: 2030127 - RNA, 21 nt, Homo sapiens
agaaugucucggucacaucag

SEQ ID NO: 2030128 - RNA, 21 nt, Homo sapiens
ggccuguugaagaugcuugua

SEQ ID NO: 2030129 - RNA, 16 nt, Homo sapiens
cuguuagcugcucacu

SEQ ID NO: 2030130 - RNA, 17 nt, Homo sapiens
uucuggaaagaaaacca

SEQ ID NO: 2030131 - RNA, 20 nt, Homo sapiens
aguguuaaagugaaucucaa

SEQ ID NO: 2030132 - RNA, 20 nt, Homo sapiens
uugugguugaaaaccacagu

SEQ ID NO: 2030133 - RNA, 20 nt, Homo sapiens
uucagacauuccauggugau

SEQ ID NO: 2030134 - RNA, 19 nt, Homo sapiens
aaaaauagacuuaaaucuc

SEQ ID NO: 2030135 - RNA, 23 nt, Homo sapiens
ugguaucaucuucucauuuugca

SEQ ID NO: 2030136 - RNA, 21 nt, Homo sapiens
gaaauccuuucuaaauugcau

SEQ ID NO: 2030137 - RNA, 17 nt, Homo sapiens
ugcacacauauacaugu

SEQ ID NO: 2030138 - RNA, 14 nt, Homo sapiens
uucugauguauuac

SEQ ID NO: 2030139 - RNA, 14 nt, Homo sapiens
agguggagguugca

SEQ ID NO: 2030140 - RNA, 21 nt, Homo sapiens
acccaggauucccccaacaca

SEQ ID NO: 2030141 - RNA, 20 nt, Homo sapiens
ccuccaccucccugcaauaa

SEQ ID NO: 2030142 - RNA, 21 nt, Homo sapiens
uccuaucccuggacgcaugca

SEQ ID NO: 2030143 - RNA, 19 nt, Homo sapiens
aucaaacauuuucuggcca

SEQ ID NO: 2030144 - RNA, 21 nt, Homo sapiens
uaaaauggagacaccaccacc

SEQ ID NO: 2030145 - RNA, 20 nt, Homo sapiens
caggcagaucugugccccau

SEQ ID NO: 2030146 - RNA, 15 nt, Homo sapiens
cauuuugcacuguaa

SEQ ID NO: 2030147 - RNA, 12 nt, Homo sapiens
agaagugccagu

SEQ ID NO: 2030148 - RNA, 15 nt, Homo sapiens
aaugagccuggcaag

SEQ ID NO: 2030149 - RNA, 14 nt, Homo sapiens
guggguugcacugg

SEQ ID NO: 2030150 - RNA, 16 nt, Homo sapiens
gcguguacuaccccag

SEQ ID NO: 2030151 - RNA, 19 nt, Homo sapiens
cacaguucacaaacaguaa

SEQ ID NO: 2030152 - RNA, 14 nt, Homo sapiens
uggcuucugaugaa

SEQ ID NO: 2030153 - RNA, 14 nt, Homo sapiens
caccauguaugugg

SEQ ID NO: 2030154 - RNA, 20 nt, Homo sapiens
uaauuuugugcucuuuccug

SEQ ID NO: 2030155 - RNA, 13 nt, Homo sapiens
cuugguaugugcc

SEQ ID NO: 2030156 - RNA, 17 nt, Homo sapiens
cagccugucucuuccau

SEQ ID NO: 2030157 - RNA, 18 nt, Homo sapiens
ucauucgcuacuaugauu

SEQ ID NO: 2030158 - RNA, 22 nt, Homo sapiens
acaugcuggaaauaaaacagcu

SEQ ID NO: 2030159 - RNA, 14 nt, Homo sapiens
agguuaucgaaaua

SEQ ID NO: 2030160 - RNA, 20 nt, Homo sapiens
cagugcuugcaagauuccaa

SEQ ID NO: 2030161 - RNA, 15 nt, Homo sapiens
uucauuguaaucaaa

SEQ ID NO: 2030162 - RNA, 22 nt, Homo sapiens
uucuggcauauguuucugcuag

SEQ ID NO: 2030163 - RNA, 21 nt, Homo sapiens
agaaucuuuuaaauacauucc

SEQ ID NO: 2030164 - RNA, 23 nt, Homo sapiens
cucuccccaacccccauucucau

SEQ ID NO: 2030165 - RNA, 18 nt, Homo sapiens
ccagucgaccccaaagga

SEQ ID NO: 2030166 - RNA, 13 nt, Homo sapiens
agcuaccaaagug

SEQ ID NO: 2030167 - RNA, 17 nt, Homo sapiens
ccaccugagcuuuggac

SEQ ID NO: 2030168 - RNA, 13 nt, Homo sapiens
guauggcucugca

SEQ ID NO: 2030169 - RNA, 15 nt, Homo sapiens
gcccagccacugcag

SEQ ID NO: 2030170 - RNA, 20 nt, Homo sapiens
accuccucccuaaugcucac

SEQ ID NO: 2030171 - RNA, 23 nt, Homo sapiens
uucccaucaccaucaccaccacc

SEQ ID NO: 2030172 - RNA, 21 nt, Homo sapiens
augguuguacuacaguauacu

SEQ ID NO: 2030173 - RNA, 14 nt, Homo sapiens
agugcugugucauu

SEQ ID NO: 2030174 - RNA, 12 nt, Homo sapiens
aaccagcaguug

SEQ ID NO: 2030175 - RNA, 22 nt, Homo sapiens
cagggccccuggggaucuugcc

SEQ ID NO: 2030176 - RNA, 11 nt, Homo sapiens
uaaaauuccaa

SEQ ID NO: 2030177 - RNA, 18 nt, Homo sapiens
gcagggacaccuggacaa

SEQ ID NO: 2030178 - RNA, 16 nt, Homo sapiens
uucugaauuugcaaag

SEQ ID NO: 2030179 - RNA, 23 nt, Homo sapiens
gaccuuaucaggauaccagagga

SEQ ID NO: 2030180 - RNA, 12 nt, Homo sapiens
ccuuugccagug

SEQ ID NO: 2030181 - RNA, 18 nt, Homo sapiens
agggaagguauaucagga

SEQ ID NO: 2030182 - RNA, 21 nt, Homo sapiens
aagucuaaacaaaauugcaau

SEQ ID NO: 2030183 - RNA, 21 nt, Homo sapiens
uucauuucacuguagcucuaa

SEQ ID NO: 2030184 - RNA, 15 nt, Homo sapiens
ggcaugguccugugc

SEQ ID NO: 2030185 - RNA, 16 nt, Homo sapiens
aaguagccaucauucc

SEQ ID NO: 2030186 - RNA, 13 nt, Homo sapiens
uuaaacucaggga

SEQ ID NO: 2030187 - RNA, 18 nt, Homo sapiens
cuagaagauaacauuuuc

SEQ ID NO: 2030188 - RNA, 18 nt, Homo sapiens
ggccuccccaauccaggc

SEQ ID NO: 2030189 - RNA, 22 nt, Homo sapiens
cagcuccucugccuuugugcuc

SEQ ID NO: 2030190 - RNA, 20 nt, Homo sapiens
cacccaguuugauaccugca

SEQ ID NO: 2030191 - RNA, 20 nt, Homo sapiens
gaaucuucacaaaacacuuc

SEQ ID NO: 2030192 - RNA, 19 nt, Homo sapiens
guggaguuggggcugccau

SEQ ID NO: 2030193 - RNA, 14 nt, Homo sapiens
cugggccagggucu

SEQ ID NO: 2030194 - RNA, 13 nt, Homo sapiens
aagaaaaucacuu

SEQ ID NO: 2030195 - RNA, 22 nt, Homo sapiens
auuuucuaauguugacuuuaau

SEQ ID NO: 2030196 - RNA, 13 nt, Homo sapiens
acccuaagaaaag

SEQ ID NO: 2030197 - RNA, 15 nt, Homo sapiens
gaucagaacugggaa

SEQ ID NO: 2030198 - RNA, 15 nt, Homo sapiens
ccgucugugacaugg

SEQ ID NO: 2030199 - RNA, 15 nt, Homo sapiens
uguggaagcaaaaau

SEQ ID NO: 2030200 - RNA, 19 nt, Homo sapiens
acuguauuuaagaaaacac

SEQ ID NO: 2030201 - RNA, 12 nt, Homo sapiens
ucacaucacuuc

SEQ ID NO: 2030202 - RNA, 15 nt, Homo sapiens
aucugaggaguccaa

SEQ ID NO: 2030203 - RNA, 15 nt, Homo sapiens
gcagaaaauuacauu

SEQ ID NO: 2030204 - RNA, 21 nt, Homo sapiens
uuuuuaauucaguacaaccca

SEQ ID NO: 2030205 - RNA, 19 nt, Homo sapiens
cacaggagccucugcaguc

SEQ ID NO: 2030206 - RNA, 20 nt, Homo sapiens
cuuugaaauguguuucugua

SEQ ID NO: 2030207 - RNA, 15 nt, Homo sapiens
ccuucuaaacauuuu

SEQ ID NO: 2030208 - RNA, 15 nt, Homo sapiens
uauacuucacacuga

SEQ ID NO: 2030209 - RNA, 15 nt, Homo sapiens
ggucuaggacacagu

SEQ ID NO: 2030210 - RNA, 23 nt, Homo sapiens
ccagggcagggcgagcugcagga

SEQ ID NO: 2030211 - RNA, 22 nt, Homo sapiens
aucucauuggacccuuccaugg

SEQ ID NO: 2030212 - RNA, 13 nt, Homo sapiens
aaugugacuucau

SEQ ID NO: 2030213 - RNA, 23 nt, Homo sapiens
ggaggaugucccugggccagggu

SEQ ID NO: 2030214 - RNA, 12 nt, Homo sapiens
aucaucucucau

SEQ ID NO: 2030215 - RNA, 23 nt, Homo sapiens
ggcacacacgccuucaugccagu

SEQ ID NO: 2030216 - RNA, 21 nt, Homo sapiens
aagugcaugcauugagcugcc

SEQ ID NO: 2030217 - RNA, 23 nt, Homo sapiens
ucccauuguauuuaaaacauuuc

SEQ ID NO: 2030218 - RNA, 14 nt, Homo sapiens
guccuggcuucuag

SEQ ID NO: 2030219 - RNA, 16 nt, Homo sapiens
ggcuaucaacuuaaua

SEQ ID NO: 2030220 - RNA, 21 nt, Homo sapiens
cuggaacuacaagugugagcc

SEQ ID NO: 2030221 - RNA, 23 nt, Homo sapiens
gcuccccacgauaagcaccagug

SEQ ID NO: 2030222 - RNA, 15 nt, Homo sapiens
uacucauacauguua

SEQ ID NO: 2030223 - RNA, 19 nt, Homo sapiens
ccagagcuuuacagugcca

SEQ ID NO: 2030224 - RNA, 19 nt, Homo sapiens
acauggccuuggagggcau

SEQ ID NO: 2030225 - RNA, 20 nt, Homo sapiens
auacugguuauccugugcua

SEQ ID NO: 2030226 - RNA, 17 nt, Homo sapiens
gaagggggacacuccau

SEQ ID NO: 2030227 - RNA, 19 nt, Homo sapiens
auguaugacuuugugccau

SEQ ID NO: 2030228 - RNA, 20 nt, Homo sapiens
aucucugcugcuucugggcc

SEQ ID NO: 2030229 - RNA, 16 nt, Homo sapiens
aauuggcuuuucauag

SEQ ID NO: 2030230 - RNA, 11 nt, Homo sapiens
uccccagcucc

SEQ ID NO: 2030231 - RNA, 18 nt, Homo sapiens
caggugcucaugcugcuc

SEQ ID NO: 2030232 - RNA, 15 nt, Homo sapiens
aaacaaagaguagaa

SEQ ID NO: 2030233 - RNA, 21 nt, Homo sapiens
gacagcucccucugccugaac

SEQ ID NO: 2030234 - RNA, 23 nt, Homo sapiens
cugacacaguaaaauuaacucug

SEQ ID NO: 2030235 - RNA, 12 nt, Homo sapiens
ugugucaaugug

SEQ ID NO: 2030236 - RNA, 12 nt, Homo sapiens
ugaaucaaugaa

SEQ ID NO: 2030237 - RNA, 22 nt, Homo sapiens
uucagcaaaacugguugaacag

SEQ ID NO: 2030238 - RNA, 20 nt, Homo sapiens
aauguaggaaggagagcucu

SEQ ID NO: 2030239 - RNA, 18 nt, Homo sapiens
aaccuugguuaugacugc

SEQ ID NO: 2030240 - RNA, 13 nt, Homo sapiens
uaauauuugcaca

SEQ ID NO: 2030241 - RNA, 22 nt, Homo sapiens
aggccuuccccuggcacuggca

SEQ ID NO: 2030242 - RNA, 21 nt, Homo sapiens
agaaugaaaggcaaugacaag

SEQ ID NO: 2030243 - RNA, 11 nt, Homo sapiens
ccuggugggac

SEQ ID NO: 2030244 - RNA, 15 nt, Homo sapiens
ucaccacaaacugua

SEQ ID NO: 2030245 - RNA, 23 nt, Homo sapiens
ccuugcaguuccccgagaacuuu

SEQ ID NO: 2030246 - RNA, 23 nt, Homo sapiens
uuugcgcugguggaccacaggca

SEQ ID NO: 2030247 - RNA, 22 nt, Homo sapiens
guggagaugcggaaagcccuga

SEQ ID NO: 2030248 - RNA, 17 nt, Homo sapiens
ucgcuucacggacagga

SEQ ID NO: 2030249 - RNA, 15 nt, Homo sapiens
acugcgguauacauu

SEQ ID NO: 2030250 - RNA, 14 nt, Homo sapiens
caaagggaugagcc

SEQ ID NO: 2030251 - RNA, 17 nt, Homo sapiens
accagagccguuacuac

SEQ ID NO: 2030252 - RNA, 18 nt, Homo sapiens
caacacccaaguugaaga

SEQ ID NO: 2030253 - RNA, 23 nt, Homo sapiens
ucccagcagcccuaaggaucucu

SEQ ID NO: 2030254 - RNA, 20 nt, Homo sapiens
cccauggcauggguggaauu

SEQ ID NO: 2030255 - RNA, 14 nt, Homo sapiens
cugaggugcaaagg

SEQ ID NO: 2030256 - RNA, 15 nt, Homo sapiens
ucccaaauacauuaa

SEQ ID NO: 2030257 - RNA, 14 nt, Homo sapiens
uaauuuuguuguuu

SEQ ID NO: 2030258 - RNA, 13 nt, Homo sapiens
ugugugacauucc

SEQ ID NO: 2030259 - RNA, 22 nt, Homo sapiens
uagauaaaaaccugaacuuuca

SEQ ID NO: 2030260 - RNA, 18 nt, Homo sapiens
augcuuuugcuugcaaug

SEQ ID NO: 2030261 - RNA, 17 nt, Homo sapiens
auguuugucucauccca

SEQ ID NO: 2030262 - RNA, 18 nt, Homo sapiens
cuaauauaauagaugaca

SEQ ID NO: 2030263 - RNA, 21 nt, Homo sapiens
ccaucaguuagagcugacaca

SEQ ID NO: 2030264 - RNA, 17 nt, Homo sapiens
uaaucucacauucauua

SEQ ID NO: 2030265 - RNA, 16 nt, Homo sapiens
agugugucugcugagu

SEQ ID NO: 2030266 - RNA, 21 nt, Homo sapiens
gaagaucauauacgugaaaau

SEQ ID NO: 2030267 - RNA, 15 nt, Homo sapiens
ggcaagagaauuacu

SEQ ID NO: 2030268 - RNA, 20 nt, Homo sapiens
ucaccagucugucuacugug

SEQ ID NO: 2030269 - RNA, 15 nt, Homo sapiens
cugcaauaauaucaa

SEQ ID NO: 2030270 - RNA, 22 nt, Homo sapiens
aauaccacagcagagaauaaaa

SEQ ID NO: 2030271 - RNA, 19 nt, Homo sapiens
cuuaagccaaacucaggcc

SEQ ID NO: 2030272 - RNA, 20 nt, Homo sapiens
gcuaauacccaguuacuuau

SEQ ID NO: 2030273 - RNA, 14 nt, Homo sapiens
agcaccauugcacu

SEQ ID NO: 2030274 - RNA, 13 nt, Homo sapiens
uucauaccuguac

SEQ ID NO: 2030275 - RNA, 14 nt, Homo sapiens
cacacacacaguuu

SEQ ID NO: 2030276 - RNA, 16 nt, Homo sapiens
uauaaagucagugacg

SEQ ID NO: 2030277 - RNA, 21 nt, Homo sapiens
uuucuugacaaaaccuaacuu

SEQ ID NO: 2030278 - RNA, 14 nt, Homo sapiens
caugcaagugagaa

SEQ ID NO: 2030279 - RNA, 22 nt, Homo sapiens
ugcaaaucacucugcaauggaa

SEQ ID NO: 2030280 - RNA, 17 nt, Homo sapiens
uuuaucaugaagcacau

SEQ ID NO: 2030281 - RNA, 17 nt, Homo sapiens
ggcuaguaaaagccauc

SEQ ID NO: 2030282 - RNA, 16 nt, Homo sapiens
cccagccccaggccug

SEQ ID NO: 2030283 - RNA, 12 nt, Homo sapiens
ugucacugccaa

SEQ ID NO: 2030284 - RNA, 18 nt, Homo sapiens
uagaaauguaaacugcca

SEQ ID NO: 2030285 - RNA, 14 nt, Homo sapiens
agagacuagacaaa

SEQ ID NO: 2030286 - RNA, 17 nt, Homo sapiens
ggcccaucuuacuggaa

SEQ ID NO: 2030287 - RNA, 22 nt, Homo sapiens
uucucaagcugagauugagcag

SEQ ID NO: 2030288 - RNA, 13 nt, Homo sapiens
acaucaaugauga

SEQ ID NO: 2030289 - RNA, 13 nt, Homo sapiens
gagugagacucca

SEQ ID NO: 2030290 - RNA, 13 nt, Homo sapiens
gagcaagacucug

SEQ ID NO: 2030291 - RNA, 22 nt, Homo sapiens
ccuguagucccagcuacuugag

SEQ ID NO: 2030292 - RNA, 17 nt, Homo sapiens
auauugucugucucuau

SEQ ID NO: 2030293 - RNA, 16 nt, Homo sapiens
gucagcacuagaucau

SEQ ID NO: 2030294 - RNA, 14 nt, Homo sapiens
ucauuaucuaauga

SEQ ID NO: 2030295 - RNA, 14 nt, Homo sapiens
uaagucucucaggc

SEQ ID NO: 2030296 - RNA, 14 nt, Homo sapiens
cagagcagaaccaa

SEQ ID NO: 2030297 - RNA, 20 nt, Homo sapiens
cacccugggcaacaugauga

SEQ ID NO: 2030298 - RNA, 19 nt, Homo sapiens
gacacauuggaaugccuug

SEQ ID NO: 2030299 - RNA, 18 nt, Homo sapiens
ucugguauucacagaaag

SEQ ID NO: 2030300 - RNA, 19 nt, Homo sapiens
guuucacccuuaacccaag

SEQ ID NO: 2030301 - RNA, 14 nt, Homo sapiens
aaugaccauguuau

SEQ ID NO: 2030302 - RNA, 15 nt, Homo sapiens
ccuaccaaaauggaa

SEQ ID NO: 2030303 - RNA, 23 nt, Homo sapiens
agaaggcuauguaaacaaaccac

SEQ ID NO: 2030304 - RNA, 14 nt, Homo sapiens
caguuauaaaguca

SEQ ID NO: 2030305 - RNA, 20 nt, Homo sapiens
ccaaaccugucuuggggcca

SEQ ID NO: 2030306 - RNA, 19 nt, Homo sapiens
agauuauggaugauuaaau

SEQ ID NO: 2030307 - RNA, 14 nt, Homo sapiens
aaaaaccacagaua

SEQ ID NO: 2030308 - RNA, 23 nt, Homo sapiens
ccaccuaguggcuguccagugcc

SEQ ID NO: 2030309 - RNA, 11 nt, Homo sapiens
acacagugauu

SEQ ID NO: 2030310 - RNA, 17 nt, Homo sapiens
uccuagaauggaugugc

SEQ ID NO: 2030311 - RNA, 19 nt, Homo sapiens
ucccugggggaagcccugg

SEQ ID NO: 2030312 - RNA, 18 nt, Homo sapiens
acauuuacacauucucac

SEQ ID NO: 2030313 - RNA, 17 nt, Homo sapiens
auaauauugauuccuca

SEQ ID NO: 2030314 - RNA, 22 nt, Homo sapiens
ugaauguuaaacuacucuugaa

SEQ ID NO: 2030315 - RNA, 13 nt, Homo sapiens
aacaugacauuua

SEQ ID NO: 2030316 - RNA, 16 nt, Homo sapiens
aggucauaguuacuua

SEQ ID NO: 2030317 - RNA, 21 nt, Homo sapiens
ucaagcaguuauuugauuugu

SEQ ID NO: 2030318 - RNA, 15 nt, Homo sapiens
uaggcauacuuuuca

SEQ ID NO: 2030319 - RNA, 18 nt, Homo sapiens
aagaaugaaacaauccaa

SEQ ID NO: 2030320 - RNA, 19 nt, Homo sapiens
caaguuacaccuccacuca

SEQ ID NO: 2030321 - RNA, 22 nt, Homo sapiens
gacagugauuuucaaaaccagc

SEQ ID NO: 2030322 - RNA, 22 nt, Homo sapiens
aaauauccaagauuuaaaugcc

SEQ ID NO: 2030323 - RNA, 17 nt, Homo sapiens
agcagcuuuagcaaaga

SEQ ID NO: 2030324 - RNA, 18 nt, Homo sapiens
uagaaaagauugggucua

SEQ ID NO: 2030325 - RNA, 23 nt, Homo sapiens
ccaaagagcugccuaagaggcaa

SEQ ID NO: 2030326 - RNA, 15 nt, Homo sapiens
ugacuuccacaccua

SEQ ID NO: 2030327 - RNA, 22 nt, Homo sapiens
ugaaguuuauuuucuauuuuag

SEQ ID NO: 2030328 - RNA, 12 nt, Homo sapiens
auaauuguguac

SEQ ID NO: 2030329 - RNA, 12 nt, Homo sapiens
gugguccagcuc

SEQ ID NO: 2030330 - RNA, 19 nt, Homo sapiens
ccagccgcucuccugccac

SEQ ID NO: 2030331 - RNA, 14 nt, Homo sapiens
ccucaguccacugc

SEQ ID NO: 2030332 - RNA, 19 nt, Homo sapiens
acaaauaaugaacagcaga

SEQ ID NO: 2030333 - RNA, 18 nt, Homo sapiens
ccuaacuuaacauugcau

SEQ ID NO: 2030334 - RNA, 17 nt, Homo sapiens
cuguguaaccuccacag

SEQ ID NO: 2030335 - RNA, 17 nt, Homo sapiens
uaaccccuaugaacucu

SEQ ID NO: 2030336 - RNA, 16 nt, Homo sapiens
uagaagcugucuaggu

SEQ ID NO: 2030337 - RNA, 20 nt, Homo sapiens
ugguugggguggggcaggau

SEQ ID NO: 2030338 - RNA, 18 nt, Homo sapiens
cucucagagcaucuggcu

SEQ ID NO: 2030339 - RNA, 13 nt, Homo sapiens
gacagcucuccaa

SEQ ID NO: 2030340 - RNA, 19 nt, Homo sapiens
gcugccucuuggcuucuca

SEQ ID NO: 2030341 - RNA, 16 nt, Homo sapiens
ugcucaaaaucuuucc

SEQ ID NO: 2030342 - RNA, 15 nt, Homo sapiens
gugcugcucuaagca

SEQ ID NO: 2030343 - RNA, 18 nt, Homo sapiens
uugcugauaccauaugaa

SEQ ID NO: 2030344 - RNA, 22 nt, Homo sapiens
uaugugugccagcugugugaga

SEQ ID NO: 2030345 - RNA, 16 nt, Homo sapiens
ggaaaagauacccaaa

SEQ ID NO: 2030346 - RNA, 16 nt, Homo sapiens
uccguuccucauccac

SEQ ID NO: 2030347 - RNA, 15 nt, Homo sapiens
ccaaagguagaacuu

SEQ ID NO: 2030348 - RNA, 14 nt, Homo sapiens
cuggcacuggacuu

SEQ ID NO: 2030349 - RNA, 22 nt, Homo sapiens
ugugauuuugagcaaaccacau

SEQ ID NO: 2030350 - RNA, 21 nt, Homo sapiens
ugaaagauguuuguacaauga

SEQ ID NO: 2030351 - RNA, 21 nt, Homo sapiens
cugccccuaacuccugccuau

SEQ ID NO: 2030352 - RNA, 18 nt, Homo sapiens
aaaaauguuugaguauuc

SEQ ID NO: 2030353 - RNA, 15 nt, Homo sapiens
auuuuagcacaaaga

SEQ ID NO: 2030354 - RNA, 23 nt, Homo sapiens
aagaaauuuaauguuucucugga

SEQ ID NO: 2030355 - RNA, 19 nt, Homo sapiens
uggaaccacuagaggaaua

SEQ ID NO: 2030356 - RNA, 23 nt, Homo sapiens
uaauucuccugacuguucuuccc

SEQ ID NO: 2030357 - RNA, 12 nt, Homo sapiens
gacaguaccuga

SEQ ID NO: 2030358 - RNA, 14 nt, Homo sapiens
aagccaaguguccu

SEQ ID NO: 2030359 - RNA, 17 nt, Homo sapiens
agacacuuuaccaggag

SEQ ID NO: 2030360 - RNA, 20 nt, Homo sapiens
cagccuuuggucuccuggau

SEQ ID NO: 2030361 - RNA, 17 nt, Homo sapiens
aauaauaaagcauuuau

SEQ ID NO: 2030362 - RNA, 10 nt, Homo sapiens
cucucaggug

SEQ ID NO: 2030363 - RNA, 15 nt, Homo sapiens
guuuugagaccagaa

SEQ ID NO: 2030364 - RNA, 14 nt, Homo sapiens
caaauguccuccag

SEQ ID NO: 2030365 - RNA, 13 nt, Homo sapiens
cauggacaagguc

SEQ ID NO: 2030366 - RNA, 21 nt, Homo sapiens
aagugguccagaaacaaaaag

SEQ ID NO: 2030367 - RNA, 11 nt, Homo sapiens
aaagugucuug

SEQ ID NO: 2030368 - RNA, 11 nt, Homo sapiens
gcuaugcaaau

SEQ ID NO: 2030369 - RNA, 20 nt, Homo sapiens
aaacacauguuuuuauacaa

SEQ ID NO: 2030370 - RNA, 14 nt, Homo sapiens
ucuucugacccagg

SEQ ID NO: 2030371 - RNA, 19 nt, Homo sapiens
uauugaaagccaacaacuc

SEQ ID NO: 2030372 - RNA, 20 nt, Homo sapiens
auacugguuuauggaacuuu

SEQ ID NO: 2030373 - RNA, 14 nt, Homo sapiens
uacuguuacugugu

SEQ ID NO: 2030374 - RNA, 21 nt, Homo sapiens
gcaccagcccagaagugcaga

SEQ ID NO: 2030375 - RNA, 18 nt, Homo sapiens
accuguaaagugccuuac

SEQ ID NO: 2030376 - RNA, 16 nt, Homo sapiens
cagacuguaggauuug

SEQ ID NO: 2030377 - RNA, 19 nt, Homo sapiens
gaaggguggaugugcugga

SEQ ID NO: 2030378 - RNA, 16 nt, Homo sapiens
uugugugaacuuggaa

SEQ ID NO: 2030379 - RNA, 23 nt, Homo sapiens
gugcugcagauuugauauuugca

SEQ ID NO: 2030380 - RNA, 15 nt, Homo sapiens
aucuuaucaacuuac

SEQ ID NO: 2030381 - RNA, 17 nt, Homo sapiens
uuugcagaaaucacaau

SEQ ID NO: 2030382 - RNA, 18 nt, Homo sapiens
ugaaacccauuuacuuag

SEQ ID NO: 2030383 - RNA, 20 nt, Homo sapiens
agauguaaguauuaagaaua

SEQ ID NO: 2030384 - RNA, 22 nt, Homo sapiens
gcacagcucccggcgggugcuc

SEQ ID NO: 2030385 - RNA, 17 nt, Homo sapiens
caguaacugaguguggc

SEQ ID NO: 2030386 - RNA, 23 nt, Homo sapiens
auuugucccagccuggggcuccc

SEQ ID NO: 2030387 - RNA, 14 nt, Homo sapiens
acaugaccaaaaac

SEQ ID NO: 2030388 - RNA, 16 nt, Homo sapiens
gauggacuuggcuuca

SEQ ID NO: 2030389 - RNA, 16 nt, Homo sapiens
aucucuuuaaccuaag

SEQ ID NO: 2030390 - RNA, 19 nt, Homo sapiens
cuccagaccucccagagag

SEQ ID NO: 2030391 - RNA, 20 nt, Homo sapiens
uuccucgugggucccagaga

SEQ ID NO: 2030392 - RNA, 12 nt, Homo sapiens
uaauaggccaug

SEQ ID NO: 2030393 - RNA, 17 nt, Homo sapiens
acgcacccccacugcug

SEQ ID NO: 2030394 - RNA, 14 nt, Homo sapiens
gcuuguguguuuca

SEQ ID NO: 2030395 - RNA, 21 nt, Homo sapiens
ccuccccauguacccaaggaa

SEQ ID NO: 2030396 - RNA, 20 nt, Homo sapiens
auauuuuguucugcaaauua

SEQ ID NO: 2030397 - RNA, 24 nt, Homo sapiens
aaggaugacuuuuuuucugauuca

SEQ ID NO: 2030398 - RNA, 12 nt, Homo sapiens
aagugagcagag

SEQ ID NO: 2030399 - RNA, 14 nt, Homo sapiens
cuuauucucuguag

SEQ ID NO: 2030400 - RNA, 18 nt, Homo sapiens
cauguuuuuucugcaaug

SEQ ID NO: 2030401 - RNA, 14 nt, Homo sapiens
gcuuuaugcaaaua

SEQ ID NO: 2030402 - RNA, 15 nt, Homo sapiens
ugcggccugagauau

SEQ ID NO: 2030403 - RNA, 18 nt, Homo sapiens
gccuucugccugcugacc

SEQ ID NO: 2030404 - RNA, 16 nt, Homo sapiens
aucaauacagcuucau

SEQ ID NO: 2030405 - RNA, 17 nt, Homo sapiens
aucuacucauugucuca

SEQ ID NO: 2030406 - RNA, 20 nt, Homo sapiens
ccugauaaacagaguaacug

SEQ ID NO: 2030407 - RNA, 23 nt, Homo sapiens
ugcuuugcuggaguccuguucuc

SEQ ID NO: 2030408 - RNA, 16 nt, Homo sapiens
cuucugggcacagugg

SEQ ID NO: 2030409 - RNA, 20 nt, Homo sapiens
cuauucuuaagcacuuugaa

SEQ ID NO: 2030410 - RNA, 16 nt, Homo sapiens
gaucugcugucagucu

SEQ ID NO: 2030411 - RNA, 16 nt, Homo sapiens
uguaaaagacagugua

SEQ ID NO: 2030412 - RNA, 19 nt, Homo sapiens
cucaacaaagaagaaccau

SEQ ID NO: 2030413 - RNA, 15 nt, Homo sapiens
uauuuaaguauucaa

SEQ ID NO: 2030414 - RNA, 14 nt, Homo sapiens
caccaaauagcuuu

SEQ ID NO: 2030415 - RNA, 20 nt, Homo sapiens
cagcagauccaccugcacaa

SEQ ID NO: 2030416 - RNA, 17 nt, Homo sapiens
agagggcugccuuugga

SEQ ID NO: 2030417 - RNA, 19 nt, Homo sapiens
acauuaugugugcaugugu

SEQ ID NO: 2030418 - RNA, 15 nt, Homo sapiens
acuacaaugauggua

SEQ ID NO: 2030419 - RNA, 23 nt, Homo sapiens
uaaagaaaaaugcaaucaggauu

SEQ ID NO: 2030420 - RNA, 18 nt, Homo sapiens
caguuauaaauacauaua

SEQ ID NO: 2030421 - RNA, 17 nt, Homo sapiens
accauuuccccuguggu

SEQ ID NO: 2030422 - RNA, 22 nt, Homo sapiens
uauuaacuuuuaauggugaugg

SEQ ID NO: 2030423 - RNA, 21 nt, Homo sapiens
acuacacagaaucuccugaua

SEQ ID NO: 2030424 - RNA, 17 nt, Homo sapiens
ucaacaggcccagggag

SEQ ID NO: 2030425 - RNA, 15 nt, Homo sapiens
aguucaacuguauag

SEQ ID NO: 2030426 - RNA, 20 nt, Homo sapiens
aguuuuaaacaaaugugaua

SEQ ID NO: 2030427 - RNA, 14 nt, Homo sapiens
uugacaacacagcc

SEQ ID NO: 2030428 - RNA, 16 nt, Homo sapiens
acaaguaugaaucuag

SEQ ID NO: 2030429 - RNA, 22 nt, Homo sapiens
acgcaggccccucuccuccgug

SEQ ID NO: 2030430 - RNA, 18 nt, Homo sapiens
caugugcugcuguggcau

SEQ ID NO: 2030431 - RNA, 23 nt, Homo sapiens
gaggagcaggugucccugagaac

SEQ ID NO: 2030432 - RNA, 18 nt, Homo sapiens
cauagagggcuccucuca

SEQ ID NO: 2030433 - RNA, 17 nt, Homo sapiens
cuaugcugcaauacauu

SEQ ID NO: 2030434 - RNA, 20 nt, Homo sapiens
gcuuugaaaagucacuuacu

SEQ ID NO: 2030435 - RNA, 13 nt, Homo sapiens
cugaccugucuca

SEQ ID NO: 2030436 - RNA, 16 nt, Homo sapiens
uuacauuaacauuuag

SEQ ID NO: 2030437 - RNA, 14 nt, Homo sapiens
ucacuggacugcau

SEQ ID NO: 2030438 - RNA, 13 nt, Homo sapiens
uucuccugccuca

SEQ ID NO: 2030439 - RNA, 19 nt, Homo sapiens
acauugaguuggaaucacu

SEQ ID NO: 2030440 - RNA, 20 nt, Homo sapiens
uaaccuauuuccacauucuc

SEQ ID NO: 2030441 - RNA, 14 nt, Homo sapiens
aguuaaugaaggug

SEQ ID NO: 2030442 - RNA, 17 nt, Homo sapiens
cacuuuaaaacacucuu

SEQ ID NO: 2030443 - RNA, 20 nt, Homo sapiens
gccagaaucuucguccugcc

SEQ ID NO: 2030444 - RNA, 19 nt, Homo sapiens
agaauuucccaaagcagug

SEQ ID NO: 2030445 - RNA, 20 nt, Homo sapiens
aggcaggaggaucacuugag

SEQ ID NO: 2030446 - RNA, 20 nt, Homo sapiens
aguggggcaaugacuuuccu

SEQ ID NO: 2030447 - RNA, 22 nt, Homo sapiens
aucagcaucacccgggaacuuu

SEQ ID NO: 2030448 - RNA, 19 nt, Homo sapiens
agcauucugccuaacagaa

SEQ ID NO: 2030449 - RNA, 20 nt, Homo sapiens
cccagggccugcaggaccug

SEQ ID NO: 2030450 - RNA, 21 nt, Homo sapiens
aggccagagggagugacagag

SEQ ID NO: 2030451 - RNA, 22 nt, Homo sapiens
agucucagagacuauuuagaca

SEQ ID NO: 2030452 - RNA, 12 nt, Homo sapiens
cagaacugaaga

SEQ ID NO: 2030453 - RNA, 13 nt, Homo sapiens
ucaaaacuuucag

SEQ ID NO: 2030454 - RNA, 14 nt, Homo sapiens
gagugcaccaaaga

SEQ ID NO: 2030455 - RNA, 17 nt, Homo sapiens
accaccuauucugaguu

SEQ ID NO: 2030456 - RNA, 21 nt, Homo sapiens
cccaguucaucaccauuuccu

SEQ ID NO: 2030457 - RNA, 22 nt, Homo sapiens
cugacuaauuuuguaguuuuag

SEQ ID NO: 2030458 - RNA, 18 nt, Homo sapiens
cacagauggucacacaga

SEQ ID NO: 2030459 - RNA, 22 nt, Homo sapiens
acuuguguccccaccucaggcu

SEQ ID NO: 2030460 - RNA, 13 nt, Homo sapiens
caacagcuacaac

SEQ ID NO: 2030461 - RNA, 19 nt, Homo sapiens
uuguuugcauaggugaucu

SEQ ID NO: 2030462 - RNA, 12 nt, Homo sapiens
acugacuuucuc

SEQ ID NO: 2030463 - RNA, 22 nt, Homo sapiens
augccagggcgcacuuuccacu

SEQ ID NO: 2030464 - RNA, 17 nt, Homo sapiens
agcuccuguugucauga

SEQ ID NO: 2030465 - RNA, 15 nt, Homo sapiens
cacucaggugcugaa

SEQ ID NO: 2030466 - RNA, 22 nt, Homo sapiens
aaacagcguaacggagggugaa

SEQ ID NO: 2030467 - RNA, 13 nt, Homo sapiens
cugcuucauugac

SEQ ID NO: 2030468 - RNA, 13 nt, Homo sapiens
gcuccaguuccag

SEQ ID NO: 2030469 - RNA, 19 nt, Homo sapiens
acucaaaucgaauagggaa

SEQ ID NO: 2030470 - RNA, 13 nt, Homo sapiens
acauugcuagacg

SEQ ID NO: 2030471 - RNA, 12 nt, Homo sapiens
ugacgcuggaag

SEQ ID NO: 2030472 - RNA, 16 nt, Homo sapiens
cauaacuucuuacuag

SEQ ID NO: 2030473 - RNA, 13 nt, Homo sapiens
aauaugucuuucu

SEQ ID NO: 2030474 - RNA, 14 nt, Homo sapiens
ucaacuugcaauuu

SEQ ID NO: 2030475 - RNA, 21 nt, Homo sapiens
auuuuauuuugcugaguuguu

SEQ ID NO: 2030476 - RNA, 14 nt, Homo sapiens
cuaaugacccagau

SEQ ID NO: 2030477 - RNA, 16 nt, Homo sapiens
cagauauagcauuaau

SEQ ID NO: 2030478 - RNA, 22 nt, Homo sapiens
ugaagaauuauucagugaauuu

SEQ ID NO: 2030479 - RNA, 16 nt, Homo sapiens
gacccaacccaugccc

SEQ ID NO: 2030480 - RNA, 16 nt, Homo sapiens
acuccugccaguugaa

SEQ ID NO: 2030481 - RNA, 17 nt, Homo sapiens
agcaugcugcuuugcca

SEQ ID NO: 2030482 - RNA, 18 nt, Homo sapiens
uggcaaaaccaguagcuu

SEQ ID NO: 2030483 - RNA, 20 nt, Homo sapiens
gcaagaccacgucucuaaau

SEQ ID NO: 2030484 - RNA, 21 nt, Homo sapiens
cuaggacuacagacaugugca

SEQ ID NO: 2030485 - RNA, 17 nt, Homo sapiens
gaaaaauaucuuggccu

SEQ ID NO: 2030486 - RNA, 22 nt, Homo sapiens
caagacuacuggacuucuauca

SEQ ID NO: 2030487 - RNA, 22 nt, Homo sapiens
uuuugaguuucauguugguuua

SEQ ID NO: 2030488 - RNA, 22 nt, Homo sapiens
aauuuagcaaccuagaaacaca

SEQ ID NO: 2030489 - RNA, 12 nt, Homo sapiens
agagacaugaau

SEQ ID NO: 2030490 - RNA, 14 nt, Homo sapiens
uucaauuuauaccu

SEQ ID NO: 2030491 - RNA, 16 nt, Homo sapiens
uaaacuuuaucacuua

SEQ ID NO: 2030492 - RNA, 17 nt, Homo sapiens
gcugccugagucgugac

SEQ ID NO: 2030493 - RNA, 14 nt, Homo sapiens
agcgugaguggugg

SEQ ID NO: 2030494 - RNA, 13 nt, Homo sapiens
uggccuacaguca

SEQ ID NO: 2030495 - RNA, 14 nt, Homo sapiens
aaaaucaaguucua

SEQ ID NO: 2030496 - RNA, 19 nt, Homo sapiens
auaccuuauuaacaaaaua

SEQ ID NO: 2030497 - RNA, 17 nt, Homo sapiens
ucucuccaaaaaugcac

SEQ ID NO: 2030498 - RNA, 22 nt, Homo sapiens
cucaguggaucacacacaugga

SEQ ID NO: 2030499 - RNA, 18 nt, Homo sapiens
cccuuaagcaugcuucua

SEQ ID NO: 2030500 - RNA, 14 nt, Homo sapiens
caggcucgucauug

SEQ ID NO: 2030501 - RNA, 23 nt, Homo sapiens
aacccccagaccauacugacuca

SEQ ID NO: 2030502 - RNA, 15 nt, Homo sapiens
cuggggaucuugccc

SEQ ID NO: 2030503 - RNA, 21 nt, Homo sapiens
ugccuggcuucuuucucucag

SEQ ID NO: 2030504 - RNA, 13 nt, Homo sapiens
uuuugucuaugaa

SEQ ID NO: 2030505 - RNA, 15 nt, Homo sapiens
cagagagcggucuca

SEQ ID NO: 2030506 - RNA, 12 nt, Homo sapiens
ucaggguggcug

SEQ ID NO: 2030507 - RNA, 19 nt, Homo sapiens
auucuccccugauuggaau

SEQ ID NO: 2030508 - RNA, 18 nt, Homo sapiens
ugugaaugggcuuucaua

SEQ ID NO: 2030509 - RNA, 23 nt, Homo sapiens
uggcucagcucggggagccuuag

SEQ ID NO: 2030510 - RNA, 13 nt, Homo sapiens
aaaccacagucag

SEQ ID NO: 2030511 - RNA, 18 nt, Homo sapiens
cuguaaugguugggacca

SEQ ID NO: 2030512 - RNA, 12 nt, Homo sapiens
auugcacuggaa

SEQ ID NO: 2030513 - RNA, 14 nt, Homo sapiens
cuguguauacauau

SEQ ID NO: 2030514 - RNA, 16 nt, Homo sapiens
ccauguaaauugcaaa

SEQ ID NO: 2030515 - RNA, 13 nt, Homo sapiens
ugggaggugagcu

SEQ ID NO: 2030516 - RNA, 23 nt, Homo sapiens
ucaguuauuuuuugaauaauaac

SEQ ID NO: 2030517 - RNA, 18 nt, Homo sapiens
agaacaauguuucuucag

SEQ ID NO: 2030518 - RNA, 17 nt, Homo sapiens
cucgcacacacagugau

SEQ ID NO: 2030519 - RNA, 22 nt, Homo sapiens
cuauuuauuuauuuauucauua

SEQ ID NO: 2030520 - RNA, 14 nt, Homo sapiens
uuuauguacuaaau

SEQ ID NO: 2030521 - RNA, 18 nt, Homo sapiens
cagggcgucccugacaga

SEQ ID NO: 2030522 - RNA, 19 nt, Homo sapiens
aaggauuuuaaaugcugua

SEQ ID NO: 2030523 - RNA, 17 nt, Homo sapiens
cuaauauaagugaagga

SEQ ID NO: 2030524 - RNA, 14 nt, Homo sapiens
uuuugaaggcaaaa

SEQ ID NO: 2030525 - RNA, 18 nt, Homo sapiens
acuucuauccuguuaaca

SEQ ID NO: 2030526 - RNA, 16 nt, Homo sapiens
ccaguccgccaaacac

SEQ ID NO: 2030527 - RNA, 11 nt, Homo sapiens
auccugaacau

SEQ ID NO: 2030528 - RNA, 21 nt, Homo sapiens
aaugauacgauuaugcccaau

SEQ ID NO: 2030529 - RNA, 14 nt, Homo sapiens
ggauggaagugucu

SEQ ID NO: 2030530 - RNA, 19 nt, Homo sapiens
agucugcaucaucaucaca

SEQ ID NO: 2030531 - RNA, 19 nt, Homo sapiens
aggaauccuggauuuugcc

SEQ ID NO: 2030532 - RNA, 16 nt, Homo sapiens
acuaauugacuugcaa

SEQ ID NO: 2030533 - RNA, 22 nt, Homo sapiens
acuaagggcaggaagacuucca

SEQ ID NO: 2030534 - RNA, 23 nt, Homo sapiens
aauguaugugcacugucacuuug

SEQ ID NO: 2030535 - RNA, 18 nt, Homo sapiens
aauauuugcugacagcug

SEQ ID NO: 2030536 - RNA, 22 nt, Homo sapiens
gccagaccaggugaccuuagau

SEQ ID NO: 2030537 - RNA, 13 nt, Homo sapiens
uccuaaccuagag

SEQ ID NO: 2030538 - RNA, 17 nt, Homo sapiens
uguggaggccucaggga

SEQ ID NO: 2030539 - RNA, 22 nt, Homo sapiens
gcacucccuaaguccacucuag

SEQ ID NO: 2030540 - RNA, 18 nt, Homo sapiens
uuaacaaccgacacuccu

SEQ ID NO: 2030541 - RNA, 21 nt, Homo sapiens
aaauaaucacacacacacuug

SEQ ID NO: 2030542 - RNA, 19 nt, Homo sapiens
agcuguuaauuugaguacu

SEQ ID NO: 2030543 - RNA, 18 nt, Homo sapiens
uuaacagacacuguaaaa

SEQ ID NO: 2030544 - RNA, 15 nt, Homo sapiens
ugauuuagugaucaa

SEQ ID NO: 2030545 - RNA, 18 nt, Homo sapiens
aauaacaaaucauuucua

SEQ ID NO: 2030546 - RNA, 14 nt, Homo sapiens
auuuugugugaugc

SEQ ID NO: 2030547 - RNA, 17 nt, Homo sapiens
cuuccaaagagucauca

SEQ ID NO: 2030548 - RNA, 16 nt, Homo sapiens
auuaacaagcucuuac

SEQ ID NO: 2030549 - RNA, 19 nt, Homo sapiens
cugaguguuauuugcacac

SEQ ID NO: 2030550 - RNA, 16 nt, Homo sapiens
uggacauagagaggga

SEQ ID NO: 2030551 - RNA, 20 nt, Homo sapiens
gaguguggcuuaguaauaga

SEQ ID NO: 2030552 - RNA, 17 nt, Homo sapiens
gauacaaaccacuguga

SEQ ID NO: 2030553 - RNA, 19 nt, Homo sapiens
aagucccuuucaaaaugga

SEQ ID NO: 2030554 - RNA, 14 nt, Homo sapiens
cuuaaaauguuaac

SEQ ID NO: 2030555 - RNA, 19 nt, Homo sapiens
ugaccuuguaccucucuuu

SEQ ID NO: 2030556 - RNA, 13 nt, Homo sapiens
acuccuccuuuau

SEQ ID NO: 2030557 - RNA, 21 nt, Homo sapiens
uagggcaccagggacagagcu

SEQ ID NO: 2030558 - RNA, 19 nt, Homo sapiens
ccacguggguccucuucaa

SEQ ID NO: 2030559 - RNA, 22 nt, Homo sapiens
caugcuuuguuuuucacauaua

SEQ ID NO: 2030560 - RNA, 14 nt, Homo sapiens
aaauuagccuugau

SEQ ID NO: 2030561 - RNA, 11 nt, Homo sapiens
ucauucacaga

SEQ ID NO: 2030562 - RNA, 20 nt, Homo sapiens
auguugagggaagcuuccau

SEQ ID NO: 2030563 - RNA, 18 nt, Homo sapiens
cgcaggcugagugcacug

SEQ ID NO: 2030564 - RNA, 22 nt, Homo sapiens
uaaugucuucacucuauacuua

SEQ ID NO: 2030565 - RNA, 20 nt, Homo sapiens
gaaccaucuucguacaugaa

SEQ ID NO: 2030566 - RNA, 22 nt, Homo sapiens
cugucaaguguuuuacuaucuc

SEQ ID NO: 2030567 - RNA, 14 nt, Homo sapiens
uaaucuguguaaac

SEQ ID NO: 2030568 - RNA, 13 nt, Homo sapiens
aaaucaagagcuu

SEQ ID NO: 2030569 - RNA, 19 nt, Homo sapiens
uuaaugaucagcuauauac

SEQ ID NO: 2030570 - RNA, 10 nt, Homo sapiens
ucaguacaac

SEQ ID NO: 2030571 - RNA, 20 nt, Homo sapiens
aagagucuggggaccagcuu

SEQ ID NO: 2030572 - RNA, 22 nt, Homo sapiens
gacgaguacucuugaacacaag

SEQ ID NO: 2030573 - RNA, 19 nt, Homo sapiens
cuuacccuaaagaucuucu

SEQ ID NO: 2030574 - RNA, 22 nt, Homo sapiens
gaauagcaauuagugauauagu

SEQ ID NO: 2030575 - RNA, 22 nt, Homo sapiens
aaccauaccacacacauuauca

SEQ ID NO: 2030576 - RNA, 17 nt, Homo sapiens
aggauuuuuauugauug

SEQ ID NO: 2030577 - RNA, 15 nt, Homo sapiens
ccagugaaaugugaa

SEQ ID NO: 2030578 - RNA, 23 nt, Homo sapiens
ugagcuccuaagcugccagccuu

SEQ ID NO: 2030579 - RNA, 19 nt, Homo sapiens
ucgggcugagaacccugcg

SEQ ID NO: 2030580 - RNA, 16 nt, Homo sapiens
cacuuccuugccaguc

SEQ ID NO: 2030581 - RNA, 20 nt, Homo sapiens
auucuaacgcaaaaauagcu

SEQ ID NO: 2030582 - RNA, 14 nt, Homo sapiens
ugcagucacuguga

SEQ ID NO: 2030583 - RNA, 16 nt, Homo sapiens
aaggaagucaccaaaa

SEQ ID NO: 2030584 - RNA, 16 nt, Homo sapiens
gaggacagcaaugcag

SEQ ID NO: 2030585 - RNA, 14 nt, Homo sapiens
aagcuccaccacuu

SEQ ID NO: 2030586 - RNA, 23 nt, Homo sapiens
ucuuugugcaguguuaguauuca

SEQ ID NO: 2030587 - RNA, 17 nt, Homo sapiens
agcuaaguacacaauaa

SEQ ID NO: 2030588 - RNA, 18 nt, Homo sapiens
ucagccucccgaguagcu

SEQ ID NO: 2030589 - RNA, 19 nt, Homo sapiens
ucaguugcaggugccaaug

SEQ ID NO: 2030590 - RNA, 21 nt, Homo sapiens
caauuuccggccaacaguuaa

SEQ ID NO: 2030591 - RNA, 13 nt, Homo sapiens
ucuagaaugucau

SEQ ID NO: 2030592 - RNA, 16 nt, Homo sapiens
acagcaacacaaagcu

SEQ ID NO: 2030593 - RNA, 19 nt, Homo sapiens
cauaaauuuaucaucucga

SEQ ID NO: 2030594 - RNA, 21 nt, Homo sapiens
aagugguauuuuccagcacuu

SEQ ID NO: 2030595 - RNA, 20 nt, Homo sapiens
gacccacaugcuccagauua

SEQ ID NO: 2030596 - RNA, 17 nt, Homo sapiens
ucuuauaacuucugaag

SEQ ID NO: 2030597 - RNA, 17 nt, Homo sapiens
uaucugugaggugcuga

SEQ ID NO: 2030598 - RNA, 18 nt, Homo sapiens
gucaauccgaaguaugag

SEQ ID NO: 2030599 - RNA, 20 nt, Homo sapiens
caaauuacuccaagguuuau

SEQ ID NO: 2030600 - RNA, 17 nt, Homo sapiens
cccauuuugagugacuc

SEQ ID NO: 2030601 - RNA, 23 nt, Homo sapiens
uauuucaaauuguuuucagugaa

SEQ ID NO: 2030602 - RNA, 17 nt, Homo sapiens
uacaauccuguuuauaa

SEQ ID NO: 2030603 - RNA, 19 nt, Homo sapiens
caaacccagacaaccaaaa

SEQ ID NO: 2030604 - RNA, 15 nt, Homo sapiens
aguacuuaacauaca

SEQ ID NO: 2030605 - RNA, 14 nt, Homo sapiens
ugaucuggcccaag

SEQ ID NO: 2030606 - RNA, 16 nt, Homo sapiens
ccaggauggcgcagga

SEQ ID NO: 2030607 - RNA, 20 nt, Homo sapiens
aguacaaaacaaucucucaa

SEQ ID NO: 2030608 - RNA, 19 nt, Homo sapiens
cucugaagucacaucacag

SEQ ID NO: 2030609 - RNA, 21 nt, Homo sapiens
agcuguugaugggaugauuga

SEQ ID NO: 2030610 - RNA, 22 nt, Homo sapiens
cuuuccuuuacuccuggcucaa

SEQ ID NO: 2030611 - RNA, 15 nt, Homo sapiens
uaaaauaacuaacaa

SEQ ID NO: 2030612 - RNA, 23 nt, Homo sapiens
ucccacccccacccccagcucaa

SEQ ID NO: 2030613 - RNA, 15 nt, Homo sapiens
gagggacccuuccaa

SEQ ID NO: 2030614 - RNA, 16 nt, Homo sapiens
uagauuucuacauuaa

SEQ ID NO: 2030615 - RNA, 15 nt, Homo sapiens
ugcccuagcaguuug

SEQ ID NO: 2030616 - RNA, 15 nt, Homo sapiens
uucccuuccacugcc

SEQ ID NO: 2030617 - RNA, 20 nt, Homo sapiens
uuuacauacacuguauguua
